United States Patent 7,901,882 (ANALYSIS OF METHYLATION USING NUCLEIC ACID ARRAYS) - sequence listing, part 2

SEQ ID NO: 38682 - DNA, 25 bp, Homo sapien
cacccgaatcccaggggcaggtaga

SEQ ID NO: 38683 - DNA, 25 bp, Homo sapien
tgcctatatataagcgcccggagct

SEQ ID NO: 38684 - DNA, 25 bp, Homo sapien
cggggtcactcctggtcgatttaga

SEQ ID NO: 38685 - DNA, 25 bp, Homo sapien
cggcgcactcacgtgagtctcgggc

SEQ ID NO: 38686 - DNA, 25 bp, Homo sapien
cactcctggtcgatttagagggacg

SEQ ID NO: 38687 - DNA, 25 bp, Homo sapien
tgcgggctcagccagtagtcgccca

SEQ ID NO: 38688 - DNA, 25 bp, Homo sapien
tcagccagtagtcgcccaggctgcg

SEQ ID NO: 38689 - DNA, 25 bp, Homo sapien
agaaacacaactcctggtccaggcg

SEQ ID NO: 38690 - DNA, 25 bp, Homo sapien
acaactcctggtccaggcggtgcgg

SEQ ID NO: 38691 - DNA, 25 bp, Homo sapien
gaggaagttgcctccgatcggacga

SEQ ID NO: 38692 - DNA, 25 bp, Homo sapien
ggccttacctgaccgggttgtgctc

SEQ ID NO: 38693 - DNA, 25 bp, Homo sapien
agaccggtcccaggctagaagcagc

SEQ ID NO: 38694 - DNA, 25 bp, Homo sapien
agagcacgttcctcccactggagaa

SEQ ID NO: 38695 - DNA, 25 bp, Homo sapien
tcaatggggaatctccgaccctgcg

SEQ ID NO: 38696 - DNA, 25 bp, Homo sapien
gagtctccggcctcaatggggaatc

SEQ ID NO: 38697 - DNA, 25 bp, Homo sapien
ggctcctgggcgctcatgtccaagc

SEQ ID NO: 38698 - DNA, 25 bp, Homo sapien
cgcccatggcgaggtagacgtcgat

SEQ ID NO: 38699 - DNA, 25 bp, Homo sapien
agcagcgtcaggcagtggcatccag

SEQ ID NO: 38700 - DNA, 25 bp, Homo sapien
tggccacaaaaagcggagggcactc

SEQ ID NO: 38701 - DNA, 25 bp, Homo sapien
ccgagcctgtgacatccgcggagac

SEQ ID NO: 38702 - DNA, 25 bp, Homo sapien
cggaaccggacacagacgcagatct

SEQ ID NO: 38703 - DNA, 25 bp, Homo sapien
tggggacgatggaagacaagccaca

SEQ ID NO: 38704 - DNA, 25 bp, Homo sapien
aggactggcgtctgccgaatcccag

SEQ ID NO: 38705 - DNA, 25 bp, Homo sapien
gcgacctcagtgacggaaccggaca

SEQ ID NO: 38706 - DNA, 25 bp, Homo sapien
gcgtttctggccctgccagtgtctc

SEQ ID NO: 38707 - DNA, 25 bp, Homo sapien
gacaggcttcggagcatttccgggc

SEQ ID NO: 38708 - DNA, 25 bp, Homo sapien
cgcgatctgccgtcatatcagctta

SEQ ID NO: 38709 - DNA, 25 bp, Homo sapien
atatcagcttatggcgccggtcgct

SEQ ID NO: 38710 - DNA, 25 bp, Homo sapien
tgcccagctgctaggacagtttgca

SEQ ID NO: 38711 - DNA, 25 bp, Homo sapien
atggagagacttcagcgcctgggac

SEQ ID NO: 38712 - DNA, 25 bp, Homo sapien
tcgcggtagcatacggatccgagtc

SEQ ID NO: 38713 - DNA, 25 bp, Homo sapien
gtagcctggcatcccgaagactggc

SEQ ID NO: 38714 - DNA, 25 bp, Homo sapien
gcctggacttgaaggagccgaccgt

SEQ ID NO: 38715 - DNA, 25 bp, Homo sapien
cctccaccgcaaaggtactcggatg

SEQ ID NO: 38716 - DNA, 25 bp, Homo sapien
ctctttgatacgtgctcggagcctg

SEQ ID NO: 38717 - DNA, 25 bp, Homo sapien
actcgtcagagctcgccatggtcac

SEQ ID NO: 38718 - DNA, 25 bp, Homo sapien
cccgtgtgctggctgtcatcgggcc

SEQ ID NO: 38719 - DNA, 25 bp, Homo sapien
tactgcaactacacgcagtaccagc

SEQ ID NO: 38720 - DNA, 25 bp, Homo sapien
gccaaggcaggcagccgcgacatcg

SEQ ID NO: 38721 - DNA, 25 bp, Homo sapien
ggccatgaagcccagcctcatgttc

SEQ ID NO: 38722 - DNA, 25 bp, Homo sapien
gcctgggctacgacctctttgatac

SEQ ID NO: 38723 - DNA, 25 bp, Homo sapien
tgaagcccagcctcatgttcctggc

SEQ ID NO: 38724 - DNA, 25 bp, Homo sapien
gcctgcatgacatcaccactattta

SEQ ID NO: 38725 - DNA, 25 bp, Homo sapien
cccaacgcctaggagcaaaacgaca

SEQ ID NO: 38726 - DNA, 25 bp, Homo sapien
tactgacctttgacttccgacacgg

SEQ ID NO: 38727 - DNA, 25 bp, Homo sapien
ctgcccgcccaaggatccggtttgt

SEQ ID NO: 38728 - DNA, 25 bp, Homo sapien
tgtcctcaggctccaccaagcttga

SEQ ID NO: 38729 - DNA, 25 bp, Homo sapien
atcgtcattcagtcctgtcctcagg

SEQ ID NO: 38730 - DNA, 25 bp, Homo sapien
cggtggcctctatggacgatgatca

SEQ ID NO: 38731 - DNA, 25 bp, Homo sapien
tgtcactgtccgcaaacgtcgggta

SEQ ID NO: 38732 - DNA, 25 bp, Homo sapien
cacagccgggacgtgacatgcgctg

SEQ ID NO: 38733 - DNA, 25 bp, Homo sapien
agggcgatctcatcccacaatcctg

SEQ ID NO: 38734 - DNA, 25 bp, Homo sapien
taagcaaattttattaggtgaggtc

SEQ ID NO: 38735 - DNA, 25 bp, Homo sapien
tcggagatcagctgcagcgggtcct

SEQ ID NO: 38736 - DNA, 25 bp, Homo sapien
cacagggcatcggagatcagctgca

SEQ ID NO: 38737 - DNA, 25 bp, Homo sapien
ggaaaacaagggctcatcggccaca

SEQ ID NO: 38738 - DNA, 25 bp, Homo sapien
ctcatcggccacagggcatcggaga

SEQ ID NO: 38739 - DNA, 25 bp, Homo sapien
ttaggtgaggtctagatccgctccg

SEQ ID NO: 38740 - DNA, 25 bp, Homo sapien
agtcatcctccttcggaccgcttgg

SEQ ID NO: 38741 - DNA, 25 bp, Homo sapien
agcggcagcgatggccactttgtcc

SEQ ID NO: 38742 - DNA, 25 bp, Homo sapien
gctcggccacactggagaagtgcca

SEQ ID NO: 38743 - DNA, 25 bp, Homo sapien
acttccacggtgaatggtgcccagg

SEQ ID NO: 38744 - DNA, 25 bp, Homo sapien
gcgccgactacttccacggtgaatg

SEQ ID NO: 38745 - DNA, 25 bp, Homo sapien
ccagcttccctgtcattgggtgtcc

SEQ ID NO: 38746 - DNA, 25 bp, Homo sapien
gccttcagagcgcatcctccgaggg

SEQ ID NO: 38747 - DNA, 25 bp, Homo sapien
gaggattcctagcacccgggaggct

SEQ ID NO: 38748 - DNA, 25 bp, Homo sapien
ccgagcgggcgccatttgcagcctg

SEQ ID NO: 38749 - DNA, 25 bp, Homo sapien
tgcgccgcgcagagacagcagccgc

SEQ ID NO: 38750 - DNA, 25 bp, Homo sapien
ctgcagcgctgtctccgaggggttg

SEQ ID NO: 38751 - DNA, 25 bp, Homo sapien
cgctgtctccgaggggttgggaacg

SEQ ID NO: 38752 - DNA, 25 bp, Homo sapien
ctgcgccgcgcagagacagcagccg

SEQ ID NO: 38753 - DNA, 25 bp, Homo sapien
gcagctgcagcgctgtctccgaggg

SEQ ID NO: 38754 - DNA, 25 bp, Homo sapien
ggcgtgcggccctcagccgtctccc

SEQ ID NO: 38755 - DNA, 25 bp, Homo sapien
gcgccaagccgagcgggcgccattt

SEQ ID NO: 38756 - DNA, 25 bp, Homo sapien
ccttggttttatgtcaagatgcgac

SEQ ID NO: 38757 - DNA, 25 bp, Homo sapien
agcccgagtttctcggtgcagcctc

SEQ ID NO: 38758 - DNA, 25 bp, Homo sapien
cccagggcagtagcccgagtttctc

SEQ ID NO: 38759 - DNA, 25 bp, Homo sapien
tggctcccagggcagtagcccgagt

SEQ ID NO: 38760 - DNA, 25 bp, Homo sapien
tgtcaagatgcgacatctgggctta

SEQ ID NO: 38761 - DNA, 25 bp, Homo sapien
tgcagcctccatccttggttttatg

SEQ ID NO: 38762 - DNA, 25 bp, Homo sapien
gcttagaaccgagggcgaactcacc

SEQ ID NO: 38763 - DNA, 25 bp, Homo sapien
acatctgggcttagaaccgagggcg

SEQ ID NO: 38764 - DNA, 25 bp, Homo sapien
ccggccagtgtttgtttctcttcct

SEQ ID NO: 38765 - DNA, 25 bp, Homo sapien
gagtgtgcggaccaaacctctctca

SEQ ID NO: 38766 - DNA, 25 bp, Homo sapien
tcccattggctgatgttggcgcgaa

SEQ ID NO: 38767 - DNA, 25 bp, Homo sapien
ggaaacaatagaggccgcgcgcaca

SEQ ID NO: 38768 - DNA, 25 bp, Homo sapien
cggcctcgacatggcctaacagtga

SEQ ID NO: 38769 - DNA, 25 bp, Homo sapien
tcgccagttccctgggaccgatttc

SEQ ID NO: 38770 - DNA, 25 bp, Homo sapien
tccgatatcggtttctcggcctctg

SEQ ID NO: 38771 - DNA, 25 bp, Homo sapien
accgatttcggtcgcagctggcgaa

SEQ ID NO: 38772 - DNA, 25 bp, Homo sapien
agacaggcgaaagacgcccgcggtc

SEQ ID NO: 38773 - DNA, 25 bp, Homo sapien
gggcctggagctgtctttccaaacc

SEQ ID NO: 38774 - DNA, 25 bp, Homo sapien
agctgcaaccgacaccggatcccgg

SEQ ID NO: 38775 - DNA, 25 bp, Homo sapien
cgcgttattaatagccgggcccgcg

SEQ ID NO: 38776 - DNA, 25 bp, Homo sapien
ctggcggccgcgttattaatagccg

SEQ ID NO: 38777 - DNA, 25 bp, Homo sapien
cgggctgctcaaagggagccagcac

SEQ ID NO: 38778 - DNA, 25 bp, Homo sapien
ggaaagggaacccgtccagcagcac

SEQ ID NO: 38779 - DNA, 25 bp, Homo sapien
cttcctttcgtgaggtcccgttgca

SEQ ID NO: 38780 - DNA, 25 bp, Homo sapien
ctggtgctggaaagcgaagaggcca

SEQ ID NO: 38781 - DNA, 25 bp, Homo sapien
tccgcagtttccagacccagtcctg

SEQ ID NO: 38782 - DNA, 25 bp, Homo sapien
tgcgctgccttccgcagtttccaga

SEQ ID NO: 38783 - DNA, 25 bp, Homo sapien
agggctgagtccgaacacttccacc

SEQ ID NO: 38784 - DNA, 25 bp, Homo sapien
gcaggaagaagtcccgctccggcgc

SEQ ID NO: 38785 - DNA, 25 bp, Homo sapien
cgcgcaggaagaagtcccgctccgg

SEQ ID NO: 38786 - DNA, 25 bp, Homo sapien
tccgaacacttccaccctgcgctgc

SEQ ID NO: 38787 - DNA, 25 bp, Homo sapien
gccaagagggccaagggcaaaggcc

SEQ ID NO: 38788 - DNA, 25 bp, Homo sapien
cctacgggcgggcacacgtacatgt

SEQ ID NO: 38789 - DNA, 25 bp, Homo sapien
aactcacaccacaagaggaaggccc

SEQ ID NO: 38790 - DNA, 25 bp, Homo sapien
agggtccctactgcggtcgtcgcca

SEQ ID NO: 38791 - DNA, 25 bp, Homo sapien
acggagacacacgtacacggtaata

SEQ ID NO: 38792 - DNA, 25 bp, Homo sapien
ggcacacgtacatgttcgcagttta

SEQ ID NO: 38793 - DNA, 25 bp, Homo sapien
acacccactcaaatgtacggacacg

SEQ ID NO: 38794 - DNA, 25 bp, Homo sapien
ccgcaatggggaactcacaccacaa

SEQ ID NO: 38795 - DNA, 25 bp, Homo sapien
ttcgcagtttacacagtcacacgca

SEQ ID NO: 38796 - DNA, 25 bp, Homo sapien
acgcgccgagcctaagccttcctgc

SEQ ID NO: 38797 - DNA, 25 bp, Homo sapien
cgccgagcctaagccttcctgcccg

SEQ ID NO: 38798 - DNA, 25 bp, Homo sapien
ctcgatcgggccgtgcgatcttcgc

SEQ ID NO: 38799 - DNA, 25 bp, Homo sapien
cgatcgggccgtgcgatcttcgccg

SEQ ID NO: 38800 - DNA, 25 bp, Homo sapien
atcgggccgtgcgatcttcgccgcg

SEQ ID NO: 38801 - DNA, 25 bp, Homo sapien
gacggacgcgccgagcctaagcctt

SEQ ID NO: 38802 - DNA, 25 bp, Homo sapien
cggaccccagggaacgcatcctcca

SEQ ID NO: 38803 - DNA, 25 bp, Homo sapien
ccgtgcgatcttcgccgcgcgcgga

SEQ ID NO: 38804 - DNA, 25 bp, Homo sapien
taccgggatgacacctttgttggcc

SEQ ID NO: 38805 - DNA, 25 bp, Homo sapien
tggtgcacgggatgccgtacgcatc

SEQ ID NO: 38806 - DNA, 25 bp, Homo sapien
tgacacctttgttggccggtccacg

SEQ ID NO: 38807 - DNA, 25 bp, Homo sapien
attgaccgtgtctaccgggatgaca

SEQ ID NO: 38808 - DNA, 25 bp, Homo sapien
agcgccacattgaccgtgtctaccg

SEQ ID NO: 38809 - DNA, 25 bp, Homo sapien
atgctgcagcgccacattgaccgtg

SEQ ID NO: 38810 - DNA, 25 bp, Homo sapien
ctggcgctgagacagaggccatgct

SEQ ID NO: 38811 - DNA, 25 bp, Homo sapien
cgctgagacagaggccatgctgcag

SEQ ID NO: 38812 - DNA, 25 bp, Homo sapien
gggctaaatcaccaccagacgttct

SEQ ID NO: 38813 - DNA, 25 bp, Homo sapien
aggccctgcacaacactcttcagtg

SEQ ID NO: 38814 - DNA, 25 bp, Homo sapien
ctcttcagtgcaacgcctcaggctg

SEQ ID NO: 38815 - DNA, 25 bp, Homo sapien
ctcctggagaacatgtacaacctga

SEQ ID NO: 38816 - DNA, 25 bp, Homo sapien
tggacatggagtacgacctgaagct

SEQ ID NO: 38817 - DNA, 25 bp, Homo sapien
caggttcaacggcagcctcaggaca

SEQ ID NO: 38818 - DNA, 25 bp, Homo sapien
cctgaagatccgctggcacacgtct

SEQ ID NO: 38819 - DNA, 25 bp, Homo sapien
cgttctctgtctacgcagctgtgta

SEQ ID NO: 38820 - DNA, 25 bp, Homo sapien
cgggacggtttcctgccaatcactg

SEQ ID NO: 38821 - DNA, 25 bp, Homo sapien
gaggacgacccattccctggggaga

SEQ ID NO: 38822 - DNA, 25 bp, Homo sapien
aagctccctggtcgtcttgagagtc

SEQ ID NO: 38823 - DNA, 25 bp, Homo sapien
tgccaatcactgctggtttgccctc

SEQ ID NO: 38824 - DNA, 25 bp, Homo sapien
cggggcacaaccctcctagaggcgg

SEQ ID NO: 38825 - DNA, 25 bp, Homo sapien
tcacgcgagtccagccaggttgcat

SEQ ID NO: 38826 - DNA, 25 bp, Homo sapien
ttccgggtgataaggtgcagtttct

SEQ ID NO: 38827 - DNA, 25 bp, Homo sapien
aggcgcagtcgttcgcccaggcttt

SEQ ID NO: 38828 - DNA, 25 bp, Homo sapien
gcgctgtcctagtgctgagcggatg

SEQ ID NO: 38829 - DNA, 25 bp, Homo sapien
ctaggaaccgcgttcgaccgccctg

SEQ ID NO: 38830 - DNA, 25 bp, Homo sapien
ggctcaggagagagacctcttggca

SEQ ID NO: 38831 - DNA, 25 bp, Homo sapien
gagagacctcttggcactaccgtgt

SEQ ID NO: 38832 - DNA, 25 bp, Homo sapien
attccggccaccagagccgaggtgc

SEQ ID NO: 38833 - DNA, 25 bp, Homo sapien
ctgcgcagtcggtgtctccgcgtcg

SEQ ID NO: 38834 - DNA, 25 bp, Homo sapien
ggcccacgtccagggcttcccaaca

SEQ ID NO: 38835 - DNA, 25 bp, Homo sapien
ccctcgaagcgacgtgcggctcaga

SEQ ID NO: 38836 - DNA, 25 bp, Homo sapien
tgcccgctgcagatgctcatttgca

SEQ ID NO: 38837 - DNA, 25 bp, Homo sapien
aagatgccggaggacgagtcgaccc

SEQ ID NO: 38838 - DNA, 25 bp, Homo sapien
ctgagaaaatcttccgccaaatgga

SEQ ID NO: 38839 - DNA, 25 bp, Homo sapien
tggtttcgtccgtgatgaagatgcc

SEQ ID NO: 38840 - DNA, 25 bp, Homo sapien
ggcaagctgtccttggaggagttca

SEQ ID NO: 38841 - DNA, 25 bp, Homo sapien
cccaggccatttacaagatggtttc

SEQ ID NO: 38842 - DNA, 25 bp, Homo sapien
ggccaaaagcgacccgtccatcgtg

SEQ ID NO: 38843 - DNA, 25 bp, Homo sapien
gccaaatggacacaaacaacgacgg

SEQ ID NO: 38844 - DNA, 25 bp, Homo sapien
agtcgctcaccgaggcgcagacaca

SEQ ID NO: 38845 - DNA, 25 bp, Homo sapien
ctcaccgaggcgcagacacatgtcg

SEQ ID NO: 38846 - DNA, 25 bp, Homo sapien
caccgaggcgcagacacatgtcggc

SEQ ID NO: 38847 - DNA, 25 bp, Homo sapien
cgaggcgcagacacatgtcggctcc

SEQ ID NO: 38848 - DNA, 25 bp, Homo sapien
aggcgcagacacatgtcggctccgc

SEQ ID NO: 38849 - DNA, 25 bp, Homo sapien
gcagacacatgtcggctccgcgctg

SEQ ID NO: 38850 - DNA, 25 bp, Homo sapien
gacacatgtcggctccgcgctggtc

SEQ ID NO: 38851 - DNA, 25 bp, Homo sapien
gcttcagcgcggctcccgaggctgc

SEQ ID NO: 38852 - DNA, 25 bp, Homo sapien
actcggagtccttctcggagcccat

SEQ ID NO: 38853 - DNA, 25 bp, Homo sapien
ttgcgggtttccctgcttgggacac

SEQ ID NO: 38854 - DNA, 25 bp, Homo sapien
cgaagtgattataaagcctccgccc

SEQ ID NO: 38855 - DNA, 25 bp, Homo sapien
ccgaggcagagaagacgctgtgcaa

SEQ ID NO: 38856 - DNA, 25 bp, Homo sapien
tcgcttatctccaggcgcaggtagt

SEQ ID NO: 38857 - DNA, 25 bp, Homo sapien
atgggcaccctgctctcgcttatct

SEQ ID NO: 38858 - DNA, 25 bp, Homo sapien
tcgtacttgtgcataagcggcgggt

SEQ ID NO: 38859 - DNA, 25 bp, Homo sapien
cgcagcatgaactcctcgtacttgt

SEQ ID NO: 38860 - DNA, 25 bp, Homo sapien
gcatacccactctttgacaaggctg

SEQ ID NO: 38861 - DNA, 25 bp, Homo sapien
gcgataccgtgcgtttcacactgcg

SEQ ID NO: 38862 - DNA, 25 bp, Homo sapien
tgcgtttcacactgcggaacgagca

SEQ ID NO: 38863 - DNA, 25 bp, Homo sapien
agcgctttccttgggcactcgaacg

SEQ ID NO: 38864 - DNA, 25 bp, Homo sapien
ggtgccatgtgaccagcctcccttt

SEQ ID NO: 38865 - DNA, 25 bp, Homo sapien
ttctgtcaaggtcaagcatacccac

SEQ ID NO: 38866 - DNA, 25 bp, Homo sapien
tgacaaggctgcctccgaaatccct

SEQ ID NO: 38867 - DNA, 25 bp, Homo sapien
gcagctcccgcagtgttttctgtca

SEQ ID NO: 38868 - DNA, 25 bp, Homo sapien
gcaggtccagggcttctagatctcc

SEQ ID NO: 38869 - DNA, 25 bp, Homo sapien
tgagcacgacggactcttcacctta

SEQ ID NO: 38870 - DNA, 25 bp, Homo sapien
aggtccagtgcttcccaggtcaacg

SEQ ID NO: 38871 - DNA, 25 bp, Homo sapien
agttcgcacgcctcacaggtccagt

SEQ ID NO: 38872 - DNA, 25 bp, Homo sapien
taggatactcgggttctgccgctgg

SEQ ID NO: 38873 - DNA, 25 bp, Homo sapien
cggcccggatgcctttaggatactc

SEQ ID NO: 38874 - DNA, 25 bp, Homo sapien
gccgccttgaccttggagttcagca

SEQ ID NO: 38875 - DNA, 25 bp, Homo sapien
ctgcacggcgatactgaggaacttt

SEQ ID NO: 38876 - DNA, 25 bp, Homo sapien
agaatagggagagcattaacattta

SEQ ID NO: 38877 - DNA, 25 bp, Homo sapien
ggtagaggctctattactaaaggaa

SEQ ID NO: 38878 - DNA, 25 bp, Homo sapien
gcctagccaacaggtagaggctcta

SEQ ID NO: 38879 - DNA, 25 bp, Homo sapien
attctggacagacatatgcctagcc

SEQ ID NO: 38880 - DNA, 25 bp, Homo sapien
ctgggaaacatagcttttattctgg

SEQ ID NO: 38881 - DNA, 25 bp, Homo sapien
tagcagccggggtactgggaaacat

SEQ ID NO: 38882 - DNA, 25 bp, Homo sapien
ttacaatgccacgactagcagccgg

SEQ ID NO: 38883 - DNA, 25 bp, Homo sapien
taaaaagactagcagaggaggtcgc

SEQ ID NO: 38884 - DNA, 25 bp, Homo sapien
cgcagtcccgcgcaaggggcggaag

SEQ ID NO: 38885 - DNA, 25 bp, Homo sapien
ctcgcgcggaaacttcgagctgcgc

SEQ ID NO: 38886 - DNA, 25 bp, Homo sapien
gaaacttcgagctgcgcagccgccg

SEQ ID NO: 38887 - DNA, 25 bp, Homo sapien
cccagcaaagctccgctaagtgcgg

SEQ ID NO: 38888 - DNA, 25 bp, Homo sapien
aaagctccgctaagtgcggccggcg

SEQ ID NO: 38889 - DNA, 25 bp, Homo sapien
gtcgcagagctccaagaccaggtcc

SEQ ID NO: 38890 - DNA, 25 bp, Homo sapien
cgcggtcgcagagctccaagaccag

SEQ ID NO: 38891 - DNA, 25 bp, Homo sapien
gcagagctccaagaccaggtcccgg

SEQ ID NO: 38892 - DNA, 25 bp, Homo sapien
cactccctggggagacctatgggcc

SEQ ID NO: 38893 - DNA, 25 bp, Homo sapien
cctcctcggggtgttgcacaagttt

SEQ ID NO: 38894 - DNA, 25 bp, Homo sapien
tgcacaagtttcgaggtcaccggcg

SEQ ID NO: 38895 - DNA, 25 bp, Homo sapien
gccgaggatccgattcactccctgg

SEQ ID NO: 38896 - DNA, 25 bp, Homo sapien
gctgaatgctttatgtcggaatcga

SEQ ID NO: 38897 - DNA, 25 bp, Homo sapien
tgacttccagcgtgaggtagccacc

SEQ ID NO: 38898 - DNA, 25 bp, Homo sapien
gcggccctgtagttctgacttccag

SEQ ID NO: 38899 - DNA, 25 bp, Homo sapien
gccgaagccgtgtaaatgcgtttta

SEQ ID NO: 38900 - DNA, 25 bp, Homo sapien
cgtaaagtcacttccgtattcgaga

SEQ ID NO: 38901 - DNA, 25 bp, Homo sapien
cttccgtattcgagagccttctagg

SEQ ID NO: 38902 - DNA, 25 bp, Homo sapien
tctaggcttcgagccacgcgatgtc

SEQ ID NO: 38903 - DNA, 25 bp, Homo sapien
tgagaaggaacagggaagtccattg

SEQ ID NO: 38904 - DNA, 25 bp, Homo sapien
aagtccattggttgaaagacggaga

SEQ ID NO: 38905 - DNA, 25 bp, Homo sapien
gagaggcgcagctcagtcttccaac

SEQ ID NO: 38906 - DNA, 25 bp, Homo sapien
agtcttccaacctcaaccaatgtta

SEQ ID NO: 38907 - DNA, 25 bp, Homo sapien
tcttccggtagcgtaaagtcacttc

SEQ ID NO: 38908 - DNA, 25 bp, Homo sapien
aaggcaagcccacgcgagctctgca

SEQ ID NO: 38909 - DNA, 25 bp, Homo sapien
tgctccgggtggacccactgctttt

SEQ ID NO: 38910 - DNA, 25 bp, Homo sapien
tgtgatccgattcactgccactgcc

SEQ ID NO: 38911 - DNA, 25 bp, Homo sapien
cactcggtgccgtgtgatccgattc

SEQ ID NO: 38912 - DNA, 25 bp, Homo sapien
caccactgtataggccttggtcgtg

SEQ ID NO: 38913 - DNA, 25 bp, Homo sapien
tccacgaagaactcgcaggggttcc

SEQ ID NO: 38914 - DNA, 25 bp, Homo sapien
tctgcatgcggcaggaccgccagct

SEQ ID NO: 38915 - DNA, 25 bp, Homo sapien
tgcgccacgagtcacatgatgtcca

SEQ ID NO: 38916 - DNA, 25 bp, Homo sapien
agtggacgccactactgaaggcttc

SEQ ID NO: 38917 - DNA, 25 bp, Homo sapien
gacacctccacatcgaagcgctttg

SEQ ID NO: 38918 - DNA, 25 bp, Homo sapien
aaggcttcagaacccagcaccgaca

SEQ ID NO: 38919 - DNA, 25 bp, Homo sapien
atcgaagcgctttggcgagtcctgc

SEQ ID NO: 38920 - DNA, 25 bp, Homo sapien
tgcaagttgccgtaagccacaatgg

SEQ ID NO: 38921 - DNA, 25 bp, Homo sapien
gccacaatggtgcagtcgtccgaca

SEQ ID NO: 38922 - DNA, 25 bp, Homo sapien
tcgtccgacaggatcaggcgctggt

SEQ ID NO: 38923 - DNA, 25 bp, Homo sapien
gctgtactggttgccatcgtgcatc

SEQ ID NO: 38924 - DNA, 25 bp, Homo sapien
cagcagccggtgcagccgctcgaag

SEQ ID NO: 38925 - DNA, 25 bp, Homo sapien
acttaccgctcggacagtgaggcca

SEQ ID NO: 38926 - DNA, 25 bp, Homo sapien
ctgtagcgctggactttctgctcga

SEQ ID NO: 38927 - DNA, 25 bp, Homo sapien
tttctgctcgatgtcggtcagcgtg

SEQ ID NO: 38928 - DNA, 25 bp, Homo sapien
agctcctctagcatggccttctggc

SEQ ID NO: 38929 - DNA, 25 bp, Homo sapien
ggccttctggcgttcacgcagcagc

SEQ ID NO: 38930 - DNA, 25 bp, Homo sapien
aaggtgtgccggtcggtttcagcca

SEQ ID NO: 38931 - DNA, 25 bp, Homo sapien
ccgctcgaaggcctcgccgatagtg

SEQ ID NO: 38932 - DNA, 25 bp, Homo sapien
acccagtgctccgtgatgcagcggc

SEQ ID NO: 38933 - DNA, 25 bp, Homo sapien
gcagaagtaatgctcgcagcccagg

SEQ ID NO: 38934 - DNA, 25 bp, Homo sapien
ctcaccgggtcctggtagatgctca

SEQ ID NO: 38935 - DNA, 25 bp, Homo sapien
ggcagatggagcacagcagctcgtc

SEQ ID NO: 38936 - DNA, 25 bp, Homo sapien
cagtctagaggtagtgggcagctca

SEQ ID NO: 38937 - DNA, 25 bp, Homo sapien
ccgtacattggctgtgaccggcaga

SEQ ID NO: 38938 - DNA, 25 bp, Homo sapien
gagcttagcagccaccgcttcggtc

SEQ ID NO: 38939 - DNA, 25 bp, Homo sapien
ctgtagcgctccacgatgttggcca

SEQ ID NO: 38940 - DNA, 25 bp, Homo sapien
aggagttcctttgtggctctgcctc

SEQ ID NO: 38941 - DNA, 25 bp, Homo sapien
cgcagcgcaactttgccaggcggtg

SEQ ID NO: 38942 - DNA, 25 bp, Homo sapien
gctgggcctgtgcaaacttctactc

SEQ ID NO: 38943 - DNA, 25 bp, Homo sapien
aatcggcctggattttgagcaggtc

SEQ ID NO: 38944 - DNA, 25 bp, Homo sapien
cctggattttgagcaggtcgttatc

SEQ ID NO: 38945 - DNA, 25 bp, Homo sapien
ttttgagcaggtcgttatcaggggt

SEQ ID NO: 38946 - DNA, 25 bp, Homo sapien
cctccaggcggccgtcttcgaggga

SEQ ID NO: 38947 - DNA, 25 bp, Homo sapien
tgggcaggacaatggccacggccgc

SEQ ID NO: 38948 - DNA, 25 bp, Homo sapien
caacctggttctgattaacaagatc

SEQ ID NO: 38949 - DNA, 25 bp, Homo sapien
gggttggccacgacgagccacagca

SEQ ID NO: 38950 - DNA, 25 bp, Homo sapien
accagcaccgtcacaggtaggccga

SEQ ID NO: 38951 - DNA, 25 bp, Homo sapien
gctgcatccacaggcggtgccgcag

SEQ ID NO: 38952 - DNA, 25 bp, Homo sapien
aggccgtcatgtcgctgcccaagct

SEQ ID NO: 38953 - DNA, 25 bp, Homo sapien
tcaaggagcagctgatggccgagaa

SEQ ID NO: 38954 - DNA, 25 bp, Homo sapien
cttcccgcagctggacaacctggtt

SEQ ID NO: 38955 - DNA, 25 bp, Homo sapien
cctcgtcgcagcagccgttgctagt

SEQ ID NO: 38956 - DNA, 25 bp, Homo sapien
tctcctggactccatcaagacaatc

SEQ ID NO: 38957 - DNA, 25 bp, Homo sapien
caaaaagatcaaggcggagaacccg

SEQ ID NO: 38958 - DNA, 25 bp, Homo sapien
cccgtctgtgagcacttctgagtca

SEQ ID NO: 38959 - DNA, 25 bp, Homo sapien
agcacttctgagtcaagcgcgggcg

SEQ ID NO: 38960 - DNA, 25 bp, Homo sapien
agccagagccgcctcatcgcctcgt

SEQ ID NO: 38961 - DNA, 25 bp, Homo sapien
accctcatctcagggatcaccagcc

SEQ ID NO: 38962 - DNA, 25 bp, Homo sapien
gaacgcggccgcaaaaagatcaagg

SEQ ID NO: 38963 - DNA, 25 bp, Homo sapien
atcaagacaatccagggccacggcc

SEQ ID NO: 38964 - DNA, 25 bp, Homo sapien
acaccgccgcgtggttatagaagtc

SEQ ID NO: 38965 - DNA, 25 bp, Homo sapien
ctcccggaagctcggtgaacacgta

SEQ ID NO: 38966 - DNA, 25 bp, Homo sapien
ttctccaggtatctaagggcgcggc

SEQ ID NO: 38967 - DNA, 25 bp, Homo sapien
ctccagcagaactcgggcgacagca

SEQ ID NO: 38968 - DNA, 25 bp, Homo sapien
cagaacatgaagtgcgcctcgcggc

SEQ ID NO: 38969 - DNA, 25 bp, Homo sapien
cccggtttcaggatctcttcctcta

SEQ ID NO: 38970 - DNA, 25 bp, Homo sapien
tgctggtccacgtccatgcagaaca

SEQ ID NO: 38971 - DNA, 25 bp, Homo sapien
caaaagtgccgctgaagtgctggtc

SEQ ID NO: 38972 - DNA, 25 bp, Homo sapien
gagctctctgcgaagtctggacgca

SEQ ID NO: 38973 - DNA, 25 bp, Homo sapien
taactccagagaaaacgagcgagcc

SEQ ID NO: 38974 - DNA, 25 bp, Homo sapien
acgagaagccgctccggaggaaacg

SEQ ID NO: 38975 - DNA, 25 bp, Homo sapien
cccgaacatggcgacacggagcagc

SEQ ID NO: 38976 - DNA, 25 bp, Homo sapien
gccacggtttaggacgacctcgaca

SEQ ID NO: 38977 - DNA, 25 bp, Homo sapien
cacgaccctgtataggacgcaacta

SEQ ID NO: 38978 - DNA, 25 bp, Homo sapien
acctgcagtagcgttcgcccgaaca

SEQ ID NO: 38979 - DNA, 25 bp, Homo sapien
ggagtcgcgactcccgttcctattc

SEQ ID NO: 38980 - DNA, 25 bp, Homo sapien
agatgccagcagtctcgtccccgaa

SEQ ID NO: 38981 - DNA, 25 bp, Homo sapien
cgcaggcgcctccaagatagggagt

SEQ ID NO: 38982 - DNA, 25 bp, Homo sapien
cgcctccaagatagggagtccacca

SEQ ID NO: 38983 - DNA, 25 bp, Homo sapien
caccaataaagtacggcagatgcca

SEQ ID NO: 38984 - DNA, 25 bp, Homo sapien
accgtccgtcccagggaagtcgcag

SEQ ID NO: 38985 - DNA, 25 bp, Homo sapien
cgcgccgaggtgacacggcttccag

SEQ ID NO: 38986 - DNA, 25 bp, Homo sapien
tgcccgacttccagtgcggcgagcg

SEQ ID NO: 38987 - DNA, 25 bp, Homo sapien
tagggagtccaccaccaataaagta

SEQ ID NO: 38988 - DNA, 25 bp, Homo sapien
tactcattcagcacgcgcgcgaggg

SEQ ID NO: 38989 - DNA, 25 bp, Homo sapien
cctggcacacggtcagagtcccgta

SEQ ID NO: 38990 - DNA, 25 bp, Homo sapien
gagacgtgcagcgtgacacagtccc

SEQ ID NO: 38991 - DNA, 25 bp, Homo sapien
gtacagagacgtgcagcgtgacaca

SEQ ID NO: 38992 - DNA, 25 bp, Homo sapien
cgctgtcgtggcgaagcatactcat

SEQ ID NO: 38993 - DNA, 25 bp, Homo sapien
tcgtggcgaagcatactcattcagc

SEQ ID NO: 38994 - DNA, 25 bp, Homo sapien
caccgggtgaacctgcgctgtcgtg

SEQ ID NO: 38995 - DNA, 25 bp, Homo sapien
cacggtcagagtcccgtaagtgttg

SEQ ID NO: 38996 - DNA, 25 bp, Homo sapien
tattagcataccagcgcgcgtcacg

SEQ ID NO: 38997 - DNA, 25 bp, Homo sapien
gggtctcaccgcactctgcgggaca

SEQ ID NO: 38998 - DNA, 25 bp, Homo sapien
tgactctgggccgaaagtgccagcg

SEQ ID NO: 38999 - DNA, 25 bp, Homo sapien
agcgagtcactgacgggaccttggc

SEQ ID NO: 39000 - DNA, 25 bp, Homo sapien
cagctgggtgcccaaagggttaagc

SEQ ID NO: 39001 - DNA, 25 bp, Homo sapien
gcgagggcgctattaccatatatta

SEQ ID NO: 39002 - DNA, 25 bp, Homo sapien
ggcggaacacgccttagtgctgctc

SEQ ID NO: 39003 - DNA, 25 bp, Homo sapien
tccagccaatggtcaccctagaagg

SEQ ID NO: 39004 - DNA, 25 bp, Homo sapien
cgagggtcagtagacacccagcgtg

SEQ ID NO: 39005 - DNA, 25 bp, Homo sapien
ggtcgagggtcagtagacacccagc

SEQ ID NO: 39006 - DNA, 25 bp, Homo sapien
ccggtcgagggtcagtagacaccca

SEQ ID NO: 39007 - DNA, 25 bp, Homo sapien
ggtcagtagacacccagcgtggctt

SEQ ID NO: 39008 - DNA, 25 bp, Homo sapien
tctctgcggtcccacaccctctggc

SEQ ID NO: 39009 - DNA, 25 bp, Homo sapien
gacacccagcgtggcttctctgcgg

SEQ ID NO: 39010 - DNA, 25 bp, Homo sapien
tagacacccagcgtggcttctctgc

SEQ ID NO: 39011 - DNA, 25 bp, Homo sapien
cagtagacacccagcgtggcttctc

SEQ ID NO: 39012 - DNA, 25 bp, Homo sapien
tagcacgagttacacgcccggctgc

SEQ ID NO: 39013 - DNA, 25 bp, Homo sapien
cgctagtccttcagtctaaggcttg

SEQ ID NO: 39014 - DNA, 25 bp, Homo sapien
tgtttagcacaagacaagggatagc

SEQ ID NO: 39015 - DNA, 25 bp, Homo sapien
cgctccgctagtccttcagtctaag

SEQ ID NO: 39016 - DNA, 25 bp, Homo sapien
ttcagtctaaggcttgtttagcaca

SEQ ID NO: 39017 - DNA, 25 bp, Homo sapien
aggtccgctccgctagtccttcagt

SEQ ID NO: 39018 - DNA, 25 bp, Homo sapien
caagggatagcacgagttacacgcc

SEQ ID NO: 39019 - DNA, 25 bp, Homo sapien
caagacaagggatagcacgagttac

SEQ ID NO: 39020 - DNA, 25 bp, Homo sapien
acgtctgaaaggcagcaaacggagg

SEQ ID NO: 39021 - DNA, 25 bp, Homo sapien
cgccctgttgtgaagtgggtgtctc

SEQ ID NO: 39022 - DNA, 25 bp, Homo sapien
cgcgcccgttccgatttgttccagt

SEQ ID NO: 39023 - DNA, 25 bp, Homo sapien
ccgatttgttccagtgccagggtcc

SEQ ID NO: 39024 - DNA, 25 bp, Homo sapien
catatctattggctgaagacgtctg

SEQ ID NO: 39025 - DNA, 25 bp, Homo sapien
gctcgcgcggttccttctgggaatt

SEQ ID NO: 39026 - DNA, 25 bp, Homo sapien
gtggtctcagacgttccattcccag

SEQ ID NO: 39027 - DNA, 25 bp, Homo sapien
ccagggtccgttagaagatgacata

SEQ ID NO: 39028 - DNA, 25 bp, Homo sapien
tcaacgcccgggtcctggttactca

SEQ ID NO: 39029 - DNA, 25 bp, Homo sapien
acacgtgggcgctgagacattccat

SEQ ID NO: 39030 - DNA, 25 bp, Homo sapien
tgagacattccattgggccaaggcc

SEQ ID NO: 39031 - DNA, 25 bp, Homo sapien
ctgcagggcatagccggagttgcat

SEQ ID NO: 39032 - DNA, 25 bp, Homo sapien
ccagcctcttgccatagcggggttc

SEQ ID NO: 39033 - DNA, 25 bp, Homo sapien
gcacagagctgcactgcgtggcgct

SEQ ID NO: 39034 - DNA, 25 bp, Homo sapien
catagcggggttccggcacagagct

SEQ ID NO: 39035 - DNA, 25 bp, Homo sapien
agttgcattcgaagcggacgatggc

SEQ ID NO: 39036 - DNA, 25 bp, Homo sapien
ggggtgcttctagagcctccttcct

SEQ ID NO: 39037 - DNA, 25 bp, Homo sapien
gcctccttcctttagccggacgtga

SEQ ID NO: 39038 - DNA, 25 bp, Homo sapien
cccggatacctgtatgggagcccga

SEQ ID NO: 39039 - DNA, 25 bp, Homo sapien
ggctgtggccgtcgtgaacctccac

SEQ ID NO: 39040 - DNA, 25 bp, Homo sapien
gtcgtgaacctccaccacgtcgttg

SEQ ID NO: 39041 - DNA, 25 bp, Homo sapien
ccacgtcgttgagggccgtgtgaaa

SEQ ID NO: 39042 - DNA, 25 bp, Homo sapien
acaggcacgcagagccgtagggttc

SEQ ID NO: 39043 - DNA, 25 bp, Homo sapien
agccgtagggttccacctgcggcca

SEQ ID NO: 39044 - DNA, 25 bp, Homo sapien
tagcttgtagctagaactgagcttc

SEQ ID NO: 39045 - DNA, 25 bp, Homo sapien
caggcatcccggtttggacccgtct

SEQ ID NO: 39046 - DNA, 25 bp, Homo sapien
cgggcacacggaactttctagcttg

SEQ ID NO: 39047 - DNA, 25 bp, Homo sapien
aactgaagccacagaccaggtgccc

SEQ ID NO: 39048 - DNA, 25 bp, Homo sapien
ggcagaccttgcagacgcagaaatg

SEQ ID NO: 39049 - DNA, 25 bp, Homo sapien
gcaccggtttcaattggagaaaatg

SEQ ID NO: 39050 - DNA, 25 bp, Homo sapien
ccgcagtctgcagtcggttccagag

SEQ ID NO: 39051 - DNA, 25 bp, Homo sapien
cctcctgcaaggaatgcgcgggacc

SEQ ID NO: 39052 - DNA, 25 bp, Homo sapien
ccttgccgagtcagcgcgctcttga

SEQ ID NO: 39053 - DNA, 25 bp, Homo sapien
cgagccgttgcgtttgaaacccaca

SEQ ID NO: 39054 - DNA, 25 bp, Homo sapien
gcccaggcgccgaaagttgtcacgg

SEQ ID NO: 39055 - DNA, 25 bp, Homo sapien
ttgacgctcgctctgcgaggggctc

SEQ ID NO: 39056 - DNA, 25 bp, Homo sapien
cccgagtgcctacaatggtgccagg

SEQ ID NO: 39057 - DNA, 25 bp, Homo sapien
gcgcgtttggctttgacttctgatc

SEQ ID NO: 39058 - DNA, 25 bp, Homo sapien
tgtgggagctactggcaggcaaatt

SEQ ID NO: 39059 - DNA, 25 bp, Homo sapien
ccagtcctccgcgtggcttagcggg

SEQ ID NO: 39060 - DNA, 25 bp, Homo sapien
gcgcaagcaccacctgaaacacggg

SEQ ID NO: 39061 - DNA, 25 bp, Homo sapien
tgctgagcctcatcttcaaggccgc

SEQ ID NO: 39062 - DNA, 25 bp, Homo sapien
gtggacgtacttgctgagcctcatc

SEQ ID NO: 39063 - DNA, 25 bp, Homo sapien
gtccctgtacgacaacctgagcaag

SEQ ID NO: 39064 - DNA, 25 bp, Homo sapien
acgtctgctatgacgagttcttccc

SEQ ID NO: 39065 - DNA, 25 bp, Homo sapien
taccgcgaggaacgcgagcgcaagc

SEQ ID NO: 39066 - DNA, 25 bp, Homo sapien
ctcgtggtcatgcacgtggcctacc

SEQ ID NO: 39067 - DNA, 25 bp, Homo sapien
tgggccctacagctcatcctggtca

SEQ ID NO: 39068 - DNA, 25 bp, Homo sapien
tggacgtgctcctctccatggggtt

SEQ ID NO: 39069 - DNA, 25 bp, Homo sapien
ggcaccctctccgtctggaatactg

SEQ ID NO: 39070 - DNA, 25 bp, Homo sapien
gtggagctcagcgtttctctcgcgc

SEQ ID NO: 39071 - DNA, 25 bp, Homo sapien
gagtcccgggtatagtgctcagcct

SEQ ID NO: 39072 - DNA, 25 bp, Homo sapien
tgagccatggctcagtacggccacc

SEQ ID NO: 39073 - DNA, 25 bp, Homo sapien
caaattcccggactgctaggcgagg

SEQ ID NO: 39074 - DNA, 25 bp, Homo sapien
aggaagcgtcagagtcccgacactg

SEQ ID NO: 39075 - DNA, 25 bp, Homo sapien
ccatcaagcatggatcggcgctgga

SEQ ID NO: 39076 - DNA, 25 bp, Homo sapien
aagcggaggctcagacgggccacca

SEQ ID NO: 39077 - DNA, 25 bp, Homo sapien
tcgcctctcaattctgggcccatta

SEQ ID NO: 39078 - DNA, 25 bp, Homo sapien
cttgagcctgccagtgcgctgggat

SEQ ID NO: 39079 - DNA, 25 bp, Homo sapien
cgccgtctgtgtgcaccactgctga

SEQ ID NO: 39080 - DNA, 25 bp, Homo sapien
ccctgatctcattggagccttcgga

SEQ ID NO: 39081 - DNA, 25 bp, Homo sapien
agtcctgattgcagtcggacctgcc

SEQ ID NO: 39082 - DNA, 25 bp, Homo sapien
ccgccgcggcacttaacagtttgca

SEQ ID NO: 39083 - DNA, 25 bp, Homo sapien
cggtactcgcggcaaactagcgtgg

SEQ ID NO: 39084 - DNA, 25 bp, Homo sapien
cgttcgggcgcatctggctgtccgt

SEQ ID NO: 39085 - DNA, 25 bp, Homo sapien
tggctgtccgtggtgttcgtcttcc

SEQ ID NO: 39086 - DNA, 25 bp, Homo sapien
tcgtcttccgggtgctggtatacgt

SEQ ID NO: 39087 - DNA, 25 bp, Homo sapien
tgctggtcatcctgcacgtggccta

SEQ ID NO: 39088 - DNA, 25 bp, Homo sapien
agtgcgccaagctgtacgacaacgc

SEQ ID NO: 39089 - DNA, 25 bp, Homo sapien
agaaacacggggaccagtgcgccaa

SEQ ID NO: 39090 - DNA, 25 bp, Homo sapien
gccggcaccgccagaaacacgggga

SEQ ID NO: 39091 - DNA, 25 bp, Homo sapien
tacgacaacgcaggcaagaagcacg

SEQ ID NO: 39092 - DNA, 25 bp, Homo sapien
accctctttccatggaatccttgta

SEQ ID NO: 39093 - DNA, 25 bp, Homo sapien
tttagggagtctgcacctcccagtc

SEQ ID NO: 39094 - DNA, 25 bp, Homo sapien
gctcacccaggtggccttggccagg

SEQ ID NO: 39095 - DNA, 25 bp, Homo sapien
ttccttatccaaggggccgcagtta

SEQ ID NO: 39096 - DNA, 25 bp, Homo sapien
cgaggcgggaggaatactattgttt

SEQ ID NO: 39097 - DNA, 25 bp, Homo sapien
atactattgtttccactctatcgtg

SEQ ID NO: 39098 - DNA, 25 bp, Homo sapien
ccactctatcgtggaggagactgag

SEQ ID NO: 39099 - DNA, 25 bp, Homo sapien
gggcccagaggttgttccttatcca

SEQ ID NO: 39100 - DNA, 25 bp, Homo sapien
tctcagtgatgtcgccacgtgtttt

SEQ ID NO: 39101 - DNA, 25 bp, Homo sapien
ggagcacggaagtcgccgcacccag

SEQ ID NO: 39102 - DNA, 25 bp, Homo sapien
cgctgaaatggacgtcgcgccctct

SEQ ID NO: 39103 - DNA, 25 bp, Homo sapien
gagcgcagggattggctgaacttca

SEQ ID NO: 39104 - DNA, 25 bp, Homo sapien
taactcagaggttactggcctgggc

SEQ ID NO: 39105 - DNA, 25 bp, Homo sapien
ttcagccaaaggacggaaggaagct

SEQ ID NO: 39106 - DNA, 25 bp, Homo sapien
gggtggaccctagcgatcactcctc

SEQ ID NO: 39107 - DNA, 25 bp, Homo sapien
ggaaggaagctaggcgtccgcaact

SEQ ID NO: 39108 - DNA, 25 bp, Homo sapien
gtagataatcttggtctccgccatg

SEQ ID NO: 39109 - DNA, 25 bp, Homo sapien
agcacgttcttgaagtcggccagcg

SEQ ID NO: 39110 - DNA, 25 bp, Homo sapien
gccggttgctgagcacgttcttgaa

SEQ ID NO: 39111 - DNA, 25 bp, Homo sapien
aaagaagaatttgtaggcgtgcacg

SEQ ID NO: 39112 - DNA, 25 bp, Homo sapien
tcctggtccatggacttaaagaaga

SEQ ID NO: 39113 - DNA, 25 bp, Homo sapien
cgctccattatgatccggcgcatgc

SEQ ID NO: 39114 - DNA, 25 bp, Homo sapien
aggatgcgcagacgcaggcgatcat

SEQ ID NO: 39115 - DNA, 25 bp, Homo sapien
cacgggcagcttgaccaggtacggc

SEQ ID NO: 39116 - DNA, 25 bp, Homo sapien
tccgaacgcgatggcgctcagaatc

SEQ ID NO: 39117 - DNA, 25 bp, Homo sapien
aggtgctcctgttccgacaaggtca

SEQ ID NO: 39118 - DNA, 25 bp, Homo sapien
ttttccaccaaagcgcggcgcgttc

SEQ ID NO: 39119 - DNA, 25 bp, Homo sapien
gtggcgccgttctcaacagctcgca

SEQ ID NO: 39120 - DNA, 25 bp, Homo sapien
ggacagtctgtccttccgtaaggtc

SEQ ID NO: 39121 - DNA, 25 bp, Homo sapien
cagctcgcagcagagccggtttttc

SEQ ID NO: 39122 - DNA, 25 bp, Homo sapien
gctccgcaatgagggtgcacatacc

SEQ ID NO: 39123 - DNA, 25 bp, Homo sapien
tctggccctcatcgcagacaaggtc

SEQ ID NO: 39124 - DNA, 25 bp, Homo sapien
ggaggctacgtgaaccgcgctctat

SEQ ID NO: 39125 - DNA, 25 bp, Homo sapien
accgcgctctatccaggagtcacgg

SEQ ID NO: 39126 - DNA, 25 bp, Homo sapien
gctctatccaggagtcacggcggcc

SEQ ID NO: 39127 - DNA, 25 bp, Homo sapien
gctcgtacggcagtgggtagccctc

SEQ ID NO: 39128 - DNA, 25 bp, Homo sapien
tcgtacggcagtgggtagccctcgc

SEQ ID NO: 39129 - DNA, 25 bp, Homo sapien
tagccctcgcggtaggcccactggc

SEQ ID NO: 39130 - DNA, 25 bp, Homo sapien
cactggccctgcgtgtggaccgtgc

SEQ ID NO: 39131 - DNA, 25 bp, Homo sapien
cgtgaaccgcgctctatccaggagt

SEQ ID NO: 39132 - DNA, 25 bp, Homo sapien
aggcacggggttcacttgcagctca

SEQ ID NO: 39133 - DNA, 25 bp, Homo sapien
aaggtgtactcacaggagccgggcc

SEQ ID NO: 39134 - DNA, 25 bp, Homo sapien
caggcagtcgtcgtcttgagagcag

SEQ ID NO: 39135 - DNA, 25 bp, Homo sapien
tccctgccagggatggtcttgatga

SEQ ID NO: 39136 - DNA, 25 bp, Homo sapien
atgctgctgcacacacgccaacgga

SEQ ID NO: 39137 - DNA, 25 bp, Homo sapien
tcagggcaagccagaaagaatgtcg

SEQ ID NO: 39138 - DNA, 25 bp, Homo sapien
ctttctgaagttgaaggctgtggcc

SEQ ID NO: 39139 - DNA, 25 bp, Homo sapien
gtcgatatatccagaaggccgcttc

SEQ ID NO: 39140 - DNA, 25 bp, Homo sapien
ggccaagccacggaggctggatttc

SEQ ID NO: 39141 - DNA, 25 bp, Homo sapien
aggcacccgaagtgtcacggccacg

SEQ ID NO: 39142 - DNA, 25 bp, Homo sapien
aagtgtcacggccacgcacagccga

SEQ ID NO: 39143 - DNA, 25 bp, Homo sapien
gccgaggggcagtcacgccctgaat

SEQ ID NO: 39144 - DNA, 25 bp, Homo sapien
taggagactctccttcgggctttcc

SEQ ID NO: 39145 - DNA, 25 bp, Homo sapien
gacccaggaacaggcacccgaagtg

SEQ ID NO: 39146 - DNA, 25 bp, Homo sapien
caggcccgtccgcttaggagactct

SEQ ID NO: 39147 - DNA, 25 bp, Homo sapien
agtcacgccctgaatgtcacacaca

SEQ ID NO: 39148 - DNA, 25 bp, Homo sapien
gcgcgacaccggtctccgttgtctt

SEQ ID NO: 39149 - DNA, 25 bp, Homo sapien
atgaacattgccagggccgccacgt

SEQ ID NO: 39150 - DNA, 25 bp, Homo sapien
cgccgctgcggatgaacattgccag

SEQ ID NO: 39151 - DNA, 25 bp, Homo sapien
accagagccaggttgaacaggtaga

SEQ ID NO: 39152 - DNA, 25 bp, Homo sapien
cgtgagcgtgaagaactcatcaacc

SEQ ID NO: 39153 - DNA, 25 bp, Homo sapien
accgccgcataggtggacacgtagt

SEQ ID NO: 39154 - DNA, 25 bp, Homo sapien
tgccaaggcataggccgcgggcacc

SEQ ID NO: 39155 - DNA, 25 bp, Homo sapien
gccaggctcacgttggccgcgagca

SEQ ID NO: 39156 - DNA, 25 bp, Homo sapien
ccgatgtcgttattacggccgtttg

SEQ ID NO: 39157 - DNA, 25 bp, Homo sapien
cgtctgtgttgtctgcggtctccag

SEQ ID NO: 39158 - DNA, 25 bp, Homo sapien
gatggggacggcaggaaaccaccca

SEQ ID NO: 39159 - DNA, 25 bp, Homo sapien
ggcaggaaaccacccaagcaagctg

SEQ ID NO: 39160 - DNA, 25 bp, Homo sapien
aaccacccaagcaagctggggagga

SEQ ID NO: 39161 - DNA, 25 bp, Homo sapien
agagcagccctgttcccggtcaatt

SEQ ID NO: 39162 - DNA, 25 bp, Homo sapien
agcagccctgttcccggtcaattag

SEQ ID NO: 39163 - DNA, 25 bp, Homo sapien
attacggccgtttgcagcctccgtg

SEQ ID NO: 39164 - DNA, 25 bp, Homo sapien
actggagccgagatctcctccgaga

SEQ ID NO: 39165 - DNA, 25 bp, Homo sapien
tccagctgagcctcggaagcccgaa

SEQ ID NO: 39166 - DNA, 25 bp, Homo sapien
catccgctccgaaactggagccgag

SEQ ID NO: 39167 - DNA, 25 bp, Homo sapien
ccgagatctcctccgagagcttggc

SEQ ID NO: 39168 - DNA, 25 bp, Homo sapien
gcagccggaagactctcgcctgagc

SEQ ID NO: 39169 - DNA, 25 bp, Homo sapien
gaagactctcgcctgagctaccgtc

SEQ ID NO: 39170 - DNA, 25 bp, Homo sapien
gcctcagtcgaaagccaggcgcttt

SEQ ID NO: 39171 - DNA, 25 bp, Homo sapien
gcagcaccgaaagcaggagcgccat

SEQ ID NO: 39172 - DNA, 25 bp, Homo sapien
cccatcattgaggactaacgaggca

SEQ ID NO: 39173 - DNA, 25 bp, Homo sapien
agcggtggactagccagtgaatgtc

SEQ ID NO: 39174 - DNA, 25 bp, Homo sapien
agtgaatgtcaacgcgtccctaagg

SEQ ID NO: 39175 - DNA, 25 bp, Homo sapien
gtccctaaggcgatatccgcagccg

SEQ ID NO: 39176 - DNA, 25 bp, Homo sapien
cacaaaatatctacgggcgctcatc

SEQ ID NO: 39177 - DNA, 25 bp, Homo sapien
ctgctaccggaggagcactggaata

SEQ ID NO: 39178 - DNA, 25 bp, Homo sapien
gtcctctgcatctagacagggatta

SEQ ID NO: 39179 - DNA, 25 bp, Homo sapien
gagaaccgcacgctttccgaaattc

SEQ ID NO: 39180 - DNA, 25 bp, Homo sapien
ggtctttactcctgcgccttactcg

SEQ ID NO: 39181 - DNA, 25 bp, Homo sapien
gccgtttcgcttcgaagattgtttc

SEQ ID NO: 39182 - DNA, 25 bp, Homo sapien
gggcgtccctgagagaaattagtaa

SEQ ID NO: 39183 - DNA, 25 bp, Homo sapien
tgcggctctggtttcggtctttact

SEQ ID NO: 39184 - DNA, 25 bp, Homo sapien
agacggagctttgagtgcggattcc

SEQ ID NO: 39185 - DNA, 25 bp, Homo sapien
ccctgacgtggattgtgtttgccgc

SEQ ID NO: 39186 - DNA, 25 bp, Homo sapien
tgtttgccgcctcctttaaccttgc

SEQ ID NO: 39187 - DNA, 25 bp, Homo sapien
tagtaagcctcctcatgcggctctg

SEQ ID NO: 39188 - DNA, 25 bp, Homo sapien
ctgagacctcaaactccaggcggaa

SEQ ID NO: 39189 - DNA, 25 bp, Homo sapien
gttggctgagcagccgtagcccgcc

SEQ ID NO: 39190 - DNA, 25 bp, Homo sapien
aagcgctatcggttggctgagcagc

SEQ ID NO: 39191 - DNA, 25 bp, Homo sapien
gcgtttgagtgactgagagttgccc

SEQ ID NO: 39192 - DNA, 25 bp, Homo sapien
cctgcgcgtttgagtgactgagagt

SEQ ID NO: 39193 - DNA, 25 bp, Homo sapien
caataacaacaacgtgtagggagca

SEQ ID NO: 39194 - DNA, 25 bp, Homo sapien
ccgcccacaataacaacaacgtgta

SEQ ID NO: 39195 - DNA, 25 bp, Homo sapien
ctccaggcggaagcgctatcggttg

SEQ ID NO: 39196 - DNA, 25 bp, Homo sapien
tccctgagcaacgacgggcttggaa

SEQ ID NO: 39197 - DNA, 25 bp, Homo sapien
gcattttgccgcctttgggaccacc

SEQ ID NO: 39198 - DNA, 25 bp, Homo sapien
tggccgccaggcgtacttaggcccg

SEQ ID NO: 39199 - DNA, 25 bp, Homo sapien
agtccgagatcttctcctcgctgcg

SEQ ID NO: 39200 - DNA, 25 bp, Homo sapien
tagacactcacctccgagtccgaga

SEQ ID NO: 39201 - DNA, 25 bp, Homo sapien
ggagccgacgcgtcgctcccataga

SEQ ID NO: 39202 - DNA, 25 bp, Homo sapien
tccggcagccgacaaaatggaagcc

SEQ ID NO: 39203 - DNA, 25 bp, Homo sapien
ccgcgattctgattgaggcccatgc

SEQ ID NO: 39204 - DNA, 25 bp, Homo sapien
agcagcgagaagttgccgtcgtcga

SEQ ID NO: 39205 - DNA, 25 bp, Homo sapien
ccgcaccgcggatgagcagcgagaa

SEQ ID NO: 39206 - DNA, 25 bp, Homo sapien
tgcaggttgcaggtgtacagccccg

SEQ ID NO: 39207 - DNA, 25 bp, Homo sapien
ctctcgtagaggtggcagtagtgat

SEQ ID NO: 39208 - DNA, 25 bp, Homo sapien
aggcggacggccaggctctcgtaga

SEQ ID NO: 39209 - DNA, 25 bp, Homo sapien
tcacggccgtcggtgacctccaggc

SEQ ID NO: 39210 - DNA, 25 bp, Homo sapien
cggtcccgcgcctcgtacacgcgct

SEQ ID NO: 39211 - DNA, 25 bp, Homo sapien
agaagttgccgtcgtcgaaggccga

SEQ ID NO: 39212 - DNA, 25 bp, Homo sapien
tgcccgcggttcacgcaggtcagaa

SEQ ID NO: 39213 - DNA, 25 bp, Homo sapien
tgttgagcctcctccacgtgccggt

SEQ ID NO: 39214 - DNA, 25 bp, Homo sapien
ggtcccagtgcaccacctgttgagc

SEQ ID NO: 39215 - DNA, 25 bp, Homo sapien
tcgcccgacgcgtagaggtccagca

SEQ ID NO: 39216 - DNA, 25 bp, Homo sapien
aagtcaccgcgctcaaaggcatccg

SEQ ID NO: 39217 - DNA, 25 bp, Homo sapien
cctccagcggctcgatacgcagtga

SEQ ID NO: 39218 - DNA, 25 bp, Homo sapien
gtcaggtaccagcaagacctgcgcc

SEQ ID NO: 39219 - DNA, 25 bp, Homo sapien
cggcgttcgtgcaggccacagtaat

SEQ ID NO: 39220 - DNA, 25 bp, Homo sapien
gcggacccgtgggatctcagaagct

SEQ ID NO: 39221 - DNA, 25 bp, Homo sapien
gtcgccgaggcccagttaggacaag

SEQ ID NO: 39222 - DNA, 25 bp, Homo sapien
gtgatccctttaagaaaccgcaggc

SEQ ID NO: 39223 - DNA, 25 bp, Homo sapien
cccagttaggacaaggttgcgggca

SEQ ID NO: 39224 - DNA, 25 bp, Homo sapien
gagaaaataatcctactcacggggc

SEQ ID NO: 39225 - DNA, 25 bp, Homo sapien
cgcaaggggctgatttggtgatccc

SEQ ID NO: 39226 - DNA, 25 bp, Homo sapien
cgcaggcggaggaatttctctgaga

SEQ ID NO: 39227 - DNA, 25 bp, Homo sapien
ccatactcaggttcgtggaggggtc

SEQ ID NO: 39228 - DNA, 25 bp, Homo sapien
tcgggcaatacccacaagcaagatg

SEQ ID NO: 39229 - DNA, 25 bp, Homo sapien
tttgacgtgatctctccgtgacatc

SEQ ID NO: 39230 - DNA, 25 bp, Homo sapien
gggctgtctcccatgtcgtgatttt

SEQ ID NO: 39231 - DNA, 25 bp, Homo sapien
cgtgccctgtcgagactccattttg

SEQ ID NO: 39232 - DNA, 25 bp, Homo sapien
gcaccctgacttgccattggccaga

SEQ ID NO: 39233 - DNA, 25 bp, Homo sapien
tacgcacaagcgaaggaatctgggc

SEQ ID NO: 39234 - DNA, 25 bp, Homo sapien
tgctgggcgggtaaaactacgcaca

SEQ ID NO: 39235 - DNA, 25 bp, Homo sapien
gccggcgctgatcgatgccgacaca

SEQ ID NO: 39236 - DNA, 25 bp, Homo sapien
tccgccatggtgagtagtctcgggc

SEQ ID NO: 39237 - DNA, 25 bp, Homo sapien
ggtgcacacctactccgccatggtg

SEQ ID NO: 39238 - DNA, 25 bp, Homo sapien
tgtcccgcgctaacgaaatctcgga

SEQ ID NO: 39239 - DNA, 25 bp, Homo sapien
cagggacttcgccagctgagaacgc

SEQ ID NO: 39240 - DNA, 25 bp, Homo sapien
cgcgatgcgcaagtgaccgctgtcc

SEQ ID NO: 39241 - DNA, 25 bp, Homo sapien
cagctgaaccctcccgagctgagga

SEQ ID NO: 39242 - DNA, 25 bp, Homo sapien
atcctttcaggctggggtcctttca

SEQ ID NO: 39243 - DNA, 25 bp, Homo sapien
tgccagtgggtcacctaaggcaccc

SEQ ID NO: 39244 - DNA, 25 bp, Homo sapien
ggggagtgaattagcgccctccttc

SEQ ID NO: 39245 - DNA, 25 bp, Homo sapien
gacggcacgaggaactcctgtcctg

SEQ ID NO: 39246 - DNA, 25 bp, Homo sapien
gccctggaatcagagaaagtcgctc

SEQ ID NO: 39247 - DNA, 25 bp, Homo sapien
tctttggccacctgaagcgtcggat

SEQ ID NO: 39248 - DNA, 25 bp, Homo sapien
gaagcgtcggatccctacagtgcct

SEQ ID NO: 39249 - DNA, 25 bp, Homo sapien
acttccgggtcccatgccagttgca

SEQ ID NO: 39250 - DNA, 25 bp, Homo sapien
acgtcaagttacagcccgcgcagca

SEQ ID NO: 39251 - DNA, 25 bp, Homo sapien
ggaaaagcttcgctgactgcaggca

SEQ ID NO: 39252 - DNA, 25 bp, Homo sapien
gaaccgcgagctctagaggagaaca

SEQ ID NO: 39253 - DNA, 25 bp, Homo sapien
agggagtcgccttagtatttgagtc

SEQ ID NO: 39254 - DNA, 25 bp, Homo sapien
tgacgagcagtgcacgagtctgtcc

SEQ ID NO: 39255 - DNA, 25 bp, Homo sapien
agagccgagagctgaatttccagtc

SEQ ID NO: 39256 - DNA, 25 bp, Homo sapien
gttttgtttgtcttccaggagcgga

SEQ ID NO: 39257 - DNA, 25 bp, Homo sapien
agcggatttccaaggcccgccacga

SEQ ID NO: 39258 - DNA, 25 bp, Homo sapien
agtctgagtcttccggtccaggagg

SEQ ID NO: 39259 - DNA, 25 bp, Homo sapien
gtctgtcctgaaactggacgtttta

SEQ ID NO: 39260 - DNA, 25 bp, Homo sapien
ggcgctctcggatgacgtacaactg

SEQ ID NO: 39261 - DNA, 25 bp, Homo sapien
agacagcacctcagagcgaagattg

SEQ ID NO: 39262 - DNA, 25 bp, Homo sapien
gccgggtgccttatgttcagtgctt

SEQ ID NO: 39263 - DNA, 25 bp, Homo sapien
tgcaggtccgacacagcacgagact

SEQ ID NO: 39264 - DNA, 25 bp, Homo sapien
caactgtcgcgagaggttgcaaagc

SEQ ID NO: 39265 - DNA, 25 bp, Homo sapien
taccgatgaggtactccatggtggc

SEQ ID NO: 39266 - DNA, 25 bp, Homo sapien
cacccggtcggaggcgacaagaaca

SEQ ID NO: 39267 - DNA, 25 bp, Homo sapien
cgacaagaacatagtcggggccttg

SEQ ID NO: 39268 - DNA, 25 bp, Homo sapien
ccagccgttttcatgcttgttggga

SEQ ID NO: 39269 - DNA, 25 bp, Homo sapien
ttcattcacggcgaggaggccctcg

SEQ ID NO: 39270 - DNA, 25 bp, Homo sapien
ttcatgcttgttgggattaggggca

SEQ ID NO: 39271 - DNA, 25 bp, Homo sapien
cgggactgtgcggatcaacagtctg

SEQ ID NO: 39272 - DNA, 25 bp, Homo sapien
gagcgccgagcaccagctgagcgcc

SEQ ID NO: 39273 - DNA, 25 bp, Homo sapien
ccctcggacggctcccatcccacag

SEQ ID NO: 39274 - DNA, 25 bp, Homo sapien
ccctttcattcacggcgaggaggcc

SEQ ID NO: 39275 - DNA, 25 bp, Homo sapien
ctttgtctgcgcctttcggggacga

SEQ ID NO: 39276 - DNA, 25 bp, Homo sapien
ccggcgttaaactcctcaatggctt

SEQ ID NO: 39277 - DNA, 25 bp, Homo sapien
cccagactcggactcacggcgtaga

SEQ ID NO: 39278 - DNA, 25 bp, Homo sapien
ttccaggtccggtgctctctcctat

SEQ ID NO: 39279 - DNA, 25 bp, Homo sapien
cctattggcattcgctgggcccttc

SEQ ID NO: 39280 - DNA, 25 bp, Homo sapien
tcccatcagttagcctcgctgcaga

SEQ ID NO: 39281 - DNA, 25 bp, Homo sapien
ctcgctgcagacaccgtgccatttt

SEQ ID NO: 39282 - DNA, 25 bp, Homo sapien
caccgtgccattttcaagtgaaatc

SEQ ID NO: 39283 - DNA, 25 bp, Homo sapien
gattagtcaccaccttccggcgtta

SEQ ID NO: 39284 - DNA, 25 bp, Homo sapien
aggcccagtgtggaactccctaaca

SEQ ID NO: 39285 - DNA, 25 bp, Homo sapien
cggctagagcctcccggctttcaga

SEQ ID NO: 39286 - DNA, 25 bp, Homo sapien
cggctttcagagcaccctgagggga

SEQ ID NO: 39287 - DNA, 25 bp, Homo sapien
ggggcgtgtgcataaactcacctca

SEQ ID NO: 39288 - DNA, 25 bp, Homo sapien
gacggagctgtctctgattccctca

SEQ ID NO: 39289 - DNA, 25 bp, Homo sapien
gcccagcagtgctgttcttgctttc

SEQ ID NO: 39290 - DNA, 25 bp, Homo sapien
ggaggtcccacccagatggtttgca

SEQ ID NO: 39291 - DNA, 25 bp, Homo sapien
tctcctattacccaggctgagttgg

SEQ ID NO: 39292 - DNA, 25 bp, Homo sapien
ccacctcggggagacgatatgtgcc

SEQ ID NO: 39293 - DNA, 25 bp, Homo sapien
ttccggagatcaagcgttacgcggc

SEQ ID NO: 39294 - DNA, 25 bp, Homo sapien
agagccgttggccaccggacggcct

SEQ ID NO: 39295 - DNA, 25 bp, Homo sapien
cggggattgtttttgttgtcgctga

SEQ ID NO: 39296 - DNA, 25 bp, Homo sapien
tgcctactaccagccggtagtcctg

SEQ ID NO: 39297 - DNA, 25 bp, Homo sapien
cccagcgccaatattccggagatca

SEQ ID NO: 39298 - DNA, 25 bp, Homo sapien
gatccgctacccagtgcgcgcggag

SEQ ID NO: 39299 - DNA, 25 bp, Homo sapien
ctaccagccggtagtcctggtttgg

SEQ ID NO: 39300 - DNA, 25 bp, Homo sapien
tcagatgccagttgcgtgatggcgt

SEQ ID NO: 39301 - DNA, 25 bp, Homo sapien
acgttcaccaatcagatgccagttg

SEQ ID NO: 39302 - DNA, 25 bp, Homo sapien
ctcaggagtgcgtgaggcccacgca

SEQ ID NO: 39303 - DNA, 25 bp, Homo sapien
cgcggatctaaatttacggacggag

SEQ ID NO: 39304 - DNA, 25 bp, Homo sapien
gatcgtgcatgctcagtccttcctc

SEQ ID NO: 39305 - DNA, 25 bp, Homo sapien
ggcagactcgcggatctaaatttac

SEQ ID NO: 39306 - DNA, 25 bp, Homo sapien
ccaaatgtggacctgtgaggacgcc

SEQ ID NO: 39307 - DNA, 25 bp, Homo sapien
ggaggagctagatcgtgcatgctca

SEQ ID NO: 39308 - DNA, 25 bp, Homo sapien
acggccctcaacagctgggaagtca

SEQ ID NO: 39309 - DNA, 25 bp, Homo sapien
acacaagtgcccgttcaggtcaggc

SEQ ID NO: 39310 - DNA, 25 bp, Homo sapien
aggaggactttgcttccaacacagc

SEQ ID NO: 39311 - DNA, 25 bp, Homo sapien
gcggccgcctgcagaaaaccagacg

SEQ ID NO: 39312 - DNA, 25 bp, Homo sapien
tcgacgcggctcaaattgaccgttc

SEQ ID NO: 39313 - DNA, 25 bp, Homo sapien
agacccgcactcctaaccaggtgtg

SEQ ID NO: 39314 - DNA, 25 bp, Homo sapien
tccctctgtgagcatcggaagctta

SEQ ID NO: 39315 - DNA, 25 bp, Homo sapien
acggacatcttcctggggaccagca

SEQ ID NO: 39316 - DNA, 25 bp, Homo sapien
ggaacggtgcatgctccaaggactg

SEQ ID NO: 39317 - DNA, 25 bp, Homo sapien
tcccagacatccgtggaggcctacg

SEQ ID NO: 39318 - DNA, 25 bp, Homo sapien
ctccgctgggctggaataggctaat

SEQ ID NO: 39319 - DNA, 25 bp, Homo sapien
tcccgcatgaaaagcgtggtttcca

SEQ ID NO: 39320 - DNA, 25 bp, Homo sapien
cattggcctttgttgccgtcggagc

SEQ ID NO: 39321 - DNA, 25 bp, Homo sapien
tgcgcggttccaaggcacctctact

SEQ ID NO: 39322 - DNA, 25 bp, Homo sapien
acagtcctgcgggttggaagtaatc

SEQ ID NO: 39323 - DNA, 25 bp, Homo sapien
ctgacctccgcacgggtatatggga

SEQ ID NO: 39324 - DNA, 25 bp, Homo sapien
ctccatgaatggaaatcggctccgc

SEQ ID NO: 39325 - DNA, 25 bp, Homo sapien
caggtaggctactcctcaggtaagc

SEQ ID NO: 39326 - DNA, 25 bp, Homo sapien
gcgatgcaacttccggacgggactc

SEQ ID NO: 39327 - DNA, 25 bp, Homo sapien
agctactgtcctctgagcatccctg

SEQ ID NO: 39328 - DNA, 25 bp, Homo sapien
ttccggcccagagctttcggagtgc

SEQ ID NO: 39329 - DNA, 25 bp, Homo sapien
ctccgcaggtgagtcagagtagctg

SEQ ID NO: 39330 - DNA, 25 bp, Homo sapien
ccaggtaggggatgtcacccagcta

SEQ ID NO: 39331 - DNA, 25 bp, Homo sapien
ctctcgcctagtcctgtgccgtttt

SEQ ID NO: 39332 - DNA, 25 bp, Homo sapien
ccctccaacagtaggcgagggcgga

SEQ ID NO: 39333 - DNA, 25 bp, Homo sapien
cagctcttcccacggggctctccct

SEQ ID NO: 39334 - DNA, 25 bp, Homo sapien
ccaaaggcgatcatcctgcggaggg

SEQ ID NO: 39335 - DNA, 25 bp, Homo sapien
gggtactgatctaaaccaaaggcga

SEQ ID NO: 39336 - DNA, 25 bp, Homo sapien
gctggaccggggtactgatctaaac

SEQ ID NO: 39337 - DNA, 25 bp, Homo sapien
tagcaaccggtggtgccaaacactg

SEQ ID NO: 39338 - DNA, 25 bp, Homo sapien
gcctagcaaccggtggtgccaaaca

SEQ ID NO: 39339 - DNA, 25 bp, Homo sapien
cggttgccaagcgaagcgcccaggc

SEQ ID NO: 39340 - DNA, 25 bp, Homo sapien
ctctgtgttggagaattggcagctt

SEQ ID NO: 39341 - DNA, 25 bp, Homo sapien
cagagtctccaagcctgctcgaaag

SEQ ID NO: 39342 - DNA, 25 bp, Homo sapien
cggcaaccaccctccgaggctcgaa

SEQ ID NO: 39343 - DNA, 25 bp, Homo sapien
gagagccaatgacgaggctgccaga

SEQ ID NO: 39344 - DNA, 25 bp, Homo sapien
gaggctcgaatctccgctgctctct

SEQ ID NO: 39345 - DNA, 25 bp, Homo sapien
tggagaggcaagaagacaagctcct

SEQ ID NO: 39346 - DNA, 25 bp, Homo sapien
agccaatgacgaggctgccagaggc

SEQ ID NO: 39347 - DNA, 25 bp, Homo sapien
aggcagagtctccaagcctgctcga

SEQ ID NO: 39348 - DNA, 25 bp, Homo sapien
atctccggccttatagacgtctcgc

SEQ ID NO: 39349 - DNA, 25 bp, Homo sapien
tgccagtgcgatctccggccttata

SEQ ID NO: 39350 - DNA, 25 bp, Homo sapien
cggatgacccgcagacagcttgagc

SEQ ID NO: 39351 - DNA, 25 bp, Homo sapien
tcctgcgtcatgtccagagtctgga

SEQ ID NO: 39352 - DNA, 25 bp, Homo sapien
gtcgacctgacgtcagtcctgcgtc

SEQ ID NO: 39353 - DNA, 25 bp, Homo sapien
aaccgagactcaaagcacaggctgg

SEQ ID NO: 39354 - DNA, 25 bp, Homo sapien
ccgaacatcccgtgctcggggcgtg

SEQ ID NO: 39355 - DNA, 25 bp, Homo sapien
tgggctccttctacgaggcccacga

SEQ ID NO: 39356 - DNA, 25 bp, Homo sapien
cgcacattcaggctttagggcattg

SEQ ID NO: 39357 - DNA, 25 bp, Homo sapien
tcgtgacccgcacattcaggcttta

SEQ ID NO: 39358 - DNA, 25 bp, Homo sapien
ggccagtcgtgacccgcacattcag

SEQ ID NO: 39359 - DNA, 25 bp, Homo sapien
actcacaggggccagtcgtgacccg

SEQ ID NO: 39360 - DNA, 25 bp, Homo sapien
acattcaggctttagggcattgagc

SEQ ID NO: 39361 - DNA, 25 bp, Homo sapien
acgtgacctcggtaggctgagcccg

SEQ ID NO: 39362 - DNA, 25 bp, Homo sapien
cctgcagacgtgacctcggtaggct

SEQ ID NO: 39363 - DNA, 25 bp, Homo sapien
ccagaaggctgcctgcagacgtgac

SEQ ID NO: 39364 - DNA, 25 bp, Homo sapien
acaaattcctctctcgccggggttg

SEQ ID NO: 39365 - DNA, 25 bp, Homo sapien
aaagtccctctttcgagctagcgtc

SEQ ID NO: 39366 - DNA, 25 bp, Homo sapien
gtcacgcgctccaagttaccatttt

SEQ ID NO: 39367 - DNA, 25 bp, Homo sapien
ttttcttgctctcggtgccacggtt

SEQ ID NO: 39368 - DNA, 25 bp, Homo sapien
actcgcctagccacgggttagctcg

SEQ ID NO: 39369 - DNA, 25 bp, Homo sapien
aagaccgaccggcactgactcactg

SEQ ID NO: 39370 - DNA, 25 bp, Homo sapien
gccttcggtaatcctgggtcacaca

SEQ ID NO: 39371 - DNA, 25 bp, Homo sapien
cgcccggctcagagatgatgctcca

SEQ ID NO: 39372 - DNA, 25 bp, Homo sapien
gagcgctccctacttagtcctcagg

SEQ ID NO: 39373 - DNA, 25 bp, Homo sapien
ctacttagtcctcaggcgctgcggc

SEQ ID NO: 39374 - DNA, 25 bp, Homo sapien
cggcgcgtaccaagacgcggacgca

SEQ ID NO: 39375 - DNA, 25 bp, Homo sapien
gcctcgaacttggtacgcgccagcg

SEQ ID NO: 39376 - DNA, 25 bp, Homo sapien
agctagcgcggcgaactcctggagc

SEQ ID NO: 39377 - DNA, 25 bp, Homo sapien
ggttcgcgaccgcagccgagagacc

SEQ ID NO: 39378 - DNA, 25 bp, Homo sapien
cgccctctgaccacttggaagttta

SEQ ID NO: 39379 - DNA, 25 bp, Homo sapien
caggctcgcgatgcatcctctgaca

SEQ ID NO: 39380 - DNA, 25 bp, Homo sapien
ccggtgagtggctctactggctcga

SEQ ID NO: 39381 - DNA, 25 bp, Homo sapien
ctctactggctcgagtggccgcgca

SEQ ID NO: 39382 - DNA, 25 bp, Homo sapien
cgtgcagcgtcacccgaagcgtgca

SEQ ID NO: 39383 - DNA, 25 bp, Homo sapien
ctcggagtcgcagcgcggtcacact

SEQ ID NO: 39384 - DNA, 25 bp, Homo sapien
tctccttccttgctcggagtcgcag

SEQ ID NO: 39385 - DNA, 25 bp, Homo sapien
gatcgtctgatgacgcccactctct

SEQ ID NO: 39386 - DNA, 25 bp, Homo sapien
gagagcagcatcgtggatcgtctga

SEQ ID NO: 39387 - DNA, 25 bp, Homo sapien
gtacgcgggcgctgctgacctctac

SEQ ID NO: 39388 - DNA, 25 bp, Homo sapien
gaagccactcggctcttggctgaga

SEQ ID NO: 39389 - DNA, 25 bp, Homo sapien
tccagacgctgctgtcttgacctca

SEQ ID NO: 39390 - DNA, 25 bp, Homo sapien
cggtgacccctagcaaaccaatggc

SEQ ID NO: 39391 - DNA, 25 bp, Homo sapien
tggccggcaccacagaccgagaaga

SEQ ID NO: 39392 - DNA, 25 bp, Homo sapien
accacagaccgagaagaagccactc

SEQ ID NO: 39393 - DNA, 25 bp, Homo sapien
ccaggcgaatgcgagaggagcagct

SEQ ID NO: 39394 - DNA, 25 bp, Homo sapien
agaaagggacaagtgagtgcgcctc

SEQ ID NO: 39395 - DNA, 25 bp, Homo sapien
cactcggctcttggctgagaagcgg

SEQ ID NO: 39396 - DNA, 25 bp, Homo sapien
caacgctcgccttgtcttttgggaa

SEQ ID NO: 39397 - DNA, 25 bp, Homo sapien
cccgagcaacccacgtgaccgccga

SEQ ID NO: 39398 - DNA, 25 bp, Homo sapien
aaccgagcgcgtgacgcaaagcggc

SEQ ID NO: 39399 - DNA, 25 bp, Homo sapien
cgctcgccttgtcttttgggaaacg

SEQ ID NO: 39400 - DNA, 25 bp, Homo sapien
ggaaacgtagttctgatggcagcca

SEQ ID NO: 39401 - DNA, 25 bp, Homo sapien
tctgatggcagccaagtcggccagg

SEQ ID NO: 39402 - DNA, 25 bp, Homo sapien
gaggagggcgtaggactacatttcc

SEQ ID NO: 39403 - DNA, 25 bp, Homo sapien
tgaccgccgacaaccgagcgcgtga

SEQ ID NO: 39404 - DNA, 25 bp, Homo sapien
cggcgtgaaacggagcttgtcgtca

SEQ ID NO: 39405 - DNA, 25 bp, Homo sapien
ccagcggttacctgggccggaggct

SEQ ID NO: 39406 - DNA, 25 bp, Homo sapien
agctcgcagcccaccacgcggaggt

SEQ ID NO: 39407 - DNA, 25 bp, Homo sapien
tctctgtgtcggtgtcgaggccgct

SEQ ID NO: 39408 - DNA, 25 bp, Homo sapien
tgtcggtgtcgaggccgctcgacat

SEQ ID NO: 39409 - DNA, 25 bp, Homo sapien
acatggacggcgtgaaacggagctt

SEQ ID NO: 39410 - DNA, 25 bp, Homo sapien
gataccggccgcctggatgagctcg

SEQ ID NO: 39411 - DNA, 25 bp, Homo sapien
ccgctcgacatggacggcgtgaaac

SEQ ID NO: 39412 - DNA, 25 bp, Homo sapien
cggaagcatgtctgtccctagcgga

SEQ ID NO: 39413 - DNA, 25 bp, Homo sapien
gtgccattggttcggcccgcgacca

SEQ ID NO: 39414 - DNA, 25 bp, Homo sapien
ccgcctagccgcaattggctacata

SEQ ID NO: 39415 - DNA, 25 bp, Homo sapien
ggctacataacctgcccgtcagcaa

SEQ ID NO: 39416 - DNA, 25 bp, Homo sapien
ggcgtcgtgtcttcagtccttatcg

SEQ ID NO: 39417 - DNA, 25 bp, Homo sapien
gcgtattaacgccagactcctgcaa

SEQ ID NO: 39418 - DNA, 25 bp, Homo sapien
gcaaagtcttgccttcaacactcag

SEQ ID NO: 39419 - DNA, 25 bp, Homo sapien
cgactccagactttggggatgcgta

SEQ ID NO: 39420 - DNA, 25 bp, Homo sapien
taccctactgtcttgcctcaggtcg

SEQ ID NO: 39421 - DNA, 25 bp, Homo sapien
ccaaagatggtgcaaagtgaacttc

SEQ ID NO: 39422 - DNA, 25 bp, Homo sapien
tccggtgctaggtcatcctgccaaa

SEQ ID NO: 39423 - DNA, 25 bp, Homo sapien
ttggttctcgagtgcaatgctccgc

SEQ ID NO: 39424 - DNA, 25 bp, Homo sapien
ctgccctctacggtgcttggggaca

SEQ ID NO: 39425 - DNA, 25 bp, Homo sapien
aggctttgaggtggcctctctctgc

SEQ ID NO: 39426 - DNA, 25 bp, Homo sapien
gtgaacttcagctacagcccagagc

SEQ ID NO: 39427 - DNA, 25 bp, Homo sapien
tgcaaccgtggacatagcaagagcc

SEQ ID NO: 39428 - DNA, 25 bp, Homo sapien
ctgagtcactgagaatgcagctttc

SEQ ID NO: 39429 - DNA, 25 bp, Homo sapien
tcagtaatagtgcatgcggcccagg

SEQ ID NO: 39430 - DNA, 25 bp, Homo sapien
cccagcacgaagtagaggccgaagc

SEQ ID NO: 39431 - DNA, 25 bp, Homo sapien
gcgcccacgagatgctgatgacgag

SEQ ID NO: 39432 - DNA, 25 bp, Homo sapien
tcctccgccgacgtgaagacgttga

SEQ ID NO: 39433 - DNA, 25 bp, Homo sapien
cggtgcgccagatctcccgcaggat

SEQ ID NO: 39434 - DNA, 25 bp, Homo sapien
tagctctgagctcatgtgcaggtcc

SEQ ID NO: 39435 - DNA, 25 bp, Homo sapien
tttctgctggctgtgaagtgaatgc

SEQ ID NO: 39436 - DNA, 25 bp, Homo sapien
tcctacagctacgtggccgtgggca

SEQ ID NO: 39437 - DNA, 25 bp, Homo sapien
ggcgacctggacctgctggctcagc

SEQ ID NO: 39438 - DNA, 25 bp, Homo sapien
cgcccaggtatgtggcgtgccccag

SEQ ID NO: 39439 - DNA, 25 bp, Homo sapien
ctacagctacgtggccgtgggcagt

SEQ ID NO: 39440 - DNA, 25 bp, Homo sapien
tacactagggggtcctacagctacg

SEQ ID NO: 39441 - DNA, 25 bp, Homo sapien
ggtctcgctggcacagcgccccgta

SEQ ID NO: 39442 - DNA, 25 bp, Homo sapien
cccgcgcccaagagcgtcctgcggt

SEQ ID NO: 39443 - DNA, 25 bp, Homo sapien
ctacgtggccgtgggcagtactggg

SEQ ID NO: 39444 - DNA, 25 bp, Homo sapien
agctccgcggctgaaaagaacacca

SEQ ID NO: 39445 - DNA, 25 bp, Homo sapien
ttaaagctgtgtcccaaagcctagg

SEQ ID NO: 39446 - DNA, 25 bp, Homo sapien
gggccgctcagtcccttaaagctgt

SEQ ID NO: 39447 - DNA, 25 bp, Homo sapien
tggctggtcctccaaaggtttcaga

SEQ ID NO: 39448 - DNA, 25 bp, Homo sapien
catccggagtgcaggagattcctca

SEQ ID NO: 39449 - DNA, 25 bp, Homo sapien
ctctttcctttcagcgacactggga

SEQ ID NO: 39450 - DNA, 25 bp, Homo sapien
aggaaatggcatcgcttcaggaagg

SEQ ID NO: 39451 - DNA, 25 bp, Homo sapien
aagtttctctgaggtgtggggctcc

SEQ ID NO: 39452 - DNA, 25 bp, Homo sapien
tcgtactgggagcactcctccgtca

SEQ ID NO: 39453 - DNA, 25 bp, Homo sapien
tctcaaactcgtactgggagcactc

SEQ ID NO: 39454 - DNA, 25 bp, Homo sapien
gctgacgcatgtagttctcaaactc

SEQ ID NO: 39455 - DNA, 25 bp, Homo sapien
cagctgctgacgcatgtagttctca

SEQ ID NO: 39456 - DNA, 25 bp, Homo sapien
ggcgtcatggatggagctcttctcc

SEQ ID NO: 39457 - DNA, 25 bp, Homo sapien
cgcttgggtacccagctccgggcgt

SEQ ID NO: 39458 - DNA, 25 bp, Homo sapien
tcgcaccggtggtgcgctgccgaac

SEQ ID NO: 39459 - DNA, 25 bp, Homo sapien
ctgcgccaggatggccgtgtccaag

SEQ ID NO: 39460 - DNA, 25 bp, Homo sapien
ttcgcccatagtccgtagcccagag

SEQ ID NO: 39461 - DNA, 25 bp, Homo sapien
cgccgccacctgacaacggaagtga

SEQ ID NO: 39462 - DNA, 25 bp, Homo sapien
ctgggcgaaacctgttacacgattg

SEQ ID NO: 39463 - DNA, 25 bp, Homo sapien
ccgaggctctaatggggcggtactt

SEQ ID NO: 39464 - DNA, 25 bp, Homo sapien
tggcttcaggctgtcactccgattc

SEQ ID NO: 39465 - DNA, 25 bp, Homo sapien
gggcggtacttactgctgatctata

SEQ ID NO: 39466 - DNA, 25 bp, Homo sapien
cggggccatttctgctgcactcaga

SEQ ID NO: 39467 - DNA, 25 bp, Homo sapien
gggtggtcagagctattcgcccata

SEQ ID NO: 39468 - DNA, 25 bp, Homo sapien
gctgcagcaggacggagaaaccatg

SEQ ID NO: 39469 - DNA, 25 bp, Homo sapien
gctatactcggtaaatggggaagaa

SEQ ID NO: 39470 - DNA, 25 bp, Homo sapien
ggacggagaaaccatgccggcgacc

SEQ ID NO: 39471 - DNA, 25 bp, Homo sapien
agagtgcgtcagtgctctgcaagtc

SEQ ID NO: 39472 - DNA, 25 bp, Homo sapien
cagtgctctgcaagtcaccgcgtca

SEQ ID NO: 39473 - DNA, 25 bp, Homo sapien
accgcgtcacggagaaactacaatc

SEQ ID NO: 39474 - DNA, 25 bp, Homo sapien
ggggctcgtgctccgcaaatcccgg

SEQ ID NO: 39475 - DNA, 25 bp, Homo sapien
ggaaaggagctatactcggtaaatg

SEQ ID NO: 39476 - DNA, 25 bp, Homo sapien
gtgcttctgagagtaggtttccctc

SEQ ID NO: 39477 - DNA, 25 bp, Homo sapien
ccctgaagacgggagctaattggtc

SEQ ID NO: 39478 - DNA, 25 bp, Homo sapien
cgggccttgtctcccgggatgttct

SEQ ID NO: 39479 - DNA, 25 bp, Homo sapien
cgcagcgtcccaatagtccggttgc

SEQ ID NO: 39480 - DNA, 25 bp, Homo sapien
ccgacatggtgctggaaacgagctg

SEQ ID NO: 39481 - DNA, 25 bp, Homo sapien
gggcctctcacctttgcgggccttg

SEQ ID NO: 39482 - DNA, 25 bp, Homo sapien
ccgcccaagttcaagaagagcagcg

SEQ ID NO: 39483 - DNA, 25 bp, Homo sapien
ccgttggtcgaggatgtaaagcatc

SEQ ID NO: 39484 - DNA, 25 bp, Homo sapien
gggctgaggaccatctccttaaata

SEQ ID NO: 39485 - DNA, 25 bp, Homo sapien
tggttgtgtgcccacgtttagcagc

SEQ ID NO: 39486 - DNA, 25 bp, Homo sapien
ccgccacggtctatgcgcttctgaa

SEQ ID NO: 39487 - DNA, 25 bp, Homo sapien
gcgaccctcagcatggtgacctcta

SEQ ID NO: 39488 - DNA, 25 bp, Homo sapien
tcgaccaatcgaggcagttgcaata

SEQ ID NO: 39489 - DNA, 25 bp, Homo sapien
catgctggcccaggatcgaccaatc

SEQ ID NO: 39490 - DNA, 25 bp, Homo sapien
tgcccgggtccgaatcaaactcagc

SEQ ID NO: 39491 - DNA, 25 bp, Homo sapien
tgactctgatgacgcaacgcacggg

SEQ ID NO: 39492 - DNA, 25 bp, Homo sapien
gctgccctcgtcatgcgaatctgtg

SEQ ID NO: 39493 - DNA, 25 bp, Homo sapien
agcgcttaccgatccggatgacgtg

SEQ ID NO: 39494 - DNA, 25 bp, Homo sapien
aggaaaatctctccggaacgcgttg

SEQ ID NO: 39495 - DNA, 25 bp, Homo sapien
tattcccaaaccagactccggaggc

SEQ ID NO: 39496 - DNA, 25 bp, Homo sapien
tcgactcgggatcgcactggaaacc

SEQ ID NO: 39497 - DNA, 25 bp, Homo sapien
gtggtcaccgatcggctcagcagct

SEQ ID NO: 39498 - DNA, 25 bp, Homo sapien
gcggagaagcccgatcgcagaactc

SEQ ID NO: 39499 - DNA, 25 bp, Homo sapien
cttcgccacactgtgccaggtctga

SEQ ID NO: 39500 - DNA, 25 bp, Homo sapien
atgcctgttcgcctttaatctgtta

SEQ ID NO: 39501 - DNA, 25 bp, Homo sapien
cctctgtgacaggttcaagctctca

SEQ ID NO: 39502 - DNA, 25 bp, Homo sapien
agcttcccgcctgtgtgagacattg

SEQ ID NO: 39503 - DNA, 25 bp, Homo sapien
tggctgcacatttacggggaacgac

SEQ ID NO: 39504 - DNA, 25 bp, Homo sapien
agaggtgcaatccatccgaaaaggc

SEQ ID NO: 39505 - DNA, 25 bp, Homo sapien
ctccatcacgggaagaatgttttta

SEQ ID NO: 39506 - DNA, 25 bp, Homo sapien
cgtggccctttctcaggagagcaga

SEQ ID NO: 39507 - DNA, 25 bp, Homo sapien
ccgtaatgggatccttgcagtcgta

SEQ ID NO: 39508 - DNA, 25 bp, Homo sapien
caccaggttcctgatcgggatcgcg

SEQ ID NO: 39509 - DNA, 25 bp, Homo sapien
ctgattcactcgatgcgcacctggc

SEQ ID NO: 39510 - DNA, 25 bp, Homo sapien
ccggcaggtgcgtgtacctgattca

SEQ ID NO: 39511 - DNA, 25 bp, Homo sapien
cacctggccgtacgtagcttcatca

SEQ ID NO: 39512 - DNA, 25 bp, Homo sapien
caagttcttaggtccgagtgttcgc

SEQ ID NO: 39513 - DNA, 25 bp, Homo sapien
gcagggtgtacctgtcaagttctta

SEQ ID NO: 39514 - DNA, 25 bp, Homo sapien
ttatcttgcgcatacgggccgttca

SEQ ID NO: 39515 - DNA, 25 bp, Homo sapien
gttcgcggctttacctgtcctggta

SEQ ID NO: 39516 - DNA, 25 bp, Homo sapien
tcagcacctcctggatccgaaagta

SEQ ID NO: 39517 - DNA, 25 bp, Homo sapien
ggtccacgcttacggtcctcatgtt

SEQ ID NO: 39518 - DNA, 25 bp, Homo sapien
tcaggtatcgggctttggtgcattt

SEQ ID NO: 39519 - DNA, 25 bp, Homo sapien
ccgccaacctgtagcagcgattttt

SEQ ID NO: 39520 - DNA, 25 bp, Homo sapien
attcgcggacgatggataaacagca

SEQ ID NO: 39521 - DNA, 25 bp, Homo sapien
taaacagcagcgcacgcggaccgtc

SEQ ID NO: 39522 - DNA, 25 bp, Homo sapien
gaacggatgtcccacagtttgcctg

SEQ ID NO: 39523 - DNA, 25 bp, Homo sapien
ggtgcatttcacaaaggctcgaatc

SEQ ID NO: 39524 - DNA, 25 bp, Homo sapien
gttgtgcatcgccatgttgggctga

SEQ ID NO: 39525 - DNA, 25 bp, Homo sapien
ccggagtaacaaacggcctagcgcg

SEQ ID NO: 39526 - DNA, 25 bp, Homo sapien
cgccttgttgtgcatcgccatgttg

SEQ ID NO: 39527 - DNA, 25 bp, Homo sapien
cagcgccgtgccgagcttcgctaag

SEQ ID NO: 39528 - DNA, 25 bp, Homo sapien
gagcttcgctaaggccggggctctc

SEQ ID NO: 39529 - DNA, 25 bp, Homo sapien
ggggctctcgaaggtccttctcgga

SEQ ID NO: 39530 - DNA, 25 bp, Homo sapien
ctagagatgcggcttctgctttctg

SEQ ID NO: 39531 - DNA, 25 bp, Homo sapien
cttctcggagagctctagagatgcg

SEQ ID NO: 39532 - DNA, 25 bp, Homo sapien
ctgcggcgtcatcctgttcgccttg

SEQ ID NO: 39533 - DNA, 25 bp, Homo sapien
gactgccagagtctgctacggggca

SEQ ID NO: 39534 - DNA, 25 bp, Homo sapien
ggcgtgttccacatgccgcacttta

SEQ ID NO: 39535 - DNA, 25 bp, Homo sapien
cgatgacaacttgcgacagctgctg

SEQ ID NO: 39536 - DNA, 25 bp, Homo sapien
ctgttcgccttgctggtggtgagac

SEQ ID NO: 39537 - DNA, 25 bp, Homo sapien
agcccgggcactgctgtccacaggg

SEQ ID NO: 39538 - DNA, 25 bp, Homo sapien
ccaggtgctgctaggctgcctgtcc

SEQ ID NO: 39539 - DNA, 25 bp, Homo sapien
tctgcccttcgacgatgacaacttg

SEQ ID NO: 39540 - DNA, 25 bp, Homo sapien
ggccggctcgctggtcggcggagac

SEQ ID NO: 39541 - DNA, 25 bp, Homo sapien
gagacgggctaccaccggagtggtc

SEQ ID NO: 39542 - DNA, 25 bp, Homo sapien
caccggagtggtccggacggcggtg

SEQ ID NO: 39543 - DNA, 25 bp, Homo sapien
gggaggtgcgacttctgggctgaga

SEQ ID NO: 39544 - DNA, 25 bp, Homo sapien
gggctgagacgctcctgcttcacca

SEQ ID NO: 39545 - DNA, 25 bp, Homo sapien
tcccggtgtcttcgccggctccctc

SEQ ID NO: 39546 - DNA, 25 bp, Homo sapien
cctcgctcccgttcgctcttcaccg

SEQ ID NO: 39547 - DNA, 25 bp, Homo sapien
ctggtcggcggagacgggctaccac

SEQ ID NO: 39548 - DNA, 25 bp, Homo sapien
ctggtgagccggaacacggagaaac

SEQ ID NO: 39549 - DNA, 25 bp, Homo sapien
gaagctccgcccaggccaagaagcg

SEQ ID NO: 39550 - DNA, 25 bp, Homo sapien
ggagacaaaggagcctcgaaactcc

SEQ ID NO: 39551 - DNA, 25 bp, Homo sapien
cccagtgctggtgagccggaacacg

SEQ ID NO: 39552 - DNA, 25 bp, Homo sapien
ccgcagactctttgctcaagtacga

SEQ ID NO: 39553 - DNA, 25 bp, Homo sapien
tccgccatgattccgcccgcagact

SEQ ID NO: 39554 - DNA, 25 bp, Homo sapien
gcaaacaaggcccacactggacagg

SEQ ID NO: 39555 - DNA, 25 bp, Homo sapien
agctgctgggttgctactctcgcct

SEQ ID NO: 39556 - DNA, 25 bp, Homo sapien
gaggtccggcttacgtggtgaaaca

SEQ ID NO: 39557 - DNA, 25 bp, Homo sapien
tctcggcctcagagcgacttcctgt

SEQ ID NO: 39558 - DNA, 25 bp, Homo sapien
acgtgtgcacgacgtacgtcacttc

SEQ ID NO: 39559 - DNA, 25 bp, Homo sapien
agcgacttcctgtgaacgcgcggcg

SEQ ID NO: 39560 - DNA, 25 bp, Homo sapien
gcaaccgccaagctgcccgttcata

SEQ ID NO: 39561 - DNA, 25 bp, Homo sapien
gcccgttcatagcaaccgcctagtt

SEQ ID NO: 39562 - DNA, 25 bp, Homo sapien
accgcctagttaacctgaacgcgcg

SEQ ID NO: 39563 - DNA, 25 bp, Homo sapien
ccggaccacgtgtgcacgacgtacg

SEQ ID NO: 39564 - DNA, 25 bp, Homo sapien
agttgctcaatctgcggacggctca

SEQ ID NO: 39565 - DNA, 25 bp, Homo sapien
gaaaaaatggactggagcgccggcc

SEQ ID NO: 39566 - DNA, 25 bp, Homo sapien
ccagtcctctgcgagcaccagggag

SEQ ID NO: 39567 - DNA, 25 bp, Homo sapien
aggggactcaccttcgtgctgccag

SEQ ID NO: 39568 - DNA, 25 bp, Homo sapien
tcgccgaccggagagcgatcagact

SEQ ID NO: 39569 - DNA, 25 bp, Homo sapien
ttcaggactgcgagtgaggatgatc

SEQ ID NO: 39570 - DNA, 25 bp, Homo sapien
gggagtccacacgtccttgcccgaa

SEQ ID NO: 39571 - DNA, 25 bp, Homo sapien
tccagggatccgcaagaaaaaatgg

SEQ ID NO: 39572 - DNA, 25 bp, Homo sapien
gtcgcgaaaatatatcgtagtgccg

SEQ ID NO: 39573 - DNA, 25 bp, Homo sapien
caagcgccgtctcttctctgacata

SEQ ID NO: 39574 - DNA, 25 bp, Homo sapien
gcctggctactgagtcgcgaaaata

SEQ ID NO: 39575 - DNA, 25 bp, Homo sapien
taaaagtccagacagccaaagcgtg

SEQ ID NO: 39576 - DNA, 25 bp, Homo sapien
gcgtgagaaccctccagggactgca

SEQ ID NO: 39577 - DNA, 25 bp, Homo sapien
cacagtctctctgcgcatgctcaca

SEQ ID NO: 39578 - DNA, 25 bp, Homo sapien
ccacaaagctactccgcgggcctgc

SEQ ID NO: 39579 - DNA, 25 bp, Homo sapien
ttctctgacatacagtcctgtctcc

SEQ ID NO: 39580 - DNA, 25 bp, Homo sapien
ccagccctccagagcttggggtatt

SEQ ID NO: 39581 - DNA, 25 bp, Homo sapien
agcgccactacttgcacctgaagtc

SEQ ID NO: 39582 - DNA, 25 bp, Homo sapien
cagccagtcaatcagtcagagggtc

SEQ ID NO: 39583 - DNA, 25 bp, Homo sapien
agtttgtatagttcgcagccggcca

SEQ ID NO: 39584 - DNA, 25 bp, Homo sapien
acagcgaggttttgctcagcccttg

SEQ ID NO: 39585 - DNA, 25 bp, Homo sapien
tcgggtggccaagaccaactcctta

SEQ ID NO: 39586 - DNA, 25 bp, Homo sapien
gcggaagctcgcctcctttctgaaa

SEQ ID NO: 39587 - DNA, 25 bp, Homo sapien
gcctcgctgtcgcactcaggctata

SEQ ID NO: 39588 - DNA, 25 bp, Homo sapien
gcactcaccttctcgtagtatcgga

SEQ ID NO: 39589 - DNA, 25 bp, Homo sapien
ctcgtagtatcggatctcgtactcc

SEQ ID NO: 39590 - DNA, 25 bp, Homo sapien
atctcgtactccgtgtcattggccc

SEQ ID NO: 39591 - DNA, 25 bp, Homo sapien
atgggctcccgccacgacagggaca

SEQ ID NO: 39592 - DNA, 25 bp, Homo sapien
cccagggcgctgaaagtaagttacg

SEQ ID NO: 39593 - DNA, 25 bp, Homo sapien
agttacgtgggattctccaccttga

SEQ ID NO: 39594 - DNA, 25 bp, Homo sapien
ttgacccacctcacggcagggctgg

SEQ ID NO: 39595 - DNA, 25 bp, Homo sapien
acagggacacgctctggggttccac

SEQ ID NO: 39596 - DNA, 25 bp, Homo sapien
cggctcaggctgtactgcaggtccc

SEQ ID NO: 39597 - DNA, 25 bp, Homo sapien
agcgcagtcgcagcaccagcggcga

SEQ ID NO: 39598 - DNA, 25 bp, Homo sapien
agtccaggagaaaagcgagcacaca

SEQ ID NO: 39599 - DNA, 25 bp, Homo sapien
ggtgcttcccgcagacgcaacagaa

SEQ ID NO: 39600 - DNA, 25 bp, Homo sapien
tctggcccagtagtaaggggacgcc

SEQ ID NO: 39601 - DNA, 25 bp, Homo sapien
ctctcgcacactcgggagggcgact

SEQ ID NO: 39602 - DNA, 25 bp, Homo sapien
gtgcgtgtacagaggatggcttctc

SEQ ID NO: 39603 - DNA, 25 bp, Homo sapien
acagaggctttgtgcaaggagtcca

SEQ ID NO: 39604 - DNA, 25 bp, Homo sapien
cctggatcaggccttccttcttggc

SEQ ID NO: 39605 - DNA, 25 bp, Homo sapien
tgtgctctgggcacggtgagcagag

SEQ ID NO: 39606 - DNA, 25 bp, Homo sapien
tagctgtcctggcacacgcagaagg

SEQ ID NO: 39607 - DNA, 25 bp, Homo sapien
gcatagctgtcctggcacacgcaga

SEQ ID NO: 39608 - DNA, 25 bp, Homo sapien
gcgcgcatagctgtcctggcacacg

SEQ ID NO: 39609 - DNA, 25 bp, Homo sapien
tgtcctggcacacgcagaaggtgga

SEQ ID NO: 39610 - DNA, 25 bp, Homo sapien
aggccttccttcttggccactccca

SEQ ID NO: 39611 - DNA, 25 bp, Homo sapien
gatcaggccttccttcttggccact

SEQ ID NO: 39612 - DNA, 25 bp, Homo sapien
agcagctcggccacccgcgagtgtc

SEQ ID NO: 39613 - DNA, 25 bp, Homo sapien
gttgctgccaccagcatgaagccga

SEQ ID NO: 39614 - DNA, 25 bp, Homo sapien
cccggtggcacgtctctggggatcc

SEQ ID NO: 39615 - DNA, 25 bp, Homo sapien
gctcagggccttcgtgcctggacac

SEQ ID NO: 39616 - DNA, 25 bp, Homo sapien
ctggcggagagtctgttgctgccac

SEQ ID NO: 39617 - DNA, 25 bp, Homo sapien
ggctacaccggaggggcacagccgg

SEQ ID NO: 39618 - DNA, 25 bp, Homo sapien
tggtctccacgggacggggctacac

SEQ ID NO: 39619 - DNA, 25 bp, Homo sapien
ccacccgcgagtgtccgtgccaggc

SEQ ID NO: 39620 - DNA, 25 bp, Homo sapien
cgagttcaatgagaccggtttccgc

SEQ ID NO: 39621 - DNA, 25 bp, Homo sapien
cttcgtgttccagacgggcctctaa

SEQ ID NO: 39622 - DNA, 25 bp, Homo sapien
aatggctgcgaaggttgttgctccc

SEQ ID NO: 39623 - DNA, 25 bp, Homo sapien
atagacgcccggctgcccttacaag

SEQ ID NO: 39624 - DNA, 25 bp, Homo sapien
gtaggcctggctccaataacgaagg

SEQ ID NO: 39625 - DNA, 25 bp, Homo sapien
ctttaagccggtagaaggagccgca

SEQ ID NO: 39626 - DNA, 25 bp, Homo sapien
tgccggctgcaaccaaataccgctg

SEQ ID NO: 39627 - DNA, 25 bp, Homo sapien
ctcaccgcagcgttctggaactttc

SEQ ID NO: 39628 - DNA, 25 bp, Homo sapien
tccagccagtctgcagccagttgtc

SEQ ID NO: 39629 - DNA, 25 bp, Homo sapien
tgaactgcagttccacgaagatgcg

SEQ ID NO: 39630 - DNA, 25 bp, Homo sapien
ctcagtttccaggtagtagacgttg

SEQ ID NO: 39631 - DNA, 25 bp, Homo sapien
tccgccgcgatcgtgtcgattttgc

SEQ ID NO: 39632 - DNA, 25 bp, Homo sapien
gcgcacctctgtgttcagcttcatc

SEQ ID NO: 39633 - DNA, 25 bp, Homo sapien
tccaccagtgtggagaaggcgctct

SEQ ID NO: 39634 - DNA, 25 bp, Homo sapien
ggctccagcacattgcacacttggt

SEQ ID NO: 39635 - DNA, 25 bp, Homo sapien
gcactgcttgtagtagacgcgcacc

SEQ ID NO: 39636 - DNA, 25 bp, Homo sapien
atgacgcctctggattcaactgagc

SEQ ID NO: 39637 - DNA, 25 bp, Homo sapien
gctttccgagatccgcgcaactgac

SEQ ID NO: 39638 - DNA, 25 bp, Homo sapien
cctccggattctgcacctagatatg

SEQ ID NO: 39639 - DNA, 25 bp, Homo sapien
cgcccggcagactacgctcagaatt

SEQ ID NO: 39640 - DNA, 25 bp, Homo sapien
ttccatgatcagcacgtcgggcagc

SEQ ID NO: 39641 - DNA, 25 bp, Homo sapien
tccaccttctgttggccacactgtg

SEQ ID NO: 39642 - DNA, 25 bp, Homo sapien
tttggtatgccacgctccgagcaga

SEQ ID NO: 39643 - DNA, 25 bp, Homo sapien
tcggaatcgcgaactggaaggcatc

SEQ ID NO: 39644 - DNA, 25 bp, Homo sapien
ttcactgggaccacgtcatggtgcc

SEQ ID NO: 39645 - DNA, 25 bp, Homo sapien
gcgagggccactacattcactggga

SEQ ID NO: 39646 - DNA, 25 bp, Homo sapien
gccttctactactcgtggtacggga

SEQ ID NO: 39647 - DNA, 25 bp, Homo sapien
ttcggcaccctcatgggtctgcgca

SEQ ID NO: 39648 - DNA, 25 bp, Homo sapien
ctgcatcgctctgttcctggtgctg

SEQ ID NO: 39649 - DNA, 25 bp, Homo sapien
cgaaactcgccgttcgctgggcctt

SEQ ID NO: 39650 - DNA, 25 bp, Homo sapien
atccttggggagagaaccaccgacg

SEQ ID NO: 39651 - DNA, 25 bp, Homo sapien
caggcgactcttctttcgcgggtca

SEQ ID NO: 39652 - DNA, 25 bp, Homo sapien
cttacctgtagacgtcggccacgcg

SEQ ID NO: 39653 - DNA, 25 bp, Homo sapien
ctctgcgccgggcagcttaaaggga

SEQ ID NO: 39654 - DNA, 25 bp, Homo sapien
gctgcgacccttgaggcggtacaca

SEQ ID NO: 39655 - DNA, 25 bp, Homo sapien
aggccaggccgtacagcgtatcggt

SEQ ID NO: 39656 - DNA, 25 bp, Homo sapien
agccagcttccggtccaggagactc

SEQ ID NO: 39657 - DNA, 25 bp, Homo sapien
cagcctgcgaggagatgttacggca

SEQ ID NO: 39658 - DNA, 25 bp, Homo sapien
ttgcgaagccctaacgcagcgctgg

SEQ ID NO: 39659 - DNA, 25 bp, Homo sapien
gaggaagtgacgctcccagccagct

SEQ ID NO: 39660 - DNA, 25 bp, Homo sapien
ccaggccgagtctagtttcgccttt

SEQ ID NO: 39661 - DNA, 25 bp, Homo sapien
taagagtattctaagcccagctgga

SEQ ID NO: 39662 - DNA, 25 bp, Homo sapien
cccaaaggcagaactaagagtattc

SEQ ID NO: 39663 - DNA, 25 bp, Homo sapien
cccatcaaagttaacacaggcagga

SEQ ID NO: 39664 - DNA, 25 bp, Homo sapien
cagttggcagtcagaaccctggctc

SEQ ID NO: 39665 - DNA, 25 bp, Homo sapien
agaatccgaaatgtcctcagccagg

SEQ ID NO: 39666 - DNA, 25 bp, Homo sapien
cagcctccaattggcgagcggggca

SEQ ID NO: 39667 - DNA, 25 bp, Homo sapien
tcaccgttcacattgtcctgctggc

SEQ ID NO: 39668 - DNA, 25 bp, Homo sapien
agctctgcgcacctataccgagaca

SEQ ID NO: 39669 - DNA, 25 bp, Homo sapien
gccgagttacaaccgcgcggcgttg

SEQ ID NO: 39670 - DNA, 25 bp, Homo sapien
tggccaggtaactagggccgagtta

SEQ ID NO: 39671 - DNA, 25 bp, Homo sapien
aattgtcgcgtaccctggccaggta

SEQ ID NO: 39672 - DNA, 25 bp, Homo sapien
ggatacctgcctccgccaattgtcg

SEQ ID NO: 39673 - DNA, 25 bp, Homo sapien
gtgtgcccgctccatcaatcgaaag

SEQ ID NO: 39674 - DNA, 25 bp, Homo sapien
gaacctgcagtgttgcgctcccgag

SEQ ID NO: 39675 - DNA, 25 bp, Homo sapien
caggaattcaggatcccgggtcgca

SEQ ID NO: 39676 - DNA, 25 bp, Homo sapien
tgcgcatcaggctgcaccaaagttc

SEQ ID NO: 39677 - DNA, 25 bp, Homo sapien
ttctggagtagaaaaggccgcccga

SEQ ID NO: 39678 - DNA, 25 bp, Homo sapien
gttctgagggccaaagcaagctctc

SEQ ID NO: 39679 - DNA, 25 bp, Homo sapien
gctctcagaggtcaaacacgggata

SEQ ID NO: 39680 - DNA, 25 bp, Homo sapien
cgtggacttcttggtgagcatctct

SEQ ID NO: 39681 - DNA, 25 bp, Homo sapien
gagccgttccttctcctcatgatag

SEQ ID NO: 39682 - DNA, 25 bp, Homo sapien
cttagtcgcggcttctcaattcaga

SEQ ID NO: 39683 - DNA, 25 bp, Homo sapien
cgccgttagtttgcgttctggagta

SEQ ID NO: 39684 - DNA, 25 bp, Homo sapien
gcgtgacccattcatgccgggaatc

SEQ ID NO: 39685 - DNA, 25 bp, Homo sapien
tgccgggaatcggatccagatgttc

SEQ ID NO: 39686 - DNA, 25 bp, Homo sapien
tttggcaaaaaacgtgcggccgcga

SEQ ID NO: 39687 - DNA, 25 bp, Homo sapien
tcggatccagatgttcccgcggcgt

SEQ ID NO: 39688 - DNA, 25 bp, Homo sapien
gtgtgcagctgcatccttgcctttt

SEQ ID NO: 39689 - DNA, 25 bp, Homo sapien
gcatccttgccttttttggcaaaaa

SEQ ID NO: 39690 - DNA, 25 bp, Homo sapien
ggcgccactgtgtgcgcatacctgc

SEQ ID NO: 39691 - DNA, 25 bp, Homo sapien
cacccttgacttgaatcactgttgg

SEQ ID NO: 39692 - DNA, 25 bp, Homo sapien
cccggtgtgtccttgtttcagtggt

SEQ ID NO: 39693 - DNA, 25 bp, Homo sapien
ccttgtttcagtggtctcggtagcc

SEQ ID NO: 39694 - DNA, 25 bp, Homo sapien
ctcggtagcctcctgtgcctcgagt

SEQ ID NO: 39695 - DNA, 25 bp, Homo sapien
tttccgagaacctcagtttctccag

SEQ ID NO: 39696 - DNA, 25 bp, Homo sapien
gctgccgactgcagacggaccgtgt

SEQ ID NO: 39697 - DNA, 25 bp, Homo sapien
ctcagtttctccagcgcttctggtc

SEQ ID NO: 39698 - DNA, 25 bp, Homo sapien
tccagcgcttctggtcggtcggtct

SEQ ID NO: 39699 - DNA, 25 bp, Homo sapien
tctctccggcttttctatttcaaac

SEQ ID NO: 39700 - DNA, 25 bp, Homo sapien
gctaggcctatttccggtaggaatc

SEQ ID NO: 39701 - DNA, 25 bp, Homo sapien
cctttgtcgccatgtgttacccttg

SEQ ID NO: 39702 - DNA, 25 bp, Homo sapien
tccggcgttctccactgatcttttc

SEQ ID NO: 39703 - DNA, 25 bp, Homo sapien
aagccggctccggataggttgctta

SEQ ID NO: 39704 - DNA, 25 bp, Homo sapien
tgcggtgactgcctctgttaaatga

SEQ ID NO: 39705 - DNA, 25 bp, Homo sapien
cgctagcgaataagaactggctctt

SEQ ID NO: 39706 - DNA, 25 bp, Homo sapien
gccgagctgtaagtgactgcacatg

SEQ ID NO: 39707 - DNA, 25 bp, Homo sapien
ggatccgggtccaaactgtatagta

SEQ ID NO: 39708 - DNA, 25 bp, Homo sapien
gctaccgcttcgtggaacacttttc

SEQ ID NO: 39709 - DNA, 25 bp, Homo sapien
ctttcccggacgcagggctgcgttt

SEQ ID NO: 39710 - DNA, 25 bp, Homo sapien
ggaaccacatggttgcctcctaccg

SEQ ID NO: 39711 - DNA, 25 bp, Homo sapien
ctgaaaagccggctgactccagggg

SEQ ID NO: 39712 - DNA, 25 bp, Homo sapien
cagaggcactcacctagcaagagga

SEQ ID NO: 39713 - DNA, 25 bp, Homo sapien
ctcggttgccagatgtgctcctccg

SEQ ID NO: 39714 - DNA, 25 bp, Homo sapien
cgagacaatctcgatggccgactgg

SEQ ID NO: 39715 - DNA, 25 bp, Homo sapien
gcgaggcgaaaaggcgctaccgctt

SEQ ID NO: 39716 - DNA, 25 bp, Homo sapien
aacgtgagatgaccgccgtgtggta

SEQ ID NO: 39717 - DNA, 25 bp, Homo sapien
tgaccgccgtgtggtaaactgatga

SEQ ID NO: 39718 - DNA, 25 bp, Homo sapien
cccgaccctgatgaacgtgagatga

SEQ ID NO: 39719 - DNA, 25 bp, Homo sapien
gatgaccgccgtgtggtaaactgat

SEQ ID NO: 39720 - DNA, 25 bp, Homo sapien
ccgccgtgtggtaaactgatgaacc

SEQ ID NO: 39721 - DNA, 25 bp, Homo sapien
aacatgagatgaccgccgtgtggta

SEQ ID NO: 39722 - DNA, 25 bp, Homo sapien
cccgaccctgatcaacatgagatga

SEQ ID NO: 39723 - DNA, 25 bp, Homo sapien
accgccgtgtggtaaactgatgaac

SEQ ID NO: 39724 - DNA, 25 bp, Homo sapien
gcctcagccctgacgtgcccagggt

SEQ ID NO: 39725 - DNA, 25 bp, Homo sapien
gacacagcgcccatgctgccccggg

SEQ ID NO: 39726 - DNA, 25 bp, Homo sapien
gccactcgagggtgagcctgtgccc

SEQ ID NO: 39727 - DNA, 25 bp, Homo sapien
ctgtgccactcgagggtgagcctgt

SEQ ID NO: 39728 - DNA, 25 bp, Homo sapien
tcctgtgccactcgagggtgagcct

SEQ ID NO: 39729 - DNA, 25 bp, Homo sapien
attcctgtgccactcgagggtgagc

SEQ ID NO: 39730 - DNA, 25 bp, Homo sapien
ggattcctgtgccactcgagggtga

SEQ ID NO: 39731 - DNA, 25 bp, Homo sapien
tgggattcctgtgccactcgagggt

SEQ ID NO: 39732 - DNA, 25 bp, Homo sapien
actcgtggtgcatcagcttctgcac

SEQ ID NO: 39733 - DNA, 25 bp, Homo sapien
cgccgcgatcttgtccaggttggtg

SEQ ID NO: 39734 - DNA, 25 bp, Homo sapien
tccaggtcgtccgagctgggcgcat

SEQ ID NO: 39735 - DNA, 25 bp, Homo sapien
ctgggcgcatcctcgtccgagtgct

SEQ ID NO: 39736 - DNA, 25 bp, Homo sapien
ccatcctcgtgcagcgcgtggtgca

SEQ ID NO: 39737 - DNA, 25 bp, Homo sapien
ctgccgctggacgagtcggtctcct

SEQ ID NO: 39738 - DNA, 25 bp, Homo sapien
gcctgccttgccgtgttctaggtgc

SEQ ID NO: 39739 - DNA, 25 bp, Homo sapien
tcagcttctgcacttcgcggtacgc

SEQ ID NO: 39740 - DNA, 25 bp, Homo sapien
atccagggtaactgcggcccacttt

SEQ ID NO: 39741 - DNA, 25 bp, Homo sapien
ggaatgttttcccagcgattcactg

SEQ ID NO: 39742 - DNA, 25 bp, Homo sapien
ttgcacacaaagacccggggtccgc

SEQ ID NO: 39743 - DNA, 25 bp, Homo sapien
ggtcccggtgggaaatttgcacaca

SEQ ID NO: 39744 - DNA, 25 bp, Homo sapien
cgctgctgcggacaaatctttcatt

SEQ ID NO: 39745 - DNA, 25 bp, Homo sapien
agctaggtgagacgcgtcccagaag

SEQ ID NO: 39746 - DNA, 25 bp, Homo sapien
cttgttaggccaactccggactcta

SEQ ID NO: 39747 - DNA, 25 bp, Homo sapien
gcgattcactgacgggcctttcatt

SEQ ID NO: 39748 - DNA, 25 bp, Homo sapien
attcactttgccgtcacctctcggg

SEQ ID NO: 39749 - DNA, 25 bp, Homo sapien
tcggctgcgcgctaattcactttgc

SEQ ID NO: 39750 - DNA, 25 bp, Homo sapien
tgtgcaaatatcaggccgggaagtg

SEQ ID NO: 39751 - DNA, 25 bp, Homo sapien
gccctgagagcactttgtgcaaata

SEQ ID NO: 39752 - DNA, 25 bp, Homo sapien
cccggccaagtgcaaatgtaaagag

SEQ ID NO: 39753 - DNA, 25 bp, Homo sapien
tcaaacacaggatgcgagcgccctt

SEQ ID NO: 39754 - DNA, 25 bp, Homo sapien
cgcggccctgcctaatggagcaaaa

SEQ ID NO: 39755 - DNA, 25 bp, Homo sapien
tcgcgctcggcggaaacgctaactc

SEQ ID NO: 39756 - DNA, 25 bp, Homo sapien
tcgccatccacctggggacaaccta

SEQ ID NO: 39757 - DNA, 25 bp, Homo sapien
gcaagtcggtaaccgcgctgtgctc

SEQ ID NO: 39758 - DNA, 25 bp, Homo sapien
caggtggcacgacccgtctgtgcag

SEQ ID NO: 39759 - DNA, 25 bp, Homo sapien
tcggcgatgcagctaagaaccagct

SEQ ID NO: 39760 - DNA, 25 bp, Homo sapien
ctgatcggcgatgcagctaagaacc

SEQ ID NO: 39761 - DNA, 25 bp, Homo sapien
acatgggcacggtggtcgccatcca

SEQ ID NO: 39762 - DNA, 25 bp, Homo sapien
ttcgtgaatgtgagaggtaagcgcc

SEQ ID NO: 39763 - DNA, 25 bp, Homo sapien
gccgcggcctgcatttccagagctg

SEQ ID NO: 39764 - DNA, 25 bp, Homo sapien
ggcgccgcattagcatctccgaagc

SEQ ID NO: 39765 - DNA, 25 bp, Homo sapien
ctgccctggttttagaaagagctgc

SEQ ID NO: 39766 - DNA, 25 bp, Homo sapien
ccgaacgtagctgccctggttttag

SEQ ID NO: 39767 - DNA, 25 bp, Homo sapien
ttttccagcccgaatgctcggcaca

SEQ ID NO: 39768 - DNA, 25 bp, Homo sapien
tgtgttcttttgtgctcattttcca

SEQ ID NO: 39769 - DNA, 25 bp, Homo sapien
atctccgaagccttcctgtgtgttc

SEQ ID NO: 39770 - DNA, 25 bp, Homo sapien
aataatgaggcacagcgccatgacc

SEQ ID NO: 39771 - DNA, 25 bp, Homo sapien
ccaccggcggtaataatgaggcaca

SEQ ID NO: 39772 - DNA, 25 bp, Homo sapien
tttccttgctttggtcactggggcc

SEQ ID NO: 39773 - DNA, 25 bp, Homo sapien
aggcgctggggaaatcctgcaaagc

SEQ ID NO: 39774 - DNA, 25 bp, Homo sapien
gcgtcgccgcttttgaagacagctc

SEQ ID NO: 39775 - DNA, 25 bp, Homo sapien
agacagctccaagcgtggctttcca

SEQ ID NO: 39776 - DNA, 25 bp, Homo sapien
gcttcagagcgagctgtgtgaccct

SEQ ID NO: 39777 - DNA, 25 bp, Homo sapien
gggacttaggcgcaagcttcagagc

SEQ ID NO: 39778 - DNA, 25 bp, Homo sapien
cctgggctgctttctggaactcttt

SEQ ID NO: 39779 - DNA, 25 bp, Homo sapien
ggatacaactcctctgctcggggtc

SEQ ID NO: 39780 - DNA, 25 bp, Homo sapien
cgtcacgtgccggaatcacctgact

SEQ ID NO: 39781 - DNA, 25 bp, Homo sapien
ctccacttggcttcagctgacttgg

SEQ ID NO: 39782 - DNA, 25 bp, Homo sapien
cctgtgcgctcgcaagagtggaaga

SEQ ID NO: 39783 - DNA, 25 bp, Homo sapien
ctcaccttctggatggaggacttgc

SEQ ID NO: 39784 - DNA, 25 bp, Homo sapien
ccggagtcccatgagcagaatcctc

SEQ ID NO: 39785 - DNA, 25 bp, Homo sapien
cacgccgtagccgaagtcctttgga

SEQ ID NO: 39786 - DNA, 25 bp, Homo sapien
ttggaaacgaatcggccgcgccgta

SEQ ID NO: 39787 - DNA, 25 bp, Homo sapien
gtttcgccttcagcgctccacttgg

SEQ ID NO: 39788 - DNA, 25 bp, Homo sapien
ggcccgggagcattgagactattgc

SEQ ID NO: 39789 - DNA, 25 bp, Homo sapien
ctattgcgagagaaaggaccgccgc

SEQ ID NO: 39790 - DNA, 25 bp, Homo sapien
tccggaactgctcacgcttcgagtc

SEQ ID NO: 39791 - DNA, 25 bp, Homo sapien
ccctcactttgtaatgggccatagt

SEQ ID NO: 39792 - DNA, 25 bp, Homo sapien
agcagcactgctcatgcgcggaagg

SEQ ID NO: 39793 - DNA, 25 bp, Homo sapien
gcacttgcaaaccaccggccgggat

SEQ ID NO: 39794 - DNA, 25 bp, Homo sapien
aggctcacccttggtcagcgtgtcc

SEQ ID NO: 39795 - DNA, 25 bp, Homo sapien
tgttttcatggcgaccaggacgctc

SEQ ID NO: 39796 - DNA, 25 bp, Homo sapien
aggtcccgagcagagctaagccagc

SEQ ID NO: 39797 - DNA, 25 bp, Homo sapien
tatcgagatgctttgcagcaaagtg

SEQ ID NO: 39798 - DNA, 25 bp, Homo sapien
aggtctatcgagatgctttgcagca

SEQ ID NO: 39799 - DNA, 25 bp, Homo sapien
tgcacgtggccctggccaaaatgtg

SEQ ID NO: 39800 - DNA, 25 bp, Homo sapien
tggccctggccaaaatgtgcaccac

SEQ ID NO: 39801 - DNA, 25 bp, Homo sapien
ttcagaaagaacataaggcagaggg

SEQ ID NO: 39802 - DNA, 25 bp, Homo sapien
cccgtggaaagaggtctatcgagat

SEQ ID NO: 39803 - DNA, 25 bp, Homo sapien
tcccgagcagagctaagccagccag

SEQ ID NO: 39804 - DNA, 25 bp, Homo sapien
gggccgcacttaccgccgcgtccgc

SEQ ID NO: 39805 - DNA, 25 bp, Homo sapien
agcccggctgaggagcctcttgggc

SEQ ID NO: 39806 - DNA, 25 bp, Homo sapien
cttcccggtgttgcttggtgaccac

SEQ ID NO: 39807 - DNA, 25 bp, Homo sapien
gttgcttggtgaccacgctctccgc

SEQ ID NO: 39808 - DNA, 25 bp, Homo sapien
tccgcccagaccgttccatttcttc

SEQ ID NO: 39809 - DNA, 25 bp, Homo sapien
gcgcagcgcaggtgcgaaaacctta

SEQ ID NO: 39810 - DNA, 25 bp, Homo sapien
gccggcactgaccagcctcgcagag

SEQ ID NO: 39811 - DNA, 25 bp, Homo sapien
gcaggtgcgaaaaccttaggggcca

SEQ ID NO: 39812 - DNA, 25 bp, Homo sapien
ggaaaatgggacacggagccctgca

SEQ ID NO: 39813 - DNA, 25 bp, Homo sapien
agctcggccattgtgggagccgctc

SEQ ID NO: 39814 - DNA, 25 bp, Homo sapien
agcacctggtgaggtgcctgtcgcc

SEQ ID NO: 39815 - DNA, 25 bp, Homo sapien
tagagcccagaagggacgctttctc

SEQ ID NO: 39816 - DNA, 25 bp, Homo sapien
tctttgtcagccacgcttggcgggc

SEQ ID NO: 39817 - DNA, 25 bp, Homo sapien
ggcactcctgtgagtctcggggatt

SEQ ID NO: 39818 - DNA, 25 bp, Homo sapien
agcccggaggtcaaacaagtgtttg

SEQ ID NO: 39819 - DNA, 25 bp, Homo sapien
tctcggggattgatggaatgaccca

SEQ ID NO: 39820 - DNA, 25 bp, Homo sapien
cccgacgaggacgagcaactctgcg

SEQ ID NO: 39821 - DNA, 25 bp, Homo sapien
ggtgccgcgcgctgttctcagaccg

SEQ ID NO: 39822 - DNA, 25 bp, Homo sapien
caactctgcgcctgggtgtgacccg

SEQ ID NO: 39823 - DNA, 25 bp, Homo sapien
gacgagcaactctgcgcctgggtgt

SEQ ID NO: 39824 - DNA, 25 bp, Homo sapien
acgaggacgagcaactctgcgcctg

SEQ ID NO: 39825 - DNA, 25 bp, Homo sapien
atcgtgttcgggcttctctcgctgc

SEQ ID NO: 39826 - DNA, 25 bp, Homo sapien
gaaaactgagggtcgcccccgctgc

SEQ ID NO: 39827 - DNA, 25 bp, Homo sapien
ggctccgcggcgctcatcgtgttcg

SEQ ID NO: 39828 - DNA, 25 bp, Homo sapien
cccagctggaagaaggcgagacaag

SEQ ID NO: 39829 - DNA, 25 bp, Homo sapien
gccagttacatgatttgccctatta

SEQ ID NO: 39830 - DNA, 25 bp, Homo sapien
cgctcagagcgccagttacatgatt

SEQ ID NO: 39831 - DNA, 25 bp, Homo sapien
ccgtctctgagacgcacaaagggtc

SEQ ID NO: 39832 - DNA, 25 bp, Homo sapien
ttgagataagccttcggaaaccgcc

SEQ ID NO: 39833 - DNA, 25 bp, Homo sapien
gcttctcggggccagtttatttaca

SEQ ID NO: 39834 - DNA, 25 bp, Homo sapien
ccatggccggctacgtgccgggtca

SEQ ID NO: 39835 - DNA, 25 bp, Homo sapien
agaaaccacccgctctgctctgggt

SEQ ID NO: 39836 - DNA, 25 bp, Homo sapien
aatagaggcggctgcttgtcatgca

SEQ ID NO: 39837 - DNA, 25 bp, Homo sapien
gggcgccctttctggattcgttcgc

SEQ ID NO: 39838 - DNA, 25 bp, Homo sapien
attcgttcgcctttgggctgggctc

SEQ ID NO: 39839 - DNA, 25 bp, Homo sapien
tttcctttgtcaggggatttgcgcc

SEQ ID NO: 39840 - DNA, 25 bp, Homo sapien
agccgagcacttccagcgagctagc

SEQ ID NO: 39841 - DNA, 25 bp, Homo sapien
ccagaagtttgcatgccgggaccgt

SEQ ID NO: 39842 - DNA, 25 bp, Homo sapien
agctgccggagggacaaactaactt

SEQ ID NO: 39843 - DNA, 25 bp, Homo sapien
gagccttttgttcccagccagaagt

SEQ ID NO: 39844 - DNA, 25 bp, Homo sapien
ccgcagaagcgcatgcaggggccac

SEQ ID NO: 39845 - DNA, 25 bp, Homo sapien
accacggcacaccacggcgaggcag

SEQ ID NO: 39846 - DNA, 25 bp, Homo sapien
gaccaaccgccagccacgccgaggt

SEQ ID NO: 39847 - DNA, 25 bp, Homo sapien
aaggactcgcgggaatcgcgccgcc

SEQ ID NO: 39848 - DNA, 25 bp, Homo sapien
gacggattggctgacagtcccagcc

SEQ ID NO: 39849 - DNA, 25 bp, Homo sapien
ttggctgacagtcccagccctcaga

SEQ ID NO: 39850 - DNA, 25 bp, Homo sapien
cctcgaagcgttggcgtctgcgtcc

SEQ ID NO: 39851 - DNA, 25 bp, Homo sapien
ttctgggcctgacgttgtgcgcgct

SEQ ID NO: 39852 - DNA, 25 bp, Homo sapien
tgaggacggcatgtacgccaatctg

SEQ ID NO: 39853 - DNA, 25 bp, Homo sapien
cgtgccaagttctacgcggacccgg

SEQ ID NO: 39854 - DNA, 25 bp, Homo sapien
tcagacgcgcagctctggaatttga

SEQ ID NO: 39855 - DNA, 25 bp, Homo sapien
aggtccgtcgcatcgtctgttccta

SEQ ID NO: 39856 - DNA, 25 bp, Homo sapien
agaacaccctgtgcgagagccagta

SEQ ID NO: 39857 - DNA, 25 bp, Homo sapien
tcaacggcgaccacttccttttgga

SEQ ID NO: 39858 - DNA, 25 bp, Homo sapien
gcccgcaatttcaacgtgcccatgt

SEQ ID NO: 39859 - DNA, 25 bp, Homo sapien
cccatgtgcaaagctgcagacgtca

SEQ ID NO: 39860 - DNA, 25 bp, Homo sapien
accaaatctttgtgggcgccgactc

SEQ ID NO: 39861 - DNA, 25 bp, Homo sapien
ccgcggggctgaacttttcgtacag

SEQ ID NO: 39862 - DNA, 25 bp, Homo sapien
tctataaatataggcctcgggctcc

SEQ ID NO: 39863 - DNA, 25 bp, Homo sapien
ggggacacgcgtttctctataaata

SEQ ID NO: 39864 - DNA, 25 bp, Homo sapien
cctttaagaggcgaccggacgctgc

SEQ ID NO: 39865 - DNA, 25 bp, Homo sapien
cggtcctggtgcgaagctccaaatt

SEQ ID NO: 39866 - DNA, 25 bp, Homo sapien
gacaaaaggctctccgcacaatacg

SEQ ID NO: 39867 - DNA, 25 bp, Homo sapien
cctcggtgacgtccgaatgcaggtc

SEQ ID NO: 39868 - DNA, 25 bp, Homo sapien
gagagcgcgcaggatccaggcactc

SEQ ID NO: 39869 - DNA, 25 bp, Homo sapien
ccaggcactcgtgcgtgtaacggca

SEQ ID NO: 39870 - DNA, 25 bp, Homo sapien
ctccttgggtcgcttcatggcgaac

SEQ ID NO: 39871 - DNA, 25 bp, Homo sapien
gcttcatggcgaacgcaggctgcct

SEQ ID NO: 39872 - DNA, 25 bp, Homo sapien
gctaaggctcccagtcgggaagtca

SEQ ID NO: 39873 - DNA, 25 bp, Homo sapien
tcgccgccttcatcgacggctggga

SEQ ID NO: 39874 - DNA, 25 bp, Homo sapien
cgggattccgcaagggtcaaccctg

SEQ ID NO: 39875 - DNA, 25 bp, Homo sapien
tcttggcccacgtcgatgggtccgt

SEQ ID NO: 39876 - DNA, 25 bp, Homo sapien
gcagctccctttccttaggacgcgg

SEQ ID NO: 39877 - DNA, 25 bp, Homo sapien
gcgcgaggttgtcgtagaaaatctt

SEQ ID NO: 39878 - DNA, 25 bp, Homo sapien
cccgtgcattgcttttaccgatttg

SEQ ID NO: 39879 - DNA, 25 bp, Homo sapien
gagcagagctcccaaaataaacccg

SEQ ID NO: 39880 - DNA, 25 bp, Homo sapien
aagcgctgcggaccagcttcgccaa

SEQ ID NO: 39881 - DNA, 25 bp, Homo sapien
ccaaagtctggttacccgcgcctgg

SEQ ID NO: 39882 - DNA, 25 bp, Homo sapien
tgctgctactgctgtacggtatgag

SEQ ID NO: 39883 - DNA, 25 bp, Homo sapien
ccaaacgcagagtctcaggtccgga

SEQ ID NO: 39884 - DNA, 25 bp, Homo sapien
tactttggggactgaaccgttgcga

SEQ ID NO: 39885 - DNA, 25 bp, Homo sapien
gctacttgccttgtgtgatacactg

SEQ ID NO: 39886 - DNA, 25 bp, Homo sapien
ggttgacgaagccattccctccttg

SEQ ID NO: 39887 - DNA, 25 bp, Homo sapien
ggcggcatccatcccagcaaagcgt

SEQ ID NO: 39888 - DNA, 25 bp, Homo sapien
tggttgccctcaaaggagccctctc

SEQ ID NO: 39889 - DNA, 25 bp, Homo sapien
gcctgcctccttttactgctggttg

SEQ ID NO: 39890 - DNA, 25 bp, Homo sapien
gaattcggagcactttcgccgcctg

SEQ ID NO: 39891 - DNA, 25 bp, Homo sapien
agcgctgcccgctttagagaactgt

SEQ ID NO: 39892 - DNA, 25 bp, Homo sapien
gtgatgcgcccgtcgccgtccaggt

SEQ ID NO: 39893 - DNA, 25 bp, Homo sapien
tgcggaaagcgtgctgcgcgaactt

SEQ ID NO: 39894 - DNA, 25 bp, Homo sapien
accgacagggcgcagatgaactccc

SEQ ID NO: 39895 - DNA, 25 bp, Homo sapien
gcttctgctcgaagctgccgcggga

SEQ ID NO: 39896 - DNA, 25 bp, Homo sapien
cccgtcgagtgtcgggtaaagcatt

SEQ ID NO: 39897 - DNA, 25 bp, Homo sapien
ggtcgtacatctcaaaggcccagtt

SEQ ID NO: 39898 - DNA, 25 bp, Homo sapien
gtaaagcatttagcccgggcctgta

SEQ ID NO: 39899 - DNA, 25 bp, Homo sapien
aggcccagttgagcttctgctcgaa

SEQ ID NO: 39900 - DNA, 25 bp, Homo sapien
tctgagagctcctgacacaaggctg

SEQ ID NO: 39901 - DNA, 25 bp, Homo sapien
cagggacttctaaggatctgtcgaa

SEQ ID NO: 39902 - DNA, 25 bp, Homo sapien
cgggagaaccacagccgaatctcta

SEQ ID NO: 39903 - DNA, 25 bp, Homo sapien
gaatctctaagcttcctttcctggg

SEQ ID NO: 39904 - DNA, 25 bp, Homo sapien
ggctggtcagcagtccacatctctg

SEQ ID NO: 39905 - DNA, 25 bp, Homo sapien
ggtcgacgatgaaagtggattctca

SEQ ID NO: 39906 - DNA, 25 bp, Homo sapien
tccggcctcggatgttgacacaaac

SEQ ID NO: 39907 - DNA, 25 bp, Homo sapien
cggtttacactgagcgggtctggaa

SEQ ID NO: 39908 - DNA, 25 bp, Homo sapien
gtgggacgcatctctgaaccaggag

SEQ ID NO: 39909 - DNA, 25 bp, Homo sapien
aaaagcgcgcgagcaagatggccac

SEQ ID NO: 39910 - DNA, 25 bp, Homo sapien
agatggccaccaccaagcgcgtctt

SEQ ID NO: 39911 - DNA, 25 bp, Homo sapien
ccaagcgcgtcttgtacgtgggtga

SEQ ID NO: 39912 - DNA, 25 bp, Homo sapien
acgtcccttggtttaccactgcgca

SEQ ID NO: 39913 - DNA, 25 bp, Homo sapien
ctctgaaccaggaggacggcgagct

SEQ ID NO: 39914 - DNA, 25 bp, Homo sapien
cgtttgcccataataatcgggttga

SEQ ID NO: 39915 - DNA, 25 bp, Homo sapien
gagctgctgtcaaggccgggtctct

SEQ ID NO: 39916 - DNA, 25 bp, Homo sapien
tgcgtgcctcggtcgtatctcggct

SEQ ID NO: 39917 - DNA, 25 bp, Homo sapien
tgctccaggcgacaccgtccgtgag

SEQ ID NO: 39918 - DNA, 25 bp, Homo sapien
tcggtcgtatctcggctggtgctgc

SEQ ID NO: 39919 - DNA, 25 bp, Homo sapien
gtcctgctcacctgaggctggcggc

SEQ ID NO: 39920 - DNA, 25 bp, Homo sapien
gggtccgctcgtgcgcgcctctccg

SEQ ID NO: 39921 - DNA, 25 bp, Homo sapien
ctgcccgcgcaaggccgtcgctgtc

SEQ ID NO: 39922 - DNA, 25 bp, Homo sapien
cggagcgtcctgctcacctgaggct

SEQ ID NO: 39923 - DNA, 25 bp, Homo sapien
ctgcgcgtgcgtgcctcggtcgtat

SEQ ID NO: 39924 - DNA, 25 bp, Homo sapien
gggcgcttctcctgaagaccacgtt

SEQ ID NO: 39925 - DNA, 25 bp, Homo sapien
ggcgtacatgccgtcctcaaattcc

SEQ ID NO: 39926 - DNA, 25 bp, Homo sapien
gcgctcaattcgtttctcgtatttc

SEQ ID NO: 39927 - DNA, 25 bp, Homo sapien
ggcacgttgaaattgcgggcgcttc

SEQ ID NO: 39928 - DNA, 25 bp, Homo sapien
tactggctctcgcacagggtgttct

SEQ ID NO: 39929 - DNA, 25 bp, Homo sapien
tcgcccacgtaggaacagacgatgc

SEQ ID NO: 39930 - DNA, 25 bp, Homo sapien
tgcaggtctttcacgcgggtcctga

SEQ ID NO: 39931 - DNA, 25 bp, Homo sapien
gccgtgacgtctgcagctttgcaca

SEQ ID NO: 39932 - DNA, 25 bp, Homo sapien
atggcatgctgcaggcgcctccttc

SEQ ID NO: 39933 - DNA, 25 bp, Homo sapien
tcgccatggcatgctgcaggcgcct

SEQ ID NO: 39934 - DNA, 25 bp, Homo sapien
agcgcgcatagcgccaggcccagga

SEQ ID NO: 39935 - DNA, 25 bp, Homo sapien
tcctggctcctggacgagaggacgc

SEQ ID NO: 39936 - DNA, 25 bp, Homo sapien
acgcggacgccaccgcctcgaggcc

SEQ ID NO: 39937 - DNA, 25 bp, Homo sapien
ggctactctgcggactgggactctc

SEQ ID NO: 39938 - DNA, 25 bp, Homo sapien
gactgggactctcggccaatccgtc

SEQ ID NO: 39939 - DNA, 25 bp, Homo sapien
cttggtgcggttcccgcgagtccct

SEQ ID NO: 39940 - DNA, 25 bp, Homo sapien
actgcccacgggaactgctcgtgca

SEQ ID NO: 39941 - DNA, 25 bp, Homo sapien
tcactacaagaggtagggtccgttg

SEQ ID NO: 39942 - DNA, 25 bp, Homo sapien
cctgcgcggatctcaggctttgtag

SEQ ID NO: 39943 - DNA, 25 bp, Homo sapien
atggcaaccgtctatgcgcctgcgc

SEQ ID NO: 39944 - DNA, 25 bp, Homo sapien
tagctgcaacgccagcgtggatttg

SEQ ID NO: 39945 - DNA, 25 bp, Homo sapien
agccgccacggacgccatcttatgg

SEQ ID NO: 39946 - DNA, 25 bp, Homo sapien
acctgcatggagtcagcgctgacga

SEQ ID NO: 39947 - DNA, 25 bp, Homo sapien
agccgcactgccatacctgcatgga

SEQ ID NO: 39948 - DNA, 25 bp, Homo sapien
tcaaagcaaactttgccagcgccgc

SEQ ID NO: 39949 - DNA, 25 bp, Homo sapien
cctactacgggcagtcgacaggtgg

SEQ ID NO: 39950 - DNA, 25 bp, Homo sapien
ccaaataaattgcacgctggggagc

SEQ ID NO: 39951 - DNA, 25 bp, Homo sapien
tgactgccttatatctcgtcgcgcg

SEQ ID NO: 39952 - DNA, 25 bp, Homo sapien
gccgtgcccagaaggcagcctgcag

SEQ ID NO: 39953 - DNA, 25 bp, Homo sapien
ctgtgggcagcgagttcaaagcaaa

SEQ ID NO: 39954 - DNA, 25 bp, Homo sapien
tacgagtcgtagtccatgtccgctc

SEQ ID NO: 39955 - DNA, 25 bp, Homo sapien
gagctgcaggcgcattgtttcctga

SEQ ID NO: 39956 - DNA, 25 bp, Homo sapien
cagatcactttcagcctggggcctc

SEQ ID NO: 39957 - DNA, 25 bp, Homo sapien
tccattcttccgtgttgagcggctg

SEQ ID NO: 39958 - DNA, 25 bp, Homo sapien
gtgcagcagagtgcgttcctcgtct

SEQ ID NO: 39959 - DNA, 25 bp, Homo sapien
tggctaaggctgctacgaagcgagc

SEQ ID NO: 39960 - DNA, 25 bp, Homo sapien
ccagggacaggaagcctacgagcca

SEQ ID NO: 39961 - DNA, 25 bp, Homo sapien
acggagaaaagctgtgggcgccctc

SEQ ID NO: 39962 - DNA, 25 bp, Homo sapien
tctgcctagccggtttccattcttc

SEQ ID NO: 39963 - DNA, 25 bp, Homo sapien
cggcctgcttctcggattgctagga

SEQ ID NO: 39964 - DNA, 25 bp, Homo sapien
tgcagcttaaaggaaccggcctctg

SEQ ID NO: 39965 - DNA, 25 bp, Homo sapien
agaccctttacggactgcagcttaa

SEQ ID NO: 39966 - DNA, 25 bp, Homo sapien
agcgtggcctcgatcaccaccgaga

SEQ ID NO: 39967 - DNA, 25 bp, Homo sapien
ggaaaccgaggtatgcacgcccaga

SEQ ID NO: 39968 - DNA, 25 bp, Homo sapien
gctcatcttattctcggggaccaca

SEQ ID NO: 39969 - DNA, 25 bp, Homo sapien
tgtccagactaattgccttcccacg

SEQ ID NO: 39970 - DNA, 25 bp, Homo sapien
tccaaaaccacagggcggaggcttc

SEQ ID NO: 39971 - DNA, 25 bp, Homo sapien
tcttctgttctttccagagaggagc

SEQ ID NO: 39972 - DNA, 25 bp, Homo sapien
cagtagccagcagctggtgtgccgt

SEQ ID NO: 39973 - DNA, 25 bp, Homo sapien
tagcctcggagacagtgggagctcc

SEQ ID NO: 39974 - DNA, 25 bp, Homo sapien
cggtgcggtgacacctagcctcgga

SEQ ID NO: 39975 - DNA, 25 bp, Homo sapien
tccagatgggactggctctcctctt

SEQ ID NO: 39976 - DNA, 25 bp, Homo sapien
tggctctcctctttgcaaagccagg

SEQ ID NO: 39977 - DNA, 25 bp, Homo sapien
tcctctttgcaaagccaggctcgcg

SEQ ID NO: 39978 - DNA, 25 bp, Homo sapien
acgtggtgagcagtagccagcagct

SEQ ID NO: 39979 - DNA, 25 bp, Homo sapien
gtgacacctagcctcggagacagtg

SEQ ID NO: 39980 - DNA, 25 bp, Homo sapien
acgccatcttcgctgtgtcacatga

SEQ ID NO: 39981 - DNA, 25 bp, Homo sapien
cctctacacccgcattttgcagatg

SEQ ID NO: 39982 - DNA, 25 bp, Homo sapien
tttgcagatgcgaacccaggctagg

SEQ ID NO: 39983 - DNA, 25 bp, Homo sapien
gtccagatgctgcagcgcccgagaa

SEQ ID NO: 39984 - DNA, 25 bp, Homo sapien
ggttgcagatcgcaacctgcgcatc

SEQ ID NO: 39985 - DNA, 25 bp, Homo sapien
atcccgaacggatgcccagcctgat

SEQ ID NO: 39986 - DNA, 25 bp, Homo sapien
ctaccctggagctttcagcgcgaca

SEQ ID NO: 39987 - DNA, 25 bp, Homo sapien
ccaggctaggaagagagagaatcgc

SEQ ID NO: 39988 - DNA, 25 bp, Homo sapien
ccgcagcagcaagagttccagggtc

SEQ ID NO: 39989 - DNA, 25 bp, Homo sapien
ttgcagttctccagcagttcgccga

SEQ ID NO: 39990 - DNA, 25 bp, Homo sapien
gcagcctctgcatcggagattcctg

SEQ ID NO: 39991 - DNA, 25 bp, Homo sapien
ccaaactggcattaactggcgagcc

SEQ ID NO: 39992 - DNA, 25 bp, Homo sapien
acgttcaacgacaagaggattctca

SEQ ID NO: 39993 - DNA, 25 bp, Homo sapien
gctactctactcctatgatcgactg

SEQ ID NO: 39994 - DNA, 25 bp, Homo sapien
ggatcacgatctttcagctactcta

SEQ ID NO: 39995 - DNA, 25 bp, Homo sapien
gcgaacggtaggctcgctcatctcg

SEQ ID NO: 39996 - DNA, 25 bp, Homo sapien
tctgagccttactgagatcccggag

SEQ ID NO: 39997 - DNA, 25 bp, Homo sapien
cgtcgctaaggagtgcgtcacagtg

SEQ ID NO: 39998 - DNA, 25 bp, Homo sapien
agtcacgtggcttggttgcctacgc

SEQ ID NO: 39999 - DNA, 25 bp, Homo sapien
agactgagtccatggttcggggtca

SEQ ID NO: 40000 - DNA, 25 bp, Homo sapien
catctttgaactactgccggagctt

SEQ ID NO: 40001 - DNA, 25 bp, Homo sapien
aggccctggatcctctgtaagcagc

SEQ ID NO: 40002 - DNA, 25 bp, Homo sapien
cacccggagtccgagtgacggaatc

SEQ ID NO: 40003 - DNA, 25 bp, Homo sapien
gccgggtccaaactgaaaggcgcca

SEQ ID NO: 40004 - DNA, 25 bp, Homo sapien
gagccgcggcccactcagtcagttg

SEQ ID NO: 40005 - DNA, 25 bp, Homo sapien
ccgcgttcactagcccaggaggaaa

SEQ ID NO: 40006 - DNA, 25 bp, Homo sapien
agaggaggacttcgccgcgttcact

SEQ ID NO: 40007 - DNA, 25 bp, Homo sapien
actgcggctctggagattagaaaga

SEQ ID NO: 40008 - DNA, 25 bp, Homo sapien
gtaagccgctgacccagaggatgga

SEQ ID NO: 40009 - DNA, 25 bp, Homo sapien
aggcagataccgcagcccagtcagg

SEQ ID NO: 40010 - DNA, 25 bp, Homo sapien
ccgactacctgtcgccttgttgggg

SEQ ID NO: 40011 - DNA, 25 bp, Homo sapien
ttgcggcccactcagtcagttccgg

SEQ ID NO: 40012 - DNA, 25 bp, Homo sapien
tccgtgggtgataattgagagcgtc

SEQ ID NO: 40013 - DNA, 25 bp, Homo sapien
tcggctaccacgtgcagttcgggcc

SEQ ID NO: 40014 - DNA, 25 bp, Homo sapien
ctgagtccaacgtgcgcctcctgag

SEQ ID NO: 40015 - DNA, 25 bp, Homo sapien
acgtggcgctagtgcctgagtccaa

SEQ ID NO: 40016 - DNA, 25 bp, Homo sapien
ccagggaacgccacggactggatct

SEQ ID NO: 40017 - DNA, 25 bp, Homo sapien
cccggtcagactcccacgtgtgaag

SEQ ID NO: 40018 - DNA, 25 bp, Homo sapien
tgctgaccgcagactcgggctacta

SEQ ID NO: 40019 - DNA, 25 bp, Homo sapien
tgagagcgtcagacccaggactgtt

SEQ ID NO: 40020 - DNA, 25 bp, Homo sapien
agccgggttctccacgtactccttg

SEQ ID NO: 40021 - DNA, 25 bp, Homo sapien
cctgcagagagaaccacgggtcaga

SEQ ID NO: 40022 - DNA, 25 bp, Homo sapien
tctccacgtactccttgctgcgggg

SEQ ID NO: 40023 - DNA, 25 bp, Homo sapien
gggaggactcacctgtcccttgggc

SEQ ID NO: 40024 - DNA, 25 bp, Homo sapien
ctgcaggcacaaggagcagcggtca

SEQ ID NO: 40025 - DNA, 25 bp, Homo sapien
caaggagcagcggtcacgaagccgc

SEQ ID NO: 40026 - DNA, 25 bp, Homo sapien
ggggtgctggaactcaccactttgc

SEQ ID NO: 40027 - DNA, 25 bp, Homo sapien
ggaactcaccactttgccgcggggc

SEQ ID NO: 40028 - DNA, 25 bp, Homo sapien
ctggtttgaggtttttgcagaacaa

SEQ ID NO: 40029 - DNA, 25 bp, Homo sapien
gaggggcactacatctccgggcacc

SEQ ID NO: 40030 - DNA, 25 bp, Homo sapien
ccgcctattggcgacgaggggcact

SEQ ID NO: 40031 - DNA, 25 bp, Homo sapien
ttttgcagaacaaacggcgtccttg

SEQ ID NO: 40032 - DNA, 25 bp, Homo sapien
ctccgcatgtcagggctggtttgag

SEQ ID NO: 40033 - DNA, 25 bp, Homo sapien
cggcggctataacgggctccgcatg

SEQ ID NO: 40034 - DNA, 25 bp, Homo sapien
ctccttgtctgtcggcggctataac

SEQ ID NO: 40035 - DNA, 25 bp, Homo sapien
aacaaacggcgtccttgtggtgcgg

SEQ ID NO: 40036 - DNA, 25 bp, Homo sapien
tgttgttcttacgtgaacgacaggc

SEQ ID NO: 40037 - DNA, 25 bp, Homo sapien
gctcgggttgttgttcttacgtgaa

SEQ ID NO: 40038 - DNA, 25 bp, Homo sapien
cttacgtgaacgacaggcagagaca

SEQ ID NO: 40039 - DNA, 25 bp, Homo sapien
gaggtgaagcgggtactatcttccc

SEQ ID NO: 40040 - DNA, 25 bp, Homo sapien
agcgggtactatcttcccactcgga

SEQ ID NO: 40041 - DNA, 25 bp, Homo sapien
gggtactatcttcccactcggagcg

SEQ ID NO: 40042 - DNA, 25 bp, Homo sapien
cagatggaatgtaaggttgtgccta

SEQ ID NO: 40043 - DNA, 25 bp, Homo sapien
atgtaaggttgtgcctagcaggctg

SEQ ID NO: 40044 - DNA, 25 bp, Homo sapien
ccgcgatgggcaccatgtatgcacc

SEQ ID NO: 40045 - DNA, 25 bp, Homo sapien
tgagctgtcacctgagaggaccggc

SEQ ID NO: 40046 - DNA, 25 bp, Homo sapien
aggggctgcgaaacttacaatctgc

SEQ ID NO: 40047 - DNA, 25 bp, Homo sapien
tgtatgcacccaccgaggggacctg

SEQ ID NO: 40048 - DNA, 25 bp, Homo sapien
cctccattcacggtgccgcgatggg

SEQ ID NO: 40049 - DNA, 25 bp, Homo sapien
ggtcccgtttgactctccggctcag

SEQ ID NO: 40050 - DNA, 25 bp, Homo sapien
gcgcagcgggtgaatgagcaccatt

SEQ ID NO: 40051 - DNA, 25 bp, Homo sapien
gggacacaggcagagctcctccatc

SEQ ID NO: 40052 - DNA, 25 bp, Homo sapien
tgcgccgcatgaagaacgtacagga

SEQ ID NO: 40053 - DNA, 25 bp, Homo sapien
gccgagtcccgctaaggcaaagacg

SEQ ID NO: 40054 - DNA, 25 bp, Homo sapien
aacatgatggagaaccggccgctgc

SEQ ID NO: 40055 - DNA, 25 bp, Homo sapien
cccggcaaggagttcctgcagctgc

SEQ ID NO: 40056 - DNA, 25 bp, Homo sapien
tgcagctgccgtccatcgagatcac

SEQ ID NO: 40057 - DNA, 25 bp, Homo sapien
ctcctccgcaagtggctgagggtga

SEQ ID NO: 40058 - DNA, 25 bp, Homo sapien
gcccgtcaccagaggcgcttctgga

SEQ ID NO: 40059 - DNA, 25 bp, Homo sapien
tgaggggcttcatgttgcacgacac

SEQ ID NO: 40060 - DNA, 25 bp, Homo sapien
ctgctggaggaggataacaagtttt

SEQ ID NO: 40061 - DNA, 25 bp, Homo sapien
acaagttttgtgcagattgccagtc

SEQ ID NO: 40062 - DNA, 25 bp, Homo sapien
cgcccaactcggcttataagtggta

SEQ ID NO: 40063 - DNA, 25 bp, Homo sapien
gccagtctaaaggtagcgcatccca

SEQ ID NO: 40064 - DNA, 25 bp, Homo sapien
acgtggatcggtaccaggctgtcct

SEQ ID NO: 40065 - DNA, 25 bp, Homo sapien
ctggccatgacaggcaagtcggtga

SEQ ID NO: 40066 - DNA, 25 bp, Homo sapien
ggtttctgaagcttaggccgcccaa

SEQ ID NO: 40067 - DNA, 25 bp, Homo sapien
ctccacggattggttcccgagaggc

SEQ ID NO: 40068 - DNA, 25 bp, Homo sapien
ggaaccatgctctagccagccgctg

SEQ ID NO: 40069 - DNA, 25 bp, Homo sapien
gtctagcggtttcgcggtttgctac

SEQ ID NO: 40070 - DNA, 25 bp, Homo sapien
atgctctagccagccgctgcgcagg

SEQ ID NO: 40071 - DNA, 25 bp, Homo sapien
ttgctttgtggggaggacttagcct

SEQ ID NO: 40072 - DNA, 25 bp, Homo sapien
cccggagtcgtgctcagacaaaggc

SEQ ID NO: 40073 - DNA, 25 bp, Homo sapien
agcttggccgcgcagtgccggaacc

SEQ ID NO: 40074 - DNA, 25 bp, Homo sapien
aggacgctgggaaccatgctctagc

SEQ ID NO: 40075 - DNA, 25 bp, Homo sapien
gacttagcctctcatttggggagga

SEQ ID NO: 40076 - DNA, 25 bp, Homo sapien
ggaatgtggagcagaccctcgtcca

SEQ ID NO: 40077 - DNA, 25 bp, Homo sapien
cccttgatgggaatgtggagcagac

SEQ ID NO: 40078 - DNA, 25 bp, Homo sapien
cagaggccaggcgagacacccggct

SEQ ID NO: 40079 - DNA, 25 bp, Homo sapien
aggaagccgacctcaacgctggacg

SEQ ID NO: 40080 - DNA, 25 bp, Homo sapien
ccggggtctgcaagacgccggctca

SEQ ID NO: 40081 - DNA, 25 bp, Homo sapien
cggcagccagggaggtgtatcctcc

SEQ ID NO: 40082 - DNA, 25 bp, Homo sapien
agacacccggctgcggcctaagagg

SEQ ID NO: 40083 - DNA, 25 bp, Homo sapien
cttccgaaggaagccgacctcaacg

SEQ ID NO: 40084 - DNA, 25 bp, Homo sapien
tccgctcacagagacggatttctgc

SEQ ID NO: 40085 - DNA, 25 bp, Homo sapien
cgcaaacagagggactgacctgctt

SEQ ID NO: 40086 - DNA, 25 bp, Homo sapien
ttagggttctgtccctgcgatcgcc

SEQ ID NO: 40087 - DNA, 25 bp, Homo sapien
tgacctgctttagtgagctcccaaa

SEQ ID NO: 40088 - DNA, 25 bp, Homo sapien
cagctgcgcccggaattaaacgacc

SEQ ID NO: 40089 - DNA, 25 bp, Homo sapien
tcgccagtgagggaagttacagatc

SEQ ID NO: 40090 - DNA, 25 bp, Homo sapien
tgctcggattgtcccggtggtaact

SEQ ID NO: 40091 - DNA, 25 bp, Homo sapien
tcgccctcggaacacagtgctgttg

SEQ ID NO: 40092 - DNA, 25 bp, Homo sapien
ccggaaacgagctccactggcctta

SEQ ID NO: 40093 - DNA, 25 bp, Homo sapien
ggacggtagccggtattcaatcttc

SEQ ID NO: 40094 - DNA, 25 bp, Homo sapien
ggacagttacttccgcacacgcgta

SEQ ID NO: 40095 - DNA, 25 bp, Homo sapien
tccaggaactctaggtggacagtta

SEQ ID NO: 40096 - DNA, 25 bp, Homo sapien
ccttatgggaaatgtggtctccgac

SEQ ID NO: 40097 - DNA, 25 bp, Homo sapien
gacgctgtgactgatcccaggcttg

SEQ ID NO: 40098 - DNA, 25 bp, Homo sapien
ccctgtctctggacgacgctgtgac

SEQ ID NO: 40099 - DNA, 25 bp, Homo sapien
tggtctccgacggatggcctacacc

SEQ ID NO: 40100 - DNA, 25 bp, Homo sapien
gacgcgccacagagcgagatgcacg

SEQ ID NO: 40101 - DNA, 25 bp, Homo sapien
ctgacgaggccggatcaatatttca

SEQ ID NO: 40102 - DNA, 25 bp, Homo sapien
gaggccggatcaatatttcatgggg

SEQ ID NO: 40103 - DNA, 25 bp, Homo sapien
accgcccaaagaggtgcacgcattc

SEQ ID NO: 40104 - DNA, 25 bp, Homo sapien
agaggtgcacgcattccctgcaacc

SEQ ID NO: 40105 - DNA, 25 bp, Homo sapien
cgcgccgctgacgaggccggatcaa

SEQ ID NO: 40106 - DNA, 25 bp, Homo sapien
actccgacgcgccacagagcgagat

SEQ ID NO: 40107 - DNA, 25 bp, Homo sapien
acgcaagccatacacctccggttgg

SEQ ID NO: 40108 - DNA, 25 bp, Homo sapien
gcgcggactccgagtggataggcac

SEQ ID NO: 40109 - DNA, 25 bp, Homo sapien
cgcgaacccggcagtaggcgcggcc

SEQ ID NO: 40110 - DNA, 25 bp, Homo sapien
ctccgagtggataggcacgcggggc

SEQ ID NO: 40111 - DNA, 25 bp, Homo sapien
ggcatcgcccgccaccacgggggca

SEQ ID NO: 40112 - DNA, 25 bp, Homo sapien
ccgcagcagccaccgttttcagtcg

SEQ ID NO: 40113 - DNA, 25 bp, Homo sapien
caccgttttcagtcgccgccgggtg

SEQ ID NO: 40114 - DNA, 25 bp, Homo sapien
agtcgccgccgggtgcaaagcccaa

SEQ ID NO: 40115 - DNA, 25 bp, Homo sapien
tgcaaagcccaagcttgggccggcg

SEQ ID NO: 40116 - DNA, 25 bp, Homo sapien
ggcggggtcaaaactcagatctcga

SEQ ID NO: 40117 - DNA, 25 bp, Homo sapien
ggacctggcaccttattggacgcgc

SEQ ID NO: 40118 - DNA, 25 bp, Homo sapien
tcagatctcgagctcccgaaagggg

SEQ ID NO: 40119 - DNA, 25 bp, Homo sapien
gcgagacctcaaggagcacagcttc

SEQ ID NO: 40120 - DNA, 25 bp, Homo sapien
ttctgcgcaccgcacgatactggga

SEQ ID NO: 40121 - DNA, 25 bp, Homo sapien
tctgcattgcccgactccgtaggag

SEQ ID NO: 40122 - DNA, 25 bp, Homo sapien
ttcctggactcctgagcagaggtgt

SEQ ID NO: 40123 - DNA, 25 bp, Homo sapien
cgggctttctcccattggcggaagg

SEQ ID NO: 40124 - DNA, 25 bp, Homo sapien
cacgtcttcatgtgagtttgcgacc

SEQ ID NO: 40125 - DNA, 25 bp, Homo sapien
ggtggacaccacttgcacgcgtccg

SEQ ID NO: 40126 - DNA, 25 bp, Homo sapien
gcatggagcgcgtaataagagagtt

SEQ ID NO: 40127 - DNA, 25 bp, Homo sapien
agcgcgtaataagagagttggagtc

SEQ ID NO: 40128 - DNA, 25 bp, Homo sapien
ccgggtccgagccatgcgtctctga

SEQ ID NO: 40129 - DNA, 25 bp, Homo sapien
cgctcacggccgtgcagagcgaaca

SEQ ID NO: 40130 - DNA, 25 bp, Homo sapien
tgggccttcgtctaccacgtcttca

SEQ ID NO: 40131 - DNA, 25 bp, Homo sapien
tgcagaactgggtctacaacgtgct

SEQ ID NO: 40132 - DNA, 25 bp, Homo sapien
accaggacggagacaccatggtgga

SEQ ID NO: 40133 - DNA, 25 bp, Homo sapien
gagaacatctgcgagggtcctcacg

SEQ ID NO: 40134 - DNA, 25 bp, Homo sapien
tggagaagggctcagatcactcctc

SEQ ID NO: 40135 - DNA, 25 bp, Homo sapien
gctcagatcactcctcggacaagtc

SEQ ID NO: 40136 - DNA, 25 bp, Homo sapien
ccgttgaggcggtacctccttgtca

SEQ ID NO: 40137 - DNA, 25 bp, Homo sapien
agccggagaacatctgcgagggtcc

SEQ ID NO: 40138 - DNA, 25 bp, Homo sapien
cgcagaaccaggacggagacaccat

SEQ ID NO: 40139 - DNA, 25 bp, Homo sapien
cccatcctccggaagcggtctcgct

SEQ ID NO: 40140 - DNA, 25 bp, Homo sapien
gcaggaacccgtacctctcccgaga

SEQ ID NO: 40141 - DNA, 25 bp, Homo sapien
gaggtaatcggagccgcagcaccgc

SEQ ID NO: 40142 - DNA, 25 bp, Homo sapien
caggccgccgcgttttcaattgtta

SEQ ID NO: 40143 - DNA, 25 bp, Homo sapien
tggcccgctgctcgcctttcaggcc

SEQ ID NO: 40144 - DNA, 25 bp, Homo sapien
tcacactttccgcttggcccgctgc

SEQ ID NO: 40145 - DNA, 25 bp, Homo sapien
ggacgcggcggcaccttcacacttt

SEQ ID NO: 40146 - DNA, 25 bp, Homo sapien
tcggggcctggcattggcaaagccc

SEQ ID NO: 40147 - DNA, 25 bp, Homo sapien
cgccgcgttttcaattgttaatttg

SEQ ID NO: 40148 - DNA, 25 bp, Homo sapien
cagggtgacgcctttactcccaatc

SEQ ID NO: 40149 - DNA, 25 bp, Homo sapien
gttttcggcttggagtacatcgtcc

SEQ ID NO: 40150 - DNA, 25 bp, Homo sapien
cagacttcatcgtgttcgtggcctc

SEQ ID NO: 40151 - DNA, 25 bp, Homo sapien
ggtacccagggcaacatcttcgcca

SEQ ID NO: 40152 - DNA, 25 bp, Homo sapien
ggtcgcttccgctttgccagaaagc

SEQ ID NO: 40153 - DNA, 25 bp, Homo sapien
ttcctgcagatcctgcgcatggtgc

SEQ ID NO: 40154 - DNA, 25 bp, Homo sapien
ggctcagtggtctacgcgcatagca

SEQ ID NO: 40155 - DNA, 25 bp, Homo sapien
tgtgtcatcggtaatgaggcgcgcc

SEQ ID NO: 40156 - DNA, 25 bp, Homo sapien
ggctgagaaggacgccaactccgac

SEQ ID NO: 40157 - DNA, 25 bp, Homo sapien
ccgactcgctctggtgggggacggt

SEQ ID NO: 40158 - DNA, 25 bp, Homo sapien
gagaaggacgccaactccgacttct

SEQ ID NO: 40159 - DNA, 25 bp, Homo sapien
tgagaaggacgccaactccgacttc

SEQ ID NO: 40160 - DNA, 25 bp, Homo sapien
tcctacgccgactcgctctggtggg

SEQ ID NO: 40161 - DNA, 25 bp, Homo sapien
gacttctcctcctacgccgactcgc

SEQ ID NO: 40162 - DNA, 25 bp, Homo sapien
tccgacttctcctcctacgccgact

SEQ ID NO: 40163 - DNA, 25 bp, Homo sapien
cctacgccgactcgctctggtgggg

SEQ ID NO: 40164 - DNA, 25 bp, Homo sapien
tcgggttcctggtgctcatcttcgc

SEQ ID NO: 40165 - DNA, 25 bp, Homo sapien
caccgcctggtacatcgggttcctg

SEQ ID NO: 40166 - DNA, 25 bp, Homo sapien
cgcaggagctgatcaccgcctggta

SEQ ID NO: 40167 - DNA, 25 bp, Homo sapien
catctcccaggcaggcacagcgctc

SEQ ID NO: 40168 - DNA, 25 bp, Homo sapien
gaaagaaaagcgagcctgggactcc

SEQ ID NO: 40169 - DNA, 25 bp, Homo sapien
ctgagaaagaaaagcgagcctggga

SEQ ID NO: 40170 - DNA, 25 bp, Homo sapien
ctccttcctggtctacctggctgag

SEQ ID NO: 40171 - DNA, 25 bp, Homo sapien
tacatcgggttcctggtgctcatct

SEQ ID NO: 40172 - DNA, 25 bp, Homo sapien
cggactcctctcgtacttgaactca

SEQ ID NO: 40173 - DNA, 25 bp, Homo sapien
accaacatggactgagggacttctc

SEQ ID NO: 40174 - DNA, 25 bp, Homo sapien
tgtggaccacgaggacatctccgtc

SEQ ID NO: 40175 - DNA, 25 bp, Homo sapien
tgcagtccatcgagcacaagctgga

SEQ ID NO: 40176 - DNA, 25 bp, Homo sapien
ctttccaggcgggatttgtgcttcc

SEQ ID NO: 40177 - DNA, 25 bp, Homo sapien
ttgtcgctgtagctcgcggactatc

SEQ ID NO: 40178 - DNA, 25 bp, Homo sapien
ggaggatgcgtttcccacagccaca

SEQ ID NO: 40179 - DNA, 25 bp, Homo sapien
ggagagagaccacacgcagtattga

SEQ ID NO: 40180 - DNA, 25 bp, Homo sapien
ctgggctcggcgtattcttataccc

SEQ ID NO: 40181 - DNA, 25 bp, Homo sapien
gacgtcagcgcctcctcgtcgatga

SEQ ID NO: 40182 - DNA, 25 bp, Homo sapien
cctcgtcgatgagttcggcgtccat

SEQ ID NO: 40183 - DNA, 25 bp, Homo sapien
tagccctcggcgagcatcaggtggt

SEQ ID NO: 40184 - DNA, 25 bp, Homo sapien
agcctggggtcacaaaggcccgcaa

SEQ ID NO: 40185 - DNA, 25 bp, Homo sapien
aggcccgcaacctgtagtgctccga

SEQ ID NO: 40186 - DNA, 25 bp, Homo sapien
gtagtgctccgaaacctccgcgtcg

SEQ ID NO: 40187 - DNA, 25 bp, Homo sapien
ccaagtccgagaagcagtcgaactc

SEQ ID NO: 40188 - DNA, 25 bp, Homo sapien
cgcccgtagtctccctccttcgcac

SEQ ID NO: 40189 - DNA, 25 bp, Homo sapien
ggggcaggcttatcgcccatccagg

SEQ ID NO: 40190 - DNA, 25 bp, Homo sapien
gcgcgtttggccactcgctgctcct

SEQ ID NO: 40191 - DNA, 25 bp, Homo sapien
gggcagatgaaaggggcagtcgaaa

SEQ ID NO: 40192 - DNA, 25 bp, Homo sapien
ggcgtggccgcgctcaccaccaccg

SEQ ID NO: 40193 - DNA, 25 bp, Homo sapien
aggccgggctgtaattaggataatt

SEQ ID NO: 40194 - DNA, 25 bp, Homo sapien
attaggataattgcgctgctcccag

SEQ ID NO: 40195 - DNA, 25 bp, Homo sapien
gcctgggaacctcctcgcgcgtttg

SEQ ID NO: 40196 - DNA, 25 bp, Homo sapien
tgccaccccgagcagttcgactggg

SEQ ID NO: 40197 - DNA, 25 bp, Homo sapien
gcctggtgagaatgtatcttaacga

SEQ ID NO: 40198 - DNA, 25 bp, Homo sapien
gcgcgcctggtgagaatgtatctta

SEQ ID NO: 40199 - DNA, 25 bp, Homo sapien
atcaatgcctgcatcgacgtgatgg

SEQ ID NO: 40200 - DNA, 25 bp, Homo sapien
gtgagaatgtatcttaacgagtatg

SEQ ID NO: 40201 - DNA, 25 bp, Homo sapien
tgggccatcaatgcctgcatcgacg

SEQ ID NO: 40202 - DNA, 25 bp, Homo sapien
ttaacgagtatgttcttaagccggc

SEQ ID NO: 40203 - DNA, 25 bp, Homo sapien
ttcgactgggccatcaatgcctgca

SEQ ID NO: 40204 - DNA, 25 bp, Homo sapien
gcctcgaacctacggcggcacagtt

SEQ ID NO: 40205 - DNA, 25 bp, Homo sapien
gcccttgctcttcgtctgcgaggaa

SEQ ID NO: 40206 - DNA, 25 bp, Homo sapien
cctccgtgaaagactgccgggcgca

SEQ ID NO: 40207 - DNA, 25 bp, Homo sapien
agtcgcccatccattcaagcagtgc

SEQ ID NO: 40208 - DNA, 25 bp, Homo sapien
aggccaggcgtgagttcccaaacag

SEQ ID NO: 40209 - DNA, 25 bp, Homo sapien
ggcgacgcccagaactccaggagac

SEQ ID NO: 40210 - DNA, 25 bp, Homo sapien
gcccacagtgaaagaccatcggatg

SEQ ID NO: 40211 - DNA, 25 bp, Homo sapien
ggacgtcgctcctaccaatcagggg

SEQ ID NO: 40212 - DNA, 25 bp, Homo sapien
cacaatggcactgtcggagcacacg

SEQ ID NO: 40213 - DNA, 25 bp, Homo sapien
tcgctgcccaggaaggcaccctgga

SEQ ID NO: 40214 - DNA, 25 bp, Homo sapien
gcttgaactccatattgcgggtctc

SEQ ID NO: 40215 - DNA, 25 bp, Homo sapien
gccaggctgaggtactcgccgctac

SEQ ID NO: 40216 - DNA, 25 bp, Homo sapien
cgccgcacgtggtgcttgaaggcca

SEQ ID NO: 40217 - DNA, 25 bp, Homo sapien
ccctcgctgttgaggaaggcgcaca

SEQ ID NO: 40218 - DNA, 25 bp, Homo sapien
gcccacgatctgctggtgcacaatg

SEQ ID NO: 40219 - DNA, 25 bp, Homo sapien
tggctgcagcggatgccctgcacca

SEQ ID NO: 40220 - DNA, 25 bp, Homo sapien
cagctctccggtctgcgtcctgtag

SEQ ID NO: 40221 - DNA, 25 bp, Homo sapien
tgacacggccgagaaagggcccagc

SEQ ID NO: 40222 - DNA, 25 bp, Homo sapien
gccagacacggcgacctatacggac

SEQ ID NO: 40223 - DNA, 25 bp, Homo sapien
aggggaccgactgacccgcgcagac

SEQ ID NO: 40224 - DNA, 25 bp, Homo sapien
attcccacctctggcgccggagggg

SEQ ID NO: 40225 - DNA, 25 bp, Homo sapien
gggacccggccagccagaatcacag

SEQ ID NO: 40226 - DNA, 25 bp, Homo sapien
ctgcgtcctgtagatgggaaaactg

SEQ ID NO: 40227 - DNA, 25 bp, Homo sapien
cggccagccagaatcacaggcattc

SEQ ID NO: 40228 - DNA, 25 bp, Homo sapien
gccagagctctttcaggcaatgatg

SEQ ID NO: 40229 - DNA, 25 bp, Homo sapien
aatgatgtcatctgcaaggcgcgcc

SEQ ID NO: 40230 - DNA, 25 bp, Homo sapien
cgcccagggtaagctcagctcggaa

SEQ ID NO: 40231 - DNA, 25 bp, Homo sapien
cccaggatcggttgcgttccgactg

SEQ ID NO: 40232 - DNA, 25 bp, Homo sapien
taactgcttctccagctgggcgtga

SEQ ID NO: 40233 - DNA, 25 bp, Homo sapien
cccgtctgggctacagaatgcgttc

SEQ ID NO: 40234 - DNA, 25 bp, Homo sapien
gcaggtgatcagcaacccttctcta

SEQ ID NO: 40235 - DNA, 25 bp, Homo sapien
cttccagccgggatatctttgctcg

SEQ ID NO: 40236 - DNA, 25 bp, Homo sapien
ctgcgaagctgcgagcgcatcaggt

SEQ ID NO: 40237 - DNA, 25 bp, Homo sapien
catcaggtggacgtggacccggact

SEQ ID NO: 40238 - DNA, 25 bp, Homo sapien
tggacccggacttcgcgccgcagag

SEQ ID NO: 40239 - DNA, 25 bp, Homo sapien
ccgctgcggaaagcgaagagctctc

SEQ ID NO: 40240 - DNA, 25 bp, Homo sapien
aagcgaagagctctcggcggaacgc

SEQ ID NO: 40241 - DNA, 25 bp, Homo sapien
acgactggatggtccgttacgtgcc

SEQ ID NO: 40242 - DNA, 25 bp, Homo sapien
gctccggcatggtgcaatccggcct

SEQ ID NO: 40243 - DNA, 25 bp, Homo sapien
aatccggcctcgtcccgggagagca

SEQ ID NO: 40244 - DNA, 25 bp, Homo sapien
tttgcgggttcgaaagttcagcgcc

SEQ ID NO: 40245 - DNA, 25 bp, Homo sapien
acagttgctggcacgcccggcagac

SEQ ID NO: 40246 - DNA, 25 bp, Homo sapien
cccgcgcaacttagggagctgagga

SEQ ID NO: 40247 - DNA, 25 bp, Homo sapien
ccgtgccaggcggtaattgcagaca

SEQ ID NO: 40248 - DNA, 25 bp, Homo sapien
ccaggcggtaattgcagacagacta

SEQ ID NO: 40249 - DNA, 25 bp, Homo sapien
ctcgcgttaaggtaatgaacggcgc

SEQ ID NO: 40250 - DNA, 25 bp, Homo sapien
agccgctcctggcacagttgctggc

SEQ ID NO: 40251 - DNA, 25 bp, Homo sapien
atgagacggttatttttaactcgcg

SEQ ID NO: 40252 - DNA, 25 bp, Homo sapien
ctggacctcgacatgttcagcggga

SEQ ID NO: 40253 - DNA, 25 bp, Homo sapien
cttcagtttcatttgcggaggccta

SEQ ID NO: 40254 - DNA, 25 bp, Homo sapien
ggagcgtttacaaatcttcagtttc

SEQ ID NO: 40255 - DNA, 25 bp, Homo sapien
tgtcttcccatcctgattcccgggt

SEQ ID NO: 40256 - DNA, 25 bp, Homo sapien
atggacttcaacttcgattcggccc

SEQ ID NO: 40257 - DNA, 25 bp, Homo sapien
tgcgacgtggagtccatcatcctca

SEQ ID NO: 40258 - DNA, 25 bp, Homo sapien
atcagccttatgacgctgcccggcg

SEQ ID NO: 40259 - DNA, 25 bp, Homo sapien
tcaacgacttcatggacagcgacga

SEQ ID NO: 40260 - DNA, 25 bp, Homo sapien
cccgattgtacggaagtctgcagcg

SEQ ID NO: 40261 - DNA, 25 bp, Homo sapien
tgtctcaggccacactgcgagttgg

SEQ ID NO: 40262 - DNA, 25 bp, Homo sapien
ccagcctggtgtccttgcctggagg

SEQ ID NO: 40263 - DNA, 25 bp, Homo sapien
aggaaatgcgaggtgtcagatgacc

SEQ ID NO: 40264 - DNA, 25 bp, Homo sapien
tggcaggacaccctagggccgtctg

SEQ ID NO: 40265 - DNA, 25 bp, Homo sapien
cagcatgcccgctggctcgtgagct

SEQ ID NO: 40266 - DNA, 25 bp, Homo sapien
cgtgagctggccctggaaactagcg

SEQ ID NO: 40267 - DNA, 25 bp, Homo sapien
gaagtctgcagcgtgtctcaggcca

SEQ ID NO: 40268 - DNA, 25 bp, Homo sapien
ctctccgacgtgtttgggaaatcct

SEQ ID NO: 40269 - DNA, 25 bp, Homo sapien
cgcaggaatgcgcaggacgctttgt

SEQ ID NO: 40270 - DNA, 25 bp, Homo sapien
cggccatgagtcagcgcgcaggaat

SEQ ID NO: 40271 - DNA, 25 bp, Homo sapien
ctacgtgccggccatgagtcagcgc

SEQ ID NO: 40272 - DNA, 25 bp, Homo sapien
ctcccgaccaattttgggcaaagca

SEQ ID NO: 40273 - DNA, 25 bp, Homo sapien
acgtgtttgggaaatcctcgggctg

SEQ ID NO: 40274 - DNA, 25 bp, Homo sapien
ctgacacgaccgcacgggcagtacg

SEQ ID NO: 40275 - DNA, 25 bp, Homo sapien
tcgcctcccgaccaattttgggcaa

SEQ ID NO: 40276 - DNA, 25 bp, Homo sapien
gctccttccaggcagttctcccacg

SEQ ID NO: 40277 - DNA, 25 bp, Homo sapien
acaaatgagagagcttgagcgcgcg

SEQ ID NO: 40278 - DNA, 25 bp, Homo sapien
ccaggccaacgctccacaaatgaga

SEQ ID NO: 40279 - DNA, 25 bp, Homo sapien
cagcctggccagcaccatgggcagg

SEQ ID NO: 40280 - DNA, 25 bp, Homo sapien
cacacggtggcgctagcgcccagcc

SEQ ID NO: 40281 - DNA, 25 bp, Homo sapien
gatccaggccaacgctccacaaatg

SEQ ID NO: 40282 - DNA, 25 bp, Homo sapien
tgctgggatccaggccaacgctcca

SEQ ID NO: 40283 - DNA, 25 bp, Homo sapien
tccacatctgcgttcctgcagggcg

SEQ ID NO: 40284 - DNA, 25 bp, Homo sapien
gaagtagtgtctggaaaacgctggc

SEQ ID NO: 40285 - DNA, 25 bp, Homo sapien
gcggccgcttggaagctccttattt

SEQ ID NO: 40286 - DNA, 25 bp, Homo sapien
cagagtttcctgtcgccgagcacgg

SEQ ID NO: 40287 - DNA, 25 bp, Homo sapien
tcctcggtgacaggccgtgtcactc

SEQ ID NO: 40288 - DNA, 25 bp, Homo sapien
agctccttatttgggcagtgatgtc

SEQ ID NO: 40289 - DNA, 25 bp, Homo sapien
gagttggcaccgacgcactactgca

SEQ ID NO: 40290 - DNA, 25 bp, Homo sapien
ctcactccaagggtcccgggagttg

SEQ ID NO: 40291 - DNA, 25 bp, Homo sapien
ctgagagcgcgtgcatcaggccacc

SEQ ID NO: 40292 - DNA, 25 bp, Homo sapien
ccgcgagcgcgtgaaccgtgggctc

SEQ ID NO: 40293 - DNA, 25 bp, Homo sapien
gtgcggctccggtacccagacgctt

SEQ ID NO: 40294 - DNA, 25 bp, Homo sapien
ggtacccagacgcttcaccacgccc

SEQ ID NO: 40295 - DNA, 25 bp, Homo sapien
gcgtgtcccttacgcatttccgtcg

SEQ ID NO: 40296 - DNA, 25 bp, Homo sapien
actgacgttgcgccgggttcgagta

SEQ ID NO: 40297 - DNA, 25 bp, Homo sapien
acgcatttccgtcgccgggaggaag

SEQ ID NO: 40298 - DNA, 25 bp, Homo sapien
ttacgcatttccgtcgccgggagga

SEQ ID NO: 40299 - DNA, 25 bp, Homo sapien
ccttacgcatttccgtcgccgggag

SEQ ID NO: 40300 - DNA, 25 bp, Homo sapien
cacggcgcgcatagggttacagccc

SEQ ID NO: 40301 - DNA, 25 bp, Homo sapien
ccagccgaggctcctatggagccgg

SEQ ID NO: 40302 - DNA, 25 bp, Homo sapien
agagcctgctgcaagcagcgctgga

SEQ ID NO: 40303 - DNA, 25 bp, Homo sapien
cggtgccacggaacgcgatgcctaa

SEQ ID NO: 40304 - DNA, 25 bp, Homo sapien
gcagccggacaccttgcctaagaaa

SEQ ID NO: 40305 - DNA, 25 bp, Homo sapien
gcctaagaaaggcatacacaaaatg

SEQ ID NO: 40306 - DNA, 25 bp, Homo sapien
cagctcgctattctgcttcgcggtg

SEQ ID NO: 40307 - DNA, 25 bp, Homo sapien
cacaaaatggaatcgcagctcgcta

SEQ ID NO: 40308 - DNA, 25 bp, Homo sapien
gccggcaggacttctggaagggaaa

SEQ ID NO: 40309 - DNA, 25 bp, Homo sapien
tcgttttttcatcccgggcagctgg

SEQ ID NO: 40310 - DNA, 25 bp, Homo sapien
gggcatcgttttttcatcccgggca

SEQ ID NO: 40311 - DNA, 25 bp, Homo sapien
tcgctttcgattggcctcaaaggtg

SEQ ID NO: 40312 - DNA, 25 bp, Homo sapien
gggatgctcgctttcgattggcctc

SEQ ID NO: 40313 - DNA, 25 bp, Homo sapien
agccacccgggccacggcatgcgag

SEQ ID NO: 40314 - DNA, 25 bp, Homo sapien
ctgaccacaaagtgaaactttcccg

SEQ ID NO: 40315 - DNA, 25 bp, Homo sapien
cccgcatctctcagacgtcaacaaa

SEQ ID NO: 40316 - DNA, 25 bp, Homo sapien
ctgcttctcccggtcgttctgggct

SEQ ID NO: 40317 - DNA, 25 bp, Homo sapien
cccgacgctcgacccaccattcgtc

SEQ ID NO: 40318 - DNA, 25 bp, Homo sapien
acccaccattcgtccctccctctgg

SEQ ID NO: 40319 - DNA, 25 bp, Homo sapien
cccactccgggcttcgccggaggcg

SEQ ID NO: 40320 - DNA, 25 bp, Homo sapien
gaggcaacgtcgtgcgcacgcgcag

SEQ ID NO: 40321 - DNA, 25 bp, Homo sapien
gacggtgccgccatgagattgaccc

SEQ ID NO: 40322 - DNA, 25 bp, Homo sapien
agaacttccccctgtgcggtcgcga

SEQ ID NO: 40323 - DNA, 25 bp, Homo sapien
gcaaggtcatgcctacggccgcggc

SEQ ID NO: 40324 - DNA, 25 bp, Homo sapien
cctttctaggctgtgggaggtttga

SEQ ID NO: 40325 - DNA, 25 bp, Homo sapien
ggtacggactaactacatttctgca

SEQ ID NO: 40326 - DNA, 25 bp, Homo sapien
ggtttgatcctctctatgcgccctc

SEQ ID NO: 40327 - DNA, 25 bp, Homo sapien
ttctcgccgagtaggagcctttcta

SEQ ID NO: 40328 - DNA, 25 bp, Homo sapien
tttgcgcccggaaccggaagcgatc

SEQ ID NO: 40329 - DNA, 25 bp, Homo sapien
caggaaacacagagaccacaacgtc

SEQ ID NO: 40330 - DNA, 25 bp, Homo sapien
cccaaggacccagtgcgaagaagcc

SEQ ID NO: 40331 - DNA, 25 bp, Homo sapien
cctccgcgggttgcggctcagtgct

SEQ ID NO: 40332 - DNA, 25 bp, Homo sapien
gcccggccagatcacagggccgccg

SEQ ID NO: 40333 - DNA, 25 bp, Homo sapien
cggctgctgggcgagacagggagtt

SEQ ID NO: 40334 - DNA, 25 bp, Homo sapien
ggagttgaggaagggcgatcctgct

SEQ ID NO: 40335 - DNA, 25 bp, Homo sapien
gacggtgtgggctaggcgcgctccg

SEQ ID NO: 40336 - DNA, 25 bp, Homo sapien
gcgctccgggtcctccgtgaattcc

SEQ ID NO: 40337 - DNA, 25 bp, Homo sapien
gtcctccgtgaattcccagtttcca

SEQ ID NO: 40338 - DNA, 25 bp, Homo sapien
tcctccgtgaattcccagtttccag

SEQ ID NO: 40339 - DNA, 25 bp, Homo sapien
tctgcacgcagagacctctcctcac

SEQ ID NO: 40340 - DNA, 25 bp, Homo sapien
ggcggcagcaagagcagccaacatc

SEQ ID NO: 40341 - DNA, 25 bp, Homo sapien
gtcacggtcgcttcgacgcacgcag

SEQ ID NO: 40342 - DNA, 25 bp, Homo sapien
ctccgctgggacaagtagtgccctg

SEQ ID NO: 40343 - DNA, 25 bp, Homo sapien
agactcccgaggctctgcatcggcg

SEQ ID NO: 40344 - DNA, 25 bp, Homo sapien
cccgcagttgaggacagtagggatc

SEQ ID NO: 40345 - DNA, 25 bp, Homo sapien
tggaccctgcccacggatacctggg

SEQ ID NO: 40346 - DNA, 25 bp, Homo sapien
cccgaaggaatggtgccttctgccc

SEQ ID NO: 40347 - DNA, 25 bp, Homo sapien
aaggtcccaacggtgcctactgcga

SEQ ID NO: 40348 - DNA, 25 bp, Homo sapien
gtgcttatggaccagatcgccgtca

SEQ ID NO: 40349 - DNA, 25 bp, Homo sapien
gccgctaaccttcatagcttcttta

SEQ ID NO: 40350 - DNA, 25 bp, Homo sapien
catctctggcccgtcagctcggaaa

SEQ ID NO: 40351 - DNA, 25 bp, Homo sapien
cagctctggttcctgacggaccggc

SEQ ID NO: 40352 - DNA, 25 bp, Homo sapien
ggactacccgcaggtgcagatcctg

SEQ ID NO: 40353 - DNA, 25 bp, Homo sapien
cactctagctgcgagacttcttggg

SEQ ID NO: 40354 - DNA, 25 bp, Homo sapien
cttcttggggttggagaaagccgct

SEQ ID NO: 40355 - DNA, 25 bp, Homo sapien
ggaccggcgcatccgcgaggactac

SEQ ID NO: 40356 - DNA, 25 bp, Homo sapien
ctacggggtcctgttcttgtatcgc

SEQ ID NO: 40357 - DNA, 25 bp, Homo sapien
gcgggacgtgactcgactaacatct

SEQ ID NO: 40358 - DNA, 25 bp, Homo sapien
agggtcaaacatggccagttcttca

SEQ ID NO: 40359 - DNA, 25 bp, Homo sapien
tcacccaggctaggaaacgaacgtg

SEQ ID NO: 40360 - DNA, 25 bp, Homo sapien
ggaacgtgaccctaccagatgccca

SEQ ID NO: 40361 - DNA, 25 bp, Homo sapien
ttgcagtgtcactttcgctgggctc

SEQ ID NO: 40362 - DNA, 25 bp, Homo sapien
tctggggcagaacaactacgcattt

SEQ ID NO: 40363 - DNA, 25 bp, Homo sapien
gggctgcgtacttgccagcatttca

SEQ ID NO: 40364 - DNA, 25 bp, Homo sapien
gcatttagtattaggctgccgctta

SEQ ID NO: 40365 - DNA, 25 bp, Homo sapien
ccgacttggttcttgaggttcctgc

SEQ ID NO: 40366 - DNA, 25 bp, Homo sapien
tatgacgcccaggtctccgtaggca

SEQ ID NO: 40367 - DNA, 25 bp, Homo sapien
tcgtctctatggttcccgccggaag

SEQ ID NO: 40368 - DNA, 25 bp, Homo sapien
ttccgcctgaaggagaattcgcccg

SEQ ID NO: 40369 - DNA, 25 bp, Homo sapien
agcgggcttagaacatcctcagcga

SEQ ID NO: 40370 - DNA, 25 bp, Homo sapien
gaaggtccaggccactacgaagtcc

SEQ ID NO: 40371 - DNA, 25 bp, Homo sapien
gtgtaggcccgcgaacaaagaacta

SEQ ID NO: 40372 - DNA, 25 bp, Homo sapien
ccatggcggtggcaaattcaagtcc

SEQ ID NO: 40373 - DNA, 25 bp, Homo sapien
gaaagtgaaattgcacccgaaccta

SEQ ID NO: 40374 - DNA, 25 bp, Homo sapien
ctcgggaagccagccagaaagtgaa

SEQ ID NO: 40375 - DNA, 25 bp, Homo sapien
taggcaggcagaactcacccagaga

SEQ ID NO: 40376 - DNA, 25 bp, Homo sapien
cacctgcgccgaagggaaactgctc

SEQ ID NO: 40377 - DNA, 25 bp, Homo sapien
tcagtattggcggtcaggtgagatc

SEQ ID NO: 40378 - DNA, 25 bp, Homo sapien
cccgtggtgttctttgatgtcagta

SEQ ID NO: 40379 - DNA, 25 bp, Homo sapien
ggagcctggtctcgctccacgtcta

SEQ ID NO: 40380 - DNA, 25 bp, Homo sapien
cgtcctctcgggtactctatggttt

SEQ ID NO: 40381 - DNA, 25 bp, Homo sapien
tgtcccgccattctcgctagttcga

SEQ ID NO: 40382 - DNA, 25 bp, Homo sapien
tgggcagattgacagtaccactggc

SEQ ID NO: 40383 - DNA, 25 bp, Homo sapien
ttcgtggccgactactctaattcta

SEQ ID NO: 40384 - DNA, 25 bp, Homo sapien
tctagttccggtctctatggcggcc

SEQ ID NO: 40385 - DNA, 25 bp, Homo sapien
ttgtaggtcgactgaattagccgcc

SEQ ID NO: 40386 - DNA, 25 bp, Homo sapien
ggaagtcacgttccttctgcccgtc

SEQ ID NO: 40387 - DNA, 25 bp, Homo sapien
attagccgccaaaggtccaatgaga

SEQ ID NO: 40388 - DNA, 25 bp, Homo sapien
caacacggcccttggcaatggggtt

SEQ ID NO: 40389 - DNA, 25 bp, Homo sapien
gaggaccatggccacgaagcccagg

SEQ ID NO: 40390 - DNA, 25 bp, Homo sapien
ctacgctgaggaccatggccacgaa

SEQ ID NO: 40391 - DNA, 25 bp, Homo sapien
ttcatgccaactacgctgaggacca

SEQ ID NO: 40392 - DNA, 25 bp, Homo sapien
cgtacacttcatgccaactacgctg

SEQ ID NO: 40393 - DNA, 25 bp, Homo sapien
tgctgtctcccacccgcgtacactt

SEQ ID NO: 40394 - DNA, 25 bp, Homo sapien
ttggcaatggggttgctgtctccca

SEQ ID NO: 40395 - DNA, 25 bp, Homo sapien
tgattggatgtgacctagggtgggc

SEQ ID NO: 40396 - DNA, 25 bp, Homo sapien
gggcactctggagtcagccattaga

SEQ ID NO: 40397 - DNA, 25 bp, Homo sapien
cggaacggccttgcacaaacgccta

SEQ ID NO: 40398 - DNA, 25 bp, Homo sapien
cccacgtttgtgtgaggctgatggc

SEQ ID NO: 40399 - DNA, 25 bp, Homo sapien
agcaccaggccgtaagagcgcaaga

SEQ ID NO: 40400 - DNA, 25 bp, Homo sapien
ggcagcgctacgaggaccaactgaa

SEQ ID NO: 40401 - DNA, 25 bp, Homo sapien
agctcccggctgagatgtgtctttg

SEQ ID NO: 40402 - DNA, 25 bp, Homo sapien
gacctgtaaggtccctcactgctga

SEQ ID NO: 40403 - DNA, 25 bp, Homo sapien
ccagagggcccagtatcaagacaag

SEQ ID NO: 40404 - DNA, 25 bp, Homo sapien
gaagagcagatcaggcgtcaccatg

SEQ ID NO: 40405 - DNA, 25 bp, Homo sapien
cccgaagaagctcaggtcgcgcagg

SEQ ID NO: 40406 - DNA, 25 bp, Homo sapien
ccttagacctcgtggcgctcgcaga

SEQ ID NO: 40407 - DNA, 25 bp, Homo sapien
gtggtcagcagcttcaacgcgcgta

SEQ ID NO: 40408 - DNA, 25 bp, Homo sapien
cttttcctttcagtcagcccggatc

SEQ ID NO: 40409 - DNA, 25 bp, Homo sapien
ctcagtcgaactgacgcccagtaga

SEQ ID NO: 40410 - DNA, 25 bp, Homo sapien
acgcgcctttatgcgcaggctcttc

SEQ ID NO: 40411 - DNA, 25 bp, Homo sapien
tcctactcgcacagcccagggagtg

SEQ ID NO: 40412 - DNA, 25 bp, Homo sapien
gggcttacttccaagacagacacgg

SEQ ID NO: 40413 - DNA, 25 bp, Homo sapien
ccacggtgtttgtgagtctgaccca

SEQ ID NO: 40414 - DNA, 25 bp, Homo sapien
cccgacttaggatccgatgccggca

SEQ ID NO: 40415 - DNA, 25 bp, Homo sapien
taccggctgaagtacctgcggctgc

SEQ ID NO: 40416 - DNA, 25 bp, Homo sapien
tccagcaaggccaggatgaaaaagc

SEQ ID NO: 40417 - DNA, 25 bp, Homo sapien
ggaagttacacactgccgacaccgg

SEQ ID NO: 40418 - DNA, 25 bp, Homo sapien
cgtcccggagagctagattcctaga

SEQ ID NO: 40419 - DNA, 25 bp, Homo sapien
tagattcctagaggcccgattccgc

SEQ ID NO: 40420 - DNA, 25 bp, Homo sapien
tccgcctggatggtttcactccgcg

SEQ ID NO: 40421 - DNA, 25 bp, Homo sapien
gagagctccgcctggatggtttcac

SEQ ID NO: 40422 - DNA, 25 bp, Homo sapien
gtcgccgtgcctgtgccacgcgtgt

SEQ ID NO: 40423 - DNA, 25 bp, Homo sapien
catgagcggcgtcgtcgccgtgcct

SEQ ID NO: 40424 - DNA, 25 bp, Homo sapien
gtctgtaactggcatgagcggcgtc

SEQ ID NO: 40425 - DNA, 25 bp, Homo sapien
tcccgatgtggtcgcggctgaagcc

SEQ ID NO: 40426 - DNA, 25 bp, Homo sapien
cgaccagcccggctccatcttcccg

SEQ ID NO: 40427 - DNA, 25 bp, Homo sapien
gatggtttcactccgcggaggcgcc

SEQ ID NO: 40428 - DNA, 25 bp, Homo sapien
gcttgggagtctgtacctttcccga

SEQ ID NO: 40429 - DNA, 25 bp, Homo sapien
caagaggcttgggagtctgtacctt

SEQ ID NO: 40430 - DNA, 25 bp, Homo sapien
ctctcctggaggaaaatggcggtcg

SEQ ID NO: 40431 - DNA, 25 bp, Homo sapien
cttccctctcctggaggaaaatggc

SEQ ID NO: 40432 - DNA, 25 bp, Homo sapien
gtcctaatgggacgctgagacccag

SEQ ID NO: 40433 - DNA, 25 bp, Homo sapien
cgcagacaacgcctccgggagggta

SEQ ID NO: 40434 - DNA, 25 bp, Homo sapien
cgagtcgcagacaacgcctccggga

SEQ ID NO: 40435 - DNA, 25 bp, Homo sapien
acccagcgcggaaccgtcctaatgg

SEQ ID NO: 40436 - DNA, 25 bp, Homo sapien
acttccctctcaccgaggatctgga

SEQ ID NO: 40437 - DNA, 25 bp, Homo sapien
ctctcaccgaggatctggatgctgc

SEQ ID NO: 40438 - DNA, 25 bp, Homo sapien
gcggacacgacttcgcgggaaactc

SEQ ID NO: 40439 - DNA, 25 bp, Homo sapien
ttgctccctggaccgagtgggaagc

SEQ ID NO: 40440 - DNA, 25 bp, Homo sapien
gacttcgcgggaaactctgtacacg

SEQ ID NO: 40441 - DNA, 25 bp, Homo sapien
gggaaactctgtacacggccacttc

SEQ ID NO: 40442 - DNA, 25 bp, Homo sapien
ggatctggatgctgctgctttgctc

SEQ ID NO: 40443 - DNA, 25 bp, Homo sapien
atgctgctgctttgctccctggacc

SEQ ID NO: 40444 - DNA, 25 bp, Homo sapien
tcggagataatcctccacatcaatt

SEQ ID NO: 40445 - DNA, 25 bp, Homo sapien
cgtagaagacgagcagcagcttgat

SEQ ID NO: 40446 - DNA, 25 bp, Homo sapien
aaaagcgtgtccagcacgtgaggac

SEQ ID NO: 40447 - DNA, 25 bp, Homo sapien
agcttgatgatctgcaccgcgtgga

SEQ ID NO: 40448 - DNA, 25 bp, Homo sapien
ccaggtcagagtcggcccgtaaatc

SEQ ID NO: 40449 - DNA, 25 bp, Homo sapien
taaatcagctccagaacattccggg

SEQ ID NO: 40450 - DNA, 25 bp, Homo sapien
ccgggcaatgtcaaactcaggcttc

SEQ ID NO: 40451 - DNA, 25 bp, Homo sapien
cctcttcagcttcttctcggagata

SEQ ID NO: 40452 - DNA, 25 bp, Homo sapien
ggttcggctcttctctcgcaggccg

SEQ ID NO: 40453 - DNA, 25 bp, Homo sapien
cgcaccaagtctgcgagcaggggcc

SEQ ID NO: 40454 - DNA, 25 bp, Homo sapien
gaggagcgcaccaagtctgcgagca

SEQ ID NO: 40455 - DNA, 25 bp, Homo sapien
cttcaggtcgtacagacgcaggctg

SEQ ID NO: 40456 - DNA, 25 bp, Homo sapien
tcttcctcccaggacgtggggtcca

SEQ ID NO: 40457 - DNA, 25 bp, Homo sapien
gaatccctcgaagcacgtggtcccg

SEQ ID NO: 40458 - DNA, 25 bp, Homo sapien
aggcttaggggaatccctcgaagca

SEQ ID NO: 40459 - DNA, 25 bp, Homo sapien
gccgcgtttctcagccaggcttagg

SEQ ID NO: 40460 - DNA, 25 bp, Homo sapien
ccctcgagtgtgaatgagctccgcc

SEQ ID NO: 40461 - DNA, 25 bp, Homo sapien
ctcggggacgtcgatactgacccag

SEQ ID NO: 40462 - DNA, 25 bp, Homo sapien
tgcgcctgcgctgacattttgcagt

SEQ ID NO: 40463 - DNA, 25 bp, Homo sapien
gggcccaacaatgcgcctctgattg

SEQ ID NO: 40464 - DNA, 25 bp, Homo sapien
agtaaaccgcatcgcctggcaagca

SEQ ID NO: 40465 - DNA, 25 bp, Homo sapien
gggatgcccagcgatacacaagtca

SEQ ID NO: 40466 - DNA, 25 bp, Homo sapien
agacgtcaccttacgcgggatagga

SEQ ID NO: 40467 - DNA, 25 bp, Homo sapien
ctgccaacgttctgggccctcgagt

SEQ ID NO: 40468 - DNA, 25 bp, Homo sapien
ctcttgcctcttgccagagagcgcg

SEQ ID NO: 40469 - DNA, 25 bp, Homo sapien
actagcgaccggcacgctcgctgtt

SEQ ID NO: 40470 - DNA, 25 bp, Homo sapien
ggggactcccactgcgactctgact

SEQ ID NO: 40471 - DNA, 25 bp, Homo sapien
aggagtctgcgcctttgttcctggc

SEQ ID NO: 40472 - DNA, 25 bp, Homo sapien
ccgagaccggaggttcatctcaacc

SEQ ID NO: 40473 - DNA, 25 bp, Homo sapien
tcgcaaaggagagcctccgagaccg

SEQ ID NO: 40474 - DNA, 25 bp, Homo sapien
ggcctgcactcctcgcaaaggagag

SEQ ID NO: 40475 - DNA, 25 bp, Homo sapien
cgcgcggaccgtagcgtttatagga

SEQ ID NO: 40476 - DNA, 25 bp, Homo sapien
cagagccgtgcacccgaatatccat

SEQ ID NO: 40477 - DNA, 25 bp, Homo sapien
cagctttgttacctgccctggcgcg

SEQ ID NO: 40478 - DNA, 25 bp, Homo sapien
gagctgtgcatctcacgactcctgc

SEQ ID NO: 40479 - DNA, 25 bp, Homo sapien
caggccctattagtgtctgggcttc

SEQ ID NO: 40480 - DNA, 25 bp, Homo sapien
ggcttcgggcatctagtctgcaaaa

SEQ ID NO: 40481 - DNA, 25 bp, Homo sapien
cgccggcacactggcagctttgtta

SEQ ID NO: 40482 - DNA, 25 bp, Homo sapien
caactccgctcagaagcctggggca

SEQ ID NO: 40483 - DNA, 25 bp, Homo sapien
aaccgactgtgtcgcttttctcggg

SEQ ID NO: 40484 - DNA, 25 bp, Homo sapien
ccgagcaccgtcagaccgtcttgga

SEQ ID NO: 40485 - DNA, 25 bp, Homo sapien
tgcagacatcatccgcgagcagatc

SEQ ID NO: 40486 - DNA, 25 bp, Homo sapien
gggcctgtccgtggccttagcctgt

SEQ ID NO: 40487 - DNA, 25 bp, Homo sapien
cgagcgggagaatgcagacatcatc

SEQ ID NO: 40488 - DNA, 25 bp, Homo sapien
ctgcggcacaagaatgagatgctgc

SEQ ID NO: 40489 - DNA, 25 bp, Homo sapien
cgtcagaccgtcttggagtccatca

SEQ ID NO: 40490 - DNA, 25 bp, Homo sapien
ttggagtccatcaggtgagcactgc

SEQ ID NO: 40491 - DNA, 25 bp, Homo sapien
ctgcactgcatggtgctgagctgcc

SEQ ID NO: 40492 - DNA, 25 bp, Homo sapien
aatccatggaggtgctcagcgtgac

SEQ ID NO: 40493 - DNA, 25 bp, Homo sapien
tgagcccgaaccagagcagcccatt

SEQ ID NO: 40494 - DNA, 25 bp, Homo sapien
gcggcggccagaacgcaaatccatg

SEQ ID NO: 40495 - DNA, 25 bp, Homo sapien
cccgatgctgaaccggcacggcaag

SEQ ID NO: 40496 - DNA, 25 bp, Homo sapien
ccggaacgagataggtatgggtcca

SEQ ID NO: 40497 - DNA, 25 bp, Homo sapien
gcccattcctcgcaaggtgcagatc

SEQ ID NO: 40498 - DNA, 25 bp, Homo sapien
ctctcgcccgctgtagggagaacca

SEQ ID NO: 40499 - DNA, 25 bp, Homo sapien
tgggctgcttccgagaccgcaacaa

SEQ ID NO: 40500 - DNA, 25 bp, Homo sapien
gaccgcccgctgagcaacgtgactg

SEQ ID NO: 40501 - DNA, 25 bp, Homo sapien
gcccgctgagcaacgtgactgcgcg

SEQ ID NO: 40502 - DNA, 25 bp, Homo sapien
ggcctctgtgccgacccagctgatt

SEQ ID NO: 40503 - DNA, 25 bp, Homo sapien
agctgattcctctcgggctgcaaat

SEQ ID NO: 40504 - DNA, 25 bp, Homo sapien
ggctgcaaatcccttccggctgaca

SEQ ID NO: 40505 - DNA, 25 bp, Homo sapien
tgggcgctgaggattggagcccatt

SEQ ID NO: 40506 - DNA, 25 bp, Homo sapien
cgctcccaaacagcccgcggggcgc

SEQ ID NO: 40507 - DNA, 25 bp, Homo sapien
gaaatccggcgccggcccttgaagc

SEQ ID NO: 40508 - DNA, 25 bp, Homo sapien
tcaaggagctacgaacccagaaact

SEQ ID NO: 40509 - DNA, 25 bp, Homo sapien
ctctacacgcagtatcacgtgaatc

SEQ ID NO: 40510 - DNA, 25 bp, Homo sapien
agcactacccgagcgctgttgcctg

SEQ ID NO: 40511 - DNA, 25 bp, Homo sapien
tggagaccacgggacgccgttgcct

SEQ ID NO: 40512 - DNA, 25 bp, Homo sapien
ggacacccaaaagagaaggtgattc

SEQ ID NO: 40513 - DNA, 25 bp, Homo sapien
aaggtgattccagatgaggtccatc

SEQ ID NO: 40514 - DNA, 25 bp, Homo sapien
ttgcgggaactgtacctcaaggagc

SEQ ID NO: 40515 - DNA, 25 bp, Homo sapien
cctccgcaagagtgagaggcacggc

SEQ ID NO: 40516 - DNA, 25 bp, Homo sapien
tagcacgacattgaggcctggcttc

SEQ ID NO: 40517 - DNA, 25 bp, Homo sapien
agccctcgggaaaacgcatcctgca

SEQ ID NO: 40518 - DNA, 25 bp, Homo sapien
aatcacggtcactcccaggggtgta

SEQ ID NO: 40519 - DNA, 25 bp, Homo sapien
ctctgtctgtgacaagggattcatc

SEQ ID NO: 40520 - DNA, 25 bp, Homo sapien
gctcaacttttgattgggacttccg

SEQ ID NO: 40521 - DNA, 25 bp, Homo sapien
ccatacttccggtttgtcgttgcta

SEQ ID NO: 40522 - DNA, 25 bp, Homo sapien
tcgttgctataggaaccgctacggc

SEQ ID NO: 40523 - DNA, 25 bp, Homo sapien
gaagcgcatcccatgtccgagtacc

SEQ ID NO: 40524 - DNA, 25 bp, Homo sapien
ggcgtggcactgctgtcaaccacca

SEQ ID NO: 40525 - DNA, 25 bp, Homo sapien
ttctggtgaaacagctgatgagctc

SEQ ID NO: 40526 - DNA, 25 bp, Homo sapien
ggacatgaactgcatccgccaggcc

SEQ ID NO: 40527 - DNA, 25 bp, Homo sapien
agctcggctgtgcaggacatgaact

SEQ ID NO: 40528 - DNA, 25 bp, Homo sapien
ctagcaacgggcactgtgctctgtt

SEQ ID NO: 40529 - DNA, 25 bp, Homo sapien
accagcagccgctcaggtgaatggc

SEQ ID NO: 40530 - DNA, 25 bp, Homo sapien
gctcaggtgaatggcggctagcaac

SEQ ID NO: 40531 - DNA, 25 bp, Homo sapien
cactgtgctctgtttgctggctctg

SEQ ID NO: 40532 - DNA, 25 bp, Homo sapien
gcgcgcaacggttcgcaccaggtca

SEQ ID NO: 40533 - DNA, 25 bp, Homo sapien
aaggacgaccgtatcgtgcgcaccc

SEQ ID NO: 40534 - DNA, 25 bp, Homo sapien
gttcgcaccaggtcacgcttcgcgg

SEQ ID NO: 40535 - DNA, 25 bp, Homo sapien
agccctcggacctcgtgggcgtctt

SEQ ID NO: 40536 - DNA, 25 bp, Homo sapien
ggcgcacgcgcgtcatctacgtgca

SEQ ID NO: 40537 - DNA, 25 bp, Homo sapien
tcatctacgtgcacaacagccctgg

SEQ ID NO: 40538 - DNA, 25 bp, Homo sapien
aacagccctggaggtgagttaggca

SEQ ID NO: 40539 - DNA, 25 bp, Homo sapien
ctggagaaggacgaccgtatcgtgc

SEQ ID NO: 40540 - DNA, 25 bp, Homo sapien
ggcagtttcctgcacactacaggta

SEQ ID NO: 40541 - DNA, 25 bp, Homo sapien
tgtctcctagcctggatctccttgg

SEQ ID NO: 40542 - DNA, 25 bp, Homo sapien
tgggtcaaacagacgctgggctatc

SEQ ID NO: 40543 - DNA, 25 bp, Homo sapien
cggagctgcaggatttgggtcaaac

SEQ ID NO: 40544 - DNA, 25 bp, Homo sapien
gggcgctctatcctgttgctgggaa

SEQ ID NO: 40545 - DNA, 25 bp, Homo sapien
gtttctctcgggcagagcgtgatcc

SEQ ID NO: 40546 - DNA, 25 bp, Homo sapien
aggcattcttggttcgctctgtgac

SEQ ID NO: 40547 - DNA, 25 bp, Homo sapien
tggtgaccgctctgcatctagtgct

SEQ ID NO: 40548 - DNA, 25 bp, Homo sapien
gccgctagactctcgtgatagctga

SEQ ID NO: 40549 - DNA, 25 bp, Homo sapien
ttctaggaacggctcaagcgccttg

SEQ ID NO: 40550 - DNA, 25 bp, Homo sapien
ttgggcactccatcgggttctgcac

SEQ ID NO: 40551 - DNA, 25 bp, Homo sapien
tgcaccgagttctgcatcataaata

SEQ ID NO: 40552 - DNA, 25 bp, Homo sapien
ggccggctttccagtactagtcctc

SEQ ID NO: 40553 - DNA, 25 bp, Homo sapien
tgttaaagccggtcggaactgctcc

SEQ ID NO: 40554 - DNA, 25 bp, Homo sapien
gccctgattttgtggccggccagga

SEQ ID NO: 40555 - DNA, 25 bp, Homo sapien
aacttctgcaggttctcggaccctg

SEQ ID NO: 40556 - DNA, 25 bp, Homo sapien
acgccgagggctggcacacacgtct

SEQ ID NO: 40557 - DNA, 25 bp, Homo sapien
ctcacacacgtgtgcgcgctgcctg

SEQ ID NO: 40558 - DNA, 25 bp, Homo sapien
acacgcatggctcccggccctcacg

SEQ ID NO: 40559 - DNA, 25 bp, Homo sapien
tgggctgacacgcatggctcccggc

SEQ ID NO: 40560 - DNA, 25 bp, Homo sapien
tccgtgggctgacacgcatggctcc

SEQ ID NO: 40561 - DNA, 25 bp, Homo sapien
cacctccgtgggctgacacgcatgg

SEQ ID NO: 40562 - DNA, 25 bp, Homo sapien
gagggctggcacacacgtctcctgc

SEQ ID NO: 40563 - DNA, 25 bp, Homo sapien
gtctcctgcctgacacaccacgcaa

SEQ ID NO: 40564 - DNA, 25 bp, Homo sapien
ttcggccttgccttcaaagagctcc

SEQ ID NO: 40565 - DNA, 25 bp, Homo sapien
tggccacctcaggagcacgctgtct

SEQ ID NO: 40566 - DNA, 25 bp, Homo sapien
aggagcacgctgtctcttcccgacg

SEQ ID NO: 40567 - DNA, 25 bp, Homo sapien
tgcacatctgtggcggcaggcccag

SEQ ID NO: 40568 - DNA, 25 bp, Homo sapien
ggaggttcggccttgccttcaaaga

SEQ ID NO: 40569 - DNA, 25 bp, Homo sapien
tcaaagagctccctctcctgcaggg

SEQ ID NO: 40570 - DNA, 25 bp, Homo sapien
agaccacactgcgtgtgctgagggc

SEQ ID NO: 40571 - DNA, 25 bp, Homo sapien
cgggcgagaccacactgcgtgtgct

SEQ ID NO: 40572 - DNA, 25 bp, Homo sapien
gctgccacgatttcacttccggttt

SEQ ID NO: 40573 - DNA, 25 bp, Homo sapien
cttccggttttccagtcagcaaacg

SEQ ID NO: 40574 - DNA, 25 bp, Homo sapien
gagaaggcttcgtccaccaatcaga

SEQ ID NO: 40575 - DNA, 25 bp, Homo sapien
tgtacccgaagcttgccagccgcta

SEQ ID NO: 40576 - DNA, 25 bp, Homo sapien
tcagcaaacgcctacgagaaggctt

SEQ ID NO: 40577 - DNA, 25 bp, Homo sapien
atcagaaaactggaactcggccctc

SEQ ID NO: 40578 - DNA, 25 bp, Homo sapien
ggtcaagagtggaacaccctcactg

SEQ ID NO: 40579 - DNA, 25 bp, Homo sapien
tactgacatgtcacccgcgtcgtcg

SEQ ID NO: 40580 - DNA, 25 bp, Homo sapien
gcgagtctgaaatcccaggtcctca

SEQ ID NO: 40581 - DNA, 25 bp, Homo sapien
cttgcaaggatctgaccgccgccta

SEQ ID NO: 40582 - DNA, 25 bp, Homo sapien
ccggcgcgaccatgcttgcaaggat

SEQ ID NO: 40583 - DNA, 25 bp, Homo sapien
tctgtcggcccacaggattaatggc

SEQ ID NO: 40584 - DNA, 25 bp, Homo sapien
ttcgtcgaccttgagaaaggggcgc

SEQ ID NO: 40585 - DNA, 25 bp, Homo sapien
tagcctagctaggttccttcgtcga

SEQ ID NO: 40586 - DNA, 25 bp, Homo sapien
ggcagcccattctgcgcgagtctga

SEQ ID NO: 40587 - DNA, 25 bp, Homo sapien
tctccgataccaagacctagccttt

SEQ ID NO: 40588 - DNA, 25 bp, Homo sapien
gggagacgtcccgcatcacggtgct

SEQ ID NO: 40589 - DNA, 25 bp, Homo sapien
tgagggagacgtcccgcatcacggt

SEQ ID NO: 40590 - DNA, 25 bp, Homo sapien
tccctagtgagggagacgtcccgca

SEQ ID NO: 40591 - DNA, 25 bp, Homo sapien
agccgtccctagtgagggagacgtc

SEQ ID NO: 40592 - DNA, 25 bp, Homo sapien
ctcggctggggaagccgtccctagt

SEQ ID NO: 40593 - DNA, 25 bp, Homo sapien
tgcgccagtgcggtgtctctgctgc

SEQ ID NO: 40594 - DNA, 25 bp, Homo sapien
ctagtgagggagacgtcccgcatca

SEQ ID NO: 40595 - DNA, 25 bp, Homo sapien
cgccagtgcggtgtctctgctgcag

SEQ ID NO: 40596 - DNA, 25 bp, Homo sapien
cgagcactgttcgtggttagaaaag

SEQ ID NO: 40597 - DNA, 25 bp, Homo sapien
cttctcttggtctcctgcagagaga

SEQ ID NO: 40598 - DNA, 25 bp, Homo sapien
tgttgatcagtacaagccgcagccc

SEQ ID NO: 40599 - DNA, 25 bp, Homo sapien
gccctgcgaacgaacgagcactgtt

SEQ ID NO: 40600 - DNA, 25 bp, Homo sapien
cgggccttcacgaaaagcgcctacg

SEQ ID NO: 40601 - DNA, 25 bp, Homo sapien
cctacggttagcgagagagggatca

SEQ ID NO: 40602 - DNA, 25 bp, Homo sapien
gctcggggaatagccaggacagatt

SEQ ID NO: 40603 - DNA, 25 bp, Homo sapien
tcctgcagagagaacgggcctcagc

SEQ ID NO: 40604 - DNA, 25 bp, Homo sapien
acctgtcccgtgaggacgtggccac

SEQ ID NO: 40605 - DNA, 25 bp, Homo sapien
tttctgttttcctcggcgtctctgc

SEQ ID NO: 40606 - DNA, 25 bp, Homo sapien
ctgtctcggctgctttctgttttcc

SEQ ID NO: 40607 - DNA, 25 bp, Homo sapien
accctctccgaaagttcactcagtg

SEQ ID NO: 40608 - DNA, 25 bp, Homo sapien
cccaaccgggtgcaacgccctggag

SEQ ID NO: 40609 - DNA, 25 bp, Homo sapien
cacccagcgcaaagtttcccgtttg

SEQ ID NO: 40610 - DNA, 25 bp, Homo sapien
tctccaccgcaccttagccgcagcc

SEQ ID NO: 40611 - DNA, 25 bp, Homo sapien
tccgaaagttcactcagtggccgcc

SEQ ID NO: 40612 - DNA, 25 bp, Homo sapien
cgatttgaggggactcagcgtgact

SEQ ID NO: 40613 - DNA, 25 bp, Homo sapien
ttgcggtagatgcaaacgccgcggc

SEQ ID NO: 40614 - DNA, 25 bp, Homo sapien
ccctggggttcgctttgcggtagat

SEQ ID NO: 40615 - DNA, 25 bp, Homo sapien
tgggtgcttgcgactgtccacgtgt

SEQ ID NO: 40616 - DNA, 25 bp, Homo sapien
gactcagcgtgactggtgcatcccg

SEQ ID NO: 40617 - DNA, 25 bp, Homo sapien
ccgcactgtgcagggcacccggttg

SEQ ID NO: 40618 - DNA, 25 bp, Homo sapien
aagcctagtgggaggattccctgga

SEQ ID NO: 40619 - DNA, 25 bp, Homo sapien
cttcggcgccaacaggaggcgattt

SEQ ID NO: 40620 - DNA, 25 bp, Homo sapien
tggcatcacctacagcctgcgcgtg

SEQ ID NO: 40621 - DNA, 25 bp, Homo sapien
aggcacgcatgctgagcgccagcac

SEQ ID NO: 40622 - DNA, 25 bp, Homo sapien
cggggataccgcgtctactatactc

SEQ ID NO: 40623 - DNA, 25 bp, Homo sapien
gcgccagcaccatgctggtgcagtg

SEQ ID NO: 40624 - DNA, 25 bp, Homo sapien
tggcacaagcacaacaccgacgcgg

SEQ ID NO: 40625 - DNA, 25 bp, Homo sapien
ggaatatgccttccgcgtgctggcg

SEQ ID NO: 40626 - DNA, 25 bp, Homo sapien
atggtgtggccaccacccgctacag

SEQ ID NO: 40627 - DNA, 25 bp, Homo sapien
tcagccctttctcggaatatgcctt

SEQ ID NO: 40628 - DNA, 25 bp, Homo sapien
gccgcaacggcgttatcacccagta

SEQ ID NO: 40629 - DNA, 25 bp, Homo sapien
ggcgttatcacccagtactccgtgg

SEQ ID NO: 40630 - DNA, 25 bp, Homo sapien
ttatcacccagtactccgtggccta

SEQ ID NO: 40631 - DNA, 25 bp, Homo sapien
caccgatgaggacggtaggcagtgc

SEQ ID NO: 40632 - DNA, 25 bp, Homo sapien
tggatggcatcagccgtgagcactc

SEQ ID NO: 40633 - DNA, 25 bp, Homo sapien
tggcatcagccgtgagcactccagc

SEQ ID NO: 40634 - DNA, 25 bp, Homo sapien
tcagccgtgagcactccagctggga

SEQ ID NO: 40635 - DNA, 25 bp, Homo sapien
ccgccgcctgccgacagccgcaacg

SEQ ID NO: 40636 - DNA, 25 bp, Homo sapien
gagtactcgtttgtgctgatgaacc

SEQ ID NO: 40637 - DNA, 25 bp, Homo sapien
cgggcactcgatgcggaagctgatc

SEQ ID NO: 40638 - DNA, 25 bp, Homo sapien
ctgatgaaccgtggcagcagcgcag

SEQ ID NO: 40639 - DNA, 25 bp, Homo sapien
ttgtcaggtgtgcacacgaggtatc

SEQ ID NO: 40640 - DNA, 25 bp, Homo sapien
ccctcgcttgtcaggtgtgcacacg

SEQ ID NO: 40641 - DNA, 25 bp, Homo sapien
ggacggccgcttcgatctctccatg

SEQ ID NO: 40642 - DNA, 25 bp, Homo sapien
tgcctacatagaggacggccgcttc

SEQ ID NO: 40643 - DNA, 25 bp, Homo sapien
ggaagctgatcgcagacctgcagcc

SEQ ID NO: 40644 - DNA, 25 bp, Homo sapien
gtacagcgtttcctcccggcaacag

SEQ ID NO: 40645 - DNA, 25 bp, Homo sapien
aattggttgactctgtacggctgcg

SEQ ID NO: 40646 - DNA, 25 bp, Homo sapien
tcggccttcgcctgctggaaaagca

SEQ ID NO: 40647 - DNA, 25 bp, Homo sapien
tattttcttcttcctgcggccgagc

SEQ ID NO: 40648 - DNA, 25 bp, Homo sapien
tcggccaataggagaaggagcttcc

SEQ ID NO: 40649 - DNA, 25 bp, Homo sapien
cgctgtagcagtgaccgtgagtttt

SEQ ID NO: 40650 - DNA, 25 bp, Homo sapien
ggcttgcagccacccttgaattggt

SEQ ID NO: 40651 - DNA, 25 bp, Homo sapien
tgatcggcatgtttctcggccaata

SEQ ID NO: 40652 - DNA, 25 bp, Homo sapien
ggagagacacccacgctgaacctgc

SEQ ID NO: 40653 - DNA, 25 bp, Homo sapien
gggcccagtacctggatgacctctc

SEQ ID NO: 40654 - DNA, 25 bp, Homo sapien
tggccgtgactaccctagcactttg

SEQ ID NO: 40655 - DNA, 25 bp, Homo sapien
aggccaggaggtctgagatcatctc

SEQ ID NO: 40656 - DNA, 25 bp, Homo sapien
ggtccgaagctttcggcctcagtga

SEQ ID NO: 40657 - DNA, 25 bp, Homo sapien
aaatccgcggctcctgcgtctattg

SEQ ID NO: 40658 - DNA, 25 bp, Homo sapien
tgaacctgcaagctggggtgctcca

SEQ ID NO: 40659 - DNA, 25 bp, Homo sapien
agggttcctctagacagctcgatgt

SEQ ID NO: 40660 - DNA, 25 bp, Homo sapien
ccgctcgagttctctactctccata

SEQ ID NO: 40661 - DNA, 25 bp, Homo sapien
cagctctctacttcgcgagtctaca

SEQ ID NO: 40662 - DNA, 25 bp, Homo sapien
cgtgcctctccaccgctcgagttct

SEQ ID NO: 40663 - DNA, 25 bp, Homo sapien
ctccgccagcagcaggtccctcggg

SEQ ID NO: 40664 - DNA, 25 bp, Homo sapien
ctggaatttgacaccggacggctgc

SEQ ID NO: 40665 - DNA, 25 bp, Homo sapien
acgctggggctggaatttgacaccg

SEQ ID NO: 40666 - DNA, 25 bp, Homo sapien
tctactctccatatccgaggggccc

SEQ ID NO: 40667 - DNA, 25 bp, Homo sapien
gcgagtctacaaactcaactcccgg

SEQ ID NO: 40668 - DNA, 25 bp, Homo sapien
gcagcagcgagtccgccgtccgact

SEQ ID NO: 40669 - DNA, 25 bp, Homo sapien
ggctgcggttcccagtaactcccgc

SEQ ID NO: 40670 - DNA, 25 bp, Homo sapien
tattgttgtggtttagcgcctggca

SEQ ID NO: 40671 - DNA, 25 bp, Homo sapien
gcggcggtattattgttgtggttta

SEQ ID NO: 40672 - DNA, 25 bp, Homo sapien
cacacacttgtcagcggcggtatta

SEQ ID NO: 40673 - DNA, 25 bp, Homo sapien
ttgttgctccctaaccacacacttg

SEQ ID NO: 40674 - DNA, 25 bp, Homo sapien
cccagatgaagcagggggagtttta

SEQ ID NO: 40675 - DNA, 25 bp, Homo sapien
gctgctctgggacccagatgaagca

SEQ ID NO: 40676 - DNA, 25 bp, Homo sapien
agctggtgcgtttccgcttctgcag

SEQ ID NO: 40677 - DNA, 25 bp, Homo sapien
cgcgtgactgggtctcattccaggg

SEQ ID NO: 40678 - DNA, 25 bp, Homo sapien
ctccgacgagctggtgcgtttccgc

SEQ ID NO: 40679 - DNA, 25 bp, Homo sapien
gacaccgcgcgtgactgggtctcat

SEQ ID NO: 40680 - DNA, 25 bp, Homo sapien
acgcgctacgaagcggtctccttca

SEQ ID NO: 40681 - DNA, 25 bp, Homo sapien
gcggtctccttcatggacgtcaaca

SEQ ID NO: 40682 - DNA, 25 bp, Homo sapien
tggacgtcaacagcacctggagaac

SEQ ID NO: 40683 - DNA, 25 bp, Homo sapien
acctggagaaccgtggaccgcctct

SEQ ID NO: 40684 - DNA, 25 bp, Homo sapien
ccgcgctggggcttgtttgtccggg

SEQ ID NO: 40685 - DNA, 25 bp, Homo sapien
aggcagagtctcacgctaccgccca

SEQ ID NO: 40686 - DNA, 25 bp, Homo sapien
tgatctcataatccacccgtctcag

SEQ ID NO: 40687 - DNA, 25 bp, Homo sapien
gggcttgtttgtccgggtgtgtgtg

SEQ ID NO: 40688 - DNA, 25 bp, Homo sapien
cggcgttgtcgttcttctcgcttgt

SEQ ID NO: 40689 - DNA, 25 bp, Homo sapien
gccggcgttgtcgttcttctcgctt

SEQ ID NO: 40690 - DNA, 25 bp, Homo sapien
tggccggcgttgtcgttcttctcgc

SEQ ID NO: 40691 - DNA, 25 bp, Homo sapien
ggcgttgtcgttcttctcgcttgtg

SEQ ID NO: 40692 - DNA, 25 bp, Homo sapien
tcagttctcgcacgggctcgaccaa

SEQ ID NO: 40693 - DNA, 25 bp, Homo sapien
tcccgaccattgatgtgagaaaggc

SEQ ID NO: 40694 - DNA, 25 bp, Homo sapien
ttgcagactgcggttgtcaagtgcc

SEQ ID NO: 40695 - DNA, 25 bp, Homo sapien
atgggcacgaacctcgcgctcactt

SEQ ID NO: 40696 - DNA, 25 bp, Homo sapien
cacttgctgctcagtgccagggcga

SEQ ID NO: 40697 - DNA, 25 bp, Homo sapien
agtcggcacccaagcccactaaaga

SEQ ID NO: 40698 - DNA, 25 bp, Homo sapien
tgaccatggcaacccgaggtgtgca

SEQ ID NO: 40699 - DNA, 25 bp, Homo sapien
gcgcgtcaatccatcagttcgtcaa

SEQ ID NO: 40700 - DNA, 25 bp, Homo sapien
gatgctgcccaatcaggaggcccgg

SEQ ID NO: 40701 - DNA, 25 bp, Homo sapien
gcctgagatcagagtcacgcccttg

SEQ ID NO: 40702 - DNA, 25 bp, Homo sapien
agaccctgtcgagcgagcgctacga

SEQ ID NO: 40703 - DNA, 25 bp, Homo sapien
gagcgctacgagtctcacctgggaa

SEQ ID NO: 40704 - DNA, 25 bp, Homo sapien
gcttcagatggcaccggactggatg

SEQ ID NO: 40705 - DNA, 25 bp, Homo sapien
ccctgattggttggatgctgcccaa

SEQ ID NO: 40706 - DNA, 25 bp, Homo sapien
gcgctttcgtcggtgccttgacctc

SEQ ID NO: 40707 - DNA, 25 bp, Homo sapien
ctcccgtttctcgtggagccaggtg

SEQ ID NO: 40708 - DNA, 25 bp, Homo sapien
ccatcacgtcgatgcaggcattgat

SEQ ID NO: 40709 - DNA, 25 bp, Homo sapien
cccagtcgaactgctcggggtggca

SEQ ID NO: 40710 - DNA, 25 bp, Homo sapien
atggcccagtcgaactgctcggggt

SEQ ID NO: 40711 - DNA, 25 bp, Homo sapien
cgtcgatgcaggcattgatggccca

SEQ ID NO: 40712 - DNA, 25 bp, Homo sapien
aagatacattctcaccaggcgcgcc

SEQ ID NO: 40713 - DNA, 25 bp, Homo sapien
agaacatactcgttaagatacattc

SEQ ID NO: 40714 - DNA, 25 bp, Homo sapien
gccggcttaagaacatactcgttaa

SEQ ID NO: 40715 - DNA, 25 bp, Homo sapien
tgcaggcattgatggcccagtcgaa

SEQ ID NO: 40716 - DNA, 25 bp, Homo sapien
ggcccgaactgcacgtggtagccga

SEQ ID NO: 40717 - DNA, 25 bp, Homo sapien
actcaggcactagcgccacgtcgta

SEQ ID NO: 40718 - DNA, 25 bp, Homo sapien
agatccagtccgtggcgttccctgg

SEQ ID NO: 40719 - DNA, 25 bp, Homo sapien
tccagcacatagtagcccgagtctg

SEQ ID NO: 40720 - DNA, 25 bp, Homo sapien
gacgctctcaattatcacccacgga

SEQ ID NO: 40721 - DNA, 25 bp, Homo sapien
gtcctgggtctgacgctctcaatta

SEQ ID NO: 40722 - DNA, 25 bp, Homo sapien
ggctcctccctgaacagtcctgggt

SEQ ID NO: 40723 - DNA, 25 bp, Homo sapien
ccggtcttcacacgtgggagtctga

SEQ ID NO: 40724 - DNA, 25 bp, Homo sapien
ccgccagcctcaggtgagcaggacg

SEQ ID NO: 40725 - DNA, 25 bp, Homo sapien
atacgaccgaggcacgcacgcgcag

SEQ ID NO: 40726 - DNA, 25 bp, Homo sapien
cacggacggtgtcgcctggagcacc

SEQ ID NO: 40727 - DNA, 25 bp, Homo sapien
gcgctcggcaactcgctcgctcgct

SEQ ID NO: 40728 - DNA, 25 bp, Homo sapien
agcctcaggtgagcaggacgctccg

SEQ ID NO: 40729 - DNA, 25 bp, Homo sapien
gcagcaccagccgagatacgaccga

SEQ ID NO: 40730 - DNA, 25 bp, Homo sapien
agccgagatacgaccgaggcacgca

SEQ ID NO: 40731 - DNA, 25 bp, Homo sapien
agcggagggccacgcgcacagaccc

SEQ ID NO: 40732 - DNA, 25 bp, Homo sapien
gcatggactgctgcaccgtaagtta

SEQ ID NO: 40733 - DNA, 25 bp, Homo sapien
ctcaggttacattcgcgagcggagc

SEQ ID NO: 40734 - DNA, 25 bp, Homo sapien
tccggcgtacatctgcctggcagtc

SEQ ID NO: 40735 - DNA, 25 bp, Homo sapien
ctggagacactgcagcgactccttc

SEQ ID NO: 40736 - DNA, 25 bp, Homo sapien
gaaaaatgctcctcaactcgcgggg

SEQ ID NO: 40737 - DNA, 25 bp, Homo sapien
gcgcccatccgttagacagcctagg

SEQ ID NO: 40738 - DNA, 25 bp, Homo sapien
gacgctggcaaccatcgcctggaga

SEQ ID NO: 40739 - DNA, 25 bp, Homo sapien
aacgatcgcctaagcgccctgtgca

SEQ ID NO: 40740 - DNA, 25 bp, Homo sapien
aggagccgttttgccctcggcgatc

SEQ ID NO: 40741 - DNA, 25 bp, Homo sapien
gtcctacagattcatgctggtcctg

SEQ ID NO: 40742 - DNA, 25 bp, Homo sapien
gcctgagcagttcgactgtgccatc

SEQ ID NO: 40743 - DNA, 25 bp, Homo sapien
tgtgccatcaacagccgcatcgacg

SEQ ID NO: 40744 - DNA, 25 bp, Homo sapien
cgcctggtgagactgcattttgaca

SEQ ID NO: 40745 - DNA, 25 bp, Homo sapien
ttgacaactgtgttcttaagccggc

SEQ ID NO: 40746 - DNA, 25 bp, Homo sapien
ccaggcaccatatggcatgggtgta

SEQ ID NO: 40747 - DNA, 25 bp, Homo sapien
ttggctgcctcacttgggaactcct

SEQ ID NO: 40748 - DNA, 25 bp, Homo sapien
ctccgcttattgctgcgagtttatc

SEQ ID NO: 40749 - DNA, 25 bp, Homo sapien
ccaggtatacgctggagcgccacgc

SEQ ID NO: 40750 - DNA, 25 bp, Homo sapien
catgtcgacggcttgaaaacgaaac

SEQ ID NO: 40751 - DNA, 25 bp, Homo sapien
cgaaacagaaccaaactccgcttat

SEQ ID NO: 40752 - DNA, 25 bp, Homo sapien
gccgtccatgtcgacggcttgaaaa

SEQ ID NO: 40753 - DNA, 25 bp, Homo sapien
ctgcgagtttatccaggcgtcggta

SEQ ID NO: 40754 - DNA, 25 bp, Homo sapien
aggcgtcggtatcccttcgcctgcg

SEQ ID NO: 40755 - DNA, 25 bp, Homo sapien
cgatccggcccaggtatacgctgga

SEQ ID NO: 40756 - DNA, 25 bp, Homo sapien
cccggaagtccaaggactgcaagta

SEQ ID NO: 40757 - DNA, 25 bp, Homo sapien
aaaggctctgagattcggggctccc

SEQ ID NO: 40758 - DNA, 25 bp, Homo sapien
aagccacacaagtctcggagccgga

SEQ ID NO: 40759 - DNA, 25 bp, Homo sapien
gagccggagttcttcccgttctcga

SEQ ID NO: 40760 - DNA, 25 bp, Homo sapien
cgttctcgaagcaggtcacgggagc

SEQ ID NO: 40761 - DNA, 25 bp, Homo sapien
tactacagagatcagcgacgagagc

SEQ ID NO: 40762 - DNA, 25 bp, Homo sapien
tatgaacgcacaggccgtcgctatg

SEQ ID NO: 40763 - DNA, 25 bp, Homo sapien
gcagcgctccctacaaaggctctga

SEQ ID NO: 40764 - DNA, 25 bp, Homo sapien
tccgtgcccttttagttagttctgc

SEQ ID NO: 40765 - DNA, 25 bp, Homo sapien
ttgcgcggattccaggagctcacct

SEQ ID NO: 40766 - DNA, 25 bp, Homo sapien
tcccagccggggaaaatgcaccctg

SEQ ID NO: 40767 - DNA, 25 bp, Homo sapien
ccctgcgggttttctgatacatcca

SEQ ID NO: 40768 - DNA, 25 bp, Homo sapien
tgatacatccagacgcccgaggctg

SEQ ID NO: 40769 - DNA, 25 bp, Homo sapien
cggccaaggggcagaaatacatcgc

SEQ ID NO: 40770 - DNA, 25 bp, Homo sapien
catttcagcgctttgactcggggtg

SEQ ID NO: 40771 - DNA, 25 bp, Homo sapien
gacttccctgccgtgtttgtgaccc

SEQ ID NO: 40772 - DNA, 25 bp, Homo sapien
aacctcaggggttcaggccaggaat

SEQ ID NO: 40773 - DNA, 25 bp, Homo sapien
ttctgggacctttcggtgcgtccga

SEQ ID NO: 40774 - DNA, 25 bp, Homo sapien
ctgggacgaacctgctgctcctcaa

SEQ ID NO: 40775 - DNA, 25 bp, Homo sapien
tgttggaagcaaagtcctccttgtg

SEQ ID NO: 40776 - DNA, 25 bp, Homo sapien
cgcctgacctgaacgggcacttgtg

SEQ ID NO: 40777 - DNA, 25 bp, Homo sapien
tgacttcccagctgttgagggccgt

SEQ ID NO: 40778 - DNA, 25 bp, Homo sapien
ctaagcttccgatgctcacagaggg

SEQ ID NO: 40779 - DNA, 25 bp, Homo sapien
cacacctggttaggagtgcgggtct

SEQ ID NO: 40780 - DNA, 25 bp, Homo sapien
gggtcagggtcctccacaggataca

SEQ ID NO: 40781 - DNA, 25 bp, Homo sapien
ccgagcggatagacagagtgcagca

SEQ ID NO: 40782 - DNA, 25 bp, Homo sapien
caggaaaaggagtaaccgagcggat

SEQ ID NO: 40783 - DNA, 25 bp, Homo sapien
ttgcgacagccgcagctcgacccag

SEQ ID NO: 40784 - DNA, 25 bp, Homo sapien
cgcagcggggccttaaaggtacatg

SEQ ID NO: 40785 - DNA, 25 bp, Homo sapien
ctccacaggatacacgaggacgtgc

SEQ ID NO: 40786 - DNA, 25 bp, Homo sapien
atagacagagtgcagcagagaccgg

SEQ ID NO: 40787 - DNA, 25 bp, Homo sapien
ccttaaaggtacatggccgcctctg

SEQ ID NO: 40788 - DNA, 25 bp, Homo sapien
tttgttcagtcagggctccagcccg

SEQ ID NO: 40789 - DNA, 25 bp, Homo sapien
tgattacgcgcgatgccaacgacga

SEQ ID NO: 40790 - DNA, 25 bp, Homo sapien
tgaagcgcaaggatgtcaggaactg

SEQ ID NO: 40791 - DNA, 25 bp, Homo sapien
atcatgggccgcgatgttgcgtgaa

SEQ ID NO: 40792 - DNA, 25 bp, Homo sapien
acaactggagttgcacacgctcgga

SEQ ID NO: 40793 - DNA, 25 bp, Homo sapien
gcagcggcgaccctttctacttggt

SEQ ID NO: 40794 - DNA, 25 bp, Homo sapien
ctcgcagtcctgagaagtattatgg

SEQ ID NO: 40795 - DNA, 25 bp, Homo sapien
ccaacgacgactgccctacggtgga

SEQ ID NO: 40796 - DNA, 25 bp, Homo sapien
cccgcggcttctgttcctttcagga

SEQ ID NO: 40797 - DNA, 25 bp, Homo sapien
tcccgcctagtgagcgcaccttgga

SEQ ID NO: 40798 - DNA, 25 bp, Homo sapien
tttccgagccgaaactcacgggctg

SEQ ID NO: 40799 - DNA, 25 bp, Homo sapien
caccagtcggggacttcgtgcttta

SEQ ID NO: 40800 - DNA, 25 bp, Homo sapien
gtcagggtacctgcccataccgatg

SEQ ID NO: 40801 - DNA, 25 bp, Homo sapien
ttcctttcaggacggacagcgccca

SEQ ID NO: 40802 - DNA, 25 bp, Homo sapien
agcgcccacccggaggaaagcctga

SEQ ID NO: 40803 - DNA, 25 bp, Homo sapien
tgagacttcgcaaggtgagaactcc

SEQ ID NO: 40804 - DNA, 25 bp, Homo sapien
gccgcagagggctaggcccagctac

SEQ ID NO: 40805 - DNA, 25 bp, Homo sapien
tactcgcgacctagcccgtgatttc

SEQ ID NO: 40806 - DNA, 25 bp, Homo sapien
caattccttcgggattacagggagg

SEQ ID NO: 40807 - DNA, 25 bp, Homo sapien
cctcccttagagactgtcgcatttc

SEQ ID NO: 40808 - DNA, 25 bp, Homo sapien
agagactgtcgcatttccgccgcta

SEQ ID NO: 40809 - DNA, 25 bp, Homo sapien
gagatactcgcgacctagcccgtga

SEQ ID NO: 40810 - DNA, 25 bp, Homo sapien
gaaagcaccaccgtcctcccgcagg

SEQ ID NO: 40811 - DNA, 25 bp, Homo sapien
atttccgccgctaggccggaaagca

SEQ ID NO: 40812 - DNA, 25 bp, Homo sapien
tgatgtaggccaccagcaggcagat

SEQ ID NO: 40813 - DNA, 25 bp, Homo sapien
taggcgccgcgccacgagcagttga

SEQ ID NO: 40814 - DNA, 25 bp, Homo sapien
gtcatggccaccacgatgtcctgca

SEQ ID NO: 40815 - DNA, 25 bp, Homo sapien
atgacgcagatggagccgcccaccg

SEQ ID NO: 40816 - DNA, 25 bp, Homo sapien
tcggcggtgaactccacgcactcgg

SEQ ID NO: 40817 - DNA, 25 bp, Homo sapien
atgaggttctcggtgatgtaggcca

SEQ ID NO: 40818 - DNA, 25 bp, Homo sapien
cgggcagcaccttgtaggggcacca

SEQ ID NO: 40819 - DNA, 25 bp, Homo sapien
ggcagatgaccaccagcatgacgca

SEQ ID NO: 40820 - DNA, 25 bp, Homo sapien
ggagcctcctgacgtctgcgagccg

SEQ ID NO: 40821 - DNA, 25 bp, Homo sapien
ccctggcaaggtctggcagcggaca

SEQ ID NO: 40822 - DNA, 25 bp, Homo sapien
gctctggcagaacgcgagcgccgtc

SEQ ID NO: 40823 - DNA, 25 bp, Homo sapien
gatgcgggccgtcctctcggctgat

SEQ ID NO: 40824 - DNA, 25 bp, Homo sapien
cgagtcgctcctaggtcactggcgc

SEQ ID NO: 40825 - DNA, 25 bp, Homo sapien
tcggaacctagctgcgccacgcagg

SEQ ID NO: 40826 - DNA, 25 bp, Homo sapien
ccgagtcgttctccgctctggcaga

SEQ ID NO: 40827 - DNA, 25 bp, Homo sapien
aggcgacgcagacgctcccgcgtga

SEQ ID NO: 40828 - DNA, 25 bp, Homo sapien
gcgcacgacctgctgctgtacgaca

SEQ ID NO: 40829 - DNA, 25 bp, Homo sapien
cactctgaccgggagtgtcccatgg

SEQ ID NO: 40830 - DNA, 25 bp, Homo sapien
tgctgtacgacaacgcccagatcgg

SEQ ID NO: 40831 - DNA, 25 bp, Homo sapien
tggactacgacctctgcacgcagtg

SEQ ID NO: 40832 - DNA, 25 bp, Homo sapien
cccatggtggcctgagaataccctc

SEQ ID NO: 40833 - DNA, 25 bp, Homo sapien
tgcacgcagtgctacatgcacaaca

SEQ ID NO: 40834 - DNA, 25 bp, Homo sapien
tgactgctgcaagaagcacgggctg

SEQ ID NO: 40835 - DNA, 25 bp, Homo sapien
tccttgggccctagggcttgaacca

SEQ ID NO: 40836 - DNA, 25 bp, Homo sapien
gcccgacccagccacagctccatga

SEQ ID NO: 40837 - DNA, 25 bp, Homo sapien
tccatgacccgccacagtttatcgg

SEQ ID NO: 40838 - DNA, 25 bp, Homo sapien
acagtttatcggacagacgggcacc

SEQ ID NO: 40839 - DNA, 25 bp, Homo sapien
cagacgggcaccgtgcatcgtatca

SEQ ID NO: 40840 - DNA, 25 bp, Homo sapien
tgcatcgtatcacggaccgcgggga

SEQ ID NO: 40841 - DNA, 25 bp, Homo sapien
ggacgtgcgcgtgcagttcaaccac

SEQ ID NO: 40842 - DNA, 25 bp, Homo sapien
tgcagttcaaccacgagacgcgctg

SEQ ID NO: 40843 - DNA, 25 bp, Homo sapien
tcaaccacgagacgcgctggacctt

SEQ ID NO: 40844 - DNA, 25 bp, Homo sapien
ggtcatcggcgaccttgacacagtg

SEQ ID NO: 40845 - DNA, 25 bp, Homo sapien
aggatgccaacctggacgtggccga

SEQ ID NO: 40846 - DNA, 25 bp, Homo sapien
cctaccggcccgaggaggatgccaa

SEQ ID NO: 40847 - DNA, 25 bp, Homo sapien
ctggtcagcggtggaccttcagccc

SEQ ID NO: 40848 - DNA, 25 bp, Homo sapien
acctgcgtgtagcagtcgctggtca

SEQ ID NO: 40849 - DNA, 25 bp, Homo sapien
agacgggaacctgcgtgtagcagtc

SEQ ID NO: 40850 - DNA, 25 bp, Homo sapien
cttgacacagtgaagcggctgcagg

SEQ ID NO: 40851 - DNA, 25 bp, Homo sapien
cgggagaacaaaagtgcggcacagc

SEQ ID NO: 40852 - DNA, 25 bp, Homo sapien
gcctgacccagtgaatgcgatgctc

SEQ ID NO: 40853 - DNA, 25 bp, Homo sapien
cgcgcaatctcagaggcgggcttcc

SEQ ID NO: 40854 - DNA, 25 bp, Homo sapien
gcatttattcgtatccagaggcgca

SEQ ID NO: 40855 - DNA, 25 bp, Homo sapien
gcggctccttctgagcttgccagga

SEQ ID NO: 40856 - DNA, 25 bp, Homo sapien
agaactctcgggtggcaaggaatta

SEQ ID NO: 40857 - DNA, 25 bp, Homo sapien
ctgtttctgtcgtacgcgccacgta

SEQ ID NO: 40858 - DNA, 25 bp, Homo sapien
cagcgcgaacgacggtctctagaca

SEQ ID NO: 40859 - DNA, 25 bp, Homo sapien
cggggatggggacacatttatatgc

SEQ ID NO: 40860 - DNA, 25 bp, Homo sapien
gacgccaagaaggaggacggcttca

SEQ ID NO: 40861 - DNA, 25 bp, Homo sapien
gtgacgtgaacgtgcgcaaccggaa

SEQ ID NO: 40862 - DNA, 25 bp, Homo sapien
atcctcatccgggaggtgcggacgc

SEQ ID NO: 40863 - DNA, 25 bp, Homo sapien
gcccagatcctcatccgggaggtgc

SEQ ID NO: 40864 - DNA, 25 bp, Homo sapien
tggctgccctcaacaaccaccgcga

SEQ ID NO: 40865 - DNA, 25 bp, Homo sapien
aggacggcttcacggcgctgcatct

SEQ ID NO: 40866 - DNA, 25 bp, Homo sapien
cccgctgcatctcgccgtgcaacag

SEQ ID NO: 40867 - DNA, 25 bp, Homo sapien
cccagggccgctgtgacgtgaacgt

SEQ ID NO: 40868 - DNA, 25 bp, Homo sapien
tgcggccagaagatcctccacaaga

SEQ ID NO: 40869 - DNA, 25 bp, Homo sapien
caggaacgtgaccttccgctgcggc

SEQ ID NO: 40870 - DNA, 25 bp, Homo sapien
ctgcgacttctgctacggtgatgcc

SEQ ID NO: 40871 - DNA, 25 bp, Homo sapien
gctcccgacaggatgcctcgacagg

SEQ ID NO: 40872 - DNA, 25 bp, Homo sapien
cggctctacggtgagtccctttgtc

SEQ ID NO: 40873 - DNA, 25 bp, Homo sapien
tgatgcactcacaacacggccgggc

SEQ ID NO: 40874 - DNA, 25 bp, Homo sapien
gctgcgctccagcagatacaccggg

SEQ ID NO: 40875 - DNA, 25 bp, Homo sapien
gaggcgcacctgagcatcatcgcca

SEQ ID NO: 40876 - DNA, 25 bp, Homo sapien
gtgccagcaccgcaccgtgtgtgag

SEQ ID NO: 40877 - DNA, 25 bp, Homo sapien
gggcgccgacgtgagctacaccaac

SEQ ID NO: 40878 - DNA, 25 bp, Homo sapien
tcgcgtgctcaaggcccttcagggc

SEQ ID NO: 40879 - DNA, 25 bp, Homo sapien
caacaccgtgacgaacctgcacgtg

SEQ ID NO: 40880 - DNA, 25 bp, Homo sapien
tggtgctgttctcgccgtgccagca

SEQ ID NO: 40881 - DNA, 25 bp, Homo sapien
tgcaggtggtcgtcagcaagaaact

SEQ ID NO: 40882 - DNA, 25 bp, Homo sapien
gtcagcaagaaactgcgcccaggtg

SEQ ID NO: 40883 - DNA, 25 bp, Homo sapien
ctgagtgcctggtgtgctccgagct

SEQ ID NO: 40884 - DNA, 25 bp, Homo sapien
tccatttgggaaaaaagccaccaga

SEQ ID NO: 40885 - DNA, 25 bp, Homo sapien
caacggacgggccagctggttccct

SEQ ID NO: 40886 - DNA, 25 bp, Homo sapien
tcgaacctttgggtctccgagctcc

SEQ ID NO: 40887 - DNA, 25 bp, Homo sapien
agatcactcactgcccagcagtggg

SEQ ID NO: 40888 - DNA, 25 bp, Homo sapien
cacagcaagtctgccatgggccgcg

SEQ ID NO: 40889 - DNA, 25 bp, Homo sapien
acactgtcaggcgagcgacgcgtct

SEQ ID NO: 40890 - DNA, 25 bp, Homo sapien
ggccaggatggagactccgctcatg

SEQ ID NO: 40891 - DNA, 25 bp, Homo sapien
tgctaccctttcctaagcgggagcc

SEQ ID NO: 40892 - DNA, 25 bp, Homo sapien
tcgtcacttcctgtattggcgcgta

SEQ ID NO: 40893 - DNA, 25 bp, Homo sapien
gctgtgacgcaggaatcgggactcc

SEQ ID NO: 40894 - DNA, 25 bp, Homo sapien
ccagaagaaacagcccggtgagcgc

SEQ ID NO: 40895 - DNA, 25 bp, Homo sapien
gtccaggacgccagaagaaacagcc

SEQ ID NO: 40896 - DNA, 25 bp, Homo sapien
gaactcgagacaaggacaggggctc

SEQ ID NO: 40897 - DNA, 25 bp, Homo sapien
ctccggcccagaactcgagacaagg

SEQ ID NO: 40898 - DNA, 25 bp, Homo sapien
tgtattggcgcgtaatgatgatata

SEQ ID NO: 40899 - DNA, 25 bp, Homo sapien
ggcgcgcgccaaaagtatcgtcact

SEQ ID NO: 40900 - DNA, 25 bp, Homo sapien
taagcttcgagatagcgtttcttac

SEQ ID NO: 40901 - DNA, 25 bp, Homo sapien
gtagtaagcttcgagatagcgtttc

SEQ ID NO: 40902 - DNA, 25 bp, Homo sapien
agacttatctaccacggccaagtag

SEQ ID NO: 40903 - DNA, 25 bp, Homo sapien
ccaagtagtaagcttcgagatagcg

SEQ ID NO: 40904 - DNA, 25 bp, Homo sapien
cggccaagtagtaagcttcgagata

SEQ ID NO: 40905 - DNA, 25 bp, Homo sapien
accacggccaagtagtaagcttcga

SEQ ID NO: 40906 - DNA, 25 bp, Homo sapien
ctaccacggccaagtagtaagcttc

SEQ ID NO: 40907 - DNA, 25 bp, Homo sapien
acttatctaccacggccaagtagta

SEQ ID NO: 40908 - DNA, 25 bp, Homo sapien
ccagcacacggcctggaaacggaag

SEQ ID NO: 40909 - DNA, 25 bp, Homo sapien
cctggaaacggaagtcattctgctc

SEQ ID NO: 40910 - DNA, 25 bp, Homo sapien
gtcattctgctcctgaatcaccgga

SEQ ID NO: 40911 - DNA, 25 bp, Homo sapien
ggacgcctgtgtctgaaacccaccg

SEQ ID NO: 40912 - DNA, 25 bp, Homo sapien
ctgtgtctgaaacccaccgtaaaga

SEQ ID NO: 40913 - DNA, 25 bp, Homo sapien
cggcgctggtgtagaactgcagctc

SEQ ID NO: 40914 - DNA, 25 bp, Homo sapien
ccctgtgggtgacagaacacgctgg

SEQ ID NO: 40915 - DNA, 25 bp, Homo sapien
cgtgtcgggacaggccgagttcaca

SEQ ID NO: 40916 - DNA, 25 bp, Homo sapien
tgggagtcggcctctcatccttcct

SEQ ID NO: 40917 - DNA, 25 bp, Homo sapien
ttctctaccgagtgacaaagacgta

SEQ ID NO: 40918 - DNA, 25 bp, Homo sapien
tgccatcgtgacaccaggacacaga

SEQ ID NO: 40919 - DNA, 25 bp, Homo sapien
tggcagccgcatgaagacacaccga

SEQ ID NO: 40920 - DNA, 25 bp, Homo sapien
gaagtgcagcgtccaccgctcttct

SEQ ID NO: 40921 - DNA, 25 bp, Homo sapien
caccgagcgagacacactgctgagc

SEQ ID NO: 40922 - DNA, 25 bp, Homo sapien
atggccacaaggaagcagaggatcc

SEQ ID NO: 40923 - DNA, 25 bp, Homo sapien
gcagctcccaaacaggcagaacctg

SEQ ID NO: 40924 - DNA, 25 bp, Homo sapien
tccactttccagaaggtagaggaga

SEQ ID NO: 40925 - DNA, 25 bp, Homo sapien
tcccatttcctggaggatctctgtg

SEQ ID NO: 40926 - DNA, 25 bp, Homo sapien
gtggtctgggcaggaaatttgtacc

SEQ ID NO: 40927 - DNA, 25 bp, Homo sapien
gtacccagtgataaggcagaagaca

SEQ ID NO: 40928 - DNA, 25 bp, Homo sapien
tgttacttggccttcgcagcatccc

SEQ ID NO: 40929 - DNA, 25 bp, Homo sapien
cccaggtcccacatttataattcca

SEQ ID NO: 40930 - DNA, 25 bp, Homo sapien
taacggacacactggggtctgggca

SEQ ID NO: 40931 - DNA, 25 bp, Homo sapien
ccactagaccggaggctctacggga

SEQ ID NO: 40932 - DNA, 25 bp, Homo sapien
cgcggtaccactgggtcaccacgac

SEQ ID NO: 40933 - DNA, 25 bp, Homo sapien
ccacgaccggggtgtaggccttcag

SEQ ID NO: 40934 - DNA, 25 bp, Homo sapien
cagcaggttggacgtcttgaggtca

SEQ ID NO: 40935 - DNA, 25 bp, Homo sapien
agaggggatccgtactcccgcgcca

SEQ ID NO: 40936 - DNA, 25 bp, Homo sapien
taggccttcagaggggatccgtact

SEQ ID NO: 40937 - DNA, 25 bp, Homo sapien
cctgcaacgacagatgggcggctgt

SEQ ID NO: 40938 - DNA, 25 bp, Homo sapien
atcacccacctgcaacgacagatgg

SEQ ID NO: 40939 - DNA, 25 bp, Homo sapien
ctcaccttgaggatgccggcgtggc

SEQ ID NO: 40940 - DNA, 25 bp, Homo sapien
ccctgtgaggcgacagacgccaaca

SEQ ID NO: 40941 - DNA, 25 bp, Homo sapien
tcctgcttgagctcgatgggcaaca

SEQ ID NO: 40942 - DNA, 25 bp, Homo sapien
cctgtggtaactccgactgccaatg

SEQ ID NO: 40943 - DNA, 25 bp, Homo sapien
aaagaggcgggacctagaagcatga

SEQ ID NO: 40944 - DNA, 25 bp, Homo sapien
cacccagttccgtccagcatgagaa

SEQ ID NO: 40945 - DNA, 25 bp, Homo sapien
cctttcaagccgcagagcagtcctg

SEQ ID NO: 40946 - DNA, 25 bp, Homo sapien
tcgggcacatagtcgccctctgtca

SEQ ID NO: 40947 - DNA, 25 bp, Homo sapien
aggtacttgggcagctcctgcttga

SEQ ID NO: 40948 - DNA, 25 bp, Homo sapien
cacggggcttttaagtgcctctccg

SEQ ID NO: 40949 - DNA, 25 bp, Homo sapien
gggctgttccaccagcggcacttca

SEQ ID NO: 40950 - DNA, 25 bp, Homo sapien
ggttccaggaataagaaatccactg

SEQ ID NO: 40951 - DNA, 25 bp, Homo sapien
cggggccgttccactgaaggcagaa

SEQ ID NO: 40952 - DNA, 25 bp, Homo sapien
gccgttctactccaggcagacggga

SEQ ID NO: 40953 - DNA, 25 bp, Homo sapien
ccggcgccttcacaacaaagggacg

SEQ ID NO: 40954 - DNA, 25 bp, Homo sapien
accgagagcctgatgcagtctccgc

SEQ ID NO: 40955 - DNA, 25 bp, Homo sapien
agtctccgccgcaggcatagcgcta

SEQ ID NO: 40956 - DNA, 25 bp, Homo sapien
cctgcaccgtggtgatgaggtgtcc

SEQ ID NO: 40957 - DNA, 25 bp, Homo sapien
tggacacgatcactcctgacaggga

SEQ ID NO: 40958 - DNA, 25 bp, Homo sapien
agtgtcgttggctctgaccttcagc

SEQ ID NO: 40959 - DNA, 25 bp, Homo sapien
gaggggcctctgtcaatcaccacct

SEQ ID NO: 40960 - DNA, 25 bp, Homo sapien
gggcgacagcattgcacactcaggg

SEQ ID NO: 40961 - DNA, 25 bp, Homo sapien
tctccggaaggtcctcatccctggg

SEQ ID NO: 40962 - DNA, 25 bp, Homo sapien
gtgttgcacggggtcaaatgactca

SEQ ID NO: 40963 - DNA, 25 bp, Homo sapien
tccgtccaggtagacatccacattg

SEQ ID NO: 40964 - DNA, 25 bp, Homo sapien
ctgtgcctcatactccgagcaggga

SEQ ID NO: 40965 - DNA, 25 bp, Homo sapien
tccagaactatcctgagccgtaacc

SEQ ID NO: 40966 - DNA, 25 bp, Homo sapien
ctgacatgtaaacgctcctgggctc

SEQ ID NO: 40967 - DNA, 25 bp, Homo sapien
aagcgctccgcgagttcagcagacc

SEQ ID NO: 40968 - DNA, 25 bp, Homo sapien
aactgaggcaacgtgcgtgctgctc

SEQ ID NO: 40969 - DNA, 25 bp, Homo sapien
caggcgcgctctgatcctttaattc

SEQ ID NO: 40970 - DNA, 25 bp, Homo sapien
cacgagccagccaggtacgagtaga

SEQ ID NO: 40971 - DNA, 25 bp, Homo sapien
acagcgggaatctgtggctttcctg

SEQ ID NO: 40972 - DNA, 25 bp, Homo sapien
gccgcattgcgctttctggtcaaca

SEQ ID NO: 40973 - DNA, 25 bp, Homo sapien
gcagcctgcgcgctggaacactcgg

SEQ ID NO: 40974 - DNA, 25 bp, Homo sapien
attgcgctttctggtcaacagtccc

SEQ ID NO: 40975 - DNA, 25 bp, Homo sapien
tcctgggacctgaacttcggtgaca

SEQ ID NO: 40976 - DNA, 25 bp, Homo sapien
catggcaccggtgcctgtcagcaaa

SEQ ID NO: 40977 - DNA, 25 bp, Homo sapien
cctgtcagcaaagggccatgcagtg

SEQ ID NO: 40978 - DNA, 25 bp, Homo sapien
tcacacggccgcattgcgctttctg

SEQ ID NO: 40979 - DNA, 25 bp, Homo sapien
cccgtggctcctgggacctgaactt

SEQ ID NO: 40980 - DNA, 25 bp, Homo sapien
gccgcgcgctgcctaaatacctaaa

SEQ ID NO: 40981 - DNA, 25 bp, Homo sapien
gctctaaatttaggcgggtaagtgc

SEQ ID NO: 40982 - DNA, 25 bp, Homo sapien
gctttactgaggagctctaaattta

SEQ ID NO: 40983 - DNA, 25 bp, Homo sapien
agtcggagactgagtttagctttac

SEQ ID NO: 40984 - DNA, 25 bp, Homo sapien
cttccggtgggaatttcttcacgtg

SEQ ID NO: 40985 - DNA, 25 bp, Homo sapien
agctctcctaactcgtcttccggtg

SEQ ID NO: 40986 - DNA, 25 bp, Homo sapien
cgcctgctcatataaagctctccta

SEQ ID NO: 40987 - DNA, 25 bp, Homo sapien
aagtgccgcagatatcgcccgtggt

SEQ ID NO: 40988 - DNA, 25 bp, Homo sapien
acgtgttttataggcggcataaagc

SEQ ID NO: 40989 - DNA, 25 bp, Homo sapien
gcagtggctgatgacgtgttttata

SEQ ID NO: 40990 - DNA, 25 bp, Homo sapien
atagttggttccgtccgctctggcc

SEQ ID NO: 40991 - DNA, 25 bp, Homo sapien
ccctcgatagttggttccgtccgct

SEQ ID NO: 40992 - DNA, 25 bp, Homo sapien
ggattcttccgctctagccctattc

SEQ ID NO: 40993 - DNA, 25 bp, Homo sapien
tctttttactgggattcttccgctc

SEQ ID NO: 40994 - DNA, 25 bp, Homo sapien
ccggttcctggcgaaagcgccagtc

SEQ ID NO: 40995 - DNA, 25 bp, Homo sapien
tggcgaaagcgccagtcacttccgc

SEQ ID NO: 40996 - DNA, 25 bp, Homo sapien
ccgtcaactcggctgctggctaaca

SEQ ID NO: 40997 - DNA, 25 bp, Homo sapien
gctagccgtttctgtggctgacacg

SEQ ID NO: 40998 - DNA, 25 bp, Homo sapien
tggcccgaatgctagccgtttctgt

SEQ ID NO: 40999 - DNA, 25 bp, Homo sapien
agagcgccgccagcgtggcccgaat

SEQ ID NO: 41000 - DNA, 25 bp, Homo sapien
tgcgcctgcagttacggcgcgtggc

SEQ ID NO: 41001 - DNA, 25 bp, Homo sapien
aactcggctgctggctaacaggaca

SEQ ID NO: 41002 - DNA, 25 bp, Homo sapien
gccttggccgtcaactcggctgctg

SEQ ID NO: 41003 - DNA, 25 bp, Homo sapien
gctggctaacaggacaggccgaagc

SEQ ID NO: 41004 - DNA, 25 bp, Homo sapien
gtaaagctaaactcagtctccgact

SEQ ID NO: 41005 - DNA, 25 bp, Homo sapien
tggtttaggtatttaggcagcgcgc

SEQ ID NO: 41006 - DNA, 25 bp, Homo sapien
cgcctaaatttagagctcctcagta

SEQ ID NO: 41007 - DNA, 25 bp, Homo sapien
ctgcggcacttacccgcctaaattt

SEQ ID NO: 41008 - DNA, 25 bp, Homo sapien
caccggaagacgagttaggagagct

SEQ ID NO: 41009 - DNA, 25 bp, Homo sapien
cacgtgaagaaattcccaccggaag

SEQ ID NO: 41010 - DNA, 25 bp, Homo sapien
agagctttatatgagcaggcgctaa

SEQ ID NO: 41011 - DNA, 25 bp, Homo sapien
aaccacgggcgatatctgcggcact

SEQ ID NO: 41012 - DNA, 25 bp, Homo sapien
agtcctggttgccacggcagcgacc

SEQ ID NO: 41013 - DNA, 25 bp, Homo sapien
tgaactaagaatggagtcacgcgga

SEQ ID NO: 41014 - DNA, 25 bp, Homo sapien
aaactgctcagaccttcgcgggcgc

SEQ ID NO: 41015 - DNA, 25 bp, Homo sapien
ctgacgtgtcagtcggaaactgctc

SEQ ID NO: 41016 - DNA, 25 bp, Homo sapien
aggtctcccgcatccctcctagagc

SEQ ID NO: 41017 - DNA, 25 bp, Homo sapien
ggaggctgctgtcagtcctcctcct

SEQ ID NO: 41018 - DNA, 25 bp, Homo sapien
cagcgaccagaggagaaggcttcga

SEQ ID NO: 41019 - DNA, 25 bp, Homo sapien
tcctagagcctctgctgacgtgtca

SEQ ID NO: 41020 - DNA, 25 bp, Homo sapien
cctggtgcgtctcctgctgcagcga

SEQ ID NO: 41021 - DNA, 25 bp, Homo sapien
ggtggcagcaacagactctccgcca

SEQ ID NO: 41022 - DNA, 25 bp, Homo sapien
cggcttcatgctggtggcagcaaca

SEQ ID NO: 41023 - DNA, 25 bp, Homo sapien
cctcacgccgctgcactgggccgct

SEQ ID NO: 41024 - DNA, 25 bp, Homo sapien
tcctcagggaccacgcaggccggac

SEQ ID NO: 41025 - DNA, 25 bp, Homo sapien
cgccctaggccgctcccaggtacgt

SEQ ID NO: 41026 - DNA, 25 bp, Homo sapien
tgtccaggcacgaaggccctgagcg

SEQ ID NO: 41027 - DNA, 25 bp, Homo sapien
gtgtagccccgtcccgtggagacca

SEQ ID NO: 41028 - DNA, 25 bp, Homo sapien
tttgccgccacagccaaactttgcg

SEQ ID NO: 41029 - DNA, 25 bp, Homo sapien
gagccgttgtccctagagcagcctc

SEQ ID NO: 41030 - DNA, 25 bp, Homo sapien
agccttggctgcagatacggtgatg

SEQ ID NO: 41031 - DNA, 25 bp, Homo sapien
cgcggttagtcactcacatctgata

SEQ ID NO: 41032 - DNA, 25 bp, Homo sapien
ggtaggggcaactcttctcttcctg

SEQ ID NO: 41033 - DNA, 25 bp, Homo sapien
tggttctgtagtctcggttctccga

SEQ ID NO: 41034 - DNA, 25 bp, Homo sapien
ccctctttttctcgcttgtggactc

SEQ ID NO: 41035 - DNA, 25 bp, Homo sapien
cgaagcgttttgaggggactgcaac

SEQ ID NO: 41036 - DNA, 25 bp, Homo sapien
cgtgaaatcaaggaaatgagcgttc

SEQ ID NO: 41037 - DNA, 25 bp, Homo sapien
ctgctcctccttcgtgaaatcaagg

SEQ ID NO: 41038 - DNA, 25 bp, Homo sapien
ccttcgtgaaatcaaggaaacgagc

SEQ ID NO: 41039 - DNA, 25 bp, Homo sapien
cctgctcctccttcgtgaaatcaag

SEQ ID NO: 41040 - DNA, 25 bp, Homo sapien
cttcgtgaaatcaaggaaacgagcg

SEQ ID NO: 41041 - DNA, 25 bp, Homo sapien
atcaaggaaacgagcgttcccgtca

SEQ ID NO: 41042 - DNA, 25 bp, Homo sapien
cgtgaaatcaaggaaacgagcgttc

SEQ ID NO: 41043 - DNA, 25 bp, Homo sapien
gctcctccttcgtgaaatcaaggaa

SEQ ID NO: 41044 - DNA, 25 bp, Homo sapien
ccatcttcggaatttttagcggcga

SEQ ID NO: 41045 - DNA, 25 bp, Homo sapien
ctaccaacttcagagcgcaggaaca

SEQ ID NO: 41046 - DNA, 25 bp, Homo sapien
aactcaggaaacctacgggctggcg

SEQ ID NO: 41047 - DNA, 25 bp, Homo sapien
gcgcacaatgagaaactaccaactt

SEQ ID NO: 41048 - DNA, 25 bp, Homo sapien
acactgcgatgagcgcgttcgtctc

SEQ ID NO: 41049 - DNA, 25 bp, Homo sapien
agaagccggggaaagcacctccatc

SEQ ID NO: 41050 - DNA, 25 bp, Homo sapien
cgcaggaacatctcaattggcaaga

SEQ ID NO: 41051 - DNA, 25 bp, Homo sapien
ggatttccgtcgctcaggccaccag

SEQ ID NO: 41052 - DNA, 25 bp, Homo sapien
ccagcatccgagagcccggactgga

SEQ ID NO: 41053 - DNA, 25 bp, Homo sapien
ttcgcagccggaacgttgcaggcac

SEQ ID NO: 41054 - DNA, 25 bp, Homo sapien
gccggaacgttgcaggcacttgttt

SEQ ID NO: 41055 - DNA, 25 bp, Homo sapien
tgcaggcacttgtttcctcagtgga

SEQ ID NO: 41056 - DNA, 25 bp, Homo sapien
agtggatgcctttcggcgcgccgcc

SEQ ID NO: 41057 - DNA, 25 bp, Homo sapien
gagagtcggcatctcccgcgcgtgt

SEQ ID NO: 41058 - DNA, 25 bp, Homo sapien
ctcccgcgcgtgtggagggaaatcc

SEQ ID NO: 41059 - DNA, 25 bp, Homo sapien
tttcctcagtggatgcctttcggcg

SEQ ID NO: 41060 - DNA, 25 bp, Homo sapien
aggggaccgaccaggccaactctct

SEQ ID NO: 41061 - DNA, 25 bp, Homo sapien
actcgcaacacctgcggctggcaga

SEQ ID NO: 41062 - DNA, 25 bp, Homo sapien
gcggcgagtgagagctgcaaccact

SEQ ID NO: 41063 - DNA, 25 bp, Homo sapien
tctccaagaccggacaggggtcctc

SEQ ID NO: 41064 - DNA, 25 bp, Homo sapien
gggctgagctccgacaccagaatcg

SEQ ID NO: 41065 - DNA, 25 bp, Homo sapien
gctgggagggcaattaccaccgacc

SEQ ID NO: 41066 - DNA, 25 bp, Homo sapien
caactctctccacttggggctggga

SEQ ID NO: 41067 - DNA, 25 bp, Homo sapien
tcagccgcctcagatggtccttcgg

SEQ ID NO: 41068 - DNA, 25 bp, Homo sapien
ctcctcccgctgaagggagtaaatc

SEQ ID NO: 41069 - DNA, 25 bp, Homo sapien
cccgctgaagggagtaaatccaggc

SEQ ID NO: 41070 - DNA, 25 bp, Homo sapien
tgaagggagtaaatccaggcaggtc

SEQ ID NO: 41071 - DNA, 25 bp, Homo sapien
agtaaatccaggcaggtctggggct

SEQ ID NO: 41072 - DNA, 25 bp, Homo sapien
aggacgcgccctcgggtccagccgc

SEQ ID NO: 41073 - DNA, 25 bp, Homo sapien
gtcaggggtcatctcttctgcgccg

SEQ ID NO: 41074 - DNA, 25 bp, Homo sapien
gcgagaagagtagccgcagaggctc

SEQ ID NO: 41075 - DNA, 25 bp, Homo sapien
gtcggcctcttggtgtctcctcccg

SEQ ID NO: 41076 - DNA, 25 bp, Homo sapien
tgacagcgagacagcacaagaagga

SEQ ID NO: 41077 - DNA, 25 bp, Homo sapien
agaaggacccgctctgtttcaaagc

SEQ ID NO: 41078 - DNA, 25 bp, Homo sapien
tcaaagcgaggatgtgagtgacttc

SEQ ID NO: 41079 - DNA, 25 bp, Homo sapien
gtgccgaggtctcttcgtctccaac

SEQ ID NO: 41080 - DNA, 25 bp, Homo sapien
cgcgagttggacatagactggaaaa

SEQ ID NO: 41081 - DNA, 25 bp, Homo sapien
gactggaaaatagacccggacagcc

SEQ ID NO: 41082 - DNA, 25 bp, Homo sapien
gctcgggctcctgaaaacctcgcgg

SEQ ID NO: 41083 - DNA, 25 bp, Homo sapien
tgagtgacttcgtctgtgccgaggt

SEQ ID NO: 41084 - DNA, 25 bp, Homo sapien
gcctcctcggaatggaagacccttc

SEQ ID NO: 41085 - DNA, 25 bp, Homo sapien
actgtcggtcttacctgtgggtctc

SEQ ID NO: 41086 - DNA, 25 bp, Homo sapien
ctgtgggtctcatgcatgcagcttc

SEQ ID NO: 41087 - DNA, 25 bp, Homo sapien
tgcccgagtctcttaatttcccgcg

SEQ ID NO: 41088 - DNA, 25 bp, Homo sapien
gctacctgaactcgcgagcgcgcgg

SEQ ID NO: 41089 - DNA, 25 bp, Homo sapien
ccggttaacttgagcaccgccaatt

SEQ ID NO: 41090 - DNA, 25 bp, Homo sapien
tctcgccacagacccggttaacttg

SEQ ID NO: 41091 - DNA, 25 bp, Homo sapien
cagtctaacccgcatctgtgcgcga

SEQ ID NO: 41092 - DNA, 25 bp, Homo sapien
tcggtgtcattcgttggcttcttgc

SEQ ID NO: 41093 - DNA, 25 bp, Homo sapien
cgggcgcactaacgggctcagcaaa

SEQ ID NO: 41094 - DNA, 25 bp, Homo sapien
gcgcaacggttctttcccgcgagaa

SEQ ID NO: 41095 - DNA, 25 bp, Homo sapien
tacctccgcgcaaagtcgggcgcaa

SEQ ID NO: 41096 - DNA, 25 bp, Homo sapien
acggcaaccgactcttctcgcgaga

SEQ ID NO: 41097 - DNA, 25 bp, Homo sapien
cacacacagctagagggctctgcta

SEQ ID NO: 41098 - DNA, 25 bp, Homo sapien
acctgccttgtacctacctggtgtc

SEQ ID NO: 41099 - DNA, 25 bp, Homo sapien
gtcggccacgttcctgacgaacaga

SEQ ID NO: 41100 - DNA, 25 bp, Homo sapien
gctcaacaggtggtgcactgggacc

SEQ ID NO: 41101 - DNA, 25 bp, Homo sapien
attactgtggcctgcacgaacgccg

SEQ ID NO: 41102 - DNA, 25 bp, Homo sapien
gcgcggccacaacgtcatcaatgtc

SEQ ID NO: 41103 - DNA, 25 bp, Homo sapien
ctgctcttcatcctgctactggtca

SEQ ID NO: 41104 - DNA, 25 bp, Homo sapien
tgctactggtcactgtcctcctggc

SEQ ID NO: 41105 - DNA, 25 bp, Homo sapien
tttgagcgcggtgacttctcactgc

SEQ ID NO: 41106 - DNA, 25 bp, Homo sapien
aggtcttgctggtacctgacgccgc

SEQ ID NO: 41107 - DNA, 25 bp, Homo sapien
tctcactgcgtatcgagccgctgga

SEQ ID NO: 41108 - DNA, 25 bp, Homo sapien
ctcaccctcgagtggcacaggaatc

SEQ ID NO: 41109 - DNA, 25 bp, Homo sapien
gcagcatgggcgctgtgtcggaagc

SEQ ID NO: 41110 - DNA, 25 bp, Homo sapien
accctgggcacgtcagggctgaggc

SEQ ID NO: 41111 - DNA, 25 bp, Homo sapien
tcaccctcgagtggcacaggaatcc

SEQ ID NO: 41112 - DNA, 25 bp, Homo sapien
aggctcaccctcgagtggcacagga

SEQ ID NO: 41113 - DNA, 25 bp, Homo sapien
acaggctcaccctcgagtggcacag

SEQ ID NO: 41114 - DNA, 25 bp, Homo sapien
ggcacaggctcaccctcgagtggca

SEQ ID NO: 41115 - DNA, 25 bp, Homo sapien
accctcgagtggcacaggaatccca

SEQ ID NO: 41116 - DNA, 25 bp, Homo sapien
cttctgggagacgttgtagacacgc

SEQ ID NO: 41117 - DNA, 25 bp, Homo sapien
accagctcagctcacaggggcgaca

SEQ ID NO: 41118 - DNA, 25 bp, Homo sapien
ctgcgcacgcgtgtaataggccgag

SEQ ID NO: 41119 - DNA, 25 bp, Homo sapien
agatctgcagcaggaaagccggtgc

SEQ ID NO: 41120 - DNA, 25 bp, Homo sapien
gtcacagtctgtggttcctaaccag

SEQ ID NO: 41121 - DNA, 25 bp, Homo sapien
agaaggctctgccacgggactcacg

SEQ ID NO: 41122 - DNA, 25 bp, Homo sapien
cagaggatctcctgttcccgcagcg

SEQ ID NO: 41123 - DNA, 25 bp, Homo sapien
ggcgctccatgatccgcagcttgga

SEQ ID NO: 41124 - DNA, 25 bp, Homo sapien
tccgacgaacaggagctggtccagc

SEQ ID NO: 41125 - DNA, 25 bp, Homo sapien
gccgctgattgcctattgtgcgtcc

SEQ ID NO: 41126 - DNA, 25 bp, Homo sapien
ttcgtttctaaatgagcagccagcg

SEQ ID NO: 41127 - DNA, 25 bp, Homo sapien
cgaggacggcccattagcggctgat

SEQ ID NO: 41128 - DNA, 25 bp, Homo sapien
gtctgctgcactgtccttctcacgt

SEQ ID NO: 41129 - DNA, 25 bp, Homo sapien
tgcaataagacaagagaccgcacgg

SEQ ID NO: 41130 - DNA, 25 bp, Homo sapien
cgtgccaagggaagggtagttcact

SEQ ID NO: 41131 - DNA, 25 bp, Homo sapien
ctggtccagcgaacaataaaaggcc

SEQ ID NO: 41132 - DNA, 25 bp, Homo sapien
cactaagggccaacatggtcatctc

SEQ ID NO: 41133 - DNA, 25 bp, Homo sapien
actgggcactcgcaatgcgcgcaga

SEQ ID NO: 41134 - DNA, 25 bp, Homo sapien
tctctttcgccacactaagggccaa

SEQ ID NO: 41135 - DNA, 25 bp, Homo sapien
tggtcatctccaggtgcggattctg

SEQ ID NO: 41136 - DNA, 25 bp, Homo sapien
gcggattctgccgtaaaatgcgccc

SEQ ID NO: 41137 - DNA, 25 bp, Homo sapien
cgccctcgaggctgattgatttgtg

SEQ ID NO: 41138 - DNA, 25 bp, Homo sapien
ttgtgccagtctctaccgccatctg

SEQ ID NO: 41139 - DNA, 25 bp, Homo sapien
aatgcgcgcagaacaaaggcctctc

SEQ ID NO: 41140 - DNA, 25 bp, Homo sapien
cacggcttcggagctctcgcagagc

SEQ ID NO: 41141 - DNA, 25 bp, Homo sapien
ggtctcaccgccagggtgtcctgct

SEQ ID NO: 41142 - DNA, 25 bp, Homo sapien
gcagggtcgtgctgttctccatctc

SEQ ID NO: 41143 - DNA, 25 bp, Homo sapien
tggtctcgatcagctcccggttgag

SEQ ID NO: 41144 - DNA, 25 bp, Homo sapien
cccggttgagcttgctgaggaagtt

SEQ ID NO: 41145 - DNA, 25 bp, Homo sapien
cccgcacgtgcagggtcgtgctgtt

SEQ ID NO: 41146 - DNA, 25 bp, Homo sapien
ctcctgctggtaaacgcggcccaag

SEQ ID NO: 41147 - DNA, 25 bp, Homo sapien
ctgaggaagttctcacggcttcgga

SEQ ID NO: 41148 - DNA, 25 bp, Homo sapien
ctctccagatggaagaaagccgggg

SEQ ID NO: 41149 - DNA, 25 bp, Homo sapien
cttcgtctgcgctgtagactctacg

SEQ ID NO: 41150 - DNA, 25 bp, Homo sapien
agcgctctgaggagttggcttcgtc

SEQ ID NO: 41151 - DNA, 25 bp, Homo sapien
tctgcctggggacgcgactctgccg

SEQ ID NO: 41152 - DNA, 25 bp, Homo sapien
atgcagttcgggagagctgataccc

SEQ ID NO: 41153 - DNA, 25 bp, Homo sapien
ggcagcgcgtcaatcaagccggcga

SEQ ID NO: 41154 - DNA, 25 bp, Homo sapien
gtagcacccgctcggcatcggcagg

SEQ ID NO: 41155 - DNA, 25 bp, Homo sapien
tcaagccggcgacggtgaatgcagt

SEQ ID NO: 41156 - DNA, 25 bp, Homo sapien
tgatgcaagtgttcaagcgaatctc

SEQ ID NO: 41157 - DNA, 25 bp, Homo sapien
agcgaatctcaactcgttttttccg

SEQ ID NO: 41158 - DNA, 25 bp, Homo sapien
tgcttggcagcgctgcaccctttaa

SEQ ID NO: 41159 - DNA, 25 bp, Homo sapien
tgtcctccgagccagtcgctgacag

SEQ ID NO: 41160 - DNA, 25 bp, Homo sapien
tcacgaccgaggcaggtaaacgccc

SEQ ID NO: 41161 - DNA, 25 bp, Homo sapien
cttggcttcgcttttcaggttagga

SEQ ID NO: 41162 - DNA, 25 bp, Homo sapien
ggcggtatcaactgatgcaagtgtt

SEQ ID NO: 41163 - DNA, 25 bp, Homo sapien
caggttaggaaagctccctttactg

SEQ ID NO: 41164 - DNA, 25 bp, Homo sapien
ccttgatgacttatggggacacctg

SEQ ID NO: 41165 - DNA, 25 bp, Homo sapien
tggcagccggaagaaccgcacgaac

SEQ ID NO: 41166 - DNA, 25 bp, Homo sapien
gatggtctctgatggtctgccttga

SEQ ID NO: 41167 - DNA, 25 bp, Homo sapien
tcagctgatataggaggtggaaccc

SEQ ID NO: 41168 - DNA, 25 bp, Homo sapien
cctcgggacaggcaaacctgctgta

SEQ ID NO: 41169 - DNA, 25 bp, Homo sapien
cacgaacgccttccgcagagctggt

SEQ ID NO: 41170 - DNA, 25 bp, Homo sapien
gacgtgctccaaacattccaaaggg

SEQ ID NO: 41171 - DNA, 25 bp, Homo sapien
ggtggaaccctcctacagtcacaga

SEQ ID NO: 41172 - DNA, 25 bp, Homo sapien
ctgcctctggggaatccgcctagaa

SEQ ID NO: 41173 - DNA, 25 bp, Homo sapien
caactttcttcggacccaaggcagg

SEQ ID NO: 41174 - DNA, 25 bp, Homo sapien
ggactagctccaagccacaactttc

SEQ ID NO: 41175 - DNA, 25 bp, Homo sapien
ccacctcgccaggaagtctcagaga

SEQ ID NO: 41176 - DNA, 25 bp, Homo sapien
cagtctccctatgaggccactggca

SEQ ID NO: 41177 - DNA, 25 bp, Homo sapien
gcgcccgaggtgaaacagaaccctc

SEQ ID NO: 41178 - DNA, 25 bp, Homo sapien
cgcgcttggcttctcctatcactga

SEQ ID NO: 41179 - DNA, 25 bp, Homo sapien
tcccatcgcgggctcaaaaagaagg

SEQ ID NO: 41180 - DNA, 25 bp, Homo sapien
gcttctggaaagaggccaactgtgc

SEQ ID NO: 41181 - DNA, 25 bp, Homo sapien
gtctccggaagcgtttgtctcttta

SEQ ID NO: 41182 - DNA, 25 bp, Homo sapien
taacccttaccgagtgtcacctgca

SEQ ID NO: 41183 - DNA, 25 bp, Homo sapien
tgcacggcccgaatgcttcttcgtg

SEQ ID NO: 41184 - DNA, 25 bp, Homo sapien
cccacacggatgactcggagcttga

SEQ ID NO: 41185 - DNA, 25 bp, Homo sapien
ctcctcagtacaggggccaggctag

SEQ ID NO: 41186 - DNA, 25 bp, Homo sapien
agggtcctcacctacctgggtcaca

SEQ ID NO: 41187 - DNA, 25 bp, Homo sapien
tttgtttaagcagccgcgacctgtg

SEQ ID NO: 41188 - DNA, 25 bp, Homo sapien
gacgagtccatgctctgcaggttta

SEQ ID NO: 41189 - DNA, 25 bp, Homo sapien
tttgactcctgaacccggccgcaga

SEQ ID NO: 41190 - DNA, 25 bp, Homo sapien
ttagggccaatcgtgtccatgctcc

SEQ ID NO: 41191 - DNA, 25 bp, Homo sapien
tggagctaatatcccagcaggcctc

SEQ ID NO: 41192 - DNA, 25 bp, Homo sapien
cccgctttgtgactttggcgcgaaa

SEQ ID NO: 41193 - DNA, 25 bp, Homo sapien
tgcaggtttacaccgctggagctaa

SEQ ID NO: 41194 - DNA, 25 bp, Homo sapien
ctgctacgcctgcaaccgtttaatg

SEQ ID NO: 41195 - DNA, 25 bp, Homo sapien
accttcttgaggatggagccctgga

SEQ ID NO: 41196 - DNA, 25 bp, Homo sapien
agaggggtcgtcttgttctctgacc

SEQ ID NO: 41197 - DNA, 25 bp, Homo sapien
tctgaccctttgtcgcagccgacgg

SEQ ID NO: 41198 - DNA, 25 bp, Homo sapien
ttgcgccacccgaggacaaggtagc

SEQ ID NO: 41199 - DNA, 25 bp, Homo sapien
ctcagggtctgactgaagtggctcc

SEQ ID NO: 41200 - DNA, 25 bp, Homo sapien
tcgggccgattttcccaggatgaca

SEQ ID NO: 41201 - DNA, 25 bp, Homo sapien
ctgctaagggaactgtgagccgctc

SEQ ID NO: 41202 - DNA, 25 bp, Homo sapien
ttgcgccattggtggatattccgga

SEQ ID NO: 41203 - DNA, 25 bp, Homo sapien
ggagctcccattggctaatcgcaca

SEQ ID NO: 41204 - DNA, 25 bp, Homo sapien
ttccttcacgaacacagtggggaag

SEQ ID NO: 41205 - DNA, 25 bp, Homo sapien
agtcacgaacgatggtgaaaccgta

SEQ ID NO: 41206 - DNA, 25 bp, Homo sapien
gaaaccgtagaagggtgcccagcac

SEQ ID NO: 41207 - DNA, 25 bp, Homo sapien
agaagggtgcccagcacagcacata

SEQ ID NO: 41208 - DNA, 25 bp, Homo sapien
acacagtggggaagaagtcacgaac

SEQ ID NO: 41209 - DNA, 25 bp, Homo sapien
ataggccgtgagaatgcacatgagc

SEQ ID NO: 41210 - DNA, 25 bp, Homo sapien
gcacagcacataggccgtgagaatg

SEQ ID NO: 41211 - DNA, 25 bp, Homo sapien
tgcccagcacagcacataggccgtg

SEQ ID NO: 41212 - DNA, 25 bp, Homo sapien
gttaatgaggagaaagctaaacgca

SEQ ID NO: 41213 - DNA, 25 bp, Homo sapien
taccggccgcactgaagtcggtctc

SEQ ID NO: 41214 - DNA, 25 bp, Homo sapien
cggcttagcgcaagccacatggtgc

SEQ ID NO: 41215 - DNA, 25 bp, Homo sapien
aaagctaaacgcagggagctgagcc

SEQ ID NO: 41216 - DNA, 25 bp, Homo sapien
ggcgcatttcatcggggctgattaa

SEQ ID NO: 41217 - DNA, 25 bp, Homo sapien
taattaaagcgccaaacggcggagc

SEQ ID NO: 41218 - DNA, 25 bp, Homo sapien
ctcccgctgggaggataattaaagc

SEQ ID NO: 41219 - DNA, 25 bp, Homo sapien
gccctctctttctagtagcggctta

SEQ ID NO: 41220 - DNA, 25 bp, Homo sapien
cgtctagaggcgacatcctggcaaa

SEQ ID NO: 41221 - DNA, 25 bp, Homo sapien
ctctttccagcgtctcggacctgtg

SEQ ID NO: 41222 - DNA, 25 bp, Homo sapien
tttcacctcgaggacccggacttgc

SEQ ID NO: 41223 - DNA, 25 bp, Homo sapien
ccggatcgagagtcacagtgtggtt

SEQ ID NO: 41224 - DNA, 25 bp, Homo sapien
tcccgggactgcagggatctaagcc

SEQ ID NO: 41225 - DNA, 25 bp, Homo sapien
aggggatctcctgaaaccaactcgc

SEQ ID NO: 41226 - DNA, 25 bp, Homo sapien
cctgcaatttggagctcgtccgcga

SEQ ID NO: 41227 - DNA, 25 bp, Homo sapien
tgcctcctggctggaagaaaacggc

SEQ ID NO: 41228 - DNA, 25 bp, Homo sapien
agcagccacgctcaaaccggtttca

SEQ ID NO: 41229 - DNA, 25 bp, Homo sapien
cgggttcgctagtccgcaggtccgc

SEQ ID NO: 41230 - DNA, 25 bp, Homo sapien
ttcgctagtccgcaggtccgcgtcg

SEQ ID NO: 41231 - DNA, 25 bp, Homo sapien
gcaggaagcagccacgctcaaaccg

SEQ ID NO: 41232 - DNA, 25 bp, Homo sapien
tcaaaccggtttcagctgctccaga

SEQ ID NO: 41233 - DNA, 25 bp, Homo sapien
agctgctccagaccaaactgccagg

SEQ ID NO: 41234 - DNA, 25 bp, Homo sapien
cgttcctggaaagggctgacgtacg

SEQ ID NO: 41235 - DNA, 25 bp, Homo sapien
cgccgtccgtgcctcgccagcgctc

SEQ ID NO: 41236 - DNA, 25 bp, Homo sapien
ggcgactggactggcgtaaatttcc

SEQ ID NO: 41237 - DNA, 25 bp, Homo sapien
cggggccatgcagccaacgctgctt

SEQ ID NO: 41238 - DNA, 25 bp, Homo sapien
gccgccatcttcctttccgcacagg

SEQ ID NO: 41239 - DNA, 25 bp, Homo sapien
ggaccaggaggcacgctggttttcc

SEQ ID NO: 41240 - DNA, 25 bp, Homo sapien
tggcgtaaatttccgcccatttgcg

SEQ ID NO: 41241 - DNA, 25 bp, Homo sapien
aaatttccgcccatttgcgtcgccg

SEQ ID NO: 41242 - DNA, 25 bp, Homo sapien
agaccctgcacaccaggcgactgga

SEQ ID NO: 41243 - DNA, 25 bp, Homo sapien
tgccctttaaaagagcggggcctgc

SEQ ID NO: 41244 - DNA, 25 bp, Homo sapien
ggagacacacggctcggccgccagc

SEQ ID NO: 41245 - DNA, 25 bp, Homo sapien
cggggcgagacagcttccgactccg

SEQ ID NO: 41246 - DNA, 25 bp, Homo sapien
gctccgctgccctatcctgggccca

SEQ ID NO: 41247 - DNA, 25 bp, Homo sapien
cccacccgccaacgacctcgcctgg

SEQ ID NO: 41248 - DNA, 25 bp, Homo sapien
cctggctgctccctaggtacctgtg

SEQ ID NO: 41249 - DNA, 25 bp, Homo sapien
tccctaggtacctgtggtggaagcg

SEQ ID NO: 41250 - DNA, 25 bp, Homo sapien
ctgctcacacagacaatatggcggc

SEQ ID NO: 41251 - DNA, 25 bp, Homo sapien
acacagacaatatggcggcgatgga

SEQ ID NO: 41252 - DNA, 25 bp, Homo sapien
ctgagtttcccgagccgttgagaca

SEQ ID NO: 41253 - DNA, 25 bp, Homo sapien
acagatctgcgcgtatcctggagcc

SEQ ID NO: 41254 - DNA, 25 bp, Homo sapien
agtcgcctgaggagctaagatcccg

SEQ ID NO: 41255 - DNA, 25 bp, Homo sapien
tgcggctgaagagaactgcggactt

SEQ ID NO: 41256 - DNA, 25 bp, Homo sapien
gcgctgtgcgctacagacaccttct

SEQ ID NO: 41257 - DNA, 25 bp, Homo sapien
tgagcggaagttggatcactgaagc

SEQ ID NO: 41258 - DNA, 25 bp, Homo sapien
tccgtctggccaaactccttgattg

SEQ ID NO: 41259 - DNA, 25 bp, Homo sapien
ttcccacaacctggcgcactaggag

SEQ ID NO: 41260 - DNA, 25 bp, Homo sapien
acccgcctcagagggtttcaggcca

SEQ ID NO: 41261 - DNA, 25 bp, Homo sapien
aacaagctctgggtggtgcagctcg

SEQ ID NO: 41262 - DNA, 25 bp, Homo sapien
ccctgcactcaggtaacaagctctg

SEQ ID NO: 41263 - DNA, 25 bp, Homo sapien
ccagcctggtacgtaccgatgaggc

SEQ ID NO: 41264 - DNA, 25 bp, Homo sapien
tcctgccacctgtataagtggagtg

SEQ ID NO: 41265 - DNA, 25 bp, Homo sapien
tcgtaaaagcgtcgcgaaggcgtcc

SEQ ID NO: 41266 - DNA, 25 bp, Homo sapien
caaaacccactgagcctgatgcgcg

SEQ ID NO: 41267 - DNA, 25 bp, Homo sapien
gctgcgcggtcatcctatcttgttc

SEQ ID NO: 41268 - DNA, 25 bp, Homo sapien
aaacgctggagttgctgtgacctgc

SEQ ID NO: 41269 - DNA, 25 bp, Homo sapien
agctatcgtgcgagagcccacgtta

SEQ ID NO: 41270 - DNA, 25 bp, Homo sapien
cgcagagtagcggatctggtaccca

SEQ ID NO: 41271 - DNA, 25 bp, Homo sapien
aggcgagcttatgctgcggtcccac

SEQ ID NO: 41272 - DNA, 25 bp, Homo sapien
agactggaatctcgccctcggaaag

SEQ ID NO: 41273 - DNA, 25 bp, Homo sapien
tcactgtagtcgtccagcagcaaga

SEQ ID NO: 41274 - DNA, 25 bp, Homo sapien
tggtacccatgcactaccgagttgg

SEQ ID NO: 41275 - DNA, 25 bp, Homo sapien
acgttaggggccttggagacactct

SEQ ID NO: 41276 - DNA, 25 bp, Homo sapien
ggacgcccatcaaatccacaggaac

SEQ ID NO: 41277 - DNA, 25 bp, Homo sapien
atccaggacttcgagcgtgaccagg

SEQ ID NO: 41278 - DNA, 25 bp, Homo sapien
acgtgccgctgagatccaggacttc

SEQ ID NO: 41279 - DNA, 25 bp, Homo sapien
gccagctggttgtagctgaggtcca

SEQ ID NO: 41280 - DNA, 25 bp, Homo sapien
tggcgcagggtcagcacctgcagct

SEQ ID NO: 41281 - DNA, 25 bp, Homo sapien
ccaggttgcggttcgccagggtcaa

SEQ ID NO: 41282 - DNA, 25 bp, Homo sapien
ggagagaacagcaggacgcccatca

SEQ ID NO: 41283 - DNA, 25 bp, Homo sapien
ccctcgaggaagaacgcagccctgc

SEQ ID NO: 41284 - DNA, 25 bp, Homo sapien
gcagctcctcttgcgatgtctcatc

SEQ ID NO: 41285 - DNA, 25 bp, Homo sapien
ggcgcacgctcagtatctgcagctc

SEQ ID NO: 41286 - DNA, 25 bp, Homo sapien
cgcagtctgcagatttttaagggca

SEQ ID NO: 41287 - DNA, 25 bp, Homo sapien
ctaggtctcgctcccgcggagagga

SEQ ID NO: 41288 - DNA, 25 bp, Homo sapien
ctgctcagctaaggctgcggcaggt

SEQ ID NO: 41289 - DNA, 25 bp, Homo sapien
tggagagctgcgtccctacaaacta

SEQ ID NO: 41290 - DNA, 25 bp, Homo sapien
ggggactagcccagatgattaaagc

SEQ ID NO: 41291 - DNA, 25 bp, Homo sapien
gtctcatcctgacgctttaaggccg

SEQ ID NO: 41292 - DNA, 25 bp, Homo sapien
tcctgaggcctaggctacgtggtca

SEQ ID NO: 41293 - DNA, 25 bp, Homo sapien
agagtgcgagcaagcgagccagaag

SEQ ID NO: 41294 - DNA, 25 bp, Homo sapien
tgaggcctaggctacgtggtcacgt

SEQ ID NO: 41295 - DNA, 25 bp, Homo sapien
atcctgaggcctaggctacgtggtc

SEQ ID NO: 41296 - DNA, 25 bp, Homo sapien
gcatcctgaggcctaggctacgtgg

SEQ ID NO: 41297 - DNA, 25 bp, Homo sapien
ctgagcccgcgggtgcgcatcctga

SEQ ID NO: 41298 - DNA, 25 bp, Homo sapien
gcagccgctgccagagcggaagggc

SEQ ID NO: 41299 - DNA, 25 bp, Homo sapien
tactgggtcgagagtgcgagcaagc

SEQ ID NO: 41300 - DNA, 25 bp, Homo sapien
ttcctccaaggatggcagctgccac

SEQ ID NO: 41301 - DNA, 25 bp, Homo sapien
tggccagcgtggcactctccacggt

SEQ ID NO: 41302 - DNA, 25 bp, Homo sapien
cagctgccactgtctgggcacgtgg

SEQ ID NO: 41303 - DNA, 25 bp, Homo sapien
cagtgtggtggaacgacgcacagcc

SEQ ID NO: 41304 - DNA, 25 bp, Homo sapien
cacagccgtcctggtccctgcacgg

SEQ ID NO: 41305 - DNA, 25 bp, Homo sapien
tggcggccacacaccggagtctcag

SEQ ID NO: 41306 - DNA, 25 bp, Homo sapien
gcaggccgggcttttactcttctct

SEQ ID NO: 41307 - DNA, 25 bp, Homo sapien
tctgtcctcttctcttcggcggctg

SEQ ID NO: 41308 - DNA, 25 bp, Homo sapien
tgcggagcacctactgcaggagatc

SEQ ID NO: 41309 - DNA, 25 bp, Homo sapien
tggctggggacttcttgaacttgca

SEQ ID NO: 41310 - DNA, 25 bp, Homo sapien
ctcgctgttgttgtgtgtcagcact

SEQ ID NO: 41311 - DNA, 25 bp, Homo sapien
tcctaaggaggacgacagcaccagc

SEQ ID NO: 41312 - DNA, 25 bp, Homo sapien
gggcaactcgcctggcaccgagatc

SEQ ID NO: 41313 - DNA, 25 bp, Homo sapien
gtgctttcaactggcgagcgcgaat

SEQ ID NO: 41314 - DNA, 25 bp, Homo sapien
ggctagccacaaagggcacttggcc

SEQ ID NO: 41315 - DNA, 25 bp, Homo sapien
ttgcagggagaataacttgcgcacc

SEQ ID NO: 41316 - DNA, 25 bp, Homo sapien
tgactcacgtcggtcctgtccgcag

SEQ ID NO: 41317 - DNA, 25 bp, Homo sapien
tcctgagcgagttcgagttgcggct

SEQ ID NO: 41318 - DNA, 25 bp, Homo sapien
tcctgtccgcaggtcgaccatggtg

SEQ ID NO: 41319 - DNA, 25 bp, Homo sapien
ccgggacccgctgtcttctagcgtt

SEQ ID NO: 41320 - DNA, 25 bp, Homo sapien
ctgtcttctagcgttgctgcttccc

SEQ ID NO: 41321 - DNA, 25 bp, Homo sapien
agccctctgacgaggtcctgagcga

SEQ ID NO: 41322 - DNA, 25 bp, Homo sapien
tcgagttgcggctgctcagcatgtt

SEQ ID NO: 41323 - DNA, 25 bp, Homo sapien
gaactcgggtgactcacgtcggtcc

SEQ ID NO: 41324 - DNA, 25 bp, Homo sapien
ggttttaggttgagcccaagcggca

SEQ ID NO: 41325 - DNA, 25 bp, Homo sapien
acccgccatgttgggcgccgagcga

SEQ ID NO: 41326 - DNA, 25 bp, Homo sapien
acagccgcgatccaggcggccagga

SEQ ID NO: 41327 - DNA, 25 bp, Homo sapien
ccagcgtccagttggaggcggtcat

SEQ ID NO: 41328 - DNA, 25 bp, Homo sapien
ccaagcggcaatgcgggatcgccac

SEQ ID NO: 41329 - DNA, 25 bp, Homo sapien
gtttttcaaggaagcgggagacgca

SEQ ID NO: 41330 - DNA, 25 bp, Homo sapien
cccacagccgcaggtcgttggtaag

SEQ ID NO: 41331 - DNA, 25 bp, Homo sapien
ggcgggcacactcacaatttcagca

SEQ ID NO: 41332 - DNA, 25 bp, Homo sapien
gcggatgtccaagggcagaagcttt

SEQ ID NO: 41333 - DNA, 25 bp, Homo sapien
gctttgcgcgcgctcctgtttcatc

SEQ ID NO: 41334 - DNA, 25 bp, Homo sapien
ggagcccagatgagcccagatggcc

SEQ ID NO: 41335 - DNA, 25 bp, Homo sapien
ttggcatctgccaaagcggatgtcc

SEQ ID NO: 41336 - DNA, 25 bp, Homo sapien
cctcaagaagggcaccaaattcgtc

SEQ ID NO: 41337 - DNA, 25 bp, Homo sapien
tgtgcgtgtccgacagcctcaagaa

SEQ ID NO: 41338 - DNA, 25 bp, Homo sapien
aacccggagtgcacgccttgcaact

SEQ ID NO: 41339 - DNA, 25 bp, Homo sapien
ctccctctgtgtatagaggatgtgc

SEQ ID NO: 41340 - DNA, 25 bp, Homo sapien
gacgcgtcgctctcgctgcggttct

SEQ ID NO: 41341 - DNA, 25 bp, Homo sapien
ctagcccggcagatgctggaggtct

SEQ ID NO: 41342 - DNA, 25 bp, Homo sapien
cacgtccgggtacagcacgtgcgcg

SEQ ID NO: 41343 - DNA, 25 bp, Homo sapien
gtgttcacgctctgagtgcggtccc

SEQ ID NO: 41344 - DNA, 25 bp, Homo sapien
aacgactggtccgacgcgtcgctct

SEQ ID NO: 41345 - DNA, 25 bp, Homo sapien
gatcttggacagcttgcggtccacc

SEQ ID NO: 41346 - DNA, 25 bp, Homo sapien
tcgcagcagccgaacgactggtccg

SEQ ID NO: 41347 - DNA, 25 bp, Homo sapien
acagcttgcggtccaccggctcggt

SEQ ID NO: 41348 - DNA, 25 bp, Homo sapien
tgcccaccacctgcctcggctgctc

SEQ ID NO: 41349 - DNA, 25 bp, Homo sapien
gagctgcaccgccaacaagatctct

SEQ ID NO: 41350 - DNA, 25 bp, Homo sapien
cctcaactgaggtaaggaccgcgcg

SEQ ID NO: 41351 - DNA, 25 bp, Homo sapien
acccacctcctcttggcgctgccca

SEQ ID NO: 41352 - DNA, 25 bp, Homo sapien
cacgcgcgtacacactgggtctcca

SEQ ID NO: 41353 - DNA, 25 bp, Homo sapien
ccaggcaaagtgacaggtaggaaaa

SEQ ID NO: 41354 - DNA, 25 bp, Homo sapien
gcttgtttgctttccgcgggtgcgt

SEQ ID NO: 41355 - DNA, 25 bp, Homo sapien
tgctttccgcgggtgcgtcccggac

SEQ ID NO: 41356 - DNA, 25 bp, Homo sapien
agacgatccatcagtgccaggctcc

SEQ ID NO: 41357 - DNA, 25 bp, Homo sapien
gaccagagcccaagttcccaagttc

SEQ ID NO: 41358 - DNA, 25 bp, Homo sapien
ttccggcccatcaagttgggaaatg

SEQ ID NO: 41359 - DNA, 25 bp, Homo sapien
agagtcacccgggaataactgcgcc

SEQ ID NO: 41360 - DNA, 25 bp, Homo sapien
tggctttgctgctctgggctacaag

SEQ ID NO: 41361 - DNA, 25 bp, Homo sapien
cattccacggggagatgcggacttt

SEQ ID NO: 41362 - DNA, 25 bp, Homo sapien
gaagggcgagtcctttgcttccgca

SEQ ID NO: 41363 - DNA, 25 bp, Homo sapien
gcaggcacagctatcccaggttccg

SEQ ID NO: 41364 - DNA, 25 bp, Homo sapien
tccgtgagtagcgatttggcgactg

SEQ ID NO: 41365 - DNA, 25 bp, Homo sapien
gagttctcctgatgttgttccgtga

SEQ ID NO: 41366 - DNA, 25 bp, Homo sapien
gggcactgcgagtatggatctccaa

SEQ ID NO: 41367 - DNA, 25 bp, Homo sapien
actccagcggcgactttgagggatt

SEQ ID NO: 41368 - DNA, 25 bp, Homo sapien
cctagctaggcgctcacagaatacg

SEQ ID NO: 41369 - DNA, 25 bp, Homo sapien
cgtgcggtcctttcctccgcagtga

SEQ ID NO: 41370 - DNA, 25 bp, Homo sapien
tgagccgatttgctctgccagcagc

SEQ ID NO: 41371 - DNA, 25 bp, Homo sapien
gctcgacaccgagtcctagctaggc

SEQ ID NO: 41372 - DNA, 25 bp, Homo sapien
tctaaccgcatgttcccggaacctg

SEQ ID NO: 41373 - DNA, 25 bp, Homo sapien
ggatcgcgcatatgcactcaaaatg

SEQ ID NO: 41374 - DNA, 25 bp, Homo sapien
agccagtcggagctgcaagtgttct

SEQ ID NO: 41375 - DNA, 25 bp, Homo sapien
cggggctgcacgtagagcatctaac

SEQ ID NO: 41376 - DNA, 25 bp, Homo sapien
cgcccaagcgtgcaacccagagttt

SEQ ID NO: 41377 - DNA, 25 bp, Homo sapien
ggcgtctgtgttcccagctgatcac

SEQ ID NO: 41378 - DNA, 25 bp, Homo sapien
gctgatcacagaacaggccgatatc

SEQ ID NO: 41379 - DNA, 25 bp, Homo sapien
cgatatcgcattgacccggggagct

SEQ ID NO: 41380 - DNA, 25 bp, Homo sapien
tgtctacactcagggtgcaggagcc

SEQ ID NO: 41381 - DNA, 25 bp, Homo sapien
ggcagagccacagctttctactctc

SEQ ID NO: 41382 - DNA, 25 bp, Homo sapien
ttcgcatcctctcccggcaaagaga

SEQ ID NO: 41383 - DNA, 25 bp, Homo sapien
aaagagagatgctccggttaccagc

SEQ ID NO: 41384 - DNA, 25 bp, Homo sapien
ctggggaactactactggctgggta

SEQ ID NO: 41385 - DNA, 25 bp, Homo sapien
tgtccatgagcgtacgcagctgctc

SEQ ID NO: 41386 - DNA, 25 bp, Homo sapien
caggcgaccaatccaatcacgttta

SEQ ID NO: 41387 - DNA, 25 bp, Homo sapien
ctgtcacagtggtcctcttcgcatc

SEQ ID NO: 41388 - DNA, 25 bp, Homo sapien
cgctacctgctgaaaacgctgctgc

SEQ ID NO: 41389 - DNA, 25 bp, Homo sapien
gcgagctgctcttgggcttcaactc

SEQ ID NO: 41390 - DNA, 25 bp, Homo sapien
ggcgatccctctctcaacggtgaga

SEQ ID NO: 41391 - DNA, 25 bp, Homo sapien
tgagaccctgcctcttggggatatg

SEQ ID NO: 41392 - DNA, 25 bp, Homo sapien
cttgggagaagatggctactgagtc

SEQ ID NO: 41393 - DNA, 25 bp, Homo sapien
acccaggcagctggtcttcggaacc

SEQ ID NO: 41394 - DNA, 25 bp, Homo sapien
gcggcgaggtcgttaccgctaatta

SEQ ID NO: 41395 - DNA, 25 bp, Homo sapien
agaagtttgtctttcagcggcggga

SEQ ID NO: 41396 - DNA, 25 bp, Homo sapien
tcagaggacgagagcaggggcctcc

SEQ ID NO: 41397 - DNA, 25 bp, Homo sapien
cagcgctgagcgtcagaggacgaga

SEQ ID NO: 41398 - DNA, 25 bp, Homo sapien
caagggacatcattcacgcctgggc

SEQ ID NO: 41399 - DNA, 25 bp, Homo sapien
acccaagggacatcattcacgcctg

SEQ ID NO: 41400 - DNA, 25 bp, Homo sapien
ccatggacacatacacccagccctg

SEQ ID NO: 41401 - DNA, 25 bp, Homo sapien
gcggaagctcacaatcagcccggtc

SEQ ID NO: 41402 - DNA, 25 bp, Homo sapien
ccctgcgtggcggaagctcacaatc

SEQ ID NO: 41403 - DNA, 25 bp, Homo sapien
gcgtggcggaagctcacaatcagcc

SEQ ID NO: 41404 - DNA, 25 bp, Homo sapien
gccgcctgcaatctgccaccgctgc

SEQ ID NO: 41405 - DNA, 25 bp, Homo sapien
gactcactgcggcactggcagggct

SEQ ID NO: 41406 - DNA, 25 bp, Homo sapien
cggggcgattgcctccctagagctg

SEQ ID NO: 41407 - DNA, 25 bp, Homo sapien
tcccgtgggctttccaaacagcctg

SEQ ID NO: 41408 - DNA, 25 bp, Homo sapien
ggaggcggggttcctgactcactgc

SEQ ID NO: 41409 - DNA, 25 bp, Homo sapien
ccagcaaggcatcccctgggtcaag

SEQ ID NO: 41410 - DNA, 25 bp, Homo sapien
acagcctgtgctcatttccgcggga

SEQ ID NO: 41411 - DNA, 25 bp, Homo sapien
ctgtgctcatttccgcgggagccct

SEQ ID NO: 41412 - DNA, 25 bp, Homo sapien
gttcaaaataacgtgcgccagcctc

SEQ ID NO: 41413 - DNA, 25 bp, Homo sapien
cctggctctgacgtagttcaaaata

SEQ ID NO: 41414 - DNA, 25 bp, Homo sapien
tcgagtccttgcaaacccacgctgg

SEQ ID NO: 41415 - DNA, 25 bp, Homo sapien
gagtcatccgtttttgccctcggca

SEQ ID NO: 41416 - DNA, 25 bp, Homo sapien
ttccaccgaaagcagagtcatccgt

SEQ ID NO: 41417 - DNA, 25 bp, Homo sapien
cccgccctgatttgagcatccgagg

SEQ ID NO: 41418 - DNA, 25 bp, Homo sapien
gcaacccacgtagcctggccatata

SEQ ID NO: 41419 - DNA, 25 bp, Homo sapien
cctcgacgctgcttcgataacatga

SEQ ID NO: 41420 - DNA, 25 bp, Homo sapien
cccgcggacttgatttatgccgcct

SEQ ID NO: 41421 - DNA, 25 bp, Homo sapien
ctgcctgcggcagaaatgcctggcc

SEQ ID NO: 41422 - DNA, 25 bp, Homo sapien
agcgcctcatctgcctgcggcagaa

SEQ ID NO: 41423 - DNA, 25 bp, Homo sapien
gccctcgacctttcagcaccgggga

SEQ ID NO: 41424 - DNA, 25 bp, Homo sapien
tcagcaccctggatagcaacaccga

SEQ ID NO: 41425 - DNA, 25 bp, Homo sapien
gcgctcagcaccctggatagcaaca

SEQ ID NO: 41426 - DNA, 25 bp, Homo sapien
gacttgatttatgccgcctgctcca

SEQ ID NO: 41427 - DNA, 25 bp, Homo sapien
tgctccacgtcaactgcaggctggc

SEQ ID NO: 41428 - DNA, 25 bp, Homo sapien
tttcacgtagctggcagggccacgc

SEQ ID NO: 41429 - DNA, 25 bp, Homo sapien
gggccacgctgcacaacgtctctaa

SEQ ID NO: 41430 - DNA, 25 bp, Homo sapien
caaagcgggcttttccacctagagt

SEQ ID NO: 41431 - DNA, 25 bp, Homo sapien
aggtcggtctttcgcctcctacaga

SEQ ID NO: 41432 - DNA, 25 bp, Homo sapien
tctcttcggccggacacaaagcggg

SEQ ID NO: 41433 - DNA, 25 bp, Homo sapien
gggttttccgtgaagctccagccaa

SEQ ID NO: 41434 - DNA, 25 bp, Homo sapien
tcggcagctatttcagaggtcggtc

SEQ ID NO: 41435 - DNA, 25 bp, Homo sapien
gcatccgtgccgaccgcaacattta

SEQ ID NO: 41436 - DNA, 25 bp, Homo sapien
ggccacagagcgcgctttgttctgc

SEQ ID NO: 41437 - DNA, 25 bp, Homo sapien
ctgaggtcatctgtcaggcggagcc

SEQ ID NO: 41438 - DNA, 25 bp, Homo sapien
cggcctggaagacattacacggctg

SEQ ID NO: 41439 - DNA, 25 bp, Homo sapien
cctggaagacattacacggctgtcg

SEQ ID NO: 41440 - DNA, 25 bp, Homo sapien
gaagacattacacggctgtcgggcg

SEQ ID NO: 41441 - DNA, 25 bp, Homo sapien
cccgggagctggaaccaatggattg

SEQ ID NO: 41442 - DNA, 25 bp, Homo sapien
gaaccaatggattggcggcagctga

SEQ ID NO: 41443 - DNA, 25 bp, Homo sapien
cggcagctgaggtcatctgtcaggc

SEQ ID NO: 41444 - DNA, 25 bp, Homo sapien
tcacgttctgcatggacaggatctc

SEQ ID NO: 41445 - DNA, 25 bp, Homo sapien
tctgatcgcttctttgagacgctcc

SEQ ID NO: 41446 - DNA, 25 bp, Homo sapien
agcggcccgttccagaaggcaaaga

SEQ ID NO: 41447 - DNA, 25 bp, Homo sapien
ttggagcatgcacgactggaaaaca

SEQ ID NO: 41448 - DNA, 25 bp, Homo sapien
ggctctaatatactccgccgattgg

SEQ ID NO: 41449 - DNA, 25 bp, Homo sapien
gactcaacatgattccggggcaaaa

SEQ ID NO: 41450 - DNA, 25 bp, Homo sapien
cctcctcgccgagtgaaaataattt

SEQ ID NO: 41451 - DNA, 25 bp, Homo sapien
gcgcagccttttattcccttttaga

SEQ ID NO: 41452 - DNA, 25 bp, Homo sapien
cgcgtaggtttatctcggcctcctg

SEQ ID NO: 41453 - DNA, 25 bp, Homo sapien
ttcgcgtagggaaacaggcactctc

SEQ ID NO: 41454 - DNA, 25 bp, Homo sapien
cgtggctccattttgtctttcctga

SEQ ID NO: 41455 - DNA, 25 bp, Homo sapien
tcctctcccggaagacaaggctgcg

SEQ ID NO: 41456 - DNA, 25 bp, Homo sapien
ttccttggaggagcacctgttcttc

SEQ ID NO: 41457 - DNA, 25 bp, Homo sapien
gctcgggcagggatcttaaacatca

SEQ ID NO: 41458 - DNA, 25 bp, Homo sapien
cagaatgcttcgctgtggtggttcc

SEQ ID NO: 41459 - DNA, 25 bp, Homo sapien
ggccttcctctcgaacacttgcggg

SEQ ID NO: 41460 - DNA, 25 bp, Homo sapien
tccctcccggtgaccgggcacgcgc

SEQ ID NO: 41461 - DNA, 25 bp, Homo sapien
acgctccgggtttgcgcggcctcag

SEQ ID NO: 41462 - DNA, 25 bp, Homo sapien
ccctaagtaactttcctgaggcgct

SEQ ID NO: 41463 - DNA, 25 bp, Homo sapien
tgggaagcggagcaaacttccccta

SEQ ID NO: 41464 - DNA, 25 bp, Homo sapien
aagcctcggcgcctagcaggtggcg

SEQ ID NO: 41465 - DNA, 25 bp, Homo sapien
agggccgcctcagccgaaagaccgc

SEQ ID NO: 41466 - DNA, 25 bp, Homo sapien
acccacgggaccagaggatcccata

SEQ ID NO: 41467 - DNA, 25 bp, Homo sapien
ggaccagaggatcccatatccgtcc

SEQ ID NO: 41468 - DNA, 25 bp, Homo sapien
gcgccaagcgtggaggtaactcccg

SEQ ID NO: 41469 - DNA, 25 bp, Homo sapien
ggcaagcccactagagctgagattc

SEQ ID NO: 41470 - DNA, 25 bp, Homo sapien
actccgagttcctgagcgcctgagc

SEQ ID NO: 41471 - DNA, 25 bp, Homo sapien
gcccgtgaccagacgaacgcctaga

SEQ ID NO: 41472 - DNA, 25 bp, Homo sapien
cggcccagcaagtgtcaagaccctt

SEQ ID NO: 41473 - DNA, 25 bp, Homo sapien
ccttcggaacgacactttggcactc

SEQ ID NO: 41474 - DNA, 25 bp, Homo sapien
cctcagtgtgcacaagggctctacc

SEQ ID NO: 41475 - DNA, 25 bp, Homo sapien
ctccagtttgccaataaaggtttct

SEQ ID NO: 41476 - DNA, 25 bp, Homo sapien
cccgacccaacattgagtggtacaa

SEQ ID NO: 41477 - DNA, 25 bp, Homo sapien
ttgcgtggctcgcaactacctgggg

SEQ ID NO: 41478 - DNA, 25 bp, Homo sapien
cggaggacgctatgccccgcatcgt

SEQ ID NO: 41479 - DNA, 25 bp, Homo sapien
cgccagatctgctggtctcccgagg

SEQ ID NO: 41480 - DNA, 25 bp, Homo sapien
atctgctggtctcccgaggcgagcc

SEQ ID NO: 41481 - DNA, 25 bp, Homo sapien
acattgagtggtacaagaacggggc

SEQ ID NO: 41482 - DNA, 25 bp, Homo sapien
cgcggccggacgaaggtgtctacac

SEQ ID NO: 41483 - DNA, 25 bp, Homo sapien
tctacacttgcgtggctcgcaacta

SEQ ID NO: 41484 - DNA, 25 bp, Homo sapien
tgcagctcatcaccaggggcaaggg

SEQ ID NO: 41485 - DNA, 25 bp, Homo sapien
ctacggcgacaacatgcagctcatc

SEQ ID NO: 41486 - DNA, 25 bp, Homo sapien
cagcactgctgctacggcgacaaca

SEQ ID NO: 41487 - DNA, 25 bp, Homo sapien
tccatgctgtccctggagagcacca

SEQ ID NO: 41488 - DNA, 25 bp, Homo sapien
tggagatctacaagcccactgcccg

SEQ ID NO: 41489 - DNA, 25 bp, Homo sapien
caaggacttccgctggaaggacgcc

SEQ ID NO: 41490 - DNA, 25 bp, Homo sapien
cgaccgcatcaagcgcaaggacttc

SEQ ID NO: 41491 - DNA, 25 bp, Homo sapien
ggccgacatcttcgaccgcatcaag

SEQ ID NO: 41492 - DNA, 25 bp, Homo sapien
ttcactgcaccggaagtagtcaccc

SEQ ID NO: 41493 - DNA, 25 bp, Homo sapien
actagggaactagggacatcctggc

SEQ ID NO: 41494 - DNA, 25 bp, Homo sapien
agaggacgtcccagctagcgtacgg

SEQ ID NO: 41495 - DNA, 25 bp, Homo sapien
aagagggacactcacccgcttcagc

SEQ ID NO: 41496 - DNA, 25 bp, Homo sapien
gaagcggggctgacatcaagtctcc

SEQ ID NO: 41497 - DNA, 25 bp, Homo sapien
gcagcgctaactccacctggggctt

SEQ ID NO: 41498 - DNA, 25 bp, Homo sapien
gggccgcctagagcgaccaagacta

SEQ ID NO: 41499 - DNA, 25 bp, Homo sapien
cccattggtcattcggggtaccacg

SEQ ID NO: 41500 - DNA, 25 bp, Homo sapien
ctctaattcggagaacacagggctg

SEQ ID NO: 41501 - DNA, 25 bp, Homo sapien
ccgtagggaagtcacctctggtgtc

SEQ ID NO: 41502 - DNA, 25 bp, Homo sapien
gtcccagcggagaatcttggccgta

SEQ ID NO: 41503 - DNA, 25 bp, Homo sapien
ctctggcgcttatgtcggcgacctt

SEQ ID NO: 41504 - DNA, 25 bp, Homo sapien
gcacgttccctcgagaagatctttg

SEQ ID NO: 41505 - DNA, 25 bp, Homo sapien
gactgattcgagaagcgaccctgaa

SEQ ID NO: 41506 - DNA, 25 bp, Homo sapien
cctgaatattttcgaccgggatttg

SEQ ID NO: 41507 - DNA, 25 bp, Homo sapien
tagggtctcctttccacctcctgta

SEQ ID NO: 41508 - DNA, 25 bp, Homo sapien
gctagctcgcctgtcacttggcgca

SEQ ID NO: 41509 - DNA, 25 bp, Homo sapien
ggccagcggtaagcgcggtccacct

SEQ ID NO: 41510 - DNA, 25 bp, Homo sapien
acctagttgacaggctctgaggtgc

SEQ ID NO: 41511 - DNA, 25 bp, Homo sapien
gcgtgacctagttgacaggctctga

SEQ ID NO: 41512 - DNA, 25 bp, Homo sapien
ttaggttagcgcgaggcgtgaccta

SEQ ID NO: 41513 - DNA, 25 bp, Homo sapien
agctccctagcgtcgtcggcgtcga

SEQ ID NO: 41514 - DNA, 25 bp, Homo sapien
acttggcgcacctggctctacaggc

SEQ ID NO: 41515 - DNA, 25 bp, Homo sapien
cttccaagaggccagcggtaagcgc

SEQ ID NO: 41516 - DNA, 25 bp, Homo sapien
agccctaaaacgagcgtgttgtccg

SEQ ID NO: 41517 - DNA, 25 bp, Homo sapien
ctaggggagccctaaaacgagcgtg

SEQ ID NO: 41518 - DNA, 25 bp, Homo sapien
tcctctgcaccgcagctgggacttg

SEQ ID NO: 41519 - DNA, 25 bp, Homo sapien
gcgctccgtgcaccctcatttcttt

SEQ ID NO: 41520 - DNA, 25 bp, Homo sapien
tggcaaagcgtacccaccatcgggt

SEQ ID NO: 41521 - DNA, 25 bp, Homo sapien
gcgtgacttttgaaacctggaactc

SEQ ID NO: 41522 - DNA, 25 bp, Homo sapien
gctgccgcagcgtgacttttgaaac

SEQ ID NO: 41523 - DNA, 25 bp, Homo sapien
gggcgcggcacaagttcctctgcac

SEQ ID NO: 41524 - DNA, 25 bp, Homo sapien
gccggcgacgctggctactcagatc

SEQ ID NO: 41525 - DNA, 25 bp, Homo sapien
actcacctgcgattcatgggccgga

SEQ ID NO: 41526 - DNA, 25 bp, Homo sapien
gatccatgcgccacggtttggcggc

SEQ ID NO: 41527 - DNA, 25 bp, Homo sapien
ctggaagcagcctccgggatctgca

SEQ ID NO: 41528 - DNA, 25 bp, Homo sapien
cctccgggatctgcaagtctggaaa

SEQ ID NO: 41529 - DNA, 25 bp, Homo sapien
ctgcaagtctggaaaggccacgttg

SEQ ID NO: 41530 - DNA, 25 bp, Homo sapien
gccacgttgtggaccttggcgcaga

SEQ ID NO: 41531 - DNA, 25 bp, Homo sapien
acgctggctactcagatcgcggctc

SEQ ID NO: 41532 - DNA, 25 bp, Homo sapien
cagcggttccacttccagtctggcg

SEQ ID NO: 41533 - DNA, 25 bp, Homo sapien
cagcggccggatgagcacgctcagc

SEQ ID NO: 41534 - DNA, 25 bp, Homo sapien
cacgctcagcggcacgttgtgcacc

SEQ ID NO: 41535 - DNA, 25 bp, Homo sapien
tcctagccagcgaggttatgatccc

SEQ ID NO: 41536 - DNA, 25 bp, Homo sapien
gggttcctagccagcgaggttatga

SEQ ID NO: 41537 - DNA, 25 bp, Homo sapien
cagccagggtgagtcggcaaagccc

SEQ ID NO: 41538 - DNA, 25 bp, Homo sapien
tcacccggatcgtgtccacgaggct

SEQ ID NO: 41539 - DNA, 25 bp, Homo sapien
tcgtgtccacgaggctctgcacctt

SEQ ID NO: 41540 - DNA, 25 bp, Homo sapien
gtctgagagacagccacgcctgctc

SEQ ID NO: 41541 - DNA, 25 bp, Homo sapien
cgaatttgaccaacgggtggcagga

SEQ ID NO: 41542 - DNA, 25 bp, Homo sapien
aggaacagccggagcaggatattaa

SEQ ID NO: 41543 - DNA, 25 bp, Homo sapien
cagccggagcaggatattaaggagc

SEQ ID NO: 41544 - DNA, 25 bp, Homo sapien
ggcgagcttgccaagcatgcgcagt

SEQ ID NO: 41545 - DNA, 25 bp, Homo sapien
gcccgccttatatgggagctgcgtg

SEQ ID NO: 41546 - DNA, 25 bp, Homo sapien
cccaacgcgcgggtctgagagacag

SEQ ID NO: 41547 - DNA, 25 bp, Homo sapien
gacaaactgttcgggcccaacgcgc

SEQ ID NO: 41548 - DNA, 25 bp, Homo sapien
tcactgcgctttcaggtgtcttcca

SEQ ID NO: 41549 - DNA, 25 bp, Homo sapien
gccagagacccggaagcatcgatcg

SEQ ID NO: 41550 - DNA, 25 bp, Homo sapien
cagggtgtccctgtaacaacgcagc

SEQ ID NO: 41551 - DNA, 25 bp, Homo sapien
tctgtgctcggcttctagacttgtc

SEQ ID NO: 41552 - DNA, 25 bp, Homo sapien
ttcttacagtagtcggcgtaggcct

SEQ ID NO: 41553 - DNA, 25 bp, Homo sapien
ctcgctgtttcggttttcctggctc

SEQ ID NO: 41554 - DNA, 25 bp, Homo sapien
gcttgcgcgtacgaagtaaaggata

SEQ ID NO: 41555 - DNA, 25 bp, Homo sapien
gtggcagctcccttggacttcgtta

SEQ ID NO: 41556 - DNA, 25 bp, Homo sapien
tgcgcccgaattcgcctccagtaga

SEQ ID NO: 41557 - DNA, 25 bp, Homo sapien
gtagaagacgttcagcgggcgactt

SEQ ID NO: 41558 - DNA, 25 bp, Homo sapien
accctcgctgtccttgtgcagtgga

SEQ ID NO: 41559 - DNA, 25 bp, Homo sapien
tctgagaatgcacctcccgccgtgt

SEQ ID NO: 41560 - DNA, 25 bp, Homo sapien
gccgcgtctctcctgaaggcagatc

SEQ ID NO: 41561 - DNA, 25 bp, Homo sapien
atcttggaggtgcagccaggactcc

SEQ ID NO: 41562 - DNA, 25 bp, Homo sapien
tccgtcgtcagcagttagcagagtc

SEQ ID NO: 41563 - DNA, 25 bp, Homo sapien
cgagtgcacgtttcttaaccggata

SEQ ID NO: 41564 - DNA, 25 bp, Homo sapien
ggtctcctctatcgaaccctggtcg

SEQ ID NO: 41565 - DNA, 25 bp, Homo sapien
agttcgaggacggaaagcccactca

SEQ ID NO: 41566 - DNA, 25 bp, Homo sapien
tctccataaagaaggggcaagttcg

SEQ ID NO: 41567 - DNA, 25 bp, Homo sapien
gccaggctttgcaaccatctccata

SEQ ID NO: 41568 - DNA, 25 bp, Homo sapien
ttgcctctaagacgccacgaggagg

SEQ ID NO: 41569 - DNA, 25 bp, Homo sapien
ggatctggatgacgtttgcctctaa

SEQ ID NO: 41570 - DNA, 25 bp, Homo sapien
cagcgcaaagagctcagccactaca

SEQ ID NO: 41571 - DNA, 25 bp, Homo sapien
tggccaggatcccaggcagtaaatt

SEQ ID NO: 41572 - DNA, 25 bp, Homo sapien
acggcttcctgactctagatttgga

SEQ ID NO: 41573 - DNA, 25 bp, Homo sapien
atcggggcggaacttctgcgccctc

SEQ ID NO: 41574 - DNA, 25 bp, Homo sapien
gaggctggacgtttggacactgcaa

SEQ ID NO: 41575 - DNA, 25 bp, Homo sapien
gctggacgtttggacactgcaattc

SEQ ID NO: 41576 - DNA, 25 bp, Homo sapien
gtttggacactgcaattcacctcgg

SEQ ID NO: 41577 - DNA, 25 bp, Homo sapien
cgggaacaacggcttcctgactcta

SEQ ID NO: 41578 - DNA, 25 bp, Homo sapien
ctctagatttggaaagaaactggtc

SEQ ID NO: 41579 - DNA, 25 bp, Homo sapien
ctctccgggaacaacggcttcctga

SEQ ID NO: 41580 - DNA, 25 bp, Homo sapien
cttgcggaaaggaacttgttgctct

SEQ ID NO: 41581 - DNA, 25 bp, Homo sapien
ggtcttgcggaaaggaacttgttgc

SEQ ID NO: 41582 - DNA, 25 bp, Homo sapien
aagaggctctgggtccgccggtggc

SEQ ID NO: 41583 - DNA, 25 bp, Homo sapien
aagggtctggcgacgagtttgacag

SEQ ID NO: 41584 - DNA, 25 bp, Homo sapien
cccagaagggtctggcgacgagttt

SEQ ID NO: 41585 - DNA, 25 bp, Homo sapien
gcagtaccggaatttcgaccccaga

SEQ ID NO: 41586 - DNA, 25 bp, Homo sapien
gaacttgttgctctggaaagcgtgg

SEQ ID NO: 41587 - DNA, 25 bp, Homo sapien
acttgttgctctggaaagcgtgggt

SEQ ID NO: 41588 - DNA, 25 bp, Homo sapien
gagaatgagtaggtgcctgcagcca

SEQ ID NO: 41589 - DNA, 25 bp, Homo sapien
cggtgtgaagccagtgtgaatccat

SEQ ID NO: 41590 - DNA, 25 bp, Homo sapien
gctgtcattctgtcccggtgcttca

SEQ ID NO: 41591 - DNA, 25 bp, Homo sapien
tgtgaatcgccgacacggtctcctg

SEQ ID NO: 41592 - DNA, 25 bp, Homo sapien
ctttcgcacacaacaggctcctgtt

SEQ ID NO: 41593 - DNA, 25 bp, Homo sapien
gggtctctgtcggacctgcgactcc

SEQ ID NO: 41594 - DNA, 25 bp, Homo sapien
cgcggaaagcgtcccggtgcacagc

SEQ ID NO: 41595 - DNA, 25 bp, Homo sapien
gctcctgttctctaggcagtgatta

SEQ ID NO: 41596 - DNA, 25 bp, Homo sapien
acttgcttcggaactcgtcgagcgc

SEQ ID NO: 41597 - DNA, 25 bp, Homo sapien
atggccgccgcttacttgcttcgga

SEQ ID NO: 41598 - DNA, 25 bp, Homo sapien
gagccgatcagcagttgggcgccac

SEQ ID NO: 41599 - DNA, 25 bp, Homo sapien
ggcccatacagctccggggttggaa

SEQ ID NO: 41600 - DNA, 25 bp, Homo sapien
gtactgctccttgcgggtctggaag

SEQ ID NO: 41601 - DNA, 25 bp, Homo sapien
cgcagcccgctaaataaacaccgga

SEQ ID NO: 41602 - DNA, 25 bp, Homo sapien
cctgcatggtagcagcgtgctccca

SEQ ID NO: 41603 - DNA, 25 bp, Homo sapien
tgctgggacgttccagagccgatca

SEQ ID NO: 41604 - DNA, 25 bp, Homo sapien
gacgcaaccgcccattagaaaaaca

SEQ ID NO: 41605 - DNA, 25 bp, Homo sapien
gacctgaaattaacggtgactcaca

SEQ ID NO: 41606 - DNA, 25 bp, Homo sapien
gcaaccgcccattagaaaaacacaa

SEQ ID NO: 41607 - DNA, 25 bp, Homo sapien
ccaaagataaataaatgctccttgt

SEQ ID NO: 41608 - DNA, 25 bp, Homo sapien
aaataaatgctccttgtttttccag

SEQ ID NO: 41609 - DNA, 25 bp, Homo sapien
tttccagacctgaaattaacggtga

SEQ ID NO: 41610 - DNA, 25 bp, Homo sapien
gaaattaacggtgactcacagagca

SEQ ID NO: 41611 - DNA, 25 bp, Homo sapien
tgtttccgacgcaaccgcccattag

SEQ ID NO: 41612 - DNA, 25 bp, Homo sapien
gccgcgtcagctcagcgctgggtct

SEQ ID NO: 41613 - DNA, 25 bp, Homo sapien
aatccggccaccgtccttgttggcg

SEQ ID NO: 41614 - DNA, 25 bp, Homo sapien
cctggccggctggttgcgtagcaac

SEQ ID NO: 41615 - DNA, 25 bp, Homo sapien
aggacggtctgcatactcgctgccc

SEQ ID NO: 41616 - DNA, 25 bp, Homo sapien
aacactttctggtgaggcggaccct

SEQ ID NO: 41617 - DNA, 25 bp, Homo sapien
ccttgcaacaactggctggggtcga

SEQ ID NO: 41618 - DNA, 25 bp, Homo sapien
ctccgagactctggatagccgccgg

SEQ ID NO: 41619 - DNA, 25 bp, Homo sapien
acccgctctgtgaaatccatccggg

SEQ ID NO: 41620 - DNA, 25 bp, Homo sapien
cagaagctcctgcagtctcgtggcg

SEQ ID NO: 41621 - DNA, 25 bp, Homo sapien
gtcttcagaagctcctgcagtctcg

SEQ ID NO: 41622 - DNA, 25 bp, Homo sapien
tgggtcgtcttcagaagctcctgca

SEQ ID NO: 41623 - DNA, 25 bp, Homo sapien
cgctcccagcagcttgacgactccg

SEQ ID NO: 41624 - DNA, 25 bp, Homo sapien
gcagcttgacgactccgcccagctc

SEQ ID NO: 41625 - DNA, 25 bp, Homo sapien
ctgctttggcgccaggcacgcactg

SEQ ID NO: 41626 - DNA, 25 bp, Homo sapien
agctgctcctgggtcgtcttcagaa

SEQ ID NO: 41627 - DNA, 25 bp, Homo sapien
ctcctgggtcgtcttcagaagctcc

SEQ ID NO: 41628 - DNA, 25 bp, Homo sapien
cctctgtccgggagagttgcataga

SEQ ID NO: 41629 - DNA, 25 bp, Homo sapien
ctcgcccgggcatgcaaaagcgcag

SEQ ID NO: 41630 - DNA, 25 bp, Homo sapien
agcggaggaggtagtggcggccaac

SEQ ID NO: 41631 - DNA, 25 bp, Homo sapien
ttgcatagacatggccgggagagag

SEQ ID NO: 41632 - DNA, 25 bp, Homo sapien
tctgtccgggagagttgcatagaca

SEQ ID NO: 41633 - DNA, 25 bp, Homo sapien
ccgggagagttgcatagacatggcc

SEQ ID NO: 41634 - DNA, 25 bp, Homo sapien
gggcatgcaaaagcgcagcggagga

SEQ ID NO: 41635 - DNA, 25 bp, Homo sapien
tccgggagagttgcatagacatggc

SEQ ID NO: 41636 - DNA, 25 bp, Homo sapien
tttcttcgcccaacttcggagcgcg

SEQ ID NO: 41637 - DNA, 25 bp, Homo sapien
ggcccggccaagtttcttacctgca

SEQ ID NO: 41638 - DNA, 25 bp, Homo sapien
gccgccgaggagacgtgtcactcgc

SEQ ID NO: 41639 - DNA, 25 bp, Homo sapien
gtgtggagtcgtggcactttctgcc

SEQ ID NO: 41640 - DNA, 25 bp, Homo sapien
gtccgtgccatggacagacccggtc

SEQ ID NO: 41641 - DNA, 25 bp, Homo sapien
agctgtagacgctgcgaccctgacg

SEQ ID NO: 41642 - DNA, 25 bp, Homo sapien
tttctgcctcagagctggcgaacgg

SEQ ID NO: 41643 - DNA, 25 bp, Homo sapien
agacgtgtcactcgcggcgcagcgc

SEQ ID NO: 41644 - DNA, 25 bp, Homo sapien
gttgttcgcgccttgagagttaagc

SEQ ID NO: 41645 - DNA, 25 bp, Homo sapien
acacttgccgtaggctgggctttta

SEQ ID NO: 41646 - DNA, 25 bp, Homo sapien
actctcccagcaagacgcgtctaga

SEQ ID NO: 41647 - DNA, 25 bp, Homo sapien
agcgctgacgtcaccagatctcgtg

SEQ ID NO: 41648 - DNA, 25 bp, Homo sapien
cgtccatcttggagccgggcaaaga

SEQ ID NO: 41649 - DNA, 25 bp, Homo sapien
aggctgtgcctaattcgaaaccaaa

SEQ ID NO: 41650 - DNA, 25 bp, Homo sapien
gtggcttccaaggtaccgacacttg

SEQ ID NO: 41651 - DNA, 25 bp, Homo sapien
tggacctgctttgccttaggctgtg

SEQ ID NO: 41652 - DNA, 25 bp, Homo sapien
ctccggggagtcctgcaaggacacg

SEQ ID NO: 41653 - DNA, 25 bp, Homo sapien
ggtttcaccatatcaacactgccgc

SEQ ID NO: 41654 - DNA, 25 bp, Homo sapien
gtctgcgcatgctcatacacgttca

SEQ ID NO: 41655 - DNA, 25 bp, Homo sapien
tgctcatacacgttcacacccgaga

SEQ ID NO: 41656 - DNA, 25 bp, Homo sapien
cctctcaggggatcccgaggcggct

SEQ ID NO: 41657 - DNA, 25 bp, Homo sapien
gcctcgtcttgctcgcggattatgt

SEQ ID NO: 41658 - DNA, 25 bp, Homo sapien
cgcggattatgtgcacgcccgcagt

SEQ ID NO: 41659 - DNA, 25 bp, Homo sapien
ggaagcaaatgcgacccggtttcac

SEQ ID NO: 41660 - DNA, 25 bp, Homo sapien
gggcagagtcgacacagtaccttga

SEQ ID NO: 41661 - DNA, 25 bp, Homo sapien
ggcacctcgccaagtgggcaacgtc

SEQ ID NO: 41662 - DNA, 25 bp, Homo sapien
cgaatcggcccacagagctagcttg

SEQ ID NO: 41663 - DNA, 25 bp, Homo sapien
gggtagcctctgctggctttcaatc

SEQ ID NO: 41664 - DNA, 25 bp, Homo sapien
tgcccttttctcatccgggagctca

SEQ ID NO: 41665 - DNA, 25 bp, Homo sapien
tgccgatgagcagagaagacccgcc

SEQ ID NO: 41666 - DNA, 25 bp, Homo sapien
ccgggcaattagaggctcccactac

SEQ ID NO: 41667 - DNA, 25 bp, Homo sapien
accttgattttcgatctggcgaccg

SEQ ID NO: 41668 - DNA, 25 bp, Homo sapien
caaccgcctggtaacggatttctcg

SEQ ID NO: 41669 - DNA, 25 bp, Homo sapien
taacggatttctcggcgctactggc

SEQ ID NO: 41670 - DNA, 25 bp, Homo sapien
aggacaaccggcacagcctcttgtg

SEQ ID NO: 41671 - DNA, 25 bp, Homo sapien
acagcctcttgtgtcgctgcggtcg

SEQ ID NO: 41672 - DNA, 25 bp, Homo sapien
tcctccaggaggtcgtcagacgtgt

SEQ ID NO: 41673 - DNA, 25 bp, Homo sapien
atggcccttggggacacaaccgcct

SEQ ID NO: 41674 - DNA, 25 bp, Homo sapien
tcccaaggccttgttcgggtgcgcc

SEQ ID NO: 41675 - DNA, 25 bp, Homo sapien
ggaatcaacacagcggttttccctg

SEQ ID NO: 41676 - DNA, 25 bp, Homo sapien
ccgctctatgctcggctctcgattg

SEQ ID NO: 41677 - DNA, 25 bp, Homo sapien
ctgaactgactgaggggcatggaac

SEQ ID NO: 41678 - DNA, 25 bp, Homo sapien
gcgtttaataatgggtcctcaggca

SEQ ID NO: 41679 - DNA, 25 bp, Homo sapien
ttgggcgaagcttctggatcagtca

SEQ ID NO: 41680 - DNA, 25 bp, Homo sapien
cgcgcctctgaagctgcctaacgag

SEQ ID NO: 41681 - DNA, 25 bp, Homo sapien
tgtgcagcccgcagattcaggacga

SEQ ID NO: 41682 - DNA, 25 bp, Homo sapien
caggtgaccgcgactacagcgttta

SEQ ID NO: 41683 - DNA, 25 bp, Homo sapien
gtcggtgtcacgtgaccgtctcttc

SEQ ID NO: 41684 - DNA, 25 bp, Homo sapien
tgggctcagaatcgggtctacctcg

SEQ ID NO: 41685 - DNA, 25 bp, Homo sapien
ttctgcgcgaaaaggaaggtcccga

SEQ ID NO: 41686 - DNA, 25 bp, Homo sapien
tgaccggagcgtgttactcagaaac

SEQ ID NO: 41687 - DNA, 25 bp, Homo sapien
tgccacagtggccattctccggtga

SEQ ID NO: 41688 - DNA, 25 bp, Homo sapien
cgggagctcctacgtgttttatgca

SEQ ID NO: 41689 - DNA, 25 bp, Homo sapien
gaaacgtcatttccgcgcgccaagg

SEQ ID NO: 41690 - DNA, 25 bp, Homo sapien
acctcgtacgggatgtgagacttca

SEQ ID NO: 41691 - DNA, 25 bp, Homo sapien
tacgacatgacgttcgcccggtgtt

SEQ ID NO: 41692 - DNA, 25 bp, Homo sapien
tccttcacagagttgccaagtgcta

SEQ ID NO: 41693 - DNA, 25 bp, Homo sapien
gcagagcgctatcctccactggttc

SEQ ID NO: 41694 - DNA, 25 bp, Homo sapien
ccgtttggttgttcccgcccatcag

SEQ ID NO: 41695 - DNA, 25 bp, Homo sapien
aaggacacctgcatcctttcggctg

SEQ ID NO: 41696 - DNA, 25 bp, Homo sapien
tggagactcagcttcttagcaacta

SEQ ID NO: 41697 - DNA, 25 bp, Homo sapien
gttcctttcccagtgctttcccata

SEQ ID NO: 41698 - DNA, 25 bp, Homo sapien
gcgtccgatgggcattgacattctg

SEQ ID NO: 41699 - DNA, 25 bp, Homo sapien
gacgcggatccggtcgaaatagaaa

SEQ ID NO: 41700 - DNA, 25 bp, Homo sapien
gtccagcggagctgagcccagcctg

SEQ ID NO: 41701 - DNA, 25 bp, Homo sapien
ctccaggctgacttcacggagcagc

SEQ ID NO: 41702 - DNA, 25 bp, Homo sapien
agcagcggcgttgggcgcttacctt

SEQ ID NO: 41703 - DNA, 25 bp, Homo sapien
ccagccataccagccgtgggtggtc

SEQ ID NO: 41704 - DNA, 25 bp, Homo sapien
taccagccgtgggtggtcacatccc

SEQ ID NO: 41705 - DNA, 25 bp, Homo sapien
gttcccgggaacaatcactgccttg

SEQ ID NO: 41706 - DNA, 25 bp, Homo sapien
cactgccttgctaggagaagccatg

SEQ ID NO: 41707 - DNA, 25 bp, Homo sapien
agaagccatgagtgcagcgaggcca

SEQ ID NO: 41708 - DNA, 25 bp, Homo sapien
ctggagttcctgtaaaccacgtgaa

SEQ ID NO: 41709 - DNA, 25 bp, Homo sapien
tcggccgaggcttcaagagtgtcct

SEQ ID NO: 41710 - DNA, 25 bp, Homo sapien
gaccaagatctatggggacgtcaga

SEQ ID NO: 41711 - DNA, 25 bp, Homo sapien
tggggttggctccatgaccaagatc

SEQ ID NO: 41712 - DNA, 25 bp, Homo sapien
actggttctacacacgagccggttc

SEQ ID NO: 41713 - DNA, 25 bp, Homo sapien
tcctccctacgttgagaactggttc

SEQ ID NO: 41714 - DNA, 25 bp, Homo sapien
ctttctcaaaaagtccgggaagctg

SEQ ID NO: 41715 - DNA, 25 bp, Homo sapien
accacgtgaaccagcgggacttcgt

SEQ ID NO: 41716 - DNA, 25 bp, Homo sapien
gccttcttccggcagccttagtttc

SEQ ID NO: 41717 - DNA, 25 bp, Homo sapien
gaggaggccttttcttgacagttta

SEQ ID NO: 41718 - DNA, 25 bp, Homo sapien
ctctcgttttgaagtgcgacataca

SEQ ID NO: 41719 - DNA, 25 bp, Homo sapien
gtcatattgtatcagggcgaacctc

SEQ ID NO: 41720 - DNA, 25 bp, Homo sapien
ttcccactgagacgagcggatgtca

SEQ ID NO: 41721 - DNA, 25 bp, Homo sapien
cgctttccggtagctaaggcgatca

SEQ ID NO: 41722 - DNA, 25 bp, Homo sapien
gttccgcgagcatacgtcatcgttc

SEQ ID NO: 41723 - DNA, 25 bp, Homo sapien
gcgctctttgattggccagtggaca

SEQ ID NO: 41724 - DNA, 25 bp, Homo sapien
ccgcctcgcagtgcttgtggaggta

SEQ ID NO: 41725 - DNA, 25 bp, Homo sapien
aagtagcgcgccgacaggctcgact

SEQ ID NO: 41726 - DNA, 25 bp, Homo sapien
tccatggagtagctgtcggtcactg

SEQ ID NO: 41727 - DNA, 25 bp, Homo sapien
cacgtcgggcatttgcgcgccagct

SEQ ID NO: 41728 - DNA, 25 bp, Homo sapien
cgggcatggacacgtaggccttgcc

SEQ ID NO: 41729 - DNA, 25 bp, Homo sapien
tgcgcgcagccgaacggcttttcgc

SEQ ID NO: 41730 - DNA, 25 bp, Homo sapien
agctcttgtcgcactggcggcagcg

SEQ ID NO: 41731 - DNA, 25 bp, Homo sapien
gcttctggtccgcatcgtagctgct

SEQ ID NO: 41732 - DNA, 25 bp, Homo sapien
cggctccttaatggttccggcggca

SEQ ID NO: 41733 - DNA, 25 bp, Homo sapien
gcgaagtcgtcaggtagggctcttc

SEQ ID NO: 41734 - DNA, 25 bp, Homo sapien
gacgctgaaaactggcggctcctta

SEQ ID NO: 41735 - DNA, 25 bp, Homo sapien
gtgttgggctcactgctttactata

SEQ ID NO: 41736 - DNA, 25 bp, Homo sapien
gacacctgagcgactttccgggcca

SEQ ID NO: 41737 - DNA, 25 bp, Homo sapien
cgaaatgagttcacggcctggtacc

SEQ ID NO: 41738 - DNA, 25 bp, Homo sapien
ctggcgtacccatgtatcgaaatga

SEQ ID NO: 41739 - DNA, 25 bp, Homo sapien
ggtaaaaagtatcgcacgcccacag

SEQ ID NO: 41740 - DNA, 25 bp, Homo sapien
agcaggcttttatctggcccgaggc

SEQ ID NO: 41741 - DNA, 25 bp, Homo sapien
gccagtgccatctcagccggagcag

SEQ ID NO: 41742 - DNA, 25 bp, Homo sapien
tgaggcggttaccttagtactccga

SEQ ID NO: 41743 - DNA, 25 bp, Homo sapien
atgacgatacctcgggcgctcgaaa

SEQ ID NO: 41744 - DNA, 25 bp, Homo sapien
cgttggtccaggaacgacagtccca

SEQ ID NO: 41745 - DNA, 25 bp, Homo sapien
tttaggaagtctcggcgttggtcca

SEQ ID NO: 41746 - DNA, 25 bp, Homo sapien
ttattgggactctcggctgcagaca

SEQ ID NO: 41747 - DNA, 25 bp, Homo sapien
tcagcgcgtcttcccataacctata

SEQ ID NO: 41748 - DNA, 25 bp, Homo sapien
ccgccgccatgaaggccgtggtgca

SEQ ID NO: 41749 - DNA, 25 bp, Homo sapien
caggcataggcggagtcaatctatg

SEQ ID NO: 41750 - DNA, 25 bp, Homo sapien
caatctatgagtgggtgggcctatc

SEQ ID NO: 41751 - DNA, 25 bp, Homo sapien
gggactgggcttttcaatgacgggc

SEQ ID NO: 41752 - DNA, 25 bp, Homo sapien
tagcagccgaccgagtcggaccggc

SEQ ID NO: 41753 - DNA, 25 bp, Homo sapien
tgcggagccgccctcagagtcgcga

SEQ ID NO: 41754 - DNA, 25 bp, Homo sapien
cctcagagtcgcgaggccggacgca

SEQ ID NO: 41755 - DNA, 25 bp, Homo sapien
acccgggccagcgtcacaggtcagt

SEQ ID NO: 41756 - DNA, 25 bp, Homo sapien
tctggtcgctgtcgagcctgcgaga

SEQ ID NO: 41757 - DNA, 25 bp, Homo sapien
tgctgctctggtcgctgtcgagcct

SEQ ID NO: 41758 - DNA, 25 bp, Homo sapien
gccggagggaccttctgctgagcca

SEQ ID NO: 41759 - DNA, 25 bp, Homo sapien
tggctttgccaaccggcggagttgg

SEQ ID NO: 41760 - DNA, 25 bp, Homo sapien
ccgaccatggaataggcgggcggcc

SEQ ID NO: 41761 - DNA, 25 bp, Homo sapien
gagctgcgctagctcatgctcccag

SEQ ID NO: 41762 - DNA, 25 bp, Homo sapien
ccctggcacagaagggttgaaggac

SEQ ID NO: 41763 - DNA, 25 bp, Homo sapien
aagggtgagtgcacgctgcctgccc

SEQ ID NO: 41764 - DNA, 25 bp, Homo sapien
ttccttgtaacagggtaagcgtagc

SEQ ID NO: 41765 - DNA, 25 bp, Homo sapien
ggacctttgaggagttctacctgca

SEQ ID NO: 41766 - DNA, 25 bp, Homo sapien
acaaggggcagagtgacattccgga

SEQ ID NO: 41767 - DNA, 25 bp, Homo sapien
catctcctctgcgagctcaggaagg

SEQ ID NO: 41768 - DNA, 25 bp, Homo sapien
gcagtttttcctggttgcagcctgg

SEQ ID NO: 41769 - DNA, 25 bp, Homo sapien
gccaagtttgctccggcttagataa

SEQ ID NO: 41770 - DNA, 25 bp, Homo sapien
gaacaaaactctggtcctcgcctgg

SEQ ID NO: 41771 - DNA, 25 bp, Homo sapien
tgcccgcacctagagagcccggaga

SEQ ID NO: 41772 - DNA, 25 bp, Homo sapien
gttcgaccggagcatgcctctgttt

SEQ ID NO: 41773 - DNA, 25 bp, Homo sapien
gctctgcctggaacgaaaccaactc

SEQ ID NO: 41774 - DNA, 25 bp, Homo sapien
tgagcgacatgagcatttctacttc

SEQ ID NO: 41775 - DNA, 25 bp, Homo sapien
aaacatgggaacgtagctctgcctg

SEQ ID NO: 41776 - DNA, 25 bp, Homo sapien
tggccaggactgaaacccagacgag

SEQ ID NO: 41777 - DNA, 25 bp, Homo sapien
ttaatagtctccacacaagccctcg

SEQ ID NO: 41778 - DNA, 25 bp, Homo sapien
acaaggactcccaacgcgaatggca

SEQ ID NO: 41779 - DNA, 25 bp, Homo sapien
cccagacgagcatgccagaaacagt

SEQ ID NO: 41780 - DNA, 25 bp, Homo sapien
ccttacaggagcgacctggcaattc

SEQ ID NO: 41781 - DNA, 25 bp, Homo sapien
gggtttccgcatcaccagcagcttc

SEQ ID NO: 41782 - DNA, 25 bp, Homo sapien
aactttgtctctggaccctgcgagc

SEQ ID NO: 41783 - DNA, 25 bp, Homo sapien
gttgcccagcaactcgtagcccgga

SEQ ID NO: 41784 - DNA, 25 bp, Homo sapien
gcgatgaccacgctacgggccttta

SEQ ID NO: 41785 - DNA, 25 bp, Homo sapien
gttccgcttcaacaacatgtgagtg

SEQ ID NO: 41786 - DNA, 25 bp, Homo sapien
ttggccgaggtgctcaaactttgtc

SEQ ID NO: 41787 - DNA, 25 bp, Homo sapien
tgcgaactccgctcttctgcttggg

SEQ ID NO: 41788 - DNA, 25 bp, Homo sapien
gactgacctttgacctctcgcttga

SEQ ID NO: 41789 - DNA, 25 bp, Homo sapien
cagcctccggaactgggatgaccag

SEQ ID NO: 41790 - DNA, 25 bp, Homo sapien
aggcggcaccgtttccatggtgacc

SEQ ID NO: 41791 - DNA, 25 bp, Homo sapien
agcggaacttgcaggactgaccttt

SEQ ID NO: 41792 - DNA, 25 bp, Homo sapien
tctccatctctcagggtgagccttc

SEQ ID NO: 41793 - DNA, 25 bp, Homo sapien
cacggacgctagaaatcggctctga

SEQ ID NO: 41794 - DNA, 25 bp, Homo sapien
cttggccactttgggaatccgctgc

SEQ ID NO: 41795 - DNA, 25 bp, Homo sapien
agcagtcgacctctggacacctgtc

SEQ ID NO: 41796 - DNA, 25 bp, Homo sapien
gcagcacaaatgctcgcgcatcgtg

SEQ ID NO: 41797 - DNA, 25 bp, Homo sapien
gtgccttcgcttggagacccacaaa

SEQ ID NO: 41798 - DNA, 25 bp, Homo sapien
tccgaaaacagacaggtgatcctcc

SEQ ID NO: 41799 - DNA, 25 bp, Homo sapien
ggccttacgcggcacatcaacaagt

SEQ ID NO: 41800 - DNA, 25 bp, Homo sapien
gccgaggacctactggccttgtacc

SEQ ID NO: 41801 - DNA, 25 bp, Homo sapien
agtgccatcactgcgccaagaagtt

SEQ ID NO: 41802 - DNA, 25 bp, Homo sapien
ggtgaaagtgtcgtctccgcttctc

SEQ ID NO: 41803 - DNA, 25 bp, Homo sapien
acgggctctacgagtgccatcactg

SEQ ID NO: 41804 - DNA, 25 bp, Homo sapien
cactgcagcggtaacgcacggttcc

SEQ ID NO: 41805 - DNA, 25 bp, Homo sapien
gtcgccgcagcctttctggtcagtt

SEQ ID NO: 41806 - DNA, 25 bp, Homo sapien
cagtttcgctgggttttgtcagttc

SEQ ID NO: 41807 - DNA, 25 bp, Homo sapien
tcagttccgtttgagaccgaggcgc

SEQ ID NO: 41808 - DNA, 25 bp, Homo sapien
aatgtcatcccgatgggtcccgtgc

SEQ ID NO: 41809 - DNA, 25 bp, Homo sapien
gttatgactttctcaccttctgggc

SEQ ID NO: 41810 - DNA, 25 bp, Homo sapien
ggaaatacttgagcgcggtccctcc

SEQ ID NO: 41811 - DNA, 25 bp, Homo sapien
cagctttatgctaatgcgccgaaca

SEQ ID NO: 41812 - DNA, 25 bp, Homo sapien
gcttcggccaactcgacccggatta

SEQ ID NO: 41813 - DNA, 25 bp, Homo sapien
tcagcctgcctcagagtacagattg

SEQ ID NO: 41814 - DNA, 25 bp, Homo sapien
agcacgcgtctcttttgcgtccaga

SEQ ID NO: 41815 - DNA, 25 bp, Homo sapien
cgccttgattggagcccttgattta

SEQ ID NO: 41816 - DNA, 25 bp, Homo sapien
tgcccgctcggaatgaaaatgcatg

SEQ ID NO: 41817 - DNA, 25 bp, Homo sapien
ggccgtgccaattccttctcaaact

SEQ ID NO: 41818 - DNA, 25 bp, Homo sapien
actacgcactcgtggggttctctgc

SEQ ID NO: 41819 - DNA, 25 bp, Homo sapien
ggggaatcttcgctgttgtctcttc

SEQ ID NO: 41820 - DNA, 25 bp, Homo sapien
acaggaacccagtgagctgaacaca

SEQ ID NO: 41821 - DNA, 25 bp, Homo sapien
agcctggcgacaatgccggccttca

SEQ ID NO: 41822 - DNA, 25 bp, Homo sapien
ctagcaagcggcaacggcccagcga

SEQ ID NO: 41823 - DNA, 25 bp, Homo sapien
cagcaggaacagctggtaagctagc

SEQ ID NO: 41824 - DNA, 25 bp, Homo sapien
tgagctgaacacatccgacattgta

SEQ ID NO: 41825 - DNA, 25 bp, Homo sapien
gctggtaagctagcaagcggcaacg

SEQ ID NO: 41826 - DNA, 25 bp, Homo sapien
cgacattgtacggagcagcaggaac

SEQ ID NO: 41827 - DNA, 25 bp, Homo sapien
cgtggatgctaatgagcctggcgac

SEQ ID NO: 41828 - DNA, 25 bp, Homo sapien
gtcagcacgtccttcttcgggtcca

SEQ ID NO: 41829 - DNA, 25 bp, Homo sapien
caggctgcggctttctggaaacaaa

SEQ ID NO: 41830 - DNA, 25 bp, Homo sapien
cccgtggctccttcgggagaacatc

SEQ ID NO: 41831 - DNA, 25 bp, Homo sapien
cctgcgccacgcgaatcaaagcata

SEQ ID NO: 41832 - DNA, 25 bp, Homo sapien
gccgaactctcctggcgggacacta

SEQ ID NO: 41833 - DNA, 25 bp, Homo sapien
cgttgtactacaagtcccgagatgc

SEQ ID NO: 41834 - DNA, 25 bp, Homo sapien
ggccgcaagtgctcctgggaaatga

SEQ ID NO: 41835 - DNA, 25 bp, Homo sapien
acctcttttccagggtcgcagaagc

SEQ ID NO: 41836 - DNA, 25 bp, Homo sapien
ccaggcagcacgtaggctgtctcca

SEQ ID NO: 41837 - DNA, 25 bp, Homo sapien
aatggaaccgctcggcgctctaatc

SEQ ID NO: 41838 - DNA, 25 bp, Homo sapien
tcggcgctctaatccatcaaatgtc

SEQ ID NO: 41839 - DNA, 25 bp, Homo sapien
gccggctttatatgggacgcaggct

SEQ ID NO: 41840 - DNA, 25 bp, Homo sapien
ctttgatcttctttaccaggaagga

SEQ ID NO: 41841 - DNA, 25 bp, Homo sapien
gagcccacggccagagagatctcct

SEQ ID NO: 41842 - DNA, 25 bp, Homo sapien
cagcactccggctgccggctttata

SEQ ID NO: 41843 - DNA, 25 bp, Homo sapien
gtccgcgcgggttttcagcactgga

SEQ ID NO: 41844 - DNA, 25 bp, Homo sapien
cctgcgctcccagaaggtgagagta

SEQ ID NO: 41845 - DNA, 25 bp, Homo sapien
gcgcccgcctcggaggttgataacc

SEQ ID NO: 41846 - DNA, 25 bp, Homo sapien
cttaggtaccggtcaggcaaaatgc

SEQ ID NO: 41847 - DNA, 25 bp, Homo sapien
tcctccgtcgactcagccttaggta

SEQ ID NO: 41848 - DNA, 25 bp, Homo sapien
cgtcacaccggacagcgtcgagatt

SEQ ID NO: 41849 - DNA, 25 bp, Homo sapien
tgagtgtgacttccagccctccagc

SEQ ID NO: 41850 - DNA, 25 bp, Homo sapien
taccgagattagtcatgcagggccg

SEQ ID NO: 41851 - DNA, 25 bp, Homo sapien
gagcccatggctttttaggacagga

SEQ ID NO: 41852 - DNA, 25 bp, Homo sapien
tacggggtgttccatcaaatatttc

SEQ ID NO: 41853 - DNA, 25 bp, Homo sapien
agccagtccatctaattacggggtg

SEQ ID NO: 41854 - DNA, 25 bp, Homo sapien
ggacgtgcctgtctccaatactgca

SEQ ID NO: 41855 - DNA, 25 bp, Homo sapien
tgggacgaggctgcaaaccttcaga

SEQ ID NO: 41856 - DNA, 25 bp, Homo sapien
ccttgttagactacacgcgcggtgg

SEQ ID NO: 41857 - DNA, 25 bp, Homo sapien
tcgagttttcatcctgtccgccttg

SEQ ID NO: 41858 - DNA, 25 bp, Homo sapien
tcatttgctccgttgcctgtcgaaa

SEQ ID NO: 41859 - DNA, 25 bp, Homo sapien
tttctccagatgcttccgatgcagc

SEQ ID NO: 41860 - DNA, 25 bp, Homo sapien
aacaccagggctttgtctgagcttg

SEQ ID NO: 41861 - DNA, 25 bp, Homo sapien
cagctaactttggagccgggcaaga

SEQ ID NO: 41862 - DNA, 25 bp, Homo sapien
gactcaagacttcacccagcgctgg

SEQ ID NO: 41863 - DNA, 25 bp, Homo sapien
ccagcgctggaggtcgaccttaatt

SEQ ID NO: 41864 - DNA, 25 bp, Homo sapien
acaggaggtttccaagtctttcatc

SEQ ID NO: 41865 - DNA, 25 bp, Homo sapien
cagcgggcaaacaaggagatttatc

SEQ ID NO: 41866 - DNA, 25 bp, Homo sapien
tccatcggaggagaacacggttaca

SEQ ID NO: 41867 - DNA, 25 bp, Homo sapien
cctcggcagcccgatgatgtcgcta

SEQ ID NO: 41868 - DNA, 25 bp, Homo sapien
acgcgccaacgctgcaagcaatgtg

SEQ ID NO: 41869 - DNA, 25 bp, Homo sapien
ggaagccctgactcccggcttggcg

SEQ ID NO: 41870 - DNA, 25 bp, Homo sapien
gctcctccttctgtcagcagctgga

SEQ ID NO: 41871 - DNA, 25 bp, Homo sapien
tctgtcagcagctggacccggaagc

SEQ ID NO: 41872 - DNA, 25 bp, Homo sapien
cggaggcgctgtccaaacgcgccaa

SEQ ID NO: 41873 - DNA, 25 bp, Homo sapien
tgcaagcaatgtggcagggcacacc

SEQ ID NO: 41874 - DNA, 25 bp, Homo sapien
cagggcacaccgaaatgcgtgtctc

SEQ ID NO: 41875 - DNA, 25 bp, Homo sapien
ctctggactcggtgctgaagcccca

SEQ ID NO: 41876 - DNA, 25 bp, Homo sapien
cctcagtttagatcgggttttcgcg

SEQ ID NO: 41877 - DNA, 25 bp, Homo sapien
gcctagagttttgcgggcgtctctc

SEQ ID NO: 41878 - DNA, 25 bp, Homo sapien
gtctccgaatcctagggactctcta

SEQ ID NO: 41879 - DNA, 25 bp, Homo sapien
acaaatcttcccttgcctgaggcca

SEQ ID NO: 41880 - DNA, 25 bp, Homo sapien
tgaggccattttccagccttccacg

SEQ ID NO: 41881 - DNA, 25 bp, Homo sapien
tcacgcgagttattgggactgaaca

SEQ ID NO: 41882 - DNA, 25 bp, Homo sapien
cccactgaccttgggaaggcgcaga

SEQ ID NO: 41883 - DNA, 25 bp, Homo sapien
ctttgccggggaaagagtcgatgac

SEQ ID NO: 41884 - DNA, 25 bp, Homo sapien
gagtcccgactactacgagaggctg

SEQ ID NO: 41885 - DNA, 25 bp, Homo sapien
gcggcagcagcatgagccggaccct

SEQ ID NO: 41886 - DNA, 25 bp, Homo sapien
ctgtcgagtcccgactactacgaga

SEQ ID NO: 41887 - DNA, 25 bp, Homo sapien
cgactactacgagaggctgggccaa

SEQ ID NO: 41888 - DNA, 25 bp, Homo sapien
actactacgagaggctgggccaact

SEQ ID NO: 41889 - DNA, 25 bp, Homo sapien
tgggccaactccagcacgggctgcg

SEQ ID NO: 41890 - DNA, 25 bp, Homo sapien
gcgcggtgtttacccgcggtgcatg

SEQ ID NO: 41891 - DNA, 25 bp, Homo sapien
agcatgagccggaccctcgcatcgg

SEQ ID NO: 41892 - DNA, 25 bp, Homo sapien
cgctgctcccgtctctttggttacg

SEQ ID NO: 41893 - DNA, 25 bp, Homo sapien
ttcctctccagaccgcgcattttgg

SEQ ID NO: 41894 - DNA, 25 bp, Homo sapien
gcagagcgcagcgattctgtgccca

SEQ ID NO: 41895 - DNA, 25 bp, Homo sapien
tctttggttacgctcgtcagccggt

SEQ ID NO: 41896 - DNA, 25 bp, Homo sapien
tcatagtcaactgcgtggaagagaa

SEQ ID NO: 41897 - DNA, 25 bp, Homo sapien
cgcaagtacccgtccatcatagtca

SEQ ID NO: 41898 - DNA, 25 bp, Homo sapien
gggcctatagggttccgaactcgca

SEQ ID NO: 41899 - DNA, 25 bp, Homo sapien
gaattcaggaccctcggcggggcaa

SEQ ID NO: 41900 - DNA, 25 bp, Homo sapien
tttcgtacgatgacgtgggatgcca

SEQ ID NO: 41901 - DNA, 25 bp, Homo sapien
ggctcaactttctcccagcggggtc

SEQ ID NO: 41902 - DNA, 25 bp, Homo sapien
gtcctaggtgcttggctcaactttc

SEQ ID NO: 41903 - DNA, 25 bp, Homo sapien
ctcaggtcctaggtgcttggctcaa

SEQ ID NO: 41904 - DNA, 25 bp, Homo sapien
tgctactcagagctcaggtcctagg

SEQ ID NO: 41905 - DNA, 25 bp, Homo sapien
gcgcctggaccgaactgaagggccc

SEQ ID NO: 41906 - DNA, 25 bp, Homo sapien
cgataggttaattttcgtacgatga

SEQ ID NO: 41907 - DNA, 25 bp, Homo sapien
cccgcgtgctactcagagctcaggt

SEQ ID NO: 41908 - DNA, 25 bp, Homo sapien
cccaggacctcctaagccgcgcgca

SEQ ID NO: 41909 - DNA, 25 bp, Homo sapien
cagtagctgcccatggcgccgtgcg

SEQ ID NO: 41910 - DNA, 25 bp, Homo sapien
ggccgccgttgcagtagctgcccat

SEQ ID NO: 41911 - DNA, 25 bp, Homo sapien
tgccgtttcatcttgtaccggtggt

SEQ ID NO: 41912 - DNA, 25 bp, Homo sapien
catgccggccacattcacgcccgcc

SEQ ID NO: 41913 - DNA, 25 bp, Homo sapien
cttgtccttggcctgccgtttcatc

SEQ ID NO: 41914 - DNA, 25 bp, Homo sapien
tcacttgacgagtagcgtgggtccg

SEQ ID NO: 41915 - DNA, 25 bp, Homo sapien
ccctctcacttgacgagtagcgtgg

SEQ ID NO: 41916 - DNA, 25 bp, Homo sapien
tagattggctacctgatgctcgttc

SEQ ID NO: 41917 - DNA, 25 bp, Homo sapien
cgcgctccacgtttccaggttaagt

SEQ ID NO: 41918 - DNA, 25 bp, Homo sapien
gccactctcggctctgggaactgaa

SEQ ID NO: 41919 - DNA, 25 bp, Homo sapien
gaactgaactttcccgggacttgca

SEQ ID NO: 41920 - DNA, 25 bp, Homo sapien
ggggtccaggtctagtcttcccaca

SEQ ID NO: 41921 - DNA, 25 bp, Homo sapien
tcggacccgggcaaacacaaataca

SEQ ID NO: 41922 - DNA, 25 bp, Homo sapien
gtagacaaatgtcccgctcccgttg

SEQ ID NO: 41923 - DNA, 25 bp, Homo sapien
tctcccacgcgagttctttagtgtg

SEQ ID NO: 41924 - DNA, 25 bp, Homo sapien
gtttggagccacgatgcctttgatg

SEQ ID NO: 41925 - DNA, 25 bp, Homo sapien
gtggtctgtgcccaaacacgatgga

SEQ ID NO: 41926 - DNA, 25 bp, Homo sapien
ggacacctttgcaccctagccgagg

SEQ ID NO: 41927 - DNA, 25 bp, Homo sapien
ggcggttccacccaacaatcaacga

SEQ ID NO: 41928 - DNA, 25 bp, Homo sapien
cggcccaccgacagctggttttgaa

SEQ ID NO: 41929 - DNA, 25 bp, Homo sapien
aagcctgggtactgcagacgccctc

SEQ ID NO: 41930 - DNA, 25 bp, Homo sapien
ggagacatctcgagtcccgcaggtg

SEQ ID NO: 41931 - DNA, 25 bp, Homo sapien
gctggaactgcaggccctacttttg

SEQ ID NO: 41932 - DNA, 25 bp, Homo sapien
ttgcggctcccgaagtcacttttcc

SEQ ID NO: 41933 - DNA, 25 bp, Homo sapien
gcttcctggggccaaagatcctagg

SEQ ID NO: 41934 - DNA, 25 bp, Homo sapien
cttagcggtctcctaggtcagcacc

SEQ ID NO: 41935 - DNA, 25 bp, Homo sapien
aaccgcgccgaatagctgagctcca

SEQ ID NO: 41936 - DNA, 25 bp, Homo sapien
gcaccagcccgcagattttgaaaag

SEQ ID NO: 41937 - DNA, 25 bp, Homo sapien
ctgggattgccaaagattctcgctc

SEQ ID NO: 41938 - DNA, 25 bp, Homo sapien
tctcaggctgaaggagccactcata

SEQ ID NO: 41939 - DNA, 25 bp, Homo sapien
catcgagtgtagtggcttcaacagc

SEQ ID NO: 41940 - DNA, 25 bp, Homo sapien
tttccctgaccgcaccggaaagtgc

SEQ ID NO: 41941 - DNA, 25 bp, Homo sapien
gttcaccggaaacgcgtgcgagctg

SEQ ID NO: 41942 - DNA, 25 bp, Homo sapien
ggccgctctttatcccgagtcgcgg

SEQ ID NO: 41943 - DNA, 25 bp, Homo sapien
cgccgcatttcaaggcgcgtcttta

SEQ ID NO: 41944 - DNA, 25 bp, Homo sapien
tcctgccgtgatccgcaaagtcggg

SEQ ID NO: 41945 - DNA, 25 bp, Homo sapien
ttttcctgactgcaggcgcgacaga

SEQ ID NO: 41946 - DNA, 25 bp, Homo sapien
gcaggaggaccagacagtcagcgcc

SEQ ID NO: 41947 - DNA, 25 bp, Homo sapien
cggctggtaaaacttttcctgactg

SEQ ID NO: 41948 - DNA, 25 bp, Homo sapien
tgtgacaacgtagagcgcgtgctga

SEQ ID NO: 41949 - DNA, 25 bp, Homo sapien
ctatgtgcaggtacgtgcagcacta

SEQ ID NO: 41950 - DNA, 25 bp, Homo sapien
aggtacgtgcagcactacggcctgg

SEQ ID NO: 41951 - DNA, 25 bp, Homo sapien
tgggcagtgcctgtgacaacgtaga

SEQ ID NO: 41952 - DNA, 25 bp, Homo sapien
tgcctgtgacaacgtagagcgcgtg

SEQ ID NO: 41953 - DNA, 25 bp, Homo sapien
cagaaggtgaaggtgctcacgggca

SEQ ID NO: 41954 - DNA, 25 bp, Homo sapien
tgcagcctatgtgcaggtacgtgca

SEQ ID NO: 41955 - DNA, 25 bp, Homo sapien
tgctgaagagtgtggctgtgaagct

SEQ ID NO: 41956 - DNA, 25 bp, Homo sapien
gctctggtttacttagggcgaatca

SEQ ID NO: 41957 - DNA, 25 bp, Homo sapien
agggcgaatcacaagtgggctttca

SEQ ID NO: 41958 - DNA, 25 bp, Homo sapien
acctcagttcggttgggtagcagcg

SEQ ID NO: 41959 - DNA, 25 bp, Homo sapien
tcagcctttggaccgacctcagttc

SEQ ID NO: 41960 - DNA, 25 bp, Homo sapien
ctcattagcttacgcctagcgcggc

SEQ ID NO: 41961 - DNA, 25 bp, Homo sapien
gttggctcgtcacccttcgttacgc

SEQ ID NO: 41962 - DNA, 25 bp, Homo sapien
cgttccagcccacggggctctggtt

SEQ ID NO: 41963 - DNA, 25 bp, Homo sapien
ttacgccctccgattggtcggtgcc

SEQ ID NO: 41964 - DNA, 25 bp, Homo sapien
cccgcgccgacaacttgattgggca

SEQ ID NO: 41965 - DNA, 25 bp, Homo sapien
cggtccatctgtttgagcttcacaa

SEQ ID NO: 41966 - DNA, 25 bp, Homo sapien
cccgcctttgattgtggtgagcagc

SEQ ID NO: 41967 - DNA, 25 bp, Homo sapien
gcgagtcgcggagcaaattaacttt

SEQ ID NO: 41968 - DNA, 25 bp, Homo sapien
ttcgcacacttcattatgcgccgtc

SEQ ID NO: 41969 - DNA, 25 bp, Homo sapien
tgattgggcaattaatcttcgcgcc

SEQ ID NO: 41970 - DNA, 25 bp, Homo sapien
ccgcccggtctgctggcgcagataa

SEQ ID NO: 41971 - DNA, 25 bp, Homo sapien
cccttggctcggtccatctgtttga

SEQ ID NO: 41972 - DNA, 25 bp, Homo sapien
acctttcttggtatctcgcgcccga

SEQ ID NO: 41973 - DNA, 25 bp, Homo sapien
ggttttccctatgcccgaccgtgca

SEQ ID NO: 41974 - DNA, 25 bp, Homo sapien
ccacttttccaagctcggcagcaga

SEQ ID NO: 41975 - DNA, 25 bp, Homo sapien
gggcgaaccagctctcacggtgtca

SEQ ID NO: 41976 - DNA, 25 bp, Homo sapien
cacggtgtcacgaccggctttattt

SEQ ID NO: 41977 - DNA, 25 bp, Homo sapien
gctgcttttccggatcacgagtatc

SEQ ID NO: 41978 - DNA, 25 bp, Homo sapien
tggcgttcctttatctcagagactc

SEQ ID NO: 41979 - DNA, 25 bp, Homo sapien
gcgcccgacgaagctagcagattcc

SEQ ID NO: 41980 - DNA, 25 bp, Homo sapien
ccgacggcgtctgtgacaagtacaa

SEQ ID NO: 41981 - DNA, 25 bp, Homo sapien
ggagtgttccaagtagacgcgctaa

SEQ ID NO: 41982 - DNA, 25 bp, Homo sapien
cacaggtcacctttggaagtgcgcc

SEQ ID NO: 41983 - DNA, 25 bp, Homo sapien
tccggctcactcttgtctggcgcat

SEQ ID NO: 41984 - DNA, 25 bp, Homo sapien
tggcgcatccgcagagcagacgtat

SEQ ID NO: 41985 - DNA, 25 bp, Homo sapien
acgccatccgcttgcgcattgtgga

SEQ ID NO: 41986 - DNA, 25 bp, Homo sapien
gcgctacaacgagaccggctccatt

SEQ ID NO: 41987 - DNA, 25 bp, Homo sapien
acgtggtcaagcacatccgggacta

SEQ ID NO: 41988 - DNA, 25 bp, Homo sapien
ccgcctgcgcaaggtcctcctctgg

SEQ ID NO: 41989 - DNA, 25 bp, Homo sapien
cggcctccaaccagcacggcgtgta

SEQ ID NO: 41990 - DNA, 25 bp, Homo sapien
ccgcctgcgcctacccggcctccaa

SEQ ID NO: 41991 - DNA, 25 bp, Homo sapien
tccaccctctctgccgtgggcggct

SEQ ID NO: 41992 - DNA, 25 bp, Homo sapien
gctgctgacggtccctctctatccc

SEQ ID NO: 41993 - DNA, 25 bp, Homo sapien
caggattttctgctgctgacggtcc

SEQ ID NO: 41994 - DNA, 25 bp, Homo sapien
tgggctagagaaggcaggattttct

SEQ ID NO: 41995 - DNA, 25 bp, Homo sapien
aaccagcacggcgtgtacagcgccc

SEQ ID NO: 41996 - DNA, 25 bp, Homo sapien
aatctctggtggctcatttcccgca

SEQ ID NO: 41997 - DNA, 25 bp, Homo sapien
aagcgcaactgcctcctacgtcgga

SEQ ID NO: 41998 - DNA, 25 bp, Homo sapien
attggctgctcttcgcacttgtgcg

SEQ ID NO: 41999 - DNA, 25 bp, Homo sapien
ggacgccctcagtagcttacacgga

SEQ ID NO: 42000 - DNA, 25 bp, Homo sapien
tccgcgcaacgttagagtcctgttc

SEQ ID NO: 42001 - DNA, 25 bp, Homo sapien
tgcggaagtcgccatcagacctgaa

SEQ ID NO: 42002 - DNA, 25 bp, Homo sapien
gctctccttgcaagtggctctccta

SEQ ID NO: 42003 - DNA, 25 bp, Homo sapien
gccttcaagggttgagcgctcacga

SEQ ID NO: 42004 - DNA, 25 bp, Homo sapien
ctggactcgccagtgttaccggaga

SEQ ID NO: 42005 - DNA, 25 bp, Homo sapien
ggttccctgcgctttctagaatttg

SEQ ID NO: 42006 - DNA, 25 bp, Homo sapien
tgcctcgtgctcttttcgatctctc

SEQ ID NO: 42007 - DNA, 25 bp, Homo sapien
ccttggcacctgcaggagaaaccct

SEQ ID NO: 42008 - DNA, 25 bp, Homo sapien
tggccttctccactaagacccttgg

SEQ ID NO: 42009 - DNA, 25 bp, Homo sapien
cccagtgacatttagcaggcatttt

SEQ ID NO: 42010 - DNA, 25 bp, Homo sapien
gtcttgacccaaggccgtctgcctg

SEQ ID NO: 42011 - DNA, 25 bp, Homo sapien
tcctatgtcagcgaagtgagcgttg

SEQ ID NO: 42012 - DNA, 25 bp, Homo sapien
tgtgccagttccctgtcgcatcaga

SEQ ID NO: 42013 - DNA, 25 bp, Homo sapien
cgctggtagacacctggggaaatac

SEQ ID NO: 42014 - DNA, 25 bp, Homo sapien
gcctgcctgtgtccgagaaagagtt

SEQ ID NO: 42015 - DNA, 25 bp, Homo sapien
ggggcagcagcagaactactatttt

SEQ ID NO: 42016 - DNA, 25 bp, Homo sapien
ctgttgggtcctacaaactcgcgtc

SEQ ID NO: 42017 - DNA, 25 bp, Homo sapien
aatggccctgcgtctgctttctgac

SEQ ID NO: 42018 - DNA, 25 bp, Homo sapien
cttcctgcagccagagctaaggttc

SEQ ID NO: 42019 - DNA, 25 bp, Homo sapien
ccctgctgctgcttgatgacgatcc

SEQ ID NO: 42020 - DNA, 25 bp, Homo sapien
accctcgcacaatgggcgtgccata

SEQ ID NO: 42021 - DNA, 25 bp, Homo sapien
gaactatatcttatcggccgggatc

SEQ ID NO: 42022 - DNA, 25 bp, Homo sapien
catcctttttatgtattcggacaga

SEQ ID NO: 42023 - DNA, 25 bp, Homo sapien
aaacacatttcaggccgggctcacg

SEQ ID NO: 42024 - DNA, 25 bp, Homo sapien
catagcaggttagggcagcgctttc

SEQ ID NO: 42025 - DNA, 25 bp, Homo sapien
cgccacgggagccttttatgtgata

SEQ ID NO: 42026 - DNA, 25 bp, Homo sapien
gaaaagcctccgaaagcgcctgctc

SEQ ID NO: 42027 - DNA, 25 bp, Homo sapien
tgggcgtgccatacgaaacatagca

SEQ ID NO: 42028 - DNA, 25 bp, Homo sapien
ccggactccgagtctgtttcattca

SEQ ID NO: 42029 - DNA, 25 bp, Homo sapien
tacctcgggctctgcatagtagctg

SEQ ID NO: 42030 - DNA, 25 bp, Homo sapien
ggaggcgccgcaagtcaatatttga

SEQ ID NO: 42031 - DNA, 25 bp, Homo sapien
cgcgcgctgccaaacataactctgt

SEQ ID NO: 42032 - DNA, 25 bp, Homo sapien
cgcggctgagctttgcaggcaaaaa

SEQ ID NO: 42033 - DNA, 25 bp, Homo sapien
cgagacctgaaccacacgcggctga

SEQ ID NO: 42034 - DNA, 25 bp, Homo sapien
gagtcatgatcgatcgcccttggga

SEQ ID NO: 42035 - DNA, 25 bp, Homo sapien
cccagcatactggaagccgagtgca

SEQ ID NO: 42036 - DNA, 25 bp, Homo sapien
tccgcggaagccgtgcctatcggtc

SEQ ID NO: 42037 - DNA, 25 bp, Homo sapien
gtatctccgcggaagccgtgcctat

SEQ ID NO: 42038 - DNA, 25 bp, Homo sapien
tcaaggtctgtatctccgcggaagc

SEQ ID NO: 42039 - DNA, 25 bp, Homo sapien
cccacaaattcaaggtctgtatctc

SEQ ID NO: 42040 - DNA, 25 bp, Homo sapien
gattctcccacaaattcaaggtctg

SEQ ID NO: 42041 - DNA, 25 bp, Homo sapien
gcgggattctcccacaaattcaagg

SEQ ID NO: 42042 - DNA, 25 bp, Homo sapien
cgccagggcgggattctcccacaaa

SEQ ID NO: 42043 - DNA, 25 bp, Homo sapien
cccgagtgctgaaggctcccacgag

SEQ ID NO: 42044 - DNA, 25 bp, Homo sapien
ccggttgttcgctaaggaggacttg

SEQ ID NO: 42045 - DNA, 25 bp, Homo sapien
agcaccggtgatatcttggaactcg

SEQ ID NO: 42046 - DNA, 25 bp, Homo sapien
ccggtgatatcttggaactcggccc

SEQ ID NO: 42047 - DNA, 25 bp, Homo sapien
atatcttggaactcggccccggttg

SEQ ID NO: 42048 - DNA, 25 bp, Homo sapien
gagttcctgggggtccaccgcactc

SEQ ID NO: 42049 - DNA, 25 bp, Homo sapien
aggctcctcgcgagcggagccgctt

SEQ ID NO: 42050 - DNA, 25 bp, Homo sapien
ccctcagcaccggtgatatcttgga

SEQ ID NO: 42051 - DNA, 25 bp, Homo sapien
atccgaggctcctcgcgagcggagc

SEQ ID NO: 42052 - DNA, 25 bp, Homo sapien
gacgttcagacagcctggggttcgc

SEQ ID NO: 42053 - DNA, 25 bp, Homo sapien
gctggatgacgcctcctagagtctc

SEQ ID NO: 42054 - DNA, 25 bp, Homo sapien
ctcctagagtctcggagcagccgct

SEQ ID NO: 42055 - DNA, 25 bp, Homo sapien
cacgcctgcccatgggaatgcgagc

SEQ ID NO: 42056 - DNA, 25 bp, Homo sapien
tctacggttagctttaggtagctgg

SEQ ID NO: 42057 - DNA, 25 bp, Homo sapien
acaccaacgggctgcgaaggaagca

SEQ ID NO: 42058 - DNA, 25 bp, Homo sapien
aggaagcagggacgttcagacagcc

SEQ ID NO: 42059 - DNA, 25 bp, Homo sapien
ctcctgcaccctggcgaggttctgg

SEQ ID NO: 42060 - DNA, 25 bp, Homo sapien
agtcaattatctgaggcgcggaggc

SEQ ID NO: 42061 - DNA, 25 bp, Homo sapien
gcgtgcggggcttttccactggttc

SEQ ID NO: 42062 - DNA, 25 bp, Homo sapien
gcgcttcatcggttcgagtcaatta

SEQ ID NO: 42063 - DNA, 25 bp, Homo sapien
actcgctcgttcacctttttctcaa

SEQ ID NO: 42064 - DNA, 25 bp, Homo sapien
aaggcgccgcgatcagcgcttcatc

SEQ ID NO: 42065 - DNA, 25 bp, Homo sapien
tgttactccctcaacgggaacacaa

SEQ ID NO: 42066 - DNA, 25 bp, Homo sapien
cgctgttgttactccctcaacggga

SEQ ID NO: 42067 - DNA, 25 bp, Homo sapien
cccgctttccatggcagtgccgagg

SEQ ID NO: 42068 - DNA, 25 bp, Homo sapien
gcatggtcgctatccagtgcatcta

SEQ ID NO: 42069 - DNA, 25 bp, Homo sapien
gcgtcgacggcctcaacatgttcac

SEQ ID NO: 42070 - DNA, 25 bp, Homo sapien
agcgtcttctgtctcaccgtgctca

SEQ ID NO: 42071 - DNA, 25 bp, Homo sapien
ggccaagctcatcaacctgggcgtg

SEQ ID NO: 42072 - DNA, 25 bp, Homo sapien
ggtctacactttcctgctgggcttc

SEQ ID NO: 42073 - DNA, 25 bp, Homo sapien
gtcggcagtcttcgtggtctacact

SEQ ID NO: 42074 - DNA, 25 bp, Homo sapien
ggctggcatccctgttggtcactct

SEQ ID NO: 42075 - DNA, 25 bp, Homo sapien
ttcgtgatccttcgctacgccaaga

SEQ ID NO: 42076 - DNA, 25 bp, Homo sapien
ccgtcgccgttcagtagcaaggaaa

SEQ ID NO: 42077 - DNA, 25 bp, Homo sapien
ccgtcgcagatctgactggcattga

SEQ ID NO: 42078 - DNA, 25 bp, Homo sapien
cagcctctgacatgcggatcggcca

SEQ ID NO: 42079 - DNA, 25 bp, Homo sapien
aagagctctgggaaccggagacttc

SEQ ID NO: 42080 - DNA, 25 bp, Homo sapien
gcgtgcagccctctttcatctcttg

SEQ ID NO: 42081 - DNA, 25 bp, Homo sapien
acctcgccgggatgagtaaaccctg

SEQ ID NO: 42082 - DNA, 25 bp, Homo sapien
cgcatactcggattgctgggttctc

SEQ ID NO: 42083 - DNA, 25 bp, Homo sapien
tcggccagggctcgagtttataagt

SEQ ID NO: 42084 - DNA, 25 bp, Homo sapien
tcactccaatacaggcgcatgcggg

SEQ ID NO: 42085 - DNA, 25 bp, Homo sapien
ggacctaagaggtttggcccaatca

SEQ ID NO: 42086 - DNA, 25 bp, Homo sapien
ggtgacccagagtaagcctccaaga

SEQ ID NO: 42087 - DNA, 25 bp, Homo sapien
cacacatgggcggagttagccttcc

SEQ ID NO: 42088 - DNA, 25 bp, Homo sapien
ctaactcctaaagagcgcgatcggc

SEQ ID NO: 42089 - DNA, 25 bp, Homo sapien
ctggtgacgtttcacgagactttta

SEQ ID NO: 42090 - DNA, 25 bp, Homo sapien
cacatgttgccagacggaaggcctc

SEQ ID NO: 42091 - DNA, 25 bp, Homo sapien
tcccggaagctaccgcctcttataa

SEQ ID NO: 42092 - DNA, 25 bp, Homo sapien
ccacctacactagcctggttgcagg

SEQ ID NO: 42093 - DNA, 25 bp, Homo sapien
tagcctggttgcaggcggcctccaa

SEQ ID NO: 42094 - DNA, 25 bp, Homo sapien
gccaccggggaaggcaagacaaatg

SEQ ID NO: 42095 - DNA, 25 bp, Homo sapien
caagacaaatgtgcgtggcaccctc

SEQ ID NO: 42096 - DNA, 25 bp, Homo sapien
tcctccttcggttctgggacacatc

SEQ ID NO: 42097 - DNA, 25 bp, Homo sapien
tctgggacacatctccaccaagcgg

SEQ ID NO: 42098 - DNA, 25 bp, Homo sapien
caccaagcggccgttcggcaggtag

SEQ ID NO: 42099 - DNA, 25 bp, Homo sapien
gtccgggccagacccgcaatgggca

SEQ ID NO: 42100 - DNA, 25 bp, Homo sapien
tacggccgacgtcattaccctgcga

SEQ ID NO: 42101 - DNA, 25 bp, Homo sapien
ggcgttctttctcgttcggagctca

SEQ ID NO: 42102 - DNA, 25 bp, Homo sapien
cgaagcgctcttgccaggacgtact

SEQ ID NO: 42103 - DNA, 25 bp, Homo sapien
gtttctcactcaaccgcaggttcca

SEQ ID NO: 42104 - DNA, 25 bp, Homo sapien
gacacttctgaggactcttttgaca

SEQ ID NO: 42105 - DNA, 25 bp, Homo sapien
tttgacagctagtaatcgcgcggtg

SEQ ID NO: 42106 - DNA, 25 bp, Homo sapien
aaggagctataccagcggctccaga

SEQ ID NO: 42107 - DNA, 25 bp, Homo sapien
ttcgcaaaggagctgggtaaaacca

SEQ ID NO: 42108 - DNA, 25 bp, Homo sapien
aagcccggaatggacgcgaaagtga

SEQ ID NO: 42109 - DNA, 25 bp, Homo sapien
ctgtggctgcagtagtttgttctct

SEQ ID NO: 42110 - DNA, 25 bp, Homo sapien
cgcgcggccagatcaggtaactgcc

SEQ ID NO: 42111 - DNA, 25 bp, Homo sapien
ctcacgtgacttttcgcgactggcc

SEQ ID NO: 42112 - DNA, 25 bp, Homo sapien
gccaaggtgagtaccagctccaagc

SEQ ID NO: 42113 - DNA, 25 bp, Homo sapien
cgtgagcagctcttagtgggaagcc

SEQ ID NO: 42114 - DNA, 25 bp, Homo sapien
gcagacgtcgctgtctcctgcgcag

SEQ ID NO: 42115 - DNA, 25 bp, Homo sapien
agtgaccacgcgaatctgacgctca

SEQ ID NO: 42116 - DNA, 25 bp, Homo sapien
tcgccaaccgctgcaacctgaagag

SEQ ID NO: 42117 - DNA, 25 bp, Homo sapien
gatggctctgctcccttgttctgag

SEQ ID NO: 42118 - DNA, 25 bp, Homo sapien
gcgtttagttctctgtcaaggtaca

SEQ ID NO: 42119 - DNA, 25 bp, Homo sapien
ggggcttatttcgagacagcgttta

SEQ ID NO: 42120 - DNA, 25 bp, Homo sapien
gtcgtcctgggatttgatgtctcac

SEQ ID NO: 42121 - DNA, 25 bp, Homo sapien
tgtgtcaagcactgaggtcgtcctg

SEQ ID NO: 42122 - DNA, 25 bp, Homo sapien
ccgcgctcaagacgcacatgaggta

SEQ ID NO: 42123 - DNA, 25 bp, Homo sapien
agcgccatttcccatgcgagctgtg

SEQ ID NO: 42124 - DNA, 25 bp, Homo sapien
cccagagtgttctaggggcttcgtg

SEQ ID NO: 42125 - DNA, 25 bp, Homo sapien
accggtctcaggagcgatacgggct

SEQ ID NO: 42126 - DNA, 25 bp, Homo sapien
cctacaggatttctggagggcgcct

SEQ ID NO: 42127 - DNA, 25 bp, Homo sapien
ctgaggaaccctggggagttctgcc

SEQ ID NO: 42128 - DNA, 25 bp, Homo sapien
gatacgggcttcagcgtggcgaaat

SEQ ID NO: 42129 - DNA, 25 bp, Homo sapien
gtggcgaaatgcaccaatacgactc

SEQ ID NO: 42130 - DNA, 25 bp, Homo sapien
tacgactcgctacgcactgagaagg

SEQ ID NO: 42131 - DNA, 25 bp, Homo sapien
tcagggagccgctgaccttctaggt

SEQ ID NO: 42132 - DNA, 25 bp, Homo sapien
ccagactgtttacggaatcgggatc

SEQ ID NO: 42133 - DNA, 25 bp, Homo sapien
tcgaggggccgataagtagtttaca

SEQ ID NO: 42134 - DNA, 25 bp, Homo sapien
aagtagtttacacgccggccagagc

SEQ ID NO: 42135 - DNA, 25 bp, Homo sapien
acccgagaataggaacaggcacgcc

SEQ ID NO: 42136 - DNA, 25 bp, Homo sapien
ggaccagtctagagttcggtttata

SEQ ID NO: 42137 - DNA, 25 bp, Homo sapien
ggatcccgaatctgccgctcaaagt

SEQ ID NO: 42138 - DNA, 25 bp, Homo sapien
cggtttataggatccagactgttta

SEQ ID NO: 42139 - DNA, 25 bp, Homo sapien
agggtcaccggctttccatgattgc

SEQ ID NO: 42140 - DNA, 25 bp, Homo sapien
cggacctgacgtgtccgtgcggttc

SEQ ID NO: 42141 - DNA, 25 bp, Homo sapien
ctgtggtacatgtcgttgctggctt

SEQ ID NO: 42142 - DNA, 25 bp, Homo sapien
gctggctttgttgtactcgccgacg

SEQ ID NO: 42143 - DNA, 25 bp, Homo sapien
ctcgccgacggcaaagtccagtgca

SEQ ID NO: 42144 - DNA, 25 bp, Homo sapien
ggcaaagtccagtgcacgccgcaca

SEQ ID NO: 42145 - DNA, 25 bp, Homo sapien
ctggagctagatagagaggacccgc

SEQ ID NO: 42146 - DNA, 25 bp, Homo sapien
aggacccgctgcgataccgaggcga

SEQ ID NO: 42147 - DNA, 25 bp, Homo sapien
tcctggaagctgatcttaggcgccg

SEQ ID NO: 42148 - DNA, 25 bp, Homo sapien
taagctcactctgtcaccggcgcca

SEQ ID NO: 42149 - DNA, 25 bp, Homo sapien
tgtcaccggcgccattaagtgctca

SEQ ID NO: 42150 - DNA, 25 bp, Homo sapien
ctcactctgtcaccggcgccattaa

SEQ ID NO: 42151 - DNA, 25 bp, Homo sapien
agctcactctgtcaccggcgccatt

SEQ ID NO: 42152 - DNA, 25 bp, Homo sapien
tcaccggcgccattaagtgctcacg

SEQ ID NO: 42153 - DNA, 25 bp, Homo sapien
accggcgccattaagtgctcacgcg

SEQ ID NO: 42154 - DNA, 25 bp, Homo sapien
gtcaccggcgccattaagtgctcac

SEQ ID NO: 42155 - DNA, 25 bp, Homo sapien
cggcgccattaagtgctcacgcgcc

SEQ ID NO: 42156 - DNA, 25 bp, Homo sapien
tacttttgtaagacatgcgccattg

SEQ ID NO: 42157 - DNA, 25 bp, Homo sapien
tgcgagtctgtgagaccctgatctt

SEQ ID NO: 42158 - DNA, 25 bp, Homo sapien
ccctgatcttctggtataactactc

SEQ ID NO: 42159 - DNA, 25 bp, Homo sapien
ccagcgtctcggtctccaaggaaac

SEQ ID NO: 42160 - DNA, 25 bp, Homo sapien
tctcagtgtagatcgcgcggtaacc

SEQ ID NO: 42161 - DNA, 25 bp, Homo sapien
cgcggtaacccaggccactcagaag

SEQ ID NO: 42162 - DNA, 25 bp, Homo sapien
gagacccgatgctttcgccagcgtc

SEQ ID NO: 42163 - DNA, 25 bp, Homo sapien
agtacgcatgcgtattccgcctttc

SEQ ID NO: 42164 - DNA, 25 bp, Homo sapien
ggcagccgctgaaaagcacccacga

SEQ ID NO: 42165 - DNA, 25 bp, Homo sapien
atactctctaggtgcgaggagcgcc

SEQ ID NO: 42166 - DNA, 25 bp, Homo sapien
gcagattgcagaagtccgcggacga

SEQ ID NO: 42167 - DNA, 25 bp, Homo sapien
gcaaagaactctcacagggctcagg

SEQ ID NO: 42168 - DNA, 25 bp, Homo sapien
tcaccttgacgtaactgaggcagcc

SEQ ID NO: 42169 - DNA, 25 bp, Homo sapien
ccagagggaacatgagcagcgctcc

SEQ ID NO: 42170 - DNA, 25 bp, Homo sapien
aagagccgcagcacgttgaccagag

SEQ ID NO: 42171 - DNA, 25 bp, Homo sapien
tcaggggaacccacggaatactctc

SEQ ID NO: 42172 - DNA, 25 bp, Homo sapien
gggctttgtccctatgcgctttttg

SEQ ID NO: 42173 - DNA, 25 bp, Homo sapien
tggagcctctttcctctagccagga

SEQ ID NO: 42174 - DNA, 25 bp, Homo sapien
tgggagcgagcacatacgctttttt

SEQ ID NO: 42175 - DNA, 25 bp, Homo sapien
tgcctcttcatgtgcactctctggg

SEQ ID NO: 42176 - DNA, 25 bp, Homo sapien
aacagactaattctccgagcggagc

SEQ ID NO: 42177 - DNA, 25 bp, Homo sapien
gcgctttttgcaagaccctactaga

SEQ ID NO: 42178 - DNA, 25 bp, Homo sapien
ggccgcttggcgtttctgaaagacg

SEQ ID NO: 42179 - DNA, 25 bp, Homo sapien
ctcgctttttcctagtcgtgatttc

SEQ ID NO: 42180 - DNA, 25 bp, Homo sapien
tcacagctgaagagggaagccagcc

SEQ ID NO: 42181 - DNA, 25 bp, Homo sapien
ctcatggctgggatcacagcgccac

SEQ ID NO: 42182 - DNA, 25 bp, Homo sapien
cgtgctcatggctgggatcacagcg

SEQ ID NO: 42183 - DNA, 25 bp, Homo sapien
ctggaaaatgcgctcaggccgggcc

SEQ ID NO: 42184 - DNA, 25 bp, Homo sapien
aaagctggaaaatgcgctcaggccg

SEQ ID NO: 42185 - DNA, 25 bp, Homo sapien
cagcgccaccctgtggccgacgctc

SEQ ID NO: 42186 - DNA, 25 bp, Homo sapien
ctacggaaagctggaaaatgcgctc

SEQ ID NO: 42187 - DNA, 25 bp, Homo sapien
gggcctacggaaagctggaaaatgc

SEQ ID NO: 42188 - DNA, 25 bp, Homo sapien
gtgcacccgaacctgaaagacctgg

SEQ ID NO: 42189 - DNA, 25 bp, Homo sapien
acctggcaggtacatccgccttgtc

SEQ ID NO: 42190 - DNA, 25 bp, Homo sapien
ggagcctgcttcctcggaaaaatga

SEQ ID NO: 42191 - DNA, 25 bp, Homo sapien
aggactctgacaacgcgctcggcac

SEQ ID NO: 42192 - DNA, 25 bp, Homo sapien
tgctcggcgctctgaggctaattct

SEQ ID NO: 42193 - DNA, 25 bp, Homo sapien
ggctaattctgaccgcccggaagtg

SEQ ID NO: 42194 - DNA, 25 bp, Homo sapien
tgccgccttcgtctcacgtttctga

SEQ ID NO: 42195 - DNA, 25 bp, Homo sapien
gaagccatctcttcgccggataacg

SEQ ID NO: 42196 - DNA, 25 bp, Homo sapien
cacccggtaacgcaactctggagtc

SEQ ID NO: 42197 - DNA, 25 bp, Homo sapien
gcaggctacctgagctctctgtgct

SEQ ID NO: 42198 - DNA, 25 bp, Homo sapien
ggctcttgctcagcggcgctatgca

SEQ ID NO: 42199 - DNA, 25 bp, Homo sapien
tgacgtggagccactgcttagagcg

SEQ ID NO: 42200 - DNA, 25 bp, Homo sapien
aggaaccagccgatcttgccagtgc

SEQ ID NO: 42201 - DNA, 25 bp, Homo sapien
ttgccagtgctgaagtcgcagtccc

SEQ ID NO: 42202 - DNA, 25 bp, Homo sapien
gtgtcccacacgagagtgtcccgcg

SEQ ID NO: 42203 - DNA, 25 bp, Homo sapien
agtgacaaccgccaccgctttgttt

SEQ ID NO: 42204 - DNA, 25 bp, Homo sapien
ggtccggactcacgggcattcaacg

SEQ ID NO: 42205 - DNA, 25 bp, Homo sapien
cggatcttctctcccgagcatgatc

SEQ ID NO: 42206 - DNA, 25 bp, Homo sapien
gccatttggccctgcggttttgaaa

SEQ ID NO: 42207 - DNA, 25 bp, Homo sapien
catgatcccatgctatttctgaagg

SEQ ID NO: 42208 - DNA, 25 bp, Homo sapien
aaatagctcccgagggccaaccagc

SEQ ID NO: 42209 - DNA, 25 bp, Homo sapien
cagggctcggatcttctctcccgag

SEQ ID NO: 42210 - DNA, 25 bp, Homo sapien
cagaaggcacacagaagagacagtg

SEQ ID NO: 42211 - DNA, 25 bp, Homo sapien
ctgaaggaaatagctcccgagggcc

SEQ ID NO: 42212 - DNA, 25 bp, Homo sapien
cccagggtctcatcaaaaggttcca

SEQ ID NO: 42213 - DNA, 25 bp, Homo sapien
ggcccagcttagaggaagctttata

SEQ ID NO: 42214 - DNA, 25 bp, Homo sapien
ccttagcaagcaaggcgcgagcctc

SEQ ID NO: 42215 - DNA, 25 bp, Homo sapien
gcggtctcacatcgctgagggaaca

SEQ ID NO: 42216 - DNA, 25 bp, Homo sapien
ccctctggagatggttgttgaagac

SEQ ID NO: 42217 - DNA, 25 bp, Homo sapien
tcattcgatcatttccgcccgcgtt

SEQ ID NO: 42218 - DNA, 25 bp, Homo sapien
tccaggacccgtcaatcattcgatc

SEQ ID NO: 42219 - DNA, 25 bp, Homo sapien
cggccggtcatggttccttagcaag

SEQ ID NO: 42220 - DNA, 25 bp, Homo sapien
gtgagtcgggtcctaactaaagtca

SEQ ID NO: 42221 - DNA, 25 bp, Homo sapien
cagaccgtcctgtcagagaatcccg

SEQ ID NO: 42222 - DNA, 25 bp, Homo sapien
tgctgagatgatactggaagtgccc

SEQ ID NO: 42223 - DNA, 25 bp, Homo sapien
gcgtttacggtgactggaccagata

SEQ ID NO: 42224 - DNA, 25 bp, Homo sapien
tgccagcggttctgacactgcagga

SEQ ID NO: 42225 - DNA, 25 bp, Homo sapien
gtaaaacaatcgctctcccggcgtc

SEQ ID NO: 42226 - DNA, 25 bp, Homo sapien
tctcccgcccgtctgtagtaaaaca

SEQ ID NO: 42227 - DNA, 25 bp, Homo sapien
gtgatacctcctcgacgccgtcaaa

SEQ ID NO: 42228 - DNA, 25 bp, Homo sapien
tcgcccgcgaatggaaagcctaagg

SEQ ID NO: 42229 - DNA, 25 bp, Homo sapien
tctccctggaaggtaggcgatcacg

SEQ ID NO: 42230 - DNA, 25 bp, Homo sapien
gtcttttgaaccactccagctcggg

SEQ ID NO: 42231 - DNA, 25 bp, Homo sapien
ccttgcaagctgttcccgggattac

SEQ ID NO: 42232 - DNA, 25 bp, Homo sapien
cccgagtagatagccagtgatccaa

SEQ ID NO: 42233 - DNA, 25 bp, Homo sapien
ctcgggaaggatcgtcttaaactca

SEQ ID NO: 42234 - DNA, 25 bp, Homo sapien
ccgtattggagctctaaggggactc

SEQ ID NO: 42235 - DNA, 25 bp, Homo sapien
cacacagtttgtagcccgagaccag

SEQ ID NO: 42236 - DNA, 25 bp, Homo sapien
tctttgctgtcgtcactcggttctc

SEQ ID NO: 42237 - DNA, 25 bp, Homo sapien
ctgcggggacgctttcagaacatca

SEQ ID NO: 42238 - DNA, 25 bp, Homo sapien
tgactctgcccggtttgctaacccg

SEQ ID NO: 42239 - DNA, 25 bp, Homo sapien
ccgcctttgtttggctctcaaaatt

SEQ ID NO: 42240 - DNA, 25 bp, Homo sapien
tggccctgcacaccgtgagactcga

SEQ ID NO: 42241 - DNA, 25 bp, Homo sapien
ctgccgttagagtcggtagattaca

SEQ ID NO: 42242 - DNA, 25 bp, Homo sapien
ctccgggatcgctgttcctggaaaa

SEQ ID NO: 42243 - DNA, 25 bp, Homo sapien
ttctgaggccacacatctcgaggca

SEQ ID NO: 42244 - DNA, 25 bp, Homo sapien
gctgagcacccatactccgcccgcg

SEQ ID NO: 42245 - DNA, 25 bp, Homo sapien
gcccgccatgagacgctcggggaac

SEQ ID NO: 42246 - DNA, 25 bp, Homo sapien
ccatgagacgctcggggaaccagac

SEQ ID NO: 42247 - DNA, 25 bp, Homo sapien
agaaaaccgcaaggccacctgcaga

SEQ ID NO: 42248 - DNA, 25 bp, Homo sapien
agaaaagaaggccatcgcgcctacg

SEQ ID NO: 42249 - DNA, 25 bp, Homo sapien
aggccatcgcgcctacgcagctgag

SEQ ID NO: 42250 - DNA, 25 bp, Homo sapien
gccgcgccgtaaggaaactggccaa

SEQ ID NO: 42251 - DNA, 25 bp, Homo sapien
ctccgccgcgccgtaaggaaactgg

SEQ ID NO: 42252 - DNA, 25 bp, Homo sapien
gatcaggccgctcggacaggactga

SEQ ID NO: 42253 - DNA, 25 bp, Homo sapien
taaggacgattcaccctggcattgg

SEQ ID NO: 42254 - DNA, 25 bp, Homo sapien
gtcccgaggagctcataggtggtca

SEQ ID NO: 42255 - DNA, 25 bp, Homo sapien
ttctgcccgagctgacctgtgagcc

SEQ ID NO: 42256 - DNA, 25 bp, Homo sapien
cagtttctgggaaacaggtaggatc

SEQ ID NO: 42257 - DNA, 25 bp, Homo sapien
cctgtgagccgcgaatgccctggac

SEQ ID NO: 42258 - DNA, 25 bp, Homo sapien
actgagggtgtaaggacgattcacc

SEQ ID NO: 42259 - DNA, 25 bp, Homo sapien
ggaaacaggtaggatcaggccgctc

SEQ ID NO: 42260 - DNA, 25 bp, Homo sapien
ccggggcgaaccattctggtgtgaa

SEQ ID NO: 42261 - DNA, 25 bp, Homo sapien
cgcgtcgtacctgcgtgtcatttca

SEQ ID NO: 42262 - DNA, 25 bp, Homo sapien
ggccttcgacagtgagggccacccg

SEQ ID NO: 42263 - DNA, 25 bp, Homo sapien
gtccgagctgtcagcctctccaaag

SEQ ID NO: 42264 - DNA, 25 bp, Homo sapien
gagcgtctgctgtctgctttctccc

SEQ ID NO: 42265 - DNA, 25 bp, Homo sapien
caatcaggaagtccggggcgaacca

SEQ ID NO: 42266 - DNA, 25 bp, Homo sapien
tcgaacggaagcgaggaaccaatca

SEQ ID NO: 42267 - DNA, 25 bp, Homo sapien
aagctaagcggtcgcctggcaaccc

SEQ ID NO: 42268 - DNA, 25 bp, Homo sapien
cgaagccgctgacggacagcgagaa

SEQ ID NO: 42269 - DNA, 25 bp, Homo sapien
cagcgagaagcggaagcagatcagc

SEQ ID NO: 42270 - DNA, 25 bp, Homo sapien
atctcagctatgagcctggacgccc

SEQ ID NO: 42271 - DNA, 25 bp, Homo sapien
cggactacaccagagatctcagcta

SEQ ID NO: 42272 - DNA, 25 bp, Homo sapien
tgccgcctcggactacaccagagat

SEQ ID NO: 42273 - DNA, 25 bp, Homo sapien
tggacaggtcgctgccgcctcggac

SEQ ID NO: 42274 - DNA, 25 bp, Homo sapien
ggggcaaacaccacgctcaggtggc

SEQ ID NO: 42275 - DNA, 25 bp, Homo sapien
gcggaagagcttcaaccggcacttg

SEQ ID NO: 42276 - DNA, 25 bp, Homo sapien
ctcccacgcggggtcatgacttcgg

SEQ ID NO: 42277 - DNA, 25 bp, Homo sapien
caaggcgccagtaaggctccgcgca

SEQ ID NO: 42278 - DNA, 25 bp, Homo sapien
cgctcatgctccaaggcgacgggct

SEQ ID NO: 42279 - DNA, 25 bp, Homo sapien
gtaggttctgcttcaggcggcagtc

SEQ ID NO: 42280 - DNA, 25 bp, Homo sapien
acctgcgcaaagtgagggaccggcc

SEQ ID NO: 42281 - DNA, 25 bp, Homo sapien
tgccgcgggccaaatgcgggacaca

SEQ ID NO: 42282 - DNA, 25 bp, Homo sapien
ctggcgtccagggatcttccaagga

SEQ ID NO: 42283 - DNA, 25 bp, Homo sapien
tgcgggacgcacctgcgcaaagtga

SEQ ID NO: 42284 - DNA, 25 bp, Homo sapien
cctattggctagctttgttcggcgc

SEQ ID NO: 42285 - DNA, 25 bp, Homo sapien
tggatgtcccttttcgggcgccgta

SEQ ID NO: 42286 - DNA, 25 bp, Homo sapien
cgtcagggttcactttcgcaccttg

SEQ ID NO: 42287 - DNA, 25 bp, Homo sapien
cctggcgctgtaggactagaacgaa

SEQ ID NO: 42288 - DNA, 25 bp, Homo sapien
cgccgagagcccagataccattttg

SEQ ID NO: 42289 - DNA, 25 bp, Homo sapien
gaagcgtccgccatgttctgcgaaa

SEQ ID NO: 42290 - DNA, 25 bp, Homo sapien
ttctgcgaaaaagccatggaactga

SEQ ID NO: 42291 - DNA, 25 bp, Homo sapien
ccatggaactgatccgcgagctgca

SEQ ID NO: 42292 - DNA, 25 bp, Homo sapien
ggcaaggcggcctccgcaaatctca

SEQ ID NO: 42293 - DNA, 25 bp, Homo sapien
ggggcgaatctgcaaaacgagtaca

SEQ ID NO: 42294 - DNA, 25 bp, Homo sapien
cagccacactggcaggagggaatcc

SEQ ID NO: 42295 - DNA, 25 bp, Homo sapien
gggcaccgcgtagctcattaccacg

SEQ ID NO: 42296 - DNA, 25 bp, Homo sapien
cccagcgggcgctgtattttagggc

SEQ ID NO: 42297 - DNA, 25 bp, Homo sapien
caccacagcagatgcgccgagtctg

SEQ ID NO: 42298 - DNA, 25 bp, Homo sapien
agctctcggggtagcatcttctgga

SEQ ID NO: 42299 - DNA, 25 bp, Homo sapien
tcttctggaaacaagcccggaggcc

SEQ ID NO: 42300 - DNA, 25 bp, Homo sapien
ctctggcggatctcacaggacacac

SEQ ID NO: 42301 - DNA, 25 bp, Homo sapien
tctggcggatctcacaggacacacg

SEQ ID NO: 42302 - DNA, 25 bp, Homo sapien
tggcggatcacacaggacacacgtg

SEQ ID NO: 42303 - DNA, 25 bp, Homo sapien
tggcggatctcacaggacacacgtg

SEQ ID NO: 42304 - DNA, 25 bp, Homo sapien
gctctggcggatctcacaggacaca

SEQ ID NO: 42305 - DNA, 25 bp, Homo sapien
gctctggcggatcacaggacacacg

SEQ ID NO: 42306 - DNA, 25 bp, Homo sapien
tctggcggatcacaggacacacgtg

SEQ ID NO: 42307 - DNA, 25 bp, Homo sapien
ctggcggatcacaggacacacgtgc

SEQ ID NO: 42308 - DNA, 25 bp, Homo sapien
cccgtagcctattaggaagcttgtc

SEQ ID NO: 42309 - DNA, 25 bp, Homo sapien
cccgaagcttgtgggagcgcctcga

SEQ ID NO: 42310 - DNA, 25 bp, Homo sapien
agcccgaagcttgtgggagcgcctc

SEQ ID NO: 42311 - DNA, 25 bp, Homo sapien
gcctattaggaagcttgtcctgccc

SEQ ID NO: 42312 - DNA, 25 bp, Homo sapien
gtagcctattaggaagcttgtcctg

SEQ ID NO: 42313 - DNA, 25 bp, Homo sapien
tttctggtcctcctgtgccgtgtgc

SEQ ID NO: 42314 - DNA, 25 bp, Homo sapien
cctggacacgtcctccctctgcagg

SEQ ID NO: 42315 - DNA, 25 bp, Homo sapien
cgcctcgaggcctggacacgtcctc

SEQ ID NO: 42316 - DNA, 25 bp, Homo sapien
ccgtgtcgatgagagtgttgtccaa

SEQ ID NO: 42317 - DNA, 25 bp, Homo sapien
tttcaaccagcaagagcggcccgcg

SEQ ID NO: 42318 - DNA, 25 bp, Homo sapien
ttgggtcaacactggggctaactct

SEQ ID NO: 42319 - DNA, 25 bp, Homo sapien
agccgtgtcccttcttgggtcaaca

SEQ ID NO: 42320 - DNA, 25 bp, Homo sapien
cttccctggtgtctttctgcttatc

SEQ ID NO: 42321 - DNA, 25 bp, Homo sapien
tctgcttatctctttcctccctggg

SEQ ID NO: 42322 - DNA, 25 bp, Homo sapien
cccagggtatggtctctcaagagcc

SEQ ID NO: 42323 - DNA, 25 bp, Homo sapien
ctcaagagccctggaaacgtgtgtc

SEQ ID NO: 42324 - DNA, 25 bp, Homo sapien
cgaggacatttggtcccggcctaca

SEQ ID NO: 42325 - DNA, 25 bp, Homo sapien
ggcctacactcctatccgcggaaga

SEQ ID NO: 42326 - DNA, 25 bp, Homo sapien
ctagcccatccgtctcatggctgta

SEQ ID NO: 42327 - DNA, 25 bp, Homo sapien
atattggtcatagcggtccacccgg

SEQ ID NO: 42328 - DNA, 25 bp, Homo sapien
acgcccagggatctggaacgctctg

SEQ ID NO: 42329 - DNA, 25 bp, Homo sapien
ggtcaccgatggtggaccacgcatc

SEQ ID NO: 42330 - DNA, 25 bp, Homo sapien
gccactacacgcaaccgggaacgga

SEQ ID NO: 42331 - DNA, 25 bp, Homo sapien
cggaaggactcctctctgacaggtg

SEQ ID NO: 42332 - DNA, 25 bp, Homo sapien
ttgtgtgtgcggatgtggacaaccg

SEQ ID NO: 42333 - DNA, 25 bp, Homo sapien
ttcgctgtgcccaattagctgctgc

SEQ ID NO: 42334 - DNA, 25 bp, Homo sapien
tgtgcccaattagctgctgccgcgc

SEQ ID NO: 42335 - DNA, 25 bp, Homo sapien
cttggagtccggagtaacttggcca

SEQ ID NO: 42336 - DNA, 25 bp, Homo sapien
tcttagccaggtggcagattctttc

SEQ ID NO: 42337 - DNA, 25 bp, Homo sapien
agccaggtggcagattctttcgctg

SEQ ID NO: 42338 - DNA, 25 bp, Homo sapien
cagattctttcgctgtgcccaatta

SEQ ID NO: 42339 - DNA, 25 bp, Homo sapien
gagtccggagtaacttggccaggct

SEQ ID NO: 42340 - DNA, 25 bp, Homo sapien
cgagcgtgagcgcaactccacaagc

SEQ ID NO: 42341 - DNA, 25 bp, Homo sapien
atcgctcgtgattctcgtccatcct

SEQ ID NO: 42342 - DNA, 25 bp, Homo sapien
ggtcactcgccggacggaacgctgc

SEQ ID NO: 42343 - DNA, 25 bp, Homo sapien
cggacggaacgctgcgcgcagccat

SEQ ID NO: 42344 - DNA, 25 bp, Homo sapien
ctaccataacggagagagagacaga

SEQ ID NO: 42345 - DNA, 25 bp, Homo sapien
ctcttttcttcagaggcaaagcacc

SEQ ID NO: 42346 - DNA, 25 bp, Homo sapien
aagctgaggagggttcctctgcaag

SEQ ID NO: 42347 - DNA, 25 bp, Homo sapien
ccagggccacatcgctcgtgattct

SEQ ID NO: 42348 - DNA, 25 bp, Homo sapien
tgatggtttgttcagaatcgcagaa

SEQ ID NO: 42349 - DNA, 25 bp, Homo sapien
agattgatggtttgttcagaatcgc

SEQ ID NO: 42350 - DNA, 25 bp, Homo sapien
ggagattgatggtttgttcagaatc

SEQ ID NO: 42351 - DNA, 25 bp, Homo sapien
gattgatggtttgttcagaatcgca

SEQ ID NO: 42352 - DNA, 25 bp, Homo sapien
ttgatggtttgttcagaatcgcaga

SEQ ID NO: 42353 - DNA, 25 bp, Homo sapien
gatggtttgttcagaatcgcagaag

SEQ ID NO: 42354 - DNA, 25 bp, Homo sapien
atggtttgttcagaatcgcagaagc

SEQ ID NO: 42355 - DNA, 25 bp, Homo sapien
attgatggtttgttcagaatcgcag

SEQ ID NO: 42356 - DNA, 25 bp, Homo sapien
gcaagggtcacacagcgccctgcta

SEQ ID NO: 42357 - DNA, 25 bp, Homo sapien
gtacctggaccagcgggttcacttg

SEQ ID NO: 42358 - DNA, 25 bp, Homo sapien
ccggaagttgcgcaaactcagcttg

SEQ ID NO: 42359 - DNA, 25 bp, Homo sapien
ggtgccgctctctccctcatttgag

SEQ ID NO: 42360 - DNA, 25 bp, Homo sapien
gccaccgggagtcctcaagcttttc

SEQ ID NO: 42361 - DNA, 25 bp, Homo sapien
ccggaattgagggagagcaaaagcc

SEQ ID NO: 42362 - DNA, 25 bp, Homo sapien
gcatccgtgggaggcatttgaatcc

SEQ ID NO: 42363 - DNA, 25 bp, Homo sapien
agggatctacctttcggcttcaaga

SEQ ID NO: 42364 - DNA, 25 bp, Homo sapien
cgagaggaggttccacagcgcgccc

SEQ ID NO: 42365 - DNA, 25 bp, Homo sapien
ggaaatctcgggcattcaccgtttg

SEQ ID NO: 42366 - DNA, 25 bp, Homo sapien
ccagcccgcatctctagcgagagga

SEQ ID NO: 42367 - DNA, 25 bp, Homo sapien
ctctagcgagaggaggttccacagc

SEQ ID NO: 42368 - DNA, 25 bp, Homo sapien
cgggcattcaccgtttgggtgaaga

SEQ ID NO: 42369 - DNA, 25 bp, Homo sapien
gcgggcctcaacatgtctcttcatt

SEQ ID NO: 42370 - DNA, 25 bp, Homo sapien
ggcacagccctgagtgacctgcgcg

SEQ ID NO: 42371 - DNA, 25 bp, Homo sapien
ggttctggacagacgtaggctgtca

SEQ ID NO: 42372 - DNA, 25 bp, Homo sapien
aggcgggtggtacagcctggagcat

SEQ ID NO: 42373 - DNA, 25 bp, Homo sapien
caagttggagcagagttcgccaggc

SEQ ID NO: 42374 - DNA, 25 bp, Homo sapien
tgctcaagttggagcagagttcgcc

SEQ ID NO: 42375 - DNA, 25 bp, Homo sapien
tacgcgccgccaacttgctcaagtt

SEQ ID NO: 42376 - DNA, 25 bp, Homo sapien
aggtaaagccctgcgctacgcgccg

SEQ ID NO: 42377 - DNA, 25 bp, Homo sapien
ctcccacgccgaggtaaagccctgc

SEQ ID NO: 42378 - DNA, 25 bp, Homo sapien
agcagagttcgccaggcgattgaag

SEQ ID NO: 42379 - DNA, 25 bp, Homo sapien
gagctgcgagggaccctggacccct

SEQ ID NO: 42380 - DNA, 25 bp, Homo sapien
atccgccacgctgcagcacaatgtg

SEQ ID NO: 42381 - DNA, 25 bp, Homo sapien
attcatcgagacatccgccacgctg

SEQ ID NO: 42382 - DNA, 25 bp, Homo sapien
ctgcagcacaatgtggccgagctct

SEQ ID NO: 42383 - DNA, 25 bp, Homo sapien
caagtcctgccacaatctggccgtg

SEQ ID NO: 42384 - DNA, 25 bp, Homo sapien
acaatctggccgtgctctgaagccc

SEQ ID NO: 42385 - DNA, 25 bp, Homo sapien
cgctgtggtgttcgactgtaaattc

SEQ ID NO: 42386 - DNA, 25 bp, Homo sapien
gcccttctgagagttggcgggtcac

SEQ ID NO: 42387 - DNA, 25 bp, Homo sapien
ggtcactgaggtgcattctgggctc

SEQ ID NO: 42388 - DNA, 25 bp, Homo sapien
ccgcctcgtggtgccggctggttct

SEQ ID NO: 42389 - DNA, 25 bp, Homo sapien
tgatccgcacctcgcgtgatccgta

SEQ ID NO: 42390 - DNA, 25 bp, Homo sapien
tgacccggagcgtgcgtgatccgca

SEQ ID NO: 42391 - DNA, 25 bp, Homo sapien
ctccctgtgtgacccggagcgtgcg

SEQ ID NO: 42392 - DNA, 25 bp, Homo sapien
agctatctttagctccctgtgtgac

SEQ ID NO: 42393 - DNA, 25 bp, Homo sapien
ggtgcggcgcagctatctttagctc

SEQ ID NO: 42394 - DNA, 25 bp, Homo sapien
gccgcccattctgagtggcagggac

SEQ ID NO: 42395 - DNA, 25 bp, Homo sapien
gtgccggctggttcttcgcgctcgc

SEQ ID NO: 42396 - DNA, 25 bp, Homo sapien
cttcctgttgccttaggggaacgtg

SEQ ID NO: 42397 - DNA, 25 bp, Homo sapien
cccaataggaacttgcttctgctcc

SEQ ID NO: 42398 - DNA, 25 bp, Homo sapien
cacattccggggctggcatttccta

SEQ ID NO: 42399 - DNA, 25 bp, Homo sapien
cttcctaggcgggacagacacctct

SEQ ID NO: 42400 - DNA, 25 bp, Homo sapien
acggccgacatggacccttcctagg

SEQ ID NO: 42401 - DNA, 25 bp, Homo sapien
ggaacgtggctttccctgcagagcc

SEQ ID NO: 42402 - DNA, 25 bp, Homo sapien
gtccggaccgctaacaagttgctta

SEQ ID NO: 42403 - DNA, 25 bp, Homo sapien
gcgatccgcataacggcagtgccga

SEQ ID NO: 42404 - DNA, 25 bp, Homo sapien
aagcgcagtcgtgacgtggcgttca

SEQ ID NO: 42405 - DNA, 25 bp, Homo sapien
aacagcgggccaagcgcagtcgtga

SEQ ID NO: 42406 - DNA, 25 bp, Homo sapien
caacggctctgaccgtctggcaggc

SEQ ID NO: 42407 - DNA, 25 bp, Homo sapien
ccgtaaagcgcgctggctgtgtcat

SEQ ID NO: 42408 - DNA, 25 bp, Homo sapien
tgcaggggactccaccggagccttg

SEQ ID NO: 42409 - DNA, 25 bp, Homo sapien
ttccggttagcgacaacggctctga

SEQ ID NO: 42410 - DNA, 25 bp, Homo sapien
ggctgtgtcatcttccggttagcga

SEQ ID NO: 42411 - DNA, 25 bp, Homo sapien
agttgtcagatttcaccgggccgta

SEQ ID NO: 42412 - DNA, 25 bp, Homo sapien
gcaggcaggaaacgccggccgggct

SEQ ID NO: 42413 - DNA, 25 bp, Homo sapien
ctcagcgacgcaggcaggaaacgcc

SEQ ID NO: 42414 - DNA, 25 bp, Homo sapien
agctcagcgacgcaggcaggaaacg

SEQ ID NO: 42415 - DNA, 25 bp, Homo sapien
gattccctccagcattccgggccag

SEQ ID NO: 42416 - DNA, 25 bp, Homo sapien
ttggattccctccagcattccgggc

SEQ ID NO: 42417 - DNA, 25 bp, Homo sapien
tttggattccctccagcattccggg

SEQ ID NO: 42418 - DNA, 25 bp, Homo sapien
cgtttggattccctccagcattccg

SEQ ID NO: 42419 - DNA, 25 bp, Homo sapien
cgccctgcgtttggattccctccag

SEQ ID NO: 42420 - DNA, 25 bp, Homo sapien
aggcaagctggtttttcccaggctc

SEQ ID NO: 42421 - DNA, 25 bp, Homo sapien
gaacacttcgggctcactgacgcgc

SEQ ID NO: 42422 - DNA, 25 bp, Homo sapien
gctggacccaaagtcgctgcccggg

SEQ ID NO: 42423 - DNA, 25 bp, Homo sapien
aacaaagtcggggtgcacggcctct

SEQ ID NO: 42424 - DNA, 25 bp, Homo sapien
caatgtctttcaggcgggtgcgccc

SEQ ID NO: 42425 - DNA, 25 bp, Homo sapien
gaccggcgcccagcaatgtctttca

SEQ ID NO: 42426 - DNA, 25 bp, Homo sapien
gaacatctgcccttcgcttttgtgg

SEQ ID NO: 42427 - DNA, 25 bp, Homo sapien
cctggaacatctggccgcgaacatc

SEQ ID NO: 42428 - DNA, 25 bp, Homo sapien
acgtcacaggcctggcgtctaacgg

SEQ ID NO: 42429 - DNA, 25 bp, Homo sapien
gcacgggaactagctagaccagttt

SEQ ID NO: 42430 - DNA, 25 bp, Homo sapien
cagcctgacagtccgtccgggtttt

SEQ ID NO: 42431 - DNA, 25 bp, Homo sapien
cctggcgtctaacggtctgagccgc

SEQ ID NO: 42432 - DNA, 25 bp, Homo sapien
agccgctggttcagacgctgacaca

SEQ ID NO: 42433 - DNA, 25 bp, Homo sapien
gggagactgtagctccgcagctgcc

SEQ ID NO: 42434 - DNA, 25 bp, Homo sapien
gacgctgacacagaccggcccggga

SEQ ID NO: 42435 - DNA, 25 bp, Homo sapien
gaccagtttgtcgtctccatggcga

SEQ ID NO: 42436 - DNA, 25 bp, Homo sapien
tgctgctctacgacatgaacggctg

SEQ ID NO: 42437 - DNA, 25 bp, Homo sapien
ctgtttcagccagtcgccaagaatc

SEQ ID NO: 42438 - DNA, 25 bp, Homo sapien
acggctgttactcacgcctcaagga

SEQ ID NO: 42439 - DNA, 25 bp, Homo sapien
ctagatcatccttataccgacgggg

SEQ ID NO: 42440 - DNA, 25 bp, Homo sapien
tcgcatcttgtgtcgctgaagcgcc

SEQ ID NO: 42441 - DNA, 25 bp, Homo sapien
tggagattctccagcacgtcatcga

SEQ ID NO: 42442 - DNA, 25 bp, Homo sapien
ttctcgttttcacaggcggcatgcg

SEQ ID NO: 42443 - DNA, 25 bp, Homo sapien
tcatcgactacatcagggaccttca

SEQ ID NO: 42444 - DNA, 25 bp, Homo sapien
tgcctactttctgcccggatctctg

SEQ ID NO: 42445 - DNA, 25 bp, Homo sapien
cagctcggatatcgtgtccctggca

SEQ ID NO: 42446 - DNA, 25 bp, Homo sapien
ccgctgatctcgagcgcttttttaa

SEQ ID NO: 42447 - DNA, 25 bp, Homo sapien
tcggacttgagcgagcgcttttcta

SEQ ID NO: 42448 - DNA, 25 bp, Homo sapien
tttgcaacgctccaagtcggacttg

SEQ ID NO: 42449 - DNA, 25 bp, Homo sapien
ctcagcagcctcatcgacttgtgtg

SEQ ID NO: 42450 - DNA, 25 bp, Homo sapien
aagccctcgggatatgcagcagcca

SEQ ID NO: 42451 - DNA, 25 bp, Homo sapien
agccgctctttagccctgagactcg

SEQ ID NO: 42452 - DNA, 25 bp, Homo sapien
tgcggagctatttaacctgagcatc

SEQ ID NO: 42453 - DNA, 25 bp, Homo sapien
cgccattcaggcacactctggattc

SEQ ID NO: 42454 - DNA, 25 bp, Homo sapien
ggcccgaggaatgcggagctattta

SEQ ID NO: 42455 - DNA, 25 bp, Homo sapien
acatgcagggcctttttccagggga

SEQ ID NO: 42456 - DNA, 25 bp, Homo sapien
ggcacagccgcgctagacaaacagc

SEQ ID NO: 42457 - DNA, 25 bp, Homo sapien
cggcttgcataagaggctccgggcc

SEQ ID NO: 42458 - DNA, 25 bp, Homo sapien
cggcctgggagcgtttccatcagct

SEQ ID NO: 42459 - DNA, 25 bp, Homo sapien
ctggattccacgtttccctctgttc

SEQ ID NO: 42460 - DNA, 25 bp, Homo sapien
ggtgattcccatagctccgcagagc

SEQ ID NO: 42461 - DNA, 25 bp, Homo sapien
tgtctgtccacggttttagaagcgc

SEQ ID NO: 42462 - DNA, 25 bp, Homo sapien
accctcagcgttcggtgattcccat

SEQ ID NO: 42463 - DNA, 25 bp, Homo sapien
tgagctgctgccgagacaccctcag

SEQ ID NO: 42464 - DNA, 25 bp, Homo sapien
gacgtcctccgagcctgagctgctg

SEQ ID NO: 42465 - DNA, 25 bp, Homo sapien
agagctgcgggtcttcccgcgacgt

SEQ ID NO: 42466 - DNA, 25 bp, Homo sapien
ttgctggacggtccaccagagctgc

SEQ ID NO: 42467 - DNA, 25 bp, Homo sapien
ttagaagcgcttgctggacggtcca

SEQ ID NO: 42468 - DNA, 25 bp, Homo sapien
aggtcgcgctcccactgccgagccc

SEQ ID NO: 42469 - DNA, 25 bp, Homo sapien
cgctcccacgccctgccgaagcagg

SEQ ID NO: 42470 - DNA, 25 bp, Homo sapien
ggctcggtctcctgccttcgccgct

SEQ ID NO: 42471 - DNA, 25 bp, Homo sapien
tcgctgggcagacccaggtcgcgct

SEQ ID NO: 42472 - DNA, 25 bp, Homo sapien
tcagttgctcgctgggcagacccag

SEQ ID NO: 42473 - DNA, 25 bp, Homo sapien
gttctcagttgctcgctgggcagac

SEQ ID NO: 42474 - DNA, 25 bp, Homo sapien
cctccgcagcgggttctcagttgct

SEQ ID NO: 42475 - DNA, 25 bp, Homo sapien
tgccgaagcaggacgttcccacgct

SEQ ID NO: 42476 - DNA, 25 bp, Homo sapien
gcgggagcatacagacctgcctcta

SEQ ID NO: 42477 - DNA, 25 bp, Homo sapien
gttctttccgcgctcttgactccta

SEQ ID NO: 42478 - DNA, 25 bp, Homo sapien
aactgcttggggcacgttctttccg

SEQ ID NO: 42479 - DNA, 25 bp, Homo sapien
cgtagtttccgcttcttgtcacatg

SEQ ID NO: 42480 - DNA, 25 bp, Homo sapien
caagggcctatttcagcgtagtttc

SEQ ID NO: 42481 - DNA, 25 bp, Homo sapien
cctgcctctagactgctaagtgata

SEQ ID NO: 42482 - DNA, 25 bp, Homo sapien
agcggctccgcattccgagttactg

SEQ ID NO: 42483 - DNA, 25 bp, Homo sapien
cgcctccggatttgacagacagttc

SEQ ID NO: 42484 - DNA, 25 bp, Homo sapien
tggctggcaaaaaaaccagctccgg

SEQ ID NO: 42485 - DNA, 25 bp, Homo sapien
gccggtaactcagccggcctcgcgg

SEQ ID NO: 42486 - DNA, 25 bp, Homo sapien
gatgccggtaactcagccggcctcg

SEQ ID NO: 42487 - DNA, 25 bp, Homo sapien
ggatgccggtaactcagccggcctc

SEQ ID NO: 42488 - DNA, 25 bp, Homo sapien
gggatgccggtaactcagccggcct

SEQ ID NO: 42489 - DNA, 25 bp, Homo sapien
ctggcaaaaaaaccagctccggccg

SEQ ID NO: 42490 - DNA, 25 bp, Homo sapien
tccggccggagggatcatgcgaccc

SEQ ID NO: 42491 - DNA, 25 bp, Homo sapien
aaaccagctccggccggagggatca

SEQ ID NO: 42492 - DNA, 25 bp, Homo sapien
cacaggaattgcgaagctcaggaac

SEQ ID NO: 42493 - DNA, 25 bp, Homo sapien
agcccagaaggcgacacaggaattg

SEQ ID NO: 42494 - DNA, 25 bp, Homo sapien
ccagaaggcgacacaggaattgcga

SEQ ID NO: 42495 - DNA, 25 bp, Homo sapien
cgacacaggaattgcgaagctcagg

SEQ ID NO: 42496 - DNA, 25 bp, Homo sapien
caggaattgcgaagctcaggaacca

SEQ ID NO: 42497 - DNA, 25 bp, Homo sapien
ggaattgcgaagctcaggaaccagc

SEQ ID NO: 42498 - DNA, 25 bp, Homo sapien
tccatcgcccggatcgagggcggcc

SEQ ID NO: 42499 - DNA, 25 bp, Homo sapien
aggcgacacaggaattgcgaagctc

SEQ ID NO: 42500 - DNA, 25 bp, Homo sapien
ccttgagtgactggcatcaggaccg

SEQ ID NO: 42501 - DNA, 25 bp, Homo sapien
ccctcgcggtagatctggggaatcg

SEQ ID NO: 42502 - DNA, 25 bp, Homo sapien
cttgcaagctcagtcacttccggtg

SEQ ID NO: 42503 - DNA, 25 bp, Homo sapien
acgcaagagctcttcgcggccgagt

SEQ ID NO: 42504 - DNA, 25 bp, Homo sapien
cccggtagcttccagacgcaagagc

SEQ ID NO: 42505 - DNA, 25 bp, Homo sapien
aaggctcctattgggcgcaacggct

SEQ ID NO: 42506 - DNA, 25 bp, Homo sapien
tagcggcttctcgagctcactaggc

SEQ ID NO: 42507 - DNA, 25 bp, Homo sapien
acaggcccaaagtggctttctggcg

SEQ ID NO: 42508 - DNA, 25 bp, Homo sapien
ggccacgcttctcttggcgacagga

SEQ ID NO: 42509 - DNA, 25 bp, Homo sapien
aggctgtcggctaataacggtaacg

SEQ ID NO: 42510 - DNA, 25 bp, Homo sapien
tcgcgcttcgttgtcagatctgagg

SEQ ID NO: 42511 - DNA, 25 bp, Homo sapien
aacgatactgaatgagtcccgcggc

SEQ ID NO: 42512 - DNA, 25 bp, Homo sapien
cgctctgattggtgcattcgactag

SEQ ID NO: 42513 - DNA, 25 bp, Homo sapien
gttgttcgctggtacctccttctga

SEQ ID NO: 42514 - DNA, 25 bp, Homo sapien
ttgctgtgaagtccgtccgggaaac

SEQ ID NO: 42515 - DNA, 25 bp, Homo sapien
tccttctgacttccggtattgctgc

SEQ ID NO: 42516 - DNA, 25 bp, Homo sapien
ctagagtgacaggatctgaaccacc

SEQ ID NO: 42517 - DNA, 25 bp, Homo sapien
cccgaaatcgcatcctagagtgaca

SEQ ID NO: 42518 - DNA, 25 bp, Homo sapien
ctgaaccacctccaaaggccgtttg

SEQ ID NO: 42519 - DNA, 25 bp, Homo sapien
gtttgatttatcaccagcccggctt

SEQ ID NO: 42520 - DNA, 25 bp, Homo sapien
tccctgccgcctcttgctatttata

SEQ ID NO: 42521 - DNA, 25 bp, Homo sapien
gctatttataaagaggtttccattc

SEQ ID NO: 42522 - DNA, 25 bp, Homo sapien
gtttccattcctgatgaccgcctgc

SEQ ID NO: 42523 - DNA, 25 bp, Homo sapien
cctgccagccttcagggcgagcggt

SEQ ID NO: 42524 - DNA, 25 bp, Homo sapien
agctgccgtgctcaaacatgtcgtg

SEQ ID NO: 42525 - DNA, 25 bp, Homo sapien
cggtagaaggcgaatcggcccatga

SEQ ID NO: 42526 - DNA, 25 bp, Homo sapien
cctcagcacctgtctgccgggtgaa

SEQ ID NO: 42527 - DNA, 25 bp, Homo sapien
aacatgtcgtggcagtcagggtcca

SEQ ID NO: 42528 - DNA, 25 bp, Homo sapien
gcccttgcctggcttgcggtcatcg

SEQ ID NO: 42529 - DNA, 25 bp, Homo sapien
ggcgtaggaagctgccgtgctcaaa

SEQ ID NO: 42530 - DNA, 25 bp, Homo sapien
cttgacaaagcactcgttgagtgac

SEQ ID NO: 42531 - DNA, 25 bp, Homo sapien
cggcccatgatgtagcggtagatgc

SEQ ID NO: 42532 - DNA, 25 bp, Homo sapien
gcctgcgctccaccttgttgggctg

SEQ ID NO: 42533 - DNA, 25 bp, Homo sapien
accttgttgggctgcgccagtacag

SEQ ID NO: 42534 - DNA, 25 bp, Homo sapien
acaggcgcttggtgaacacgccctc

SEQ ID NO: 42535 - DNA, 25 bp, Homo sapien
cctgcaacacgtgggcgctgggcaa

SEQ ID NO: 42536 - DNA, 25 bp, Homo sapien
agaagagccacacgtgcagccagca

SEQ ID NO: 42537 - DNA, 25 bp, Homo sapien
gggaagcgaacctgctgcaacgtga

SEQ ID NO: 42538 - DNA, 25 bp, Homo sapien
accagcgctgcggagagaagagcca

SEQ ID NO: 42539 - DNA, 25 bp, Homo sapien
cggactcagacgacagcgctgggct

SEQ ID NO: 42540 - DNA, 25 bp, Homo sapien
acgctgactgcagacgcggacgagc

SEQ ID NO: 42541 - DNA, 25 bp, Homo sapien
tgcatcctcacttgccgcccttgcg

SEQ ID NO: 42542 - DNA, 25 bp, Homo sapien
aagagaaagtctgcttgacgcgcgc

SEQ ID NO: 42543 - DNA, 25 bp, Homo sapien
aaagtctgcttgacgcgcgccagca

SEQ ID NO: 42544 - DNA, 25 bp, Homo sapien
ctgcacggttccctcggaggctgct

SEQ ID NO: 42545 - DNA, 25 bp, Homo sapien
gcaactcctcctcgtcgcggaaggg

SEQ ID NO: 42546 - DNA, 25 bp, Homo sapien
cgaccttcgcccttctccgagcgtc

SEQ ID NO: 42547 - DNA, 25 bp, Homo sapien
gggagccacggctggactgcatcct

SEQ ID NO: 42548 - DNA, 25 bp, Homo sapien
gcgctctggcggctcagcgtgttca

SEQ ID NO: 42549 - DNA, 25 bp, Homo sapien
cagcgtgttcagcagcttcgccttc

SEQ ID NO: 42550 - DNA, 25 bp, Homo sapien
cttcgccttcttgctgaggatgctg

SEQ ID NO: 42551 - DNA, 25 bp, Homo sapien
tcttgctgaggatgctggccagctc

SEQ ID NO: 42552 - DNA, 25 bp, Homo sapien
ctccagggcctgcaaccgcttctcg

SEQ ID NO: 42553 - DNA, 25 bp, Homo sapien
aaccgcttctcgagcgcgctgcggg

SEQ ID NO: 42554 - DNA, 25 bp, Homo sapien
gcacagaggtgagcctggcatcctc

SEQ ID NO: 42555 - DNA, 25 bp, Homo sapien
tggcatcctcgcgaagcacgcaccc

SEQ ID NO: 42556 - DNA, 25 bp, Homo sapien
cgacagccgcggtctcgagtcacag

SEQ ID NO: 42557 - DNA, 25 bp, Homo sapien
cccgggaagcgatccggtcacagct

SEQ ID NO: 42558 - DNA, 25 bp, Homo sapien
agcgatccggtcacagctgccctga

SEQ ID NO: 42559 - DNA, 25 bp, Homo sapien
agaccggcgagaacagaaggtcaga

SEQ ID NO: 42560 - DNA, 25 bp, Homo sapien
cgcctcggcttctagcagaaacgtg

SEQ ID NO: 42561 - DNA, 25 bp, Homo sapien
tcgagtcacagggacacggagatgc

SEQ ID NO: 42562 - DNA, 25 bp, Homo sapien
catgccattgcccatgatcccgggg

SEQ ID NO: 42563 - DNA, 25 bp, Homo sapien
ttctagcagaaacgtgacggggctg

SEQ ID NO: 42564 - DNA, 25 bp, Homo sapien
cccagatgcttttatcgtccctaga

SEQ ID NO: 42565 - DNA, 25 bp, Homo sapien
cagcagagggattcaaaatcggttg

SEQ ID NO: 42566 - DNA, 25 bp, Homo sapien
cgagagcatgcccttggctcatcca

SEQ ID NO: 42567 - DNA, 25 bp, Homo sapien
ggcgcctgtctgtcgccttggcaac

SEQ ID NO: 42568 - DNA, 25 bp, Homo sapien
ttggcaacgggacgcataagcacgc

SEQ ID NO: 42569 - DNA, 25 bp, Homo sapien
tatgtcgcgaccgaaggtaggagtc

SEQ ID NO: 42570 - DNA, 25 bp, Homo sapien
taggagtcgacctgacccagatgct

SEQ ID NO: 42571 - DNA, 25 bp, Homo sapien
ttctcgcggaggaattccgaaaaca

SEQ ID NO: 42572 - DNA, 25 bp, Homo sapien
actgcgtggccagttctttcgaagc

SEQ ID NO: 42573 - DNA, 25 bp, Homo sapien
cagcgtgacgccctcaagttttggc

SEQ ID NO: 42574 - DNA, 25 bp, Homo sapien
ggtccgccgtccttaaatctcttca

SEQ ID NO: 42575 - DNA, 25 bp, Homo sapien
gcccagagctcaattcgcgccgatg

SEQ ID NO: 42576 - DNA, 25 bp, Homo sapien
acaccggatgccacttcatatttgg

SEQ ID NO: 42577 - DNA, 25 bp, Homo sapien
aagcactctgcttcaccgactgtga

SEQ ID NO: 42578 - DNA, 25 bp, Homo sapien
cacgagtaccgcactctgaggttta

SEQ ID NO: 42579 - DNA, 25 bp, Homo sapien
ggagttcctcccatttcttcacagt

SEQ ID NO: 42580 - DNA, 25 bp, Homo sapien
gctcacttagtagcggccgaatatt

SEQ ID NO: 42581 - DNA, 25 bp, Homo sapien
tctgcctcgggtgatagcatagcgc

SEQ ID NO: 42582 - DNA, 25 bp, Homo sapien
tggtgcgcaggctctaacactagtg

SEQ ID NO: 42583 - DNA, 25 bp, Homo sapien
ccgaatatttatcggcccaggtctg

SEQ ID NO: 42584 - DNA, 25 bp, Homo sapien
tcggagccgttaaccgcctgtccag

SEQ ID NO: 42585 - DNA, 25 bp, Homo sapien
gcctgtccaggtcaactcactgcga

SEQ ID NO: 42586 - DNA, 25 bp, Homo sapien
ggcgagctcctccacttctacaagg

SEQ ID NO: 42587 - DNA, 25 bp, Homo sapien
ttctacaaggtaccgcagcactcgc

SEQ ID NO: 42588 - DNA, 25 bp, Homo sapien
tctacgactactcggagcccgcagg

SEQ ID NO: 42589 - DNA, 25 bp, Homo sapien
caacatggccgcgaagtcggatgga

SEQ ID NO: 42590 - DNA, 25 bp, Homo sapien
ctgctcgtgttcttctccgacggtg

SEQ ID NO: 42591 - DNA, 25 bp, Homo sapien
tcgctggtcgtgcagttactgagct

SEQ ID NO: 42592 - DNA, 25 bp, Homo sapien
cttcagcctcaccttgctgttcgtg

SEQ ID NO: 42593 - DNA, 25 bp, Homo sapien
tgcagaatcaacacacctacttcag

SEQ ID NO: 42594 - DNA, 25 bp, Homo sapien
ggcggcctcctactacctgcagaat

SEQ ID NO: 42595 - DNA, 25 bp, Homo sapien
tccgctggttcgtctacgactactc

SEQ ID NO: 42596 - DNA, 25 bp, Homo sapien
actggcagatgctgttcgagagcgc

SEQ ID NO: 42597 - DNA, 25 bp, Homo sapien
ctagtgctgcagctcagcctgctgg

SEQ ID NO: 42598 - DNA, 25 bp, Homo sapien
gcagcgcgccgcagctagtgctgca

SEQ ID NO: 42599 - DNA, 25 bp, Homo sapien
ttcgagagcgccgacgtgagcatgc

SEQ ID NO: 42600 - DNA, 25 bp, Homo sapien
gcggcgccacttctactggcagatg

SEQ ID NO: 42601 - DNA, 25 bp, Homo sapien
gcgggagcctgagcaccgcgtcctt

SEQ ID NO: 42602 - DNA, 25 bp, Homo sapien
agctcagcctgctggtgcaccgcgg

SEQ ID NO: 42603 - DNA, 25 bp, Homo sapien
cgacgtgagcatgctgcgcttgctg

SEQ ID NO: 42604 - DNA, 25 bp, Homo sapien
tggcctcctaccagaaggtgctgcg

SEQ ID NO: 42605 - DNA, 25 bp, Homo sapien
ctacatcttctgctggttcaacgtc

SEQ ID NO: 42606 - DNA, 25 bp, Homo sapien
ctacaacatggtcgtgggcatcatc

SEQ ID NO: 42607 - DNA, 25 bp, Homo sapien
tcatccaaggggagacggacttctg

SEQ ID NO: 42608 - DNA, 25 bp, Homo sapien
cccactggtgcgtcatgaccttctg

SEQ ID NO: 42609 - DNA, 25 bp, Homo sapien
tggcatcttcatcgtggcccactgg

SEQ ID NO: 42610 - DNA, 25 bp, Homo sapien
gccagcgtctacaagctctattttg

SEQ ID NO: 42611 - DNA, 25 bp, Homo sapien
cactgcatcgtcctgctggagaacg

SEQ ID NO: 42612 - DNA, 25 bp, Homo sapien
agctgccgctgaagaccacggcgga

SEQ ID NO: 42613 - DNA, 25 bp, Homo sapien
acgcgctgcacctgctagtgctcaa

SEQ ID NO: 42614 - DNA, 25 bp, Homo sapien
gaagagctcattctgcgaatcccta

SEQ ID NO: 42615 - DNA, 25 bp, Homo sapien
acctggcgcgacaatgaagagctca

SEQ ID NO: 42616 - DNA, 25 bp, Homo sapien
tgctgctcacctggcgcgacaatga

SEQ ID NO: 42617 - DNA, 25 bp, Homo sapien
ggacagcatcctgagcctgtctgcc

SEQ ID NO: 42618 - DNA, 25 bp, Homo sapien
tctgcgaatccctacgcacgagatc

SEQ ID NO: 42619 - DNA, 25 bp, Homo sapien
agcaggacagcatcctgagcctgtc

SEQ ID NO: 42620 - DNA, 25 bp, Homo sapien
ctctcctaggtctgggtgtggaccc

SEQ ID NO: 42621 - DNA, 25 bp, Homo sapien
ggcccgaaagtgtggaagcggagtg

SEQ ID NO: 42622 - DNA, 25 bp, Homo sapien
ccagagccgcgaggtcaggtggcca

SEQ ID NO: 42623 - DNA, 25 bp, Homo sapien
gtcgtggggagcgtggaagccacct

SEQ ID NO: 42624 - DNA, 25 bp, Homo sapien
cccggactctcctaggtctgggtgt

SEQ ID NO: 42625 - DNA, 25 bp, Homo sapien
gagcggcgccacaccatctgcagcc

SEQ ID NO: 42626 - DNA, 25 bp, Homo sapien
gccacaccatctgcagcctggactg

SEQ ID NO: 42627 - DNA, 25 bp, Homo sapien
cgacggcagacgttcagcggcagct

SEQ ID NO: 42628 - DNA, 25 bp, Homo sapien
agggcggcatcctcactgacagctt

SEQ ID NO: 42629 - DNA, 25 bp, Homo sapien
tcatcccggaccaggacatcggcta

SEQ ID NO: 42630 - DNA, 25 bp, Homo sapien
catcggctacttcgagggcttcctg

SEQ ID NO: 42631 - DNA, 25 bp, Homo sapien
gcgacgccgcagaagacaactacct

SEQ ID NO: 42632 - DNA, 25 bp, Homo sapien
gctggctgacatcacgcacgacatc

SEQ ID NO: 42633 - DNA, 25 bp, Homo sapien
ccgcagtgcgcagctacgatggcgc

SEQ ID NO: 42634 - DNA, 25 bp, Homo sapien
cactgacagcttcggccgcatcaag

SEQ ID NO: 42635 - DNA, 25 bp, Homo sapien
cgcatcaagcgcagcatgagctcca

SEQ ID NO: 42636 - DNA, 25 bp, Homo sapien
actgttgcggactgctggattcccg

SEQ ID NO: 42637 - DNA, 25 bp, Homo sapien
tcagacagtgcaggacgagaaacgc

SEQ ID NO: 42638 - DNA, 25 bp, Homo sapien
tttatccaccacttctctgggccgt

SEQ ID NO: 42639 - DNA, 25 bp, Homo sapien
agctcgggagcacatcagaggctta

SEQ ID NO: 42640 - DNA, 25 bp, Homo sapien
cctctagttctagaaagtcagtttc

SEQ ID NO: 42641 - DNA, 25 bp, Homo sapien
ggcccgtgcagtgactttatccacc

SEQ ID NO: 42642 - DNA, 25 bp, Homo sapien
gatggggcttcacagaacccgggaa

SEQ ID NO: 42643 - DNA, 25 bp, Homo sapien
cgtctgaatcttcggggaggtgtta

SEQ ID NO: 42644 - DNA, 25 bp, Homo sapien
ttcagggcgagcatgtccacggcgt

SEQ ID NO: 42645 - DNA, 25 bp, Homo sapien
cacgcgcgcgcaggtacagatgcgc

SEQ ID NO: 42646 - DNA, 25 bp, Homo sapien
agccggcggtcttgcgtctttcccg

SEQ ID NO: 42647 - DNA, 25 bp, Homo sapien
gatctgtcccgcagccggcggtctt

SEQ ID NO: 42648 - DNA, 25 bp, Homo sapien
tcggggccctcgagttcgatctgtc

SEQ ID NO: 42649 - DNA, 25 bp, Homo sapien
ttcttccttcggttcagggcgagca

SEQ ID NO: 42650 - DNA, 25 bp, Homo sapien
cttgtaccttgcttcttccttcggt

SEQ ID NO: 42651 - DNA, 25 bp, Homo sapien
tcgagttcgatctgtcccgcagccg

SEQ ID NO: 42652 - DNA, 25 bp, Homo sapien
gccctcctccttgttcgcgtcctcg

SEQ ID NO: 42653 - DNA, 25 bp, Homo sapien
ccctctgcaccacaggtttctgggg

SEQ ID NO: 42654 - DNA, 25 bp, Homo sapien
gacccggccattttccaggctcgga

SEQ ID NO: 42655 - DNA, 25 bp, Homo sapien
caccacaggtttctggggcttcgtc

SEQ ID NO: 42656 - DNA, 25 bp, Homo sapien
cctctcggatgtgattcgccggggt

SEQ ID NO: 42657 - DNA, 25 bp, Homo sapien
agtagtcgccgtggaggccgcttcc

SEQ ID NO: 42658 - DNA, 25 bp, Homo sapien
aactgcccgatggggatgcgaccgc

SEQ ID NO: 42659 - DNA, 25 bp, Homo sapien
tttccaggctcggagtagtcgccgt

SEQ ID NO: 42660 - DNA, 25 bp, Homo sapien
ttacgcgaaagctaacagaatctgc

SEQ ID NO: 42661 - DNA, 25 bp, Homo sapien
tggcagcttccctccgtggattcca

SEQ ID NO: 42662 - DNA, 25 bp, Homo sapien
gtgcgcctgcgcaagttacgcgaaa

SEQ ID NO: 42663 - DNA, 25 bp, Homo sapien
tgccggttcgctctccggatttaaa

SEQ ID NO: 42664 - DNA, 25 bp, Homo sapien
cagacttggaggacgtttaccctca

SEQ ID NO: 42665 - DNA, 25 bp, Homo sapien
cggagaaggcccagacaaaatgtgc

SEQ ID NO: 42666 - DNA, 25 bp, Homo sapien
ggccacattggaaatcccgggcatg

SEQ ID NO: 42667 - DNA, 25 bp, Homo sapien
gctaggcgggctcggatatttttaa

SEQ ID NO: 42668 - DNA, 25 bp, Homo sapien
gggatctctatggtcccgcccgccc

SEQ ID NO: 42669 - DNA, 25 bp, Homo sapien
gcgcgcggacgcagcgagacggcct

SEQ ID NO: 42670 - DNA, 25 bp, Homo sapien
gtcgggccattgtgcggtgcattgt

SEQ ID NO: 42671 - DNA, 25 bp, Homo sapien
tgccgcgggatctctatggtcccgc

SEQ ID NO: 42672 - DNA, 25 bp, Homo sapien
ttcccgggccgacatgggcgccgcc

SEQ ID NO: 42673 - DNA, 25 bp, Homo sapien
cgctgagcgtgtctttcctgctgct

SEQ ID NO: 42674 - DNA, 25 bp, Homo sapien
tgagcgtgtctttcctgctgctgct

SEQ ID NO: 42675 - DNA, 25 bp, Homo sapien
cggtgccgcgggatctctatggtcc

SEQ ID NO: 42676 - DNA, 25 bp, Homo sapien
tgcctcctaggcatcctttggtagt

SEQ ID NO: 42677 - DNA, 25 bp, Homo sapien
cagggctaatcctgtggccgcctgg

SEQ ID NO: 42678 - DNA, 25 bp, Homo sapien
catcctttggtagtccggacggcct

SEQ ID NO: 42679 - DNA, 25 bp, Homo sapien
cctaggcatcctttggtagtccgga

SEQ ID NO: 42680 - DNA, 25 bp, Homo sapien
ttgctgtcccgcgagccggagcatc

SEQ ID NO: 42681 - DNA, 25 bp, Homo sapien
tggggttttccctgcgacctgcgcc

SEQ ID NO: 42682 - DNA, 25 bp, Homo sapien
caccgagcagggctaatcctgtggc

SEQ ID NO: 42683 - DNA, 25 bp, Homo sapien
ctgcctggctttgctgtcccgcgag

SEQ ID NO: 42684 - DNA, 25 bp, Homo sapien
ccagagaggccgttgggactacgac

SEQ ID NO: 42685 - DNA, 25 bp, Homo sapien
gatgtggcgcctttttccgctcgcc

SEQ ID NO: 42686 - DNA, 25 bp, Homo sapien
cattccttagcgatcgcggggcagc

SEQ ID NO: 42687 - DNA, 25 bp, Homo sapien
cggagccgccgcattccttagcgat

SEQ ID NO: 42688 - DNA, 25 bp, Homo sapien
ccgttcctagctgaggtcggtgcta

SEQ ID NO: 42689 - DNA, 25 bp, Homo sapien
cgccgaagggaaagccgcgtctcgc

SEQ ID NO: 42690 - DNA, 25 bp, Homo sapien
gaagtgtggtccacgcgcttcacgc

SEQ ID NO: 42691 - DNA, 25 bp, Homo sapien
tgtctcagtccctcagcagagcggg

SEQ ID NO: 42692 - DNA, 25 bp, Homo sapien
tcacacaggttgatgggctgatcct

SEQ ID NO: 42693 - DNA, 25 bp, Homo sapien
cttgtcacacaggttgatgggctga

SEQ ID NO: 42694 - DNA, 25 bp, Homo sapien
tgccattcatctcggggaaggcagg

SEQ ID NO: 42695 - DNA, 25 bp, Homo sapien
ctcggcggccgtggtgaagtccatg

SEQ ID NO: 42696 - DNA, 25 bp, Homo sapien
gcgccgttgccattcatctcgggga

SEQ ID NO: 42697 - DNA, 25 bp, Homo sapien
cgttgccattcatctcggggaaggc

SEQ ID NO: 42698 - DNA, 25 bp, Homo sapien
ggcaccgcagccatccgaggggtag

SEQ ID NO: 42699 - DNA, 25 bp, Homo sapien
agggtcgccctgcgtgctgctcgac

SEQ ID NO: 42700 - DNA, 25 bp, Homo sapien
ggaagcgcttcgaggaagatccttg

SEQ ID NO: 42701 - DNA, 25 bp, Homo sapien
gactccgtacctgggctggaagcga

SEQ ID NO: 42702 - DNA, 25 bp, Homo sapien
cttggcccaaataaagtgactcagg

SEQ ID NO: 42703 - DNA, 25 bp, Homo sapien
ccaggagagggagacttggcccaaa

SEQ ID NO: 42704 - DNA, 25 bp, Homo sapien
tgggatctgtgcctacccatcgctc

SEQ ID NO: 42705 - DNA, 25 bp, Homo sapien
agaaggcgctgggatctgtgcctac

SEQ ID NO: 42706 - DNA, 25 bp, Homo sapien
aagatccttgcacggggctgagccc

SEQ ID NO: 42707 - DNA, 25 bp, Homo sapien
aataaagtgactcaggcaccctcag

SEQ ID NO: 42708 - DNA, 25 bp, Homo sapien
gggacagcctgactttccattctca

SEQ ID NO: 42709 - DNA, 25 bp, Homo sapien
gggccgcgctaatgactgttgacag

SEQ ID NO: 42710 - DNA, 25 bp, Homo sapien
ggcaggcaggtaatgagagtaacca

SEQ ID NO: 42711 - DNA, 25 bp, Homo sapien
ctaggacagggaatcgggagtcacc

SEQ ID NO: 42712 - DNA, 25 bp, Homo sapien
ccatggcaacccaccagaggaagtg

SEQ ID NO: 42713 - DNA, 25 bp, Homo sapien
gtattctgcaggagacgttaatccc

SEQ ID NO: 42714 - DNA, 25 bp, Homo sapien
gtaattagataccagctgtcagtgc

SEQ ID NO: 42715 - DNA, 25 bp, Homo sapien
cccaccagaggaagtgtattctgca

SEQ ID NO: 42716 - DNA, 25 bp, Homo sapien
ccttggagcgcacccagaactggaa

SEQ ID NO: 42717 - DNA, 25 bp, Homo sapien
tcagggacacacgttcggacacaca

SEQ ID NO: 42718 - DNA, 25 bp, Homo sapien
cgacacacggacaacctcagggaca

SEQ ID NO: 42719 - DNA, 25 bp, Homo sapien
ttgaccggcacatacaccacttggc

SEQ ID NO: 42720 - DNA, 25 bp, Homo sapien
ggaacttgcctttctcgccggctgc

SEQ ID NO: 42721 - DNA, 25 bp, Homo sapien
ccgctggtatttgctgcgtgtcacc

SEQ ID NO: 42722 - DNA, 25 bp, Homo sapien
tgcgcaagcaccagtcccggaactg

SEQ ID NO: 42723 - DNA, 25 bp, Homo sapien
tcaccgtcttggttttggccgagtc

SEQ ID NO: 42724 - DNA, 25 bp, Homo sapien
cacaagacgccgctctgtctagtct

SEQ ID NO: 42725 - DNA, 25 bp, Homo sapien
aagacgccgctctgtctagtctctc

SEQ ID NO: 42726 - DNA, 25 bp, Homo sapien
tgtctagtctctcccaactcccgcg

SEQ ID NO: 42727 - DNA, 25 bp, Homo sapien
aggcccggatcctggaatcacctgg

SEQ ID NO: 42728 - DNA, 25 bp, Homo sapien
gcgcgcccagctggttcagctgctg

SEQ ID NO: 42729 - DNA, 25 bp, Homo sapien
agctggttcagctgctgcatgtcgc

SEQ ID NO: 42730 - DNA, 25 bp, Homo sapien
ggttcagctgctgcatgtcgccgcc

SEQ ID NO: 42731 - DNA, 25 bp, Homo sapien
gcaccgggtcctcagtgcagtgcag

SEQ ID NO: 42732 - DNA, 25 bp, Homo sapien
aggaaacgtccacggaccctgcttg

SEQ ID NO: 42733 - DNA, 25 bp, Homo sapien
acatacgtctgacggggaccggaga

SEQ ID NO: 42734 - DNA, 25 bp, Homo sapien
atactagaggaagggacgcgtctgc

SEQ ID NO: 42735 - DNA, 25 bp, Homo sapien
cgtcgagagcatgaacaggggcttt

SEQ ID NO: 42736 - DNA, 25 bp, Homo sapien
ggtgtaattacctggcctctgcctt

SEQ ID NO: 42737 - DNA, 25 bp, Homo sapien
tcccagctttaggaaagagctcgtg

SEQ ID NO: 42738 - DNA, 25 bp, Homo sapien
agctcgtgagtgtgggcttagactc

SEQ ID NO: 42739 - DNA, 25 bp, Homo sapien
aagtaaacctagctcggcgatcggc

SEQ ID NO: 42740 - DNA, 25 bp, Homo sapien
aggtactgttcgcatcggcagcgcc

SEQ ID NO: 42741 - DNA, 25 bp, Homo sapien
gcgatcctgtcgactgccgccaaga

SEQ ID NO: 42742 - DNA, 25 bp, Homo sapien
ggtgacacacggttacttcggcttg

SEQ ID NO: 42743 - DNA, 25 bp, Homo sapien
acgcgctcgtctgcttcttgcattg

SEQ ID NO: 42744 - DNA, 25 bp, Homo sapien
ttctttcctccagacgccgaagtcg

SEQ ID NO: 42745 - DNA, 25 bp, Homo sapien
cagcgcaagagggaagcagagttat

SEQ ID NO: 42746 - DNA, 25 bp, Homo sapien
ccattttggtctcaggtgtggactc

SEQ ID NO: 42747 - DNA, 25 bp, Homo sapien
cctggcggaacctttcagtgctgcg

SEQ ID NO: 42748 - DNA, 25 bp, Homo sapien
agcccgcgagcgttcgaagtggggc

SEQ ID NO: 42749 - DNA, 25 bp, Homo sapien
gcgggagcagcaatcgcagccatgg

SEQ ID NO: 42750 - DNA, 25 bp, Homo sapien
agccatggcgtcgttactgtgggga

SEQ ID NO: 42751 - DNA, 25 bp, Homo sapien
agcgagcggctgaacagccacgtaa

SEQ ID NO: 42752 - DNA, 25 bp, Homo sapien
agcggctgaacagccacgtaaccgc

SEQ ID NO: 42753 - DNA, 25 bp, Homo sapien
gaacagccacgtaaccgccaccgag

SEQ ID NO: 42754 - DNA, 25 bp, Homo sapien
actcgcagagggagatcggctggga

SEQ ID NO: 42755 - DNA, 25 bp, Homo sapien
cattggccagcggatggggccagca

SEQ ID NO: 42756 - DNA, 25 bp, Homo sapien
ccctctctataaaaggagccggcgg

SEQ ID NO: 42757 - DNA, 25 bp, Homo sapien
ggccgttccacacggcggtgctgtt

SEQ ID NO: 42758 - DNA, 25 bp, Homo sapien
tgaacgagacgaagacggaaccgga

SEQ ID NO: 42759 - DNA, 25 bp, Homo sapien
gcgagcctttacgtcggcgcgtaac

SEQ ID NO: 42760 - DNA, 25 bp, Homo sapien
ctgagaccctctctataaaaggagc

SEQ ID NO: 42761 - DNA, 25 bp, Homo sapien
taccgttctgtggatcaggggccga

SEQ ID NO: 42762 - DNA, 25 bp, Homo sapien
ccctcggctaccgttctgtggatca

SEQ ID NO: 42763 - DNA, 25 bp, Homo sapien
tctggcggtttgaacgagacgaaga

SEQ ID NO: 42764 - DNA, 25 bp, Homo sapien
cgggtcatgctaacggaagtgcttc

SEQ ID NO: 42765 - DNA, 25 bp, Homo sapien
gccgctacttcaggccgggtcatgc

SEQ ID NO: 42766 - DNA, 25 bp, Homo sapien
tgcgttcatacacaagcgacttccg

SEQ ID NO: 42767 - DNA, 25 bp, Homo sapien
aggtccgccgctgcgttcatacaca

SEQ ID NO: 42768 - DNA, 25 bp, Homo sapien
aagttctgccggcaagtcggatccc

SEQ ID NO: 42769 - DNA, 25 bp, Homo sapien
tacagtccgggtggacccaaagctc

SEQ ID NO: 42770 - DNA, 25 bp, Homo sapien
cccaggcgccagtcaaaagcgggtg

SEQ ID NO: 42771 - DNA, 25 bp, Homo sapien
gggtcccgcagcgtaagttctgccg

SEQ ID NO: 42772 - DNA, 25 bp, Homo sapien
cgctggagcagtagcgcctctggca

SEQ ID NO: 42773 - DNA, 25 bp, Homo sapien
ccacgtatcctggtgcgaagcactg

SEQ ID NO: 42774 - DNA, 25 bp, Homo sapien
gcggggctcacggtcagcacgtcct

SEQ ID NO: 42775 - DNA, 25 bp, Homo sapien
cgtgggagcgcatgaaaaagagaca

SEQ ID NO: 42776 - DNA, 25 bp, Homo sapien
taactcccggacgtgggagcgcatg

SEQ ID NO: 42777 - DNA, 25 bp, Homo sapien
ctcggcgctcggaatgcccatcgag

SEQ ID NO: 42778 - DNA, 25 bp, Homo sapien
gcgggccactaagtaaggcgaaagc

SEQ ID NO: 42779 - DNA, 25 bp, Homo sapien
aaagagacagaaccacgtatcctgg

SEQ ID NO: 42780 - DNA, 25 bp, Homo sapien
gggcaagaatcattttgttgtccca

SEQ ID NO: 42781 - DNA, 25 bp, Homo sapien
gctggggccacgaagtccggctcct

SEQ ID NO: 42782 - DNA, 25 bp, Homo sapien
ttgccggcgggcaagaatcattttg

SEQ ID NO: 42783 - DNA, 25 bp, Homo sapien
ccgcccgaagagctcggggctcacg

SEQ ID NO: 42784 - DNA, 25 bp, Homo sapien
ctccgcaggcgcggtgattccgagt

SEQ ID NO: 42785 - DNA, 25 bp, Homo sapien
ccttccagcgtaagtggggcgtgaa

SEQ ID NO: 42786 - DNA, 25 bp, Homo sapien
ggagcggccgccttccagcgtaagt

SEQ ID NO: 42787 - DNA, 25 bp, Homo sapien
gcaggtctgagaagcaggctgcgcc

SEQ ID NO: 42788 - DNA, 25 bp, Homo sapien
gctctttctgccagcacaaggactg

SEQ ID NO: 42789 - DNA, 25 bp, Homo sapien
ctgcttcctgtaggcaggggctcct

SEQ ID NO: 42790 - DNA, 25 bp, Homo sapien
cacaaggactgggagcggcaccacc

SEQ ID NO: 42791 - DNA, 25 bp, Homo sapien
tggtcagaacctgcatggccagagc

SEQ ID NO: 42792 - DNA, 25 bp, Homo sapien
gcctctgtggtcagaacctgcatgg

SEQ ID NO: 42793 - DNA, 25 bp, Homo sapien
gccagcgagacatgcagtggctgca

SEQ ID NO: 42794 - DNA, 25 bp, Homo sapien
gcagtggctgcaatatcgcgcgata

SEQ ID NO: 42795 - DNA, 25 bp, Homo sapien
atcgcgcgatactgtggctctttct

SEQ ID NO: 42796 - DNA, 25 bp, Homo sapien
aacggattgactacgcgtccggcgc

SEQ ID NO: 42797 - DNA, 25 bp, Homo sapien
caaagctcagcctaggagccgcaga

SEQ ID NO: 42798 - DNA, 25 bp, Homo sapien
ccagaccaggatcgtgctgattctc

SEQ ID NO: 42799 - DNA, 25 bp, Homo sapien
ccaacgctgggcaacggattgacta

SEQ ID NO: 42800 - DNA, 25 bp, Homo sapien
cctgcgaaccctgtcggaggcgtct

SEQ ID NO: 42801 - DNA, 25 bp, Homo sapien
ctcgcccgcagctttaaacgcttgg

SEQ ID NO: 42802 - DNA, 25 bp, Homo sapien
ataaagagtgcgtggcaaccctggc

SEQ ID NO: 42803 - DNA, 25 bp, Homo sapien
cagccctgtgcacgagaggatgaca

SEQ ID NO: 42804 - DNA, 25 bp, Homo sapien
ccgcgcatagtgctgaagagctcta

SEQ ID NO: 42805 - DNA, 25 bp, Homo sapien
gctgcagaagatgcccaaaacgctg

SEQ ID NO: 42806 - DNA, 25 bp, Homo sapien
tccggccagtttcagcgtgggtaac

SEQ ID NO: 42807 - DNA, 25 bp, Homo sapien
ggcgaaccctgacctcttgcagcag

SEQ ID NO: 42808 - DNA, 25 bp, Homo sapien
ttccgactgaacgtggcaggcagca

SEQ ID NO: 42809 - DNA, 25 bp, Homo sapien
gtgccacatggctagcaccgcgttg

SEQ ID NO: 42810 - DNA, 25 bp, Homo sapien
agagctctagcttggtgcccagctg

SEQ ID NO: 42811 - DNA, 25 bp, Homo sapien
ggctccacactgtttcctggcttcg

SEQ ID NO: 42812 - DNA, 25 bp, Homo sapien
agcaggcacacggtgagcagccccg

SEQ ID NO: 42813 - DNA, 25 bp, Homo sapien
gcctcaaggtccaactccagcgccg

SEQ ID NO: 42814 - DNA, 25 bp, Homo sapien
ggtgagactaacagagactcgggta

SEQ ID NO: 42815 - DNA, 25 bp, Homo sapien
tagggagacaccgcgagcagagccc

SEQ ID NO: 42816 - DNA, 25 bp, Homo sapien
tgcggttgctgccgaccctggacgc

SEQ ID NO: 42817 - DNA, 25 bp, Homo sapien
actcggtgtggctagaggccgcccc

SEQ ID NO: 42818 - DNA, 25 bp, Homo sapien
gttccctcgcctcaaggtccaactc

SEQ ID NO: 42819 - DNA, 25 bp, Homo sapien
ccggagggtgagactaacagagact

SEQ ID NO: 42820 - DNA, 25 bp, Homo sapien
tcccgcacatgctccaggagcgagt

SEQ ID NO: 42821 - DNA, 25 bp, Homo sapien
catccgggacaacagcggttctggg

SEQ ID NO: 42822 - DNA, 25 bp, Homo sapien
cgccctcctcgaggccgaagtggta

SEQ ID NO: 42823 - DNA, 25 bp, Homo sapien
tcctcgaggccgaagtggtagtcga

SEQ ID NO: 42824 - DNA, 25 bp, Homo sapien
acaggcggtcctcgtccacgggagc

SEQ ID NO: 42825 - DNA, 25 bp, Homo sapien
tgcccatccgggacaacagcggttc

SEQ ID NO: 42826 - DNA, 25 bp, Homo sapien
gcaggctgcccatccgggacaacag

SEQ ID NO: 42827 - DNA, 25 bp, Homo sapien
tgctccaggagcgagtcggccgcca

SEQ ID NO: 42828 - DNA, 25 bp, Homo sapien
ctttgtccggatggtaccaggcgcg

SEQ ID NO: 42829 - DNA, 25 bp, Homo sapien
atgatgacgatctgcgaggagtcga

SEQ ID NO: 42830 - DNA, 25 bp, Homo sapien
ttacgcgccaaatcctttttgccgc

SEQ ID NO: 42831 - DNA, 25 bp, Homo sapien
tttttgccgcgaaagagccacgagc

SEQ ID NO: 42832 - DNA, 25 bp, Homo sapien
acaacggcggcggttcctattggct

SEQ ID NO: 42833 - DNA, 25 bp, Homo sapien
cgcaggctttgtccggatggtacca

SEQ ID NO: 42834 - DNA, 25 bp, Homo sapien
cagcaaacagggaccggcccgaggt

SEQ ID NO: 42835 - DNA, 25 bp, Homo sapien
tcctattggctttaacgcgccggac

SEQ ID NO: 42836 - DNA, 25 bp, Homo sapien
ggcgcacaactctctgggaccggaa

SEQ ID NO: 42837 - DNA, 25 bp, Homo sapien
ggcaagcgaggacagaaacggtttc

SEQ ID NO: 42838 - DNA, 25 bp, Homo sapien
ttgcactcacatcccgtctgtttgg

SEQ ID NO: 42839 - DNA, 25 bp, Homo sapien
aggcctgaccctaagcgtcgtcgtc

SEQ ID NO: 42840 - DNA, 25 bp, Homo sapien
agcgtccttgtgctgcttctcagtg

SEQ ID NO: 42841 - DNA, 25 bp, Homo sapien
tggagttagtcccaccgcacctagg

SEQ ID NO: 42842 - DNA, 25 bp, Homo sapien
acattaggttctgttggtcccgctt

SEQ ID NO: 42843 - DNA, 25 bp, Homo sapien
ggaacatccggttgctggcgcacaa

SEQ ID NO: 42844 - DNA, 25 bp, Homo sapien
gtttcgtcgtgtcactgacacctca

SEQ ID NO: 42845 - DNA, 25 bp, Homo sapien
cccgctctgcggcatctcacctgcc

SEQ ID NO: 42846 - DNA, 25 bp, Homo sapien
ggtctcctcgcacctagccgcgcga

SEQ ID NO: 42847 - DNA, 25 bp, Homo sapien
cgccgggcaagcatcagcatccaga

SEQ ID NO: 42848 - DNA, 25 bp, Homo sapien
agaagaggtttcgtcgtgtcactga

SEQ ID NO: 42849 - DNA, 25 bp, Homo sapien
cccgaggaccatcgtcaagaagagg

SEQ ID NO: 42850 - DNA, 25 bp, Homo sapien
tgtgcgcgcgcagcctgccagatca

SEQ ID NO: 42851 - DNA, 25 bp, Homo sapien
cggggctggctaagcctccagacct

SEQ ID NO: 42852 - DNA, 25 bp, Homo sapien
cccttgcacagggagaccatgagca

SEQ ID NO: 42853 - DNA, 25 bp, Homo sapien
cgagggcggaaacaaagccataatc

SEQ ID NO: 42854 - DNA, 25 bp, Homo sapien
ggcgtatgctgtcaccaccagaaga

SEQ ID NO: 42855 - DNA, 25 bp, Homo sapien
tgtccggattgactcgagcctcacg

SEQ ID NO: 42856 - DNA, 25 bp, Homo sapien
tcccgcgctgtcactgtgtccggat

SEQ ID NO: 42857 - DNA, 25 bp, Homo sapien
gggcgtagtacatctccagtcgttc

SEQ ID NO: 42858 - DNA, 25 bp, Homo sapien
tgagcagcaccgacaagagcatgcc

SEQ ID NO: 42859 - DNA, 25 bp, Homo sapien
aggcctgcgatgatgcacctgtcca

SEQ ID NO: 42860 - DNA, 25 bp, Homo sapien
cgcagcagtgcgttgacgactacga

SEQ ID NO: 42861 - DNA, 25 bp, Homo sapien
atcggacttcgaactcgcgcctctg

SEQ ID NO: 42862 - DNA, 25 bp, Homo sapien
acgagcagagcccttagctgcggcg

SEQ ID NO: 42863 - DNA, 25 bp, Homo sapien
cactgacagccggaggttccagctg

SEQ ID NO: 42864 - DNA, 25 bp, Homo sapien
tcggggttaggaactgtaagcgcac

SEQ ID NO: 42865 - DNA, 25 bp, Homo sapien
ttgacgactacgagcagagccctta

SEQ ID NO: 42866 - DNA, 25 bp, Homo sapien
ttccggaagcccttaagcacggcca

SEQ ID NO: 42867 - DNA, 25 bp, Homo sapien
taagcacggccaacgcagcgtggta

SEQ ID NO: 42868 - DNA, 25 bp, Homo sapien
caaattaaactgacaccgtgggtgc

SEQ ID NO: 42869 - DNA, 25 bp, Homo sapien
gtggccggtgcagttttacaaatta

SEQ ID NO: 42870 - DNA, 25 bp, Homo sapien
agcctggactcagagcttagggacc

SEQ ID NO: 42871 - DNA, 25 bp, Homo sapien
cgtgctaggacgtagtctcaaaatc

SEQ ID NO: 42872 - DNA, 25 bp, Homo sapien
cggactgtatgcctcgtgctaggac

SEQ ID NO: 42873 - DNA, 25 bp, Homo sapien
agaacttctgcggagcggactgtat

SEQ ID NO: 42874 - DNA, 25 bp, Homo sapien
aggtcggtgtagacttggtcgttca

SEQ ID NO: 42875 - DNA, 25 bp, Homo sapien
gcggcctgaccacgaagaacttctg

SEQ ID NO: 42876 - DNA, 25 bp, Homo sapien
ccggacgcggtgctgtccatcgttg

SEQ ID NO: 42877 - DNA, 25 bp, Homo sapien
agccccccgcagttgcggcagtggt

SEQ ID NO: 42878 - DNA, 25 bp, Homo sapien
cgcccttcgcagagccggacgcggt

SEQ ID NO: 42879 - DNA, 25 bp, Homo sapien
gacgcggtgctgtccatcgttgtgg

SEQ ID NO: 42880 - DNA, 25 bp, Homo sapien
cgcggtgctgtccatcgttgtgggt

SEQ ID NO: 42881 - DNA, 25 bp, Homo sapien
ccttcgcagagccggacgcggtgct

SEQ ID NO: 42882 - DNA, 25 bp, Homo sapien
tgctgtccatcgttgtgggtggtgc

SEQ ID NO: 42883 - DNA, 25 bp, Homo sapien
cggacgcggtgctgtccatcgttgt

SEQ ID NO: 42884 - DNA, 25 bp, Homo sapien
acctcaaagatcaccgctgtcgtct

SEQ ID NO: 42885 - DNA, 25 bp, Homo sapien
acaaatacctcaaagatcaccgctg

SEQ ID NO: 42886 - DNA, 25 bp, Homo sapien
aatacctcaaagatcaccgctgtcg

SEQ ID NO: 42887 - DNA, 25 bp, Homo sapien
gccacaaatacctcaaagatcaccg

SEQ ID NO: 42888 - DNA, 25 bp, Homo sapien
tacctcaaagatcaccgctgtcgtc

SEQ ID NO: 42889 - DNA, 25 bp, Homo sapien
caaagatcaccgctgtcgtctcggc

SEQ ID NO: 42890 - DNA, 25 bp, Homo sapien
aaagatcaccgctgtcgtctcggcc

SEQ ID NO: 42891 - DNA, 25 bp, Homo sapien
atacctcaaagatcaccgctgtcgt

SEQ ID NO: 42892 - DNA, 25 bp, Homo sapien
aaaacaagcgcggtgaggctgcccg

SEQ ID NO: 42893 - DNA, 25 bp, Homo sapien
gcaccaaaaacaagcgcggtgaggc

SEQ ID NO: 42894 - DNA, 25 bp, Homo sapien
gagctgacggccgccaagaagcacg

SEQ ID NO: 42895 - DNA, 25 bp, Homo sapien
tgttcgggaagctgttcggggctgg

SEQ ID NO: 42896 - DNA, 25 bp, Homo sapien
caaccatgtcggtgttcgggaagct

SEQ ID NO: 42897 - DNA, 25 bp, Homo sapien
cagcaaccatgtcggtgttcgggaa

SEQ ID NO: 42898 - DNA, 25 bp, Homo sapien
cgagcagcaaccatgtcggtgttcg

SEQ ID NO: 42899 - DNA, 25 bp, Homo sapien
cccttcagacttgccacgggctccc

SEQ ID NO: 42900 - DNA, 25 bp, Homo sapien
gtttgaggggccgacgcggcagcgc

SEQ ID NO: 42901 - DNA, 25 bp, Homo sapien
gtccctagagcgtgtgggtcctccc

SEQ ID NO: 42902 - DNA, 25 bp, Homo sapien
aggggtgtctgcttagcatcgggcg

SEQ ID NO: 42903 - DNA, 25 bp, Homo sapien
tgcaggtggcgccatgtcccaggct

SEQ ID NO: 42904 - DNA, 25 bp, Homo sapien
cctagagcgtgtgggtcctccccat

SEQ ID NO: 42905 - DNA, 25 bp, Homo sapien
atcttttgggaaacgctgtgcgggg

SEQ ID NO: 42906 - DNA, 25 bp, Homo sapien
ggtccctagagcgtgtgggtcctcc

SEQ ID NO: 42907 - DNA, 25 bp, Homo sapien
ctcccgggtggtctgcgcctggcgc

SEQ ID NO: 42908 - DNA, 25 bp, Homo sapien
ctgcagactcctcgtgctcgtgtca

SEQ ID NO: 42909 - DNA, 25 bp, Homo sapien
ttcggctccaaacctgtgcaagctg

SEQ ID NO: 42910 - DNA, 25 bp, Homo sapien
ctccagacctctcggcgcgggtgag

SEQ ID NO: 42911 - DNA, 25 bp, Homo sapien
tcctttcaagcgctgtcctggttcc

SEQ ID NO: 42912 - DNA, 25 bp, Homo sapien
tcgtgtcaccgtgtccttcccagga

SEQ ID NO: 42913 - DNA, 25 bp, Homo sapien
gcaggccgctgcctatttttagaaa

SEQ ID NO: 42914 - DNA, 25 bp, Homo sapien
cgccgaagctctggacctttccaaa

SEQ ID NO: 42915 - DNA, 25 bp, Homo sapien
tgtgtgctttgtgcctttccgttca

SEQ ID NO: 42916 - DNA, 25 bp, Homo sapien
tcgccggtagccctctgttaaggga

SEQ ID NO: 42917 - DNA, 25 bp, Homo sapien
ctcaacgtgtgctctccattccgga

SEQ ID NO: 42918 - DNA, 25 bp, Homo sapien
cggcagtgcccagcagaaaggaatg

SEQ ID NO: 42919 - DNA, 25 bp, Homo sapien
gcactaggctcttgcatcagcgaaa

SEQ ID NO: 42920 - DNA, 25 bp, Homo sapien
acgagggcgttataccaagccaaga

SEQ ID NO: 42921 - DNA, 25 bp, Homo sapien
cctgaggctgcagaatctttttctc

SEQ ID NO: 42922 - DNA, 25 bp, Homo sapien
aagagccaacctagcgcgcttcgtg

SEQ ID NO: 42923 - DNA, 25 bp, Homo sapien
ccatttataagagggttgcgcttgc

SEQ ID NO: 42924 - DNA, 25 bp, Homo sapien
agctcgcagagagctgggacagcgg

SEQ ID NO: 42925 - DNA, 25 bp, Homo sapien
gaagcgccctctccgagtaggtgcc

SEQ ID NO: 42926 - DNA, 25 bp, Homo sapien
cgcgaagcgccctctccgagtaggt

SEQ ID NO: 42927 - DNA, 25 bp, Homo sapien
tctcttgagtggcaggcaagcaagc

SEQ ID NO: 42928 - DNA, 25 bp, Homo sapien
cttctcttgagtggcaggcaagcaa

SEQ ID NO: 42929 - DNA, 25 bp, Homo sapien
gccagagacggagttggccgggact

SEQ ID NO: 42930 - DNA, 25 bp, Homo sapien
tgccacgaccgcagcgccaacgcca

SEQ ID NO: 42931 - DNA, 25 bp, Homo sapien
gtagtcctctgccacgaccgcagcg

SEQ ID NO: 42932 - DNA, 25 bp, Homo sapien
tatataggctgctcgaaggtgtgcg

SEQ ID NO: 42933 - DNA, 25 bp, Homo sapien
gggatctccctagcccgaggagctc

SEQ ID NO: 42934 - DNA, 25 bp, Homo sapien
cacgcagaaggaggcttcgatgaag

SEQ ID NO: 42935 - DNA, 25 bp, Homo sapien
cttctcgggcgggtgatccctaaca

SEQ ID NO: 42936 - DNA, 25 bp, Homo sapien
tgatccctaacagggcggcttccca

SEQ ID NO: 42937 - DNA, 25 bp, Homo sapien
cctggcttgggctaaaatcgaaata

SEQ ID NO: 42938 - DNA, 25 bp, Homo sapien
tcgaaatacaatatatataggctgc

SEQ ID NO: 42939 - DNA, 25 bp, Homo sapien
gtgcggctgtttctgtaaaggtccc

SEQ ID NO: 42940 - DNA, 25 bp, Homo sapien
tttccgttcaagaagagcactggtc

SEQ ID NO: 42941 - DNA, 25 bp, Homo sapien
gagcttctccgctaatctctgggca

SEQ ID NO: 42942 - DNA, 25 bp, Homo sapien
cggggaccctcttgatcggatgccc

SEQ ID NO: 42943 - DNA, 25 bp, Homo sapien
atgccggtgcctcaacggtttaacg

SEQ ID NO: 42944 - DNA, 25 bp, Homo sapien
gcactggtctgagaaacgtttctcc

SEQ ID NO: 42945 - DNA, 25 bp, Homo sapien
cccttaggagcgatgtcccataaac

SEQ ID NO: 42946 - DNA, 25 bp, Homo sapien
cttagccactgaatctccggtgatc

SEQ ID NO: 42947 - DNA, 25 bp, Homo sapien
ctgggcatttatggccgtagaggca

SEQ ID NO: 42948 - DNA, 25 bp, Homo sapien
acgccgccagtttgcggctcgcaga

SEQ ID NO: 42949 - DNA, 25 bp, Homo sapien
gacttgtagtccacggccacccgga

SEQ ID NO: 42950 - DNA, 25 bp, Homo sapien
tttcgatccctgaaaagaagcctca

SEQ ID NO: 42951 - DNA, 25 bp, Homo sapien
tgcatattcatgacccgctggggcg

SEQ ID NO: 42952 - DNA, 25 bp, Homo sapien
ggcgccgacgcctttaaatatcttc

SEQ ID NO: 42953 - DNA, 25 bp, Homo sapien
ctgggactcaccgactttgtagggc

SEQ ID NO: 42954 - DNA, 25 bp, Homo sapien
tccagctggcttcgcgcggccagaa

SEQ ID NO: 42955 - DNA, 25 bp, Homo sapien
atggccgcgcgagaactccaacttc

SEQ ID NO: 42956 - DNA, 25 bp, Homo sapien
cgcgcgcactgacacccggagagag

SEQ ID NO: 42957 - DNA, 25 bp, Homo sapien
cagtcgatagacacacgcacgagtt

SEQ ID NO: 42958 - DNA, 25 bp, Homo sapien
cgcacgagttgtacacaaagccttg

SEQ ID NO: 42959 - DNA, 25 bp, Homo sapien
gatacgcacacgcaggtccacgctg

SEQ ID NO: 42960 - DNA, 25 bp, Homo sapien
gtccacgctgttgtacccaaagttg

SEQ ID NO: 42961 - DNA, 25 bp, Homo sapien
gtacccaaagttgcgcgcagaaagc

SEQ ID NO: 42962 - DNA, 25 bp, Homo sapien
gaagcttcacaaaacccagtcgata

SEQ ID NO: 42963 - DNA, 25 bp, Homo sapien
agcggctgtgggtgaagcttcacaa

SEQ ID NO: 42964 - DNA, 25 bp, Homo sapien
agacagttcccgtccgcgacagaaa

SEQ ID NO: 42965 - DNA, 25 bp, Homo sapien
ccggagagtgcccttttctttagca

SEQ ID NO: 42966 - DNA, 25 bp, Homo sapien
cgccgacttttgcagacgtggagct

SEQ ID NO: 42967 - DNA, 25 bp, Homo sapien
tggggcttgtagtctagaccacttc

SEQ ID NO: 42968 - DNA, 25 bp, Homo sapien
ctccttcttccagagccggtgtctg

SEQ ID NO: 42969 - DNA, 25 bp, Homo sapien
ccagctggccttctcgagacttttc

SEQ ID NO: 42970 - DNA, 25 bp, Homo sapien
ggaccggctgccatcttagtctagg

SEQ ID NO: 42971 - DNA, 25 bp, Homo sapien
tcgcagaatttgtgcgcccgaagta

SEQ ID NO: 42972 - DNA, 25 bp, Homo sapien
ctaccggatcggtcggaaatggtga

SEQ ID NO: 42973 - DNA, 25 bp, Homo sapien
cgctggctcctgataggcagctaga

SEQ ID NO: 42974 - DNA, 25 bp, Homo sapien
gcagctagagctgtccgttttgaca

SEQ ID NO: 42975 - DNA, 25 bp, Homo sapien
cacaggactcgctaagtgttcgcta

SEQ ID NO: 42976 - DNA, 25 bp, Homo sapien
cgccaggccttcagtcttccgagga

SEQ ID NO: 42977 - DNA, 25 bp, Homo sapien
gtcttccgaggatgaggggatctca

SEQ ID NO: 42978 - DNA, 25 bp, Homo sapien
tctaaagcctgaccgaggcggggcc

SEQ ID NO: 42979 - DNA, 25 bp, Homo sapien
ttgacagaaacctttgcgcaggcgc

SEQ ID NO: 42980 - DNA, 25 bp, Homo sapien
gacctgacgtcaccgggcgagttac

SEQ ID NO: 42981 - DNA, 25 bp, Homo sapien
cagccgaccgctgtaaggaggtaca

SEQ ID NO: 42982 - DNA, 25 bp, Homo sapien
cccaccgcgataggtgccaggggct

SEQ ID NO: 42983 - DNA, 25 bp, Homo sapien
tcagaccggcctttcaagcagcggc

SEQ ID NO: 42984 - DNA, 25 bp, Homo sapien
ccctttaaggaatgttgtgacctga

SEQ ID NO: 42985 - DNA, 25 bp, Homo sapien
tcacgggactgtgacgcgcccagaa

SEQ ID NO: 42986 - DNA, 25 bp, Homo sapien
cgggccttaccttgagttcgggctg

SEQ ID NO: 42987 - DNA, 25 bp, Homo sapien
tgacgtcaggctctggctggaccct

SEQ ID NO: 42988 - DNA, 25 bp, Homo sapien
tgagtgtgtccacgcccatcgcgga

SEQ ID NO: 42989 - DNA, 25 bp, Homo sapien
ttcttcctgctggtgaaccagcaca

SEQ ID NO: 42990 - DNA, 25 bp, Homo sapien
gtgaaccagcacagcatggtgagtg

SEQ ID NO: 42991 - DNA, 25 bp, Homo sapien
ccatcgcggacatctacgagcagga

SEQ ID NO: 42992 - DNA, 25 bp, Homo sapien
agacgaggacggcttcctctatatg

SEQ ID NO: 42993 - DNA, 25 bp, Homo sapien
acggcttcctctatatggtctacgc

SEQ ID NO: 42994 - DNA, 25 bp, Homo sapien
tatggtctacgcctcccaggaaacc

SEQ ID NO: 42995 - DNA, 25 bp, Homo sapien
cggacatctacgagcaggagaaaga

SEQ ID NO: 42996 - DNA, 25 bp, Homo sapien
tgtgcgccacgctctgtagttccgc

SEQ ID NO: 42997 - DNA, 25 bp, Homo sapien
gcctgacagtctgctcgagccagtg

SEQ ID NO: 42998 - DNA, 25 bp, Homo sapien
aggaccaagggagccgccatgataa

SEQ ID NO: 42999 - DNA, 25 bp, Homo sapien
cctcaagctgcgtatgcagaaggtg

SEQ ID NO: 43000 - DNA, 25 bp, Homo sapien
tggggcgaaaccttctacgatcgca

SEQ ID NO: 43001 - DNA, 25 bp, Homo sapien
acgatcgcaggtgttttgtgaagcc

SEQ ID NO: 43002 - DNA, 25 bp, Homo sapien
gggctgaaacgctgctgaaagtaga

SEQ ID NO: 43003 - DNA, 25 bp, Homo sapien
ctcggaaatgaactcggccagactg

SEQ ID NO: 43004 - DNA, 25 bp, Homo sapien
cattgagacgtcaccaaggccggta

SEQ ID NO: 43005 - DNA, 25 bp, Homo sapien
ctgcgatccgggaagaatcaggaaa

SEQ ID NO: 43006 - DNA, 25 bp, Homo sapien
tcagctgtttgaacgttccaatttg

SEQ ID NO: 43007 - DNA, 25 bp, Homo sapien
acgttccaatttgtgccgtgagccc

SEQ ID NO: 43008 - DNA, 25 bp, Homo sapien
attggttgccgcacgcccggtagac

SEQ ID NO: 43009 - DNA, 25 bp, Homo sapien
gacgtcgttctatttgcatatgaca

SEQ ID NO: 43010 - DNA, 25 bp, Homo sapien
tgtgacgtcacaatcagctgtttga

SEQ ID NO: 43011 - DNA, 25 bp, Homo sapien
cccggtagaccatgacgtcgttcta

SEQ ID NO: 43012 - DNA, 25 bp, Homo sapien
agcatgtccgtttacgtcaccggca

SEQ ID NO: 43013 - DNA, 25 bp, Homo sapien
ctcccgcctgttttacggcagaggg

SEQ ID NO: 43014 - DNA, 25 bp, Homo sapien
ggtctgactaacgatgccctttctc

SEQ ID NO: 43015 - DNA, 25 bp, Homo sapien
cttgggagggttgcctttgagacaa

SEQ ID NO: 43016 - DNA, 25 bp, Homo sapien
cgcctagggagtgggacttaaacag

SEQ ID NO: 43017 - DNA, 25 bp, Homo sapien
tccagtttacctgttaagggctaga

SEQ ID NO: 43018 - DNA, 25 bp, Homo sapien
cctggctctgtcctcacagggaatt

SEQ ID NO: 43019 - DNA, 25 bp, Homo sapien
cgcgccctccttgatggacgagagc

SEQ ID NO: 43020 - DNA, 25 bp, Homo sapien
ggcattgcccacgtgaccagacgtc

SEQ ID NO: 43021 - DNA, 25 bp, Homo sapien
cggggcattgcccacgtgaccagac

SEQ ID NO: 43022 - DNA, 25 bp, Homo sapien
tccgtcagtcctcgcgtgcgcccgt

SEQ ID NO: 43023 - DNA, 25 bp, Homo sapien
aagccagcccgacaaggaccgcgga

SEQ ID NO: 43024 - DNA, 25 bp, Homo sapien
gtcgcccggcgccatttttccgcgc

SEQ ID NO: 43025 - DNA, 25 bp, Homo sapien
cccgctctcagaccgtgccactcgg

SEQ ID NO: 43026 - DNA, 25 bp, Homo sapien
cccaacatggcgacggggacacaag

SEQ ID NO: 43027 - DNA, 25 bp, Homo sapien
ggacccagtgttccttctccgcgac

SEQ ID NO: 43028 - DNA, 25 bp, Homo sapien
cgtcattaagttgcggggtagtctg

SEQ ID NO: 43029 - DNA, 25 bp, Homo sapien
cagcagtgcagctttcagagggtcc

SEQ ID NO: 43030 - DNA, 25 bp, Homo sapien
tgacgtatcgcaaggccagccaatg

SEQ ID NO: 43031 - DNA, 25 bp, Homo sapien
tggaagcaccagagcacaagcccgc

SEQ ID NO: 43032 - DNA, 25 bp, Homo sapien
tgcatgagtcgctaacgccctggaa

SEQ ID NO: 43033 - DNA, 25 bp, Homo sapien
ccggaattcggctagagttgagaca

SEQ ID NO: 43034 - DNA, 25 bp, Homo sapien
tgcagcagcacggaacgaatcaacg

SEQ ID NO: 43035 - DNA, 25 bp, Homo sapien
tcaacgcgttaacgggtccggtgca

SEQ ID NO: 43036 - DNA, 25 bp, Homo sapien
ccgatggcaggaacgtctcccggaa

SEQ ID NO: 43037 - DNA, 25 bp, Homo sapien
ccggaggtgccaagtacatccagca

SEQ ID NO: 43038 - DNA, 25 bp, Homo sapien
agcacctcagccaggtcgggccgat

SEQ ID NO: 43039 - DNA, 25 bp, Homo sapien
ttgccacctgcgtagaaggcagccg

SEQ ID NO: 43040 - DNA, 25 bp, Homo sapien
atctccagtgtgaggttgccacctg

SEQ ID NO: 43041 - DNA, 25 bp, Homo sapien
ctcggccaccatctccagtgtgagg

SEQ ID NO: 43042 - DNA, 25 bp, Homo sapien
acgcggatgtcctgcaatagggacc

SEQ ID NO: 43043 - DNA, 25 bp, Homo sapien
ccgatgcagcaacgagccaggtagt

SEQ ID NO: 43044 - DNA, 25 bp, Homo sapien
atctccgacgacgacgatggcagcc

SEQ ID NO: 43045 - DNA, 25 bp, Homo sapien
tgagacaggccgtgacgatgaccgt

SEQ ID NO: 43046 - DNA, 25 bp, Homo sapien
ccatcctggcggcaggagcactcgg

SEQ ID NO: 43047 - DNA, 25 bp, Homo sapien
cggagaacgggtctttgcgcgtctc

SEQ ID NO: 43048 - DNA, 25 bp, Homo sapien
ctttgcgcgtctcgcgtagcggcga

SEQ ID NO: 43049 - DNA, 25 bp, Homo sapien
acttcaggaaggagtccgggtctgc

SEQ ID NO: 43050 - DNA, 25 bp, Homo sapien
cgctgcagccgtgcagacttcagga

SEQ ID NO: 43051 - DNA, 25 bp, Homo sapien
ccgtgacgatgaccgtgagcccatc

SEQ ID NO: 43052 - DNA, 25 bp, Homo sapien
gccaagctgacttggcgactcctcg

SEQ ID NO: 43053 - DNA, 25 bp, Homo sapien
tcctcgcccgcacgcggaagaaaat

SEQ ID NO: 43054 - DNA, 25 bp, Homo sapien
caagaacccggccaagctgacttgg

SEQ ID NO: 43055 - DNA, 25 bp, Homo sapien
cgccacacctcagacgaggctttga

SEQ ID NO: 43056 - DNA, 25 bp, Homo sapien
gctttgaaagtagggcgcagcctga

SEQ ID NO: 43057 - DNA, 25 bp, Homo sapien
acgccgtgttagctcgcggcgccaa

SEQ ID NO: 43058 - DNA, 25 bp, Homo sapien
tgaggaagaaaggtcgtcgcccgca

SEQ ID NO: 43059 - DNA, 25 bp, Homo sapien
gcccggaactctgaggagtcgtctg

SEQ ID NO: 43060 - DNA, 25 bp, Homo sapien
ggtctcccagaaaggcgtcctcgtc

SEQ ID NO: 43061 - DNA, 25 bp, Homo sapien
gcctgcagctggcacacaggtgcgt

SEQ ID NO: 43062 - DNA, 25 bp, Homo sapien
acaggtgcgtgtagatggacagcca

SEQ ID NO: 43063 - DNA, 25 bp, Homo sapien
tagtccactggcgagtaggcgccca

SEQ ID NO: 43064 - DNA, 25 bp, Homo sapien
gtctgctcagcgctatcagcctgca

SEQ ID NO: 43065 - DNA, 25 bp, Homo sapien
ctggtgatgctcatgtagtccactg

SEQ ID NO: 43066 - DNA, 25 bp, Homo sapien
gaaaggcgtcctcgtccttgcggcc

SEQ ID NO: 43067 - DNA, 25 bp, Homo sapien
cctgatcttcgcgacagccgggagg

SEQ ID NO: 43068 - DNA, 25 bp, Homo sapien
cggccgcggttctaggaacttgacg

SEQ ID NO: 43069 - DNA, 25 bp, Homo sapien
cttctgctttcactcgacggcgtca

SEQ ID NO: 43070 - DNA, 25 bp, Homo sapien
ggcgtcactccttccggcaagtcag

SEQ ID NO: 43071 - DNA, 25 bp, Homo sapien
tatccctcgacttttccttatagta

SEQ ID NO: 43072 - DNA, 25 bp, Homo sapien
agtatttctgtccttgccaacctcg

SEQ ID NO: 43073 - DNA, 25 bp, Homo sapien
ccgcctctagttcggcctgttttct

SEQ ID NO: 43074 - DNA, 25 bp, Homo sapien
aacttgacgtgatggggcttcctga

SEQ ID NO: 43075 - DNA, 25 bp, Homo sapien
tcggcctgttttctcagtcccggca

SEQ ID NO: 43076 - DNA, 25 bp, Homo sapien
tcctcccgaggaaacgtgacccatg

SEQ ID NO: 43077 - DNA, 25 bp, Homo sapien
acccatacctttggcgctgagtcga

SEQ ID NO: 43078 - DNA, 25 bp, Homo sapien
cggcctccggaattccaatctcttg

SEQ ID NO: 43079 - DNA, 25 bp, Homo sapien
cgaagggtttcagccacaaggtctc

SEQ ID NO: 43080 - DNA, 25 bp, Homo sapien
gacaccggcccgatctaaaggcaga

SEQ ID NO: 43081 - DNA, 25 bp, Homo sapien
ggtcgcactttatcgccaggactta

SEQ ID NO: 43082 - DNA, 25 bp, Homo sapien
cgcccacaaggaaatcggtcgcact

SEQ ID NO: 43083 - DNA, 25 bp, Homo sapien
ggtcagatcaccgaaagcctcaaaa

SEQ ID NO: 43084 - DNA, 25 bp, Homo sapien
gcccgcgtggagaagcagcgtgcag

SEQ ID NO: 43085 - DNA, 25 bp, Homo sapien
gctgccaacgtggagactctgaccc

SEQ ID NO: 43086 - DNA, 25 bp, Homo sapien
ctggctgccaacgtggagactctga

SEQ ID NO: 43087 - DNA, 25 bp, Homo sapien
gacgacctggctgccaacgtggaga

SEQ ID NO: 43088 - DNA, 25 bp, Homo sapien
aggtggacgacctggctgccaacgt

SEQ ID NO: 43089 - DNA, 25 bp, Homo sapien
ggcactgcggcgcaagcaggcggag

SEQ ID NO: 43090 - DNA, 25 bp, Homo sapien
gctgcggcacgaggccacagtggcg

SEQ ID NO: 43091 - DNA, 25 bp, Homo sapien
gccaacgtggagactctgacccgcg

SEQ ID NO: 43092 - DNA, 25 bp, Homo sapien
ggcccagggttcgtacacgccatca

SEQ ID NO: 43093 - DNA, 25 bp, Homo sapien
cgcaaagaagggaggatccagaaac

SEQ ID NO: 43094 - DNA, 25 bp, Homo sapien
cccagacgtgtagacgtggcgcaaa

SEQ ID NO: 43095 - DNA, 25 bp, Homo sapien
agaggctaaaacaaacacgacaggg

SEQ ID NO: 43096 - DNA, 25 bp, Homo sapien
ctcgaggcccacagaggctaaaaca

SEQ ID NO: 43097 - DNA, 25 bp, Homo sapien
caatacacgggataaactcgaggcc

SEQ ID NO: 43098 - DNA, 25 bp, Homo sapien
ccctgacaagggacatcaagccagc

SEQ ID NO: 43099 - DNA, 25 bp, Homo sapien
cttccggccagccaaaagggctttg

SEQ ID NO: 43100 - DNA, 25 bp, Homo sapien
ctctcgccgatttgggcaggatgca

SEQ ID NO: 43101 - DNA, 25 bp, Homo sapien
cggacatcgaccaagtcatcgcgct

SEQ ID NO: 43102 - DNA, 25 bp, Homo sapien
acacgtgactcaccgcggacatcga

SEQ ID NO: 43103 - DNA, 25 bp, Homo sapien
tgcctgcttctctctacacgtgact

SEQ ID NO: 43104 - DNA, 25 bp, Homo sapien
caggcagctggccaagaaatgatcc

SEQ ID NO: 43105 - DNA, 25 bp, Homo sapien
ttctcccatttctctcgccgatttg

SEQ ID NO: 43106 - DNA, 25 bp, Homo sapien
ggcgaaatctcccaaggtccacatt

SEQ ID NO: 43107 - DNA, 25 bp, Homo sapien
agaaatgatcctgggcttcaggtca

SEQ ID NO: 43108 - DNA, 25 bp, Homo sapien
cacaggtgagaggtcgcagctcatc

SEQ ID NO: 43109 - DNA, 25 bp, Homo sapien
aggcattctccaggtagctgtcgta

SEQ ID NO: 43110 - DNA, 25 bp, Homo sapien
gcgtggtagaacatggccttgactc

SEQ ID NO: 43111 - DNA, 25 bp, Homo sapien
cactagctgatttctccctgggacc

SEQ ID NO: 43112 - DNA, 25 bp, Homo sapien
cccaactgcgaaagggcgggtcaca

SEQ ID NO: 43113 - DNA, 25 bp, Homo sapien
cgaaacgcggccgaagagcaacttc

SEQ ID NO: 43114 - DNA, 25 bp, Homo sapien
tcggatgtacggtttcggcaacact

SEQ ID NO: 43115 - DNA, 25 bp, Homo sapien
gctcatcgaagggaaaggcattctc

SEQ ID NO: 43116 - DNA, 25 bp, Homo sapien
ctcagtgcgttgtggatatcgtttc

SEQ ID NO: 43117 - DNA, 25 bp, Homo sapien
cagccggattgtgcccgagagtctc

SEQ ID NO: 43118 - DNA, 25 bp, Homo sapien
ttttctgtcgcaaagaagctcgcgc

SEQ ID NO: 43119 - DNA, 25 bp, Homo sapien
cgcaagcggcatgaaagggccctcc

SEQ ID NO: 43120 - DNA, 25 bp, Homo sapien
gccctccgaggagaatgtcaccttt

SEQ ID NO: 43121 - DNA, 25 bp, Homo sapien
ctttcgcttgcctcgctggaagagc

SEQ ID NO: 43122 - DNA, 25 bp, Homo sapien
gagcccggagtcatgcagaagccag

SEQ ID NO: 43123 - DNA, 25 bp, Homo sapien
gtggatatcgtttctcctcacgttc

SEQ ID NO: 43124 - DNA, 25 bp, Homo sapien
gggttattatcttccgctgcccgcc

SEQ ID NO: 43125 - DNA, 25 bp, Homo sapien
gcctggtgcaccaggagcggacctt

SEQ ID NO: 43126 - DNA, 25 bp, Homo sapien
acgcagagtggcctgcagtcctacc

SEQ ID NO: 43127 - DNA, 25 bp, Homo sapien
cacgatcattcagctgcagcccttg

SEQ ID NO: 43128 - DNA, 25 bp, Homo sapien
ggggacacctaacgcacgtgctgga

SEQ ID NO: 43129 - DNA, 25 bp, Homo sapien
ctatcacgtgtggtaccagggcaac

SEQ ID NO: 43130 - DNA, 25 bp, Homo sapien
aggctgaagctgactctgcccgcag

SEQ ID NO: 43131 - DNA, 25 bp, Homo sapien
gacttcatatgctccagatctccta

SEQ ID NO: 43132 - DNA, 25 bp, Homo sapien
ccgagcacgagggtcgggtttgttg

SEQ ID NO: 43133 - DNA, 25 bp, Homo sapien
cacctactgccgaggtcgcggaggc

SEQ ID NO: 43134 - DNA, 25 bp, Homo sapien
tgtgtggcctgcatgactatgtgcg

SEQ ID NO: 43135 - DNA, 25 bp, Homo sapien
tgcatgactatgtgcgagggaaacc

SEQ ID NO: 43136 - DNA, 25 bp, Homo sapien
tgactatgtgcgagggaaaccgtac

SEQ ID NO: 43137 - DNA, 25 bp, Homo sapien
tgtgcgagggaaaccgtacaacgcc

SEQ ID NO: 43138 - DNA, 25 bp, Homo sapien
ccgtacaacgcctcggagtaaatag

SEQ ID NO: 43139 - DNA, 25 bp, Homo sapien
caacgcctcggagtaaatagtaagc

SEQ ID NO: 43140 - DNA, 25 bp, Homo sapien
ggcgacctcttcgaattctctgcta

SEQ ID NO: 43141 - DNA, 25 bp, Homo sapien
gacgccgtcagtaccaggaagtgca

SEQ ID NO: 43142 - DNA, 25 bp, Homo sapien
gcgatgaggaagcgcacgtcgtcca

SEQ ID NO: 43143 - DNA, 25 bp, Homo sapien
caaggcaggcaagaaccacagggga

SEQ ID NO: 43144 - DNA, 25 bp, Homo sapien
tcgaattctctgctatctctgggga

SEQ ID NO: 43145 - DNA, 25 bp, Homo sapien
gccctgccgggacttctttccagtc

SEQ ID NO: 43146 - DNA, 25 bp, Homo sapien
acggcggacagacgggcgacatcct

SEQ ID NO: 43147 - DNA, 25 bp, Homo sapien
tctctgctatctctggggagcctcg

SEQ ID NO: 43148 - DNA, 25 bp, Homo sapien
ttccgctcagcggagaagctggccc

SEQ ID NO: 43149 - DNA, 25 bp, Homo sapien
cagccgcgaattcgacgtgagcttc

SEQ ID NO: 43150 - DNA, 25 bp, Homo sapien
cgagcgacatctacgcggtcatcca

SEQ ID NO: 43151 - DNA, 25 bp, Homo sapien
ttatcctgcgctccatcggcatgga

SEQ ID NO: 43152 - DNA, 25 bp, Homo sapien
gacttcgtggtaggagcgcttatcc

SEQ ID NO: 43153 - DNA, 25 bp, Homo sapien
ggccctgttcctacgcgtctacgag

SEQ ID NO: 43154 - DNA, 25 bp, Homo sapien
tatgcgccgcatgtgatacctttga

SEQ ID NO: 43155 - DNA, 25 bp, Homo sapien
tccgcatctgtttccagggagacga

SEQ ID NO: 43156 - DNA, 25 bp, Homo sapien
agctgaagccatggaagcctccgca

SEQ ID NO: 43157 - DNA, 25 bp, Homo sapien
aaagacgggccgcttacgcagctgc

SEQ ID NO: 43158 - DNA, 25 bp, Homo sapien
cccgcaggtcgctgatcagggccag

SEQ ID NO: 43159 - DNA, 25 bp, Homo sapien
cctctagagcaagatactaactatc

SEQ ID NO: 43160 - DNA, 25 bp, Homo sapien
ccgcagtccagagtgccgagtgcca

SEQ ID NO: 43161 - DNA, 25 bp, Homo sapien
cccgtgtgctcgttgtctctgttcc

SEQ ID NO: 43162 - DNA, 25 bp, Homo sapien
tcgatcgcccagctcaaaataccgg

SEQ ID NO: 43163 - DNA, 25 bp, Homo sapien
cctccgcaggtgatgacaaggaccc

SEQ ID NO: 43164 - DNA, 25 bp, Homo sapien
agcctccgatcgctaccagacagta

SEQ ID NO: 43165 - DNA, 25 bp, Homo sapien
ttccacttccgtccagggagacttc

SEQ ID NO: 43166 - DNA, 25 bp, Homo sapien
ggcgactgtaccttggactccctaa

SEQ ID NO: 43167 - DNA, 25 bp, Homo sapien
gccggcggatcctttcccaagtatc

SEQ ID NO: 43168 - DNA, 25 bp, Homo sapien
agcagccgatctcacagttgttctc

SEQ ID NO: 43169 - DNA, 25 bp, Homo sapien
ccgcacctgtagaagttctctgagc

SEQ ID NO: 43170 - DNA, 25 bp, Homo sapien
agctcgccctcgaacacactgtagg

SEQ ID NO: 43171 - DNA, 25 bp, Homo sapien
tgttctcgaacgaagctcggaccgc

SEQ ID NO: 43172 - DNA, 25 bp, Homo sapien
gcaccagcggtgagctctcccgcca

SEQ ID NO: 43173 - DNA, 25 bp, Homo sapien
gcaggaagaggagaccagcagaacc

SEQ ID NO: 43174 - DNA, 25 bp, Homo sapien
cggcagggcccatggcccgcacgct

SEQ ID NO: 43175 - DNA, 25 bp, Homo sapien
tccgaacatgcctgccacgcggctg

SEQ ID NO: 43176 - DNA, 25 bp, Homo sapien
ggcagcttcagctcttccacccggc

SEQ ID NO: 43177 - DNA, 25 bp, Homo sapien
gaggagaccagcagaaccgccttct

SEQ ID NO: 43178 - DNA, 25 bp, Homo sapien
atgacccgcaggtaggcagcctcac

SEQ ID NO: 43179 - DNA, 25 bp, Homo sapien
cccgggcctccgaacatgcctgcca

SEQ ID NO: 43180 - DNA, 25 bp, Homo sapien
gccgctggctgaacaggtactcata

SEQ ID NO: 43181 - DNA, 25 bp, Homo sapien
cggaagagcttccagatgtcgaaca

SEQ ID NO: 43182 - DNA, 25 bp, Homo sapien
cagctgggccgagttcttaaagttt

SEQ ID NO: 43183 - DNA, 25 bp, Homo sapien
tcccgtttcttggtgcggccaaaca

SEQ ID NO: 43184 - DNA, 25 bp, Homo sapien
acacggtcttatcgtcctggccaga

SEQ ID NO: 43185 - DNA, 25 bp, Homo sapien
gggcttcttccgcaagatccgcagc

SEQ ID NO: 43186 - DNA, 25 bp, Homo sapien
cgactgcagcgagccttaaggttct

SEQ ID NO: 43187 - DNA, 25 bp, Homo sapien
gccagagcgggccttaatctcatta

SEQ ID NO: 43188 - DNA, 25 bp, Homo sapien
caggaccctgctgaagtatcgcttc

SEQ ID NO: 43189 - DNA, 25 bp, Homo sapien
agctgcattcgcttctcggtttttg

SEQ ID NO: 43190 - DNA, 25 bp, Homo sapien
ctcgttgacaccgtaagctcgttcg

SEQ ID NO: 43191 - DNA, 25 bp, Homo sapien
tcctggcggatttgcacgtaatcta

SEQ ID NO: 43192 - DNA, 25 bp, Homo sapien
tcgtgtccagtagccgcaatcccag

SEQ ID NO: 43193 - DNA, 25 bp, Homo sapien
ccgcagctcaatcgcggagcaacta

SEQ ID NO: 43194 - DNA, 25 bp, Homo sapien
ccggctcagtctgcctataggtgca

SEQ ID NO: 43195 - DNA, 25 bp, Homo sapien
ggagctcccattcttcaggaccctg

SEQ ID NO: 43196 - DNA, 25 bp, Homo sapien
atttgcgtcagaaacgttgcttccc

SEQ ID NO: 43197 - DNA, 25 bp, Homo sapien
gtcaacgtcggtgtaactatgatta

SEQ ID NO: 43198 - DNA, 25 bp, Homo sapien
gtcagtattcaaacaagggctccaa

SEQ ID NO: 43199 - DNA, 25 bp, Homo sapien
tttcgggactctcagccttcttttc

SEQ ID NO: 43200 - DNA, 25 bp, Homo sapien
cacaacggggccaaaggcagtaact

SEQ ID NO: 43201 - DNA, 25 bp, Homo sapien
cagtaactcggttgaaaggcgcgcc

SEQ ID NO: 43202 - DNA, 25 bp, Homo sapien
gcggacgcagctcctcaactaggca

SEQ ID NO: 43203 - DNA, 25 bp, Homo sapien
actaggcaagaggaagcgcgaattg

SEQ ID NO: 43204 - DNA, 25 bp, Homo sapien
aggacttccgggtcaagacctgcgg

SEQ ID NO: 43205 - DNA, 25 bp, Homo sapien
agctgaagcagttcgatgcctaccc

SEQ ID NO: 43206 - DNA, 25 bp, Homo sapien
tgctgcgcctgcgtgaggaaaaaga

SEQ ID NO: 43207 - DNA, 25 bp, Homo sapien
ccgcctgtaagagaacgcggctaaa

SEQ ID NO: 43208 - DNA, 25 bp, Homo sapien
tcctagagcttagcccgggctcctg

SEQ ID NO: 43209 - DNA, 25 bp, Homo sapien
cgaacggtgctattagcgtttctaa

SEQ ID NO: 43210 - DNA, 25 bp, Homo sapien
gggcagtagcttccagacccaattg

SEQ ID NO: 43211 - DNA, 25 bp, Homo sapien
cgagcacaaggcacacgaacggtgc

SEQ ID NO: 43212 - DNA, 25 bp, Homo sapien
cccaggaaagacacccgcacatagg

SEQ ID NO: 43213 - DNA, 25 bp, Homo sapien
tggggcgcctccaaaacagctcagc

SEQ ID NO: 43214 - DNA, 25 bp, Homo sapien
ttttgccaacggagccaaaccgatg

SEQ ID NO: 43215 - DNA, 25 bp, Homo sapien
tgaggccagatttgccgcggccaga

SEQ ID NO: 43216 - DNA, 25 bp, Homo sapien
cctatggagccctatggaccgaggc

SEQ ID NO: 43217 - DNA, 25 bp, Homo sapien
gctcagctgctcgttccattcgggc

SEQ ID NO: 43218 - DNA, 25 bp, Homo sapien
cgccctgaaggtggcgttaaagaca

SEQ ID NO: 43219 - DNA, 25 bp, Homo sapien
caaaccgatggtggggttcacagtc

SEQ ID NO: 43220 - DNA, 25 bp, Homo sapien
acgcccaactttttcagcgagaaca

SEQ ID NO: 43221 - DNA, 25 bp, Homo sapien
ctttagcgtcagtgactaggcagca

SEQ ID NO: 43222 - DNA, 25 bp, Homo sapien
ggagaccgaggctcctctgtgacgt

SEQ ID NO: 43223 - DNA, 25 bp, Homo sapien
acagcaaagggctccggtcagcgga

SEQ ID NO: 43224 - DNA, 25 bp, Homo sapien
ctgccgacttcacgcagggtccgtg

SEQ ID NO: 43225 - DNA, 25 bp, Homo sapien
gctcaatgagcatcacctcggagga

SEQ ID NO: 43226 - DNA, 25 bp, Homo sapien
cccggaggaaccacatgggcaggaa

SEQ ID NO: 43227 - DNA, 25 bp, Homo sapien
gcgcctcggagccacaactggcaga

SEQ ID NO: 43228 - DNA, 25 bp, Homo sapien
tggagcccttgggttcccgcagaac

SEQ ID NO: 43229 - DNA, 25 bp, Homo sapien
aaataggtctgtggtccgcaaggcc

SEQ ID NO: 43230 - DNA, 25 bp, Homo sapien
agctttctgagtacgggccaggcca

SEQ ID NO: 43231 - DNA, 25 bp, Homo sapien
ccgcgggtgttcaagagctttctga

SEQ ID NO: 43232 - DNA, 25 bp, Homo sapien
tggatctgaggcaggagatgcctcc

SEQ ID NO: 43233 - DNA, 25 bp, Homo sapien
ttctcccgaccctggatctgaggca

SEQ ID NO: 43234 - DNA, 25 bp, Homo sapien
tccagtagtctctgaggagccgctc

SEQ ID NO: 43235 - DNA, 25 bp, Homo sapien
cgcagaaccgactgggtctccagta

SEQ ID NO: 43236 - DNA, 25 bp, Homo sapien
ctgagcgacatcactctgcagcatc

SEQ ID NO: 43237 - DNA, 25 bp, Homo sapien
ccaaggccaggtggtgatccaactg

SEQ ID NO: 43238 - DNA, 25 bp, Homo sapien
gcttttgaaggcgaccaaggccagg

SEQ ID NO: 43239 - DNA, 25 bp, Homo sapien
ccctgggaattgctgggcttttgaa

SEQ ID NO: 43240 - DNA, 25 bp, Homo sapien
tgtccgacggttccgatggtccctc

SEQ ID NO: 43241 - DNA, 25 bp, Homo sapien
cagcagtcgctctgtccgacggttc

SEQ ID NO: 43242 - DNA, 25 bp, Homo sapien
agcacaccggaggagccaacagcgc

SEQ ID NO: 43243 - DNA, 25 bp, Homo sapien
gcgatttcgcggtctttgtgagtgc

SEQ ID NO: 43244 - DNA, 25 bp, Homo sapien
gctcacagcctaggcttcggagggc

SEQ ID NO: 43245 - DNA, 25 bp, Homo sapien
ctcgctcacagcctaggcttcggag

SEQ ID NO: 43246 - DNA, 25 bp, Homo sapien
gctggatcacgcaggtgagtctccc

SEQ ID NO: 43247 - DNA, 25 bp, Homo sapien
ctgccaggaagtagacggacctctg

SEQ ID NO: 43248 - DNA, 25 bp, Homo sapien
ctctgctggatcacgcaggtgagtc

SEQ ID NO: 43249 - DNA, 25 bp, Homo sapien
agacggacctctgctggatcacgca

SEQ ID NO: 43250 - DNA, 25 bp, Homo sapien
tccctgccaggaagtagacggacct

SEQ ID NO: 43251 - DNA, 25 bp, Homo sapien
aagtagacggacctctgctggatca

SEQ ID NO: 43252 - DNA, 25 bp, Homo sapien
agttgccgcgggctcgaaggcctcc

SEQ ID NO: 43253 - DNA, 25 bp, Homo sapien
agtcttaccggggaaagctgcgcgg

SEQ ID NO: 43254 - DNA, 25 bp, Homo sapien
aagctgcgcggcaccagaacccaga

SEQ ID NO: 43255 - DNA, 25 bp, Homo sapien
tcccggagcccaacgcagccaccac

SEQ ID NO: 43256 - DNA, 25 bp, Homo sapien
ctccttcgccgcttcacaaaatggc

SEQ ID NO: 43257 - DNA, 25 bp, Homo sapien
ctcagcggctccgcgttccagaagg

SEQ ID NO: 43258 - DNA, 25 bp, Homo sapien
gcgctgacggtctcgggcgatctcc

SEQ ID NO: 43259 - DNA, 25 bp, Homo sapien
cgaccctttgtgtggggcgctagtt

SEQ ID NO: 43260 - DNA, 25 bp, Homo sapien
cggcaccttttcctgtctcaggtga

SEQ ID NO: 43261 - DNA, 25 bp, Homo sapien
ccgtgtcaaaatgggcttcgtgatg

SEQ ID NO: 43262 - DNA, 25 bp, Homo sapien
gccaagctgcttcgaccgtgtcaaa

SEQ ID NO: 43263 - DNA, 25 bp, Homo sapien
ggagtcgggctacccactgattttc

SEQ ID NO: 43264 - DNA, 25 bp, Homo sapien
ttttccgtgagagacgtagagctga

SEQ ID NO: 43265 - DNA, 25 bp, Homo sapien
ggaatattcagttgcgtcgccgcgc

SEQ ID NO: 43266 - DNA, 25 bp, Homo sapien
tggacaggaaggctccggaatattc

SEQ ID NO: 43267 - DNA, 25 bp, Homo sapien
agcagcatctgtaacttggccagga

SEQ ID NO: 43268 - DNA, 25 bp, Homo sapien
gaccgtagcccaatctcgcgcaatg

SEQ ID NO: 43269 - DNA, 25 bp, Homo sapien
cggtcactgaaacagggccgatttc

SEQ ID NO: 43270 - DNA, 25 bp, Homo sapien
tcgacaagctccctgaaatggcggc

SEQ ID NO: 43271 - DNA, 25 bp, Homo sapien
gcggccgaagtatcgcgagacctaa

SEQ ID NO: 43272 - DNA, 25 bp, Homo sapien
cggctaggcccgagagaatctaaaa

SEQ ID NO: 43273 - DNA, 25 bp, Homo sapien
gcagcgttcaactggcgccatgttg

SEQ ID NO: 43274 - DNA, 25 bp, Homo sapien
gtaggctgcctgtcaatctttcaga

SEQ ID NO: 43275 - DNA, 25 bp, Homo sapien
agacctaagtatggctccggcgacc

SEQ ID NO: 43276 - DNA, 25 bp, Homo sapien
gcagctgggaccttacgtcactcgg

SEQ ID NO: 43277 - DNA, 25 bp, Homo sapien
ccggcttcggtgatctcagtgatta

SEQ ID NO: 43278 - DNA, 25 bp, Homo sapien
ggacttcgtgttcctgctagggcgc

SEQ ID NO: 43279 - DNA, 25 bp, Homo sapien
gccgttgccacagtgatcgggcaga

SEQ ID NO: 43280 - DNA, 25 bp, Homo sapien
accttacgtcactcggtggtggcga

SEQ ID NO: 43281 - DNA, 25 bp, Homo sapien
agagtccttctgtcggttggtcctg

SEQ ID NO: 43282 - DNA, 25 bp, Homo sapien
cgggtgatggatagcgtccattccc

SEQ ID NO: 43283 - DNA, 25 bp, Homo sapien
tggtgcagagcacgcagagtccttc

SEQ ID NO: 43284 - DNA, 25 bp, Homo sapien
tgcgccaggaaaacattcccgaacc

SEQ ID NO: 43285 - DNA, 25 bp, Homo sapien
ttccggccgaggtgcggtcgtcact

SEQ ID NO: 43286 - DNA, 25 bp, Homo sapien
gaacacaaagggctctgcccgtccg

SEQ ID NO: 43287 - DNA, 25 bp, Homo sapien
gaaaacagccctgaaagcgcggcca

SEQ ID NO: 43288 - DNA, 25 bp, Homo sapien
cggtgaccagcgctgccctcggcgc

SEQ ID NO: 43289 - DNA, 25 bp, Homo sapien
ccagcccgaggaaaacagccctgaa

SEQ ID NO: 43290 - DNA, 25 bp, Homo sapien
ggctgtgcgccaggaaaacattccc

SEQ ID NO: 43291 - DNA, 25 bp, Homo sapien
ccgaggaaaacagccctgaaagcgc

SEQ ID NO: 43292 - DNA, 25 bp, Homo sapien
cccacacagttacgctcaggggctg

SEQ ID NO: 43293 - DNA, 25 bp, Homo sapien
ccgcttcggtttgcaggtgaccttt

SEQ ID NO: 43294 - DNA, 25 bp, Homo sapien
ccctctagcgttctcgagtcgcatg

SEQ ID NO: 43295 - DNA, 25 bp, Homo sapien
aaagtctctggcttctctgcgtcca

SEQ ID NO: 43296 - DNA, 25 bp, Homo sapien
tttccggttaaagggcagagctcgc

SEQ ID NO: 43297 - DNA, 25 bp, Homo sapien
cgggcgtcactctttgtccggtagc

SEQ ID NO: 43298 - DNA, 25 bp, Homo sapien
cccttctgattgaccctgatgagct

SEQ ID NO: 43299 - DNA, 25 bp, Homo sapien
gctccttccagtttctccggtggca

SEQ ID NO: 43300 - DNA, 25 bp, Homo sapien
actgacttggcagttctctgcgctg

SEQ ID NO: 43301 - DNA, 25 bp, Homo sapien
tgccggaccggaactgacttggcag

SEQ ID NO: 43302 - DNA, 25 bp, Homo sapien
ttggcagttctctgcgctggcaaga

SEQ ID NO: 43303 - DNA, 25 bp, Homo sapien
agttctctgcgctggcaagagagga

SEQ ID NO: 43304 - DNA, 25 bp, Homo sapien
tggcaagagaggagcggtaccggaa

SEQ ID NO: 43305 - DNA, 25 bp, Homo sapien
cggaccggaactgacttggcagttc

SEQ ID NO: 43306 - DNA, 25 bp, Homo sapien
cgagccgtggttccgggtctgcaat

SEQ ID NO: 43307 - DNA, 25 bp, Homo sapien
gttccgggtctgcaatgttccggcg

SEQ ID NO: 43308 - DNA, 25 bp, Homo sapien
cgacaccgacggattgactctggca

SEQ ID NO: 43309 - DNA, 25 bp, Homo sapien
gctaccggcttccagagacttcctg

SEQ ID NO: 43310 - DNA, 25 bp, Homo sapien
cagcctccatctgtgcttggcgagc

SEQ ID NO: 43311 - DNA, 25 bp, Homo sapien
ttccgtctgactgaacgcaggtttc

SEQ ID NO: 43312 - DNA, 25 bp, Homo sapien
gccgccaccgcctgataatacgagt

SEQ ID NO: 43313 - DNA, 25 bp, Homo sapien
cagcgactgtgcctgactgaccaca

SEQ ID NO: 43314 - DNA, 25 bp, Homo sapien
acccactggccgcttctagagagtc

SEQ ID NO: 43315 - DNA, 25 bp, Homo sapien
tgtctgactgagcacaaggttccta

SEQ ID NO: 43316 - DNA, 25 bp, Homo sapien
gaacgcactgggctatcctccgcga

SEQ ID NO: 43317 - DNA, 25 bp, Homo sapien
accgggcacagagccgagaagtcta

SEQ ID NO: 43318 - DNA, 25 bp, Homo sapien
cgagaagtctaagctagggaaaatc

SEQ ID NO: 43319 - DNA, 25 bp, Homo sapien
taagctagggaaaatcgaggtcggc

SEQ ID NO: 43320 - DNA, 25 bp, Homo sapien
agcggggcatttctgcgcagctcta

SEQ ID NO: 43321 - DNA, 25 bp, Homo sapien
tgcgcagctctagcgcgcctcggag

SEQ ID NO: 43322 - DNA, 25 bp, Homo sapien
ggcgggctcgattcccgatctttgg

SEQ ID NO: 43323 - DNA, 25 bp, Homo sapien
ccgatctttgggcactgacaggccg

SEQ ID NO: 43324 - DNA, 25 bp, Homo sapien
ttctcggctcagagtcacggagtgc

SEQ ID NO: 43325 - DNA, 25 bp, Homo sapien
gtcgctccagtcagacgccaaagct

SEQ ID NO: 43326 - DNA, 25 bp, Homo sapien
gaagccgtcgccagagttacgtcgc

SEQ ID NO: 43327 - DNA, 25 bp, Homo sapien
cacggagtgccttgaactaggccca

SEQ ID NO: 43328 - DNA, 25 bp, Homo sapien
tcagacgccaaagctggagaacttc

SEQ ID NO: 43329 - DNA, 25 bp, Homo sapien
aacctgcaggcacgggccattcttc

SEQ ID NO: 43330 - DNA, 25 bp, Homo sapien
cctttcctgattccttgtgtatgtg

SEQ ID NO: 43331 - DNA, 25 bp, Homo sapien
agaacttccggtgcgtttccgctgt

SEQ ID NO: 43332 - DNA, 25 bp, Homo sapien
ccaaccttggcgcttgggagagcag

SEQ ID NO: 43333 - DNA, 25 bp, Homo sapien
gaagcgccttctccggttgggatcg

SEQ ID NO: 43334 - DNA, 25 bp, Homo sapien
ccagttctgtcttccgatcccgggt

SEQ ID NO: 43335 - DNA, 25 bp, Homo sapien
gtgcccggccaaccttggcgcttgg

SEQ ID NO: 43336 - DNA, 25 bp, Homo sapien
ggcattcctccattcaacccagctg

SEQ ID NO: 43337 - DNA, 25 bp, Homo sapien
agctgcctcggatcccgtctcggta

SEQ ID NO: 43338 - DNA, 25 bp, Homo sapien
ttcccgagctctttccctgacctgg

SEQ ID NO: 43339 - DNA, 25 bp, Homo sapien
catatcaagcggctgccaaagcctg

SEQ ID NO: 43340 - DNA, 25 bp, Homo sapien
gctgagccagccgagtcccagccca

SEQ ID NO: 43341 - DNA, 25 bp, Homo sapien
cccacggtggcctggctttgccgct

SEQ ID NO: 43342 - DNA, 25 bp, Homo sapien
tggcctggctttgccgctcccagcg

SEQ ID NO: 43343 - DNA, 25 bp, Homo sapien
gcccatctacaacatcagctccctg

SEQ ID NO: 43344 - DNA, 25 bp, Homo sapien
tgctgcactgtggccttgcactcca

SEQ ID NO: 43345 - DNA, 25 bp, Homo sapien
tgtggccttgcactccatccgcagg

SEQ ID NO: 43346 - DNA, 25 bp, Homo sapien
tggccttgcactccatccgcaggat

SEQ ID NO: 43347 - DNA, 25 bp, Homo sapien
cgcaggatcagctgccgctcgctga

SEQ ID NO: 43348 - DNA, 25 bp, Homo sapien
ccctcggcccgggatcatgaaaggc

SEQ ID NO: 43349 - DNA, 25 bp, Homo sapien
cctgtttgcagggaccgaccgcaac

SEQ ID NO: 43350 - DNA, 25 bp, Homo sapien
cccgccacctctccgacagcctaga

SEQ ID NO: 43351 - DNA, 25 bp, Homo sapien
tgaaaggcctcggtgacagccgccc

SEQ ID NO: 43352 - DNA, 25 bp, Homo sapien
ccgggatcatgaaaggcctcggtga

SEQ ID NO: 43353 - DNA, 25 bp, Homo sapien
ctgctagggtgaaggcccctgccct

SEQ ID NO: 43354 - DNA, 25 bp, Homo sapien
atcatgaaaggcctcggtgacagcc

SEQ ID NO: 43355 - DNA, 25 bp, Homo sapien
tgctgtcgcccacggaggccttcgc

SEQ ID NO: 43356 - DNA, 25 bp, Homo sapien
cctcacccaagaccgcggcgcggcg

SEQ ID NO: 43357 - DNA, 25 bp, Homo sapien
gagagcagagcaacccccgcaggta

SEQ ID NO: 43358 - DNA, 25 bp, Homo sapien
cggcgccagagctatctgagggcca

SEQ ID NO: 43359 - DNA, 25 bp, Homo sapien
catcaaggccatgggcgacgaggac

SEQ ID NO: 43360 - DNA, 25 bp, Homo sapien
gcagctacatcaaggccatgggcga

SEQ ID NO: 43361 - DNA, 25 bp, Homo sapien
cagcggcagctacatcaaggccatg

SEQ ID NO: 43362 - DNA, 25 bp, Homo sapien
gctgctgtccccacgcgagacggat

SEQ ID NO: 43363 - DNA, 25 bp, Homo sapien
agagctatctgagggccacgcagca

SEQ ID NO: 43364 - DNA, 25 bp, Homo sapien
gtctgtccggtccacgtcgtcgctg

SEQ ID NO: 43365 - DNA, 25 bp, Homo sapien
ggccacatgccaagcgggctgcgcg

SEQ ID NO: 43366 - DNA, 25 bp, Homo sapien
ttccagctggaaccggtttggcgag

SEQ ID NO: 43367 - DNA, 25 bp, Homo sapien
tcgcgttccagctggaaccggtttg

SEQ ID NO: 43368 - DNA, 25 bp, Homo sapien
catgcgtcgcgttccagctggaacc

SEQ ID NO: 43369 - DNA, 25 bp, Homo sapien
cacagagcatgcgtcgcgttccagc

SEQ ID NO: 43370 - DNA, 25 bp, Homo sapien
tcgctggggtgaactggtgggaact

SEQ ID NO: 43371 - DNA, 25 bp, Homo sapien
ccttacagcgaggtgtcgctggggt

SEQ ID NO: 43372 - DNA, 25 bp, Homo sapien
gcgctggggtcctaagttcctggcc

SEQ ID NO: 43373 - DNA, 25 bp, Homo sapien
tcctgcgcaacagctcggaggcgct

SEQ ID NO: 43374 - DNA, 25 bp, Homo sapien
agcactgggtcctgcgcaacagctc

SEQ ID NO: 43375 - DNA, 25 bp, Homo sapien
ccaaaggagcactgggtcctgcgca

SEQ ID NO: 43376 - DNA, 25 bp, Homo sapien
cgcttcgccaaaggagcactgggtc

SEQ ID NO: 43377 - DNA, 25 bp, Homo sapien
cgagcctcgcttcgccaaaggagca

SEQ ID NO: 43378 - DNA, 25 bp, Homo sapien
tcagcctcatctctgggttctttcc

SEQ ID NO: 43379 - DNA, 25 bp, Homo sapien
ctctgggttctttccctcgtcgagg

SEQ ID NO: 43380 - DNA, 25 bp, Homo sapien
ccagagcaccctgcggaacagccca

SEQ ID NO: 43381 - DNA, 25 bp, Homo sapien
gtgcttcccgagtggttccttcaac

SEQ ID NO: 43382 - DNA, 25 bp, Homo sapien
tgtttccctccacgaaaccagtgct

SEQ ID NO: 43383 - DNA, 25 bp, Homo sapien
tgttcatcgtgtttccctccacgaa

SEQ ID NO: 43384 - DNA, 25 bp, Homo sapien
cggagctacttgttcatcgtgtttc

SEQ ID NO: 43385 - DNA, 25 bp, Homo sapien
ccaggccgcggagctacttgttcat

SEQ ID NO: 43386 - DNA, 25 bp, Homo sapien
tgtctgcccaatgtcactgcccaga

SEQ ID NO: 43387 - DNA, 25 bp, Homo sapien
gctgatgtggacagagcgagtcacc

SEQ ID NO: 43388 - DNA, 25 bp, Homo sapien
gcgcgcggacaacttggaaagtttc

SEQ ID NO: 43389 - DNA, 25 bp, Homo sapien
gtttggtttcaaaagtgcacgttgc

SEQ ID NO: 43390 - DNA, 25 bp, Homo sapien
gcgctccgcacaaagtttgttttct

SEQ ID NO: 43391 - DNA, 25 bp, Homo sapien
aaggaaagtctgtctccgaggcatc

SEQ ID NO: 43392 - DNA, 25 bp, Homo sapien
caggccgaaggtgatccaagcctcc

SEQ ID NO: 43393 - DNA, 25 bp, Homo sapien
tgcacgttgctaaccgccagcaggg

SEQ ID NO: 43394 - DNA, 25 bp, Homo sapien
aaagccgctgggaaaagtcagtgca

SEQ ID NO: 43395 - DNA, 25 bp, Homo sapien
atcctgcaccggacctgagtgagcg

SEQ ID NO: 43396 - DNA, 25 bp, Homo sapien
acgctgacgtccagcctcggttttc

SEQ ID NO: 43397 - DNA, 25 bp, Homo sapien
atgtcaccgttctaccaagattgtc

SEQ ID NO: 43398 - DNA, 25 bp, Homo sapien
tcgctgtttcactcggatggcttcg

SEQ ID NO: 43399 - DNA, 25 bp, Homo sapien
gccctcaaagtctccgtctggagta

SEQ ID NO: 43400 - DNA, 25 bp, Homo sapien
cgttccggcacaatcgagtagggca

SEQ ID NO: 43401 - DNA, 25 bp, Homo sapien
tggcccaagggtgtcagagcaaact

SEQ ID NO: 43402 - DNA, 25 bp, Homo sapien
tcgcaaggaaaggtagagccgctcc

SEQ ID NO: 43403 - DNA, 25 bp, Homo sapien
atttccgccacgagtagcgcgcttg

SEQ ID NO: 43404 - DNA, 25 bp, Homo sapien
tccacctcgggaactaccgagaaga

SEQ ID NO: 43405 - DNA, 25 bp, Homo sapien
gaactaccgagaagatggtggctga

SEQ ID NO: 43406 - DNA, 25 bp, Homo sapien
gagggaggctctcttgctacccaca

SEQ ID NO: 43407 - DNA, 25 bp, Homo sapien
ttgctacccacacgctgtcgccggc

SEQ ID NO: 43408 - DNA, 25 bp, Homo sapien
ggcaaaggagcgacgcccccgaatg

SEQ ID NO: 43409 - DNA, 25 bp, Homo sapien
ggcacccgccgtcagtgcagcagca

SEQ ID NO: 43410 - DNA, 25 bp, Homo sapien
cctgtgacccagggtgttgagcccg

SEQ ID NO: 43411 - DNA, 25 bp, Homo sapien
agtgctgtgcccgtccacctcggga

SEQ ID NO: 43412 - DNA, 25 bp, Homo sapien
agtctgtgacttcctgacgcccgtc

SEQ ID NO: 43413 - DNA, 25 bp, Homo sapien
cgacgggtacgacgccgaagagatt

SEQ ID NO: 43414 - DNA, 25 bp, Homo sapien
cggcagatacgtctctaatggggtc

SEQ ID NO: 43415 - DNA, 25 bp, Homo sapien
gctcctctagtccaagtcctttagg

SEQ ID NO: 43416 - DNA, 25 bp, Homo sapien
ctgatcagggtgaagcggtctccac

SEQ ID NO: 43417 - DNA, 25 bp, Homo sapien
cgcagccgatactccctgatcaggg

SEQ ID NO: 43418 - DNA, 25 bp, Homo sapien
aaacacaaggccacgggtcgctctc

SEQ ID NO: 43419 - DNA, 25 bp, Homo sapien
acactatcgtgtccttttgcgcccg

SEQ ID NO: 43420 - DNA, 25 bp, Homo sapien
aggagatctgcttgctgcgcacaga

SEQ ID NO: 43421 - DNA, 25 bp, Homo sapien
ctggctggatgtgctcttcactttc

SEQ ID NO: 43422 - DNA, 25 bp, Homo sapien
cctggcgcacacagttggtgatctc

SEQ ID NO: 43423 - DNA, 25 bp, Homo sapien
aagccgggctcgataatgatcttgc

SEQ ID NO: 43424 - DNA, 25 bp, Homo sapien
tgccctctttgtcatgaaccacagg

SEQ ID NO: 43425 - DNA, 25 bp, Homo sapien
agtagactcggatgcccgtcttgtc

SEQ ID NO: 43426 - DNA, 25 bp, Homo sapien
tcgatgcgcgaatggaccttgtcca

SEQ ID NO: 43427 - DNA, 25 bp, Homo sapien
agttgcagagccaccgaccatagga

SEQ ID NO: 43428 - DNA, 25 bp, Homo sapien
caaactgcaggtgtcgccgcagctc

SEQ ID NO: 43429 - DNA, 25 bp, Homo sapien
agctcctcctgtgaaggttcgctga

SEQ ID NO: 43430 - DNA, 25 bp, Homo sapien
cagcagcttgttctggtcctcgagc

SEQ ID NO: 43431 - DNA, 25 bp, Homo sapien
gatccttcatgtcgtccatctcagc

SEQ ID NO: 43432 - DNA, 25 bp, Homo sapien
gcatgggactcgtgtgtctcgccca

SEQ ID NO: 43433 - DNA, 25 bp, Homo sapien
gccagctcgttcagcagcagcttgt

SEQ ID NO: 43434 - DNA, 25 bp, Homo sapien
gtgctccgagcggaacttggccagc

SEQ ID NO: 43435 - DNA, 25 bp, Homo sapien
tgagcacagaacaactgtcctccga

SEQ ID NO: 43436 - DNA, 25 bp, Homo sapien
gctcgtccttgcacaggtggatctc

SEQ ID NO: 43437 - DNA, 25 bp, Homo sapien
tacaccgtcgcctggaagctagatg

SEQ ID NO: 43438 - DNA, 25 bp, Homo sapien
tctgcaccttccttactgtggacgg

SEQ ID NO: 43439 - DNA, 25 bp, Homo sapien
gagacgtggctccacgcggccacta

SEQ ID NO: 43440 - DNA, 25 bp, Homo sapien
gttaccggtgccaccatctggccgg

SEQ ID NO: 43441 - DNA, 25 bp, Homo sapien
ggcccgagaccgctgtctgcagaca

SEQ ID NO: 43442 - DNA, 25 bp, Homo sapien
gaccctgtgcctcaggagacactgg

SEQ ID NO: 43443 - DNA, 25 bp, Homo sapien
tccgagcgacggaagcccacggaga

SEQ ID NO: 43444 - DNA, 25 bp, Homo sapien
tccatatagacgtcccgcatctcca

SEQ ID NO: 43445 - DNA, 25 bp, Homo sapien
cgcagctcctcaatctcgtcctgcg

SEQ ID NO: 43446 - DNA, 25 bp, Homo sapien
tgatacacgtcctcctccatataga

SEQ ID NO: 43447 - DNA, 25 bp, Homo sapien
agctcctgcagctgatacacgtcct

SEQ ID NO: 43448 - DNA, 25 bp, Homo sapien
tcttgctggcctggtccagctgctg

SEQ ID NO: 43449 - DNA, 25 bp, Homo sapien
cggcaggtcttgctggcctggtcca

SEQ ID NO: 43450 - DNA, 25 bp, Homo sapien
actgcggcgctcggctttgcgcagc

SEQ ID NO: 43451 - DNA, 25 bp, Homo sapien
cagccggtactgcaggatgcggcag

SEQ ID NO: 43452 - DNA, 25 bp, Homo sapien
tgcgaggcaacagcgaccccttcga

SEQ ID NO: 43453 - DNA, 25 bp, Homo sapien
tccgcgaacaaaaggcggacgcggc

SEQ ID NO: 43454 - DNA, 25 bp, Homo sapien
gcacgccgatcgctccctcgggctc

SEQ ID NO: 43455 - DNA, 25 bp, Homo sapien
agagtgcggcccgaccgcctccagg

SEQ ID NO: 43456 - DNA, 25 bp, Homo sapien
cgccgcgcggtctctccgctgctct

SEQ ID NO: 43457 - DNA, 25 bp, Homo sapien
cgctgcaggcgactgctgagcccgg

SEQ ID NO: 43458 - DNA, 25 bp, Homo sapien
tcttgtccggccgtgaggagaacgc

SEQ ID NO: 43459 - DNA, 25 bp, Homo sapien
ggcccttagccagcgaccagccggc

SEQ ID NO: 43460 - DNA, 25 bp, Homo sapien
tcggaggcgcgaacaccatcccaag

SEQ ID NO: 43461 - DNA, 25 bp, Homo sapien
cctttccctggaccagattttcgcg

SEQ ID NO: 43462 - DNA, 25 bp, Homo sapien
cctggaccagattttcgcgggaagc

SEQ ID NO: 43463 - DNA, 25 bp, Homo sapien
attttcgcgggaagccggatcctct

SEQ ID NO: 43464 - DNA, 25 bp, Homo sapien
ggatcctctccgttcccttggagtg

SEQ ID NO: 43465 - DNA, 25 bp, Homo sapien
tcccttggagtgagcaagcgggaca

SEQ ID NO: 43466 - DNA, 25 bp, Homo sapien
gcgggacagttctgcggaaagtttc

SEQ ID NO: 43467 - DNA, 25 bp, Homo sapien
gccgtgtgcgcaagcgtgtccagcc

SEQ ID NO: 43468 - DNA, 25 bp, Homo sapien
cccacgagagtgagatcccaatcta

SEQ ID NO: 43469 - DNA, 25 bp, Homo sapien
cagtccagtcgtcctcaaatcaatc

SEQ ID NO: 43470 - DNA, 25 bp, Homo sapien
cactgacagttgagcccttcgggca

SEQ ID NO: 43471 - DNA, 25 bp, Homo sapien
ctcctgcgcaggctcactgacagtt

SEQ ID NO: 43472 - DNA, 25 bp, Homo sapien
tccaaggagtattggcagcctattg

SEQ ID NO: 43473 - DNA, 25 bp, Homo sapien
gtccggcacagcagtcaagaacctc

SEQ ID NO: 43474 - DNA, 25 bp, Homo sapien
gaatcggctcgctgcatggctacac

SEQ ID NO: 43475 - DNA, 25 bp, Homo sapien
cggagccgctacctcggatgttctt

SEQ ID NO: 43476 - DNA, 25 bp, Homo sapien
ttttcctccggagctcctagcagtc

SEQ ID NO: 43477 - DNA, 25 bp, Homo sapien
gcgggacgtgttgtcatccaccgtc

SEQ ID NO: 43478 - DNA, 25 bp, Homo sapien
gccaaagcgcgcgaaaatctgcagc

SEQ ID NO: 43479 - DNA, 25 bp, Homo sapien
ggcttgtcctcgaacatcccttcag

SEQ ID NO: 43480 - DNA, 25 bp, Homo sapien
tggcagtaaagtcgtccagggcttc

SEQ ID NO: 43481 - DNA, 25 bp, Homo sapien
tcagattctgaaagacctgtccttg

SEQ ID NO: 43482 - DNA, 25 bp, Homo sapien
cccggaaatgtgataagaagatgta

SEQ ID NO: 43483 - DNA, 25 bp, Homo sapien
tgctgccgctcacctctaggctgta

SEQ ID NO: 43484 - DNA, 25 bp, Homo sapien
ccgcggacactgacctgtgcttaga

SEQ ID NO: 43485 - DNA, 25 bp, Homo sapien
gaggttactagtcgccgctcgagag

SEQ ID NO: 43486 - DNA, 25 bp, Homo sapien
cgcgtcccggtagctcccggaatag

SEQ ID NO: 43487 - DNA, 25 bp, Homo sapien
tcccggaataggagcgttgcgagac

SEQ ID NO: 43488 - DNA, 25 bp, Homo sapien
gctgctggaagcgtcgaagctcagc

SEQ ID NO: 43489 - DNA, 25 bp, Homo sapien
cgggctcttggagccactttcccga

SEQ ID NO: 43490 - DNA, 25 bp, Homo sapien
tttcccgagcggaagtcagcccgcg

SEQ ID NO: 43491 - DNA, 25 bp, Homo sapien
tctgtcctcgggaactgcaaggccc

SEQ ID NO: 43492 - DNA, 25 bp, Homo sapien
cctgaatacgttccctcggcggttg

SEQ ID NO: 43493 - DNA, 25 bp, Homo sapien
acagagccggttggttgctcagtgc

SEQ ID NO: 43494 - DNA, 25 bp, Homo sapien
tggttgctcagtgcgcgtcacttcc

SEQ ID NO: 43495 - DNA, 25 bp, Homo sapien
tccgctcagggcctgaatacgttcc

SEQ ID NO: 43496 - DNA, 25 bp, Homo sapien
tgtcgctccgctcagggcctgaata

SEQ ID NO: 43497 - DNA, 25 bp, Homo sapien
tcctcggtgcggtggcctggctttc

SEQ ID NO: 43498 - DNA, 25 bp, Homo sapien
tgggaaccgagagagagccgtcctc

SEQ ID NO: 43499 - DNA, 25 bp, Homo sapien
ttccgggactcagggtcgcagggaa

SEQ ID NO: 43500 - DNA, 25 bp, Homo sapien
tcccgctggacgtcccgcggtccgc

SEQ ID NO: 43501 - DNA, 25 bp, Homo sapien
cgcggccttttgttgtgatgcagcg

SEQ ID NO: 43502 - DNA, 25 bp, Homo sapien
gggccaagccgcgatacccaagcgc

SEQ ID NO: 43503 - DNA, 25 bp, Homo sapien
cgtgcgtccgtctgccggtgagccc

SEQ ID NO: 43504 - DNA, 25 bp, Homo sapien
gccgtctgcccgtcccgctggacgt

SEQ ID NO: 43505 - DNA, 25 bp, Homo sapien
ccggaatccattccggcctgggagc

SEQ ID NO: 43506 - DNA, 25 bp, Homo sapien
cgtgatttcgggagaggcggatctg

SEQ ID NO: 43507 - DNA, 25 bp, Homo sapien
ccggaccaccctggcgtcggatcgc

SEQ ID NO: 43508 - DNA, 25 bp, Homo sapien
ttttcgttgcctgggtccgcccaga

SEQ ID NO: 43509 - DNA, 25 bp, Homo sapien
ttggcgcccagtcctttttcgttgc

SEQ ID NO: 43510 - DNA, 25 bp, Homo sapien
tccgcccagagatgagtcgggacgc

SEQ ID NO: 43511 - DNA, 25 bp, Homo sapien
tgggttctaattggacgcttaagcc

SEQ ID NO: 43512 - DNA, 25 bp, Homo sapien
ccaagctgttcggaggcttcaactc

SEQ ID NO: 43513 - DNA, 25 bp, Homo sapien
aggcccttcctctcgccaggggtag

SEQ ID NO: 43514 - DNA, 25 bp, Homo sapien
tacacactgtgaagcgtccgcgccg

SEQ ID NO: 43515 - DNA, 25 bp, Homo sapien
agcaagcgcaaaagacacggggtgt

SEQ ID NO: 43516 - DNA, 25 bp, Homo sapien
ccggggagaacctctaggcacaggc

SEQ ID NO: 43517 - DNA, 25 bp, Homo sapien
ggagtgtcccgagtccctgcacgac

SEQ ID NO: 43518 - DNA, 25 bp, Homo sapien
ccctgcacgacctcatgtgccagtg

SEQ ID NO: 43519 - DNA, 25 bp, Homo sapien
cttcgagtacctgcaggccttcctg

SEQ ID NO: 43520 - DNA, 25 bp, Homo sapien
ggccttcctggaggactacttcacg

SEQ ID NO: 43521 - DNA, 25 bp, Homo sapien
gaggactacttcacgtccaccgagc

SEQ ID NO: 43522 - DNA, 25 bp, Homo sapien
ccagcccggggagaacctctaggca

SEQ ID NO: 43523 - DNA, 25 bp, Homo sapien
tgcccacagggatggtgaaccgcga

SEQ ID NO: 43524 - DNA, 25 bp, Homo sapien
cacgtgcgagcgcaaccgggacaaa

SEQ ID NO: 43525 - DNA, 25 bp, Homo sapien
gacccgtgtgagcttgggctcgcac

SEQ ID NO: 43526 - DNA, 25 bp, Homo sapien
cgtgcgagcgcaaccgggacaaagc

SEQ ID NO: 43527 - DNA, 25 bp, Homo sapien
agcgcaaccgggacaaagcgctcgc

SEQ ID NO: 43528 - DNA, 25 bp, Homo sapien
cagcgctggccactcccggcgggac

SEQ ID NO: 43529 - DNA, 25 bp, Homo sapien
tgtgagcttgggctcgcacccccag

SEQ ID NO: 43530 - DNA, 25 bp, Homo sapien
gggacaaagcgctcgcccgcgctgc

SEQ ID NO: 43531 - DNA, 25 bp, Homo sapien
acccgtgtgagcttgggctcgcacc

SEQ ID NO: 43532 - DNA, 25 bp, Homo sapien
ccgtttcttgtctggccgtgacttc

SEQ ID NO: 43533 - DNA, 25 bp, Homo sapien
gcgtcaagtcccaaggtatttccta

SEQ ID NO: 43534 - DNA, 25 bp, Homo sapien
ccctggcctcggaacaccatttgta

SEQ ID NO: 43535 - DNA, 25 bp, Homo sapien
catcttccggttgctacaggttacg

SEQ ID NO: 43536 - DNA, 25 bp, Homo sapien
tgcgcgggtgaaatcgagctttaaa

SEQ ID NO: 43537 - DNA, 25 bp, Homo sapien
tggcgccggcatccacaaaaataga

SEQ ID NO: 43538 - DNA, 25 bp, Homo sapien
gcttgcgttaccagagtccacccgg

SEQ ID NO: 43539 - DNA, 25 bp, Homo sapien
ctgacccagtgttgagctaaaaatg

SEQ ID NO: 43540 - DNA, 25 bp, Homo sapien
ggcctcggctgaactgctcatcatc

SEQ ID NO: 43541 - DNA, 25 bp, Homo sapien
gtagagctcattccttccgtgcata

SEQ ID NO: 43542 - DNA, 25 bp, Homo sapien
ggcaccggagactgagctcaaattt

SEQ ID NO: 43543 - DNA, 25 bp, Homo sapien
ggtgactactgcttttgcgcccaaa

SEQ ID NO: 43544 - DNA, 25 bp, Homo sapien
accacgttttttgctctatggggca

SEQ ID NO: 43545 - DNA, 25 bp, Homo sapien
gctcatcatcggctggtacatcttc

SEQ ID NO: 43546 - DNA, 25 bp, Homo sapien
tacgcgctcaggcaccctcatgaag

SEQ ID NO: 43547 - DNA, 25 bp, Homo sapien
agcggatctcggcaaaccctctttc

SEQ ID NO: 43548 - DNA, 25 bp, Homo sapien
acgcgcagtttcctctccggagggg

SEQ ID NO: 43549 - DNA, 25 bp, Homo sapien
cctgcgtgtaaagcctgcgctaagc

SEQ ID NO: 43550 - DNA, 25 bp, Homo sapien
gtcaattaggcgcacgcgcagtttc

SEQ ID NO: 43551 - DNA, 25 bp, Homo sapien
agggccgtgcaagcgttgtccgcat

SEQ ID NO: 43552 - DNA, 25 bp, Homo sapien
cctgtcgcgcttcgtccaggttgac

SEQ ID NO: 43553 - DNA, 25 bp, Homo sapien
cagtgtccttcagcggcgtcaatta

SEQ ID NO: 43554 - DNA, 25 bp, Homo sapien
cctggcaagcggctcaaggcttggc

SEQ ID NO: 43555 - DNA, 25 bp, Homo sapien
ctcttgactctacggcctgcgtgta

SEQ ID NO: 43556 - DNA, 25 bp, Homo sapien
ccacagacatgctgtgggtgctctc

SEQ ID NO: 43557 - DNA, 25 bp, Homo sapien
tgctctccactaagggtgggtcctg

SEQ ID NO: 43558 - DNA, 25 bp, Homo sapien
tcctgggtttctcgtcgcaggtgtt

SEQ ID NO: 43559 - DNA, 25 bp, Homo sapien
ggtactccctgcagaagctggcata

SEQ ID NO: 43560 - DNA, 25 bp, Homo sapien
cagaagctggcatacacggtgtcgc

SEQ ID NO: 43561 - DNA, 25 bp, Homo sapien
cggccgtatcatcaggtgctcctgt

SEQ ID NO: 43562 - DNA, 25 bp, Homo sapien
gtgctcctgtgcatctcggccagca

SEQ ID NO: 43563 - DNA, 25 bp, Homo sapien
cgtcgcaggtgttcaggtactccct

SEQ ID NO: 43564 - DNA, 25 bp, Homo sapien
ttagtcttctagtcgagccggccga

SEQ ID NO: 43565 - DNA, 25 bp, Homo sapien
tcatgttggtgaacccgcttcgttc

SEQ ID NO: 43566 - DNA, 25 bp, Homo sapien
atccttactccgtgagcgctgggcg

SEQ ID NO: 43567 - DNA, 25 bp, Homo sapien
atgcagcagattgtgatccttactc

SEQ ID NO: 43568 - DNA, 25 bp, Homo sapien
ttttatcaggcgcagtgtggacagc

SEQ ID NO: 43569 - DNA, 25 bp, Homo sapien
ccacctttgaggactttgtatgcac

SEQ ID NO: 43570 - DNA, 25 bp, Homo sapien
acccatcctgggatcgggctgtcta

SEQ ID NO: 43571 - DNA, 25 bp, Homo sapien
gctgtctaccgcaaacgcctgatca

SEQ ID NO: 43572 - DNA, 25 bp, Homo sapien
attgacgcggtaattggcgcgctta

SEQ ID NO: 43573 - DNA, 25 bp, Homo sapien
attgcagtggctgcttcgcagaggc

SEQ ID NO: 43574 - DNA, 25 bp, Homo sapien
tcaggctgcagattgcagtggctgc

SEQ ID NO: 43575 - DNA, 25 bp, Homo sapien
accgggctaattgaggtcaggctgc

SEQ ID NO: 43576 - DNA, 25 bp, Homo sapien
cgcgcttaggcaccgggctaattga

SEQ ID NO: 43577 - DNA, 25 bp, Homo sapien
cggcgcagtgattgacgcggtaatt

SEQ ID NO: 43578 - DNA, 25 bp, Homo sapien
cttgggagaacgctctccagcggca

SEQ ID NO: 43579 - DNA, 25 bp, Homo sapien
ttttcccttgggagaacgctctcca

SEQ ID NO: 43580 - DNA, 25 bp, Homo sapien
ctggacactagggacgcgcaatcaa

SEQ ID NO: 43581 - DNA, 25 bp, Homo sapien
gtaccatggacgtgggcgaacttct

SEQ ID NO: 43582 - DNA, 25 bp, Homo sapien
gctcgccgcactttacggcagtgtg

SEQ ID NO: 43583 - DNA, 25 bp, Homo sapien
gtcgctcgcacttttgccctattgg

SEQ ID NO: 43584 - DNA, 25 bp, Homo sapien
gcgcgtccttttaccgcggtgtggc

SEQ ID NO: 43585 - DNA, 25 bp, Homo sapien
cctgttccaaatgcagcgcgcttta

SEQ ID NO: 43586 - DNA, 25 bp, Homo sapien
gctccaggcggaagcaaccctgttc

SEQ ID NO: 43587 - DNA, 25 bp, Homo sapien
gggcgaacttctgagctaccaggta

SEQ ID NO: 43588 - DNA, 25 bp, Homo sapien
tgatgataaatcaagcggcagatcc

SEQ ID NO: 43589 - DNA, 25 bp, Homo sapien
ctgccggtaaagttaggagcctctg

SEQ ID NO: 43590 - DNA, 25 bp, Homo sapien
cagcctgggcaaaactttgatgata

SEQ ID NO: 43591 - DNA, 25 bp, Homo sapien
tggcacttttcctgcaactcggcgg

SEQ ID NO: 43592 - DNA, 25 bp, Homo sapien
cgtgctttgcgggaaccgcgtccct

SEQ ID NO: 43593 - DNA, 25 bp, Homo sapien
tggacggcatttctgtggctgaagc

SEQ ID NO: 43594 - DNA, 25 bp, Homo sapien
atggccacaccgatatgcacagccg

SEQ ID NO: 43595 - DNA, 25 bp, Homo sapien
gcggatacgcacacctgcatggcca

SEQ ID NO: 43596 - DNA, 25 bp, Homo sapien
aaggtcaaggcctacctgcgggtgc

SEQ ID NO: 43597 - DNA, 25 bp, Homo sapien
gggagaactccgtcctgcatctgcc

SEQ ID NO: 43598 - DNA, 25 bp, Homo sapien
agcccacggacgaaggcacctacga

SEQ ID NO: 43599 - DNA, 25 bp, Homo sapien
tacgagtgccgcgtcatcgacttca

SEQ ID NO: 43600 - DNA, 25 bp, Homo sapien
atcgacttcagcgacggcaaggccc

SEQ ID NO: 43601 - DNA, 25 bp, Homo sapien
aggcctgcagcctctagactgatgc

SEQ ID NO: 43602 - DNA, 25 bp, Homo sapien
gcaaggcccggcaccacaaggtcaa

SEQ ID NO: 43603 - DNA, 25 bp, Homo sapien
ccacgctgtacagagtgcatgagga

SEQ ID NO: 43604 - DNA, 25 bp, Homo sapien
cggttttctagagctccgacgcctc

SEQ ID NO: 43605 - DNA, 25 bp, Homo sapien
ccgtatcgcgccagaaaggttccga

SEQ ID NO: 43606 - DNA, 25 bp, Homo sapien
gcctcgctctgtctccttcgaagtg

SEQ ID NO: 43607 - DNA, 25 bp, Homo sapien
cctggcagtctgtcagtcggtaaaa

SEQ ID NO: 43608 - DNA, 25 bp, Homo sapien
tcggtaaaaagtcccgcagcctgtc

SEQ ID NO: 43609 - DNA, 25 bp, Homo sapien
gtcctccttctctgagtcggcgctg

SEQ ID NO: 43610 - DNA, 25 bp, Homo sapien
agctctcggagctgagcaactctca

SEQ ID NO: 43611 - DNA, 25 bp, Homo sapien
gctcgagcggtcaaagctctttccg

SEQ ID NO: 43612 - DNA, 25 bp, Homo sapien
gagaccctccaagtgcgaccactgg

SEQ ID NO: 43613 - DNA, 25 bp, Homo sapien
tggctccttccactggcggcgagac

SEQ ID NO: 43614 - DNA, 25 bp, Homo sapien
caagtgcgaccactggcggctggca

SEQ ID NO: 43615 - DNA, 25 bp, Homo sapien
cggagagcggcgctaacttatagcc

SEQ ID NO: 43616 - DNA, 25 bp, Homo sapien
cgctaacttatagcccgctttgggg

SEQ ID NO: 43617 - DNA, 25 bp, Homo sapien
ggcgacctgggaggccacccattgc

SEQ ID NO: 43618 - DNA, 25 bp, Homo sapien
cggctgcggtgactctgatactcac

SEQ ID NO: 43619 - DNA, 25 bp, Homo sapien
ggtgactctgatactcaccctcggc

SEQ ID NO: 43620 - DNA, 25 bp, Homo sapien
cgctcctcgctcttcccacggcgca

SEQ ID NO: 43621 - DNA, 25 bp, Homo sapien
cccattgtacagacccgcagagcga

SEQ ID NO: 43622 - DNA, 25 bp, Homo sapien
tgtgcctgagccctttgtgcccagc

SEQ ID NO: 43623 - DNA, 25 bp, Homo sapien
ccctttgtgcctgagccctttgtgc

SEQ ID NO: 43624 - DNA, 25 bp, Homo sapien
agacggcgagagacataagggagcc

SEQ ID NO: 43625 - DNA, 25 bp, Homo sapien
accccggcgtcatctcggaggagcg

SEQ ID NO: 43626 - DNA, 25 bp, Homo sapien
ttaccatggtgacgggctgccagcg

SEQ ID NO: 43627 - DNA, 25 bp, Homo sapien
cgcgttaccatggtgacgggctgcc

SEQ ID NO: 43628 - DNA, 25 bp, Homo sapien
ctggggagatggtttccacctgcac

SEQ ID NO: 43629 - DNA, 25 bp, Homo sapien
aggcctccggatacagctgtgtttg

SEQ ID NO: 43630 - DNA, 25 bp, Homo sapien
ggctctgcctagtacctcggcgcgt

SEQ ID NO: 43631 - DNA, 25 bp, Homo sapien
cgtggaccaacagcgacctggcggc

SEQ ID NO: 43632 - DNA, 25 bp, Homo sapien
atacagctgtgtttgccgggtgact

SEQ ID NO: 43633 - DNA, 25 bp, Homo sapien
acagagacgggcatgctgagccgat

SEQ ID NO: 43634 - DNA, 25 bp, Homo sapien
actcaccggtgtagtgcaccacgca

SEQ ID NO: 43635 - DNA, 25 bp, Homo sapien
gcggttccacggctctgcctagtac

SEQ ID NO: 43636 - DNA, 25 bp, Homo sapien
ggcaccgagagacgcatccatcagt

SEQ ID NO: 43637 - DNA, 25 bp, Homo sapien
gggttcgcgcctaccatctgtccgt

SEQ ID NO: 43638 - DNA, 25 bp, Homo sapien
tggttagtttctcttccttggcggc

SEQ ID NO: 43639 - DNA, 25 bp, Homo sapien
cttagcgcagcgaaggaaagccggc

SEQ ID NO: 43640 - DNA, 25 bp, Homo sapien
agggtttcattccttagcgcagcga

SEQ ID NO: 43641 - DNA, 25 bp, Homo sapien
agcagatcgagctggaagggtttca

SEQ ID NO: 43642 - DNA, 25 bp, Homo sapien
atccatcagtccgagttcccgaagc

SEQ ID NO: 43643 - DNA, 25 bp, Homo sapien
ggggtcctaccttgactgaagagga

SEQ ID NO: 43644 - DNA, 25 bp, Homo sapien
aaggacagggcctgacctctctggc

SEQ ID NO: 43645 - DNA, 25 bp, Homo sapien
caagatgtctgcagatttcgagaga

SEQ ID NO: 43646 - DNA, 25 bp, Homo sapien
aggaaccgacgcgagcagtcctgca

SEQ ID NO: 43647 - DNA, 25 bp, Homo sapien
ttcgcgccggcggaaatacagacga

SEQ ID NO: 43648 - DNA, 25 bp, Homo sapien
tgtttcccgccatccaggggcacta

SEQ ID NO: 43649 - DNA, 25 bp, Homo sapien
aggacgagacactgcaccaaggaca

SEQ ID NO: 43650 - DNA, 25 bp, Homo sapien
gctcactccggcaaagaggacgaga

SEQ ID NO: 43651 - DNA, 25 bp, Homo sapien
gccacacgacaaggaagctacgctc

SEQ ID NO: 43652 - DNA, 25 bp, Homo sapien
cgctgcaggcacgtctgcttgggca

SEQ ID NO: 43653 - DNA, 25 bp, Homo sapien
ctcccaaggccggtgctgtgtacct

SEQ ID NO: 43654 - DNA, 25 bp, Homo sapien
gcccgaggagtggtcttcccaagaa

SEQ ID NO: 43655 - DNA, 25 bp, Homo sapien
ctggcgctccggatgagtcaatgag

SEQ ID NO: 43656 - DNA, 25 bp, Homo sapien
actagagagagcgtcttgtggctgc

SEQ ID NO: 43657 - DNA, 25 bp, Homo sapien
ccagccgtatttccgcgggcgctga

SEQ ID NO: 43658 - DNA, 25 bp, Homo sapien
cttgagaaacggcttggcaacgctg

SEQ ID NO: 43659 - DNA, 25 bp, Homo sapien
gggctagagacctcgcgacttttac

SEQ ID NO: 43660 - DNA, 25 bp, Homo sapien
cctaaggacgcaggtagagcgcctc

SEQ ID NO: 43661 - DNA, 25 bp, Homo sapien
cgcgatgaggtaggtgcatccgtca

SEQ ID NO: 43662 - DNA, 25 bp, Homo sapien
cctctccacttgatccggaatggga

SEQ ID NO: 43663 - DNA, 25 bp, Homo sapien
cggctctgtgtctcgggaattattt

SEQ ID NO: 43664 - DNA, 25 bp, Homo sapien
ggaattatttgacgccaccggttca

SEQ ID NO: 43665 - DNA, 25 bp, Homo sapien
aagctctgattaggcgcaccgcgca

SEQ ID NO: 43666 - DNA, 25 bp, Homo sapien
cagtcggaagttgcctgagcagatc

SEQ ID NO: 43667 - DNA, 25 bp, Homo sapien
cacttggctggggagttatttgacg

SEQ ID NO: 43668 - DNA, 25 bp, Homo sapien
cgaccgaccgggatcctcgaggtgc

SEQ ID NO: 43669 - DNA, 25 bp, Homo sapien
cggcagcaccacgaccgaccgggat

SEQ ID NO: 43670 - DNA, 25 bp, Homo sapien
acgaccgaccgggatcctcgaggtg

SEQ ID NO: 43671 - DNA, 25 bp, Homo sapien
gatcctcgaggtgccagcccatggc

SEQ ID NO: 43672 - DNA, 25 bp, Homo sapien
cccatggccgagcctgccctcctcc

SEQ ID NO: 43673 - DNA, 25 bp, Homo sapien
cgtgtcctcggatcccgcgggcccg

SEQ ID NO: 43674 - DNA, 25 bp, Homo sapien
gcccgcattgccaggcgctgcgccc

SEQ ID NO: 43675 - DNA, 25 bp, Homo sapien
cgctgcgcccagcgctgggccgacc

SEQ ID NO: 43676 - DNA, 25 bp, Homo sapien
actgaacgacagtagcagcaggcgc

SEQ ID NO: 43677 - DNA, 25 bp, Homo sapien
gcaggcctcaagacttggctgcgga

SEQ ID NO: 43678 - DNA, 25 bp, Homo sapien
cctggtcgcccaggtgcgaaaactg

SEQ ID NO: 43679 - DNA, 25 bp, Homo sapien
caagacttggctgcggaggatgcac

SEQ ID NO: 43680 - DNA, 25 bp, Homo sapien
cgggctgccagcaacggcccagtga

SEQ ID NO: 43681 - DNA, 25 bp, Homo sapien
agcaacggcccagtgaggccaccag

SEQ ID NO: 43682 - DNA, 25 bp, Homo sapien
aaatggagtgactcggagacttccc

SEQ ID NO: 43683 - DNA, 25 bp, Homo sapien
gcccaggtgcgaaaactgaacgaca

SEQ ID NO: 43684 - DNA, 25 bp, Homo sapien
ccgccattgtttagtcgtgatgctc

SEQ ID NO: 43685 - DNA, 25 bp, Homo sapien
gtgatgctctcattttctctgaatc

SEQ ID NO: 43686 - DNA, 25 bp, Homo sapien
gaatcaacaattttctgctcggctc

SEQ ID NO: 43687 - DNA, 25 bp, Homo sapien
ggggcttttcctcgcccgcctgatg

SEQ ID NO: 43688 - DNA, 25 bp, Homo sapien
ccgcctgatgacagcagagcggcgc

SEQ ID NO: 43689 - DNA, 25 bp, Homo sapien
cccacgctaggaatgcaaactgtag

SEQ ID NO: 43690 - DNA, 25 bp, Homo sapien
cgtcgccgctttccgccattgttta

SEQ ID NO: 43691 - DNA, 25 bp, Homo sapien
gctgcggatcattaccgcccttttg

SEQ ID NO: 43692 - DNA, 25 bp, Homo sapien
gtgtcgcagaagtcctggtccatta

SEQ ID NO: 43693 - DNA, 25 bp, Homo sapien
gctgctgtggcaccaagtcttcttc

SEQ ID NO: 43694 - DNA, 25 bp, Homo sapien
ttcacgctgctcatggccatttatg

SEQ ID NO: 43695 - DNA, 25 bp, Homo sapien
gcgccgtggtcaacatctttctggt

SEQ ID NO: 43696 - DNA, 25 bp, Homo sapien
gcccagcgagttccactgcatgatg

SEQ ID NO: 43697 - DNA, 25 bp, Homo sapien
ccattggcatcatcgtgttcagcta

SEQ ID NO: 43698 - DNA, 25 bp, Homo sapien
ctcaaggccgtgtccaagttcagtc

SEQ ID NO: 43699 - DNA, 25 bp, Homo sapien
ccatcttcgtcatcggcggcatctg

SEQ ID NO: 43700 - DNA, 25 bp, Homo sapien
tgacttatagacgacccgctccgcg

SEQ ID NO: 43701 - DNA, 25 bp, Homo sapien
ggtgtcctcatagagtcctgccttc

SEQ ID NO: 43702 - DNA, 25 bp, Homo sapien
ttcgcctccattctgcacgcatttg

SEQ ID NO: 43703 - DNA, 25 bp, Homo sapien
tgccagccacttctaccttcaaggg

SEQ ID NO: 43704 - DNA, 25 bp, Homo sapien
ggccaggatgcgagcttagcacctc

SEQ ID NO: 43705 - DNA, 25 bp, Homo sapien
cgctccgcgagagactgacaactca

SEQ ID NO: 43706 - DNA, 25 bp, Homo sapien
tgacaactcagtcctgcgggctttc

SEQ ID NO: 43707 - DNA, 25 bp, Homo sapien
gcttccttgggagcgatccatgcca

SEQ ID NO: 43708 - DNA, 25 bp, Homo sapien
ggaccctggatttcgttagctctta

SEQ ID NO: 43709 - DNA, 25 bp, Homo sapien
gggcgtctttcaaggctccgtttga

SEQ ID NO: 43710 - DNA, 25 bp, Homo sapien
catgtatcggggtaagcaggactcc

SEQ ID NO: 43711 - DNA, 25 bp, Homo sapien
ctcccaggggttgttccatgtatcg

SEQ ID NO: 43712 - DNA, 25 bp, Homo sapien
tcttggcaacgacctccgagctagc

SEQ ID NO: 43713 - DNA, 25 bp, Homo sapien
ggcgcacacgacatgtatctatata

SEQ ID NO: 43714 - DNA, 25 bp, Homo sapien
gtggattctaaaccctacagccctg

SEQ ID NO: 43715 - DNA, 25 bp, Homo sapien
ccctgaagcttctggttctagactc

SEQ ID NO: 43716 - DNA, 25 bp, Homo sapien
tctccgagtcagtgtgtcgccttca

SEQ ID NO: 43717 - DNA, 25 bp, Homo sapien
ctccaggttttgtgctcagcttgca

SEQ ID NO: 43718 - DNA, 25 bp, Homo sapien
tggatccgctccactaatcctggct

SEQ ID NO: 43719 - DNA, 25 bp, Homo sapien
agacactaggcaggctccggatagc

SEQ ID NO: 43720 - DNA, 25 bp, Homo sapien
aatcccggacttctatggtggaagg

SEQ ID NO: 43721 - DNA, 25 bp, Homo sapien
gtgtcgccttcagaaaaatcccgga

SEQ ID NO: 43722 - DNA, 25 bp, Homo sapien
agcttgcagcgtctcttgtcctagg

SEQ ID NO: 43723 - DNA, 25 bp, Homo sapien
gaactagcaccctagacgcccaagg

SEQ ID NO: 43724 - DNA, 25 bp, Homo sapien
tgaaagcagccttgacagccagagg

SEQ ID NO: 43725 - DNA, 25 bp, Homo sapien
caacgggtcgttccaagtccgcgct

SEQ ID NO: 43726 - DNA, 25 bp, Homo sapien
ttaaaggcctgaatcgcgcggcgtg

SEQ ID NO: 43727 - DNA, 25 bp, Homo sapien
gggcatcgaggtacttaaaggcctg

SEQ ID NO: 43728 - DNA, 25 bp, Homo sapien
cagccagaggcgagtcaagtggaaa

SEQ ID NO: 43729 - DNA, 25 bp, Homo sapien
cgtagaatttcgcagccagaatggg

SEQ ID NO: 43730 - DNA, 25 bp, Homo sapien
ccagaatgggtacgtctcagcgatc

SEQ ID NO: 43731 - DNA, 25 bp, Homo sapien
ctcagcgatcctgaaagcagccttg

SEQ ID NO: 43732 - DNA, 25 bp, Homo sapien
ggctcatcgattccggcccagagga

SEQ ID NO: 43733 - DNA, 25 bp, Homo sapien
gtggtcccagcctgctatcacctag

SEQ ID NO: 43734 - DNA, 25 bp, Homo sapien
ggagccacagcggacaccaaacaac

SEQ ID NO: 43735 - DNA, 25 bp, Homo sapien
gactctggaaagacgggtaccgaga

SEQ ID NO: 43736 - DNA, 25 bp, Homo sapien
tcctcggtctgttctggactcatgg

SEQ ID NO: 43737 - DNA, 25 bp, Homo sapien
tcaggatccggctgacagcaccagc

SEQ ID NO: 43738 - DNA, 25 bp, Homo sapien
tcgcaattccttgacgaggccaggg

SEQ ID NO: 43739 - DNA, 25 bp, Homo sapien
cgctttggccaagggacgatagctt

SEQ ID NO: 43740 - DNA, 25 bp, Homo sapien
gccgccagtagcagagcccagcacg

SEQ ID NO: 43741 - DNA, 25 bp, Homo sapien
gcccggggcaccgtagcgctgcgcc

SEQ ID NO: 43742 - DNA, 25 bp, Homo sapien
ccagcacgttgcgggtgcccagttc

SEQ ID NO: 43743 - DNA, 25 bp, Homo sapien
gcccagcacgttgcgggtgcccagt

SEQ ID NO: 43744 - DNA, 25 bp, Homo sapien
cggccgccagtagcagagcccagca

SEQ ID NO: 43745 - DNA, 25 bp, Homo sapien
cgctgcgccggcctcacgcgcaccc

SEQ ID NO: 43746 - DNA, 25 bp, Homo sapien
ctgcgccggcctcacgcgcaccctc

SEQ ID NO: 43747 - DNA, 25 bp, Homo sapien
ggccgccagtagcagagcccagcac

SEQ ID NO: 43748 - DNA, 25 bp, Homo sapien
caggtctcttgtgcccaccgtgcaa

SEQ ID NO: 43749 - DNA, 25 bp, Homo sapien
aaaacccacggcaatcttcagcagc

SEQ ID NO: 43750 - DNA, 25 bp, Homo sapien
agaagcgcggagagtccctagacct

SEQ ID NO: 43751 - DNA, 25 bp, Homo sapien
ccctagacctcggagtgcgctgcaa

SEQ ID NO: 43752 - DNA, 25 bp, Homo sapien
gagacagccgaaagccagcaacttg

SEQ ID NO: 43753 - DNA, 25 bp, Homo sapien
acgcgagcagtacctgcaggaccca

SEQ ID NO: 43754 - DNA, 25 bp, Homo sapien
ctccagcgtttcttcgccaggcgtg

SEQ ID NO: 43755 - DNA, 25 bp, Homo sapien
accgcccgaattctgggtttctgca

SEQ ID NO: 43756 - DNA, 25 bp, Homo sapien
cccagccggccgactcgagaaagaa

SEQ ID NO: 43757 - DNA, 25 bp, Homo sapien
aggcccagccgatgagggcccagca

SEQ ID NO: 43758 - DNA, 25 bp, Homo sapien
cagggtgaaactggcacggcagaac

SEQ ID NO: 43759 - DNA, 25 bp, Homo sapien
acttcggaagtggaaatgagcggcc

SEQ ID NO: 43760 - DNA, 25 bp, Homo sapien
cgaagtctcgctgacgccgcaagcg

SEQ ID NO: 43761 - DNA, 25 bp, Homo sapien
ctccagcagatactcggcgcggcag

SEQ ID NO: 43762 - DNA, 25 bp, Homo sapien
agtggggcttcacccaagagctgct

SEQ ID NO: 43763 - DNA, 25 bp, Homo sapien
ccacctagtcccgagtggggcttca

SEQ ID NO: 43764 - DNA, 25 bp, Homo sapien
tacgagcaggacttgcagcaccgca

SEQ ID NO: 43765 - DNA, 25 bp, Homo sapien
agtcacgtggacctgctgacggagc

SEQ ID NO: 43766 - DNA, 25 bp, Homo sapien
atgggcacagtacgagcaggacttg

SEQ ID NO: 43767 - DNA, 25 bp, Homo sapien
aggcctcgctgaggaacgacgccga

SEQ ID NO: 43768 - DNA, 25 bp, Homo sapien
ttgcagcaccgcaagcgaaagcatg

SEQ ID NO: 43769 - DNA, 25 bp, Homo sapien
aaagcatgagcggaagcgcagcacg

SEQ ID NO: 43770 - DNA, 25 bp, Homo sapien
gccgccgcaagaaagtgtccttcga

SEQ ID NO: 43771 - DNA, 25 bp, Homo sapien
tgaagaaatgggcacagtacgagca

SEQ ID NO: 43772 - DNA, 25 bp, Homo sapien
cgagcgcctggctcgtttcctgaac

SEQ ID NO: 43773 - DNA, 25 bp, Homo sapien
acgactgctcttcgggcacctactt

SEQ ID NO: 43774 - DNA, 25 bp, Homo sapien
cccgaccgagctgttcagcgagtca

SEQ ID NO: 43775 - DNA, 25 bp, Homo sapien
actgcacgccggtttttgtccgagg

SEQ ID NO: 43776 - DNA, 25 bp, Homo sapien
gttgcctataaagcgggactgcacg

SEQ ID NO: 43777 - DNA, 25 bp, Homo sapien
cgcctcgctccgctattggaaggaa

SEQ ID NO: 43778 - DNA, 25 bp, Homo sapien
agcaagcccagcatcgcagccaata

SEQ ID NO: 43779 - DNA, 25 bp, Homo sapien
cacgcgtgtcgagacgcacttccag

SEQ ID NO: 43780 - DNA, 25 bp, Homo sapien
ggagctagcctcgtgaccttttacc

SEQ ID NO: 43781 - DNA, 25 bp, Homo sapien
ccaaagcccgttcttcctaagtgtg

SEQ ID NO: 43782 - DNA, 25 bp, Homo sapien
gccacgctcgtaaaaggtcacctga

SEQ ID NO: 43783 - DNA, 25 bp, Homo sapien
aaggtcacctgaagcatctaccctc

SEQ ID NO: 43784 - DNA, 25 bp, Homo sapien
taccctccacgctcaagaggtaggc

SEQ ID NO: 43785 - DNA, 25 bp, Homo sapien
ggagcgcgcccttttctccaaaatg

SEQ ID NO: 43786 - DNA, 25 bp, Homo sapien
ctccaaaatggctgagcagggtcac

SEQ ID NO: 43787 - DNA, 25 bp, Homo sapien
cgcccagtgcgtgcaaggttccact

SEQ ID NO: 43788 - DNA, 25 bp, Homo sapien
gttcgtcctccgcaaagagtgactg

SEQ ID NO: 43789 - DNA, 25 bp, Homo sapien
cacagcagctcagtcccggtctgag

SEQ ID NO: 43790 - DNA, 25 bp, Homo sapien
agacttccgggtcggcgttgcacac

SEQ ID NO: 43791 - DNA, 25 bp, Homo sapien
tcgagaacgagattgcagggacgct

SEQ ID NO: 43792 - DNA, 25 bp, Homo sapien
ttccctgcgcccaaagcaaggtcgg

SEQ ID NO: 43793 - DNA, 25 bp, Homo sapien
gtctgagcgcatcggagtgaaaaca

SEQ ID NO: 43794 - DNA, 25 bp, Homo sapien
cagccttgcccaaaacggatgcagc

SEQ ID NO: 43795 - DNA, 25 bp, Homo sapien
gagaagtcgaattcccaccctgttc

SEQ ID NO: 43796 - DNA, 25 bp, Homo sapien
acgacaggctacaggcggagacgca

SEQ ID NO: 43797 - DNA, 25 bp, Homo sapien
atgtgaaggattgcaaggagcccgc

SEQ ID NO: 43798 - DNA, 25 bp, Homo sapien
ggcagcgccgagataaaaaacagaa

SEQ ID NO: 43799 - DNA, 25 bp, Homo sapien
caggcgccagcctgtctacgtggga

SEQ ID NO: 43800 - DNA, 25 bp, Homo sapien
gtgcctgtctctgagtgcgtctccg

SEQ ID NO: 43801 - DNA, 25 bp, Homo sapien
gccggactagactgcagctgctcca

SEQ ID NO: 43802 - DNA, 25 bp, Homo sapien
caagggaatggtgcctaggctccca

SEQ ID NO: 43803 - DNA, 25 bp, Homo sapien
cttgcctgatgtgcgagtccgccct

SEQ ID NO: 43804 - DNA, 25 bp, Homo sapien
tggcgcggactactctccgggcagc

SEQ ID NO: 43805 - DNA, 25 bp, Homo sapien
tctccggctctgctcgagtctagga

SEQ ID NO: 43806 - DNA, 25 bp, Homo sapien
tgacttctcgggactatgcctcgcc

SEQ ID NO: 43807 - DNA, 25 bp, Homo sapien
tgtcccggcttaacgcgcaaagttc

SEQ ID NO: 43808 - DNA, 25 bp, Homo sapien
tttcctcgttgctctcttcctggcg

SEQ ID NO: 43809 - DNA, 25 bp, Homo sapien
aggagtctccagatggccttggtga

SEQ ID NO: 43810 - DNA, 25 bp, Homo sapien
tcagaaagccaggagtctccagatg

SEQ ID NO: 43811 - DNA, 25 bp, Homo sapien
cttcagcctggagagaagttactcc

SEQ ID NO: 43812 - DNA, 25 bp, Homo sapien
gcgagtgcccgttgctcgctctcta

SEQ ID NO: 43813 - DNA, 25 bp, Homo sapien
tgctccgagtagctctccactgctg

SEQ ID NO: 43814 - DNA, 25 bp, Homo sapien
agagccctgaggttcgactccactg

SEQ ID NO: 43815 - DNA, 25 bp, Homo sapien
tcaggggacctttctcaggccaagc

SEQ ID NO: 43816 - DNA, 25 bp, Homo sapien
gctccgagagttgtgttcagaccca

SEQ ID NO: 43817 - DNA, 25 bp, Homo sapien
ttctggagatctgcgcgtatttgta

SEQ ID NO: 43818 - DNA, 25 bp, Homo sapien
tgtcgtgcgttcctgtttctggaga

SEQ ID NO: 43819 - DNA, 25 bp, Homo sapien
cgcagccttttatcgcctcctgatg

SEQ ID NO: 43820 - DNA, 25 bp, Homo sapien
tcagccgagggaataactccagaga

SEQ ID NO: 43821 - DNA, 25 bp, Homo sapien
cagagcggcattcctggcatcctca

SEQ ID NO: 43822 - DNA, 25 bp, Homo sapien
tggcatcctcattcagcccgaaggt

SEQ ID NO: 43823 - DNA, 25 bp, Homo sapien
tcggcgttatttccctgagggttgc

SEQ ID NO: 43824 - DNA, 25 bp, Homo sapien
cgggagcgggaaacttccagcttca

SEQ ID NO: 43825 - DNA, 25 bp, Homo sapien
ccagcttcaaagctcggtgggctcc

SEQ ID NO: 43826 - DNA, 25 bp, Homo sapien
tgggctccggatcgtactatgcgga

SEQ ID NO: 43827 - DNA, 25 bp, Homo sapien
gcgtgtcctcccgtacgcctggaaa

SEQ ID NO: 43828 - DNA, 25 bp, Homo sapien
ttccgattgaatggtgagtgtgccc

SEQ ID NO: 43829 - DNA, 25 bp, Homo sapien
gagtcggctccttatgcaaatcaca

SEQ ID NO: 43830 - DNA, 25 bp, Homo sapien
cttgcgatgcaaagacaggtccgtc

SEQ ID NO: 43831 - DNA, 25 bp, Homo sapien
cgtgttgtttaaaagcggccgcgca

SEQ ID NO: 43832 - DNA, 25 bp, Homo sapien
aggctgttacacaactgctggggtc

SEQ ID NO: 43833 - DNA, 25 bp, Homo sapien
cctgccggagtagatcggctcgcta

SEQ ID NO: 43834 - DNA, 25 bp, Homo sapien
gacagacatggcgtcccagagacta

SEQ ID NO: 43835 - DNA, 25 bp, Homo sapien
gtggggaccacctccacaacgattc

SEQ ID NO: 43836 - DNA, 25 bp, Homo sapien
ggggcagcccgaagagcaaaacaaa

SEQ ID NO: 43837 - DNA, 25 bp, Homo sapien
ttcgcctttccacgcccaaagccag

SEQ ID NO: 43838 - DNA, 25 bp, Homo sapien
agctggccggaacggccttcgcctt

SEQ ID NO: 43839 - DNA, 25 bp, Homo sapien
caaacagagcgaggagtagtggaaa

SEQ ID NO: 43840 - DNA, 25 bp, Homo sapien
tgctgttggacatcattcagaagtc

SEQ ID NO: 43841 - DNA, 25 bp, Homo sapien
gacttcgggcagacccggcgttgct

SEQ ID NO: 43842 - DNA, 25 bp, Homo sapien
agtggaaaatgctgagtcctggagc

SEQ ID NO: 43843 - DNA, 25 bp, Homo sapien
cggcgttgctgttggacatcattca

SEQ ID NO: 43844 - DNA, 25 bp, Homo sapien
ggggccagtaagtgcgcccacttcc

SEQ ID NO: 43845 - DNA, 25 bp, Homo sapien
gcgacccgagcggaagaccttccag

SEQ ID NO: 43846 - DNA, 25 bp, Homo sapien
gttctactccaagaagtcgcagcga

SEQ ID NO: 43847 - DNA, 25 bp, Homo sapien
ggtgggcaccgtcatgactttgttc

SEQ ID NO: 43848 - DNA, 25 bp, Homo sapien
gcccgtgcgagtacgcctgactgac

SEQ ID NO: 43849 - DNA, 25 bp, Homo sapien
gtaactgagtttggccgggcattcc

SEQ ID NO: 43850 - DNA, 25 bp, Homo sapien
atgtcggctgtccatcagtgcccgc

SEQ ID NO: 43851 - DNA, 25 bp, Homo sapien
gtcaagctggagacgcgccagatca

SEQ ID NO: 43852 - DNA, 25 bp, Homo sapien
gatgagtgcccagtagggagacttc

SEQ ID NO: 43853 - DNA, 25 bp, Homo sapien
agacttctgtgaagcgtcccggtcc

SEQ ID NO: 43854 - DNA, 25 bp, Homo sapien
cttctgtgaagcgtcccggtcctgc

SEQ ID NO: 43855 - DNA, 25 bp, Homo sapien
tgaagcgtcccggtcctgcgacgtc

SEQ ID NO: 43856 - DNA, 25 bp, Homo sapien
gagtgcccagtagggagacttctgt

SEQ ID NO: 43857 - DNA, 25 bp, Homo sapien
tgggtggtccatccggccgcagagg

SEQ ID NO: 43858 - DNA, 25 bp, Homo sapien
tccgaacctcggcaggaggctggca

SEQ ID NO: 43859 - DNA, 25 bp, Homo sapien
cggtcctgcgacgtcgcccacccgg

SEQ ID NO: 43860 - DNA, 25 bp, Homo sapien
cccttttgcgccttctacgatggtg

SEQ ID NO: 43861 - DNA, 25 bp, Homo sapien
catgcactctcacacggtcaggcgg

SEQ ID NO: 43862 - DNA, 25 bp, Homo sapien
gccttcactggtcgagctgacgctc

SEQ ID NO: 43863 - DNA, 25 bp, Homo sapien
cgagctgacgctctttacaccgggg

SEQ ID NO: 43864 - DNA, 25 bp, Homo sapien
tcccagcagagtgcaagggccctcg

SEQ ID NO: 43865 - DNA, 25 bp, Homo sapien
ggaacgcacactcgggcatgcactc

SEQ ID NO: 43866 - DNA, 25 bp, Homo sapien
gtgctggcggctgacagaaagacca

SEQ ID NO: 43867 - DNA, 25 bp, Homo sapien
tgcacacgcggaacgcacactcggg

SEQ ID NO: 43868 - DNA, 25 bp, Homo sapien
tctttggtccaggaaagccgcgagc

SEQ ID NO: 43869 - DNA, 25 bp, Homo sapien
taaatgcaccttccgcgtgcctcgg

SEQ ID NO: 43870 - DNA, 25 bp, Homo sapien
gggccagaaggctgatcaccgcctg

SEQ ID NO: 43871 - DNA, 25 bp, Homo sapien
cgagagtaaatgcaccttccgcgtg

SEQ ID NO: 43872 - DNA, 25 bp, Homo sapien
cttgcccaaggcacgagagtaaatg

SEQ ID NO: 43873 - DNA, 25 bp, Homo sapien
cagatccaagaggaaaaagccgttc

SEQ ID NO: 43874 - DNA, 25 bp, Homo sapien
ccctgctggccagtgtcagtattga

SEQ ID NO: 43875 - DNA, 25 bp, Homo sapien
tgtcagtattgagcccgctgccgct

SEQ ID NO: 43876 - DNA, 25 bp, Homo sapien
ctgcacacagcgcagctggaaaatg

SEQ ID NO: 43877 - DNA, 25 bp, Homo sapien
agccgcctgcgaacaggaggttcca

SEQ ID NO: 43878 - DNA, 25 bp, Homo sapien
attagcataaacttggggccgcgcc

SEQ ID NO: 43879 - DNA, 25 bp, Homo sapien
aggcgggctctttgcggattagcat

SEQ ID NO: 43880 - DNA, 25 bp, Homo sapien
gccatcccgtcgtgtagagactgta

SEQ ID NO: 43881 - DNA, 25 bp, Homo sapien
ctggaaaggtttccgctggcactgc

SEQ ID NO: 43882 - DNA, 25 bp, Homo sapien
caggaggttccaaagggagcagccc

SEQ ID NO: 43883 - DNA, 25 bp, Homo sapien
ctggaaaatgttacttcgctggaaa

SEQ ID NO: 43884 - DNA, 25 bp, Homo sapien
cggtccaaaacacagacccattggt

SEQ ID NO: 43885 - DNA, 25 bp, Homo sapien
gtgaagtttagctcagacaccctgc

SEQ ID NO: 43886 - DNA, 25 bp, Homo sapien
gccattgggcttcgccggtccaaaa

SEQ ID NO: 43887 - DNA, 25 bp, Homo sapien
tgccgctcagacagaagcccatttc

SEQ ID NO: 43888 - DNA, 25 bp, Homo sapien
tttgcatggatgtgatcgcggcctt

SEQ ID NO: 43889 - DNA, 25 bp, Homo sapien
tagctggctagtgatctggaagacc

SEQ ID NO: 43890 - DNA, 25 bp, Homo sapien
tacctaaaatggctcctgcagcagc

SEQ ID NO: 43891 - DNA, 25 bp, Homo sapien
gggctcgctccattgtgctcgtatt

SEQ ID NO: 43892 - DNA, 25 bp, Homo sapien
aacaacccgcatttcgaggcgagga

SEQ ID NO: 43893 - DNA, 25 bp, Homo sapien
ccggacgtttttgggagcttcacag

SEQ ID NO: 43894 - DNA, 25 bp, Homo sapien
cctcggactctgtttcccagaagtc

SEQ ID NO: 43895 - DNA, 25 bp, Homo sapien
ctagcccggctctatttggctgcaa

SEQ ID NO: 43896 - DNA, 25 bp, Homo sapien
cctcctggctgattagatgggactg

SEQ ID NO: 43897 - DNA, 25 bp, Homo sapien
tccctttgtgaggagaaccaggccc

SEQ ID NO: 43898 - DNA, 25 bp, Homo sapien
tagtaacgtgaaggtctccgagtcc

SEQ ID NO: 43899 - DNA, 25 bp, Homo sapien
gggcgaaacctgctcgattaaaaca

SEQ ID NO: 43900 - DNA, 25 bp, Homo sapien
catccctctggctggttgctcagcg

SEQ ID NO: 43901 - DNA, 25 bp, Homo sapien
tgctcctcctcactgctcgttgtag

SEQ ID NO: 43902 - DNA, 25 bp, Homo sapien
atgtagcccgcaaagcggtccgtcg

SEQ ID NO: 43903 - DNA, 25 bp, Homo sapien
tgccgctccttgtcgatgtagcccg

SEQ ID NO: 43904 - DNA, 25 bp, Homo sapien
tgccagagctcgttgtcgaggcgct

SEQ ID NO: 43905 - DNA, 25 bp, Homo sapien
acttcgcccttgagagcgttgcgca

SEQ ID NO: 43906 - DNA, 25 bp, Homo sapien
acctgctcctcctggtagtggcgcg

SEQ ID NO: 43907 - DNA, 25 bp, Homo sapien
tgccaccgccgtgcaacggcaggaa

SEQ ID NO: 43908 - DNA, 25 bp, Homo sapien
gcgcctgcaagctgagacccgggtt

SEQ ID NO: 43909 - DNA, 25 bp, Homo sapien
ggcgctcctgcgttccaagccgagg

SEQ ID NO: 43910 - DNA, 25 bp, Homo sapien
gcaggaaactgaagcggggaacttc

SEQ ID NO: 43911 - DNA, 25 bp, Homo sapien
aacttcgccaaacgcgggctgccga

SEQ ID NO: 43912 - DNA, 25 bp, Homo sapien
tgggaggcagcaagtggaaatattc

SEQ ID NO: 43913 - DNA, 25 bp, Homo sapien
ctcaagtggcagattccgacaagtg

SEQ ID NO: 43914 - DNA, 25 bp, Homo sapien
agctgcccgggagagaacgctccac

SEQ ID NO: 43915 - DNA, 25 bp, Homo sapien
gcaacaaccgcggaaagttactcca

SEQ ID NO: 43916 - DNA, 25 bp, Homo sapien
tttaagccaccaagcagagaccgcg

SEQ ID NO: 43917 - DNA, 25 bp, Homo sapien
ggccgcccatatagcgaaagcctgg

SEQ ID NO: 43918 - DNA, 25 bp, Homo sapien
tcctagaagctagcaagaccgcact

SEQ ID NO: 43919 - DNA, 25 bp, Homo sapien
cagttctgcggctggattagagaca

SEQ ID NO: 43920 - DNA, 25 bp, Homo sapien
agatcgcgcacagttttataaaagg

SEQ ID NO: 43921 - DNA, 25 bp, Homo sapien
gaaatccgcagcctcgttttaagcc

SEQ ID NO: 43922 - DNA, 25 bp, Homo sapien
tgaaaaacggggattcgctcagccc

SEQ ID NO: 43923 - DNA, 25 bp, Homo sapien
gagaccgcggcgacctattatgata

SEQ ID NO: 43924 - DNA, 25 bp, Homo sapien
cgggatggtagcaagtttgcagtta

SEQ ID NO: 43925 - DNA, 25 bp, Homo sapien
acgcattcttgagggcttggtcacc

SEQ ID NO: 43926 - DNA, 25 bp, Homo sapien
tttcgggaaagtccgtctgattctc

SEQ ID NO: 43927 - DNA, 25 bp, Homo sapien
actccaggggaagttggcactttgc

SEQ ID NO: 43928 - DNA, 25 bp, Homo sapien
tcggcttgagatcgacggccgcctt

SEQ ID NO: 43929 - DNA, 25 bp, Homo sapien
ttccgtcttgatgatggtgagagtc

SEQ ID NO: 43930 - DNA, 25 bp, Homo sapien
aagctccagatcgactttttccgtc

SEQ ID NO: 43931 - DNA, 25 bp, Homo sapien
cctctttagggcgtttctcgcggcg

SEQ ID NO: 43932 - DNA, 25 bp, Homo sapien
cgttggacagagcagacactcggct

SEQ ID NO: 43933 - DNA, 25 bp, Homo sapien
gcaggaaaaatctcgacccgccacg

SEQ ID NO: 43934 - DNA, 25 bp, Homo sapien
ctgcgtgtttggagatacgcaatca

SEQ ID NO: 43935 - DNA, 25 bp, Homo sapien
accgttctgcggaactgtcggatca

SEQ ID NO: 43936 - DNA, 25 bp, Homo sapien
ccaggcaggtaagcaaccagcggtg

SEQ ID NO: 43937 - DNA, 25 bp, Homo sapien
aggctctctcttcgagctccgcggt

SEQ ID NO: 43938 - DNA, 25 bp, Homo sapien
ttttgtcactaaccactcagctcgg

SEQ ID NO: 43939 - DNA, 25 bp, Homo sapien
ggtgcagcctcgtcttttgtcacta

SEQ ID NO: 43940 - DNA, 25 bp, Homo sapien
gtcaaggacccgtacgggagtcgca

SEQ ID NO: 43941 - DNA, 25 bp, Homo sapien
acgggagtcgcaatcctcagaccct

SEQ ID NO: 43942 - DNA, 25 bp, Homo sapien
ctccagttccggataagcgagtata

SEQ ID NO: 43943 - DNA, 25 bp, Homo sapien
ttccggataagcgagtataagccgc

SEQ ID NO: 43944 - DNA, 25 bp, Homo sapien
ccgtacgggagtcgcaatcctcaga

SEQ ID NO: 43945 - DNA, 25 bp, Homo sapien
aggcgtgaccgaatacgaagatggc

SEQ ID NO: 43946 - DNA, 25 bp, Homo sapien
gcaggaaggcgtgaccgaatacgaa

SEQ ID NO: 43947 - DNA, 25 bp, Homo sapien
gtataagccgctgaacatggcggga

SEQ ID NO: 43948 - DNA, 25 bp, Homo sapien
ggtagttcattctcccgagctcatc

SEQ ID NO: 43949 - DNA, 25 bp, Homo sapien
catcccagcctctgggccggtagtt

SEQ ID NO: 43950 - DNA, 25 bp, Homo sapien
ctgggccggtagttcattctcccga

SEQ ID NO: 43951 - DNA, 25 bp, Homo sapien
gcctctgggccggtagttcattctc

SEQ ID NO: 43952 - DNA, 25 bp, Homo sapien
gtagttcattctcccgagctcatcc

SEQ ID NO: 43953 - DNA, 25 bp, Homo sapien
tcatcccagcctctgggccggtagt

SEQ ID NO: 43954 - DNA, 25 bp, Homo sapien
ctctgggccggtagttcattctccc

SEQ ID NO: 43955 - DNA, 25 bp, Homo sapien
ggccggtagttcattctcccgagct

SEQ ID NO: 43956 - DNA, 25 bp, Homo sapien
gtaattcattctcccgagctcatcc

SEQ ID NO: 43957 - DNA, 25 bp, Homo sapien
cactctgggccagtaattcattctc

SEQ ID NO: 43958 - DNA, 25 bp, Homo sapien
gcccgcgctctctgggtctgaactg

SEQ ID NO: 43959 - DNA, 25 bp, Homo sapien
tctgggtctgaactgccggccgaca

SEQ ID NO: 43960 - DNA, 25 bp, Homo sapien
cggccgacagctccctcttgtggag

SEQ ID NO: 43961 - DNA, 25 bp, Homo sapien
cctcttgtggagaaaacggtttgag

SEQ ID NO: 43962 - DNA, 25 bp, Homo sapien
tggagaaaacggtttgaggccgcaa

SEQ ID NO: 43963 - DNA, 25 bp, Homo sapien
ggccgatcctaatgacctccaccca

SEQ ID NO: 43964 - DNA, 25 bp, Homo sapien
gacgaggaatcgtacagtcttaatc

SEQ ID NO: 43965 - DNA, 25 bp, Homo sapien
tccgtgctgtcgtcatcacgtcggc

SEQ ID NO: 43966 - DNA, 25 bp, Homo sapien
tccggttactaagcggccttggata

SEQ ID NO: 43967 - DNA, 25 bp, Homo sapien
agggactcgccgcactcttcgaggc

SEQ ID NO: 43968 - DNA, 25 bp, Homo sapien
ggccggtcatagaacatccagggtc

SEQ ID NO: 43969 - DNA, 25 bp, Homo sapien
tcgttccgctgactatgaaagagca

SEQ ID NO: 43970 - DNA, 25 bp, Homo sapien
aatctctcttctgtcgtggctgcga

SEQ ID NO: 43971 - DNA, 25 bp, Homo sapien
ggtgcaggtgtttagtcgttccgct

SEQ ID NO: 43972 - DNA, 25 bp, Homo sapien
gggcgacacaatgtccgaggtctgc

SEQ ID NO: 43973 - DNA, 25 bp, Homo sapien
cgaacgagaccacgccaccgagaag

SEQ ID NO: 43974 - DNA, 25 bp, Homo sapien
gctcagactgggatctcggagttcc

SEQ ID NO: 43975 - DNA, 25 bp, Homo sapien
agcctttggcctcggtttacatggg

SEQ ID NO: 43976 - DNA, 25 bp, Homo sapien
ctcgaaacagggcacgtcacttgcc

SEQ ID NO: 43977 - DNA, 25 bp, Homo sapien
cggcgagactctcgggttgactcca

SEQ ID NO: 43978 - DNA, 25 bp, Homo sapien
atgttgccaggagctgccgtaaggc

SEQ ID NO: 43979 - DNA, 25 bp, Homo sapien
gggttgactccaaggcctgacattc

SEQ ID NO: 43980 - DNA, 25 bp, Homo sapien
acacgtgagccaggcctcggtcaca

SEQ ID NO: 43981 - DNA, 25 bp, Homo sapien
gtttccgcggaaatgctgcgtcctg

SEQ ID NO: 43982 - DNA, 25 bp, Homo sapien
ctcccaccaagctggggtgtgtgtg

SEQ ID NO: 43983 - DNA, 25 bp, Homo sapien
gggccaagccgtgcatgatgtcatt

SEQ ID NO: 43984 - DNA, 25 bp, Homo sapien
ttggcgggagatagaaaagtgcttc

SEQ ID NO: 43985 - DNA, 25 bp, Homo sapien
tgatgtcattttgtctcccgcctaa

SEQ ID NO: 43986 - DNA, 25 bp, Homo sapien
gaaaagtgcttcaacccgcgccggc

SEQ ID NO: 43987 - DNA, 25 bp, Homo sapien
cctcggtcttcgctatgtgggatac

SEQ ID NO: 43988 - DNA, 25 bp, Homo sapien
tcgcagtcattcacaagccgtcaca

SEQ ID NO: 43989 - DNA, 25 bp, Homo sapien
cgcattcccagtgatggaggcttgc

SEQ ID NO: 43990 - DNA, 25 bp, Homo sapien
attccgagtaggctgcggccaatcg

SEQ ID NO: 43991 - DNA, 25 bp, Homo sapien
ggcagtttactaattggccgtcact

SEQ ID NO: 43992 - DNA, 25 bp, Homo sapien
tcagcgccgcagcacactaattggg

SEQ ID NO: 43993 - DNA, 25 bp, Homo sapien
ctcgcgcgtcgaggtttaacttctc

SEQ ID NO: 43994 - DNA, 25 bp, Homo sapien
agatcgtcctgacggccacacagtc

SEQ ID NO: 43995 - DNA, 25 bp, Homo sapien
acgctcacgccctgagttgttggga

SEQ ID NO: 43996 - DNA, 25 bp, Homo sapien
agcaggctctccgagttctccagga

SEQ ID NO: 43997 - DNA, 25 bp, Homo sapien
tggtcagccctcgagcctcagtctt

SEQ ID NO: 43998 - DNA, 25 bp, Homo sapien
agcctcagtcttgcgggccttggcc

SEQ ID NO: 43999 - DNA, 25 bp, Homo sapien
gcatagctgtggtagccctggtaaa

SEQ ID NO: 44000 - DNA, 25 bp, Homo sapien
ggtagccctggtaaagcgccacctc

SEQ ID NO: 44001 - DNA, 25 bp, Homo sapien
acggagtgactgaccggctgccctc

SEQ ID NO: 44002 - DNA, 25 bp, Homo sapien
agcagccggcgcttctgatattccg

SEQ ID NO: 44003 - DNA, 25 bp, Homo sapien
aggggtctcacgctcgtgcagctgc

SEQ ID NO: 44004 - DNA, 25 bp, Homo sapien
gcgtactccgtagccatggcgcatg

SEQ ID NO: 44005 - DNA, 25 bp, Homo sapien
ctcttaaggaagctgacacggctgc

SEQ ID NO: 44006 - DNA, 25 bp, Homo sapien
cgcccgagctgaggtcgctcttaag

SEQ ID NO: 44007 - DNA, 25 bp, Homo sapien
ctggagcgttcgctcacgccgaagc

SEQ ID NO: 44008 - DNA, 25 bp, Homo sapien
ccttgaccagcacgttgtggcggta

SEQ ID NO: 44009 - DNA, 25 bp, Homo sapien
ttgttgctcttgagctgcagcatgc

SEQ ID NO: 44010 - DNA, 25 bp, Homo sapien
cactttctggcggaccttgttgctc

SEQ ID NO: 44011 - DNA, 25 bp, Homo sapien
cgcatgccgttggtgaactggcctt

SEQ ID NO: 44012 - DNA, 25 bp, Homo sapien
cctatgcagaggaattccacggggc

SEQ ID NO: 44013 - DNA, 25 bp, Homo sapien
gtgcgccttacgtaatttcctgtta

SEQ ID NO: 44014 - DNA, 25 bp, Homo sapien
tgacccggatccaaaccagccaagg

SEQ ID NO: 44015 - DNA, 25 bp, Homo sapien
tttgcctcctcccagtggcgtggat

SEQ ID NO: 44016 - DNA, 25 bp, Homo sapien
ctcctctctgttaggtgagtgagta

SEQ ID NO: 44017 - DNA, 25 bp, Homo sapien
gtaggcgtcattcttcacagtagtc

SEQ ID NO: 44018 - DNA, 25 bp, Homo sapien
ggtcctctacgtggagtcacctatg

SEQ ID NO: 44019 - DNA, 25 bp, Homo sapien
ggcagtcagttcagagcgtctctcc

SEQ ID NO: 44020 - DNA, 25 bp, Homo sapien
ttcctaggatgttcgagaagctgcg

SEQ ID NO: 44021 - DNA, 25 bp, Homo sapien
atcggcccacccgaagatgtccatt

SEQ ID NO: 44022 - DNA, 25 bp, Homo sapien
gatgtccattcacccagtgccgcgg

SEQ ID NO: 44023 - DNA, 25 bp, Homo sapien
tcccaactcggaccaaatatttgtg

SEQ ID NO: 44024 - DNA, 25 bp, Homo sapien
tgaatcgcataagaacccggtgccc

SEQ ID NO: 44025 - DNA, 25 bp, Homo sapien
ctgggagtcccagcgcaatgctgtt

SEQ ID NO: 44026 - DNA, 25 bp, Homo sapien
cgcaatgctgttacttcctaggatg

SEQ ID NO: 44027 - DNA, 25 bp, Homo sapien
ggggtcaaactgcttgaatcgcata

SEQ ID NO: 44028 - DNA, 25 bp, Homo sapien
cttctttcctgcctctgattccggg

SEQ ID NO: 44029 - DNA, 25 bp, Homo sapien
agtaatgacattcacggagcgggga

SEQ ID NO: 44030 - DNA, 25 bp, Homo sapien
ggacccagtccttcagctcgcagaa

SEQ ID NO: 44031 - DNA, 25 bp, Homo sapien
tctgattccgggctgtcatggcgac

SEQ ID NO: 44032 - DNA, 25 bp, Homo sapien
ccatctccgcgctggagagcgatgc

SEQ ID NO: 44033 - DNA, 25 bp, Homo sapien
tggttctgtaccactggacccagtc

SEQ ID NO: 44034 - DNA, 25 bp, Homo sapien
ttcagctcgcagaaggtagagccgg

SEQ ID NO: 44035 - DNA, 25 bp, Homo sapien
cccaactgcccggtgagtaatgaca

SEQ ID NO: 44036 - DNA, 25 bp, Homo sapien
aatgactcgtccaccacggcagcta

SEQ ID NO: 44037 - DNA, 25 bp, Homo sapien
agtcccacagcttgaggcgtgcttg

SEQ ID NO: 44038 - DNA, 25 bp, Homo sapien
agcgctccagatgctccatgccgga

SEQ ID NO: 44039 - DNA, 25 bp, Homo sapien
tcgggcaacggggacaactccttga

SEQ ID NO: 44040 - DNA, 25 bp, Homo sapien
acgttgcgcttgttgctgaggtagc

SEQ ID NO: 44041 - DNA, 25 bp, Homo sapien
acggcagctagcaccggcttctctg

SEQ ID NO: 44042 - DNA, 25 bp, Homo sapien
gcagatgctgctgtcacggctagga

SEQ ID NO: 44043 - DNA, 25 bp, Homo sapien
tgcactcacacgttgaggacgttgc

SEQ ID NO: 44044 - DNA, 25 bp, Homo sapien
ttccgagggcacacctggctgtgca

SEQ ID NO: 44045 - DNA, 25 bp, Homo sapien
cgaggatttcccagtcctccggtcg

SEQ ID NO: 44046 - DNA, 25 bp, Homo sapien
ccctggggttaagcgcgctaggcca

SEQ ID NO: 44047 - DNA, 25 bp, Homo sapien
gttaagcgcgctaggccagccctcg

SEQ ID NO: 44048 - DNA, 25 bp, Homo sapien
gagccttttccgctccagctgcgcg

SEQ ID NO: 44049 - DNA, 25 bp, Homo sapien
gggccggcgacacagcaaattccga

SEQ ID NO: 44050 - DNA, 25 bp, Homo sapien
cagctgtcccgggacgaggatttcc

SEQ ID NO: 44051 - DNA, 25 bp, Homo sapien
cgacacagcaaattccgagggcaca

SEQ ID NO: 44052 - DNA, 25 bp, Homo sapien
gacggggttcctgttttcatgcaaa

SEQ ID NO: 44053 - DNA, 25 bp, Homo sapien
taaaaggtcccgaggagtccgcaga

SEQ ID NO: 44054 - DNA, 25 bp, Homo sapien
tgcaaatgcctttgttagcgcaccg

SEQ ID NO: 44055 - DNA, 25 bp, Homo sapien
cgcttttccgccttcgcttgattcg

SEQ ID NO: 44056 - DNA, 25 bp, Homo sapien
tgattcggcctcaacgacttaaacg

SEQ ID NO: 44057 - DNA, 25 bp, Homo sapien
gaaaccctcaggagcggcacgagaa

SEQ ID NO: 44058 - DNA, 25 bp, Homo sapien
tgcagacaggcgctgtgacacgctt

SEQ ID NO: 44059 - DNA, 25 bp, Homo sapien
cctttgttagcgcaccgggaaccag

SEQ ID NO: 44060 - DNA, 25 bp, Homo sapien
agtgcgggtcggttctgcgtgcgct

SEQ ID NO: 44061 - DNA, 25 bp, Homo sapien
cttccggcgcgagaggccgggcagg

SEQ ID NO: 44062 - DNA, 25 bp, Homo sapien
ggtggggactgaacaccaacgccgc

SEQ ID NO: 44063 - DNA, 25 bp, Homo sapien
ggactgaacaccaacgccgcgggga

SEQ ID NO: 44064 - DNA, 25 bp, Homo sapien
gcacatgcgcgctcctaggcggagc

SEQ ID NO: 44065 - DNA, 25 bp, Homo sapien
ctcccacgccctggatcgtcacttc

SEQ ID NO: 44066 - DNA, 25 bp, Homo sapien
cgctgccggacgaggctcccgccgc

SEQ ID NO: 44067 - DNA, 25 bp, Homo sapien
acgccctggatcgtcacttccggcg

SEQ ID NO: 44068 - DNA, 25 bp, Homo sapien
caaaccgcaggtccggcgaggactc

SEQ ID NO: 44069 - DNA, 25 bp, Homo sapien
aattgtaaacaatggcggcctagcc

SEQ ID NO: 44070 - DNA, 25 bp, Homo sapien
gggcggagccatccgaattgtaaac

SEQ ID NO: 44071 - DNA, 25 bp, Homo sapien
ggaaacgcagccttccacagacgca

SEQ ID NO: 44072 - DNA, 25 bp, Homo sapien
acatgacggtttctcaggccggaaa

SEQ ID NO: 44073 - DNA, 25 bp, Homo sapien
tgctgacatcccgagagcctctgga

SEQ ID NO: 44074 - DNA, 25 bp, Homo sapien
gaggctgctttctaacacggtggta

SEQ ID NO: 44075 - DNA, 25 bp, Homo sapien
cgcctaagctggacctgagggtatc

SEQ ID NO: 44076 - DNA, 25 bp, Homo sapien
ccgggcctggcgtcgacacgtcgca

SEQ ID NO: 44077 - DNA, 25 bp, Homo sapien
aacccggatccctccttcgcagctc

SEQ ID NO: 44078 - DNA, 25 bp, Homo sapien
gcagctcagccctcgactcccactt

SEQ ID NO: 44079 - DNA, 25 bp, Homo sapien
ggacgcgaaccgtcctggtcccatc

SEQ ID NO: 44080 - DNA, 25 bp, Homo sapien
cggcgagaccgcaggtgagcaggag

SEQ ID NO: 44081 - DNA, 25 bp, Homo sapien
aggctgcggcccgatctttgtccct

SEQ ID NO: 44082 - DNA, 25 bp, Homo sapien
cgatctttgtccctcagccgcgccg

SEQ ID NO: 44083 - DNA, 25 bp, Homo sapien
aaccgtcctggtcccatccgagccg

SEQ ID NO: 44084 - DNA, 25 bp, Homo sapien
ttccaccggatagacggacgctcgt

SEQ ID NO: 44085 - DNA, 25 bp, Homo sapien
atcgcaagcctcgagcggcgtgcct

SEQ ID NO: 44086 - DNA, 25 bp, Homo sapien
tgcgccaggcccaagctagaagcgg

SEQ ID NO: 44087 - DNA, 25 bp, Homo sapien
ggctcctccagcaactttcaagcgt

SEQ ID NO: 44088 - DNA, 25 bp, Homo sapien
cctggaattctggacccggcgtcct

SEQ ID NO: 44089 - DNA, 25 bp, Homo sapien
cgcgctcactttgggcttgtcgaag

SEQ ID NO: 44090 - DNA, 25 bp, Homo sapien
ccgaaggaagaactcgcctgcagga

SEQ ID NO: 44091 - DNA, 25 bp, Homo sapien
gcaagccacggcctaagccgaagga

SEQ ID NO: 44092 - DNA, 25 bp, Homo sapien
gtcatcactaccatcggtgagccgc

SEQ ID NO: 44093 - DNA, 25 bp, Homo sapien
cgctctccggaggaagttcggcttc

SEQ ID NO: 44094 - DNA, 25 bp, Homo sapien
aaagcggccgccagcgactgctggt

SEQ ID NO: 44095 - DNA, 25 bp, Homo sapien
ctgctgtcttcgacgcgctcgagtc

SEQ ID NO: 44096 - DNA, 25 bp, Homo sapien
actaccatcggtgagccgcccggag

SEQ ID NO: 44097 - DNA, 25 bp, Homo sapien
gctggtcctgtgcaccctgtgttac

SEQ ID NO: 44098 - DNA, 25 bp, Homo sapien
tcgcccgtcacaaccctgccgcgtg

SEQ ID NO: 44099 - DNA, 25 bp, Homo sapien
caccctgtgttacctgctggtgggc

SEQ ID NO: 44100 - DNA, 25 bp, Homo sapien
tggtcctgcgcttcctcgttgccag

SEQ ID NO: 44101 - DNA, 25 bp, Homo sapien
tgcgcccgcgacaacctgggctttt

SEQ ID NO: 44102 - DNA, 25 bp, Homo sapien
tcttctgccacgtgcacaagctgga

SEQ ID NO: 44103 - DNA, 25 bp, Homo sapien
agggctggaccttcttccacgccta

SEQ ID NO: 44104 - DNA, 25 bp, Homo sapien
gccttctcgcacttcgagggctgga

SEQ ID NO: 44105 - DNA, 25 bp, Homo sapien
gcatcccgctgacgctggtcacttt

SEQ ID NO: 44106 - DNA, 25 bp, Homo sapien
acggactccggcaaggtcttctgca

SEQ ID NO: 44107 - DNA, 25 bp, Homo sapien
tctccctgcatagagtacggccacg

SEQ ID NO: 44108 - DNA, 25 bp, Homo sapien
cattgagcgagccaagacacgtttc

SEQ ID NO: 44109 - DNA, 25 bp, Homo sapien
agcggcccgagacattctgccaggc

SEQ ID NO: 44110 - DNA, 25 bp, Homo sapien
gcctggcatcctgcggagtttcaag

SEQ ID NO: 44111 - DNA, 25 bp, Homo sapien
cggagtttcaagtgacggagccacc

SEQ ID NO: 44112 - DNA, 25 bp, Homo sapien
cttgaccgggtcaaaagggctgaca

SEQ ID NO: 44113 - DNA, 25 bp, Homo sapien
caggacttccgcatctttgaaaata

SEQ ID NO: 44114 - DNA, 25 bp, Homo sapien
aatggtgcgaggcaagtcgtctcac

SEQ ID NO: 44115 - DNA, 25 bp, Homo sapien
aggctcagatcgtcaggtccgccca

SEQ ID NO: 44116 - DNA, 25 bp, Homo sapien
gccctggtccgagggctgttcccga

SEQ ID NO: 44117 - DNA, 25 bp, Homo sapien
agtccctcacccagacaggcctctc

SEQ ID NO: 44118 - DNA, 25 bp, Homo sapien
cgaaggagttcatgcacgggaagta

SEQ ID NO: 44119 - DNA, 25 bp, Homo sapien
tcccagagacactggcgcgctcgga

SEQ ID NO: 44120 - DNA, 25 bp, Homo sapien
ggcgccgcagccaatccgtgccgcc

SEQ ID NO: 44121 - DNA, 25 bp, Homo sapien
cctcagccggccgacttgcggagag

SEQ ID NO: 44122 - DNA, 25 bp, Homo sapien
cctcgtcgtcgaaggagttcatgca

SEQ ID NO: 44123 - DNA, 25 bp, Homo sapien
attcttgacgcggagtacggcgcgc

SEQ ID NO: 44124 - DNA, 25 bp, Homo sapien
gggtgcaactccgtactgtgccgta

SEQ ID NO: 44125 - DNA, 25 bp, Homo sapien
ccctgcgtcttggtcggcaagaacg

SEQ ID NO: 44126 - DNA, 25 bp, Homo sapien
tacctcttggagaggctcgggccgc

SEQ ID NO: 44127 - DNA, 25 bp, Homo sapien
tgcaactccgtactgtgccgtaagg

SEQ ID NO: 44128 - DNA, 25 bp, Homo sapien
ccgtactgtgccgtaagggacagcg

SEQ ID NO: 44129 - DNA, 25 bp, Homo sapien
actccgtactgtgccgtaagggaca

SEQ ID NO: 44130 - DNA, 25 bp, Homo sapien
cctccctgcgtcttggtcggcaaga

SEQ ID NO: 44131 - DNA, 25 bp, Homo sapien
ccggaccctccctcactatctgctt

SEQ ID NO: 44132 - DNA, 25 bp, Homo sapien
gctcgctgggctacgcctacatcaa

SEQ ID NO: 44133 - DNA, 25 bp, Homo sapien
tgaacgccagcggttctggctaccc

SEQ ID NO: 44134 - DNA, 25 bp, Homo sapien
tgtgccgcgatgtagccacccggcg

SEQ ID NO: 44135 - DNA, 25 bp, Homo sapien
gtccatccgcgtgtgccgcgatgta

SEQ ID NO: 44136 - DNA, 25 bp, Homo sapien
tatgagaagttctctcccgccggcc

SEQ ID NO: 44137 - DNA, 25 bp, Homo sapien
cctcgctttacgtgggcgatctgca

SEQ ID NO: 44138 - DNA, 25 bp, Homo sapien
agcggttctggctacccgcttgcct

SEQ ID NO: 44139 - DNA, 25 bp, Homo sapien
accgacggacaagcaggcggacaga

SEQ ID NO: 44140 - DNA, 25 bp, Homo sapien
cggaaactctcattgccggcggcgc

SEQ ID NO: 44141 - DNA, 25 bp, Homo sapien
aacttaggctcccttgcacgcgggg

SEQ ID NO: 44142 - DNA, 25 bp, Homo sapien
gcgtgctcggtttggaacttaggct

SEQ ID NO: 44143 - DNA, 25 bp, Homo sapien
ggcggcgaatatctccgcccaacag

SEQ ID NO: 44144 - DNA, 25 bp, Homo sapien
ggcgagttgggagctccttccttcc

SEQ ID NO: 44145 - DNA, 25 bp, Homo sapien
ggagctcctccacagagtctgggaa

SEQ ID NO: 44146 - DNA, 25 bp, Homo sapien
cgtactggccgttgcggaaactctc

SEQ ID NO: 44147 - DNA, 25 bp, Homo sapien
catcccgtggccaggccggcgagtt

SEQ ID NO: 44148 - DNA, 25 bp, Homo sapien
cacatggcggattacccggactaca

SEQ ID NO: 44149 - DNA, 25 bp, Homo sapien
gtaccggccgcgcaaaaagagcaag

SEQ ID NO: 44150 - DNA, 25 bp, Homo sapien
ctgctgcaggactcggagaagatcc

SEQ ID NO: 44151 - DNA, 25 bp, Homo sapien
gaagatcatggaccagtggcccgac

SEQ ID NO: 44152 - DNA, 25 bp, Homo sapien
tcgcagcacgaacggcggaagatca

SEQ ID NO: 44153 - DNA, 25 bp, Homo sapien
ccgagcggccacatcaagaggccga

SEQ ID NO: 44154 - DNA, 25 bp, Homo sapien
tgttgtgagccaggacgcaacttgc

SEQ ID NO: 44155 - DNA, 25 bp, Homo sapien
agaaagacactgaaaggcgtcggcg

SEQ ID NO: 44156 - DNA, 25 bp, Homo sapien
ctctcccgcgcggtctgtcggtctg

SEQ ID NO: 44157 - DNA, 25 bp, Homo sapien
ggaccagccgcgcgggcttctgaac

SEQ ID NO: 44158 - DNA, 25 bp, Homo sapien
cgggcttctgaacgggcacgctgtc

SEQ ID NO: 44159 - DNA, 25 bp, Homo sapien
tctgaacgggcacgctgtcggagcc

SEQ ID NO: 44160 - DNA, 25 bp, Homo sapien
cggagccggaggctcgtctagtccc

SEQ ID NO: 44161 - DNA, 25 bp, Homo sapien
gccggaggctcgtctagtcccgagc

SEQ ID NO: 44162 - DNA, 25 bp, Homo sapien
gcgctcgctcgcagagaaggtgccg

SEQ ID NO: 44163 - DNA, 25 bp, Homo sapien
tgctcgcgcggtcctctctcccgcg

SEQ ID NO: 44164 - DNA, 25 bp, Homo sapien
acggtacagctgaggaacccgccgc

SEQ ID NO: 44165 - DNA, 25 bp, Homo sapien
gcagcgccatggagacggtacagct

SEQ ID NO: 44166 - DNA, 25 bp, Homo sapien
tcacgcccgaaccacgtgatcaggg

SEQ ID NO: 44167 - DNA, 25 bp, Homo sapien
aggcgccttcaccacttggcggttc

SEQ ID NO: 44168 - DNA, 25 bp, Homo sapien
acactctagagaccagcgggcaccg

SEQ ID NO: 44169 - DNA, 25 bp, Homo sapien
gacagcgccactgacactctagaga

SEQ ID NO: 44170 - DNA, 25 bp, Homo sapien
cgagtattttgtgcgctccggtaac

SEQ ID NO: 44171 - DNA, 25 bp, Homo sapien
tccggtaacgcaggaagacagcgcc

SEQ ID NO: 44172 - DNA, 25 bp, Homo sapien
aggcgagcaccacgctgatggagac

SEQ ID NO: 44173 - DNA, 25 bp, Homo sapien
tcgaagtagaattcgcgcgccgcct

SEQ ID NO: 44174 - DNA, 25 bp, Homo sapien
cctcctggccaaaggcgaagacgca

SEQ ID NO: 44175 - DNA, 25 bp, Homo sapien
ggcgcgacgacacctcgaagctgaa

SEQ ID NO: 44176 - DNA, 25 bp, Homo sapien
ctcgctcacaaaggtttcagtgctc

SEQ ID NO: 44177 - DNA, 25 bp, Homo sapien
gaggcggaacacctgcaccaccttg

SEQ ID NO: 44178 - DNA, 25 bp, Homo sapien
cgccaacttgagtacgcggaagatg

SEQ ID NO: 44179 - DNA, 25 bp, Homo sapien
tgaaccaggcgatgcagaagtactc

SEQ ID NO: 44180 - DNA, 25 bp, Homo sapien
gctgaaggccgcatcgatcgctgcc

SEQ ID NO: 44181 - DNA, 25 bp, Homo sapien
aggaggccccttacctgtggtggca

SEQ ID NO: 44182 - DNA, 25 bp, Homo sapien
gggcgcctcgcgtgtctgtcccaaa

SEQ ID NO: 44183 - DNA, 25 bp, Homo sapien
tggctatactcggtctcgcctctgc

SEQ ID NO: 44184 - DNA, 25 bp, Homo sapien
tcgcgtgtctgtcccaaagccaccg

SEQ ID NO: 44185 - DNA, 25 bp, Homo sapien
aaggccgcatcgatcgctgccggag

SEQ ID NO: 44186 - DNA, 25 bp, Homo sapien
ctgggagccgctggctatactcggt

SEQ ID NO: 44187 - DNA, 25 bp, Homo sapien
agccgctggctatactcggtctcgc

SEQ ID NO: 44188 - DNA, 25 bp, Homo sapien
cgcacaatgcgcctttctccaagga

SEQ ID NO: 44189 - DNA, 25 bp, Homo sapien
cggccctggaactccacgaggcttt

SEQ ID NO: 44190 - DNA, 25 bp, Homo sapien
aaggatatggttcagcgtcaggctc

SEQ ID NO: 44191 - DNA, 25 bp, Homo sapien
tggttctccagatcctccaggcgcg

SEQ ID NO: 44192 - DNA, 25 bp, Homo sapien
ggccaactcagctcaatgccggaag

SEQ ID NO: 44193 - DNA, 25 bp, Homo sapien
tgacgccgcagtccgcctaatggtc

SEQ ID NO: 44194 - DNA, 25 bp, Homo sapien
ggcggcgcagcaagacccaaaaacg

SEQ ID NO: 44195 - DNA, 25 bp, Homo sapien
acgaggctttcgcattcgcatgggc

SEQ ID NO: 44196 - DNA, 25 bp, Homo sapien
cttggccaaatggacgggactatta

SEQ ID NO: 44197 - DNA, 25 bp, Homo sapien
gttaactgtctctttcgctccgcta

SEQ ID NO: 44198 - DNA, 25 bp, Homo sapien
aggtcaggctgtaaccgggtcaatg

SEQ ID NO: 44199 - DNA, 25 bp, Homo sapien
tctccggctggaaaaagcattaatg

SEQ ID NO: 44200 - DNA, 25 bp, Homo sapien
aagtatcctgtgtgcgcagcgcatg

SEQ ID NO: 44201 - DNA, 25 bp, Homo sapien
cgcatgaatgtgtctgggcatctcc

SEQ ID NO: 44202 - DNA, 25 bp, Homo sapien
gggcatctccgcgtatatttatata

SEQ ID NO: 44203 - DNA, 25 bp, Homo sapien
tcgctccgctacaacaacaaacgtg

SEQ ID NO: 44204 - DNA, 25 bp, Homo sapien
acgcccacggcgtacatgacgatgc

SEQ ID NO: 44205 - DNA, 25 bp, Homo sapien
cgttccatgtactccacggccagga

SEQ ID NO: 44206 - DNA, 25 bp, Homo sapien
cggagaagctgtgctccaccatgtg

SEQ ID NO: 44207 - DNA, 25 bp, Homo sapien
cacaatctggttcacgaagcgcttc

SEQ ID NO: 44208 - DNA, 25 bp, Homo sapien
tgcccacaccgagatgtcatcctgg

SEQ ID NO: 44209 - DNA, 25 bp, Homo sapien
agcgcttcactagctcgaagttttg

SEQ ID NO: 44210 - DNA, 25 bp, Homo sapien
gaccaggccaacacgaggcacgtta

SEQ ID NO: 44211 - DNA, 25 bp, Homo sapien
ataggacacgtgcagttccgctggc

SEQ ID NO: 44212 - DNA, 25 bp, Homo sapien
tgtcacgatgacagcgacacgcggc

SEQ ID NO: 44213 - DNA, 25 bp, Homo sapien
cacgttcatggcgtactggattgcc

SEQ ID NO: 44214 - DNA, 25 bp, Homo sapien
ctggattgccagtcccgtcatggtg

SEQ ID NO: 44215 - DNA, 25 bp, Homo sapien
agacgctctgcacttgactcgaata

SEQ ID NO: 44216 - DNA, 25 bp, Homo sapien
gaatactggatcacgccaacgcgcg

SEQ ID NO: 44217 - DNA, 25 bp, Homo sapien
gaggcccatgaggaactgccgcatg

SEQ ID NO: 44218 - DNA, 25 bp, Homo sapien
tctcgaactcgaaagggcgcacgct

SEQ ID NO: 44219 - DNA, 25 bp, Homo sapien
aggactctacgaggaagacgtgctc

SEQ ID NO: 44220 - DNA, 25 bp, Homo sapien
ccttggagataaggcctggacagga

SEQ ID NO: 44221 - DNA, 25 bp, Homo sapien
ggaccaaaacccactgcgcacgaga

SEQ ID NO: 44222 - DNA, 25 bp, Homo sapien
gtttcccgcctgctctcaggagcga

SEQ ID NO: 44223 - DNA, 25 bp, Homo sapien
gaagcccacatctgcccagcaggtg

SEQ ID NO: 44224 - DNA, 25 bp, Homo sapien
gcctggacaggatataacccgcgca

SEQ ID NO: 44225 - DNA, 25 bp, Homo sapien
agcaggtgagcgcttaccctcccga

SEQ ID NO: 44226 - DNA, 25 bp, Homo sapien
gtggcagcgagtggaccaaaaccca

SEQ ID NO: 44227 - DNA, 25 bp, Homo sapien
ataacccgcgcaagagccgaggagc

SEQ ID NO: 44228 - DNA, 25 bp, Homo sapien
cccgagtccttgcagagccagttcg

SEQ ID NO: 44229 - DNA, 25 bp, Homo sapien
gccctcgcagaagaagcagtcgctg

SEQ ID NO: 44230 - DNA, 25 bp, Homo sapien
gccgccttatcaaggtcatctcgaa

SEQ ID NO: 44231 - DNA, 25 bp, Homo sapien
ggctgcgccaagaccctgtacatct

SEQ ID NO: 44232 - DNA, 25 bp, Homo sapien
atgagatggccctgtacctgtgagc

SEQ ID NO: 44233 - DNA, 25 bp, Homo sapien
tgaatttcgagcagcagccggactc

SEQ ID NO: 44234 - DNA, 25 bp, Homo sapien
gaggtgcaaccaagcccagaacggc

SEQ ID NO: 44235 - DNA, 25 bp, Homo sapien
cactgagacgcagaagctgaatttc

SEQ ID NO: 44236 - DNA, 25 bp, Homo sapien
acgggctcttctaccctagtgcctt

SEQ ID NO: 44237 - DNA, 25 bp, Homo sapien
agagaacttccacgcggggctcaag

SEQ ID NO: 44238 - DNA, 25 bp, Homo sapien
acctcttcatccagacttaggcgcg

SEQ ID NO: 44239 - DNA, 25 bp, Homo sapien
acgccgacgcgctcctggagagcat

SEQ ID NO: 44240 - DNA, 25 bp, Homo sapien
tccatcaggagttcacgcgcaccaa

SEQ ID NO: 44241 - DNA, 25 bp, Homo sapien
tggaggcagaaaccatgtacaggta

SEQ ID NO: 44242 - DNA, 25 bp, Homo sapien
ccttctgcagcgactggcgctggct

SEQ ID NO: 44243 - DNA, 25 bp, Homo sapien
tggtgaggcagcctctcttgggccc

SEQ ID NO: 44244 - DNA, 25 bp, Homo sapien
gcttagtcactaacgagcccgtagc

SEQ ID NO: 44245 - DNA, 25 bp, Homo sapien
cacggcgcgtgaagccatcccggag

SEQ ID NO: 44246 - DNA, 25 bp, Homo sapien
tccgacgaacaaaggaggcaccggc

SEQ ID NO: 44247 - DNA, 25 bp, Homo sapien
gggccatctcggatcctaaagctgt

SEQ ID NO: 44248 - DNA, 25 bp, Homo sapien
ggcgactccgcctacgaagaacagc

SEQ ID NO: 44249 - DNA, 25 bp, Homo sapien
ttgaagagttgacaccggcttagtc

SEQ ID NO: 44250 - DNA, 25 bp, Homo sapien
aggaggggattcagcgctccaagcc

SEQ ID NO: 44251 - DNA, 25 bp, Homo sapien
ggcgcgccacccatcttataggcgg

SEQ ID NO: 44252 - DNA, 25 bp, Homo sapien
gcgtcggaggacaccctcacctatg

SEQ ID NO: 44253 - DNA, 25 bp, Homo sapien
tctacgcgctttcttgtcccacagg

SEQ ID NO: 44254 - DNA, 25 bp, Homo sapien
gtttgctctagcacccatctctacg

SEQ ID NO: 44255 - DNA, 25 bp, Homo sapien
aatgggaccgtggtttgctctagca

SEQ ID NO: 44256 - DNA, 25 bp, Homo sapien
gagtacgccagcgtccaggtcccga

SEQ ID NO: 44257 - DNA, 25 bp, Homo sapien
gagccgtccttctcagagtacgcca

SEQ ID NO: 44258 - DNA, 25 bp, Homo sapien
ctggacatggtccacctcaaccgga

SEQ ID NO: 44259 - DNA, 25 bp, Homo sapien
cctcacctatgctgacctggacatg

SEQ ID NO: 44260 - DNA, 25 bp, Homo sapien
gacccgctgctgatcctgtcgcaga

SEQ ID NO: 44261 - DNA, 25 bp, Homo sapien
ctcactctgagaatgggtctgtctg

SEQ ID NO: 44262 - DNA, 25 bp, Homo sapien
gggccacgctcagacacttcgatcg

SEQ ID NO: 44263 - DNA, 25 bp, Homo sapien
ggagctttgcctctctaggccggca

SEQ ID NO: 44264 - DNA, 25 bp, Homo sapien
tatccggctgcttgtacctggttca

SEQ ID NO: 44265 - DNA, 25 bp, Homo sapien
atgtgctcagttcgctatccggctg

SEQ ID NO: 44266 - DNA, 25 bp, Homo sapien
ggaccagatgttcgacgccgaggta

SEQ ID NO: 44267 - DNA, 25 bp, Homo sapien
tcgtcctcatgcagaccgtgtatta

SEQ ID NO: 44268 - DNA, 25 bp, Homo sapien
tctttcccatcgtgcgtcctctgga

SEQ ID NO: 44269 - DNA, 25 bp, Homo sapien
cctctggagaagtgcgcgcgtgtaa

SEQ ID NO: 44270 - DNA, 25 bp, Homo sapien
cagcaagtgcatccgagcgagcgga

SEQ ID NO: 44271 - DNA, 25 bp, Homo sapien
tttgaccgccttggaagtaccagta

SEQ ID NO: 44272 - DNA, 25 bp, Homo sapien
gaagtaccagtagccgcgctcgcag

SEQ ID NO: 44273 - DNA, 25 bp, Homo sapien
agaccgagagggagttctccatttc

SEQ ID NO: 44274 - DNA, 25 bp, Homo sapien
ccctttccagtacctataggtcgcg

SEQ ID NO: 44275 - DNA, 25 bp, Homo sapien
ctataggtcgcgtaaacaactccct

SEQ ID NO: 44276 - DNA, 25 bp, Homo sapien
ttccagttccgcacgcgctgggatt

SEQ ID NO: 44277 - DNA, 25 bp, Homo sapien
ataccggcttttcatggggccgagc

SEQ ID NO: 44278 - DNA, 25 bp, Homo sapien
acacgcctttcttattggataccgg

SEQ ID NO: 44279 - DNA, 25 bp, Homo sapien
gtcgctctgataaccgcatcccggt

SEQ ID NO: 44280 - DNA, 25 bp, Homo sapien
ctgcgggaggaacttgtcatcaccc

SEQ ID NO: 44281 - DNA, 25 bp, Homo sapien
ggacgtagccgccacattccagttc

SEQ ID NO: 44282 - DNA, 25 bp, Homo sapien
ggaaagatttccgtagtgcctgctg

SEQ ID NO: 44283 - DNA, 25 bp, Homo sapien
cggaagtcacttctcacacgccttt

SEQ ID NO: 44284 - DNA, 25 bp, Homo sapien
atgacggaccccgatgaggtggcca

SEQ ID NO: 44285 - DNA, 25 bp, Homo sapien
gagttcaaaatgacggaccccgatg

SEQ ID NO: 44286 - DNA, 25 bp, Homo sapien
agctgtatcacctgggaggggacca

SEQ ID NO: 44287 - DNA, 25 bp, Homo sapien
acgccagctgtatcacctgggaggg

SEQ ID NO: 44288 - DNA, 25 bp, Homo sapien
gccaacgccagctgtatcacctggg

SEQ ID NO: 44289 - DNA, 25 bp, Homo sapien
ctgctctccgacagcgccaacgcca

SEQ ID NO: 44290 - DNA, 25 bp, Homo sapien
gatccagctgtggcaattcctcctg

SEQ ID NO: 44291 - DNA, 25 bp, Homo sapien
tttgcctcacggcgtgcaggaagcg

SEQ ID NO: 44292 - DNA, 25 bp, Homo sapien
tttgcagctctcagggcagcgctgc

SEQ ID NO: 44293 - DNA, 25 bp, Homo sapien
tttccagctgcgtaacacgaccagg

SEQ ID NO: 44294 - DNA, 25 bp, Homo sapien
cgtccctgcgaattggaatttcagg

SEQ ID NO: 44295 - DNA, 25 bp, Homo sapien
ctgggatcagggcagctccgcctaa

SEQ ID NO: 44296 - DNA, 25 bp, Homo sapien
ccgaagggtccaagctttccagctg

SEQ ID NO: 44297 - DNA, 25 bp, Homo sapien
ggcagatactttcggtttgcagctc

SEQ ID NO: 44298 - DNA, 25 bp, Homo sapien
gacgcccagtgggttttcacggctc

SEQ ID NO: 44299 - DNA, 25 bp, Homo sapien
ggctctgccggcaaactcgccttat

SEQ ID NO: 44300 - DNA, 25 bp, Homo sapien
gcaccatgcctgcttgtcgcctagg

SEQ ID NO: 44301 - DNA, 25 bp, Homo sapien
gcggttgaaaccagatccgtcagtc

SEQ ID NO: 44302 - DNA, 25 bp, Homo sapien
atgcgccgacaacctcaagtgctgc

SEQ ID NO: 44303 - DNA, 25 bp, Homo sapien
ccgagctccaggctgaccagaactg

SEQ ID NO: 44304 - DNA, 25 bp, Homo sapien
cctagggccagagactgagaattcc

SEQ ID NO: 44305 - DNA, 25 bp, Homo sapien
caagggttagggagctctcgtactc

SEQ ID NO: 44306 - DNA, 25 bp, Homo sapien
attctgtgctgaacgcggacactcc

SEQ ID NO: 44307 - DNA, 25 bp, Homo sapien
tgttcggcttcaccctagtctcagg

SEQ ID NO: 44308 - DNA, 25 bp, Homo sapien
catgggagccactggcgacgccgag

SEQ ID NO: 44309 - DNA, 25 bp, Homo sapien
gagcagcgcgctccagtgacgtcac

SEQ ID NO: 44310 - DNA, 25 bp, Homo sapien
acgtcacggcgccactttccggccg

SEQ ID NO: 44311 - DNA, 25 bp, Homo sapien
tccagcgtcgcgcttccgggcggac

SEQ ID NO: 44312 - DNA, 25 bp, Homo sapien
actttccggccggtgacagagtcca

SEQ ID NO: 44313 - DNA, 25 bp, Homo sapien
ttccggccggtgacagagtccagcg

SEQ ID NO: 44314 - DNA, 25 bp, Homo sapien
cagctggttcttacggtgagggcgc

SEQ ID NO: 44315 - DNA, 25 bp, Homo sapien
acgagcagcgcgctccagtgacgtc

SEQ ID NO: 44316 - DNA, 25 bp, Homo sapien
tgcagtcgtgttctccgagttcctg

SEQ ID NO: 44317 - DNA, 25 bp, Homo sapien
caaaaggtgagtgatgcggcctacc

SEQ ID NO: 44318 - DNA, 25 bp, Homo sapien
cgtctcattggctggatcaaaccca

SEQ ID NO: 44319 - DNA, 25 bp, Homo sapien
ggcagcatcatctaccaatcggttg

SEQ ID NO: 44320 - DNA, 25 bp, Homo sapien
cggccaccaattcgctacggattcg

SEQ ID NO: 44321 - DNA, 25 bp, Homo sapien
tcatcccacgtggacgttttcttgg

SEQ ID NO: 44322 - DNA, 25 bp, Homo sapien
cgagtgttcccacgcggagtaagac

SEQ ID NO: 44323 - DNA, 25 bp, Homo sapien
atgccctaggcattggtacccagag

SEQ ID NO: 44324 - DNA, 25 bp, Homo sapien
tgcaaacctgcagagcgagtcagcg

SEQ ID NO: 44325 - DNA, 25 bp, Homo sapien
acctgcagagcgagtcagcgccatc

SEQ ID NO: 44326 - DNA, 25 bp, Homo sapien
agtcagcgccatcgagcactcgcag

SEQ ID NO: 44327 - DNA, 25 bp, Homo sapien
ggcccagctcccttccacatcccgc

SEQ ID NO: 44328 - DNA, 25 bp, Homo sapien
cacatcccgccgctcagacagcctc

SEQ ID NO: 44329 - DNA, 25 bp, Homo sapien
gccaagctgtgcacgcccagcgcca

SEQ ID NO: 44330 - DNA, 25 bp, Homo sapien
tggaccacagcccttgcgacctgct

SEQ ID NO: 44331 - DNA, 25 bp, Homo sapien
cccagcgccagctgtcaggagccgg

SEQ ID NO: 44332 - DNA, 25 bp, Homo sapien
ccgtcgttgttcttgtcgccgtctt

SEQ ID NO: 44333 - DNA, 25 bp, Homo sapien
tcgccgtctttcatcagagattcga

SEQ ID NO: 44334 - DNA, 25 bp, Homo sapien
tcgatgtagccgtctgcattccttc

SEQ ID NO: 44335 - DNA, 25 bp, Homo sapien
tgcattccttcaggtccgagggaca

SEQ ID NO: 44336 - DNA, 25 bp, Homo sapien
acctgtcgaagatgcggaagcactc

SEQ ID NO: 44337 - DNA, 25 bp, Homo sapien
tggcgcaccatcatgaccaagaact

SEQ ID NO: 44338 - DNA, 25 bp, Homo sapien
tggccctcaccgtcgaagtcaatgc

SEQ ID NO: 44339 - DNA, 25 bp, Homo sapien
ccggaggccctgaaaatctcagcca

SEQ ID NO: 44340 - DNA, 25 bp, Homo sapien
tcagcttcaccagcgccgaggacga

SEQ ID NO: 44341 - DNA, 25 bp, Homo sapien
gatccggtacacagcgtcgcgcgct

SEQ ID NO: 44342 - DNA, 25 bp, Homo sapien
ggccagtccagaggccgagcagttt

SEQ ID NO: 44343 - DNA, 25 bp, Homo sapien
cctggttcgcaagacctcggactgc

SEQ ID NO: 44344 - DNA, 25 bp, Homo sapien
ggccgagcagtttccggagagctca

SEQ ID NO: 44345 - DNA, 25 bp, Homo sapien
gcagtttccggagagctcagagctg

SEQ ID NO: 44346 - DNA, 25 bp, Homo sapien
ggggctcgattaggcctccatccca

SEQ ID NO: 44347 - DNA, 25 bp, Homo sapien
ctccgggatccggtacacagcgtcg

SEQ ID NO: 44348 - DNA, 25 bp, Homo sapien
atgcggccagcgatgaaagctcaga

SEQ ID NO: 44349 - DNA, 25 bp, Homo sapien
aggccctttgaagtcatccgccctg

SEQ ID NO: 44350 - DNA, 25 bp, Homo sapien
ttcaggacgtgctgcaaaggccctt

SEQ ID NO: 44351 - DNA, 25 bp, Homo sapien
ttccctttcaagctgtgtgttctgc

SEQ ID NO: 44352 - DNA, 25 bp, Homo sapien
gagccacctgctccgagctcgattt

SEQ ID NO: 44353 - DNA, 25 bp, Homo sapien
ctcctcgcgtatttgtgcccaaatg

SEQ ID NO: 44354 - DNA, 25 bp, Homo sapien
acgcgcaatactaaccgggagtgta

SEQ ID NO: 44355 - DNA, 25 bp, Homo sapien
tggagctgagctcttccaaaaatga

SEQ ID NO: 44356 - DNA, 25 bp, Homo sapien
atctctcgccgttactcggactttg

SEQ ID NO: 44357 - DNA, 25 bp, Homo sapien
gactttgagcggctgcaccgaaacc

SEQ ID NO: 44358 - DNA, 25 bp, Homo sapien
ccgtaagcggctgcgccggaatttt

SEQ ID NO: 44359 - DNA, 25 bp, Homo sapien
tgcagagaccattgcccgccgtagc

SEQ ID NO: 44360 - DNA, 25 bp, Homo sapien
tgcaggacttcttcgtgctgccgga

SEQ ID NO: 44361 - DNA, 25 bp, Homo sapien
gcaccgaaacctgcagcggcaattc

SEQ ID NO: 44362 - DNA, 25 bp, Homo sapien
ttgagcagtttttgggtcacctgca

SEQ ID NO: 44363 - DNA, 25 bp, Homo sapien
cgccggaattttactgcagagacca

SEQ ID NO: 44364 - DNA, 25 bp, Homo sapien
caaggcgaccttgtaaggcatttcc

SEQ ID NO: 44365 - DNA, 25 bp, Homo sapien
cctcgatctcgaccaggaagacctg

SEQ ID NO: 44366 - DNA, 25 bp, Homo sapien
cggtcagaccgagacgcagatgtcc

SEQ ID NO: 44367 - DNA, 25 bp, Homo sapien
ctcaatgcgcagatatggttccacg

SEQ ID NO: 44368 - DNA, 25 bp, Homo sapien
cccggggaatgcgaaactgctcaat

SEQ ID NO: 44369 - DNA, 25 bp, Homo sapien
tagccgtccacaacaggatcatctg

SEQ ID NO: 44370 - DNA, 25 bp, Homo sapien
ccggagttcacgtgactcgtacaca

SEQ ID NO: 44371 - DNA, 25 bp, Homo sapien
aggcagcagccatctctcggccata

SEQ ID NO: 44372 - DNA, 25 bp, Homo sapien
cgaggccatcctctgtgaccgaagg

SEQ ID NO: 44373 - DNA, 25 bp, Homo sapien
tgcctgtctctgacagcatcgcttg

SEQ ID NO: 44374 - DNA, 25 bp, Homo sapien
agcatcgcttgtttccactctgata

SEQ ID NO: 44375 - DNA, 25 bp, Homo sapien
tctgataccaggaattatcccgaaa

SEQ ID NO: 44376 - DNA, 25 bp, Homo sapien
agttaacatgtcacctccacgaggc

SEQ ID NO: 44377 - DNA, 25 bp, Homo sapien
tggtgggcaacgtagccacaggaac

SEQ ID NO: 44378 - DNA, 25 bp, Homo sapien
ctccgtgtagtcttggcctcctcag

SEQ ID NO: 44379 - DNA, 25 bp, Homo sapien
tatcccgaaaagttaacatgtcacc

SEQ ID NO: 44380 - DNA, 25 bp, Homo sapien
cccacttactcagagatgttgtagt

SEQ ID NO: 44381 - DNA, 25 bp, Homo sapien
agcagcagagaaacccttacttagc

SEQ ID NO: 44382 - DNA, 25 bp, Homo sapien
gcttcactgaagcagcagagaaacc

SEQ ID NO: 44383 - DNA, 25 bp, Homo sapien
ccggaatggtgatagtctccagctc

SEQ ID NO: 44384 - DNA, 25 bp, Homo sapien
ttctttgccccgcaggtccggaatg

SEQ ID NO: 44385 - DNA, 25 bp, Homo sapien
tgtagtagaagtggccttctttgcc

SEQ ID NO: 44386 - DNA, 25 bp, Homo sapien
acttagctcccgtgcccactgttgg

SEQ ID NO: 44387 - DNA, 25 bp, Homo sapien
agatgttgtagtagaagtggccttc

SEQ ID NO: 44388 - DNA, 25 bp, Homo sapien
tcccattagagattctgcctggagc

SEQ ID NO: 44389 - DNA, 25 bp, Homo sapien
cagggttgttccagccgcctttata

SEQ ID NO: 44390 - DNA, 25 bp, Homo sapien
cccaactcactcagcggtggagctg

SEQ ID NO: 44391 - DNA, 25 bp, Homo sapien
ccacgccggcttcagtgcaccacgc

SEQ ID NO: 44392 - DNA, 25 bp, Homo sapien
tgttagcgttctccttcatcggctc

SEQ ID NO: 44393 - DNA, 25 bp, Homo sapien
cccatgttagcgttctccttcatcg

SEQ ID NO: 44394 - DNA, 25 bp, Homo sapien
tgttccagccgcctttataaagccg

SEQ ID NO: 44395 - DNA, 25 bp, Homo sapien
ccattagagattctgcctggagccc

SEQ ID NO: 44396 - DNA, 25 bp, Homo sapien
tttgactcctccctactgggccgga

SEQ ID NO: 44397 - DNA, 25 bp, Homo sapien
ggggacgtgccagtgaattcattcc

SEQ ID NO: 44398 - DNA, 25 bp, Homo sapien
tcgagcagaacgtgtagccgcgtcc

SEQ ID NO: 44399 - DNA, 25 bp, Homo sapien
cctgcgtactttgttcgccctttga

SEQ ID NO: 44400 - DNA, 25 bp, Homo sapien
agttgtttatccttgagcagcggta

SEQ ID NO: 44401 - DNA, 25 bp, Homo sapien
ctgggccggagaattctgattggta

SEQ ID NO: 44402 - DNA, 25 bp, Homo sapien
ctggttgcgcagatagagttgttta

SEQ ID NO: 44403 - DNA, 25 bp, Homo sapien
accgcctttgtgtcgggctccgact

SEQ ID NO: 44404 - DNA, 25 bp, Homo sapien
gccactccgcagatgatgttcggcg

SEQ ID NO: 44405 - DNA, 25 bp, Homo sapien
cgacacagacggctactttggctcc

SEQ ID NO: 44406 - DNA, 25 bp, Homo sapien
tgctacttccgccagtactgttctg

SEQ ID NO: 44407 - DNA, 25 bp, Homo sapien
gactctttggcgtcagcttcgagtg

SEQ ID NO: 44408 - DNA, 25 bp, Homo sapien
ttgaggccctccaccgactctttgg

SEQ ID NO: 44409 - DNA, 25 bp, Homo sapien
ctgtgcatgtctttgaggccctcca

SEQ ID NO: 44410 - DNA, 25 bp, Homo sapien
agggatcgctgcctgtgcatgtctt

SEQ ID NO: 44411 - DNA, 25 bp, Homo sapien
cctctacgaggggactggcctgcag

SEQ ID NO: 44412 - DNA, 25 bp, Homo sapien
gaagctgtgcttcccaggctaaggc

SEQ ID NO: 44413 - DNA, 25 bp, Homo sapien
ggtgtttggcactgagcccactatg

SEQ ID NO: 44414 - DNA, 25 bp, Homo sapien
cacgattctcgtggagcgttccgct

SEQ ID NO: 44415 - DNA, 25 bp, Homo sapien
tgtgacctcactccacggcagggta

SEQ ID NO: 44416 - DNA, 25 bp, Homo sapien
gtagggtctgggaacttcactctga

SEQ ID NO: 44417 - DNA, 25 bp, Homo sapien
cacattttcagtgttccggaaggtc

SEQ ID NO: 44418 - DNA, 25 bp, Homo sapien
aacagactctgggactttatacgtc

SEQ ID NO: 44419 - DNA, 25 bp, Homo sapien
cggaggaacccatcggcctattgta

SEQ ID NO: 44420 - DNA, 25 bp, Homo sapien
ccggcattcagggagacgcccattt

SEQ ID NO: 44421 - DNA, 25 bp, Homo sapien
cgcccatttcgacgatgacgagttg

SEQ ID NO: 44422 - DNA, 25 bp, Homo sapien
cttcagagcacggagacgggtatcc

SEQ ID NO: 44423 - DNA, 25 bp, Homo sapien
tctgcgcagcagtactcggctaacc

SEQ ID NO: 44424 - DNA, 25 bp, Homo sapien
gcccgcacttatttcggagcccttg

SEQ ID NO: 44425 - DNA, 25 bp, Homo sapien
gcagacatcgtcatccagtttggtg

SEQ ID NO: 44426 - DNA, 25 bp, Homo sapien
ccttcactcgcgtgtacagccggga

SEQ ID NO: 44427 - DNA, 25 bp, Homo sapien
cctgcagtggttccaactcggtttg

SEQ ID NO: 44428 - DNA, 25 bp, Homo sapien
tctccctccaggatacagtttgttc

SEQ ID NO: 44429 - DNA, 25 bp, Homo sapien
cccttgcataaggacgacgtgaatg

SEQ ID NO: 44430 - DNA, 25 bp, Homo sapien
cggaggcgctcatgtaccctatgta

SEQ ID NO: 44431 - DNA, 25 bp, Homo sapien
cgcgctgggcttagatcattcctca

SEQ ID NO: 44432 - DNA, 25 bp, Homo sapien
agattgtttagctccctgtcgggtc

SEQ ID NO: 44433 - DNA, 25 bp, Homo sapien
tggtgcgctaccacctcgaactttg

SEQ ID NO: 44434 - DNA, 25 bp, Homo sapien
cgggtctagcctcttctcaggagtg

SEQ ID NO: 44435 - DNA, 25 bp, Homo sapien
ttgggtctctccagctgactcgacg

SEQ ID NO: 44436 - DNA, 25 bp, Homo sapien
gattgggaaccagctgtatttgttc

SEQ ID NO: 44437 - DNA, 25 bp, Homo sapien
ggaaccagctgtatttgttcaagga

SEQ ID NO: 44438 - DNA, 25 bp, Homo sapien
cgatgcctgcaacgtgaacatcttc

SEQ ID NO: 44439 - DNA, 25 bp, Homo sapien
gcctgcaacgtgaacatcttcgacg

SEQ ID NO: 44440 - DNA, 25 bp, Homo sapien
gtgaacatcttcgacgccatcgcgg

SEQ ID NO: 44441 - DNA, 25 bp, Homo sapien
acgccatcgcggagattgggaacca

SEQ ID NO: 44442 - DNA, 25 bp, Homo sapien
atcttcgacgccatcgcggagattg

SEQ ID NO: 44443 - DNA, 25 bp, Homo sapien
gtggacgatgcctgcaacgtgaaca

SEQ ID NO: 44444 - DNA, 25 bp, Homo sapien
tgggctccgctagggcttaattcaa

SEQ ID NO: 44445 - DNA, 25 bp, Homo sapien
ttcgcccgcaggtcacaatccaagg

SEQ ID NO: 44446 - DNA, 25 bp, Homo sapien
ggcgtgaagcttgctggctcttctt

SEQ ID NO: 44447 - DNA, 25 bp, Homo sapien
atcgcgtctctaagcggttttcaga

SEQ ID NO: 44448 - DNA, 25 bp, Homo sapien
cgccgaggctggagttactgccact

SEQ ID NO: 44449 - DNA, 25 bp, Homo sapien
gccagtcgcactccgagaagccgaa

SEQ ID NO: 44450 - DNA, 25 bp, Homo sapien
tggactgtttacacccgggcgaaca

SEQ ID NO: 44451 - DNA, 25 bp, Homo sapien
acggcgcccgcagaggtacacaaag

SEQ ID NO: 44452 - DNA, 25 bp, Homo sapien
cggggtgcctttggacacgcacgac

SEQ ID NO: 44453 - DNA, 25 bp, Homo sapien
ggacacgcacgacgtcttccagtac

SEQ ID NO: 44454 - DNA, 25 bp, Homo sapien
tgcctttggacacgcacgacgtctt

SEQ ID NO: 44455 - DNA, 25 bp, Homo sapien
ccagcgaggtggaccggatgttccc

SEQ ID NO: 44456 - DNA, 25 bp, Homo sapien
cgtgaaggcgcagatggtggatccc

SEQ ID NO: 44457 - DNA, 25 bp, Homo sapien
ccgcaggttcgacgtgaaggcgcag

SEQ ID NO: 44458 - DNA, 25 bp, Homo sapien
gtccgtccgctagccggctcagcac

SEQ ID NO: 44459 - DNA, 25 bp, Homo sapien
ctttggacacgcacgacgtcttcca

SEQ ID NO: 44460 - DNA, 25 bp, Homo sapien
tttctttggctttctggcgcgctcc

SEQ ID NO: 44461 - DNA, 25 bp, Homo sapien
caggagctacgcgagctcggattgt

SEQ ID NO: 44462 - DNA, 25 bp, Homo sapien
tttattttcaagctgccggccaggc

SEQ ID NO: 44463 - DNA, 25 bp, Homo sapien
agcttgggattgtattttctttggc

SEQ ID NO: 44464 - DNA, 25 bp, Homo sapien
ctgctcggagcttgggattgtattt

SEQ ID NO: 44465 - DNA, 25 bp, Homo sapien
tggcgcgctccttattatttatttc

SEQ ID NO: 44466 - DNA, 25 bp, Homo sapien
caggcttgaagcctgctcggagctt

SEQ ID NO: 44467 - DNA, 25 bp, Homo sapien
tatttttattttcaagctgccggcc

SEQ ID NO: 44468 - DNA, 25 bp, Homo sapien
ttagcggacagcgactggggatccc

SEQ ID NO: 44469 - DNA, 25 bp, Homo sapien
ggggacccacttagctccttgtctg

SEQ ID NO: 44470 - DNA, 25 bp, Homo sapien
tgatcccgactcttggggacccact

SEQ ID NO: 44471 - DNA, 25 bp, Homo sapien
agttagtatggatcctgggcagcga

SEQ ID NO: 44472 - DNA, 25 bp, Homo sapien
gtctgctcgagctccgtaagggttg

SEQ ID NO: 44473 - DNA, 25 bp, Homo sapien
tagctccctggaggcttagcggaca

SEQ ID NO: 44474 - DNA, 25 bp, Homo sapien
tggcggatcctccaatcctctagct

SEQ ID NO: 44475 - DNA, 25 bp, Homo sapien
atgccgtagggtcgctgatcccgac

SEQ ID NO: 44476 - DNA, 25 bp, Homo sapien
attcaggacgggaagcaagatcacc

SEQ ID NO: 44477 - DNA, 25 bp, Homo sapien
tcgctttcccgtgggttcctattca

SEQ ID NO: 44478 - DNA, 25 bp, Homo sapien
agctccattggaatgctccgggcgc

SEQ ID NO: 44479 - DNA, 25 bp, Homo sapien
cctagaatgggctgatgtggagctc

SEQ ID NO: 44480 - DNA, 25 bp, Homo sapien
agtctgctgcagtccctcgttctaa

SEQ ID NO: 44481 - DNA, 25 bp, Homo sapien
cgggctgtggtgtctccttaagaca

SEQ ID NO: 44482 - DNA, 25 bp, Homo sapien
agcgtacttcctccatagattttca

SEQ ID NO: 44483 - DNA, 25 bp, Homo sapien
aggtccgacctcagactgaagcgta

SEQ ID NO: 44484 - DNA, 25 bp, Homo sapien
ccttagctgttctggtcctttgaga

SEQ ID NO: 44485 - DNA, 25 bp, Homo sapien
ctggccgccgcagcttaattgaaag

SEQ ID NO: 44486 - DNA, 25 bp, Homo sapien
agccgattcgggttgagagctccca

SEQ ID NO: 44487 - DNA, 25 bp, Homo sapien
cttactccttggctccggggaatca

SEQ ID NO: 44488 - DNA, 25 bp, Homo sapien
cctttgagaactcggaagctcattc

SEQ ID NO: 44489 - DNA, 25 bp, Homo sapien
cctggctgacaagtcccgggagcct

SEQ ID NO: 44490 - DNA, 25 bp, Homo sapien
gctgcgcgccgcgttacataagcgg

SEQ ID NO: 44491 - DNA, 25 bp, Homo sapien
gccacctagttgcagggtctcgggc

SEQ ID NO: 44492 - DNA, 25 bp, Homo sapien
ggccgcgaggtcatcaccatctact

SEQ ID NO: 44493 - DNA, 25 bp, Homo sapien
tccagtccttttccgagatgaggtg

SEQ ID NO: 44494 - DNA, 25 bp, Homo sapien
aggcctcgggaagctgaattttcct

SEQ ID NO: 44495 - DNA, 25 bp, Homo sapien
ggcggccgagcctatacatagtgta

SEQ ID NO: 44496 - DNA, 25 bp, Homo sapien
ctgggtcttcgctgccctttttcta

SEQ ID NO: 44497 - DNA, 25 bp, Homo sapien
cagagctcctcagtgccagtttggc

SEQ ID NO: 44498 - DNA, 25 bp, Homo sapien
gccgctgtcaccgtttacatacaga

SEQ ID NO: 44499 - DNA, 25 bp, Homo sapien
catcggctcttatgcaagttggggc

SEQ ID NO: 44500 - DNA, 25 bp, Homo sapien
actgtcgcaagaccgcgcgtgttta

SEQ ID NO: 44501 - DNA, 25 bp, Homo sapien
tgcgtccaccacagagaaccgtagg

SEQ ID NO: 44502 - DNA, 25 bp, Homo sapien
accgaccgttcgtgcacagacaggc

SEQ ID NO: 44503 - DNA, 25 bp, Homo sapien
tgaggactcctagtgaccgaccgtt

SEQ ID NO: 44504 - DNA, 25 bp, Homo sapien
tgtgcggctcaaccagagaagcctt

SEQ ID NO: 44505 - DNA, 25 bp, Homo sapien
agcgactccaccgtttcgacagggg

SEQ ID NO: 44506 - DNA, 25 bp, Homo sapien
gactgcgccactgactcgctgagga

SEQ ID NO: 44507 - DNA, 25 bp, Homo sapien
cctacaaaacgcgtggggtgtcaca

SEQ ID NO: 44508 - DNA, 25 bp, Homo sapien
cgcctggtctcacctcgctatggtt

SEQ ID NO: 44509 - DNA, 25 bp, Homo sapien
gtgagttgtttttgccccgaccaga

SEQ ID NO: 44510 - DNA, 25 bp, Homo sapien
cctctgcagtgcgtcctctggggct

SEQ ID NO: 44511 - DNA, 25 bp, Homo sapien
gtctgcctctgcagtgcgtcctctg

SEQ ID NO: 44512 - DNA, 25 bp, Homo sapien
ccgataggtggaccgcgattggtct

SEQ ID NO: 44513 - DNA, 25 bp, Homo sapien
gtctcacctcgctatggttcgtctg

SEQ ID NO: 44514 - DNA, 25 bp, Homo sapien
gaccgcgattggtctttgaagaccc

SEQ ID NO: 44515 - DNA, 25 bp, Homo sapien
acctcgctatggttcgtctgcctct

SEQ ID NO: 44516 - DNA, 25 bp, Homo sapien
ctggcacgacgctcttcatgctctt

SEQ ID NO: 44517 - DNA, 25 bp, Homo sapien
cagcgggacgctggcacgacgctct

SEQ ID NO: 44518 - DNA, 25 bp, Homo sapien
ttatccggcccatggagaggtgagc

SEQ ID NO: 44519 - DNA, 25 bp, Homo sapien
accgctaattatccggcccatggag

SEQ ID NO: 44520 - DNA, 25 bp, Homo sapien
tgctaatcagccaccgctaattatc

SEQ ID NO: 44521 - DNA, 25 bp, Homo sapien
ggggccgcaataattgctaatcagc

SEQ ID NO: 44522 - DNA, 25 bp, Homo sapien
agcctgccttgtccaggaccggcgg

SEQ ID NO: 44523 - DNA, 25 bp, Homo sapien
ggctctccgtgcctcatcgccctgt

SEQ ID NO: 44524 - DNA, 25 bp, Homo sapien
gacgttgtcccgcatgtcttcatcc

SEQ ID NO: 44525 - DNA, 25 bp, Homo sapien
cgaagtcctgctcggagcccgacga

SEQ ID NO: 44526 - DNA, 25 bp, Homo sapien
ccagtgccaccttgcggctgatgaa

SEQ ID NO: 44527 - DNA, 25 bp, Homo sapien
cggctgatgaagtccctgaacactg

SEQ ID NO: 44528 - DNA, 25 bp, Homo sapien
agctcgccgaagtcgtagaggctcc

SEQ ID NO: 44529 - DNA, 25 bp, Homo sapien
acatgtcgtaggcttcggtgtcctg

SEQ ID NO: 44530 - DNA, 25 bp, Homo sapien
ccgccttcgtcgttgtatttgatga

SEQ ID NO: 44531 - DNA, 25 bp, Homo sapien
gctgctgagataggcgaagtcctgc

SEQ ID NO: 44532 - DNA, 25 bp, Homo sapien
tgctcctgccggttgaagcccacgt

SEQ ID NO: 44533 - DNA, 25 bp, Homo sapien
acaaaggccgtggtgttgcaggact

SEQ ID NO: 44534 - DNA, 25 bp, Homo sapien
gctgtcgcagccacagatgcggatg

SEQ ID NO: 44535 - DNA, 25 bp, Homo sapien
tgagcgtgcctgtgctgctcagtgt

SEQ ID NO: 44536 - DNA, 25 bp, Homo sapien
ggaagaacacgtcctgctcctgccg

SEQ ID NO: 44537 - DNA, 25 bp, Homo sapien
cccacgtgctgcgtgtgcactgcag

SEQ ID NO: 44538 - DNA, 25 bp, Homo sapien
cagcggtgttgtctgttccggaaga

SEQ ID NO: 44539 - DNA, 25 bp, Homo sapien
ggcccactgtctaccaccaggatgg

SEQ ID NO: 44540 - DNA, 25 bp, Homo sapien
caactgcacgcgacttgggaccttg

SEQ ID NO: 44541 - DNA, 25 bp, Homo sapien
ttgacgtctgctacccacagcctgg

SEQ ID NO: 44542 - DNA, 25 bp, Homo sapien
gcttcccttcatgtcggaggtccta

SEQ ID NO: 44543 - DNA, 25 bp, Homo sapien
cagcgaagtccgcaaagagctttcc

SEQ ID NO: 44544 - DNA, 25 bp, Homo sapien
cttcaccatggcaactcgggcgtcg

SEQ ID NO: 44545 - DNA, 25 bp, Homo sapien
gggccttggtcacactcagagctga

SEQ ID NO: 44546 - DNA, 25 bp, Homo sapien
cccttgctgaggactcgagcgaaca

SEQ ID NO: 44547 - DNA, 25 bp, Homo sapien
tcgcgctctggtgtatctcttttga

SEQ ID NO: 44548 - DNA, 25 bp, Homo sapien
ccgaggctccgagccaagatttctg

SEQ ID NO: 44549 - DNA, 25 bp, Homo sapien
gcaaggttgagctccgttccctccg

SEQ ID NO: 44550 - DNA, 25 bp, Homo sapien
cctcctgtccgtgcagggcgcgttt

SEQ ID NO: 44551 - DNA, 25 bp, Homo sapien
tccacggcgggaatcagagccgtcg

SEQ ID NO: 44552 - DNA, 25 bp, Homo sapien
cgaaatgctgccaaccgtccgctta

SEQ ID NO: 44553 - DNA, 25 bp, Homo sapien
gccaagatttctgccctaatagttt

SEQ ID NO: 44554 - DNA, 25 bp, Homo sapien
ggcgctcacacacggacacgcgtga

SEQ ID NO: 44555 - DNA, 25 bp, Homo sapien
tccctctcgggaaacggcgaaatgc

SEQ ID NO: 44556 - DNA, 25 bp, Homo sapien
cgcgcggacaaaggcctcgaatgcc

SEQ ID NO: 44557 - DNA, 25 bp, Homo sapien
cagcacgcgcgagctaatctgcagc

SEQ ID NO: 44558 - DNA, 25 bp, Homo sapien
tgtccaacacatgtctcgggcggcg

SEQ ID NO: 44559 - DNA, 25 bp, Homo sapien
taaaggcccgtgtccaacacatgtc

SEQ ID NO: 44560 - DNA, 25 bp, Homo sapien
cggctccaggccttaaaggcccgtg

SEQ ID NO: 44561 - DNA, 25 bp, Homo sapien
tgccgcgtgaaaaagccctttgttc

SEQ ID NO: 44562 - DNA, 25 bp, Homo sapien
tgcagcttttccgttgccgcgtgaa

SEQ ID NO: 44563 - DNA, 25 bp, Homo sapien
tcgaatgccaagcaagcgctcattg

SEQ ID NO: 44564 - DNA, 25 bp, Homo sapien
gcacgatcgcctggtcgcggaacgt

SEQ ID NO: 44565 - DNA, 25 bp, Homo sapien
gcctccaggatcacggtgtgcacgg

SEQ ID NO: 44566 - DNA, 25 bp, Homo sapien
ggtccacgaacttgttgagggcctc

SEQ ID NO: 44567 - DNA, 25 bp, Homo sapien
ctgggattcgaagtccaggcgctgc

SEQ ID NO: 44568 - DNA, 25 bp, Homo sapien
gctcgtccacgtcggtcacggccac

SEQ ID NO: 44569 - DNA, 25 bp, Homo sapien
tgcgcgtcctcctgcacctccagga

SEQ ID NO: 44570 - DNA, 25 bp, Homo sapien
gcgccgtcaccacgccgaccaggga

SEQ ID NO: 44571 - DNA, 25 bp, Homo sapien
cacgaacttgttgagggcctccagg

SEQ ID NO: 44572 - DNA, 25 bp, Homo sapien
agctacctttagaattcgacaagga

SEQ ID NO: 44573 - DNA, 25 bp, Homo sapien
tagaattcgacaaggacggatgctc

SEQ ID NO: 44574 - DNA, 25 bp, Homo sapien
tctgcggatggtgctgttgctaagc

SEQ ID NO: 44575 - DNA, 25 bp, Homo sapien
ttcactctgcggatggtgctgttgc

SEQ ID NO: 44576 - DNA, 25 bp, Homo sapien
atggaggaggcggttgtaaaatagg

SEQ ID NO: 44577 - DNA, 25 bp, Homo sapien
ccagcggttcctgtgggtgctgaca

SEQ ID NO: 44578 - DNA, 25 bp, Homo sapien
ccttggcgacaaccgcggggcccag

SEQ ID NO: 44579 - DNA, 25 bp, Homo sapien
tcgacaaggacggatgctccgagcg

SEQ ID NO: 44580 - DNA, 25 bp, Homo sapien
tgtactcctctaccacgaagaactg

SEQ ID NO: 44581 - DNA, 25 bp, Homo sapien
ccaggagcatggacgagaggcacca

SEQ ID NO: 44582 - DNA, 25 bp, Homo sapien
cgccgctgcttggtcgcacaacgat

SEQ ID NO: 44583 - DNA, 25 bp, Homo sapien
tcgcacaacgatgcggcgccgtgtc

SEQ ID NO: 44584 - DNA, 25 bp, Homo sapien
ccgtgtcacatggtggcctcagcgc

SEQ ID NO: 44585 - DNA, 25 bp, Homo sapien
tcgcgtgcggatcaccaggcagcac

SEQ ID NO: 44586 - DNA, 25 bp, Homo sapien
acagctccagagtcggggaagcgcc

SEQ ID NO: 44587 - DNA, 25 bp, Homo sapien
aagcgccatggttcctgcgcagaaa

SEQ ID NO: 44588 - DNA, 25 bp, Homo sapien
cacgctcgcgccgtgcggtattttc

SEQ ID NO: 44589 - DNA, 25 bp, Homo sapien
tcgcgccgtgcggtattttcccggc

SEQ ID NO: 44590 - DNA, 25 bp, Homo sapien
gctggagtcagcctccgggtgtccc

SEQ ID NO: 44591 - DNA, 25 bp, Homo sapien
cagaaccgtgcgtgtcgccgcggct

SEQ ID NO: 44592 - DNA, 25 bp, Homo sapien
ctcagaggggaccagaaccgtgcgt

SEQ ID NO: 44593 - DNA, 25 bp, Homo sapien
aagagagcagcgctggctctcgctc

SEQ ID NO: 44594 - DNA, 25 bp, Homo sapien
tcctaaggaagagagcagcgctggc

SEQ ID NO: 44595 - DNA, 25 bp, Homo sapien
tcgcgtcagggctgtgcgccacctt

SEQ ID NO: 44596 - DNA, 25 bp, Homo sapien
ttaagcacctccacctcatggcgtt

SEQ ID NO: 44597 - DNA, 25 bp, Homo sapien
tcatggcgttaatcctcgcagaccc

SEQ ID NO: 44598 - DNA, 25 bp, Homo sapien
ggactccatgggaagggaacttcga

SEQ ID NO: 44599 - DNA, 25 bp, Homo sapien
ccaaagaaatgtcagcgcggggacg

SEQ ID NO: 44600 - DNA, 25 bp, Homo sapien
gggccgtgacatgaacaaccaaaga

SEQ ID NO: 44601 - DNA, 25 bp, Homo sapien
aactgcgcagactgaagggccgtga

SEQ ID NO: 44602 - DNA, 25 bp, Homo sapien
tcatctcgccagcacatttgtaaaa

SEQ ID NO: 44603 - DNA, 25 bp, Homo sapien
acttgccagctgtgtcaccctgggc

SEQ ID NO: 44604 - DNA, 25 bp, Homo sapien
aggaaataccagatgagccggcgtc

SEQ ID NO: 44605 - DNA, 25 bp, Homo sapien
gaaataccagatgagccggcgtccg

SEQ ID NO: 44606 - DNA, 25 bp, Homo sapien
acccaggacgtcgcaggtgctcagg

SEQ ID NO: 44607 - DNA, 25 bp, Homo sapien
aataccagatgagccggcgtccggc

SEQ ID NO: 44608 - DNA, 25 bp, Homo sapien
gcgtccggcaggtgccttgcaggag

SEQ ID NO: 44609 - DNA, 25 bp, Homo sapien
ccctccacagacggcgaaactgagg

SEQ ID NO: 44610 - DNA, 25 bp, Homo sapien
tcccgcacccaggacgtcgcaggtg

SEQ ID NO: 44611 - DNA, 25 bp, Homo sapien
ggggagcccgcttcccttctccagc

SEQ ID NO: 44612 - DNA, 25 bp, Homo sapien
tcgccgtcacgctgaagtctctttc

SEQ ID NO: 44613 - DNA, 25 bp, Homo sapien
cacagctgccggtagaggggaaaaa

SEQ ID NO: 44614 - DNA, 25 bp, Homo sapien
ttgtctgtcactcaagaaggggcgg

SEQ ID NO: 44615 - DNA, 25 bp, Homo sapien
agccgggtccaggttgagcatgacc

SEQ ID NO: 44616 - DNA, 25 bp, Homo sapien
ttctgggtccaggacccggtctctc

SEQ ID NO: 44617 - DNA, 25 bp, Homo sapien
cggagcagacgctagccgcaacgct

SEQ ID NO: 44618 - DNA, 25 bp, Homo sapien
gggcccggcttctattgctccgact

SEQ ID NO: 44619 - DNA, 25 bp, Homo sapien
tcttcaattaggttgcttgtctgtc

SEQ ID NO: 44620 - DNA, 25 bp, Homo sapien
tcacccggaagagcctggcgaaccg

SEQ ID NO: 44621 - DNA, 25 bp, Homo sapien
ccaggtccaagtctcggcgggacca

SEQ ID NO: 44622 - DNA, 25 bp, Homo sapien
ccaggtaaaaaacaggaacagcaca

SEQ ID NO: 44623 - DNA, 25 bp, Homo sapien
accagggattcacgggctgcaggac

SEQ ID NO: 44624 - DNA, 25 bp, Homo sapien
aacaggaacagcacatgcgcagaaa

SEQ ID NO: 44625 - DNA, 25 bp, Homo sapien
gccgccagcccttcctataggttgt

SEQ ID NO: 44626 - DNA, 25 bp, Homo sapien
cctataggttgtgggtgcacccgct

SEQ ID NO: 44627 - DNA, 25 bp, Homo sapien
tccagttcgcaccaggtccaagtct

SEQ ID NO: 44628 - DNA, 25 bp, Homo sapien
tccctcactgctctcggttcttaag

SEQ ID NO: 44629 - DNA, 25 bp, Homo sapien
aggcagggtcaactgagggcctctc

SEQ ID NO: 44630 - DNA, 25 bp, Homo sapien
cagtgtatgccaccttgggaaagga

SEQ ID NO: 44631 - DNA, 25 bp, Homo sapien
gatgaagcccaggacagtgtatgcc

SEQ ID NO: 44632 - DNA, 25 bp, Homo sapien
taggcctccaggagcaccgtggagc

SEQ ID NO: 44633 - DNA, 25 bp, Homo sapien
ccttggtgcctgtcgtgtcttcgct

SEQ ID NO: 44634 - DNA, 25 bp, Homo sapien
cggttcttaaggcatccagcctgta

SEQ ID NO: 44635 - DNA, 25 bp, Homo sapien
cagcctgtagtctatccatgccgga

SEQ ID NO: 44636 - DNA, 25 bp, Homo sapien
ggccacagttctccagcgacagttt

SEQ ID NO: 44637 - DNA, 25 bp, Homo sapien
ctctcgggtgttgttgaggatcttg

SEQ ID NO: 44638 - DNA, 25 bp, Homo sapien
tcaggaagacgatgagggacacgct

SEQ ID NO: 44639 - DNA, 25 bp, Homo sapien
gtccacgtcgttgccgatgccaatg

SEQ ID NO: 44640 - DNA, 25 bp, Homo sapien
tgaagatgcagacttggcctcgggc

SEQ ID NO: 44641 - DNA, 25 bp, Homo sapien
ccagcagcctgaagtccacgtcgtt

SEQ ID NO: 44642 - DNA, 25 bp, Homo sapien
cagcgacagtttctccagcagcctg

SEQ ID NO: 44643 - DNA, 25 bp, Homo sapien
ccgatgccaatggtgaagatgcaga

SEQ ID NO: 44644 - DNA, 25 bp, Homo sapien
gaagcctcgcctgctgttgtcccgg

SEQ ID NO: 44645 - DNA, 25 bp, Homo sapien
ggcaggccagaacgccgtccgaacg

SEQ ID NO: 44646 - DNA, 25 bp, Homo sapien
ggacaaccgagaggctcctccggga

SEQ ID NO: 44647 - DNA, 25 bp, Homo sapien
ctcctccgggagcatgcgatccgga

SEQ ID NO: 44648 - DNA, 25 bp, Homo sapien
tgcgatccggaaccctcactctaaa

SEQ ID NO: 44649 - DNA, 25 bp, Homo sapien
gccagcgcctcatcccgcctcgcgc

SEQ ID NO: 44650 - DNA, 25 bp, Homo sapien
agcctctcaccctgacgccttcggg

SEQ ID NO: 44651 - DNA, 25 bp, Homo sapien
gcgccgaagcctcgcctgctgttgt

SEQ ID NO: 44652 - DNA, 25 bp, Homo sapien
caccattggcaggtacatcagcacc

SEQ ID NO: 44653 - DNA, 25 bp, Homo sapien
ctcgcatggacgtcacggacaagta

SEQ ID NO: 44654 - DNA, 25 bp, Homo sapien
atgccctttatcttcgcggaggtta

SEQ ID NO: 44655 - DNA, 25 bp, Homo sapien
cagctgaacttcgacatgcccttta

SEQ ID NO: 44656 - DNA, 25 bp, Homo sapien
ccgcttcggtcattggtgttcgaga

SEQ ID NO: 44657 - DNA, 25 bp, Homo sapien
cgcggaggttaatgccgaccgcatc

SEQ ID NO: 44658 - DNA, 25 bp, Homo sapien
cgcatcacctggctgtacgacaaca

SEQ ID NO: 44659 - DNA, 25 bp, Homo sapien
ttccgtgaacagtcacaccattggc

SEQ ID NO: 44660 - DNA, 25 bp, Homo sapien
ctccacaccttcttggccgctgctg

SEQ ID NO: 44661 - DNA, 25 bp, Homo sapien
gacctcagcggtctcccaacttgga

SEQ ID NO: 44662 - DNA, 25 bp, Homo sapien
cgagcggcgtgaacagcagcaccag

SEQ ID NO: 44663 - DNA, 25 bp, Homo sapien
catcagcgcgatcgcctggcggtac

SEQ ID NO: 44664 - DNA, 25 bp, Homo sapien
tgtctacactgggacctcagcggtc

SEQ ID NO: 44665 - DNA, 25 bp, Homo sapien
tggagcctgtctacactgggacctc

SEQ ID NO: 44666 - DNA, 25 bp, Homo sapien
gggtctggtggagcctgtctacact

SEQ ID NO: 44667 - DNA, 25 bp, Homo sapien
gttaggagcgttcacagcggtccgc

SEQ ID NO: 44668 - DNA, 25 bp, Homo sapien
tccggcctgtaagtggttacgcctc

SEQ ID NO: 44669 - DNA, 25 bp, Homo sapien
caatcctgggacttcttcggctacc

SEQ ID NO: 44670 - DNA, 25 bp, Homo sapien
ggcaacgctcagtaagtggctcttc

SEQ ID NO: 44671 - DNA, 25 bp, Homo sapien
ttcggcgcctctcgagaaaaacgtc

SEQ ID NO: 44672 - DNA, 25 bp, Homo sapien
ggaaatcttcggtgactctcgcagc

SEQ ID NO: 44673 - DNA, 25 bp, Homo sapien
cggctatctccgtacacgttcggca

SEQ ID NO: 44674 - DNA, 25 bp, Homo sapien
aaatcctgggacttcttcggcaatc

SEQ ID NO: 44675 - DNA, 25 bp, Homo sapien
ctgtctctgaaaactgtcgcgatgc

SEQ ID NO: 44676 - DNA, 25 bp, Homo sapien
ccggaaagtttgtccggcggcagcg

SEQ ID NO: 44677 - DNA, 25 bp, Homo sapien
cgctcgccatgggtaagtcccgatc

SEQ ID NO: 44678 - DNA, 25 bp, Homo sapien
cctcacttgctgcagcgcccactcg

SEQ ID NO: 44679 - DNA, 25 bp, Homo sapien
gtaagtcccgatcgggcgctgcctg

SEQ ID NO: 44680 - DNA, 25 bp, Homo sapien
cggataccgcctctcgggtggccag

SEQ ID NO: 44681 - DNA, 25 bp, Homo sapien
ctcgggtggccagcccgagactgca

SEQ ID NO: 44682 - DNA, 25 bp, Homo sapien
gctcggtcgcgcttccttccatctt

SEQ ID NO: 44683 - DNA, 25 bp, Homo sapien
gccgagtcccgctcgccatgggtaa

SEQ ID NO: 44684 - DNA, 25 bp, Homo sapien
ggacagcaggcaccaaagtctcctc

SEQ ID NO: 44685 - DNA, 25 bp, Homo sapien
caccaaagtctcctccggggactgg

SEQ ID NO: 44686 - DNA, 25 bp, Homo sapien
gggcggacagcaggcaccaaagtct

SEQ ID NO: 44687 - DNA, 25 bp, Homo sapien
agcaggcaccaaagtctcctccggg

SEQ ID NO: 44688 - DNA, 25 bp, Homo sapien
ccgcgctcgcagatggcagctcggg

SEQ ID NO: 44689 - DNA, 25 bp, Homo sapien
ttcgcagcccccaggttggacaggg

SEQ ID NO: 44690 - DNA, 25 bp, Homo sapien
tcgcgggggccacaatcggcccagt

SEQ ID NO: 44691 - DNA, 25 bp, Homo sapien
caggcaccaaagtctcctccgggga

SEQ ID NO: 44692 - DNA, 25 bp, Homo sapien
acggcagagacagcaacgtgcccgc

SEQ ID NO: 44693 - DNA, 25 bp, Homo sapien
cagcggcaacggcagagacagcaac

SEQ ID NO: 44694 - DNA, 25 bp, Homo sapien
tctttctggcactcgccaagcgggg

SEQ ID NO: 44695 - DNA, 25 bp, Homo sapien
tctggaaaggctctcccaggctcgg

SEQ ID NO: 44696 - DNA, 25 bp, Homo sapien
cgctttggggcaacgaccctgaagt

SEQ ID NO: 44697 - DNA, 25 bp, Homo sapien
gcaacgaccctgaagtttgctctcc

SEQ ID NO: 44698 - DNA, 25 bp, Homo sapien
gtccttggcgttttgttcgattatg

SEQ ID NO: 44699 - DNA, 25 bp, Homo sapien
ttcgattatggtcccggcggttcgc

SEQ ID NO: 44700 - DNA, 25 bp, Homo sapien
tgcacggtcttgacgccaccaagtt

SEQ ID NO: 44701 - DNA, 25 bp, Homo sapien
tctccttcggtaaaagcggcctctg

SEQ ID NO: 44702 - DNA, 25 bp, Homo sapien
tggtggagttttacctacaactagc

SEQ ID NO: 44703 - DNA, 25 bp, Homo sapien
gaaagccaggaatgccgaaccaatt

SEQ ID NO: 44704 - DNA, 25 bp, Homo sapien
gaaccaattcgacgtgccaagcaca

SEQ ID NO: 44705 - DNA, 25 bp, Homo sapien
accgcgctggaggagtacattctca

SEQ ID NO: 44706 - DNA, 25 bp, Homo sapien
tcacctaacgctgaggccacttctg

SEQ ID NO: 44707 - DNA, 25 bp, Homo sapien
agcggcctctgctttttcactgggc

SEQ ID NO: 44708 - DNA, 25 bp, Homo sapien
agctcccagtcgatgctgggcgaaa

SEQ ID NO: 44709 - DNA, 25 bp, Homo sapien
cggttctccggatcccgagggagct

SEQ ID NO: 44710 - DNA, 25 bp, Homo sapien
gctgagcggcgagtttccgatttaa

SEQ ID NO: 44711 - DNA, 25 bp, Homo sapien
gtttccgatttaaagctgagctgcg

SEQ ID NO: 44712 - DNA, 25 bp, Homo sapien
taaagctgagctgcgaggaaaatgg

SEQ ID NO: 44713 - DNA, 25 bp, Homo sapien
agagccagcggcttcagatctgcca

SEQ ID NO: 44714 - DNA, 25 bp, Homo sapien
ggcttcagatctgccaaggcactga

SEQ ID NO: 44715 - DNA, 25 bp, Homo sapien
gcgtggcctcgggactacatatccc

SEQ ID NO: 44716 - DNA, 25 bp, Homo sapien
gagccagagccttgtgtgcacgtgt

SEQ ID NO: 44717 - DNA, 25 bp, Homo sapien
ttgaaacagatgtgggattcgccca

SEQ ID NO: 44718 - DNA, 25 bp, Homo sapien
cacttggctggaaacgacgtgaatc

SEQ ID NO: 44719 - DNA, 25 bp, Homo sapien
tcgtgataaattcaggagggccatc

SEQ ID NO: 44720 - DNA, 25 bp, Homo sapien
acgacgtgaatctgcctcttttccg

SEQ ID NO: 44721 - DNA, 25 bp, Homo sapien
gctagcgcttttacctccggcctgg

SEQ ID NO: 44722 - DNA, 25 bp, Homo sapien
gccctcggcggagagttgaaacaga

SEQ ID NO: 44723 - DNA, 25 bp, Homo sapien
agggccatcgatcaggtccacttgg

SEQ ID NO: 44724 - DNA, 25 bp, Homo sapien
gaaccgtgctctgcggtccgcacgg

SEQ ID NO: 44725 - DNA, 25 bp, Homo sapien
aaccgtgctctgcggtccgcacggg

SEQ ID NO: 44726 - DNA, 25 bp, Homo sapien
gtgctctgcggtccgcacggggaac

SEQ ID NO: 44727 - DNA, 25 bp, Homo sapien
gggaacctggggaaccgtgctctgc

SEQ ID NO: 44728 - DNA, 25 bp, Homo sapien
ggaaccgtgctctgcggtccgcacg

SEQ ID NO: 44729 - DNA, 25 bp, Homo sapien
gcaggaccacatggggaacccggga

SEQ ID NO: 44730 - DNA, 25 bp, Homo sapien
ttgcaggaccacatggggaacccgg

SEQ ID NO: 44731 - DNA, 25 bp, Homo sapien
tttgcaggaccacatggggaacccg

SEQ ID NO: 44732 - DNA, 25 bp, Homo sapien
gcgggtaccttaggatcctttctga

SEQ ID NO: 44733 - DNA, 25 bp, Homo sapien
gagagcctgtctttgataatgtacc

SEQ ID NO: 44734 - DNA, 25 bp, Homo sapien
cctttctgattgcagacgtggtcca

SEQ ID NO: 44735 - DNA, 25 bp, Homo sapien
cggccacgctgcaaccctgagaagt

SEQ ID NO: 44736 - DNA, 25 bp, Homo sapien
aatgtacctgcttcgtgccgataga

SEQ ID NO: 44737 - DNA, 25 bp, Homo sapien
cgacgcagcacctctggagagcctg

SEQ ID NO: 44738 - DNA, 25 bp, Homo sapien
acgtggtccagagccaaagcggctt

SEQ ID NO: 44739 - DNA, 25 bp, Homo sapien
gggagaccggattccacagcacaca

SEQ ID NO: 44740 - DNA, 25 bp, Homo sapien
gagctcctggactcagccttgaccg

SEQ ID NO: 44741 - DNA, 25 bp, Homo sapien
gagggtcacctcctgaattcaatcg

SEQ ID NO: 44742 - DNA, 25 bp, Homo sapien
ggctgtgacctgaccttcgagggtc

SEQ ID NO: 44743 - DNA, 25 bp, Homo sapien
tctgttcccacagcggccgctttgt

SEQ ID NO: 44744 - DNA, 25 bp, Homo sapien
gagggaaccgacgaacccatgtcca

SEQ ID NO: 44745 - DNA, 25 bp, Homo sapien
tgtccagggaatgctgaggacgctc

SEQ ID NO: 44746 - DNA, 25 bp, Homo sapien
ttgtggacacttagctcagcgcctg

SEQ ID NO: 44747 - DNA, 25 bp, Homo sapien
gccttgaccgacactgactctgttc

SEQ ID NO: 44748 - DNA, 25 bp, Homo sapien
cacgaagaagattgggagatgcatc

SEQ ID NO: 44749 - DNA, 25 bp, Homo sapien
agccgggagcgtgtatactcaaaca

SEQ ID NO: 44750 - DNA, 25 bp, Homo sapien
acatcacctggctgtggcacgagga

SEQ ID NO: 44751 - DNA, 25 bp, Homo sapien
ggtcaacgccgactacatcacctgg

SEQ ID NO: 44752 - DNA, 25 bp, Homo sapien
tttgcggaggtcaacgccgactaca

SEQ ID NO: 44753 - DNA, 25 bp, Homo sapien
atgtgcacctggctcacgatggccc

SEQ ID NO: 44754 - DNA, 25 bp, Homo sapien
ccatccgcgagggtgatgtgcacct

SEQ ID NO: 44755 - DNA, 25 bp, Homo sapien
ttgggagatgcatcagcaccaaggc

SEQ ID NO: 44756 - DNA, 25 bp, Homo sapien
tctcgaaggcttcgactcgggctga

SEQ ID NO: 44757 - DNA, 25 bp, Homo sapien
atggcacctgggtcctgtgcagatg

SEQ ID NO: 44758 - DNA, 25 bp, Homo sapien
tgggacccatggctctgacaaagtc

SEQ ID NO: 44759 - DNA, 25 bp, Homo sapien
ctgacaaagtcttggacaaacactg

SEQ ID NO: 44760 - DNA, 25 bp, Homo sapien
ggacaaacactgcttcccgatcctt

SEQ ID NO: 44761 - DNA, 25 bp, Homo sapien
ccgccctgagtttctgagagtcctg

SEQ ID NO: 44762 - DNA, 25 bp, Homo sapien
accgcggcccggaggacataagacg

SEQ ID NO: 44763 - DNA, 25 bp, Homo sapien
tgcctacagcatctgcggacgctca

SEQ ID NO: 44764 - DNA, 25 bp, Homo sapien
tgctccagccacttgcggctggcgt

SEQ ID NO: 44765 - DNA, 25 bp, Homo sapien
ggactggcagtgcagcaggacgccc

SEQ ID NO: 44766 - DNA, 25 bp, Homo sapien
cagctgcttggagaaggtgcacacg

SEQ ID NO: 44767 - DNA, 25 bp, Homo sapien
ttgtagcggtagcccagggccgcca

SEQ ID NO: 44768 - DNA, 25 bp, Homo sapien
ctcgtactcgccattgttgttgtag

SEQ ID NO: 44769 - DNA, 25 bp, Homo sapien
tctcctcgtactcgccattgttgtt

SEQ ID NO: 44770 - DNA, 25 bp, Homo sapien
agaagatcgcgtctctgcgcagctg

SEQ ID NO: 44771 - DNA, 25 bp, Homo sapien
ggcctggcagaagatcgcgtctctg

SEQ ID NO: 44772 - DNA, 25 bp, Homo sapien
cctgaattctaatcccggctccaga

SEQ ID NO: 44773 - DNA, 25 bp, Homo sapien
atcccggctccagacggcctgaatt

SEQ ID NO: 44774 - DNA, 25 bp, Homo sapien
taatcccggctccagacggcctgaa

SEQ ID NO: 44775 - DNA, 25 bp, Homo sapien
ccagacggcctgaattctaatcctg

SEQ ID NO: 44776 - DNA, 25 bp, Homo sapien
ctaatcctgactccagacggcctga

SEQ ID NO: 44777 - DNA, 25 bp, Homo sapien
ggcctgaattctaatcccgactcca

SEQ ID NO: 44778 - DNA, 25 bp, Homo sapien
gctccagacggcctgaattctaatc

SEQ ID NO: 44779 - DNA, 25 bp, Homo sapien
tccagacggcctgaattctaatccc

SEQ ID NO: 44780 - DNA, 25 bp, Homo sapien
aggtgcccacgtagtccctctcggt

SEQ ID NO: 44781 - DNA, 25 bp, Homo sapien
cgagcgacactcaccgactgcaaga

SEQ ID NO: 44782 - DNA, 25 bp, Homo sapien
gcaagaagcgcaaggtgcccacgta

SEQ ID NO: 44783 - DNA, 25 bp, Homo sapien
ctctcggtgcccaagatctcgttga

SEQ ID NO: 44784 - DNA, 25 bp, Homo sapien
gctgggcgcctccattctagcgcgg

SEQ ID NO: 44785 - DNA, 25 bp, Homo sapien
gccagggaccgtctgccaagtgcca

SEQ ID NO: 44786 - DNA, 25 bp, Homo sapien
cgaggcaattctccacccacgggga

SEQ ID NO: 44787 - DNA, 25 bp, Homo sapien
cccaagatctcgttgaggacgcaga

SEQ ID NO: 44788 - DNA, 25 bp, Homo sapien
gctggcctcagcacgtcggccgttg

SEQ ID NO: 44789 - DNA, 25 bp, Homo sapien
cacgtggtcacgtgacgcgctccaa

SEQ ID NO: 44790 - DNA, 25 bp, Homo sapien
tcacgtgacgcgctccaacatggcg

SEQ ID NO: 44791 - DNA, 25 bp, Homo sapien
gttgccctatcctactcggccttgg

SEQ ID NO: 44792 - DNA, 25 bp, Homo sapien
gccatgcaggagagccagaccaaga

SEQ ID NO: 44793 - DNA, 25 bp, Homo sapien
tcctagccgacaaggaggtgaagcg

SEQ ID NO: 44794 - DNA, 25 bp, Homo sapien
tggagaagatcctagccgacaagga

SEQ ID NO: 44795 - DNA, 25 bp, Homo sapien
accaagagcatgttcgtgtcccggg

SEQ ID NO: 44796 - DNA, 25 bp, Homo sapien
ggtcgcgctcgcatgtccattctct

SEQ ID NO: 44797 - DNA, 25 bp, Homo sapien
aggccgctccttattggtcgcgctc

SEQ ID NO: 44798 - DNA, 25 bp, Homo sapien
ggcatcctaggtctctggcccaggt

SEQ ID NO: 44799 - DNA, 25 bp, Homo sapien
ctcccggtactaacgagcgctaggg

SEQ ID NO: 44800 - DNA, 25 bp, Homo sapien
tgcacggcctaccagagtggctctt

SEQ ID NO: 44801 - DNA, 25 bp, Homo sapien
ctcaggctcgctgtcgcgccatttt

SEQ ID NO: 44802 - DNA, 25 bp, Homo sapien
ccgattggcccttcgaacttgggtg

SEQ ID NO: 44803 - DNA, 25 bp, Homo sapien
tccattctctgcgacggtggctgct

SEQ ID NO: 44804 - DNA, 25 bp, Homo sapien
cagccgccggcgcaaacgctgaaga

SEQ ID NO: 44805 - DNA, 25 bp, Homo sapien
gagtttcgcgctgcctgctggactc

SEQ ID NO: 44806 - DNA, 25 bp, Homo sapien
ttctggtgggagtttcgcgctgcct

SEQ ID NO: 44807 - DNA, 25 bp, Homo sapien
cgcaaacgctgaagagccgctcagg

SEQ ID NO: 44808 - DNA, 25 bp, Homo sapien
cgagggaacgcaagaggacccgcct

SEQ ID NO: 44809 - DNA, 25 bp, Homo sapien
agcacctgtttgtggcaccggtgag

SEQ ID NO: 44810 - DNA, 25 bp, Homo sapien
aaaggcggccgcagcacctgtttgt

SEQ ID NO: 44811 - DNA, 25 bp, Homo sapien
cggtccgaaccacaagttccggctg

SEQ ID NO: 44812 - DNA, 25 bp, Homo sapien
ttaatcggaaccataggcgaggatg

SEQ ID NO: 44813 - DNA, 25 bp, Homo sapien
ccgcaggctgtgctcgcttccggaa

SEQ ID NO: 44814 - DNA, 25 bp, Homo sapien
tgacgcatggtacttgcgcaaagac

SEQ ID NO: 44815 - DNA, 25 bp, Homo sapien
tccggaagtggcttctgcgacaaca

SEQ ID NO: 44816 - DNA, 25 bp, Homo sapien
ttgccgcatgcgcactcttaagagg

SEQ ID NO: 44817 - DNA, 25 bp, Homo sapien
cccttgatggcgtcacacgaaacca

SEQ ID NO: 44818 - DNA, 25 bp, Homo sapien
gcggacctcggcttaatcggaacca

SEQ ID NO: 44819 - DNA, 25 bp, Homo sapien
tgcgacaacatgcttgcggacctcg

SEQ ID NO: 44820 - DNA, 25 bp, Homo sapien
ggctcactttcctcggggcgcctaa

SEQ ID NO: 44821 - DNA, 25 bp, Homo sapien
gcagcggtttccctctcggcttgcg

SEQ ID NO: 44822 - DNA, 25 bp, Homo sapien
ttactggcggctgcctaccagcggc

SEQ ID NO: 44823 - DNA, 25 bp, Homo sapien
aagcactcagtttactggcggctgc

SEQ ID NO: 44824 - DNA, 25 bp, Homo sapien
agatcgcccgcaagcactcagttta

SEQ ID NO: 44825 - DNA, 25 bp, Homo sapien
tagaaagtatagacgcgacgcgctc

SEQ ID NO: 44826 - DNA, 25 bp, Homo sapien
acacgccgggcagatagaaagtata

SEQ ID NO: 44827 - DNA, 25 bp, Homo sapien
tgccgcattctgtgggcacacgccg

SEQ ID NO: 44828 - DNA, 25 bp, Homo sapien
ggctgtgctgctcgagactacattt

SEQ ID NO: 44829 - DNA, 25 bp, Homo sapien
agccattcgttctttcgcgtctgcg

SEQ ID NO: 44830 - DNA, 25 bp, Homo sapien
aaagagagcgtttcgggtccagtgc

SEQ ID NO: 44831 - DNA, 25 bp, Homo sapien
acaactactagagcgcctcgggctg

SEQ ID NO: 44832 - DNA, 25 bp, Homo sapien
agacgcggcctggacaactactaga

SEQ ID NO: 44833 - DNA, 25 bp, Homo sapien
ggccaaagaggtgacaaggctctga

SEQ ID NO: 44834 - DNA, 25 bp, Homo sapien
ttatataagggaggttcaggaagcc

SEQ ID NO: 44835 - DNA, 25 bp, Homo sapien
gtgcgcaggtgcgaaagccatcttt

SEQ ID NO: 44836 - DNA, 25 bp, Homo sapien
ctgctgcgcagactatacgcgggtc

SEQ ID NO: 44837 - DNA, 25 bp, Homo sapien
ctgctcacaggacttgaagggcggc

SEQ ID NO: 44838 - DNA, 25 bp, Homo sapien
agccgagaaagacgcgcaggttatg

SEQ ID NO: 44839 - DNA, 25 bp, Homo sapien
gggacgcagacactcaggacctaaa

SEQ ID NO: 44840 - DNA, 25 bp, Homo sapien
ggtacctagcttgagcccgaccatg

SEQ ID NO: 44841 - DNA, 25 bp, Homo sapien
tggccgtgacccgatgtttgtcgcc

SEQ ID NO: 44842 - DNA, 25 bp, Homo sapien
gacctaaaggggaagcactggctgt

SEQ ID NO: 44843 - DNA, 25 bp, Homo sapien
aaggcaaggcactagcggaacgctc

SEQ ID NO: 44844 - DNA, 25 bp, Homo sapien
tagccgaaccgccaaggtcctggtc

SEQ ID NO: 44845 - DNA, 25 bp, Homo sapien
actgggcgttaacatccggctttga

SEQ ID NO: 44846 - DNA, 25 bp, Homo sapien
cggtccagctcactagccctggagt

SEQ ID NO: 44847 - DNA, 25 bp, Homo sapien
tagaaacctacttccggtccagctc

SEQ ID NO: 44848 - DNA, 25 bp, Homo sapien
gcaccacgtaaaatgcggtcgggta

SEQ ID NO: 44849 - DNA, 25 bp, Homo sapien
gctaccggaaatgcagcaccacgta

SEQ ID NO: 44850 - DNA, 25 bp, Homo sapien
atggctctgatacccgccggattcg

SEQ ID NO: 44851 - DNA, 25 bp, Homo sapien
ctccttaccatggtggcggttctga

SEQ ID NO: 44852 - DNA, 25 bp, Homo sapien
cttggctgaagctgagcgcgcacat

SEQ ID NO: 44853 - DNA, 25 bp, Homo sapien
gagcacgccttgctgcgcacgatct

SEQ ID NO: 44854 - DNA, 25 bp, Homo sapien
cacgcttgagctcctcgttcatctg

SEQ ID NO: 44855 - DNA, 25 bp, Homo sapien
cgttcatctgctctttcttctggtg

SEQ ID NO: 44856 - DNA, 25 bp, Homo sapien
cccagtagtcgagctcttggctgaa

SEQ ID NO: 44857 - DNA, 25 bp, Homo sapien
ctccatcatgtgcagtcgcccagtg

SEQ ID NO: 44858 - DNA, 25 bp, Homo sapien
gtcgaggctgtagtcatcgcacacc

SEQ ID NO: 44859 - DNA, 25 bp, Homo sapien
actccaggtagatctcgtcgatgcc

SEQ ID NO: 44860 - DNA, 25 bp, Homo sapien
gcaccaaggcaggacggcgccacct

SEQ ID NO: 44861 - DNA, 25 bp, Homo sapien
cgagatcaacaagtcggggctgagc

SEQ ID NO: 44862 - DNA, 25 bp, Homo sapien
aacaagtcggggctgagcttcggct

SEQ ID NO: 44863 - DNA, 25 bp, Homo sapien
tattctgtcccgcacttcggagcgc

SEQ ID NO: 44864 - DNA, 25 bp, Homo sapien
cgccacctgcgggtcggaagcgagc

SEQ ID NO: 44865 - DNA, 25 bp, Homo sapien
aagcgagcgcggcttaactcctgcc

SEQ ID NO: 44866 - DNA, 25 bp, Homo sapien
gtggccgtgcatccctctccaccca

SEQ ID NO: 44867 - DNA, 25 bp, Homo sapien
gctgctattctgtcccgcacttcgg

SEQ ID NO: 44868 - DNA, 25 bp, Homo sapien
acttgtcgcggtgggcgattcgccc

SEQ ID NO: 44869 - DNA, 25 bp, Homo sapien
tctcgccttgcccgggatactggag

SEQ ID NO: 44870 - DNA, 25 bp, Homo sapien
cgggctccgagacccttgggctgca

SEQ ID NO: 44871 - DNA, 25 bp, Homo sapien
taagggccagactcggacttgtcgc

SEQ ID NO: 44872 - DNA, 25 bp, Homo sapien
ctgccgtcgcgctaagggccagact

SEQ ID NO: 44873 - DNA, 25 bp, Homo sapien
tcccacctccgagggtctcgccttg

SEQ ID NO: 44874 - DNA, 25 bp, Homo sapien
taggtccctgccgtcgcgctaaggg

SEQ ID NO: 44875 - DNA, 25 bp, Homo sapien
ttcccaccttgcaccttcttggcag

SEQ ID NO: 44876 - DNA, 25 bp, Homo sapien
cacagcagcccgcatggagtaatcg

SEQ ID NO: 44877 - DNA, 25 bp, Homo sapien
ctccggagtcttcggaggaccaggc

SEQ ID NO: 44878 - DNA, 25 bp, Homo sapien
agtgccgccgggcaccgtcgcaaaa

SEQ ID NO: 44879 - DNA, 25 bp, Homo sapien
ccgcatggagtaatcgccaaatggc

SEQ ID NO: 44880 - DNA, 25 bp, Homo sapien
cgcccaggctttcggggaatgtctc

SEQ ID NO: 44881 - DNA, 25 bp, Homo sapien
gaatgtctcccaagtgctccgcgct

SEQ ID NO: 44882 - DNA, 25 bp, Homo sapien
ccgggcgccacatagacgaagtaca

SEQ ID NO: 44883 - DNA, 25 bp, Homo sapien
acgaagtacagcagcgaggacgaga

SEQ ID NO: 44884 - DNA, 25 bp, Homo sapien
cccgggagagactaagaagcaatcc

SEQ ID NO: 44885 - DNA, 25 bp, Homo sapien
ctggttggccaggactgaccaagcc

SEQ ID NO: 44886 - DNA, 25 bp, Homo sapien
atctctcggtcccaggtggtcatgt

SEQ ID NO: 44887 - DNA, 25 bp, Homo sapien
tgaccaagccggtgcctacgaggag

SEQ ID NO: 44888 - DNA, 25 bp, Homo sapien
cggagcttcttttgctggttggcca

SEQ ID NO: 44889 - DNA, 25 bp, Homo sapien
tccgaactcggtggtcctggaagct

SEQ ID NO: 44890 - DNA, 25 bp, Homo sapien
agccggaagcaaaagcgggtcctgc

SEQ ID NO: 44891 - DNA, 25 bp, Homo sapien
caggccggacaagcgtcccgaaagc

SEQ ID NO: 44892 - DNA, 25 bp, Homo sapien
gccctgggttcagagtctgtgtaca

SEQ ID NO: 44893 - DNA, 25 bp, Homo sapien
ggcatcgtttctgagcagccacaca

SEQ ID NO: 44894 - DNA, 25 bp, Homo sapien
gccactcgtgacatggaggccgtca

SEQ ID NO: 44895 - DNA, 25 bp, Homo sapien
ggcatccactgacctcgagggcttg

SEQ ID NO: 44896 - DNA, 25 bp, Homo sapien
tccggctctcccagtagctgtcata

SEQ ID NO: 44897 - DNA, 25 bp, Homo sapien
ggctccttccgaagactcaatgagg

SEQ ID NO: 44898 - DNA, 25 bp, Homo sapien
gtacagatccacgtcatcctgagtg

SEQ ID NO: 44899 - DNA, 25 bp, Homo sapien
gccgcagagcatcctgccgacggta

SEQ ID NO: 44900 - DNA, 25 bp, Homo sapien
ttggagcctaacgagccatcgctgc

SEQ ID NO: 44901 - DNA, 25 bp, Homo sapien
gcggtaactgcctcgtggcgaaatc

SEQ ID NO: 44902 - DNA, 25 bp, Homo sapien
cttctgtttggccagtcgccgaaga

SEQ ID NO: 44903 - DNA, 25 bp, Homo sapien
cactcggcccggaaatgatgtcacc

SEQ ID NO: 44904 - DNA, 25 bp, Homo sapien
aatgatgtcaccatgaggcgggccc

SEQ ID NO: 44905 - DNA, 25 bp, Homo sapien
acggagactacaacccagaggcgga

SEQ ID NO: 44906 - DNA, 25 bp, Homo sapien
catcgctgcgtctgagactgggacc

SEQ ID NO: 44907 - DNA, 25 bp, Homo sapien
ggcggaaccgcactttggagcctaa

SEQ ID NO: 44908 - DNA, 25 bp, Homo sapien
aggcgccctcatttacttgcttccg

SEQ ID NO: 44909 - DNA, 25 bp, Homo sapien
ggccatccgcgtctatacttctcag

SEQ ID NO: 44910 - DNA, 25 bp, Homo sapien
tctcagtgtccctgtcgtgcgtttt

SEQ ID NO: 44911 - DNA, 25 bp, Homo sapien
ccctttacgcagcaattccaatgaa

SEQ ID NO: 44912 - DNA, 25 bp, Homo sapien
tacagattttgattggaacagaccc

SEQ ID NO: 44913 - DNA, 25 bp, Homo sapien
gaccctaagactaagagcctggaaa

SEQ ID NO: 44914 - DNA, 25 bp, Homo sapien
tgtcttcgcgactctctaacccggt

SEQ ID NO: 44915 - DNA, 25 bp, Homo sapien
taacccggtcgtatcgcgagggatc

SEQ ID NO: 44916 - DNA, 25 bp, Homo sapien
ttggagagccgacgtttcctttcta

SEQ ID NO: 44917 - DNA, 25 bp, Homo sapien
ggatttggcttccacgttttccaga

SEQ ID NO: 44918 - DNA, 25 bp, Homo sapien
cggcctctagctcgcttgcgtcaga

SEQ ID NO: 44919 - DNA, 25 bp, Homo sapien
tctgttgagcgcctgcgatgttcca

SEQ ID NO: 44920 - DNA, 25 bp, Homo sapien
gtcagtctccttcccacacgtgata

SEQ ID NO: 44921 - DNA, 25 bp, Homo sapien
acgtgatagtggactcgtgccctgc

SEQ ID NO: 44922 - DNA, 25 bp, Homo sapien
tcctttctagtccacgtcgctctta

SEQ ID NO: 44923 - DNA, 25 bp, Homo sapien
cgtgtctagctgtggcgagttattc

SEQ ID NO: 44924 - DNA, 25 bp, Homo sapien
gcacggcctagcgagtggttcttct

SEQ ID NO: 44925 - DNA, 25 bp, Homo sapien
cgtggcatttcaagccgccgagagc

SEQ ID NO: 44926 - DNA, 25 bp, Homo sapien
gagccacgtgcggtgtccctttcct

SEQ ID NO: 44927 - DNA, 25 bp, Homo sapien
atgtgcgtttccctcgtcaatgcca

SEQ ID NO: 44928 - DNA, 25 bp, Homo sapien
ggggcgtcagaagcgctcagaccac

SEQ ID NO: 44929 - DNA, 25 bp, Homo sapien
tgctgcattcattgcgccgcggcac

SEQ ID NO: 44930 - DNA, 25 bp, Homo sapien
agtggttcttctgcgctactgctgc

SEQ ID NO: 44931 - DNA, 25 bp, Homo sapien
cttcggcggagacgagcctccgatt

SEQ ID NO: 44932 - DNA, 25 bp, Homo sapien
cgggagcaaccagcgacaccggtca

SEQ ID NO: 44933 - DNA, 25 bp, Homo sapien
caccggtcacttacggatgctgtta

SEQ ID NO: 44934 - DNA, 25 bp, Homo sapien
caggactaaattgcggcctggggcc

SEQ ID NO: 44935 - DNA, 25 bp, Homo sapien
tcgttgacctcctccgctgaatagg

SEQ ID NO: 44936 - DNA, 25 bp, Homo sapien
caggctaaccctgcgtggaaaattc

SEQ ID NO: 44937 - DNA, 25 bp, Homo sapien
gaatgcagcacacggccgcctttat

SEQ ID NO: 44938 - DNA, 25 bp, Homo sapien
cccggcgagacgaatgcagcacacg

SEQ ID NO: 44939 - DNA, 25 bp, Homo sapien
acggatgctgttaacacgatggtcc

SEQ ID NO: 44940 - DNA, 25 bp, Homo sapien
caggcattagagttctaggtcactc

SEQ ID NO: 44941 - DNA, 25 bp, Homo sapien
ttcgaaaactggttgacccagaata

SEQ ID NO: 44942 - DNA, 25 bp, Homo sapien
ggttgacccagaataatcccgcctg

SEQ ID NO: 44943 - DNA, 25 bp, Homo sapien
gaataatcccgcctggttcaagaca

SEQ ID NO: 44944 - DNA, 25 bp, Homo sapien
cccgcctggttcaagacaggcatta

SEQ ID NO: 44945 - DNA, 25 bp, Homo sapien
tggttcaagacaggcattagagttc

SEQ ID NO: 44946 - DNA, 25 bp, Homo sapien
tcaagacaggcattagagttctagg

SEQ ID NO: 44947 - DNA, 25 bp, Homo sapien
cgtattcgaaaactggttgacccag

SEQ ID NO: 44948 - DNA, 25 bp, Homo sapien
cttaagagtcgccagccccggtatc

SEQ ID NO: 44949 - DNA, 25 bp, Homo sapien
cgcacgcacatacgccgccgctgac

SEQ ID NO: 44950 - DNA, 25 bp, Homo sapien
gtcgctcttgcttgaaggccggccc

SEQ ID NO: 44951 - DNA, 25 bp, Homo sapien
tcttgcgtcgctcttgcttgaaggc

SEQ ID NO: 44952 - DNA, 25 bp, Homo sapien
ccggtatcctcaggagtgcctcgga

SEQ ID NO: 44953 - DNA, 25 bp, Homo sapien
gggacctctagatcgccccttaaga

SEQ ID NO: 44954 - DNA, 25 bp, Homo sapien
ctcctctaggggacctctagatcgc

SEQ ID NO: 44955 - DNA, 25 bp, Homo sapien
tgccatcttgcgtcgctcttgcttg

SEQ ID NO: 44956 - DNA, 25 bp, Homo sapien
ttacctggcgagtagagcgcagcca

SEQ ID NO: 44957 - DNA, 25 bp, Homo sapien
ggtgctctgtacgatgctccctagc

SEQ ID NO: 44958 - DNA, 25 bp, Homo sapien
gcccactgtgtgcaaggaacgcgag

SEQ ID NO: 44959 - DNA, 25 bp, Homo sapien
ggcatttcttgagccggcagcgtta

SEQ ID NO: 44960 - DNA, 25 bp, Homo sapien
ggcttcggttcacgggcccatgcaa

SEQ ID NO: 44961 - DNA, 25 bp, Homo sapien
caggccaatcggacgtcgctgagcc

SEQ ID NO: 44962 - DNA, 25 bp, Homo sapien
ccaggaagcatttggcgggtgctct

SEQ ID NO: 44963 - DNA, 25 bp, Homo sapien
gcccagaggtcttacctggcgagta

SEQ ID NO: 44964 - DNA, 25 bp, Homo sapien
agaactgcaagaagccggccgagta

SEQ ID NO: 44965 - DNA, 25 bp, Homo sapien
ttacctcggctaccaggcggtgccg

SEQ ID NO: 44966 - DNA, 25 bp, Homo sapien
aatccatggaagtggccaacttcta

SEQ ID NO: 44967 - DNA, 25 bp, Homo sapien
cgccgcctgcctttaaatccatgga

SEQ ID NO: 44968 - DNA, 25 bp, Homo sapien
cgcgttcatgcaacgcctggtggcc

SEQ ID NO: 44969 - DNA, 25 bp, Homo sapien
ccttataaataaccgggctcaggag

SEQ ID NO: 44970 - DNA, 25 bp, Homo sapien
cttctactacgaggcggactgcttg

SEQ ID NO: 44971 - DNA, 25 bp, Homo sapien
aactttagcgagtcagagccgcgca

SEQ ID NO: 44972 - DNA, 25 bp, Homo sapien
attgtttgccaggacaccttcccgc

SEQ ID NO: 44973 - DNA, 25 bp, Homo sapien
cacgtgcaggcatgcccgccaggag

SEQ ID NO: 44974 - DNA, 25 bp, Homo sapien
cccgcggtgtgtgccaggctgacaa

SEQ ID NO: 44975 - DNA, 25 bp, Homo sapien
tgtgtgccaggctgacaatggctcc

SEQ ID NO: 44976 - DNA, 25 bp, Homo sapien
gggaggtattgtttgccaggacacc

SEQ ID NO: 44977 - DNA, 25 bp, Homo sapien
ctgcaggcggtccttgtcctaggac

SEQ ID NO: 44978 - DNA, 25 bp, Homo sapien
tccttgtcctaggacgcttggcacg

SEQ ID NO: 44979 - DNA, 25 bp, Homo sapien
ggctccttgtgtctgtgccgacggt

SEQ ID NO: 44980 - DNA, 25 bp, Homo sapien
gccggtctgtgctctcaacgcgaat

SEQ ID NO: 44981 - DNA, 25 bp, Homo sapien
ttccggctgccggttgacatgaaga

SEQ ID NO: 44982 - DNA, 25 bp, Homo sapien
cctggcccgtcatggagatggaaaa

SEQ ID NO: 44983 - DNA, 25 bp, Homo sapien
cccgcggaagtgcttgtcgaaattc

SEQ ID NO: 44984 - DNA, 25 bp, Homo sapien
gcccttcgcttaggccgcttgaaca

SEQ ID NO: 44985 - DNA, 25 bp, Homo sapien
ctcgatcgctgattggtccttctgc

SEQ ID NO: 44986 - DNA, 25 bp, Homo sapien
gctcctactgcttgaggattcgatg

SEQ ID NO: 44987 - DNA, 25 bp, Homo sapien
tctccagctcgggtgatctctcaag

SEQ ID NO: 44988 - DNA, 25 bp, Homo sapien
tccctcgtagcgcaggaccaatcgt

SEQ ID NO: 44989 - DNA, 25 bp, Homo sapien
ggctcggcgttcagcatgaaccgca

SEQ ID NO: 44990 - DNA, 25 bp, Homo sapien
gaacgcgagggattgcggcatcttc

SEQ ID NO: 44991 - DNA, 25 bp, Homo sapien
caggtgcgcgctttctattgggtgt

SEQ ID NO: 44992 - DNA, 25 bp, Homo sapien
acgcaccgcgcgaggcgtgtatcga

SEQ ID NO: 44993 - DNA, 25 bp, Homo sapien
cgtagcgcaggaccaatcgtgcggt

SEQ ID NO: 44994 - DNA, 25 bp, Homo sapien
agccgagcccttcttcaggtgcgct

SEQ ID NO: 44995 - DNA, 25 bp, Homo sapien
ttttgaggaggcagcccgcccacgc

SEQ ID NO: 44996 - DNA, 25 bp, Homo sapien
cctgtacgggtaagacgctccgcta

SEQ ID NO: 44997 - DNA, 25 bp, Homo sapien
aggagacctgcgattactttgagaa

SEQ ID NO: 44998 - DNA, 25 bp, Homo sapien
aggcggcgctacaagactttcatga

SEQ ID NO: 44999 - DNA, 25 bp, Homo sapien
aagggattcttttcctgcgcctcag

SEQ ID NO: 45000 - DNA, 25 bp, Homo sapien
cagctgcgttgtcccaaaaaggctc

SEQ ID NO: 45001 - DNA, 25 bp, Homo sapien
ctgcaggaagctcgcgctgattgac

SEQ ID NO: 45002 - DNA, 25 bp, Homo sapien
taaggtgctcatggggaacactgcc

SEQ ID NO: 45003 - DNA, 25 bp, Homo sapien
gttcggtagctttcacgtccgtgta

SEQ ID NO: 45004 - DNA, 25 bp, Homo sapien
ggagcatcctctcgctcccggagtg

SEQ ID NO: 45005 - DNA, 25 bp, Homo sapien
cgcgagctcgcgctcttcctgaccc

SEQ ID NO: 45006 - DNA, 25 bp, Homo sapien
ggagcgaaaacaccacgcctctgtc

SEQ ID NO: 45007 - DNA, 25 bp, Homo sapien
cagagatgtgcagcgggtcgtccct

SEQ ID NO: 45008 - DNA, 25 bp, Homo sapien
gtgcagcgggtcgtccctgctcgct

SEQ ID NO: 45009 - DNA, 25 bp, Homo sapien
tgctcgtggacgctgatcagccgga

SEQ ID NO: 45010 - DNA, 25 bp, Homo sapien
gctgcagctcggagcgaaaacacca

SEQ ID NO: 45011 - DNA, 25 bp, Homo sapien
ggacgctgatcagccggagcccatg

SEQ ID NO: 45012 - DNA, 25 bp, Homo sapien
ttctcttgcgtctctgtcttcttca

SEQ ID NO: 45013 - DNA, 25 bp, Homo sapien
tcttgcgtctctgtcttcttcagtt

SEQ ID NO: 45014 - DNA, 25 bp, Homo sapien
tggatttttctcttgcgtctctgtc

SEQ ID NO: 45015 - DNA, 25 bp, Homo sapien
aggcagtggatttttctcttgcgtc

SEQ ID NO: 45016 - DNA, 25 bp, Homo sapien
tttggaaggcagtggatttttctct

SEQ ID NO: 45017 - DNA, 25 bp, Homo sapien
gcctgcttgcttctcctgttcaatc

SEQ ID NO: 45018 - DNA, 25 bp, Homo sapien
acgattcgcctgcttgcttctcctg

SEQ ID NO: 45019 - DNA, 25 bp, Homo sapien
cgcctcattacgattcgcctgcttg

SEQ ID NO: 45020 - DNA, 25 bp, Homo sapien
ggcgatgcgaacaacaatgcgcccg

SEQ ID NO: 45021 - DNA, 25 bp, Homo sapien
ggcggcgatgcgaacaacaatgcgc

SEQ ID NO: 45022 - DNA, 25 bp, Homo sapien
gcgcctggacctccggagcagagtc

SEQ ID NO: 45023 - DNA, 25 bp, Homo sapien
ggcttaccttgactcggcctcgagg

SEQ ID NO: 45024 - DNA, 25 bp, Homo sapien
ccggggtgtgcaaaggagcgtgtgt

SEQ ID NO: 45025 - DNA, 25 bp, Homo sapien
cgggcttaccttgactcggcctcga

SEQ ID NO: 45026 - DNA, 25 bp, Homo sapien
cttaccttgactcggcctcgaggcg

SEQ ID NO: 45027 - DNA, 25 bp, Homo sapien
agcagagtcgggtagcggtccgtgc

SEQ ID NO: 45028 - DNA, 25 bp, Homo sapien
gggcggctccacgtgctcagatgcc

SEQ ID NO: 45029 - DNA, 25 bp, Homo sapien
agatgcccgcgcttccacggctgag

SEQ ID NO: 45030 - DNA, 25 bp, Homo sapien
cagctgggcctggactacatctggc

SEQ ID NO: 45031 - DNA, 25 bp, Homo sapien
gcccagcactcagtcaggtggccgt

SEQ ID NO: 45032 - DNA, 25 bp, Homo sapien
cgcggataatggccgcagtgcgctc

SEQ ID NO: 45033 - DNA, 25 bp, Homo sapien
gacccactaggaggcgccgcggata

SEQ ID NO: 45034 - DNA, 25 bp, Homo sapien
cggatttgccattgacccactagga

SEQ ID NO: 45035 - DNA, 25 bp, Homo sapien
gagaaccaggcggatttgccattga

SEQ ID NO: 45036 - DNA, 25 bp, Homo sapien
ctgaggctccatagcacgcgaacta

SEQ ID NO: 45037 - DNA, 25 bp, Homo sapien
gaagtcatttccgattggcgaatct

SEQ ID NO: 45038 - DNA, 25 bp, Homo sapien
ctggggtcaacgagagaagtcattt

SEQ ID NO: 45039 - DNA, 25 bp, Homo sapien
ttggcgaatctagcgggagcaatgc

SEQ ID NO: 45040 - DNA, 25 bp, Homo sapien
gagtttactgcaccggaccacctga

SEQ ID NO: 45041 - DNA, 25 bp, Homo sapien
cgcgaactaccttgcgtgagcacta

SEQ ID NO: 45042 - DNA, 25 bp, Homo sapien
gtgagcactatgtagattcgacttc

SEQ ID NO: 45043 - DNA, 25 bp, Homo sapien
agcaatgcgctgtctgtcaggcgtg

SEQ ID NO: 45044 - DNA, 25 bp, Homo sapien
aacttccggaagaggtcgccatggc

SEQ ID NO: 45045 - DNA, 25 bp, Homo sapien
ggaggtactcgccttacaagctgaa

SEQ ID NO: 45046 - DNA, 25 bp, Homo sapien
gccgcctcaattcggcagtggaatg

SEQ ID NO: 45047 - DNA, 25 bp, Homo sapien
cagtggaatgcgtgccgtacactca

SEQ ID NO: 45048 - DNA, 25 bp, Homo sapien
ttcgagggccaaatcacagtctacc

SEQ ID NO: 45049 - DNA, 25 bp, Homo sapien
ttagtttatcccagtcgctaggaga

SEQ ID NO: 45050 - DNA, 25 bp, Homo sapien
tctagggccattgcgtggttcaatt

SEQ ID NO: 45051 - DNA, 25 bp, Homo sapien
tgccggaagcggaattacgtaatgt

SEQ ID NO: 45052 - DNA, 25 bp, Homo sapien
ccaggcgtctgcagtggatggcaat

SEQ ID NO: 45053 - DNA, 25 bp, Homo sapien
tggcaatggcttcgggccacagatg

SEQ ID NO: 45054 - DNA, 25 bp, Homo sapien
gactgcactcggaagcggcctgtcc

SEQ ID NO: 45055 - DNA, 25 bp, Homo sapien
ttggttttgatgaggaactgcgccc

SEQ ID NO: 45056 - DNA, 25 bp, Homo sapien
acgctcagctgcgacttggttttga

SEQ ID NO: 45057 - DNA, 25 bp, Homo sapien
ggaggcacttccgaacaagatgtca

SEQ ID NO: 45058 - DNA, 25 bp, Homo sapien
tattgtctctggtgtccgaggaggc

SEQ ID NO: 45059 - DNA, 25 bp, Homo sapien
gtcctccgcgctcagttattgtctc

SEQ ID NO: 45060 - DNA, 25 bp, Homo sapien
acgcacaccgactccacgatgaaga

SEQ ID NO: 45061 - DNA, 25 bp, Homo sapien
cagggagaaccagcccacgcacacc

SEQ ID NO: 45062 - DNA, 25 bp, Homo sapien
ttgctgggcgcctgaatgagccgca

SEQ ID NO: 45063 - DNA, 25 bp, Homo sapien
gatggccaccaggtcgatcagcgtc

SEQ ID NO: 45064 - DNA, 25 bp, Homo sapien
ggctccgcaggaaggcgaacttgct

SEQ ID NO: 45065 - DNA, 25 bp, Homo sapien
tcgatcagcgtcagcgggctccgca

SEQ ID NO: 45066 - DNA, 25 bp, Homo sapien
ccagcagcgtgatgtagtagggcag

SEQ ID NO: 45067 - DNA, 25 bp, Homo sapien
aaggcgaacttgctgggcgcctgaa

SEQ ID NO: 45068 - DNA, 25 bp, Homo sapien
aaggtcaggatagtgccgaaggccc

SEQ ID NO: 45069 - DNA, 25 bp, Homo sapien
ctcgttgcaggtgacgtcgtagtca

SEQ ID NO: 45070 - DNA, 25 bp, Homo sapien
tcgtagtcatcgcacacgttgagga

SEQ ID NO: 45071 - DNA, 25 bp, Homo sapien
cagcgagtacttgatgccgcctacg

SEQ ID NO: 45072 - DNA, 25 bp, Homo sapien
gccgcctacgttgatgatgatccga

SEQ ID NO: 45073 - DNA, 25 bp, Homo sapien
tagaacgcgcccttgatggcctggc

SEQ ID NO: 45074 - DNA, 25 bp, Homo sapien
ctcaatcttctgcaggtagcggcgc

SEQ ID NO: 45075 - DNA, 25 bp, Homo sapien
gcaggcgaacaccttgccaggcagc

SEQ ID NO: 45076 - DNA, 25 bp, Homo sapien
gcctgcacgcgacagccttcaaggt

SEQ ID NO: 45077 - DNA, 25 bp, Homo sapien
tgggatgaaccgaagccggacccgc

SEQ ID NO: 45078 - DNA, 25 bp, Homo sapien
ttggccgtaacaagcgcgctccacg

SEQ ID NO: 45079 - DNA, 25 bp, Homo sapien
tccggttcgcgctttggtggcgccc

SEQ ID NO: 45080 - DNA, 25 bp, Homo sapien
gcgcgcaaagttcccacctcaagtt

SEQ ID NO: 45081 - DNA, 25 bp, Homo sapien
ctcgcctcgcttcgggacagtggca

SEQ ID NO: 45082 - DNA, 25 bp, Homo sapien
ggcgcgcctgctggattgcgctcct

SEQ ID NO: 45083 - DNA, 25 bp, Homo sapien
tggagcttcacgcaccaggcggcgc

SEQ ID NO: 45084 - DNA, 25 bp, Homo sapien
tgccaccaggtcaccgaggcggtct

SEQ ID NO: 45085 - DNA, 25 bp, Homo sapien
cgggcatatccgctcctctcggtga

SEQ ID NO: 45086 - DNA, 25 bp, Homo sapien
cgggaatcgcccaggcactgtcctg

SEQ ID NO: 45087 - DNA, 25 bp, Homo sapien
ccaggtcaccgaggcggtctctgct

SEQ ID NO: 45088 - DNA, 25 bp, Homo sapien
cgaggccctagccagcagcgagtca

SEQ ID NO: 45089 - DNA, 25 bp, Homo sapien
ccagcagcgagtcagagacggaaca

SEQ ID NO: 45090 - DNA, 25 bp, Homo sapien
agtcagagacggaacagcccacgcc

SEQ ID NO: 45091 - DNA, 25 bp, Homo sapien
gcatatccgctcctctcggtgatca

SEQ ID NO: 45092 - DNA, 25 bp, Homo sapien
cgccgctattctcaggacgacctgg

SEQ ID NO: 45093 - DNA, 25 bp, Homo sapien
gcctgctgcgctaaacgtcatccgt

SEQ ID NO: 45094 - DNA, 25 bp, Homo sapien
ccgtcatcctttcgctgaaaagttg

SEQ ID NO: 45095 - DNA, 25 bp, Homo sapien
tgccaggcgacttggaagaggttta

SEQ ID NO: 45096 - DNA, 25 bp, Homo sapien
tcacgccacacaagggaggaagctc

SEQ ID NO: 45097 - DNA, 25 bp, Homo sapien
ggttcctcggtcagcgacgtatcca

SEQ ID NO: 45098 - DNA, 25 bp, Homo sapien
aggccaagcgtgttcctttcatgtc

SEQ ID NO: 45099 - DNA, 25 bp, Homo sapien
ctcggcctgtcaagaggcgtgataa

SEQ ID NO: 45100 - DNA, 25 bp, Homo sapien
cttggccgcgctcagaaacttctgc

SEQ ID NO: 45101 - DNA, 25 bp, Homo sapien
cgaggtgacattattggcgaggttc

SEQ ID NO: 45102 - DNA, 25 bp, Homo sapien
cactgcctggatcagttcgtgggac

SEQ ID NO: 45103 - DNA, 25 bp, Homo sapien
gaatgcctccgcttggcaccaggcg

SEQ ID NO: 45104 - DNA, 25 bp, Homo sapien
gcccgccgttattgggcgagacgca

SEQ ID NO: 45105 - DNA, 25 bp, Homo sapien
gttcagggcatccatgatcacggca

SEQ ID NO: 45106 - DNA, 25 bp, Homo sapien
caaccaaggcctcggcgcacgaatg

SEQ ID NO: 45107 - DNA, 25 bp, Homo sapien
ggctcaagcaaagcggctcgcggta

SEQ ID NO: 45108 - DNA, 25 bp, Homo sapien
tcctcgtagggacgcacgccgggtc

SEQ ID NO: 45109 - DNA, 25 bp, Homo sapien
gttcggattcaaatactcatagtcg

SEQ ID NO: 45110 - DNA, 25 bp, Homo sapien
catagtcgaagaggatggagaagtc

SEQ ID NO: 45111 - DNA, 25 bp, Homo sapien
ggatggagaagtcaagctcgtcttg

SEQ ID NO: 45112 - DNA, 25 bp, Homo sapien
gcgcgagcttcctgctccggaggca

SEQ ID NO: 45113 - DNA, 25 bp, Homo sapien
accctccacgggtgagtgcgacacg

SEQ ID NO: 45114 - DNA, 25 bp, Homo sapien
gaccttcgttcggattcaaatactc

SEQ ID NO: 45115 - DNA, 25 bp, Homo sapien
ttcctgctccggaggcacctgttgc

SEQ ID NO: 45116 - DNA, 25 bp, Homo sapien
cgagagtcagttaccttggtccaca

SEQ ID NO: 45117 - DNA, 25 bp, Homo sapien
actcaggaatccatgacgtcgcctc

SEQ ID NO: 45118 - DNA, 25 bp, Homo sapien
tcctgtttatccagcgccatggaaa

SEQ ID NO: 45119 - DNA, 25 bp, Homo sapien
gggattccctcactgtttcctcctg

SEQ ID NO: 45120 - DNA, 25 bp, Homo sapien
cgcgctccgtgtttataggctttca

SEQ ID NO: 45121 - DNA, 25 bp, Homo sapien
ttactccagaggcaacgcgacttcc

SEQ ID NO: 45122 - DNA, 25 bp, Homo sapien
ggccgccagcacaagtccctgattg

SEQ ID NO: 45123 - DNA, 25 bp, Homo sapien
tctgtttgtatcgaccagcagccga

SEQ ID NO: 45124 - DNA, 25 bp, Homo sapien
cccagaactctgattggcgggtcta

SEQ ID NO: 45125 - DNA, 25 bp, Homo sapien
cgctgccatcctccgaacaggaaga

SEQ ID NO: 45126 - DNA, 25 bp, Homo sapien
ccaggtaagtctatggcaggcgata

SEQ ID NO: 45127 - DNA, 25 bp, Homo sapien
ggccgggaaatctgcatttgcacca

SEQ ID NO: 45128 - DNA, 25 bp, Homo sapien
gcgaggcgcaaaataccaacccgtc

SEQ ID NO: 45129 - DNA, 25 bp, Homo sapien
tgggctcccgagtaatgctccaagc

SEQ ID NO: 45130 - DNA, 25 bp, Homo sapien
cggtgtgacactgaccaaattgtta

SEQ ID NO: 45131 - DNA, 25 bp, Homo sapien
ctgatccgaattccgcgagtgtgta

SEQ ID NO: 45132 - DNA, 25 bp, Homo sapien
tctctctagggaaaaggacgcagtt

SEQ ID NO: 45133 - DNA, 25 bp, Homo sapien
cagcaggactgagtgattccatcta

SEQ ID NO: 45134 - DNA, 25 bp, Homo sapien
tccctctccagtagcagcaggactg

SEQ ID NO: 45135 - DNA, 25 bp, Homo sapien
ggaggcagcgtcaaggtcaccttcc

SEQ ID NO: 45136 - DNA, 25 bp, Homo sapien
agacctactccgtgcagccctgaaa

SEQ ID NO: 45137 - DNA, 25 bp, Homo sapien
agattccgtccatcttcgggccctg

SEQ ID NO: 45138 - DNA, 25 bp, Homo sapien
aggctgtgcagaggcgacagattcc

SEQ ID NO: 45139 - DNA, 25 bp, Homo sapien
tctgggaaggacacaactgaatgag

SEQ ID NO: 45140 - DNA, 25 bp, Homo sapien
tcgcagaggatctggaggcctttca

SEQ ID NO: 45141 - DNA, 25 bp, Homo sapien
aaggtcccggctctccattcgaaag

SEQ ID NO: 45142 - DNA, 25 bp, Homo sapien
gggcccagttcctcagattcagcgc

SEQ ID NO: 45143 - DNA, 25 bp, Homo sapien
actaagtgatggtctacgccgccgg

SEQ ID NO: 45144 - DNA, 25 bp, Homo sapien
ccctctccggagtcgaatggaatcc

SEQ ID NO: 45145 - DNA, 25 bp, Homo sapien
cggccttccgctccaagactaagtg

SEQ ID NO: 45146 - DNA, 25 bp, Homo sapien
tgccgcaatggcaagtcccaacttg

SEQ ID NO: 45147 - DNA, 25 bp, Homo sapien
gaacgagtcccgatctgtcgccgta

SEQ ID NO: 45148 - DNA, 25 bp, Homo sapien
acttatcaggcgacaatttggcggg

SEQ ID NO: 45149 - DNA, 25 bp, Homo sapien
gttctttcttttgagagcgacgcga

SEQ ID NO: 45150 - DNA, 25 bp, Homo sapien
tgcaacagatcgtcctcctccgggg

SEQ ID NO: 45151 - DNA, 25 bp, Homo sapien
atcaaagatggctggaggtcaggcc

SEQ ID NO: 45152 - DNA, 25 bp, Homo sapien
tttcacacccaagcgcaaatgtgga

SEQ ID NO: 45153 - DNA, 25 bp, Homo sapien
ccctcgatctgggaaacgctggccg

SEQ ID NO: 45154 - DNA, 25 bp, Homo sapien
agatagtggaaaaccgcctcgctcc

SEQ ID NO: 45155 - DNA, 25 bp, Homo sapien
ctcctaaaacctccgcggtgaagtg

SEQ ID NO: 45156 - DNA, 25 bp, Homo sapien
ttgagattcgccttcatggtgcagc

SEQ ID NO: 45157 - DNA, 25 bp, Homo sapien
cggacgtcgcagaactcgcacttga

SEQ ID NO: 45158 - DNA, 25 bp, Homo sapien
aaggccctctgcgtcacgatcttgg

SEQ ID NO: 45159 - DNA, 25 bp, Homo sapien
ttacagtggactctgctgtgcacgc

SEQ ID NO: 45160 - DNA, 25 bp, Homo sapien
gtcacacttgaagggacggtcctta

SEQ ID NO: 45161 - DNA, 25 bp, Homo sapien
tcgtgtcgaagctgcagaagtcaca

SEQ ID NO: 45162 - DNA, 25 bp, Homo sapien
cctgtgcaccttgtcgacgtgcttg

SEQ ID NO: 45163 - DNA, 25 bp, Homo sapien
agctgcactctggacacttctccgg

SEQ ID NO: 45164 - DNA, 25 bp, Homo sapien
gcgtccctaggagtggcctacttca

SEQ ID NO: 45165 - DNA, 25 bp, Homo sapien
tctgagcatccttccagcgtgtttg

SEQ ID NO: 45166 - DNA, 25 bp, Homo sapien
tccagcgtgtttgggaggcaaactc

SEQ ID NO: 45167 - DNA, 25 bp, Homo sapien
ggcaaactcgttgactagctcttga

SEQ ID NO: 45168 - DNA, 25 bp, Homo sapien
gcgcatcccgaaaacagcctctgag

SEQ ID NO: 45169 - DNA, 25 bp, Homo sapien
gcatgtcccggcaattctgctcatc

SEQ ID NO: 45170 - DNA, 25 bp, Homo sapien
ttcacacaacgaattcccggagttc

SEQ ID NO: 45171 - DNA, 25 bp, Homo sapien
ggactccaggagagtgtaatttaca

SEQ ID NO: 45172 - DNA, 25 bp, Homo sapien
gaggggttgacaccgcctgctccac

SEQ ID NO: 45173 - DNA, 25 bp, Homo sapien
tcgcgcacatgttcagggtcatccg

SEQ ID NO: 45174 - DNA, 25 bp, Homo sapien
ctgctcctcgcgcacatgttcaggg

SEQ ID NO: 45175 - DNA, 25 bp, Homo sapien
gggttggcctgctcctcgcgcacat

SEQ ID NO: 45176 - DNA, 25 bp, Homo sapien
gccttgagacgctggtggctgcctc

SEQ ID NO: 45177 - DNA, 25 bp, Homo sapien
agagccccgctgtgcccgagagcga

SEQ ID NO: 45178 - DNA, 25 bp, Homo sapien
tgacaccgcctgctccaccgcaagc

SEQ ID NO: 45179 - DNA, 25 bp, Homo sapien
acatgttcagggtcatccgcgctgc

SEQ ID NO: 45180 - DNA, 25 bp, Homo sapien
caggcgggacgatgttcactgcagc

SEQ ID NO: 45181 - DNA, 25 bp, Homo sapien
ctcgctcggacaccgcgaggactga

SEQ ID NO: 45182 - DNA, 25 bp, Homo sapien
gcgatcagactgacctggcgcagga

SEQ ID NO: 45183 - DNA, 25 bp, Homo sapien
cgcaggatctgcagccggctgttcc

SEQ ID NO: 45184 - DNA, 25 bp, Homo sapien
ccggctgttccctgggagttcctct

SEQ ID NO: 45185 - DNA, 25 bp, Homo sapien
caaggcaggcgggacgatgttcact

SEQ ID NO: 45186 - DNA, 25 bp, Homo sapien
acagccggctgggtcattgcgcccg

SEQ ID NO: 45187 - DNA, 25 bp, Homo sapien
tccctgggagttcctctgggttctg

SEQ ID NO: 45188 - DNA, 25 bp, Homo sapien
ttctcccaactctgcgaggcgggga

SEQ ID NO: 45189 - DNA, 25 bp, Homo sapien
ccttccaaggggtctcgcaaggctg

SEQ ID NO: 45190 - DNA, 25 bp, Homo sapien
ctgctcccggaaaagcacttacttt

SEQ ID NO: 45191 - DNA, 25 bp, Homo sapien
acttactttgcaccgagcccgcgaa

SEQ ID NO: 45192 - DNA, 25 bp, Homo sapien
ctgatctacatggtgcaaggacttt

SEQ ID NO: 45193 - DNA, 25 bp, Homo sapien
gcaagctgcacttccgctgcctaga

SEQ ID NO: 45194 - DNA, 25 bp, Homo sapien
caacctggctttgcagcagcggctc

SEQ ID NO: 45195 - DNA, 25 bp, Homo sapien
ctgctcgcgttcatggccgcagact

SEQ ID NO: 45196 - DNA, 25 bp, Homo sapien
ccagaagtgggactggagcgaagta

SEQ ID NO: 45197 - DNA, 25 bp, Homo sapien
caggtaagagaaacggctccgcttc

SEQ ID NO: 45198 - DNA, 25 bp, Homo sapien
cgagtgacgtcctaggagccaccgg

SEQ ID NO: 45199 - DNA, 25 bp, Homo sapien
tcctaggagccaccgggcaagaggc

SEQ ID NO: 45200 - DNA, 25 bp, Homo sapien
cggcaggtaagagaaacggctccgc

SEQ ID NO: 45201 - DNA, 25 bp, Homo sapien
gaaacggctccgcttcggggctgcc

SEQ ID NO: 45202 - DNA, 25 bp, Homo sapien
tttgcgccgggtgcccttctaataa

SEQ ID NO: 45203 - DNA, 25 bp, Homo sapien
agtagaggatgccgaggagaaaaca

SEQ ID NO: 45204 - DNA, 25 bp, Homo sapien
ccttcttgtggaccctggagtgcaa

SEQ ID NO: 45205 - DNA, 25 bp, Homo sapien
tctcggaactcgaatcgtcgttgtc

SEQ ID NO: 45206 - DNA, 25 bp, Homo sapien
ggcctgcacaactgcccttatttgt

SEQ ID NO: 45207 - DNA, 25 bp, Homo sapien
ctttctcttgcgagaggcctgcaca

SEQ ID NO: 45208 - DNA, 25 bp, Homo sapien
tcgccgtgggagtgtttgcacttct

SEQ ID NO: 45209 - DNA, 25 bp, Homo sapien
ccagctggtggtaggttctgaaagc

SEQ ID NO: 45210 - DNA, 25 bp, Homo sapien
ccattttcatccagaggggcggcga

SEQ ID NO: 45211 - DNA, 25 bp, Homo sapien
cttgctactgggtaacttgggatcc

SEQ ID NO: 45212 - DNA, 25 bp, Homo sapien
catcggaaagagtaaagtcacgttc

SEQ ID NO: 45213 - DNA, 25 bp, Homo sapien
ggggagaccacgtgattttctggaa

SEQ ID NO: 45214 - DNA, 25 bp, Homo sapien
caaggagcggcgtgcctccacgcag

SEQ ID NO: 45215 - DNA, 25 bp, Homo sapien
ctggctcgcctctttattttgattc

SEQ ID NO: 45216 - DNA, 25 bp, Homo sapien
cgccagcgcaaagtcggtgcgcaca

SEQ ID NO: 45217 - DNA, 25 bp, Homo sapien
cccaaaatgcgttgagggcatcgga

SEQ ID NO: 45218 - DNA, 25 bp, Homo sapien
tgattttctggaacgctggctcgcc

SEQ ID NO: 45219 - DNA, 25 bp, Homo sapien
acagcctggcgcgagttcgaagctg

SEQ ID NO: 45220 - DNA, 25 bp, Homo sapien
tccatgttcctatgcccagggacca

SEQ ID NO: 45221 - DNA, 25 bp, Homo sapien
ccagggaccatgcatttatggagac

SEQ ID NO: 45222 - DNA, 25 bp, Homo sapien
gtacgccgtagatgtcaccagtctc

SEQ ID NO: 45223 - DNA, 25 bp, Homo sapien
tttccagagaatctgcagcaggctg

SEQ ID NO: 45224 - DNA, 25 bp, Homo sapien
gcctcagagcattggtgcctccttg

SEQ ID NO: 45225 - DNA, 25 bp, Homo sapien
tgtctggggacctcttgaaaaggga

SEQ ID NO: 45226 - DNA, 25 bp, Homo sapien
tgttggtccgcaaggctgacctcta

SEQ ID NO: 45227 - DNA, 25 bp, Homo sapien
ttaccagggtgtcgtgctgtttctt

SEQ ID NO: 45228 - DNA, 25 bp, Homo sapien
aaacccaggtgtgttgtggctccga

SEQ ID NO: 45229 - DNA, 25 bp, Homo sapien
tcgaagcggcagaagaaacccaggt

SEQ ID NO: 45230 - DNA, 25 bp, Homo sapien
ccactctgcggtgggttcttcatcc

SEQ ID NO: 45231 - DNA, 25 bp, Homo sapien
tcccagaaccgggatgaagatcgcg

SEQ ID NO: 45232 - DNA, 25 bp, Homo sapien
ggagctgagcgacatgaacaaaatc

SEQ ID NO: 45233 - DNA, 25 bp, Homo sapien
ggcctccttccaggagcggacagca

SEQ ID NO: 45234 - DNA, 25 bp, Homo sapien
tcaggaaccatctgagggcttaagc

SEQ ID NO: 45235 - DNA, 25 bp, Homo sapien
gggcttaagcacacctcgttccggc

SEQ ID NO: 45236 - DNA, 25 bp, Homo sapien
cagccgtttggactcactggccaaa

SEQ ID NO: 45237 - DNA, 25 bp, Homo sapien
cctgtccctttaattggcatgtacc

SEQ ID NO: 45238 - DNA, 25 bp, Homo sapien
gagcctcgaaggacgcaggtccgcc

SEQ ID NO: 45239 - DNA, 25 bp, Homo sapien
ctgagcgttttcctaggcacctggc

SEQ ID NO: 45240 - DNA, 25 bp, Homo sapien
tgttgtatttttgcggggagttcta

SEQ ID NO: 45241 - DNA, 25 bp, Homo sapien
ggcatgtaccaagtccttccaggtc

SEQ ID NO: 45242 - DNA, 25 bp, Homo sapien
cttgactcgggcgttgcaccggcat

SEQ ID NO: 45243 - DNA, 25 bp, Homo sapien
tgcggtagtccagtcccaagatggc

SEQ ID NO: 45244 - DNA, 25 bp, Homo sapien
gccggttcgattgtctctctcttga

SEQ ID NO: 45245 - DNA, 25 bp, Homo sapien
agtatcgatcctctccgtgttgctg

SEQ ID NO: 45246 - DNA, 25 bp, Homo sapien
ttctcccaccgactgcttgtcttga

SEQ ID NO: 45247 - DNA, 25 bp, Homo sapien
ccagcgtctaggtatgtaatggatc

SEQ ID NO: 45248 - DNA, 25 bp, Homo sapien
atctcttggatgacttggctttctg

SEQ ID NO: 45249 - DNA, 25 bp, Homo sapien
ccctggagcccatctactcgaaata

SEQ ID NO: 45250 - DNA, 25 bp, Homo sapien
agtgatgtgcgccttctaaagcctc

SEQ ID NO: 45251 - DNA, 25 bp, Homo sapien
gctgtcactgtaaggccagcgtcta

SEQ ID NO: 45252 - DNA, 25 bp, Homo sapien
tgggacaggggtgaaggctgcgcta

SEQ ID NO: 45253 - DNA, 25 bp, Homo sapien
gaaggctgcgctaggggaggacggg

SEQ ID NO: 45254 - DNA, 25 bp, Homo sapien
gtgaaggctgcgctaggggaggacg

SEQ ID NO: 45255 - DNA, 25 bp, Homo sapien
caggggtgaaggctgcgctagggga

SEQ ID NO: 45256 - DNA, 25 bp, Homo sapien
gggacaggggtgaaggctgcgctag

SEQ ID NO: 45257 - DNA, 25 bp, Homo sapien
ctgggacaggggtgaaggctgcgct

SEQ ID NO: 45258 - DNA, 25 bp, Homo sapien
tctgggacaggggtgaaggctgcgc

SEQ ID NO: 45259 - DNA, 25 bp, Homo sapien
gacaggggtgaaggctgcgctaggg

SEQ ID NO: 45260 - DNA, 25 bp, Homo sapien
cccactctggttcctagacatctga

SEQ ID NO: 45261 - DNA, 25 bp, Homo sapien
ccgaaagcgcggattcgcaggatca

SEQ ID NO: 45262 - DNA, 25 bp, Homo sapien
aacgcgaggctgtgttcatggccag

SEQ ID NO: 45263 - DNA, 25 bp, Homo sapien
tgtcctttaaggagctcatgcagca

SEQ ID NO: 45264 - DNA, 25 bp, Homo sapien
tctctcgctggctctgttacctttg

SEQ ID NO: 45265 - DNA, 25 bp, Homo sapien
caccaattctgtggcttgaagtcaa

SEQ ID NO: 45266 - DNA, 25 bp, Homo sapien
gggcacacgcgctctatttatagga

SEQ ID NO: 45267 - DNA, 25 bp, Homo sapien
gactcccactttcgcctggtcaaaa

SEQ ID NO: 45268 - DNA, 25 bp, Homo sapien
catcatgaccgtgaggaaggccctc

SEQ ID NO: 45269 - DNA, 25 bp, Homo sapien
ctactcggagagcaaaatggtcatt

SEQ ID NO: 45270 - DNA, 25 bp, Homo sapien
atgttcttcgccatgatgctcctca

SEQ ID NO: 45271 - DNA, 25 bp, Homo sapien
gggcaccctctacgtgcacatgttc

SEQ ID NO: 45272 - DNA, 25 bp, Homo sapien
cacatgttcctctttgcgcggctgc

SEQ ID NO: 45273 - DNA, 25 bp, Homo sapien
gcggctgcacgtcaagcgcatagca

SEQ ID NO: 45274 - DNA, 25 bp, Homo sapien
cctcaccttgatcgtggccatctgg

SEQ ID NO: 45275 - DNA, 25 bp, Homo sapien
gcgtggtgttcatcgtctactcgga

SEQ ID NO: 45276 - DNA, 25 bp, Homo sapien
aaacctcgaagtcttgggctgcgcc

SEQ ID NO: 45277 - DNA, 25 bp, Homo sapien
ctggaaatgctgatgggaaccgttt

SEQ ID NO: 45278 - DNA, 25 bp, Homo sapien
cagcctcggagcgtgctggaaatgc

SEQ ID NO: 45279 - DNA, 25 bp, Homo sapien
gagcgcgcaactctcagcctcggag

SEQ ID NO: 45280 - DNA, 25 bp, Homo sapien
gatccagattgccttcctgcacgag

SEQ ID NO: 45281 - DNA, 25 bp, Homo sapien
ccctgcaaccatcagatccagattg

SEQ ID NO: 45282 - DNA, 25 bp, Homo sapien
tgggaaccgtttgaatgaccgggca

SEQ ID NO: 45283 - DNA, 25 bp, Homo sapien
gccgcctggtgcaaggtcatccggt

SEQ ID NO: 45284 - DNA, 25 bp, Homo sapien
ttgcacttgtagctgcccgggaccg

SEQ ID NO: 45285 - DNA, 25 bp, Homo sapien
aaggacgcctttgcacttgtagctg

SEQ ID NO: 45286 - DNA, 25 bp, Homo sapien
cgccaaggacgcctttgcacttgta

SEQ ID NO: 45287 - DNA, 25 bp, Homo sapien
gaccctgatcccgggcggtgtccag

SEQ ID NO: 45288 - DNA, 25 bp, Homo sapien
caccatggccgggttgctggcgttg

SEQ ID NO: 45289 - DNA, 25 bp, Homo sapien
gtgctgcgcctagctgcgcaccatg

SEQ ID NO: 45290 - DNA, 25 bp, Homo sapien
cctttgcacttgtagctgcccggga

SEQ ID NO: 45291 - DNA, 25 bp, Homo sapien
gacgcctttgcacttgtagctgccc

SEQ ID NO: 45292 - DNA, 25 bp, Homo sapien
cccgacgccttgagtcgcgtttaag

SEQ ID NO: 45293 - DNA, 25 bp, Homo sapien
tgcgtttcctaagttgcccggcttg

SEQ ID NO: 45294 - DNA, 25 bp, Homo sapien
ggcatgcgcctctactttgcgtttc

SEQ ID NO: 45295 - DNA, 25 bp, Homo sapien
tcggctggggcatttagagaaaacc

SEQ ID NO: 45296 - DNA, 25 bp, Homo sapien
tttttccaggagagagcgggatacc

SEQ ID NO: 45297 - DNA, 25 bp, Homo sapien
cggtcggccatttatcggtgaagca

SEQ ID NO: 45298 - DNA, 25 bp, Homo sapien
ttagttcgcctctgcatccagatgg

SEQ ID NO: 45299 - DNA, 25 bp, Homo sapien
cgcaggcgcacttgctccctaagaa

SEQ ID NO: 45300 - DNA, 25 bp, Homo sapien
ttcagagcgcggttttggtaccgga

SEQ ID NO: 45301 - DNA, 25 bp, Homo sapien
ggtttaagtggacgccaggtgcacc

SEQ ID NO: 45302 - DNA, 25 bp, Homo sapien
ctgtgtttaaccacaccgaggacta

SEQ ID NO: 45303 - DNA, 25 bp, Homo sapien
aggactatgtgttgctgcccgacga

SEQ ID NO: 45304 - DNA, 25 bp, Homo sapien
gcccgacgagaggacgatcagtctt

SEQ ID NO: 45305 - DNA, 25 bp, Homo sapien
ccgagcggagaaacctgctgtcgtt

SEQ ID NO: 45306 - DNA, 25 bp, Homo sapien
attgtacgctgcatagtgcactccc

SEQ ID NO: 45307 - DNA, 25 bp, Homo sapien
tgacgtgcagcgatgacttcagagc

SEQ ID NO: 45308 - DNA, 25 bp, Homo sapien
cgagtgattccgattgtgcagcaga

SEQ ID NO: 45309 - DNA, 25 bp, Homo sapien
cagccacacaagctggcgtgggata

SEQ ID NO: 45310 - DNA, 25 bp, Homo sapien
agcagaaacccagggtctcacggga

SEQ ID NO: 45311 - DNA, 25 bp, Homo sapien
aagcgacgctctccatgacaaccgg

SEQ ID NO: 45312 - DNA, 25 bp, Homo sapien
tgacaaccggcacttggtaacggcc

SEQ ID NO: 45313 - DNA, 25 bp, Homo sapien
aagtggctgcggatttcgccggaaa

SEQ ID NO: 45314 - DNA, 25 bp, Homo sapien
ccggaaatcccggaagtgacagctt

SEQ ID NO: 45315 - DNA, 25 bp, Homo sapien
tctgactcccgtcctgcgatgggtt

SEQ ID NO: 45316 - DNA, 25 bp, Homo sapien
tcccacactggagtcgccgaatatc

SEQ ID NO: 45317 - DNA, 25 bp, Homo sapien
gcgggctccacgagatagctctgca

SEQ ID NO: 45318 - DNA, 25 bp, Homo sapien
gccacggacttttctggcccaagac

SEQ ID NO: 45319 - DNA, 25 bp, Homo sapien
cccgcactctttgcttacaacgaaa

SEQ ID NO: 45320 - DNA, 25 bp, Homo sapien
caacgaaatcctcggggcgcattgc

SEQ ID NO: 45321 - DNA, 25 bp, Homo sapien
cgcagtagcggggtttcgcactaac

SEQ ID NO: 45322 - DNA, 25 bp, Homo sapien
agcagcaatgggaatccgcgggtcc

SEQ ID NO: 45323 - DNA, 25 bp, Homo sapien
acgacatgcctcaccagatggacga

SEQ ID NO: 45324 - DNA, 25 bp, Homo sapien
tcgcctcactttgcctgtttgaaaa

SEQ ID NO: 45325 - DNA, 25 bp, Homo sapien
cgcgccctattaaagcaatctgtta

SEQ ID NO: 45326 - DNA, 25 bp, Homo sapien
aggagtctaccatcccacggccaag

SEQ ID NO: 45327 - DNA, 25 bp, Homo sapien
gtcaggcatgtctctaacgggctcc

SEQ ID NO: 45328 - DNA, 25 bp, Homo sapien
accctaggcacctttgtggctttca

SEQ ID NO: 45329 - DNA, 25 bp, Homo sapien
gactgtgcccacgaagtctcgtttg

SEQ ID NO: 45330 - DNA, 25 bp, Homo sapien
ctcctcggaagcttgggaacctgtg

SEQ ID NO: 45331 - DNA, 25 bp, Homo sapien
ggcatgcccttactggacatagata

SEQ ID NO: 45332 - DNA, 25 bp, Homo sapien
tgcggacaccgtactgataggcatt

SEQ ID NO: 45333 - DNA, 25 bp, Homo sapien
acgccctcgagaattagcgatgttc

SEQ ID NO: 45334 - DNA, 25 bp, Homo sapien
cagaatgtttaaatccagcccaggg

SEQ ID NO: 45335 - DNA, 25 bp, Homo sapien
aacatgtgggacctgggtgtctacc

SEQ ID NO: 45336 - DNA, 25 bp, Homo sapien
gcgcttctttcccagggcgagtaga

SEQ ID NO: 45337 - DNA, 25 bp, Homo sapien
cgcagtttcttaactccaggtgaca

SEQ ID NO: 45338 - DNA, 25 bp, Homo sapien
tgacatccgtcttttggaggaacga

SEQ ID NO: 45339 - DNA, 25 bp, Homo sapien
cgccattccgtggatgggagagtca

SEQ ID NO: 45340 - DNA, 25 bp, Homo sapien
cgcgagctacattcccagcagggtc

SEQ ID NO: 45341 - DNA, 25 bp, Homo sapien
gctctgctgcccgtaactcatatga

SEQ ID NO: 45342 - DNA, 25 bp, Homo sapien
gaacatcaggaaccggactattacc

SEQ ID NO: 45343 - DNA, 25 bp, Homo sapien
ctccaaaggccggagatggtgtcgt

SEQ ID NO: 45344 - DNA, 25 bp, Homo sapien
tagccgcattgcgagccgaacccgg

SEQ ID NO: 45345 - DNA, 25 bp, Homo sapien
agacgctgaggttgcgttgacgctc

SEQ ID NO: 45346 - DNA, 25 bp, Homo sapien
gctcccgttccaggtgctgttgcac

SEQ ID NO: 45347 - DNA, 25 bp, Homo sapien
tggaggagatcagtctgctgcagcc

SEQ ID NO: 45348 - DNA, 25 bp, Homo sapien
tgatcgatgatgaggctgcaccgta

SEQ ID NO: 45349 - DNA, 25 bp, Homo sapien
tcccgatgcagccaagagaacggtg

SEQ ID NO: 45350 - DNA, 25 bp, Homo sapien
ctttcagccgagagagtgacagatt

SEQ ID NO: 45351 - DNA, 25 bp, Homo sapien
ggaccactttgcattcacgctttga

SEQ ID NO: 45352 - DNA, 25 bp, Homo sapien
ctgtgtaaactgtagggtgcctcgc

SEQ ID NO: 45353 - DNA, 25 bp, Homo sapien
cgcctcattagagacgcgtttgatg

SEQ ID NO: 45354 - DNA, 25 bp, Homo sapien
tacgatgatctaatggccggctctt

SEQ ID NO: 45355 - DNA, 25 bp, Homo sapien
cctgggcgatgtcaatgggataatt

SEQ ID NO: 45356 - DNA, 25 bp, Homo sapien
ttccgcaaagacagcgacgcaggtc

SEQ ID NO: 45357 - DNA, 25 bp, Homo sapien
ggacacacgcggactccagcaggcg

SEQ ID NO: 45358 - DNA, 25 bp, Homo sapien
ttgtgcttcggacacacgcggactc

SEQ ID NO: 45359 - DNA, 25 bp, Homo sapien
aggacacgaagcaaactgcctcttg

SEQ ID NO: 45360 - DNA, 25 bp, Homo sapien
ctctccacggagatcgaggacacga

SEQ ID NO: 45361 - DNA, 25 bp, Homo sapien
gctgcagctccggaacaataaatcc

SEQ ID NO: 45362 - DNA, 25 bp, Homo sapien
aggcgccacggaaatgggcaagccc

SEQ ID NO: 45363 - DNA, 25 bp, Homo sapien
ccctgtcataactgtgagcagctgc

SEQ ID NO: 45364 - DNA, 25 bp, Homo sapien
aaccacagctttggcttcattctca

SEQ ID NO: 45365 - DNA, 25 bp, Homo sapien
tcacagttgacaagggacacgcggg

SEQ ID NO: 45366 - DNA, 25 bp, Homo sapien
aatatgctgagcacccaccagaggg

SEQ ID NO: 45367 - DNA, 25 bp, Homo sapien
ttctcaggacctgcgtgtagcgagc

SEQ ID NO: 45368 - DNA, 25 bp, Homo sapien
cacgcttcttgccaccggctgagaa

SEQ ID NO: 45369 - DNA, 25 bp, Homo sapien
ttgccaccggctgagaatatgctga

SEQ ID NO: 45370 - DNA, 25 bp, Homo sapien
agagggcgtccgcactcactgtgcc

SEQ ID NO: 45371 - DNA, 25 bp, Homo sapien
cggcctgcgctctcacagttgacaa

SEQ ID NO: 45372 - DNA, 25 bp, Homo sapien
tgcggggcgctgtgctaagtcttcc

SEQ ID NO: 45373 - DNA, 25 bp, Homo sapien
ggcgctgtgctaagtcttccggctg

SEQ ID NO: 45374 - DNA, 25 bp, Homo sapien
tgctgtcttccggttcggcgtgtgc

SEQ ID NO: 45375 - DNA, 25 bp, Homo sapien
gcgctgtgctaagtcttccggctgg

SEQ ID NO: 45376 - DNA, 25 bp, Homo sapien
gggcgctgtgctaagtcttccggct

SEQ ID NO: 45377 - DNA, 25 bp, Homo sapien
tgtgctaagtcttccggctgggcgt

SEQ ID NO: 45378 - DNA, 25 bp, Homo sapien
cgctgtgctaagtcttccggctggg

SEQ ID NO: 45379 - DNA, 25 bp, Homo sapien
ctgtgctgtcttccggttcggcgtg

SEQ ID NO: 45380 - DNA, 25 bp, Homo sapien
tatgctaagtcttccggctgggcgt

SEQ ID NO: 45381 - DNA, 25 bp, Homo sapien
gtcttccggctgcattcgcactctt

SEQ ID NO: 45382 - DNA, 25 bp, Homo sapien
ggtgctgtgctaagtcttccggctg

SEQ ID NO: 45383 - DNA, 25 bp, Homo sapien
gcgctgtcttccagatccgcttgtg

SEQ ID NO: 45384 - DNA, 25 bp, Homo sapien
taagtcttcccaaacggcgtgtgcg

SEQ ID NO: 45385 - DNA, 25 bp, Homo sapien
ggtgctgagctaagtcttcccaaac

SEQ ID NO: 45386 - DNA, 25 bp, Homo sapien
atagcgacagcgcaaacagcagcag

SEQ ID NO: 45387 - DNA, 25 bp, Homo sapien
tatgcacgcataatagcgacagcgc

SEQ ID NO: 45388 - DNA, 25 bp, Homo sapien
tcttgacttggttcgggttttcgca

SEQ ID NO: 45389 - DNA, 25 bp, Homo sapien
cccaatcgccaaaacctgtggtttg

SEQ ID NO: 45390 - DNA, 25 bp, Homo sapien
caagtctggagaatgtgcgcgcaca

SEQ ID NO: 45391 - DNA, 25 bp, Homo sapien
tcggggtgtgttatctcggaaacca

SEQ ID NO: 45392 - DNA, 25 bp, Homo sapien
gttttcgcagcaagttacacaagta

SEQ ID NO: 45393 - DNA, 25 bp, Homo sapien
cgtggggcttcagtatcattatttc

SEQ ID NO: 45394 - DNA, 25 bp, Homo sapien
atttgatcatcagtcccgcagcgcg

SEQ ID NO: 45395 - DNA, 25 bp, Homo sapien
tttccatgttgacacagcgcccgtg

SEQ ID NO: 45396 - DNA, 25 bp, Homo sapien
gccagcaagcctaggagtccagaga

SEQ ID NO: 45397 - DNA, 25 bp, Homo sapien
agctcgcagtgagcgcacgtgcatc

SEQ ID NO: 45398 - DNA, 25 bp, Homo sapien
aagctcgagtgcacctcgttgtcca

SEQ ID NO: 45399 - DNA, 25 bp, Homo sapien
accgccatggcgttgtacaggtcca

SEQ ID NO: 45400 - DNA, 25 bp, Homo sapien
atggctatcttgcaggctggccaga

SEQ ID NO: 45401 - DNA, 25 bp, Homo sapien
gcgtcggtgaggaaatggctatctt

SEQ ID NO: 45402 - DNA, 25 bp, Homo sapien
gcctgcccttactcaccgaggttga

SEQ ID NO: 45403 - DNA, 25 bp, Homo sapien
gaaaggagacgcgtaccctcgcctg

SEQ ID NO: 45404 - DNA, 25 bp, Homo sapien
gtgctctacgcatacgcctgtccag

SEQ ID NO: 45405 - DNA, 25 bp, Homo sapien
gcctcagggcctcacaggtgggacc

SEQ ID NO: 45406 - DNA, 25 bp, Homo sapien
tgccctcatggcctttgcacctatg

SEQ ID NO: 45407 - DNA, 25 bp, Homo sapien
ccggccgctcagaaagcgcgggaaa

SEQ ID NO: 45408 - DNA, 25 bp, Homo sapien
taggacaggggcttctggagcttct

SEQ ID NO: 45409 - DNA, 25 bp, Homo sapien
ttctggcagccgtctgccctcatgg

SEQ ID NO: 45410 - DNA, 25 bp, Homo sapien
ctttgcacctatggggcccgaggcc

SEQ ID NO: 45411 - DNA, 25 bp, Homo sapien
cgaggcctcgttcttcgacgttttg

SEQ ID NO: 45412 - DNA, 25 bp, Homo sapien
ccgcggtagtcagggcagtttctac

SEQ ID NO: 45413 - DNA, 25 bp, Homo sapien
agcaggttcgcaaactcctcagacc

SEQ ID NO: 45414 - DNA, 25 bp, Homo sapien
cttcgcgccagagcaggttcgcaaa

SEQ ID NO: 45415 - DNA, 25 bp, Homo sapien
tcctgggatttctgtccgcgctcct

SEQ ID NO: 45416 - DNA, 25 bp, Homo sapien
atgtgctgtcgccttgcgggaaaag

SEQ ID NO: 45417 - DNA, 25 bp, Homo sapien
agggcagtttctaccgcaggcttaa

SEQ ID NO: 45418 - DNA, 25 bp, Homo sapien
tcttcgacgatttccgggcgacgca

SEQ ID NO: 45419 - DNA, 25 bp, Homo sapien
caggcttaaggaggcttcgggctcc

SEQ ID NO: 45420 - DNA, 25 bp, Homo sapien
tatggcacgtggctcttccctaagt

SEQ ID NO: 45421 - DNA, 25 bp, Homo sapien
cagcctcgcgcccagagtaaatatc

SEQ ID NO: 45422 - DNA, 25 bp, Homo sapien
ggaatatgatctgtgctccgctgca

SEQ ID NO: 45423 - DNA, 25 bp, Homo sapien
ccggggtcgtatgctgtatgtttac

SEQ ID NO: 45424 - DNA, 25 bp, Homo sapien
ccgaaaattctgtggctggccctgc

SEQ ID NO: 45425 - DNA, 25 bp, Homo sapien
gcccggggctgagtttcatgctcaa

SEQ ID NO: 45426 - DNA, 25 bp, Homo sapien
tgtttcccagctgcataggtcccaa

SEQ ID NO: 45427 - DNA, 25 bp, Homo sapien
tcgccctgggttaaataccgactca

SEQ ID NO: 45428 - DNA, 25 bp, Homo sapien
tgcctccgaagaccgctcgggcatt

SEQ ID NO: 45429 - DNA, 25 bp, Homo sapien
ctgccagcttcgtgggctacagcta

SEQ ID NO: 45430 - DNA, 25 bp, Homo sapien
ctacattgagtacacgccggccagc

SEQ ID NO: 45431 - DNA, 25 bp, Homo sapien
ccgcgggcaccactttcgtgcagta

SEQ ID NO: 45432 - DNA, 25 bp, Homo sapien
cgaggactgtggcattgtcaccttc

SEQ ID NO: 45433 - DNA, 25 bp, Homo sapien
gtcaccttcacagcagacagagctg

SEQ ID NO: 45434 - DNA, 25 bp, Homo sapien
gctgagcttcagtgaggtgccacca

SEQ ID NO: 45435 - DNA, 25 bp, Homo sapien
gctgtcctcgccctacattgagtac

SEQ ID NO: 45436 - DNA, 25 bp, Homo sapien
gtctttggcttgtgggctctgcctc

SEQ ID NO: 45437 - DNA, 25 bp, Homo sapien
gcttgtgggctctgcctcgtgcacc

SEQ ID NO: 45438 - DNA, 25 bp, Homo sapien
cagcccatgctcttggaggagagca

SEQ ID NO: 45439 - DNA, 25 bp, Homo sapien
gggcttgaccgggactggcccctca

SEQ ID NO: 45440 - DNA, 25 bp, Homo sapien
ctccgtctttggcttgtgggctctg

SEQ ID NO: 45441 - DNA, 25 bp, Homo sapien
gaacagcccatgctcttggaggaga

SEQ ID NO: 45442 - DNA, 25 bp, Homo sapien
ccagaacagcccatgctcttggagg

SEQ ID NO: 45443 - DNA, 25 bp, Homo sapien
tgggctctgcctcgtgcaccgcgtg

SEQ ID NO: 45444 - DNA, 25 bp, Homo sapien
cccgaacactacagttgactttgcc

SEQ ID NO: 45445 - DNA, 25 bp, Homo sapien
ggactccgctcaatgccgccatgtt

SEQ ID NO: 45446 - DNA, 25 bp, Homo sapien
gcctgcaacagggacacacaagcct

SEQ ID NO: 45447 - DNA, 25 bp, Homo sapien
gccgaggtactcagacctctccatg

SEQ ID NO: 45448 - DNA, 25 bp, Homo sapien
tgcatacctggctccgcgatgcagc

SEQ ID NO: 45449 - DNA, 25 bp, Homo sapien
acagttgactttgccctgtttagga

SEQ ID NO: 45450 - DNA, 25 bp, Homo sapien
cctgtaaggtcagctttgagacatc

SEQ ID NO: 45451 - DNA, 25 bp, Homo sapien
gccgccatgtttcccgcaggaagtc

SEQ ID NO: 45452 - DNA, 25 bp, Homo sapien
aggagacacttcaaccctttcgccg

SEQ ID NO: 45453 - DNA, 25 bp, Homo sapien
caaggcccgggtccaatcctcagaa

SEQ ID NO: 45454 - DNA, 25 bp, Homo sapien
ggcccgggtccaatcctcagaactg

SEQ ID NO: 45455 - DNA, 25 bp, Homo sapien
tcctcagaactgcacggctcggccc

SEQ ID NO: 45456 - DNA, 25 bp, Homo sapien
gggcagcgacctcgcggacccagcc

SEQ ID NO: 45457 - DNA, 25 bp, Homo sapien
agacgcactcgctcccgcaaggagt

SEQ ID NO: 45458 - DNA, 25 bp, Homo sapien
tcgctcccgcaaggagtctgggtgc

SEQ ID NO: 45459 - DNA, 25 bp, Homo sapien
cactcgctcccgcaaggagtctggg

SEQ ID NO: 45460 - DNA, 25 bp, Homo sapien
agtggccgatgacctcgctgtaggt

SEQ ID NO: 45461 - DNA, 25 bp, Homo sapien
gcgctgatgcccgagttactgctgg

SEQ ID NO: 45462 - DNA, 25 bp, Homo sapien
cagcctggcactatccatcaggtca

SEQ ID NO: 45463 - DNA, 25 bp, Homo sapien
atcaggtcactgtcgaagatggttc

SEQ ID NO: 45464 - DNA, 25 bp, Homo sapien
ccgctgccgtagcacgtggcgctga

SEQ ID NO: 45465 - DNA, 25 bp, Homo sapien
caggtcgatctcgtgctgcaggtac

SEQ ID NO: 45466 - DNA, 25 bp, Homo sapien
tctcgtgctgcaggtacggataggt

SEQ ID NO: 45467 - DNA, 25 bp, Homo sapien
cactgtcgaagatggttctgtttgg

SEQ ID NO: 45468 - DNA, 25 bp, Homo sapien
agaatcctcttcgtgcctgcatttg

SEQ ID NO: 45469 - DNA, 25 bp, Homo sapien
tcaggatcagatgcctcgcgggcaa

SEQ ID NO: 45470 - DNA, 25 bp, Homo sapien
gcccattcccagtcgcagcttgaga

SEQ ID NO: 45471 - DNA, 25 bp, Homo sapien
tcgcagcttgagagccggactctca

SEQ ID NO: 45472 - DNA, 25 bp, Homo sapien
ggcagctcgcagaatcctcttcgtg

SEQ ID NO: 45473 - DNA, 25 bp, Homo sapien
cggcaccaatataaacacggctctc

SEQ ID NO: 45474 - DNA, 25 bp, Homo sapien
ccggactctcaggatcagatgcctc

SEQ ID NO: 45475 - DNA, 25 bp, Homo sapien
gcctgcatttgttccgaggagcgca

SEQ ID NO: 45476 - DNA, 25 bp, Homo sapien
ttggtaaccagcagatgtttctctc

SEQ ID NO: 45477 - DNA, 25 bp, Homo sapien
gccgcttctcaatagtgcctcattc

SEQ ID NO: 45478 - DNA, 25 bp, Homo sapien
cctggatcaggaagcacaatgcggc

SEQ ID NO: 45479 - DNA, 25 bp, Homo sapien
tcttggacaaaaagcgaagccctgg

SEQ ID NO: 45480 - DNA, 25 bp, Homo sapien
cggccgacagtgacgcacgtatgcc

SEQ ID NO: 45481 - DNA, 25 bp, Homo sapien
catgtgtgtttccaaccggccgaca

SEQ ID NO: 45482 - DNA, 25 bp, Homo sapien
gtgcctgcatgcactcacatgtgtg

SEQ ID NO: 45483 - DNA, 25 bp, Homo sapien
agcacctcgtgctccttggtaacca

SEQ ID NO: 45484 - DNA, 25 bp, Homo sapien
ccaaagttgataaagagccggccta

SEQ ID NO: 45485 - DNA, 25 bp, Homo sapien
tgatctccatgctctggaacaaaga

SEQ ID NO: 45486 - DNA, 25 bp, Homo sapien
gcgtggggtcactcactgatctcca

SEQ ID NO: 45487 - DNA, 25 bp, Homo sapien
aatggaaacttcacggatccgcccg

SEQ ID NO: 45488 - DNA, 25 bp, Homo sapien
tccatcgcgactgccctcagggaaa

SEQ ID NO: 45489 - DNA, 25 bp, Homo sapien
agccggcctaaatgctccatcgcga

SEQ ID NO: 45490 - DNA, 25 bp, Homo sapien
ttgcacgtgcaggagacattgggct

SEQ ID NO: 45491 - DNA, 25 bp, Homo sapien
ggagatcgggtttcgctccgagacc

SEQ ID NO: 45492 - DNA, 25 bp, Homo sapien
tttaaatccacgtggtggctgcggg

SEQ ID NO: 45493 - DNA, 25 bp, Homo sapien
gcggctgcgtgggttttaaatccac

SEQ ID NO: 45494 - DNA, 25 bp, Homo sapien
ttggatacaagtgctggtggcctcg

SEQ ID NO: 45495 - DNA, 25 bp, Homo sapien
attccgggagaagcacgatctattg

SEQ ID NO: 45496 - DNA, 25 bp, Homo sapien
cggccaatcccaagtttggattccg

SEQ ID NO: 45497 - DNA, 25 bp, Homo sapien
tgggcagcccgaaatgacacagcta

SEQ ID NO: 45498 - DNA, 25 bp, Homo sapien
ggctcctttaacagcggccaagaca

SEQ ID NO: 45499 - DNA, 25 bp, Homo sapien
tgccagacaggctgacgtcatgggc

SEQ ID NO: 45500 - DNA, 25 bp, Homo sapien
cagaagtttgcccacgtgctccggc

SEQ ID NO: 45501 - DNA, 25 bp, Homo sapien
ccggccgcctgagatatggagttaa

SEQ ID NO: 45502 - DNA, 25 bp, Homo sapien
ctctgggctgcgcattcatttttag

SEQ ID NO: 45503 - DNA, 25 bp, Homo sapien
tcatttttagattccggcctcctcc

SEQ ID NO: 45504 - DNA, 25 bp, Homo sapien
ttcttagaaagcaaactggggtgtg

SEQ ID NO: 45505 - DNA, 25 bp, Homo sapien
cttgggcttcgcagggaagtcagac

SEQ ID NO: 45506 - DNA, 25 bp, Homo sapien
cgcagggaagtcagacagaagtttg

SEQ ID NO: 45507 - DNA, 25 bp, Homo sapien
cggcaggttcattggccggaaacgc

SEQ ID NO: 45508 - DNA, 25 bp, Homo sapien
ggacccaagcgacgcggcgaaagca

SEQ ID NO: 45509 - DNA, 25 bp, Homo sapien
ggcctcatggcgcagaaacctctca

SEQ ID NO: 45510 - DNA, 25 bp, Homo sapien
atctggtaacgcctgggatcgggca

SEQ ID NO: 45511 - DNA, 25 bp, Homo sapien
accttgtgggtcaggatgagatctg

SEQ ID NO: 45512 - DNA, 25 bp, Homo sapien
tgcagagccatttccgcctccgagt

SEQ ID NO: 45513 - DNA, 25 bp, Homo sapien
gcggctgaacgcatgaaccttgtgg

SEQ ID NO: 45514 - DNA, 25 bp, Homo sapien
tccgagtcctgcgttgcctggcaac

SEQ ID NO: 45515 - DNA, 25 bp, Homo sapien
ctggcaaccggtctcccaggagacg

SEQ ID NO: 45516 - DNA, 25 bp, Homo sapien
gcaggctgaggaacactgatgaacg

SEQ ID NO: 45517 - DNA, 25 bp, Homo sapien
ctgatgaacgacctcctgcaaagga

SEQ ID NO: 45518 - DNA, 25 bp, Homo sapien
caggggccaggctgaaaaacaatgc

SEQ ID NO: 45519 - DNA, 25 bp, Homo sapien
cggccacgcactggggtctcacagg

SEQ ID NO: 45520 - DNA, 25 bp, Homo sapien
ccacgcctggagttgcaggaaccgg

SEQ ID NO: 45521 - DNA, 25 bp, Homo sapien
tcagggtcgtttgcacgaaggcaga

SEQ ID NO: 45522 - DNA, 25 bp, Homo sapien
agcaggacggcgcagcgtctacacc

SEQ ID NO: 45523 - DNA, 25 bp, Homo sapien
tgaaaaacaatgcacgccttaaagg

SEQ ID NO: 45524 - DNA, 25 bp, Homo sapien
gaagacgcctcccacgtcccgtctg

SEQ ID NO: 45525 - DNA, 25 bp, Homo sapien
tccgcacctgaagacgcctcccacg

SEQ ID NO: 45526 - DNA, 25 bp, Homo sapien
cccacacctgaagacgcctcccacg

SEQ ID NO: 45527 - DNA, 25 bp, Homo sapien
cccgcacctgaagacgcctcccacg

SEQ ID NO: 45528 - DNA, 25 bp, Homo sapien
tgcgcccgcacctgaagacgcctcc

SEQ ID NO: 45529 - DNA, 25 bp, Homo sapien
tctgcgcccgcacctgaagacgcct

SEQ ID NO: 45530 - DNA, 25 bp, Homo sapien
tgcacccacacctgaagacacctcc

SEQ ID NO: 45531 - DNA, 25 bp, Homo sapien
ctgcacccacacctgaagacacctc

SEQ ID NO: 45532 - DNA, 25 bp, Homo sapien
agccgcacccgcaggacgaagacgt

SEQ ID NO: 45533 - DNA, 25 bp, Homo sapien
aggttgaaggggatgccgaccatca

SEQ ID NO: 45534 - DNA, 25 bp, Homo sapien
gcggcagtttgccactcggaacatc

SEQ ID NO: 45535 - DNA, 25 bp, Homo sapien
ccgcgatgaacaaagccgcagtttc

SEQ ID NO: 45536 - DNA, 25 bp, Homo sapien
cgcgggagacggttcttaaataatg

SEQ ID NO: 45537 - DNA, 25 bp, Homo sapien
gaacaggacataagtgcttcccaga

SEQ ID NO: 45538 - DNA, 25 bp, Homo sapien
cttcccagagcaaccgggagattta

SEQ ID NO: 45539 - DNA, 25 bp, Homo sapien
tttgagctcccgcacggtcatgtcg

SEQ ID NO: 45540 - DNA, 25 bp, Homo sapien
ccagcctcaggagatgcatgggccc

SEQ ID NO: 45541 - DNA, 25 bp, Homo sapien
tgcctccgctggtgtttcttattcg

SEQ ID NO: 45542 - DNA, 25 bp, Homo sapien
tacctgcctccgctggtgtttctta

SEQ ID NO: 45543 - DNA, 25 bp, Homo sapien
aggtcttcgcgtggagaccaaggtc

SEQ ID NO: 45544 - DNA, 25 bp, Homo sapien
ccctgggtgcatccgcgcagcctcc

SEQ ID NO: 45545 - DNA, 25 bp, Homo sapien
tgggccgacgaaggctcagcgctga

SEQ ID NO: 45546 - DNA, 25 bp, Homo sapien
ttcagagacccctacccatggcggg

SEQ ID NO: 45547 - DNA, 25 bp, Homo sapien
accagccagcgaggcaccttggggc

SEQ ID NO: 45548 - DNA, 25 bp, Homo sapien
gaccctggcttatctggttccctta

SEQ ID NO: 45549 - DNA, 25 bp, Homo sapien
ctctccctaggggtgatagaaatca

SEQ ID NO: 45550 - DNA, 25 bp, Homo sapien
ggcggggtcttattagcataatctg

SEQ ID NO: 45551 - DNA, 25 bp, Homo sapien
gcctggcaacctgatctcgacgtta

SEQ ID NO: 45552 - DNA, 25 bp, Homo sapien
cccatgccgtgcctagagacgagaa

SEQ ID NO: 45553 - DNA, 25 bp, Homo sapien
cgtgctctgctgttcgtgtaaaacc

SEQ ID NO: 45554 - DNA, 25 bp, Homo sapien
gcgccattttgggtgggactaagca

SEQ ID NO: 45555 - DNA, 25 bp, Homo sapien
ggcccagatttaggagtcatgacga

SEQ ID NO: 45556 - DNA, 25 bp, Homo sapien
tcgggctgagctagacgcccgcagc

SEQ ID NO: 45557 - DNA, 25 bp, Homo sapien
tccgcctcccggatggtaatcagcg

SEQ ID NO: 45558 - DNA, 25 bp, Homo sapien
gggctgagctagacgcccgcagcct

SEQ ID NO: 45559 - DNA, 25 bp, Homo sapien
cgcgcactgagccacccggactcgg

SEQ ID NO: 45560 - DNA, 25 bp, Homo sapien
caagaggcgagcgcgcactgagcca

SEQ ID NO: 45561 - DNA, 25 bp, Homo sapien
cggatggtaatcagcgccccgcgct

SEQ ID NO: 45562 - DNA, 25 bp, Homo sapien
cgcggacccgctttctccgagggag

SEQ ID NO: 45563 - DNA, 25 bp, Homo sapien
agcctcagcgggaccggatccgggg

SEQ ID NO: 45564 - DNA, 25 bp, Homo sapien
ccatggcgctgagggagctcaaagt

SEQ ID NO: 45565 - DNA, 25 bp, Homo sapien
aagacgctgtctgccagccccgtgg

SEQ ID NO: 45566 - DNA, 25 bp, Homo sapien
gccaggggatgctcttgctgggcct

SEQ ID NO: 45567 - DNA, 25 bp, Homo sapien
cccttctcaacttagggcggcggcg

SEQ ID NO: 45568 - DNA, 25 bp, Homo sapien
aagtgtgtctgctcggggtgagtgg

SEQ ID NO: 45569 - DNA, 25 bp, Homo sapien
cctcccacgtccaagacgctgtctg

SEQ ID NO: 45570 - DNA, 25 bp, Homo sapien
ctggcagcggacaggccggacctac

SEQ ID NO: 45571 - DNA, 25 bp, Homo sapien
tctcccttctcaacttagggcggcg

SEQ ID NO: 45572 - DNA, 25 bp, Homo sapien
cccttaatagtttccgcggtggctg

SEQ ID NO: 45573 - DNA, 25 bp, Homo sapien
cgagctcaaattccgaggtaagccc

SEQ ID NO: 45574 - DNA, 25 bp, Homo sapien
agccgcagcacgagctcaaattccg

SEQ ID NO: 45575 - DNA, 25 bp, Homo sapien
gtgctccgccgctaaggaacatggc

SEQ ID NO: 45576 - DNA, 25 bp, Homo sapien
agcgggcgcagcattaacgcttccc

SEQ ID NO: 45577 - DNA, 25 bp, Homo sapien
ttgtaaaacttaaagcgggcgcagc

SEQ ID NO: 45578 - DNA, 25 bp, Homo sapien
tggctgtcgtagctggactacagac

SEQ ID NO: 45579 - DNA, 25 bp, Homo sapien
tgcgtgtgtacgactctgcgtgcgt

SEQ ID NO: 45580 - DNA, 25 bp, Homo sapien
agcggccggcggcatacacggtgaa

SEQ ID NO: 45581 - DNA, 25 bp, Homo sapien
aacaggactgctgggcgcacctcgc

SEQ ID NO: 45582 - DNA, 25 bp, Homo sapien
catcggagcgggcaatgaggccaca

SEQ ID NO: 45583 - DNA, 25 bp, Homo sapien
aggaacaggactgctgggcgcacct

SEQ ID NO: 45584 - DNA, 25 bp, Homo sapien
gtgcccgtggaaagtgaagagccgg

SEQ ID NO: 45585 - DNA, 25 bp, Homo sapien
ccaggagcggctgtgcccgtggaaa

SEQ ID NO: 45586 - DNA, 25 bp, Homo sapien
ctgagaagtggtggtaatacccttc

SEQ ID NO: 45587 - DNA, 25 bp, Homo sapien
ggtctgagaagtggtggtaataccc

SEQ ID NO: 45588 - DNA, 25 bp, Homo sapien
attggtcctgatcgtcggcctgacc

SEQ ID NO: 45589 - DNA, 25 bp, Homo sapien
cgtttattggtcctgatcgtcggcc

SEQ ID NO: 45590 - DNA, 25 bp, Homo sapien
ccatccacgtttattggtcctgatc

SEQ ID NO: 45591 - DNA, 25 bp, Homo sapien
tccctaattcatccatccacgttta

SEQ ID NO: 45592 - DNA, 25 bp, Homo sapien
gcgccctggaggaaagctgccctct

SEQ ID NO: 45593 - DNA, 25 bp, Homo sapien
tgaggctcgcactgagatttcgagg

SEQ ID NO: 45594 - DNA, 25 bp, Homo sapien
gctaggtcagtgtgaggctcgcact

SEQ ID NO: 45595 - DNA, 25 bp, Homo sapien
atcgtcggcctgacccgtgctaggt

SEQ ID NO: 45596 - DNA, 25 bp, Homo sapien
tgcacgcggaccaggctgagctcgt

SEQ ID NO: 45597 - DNA, 25 bp, Homo sapien
tcctcgtagtagaactggtgggctc

SEQ ID NO: 45598 - DNA, 25 bp, Homo sapien
cgcagaaggggtcctcgtagtagaa

SEQ ID NO: 45599 - DNA, 25 bp, Homo sapien
ctttgcccttgacgagcagcgagtg

SEQ ID NO: 45600 - DNA, 25 bp, Homo sapien
caggcggactttgcccttgacgagc

SEQ ID NO: 45601 - DNA, 25 bp, Homo sapien
ctgagctcgtgcatggtgaggccca

SEQ ID NO: 45602 - DNA, 25 bp, Homo sapien
tagtagaactggtgggctcgaaaga

SEQ ID NO: 45603 - DNA, 25 bp, Homo sapien
ccttgtgcaggtggtagtcggcctc

SEQ ID NO: 45604 - DNA, 25 bp, Homo sapien
tcctgcgaagaagttgcgagggtcc

SEQ ID NO: 45605 - DNA, 25 bp, Homo sapien
taggggacattagacggcgagctcc

SEQ ID NO: 45606 - DNA, 25 bp, Homo sapien
ccttcccggctgttgatagttgtaa

SEQ ID NO: 45607 - DNA, 25 bp, Homo sapien
ccaaagtcttcgcagtgggcaagga

SEQ ID NO: 45608 - DNA, 25 bp, Homo sapien
gctgcgcactcataggtccaacttg

SEQ ID NO: 45609 - DNA, 25 bp, Homo sapien
cttccgagctcagccagtttgccgg

SEQ ID NO: 45610 - DNA, 25 bp, Homo sapien
gagtgcagcggctctcatattgcga

SEQ ID NO: 45611 - DNA, 25 bp, Homo sapien
catattgcgaggtgacgcgactccc

SEQ ID NO: 45612 - DNA, 25 bp, Homo sapien
ccgcgcccaaaacttcagttcttgg

SEQ ID NO: 45613 - DNA, 25 bp, Homo sapien
gctttgcaagcgctcagcacacggg

SEQ ID NO: 45614 - DNA, 25 bp, Homo sapien
cacacacgtgtgtaaagtttgttcc

SEQ ID NO: 45615 - DNA, 25 bp, Homo sapien
tgttccacgcagaaacaaaggacgc

SEQ ID NO: 45616 - DNA, 25 bp, Homo sapien
ttgagattccacgaccctgcagtgc

SEQ ID NO: 45617 - DNA, 25 bp, Homo sapien
cagaggcagtcgtctccaacttttc

SEQ ID NO: 45618 - DNA, 25 bp, Homo sapien
ggagcccaaatttgcctgccgcgca

SEQ ID NO: 45619 - DNA, 25 bp, Homo sapien
cggatacatctttttccagagtggg

SEQ ID NO: 45620 - DNA, 25 bp, Homo sapien
gccctgcacgtctcgcgagcagccc

SEQ ID NO: 45621 - DNA, 25 bp, Homo sapien
gcgcggtggtcctcctgtcagccca

SEQ ID NO: 45622 - DNA, 25 bp, Homo sapien
gtgggcttgggcctacgtcggccca

SEQ ID NO: 45623 - DNA, 25 bp, Homo sapien
gccctactcggcagggcctgctcgg

SEQ ID NO: 45624 - DNA, 25 bp, Homo sapien
aagatggcgaacgtggggctgcagt

SEQ ID NO: 45625 - DNA, 25 bp, Homo sapien
gcaccgcgtgccctggagccacgtc

SEQ ID NO: 45626 - DNA, 25 bp, Homo sapien
cctggagccacgtccgcgggaagct

SEQ ID NO: 45627 - DNA, 25 bp, Homo sapien
cgccggccgccatgcgacccgcgcc

SEQ ID NO: 45628 - DNA, 25 bp, Homo sapien
agcgtcatatgcgagccgcaggaga

SEQ ID NO: 45629 - DNA, 25 bp, Homo sapien
gtcgatcaaagtgaccacacaaacc

SEQ ID NO: 45630 - DNA, 25 bp, Homo sapien
cgaccatctgtcgatcaaagtgacc

SEQ ID NO: 45631 - DNA, 25 bp, Homo sapien
gcctcctcccgagagcaaacgtgga

SEQ ID NO: 45632 - DNA, 25 bp, Homo sapien
tttgtccaagcgtcatatgcgagcc

SEQ ID NO: 45633 - DNA, 25 bp, Homo sapien
cgccagtgttccttattcgaccatc

SEQ ID NO: 45634 - DNA, 25 bp, Homo sapien
gctttgccgtcgcagtacctccaca

SEQ ID NO: 45635 - DNA, 25 bp, Homo sapien
gcaaacgtggagctatttgtccaag

SEQ ID NO: 45636 - DNA, 25 bp, Homo sapien
ggctggtgaagccacactcgcccag

SEQ ID NO: 45637 - DNA, 25 bp, Homo sapien
ggcggccgcttgaggattccctcca

SEQ ID NO: 45638 - DNA, 25 bp, Homo sapien
tcttgccatcatccaagagttggta

SEQ ID NO: 45639 - DNA, 25 bp, Homo sapien
tgaggattccctccacgacgcgctt

SEQ ID NO: 45640 - DNA, 25 bp, Homo sapien
gtgccgtttggctggtgaagccaca

SEQ ID NO: 45641 - DNA, 25 bp, Homo sapien
cctcaaaggcgtcgtgtgcccggaa

SEQ ID NO: 45642 - DNA, 25 bp, Homo sapien
acggctcgatgcacagggcctcaaa

SEQ ID NO: 45643 - DNA, 25 bp, Homo sapien
gagttggtagtccttgtacagccgc

SEQ ID NO: 45644 - DNA, 25 bp, Homo sapien
gcaccggcgaggatggcaccgcatc

SEQ ID NO: 45645 - DNA, 25 bp, Homo sapien
accggcgaggatggcaccgcatcct

SEQ ID NO: 45646 - DNA, 25 bp, Homo sapien
cggcgaggatggcaccgcatcctgc

SEQ ID NO: 45647 - DNA, 25 bp, Homo sapien
gcgaggatggcaccgcatcctgcag

SEQ ID NO: 45648 - DNA, 25 bp, Homo sapien
ctttcccgaggaggcgtcagtgagg

SEQ ID NO: 45649 - DNA, 25 bp, Homo sapien
acccacgggagactgtggcagaggc

SEQ ID NO: 45650 - DNA, 25 bp, Homo sapien
acggcgagttcaccattccccagtg

SEQ ID NO: 45651 - DNA, 25 bp, Homo sapien
gcgcggcacggcgagttcaccattc

SEQ ID NO: 45652 - DNA, 25 bp, Homo sapien
ttgcaggtcgtgttcggaaacgtgc

SEQ ID NO: 45653 - DNA, 25 bp, Homo sapien
ctggccgtgtccgacaacatgtttg

SEQ ID NO: 45654 - DNA, 25 bp, Homo sapien
ttgtgcacaacaactccaagcatgg

SEQ ID NO: 45655 - DNA, 25 bp, Homo sapien
gcggcgccaccgtcattgtcatcgg

SEQ ID NO: 45656 - DNA, 25 bp, Homo sapien
caacttcttcgacgggttgcaggtc

SEQ ID NO: 45657 - DNA, 25 bp, Homo sapien
cagtctccctctgggcctaggggct

SEQ ID NO: 45658 - DNA, 25 bp, Homo sapien
tggaggtgaccctctcctacaagtc

SEQ ID NO: 45659 - DNA, 25 bp, Homo sapien
ttgtcatcggcgacaacttcttcga

SEQ ID NO: 45660 - DNA, 25 bp, Homo sapien
cgcccatcgcttcgcccaaatcctt

SEQ ID NO: 45661 - DNA, 25 bp, Homo sapien
cttcgcccaaatcctttcaaacaag

SEQ ID NO: 45662 - DNA, 25 bp, Homo sapien
gcttcgcccaaatcctttcaaacaa

SEQ ID NO: 45663 - DNA, 25 bp, Homo sapien
atcgcttcgcccaaatcctttcaaa

SEQ ID NO: 45664 - DNA, 25 bp, Homo sapien
ccgcccatcgcttcgcccaaatcct

SEQ ID NO: 45665 - DNA, 25 bp, Homo sapien
ggccccccgcccatcgcttcgccca

SEQ ID NO: 45666 - DNA, 25 bp, Homo sapien
tcgcttcgcccaaatcctttcaaac

SEQ ID NO: 45667 - DNA, 25 bp, Homo sapien
cgcttcgcccaaatcctttcaaaca

SEQ ID NO: 45668 - DNA, 25 bp, Homo sapien
agtccgggcgcgcaacttcgcagaa

SEQ ID NO: 45669 - DNA, 25 bp, Homo sapien
tccttactgcacatgcccggcagaa

SEQ ID NO: 45670 - DNA, 25 bp, Homo sapien
gggcgcgcaacttcgcagaacctca

SEQ ID NO: 45671 - DNA, 25 bp, Homo sapien
cggaggcacctctctcgagtcttag

SEQ ID NO: 45672 - DNA, 25 bp, Homo sapien
ctctcgagtcttaggctgcggaatc

SEQ ID NO: 45673 - DNA, 25 bp, Homo sapien
ctgcggaatctaagactcagcgaga

SEQ ID NO: 45674 - DNA, 25 bp, Homo sapien
gaatctaagactcagcgagaggagc

SEQ ID NO: 45675 - DNA, 25 bp, Homo sapien
cggcccactagggtctgcgccacag

SEQ ID NO: 45676 - DNA, 25 bp, Homo sapien
gctgacaattaagccgcgggacctc

SEQ ID NO: 45677 - DNA, 25 bp, Homo sapien
cgtcccgctggagacaacctgaggt

SEQ ID NO: 45678 - DNA, 25 bp, Homo sapien
gattcaggttagttgcccaccgcta

SEQ ID NO: 45679 - DNA, 25 bp, Homo sapien
gaggacgccgtccagattctccttg

SEQ ID NO: 45680 - DNA, 25 bp, Homo sapien
ccgcgctgtagagacaccgttgaaa

SEQ ID NO: 45681 - DNA, 25 bp, Homo sapien
aactctagagactgaccacccggga

SEQ ID NO: 45682 - DNA, 25 bp, Homo sapien
cgcgcgccaactttcacgatgtgag

SEQ ID NO: 45683 - DNA, 25 bp, Homo sapien
gcccaggtcccagagctgacaatta

SEQ ID NO: 45684 - DNA, 25 bp, Homo sapien
gagcagcgcacctcagctccggttg

SEQ ID NO: 45685 - DNA, 25 bp, Homo sapien
taccctaagatacccagagcgagag

SEQ ID NO: 45686 - DNA, 25 bp, Homo sapien
tggggctaaaggagctgactgacca

SEQ ID NO: 45687 - DNA, 25 bp, Homo sapien
gccgcgcggcatggtatttatctgt

SEQ ID NO: 45688 - DNA, 25 bp, Homo sapien
gcgcacagcgttgtccagtctcgaa

SEQ ID NO: 45689 - DNA, 25 bp, Homo sapien
tgtccagtctcgaaaccaccctaaa

SEQ ID NO: 45690 - DNA, 25 bp, Homo sapien
cgcctcagtgggctctagcagtaga

SEQ ID NO: 45691 - DNA, 25 bp, Homo sapien
tatctgtgggttcagtgcgcacagc

SEQ ID NO: 45692 - DNA, 25 bp, Homo sapien
tccaaatcagtcagggagaggagtg

SEQ ID NO: 45693 - DNA, 25 bp, Homo sapien
gaagcgaggagaaagactccaaatc

SEQ ID NO: 45694 - DNA, 25 bp, Homo sapien
ctttctctggccagcggagaagcga

SEQ ID NO: 45695 - DNA, 25 bp, Homo sapien
gagcgctttctctggccagcggaga

SEQ ID NO: 45696 - DNA, 25 bp, Homo sapien
aacgcaggagcgctttctctggcca

SEQ ID NO: 45697 - DNA, 25 bp, Homo sapien
gtcccgcaacgcaggagcgctttct

SEQ ID NO: 45698 - DNA, 25 bp, Homo sapien
acgtcttgcgtcacgtgtcccgcaa

SEQ ID NO: 45699 - DNA, 25 bp, Homo sapien
gtggaaggagccaaaacgtccctgc

SEQ ID NO: 45700 - DNA, 25 bp, Homo sapien
gcccatccccgtcgagaatgatggc

SEQ ID NO: 45701 - DNA, 25 bp, Homo sapien
gagcccatccccgtcgagaatgatg

SEQ ID NO: 45702 - DNA, 25 bp, Homo sapien
cccatccccgtcgagaatgatggcg

SEQ ID NO: 45703 - DNA, 25 bp, Homo sapien
agcccatccccgtcgagaatgatgg

SEQ ID NO: 45704 - DNA, 25 bp, Homo sapien
aacgagcccatccccgtcgagaatg

SEQ ID NO: 45705 - DNA, 25 bp, Homo sapien
acaacgagcccatccccgtcgagaa

SEQ ID NO: 45706 - DNA, 25 bp, Homo sapien
tcacaacgagcccatccccgtcgag

SEQ ID NO: 45707 - DNA, 25 bp, Homo sapien
acgagcccatccccgtcgagaatga

SEQ ID NO: 45708 - DNA, 25 bp, Homo sapien
atggagaccgaaccgcctcacaacg

SEQ ID NO: 45709 - DNA, 25 bp, Homo sapien
tgcctctacggcaataatatgtcag

SEQ ID NO: 45710 - DNA, 25 bp, Homo sapien
atatgtcaggacaacgcgatatccc

SEQ ID NO: 45711 - DNA, 25 bp, Homo sapien
cctgaaatcggggaacagcccgagc

SEQ ID NO: 45712 - DNA, 25 bp, Homo sapien
cgccaccgtgttatgggcgtgcgca

SEQ ID NO: 45713 - DNA, 25 bp, Homo sapien
cagcccgagcaaccacctttggagg

SEQ ID NO: 45714 - DNA, 25 bp, Homo sapien
cctagcccagccgaagagatggaga

SEQ ID NO: 45715 - DNA, 25 bp, Homo sapien
tatgggcgtgcgcaactgcctctac

SEQ ID NO: 45716 - DNA, 25 bp, Homo sapien
tccgctggtttcagcatcggcgaaa

SEQ ID NO: 45717 - DNA, 25 bp, Homo sapien
aactttctcgtgcaagccttcgggg

SEQ ID NO: 45718 - DNA, 25 bp, Homo sapien
ctgcttcggtcgatctgagagtccc

SEQ ID NO: 45719 - DNA, 25 bp, Homo sapien
ggctacatgtgtacgcaccgcctgc

SEQ ID NO: 45720 - DNA, 25 bp, Homo sapien
cgcctgctgcttctaggtaatgcgg

SEQ ID NO: 45721 - DNA, 25 bp, Homo sapien
ggggccagacgcaagatccatctca

SEQ ID NO: 45722 - DNA, 25 bp, Homo sapien
ggccgaagtatatgccctccaggga

SEQ ID NO: 45723 - DNA, 25 bp, Homo sapien
ctccaggacgaaaagatgggctaca

SEQ ID NO: 45724 - DNA, 25 bp, Homo sapien
caggaccgactgactgtgtgtgcgc

SEQ ID NO: 45725 - DNA, 25 bp, Homo sapien
ctctttttccgcgaggcctacacga

SEQ ID NO: 45726 - DNA, 25 bp, Homo sapien
aggcctacacgacgccaggggtttg

SEQ ID NO: 45727 - DNA, 25 bp, Homo sapien
ctgcagaaggacaagcaggtctacc

SEQ ID NO: 45728 - DNA, 25 bp, Homo sapien
taagaccgaggaccagcgcaacgag

SEQ ID NO: 45729 - DNA, 25 bp, Homo sapien
ggctccggagactgcgacaaaaaga

SEQ ID NO: 45730 - DNA, 25 bp, Homo sapien
acccgcctccgtggggtgtgagatt

SEQ ID NO: 45731 - DNA, 25 bp, Homo sapien
ctgcctcgggaacagtaagaccgag

SEQ ID NO: 45732 - DNA, 25 bp, Homo sapien
ctccgtccgggcgtcgcaaataatt

SEQ ID NO: 45733 - DNA, 25 bp, Homo sapien
cttcggtttataggggccgctgcta

SEQ ID NO: 45734 - DNA, 25 bp, Homo sapien
ttcgaattcggctctctgacaccta

SEQ ID NO: 45735 - DNA, 25 bp, Homo sapien
cgcgcctttgcacttttctttttga

SEQ ID NO: 45736 - DNA, 25 bp, Homo sapien
gggctacaccactcaccgaaaattg

SEQ ID NO: 45737 - DNA, 25 bp, Homo sapien
gcgcctgagggtaaacagactcctg

SEQ ID NO: 45738 - DNA, 25 bp, Homo sapien
tgcacctcactcacatgtaagtcgg

SEQ ID NO: 45739 - DNA, 25 bp, Homo sapien
ccatcgcacttttctcgtccgaaga

SEQ ID NO: 45740 - DNA, 25 bp, Homo sapien
tccttttcggttgctctgtcctttg

SEQ ID NO: 45741 - DNA, 25 bp, Homo sapien
tctgtcctttggttcgtgctcgcct

SEQ ID NO: 45742 - DNA, 25 bp, Homo sapien
tgtgtctctcgctctttcgaaaatt

SEQ ID NO: 45743 - DNA, 25 bp, Homo sapien
attttcctaagtccgggcgcgcgct

SEQ ID NO: 45744 - DNA, 25 bp, Homo sapien
cctcgtgggtgctcaacttcctgct

SEQ ID NO: 45745 - DNA, 25 bp, Homo sapien
cgacctgctgcttccgagtgttcct

SEQ ID NO: 45746 - DNA, 25 bp, Homo sapien
gaggagcggctcatctagtcagacc

SEQ ID NO: 45747 - DNA, 25 bp, Homo sapien
cagacaccaccatcgctgtgtagtg

SEQ ID NO: 45748 - DNA, 25 bp, Homo sapien
catggacgaggactactacgggagc

SEQ ID NO: 45749 - DNA, 25 bp, Homo sapien
ggcgcaccctagagagaatcgttcg

SEQ ID NO: 45750 - DNA, 25 bp, Homo sapien
caccctagagagaatcgttcgtctc

SEQ ID NO: 45751 - DNA, 25 bp, Homo sapien
cccgcgcggtcaccgtgtggttcaa

SEQ ID NO: 45752 - DNA, 25 bp, Homo sapien
gcggtcaccgtgtggttcaagcaca

SEQ ID NO: 45753 - DNA, 25 bp, Homo sapien
accgtgtggttcaagcacagcccgc

SEQ ID NO: 45754 - DNA, 25 bp, Homo sapien
agagaatcgttcgtctccgccgccg

SEQ ID NO: 45755 - DNA, 25 bp, Homo sapien
atcatggacgaggactactacggga

SEQ ID NO: 45756 - DNA, 25 bp, Homo sapien
gctttgccaccttcgattcggatga

SEQ ID NO: 45757 - DNA, 25 bp, Homo sapien
cccgaggccaacacgtgtatctttg

SEQ ID NO: 45758 - DNA, 25 bp, Homo sapien
gggttgtcaagtccgtccgcaccaa

SEQ ID NO: 45759 - DNA, 25 bp, Homo sapien
aatacaaggtctcgtcctgcgctgg

SEQ ID NO: 45760 - DNA, 25 bp, Homo sapien
ggccacatggtgagatccctacctg

SEQ ID NO: 45761 - DNA, 25 bp, Homo sapien
cccggtgttgctggaactgcaagaa

SEQ ID NO: 45762 - DNA, 25 bp, Homo sapien
tcccagatggctgtagggtccgata

SEQ ID NO: 45763 - DNA, 25 bp, Homo sapien
ggggaagctgcgcacatttatgtca

SEQ ID NO: 45764 - DNA, 25 bp, Homo sapien
ggactgtccggctggactcatttgc

SEQ ID NO: 45765 - DNA, 25 bp, Homo sapien
gctggactcatttgccggggttcct

SEQ ID NO: 45766 - DNA, 25 bp, Homo sapien
tggctccggggcacctgaactcgcg

SEQ ID NO: 45767 - DNA, 25 bp, Homo sapien
gggctgtcccatcgctgctcctgcc

SEQ ID NO: 45768 - DNA, 25 bp, Homo sapien
cgctccgagtcccagatcccgcgcc

SEQ ID NO: 45769 - DNA, 25 bp, Homo sapien
cagaggccggtagcaggtctgtccc

SEQ ID NO: 45770 - DNA, 25 bp, Homo sapien
ccttccaaggcctgttggcgacgca

SEQ ID NO: 45771 - DNA, 25 bp, Homo sapien
tggatctgaccttccaaggcctgtt

SEQ ID NO: 45772 - DNA, 25 bp, Homo sapien
gttcccgggtcagctcaacgcagac

SEQ ID NO: 45773 - DNA, 25 bp, Homo sapien
atggctgcctgtgacctccgccgtg

SEQ ID NO: 45774 - DNA, 25 bp, Homo sapien
gcccgcaataccatggctgcctgtg

SEQ ID NO: 45775 - DNA, 25 bp, Homo sapien
ttcgatgcccgcaataccatggctg

SEQ ID NO: 45776 - DNA, 25 bp, Homo sapien
cagatgttcgatgcccgcaatacca

SEQ ID NO: 45777 - DNA, 25 bp, Homo sapien
taccgagccctctccgtggccgagc

SEQ ID NO: 45778 - DNA, 25 bp, Homo sapien
aataccatggctgcctgtgacctcc

SEQ ID NO: 45779 - DNA, 25 bp, Homo sapien
gccagcagtaccgagccctctccgt

SEQ ID NO: 45780 - DNA, 25 bp, Homo sapien
ctaacgcggaaaggctgagcagaga

SEQ ID NO: 45781 - DNA, 25 bp, Homo sapien
tcatcgagcccttcgagggacactc

SEQ ID NO: 45782 - DNA, 25 bp, Homo sapien
gctccagtctaacgcggaaaggctg

SEQ ID NO: 45783 - DNA, 25 bp, Homo sapien
cccggagctccagtctaacgcggaa

SEQ ID NO: 45784 - DNA, 25 bp, Homo sapien
cactcggtagtgaccctacttagcc

SEQ ID NO: 45785 - DNA, 25 bp, Homo sapien
ggacactcggtagtgaccctactta

SEQ ID NO: 45786 - DNA, 25 bp, Homo sapien
cccttcgagggacactcggtagtga

SEQ ID NO: 45787 - DNA, 25 bp, Homo sapien
ctgagcagagaaccgcatggggtgg

SEQ ID NO: 45788 - DNA, 25 bp, Homo sapien
ctgtctccagtaggccaccatgctg

SEQ ID NO: 45789 - DNA, 25 bp, Homo sapien
gaagcccttccctctggaggcctgg

SEQ ID NO: 45790 - DNA, 25 bp, Homo sapien
gctttgcgcccgcttcagggaaacg

SEQ ID NO: 45791 - DNA, 25 bp, Homo sapien
taaggaccactgagccgcgtgcttt

SEQ ID NO: 45792 - DNA, 25 bp, Homo sapien
agccgcaggaagatcagaccacaga

SEQ ID NO: 45793 - DNA, 25 bp, Homo sapien
ccgaatcgccaagacgccggcaatg

SEQ ID NO: 45794 - DNA, 25 bp, Homo sapien
ccatgctgtagcgaaagcggagctc

SEQ ID NO: 45795 - DNA, 25 bp, Homo sapien
tctgtgtcctgcatgacctctgggc

SEQ ID NO: 45796 - DNA, 25 bp, Homo sapien
ggcccgcaggcttcagagttcgctc

SEQ ID NO: 45797 - DNA, 25 bp, Homo sapien
catttcgaggcgtgtggacgcatgc

SEQ ID NO: 45798 - DNA, 25 bp, Homo sapien
tagcgagccttgacctctgggcaga

SEQ ID NO: 45799 - DNA, 25 bp, Homo sapien
gacaacgaggcacagaggctacacc

SEQ ID NO: 45800 - DNA, 25 bp, Homo sapien
cggcaccctgagagatgtccgggta

SEQ ID NO: 45801 - DNA, 25 bp, Homo sapien
ttactcaaagacgtgctccgaagtc

SEQ ID NO: 45802 - DNA, 25 bp, Homo sapien
gtcgtgaccttggtctgccctccgt

SEQ ID NO: 45803 - DNA, 25 bp, Homo sapien
agtccagatcttcatggtgccggca

SEQ ID NO: 45804 - DNA, 25 bp, Homo sapien
cctacttgccaagaacctggatgtg

SEQ ID NO: 45805 - DNA, 25 bp, Homo sapien
ttccactttgacatccgcgcgctgg

SEQ ID NO: 45806 - DNA, 25 bp, Homo sapien
cgggctgtccaaacagggcagcatc

SEQ ID NO: 45807 - DNA, 25 bp, Homo sapien
tggacgatgcccagctggacaacgt

SEQ ID NO: 45808 - DNA, 25 bp, Homo sapien
gttgccagagcagaagtcgccgacc

SEQ ID NO: 45809 - DNA, 25 bp, Homo sapien
cagggtccgcatttgccgacagaga

SEQ ID NO: 45810 - DNA, 25 bp, Homo sapien
gatgtgaggaccgaagctgctccct

SEQ ID NO: 45811 - DNA, 25 bp, Homo sapien
ggagcaactcgctgcccttcgtcga

SEQ ID NO: 45812 - DNA, 25 bp, Homo sapien
tggcaggaagcgatcaacgcagagc

SEQ ID NO: 45813 - DNA, 25 bp, Homo sapien
cgaagcctcgggaaggctgcagggt

SEQ ID NO: 45814 - DNA, 25 bp, Homo sapien
tcgagctcagcgaagcctcgggaag

SEQ ID NO: 45815 - DNA, 25 bp, Homo sapien
gtcgagctcagcgaagcctcgggaa

SEQ ID NO: 45816 - DNA, 25 bp, Homo sapien
gcaggaagcgatcaacgcagagccc

SEQ ID NO: 45817 - DNA, 25 bp, Homo sapien
gcatggcaggaagcgatcaacgcag

SEQ ID NO: 45818 - DNA, 25 bp, Homo sapien
ggcatggcaggaagcgatcaacgca

SEQ ID NO: 45819 - DNA, 25 bp, Homo sapien
aagcgatcaacgcagagccccgaac

SEQ ID NO: 45820 - DNA, 25 bp, Homo sapien
ccggcgcctgatctaggttcatgga

SEQ ID NO: 45821 - DNA, 25 bp, Homo sapien
tcacagtgacctccgccgcaggtaa

SEQ ID NO: 45822 - DNA, 25 bp, Homo sapien
gcgcgagcgcacacaaaaggaccca

SEQ ID NO: 45823 - DNA, 25 bp, Homo sapien
gagcaaactcttgcctgggctctgc

SEQ ID NO: 45824 - DNA, 25 bp, Homo sapien
gggcagcgcgctctgaaagtttatg

SEQ ID NO: 45825 - DNA, 25 bp, Homo sapien
gctgtggctccttttcgggctcaca

SEQ ID NO: 45826 - DNA, 25 bp, Homo sapien
gctctgcactcgtgaagacgcctgg

SEQ ID NO: 45827 - DNA, 25 bp, Homo sapien
tgaaagtttatgaccgccgcagcca

SEQ ID NO: 45828 - DNA, 25 bp, Homo sapien
tgccaggtctaagccgaccctcaga

SEQ ID NO: 45829 - DNA, 25 bp, Homo sapien
ctcggagctgccaggtctaagccga

SEQ ID NO: 45830 - DNA, 25 bp, Homo sapien
tctggcgcagcgaagtctgcagatc

SEQ ID NO: 45831 - DNA, 25 bp, Homo sapien
ggcgcagcgaagtctgcagatctct

SEQ ID NO: 45832 - DNA, 25 bp, Homo sapien
caacagcgccaccacgaggccgcgg

SEQ ID NO: 45833 - DNA, 25 bp, Homo sapien
aactgccggcagcacagcggtcgca

SEQ ID NO: 45834 - DNA, 25 bp, Homo sapien
atcccgaatccctgcttggctcgga

SEQ ID NO: 45835 - DNA, 25 bp, Homo sapien
aggtctaagccgaccctcagagacg

SEQ ID NO: 45836 - DNA, 25 bp, Homo sapien
gcatccctggaaggcccgggcacgg

SEQ ID NO: 45837 - DNA, 25 bp, Homo sapien
gggacgactcctcctgaatcccttg

SEQ ID NO: 45838 - DNA, 25 bp, Homo sapien
agatcctgcgcaaggtaagcgcgcg

SEQ ID NO: 45839 - DNA, 25 bp, Homo sapien
ccgcccgagatcctgcgcaaggtaa

SEQ ID NO: 45840 - DNA, 25 bp, Homo sapien
cctgcgcaaggtaagcgcgcgctgc

SEQ ID NO: 45841 - DNA, 25 bp, Homo sapien
gcccgagatcctgcgcaaggtaagc

SEQ ID NO: 45842 - DNA, 25 bp, Homo sapien
ggtcaaggtcgcagcggagcccctc

SEQ ID NO: 45843 - DNA, 25 bp, Homo sapien
cctcctgaatcccttgcccttggcc

SEQ ID NO: 45844 - DNA, 25 bp, Homo sapien
cgaacgccggagagtcgtctccttc

SEQ ID NO: 45845 - DNA, 25 bp, Homo sapien
cagcagggacagataaccgcgccgg

SEQ ID NO: 45846 - DNA, 25 bp, Homo sapien
ccgcagaggccaaatgaaaggcgtc

SEQ ID NO: 45847 - DNA, 25 bp, Homo sapien
gcaggctcttccatctcctgattgg

SEQ ID NO: 45848 - DNA, 25 bp, Homo sapien
cgggacaatgccagggcgctcctct

SEQ ID NO: 45849 - DNA, 25 bp, Homo sapien
gcggcgaactggctttagatgcttc

SEQ ID NO: 45850 - DNA, 25 bp, Homo sapien
ccctgcttggcgcagtgcttagcgc

SEQ ID NO: 45851 - DNA, 25 bp, Homo sapien
tatgaagtcagttccggttggtgta

SEQ ID NO: 45852 - DNA, 25 bp, Homo sapien
acagagcccggtttcgtgacagcgt

SEQ ID NO: 45853 - DNA, 25 bp, Homo sapien
aggcttcctttcctcgggtgctgac

SEQ ID NO: 45854 - DNA, 25 bp, Homo sapien
tgtccataaaagagctgatttcctg

SEQ ID NO: 45855 - DNA, 25 bp, Homo sapien
gcctcggagccctttgtccataaaa

SEQ ID NO: 45856 - DNA, 25 bp, Homo sapien
attccacgcggctcgctctaacttg

SEQ ID NO: 45857 - DNA, 25 bp, Homo sapien
gaataaataacaaagcgaggccgcg

SEQ ID NO: 45858 - DNA, 25 bp, Homo sapien
gcctcggatgctctgattccacgcg

SEQ ID NO: 45859 - DNA, 25 bp, Homo sapien
ggcgtctttctccagctcgtttcct

SEQ ID NO: 45860 - DNA, 25 bp, Homo sapien
agcgtcgcaactctgcgcctcaggg

SEQ ID NO: 45861 - DNA, 25 bp, Homo sapien
caatccgcgccaggtgcggtcgata

SEQ ID NO: 45862 - DNA, 25 bp, Homo sapien
atagtgcgtccaatcggcgtcgccg

SEQ ID NO: 45863 - DNA, 25 bp, Homo sapien
gccaggccctcaggttagtgggtcc

SEQ ID NO: 45864 - DNA, 25 bp, Homo sapien
tcaaccgtcggaagcttctcgcctg

SEQ ID NO: 45865 - DNA, 25 bp, Homo sapien
tcgcgctatgctctcctgatgaacg

SEQ ID NO: 45866 - DNA, 25 bp, Homo sapien
ctcgcctgccggcttgaaaggccaa

SEQ ID NO: 45867 - DNA, 25 bp, Homo sapien
agactcgctgccttgactggggccc

SEQ ID NO: 45868 - DNA, 25 bp, Homo sapien
ttctcgaaggccacgttgcacacgc

SEQ ID NO: 45869 - DNA, 25 bp, Homo sapien
accaggcaatgcagggtgaactcca

SEQ ID NO: 45870 - DNA, 25 bp, Homo sapien
ctgcagcacaggtccgagttgattg

SEQ ID NO: 45871 - DNA, 25 bp, Homo sapien
tcgtctcccgcgttgaacaccttga

SEQ ID NO: 45872 - DNA, 25 bp, Homo sapien
gaagccgcagagagtccaccgtatc

SEQ ID NO: 45873 - DNA, 25 bp, Homo sapien
cttgctcctcgagtccttgtccagg

SEQ ID NO: 45874 - DNA, 25 bp, Homo sapien
tctagtggaagctttcagaggcctc

SEQ ID NO: 45875 - DNA, 25 bp, Homo sapien
taccgctgatgccaaggtccgagca

SEQ ID NO: 45876 - DNA, 25 bp, Homo sapien
cgcctgccggaagcctaaggaaact

SEQ ID NO: 45877 - DNA, 25 bp, Homo sapien
acgtggccgaggctctgtacagcac

SEQ ID NO: 45878 - DNA, 25 bp, Homo sapien
tgagagtcgaccctggctcagccct

SEQ ID NO: 45879 - DNA, 25 bp, Homo sapien
ggccagagtactccgtgcactttta

SEQ ID NO: 45880 - DNA, 25 bp, Homo sapien
gcacttttagccttctttgccggtc

SEQ ID NO: 45881 - DNA, 25 bp, Homo sapien
tttgccggtccgttatgcacatcgc

SEQ ID NO: 45882 - DNA, 25 bp, Homo sapien
gtcgtgggcatcaacgccttcagca

SEQ ID NO: 45883 - DNA, 25 bp, Homo sapien
tgcacatcgcttctaggcctccggt

SEQ ID NO: 45884 - DNA, 25 bp, Homo sapien
gccgcagatattctgcctcccattt

SEQ ID NO: 45885 - DNA, 25 bp, Homo sapien
cggcgccgtatcctgtggccgtttt

SEQ ID NO: 45886 - DNA, 25 bp, Homo sapien
gatattctgcctcccattttgcccg

SEQ ID NO: 45887 - DNA, 25 bp, Homo sapien
agccgaggcccggtgctgtattctg

SEQ ID NO: 45888 - DNA, 25 bp, Homo sapien
cgaggcccggtgctgtattctgccg

SEQ ID NO: 45889 - DNA, 25 bp, Homo sapien
cgcagatattctgcctcccattttg

SEQ ID NO: 45890 - DNA, 25 bp, Homo sapien
tgcctcccattttgcccgcggggac

SEQ ID NO: 45891 - DNA, 25 bp, Homo sapien
agcagcgccgcagatattctgcctc

SEQ ID NO: 45892 - DNA, 25 bp, Homo sapien
caggtatgacaagcaaaactgtctc

SEQ ID NO: 45893 - DNA, 25 bp, Homo sapien
gatcttccggggagcataaactgcc

SEQ ID NO: 45894 - DNA, 25 bp, Homo sapien
gttgccgattaggatggacattttc

SEQ ID NO: 45895 - DNA, 25 bp, Homo sapien
cccgggcactactgatattttgaac

SEQ ID NO: 45896 - DNA, 25 bp, Homo sapien
tcctgtgctttgtagaatgcttagc

SEQ ID NO: 45897 - DNA, 25 bp, Homo sapien
aatgcttagccgcatccctgacttc

SEQ ID NO: 45898 - DNA, 25 bp, Homo sapien
ttccatccagaaggtgccggtacca

SEQ ID NO: 45899 - DNA, 25 bp, Homo sapien
ccggtaccacctccatcaggtatga

SEQ ID NO: 45900 - DNA, 25 bp, Homo sapien
ccacagcaccttgtcggaactgatc

SEQ ID NO: 45901 - DNA, 25 bp, Homo sapien
ccactcgcaggagcacgcggccact

SEQ ID NO: 45902 - DNA, 25 bp, Homo sapien
ggagcacgcggccactcgcaggagc

SEQ ID NO: 45903 - DNA, 25 bp, Homo sapien
acgcagccacagcaccttgtcggaa

SEQ ID NO: 45904 - DNA, 25 bp, Homo sapien
agccacagcaccttgtcggaactga

SEQ ID NO: 45905 - DNA, 25 bp, Homo sapien
cacagcaccttgtcggaactgatcg

SEQ ID NO: 45906 - DNA, 25 bp, Homo sapien
tccgcccacgcggccactcgcaggg

SEQ ID NO: 45907 - DNA, 25 bp, Homo sapien
gcagccacagcaccttgtcggaact

SEQ ID NO: 45908 - DNA, 25 bp, Homo sapien
gcctgcatggggcaggcttccactg

SEQ ID NO: 45909 - DNA, 25 bp, Homo sapien
cccggagctcggcttgcctgcatgg

SEQ ID NO: 45910 - DNA, 25 bp, Homo sapien
ccggattgccagctttgctctgcgc

SEQ ID NO: 45911 - DNA, 25 bp, Homo sapien
gcgcgctccgggtaagttgccgcct

SEQ ID NO: 45912 - DNA, 25 bp, Homo sapien
ccagctttgctctgcgcctggcgag

SEQ ID NO: 45913 - DNA, 25 bp, Homo sapien
tcgaacgcccaaagcccgtagccgc

SEQ ID NO: 45914 - DNA, 25 bp, Homo sapien
ctagcggcgccgctcagttctgtgg

SEQ ID NO: 45915 - DNA, 25 bp, Homo sapien
gacccgccgagcctccctcgaacgc

SEQ ID NO: 45916 - DNA, 25 bp, Homo sapien
ccgtatccaacgagacttgctgggt

SEQ ID NO: 45917 - DNA, 25 bp, Homo sapien
cccgtatccaacgagacttgctggg

SEQ ID NO: 45918 - DNA, 25 bp, Homo sapien
atccaacgagacttgctgggtttat

SEQ ID NO: 45919 - DNA, 25 bp, Homo sapien
acgagacttgctgggtttatccccg

SEQ ID NO: 45920 - DNA, 25 bp, Homo sapien
caacgagacttgctgggtttatccc

SEQ ID NO: 45921 - DNA, 25 bp, Homo sapien
cgtatccaacgagacttgctgggtt

SEQ ID NO: 45922 - DNA, 25 bp, Homo sapien
tatccaacgagacttgctgggttta

SEQ ID NO: 45923 - DNA, 25 bp, Homo sapien
ccaacgagacttgctgggtttatcc

SEQ ID NO: 45924 - DNA, 25 bp, Homo sapien
atagggtgcccatagtgccgtgtct

SEQ ID NO: 45925 - DNA, 25 bp, Homo sapien
tgcggtcatagggtgcccatagtgc

SEQ ID NO: 45926 - DNA, 25 bp, Homo sapien
ccatagtgccgtgtctgggaaaccc

SEQ ID NO: 45927 - DNA, 25 bp, Homo sapien
atcgtacggtcatagggtgcccata

SEQ ID NO: 45928 - DNA, 25 bp, Homo sapien
cccgattgagatcgtgcggtcatag

SEQ ID NO: 45929 - DNA, 25 bp, Homo sapien
atcgtgcggtcatagggtgcccata

SEQ ID NO: 45930 - DNA, 25 bp, Homo sapien
cccaattgagatcgtacggtcatag

SEQ ID NO: 45931 - DNA, 25 bp, Homo sapien
cccatagtgccgtgtctgggaaacc

SEQ ID NO: 45932 - DNA, 25 bp, Homo sapien
gatgagtaagtcctgcctcgcgctg

SEQ ID NO: 45933 - DNA, 25 bp, Homo sapien
ccgtgatgcctcgttggtacttcga

SEQ ID NO: 45934 - DNA, 25 bp, Homo sapien
tggtacttcgacctctccaagggaa

SEQ ID NO: 45935 - DNA, 25 bp, Homo sapien
ctctccaagggaaagtgcgtgcgct

SEQ ID NO: 45936 - DNA, 25 bp, Homo sapien
cgtgcgctttatatatggtggctgc

SEQ ID NO: 45937 - DNA, 25 bp, Homo sapien
ggaacaattttgagtctgaggatta

SEQ ID NO: 45938 - DNA, 25 bp, Homo sapien
ctgccgtcttcgtggctgcatctgt

SEQ ID NO: 45939 - DNA, 25 bp, Homo sapien
ctgcccactcgggtgtttgctgtcg

SEQ ID NO: 45940 - DNA, 25 bp, Homo sapien
aggaaagcccgtggattatgcatcc

SEQ ID NO: 45941 - DNA, 25 bp, Homo sapien
cagccgccaagcagagacggtgacg

SEQ ID NO: 45942 - DNA, 25 bp, Homo sapien
cagtccatgcaatggcagccgccaa

SEQ ID NO: 45943 - DNA, 25 bp, Homo sapien
atccctgcgttgacggtggcatgac

SEQ ID NO: 45944 - DNA, 25 bp, Homo sapien
atccaggaattaaagcagtccatgc

SEQ ID NO: 45945 - DNA, 25 bp, Homo sapien
ccgtggattatgcatccaggaatta

SEQ ID NO: 45946 - DNA, 25 bp, Homo sapien
tcttcgaaggaaagcccgtggatta

SEQ ID NO: 45947 - DNA, 25 bp, Homo sapien
acggtgacgggatccctgcgttgac

SEQ ID NO: 45948 - DNA, 25 bp, Homo sapien
gagataagccttacacagcgcgatg

SEQ ID NO: 45949 - DNA, 25 bp, Homo sapien
tgtctgagaaggtcgcgatttcacc

SEQ ID NO: 45950 - DNA, 25 bp, Homo sapien
agcagtaggctcttctcccgacatc

SEQ ID NO: 45951 - DNA, 25 bp, Homo sapien
gtctcggcgttagcagtaggctctt

SEQ ID NO: 45952 - DNA, 25 bp, Homo sapien
atcaacgtgcccgagaactcgcgcg

SEQ ID NO: 45953 - DNA, 25 bp, Homo sapien
gggactgggtcatcccgcccatcaa

SEQ ID NO: 45954 - DNA, 25 bp, Homo sapien
caccagaacgccaacgggctgaggc

SEQ ID NO: 45955 - DNA, 25 bp, Homo sapien
tacacagcgcgatgaaaaattcagg

SEQ ID NO: 45956 - DNA, 25 bp, Homo sapien
tttcctgctacctccgtgcgcagca

SEQ ID NO: 45957 - DNA, 25 bp, Homo sapien
cactcctcacatacagaatgggctg

SEQ ID NO: 45958 - DNA, 25 bp, Homo sapien
ctcctcacatacagaatgggctgtg

SEQ ID NO: 45959 - DNA, 25 bp, Homo sapien
cctcacatacagaatgggctgtggg

SEQ ID NO: 45960 - DNA, 25 bp, Homo sapien
ccgctcctttcctgctacctccgtg

SEQ ID NO: 45961 - DNA, 25 bp, Homo sapien
ccttgtggggtgtggtccagagcgt

SEQ ID NO: 45962 - DNA, 25 bp, Homo sapien
tccacactcctcacatacagaatgg

SEQ ID NO: 45963 - DNA, 25 bp, Homo sapien
cacatacagaatgggctgtgggtcc

SEQ ID NO: 45964 - DNA, 25 bp, Homo sapien
tgttcaccatcaacagcgagactgg

SEQ ID NO: 45965 - DNA, 25 bp, Homo sapien
tccaggcacctacgtgatgaccgtc

SEQ ID NO: 45966 - DNA, 25 bp, Homo sapien
cacggccaacgatgctgacgacagc

SEQ ID NO: 45967 - DNA, 25 bp, Homo sapien
gacgacagcaccacggccaacggga

SEQ ID NO: 45968 - DNA, 25 bp, Homo sapien
cagagcccgtcccagaatatgttca

SEQ ID NO: 45969 - DNA, 25 bp, Homo sapien
cagcgagactggagatatcgtcaca

SEQ ID NO: 45970 - DNA, 25 bp, Homo sapien
atatcgtcacagtggcggctggcct

SEQ ID NO: 45971 - DNA, 25 bp, Homo sapien
tgcggtaccggatcgtgacccagac

SEQ ID NO: 45972 - DNA, 25 bp, Homo sapien
ggggaactcaccgttagctgtctcc

SEQ ID NO: 45973 - DNA, 25 bp, Homo sapien
tcgagcctgggaccttggtggtccc

SEQ ID NO: 45974 - DNA, 25 bp, Homo sapien
ccaagtctcaggaccgccgactctg

SEQ ID NO: 45975 - DNA, 25 bp, Homo sapien
gtcggggaactcaccgttagctgtc

SEQ ID NO: 45976 - DNA, 25 bp, Homo sapien
tgcccgcctcggacctcggagagga

SEQ ID NO: 45977 - DNA, 25 bp, Homo sapien
gtcggtctcttcctgccgagtgcgc

SEQ ID NO: 45978 - DNA, 25 bp, Homo sapien
cccacatggcggggattgagtgcca

SEQ ID NO: 45979 - DNA, 25 bp, Homo sapien
aggcccagcaccgagttcctgggcg

SEQ ID NO: 45980 - DNA, 25 bp, Homo sapien
tgcctcaggaagctgcgctgcgaag

SEQ ID NO: 45981 - DNA, 25 bp, Homo sapien
tgaaccgtggccaggattacggccc

SEQ ID NO: 45982 - DNA, 25 bp, Homo sapien
tgagccggccacaacatgaaccgtg

SEQ ID NO: 45983 - DNA, 25 bp, Homo sapien
ccgtggctgcggaagaaataaacca

SEQ ID NO: 45984 - DNA, 25 bp, Homo sapien
ggctccattccagcggtggcatttc

SEQ ID NO: 45985 - DNA, 25 bp, Homo sapien
cacacggggtgatctccgtgcctca

SEQ ID NO: 45986 - DNA, 25 bp, Homo sapien
cagagcctccagtggtcaattagtc

SEQ ID NO: 45987 - DNA, 25 bp, Homo sapien
tttcgtaaccaaagtgccaagtgtg

SEQ ID NO: 45988 - DNA, 25 bp, Homo sapien
ccagcacggtgagtccctcgaagct

SEQ ID NO: 45989 - DNA, 25 bp, Homo sapien
cgccagaatttaccgccagcacggt

SEQ ID NO: 45990 - DNA, 25 bp, Homo sapien
ctgcctgacgggcacttggcagata

SEQ ID NO: 45991 - DNA, 25 bp, Homo sapien
ggcacttggcagatagcgtgtaaga

SEQ ID NO: 45992 - DNA, 25 bp, Homo sapien
tagcgtgtaagaaaggccctgggca

SEQ ID NO: 45993 - DNA, 25 bp, Homo sapien
agtggctcgattcctgatgtgcgca

SEQ ID NO: 45994 - DNA, 25 bp, Homo sapien
agtccctcgaagctgcccagtgacg

SEQ ID NO: 45995 - DNA, 25 bp, Homo sapien
tgcccagtgacgcatggcccgtgca

SEQ ID NO: 45996 - DNA, 25 bp, Homo sapien
catggtatcgtgattgtgtggaagc

SEQ ID NO: 45997 - DNA, 25 bp, Homo sapien
gattgcatggaagtgtggtgtcaca

SEQ ID NO: 45998 - DNA, 25 bp, Homo sapien
attgtgtggaagcatggtatcgtga

SEQ ID NO: 45999 - DNA, 25 bp, Homo sapien
aagcatggtatcgtgattgtgtgga

SEQ ID NO: 46000 - DNA, 25 bp, Homo sapien
tgtcacggtgattgcatggaagcgt

SEQ ID NO: 46001 - DNA, 25 bp, Homo sapien
gattgcatggaagcgtggtgtcaca

SEQ ID NO: 46002 - DNA, 25 bp, Homo sapien
tgattgtgtggaagcatggtatcgt

SEQ ID NO: 46003 - DNA, 25 bp, Homo sapien
tgtcacagtgattgcatggaagcgt

SEQ ID NO: 46004 - DNA, 25 bp, Homo sapien
ttttgtgattgcatggaagcatggc

SEQ ID NO: 46005 - DNA, 25 bp, Homo sapien
agcatgttgtgattggaagcgtgtc

SEQ ID NO: 46006 - DNA, 25 bp, Homo sapien
aagtgtgtcgtgattgcatggaagc

SEQ ID NO: 46007 - DNA, 25 bp, Homo sapien
catgatgattgcgtggaagcatgtc

SEQ ID NO: 46008 - DNA, 25 bp, Homo sapien
catggcgtcacagtgactgcgtgga

SEQ ID NO: 46009 - DNA, 25 bp, Homo sapien
gcgtgtcatgattgtgtggaagcat

SEQ ID NO: 46010 - DNA, 25 bp, Homo sapien
cgtggaagcgctgtgtcatgatgat

SEQ ID NO: 46011 - DNA, 25 bp, Homo sapien
aagcatgtcatggttgcgtggaagc

SEQ ID NO: 46012 - DNA, 25 bp, Homo sapien
gtgccgtgccatcagctacatctca

SEQ ID NO: 46013 - DNA, 25 bp, Homo sapien
cgcagctggaacatcggagcgtcca

SEQ ID NO: 46014 - DNA, 25 bp, Homo sapien
cccggttaacagaacctgtctgtgc

SEQ ID NO: 46015 - DNA, 25 bp, Homo sapien
gtgcttctccgatcacgtgccgtgc

SEQ ID NO: 46016 - DNA, 25 bp, Homo sapien
cagctacatctcaaagcagttttca

SEQ ID NO: 46017 - DNA, 25 bp, Homo sapien
cagttttcaaaggtagcgccgcgct

SEQ ID NO: 46018 - DNA, 25 bp, Homo sapien
gccgcgctgcgtcaccttaaatgtg

SEQ ID NO: 46019 - DNA, 25 bp, Homo sapien
taaatgtgttttgacgcagcttccg

SEQ ID NO: 46020 - DNA, 25 bp, Homo sapien
agaactggaccatcacccgcctgaa

SEQ ID NO: 46021 - DNA, 25 bp, Homo sapien
gccgtgcggaagaactggaccatca

SEQ ID NO: 46022 - DNA, 25 bp, Homo sapien
ctacgtcttcgagctgccctttgtc

SEQ ID NO: 46023 - DNA, 25 bp, Homo sapien
gagaagcccaacctgaacgccatca

SEQ ID NO: 46024 - DNA, 25 bp, Homo sapien
gcgcagatctgcgagaagcccaacc

SEQ ID NO: 46025 - DNA, 25 bp, Homo sapien
gggaccctccagatctatctcattg

SEQ ID NO: 46026 - DNA, 25 bp, Homo sapien
cgcctgaacggtgagcccgccttag

SEQ ID NO: 46027 - DNA, 25 bp, Homo sapien
tcacggcggccgacgctgacgtcga

SEQ ID NO: 46028 - DNA, 25 bp, Homo sapien
gactcaagtacaactcccggcacga

SEQ ID NO: 46029 - DNA, 25 bp, Homo sapien
cggcagggacgacgcctgtgagacc

SEQ ID NO: 46030 - DNA, 25 bp, Homo sapien
acttcggcgcgggactcaagtacaa

SEQ ID NO: 46031 - DNA, 25 bp, Homo sapien
cggcgcgggactcaagtacaactcc

SEQ ID NO: 46032 - DNA, 25 bp, Homo sapien
tacaactcccggcacgaggtgagcg

SEQ ID NO: 46033 - DNA, 25 bp, Homo sapien
cacaggtggaatttcctgttcagcg

SEQ ID NO: 46034 - DNA, 25 bp, Homo sapien
gaatttcctgttcagcgggtgccgg

SEQ ID NO: 46035 - DNA, 25 bp, Homo sapien
tcggtcctttctttccctgagttga

SEQ ID NO: 46036 - DNA, 25 bp, Homo sapien
ctgctggtcttcgactacgagggga

SEQ ID NO: 46037 - DNA, 25 bp, Homo sapien
ttcggaccgaagtgagagccgtgct

SEQ ID NO: 46038 - DNA, 25 bp, Homo sapien
ccgttccatctgatcccggggctga

SEQ ID NO: 46039 - DNA, 25 bp, Homo sapien
tgagacaacgcgtcctgcaccctaa

SEQ ID NO: 46040 - DNA, 25 bp, Homo sapien
gtcagctccctgaactcatccagtt

SEQ ID NO: 46041 - DNA, 25 bp, Homo sapien
ggggaccaagactacgattacctca

SEQ ID NO: 46042 - DNA, 25 bp, Homo sapien
actcatccagttccggggaccaaga

SEQ ID NO: 46043 - DNA, 25 bp, Homo sapien
tgactgacctcgcatcttcggaccg

SEQ ID NO: 46044 - DNA, 25 bp, Homo sapien
tctcaccgatgaggagcactgcgac

SEQ ID NO: 46045 - DNA, 25 bp, Homo sapien
ttctcaccgacgacgaggagcactg

SEQ ID NO: 46046 - DNA, 25 bp, Homo sapien
gaacattgtgactgtctgcaccgtg

SEQ ID NO: 46047 - DNA, 25 bp, Homo sapien
acattgtgactgtctgcaccgtggc

SEQ ID NO: 46048 - DNA, 25 bp, Homo sapien
gagcactgcgactgtctgcaccatg

SEQ ID NO: 46049 - DNA, 25 bp, Homo sapien
ccaacgatgaggagcactgcgactg

SEQ ID NO: 46050 - DNA, 25 bp, Homo sapien
ctgaggagcactacgaccgtctgca

SEQ ID NO: 46051 - DNA, 25 bp, Homo sapien
cactgacgatgaggagcactgcgac

SEQ ID NO: 46052 - DNA, 25 bp, Homo sapien
tcaccgaccacgaggagcactgcga

SEQ ID NO: 46053 - DNA, 25 bp, Homo sapien
cactgacgatgaggagcattgcgac

SEQ ID NO: 46054 - DNA, 25 bp, Homo sapien
attgcgactgtatgcaccgtggccg

SEQ ID NO: 46055 - DNA, 25 bp, Homo sapien
ttctcaccgacgacgaggagcactg

SEQ ID NO: 46056 - DNA, 25 bp, Homo sapien
gagcactgcgactgtctgcaccatg

SEQ ID NO: 46057 - DNA, 25 bp, Homo sapien
tctcaccgacgacgaggagcactgc

SEQ ID NO: 46058 - DNA, 25 bp, Homo sapien
ctcaccgacgacgaggagcactgcg

SEQ ID NO: 46059 - DNA, 25 bp, Homo sapien
ctctcaccgacgacgaggagcactg

SEQ ID NO: 46060 - DNA, 25 bp, Homo sapien
tcaccgacgatgaggagcactgcga

SEQ ID NO: 46061 - DNA, 25 bp, Homo sapien
ttctcaccgacgacgaggagcactg

SEQ ID NO: 46062 - DNA, 25 bp, Homo sapien
tcaccgatgacgaggagcactgcga

SEQ ID NO: 46063 - DNA, 25 bp, Homo sapien
cgctgaggagcactgcaaccatctg

SEQ ID NO: 46064 - DNA, 25 bp, Homo sapien
cactgacgatgaggagcactgcgac

SEQ ID NO: 46065 - DNA, 25 bp, Homo sapien
gagcactgcgactgtctgcaccatg

SEQ ID NO: 46066 - DNA, 25 bp, Homo sapien
tcaccgacgatgagtagcactgcga

SEQ ID NO: 46067 - DNA, 25 bp, Homo sapien
tggccgccctttctgactgatgata

SEQ ID NO: 46068 - DNA, 25 bp, Homo sapien
agtcagcctgggtgactgcgactgc

SEQ ID NO: 46069 - DNA, 25 bp, Homo sapien
actgtggcaggtttgtgacccctcc

SEQ ID NO: 46070 - DNA, 25 bp, Homo sapien
agcctggcacatcggcagccctccc

SEQ ID NO: 46071 - DNA, 25 bp, Homo sapien
ctcccgcgagtcagcctgggtgact

SEQ ID NO: 46072 - DNA, 25 bp, Homo sapien
actgcgactgccctgggctctaaac

SEQ ID NO: 46073 - DNA, 25 bp, Homo sapien
aaggtgtcctccacgaaggacgcgg

SEQ ID NO: 46074 - DNA, 25 bp, Homo sapien
acccgacgtgcagggactgtggcag

SEQ ID NO: 46075 - DNA, 25 bp, Homo sapien
aggcgaaggtgtcctccacgaagga

SEQ ID NO: 46076 - DNA, 25 bp, Homo sapien
catttggaggccaccgtctgataga

SEQ ID NO: 46077 - DNA, 25 bp, Homo sapien
cagcaactgactgtggagaaccacc

SEQ ID NO: 46078 - DNA, 25 bp, Homo sapien
ccaccagatttgtagtcagagcagc

SEQ ID NO: 46079 - DNA, 25 bp, Homo sapien
gatgacaacttctcaggcactcggc

SEQ ID NO: 46080 - DNA, 25 bp, Homo sapien
gccattacatgccacgagtcctttg

SEQ ID NO: 46081 - DNA, 25 bp, Homo sapien
gtcctttggtgtcagatccctagtg

SEQ ID NO: 46082 - DNA, 25 bp, Homo sapien
ggtgcccttacactggctcaaatgc

SEQ ID NO: 46083 - DNA, 25 bp, Homo sapien
cggttgcttaactgaggtgccctta

SEQ ID NO: 46084 - DNA, 25 bp, Homo sapien
ccgggcagacgtgcattcaacactg

SEQ ID NO: 46085 - DNA, 25 bp, Homo sapien
tcacacaccgggcagacgtgcattc

SEQ ID NO: 46086 - DNA, 25 bp, Homo sapien
acaccgggtagacgtgcattcaaca

SEQ ID NO: 46087 - DNA, 25 bp, Homo sapien
acaccgggcagacgtgcattcaaca

SEQ ID NO: 46088 - DNA, 25 bp, Homo sapien
ggtagacgggcattcagcttcatca

SEQ ID NO: 46089 - DNA, 25 bp, Homo sapien
gggtagacgggcattcagcttcatc

SEQ ID NO: 46090 - DNA, 25 bp, Homo sapien
ttcaacactgggtagacgggcattc

SEQ ID NO: 46091 - DNA, 25 bp, Homo sapien
tcaacactgggtagacgggcattca

SEQ ID NO: 46092 - DNA, 25 bp, Homo sapien
gagccctctggctctggcaacgaag

SEQ ID NO: 46093 - DNA, 25 bp, Homo sapien
gacaggagcgcctggtcagacagca

SEQ ID NO: 46094 - DNA, 25 bp, Homo sapien
cgtcgaggccggagcgatgaccctc

SEQ ID NO: 46095 - DNA, 25 bp, Homo sapien
tgggagagaaatcccaagcccggcc

SEQ ID NO: 46096 - DNA, 25 bp, Homo sapien
ccgtgggcatccacacggggcatgt

SEQ ID NO: 46097 - DNA, 25 bp, Homo sapien
caaggccatcgaagccgtggtcaca

SEQ ID NO: 46098 - DNA, 25 bp, Homo sapien
tggcggccctgaagcgccgatgtcc

SEQ ID NO: 46099 - DNA, 25 bp, Homo sapien
accgacagcgcgcaaggagagccct

SEQ ID NO: 46100 - DNA, 25 bp, Homo sapien
gaccaaccaagggagggcgcgacac

SEQ ID NO: 46101 - DNA, 25 bp, Homo sapien
acaccaaccaagggagggcgcgaga

SEQ ID NO: 46102 - DNA, 25 bp, Homo sapien
aagggagggcgcgacaccaaccaag

SEQ ID NO: 46103 - DNA, 25 bp, Homo sapien
cgacaccaaccaagggagggcgcga

SEQ ID NO: 46104 - DNA, 25 bp, Homo sapien
ccaaccaagggagggcgcgacacca

SEQ ID NO: 46105 - DNA, 25 bp, Homo sapien
caccaaccaagggagggcgcgacac

SEQ ID NO: 46106 - DNA, 25 bp, Homo sapien
gacaccaaccaagggagggcgcgac

SEQ ID NO: 46107 - DNA, 25 bp, Homo sapien
acaccaaccaagggagggcgcgaca

SEQ ID NO: 46108 - DNA, 25 bp, Homo sapien
aggcgccatggccactccagaggga

SEQ ID NO: 46109 - DNA, 25 bp, Homo sapien
tgcaggcgccatggccactccagag

SEQ ID NO: 46110 - DNA, 25 bp, Homo sapien
atggccactccagagggactgcggc

SEQ ID NO: 46111 - DNA, 25 bp, Homo sapien
ccactccagagggactgcggcatgt

SEQ ID NO: 46112 - DNA, 25 bp, Homo sapien
ccgtggccactccagagggactgcg

SEQ ID NO: 46113 - DNA, 25 bp, Homo sapien
cactccagagggactgcggcatgtg

SEQ ID NO: 46114 - DNA, 25 bp, Homo sapien
gcgccatggccactccagagggact

SEQ ID NO: 46115 - DNA, 25 bp, Homo sapien
cgccatggccactccagagggactg

SEQ ID NO: 46116 - DNA, 25 bp, Homo sapien
gcggcgggtaacaatagcctatgcc

SEQ ID NO: 46117 - DNA, 25 bp, Homo sapien
gggtctgcgccacccaaacgtcagg

SEQ ID NO: 46118 - DNA, 25 bp, Homo sapien
agacactcagtatcgaagccaaatg

SEQ ID NO: 46119 - DNA, 25 bp, Homo sapien
tcacagggctctcaaaaggatcaaa

SEQ ID NO: 46120 - DNA, 25 bp, Homo sapien
gcggccctggacataccacgtgagc

SEQ ID NO: 46121 - DNA, 25 bp, Homo sapien
cacctctgacgcatggcgctgcaga

SEQ ID NO: 46122 - DNA, 25 bp, Homo sapien
aagccaaatgcagagtcgccgtccg

SEQ ID NO: 46123 - DNA, 25 bp, Homo sapien
aggaggtctctccaccgcatatgtg

SEQ ID NO: 46124 - DNA, 25 bp, Homo sapien
cacggtgggctgtgcagaccagtca

SEQ ID NO: 46125 - DNA, 25 bp, Homo sapien
tctcaaggcgggtaagctcctctgg

SEQ ID NO: 46126 - DNA, 25 bp, Homo sapien
gtcagctgtctcaaggcgggtaagc

SEQ ID NO: 46127 - DNA, 25 bp, Homo sapien
gagctactcagcaccacggccgtga

SEQ ID NO: 46128 - DNA, 25 bp, Homo sapien
gccgtgcgctggaccgagctactca

SEQ ID NO: 46129 - DNA, 25 bp, Homo sapien
tccataccagcggtgtgggttgccc

SEQ ID NO: 46130 - DNA, 25 bp, Homo sapien
cccttccataccagcggtgtgggtt

SEQ ID NO: 46131 - DNA, 25 bp, Homo sapien
ggctgtgcagaccagtcaggcgccc

SEQ ID NO: 46132 - DNA, 25 bp, Homo sapien
tcggccacgttcaccttagcgacag

SEQ ID NO: 46133 - DNA, 25 bp, Homo sapien
tgagagcgacgcctcggccacgttc

SEQ ID NO: 46134 - DNA, 25 bp, Homo sapien
cctgcaacagtgagagcgacgcctc

SEQ ID NO: 46135 - DNA, 25 bp, Homo sapien
cggtgaaagttacggtccatgtgcc

SEQ ID NO: 46136 - DNA, 25 bp, Homo sapien
atctgcttcccagggtgcggtgaaa

SEQ ID NO: 46137 - DNA, 25 bp, Homo sapien
ggagcgatgtcatctgcttcccagg

SEQ ID NO: 46138 - DNA, 25 bp, Homo sapien
ccacgagatgaagggagcgatgtca

SEQ ID NO: 46139 - DNA, 25 bp, Homo sapien
tgtaagcgccgcaccacgagatgaa

SEQ ID NO: 46140 - DNA, 25 bp, Homo sapien
cgaggagcgcgtagtcatgctgccc

SEQ ID NO: 46141 - DNA, 25 bp, Homo sapien
tcctggagtcgctctgggcgcacgt

SEQ ID NO: 46142 - DNA, 25 bp, Homo sapien
tcatggccgaggagcgcgtagtcat

SEQ ID NO: 46143 - DNA, 25 bp, Homo sapien
gtctgagttcagcatcccgcagcac

SEQ ID NO: 46144 - DNA, 25 bp, Homo sapien
gcctactactggtctgagttcagca

SEQ ID NO: 46145 - DNA, 25 bp, Homo sapien
cgagggcagcgtcatcgcctactac

SEQ ID NO: 46146 - DNA, 25 bp, Homo sapien
catgtgtcctggagtcgctctgggc

SEQ ID NO: 46147 - DNA, 25 bp, Homo sapien
gcgtcatcgcctactactggtctga

SEQ ID NO: 46148 - DNA, 25 bp, Homo sapien
agctccattaagtgcccggtcaggc

SEQ ID NO: 46149 - DNA, 25 bp, Homo sapien
tggggcacccacatctgaacagaga

SEQ ID NO: 46150 - DNA, 25 bp, Homo sapien
gtgcaagcaccatcctgaaaccagg

SEQ ID NO: 46151 - DNA, 25 bp, Homo sapien
ctgaacagagaagatgcccaccttg

SEQ ID NO: 46152 - DNA, 25 bp, Homo sapien
gcccaccttgagaaggtactctgga

SEQ ID NO: 46153 - DNA, 25 bp, Homo sapien
gagccacgagcgacgtttatgctga

SEQ ID NO: 46154 - DNA, 25 bp, Homo sapien
ctgagaagcggcatccgtgcacctc

SEQ ID NO: 46155 - DNA, 25 bp, Homo sapien
ctgccgctctggatccgtcactaag

SEQ ID NO: 46156 - DNA, 25 bp, Homo sapien
tgcgggcagtcctgcaagacaatag

SEQ ID NO: 46157 - DNA, 25 bp, Homo sapien
tgcctgcgggcagtcctgcaagaca

SEQ ID NO: 46158 - DNA, 25 bp, Homo sapien
gcgggcagtcctgcaagacaataga

SEQ ID NO: 46159 - DNA, 25 bp, Homo sapien
ctgcctgcgggcagtcctgcaatac

SEQ ID NO: 46160 - DNA, 25 bp, Homo sapien
gctgcctgcgggcagtcctgcaaga

SEQ ID NO: 46161 - DNA, 25 bp, Homo sapien
ctgcgggcagtcctgcaagacaata

SEQ ID NO: 46162 - DNA, 25 bp, Homo sapien
ctgcctgcgggcagtcctgcaagac

SEQ ID NO: 46163 - DNA, 25 bp, Homo sapien
gcctgcgggcagtcctgcaagacaa

SEQ ID NO: 46164 - DNA, 25 bp, Homo sapien
cctgcacggagcgagaacatctgct

SEQ ID NO: 46165 - DNA, 25 bp, Homo sapien
ccaggcatccgcagcatagccagta

SEQ ID NO: 46166 - DNA, 25 bp, Homo sapien
gcatccgcagcatagccagtatcgc

SEQ ID NO: 46167 - DNA, 25 bp, Homo sapien
cacggagcgagaacatctgctgcca

SEQ ID NO: 46168 - DNA, 25 bp, Homo sapien
gagcgagaacatctgctgccaccgc

SEQ ID NO: 46169 - DNA, 25 bp, Homo sapien
cagcaaccagagtagctaggcgctc

SEQ ID NO: 46170 - DNA, 25 bp, Homo sapien
aaccagagtagctaggcgctccttc

SEQ ID NO: 46171 - DNA, 25 bp, Homo sapien
aggcgctccttcctttaggcaccaa

SEQ ID NO: 46172 - DNA, 25 bp, Homo sapien
ttggcccgatgaccatgctggccgc

SEQ ID NO: 46173 - DNA, 25 bp, Homo sapien
cagctggaagttctggatgttggtc

SEQ ID NO: 46174 - DNA, 25 bp, Homo sapien
aagttctggatgttggtcgggttct

SEQ ID NO: 46175 - DNA, 25 bp, Homo sapien
ctctgggtcactgcgccggccgcgc

SEQ ID NO: 46176 - DNA, 25 bp, Homo sapien
cccttgcatagttggcccgatgacc

SEQ ID NO: 46177 - DNA, 25 bp, Homo sapien
ctgcaccaccctcttgggcgactcg

SEQ ID NO: 46178 - DNA, 25 bp, Homo sapien
catagttggcccgatgaccatgctg

SEQ ID NO: 46179 - DNA, 25 bp, Homo sapien
tagttggcccgatgaccatgctggc

SEQ ID NO: 46180 - DNA, 25 bp, Homo sapien
tccaccagcggagaacttcctggaa

SEQ ID NO: 46181 - DNA, 25 bp, Homo sapien
acttcctggaactggcagctggcgc

SEQ ID NO: 46182 - DNA, 25 bp, Homo sapien
agatgaccttagcattccaccagcg

SEQ ID NO: 46183 - DNA, 25 bp, Homo sapien
ggacagatgaccttagcattccacc

SEQ ID NO: 46184 - DNA, 25 bp, Homo sapien
ccagccacgggcctacgggacagat

SEQ ID NO: 46185 - DNA, 25 bp, Homo sapien
tccctctggctcactcgcagacagc

SEQ ID NO: 46186 - DNA, 25 bp, Homo sapien
gggacgcaggctatgccgactccct

SEQ ID NO: 46187 - DNA, 25 bp, Homo sapien
acagcgacagggacgcaggctatgc

SEQ ID NO: 46188 - DNA, 25 bp, Homo sapien
tcgctgttgaagaagacctcgtcca

SEQ ID NO: 46189 - DNA, 25 bp, Homo sapien
tcgtataagcccgtaggtaagagca

SEQ ID NO: 46190 - DNA, 25 bp, Homo sapien
actttctcgtccacctcgctgttga

SEQ ID NO: 46191 - DNA, 25 bp, Homo sapien
gacaggagtgtcgtataagcccgta

SEQ ID NO: 46192 - DNA, 25 bp, Homo sapien
acccagctgccttggagacaggagt

SEQ ID NO: 46193 - DNA, 25 bp, Homo sapien
gcccgtaggtaagagcacggtgctt

SEQ ID NO: 46194 - DNA, 25 bp, Homo sapien
tggcccttccctccatttttaatca

SEQ ID NO: 46195 - DNA, 25 bp, Homo sapien
gcgcgcttaaaaggcgcggccaatg

SEQ ID NO: 46196 - DNA, 25 bp, Homo sapien
ccagcggcgccttgctgcgcaggaa

SEQ ID NO: 46197 - DNA, 25 bp, Homo sapien
tccaccgtggcgctcgccaaaggta

SEQ ID NO: 46198 - DNA, 25 bp, Homo sapien
cttcttggttcgctcggtgcccgcg

SEQ ID NO: 46199 - DNA, 25 bp, Homo sapien
ccatatttaaaggacggcgggcgcg

SEQ ID NO: 46200 - DNA, 25 bp, Homo sapien
ccttgctgcgcaggaacgacgcgag

SEQ ID NO: 46201 - DNA, 25 bp, Homo sapien
ctggcccaagataggggagtcgtcc

SEQ ID NO: 46202 - DNA, 25 bp, Homo sapien
ggctataggcgcatctggcccaaga

SEQ ID NO: 46203 - DNA, 25 bp, Homo sapien
tggcggcccggccatatttaaagga

SEQ ID NO: 46204 - DNA, 25 bp, Homo sapien
agatcccttttgatccgggcctggg

SEQ ID NO: 46205 - DNA, 25 bp, Homo sapien
cgtctgcgtgttgccgcgtgttaca

SEQ ID NO: 46206 - DNA, 25 bp, Homo sapien
gcggccaggtcagatcccttttgat

SEQ ID NO: 46207 - DNA, 25 bp, Homo sapien
ttgccgcgtgttacacgcacgcacg

SEQ ID NO: 46208 - DNA, 25 bp, Homo sapien
ccgagcacctgtgtctcaggagatg

SEQ ID NO: 46209 - DNA, 25 bp, Homo sapien
cgctgaaacttctgactcggacacc

SEQ ID NO: 46210 - DNA, 25 bp, Homo sapien
tctcaggagatggtgagagctgtct

SEQ ID NO: 46211 - DNA, 25 bp, Homo sapien
ggccgcgcttcaatttccgctgaaa

SEQ ID NO: 46212 - DNA, 25 bp, Homo sapien
tccaggttagccgtcggtgcacagc

SEQ ID NO: 46213 - DNA, 25 bp, Homo sapien
gagcgtctgccacttagcgcacagc

SEQ ID NO: 46214 - DNA, 25 bp, Homo sapien
ctctgccttttaccggtgagctgcc

SEQ ID NO: 46215 - DNA, 25 bp, Homo sapien
atggactgctacacggcgaactgga

SEQ ID NO: 46216 - DNA, 25 bp, Homo sapien
cgctctccatgcgagcgtcgctgtg

SEQ ID NO: 46217 - DNA, 25 bp, Homo sapien
agctgccgtctgcaccagccatgga

SEQ ID NO: 46218 - DNA, 25 bp, Homo sapien
tcggccagtcggttctgcaaagctc

SEQ ID NO: 46219 - DNA, 25 bp, Homo sapien
gccaagtgaggctgcccacagtggt

SEQ ID NO: 46220 - DNA, 25 bp, Homo sapien
gcggtcgagcccttcttgacggcct

SEQ ID NO: 46221 - DNA, 25 bp, Homo sapien
tgatggcgcggtcgtagctcatgcc

SEQ ID NO: 46222 - DNA, 25 bp, Homo sapien
cgcgactgcggataatgagcgcctc

SEQ ID NO: 46223 - DNA, 25 bp, Homo sapien
gcagccggagtatccacctcgatga

SEQ ID NO: 46224 - DNA, 25 bp, Homo sapien
tccacctcgatgaccacgggctgag

SEQ ID NO: 46225 - DNA, 25 bp, Homo sapien
gcaaaggggaggttacgcagcaaac

SEQ ID NO: 46226 - DNA, 25 bp, Homo sapien
ttcttgacggcctcctgcgcgtact

SEQ ID NO: 46227 - DNA, 25 bp, Homo sapien
tcctgcgcgtactccacttggaaga

SEQ ID NO: 46228 - DNA, 25 bp, Homo sapien
tctgagcttgcagggcgtcagtgca

SEQ ID NO: 46229 - DNA, 25 bp, Homo sapien
gggccagtcgtccatcgccatgatg

SEQ ID NO: 46230 - DNA, 25 bp, Homo sapien
acgtcgcactacagctcggcgcagg

SEQ ID NO: 46231 - DNA, 25 bp, Homo sapien
agtctccatgatgcagcagcaggcg

SEQ ID NO: 46232 - DNA, 25 bp, Homo sapien
cctgtcgttcagtctccatgatgca

SEQ ID NO: 46233 - DNA, 25 bp, Homo sapien
gggcctctgtcctgtcgttcagtct

SEQ ID NO: 46234 - DNA, 25 bp, Homo sapien
tccatcgccatgatggggcagggca

SEQ ID NO: 46235 - DNA, 25 bp, Homo sapien
ggagcacaggaaaataacgaggaac

SEQ ID NO: 46236 - DNA, 25 bp, Homo sapien
gccgtgtgcacagacccgagtgacc

SEQ ID NO: 46237 - DNA, 25 bp, Homo sapien
cacacccagtatggaggtaagcttc

SEQ ID NO: 46238 - DNA, 25 bp, Homo sapien
caaggccgtgtttcctctgcgtgtc

SEQ ID NO: 46239 - DNA, 25 bp, Homo sapien
gcagagtacagctccatggtgcggc

SEQ ID NO: 46240 - DNA, 25 bp, Homo sapien
cttcgactatgacatcgcgctgctg

SEQ ID NO: 46241 - DNA, 25 bp, Homo sapien
agcgcaggctcaagcgcatcatctc

SEQ ID NO: 46242 - DNA, 25 bp, Homo sapien
cgagtgaccgcgcagtctcatagcg

SEQ ID NO: 46243 - DNA, 25 bp, Homo sapien
agcagctgtgcctcatccatgcgga

SEQ ID NO: 46244 - DNA, 25 bp, Homo sapien
agcgccacacgcagcagagttaaga

SEQ ID NO: 46245 - DNA, 25 bp, Homo sapien
tctccgtttcgcacaggccatggcg

SEQ ID NO: 46246 - DNA, 25 bp, Homo sapien
tggcgattacgcctaccagcagtca

SEQ ID NO: 46247 - DNA, 25 bp, Homo sapien
cagcagtcatcctacacggagcaga

SEQ ID NO: 46248 - DNA, 25 bp, Homo sapien
agcagagctacgaccggtccttcga

SEQ ID NO: 46249 - DNA, 25 bp, Homo sapien
accggtccttcgaggagtccacgca

SEQ ID NO: 46250 - DNA, 25 bp, Homo sapien
agtccacgcagcactactatgaggg

SEQ ID NO: 46251 - DNA, 25 bp, Homo sapien
ttaagacgctgcacccttaggagca

SEQ ID NO: 46252 - DNA, 25 bp, Homo sapien
cagcgtgtcccaggagtggacgaca

SEQ ID NO: 46253 - DNA, 25 bp, Homo sapien
actcatcttccctgggcagtgctgg

SEQ ID NO: 46254 - DNA, 25 bp, Homo sapien
gcgtcctcgtgtggatcactgtgtt

SEQ ID NO: 46255 - DNA, 25 bp, Homo sapien
tcactgtgtttttatgtgacacggc

SEQ ID NO: 46256 - DNA, 25 bp, Homo sapien
gccctcgccaggtggtgaccagcgt

SEQ ID NO: 46257 - DNA, 25 bp, Homo sapien
ttgagcgtcgttcacatgttcctcg

SEQ ID NO: 46258 - DNA, 25 bp, Homo sapien
tgtgacacggctttgagcgtcgttc

SEQ ID NO: 46259 - DNA, 25 bp, Homo sapien
tgtcgtgtgcatttctcaggccctc

SEQ ID NO: 46260 - DNA, 25 bp, Homo sapien
gttttctgcacctgcgcactgggca

SEQ ID NO: 46261 - DNA, 25 bp, Homo sapien
aagtgacgtgctttcccgagccggt

SEQ ID NO: 46262 - DNA, 25 bp, Homo sapien
caagccttgggcttccggagccaaa

SEQ ID NO: 46263 - DNA, 25 bp, Homo sapien
gctaccagggacaaggtcgcctctc

SEQ ID NO: 46264 - DNA, 25 bp, Homo sapien
tgtcctcgtcagacccgggaggttc

SEQ ID NO: 46265 - DNA, 25 bp, Homo sapien
ccgcttgcgacgctccggaagtgac

SEQ ID NO: 46266 - DNA, 25 bp, Homo sapien
gttgctcctgcttccgctaccaggg

SEQ ID NO: 46267 - DNA, 25 bp, Homo sapien
aggtagatcgtcacctcggctcccg

SEQ ID NO: 46268 - DNA, 25 bp, Homo sapien
gagcgctgccgctttctcttgttcg

SEQ ID NO: 46269 - DNA, 25 bp, Homo sapien
ggcatcatacgaggcgcccaccaga

SEQ ID NO: 46270 - DNA, 25 bp, Homo sapien
acctgaaggtgctgtatgacgccta

SEQ ID NO: 46271 - DNA, 25 bp, Homo sapien
acaagattgacctccctgaagccca

SEQ ID NO: 46272 - DNA, 25 bp, Homo sapien
gccgtggactcaagttgacgattta

SEQ ID NO: 46273 - DNA, 25 bp, Homo sapien
ctcttgttcgtggtggatctttctc

SEQ ID NO: 46274 - DNA, 25 bp, Homo sapien
agctccgggatcacttgggacagga

SEQ ID NO: 46275 - DNA, 25 bp, Homo sapien
tggagatgtatgaaaagggcctgtc

SEQ ID NO: 46276 - DNA, 25 bp, Homo sapien
cctgaagggcagacatgctgaggca

SEQ ID NO: 46277 - DNA, 25 bp, Homo sapien
acgcactttccacacttcacgttag

SEQ ID NO: 46278 - DNA, 25 bp, Homo sapien
acctcgtttgtctgtatgcagtgcc

SEQ ID NO: 46279 - DNA, 25 bp, Homo sapien
aaccggagcgtctcatcagtgaaca

SEQ ID NO: 46280 - DNA, 25 bp, Homo sapien
tcagtgaacacacgtgccggggacc

SEQ ID NO: 46281 - DNA, 25 bp, Homo sapien
tcctggtgccgctaaagaggctgca

SEQ ID NO: 46282 - DNA, 25 bp, Homo sapien
agctctgcgtgcatggcgtccacct

SEQ ID NO: 46283 - DNA, 25 bp, Homo sapien
ctcctggagaacagagacctcgttt

SEQ ID NO: 46284 - DNA, 25 bp, Homo sapien
tgacggccagcgacttggccacttt

SEQ ID NO: 46285 - DNA, 25 bp, Homo sapien
gccgacggcttggagcccctcttga

SEQ ID NO: 46286 - DNA, 25 bp, Homo sapien
gggacaccatcttcatgcgcttctc

SEQ ID NO: 46287 - DNA, 25 bp, Homo sapien
agctctgggacaccatcttcatgcg

SEQ ID NO: 46288 - DNA, 25 bp, Homo sapien
tgggtgaagctctgggacaccatct

SEQ ID NO: 46289 - DNA, 25 bp, Homo sapien
cagccgaaagcgctgggtgaagctc

SEQ ID NO: 46290 - DNA, 25 bp, Homo sapien
ctttcctgtcccgagacagccgaaa

SEQ ID NO: 46291 - DNA, 25 bp, Homo sapien
ttggccactttcctgtcccgagaca

SEQ ID NO: 46292 - DNA, 25 bp, Homo sapien
tttaccgacgaggaagtcggagatg

SEQ ID NO: 46293 - DNA, 25 bp, Homo sapien
agcaccgtggccacgatgagcagcg

SEQ ID NO: 46294 - DNA, 25 bp, Homo sapien
ccacgaaggcgagcatgaccagcgc

SEQ ID NO: 46295 - DNA, 25 bp, Homo sapien
gcgagcatgaccagcgcgttgccca

SEQ ID NO: 46296 - DNA, 25 bp, Homo sapien
cgggagcctcgtctttgcgggccct

SEQ ID NO: 46297 - DNA, 25 bp, Homo sapien
tgcgaccgtgcagccggagcgcaac

SEQ ID NO: 46298 - DNA, 25 bp, Homo sapien
ctgcgctcacagcagctggctggga

SEQ ID NO: 46299 - DNA, 25 bp, Homo sapien
gagccacccaggtccgtgttccagt

SEQ ID NO: 46300 - DNA, 25 bp, Homo sapien
cgtgcgcatttagggcgatcctgta

SEQ ID NO: 46301 - DNA, 25 bp, Homo sapien
catttagggcgatcctgtaggtgag

SEQ ID NO: 46302 - DNA, 25 bp, Homo sapien
cagggaaggatttcgtgcgcattta

SEQ ID NO: 46303 - DNA, 25 bp, Homo sapien
cacctcaccgggaacagggaaggat

SEQ ID NO: 46304 - DNA, 25 bp, Homo sapien
cgcacttccgcctcggtgtcagtgg

SEQ ID NO: 46305 - DNA, 25 bp, Homo sapien
cgaagggattagcatagtcccaccc

SEQ ID NO: 46306 - DNA, 25 bp, Homo sapien
ccttcgcgaagggattagcatagtc

SEQ ID NO: 46307 - DNA, 25 bp, Homo sapien
ggcacaggtagaggcccttcgcgaa

SEQ ID NO: 46308 - DNA, 25 bp, Homo sapien
actctggctcctctctgcgttttga

SEQ ID NO: 46309 - DNA, 25 bp, Homo sapien
cccgccaggcgtatcgcaaaaggca

SEQ ID NO: 46310 - DNA, 25 bp, Homo sapien
ctccatcgcagagcaccatgtgttg

SEQ ID NO: 46311 - DNA, 25 bp, Homo sapien
tgttgtgcttctactcagctcggtg

SEQ ID NO: 46312 - DNA, 25 bp, Homo sapien
tccgttctagggacttggcaggttc

SEQ ID NO: 46313 - DNA, 25 bp, Homo sapien
atccgtcgttctttgcagcaattag

SEQ ID NO: 46314 - DNA, 25 bp, Homo sapien
gcgcctgtctctgaacagccaatga

SEQ ID NO: 46315 - DNA, 25 bp, Homo sapien
tgaacacgcgtcttacagccaaggc

SEQ ID NO: 46316 - DNA, 25 bp, Homo sapien
gctgaccttctgtcatctccgtgaa

SEQ ID NO: 46317 - DNA, 25 bp, Homo sapien
tcgtctctgcgaagggaaacgcctg

SEQ ID NO: 46318 - DNA, 25 bp, Homo sapien
tccatgaagccaccgctgtgtcgtc

SEQ ID NO: 46319 - DNA, 25 bp, Homo sapien
agactccatgaagtgctgtttcgcg

SEQ ID NO: 46320 - DNA, 25 bp, Homo sapien
tctcccgaagggaaacacgcctggc

SEQ ID NO: 46321 - DNA, 25 bp, Homo sapien
tcatctccacgaagggaaacgcctg

SEQ ID NO: 46322 - DNA, 25 bp, Homo sapien
gacctcctgtcgtcacccgaaggga

SEQ ID NO: 46323 - DNA, 25 bp, Homo sapien
tcacccgaagggaaacacgcctggc

SEQ ID NO: 46324 - DNA, 25 bp, Homo sapien
tctagtccaatgacccgtggggagc

SEQ ID NO: 46325 - DNA, 25 bp, Homo sapien
tgggctgttccagagttttctagtc

SEQ ID NO: 46326 - DNA, 25 bp, Homo sapien
cttgtctccgcccagggtgattccg

SEQ ID NO: 46327 - DNA, 25 bp, Homo sapien
cgcagcagatcacgccgcgcatgat

SEQ ID NO: 46328 - DNA, 25 bp, Homo sapien
tggcgcgctgatcctgcaaaagggt

SEQ ID NO: 46329 - DNA, 25 bp, Homo sapien
caaaagggtgagatccgcgtcatca

SEQ ID NO: 46330 - DNA, 25 bp, Homo sapien
tctcgaatgacgctgccctcgaagc

SEQ ID NO: 46331 - DNA, 25 bp, Homo sapien
gtcatcaaccagaccacctgcgaga

SEQ ID NO: 46332 - DNA, 25 bp, Homo sapien
cggggcgcctccaacaagtacttgg

SEQ ID NO: 46333 - DNA, 25 bp, Homo sapien
gcgctctttccaagcctggtgccag

SEQ ID NO: 46334 - DNA, 25 bp, Homo sapien
gggaccaccgtgactccggataagc

SEQ ID NO: 46335 - DNA, 25 bp, Homo sapien
tccgcgctttcaggatgacgacctc

SEQ ID NO: 46336 - DNA, 25 bp, Homo sapien
tctgaaacccgcctgtggtccctgg

SEQ ID NO: 46337 - DNA, 25 bp, Homo sapien
cacagcaacaataggggccgctctg

SEQ ID NO: 46338 - DNA, 25 bp, Homo sapien
gccctcgccaatcgttggcaggtta

SEQ ID NO: 46339 - DNA, 25 bp, Homo sapien
ggcgtgtctgagtctgccttaggca

SEQ ID NO: 46340 - DNA, 25 bp, Homo sapien
cagctgcctcagcaactagcccgag

SEQ ID NO: 46341 - DNA, 25 bp, Homo sapien
cggccagcaaggtaacgtgtgctgt

SEQ ID NO: 46342 - DNA, 25 bp, Homo sapien
gatgaacgtaccagccgggccagca

SEQ ID NO: 46343 - DNA, 25 bp, Homo sapien
gagcatcctggccacgatgaacgta

SEQ ID NO: 46344 - DNA, 25 bp, Homo sapien
gctgagcgacctccagagcatcctg

SEQ ID NO: 46345 - DNA, 25 bp, Homo sapien
tcccggagccagtcggcagcggtca

SEQ ID NO: 46346 - DNA, 25 bp, Homo sapien
ccagttccgggaatggagccagcac

SEQ ID NO: 46347 - DNA, 25 bp, Homo sapien
atccagctgagcgacctccagagca

SEQ ID NO: 46348 - DNA, 25 bp, Homo sapien
gtcccgaggccttccatctgtgcaa

SEQ ID NO: 46349 - DNA, 25 bp, Homo sapien
cgaggccttccatctgtgcaacgaa

SEQ ID NO: 46350 - DNA, 25 bp, Homo sapien
ttccatctgtgcaacgaagtggcca

SEQ ID NO: 46351 - DNA, 25 bp, Homo sapien
ctgtgcaacgaagtggccattgctc

SEQ ID NO: 46352 - DNA, 25 bp, Homo sapien
acgaagtggccattgctcaggaaga

SEQ ID NO: 46353 - DNA, 25 bp, Homo sapien
cattgctcaggaagagcgccaggga

SEQ ID NO: 46354 - DNA, 25 bp, Homo sapien
ctcagacgggcagtgaagaggagga

SEQ ID NO: 46355 - DNA, 25 bp, Homo sapien
aggacgtgcatggagagactgggcc

SEQ ID NO: 46356 - DNA, 25 bp, Homo sapien
gcgaacgggcaagggccctgcagtt

SEQ ID NO: 46357 - DNA, 25 bp, Homo sapien
caggctgacagctgcgaactgctcc

SEQ ID NO: 46358 - DNA, 25 bp, Homo sapien
tccaggctgacagctgcgaactgct

SEQ ID NO: 46359 - DNA, 25 bp, Homo sapien
tgtccaggctgacagctgcgaactg

SEQ ID NO: 46360 - DNA, 25 bp, Homo sapien
agaggtgaagggtggtgggtgcaca

SEQ ID NO: 46361 - DNA, 25 bp, Homo sapien
cacctgtccaggctgacagctgcga

SEQ ID NO: 46362 - DNA, 25 bp, Homo sapien
agagatggcgaacgggcaagggccc

SEQ ID NO: 46363 - DNA, 25 bp, Homo sapien
cctgtccaggctgacagctgcgaac

SEQ ID NO: 46364 - DNA, 25 bp, Homo sapien
gaactcctcaatgggcaccagagtg

SEQ ID NO: 46365 - DNA, 25 bp, Homo sapien
agagcacagtgggtgagtcagagcc

SEQ ID NO: 46366 - DNA, 25 bp, Homo sapien
ccattacctgccattacctgttggg

SEQ ID NO: 46367 - DNA, 25 bp, Homo sapien
attacctgccattacctgttggggc

SEQ ID NO: 46368 - DNA, 25 bp, Homo sapien
tccgggctgaactcctcaatgggca

SEQ ID NO: 46369 - DNA, 25 bp, Homo sapien
agggacgagatgctgcaacgcccgt

SEQ ID NO: 46370 - DNA, 25 bp, Homo sapien
cgagatgctgcaacgcccgtggtgc

SEQ ID NO: 46371 - DNA, 25 bp, Homo sapien
ctgctgatgcagctgacccggggct

SEQ ID NO: 46372 - DNA, 25 bp, Homo sapien
tccacacgcagtgtgtgacacacgt

SEQ ID NO: 46373 - DNA, 25 bp, Homo sapien
acccacacttgagacacgcgatacg

SEQ ID NO: 46374 - DNA, 25 bp, Homo sapien
acacgcccgtgaaaggacatgaaca

SEQ ID NO: 46375 - DNA, 25 bp, Homo sapien
acgcaaacgtgcaccgcgtggggta

SEQ ID NO: 46376 - DNA, 25 bp, Homo sapien
gtggggtacccgtgtacattccaca

SEQ ID NO: 46377 - DNA, 25 bp, Homo sapien
aacgcacgtgaagatgcacccacta

SEQ ID NO: 46378 - DNA, 25 bp, Homo sapien
tgacacacgtctgaacaagcacaca

SEQ ID NO: 46379 - DNA, 25 bp, Homo sapien
gctcatggacatgcacgcaaacgtg

SEQ ID NO: 46380 - DNA, 25 bp, Homo sapien
tctttggcatcgcaggcatccgcgt

SEQ ID NO: 46381 - DNA, 25 bp, Homo sapien
ggacgtccgttcaccagggacacca

SEQ ID NO: 46382 - DNA, 25 bp, Homo sapien
taggagaaattcatggcgcccggac

SEQ ID NO: 46383 - DNA, 25 bp, Homo sapien
tgaactcacgtagcagcggcgagta

SEQ ID NO: 46384 - DNA, 25 bp, Homo sapien
acgttggtggccttggtgaactcac

SEQ ID NO: 46385 - DNA, 25 bp, Homo sapien
tgtaataatactgcacccgcaggcc

SEQ ID NO: 46386 - DNA, 25 bp, Homo sapien
cggcctccgatgctgatatccttga

SEQ ID NO: 46387 - DNA, 25 bp, Homo sapien
acaccacgatctgtgggcagtatgc

SEQ ID NO: 46388 - DNA, 25 bp, Homo sapien
gcagtcgaactggaccggcgcccag

SEQ ID NO: 46389 - DNA, 25 bp, Homo sapien
tccatgccggggactttaattccgc

SEQ ID NO: 46390 - DNA, 25 bp, Homo sapien
cccaaaatgcggaaccagagagtcc

SEQ ID NO: 46391 - DNA, 25 bp, Homo sapien
ggggccgcgaacacacagtgcgctc

SEQ ID NO: 46392 - DNA, 25 bp, Homo sapien
tgcgctcacccggatggtctggttg

SEQ ID NO: 46393 - DNA, 25 bp, Homo sapien
ccctaccagcttgcagtaaaggtcc

SEQ ID NO: 46394 - DNA, 25 bp, Homo sapien
cagcttgcagtaaaggtcctcggtg

SEQ ID NO: 46395 - DNA, 25 bp, Homo sapien
gtcaccgcagtcgaactggaccggc

SEQ ID NO: 46396 - DNA, 25 bp, Homo sapien
gcgcctcggtcacgttcactaggga

SEQ ID NO: 46397 - DNA, 25 bp, Homo sapien
ctcggtcacgttcactagggatcgc

SEQ ID NO: 46398 - DNA, 25 bp, Homo sapien
tcacgttcactagggatcgcgggtg

SEQ ID NO: 46399 - DNA, 25 bp, Homo sapien
gtgtgcgcctcggtcacgttcacta

SEQ ID NO: 46400 - DNA, 25 bp, Homo sapien
ggcctcggtcacgttcactagggat

SEQ ID NO: 46401 - DNA, 25 bp, Homo sapien
gcctcggtcacgttcactagggatc

SEQ ID NO: 46402 - DNA, 25 bp, Homo sapien
cctcggtcacgttcactagggatcg

SEQ ID NO: 46403 - DNA, 25 bp, Homo sapien
cgcctcggtcacgttcactagggat

SEQ ID NO: 46404 - DNA, 25 bp, Homo sapien
tcggccctttgaccctcacaggata

SEQ ID NO: 46405 - DNA, 25 bp, Homo sapien
tgaggttctccgaagctgttgcgtc

SEQ ID NO: 46406 - DNA, 25 bp, Homo sapien
gttgcgtcgagttctgtccttcgtc

SEQ ID NO: 46407 - DNA, 25 bp, Homo sapien
cagtgaggagactcggccatgctac

SEQ ID NO: 46408 - DNA, 25 bp, Homo sapien
gacccgctggccaaatccaagatcg

SEQ ID NO: 46409 - DNA, 25 bp, Homo sapien
ccaagatcgagcgagtgaacatgcc

SEQ ID NO: 46410 - DNA, 25 bp, Homo sapien
accctgcggagttcttcgtgctgat

SEQ ID NO: 46411 - DNA, 25 bp, Homo sapien
tgatggagcgttaccagcactaccg

SEQ ID NO: 46412 - DNA, 25 bp, Homo sapien
tccttcacgtggttctgtgctcccg

SEQ ID NO: 46413 - DNA, 25 bp, Homo sapien
accaccgtctctttgcacacgtgtg

SEQ ID NO: 46414 - DNA, 25 bp, Homo sapien
gagaacacacaccaccgtctctttg

SEQ ID NO: 46415 - DNA, 25 bp, Homo sapien
acatgtgtgcacacgcagatgcagg

SEQ ID NO: 46416 - DNA, 25 bp, Homo sapien
cacacgcgtgcccagcacatgtgtg

SEQ ID NO: 46417 - DNA, 25 bp, Homo sapien
cacctcggtgaggtcgtccatgatg

SEQ ID NO: 46418 - DNA, 25 bp, Homo sapien
cccgctgcatagcacctcggtgagg

SEQ ID NO: 46419 - DNA, 25 bp, Homo sapien
gcacacgcagatgcaggagagaaca

SEQ ID NO: 46420 - DNA, 25 bp, Homo sapien
tccagcccgacgctctcagaagcag

SEQ ID NO: 46421 - DNA, 25 bp, Homo sapien
ctcgaatcctccatgactccaggga

SEQ ID NO: 46422 - DNA, 25 bp, Homo sapien
atgactccagggaagcgactccgtc

SEQ ID NO: 46423 - DNA, 25 bp, Homo sapien
cgccagcagggctccagaaatgagg

SEQ ID NO: 46424 - DNA, 25 bp, Homo sapien
aatcccgccattcccactgggcatg

SEQ ID NO: 46425 - DNA, 25 bp, Homo sapien
tggacgtgccgtgcccgaaatcccg

SEQ ID NO: 46426 - DNA, 25 bp, Homo sapien
acaccgttgcctctggacgtgccgt

SEQ ID NO: 46427 - DNA, 25 bp, Homo sapien
ctgggcgccagcagggctccagaaa

SEQ ID NO: 46428 - DNA, 25 bp, Homo sapien
cgagaacctccttgccggaagcgga

SEQ ID NO: 46429 - DNA, 25 bp, Homo sapien
tacgtgccgcggaaatggtaagcgc

SEQ ID NO: 46430 - DNA, 25 bp, Homo sapien
ttcctttctctctcgcgcgcggtgt

SEQ ID NO: 46431 - DNA, 25 bp, Homo sapien
gggcacaacccaggggccaggctaa

SEQ ID NO: 46432 - DNA, 25 bp, Homo sapien
cgccgatatctctgccgggtgacta

SEQ ID NO: 46433 - DNA, 25 bp, Homo sapien
gctaagacgccacacacggcaacga

SEQ ID NO: 46434 - DNA, 25 bp, Homo sapien
cttctcccagctgctattcggggct

SEQ ID NO: 46435 - DNA, 25 bp, Homo sapien
ccgggtgactagctgcttcctttct

SEQ ID NO: 46436 - DNA, 25 bp, Homo sapien
cactccacccttgcgttttacgtgg

SEQ ID NO: 46437 - DNA, 25 bp, Homo sapien
ttcacgtgtgcctcgtgggcactga

SEQ ID NO: 46438 - DNA, 25 bp, Homo sapien
tctcggaagacacagagacgccgcc

SEQ ID NO: 46439 - DNA, 25 bp, Homo sapien
cttctagctcaaagaccatctcgga

SEQ ID NO: 46440 - DNA, 25 bp, Homo sapien
gtgtccaccagcgaagaggctctta

SEQ ID NO: 46441 - DNA, 25 bp, Homo sapien
tttacgtggagtgaagcacagcttc

SEQ ID NO: 46442 - DNA, 25 bp, Homo sapien
cagggccacgttctcagggctgcac

SEQ ID NO: 46443 - DNA, 25 bp, Homo sapien
agaggctcttaccttcccgtctgct

SEQ ID NO: 46444 - DNA, 25 bp, Homo sapien
gctggaggttgacatgctgagcctc

SEQ ID NO: 46445 - DNA, 25 bp, Homo sapien
cctagatggacaccgcatgcgaggc

SEQ ID NO: 46446 - DNA, 25 bp, Homo sapien
gcgaggcaagcgctgagtactcacc

SEQ ID NO: 46447 - DNA, 25 bp, Homo sapien
agtactcacctgatccgcaggcctt

SEQ ID NO: 46448 - DNA, 25 bp, Homo sapien
cccatagggcaggaccgagaaggcc

SEQ ID NO: 46449 - DNA, 25 bp, Homo sapien
ccgcttggcacagatgagcacgatc

SEQ ID NO: 46450 - DNA, 25 bp, Homo sapien
agaaaccggctcctctggagagtga

SEQ ID NO: 46451 - DNA, 25 bp, Homo sapien
gccttgccttctgcctagatggaca

SEQ ID NO: 46452 - DNA, 25 bp, Homo sapien
cctgcaagatgacaatggagcctca

SEQ ID NO: 46453 - DNA, 25 bp, Homo sapien
ggtgccgcctttgtggccagaaacc

SEQ ID NO: 46454 - DNA, 25 bp, Homo sapien
ttgtggccagaaaccgagtgccgcc

SEQ ID NO: 46455 - DNA, 25 bp, Homo sapien
tggagcctcaaaacaggccaccagc

SEQ ID NO: 46456 - DNA, 25 bp, Homo sapien
ctcgcttcctgcaagatgacaatgg

SEQ ID NO: 46457 - DNA, 25 bp, Homo sapien
gacgtgactcgcttcctgcaagatg

SEQ ID NO: 46458 - DNA, 25 bp, Homo sapien
gctggagcgcatcccacggcatctt

SEQ ID NO: 46459 - DNA, 25 bp, Homo sapien
agcagcgctgggacgtgactcgctt

SEQ ID NO: 46460 - DNA, 25 bp, Homo sapien
gggctctcgctttctgttccctttg

SEQ ID NO: 46461 - DNA, 25 bp, Homo sapien
tccctttgctgtatggcggccttcg

SEQ ID NO: 46462 - DNA, 25 bp, Homo sapien
tatggcggccttcgcggatggcctc

SEQ ID NO: 46463 - DNA, 25 bp, Homo sapien
cacattttaaggctccggacccagg

SEQ ID NO: 46464 - DNA, 25 bp, Homo sapien
cggcgcgcccacatgcaaatgtatc

SEQ ID NO: 46465 - DNA, 25 bp, Homo sapien
atgcaaatgtatcgccgtcgcgctc

SEQ ID NO: 46466 - DNA, 25 bp, Homo sapien
cagcacacttccctgtccggaggtg

SEQ ID NO: 46467 - DNA, 25 bp, Homo sapien
tggcctccatcgagcgcacatttta

SEQ ID NO: 46468 - DNA, 25 bp, Homo sapien
tcctctgtgacgtctgtcccgtcca

SEQ ID NO: 46469 - DNA, 25 bp, Homo sapien
ctgtcctgtccacgcaacgcccccc

SEQ ID NO: 46470 - DNA, 25 bp, Homo sapien
tcctctgtgacgtctgtcctgtcca

SEQ ID NO: 46471 - DNA, 25 bp, Homo sapien
tctgtcctgtccacgcaacgccccc

SEQ ID NO: 46472 - DNA, 25 bp, Homo sapien
tctgtgacgtctgtcccgtccacgc

SEQ ID NO: 46473 - DNA, 25 bp, Homo sapien
ctgtgacgtctgtcccgtccacgca

SEQ ID NO: 46474 - DNA, 25 bp, Homo sapien
ctcctctgtgacgtctgtcctgtcc

SEQ ID NO: 46475 - DNA, 25 bp, Homo sapien
ctctgtgacgtctgtcccgtccacg

SEQ ID NO: 46476 - DNA, 25 bp, Homo sapien
cccagcctcttggtctgagagtgcg

SEQ ID NO: 46477 - DNA, 25 bp, Homo sapien
cgcgtctgtgccgtgagtgtaacag

SEQ ID NO: 46478 - DNA, 25 bp, Homo sapien
gagtgtaacaggaatagcccgggcc

SEQ ID NO: 46479 - DNA, 25 bp, Homo sapien
ccggccgggacatgtgtgtacaaca

SEQ ID NO: 46480 - DNA, 25 bp, Homo sapien
catgtgtgtacaacagcccagggga

SEQ ID NO: 46481 - DNA, 25 bp, Homo sapien
acagcccaggggacaatagccatcc

SEQ ID NO: 46482 - DNA, 25 bp, Homo sapien
ggggacaatagccatcctgcccgct

SEQ ID NO: 46483 - DNA, 25 bp, Homo sapien
agttccgccgccacagcgtggtgtt

SEQ ID NO: 46484 - DNA, 25 bp, Homo sapien
ctgcccgggccgaaggccgacgaat

SEQ ID NO: 46485 - DNA, 25 bp, Homo sapien
caacagcgcgccctggtaggcactg

SEQ ID NO: 46486 - DNA, 25 bp, Homo sapien
acgaatccgcggtggctgtctgcgc

SEQ ID NO: 46487 - DNA, 25 bp, Homo sapien
gctcggctcacacccggacaggtag

SEQ ID NO: 46488 - DNA, 25 bp, Homo sapien
acacccggacaggtaggacagcatc

SEQ ID NO: 46489 - DNA, 25 bp, Homo sapien
ccggcggcacaaacatcggagagcc

SEQ ID NO: 46490 - DNA, 25 bp, Homo sapien
gtacatcctcccaggcgtggtcttg

SEQ ID NO: 46491 - DNA, 25 bp, Homo sapien
gccgcgaactgttctcgaggcaaca

SEQ ID NO: 46492 - DNA, 25 bp, Homo sapien
cgcggcccagctgacaggctatttt

SEQ ID NO: 46493 - DNA, 25 bp, Homo sapien
actaaatatggtcagggagcgcagc

SEQ ID NO: 46494 - DNA, 25 bp, Homo sapien
tggcgtgggtgctcccaccctgttc

SEQ ID NO: 46495 - DNA, 25 bp, Homo sapien
ccctgcttgactaaatatggtcagg

SEQ ID NO: 46496 - DNA, 25 bp, Homo sapien
cgtcaatggcgtgggtgctcccacc

SEQ ID NO: 46497 - DNA, 25 bp, Homo sapien
acccgccgtcaatggcgtgggtgct

SEQ ID NO: 46498 - DNA, 25 bp, Homo sapien
gcccagctgacaggctattttttcc

SEQ ID NO: 46499 - DNA, 25 bp, Homo sapien
taaatatggtcagggagcgcagccc

SEQ ID NO: 46500 - DNA, 25 bp, Homo sapien
ggtccatcggtgtctgggtcagcgt

SEQ ID NO: 46501 - DNA, 25 bp, Homo sapien
tccatcggtgtctgggtcagcgtct

SEQ ID NO: 46502 - DNA, 25 bp, Homo sapien
ggtcagcgtctgtcggggtctgggt

SEQ ID NO: 46503 - DNA, 25 bp, Homo sapien
gtccatcggtgtctgggtcagcgtc

SEQ ID NO: 46504 - DNA, 25 bp, Homo sapien
gtcagcgtctgtcggggtctgggtc

SEQ ID NO: 46505 - DNA, 25 bp, Homo sapien
tctgggtcggggtccatcggtgtct

SEQ ID NO: 46506 - DNA, 25 bp, Homo sapien
ccatcggtgtctgggtcagcgtctg

SEQ ID NO: 46507 - DNA, 25 bp, Homo sapien
gggtcagcgtctgtcggggtctggg

SEQ ID NO: 46508 - DNA, 25 bp, Homo sapien
ggtctcctcccagaaggattaaatg

SEQ ID NO: 46509 - DNA, 25 bp, Homo sapien
caaaggacgggcagctccctggaag

SEQ ID NO: 46510 - DNA, 25 bp, Homo sapien
ggccggtctcctcccagaaggatta

SEQ ID NO: 46511 - DNA, 25 bp, Homo sapien
gcgcctaggcccgtgagcagcctgt

SEQ ID NO: 46512 - DNA, 25 bp, Homo sapien
ctcccagaaggattaaatgccaccg

SEQ ID NO: 46513 - DNA, 25 bp, Homo sapien
taaatgccaccgaggggatcccgtg

SEQ ID NO: 46514 - DNA, 25 bp, Homo sapien
cccggcgcggactaggctgacagac

SEQ ID NO: 46515 - DNA, 25 bp, Homo sapien
agaggtggcaacactccggccgctc

SEQ ID NO: 46516 - DNA, 25 bp, Homo sapien
agaggaaagcccgtacgcactcggc

SEQ ID NO: 46517 - DNA, 25 bp, Homo sapien
gcccaggccctgctaatgaagagga

SEQ ID NO: 46518 - DNA, 25 bp, Homo sapien
cggcgaccctctgtgaccaatcata

SEQ ID NO: 46519 - DNA, 25 bp, Homo sapien
actccaggagctgagcggattttga

SEQ ID NO: 46520 - DNA, 25 bp, Homo sapien
cccagcgctgaaacttgatggctcc

SEQ ID NO: 46521 - DNA, 25 bp, Homo sapien
tgatggctccgaacaccctcgaagc

SEQ ID NO: 46522 - DNA, 25 bp, Homo sapien
aaacagagctccaccgacgcaatgc

SEQ ID NO: 46523 - DNA, 25 bp, Homo sapien
ggcccaatatctgctgcgcggaaga

SEQ ID NO: 46524 - DNA, 25 bp, Homo sapien
gccgggcggtattcaccgctgaaga

SEQ ID NO: 46525 - DNA, 25 bp, Homo sapien
gccgtggagttttctcttggctcgc

SEQ ID NO: 46526 - DNA, 25 bp, Homo sapien
tccacatttggaaaactgcagagcc

SEQ ID NO: 46527 - DNA, 25 bp, Homo sapien
caggaactttgacttgcgggcattt

SEQ ID NO: 46528 - DNA, 25 bp, Homo sapien
tgcgggcattttgcaagaaagcagc

SEQ ID NO: 46529 - DNA, 25 bp, Homo sapien
gggctaaacttaccttgaacttgca

SEQ ID NO: 46530 - DNA, 25 bp, Homo sapien
gggactcggcacttctgcagctctc

SEQ ID NO: 46531 - DNA, 25 bp, Homo sapien
tggctcgcggcatcatccacatttg

SEQ ID NO: 46532 - DNA, 25 bp, Homo sapien
cggttcagggtggtgacgctgcgag

SEQ ID NO: 46533 - DNA, 25 bp, Homo sapien
ccatgtaagctgctggctctgcgca

SEQ ID NO: 46534 - DNA, 25 bp, Homo sapien
ggcaggtgacggtggctgctgaccc

SEQ ID NO: 46535 - DNA, 25 bp, Homo sapien
agctgccgcttcaggtgggccgcac

SEQ ID NO: 46536 - DNA, 25 bp, Homo sapien
tgcccatgtaagctgctggctctgc

SEQ ID NO: 46537 - DNA, 25 bp, Homo sapien
cggtgcccatgtaagctgctggctc

SEQ ID NO: 46538 - DNA, 25 bp, Homo sapien
cccggtgcccatgtaagctgctggc

SEQ ID NO: 46539 - DNA, 25 bp, Homo sapien
gtaagctgctggctctgcgcagctg

SEQ ID NO: 46540 - DNA, 25 bp, Homo sapien
cgggacctctctcgccgcactgagg

SEQ ID NO: 46541 - DNA, 25 bp, Homo sapien
cgcactgaggggcactccacaccac

SEQ ID NO: 46542 - DNA, 25 bp, Homo sapien
accagacattaaatattcagcttgc

SEQ ID NO: 46543 - DNA, 25 bp, Homo sapien
ggaagtgctcaccagacattaaata

SEQ ID NO: 46544 - DNA, 25 bp, Homo sapien
cctgtgtcagcaggtggaagtgctc

SEQ ID NO: 46545 - DNA, 25 bp, Homo sapien
ttctgtcactttgcctgtgtcagca

SEQ ID NO: 46546 - DNA, 25 bp, Homo sapien
ccgccagcattgttctgtcactttg

SEQ ID NO: 46547 - DNA, 25 bp, Homo sapien
attcagcttgctgactgcggcagag

SEQ ID NO: 46548 - DNA, 25 bp, Homo sapien
ccagaggctgtgtgttacgtgctgt

SEQ ID NO: 46549 - DNA, 25 bp, Homo sapien
ctcacaccgggcctgcgtgcatcac

SEQ ID NO: 46550 - DNA, 25 bp, Homo sapien
gtgtgcgtcccctgagcctgcgtgc

SEQ ID NO: 46551 - DNA, 25 bp, Homo sapien
cctgcgtgcacccagaggctgtgtg

SEQ ID NO: 46552 - DNA, 25 bp, Homo sapien
cgtgcacccagaggctgtgtgttac

SEQ ID NO: 46553 - DNA, 25 bp, Homo sapien
tgcacccagaggctgtgtgttacgt

SEQ ID NO: 46554 - DNA, 25 bp, Homo sapien
cacccagaggctgtgtgttacgtgc

SEQ ID NO: 46555 - DNA, 25 bp, Homo sapien
acccagaggctgtgtgttacgtgct

SEQ ID NO: 46556 - DNA, 25 bp, Homo sapien
ccatggaccaggagcgcttcccgga

SEQ ID NO: 46557 - DNA, 25 bp, Homo sapien
ctcaggaccgcgtcccggggtgaat

SEQ ID NO: 46558 - DNA, 25 bp, Homo sapien
gggactgtggtgcacagtcacatca

SEQ ID NO: 46559 - DNA, 25 bp, Homo sapien
caggacaccttcagggcacttccgg

SEQ ID NO: 46560 - DNA, 25 bp, Homo sapien
acaccttcagggcacttccggtggc

SEQ ID NO: 46561 - DNA, 25 bp, Homo sapien
gtgatgccatggaccaggagcgctt

SEQ ID NO: 46562 - DNA, 25 bp, Homo sapien
gtgaatcgtgctcctgaaatgggga

SEQ ID NO: 46563 - DNA, 25 bp, Homo sapien
actgcgcctgaggacggtgatgcca

SEQ ID NO: 46564 - DNA, 25 bp, Homo sapien
cgtgacagcttaatggcttcggtta

SEQ ID NO: 46565 - DNA, 25 bp, Homo sapien
cgcagagccgatgagctcagagccg

SEQ ID NO: 46566 - DNA, 25 bp, Homo sapien
actgtctccggctgccgctgagctg

SEQ ID NO: 46567 - DNA, 25 bp, Homo sapien
gcactctggacactgtctccggctg

SEQ ID NO: 46568 - DNA, 25 bp, Homo sapien
aagcatcctctgatcgtgctggcgc

SEQ ID NO: 46569 - DNA, 25 bp, Homo sapien
cccgcctgcagtaactgacaggaag

SEQ ID NO: 46570 - DNA, 25 bp, Homo sapien
tggcttcggttaaagcatcctctga

SEQ ID NO: 46571 - DNA, 25 bp, Homo sapien
tgggccgtgacagcttaatggcttc

SEQ ID NO: 46572 - DNA, 25 bp, Homo sapien
cacagggctagtttccagcagcggc

SEQ ID NO: 46573 - DNA, 25 bp, Homo sapien
ctttgttcgcgccagaggcgctcga

SEQ ID NO: 46574 - DNA, 25 bp, Homo sapien
aaccttcatgcacggaagtttctcg

SEQ ID NO: 46575 - DNA, 25 bp, Homo sapien
ctgccgagtcaaggaggaaaccttc

SEQ ID NO: 46576 - DNA, 25 bp, Homo sapien
tccagagttgcggagtcacccacct

SEQ ID NO: 46577 - DNA, 25 bp, Homo sapien
ccacagatccagctggggacgaacg

SEQ ID NO: 46578 - DNA, 25 bp, Homo sapien
aatcggaggccaaattcgccgcttc

SEQ ID NO: 46579 - DNA, 25 bp, Homo sapien
agaggcgctcgagacatctccggga

SEQ ID NO: 46580 - DNA, 25 bp, Homo sapien
atcctgttcttcctgtgtgcggccg

SEQ ID NO: 46581 - DNA, 25 bp, Homo sapien
tgcaggtcctcaacacgcccaaggg

SEQ ID NO: 46582 - DNA, 25 bp, Homo sapien
ggccgcattcctgcaggggatgact

SEQ ID NO: 46583 - DNA, 25 bp, Homo sapien
caggggatgactgtgaatggcttca

SEQ ID NO: 46584 - DNA, 25 bp, Homo sapien
tggcttcatcaacacagtcatcacc

SEQ ID NO: 46585 - DNA, 25 bp, Homo sapien
agcgccgctatgacctgcacagcta

SEQ ID NO: 46586 - DNA, 25 bp, Homo sapien
gcacagctaccagagcgggctcatc

SEQ ID NO: 46587 - DNA, 25 bp, Homo sapien
ggtgtcaggacgtgccctgccaacc

SEQ ID NO: 46588 - DNA, 25 bp, Homo sapien
atcttctacacagcggccatcctgg

SEQ ID NO: 46589 - DNA, 25 bp, Homo sapien
cccagctgccggctacctgattgga

SEQ ID NO: 46590 - DNA, 25 bp, Homo sapien
tacctgattggaggtgccctgctga

SEQ ID NO: 46591 - DNA, 25 bp, Homo sapien
tcagagtcagcagggcccactctga

SEQ ID NO: 46592 - DNA, 25 bp, Homo sapien
ccacgtgtctctggaagggggttca

SEQ ID NO: 46593 - DNA, 25 bp, Homo sapien
atatctacacggaaatgggccgacg

SEQ ID NO: 46594 - DNA, 25 bp, Homo sapien
cctgctgaatatctacacggaaatg

SEQ ID NO: 46595 - DNA, 25 bp, Homo sapien
ggaggtgccctgctgaatatctaca

SEQ ID NO: 46596 - DNA, 25 bp, Homo sapien
aaggcagccatggacgcatcggcca

SEQ ID NO: 46597 - DNA, 25 bp, Homo sapien
agcggaatcaatcgggtgcaaggcc

SEQ ID NO: 46598 - DNA, 25 bp, Homo sapien
aagcccttgccgaaggcggacaggt

SEQ ID NO: 46599 - DNA, 25 bp, Homo sapien
cgatcttgaactcgggcgctaggaa

SEQ ID NO: 46600 - DNA, 25 bp, Homo sapien
cccgaggcgctcgatcttgaactcg

SEQ ID NO: 46601 - DNA, 25 bp, Homo sapien
ccctgcggctggatggtgaactcct

SEQ ID NO: 46602 - DNA, 25 bp, Homo sapien
caaaccgcttggtcctactcgtggc

SEQ ID NO: 46603 - DNA, 25 bp, Homo sapien
gcgcctcagacacaaaccgcttggt

SEQ ID NO: 46604 - DNA, 25 bp, Homo sapien
cgtgacggagctcagacccagcact

SEQ ID NO: 46605 - DNA, 25 bp, Homo sapien
gcacttctcctgcagagccagccgc

SEQ ID NO: 46606 - DNA, 25 bp, Homo sapien
gccgtgacggagctcagacccagca

SEQ ID NO: 46607 - DNA, 25 bp, Homo sapien
ccagcacttctcctgcagagccagc

SEQ ID NO: 46608 - DNA, 25 bp, Homo sapien
acggagctcagacccagcacttctc

SEQ ID NO: 46609 - DNA, 25 bp, Homo sapien
gacggagctcagacccagcacttct

SEQ ID NO: 46610 - DNA, 25 bp, Homo sapien
tgacggagctcagacccagcacttc

SEQ ID NO: 46611 - DNA, 25 bp, Homo sapien
gtgacggagctcagacccagcactt

SEQ ID NO: 46612 - DNA, 25 bp, Homo sapien
aggacgggcttttccatcactctcg

SEQ ID NO: 46613 - DNA, 25 bp, Homo sapien
aatagttgatgttgaggttgacggc

SEQ ID NO: 46614 - DNA, 25 bp, Homo sapien
aagctgcgggaatagttgatgttga

SEQ ID NO: 46615 - DNA, 25 bp, Homo sapien
tccatgggcgcttggcgggacggaa

SEQ ID NO: 46616 - DNA, 25 bp, Homo sapien
atcactctcggtgggggcacctgct

SEQ ID NO: 46617 - DNA, 25 bp, Homo sapien
ggcttttccatcactctcggtgggg

SEQ ID NO: 46618 - DNA, 25 bp, Homo sapien
acgggcttttccatcactctcggtg

SEQ ID NO: 46619 - DNA, 25 bp, Homo sapien
ggcgaggacgggcttttccatcact

SEQ ID NO: 46620 - DNA, 25 bp, Homo sapien
gcaccgtcgttgcagcaaacgccga

SEQ ID NO: 46621 - DNA, 25 bp, Homo sapien
ggcgtccagatctgctcggcacctt

SEQ ID NO: 46622 - DNA, 25 bp, Homo sapien
tggggtggatctgcccacgacctca

SEQ ID NO: 46623 - DNA, 25 bp, Homo sapien
cacgacctcaggtccggggactggc

SEQ ID NO: 46624 - DNA, 25 bp, Homo sapien
gcggaggtttattgtccgtgctgca

SEQ ID NO: 46625 - DNA, 25 bp, Homo sapien
gctcggcaccttggtttcttggatg

SEQ ID NO: 46626 - DNA, 25 bp, Homo sapien
gatgacctctcggtgacagccctca

SEQ ID NO: 46627 - DNA, 25 bp, Homo sapien
acgcagctctctgccgggaggacgt

SEQ ID NO: 46628 - DNA, 25 bp, Homo sapien
cacgctcacgcaacgatctcacgtg

SEQ ID NO: 46629 - DNA, 25 bp, Homo sapien
cgcaacgatctcacgtgaccacgcg

SEQ ID NO: 46630 - DNA, 25 bp, Homo sapien
aacgatctcacgtgaccacgcgctt

SEQ ID NO: 46631 - DNA, 25 bp, Homo sapien
acgcaacgatctcacgtgaccacgc

SEQ ID NO: 46632 - DNA, 25 bp, Homo sapien
atctcacgtgaccacgcgcttccca

SEQ ID NO: 46633 - DNA, 25 bp, Homo sapien
aagatctcacgtgaccacgcgcttc

SEQ ID NO: 46634 - DNA, 25 bp, Homo sapien
gcaaagatctcacgtgaccacgcgc

SEQ ID NO: 46635 - DNA, 25 bp, Homo sapien
acgctcacgcaacgatctcacgtga

SEQ ID NO: 46636 - DNA, 25 bp, Homo sapien
cacggtgcattaccacctgggcagc

SEQ ID NO: 46637 - DNA, 25 bp, Homo sapien
ttcggcaacgcttcgggcaacgcgt

SEQ ID NO: 46638 - DNA, 25 bp, Homo sapien
tggacgtgaacaccgacatctactc

SEQ ID NO: 46639 - DNA, 25 bp, Homo sapien
tctactccaaggtgctggtgaccgc

SEQ ID NO: 46640 - DNA, 25 bp, Homo sapien
agagcctgcagagcacggtgcatta

SEQ ID NO: 46641 - DNA, 25 bp, Homo sapien
ccatgcccgtggagctgtacaactt

SEQ ID NO: 46642 - DNA, 25 bp, Homo sapien
tgtacaacttcatctgggtgcacca

SEQ ID NO: 46643 - DNA, 25 bp, Homo sapien
gcaacacggtgacggcgttcacgct

SEQ ID NO: 46644 - DNA, 25 bp, Homo sapien
agcccatggtgtgcgccgtcagcat

SEQ ID NO: 46645 - DNA, 25 bp, Homo sapien
accaccaggcagagcgccaagggga

SEQ ID NO: 46646 - DNA, 25 bp, Homo sapien
gcgccgtcagcatgggctctgcagc

SEQ ID NO: 46647 - DNA, 25 bp, Homo sapien
acagcaggccgagcccatggtgtgc

SEQ ID NO: 46648 - DNA, 25 bp, Homo sapien
acactttctagggacagcaggccga

SEQ ID NO: 46649 - DNA, 25 bp, Homo sapien
acacaggtgcatccgttctttctgc

SEQ ID NO: 46650 - DNA, 25 bp, Homo sapien
ttccagcaaggagcacacaggtgca

SEQ ID NO: 46651 - DNA, 25 bp, Homo sapien
tccggagatccagcatgggaagagc

SEQ ID NO: 46652 - DNA, 25 bp, Homo sapien
tgcttcctagggagacggttccatc

SEQ ID NO: 46653 - DNA, 25 bp, Homo sapien
agcacgaccgcacgagggtcccgag

SEQ ID NO: 46654 - DNA, 25 bp, Homo sapien
cgcgctcgctgcttttaggctgaac

SEQ ID NO: 46655 - DNA, 25 bp, Homo sapien
tgaaggaacggccagactgtctttc

SEQ ID NO: 46656 - DNA, 25 bp, Homo sapien
acctgtgtcttgttccactgccgcg

SEQ ID NO: 46657 - DNA, 25 bp, Homo sapien
ggtcccagcctgaacctgtgtcttg

SEQ ID NO: 46658 - DNA, 25 bp, Homo sapien
cgggctgattctagtttcgcgtgac

SEQ ID NO: 46659 - DNA, 25 bp, Homo sapien
tgtctttcgcagcagcggcccatct

SEQ ID NO: 46660 - DNA, 25 bp, Homo sapien
tttttgtttgggtgcagtgtatttc

SEQ ID NO: 46661 - DNA, 25 bp, Homo sapien
ttcacttttctgatggtttcctttg

SEQ ID NO: 46662 - DNA, 25 bp, Homo sapien
ttccacgccatgctgggccacaagc

SEQ ID NO: 46663 - DNA, 25 bp, Homo sapien
ttcctttgaagcacagacttttttg

SEQ ID NO: 46664 - DNA, 25 bp, Homo sapien
ttgggtgcagtgtatttcttactgt

SEQ ID NO: 46665 - DNA, 25 bp, Homo sapien
cttactgtgctttaaagaggaacac

SEQ ID NO: 46666 - DNA, 25 bp, Homo sapien
ctgtgctttaaagaggaacacgttt

SEQ ID NO: 46667 - DNA, 25 bp, Homo sapien
tgatggtttcctttgaagcacagac

SEQ ID NO: 46668 - DNA, 25 bp, Homo sapien
acttttgttgccgcgctgggaacgc

SEQ ID NO: 46669 - DNA, 25 bp, Homo sapien
ctgggattgatctgggagcggcctt

SEQ ID NO: 46670 - DNA, 25 bp, Homo sapien
ctgggaacgccacactgtcgcagtc

SEQ ID NO: 46671 - DNA, 25 bp, Homo sapien
tcatcgccggggttacttttgttgc

SEQ ID NO: 46672 - DNA, 25 bp, Homo sapien
ccatcccgggcggagacacctggag

SEQ ID NO: 46673 - DNA, 25 bp, Homo sapien
gcccagctcgttccaggtgcggccc

SEQ ID NO: 46674 - DNA, 25 bp, Homo sapien
ggcgcctgtcatcgccggggttact

SEQ ID NO: 46675 - DNA, 25 bp, Homo sapien
ggaacgccacactgtcgcagtccgg

SEQ ID NO: 46676 - DNA, 25 bp, Homo sapien
cagaactaccagaagcgcttccaga

SEQ ID NO: 46677 - DNA, 25 bp, Homo sapien
gcttgtccgggcctacgagctcatg

SEQ ID NO: 46678 - DNA, 25 bp, Homo sapien
acgagctcatgctgggcttctacgg

SEQ ID NO: 46679 - DNA, 25 bp, Homo sapien
gtgggccgagcacagaactaccaga

SEQ ID NO: 46680 - DNA, 25 bp, Homo sapien
ttccagaacctgaactggtgaggcc

SEQ ID NO: 46681 - DNA, 25 bp, Homo sapien
cagaacagggccacgtcaggtttcg

SEQ ID NO: 46682 - DNA, 25 bp, Homo sapien
cacgtcaggtttcgggcaggtcaca

SEQ ID NO: 46683 - DNA, 25 bp, Homo sapien
cttctacgggatccggctggaggac

SEQ ID NO: 46684 - DNA, 25 bp, Homo sapien
tcatgttcgccgtgcgctgccgaca

SEQ ID NO: 46685 - DNA, 25 bp, Homo sapien
tcacacgcatcctcaagtcgctggg

SEQ ID NO: 46686 - DNA, 25 bp, Homo sapien
atcctcaagtcgctgggtgagctgg

SEQ ID NO: 46687 - DNA, 25 bp, Homo sapien
gccgctggtccgcttcttcctggag

SEQ ID NO: 46688 - DNA, 25 bp, Homo sapien
tccgcttcttcctggaggagacgct

SEQ ID NO: 46689 - DNA, 25 bp, Homo sapien
tggactacttcatgttcgccgtgcg

SEQ ID NO: 46690 - DNA, 25 bp, Homo sapien
ccagctggtgcacttcgcctgggag

SEQ ID NO: 46691 - DNA, 25 bp, Homo sapien
gcagagtgccctggactacttcatg

SEQ ID NO: 46692 - DNA, 25 bp, Homo sapien
ggcgcggacctggaacattatctgc

SEQ ID NO: 46693 - DNA, 25 bp, Homo sapien
cgcgccaagcgtttcgtgtctatcc

SEQ ID NO: 46694 - DNA, 25 bp, Homo sapien
cgagtatgtcattagcccgctgccc

SEQ ID NO: 46695 - DNA, 25 bp, Homo sapien
cgctgcttctattctggggacgtga

SEQ ID NO: 46696 - DNA, 25 bp, Homo sapien
ttttacctacacctgacgccggatg

SEQ ID NO: 46697 - DNA, 25 bp, Homo sapien
tcacagcatttcaggaggactttta

SEQ ID NO: 46698 - DNA, 25 bp, Homo sapien
gctgggcatcctaaccctggctttc

SEQ ID NO: 46699 - DNA, 25 bp, Homo sapien
ggggatcagggactcatttttcaga

SEQ ID NO: 46700 - DNA, 25 bp, Homo sapien
tctctcttgctcaaagctgcgtgtg

SEQ ID NO: 46701 - DNA, 25 bp, Homo sapien
tgcggcttcggaaactcgcgggtct

SEQ ID NO: 46702 - DNA, 25 bp, Homo sapien
ccacactcgggttgaggagcaagga

SEQ ID NO: 46703 - DNA, 25 bp, Homo sapien
agaaaagagcgtctttctctcttgc

SEQ ID NO: 46704 - DNA, 25 bp, Homo sapien
ctgcgtgtgtgcaacgcgccagtcc

SEQ ID NO: 46705 - DNA, 25 bp, Homo sapien
gcgccagtcccaggataattttaac

SEQ ID NO: 46706 - DNA, 25 bp, Homo sapien
tagcaactgacgtggcctgaccacc

SEQ ID NO: 46707 - DNA, 25 bp, Homo sapien
gataattttaactcgcggccggaga

SEQ ID NO: 46708 - DNA, 25 bp, Homo sapien
ggtcccatcatctgtgcggagtggc

SEQ ID NO: 46709 - DNA, 25 bp, Homo sapien
cccatcatctgtgcggagtggcctc

SEQ ID NO: 46710 - DNA, 25 bp, Homo sapien
cccacgtggagtggcctcctggggt

SEQ ID NO: 46711 - DNA, 25 bp, Homo sapien
gtcccgtcaccgtgcagagtggcct

SEQ ID NO: 46712 - DNA, 25 bp, Homo sapien
ccggggtcccgtcaccgtgcagagt

SEQ ID NO: 46713 - DNA, 25 bp, Homo sapien
tcctgtcaccatgaggagtggcctc

SEQ ID NO: 46714 - DNA, 25 bp, Homo sapien
tggggtcccatcatctgtgcggagt

SEQ ID NO: 46715 - DNA, 25 bp, Homo sapien
gtctctgtgtggagtggcctcctgg

SEQ ID NO: 46716 - DNA, 25 bp, Homo sapien
ttccaagtgacgtggcctgtcgcac

SEQ ID NO: 46717 - DNA, 25 bp, Homo sapien
aaccctagctccgtgttccaagtga

SEQ ID NO: 46718 - DNA, 25 bp, Homo sapien
ggtcccacagacgttccctttgcta

SEQ ID NO: 46719 - DNA, 25 bp, Homo sapien
tgcccggaatcacttagcgccatca

SEQ ID NO: 46720 - DNA, 25 bp, Homo sapien
cctcgccctaggctgccaattgaga

SEQ ID NO: 46721 - DNA, 25 bp, Homo sapien
attgagagttccacctccgcccaga

SEQ ID NO: 46722 - DNA, 25 bp, Homo sapien
cctggagggataaacagcttgtgca

SEQ ID NO: 46723 - DNA, 25 bp, Homo sapien
gacgtcatacaggacgcgtggccta

SEQ ID NO: 46724 - DNA, 25 bp, Homo sapien
tgtggaagctccctggtttgtgtct

SEQ ID NO: 46725 - DNA, 25 bp, Homo sapien
agaaggtgaagctgccgcacagcag

SEQ ID NO: 46726 - DNA, 25 bp, Homo sapien
cttgcagggacccactggctacaaa

SEQ ID NO: 46727 - DNA, 25 bp, Homo sapien
tttaggcagggtccctggacagacc

SEQ ID NO: 46728 - DNA, 25 bp, Homo sapien
ccacatttgcttgcagggacccact

SEQ ID NO: 46729 - DNA, 25 bp, Homo sapien
tctgtgcctgtcttccagacagggc

SEQ ID NO: 46730 - DNA, 25 bp, Homo sapien
ggcctcacttcagtgttgccaggga

SEQ ID NO: 46731 - DNA, 25 bp, Homo sapien
ggaccgtttcatgggtgcacctgca

SEQ ID NO: 46732 - DNA, 25 bp, Homo sapien
tccagctttcacagggttgagatcg

SEQ ID NO: 46733 - DNA, 25 bp, Homo sapien
cctctgcgctagaggatggcccacg

SEQ ID NO: 46734 - DNA, 25 bp, Homo sapien
tggggctacacagaaagccttcgtg

SEQ ID NO: 46735 - DNA, 25 bp, Homo sapien
tgagatcgtgttttttccggaagga

SEQ ID NO: 46736 - DNA, 25 bp, Homo sapien
gcttttccggcttttccagctttca

SEQ ID NO: 46737 - DNA, 25 bp, Homo sapien
tgttcctggcatcacggggaagccg

SEQ ID NO: 46738 - DNA, 25 bp, Homo sapien
gattcaaccagattcccagcacgca

SEQ ID NO: 46739 - DNA, 25 bp, Homo sapien
atcagcggtaagtcagccacgtgca

SEQ ID NO: 46740 - DNA, 25 bp, Homo sapien
gtcggggagaaatcaggctctcgaa

SEQ ID NO: 46741 - DNA, 25 bp, Homo sapien
cccgaagcacagtggacggtcatga

SEQ ID NO: 46742 - DNA, 25 bp, Homo sapien
tgggcctcccggagatcctgggctt

SEQ ID NO: 46743 - DNA, 25 bp, Homo sapien
aggctctcgaagctcataaaattca

SEQ ID NO: 46744 - DNA, 25 bp, Homo sapien
tcagcctgccaaggagccgtgttag

SEQ ID NO: 46745 - DNA, 25 bp, Homo sapien
agcgagcaccctcatcgggctgtcg

SEQ ID NO: 46746 - DNA, 25 bp, Homo sapien
acaccggggatctgcgacacctcag

SEQ ID NO: 46747 - DNA, 25 bp, Homo sapien
gaagcaagtgacaaggacgcccgaa

SEQ ID NO: 46748 - DNA, 25 bp, Homo sapien
ctcaggtcggtggtcgtgaagctca

SEQ ID NO: 46749 - DNA, 25 bp, Homo sapien
gctgcgtgtactccacctccgtcat

SEQ ID NO: 46750 - DNA, 25 bp, Homo sapien
gcctcgcttagcagcatcatgcgca

SEQ ID NO: 46751 - DNA, 25 bp, Homo sapien
ggaaaaccgctgagtgccgcgcaca

SEQ ID NO: 46752 - DNA, 25 bp, Homo sapien
gagcactactctgcgccggccacag

SEQ ID NO: 46753 - DNA, 25 bp, Homo sapien
tagcagcatcatgcgcagctcctgg

SEQ ID NO: 46754 - DNA, 25 bp, Homo sapien
aggcgcgtctcgagctcgccgtcag

SEQ ID NO: 46755 - DNA, 25 bp, Homo sapien
cagctcctggaagtcgatgtggccc

SEQ ID NO: 46756 - DNA, 25 bp, Homo sapien
cctccactggcactgctgggtctgg

SEQ ID NO: 46757 - DNA, 25 bp, Homo sapien
cccatacgcttgttcggaagccaag

SEQ ID NO: 46758 - DNA, 25 bp, Homo sapien
tccctgcagccgcgctgtgtgcagg

SEQ ID NO: 46759 - DNA, 25 bp, Homo sapien
acaggcgaccagaggaagctcgcag

SEQ ID NO: 46760 - DNA, 25 bp, Homo sapien
ctgtggacccatacgcttgttcgga

SEQ ID NO: 46761 - DNA, 25 bp, Homo sapien
accggcgtctgctcatggctgggct

SEQ ID NO: 46762 - DNA, 25 bp, Homo sapien
ggtctgggccgccaagcccacctgc

SEQ ID NO: 46763 - DNA, 25 bp, Homo sapien
ctgggctgtggacccatacgcttgt

SEQ ID NO: 46764 - DNA, 25 bp, Homo sapien
tctgctgcctgagagcttcttcttg

SEQ ID NO: 46765 - DNA, 25 bp, Homo sapien
cggagttccttctcacgtcggcaca

SEQ ID NO: 46766 - DNA, 25 bp, Homo sapien
tgggcaggtcatcaacagtcacttt

SEQ ID NO: 46767 - DNA, 25 bp, Homo sapien
agatggtctcatcctcggggtcata

SEQ ID NO: 46768 - DNA, 25 bp, Homo sapien
cacaagctgagtgtcgaaggccctc

SEQ ID NO: 46769 - DNA, 25 bp, Homo sapien
ggtcgtactcctcctcagggtcgta

SEQ ID NO: 46770 - DNA, 25 bp, Homo sapien
cttttgagaactgaccgaactgctg

SEQ ID NO: 46771 - DNA, 25 bp, Homo sapien
cgaactgctggacgatcggatctaa

SEQ ID NO: 46772 - DNA, 25 bp, Homo sapien
cgcaggcgactctggatccctttca

SEQ ID NO: 46773 - DNA, 25 bp, Homo sapien
tcctgcgaaggcgattctgaagctc

SEQ ID NO: 46774 - DNA, 25 bp, Homo sapien
agctctttcaaggtcaggccatcgc

SEQ ID NO: 46775 - DNA, 25 bp, Homo sapien
atcgctgtcactatcggaggtgtca

SEQ ID NO: 46776 - DNA, 25 bp, Homo sapien
aagaggctggtcgttccttcacagc

SEQ ID NO: 46777 - DNA, 25 bp, Homo sapien
cgtgggctcaccagaatcctccagg

SEQ ID NO: 46778 - DNA, 25 bp, Homo sapien
atcctccagggagacaggcatgctc

SEQ ID NO: 46779 - DNA, 25 bp, Homo sapien
tgcgccctctcgcttggcgatagtg

SEQ ID NO: 46780 - DNA, 25 bp, Homo sapien
aagcatcgacatccgccagcgcggt

SEQ ID NO: 46781 - DNA, 25 bp, Homo sapien
ggaccctctgtcttgcacaacagcg

SEQ ID NO: 46782 - DNA, 25 bp, Homo sapien
ttctatctgcccaaagagcctcggg

SEQ ID NO: 46783 - DNA, 25 bp, Homo sapien
cctctccgtggggaagatgacaccg

SEQ ID NO: 46784 - DNA, 25 bp, Homo sapien
gtacctgctcaacgggcatttcgtg

SEQ ID NO: 46785 - DNA, 25 bp, Homo sapien
caactacctggctctgaagaacagc

SEQ ID NO: 46786 - DNA, 25 bp, Homo sapien
gctgatcggggatgacaactacctg

SEQ ID NO: 46787 - DNA, 25 bp, Homo sapien
ccagcgcggttacaaagggctgatc

SEQ ID NO: 46788 - DNA, 25 bp, Homo sapien
gtctttcatacctgcactccggacg

SEQ ID NO: 46789 - DNA, 25 bp, Homo sapien
atgtgtcacaaatacggccagtaca

SEQ ID NO: 46790 - DNA, 25 bp, Homo sapien
ttcgggtctgcactgacaatgactt

SEQ ID NO: 46791 - DNA, 25 bp, Homo sapien
caggcctctagggtctcgcagccat

SEQ ID NO: 46792 - DNA, 25 bp, Homo sapien
agggaaaccagctgcgcttacaagc

SEQ ID NO: 46793 - DNA, 25 bp, Homo sapien
cccgagaatgcctagggaaaccagc

SEQ ID NO: 46794 - DNA, 25 bp, Homo sapien
tcagaaaagcgaatccgggctcttc

SEQ ID NO: 46795 - DNA, 25 bp, Homo sapien
gcttgcatcctttgtggacacctta

SEQ ID NO: 46796 - DNA, 25 bp, Homo sapien
agccggatttcgcttagtcccgtga

SEQ ID NO: 46797 - DNA, 25 bp, Homo sapien
cccgtgaaagcgaaggagcaccagc

SEQ ID NO: 46798 - DNA, 25 bp, Homo sapien
ggagcaccagcgcttcctgattccg

SEQ ID NO: 46799 - DNA, 25 bp, Homo sapien
ttccgcacagttctctcggcagaga

SEQ ID NO: 46800 - DNA, 25 bp, Homo sapien
gggacacccacaggattcttgcaga

SEQ ID NO: 46801 - DNA, 25 bp, Homo sapien
acatagttctttctggccggagatc

SEQ ID NO: 46802 - DNA, 25 bp, Homo sapien
gacgttttattcttctcacctggga

SEQ ID NO: 46803 - DNA, 25 bp, Homo sapien
tcacctgggattcagagaggcagcg

SEQ ID NO: 46804 - DNA, 25 bp, Homo sapien
agacgtcgccatcccggttccagat

SEQ ID NO: 46805 - DNA, 25 bp, Homo sapien
agggccgacgccttttgactctggc

SEQ ID NO: 46806 - DNA, 25 bp, Homo sapien
gcggcctcacgcaaacgacaggaaa

SEQ ID NO: 46807 - DNA, 25 bp, Homo sapien
ggttccagatttccgcgctccaacg

SEQ ID NO: 46808 - DNA, 25 bp, Homo sapien
gcttcattggtcatcggctcgcgct

SEQ ID NO: 46809 - DNA, 25 bp, Homo sapien
tgcgcaagtacggaagctgaggttc

SEQ ID NO: 46810 - DNA, 25 bp, Homo sapien
tcgcctccgactcagtgtagacgtc

SEQ ID NO: 46811 - DNA, 25 bp, Homo sapien
gacgcgctcaacaacatctcgagta

SEQ ID NO: 46812 - DNA, 25 bp, Homo sapien
gccaaggcccaggacggtcgtgaac

SEQ ID NO: 46813 - DNA, 25 bp, Homo sapien
tacttccgcctgctgcgcgagtgac

SEQ ID NO: 46814 - DNA, 25 bp, Homo sapien
cttccggccaactgcccgctacttc

SEQ ID NO: 46815 - DNA, 25 bp, Homo sapien
acagatactggctcctccggcgact

SEQ ID NO: 46816 - DNA, 25 bp, Homo sapien
ggcggcgacacagatactggctcct

SEQ ID NO: 46817 - DNA, 25 bp, Homo sapien
aggtgggcgccgcaacaccaaaccg

SEQ ID NO: 46818 - DNA, 25 bp, Homo sapien
actcacctgatcctcccgaaggtgg

SEQ ID NO: 46819 - DNA, 25 bp, Homo sapien
atcctcccgaaggtgggcgccgcaa

SEQ ID NO: 46820 - DNA, 25 bp, Homo sapien
ccccgctcctatggggcagcaggga

SEQ ID NO: 46821 - DNA, 25 bp, Homo sapien
ggggcgacaagtcctgagagaacca

SEQ ID NO: 46822 - DNA, 25 bp, Homo sapien
tcctgagagaaccagacggaagcgc

SEQ ID NO: 46823 - DNA, 25 bp, Homo sapien
cgcgctgggactgacacgtggactt

SEQ ID NO: 46824 - DNA, 25 bp, Homo sapien
acacgtggacttgggcggtgctgcc

SEQ ID NO: 46825 - DNA, 25 bp, Homo sapien
ggacacagctgtgcccacgccgtct

SEQ ID NO: 46826 - DNA, 25 bp, Homo sapien
cagcagggaccgacgtcagcagggt

SEQ ID NO: 46827 - DNA, 25 bp, Homo sapien
gggcgggcacccgagtggtatgccc

SEQ ID NO: 46828 - DNA, 25 bp, Homo sapien
gtcccaagacctgtggctcttgctg

SEQ ID NO: 46829 - DNA, 25 bp, Homo sapien
agcatcagcgccctgtagacacggc

SEQ ID NO: 46830 - DNA, 25 bp, Homo sapien
agcagagacgccaggtgtcccaaga

SEQ ID NO: 46831 - DNA, 25 bp, Homo sapien
ctctgagccgtgagcctatgagtga

SEQ ID NO: 46832 - DNA, 25 bp, Homo sapien
atgagtgagcgctctgcggttaaaa

SEQ ID NO: 46833 - DNA, 25 bp, Homo sapien
tgtggccgtctgtttgacgatgccc

SEQ ID NO: 46834 - DNA, 25 bp, Homo sapien
caagctcctgttgtcaccgtggctc

SEQ ID NO: 46835 - DNA, 25 bp, Homo sapien
tgccgtgtttgtgcacgctgtcttc

SEQ ID NO: 46836 - DNA, 25 bp, Homo sapien
ggccacacgagagctcggctgcgtt

SEQ ID NO: 46837 - DNA, 25 bp, Homo sapien
gcctaggtccggcatcgctggtgga

SEQ ID NO: 46838 - DNA, 25 bp, Homo sapien
gggtgcagacggcaccacacagaga

SEQ ID NO: 46839 - DNA, 25 bp, Homo sapien
gcagacggcaccacacagagaggca

SEQ ID NO: 46840 - DNA, 25 bp, Homo sapien
gacggcaccacacagagaggcacgg

SEQ ID NO: 46841 - DNA, 25 bp, Homo sapien
aggcagcctcctgtcggctgaaacg

SEQ ID NO: 46842 - DNA, 25 bp, Homo sapien
gcagcctcctgtcggctgaaacgcg

SEQ ID NO: 46843 - DNA, 25 bp, Homo sapien
cacacgagagctcggctgcgttccg

SEQ ID NO: 46844 - DNA, 25 bp, Homo sapien
cccggctggcattgccttctcctaa

SEQ ID NO: 46845 - DNA, 25 bp, Homo sapien
ctggcattgccttctcctaacgttc

SEQ ID NO: 46846 - DNA, 25 bp, Homo sapien
gcccggctggcattgccttctccta

SEQ ID NO: 46847 - DNA, 25 bp, Homo sapien
tggcattgccttctcctaacgttcc

SEQ ID NO: 46848 - DNA, 25 bp, Homo sapien
cggctggcattgccttctcctaacg

SEQ ID NO: 46849 - DNA, 25 bp, Homo sapien
gctggcattgccttctcctaacgtt

SEQ ID NO: 46850 - DNA, 25 bp, Homo sapien
ggctggcattgccttctcctaacgt

SEQ ID NO: 46851 - DNA, 25 bp, Homo sapien
ccggctggcattgccttctcctaac

SEQ ID NO: 46852 - DNA, 25 bp, Homo sapien
ggtcccgacaatacccagtgggtgc

SEQ ID NO: 46853 - DNA, 25 bp, Homo sapien
cgcgttgatgctgagccgcagagac

SEQ ID NO: 46854 - DNA, 25 bp, Homo sapien
caggcctttcctgtccgggcagaga

SEQ ID NO: 46855 - DNA, 25 bp, Homo sapien
tcgtttaggtcgtgcatgcgccgcc

SEQ ID NO: 46856 - DNA, 25 bp, Homo sapien
agccgtggcttagtgccaggtacgc

SEQ ID NO: 46857 - DNA, 25 bp, Homo sapien
cagagagacagtcacaggggcgatc

SEQ ID NO: 46858 - DNA, 25 bp, Homo sapien
acggcttctcgtgacagtgtttgca

SEQ ID NO: 46859 - DNA, 25 bp, Homo sapien
ttcctagacttgctgggtcccgaca

SEQ ID NO: 46860 - DNA, 25 bp, Homo sapien
tgggtctgtaactgcggactcactt

SEQ ID NO: 46861 - DNA, 25 bp, Homo sapien
caacacgtgtggtctagcgacggcc

SEQ ID NO: 46862 - DNA, 25 bp, Homo sapien
cagaacccgtgtttctcagagggcc

SEQ ID NO: 46863 - DNA, 25 bp, Homo sapien
acttgtcccgggctgttctgaaccg

SEQ ID NO: 46864 - DNA, 25 bp, Homo sapien
ccacagctgtaaagtggggtctgtc

SEQ ID NO: 46865 - DNA, 25 bp, Homo sapien
agcttctcgaacctcctctgggcag

SEQ ID NO: 46866 - DNA, 25 bp, Homo sapien
ctgccagtttgcacagcagcaggtg

SEQ ID NO: 46867 - DNA, 25 bp, Homo sapien
gggctgtttcacaggcgcccacatg

SEQ ID NO: 46868 - DNA, 25 bp, Homo sapien
ccgtgctggtagacatgtaggacca

SEQ ID NO: 46869 - DNA, 25 bp, Homo sapien
tctcaaacaggctggaggcgatctt

SEQ ID NO: 46870 - DNA, 25 bp, Homo sapien
tgaagtactcgtaggcgttctctgc

SEQ ID NO: 46871 - DNA, 25 bp, Homo sapien
gtgctgcagcatggtctggaactcc

SEQ ID NO: 46872 - DNA, 25 bp, Homo sapien
tctggaactccgaagtcatagtgcc

SEQ ID NO: 46873 - DNA, 25 bp, Homo sapien
tcatagtgccggttgatgtcgtcct

SEQ ID NO: 46874 - DNA, 25 bp, Homo sapien
gccttgttgcagcatgaagaccacg

SEQ ID NO: 46875 - DNA, 25 bp, Homo sapien
ccaggaagccagtcaagccgtgctg

SEQ ID NO: 46876 - DNA, 25 bp, Homo sapien
cctctcagcctggactggacaactg

SEQ ID NO: 46877 - DNA, 25 bp, Homo sapien
tgcaggctcaagtttgccaacgtcc

SEQ ID NO: 46878 - DNA, 25 bp, Homo sapien
gtttgccaacgtccatgcacgtctc

SEQ ID NO: 46879 - DNA, 25 bp, Homo sapien
ggcggcgtccagtgcattcatcacg

SEQ ID NO: 46880 - DNA, 25 bp, Homo sapien
attcatcacgcgtgtgctgccgtga

SEQ ID NO: 46881 - DNA, 25 bp, Homo sapien
catttaaattctacccgctacacgc

SEQ ID NO: 46882 - DNA, 25 bp, Homo sapien
gcgtctctgtgtgcaggctcaagtt

SEQ ID NO: 46883 - DNA, 25 bp, Homo sapien
tggacaactgggcttcgggaattca

SEQ ID NO: 46884 - DNA, 25 bp, Homo sapien
cgcaggacacgcatgcagggtcacg

SEQ ID NO: 46885 - DNA, 25 bp, Homo sapien
cagggtcacgggtcagccacccgca

SEQ ID NO: 46886 - DNA, 25 bp, Homo sapien
cagggtcacgggtcagccaccagca

SEQ ID NO: 46887 - DNA, 25 bp, Homo sapien
acgcatgcagggtcacgggtcagcc

SEQ ID NO: 46888 - DNA, 25 bp, Homo sapien
cacgcatgcagggtcacgggtcagc

SEQ ID NO: 46889 - DNA, 25 bp, Homo sapien
gacacgcatgcagggtcacgggtca

SEQ ID NO: 46890 - DNA, 25 bp, Homo sapien
gcatgcagggtcacgggtcagccac

SEQ ID NO: 46891 - DNA, 25 bp, Homo sapien
ggtcacgggtcagccaccagcagga

SEQ ID NO: 46892 - DNA, 25 bp, Homo sapien
tgcccgtgagcaggacatgcttgta

SEQ ID NO: 46893 - DNA, 25 bp, Homo sapien
cgctaaagcatccaggcaggactcc

SEQ ID NO: 46894 - DNA, 25 bp, Homo sapien
tggtctcctccagataaacgcgcgc

SEQ ID NO: 46895 - DNA, 25 bp, Homo sapien
cacgtctctgctgggctttggaatt

SEQ ID NO: 46896 - DNA, 25 bp, Homo sapien
gtgtgccctgccaggacagacgtca

SEQ ID NO: 46897 - DNA, 25 bp, Homo sapien
gtgcggtgcttgagtgccatcaata

SEQ ID NO: 46898 - DNA, 25 bp, Homo sapien
aatccggaaacaagggacgcgcagc

SEQ ID NO: 46899 - DNA, 25 bp, Homo sapien
tcaggagcggcatgtagcatctttt

SEQ ID NO: 46900 - DNA, 25 bp, Homo sapien
gcgtttcccacatgggcactgcgga

SEQ ID NO: 46901 - DNA, 25 bp, Homo sapien
tgcagcgtttcccacatgggcactg

SEQ ID NO: 46902 - DNA, 25 bp, Homo sapien
gtggtgcacacactcgatctctgca

SEQ ID NO: 46903 - DNA, 25 bp, Homo sapien
accaggccaggtcgtggtgcacaca

SEQ ID NO: 46904 - DNA, 25 bp, Homo sapien
aggcgcagtctctggaccaggccag

SEQ ID NO: 46905 - DNA, 25 bp, Homo sapien
caacgatgttaactcagggacaggc

SEQ ID NO: 46906 - DNA, 25 bp, Homo sapien
tcctggggacaacgatgttaactca

SEQ ID NO: 46907 - DNA, 25 bp, Homo sapien
gcgatcctggggacaacgatgttaa

SEQ ID NO: 46908 - DNA, 25 bp, Homo sapien
ccactgacctgcatgggccgaggtc

SEQ ID NO: 46909 - DNA, 25 bp, Homo sapien
tcctgcaagagaacgggctccattt

SEQ ID NO: 46910 - DNA, 25 bp, Homo sapien
tgtgcttcggatggagcctccaatc

SEQ ID NO: 46911 - DNA, 25 bp, Homo sapien
ctgcactggggatcacgctgtgctt

SEQ ID NO: 46912 - DNA, 25 bp, Homo sapien
attttaccctggaggccatcgggct

SEQ ID NO: 46913 - DNA, 25 bp, Homo sapien
cccacgggcattgtatcggcttccg

SEQ ID NO: 46914 - DNA, 25 bp, Homo sapien
ctccatttgcgtctgagggccagga

SEQ ID NO: 46915 - DNA, 25 bp, Homo sapien
ccaatctcggggatgccattttacc

SEQ ID NO: 46916 - DNA, 25 bp, Homo sapien
acgatctcactcaacttctgcgaca

SEQ ID NO: 46917 - DNA, 25 bp, Homo sapien
gcctgacggcgcatcttagcctcgt

SEQ ID NO: 46918 - DNA, 25 bp, Homo sapien
atcttagcctcgtcgctctcgcagg

SEQ ID NO: 46919 - DNA, 25 bp, Homo sapien
ccaggctggcctgcttgctgctgaa

SEQ ID NO: 46920 - DNA, 25 bp, Homo sapien
ctgctgaaggagtcccgcaggctga

SEQ ID NO: 46921 - DNA, 25 bp, Homo sapien
tctccacgtagctcagctgcagctg

SEQ ID NO: 46922 - DNA, 25 bp, Homo sapien
cagctgcttctggtactcgatcacc

SEQ ID NO: 46923 - DNA, 25 bp, Homo sapien
ggttgcgctggtacatctccacgta

SEQ ID NO: 46924 - DNA, 25 bp, Homo sapien
actggcttaccaggactccgactgg

SEQ ID NO: 46925 - DNA, 25 bp, Homo sapien
accaggactccgactgggcttgcca

SEQ ID NO: 46926 - DNA, 25 bp, Homo sapien
gaggacccggcctgaaccaagcact

SEQ ID NO: 46927 - DNA, 25 bp, Homo sapien
ccaagcactggccacggaggctcgt

SEQ ID NO: 46928 - DNA, 25 bp, Homo sapien
tcctgcctgtggctgccggggctca

SEQ ID NO: 46929 - DNA, 25 bp, Homo sapien
tctgagcgccactggcttaccagga

SEQ ID NO: 46930 - DNA, 25 bp, Homo sapien
atgcagacagaaagagaggacccgg

SEQ ID NO: 46931 - DNA, 25 bp, Homo sapien
tgccggggctcacatctgagcgcca

SEQ ID NO: 46932 - DNA, 25 bp, Homo sapien
gttctagctgcctgctcaggcttgg

SEQ ID NO: 46933 - DNA, 25 bp, Homo sapien
tcgggcttttggagccgcgcgccca

SEQ ID NO: 46934 - DNA, 25 bp, Homo sapien
acccacagccgtggaacgccgaggt

SEQ ID NO: 46935 - DNA, 25 bp, Homo sapien
gtggaacgccgaggtctcagctccc

SEQ ID NO: 46936 - DNA, 25 bp, Homo sapien
gccgagactcgaggacgcccgaggc

SEQ ID NO: 46937 - DNA, 25 bp, Homo sapien
ttaggtggatgagtgaaggggaaaa

SEQ ID NO: 46938 - DNA, 25 bp, Homo sapien
gaaaagcgcggttctagctgcctgc

SEQ ID NO: 46939 - DNA, 25 bp, Homo sapien
gcgatgtgaacgtcggggtttgccc

SEQ ID NO: 46940 - DNA, 25 bp, Homo sapien
ggagtttaagatgaatgaagcaccc

SEQ ID NO: 46941 - DNA, 25 bp, Homo sapien
tcagctgcgttcacgtctgcaggtc

SEQ ID NO: 46942 - DNA, 25 bp, Homo sapien
cacctggtcagctgcgttcacgtct

SEQ ID NO: 46943 - DNA, 25 bp, Homo sapien
ccctgtggcacctggtcagctgcgt

SEQ ID NO: 46944 - DNA, 25 bp, Homo sapien
ggaatgcgccgtgtttaaggctccc

SEQ ID NO: 46945 - DNA, 25 bp, Homo sapien
cccaaccttgcgctctgggaatgcg

SEQ ID NO: 46946 - DNA, 25 bp, Homo sapien
cgctaggagctctgggattgcctgt

SEQ ID NO: 46947 - DNA, 25 bp, Homo sapien
cgctctgggaatgcgccgtgtttaa

SEQ ID NO: 46948 - DNA, 25 bp, Homo sapien
gtggtgtggcgtgtctatcccgact

SEQ ID NO: 46949 - DNA, 25 bp, Homo sapien
agcccatagtttgctgctgctcctt

SEQ ID NO: 46950 - DNA, 25 bp, Homo sapien
tctatcccgactggcgaggccgcga

SEQ ID NO: 46951 - DNA, 25 bp, Homo sapien
acccttgccctctgtgtggtgtggc

SEQ ID NO: 46952 - DNA, 25 bp, Homo sapien
aatcagctgggttcccatgggaagg

SEQ ID NO: 46953 - DNA, 25 bp, Homo sapien
cggacacctcgccagaatcagctgg

SEQ ID NO: 46954 - DNA, 25 bp, Homo sapien
gcggcccttcttccttctgagttgt

SEQ ID NO: 46955 - DNA, 25 bp, Homo sapien
ggccgcgagcccatagtttgctgct

SEQ ID NO: 46956 - DNA, 25 bp, Homo sapien
cccgcagctgacagggttcgaaaga

SEQ ID NO: 46957 - DNA, 25 bp, Homo sapien
ggcagagtccgcgtttctaaccagc

SEQ ID NO: 46958 - DNA, 25 bp, Homo sapien
tcacggacgcctgaaccgaggtcac

SEQ ID NO: 46959 - DNA, 25 bp, Homo sapien
gaatcccgttttccgcgatgctgca

SEQ ID NO: 46960 - DNA, 25 bp, Homo sapien
tcaagtttcaaatgaggcgaatccc

SEQ ID NO: 46961 - DNA, 25 bp, Homo sapien
acgtcagcggcggaaatggtttcta

SEQ ID NO: 46962 - DNA, 25 bp, Homo sapien
cgcagtggacgctgccacttaattt

SEQ ID NO: 46963 - DNA, 25 bp, Homo sapien
cgtgtcagctgaaatgatgggcgta

SEQ ID NO: 46964 - DNA, 25 bp, Homo sapien
ctgaagtggactcatcgcggtcctc

SEQ ID NO: 46965 - DNA, 25 bp, Homo sapien
ctgccgccgtaaacctgggcgactg

SEQ ID NO: 46966 - DNA, 25 bp, Homo sapien
tagtctctgagcctgagcgtgagcc

SEQ ID NO: 46967 - DNA, 25 bp, Homo sapien
agctggcgcagatttccgaagtgcc

SEQ ID NO: 46968 - DNA, 25 bp, Homo sapien
ttccgaagtgccacgaaacagccgc

SEQ ID NO: 46969 - DNA, 25 bp, Homo sapien
gcaatcaccgctaagacccagactt

SEQ ID NO: 46970 - DNA, 25 bp, Homo sapien
gacccagacttccaggcgctttaaa

SEQ ID NO: 46971 - DNA, 25 bp, Homo sapien
cggacacttacacacgcagcgggca

SEQ ID NO: 46972 - DNA, 25 bp, Homo sapien
caagggctctcaaggtcctggtttc

SEQ ID NO: 46973 - DNA, 25 bp, Homo sapien
actgaagcgtggaccactgtggccc

SEQ ID NO: 46974 - DNA, 25 bp, Homo sapien
cgtggaccactgtggcccgaggcca

SEQ ID NO: 46975 - DNA, 25 bp, Homo sapien
cagagaaaactgaagcgtggaccac

SEQ ID NO: 46976 - DNA, 25 bp, Homo sapien
gtcctggtttcccaatggtcacacc

SEQ ID NO: 46977 - DNA, 25 bp, Homo sapien
acacgtgaactgacgctcagccgca

SEQ ID NO: 46978 - DNA, 25 bp, Homo sapien
ggcgacctggaccacacacgtgaac

SEQ ID NO: 46979 - DNA, 25 bp, Homo sapien
tttcccaatggtcacaccgaggcag

SEQ ID NO: 46980 - DNA, 25 bp, Homo sapien
cgttacagcagcgagggaaactgac

SEQ ID NO: 46981 - DNA, 25 bp, Homo sapien
cacgttacagcagcgagggaaactg

SEQ ID NO: 46982 - DNA, 25 bp, Homo sapien
ttacagcagcgagggaaactgacgg

SEQ ID NO: 46983 - DNA, 25 bp, Homo sapien
acggggtgagatgcacgttacagca

SEQ ID NO: 46984 - DNA, 25 bp, Homo sapien
tgcacgttacagcagcgagggaaac

SEQ ID NO: 46985 - DNA, 25 bp, Homo sapien
tgcacgttacagcagggagggaaac

SEQ ID NO: 46986 - DNA, 25 bp, Homo sapien
gcacgttacagcagcgagggaaact

SEQ ID NO: 46987 - DNA, 25 bp, Homo sapien
ggtgagatgcacgttacagcagcga

SEQ ID NO: 46988 - DNA, 25 bp, Homo sapien
cggtgaatgccaagagaggcgcctc

SEQ ID NO: 46989 - DNA, 25 bp, Homo sapien
gaccaggcacgtgagactccgcagc

SEQ ID NO: 46990 - DNA, 25 bp, Homo sapien
gccgcagtgacacccactcgggttt

SEQ ID NO: 46991 - DNA, 25 bp, Homo sapien
cgtccgcgtccagggtccaaacgag

SEQ ID NO: 46992 - DNA, 25 bp, Homo sapien
tgaggtcaccgctaagtctgccctt

SEQ ID NO: 46993 - DNA, 25 bp, Homo sapien
gcgccctggacagttgccacggcaa

SEQ ID NO: 46994 - DNA, 25 bp, Homo sapien
ccgcggacaaatccggcgaacaatg

SEQ ID NO: 46995 - DNA, 25 bp, Homo sapien
ttctcatggaaatggcccgcgagcc

SEQ ID NO: 46996 - DNA, 25 bp, Homo sapien
ttttatgaaacctacgaagctcgcg

SEQ ID NO: 46997 - DNA, 25 bp, Homo sapien
cacgctattcggaggctttcacgga

SEQ ID NO: 46998 - DNA, 25 bp, Homo sapien
gccacctgacccgtagcgaagttgc

SEQ ID NO: 46999 - DNA, 25 bp, Homo sapien
cccggcagcagtaagttgactttta

SEQ ID NO: 47000 - DNA, 25 bp, Homo sapien
tggagccggtcctgtacggaaaaga

SEQ ID NO: 47001 - DNA, 25 bp, Homo sapien
agagccctccgccaaaggtaaagtg

SEQ ID NO: 47002 - DNA, 25 bp, Homo sapien
gccgggttcttctagggatgtacaa

SEQ ID NO: 47003 - DNA, 25 bp, Homo sapien
ccgatcgctactcaggactccaaga

SEQ ID NO: 47004 - DNA, 25 bp, Homo sapien
aaggaccctatcgagctggcagtga

SEQ ID NO: 47005 - DNA, 25 bp, Homo sapien
ctgtgagaaccgcaagctccgatgg

SEQ ID NO: 47006 - DNA, 25 bp, Homo sapien
gggaagccactgatccctggcccta

SEQ ID NO: 47007 - DNA, 25 bp, Homo sapien
ttctcaaggacacctcggggaggca

SEQ ID NO: 47008 - DNA, 25 bp, Homo sapien
tgcagtctaaacaaaggccagcggg

SEQ ID NO: 47009 - DNA, 25 bp, Homo sapien
cggcctgcgctccttgcagtctaaa

SEQ ID NO: 47010 - DNA, 25 bp, Homo sapien
gctcccatcccggtctgaaactgtg

SEQ ID NO: 47011 - DNA, 25 bp, Homo sapien
tccgtggtccctacgggcaagagct

SEQ ID NO: 47012 - DNA, 25 bp, Homo sapien
atcacccacgggaagcagcactgca

SEQ ID NO: 47013 - DNA, 25 bp, Homo sapien
taggaccgacttcgggcggctcgcc

SEQ ID NO: 47014 - DNA, 25 bp, Homo sapien
ccatagcttaggaccgacttcgggc

SEQ ID NO: 47015 - DNA, 25 bp, Homo sapien
tatggcttcccatagcttaggaccg

SEQ ID NO: 47016 - DNA, 25 bp, Homo sapien
gcaagtgctgggctatggcttccca

SEQ ID NO: 47017 - DNA, 25 bp, Homo sapien
cgtcagcatgctgccatccacagag

SEQ ID NO: 47018 - DNA, 25 bp, Homo sapien
acaccaggagcgtcagcatgctgcc

SEQ ID NO: 47019 - DNA, 25 bp, Homo sapien
aagcagcactgcaatctccgagcct

SEQ ID NO: 47020 - DNA, 25 bp, Homo sapien
acgcactgaggaggcgtcgactcca

SEQ ID NO: 47021 - DNA, 25 bp, Homo sapien
ccagagaactggtctccaacgggcc

SEQ ID NO: 47022 - DNA, 25 bp, Homo sapien
ttcatgaacaactagacgcggggcc

SEQ ID NO: 47023 - DNA, 25 bp, Homo sapien
ccgtcttacgggatggatttcgctc

SEQ ID NO: 47024 - DNA, 25 bp, Homo sapien
gcactgaggcctctgtagttttccc

SEQ ID NO: 47025 - DNA, 25 bp, Homo sapien
cccaaggtccgaagactaaacgctg

SEQ ID NO: 47026 - DNA, 25 bp, Homo sapien
gactaaacgctgttctggtccgaca

SEQ ID NO: 47027 - DNA, 25 bp, Homo sapien
tggtggccgacatgcttcatgaaca

SEQ ID NO: 47028 - DNA, 25 bp, Homo sapien
cccaaggatcctgcgcctgccgaac

SEQ ID NO: 47029 - DNA, 25 bp, Homo sapien
ggtaggcgacgcacatctgggtcgc

SEQ ID NO: 47030 - DNA, 25 bp, Homo sapien
gccgccaagggcacagcctgtccct

SEQ ID NO: 47031 - DNA, 25 bp, Homo sapien
caaggtcttcccagctcggccgcac

SEQ ID NO: 47032 - DNA, 25 bp, Homo sapien
ttcccgggatcagtcctccgcagag

SEQ ID NO: 47033 - DNA, 25 bp, Homo sapien
gggatcagtcctccgcagaggtccc

SEQ ID NO: 47034 - DNA, 25 bp, Homo sapien
tgacggagcctctctcagggcctgc

SEQ ID NO: 47035 - DNA, 25 bp, Homo sapien
tgctggcactgacggagcctctctc

SEQ ID NO: 47036 - DNA, 25 bp, Homo sapien
catcgtctttgtgccgtgcggccac

SEQ ID NO: 47037 - DNA, 25 bp, Homo sapien
ctacctcccttgacgcttaggttgg

SEQ ID NO: 47038 - DNA, 25 bp, Homo sapien
ccacctggtctgtgctgagtgtgcc

SEQ ID NO: 47039 - DNA, 25 bp, Homo sapien
gtggcagcgtcagcttgtttttacc

SEQ ID NO: 47040 - DNA, 25 bp, Homo sapien
tggaccgcgccgtgtccatcgtctt

SEQ ID NO: 47041 - DNA, 25 bp, Homo sapien
cagcttgtttttacccggctcccag

SEQ ID NO: 47042 - DNA, 25 bp, Homo sapien
aggtcccgctgatagcgcccatcaa

SEQ ID NO: 47043 - DNA, 25 bp, Homo sapien
gatagcgcccatcaatcttactacc

SEQ ID NO: 47044 - DNA, 25 bp, Homo sapien
tccacctggtgtgttgcgtcgacac

SEQ ID NO: 47045 - DNA, 25 bp, Homo sapien
ccttagatttggaattcagctccca

SEQ ID NO: 47046 - DNA, 25 bp, Homo sapien
aaaagccagggagcctcgagatcgg

SEQ ID NO: 47047 - DNA, 25 bp, Homo sapien
agaagttcctccagcgacggcacca

SEQ ID NO: 47048 - DNA, 25 bp, Homo sapien
tgttgcgtcgacaccaccgtgcgca

SEQ ID NO: 47049 - DNA, 25 bp, Homo sapien
accgtgcgcaccaggaaaagccagg

SEQ ID NO: 47050 - DNA, 25 bp, Homo sapien
cctcgagatcggtcagaagttcctc

SEQ ID NO: 47051 - DNA, 25 bp, Homo sapien
gccacgggctccttagatttggaat

SEQ ID NO: 47052 - DNA, 25 bp, Homo sapien
tgcgggaaacgctcgcacagacaga

SEQ ID NO: 47053 - DNA, 25 bp, Homo sapien
tacactcgcaaactcgcaggcacag

SEQ ID NO: 47054 - DNA, 25 bp, Homo sapien
tctcagaatcggaacttggccgctc

SEQ ID NO: 47055 - DNA, 25 bp, Homo sapien
ctcaccagctgaaaagcgcagagga

SEQ ID NO: 47056 - DNA, 25 bp, Homo sapien
catggtgcccgcctatacaggaggc

SEQ ID NO: 47057 - DNA, 25 bp, Homo sapien
cgggtaacagctgcgctgcgtctcc

SEQ ID NO: 47058 - DNA, 25 bp, Homo sapien
ctccggggcagaatggaaacttggc

SEQ ID NO: 47059 - DNA, 25 bp, Homo sapien
cagacagagacaggcgcgcacccgg

SEQ ID NO: 47060 - DNA, 25 bp, Homo sapien
agttcttctggacgccacgcacagg

SEQ ID NO: 47061 - DNA, 25 bp, Homo sapien
aagccaggaccaaggcagcaccgtc

SEQ ID NO: 47062 - DNA, 25 bp, Homo sapien
aacctcacgtgcttctctccagata

SEQ ID NO: 47063 - DNA, 25 bp, Homo sapien
tccagatacaggacaaagctgtttc

SEQ ID NO: 47064 - DNA, 25 bp, Homo sapien
acctggtggtggaagatgatcaaca

SEQ ID NO: 47065 - DNA, 25 bp, Homo sapien
tgtttgcttggcctcaccaccatta

SEQ ID NO: 47066 - DNA, 25 bp, Homo sapien
tggaaccagccaggtggagtcccac

SEQ ID NO: 47067 - DNA, 25 bp, Homo sapien
gtggagtcccaccatgcagcaggcc

SEQ ID NO: 47068 - DNA, 25 bp, Homo sapien
acgggctcagcatgggctcacggca

SEQ ID NO: 47069 - DNA, 25 bp, Homo sapien
gctcagcatgggctcacggcagaac

SEQ ID NO: 47070 - DNA, 25 bp, Homo sapien
aaccttgctgcacgggctcagcatg

SEQ ID NO: 47071 - DNA, 25 bp, Homo sapien
cagcatgggctcacggcagaaccca

SEQ ID NO: 47072 - DNA, 25 bp, Homo sapien
cgcgaaccttgctgcacgggctcag

SEQ ID NO: 47073 - DNA, 25 bp, Homo sapien
tcagcgcgaaccttgctgcacgggc

SEQ ID NO: 47074 - DNA, 25 bp, Homo sapien
ggctcagcgcgaaccttgctgcacg

SEQ ID NO: 47075 - DNA, 25 bp, Homo sapien
cgggctcagcgcgaaccttgctgca

SEQ ID NO: 47076 - DNA, 25 bp, Homo sapien
gggaaagcgttctctgccctcagaa

SEQ ID NO: 47077 - DNA, 25 bp, Homo sapien
catacaccgtggacgctgccttgta

SEQ ID NO: 47078 - DNA, 25 bp, Homo sapien
gtggacgctgccttgtacggaaata

SEQ ID NO: 47079 - DNA, 25 bp, Homo sapien
cgctgccttgtacggaaatacagaa

SEQ ID NO: 47080 - DNA, 25 bp, Homo sapien
ctgccctcagaaacatacaccgtgg

SEQ ID NO: 47081 - DNA, 25 bp, Homo sapien
tcccatctgcaaggtgtcagagcgc

SEQ ID NO: 47082 - DNA, 25 bp, Homo sapien
gaacacacttcccatctgcaaggtg

SEQ ID NO: 47083 - DNA, 25 bp, Homo sapien
tgtacggaaatacagaacacacttc

SEQ ID NO: 47084 - DNA, 25 bp, Homo sapien
ggtgaacgcgccgtcccagaagcac

SEQ ID NO: 47085 - DNA, 25 bp, Homo sapien
aagcacctcagcttggttccgcgga

SEQ ID NO: 47086 - DNA, 25 bp, Homo sapien
ttccgcggatgaacggacgcttctc

SEQ ID NO: 47087 - DNA, 25 bp, Homo sapien
cggctcccgtgagaccttgcaaagc

SEQ ID NO: 47088 - DNA, 25 bp, Homo sapien
tgcaaagcgcaacgtagccggaagc

SEQ ID NO: 47089 - DNA, 25 bp, Homo sapien
cgaccgggcgcatcctcattgcagt

SEQ ID NO: 47090 - DNA, 25 bp, Homo sapien
atcctcattgcagtgcggcggccct

SEQ ID NO: 47091 - DNA, 25 bp, Homo sapien
cggatctggaatctcccaccggtta

SEQ ID NO: 47092 - DNA, 25 bp, Homo sapien
tcctacaggcgtccgagctgggcca

SEQ ID NO: 47093 - DNA, 25 bp, Homo sapien
acgtgacttcccttcctacaggcgt

SEQ ID NO: 47094 - DNA, 25 bp, Homo sapien
ttccctcctgctggtgaagctcgtg

SEQ ID NO: 47095 - DNA, 25 bp, Homo sapien
gtttcctgctccctgcgcttgtatc

SEQ ID NO: 47096 - DNA, 25 bp, Homo sapien
gagaacgtcctcaagcctgcgcagg

SEQ ID NO: 47097 - DNA, 25 bp, Homo sapien
ctgcccttcgggtgttgtgtgcaaa

SEQ ID NO: 47098 - DNA, 25 bp, Homo sapien
ggggaccttcctgcaagaattggtg

SEQ ID NO: 47099 - DNA, 25 bp, Homo sapien
cgccttctagaggtggcggcctact

SEQ ID NO: 47100 - DNA, 25 bp, Homo sapien
tttgcctgggtcttctcagcgggac

SEQ ID NO: 47101 - DNA, 25 bp, Homo sapien
tctggattttgcctgggtcttctca

SEQ ID NO: 47102 - DNA, 25 bp, Homo sapien
cccttgtttctggattttgcctggg

SEQ ID NO: 47103 - DNA, 25 bp, Homo sapien
tgtctgtacgtgtgtgcgaggcacc

SEQ ID NO: 47104 - DNA, 25 bp, Homo sapien
acacacctggcaccgctgcagagtg

SEQ ID NO: 47105 - DNA, 25 bp, Homo sapien
tcctcgctgccatgtcccgcacaca

SEQ ID NO: 47106 - DNA, 25 bp, Homo sapien
gacagggcctgcctaacctctcttc

SEQ ID NO: 47107 - DNA, 25 bp, Homo sapien
ggggcctcctgaagctgcctgtgcc

SEQ ID NO: 47108 - DNA, 25 bp, Homo sapien
caaccagaactggtagggcccactg

SEQ ID NO: 47109 - DNA, 25 bp, Homo sapien
ccgggcgacttcgtgtttgcactct

SEQ ID NO: 47110 - DNA, 25 bp, Homo sapien
ctggaaatgatactggcgctcacgc

SEQ ID NO: 47111 - DNA, 25 bp, Homo sapien
aactgcagtgtgaggacagcgtctc

SEQ ID NO: 47112 - DNA, 25 bp, Homo sapien
cctgggcattcttggactcaaggcc

SEQ ID NO: 47113 - DNA, 25 bp, Homo sapien
cccactgatgatggctgggacaacc

SEQ ID NO: 47114 - DNA, 25 bp, Homo sapien
tgaggtgtcccttctcgttgagata

SEQ ID NO: 47115 - DNA, 25 bp, Homo sapien
agcggccagttcactacgcagtatc

SEQ ID NO: 47116 - DNA, 25 bp, Homo sapien
tggagccgcctgttgagacccttcc

SEQ ID NO: 47117 - DNA, 25 bp, Homo sapien
ttccgctggggtgaaaggcagctcc

SEQ ID NO: 47118 - DNA, 25 bp, Homo sapien
cacctgcaagctcctgggaggttcc

SEQ ID NO: 47119 - DNA, 25 bp, Homo sapien
cttctactgtgcgtttaaagcaccc

SEQ ID NO: 47120 - DNA, 25 bp, Homo sapien
aggttccgggctcccactgagcgat

SEQ ID NO: 47121 - DNA, 25 bp, Homo sapien
gctgtaaacttgtccctgggctggg

SEQ ID NO: 47122 - DNA, 25 bp, Homo sapien
gccacgctgtaaacttgtccctggg

SEQ ID NO: 47123 - DNA, 25 bp, Homo sapien
ccactgagcgatggttttgttccgc

SEQ ID NO: 47124 - DNA, 25 bp, Homo sapien
tgtctgaccacacggtctctgacca

SEQ ID NO: 47125 - DNA, 25 bp, Homo sapien
ccgggaagttcttcctcgtgtctga

SEQ ID NO: 47126 - DNA, 25 bp, Homo sapien
tcgtgtctgaccacacggtctctga

SEQ ID NO: 47127 - DNA, 25 bp, Homo sapien
cgggaagttcttcctcgtgtctgac

SEQ ID NO: 47128 - DNA, 25 bp, Homo sapien
gaccacacggtctctgaccacgagg

SEQ ID NO: 47129 - DNA, 25 bp, Homo sapien
aagttcttcctcgtgtctgaccaca

SEQ ID NO: 47130 - DNA, 25 bp, Homo sapien
tctctgaccacgaggccgggaagtt

SEQ ID NO: 47131 - DNA, 25 bp, Homo sapien
tgaccacacggtctctgaccacgag

SEQ ID NO: 47132 - DNA, 25 bp, Homo sapien
gccgggcgaagcatccatgacatca

SEQ ID NO: 47133 - DNA, 25 bp, Homo sapien
tgctcacactggatcaccgtctgga

SEQ ID NO: 47134 - DNA, 25 bp, Homo sapien
ttcgtgaccaaacggagacgatttg

SEQ ID NO: 47135 - DNA, 25 bp, Homo sapien
gggcagtaaactccgttcgtgacca

SEQ ID NO: 47136 - DNA, 25 bp, Homo sapien
cggacgccctgagaccttgcaagtc

SEQ ID NO: 47137 - DNA, 25 bp, Homo sapien
tccctgaatcccacgtctaggaaga

SEQ ID NO: 47138 - DNA, 25 bp, Homo sapien
tacccagtccgggtcaggtcagaca

SEQ ID NO: 47139 - DNA, 25 bp, Homo sapien
ggcccagtcgttcctctgcaacaaa

SEQ ID NO: 47140 - DNA, 25 bp, Homo sapien
ggccgctccaaggtcaggctctatg

SEQ ID NO: 47141 - DNA, 25 bp, Homo sapien
tgggctgtggagaacctcccgtgcc

SEQ ID NO: 47142 - DNA, 25 bp, Homo sapien
tgtggagaacctcccgtgccgtctc

SEQ ID NO: 47143 - DNA, 25 bp, Homo sapien
cgtctcacaggtgcacgtggctgtg

SEQ ID NO: 47144 - DNA, 25 bp, Homo sapien
cgctccaaggtcaggctctatgtgg

SEQ ID NO: 47145 - DNA, 25 bp, Homo sapien
caaggtcaggctctatgtggactgc

SEQ ID NO: 47146 - DNA, 25 bp, Homo sapien
tctatgtggactgccggaaggtggc

SEQ ID NO: 47147 - DNA, 25 bp, Homo sapien
tgccgtctcacaggtgcacgtggct

SEQ ID NO: 47148 - DNA, 25 bp, Homo sapien
cgtgagcaaagacgtgcgcctggct

SEQ ID NO: 47149 - DNA, 25 bp, Homo sapien
tgcgctgccatattccctttgtctg

SEQ ID NO: 47150 - DNA, 25 bp, Homo sapien
agggatgttgaagacagcgcgccca

SEQ ID NO: 47151 - DNA, 25 bp, Homo sapien
ttgtgctggagcctcagagcacatc

SEQ ID NO: 47152 - DNA, 25 bp, Homo sapien
gccctccaggctcgattctaaacat

SEQ ID NO: 47153 - DNA, 25 bp, Homo sapien
acagagtccctaggacagtcgctgg

SEQ ID NO: 47154 - DNA, 25 bp, Homo sapien
cagagcacatctcaggcacagagtc

SEQ ID NO: 47155 - DNA, 25 bp, Homo sapien
tactgcacaagcgtgacacagatgc

SEQ ID NO: 47156 - DNA, 25 bp, Homo sapien
gctgaggattcatacgcacgctgtg

SEQ ID NO: 47157 - DNA, 25 bp, Homo sapien
ccgagctggcgacgggtaaataaga

SEQ ID NO: 47158 - DNA, 25 bp, Homo sapien
cgcagcgagcaatgacccgggatcg

SEQ ID NO: 47159 - DNA, 25 bp, Homo sapien
tgccggctctatgcgaatattcttc

SEQ ID NO: 47160 - DNA, 25 bp, Homo sapien
cgttggcaaacccttcgtcagcagc

SEQ ID NO: 47161 - DNA, 25 bp, Homo sapien
cgtcgatgcaaccacgttggcaaac

SEQ ID NO: 47162 - DNA, 25 bp, Homo sapien
aaatgccttgtcatgccgctgagga

SEQ ID NO: 47163 - DNA, 25 bp, Homo sapien
ggtcagcctccctgccaaagtctgt

SEQ ID NO: 47164 - DNA, 25 bp, Homo sapien
cagggcggttccttcagtccttgac

SEQ ID NO: 47165 - DNA, 25 bp, Homo sapien
aacgtagttcagatcctcaggccca

SEQ ID NO: 47166 - DNA, 25 bp, Homo sapien
caaggcgatgtcgtcgcctggactc

SEQ ID NO: 47167 - DNA, 25 bp, Homo sapien
cacgtcacgaggagctccgggtcca

SEQ ID NO: 47168 - DNA, 25 bp, Homo sapien
gtgcgcccagggagtccacgtcacg

SEQ ID NO: 47169 - DNA, 25 bp, Homo sapien
ataaggcagcttcttcggcggccgc

SEQ ID NO: 47170 - DNA, 25 bp, Homo sapien
gcccggatgataaggcagcttcttc

SEQ ID NO: 47171 - DNA, 25 bp, Homo sapien
ccttgaccttcgcagaacgtagttc

SEQ ID NO: 47172 - DNA, 25 bp, Homo sapien
aggcagacgatgatgaacatccaga

SEQ ID NO: 47173 - DNA, 25 bp, Homo sapien
ccagaggaagatgcggtcgatgacc

SEQ ID NO: 47174 - DNA, 25 bp, Homo sapien
gtcgatgaccatggccacgtacttc

SEQ ID NO: 47175 - DNA, 25 bp, Homo sapien
tgaccatggccacgtacttccagtc

SEQ ID NO: 47176 - DNA, 25 bp, Homo sapien
cctgcaagcacagacgccgtcactc

SEQ ID NO: 47177 - DNA, 25 bp, Homo sapien
ttcctagatcatgccagccagccag

SEQ ID NO: 47178 - DNA, 25 bp, Homo sapien
gcaggctcccggtcccttcctagat

SEQ ID NO: 47179 - DNA, 25 bp, Homo sapien
agtcctccttcacctgcaagcacag

SEQ ID NO: 47180 - DNA, 25 bp, Homo sapien
cctgaagatgaaacgcagccgcaga

SEQ ID NO: 47181 - DNA, 25 bp, Homo sapien
gctgctgtgaagtcagctctgctcc

SEQ ID NO: 47182 - DNA, 25 bp, Homo sapien
ttataaataaagtcctgcccaggcc

SEQ ID NO: 47183 - DNA, 25 bp, Homo sapien
cgcgttccatccaccctgaagatga

SEQ ID NO: 47184 - DNA, 25 bp, Homo sapien
aaacgcagccgcagaccaaagcctt

SEQ ID NO: 47185 - DNA, 25 bp, Homo sapien
gcagcggcagcaatcggcccgagaa

SEQ ID NO: 47186 - DNA, 25 bp, Homo sapien
cggccgcatttatctacgggaagcc

SEQ ID NO: 47187 - DNA, 25 bp, Homo sapien
tctcgccctttcctatgtgccttta

SEQ ID NO: 47188 - DNA, 25 bp, Homo sapien
tcagaggcgcccaacacagccatgg

SEQ ID NO: 47189 - DNA, 25 bp, Homo sapien
tgtccttgaccacggacggccgctt

SEQ ID NO: 47190 - DNA, 25 bp, Homo sapien
atgagccgccggcaattgtccttga

SEQ ID NO: 47191 - DNA, 25 bp, Homo sapien
ggccatcttatgcatggactcgatg

SEQ ID NO: 47192 - DNA, 25 bp, Homo sapien
tctgcaatgtactggacgccctcca

SEQ ID NO: 47193 - DNA, 25 bp, Homo sapien
cggccttcaggtggtctgcaatgta

SEQ ID NO: 47194 - DNA, 25 bp, Homo sapien
cgagaagtctgtgtcttcggccttc

SEQ ID NO: 47195 - DNA, 25 bp, Homo sapien
catcgtctcggggaacacagtactg

SEQ ID NO: 47196 - DNA, 25 bp, Homo sapien
cctagcacatctgggttactccatc

SEQ ID NO: 47197 - DNA, 25 bp, Homo sapien
gcacatctaggggatccggcgcaag

SEQ ID NO: 47198 - DNA, 25 bp, Homo sapien
gtgtctgcagcctgaaaatcgcgtc

SEQ ID NO: 47199 - DNA, 25 bp, Homo sapien
aaatcgcgtctctggtcttgttccc

SEQ ID NO: 47200 - DNA, 25 bp, Homo sapien
agcgagccgttcaggactctctgtc

SEQ ID NO: 47201 - DNA, 25 bp, Homo sapien
tggtacctccgcagagacccaagag

SEQ ID NO: 47202 - DNA, 25 bp, Homo sapien
cgccttgtgcggctgaatctcgtgt

SEQ ID NO: 47203 - DNA, 25 bp, Homo sapien
gggtcccggagtcagtctgacctcc

SEQ ID NO: 47204 - DNA, 25 bp, Homo sapien
ggggaggctcctcattacgctccca

SEQ ID NO: 47205 - DNA, 25 bp, Homo sapien
aaggcagctcttccgtgcctccgtg

SEQ ID NO: 47206 - DNA, 25 bp, Homo sapien
acactagaccctgcctgcggggaga

SEQ ID NO: 47207 - DNA, 25 bp, Homo sapien
tttgcagcgtttaatttgcttcctc

SEQ ID NO: 47208 - DNA, 25 bp, Homo sapien
gcacaaagcccaatcacagacatcg

SEQ ID NO: 47209 - DNA, 25 bp, Homo sapien
tatgtgttatgatggccacgtgtcc

SEQ ID NO: 47210 - DNA, 25 bp, Homo sapien
cccacgtttggtgatgtatgtgtta

SEQ ID NO: 47211 - DNA, 25 bp, Homo sapien
agacatcgcacacggatacactaga

SEQ ID NO: 47212 - DNA, 25 bp, Homo sapien
tccagggccacgaaggatggcattg

SEQ ID NO: 47213 - DNA, 25 bp, Homo sapien
caacccggcacgcagagaggcacga

SEQ ID NO: 47214 - DNA, 25 bp, Homo sapien
tgcagggaccaacccggcacgcaga

SEQ ID NO: 47215 - DNA, 25 bp, Homo sapien
gaccactcctcatgaggctgcaggg

SEQ ID NO: 47216 - DNA, 25 bp, Homo sapien
ggccaagcgaccactcctcatgagg

SEQ ID NO: 47217 - DNA, 25 bp, Homo sapien
ggctcccaagacatgaccacgctgg

SEQ ID NO: 47218 - DNA, 25 bp, Homo sapien
cagagaggcacgaggtgacatccga

SEQ ID NO: 47219 - DNA, 25 bp, Homo sapien
tgacatccgaggcagggagcacatc

SEQ ID NO: 47220 - DNA, 25 bp, Homo sapien
ttactgagtgcacaggtccacctgg

SEQ ID NO: 47221 - DNA, 25 bp, Homo sapien
tggcgcattcttacggctctggcat

SEQ ID NO: 47222 - DNA, 25 bp, Homo sapien
ctctggcatcaacctgtccgtgtga

SEQ ID NO: 47223 - DNA, 25 bp, Homo sapien
aactagagttcattccctgggcgtc

SEQ ID NO: 47224 - DNA, 25 bp, Homo sapien
gggagttcctgtccacatgcattaa

SEQ ID NO: 47225 - DNA, 25 bp, Homo sapien
cctgggcgtctatccctagaaaatg

SEQ ID NO: 47226 - DNA, 25 bp, Homo sapien
aggcctggtcactacggcacaagga

SEQ ID NO: 47227 - DNA, 25 bp, Homo sapien
tacgtcggtactgaaggcattatga

SEQ ID NO: 47228 - DNA, 25 bp, Homo sapien
tgcctccttcgtcgggagccagctg

SEQ ID NO: 47229 - DNA, 25 bp, Homo sapien
ctgtctggttcgctgcctccttcgt

SEQ ID NO: 47230 - DNA, 25 bp, Homo sapien
gcctgtcctgctcttcggcaagatc

SEQ ID NO: 47231 - DNA, 25 bp, Homo sapien
ttccaggactcggagcctgtcctgc

SEQ ID NO: 47232 - DNA, 25 bp, Homo sapien
gcctacgtgggacctgagatactca

SEQ ID NO: 47233 - DNA, 25 bp, Homo sapien
tgggcgtggcgctcttcaccatgct

SEQ ID NO: 47234 - DNA, 25 bp, Homo sapien
agctcacgggcctcatactcgggca

SEQ ID NO: 47235 - DNA, 25 bp, Homo sapien
atactcgggcaaggcagccgatgtc

SEQ ID NO: 47236 - DNA, 25 bp, Homo sapien
cgcgacggtccacaaaggctcagaa

SEQ ID NO: 47237 - DNA, 25 bp, Homo sapien
ggcctcagtgcagaaccactgcgtc

SEQ ID NO: 47238 - DNA, 25 bp, Homo sapien
caggcctttggaggtatggagttcc

SEQ ID NO: 47239 - DNA, 25 bp, Homo sapien
ccaccgattccaggtagggcactgc

SEQ ID NO: 47240 - DNA, 25 bp, Homo sapien
taaagccgactagcagagccgccgc

SEQ ID NO: 47241 - DNA, 25 bp, Homo sapien
ctgcgagtcaggaagaggataaagc

SEQ ID NO: 47242 - DNA, 25 bp, Homo sapien
gcgccaccatgacgagggcctcagt

SEQ ID NO: 47243 - DNA, 25 bp, Homo sapien
gctcagaaggccagaaaacccggta

SEQ ID NO: 47244 - DNA, 25 bp, Homo sapien
acacccgcctgtagctgcccggaaa

SEQ ID NO: 47245 - DNA, 25 bp, Homo sapien
ccgcaggtcctcaccaaacaggccc

SEQ ID NO: 47246 - DNA, 25 bp, Homo sapien
cccgcctgttgccacgctggcaaca

SEQ ID NO: 47247 - DNA, 25 bp, Homo sapien
cagggaacaggcctgccctttgtgc

SEQ ID NO: 47248 - DNA, 25 bp, Homo sapien
aaacaggcccgccctttgcgcaggt

SEQ ID NO: 47249 - DNA, 25 bp, Homo sapien
tcctcagggaacaggcctgcccttt

SEQ ID NO: 47250 - DNA, 25 bp, Homo sapien
cctttgcgcaggtcctcagggaaca

SEQ ID NO: 47251 - DNA, 25 bp, Homo sapien
aggtgtgaaggcagaggccacgcac

SEQ ID NO: 47252 - DNA, 25 bp, Homo sapien
accttcccggcggaagcagcgagga

SEQ ID NO: 47253 - DNA, 25 bp, Homo sapien
gcgagcccggctccgaaacttacaa

SEQ ID NO: 47254 - DNA, 25 bp, Homo sapien
tccgattgttttccggtggcgagcc

SEQ ID NO: 47255 - DNA, 25 bp, Homo sapien
gctccacttcccatctgctattgtt

SEQ ID NO: 47256 - DNA, 25 bp, Homo sapien
catttgggctccgaggaagttgacc

SEQ ID NO: 47257 - DNA, 25 bp, Homo sapien
ttccgaggctggcaaaagccgaggc

SEQ ID NO: 47258 - DNA, 25 bp, Homo sapien
ctcctctccaaagtgccgtgtctga

SEQ ID NO: 47259 - DNA, 25 bp, Homo sapien
tctggtaccaaagtgcttactcctc

SEQ ID NO: 47260 - DNA, 25 bp, Homo sapien
ctcctcgtggtccacggacgggatg

SEQ ID NO: 47261 - DNA, 25 bp, Homo sapien
ctgtcgacatgctcccggctgtctt

SEQ ID NO: 47262 - DNA, 25 bp, Homo sapien
caatgcagccgtgcctgtcgacatg

SEQ ID NO: 47263 - DNA, 25 bp, Homo sapien
gctggagcgcacgatcttgacaatg

SEQ ID NO: 47264 - DNA, 25 bp, Homo sapien
agaagttcttctggcccgtggagct

SEQ ID NO: 47265 - DNA, 25 bp, Homo sapien
atggagatggacgtgtcgctgtccc

SEQ ID NO: 47266 - DNA, 25 bp, Homo sapien
ccaaagtaggcctcggtctctgtcg

SEQ ID NO: 47267 - DNA, 25 bp, Homo sapien
tgccgcaggaactccatgctggcgc

SEQ ID NO: 47268 - DNA, 25 bp, Homo sapien
cggcgaaacgcatcgtaaagccaca

SEQ ID NO: 47269 - DNA, 25 bp, Homo sapien
aacgggaaacgcattgtcaggagcc

SEQ ID NO: 47270 - DNA, 25 bp, Homo sapien
caaagcttttgactcgggagcgggt

SEQ ID NO: 47271 - DNA, 25 bp, Homo sapien
cccgtgtttcaagcaaagcttttga

SEQ ID NO: 47272 - DNA, 25 bp, Homo sapien
ttggatttgccaagtccttcccgtg

SEQ ID NO: 47273 - DNA, 25 bp, Homo sapien
gtcgaaacaggtgctctcccacaga

SEQ ID NO: 47274 - DNA, 25 bp, Homo sapien
ccacaggaaatgaggagctggccag

SEQ ID NO: 47275 - DNA, 25 bp, Homo sapien
gcaacagggaggctccgtcgaaaca

SEQ ID NO: 47276 - DNA, 25 bp, Homo sapien
acgcggcacccttgatgcggaaagc

SEQ ID NO: 47277 - DNA, 25 bp, Homo sapien
acaggccgtgtctgctcatggccga

SEQ ID NO: 47278 - DNA, 25 bp, Homo sapien
gctcccacgggaaccgacagacaga

SEQ ID NO: 47279 - DNA, 25 bp, Homo sapien
ttcaaactgaccttctggctgctcc

SEQ ID NO: 47280 - DNA, 25 bp, Homo sapien
ggggctggagaagacacgatctttc

SEQ ID NO: 47281 - DNA, 25 bp, Homo sapien
ggtgaccgcctcacagtctgggcct

SEQ ID NO: 47282 - DNA, 25 bp, Homo sapien
ctctgcaaagaacacaggccgtgtc

SEQ ID NO: 47283 - DNA, 25 bp, Homo sapien
gaagctccagctcttgggcaccttg

SEQ ID NO: 47284 - DNA, 25 bp, Homo sapien
tagtacacaagcgactttggggtcc

SEQ ID NO: 47285 - DNA, 25 bp, Homo sapien
tcctgcgcacacgtgtgtttagaca

SEQ ID NO: 47286 - DNA, 25 bp, Homo sapien
ttagacaccgatgtccctgcacgca

SEQ ID NO: 47287 - DNA, 25 bp, Homo sapien
ggcgtcacagacacggctagctcca

SEQ ID NO: 47288 - DNA, 25 bp, Homo sapien
tgctggttaaccacgaacgcgacgg

SEQ ID NO: 47289 - DNA, 25 bp, Homo sapien
tgccggtccggctttttagtacaca

SEQ ID NO: 47290 - DNA, 25 bp, Homo sapien
cccaggcacgaagggatgtagtgca

SEQ ID NO: 47291 - DNA, 25 bp, Homo sapien
aggctggactctgtttgctggttaa

SEQ ID NO: 47292 - DNA, 25 bp, Homo sapien
atggggtgtcggacaagacagcaca

SEQ ID NO: 47293 - DNA, 25 bp, Homo sapien
cagaaccgccgtggccaaagagacc

SEQ ID NO: 47294 - DNA, 25 bp, Homo sapien
gacagcacaagtcagaaccgccgtg

SEQ ID NO: 47295 - DNA, 25 bp, Homo sapien
gacatgcaccaaaaacacgcggaca

SEQ ID NO: 47296 - DNA, 25 bp, Homo sapien
gagctcgagacccacagacactgac

SEQ ID NO: 47297 - DNA, 25 bp, Homo sapien
ggacaggcccacagtgagctcgaga

SEQ ID NO: 47298 - DNA, 25 bp, Homo sapien
ccgagacccgacaggacagacatgc

SEQ ID NO: 47299 - DNA, 25 bp, Homo sapien
acgcggacacgtgtgcttgagaaga

SEQ ID NO: 47300 - DNA, 25 bp, Homo sapien
gtcagcagacgcgaaaagagaaagc

SEQ ID NO: 47301 - DNA, 25 bp, Homo sapien
gacgggctgggacactttgtcgtac

SEQ ID NO: 47302 - DNA, 25 bp, Homo sapien
gctgggacactttgtcgtacgaccc

SEQ ID NO: 47303 - DNA, 25 bp, Homo sapien
gacactttgtcgtacgacccacgcg

SEQ ID NO: 47304 - DNA, 25 bp, Homo sapien
cgcctgggccccattaggagccatg

SEQ ID NO: 47305 - DNA, 25 bp, Homo sapien
gaccaggtcagcagacgcgaaaaga

SEQ ID NO: 47306 - DNA, 25 bp, Homo sapien
gaaaagagaaagcaccaccatcacc

SEQ ID NO: 47307 - DNA, 25 bp, Homo sapien
ttaggagccatgcagagcccccggc

SEQ ID NO: 47308 - DNA, 25 bp, Homo sapien
atgatgtctacaaagcgggcgtgga

SEQ ID NO: 47309 - DNA, 25 bp, Homo sapien
ccggtccatgcggatcatccgcaga

SEQ ID NO: 47310 - DNA, 25 bp, Homo sapien
tcatccgcagaatctgcaggaagcg

SEQ ID NO: 47311 - DNA, 25 bp, Homo sapien
tccggagcgcagatgtggcaaagac

SEQ ID NO: 47312 - DNA, 25 bp, Homo sapien
tggcaaagacgttgccctgggagcc

SEQ ID NO: 47313 - DNA, 25 bp, Homo sapien
cggccagcaccgcaatggaggcgat

SEQ ID NO: 47314 - DNA, 25 bp, Homo sapien
tggaggcgatgagcaccatgatgtc

SEQ ID NO: 47315 - DNA, 25 bp, Homo sapien
ggcgatgagcaccatgatgtctaca

SEQ ID NO: 47316 - DNA, 25 bp, Homo sapien
gtccaggtccttcgtcacagccata

SEQ ID NO: 47317 - DNA, 25 bp, Homo sapien
ccaggcaatgtgagagacgccttca

SEQ ID NO: 47318 - DNA, 25 bp, Homo sapien
gccttcaccttgaccgtgttgctgc

SEQ ID NO: 47319 - DNA, 25 bp, Homo sapien
gttgctgcctctcgttccaaccgtg

SEQ ID NO: 47320 - DNA, 25 bp, Homo sapien
ttccaaccgtgctcagaaccaggag

SEQ ID NO: 47321 - DNA, 25 bp, Homo sapien
ggacacgccctcattccaggcaatg

SEQ ID NO: 47322 - DNA, 25 bp, Homo sapien
tgtactgtcttcacactcgccatca

SEQ ID NO: 47323 - DNA, 25 bp, Homo sapien
cataaaggaggccatgcgtgggaca

SEQ ID NO: 47324 - DNA, 25 bp, Homo sapien
cgcgattaatttcctgtgctcgttg

SEQ ID NO: 47325 - DNA, 25 bp, Homo sapien
ttccagctcgaaggcactggccctg

SEQ ID NO: 47326 - DNA, 25 bp, Homo sapien
tctgaactctcagcggggtaggagc

SEQ ID NO: 47327 - DNA, 25 bp, Homo sapien
cgtcccatttccaagccgcgattaa

SEQ ID NO: 47328 - DNA, 25 bp, Homo sapien
tcttcaattaactgagccctgggaa

SEQ ID NO: 47329 - DNA, 25 bp, Homo sapien
gccctgggaaaaatgcgcagacatc

SEQ ID NO: 47330 - DNA, 25 bp, Homo sapien
tctgtctgcctaacggggttttctc

SEQ ID NO: 47331 - DNA, 25 bp, Homo sapien
gctcgttggccaagttcttcaatta

SEQ ID NO: 47332 - DNA, 25 bp, Homo sapien
ttctgtcactggacgccaaggagtt

SEQ ID NO: 47333 - DNA, 25 bp, Homo sapien
gggtctcgacagatcccgacacagg

SEQ ID NO: 47334 - DNA, 25 bp, Homo sapien
cgccaccagccggaagttttctgtc

SEQ ID NO: 47335 - DNA, 25 bp, Homo sapien
ccaaggagttttcggtggctcagct

SEQ ID NO: 47336 - DNA, 25 bp, Homo sapien
tcagctgggtaaccggggatcacca

SEQ ID NO: 47337 - DNA, 25 bp, Homo sapien
cagcccggaagaatgggtcctgacc

SEQ ID NO: 47338 - DNA, 25 bp, Homo sapien
tcctgacccggctgtgtggaaaagc

SEQ ID NO: 47339 - DNA, 25 bp, Homo sapien
ggccggaaactgagccgttcacttc

SEQ ID NO: 47340 - DNA, 25 bp, Homo sapien
actcgcgttccggtcccccatggag

SEQ ID NO: 47341 - DNA, 25 bp, Homo sapien
ttccggtcccccatggagccttctg

SEQ ID NO: 47342 - DNA, 25 bp, Homo sapien
cggcagtcggcacggcagcacgcaa

SEQ ID NO: 47343 - DNA, 25 bp, Homo sapien
cagtcggcacggcagcacgcaagcg

SEQ ID NO: 47344 - DNA, 25 bp, Homo sapien
cacggcagcacgcaagcgggcgccc

SEQ ID NO: 47345 - DNA, 25 bp, Homo sapien
cctcgggcctgcacaaggcccactc

SEQ ID NO: 47346 - DNA, 25 bp, Homo sapien
ctgcacaaggcccactcgcgttccg

SEQ ID NO: 47347 - DNA, 25 bp, Homo sapien
ccagcgaccacagcccaggggctcg

SEQ ID NO: 47348 - DNA, 25 bp, Homo sapien
ctgccggaccgtcacgttgtccata

SEQ ID NO: 47349 - DNA, 25 bp, Homo sapien
ggcaggaacaggtacccacagaccc

SEQ ID NO: 47350 - DNA, 25 bp, Homo sapien
cacttccagggcaggaacaggtacc

SEQ ID NO: 47351 - DNA, 25 bp, Homo sapien
gacacgaccacgaggcacttccagg

SEQ ID NO: 47352 - DNA, 25 bp, Homo sapien
aacagcagcctgagagacacgacca

SEQ ID NO: 47353 - DNA, 25 bp, Homo sapien
acgggcactcctgtgggtacaagga

SEQ ID NO: 47354 - DNA, 25 bp, Homo sapien
tcacgttgtccatagctttggggaa

SEQ ID NO: 47355 - DNA, 25 bp, Homo sapien
gctccctacctgagggtggcgctct

SEQ ID NO: 47356 - DNA, 25 bp, Homo sapien
gcaaagatcccggtgcctcggccgt

SEQ ID NO: 47357 - DNA, 25 bp, Homo sapien
aagtttttggaacagatggcacaga

SEQ ID NO: 47358 - DNA, 25 bp, Homo sapien
accctgcatgaaggaagcagctgcc

SEQ ID NO: 47359 - DNA, 25 bp, Homo sapien
ggcccgcagaccctgcatgaaggaa

SEQ ID NO: 47360 - DNA, 25 bp, Homo sapien
ggggacgcaaagatcccggtgcctc

SEQ ID NO: 47361 - DNA, 25 bp, Homo sapien
ggaagaaacctccaaactgcggata

SEQ ID NO: 47362 - DNA, 25 bp, Homo sapien
ctgcggatagttcccaaacgcactg

SEQ ID NO: 47363 - DNA, 25 bp, Homo sapien
aaacgcactggccagccatccggtc

SEQ ID NO: 47364 - DNA, 25 bp, Homo sapien
tctcctgcggtggatgtgcttactt

SEQ ID NO: 47365 - DNA, 25 bp, Homo sapien
aggaagagcaaacgtccttccctgt

SEQ ID NO: 47366 - DNA, 25 bp, Homo sapien
cgggcgcagacacctggaaagaaac

SEQ ID NO: 47367 - DNA, 25 bp, Homo sapien
ttttccacgctttcccagtctcctg

SEQ ID NO: 47368 - DNA, 25 bp, Homo sapien
ccgcctgaatcctattctgtttaga

SEQ ID NO: 47369 - DNA, 25 bp, Homo sapien
tggatgtgcttactttgcagtcaga

SEQ ID NO: 47370 - DNA, 25 bp, Homo sapien
tgcagtcagaagaaaataagccacg

SEQ ID NO: 47371 - DNA, 25 bp, Homo sapien
gacgggaccgcctgaatcctattct

SEQ ID NO: 47372 - DNA, 25 bp, Homo sapien
ttccaagtgaacagccggcatctcc

SEQ ID NO: 47373 - DNA, 25 bp, Homo sapien
ctttcacagcttaaggggttccctg

SEQ ID NO: 47374 - DNA, 25 bp, Homo sapien
gggcaggcaccttcgttccaagtga

SEQ ID NO: 47375 - DNA, 25 bp, Homo sapien
ccgctgaccaatgggactgagaatc

SEQ ID NO: 47376 - DNA, 25 bp, Homo sapien
tcacggcgatgacagctacgagctt

SEQ ID NO: 47377 - DNA, 25 bp, Homo sapien
tggggaacatcgcacgcatcaggca

SEQ ID NO: 47378 - DNA, 25 bp, Homo sapien
catcaggcatcgtgtggagtgactc

SEQ ID NO: 47379 - DNA, 25 bp, Homo sapien
agggtcttcacaggtcacggccaca

SEQ ID NO: 47380 - DNA, 25 bp, Homo sapien
ggagagtccagacccagcgctgccg

SEQ ID NO: 47381 - DNA, 25 bp, Homo sapien
cggccctttgttcggcgcagaggcc

SEQ ID NO: 47382 - DNA, 25 bp, Homo sapien
gcgcgctgtacaatcgctctccggt

SEQ ID NO: 47383 - DNA, 25 bp, Homo sapien
tgtacaatcgctctccggtctcggc

SEQ ID NO: 47384 - DNA, 25 bp, Homo sapien
cggccactcacacgtaggcgtggta

SEQ ID NO: 47385 - DNA, 25 bp, Homo sapien
cagcacgttgtagaggaaattctgc

SEQ ID NO: 47386 - DNA, 25 bp, Homo sapien
aggacagacagctgcgctcagcccg

SEQ ID NO: 47387 - DNA, 25 bp, Homo sapien
aattctgcagcttgcggtagaaggc

SEQ ID NO: 47388 - DNA, 25 bp, Homo sapien
tcttccctggtctcgcacgggaagt

SEQ ID NO: 47389 - DNA, 25 bp, Homo sapien
gtgagtccagttcccggctcggaca

SEQ ID NO: 47390 - DNA, 25 bp, Homo sapien
gcccaggtgagtccagttcccggct

SEQ ID NO: 47391 - DNA, 25 bp, Homo sapien
aagtcgcccaggtgagtccagttcc

SEQ ID NO: 47392 - DNA, 25 bp, Homo sapien
tctcgcacgggaagtcgcccaggtg

SEQ ID NO: 47393 - DNA, 25 bp, Homo sapien
cttccctggtctcgcacgggaagtc

SEQ ID NO: 47394 - DNA, 25 bp, Homo sapien
ctcgcacgggaagtcgcccaggtga

SEQ ID NO: 47395 - DNA, 25 bp, Homo sapien
tgcccaggtgagtccagttcccggc

SEQ ID NO: 47396 - DNA, 25 bp, Homo sapien
agagcgccggtcaatcttctccttc

SEQ ID NO: 47397 - DNA, 25 bp, Homo sapien
acgatggccgcgtctccagacttca

SEQ ID NO: 47398 - DNA, 25 bp, Homo sapien
cgggaatgtcctcggaacacgctta

SEQ ID NO: 47399 - DNA, 25 bp, Homo sapien
cgggtactgggagaagctctccaca

SEQ ID NO: 47400 - DNA, 25 bp, Homo sapien
acgttcttgatgacgcctacggcca

SEQ ID NO: 47401 - DNA, 25 bp, Homo sapien
aacttccactggaccttgatggcga

SEQ ID NO: 47402 - DNA, 25 bp, Homo sapien
ttgatggcgagcatccagtcgctga

SEQ ID NO: 47403 - DNA, 25 bp, Homo sapien
tctgcctcatgtcgcgcacggcgaa

SEQ ID NO: 47404 - DNA, 25 bp, Homo sapien
ttcactggcgcaaaggtcaccacca

SEQ ID NO: 47405 - DNA, 25 bp, Homo sapien
cacctcagtggtgatgttcactggc

SEQ ID NO: 47406 - DNA, 25 bp, Homo sapien
tcgtggtgcatctccactgacttca

SEQ ID NO: 47407 - DNA, 25 bp, Homo sapien
agcttcgctcagagcctcgtggtgc

SEQ ID NO: 47408 - DNA, 25 bp, Homo sapien
ccgggcagagcttcgctcagagcct

SEQ ID NO: 47409 - DNA, 25 bp, Homo sapien
cttcacattgaagccgacgttgtcg

SEQ ID NO: 47410 - DNA, 25 bp, Homo sapien
caccgacacgttcttcacattgaag

SEQ ID NO: 47411 - DNA, 25 bp, Homo sapien
gccggatgtccttcaccgacacgtt

SEQ ID NO: 47412 - DNA, 25 bp, Homo sapien
ccattcttggagatgcccgcctcga

SEQ ID NO: 47413 - DNA, 25 bp, Homo sapien
cggctctgtggagtccattttgttc

SEQ ID NO: 47414 - DNA, 25 bp, Homo sapien
gagggctccagcatgttgtcaccgt

SEQ ID NO: 47415 - DNA, 25 bp, Homo sapien
acgatctcgtcgtagcgcttctcgc

SEQ ID NO: 47416 - DNA, 25 bp, Homo sapien
ttgatgtaggcgctgacttccttga

SEQ ID NO: 47417 - DNA, 25 bp, Homo sapien
atgttgtcaccgtgccagccggaga

SEQ ID NO: 47418 - DNA, 25 bp, Homo sapien
ctgagccagttagggaaacccagca

SEQ ID NO: 47419 - DNA, 25 bp, Homo sapien
gttcacgcccacgatgagctgcttc

SEQ ID NO: 47420 - DNA, 25 bp, Homo sapien
ggtgcgagctgcttgttacagcaga

SEQ ID NO: 47421 - DNA, 25 bp, Homo sapien
acctgctccgaaatgggcgcggcta

SEQ ID NO: 47422 - DNA, 25 bp, Homo sapien
tagtacttggtggtctcgaacttcc

SEQ ID NO: 47423 - DNA, 25 bp, Homo sapien
tctcgaacttccagagggagatgtc

SEQ ID NO: 47424 - DNA, 25 bp, Homo sapien
atgtcgatggtgatgccgcgctcac

SEQ ID NO: 47425 - DNA, 25 bp, Homo sapien
gcttgtccagcacccaggcatactt

SEQ ID NO: 47426 - DNA, 25 bp, Homo sapien
ccaggcatacttgaaggatcccttc

SEQ ID NO: 47427 - DNA, 25 bp, Homo sapien
cgaagccgccagatgggataaaccc

SEQ ID NO: 47428 - DNA, 25 bp, Homo sapien
cgcggtcttctctgcaaatgggctc

SEQ ID NO: 47429 - DNA, 25 bp, Homo sapien
cccgcgcatataagtgggcgcgtcc

SEQ ID NO: 47430 - DNA, 25 bp, Homo sapien
agccagacggcgagagtcgcaccga

SEQ ID NO: 47431 - DNA, 25 bp, Homo sapien
ccgtcgcctccacaagggctgaaga

SEQ ID NO: 47432 - DNA, 25 bp, Homo sapien
ctccgcgcacgtagcactttttggc

SEQ ID NO: 47433 - DNA, 25 bp, Homo sapien
aggttcctctggctgcgaagtccct

SEQ ID NO: 47434 - DNA, 25 bp, Homo sapien
gactcgggagagatccaggttcctc

SEQ ID NO: 47435 - DNA, 25 bp, Homo sapien
tctgcaaatgggctccgtggcctag

SEQ ID NO: 47436 - DNA, 25 bp, Homo sapien
acagcgcccgcagccatacgtcctg

SEQ ID NO: 47437 - DNA, 25 bp, Homo sapien
tgcggtgcccaccaggaggctttgc

SEQ ID NO: 47438 - DNA, 25 bp, Homo sapien
ggcagggaggaacccactcccaaca

SEQ ID NO: 47439 - DNA, 25 bp, Homo sapien
cgggcaggtgcagactccaggtcct

SEQ ID NO: 47440 - DNA, 25 bp, Homo sapien
gcctcactgagagcccaagaccggg

SEQ ID NO: 47441 - DNA, 25 bp, Homo sapien
cccgggagcttttctgggcctgcgt

SEQ ID NO: 47442 - DNA, 25 bp, Homo sapien
tgagagcccaagaccggggccgcca

SEQ ID NO: 47443 - DNA, 25 bp, Homo sapien
cttttctgggcctgcgtcggtggcc

SEQ ID NO: 47444 - DNA, 25 bp, Homo sapien
tctgcacggagctcatgacgaagtc

SEQ ID NO: 47445 - DNA, 25 bp, Homo sapien
cccgctcaggtcatctgcgggcaga

SEQ ID NO: 47446 - DNA, 25 bp, Homo sapien
acacggtcagggcatgcgcccgctg

SEQ ID NO: 47447 - DNA, 25 bp, Homo sapien
aagtcaacgtactgtggggccgtgc

SEQ ID NO: 47448 - DNA, 25 bp, Homo sapien
accagtagtactgtctgtggagaca

SEQ ID NO: 47449 - DNA, 25 bp, Homo sapien
cccgctcgtcataccagtagtactg

SEQ ID NO: 47450 - DNA, 25 bp, Homo sapien
ggggccgtgcacttgaccttcttcc

SEQ ID NO: 47451 - DNA, 25 bp, Homo sapien
tttgtggggaacacgtcctcatccg

SEQ ID NO: 47452 - DNA, 25 bp, Homo sapien
atccactgaagcgggaccggcagca

SEQ ID NO: 47453 - DNA, 25 bp, Homo sapien
agcaacagggacaggcccaccagga

SEQ ID NO: 47454 - DNA, 25 bp, Homo sapien
cactccctcgcagggccaagcgctc

SEQ ID NO: 47455 - DNA, 25 bp, Homo sapien
cgctggacgagctggttgccatcga

SEQ ID NO: 47456 - DNA, 25 bp, Homo sapien
tgtagaggaagaggccatagagcac

SEQ ID NO: 47457 - DNA, 25 bp, Homo sapien
cttggggatccactgaagcgggacc

SEQ ID NO: 47458 - DNA, 25 bp, Homo sapien
accggcagcagcaacagggacaggc

SEQ ID NO: 47459 - DNA, 25 bp, Homo sapien
aagaggccatagagcacgggcttgg

SEQ ID NO: 47460 - DNA, 25 bp, Homo sapien
cctcccgttcatggccacggtgttg

SEQ ID NO: 47461 - DNA, 25 bp, Homo sapien
tcctgacctgagcggttaccaccag

SEQ ID NO: 47462 - DNA, 25 bp, Homo sapien
ccacggtgttggagtccgcagagca

SEQ ID NO: 47463 - DNA, 25 bp, Homo sapien
ttggagtccgcagagcactcggaac

SEQ ID NO: 47464 - DNA, 25 bp, Homo sapien
gagtccgcagagcactcggaacctc

SEQ ID NO: 47465 - DNA, 25 bp, Homo sapien
cctccagcagcatgaccgcctgtgg

SEQ ID NO: 47466 - DNA, 25 bp, Homo sapien
catgaccgcctgtggcctggctcgg

SEQ ID NO: 47467 - DNA, 25 bp, Homo sapien
agcatgaccgcctgtggcctggctc

SEQ ID NO: 47468 - DNA, 25 bp, Homo sapien
gcaggctgaggaaggacaccgcctc

SEQ ID NO: 47469 - DNA, 25 bp, Homo sapien
ctctgggccctgtggtagttcacaa

SEQ ID NO: 47470 - DNA, 25 bp, Homo sapien
gccagatcttgtagtgccgcacagc

SEQ ID NO: 47471 - DNA, 25 bp, Homo sapien
ccggcacgccgccagatcttgtagt

SEQ ID NO: 47472 - DNA, 25 bp, Homo sapien
tagttcacaagctcgggcaggctga

SEQ ID NO: 47473 - DNA, 25 bp, Homo sapien
ggacaccgcctcgttcaggtgcagc

SEQ ID NO: 47474 - DNA, 25 bp, Homo sapien
caagtcagggcggagcggctacctt

SEQ ID NO: 47475 - DNA, 25 bp, Homo sapien
acagcctgcgtgtcccgcactggga

SEQ ID NO: 47476 - DNA, 25 bp, Homo sapien
gttccgactccaccgtctccctctc

SEQ ID NO: 47477 - DNA, 25 bp, Homo sapien
gcccacatacttggggcccaggtga

SEQ ID NO: 47478 - DNA, 25 bp, Homo sapien
gtcccagaggcccacatacttgggg

SEQ ID NO: 47479 - DNA, 25 bp, Homo sapien
acttgaagtcccagaggcccacata

SEQ ID NO: 47480 - DNA, 25 bp, Homo sapien
gctcctcgtccgtccgggacttgaa

SEQ ID NO: 47481 - DNA, 25 bp, Homo sapien
gcgtggcccaccaccactgctcctc

SEQ ID NO: 47482 - DNA, 25 bp, Homo sapien
tgtggggcacatagccctgggccac

SEQ ID NO: 47483 - DNA, 25 bp, Homo sapien
ccaggtagttgtggggcacatagcc

SEQ ID NO: 47484 - DNA, 25 bp, Homo sapien
aaggccagccgcctcctgaggaacg

SEQ ID NO: 47485 - DNA, 25 bp, Homo sapien
gccgtgaagtcatagagcgcaagga

SEQ ID NO: 47486 - DNA, 25 bp, Homo sapien
cctcttcgagggcacagagcctgtc

SEQ ID NO: 47487 - DNA, 25 bp, Homo sapien
ccgaaagcctgcgtgcgaagatgta

SEQ ID NO: 47488 - DNA, 25 bp, Homo sapien
ctcaggagaagccttggccacgtgg

SEQ ID NO: 47489 - DNA, 25 bp, Homo sapien
tactcacggttggtctgagagcgtc

SEQ ID NO: 47490 - DNA, 25 bp, Homo sapien
gccggccagatcttgtcccagaaga

SEQ ID NO: 47491 - DNA, 25 bp, Homo sapien
acctccttggcgtctggagtgcacc

SEQ ID NO: 47492 - DNA, 25 bp, Homo sapien
tggaagattactcggctcggggtcc

SEQ ID NO: 47493 - DNA, 25 bp, Homo sapien
tctcccaaattcctccgagggattc

SEQ ID NO: 47494 - DNA, 25 bp, Homo sapien
cggctccgcttcagaggcagggcaa

SEQ ID NO: 47495 - DNA, 25 bp, Homo sapien
cgcagcgtcacaaaggccgctggtc

SEQ ID NO: 47496 - DNA, 25 bp, Homo sapien
cctccgagggattcccgaggagtgc

SEQ ID NO: 47497 - DNA, 25 bp, Homo sapien
aagcgaagcggatggaagattactc

SEQ ID NO: 47498 - DNA, 25 bp, Homo sapien
tgggtggtccatccgcctggtcacc

SEQ ID NO: 47499 - DNA, 25 bp, Homo sapien
tctgtccaggcgctgggtggtccat

SEQ ID NO: 47500 - DNA, 25 bp, Homo sapien
ggtgggcacagctcagaccaagatc

SEQ ID NO: 47501 - DNA, 25 bp, Homo sapien
agctgctgcgtaagtgctcctacta

SEQ ID NO: 47502 - DNA, 25 bp, Homo sapien
tgctgcccaaccgatcctataagtt

SEQ ID NO: 47503 - DNA, 25 bp, Homo sapien
ttggaacagctcgaccatggccgtg

SEQ ID NO: 47504 - DNA, 25 bp, Homo sapien
atcccgcacatctggctcatgctga

SEQ ID NO: 47505 - DNA, 25 bp, Homo sapien
cgtgagttcctgacctcggacctga

SEQ ID NO: 47506 - DNA, 25 bp, Homo sapien
ctgtcgtgtttgaccgaaaggcgtc

SEQ ID NO: 47507 - DNA, 25 bp, Homo sapien
agccagccacatcggagcagtatga

SEQ ID NO: 47508 - DNA, 25 bp, Homo sapien
cacccagaagtgagaagagctttca

SEQ ID NO: 47509 - DNA, 25 bp, Homo sapien
cagcctggtgacaccggagcagctc

SEQ ID NO: 47510 - DNA, 25 bp, Homo sapien
tgagaagagctttcagagtggtttt

SEQ ID NO: 47511 - DNA, 25 bp, Homo sapien
ctcagggactttggacttggccagc

SEQ ID NO: 47512 - DNA, 25 bp, Homo sapien
gccagacctcaaacacccagaagtg

SEQ ID NO: 47513 - DNA, 25 bp, Homo sapien
ctgcgtaccaagcacagtgaccatc

SEQ ID NO: 47514 - DNA, 25 bp, Homo sapien
agcacagtgaccatccacttttgcc

SEQ ID NO: 47515 - DNA, 25 bp, Homo sapien
tgggaccagcaggacagtcaaggct

SEQ ID NO: 47516 - DNA, 25 bp, Homo sapien
accctggctcttggtgatggaggac

SEQ ID NO: 47517 - DNA, 25 bp, Homo sapien
ccgaagggccttgctgatctcagag

SEQ ID NO: 47518 - DNA, 25 bp, Homo sapien
cctctcgccgaagggccttgctgat

SEQ ID NO: 47519 - DNA, 25 bp, Homo sapien
tccaggtcgctcttggcacaggtgc

SEQ ID NO: 47520 - DNA, 25 bp, Homo sapien
ttggtgatggaggacacggccaccc

SEQ ID NO: 47521 - DNA, 25 bp, Homo sapien
ggacggtgctcaccagcacatagcg

SEQ ID NO: 47522 - DNA, 25 bp, Homo sapien
gcacaggtgcggacggtgctcacca

SEQ ID NO: 47523 - DNA, 25 bp, Homo sapien
ttgctgatctcagaggcctgcgcgt

SEQ ID NO: 47524 - DNA, 25 bp, Homo sapien
ctgggccgcctcatcgatgagaatg

SEQ ID NO: 47525 - DNA, 25 bp, Homo sapien
tctcagccagattcagccaggacgc

SEQ ID NO: 47526 - DNA, 25 bp, Homo sapien
gttgcccttggccacgtagaagtgc

SEQ ID NO: 47527 - DNA, 25 bp, Homo sapien
ctgacgtggctgtggaaatactccc

SEQ ID NO: 47528 - DNA, 25 bp, Homo sapien
tcgtcggtcaggcaacagtactgca

SEQ ID NO: 47529 - DNA, 25 bp, Homo sapien
cagcggtagttctcgtggaagacca

SEQ ID NO: 47530 - DNA, 25 bp, Homo sapien
ttgtaggcctcctgcaccttctcga

SEQ ID NO: 47531 - DNA, 25 bp, Homo sapien
tcagccctgggaggcaaatactgca

SEQ ID NO: 47532 - DNA, 25 bp, Homo sapien
tgacggagtcattctcggcaaccgc

SEQ ID NO: 47533 - DNA, 25 bp, Homo sapien
gatccctgcgctgagtagacacggc

SEQ ID NO: 47534 - DNA, 25 bp, Homo sapien
aggcgtactcatccacgtcgcggta

SEQ ID NO: 47535 - DNA, 25 bp, Homo sapien
tccagggcgcagaatggttcccaca

SEQ ID NO: 47536 - DNA, 25 bp, Homo sapien
cctcccaggagacactcaggtgctg

SEQ ID NO: 47537 - DNA, 25 bp, Homo sapien
tgtcggcacagttctcctcgaggaa

SEQ ID NO: 47538 - DNA, 25 bp, Homo sapien
gggtcaacattcaggccagggccga

SEQ ID NO: 47539 - DNA, 25 bp, Homo sapien
agcagctgaagttgatgtcggcaca

SEQ ID NO: 47540 - DNA, 25 bp, Homo sapien
ctcgtccagaagctcccgtaggatg

SEQ ID NO: 47541 - DNA, 25 bp, Homo sapien
ggtctcggacactgagggcatcatc

SEQ ID NO: 47542 - DNA, 25 bp, Homo sapien
cccgctcgaaggtctctggcacgaa

SEQ ID NO: 47543 - DNA, 25 bp, Homo sapien
agccttgccgccacaggacaatttg

SEQ ID NO: 47544 - DNA, 25 bp, Homo sapien
atgcccagcgggtagtagaagcctt

SEQ ID NO: 47545 - DNA, 25 bp, Homo sapien
ggggcaccctcaagctgtactccag

SEQ ID NO: 47546 - DNA, 25 bp, Homo sapien
acccggccaagctccgtgtggtatt

SEQ ID NO: 47547 - DNA, 25 bp, Homo sapien
tgcggcacacaaacgccagctcgtg

SEQ ID NO: 47548 - DNA, 25 bp, Homo sapien
ctggagagctgaactaccctgccca

SEQ ID NO: 47549 - DNA, 25 bp, Homo sapien
atgcctgcggggatgagcccgcacc

SEQ ID NO: 47550 - DNA, 25 bp, Homo sapien
ctggggaaagcagcaaactgaaaac

SEQ ID NO: 47551 - DNA, 25 bp, Homo sapien
actgaaaactgacactggcaccttc

SEQ ID NO: 47552 - DNA, 25 bp, Homo sapien
tgcccacgccagatggggcaccggt

SEQ ID NO: 47553 - DNA, 25 bp, Homo sapien
cccgcgcagaggtggagtgcaccca

SEQ ID NO: 47554 - DNA, 25 bp, Homo sapien
gtggagtgcacccacctccgaggac

SEQ ID NO: 47555 - DNA, 25 bp, Homo sapien
gtgtccatcgcgctgcgaacggctc

SEQ ID NO: 47556 - DNA, 25 bp, Homo sapien
agccgcacctcgaacaccgtattgt

SEQ ID NO: 47557 - DNA, 25 bp, Homo sapien
acctcgaacaccgtattgtcgggtg

SEQ ID NO: 47558 - DNA, 25 bp, Homo sapien
gcacctcgaacaccgtattgtcggg

SEQ ID NO: 47559 - DNA, 25 bp, Homo sapien
gccgcacctcgaacaccgtattgtc

SEQ ID NO: 47560 - DNA, 25 bp, Homo sapien
ccagccgcacctcgaacaccgtatt

SEQ ID NO: 47561 - DNA, 25 bp, Homo sapien
tccagccgcacctcgaacaccgtat

SEQ ID NO: 47562 - DNA, 25 bp, Homo sapien
cgcacctcgaacaccgtattgtcgg

SEQ ID NO: 47563 - DNA, 25 bp, Homo sapien
cagccgcacctcgaacaccgtattg

SEQ ID NO: 47564 - DNA, 25 bp, Homo sapien
gacctctgcgtacagtgctcccgga

SEQ ID NO: 47565 - DNA, 25 bp, Homo sapien
ttcagcgctggcgtctgcaatgccg

SEQ ID NO: 47566 - DNA, 25 bp, Homo sapien
gcatgttcagcgctggcgtctgcaa

SEQ ID NO: 47567 - DNA, 25 bp, Homo sapien
ctgcgtacagtgctcccggaggcgc

SEQ ID NO: 47568 - DNA, 25 bp, Homo sapien
gacggggacctctgcgtacagtgct

SEQ ID NO: 47569 - DNA, 25 bp, Homo sapien
gccaccagggctgtgctgaccgccc

SEQ ID NO: 47570 - DNA, 25 bp, Homo sapien
ccgtattgtcgggtgcaggtacagg

SEQ ID NO: 47571 - DNA, 25 bp, Homo sapien
ccggaggcgcgaagagcatgttcag

SEQ ID NO: 47572 - DNA, 25 bp, Homo sapien
aacttgctcactgcagtaggggaca

SEQ ID NO: 47573 - DNA, 25 bp, Homo sapien
tcccggaagccatgggagctgatga

SEQ ID NO: 47574 - DNA, 25 bp, Homo sapien
cgcagtcggacaggatctctcgcac

SEQ ID NO: 47575 - DNA, 25 bp, Homo sapien
ctctcgctggggttgtagcggaact

SEQ ID NO: 47576 - DNA, 25 bp, Homo sapien
gtagcggaacttgctcactgcagta

SEQ ID NO: 47577 - DNA, 25 bp, Homo sapien
cactctcgatttcccggaagccatg

SEQ ID NO: 47578 - DNA, 25 bp, Homo sapien
caactcactctcgatttcccggaag

SEQ ID NO: 47579 - DNA, 25 bp, Homo sapien
ggctactgctatgcctgcagcgcct

SEQ ID NO: 47580 - DNA, 25 bp, Homo sapien
cggaagcgctcaccccgtgcgtaga

SEQ ID NO: 47581 - DNA, 25 bp, Homo sapien
ccacctggaagtcggcagtggagct

SEQ ID NO: 47582 - DNA, 25 bp, Homo sapien
gcactcccacctggaagtcggcagt

SEQ ID NO: 47583 - DNA, 25 bp, Homo sapien
ggcggccaaagtcgaagaccaccca

SEQ ID NO: 47584 - DNA, 25 bp, Homo sapien
ctcaaaggtgccgaacgaggcagcc

SEQ ID NO: 47585 - DNA, 25 bp, Homo sapien
cccattgctcaaaggtgccgaacga

SEQ ID NO: 47586 - DNA, 25 bp, Homo sapien
aaagtcgaagaccacccattgctca

SEQ ID NO: 47587 - DNA, 25 bp, Homo sapien
tgccgaacgaggcagcctgcacacg

SEQ ID NO: 47588 - DNA, 25 bp, Homo sapien
actggaactgttggccacggttcga

SEQ ID NO: 47589 - DNA, 25 bp, Homo sapien
ttgtgctgacgctcgaaggtccaga

SEQ ID NO: 47590 - DNA, 25 bp, Homo sapien
gggtccacgcagtccactggaactg

SEQ ID NO: 47591 - DNA, 25 bp, Homo sapien
gacgtaggtgctttcattgagccgc

SEQ ID NO: 47592 - DNA, 25 bp, Homo sapien
catgctccaccctacggaggacgta

SEQ ID NO: 47593 - DNA, 25 bp, Homo sapien
ccttgctcttggtggcctgcttaaa

SEQ ID NO: 47594 - DNA, 25 bp, Homo sapien
cccagggctgtagtagtggcagact

SEQ ID NO: 47595 - DNA, 25 bp, Homo sapien
aaagcagctcgaagcggccgccaaa

SEQ ID NO: 47596 - DNA, 25 bp, Homo sapien
agagacgccccgatgatgtgccagg

SEQ ID NO: 47597 - DNA, 25 bp, Homo sapien
aagcgccagcgagcagaggacgccc

SEQ ID NO: 47598 - DNA, 25 bp, Homo sapien
tgatcgcggaaattacctcaccgcc

SEQ ID NO: 47599 - DNA, 25 bp, Homo sapien
cgctgatcgcggaaattacctcacc

SEQ ID NO: 47600 - DNA, 25 bp, Homo sapien
actgacgctgatcgcggaaattacc

SEQ ID NO: 47601 - DNA, 25 bp, Homo sapien
gcactgacgctgatcgcggaaatta

SEQ ID NO: 47602 - DNA, 25 bp, Homo sapien
ctggcccgggcactgacgctgatcg

SEQ ID NO: 47603 - DNA, 25 bp, Homo sapien
cagcccttcacacaccagagacgcc

SEQ ID NO: 47604 - DNA, 25 bp, Homo sapien
cgggagagagttccacgtacacaca

SEQ ID NO: 47605 - DNA, 25 bp, Homo sapien
tgagaccacgggagagagttccacg

SEQ ID NO: 47606 - DNA, 25 bp, Homo sapien
ggagagagttccacgtacacacagc

SEQ ID NO: 47607 - DNA, 25 bp, Homo sapien
caacaacacgctcacacgggctgag

SEQ ID NO: 47608 - DNA, 25 bp, Homo sapien
ggacagagttccacgtacacacagc

SEQ ID NO: 47609 - DNA, 25 bp, Homo sapien
acagcacacggccaacaacacgctc

SEQ ID NO: 47610 - DNA, 25 bp, Homo sapien
aacaacacgctcacacgggctgagt

SEQ ID NO: 47611 - DNA, 25 bp, Homo sapien
gcacacggccaacaacacgctcaca

SEQ ID NO: 47612 - DNA, 25 bp, Homo sapien
gtcctgatgtggcacgtgcaagccg

SEQ ID NO: 47613 - DNA, 25 bp, Homo sapien
gcgtcagcgtcatgagcacgttgct

SEQ ID NO: 47614 - DNA, 25 bp, Homo sapien
gccaggcaacgtgagcagctgtagc

SEQ ID NO: 47615 - DNA, 25 bp, Homo sapien
ggctgaccaccttgaacaccgtgct

SEQ ID NO: 47616 - DNA, 25 bp, Homo sapien
acgcgtccgggtggatctccactgt

SEQ ID NO: 47617 - DNA, 25 bp, Homo sapien
caccactttaccaaggggcacgctg

SEQ ID NO: 47618 - DNA, 25 bp, Homo sapien
tgccatggcagccacctcaatggtg

SEQ ID NO: 47619 - DNA, 25 bp, Homo sapien
ccggaagaggccaagactgtgtatc

SEQ ID NO: 47620 - DNA, 25 bp, Homo sapien
gtggtctcagcatacctgccaggtc

SEQ ID NO: 47621 - DNA, 25 bp, Homo sapien
ccgaagttctgcacgatgttgttga

SEQ ID NO: 47622 - DNA, 25 bp, Homo sapien
agcggtccatctggcacttgtggct

SEQ ID NO: 47623 - DNA, 25 bp, Homo sapien
cttgtggctggccagcaccttcttc

SEQ ID NO: 47624 - DNA, 25 bp, Homo sapien
cacaacagcagtgcggagaagctcg

SEQ ID NO: 47625 - DNA, 25 bp, Homo sapien
gcccgggaccttcctagagagtcac

SEQ ID NO: 47626 - DNA, 25 bp, Homo sapien
tcttaaagggtaacgcggacactca

SEQ ID NO: 47627 - DNA, 25 bp, Homo sapien
caccaggtccagcatgccgaagttc

SEQ ID NO: 47628 - DNA, 25 bp, Homo sapien
gtgcgcggaccgacactgtcagctc

SEQ ID NO: 47629 - DNA, 25 bp, Homo sapien
tcacgcggaacatgccagaggctca

SEQ ID NO: 47630 - DNA, 25 bp, Homo sapien
tgtcagctcctaacgccgcaggttc

SEQ ID NO: 47631 - DNA, 25 bp, Homo sapien
gccggacacttatttggcgctcgcg

SEQ ID NO: 47632 - DNA, 25 bp, Homo sapien
cgcgcttcctagtgacgcaggcggc

SEQ ID NO: 47633 - DNA, 25 bp, Homo sapien
gcttcgctccttgttggggattcgg

SEQ ID NO: 47634 - DNA, 25 bp, Homo sapien
gtaacgtcctgacgctccgcaggga

SEQ ID NO: 47635 - DNA, 25 bp, Homo sapien
accttcaggcctccaggtacgggcg

SEQ ID NO: 47636 - DNA, 25 bp, Homo sapien
cgcttctagctcgtaccggagccga

SEQ ID NO: 47637 - DNA, 25 bp, Homo sapien
ggagccgagcttccttcagggcact

SEQ ID NO: 47638 - DNA, 25 bp, Homo sapien
ccttcagggcactttcaatataatg

SEQ ID NO: 47639 - DNA, 25 bp, Homo sapien
tgaatttagccatctattactgcgg

SEQ ID NO: 47640 - DNA, 25 bp, Homo sapien
tattactgcggctagttactgtccc

SEQ ID NO: 47641 - DNA, 25 bp, Homo sapien
gaccagactctggacctgcctcgtg

SEQ ID NO: 47642 - DNA, 25 bp, Homo sapien
gacgcccagtaaacacgggaggagc

SEQ ID NO: 47643 - DNA, 25 bp, Homo sapien
ttcggcaggaccctgactgagttga

SEQ ID NO: 47644 - DNA, 25 bp, Homo sapien
gcggttcccagacgctgccgggtaa

SEQ ID NO: 47645 - DNA, 25 bp, Homo sapien
agagctcctccgcagggagcattcc

SEQ ID NO: 47646 - DNA, 25 bp, Homo sapien
cagcttctgttctcacttgtggagc

SEQ ID NO: 47647 - DNA, 25 bp, Homo sapien
ttctcacttgtggagctttgtctcc

SEQ ID NO: 47648 - DNA, 25 bp, Homo sapien
agacgctgccgggtaactgatgccg

SEQ ID NO: 47649 - DNA, 25 bp, Homo sapien
atgccgccggcacagcttctgttct

SEQ ID NO: 47650 - DNA, 25 bp, Homo sapien
aaggagaggaacgccggcccactag

SEQ ID NO: 47651 - DNA, 25 bp, Homo sapien
ccgggtaactgatgccgccggcaca

SEQ ID NO: 47652 - DNA, 25 bp, Homo sapien
gtcctgtcctcccaaacgtcgagtg

SEQ ID NO: 47653 - DNA, 25 bp, Homo sapien
caaacgtcgagtgaaaaacgaagcg

SEQ ID NO: 47654 - DNA, 25 bp, Homo sapien
aaacgaagcgggttctgcggcctcg

SEQ ID NO: 47655 - DNA, 25 bp, Homo sapien
ccacgaaggctctggcggacccaga

SEQ ID NO: 47656 - DNA, 25 bp, Homo sapien
ggcagtggcttttctggccagagca

SEQ ID NO: 47657 - DNA, 25 bp, Homo sapien
gtctgggagccaccctgcggcagtc

SEQ ID NO: 47658 - DNA, 25 bp, Homo sapien
gtcgggcccaggcttgcaacgcgca

SEQ ID NO: 47659 - DNA, 25 bp, Homo sapien
cggacccagatctcgggtcgccgga

SEQ ID NO: 47660 - DNA, 25 bp, Homo sapien
aaacatccgtgacgctgggctgacc

SEQ ID NO: 47661 - DNA, 25 bp, Homo sapien
aggcgcagccgttttcaaattttca

SEQ ID NO: 47662 - DNA, 25 bp, Homo sapien
gcggtcggctcacactcgagcagta

SEQ ID NO: 47663 - DNA, 25 bp, Homo sapien
ggagccggacacagaacgcgcaaaa

SEQ ID NO: 47664 - DNA, 25 bp, Homo sapien
gcgcaaaacgccgtgtaggcctgga

SEQ ID NO: 47665 - DNA, 25 bp, Homo sapien
ttccgccgggagcacaaagcaacgg

SEQ ID NO: 47666 - DNA, 25 bp, Homo sapien
tctgcccgcgaaaactctgagctgg

SEQ ID NO: 47667 - DNA, 25 bp, Homo sapien
aagccacgaagaagtgctgcctgcc

SEQ ID NO: 47668 - DNA, 25 bp, Homo sapien
agaatcaccaatggctgcccagaga

SEQ ID NO: 47669 - DNA, 25 bp, Homo sapien
ctcgtcattgagagacccgaaagcg

SEQ ID NO: 47670 - DNA, 25 bp, Homo sapien
cccgtctgtgttctcgtcattgaga

SEQ ID NO: 47671 - DNA, 25 bp, Homo sapien
gctatggtcttctgcacgtctgtgg

SEQ ID NO: 47672 - DNA, 25 bp, Homo sapien
cccggctatggtcttctgcacgtct

SEQ ID NO: 47673 - DNA, 25 bp, Homo sapien
agagaagagcgcgtagagcaggccc

SEQ ID NO: 47674 - DNA, 25 bp, Homo sapien
gtcagcagaatcaccaatggctgcc

SEQ ID NO: 47675 - DNA, 25 bp, Homo sapien
tctgcccggctatggtcttctgcac

SEQ ID NO: 47676 - DNA, 25 bp, Homo sapien
ctcttgtggaagtcgcggaattact

SEQ ID NO: 47677 - DNA, 25 bp, Homo sapien
tgcaggcggaacttgcagcactgtg

SEQ ID NO: 47678 - DNA, 25 bp, Homo sapien
agcactgtgggcgtcttttccagag

SEQ ID NO: 47679 - DNA, 25 bp, Homo sapien
tcttcagccctcacgctcttgtgga

SEQ ID NO: 47680 - DNA, 25 bp, Homo sapien
tccgctctgacgttgcgcctggtga

SEQ ID NO: 47681 - DNA, 25 bp, Homo sapien
taaggcaaggcccagccacttcgca

SEQ ID NO: 47682 - DNA, 25 bp, Homo sapien
gaggttcagaccctccgctctgacg

SEQ ID NO: 47683 - DNA, 25 bp, Homo sapien
tcttttccagagaaggacggagttg

SEQ ID NO: 47684 - DNA, 25 bp, Homo sapien
tccgtggcgtcttcgagtcggtgct

SEQ ID NO: 47685 - DNA, 25 bp, Homo sapien
gcctccacagtgaggcacggctctg

SEQ ID NO: 47686 - DNA, 25 bp, Homo sapien
cgggccaagcctcagggtcacatct

SEQ ID NO: 47687 - DNA, 25 bp, Homo sapien
tcagcacagagcctccacagtgagg

SEQ ID NO: 47688 - DNA, 25 bp, Homo sapien
atgccgaggccgtcagcacagagcc

SEQ ID NO: 47689 - DNA, 25 bp, Homo sapien
ctcgtttatgccgaggccgtcagca

SEQ ID NO: 47690 - DNA, 25 bp, Homo sapien
cctgtgctccgtggcgtcttcgagt

SEQ ID NO: 47691 - DNA, 25 bp, Homo sapien
cttcttggcttcctgtgctccgtgg

SEQ ID NO: 47692 - DNA, 25 bp, Homo sapien
tgtgcacgtgtcctgcttccaggca

SEQ ID NO: 47693 - DNA, 25 bp, Homo sapien
ccgtcttctgcacgcggccgtggaa

SEQ ID NO: 47694 - DNA, 25 bp, Homo sapien
tgctgacgccactcagaggcttgtg

SEQ ID NO: 47695 - DNA, 25 bp, Homo sapien
tggcgcccttgttcactgctgacgc

SEQ ID NO: 47696 - DNA, 25 bp, Homo sapien
gccagtcggtcaagcccttctagga

SEQ ID NO: 47697 - DNA, 25 bp, Homo sapien
gaattcccggcatccggcatccaga

SEQ ID NO: 47698 - DNA, 25 bp, Homo sapien
ctgcttgtgccgtgttgaattcccg

SEQ ID NO: 47699 - DNA, 25 bp, Homo sapien
ctccgaatcgcagtcagagtcgttc

SEQ ID NO: 47700 - DNA, 25 bp, Homo sapien
cttcctctgtgaccacaggtgcgtg

SEQ ID NO: 47701 - DNA, 25 bp, Homo sapien
agctgtcttcctctgtgaccacagg

SEQ ID NO: 47702 - DNA, 25 bp, Homo sapien
ccaggactacggagctgtcttcctc

SEQ ID NO: 47703 - DNA, 25 bp, Homo sapien
gcaccgccaggactacggagctgtc

SEQ ID NO: 47704 - DNA, 25 bp, Homo sapien
tcgggcgagtgatccggcaccgcca

SEQ ID NO: 47705 - DNA, 25 bp, Homo sapien
tgaaccaggccatcgggcgagtgat

SEQ ID NO: 47706 - DNA, 25 bp, Homo sapien
agcaggcgtccagggctgtgaacca

SEQ ID NO: 47707 - DNA, 25 bp, Homo sapien
ttcctctctgggcaggagtggtacc

SEQ ID NO: 47708 - DNA, 25 bp, Homo sapien
ttctgcttggagcacgcatcgtgtc

SEQ ID NO: 47709 - DNA, 25 bp, Homo sapien
tgtacgcggagtggcagaaacaccc

SEQ ID NO: 47710 - DNA, 25 bp, Homo sapien
ccaggcacctttgtgcagcggccgt

SEQ ID NO: 47711 - DNA, 25 bp, Homo sapien
ctgctccagcaaggaccatgagggc

SEQ ID NO: 47712 - DNA, 25 bp, Homo sapien
cgcgccactacacgcagttctggaa

SEQ ID NO: 47713 - DNA, 25 bp, Homo sapien
gttctggaactacctagagcgctgc

SEQ ID NO: 47714 - DNA, 25 bp, Homo sapien
gcttcttcgcgcacgctggtttctg

SEQ ID NO: 47715 - DNA, 25 bp, Homo sapien
gctactgcaacgtcctctgcgggga

SEQ ID NO: 47716 - DNA, 25 bp, Homo sapien
gcagccaaagctggctcctgtcaca

SEQ ID NO: 47717 - DNA, 25 bp, Homo sapien
ccctctctcagcatggacgaggaga

SEQ ID NO: 47718 - DNA, 25 bp, Homo sapien
cggctgctcctggagtgcacctgga

SEQ ID NO: 47719 - DNA, 25 bp, Homo sapien
ggaacgactgcgaaggaagaacctg

SEQ ID NO: 47720 - DNA, 25 bp, Homo sapien
ccggcctcagggaatgagctgaacc

SEQ ID NO: 47721 - DNA, 25 bp, Homo sapien
gcggccctggccagacagaagagac

SEQ ID NO: 47722 - DNA, 25 bp, Homo sapien
ggaatgagctgaaccgcgtcccagc

SEQ ID NO: 47723 - DNA, 25 bp, Homo sapien
gggctcagctggcttctcttcttgc

SEQ ID NO: 47724 - DNA, 25 bp, Homo sapien
tgccatctccgtgctcctcagattc

SEQ ID NO: 47725 - DNA, 25 bp, Homo sapien
tgcctccgcaggtttgggccgacac

SEQ ID NO: 47726 - DNA, 25 bp, Homo sapien
ctccgcaggtttgggccgacacgcg

SEQ ID NO: 47727 - DNA, 25 bp, Homo sapien
tcccgcggccacagcactgccatcc

SEQ ID NO: 47728 - DNA, 25 bp, Homo sapien
tcctcagattcccagggtcctacgg

SEQ ID NO: 47729 - DNA, 25 bp, Homo sapien
gtcccgcagccatcgggttcccagg

SEQ ID NO: 47730 - DNA, 25 bp, Homo sapien
gattcccagggtcctacggccacag

SEQ ID NO: 47731 - DNA, 25 bp, Homo sapien
tacggccacagcactgccatctccg

SEQ ID NO: 47732 - DNA, 25 bp, Homo sapien
tgtgcccagagtcctgccgtttcct

SEQ ID NO: 47733 - DNA, 25 bp, Homo sapien
gccgtttccttctagcgcgcgttct

SEQ ID NO: 47734 - DNA, 25 bp, Homo sapien
cgcgcgttctttactggcgccattc

SEQ ID NO: 47735 - DNA, 25 bp, Homo sapien
ggccctttctcttccaggcatctgt

SEQ ID NO: 47736 - DNA, 25 bp, Homo sapien
tggcgccattcctgctgctaagagc

SEQ ID NO: 47737 - DNA, 25 bp, Homo sapien
cttcagccgccagcgtgtgctgtga

SEQ ID NO: 47738 - DNA, 25 bp, Homo sapien
ccgttcgaatggcaggtgaagcgct

SEQ ID NO: 47739 - DNA, 25 bp, Homo sapien
atctgtcccttgcatcccaacggga

SEQ ID NO: 47740 - DNA, 25 bp, Homo sapien
gttaaagagtaacctgctgccggga

SEQ ID NO: 47741 - DNA, 25 bp, Homo sapien
ctcttcttgaaagctgggcgggttg

SEQ ID NO: 47742 - DNA, 25 bp, Homo sapien
ccacccagcctggtgttacataagg

SEQ ID NO: 47743 - DNA, 25 bp, Homo sapien
gagaaggcccgcgtctaaataaagc

SEQ ID NO: 47744 - DNA, 25 bp, Homo sapien
tgccctgaacactcaaggacctgtg

SEQ ID NO: 47745 - DNA, 25 bp, Homo sapien
cctggaaaacgtgtatgagagcatc

SEQ ID NO: 47746 - DNA, 25 bp, Homo sapien
ctgtactccagggtctgcaagccta

SEQ ID NO: 47747 - DNA, 25 bp, Homo sapien
ttctctggaaggcttggagctgtcc

SEQ ID NO: 47748 - DNA, 25 bp, Homo sapien
gcggttcctggactaagtccggctc

SEQ ID NO: 47749 - DNA, 25 bp, Homo sapien
tgccagcggttcctggactaagtcc

SEQ ID NO: 47750 - DNA, 25 bp, Homo sapien
agcctgccagcggttcctggactaa

SEQ ID NO: 47751 - DNA, 25 bp, Homo sapien
agcgccgggacctctggtgcacagc

SEQ ID NO: 47752 - DNA, 25 bp, Homo sapien
tgccggaaggtgtatggcatggagc

SEQ ID NO: 47753 - DNA, 25 bp, Homo sapien
gtcctccaggatcggagtcaccctg

SEQ ID NO: 47754 - DNA, 25 bp, Homo sapien
cagcctgccgctggaagaaagcctg

SEQ ID NO: 47755 - DNA, 25 bp, Homo sapien
ccttgtcctccaggatcggagtcac

SEQ ID NO: 47756 - DNA, 25 bp, Homo sapien
gaagtccttgtcagggcctcctggg

SEQ ID NO: 47757 - DNA, 25 bp, Homo sapien
tgatgcccacgctggcggcggacat

SEQ ID NO: 47758 - DNA, 25 bp, Homo sapien
tggagccatgcctgatgcccacgct

SEQ ID NO: 47759 - DNA, 25 bp, Homo sapien
gtgcacacaccgtggcgcctggagc

SEQ ID NO: 47760 - DNA, 25 bp, Homo sapien
gcggccagcacagtcggtgcacaca

SEQ ID NO: 47761 - DNA, 25 bp, Homo sapien
ggcgagtcttcctcatccttgtcgt

SEQ ID NO: 47762 - DNA, 25 bp, Homo sapien
ctaggagagccaggcgaagtccttg

SEQ ID NO: 47763 - DNA, 25 bp, Homo sapien
tcctcagggtcctccagatagggcc

SEQ ID NO: 47764 - DNA, 25 bp, Homo sapien
aggcgatatccgagaacatggtggc

SEQ ID NO: 47765 - DNA, 25 bp, Homo sapien
gagcttctggcggaaggcgatatcc

SEQ ID NO: 47766 - DNA, 25 bp, Homo sapien
gcttctggcggaaggcgatatccga

SEQ ID NO: 47767 - DNA, 25 bp, Homo sapien
tggtggcaaacgtgcgcgccacctc

SEQ ID NO: 47768 - DNA, 25 bp, Homo sapien
cgatatccgagaacatggtggcaaa

SEQ ID NO: 47769 - DNA, 25 bp, Homo sapien
tccgagaacatggtggcaaacgtgc

SEQ ID NO: 47770 - DNA, 25 bp, Homo sapien
gaacatggtggcaaacgtgcgcgcc

SEQ ID NO: 47771 - DNA, 25 bp, Homo sapien
gcggaaggcgatatccgagaacatg

SEQ ID NO: 47772 - DNA, 25 bp, Homo sapien
tgaattcctcctctgtgcgggtctc

SEQ ID NO: 47773 - DNA, 25 bp, Homo sapien
gctgtctctgatgcaccaaggcctc

SEQ ID NO: 47774 - DNA, 25 bp, Homo sapien
tcaccatggtgagcagctgtctctg

SEQ ID NO: 47775 - DNA, 25 bp, Homo sapien
ccactggaccgtggctcaccatggt

SEQ ID NO: 47776 - DNA, 25 bp, Homo sapien
ttccttcgttctcggcgccactgga

SEQ ID NO: 47777 - DNA, 25 bp, Homo sapien
ggagactgtgctgcgttccttcgtt

SEQ ID NO: 47778 - DNA, 25 bp, Homo sapien
ccggcctctaccctgtacctctggg

SEQ ID NO: 47779 - DNA, 25 bp, Homo sapien
tccttgaattcctcctctgtgcggg

SEQ ID NO: 47780 - DNA, 25 bp, Homo sapien
agatgccctcgccaggccttttttg

SEQ ID NO: 47781 - DNA, 25 bp, Homo sapien
aggcacaaggacagggttctccctc

SEQ ID NO: 47782 - DNA, 25 bp, Homo sapien
aacgacctgccagtgctgagctcca

SEQ ID NO: 47783 - DNA, 25 bp, Homo sapien
ggaacctgctgactctcctgcgatt

SEQ ID NO: 47784 - DNA, 25 bp, Homo sapien
tgcgattcctaaactggcagcgatg

SEQ ID NO: 47785 - DNA, 25 bp, Homo sapien
tggcagcgatgctccagagcctctt

SEQ ID NO: 47786 - DNA, 25 bp, Homo sapien
actggttgatctcacccacttgaga

SEQ ID NO: 47787 - DNA, 25 bp, Homo sapien
actcaccagcgtgtggcgcttcatg

SEQ ID NO: 47788 - DNA, 25 bp, Homo sapien
atggagatgccttcacctggcagca

SEQ ID NO: 47789 - DNA, 25 bp, Homo sapien
gtggcaggctttgtctttcgatctc

SEQ ID NO: 47790 - DNA, 25 bp, Homo sapien
ttcgatctccctagaaagttgctgg

SEQ ID NO: 47791 - DNA, 25 bp, Homo sapien
ttggcaatcccgtaggatctcggtc

SEQ ID NO: 47792 - DNA, 25 bp, Homo sapien
tctggccgcagcactgaggtcaaag

SEQ ID NO: 47793 - DNA, 25 bp, Homo sapien
tgaggtcaaagcaaacgccggctcc

SEQ ID NO: 47794 - DNA, 25 bp, Homo sapien
cacggatggggacatgttttcccgc

SEQ ID NO: 47795 - DNA, 25 bp, Homo sapien
cgcggggcgctctttctgaaaagca

SEQ ID NO: 47796 - DNA, 25 bp, Homo sapien
ccatggctgtccctagaatccttga

SEQ ID NO: 47797 - DNA, 25 bp, Homo sapien
atgcggggcttacagtctcctgtcc

SEQ ID NO: 47798 - DNA, 25 bp, Homo sapien
tccagaggccgcgtcccacatttcc

SEQ ID NO: 47799 - DNA, 25 bp, Homo sapien
ctagaatccttgactctttaaaaga

SEQ ID NO: 47800 - DNA, 25 bp, Homo sapien
gcaccgccatggctgtccctagaat

SEQ ID NO: 47801 - DNA, 25 bp, Homo sapien
taacgagctggtcagaagccgtccc

SEQ ID NO: 47802 - DNA, 25 bp, Homo sapien
ggccaccttctccagtaacgagctg

SEQ ID NO: 47803 - DNA, 25 bp, Homo sapien
ggggttacaccagcaacgctccaga

SEQ ID NO: 47804 - DNA, 25 bp, Homo sapien
gccctggaaatgctcatcgcctgca

SEQ ID NO: 47805 - DNA, 25 bp, Homo sapien
cttcagatcagcagacggcgtcaga

SEQ ID NO: 47806 - DNA, 25 bp, Homo sapien
ctcccgcacggtgttgagagactta

SEQ ID NO: 47807 - DNA, 25 bp, Homo sapien
ttcagcaatgggaggacacggctct

SEQ ID NO: 47808 - DNA, 25 bp, Homo sapien
ggggctacgccacaagctgcaatga

SEQ ID NO: 47809 - DNA, 25 bp, Homo sapien
gccctcttcagagctggcctgagtt

SEQ ID NO: 47810 - DNA, 25 bp, Homo sapien
cacatggagatggtcgcaagtcagc

SEQ ID NO: 47811 - DNA, 25 bp, Homo sapien
tccgtgagttcaacgcttcagatca

SEQ ID NO: 47812 - DNA, 25 bp, Homo sapien
ttcagctggggacatttacgtttta

SEQ ID NO: 47813 - DNA, 25 bp, Homo sapien
ttcttactcatgagcgccgcgcgca

SEQ ID NO: 47814 - DNA, 25 bp, Homo sapien
cctctgggcaggtactcgaacagca

SEQ ID NO: 47815 - DNA, 25 bp, Homo sapien
agcctcatctcatcttggcccggga

SEQ ID NO: 47816 - DNA, 25 bp, Homo sapien
gactcctgtgagaaacattccagca

SEQ ID NO: 47817 - DNA, 25 bp, Homo sapien
tcgcattcagccaacgactcctgtg

SEQ ID NO: 47818 - DNA, 25 bp, Homo sapien
cgagcccgtctctggagcacaaaga

SEQ ID NO: 47819 - DNA, 25 bp, Homo sapien
ttttaaagacaacctccgacgcatc

SEQ ID NO: 47820 - DNA, 25 bp, Homo sapien
gagttctgtactgcaccgtccttgg

SEQ ID NO: 47821 - DNA, 25 bp, Homo sapien
gacggtgaaacctgctcttccttga

SEQ ID NO: 47822 - DNA, 25 bp, Homo sapien
gcaggcttgcacgatgtccgtcatc

SEQ ID NO: 47823 - DNA, 25 bp, Homo sapien
cctggcagtagagcgtcttgaagta

SEQ ID NO: 47824 - DNA, 25 bp, Homo sapien
aggacgttcttgtgcgccttgaaga

SEQ ID NO: 47825 - DNA, 25 bp, Homo sapien
ccggtagtgggacgtgatttccata

SEQ ID NO: 47826 - DNA, 25 bp, Homo sapien
ggtgtcgcctcttctacagactctg

SEQ ID NO: 47827 - DNA, 25 bp, Homo sapien
ggctgtcatcttccacctgctgtgt

SEQ ID NO: 47828 - DNA, 25 bp, Homo sapien
gcctgagtcccggatactggtgccc

SEQ ID NO: 47829 - DNA, 25 bp, Homo sapien
agccactgcctggtggagccacagg

SEQ ID NO: 47830 - DNA, 25 bp, Homo sapien
gggcgccgctcgctttgctgccttt

SEQ ID NO: 47831 - DNA, 25 bp, Homo sapien
tcgctttgctgcctttcccgcgggt

SEQ ID NO: 47832 - DNA, 25 bp, Homo sapien
ctttcccgcgggtgcactgagcggc

SEQ ID NO: 47833 - DNA, 25 bp, Homo sapien
gcgaccgcatgcgtgtgtgctccca

SEQ ID NO: 47834 - DNA, 25 bp, Homo sapien
cgagcccagccactgcctggtggag

SEQ ID NO: 47835 - DNA, 25 bp, Homo sapien
cccagcctgagtcccggatactggt

SEQ ID NO: 47836 - DNA, 25 bp, Homo sapien
atttggacacaggtcggcacaaagc

SEQ ID NO: 47837 - DNA, 25 bp, Homo sapien
ttgtggccctttgacatggcagccc

SEQ ID NO: 47838 - DNA, 25 bp, Homo sapien
ccctttgtggccctttgacatggca

SEQ ID NO: 47839 - DNA, 25 bp, Homo sapien
cagatgtctgttgtttacgacgttc

SEQ ID NO: 47840 - DNA, 25 bp, Homo sapien
tccaggactggagggaacagatgtc

SEQ ID NO: 47841 - DNA, 25 bp, Homo sapien
cggcgggccgacaaccgaacctcag

SEQ ID NO: 47842 - DNA, 25 bp, Homo sapien
ctaatccagtatgataagtaccctt

SEQ ID NO: 47843 - DNA, 25 bp, Homo sapien
acacaggtcggcacaaagcggcagc

SEQ ID NO: 47844 - DNA, 25 bp, Homo sapien
tcccacaggggacactcacggaagc

SEQ ID NO: 47845 - DNA, 25 bp, Homo sapien
cactcacggaagctgaacggacctt

SEQ ID NO: 47846 - DNA, 25 bp, Homo sapien
caggggacactcacggaagctgaac

SEQ ID NO: 47847 - DNA, 25 bp, Homo sapien
ggacactcacggaagctgaacggac

SEQ ID NO: 47848 - DNA, 25 bp, Homo sapien
tcacggaagctgaacggaccttccc

SEQ ID NO: 47849 - DNA, 25 bp, Homo sapien
gaagctgaacggaccttcccacagg

SEQ ID NO: 47850 - DNA, 25 bp, Homo sapien
cacggaagctgaacggaccttccca

SEQ ID NO: 47851 - DNA, 25 bp, Homo sapien
cacaggggacactcacggaagctga

SEQ ID NO: 47852 - DNA, 25 bp, Homo sapien
tggaggagtcctcagtctccacatc

SEQ ID NO: 47853 - DNA, 25 bp, Homo sapien
gagacactcacggaagctgaacgga

SEQ ID NO: 47854 - DNA, 25 bp, Homo sapien
attactggatttcaccaccggccgc

SEQ ID NO: 47855 - DNA, 25 bp, Homo sapien
cccagcgatgaacctgtcaggggtc

SEQ ID NO: 47856 - DNA, 25 bp, Homo sapien
taccctgtaggccagtcaagccatc

SEQ ID NO: 47857 - DNA, 25 bp, Homo sapien
gtcatccggacccacaaggagtctc

SEQ ID NO: 47858 - DNA, 25 bp, Homo sapien
gaagcacccgtctgtgtgaggcagc

SEQ ID NO: 47859 - DNA, 25 bp, Homo sapien
agcagccgcctgagcagtgaggaaa

SEQ ID NO: 47860 - DNA, 25 bp, Homo sapien
acgcccagcgcgtccagtcctcatg

SEQ ID NO: 47861 - DNA, 25 bp, Homo sapien
gcactaaaggtgcagactcggtgga

SEQ ID NO: 47862 - DNA, 25 bp, Homo sapien
agaggcactcaaggggctctccacg

SEQ ID NO: 47863 - DNA, 25 bp, Homo sapien
tcaaggggctctccacgttcgcctt

SEQ ID NO: 47864 - DNA, 25 bp, Homo sapien
cagcgcctggggcacttcgccatgg

SEQ ID NO: 47865 - DNA, 25 bp, Homo sapien
cttggccgaagtgggcactaaaggt

SEQ ID NO: 47866 - DNA, 25 bp, Homo sapien
aaaggtgcagactcggtggagccaa

SEQ ID NO: 47867 - DNA, 25 bp, Homo sapien
gcacttcgccatgggcttggccgaa

SEQ ID NO: 47868 - DNA, 25 bp, Homo sapien
tcccgcagttccgactcttggcaaa

SEQ ID NO: 47869 - DNA, 25 bp, Homo sapien
ggccgcgcgctaaacacgtttctaa

SEQ ID NO: 47870 - DNA, 25 bp, Homo sapien
tgctgatcacaatcttgccaccgta

SEQ ID NO: 47871 - DNA, 25 bp, Homo sapien
cttcgctgtcagaaaatatccgttc

SEQ ID NO: 47872 - DNA, 25 bp, Homo sapien
ggctcctcggtccagccctattgtg

SEQ ID NO: 47873 - DNA, 25 bp, Homo sapien
gccctattgtgtgtgcttcgttaaa

SEQ ID NO: 47874 - DNA, 25 bp, Homo sapien
agccctccctctggcgcagagaatt

SEQ ID NO: 47875 - DNA, 25 bp, Homo sapien
cccgcgaaactgacatgtctattta

SEQ ID NO: 47876 - DNA, 25 bp, Homo sapien
gcgaagcatggtccgcagcacgtta

SEQ ID NO: 47877 - DNA, 25 bp, Homo sapien
aagccatctaggtcgcggtgcgcac

SEQ ID NO: 47878 - DNA, 25 bp, Homo sapien
aggtggccgtctcgttcaggacgat

SEQ ID NO: 47879 - DNA, 25 bp, Homo sapien
aagagcatggccatgagcaggtcca

SEQ ID NO: 47880 - DNA, 25 bp, Homo sapien
tggcctgcgccaggaagccatctag

SEQ ID NO: 47881 - DNA, 25 bp, Homo sapien
gcatcggtgaagagcatggccatga

SEQ ID NO: 47882 - DNA, 25 bp, Homo sapien
cagcacgttatccagggaggtggcc

SEQ ID NO: 47883 - DNA, 25 bp, Homo sapien
agttgggctcattgttgtcagggtc

SEQ ID NO: 47884 - DNA, 25 bp, Homo sapien
gtctccaccactcggcgcccggact

SEQ ID NO: 47885 - DNA, 25 bp, Homo sapien
cagtggggctcgcttttggctgact

SEQ ID NO: 47886 - DNA, 25 bp, Homo sapien
cgcgcgtctcgcaaacttggcgact

SEQ ID NO: 47887 - DNA, 25 bp, Homo sapien
acgcgcggttgcactgcgcgcgtct

SEQ ID NO: 47888 - DNA, 25 bp, Homo sapien
ctcgcttttggctgactaggggcac

SEQ ID NO: 47889 - DNA, 25 bp, Homo sapien
tccctcccgtcgtgttgtctgcggg

SEQ ID NO: 47890 - DNA, 25 bp, Homo sapien
cgcaggggtaaaggccacctcgctt

SEQ ID NO: 47891 - DNA, 25 bp, Homo sapien
gcctgcgcaggggtaaaggccacct

SEQ ID NO: 47892 - DNA, 25 bp, Homo sapien
ctcgtcatctgctgcgaaggcaacg

SEQ ID NO: 47893 - DNA, 25 bp, Homo sapien
ctatgttcatggaccgccgccagca

SEQ ID NO: 47894 - DNA, 25 bp, Homo sapien
tgacggcaacgagatcgacactatg

SEQ ID NO: 47895 - DNA, 25 bp, Homo sapien
agcacgacgccaacgccatggacgt

SEQ ID NO: 47896 - DNA, 25 bp, Homo sapien
accttcgacgaccttgtgccgctgg

SEQ ID NO: 47897 - DNA, 25 bp, Homo sapien
cgcaggatgacgtggtcagcacttc

SEQ ID NO: 47898 - DNA, 25 bp, Homo sapien
gcttctacgagatgggctgtctgtc

SEQ ID NO: 47899 - DNA, 25 bp, Homo sapien
ttcaacctcaacgtggccgagcagc

SEQ ID NO: 47900 - DNA, 25 bp, Homo sapien
agcgccatgttggacggtcctccca

SEQ ID NO: 47901 - DNA, 25 bp, Homo sapien
gctactctgaccgttctacctgtga

SEQ ID NO: 47902 - DNA, 25 bp, Homo sapien
acctgtgattctcgctggtggagtc

SEQ ID NO: 47903 - DNA, 25 bp, Homo sapien
tagccgtcgcatcgcggattacgaa

SEQ ID NO: 47904 - DNA, 25 bp, Homo sapien
gtctgcgactctctgtcctctcggt

SEQ ID NO: 47905 - DNA, 25 bp, Homo sapien
cggcactctcattggatatcactgg

SEQ ID NO: 47906 - DNA, 25 bp, Homo sapien
tcgcccgcagtttcggcctatcagg

SEQ ID NO: 47907 - DNA, 25 bp, Homo sapien
gggccactgacctcgaagcttatga

SEQ ID NO: 47908 - DNA, 25 bp, Homo sapien
tccagagtggaagcgtttctgccgg

SEQ ID NO: 47909 - DNA, 25 bp, Homo sapien
gtggaagcgtttctgccgggaaggc

SEQ ID NO: 47910 - DNA, 25 bp, Homo sapien
gttccagagtggaagcgtttctgcc

SEQ ID NO: 47911 - DNA, 25 bp, Homo sapien
gacggttccagagtggaagcgtttc

SEQ ID NO: 47912 - DNA, 25 bp, Homo sapien
ctgacggttccagagtggaagcgtt

SEQ ID NO: 47913 - DNA, 25 bp, Homo sapien
caactgacggttccagagtggaagc

SEQ ID NO: 47914 - DNA, 25 bp, Homo sapien
tgtcaactgacggttccagagtgga

SEQ ID NO: 47915 - DNA, 25 bp, Homo sapien
cgatggtttctggtgggaaggccca

SEQ ID NO: 47916 - DNA, 25 bp, Homo sapien
ctgcgcttctctttctgcgcggttc

SEQ ID NO: 47917 - DNA, 25 bp, Homo sapien
gcgctgagtaaactcacctgcaaga

SEQ ID NO: 47918 - DNA, 25 bp, Homo sapien
tcagtcttacttaaagcgctgagta

SEQ ID NO: 47919 - DNA, 25 bp, Homo sapien
gaacgattacgttttctcagtctta

SEQ ID NO: 47920 - DNA, 25 bp, Homo sapien
ctccctgttcagttctttgatgaga

SEQ ID NO: 47921 - DNA, 25 bp, Homo sapien
tgagcaaatgtcagtcccaggacgg

SEQ ID NO: 47922 - DNA, 25 bp, Homo sapien
tctcggcgctccagggttgagcaaa

SEQ ID NO: 47923 - DNA, 25 bp, Homo sapien
acctgcggccacctgaagactggga

SEQ ID NO: 47924 - DNA, 25 bp, Homo sapien
acacgtgaagtgctcgaatgcctga

SEQ ID NO: 47925 - DNA, 25 bp, Homo sapien
cgatcaggacaccaccaatgcgttc

SEQ ID NO: 47926 - DNA, 25 bp, Homo sapien
agggcaaatggttctccgcagcatg

SEQ ID NO: 47927 - DNA, 25 bp, Homo sapien
atgcctgagtcctggcagtcctacc

SEQ ID NO: 47928 - DNA, 25 bp, Homo sapien
gcatgcggtctcatctcagcctgaa

SEQ ID NO: 47929 - DNA, 25 bp, Homo sapien
tcagcctgaaagtgcggggaatttc

SEQ ID NO: 47930 - DNA, 25 bp, Homo sapien
ccagatgctgcctgagtgacggtta

SEQ ID NO: 47931 - DNA, 25 bp, Homo sapien
acggttattcagcagacgagccctc

SEQ ID NO: 47932 - DNA, 25 bp, Homo sapien
cacggaagaggacgcacccggctgt

SEQ ID NO: 47933 - DNA, 25 bp, Homo sapien
gaagaggacgcacccggctgtgtgc

SEQ ID NO: 47934 - DNA, 25 bp, Homo sapien
aagaggacgcacccggctgtgtgca

SEQ ID NO: 47935 - DNA, 25 bp, Homo sapien
ctgtgtggacatgtgcccagggccc

SEQ ID NO: 47936 - DNA, 25 bp, Homo sapien
aggacgcacccggctgtgtggacat

SEQ ID NO: 47937 - DNA, 25 bp, Homo sapien
gccacggaagaggacgcacaggaca

SEQ ID NO: 47938 - DNA, 25 bp, Homo sapien
gacgcacccggctgtgtggacatgt

SEQ ID NO: 47939 - DNA, 25 bp, Homo sapien
cacggaagaggacgcacaggacagc

SEQ ID NO: 47940 - DNA, 25 bp, Homo sapien
ccggcactctgtgctctgtgtctgc

SEQ ID NO: 47941 - DNA, 25 bp, Homo sapien
gccgaggtcatagagtggctgccct

SEQ ID NO: 47942 - DNA, 25 bp, Homo sapien
ccaacgtctggtggggatgcccgcc

SEQ ID NO: 47943 - DNA, 25 bp, Homo sapien
gctctcgtccgccaacgtctggtgg

SEQ ID NO: 47944 - DNA, 25 bp, Homo sapien
gctggcgtcagcagggctctcgtcc

SEQ ID NO: 47945 - DNA, 25 bp, Homo sapien
aacaggtagtcctgcgtcggaccgg

SEQ ID NO: 47946 - DNA, 25 bp, Homo sapien
gccatttcagaagctcagcgtccct

SEQ ID NO: 47947 - DNA, 25 bp, Homo sapien
tgtctgcccgggaacaggtagtcct

SEQ ID NO: 47948 - DNA, 25 bp, Homo sapien
atctacgacaagtacggctcgctgg

SEQ ID NO: 47949 - DNA, 25 bp, Homo sapien
acgtgaacacctacttcgtgctgtc

SEQ ID NO: 47950 - DNA, 25 bp, Homo sapien
caggacatggttttggtttgcagga

SEQ ID NO: 47951 - DNA, 25 bp, Homo sapien
tgcaggaagcttgccttgaaatatc

SEQ ID NO: 47952 - DNA, 25 bp, Homo sapien
gccgcggacaagtttaaggagatca

SEQ ID NO: 47953 - DNA, 25 bp, Homo sapien
ggagatcaacaacgcgcacgccatc

SEQ ID NO: 47954 - DNA, 25 bp, Homo sapien
cggacgccacaaaaaggaacatcta

SEQ ID NO: 47955 - DNA, 25 bp, Homo sapien
gggtctctacgtggccgagcagttt

SEQ ID NO: 47956 - DNA, 25 bp, Homo sapien
cagtgccctgtgtgcttgcttttca

SEQ ID NO: 47957 - DNA, 25 bp, Homo sapien
ttgcttttcagaggccacagacacg

SEQ ID NO: 47958 - DNA, 25 bp, Homo sapien
ggtgcccgaaagtcgctccacagga

SEQ ID NO: 47959 - DNA, 25 bp, Homo sapien
tctcccggtggagagtttgtccagg

SEQ ID NO: 47960 - DNA, 25 bp, Homo sapien
tggaggtcagcgagtagcctctccc

SEQ ID NO: 47961 - DNA, 25 bp, Homo sapien
tgacccaaggcgacggaggaaagcc

SEQ ID NO: 47962 - DNA, 25 bp, Homo sapien
tgacctgcggtagccgtagatccca

SEQ ID NO: 47963 - DNA, 25 bp, Homo sapien
agacacgccgatcgtcatacagccg

SEQ ID NO: 47964 - DNA, 25 bp, Homo sapien
attcagttatctgggcctctccggg

SEQ ID NO: 47965 - DNA, 25 bp, Homo sapien
tggacttccacgcagaaagacactg

SEQ ID NO: 47966 - DNA, 25 bp, Homo sapien
cgccacgcttttggccgtggacttc

SEQ ID NO: 47967 - DNA, 25 bp, Homo sapien
caggacctaagggaacccacgcttg

SEQ ID NO: 47968 - DNA, 25 bp, Homo sapien
ccgggatccggcataatcgaggtgc

SEQ ID NO: 47969 - DNA, 25 bp, Homo sapien
tcttcctcagtaaaccacggcggcg

SEQ ID NO: 47970 - DNA, 25 bp, Homo sapien
gaacgccaggaagggaccacttcta

SEQ ID NO: 47971 - DNA, 25 bp, Homo sapien
aggcgctgcggcaaaactctccgtc

SEQ ID NO: 47972 - DNA, 25 bp, Homo sapien
aggctcccaaaagctcggcgctcgg

SEQ ID NO: 47973 - DNA, 25 bp, Homo sapien
ctgcatcagctgttcaaacctggta

SEQ ID NO: 47974 - DNA, 25 bp, Homo sapien
ccctaatgaaaccaagcgcgcggtg

SEQ ID NO: 47975 - DNA, 25 bp, Homo sapien
accgcacggctgcagatggaacacg

SEQ ID NO: 47976 - DNA, 25 bp, Homo sapien
ctgggtcctaatgccgctcagacgc

SEQ ID NO: 47977 - DNA, 25 bp, Homo sapien
ttctgggaaaacgttcgactgcgcc

SEQ ID NO: 47978 - DNA, 25 bp, Homo sapien
ctgctgggccaaaccgagtagaccc

SEQ ID NO: 47979 - DNA, 25 bp, Homo sapien
tagacccggctccttcgagcctgtg

SEQ ID NO: 47980 - DNA, 25 bp, Homo sapien
tccatgaggatcacgtggtcatcgc

SEQ ID NO: 47981 - DNA, 25 bp, Homo sapien
tctccttgtccctgtggggccaaca

SEQ ID NO: 47982 - DNA, 25 bp, Homo sapien
gcgcagaatggacacaccggtgatc

SEQ ID NO: 47983 - DNA, 25 bp, Homo sapien
tgccgatgcgcacgtctttgcacac

SEQ ID NO: 47984 - DNA, 25 bp, Homo sapien
tacgggctacgaacctgaaagggca

SEQ ID NO: 47985 - DNA, 25 bp, Homo sapien
gaactcgtcgcgactggtctccttg

SEQ ID NO: 47986 - DNA, 25 bp, Homo sapien
tggtcatcgctgatgtccttgggca

SEQ ID NO: 47987 - DNA, 25 bp, Homo sapien
tgagcagccgcatcagtctcttgga

SEQ ID NO: 47988 - DNA, 25 bp, Homo sapien
cagccgccgtaccaggcggatgtcg

SEQ ID NO: 47989 - DNA, 25 bp, Homo sapien
ttgatgacaccctcgatgtcccggc

SEQ ID NO: 47990 - DNA, 25 bp, Homo sapien
acttgttgtactgcttgatgacacc

SEQ ID NO: 47991 - DNA, 25 bp, Homo sapien
cgaaggagggcttgacaaacttgtt

SEQ ID NO: 47992 - DNA, 25 bp, Homo sapien
ctcacctctggggaccacgatgtct

SEQ ID NO: 47993 - DNA, 25 bp, Homo sapien
tgcacaatcaggtcgatggccaccg

SEQ ID NO: 47994 - DNA, 25 bp, Homo sapien
tggctgtgcacgtgctgcacaatca

SEQ ID NO: 47995 - DNA, 25 bp, Homo sapien
gaccacgatgtctgccaggcgcatg

SEQ ID NO: 47996 - DNA, 25 bp, Homo sapien
ggtctcgcttttctcagcctgccgg

SEQ ID NO: 47997 - DNA, 25 bp, Homo sapien
tgccacgcgcgtgcgaggcaatccg

SEQ ID NO: 47998 - DNA, 25 bp, Homo sapien
aggcaatccgaaggcaccgtgcgcc

SEQ ID NO: 47999 - DNA, 25 bp, Homo sapien
gagccgacaacatagaccaactcgc

SEQ ID NO: 48000 - DNA, 25 bp, Homo sapien
ctgtttttcaccacaaactgagccg

SEQ ID NO: 48001 - DNA, 25 bp, Homo sapien
tcgcacgcggtctcgcttttctcag

SEQ ID NO: 48002 - DNA, 25 bp, Homo sapien
ccgcagaggctcgaaggtgccacgc

SEQ ID NO: 48003 - DNA, 25 bp, Homo sapien
actcgcacagtcgagcaggcacaca

SEQ ID NO: 48004 - DNA, 25 bp, Homo sapien
agccttggatcggtacgtcttgcca

SEQ ID NO: 48005 - DNA, 25 bp, Homo sapien
aaacacacgcgttgggcggtacatg

SEQ ID NO: 48006 - DNA, 25 bp, Homo sapien
ggtcctcagcctcaggggacttgtc

SEQ ID NO: 48007 - DNA, 25 bp, Homo sapien
cctccgctatctcctgcaggtggaa

SEQ ID NO: 48008 - DNA, 25 bp, Homo sapien
aggtcatccttcatgcgccgcttgg

SEQ ID NO: 48009 - DNA, 25 bp, Homo sapien
gtctcgggcacaaggtcatccttca

SEQ ID NO: 48010 - DNA, 25 bp, Homo sapien
gttggcacccaaggcacacggaaca

SEQ ID NO: 48011 - DNA, 25 bp, Homo sapien
cggtacatggacaaatacagttggc

SEQ ID NO: 48012 - DNA, 25 bp, Homo sapien
ctgggtgtctaaactccgcctctcg

SEQ ID NO: 48013 - DNA, 25 bp, Homo sapien
gaagtttcccaactcgccgagagca

SEQ ID NO: 48014 - DNA, 25 bp, Homo sapien
tgctgccttctcttgcgtttgtttt

SEQ ID NO: 48015 - DNA, 25 bp, Homo sapien
ccctctcgggatggaaaatgaattt

SEQ ID NO: 48016 - DNA, 25 bp, Homo sapien
tgaatttcgagcatcgctgcggagc

SEQ ID NO: 48017 - DNA, 25 bp, Homo sapien
tgcggagcctgccaagtaattggaa

SEQ ID NO: 48018 - DNA, 25 bp, Homo sapien
cggttttcatgtcccggtttggctg

SEQ ID NO: 48019 - DNA, 25 bp, Homo sapien
gctggttgcggcgaagtttcccaac

SEQ ID NO: 48020 - DNA, 25 bp, Homo sapien
cctcccacctttgacagttttactg

SEQ ID NO: 48021 - DNA, 25 bp, Homo sapien
tgaggcgacctgattccgccgcatc

SEQ ID NO: 48022 - DNA, 25 bp, Homo sapien
gcgaactctcgcgttattcccgcgg

SEQ ID NO: 48023 - DNA, 25 bp, Homo sapien
ccagagtagccggttctgccgtcct

SEQ ID NO: 48024 - DNA, 25 bp, Homo sapien
aaactgaggcccgataggggcgcta

SEQ ID NO: 48025 - DNA, 25 bp, Homo sapien
tctgggctcgggaccctgacctctg

SEQ ID NO: 48026 - DNA, 25 bp, Homo sapien
cagtgaaccaaaatggcgacttttt

SEQ ID NO: 48027 - DNA, 25 bp, Homo sapien
cgcacggattgaggcgacctgattc

SEQ ID NO: 48028 - DNA, 25 bp, Homo sapien
agacgccctctcctcgcagacccag

SEQ ID NO: 48029 - DNA, 25 bp, Homo sapien
cgtgtcgggcgttgtgtccagcact

SEQ ID NO: 48030 - DNA, 25 bp, Homo sapien
cccttccagcgtgtcgggcgttgtg

SEQ ID NO: 48031 - DNA, 25 bp, Homo sapien
gggaccgcccacaggcgtgacttga

SEQ ID NO: 48032 - DNA, 25 bp, Homo sapien
ggaccgcccacaggcgtgacttgag

SEQ ID NO: 48033 - DNA, 25 bp, Homo sapien
cgcccacaggcgtgacttgagccct

SEQ ID NO: 48034 - DNA, 25 bp, Homo sapien
tcacgcgctgtctgggccgtccctt

SEQ ID NO: 48035 - DNA, 25 bp, Homo sapien
gcgttgtgtccagcactggggaccg

SEQ ID NO: 48036 - DNA, 25 bp, Homo sapien
tgcgtgcaccaaggctgtccgccag

SEQ ID NO: 48037 - DNA, 25 bp, Homo sapien
cccaacgtcaggattccagaaggaa

SEQ ID NO: 48038 - DNA, 25 bp, Homo sapien
cgcaggaaaaggtgacccgagcgta

SEQ ID NO: 48039 - DNA, 25 bp, Homo sapien
ctgcactcccggagggagttccgtc

SEQ ID NO: 48040 - DNA, 25 bp, Homo sapien
acctcagctcggtgaacatggggcc

SEQ ID NO: 48041 - DNA, 25 bp, Homo sapien
ctcagcttggacctcagctcggtga

SEQ ID NO: 48042 - DNA, 25 bp, Homo sapien
ctaaagcaggacaaaggctacggga

SEQ ID NO: 48043 - DNA, 25 bp, Homo sapien
cgagcgtagtgccagcctggacaca

SEQ ID NO: 48044 - DNA, 25 bp, Homo sapien
tttgctacggagtgcatcggacgtc

SEQ ID NO: 48045 - DNA, 25 bp, Homo sapien
atcggacgtcgaagcctagagtctc

SEQ ID NO: 48046 - DNA, 25 bp, Homo sapien
ctttccttcctagccttggtcgtcg

SEQ ID NO: 48047 - DNA, 25 bp, Homo sapien
cagtctgaaagacgcttggtggatc

SEQ ID NO: 48048 - DNA, 25 bp, Homo sapien
agagtctctgcgtctttccctcttc

SEQ ID NO: 48049 - DNA, 25 bp, Homo sapien
gacgacggcgacactttgctacgga

SEQ ID NO: 48050 - DNA, 25 bp, Homo sapien
cggaagtcgtcgaaccaggacgtcg

SEQ ID NO: 48051 - DNA, 25 bp, Homo sapien
tctatggccgcgcagtctgaaagac

SEQ ID NO: 48052 - DNA, 25 bp, Homo sapien
gtgattcacactggtgcgctggccg

SEQ ID NO: 48053 - DNA, 25 bp, Homo sapien
actcactggggacgcgtgtgattca

SEQ ID NO: 48054 - DNA, 25 bp, Homo sapien
tgtgattcacactggtgcgctggcc

SEQ ID NO: 48055 - DNA, 25 bp, Homo sapien
gggacgcatgtgattcacactggtg

SEQ ID NO: 48056 - DNA, 25 bp, Homo sapien
gtcagagactcactggggacgcatg

SEQ ID NO: 48057 - DNA, 25 bp, Homo sapien
atgtgattcacactggtgcgctggc

SEQ ID NO: 48058 - DNA, 25 bp, Homo sapien
actggggacgcgtgtgattcacact

SEQ ID NO: 48059 - DNA, 25 bp, Homo sapien
cactggggacgcatgtgattcacac

SEQ ID NO: 48060 - DNA, 25 bp, Homo sapien
gtccctgagtgcacccagagccaga

SEQ ID NO: 48061 - DNA, 25 bp, Homo sapien
ctgtagacttgttggtgacctcggc

SEQ ID NO: 48062 - DNA, 25 bp, Homo sapien
tccacgcgccgaaggcctcaataaa

SEQ ID NO: 48063 - DNA, 25 bp, Homo sapien
ctgtccatctcgtccctgggtcgga

SEQ ID NO: 48064 - DNA, 25 bp, Homo sapien
gctccacggccctaggctgaagtcg

SEQ ID NO: 48065 - DNA, 25 bp, Homo sapien
gtcgccacctgctgggagaagctct

SEQ ID NO: 48066 - DNA, 25 bp, Homo sapien
agacgcgcctcgttctgtagacttg

SEQ ID NO: 48067 - DNA, 25 bp, Homo sapien
tcctgtggcgcccagaaggtatgga

SEQ ID NO: 48068 - DNA, 25 bp, Homo sapien
tggttcctactacagctcggccgcg

SEQ ID NO: 48069 - DNA, 25 bp, Homo sapien
tcaggctggaaaggcgtggttccta

SEQ ID NO: 48070 - DNA, 25 bp, Homo sapien
cggaaacgcgcccatcaggctggaa

SEQ ID NO: 48071 - DNA, 25 bp, Homo sapien
tcgccaagctttcactgcgcggaaa

SEQ ID NO: 48072 - DNA, 25 bp, Homo sapien
taaagtaggaccgaggagccacctc

SEQ ID NO: 48073 - DNA, 25 bp, Homo sapien
ttgcggttccaacgcgcagcgccaa

SEQ ID NO: 48074 - DNA, 25 bp, Homo sapien
atgcctttctggtcgctcctctaga

SEQ ID NO: 48075 - DNA, 25 bp, Homo sapien
gcacggggacagctgatgcctttct

SEQ ID NO: 48076 - DNA, 25 bp, Homo sapien
gaggtcccgacacgggcttcctcgc

SEQ ID NO: 48077 - DNA, 25 bp, Homo sapien
ttcctgttttctcgcgctggcgggc

SEQ ID NO: 48078 - DNA, 25 bp, Homo sapien
acttcctgttttctcgcgctggcgg

SEQ ID NO: 48079 - DNA, 25 bp, Homo sapien
tgcggcccgagataagcgtcgcgcc

SEQ ID NO: 48080 - DNA, 25 bp, Homo sapien
gtgagcaggtcctgcccggcttgag

SEQ ID NO: 48081 - DNA, 25 bp, Homo sapien
cggcccgattttggccgctgcggtc

SEQ ID NO: 48082 - DNA, 25 bp, Homo sapien
tcgccttccggcctcgctcccgtcg

SEQ ID NO: 48083 - DNA, 25 bp, Homo sapien
attttggccgctgcggtcaggggaa

SEQ ID NO: 48084 - DNA, 25 bp, Homo sapien
tccggctgcagttgaggtactggtc

SEQ ID NO: 48085 - DNA, 25 bp, Homo sapien
tccacgctttgcctgcgggccgtgg

SEQ ID NO: 48086 - DNA, 25 bp, Homo sapien
tggtcgcgcaagtgctgcacgcgca

SEQ ID NO: 48087 - DNA, 25 bp, Homo sapien
tcccgcgacaactcggtgggcgcgt

SEQ ID NO: 48088 - DNA, 25 bp, Homo sapien
gcccagggtgccgtagtacaggcca

SEQ ID NO: 48089 - DNA, 25 bp, Homo sapien
tactggtcgaactcggtgaggtcca

SEQ ID NO: 48090 - DNA, 25 bp, Homo sapien
aggtccgggttctgctgagccagcc

SEQ ID NO: 48091 - DNA, 25 bp, Homo sapien
agccgttcggcttcctccacgaagg

SEQ ID NO: 48092 - DNA, 25 bp, Homo sapien
tgccacccacccacggagtcggacc

SEQ ID NO: 48093 - DNA, 25 bp, Homo sapien
ccgcgacctctcagaaggagagacc

SEQ ID NO: 48094 - DNA, 25 bp, Homo sapien
ctcagaaggagagaccccccgggtg

SEQ ID NO: 48095 - DNA, 25 bp, Homo sapien
atgagggccggtgctgccagacttt

SEQ ID NO: 48096 - DNA, 25 bp, Homo sapien
gccagactttcggaggcgagctgcc

SEQ ID NO: 48097 - DNA, 25 bp, Homo sapien
cagtgtcccgctggttgccgttccc

SEQ ID NO: 48098 - DNA, 25 bp, Homo sapien
ccgggcgggattccgctgaggcctc

SEQ ID NO: 48099 - DNA, 25 bp, Homo sapien
tgctgccagactttcggaggcgagc

SEQ ID NO: 48100 - DNA, 25 bp, Homo sapien
cacctggctggcacacttgtttgca

SEQ ID NO: 48101 - DNA, 25 bp, Homo sapien
cacttgtttgcacccatctggaggc

SEQ ID NO: 48102 - DNA, 25 bp, Homo sapien
gcaatacgtggttcttggggtcata

SEQ ID NO: 48103 - DNA, 25 bp, Homo sapien
tgtcatagatgtaccgccgggtccc

SEQ ID NO: 48104 - DNA, 25 bp, Homo sapien
ctggtgcatttgtgggtgcccatct

SEQ ID NO: 48105 - DNA, 25 bp, Homo sapien
agagatgcctcctcgtgctgtacgc

SEQ ID NO: 48106 - DNA, 25 bp, Homo sapien
tgtcggttcccagcttggtgtcata

SEQ ID NO: 48107 - DNA, 25 bp, Homo sapien
gggcattcatggtggcgtcctcaaa

SEQ ID NO: 48108 - DNA, 25 bp, Homo sapien
cacaggggagggaaagttcttcagc

SEQ ID NO: 48109 - DNA, 25 bp, Homo sapien
agtgaacgtccctctcctccgtggg

SEQ ID NO: 48110 - DNA, 25 bp, Homo sapien
acccttcaggctacgtgcatttccg

SEQ ID NO: 48111 - DNA, 25 bp, Homo sapien
catttccgcctgttctcagggttta

SEQ ID NO: 48112 - DNA, 25 bp, Homo sapien
ttaaccgtagccctaacgcggctga

SEQ ID NO: 48113 - DNA, 25 bp, Homo sapien
agagacagacactcgccaaccagtc

SEQ ID NO: 48114 - DNA, 25 bp, Homo sapien
ggagggaaagttcttcagctgccga

SEQ ID NO: 48115 - DNA, 25 bp, Homo sapien
gctgagggatccaggccttgcctct

SEQ ID NO: 48116 - DNA, 25 bp, Homo sapien
ttgtgggatcacgagtcactggcga

SEQ ID NO: 48117 - DNA, 25 bp, Homo sapien
cctggaccttgtcccgggagagcca

SEQ ID NO: 48118 - DNA, 25 bp, Homo sapien
gcgtggactacgcatcctaggatgc

SEQ ID NO: 48119 - DNA, 25 bp, Homo sapien
ctggggacggccttctaggccaagt

SEQ ID NO: 48120 - DNA, 25 bp, Homo sapien
ccgcgggacagcaaggcccgaagca

SEQ ID NO: 48121 - DNA, 25 bp, Homo sapien
gacggtgggtcaggactacacttcc

SEQ ID NO: 48122 - DNA, 25 bp, Homo sapien
aggccgcgatcaggcctggaccttg

SEQ ID NO: 48123 - DNA, 25 bp, Homo sapien
gagagccacccgctctggactcaga

SEQ ID NO: 48124 - DNA, 25 bp, Homo sapien
ctgccgacaacaacacctgaaggga

SEQ ID NO: 48125 - DNA, 25 bp, Homo sapien
ccgccgctcttggttcctagtggca

SEQ ID NO: 48126 - DNA, 25 bp, Homo sapien
agccggctggactcaccatacttca

SEQ ID NO: 48127 - DNA, 25 bp, Homo sapien
cacctcctcaggacttggcgtggca

SEQ ID NO: 48128 - DNA, 25 bp, Homo sapien
ctcgctgtactctgtccgcaggaac

SEQ ID NO: 48129 - DNA, 25 bp, Homo sapien
taccacatgctggttggcctcggcc

SEQ ID NO: 48130 - DNA, 25 bp, Homo sapien
atcttcttgttgatgccctcccgca

SEQ ID NO: 48131 - DNA, 25 bp, Homo sapien
gtcctcgtagatgagcctcgccttc

SEQ ID NO: 48132 - DNA, 25 bp, Homo sapien
gtgctcatagtggagccctggctcc

SEQ ID NO: 48133 - DNA, 25 bp, Homo sapien
ctgcaaaggaccgatcggcgggtac

SEQ ID NO: 48134 - DNA, 25 bp, Homo sapien
tgctgcttgcccagcttgggaaaga

SEQ ID NO: 48135 - DNA, 25 bp, Homo sapien
tccacgacagtggaggcacgagagc

SEQ ID NO: 48136 - DNA, 25 bp, Homo sapien
tgccatccgtgtgggacttccacga

SEQ ID NO: 48137 - DNA, 25 bp, Homo sapien
gggccgttcctgctttgccatccgt

SEQ ID NO: 48138 - DNA, 25 bp, Homo sapien
cccaggctttgagctccagaaaaag

SEQ ID NO: 48139 - DNA, 25 bp, Homo sapien
cccggagagtcgaggtgctcatagt

SEQ ID NO: 48140 - DNA, 25 bp, Homo sapien
ggacttctgccgctggatgagcagc

SEQ ID NO: 48141 - DNA, 25 bp, Homo sapien
cttgtctgcacctcttggcggtcca

SEQ ID NO: 48142 - DNA, 25 bp, Homo sapien
atgagcagcgcgatctcctcggcct

SEQ ID NO: 48143 - DNA, 25 bp, Homo sapien
gcagctcgagcgactgcgtccacgg

SEQ ID NO: 48144 - DNA, 25 bp, Homo sapien
tccgcagtcggttttgagttccgca

SEQ ID NO: 48145 - DNA, 25 bp, Homo sapien
agcctctgagctttgcccaggcgct

SEQ ID NO: 48146 - DNA, 25 bp, Homo sapien
agatggtgccatccacgttctcctc

SEQ ID NO: 48147 - DNA, 25 bp, Homo sapien
acccgcatgcgggtgtagcgcagcc

SEQ ID NO: 48148 - DNA, 25 bp, Homo sapien
ccagcttgggtgagcgtcctttcca

SEQ ID NO: 48149 - DNA, 25 bp, Homo sapien
tcattggggcatagaggcatagagc

SEQ ID NO: 48150 - DNA, 25 bp, Homo sapien
ccctcataggggtcattggggcata

SEQ ID NO: 48151 - DNA, 25 bp, Homo sapien
gttgcccagcaaccgggagtcctgc

SEQ ID NO: 48152 - DNA, 25 bp, Homo sapien
cttgttgacgcggttgcccagcaac

SEQ ID NO: 48153 - DNA, 25 bp, Homo sapien
agactctttgggcttgttgacgcgg

SEQ ID NO: 48154 - DNA, 25 bp, Homo sapien
tagaggcatagagccggcttctcca

SEQ ID NO: 48155 - DNA, 25 bp, Homo sapien
cgccgtagcccagactctttgggct

SEQ ID NO: 48156 - DNA, 25 bp, Homo sapien
tcgcgtgtcatcgttcgtgtcttgg

SEQ ID NO: 48157 - DNA, 25 bp, Homo sapien
cgtgtcttgggctatccctagtatc

SEQ ID NO: 48158 - DNA, 25 bp, Homo sapien
gctgtcattcgcgtgtcatcgttcg

SEQ ID NO: 48159 - DNA, 25 bp, Homo sapien
gggctatccctagtatcctcgcaca

SEQ ID NO: 48160 - DNA, 25 bp, Homo sapien
ttgggctatccctagtatcctcgca

SEQ ID NO: 48161 - DNA, 25 bp, Homo sapien
tgggctatccctagtatcctcgcac

SEQ ID NO: 48162 - DNA, 25 bp, Homo sapien
tcatcgttcgtgtcttgggctatcc

SEQ ID NO: 48163 - DNA, 25 bp, Homo sapien
ttcgcgtgtcatcgttcgtgtcttg

SEQ ID NO: 48164 - DNA, 25 bp, Homo sapien
ctcgggttagcgcagcagtgcgcac

SEQ ID NO: 48165 - DNA, 25 bp, Homo sapien
tccaatagattcctagccggcctcg

SEQ ID NO: 48166 - DNA, 25 bp, Homo sapien
cccggcatcatagagcggggctctg

SEQ ID NO: 48167 - DNA, 25 bp, Homo sapien
cacttcttaagctgcgaggccgccg

SEQ ID NO: 48168 - DNA, 25 bp, Homo sapien
ccctgcgcagggcatgagcgttaga

SEQ ID NO: 48169 - DNA, 25 bp, Homo sapien
aggaagccatgtcggaccacgccct

SEQ ID NO: 48170 - DNA, 25 bp, Homo sapien
gaaccgtcccgaggaagccatgtcg

SEQ ID NO: 48171 - DNA, 25 bp, Homo sapien
ctgagccgttcagcaaagaaccgtc

SEQ ID NO: 48172 - DNA, 25 bp, Homo sapien
tcaaggcctgcttccgcaagttctg

SEQ ID NO: 48173 - DNA, 25 bp, Homo sapien
gtctgctacagcctcatgatccggc

SEQ ID NO: 48174 - DNA, 25 bp, Homo sapien
ctacgccttcctggatgagaacttc

SEQ ID NO: 48175 - DNA, 25 bp, Homo sapien
ccgtgctcgtcatctctgtctgcta

SEQ ID NO: 48176 - DNA, 25 bp, Homo sapien
gcgtgcgcagcattgccaaggacgt

SEQ ID NO: 48177 - DNA, 25 bp, Homo sapien
ggcctgcaagacctctgagacggta

SEQ ID NO: 48178 - DNA, 25 bp, Homo sapien
cgtggccattctgcgcttctgcacg

SEQ ID NO: 48179 - DNA, 25 bp, Homo sapien
gtccaggtcttcgtgctggcccaag

SEQ ID NO: 48180 - DNA, 25 bp, Homo sapien
gtctgcagaccctttggccgtgccg

SEQ ID NO: 48181 - DNA, 25 bp, Homo sapien
aagacgctgaggatcccattgctgg

SEQ ID NO: 48182 - DNA, 25 bp, Homo sapien
aggaatcctggttggcgccttctct

SEQ ID NO: 48183 - DNA, 25 bp, Homo sapien
ctgctttgcgaggtgtgactgcagc

SEQ ID NO: 48184 - DNA, 25 bp, Homo sapien
ccgtaacagcgtgcagagcgcagtc

SEQ ID NO: 48185 - DNA, 25 bp, Homo sapien
gttgttcacttgctcattacgcctc

SEQ ID NO: 48186 - DNA, 25 bp, Homo sapien
acttgtctcctcaaggggctccggg

SEQ ID NO: 48187 - DNA, 25 bp, Homo sapien
tgtctgggaaacacagtctcacttg

SEQ ID NO: 48188 - DNA, 25 bp, Homo sapien
cttgccggagaagacgcctcatgct

SEQ ID NO: 48189 - DNA, 25 bp, Homo sapien
ggcgcactcaccctgaagtaggtaa

SEQ ID NO: 48190 - DNA, 25 bp, Homo sapien
tggacggcgtagactttcgagaaaa

SEQ ID NO: 48191 - DNA, 25 bp, Homo sapien
tgatctctgacatctctgcctgctg

SEQ ID NO: 48192 - DNA, 25 bp, Homo sapien
agggctgtagcaccacttgatgtaa

SEQ ID NO: 48193 - DNA, 25 bp, Homo sapien
acttgatgtaaactgggctcggcgc

SEQ ID NO: 48194 - DNA, 25 bp, Homo sapien
gggactcggagagccgtcaactcca

SEQ ID NO: 48195 - DNA, 25 bp, Homo sapien
gggaaggcgtctgtccaaacacgtc

SEQ ID NO: 48196 - DNA, 25 bp, Homo sapien
ttgaaccagacctgctcgggccacg

SEQ ID NO: 48197 - DNA, 25 bp, Homo sapien
tgtagacacggctggccttgaacca

SEQ ID NO: 48198 - DNA, 25 bp, Homo sapien
accgtcttcatcttgggcgccctta

SEQ ID NO: 48199 - DNA, 25 bp, Homo sapien
gttcaggatgaacacgttggtcacc

SEQ ID NO: 48200 - DNA, 25 bp, Homo sapien
agcccaggaccaacgtgtagacacg

SEQ ID NO: 48201 - DNA, 25 bp, Homo sapien
ttgggacctgcagctcgttgctgta

SEQ ID NO: 48202 - DNA, 25 bp, Homo sapien
ccacgctcatcacggctaggaagta

SEQ ID NO: 48203 - DNA, 25 bp, Homo sapien
acacagatggtgcacacgggcagca

SEQ ID NO: 48204 - DNA, 25 bp, Homo sapien
gccgttattcagtgggatacccttc

SEQ ID NO: 48205 - DNA, 25 bp, Homo sapien
ccgttattcggtgagatacccttca

SEQ ID NO: 48206 - DNA, 25 bp, Homo sapien
gccgttattcggtgagatacccttc

SEQ ID NO: 48207 - DNA, 25 bp, Homo sapien
ccgttattcggtgggatgcccttca

SEQ ID NO: 48208 - DNA, 25 bp, Homo sapien
tgagccgttattcagtgggataccc

SEQ ID NO: 48209 - DNA, 25 bp, Homo sapien
tgcccttcaacgtgggagcactgag

SEQ ID NO: 48210 - DNA, 25 bp, Homo sapien
ctgagccgttattcggtgggatacc

SEQ ID NO: 48211 - DNA, 25 bp, Homo sapien
ttcggtgagatacccttcaacgtgg

SEQ ID NO: 48212 - DNA, 25 bp, Homo sapien
gagagttttcctgtagcctgtggcc

SEQ ID NO: 48213 - DNA, 25 bp, Homo sapien
tccgtggagacttttcctgtagccc

SEQ ID NO: 48214 - DNA, 25 bp, Homo sapien
gagacttttcctgtagcctgtggcc

SEQ ID NO: 48215 - DNA, 25 bp, Homo sapien
ggagacttttcctgtagcccgtggc

SEQ ID NO: 48216 - DNA, 25 bp, Homo sapien
agagatttcctgtagcccgtggccc

SEQ ID NO: 48217 - DNA, 25 bp, Homo sapien
gagacttttcctgtagcccgtggcc

SEQ ID NO: 48218 - DNA, 25 bp, Homo sapien
agagttttcctgtagcctgtggccc

SEQ ID NO: 48219 - DNA, 25 bp, Homo sapien
ggagacttttcctgtagcctgtggc

SEQ ID NO: 48220 - DNA, 25 bp, Homo sapien
agcgctcgcggtttcccgtcggtct

SEQ ID NO: 48221 - DNA, 25 bp, Homo sapien
ccgcgtttctctctccgagcgctcg

SEQ ID NO: 48222 - DNA, 25 bp, Homo sapien
ccgcggacacacgagggacgcgccc

SEQ ID NO: 48223 - DNA, 25 bp, Homo sapien
tcaggtgacccttagggagggcttc

SEQ ID NO: 48224 - DNA, 25 bp, Homo sapien
gcaaaggcgtctcaggtgaccctta

SEQ ID NO: 48225 - DNA, 25 bp, Homo sapien
cccagccgtgggtcagcaaaggcgt

SEQ ID NO: 48226 - DNA, 25 bp, Homo sapien
ggcaccctggagatgcggaacgccc

SEQ ID NO: 48227 - DNA, 25 bp, Homo sapien
tcggacccggcctagggctcagcga

SEQ ID NO: 48228 - DNA, 25 bp, Homo sapien
cctgcacaatatggggtcaaagtga

SEQ ID NO: 48229 - DNA, 25 bp, Homo sapien
tgtaagtttagacctgcacaatatg

SEQ ID NO: 48230 - DNA, 25 bp, Homo sapien
atatggggtcaaagtgagtgtagac

SEQ ID NO: 48231 - DNA, 25 bp, Homo sapien
gtcatgtgtggacatttgcagtgtg

SEQ ID NO: 48232 - DNA, 25 bp, Homo sapien
acatttgcagtgtggggtaatgtgt

SEQ ID NO: 48233 - DNA, 25 bp, Homo sapien
tcatgtgaatgtgggcacgcgtggt

SEQ ID NO: 48234 - DNA, 25 bp, Homo sapien
tggggtgtgtaagtttagacctgca

SEQ ID NO: 48235 - DNA, 25 bp, Homo sapien
acatgcgcaatgtggggtcatgtgt

SEQ ID NO: 48236 - DNA, 25 bp, Homo sapien
atgtgactgcggatgtgcacagtgt

SEQ ID NO: 48237 - DNA, 25 bp, Homo sapien
cgtcgtgagttcaggcatgcagggt

SEQ ID NO: 48238 - DNA, 25 bp, Homo sapien
tgtgggcacacgtgatgtgtcatgt

SEQ ID NO: 48239 - DNA, 25 bp, Homo sapien
tgtgtcatgtgactgcggatgtgca

SEQ ID NO: 48240 - DNA, 25 bp, Homo sapien
gcacagtgtgaggtcgtgtgaatgc

SEQ ID NO: 48241 - DNA, 25 bp, Homo sapien
tgcatggtgtgcagtcgtgagttcc

SEQ ID NO: 48242 - DNA, 25 bp, Homo sapien
cagtcgtgagttccggcgtgcacga

SEQ ID NO: 48243 - DNA, 25 bp, Homo sapien
cacacgtgatgtgtcatgtgactgc

SEQ ID NO: 48244 - DNA, 25 bp, Homo sapien
caggagcggcatcgcggaagcccct

SEQ ID NO: 48245 - DNA, 25 bp, Homo sapien
ggagcggcatcgcggaagccccttc

SEQ ID NO: 48246 - DNA, 25 bp, Homo sapien
gccaggctgcgtgggagcgggcagc

SEQ ID NO: 48247 - DNA, 25 bp, Homo sapien
gcggctgtgcgcggccaggctgcgt

SEQ ID NO: 48248 - DNA, 25 bp, Homo sapien
gcggcatcgcggaagccccttccga

SEQ ID NO: 48249 - DNA, 25 bp, Homo sapien
agcggcatcgcggaagccccttccg

SEQ ID NO: 48250 - DNA, 25 bp, Homo sapien
cggcaggagcggcatcgcggaagcc

SEQ ID NO: 48251 - DNA, 25 bp, Homo sapien
ggcaggagcggcatcgcggaagccc

SEQ ID NO: 48252 - DNA, 25 bp, Homo sapien
tgctcccgggttttacgcactcacg

SEQ ID NO: 48253 - DNA, 25 bp, Homo sapien
ttcccttcgcgggtgactcagcagc

SEQ ID NO: 48254 - DNA, 25 bp, Homo sapien
tgggccgggagattccttctcgcct

SEQ ID NO: 48255 - DNA, 25 bp, Homo sapien
cgggagattccttctcgcctgccgg

SEQ ID NO: 48256 - DNA, 25 bp, Homo sapien
gctgctcccgggttttacgcactca

SEQ ID NO: 48257 - DNA, 25 bp, Homo sapien
ttttacgcactcacggtcggaggga

SEQ ID NO: 48258 - DNA, 25 bp, Homo sapien
tacgcactcacggtcggagggagcc

SEQ ID NO: 48259 - DNA, 25 bp, Homo sapien
ccacgccgccgagatcccgactcca

SEQ ID NO: 48260 - DNA, 25 bp, Homo sapien
tcacacacgcatcgcggggcggggc

SEQ ID NO: 48261 - DNA, 25 bp, Homo sapien
cagctcgtcgatacgctctcgctgg

SEQ ID NO: 48262 - DNA, 25 bp, Homo sapien
agctcgtcgatacgctctcgctggg

SEQ ID NO: 48263 - DNA, 25 bp, Homo sapien
cttcacacacgcatcgcggggcggg

SEQ ID NO: 48264 - DNA, 25 bp, Homo sapien
ctcgtcgatacgctctcgctgggtg

SEQ ID NO: 48265 - DNA, 25 bp, Homo sapien
gcggcggccgatcgggcgcgggatg

SEQ ID NO: 48266 - DNA, 25 bp, Homo sapien
tcgtcgatacgctctcgctgggtgt

SEQ ID NO: 48267 - DNA, 25 bp, Homo sapien
gagcggtggccggagcggccggcag

SEQ ID NO: 48268 - DNA, 25 bp, Homo sapien
agcggctcgacgctgtggatcccgc

SEQ ID NO: 48269 - DNA, 25 bp, Homo sapien
aggtcccggatgaggcgacaatttt

SEQ ID NO: 48270 - DNA, 25 bp, Homo sapien
cacacggcctggctgagttgctcct

SEQ ID NO: 48271 - DNA, 25 bp, Homo sapien
cagtgtgatgcttcccgactgccgc

SEQ ID NO: 48272 - DNA, 25 bp, Homo sapien
aggatcccggcctggtcaccgggca

SEQ ID NO: 48273 - DNA, 25 bp, Homo sapien
gatgaggcgacaatttttccggccc

SEQ ID NO: 48274 - DNA, 25 bp, Homo sapien
ccttgcgaagaactggggcctcccg

SEQ ID NO: 48275 - DNA, 25 bp, Homo sapien
agagagggctttgccttgaaacccg

SEQ ID NO: 48276 - DNA, 25 bp, Homo sapien
actcaacgcagtcggctcctaggca

SEQ ID NO: 48277 - DNA, 25 bp, Homo sapien
tctctaggagggcaacactcaacgc

SEQ ID NO: 48278 - DNA, 25 bp, Homo sapien
tcctaggcatccagtggggctgcaa

SEQ ID NO: 48279 - DNA, 25 bp, Homo sapien
cagccgggtttcagctcgttctacg

SEQ ID NO: 48280 - DNA, 25 bp, Homo sapien
gtccacgtcagaagatcgcctccgg

SEQ ID NO: 48281 - DNA, 25 bp, Homo sapien
cgcagccgaggccaaggaatgtgac

SEQ ID NO: 48282 - DNA, 25 bp, Homo sapien
tgtcaacggcggtcgctgcaaccct

SEQ ID NO: 48283 - DNA, 25 bp, Homo sapien
tgcgatgcagcctcctgtacccttt

SEQ ID NO: 48284 - DNA, 25 bp, Homo sapien
ctgcactgacttaggaagggagccc

SEQ ID NO: 48285 - DNA, 25 bp, Homo sapien
tgatgctcgtgaccacgttggtggc

SEQ ID NO: 48286 - DNA, 25 bp, Homo sapien
agccttgccggccacgtaccgatga

SEQ ID NO: 48287 - DNA, 25 bp, Homo sapien
cagtgatgctcgtgaccacgttggt

SEQ ID NO: 48288 - DNA, 25 bp, Homo sapien
tggcagtgatgctcgtgaccacgtt

SEQ ID NO: 48289 - DNA, 25 bp, Homo sapien
cactgacttaggaagggagcccgca

SEQ ID NO: 48290 - DNA, 25 bp, Homo sapien
gccggccacgtaccgatgacggtga

SEQ ID NO: 48291 - DNA, 25 bp, Homo sapien
tgctggcagtgatgctcgtgaccac

SEQ ID NO: 48292 - DNA, 25 bp, Homo sapien
cccgagaaagcatagagtgtggccc

SEQ ID NO: 48293 - DNA, 25 bp, Homo sapien
tactcggagcgcaaacgctggcacc

SEQ ID NO: 48294 - DNA, 25 bp, Homo sapien
ggcactgcgccacatactcggagcg

SEQ ID NO: 48295 - DNA, 25 bp, Homo sapien
cccaagcagcggttcctggtaaaga

SEQ ID NO: 48296 - DNA, 25 bp, Homo sapien
cgctcgcagaagtttaagggctcaa

SEQ ID NO: 48297 - DNA, 25 bp, Homo sapien
aggcttcgcagtcctcacgccggtt

SEQ ID NO: 48298 - DNA, 25 bp, Homo sapien
cgactggcactgatcggctctccgt

SEQ ID NO: 48299 - DNA, 25 bp, Homo sapien
cgcgctcacgttgtccacgtagtta

SEQ ID NO: 48300 - DNA, 25 bp, Homo sapien
tcgccaggttactcggaaaataatc

SEQ ID NO: 48301 - DNA, 25 bp, Homo sapien
gtcagaggcacccacgtgagcagct

SEQ ID NO: 48302 - DNA, 25 bp, Homo sapien
tgagggacgaccaaagaaacgcagc

SEQ ID NO: 48303 - DNA, 25 bp, Homo sapien
gtaacccgcgcaaagtcacacaaca

SEQ ID NO: 48304 - DNA, 25 bp, Homo sapien
gacccaaggtggaatcgcgacccga

SEQ ID NO: 48305 - DNA, 25 bp, Homo sapien
aaccaccctgaagcggacactatga

SEQ ID NO: 48306 - DNA, 25 bp, Homo sapien
accgttgagaatccactttgcctga

SEQ ID NO: 48307 - DNA, 25 bp, Homo sapien
tcccggtgtaggagtaacctcgcca

SEQ ID NO: 48308 - DNA, 25 bp, Homo sapien
aagcacacttgagcgtccctgggca

SEQ ID NO: 48309 - DNA, 25 bp, Homo sapien
cagagggcctctactcctgagagga

SEQ ID NO: 48310 - DNA, 25 bp, Homo sapien
acgccctgacctactggccgtatgg

SEQ ID NO: 48311 - DNA, 25 bp, Homo sapien
ggcctctaggcagcggctcgcaact

SEQ ID NO: 48312 - DNA, 25 bp, Homo sapien
aggagcgcgatcttccgtggtctcc

SEQ ID NO: 48313 - DNA, 25 bp, Homo sapien
cggggccagcccaagcacacttgag

SEQ ID NO: 48314 - DNA, 25 bp, Homo sapien
catagctgtgagctcctcggcctct

SEQ ID NO: 48315 - DNA, 25 bp, Homo sapien
gggcctccagcccatagctgtgagc

SEQ ID NO: 48316 - DNA, 25 bp, Homo sapien
ctggtggggacagatctgcaagccc

SEQ ID NO: 48317 - DNA, 25 bp, Homo sapien
tttgccgtcccgggctgtcggctga

SEQ ID NO: 48318 - DNA, 25 bp, Homo sapien
cagctggaccgcaggaggccgacca

SEQ ID NO: 48319 - DNA, 25 bp, Homo sapien
accaaaaacctccagactttgtctg

SEQ ID NO: 48320 - DNA, 25 bp, Homo sapien
acctccagactttgtctggtgggga

SEQ ID NO: 48321 - DNA, 25 bp, Homo sapien
gcacttggggcagcgaccttggtct

SEQ ID NO: 48322 - DNA, 25 bp, Homo sapien
tggggcagcgaccttggtctcccac

SEQ ID NO: 48323 - DNA, 25 bp, Homo sapien
ctcagcagctggaccgcaggaggcc

SEQ ID NO: 48324 - DNA, 25 bp, Homo sapien
ctgggtagatctgaccatcgccttc

SEQ ID NO: 48325 - DNA, 25 bp, Homo sapien
gtctgcctgattcatcccacatata

SEQ ID NO: 48326 - DNA, 25 bp, Homo sapien
tcattgacttctaccgcaagcagcg

SEQ ID NO: 48327 - DNA, 25 bp, Homo sapien
gccacaacgtggagaccgctctgcg

SEQ ID NO: 48328 - DNA, 25 bp, Homo sapien
gtgccgcatcttcggcgaggacttc

SEQ ID NO: 48329 - DNA, 25 bp, Homo sapien
ggacttcatcgccaccttcaaaagg

SEQ ID NO: 48330 - DNA, 25 bp, Homo sapien
aggagctctacaaggcatctggtga

SEQ ID NO: 48331 - DNA, 25 bp, Homo sapien
gacccgggaatgaccgtgcactgga

SEQ ID NO: 48332 - DNA, 25 bp, Homo sapien
aaacgatagttctgcagtctgcgcc

SEQ ID NO: 48333 - DNA, 25 bp, Homo sapien
agcggcgcgtactcatcaacctgta

SEQ ID NO: 48334 - DNA, 25 bp, Homo sapien
tttctttccaactgagggcgcgccg

SEQ ID NO: 48335 - DNA, 25 bp, Homo sapien
tcaacctgtactgctgcgcggcaga

SEQ ID NO: 48336 - DNA, 25 bp, Homo sapien
gcaccgacgtcttcgagcgcttcgt

SEQ ID NO: 48337 - DNA, 25 bp, Homo sapien
acccgcccgaaaagctgctggttcg

SEQ ID NO: 48338 - DNA, 25 bp, Homo sapien
acgtgggcctcaccatcctcaaagg

SEQ ID NO: 48339 - DNA, 25 bp, Homo sapien
atgcagtttggcgacaccgaaatta

SEQ ID NO: 48340 - DNA, 25 bp, Homo sapien
ggggatagcgcctctagccttgaac

SEQ ID NO: 48341 - DNA, 25 bp, Homo sapien
cccggcctggagaagcatcagaaca

SEQ ID NO: 48342 - DNA, 25 bp, Homo sapien
ttgaaccttgcttaggacgcacctc

SEQ ID NO: 48343 - DNA, 25 bp, Homo sapien
tcagaacaaagaaggcacgcgggct

SEQ ID NO: 48344 - DNA, 25 bp, Homo sapien
ggggccagaaccgaccactcgaaga

SEQ ID NO: 48345 - DNA, 25 bp, Homo sapien
gggctccaaagaacggccaactggc

SEQ ID NO: 48346 - DNA, 25 bp, Homo sapien
ctcaacgccgagcacgaggaaggga

SEQ ID NO: 48347 - DNA, 25 bp, Homo sapien
ctcgttcaggagctgaggaaccctc

SEQ ID NO: 48348 - DNA, 25 bp, Homo sapien
gaggtcttcgatccgcacattcttg

SEQ ID NO: 48349 - DNA, 25 bp, Homo sapien
tgctccttttcagcgatctggagga

SEQ ID NO: 48350 - DNA, 25 bp, Homo sapien
aggcgccttaccttcatctgcagga

SEQ ID NO: 48351 - DNA, 25 bp, Homo sapien
ctgcaacgcccggttatacgctgga

SEQ ID NO: 48352 - DNA, 25 bp, Homo sapien
aagcggtccattctcctgacccgga

SEQ ID NO: 48353 - DNA, 25 bp, Homo sapien
ggcccaaggtgttggacactgcttt

SEQ ID NO: 48354 - DNA, 25 bp, Homo sapien
ctgctacgggcacatcgtcgatgtc

SEQ ID NO: 48355 - DNA, 25 bp, Homo sapien
ctcttgagaggccaacagctcctgc

SEQ ID NO: 48356 - DNA, 25 bp, Homo sapien
tcgggcaggaagtcgtaccatagac

SEQ ID NO: 48357 - DNA, 25 bp, Homo sapien
cgctgaacacgtcctgcgaggcgta

SEQ ID NO: 48358 - DNA, 25 bp, Homo sapien
ttctccttgaggatgatgcccttga

SEQ ID NO: 48359 - DNA, 25 bp, Homo sapien
tggaaccaggcgatgagcaagccct

SEQ ID NO: 48360 - DNA, 25 bp, Homo sapien
ctcgagcttgtcgtagggagacagc

SEQ ID NO: 48361 - DNA, 25 bp, Homo sapien
ttgttcttcaggatcgtgctcagcg

SEQ ID NO: 48362 - DNA, 25 bp, Homo sapien
acttctcccggaacgtcagctgtcg

SEQ ID NO: 48363 - DNA, 25 bp, Homo sapien
cctcctggatgatccgtgacttctc

SEQ ID NO: 48364 - DNA, 25 bp, Homo sapien
tggacagacacctgcagaccgcacg

SEQ ID NO: 48365 - DNA, 25 bp, Homo sapien
ccgcctcataccagcccgacgagga

SEQ ID NO: 48366 - DNA, 25 bp, Homo sapien
aggaggcgctgcgtcagtaccagca

SEQ ID NO: 48367 - DNA, 25 bp, Homo sapien
aggcgctgcgtcagtaccagcaggt

SEQ ID NO: 48368 - DNA, 25 bp, Homo sapien
aagtccctggacagacacctgcaga

SEQ ID NO: 48369 - DNA, 25 bp, Homo sapien
acagacacctgcagaccgcacgggg

SEQ ID NO: 48370 - DNA, 25 bp, Homo sapien
gcgggaaagtccctggacagacacc

SEQ ID NO: 48371 - DNA, 25 bp, Homo sapien
gtaggccaggaagggagacacctgc

SEQ ID NO: 48372 - DNA, 25 bp, Homo sapien
gtcgtcaggaagtacctggcctgca

SEQ ID NO: 48373 - DNA, 25 bp, Homo sapien
agtacctggcctgcaggggtaccga

SEQ ID NO: 48374 - DNA, 25 bp, Homo sapien
atcagaaacgtgaatggggtggacc

SEQ ID NO: 48375 - DNA, 25 bp, Homo sapien
acgtgggcgtcgtcaggaagtacct

SEQ ID NO: 48376 - DNA, 25 bp, Homo sapien
tggacaacaacttccgcagcggctg

SEQ ID NO: 48377 - DNA, 25 bp, Homo sapien
tccgcagctgcagactggacaacaa

SEQ ID NO: 48378 - DNA, 25 bp, Homo sapien
accatccgcagctgcagactggaca

SEQ ID NO: 48379 - DNA, 25 bp, Homo sapien
tggcctgcaggggtaccgagcccac

SEQ ID NO: 48380 - DNA, 25 bp, Homo sapien
cggggtccagccaaaagcggacaca

SEQ ID NO: 48381 - DNA, 25 bp, Homo sapien
ggagcctcatcctatcgcaaagtgc

SEQ ID NO: 48382 - DNA, 25 bp, Homo sapien
ggacacacctcgaagctggcctcat

SEQ ID NO: 48383 - DNA, 25 bp, Homo sapien
cttgctatgaaagtggccacatacc

SEQ ID NO: 48384 - DNA, 25 bp, Homo sapien
tcgggtgccgatcacacttgctatg

SEQ ID NO: 48385 - DNA, 25 bp, Homo sapien
aagtcgacccaggttccactgcgtc

SEQ ID NO: 48386 - DNA, 25 bp, Homo sapien
tccgacctccagctgccaagatgtg

SEQ ID NO: 48387 - DNA, 25 bp, Homo sapien
gcagccagagtttcccgcagctctg

SEQ ID NO: 48388 - DNA, 25 bp, Homo sapien
tgtggagctccaaaccatgtcgcga

SEQ ID NO: 48389 - DNA, 25 bp, Homo sapien
accctagggcgttgctgctgccttt

SEQ ID NO: 48390 - DNA, 25 bp, Homo sapien
accatgtcgcgagaggcggattttg

SEQ ID NO: 48391 - DNA, 25 bp, Homo sapien
ggtgtgggataaatcttaattcctc

SEQ ID NO: 48392 - DNA, 25 bp, Homo sapien
tcggctctcagtccagcaggcgtgt

SEQ ID NO: 48393 - DNA, 25 bp, Homo sapien
tcctgctgggatctcatggcctcct

SEQ ID NO: 48394 - DNA, 25 bp, Homo sapien
gtgatcccaggtgacgacatgccgc

SEQ ID NO: 48395 - DNA, 25 bp, Homo sapien
agtggcagctgcaactagaggcttc

SEQ ID NO: 48396 - DNA, 25 bp, Homo sapien
aagctgtcttgaccgctaccatttc

SEQ ID NO: 48397 - DNA, 25 bp, Homo sapien
ggctccggttctcgaagtgcctttg

SEQ ID NO: 48398 - DNA, 25 bp, Homo sapien
cggaggcagtgacgtaagctgtctt

SEQ ID NO: 48399 - DNA, 25 bp, Homo sapien
cctggctgaccggagtaagaaacta

SEQ ID NO: 48400 - DNA, 25 bp, Homo sapien
cgagggtccaagcatcgggatatgc

SEQ ID NO: 48401 - DNA, 25 bp, Homo sapien
ggctccgctgatctagggcaacgag

SEQ ID NO: 48402 - DNA, 25 bp, Homo sapien
gttttgactgcaaggccagcccacg

SEQ ID NO: 48403 - DNA, 25 bp, Homo sapien
agcccgcagcgagagtgaccagcat

SEQ ID NO: 48404 - DNA, 25 bp, Homo sapien
ccctggaagttgctcgagactgcgc

SEQ ID NO: 48405 - DNA, 25 bp, Homo sapien
gccgcatccagcatccggggaaaag

SEQ ID NO: 48406 - DNA, 25 bp, Homo sapien
ggcggcgacaccagctcaaaacggc

SEQ ID NO: 48407 - DNA, 25 bp, Homo sapien
gggtcctttcggctcagcacgcacg

SEQ ID NO: 48408 - DNA, 25 bp, Homo sapien
gttctccgagcccagtctagcgctt

SEQ ID NO: 48409 - DNA, 25 bp, Homo sapien
agcacgcacggacgcctttagggaa

SEQ ID NO: 48410 - DNA, 25 bp, Homo sapien
ccagcaaaaaatcaggtcggttctc

SEQ ID NO: 48411 - DNA, 25 bp, Homo sapien
ccctgtcgcaagagtttcgggaaca

SEQ ID NO: 48412 - DNA, 25 bp, Homo sapien
ggcacggtcaatcctcctcgagtta

SEQ ID NO: 48413 - DNA, 25 bp, Homo sapien
ttcaagccctttcgtctgccgacga

SEQ ID NO: 48414 - DNA, 25 bp, Homo sapien
tctcattggacggaggcacggtcaa

SEQ ID NO: 48415 - DNA, 25 bp, Homo sapien
caaaggctaaggtcagccgcggttc

SEQ ID NO: 48416 - DNA, 25 bp, Homo sapien
cctcctcgagttagggagccgactg

SEQ ID NO: 48417 - DNA, 25 bp, Homo sapien
cagcctcgtcggattggcttcctgc

SEQ ID NO: 48418 - DNA, 25 bp, Homo sapien
gatcgactgggctcttacagcggcc

SEQ ID NO: 48419 - DNA, 25 bp, Homo sapien
cccgtcacgatagcctctcattgga

SEQ ID NO: 48420 - DNA, 25 bp, Homo sapien
cggggcacgagacaagcgccacaaa

SEQ ID NO: 48421 - DNA, 25 bp, Homo sapien
caagcgccacaaagaaaggggagga

SEQ ID NO: 48422 - DNA, 25 bp, Homo sapien
cgctccgccctttgtgagggactca

SEQ ID NO: 48423 - DNA, 25 bp, Homo sapien
tccctccgtgatctccaggtgacag

SEQ ID NO: 48424 - DNA, 25 bp, Homo sapien
agacgtgcgggaccgtcagcgccct

SEQ ID NO: 48425 - DNA, 25 bp, Homo sapien
cgcgcctctcattcatgcagcgggg

SEQ ID NO: 48426 - DNA, 25 bp, Homo sapien
gacggggaccaggaaaacactgcca

SEQ ID NO: 48427 - DNA, 25 bp, Homo sapien
tttgtgagggactcaccctccagtc

SEQ ID NO: 48428 - DNA, 25 bp, Homo sapien
agggtgaggagcagctttctcttaa

SEQ ID NO: 48429 - DNA, 25 bp, Homo sapien
tcctttagagcagttgaggggcccg

SEQ ID NO: 48430 - DNA, 25 bp, Homo sapien
gcgagggctcctttagagcagttga

SEQ ID NO: 48431 - DNA, 25 bp, Homo sapien
tctcttaagggccaactaggggctc

SEQ ID NO: 48432 - DNA, 25 bp, Homo sapien
gaaaggtacggtgcgcccgctctcc

SEQ ID NO: 48433 - DNA, 25 bp, Homo sapien
ggacttggcccgatgagatacgctc

SEQ ID NO: 48434 - DNA, 25 bp, Homo sapien
cccgatgagatacgctcggtgcccg

SEQ ID NO: 48435 - DNA, 25 bp, Homo sapien
gccaactaggggctcacgggttgtc

SEQ ID NO: 48436 - DNA, 25 bp, Homo sapien
gtgtttaccgacctgacgcagcgtc

SEQ ID NO: 48437 - DNA, 25 bp, Homo sapien
ccggctggcagacatccggcggcat

SEQ ID NO: 48438 - DNA, 25 bp, Homo sapien
gccacgtcagtccagggtgcccagg

SEQ ID NO: 48439 - DNA, 25 bp, Homo sapien
agccctgatccgtgtcctctcggga

SEQ ID NO: 48440 - DNA, 25 bp, Homo sapien
ggcccttttgggaaccgattctgca

SEQ ID NO: 48441 - DNA, 25 bp, Homo sapien
ggagcccttgcctccgaactggacg

SEQ ID NO: 48442 - DNA, 25 bp, Homo sapien
gcgaaagcgcgacacccgctgtctg

SEQ ID NO: 48443 - DNA, 25 bp, Homo sapien
gcaggacctagcatctctggggcga

SEQ ID NO: 48444 - DNA, 25 bp, Homo sapien
ggttgctgtagtcggccaattcgta

SEQ ID NO: 48445 - DNA, 25 bp, Homo sapien
tatcggtctcccgtaggttgctgta

SEQ ID NO: 48446 - DNA, 25 bp, Homo sapien
agacgccctccgatggcttcagctg

SEQ ID NO: 48447 - DNA, 25 bp, Homo sapien
gtagccgagccagaagatgaccttg

SEQ ID NO: 48448 - DNA, 25 bp, Homo sapien
gcgcgcttgaactcgcggctggaac

SEQ ID NO: 48449 - DNA, 25 bp, Homo sapien
atcttgtgcgacaggctggagactt

SEQ ID NO: 48450 - DNA, 25 bp, Homo sapien
tagggacacagcctccacctctgag

SEQ ID NO: 48451 - DNA, 25 bp, Homo sapien
tctggggtccttaaatatcggtctc

SEQ ID NO: 48452 - DNA, 25 bp, Homo sapien
gaaagtcatctcaacgcgcggccgt

SEQ ID NO: 48453 - DNA, 25 bp, Homo sapien
ggggtccctcgaaactgacgctcag

SEQ ID NO: 48454 - DNA, 25 bp, Homo sapien
cagaacctccatggtggccgagaag

SEQ ID NO: 48455 - DNA, 25 bp, Homo sapien
ccacggccaggttcacgatgaaata

SEQ ID NO: 48456 - DNA, 25 bp, Homo sapien
gcaggccactgagaggatgacaagc

SEQ ID NO: 48457 - DNA, 25 bp, Homo sapien
aggttacctgccacggccataagga

SEQ ID NO: 48458 - DNA, 25 bp, Homo sapien
acgctcaggagatcgcggaaagtca

SEQ ID NO: 48459 - DNA, 25 bp, Homo sapien
cccacgtaccggtccacggagatgg

SEQ ID NO: 48460 - DNA, 25 bp, Homo sapien
cgggcagggcaacgtcccataccgt

SEQ ID NO: 48461 - DNA, 25 bp, Homo sapien
gcagggcaacgtcccataccgtcta

SEQ ID NO: 48462 - DNA, 25 bp, Homo sapien
ggcaacgtcccataccgtctaaatc

SEQ ID NO: 48463 - DNA, 25 bp, Homo sapien
ataccgtctaaatcgcgcccatacg

SEQ ID NO: 48464 - DNA, 25 bp, Homo sapien
gcgcccatacgctgccacctgggaa

SEQ ID NO: 48465 - DNA, 25 bp, Homo sapien
cggtgctctaaagtgaggcggagct

SEQ ID NO: 48466 - DNA, 25 bp, Homo sapien
ctctgaggaaatgccccggggcacc

SEQ ID NO: 48467 - DNA, 25 bp, Homo sapien
gagaagcctgtggttggttccagcc

SEQ ID NO: 48468 - DNA, 25 bp, Homo sapien
acctcacagagggagtcacactaac

SEQ ID NO: 48469 - DNA, 25 bp, Homo sapien
ccctctggtggagactggctcggcc

SEQ ID NO: 48470 - DNA, 25 bp, Homo sapien
agcaggctgggccaacggcagtccc

SEQ ID NO: 48471 - DNA, 25 bp, Homo sapien
ccaaccactatgctcacagccagga

SEQ ID NO: 48472 - DNA, 25 bp, Homo sapien
cactaacgtggtcggggctccagag

SEQ ID NO: 48473 - DNA, 25 bp, Homo sapien
tcacactaacgtggtcggggctcca

SEQ ID NO: 48474 - DNA, 25 bp, Homo sapien
cagagggagtcacactaacgtggtc

SEQ ID NO: 48475 - DNA, 25 bp, Homo sapien
ggcctccgcggcactgcattcccac

SEQ ID NO: 48476 - DNA, 25 bp, Homo sapien
gccgccgcaacaaaaagctgcgctg

SEQ ID NO: 48477 - DNA, 25 bp, Homo sapien
cgccgcaacaaaaagctgcgctgac

SEQ ID NO: 48478 - DNA, 25 bp, Homo sapien
aagccgccgcaacaaaaagctgcgc

SEQ ID NO: 48479 - DNA, 25 bp, Homo sapien
ccgcagcgggcggcaaaaacccgtg

SEQ ID NO: 48480 - DNA, 25 bp, Homo sapien
taaataagaaggcagcaaaggccgg

SEQ ID NO: 48481 - DNA, 25 bp, Homo sapien
taagaaggcagcaaaggccgggcaa

SEQ ID NO: 48482 - DNA, 25 bp, Homo sapien
aggcagcaaaggccgggcaaaaagc

SEQ ID NO: 48483 - DNA, 25 bp, Homo sapien
gaaggcagcaaaggccgggcaaaaa

SEQ ID NO: 48484 - DNA, 25 bp, Homo sapien
gttctcttttggtgttatcaccttc

SEQ ID NO: 48485 - DNA, 25 bp, Homo sapien
tggtgttatcaccttccagatttga

SEQ ID NO: 48486 - DNA, 25 bp, Homo sapien
tgctcttttcctgggtagagtcctc

SEQ ID NO: 48487 - DNA, 25 bp, Homo sapien
ccagtgttctcttttggtgttatca

SEQ ID NO: 48488 - DNA, 25 bp, Homo sapien
cagctccagtgttctcttttggtgt

SEQ ID NO: 48489 - DNA, 25 bp, Homo sapien
tcctgggtagagtcctcttgttttc

SEQ ID NO: 48490 - DNA, 25 bp, Homo sapien
tcttttcctgggtagagtcctcttg

SEQ ID NO: 48491 - DNA, 25 bp, Homo sapien
caaattaaggctctgattaaataag

SEQ ID NO: 48492 - DNA, 25 bp, Homo sapien
gctgcagtccaggaaacatcactta

SEQ ID NO: 48493 - DNA, 25 bp, Homo sapien
gcggcaaaaagctgcagtccaggaa

SEQ ID NO: 48494 - DNA, 25 bp, Homo sapien
acatcacttactgtccctgctagtg

SEQ ID NO: 48495 - DNA, 25 bp, Homo sapien
gaaacgtcttttacaatgagactga

SEQ ID NO: 48496 - DNA, 25 bp, Homo sapien
acaatgagactgatagtggactgtg

SEQ ID NO: 48497 - DNA, 25 bp, Homo sapien
actgtgtcttagagccatgaaagga

SEQ ID NO: 48498 - DNA, 25 bp, Homo sapien
cccagagttacaattccctaacata

SEQ ID NO: 48499 - DNA, 25 bp, Homo sapien
gtccctgctagtgttgggaaagaaa

SEQ ID NO: 48500 - DNA, 25 bp, Homo sapien
caatgtaattcttcagagatgttaa

SEQ ID NO: 48501 - DNA, 25 bp, Homo sapien
agctggagctgacccacgggcctgg

SEQ ID NO: 48502 - DNA, 25 bp, Homo sapien
tgacccctgtcaggcggagcagctg

SEQ ID NO: 48503 - DNA, 25 bp, Homo sapien
gcgcgttctgtgtcgccctgcggct

SEQ ID NO: 48504 - DNA, 25 bp, Homo sapien
cctgggcgcgttctgtgtcgccctg

SEQ ID NO: 48505 - DNA, 25 bp, Homo sapien
acgcttttttcgttctgcaggcgaa

SEQ ID NO: 48506 - DNA, 25 bp, Homo sapien
tttgtccaggcgctaatgatgggaa

SEQ ID NO: 48507 - DNA, 25 bp, Homo sapien
aaacgcttttttcgttctgcaggcg

SEQ ID NO: 48508 - DNA, 25 bp, Homo sapien
aagctcccaattcggcattgcctgg

SEQ ID NO: 48509 - DNA, 25 bp, Homo sapien
ggtctcgggtataccgcatctcgcg

SEQ ID NO: 48510 - DNA, 25 bp, Homo sapien
ttccgtcgcctctgcattgtgtttc

SEQ ID NO: 48511 - DNA, 25 bp, Homo sapien
tacccatagggctccacagtcgttc

SEQ ID NO: 48512 - DNA, 25 bp, Homo sapien
gctttaaccagtcaggcaattcatc

SEQ ID NO: 48513 - DNA, 25 bp, Homo sapien
ctcgagctccagctgggtgtcgaga

SEQ ID NO: 48514 - DNA, 25 bp, Homo sapien
ttgtgtttctgttttgcttcggggc

SEQ ID NO: 48515 - DNA, 25 bp, Homo sapien
cgttcctggctttgtagctcgctca

SEQ ID NO: 48516 - DNA, 25 bp, Homo sapien
cgtgggtctggcaggcataaattcc

SEQ ID NO: 48517 - DNA, 25 bp, Homo sapien
caggcataaattccggccgggattc

SEQ ID NO: 48518 - DNA, 25 bp, Homo sapien
cagagcaggactcgccttggcgtct

SEQ ID NO: 48519 - DNA, 25 bp, Homo sapien
actcgccttggcgtctatgagtggg

SEQ ID NO: 48520 - DNA, 25 bp, Homo sapien
ggcgtctatgaggtcccgcccatgc

SEQ ID NO: 48521 - DNA, 25 bp, Homo sapien
tgactgtccgggtccctccaggtac

SEQ ID NO: 48522 - DNA, 25 bp, Homo sapien
cagctccgcggctcttttggtcgcg

SEQ ID NO: 48523 - DNA, 25 bp, Homo sapien
aggtgacggtgcctctgactgtccg

SEQ ID NO: 48524 - DNA, 25 bp, Homo sapien
ggcaggaccgcgactcccaataatg

SEQ ID NO: 48525 - DNA, 25 bp, Homo sapien
tagagtcccgagtcccttttgcgga

SEQ ID NO: 48526 - DNA, 25 bp, Homo sapien
ttttgcggaattaaggagacctctg

SEQ ID NO: 48527 - DNA, 25 bp, Homo sapien
gccgccgctcagatctgaagtccgg

SEQ ID NO: 48528 - DNA, 25 bp, Homo sapien
acctctgacccggagcagctctagg

SEQ ID NO: 48529 - DNA, 25 bp, Homo sapien
cgctcgaagcgggaaaatgtccacg

SEQ ID NO: 48530 - DNA, 25 bp, Homo sapien
cggtcccgagacttcgcgcaaaagg

SEQ ID NO: 48531 - DNA, 25 bp, Homo sapien
cactcacttgagtgtcacgcaagtc

SEQ ID NO: 48532 - DNA, 25 bp, Homo sapien
ctgaggccacagagcgaacacttgt

SEQ ID NO: 48533 - DNA, 25 bp, Homo sapien
gcgctgccgttcttttcaggattga

SEQ ID NO: 48534 - DNA, 25 bp, Homo sapien
caagcctgttatttgtgctggccgc

SEQ ID NO: 48535 - DNA, 25 bp, Homo sapien
tcggaaagctcgaccttttgcgttc

SEQ ID NO: 48536 - DNA, 25 bp, Homo sapien
aggcacctccgagcagcaggtctga

SEQ ID NO: 48537 - DNA, 25 bp, Homo sapien
ggtctgagcgtttttggcgtcccaa

SEQ ID NO: 48538 - DNA, 25 bp, Homo sapien
atttgactctttgctgggaggcgcg

SEQ ID NO: 48539 - DNA, 25 bp, Homo sapien
gaagcggaccctaggcctctcctgt

SEQ ID NO: 48540 - DNA, 25 bp, Homo sapien
ctcgttcctcttggggcctgaattt

SEQ ID NO: 48541 - DNA, 25 bp, Homo sapien
tacggcctgtgggtattagctctaa

SEQ ID NO: 48542 - DNA, 25 bp, Homo sapien
ctagtgagcacctgcccggtacttt

SEQ ID NO: 48543 - DNA, 25 bp, Homo sapien
ccatttagaacggtgcctcggactc

SEQ ID NO: 48544 - DNA, 25 bp, Homo sapien
acttctggtactttgcgtggtgcca

SEQ ID NO: 48545 - DNA, 25 bp, Homo sapien
ccagtgggtgaaccgccatttagaa

SEQ ID NO: 48546 - DNA, 25 bp, Homo sapien
cggccggagttcttcccttgatctc

SEQ ID NO: 48547 - DNA, 25 bp, Homo sapien
gccgatgctcctgaccactctagtg

SEQ ID NO: 48548 - DNA, 25 bp, Homo sapien
ctcctcctgagaaggcgacaatctc

SEQ ID NO: 48549 - DNA, 25 bp, Homo sapien
ccgaaggcgggtctgccataaacaa

SEQ ID NO: 48550 - DNA, 25 bp, Homo sapien
attcctcaaaattccggctgcgctg

SEQ ID NO: 48551 - DNA, 25 bp, Homo sapien
cgctgaatcgggctgcttttgccgc

SEQ ID NO: 48552 - DNA, 25 bp, Homo sapien
tgcaccttagtgtttcgaggacaga

SEQ ID NO: 48553 - DNA, 25 bp, Homo sapien
agctcttggacctgcaacaccggga

SEQ ID NO: 48554 - DNA, 25 bp, Homo sapien
cgcgccgttttcacgtgtgtgtgta

SEQ ID NO: 48555 - DNA, 25 bp, Homo sapien
tgaccttcccgagagccacaggggc

SEQ ID NO: 48556 - DNA, 25 bp, Homo sapien
gaggctcaagctataggctgtccta

SEQ ID NO: 48557 - DNA, 25 bp, Homo sapien
tgcgacaatttactgggatcctttt

SEQ ID NO: 48558 - DNA, 25 bp, Homo sapien
ttctgggtcataaacgccgaggtcg

SEQ ID NO: 48559 - DNA, 25 bp, Homo sapien
acagggcctgtgctttcgttgcagg

SEQ ID NO: 48560 - DNA, 25 bp, Homo sapien
tccgaaagtgagaccttgagtcctc

SEQ ID NO: 48561 - DNA, 25 bp, Homo sapien
cgaagtggtttgcaatccgaaagtg

SEQ ID NO: 48562 - DNA, 25 bp, Homo sapien
gctccaggatcccaatatgtgcttg

SEQ ID NO: 48563 - DNA, 25 bp, Homo sapien
gaatacgtaggatacccgcgggcga

SEQ ID NO: 48564 - DNA, 25 bp, Homo sapien
cgccggcagattggagtctgctctc

SEQ ID NO: 48565 - DNA, 25 bp, Homo sapien
aggagtccggggatccctaattatg

SEQ ID NO: 48566 - DNA, 25 bp, Homo sapien
ccctggtgcgcaacactggttggta

SEQ ID NO: 48567 - DNA, 25 bp, Homo sapien
aacggcaatttcagggccatgagca

SEQ ID NO: 48568 - DNA, 25 bp, Homo sapien
ggcgatttcaaagcagattagatta

SEQ ID NO: 48569 - DNA, 25 bp, Homo sapien
ttttttatgcgggaggagctgcctc

SEQ ID NO: 48570 - DNA, 25 bp, Homo sapien
gagaccctttccagttcggcctgtg

SEQ ID NO: 48571 - DNA, 25 bp, Homo sapien
ccgtttggccacgagaatggcgatt

SEQ ID NO: 48572 - DNA, 25 bp, Homo sapien
tcggtcatcatcaccaacgggaggt

SEQ ID NO: 48573 - DNA, 25 bp, Homo sapien
ttgaaatcgggcttcacgcgtcttg

SEQ ID NO: 48574 - DNA, 25 bp, Homo sapien
agctgcccttcgtgctgctcaacta

SEQ ID NO: 48575 - DNA, 25 bp, Homo sapien
agagacagctgtttgaattggaccc

SEQ ID NO: 48576 - DNA, 25 bp, Homo sapien
tgctgccctctaacgtgtcgcctgt

SEQ ID NO: 48577 - DNA, 25 bp, Homo sapien
acgttccacaacagtcccgctgggg

SEQ ID NO: 48578 - DNA, 25 bp, Homo sapien
tcctgagattggacagcacggccta

SEQ ID NO: 48579 - DNA, 25 bp, Homo sapien
tgcgcacgacctacattaatttatg

SEQ ID NO: 48580 - DNA, 25 bp, Homo sapien
gatgccacagctcggccggaaggct

SEQ ID NO: 48581 - DNA, 25 bp, Homo sapien
ttatgaagccgtaaccggccagcgc

SEQ ID NO: 48582 - DNA, 25 bp, Homo sapien
aatcctgggcccacccatttgcgtg

SEQ ID NO: 48583 - DNA, 25 bp, Homo sapien
cacccatttgcgtggatgccacagc

SEQ ID NO: 48584 - DNA, 25 bp, Homo sapien
cttgagagcgacaccggcctgaacc

SEQ ID NO: 48585 - DNA, 25 bp, Homo sapien
cacttctcctcagcgtctgggtgct

SEQ ID NO: 48586 - DNA, 25 bp, Homo sapien
ctgcagacggttcgccttgtccact

SEQ ID NO: 48587 - DNA, 25 bp, Homo sapien
ccgtggaactgggatttatgaagcc

SEQ ID NO: 48588 - DNA, 25 bp, Homo sapien
cactgctggcgtccggctgtcaatc

SEQ ID NO: 48589 - DNA, 25 bp, Homo sapien
ccaaacgccggctcgaagtgtggga

SEQ ID NO: 48590 - DNA, 25 bp, Homo sapien
tgcgcgcctagagtcacgcgtccag

SEQ ID NO: 48591 - DNA, 25 bp, Homo sapien
ggcgtccggctgtcaatccacagct

SEQ ID NO: 48592 - DNA, 25 bp, Homo sapien
ccacctggctgtcgctgacgcagaa

SEQ ID NO: 48593 - DNA, 25 bp, Homo sapien
acgtcctcacaggtgcgcgcctaga

SEQ ID NO: 48594 - DNA, 25 bp, Homo sapien
ccgcgccgcagaaggtgaaggaaca

SEQ ID NO: 48595 - DNA, 25 bp, Homo sapien
tgacgcagaagacgcggccgccacg

SEQ ID NO: 48596 - DNA, 25 bp, Homo sapien
aagcggcgacttcggcacctggaca

SEQ ID NO: 48597 - DNA, 25 bp, Homo sapien
ctccgggaccgctgaaacgcaccca

SEQ ID NO: 48598 - DNA, 25 bp, Homo sapien
aggcgtagtcgccaaggacagcgca

SEQ ID NO: 48599 - DNA, 25 bp, Homo sapien
catgggagccggaacctaccgtggc

SEQ ID NO: 48600 - DNA, 25 bp, Homo sapien
cctaccgtggcaaagggccaggtcg

SEQ ID NO: 48601 - DNA, 25 bp, Homo sapien
acctctggccacacgggctgagacg

SEQ ID NO: 48602 - DNA, 25 bp, Homo sapien
acacgggctgagacgtctggctcct

SEQ ID NO: 48603 - DNA, 25 bp, Homo sapien
gcgtccctacctgcaggcctgatac

SEQ ID NO: 48604 - DNA, 25 bp, Homo sapien
tgcggccttacagggccgaacctca

SEQ ID NO: 48605 - DNA, 25 bp, Homo sapien
ggaacgcgggcctttcgccgctagc

SEQ ID NO: 48606 - DNA, 25 bp, Homo sapien
ctgcggaaggcaggcctacaccttc

SEQ ID NO: 48607 - DNA, 25 bp, Homo sapien
tgcaactgggctctctgcgcagggc

SEQ ID NO: 48608 - DNA, 25 bp, Homo sapien
ccgacttacttctgaggccgaaacg

SEQ ID NO: 48609 - DNA, 25 bp, Homo sapien
caaccgtgctttttagcggcgagta

SEQ ID NO: 48610 - DNA, 25 bp, Homo sapien
tcgactcaggagacggctgttccct

SEQ ID NO: 48611 - DNA, 25 bp, Homo sapien
cgcaggtcctagtcaaccgtgcttt

SEQ ID NO: 48612 - DNA, 25 bp, Homo sapien
ctggggcgtgaccacctgtccaggc

SEQ ID NO: 48613 - DNA, 25 bp, Homo sapien
tttctggtaagtagagtgagccatg

SEQ ID NO: 48614 - DNA, 25 bp, Homo sapien
tcctggggcgtgaccacctgtccag

SEQ ID NO: 48615 - DNA, 25 bp, Homo sapien
tggtaagtagagtgagccatgtctt

SEQ ID NO: 48616 - DNA, 25 bp, Homo sapien
atttttctggtaagtagagtgagcc

SEQ ID NO: 48617 - DNA, 25 bp, Homo sapien
tttttctggtaagtagagtgagcca

SEQ ID NO: 48618 - DNA, 25 bp, Homo sapien
tctggtaagtagagtgagccatgtc

SEQ ID NO: 48619 - DNA, 25 bp, Homo sapien
ctggtaagtagagtgagccatgtct

SEQ ID NO: 48620 - DNA, 25 bp, Homo sapien
ccgctgccgctctaaggcggtggaa

SEQ ID NO: 48621 - DNA, 25 bp, Homo sapien
cgcgttagcccgagtggatctaggc

SEQ ID NO: 48622 - DNA, 25 bp, Homo sapien
cggagaagccgggactcctcacatc

SEQ ID NO: 48623 - DNA, 25 bp, Homo sapien
tccgatgctcgcacaggaccaaagc

SEQ ID NO: 48624 - DNA, 25 bp, Homo sapien
gtggaagcgagattctccggaaacc

SEQ ID NO: 48625 - DNA, 25 bp, Homo sapien
cggacccgaggattcggtagatgtc

SEQ ID NO: 48626 - DNA, 25 bp, Homo sapien
cttctgtctcctggaagggtcgccg

SEQ ID NO: 48627 - DNA, 25 bp, Homo sapien
cggaaacccagggaatccgatgctc

SEQ ID NO: 48628 - DNA, 25 bp, Homo sapien
ccctgcccattcgtggagacttcta

SEQ ID NO: 48629 - DNA, 25 bp, Homo sapien
tgcgtggctgacacctccgctgggt

SEQ ID NO: 48630 - DNA, 25 bp, Homo sapien
gtgagtagtccctttgtgcgcaacc

SEQ ID NO: 48631 - DNA, 25 bp, Homo sapien
gtgcctactgtgtctgcatgggttg

SEQ ID NO: 48632 - DNA, 25 bp, Homo sapien
cgtccctcgctgaggtgcctactgt

SEQ ID NO: 48633 - DNA, 25 bp, Homo sapien
tcagcgctgagttctccgcgcaagc

SEQ ID NO: 48634 - DNA, 25 bp, Homo sapien
ccttttgtgtcggtgtccgcgctcc

SEQ ID NO: 48635 - DNA, 25 bp, Homo sapien
tctatttctcattcgaggcggggta

SEQ ID NO: 48636 - DNA, 25 bp, Homo sapien
tcatgccaagacctgcgcctaacgg

SEQ ID NO: 48637 - DNA, 25 bp, Homo sapien
gccctgttgcagctctcatgccaag

SEQ ID NO: 48638 - DNA, 25 bp, Homo sapien
ttccggcggtcatcatttattcttg

SEQ ID NO: 48639 - DNA, 25 bp, Homo sapien
ccagcagcgtatagacgagcccatg

SEQ ID NO: 48640 - DNA, 25 bp, Homo sapien
cgagcccatgtctgcgatgtaactg

SEQ ID NO: 48641 - DNA, 25 bp, Homo sapien
cgtcctccagcgtatgctaggcagg

SEQ ID NO: 48642 - DNA, 25 bp, Homo sapien
tgagtagagcaacgcacagcacatc

SEQ ID NO: 48643 - DNA, 25 bp, Homo sapien
gccgcttctcttttttatcaccaca

SEQ ID NO: 48644 - DNA, 25 bp, Homo sapien
gcagccagcagaaacccgttctagg

SEQ ID NO: 48645 - DNA, 25 bp, Homo sapien
cgttgcccagtgacttcagtgagtg

SEQ ID NO: 48646 - DNA, 25 bp, Homo sapien
gtcggcgttagctggattggaaaca

SEQ ID NO: 48647 - DNA, 25 bp, Homo sapien
cagtccagacagaacgatgggctct

SEQ ID NO: 48648 - DNA, 25 bp, Homo sapien
acagtgaagcaccatgcagcgccca

SEQ ID NO: 48649 - DNA, 25 bp, Homo sapien
tgagaccctcgtgaagagactaagc

SEQ ID NO: 48650 - DNA, 25 bp, Homo sapien
ctgctcacactacgaggttaactgc

SEQ ID NO: 48651 - DNA, 25 bp, Homo sapien
gttaactgccgtgagatctgcctgc

SEQ ID NO: 48652 - DNA, 25 bp, Homo sapien
tttaacttggtaatgcctgccctcc

SEQ ID NO: 48653 - DNA, 25 bp, Homo sapien
cgcccaatggagttgtctttcagga

SEQ ID NO: 48654 - DNA, 25 bp, Homo sapien
agcctgcgcaggaaggatgacgctc

SEQ ID NO: 48655 - DNA, 25 bp, Homo sapien
aaatgctcctttgctgtccgggtta

SEQ ID NO: 48656 - DNA, 25 bp, Homo sapien
tagggacagtcttacgccggaaatg

SEQ ID NO: 48657 - DNA, 25 bp, Homo sapien
ctccctagctccgaggggcgaatgc

SEQ ID NO: 48658 - DNA, 25 bp, Homo sapien
taatcttgatgtccagggcggtccc

SEQ ID NO: 48659 - DNA, 25 bp, Homo sapien
ccctgcgtgctagtcctgcaaagcg

SEQ ID NO: 48660 - DNA, 25 bp, Homo sapien
ttgctccggaggaaaacaggcttgc

SEQ ID NO: 48661 - DNA, 25 bp, Homo sapien
gcgaatgccctaaagctccgaagtt

SEQ ID NO: 48662 - DNA, 25 bp, Homo sapien
agggctggtcacctttgcttgctga

SEQ ID NO: 48663 - DNA, 25 bp, Homo sapien
tttcgggtatttgctaccggctctc

SEQ ID NO: 48664 - DNA, 25 bp, Homo sapien
ccaggaaatcgcaggctcggaagcc

SEQ ID NO: 48665 - DNA, 25 bp, Homo sapien
tctctcgggcctcaagttttcctga

SEQ ID NO: 48666 - DNA, 25 bp, Homo sapien
ccgcagatttcctgctggaacgttc

SEQ ID NO: 48667 - DNA, 25 bp, Homo sapien
gggtgcacgtccttactgcccgtga

SEQ ID NO: 48668 - DNA, 25 bp, Homo sapien
tcgacatggcgctgaggcggccacc

SEQ ID NO: 48669 - DNA, 25 bp, Homo sapien
agcaaccctcgacatggcgctgagg

SEQ ID NO: 48670 - DNA, 25 bp, Homo sapien
cgcgtttccgctgttgggagactag

SEQ ID NO: 48671 - DNA, 25 bp, Homo sapien
gtgagtttgcgcgtttccgctgttg

SEQ ID NO: 48672 - DNA, 25 bp, Homo sapien
tctgcgctcggctgcctgacttctt

SEQ ID NO: 48673 - DNA, 25 bp, Homo sapien
cctgctgctgcttttcaggggtgag

SEQ ID NO: 48674 - DNA, 25 bp, Homo sapien
catgcgcgcggggactacaagccgc

SEQ ID NO: 48675 - DNA, 25 bp, Homo sapien
gctgctgcttttcaggggtgagttt

SEQ ID NO: 48676 - DNA, 25 bp, Homo sapien
ggcgtttagcaacacctttccctca

SEQ ID NO: 48677 - DNA, 25 bp, Homo sapien
ttgtaacaagcccatcctgtctgga

SEQ ID NO: 48678 - DNA, 25 bp, Homo sapien
ctgcagggtgtttagcagcattctc

SEQ ID NO: 48679 - DNA, 25 bp, Homo sapien
tgcctctgatcacagggtgccagta

SEQ ID NO: 48680 - DNA, 25 bp, Homo sapien
gggtgccagtagcagagtcctctca

SEQ ID NO: 48681 - DNA, 25 bp, Homo sapien
aaaacttgcccttgactgagaacca

SEQ ID NO: 48682 - DNA, 25 bp, Homo sapien
gctaagcctagggtcagtccaaata

SEQ ID NO: 48683 - DNA, 25 bp, Homo sapien
atgcctccatatattgccctctgtc

SEQ ID NO: 48684 - DNA, 25 bp, Homo sapien
ggatttttccgcgagtggctgcatt

SEQ ID NO: 48685 - DNA, 25 bp, Homo sapien
tgagcaccactgtcatcgcggggac

SEQ ID NO: 48686 - DNA, 25 bp, Homo sapien
cgctggggatgagcaccactgtcat

SEQ ID NO: 48687 - DNA, 25 bp, Homo sapien
ctcgctgcgtctttcagggctgcag

SEQ ID NO: 48688 - DNA, 25 bp, Homo sapien
ctgggcagccgacgcaccgctaggt

SEQ ID NO: 48689 - DNA, 25 bp, Homo sapien
cgagtggctgcattggctttaagaa

SEQ ID NO: 48690 - DNA, 25 bp, Homo sapien
aggagctgctgcgatgacacccagt

SEQ ID NO: 48691 - DNA, 25 bp, Homo sapien
gctttaagaaactgcgccgggctgg

SEQ ID NO: 48692 - DNA, 25 bp, Homo sapien
acggggtggcttcactcaatcatga

SEQ ID NO: 48693 - DNA, 25 bp, Homo sapien
taggagactccattctgctcgcggc

SEQ ID NO: 48694 - DNA, 25 bp, Homo sapien
ccacgcagagagacgtcatgaaatc

SEQ ID NO: 48695 - DNA, 25 bp, Homo sapien
tgctactcaattccagccgactggc

SEQ ID NO: 48696 - DNA, 25 bp, Homo sapien
cgcggctccgagataaaagcgagtg

SEQ ID NO: 48697 - DNA, 25 bp, Homo sapien
ggctgggcacaaaccaacgtgcatc

SEQ ID NO: 48698 - DNA, 25 bp, Homo sapien
cgccactggaaacgtgggtgctcca

SEQ ID NO: 48699 - DNA, 25 bp, Homo sapien
cccagtgccactaagtaagttattc

SEQ ID NO: 48700 - DNA, 25 bp, Homo sapien
cggttgcgacactaagacgtttata

SEQ ID NO: 48701 - DNA, 25 bp, Homo sapien
aggtttggacactacgcgccctgct

SEQ ID NO: 48702 - DNA, 25 bp, Homo sapien
aggaacccagcacgcgactactgga

SEQ ID NO: 48703 - DNA, 25 bp, Homo sapien
agtgatatttttccagcctcattga

SEQ ID NO: 48704 - DNA, 25 bp, Homo sapien
tttataaaatgaccgcggactgccc

SEQ ID NO: 48705 - DNA, 25 bp, Homo sapien
cctcgatgctgatgagaactgggac

SEQ ID NO: 48706 - DNA, 25 bp, Homo sapien
tctgaccgacgcacgcggtgacagc

SEQ ID NO: 48707 - DNA, 25 bp, Homo sapien
ctaactcggggtcgcttttagcgag

SEQ ID NO: 48708 - DNA, 25 bp, Homo sapien
ttcctgcgtgctagggccgctgtct

SEQ ID NO: 48709 - DNA, 25 bp, Homo sapien
acgccgagcgctccacggaaagtct

SEQ ID NO: 48710 - DNA, 25 bp, Homo sapien
ggttacttcctccagagactgacga

SEQ ID NO: 48711 - DNA, 25 bp, Homo sapien
tgcggtgtcgctccagctcagagct

SEQ ID NO: 48712 - DNA, 25 bp, Homo sapien
cgcggctccagtcccatggagggtc

SEQ ID NO: 48713 - DNA, 25 bp, Homo sapien
cactgacacgcagatctcggggcgc

SEQ ID NO: 48714 - DNA, 25 bp, Homo sapien
gctcgttttccggttatggagtggc

SEQ ID NO: 48715 - DNA, 25 bp, Homo sapien
ccgtcgctgcggaattccaaaggca

SEQ ID NO: 48716 - DNA, 25 bp, Homo sapien
cgtccagcccgacacggaggactga

SEQ ID NO: 48717 - DNA, 25 bp, Homo sapien
ggttcacgcccgaggaactgcacgc

SEQ ID NO: 48718 - DNA, 25 bp, Homo sapien
agcgctacgtgtaccgcttcgtgtg

SEQ ID NO: 48719 - DNA, 25 bp, Homo sapien
accgcttcgtgtgcgacctccagaa

SEQ ID NO: 48720 - DNA, 25 bp, Homo sapien
cggggcttacgctactattacgaca

SEQ ID NO: 48721 - DNA, 25 bp, Homo sapien
tccacaagacgtcggggaagcgcta

SEQ ID NO: 48722 - DNA, 25 bp, Homo sapien
cgacaagaacatcatccacaagacg

SEQ ID NO: 48723 - DNA, 25 bp, Homo sapien
ccagaacttgctggggttcacgccc

SEQ ID NO: 48724 - DNA, 25 bp, Homo sapien
cccaaaggctttcattcgcagcttg

SEQ ID NO: 48725 - DNA, 25 bp, Homo sapien
gaaacgccagcagatccacgcgaga

SEQ ID NO: 48726 - DNA, 25 bp, Homo sapien
acgcgagaaccacacacacctgggg

SEQ ID NO: 48727 - DNA, 25 bp, Homo sapien
tggacgccgcggcttcacggagacc

SEQ ID NO: 48728 - DNA, 25 bp, Homo sapien
ttcaccacctctccgaagaacgtgg

SEQ ID NO: 48729 - DNA, 25 bp, Homo sapien
cgtgaccggctggacacaactgcag

SEQ ID NO: 48730 - DNA, 25 bp, Homo sapien
gactctagcgatcgtcctccttaga

SEQ ID NO: 48731 - DNA, 25 bp, Homo sapien
tcgaactccaggactctagcgatcg

SEQ ID NO: 48732 - DNA, 25 bp, Homo sapien
ggacactggggacgccaagtccgca

SEQ ID NO: 48733 - DNA, 25 bp, Homo sapien
ggcgagcatccctcagggcaaggtc

SEQ ID NO: 48734 - DNA, 25 bp, Homo sapien
gaagacaaggagtcaggtcaagccc

SEQ ID NO: 48735 - DNA, 25 bp, Homo sapien
ttacccgactcgatgagaggcaccg

SEQ ID NO: 48736 - DNA, 25 bp, Homo sapien
gaagtagttcctccgcgggagacga

SEQ ID NO: 48737 - DNA, 25 bp, Homo sapien
ccggggaggcgaacctcgctcagct

SEQ ID NO: 48738 - DNA, 25 bp, Homo sapien
aaagtgacgcggaggcaaagacctg

SEQ ID NO: 48739 - DNA, 25 bp, Homo sapien
gtccgaatccctgcgcgcaatgagg

SEQ ID NO: 48740 - DNA, 25 bp, Homo sapien
gcgccgacagccttcgcgaaactgg

SEQ ID NO: 48741 - DNA, 25 bp, Homo sapien
atggaaccggattgggagcccgcct

SEQ ID NO: 48742 - DNA, 25 bp, Homo sapien
cattggctacgggactcagcccgcg

SEQ ID NO: 48743 - DNA, 25 bp, Homo sapien
gtgaggcgggcccttaattgatccc

SEQ ID NO: 48744 - DNA, 25 bp, Homo sapien
tccggcctcacggtagtttgaagcc

SEQ ID NO: 48745 - DNA, 25 bp, Homo sapien
agtttgaagccgagccgcaaagtgc

SEQ ID NO: 48746 - DNA, 25 bp, Homo sapien
cgcaaagtgcggtctgcgcgctgat

SEQ ID NO: 48747 - DNA, 25 bp, Homo sapien
acccacaattcttctggatacctgg

SEQ ID NO: 48748 - DNA, 25 bp, Homo sapien
ttccaacgaaaaacgctggcgagcg

SEQ ID NO: 48749 - DNA, 25 bp, Homo sapien
gaaaacgctgtgctgagcccggcag

SEQ ID NO: 48750 - DNA, 25 bp, Homo sapien
tgagcccggcagaagtctgccctca

SEQ ID NO: 48751 - DNA, 25 bp, Homo sapien
ctcacactcagaatcgccgtaaatg

SEQ ID NO: 48752 - DNA, 25 bp, Homo sapien
tgtgcaacgtatattccaacgaaaa

SEQ ID NO: 48753 - DNA, 25 bp, Homo sapien
tgtggtgtcgcctcccgaggtgcac

SEQ ID NO: 48754 - DNA, 25 bp, Homo sapien
gctcccggacggacaacggctacag

SEQ ID NO: 48755 - DNA, 25 bp, Homo sapien
cgccgtaaatgtgcaacgtatattc

SEQ ID NO: 48756 - DNA, 25 bp, Homo sapien
atccttcgtaagtggctgcctggcc

SEQ ID NO: 48757 - DNA, 25 bp, Homo sapien
agcttcgtgtttggatgcaatgttc

SEQ ID NO: 48758 - DNA, 25 bp, Homo sapien
cgactgaaggccgtagtagcgtctt

SEQ ID NO: 48759 - DNA, 25 bp, Homo sapien
gcggcgaacctcacactgggagttc

SEQ ID NO: 48760 - DNA, 25 bp, Homo sapien
gctgtcagcctcgtttccgttaatc

SEQ ID NO: 48761 - DNA, 25 bp, Homo sapien
cctggttcctagaggcattcgagca

SEQ ID NO: 48762 - DNA, 25 bp, Homo sapien
ttccaggtcccggagagatggatcc

SEQ ID NO: 48763 - DNA, 25 bp, Homo sapien
cggaacgtgttaaccgctccaactg

SEQ ID NO: 48764 - DNA, 25 bp, Homo sapien
gcaagccgcacgcactgcacaggtg

SEQ ID NO: 48765 - DNA, 25 bp, Homo sapien
gcgccctaggactggcgctggctca

SEQ ID NO: 48766 - DNA, 25 bp, Homo sapien
aacggcactactacgcaggcgtcgc

SEQ ID NO: 48767 - DNA, 25 bp, Homo sapien
gctcaaggtccgtgcaaactgcatg

SEQ ID NO: 48768 - DNA, 25 bp, Homo sapien
ggggtcaaagtccatgcaagccgca

SEQ ID NO: 48769 - DNA, 25 bp, Homo sapien
gcgcgggctcagagtctatgcaaac

SEQ ID NO: 48770 - DNA, 25 bp, Homo sapien
gcatacactgtgcaggcgccctagg

SEQ ID NO: 48771 - DNA, 25 bp, Homo sapien
actgcatgcactgcgcaggtgctcc

SEQ ID NO: 48772 - DNA, 25 bp, Homo sapien
tggactaggccttcccggcagatct

SEQ ID NO: 48773 - DNA, 25 bp, Homo sapien
cagtccttggactaggccttcccgg

SEQ ID NO: 48774 - DNA, 25 bp, Homo sapien
aggccttcccggcagatctgcgggc

SEQ ID NO: 48775 - DNA, 25 bp, Homo sapien
ccgttccctggagagtggacggctg

SEQ ID NO: 48776 - DNA, 25 bp, Homo sapien
tccagtcacctctcccatcccggtg

SEQ ID NO: 48777 - DNA, 25 bp, Homo sapien
gactcctccgttgcgctccagtcac

SEQ ID NO: 48778 - DNA, 25 bp, Homo sapien
gcggtcactgccgactcctccgttg

SEQ ID NO: 48779 - DNA, 25 bp, Homo sapien
ccgcgcagtccttggactaggcctt

SEQ ID NO: 48780 - DNA, 25 bp, Homo sapien
cggggtagctgttccttggcaaact

SEQ ID NO: 48781 - DNA, 25 bp, Homo sapien
tccttggcaaactgtgccgcgagga

SEQ ID NO: 48782 - DNA, 25 bp, Homo sapien
agtgaccggcgatactggaagccca

SEQ ID NO: 48783 - DNA, 25 bp, Homo sapien
ctggaagcccagaaagagcgtagca

SEQ ID NO: 48784 - DNA, 25 bp, Homo sapien
tggcctcgcgtttgtcttcggtgac

SEQ ID NO: 48785 - DNA, 25 bp, Homo sapien
cttcggtgacgggaagtgagtttct

SEQ ID NO: 48786 - DNA, 25 bp, Homo sapien
tgagtttcttgtgtagacgtctgta

SEQ ID NO: 48787 - DNA, 25 bp, Homo sapien
agacgtctgtaaacgatcctcctgc

SEQ ID NO: 48788 - DNA, 25 bp, Homo sapien
gcaggtcactgcaaagtcgtggggc

SEQ ID NO: 48789 - DNA, 25 bp, Homo sapien
gcagacccgagggaacctttgcgga

SEQ ID NO: 48790 - DNA, 25 bp, Homo sapien
ggccgaacctaccatcctcgagagt

SEQ ID NO: 48791 - DNA, 25 bp, Homo sapien
tggtggtgatgatttcctgagaaga

SEQ ID NO: 48792 - DNA, 25 bp, Homo sapien
tgatgatttcctgagaagaaggccc

SEQ ID NO: 48793 - DNA, 25 bp, Homo sapien
tttcctgagaagaaggccccgtgcc

SEQ ID NO: 48794 - DNA, 25 bp, Homo sapien
gaggtcacgagggaaggcttttcca

SEQ ID NO: 48795 - DNA, 25 bp, Homo sapien
ctaccatcctcgagagtggtggtga

SEQ ID NO: 48796 - DNA, 25 bp, Homo sapien
actgcttagggcagacatttctttt

SEQ ID NO: 48797 - DNA, 25 bp, Homo sapien
gcttagggcagacatttctttttta

SEQ ID NO: 48798 - DNA, 25 bp, Homo sapien
ctgcttagggcagacatttcttttt

SEQ ID NO: 48799 - DNA, 25 bp, Homo sapien
aactgcttagggcagacatttcttt

SEQ ID NO: 48800 - DNA, 25 bp, Homo sapien
ccattttcatgaaactgcttagggc

SEQ ID NO: 48801 - DNA, 25 bp, Homo sapien
tccattttcatgaaactgcttaggg

SEQ ID NO: 48802 - DNA, 25 bp, Homo sapien
atccattttcatgaaactgcttagg

SEQ ID NO: 48803 - DNA, 25 bp, Homo sapien
tgcttagggcagacatttctttttt

SEQ ID NO: 48804 - DNA, 25 bp, Homo sapien
aaattgtaataaatatgccggcgga

SEQ ID NO: 48805 - DNA, 25 bp, Homo sapien
atttgcctgaaacttgattgttcag

SEQ ID NO: 48806 - DNA, 25 bp, Homo sapien
cctgaaacttgattgttcaggctca

SEQ ID NO: 48807 - DNA, 25 bp, Homo sapien
tctctactgaatactcttgtgcttg

SEQ ID NO: 48808 - DNA, 25 bp, Homo sapien
cttgcttttgtatttatccattttc

SEQ ID NO: 48809 - DNA, 25 bp, Homo sapien
tgtaataaatatgccggcggatggt

SEQ ID NO: 48810 - DNA, 25 bp, Homo sapien
actgaatactcttgtgcttgctttt

SEQ ID NO: 48811 - DNA, 25 bp, Homo sapien
gtgcttgcttttgtatttatccatt

SEQ ID NO: 48812 - DNA, 25 bp, Homo sapien
aaccgtggacagaacgggccaccag

SEQ ID NO: 48813 - DNA, 25 bp, Homo sapien
ccaccagagaaaccgtggacaggag

SEQ ID NO: 48814 - DNA, 25 bp, Homo sapien
ggttaccagagaaaccgtggacaga

SEQ ID NO: 48815 - DNA, 25 bp, Homo sapien
accgtggacagaacgggccaccaga

SEQ ID NO: 48816 - DNA, 25 bp, Homo sapien
cgggccaccagagaaaccgtggaca

SEQ ID NO: 48817 - DNA, 25 bp, Homo sapien
gacagaacgggccaccagagaaacc

SEQ ID NO: 48818 - DNA, 25 bp, Homo sapien
accagagaaaccgtggacagaacgg

SEQ ID NO: 48819 - DNA, 25 bp, Homo sapien
gttaccagagaaaccgtggacagaa

SEQ ID NO: 48820 - DNA, 25 bp, Homo sapien
ccttgcctgcggagattgatggact

SEQ ID NO: 48821 - DNA, 25 bp, Homo sapien
ttagacgaactctacgacgccggag

SEQ ID NO: 48822 - DNA, 25 bp, Homo sapien
tgcctttgcccggttcctgttagac

SEQ ID NO: 48823 - DNA, 25 bp, Homo sapien
cggtcctccgctgtacagttgaaaa

SEQ ID NO: 48824 - DNA, 25 bp, Homo sapien
atattgctgtgaatacggtcctccg

SEQ ID NO: 48825 - DNA, 25 bp, Homo sapien
gtgtttcctttctgggcaccttcta

SEQ ID NO: 48826 - DNA, 25 bp, Homo sapien
gctacccgctgcaacacctgtgttt

SEQ ID NO: 48827 - DNA, 25 bp, Homo sapien
ggcggctcctggaatgacattggaa

SEQ ID NO: 48828 - DNA, 25 bp, Homo sapien
atctttgccgtgctccggcctcagt

SEQ ID NO: 48829 - DNA, 25 bp, Homo sapien
ccggtcaatgataaggaaacgaaat

SEQ ID NO: 48830 - DNA, 25 bp, Homo sapien
tcacaaaccgaaaggctcaccattc

SEQ ID NO: 48831 - DNA, 25 bp, Homo sapien
ggagagagccagtatccacatgccc

SEQ ID NO: 48832 - DNA, 25 bp, Homo sapien
tcagtcacatggatccctctgccaa

SEQ ID NO: 48833 - DNA, 25 bp, Homo sapien
tggggcgctctgcagtcttaaagca

SEQ ID NO: 48834 - DNA, 25 bp, Homo sapien
cagcagagacgtgcagccgaactga

SEQ ID NO: 48835 - DNA, 25 bp, Homo sapien
tcaccattcgcgaagctctggaaca

SEQ ID NO: 48836 - DNA, 25 bp, Homo sapien
agcctcgtcacatccgttggccgtg

SEQ ID NO: 48837 - DNA, 25 bp, Homo sapien
cccggtatcagatgagcctcgtcac

SEQ ID NO: 48838 - DNA, 25 bp, Homo sapien
agagacgcctccacgcggcttagcg

SEQ ID NO: 48839 - DNA, 25 bp, Homo sapien
ttcttggccatggtagacaacctgc

SEQ ID NO: 48840 - DNA, 25 bp, Homo sapien
gccgcggccacgaaccgcgtagttg

SEQ ID NO: 48841 - DNA, 25 bp, Homo sapien
ggggccctagttcaggccctcgctg

SEQ ID NO: 48842 - DNA, 25 bp, Homo sapien
ctacctggagatgctgatcgggacc

SEQ ID NO: 48843 - DNA, 25 bp, Homo sapien
cgcggctactacctggagatgctga

SEQ ID NO: 48844 - DNA, 25 bp, Homo sapien
cgtgcgtgtcaaagggctgcctttc

SEQ ID NO: 48845 - DNA, 25 bp, Homo sapien
tcccagcgaggtagcagctgccatg

SEQ ID NO: 48846 - DNA, 25 bp, Homo sapien
gcactccgagaagacaagacaactg

SEQ ID NO: 48847 - DNA, 25 bp, Homo sapien
gcccaacgtgtatcgagctaaagta

SEQ ID NO: 48848 - DNA, 25 bp, Homo sapien
atccgaatgtgaaaggcagcccaac

SEQ ID NO: 48849 - DNA, 25 bp, Homo sapien
tttgccctcgtcaggcgacatttcg

SEQ ID NO: 48850 - DNA, 25 bp, Homo sapien
cttccggtagtaactgtcacctttg

SEQ ID NO: 48851 - DNA, 25 bp, Homo sapien
actgctcctcggtgcattgctgctc

SEQ ID NO: 48852 - DNA, 25 bp, Homo sapien
ctgtcactcacgcacctttcccttt

SEQ ID NO: 48853 - DNA, 25 bp, Homo sapien
gtataacgcagacaaggccatcgtg

SEQ ID NO: 48854 - DNA, 25 bp, Homo sapien
cgcagacaaggccatcgtggacagt

SEQ ID NO: 48855 - DNA, 25 bp, Homo sapien
ccgcgcatctctggtgagtcctcgg

SEQ ID NO: 48856 - DNA, 25 bp, Homo sapien
tcccggttcaagtataacgcagaca

SEQ ID NO: 48857 - DNA, 25 bp, Homo sapien
aggccatcgtggacagtggcaccac

SEQ ID NO: 48858 - DNA, 25 bp, Homo sapien
ggacagtggcaccacgctgctgcgc

SEQ ID NO: 48859 - DNA, 25 bp, Homo sapien
tgagtcctcgggacactcacgggtc

SEQ ID NO: 48860 - DNA, 25 bp, Homo sapien
ctggggcaccctggcgccatctttt

SEQ ID NO: 48861 - DNA, 25 bp, Homo sapien
cggtttcccacgtgcccaggcacct

SEQ ID NO: 48862 - DNA, 25 bp, Homo sapien
gcatctgggaccctgagcagcccga

SEQ ID NO: 48863 - DNA, 25 bp, Homo sapien
tgccgcctgcatctgggaccctgag

SEQ ID NO: 48864 - DNA, 25 bp, Homo sapien
ctttttccaccgtgcgaaggcagga

SEQ ID NO: 48865 - DNA, 25 bp, Homo sapien
tgcgctgttcccgtgatccactgcg

SEQ ID NO: 48866 - DNA, 25 bp, Homo sapien
gcgactgcgctgttcccgtgatcca

SEQ ID NO: 48867 - DNA, 25 bp, Homo sapien
ccaccgtgcgaaggcaggagcccga

SEQ ID NO: 48868 - DNA, 25 bp, Homo sapien
tgggacccgccacgcttagcaaaag

SEQ ID NO: 48869 - DNA, 25 bp, Homo sapien
acctggaagatgcgcccattggctg

SEQ ID NO: 48870 - DNA, 25 bp, Homo sapien
gacccgccacgcttagcaaaagcgg

SEQ ID NO: 48871 - DNA, 25 bp, Homo sapien
cacgcttagcaaaagcgggagggct

SEQ ID NO: 48872 - DNA, 25 bp, Homo sapien
gttcttggcgccgaggctggtctta

SEQ ID NO: 48873 - DNA, 25 bp, Homo sapien
gctggtcttagacctgggatcagga

SEQ ID NO: 48874 - DNA, 25 bp, Homo sapien
tcttagacctgggatcaggaatgcg

SEQ ID NO: 48875 - DNA, 25 bp, Homo sapien
caggaatgcgggaagcgattccaga

SEQ ID NO: 48876 - DNA, 25 bp, Homo sapien
cctgaggcccgtgtttgcaggacca

SEQ ID NO: 48877 - DNA, 25 bp, Homo sapien
gcggtgtatgtgagtaacactgccc

SEQ ID NO: 48878 - DNA, 25 bp, Homo sapien
tccagaagcaccgaaccacgctgtg

SEQ ID NO: 48879 - DNA, 25 bp, Homo sapien
aagtaagcccagtgcaggatcctga

SEQ ID NO: 48880 - DNA, 25 bp, Homo sapien
cctttctggaaaccagcgagcagaa

SEQ ID NO: 48881 - DNA, 25 bp, Homo sapien
tgcaatttgacttttcctttctgga

SEQ ID NO: 48882 - DNA, 25 bp, Homo sapien
ctgaagtctgaagtcatgcaatttg

SEQ ID NO: 48883 - DNA, 25 bp, Homo sapien
ggatcccaagtgcagcggcacccag

SEQ ID NO: 48884 - DNA, 25 bp, Homo sapien
gtcgacttctatttcctgggaacgc

SEQ ID NO: 48885 - DNA, 25 bp, Homo sapien
ggaaggttcaaggagttctcgccga

SEQ ID NO: 48886 - DNA, 25 bp, Homo sapien
cgcgcgaaagcaaacccaagtcaga

SEQ ID NO: 48887 - DNA, 25 bp, Homo sapien
gaccactgctttccgtcgacttcta

SEQ ID NO: 48888 - DNA, 25 bp, Homo sapien
ggagcacgcctgattctggttccca

SEQ ID NO: 48889 - DNA, 25 bp, Homo sapien
gcaccttctcggctgctagtaacta

SEQ ID NO: 48890 - DNA, 25 bp, Homo sapien
cgcaccctcggggtccatcgtagtt

SEQ ID NO: 48891 - DNA, 25 bp, Homo sapien
tctcgccgatcctgctgaataaagg

SEQ ID NO: 48892 - DNA, 25 bp, Homo sapien
gttcaggtaacactgcgggactgca

SEQ ID NO: 48893 - DNA, 25 bp, Homo sapien
ggccgtatcgttcccggcatctcag

SEQ ID NO: 48894 - DNA, 25 bp, Homo sapien
acctcgcgatgccaagccaacaggg

SEQ ID NO: 48895 - DNA, 25 bp, Homo sapien
ggcatctcagcgagtttccagtttc

SEQ ID NO: 48896 - DNA, 25 bp, Homo sapien
tccagtttctccctacctcagtagg

SEQ ID NO: 48897 - DNA, 25 bp, Homo sapien
cctcagtagggaaccaagaagcaga

SEQ ID NO: 48898 - DNA, 25 bp, Homo sapien
tccaccaactggctagggactcgca

SEQ ID NO: 48899 - DNA, 25 bp, Homo sapien
ccaaagagaaaaggcgcaccggtgc

SEQ ID NO: 48900 - DNA, 25 bp, Homo sapien
atcggatcattccaagggcaggcta

SEQ ID NO: 48901 - DNA, 25 bp, Homo sapien
gctctaatcatcaggtcttccctca

SEQ ID NO: 48902 - DNA, 25 bp, Homo sapien
ctcatcactgggtcgccctgcatgg

SEQ ID NO: 48903 - DNA, 25 bp, Homo sapien
gggtcatcctgcacaagctctaatc

SEQ ID NO: 48904 - DNA, 25 bp, Homo sapien
aagggcaggctatcccacacaggcc

SEQ ID NO: 48905 - DNA, 25 bp, Homo sapien
tcaaatgcaggagagtgatcggatc

SEQ ID NO: 48906 - DNA, 25 bp, Homo sapien
cacaagctctaatcaccgggtcatc

SEQ ID NO: 48907 - DNA, 25 bp, Homo sapien
tgcatttgcttttgtagattccaca

SEQ ID NO: 48908 - DNA, 25 bp, Homo sapien
caggcagccagctaggtcttgcttc

SEQ ID NO: 48909 - DNA, 25 bp, Homo sapien
ttgacactgatcttccgcgccagca

SEQ ID NO: 48910 - DNA, 25 bp, Homo sapien
ctggtcctcatccttggcgttgaca

SEQ ID NO: 48911 - DNA, 25 bp, Homo sapien
agcagccgtgtgctagactcgtccc

SEQ ID NO: 48912 - DNA, 25 bp, Homo sapien
tgaccgaggcgttcttctccaacag

SEQ ID NO: 48913 - DNA, 25 bp, Homo sapien
acgatattctcctgcccgtgctggc

SEQ ID NO: 48914 - DNA, 25 bp, Homo sapien
ctgctcgtcgaacaggtcaatgaca

SEQ ID NO: 48915 - DNA, 25 bp, Homo sapien
aggtgcaatggcgtcctcccatcca

SEQ ID NO: 48916 - DNA, 25 bp, Homo sapien
gtgcaggaagttcatgcccaccgcc

SEQ ID NO: 48917 - DNA, 25 bp, Homo sapien
caccttgacgtggtagtgggcatcc

SEQ ID NO: 48918 - DNA, 25 bp, Homo sapien
gagcccgtctccatgtactccatga

SEQ ID NO: 48919 - DNA, 25 bp, Homo sapien
gcagcttttccagggagcccgtctc

SEQ ID NO: 48920 - DNA, 25 bp, Homo sapien
accgccgtctcgtggatgattcgga

SEQ ID NO: 48921 - DNA, 25 bp, Homo sapien
tccagcaggatgttcgcgggcttga

SEQ ID NO: 48922 - DNA, 25 bp, Homo sapien
cggaaccggagatcccatggcaatg

SEQ ID NO: 48923 - DNA, 25 bp, Homo sapien
actccatgaccaggccgacaggttc

SEQ ID NO: 48924 - DNA, 25 bp, Homo sapien
taatgtcctccaaaacccgcgcaga

SEQ ID NO: 48925 - DNA, 25 bp, Homo sapien
cgttatctgcgccatttccatctcg

SEQ ID NO: 48926 - DNA, 25 bp, Homo sapien
agacgcctacgtttgagccctcaaa

SEQ ID NO: 48927 - DNA, 25 bp, Homo sapien
acatggtcacgctgcaggggacttt

SEQ ID NO: 48928 - DNA, 25 bp, Homo sapien
cttttgcgaaacacagacgcctacg

SEQ ID NO: 48929 - DNA, 25 bp, Homo sapien
ggcagcctagaacgtctccaacttt

SEQ ID NO: 48930 - DNA, 25 bp, Homo sapien
ttctggaatcaacggagatacaaga

SEQ ID NO: 48931 - DNA, 25 bp, Homo sapien
ctttagtgcggacgattctggaatc

SEQ ID NO: 48932 - DNA, 25 bp, Homo sapien
caagccgaagcttccgaccgaaata

SEQ ID NO: 48933 - DNA, 25 bp, Homo sapien
gcccagaggcccacatggcaatttt

SEQ ID NO: 48934 - DNA, 25 bp, Homo sapien
atggcaatttttctaagccctgcgc

SEQ ID NO: 48935 - DNA, 25 bp, Homo sapien
tcacctgtcgtcgacgtgcaggctg

SEQ ID NO: 48936 - DNA, 25 bp, Homo sapien
ccaggtcttccagtggacatggcgc

SEQ ID NO: 48937 - DNA, 25 bp, Homo sapien
ggacatggcgcaccttgtacacctg

SEQ ID NO: 48938 - DNA, 25 bp, Homo sapien
tactaagtaagtcgaacggaggcta

SEQ ID NO: 48939 - DNA, 25 bp, Homo sapien
ggaggctaactccactcacaaagcc

SEQ ID NO: 48940 - DNA, 25 bp, Homo sapien
gggcctctgttatctcgctccagaa

SEQ ID NO: 48941 - DNA, 25 bp, Homo sapien
accgctgcttgggaatcaggacgtc

SEQ ID NO: 48942 - DNA, 25 bp, Homo sapien
gagactttccatgaggcgcctcctg

SEQ ID NO: 48943 - DNA, 25 bp, Homo sapien
cagcgggctcagctttgccaaattc

SEQ ID NO: 48944 - DNA, 25 bp, Homo sapien
tctgcttagacgcacagcgggctca

SEQ ID NO: 48945 - DNA, 25 bp, Homo sapien
ggacgctccttggagtctgcttaga

SEQ ID NO: 48946 - DNA, 25 bp, Homo sapien
ggaatcaggacgtcccagctcccaa

SEQ ID NO: 48947 - DNA, 25 bp, Homo sapien
gccagccaagaccttcctcgtggag

SEQ ID NO: 48948 - DNA, 25 bp, Homo sapien
cacggtcaggattgagttgtccagc

SEQ ID NO: 48949 - DNA, 25 bp, Homo sapien
attggtaaactgagtcgcggccgca

SEQ ID NO: 48950 - DNA, 25 bp, Homo sapien
gttgtccagctgtaactggcgttca

SEQ ID NO: 48951 - DNA, 25 bp, Homo sapien
acggtatcaaaggtcacggtcagga

SEQ ID NO: 48952 - DNA, 25 bp, Homo sapien
cgtcaggttgatgaaatgggccaca

SEQ ID NO: 48953 - DNA, 25 bp, Homo sapien
ggtgctggtcactaagctggctccc

SEQ ID NO: 48954 - DNA, 25 bp, Homo sapien
ccaccggctggagattggtaaactg

SEQ ID NO: 48955 - DNA, 25 bp, Homo sapien
tcacggtgatgttggttaagccgac

SEQ ID NO: 48956 - DNA, 25 bp, Homo sapien
agccggccagtgtggtcactctgaa

SEQ ID NO: 48957 - DNA, 25 bp, Homo sapien
tccgtgtacaccctgagtgcgcttc

SEQ ID NO: 48958 - DNA, 25 bp, Homo sapien
cgcatgagctccctctccgtgtaca

SEQ ID NO: 48959 - DNA, 25 bp, Homo sapien
acggctgttcttcccgcatgagctc

SEQ ID NO: 48960 - DNA, 25 bp, Homo sapien
ttccgtgtgtttttcaccacggctg

SEQ ID NO: 48961 - DNA, 25 bp, Homo sapien
gccgctaccgtttgcttttctggga

SEQ ID NO: 48962 - DNA, 25 bp, Homo sapien
tgtggtcactctgaatctaaaaccc

SEQ ID NO: 48963 - DNA, 25 bp, Homo sapien
cccgcaagaggcgaaggatgccatc

SEQ ID NO: 48964 - DNA, 25 bp, Homo sapien
actcggtcacgtacttcttgtcgca

SEQ ID NO: 48965 - DNA, 25 bp, Homo sapien
cttctgcagcatgtactcggtcacg

SEQ ID NO: 48966 - DNA, 25 bp, Homo sapien
tgtgagctgaacgtgcttctgcagc

SEQ ID NO: 48967 - DNA, 25 bp, Homo sapien
ccaccttgtcgtgtgtgagctgaac

SEQ ID NO: 48968 - DNA, 25 bp, Homo sapien
tgcgcctccaccttgtcgtgtgtga

SEQ ID NO: 48969 - DNA, 25 bp, Homo sapien
cttgcgccgcatgtgtcggctcatg

SEQ ID NO: 48970 - DNA, 25 bp, Homo sapien
tcttgtcgcacacggagcacgtcca

SEQ ID NO: 48971 - DNA, 25 bp, Homo sapien
ctggtggacaccttggtcccgcaca

SEQ ID NO: 48972 - DNA, 25 bp, Homo sapien
agcatgttgaccttctgcgcgaacc

SEQ ID NO: 48973 - DNA, 25 bp, Homo sapien
aggatcccggtcagtccaccagcgg

SEQ ID NO: 48974 - DNA, 25 bp, Homo sapien
ggtaaacttccctgcgtgcccatgg

SEQ ID NO: 48975 - DNA, 25 bp, Homo sapien
cgcttgcagtgcttgagcatgttga

SEQ ID NO: 48976 - DNA, 25 bp, Homo sapien
tcaggttcactcactcctgccaggg

SEQ ID NO: 48977 - DNA, 25 bp, Homo sapien
gcgtgcttggtcttcatgccttcaa

SEQ ID NO: 48978 - DNA, 25 bp, Homo sapien
cccttgtgcagcttcatgtggtggc

SEQ ID NO: 48979 - DNA, 25 bp, Homo sapien
tcgtactccttgatgcccttgtgca

SEQ ID NO: 48980 - DNA, 25 bp, Homo sapien
gtggatgtacctgaaaccagagaca

SEQ ID NO: 48981 - DNA, 25 bp, Homo sapien
accagagacaagctcaggatggccg

SEQ ID NO: 48982 - DNA, 25 bp, Homo sapien
atctcgcaggggtggatgtacctga

SEQ ID NO: 48983 - DNA, 25 bp, Homo sapien
acaagctcaggatggccgcacagcc

SEQ ID NO: 48984 - DNA, 25 bp, Homo sapien
gctgttgaagatccgcccgcagatc

SEQ ID NO: 48985 - DNA, 25 bp, Homo sapien
tccaggttcccgatgctgttgaaga

SEQ ID NO: 48986 - DNA, 25 bp, Homo sapien
gacagacacgcacctgtgtggatga

SEQ ID NO: 48987 - DNA, 25 bp, Homo sapien
ccaaatgctgacagacacgcacctg

SEQ ID NO: 48988 - DNA, 25 bp, Homo sapien
cgtctttcttcatgtcggcggctct

SEQ ID NO: 48989 - DNA, 25 bp, Homo sapien
tctttcttcatgtcggcggctctcg

SEQ ID NO: 48990 - DNA, 25 bp, Homo sapien
ctttcttcatgtcggcggctctcgg

SEQ ID NO: 48991 - DNA, 25 bp, Homo sapien
ttcttcatgtcggcggctctcgggg

SEQ ID NO: 48992 - DNA, 25 bp, Homo sapien
gtctttcttcatgtcggcggctctc

SEQ ID NO: 48993 - DNA, 25 bp, Homo sapien
ttccccgcaagagagccgggacagc

SEQ ID NO: 48994 - DNA, 25 bp, Homo sapien
ttgcttccccgcaagagagccggga

SEQ ID NO: 48995 - DNA, 25 bp, Homo sapien
cctcagttgcttccccgcaagagag

SEQ ID NO: 48996 - DNA, 25 bp, Homo sapien
tgccgataaactcttccctctggtg

SEQ ID NO: 48997 - DNA, 25 bp, Homo sapien
ttccggtttctaacagcgcagcaga

SEQ ID NO: 48998 - DNA, 25 bp, Homo sapien
gcgcagcagacgcttcactcagtta

SEQ ID NO: 48999 - DNA, 25 bp, Homo sapien
ggtggtcatccatcaacgcgatgtc

SEQ ID NO: 49000 - DNA, 25 bp, Homo sapien
tggcaccgcttgcagctgtacttgt

SEQ ID NO: 49001 - DNA, 25 bp, Homo sapien
tgcgctctcgtcagaattgtcatcg

SEQ ID NO: 49002 - DNA, 25 bp, Homo sapien
ttcttccgaggagatcccgatcttg

SEQ ID NO: 49003 - DNA, 25 bp, Homo sapien
ctcagttatctacaccgcagggacg

SEQ ID NO: 49004 - DNA, 25 bp, Homo sapien
ctccgcggcgtatctagaatccgta

SEQ ID NO: 49005 - DNA, 25 bp, Homo sapien
cgccgtccacctggtcagagggaca

SEQ ID NO: 49006 - DNA, 25 bp, Homo sapien
tcttctcacaagtgccgcagcggta

SEQ ID NO: 49007 - DNA, 25 bp, Homo sapien
gctctcgatgcggaaggtcttctca

SEQ ID NO: 49008 - DNA, 25 bp, Homo sapien
cacctgtcctgcagttgtggaactc

SEQ ID NO: 49009 - DNA, 25 bp, Homo sapien
tgtggaactccagcgcgctctcgat

SEQ ID NO: 49010 - DNA, 25 bp, Homo sapien
atggcccagcgcagagtccacagat

SEQ ID NO: 49011 - DNA, 25 bp, Homo sapien
gacacgccgtgagtgagatggccca

SEQ ID NO: 49012 - DNA, 25 bp, Homo sapien
tgcatcgaccgtaaggatctcctgg

SEQ ID NO: 49013 - DNA, 25 bp, Homo sapien
gtccagaccggccaccggagcttga

SEQ ID NO: 49014 - DNA, 25 bp, Homo sapien
agcttgacctcctgcatcgaccgta

SEQ ID NO: 49015 - DNA, 25 bp, Homo sapien
ccctccggtcggtcaccaccatccg

SEQ ID NO: 49016 - DNA, 25 bp, Homo sapien
ccgtaaggatctcctggcgggcagt

SEQ ID NO: 49017 - DNA, 25 bp, Homo sapien
ggcggtctccgggtcctcgtccaga

SEQ ID NO: 49018 - DNA, 25 bp, Homo sapien
gcagtaggacaggtgtccagaaccc

SEQ ID NO: 49019 - DNA, 25 bp, Homo sapien
tggctccctactccggccggtcacc

SEQ ID NO: 49020 - DNA, 25 bp, Homo sapien
catccagttgcagtcatcctcgttg

SEQ ID NO: 49021 - DNA, 25 bp, Homo sapien
agccggcctgcttcagcatgggctt

SEQ ID NO: 49022 - DNA, 25 bp, Homo sapien
ctgcttcagcatgggcttgtccatc

SEQ ID NO: 49023 - DNA, 25 bp, Homo sapien
tagaaggccgcataccacacgcgca

SEQ ID NO: 49024 - DNA, 25 bp, Homo sapien
aggtggtgaagtacacgtcgctgcc

SEQ ID NO: 49025 - DNA, 25 bp, Homo sapien
gccgtcaggttctggtgctcggcct

SEQ ID NO: 49026 - DNA, 25 bp, Homo sapien
cctcgttggaggtgtcgaagcacac

SEQ ID NO: 49027 - DNA, 25 bp, Homo sapien
tcgctgccgtgctggtaggccgtca

SEQ ID NO: 49028 - DNA, 25 bp, Homo sapien
ccagcagacctgaaaagataggaga

SEQ ID NO: 49029 - DNA, 25 bp, Homo sapien
tgccgctgatgtttcccgggcttcc

SEQ ID NO: 49030 - DNA, 25 bp, Homo sapien
ggcccagaaggctgcttcttaaata

SEQ ID NO: 49031 - DNA, 25 bp, Homo sapien
tgcatccagcccacggggaagtgct

SEQ ID NO: 49032 - DNA, 25 bp, Homo sapien
agcgtgaagctctgtggcccagaag

SEQ ID NO: 49033 - DNA, 25 bp, Homo sapien
acccgctggtcagcgtgaagctctg

SEQ ID NO: 49034 - DNA, 25 bp, Homo sapien
tgccgcaggcagacccgctggtcag

SEQ ID NO: 49035 - DNA, 25 bp, Homo sapien
taagtccagaggaactgtcgccgtc

SEQ ID NO: 49036 - DNA, 25 bp, Homo sapien
actgcgccaggtacaggcctaccgt

SEQ ID NO: 49037 - DNA, 25 bp, Homo sapien
ggatgagcacttctgacggtccctc

SEQ ID NO: 49038 - DNA, 25 bp, Homo sapien
tcccgactcggcgtctgggaagttc

SEQ ID NO: 49039 - DNA, 25 bp, Homo sapien
gccgtttggagaataaaatcaatca

SEQ ID NO: 49040 - DNA, 25 bp, Homo sapien
tcttgtctctccgtcaaggggcctc

SEQ ID NO: 49041 - DNA, 25 bp, Homo sapien
agagcgacaccagcgcgagccactg

SEQ ID NO: 49042 - DNA, 25 bp, Homo sapien
gaggactcccttagcctgggtcagg

SEQ ID NO: 49043 - DNA, 25 bp, Homo sapien
taactctcgaggatggtctgcgctg

SEQ ID NO: 49044 - DNA, 25 bp, Homo sapien
atgaggtcatcgcaggcatcgctcg

SEQ ID NO: 49045 - DNA, 25 bp, Homo sapien
caccggtcttcagtctcgaggcaga

SEQ ID NO: 49046 - DNA, 25 bp, Homo sapien
ccggaacaggagaacgcgcccttct

SEQ ID NO: 49047 - DNA, 25 bp, Homo sapien
aatttgacgtcatcccacaccaggg

SEQ ID NO: 49048 - DNA, 25 bp, Homo sapien
gcgtgcgcagtgtgaaggtacaatc

SEQ ID NO: 49049 - DNA, 25 bp, Homo sapien
gctaggggcgtgacagttactcacc

SEQ ID NO: 49050 - DNA, 25 bp, Homo sapien
tcagagttacgtcaggaaaggccgc

SEQ ID NO: 49051 - DNA, 25 bp, Homo sapien
gccgctgtgattccatccatcttga

SEQ ID NO: 49052 - DNA, 25 bp, Homo sapien
ggggtcaggttgtcgtgaccttatc

SEQ ID NO: 49053 - DNA, 25 bp, Homo sapien
tatctttacccttaggccgtccatc

SEQ ID NO: 49054 - DNA, 25 bp, Homo sapien
tttcctgcgccagtcacggtgggct

SEQ ID NO: 49055 - DNA, 25 bp, Homo sapien
aggtggccatgtgttcggtctttcc

SEQ ID NO: 49056 - DNA, 25 bp, Homo sapien
cccaggaggtacgtaccatgtgctg

SEQ ID NO: 49057 - DNA, 25 bp, Homo sapien
gtacgtaccatgtgctgggaggcct

SEQ ID NO: 49058 - DNA, 25 bp, Homo sapien
gcgcctatgagttgcaccctcacag

SEQ ID NO: 49059 - DNA, 25 bp, Homo sapien
tgtcgtgaccttatctttaccctta

SEQ ID NO: 49060 - DNA, 25 bp, Homo sapien
cccggagccacgtgcaaaatcgtaa

SEQ ID NO: 49061 - DNA, 25 bp, Homo sapien
tacggttcgaggctctgttaataaa

SEQ ID NO: 49062 - DNA, 25 bp, Homo sapien
aaaaacctagggctcgagtggctcg

SEQ ID NO: 49063 - DNA, 25 bp, Homo sapien
gcaaactccgcgtctgcatggaatc

SEQ ID NO: 49064 - DNA, 25 bp, Homo sapien
ttggttggattcacgttccttattg

SEQ ID NO: 49065 - DNA, 25 bp, Homo sapien
tccttattgttacggttcgaggctc

SEQ ID NO: 49066 - DNA, 25 bp, Homo sapien
ccacgtgcaaaatcgtaagtgtttt

SEQ ID NO: 49067 - DNA, 25 bp, Homo sapien
gctcgagtggctcggggccaacctc

SEQ ID NO: 49068 - DNA, 25 bp, Homo sapien
cttgcaccggcagagagcacggact

SEQ ID NO: 49069 - DNA, 25 bp, Homo sapien
agcgagttgccctacaagttggacc

SEQ ID NO: 49070 - DNA, 25 bp, Homo sapien
aagttggaccgatggccttgacctg

SEQ ID NO: 49071 - DNA, 25 bp, Homo sapien
aaagactcgcaagctcgacctgaca

SEQ ID NO: 49072 - DNA, 25 bp, Homo sapien
tggcctgtctgatggccgctttctc

SEQ ID NO: 49073 - DNA, 25 bp, Homo sapien
agcaaaacaagagcacgcgcacctg

SEQ ID NO: 49074 - DNA, 25 bp, Homo sapien
acctgcacttcaggggtcctggtcc

SEQ ID NO: 49075 - DNA, 25 bp, Homo sapien
gagcgcatccttcgtccgccgggaa

SEQ ID NO: 49076 - DNA, 25 bp, Homo sapien
ctatgcataggggatcacccgggcc

SEQ ID NO: 49077 - DNA, 25 bp, Homo sapien
caggtccaggaacaccggtccagga

SEQ ID NO: 49078 - DNA, 25 bp, Homo sapien
ctccattcaggcttgagcggtgact

SEQ ID NO: 49079 - DNA, 25 bp, Homo sapien
cccgggaatggaaatggcgctcaaa

SEQ ID NO: 49080 - DNA, 25 bp, Homo sapien
ctcaaatgctggtgtggtgtccgca

SEQ ID NO: 49081 - DNA, 25 bp, Homo sapien
ggttactaccggtcaacgctcgcta

SEQ ID NO: 49082 - DNA, 25 bp, Homo sapien
gctcgctagtaacctccgcggcgga

SEQ ID NO: 49083 - DNA, 25 bp, Homo sapien
aacgcccgggagaaaacagcgctgc

SEQ ID NO: 49084 - DNA, 25 bp, Homo sapien
ccaaccaactgctcttgagaggagg

SEQ ID NO: 49085 - DNA, 25 bp, Homo sapien
gactcccaaccaactgctcttgaga

SEQ ID NO: 49086 - DNA, 25 bp, Homo sapien
agactcccaaccaactgctcttgag

SEQ ID NO: 49087 - DNA, 25 bp, Homo sapien
ccaactgctcttgagaggaggcagc

SEQ ID NO: 49088 - DNA, 25 bp, Homo sapien
aaccaactgctcttgagaggaggca

SEQ ID NO: 49089 - DNA, 25 bp, Homo sapien
cccaaccaactgctcttgagaggag

SEQ ID NO: 49090 - DNA, 25 bp, Homo sapien
caactgctcttgagaggaggcagct

SEQ ID NO: 49091 - DNA, 25 bp, Homo sapien
tcccaaccaactgctcttgagagga

SEQ ID NO: 49092 - DNA, 25 bp, Homo sapien
cgttctagaatccatgcagcgagca

SEQ ID NO: 49093 - DNA, 25 bp, Homo sapien
cggagcgctccagaatccatgaagc

SEQ ID NO: 49094 - DNA, 25 bp, Homo sapien
ttgtcgcagcactccagcatccatg

SEQ ID NO: 49095 - DNA, 25 bp, Homo sapien
ttcggagcactccagaatccatgca

SEQ ID NO: 49096 - DNA, 25 bp, Homo sapien
atcggagcgctctagaacccgtgca

SEQ ID NO: 49097 - DNA, 25 bp, Homo sapien
tgctccagaatccacgcagcacgtg

SEQ ID NO: 49098 - DNA, 25 bp, Homo sapien
ggcatctcctcgtcatagcgttcta

SEQ ID NO: 49099 - DNA, 25 bp, Homo sapien
cctcgtcagagtgctccagaatcca

SEQ ID NO: 49100 - DNA, 25 bp, Homo sapien
gggccgttcaccagatgccagaaaa

SEQ ID NO: 49101 - DNA, 25 bp, Homo sapien
tgtggaaccctcgttttaggatctg

SEQ ID NO: 49102 - DNA, 25 bp, Homo sapien
ggacggatttctgcctcggctgcag

SEQ ID NO: 49103 - DNA, 25 bp, Homo sapien
ttaggatctgcacgccgtttccagt

SEQ ID NO: 49104 - DNA, 25 bp, Homo sapien
cccaattctcgctcgtttgccaaga

SEQ ID NO: 49105 - DNA, 25 bp, Homo sapien
aggtcccgctacttcgtcaccaaag

SEQ ID NO: 49106 - DNA, 25 bp, Homo sapien
ttctgctggaaaccgttgaatagtc

SEQ ID NO: 49107 - DNA, 25 bp, Homo sapien
cggctgtcgacccaggttaggaagc

SEQ ID NO: 49108 - DNA, 25 bp, Homo sapien
aggtgggtagcaaccgcctccaccg

SEQ ID NO: 49109 - DNA, 25 bp, Homo sapien
ggaagggcacctcgaccaatcaccg

SEQ ID NO: 49110 - DNA, 25 bp, Homo sapien
ctgtcatagcaacgggaagggcacc

SEQ ID NO: 49111 - DNA, 25 bp, Homo sapien
gcagcctttgcgtactgtcatagca

SEQ ID NO: 49112 - DNA, 25 bp, Homo sapien
ccactggcagcctttgcgtactgtc

SEQ ID NO: 49113 - DNA, 25 bp, Homo sapien
cgcctctagcaggtgggtagcaacc

SEQ ID NO: 49114 - DNA, 25 bp, Homo sapien
gagcccaggtccgacatggtctcgc

SEQ ID NO: 49115 - DNA, 25 bp, Homo sapien
cagccgcagcgcctctagcaggtgg

SEQ ID NO: 49116 - DNA, 25 bp, Homo sapien
cccgacctcgacatgagtcccagcc

SEQ ID NO: 49117 - DNA, 25 bp, Homo sapien
cttggaaatctgctttacctgacgc

SEQ ID NO: 49118 - DNA, 25 bp, Homo sapien
cctacagtgatgtccgtccgggttt

SEQ ID NO: 49119 - DNA, 25 bp, Homo sapien
tacgatcgccgtcctctcctctcgc

SEQ ID NO: 49120 - DNA, 25 bp, Homo sapien
acacgcatgtacacgtgcaggcttg

SEQ ID NO: 49121 - DNA, 25 bp, Homo sapien
tgtacacgtgcaggcttggaaatct

SEQ ID NO: 49122 - DNA, 25 bp, Homo sapien
cgtgcaggcttggaaatctgcttta

SEQ ID NO: 49123 - DNA, 25 bp, Homo sapien
tttacctgacgcactccgcctgccg

SEQ ID NO: 49124 - DNA, 25 bp, Homo sapien
cgctccaggaagtcgcgagcaggaa

SEQ ID NO: 49125 - DNA, 25 bp, Homo sapien
ctttgcgttgtttgtcggctgagca

SEQ ID NO: 49126 - DNA, 25 bp, Homo sapien
accctgcgcattgtctgccgcgatg

SEQ ID NO: 49127 - DNA, 25 bp, Homo sapien
gagcttagctgtccagccgggtccc

SEQ ID NO: 49128 - DNA, 25 bp, Homo sapien
aagagtggccctcggcgacaatgcc

SEQ ID NO: 49129 - DNA, 25 bp, Homo sapien
ttcgcccgcaaaggccgggcagtgc

SEQ ID NO: 49130 - DNA, 25 bp, Homo sapien
ctggtttggatgttttccgagagcc

SEQ ID NO: 49131 - DNA, 25 bp, Homo sapien
cggggacggtctcaagctattttcg

SEQ ID NO: 49132 - DNA, 25 bp, Homo sapien
tccttgttctgcgtttccttgttct

SEQ ID NO: 49133 - DNA, 25 bp, Homo sapien
gctgcgtttccttgttctgcgtttc

SEQ ID NO: 49134 - DNA, 25 bp, Homo sapien
cgtttccttgttctgcgtttccttg

SEQ ID NO: 49135 - DNA, 25 bp, Homo sapien
gcccaggcggctgactgcacagtga

SEQ ID NO: 49136 - DNA, 25 bp, Homo sapien
cggctgactgcacagtgaggagcca

SEQ ID NO: 49137 - DNA, 25 bp, Homo sapien
tgttctgcgtttccttgttctggcc

SEQ ID NO: 49138 - DNA, 25 bp, Homo sapien
ctgctgcgtttccttgttctgcgtt

SEQ ID NO: 49139 - DNA, 25 bp, Homo sapien
tctgcgtttccttgttctggccttg

SEQ ID NO: 49140 - DNA, 25 bp, Homo sapien
cgtttacatccacgcaggcgtttcc

SEQ ID NO: 49141 - DNA, 25 bp, Homo sapien
gtttacatccacgcaggcgtttccc

SEQ ID NO: 49142 - DNA, 25 bp, Homo sapien
ccgtttatatccacgcaggcgtttc

SEQ ID NO: 49143 - DNA, 25 bp, Homo sapien
tccattcccgtttatatccacgcag

SEQ ID NO: 49144 - DNA, 25 bp, Homo sapien
cccgtttacatccacgcaggcgttt

SEQ ID NO: 49145 - DNA, 25 bp, Homo sapien
attcccgtttacatccacgcaggcg

SEQ ID NO: 49146 - DNA, 25 bp, Homo sapien
ccgtttacatccacgcaggcgtttc

SEQ ID NO: 49147 - DNA, 25 bp, Homo sapien
attcccgtttatatccacgcaggcg

SEQ ID NO: 49148 - DNA, 25 bp, Homo sapien
caggaggcatctgggctgcacccca

SEQ ID NO: 49149 - DNA, 25 bp, Homo sapien
ggctctgcttgtaaacagacaagtg

SEQ ID NO: 49150 - DNA, 25 bp, Homo sapien
tgcacaagcgcagcccggtgaaggc

SEQ ID NO: 49151 - DNA, 25 bp, Homo sapien
gcgagccgcccatacacgtggagat

SEQ ID NO: 49152 - DNA, 25 bp, Homo sapien
ccatacacgtggagatgccggccaa

SEQ ID NO: 49153 - DNA, 25 bp, Homo sapien
acacgtggagatgccggccaaggcc

SEQ ID NO: 49154 - DNA, 25 bp, Homo sapien
aggccctgcagcacacggcagagga

SEQ ID NO: 49155 - DNA, 25 bp, Homo sapien
tgtaaacagacaagtgcacaagcgc

SEQ ID NO: 49156 - DNA, 25 bp, Homo sapien
tacctggacatcgatggacgcattc

SEQ ID NO: 49157 - DNA, 25 bp, Homo sapien
ggcccaaggccatctacctggacat

SEQ ID NO: 49158 - DNA, 25 bp, Homo sapien
ggcgggctagtgtttccgtttcaca

SEQ ID NO: 49159 - DNA, 25 bp, Homo sapien
aatctgattaggctgagtttttaca

SEQ ID NO: 49160 - DNA, 25 bp, Homo sapien
gtttttacattcaagggctggcaca

SEQ ID NO: 49161 - DNA, 25 bp, Homo sapien
tgaagcctttaatttccggtggatc

SEQ ID NO: 49162 - DNA, 25 bp, Homo sapien
tacagtaaaaagtccgagtgcagcc

SEQ ID NO: 49163 - DNA, 25 bp, Homo sapien
ttccgtttcacaggcagagcttttc

SEQ ID NO: 49164 - DNA, 25 bp, Homo sapien
cacggattatcagagctgctccctc

SEQ ID NO: 49165 - DNA, 25 bp, Homo sapien
ctgcgcatgaacatcctccgtcggg

SEQ ID NO: 49166 - DNA, 25 bp, Homo sapien
gtgtcctgcgcatgaacatcctccg

SEQ ID NO: 49167 - DNA, 25 bp, Homo sapien
gtagccgtgtcctgcgcatgaacat

SEQ ID NO: 49168 - DNA, 25 bp, Homo sapien
ttcagacggtctgggtagccgtgtc

SEQ ID NO: 49169 - DNA, 25 bp, Homo sapien
gaaatcccaccgtcaggccaggcag

SEQ ID NO: 49170 - DNA, 25 bp, Homo sapien
cgcatgaacatcctccgtcgggaga

SEQ ID NO: 49171 - DNA, 25 bp, Homo sapien
aacatcctccgtcgggagaggaatt

SEQ ID NO: 49172 - DNA, 25 bp, Homo sapien
caggatcctcaacggttctgttgtg

SEQ ID NO: 49173 - DNA, 25 bp, Homo sapien
tccctgagagccgagactcatggcc

SEQ ID NO: 49174 - DNA, 25 bp, Homo sapien
ccttggacagaagatgcggatgcta

SEQ ID NO: 49175 - DNA, 25 bp, Homo sapien
tgcggatgctaacccggcgcttcca

SEQ ID NO: 49176 - DNA, 25 bp, Homo sapien
catcccgcgcgtaggtggtgtttct

SEQ ID NO: 49177 - DNA, 25 bp, Homo sapien
tggtgtttctctgcaggcgccagtt

SEQ ID NO: 49178 - DNA, 25 bp, Homo sapien
tctgcaggcgccagtttcaccgcgg

SEQ ID NO: 49179 - DNA, 25 bp, Homo sapien
acggttctgttgtgatgtgattccc

SEQ ID NO: 49180 - DNA, 25 bp, Homo sapien
gcggagatcaacttcaacatcgaca

SEQ ID NO: 49181 - DNA, 25 bp, Homo sapien
gaggacagtgtgagcgagcggggct

SEQ ID NO: 49182 - DNA, 25 bp, Homo sapien
cccatttgacaggatcgcggagatc

SEQ ID NO: 49183 - DNA, 25 bp, Homo sapien
atttgacaggatcgcggagatcaac

SEQ ID NO: 49184 - DNA, 25 bp, Homo sapien
gacaggatcgcggagatcaacttca

SEQ ID NO: 49185 - DNA, 25 bp, Homo sapien
aggatcgcggagatcaacttcaaca

SEQ ID NO: 49186 - DNA, 25 bp, Homo sapien
atcgcggagatcaacttcaacatcg

SEQ ID NO: 49187 - DNA, 25 bp, Homo sapien
agatcaacttcaacatcgacactga

SEQ ID NO: 49188 - DNA, 25 bp, Homo sapien
aacacgcgatgaccacgtggagcct

SEQ ID NO: 49189 - DNA, 25 bp, Homo sapien
cactctactcctgccgcgcgatcca

SEQ ID NO: 49190 - DNA, 25 bp, Homo sapien
tgcggctgcaggcactctactcctg

SEQ ID NO: 49191 - DNA, 25 bp, Homo sapien
ccagctgcttctttctgggagctcc

SEQ ID NO: 49192 - DNA, 25 bp, Homo sapien
tgctgctggtcgtcttgggcttcct

SEQ ID NO: 49193 - DNA, 25 bp, Homo sapien
gcttagagaacacgcgatgaccacg

SEQ ID NO: 49194 - DNA, 25 bp, Homo sapien
cccgcgcttagagaacacgcgatga

SEQ ID NO: 49195 - DNA, 25 bp, Homo sapien
tgagagagagcttcgcgcagcacct

SEQ ID NO: 49196 - DNA, 25 bp, Homo sapien
accttcagtttggagccgaagcgga

SEQ ID NO: 49197 - DNA, 25 bp, Homo sapien
tcaatcaatgcgcagaatcccgagg

SEQ ID NO: 49198 - DNA, 25 bp, Homo sapien
tggacctgttctgcatcgccaccgg

SEQ ID NO: 49199 - DNA, 25 bp, Homo sapien
gtactgcaactccagcgacatcatg

SEQ ID NO: 49200 - DNA, 25 bp, Homo sapien
aagcacgtggcgtctgacgtctcca

SEQ ID NO: 49201 - DNA, 25 bp, Homo sapien
aggggctcttcgaaatcaatcaatg

SEQ ID NO: 49202 - DNA, 25 bp, Homo sapien
ggcaccggccttctacaaggggctc

SEQ ID NO: 49203 - DNA, 25 bp, Homo sapien
cctcctcgccttttcgggatggctg

SEQ ID NO: 49204 - DNA, 25 bp, Homo sapien
tgcggccaccccaggtttctgtgca

SEQ ID NO: 49205 - DNA, 25 bp, Homo sapien
tcctcggactacagcacttgctcgt

SEQ ID NO: 49206 - DNA, 25 bp, Homo sapien
tcggactacagcacttgctcgtcgc

SEQ ID NO: 49207 - DNA, 25 bp, Homo sapien
actctccagtcacctgagggcgctg

SEQ ID NO: 49208 - DNA, 25 bp, Homo sapien
ctctgcggccgggtgatcccaagac

SEQ ID NO: 49209 - DNA, 25 bp, Homo sapien
ggggcttctcttacccactctccag

SEQ ID NO: 49210 - DNA, 25 bp, Homo sapien
tccagggaggcacgggatctgctcc

SEQ ID NO: 49211 - DNA, 25 bp, Homo sapien
tgtgccgtcccacgcctacggggat

SEQ ID NO: 49212 - DNA, 25 bp, Homo sapien
cacctgcttgctatggaggtggcca

SEQ ID NO: 49213 - DNA, 25 bp, Homo sapien
gagcctgccttgagcatgcgtgaaa

SEQ ID NO: 49214 - DNA, 25 bp, Homo sapien
cttcccagttctgcagagcgtgttc

SEQ ID NO: 49215 - DNA, 25 bp, Homo sapien
accagccatctagtgcaaggagcgc

SEQ ID NO: 49216 - DNA, 25 bp, Homo sapien
gcagcctggtctccctgttccaaga

SEQ ID NO: 49217 - DNA, 25 bp, Homo sapien
gccatacacatgtgccagcccagag

SEQ ID NO: 49218 - DNA, 25 bp, Homo sapien
cgcagacgccgagagatgacgtata

SEQ ID NO: 49219 - DNA, 25 bp, Homo sapien
acgtaccgcgcatgctcaaggacga

SEQ ID NO: 49220 - DNA, 25 bp, Homo sapien
cagctggcctgtaattggcgcagtc

SEQ ID NO: 49221 - DNA, 25 bp, Homo sapien
cccagggaaggtcgcagatttaagg

SEQ ID NO: 49222 - DNA, 25 bp, Homo sapien
ggtgacgtgtccctcacgctgctgc

SEQ ID NO: 49223 - DNA, 25 bp, Homo sapien
tgcctgtgattggtggtcccgatcc

SEQ ID NO: 49224 - DNA, 25 bp, Homo sapien
ccgagctgaagagctttaaaacctc

SEQ ID NO: 49225 - DNA, 25 bp, Homo sapien
acttagccctactggggatgcgcgc

SEQ ID NO: 49226 - DNA, 25 bp, Homo sapien
cgacctctagccgtcctagttgggc

SEQ ID NO: 49227 - DNA, 25 bp, Homo sapien
aatcaagtaggaccagactgtgccc

SEQ ID NO: 49228 - DNA, 25 bp, Homo sapien
cgcgcccagttggtttcttagtgtg

SEQ ID NO: 49229 - DNA, 25 bp, Homo sapien
ctgcagccgcttgtcagtgtgatga

SEQ ID NO: 49230 - DNA, 25 bp, Homo sapien
ctcccattgagcgaggctgtgtcgc

SEQ ID NO: 49231 - DNA, 25 bp, Homo sapien
tctgaatattgatgcggcgcgcgtc

SEQ ID NO: 49232 - DNA, 25 bp, Homo sapien
ggcctgatcgaagcgcgcgctccta

SEQ ID NO: 49233 - DNA, 25 bp, Homo sapien
gacgcggaaatttctggaaggcgcc

SEQ ID NO: 49234 - DNA, 25 bp, Homo sapien
tcagtgtgatgaagattggcaccca

SEQ ID NO: 49235 - DNA, 25 bp, Homo sapien
ttggcacccaggtaagctgtcactc

SEQ ID NO: 49236 - DNA, 25 bp, Homo sapien
gccaggcagttaccaatcacgcgtg

SEQ ID NO: 49237 - DNA, 25 bp, Homo sapien
cgaacaccatctgccgctgactgga

SEQ ID NO: 49238 - DNA, 25 bp, Homo sapien
cagcaagtcaatggcggtgaccacc

SEQ ID NO: 49239 - DNA, 25 bp, Homo sapien
ggcggccacgaagttcagcaagtca

SEQ ID NO: 49240 - DNA, 25 bp, Homo sapien
gacttcacttctggtcccgctcctg

SEQ ID NO: 49241 - DNA, 25 bp, Homo sapien
accgcccagcgctccggacttcact

SEQ ID NO: 49242 - DNA, 25 bp, Homo sapien
caatcacgcgtgtgtttagggctca

SEQ ID NO: 49243 - DNA, 25 bp, Homo sapien
acgcgtgtgtttagggctcaggaaa

SEQ ID NO: 49244 - DNA, 25 bp, Homo sapien
gggcacccgtttgagctgcctgtag

SEQ ID NO: 49245 - DNA, 25 bp, Homo sapien
cgggcacctgtttgagctgcctgta

SEQ ID NO: 49246 - DNA, 25 bp, Homo sapien
cgcacctgtttgagctgcctgtagg

SEQ ID NO: 49247 - DNA, 25 bp, Homo sapien
ggcacccgtttgagctgcctgtagg

SEQ ID NO: 49248 - DNA, 25 bp, Homo sapien
cacccgtttgagctgcctgtaggtg

SEQ ID NO: 49249 - DNA, 25 bp, Homo sapien
gcacccgtttgagctgcctgtaggt

SEQ ID NO: 49250 - DNA, 25 bp, Homo sapien
acccgtttgagctgcctgtaggtga

SEQ ID NO: 49251 - DNA, 25 bp, Homo sapien
accgcgcacctgtttgagctgcctg

SEQ ID NO: 49252 - DNA, 25 bp, Homo sapien
cgtatgcatgaattgtgcacgtgca

SEQ ID NO: 49253 - DNA, 25 bp, Homo sapien
tgtcagacacactccgaaggatccg

SEQ ID NO: 49254 - DNA, 25 bp, Homo sapien
cacgcatgggagcatgtcagacaca

SEQ ID NO: 49255 - DNA, 25 bp, Homo sapien
ttgtgcacgtgcacgcatgggagca

SEQ ID NO: 49256 - DNA, 25 bp, Homo sapien
gggtgcacacgtatgcatgaattgt

SEQ ID NO: 49257 - DNA, 25 bp, Homo sapien
agagggccacgagtcagacgcgcca

SEQ ID NO: 49258 - DNA, 25 bp, Homo sapien
cactgagtcgggcagaatgaccacg

SEQ ID NO: 49259 - DNA, 25 bp, Homo sapien
ggcagaatgaccacgcagcgctggc

SEQ ID NO: 49260 - DNA, 25 bp, Homo sapien
gcactggccccgaatgctggtcaaa

SEQ ID NO: 49261 - DNA, 25 bp, Homo sapien
tcaaaggaagctaggttgggacaca

SEQ ID NO: 49262 - DNA, 25 bp, Homo sapien
tggcacccaccggtgttcccggatg

SEQ ID NO: 49263 - DNA, 25 bp, Homo sapien
gttcccggatgtcggctcgataatc

SEQ ID NO: 49264 - DNA, 25 bp, Homo sapien
gatgtcggctcgataatcgtgtccc

SEQ ID NO: 49265 - DNA, 25 bp, Homo sapien
gcatcctcaatcatccgcaggctga

SEQ ID NO: 49266 - DNA, 25 bp, Homo sapien
aggctgatgcggtccttcacgctcc

SEQ ID NO: 49267 - DNA, 25 bp, Homo sapien
atccgcaggctgatgcggtccttca

SEQ ID NO: 49268 - DNA, 25 bp, Homo sapien
ccggccaatgtctcgtggcagagca

SEQ ID NO: 49269 - DNA, 25 bp, Homo sapien
ttgattcaaccgcagacccgggtcg

SEQ ID NO: 49270 - DNA, 25 bp, Homo sapien
gccggatctcacctggacggataca

SEQ ID NO: 49271 - DNA, 25 bp, Homo sapien
gcttgcatcctacagctcagctgcg

SEQ ID NO: 49272 - DNA, 25 bp, Homo sapien
ggtccgccaaaaagggcgatttgca

SEQ ID NO: 49273 - DNA, 25 bp, Homo sapien
gcgaactcaatgctgggcaccgaaa

SEQ ID NO: 49274 - DNA, 25 bp, Homo sapien
gccgcctttcggtgcagatgatgca

SEQ ID NO: 49275 - DNA, 25 bp, Homo sapien
acccagttgagatcctctgtccaga

SEQ ID NO: 49276 - DNA, 25 bp, Homo sapien
tcgctgctgttccactgcccacggg

SEQ ID NO: 49277 - DNA, 25 bp, Homo sapien
tgacctggggcaccgtctgtgatgc

SEQ ID NO: 49278 - DNA, 25 bp, Homo sapien
ccacggcccacgtggtgtgccggga

SEQ ID NO: 49279 - DNA, 25 bp, Homo sapien
aggccttccgctgtgcgggcaacga

SEQ ID NO: 49280 - DNA, 25 bp, Homo sapien
gccttccgctgtgcgggcaacgagt

SEQ ID NO: 49281 - DNA, 25 bp, Homo sapien
aacgagtcgctgctgttccactgcc

SEQ ID NO: 49282 - DNA, 25 bp, Homo sapien
agccagtgtgggcatggtcacgacg

SEQ ID NO: 49283 - DNA, 25 bp, Homo sapien
gcaacgagtcgctgctgttccactg

SEQ ID NO: 49284 - DNA, 25 bp, Homo sapien
gccaccgcctgctagtgtcagggca

SEQ ID NO: 49285 - DNA, 25 bp, Homo sapien
ggtgcgcggtcttcagaaaataatg

SEQ ID NO: 49286 - DNA, 25 bp, Homo sapien
actctgctctagctgggtcacctcg

SEQ ID NO: 49287 - DNA, 25 bp, Homo sapien
gagagatgccgagaggcgctttctc

SEQ ID NO: 49288 - DNA, 25 bp, Homo sapien
ctcggaggtaccgtgtgaagtcgct

SEQ ID NO: 49289 - DNA, 25 bp, Homo sapien
cttctcgcacggctttcgggagaca

SEQ ID NO: 49290 - DNA, 25 bp, Homo sapien
cctgaccttcctgacttgaaatgtg

SEQ ID NO: 49291 - DNA, 25 bp, Homo sapien
gcccttgtttcatgcctccagcttt

SEQ ID NO: 49292 - DNA, 25 bp, Homo sapien
cagataaaactgtccgttttacatc

SEQ ID NO: 49293 - DNA, 25 bp, Homo sapien
ttactgaaggttcttagagagaaac

SEQ ID NO: 49294 - DNA, 25 bp, Homo sapien
gttctttactgaaggttcttagaga

SEQ ID NO: 49295 - DNA, 25 bp, Homo sapien
cgttttacatccgtatccccctgtg

SEQ ID NO: 49296 - DNA, 25 bp, Homo sapien
ttctcagataaaactgtccgtttta

SEQ ID NO: 49297 - DNA, 25 bp, Homo sapien
gaaggttcttagagagaaacttgga

SEQ ID NO: 49298 - DNA, 25 bp, Homo sapien
tgcaacgtctgaggcggggacgggt

SEQ ID NO: 49299 - DNA, 25 bp, Homo sapien
ccctgtgtaggtaggttctttactg

SEQ ID NO: 49300 - DNA, 25 bp, Homo sapien
caggatctcaaggtgcatggcgaca

SEQ ID NO: 49301 - DNA, 25 bp, Homo sapien
ttggccctggcacactaagcggcca

SEQ ID NO: 49302 - DNA, 25 bp, Homo sapien
acactaagcggctgcaccactgtct

SEQ ID NO: 49303 - DNA, 25 bp, Homo sapien
tgtgcgcctgagcatccaggatctc

SEQ ID NO: 49304 - DNA, 25 bp, Homo sapien
accgccacatatgacgcagctggta

SEQ ID NO: 49305 - DNA, 25 bp, Homo sapien
cgtccttcagttctgctggctgggc

SEQ ID NO: 49306 - DNA, 25 bp, Homo sapien
gtgtacggtccgtccttcagttctg

SEQ ID NO: 49307 - DNA, 25 bp, Homo sapien
accactgtctcgctttcgcctgttg

SEQ ID NO: 49308 - DNA, 25 bp, Homo sapien
cacttgtctttctcggtgccgaaga

SEQ ID NO: 49309 - DNA, 25 bp, Homo sapien
aggggcttctccacagagccgcctg

SEQ ID NO: 49310 - DNA, 25 bp, Homo sapien
cagtgcagaccgaacccggggccga

SEQ ID NO: 49311 - DNA, 25 bp, Homo sapien
tggaggccagatactccgccatttc

SEQ ID NO: 49312 - DNA, 25 bp, Homo sapien
aggcaactttcagcgcggctcgagg

SEQ ID NO: 49313 - DNA, 25 bp, Homo sapien
gcccggatgctccaggcaactttca

SEQ ID NO: 49314 - DNA, 25 bp, Homo sapien
tgtccacgtccaaaaggcccggatg

SEQ ID NO: 49315 - DNA, 25 bp, Homo sapien
gcagcgctacccagtcaggcgaggt

SEQ ID NO: 49316 - DNA, 25 bp, Homo sapien
atcctggagaccaggtggagccagt

SEQ ID NO: 49317 - DNA, 25 bp, Homo sapien
aagtagaggatgcaagcaccgagcc

SEQ ID NO: 49318 - DNA, 25 bp, Homo sapien
gacggaagtagaggatgcaagcacc

SEQ ID NO: 49319 - DNA, 25 bp, Homo sapien
tgatgaggtcaaccggctggtccaa

SEQ ID NO: 49320 - DNA, 25 bp, Homo sapien
ataggacgtgatgaggtcaaccggc

SEQ ID NO: 49321 - DNA, 25 bp, Homo sapien
gagaagcaggggaccgcgcatcctg

SEQ ID NO: 49322 - DNA, 25 bp, Homo sapien
agcgcacaggaaataggacgtgatg

SEQ ID NO: 49323 - DNA, 25 bp, Homo sapien
caaccggctggtccaagtgtggacg

SEQ ID NO: 49324 - DNA, 25 bp, Homo sapien
cttcctcgatgtgaagcacttctcc

SEQ ID NO: 49325 - DNA, 25 bp, Homo sapien
cgatccgaccgggacaagttcgtca

SEQ ID NO: 49326 - DNA, 25 bp, Homo sapien
ccggaggacctcaccgtgaaggtgc

SEQ ID NO: 49327 - DNA, 25 bp, Homo sapien
aagttcgtcatcttcctcgatgtga

SEQ ID NO: 49328 - DNA, 25 bp, Homo sapien
caccgtgaaggtgcaggacgacttt

SEQ ID NO: 49329 - DNA, 25 bp, Homo sapien
caggacgactttgtggagatccacg

SEQ ID NO: 49330 - DNA, 25 bp, Homo sapien
atccacggaaagcacaacgagcgcc

SEQ ID NO: 49331 - DNA, 25 bp, Homo sapien
tttggatttcaggttcgatccgacc

SEQ ID NO: 49332 - DNA, 25 bp, Homo sapien
cccaagatccagactggcctggatg

SEQ ID NO: 49333 - DNA, 25 bp, Homo sapien
aagatccagactggcctggatgcca

SEQ ID NO: 49334 - DNA, 25 bp, Homo sapien
tccctgtctgccgatggcatgctga

SEQ ID NO: 49335 - DNA, 25 bp, Homo sapien
atggcatgctgaccttctgtggccc

SEQ ID NO: 49336 - DNA, 25 bp, Homo sapien
tgccgatggcatgctgaccttctgt

SEQ ID NO: 49337 - DNA, 25 bp, Homo sapien
ctggatgccacccacgccgagcgag

SEQ ID NO: 49338 - DNA, 25 bp, Homo sapien
ctgccgtccaacgtggaccagtcgg

SEQ ID NO: 49339 - DNA, 25 bp, Homo sapien
aacgtggaccagtcggccctctctt

SEQ ID NO: 49340 - DNA, 25 bp, Homo sapien
gctttaagggcactcgtgcttttga

SEQ ID NO: 49341 - DNA, 25 bp, Homo sapien
tgccagcgccctcagccaagtaaag

SEQ ID NO: 49342 - DNA, 25 bp, Homo sapien
gcacccaaggggaagcagacgccac

SEQ ID NO: 49343 - DNA, 25 bp, Homo sapien
aggaggtggaactcggcagcttccc

SEQ ID NO: 49344 - DNA, 25 bp, Homo sapien
gtctgctgggtcgtcctgttctctc

SEQ ID NO: 49345 - DNA, 25 bp, Homo sapien
cgcggcaatcaataaacagcaggtg

SEQ ID NO: 49346 - DNA, 25 bp, Homo sapien
ccgggaccagacactgggcggccat

SEQ ID NO: 49347 - DNA, 25 bp, Homo sapien
ggtgatacaagcaacccgccgtctg

SEQ ID NO: 49348 - DNA, 25 bp, Homo sapien
gaggcatgctcatcctacgtgactg

SEQ ID NO: 49349 - DNA, 25 bp, Homo sapien
cccaagagcggaggcgtcagccgca

SEQ ID NO: 49350 - DNA, 25 bp, Homo sapien
gggctccgaggcatgctcatcctac

SEQ ID NO: 49351 - DNA, 25 bp, Homo sapien
ggctgccttcgcacgagggctccga

SEQ ID NO: 49352 - DNA, 25 bp, Homo sapien
tcctacgtgactgcccgagtgtgca

SEQ ID NO: 49353 - DNA, 25 bp, Homo sapien
gtcagccgcatgagtcccaccggaa

SEQ ID NO: 49354 - DNA, 25 bp, Homo sapien
cgtctgttcccaagagcggaggcgt

SEQ ID NO: 49355 - DNA, 25 bp, Homo sapien
tgccctgcagacgacgcattccgga

SEQ ID NO: 49356 - DNA, 25 bp, Homo sapien
tgtctctggaagcttccggagtacc

SEQ ID NO: 49357 - DNA, 25 bp, Homo sapien
gagccgctgtctcgattttacaaaa

SEQ ID NO: 49358 - DNA, 25 bp, Homo sapien
ttccggagtacccaggccttctgca

SEQ ID NO: 49359 - DNA, 25 bp, Homo sapien
cgtggcgtcctccacgtctgtgtct

SEQ ID NO: 49360 - DNA, 25 bp, Homo sapien
aggaaacgctcagcagcaccatctg

SEQ ID NO: 49361 - DNA, 25 bp, Homo sapien
agcgagccgcactcacagtcacagg

SEQ ID NO: 49362 - DNA, 25 bp, Homo sapien
ctctgccgtcacacatggcgtaatc

SEQ ID NO: 49363 - DNA, 25 bp, Homo sapien
ttctgcactccacgcactgcatgtg

SEQ ID NO: 49364 - DNA, 25 bp, Homo sapien
tcggtgtgtagacagcacggcccag

SEQ ID NO: 49365 - DNA, 25 bp, Homo sapien
cccaggccggtgtagacagcacggc

SEQ ID NO: 49366 - DNA, 25 bp, Homo sapien
ccggtgtcagtgtgtagacagcaca

SEQ ID NO: 49367 - DNA, 25 bp, Homo sapien
acggtgtgtagacagcacggcccag

SEQ ID NO: 49368 - DNA, 25 bp, Homo sapien
cggcccaggccggtgtagacagcac

SEQ ID NO: 49369 - DNA, 25 bp, Homo sapien
gtcagtgtgtagacagcacagccca

SEQ ID NO: 49370 - DNA, 25 bp, Homo sapien
tgtcggtgtgtagacagcacggccc

SEQ ID NO: 49371 - DNA, 25 bp, Homo sapien
gacggtgtgtagacagcacggccca

SEQ ID NO: 49372 - DNA, 25 bp, Homo sapien
ttgctgcttcggcacaggggactcc

SEQ ID NO: 49373 - DNA, 25 bp, Homo sapien
cggccaagttcctcagggagcccgc

SEQ ID NO: 49374 - DNA, 25 bp, Homo sapien
cttctcgtgctgctgcgcatccggg

SEQ ID NO: 49375 - DNA, 25 bp, Homo sapien
cgcatccggggagcggcccagttac

SEQ ID NO: 49376 - DNA, 25 bp, Homo sapien
gcggcccagttacgctcaccatggt

SEQ ID NO: 49377 - DNA, 25 bp, Homo sapien
ggcccagttacgctcaccatggtgg

SEQ ID NO: 49378 - DNA, 25 bp, Homo sapien
gtgcgtgtctttcgtggtgctccac

SEQ ID NO: 49379 - DNA, 25 bp, Homo sapien
tgtctttcgtggtgctccaccctct

SEQ ID NO: 49380 - DNA, 25 bp, Homo sapien
aagaccacacggctgcatctgcttg

SEQ ID NO: 49381 - DNA, 25 bp, Homo sapien
ttctgtgcgggaactcccgagctca

SEQ ID NO: 49382 - DNA, 25 bp, Homo sapien
ctgggtaattctgcagcagcagcgc

SEQ ID NO: 49383 - DNA, 25 bp, Homo sapien
ggcactgccgatatgtcgccttcca

SEQ ID NO: 49384 - DNA, 25 bp, Homo sapien
cctgggaatttaggtcgggcactgc

SEQ ID NO: 49385 - DNA, 25 bp, Homo sapien
cctggccacagtgcctgggaattta

SEQ ID NO: 49386 - DNA, 25 bp, Homo sapien
gtagtaacccggacgtctctctctc

SEQ ID NO: 49387 - DNA, 25 bp, Homo sapien
cgagtgacgtgagggttcatgaccc

SEQ ID NO: 49388 - DNA, 25 bp, Homo sapien
ggtgcatggcctcgccagcgatggc

SEQ ID NO: 49389 - DNA, 25 bp, Homo sapien
ccggcggaaggtccagcgcggagac

SEQ ID NO: 49390 - DNA, 25 bp, Homo sapien
aaggtccagcgcggagacccacagt

SEQ ID NO: 49391 - DNA, 25 bp, Homo sapien
agacccacagtgctggggcgtggag

SEQ ID NO: 49392 - DNA, 25 bp, Homo sapien
ccagcagcgggcgagtggctcagag

SEQ ID NO: 49393 - DNA, 25 bp, Homo sapien
gctcagaggtgaccgatcggagccc

SEQ ID NO: 49394 - DNA, 25 bp, Homo sapien
cagaggtgaccgatcggagccccgc

SEQ ID NO: 49395 - DNA, 25 bp, Homo sapien
agcgatggcgggaggctcttggagg

SEQ ID NO: 49396 - DNA, 25 bp, Homo sapien
gcaggcggtcaggtcgccaacaatc

SEQ ID NO: 49397 - DNA, 25 bp, Homo sapien
ccgttcagggtgacagaaaagcaca

SEQ ID NO: 49398 - DNA, 25 bp, Homo sapien
catgtcgcgcccttgtcacgggagc

SEQ ID NO: 49399 - DNA, 25 bp, Homo sapien
acggtgcttcttccctggtgggtgt

SEQ ID NO: 49400 - DNA, 25 bp, Homo sapien
gtcaggtcgccaacaatccggtcaa

SEQ ID NO: 49401 - DNA, 25 bp, Homo sapien
ccacgacggaataagcaggcggtca

SEQ ID NO: 49402 - DNA, 25 bp, Homo sapien
aggaggcgcgtccacgacggaataa

SEQ ID NO: 49403 - DNA, 25 bp, Homo sapien
atccggtcaaccacggtgcttcttc

SEQ ID NO: 49404 - DNA, 25 bp, Homo sapien
cagctcagagatgcggccacaaggc

SEQ ID NO: 49405 - DNA, 25 bp, Homo sapien
tttctcagcagctcagagatgcggc

SEQ ID NO: 49406 - DNA, 25 bp, Homo sapien
tttcattctccacccggtttctcag

SEQ ID NO: 49407 - DNA, 25 bp, Homo sapien
gcaggtgcgtggctgatccctgacc

SEQ ID NO: 49408 - DNA, 25 bp, Homo sapien
tctcgggtttccgagtgcccgtgtg

SEQ ID NO: 49409 - DNA, 25 bp, Homo sapien
acaggtggtcactgcgccggctcgc

SEQ ID NO: 49410 - DNA, 25 bp, Homo sapien
cccagggccatcacagggggcgatc

SEQ ID NO: 49411 - DNA, 25 bp, Homo sapien
tcactgcgccggctcgcagggttct

SEQ ID NO: 49412 - DNA, 25 bp, Homo sapien
acgtggtttgacacgccagggccca

SEQ ID NO: 49413 - DNA, 25 bp, Homo sapien
ggtccacgcccagggtctgcatgat

SEQ ID NO: 49414 - DNA, 25 bp, Homo sapien
ggtctgcatgatacccagcgcctgc

SEQ ID NO: 49415 - DNA, 25 bp, Homo sapien
tgcatgatacccagcgcctgctcat

SEQ ID NO: 49416 - DNA, 25 bp, Homo sapien
ctgctcatcgtagtcgcccaggttg

SEQ ID NO: 49417 - DNA, 25 bp, Homo sapien
ggtccaccaccagcatgcggcggat

SEQ ID NO: 49418 - DNA, 25 bp, Homo sapien
gctctcacagtctgtggaggggcca

SEQ ID NO: 49419 - DNA, 25 bp, Homo sapien
ggcggatcaggctctcacagtctgt

SEQ ID NO: 49420 - DNA, 25 bp, Homo sapien
tgtgcgcggaacagccgcttttaca

SEQ ID NO: 49421 - DNA, 25 bp, Homo sapien
gaccctgtgagcctgctgatggcca

SEQ ID NO: 49422 - DNA, 25 bp, Homo sapien
gtgaccacctgaaagccagatgagc

SEQ ID NO: 49423 - DNA, 25 bp, Homo sapien
gatgcacggcgagttctctcagtgg

SEQ ID NO: 49424 - DNA, 25 bp, Homo sapien
ccgggaccctggctagagtctgaaa

SEQ ID NO: 49425 - DNA, 25 bp, Homo sapien
tacactcgcctgatgggtggccttc

SEQ ID NO: 49426 - DNA, 25 bp, Homo sapien
ccagcatatggagaacgcggcagga

SEQ ID NO: 49427 - DNA, 25 bp, Homo sapien
ccgtgccgggagcataaagccacca

SEQ ID NO: 49428 - DNA, 25 bp, Homo sapien
tcccacccgccgagcacacgctgtc

SEQ ID NO: 49429 - DNA, 25 bp, Homo sapien
cgcagcctcctatcagcgctgggct

SEQ ID NO: 49430 - DNA, 25 bp, Homo sapien
acgcccgcaggtgggcagcgtcact

SEQ ID NO: 49431 - DNA, 25 bp, Homo sapien
gaaagctgcacctcgggctgcactc

SEQ ID NO: 49432 - DNA, 25 bp, Homo sapien
tgtccccgtctcgtgtcccgaggag

SEQ ID NO: 49433 - DNA, 25 bp, Homo sapien
tgcttcctcccagcctgaaagctgc

SEQ ID NO: 49434 - DNA, 25 bp, Homo sapien
cctgaaagctgcacctcgggctgca

SEQ ID NO: 49435 - DNA, 25 bp, Homo sapien
ctgggctccgtaccgccacacagcc

SEQ ID NO: 49436 - DNA, 25 bp, Homo sapien
actgcacacatgctgggttggtgcc

SEQ ID NO: 49437 - DNA, 25 bp, Homo sapien
gcagtgatgcgtggccacgtctaca

SEQ ID NO: 49438 - DNA, 25 bp, Homo sapien
atgccaccgagcatgccgggtgcca

SEQ ID NO: 49439 - DNA, 25 bp, Homo sapien
cgagctgctggcatgttcggtgcct

SEQ ID NO: 49440 - DNA, 25 bp, Homo sapien
gttcggtgcctgctggctgaacctc

SEQ ID NO: 49441 - DNA, 25 bp, Homo sapien
ggtggctttgcttcatcactgtctg

SEQ ID NO: 49442 - DNA, 25 bp, Homo sapien
tcactgtctggttcaccgtgctcta

SEQ ID NO: 49443 - DNA, 25 bp, Homo sapien
ctctaagttcgggagccctgcgagc

SEQ ID NO: 49444 - DNA, 25 bp, Homo sapien
gatctgctgctcgtctcaggctcgt

SEQ ID NO: 49445 - DNA, 25 bp, Homo sapien
gctcgtctcaggctcgtagttcgcc

SEQ ID NO: 49446 - DNA, 25 bp, Homo sapien
gtctcaggctcgtagttcgccttca

SEQ ID NO: 49447 - DNA, 25 bp, Homo sapien
aggctcgtagttcgccttcaacatg

SEQ ID NO: 49448 - DNA, 25 bp, Homo sapien
cgtagttcgccttcaacatgccgga

SEQ ID NO: 49449 - DNA, 25 bp, Homo sapien
aagggctcgaagaaagccgtgacta

SEQ ID NO: 49450 - DNA, 25 bp, Homo sapien
tgctgctcgtctcaggctcgtagtt

SEQ ID NO: 49451 - DNA, 25 bp, Homo sapien
cgaagaaagccgtgactaaggcgca

SEQ ID NO: 49452 - DNA, 25 bp, Homo sapien
tctctggaattagcaagcagcccgc

SEQ ID NO: 49453 - DNA, 25 bp, Homo sapien
acgtgtggagtgacctagtccatta

SEQ ID NO: 49454 - DNA, 25 bp, Homo sapien
tccacgccacggagatcgcaggtaa

SEQ ID NO: 49455 - DNA, 25 bp, Homo sapien
ttttgtgtcaacaggcacctcggga

SEQ ID NO: 49456 - DNA, 25 bp, Homo sapien
cctcgctcggattcaggcgctttta

SEQ ID NO: 49457 - DNA, 25 bp, Homo sapien
cctgtttggcgaggaatgctacact

SEQ ID NO: 49458 - DNA, 25 bp, Homo sapien
cctagacaactgagcggagcaactg

SEQ ID NO: 49459 - DNA, 25 bp, Homo sapien
ctgctggctcaacgaggtgtgctaa

SEQ ID NO: 49460 - DNA, 25 bp, Homo sapien
cccacgtgctcggagcggagcagct

SEQ ID NO: 49461 - DNA, 25 bp, Homo sapien
tcctggagtttcttgttacggtcca

SEQ ID NO: 49462 - DNA, 25 bp, Homo sapien
ttgccagccctaatgccctccgaga

SEQ ID NO: 49463 - DNA, 25 bp, Homo sapien
ggacaggtgtttgcccacctaggcc

SEQ ID NO: 49464 - DNA, 25 bp, Homo sapien
ccatgcgggacaggtgtttgcccac

SEQ ID NO: 49465 - DNA, 25 bp, Homo sapien
cgggagaagagctcatactacgttc

SEQ ID NO: 49466 - DNA, 25 bp, Homo sapien
cgggcgagcccaagtcgaagcccga

SEQ ID NO: 49467 - DNA, 25 bp, Homo sapien
ttgttacggtccacacaggcgaagg

SEQ ID NO: 49468 - DNA, 25 bp, Homo sapien
agaccgttctcctgtaagttcatta

SEQ ID NO: 49469 - DNA, 25 bp, Homo sapien
ctgagccttctgctgaggtccttgc

SEQ ID NO: 49470 - DNA, 25 bp, Homo sapien
gtccttgcgtggagcacactcattc

SEQ ID NO: 49471 - DNA, 25 bp, Homo sapien
acgttccagccgagtcactgcctga

SEQ ID NO: 49472 - DNA, 25 bp, Homo sapien
agtcactgcctgaccggctccatgg

SEQ ID NO: 49473 - DNA, 25 bp, Homo sapien
gctcagcgacctttcctctcaaatg

SEQ ID NO: 49474 - DNA, 25 bp, Homo sapien
tctcaaatgcggaagcgtgcactta

SEQ ID NO: 49475 - DNA, 25 bp, Homo sapien
cgtgcacttacagttcagaccgttc

SEQ ID NO: 49476 - DNA, 25 bp, Homo sapien
gcgcggagctaagtgtaggcgccgg

SEQ ID NO: 49477 - DNA, 25 bp, Homo sapien
ggtagcagctgttgtgccctccctt

SEQ ID NO: 49478 - DNA, 25 bp, Homo sapien
tagcagctgttgtgccctcccttgg

SEQ ID NO: 49479 - DNA, 25 bp, Homo sapien
cgagtccggcgctgggtaactgttg

SEQ ID NO: 49480 - DNA, 25 bp, Homo sapien
cagacacggggaactcaggtcatcc

SEQ ID NO: 49481 - DNA, 25 bp, Homo sapien
tagaggagcggctagaaagcagaca

SEQ ID NO: 49482 - DNA, 25 bp, Homo sapien
gctagaaagcagacacggggaactc

SEQ ID NO: 49483 - DNA, 25 bp, Homo sapien
gacttagggcctgggctcacctcgg

SEQ ID NO: 49484 - DNA, 25 bp, Homo sapien
tgcgcctaagcatgtacacacgtgc

SEQ ID NO: 49485 - DNA, 25 bp, Homo sapien
ctcgggaaaacatggagaaacatgc

SEQ ID NO: 49486 - DNA, 25 bp, Homo sapien
agctcccaacaactaatcgaccaga

SEQ ID NO: 49487 - DNA, 25 bp, Homo sapien
aacgcatggaagtgtcagcccggca

SEQ ID NO: 49488 - DNA, 25 bp, Homo sapien
tgacgaccgatgacaacgcatggaa

SEQ ID NO: 49489 - DNA, 25 bp, Homo sapien
gttgaccgctagatgacgaccgatg

SEQ ID NO: 49490 - DNA, 25 bp, Homo sapien
cgtgcacgccatatcccacaatata

SEQ ID NO: 49491 - DNA, 25 bp, Homo sapien
ggagagaagccacgctccttccgta

SEQ ID NO: 49492 - DNA, 25 bp, Homo sapien
acgaacgaatgaacggcgctgcaga

SEQ ID NO: 49493 - DNA, 25 bp, Homo sapien
ctgaggcggagcacaatggttgaat

SEQ ID NO: 49494 - DNA, 25 bp, Homo sapien
tccaggcggaatgaaagtgcaaacc

SEQ ID NO: 49495 - DNA, 25 bp, Homo sapien
gggtgctctccatacagagccacgt

SEQ ID NO: 49496 - DNA, 25 bp, Homo sapien
cgtcatccgcggctacgtgggcaac

SEQ ID NO: 49497 - DNA, 25 bp, Homo sapien
agccctgtgcaccagctatggcgca

SEQ ID NO: 49498 - DNA, 25 bp, Homo sapien
catccgcgttgcgagagtgtcgcgc

SEQ ID NO: 49499 - DNA, 25 bp, Homo sapien
tgcaaacccagcgtttcgggcggca

SEQ ID NO: 49500 - DNA, 25 bp, Homo sapien
tcacgtagtgtctggctgtctgcct

SEQ ID NO: 49501 - DNA, 25 bp, Homo sapien
tccagccggatgactgatgaggttg

SEQ ID NO: 49502 - DNA, 25 bp, Homo sapien
cttggcgcttgtttacggagttaca

SEQ ID NO: 49503 - DNA, 25 bp, Homo sapien
ggactctgctgggattattttgacc

SEQ ID NO: 49504 - DNA, 25 bp, Homo sapien
caggaggaagttgcgaccctttcta

SEQ ID NO: 49505 - DNA, 25 bp, Homo sapien
aaccctcgttcttcgcgtgctgtcg

SEQ ID NO: 49506 - DNA, 25 bp, Homo sapien
tgtccttcagacttcccagcggaga

SEQ ID NO: 49507 - DNA, 25 bp, Homo sapien
gttgaaagcacttccgctgcggccc

SEQ ID NO: 49508 - DNA, 25 bp, Homo sapien
aatgtcttcacgagcgtgcatcagg

SEQ ID NO: 49509 - DNA, 25 bp, Homo sapien
ccgccacaccagcaggaaggaggat

SEQ ID NO: 49510 - DNA, 25 bp, Homo sapien
acgggtttcgcagccatgtttcctg

SEQ ID NO: 49511 - DNA, 25 bp, Homo sapien
tcagacacgggtttcgcagccatgt

SEQ ID NO: 49512 - DNA, 25 bp, Homo sapien
ttcacgagcgtgcatcagggcgcct

SEQ ID NO: 49513 - DNA, 25 bp, Homo sapien
atgtttcctggctccgaggacacgg

SEQ ID NO: 49514 - DNA, 25 bp, Homo sapien
cgttctgaatgtcttcacgagcgtg

SEQ ID NO: 49515 - DNA, 25 bp, Homo sapien
ccagtgagtcagacacgggtttcgc

SEQ ID NO: 49516 - DNA, 25 bp, Homo sapien
ggctcctcagcccaagtaggcgctg

SEQ ID NO: 49517 - DNA, 25 bp, Homo sapien
caccgcttgtgaccgagaacactga

SEQ ID NO: 49518 - DNA, 25 bp, Homo sapien
gctgcagtggacatcaccgcttgtg

SEQ ID NO: 49519 - DNA, 25 bp, Homo sapien
ctggtatcgtctttccgggcgccga

SEQ ID NO: 49520 - DNA, 25 bp, Homo sapien
caaagcggcttctttcgctccagga

SEQ ID NO: 49521 - DNA, 25 bp, Homo sapien
gagggaggcctctcacggccacagc

SEQ ID NO: 49522 - DNA, 25 bp, Homo sapien
gcagtcggagtaggcgcaatcctgc

SEQ ID NO: 49523 - DNA, 25 bp, Homo sapien
cacccacctggtcggcgatgtgctg

SEQ ID NO: 49524 - DNA, 25 bp, Homo sapien
tgcgacatacccattgtgcgcacga

SEQ ID NO: 49525 - DNA, 25 bp, Homo sapien
ctgtgcatctgacacgcccattgtg

SEQ ID NO: 49526 - DNA, 25 bp, Homo sapien
cgtgacatgcccactgtgcgtctga

SEQ ID NO: 49527 - DNA, 25 bp, Homo sapien
ctgtgcgcatgacacaccctgtgtg

SEQ ID NO: 49528 - DNA, 25 bp, Homo sapien
ctgtgcgcgtgaaatacccattgtg

SEQ ID NO: 49529 - DNA, 25 bp, Homo sapien
gcgcgcgacatacccactgtgtgag

SEQ ID NO: 49530 - DNA, 25 bp, Homo sapien
ttgcatgcgacatacccactgtgca

SEQ ID NO: 49531 - DNA, 25 bp, Homo sapien
tgcccactgtttgcatgcgacatac

SEQ ID NO: 49532 - DNA, 25 bp, Homo sapien
gcgtcatggtttcgcgcgtgcagct

SEQ ID NO: 49533 - DNA, 25 bp, Homo sapien
cgagccctgtggaacctccacgtgg

SEQ ID NO: 49534 - DNA, 25 bp, Homo sapien
acatcgtcgccaggactcagcgggc

SEQ ID NO: 49535 - DNA, 25 bp, Homo sapien
gctccggaaatacatcgtcgccagg

SEQ ID NO: 49536 - DNA, 25 bp, Homo sapien
cgcgtgctcagtgtgctgggtacca

SEQ ID NO: 49537 - DNA, 25 bp, Homo sapien
tgactctggtccctctgcgagaacg

SEQ ID NO: 49538 - DNA, 25 bp, Homo sapien
ccgctttccctcgtggtgcggtgac

SEQ ID NO: 49539 - DNA, 25 bp, Homo sapien
gcggtgaggaagctccggaaataca

SEQ ID NO: 49540 - DNA, 25 bp, Homo sapien
cctcttcgaagagctccaggctgta

SEQ ID NO: 49541 - DNA, 25 bp, Homo sapien
tacggccctggattcagagcgggac

SEQ ID NO: 49542 - DNA, 25 bp, Homo sapien
tcactgccctcatctgcggagtcgg

SEQ ID NO: 49543 - DNA, 25 bp, Homo sapien
tcagacgtgcagtactccctggggt

SEQ ID NO: 49544 - DNA, 25 bp, Homo sapien
acctccacgatgtcgcggtcagacg

SEQ ID NO: 49545 - DNA, 25 bp, Homo sapien
gtgtacacgtactcggtgcgcacca

SEQ ID NO: 49546 - DNA, 25 bp, Homo sapien
tcgtcgtcggcgaagtagaccacgc

SEQ ID NO: 49547 - DNA, 25 bp, Homo sapien
cgtctccgcgcagcttgtagttgcg

SEQ ID NO: 49548 - DNA, 25 bp, Homo sapien
tgcccgagcaaaggcggccaatgtc

SEQ ID NO: 49549 - DNA, 25 bp, Homo sapien
tgaccagtgcccgagcaaaggcggc

SEQ ID NO: 49550 - DNA, 25 bp, Homo sapien
caaaggcggccaatgtccaggagcc

SEQ ID NO: 49551 - DNA, 25 bp, Homo sapien
cttgcaccgcgggacgaggctgacc

SEQ ID NO: 49552 - DNA, 25 bp, Homo sapien
ccaatgtccaggagccggagaagaa

SEQ ID NO: 49553 - DNA, 25 bp, Homo sapien
aggcctcgcttgcaccgcgggacga

SEQ ID NO: 49554 - DNA, 25 bp, Homo sapien
gctccgagatcagcccaggggccgt

SEQ ID NO: 49555 - DNA, 25 bp, Homo sapien
ccagagaaggaggacacctcggccc

SEQ ID NO: 49556 - DNA, 25 bp, Homo sapien
cagcgccacatctctgactgcaggg

SEQ ID NO: 49557 - DNA, 25 bp, Homo sapien
gctcatggaaatccagcgcccagcg

SEQ ID NO: 49558 - DNA, 25 bp, Homo sapien
gagagcatgatccagcacccggcgc

SEQ ID NO: 49559 - DNA, 25 bp, Homo sapien
cccgtacacaaggagagcatgatcc

SEQ ID NO: 49560 - DNA, 25 bp, Homo sapien
gagaagagaggaatttcgacagccc

SEQ ID NO: 49561 - DNA, 25 bp, Homo sapien
tcaaatacggtaacccgagaagaga

SEQ ID NO: 49562 - DNA, 25 bp, Homo sapien
cccggccaaggcaggtatcaaatac

SEQ ID NO: 49563 - DNA, 25 bp, Homo sapien
gcactagctcggcttgctgagaacc

SEQ ID NO: 49564 - DNA, 25 bp, Homo sapien
acgctgagagtctgccggggcacct

SEQ ID NO: 49565 - DNA, 25 bp, Homo sapien
gccacggcctgtgtcacggaggaag

SEQ ID NO: 49566 - DNA, 25 bp, Homo sapien
gcagtagtggcagcttattaccaca

SEQ ID NO: 49567 - DNA, 25 bp, Homo sapien
ggcagcttattaccacatcaggaga

SEQ ID NO: 49568 - DNA, 25 bp, Homo sapien
ttaccacatcaggagaggccggagc

SEQ ID NO: 49569 - DNA, 25 bp, Homo sapien
ccggagcgttttcagcaaggtcaga

SEQ ID NO: 49570 - DNA, 25 bp, Homo sapien
agcaaggtcagaagcctgcgctgtg

SEQ ID NO: 49571 - DNA, 25 bp, Homo sapien
gaagcctgcgctgtgtttaaaatca

SEQ ID NO: 49572 - DNA, 25 bp, Homo sapien
ctggccggtcagcaagcagctctac

SEQ ID NO: 49573 - DNA, 25 bp, Homo sapien
tgcacctgctggtcggctttgtctt

SEQ ID NO: 49574 - DNA, 25 bp, Homo sapien
tcttcgtggtgagtggtctggtcat

SEQ ID NO: 49575 - DNA, 25 bp, Homo sapien
agtggtctggtcatcaacttcgtcc

SEQ ID NO: 49576 - DNA, 25 bp, Homo sapien
gaagacccagttcgtgctgcacctg

SEQ ID NO: 49577 - DNA, 25 bp, Homo sapien
tgtcctcagcgaggggccgtgcacc

SEQ ID NO: 49578 - DNA, 25 bp, Homo sapien
tcaacttcgtccagctgtgcacgct

SEQ ID NO: 49579 - DNA, 25 bp, Homo sapien
tcgcctactcactctggagccgtga

SEQ ID NO: 49580 - DNA, 25 bp, Homo sapien
ccgatgggctttcgcaagagacacc

SEQ ID NO: 49581 - DNA, 25 bp, Homo sapien
cggcaccttggaaagaccgcgagtg

SEQ ID NO: 49582 - DNA, 25 bp, Homo sapien
agcaggggcgccaaccctacatcgg

SEQ ID NO: 49583 - DNA, 25 bp, Homo sapien
ctccactgttcgctggttgacccgg

SEQ ID NO: 49584 - DNA, 25 bp, Homo sapien
ttggatccttatcccaccaatctgg

SEQ ID NO: 49585 - DNA, 25 bp, Homo sapien
gcggacagacctagttggatcctta

SEQ ID NO: 49586 - DNA, 25 bp, Homo sapien
acgctcgctgcagacatctagtgga

SEQ ID NO: 49587 - DNA, 25 bp, Homo sapien
ggtctgactttcagcagatcgcagc

SEQ ID NO: 49588 - DNA, 25 bp, Homo sapien
aatactcgctttgaacttgtaaggc

SEQ ID NO: 49589 - DNA, 25 bp, Homo sapien
ggagagactcctcatccgccatcct

SEQ ID NO: 49590 - DNA, 25 bp, Homo sapien
tcaccgcttcgctgtttgaggagca

SEQ ID NO: 49591 - DNA, 25 bp, Homo sapien
ctttgaacttgtaaggcttcggctg

SEQ ID NO: 49592 - DNA, 25 bp, Homo sapien
aggcttcggctgttcaggtcactca

SEQ ID NO: 49593 - DNA, 25 bp, Homo sapien
ttgcccgatcatattttaataaata

SEQ ID NO: 49594 - DNA, 25 bp, Homo sapien
ggtcactcaccgcttcgctgtttga

SEQ ID NO: 49595 - DNA, 25 bp, Homo sapien
cgctgtttgaggagcagcagtgtcc

SEQ ID NO: 49596 - DNA, 25 bp, Homo sapien
tggctgctttctctccttaaactta

SEQ ID NO: 49597 - DNA, 25 bp, Homo sapien
taagcacaccggcacgaacgtcagg

SEQ ID NO: 49598 - DNA, 25 bp, Homo sapien
gggcgcccgtagtgataagcacacc

SEQ ID NO: 49599 - DNA, 25 bp, Homo sapien
gctcagcaccttggctcccagtggg

SEQ ID NO: 49600 - DNA, 25 bp, Homo sapien
gggagcatcgctcggctcagcacct

SEQ ID NO: 49601 - DNA, 25 bp, Homo sapien
aatgaatttctgctgtcctcctggg

SEQ ID NO: 49602 - DNA, 25 bp, Homo sapien
cccgaaactgtctcgtaatgaattt

SEQ ID NO: 49603 - DNA, 25 bp, Homo sapien
acgtcaggtccattcctcgaagtcg

SEQ ID NO: 49604 - DNA, 25 bp, Homo sapien
gcgcccactgccgagggaggaagat

SEQ ID NO: 49605 - DNA, 25 bp, Homo sapien
gccctctgaccttcccgccgggcga

SEQ ID NO: 49606 - DNA, 25 bp, Homo sapien
tgacttttcggggacgccctctgac

SEQ ID NO: 49607 - DNA, 25 bp, Homo sapien
ccatcgtcacctgtgagtgcccgga

SEQ ID NO: 49608 - DNA, 25 bp, Homo sapien
catggagaacaagcccatcgtcacc

SEQ ID NO: 49609 - DNA, 25 bp, Homo sapien
ccggtgatctacaccatggagaaca

SEQ ID NO: 49610 - DNA, 25 bp, Homo sapien
gctgccgccggtgatctacaccatg

SEQ ID NO: 49611 - DNA, 25 bp, Homo sapien
cgcacttccgtcggaggcgaagcgc

SEQ ID NO: 49612 - DNA, 25 bp, Homo sapien
ctggtccctaacgagcgagcgtcca

SEQ ID NO: 49613 - DNA, 25 bp, Homo sapien
acccaggtgtgagctctgtttcccg

SEQ ID NO: 49614 - DNA, 25 bp, Homo sapien
tgcacgccgtcgcttcccggaagtg

SEQ ID NO: 49615 - DNA, 25 bp, Homo sapien
acggccgtgatgaagttcgcttacc

SEQ ID NO: 49616 - DNA, 25 bp, Homo sapien
cttctcggagggaacagggacattt

SEQ ID NO: 49617 - DNA, 25 bp, Homo sapien
gttgggcctcgcgttcaaactccgc

SEQ ID NO: 49618 - DNA, 25 bp, Homo sapien
cctaaaggctggagttggtgcagtc

SEQ ID NO: 49619 - DNA, 25 bp, Homo sapien
tgagtatggcccaacctaaaggctg

SEQ ID NO: 49620 - DNA, 25 bp, Homo sapien
gcggcatctgcattcacgtccctgt

SEQ ID NO: 49621 - DNA, 25 bp, Homo sapien
tcgctgttctctgcccaaggtcggc

SEQ ID NO: 49622 - DNA, 25 bp, Homo sapien
gtctacgatgggaccgagatccacg

SEQ ID NO: 49623 - DNA, 25 bp, Homo sapien
agtcccgacgagcaacgcgtttgta

SEQ ID NO: 49624 - DNA, 25 bp, Homo sapien
caccggcgaactcactggatagggc

SEQ ID NO: 49625 - DNA, 25 bp, Homo sapien
cccggaactctattcggaggctctg

SEQ ID NO: 49626 - DNA, 25 bp, Homo sapien
accctggacgctcgtggtgagttaa

SEQ ID NO: 49627 - DNA, 25 bp, Homo sapien
ccgagattaagacgagtggccattt

SEQ ID NO: 49628 - DNA, 25 bp, Homo sapien
acagtgatgagcagagtccagggca

SEQ ID NO: 49629 - DNA, 25 bp, Homo sapien
cgtgcgtgctcacccttatgtaccg

SEQ ID NO: 49630 - DNA, 25 bp, Homo sapien
gctcctcattacctgagtggcggta

SEQ ID NO: 49631 - DNA, 25 bp, Homo sapien
tcttcggcatctccaaggctggctg

SEQ ID NO: 49632 - DNA, 25 bp, Homo sapien
ggcagcacgatgaggacgatcgcta

SEQ ID NO: 49633 - DNA, 25 bp, Homo sapien
ctctggtgccagacagtgatgagca

SEQ ID NO: 49634 - DNA, 25 bp, Homo sapien
ctcacccttatgtaccgcgagcagg

SEQ ID NO: 49635 - DNA, 25 bp, Homo sapien
cgatcgctaggatgtcccgtctctt

SEQ ID NO: 49636 - DNA, 25 bp, Homo sapien
tgtgtgctcttcagcgtctgctgcc

SEQ ID NO: 49637 - DNA, 25 bp, Homo sapien
tggccgctcactaccgagttctgtc

SEQ ID NO: 49638 - DNA, 25 bp, Homo sapien
tgaacatcagtgaggcgcactcgcg

SEQ ID NO: 49639 - DNA, 25 bp, Homo sapien
agccgcacttgcgtgggtgaacatc

SEQ ID NO: 49640 - DNA, 25 bp, Homo sapien
tccaggtctcagctgcgtctggtgc

SEQ ID NO: 49641 - DNA, 25 bp, Homo sapien
gtgtgatgcttccacgagcctcccg

SEQ ID NO: 49642 - DNA, 25 bp, Homo sapien
tccttcatccacgtaagcgccttgg

SEQ ID NO: 49643 - DNA, 25 bp, Homo sapien
tgccgggaagtcactctcagatgtg

SEQ ID NO: 49644 - DNA, 25 bp, Homo sapien
tccagggctatcaggcgctctggct

SEQ ID NO: 49645 - DNA, 25 bp, Homo sapien
accatgctgtaaacctgcgcggctc

SEQ ID NO: 49646 - DNA, 25 bp, Homo sapien
tggcagtttgctcctgccgtgtggc

SEQ ID NO: 49647 - DNA, 25 bp, Homo sapien
agggcatcgtctctaagcctgcagc

SEQ ID NO: 49648 - DNA, 25 bp, Homo sapien
ctcgattcgtcagcagtcggggtca

SEQ ID NO: 49649 - DNA, 25 bp, Homo sapien
tccgaattttccgaggaccaagtgc

SEQ ID NO: 49650 - DNA, 25 bp, Homo sapien
tgcggtcacacacaggaccatgctg

SEQ ID NO: 49651 - DNA, 25 bp, Homo sapien
ttgtgggacgcccacattgccggtc

SEQ ID NO: 49652 - DNA, 25 bp, Homo sapien
tgtcaggtgcccatggcatatggta

SEQ ID NO: 49653 - DNA, 25 bp, Homo sapien
ttcttcagactggacatgcggtgcg

SEQ ID NO: 49654 - DNA, 25 bp, Homo sapien
tctgtgggattcttcagactggaca

SEQ ID NO: 49655 - DNA, 25 bp, Homo sapien
ggctgctcttctgtgggattcttca

SEQ ID NO: 49656 - DNA, 25 bp, Homo sapien
gcgttcccacatgcgggctgctctt

SEQ ID NO: 49657 - DNA, 25 bp, Homo sapien
gtgttatagaaaagcatgtgcgttc

SEQ ID NO: 49658 - DNA, 25 bp, Homo sapien
tggcatatggtatgagccctgcttt

SEQ ID NO: 49659 - DNA, 25 bp, Homo sapien
tggtatgagccctgcttttcttttc

SEQ ID NO: 49660 - DNA, 25 bp, Homo sapien
gacgcgtccgcctggaacctcggga

SEQ ID NO: 49661 - DNA, 25 bp, Homo sapien
tggaacctcgggaagggatgcgtcc

SEQ ID NO: 49662 - DNA, 25 bp, Homo sapien
agggacgcgtccgcctggaacctcg

SEQ ID NO: 49663 - DNA, 25 bp, Homo sapien
atgcgtccgcctggaacctcgggaa

SEQ ID NO: 49664 - DNA, 25 bp, Homo sapien
acctcgggaagggatgcgtccgcct

SEQ ID NO: 49665 - DNA, 25 bp, Homo sapien
gaagggatgcgtccgcctggaacct

SEQ ID NO: 49666 - DNA, 25 bp, Homo sapien
gatgcgtccgcctggaacctcggga

SEQ ID NO: 49667 - DNA, 25 bp, Homo sapien
gaacctcgggaagggatgcgtccgc

SEQ ID NO: 49668 - DNA, 25 bp, Homo sapien
agtctgacttctccgtggtgccgcc

SEQ ID NO: 49669 - DNA, 25 bp, Homo sapien
gagtctgacttctccgtggtgccgc

SEQ ID NO: 49670 - DNA, 25 bp, Homo sapien
ccggagtctgacttctccgtggtgc

SEQ ID NO: 49671 - DNA, 25 bp, Homo sapien
ccagccggagtctgacttctccgtg

SEQ ID NO: 49672 - DNA, 25 bp, Homo sapien
gttgccagcccagccggagtctgac

SEQ ID NO: 49673 - DNA, 25 bp, Homo sapien
gtgtcggcctcatcctgcgcctcag

SEQ ID NO: 49674 - DNA, 25 bp, Homo sapien
ccctgtgtcggcctcatcctgcgcc

SEQ ID NO: 49675 - DNA, 25 bp, Homo sapien
tgaggggacggctcggaccgcccgc

SEQ ID NO: 49676 - DNA, 25 bp, Homo sapien
cgtcccatcctgagcaggggtttta

SEQ ID NO: 49677 - DNA, 25 bp, Homo sapien
gccggaaacatagcgcgcacctgga

SEQ ID NO: 49678 - DNA, 25 bp, Homo sapien
acgagctgttccttcaggtaccgtc

SEQ ID NO: 49679 - DNA, 25 bp, Homo sapien
cccgagttcgggaagagattctgta

SEQ ID NO: 49680 - DNA, 25 bp, Homo sapien
gagaccggaggatgttccctgctca

SEQ ID NO: 49681 - DNA, 25 bp, Homo sapien
agctcctacttcattctacggccga

SEQ ID NO: 49682 - DNA, 25 bp, Homo sapien
ccgtttctgattaagggcttcccag

SEQ ID NO: 49683 - DNA, 25 bp, Homo sapien
atttcgtttcctcttggcgcacctg

SEQ ID NO: 49684 - DNA, 25 bp, Homo sapien
gatcgtcagacgttaggaaatccca

SEQ ID NO: 49685 - DNA, 25 bp, Homo sapien
gccaacgcaagctgggatcgtcaga

SEQ ID NO: 49686 - DNA, 25 bp, Homo sapien
gcatagatgcctgcttcctccacga

SEQ ID NO: 49687 - DNA, 25 bp, Homo sapien
ggcggccgagattccgcatagatgc

SEQ ID NO: 49688 - DNA, 25 bp, Homo sapien
caggcacctctctgtggacaaggca

SEQ ID NO: 49689 - DNA, 25 bp, Homo sapien
acacattcgggagacgtcggcacac

SEQ ID NO: 49690 - DNA, 25 bp, Homo sapien
cggcacacgctcgaagcagcggaca

SEQ ID NO: 49691 - DNA, 25 bp, Homo sapien
gacctccacgtgtggctggcccagt

SEQ ID NO: 49692 - DNA, 25 bp, Homo sapien
taggaaatcagcagtgccagggagt

SEQ ID NO: 49693 - DNA, 25 bp, Homo sapien
cccttcttctaggaaatcagcagtg

SEQ ID NO: 49694 - DNA, 25 bp, Homo sapien
ttctcccttcttctaggaaatcagc

SEQ ID NO: 49695 - DNA, 25 bp, Homo sapien
ccgggctgcggggaatcccacgtgt

SEQ ID NO: 49696 - DNA, 25 bp, Homo sapien
tgtccgcagaccgtgggcaccagct

SEQ ID NO: 49697 - DNA, 25 bp, Homo sapien
ttctaggaaatcagcagtgccaggg

SEQ ID NO: 49698 - DNA, 25 bp, Homo sapien
gcgtgtccgcagaccgtgggcacca

SEQ ID NO: 49699 - DNA, 25 bp, Homo sapien
ttcttctaggaaatcagcagtgcca

SEQ ID NO: 49700 - DNA, 25 bp, Homo sapien
gagtcccgtccctggagtcagaaaa

SEQ ID NO: 49701 - DNA, 25 bp, Homo sapien
ggctgccattccttcaaccaagatg

SEQ ID NO: 49702 - DNA, 25 bp, Homo sapien
gagaacgccgtggacaaaagcttta

SEQ ID NO: 49703 - DNA, 25 bp, Homo sapien
aattctgaaacctctgcccgtggga

SEQ ID NO: 49704 - DNA, 25 bp, Homo sapien
acatttttgcggagcagagagccca

SEQ ID NO: 49705 - DNA, 25 bp, Homo sapien
gggatttaaaatcgcgcgcctggca

SEQ ID NO: 49706 - DNA, 25 bp, Homo sapien
aaccgcatctgagccggactcttta

SEQ ID NO: 49707 - DNA, 25 bp, Homo sapien
ttgcttaacactggctctgaggatc

SEQ ID NO: 49708 - DNA, 25 bp, Homo sapien
ccagttgctcatggcgtgcaccttc

SEQ ID NO: 49709 - DNA, 25 bp, Homo sapien
gccacttcctccgacgctgcagcag

SEQ ID NO: 49710 - DNA, 25 bp, Homo sapien
gcgcgcctgcattctgcagcgggaa

SEQ ID NO: 49711 - DNA, 25 bp, Homo sapien
gactctcggtcgtagaaggccttga

SEQ ID NO: 49712 - DNA, 25 bp, Homo sapien
ggctccttaccgactctcggtcgta

SEQ ID NO: 49713 - DNA, 25 bp, Homo sapien
aaggccgtaagtcagggcctgctgc

SEQ ID NO: 49714 - DNA, 25 bp, Homo sapien
cgcctgcattctgcagcgggaaccg

SEQ ID NO: 49715 - DNA, 25 bp, Homo sapien
cacaggtagcacacccagttgctca

SEQ ID NO: 49716 - DNA, 25 bp, Homo sapien
gcttggcagcctctctcaaagggtg

SEQ ID NO: 49717 - DNA, 25 bp, Homo sapien
ggggatgcggctccttccttggctc

SEQ ID NO: 49718 - DNA, 25 bp, Homo sapien
cccagatctcggctctcgagagtta

SEQ ID NO: 49719 - DNA, 25 bp, Homo sapien
cccgagctgctaatggtcggtacca

SEQ ID NO: 49720 - DNA, 25 bp, Homo sapien
gggccacttcatagccgcggggtcc

SEQ ID NO: 49721 - DNA, 25 bp, Homo sapien
aatggtcggtaccaacctcgccagc

SEQ ID NO: 49722 - DNA, 25 bp, Homo sapien
tccggagcgtctccggtgcggtcca

SEQ ID NO: 49723 - DNA, 25 bp, Homo sapien
ctcaaagggtgattgtttccggccg

SEQ ID NO: 49724 - DNA, 25 bp, Homo sapien
gctacgccggcttctgaggctgcac

SEQ ID NO: 49725 - DNA, 25 bp, Homo sapien
agcggcctttgctctttgcgtggtc

SEQ ID NO: 49726 - DNA, 25 bp, Homo sapien
tgagtcccgcacagagcgagtctct

SEQ ID NO: 49727 - DNA, 25 bp, Homo sapien
cgaggacaagtttcaggtgggctcc

SEQ ID NO: 49728 - DNA, 25 bp, Homo sapien
gagagttctctgagtcccgcacaga

SEQ ID NO: 49729 - DNA, 25 bp, Homo sapien
gccacattcggaagtgagagttctc

SEQ ID NO: 49730 - DNA, 25 bp, Homo sapien
ccgagggcacctgtctcggctttgc

SEQ ID NO: 49731 - DNA, 25 bp, Homo sapien
aggcccggagacttcccgagagcga

SEQ ID NO: 49732 - DNA, 25 bp, Homo sapien
cagcctgcgtggcaccgtgaggctc

SEQ ID NO: 49733 - DNA, 25 bp, Homo sapien
gtgaggctcctcacttgcgcctaga

SEQ ID NO: 49734 - DNA, 25 bp, Homo sapien
acttgcgcctagacccgccgtccag

SEQ ID NO: 49735 - DNA, 25 bp, Homo sapien
ttccactggcgctgccacttcccag

SEQ ID NO: 49736 - DNA, 25 bp, Homo sapien
tcgggttcgggttcagctacatttc

SEQ ID NO: 49737 - DNA, 25 bp, Homo sapien
gcgctgttgcctcccacagaacctg

SEQ ID NO: 49738 - DNA, 25 bp, Homo sapien
ggtgtactcactgcgccgctgcctt

SEQ ID NO: 49739 - DNA, 25 bp, Homo sapien
tacggacgtgctgcggtgtactcac

SEQ ID NO: 49740 - DNA, 25 bp, Homo sapien
cttcctggttctgaagcgacccggg

SEQ ID NO: 49741 - DNA, 25 bp, Homo sapien
ctggcccttcctggttctgaagcga

SEQ ID NO: 49742 - DNA, 25 bp, Homo sapien
tttagaaacgcacagcgggaaggtg

SEQ ID NO: 49743 - DNA, 25 bp, Homo sapien
tgacattgcacaggtttagaaacgc

SEQ ID NO: 49744 - DNA, 25 bp, Homo sapien
gcccgcgtgacattgcacaggttta

SEQ ID NO: 49745 - DNA, 25 bp, Homo sapien
aggaacctccggagaagcgaagccg

SEQ ID NO: 49746 - DNA, 25 bp, Homo sapien
gctgcggccgacagcaaggaacctc

SEQ ID NO: 49747 - DNA, 25 bp, Homo sapien
gagggcgcaggatccctgctccgtc

SEQ ID NO: 49748 - DNA, 25 bp, Homo sapien
tggtagcctgggctgttcacacggc

SEQ ID NO: 49749 - DNA, 25 bp, Homo sapien
acacagcaagagcacgcgccgcaca

SEQ ID NO: 49750 - DNA, 25 bp, Homo sapien
ttcccgctctggcgggcagatggta

SEQ ID NO: 49751 - DNA, 25 bp, Homo sapien
ggaggtgtgtgtgttctcagcttcc

SEQ ID NO: 49752 - DNA, 25 bp, Homo sapien
cctacgagcgatggccactcgggtc

SEQ ID NO: 49753 - DNA, 25 bp, Homo sapien
agatggtagcctgggctgttcacac

SEQ ID NO: 49754 - DNA, 25 bp, Homo sapien
cctgcctggggtgttgccggcccta

SEQ ID NO: 49755 - DNA, 25 bp, Homo sapien
ttgccggccctacgagcgatggcca

SEQ ID NO: 49756 - DNA, 25 bp, Homo sapien
accttctgtggaaggtgccctgcct

SEQ ID NO: 49757 - DNA, 25 bp, Homo sapien
gcggtgtctgctgcctcatggctga

SEQ ID NO: 49758 - DNA, 25 bp, Homo sapien
tcatggctgagcttccatcgggccg

SEQ ID NO: 49759 - DNA, 25 bp, Homo sapien
tgtgcctgtgaccagcctcctgggc

SEQ ID NO: 49760 - DNA, 25 bp, Homo sapien
tcacggctgcgctgtggctgtacgc

SEQ ID NO: 49761 - DNA, 25 bp, Homo sapien
gtctgggttcccatgcgtgcctcca

SEQ ID NO: 49762 - DNA, 25 bp, Homo sapien
ggccaaccctcccttgagctggatg

SEQ ID NO: 49763 - DNA, 25 bp, Homo sapien
gatgccggccacgtgctttgctgca

SEQ ID NO: 49764 - DNA, 25 bp, Homo sapien
ccgctgagtgttgggcgagaaagcc

SEQ ID NO: 49765 - DNA, 25 bp, Homo sapien
cagatgcaatctggacacgcgtccc

SEQ ID NO: 49766 - DNA, 25 bp, Homo sapien
tgcctttctgtgatcagatgcaatc

SEQ ID NO: 49767 - DNA, 25 bp, Homo sapien
aaggcaatgcctttctgtgatcaga

SEQ ID NO: 49768 - DNA, 25 bp, Homo sapien
attgcagcgactgctgactggctcg

SEQ ID NO: 49769 - DNA, 25 bp, Homo sapien
ccgggcattgcagcgactgctgact

SEQ ID NO: 49770 - DNA, 25 bp, Homo sapien
cacatcccgggcattgcagcgactg

SEQ ID NO: 49771 - DNA, 25 bp, Homo sapien
tcactcggttgcctggccggtgcct

SEQ ID NO: 49772 - DNA, 25 bp, Homo sapien
cgggaacccacctaagatcgtcatc

SEQ ID NO: 49773 - DNA, 25 bp, Homo sapien
aaagcgcgttcgtttgcctgagatc

SEQ ID NO: 49774 - DNA, 25 bp, Homo sapien
ccaggattcgagtttgtgttctttc

SEQ ID NO: 49775 - DNA, 25 bp, Homo sapien
ccgcgatcctacttgagggaaaaca

SEQ ID NO: 49776 - DNA, 25 bp, Homo sapien
tggcgagagactggcgtttataatc

SEQ ID NO: 49777 - DNA, 25 bp, Homo sapien
caaggacttcatctaccgtgagggc

SEQ ID NO: 49778 - DNA, 25 bp, Homo sapien
ctctgaggcaatcggagaagctatc

SEQ ID NO: 49779 - DNA, 25 bp, Homo sapien
gccatcctccgtagaagggtccctg

SEQ ID NO: 49780 - DNA, 25 bp, Homo sapien
aaacagtctgcctcggggaccaagc

SEQ ID NO: 49781 - DNA, 25 bp, Homo sapien
acagacattcagaggggcctggtgc

SEQ ID NO: 49782 - DNA, 25 bp, Homo sapien
gatcgccggtcagcctggaattccc

SEQ ID NO: 49783 - DNA, 25 bp, Homo sapien
gctgtgaccgcatcaaacagtctgc

SEQ ID NO: 49784 - DNA, 25 bp, Homo sapien
ggaccctttcaacatccacgactta

SEQ ID NO: 49785 - DNA, 25 bp, Homo sapien
ccacgacttaaaggtgagcccagcc

SEQ ID NO: 49786 - DNA, 25 bp, Homo sapien
ccgcaggtcaacgtggagcacatga

SEQ ID NO: 49787 - DNA, 25 bp, Homo sapien
accaagcgccgtgtgttcatcgtgg

SEQ ID NO: 49788 - DNA, 25 bp, Homo sapien
ggcacgagtgcctccaataggtgga

SEQ ID NO: 49789 - DNA, 25 bp, Homo sapien
taggttcacagtggcccgtggagcc

SEQ ID NO: 49790 - DNA, 25 bp, Homo sapien
tgcccagtccctgtggaccagtgcg

SEQ ID NO: 49791 - DNA, 25 bp, Homo sapien
agtccctgtggaccagtgcgatgct

SEQ ID NO: 49792 - DNA, 25 bp, Homo sapien
ccagtgcgatgctgcttgccagata

SEQ ID NO: 49793 - DNA, 25 bp, Homo sapien
tgctgcttgccagatactgacgccc

SEQ ID NO: 49794 - DNA, 25 bp, Homo sapien
ctccaataggtggagcgcagcagca

SEQ ID NO: 49795 - DNA, 25 bp, Homo sapien
caccctaggttcacagtggcccgtg

SEQ ID NO: 49796 - DNA, 25 bp, Homo sapien
cgtggacgcgtcagagaagagaaac

SEQ ID NO: 49797 - DNA, 25 bp, Homo sapien
aagctccacgtttccctgtcaggta

SEQ ID NO: 49798 - DNA, 25 bp, Homo sapien
tccctcccgagatgtgacagaaatg

SEQ ID NO: 49799 - DNA, 25 bp, Homo sapien
agcagcgtgatgtaccgaccgcgtc

SEQ ID NO: 49800 - DNA, 25 bp, Homo sapien
ccggctgtgggactctttccaggat

SEQ ID NO: 49801 - DNA, 25 bp, Homo sapien
ccaggtctcatgcagctcctagcta

SEQ ID NO: 49802 - DNA, 25 bp, Homo sapien
ctgtgtcgcctgactagtgaaacga

SEQ ID NO: 49803 - DNA, 25 bp, Homo sapien
ttcactcggggtttcccaggtctca

SEQ ID NO: 49804 - DNA, 25 bp, Homo sapien
ttatacagtcatgagccgccctgga

SEQ ID NO: 49805 - DNA, 25 bp, Homo sapien
tcctggatgccagaatgcagcctca

SEQ ID NO: 49806 - DNA, 25 bp, Homo sapien
cagctccggatggatcctggatgcc

SEQ ID NO: 49807 - DNA, 25 bp, Homo sapien
attggcagctcctgcagtcggccct

SEQ ID NO: 49808 - DNA, 25 bp, Homo sapien
tctgtgtggaggattggcagctcct

SEQ ID NO: 49809 - DNA, 25 bp, Homo sapien
ttggtcctatttggcgacgcctctg

SEQ ID NO: 49810 - DNA, 25 bp, Homo sapien
cagtcggcccttggtcctatttggc

SEQ ID NO: 49811 - DNA, 25 bp, Homo sapien
gccctggaatcacggcagctccgga

SEQ ID NO: 49812 - DNA, 25 bp, Homo sapien
ggcgcccttctctgacgcgattcta

SEQ ID NO: 49813 - DNA, 25 bp, Homo sapien
tcggcccagtgagggctgaactgct

SEQ ID NO: 49814 - DNA, 25 bp, Homo sapien
atggccgagtgcctaggcctgactc

SEQ ID NO: 49815 - DNA, 25 bp, Homo sapien
gcctgactctgagcgcaggcctagc

SEQ ID NO: 49816 - DNA, 25 bp, Homo sapien
tcaccagcagttgagcttgcgcacg

SEQ ID NO: 49817 - DNA, 25 bp, Homo sapien
tggcccgggtcagaaccatcttccg

SEQ ID NO: 49818 - DNA, 25 bp, Homo sapien
catcttccgcgtcagcttcatggcg

SEQ ID NO: 49819 - DNA, 25 bp, Homo sapien
tgggcgctacacagctccaagttac

SEQ ID NO: 49820 - DNA, 25 bp, Homo sapien
aggcgagctcatcaccatcggagtc

SEQ ID NO: 49821 - DNA, 25 bp, Homo sapien
atcaccatcggagtcgccacctggg

SEQ ID NO: 49822 - DNA, 25 bp, Homo sapien
gagtcgccacctggggcactgtcca

SEQ ID NO: 49823 - DNA, 25 bp, Homo sapien
gcgagggcctgatccatcccacggt

SEQ ID NO: 49824 - DNA, 25 bp, Homo sapien
ggcctgatccatcccacggtgagtg

SEQ ID NO: 49825 - DNA, 25 bp, Homo sapien
cctagggaggggagcctaagaccag

SEQ ID NO: 49826 - DNA, 25 bp, Homo sapien
cctgagcagcagctacaaggaaggc

SEQ ID NO: 49827 - DNA, 25 bp, Homo sapien
aaggaaggcgagctcatcaccatcg

SEQ ID NO: 49828 - DNA, 25 bp, Homo sapien
cccaagagttccgtaagaacactcg

SEQ ID NO: 49829 - DNA, 25 bp, Homo sapien
atggcgtgtaggtcccactagggtc

SEQ ID NO: 49830 - DNA, 25 bp, Homo sapien
ggcctaggggaagagcattccttgc

SEQ ID NO: 49831 - DNA, 25 bp, Homo sapien
ttccgtaagaacactcgtgatggcg

SEQ ID NO: 49832 - DNA, 25 bp, Homo sapien
gatggcattccctggccagtggcca

SEQ ID NO: 49833 - DNA, 25 bp, Homo sapien
cgtctgggtgctgatggcattccct

SEQ ID NO: 49834 - DNA, 25 bp, Homo sapien
gaagagcattccttgctgcctccag

SEQ ID NO: 49835 - DNA, 25 bp, Homo sapien
actcgtgatggcgtgtaggtcccac

SEQ ID NO: 49836 - DNA, 25 bp, Homo sapien
acggggcccatcctggactcgtctt

SEQ ID NO: 49837 - DNA, 25 bp, Homo sapien
agctcaacgtgcgtgctggtaacgg

SEQ ID NO: 49838 - DNA, 25 bp, Homo sapien
gcgtgctggtaacggggcccatcct

SEQ ID NO: 49839 - DNA, 25 bp, Homo sapien
taacggggcccatcctggactcgtc

SEQ ID NO: 49840 - DNA, 25 bp, Homo sapien
cctgctgcccgttccccacgtcaag

SEQ ID NO: 49841 - DNA, 25 bp, Homo sapien
ggggcccatcctggactcgtcttcg

SEQ ID NO: 49842 - DNA, 25 bp, Homo sapien
ggggacttcacgcagccgctttatc

SEQ ID NO: 49843 - DNA, 25 bp, Homo sapien
gggacttcacgcagccgctttatcc

SEQ ID NO: 49844 - DNA, 25 bp, Homo sapien
gttttcctaaattcgcagccggcta

SEQ ID NO: 49845 - DNA, 25 bp, Homo sapien
acagctaccacgtgaatgcccggca

SEQ ID NO: 49846 - DNA, 25 bp, Homo sapien
gtgttcgacctgcatggccatttgg

SEQ ID NO: 49847 - DNA, 25 bp, Homo sapien
cggccctcaaggagcatatttgccc

SEQ ID NO: 49848 - DNA, 25 bp, Homo sapien
aatccctgacctgacctggttcctg

SEQ ID NO: 49849 - DNA, 25 bp, Homo sapien
gactgtgtctgaacctggtcacgta

SEQ ID NO: 49850 - DNA, 25 bp, Homo sapien
accgcactgcgagttcagctcattg

SEQ ID NO: 49851 - DNA, 25 bp, Homo sapien
gccggctatgaaatgcacatcagta

SEQ ID NO: 49852 - DNA, 25 bp, Homo sapien
tggcggtttcatgtctggttggata

SEQ ID NO: 49853 - DNA, 25 bp, Homo sapien
tttcagagctgccagagtggactgc

SEQ ID NO: 49854 - DNA, 25 bp, Homo sapien
tctggttggataaggccttgcctgc

SEQ ID NO: 49855 - DNA, 25 bp, Homo sapien
tctccacccgggagtcttgtctctt

SEQ ID NO: 49856 - DNA, 25 bp, Homo sapien
ctcctgaagctcgatgccaacaaga

SEQ ID NO: 49857 - DNA, 25 bp, Homo sapien
ctcagggagctggatctgtctcaca

SEQ ID NO: 49858 - DNA, 25 bp, Homo sapien
atctgtctcacaacgccatcgaggc

SEQ ID NO: 49859 - DNA, 25 bp, Homo sapien
tgggagtctccagaagtaagttaca

SEQ ID NO: 49860 - DNA, 25 bp, Homo sapien
ctcgctggatttcccgcagggcttg

SEQ ID NO: 49861 - DNA, 25 bp, Homo sapien
cacgcgcctctgtgaatgcgtgggc

SEQ ID NO: 49862 - DNA, 25 bp, Homo sapien
cgcggtggttctgctgaagcagcct

SEQ ID NO: 49863 - DNA, 25 bp, Homo sapien
gtcagctgtgtgtcttccgttgcct

SEQ ID NO: 49864 - DNA, 25 bp, Homo sapien
tggccaaggcctcttaggtctatta

SEQ ID NO: 49865 - DNA, 25 bp, Homo sapien
attttccgggcttgctggaatcaga

SEQ ID NO: 49866 - DNA, 25 bp, Homo sapien
ggtctcatcgtattttccgggcttg

SEQ ID NO: 49867 - DNA, 25 bp, Homo sapien
acatctccctgacggtctcatcgta

SEQ ID NO: 49868 - DNA, 25 bp, Homo sapien
gctgcaatgtctgcgaggctgactt

SEQ ID NO: 49869 - DNA, 25 bp, Homo sapien
cgccattcagctcttcagccaagtt

SEQ ID NO: 49870 - DNA, 25 bp, Homo sapien
ctcccattgtcacccggtcaggagg

SEQ ID NO: 49871 - DNA, 25 bp, Homo sapien
gcggctcacaggagctgcggaaccc

SEQ ID NO: 49872 - DNA, 25 bp, Homo sapien
tttcgtggatttccttctcgcctgc

SEQ ID NO: 49873 - DNA, 25 bp, Homo sapien
cccagacggggctgcaagacccgga

SEQ ID NO: 49874 - DNA, 25 bp, Homo sapien
cttgcccagaactggcacggacggg

SEQ ID NO: 49875 - DNA, 25 bp, Homo sapien
acccggagactcgaaccaggcagca

SEQ ID NO: 49876 - DNA, 25 bp, Homo sapien
taccagtggtggaagatcctgtccg

SEQ ID NO: 49877 - DNA, 25 bp, Homo sapien
cgaggacgcctgtgatcacatgctc

SEQ ID NO: 49878 - DNA, 25 bp, Homo sapien
tcacatgctctggtctggaggcacg

SEQ ID NO: 49879 - DNA, 25 bp, Homo sapien
cggggttactcctcagtcggatctg

SEQ ID NO: 49880 - DNA, 25 bp, Homo sapien
agtcggatctgagctctgaaaccca

SEQ ID NO: 49881 - DNA, 25 bp, Homo sapien
acaagcggccacgtcggatgtacca

SEQ ID NO: 49882 - DNA, 25 bp, Homo sapien
ctgaaacccagacccgaggaagaca

SEQ ID NO: 49883 - DNA, 25 bp, Homo sapien
ctgcaccgaggctcacatcagaagc

SEQ ID NO: 49884 - DNA, 25 bp, Homo sapien
gaggaatcccgtggggtcgcctcca

SEQ ID NO: 49885 - DNA, 25 bp, Homo sapien
cgatcagggcgcgaagcccactgga

SEQ ID NO: 49886 - DNA, 25 bp, Homo sapien
ccactggacgcggatttgggattag

SEQ ID NO: 49887 - DNA, 25 bp, Homo sapien
gtcgcctccatttatcagttgtgtg

SEQ ID NO: 49888 - DNA, 25 bp, Homo sapien
ttgtgggatcagtgaggaatcccgt

SEQ ID NO: 49889 - DNA, 25 bp, Homo sapien
tttcctagcggaattggcgccggca

SEQ ID NO: 49890 - DNA, 25 bp, Homo sapien
cctgcccggctttcctagcggaatt

SEQ ID NO: 49891 - DNA, 25 bp, Homo sapien
ggctgggaagcacccgctttcacgt

SEQ ID NO: 49892 - DNA, 25 bp, Homo sapien
tccaccgagggcaggtcgcccactc

SEQ ID NO: 49893 - DNA, 25 bp, Homo sapien
cccacacgccgtccaccgagggcag

SEQ ID NO: 49894 - DNA, 25 bp, Homo sapien
ggcaggtcgcccactcgccgtccac

SEQ ID NO: 49895 - DNA, 25 bp, Homo sapien
cacacgccgtccaccgagggcaggt

SEQ ID NO: 49896 - DNA, 25 bp, Homo sapien
aggtcgcccacacgccgtccaccga

SEQ ID NO: 49897 - DNA, 25 bp, Homo sapien
gcccactcgccgtccaccgagggca

SEQ ID NO: 49898 - DNA, 25 bp, Homo sapien
accgagggcaggtcgcccacacgcc

SEQ ID NO: 49899 - DNA, 25 bp, Homo sapien
cgcccactcgccgtccaccgagggc

SEQ ID NO: 49900 - DNA, 25 bp, Homo sapien
gcggaatcccacagaagcctacaga

SEQ ID NO: 49901 - DNA, 25 bp, Homo sapien
agaggggaatgagcgccgaaaatca

SEQ ID NO: 49902 - DNA, 25 bp, Homo sapien
cctcctgacaactccagagaaggcg

SEQ ID NO: 49903 - DNA, 25 bp, Homo sapien
acagaagcctacagagcgagcgcgc

SEQ ID NO: 49904 - DNA, 25 bp, Homo sapien
tgacaactccagagaaggcgcatgg

SEQ ID NO: 49905 - DNA, 25 bp, Homo sapien
agaaagctgagacggcgcagccacg

SEQ ID NO: 49906 - DNA, 25 bp, Homo sapien
atgagcgccgaaaatcaaagcaggt

SEQ ID NO: 49907 - DNA, 25 bp, Homo sapien
gggcccacgctaaggcggaatccca

SEQ ID NO: 49908 - DNA, 25 bp, Homo sapien
aagctgcaattaccgggtgcgaggc

SEQ ID NO: 49909 - DNA, 25 bp, Homo sapien
gagctgtaattagtgcgggccccgc

SEQ ID NO: 49910 - DNA, 25 bp, Homo sapien
cggcctccgaggagcaaggaaaggc

SEQ ID NO: 49911 - DNA, 25 bp, Homo sapien
agagccagggaggaacaaagacgcc

SEQ ID NO: 49912 - DNA, 25 bp, Homo sapien
caaagacgcctcctgtttgatgtga

SEQ ID NO: 49913 - DNA, 25 bp, Homo sapien
cgcctcctgtttgatgtgaatcacc

SEQ ID NO: 49914 - DNA, 25 bp, Homo sapien
agtccctgcagagtcagggcgcaga

SEQ ID NO: 49915 - DNA, 25 bp, Homo sapien
tgatgtgaatcacccagaactaggg

SEQ ID NO: 49916 - DNA, 25 bp, Homo sapien
ggatggggtacacagcccagcctct

SEQ ID NO: 49917 - DNA, 25 bp, Homo sapien
cccacccgccactggtgaggagatt

SEQ ID NO: 49918 - DNA, 25 bp, Homo sapien
cgccactggtgaggagattccagga

SEQ ID NO: 49919 - DNA, 25 bp, Homo sapien
caggagaaacactgccacccaagca

SEQ ID NO: 49920 - DNA, 25 bp, Homo sapien
gctgtgtcctcagtggtggtgtcta

SEQ ID NO: 49921 - DNA, 25 bp, Homo sapien
gaagcccttggccaaatcccggcta

SEQ ID NO: 49922 - DNA, 25 bp, Homo sapien
cccaggaatgaaaccatcctcaggc

SEQ ID NO: 49923 - DNA, 25 bp, Homo sapien
tgaaaccatcctcaggccgggcgct

SEQ ID NO: 49924 - DNA, 25 bp, Homo sapien
ctcacgtttgtactcggccatcagc

SEQ ID NO: 49925 - DNA, 25 bp, Homo sapien
tgcgggtacgcactgaacattccaa

SEQ ID NO: 49926 - DNA, 25 bp, Homo sapien
tgtgcgctaactgcctgttctgtgc

SEQ ID NO: 49927 - DNA, 25 bp, Homo sapien
cctgttccagtgtgtgtgcgctaac

SEQ ID NO: 49928 - DNA, 25 bp, Homo sapien
acttcctgaacggtggcgcctgttc

SEQ ID NO: 49929 - DNA, 25 bp, Homo sapien
agggtcctggtcttgtagagacttc

SEQ ID NO: 49930 - DNA, 25 bp, Homo sapien
agcaccttctactccgagggagaga

SEQ ID NO: 49931 - DNA, 25 bp, Homo sapien
accgcggctacgattctcttggctc

SEQ ID NO: 49932 - DNA, 25 bp, Homo sapien
tctcctcggacatggctgcgcgagc

SEQ ID NO: 49933 - DNA, 25 bp, Homo sapien
ctcgacacaggatcccgcacccagg

SEQ ID NO: 49934 - DNA, 25 bp, Homo sapien
caaccagcaatgactcaggagagga

SEQ ID NO: 49935 - DNA, 25 bp, Homo sapien
tcaggagaggagcacgcaaagacgc

SEQ ID NO: 49936 - DNA, 25 bp, Homo sapien
acgcaaagacgcttcggggacactg

SEQ ID NO: 49937 - DNA, 25 bp, Homo sapien
ccagacgcttgttcccgagccgact

SEQ ID NO: 49938 - DNA, 25 bp, Homo sapien
cttgggcttctcctcggacatggct

SEQ ID NO: 49939 - DNA, 25 bp, Homo sapien
gactccgtgcactcgacacaggatc

SEQ ID NO: 49940 - DNA, 25 bp, Homo sapien
tgctgctcggactcaaccctgtgtc

SEQ ID NO: 49941 - DNA, 25 bp, Homo sapien
accaatactctgctgctcggactca

SEQ ID NO: 49942 - DNA, 25 bp, Homo sapien
gggacagacagacataccaatactc

SEQ ID NO: 49943 - DNA, 25 bp, Homo sapien
acgggctggtgctcgtagccacaaa

SEQ ID NO: 49944 - DNA, 25 bp, Homo sapien
tagccacaaacgctgggccctgcgg

SEQ ID NO: 49945 - DNA, 25 bp, Homo sapien
gcctcatgcaggtgtgcgtttcaca

SEQ ID NO: 49946 - DNA, 25 bp, Homo sapien
gcactccctaaaaacctggcacgga

SEQ ID NO: 49947 - DNA, 25 bp, Homo sapien
ccctgtgtcccagaggactgaagtg

SEQ ID NO: 49948 - DNA, 25 bp, Homo sapien
gttacaactccgactccagcacaag

SEQ ID NO: 49949 - DNA, 25 bp, Homo sapien
acgctgctcttaagtgagccctgga

SEQ ID NO: 49950 - DNA, 25 bp, Homo sapien
tcacggtggcctccatcctaaaggg

SEQ ID NO: 49951 - DNA, 25 bp, Homo sapien
tgcgagtgcgcagcctcaaaaagca

SEQ ID NO: 49952 - DNA, 25 bp, Homo sapien
gccgatgtccgcgtgggacttttag

SEQ ID NO: 49953 - DNA, 25 bp, Homo sapien
ctatcagtcagtggagcgttacaac

SEQ ID NO: 49954 - DNA, 25 bp, Homo sapien
aggcgcaacctccagtacggcgtcg

SEQ ID NO: 49955 - DNA, 25 bp, Homo sapien
cctgcgcgatagaggaaaggagcct

SEQ ID NO: 49956 - DNA, 25 bp, Homo sapien
accagcaggagaatgccgatcagca

SEQ ID NO: 49957 - DNA, 25 bp, Homo sapien
gaatgccgatcagcacgatgcctgc

SEQ ID NO: 49958 - DNA, 25 bp, Homo sapien
agagccttccagatgaccagcagga

SEQ ID NO: 49959 - DNA, 25 bp, Homo sapien
tcgctcaggtggatcagagccttcc

SEQ ID NO: 49960 - DNA, 25 bp, Homo sapien
tcaaagcgcctgtactcccggaggt

SEQ ID NO: 49961 - DNA, 25 bp, Homo sapien
cttacattgttccactgggacttga

SEQ ID NO: 49962 - DNA, 25 bp, Homo sapien
cccaaggacggccacttacattgtt

SEQ ID NO: 49963 - DNA, 25 bp, Homo sapien
cgcatagtgtgggacgcacgtgccc

SEQ ID NO: 49964 - DNA, 25 bp, Homo sapien
agctagggatccgacaagccctggg

SEQ ID NO: 49965 - DNA, 25 bp, Homo sapien
ttctccttccgacgggctgtcctct

SEQ ID NO: 49966 - DNA, 25 bp, Homo sapien
gccatgaccgtggagcagaacgtgc

SEQ ID NO: 49967 - DNA, 25 bp, Homo sapien
gtggccctcacagtcggcgtttcgc

SEQ ID NO: 49968 - DNA, 25 bp, Homo sapien
aaggaacgtgcgaacgcgtgacgcc

SEQ ID NO: 49969 - DNA, 25 bp, Homo sapien
accggcagcaaaggaacgtgcgaac

SEQ ID NO: 49970 - DNA, 25 bp, Homo sapien
aggacaacgccattccgggcggccg

SEQ ID NO: 49971 - DNA, 25 bp, Homo sapien
ctttgggtaagctagggatccgaca

SEQ ID NO: 49972 - DNA, 25 bp, Homo sapien
gggcatgggtttcgcagcttatcag

SEQ ID NO: 49973 - DNA, 25 bp, Homo sapien
agcttatcagggtgcgtgttcacga

SEQ ID NO: 49974 - DNA, 25 bp, Homo sapien
ttggtcagcttcagcacgtgcctga

SEQ ID NO: 49975 - DNA, 25 bp, Homo sapien
cccgacctcggtctgaaactggttg

SEQ ID NO: 49976 - DNA, 25 bp, Homo sapien
aggtttccggaaatcagctgcttcc

SEQ ID NO: 49977 - DNA, 25 bp, Homo sapien
acggcagcacggtcttgtccacgaa

SEQ ID NO: 49978 - DNA, 25 bp, Homo sapien
ggcgacctgcatcatggcgtccagc

SEQ ID NO: 49979 - DNA, 25 bp, Homo sapien
accctcgggtgcatccaggtttccg

SEQ ID NO: 49980 - DNA, 25 bp, Homo sapien
ggggtcatccttcagacacgctgag

SEQ ID NO: 49981 - DNA, 25 bp, Homo sapien
tcagacacgctgagcctaggctgcc

SEQ ID NO: 49982 - DNA, 25 bp, Homo sapien
gcatcgtcacgtgctctgtctgcgc

SEQ ID NO: 49983 - DNA, 25 bp, Homo sapien
gagaattgggcatcgtcacgtgctc

SEQ ID NO: 49984 - DNA, 25 bp, Homo sapien
cctgagagcgggctcttctgagtcg

SEQ ID NO: 49985 - DNA, 25 bp, Homo sapien
tctgtttccgccctgagagcgggct

SEQ ID NO: 49986 - DNA, 25 bp, Homo sapien
gttgcgtgcgcagcctcctctgttt

SEQ ID NO: 49987 - DNA, 25 bp, Homo sapien
gttgcggacagcagcgccctgccta

SEQ ID NO: 49988 - DNA, 25 bp, Homo sapien
agcgacattggggacgcctttcatt

SEQ ID NO: 49989 - DNA, 25 bp, Homo sapien
aggcatcacacgaacctggcacttc

SEQ ID NO: 49990 - DNA, 25 bp, Homo sapien
acgcctttcattgagagtggcagcg

SEQ ID NO: 49991 - DNA, 25 bp, Homo sapien
tcgcagtgacactgaaacccgcctg

SEQ ID NO: 49992 - DNA, 25 bp, Homo sapien
gcttagagttgacgccagcgacatt

SEQ ID NO: 49993 - DNA, 25 bp, Homo sapien
aacccgcctggggtgcttagagttg

SEQ ID NO: 49994 - DNA, 25 bp, Homo sapien
atcagcagccacatagacaggcatc

SEQ ID NO: 49995 - DNA, 25 bp, Homo sapien
gcaggcatgtgcctcgcagtgacac

SEQ ID NO: 49996 - DNA, 25 bp, Homo sapien
ggccaccactgagcacgcgctgtga

SEQ ID NO: 49997 - DNA, 25 bp, Homo sapien
gtattccgttgcgtttgctccctgc

SEQ ID NO: 49998 - DNA, 25 bp, Homo sapien
agggattccacgctccgagcctggc

SEQ ID NO: 49999 - DNA, 25 bp, Homo sapien
cgatcctttggtcggacagtgaggt

SEQ ID NO: 50000 - DNA, 25 bp, Homo sapien
cagagcttgcccaaaacctgcggtc

SEQ ID NO: 50001 - DNA, 25 bp, Homo sapien
agagacccgcactcggaccaggcgg

SEQ ID NO: 50002 - DNA, 25 bp, Homo sapien
ggcgcgtgaagggagctttccttcc

SEQ ID NO: 50003 - DNA, 25 bp, Homo sapien
cacgcgctgtgagtaggcgcttcct

SEQ ID NO: 50004 - DNA, 25 bp, Homo sapien
tttctcccaggtgcgtcggtgaaag

SEQ ID NO: 50005 - DNA, 25 bp, Homo sapien
aggttcctgaatcgcactgagctcc

SEQ ID NO: 50006 - DNA, 25 bp, Homo sapien
aactcgttgtttctcgtgctccgcg

SEQ ID NO: 50007 - DNA, 25 bp, Homo sapien
tcctccggtctgtttctcccaggtg

SEQ ID NO: 50008 - DNA, 25 bp, Homo sapien
gctacagacgcgaccttcttgcttc

SEQ ID NO: 50009 - DNA, 25 bp, Homo sapien
ttgcttcgcgaagcgtcgtaaactc

SEQ ID NO: 50010 - DNA, 25 bp, Homo sapien
tcgtaaactccgaggctccgctctg

SEQ ID NO: 50011 - DNA, 25 bp, Homo sapien
tgcgggcatttgctgcgctacagac

SEQ ID NO: 50012 - DNA, 25 bp, Homo sapien
ccagctctagctggcttgtgcaata

SEQ ID NO: 50013 - DNA, 25 bp, Homo sapien
aacgagcccacctgttttcagacag

SEQ ID NO: 50014 - DNA, 25 bp, Homo sapien
ctgtgttccttcataccagaaaacg

SEQ ID NO: 50015 - DNA, 25 bp, Homo sapien
ctggtcatggagcacgcttagaatt

SEQ ID NO: 50016 - DNA, 25 bp, Homo sapien
atccggggagctggtcatgcagcat

SEQ ID NO: 50017 - DNA, 25 bp, Homo sapien
gggcacggctccaatccttggcatc

SEQ ID NO: 50018 - DNA, 25 bp, Homo sapien
ttttcagacaggcacttgggactca

SEQ ID NO: 50019 - DNA, 25 bp, Homo sapien
gcttgtgcaataccagagcctggca

SEQ ID NO: 50020 - DNA, 25 bp, Homo sapien
gcgtgaacctgtgccggagcacttc

SEQ ID NO: 50021 - DNA, 25 bp, Homo sapien
taagtttagaaaccggagcagctcg

SEQ ID NO: 50022 - DNA, 25 bp, Homo sapien
cagctcgagcggacttcacactgtc

SEQ ID NO: 50023 - DNA, 25 bp, Homo sapien
gagcacttcagcaagggcgccttgg

SEQ ID NO: 50024 - DNA, 25 bp, Homo sapien
acctgccctgtccatgtggccttgg

SEQ ID NO: 50025 - DNA, 25 bp, Homo sapien
cgcggcaccgactggatctcagtga

SEQ ID NO: 50026 - DNA, 25 bp, Homo sapien
tggatctcagtgaacacccgtcagc

SEQ ID NO: 50027 - DNA, 25 bp, Homo sapien
ccgtcagcccatccagaggctagaa

SEQ ID NO: 50028 - DNA, 25 bp, Homo sapien
tccagaggtggagggatatgagtgg

SEQ ID NO: 50029 - DNA, 25 bp, Homo sapien
gccctttccgagctgtggggctgac

SEQ ID NO: 50030 - DNA, 25 bp, Homo sapien
gagccacgggccacggtgcttcctg

SEQ ID NO: 50031 - DNA, 25 bp, Homo sapien
tccgcacaggtaccctgttctcagg

SEQ ID NO: 50032 - DNA, 25 bp, Homo sapien
caggtaccctgttctcagggcgtga

SEQ ID NO: 50033 - DNA, 25 bp, Homo sapien
accctgttctcagggcgtgagctcg

SEQ ID NO: 50034 - DNA, 25 bp, Homo sapien
cagccggcgccaagcccgcaggtga

SEQ ID NO: 50035 - DNA, 25 bp, Homo sapien
ggtgctccgcacaggtaccctgttc

SEQ ID NO: 50036 - DNA, 25 bp, Homo sapien
tctcactgtgtggacggcagatctg

SEQ ID NO: 50037 - DNA, 25 bp, Homo sapien
ttaactgagggtgagaagctccgcg

SEQ ID NO: 50038 - DNA, 25 bp, Homo sapien
cgaagattcccacggttaactgagg

SEQ ID NO: 50039 - DNA, 25 bp, Homo sapien
aggcgagctcccgaagattcccacg

SEQ ID NO: 50040 - DNA, 25 bp, Homo sapien
tgaccacaaggagtgcaggcgagct

SEQ ID NO: 50041 - DNA, 25 bp, Homo sapien
tcccatgtgaacattcggccaggtg

SEQ ID NO: 50042 - DNA, 25 bp, Homo sapien
cgtcagagatgagagtgtcctggcc

SEQ ID NO: 50043 - DNA, 25 bp, Homo sapien
tggccttgcgggttctctgttcctt

SEQ ID NO: 50044 - DNA, 25 bp, Homo sapien
cacccaagcggcctcgtccttcccg

SEQ ID NO: 50045 - DNA, 25 bp, Homo sapien
ccagggccagtgctcttggtccaca

SEQ ID NO: 50046 - DNA, 25 bp, Homo sapien
acaacgtgagtgctccacagccagg

SEQ ID NO: 50047 - DNA, 25 bp, Homo sapien
cagtgctcttggtccacacgggctt

SEQ ID NO: 50048 - DNA, 25 bp, Homo sapien
gtccacacgggcttcccagccggct

SEQ ID NO: 50049 - DNA, 25 bp, Homo sapien
agccggcttgcaaggtccccgttca

SEQ ID NO: 50050 - DNA, 25 bp, Homo sapien
aaggagacctcctgtcacgacaacg

SEQ ID NO: 50051 - DNA, 25 bp, Homo sapien
tcctgtcacgacaacgtgagtgctc

SEQ ID NO: 50052 - DNA, 25 bp, Homo sapien
cctgcagattctgtggtgtgtcggt

SEQ ID NO: 50053 - DNA, 25 bp, Homo sapien
tggcgtgcttgttctccgagcactc

SEQ ID NO: 50054 - DNA, 25 bp, Homo sapien
actgtcagcgcgtcacagtggcgtt

SEQ ID NO: 50055 - DNA, 25 bp, Homo sapien
gtcacgcattcgcatccactgtcag

SEQ ID NO: 50056 - DNA, 25 bp, Homo sapien
tggcactcgctgtctgtgtcacgca

SEQ ID NO: 50057 - DNA, 25 bp, Homo sapien
gtgcagtgctcagcatcagccgtga

SEQ ID NO: 50058 - DNA, 25 bp, Homo sapien
tggcctttgctattttctccacgcg

SEQ ID NO: 50059 - DNA, 25 bp, Homo sapien
gccgtgacggtcacactggcactcg

SEQ ID NO: 50060 - DNA, 25 bp, Homo sapien
ggagggcgccaacgcaatttcagta

SEQ ID NO: 50061 - DNA, 25 bp, Homo sapien
gagttttcaggtgtcgagtcgccca

SEQ ID NO: 50062 - DNA, 25 bp, Homo sapien
gttctctccagcgttacccgatttc

SEQ ID NO: 50063 - DNA, 25 bp, Homo sapien
tcccttgtcagccttcgtgtcggtt

SEQ ID NO: 50064 - DNA, 25 bp, Homo sapien
ggcagaattgcacaggggcgctttt

SEQ ID NO: 50065 - DNA, 25 bp, Homo sapien
gcgcgcaaaaccctggtttagctta

SEQ ID NO: 50066 - DNA, 25 bp, Homo sapien
tgtcccgtgcctcgccttaaaggag

SEQ ID NO: 50067 - DNA, 25 bp, Homo sapien
gaagtgacgcgagttcacctgccga

SEQ ID NO: 50068 - DNA, 25 bp, Homo sapien
tgttgctggtggagactctaagact

SEQ ID NO: 50069 - DNA, 25 bp, Homo sapien
cagccaagcctgtggtcctttattc

SEQ ID NO: 50070 - DNA, 25 bp, Homo sapien
actctaagactgtggattctgactc

SEQ ID NO: 50071 - DNA, 25 bp, Homo sapien
taggaatgaccctcagctgagctga

SEQ ID NO: 50072 - DNA, 25 bp, Homo sapien
cctgttctgaaagtaggaatgaccc

SEQ ID NO: 50073 - DNA, 25 bp, Homo sapien
tccaaagcatctccgcagcgatgga

SEQ ID NO: 50074 - DNA, 25 bp, Homo sapien
cagcggtggctccaaagcatctccg

SEQ ID NO: 50075 - DNA, 25 bp, Homo sapien
actccctgggctcaggaaggacggt

SEQ ID NO: 50076 - DNA, 25 bp, Homo sapien
gagagcatggcacgcacccacgtgg

SEQ ID NO: 50077 - DNA, 25 bp, Homo sapien
gccctggatccagccgtggcagcag

SEQ ID NO: 50078 - DNA, 25 bp, Homo sapien
gtgtcctgcattccctaggctcgtg

SEQ ID NO: 50079 - DNA, 25 bp, Homo sapien
ccggtttgcggctgaaccagaactg

SEQ ID NO: 50080 - DNA, 25 bp, Homo sapien
cacacgcctgagagcatggcacgca

SEQ ID NO: 50081 - DNA, 25 bp, Homo sapien
cgtacacagacgtggaggggcatcc

SEQ ID NO: 50082 - DNA, 25 bp, Homo sapien
tagcagcagggacgtacacagacgt

SEQ ID NO: 50083 - DNA, 25 bp, Homo sapien
accagaactgcagtcggggtgtcct

SEQ ID NO: 50084 - DNA, 25 bp, Homo sapien
cttggtgctctgtgatgcccacgct

SEQ ID NO: 50085 - DNA, 25 bp, Homo sapien
gctctattattgtaggcagcgcacc

SEQ ID NO: 50086 - DNA, 25 bp, Homo sapien
gcgggaaacgaagacacgcgcttct

SEQ ID NO: 50087 - DNA, 25 bp, Homo sapien
agacacgcgcttcttcctactgggg

SEQ ID NO: 50088 - DNA, 25 bp, Homo sapien
cgcagacccggagaacccgcgatgt

SEQ ID NO: 50089 - DNA, 25 bp, Homo sapien
cccacgctgggtgcaaatgttgctt

SEQ ID NO: 50090 - DNA, 25 bp, Homo sapien
tcccagacattctttgggcccaagg

SEQ ID NO: 50091 - DNA, 25 bp, Homo sapien
gggcgatgccattcgtcacgctcta

SEQ ID NO: 50092 - DNA, 25 bp, Homo sapien
tcacagcgtcctgcggagggaccgt

SEQ ID NO: 50093 - DNA, 25 bp, Homo sapien
gtcacagcgtcctgcggagtgaccg

SEQ ID NO: 50094 - DNA, 25 bp, Homo sapien
cagcgtcctgcggagtgaccgtctg

SEQ ID NO: 50095 - DNA, 25 bp, Homo sapien
agcgtcctgcggagtgaccgtctgt

SEQ ID NO: 50096 - DNA, 25 bp, Homo sapien
cgtcctgcggagtgaccgtctgtct

SEQ ID NO: 50097 - DNA, 25 bp, Homo sapien
ggtcctgaggagtgaccgtctgtct

SEQ ID NO: 50098 - DNA, 25 bp, Homo sapien
tcacagcgtcctgcggagtgaccgt

SEQ ID NO: 50099 - DNA, 25 bp, Homo sapien
tcctgcggagtgaccgtctgtctgg

SEQ ID NO: 50100 - DNA, 25 bp, Homo sapien
cggtggcggcgtttatgtaagcgcc

SEQ ID NO: 50101 - DNA, 25 bp, Homo sapien
cctggggacggtaggctatgtccct

SEQ ID NO: 50102 - DNA, 25 bp, Homo sapien
ccctggggaccgagactgcgttttg

SEQ ID NO: 50103 - DNA, 25 bp, Homo sapien
aggctatgtccctggggagacgctc

SEQ ID NO: 50104 - DNA, 25 bp, Homo sapien
cgctgcgcacaaccaacgaggcaga

SEQ ID NO: 50105 - DNA, 25 bp, Homo sapien
gcacaaccaacgaggcagagcgccg

SEQ ID NO: 50106 - DNA, 25 bp, Homo sapien
ccaccctcctgggtcgcccgtctgc

SEQ ID NO: 50107 - DNA, 25 bp, Homo sapien
ctgcgttggcaacaaggctgcgcct

SEQ ID NO: 50108 - DNA, 25 bp, Homo sapien
tgctcactgacgagttgccacccgg

SEQ ID NO: 50109 - DNA, 25 bp, Homo sapien
aggtgctgaaatgcccgctgccagt

SEQ ID NO: 50110 - DNA, 25 bp, Homo sapien
ccagcgggctttagcaggtgctgaa

SEQ ID NO: 50111 - DNA, 25 bp, Homo sapien
tgttaacgatcagcctcggggagca

SEQ ID NO: 50112 - DNA, 25 bp, Homo sapien
cctgcccacggctgttaacgatcag

SEQ ID NO: 50113 - DNA, 25 bp, Homo sapien
aggtcctgacagctgtaccctggcc

SEQ ID NO: 50114 - DNA, 25 bp, Homo sapien
gctctgagcggctctgcaccggcag

SEQ ID NO: 50115 - DNA, 25 bp, Homo sapien
cggtcctgtccagtgaggtcctgac

SEQ ID NO: 50116 - DNA, 25 bp, Homo sapien
tgtgcccgacagtggtgtgtgcgcc

SEQ ID NO: 50117 - DNA, 25 bp, Homo sapien
cccgacagtggtgtgtgcgcccgat

SEQ ID NO: 50118 - DNA, 25 bp, Homo sapien
gcccgacagtggtgtgtgcgcccga

SEQ ID NO: 50119 - DNA, 25 bp, Homo sapien
gcccgacagtggtgtgtgcccgaca

SEQ ID NO: 50120 - DNA, 25 bp, Homo sapien
cccgacagtggtgtgtgcccgacag

SEQ ID NO: 50121 - DNA, 25 bp, Homo sapien
cccgacagtggtgtgtgcgcccgcc

SEQ ID NO: 50122 - DNA, 25 bp, Homo sapien
cccgacagtggtgtgtgcgcccgac

SEQ ID NO: 50123 - DNA, 25 bp, Homo sapien
gtgcccgacagtggtgtgtgcgccc

SEQ ID NO: 50124 - DNA, 25 bp, Homo sapien
tgcgaccgatgggtgtatgctcgac

SEQ ID NO: 50125 - DNA, 25 bp, Homo sapien
accgatgggtgtatgctcgacagtg

SEQ ID NO: 50126 - DNA, 25 bp, Homo sapien
agtgtgtctgacatgggtgtgtgag

SEQ ID NO: 50127 - DNA, 25 bp, Homo sapien
gcgcctgacaggagtgtgtctgaca

SEQ ID NO: 50128 - DNA, 25 bp, Homo sapien
tgcgcctgacaggagtgtgtctgac

SEQ ID NO: 50129 - DNA, 25 bp, Homo sapien
acgggtgtgtgtgcccgacagtggt

SEQ ID NO: 50130 - DNA, 25 bp, Homo sapien
cgcccggcaggggtacgtacactcg

SEQ ID NO: 50131 - DNA, 25 bp, Homo sapien
ccaccgggtgtgtgcccgacggtgt

SEQ ID NO: 50132 - DNA, 25 bp, Homo sapien
agggtccgcaaagccggctgtttgc

SEQ ID NO: 50133 - DNA, 25 bp, Homo sapien
ctgcaggtcctcgtgggaaaccgcg

SEQ ID NO: 50134 - DNA, 25 bp, Homo sapien
gcctctgcaggtcctcgtgggaaac

SEQ ID NO: 50135 - DNA, 25 bp, Homo sapien
cccatgagatcctcatgctggccgg

SEQ ID NO: 50136 - DNA, 25 bp, Homo sapien
tccgcagtgcccatgagatcctcat

SEQ ID NO: 50137 - DNA, 25 bp, Homo sapien
ccaaggagcacaagtccgcagtgcc

SEQ ID NO: 50138 - DNA, 25 bp, Homo sapien
cccagaaccaaggagcacaagtccg

SEQ ID NO: 50139 - DNA, 25 bp, Homo sapien
gctgtttgcgaagggcgcagctcca

SEQ ID NO: 50140 - DNA, 25 bp, Homo sapien
gaccctgcgagggacggtcctgtcc

SEQ ID NO: 50141 - DNA, 25 bp, Homo sapien
agacggtgactccacggcgacagaa

SEQ ID NO: 50142 - DNA, 25 bp, Homo sapien
tgactccacggcgacagaacctgca

SEQ ID NO: 50143 - DNA, 25 bp, Homo sapien
gagggacggtcctgtccgcccagct

SEQ ID NO: 50144 - DNA, 25 bp, Homo sapien
agctgtgggttcacagacgctgcct

SEQ ID NO: 50145 - DNA, 25 bp, Homo sapien
ctggcaaccgagctgtgggttcaca

SEQ ID NO: 50146 - DNA, 25 bp, Homo sapien
ctcccggctggcagtagacggtgac

SEQ ID NO: 50147 - DNA, 25 bp, Homo sapien
gcaacgccgaggacggagcccagct

SEQ ID NO: 50148 - DNA, 25 bp, Homo sapien
cccacgagaatgatcacacgagggc

SEQ ID NO: 50149 - DNA, 25 bp, Homo sapien
cacgagaatgatcacacgagggccc

SEQ ID NO: 50150 - DNA, 25 bp, Homo sapien
ccacgagaatgatcacacgagggcc

SEQ ID NO: 50151 - DNA, 25 bp, Homo sapien
atcacacgagggcccacgctcccgg

SEQ ID NO: 50152 - DNA, 25 bp, Homo sapien
aatgatcacacgagggcccacgctc

SEQ ID NO: 50153 - DNA, 25 bp, Homo sapien
cgagaatgatcacacgagggcccac

SEQ ID NO: 50154 - DNA, 25 bp, Homo sapien
agaatgatcacacgagggcccacgc

SEQ ID NO: 50155 - DNA, 25 bp, Homo sapien
acgagaatgatcacacgagggccca

SEQ ID NO: 50156 - DNA, 25 bp, Homo sapien
atgctcccagccttggggacgctca

SEQ ID NO: 50157 - DNA, 25 bp, Homo sapien
catggcagccccacgagaatgatca

SEQ ID NO: 50158 - DNA, 25 bp, Homo sapien
aagaacgatcacacgagggcccatg

SEQ ID NO: 50159 - DNA, 25 bp, Homo sapien
tgctcccagccttggggacgctcat

SEQ ID NO: 50160 - DNA, 25 bp, Homo sapien
caagaacgatcacacgagggcccat

SEQ ID NO: 50161 - DNA, 25 bp, Homo sapien
ctcccagccttggggacgctcatgg

SEQ ID NO: 50162 - DNA, 25 bp, Homo sapien
tggcagccccacgagaatgatcaca

SEQ ID NO: 50163 - DNA, 25 bp, Homo sapien
gctcccagccttggggacgctcatg

SEQ ID NO: 50164 - DNA, 25 bp, Homo sapien
tctgagaacacctttgagtccgctg

SEQ ID NO: 50165 - DNA, 25 bp, Homo sapien
tcacattccagagaggcgccgaggc

SEQ ID NO: 50166 - DNA, 25 bp, Homo sapien
gggcctgccatgactgcccgtgtta

SEQ ID NO: 50167 - DNA, 25 bp, Homo sapien
tgactgcccgtgttactaaaggtaa

SEQ ID NO: 50168 - DNA, 25 bp, Homo sapien
aggccgagtgactccctgagtctgc

SEQ ID NO: 50169 - DNA, 25 bp, Homo sapien
ctgagtctgcacatgacgagggccc

SEQ ID NO: 50170 - DNA, 25 bp, Homo sapien
gcctcccgagagcaggtcattactg

SEQ ID NO: 50171 - DNA, 25 bp, Homo sapien
caggtcattactgtgactcacattc

SEQ ID NO: 50172 - DNA, 25 bp, Homo sapien
tcagtgcaacgtgtccgcgaccctg

SEQ ID NO: 50173 - DNA, 25 bp, Homo sapien
tgtctctccacagggagcctcaggg

SEQ ID NO: 50174 - DNA, 25 bp, Homo sapien
cacgagtctgcgctgtggcagtgcc

SEQ ID NO: 50175 - DNA, 25 bp, Homo sapien
aacccgcctgactcagtgcaacgtg

SEQ ID NO: 50176 - DNA, 25 bp, Homo sapien
acgccggcgtcttctgctcaggtga

SEQ ID NO: 50177 - DNA, 25 bp, Homo sapien
tgtctgggcaccgaaacccgcctga

SEQ ID NO: 50178 - DNA, 25 bp, Homo sapien
gcgtcctggacgatgcctgggacct

SEQ ID NO: 50179 - DNA, 25 bp, Homo sapien
gcacaaggaggacgccggcgtcttc

SEQ ID NO: 50180 - DNA, 25 bp, Homo sapien
cacagagcggcctcgagtccggact

SEQ ID NO: 50181 - DNA, 25 bp, Homo sapien
cagagagctcggagggagcccaaca

SEQ ID NO: 50182 - DNA, 25 bp, Homo sapien
ctcgccctctgcagtgcggagaact

SEQ ID NO: 50183 - DNA, 25 bp, Homo sapien
ggccatggaaggtgctccctgcttc

SEQ ID NO: 50184 - DNA, 25 bp, Homo sapien
ggatccaggccttcgggatctcgcc

SEQ ID NO: 50185 - DNA, 25 bp, Homo sapien
gtctccagagagaggtaacagagtg

SEQ ID NO: 50186 - DNA, 25 bp, Homo sapien
tgcggagaactcactggacggagac

SEQ ID NO: 50187 - DNA, 25 bp, Homo sapien
acagccttgcttcttttgatcctca

SEQ ID NO: 50188 - DNA, 25 bp, Homo sapien
tactttgttccacaaggctcctctg

SEQ ID NO: 50189 - DNA, 25 bp, Homo sapien
tctcctgatagacgttcccaaggtg

SEQ ID NO: 50190 - DNA, 25 bp, Homo sapien
tcccttgtaacgaaaagctaatcgc

SEQ ID NO: 50191 - DNA, 25 bp, Homo sapien
cggcctcgcaggagtttataacttt

SEQ ID NO: 50192 - DNA, 25 bp, Homo sapien
tcgcaaacgtttctaggaacacatt

SEQ ID NO: 50193 - DNA, 25 bp, Homo sapien
tcacggctgcgtggataaaacccaa

SEQ ID NO: 50194 - DNA, 25 bp, Homo sapien
ggcggctgctcctcaagttctactt

SEQ ID NO: 50195 - DNA, 25 bp, Homo sapien
ggaatccagaatcaagctcggcctc

SEQ ID NO: 50196 - DNA, 25 bp, Homo sapien
accatgctgcgacgggtctgtggaa

SEQ ID NO: 50197 - DNA, 25 bp, Homo sapien
gtgcctggcaaacaccatgctgcga

SEQ ID NO: 50198 - DNA, 25 bp, Homo sapien
agacacgtcatccacggtcgcctga

SEQ ID NO: 50199 - DNA, 25 bp, Homo sapien
gatgtctgctcctgaactcgtctcc

SEQ ID NO: 50200 - DNA, 25 bp, Homo sapien
cggagcgggttctcctgtcgctgcc

SEQ ID NO: 50201 - DNA, 25 bp, Homo sapien
gtccgtggagttgagatgtctgctc

SEQ ID NO: 50202 - DNA, 25 bp, Homo sapien
gtcgcctgagaagcagcgccatcca

SEQ ID NO: 50203 - DNA, 25 bp, Homo sapien
aaacggcgacggctcggctgagaac

SEQ ID NO: 50204 - DNA, 25 bp, Homo sapien
cgtgtcacttgcaggggcctccgga

SEQ ID NO: 50205 - DNA, 25 bp, Homo sapien
cgaacgccacgaggggccgtgcaca

SEQ ID NO: 50206 - DNA, 25 bp, Homo sapien
cctgagaattcactgcggagcgccc

SEQ ID NO: 50207 - DNA, 25 bp, Homo sapien
gcgaagctcgtcttggccctgagaa

SEQ ID NO: 50208 - DNA, 25 bp, Homo sapien
ggtccgcttggagatcccacagcca

SEQ ID NO: 50209 - DNA, 25 bp, Homo sapien
gaggggccgtgcacacctctgcgtc

SEQ ID NO: 50210 - DNA, 25 bp, Homo sapien
gcctggacccgtgtcacttgcaggg

SEQ ID NO: 50211 - DNA, 25 bp, Homo sapien
gtgacgcagcctcgactacagccaa

SEQ ID NO: 50212 - DNA, 25 bp, Homo sapien
gaccgcagcggctagaggttccatt

SEQ ID NO: 50213 - DNA, 25 bp, Homo sapien
cgcatgagagcctgggtttctagtc

SEQ ID NO: 50214 - DNA, 25 bp, Homo sapien
gttccattgcagacccggaggccgt

SEQ ID NO: 50215 - DNA, 25 bp, Homo sapien
gaagccggaggccaggacactgccc

SEQ ID NO: 50216 - DNA, 25 bp, Homo sapien
gacgaagctgagtgtcgccatggcc

SEQ ID NO: 50217 - DNA, 25 bp, Homo sapien
ccgtgaaatgcgttcccagtagcca

SEQ ID NO: 50218 - DNA, 25 bp, Homo sapien
ttatgcgccatcaccggcaagcagg

SEQ ID NO: 50219 - DNA, 25 bp, Homo sapien
tctgcgaggcgttattaaaggtctg

SEQ ID NO: 50220 - DNA, 25 bp, Homo sapien
tgaatcagtacacgcccacctcggg

SEQ ID NO: 50221 - DNA, 25 bp, Homo sapien
tcgttcattcattcgagaagtttgc

SEQ ID NO: 50222 - DNA, 25 bp, Homo sapien
attcgagaagtttgcgagggcctcc

SEQ ID NO: 50223 - DNA, 25 bp, Homo sapien
agggcctccgtgtcctgcgtttagt

SEQ ID NO: 50224 - DNA, 25 bp, Homo sapien
acgcagatgtgaagggcgctgctct

SEQ ID NO: 50225 - DNA, 25 bp, Homo sapien
ggcgctgctctcaggagcagacaga

SEQ ID NO: 50226 - DNA, 25 bp, Homo sapien
acagaggtggggatgaatcagtaca

SEQ ID NO: 50227 - DNA, 25 bp, Homo sapien
ccctctgcgtcatgctgacggtgtc

SEQ ID NO: 50228 - DNA, 25 bp, Homo sapien
gtgaatcgcctctgcgtcccgtccc

SEQ ID NO: 50229 - DNA, 25 bp, Homo sapien
atgcactcatgaccggggcctggcc

SEQ ID NO: 50230 - DNA, 25 bp, Homo sapien
tgcttggggaaccagggccccactc

SEQ ID NO: 50231 - DNA, 25 bp, Homo sapien
cccactcacacgcgggaaggtgatg

SEQ ID NO: 50232 - DNA, 25 bp, Homo sapien
caggcagactggtagctgagagcga

SEQ ID NO: 50233 - DNA, 25 bp, Homo sapien
caggctcgtgaatcgcctctgcgtc

SEQ ID NO: 50234 - DNA, 25 bp, Homo sapien
ccggatgcactcatgaccggggcct

SEQ ID NO: 50235 - DNA, 25 bp, Homo sapien
agcgaaaggtgtggcgggatccgcc

SEQ ID NO: 50236 - DNA, 25 bp, Homo sapien
ggtgtcggcatctcctggacccgtc

SEQ ID NO: 50237 - DNA, 25 bp, Homo sapien
tcggggtctcacagcaggagcttag

SEQ ID NO: 50238 - DNA, 25 bp, Homo sapien
caggagcttagctggtgtcggcatc

SEQ ID NO: 50239 - DNA, 25 bp, Homo sapien
caagtctgcactgtgcccacgaggc

SEQ ID NO: 50240 - DNA, 25 bp, Homo sapien
acccgtcctcagctccgagcgccca

SEQ ID NO: 50241 - DNA, 25 bp, Homo sapien
gccacctgtgtccaagtctgcactg

SEQ ID NO: 50242 - DNA, 25 bp, Homo sapien
tgtgtccaagtctgcactgtgccca

SEQ ID NO: 50243 - DNA, 25 bp, Homo sapien
tcacagcaggagcttagctggtgtc

SEQ ID NO: 50244 - DNA, 25 bp, Homo sapien
cgcttccagctggattttcaacgca

SEQ ID NO: 50245 - DNA, 25 bp, Homo sapien
gtcgcttcccactggattttcaacg

SEQ ID NO: 50246 - DNA, 25 bp, Homo sapien
gtgtgtcgcttccagctggattttc

SEQ ID NO: 50247 - DNA, 25 bp, Homo sapien
cttccagctggattttcaacacagg

SEQ ID NO: 50248 - DNA, 25 bp, Homo sapien
gctggattttcaacgcagggaattg

SEQ ID NO: 50249 - DNA, 25 bp, Homo sapien
ggtgtgtcgcttccagctggatttt

SEQ ID NO: 50250 - DNA, 25 bp, Homo sapien
ggtgtgtcgcttcccactggatttt

SEQ ID NO: 50251 - DNA, 25 bp, Homo sapien
gctggattttcaacacagggaattg

SEQ ID NO: 50252 - DNA, 25 bp, Homo sapien
aagccagcgtcaccgggccatagtg

SEQ ID NO: 50253 - DNA, 25 bp, Homo sapien
accgggccatagtgagcggccaagc

SEQ ID NO: 50254 - DNA, 25 bp, Homo sapien
cgggccatagtgagccgccaagcca

SEQ ID NO: 50255 - DNA, 25 bp, Homo sapien
gggccatagtgagccgccaagccag

SEQ ID NO: 50256 - DNA, 25 bp, Homo sapien
caccgggccatagtgagccgccaag

SEQ ID NO: 50257 - DNA, 25 bp, Homo sapien
cgggccatagtgagcggccaagcca

SEQ ID NO: 50258 - DNA, 25 bp, Homo sapien
caagccagcgtcaccgggccatagt

SEQ ID NO: 50259 - DNA, 25 bp, Homo sapien
ccgggccatagtgagcggccaagcc

SEQ ID NO: 50260 - DNA, 25 bp, Homo sapien
ccctcgcacccagcatccgtgcaca

SEQ ID NO: 50261 - DNA, 25 bp, Homo sapien
ccctcgcaccgagcgtctgtccgtg

SEQ ID NO: 50262 - DNA, 25 bp, Homo sapien
accagcgtccatccatgcacacagg

SEQ ID NO: 50263 - DNA, 25 bp, Homo sapien
atctctcacccagcgttggtccgtg

SEQ ID NO: 50264 - DNA, 25 bp, Homo sapien
agtccatccatgcacacacgctcat

SEQ ID NO: 50265 - DNA, 25 bp, Homo sapien
accttgcacccagagtccatccatg

SEQ ID NO: 50266 - DNA, 25 bp, Homo sapien
accctcacctcgcacccagcatctg

SEQ ID NO: 50267 - DNA, 25 bp, Homo sapien
tagcgtccgtccatgcacatactca

SEQ ID NO: 50268 - DNA, 25 bp, Homo sapien
gctgcgctcacatctggtcaccgtc

SEQ ID NO: 50269 - DNA, 25 bp, Homo sapien
tccgcagcgctcacatctggtcacc

SEQ ID NO: 50270 - DNA, 25 bp, Homo sapien
cgctgcgctcacatctggtcaccgt

SEQ ID NO: 50271 - DNA, 25 bp, Homo sapien
agagctcacatctggccaccgtccg

SEQ ID NO: 50272 - DNA, 25 bp, Homo sapien
gccaccgtccgcagagctcacatct

SEQ ID NO: 50273 - DNA, 25 bp, Homo sapien
agcgctcacatctggccaccgtcca

SEQ ID NO: 50274 - DNA, 25 bp, Homo sapien
cgtccgcagcgctcacatctggtca

SEQ ID NO: 50275 - DNA, 25 bp, Homo sapien
tgcgctcacatctggtcaccgtccg

SEQ ID NO: 50276 - DNA, 25 bp, Homo sapien
tgagtcacatctggccaccgtccgc

SEQ ID NO: 50277 - DNA, 25 bp, Homo sapien
cagatccaacgagagccgctgagtc

SEQ ID NO: 50278 - DNA, 25 bp, Homo sapien
cgctgtcagatccaacgagagccgc

SEQ ID NO: 50279 - DNA, 25 bp, Homo sapien
gatccaacgagagccgctgagtcac

SEQ ID NO: 50280 - DNA, 25 bp, Homo sapien
caacgagagccgctgagtcacatct

SEQ ID NO: 50281 - DNA, 25 bp, Homo sapien
acgagagccgctgagtcacatctgg

SEQ ID NO: 50282 - DNA, 25 bp, Homo sapien
cgagagccgctgagtcacatctggc

SEQ ID NO: 50283 - DNA, 25 bp, Homo sapien
tgtcagatccaacgagagccgctga

SEQ ID NO: 50284 - DNA, 25 bp, Homo sapien
ctcaacacggccagcacggtgtgca

SEQ ID NO: 50285 - DNA, 25 bp, Homo sapien
ctctcaccggaggagaaagacagtc

SEQ ID NO: 50286 - DNA, 25 bp, Homo sapien
tgtgcatggtgtgcacgcctcctgc

SEQ ID NO: 50287 - DNA, 25 bp, Homo sapien
ttcccggggttcacggcctctgaca

SEQ ID NO: 50288 - DNA, 25 bp, Homo sapien
tgtcacgctttgtcacgctttgccg

SEQ ID NO: 50289 - DNA, 25 bp, Homo sapien
ggccaccagagtgggctctcaccgg

SEQ ID NO: 50290 - DNA, 25 bp, Homo sapien
gagcagcgctgtctgtcacgctttg

SEQ ID NO: 50291 - DNA, 25 bp, Homo sapien
ctcatgccttgagcgcgtcatcctt

SEQ ID NO: 50292 - DNA, 25 bp, Homo sapien
gagccggagcccatgcaacctggtt

SEQ ID NO: 50293 - DNA, 25 bp, Homo sapien
caaaaagcggcgctgaaggcctgtg

SEQ ID NO: 50294 - DNA, 25 bp, Homo sapien
acgagcgcgcacacgagtgagcgca

SEQ ID NO: 50295 - DNA, 25 bp, Homo sapien
ggaactgagggctccgcctcaacgg

SEQ ID NO: 50296 - DNA, 25 bp, Homo sapien
agaccgtgtcctggccgggaactga

SEQ ID NO: 50297 - DNA, 25 bp, Homo sapien
gattcggcggcccagaccgtgtcct

SEQ ID NO: 50298 - DNA, 25 bp, Homo sapien
cagcgagccttcgacgtggccgcag

SEQ ID NO: 50299 - DNA, 25 bp, Homo sapien
ggagcccatgcaacctggttccatc

SEQ ID NO: 50300 - DNA, 25 bp, Homo sapien
gcggggcgtcgtctccgcgtttcca

SEQ ID NO: 50301 - DNA, 25 bp, Homo sapien
tgcggggtctgacccgtgcctgtcc

SEQ ID NO: 50302 - DNA, 25 bp, Homo sapien
gccgggccttgtgcgcctctgtccc

SEQ ID NO: 50303 - DNA, 25 bp, Homo sapien
tttccaacctgttgaggctcctcgc

SEQ ID NO: 50304 - DNA, 25 bp, Homo sapien
cgtctccgcgtttccaacctgttga

SEQ ID NO: 50305 - DNA, 25 bp, Homo sapien
cggagtcccgcccattcattctccc

SEQ ID NO: 50306 - DNA, 25 bp, Homo sapien
cctctgtcgccgtcacggcctcgtc

SEQ ID NO: 50307 - DNA, 25 bp, Homo sapien
ccgcgtttccaacctgttgaggctc

SEQ ID NO: 50308 - DNA, 25 bp, Homo sapien
catgtagtgacacgctcgcaggatc

SEQ ID NO: 50309 - DNA, 25 bp, Homo sapien
tgacgtgcagttccgtgtagtgacg

SEQ ID NO: 50310 - DNA, 25 bp, Homo sapien
tggtgacatgcagttccgtgtagtg

SEQ ID NO: 50311 - DNA, 25 bp, Homo sapien
tgatgccgtgtagtgacgcaatgcc

SEQ ID NO: 50312 - DNA, 25 bp, Homo sapien
gacgcaatgccgtgtagttacatga

SEQ ID NO: 50313 - DNA, 25 bp, Homo sapien
tacatgatgctgtgtgtagtgatgc

SEQ ID NO: 50314 - DNA, 25 bp, Homo sapien
acgatgccgtgtgtggtgacactta

SEQ ID NO: 50315 - DNA, 25 bp, Homo sapien
tgattccgtgtagtaaggcgatgcc

SEQ ID NO: 50316 - DNA, 25 bp, Homo sapien
tctgcaggactgagaaccagcggaa

SEQ ID NO: 50317 - DNA, 25 bp, Homo sapien
gcatgcttgtgcgtaccctggactt

SEQ ID NO: 50318 - DNA, 25 bp, Homo sapien
tctgggtgcctttgccagacaactg

SEQ ID NO: 50319 - DNA, 25 bp, Homo sapien
ccagacaactggtctgccgggccga

SEQ ID NO: 50320 - DNA, 25 bp, Homo sapien
tctgccgggccgagcattcatgctg

SEQ ID NO: 50321 - DNA, 25 bp, Homo sapien
cgagcattcatgctggtcgccatca

SEQ ID NO: 50322 - DNA, 25 bp, Homo sapien
gttgggtctgcaggactgagaacca

SEQ ID NO: 50323 - DNA, 25 bp, Homo sapien
tggtcgccatcacgtgactcccatg

SEQ ID NO: 50324 - DNA, 25 bp, Homo sapien
tggaacagaacacgtagaccacctc

SEQ ID NO: 50325 - DNA, 25 bp, Homo sapien
gtctgggagaacttgcctttatttc

SEQ ID NO: 50326 - DNA, 25 bp, Homo sapien
cactgcaagggagcgtcagtggccc

SEQ ID NO: 50327 - DNA, 25 bp, Homo sapien
tcgtccaccaaagcaagctcctttg

SEQ ID NO: 50328 - DNA, 25 bp, Homo sapien
ccaaagcaagctcctttgtggggct

SEQ ID NO: 50329 - DNA, 25 bp, Homo sapien
gaagccgggatcacgaggctctgcc

SEQ ID NO: 50330 - DNA, 25 bp, Homo sapien
tctcgtggctggtctgggagaactt

SEQ ID NO: 50331 - DNA, 25 bp, Homo sapien
caaggcggatcagatggaacagaac

SEQ ID NO: 50332 - DNA, 25 bp, Homo sapien
tctccggctgtgaatgtagcaagga

SEQ ID NO: 50333 - DNA, 25 bp, Homo sapien
tgtgaagtccattacagtctccggc

SEQ ID NO: 50334 - DNA, 25 bp, Homo sapien
tggcctctaagatgctcgggaaatg

SEQ ID NO: 50335 - DNA, 25 bp, Homo sapien
tttggatttggaagtgcagctcgtc

SEQ ID NO: 50336 - DNA, 25 bp, Homo sapien
ttcagagcgtgttttgcccggagct

SEQ ID NO: 50337 - DNA, 25 bp, Homo sapien
ttctaggcctttacgtatcgcaacg

SEQ ID NO: 50338 - DNA, 25 bp, Homo sapien
caaactgggaaatctcgggctgcgc

SEQ ID NO: 50339 - DNA, 25 bp, Homo sapien
cctgctgagaaatgcctgggcctct

SEQ ID NO: 50340 - DNA, 25 bp, Homo sapien
taagctttttggaaatgtcgatgcc

SEQ ID NO: 50341 - DNA, 25 bp, Homo sapien
cccagacctggagctaggaactggc

SEQ ID NO: 50342 - DNA, 25 bp, Homo sapien
ttttggaaatgtcgatgccggactc

SEQ ID NO: 50343 - DNA, 25 bp, Homo sapien
cgtgtctaagctttttggaaatgtc

SEQ ID NO: 50344 - DNA, 25 bp, Homo sapien
ctgcacgtggggatcgtgtctaagc

SEQ ID NO: 50345 - DNA, 25 bp, Homo sapien
ttatgtcacaccctggctgcacgtg

SEQ ID NO: 50346 - DNA, 25 bp, Homo sapien
ggggtttatgtcacaccctggctgc

SEQ ID NO: 50347 - DNA, 25 bp, Homo sapien
ggaaatgtcgatgccggactccgcc

SEQ ID NO: 50348 - DNA, 25 bp, Homo sapien
gcttgggtctcccacgtggctaact

SEQ ID NO: 50349 - DNA, 25 bp, Homo sapien
ggcgcactgtctcaggtcgcagtca

SEQ ID NO: 50350 - DNA, 25 bp, Homo sapien
gctaataactctgccctgctcgggg

SEQ ID NO: 50351 - DNA, 25 bp, Homo sapien
ccacgtggctaactctgtggggccg

SEQ ID NO: 50352 - DNA, 25 bp, Homo sapien
ccagttctgcgaggccctgcaggat

SEQ ID NO: 50353 - DNA, 25 bp, Homo sapien
ctttaaccagggacagcggtgcttg

SEQ ID NO: 50354 - DNA, 25 bp, Homo sapien
caggtcgcagtcaccactttaacca

SEQ ID NO: 50355 - DNA, 25 bp, Homo sapien
ggccgggtcttgctaataactctgc

SEQ ID NO: 50356 - DNA, 25 bp, Homo sapien
ttgatctctgtgtcaggtccctgca

SEQ ID NO: 50357 - DNA, 25 bp, Homo sapien
cagcccagtgaaaccttggaaggtc

SEQ ID NO: 50358 - DNA, 25 bp, Homo sapien
cttggaaggtcagagagctggaaca

SEQ ID NO: 50359 - DNA, 25 bp, Homo sapien
ggcctggagaagacaccatgactta

SEQ ID NO: 50360 - DNA, 25 bp, Homo sapien
tatgtggttaaatctggcctggaga

SEQ ID NO: 50361 - DNA, 25 bp, Homo sapien
caggcctcaggtgtcaggaactttc

SEQ ID NO: 50362 - DNA, 25 bp, Homo sapien
gaactttctctttgggtcttagatg

SEQ ID NO: 50363 - DNA, 25 bp, Homo sapien
tcttagatgagattccagctgggga

SEQ ID NO: 50364 - DNA, 25 bp, Homo sapien
aggctgcccacctgacgcacccgct

SEQ ID NO: 50365 - DNA, 25 bp, Homo sapien
acgggcgcctgtccttcacgaacct

SEQ ID NO: 50366 - DNA, 25 bp, Homo sapien
acccacgagctcatgtgcgccaggc

SEQ ID NO: 50367 - DNA, 25 bp, Homo sapien
gctgggcacccacgagctcatgtgc

SEQ ID NO: 50368 - DNA, 25 bp, Homo sapien
cgggccgcatcgccgaagttcaggc

SEQ ID NO: 50369 - DNA, 25 bp, Homo sapien
tgggcacccacgagctcatgtgcgc

SEQ ID NO: 50370 - DNA, 25 bp, Homo sapien
tgccgcggagtctgccgggccgcat

SEQ ID NO: 50371 - DNA, 25 bp, Homo sapien
aggccctgctgcagtgcgctggtcg

SEQ ID NO: 50372 - DNA, 25 bp, Homo sapien
gacccgattggacacgacttactga

SEQ ID NO: 50373 - DNA, 25 bp, Homo sapien
atcagcttcccagcatggcctgtcg

SEQ ID NO: 50374 - DNA, 25 bp, Homo sapien
agctcgggccacctgagaaaacaca

SEQ ID NO: 50375 - DNA, 25 bp, Homo sapien
ctccttggtcttcgaggcaaccttg

SEQ ID NO: 50376 - DNA, 25 bp, Homo sapien
agagcagcgtcctttgcttcccagg

SEQ ID NO: 50377 - DNA, 25 bp, Homo sapien
agcgtcactgtcctcgacccgattg

SEQ ID NO: 50378 - DNA, 25 bp, Homo sapien
ccgaggcaggttcagaagcgtcact

SEQ ID NO: 50379 - DNA, 25 bp, Homo sapien
aagagctccctctatgccacgaaga

SEQ ID NO: 50380 - DNA, 25 bp, Homo sapien
gtgagtcctcacgtccccccgagtc

SEQ ID NO: 50381 - DNA, 25 bp, Homo sapien
ggcgagccggtgagtcctcacgtcc

SEQ ID NO: 50382 - DNA, 25 bp, Homo sapien
gctgcggccgacatgggagtgagct

SEQ ID NO: 50383 - DNA, 25 bp, Homo sapien
ggccgacatgggagtgagctgagct

SEQ ID NO: 50384 - DNA, 25 bp, Homo sapien
acatgggagtgagctgagctgggat

SEQ ID NO: 50385 - DNA, 25 bp, Homo sapien
cctccttaggcccaccgttgctcgg

SEQ ID NO: 50386 - DNA, 25 bp, Homo sapien
ttggtgctggaaggtggtcagacgt

SEQ ID NO: 50387 - DNA, 25 bp, Homo sapien
cccaccgttgctcggggttggtgct

SEQ ID NO: 50388 - DNA, 25 bp, Homo sapien
cctcccagagggaagaaagcgtccg

SEQ ID NO: 50389 - DNA, 25 bp, Homo sapien
cgaagcttcgcatcgaacggagatc

SEQ ID NO: 50390 - DNA, 25 bp, Homo sapien
tgtccggggcaactacaccgaaggc

SEQ ID NO: 50391 - DNA, 25 bp, Homo sapien
tccactattgtttccggccgcagca

SEQ ID NO: 50392 - DNA, 25 bp, Homo sapien
gagttctcctgtgatcccgtgtttc

SEQ ID NO: 50393 - DNA, 25 bp, Homo sapien
gttctctggaacgtagctcctcaca

SEQ ID NO: 50394 - DNA, 25 bp, Homo sapien
ccctcctcgaggtgcgtagatagac

SEQ ID NO: 50395 - DNA, 25 bp, Homo sapien
gcaaaatgcacgtgggtaccgaata

SEQ ID NO: 50396 - DNA, 25 bp, Homo sapien
ctgcccagcaaatggtaacactcgg

SEQ ID NO: 50397 - DNA, 25 bp, Homo sapien
cgactgcgaataaagacctgggaac

SEQ ID NO: 50398 - DNA, 25 bp, Homo sapien
tcatggtgcccaccgaacggtcatt

SEQ ID NO: 50399 - DNA, 25 bp, Homo sapien
gccaagctgcctgcgatgaggacca

SEQ ID NO: 50400 - DNA, 25 bp, Homo sapien
tgaggaccacggcagacaaaggaca

SEQ ID NO: 50401 - DNA, 25 bp, Homo sapien
cactgcaacagggtacacgcacgcg

SEQ ID NO: 50402 - DNA, 25 bp, Homo sapien
gcaaacaccgtttccaagcacagta

SEQ ID NO: 50403 - DNA, 25 bp, Homo sapien
cgcaaaacacgcagttcagtcttta

SEQ ID NO: 50404 - DNA, 25 bp, Homo sapien
cagttgaattttaaacgcggctctt

SEQ ID NO: 50405 - DNA, 25 bp, Homo sapien
tccgatttttccttttgctcgtgga

SEQ ID NO: 50406 - DNA, 25 bp, Homo sapien
ccttttgctcgtggacagggatccg

SEQ ID NO: 50407 - DNA, 25 bp, Homo sapien
acagggatccgtcctgagcgtgccg

SEQ ID NO: 50408 - DNA, 25 bp, Homo sapien
gggacctgaggtatgtgcctgccca

SEQ ID NO: 50409 - DNA, 25 bp, Homo sapien
cagcttctaagagacgggcctgcgg

SEQ ID NO: 50410 - DNA, 25 bp, Homo sapien
cgctcgagtccagttgaattttaaa

SEQ ID NO: 50411 - DNA, 25 bp, Homo sapien
tgcctgcccagcttctaagagacgg

SEQ ID NO: 50412 - DNA, 25 bp, Homo sapien
cttaaggcctgtggaggcaaaggca

SEQ ID NO: 50413 - DNA, 25 bp, Homo sapien
agccaggctagcctcgggcgccttt

SEQ ID NO: 50414 - DNA, 25 bp, Homo sapien
aaaccactgtttgaggatgtctggg

SEQ ID NO: 50415 - DNA, 25 bp, Homo sapien
cagctggataaaatgtgagaaaacc

SEQ ID NO: 50416 - DNA, 25 bp, Homo sapien
ccgggacatccttaaggcctgtgga

SEQ ID NO: 50417 - DNA, 25 bp, Homo sapien
caagaccactgagaacagctggata

SEQ ID NO: 50418 - DNA, 25 bp, Homo sapien
cttggatgtcctgccaagaccactg

SEQ ID NO: 50419 - DNA, 25 bp, Homo sapien
cacctccattgagggtggcagggct

SEQ ID NO: 50420 - DNA, 25 bp, Homo sapien
agtccagccgctgtcacatccttga

SEQ ID NO: 50421 - DNA, 25 bp, Homo sapien
acatccttgaggaaccggcgtacct

SEQ ID NO: 50422 - DNA, 25 bp, Homo sapien
gccaagcagtggtcatgaaagtcca

SEQ ID NO: 50423 - DNA, 25 bp, Homo sapien
agctccacctggttgcgctcaacag

SEQ ID NO: 50424 - DNA, 25 bp, Homo sapien
ggccgacttccagtgcttccagcag

SEQ ID NO: 50425 - DNA, 25 bp, Homo sapien
gacctgtacagcatcgtgcgccgtg

SEQ ID NO: 50426 - DNA, 25 bp, Homo sapien
acctcaaggtgggtcagtccagtcc

SEQ ID NO: 50427 - DNA, 25 bp, Homo sapien
cctgcaggacaatgaagtggccgcc

SEQ ID NO: 50428 - DNA, 25 bp, Homo sapien
gctctgcattgagaacagcttcatg

SEQ ID NO: 50429 - DNA, 25 bp, Homo sapien
cccagaagagcgtgtggcatggctc

SEQ ID NO: 50430 - DNA, 25 bp, Homo sapien
ctgaccgagagctactgtgagacgt

SEQ ID NO: 50431 - DNA, 25 bp, Homo sapien
gcagagtgccgcgagctgccatcac

SEQ ID NO: 50432 - DNA, 25 bp, Homo sapien
acgcctacatcgtgctctgcattga

SEQ ID NO: 50433 - DNA, 25 bp, Homo sapien
acagcttcatgactgcctccaagta

SEQ ID NO: 50434 - DNA, 25 bp, Homo sapien
tccaagtagccaccgcctggatgcg

SEQ ID NO: 50435 - DNA, 25 bp, Homo sapien
gagctgccatcacgcctacatcgtg

SEQ ID NO: 50436 - DNA, 25 bp, Homo sapien
gcacgtagtagaccaccaggtagta

SEQ ID NO: 50437 - DNA, 25 bp, Homo sapien
ccatgagctgcatgtgcgccaccga

SEQ ID NO: 50438 - DNA, 25 bp, Homo sapien
ccatggtgacgctgtagaagagctc

SEQ ID NO: 50439 - DNA, 25 bp, Homo sapien
gagactcggcccacagtgaccagca

SEQ ID NO: 50440 - DNA, 25 bp, Homo sapien
ccggccgagttgaagacccaccaga

SEQ ID NO: 50441 - DNA, 25 bp, Homo sapien
ggggtccacctcgttccacaggatg

SEQ ID NO: 50442 - DNA, 25 bp, Homo sapien
gcgccgttgtagacccgcgcactgt

SEQ ID NO: 50443 - DNA, 25 bp, Homo sapien
gagcttctgaggaaaggtatccacg

SEQ ID NO: 50444 - DNA, 25 bp, Homo sapien
tgctcaggccacgtgcagctccgga

SEQ ID NO: 50445 - DNA, 25 bp, Homo sapien
ggtcaggcccaggttccacgggcac

SEQ ID NO: 50446 - DNA, 25 bp, Homo sapien
ggagggcaccatcctgctcaggcca

SEQ ID NO: 50447 - DNA, 25 bp, Homo sapien
cggtgcccacatgcctattccagaa

SEQ ID NO: 50448 - DNA, 25 bp, Homo sapien
tagcacacgaggtgccgccaggacc

SEQ ID NO: 50449 - DNA, 25 bp, Homo sapien
aagccgtagaagcaaaggtagcaca

SEQ ID NO: 50450 - DNA, 25 bp, Homo sapien
cgtatctgcgccatgaagccgtaga

SEQ ID NO: 50451 - DNA, 25 bp, Homo sapien
tgctcccgcgtgaagttcttgtcgg

SEQ ID NO: 50452 - DNA, 25 bp, Homo sapien
cgaggctccacacctcccggaccga

SEQ ID NO: 50453 - DNA, 25 bp, Homo sapien
ctttatccctcaggggccggctggg

SEQ ID NO: 50454 - DNA, 25 bp, Homo sapien
ggccgaggctccacacctcccggac

SEQ ID NO: 50455 - DNA, 25 bp, Homo sapien
gctcgcgcagatccgcgctggatct

SEQ ID NO: 50456 - DNA, 25 bp, Homo sapien
cgcagatccgcgctggatctcaggc

SEQ ID NO: 50457 - DNA, 25 bp, Homo sapien
gcagatccgcgctggatctcaggcg

SEQ ID NO: 50458 - DNA, 25 bp, Homo sapien
acactggggggatggatctgcagcc

SEQ ID NO: 50459 - DNA, 25 bp, Homo sapien
ggctttatccctcaggggccggctg

SEQ ID NO: 50460 - DNA, 25 bp, Homo sapien
gccactcgcggaggtgtcggtccct

SEQ ID NO: 50461 - DNA, 25 bp, Homo sapien
tgcacagcaacggttctgccaggcg

SEQ ID NO: 50462 - DNA, 25 bp, Homo sapien
agcaacggttctgccaggcgcccgg

SEQ ID NO: 50463 - DNA, 25 bp, Homo sapien
tccgtcccgccgaacgcgtcctgag

SEQ ID NO: 50464 - DNA, 25 bp, Homo sapien
tgcgttttccttttggcaccctgga

SEQ ID NO: 50465 - DNA, 25 bp, Homo sapien
ttggcaccctggaacacctgcattc

SEQ ID NO: 50466 - DNA, 25 bp, Homo sapien
attcctggccgcaagctggatccgg

SEQ ID NO: 50467 - DNA, 25 bp, Homo sapien
gcggactccgggactacagcgccca

SEQ ID NO: 50468 - DNA, 25 bp, Homo sapien
catcggtactttcggtccattccct

SEQ ID NO: 50469 - DNA, 25 bp, Homo sapien
acgacatcggtactttcggtccatt

SEQ ID NO: 50470 - DNA, 25 bp, Homo sapien
gaagcagcccctttgacgacatcgg

SEQ ID NO: 50471 - DNA, 25 bp, Homo sapien
tcggtccattccctgggtcgatgtt

SEQ ID NO: 50472 - DNA, 25 bp, Homo sapien
ccctgttcccggcttcagtggcgag

SEQ ID NO: 50473 - DNA, 25 bp, Homo sapien
cattccctgggtcgatgtttccaga

SEQ ID NO: 50474 - DNA, 25 bp, Homo sapien
tccctgggtcgatgtttccagaacc

SEQ ID NO: 50475 - DNA, 25 bp, Homo sapien
gttcccggcttcagtggcgaggccc

SEQ ID NO: 50476 - DNA, 25 bp, Homo sapien
cgggacagacgatcctctgaggttt

SEQ ID NO: 50477 - DNA, 25 bp, Homo sapien
tggagcaagctctacacccgggaga

SEQ ID NO: 50478 - DNA, 25 bp, Homo sapien
cgggcccagtgagtgacatcaccgc

SEQ ID NO: 50479 - DNA, 25 bp, Homo sapien
ccgccctaatcctctgaaggtcgga

SEQ ID NO: 50480 - DNA, 25 bp, Homo sapien
ggcagaaagcgacccacgcagagtt

SEQ ID NO: 50481 - DNA, 25 bp, Homo sapien
agactgcaagctcaagccctggcgg

SEQ ID NO: 50482 - DNA, 25 bp, Homo sapien
agcaaggtctactcccgcgaggtga

SEQ ID NO: 50483 - DNA, 25 bp, Homo sapien
gtcacaggtcaaagccgagaacaga

SEQ ID NO: 50484 - DNA, 25 bp, Homo sapien
gtgcaagggcgctgctaatgccctt

SEQ ID NO: 50485 - DNA, 25 bp, Homo sapien
cccttgcgaggctcagtggatctaa

SEQ ID NO: 50486 - DNA, 25 bp, Homo sapien
cttgcgaggctcagtggatctaaga

SEQ ID NO: 50487 - DNA, 25 bp, Homo sapien
taatgcccttgcgaggctcagtgga

SEQ ID NO: 50488 - DNA, 25 bp, Homo sapien
cgaggctcagtggatctaagaggtc

SEQ ID NO: 50489 - DNA, 25 bp, Homo sapien
atgcccttgcgaggctcagtggatc

SEQ ID NO: 50490 - DNA, 25 bp, Homo sapien
gctcagtggatctaagaggtcggaa

SEQ ID NO: 50491 - DNA, 25 bp, Homo sapien
cagtggatctaagaggtcggaagct

SEQ ID NO: 50492 - DNA, 25 bp, Homo sapien
gtatataagacggtgcctgagcgca

SEQ ID NO: 50493 - DNA, 25 bp, Homo sapien
acctgcatggtgtaaggacccggga

SEQ ID NO: 50494 - DNA, 25 bp, Homo sapien
tctccggggcgttggaaacctgcat

SEQ ID NO: 50495 - DNA, 25 bp, Homo sapien
aacgcgcaccctcgaagtcttgaac

SEQ ID NO: 50496 - DNA, 25 bp, Homo sapien
ttcgcctctaggacatacacgggac

SEQ ID NO: 50497 - DNA, 25 bp, Homo sapien
aaattgattgtgctgttctcctccc

SEQ ID NO: 50498 - DNA, 25 bp, Homo sapien
aagcgcttgcttacgtagctgcgga

SEQ ID NO: 50499 - DNA, 25 bp, Homo sapien
caaagcgcaacggtgtggtccaagc

SEQ ID NO: 50500 - DNA, 25 bp, Homo sapien
gcggcagctcccagacgacctagga

SEQ ID NO: 50501 - DNA, 25 bp, Homo sapien
ttcccgcactggtaggaaagctggg

SEQ ID NO: 50502 - DNA, 25 bp, Homo sapien
agaaggagtctcaccgtcctggacc

SEQ ID NO: 50503 - DNA, 25 bp, Homo sapien
gccgcctctgaggttctggaccaag

SEQ ID NO: 50504 - DNA, 25 bp, Homo sapien
acgacctaggactgcaaagggccca

SEQ ID NO: 50505 - DNA, 25 bp, Homo sapien
agcatttccaggtcgttatagggcc

SEQ ID NO: 50506 - DNA, 25 bp, Homo sapien
cgcaagaggcgctggagcatttcca

SEQ ID NO: 50507 - DNA, 25 bp, Homo sapien
gtcctggaccagtcggaaccacaga

SEQ ID NO: 50508 - DNA, 25 bp, Homo sapien
aagtgcttccggtctccgtgctggt

SEQ ID NO: 50509 - DNA, 25 bp, Homo sapien
tccggccacaccagagaagtgcttc

SEQ ID NO: 50510 - DNA, 25 bp, Homo sapien
cagagaagtgcttccggtctccgtg

SEQ ID NO: 50511 - DNA, 25 bp, Homo sapien
cacgccggtgaagtgcttccggtcc

SEQ ID NO: 50512 - DNA, 25 bp, Homo sapien
gccgttccggccacaccagagaagt

SEQ ID NO: 50513 - DNA, 25 bp, Homo sapien
ccacgccggtgaagtgcttccggtc

SEQ ID NO: 50514 - DNA, 25 bp, Homo sapien
aagaacgccgtgctgccgttccggc

SEQ ID NO: 50515 - DNA, 25 bp, Homo sapien
cgttccggccacaccagagaagtgc

SEQ ID NO: 50516 - DNA, 25 bp, Homo sapien
cggagctagggacgccaacagatgt

SEQ ID NO: 50517 - DNA, 25 bp, Homo sapien
cgccaacagatgtgagagccacgtc

SEQ ID NO: 50518 - DNA, 25 bp, Homo sapien
cgggagtggacaagcagactcctcc

SEQ ID NO: 50519 - DNA, 25 bp, Homo sapien
tcagtatttaagtggggacccgcaa

SEQ ID NO: 50520 - DNA, 25 bp, Homo sapien
ctgctgacacggcagccacagagct

SEQ ID NO: 50521 - DNA, 25 bp, Homo sapien
tccacctgtcctttcagtatttaag

SEQ ID NO: 50522 - DNA, 25 bp, Homo sapien
acagagcctccctagctggagcggc

SEQ ID NO: 50523 - DNA, 25 bp, Homo sapien
tgagagccacgtctgtgcatttcca

SEQ ID NO: 50524 - DNA, 25 bp, Homo sapien
gccaggcccacagagaacgggaagc

SEQ ID NO: 50525 - DNA, 25 bp, Homo sapien
tctgggcacaggctcacgagccgct

SEQ ID NO: 50526 - DNA, 25 bp, Homo sapien
acggctgggaattcaacggccattc

SEQ ID NO: 50527 - DNA, 25 bp, Homo sapien
ctttgactggagttggctttttcca

SEQ ID NO: 50528 - DNA, 25 bp, Homo sapien
ccagagaactttccgggctcggatt

SEQ ID NO: 50529 - DNA, 25 bp, Homo sapien
gccggttgatgttccgccctttcat

SEQ ID NO: 50530 - DNA, 25 bp, Homo sapien
gatgttccgccctttcattggcccg

SEQ ID NO: 50531 - DNA, 25 bp, Homo sapien
tggagttggctttttccagagaact

SEQ ID NO: 50532 - DNA, 25 bp, Homo sapien
cagcatcgctgtgtcagtccattga

SEQ ID NO: 50533 - DNA, 25 bp, Homo sapien
tccattgacgtagcgccacacggtg

SEQ ID NO: 50534 - DNA, 25 bp, Homo sapien
cagcatcgccgtgtcagtccattga

SEQ ID NO: 50535 - DNA, 25 bp, Homo sapien
ttgacgtagcgcacacggtgttgtc

SEQ ID NO: 50536 - DNA, 25 bp, Homo sapien
gtccactgacgtagcgcacacggtg

SEQ ID NO: 50537 - DNA, 25 bp, Homo sapien
atcgccgtgtcagtccattgacgta

SEQ ID NO: 50538 - DNA, 25 bp, Homo sapien
gtcagcatcgccgtgtcagtccatt

SEQ ID NO: 50539 - DNA, 25 bp, Homo sapien
tcagcatcgccgtgtcagtccattg

SEQ ID NO: 50540 - DNA, 25 bp, Homo sapien
ctgtgggaacacctccgcgcgtgcg

SEQ ID NO: 50541 - DNA, 25 bp, Homo sapien
gctcttaaagggaccacgcggcgtc

SEQ ID NO: 50542 - DNA, 25 bp, Homo sapien
cacgggtaattgcaccttcggcagg

SEQ ID NO: 50543 - DNA, 25 bp, Homo sapien
cccaggcgcggcgttttacctgcag

SEQ ID NO: 50544 - DNA, 25 bp, Homo sapien
cttctcctggcctttgttggcgctg

SEQ ID NO: 50545 - DNA, 25 bp, Homo sapien
actcgggcggacctgggaccctcag

SEQ ID NO: 50546 - DNA, 25 bp, Homo sapien
caggaagaacgcacgggtaattgca

SEQ ID NO: 50547 - DNA, 25 bp, Homo sapien
cgttttacctgcagcggctgtgctc

SEQ ID NO: 50548 - DNA, 25 bp, Homo sapien
catacaggacctgacacgggcgtgc

SEQ ID NO: 50549 - DNA, 25 bp, Homo sapien
cttcccgatggtagtcaccagcata

SEQ ID NO: 50550 - DNA, 25 bp, Homo sapien
ggatgacccgaaagacttcccgatg

SEQ ID NO: 50551 - DNA, 25 bp, Homo sapien
cttagaaacagaatacggatgaccc

SEQ ID NO: 50552 - DNA, 25 bp, Homo sapien
cctagaaatgaacgtacagctgctt

SEQ ID NO: 50553 - DNA, 25 bp, Homo sapien
cgaatccgcgtgaaagcagcaacca

SEQ ID NO: 50554 - DNA, 25 bp, Homo sapien
ccatagaagcgtgtgtggctgttta

SEQ ID NO: 50555 - DNA, 25 bp, Homo sapien
gcctgtgggagcagcaacatcgctc

SEQ ID NO: 50556 - DNA, 25 bp, Homo sapien
cccgcgcattgaggaatccacgtgg

SEQ ID NO: 50557 - DNA, 25 bp, Homo sapien
agctccctgcttcagcctgggcggg

SEQ ID NO: 50558 - DNA, 25 bp, Homo sapien
gcgggcatttctgcgagcctgtccc

SEQ ID NO: 50559 - DNA, 25 bp, Homo sapien
atttctgcgagcctgtccctgggcc

SEQ ID NO: 50560 - DNA, 25 bp, Homo sapien
cacagcactgggaagaacccgggag

SEQ ID NO: 50561 - DNA, 25 bp, Homo sapien
tggccagacttccagaaacattgtc

SEQ ID NO: 50562 - DNA, 25 bp, Homo sapien
ccgtcaccggaaactgcagcccaca

SEQ ID NO: 50563 - DNA, 25 bp, Homo sapien
ctggcccgcgcattgaggaatccac

SEQ ID NO: 50564 - DNA, 25 bp, Homo sapien
gtaaactgtggggtcagcaggccca

SEQ ID NO: 50565 - DNA, 25 bp, Homo sapien
gcagctgttccaggttgccacatcc

SEQ ID NO: 50566 - DNA, 25 bp, Homo sapien
cgagagagcatgcaggtcccaaacc

SEQ ID NO: 50567 - DNA, 25 bp, Homo sapien
cggctgactctctgctgcacatgtg

SEQ ID NO: 50568 - DNA, 25 bp, Homo sapien
tgggattatcttttccagtaaactg

SEQ ID NO: 50569 - DNA, 25 bp, Homo sapien
cctgtccaagtagggagctctgccc

SEQ ID NO: 50570 - DNA, 25 bp, Homo sapien
ctgcaccatggggatgcattgggtc

SEQ ID NO: 50571 - DNA, 25 bp, Homo sapien
agtactcgccttgctgctgcttttc

SEQ ID NO: 50572 - DNA, 25 bp, Homo sapien
ttgggctcgccatcagaactgtggc

SEQ ID NO: 50573 - DNA, 25 bp, Homo sapien
aacgtgtgtcccgaaactgccttgg

SEQ ID NO: 50574 - DNA, 25 bp, Homo sapien
tgtcccgaaactgccttgggctcgc

SEQ ID NO: 50575 - DNA, 25 bp, Homo sapien
acagggagatactgggccactcagc

SEQ ID NO: 50576 - DNA, 25 bp, Homo sapien
agtagcacctgtcagctctgtcccg

SEQ ID NO: 50577 - DNA, 25 bp, Homo sapien
gtgacaggccacagtagcacctgtc

SEQ ID NO: 50578 - DNA, 25 bp, Homo sapien
gcctcaccgacgtcaccattgctgg

SEQ ID NO: 50579 - DNA, 25 bp, Homo sapien
ccactcagcccagcggggaacgtgt

SEQ ID NO: 50580 - DNA, 25 bp, Homo sapien
cgcaggcgctttctaggtgatttta

SEQ ID NO: 50581 - DNA, 25 bp, Homo sapien
gctgcccgttagtgcactcaggttt

SEQ ID NO: 50582 - DNA, 25 bp, Homo sapien
aggttttctcgccttctcacgtgca

SEQ ID NO: 50583 - DNA, 25 bp, Homo sapien
aggaagatctggctctgcctaaatc

SEQ ID NO: 50584 - DNA, 25 bp, Homo sapien
aggaagcttagatagccggcgcgca

SEQ ID NO: 50585 - DNA, 25 bp, Homo sapien
cgtgttcccaaactcccaggatgtg

SEQ ID NO: 50586 - DNA, 25 bp, Homo sapien
agaaccagggtcttgtttccactga

SEQ ID NO: 50587 - DNA, 25 bp, Homo sapien
cgttggaaacagcatggtgagaacc

SEQ ID NO: 50588 - DNA, 25 bp, Homo sapien
gcggtcgcctgcagtatcagtatca

SEQ ID NO: 50589 - DNA, 25 bp, Homo sapien
tcttgcaggagaggtgacgttaatc

SEQ ID NO: 50590 - DNA, 25 bp, Homo sapien
cccaatcttaaggagcagagagtta

SEQ ID NO: 50591 - DNA, 25 bp, Homo sapien
cagagagttagttccgggcgtttgc

SEQ ID NO: 50592 - DNA, 25 bp, Homo sapien
cttcaggcctctaaggacacagctg

SEQ ID NO: 50593 - DNA, 25 bp, Homo sapien
tctccagtgtctctcccgtaaggtg

SEQ ID NO: 50594 - DNA, 25 bp, Homo sapien
tcccacgcccaaaaggaataagctg

SEQ ID NO: 50595 - DNA, 25 bp, Homo sapien
gcccaccctttagcgcctgaggaga

SEQ ID NO: 50596 - DNA, 25 bp, Homo sapien
cagtcgcgtgggtagaaacagcaca

SEQ ID NO: 50597 - DNA, 25 bp, Homo sapien
tgtgaacaccgggaacagtcgagtg

SEQ ID NO: 50598 - DNA, 25 bp, Homo sapien
ggagatgcgaacaccgggaacagtc

SEQ ID NO: 50599 - DNA, 25 bp, Homo sapien
cagtcgagtgggtagaaacagcaca

SEQ ID NO: 50600 - DNA, 25 bp, Homo sapien
ccgggaacagtcgagtggatagaaa

SEQ ID NO: 50601 - DNA, 25 bp, Homo sapien
tgcgaacaccgggaacagtcgtgtg

SEQ ID NO: 50602 - DNA, 25 bp, Homo sapien
tgcgaacaccgggaacagtcgagtg

SEQ ID NO: 50603 - DNA, 25 bp, Homo sapien
tgtgcacgaggagatgcgaacaccg

SEQ ID NO: 50604 - DNA, 25 bp, Homo sapien
ccagagcttctatggcggattctca

SEQ ID NO: 50605 - DNA, 25 bp, Homo sapien
agagcgctcttctgcagtctccagc

SEQ ID NO: 50606 - DNA, 25 bp, Homo sapien
gtggcctctcaacccagcgagatca

SEQ ID NO: 50607 - DNA, 25 bp, Homo sapien
ctcagacggctgtaaagaaatattc

SEQ ID NO: 50608 - DNA, 25 bp, Homo sapien
cacagcgccatcgagacagtctttc

SEQ ID NO: 50609 - DNA, 25 bp, Homo sapien
tctcagcttacaggcaacggaacaa

SEQ ID NO: 50610 - DNA, 25 bp, Homo sapien
cgcagagctttcttcgccgctgtct

SEQ ID NO: 50611 - DNA, 25 bp, Homo sapien
cggcattgagccttgtgtctttcca

SEQ ID NO: 50612 - DNA, 25 bp, Homo sapien
aacgcggagatctgataaagcaaca

SEQ ID NO: 50613 - DNA, 25 bp, Homo sapien
tgacacgctggttttcagacgtttg

SEQ ID NO: 50614 - DNA, 25 bp, Homo sapien
cagacgtttgattcagctgctgcag

SEQ ID NO: 50615 - DNA, 25 bp, Homo sapien
ggaactctccctgggtgacacgctg

SEQ ID NO: 50616 - DNA, 25 bp, Homo sapien
tccctgacacgggaactgaactgca

SEQ ID NO: 50617 - DNA, 25 bp, Homo sapien
cgaaagatgtttcaaggaactctcc

SEQ ID NO: 50618 - DNA, 25 bp, Homo sapien
aagcaacaattcagctcacggcgag

SEQ ID NO: 50619 - DNA, 25 bp, Homo sapien
ggagacgtctggattggaaactacc

SEQ ID NO: 50620 - DNA, 25 bp, Homo sapien
tggagatcatccaaggcctcacgcg

SEQ ID NO: 50621 - DNA, 25 bp, Homo sapien
ctggcggccgcgacgcactcaaaag

SEQ ID NO: 50622 - DNA, 25 bp, Homo sapien
ctacagtgacgaggtggagatcatc

SEQ ID NO: 50623 - DNA, 25 bp, Homo sapien
caggcgcgctgcactacagtgacga

SEQ ID NO: 50624 - DNA, 25 bp, Homo sapien
accgctgtgaccgaaacctggtgtg

SEQ ID NO: 50625 - DNA, 25 bp, Homo sapien
ttcctggcaggtactaccgctgtga

SEQ ID NO: 50626 - DNA, 25 bp, Homo sapien
ccgtgcctgttcctggcaggtacta

SEQ ID NO: 50627 - DNA, 25 bp, Homo sapien
cgcactcaaaagcagcgtggacgcg

SEQ ID NO: 50628 - DNA, 25 bp, Homo sapien
catggagacggacaacaagtgcttc

SEQ ID NO: 50629 - DNA, 25 bp, Homo sapien
acctgcgcagggagcttctaacccg

SEQ ID NO: 50630 - DNA, 25 bp, Homo sapien
ccaaaggtgtacgtgaccagggtgc

SEQ ID NO: 50631 - DNA, 25 bp, Homo sapien
ctgcggcgcccacagtggactcaaa

SEQ ID NO: 50632 - DNA, 25 bp, Homo sapien
actcaaacttgtcctccgaagcgcg

SEQ ID NO: 50633 - DNA, 25 bp, Homo sapien
ttcctgagcttgtcccaggtgtccg

SEQ ID NO: 50634 - DNA, 25 bp, Homo sapien
acaagtgcttctaccgcgagtctcc

SEQ ID NO: 50635 - DNA, 25 bp, Homo sapien
ttcctcaacccggacggtgagtgtc

SEQ ID NO: 50636 - DNA, 25 bp, Homo sapien
ctttgaggtgagtggtgactcctgc

SEQ ID NO: 50637 - DNA, 25 bp, Homo sapien
ctcagccgcactctgttcagaagga

SEQ ID NO: 50638 - DNA, 25 bp, Homo sapien
tggcaggaccaaagcctcctgggca

SEQ ID NO: 50639 - DNA, 25 bp, Homo sapien
cagaaggacctttctggaggtagga

SEQ ID NO: 50640 - DNA, 25 bp, Homo sapien
actcctgctcctcccatgtgttgtg

SEQ ID NO: 50641 - DNA, 25 bp, Homo sapien
gtgtggctcacataggatgacctta

SEQ ID NO: 50642 - DNA, 25 bp, Homo sapien
ccttaaacgttagaattagctgctg

SEQ ID NO: 50643 - DNA, 25 bp, Homo sapien
ttctgagggtgtctctgtccgccct

SEQ ID NO: 50644 - DNA, 25 bp, Homo sapien
cgcctgcagaatgcaagtgcggccc

SEQ ID NO: 50645 - DNA, 25 bp, Homo sapien
tcaaggtcatcgaccggctgagccg

SEQ ID NO: 50646 - DNA, 25 bp, Homo sapien
caaggacttcgtcgtcaaggtcatc

SEQ ID NO: 50647 - DNA, 25 bp, Homo sapien
cttcgagattgccaaggacttcgtc

SEQ ID NO: 50648 - DNA, 25 bp, Homo sapien
ttggcctgcagaacttcgagattgc

SEQ ID NO: 50649 - DNA, 25 bp, Homo sapien
tcagagagcattggcctgcagaact

SEQ ID NO: 50650 - DNA, 25 bp, Homo sapien
ccatcgacctcctgttcgtgctgga

SEQ ID NO: 50651 - DNA, 25 bp, Homo sapien
cgtgctggacagctcagagagcatt

SEQ ID NO: 50652 - DNA, 25 bp, Homo sapien
cgtgtttgacttcatcccaggctca

SEQ ID NO: 50653 - DNA, 25 bp, Homo sapien
ctctctggggagcttagacgctctc

SEQ ID NO: 50654 - DNA, 25 bp, Homo sapien
tgggctcacactgcacggcttttct

SEQ ID NO: 50655 - DNA, 25 bp, Homo sapien
tgaagaatgtcaccgcccagatctg

SEQ ID NO: 50656 - DNA, 25 bp, Homo sapien
ggctcagaccagctcaatgtcattt

SEQ ID NO: 50657 - DNA, 25 bp, Homo sapien
tctccgtgggcatcaaagacgtgtt

SEQ ID NO: 50658 - DNA, 25 bp, Homo sapien
aggctgcgccacaccgatactgtct

SEQ ID NO: 50659 - DNA, 25 bp, Homo sapien
ccggcctctcgctggtcaaggagaa

SEQ ID NO: 50660 - DNA, 25 bp, Homo sapien
atggcacgttggtgccgctgagacc

SEQ ID NO: 50661 - DNA, 25 bp, Homo sapien
tgaccaggcgtctgaccacagagcc

SEQ ID NO: 50662 - DNA, 25 bp, Homo sapien
tggcacgttggtgccgctgagaccc

SEQ ID NO: 50663 - DNA, 25 bp, Homo sapien
tctgaccacagagcaggcgagatgg

SEQ ID NO: 50664 - DNA, 25 bp, Homo sapien
ccgtgaccaggcgtctgaccacaga

SEQ ID NO: 50665 - DNA, 25 bp, Homo sapien
cgtgaccaggcgtctgaccacagag

SEQ ID NO: 50666 - DNA, 25 bp, Homo sapien
gtgaccaggcgtctgaccacagagc

SEQ ID NO: 50667 - DNA, 25 bp, Homo sapien
ccagctgagccgtgaccaggcgtct

SEQ ID NO: 50668 - DNA, 25 bp, Homo sapien
tggagaatccagacacaaaacagtg

SEQ ID NO: 50669 - DNA, 25 bp, Homo sapien
gcggaccactcctccacaataaaag

SEQ ID NO: 50670 - DNA, 25 bp, Homo sapien
gcaaggcctagtccaggaggcagca

SEQ ID NO: 50671 - DNA, 25 bp, Homo sapien
gaggctcacgtggtgtcgatgaaca

SEQ ID NO: 50672 - DNA, 25 bp, Homo sapien
caaaacagtgcctgcggtgccgtcc

SEQ ID NO: 50673 - DNA, 25 bp, Homo sapien
ccgtccgtcgacatcagctctgaga

SEQ ID NO: 50674 - DNA, 25 bp, Homo sapien
atcagctctgagacgggcaaggcct

SEQ ID NO: 50675 - DNA, 25 bp, Homo sapien
tggtgtcgatgaacatggagaatcc

SEQ ID NO: 50676 - DNA, 25 bp, Homo sapien
tctccagtgtgtgccagcctccaat

SEQ ID NO: 50677 - DNA, 25 bp, Homo sapien
ggacgggcctctccagtgtgtgcca

SEQ ID NO: 50678 - DNA, 25 bp, Homo sapien
acgggcctctccagtgtgtgccagc

SEQ ID NO: 50679 - DNA, 25 bp, Homo sapien
ccagtgtgtgccagcctccaatacc

SEQ ID NO: 50680 - DNA, 25 bp, Homo sapien
cagtgtgtgccagcctccaataccc

SEQ ID NO: 50681 - DNA, 25 bp, Homo sapien
cccgcgtcacctgcggtgtggacgg

SEQ ID NO: 50682 - DNA, 25 bp, Homo sapien
tccagtgtgtgccagcctccaatac

SEQ ID NO: 50683 - DNA, 25 bp, Homo sapien
ctccagtgtgtgccagcctccaata

SEQ ID NO: 50684 - DNA, 25 bp, Homo sapien
atagctgtacctggggtgaaatgga

SEQ ID NO: 50685 - DNA, 25 bp, Homo sapien
cacttagcaaagtgactaggtcatt

SEQ ID NO: 50686 - DNA, 25 bp, Homo sapien
tgttcctgctccctcaaggttgtgc

SEQ ID NO: 50687 - DNA, 25 bp, Homo sapien
cgtgggacatagctttaaaaatggg

SEQ ID NO: 50688 - DNA, 25 bp, Homo sapien
tggagaagacgtgggacatagcttt

SEQ ID NO: 50689 - DNA, 25 bp, Homo sapien
tgccagagctaaaaatagctgtacc

SEQ ID NO: 50690 - DNA, 25 bp, Homo sapien
agcggatggtgttcctgctccctca

SEQ ID NO: 50691 - DNA, 25 bp, Homo sapien
ggagaagcgctttttcccaagcggc

SEQ ID NO: 50692 - DNA, 25 bp, Homo sapien
cctgtgacgagttcacggaagctcc

SEQ ID NO: 50693 - DNA, 25 bp, Homo sapien
agagcatcccacttcctcggaaagc

SEQ ID NO: 50694 - DNA, 25 bp, Homo sapien
gaggcatcgccagagcatcccactt

SEQ ID NO: 50695 - DNA, 25 bp, Homo sapien
tctgggctaaaacgaggcatcgcca

SEQ ID NO: 50696 - DNA, 25 bp, Homo sapien
agttcacggaagctccaggatgacc

SEQ ID NO: 50697 - DNA, 25 bp, Homo sapien
acttcctcggaaagctgcggtctgg

SEQ ID NO: 50698 - DNA, 25 bp, Homo sapien
cggttctgctccatggacggcgcag

SEQ ID NO: 50699 - DNA, 25 bp, Homo sapien
ccacaaaccactctgggctaaaacg

SEQ ID NO: 50700 - DNA, 25 bp, Homo sapien
ggtggtccttcgtgtccacgtcagc

SEQ ID NO: 50701 - DNA, 25 bp, Homo sapien
tgggcaccatgacctcacatgcgga

SEQ ID NO: 50702 - DNA, 25 bp, Homo sapien
tcagacacctgcatgcgccgattca

SEQ ID NO: 50703 - DNA, 25 bp, Homo sapien
ctggccatggggtttccaaagtgtg

SEQ ID NO: 50704 - DNA, 25 bp, Homo sapien
gggtcccggtctgaatgcttcctaa

SEQ ID NO: 50705 - DNA, 25 bp, Homo sapien
atgacctgtcagtggctctctgtgc

SEQ ID NO: 50706 - DNA, 25 bp, Homo sapien
ttccaaagtgtgtgctcagaggaca

SEQ ID NO: 50707 - DNA, 25 bp, Homo sapien
tctccactcaggaggcgtttgctga

SEQ ID NO: 50708 - DNA, 25 bp, Homo sapien
ccctccctgctgcttactcggcgcc

SEQ ID NO: 50709 - DNA, 25 bp, Homo sapien
acccgggctgacagcgacccgcagc

SEQ ID NO: 50710 - DNA, 25 bp, Homo sapien
ccctcctcccatccgcggggccgca

SEQ ID NO: 50711 - DNA, 25 bp, Homo sapien
agcctcctcgggaccaggtgagcgc

SEQ ID NO: 50712 - DNA, 25 bp, Homo sapien
ccgcgtctctgggtccgaccctcgg

SEQ ID NO: 50713 - DNA, 25 bp, Homo sapien
cccgcaccctggaagccgctcggcc

SEQ ID NO: 50714 - DNA, 25 bp, Homo sapien
ccgcgtctgcgagcggttcgggtcc

SEQ ID NO: 50715 - DNA, 25 bp, Homo sapien
ctgcgcccgagctcggtgctgggac

SEQ ID NO: 50716 - DNA, 25 bp, Homo sapien
accgcctcccggcacaggtgtggac

SEQ ID NO: 50717 - DNA, 25 bp, Homo sapien
ctcgcctccgggaggacgtccaagg

SEQ ID NO: 50718 - DNA, 25 bp, Homo sapien
tctcgcctccgggaggacgtccaag

SEQ ID NO: 50719 - DNA, 25 bp, Homo sapien
gccgcctgaagctcctctcgcctcc

SEQ ID NO: 50720 - DNA, 25 bp, Homo sapien
tcggccgcctgaagctcctctcgcc

SEQ ID NO: 50721 - DNA, 25 bp, Homo sapien
tctggggctcgggaggaccttgcga

SEQ ID NO: 50722 - DNA, 25 bp, Homo sapien
cccgggcctgtagacgccgcctcgg

SEQ ID NO: 50723 - DNA, 25 bp, Homo sapien
gcctcccggcacaggtgtggacggg

SEQ ID NO: 50724 - DNA, 25 bp, Homo sapien
ttctgcagaaacacgaagcctacgg

SEQ ID NO: 50725 - DNA, 25 bp, Homo sapien
tctcgaggcacacggctaaccagca

SEQ ID NO: 50726 - DNA, 25 bp, Homo sapien
ctggccaacatgacggagcagatcc

SEQ ID NO: 50727 - DNA, 25 bp, Homo sapien
gcgaccgggcctccttcatcaagaa

SEQ ID NO: 50728 - DNA, 25 bp, Homo sapien
gcctgcacttctctgaccaggtgga

SEQ ID NO: 50729 - DNA, 25 bp, Homo sapien
acctcggagagcgtcaccatgcagt

SEQ ID NO: 50730 - DNA, 25 bp, Homo sapien
catgaagcagttcgtgccgcagttc

SEQ ID NO: 50731 - DNA, 25 bp, Homo sapien
atcagccagctgcagaacgagttct

SEQ ID NO: 50732 - DNA, 25 bp, Homo sapien
tccagctggacgacgaacgtatcga

SEQ ID NO: 50733 - DNA, 25 bp, Homo sapien
cgacctggtcgctgagaagttcatc

SEQ ID NO: 50734 - DNA, 25 bp, Homo sapien
aggtgcgcaacatgacgctgttctc

SEQ ID NO: 50735 - DNA, 25 bp, Homo sapien
agctccgagagcattgggtacacca

SEQ ID NO: 50736 - DNA, 25 bp, Homo sapien
cctgtcgagcttcaaggaggctgtc

SEQ ID NO: 50737 - DNA, 25 bp, Homo sapien
tcgtcatcaacgtggtcaacaggct

SEQ ID NO: 50738 - DNA, 25 bp, Homo sapien
tcaacaggctgggtgccatcgctaa

SEQ ID NO: 50739 - DNA, 25 bp, Homo sapien
cctcgggacgatgacctcaacttgc

SEQ ID NO: 50740 - DNA, 25 bp, Homo sapien
tctacaccgccgagcgggccaagtt

SEQ ID NO: 50741 - DNA, 25 bp, Homo sapien
ctggatggagctgttcattgacacc

SEQ ID NO: 50742 - DNA, 25 bp, Homo sapien
acacctttaagctggtgcacaggga

SEQ ID NO: 50743 - DNA, 25 bp, Homo sapien
acagtcttctctggacgctcccttg

SEQ ID NO: 50744 - DNA, 25 bp, Homo sapien
tcccttgcagatgcaccgtggcctg

SEQ ID NO: 50745 - DNA, 25 bp, Homo sapien
gatccaacagttgctaaacgccacg

SEQ ID NO: 50746 - DNA, 25 bp, Homo sapien
ggtcaccttcctccgcacggaagag

SEQ ID NO: 50747 - DNA, 25 bp, Homo sapien
taaacgccacggagctcacgcagga

SEQ ID NO: 50748 - DNA, 25 bp, Homo sapien
ctggagaccacacaatacctgaact

SEQ ID NO: 50749 - DNA, 25 bp, Homo sapien
ttcttcgaccgcttcatccgctgga

SEQ ID NO: 50750 - DNA, 25 bp, Homo sapien
catgcgcaagcagaacgtggtaccc

SEQ ID NO: 50751 - DNA, 25 bp, Homo sapien
cgggcaacgacagtctgcacgagtc

SEQ ID NO: 50752 - DNA, 25 bp, Homo sapien
gcagagctgtccttcgtgttcctca

SEQ ID NO: 50753 - DNA, 25 bp, Homo sapien
ctgaactccttctcgcacgtgggcg

SEQ ID NO: 50754 - DNA, 25 bp, Homo sapien
tgagcagaacttccacaaggcccgg

SEQ ID NO: 50755 - DNA, 25 bp, Homo sapien
cgtggtgcacgccatcaatgccatc

SEQ ID NO: 50756 - DNA, 25 bp, Homo sapien
cccgtaggtcatgaggcccaccatg

SEQ ID NO: 50757 - DNA, 25 bp, Homo sapien
agggcagaggctcactcgatgatcc

SEQ ID NO: 50758 - DNA, 25 bp, Homo sapien
tgaccactcggctgagaacctgcgg

SEQ ID NO: 50759 - DNA, 25 bp, Homo sapien
cgcatcgtcgtgtccagggactgga

SEQ ID NO: 50760 - DNA, 25 bp, Homo sapien
tgcacccacggggaggtgaccactc

SEQ ID NO: 50761 - DNA, 25 bp, Homo sapien
tcgatgatccgctccttagggctga

SEQ ID NO: 50762 - DNA, 25 bp, Homo sapien
catccaccagcgtggttagcttggc

SEQ ID NO: 50763 - DNA, 25 bp, Homo sapien
ttagcttggccgaagcctcgcggaa

SEQ ID NO: 50764 - DNA, 25 bp, Homo sapien
ttgatgaggaactcgctgaacgccg

SEQ ID NO: 50765 - DNA, 25 bp, Homo sapien
gggcaccacgtcgatgaccagcttg

SEQ ID NO: 50766 - DNA, 25 bp, Homo sapien
tcgcacaggcagttgagcagcagca

SEQ ID NO: 50767 - DNA, 25 bp, Homo sapien
caaacgcgtttactgcaggcaaggc

SEQ ID NO: 50768 - DNA, 25 bp, Homo sapien
ccaaactgggacaggactcgccgtc

SEQ ID NO: 50769 - DNA, 25 bp, Homo sapien
cagctcggcattcggggaaacccaa

SEQ ID NO: 50770 - DNA, 25 bp, Homo sapien
cgtttccattttgccggcaggggtg

SEQ ID NO: 50771 - DNA, 25 bp, Homo sapien
gtccacggagccgtccagagacttg

SEQ ID NO: 50772 - DNA, 25 bp, Homo sapien
agtgcccgggcctcacaagtgctgt

SEQ ID NO: 50773 - DNA, 25 bp, Homo sapien
taagggcccttttgcagccacagtg

SEQ ID NO: 50774 - DNA, 25 bp, Homo sapien
ccacacacgccaaacagattaaggg

SEQ ID NO: 50775 - DNA, 25 bp, Homo sapien
cacaagtgctgtgaacgggaccctg

SEQ ID NO: 50776 - DNA, 25 bp, Homo sapien
tgcacgtggcccagcaccgtaagcg

SEQ ID NO: 50777 - DNA, 25 bp, Homo sapien
atggagacgcagaacctggggcctc

SEQ ID NO: 50778 - DNA, 25 bp, Homo sapien
cagcaaacgccctgtggtgagcgtg

SEQ ID NO: 50779 - DNA, 25 bp, Homo sapien
accgtaagcgcaggtctgcccagca

SEQ ID NO: 50780 - DNA, 25 bp, Homo sapien
ctcgcccgggaccagagattgcgct

SEQ ID NO: 50781 - DNA, 25 bp, Homo sapien
tgcaggtacgccgacttcagtctcg

SEQ ID NO: 50782 - DNA, 25 bp, Homo sapien
cccgggaccagagattgcgctggat

SEQ ID NO: 50783 - DNA, 25 bp, Homo sapien
tcaccgccgggttaactggcgaggc

SEQ ID NO: 50784 - DNA, 25 bp, Homo sapien
gcctttcctctcttgaacgtggcag

SEQ ID NO: 50785 - DNA, 25 bp, Homo sapien
gggactcagtggtgtcgcctcgccc

SEQ ID NO: 50786 - DNA, 25 bp, Homo sapien
tggcactgcaggtacgccgacttca

SEQ ID NO: 50787 - DNA, 25 bp, Homo sapien
ggacttcggtgcgagggtcaccgcc

SEQ ID NO: 50788 - DNA, 25 bp, Homo sapien
ctcaggagccggctcatcagctcgc

SEQ ID NO: 50789 - DNA, 25 bp, Homo sapien
aggtccgcgttctcgctcaggagcc

SEQ ID NO: 50790 - DNA, 25 bp, Homo sapien
gcacctgcttcttcaggtccgcgtt

SEQ ID NO: 50791 - DNA, 25 bp, Homo sapien
tctccttcaggaggcgcacctgctt

SEQ ID NO: 50792 - DNA, 25 bp, Homo sapien
cgcagcatctgattctccttcagga

SEQ ID NO: 50793 - DNA, 25 bp, Homo sapien
cggcctcagggtaggcatgcgccct

SEQ ID NO: 50794 - DNA, 25 bp, Homo sapien
gtgacctcccgcatcagggagctgg

SEQ ID NO: 50795 - DNA, 25 bp, Homo sapien
tcagctcgccgccttcagccatggc

SEQ ID NO: 50796 - DNA, 25 bp, Homo sapien
attgctctcgcgctgcaggatttgc

SEQ ID NO: 50797 - DNA, 25 bp, Homo sapien
gaggtgagcctctctgagaaatttg

SEQ ID NO: 50798 - DNA, 25 bp, Homo sapien
cctgcaggtaggtccacgtctgccg

SEQ ID NO: 50799 - DNA, 25 bp, Homo sapien
cctctcgcagttgagtcgccagcgg

SEQ ID NO: 50800 - DNA, 25 bp, Homo sapien
aggggactcacgtgccctccgtcat

SEQ ID NO: 50801 - DNA, 25 bp, Homo sapien
ccgtcattgctgctgcagtgctcta

SEQ ID NO: 50802 - DNA, 25 bp, Homo sapien
ccctctagaggcttgcgtcccggga

SEQ ID NO: 50803 - DNA, 25 bp, Homo sapien
agctgccagatgtccgcacccggga

SEQ ID NO: 50804 - DNA, 25 bp, Homo sapien
aatcaaaattccacgcaggggcctt

SEQ ID NO: 50805 - DNA, 25 bp, Homo sapien
gggcacctttaatggctcagtcatt

SEQ ID NO: 50806 - DNA, 25 bp, Homo sapien
tgttgaattcaacgtgggcaccttt

SEQ ID NO: 50807 - DNA, 25 bp, Homo sapien
gcggcgtcaggaacgtcactcttca

SEQ ID NO: 50808 - DNA, 25 bp, Homo sapien
tggccacgtttctgccggcatcagc

SEQ ID NO: 50809 - DNA, 25 bp, Homo sapien
cgccacgtgtcgcttggcaaagccg

SEQ ID NO: 50810 - DNA, 25 bp, Homo sapien
tggggttagcctttcccactcagga

SEQ ID NO: 50811 - DNA, 25 bp, Homo sapien
catagcaaaaggaacgcggctccgc

SEQ ID NO: 50812 - DNA, 25 bp, Homo sapien
cctttgctgggtccagacaccggta

SEQ ID NO: 50813 - DNA, 25 bp, Homo sapien
gttcgctcagcactaccggattccg

SEQ ID NO: 50814 - DNA, 25 bp, Homo sapien
acttgaggcgcaagcacaggctgct

SEQ ID NO: 50815 - DNA, 25 bp, Homo sapien
ccgcaacgctccgttagcgacgatg

SEQ ID NO: 50816 - DNA, 25 bp, Homo sapien
ggggagcctaatcttccacccagca

SEQ ID NO: 50817 - DNA, 25 bp, Homo sapien
ggctggagcgctaagcactttctca

SEQ ID NO: 50818 - DNA, 25 bp, Homo sapien
ccggagaattcactgtaacgctgtc

SEQ ID NO: 50819 - DNA, 25 bp, Homo sapien
tctcccaagcgagagcgtcgcattc

SEQ ID NO: 50820 - DNA, 25 bp, Homo sapien
aaaggcttgcgtcagtatttcctgc

SEQ ID NO: 50821 - DNA, 25 bp, Homo sapien
taaaacggttccgagccgtggcatc

SEQ ID NO: 50822 - DNA, 25 bp, Homo sapien
cttcacgttgcatcgggtatttttc

SEQ ID NO: 50823 - DNA, 25 bp, Homo sapien
agccggggtcgcacacgaataaata

SEQ ID NO: 50824 - DNA, 25 bp, Homo sapien
agctcaggttctggtgaaggtgccc

SEQ ID NO: 50825 - DNA, 25 bp, Homo sapien
accctggagtttcagcgccagcgca

SEQ ID NO: 50826 - DNA, 25 bp, Homo sapien
agcgcacgcctcttcatcagggcag

SEQ ID NO: 50827 - DNA, 25 bp, Homo sapien
cgcgtccttccgtagaaaaggcttg

SEQ ID NO: 50828 - DNA, 25 bp, Homo sapien
agtgatagagcattataggaccaga

SEQ ID NO: 50829 - DNA, 25 bp, Homo sapien
gagcattataggaccagagaacagg

SEQ ID NO: 50830 - DNA, 25 bp, Homo sapien
ccagagaacaggtgtgtctgtacac

SEQ ID NO: 50831 - DNA, 25 bp, Homo sapien
ggcaggctctgagtccgtctgcaca

SEQ ID NO: 50832 - DNA, 25 bp, Homo sapien
ggctctgagtccgtctgcacacggt

SEQ ID NO: 50833 - DNA, 25 bp, Homo sapien
ggcgcgccctgagtctctactaaaa

SEQ ID NO: 50834 - DNA, 25 bp, Homo sapien
ttcctatttgttaaagtgatagagc

SEQ ID NO: 50835 - DNA, 25 bp, Homo sapien
tgtgtctgtacactgtgcaggtccc

SEQ ID NO: 50836 - DNA, 25 bp, Homo sapien
ctccacgacgaaccttttgcaagtg

SEQ ID NO: 50837 - DNA, 25 bp, Homo sapien
tactccacagttaaggacggcctgc

SEQ ID NO: 50838 - DNA, 25 bp, Homo sapien
aggggttagctgaaggaatactcca

SEQ ID NO: 50839 - DNA, 25 bp, Homo sapien
cttggacacatgaaataaaggggtt

SEQ ID NO: 50840 - DNA, 25 bp, Homo sapien
ttttgcaagtgaaggcgcacgaaca

SEQ ID NO: 50841 - DNA, 25 bp, Homo sapien
aagggcatcgttactgctgcaaaca

SEQ ID NO: 50842 - DNA, 25 bp, Homo sapien
aggagccactccagcacgctcggga

SEQ ID NO: 50843 - DNA, 25 bp, Homo sapien
cgaacaggcccggaggactacaaag

SEQ ID NO: 50844 - DNA, 25 bp, Homo sapien
gccttcgcctcgtccgtcggagatg

SEQ ID NO: 50845 - DNA, 25 bp, Homo sapien
ctgctctggcgtgaagtcctaaggg

SEQ ID NO: 50846 - DNA, 25 bp, Homo sapien
aagccgccgcggaggtctcgctttt

SEQ ID NO: 50847 - DNA, 25 bp, Homo sapien
tgtaaatagagcgaaggctgctctg

SEQ ID NO: 50848 - DNA, 25 bp, Homo sapien
ctgcttggtctagggccagtttcct

SEQ ID NO: 50849 - DNA, 25 bp, Homo sapien
cggcgttgcagtccttactgtgtga

SEQ ID NO: 50850 - DNA, 25 bp, Homo sapien
caggctggatcttccagtggctccc

SEQ ID NO: 50851 - DNA, 25 bp, Homo sapien
ttaggggcttcttctctagctgctc

SEQ ID NO: 50852 - DNA, 25 bp, Homo sapien
gcgcattcacggtgttgtgcattca

SEQ ID NO: 50853 - DNA, 25 bp, Homo sapien
tggcggaagcgcattcaccatgttg

SEQ ID NO: 50854 - DNA, 25 bp, Homo sapien
tgcattcagtggcagaagcgcattc

SEQ ID NO: 50855 - DNA, 25 bp, Homo sapien
gtggcggaagcgcattcaccatgtt

SEQ ID NO: 50856 - DNA, 25 bp, Homo sapien
attcagcagcggaagcgcattcacg

SEQ ID NO: 50857 - DNA, 25 bp, Homo sapien
tggcagaagcgcattcacagtgttg

SEQ ID NO: 50858 - DNA, 25 bp, Homo sapien
gcattcagtggcagaagcgcattca

SEQ ID NO: 50859 - DNA, 25 bp, Homo sapien
gttcagtggcagaagcgcattcaca

SEQ ID NO: 50860 - DNA, 25 bp, Homo sapien
gccgtcctggtttcctgctagtttc

SEQ ID NO: 50861 - DNA, 25 bp, Homo sapien
agcctccgtattgggcgatgccctt

SEQ ID NO: 50862 - DNA, 25 bp, Homo sapien
tgctagtttccgcacttacagaagg

SEQ ID NO: 50863 - DNA, 25 bp, Homo sapien
cgacgttctgagttctgtggcttcc

SEQ ID NO: 50864 - DNA, 25 bp, Homo sapien
ctgtggcttccttgtcgtcttggct

SEQ ID NO: 50865 - DNA, 25 bp, Homo sapien
tgtgccggcatctgctcatcttgta

SEQ ID NO: 50866 - DNA, 25 bp, Homo sapien
gagctctctgagaggagcctccgta

SEQ ID NO: 50867 - DNA, 25 bp, Homo sapien
tgggctaaatttgtcagctcccgtg

SEQ ID NO: 50868 - DNA, 25 bp, Homo sapien
agtgcacccgtctgtggagtcgggg

SEQ ID NO: 50869 - DNA, 25 bp, Homo sapien
aagctggtaaggagcgcgggctgtg

SEQ ID NO: 50870 - DNA, 25 bp, Homo sapien
ggaaggaggattccgagcaccgtct

SEQ ID NO: 50871 - DNA, 25 bp, Homo sapien
aggaggattccgagcaccgtctggt

SEQ ID NO: 50872 - DNA, 25 bp, Homo sapien
tggagctggagagcctgagacggca

SEQ ID NO: 50873 - DNA, 25 bp, Homo sapien
gagagcctgagacggcagctgcagc

SEQ ID NO: 50874 - DNA, 25 bp, Homo sapien
gccagagaagctggtaaggagcgcg

SEQ ID NO: 50875 - DNA, 25 bp, Homo sapien
tgagggaggagtgcacccgtctgtg

SEQ ID NO: 50876 - DNA, 25 bp, Homo sapien
cggcctctgaaactcactccatttg

SEQ ID NO: 50877 - DNA, 25 bp, Homo sapien
agcgcctccatagcagcggtgagaa

SEQ ID NO: 50878 - DNA, 25 bp, Homo sapien
gcgcttgcttccctaaaagaatata

SEQ ID NO: 50879 - DNA, 25 bp, Homo sapien
tgttccggacccagcactcagactg

SEQ ID NO: 50880 - DNA, 25 bp, Homo sapien
cgttacctgtgctcgatacctgggc

SEQ ID NO: 50881 - DNA, 25 bp, Homo sapien
ccacgtaggctctgcagggaaacag

SEQ ID NO: 50882 - DNA, 25 bp, Homo sapien
acagagttccacaggcgtcgttgcc

SEQ ID NO: 50883 - DNA, 25 bp, Homo sapien
gccacccaggtgaagcgcttgcttc

SEQ ID NO: 50884 - DNA, 25 bp, Homo sapien
atttccagtgtcttcgcgcccagcc

SEQ ID NO: 50885 - DNA, 25 bp, Homo sapien
tctcagcatctttgccctggcggtg

SEQ ID NO: 50886 - DNA, 25 bp, Homo sapien
gcatctttgccctggcggtgctgtt

SEQ ID NO: 50887 - DNA, 25 bp, Homo sapien
gtccgttgtcgctgtttctccgatg

SEQ ID NO: 50888 - DNA, 25 bp, Homo sapien
gtttctccgatgctttctctgcttg

SEQ ID NO: 50889 - DNA, 25 bp, Homo sapien
ctctgcttgtcctctgctgtccggg

SEQ ID NO: 50890 - DNA, 25 bp, Homo sapien
atcgctctcagcatctttgccctgg

SEQ ID NO: 50891 - DNA, 25 bp, Homo sapien
tgacgtcctgcatcgctctcagcat

SEQ ID NO: 50892 - DNA, 25 bp, Homo sapien
gagctaaaacgacaaccgtgggtca

SEQ ID NO: 50893 - DNA, 25 bp, Homo sapien
gggcgctcaaggactgctcatctgc

SEQ ID NO: 50894 - DNA, 25 bp, Homo sapien
caaggactgctcatctgcgcttctg

SEQ ID NO: 50895 - DNA, 25 bp, Homo sapien
cagccttgggccctactggcccggg

SEQ ID NO: 50896 - DNA, 25 bp, Homo sapien
gccacaggctcggagctcacggccc

SEQ ID NO: 50897 - DNA, 25 bp, Homo sapien
tcaggaagcggagagctaaaacgac

SEQ ID NO: 50898 - DNA, 25 bp, Homo sapien
aaacgacaaccgtgggtcagcggag

SEQ ID NO: 50899 - DNA, 25 bp, Homo sapien
agagagactaaaggggagaccgaga

SEQ ID NO: 50900 - DNA, 25 bp, Homo sapien
cgcgtgctcggtgaatgaacacagc

SEQ ID NO: 50901 - DNA, 25 bp, Homo sapien
ggcacgtgcttggtgaatgaacaca

SEQ ID NO: 50902 - DNA, 25 bp, Homo sapien
atgctcggtgaatgaacacagcgtg

SEQ ID NO: 50903 - DNA, 25 bp, Homo sapien
cgtgtgctcggtgaatgaacacagc

SEQ ID NO: 50904 - DNA, 25 bp, Homo sapien
cgcggcacgtgcttggtgaatgaac

SEQ ID NO: 50905 - DNA, 25 bp, Homo sapien
tgctcggtgaatgaacacagcgtgg

SEQ ID NO: 50906 - DNA, 25 bp, Homo sapien
gcgcgtgctcggtgaatgaacacag

SEQ ID NO: 50907 - DNA, 25 bp, Homo sapien
gcgtgctcggtgaatgaacacagcg

SEQ ID NO: 50908 - DNA, 25 bp, Homo sapien
cccacagcctcgcatggatggtggc

SEQ ID NO: 50909 - DNA, 25 bp, Homo sapien
agagccacagctcacacacgggtgc

SEQ ID NO: 50910 - DNA, 25 bp, Homo sapien
aggtgctgcaccagcggttcctgag

SEQ ID NO: 50911 - DNA, 25 bp, Homo sapien
tagaaatcgacgctctgaaccagcg

SEQ ID NO: 50912 - DNA, 25 bp, Homo sapien
cgacgattgccgagagaaatttaga

SEQ ID NO: 50913 - DNA, 25 bp, Homo sapien
cctgaaagcaaaggaagcgacgatt

SEQ ID NO: 50914 - DNA, 25 bp, Homo sapien
cgaagacatggcctcccggatccag

SEQ ID NO: 50915 - DNA, 25 bp, Homo sapien
ccaggagttcgaagcggccctgaaa

SEQ ID NO: 50916 - DNA, 25 bp, Homo sapien
tgcagaacatgtgggtcttgccctg

SEQ ID NO: 50917 - DNA, 25 bp, Homo sapien
ccgtgcctgcagtgacatgttctct

SEQ ID NO: 50918 - DNA, 25 bp, Homo sapien
tgacgttgaaggatgcacctctctg

SEQ ID NO: 50919 - DNA, 25 bp, Homo sapien
atgtcagtgctcaccgtctgccaga

SEQ ID NO: 50920 - DNA, 25 bp, Homo sapien
tcggagctgctcttggtgaaaaatg

SEQ ID NO: 50921 - DNA, 25 bp, Homo sapien
gtgaaaaatgaaatgcgcctgagtc

SEQ ID NO: 50922 - DNA, 25 bp, Homo sapien
ttctgctgaggtgaggagcacagtc

SEQ ID NO: 50923 - DNA, 25 bp, Homo sapien
tctcctctgtcaagggtgatctgca

SEQ ID NO: 50924 - DNA, 25 bp, Homo sapien
cccggaaggaagacgagatacagga

SEQ ID NO: 50925 - DNA, 25 bp, Homo sapien
aggcaactcccttctgacgcgcttt

SEQ ID NO: 50926 - DNA, 25 bp, Homo sapien
ctttactgcagatggtgcgtgacga

SEQ ID NO: 50927 - DNA, 25 bp, Homo sapien
tgcgtgacgagagccaccagatcct

SEQ ID NO: 50928 - DNA, 25 bp, Homo sapien
ggcgctgtcagaaggccttgcaccc

SEQ ID NO: 50929 - DNA, 25 bp, Homo sapien
cccgccacaggctttactgcagatg

SEQ ID NO: 50930 - DNA, 25 bp, Homo sapien
ccttcacagagtcctggcggcagct

SEQ ID NO: 50931 - DNA, 25 bp, Homo sapien
cagatcctggcgctgtcagaaggcc

SEQ ID NO: 50932 - DNA, 25 bp, Homo sapien
caagcgcttgtcaggggcatgggcg

SEQ ID NO: 50933 - DNA, 25 bp, Homo sapien
ctgtgcaagcgcttgtcaggggcat

SEQ ID NO: 50934 - DNA, 25 bp, Homo sapien
gctggcgctgtgcaagcgcttgtca

SEQ ID NO: 50935 - DNA, 25 bp, Homo sapien
tgccctttgtgctctctggggctgg

SEQ ID NO: 50936 - DNA, 25 bp, Homo sapien
catgccctttgtgctctctggggct

SEQ ID NO: 50937 - DNA, 25 bp, Homo sapien
ggggccggcactgtgcgatcgctcg

SEQ ID NO: 50938 - DNA, 25 bp, Homo sapien
tgtcccggcgcccatgccctttgtg

SEQ ID NO: 50939 - DNA, 25 bp, Homo sapien
ttgcagttcagcccacggcccttgt

SEQ ID NO: 50940 - DNA, 25 bp, Homo sapien
gtcgactctgcgtggcactgaaaca

SEQ ID NO: 50941 - DNA, 25 bp, Homo sapien
cgagcagacggccaaggacaacctg

SEQ ID NO: 50942 - DNA, 25 bp, Homo sapien
gaaggagctgcgtatcgagcactca

SEQ ID NO: 50943 - DNA, 25 bp, Homo sapien
gagcactcacgctgcgaggccttgc

SEQ ID NO: 50944 - DNA, 25 bp, Homo sapien
ctctctgagctccagaaggaccttg

SEQ ID NO: 50945 - DNA, 25 bp, Homo sapien
cagaaggaccttgcggctgagaaga

SEQ ID NO: 50946 - DNA, 25 bp, Homo sapien
cgtctttggagacacagcgtgctca

SEQ ID NO: 50947 - DNA, 25 bp, Homo sapien
agcgtgctcagagcagtcgactctg

SEQ ID NO: 50948 - DNA, 25 bp, Homo sapien
ccacctggcgctcactggtcccttg

SEQ ID NO: 50949 - DNA, 25 bp, Homo sapien
gcccggcttctcaccagcttcacca

SEQ ID NO: 50950 - DNA, 25 bp, Homo sapien
cgatgaggcagcggctgctctctgc

SEQ ID NO: 50951 - DNA, 25 bp, Homo sapien
gctcactggtcccttgcagccaccc

SEQ ID NO: 50952 - DNA, 25 bp, Homo sapien
cctccgggaacagcagcgagagctg

SEQ ID NO: 50953 - DNA, 25 bp, Homo sapien
accacctccgggaacagcagcgaga

SEQ ID NO: 50954 - DNA, 25 bp, Homo sapien
cacctaggttctgcccgcagggctg

SEQ ID NO: 50955 - DNA, 25 bp, Homo sapien
ctcggatgcggaccacctccgggaa

SEQ ID NO: 50956 - DNA, 25 bp, Homo sapien
gcacgagaaaggtgcctcgacgcca

SEQ ID NO: 50957 - DNA, 25 bp, Homo sapien
agctacgtagccgaggtttgcgctg

SEQ ID NO: 50958 - DNA, 25 bp, Homo sapien
cgctcctcgcctggcggatgtaggt

SEQ ID NO: 50959 - DNA, 25 bp, Homo sapien
gcatcgacgcgtcttcggggccaat

SEQ ID NO: 50960 - DNA, 25 bp, Homo sapien
agcgccaacgcccacgggttggtca

SEQ ID NO: 50961 - DNA, 25 bp, Homo sapien
aagacagcggtcaacgcggacgcgc

SEQ ID NO: 50962 - DNA, 25 bp, Homo sapien
actgcgcagcgttcgcgatcagcac

SEQ ID NO: 50963 - DNA, 25 bp, Homo sapien
cgcgatcagcacagcccgaaaggga

SEQ ID NO: 50964 - DNA, 25 bp, Homo sapien
gctccagagccattccagcgtcgag

SEQ ID NO: 50965 - DNA, 25 bp, Homo sapien
cgactcacctccactccgctccaga

SEQ ID NO: 50966 - DNA, 25 bp, Homo sapien
cgtctgcctcagaagatgagggctc

SEQ ID NO: 50967 - DNA, 25 bp, Homo sapien
attccagcgtcgagccctggctcga

SEQ ID NO: 50968 - DNA, 25 bp, Homo sapien
agccctggctcgaccgggtcattca

SEQ ID NO: 50969 - DNA, 25 bp, Homo sapien
gaccgggtcattcagggctcgtcca

SEQ ID NO: 50970 - DNA, 25 bp, Homo sapien
cacctcatctcacccgggagggaga

SEQ ID NO: 50971 - DNA, 25 bp, Homo sapien
agatgagggctctttacggcgaccc

SEQ ID NO: 50972 - DNA, 25 bp, Homo sapien
ggaaactgacatcccatctagagcc

SEQ ID NO: 50973 - DNA, 25 bp, Homo sapien
ggcgtctgaccttgcgcccaggcga

SEQ ID NO: 50974 - DNA, 25 bp, Homo sapien
gctgtaagttgctcgggttcctcta

SEQ ID NO: 50975 - DNA, 25 bp, Homo sapien
tgctgcgctacctggtggtcgccct

SEQ ID NO: 50976 - DNA, 25 bp, Homo sapien
tggaggacccgcctcttggcagcca

SEQ ID NO: 50977 - DNA, 25 bp, Homo sapien
ggacgcctcgtctggttttcacgcc

SEQ ID NO: 50978 - DNA, 25 bp, Homo sapien
aaagccgatcaatcccggaggcgtg

SEQ ID NO: 50979 - DNA, 25 bp, Homo sapien
gcgcggaccagacacaaagccgatc

SEQ ID NO: 50980 - DNA, 25 bp, Homo sapien
ggagccaccttcagacccagagctg

SEQ ID NO: 50981 - DNA, 25 bp, Homo sapien
ccctgggtgtggatgtagtgacccc

SEQ ID NO: 50982 - DNA, 25 bp, Homo sapien
gttgcagaattgaaaacgcgcctca

SEQ ID NO: 50983 - DNA, 25 bp, Homo sapien
accggtagagcaaggccgtgcacac

SEQ ID NO: 50984 - DNA, 25 bp, Homo sapien
gaatgcactaattcccgaagatatc

SEQ ID NO: 50985 - DNA, 25 bp, Homo sapien
cccgtgtttcacaagaatgcactaa

SEQ ID NO: 50986 - DNA, 25 bp, Homo sapien
ccttcagacccagagctgaagcagg

SEQ ID NO: 50987 - DNA, 25 bp, Homo sapien
attcccgaagatatccgggcgcacg

SEQ ID NO: 50988 - DNA, 25 bp, Homo sapien
agccgcgacttgaatcgcatgggtc

SEQ ID NO: 50989 - DNA, 25 bp, Homo sapien
ccggtagtgccctcggaagccgcat

SEQ ID NO: 50990 - DNA, 25 bp, Homo sapien
tgccagcgctgagcgttcacctggt

SEQ ID NO: 50991 - DNA, 25 bp, Homo sapien
cgagttctgatggagttgctttttc

SEQ ID NO: 50992 - DNA, 25 bp, Homo sapien
aatcgcatgggtcacggaggccacg

SEQ ID NO: 50993 - DNA, 25 bp, Homo sapien
aagccgcatgtgctggaggcacgtt

SEQ ID NO: 50994 - DNA, 25 bp, Homo sapien
ttcacctggtgatcaggcgcatccc

SEQ ID NO: 50995 - DNA, 25 bp, Homo sapien
agctggctcggattgcgagttctga

SEQ ID NO: 50996 - DNA, 25 bp, Homo sapien
gggttgtcgcttcccaagccgtgaa

SEQ ID NO: 50997 - DNA, 25 bp, Homo sapien
agctcagatggctggactgcacgta

SEQ ID NO: 50998 - DNA, 25 bp, Homo sapien
aacgcgattgaggtaggtgtcctga

SEQ ID NO: 50999 - DNA, 25 bp, Homo sapien
ctgacggcctgcgtgcactgcgctt

SEQ ID NO: 51000 - DNA, 25 bp, Homo sapien
cccagctgcagacgatctgtgagcg

SEQ ID NO: 51001 - DNA, 25 bp, Homo sapien
acgcgcagatgtgaagtgcgcctgc

SEQ ID NO: 51002 - DNA, 25 bp, Homo sapien
gcgattggggacgagctccacacat

SEQ ID NO: 51003 - DNA, 25 bp, Homo sapien
ttcccaagccgtgaatggcccaaac

SEQ ID NO: 51004 - DNA, 25 bp, Homo sapien
tggcgcccgcgtacaatgagtcgca

SEQ ID NO: 51005 - DNA, 25 bp, Homo sapien
ctcagggtcggtaaaatagcagtgc

SEQ ID NO: 51006 - DNA, 25 bp, Homo sapien
gtcttgttgagcaccctgcacgtgg

SEQ ID NO: 51007 - DNA, 25 bp, Homo sapien
cctctgagtgtgctgacttgtgacc

SEQ ID NO: 51008 - DNA, 25 bp, Homo sapien
caatatcccgtgaattgcgtggggc

SEQ ID NO: 51009 - DNA, 25 bp, Homo sapien
gtcgcagacagcacagacgggagta

SEQ ID NO: 51010 - DNA, 25 bp, Homo sapien
cgggagtagggcagaatagacaata

SEQ ID NO: 51011 - DNA, 25 bp, Homo sapien
accggtgactccatggtcttgttga

SEQ ID NO: 51012 - DNA, 25 bp, Homo sapien
gcgagctgcgcttcgacatcaggaa

SEQ ID NO: 51013 - DNA, 25 bp, Homo sapien
gcttcacggcctggtttagcgtcca

SEQ ID NO: 51014 - DNA, 25 bp, Homo sapien
ttagcgtccacttccagagcctgca

SEQ ID NO: 51015 - DNA, 25 bp, Homo sapien
ttccctccgtgaatccctgtctgtg

SEQ ID NO: 51016 - DNA, 25 bp, Homo sapien
gttcgttctgctgtggaaaggccca

SEQ ID NO: 51017 - DNA, 25 bp, Homo sapien
ctctgaactcacgatgcgggttttg

SEQ ID NO: 51018 - DNA, 25 bp, Homo sapien
tccttaactggaagagctgagcgcc

SEQ ID NO: 51019 - DNA, 25 bp, Homo sapien
cacgcgtgccttgtcatctgcttga

SEQ ID NO: 51020 - DNA, 25 bp, Homo sapien
ggtgtctgcctctcacttaggtatt

SEQ ID NO: 51021 - DNA, 25 bp, Homo sapien
ccgtgtgtccttcgagccacaaaaa

SEQ ID NO: 51022 - DNA, 25 bp, Homo sapien
cggcgctcgcaagtggtcagcataa

SEQ ID NO: 51023 - DNA, 25 bp, Homo sapien
gtcctccgtgagcaaagagctcctc

SEQ ID NO: 51024 - DNA, 25 bp, Homo sapien
cttttgcaaatacccgctgcgcttg

SEQ ID NO: 51025 - DNA, 25 bp, Homo sapien
actggtttccttatccgcaggtgtg

SEQ ID NO: 51026 - DNA, 25 bp, Homo sapien
ttcctatagcaaccagcgggacctg

SEQ ID NO: 51027 - DNA, 25 bp, Homo sapien
tctcctggaggactgtgttcagaca

SEQ ID NO: 51028 - DNA, 25 bp, Homo sapien
ctggagtcccaaaaggccacgctga

SEQ ID NO: 51029 - DNA, 25 bp, Homo sapien
gcagcccaggcctcgtgaaaaaacc

SEQ ID NO: 51030 - DNA, 25 bp, Homo sapien
tcttacccggagagacgctgcacgt

SEQ ID NO: 51031 - DNA, 25 bp, Homo sapien
tcacacttctagtcgcgggagctgc

SEQ ID NO: 51032 - DNA, 25 bp, Homo sapien
gcaatgcattatgggccgccgtttc

SEQ ID NO: 51033 - DNA, 25 bp, Homo sapien
cgcatgcgctctttgagtggccttt

SEQ ID NO: 51034 - DNA, 25 bp, Homo sapien
cagcgtcctgttcgttagggttatc

SEQ ID NO: 51035 - DNA, 25 bp, Homo sapien
cgttgtgcttccttgtacctcgtga

SEQ ID NO: 51036 - DNA, 25 bp, Homo sapien
aaagcgaggggctcctagcttcctg

SEQ ID NO: 51037 - DNA, 25 bp, Homo sapien
cctaccgctgccgaggaaactgacg

SEQ ID NO: 51038 - DNA, 25 bp, Homo sapien
caggagcagtgccaaaccgggcagc

SEQ ID NO: 51039 - DNA, 25 bp, Homo sapien
ccagcagccgcgaaaagaggttgga

SEQ ID NO: 51040 - DNA, 25 bp, Homo sapien
cgcggacatgcacaaagtttgcctg

SEQ ID NO: 51041 - DNA, 25 bp, Homo sapien
cgattcaagagcgaaggactggctt

SEQ ID NO: 51042 - DNA, 25 bp, Homo sapien
ccggcttctctgcattaaagacttg

SEQ ID NO: 51043 - DNA, 25 bp, Homo sapien
tcagagccaggcgagtcagctgatc

SEQ ID NO: 51044 - DNA, 25 bp, Homo sapien
tcactgacctgcgtagacaaagagc

SEQ ID NO: 51045 - DNA, 25 bp, Homo sapien
ggccattgcctagggagccttccaa

SEQ ID NO: 51046 - DNA, 25 bp, Homo sapien
agagcaggaccaacttcggaagcaa

SEQ ID NO: 51047 - DNA, 25 bp, Homo sapien
ggctcacatttcatctccgcgggtg

SEQ ID NO: 51048 - DNA, 25 bp, Homo sapien
ttctgcaaaggtcccggtccgtcca

SEQ ID NO: 51049 - DNA, 25 bp, Homo sapien
gcagaagcgtctgcaaaggtccttc

SEQ ID NO: 51050 - DNA, 25 bp, Homo sapien
ctgccgtcgcctcgcggaaaaggca

SEQ ID NO: 51051 - DNA, 25 bp, Homo sapien
gcgtccatccaagccggtggcctga

SEQ ID NO: 51052 - DNA, 25 bp, Homo sapien
ggcctgctctggattgttaaaatta

SEQ ID NO: 51053 - DNA, 25 bp, Homo sapien
gcagccgagcggtccttttatagtg

SEQ ID NO: 51054 - DNA, 25 bp, Homo sapien
ccgctttccagcgagtgcaagaacc

SEQ ID NO: 51055 - DNA, 25 bp, Homo sapien
ccttggctgcgatgttgctcactct

SEQ ID NO: 51056 - DNA, 25 bp, Homo sapien
ttccagcgcaaagttggagacactg

SEQ ID NO: 51057 - DNA, 25 bp, Homo sapien
tcactaaaaggaggcgctgcagttc

SEQ ID NO: 51058 - DNA, 25 bp, Homo sapien
gctacagccgaagctcccggagtca

SEQ ID NO: 51059 - DNA, 25 bp, Homo sapien
ctattattcgttggaagggcgcgca

SEQ ID NO: 51060 - DNA, 25 bp, Homo sapien
ccgcagctgtacagggcccagtggt

SEQ ID NO: 51061 - DNA, 25 bp, Homo sapien
ctaagtcaggcagtgggacctcagt

SEQ ID NO: 51062 - DNA, 25 bp, Homo sapien
gcaaagcctcgtcgccgcagctgta

SEQ ID NO: 51063 - DNA, 25 bp, Homo sapien
aagggcgatgtactcggcgatgctc

SEQ ID NO: 51064 - DNA, 25 bp, Homo sapien
ctcccaggtctgctgagttgcgcat

SEQ ID NO: 51065 - DNA, 25 bp, Homo sapien
gttgcctaacggttctgctcagctg

SEQ ID NO: 51066 - DNA, 25 bp, Homo sapien
aggctggagtgtccaaaagcttggc

SEQ ID NO: 51067 - DNA, 25 bp, Homo sapien
acctgcacgccgtgctgggcgaagc

SEQ ID NO: 51068 - DNA, 25 bp, Homo sapien
gcctgtttgggacatgcactccctg

SEQ ID NO: 51069 - DNA, 25 bp, Homo sapien
ctgatttgctgtggaggcctgtttg

SEQ ID NO: 51070 - DNA, 25 bp, Homo sapien
gtcttgagtgtcacttcggtgggca

SEQ ID NO: 51071 - DNA, 25 bp, Homo sapien
tggagtcagtcttgagtgtcacttc

SEQ ID NO: 51072 - DNA, 25 bp, Homo sapien
tgtcagaggacaggccacaggctgc

SEQ ID NO: 51073 - DNA, 25 bp, Homo sapien
taacccgcaggattgtcagaggaca

SEQ ID NO: 51074 - DNA, 25 bp, Homo sapien
tctcagagctgctgtttaacccgca

SEQ ID NO: 51075 - DNA, 25 bp, Homo sapien
ttctgggataggctgatttgctgtg

SEQ ID NO: 51076 - DNA, 25 bp, Homo sapien
ggccacggacgatgccaaagccctt

SEQ ID NO: 51077 - DNA, 25 bp, Homo sapien
aagcccttcgcagcagccttggcag

SEQ ID NO: 51078 - DNA, 25 bp, Homo sapien
ggctttcatcacttcgccatctgcg

SEQ ID NO: 51079 - DNA, 25 bp, Homo sapien
gcacaccaacgctgagactgacact

SEQ ID NO: 51080 - DNA, 25 bp, Homo sapien
gccgccaaccggcagagctagcaga

SEQ ID NO: 51081 - DNA, 25 bp, Homo sapien
cgcgctcagagccattgacgagtaa

SEQ ID NO: 51082 - DNA, 25 bp, Homo sapien
ccacacaaggcgatgcaggctcagc

SEQ ID NO: 51083 - DNA, 25 bp, Homo sapien
caggctgtgaaatgaacacttctcc

SEQ ID NO: 51084 - DNA, 25 bp, Homo sapien
ccagcgtcgcagaaacggccaggaa

SEQ ID NO: 51085 - DNA, 25 bp, Homo sapien
caagccctaggccagcgtcgcagaa

SEQ ID NO: 51086 - DNA, 25 bp, Homo sapien
cctaggccagcgtcgcagaaacggc

SEQ ID NO: 51087 - DNA, 25 bp, Homo sapien
gaaaaggctatatccgcgttacgaa

SEQ ID NO: 51088 - DNA, 25 bp, Homo sapien
gcgtcgcagaaacggccaggaaccc

SEQ ID NO: 51089 - DNA, 25 bp, Homo sapien
cagcagcgatcgctggggctagcaa

SEQ ID NO: 51090 - DNA, 25 bp, Homo sapien
cactcaacagcagctgcaagcccta

SEQ ID NO: 51091 - DNA, 25 bp, Homo sapien
taccaggaagggaaaaggctatatc

SEQ ID NO: 51092 - DNA, 25 bp, Homo sapien
tcggatagtggagattcagcaaata

SEQ ID NO: 51093 - DNA, 25 bp, Homo sapien
gtgccagcgtgcgaacttttctttg

SEQ ID NO: 51094 - DNA, 25 bp, Homo sapien
cacacttgcttgcaggattgagtca

SEQ ID NO: 51095 - DNA, 25 bp, Homo sapien
cgcgactgggactttatgggtattt

SEQ ID NO: 51096 - DNA, 25 bp, Homo sapien
ggacgcccacccgagcagcatagtg

SEQ ID NO: 51097 - DNA, 25 bp, Homo sapien
cccggctttatcctgggcaggtgtc

SEQ ID NO: 51098 - DNA, 25 bp, Homo sapien
aggcacgatcgctgtttcaagaaaa

SEQ ID NO: 51099 - DNA, 25 bp, Homo sapien
gttcgtcactgcacgctgcctctta

SEQ ID NO: 51100 - DNA, 25 bp, Homo sapien
ggtcatgagctcagtggcgtcgtcc

SEQ ID NO: 51101 - DNA, 25 bp, Homo sapien
caactgtccgagaagctaggggagc

SEQ ID NO: 51102 - DNA, 25 bp, Homo sapien
catgagctcagtggcgtcgtccctg

SEQ ID NO: 51103 - DNA, 25 bp, Homo sapien
gcacacagggcgcaactgtccgaga

SEQ ID NO: 51104 - DNA, 25 bp, Homo sapien
aaaaggcttacaccgactgggcagc

SEQ ID NO: 51105 - DNA, 25 bp, Homo sapien
cagggcgcaactgtccgagaagcta

SEQ ID NO: 51106 - DNA, 25 bp, Homo sapien
ggaaaaggcttacaccgactgggca

SEQ ID NO: 51107 - DNA, 25 bp, Homo sapien
cgcgcgcggaaaaggcttacaccga

SEQ ID NO: 51108 - DNA, 25 bp, Homo sapien
accctcatgcgcaggcctaggagtg

SEQ ID NO: 51109 - DNA, 25 bp, Homo sapien
cttcttcagaaagccgcaacccttt

SEQ ID NO: 51110 - DNA, 25 bp, Homo sapien
tgcctccagcgcgttcaaaagcaga

SEQ ID NO: 51111 - DNA, 25 bp, Homo sapien
tcaaaagcagaaacgtgtcctccgc

SEQ ID NO: 51112 - DNA, 25 bp, Homo sapien
gctcgtacacgtcgctgaaggcgcc

SEQ ID NO: 51113 - DNA, 25 bp, Homo sapien
tgccatagtccttcgctgcgttcca

SEQ ID NO: 51114 - DNA, 25 bp, Homo sapien
tggaacggcgtagcgaagttctccc

SEQ ID NO: 51115 - DNA, 25 bp, Homo sapien
ctcagggcggtgatagtcaccgttc

SEQ ID NO: 51116 - DNA, 25 bp, Homo sapien
ttcttcccgcccatggtcgcggttg

SEQ ID NO: 51117 - DNA, 25 bp, Homo sapien
cgccaccggagacgtcacagctaaa

SEQ ID NO: 51118 - DNA, 25 bp, Homo sapien
cggcggaagaggacaccctgtaata

SEQ ID NO: 51119 - DNA, 25 bp, Homo sapien
gggacacaacttccggcttctggcg

SEQ ID NO: 51120 - DNA, 25 bp, Homo sapien
tgcagctgtactctgagcactcaga

SEQ ID NO: 51121 - DNA, 25 bp, Homo sapien
ccctttagttcgctgcttgttcttc

SEQ ID NO: 51122 - DNA, 25 bp, Homo sapien
cctcaggttccctttagttcgctgc

SEQ ID NO: 51123 - DNA, 25 bp, Homo sapien
cggttgacacgtccgggacacaact

SEQ ID NO: 51124 - DNA, 25 bp, Homo sapien
cacgcgcgaagcatagcgagcttca

SEQ ID NO: 51125 - DNA, 25 bp, Homo sapien
ggggtcggaagctattgccgaaatc

SEQ ID NO: 51126 - DNA, 25 bp, Homo sapien
tgccgaaatccgaaacgcagcgctc

SEQ ID NO: 51127 - DNA, 25 bp, Homo sapien
agtgacgcgacctgctcataagtcc

SEQ ID NO: 51128 - DNA, 25 bp, Homo sapien
gtgctcacagcatcccggcaactta

SEQ ID NO: 51129 - DNA, 25 bp, Homo sapien
ccggcaacttacgagctagtgcttc

SEQ ID NO: 51130 - DNA, 25 bp, Homo sapien
ctccgcactcttaggctgcgtgtga

SEQ ID NO: 51131 - DNA, 25 bp, Homo sapien
cagcttaggactcaagcccggggtc

SEQ ID NO: 51132 - DNA, 25 bp, Homo sapien
ctagcatactgcgacccaaaactta

SEQ ID NO: 51133 - DNA, 25 bp, Homo sapien
ctcagctggcgacctaccggaaaaa

SEQ ID NO: 51134 - DNA, 25 bp, Homo sapien
ggacagctcaattttcatcagaagg

SEQ ID NO: 51135 - DNA, 25 bp, Homo sapien
taacccgggttccatggctgcatgg

SEQ ID NO: 51136 - DNA, 25 bp, Homo sapien
ctagctgaggcgagactcaccttga

SEQ ID NO: 51137 - DNA, 25 bp, Homo sapien
gccaagacgctctcaggaagaaagc

SEQ ID NO: 51138 - DNA, 25 bp, Homo sapien
gggagcctcaaaattctagcatact

SEQ ID NO: 51139 - DNA, 25 bp, Homo sapien
ggcacgttcccaaagggttgcactg

SEQ ID NO: 51140 - DNA, 25 bp, Homo sapien
tccggtactgcgatctcattggctg

SEQ ID NO: 51141 - DNA, 25 bp, Homo sapien
gaaggccgctctccttaagcacgta

SEQ ID NO: 51142 - DNA, 25 bp, Homo sapien
cgtcgctctcaattcgtcaccagga

SEQ ID NO: 51143 - DNA, 25 bp, Homo sapien
ttattgctttccaggggtcactctg

SEQ ID NO: 51144 - DNA, 25 bp, Homo sapien
tgccgcgttccggaagttattgctt

SEQ ID NO: 51145 - DNA, 25 bp, Homo sapien
tttactagcgtcagagccgatggtc

SEQ ID NO: 51146 - DNA, 25 bp, Homo sapien
gctggccaatgagatgccgctgctg

SEQ ID NO: 51147 - DNA, 25 bp, Homo sapien
ggtggcctagccacttcccataatg

SEQ ID NO: 51148 - DNA, 25 bp, Homo sapien
tgccgccaggtctgaagcatcgcga

SEQ ID NO: 51149 - DNA, 25 bp, Homo sapien
agtctgtgctctctgaccgtagtca

SEQ ID NO: 51150 - DNA, 25 bp, Homo sapien
cgacgtcgcagttctcaagacaatt

SEQ ID NO: 51151 - DNA, 25 bp, Homo sapien
tgtacaatgtcgatcgtgccgccga

SEQ ID NO: 51152 - DNA, 25 bp, Homo sapien
gggcagcacgctcagcccgttagta

SEQ ID NO: 51153 - DNA, 25 bp, Homo sapien
caggaagcagttcacgcgaccgctc

SEQ ID NO: 51154 - DNA, 25 bp, Homo sapien
tgtggccagaaccaagctgacgatc

SEQ ID NO: 51155 - DNA, 25 bp, Homo sapien
agcatcgcgagaagagcaacctctg

SEQ ID NO: 51156 - DNA, 25 bp, Homo sapien
ctgaattagggcgtcctgcagctcc

SEQ ID NO: 51157 - DNA, 25 bp, Homo sapien
ttccgttccgccctcagaagggaga

SEQ ID NO: 51158 - DNA, 25 bp, Homo sapien
gctcgttcgctgacagaggcttcga

SEQ ID NO: 51159 - DNA, 25 bp, Homo sapien
gcgctctcgcttcagtcagtcgggc

SEQ ID NO: 51160 - DNA, 25 bp, Homo sapien
tgcactgccggagctgttgtttacc

SEQ ID NO: 51161 - DNA, 25 bp, Homo sapien
tcgcgtctactcagcccggtggctg

SEQ ID NO: 51162 - DNA, 25 bp, Homo sapien
tcctcgagtgggagtcagttcagga

SEQ ID NO: 51163 - DNA, 25 bp, Homo sapien
aaggagtgagtcacctgaccgctgc

SEQ ID NO: 51164 - DNA, 25 bp, Homo sapien
gtggtcagtacccaggcctagcacc

SEQ ID NO: 51165 - DNA, 25 bp, Homo sapien
acgtcgcccaggatccagagtggcc

SEQ ID NO: 51166 - DNA, 25 bp, Homo sapien
tagtagcggccgatgaagacgtcgc

SEQ ID NO: 51167 - DNA, 25 bp, Homo sapien
aacacagtgtagtagcggccgatga

SEQ ID NO: 51168 - DNA, 25 bp, Homo sapien
tgttgtcacggtcaaacacagtgta

SEQ ID NO: 51169 - DNA, 25 bp, Homo sapien
cgaagcccaccctgttgttgtcacg

SEQ ID NO: 51170 - DNA, 25 bp, Homo sapien
gtccatgcccatgaagccgctcagg

SEQ ID NO: 51171 - DNA, 25 bp, Homo sapien
gggactctcctctgtttctgtgctg

SEQ ID NO: 51172 - DNA, 25 bp, Homo sapien
ctccggagcccggtgtgtatcctgg

SEQ ID NO: 51173 - DNA, 25 bp, Homo sapien
aggggcgatgcacactgcccgctgc

SEQ ID NO: 51174 - DNA, 25 bp, Homo sapien
gcagtaggggcgatgcacactgccc

SEQ ID NO: 51175 - DNA, 25 bp, Homo sapien
caagcccggtgtggggactccagcc

SEQ ID NO: 51176 - DNA, 25 bp, Homo sapien
cctcaagcccggtgtggggactcca

SEQ ID NO: 51177 - DNA, 25 bp, Homo sapien
tatcctggtcatggggacgcccacc

SEQ ID NO: 51178 - DNA, 25 bp, Homo sapien
ctgcacagcctttcgccgcacatcc

SEQ ID NO: 51179 - DNA, 25 bp, Homo sapien
agcccggtgtgtatcctggtcatgg

SEQ ID NO: 51180 - DNA, 25 bp, Homo sapien
ggggctcactcaccgatcctgagta

SEQ ID NO: 51181 - DNA, 25 bp, Homo sapien
atcctctctggatgctccggttcca

SEQ ID NO: 51182 - DNA, 25 bp, Homo sapien
tcagtgctgtcgctagcccatcacg

SEQ ID NO: 51183 - DNA, 25 bp, Homo sapien
attcatgccgagatacagccgctgc

SEQ ID NO: 51184 - DNA, 25 bp, Homo sapien
cccttttttgtgtagcctcccatga

SEQ ID NO: 51185 - DNA, 25 bp, Homo sapien
ccgcgttcctggagcccagattgaa

SEQ ID NO: 51186 - DNA, 25 bp, Homo sapien
ctcgcgatcccttgcccagagtagg

SEQ ID NO: 51187 - DNA, 25 bp, Homo sapien
ggacgcccgagagatgcacccaact

SEQ ID NO: 51188 - DNA, 25 bp, Homo sapien
accgtgccctgtgcggcggtcagca

SEQ ID NO: 51189 - DNA, 25 bp, Homo sapien
agctcccgccggaagttctcgtaca

SEQ ID NO: 51190 - DNA, 25 bp, Homo sapien
cgctgttggtggtgctcatctccag

SEQ ID NO: 51191 - DNA, 25 bp, Homo sapien
ctctcgctgttggtggtgctcatct

SEQ ID NO: 51192 - DNA, 25 bp, Homo sapien
ctcctccaggctctcgctgttggtg

SEQ ID NO: 51193 - DNA, 25 bp, Homo sapien
tgctctgctcatcgctgtgcgccga

SEQ ID NO: 51194 - DNA, 25 bp, Homo sapien
atgtccgactggcccggagagctca

SEQ ID NO: 51195 - DNA, 25 bp, Homo sapien
gcggtcagcaggatgtccgactggc

SEQ ID NO: 51196 - DNA, 25 bp, Homo sapien
tgatcctcgcttacagaagtcaagg

SEQ ID NO: 51197 - DNA, 25 bp, Homo sapien
ttcgccggtggaaagaatcgatttc

SEQ ID NO: 51198 - DNA, 25 bp, Homo sapien
ctcgttcagagccacattcggctgc

SEQ ID NO: 51199 - DNA, 25 bp, Homo sapien
ggggctctcacctatcctcgttcag

SEQ ID NO: 51200 - DNA, 25 bp, Homo sapien
agacgcgcttgctcgttctgggaag

SEQ ID NO: 51201 - DNA, 25 bp, Homo sapien
cgaatctctttaccctggagccaga

SEQ ID NO: 51202 - DNA, 25 bp, Homo sapien
gctgctcaacaaggcgcgcacgttt

SEQ ID NO: 51203 - DNA, 25 bp, Homo sapien
cctgaccacccgacacaaagagatt

SEQ ID NO: 51204 - DNA, 25 bp, Homo sapien
cccggatgaggcattgtctgcgcac

SEQ ID NO: 51205 - DNA, 25 bp, Homo sapien
agtcagggaccgagacgcaaacata

SEQ ID NO: 51206 - DNA, 25 bp, Homo sapien
ataaaatacaaagtgccgcggccgc

SEQ ID NO: 51207 - DNA, 25 bp, Homo sapien
tgccgacgtccggacgctgtcattt

SEQ ID NO: 51208 - DNA, 25 bp, Homo sapien
ctgtcatttccatccagcgaaggca

SEQ ID NO: 51209 - DNA, 25 bp, Homo sapien
acaatacgtggaaagcccgatcggg

SEQ ID NO: 51210 - DNA, 25 bp, Homo sapien
aacccgctcgtggtctgccaatcgg

SEQ ID NO: 51211 - DNA, 25 bp, Homo sapien
gcgcacccgcaggattccgctttta

SEQ ID NO: 51212 - DNA, 25 bp, Homo sapien
tttctccacatttcggggttctgga

SEQ ID NO: 51213 - DNA, 25 bp, Homo sapien
ctggcctataaagtagtcgcggaga

SEQ ID NO: 51214 - DNA, 25 bp, Homo sapien
tgcgtcgtagtctcctgcagcgtct

SEQ ID NO: 51215 - DNA, 25 bp, Homo sapien
cagggcatcatcaatttcgagcaga

SEQ ID NO: 51216 - DNA, 25 bp, Homo sapien
tccgttgcagtcctcggaaccagga

SEQ ID NO: 51217 - DNA, 25 bp, Homo sapien
ctagcgagttatggcgacgaaggcc

SEQ ID NO: 51218 - DNA, 25 bp, Homo sapien
cttgcttggccgtgttctcgttcct

SEQ ID NO: 51219 - DNA, 25 bp, Homo sapien
tgcggtgcccaagtgctgagtcacc

SEQ ID NO: 51220 - DNA, 25 bp, Homo sapien
tgcgctctgcgtctcgctgacacgg

SEQ ID NO: 51221 - DNA, 25 bp, Homo sapien
cctctcagtcccgttcgcaggatga

SEQ ID NO: 51222 - DNA, 25 bp, Homo sapien
cgttgacggcgtccatgttcgcgct

SEQ ID NO: 51223 - DNA, 25 bp, Homo sapien
cccgttcgcaggatgaggaaaagga

SEQ ID NO: 51224 - DNA, 25 bp, Homo sapien
ggcagcgctggtcttcaacatgtcc

SEQ ID NO: 51225 - DNA, 25 bp, Homo sapien
tcaacatgtccgtttggtggtggcg

SEQ ID NO: 51226 - DNA, 25 bp, Homo sapien
ggtcagttcccgtggtcgccgcgac

SEQ ID NO: 51227 - DNA, 25 bp, Homo sapien
cttacctcctggttgaaggcgttga

SEQ ID NO: 51228 - DNA, 25 bp, Homo sapien
tccagcgagggtcgagtttgactgt

SEQ ID NO: 51229 - DNA, 25 bp, Homo sapien
gacttccagcaccacaagcgcgtgg

SEQ ID NO: 51230 - DNA, 25 bp, Homo sapien
gtgggcaactacctcatcggcagca

SEQ ID NO: 51231 - DNA, 25 bp, Homo sapien
ctgcgagggaagtttcctgcctgcc

SEQ ID NO: 51232 - DNA, 25 bp, Homo sapien
tgggcagccgctattgtctacgcgc

SEQ ID NO: 51233 - DNA, 25 bp, Homo sapien
gggcgactgtcattagcttcctgga

SEQ ID NO: 51234 - DNA, 25 bp, Homo sapien
cccgcgagcggattaaatttctgca

SEQ ID NO: 51235 - DNA, 25 bp, Homo sapien
agtggagctcgcatctgttcccgcc

SEQ ID NO: 51236 - DNA, 25 bp, Homo sapien
ccttggccaagcgtgatagtcactg

SEQ ID NO: 51237 - DNA, 25 bp, Homo sapien
accgacgcgtcttcgctcatggagc

SEQ ID NO: 51238 - DNA, 25 bp, Homo sapien
cggctcgacccaactgacagcgaag

SEQ ID NO: 51239 - DNA, 25 bp, Homo sapien
ggctcgagtcttcggagagtctctt

SEQ ID NO: 51240 - DNA, 25 bp, Homo sapien
tctcttgcccaacagcgaggagtcg

SEQ ID NO: 51241 - DNA, 25 bp, Homo sapien
aggagtcgctgcatttgcccttgtc

SEQ ID NO: 51242 - DNA, 25 bp, Homo sapien
ctcagtgaccgaacgcctgccatta

SEQ ID NO: 51243 - DNA, 25 bp, Homo sapien
aagcaggatgcagttggtgtcctcc

SEQ ID NO: 51244 - DNA, 25 bp, Homo sapien
gggcgtcacacgtcctatgtcggat

SEQ ID NO: 51245 - DNA, 25 bp, Homo sapien
ggggcgtcacacgtcctatgtcgga

SEQ ID NO: 51246 - DNA, 25 bp, Homo sapien
gcgtcctatgtcaggggcgtcatgc

SEQ ID NO: 51247 - DNA, 25 bp, Homo sapien
caggggcgtcatgcgtcctatgtcg

SEQ ID NO: 51248 - DNA, 25 bp, Homo sapien
atgtgtcatgcatcctatgtcaggg

SEQ ID NO: 51249 - DNA, 25 bp, Homo sapien
atgtcaggggcgtcatgcgtcctat

SEQ ID NO: 51250 - DNA, 25 bp, Homo sapien
catgcatcctatgtcaggggcgtca

SEQ ID NO: 51251 - DNA, 25 bp, Homo sapien
tcctatgtcagatgtttcacacgtc

SEQ ID NO: 51252 - DNA, 25 bp, Homo sapien
cgcgtcgtatgtcagatgcgtcaca

SEQ ID NO: 51253 - DNA, 25 bp, Homo sapien
cgcgtcctatgtcagatgtcacaca

SEQ ID NO: 51254 - DNA, 25 bp, Homo sapien
acatcctatgtcaggggcgtcacgc

SEQ ID NO: 51255 - DNA, 25 bp, Homo sapien
catgtcagatgcgtcacgtgtccta

SEQ ID NO: 51256 - DNA, 25 bp, Homo sapien
tgtcgggtgtcatgcatcctatgtc

SEQ ID NO: 51257 - DNA, 25 bp, Homo sapien
tcctatgtcagtgtgtcgtgcgtcc

SEQ ID NO: 51258 - DNA, 25 bp, Homo sapien
tcggatatgtcatgcgccctatgtc

SEQ ID NO: 51259 - DNA, 25 bp, Homo sapien
acacgtcttatgtcaggggcgccat

SEQ ID NO: 51260 - DNA, 25 bp, Homo sapien
cagggcggcacaggtgcattccagc

SEQ ID NO: 51261 - DNA, 25 bp, Homo sapien
ggagcgcgaaagtcaccacaggccc

SEQ ID NO: 51262 - DNA, 25 bp, Homo sapien
cctgaggcttcacctgacgagcgcg

SEQ ID NO: 51263 - DNA, 25 bp, Homo sapien
gccgtgcgcttatagccgggatgac

SEQ ID NO: 51264 - DNA, 25 bp, Homo sapien
atgacgccgcagttgggccggatca

SEQ ID NO: 51265 - DNA, 25 bp, Homo sapien
tggaggattcccgtttcggcctggc

SEQ ID NO: 51266 - DNA, 25 bp, Homo sapien
tgtttgcacccggaccggtcacgtg

SEQ ID NO: 51267 - DNA, 25 bp, Homo sapien
cggatcagctgacccgcgtgtttgc

SEQ ID NO: 51268 - DNA, 25 bp, Homo sapien
ttcagctgagccttgaaccgcacgc

SEQ ID NO: 51269 - DNA, 25 bp, Homo sapien
gcacgcccgtgagctcttctttgcg

SEQ ID NO: 51270 - DNA, 25 bp, Homo sapien
tgagctcttctttgcgggcgcgctt

SEQ ID NO: 51271 - DNA, 25 bp, Homo sapien
tttgcgggcgcgcttggctgcaccc

SEQ ID NO: 51272 - DNA, 25 bp, Homo sapien
gcggaagcgcgacggaaacgacaca

SEQ ID NO: 51273 - DNA, 25 bp, Homo sapien
cactggcacagacagcagacacgcg

SEQ ID NO: 51274 - DNA, 25 bp, Homo sapien
gacggaaacgacacacctgagggga

SEQ ID NO: 51275 - DNA, 25 bp, Homo sapien
gcgggtccttcagctgagccttgaa

SEQ ID NO: 51276 - DNA, 25 bp, Homo sapien
agcttgacgccgttgttcctcctgg

SEQ ID NO: 51277 - DNA, 25 bp, Homo sapien
ccagagcttggggtgatctcaggcc

SEQ ID NO: 51278 - DNA, 25 bp, Homo sapien
cacccagagcttggggtgatctcag

SEQ ID NO: 51279 - DNA, 25 bp, Homo sapien
gcacccagagcttggggtgatctca

SEQ ID NO: 51280 - DNA, 25 bp, Homo sapien
aaggcacccagagcttggggtgatc

SEQ ID NO: 51281 - DNA, 25 bp, Homo sapien
caggccaaagactttcctccaaact

SEQ ID NO: 51282 - DNA, 25 bp, Homo sapien
gcttgacgccgttgttcctcctgga

SEQ ID NO: 51283 - DNA, 25 bp, Homo sapien
catcaggccaaagactttcctccaa

SEQ ID NO: 51284 - DNA, 25 bp, Homo sapien
ctggcctggccgatccacgaagact

SEQ ID NO: 51285 - DNA, 25 bp, Homo sapien
gcacaatgagtagttcttgacccga

SEQ ID NO: 51286 - DNA, 25 bp, Homo sapien
ttcttgacccgaggtcgccctgaag

SEQ ID NO: 51287 - DNA, 25 bp, Homo sapien
cggcgcgtccaagcagcacaatgag

SEQ ID NO: 51288 - DNA, 25 bp, Homo sapien
gccggaagaactcccagacctttca

SEQ ID NO: 51289 - DNA, 25 bp, Homo sapien
atcccagtggctcttcgggtgctct

SEQ ID NO: 51290 - DNA, 25 bp, Homo sapien
ggggcgagcggacactccacgacac

SEQ ID NO: 51291 - DNA, 25 bp, Homo sapien
cggggcgcatttctgatcccagtgg

SEQ ID NO: 51292 - DNA, 25 bp, Homo sapien
ataactgtatgtgccgggtgactgc

SEQ ID NO: 51293 - DNA, 25 bp, Homo sapien
gcactgtcctggtctgctccaaaga

SEQ ID NO: 51294 - DNA, 25 bp, Homo sapien
acggcggcaacggagatttcctctc

SEQ ID NO: 51295 - DNA, 25 bp, Homo sapien
tcctctcggggaaactacgcggatc

SEQ ID NO: 51296 - DNA, 25 bp, Homo sapien
cggagccatctgaccggttttgaga

SEQ ID NO: 51297 - DNA, 25 bp, Homo sapien
cttctgtggaatggcgataactgta

SEQ ID NO: 51298 - DNA, 25 bp, Homo sapien
ctggctccaaagtgcgtcacgggca

SEQ ID NO: 51299 - DNA, 25 bp, Homo sapien
tttgagacctccagctcgtcgccgt

SEQ ID NO: 51300 - DNA, 25 bp, Homo sapien
agatgtactgtgagcggctttgtgc

SEQ ID NO: 51301 - DNA, 25 bp, Homo sapien
tgagcgcgttaacttcagagatgta

SEQ ID NO: 51302 - DNA, 25 bp, Homo sapien
tggcacggcacaggttgaaaagtta

SEQ ID NO: 51303 - DNA, 25 bp, Homo sapien
tgacccagtttgtggcacggcacag

SEQ ID NO: 51304 - DNA, 25 bp, Homo sapien
cgtctgcctggatgatgtgtgcaca

SEQ ID NO: 51305 - DNA, 25 bp, Homo sapien
tctgttggacagactcacgggaccg

SEQ ID NO: 51306 - DNA, 25 bp, Homo sapien
gcagcgcgaacacagactcggcctt

SEQ ID NO: 51307 - DNA, 25 bp, Homo sapien
acggaaggaactcacatccactggc

SEQ ID NO: 51308 - DNA, 25 bp, Homo sapien
ttgagccgcccattatagacccggg

SEQ ID NO: 51309 - DNA, 25 bp, Homo sapien
cggcagcgacccagaactgagtctt

SEQ ID NO: 51310 - DNA, 25 bp, Homo sapien
gagcgaccctcccagaaatatccag

SEQ ID NO: 51311 - DNA, 25 bp, Homo sapien
tgtccgcacttcttcgttcaggttg

SEQ ID NO: 51312 - DNA, 25 bp, Homo sapien
tccggcaacgtttccacgctgtttc

SEQ ID NO: 51313 - DNA, 25 bp, Homo sapien
ccttcccggaagtgactgttgtcgc

SEQ ID NO: 51314 - DNA, 25 bp, Homo sapien
gggaaaccacccacacagtctgaga

SEQ ID NO: 51315 - DNA, 25 bp, Homo sapien
ctcccggaagtggatgttgccaaga

SEQ ID NO: 51316 - DNA, 25 bp, Homo sapien
ccgagccaaccaggtggcgcctgaa

SEQ ID NO: 51317 - DNA, 25 bp, Homo sapien
gtccttttgcgtgggctcttcagag

SEQ ID NO: 51318 - DNA, 25 bp, Homo sapien
agagtcacgactcggggcaccgacc

SEQ ID NO: 51319 - DNA, 25 bp, Homo sapien
tccttctcggagagacggaagagcc

SEQ ID NO: 51320 - DNA, 25 bp, Homo sapien
gagcagcccaaaccctccatttatg

SEQ ID NO: 51321 - DNA, 25 bp, Homo sapien
ccatttatgcgccagaagagatacc

SEQ ID NO: 51322 - DNA, 25 bp, Homo sapien
cgataaatacgaatggccacccggg

SEQ ID NO: 51323 - DNA, 25 bp, Homo sapien
agatctggcctccttggtccttttg

SEQ ID NO: 51324 - DNA, 25 bp, Homo sapien
aacgcgtcccttgcccgagcagaag

SEQ ID NO: 51325 - DNA, 25 bp, Homo sapien
tcgagtcctctgttgctaccgcgca

SEQ ID NO: 51326 - DNA, 25 bp, Homo sapien
agctccagccgggtcgagtcctctg

SEQ ID NO: 51327 - DNA, 25 bp, Homo sapien
cggcggtcgaatactcgcttccaca

SEQ ID NO: 51328 - DNA, 25 bp, Homo sapien
gagtcgttccgcttgcgcacgttca

SEQ ID NO: 51329 - DNA, 25 bp, Homo sapien
gcgaggcctcttgcgcggcttcagc

SEQ ID NO: 51330 - DNA, 25 bp, Homo sapien
atgcggccgtctaagggcgtccgaa

SEQ ID NO: 51331 - DNA, 25 bp, Homo sapien
agggcgtccgaagcgcgcactttac

SEQ ID NO: 51332 - DNA, 25 bp, Homo sapien
ttcaggcctacaaacgcatcttctg

SEQ ID NO: 51333 - DNA, 25 bp, Homo sapien
cgtgaatggtctgatgattggaaca

SEQ ID NO: 51334 - DNA, 25 bp, Homo sapien
atggtctgatgattggaacaatccc

SEQ ID NO: 51335 - DNA, 25 bp, Homo sapien
ggctgaggtgaaatctgggtggcat

SEQ ID NO: 51336 - DNA, 25 bp, Homo sapien
aggagaaaagtgacaaagaacgcgg

SEQ ID NO: 51337 - DNA, 25 bp, Homo sapien
tcttctgttccacaccgaggggaca

SEQ ID NO: 51338 - DNA, 25 bp, Homo sapien
acgcatcttctgttccacaccgagg

SEQ ID NO: 51339 - DNA, 25 bp, Homo sapien
ccgattcaggcctacaaacgcatct

SEQ ID NO: 51340 - DNA, 25 bp, Homo sapien
gtggagcgccctatccaggtgcgcc

SEQ ID NO: 51341 - DNA, 25 bp, Homo sapien
gcgggctgaacccatccggcacaaa

SEQ ID NO: 51342 - DNA, 25 bp, Homo sapien
cctcacacctgggagtttgcggcgc

SEQ ID NO: 51343 - DNA, 25 bp, Homo sapien
ggagacaccgctcgggagtcctccg

SEQ ID NO: 51344 - DNA, 25 bp, Homo sapien
ccgctcggctgcagaatctttatca

SEQ ID NO: 51345 - DNA, 25 bp, Homo sapien
tttatcagctgcactttaccgcagc

SEQ ID NO: 51346 - DNA, 25 bp, Homo sapien
tctctctggcgtcattcagtcccgg

SEQ ID NO: 51347 - DNA, 25 bp, Homo sapien
atccggcacaaactgcgggccactg

SEQ ID NO: 51348 - DNA, 25 bp, Homo sapien
tacgcagtgacgtctgcccacagtg

SEQ ID NO: 51349 - DNA, 25 bp, Homo sapien
acgtctgcacgcagtgacgtctgcc

SEQ ID NO: 51350 - DNA, 25 bp, Homo sapien
tgcccacagtgacgtctgcacgcag

SEQ ID NO: 51351 - DNA, 25 bp, Homo sapien
tgcagtgatgcctgtacgcagtgac

SEQ ID NO: 51352 - DNA, 25 bp, Homo sapien
cacgcagggcgtttgctcacggcag

SEQ ID NO: 51353 - DNA, 25 bp, Homo sapien
gcctgcacgcagtgacgcctacatg

SEQ ID NO: 51354 - DNA, 25 bp, Homo sapien
tgacgcctacatgcagtgatgcctg

SEQ ID NO: 51355 - DNA, 25 bp, Homo sapien
gcccgcagtgatgcctgtacgcagt

SEQ ID NO: 51356 - DNA, 25 bp, Homo sapien
tccgacgccaagtgagccgactggc

SEQ ID NO: 51357 - DNA, 25 bp, Homo sapien
agtggcttcaagtcatcctcgtcca

SEQ ID NO: 51358 - DNA, 25 bp, Homo sapien
ctgcgtcgtccaccaagaaggacaa

SEQ ID NO: 51359 - DNA, 25 bp, Homo sapien
gctgcagcagctgcgtctcaagatc

SEQ ID NO: 51360 - DNA, 25 bp, Homo sapien
tgcacgacctcaacatcgccatgga

SEQ ID NO: 51361 - DNA, 25 bp, Homo sapien
tccgcgaggtcatgccgtacgcaca

SEQ ID NO: 51362 - DNA, 25 bp, Homo sapien
gctggcgcgcaactacatcctcatg

SEQ ID NO: 51363 - DNA, 25 bp, Homo sapien
ggcctactcaagtctccgtctgctg

SEQ ID NO: 51364 - DNA, 25 bp, Homo sapien
cggggcccattagcctctgcaaatg

SEQ ID NO: 51365 - DNA, 25 bp, Homo sapien
cacgcacccggtcttttgtgggaga

SEQ ID NO: 51366 - DNA, 25 bp, Homo sapien
agagcttccgactttgccttccagg

SEQ ID NO: 51367 - DNA, 25 bp, Homo sapien
ccgagacgcagcctgaatgtgagca

SEQ ID NO: 51368 - DNA, 25 bp, Homo sapien
cttgggcaccgggatctaatttcta

SEQ ID NO: 51369 - DNA, 25 bp, Homo sapien
agaacgtcgttctgtttggcagcca

SEQ ID NO: 51370 - DNA, 25 bp, Homo sapien
agaggtactcagcatccgattggca

SEQ ID NO: 51371 - DNA, 25 bp, Homo sapien
ttccaggctctagactcgcgccatg

SEQ ID NO: 51372 - DNA, 25 bp, Homo sapien
cggccatctcctagacgcgcgagta

SEQ ID NO: 51373 - DNA, 25 bp, Homo sapien
tttccgcgcgcatcccaaaaggtgc

SEQ ID NO: 51374 - DNA, 25 bp, Homo sapien
ctggcgagtttcattgagcggaatt

SEQ ID NO: 51375 - DNA, 25 bp, Homo sapien
cgcgcgagtagagcaccaagatagt

SEQ ID NO: 51376 - DNA, 25 bp, Homo sapien
cgtgcggaaataactcgtccctgta

SEQ ID NO: 51377 - DNA, 25 bp, Homo sapien
tgggacggaaggctctttgctaacc

SEQ ID NO: 51378 - DNA, 25 bp, Homo sapien
gcgccaaatgcccacgtgttgatga

SEQ ID NO: 51379 - DNA, 25 bp, Homo sapien
gcatcgtttacatttggggcgccaa

SEQ ID NO: 51380 - DNA, 25 bp, Homo sapien
gcgggccttcagtttgcaaaccctg

SEQ ID NO: 51381 - DNA, 25 bp, Homo sapien
tgcggccacaatccgtccactggtt

SEQ ID NO: 51382 - DNA, 25 bp, Homo sapien
acccgctacgggcttttgcacatca

SEQ ID NO: 51383 - DNA, 25 bp, Homo sapien
tcactaggaaaagggtcgccaactg

SEQ ID NO: 51384 - DNA, 25 bp, Homo sapien
caagggcctagaactgcaaagcagc

SEQ ID NO: 51385 - DNA, 25 bp, Homo sapien
gactgcttaaggaacccgctctgaa

SEQ ID NO: 51386 - DNA, 25 bp, Homo sapien
agggaccgtcgttagtgccaagaca

SEQ ID NO: 51387 - DNA, 25 bp, Homo sapien
cgcgcgcagttttcctttggcgaca

SEQ ID NO: 51388 - DNA, 25 bp, Homo sapien
gccatagtccaggatgcgaggggct

SEQ ID NO: 51389 - DNA, 25 bp, Homo sapien
tggtgccatagtccaggatgcgagg

SEQ ID NO: 51390 - DNA, 25 bp, Homo sapien
ccatagtccatgacgcagggaggct

SEQ ID NO: 51391 - DNA, 25 bp, Homo sapien
tgccatagtccatgacgcagggagg

SEQ ID NO: 51392 - DNA, 25 bp, Homo sapien
ggtgccatagtccatgacgcaggga

SEQ ID NO: 51393 - DNA, 25 bp, Homo sapien
ctggtgccatagtccatgacgcagg

SEQ ID NO: 51394 - DNA, 25 bp, Homo sapien
ctctggtgccatagtccatgacgca

SEQ ID NO: 51395 - DNA, 25 bp, Homo sapien
gtcctctggtgccatagtccatgac

SEQ ID NO: 51396 - DNA, 25 bp, Homo sapien
cggaagcgcatgcaggacctgaacc

SEQ ID NO: 51397 - DNA, 25 bp, Homo sapien
caactacatcctactgctgggcagc

SEQ ID NO: 51398 - DNA, 25 bp, Homo sapien
ccaagtacctgtcgctggcgctgga

SEQ ID NO: 51399 - DNA, 25 bp, Homo sapien
cgtgcaggcgcaattctccaagtga

SEQ ID NO: 51400 - DNA, 25 bp, Homo sapien
cggttccagcggctttaggcagaaa

SEQ ID NO: 51401 - DNA, 25 bp, Homo sapien
ggcagaaagtgctcgctctcaccca

SEQ ID NO: 51402 - DNA, 25 bp, Homo sapien
ccgatgtagaacttagggcgccttg

SEQ ID NO: 51403 - DNA, 25 bp, Homo sapien
gagcacgccggctcccagtactagg

SEQ ID NO: 51404 - DNA, 25 bp, Homo sapien
tgccactgcaagatgtgagtcgttg

SEQ ID NO: 51405 - DNA, 25 bp, Homo sapien
ttgagggtcacattcctccaggtcc

SEQ ID NO: 51406 - DNA, 25 bp, Homo sapien
ttgcaaaaccggctcaccagctggg

SEQ ID NO: 51407 - DNA, 25 bp, Homo sapien
agaggcgatcggcacttgcatttca

SEQ ID NO: 51408 - DNA, 25 bp, Homo sapien
acctgcgtcagggtcacagactgca

SEQ ID NO: 51409 - DNA, 25 bp, Homo sapien
tccgttacacgcagtagcgagttga

SEQ ID NO: 51410 - DNA, 25 bp, Homo sapien
cgagttgactccatcagcccgttta

SEQ ID NO: 51411 - DNA, 25 bp, Homo sapien
cctctgcgtcttgagtatgcggcta

SEQ ID NO: 51412 - DNA, 25 bp, Homo sapien
atgcaaacgccacggccggctgctg

SEQ ID NO: 51413 - DNA, 25 bp, Homo sapien
gcgcctttcaaagcttgcgaggatc

SEQ ID NO: 51414 - DNA, 25 bp, Homo sapien
tgctgagacgcaactaggctgctgc

SEQ ID NO: 51415 - DNA, 25 bp, Homo sapien
tgctgctgccgtcgattctgtaaca

SEQ ID NO: 51416 - DNA, 25 bp, Homo sapien
tcttcctcgtgtgcatctgccaagc

SEQ ID NO: 51417 - DNA, 25 bp, Homo sapien
ggcgccctgcaagtgacttaagagc

SEQ ID NO: 51418 - DNA, 25 bp, Homo sapien
cctcgggagagaagatgcaaacgcc

SEQ ID NO: 51419 - DNA, 25 bp, Homo sapien
cgcgcccggattacagaccgtctgg

SEQ ID NO: 51420 - DNA, 25 bp, Homo sapien
tcgctctgcacacagcaacggtctg

SEQ ID NO: 51421 - DNA, 25 bp, Homo sapien
ttgccgcgccaaagattaaacccga

SEQ ID NO: 51422 - DNA, 25 bp, Homo sapien
ggctcccagatgatggtcgtcctcc

SEQ ID NO: 51423 - DNA, 25 bp, Homo sapien
ctgcgcgtgcgcgaacatgtaactg

SEQ ID NO: 51424 - DNA, 25 bp, Homo sapien
cctggaatgcgatggtgaagtgctc

SEQ ID NO: 51425 - DNA, 25 bp, Homo sapien
atcctgtgaaggtcaaggcctcctg

SEQ ID NO: 51426 - DNA, 25 bp, Homo sapien
cgccactgtccaagactctagggtc

SEQ ID NO: 51427 - DNA, 25 bp, Homo sapien
actccaaagtcgctgggtctgcgca

SEQ ID NO: 51428 - DNA, 25 bp, Homo sapien
tccgtgaagccggtaacctcggctg

SEQ ID NO: 51429 - DNA, 25 bp, Homo sapien
actggttctgcagcctggcgagact

SEQ ID NO: 51430 - DNA, 25 bp, Homo sapien
ctccagtctccaggacgttccggga

SEQ ID NO: 51431 - DNA, 25 bp, Homo sapien
agcaaattgaatccagggctccggc

SEQ ID NO: 51432 - DNA, 25 bp, Homo sapien
tgggatatgcggagtgctcagatca

SEQ ID NO: 51433 - DNA, 25 bp, Homo sapien
cgaatttctcggaatgaacaacagc

SEQ ID NO: 51434 - DNA, 25 bp, Homo sapien
ggccgcctttgctggccactggttc

SEQ ID NO: 51435 - DNA, 25 bp, Homo sapien
ccatgcgaccgacgctgctgtggtc

SEQ ID NO: 51436 - DNA, 25 bp, Homo sapien
ccaggaacgcaacctgacggcgtga

SEQ ID NO: 51437 - DNA, 25 bp, Homo sapien
tgctccagtgacaatgctctgctgc

SEQ ID NO: 51438 - DNA, 25 bp, Homo sapien
ctcctagcaatggttcggggcaaac

SEQ ID NO: 51439 - DNA, 25 bp, Homo sapien
aggaaggagactgctgcgccacaac

SEQ ID NO: 51440 - DNA, 25 bp, Homo sapien
gtgtgcaccgcagcgaccaatcgga

SEQ ID NO: 51441 - DNA, 25 bp, Homo sapien
ctcgcgaccaatcggcgtgcagcaa

SEQ ID NO: 51442 - DNA, 25 bp, Homo sapien
ccgcctctgtacttgactctcgtaa

SEQ ID NO: 51443 - DNA, 25 bp, Homo sapien
gctctgctgctacttatttaacgga

SEQ ID NO: 51444 - DNA, 25 bp, Homo sapien
caggaaaacggacaatcttccgcca

SEQ ID NO: 51445 - DNA, 25 bp, Homo sapien
ttatcatggcaagggaggtcggtcc

SEQ ID NO: 51446 - DNA, 25 bp, Homo sapien
cggaaggcagaatcgtacctgattg

SEQ ID NO: 51447 - DNA, 25 bp, Homo sapien
atgatgtaaagaccgagttggcggc

SEQ ID NO: 51448 - DNA, 25 bp, Homo sapien
ccgggctagaccatttgccacttta

SEQ ID NO: 51449 - DNA, 25 bp, Homo sapien
ctcacctgcgcagacctggggtagg

SEQ ID NO: 51450 - DNA, 25 bp, Homo sapien
agccggctgcgaaggtggttatcat

SEQ ID NO: 51451 - DNA, 25 bp, Homo sapien
cctgattgggacaggtgaccttacc

SEQ ID NO: 51452 - DNA, 25 bp, Homo sapien
gacagaaagccatatgcacagcacg

SEQ ID NO: 51453 - DNA, 25 bp, Homo sapien
ccagggactggttgcgtgtcccaga

SEQ ID NO: 51454 - DNA, 25 bp, Homo sapien
gtgtcccagaacgtgccaaaagcct

SEQ ID NO: 51455 - DNA, 25 bp, Homo sapien
cgtgccaaaagcctgcctcgtgagc

SEQ ID NO: 51456 - DNA, 25 bp, Homo sapien
tcgtgagcacggcaagagctctgcc

SEQ ID NO: 51457 - DNA, 25 bp, Homo sapien
gctgtcggtggacctgtaggtatca

SEQ ID NO: 51458 - DNA, 25 bp, Homo sapien
ctgtaggtatcagggctccttggtc

SEQ ID NO: 51459 - DNA, 25 bp, Homo sapien
tcggcagcgttgtggttagtgacac

SEQ ID NO: 51460 - DNA, 25 bp, Homo sapien
ggcgcctgcgtcagacactaacatg

SEQ ID NO: 51461 - DNA, 25 bp, Homo sapien
aacactgctggggactgacaactta

SEQ ID NO: 51462 - DNA, 25 bp, Homo sapien
gtgacacgcctgactcctgatgaga

SEQ ID NO: 51463 - DNA, 25 bp, Homo sapien
tgagactaaaatgcaccgggctttg

SEQ ID NO: 51464 - DNA, 25 bp, Homo sapien
ggatgcatatccctgtcgaaactga

SEQ ID NO: 51465 - DNA, 25 bp, Homo sapien
tcgaaactgaacttggcgccacctg

SEQ ID NO: 51466 - DNA, 25 bp, Homo sapien
agagcgcctgaaagccgtgtgttaa

SEQ ID NO: 51467 - DNA, 25 bp, Homo sapien
tttggcacctttcttcggagacgca

SEQ ID NO: 51468 - DNA, 25 bp, Homo sapien
ccttgcctcgaacgcgaggactttc

SEQ ID NO: 51469 - DNA, 25 bp, Homo sapien
tcagcgacgcttctggaaagtatgc

SEQ ID NO: 51470 - DNA, 25 bp, Homo sapien
gccaggggagcgctcttcccacaaa

SEQ ID NO: 51471 - DNA, 25 bp, Homo sapien
gcggccgaagtcttcgcgcccattt

SEQ ID NO: 51472 - DNA, 25 bp, Homo sapien
ctacaagacactcaccgggaccggg

SEQ ID NO: 51473 - DNA, 25 bp, Homo sapien
aaacccggccttgccagaatcgcgg

SEQ ID NO: 51474 - DNA, 25 bp, Homo sapien
ccagagtccagtcgccaggttcagc

SEQ ID NO: 51475 - DNA, 25 bp, Homo sapien
cccttggcggccaggctacaagaca

SEQ ID NO: 51476 - DNA, 25 bp, Homo sapien
ttccagtccttcgtcagagagcccg

SEQ ID NO: 51477 - DNA, 25 bp, Homo sapien
ctcgcgaggctgtccagaacgccat

SEQ ID NO: 51478 - DNA, 25 bp, Homo sapien
ggggcatctctccacctttcgctta

SEQ ID NO: 51479 - DNA, 25 bp, Homo sapien
gactaccaataaatgggcgaagttg

SEQ ID NO: 51480 - DNA, 25 bp, Homo sapien
tttcccaagacacaggacgcgtttc

SEQ ID NO: 51481 - DNA, 25 bp, Homo sapien
aggccgctcgtcactcctgaagggc

SEQ ID NO: 51482 - DNA, 25 bp, Homo sapien
tggcaaccggtctcggaactacatc

SEQ ID NO: 51483 - DNA, 25 bp, Homo sapien
atctcccgtcatgttccgctcgggg

SEQ ID NO: 51484 - DNA, 25 bp, Homo sapien
tgggacggcggtcctgctgtgctgt

SEQ ID NO: 51485 - DNA, 25 bp, Homo sapien
agtccaggacgtagccgaggagtcc

SEQ ID NO: 51486 - DNA, 25 bp, Homo sapien
caggggtagtccagagagcgccgtg

SEQ ID NO: 51487 - DNA, 25 bp, Homo sapien
gacgtagccgaggagtcctccaatg

SEQ ID NO: 51488 - DNA, 25 bp, Homo sapien
gacgcggtggcgcaggggtagtcca

SEQ ID NO: 51489 - DNA, 25 bp, Homo sapien
aggacgtagccgaggagtcctccaa

SEQ ID NO: 51490 - DNA, 25 bp, Homo sapien
caggacgtagccgaggagtcctcca

SEQ ID NO: 51491 - DNA, 25 bp, Homo sapien
gtccaggacgtagccgaggagtcct

SEQ ID NO: 51492 - DNA, 25 bp, Homo sapien
agcgtagcttggttgctccgtagta

SEQ ID NO: 51493 - DNA, 25 bp, Homo sapien
gcgtgagcggcactgatttgtccct

SEQ ID NO: 51494 - DNA, 25 bp, Homo sapien
ttgcagtcccttgcttgcacgaatg

SEQ ID NO: 51495 - DNA, 25 bp, Homo sapien
catttaaaggggagcgtcttccgcg

SEQ ID NO: 51496 - DNA, 25 bp, Homo sapien
ggtgtggacccaagacacaattgca

SEQ ID NO: 51497 - DNA, 25 bp, Homo sapien
cagaatcctgggtcagtgaagggca

SEQ ID NO: 51498 - DNA, 25 bp, Homo sapien
tcgctcgcaagcctgcagaatcctg

SEQ ID NO: 51499 - DNA, 25 bp, Homo sapien
tcttacgcaccgacacggttttgtg

SEQ ID NO: 51500 - DNA, 25 bp, Homo sapien
gcgttggcgtaaccgctaggttctc

SEQ ID NO: 51501 - DNA, 25 bp, Homo sapien
gctgtaggtcaaacccgagtgggaa

SEQ ID NO: 51502 - DNA, 25 bp, Homo sapien
acctgccgggagagcccggacactg

SEQ ID NO: 51503 - DNA, 25 bp, Homo sapien
tcgaggtttggtaccggtcatccca

SEQ ID NO: 51504 - DNA, 25 bp, Homo sapien
atcgcaccctggtgctcgaggtttg

SEQ ID NO: 51505 - DNA, 25 bp, Homo sapien
taaccttgaagactgccagacttcc

SEQ ID NO: 51506 - DNA, 25 bp, Homo sapien
tcgccaggtcccataaccttgaaga

SEQ ID NO: 51507 - DNA, 25 bp, Homo sapien
agacgccaaggttacggcacgcgca

SEQ ID NO: 51508 - DNA, 25 bp, Homo sapien
gtccggcgcagcagtttctaggtcc

SEQ ID NO: 51509 - DNA, 25 bp, Homo sapien
atggaaagttccagccggttcgaga

SEQ ID NO: 51510 - DNA, 25 bp, Homo sapien
atcgcgcctgtgtgtaccaggcacc

SEQ ID NO: 51511 - DNA, 25 bp, Homo sapien
cgtcctcggaggttaacgtgcagta

SEQ ID NO: 51512 - DNA, 25 bp, Homo sapien
acgtgcagtaactcactcgggtccc

SEQ ID NO: 51513 - DNA, 25 bp, Homo sapien
actttcggcacaggcagcaggccca

SEQ ID NO: 51514 - DNA, 25 bp, Homo sapien
gtcagccgcgtcagacctgagagtt

SEQ ID NO: 51515 - DNA, 25 bp, Homo sapien
tcacgcagtgccaagggactgagtc

SEQ ID NO: 51516 - DNA, 25 bp, Homo sapien
gccaatgagacgcaattctgcaaac

SEQ ID NO: 51517 - DNA, 25 bp, Homo sapien
tgcaaactcggctgagcggtggaaa

SEQ ID NO: 51518 - DNA, 25 bp, Homo sapien
ggcgttttgccacgagtcgccgtgc

SEQ ID NO: 51519 - DNA, 25 bp, Homo sapien
gtccaggcgttttgccacgagtcgc

SEQ ID NO: 51520 - DNA, 25 bp, Homo sapien
atcgcgcgctcggaatgccgcagcc

SEQ ID NO: 51521 - DNA, 25 bp, Homo sapien
gcggtggaaaattccatgctctcgg

SEQ ID NO: 51522 - DNA, 25 bp, Homo sapien
cggctgagcggtggaaaattccatg

SEQ ID NO: 51523 - DNA, 25 bp, Homo sapien
gggacagacacctccgctcggccaa

SEQ ID NO: 51524 - DNA, 25 bp, Homo sapien
accctccagctcaggtgagttcaga

SEQ ID NO: 51525 - DNA, 25 bp, Homo sapien
cacccagggaattcgagacagcgga

SEQ ID NO: 51526 - DNA, 25 bp, Homo sapien
ttaagggcacccacgtgtcctcagc

SEQ ID NO: 51527 - DNA, 25 bp, Homo sapien
gaacactgcgtctggaaacttctta

SEQ ID NO: 51528 - DNA, 25 bp, Homo sapien
cacgtagcggtgcatttcgggacct

SEQ ID NO: 51529 - DNA, 25 bp, Homo sapien
aagctctttgggatgctgcgatgtc

SEQ ID NO: 51530 - DNA, 25 bp, Homo sapien
gtcaacccgttgagcagcgtgttcc

SEQ ID NO: 51531 - DNA, 25 bp, Homo sapien
gcgctcgggttttccctcctagaca

SEQ ID NO: 51532 - DNA, 25 bp, Homo sapien
caaggccggcagaaggtttgcatta

SEQ ID NO: 51533 - DNA, 25 bp, Homo sapien
gccgaccaacggacagatctaccta

SEQ ID NO: 51534 - DNA, 25 bp, Homo sapien
tgcattaggatcgagaaagccgacc

SEQ ID NO: 51535 - DNA, 25 bp, Homo sapien
ttttagatcctgtcggagaggctca

SEQ ID NO: 51536 - DNA, 25 bp, Homo sapien
cgcgcgtagggaagcgttttagatc

SEQ ID NO: 51537 - DNA, 25 bp, Homo sapien
ccttctaagggcctgagcgctgcac

SEQ ID NO: 51538 - DNA, 25 bp, Homo sapien
cttacccgggtctgagatgccgaga

SEQ ID NO: 51539 - DNA, 25 bp, Homo sapien
tacctaccttcctgcgggagtttga

SEQ ID NO: 51540 - DNA, 25 bp, Homo sapien
gaggaaacctcattctggggctccc

SEQ ID NO: 51541 - DNA, 25 bp, Homo sapien
caggccgggtgctgccacatcagca

SEQ ID NO: 51542 - DNA, 25 bp, Homo sapien
cggccgcttccgtaatggaggctga

SEQ ID NO: 51543 - DNA, 25 bp, Homo sapien
gggctggctgatctccattcccacg

SEQ ID NO: 51544 - DNA, 25 bp, Homo sapien
ccattcccacggaggggagcaggta

SEQ ID NO: 51545 - DNA, 25 bp, Homo sapien
agcaggtatttccagatgtgcatgc

SEQ ID NO: 51546 - DNA, 25 bp, Homo sapien
tccagatgtgcatgccggagagtcg

SEQ ID NO: 51547 - DNA, 25 bp, Homo sapien
ggggccgcgaggaaacctcattctg

SEQ ID NO: 51548 - DNA, 25 bp, Homo sapien
tccatctcgcagtcaatgaagctcc

SEQ ID NO: 51549 - DNA, 25 bp, Homo sapien
gtcaatgaagctccagtcgccgccg

SEQ ID NO: 51550 - DNA, 25 bp, Homo sapien
tgtcagcagtctcccagcgacacgg

SEQ ID NO: 51551 - DNA, 25 bp, Homo sapien
cggccaccggcagatccaacggtgg

SEQ ID NO: 51552 - DNA, 25 bp, Homo sapien
ggaacggaattctcttcacgtgacc

SEQ ID NO: 51553 - DNA, 25 bp, Homo sapien
ttctcttcacgtgaccttccttctg

SEQ ID NO: 51554 - DNA, 25 bp, Homo sapien
aggccgtccacgaacacgcgcgggt

SEQ ID NO: 51555 - DNA, 25 bp, Homo sapien
gcggcgggctgtcagcagtctccca

SEQ ID NO: 51556 - DNA, 25 bp, Homo sapien
gtgagctcgcctgggacgcagcgga

SEQ ID NO: 51557 - DNA, 25 bp, Homo sapien
aggcaattgaggtcgcagccgggga

SEQ ID NO: 51558 - DNA, 25 bp, Homo sapien
ccaggccgaggcaattgaggtcgca

SEQ ID NO: 51559 - DNA, 25 bp, Homo sapien
ggacagcgtagaagccgaaggcccg

SEQ ID NO: 51560 - DNA, 25 bp, Homo sapien
ggacagcatggacgccgagggtccg

SEQ ID NO: 51561 - DNA, 25 bp, Homo sapien
cagcaatcgggggacggcagcctct

SEQ ID NO: 51562 - DNA, 25 bp, Homo sapien
cccggggacgcaagggcagacgctg

SEQ ID NO: 51563 - DNA, 25 bp, Homo sapien
caagggcagacgctggcgaggacag

SEQ ID NO: 51564 - DNA, 25 bp, Homo sapien
cgagctggcttggaacgggcctccc

SEQ ID NO: 51565 - DNA, 25 bp, Homo sapien
cgggcctgacctacagcgagatcct

SEQ ID NO: 51566 - DNA, 25 bp, Homo sapien
acctacagcgagatcctggccgtcg

SEQ ID NO: 51567 - DNA, 25 bp, Homo sapien
tccaccacgtcgctctggttcggga

SEQ ID NO: 51568 - DNA, 25 bp, Homo sapien
cttggaacgggcctccctgcgcttg

SEQ ID NO: 51569 - DNA, 25 bp, Homo sapien
gagcccatggccgacatgccgatgc

SEQ ID NO: 51570 - DNA, 25 bp, Homo sapien
gccgatgccgatgcccgaggtgacc

SEQ ID NO: 51571 - DNA, 25 bp, Homo sapien
cttgtcgcgaacaggaggcccgcgc

SEQ ID NO: 51572 - DNA, 25 bp, Homo sapien
ccttgaaagcgatgggcagggtctt

SEQ ID NO: 51573 - DNA, 25 bp, Homo sapien
cgagggtcgccacggcaacacagca

SEQ ID NO: 51574 - DNA, 25 bp, Homo sapien
tctccgggccagtaccttgaaagcg

SEQ ID NO: 51575 - DNA, 25 bp, Homo sapien
gtgctggcatctacggggatacgca

SEQ ID NO: 51576 - DNA, 25 bp, Homo sapien
gatacgcatcacaacaagccgattg

SEQ ID NO: 51577 - DNA, 25 bp, Homo sapien
aagccgattgagttaggaccctgca

SEQ ID NO: 51578 - DNA, 25 bp, Homo sapien
tgcaaacagctcctaccagacggcg

SEQ ID NO: 51579 - DNA, 25 bp, Homo sapien
atcccaagctaggaagaccgacccg

SEQ ID NO: 51580 - DNA, 25 bp, Homo sapien
agctgcgtggcctaaggtcttaggc

SEQ ID NO: 51581 - DNA, 25 bp, Homo sapien
gaattagcctctgtggtggtatctg

SEQ ID NO: 51582 - DNA, 25 bp, Homo sapien
ggcgaccactggaattagcctctgt

SEQ ID NO: 51583 - DNA, 25 bp, Homo sapien
tcttcctgagatgcggggcgaccac

SEQ ID NO: 51584 - DNA, 25 bp, Homo sapien
atggtgctgagtgcaggttcccgtc

SEQ ID NO: 51585 - DNA, 25 bp, Homo sapien
ggtcaccaagttcaccgtcctttca

SEQ ID NO: 51586 - DNA, 25 bp, Homo sapien
cggggtcgaagtcgcctctgttgct

SEQ ID NO: 51587 - DNA, 25 bp, Homo sapien
tgcaggttcccgtcttcctgagatg

SEQ ID NO: 51588 - DNA, 25 bp, Homo sapien
ttgctctcagcgtcttcccttgggt

SEQ ID NO: 51589 - DNA, 25 bp, Homo sapien
gcgaagcggcgctgattccttgcat

SEQ ID NO: 51590 - DNA, 25 bp, Homo sapien
tgtaatgggtgttttttaccgctgc

SEQ ID NO: 51591 - DNA, 25 bp, Homo sapien
cgcgtctcacttgctgcgtgcgtca

SEQ ID NO: 51592 - DNA, 25 bp, Homo sapien
ccagcgaagagtttcctagtcagga

SEQ ID NO: 51593 - DNA, 25 bp, Homo sapien
aaggaaagttgaaagcagccacgcg

SEQ ID NO: 51594 - DNA, 25 bp, Homo sapien
gaggctgctcccgtcaccatgagtc

SEQ ID NO: 51595 - DNA, 25 bp, Homo sapien
gattccttgcatgaggccggacggc

SEQ ID NO: 51596 - DNA, 25 bp, Homo sapien
ggacttgttggtggatccatccctc

SEQ ID NO: 51597 - DNA, 25 bp, Homo sapien
cctgtggttttctcgctctcgcaac

SEQ ID NO: 51598 - DNA, 25 bp, Homo sapien
gagcagcaaggggatcctttagaaa

SEQ ID NO: 51599 - DNA, 25 bp, Homo sapien
tccatccctcatggcggagcagcaa

SEQ ID NO: 51600 - DNA, 25 bp, Homo sapien
tgggcgaagtaactgaaagagcgac

SEQ ID NO: 51601 - DNA, 25 bp, Homo sapien
tcgcaaccctgctttaactgccggt

SEQ ID NO: 51602 - DNA, 25 bp, Homo sapien
caaaagctgcctgcccgcgcgttat

SEQ ID NO: 51603 - DNA, 25 bp, Homo sapien
gcgacggaacttctgcaaaagctgc

SEQ ID NO: 51604 - DNA, 25 bp, Homo sapien
caccctgagccaagagccggaagtc

SEQ ID NO: 51605 - DNA, 25 bp, Homo sapien
tcggcctaacagctccacgggagtg

SEQ ID NO: 51606 - DNA, 25 bp, Homo sapien
ctgcgagtcaaatgccggtggttaa

SEQ ID NO: 51607 - DNA, 25 bp, Homo sapien
cctctacccgtttggcgttggctct

SEQ ID NO: 51608 - DNA, 25 bp, Homo sapien
taaccgtttcctagacagcgggtgc

SEQ ID NO: 51609 - DNA, 25 bp, Homo sapien
tgcgggtctcagctagtgtccgacc

SEQ ID NO: 51610 - DNA, 25 bp, Homo sapien
ctctatgacttcctctacggcggtg

SEQ ID NO: 51611 - DNA, 25 bp, Homo sapien
tcgcaccggccaatcaaggagaacc

SEQ ID NO: 51612 - DNA, 25 bp, Homo sapien
tacgtcgagtcaggggtcagaaaac

SEQ ID NO: 51613 - DNA, 25 bp, Homo sapien
caccctgctgaggaccacgtgaagc

SEQ ID NO: 51614 - DNA, 25 bp, Homo sapien
aaactctagccgtgaggccgtccta

SEQ ID NO: 51615 - DNA, 25 bp, Homo sapien
gccggagcaacatgcgctaagtgta

SEQ ID NO: 51616 - DNA, 25 bp, Homo sapien
agaggttactgcagcgcacacgata

SEQ ID NO: 51617 - DNA, 25 bp, Homo sapien
gggacctgcgacctaaactcagttc

SEQ ID NO: 51618 - DNA, 25 bp, Homo sapien
gcgcctgcctggtgtccttaagcaa

SEQ ID NO: 51619 - DNA, 25 bp, Homo sapien
ggcctgcggagtctttccttacgaa

SEQ ID NO: 51620 - DNA, 25 bp, Homo sapien
ctcgagcagtctctggaacacgctg

SEQ ID NO: 51621 - DNA, 25 bp, Homo sapien
gcctggacgtgctggtcaacaacgc

SEQ ID NO: 51622 - DNA, 25 bp, Homo sapien
gcctgagccaggtctgttctccacg

SEQ ID NO: 51623 - DNA, 25 bp, Homo sapien
gttcagccatgtcgtccggcatcca

SEQ ID NO: 51624 - DNA, 25 bp, Homo sapien
ccggcatccatgtagcgctggtgac

SEQ ID NO: 51625 - DNA, 25 bp, Homo sapien
tccaccagctggacatcgacgatct

SEQ ID NO: 51626 - DNA, 25 bp, Homo sapien
aacaacgcgggcatcgccttcaagg

SEQ ID NO: 51627 - DNA, 25 bp, Homo sapien
ctgcgggttctgcaaagtcaggcta

SEQ ID NO: 51628 - DNA, 25 bp, Homo sapien
tttcagcgtcgtcctggtggatttc

SEQ ID NO: 51629 - DNA, 25 bp, Homo sapien
atcgtgttcctctgcgacctgcaca

SEQ ID NO: 51630 - DNA, 25 bp, Homo sapien
cctcgtggaaggaacatggacccta

SEQ ID NO: 51631 - DNA, 25 bp, Homo sapien
gcgccaggacgtgatggttcacttc

SEQ ID NO: 51632 - DNA, 25 bp, Homo sapien
tccgagtacgtcttcctgcggctgc

SEQ ID NO: 51633 - DNA, 25 bp, Homo sapien
cccagagatcgtgcctgtgactcgc

SEQ ID NO: 51634 - DNA, 25 bp, Homo sapien
ggttcacttcatcgtgccaggttcg

SEQ ID NO: 51635 - DNA, 25 bp, Homo sapien
gagcgtcccaccctgtgataccagg

SEQ ID NO: 51636 - DNA, 25 bp, Homo sapien
gtctgccgagaagccagtcacgccg

SEQ ID NO: 51637 - DNA, 25 bp, Homo sapien
agtttgtggtgattgttgctgccgc

SEQ ID NO: 51638 - DNA, 25 bp, Homo sapien
gtccaaccgagtggtctgccgagaa

SEQ ID NO: 51639 - DNA, 25 bp, Homo sapien
ccaagatgtccaaccgagtggtctg

SEQ ID NO: 51640 - DNA, 25 bp, Homo sapien
attcatcctcgtgcaccataggcgg

SEQ ID NO: 51641 - DNA, 25 bp, Homo sapien
atcttccggcggtcgccggagtttg

SEQ ID NO: 51642 - DNA, 25 bp, Homo sapien
agtggtctgccgagaagccagtcac

SEQ ID NO: 51643 - DNA, 25 bp, Homo sapien
tcgtgcaccataggcggcacaggca

SEQ ID NO: 51644 - DNA, 25 bp, Homo sapien
cagccgctgttgtgtgcaggaaaac

SEQ ID NO: 51645 - DNA, 25 bp, Homo sapien
ttttctttaagactcgcagcactgg

SEQ ID NO: 51646 - DNA, 25 bp, Homo sapien
gccgtcgccttcaagagtaggtgca

SEQ ID NO: 51647 - DNA, 25 bp, Homo sapien
gggcaacgccctgctagagttcatc

SEQ ID NO: 51648 - DNA, 25 bp, Homo sapien
catcagctttccttccaacgcgaga

SEQ ID NO: 51649 - DNA, 25 bp, Homo sapien
ttctctgcaaagaaacggtctccgc

SEQ ID NO: 51650 - DNA, 25 bp, Homo sapien
cgctttgggctttcgctttccttga

SEQ ID NO: 51651 - DNA, 25 bp, Homo sapien
ggggctcaacgtactggtcaacaac

SEQ ID NO: 51652 - DNA, 25 bp, Homo sapien
accttgggcgggcactgaccaatgt

SEQ ID NO: 51653 - DNA, 25 bp, Homo sapien
cactgccgcggtaagtcgtgcctgc

SEQ ID NO: 51654 - DNA, 25 bp, Homo sapien
agcgacacccatggcggagaagcta

SEQ ID NO: 51655 - DNA, 25 bp, Homo sapien
tcacctgtacgaggcctttcccgga

SEQ ID NO: 51656 - DNA, 25 bp, Homo sapien
actccgtgagtcaagcctggccttt

SEQ ID NO: 51657 - DNA, 25 bp, Homo sapien
agtgactccaaagcacctccgaggg

SEQ ID NO: 51658 - DNA, 25 bp, Homo sapien
gagaagctaaggaagactcccgctc

SEQ ID NO: 51659 - DNA, 25 bp, Homo sapien
gagcagcccggctacgaagcgacac

SEQ ID NO: 51660 - DNA, 25 bp, Homo sapien
gactcggacaagacgcaggcttctg

SEQ ID NO: 51661 - DNA, 25 bp, Homo sapien
ggcggccttccagtcagaaagcttc

SEQ ID NO: 51662 - DNA, 25 bp, Homo sapien
cgaagagaactgctgtgcacccatc

SEQ ID NO: 51663 - DNA, 25 bp, Homo sapien
ttcccacgacctgcaggagctgagc

SEQ ID NO: 51664 - DNA, 25 bp, Homo sapien
aggcttctgagtcgttctccagcga

SEQ ID NO: 51665 - DNA, 25 bp, Homo sapien
tcctgccacacggacagcgagaaca

SEQ ID NO: 51666 - DNA, 25 bp, Homo sapien
ccgagtctgcagatacaagctcctg

SEQ ID NO: 51667 - DNA, 25 bp, Homo sapien
tgccctactacgtggagcttccaga

SEQ ID NO: 51668 - DNA, 25 bp, Homo sapien
ctcgtgtccgcccagccggacaacc

SEQ ID NO: 51669 - DNA, 25 bp, Homo sapien
cgcagcccgcatccgcccgtatcgc

SEQ ID NO: 51670 - DNA, 25 bp, Homo sapien
tagatgcacccgtcgccctcccagc

SEQ ID NO: 51671 - DNA, 25 bp, Homo sapien
aaggccgtaccggctcttgagctcg

SEQ ID NO: 51672 - DNA, 25 bp, Homo sapien
cacaaggccgtaccggctcttgagc

SEQ ID NO: 51673 - DNA, 25 bp, Homo sapien
ggcacaaggccgtaccggctcttga

SEQ ID NO: 51674 - DNA, 25 bp, Homo sapien
cgaagggcacaaggccgtaccggct

SEQ ID NO: 51675 - DNA, 25 bp, Homo sapien
gcatccgcccgtatcgccgccgctg

SEQ ID NO: 51676 - DNA, 25 bp, Homo sapien
gacagaatctacactgcctgggagg

SEQ ID NO: 51677 - DNA, 25 bp, Homo sapien
cagacagaatctacactgcctggga

SEQ ID NO: 51678 - DNA, 25 bp, Homo sapien
gcagacagaatctacactgcctggg

SEQ ID NO: 51679 - DNA, 25 bp, Homo sapien
cagcagacagaatctacactgcctg

SEQ ID NO: 51680 - DNA, 25 bp, Homo sapien
tacagcagacagaatctacactgcc

SEQ ID NO: 51681 - DNA, 25 bp, Homo sapien
tctacagcagacagaatctacactg

SEQ ID NO: 51682 - DNA, 25 bp, Homo sapien
gtctacagcagacagaatctacact

SEQ ID NO: 51683 - DNA, 25 bp, Homo sapien
acagaatctacactgcctgggaggc

SEQ ID NO: 51684 - DNA, 25 bp, Homo sapien
cctgggctaactctgaccgtgtctt

SEQ ID NO: 51685 - DNA, 25 bp, Homo sapien
cggacgcttctccattgacctctga

SEQ ID NO: 51686 - DNA, 25 bp, Homo sapien
tctgacccgcggttttgcctcttgt

SEQ ID NO: 51687 - DNA, 25 bp, Homo sapien
cctccttggcccgtgaagttcatga

SEQ ID NO: 51688 - DNA, 25 bp, Homo sapien
atgaaccaggtacgtgcatgacttc

SEQ ID NO: 51689 - DNA, 25 bp, Homo sapien
ttctgccaccatgacgctgcttctg

SEQ ID NO: 51690 - DNA, 25 bp, Homo sapien
gcatgacttcgatgccacatgggca

SEQ ID NO: 51691 - DNA, 25 bp, Homo sapien
agttcaagaaggtacgccggcgctc

SEQ ID NO: 51692 - DNA, 25 bp, Homo sapien
cccaggcgcgtagtgcgtacagagc

SEQ ID NO: 51693 - DNA, 25 bp, Homo sapien
cccggacggcccagcagaatgcgga

SEQ ID NO: 51694 - DNA, 25 bp, Homo sapien
cggcccagcagaatgcggagcgcac

SEQ ID NO: 51695 - DNA, 25 bp, Homo sapien
ggaagaaccacaagaagatgccagt

SEQ ID NO: 51696 - DNA, 25 bp, Homo sapien
gcgtcgcgctggctactctggtacc

SEQ ID NO: 51697 - DNA, 25 bp, Homo sapien
ggcaagtgagcagatcggtccccct

SEQ ID NO: 51698 - DNA, 25 bp, Homo sapien
cgccagttagggctccggtactgga

SEQ ID NO: 51699 - DNA, 25 bp, Homo sapien
cgcgtagtgcgtacagagccagcga

SEQ ID NO: 51700 - DNA, 25 bp, Homo sapien
gtcattagcgatgtcatatacggca

SEQ ID NO: 51701 - DNA, 25 bp, Homo sapien
tatacagcgtcctcattaccgatgc

SEQ ID NO: 51702 - DNA, 25 bp, Homo sapien
gcgtcctcattaccgatgccttgta

SEQ ID NO: 51703 - DNA, 25 bp, Homo sapien
gtcctcattaccgatgccttgtatg

SEQ ID NO: 51704 - DNA, 25 bp, Homo sapien
tcctcattaccgatgccttgtatgg

SEQ ID NO: 51705 - DNA, 25 bp, Homo sapien
gtcgtatacagcgtcctcattaccg

SEQ ID NO: 51706 - DNA, 25 bp, Homo sapien
cagcgtcctcattaccgatgccttg

SEQ ID NO: 51707 - DNA, 25 bp, Homo sapien
tcgtatacagcgtcctcattaccga

SEQ ID NO: 51708 - DNA, 25 bp, Homo sapien
aggtcgaagtccagggcatcgcaca

SEQ ID NO: 51709 - DNA, 25 bp, Homo sapien
ggtcgaagtccagggcatcgcacac

SEQ ID NO: 51710 - DNA, 25 bp, Homo sapien
gaagtccagggcatcgcacacaagg

SEQ ID NO: 51711 - DNA, 25 bp, Homo sapien
aagtccagggcatcgcacacaagga

SEQ ID NO: 51712 - DNA, 25 bp, Homo sapien
aacgaggtcgaagtccagggcatcg

SEQ ID NO: 51713 - DNA, 25 bp, Homo sapien
gtcgctaacgaggtcgaagtccagg

SEQ ID NO: 51714 - DNA, 25 bp, Homo sapien
gcgtcgctaacgaggtcgaagtcca

SEQ ID NO: 51715 - DNA, 25 bp, Homo sapien
atcgcacacaaggacgccatccagg

SEQ ID NO: 51716 - DNA, 25 bp, Homo sapien
tgctactgaggacgccatatatgac

SEQ ID NO: 51717 - DNA, 25 bp, Homo sapien
acgccgcccacaatatcgctaatga

SEQ ID NO: 51718 - DNA, 25 bp, Homo sapien
cgcccacaatatcgctaatgaggac

SEQ ID NO: 51719 - DNA, 25 bp, Homo sapien
gaggacgccgcccacaatatcgcta

SEQ ID NO: 51720 - DNA, 25 bp, Homo sapien
tgacattgctactgaggacgccata

SEQ ID NO: 51721 - DNA, 25 bp, Homo sapien
atatgacattgctactgaggacgcc

SEQ ID NO: 51722 - DNA, 25 bp, Homo sapien
aggacgctgtatatgacattgctac

SEQ ID NO: 51723 - DNA, 25 bp, Homo sapien
cagggcgtccttaaagaggacgccg

SEQ ID NO: 51724 - DNA, 25 bp, Homo sapien
gtcgctaacgaggaccctgtccagg

SEQ ID NO: 51725 - DNA, 25 bp, Homo sapien
ggccatcgctaagcaggatgccgcc

SEQ ID NO: 51726 - DNA, 25 bp, Homo sapien
atcgctaccgaggatgtcgccgacg

SEQ ID NO: 51727 - DNA, 25 bp, Homo sapien
atcgaggacaccacaccgtccaggg

SEQ ID NO: 51728 - DNA, 25 bp, Homo sapien
cacagcatcgctatcgaggacacca

SEQ ID NO: 51729 - DNA, 25 bp, Homo sapien
ggatgccgcccaagcgatcgctaag

SEQ ID NO: 51730 - DNA, 25 bp, Homo sapien
cccagggcgtcgctaaagaggtcac

SEQ ID NO: 51731 - DNA, 25 bp, Homo sapien
gcgtcgctaacgaggttgaagtcca

SEQ ID NO: 51732 - DNA, 25 bp, Homo sapien
gacaaattctagttcctggacaccg

SEQ ID NO: 51733 - DNA, 25 bp, Homo sapien
cgtggacgaactaacaggacaaatt

SEQ ID NO: 51734 - DNA, 25 bp, Homo sapien
ggcactacactgatccgcacacgga

SEQ ID NO: 51735 - DNA, 25 bp, Homo sapien
gcacacggagatacacagcgacatc

SEQ ID NO: 51736 - DNA, 25 bp, Homo sapien
gtatcctcgcaattagacacccatg

SEQ ID NO: 51737 - DNA, 25 bp, Homo sapien
tctttgtggcagtcgcagtcctttt

SEQ ID NO: 51738 - DNA, 25 bp, Homo sapien
gcccgaactcgctctaggaaatgga

SEQ ID NO: 51739 - DNA, 25 bp, Homo sapien
tgctagatactcgttcgcgtcggga

SEQ ID NO: 51740 - DNA, 25 bp, Homo sapien
gaagggcttcagctgccacgcgtac

SEQ ID NO: 51741 - DNA, 25 bp, Homo sapien
ggccctacaagtgcagcgcctgcga

SEQ ID NO: 51742 - DNA, 25 bp, Homo sapien
ttcacctggagcaccaaccttctgg

SEQ ID NO: 51743 - DNA, 25 bp, Homo sapien
cacgccaagtgagccagaaaagttc

SEQ ID NO: 51744 - DNA, 25 bp, Homo sapien
acacgcaagaacgtccaggccactg

SEQ ID NO: 51745 - DNA, 25 bp, Homo sapien
ggggacccttgctggacacacgcaa

SEQ ID NO: 51746 - DNA, 25 bp, Homo sapien
ctgggacgtccctgtagaggaattc

SEQ ID NO: 51747 - DNA, 25 bp, Homo sapien
ccctcaccgtgcatgagaagatcca

SEQ ID NO: 51748 - DNA, 25 bp, Homo sapien
ctgagcgacatggactttagaggtg

SEQ ID NO: 51749 - DNA, 25 bp, Homo sapien
gctgagcgacatggactttagaggt

SEQ ID NO: 51750 - DNA, 25 bp, Homo sapien
tgctgagcgacatggactttagagg

SEQ ID NO: 51751 - DNA, 25 bp, Homo sapien
ggatgctgagcgacatggactttag

SEQ ID NO: 51752 - DNA, 25 bp, Homo sapien
aggatgctgagcgacatggacttta

SEQ ID NO: 51753 - DNA, 25 bp, Homo sapien
gaaggatgctgagcgacatggactt

SEQ ID NO: 51754 - DNA, 25 bp, Homo sapien
tgtttgggccactagtcagggggaa

SEQ ID NO: 51755 - DNA, 25 bp, Homo sapien
gatgctgagcgacatggactttaga

SEQ ID NO: 51756 - DNA, 25 bp, Homo sapien
tgccgtggatccaggacaccttagg

SEQ ID NO: 51757 - DNA, 25 bp, Homo sapien
tgcaggacctgagccaatgagacgc

SEQ ID NO: 51758 - DNA, 25 bp, Homo sapien
aatgagacgcaacctccgctagccg

SEQ ID NO: 51759 - DNA, 25 bp, Homo sapien
cggacgagccacagcctgctacagg

SEQ ID NO: 51760 - DNA, 25 bp, Homo sapien
agcggccaacatggaggcagcctcg

SEQ ID NO: 51761 - DNA, 25 bp, Homo sapien
ccgtgttcgaccgtatgcgccgatt

SEQ ID NO: 51762 - DNA, 25 bp, Homo sapien
atgcgccgatttgtcgctgggcgtc

SEQ ID NO: 51763 - DNA, 25 bp, Homo sapien
agagcacactgctccaatccaggag

SEQ ID NO: 51764 - DNA, 25 bp, Homo sapien
ccagggcgggcagcccattcatcgt

SEQ ID NO: 51765 - DNA, 25 bp, Homo sapien
ctgcgtccagcaaaaccactaagtc

SEQ ID NO: 51766 - DNA, 25 bp, Homo sapien
cagcttttgccgcttggctgtgtgc

SEQ ID NO: 51767 - DNA, 25 bp, Homo sapien
aaaaccactaagtcagggaggccag

SEQ ID NO: 51768 - DNA, 25 bp, Homo sapien
attcatcgtcctcaccgcgctgttc

SEQ ID NO: 51769 - DNA, 25 bp, Homo sapien
ccttggctggaacgctcaggatgcc

SEQ ID NO: 51770 - DNA, 25 bp, Homo sapien
cgctcactcccggtgcacatgtgcc

SEQ ID NO: 51771 - DNA, 25 bp, Homo sapien
cttccgggcccttggctggaacgct

SEQ ID NO: 51772 - DNA, 25 bp, Homo sapien
agcgcgtacacttgccggtgacatg

SEQ ID NO: 51773 - DNA, 25 bp, Homo sapien
ggctgctgaaccagacccttggctg

SEQ ID NO: 51774 - DNA, 25 bp, Homo sapien
tgcagccctcgccatagaaaccggt

SEQ ID NO: 51775 - DNA, 25 bp, Homo sapien
gactggtcaccagatcctgcgctga

SEQ ID NO: 51776 - DNA, 25 bp, Homo sapien
cccttggctgtaagtggaggtccct

SEQ ID NO: 51777 - DNA, 25 bp, Homo sapien
gtccttctgtaccaactcggggtca

SEQ ID NO: 51778 - DNA, 25 bp, Homo sapien
gtcctcgccgtaagtgccattgcta

SEQ ID NO: 51779 - DNA, 25 bp, Homo sapien
cggggtcaccttaagagcccactga

SEQ ID NO: 51780 - DNA, 25 bp, Homo sapien
tctgccctccgtgcaaactcccgga

SEQ ID NO: 51781 - DNA, 25 bp, Homo sapien
agctcctaactcctggcgtccgggg

SEQ ID NO: 51782 - DNA, 25 bp, Homo sapien
cccttgaccttgtggcctttggcca

SEQ ID NO: 51783 - DNA, 25 bp, Homo sapien
cctgcgtggagatgcccttgacctt

SEQ ID NO: 51784 - DNA, 25 bp, Homo sapien
gcggcgtctccaatccgcgccaagg

SEQ ID NO: 51785 - DNA, 25 bp, Homo sapien
gcgcctccggaccagagttcggaaa

SEQ ID NO: 51786 - DNA, 25 bp, Homo sapien
gtctgcgcgcctccggaccagagtt

SEQ ID NO: 51787 - DNA, 25 bp, Homo sapien
cggcggcatcgatgcgaagcagatg

SEQ ID NO: 51788 - DNA, 25 bp, Homo sapien
cgagggttcagttcctgaggcgcca

SEQ ID NO: 51789 - DNA, 25 bp, Homo sapien
agcacggcacacgttgcggccgcga

SEQ ID NO: 51790 - DNA, 25 bp, Homo sapien
agggttcagttcctgaggcgccacg

SEQ ID NO: 51791 - DNA, 25 bp, Homo sapien
gggttcagttcctgaggcgccacgg

SEQ ID NO: 51792 - DNA, 25 bp, Homo sapien
gagggttcagttcctgaggcgccac

SEQ ID NO: 51793 - DNA, 25 bp, Homo sapien
ttgcggccgcgagggttcagttcct

SEQ ID NO: 51794 - DNA, 25 bp, Homo sapien
gcacggcacacgttgcggccgcgag

SEQ ID NO: 51795 - DNA, 25 bp, Homo sapien
cacggcacacgttgcggccgcgagg

SEQ ID NO: 51796 - DNA, 25 bp, Homo sapien
cggggacacggacgcgactccgcaa

SEQ ID NO: 51797 - DNA, 25 bp, Homo sapien
ctgcgcactcagagctcgcaagggg

SEQ ID NO: 51798 - DNA, 25 bp, Homo sapien
tcctgcgcactcagagctcgcaagg

SEQ ID NO: 51799 - DNA, 25 bp, Homo sapien
ctggggtgtgcggtcagctccccct

SEQ ID NO: 51800 - DNA, 25 bp, Homo sapien
gaggccgaaagccaactccacagca

SEQ ID NO: 51801 - DNA, 25 bp, Homo sapien
aggtcgaggccgaaagccaactcca

SEQ ID NO: 51802 - DNA, 25 bp, Homo sapien
ggcccgcagacagcccaggtcgagg

SEQ ID NO: 51803 - DNA, 25 bp, Homo sapien
cagcgcctcggaaccggccaaggga

SEQ ID NO: 51804 - DNA, 25 bp, Homo sapien
ggcccgcaccggatctaaaatggtc

SEQ ID NO: 51805 - DNA, 25 bp, Homo sapien
ggtcagaactggcagccgacgcttc

SEQ ID NO: 51806 - DNA, 25 bp, Homo sapien
tcgcgctctggtgattttgcactga

SEQ ID NO: 51807 - DNA, 25 bp, Homo sapien
tttgcactgacagcgcgatctccgg

SEQ ID NO: 51808 - DNA, 25 bp, Homo sapien
tcctctcaggaaaccgggagagctg

SEQ ID NO: 51809 - DNA, 25 bp, Homo sapien
aaatcgcccgcctgttgcaaggccg

SEQ ID NO: 51810 - DNA, 25 bp, Homo sapien
ccaggaaggccgcattcggacctgc

SEQ ID NO: 51811 - DNA, 25 bp, Homo sapien
agcgatcgccaaggctcagtgagtc

SEQ ID NO: 51812 - DNA, 25 bp, Homo sapien
ctggggaacaggcatggacgtttcc

SEQ ID NO: 51813 - DNA, 25 bp, Homo sapien
aagcctgtgcgcgagactccatttc

SEQ ID NO: 51814 - DNA, 25 bp, Homo sapien
acgtttccgggcaagagaccgactg

SEQ ID NO: 51815 - DNA, 25 bp, Homo sapien
ttgtgggaccttcctccttagcgtg

SEQ ID NO: 51816 - DNA, 25 bp, Homo sapien
cgttcccgacatggactgctcgttt

SEQ ID NO: 51817 - DNA, 25 bp, Homo sapien
tggggccgagctctgcaaaccaacg

SEQ ID NO: 51818 - DNA, 25 bp, Homo sapien
ccgtgtccgacagctgcactggaag

SEQ ID NO: 51819 - DNA, 25 bp, Homo sapien
ccttccggcagaagctggtcagtca

SEQ ID NO: 51820 - DNA, 25 bp, Homo sapien
ccatcacgtatgtccagctgggctg

SEQ ID NO: 51821 - DNA, 25 bp, Homo sapien
cggtgccaccgaccaaacagcagta

SEQ ID NO: 51822 - DNA, 25 bp, Homo sapien
aacagcagtacctatgccagccgct

SEQ ID NO: 51823 - DNA, 25 bp, Homo sapien
gccagccgctcctggatgccgtcct

SEQ ID NO: 51824 - DNA, 25 bp, Homo sapien
attcgttccagccatgaccgccatt

SEQ ID NO: 51825 - DNA, 25 bp, Homo sapien
ggccaacatccgctcacctgtcttc

SEQ ID NO: 51826 - DNA, 25 bp, Homo sapien
gggctgctgaccgtgcccatcctgt

SEQ ID NO: 51827 - DNA, 25 bp, Homo sapien
gtaccgcacattcgttccagccatg

SEQ ID NO: 51828 - DNA, 25 bp, Homo sapien
ctgttgactgtgtacatcgtccaca

SEQ ID NO: 51829 - DNA, 25 bp, Homo sapien
tgcgtagctctgttgactgtgtaca

SEQ ID NO: 51830 - DNA, 25 bp, Homo sapien
tctcatgatagtaaagaatagagtg

SEQ ID NO: 51831 - DNA, 25 bp, Homo sapien
agagtgatggagtctatattttaca

SEQ ID NO: 51832 - DNA, 25 bp, Homo sapien
catatatcttccatttagtagcaga

SEQ ID NO: 51833 - DNA, 25 bp, Homo sapien
tccttgtacttgatttggtaaattc

SEQ ID NO: 51834 - DNA, 25 bp, Homo sapien
ttcctccatttaaattaagatgtta

SEQ ID NO: 51835 - DNA, 25 bp, Homo sapien
gctgtctatattaattctcatgata

SEQ ID NO: 51836 - DNA, 25 bp, Homo sapien
ggcgggagttcagcccagtatagaa

SEQ ID NO: 51837 - DNA, 25 bp, Homo sapien
aggggtgagagccccagacggcagc

SEQ ID NO: 51838 - DNA, 25 bp, Homo sapien
gcaggggtgagagccccagacggca

SEQ ID NO: 51839 - DNA, 25 bp, Homo sapien
ggagttcagcccagtatagaagctg

SEQ ID NO: 51840 - DNA, 25 bp, Homo sapien
gggagttcagcccagtatagaagct

SEQ ID NO: 51841 - DNA, 25 bp, Homo sapien
cgggagttcagcccagtatagaagc

SEQ ID NO: 51842 - DNA, 25 bp, Homo sapien
gcgggagttcagcccagtatagaag

SEQ ID NO: 51843 - DNA, 25 bp, Homo sapien
aggcgggagttcagcccagtataga

SEQ ID NO: 51844 - DNA, 25 bp, Homo sapien
gaggaaagacctcggcaagaaccag

SEQ ID NO: 51845 - DNA, 25 bp, Homo sapien
ggcgatacgaggaaagacctcggca

SEQ ID NO: 51846 - DNA, 25 bp, Homo sapien
atctctgggtccacagcttggctcc

SEQ ID NO: 51847 - DNA, 25 bp, Homo sapien
tgtgggcgatacgaggaaagacctc

SEQ ID NO: 51848 - DNA, 25 bp, Homo sapien
ggcgcacacttgctcctcgcgccgg

SEQ ID NO: 51849 - DNA, 25 bp, Homo sapien
gccctgcgggcgcacacttgctcct

SEQ ID NO: 51850 - DNA, 25 bp, Homo sapien
ttcgcatgcgcggagcgaggcccgt

SEQ ID NO: 51851 - DNA, 25 bp, Homo sapien
ggtccacgcacacccgcaaaacttc

SEQ ID NO: 51852 - DNA, 25 bp, Homo sapien
caagtttctgccacacagcggaggg

SEQ ID NO: 51853 - DNA, 25 bp, Homo sapien
gggtgccaccgctccaagtttctgc

SEQ ID NO: 51854 - DNA, 25 bp, Homo sapien
tcgcgggtgccaccgctccaagttt

SEQ ID NO: 51855 - DNA, 25 bp, Homo sapien
ggagtaagcgggaccagccagcagt

SEQ ID NO: 51856 - DNA, 25 bp, Homo sapien
aggccttgctgctccgcacggtgcc

SEQ ID NO: 51857 - DNA, 25 bp, Homo sapien
gctggggtctctcgctgccctgcct

SEQ ID NO: 51858 - DNA, 25 bp, Homo sapien
ctggctctagccgacgcgagggaaa

SEQ ID NO: 51859 - DNA, 25 bp, Homo sapien
aggaccctggctctagccgacgcga

SEQ ID NO: 51860 - DNA, 25 bp, Homo sapien
cctcagcaggagagcaggaatcttc

SEQ ID NO: 51861 - DNA, 25 bp, Homo sapien
aggagagcaggaatcttcagtgatc

SEQ ID NO: 51862 - DNA, 25 bp, Homo sapien
aggaatcttcagtgatccacgggca

SEQ ID NO: 51863 - DNA, 25 bp, Homo sapien
gaatcttcagtgatccacgggcaga

SEQ ID NO: 51864 - DNA, 25 bp, Homo sapien
tcttcagtgatccacgggcagatct

SEQ ID NO: 51865 - DNA, 25 bp, Homo sapien
ttcagtgatccacgggcagatctgc

SEQ ID NO: 51866 - DNA, 25 bp, Homo sapien
cagcaggagagcaggaatcttcagt

SEQ ID NO: 51867 - DNA, 25 bp, Homo sapien
gagcaggaatcttcagtgatccacg

SEQ ID NO: 51868 - DNA, 25 bp, Homo sapien
gcggggcataatcgcctgggggcgg

SEQ ID NO: 51869 - DNA, 25 bp, Homo sapien
cccttgccctcgctctcattgcctc

SEQ ID NO: 51870 - DNA, 25 bp, Homo sapien
gccctcgctctcattgcctccccgt

SEQ ID NO: 51871 - DNA, 25 bp, Homo sapien
atgtgggcggggcataatcgcctgg

SEQ ID NO: 51872 - DNA, 25 bp, Homo sapien
tgtgggcggggcataatcgcctggg

SEQ ID NO: 51873 - DNA, 25 bp, Homo sapien
tgagggctagatacgggcggagcgc

SEQ ID NO: 51874 - DNA, 25 bp, Homo sapien
gccctgagggctagatacgggcgga

SEQ ID NO: 51875 - DNA, 25 bp, Homo sapien
ccttgccctcgctctcattgcctcc

SEQ ID NO: 51876 - DNA, 25 bp, Homo sapien
gccgacgttaccttctccaaggatg

SEQ ID NO: 51877 - DNA, 25 bp, Homo sapien
gccggtctctgtgctgtcaaacgga

SEQ ID NO: 51878 - DNA, 25 bp, Homo sapien
ctcatgtacgagtccgagaaggttg

SEQ ID NO: 51879 - DNA, 25 bp, Homo sapien
agctacaatccgttcgacgacgacg

SEQ ID NO: 51880 - DNA, 25 bp, Homo sapien
cggcaccatgtcagcttaccctaaa

SEQ ID NO: 51881 - DNA, 25 bp, Homo sapien
cgccacgtgacctctcagttgctga

SEQ ID NO: 51882 - DNA, 25 bp, Homo sapien
ccagtgacaggaccgtgttgaaata

SEQ ID NO: 51883 - DNA, 25 bp, Homo sapien
ctccaaggatgctggtctctgcacc

SEQ ID NO: 51884 - DNA, 25 bp, Homo sapien
ccgccattttgttgctgtggctatt

SEQ ID NO: 51885 - DNA, 25 bp, Homo sapien
atttgaccatttgccggccctgctg

SEQ ID NO: 51886 - DNA, 25 bp, Homo sapien
agatcggggaccaggaatttgacca

SEQ ID NO: 51887 - DNA, 25 bp, Homo sapien
gactatgtgctgtcggtgtccgaga

SEQ ID NO: 51888 - DNA, 25 bp, Homo sapien
acggtatgttcctcgtccgcgattc

SEQ ID NO: 51889 - DNA, 25 bp, Homo sapien
tgggaacaagctgggcaaaagcacc

SEQ ID NO: 51890 - DNA, 25 bp, Homo sapien
agcggcccaggaagagagtgcctac

SEQ ID NO: 51891 - DNA, 25 bp, Homo sapien
gacgctccttcgagttcggtgcctc

SEQ ID NO: 51892 - DNA, 25 bp, Homo sapien
cggacaaggaactgtagcccatgta

SEQ ID NO: 51893 - DNA, 25 bp, Homo sapien
gcccttctccgtatggctcttcgga

SEQ ID NO: 51894 - DNA, 25 bp, Homo sapien
ggcgcattcagcgactgcagagact

SEQ ID NO: 51895 - DNA, 25 bp, Homo sapien
tccagtgcccatggcttctggcgtc

SEQ ID NO: 51896 - DNA, 25 bp, Homo sapien
ggaagaacttgacctttccctgaca

SEQ ID NO: 51897 - DNA, 25 bp, Homo sapien
cctcgctctcggatcccaaggaaga

SEQ ID NO: 51898 - DNA, 25 bp, Homo sapien
cccatgtaccgcgtgacgtgagagc

SEQ ID NO: 51899 - DNA, 25 bp, Homo sapien
cacggcgtttggatcccagatccca

SEQ ID NO: 51900 - DNA, 25 bp, Homo sapien
cgaggctgctggcatcggcttccca

SEQ ID NO: 51901 - DNA, 25 bp, Homo sapien
agtgcaaacgcagcgccagacacgc

SEQ ID NO: 51902 - DNA, 25 bp, Homo sapien
agcgcttgcgctcccaagtctcgga

SEQ ID NO: 51903 - DNA, 25 bp, Homo sapien
cggggtccgaagctcacctcgtcct

SEQ ID NO: 51904 - DNA, 25 bp, Homo sapien
cccttctcgggctgcaaggtctggc

SEQ ID NO: 51905 - DNA, 25 bp, Homo sapien
tgctggcatcggcttcccagagaga

SEQ ID NO: 51906 - DNA, 25 bp, Homo sapien
cccagagagagggaactgcacgtgc

SEQ ID NO: 51907 - DNA, 25 bp, Homo sapien
tcgtccttctctcgtcccacaacgg

SEQ ID NO: 51908 - DNA, 25 bp, Homo sapien
aaatgtggtttctccagccggcccg

SEQ ID NO: 51909 - DNA, 25 bp, Homo sapien
ggctagggacgacacactgcattca

SEQ ID NO: 51910 - DNA, 25 bp, Homo sapien
ttcactggaagggacaacgcagcgc

SEQ ID NO: 51911 - DNA, 25 bp, Homo sapien
cgcagcgccagtacatagcctgaaa

SEQ ID NO: 51912 - DNA, 25 bp, Homo sapien
ccgagcgtggacttcgaccatagct

SEQ ID NO: 51913 - DNA, 25 bp, Homo sapien
tgtcgagtacctgacgctcaacttc

SEQ ID NO: 51914 - DNA, 25 bp, Homo sapien
ttcgggcccttcgaaacagtgcatc

SEQ ID NO: 51915 - DNA, 25 bp, Homo sapien
accatagctgctcggacagtgtcga

SEQ ID NO: 51916 - DNA, 25 bp, Homo sapien
ttcattctggatgtaggctccggcg

SEQ ID NO: 51917 - DNA, 25 bp, Homo sapien
cttgtcaagggcatcaagggctgcc

SEQ ID NO: 51918 - DNA, 25 bp, Homo sapien
cgcttgcaggcctgcagctggcgct

SEQ ID NO: 51919 - DNA, 25 bp, Homo sapien
ttggtcagtctcaaccgcagccgct

SEQ ID NO: 51920 - DNA, 25 bp, Homo sapien
tcctgctgcagcttggtcagtctca

SEQ ID NO: 51921 - DNA, 25 bp, Homo sapien
ggcatcaagggctgcctcggctcgc

SEQ ID NO: 51922 - DNA, 25 bp, Homo sapien
gcccacctggtagctgtgttcattc

SEQ ID NO: 51923 - DNA, 25 bp, Homo sapien
cgcttccagagtaaggcgctgccca

SEQ ID NO: 51924 - DNA, 25 bp, Homo sapien
cagtatctgagaaaggcgcgaagcc

SEQ ID NO: 51925 - DNA, 25 bp, Homo sapien
cctcggaatgacctctgacggaaga

SEQ ID NO: 51926 - DNA, 25 bp, Homo sapien
cgacccgaggcgagcaacaactagc

SEQ ID NO: 51927 - DNA, 25 bp, Homo sapien
gactaccagtattgtcgcccacgtg

SEQ ID NO: 51928 - DNA, 25 bp, Homo sapien
aggttcaagcctcctcagtatctga

SEQ ID NO: 51929 - DNA, 25 bp, Homo sapien
gcgccggaagttggtaccatagaga

SEQ ID NO: 51930 - DNA, 25 bp, Homo sapien
ttgacttctgtcagcggcactcacg

SEQ ID NO: 51931 - DNA, 25 bp, Homo sapien
cctgggacgcttgcacgaaagaacc

SEQ ID NO: 51932 - DNA, 25 bp, Homo sapien
tctgccacggcaattagcgacgcgc

SEQ ID NO: 51933 - DNA, 25 bp, Homo sapien
gccgtagaaaccgtggctctcctgc

SEQ ID NO: 51934 - DNA, 25 bp, Homo sapien
tcgcctgagaggataaactgcacgc

SEQ ID NO: 51935 - DNA, 25 bp, Homo sapien
cccagtgctgtaggttgccgtagaa

SEQ ID NO: 51936 - DNA, 25 bp, Homo sapien
tgaccaatcgagtgtggcgtccatc

SEQ ID NO: 51937 - DNA, 25 bp, Homo sapien
accgcttggcgcctcacttagagcg

SEQ ID NO: 51938 - DNA, 25 bp, Homo sapien
ccgtctctaggtcggagtctgaatc

SEQ ID NO: 51939 - DNA, 25 bp, Homo sapien
tggcaggaaccgctcatcgttacgc

SEQ ID NO: 51940 - DNA, 25 bp, Homo sapien
ggaggcttcgttcctgcaccagcgt

SEQ ID NO: 51941 - DNA, 25 bp, Homo sapien
caccagcgtggcttgccctttggac

SEQ ID NO: 51942 - DNA, 25 bp, Homo sapien
gctcagggaaacagcgcaggcgcct

SEQ ID NO: 51943 - DNA, 25 bp, Homo sapien
tgccacttccgggttgtttgctccc

SEQ ID NO: 51944 - DNA, 25 bp, Homo sapien
tttgctcccggagccataaccgcag

SEQ ID NO: 51945 - DNA, 25 bp, Homo sapien
agccataaccgcagctcagcgtgcg

SEQ ID NO: 51946 - DNA, 25 bp, Homo sapien
aaccgcagctcagcgtgcgggcaga

SEQ ID NO: 51947 - DNA, 25 bp, Homo sapien
tctcaaacggggtaccaggaggctc

SEQ ID NO: 51948 - DNA, 25 bp, Homo sapien
gggccgaagcactcctgtcctccac

SEQ ID NO: 51949 - DNA, 25 bp, Homo sapien
ggctcctccgtggtgcacgtgacct

SEQ ID NO: 51950 - DNA, 25 bp, Homo sapien
gtggtgcacgtgacctcacggcctc

SEQ ID NO: 51951 - DNA, 25 bp, Homo sapien
acggcctccctgttgtgccgtcagg

SEQ ID NO: 51952 - DNA, 25 bp, Homo sapien
tgccgtcaggggtcattgcagaccc

SEQ ID NO: 51953 - DNA, 25 bp, Homo sapien
atgtgtgcatgtgccgagagtgccc

SEQ ID NO: 51954 - DNA, 25 bp, Homo sapien
tgagggcacggcctttgccagccag

SEQ ID NO: 51955 - DNA, 25 bp, Homo sapien
gcctttgccagccaggtgtcctgct

SEQ ID NO: 51956 - DNA, 25 bp, Homo sapien
cgcgactcttcttttggagaaattt

SEQ ID NO: 51957 - DNA, 25 bp, Homo sapien
cttttgtttgtcagcgactcgttcg

SEQ ID NO: 51958 - DNA, 25 bp, Homo sapien
ggagctgtcaaaacgcccgggccag

SEQ ID NO: 51959 - DNA, 25 bp, Homo sapien
cgctcgggaaactcggagctgtcaa

SEQ ID NO: 51960 - DNA, 25 bp, Homo sapien
gacggactccgagcgaaccgccgag

SEQ ID NO: 51961 - DNA, 25 bp, Homo sapien
atcattgagaaaacaagcccggagc

SEQ ID NO: 51962 - DNA, 25 bp, Homo sapien
cttggcctagctggatcattgagaa

SEQ ID NO: 51963 - DNA, 25 bp, Homo sapien
agaaatttctcgtagccgcgtcttg

SEQ ID NO: 51964 - DNA, 25 bp, Homo sapien
cagacagacagtggcggctacatac

SEQ ID NO: 51965 - DNA, 25 bp, Homo sapien
cctcgcaaggtcgttaccggagctc

SEQ ID NO: 51966 - DNA, 25 bp, Homo sapien
ccagagtcgagccggacccggaaca

SEQ ID NO: 51967 - DNA, 25 bp, Homo sapien
gccacctggccacagacagacagtg

SEQ ID NO: 51968 - DNA, 25 bp, Homo sapien
cgccttcgcctgttcttgggcctga

SEQ ID NO: 51969 - DNA, 25 bp, Homo sapien
gatctgctgcaacccacctgctgct

SEQ ID NO: 51970 - DNA, 25 bp, Homo sapien
gcaaggtcgttaccggagctcaccg

SEQ ID NO: 51971 - DNA, 25 bp, Homo sapien
ccgacacgccgctgctgctagagcc

SEQ ID NO: 51972 - DNA, 25 bp, Homo sapien
cggccacagtttctacggcaaccga

SEQ ID NO: 51973 - DNA, 25 bp, Homo sapien
caaggcgcccaatccggtgcatggt

SEQ ID NO: 51974 - DNA, 25 bp, Homo sapien
gcgaggagcctcagcacaagccggc

SEQ ID NO: 51975 - DNA, 25 bp, Homo sapien
tgcctgttgctggacggcacattcg

SEQ ID NO: 51976 - DNA, 25 bp, Homo sapien
acggcacattcggttggtcagcgca

SEQ ID NO: 51977 - DNA, 25 bp, Homo sapien
gggtcaagctgtctccgactcagtg

SEQ ID NO: 51978 - DNA, 25 bp, Homo sapien
cgactcagtgtctgagactgcgaga

SEQ ID NO: 51979 - DNA, 25 bp, Homo sapien
tctgtggcgcatgcagtgtatcagc

SEQ ID NO: 51980 - DNA, 25 bp, Homo sapien
cgtggatcactgaagattcctgctc

SEQ ID NO: 51981 - DNA, 25 bp, Homo sapien
ctgaagattcctgctctcctgctga

SEQ ID NO: 51982 - DNA, 25 bp, Homo sapien
tctgcccgtggatcactgaagattc

SEQ ID NO: 51983 - DNA, 25 bp, Homo sapien
gcagatctgcccgtggatcactgaa

SEQ ID NO: 51984 - DNA, 25 bp, Homo sapien
gcccgtggatcactgaagattcctg

SEQ ID NO: 51985 - DNA, 25 bp, Homo sapien
aagattcctgctctcctgctgaggt

SEQ ID NO: 51986 - DNA, 25 bp, Homo sapien
ggatcactgaagattcctgctctcc

SEQ ID NO: 51987 - DNA, 25 bp, Homo sapien
tcactgaagattcctgctctcctgc

SEQ ID NO: 51988 - DNA, 25 bp, Homo sapien
ggagacccgcggatctcaagtcgcc

SEQ ID NO: 51989 - DNA, 25 bp, Homo sapien
gggagctcccgacgcagacggaaaa

SEQ ID NO: 51990 - DNA, 25 bp, Homo sapien
agtaaacgcggcacggcctcacgtg

SEQ ID NO: 51991 - DNA, 25 bp, Homo sapien
gcccagcacctaaggggtccgcggc

SEQ ID NO: 51992 - DNA, 25 bp, Homo sapien
cgcgccgatttccaagggcccagca

SEQ ID NO: 51993 - DNA, 25 bp, Homo sapien
tgctgactcatgctgcccggccggg

SEQ ID NO: 51994 - DNA, 25 bp, Homo sapien
gcggatctcaagtcgcccggcccgc

SEQ ID NO: 51995 - DNA, 25 bp, Homo sapien
ctctcgcgctcagctcgagcaccgc

SEQ ID NO: 51996 - DNA, 25 bp, Homo sapien
ttgcatggaggccagagccacgaca

SEQ ID NO: 51997 - DNA, 25 bp, Homo sapien
agagccacgacacccgcctggggaa

SEQ ID NO: 51998 - DNA, 25 bp, Homo sapien
gcatggaggccagagccacgacacc

SEQ ID NO: 51999 - DNA, 25 bp, Homo sapien
gcccgcttgccactgcctgcatggc

SEQ ID NO: 52000 - DNA, 25 bp, Homo sapien
cctcgccgcccgcttgccactgcct

SEQ ID NO: 52001 - DNA, 25 bp, Homo sapien
cacgacacccgcctggggaacggag

SEQ ID NO: 52002 - DNA, 25 bp, Homo sapien
tgcatggaggccagagccacgacac

SEQ ID NO: 52003 - DNA, 25 bp, Homo sapien
gtccacctgccccacggagccctcg

SEQ ID NO: 52004 - DNA, 25 bp, Homo sapien
ataagacatcgctagtaactatcgc

SEQ ID NO: 52005 - DNA, 25 bp, Homo sapien
tataagacatcgctagtaactatcg

SEQ ID NO: 52006 - DNA, 25 bp, Homo sapien
tcaccaatgagggcgctttatacga

SEQ ID NO: 52007 - DNA, 25 bp, Homo sapien
acatcaccaatgagggcgctttata

SEQ ID NO: 52008 - DNA, 25 bp, Homo sapien
tacaagacatcaccaatgagggcgc

SEQ ID NO: 52009 - DNA, 25 bp, Homo sapien
agacatcaccaatgagggcgcttta

SEQ ID NO: 52010 - DNA, 25 bp, Homo sapien
caagacatcaccaatgagggcgctt

SEQ ID NO: 52011 - DNA, 25 bp, Homo sapien
catcaccaatgagggcgctttatac

SEQ ID NO: 52012 - DNA, 25 bp, Homo sapien
ttccgtctgcgtcgggagctcccgg

SEQ ID NO: 52013 - DNA, 25 bp, Homo sapien
cccggccgggcagcatgagtcagca

SEQ ID NO: 52014 - DNA, 25 bp, Homo sapien
gcgacttgagatccgcgggtctccc

SEQ ID NO: 52015 - DNA, 25 bp, Homo sapien
ttttccgtctgcgtcgggagctccc

SEQ ID NO: 52016 - DNA, 25 bp, Homo sapien
gcacgtgaggccgtgccgcgtttac

SEQ ID NO: 52017 - DNA, 25 bp, Homo sapien
acgtgaggccgtgccgcgtttactg

SEQ ID NO: 52018 - DNA, 25 bp, Homo sapien
cggtgctcgagctgagcgcgagagg

SEQ ID NO: 52019 - DNA, 25 bp, Homo sapien
gctgggcccttggaaatcggcgcgt

SEQ ID NO: 52020 - DNA, 25 bp, Homo sapien
aaagcgccctcattggtgatgtctt

SEQ ID NO: 52021 - DNA, 25 bp, Homo sapien
gtataaagcgccctcattggtgatg

SEQ ID NO: 52022 - DNA, 25 bp, Homo sapien
tataaagcgccctcattggtgatgt

SEQ ID NO: 52023 - DNA, 25 bp, Homo sapien
ataaagcgccctcattggtgatgtc

SEQ ID NO: 52024 - DNA, 25 bp, Homo sapien
taaagcgccctcattggtgatgtct

SEQ ID NO: 52025 - DNA, 25 bp, Homo sapien
gcgccctcattggtgatgtcttgta

SEQ ID NO: 52026 - DNA, 25 bp, Homo sapien
aagcgccctcattggtgatgtcttg

SEQ ID NO: 52027 - DNA, 25 bp, Homo sapien
agcgccctcattggtgatgtcttgt

SEQ ID NO: 52028 - DNA, 25 bp, Homo sapien
agacgtttctgatcgtcacggggcg

SEQ ID NO: 52029 - DNA, 25 bp, Homo sapien
cttagtgtcacaagcagacggaccc

SEQ ID NO: 52030 - DNA, 25 bp, Homo sapien
ccctgtcatgccttgagacacgcga

SEQ ID NO: 52031 - DNA, 25 bp, Homo sapien
tcatgccttgagacacgcgaggcgg

SEQ ID NO: 52032 - DNA, 25 bp, Homo sapien
acagagggtccgagccaaacccatg

SEQ ID NO: 52033 - DNA, 25 bp, Homo sapien
gtccgagccaaacccatggaggcca

SEQ ID NO: 52034 - DNA, 25 bp, Homo sapien
gccaaacccatggaggccacggtgc

SEQ ID NO: 52035 - DNA, 25 bp, Homo sapien
gagctgtttggagacgtttctgatc

SEQ ID NO: 52036 - DNA, 25 bp, Homo sapien
gtcaacctggactcagagaatgtca

SEQ ID NO: 52037 - DNA, 25 bp, Homo sapien
ctgcctttcatcacagtcaacctgg

SEQ ID NO: 52038 - DNA, 25 bp, Homo sapien
atccctgggccatttgggaacacta

SEQ ID NO: 52039 - DNA, 25 bp, Homo sapien
cgatgaagacctgatccctgggcca

SEQ ID NO: 52040 - DNA, 25 bp, Homo sapien
ccctctgagtggagcgatgaagacc

SEQ ID NO: 52041 - DNA, 25 bp, Homo sapien
gcagagagaggatgcttccctctga

SEQ ID NO: 52042 - DNA, 25 bp, Homo sapien
tgtcgtggctctggcctccatgcaa

SEQ ID NO: 52043 - DNA, 25 bp, Homo sapien
gttcacagggaaaggtaagtatata

SEQ ID NO: 52044 - DNA, 25 bp, Homo sapien
ttacgggggatgcccgtccagacgc

SEQ ID NO: 52045 - DNA, 25 bp, Homo sapien
agctgacaccactcagccggcgggg

SEQ ID NO: 52046 - DNA, 25 bp, Homo sapien
ggctgactgggcaaattggcagatc

SEQ ID NO: 52047 - DNA, 25 bp, Homo sapien
gctgactgggcaaattggcagatcc

SEQ ID NO: 52048 - DNA, 25 bp, Homo sapien
tgactgggcaaattggcagatccgc

SEQ ID NO: 52049 - DNA, 25 bp, Homo sapien
gctgacaccactcagccggcggggt

SEQ ID NO: 52050 - DNA, 25 bp, Homo sapien
tcggccttttgtgccatccgccgag

SEQ ID NO: 52051 - DNA, 25 bp, Homo sapien
ggccttttgtgccatccgccgaggc

SEQ ID NO: 52052 - DNA, 25 bp, Homo sapien
tggcatcttcttgtggttcttcctg

SEQ ID NO: 52053 - DNA, 25 bp, Homo sapien
agtaccggagccctaactggcggca

SEQ ID NO: 52054 - DNA, 25 bp, Homo sapien
cgacgccttccgcacctcgcctagg

SEQ ID NO: 52055 - DNA, 25 bp, Homo sapien
cactggcatcttcttgtggttcttc

SEQ ID NO: 52056 - DNA, 25 bp, Homo sapien
tgcgctccgcattctgctgggccgt

SEQ ID NO: 52057 - DNA, 25 bp, Homo sapien
gctctgtacgcactacgcgcctggg

SEQ ID NO: 52058 - DNA, 25 bp, Homo sapien
taccagagtagccagcgcgacgcct

SEQ ID NO: 52059 - DNA, 25 bp, Homo sapien
tcgctggctctgtacgcactacgcg

SEQ ID NO: 52060 - DNA, 25 bp, Homo sapien
gcacccggctttgtcgggatcaccg

SEQ ID NO: 52061 - DNA, 25 bp, Homo sapien
agctgtgccaagtctttgcccgcca

SEQ ID NO: 52062 - DNA, 25 bp, Homo sapien
agcgcgcctatacccggcgagagtt

SEQ ID NO: 52063 - DNA, 25 bp, Homo sapien
ggccaccacgagctgataaagctga

SEQ ID NO: 52064 - DNA, 25 bp, Homo sapien
caggaaactcagcaacccgcgggga

SEQ ID NO: 52065 - DNA, 25 bp, Homo sapien
agctcccttgattgcttcgcacctg

SEQ ID NO: 52066 - DNA, 25 bp, Homo sapien
tgtgcattccttggaagaaccgctg

SEQ ID NO: 52067 - DNA, 25 bp, Homo sapien
ctcggatctctagacagcctgagtg

SEQ ID NO: 52068 - DNA, 25 bp, Homo sapien
gatagaggtccctaattcggggctc

SEQ ID NO: 52069 - DNA, 25 bp, Homo sapien
cggtcctgccctggcgcttgaggtc

SEQ ID NO: 52070 - DNA, 25 bp, Homo sapien
cctagtgctgggaccgctgtccggc

SEQ ID NO: 52071 - DNA, 25 bp, Homo sapien
ggcgccgacgtcacaagcttccaag

SEQ ID NO: 52072 - DNA, 25 bp, Homo sapien
gccgacgtcacaagcttccaagatg

SEQ ID NO: 52073 - DNA, 25 bp, Homo sapien
cccgggctttgtgggccagatgccc

SEQ ID NO: 52074 - DNA, 25 bp, Homo sapien
acaagcttccaagatggcgctgggc

SEQ ID NO: 52075 - DNA, 25 bp, Homo sapien
cgcgtaggccgatagaggtccctaa

SEQ ID NO: 52076 - DNA, 25 bp, Homo sapien
ggcccttcaagtgttcggtctgcga

SEQ ID NO: 52077 - DNA, 25 bp, Homo sapien
ctcctagaagccaaagacccgcggg

SEQ ID NO: 52078 - DNA, 25 bp, Homo sapien
ggggcaagttcacccagcagcgcaa

SEQ ID NO: 52079 - DNA, 25 bp, Homo sapien
tggcatgcgcttcacccgtcagtac

SEQ ID NO: 52080 - DNA, 25 bp, Homo sapien
tcacacggaggaagagctgttcatc

SEQ ID NO: 52081 - DNA, 25 bp, Homo sapien
tatgtgtgcattccctgcgccaagg

SEQ ID NO: 52082 - DNA, 25 bp, Homo sapien
gcgcccactacatgtaccggcagga

SEQ ID NO: 52083 - DNA, 25 bp, Homo sapien
agaaaccttacgagtgccagctgtg

SEQ ID NO: 52084 - DNA, 25 bp, Homo sapien
tgtctcttggttcctctcggaagtc

SEQ ID NO: 52085 - DNA, 25 bp, Homo sapien
ggccatattccaggagcagaccgta

SEQ ID NO: 52086 - DNA, 25 bp, Homo sapien
accaaatgcgccttgcaggaggaga

SEQ ID NO: 52087 - DNA, 25 bp, Homo sapien
tcaagaatgaactggagctggcgga

SEQ ID NO: 52088 - DNA, 25 bp, Homo sapien
ttccctgggtccttctcaagaatga

SEQ ID NO: 52089 - DNA, 25 bp, Homo sapien
cgttgcttacgactggtcctgagga

SEQ ID NO: 52090 - DNA, 25 bp, Homo sapien
cccaattggtgacgctgcaggtgct

SEQ ID NO: 52091 - DNA, 25 bp, Homo sapien
ggagcagcaactcgcagcccaattg

SEQ ID NO: 52092 - DNA, 25 bp, Homo sapien
tagggacctctatcggcctacgcgc

SEQ ID NO: 52093 - DNA, 25 bp, Homo sapien
gcccagcgccatcttggaagcttgt

SEQ ID NO: 52094 - DNA, 25 bp, Homo sapien
catcttggaagcttgtgacgtcggc

SEQ ID NO: 52095 - DNA, 25 bp, Homo sapien
aagcttgtgacgtcggcgccgcccg

SEQ ID NO: 52096 - DNA, 25 bp, Homo sapien
ggccggacagcggtcccagcactag

SEQ ID NO: 52097 - DNA, 25 bp, Homo sapien
cgaattagggacctctatcggccta

SEQ ID NO: 52098 - DNA, 25 bp, Homo sapien
gggcatctggcccacaaagcccggg

SEQ ID NO: 52099 - DNA, 25 bp, Homo sapien
gacctcaagcgccagggcaggaccg

SEQ ID NO: 52100 - DNA, 25 bp, Homo sapien
tgccagcgaagctgcgccaacactt

SEQ ID NO: 52101 - DNA, 25 bp, Homo sapien
tgctcgccgtcagtctgccagcgaa

SEQ ID NO: 52102 - DNA, 25 bp, Homo sapien
cagcggttcttccaaggaatgcaca

SEQ ID NO: 52103 - DNA, 25 bp, Homo sapien
cagcgccgcctgcagatagcggatg

SEQ ID NO: 52104 - DNA, 25 bp, Homo sapien
cggaagtgcgccaggatgtacttga

SEQ ID NO: 52105 - DNA, 25 bp, Homo sapien
gcgggcaaagacttggcacagctcc

SEQ ID NO: 52106 - DNA, 25 bp, Homo sapien
tcagctttatcagctcgtggtggcc

SEQ ID NO: 52107 - DNA, 25 bp, Homo sapien
tcaggctgtctagagatccgagttg

SEQ ID NO: 52108 - DNA, 25 bp, Homo sapien
taaaagccattctctggcagcggcc

SEQ ID NO: 52109 - DNA, 25 bp, Homo sapien
ccgcgcgcaggctcaaggtgctaac

SEQ ID NO: 52110 - DNA, 25 bp, Homo sapien
caggcggccaaagttaggtcagttt

SEQ ID NO: 52111 - DNA, 25 bp, Homo sapien
tcgtttggaattgcgctgggtccta

SEQ ID NO: 52112 - DNA, 25 bp, Homo sapien
aggagcagcaccaaatccaagatgg

SEQ ID NO: 52113 - DNA, 25 bp, Homo sapien
gttccaactccaggaaggcctgagg

SEQ ID NO: 52114 - DNA, 25 bp, Homo sapien
ggtccgatctgagggcgtcgttaat

SEQ ID NO: 52115 - DNA, 25 bp, Homo sapien
ggtcctagcaaactgtcgccttgtg

SEQ ID NO: 52116 - DNA, 25 bp, Homo sapien
aagccggactacaaggtcgcctacg

SEQ ID NO: 52117 - DNA, 25 bp, Homo sapien
cgtgaggatcaagaagccggactac

SEQ ID NO: 52118 - DNA, 25 bp, Homo sapien
cctcgcaactgtgtccttggggatg

SEQ ID NO: 52119 - DNA, 25 bp, Homo sapien
tcgcctacgtgcagctggtgcgtgt

SEQ ID NO: 52120 - DNA, 25 bp, Homo sapien
ggcctcagcgcagaggcaggctcca

SEQ ID NO: 52121 - DNA, 25 bp, Homo sapien
gcacatggggcacgtctcagcgtcc

SEQ ID NO: 52122 - DNA, 25 bp, Homo sapien
cccgtgaggccggatctcagggcct

SEQ ID NO: 52123 - DNA, 25 bp, Homo sapien
cataaggtcatgctccgtcacggcc

SEQ ID NO: 52124 - DNA, 25 bp, Homo sapien
ccagactcgcttccgggttgagaaa

SEQ ID NO: 52125 - DNA, 25 bp, Homo sapien
tcagggaggagcacgtcctttcacc

SEQ ID NO: 52126 - DNA, 25 bp, Homo sapien
gcagctcccggaagcagcttagttg

SEQ ID NO: 52127 - DNA, 25 bp, Homo sapien
acaccttgagcgaccgggagtagct

SEQ ID NO: 52128 - DNA, 25 bp, Homo sapien
gataccctcctcgtgcttccgtgtg

SEQ ID NO: 52129 - DNA, 25 bp, Homo sapien
ccagtgtttgaatgcggaagtcatc

SEQ ID NO: 52130 - DNA, 25 bp, Homo sapien
tgaggcaaatccacgtctccggccg

SEQ ID NO: 52131 - DNA, 25 bp, Homo sapien
ccggaatcccatcttgccaaggaag

SEQ ID NO: 52132 - DNA, 25 bp, Homo sapien
gtgtcactcctcaggcagcggccag

SEQ ID NO: 52133 - DNA, 25 bp, Homo sapien
tcctcggaagcgtggaccaatcaaa

SEQ ID NO: 52134 - DNA, 25 bp, Homo sapien
tgctgaagctgctcaatacgcacca

SEQ ID NO: 52135 - DNA, 25 bp, Homo sapien
gccagcaatcggtgaccggcgtaga

SEQ ID NO: 52136 - DNA, 25 bp, Homo sapien
gtcggacgacgccaatagctactgg

SEQ ID NO: 52137 - DNA, 25 bp, Homo sapien
ggctgcactcgcacgacatcaaata

SEQ ID NO: 52138 - DNA, 25 bp, Homo sapien
acatcaaatacggatccggtgcgtg

SEQ ID NO: 52139 - DNA, 25 bp, Homo sapien
ttccctgggcactcattggtaagtc

SEQ ID NO: 52140 - DNA, 25 bp, Homo sapien
cttcagggcggtcgatcttgctgat

SEQ ID NO: 52141 - DNA, 25 bp, Homo sapien
ggcaacgcgccgcagctctgacggt

SEQ ID NO: 52142 - DNA, 25 bp, Homo sapien
agtgtgtatttcaaggcctcgctgg

SEQ ID NO: 52143 - DNA, 25 bp, Homo sapien
cttccggtccttgagcccgatgtag

SEQ ID NO: 52144 - DNA, 25 bp, Homo sapien
cacgcggacccacttctaggagatg

SEQ ID NO: 52145 - DNA, 25 bp, Homo sapien
cccacttctaggagatgcgcagccg

SEQ ID NO: 52146 - DNA, 25 bp, Homo sapien
agcggacaaagttccgggacatccg

SEQ ID NO: 52147 - DNA, 25 bp, Homo sapien
ggagccgtcgtggtactccaccaca

SEQ ID NO: 52148 - DNA, 25 bp, Homo sapien
tcgggaatttccacagggtctcggc

SEQ ID NO: 52149 - DNA, 25 bp, Homo sapien
cattgttaaaaccacggagcccgag

SEQ ID NO: 52150 - DNA, 25 bp, Homo sapien
cccggaggctattttgaaatctctc

SEQ ID NO: 52151 - DNA, 25 bp, Homo sapien
cctccgactgtcagcgggttaaaga

SEQ ID NO: 52152 - DNA, 25 bp, Homo sapien
atggccgggatcctcttccgtctaa

SEQ ID NO: 52153 - DNA, 25 bp, Homo sapien
gccctctttggagcagggaactcta

SEQ ID NO: 52154 - DNA, 25 bp, Homo sapien
gcgctcttgtcggtgtcgctagaaa

SEQ ID NO: 52155 - DNA, 25 bp, Homo sapien
tccagagtgtatctagtgcagggca

SEQ ID NO: 52156 - DNA, 25 bp, Homo sapien
agttgctgaccaaccacgtcctcgg

SEQ ID NO: 52157 - DNA, 25 bp, Homo sapien
cgcgctcgctcgtagagatcctaga

SEQ ID NO: 52158 - DNA, 25 bp, Homo sapien
acaagttcgacagcgaggtcccgca

SEQ ID NO: 52159 - DNA, 25 bp, Homo sapien
tacaattggaacagcgcgggctctc

SEQ ID NO: 52160 - DNA, 25 bp, Homo sapien
gggctctcttttttccggatgcggc

SEQ ID NO: 52161 - DNA, 25 bp, Homo sapien
ccctaggaaagagctccgacgattg

SEQ ID NO: 52162 - DNA, 25 bp, Homo sapien
gcagggtaggatctatcagaaagcc

SEQ ID NO: 52163 - DNA, 25 bp, Homo sapien
tgcagtaggctagagagtccgcacc

SEQ ID NO: 52164 - DNA, 25 bp, Homo sapien
ccatggggaagcgacagcaccaaaa

SEQ ID NO: 52165 - DNA, 25 bp, Homo sapien
gagcacctggcgctagcgaaccaca

SEQ ID NO: 52166 - DNA, 25 bp, Homo sapien
ctgtctccagtcagggtaatgaccc

SEQ ID NO: 52167 - DNA, 25 bp, Homo sapien
aatgtaagttgagccgcagtcggga

SEQ ID NO: 52168 - DNA, 25 bp, Homo sapien
cggctccatggtctgagttgtcagc

SEQ ID NO: 52169 - DNA, 25 bp, Homo sapien
ccatactgggcaggcgatccttccg

SEQ ID NO: 52170 - DNA, 25 bp, Homo sapien
gatccttccgagcatgagcacctgg

SEQ ID NO: 52171 - DNA, 25 bp, Homo sapien
agccgttgttttttcgtgctcgcta

SEQ ID NO: 52172 - DNA, 25 bp, Homo sapien
cacacggaattgaagaggtaggcgc

SEQ ID NO: 52173 - DNA, 25 bp, Homo sapien
aagaaggtcccgtgagattggctgc

SEQ ID NO: 52174 - DNA, 25 bp, Homo sapien
cgggctgaaccagggtactcacacg

SEQ ID NO: 52175 - DNA, 25 bp, Homo sapien
attggctgcgagtgctttctggaac

SEQ ID NO: 52176 - DNA, 25 bp, Homo sapien
tttctggaacgaagcggtgctgccc

SEQ ID NO: 52177 - DNA, 25 bp, Homo sapien
acgaagcggtgctgcccagaaccag

SEQ ID NO: 52178 - DNA, 25 bp, Homo sapien
ccagggtactcacacggaattgaag

SEQ ID NO: 52179 - DNA, 25 bp, Homo sapien
aggactgaaagaagaaggtcccgtg

SEQ ID NO: 52180 - DNA, 25 bp, Homo sapien
ctcggagccagcctgtaagggccga

SEQ ID NO: 52181 - DNA, 25 bp, Homo sapien
cccagaatgcggtcgtccgtgctgt

SEQ ID NO: 52182 - DNA, 25 bp, Homo sapien
cagacgccgttaacagccttggagc

SEQ ID NO: 52183 - DNA, 25 bp, Homo sapien
aggcgagcttgtgtgcgcctgacca

SEQ ID NO: 52184 - DNA, 25 bp, Homo sapien
tgccctttgttttggagccgtagcc

SEQ ID NO: 52185 - DNA, 25 bp, Homo sapien
tggtggtcactcgttcctccggctc

SEQ ID NO: 52186 - DNA, 25 bp, Homo sapien
cacagtatccttgggtggccacaaa

SEQ ID NO: 52187 - DNA, 25 bp, Homo sapien
cgctgaggccgttaacgcctaggca

SEQ ID NO: 52188 - DNA, 25 bp, Homo sapien
gtccagactttaaaggccgcgctgc

SEQ ID NO: 52189 - DNA, 25 bp, Homo sapien
gggaaccgcgagcaacaacacctaa

SEQ ID NO: 52190 - DNA, 25 bp, Homo sapien
ccctcgccgatgtacgagaggttgg

SEQ ID NO: 52191 - DNA, 25 bp, Homo sapien
agccgacagccactcggaccgattg

SEQ ID NO: 52192 - DNA, 25 bp, Homo sapien
cggtcacgtgcattcgcggtgcatt

SEQ ID NO: 52193 - DNA, 25 bp, Homo sapien
tgcgggtcgcgtctcttaagacacc

SEQ ID NO: 52194 - DNA, 25 bp, Homo sapien
gaaggccatgatactagcaaattga

SEQ ID NO: 52195 - DNA, 25 bp, Homo sapien
cgttgccttcccgagggtccagact

SEQ ID NO: 52196 - DNA, 25 bp, Homo sapien
actggccggcgacttcccaaaggcg

SEQ ID NO: 52197 - DNA, 25 bp, Homo sapien
tggacgggagcactcacagacaagc

SEQ ID NO: 52198 - DNA, 25 bp, Homo sapien
ccatcttgcggcgagtgttccggat

SEQ ID NO: 52199 - DNA, 25 bp, Homo sapien
ggacacgtgccggtcctccatcttg

SEQ ID NO: 52200 - DNA, 25 bp, Homo sapien
ggcacctgcttctgccactggccgg

SEQ ID NO: 52201 - DNA, 25 bp, Homo sapien
acaagccgaagagctggttgaagga

SEQ ID NO: 52202 - DNA, 25 bp, Homo sapien
ggagcactcacagacaagccgaaga

SEQ ID NO: 52203 - DNA, 25 bp, Homo sapien
ggtcctccatcttgcggcgagtgtt

SEQ ID NO: 52204 - DNA, 25 bp, Homo sapien
ctctacagcatgctcgaggaggaga

SEQ ID NO: 52205 - DNA, 25 bp, Homo sapien
cgagaaagacgagagccctgaaggc

SEQ ID NO: 52206 - DNA, 25 bp, Homo sapien
agacgagagccctgaaggcagcgct

SEQ ID NO: 52207 - DNA, 25 bp, Homo sapien
ggcagcgctgccgacgacctctaca

SEQ ID NO: 52208 - DNA, 25 bp, Homo sapien
cgacgacctctacagcatgctcgag

SEQ ID NO: 52209 - DNA, 25 bp, Homo sapien
tctacagcatgctcgaggaggagag

SEQ ID NO: 52210 - DNA, 25 bp, Homo sapien
acgacctctacagcatgctcgagga

SEQ ID NO: 52211 - DNA, 25 bp, Homo sapien
acctctacagcatgctcgaggagga

SEQ ID NO: 52212 - DNA, 25 bp, Homo sapien
caaggctgcgctcccagggaatgcg

SEQ ID NO: 52213 - DNA, 25 bp, Homo sapien
tctcccaggctaaggcaaggctgcg

SEQ ID NO: 52214 - DNA, 25 bp, Homo sapien
ctgtggacagctgtctcccaggcta

SEQ ID NO: 52215 - DNA, 25 bp, Homo sapien
caatggccgcctgtcactgtggaca

SEQ ID NO: 52216 - DNA, 25 bp, Homo sapien
gctggctcggccgagaacaatggcc

SEQ ID NO: 52217 - DNA, 25 bp, Homo sapien
cgcgtggacggacagagacccatca

SEQ ID NO: 52218 - DNA, 25 bp, Homo sapien
tggtgccggcgcagcaacgctcctt

SEQ ID NO: 52219 - DNA, 25 bp, Homo sapien
gggcacccactgatgctggcggcct

SEQ ID NO: 52220 - DNA, 25 bp, Homo sapien
tggctcacagacctgtggctgaagc

SEQ ID NO: 52221 - DNA, 25 bp, Homo sapien
cggccctttagtggtaggcgaactg

SEQ ID NO: 52222 - DNA, 25 bp, Homo sapien
agctgacgctcgcttcacggacgct

SEQ ID NO: 52223 - DNA, 25 bp, Homo sapien
tggggagaggccaaatctcggaaaa

SEQ ID NO: 52224 - DNA, 25 bp, Homo sapien
agcctcgggttcctcatgtccgcag

SEQ ID NO: 52225 - DNA, 25 bp, Homo sapien
tgcacccatgtgagcctcgtctcgg

SEQ ID NO: 52226 - DNA, 25 bp, Homo sapien
ccgagcacttgtgcagctgacgctc

SEQ ID NO: 52227 - DNA, 25 bp, Homo sapien
caccctttcggtgcacccatgtgag

SEQ ID NO: 52228 - DNA, 25 bp, Homo sapien
caggaggccgcatgcttcagctcca

SEQ ID NO: 52229 - DNA, 25 bp, Homo sapien
gcgttctcgaagcagtgcgctacca

SEQ ID NO: 52230 - DNA, 25 bp, Homo sapien
gctcctggaagacggggtcacaaaa

SEQ ID NO: 52231 - DNA, 25 bp, Homo sapien
ggaagacggggtcacaaaagacgca

SEQ ID NO: 52232 - DNA, 25 bp, Homo sapien
cttggccttgttgaagtccacatca

SEQ ID NO: 52233 - DNA, 25 bp, Homo sapien
gtccacatcaagcaaggcggcctca

SEQ ID NO: 52234 - DNA, 25 bp, Homo sapien
agacactgcaggtgtcggcggacac

SEQ ID NO: 52235 - DNA, 25 bp, Homo sapien
agcaaggcggcctcacagacactgc

SEQ ID NO: 52236 - DNA, 25 bp, Homo sapien
aggttcctgccgttttgcgaggctg

SEQ ID NO: 52237 - DNA, 25 bp, Homo sapien
ccacggcgctcaaggtaatagggtc

SEQ ID NO: 52238 - DNA, 25 bp, Homo sapien
ggaacgcaacccacacaaacctgga

SEQ ID NO: 52239 - DNA, 25 bp, Homo sapien
cgccttcgcatgcagacgtggagaa

SEQ ID NO: 52240 - DNA, 25 bp, Homo sapien
cgctgtacagcacgtggccacttct

SEQ ID NO: 52241 - DNA, 25 bp, Homo sapien
ttccgggccacgaagacaaaggcgc

SEQ ID NO: 52242 - DNA, 25 bp, Homo sapien
ctgcggggtagaaagcgcagttcta

SEQ ID NO: 52243 - DNA, 25 bp, Homo sapien
tgcccgccattctcagggcctggga

SEQ ID NO: 52244 - DNA, 25 bp, Homo sapien
tcggcgttcttaggttccgtggctc

SEQ ID NO: 52245 - DNA, 25 bp, Homo sapien
ccgccagggaagaggcaacaagaat

SEQ ID NO: 52246 - DNA, 25 bp, Homo sapien
gcaacaagaatgcagagcccggccc

SEQ ID NO: 52247 - DNA, 25 bp, Homo sapien
tccgccggccaacgttcaggaaaca

SEQ ID NO: 52248 - DNA, 25 bp, Homo sapien
gcggatccagctccggtccttgttc

SEQ ID NO: 52249 - DNA, 25 bp, Homo sapien
tggctcgcggattccgggagcaccc

SEQ ID NO: 52250 - DNA, 25 bp, Homo sapien
gagtggcacttgcacgccgcggacc

SEQ ID NO: 52251 - DNA, 25 bp, Homo sapien
ccagaaaaatgcgtgcgcttcccgc

SEQ ID NO: 52252 - DNA, 25 bp, Homo sapien
caggtgtttttgacaaccagtttat

SEQ ID NO: 52253 - DNA, 25 bp, Homo sapien
agacaggtgtttttgacaaccagtt

SEQ ID NO: 52254 - DNA, 25 bp, Homo sapien
cacgcccagccagtttgattccaat

SEQ ID NO: 52255 - DNA, 25 bp, Homo sapien
acgcccagccagtttgattccaatt

SEQ ID NO: 52256 - DNA, 25 bp, Homo sapien
cgcccagccagtttgattccaattt

SEQ ID NO: 52257 - DNA, 25 bp, Homo sapien
caattttaacagacaggtgtttttg

SEQ ID NO: 52258 - DNA, 25 bp, Homo sapien
taacagacaggtgtttttgacaacc

SEQ ID NO: 52259 - DNA, 25 bp, Homo sapien
acagacaggtgtttttgacaaccag

SEQ ID NO: 52260 - DNA, 25 bp, Homo sapien
gcggctcgccatgaaatccctcaag

SEQ ID NO: 52261 - DNA, 25 bp, Homo sapien
agctaggagcatgcgcgcgctctga

SEQ ID NO: 52262 - DNA, 25 bp, Homo sapien
gtccagtggagacctgcgattggct

SEQ ID NO: 52263 - DNA, 25 bp, Homo sapien
ctgtattgcaaaggccgctccggca

SEQ ID NO: 52264 - DNA, 25 bp, Homo sapien
atcagctgctgttcgcgagctgccg

SEQ ID NO: 52265 - DNA, 25 bp, Homo sapien
ctcagggaacgctgaagccgcgcca

SEQ ID NO: 52266 - DNA, 25 bp, Homo sapien
cgtccttaccagtccggatcagctg

SEQ ID NO: 52267 - DNA, 25 bp, Homo sapien
ctgatgtaaaagtggcgcccgctga

SEQ ID NO: 52268 - DNA, 25 bp, Homo sapien
tccacagaaatccacgcattcacgc

SEQ ID NO: 52269 - DNA, 25 bp, Homo sapien
ctgctttccctacattcagggctgc

SEQ ID NO: 52270 - DNA, 25 bp, Homo sapien
tcagggctgctccttttgtcgccaa

SEQ ID NO: 52271 - DNA, 25 bp, Homo sapien
ggctgctccttttgtcgccaataca

SEQ ID NO: 52272 - DNA, 25 bp, Homo sapien
tcgccaatacaaacctgttgacagg

SEQ ID NO: 52273 - DNA, 25 bp, Homo sapien
cctgttgacaggtcacgcctgggaa

SEQ ID NO: 52274 - DNA, 25 bp, Homo sapien
aaaactttctgaggcccgcgcatgc

SEQ ID NO: 52275 - DNA, 25 bp, Homo sapien
agctgtaccctgaagcctcgccgga

SEQ ID NO: 52276 - DNA, 25 bp, Homo sapien
tttcggtttggcactgttggcagca

SEQ ID NO: 52277 - DNA, 25 bp, Homo sapien
agagccatggcggagaggtgccgtc

SEQ ID NO: 52278 - DNA, 25 bp, Homo sapien
agcagtgtctcaggagagccatggc

SEQ ID NO: 52279 - DNA, 25 bp, Homo sapien
gcagcagtgtctcaggagagccatg

SEQ ID NO: 52280 - DNA, 25 bp, Homo sapien
ctggtgagggaactccggcccgcct

SEQ ID NO: 52281 - DNA, 25 bp, Homo sapien
cggtttggcactgttggcagcaaga

SEQ ID NO: 52282 - DNA, 25 bp, Homo sapien
cagcaagaacccgagaagggccggg

SEQ ID NO: 52283 - DNA, 25 bp, Homo sapien
ggccgggaagggatccgagggcagc

SEQ ID NO: 52284 - DNA, 25 bp, Homo sapien
cgcagacggacagctagcagttctc

SEQ ID NO: 52285 - DNA, 25 bp, Homo sapien
gcgattgtaatacgttcccggctca

SEQ ID NO: 52286 - DNA, 25 bp, Homo sapien
tgagtatcgacctgctgcgattgta

SEQ ID NO: 52287 - DNA, 25 bp, Homo sapien
agttctcggtcactgctcttgcagc

SEQ ID NO: 52288 - DNA, 25 bp, Homo sapien
ccaggacgcagcgtcagggatgccc

SEQ ID NO: 52289 - DNA, 25 bp, Homo sapien
cagctcggcagatgctctgtgctgc

SEQ ID NO: 52290 - DNA, 25 bp, Homo sapien
cgctgcccgcgtcgtacggaacgag

SEQ ID NO: 52291 - DNA, 25 bp, Homo sapien
cgagcaggttcctcacaggcattta

SEQ ID NO: 52292 - DNA, 25 bp, Homo sapien
cggcctactacctgaacgacctgga

SEQ ID NO: 52293 - DNA, 25 bp, Homo sapien
tgggcaccagcaactcaggcaagag

SEQ ID NO: 52294 - DNA, 25 bp, Homo sapien
taccacctggaggacaacgcggcct

SEQ ID NO: 52295 - DNA, 25 bp, Homo sapien
cgcctacgacgctgtgcagctcttt

SEQ ID NO: 52296 - DNA, 25 bp, Homo sapien
tgaagatcatccacagcggcggctt

SEQ ID NO: 52297 - DNA, 25 bp, Homo sapien
gcgcatcgccgcagctgactatatc

SEQ ID NO: 52298 - DNA, 25 bp, Homo sapien
ggcaacgccgcgaaatcaagctgct

SEQ ID NO: 52299 - DNA, 25 bp, Homo sapien
gtcccggagaattgaccgccacctg

SEQ ID NO: 52300 - DNA, 25 bp, Homo sapien
cgcaggcgcaaacagcccaaggctg

SEQ ID NO: 52301 - DNA, 25 bp, Homo sapien
cggccggagacaaaagaccgtgatt

SEQ ID NO: 52302 - DNA, 25 bp, Homo sapien
gcgccactggccaacctattcagtt

SEQ ID NO: 52303 - DNA, 25 bp, Homo sapien
caacctattcagttgccaggcgaca

SEQ ID NO: 52304 - DNA, 25 bp, Homo sapien
cagttgccaggcgacatcgttgcca

SEQ ID NO: 52305 - DNA, 25 bp, Homo sapien
acatcgttgccaggcgactccagca

SEQ ID NO: 52306 - DNA, 25 bp, Homo sapien
gcgccgcggtcgacataatcagcac

SEQ ID NO: 52307 - DNA, 25 bp, Homo sapien
ataatcagcacccactgcgcaggcg

SEQ ID NO: 52308 - DNA, 25 bp, Homo sapien
tgtacaggggacaaagctacacatg

SEQ ID NO: 52309 - DNA, 25 bp, Homo sapien
tgggtgtcacagagaccgataccgg

SEQ ID NO: 52310 - DNA, 25 bp, Homo sapien
ctcgcggatgctgacgcagaatgga

SEQ ID NO: 52311 - DNA, 25 bp, Homo sapien
tcccacaggacgaatgtagacggtg

SEQ ID NO: 52312 - DNA, 25 bp, Homo sapien
agccaggccgctttctttgcggatg

SEQ ID NO: 52313 - DNA, 25 bp, Homo sapien
agcttcaagaggtggccgagattcc

SEQ ID NO: 52314 - DNA, 25 bp, Homo sapien
cttctgcgacctctagggccctaga

SEQ ID NO: 52315 - DNA, 25 bp, Homo sapien
aaaatgtgtgggctctccgtccttt

SEQ ID NO: 52316 - DNA, 25 bp, Homo sapien
gcccacgacgtcgacgattcgtgta

SEQ ID NO: 52317 - DNA, 25 bp, Homo sapien
ggcgtcctcatttccggagcgcaaa

SEQ ID NO: 52318 - DNA, 25 bp, Homo sapien
tataacttgaaagcggcctgcggcc

SEQ ID NO: 52319 - DNA, 25 bp, Homo sapien
cgtggctctcgttgccatggtgatc

SEQ ID NO: 52320 - DNA, 25 bp, Homo sapien
atcgccggtgcaagctggatgcttg

SEQ ID NO: 52321 - DNA, 25 bp, Homo sapien
gactccaggcaggttctcgttgcta

SEQ ID NO: 52322 - DNA, 25 bp, Homo sapien
ccgcccttgttgtcatggtgatctc

SEQ ID NO: 52323 - DNA, 25 bp, Homo sapien
tcacagccatcgctggtgagtcagc

SEQ ID NO: 52324 - DNA, 25 bp, Homo sapien
ctgcagacgttgctggccaaggaaa

SEQ ID NO: 52325 - DNA, 25 bp, Homo sapien
aaggacaacctgatcgacgccaatg

SEQ ID NO: 52326 - DNA, 25 bp, Homo sapien
ccatgcagatggagcgcaaaaagtc

SEQ ID NO: 52327 - DNA, 25 bp, Homo sapien
ggagcgcttccgcatgatctacctg

SEQ ID NO: 52328 - DNA, 25 bp, Homo sapien
tgaacgtcgagtttcaccacgagcg

SEQ ID NO: 52329 - DNA, 25 bp, Homo sapien
cgagaagcccttctacgtgaacgtc

SEQ ID NO: 52330 - DNA, 25 bp, Homo sapien
ggagtaccagccctaccagagcatc

SEQ ID NO: 52331 - DNA, 25 bp, Homo sapien
aggtccaacttcgagcggatccgca

SEQ ID NO: 52332 - DNA, 25 bp, Homo sapien
ggctgtggcacttcaccaactgcga

SEQ ID NO: 52333 - DNA, 25 bp, Homo sapien
ctgctccggcgccagatagcctggg

SEQ ID NO: 52334 - DNA, 25 bp, Homo sapien
caggccgggaagagtacaaggacaa

SEQ ID NO: 52335 - DNA, 25 bp, Homo sapien
gtggcacttcaccaactgcgacctg

SEQ ID NO: 52336 - DNA, 25 bp, Homo sapien
acatgtgctcctacctcgacatgcg

SEQ ID NO: 52337 - DNA, 25 bp, Homo sapien
tgctgcacatgtgctcctacctcga

SEQ ID NO: 52338 - DNA, 25 bp, Homo sapien
gaggtcaggtttgggcctacatccc

SEQ ID NO: 52339 - DNA, 25 bp, Homo sapien
caaggaggtcaggtttgggcctaca

SEQ ID NO: 52340 - DNA, 25 bp, Homo sapien
gcttccgttgcaaatgatgtccagg

SEQ ID NO: 52341 - DNA, 25 bp, Homo sapien
cttccgttgcaaatgatgtccaggg

SEQ ID NO: 52342 - DNA, 25 bp, Homo sapien
ttccgttgcaaatgatgtccaggga

SEQ ID NO: 52343 - DNA, 25 bp, Homo sapien
cgttgcaaatgatgtccagggaggc

SEQ ID NO: 52344 - DNA, 25 bp, Homo sapien
tgcaaatgatgtccagggaggcgcc

SEQ ID NO: 52345 - DNA, 25 bp, Homo sapien
agcacactgctctggccacactttt

SEQ ID NO: 52346 - DNA, 25 bp, Homo sapien
actgctctggccacacttttcgccc

SEQ ID NO: 52347 - DNA, 25 bp, Homo sapien
cggcttccgttgcaaatgatgtcca

SEQ ID NO: 52348 - DNA, 25 bp, Homo sapien
gggcagcggcatgactgacagacac

SEQ ID NO: 52349 - DNA, 25 bp, Homo sapien
cgggctgaccgctgtcttgtctctt

SEQ ID NO: 52350 - DNA, 25 bp, Homo sapien
ctcgggttccaagatgcagctactg

SEQ ID NO: 52351 - DNA, 25 bp, Homo sapien
tgcagctactggagacagagttctc

SEQ ID NO: 52352 - DNA, 25 bp, Homo sapien
cagagttctcgcacaccgtgggcga

SEQ ID NO: 52353 - DNA, 25 bp, Homo sapien
gggcatagccagagccactctactt

SEQ ID NO: 52354 - DNA, 25 bp, Homo sapien
tgacagacacgctgggacctacgtc

SEQ ID NO: 52355 - DNA, 25 bp, Homo sapien
tcttcagcctccagaccgtggcgta

SEQ ID NO: 52356 - DNA, 25 bp, Homo sapien
ctccagatggtgtgctcatgaaggc

SEQ ID NO: 52357 - DNA, 25 bp, Homo sapien
atggtgtgctcatgaaggcgacatc

SEQ ID NO: 52358 - DNA, 25 bp, Homo sapien
tgtgctcatgaaggcgacatcttcc

SEQ ID NO: 52359 - DNA, 25 bp, Homo sapien
tgaaggcgacatcttcctgggctgc

SEQ ID NO: 52360 - DNA, 25 bp, Homo sapien
gatggggccggctccacagacgtcc

SEQ ID NO: 52361 - DNA, 25 bp, Homo sapien
gacgtccctaccgtggagctccaga

SEQ ID NO: 52362 - DNA, 25 bp, Homo sapien
gtccctaccgtggagctccagatgg

SEQ ID NO: 52363 - DNA, 25 bp, Homo sapien
cgtgttgctcttgggctggccccca

SEQ ID NO: 52364 - DNA, 25 bp, Homo sapien
tgagcccagggtctgtagttccgaa

SEQ ID NO: 52365 - DNA, 25 bp, Homo sapien
tctgtagttccgaaaacgtctggga

SEQ ID NO: 52366 - DNA, 25 bp, Homo sapien
agccttcaacgcctggaaaccaacg

SEQ ID NO: 52367 - DNA, 25 bp, Homo sapien
ccaaaggcaaacaaagaacagtttg

SEQ ID NO: 52368 - DNA, 25 bp, Homo sapien
ccaaggtcccgctgcgaatgcgcag

SEQ ID NO: 52369 - DNA, 25 bp, Homo sapien
cctcgcgggcacgtcgctatggcaa

SEQ ID NO: 52370 - DNA, 25 bp, Homo sapien
tcgctatggcaacgatgttactctc

SEQ ID NO: 52371 - DNA, 25 bp, Homo sapien
atgttactctctgcggccgctttcc

SEQ ID NO: 52372 - DNA, 25 bp, Homo sapien
cagggtccggtcgtgccagacgctc

SEQ ID NO: 52373 - DNA, 25 bp, Homo sapien
tcgtgccagacgctcgatgacagcc

SEQ ID NO: 52374 - DNA, 25 bp, Homo sapien
gggtctgcagccgtcagcgccaagc

SEQ ID NO: 52375 - DNA, 25 bp, Homo sapien
cggctccgccgagagatcgataact

SEQ ID NO: 52376 - DNA, 25 bp, Homo sapien
ccgccgagagatcgataactaattt

SEQ ID NO: 52377 - DNA, 25 bp, Homo sapien
taactaatttcaccgcggtagccgc

SEQ ID NO: 52378 - DNA, 25 bp, Homo sapien
caccgggcggcaggaaaactcattt

SEQ ID NO: 52379 - DNA, 25 bp, Homo sapien
gatcaattgacaccgccaccgggcg

SEQ ID NO: 52380 - DNA, 25 bp, Homo sapien
ggtagcgccaacgtgcagccataca

SEQ ID NO: 52381 - DNA, 25 bp, Homo sapien
cagtctacggggataagagctgcgc

SEQ ID NO: 52382 - DNA, 25 bp, Homo sapien
aacgggactcgacaggagcgcttct

SEQ ID NO: 52383 - DNA, 25 bp, Homo sapien
tcagccttcgcctaggaacgggact

SEQ ID NO: 52384 - DNA, 25 bp, Homo sapien
tctctcggggatacagcatcccgtc

SEQ ID NO: 52385 - DNA, 25 bp, Homo sapien
ccagctccggggcactacggtgaag

SEQ ID NO: 52386 - DNA, 25 bp, Homo sapien
gcagccatacaacagcagccggaga

SEQ ID NO: 52387 - DNA, 25 bp, Homo sapien
gcgacttaggtcgtccgcgccatct

SEQ ID NO: 52388 - DNA, 25 bp, Homo sapien
gagagtctctccagtcggcatggtg

SEQ ID NO: 52389 - DNA, 25 bp, Homo sapien
ggacccgaatcaggagagtctctcc

SEQ ID NO: 52390 - DNA, 25 bp, Homo sapien
cccgggacacaaggacccgaatcag

SEQ ID NO: 52391 - DNA, 25 bp, Homo sapien
cgcgattggggacacgcacacccag

SEQ ID NO: 52392 - DNA, 25 bp, Homo sapien
acttccgggaccactctaggccgcg

SEQ ID NO: 52393 - DNA, 25 bp, Homo sapien
gactcaggtcacaccggcggacgcg

SEQ ID NO: 52394 - DNA, 25 bp, Homo sapien
tggtcaggcggactcaggtcacacc

SEQ ID NO: 52395 - DNA, 25 bp, Homo sapien
tccagtcggcatggtggctctggcc

SEQ ID NO: 52396 - DNA, 25 bp, Homo sapien
agtgccttctgttaggaccaccgca

SEQ ID NO: 52397 - DNA, 25 bp, Homo sapien
ccgtcttcgactgttggccaaaatg

SEQ ID NO: 52398 - DNA, 25 bp, Homo sapien
ggcctttacgcgacatccgagcagc

SEQ ID NO: 52399 - DNA, 25 bp, Homo sapien
gcagcgtgtctatcccaaaggccta

SEQ ID NO: 52400 - DNA, 25 bp, Homo sapien
ttgcccggctcggtcaaatctagcg

SEQ ID NO: 52401 - DNA, 25 bp, Homo sapien
caagtttgaagcctgcggcctcgca

SEQ ID NO: 52402 - DNA, 25 bp, Homo sapien
tttagcagcttcgttccaggccagg

SEQ ID NO: 52403 - DNA, 25 bp, Homo sapien
gcgcttgtcacagccggcgcaaaaa

SEQ ID NO: 52404 - DNA, 25 bp, Homo sapien
aggcagaggcgcacttgataggcaa

SEQ ID NO: 52405 - DNA, 25 bp, Homo sapien
gtgcttcgggcagcgaaaaaaccca

SEQ ID NO: 52406 - DNA, 25 bp, Homo sapien
cctctcgagggcagtggaaaataca

SEQ ID NO: 52407 - DNA, 25 bp, Homo sapien
tagactccgtgcgtgtcaaggccag

SEQ ID NO: 52408 - DNA, 25 bp, Homo sapien
gggctcgaagcaggaacctaggata

SEQ ID NO: 52409 - DNA, 25 bp, Homo sapien
tgcacgcgtgctaagaaggagactc

SEQ ID NO: 52410 - DNA, 25 bp, Homo sapien
taattcgctggcgacagcttccgcg

SEQ ID NO: 52411 - DNA, 25 bp, Homo sapien
aagccacttgagtgtagactccgtg

SEQ ID NO: 52412 - DNA, 25 bp, Homo sapien
ttccctctaggcgtgatagacagcg

SEQ ID NO: 52413 - DNA, 25 bp, Homo sapien
cgaaacgctttctggttccctctag

SEQ ID NO: 52414 - DNA, 25 bp, Homo sapien
aggcgtgatagacagcgagcttgca

SEQ ID NO: 52415 - DNA, 25 bp, Homo sapien
ggacgggactccacgctggactcac

SEQ ID NO: 52416 - DNA, 25 bp, Homo sapien
ggactccacgctggactcacgcttg

SEQ ID NO: 52417 - DNA, 25 bp, Homo sapien
tggactcacgcttgctcccagcgtg

SEQ ID NO: 52418 - DNA, 25 bp, Homo sapien
cggctgctaggagagttcagaacaa

SEQ ID NO: 52419 - DNA, 25 bp, Homo sapien
agcgtggggacctgcctctcgcgct

SEQ ID NO: 52420 - DNA, 25 bp, Homo sapien
tacatgatcggctccgaggtagccc

SEQ ID NO: 52421 - DNA, 25 bp, Homo sapien
gtcagacgcaaagaaacgggatatt

SEQ ID NO: 52422 - DNA, 25 bp, Homo sapien
ccctcatcgacctgggatttcctta

SEQ ID NO: 52423 - DNA, 25 bp, Homo sapien
agaagcccgtgaagttccagctgga

SEQ ID NO: 52424 - DNA, 25 bp, Homo sapien
atgatggcgctgagcaagaccttcg

SEQ ID NO: 52425 - DNA, 25 bp, Homo sapien
tctgccgccgcaatgatgatgatgg

SEQ ID NO: 52426 - DNA, 25 bp, Homo sapien
ctgggttggtttccagtcagacgca

SEQ ID NO: 52427 - DNA, 25 bp, Homo sapien
ggacgacggcgagttctacatgatc

SEQ ID NO: 52428 - DNA, 25 bp, Homo sapien
tcccgccagaggctgtaaccaaggc

SEQ ID NO: 52429 - DNA, 25 bp, Homo sapien
cggggctaagatcgtatgggttaca

SEQ ID NO: 52430 - DNA, 25 bp, Homo sapien
agccctcttccagcatgcggcagta

SEQ ID NO: 52431 - DNA, 25 bp, Homo sapien
tagcggaacctacggcgtcggtata

SEQ ID NO: 52432 - DNA, 25 bp, Homo sapien
gcgcaggatacacgaagagcatgtt

SEQ ID NO: 52433 - DNA, 25 bp, Homo sapien
ctggaacttccggaacacaaggtgc

SEQ ID NO: 52434 - DNA, 25 bp, Homo sapien
tttcgcggctttctaggagaggacc

SEQ ID NO: 52435 - DNA, 25 bp, Homo sapien
tgaaccttctcaagcacgcgtggcc

SEQ ID NO: 52436 - DNA, 25 bp, Homo sapien
acagggcaagtgaaatcgcaccggg

SEQ ID NO: 52437 - DNA, 25 bp, Homo sapien
accttcgcgagtcggcggcaatcgc

SEQ ID NO: 52438 - DNA, 25 bp, Homo sapien
accactgaaccttcgcgagtcggcg

SEQ ID NO: 52439 - DNA, 25 bp, Homo sapien
ggcgcaggcctcctttgtgtcaccg

SEQ ID NO: 52440 - DNA, 25 bp, Homo sapien
aactcggtacaacggccaggactgg

SEQ ID NO: 52441 - DNA, 25 bp, Homo sapien
ctgcaactcggtacaacggccagga

SEQ ID NO: 52442 - DNA, 25 bp, Homo sapien
gcaggaggctgcaactcggtacaac

SEQ ID NO: 52443 - DNA, 25 bp, Homo sapien
aatcgctggtgctgggttccgcaga

SEQ ID NO: 52444 - DNA, 25 bp, Homo sapien
ccactttgttaactacgcttggtag

SEQ ID NO: 52445 - DNA, 25 bp, Homo sapien
ctcatttcccgtctgcgcgtgcgtg

SEQ ID NO: 52446 - DNA, 25 bp, Homo sapien
attggagacacagcctgttgcgccc

SEQ ID NO: 52447 - DNA, 25 bp, Homo sapien
ctacgcttggtagtcagggtgtccc

SEQ ID NO: 52448 - DNA, 25 bp, Homo sapien
ccagcaggacagtatggatggcaca

SEQ ID NO: 52449 - DNA, 25 bp, Homo sapien
aggacagtatggatggcacacccgc

SEQ ID NO: 52450 - DNA, 25 bp, Homo sapien
atggatggcacacccgccgaacact

SEQ ID NO: 52451 - DNA, 25 bp, Homo sapien
tcgccacattggagacacagcctgt

SEQ ID NO: 52452 - DNA, 25 bp, Homo sapien
tgggtctatctttcggtctttccta

SEQ ID NO: 52453 - DNA, 25 bp, Homo sapien
tcggggatacctgaaccaaagtgtg

SEQ ID NO: 52454 - DNA, 25 bp, Homo sapien
ccgcagacatttagtccagagactg

SEQ ID NO: 52455 - DNA, 25 bp, Homo sapien
ttcactgcgcctgagcttgagtctc

SEQ ID NO: 52456 - DNA, 25 bp, Homo sapien
cttagtcccggccatcgtttagcgt

SEQ ID NO: 52457 - DNA, 25 bp, Homo sapien
cgcttgcgctacagcttcgtctcga

SEQ ID NO: 52458 - DNA, 25 bp, Homo sapien
gtctcgacgggtttgctcctctcaa

SEQ ID NO: 52459 - DNA, 25 bp, Homo sapien
cgctccgaagactggtgggtctatc

SEQ ID NO: 52460 - DNA, 25 bp, Homo sapien
gtgacaagcctcgtggttctgggca

SEQ ID NO: 52461 - DNA, 25 bp, Homo sapien
tgccggaagcgaagatccagtacgc

SEQ ID NO: 52462 - DNA, 25 bp, Homo sapien
atccagtacgcgatcatcgggactg

SEQ ID NO: 52463 - DNA, 25 bp, Homo sapien
gttctgggcagtgccatggagctct

SEQ ID NO: 52464 - DNA, 25 bp, Homo sapien
gccctgaggagacaggtgacaagcc

SEQ ID NO: 52465 - DNA, 25 bp, Homo sapien
agctgttccagcatcgggccctgag

SEQ ID NO: 52466 - DNA, 25 bp, Homo sapien
ctcctccgtgttccggaaggcagga

SEQ ID NO: 52467 - DNA, 25 bp, Homo sapien
ctgcgggaatgactcggtgagaccc

SEQ ID NO: 52468 - DNA, 25 bp, Homo sapien
tggtccttctgccatcatgccgatg

SEQ ID NO: 52469 - DNA, 25 bp, Homo sapien
tcctcgcagtacatcgcggtgcacg

SEQ ID NO: 52470 - DNA, 25 bp, Homo sapien
tgcagcctgcacagcatcggcaaga

SEQ ID NO: 52471 - DNA, 25 bp, Homo sapien
gaaccgctcctacagcaagctgctg

SEQ ID NO: 52472 - DNA, 25 bp, Homo sapien
cccgcagggtctacatcaactatta

SEQ ID NO: 52473 - DNA, 25 bp, Homo sapien
tattacgacatgaacgcggccaatg

SEQ ID NO: 52474 - DNA, 25 bp, Homo sapien
gccaatgtgggctggaacaactcca

SEQ ID NO: 52475 - DNA, 25 bp, Homo sapien
tgtccgagaagtcaggcacgtagct

SEQ ID NO: 52476 - DNA, 25 bp, Homo sapien
tttgtgtgcccttccggcgtttcgc

SEQ ID NO: 52477 - DNA, 25 bp, Homo sapien
ctccagcatgctccgtgtgggagcg

SEQ ID NO: 52478 - DNA, 25 bp, Homo sapien
gcacacgggcagatggtcaccgcct

SEQ ID NO: 52479 - DNA, 25 bp, Homo sapien
gcccgttgctcgctgcccgttggtt

SEQ ID NO: 52480 - DNA, 25 bp, Homo sapien
cccgttggttgttgctggtagctcc

SEQ ID NO: 52481 - DNA, 25 bp, Homo sapien
gcggaactggcgtggtcaaaccaac

SEQ ID NO: 52482 - DNA, 25 bp, Homo sapien
gtggtcaaaccaacctatcagcctc

SEQ ID NO: 52483 - DNA, 25 bp, Homo sapien
atcagcctccagcatgctccgtgtg

SEQ ID NO: 52484 - DNA, 25 bp, Homo sapien
ggacaccaggtcaagaaacagctct

SEQ ID NO: 52485 - DNA, 25 bp, Homo sapien
cgcacggacatctgagggttcgttc

SEQ ID NO: 52486 - DNA, 25 bp, Homo sapien
aggcgtcgccctgacccagaaacga

SEQ ID NO: 52487 - DNA, 25 bp, Homo sapien
accaaatccacggtgcgcagctcta

SEQ ID NO: 52488 - DNA, 25 bp, Homo sapien
ggctgggcccacctttgaccaaatc

SEQ ID NO: 52489 - DNA, 25 bp, Homo sapien
cagctctaaggggatgccattcttc

SEQ ID NO: 52490 - DNA, 25 bp, Homo sapien
aagcaggtctgcttttcgggatccc

SEQ ID NO: 52491 - DNA, 25 bp, Homo sapien
cagagctctgtttctcggcgctgca

SEQ ID NO: 52492 - DNA, 25 bp, Homo sapien
atgggacttccggaaatcagccggc

SEQ ID NO: 52493 - DNA, 25 bp, Homo sapien
cgcggaagcttgagagggaaaccca

SEQ ID NO: 52494 - DNA, 25 bp, Homo sapien
ggagacgatgggacttccggaaatc

SEQ ID NO: 52495 - DNA, 25 bp, Homo sapien
catcctgggcaaacctgcggacgta

SEQ ID NO: 52496 - DNA, 25 bp, Homo sapien
tttgtttgcagaagcgggaggtacc

SEQ ID NO: 52497 - DNA, 25 bp, Homo sapien
tcctggagctggacacgaatttgcc

SEQ ID NO: 52498 - DNA, 25 bp, Homo sapien
ggagctggacacgaatttgcccgcc

SEQ ID NO: 52499 - DNA, 25 bp, Homo sapien
ttgagagggaaacccacctggcgcc

SEQ ID NO: 52500 - DNA, 25 bp, Homo sapien
gagcaaagtggagccgactcgaact

SEQ ID NO: 52501 - DNA, 25 bp, Homo sapien
agaaagcctcagaacgttcgttcgc

SEQ ID NO: 52502 - DNA, 25 bp, Homo sapien
agagccttgggcacagatatcgcgg

SEQ ID NO: 52503 - DNA, 25 bp, Homo sapien
ggcgcgtgttgcacaacctggcccg

SEQ ID NO: 52504 - DNA, 25 bp, Homo sapien
agcccacgtcgtccgtgcggaaggt

SEQ ID NO: 52505 - DNA, 25 bp, Homo sapien
tgcggaaggtggagtccctcacccg

SEQ ID NO: 52506 - DNA, 25 bp, Homo sapien
gactcgaactccaccgcggaaaaga

SEQ ID NO: 52507 - DNA, 25 bp, Homo sapien
ctcccagccggtgagactcgacgtg

SEQ ID NO: 52508 - DNA, 25 bp, Homo sapien
ttacgtccgcaggtttgcccaggat

SEQ ID NO: 52509 - DNA, 25 bp, Homo sapien
tgggtttccctctcaagcttccgcg

SEQ ID NO: 52510 - DNA, 25 bp, Homo sapien
gccaggtgggtttccctctcaagct

SEQ ID NO: 52511 - DNA, 25 bp, Homo sapien
gatttccggaagtcccatcgtctcc

SEQ ID NO: 52512 - DNA, 25 bp, Homo sapien
tgccggctgatttccggaagtccca

SEQ ID NO: 52513 - DNA, 25 bp, Homo sapien
ggtacctcccgcttctgcaaacaaa

SEQ ID NO: 52514 - DNA, 25 bp, Homo sapien
ggcaaattcgtgtccagctccagga

SEQ ID NO: 52515 - DNA, 25 bp, Homo sapien
gcgggcaaattcgtgtccagctcca

SEQ ID NO: 52516 - DNA, 25 bp, Homo sapien
cccagtcgtttctgggtcagggcga

SEQ ID NO: 52517 - DNA, 25 bp, Homo sapien
cctccctgtagggacgcacggatct

SEQ ID NO: 52518 - DNA, 25 bp, Homo sapien
ccgggatcccgaaaagcagacctgc

SEQ ID NO: 52519 - DNA, 25 bp, Homo sapien
cgaaccctcagatgtccgtgcgctg

SEQ ID NO: 52520 - DNA, 25 bp, Homo sapien
agagctgtttcttgacctggtgtcc

SEQ ID NO: 52521 - DNA, 25 bp, Homo sapien
tgcagcgccgagaaacagagctctg

SEQ ID NO: 52522 - DNA, 25 bp, Homo sapien
gctgcgcaccgtggatttggtcaaa

SEQ ID NO: 52523 - DNA, 25 bp, Homo sapien
tcccagctgtgcgttcatagcgacc

SEQ ID NO: 52524 - DNA, 25 bp, Homo sapien
ccttcagggacctcggcctgtactg

SEQ ID NO: 52525 - DNA, 25 bp, Homo sapien
atcttgggcaaacctgcagacgtga

SEQ ID NO: 52526 - DNA, 25 bp, Homo sapien
agaagccaggttgttttagcgcctc

SEQ ID NO: 52527 - DNA, 25 bp, Homo sapien
ttgtttgcagaagtgggaaggtacc

SEQ ID NO: 52528 - DNA, 25 bp, Homo sapien
gagacgaccggatttccggaaatca

SEQ ID NO: 52529 - DNA, 25 bp, Homo sapien
cattccgcaggccaagctctgactt

SEQ ID NO: 52530 - DNA, 25 bp, Homo sapien
ctggctccagcttcgggtaaaactt

SEQ ID NO: 52531 - DNA, 25 bp, Homo sapien
tcctagagctgcacacgaatttccc

SEQ ID NO: 52532 - DNA, 25 bp, Homo sapien
gacggtaacttcctgctgtcggccc

SEQ ID NO: 52533 - DNA, 25 bp, Homo sapien
ccaggcccggtggacctgccgccat

SEQ ID NO: 52534 - DNA, 25 bp, Homo sapien
cgccatgcaggacggtaacttcctg

SEQ ID NO: 52535 - DNA, 25 bp, Homo sapien
gtaacttcctgctgtcggccctgca

SEQ ID NO: 52536 - DNA, 25 bp, Homo sapien
agcctgaggccggcgtgtgctccct

SEQ ID NO: 52537 - DNA, 25 bp, Homo sapien
ctctgacctgcagctggaccgccgg

SEQ ID NO: 52538 - DNA, 25 bp, Homo sapien
ctgggacagcagccgcggcacaacg

SEQ ID NO: 52539 - DNA, 25 bp, Homo sapien
tgccgccatgcaggacggtaacttc

SEQ ID NO: 52540 - DNA, 25 bp, Homo sapien
tccaggcccatagtggggaccgacc

SEQ ID NO: 52541 - DNA, 25 bp, Homo sapien
cgaccgacctgaccggaaaccagag

SEQ ID NO: 52542 - DNA, 25 bp, Homo sapien
tgcgcagctcgaagggaatgtcgtt

SEQ ID NO: 52543 - DNA, 25 bp, Homo sapien
ttggcaaagatgtaaacagcgcggc

SEQ ID NO: 52544 - DNA, 25 bp, Homo sapien
actctttagtccaattgcgggcggc

SEQ ID NO: 52545 - DNA, 25 bp, Homo sapien
acggacgcctgggacactctttagt

SEQ ID NO: 52546 - DNA, 25 bp, Homo sapien
tcagcaaactccagtgccaggactc

SEQ ID NO: 52547 - DNA, 25 bp, Homo sapien
ggaatgtcgttcttcttggcaaaga

SEQ ID NO: 52548 - DNA, 25 bp, Homo sapien
ccgccctgaggtgcctagaatgggt

SEQ ID NO: 52549 - DNA, 25 bp, Homo sapien
ccaatgggagcacgccttgttgtca

SEQ ID NO: 52550 - DNA, 25 bp, Homo sapien
ggcacaaccggcaccggagccaatg

SEQ ID NO: 52551 - DNA, 25 bp, Homo sapien
ctgattggctggcacaaccggcacc

SEQ ID NO: 52552 - DNA, 25 bp, Homo sapien
tgcctagaatgggttccggcctccg

SEQ ID NO: 52553 - DNA, 25 bp, Homo sapien
gccgcccaagggtagccgtctgcag

SEQ ID NO: 52554 - DNA, 25 bp, Homo sapien
acgccttgttgtcaggcgcgcagcc

SEQ ID NO: 52555 - DNA, 25 bp, Homo sapien
ggtttcgcgggcagctttagagccc

SEQ ID NO: 52556 - DNA, 25 bp, Homo sapien
gcgaaagcgaaagccgcccgccaga

SEQ ID NO: 52557 - DNA, 25 bp, Homo sapien
ttgctggcgcttttgctcaatcgtc

SEQ ID NO: 52558 - DNA, 25 bp, Homo sapien
caaaagtcagttgcgctcctgggcc

SEQ ID NO: 52559 - DNA, 25 bp, Homo sapien
cctttacaagcaccggcccgttatg

SEQ ID NO: 52560 - DNA, 25 bp, Homo sapien
ccagtccagggaaccggagaggatt

SEQ ID NO: 52561 - DNA, 25 bp, Homo sapien
ggaagatggttccagccctttacaa

SEQ ID NO: 52562 - DNA, 25 bp, Homo sapien
ctataaataggtgctgtgcggggac

SEQ ID NO: 52563 - DNA, 25 bp, Homo sapien
cgcggtgcttcgctagctataaata

SEQ ID NO: 52564 - DNA, 25 bp, Homo sapien
ggacgcagctcctgacagctgactc

SEQ ID NO: 52565 - DNA, 25 bp, Homo sapien
gacggcaccaacttcacattcaatg

SEQ ID NO: 52566 - DNA, 25 bp, Homo sapien
ccacactttgtgaccttcgacggca

SEQ ID NO: 52567 - DNA, 25 bp, Homo sapien
cgccttcggagacccacactttgtg

SEQ ID NO: 52568 - DNA, 25 bp, Homo sapien
cccaagactgggtgggtgccatccc

SEQ ID NO: 52569 - DNA, 25 bp, Homo sapien
ggctctacgatgtcctcagcttcta

SEQ ID NO: 52570 - DNA, 25 bp, Homo sapien
agcatgtcccactggctctacgatg

SEQ ID NO: 52571 - DNA, 25 bp, Homo sapien
tcagcagtgctgctacacagcggac

SEQ ID NO: 52572 - DNA, 25 bp, Homo sapien
taactgcgtttctgttgcaggcacg

SEQ ID NO: 52573 - DNA, 25 bp, Homo sapien
ctcaccaggacgcagctacgcggtg

SEQ ID NO: 52574 - DNA, 25 bp, Homo sapien
ttgcgctcgtctatgtgctgctgcg

SEQ ID NO: 52575 - DNA, 25 bp, Homo sapien
gtgggaccaccgaggctacttctaa

SEQ ID NO: 52576 - DNA, 25 bp, Homo sapien
ccgaggctacttctaactgcgtttc

SEQ ID NO: 52577 - DNA, 25 bp, Homo sapien
acgcggtgctgttgggcatcatctt

SEQ ID NO: 52578 - DNA, 25 bp, Homo sapien
tctatgtgctgctgcgccgcaggaa

SEQ ID NO: 52579 - DNA, 25 bp, Homo sapien
cgcaggaagggcaacacgtgagacc

SEQ ID NO: 52580 - DNA, 25 bp, Homo sapien
ccaaaccaggagattgcgagggagc

SEQ ID NO: 52581 - DNA, 25 bp, Homo sapien
tggcgggttggtttatcgcctcagc

SEQ ID NO: 52582 - DNA, 25 bp, Homo sapien
gcttctggaacaacccgcaggcttc

SEQ ID NO: 52583 - DNA, 25 bp, Homo sapien
cccgcttgcggcttgactgtgtgca

SEQ ID NO: 52584 - DNA, 25 bp, Homo sapien
gctgctttcctgaggccggactcaa

SEQ ID NO: 52585 - DNA, 25 bp, Homo sapien
ggctactttcttgaccggccaagtg

SEQ ID NO: 52586 - DNA, 25 bp, Homo sapien
actcaacgggtctcggctgagccac

SEQ ID NO: 52587 - DNA, 25 bp, Homo sapien
agacccactggccttcgtccgttgg

SEQ ID NO: 52588 - DNA, 25 bp, Homo sapien
ccggacttcaagaggccagcctgct

SEQ ID NO: 52589 - DNA, 25 bp, Homo sapien
tctactcagcagatgaccaggatgc

SEQ ID NO: 52590 - DNA, 25 bp, Homo sapien
tgtacttccgcatccaggacctgga

SEQ ID NO: 52591 - DNA, 25 bp, Homo sapien
ggtacccgctcatggacaggttcga

SEQ ID NO: 52592 - DNA, 25 bp, Homo sapien
agtctgctacttcagcgaggtcagc

SEQ ID NO: 52593 - DNA, 25 bp, Homo sapien
agcctgcttcggcacctacgtagtc

SEQ ID NO: 52594 - DNA, 25 bp, Homo sapien
gctgggcgaaatagcgtcctcttcc

SEQ ID NO: 52595 - DNA, 25 bp, Homo sapien
gctgtcccgactggttcgaatgtga

SEQ ID NO: 52596 - DNA, 25 bp, Homo sapien
tcgcatgaaccttcgcgagctcctc

SEQ ID NO: 52597 - DNA, 25 bp, Homo sapien
ggacacctgcgggatcgtccttcca

SEQ ID NO: 52598 - DNA, 25 bp, Homo sapien
ggcctcgtcctgacagggacacctg

SEQ ID NO: 52599 - DNA, 25 bp, Homo sapien
agcgcgggtctcaaagctgcctgca

SEQ ID NO: 52600 - DNA, 25 bp, Homo sapien
cctgtgaagggcccaggcacagtca

SEQ ID NO: 52601 - DNA, 25 bp, Homo sapien
gcacagtcacgtcccaggcgcagtt

SEQ ID NO: 52602 - DNA, 25 bp, Homo sapien
ggaccctccgagctgtcccaaactg

SEQ ID NO: 52603 - DNA, 25 bp, Homo sapien
ggatcgtccttccaggatcgcctgc

SEQ ID NO: 52604 - DNA, 25 bp, Homo sapien
tgagccctcagcgaggcctaagtta

SEQ ID NO: 52605 - DNA, 25 bp, Homo sapien
ggcccgaagcctgcaggctgcacta

SEQ ID NO: 52606 - DNA, 25 bp, Homo sapien
cagcttagctgtccacaacctgagc

SEQ ID NO: 52607 - DNA, 25 bp, Homo sapien
tcatggaaacccgagccttggcagc

SEQ ID NO: 52608 - DNA, 25 bp, Homo sapien
ccaggggcctcagccgtcatggaaa

SEQ ID NO: 52609 - DNA, 25 bp, Homo sapien
cctcagcgaggcctaagttagggtc

SEQ ID NO: 52610 - DNA, 25 bp, Homo sapien
ggcaggatgtgcttcccgaaggccc

SEQ ID NO: 52611 - DNA, 25 bp, Homo sapien
aacccgagccttggcagcagcggca

SEQ ID NO: 52612 - DNA, 25 bp, Homo sapien
cccgcgaagccctggaaggcggatt

SEQ ID NO: 52613 - DNA, 25 bp, Homo sapien
cctcacttgagctgtctgggagcga

SEQ ID NO: 52614 - DNA, 25 bp, Homo sapien
cgtgccgaaggagcgctaaaggcca

SEQ ID NO: 52615 - DNA, 25 bp, Homo sapien
ttacaatattagctccaccgaggcg

SEQ ID NO: 52616 - DNA, 25 bp, Homo sapien
ttaccttcctcggtagtcctgtgag

SEQ ID NO: 52617 - DNA, 25 bp, Homo sapien
agacataaaggctccggacgacaga

SEQ ID NO: 52618 - DNA, 25 bp, Homo sapien
gtgcctcatcgcttgctaaccgaga

SEQ ID NO: 52619 - DNA, 25 bp, Homo sapien
agcaactgaccttcggctccagcgg

SEQ ID NO: 52620 - DNA, 25 bp, Homo sapien
ccggaactatcgtactggtgcccta

SEQ ID NO: 52621 - DNA, 25 bp, Homo sapien
gagaccgcgctcaacactggggaaa

SEQ ID NO: 52622 - DNA, 25 bp, Homo sapien
cggtgccgggatcaacaaatgaaat

SEQ ID NO: 52623 - DNA, 25 bp, Homo sapien
ccaactgtctttagggataaccctg

SEQ ID NO: 52624 - DNA, 25 bp, Homo sapien
cgctcttttgccagtcctaggtgta

SEQ ID NO: 52625 - DNA, 25 bp, Homo sapien
ccaaagctcgtgcatttcctgaata

SEQ ID NO: 52626 - DNA, 25 bp, Homo sapien
tgatttaagtctgctccggccattc

SEQ ID NO: 52627 - DNA, 25 bp, Homo sapien
aatagaggctcgtcccttcggcaag

SEQ ID NO: 52628 - DNA, 25 bp, Homo sapien
ggtttggcctgatcacactggagga

SEQ ID NO: 52629 - DNA, 25 bp, Homo sapien
cctgcttgcgtcagtcttggcgcta

SEQ ID NO: 52630 - DNA, 25 bp, Homo sapien
gttcctcggtttggcctgatcacac

SEQ ID NO: 52631 - DNA, 25 bp, Homo sapien
atggtcgccgaacccacaggaggcc

SEQ ID NO: 52632 - DNA, 25 bp, Homo sapien
tggactggatctcgcggagccaccg

SEQ ID NO: 52633 - DNA, 25 bp, Homo sapien
aggggcggacggctccttctctcgc

SEQ ID NO: 52634 - DNA, 25 bp, Homo sapien
ggcggatacaggcccacaacccata

SEQ ID NO: 52635 - DNA, 25 bp, Homo sapien
gtcttggcgctagaacccgagggcc

SEQ ID NO: 52636 - DNA, 25 bp, Homo sapien
ccagttttctatgaatgaggttgta

SEQ ID NO: 52637 - DNA, 25 bp, Homo sapien
cctgttaggtaagcaagggatcttg

SEQ ID NO: 52638 - DNA, 25 bp, Homo sapien
agaattactttggtgcagccgccca

SEQ ID NO: 52639 - DNA, 25 bp, Homo sapien
ggtctgctgtccgagaatgagaatt

SEQ ID NO: 52640 - DNA, 25 bp, Homo sapien
tgaggttgtacatacatctcctata

SEQ ID NO: 52641 - DNA, 25 bp, Homo sapien
cccagaacgtggagactgttcgatc

SEQ ID NO: 52642 - DNA, 25 bp, Homo sapien
atgcagggaaaactaccattcttta

SEQ ID NO: 52643 - DNA, 25 bp, Homo sapien
gctttcacttcatttggtcctgtta

SEQ ID NO: 52644 - DNA, 25 bp, Homo sapien
cccttttccaagagggagatcctct

SEQ ID NO: 52645 - DNA, 25 bp, Homo sapien
agatcctcttgcctttctgggcaca

SEQ ID NO: 52646 - DNA, 25 bp, Homo sapien
ggaaatacacggaccagcccagcct

SEQ ID NO: 52647 - DNA, 25 bp, Homo sapien
agacgtgccgcacactcaggaaagc

SEQ ID NO: 52648 - DNA, 25 bp, Homo sapien
acactcaggaaagcaggcgtcgccc

SEQ ID NO: 52649 - DNA, 25 bp, Homo sapien
aagaggccacgatgagctgcacgtg

SEQ ID NO: 52650 - DNA, 25 bp, Homo sapien
ggttcttggtcccaacaccgcagcg

SEQ ID NO: 52651 - DNA, 25 bp, Homo sapien
gcacgtggcggactcaagagatgcc

SEQ ID NO: 52652 - DNA, 25 bp, Homo sapien
ctgacccgcggctctcgtttcttgt

SEQ ID NO: 52653 - DNA, 25 bp, Homo sapien
gcagcggccaaacgggaaaagagtc

SEQ ID NO: 52654 - DNA, 25 bp, Homo sapien
tgctacgcaccgtcaagaaggaggt

SEQ ID NO: 52655 - DNA, 25 bp, Homo sapien
cagaggctgctacgcaccgtcaaga

SEQ ID NO: 52656 - DNA, 25 bp, Homo sapien
gagacccgacagaggctgctacgca

SEQ ID NO: 52657 - DNA, 25 bp, Homo sapien
gcggctctcgtttcttgtcccacag

SEQ ID NO: 52658 - DNA, 25 bp, Homo sapien
ctccggccgtcactcagcgctcggc

SEQ ID NO: 52659 - DNA, 25 bp, Homo sapien
tcttgtcccacagaggcggagaccc

SEQ ID NO: 52660 - DNA, 25 bp, Homo sapien
cccgagacttgagagtggatcccgc

SEQ ID NO: 52661 - DNA, 25 bp, Homo sapien
ggggaatccgtctcccgagacttga

SEQ ID NO: 52662 - DNA, 25 bp, Homo sapien
tcccgcacagggcaaccaatggatc

SEQ ID NO: 52663 - DNA, 25 bp, Homo sapien
ccatgccagcctgagccttgggaat

SEQ ID NO: 52664 - DNA, 25 bp, Homo sapien
tggattcagagagatcccgtggcta

SEQ ID NO: 52665 - DNA, 25 bp, Homo sapien
atctgggttactcagcctggagctg

SEQ ID NO: 52666 - DNA, 25 bp, Homo sapien
tgtccaagcgagtcgtgacctctga

SEQ ID NO: 52667 - DNA, 25 bp, Homo sapien
caatggatcacgtgccacctggttg

SEQ ID NO: 52668 - DNA, 25 bp, Homo sapien
ggagcaggacgtgaaatctcctgtc

SEQ ID NO: 52669 - DNA, 25 bp, Homo sapien
ataacgcccttgacggccgtgccag

SEQ ID NO: 52670 - DNA, 25 bp, Homo sapien
ggagaccctgacgaggacctacttc

SEQ ID NO: 52671 - DNA, 25 bp, Homo sapien
ccaaacccttctcgaaggagcagga

SEQ ID NO: 52672 - DNA, 25 bp, Homo sapien
tgacgaggacctacttcctccaggc

SEQ ID NO: 52673 - DNA, 25 bp, Homo sapien
cccggatcttggaagcgaagagccc

SEQ ID NO: 52674 - DNA, 25 bp, Homo sapien
gttactccctctgccaaggctcgcc

SEQ ID NO: 52675 - DNA, 25 bp, Homo sapien
tcgaggtgggctccataacgccctt

SEQ ID NO: 52676 - DNA, 25 bp, Homo sapien
cagcggcttgctgacgctgaggctc

SEQ ID NO: 52677 - DNA, 25 bp, Homo sapien
cccggctgttcttggcgaagaagat

SEQ ID NO: 52678 - DNA, 25 bp, Homo sapien
agtccgcggctgtcatgctgcagga

SEQ ID NO: 52679 - DNA, 25 bp, Homo sapien
cgaagtccgcggctgtcatgctgca

SEQ ID NO: 52680 - DNA, 25 bp, Homo sapien
acggcgatgaggtacaggtccagca

SEQ ID NO: 52681 - DNA, 25 bp, Homo sapien
aggtcagtggcgatccaggagcacc

SEQ ID NO: 52682 - DNA, 25 bp, Homo sapien
tgacgctgaggctctcgtcgtcgtc

SEQ ID NO: 52683 - DNA, 25 bp, Homo sapien
tctggggccgcccagctgttccctc

SEQ ID NO: 52684 - DNA, 25 bp, Homo sapien
actcgccaggagatgcgtgcaccga

SEQ ID NO: 52685 - DNA, 25 bp, Homo sapien
acaaggtagctgaggtcgcgtgccc

SEQ ID NO: 52686 - DNA, 25 bp, Homo sapien
tgtggatgcacgtcctcggtgacaa

SEQ ID NO: 52687 - DNA, 25 bp, Homo sapien
acgcacagctgtggatgcacgtcct

SEQ ID NO: 52688 - DNA, 25 bp, Homo sapien
tcagcatgcagagacccaccaagtg

SEQ ID NO: 52689 - DNA, 25 bp, Homo sapien
tgtgtacggcccacagagccacagg

SEQ ID NO: 52690 - DNA, 25 bp, Homo sapien
cgctacagggccacgatcacacaca

SEQ ID NO: 52691 - DNA, 25 bp, Homo sapien
aggcgggttaactggtcagcatgca

SEQ ID NO: 52692 - DNA, 25 bp, Homo sapien
ccggaagtgagctagccgcctgccg

SEQ ID NO: 52693 - DNA, 25 bp, Homo sapien
ctccggaagtgagctagccgcctgc

SEQ ID NO: 52694 - DNA, 25 bp, Homo sapien
gcctccggaagtgagctagccgcct

SEQ ID NO: 52695 - DNA, 25 bp, Homo sapien
ctgcctccggaagtgagctagccgc

SEQ ID NO: 52696 - DNA, 25 bp, Homo sapien
tggctgcctccggaagtgagctagc

SEQ ID NO: 52697 - DNA, 25 bp, Homo sapien
ccctcgctaagacgggggctgatgt

SEQ ID NO: 52698 - DNA, 25 bp, Homo sapien
ctgggcagcgaagcccctcgctaag

SEQ ID NO: 52699 - DNA, 25 bp, Homo sapien
tcctgcattcctgggcagcgaagcc

SEQ ID NO: 52700 - DNA, 25 bp, Homo sapien
ctgacctgcacgtgctgaccagaca

SEQ ID NO: 52701 - DNA, 25 bp, Homo sapien
gaccagacagcccagcgtaaggacc

SEQ ID NO: 52702 - DNA, 25 bp, Homo sapien
tgtctgcaccgagggaccgcgtctc

SEQ ID NO: 52703 - DNA, 25 bp, Homo sapien
ggaagccgtggtcagcgactcacca

SEQ ID NO: 52704 - DNA, 25 bp, Homo sapien
agcgactcaccacgaggacagggca

SEQ ID NO: 52705 - DNA, 25 bp, Homo sapien
catctagacagaggtgaacgaaaca

SEQ ID NO: 52706 - DNA, 25 bp, Homo sapien
agttgttattctcctccagcgcctt

SEQ ID NO: 52707 - DNA, 25 bp, Homo sapien
tccgcctggcggctgaagttgttat

SEQ ID NO: 52708 - DNA, 25 bp, Homo sapien
tcgggcattgagtcgtcgctgtcct

SEQ ID NO: 52709 - DNA, 25 bp, Homo sapien
agacttggtcgagaggcgcgggaca

SEQ ID NO: 52710 - DNA, 25 bp, Homo sapien
gactgtgcgctgaggtgcaccgacc

SEQ ID NO: 52711 - DNA, 25 bp, Homo sapien
ccgcagaccctcgcggaatgagctg

SEQ ID NO: 52712 - DNA, 25 bp, Homo sapien
cccaagcggccgtcagcgacctcct

SEQ ID NO: 52713 - DNA, 25 bp, Homo sapien
tgacaccgcggaactggcgatgcgg

SEQ ID NO: 52714 - DNA, 25 bp, Homo sapien
tgtgcgctgaggtgcaccgaccgtc

SEQ ID NO: 52715 - DNA, 25 bp, Homo sapien
gcattgagtcgtcgctgtcctgggt

SEQ ID NO: 52716 - DNA, 25 bp, Homo sapien
agacgtggccctccattgggtcata

SEQ ID NO: 52717 - DNA, 25 bp, Homo sapien
gcgagaccctccattggtccgtcta

SEQ ID NO: 52718 - DNA, 25 bp, Homo sapien
cgtccagtagacgtggccctccatt

SEQ ID NO: 52719 - DNA, 25 bp, Homo sapien
tggccctccattgggtcatagttga

SEQ ID NO: 52720 - DNA, 25 bp, Homo sapien
gtcatagttgatggcgatggcatgc

SEQ ID NO: 52721 - DNA, 25 bp, Homo sapien
gcgatggcatgctggatgtcgtcca

SEQ ID NO: 52722 - DNA, 25 bp, Homo sapien
tgtgtccagcgagaccctccattgg

SEQ ID NO: 52723 - DNA, 25 bp, Homo sapien
cctcgtcatccgtccagtagacgtg

SEQ ID NO: 52724 - DNA, 25 bp, Homo sapien
tggaaacagagtcgcgaaccggctt

SEQ ID NO: 52725 - DNA, 25 bp, Homo sapien
gcgcgtgtccctgcatcttcgtctt

SEQ ID NO: 52726 - DNA, 25 bp, Homo sapien
tgcagcctccatgttgtccagcggc

SEQ ID NO: 52727 - DNA, 25 bp, Homo sapien
gcagtgcagcctccatgttgtccag

SEQ ID NO: 52728 - DNA, 25 bp, Homo sapien
gccattgtactagcagcccgcggtc

SEQ ID NO: 52729 - DNA, 25 bp, Homo sapien
ccaactcgcttccaaggcggcggtg

SEQ ID NO: 52730 - DNA, 25 bp, Homo sapien
ggctcggctcctggcttcctacggg

SEQ ID NO: 52731 - DNA, 25 bp, Homo sapien
gccgctggaaacagagtcgcgaacc

SEQ ID NO: 52732 - DNA, 25 bp, Homo sapien
cctgcccgaacccacgtaccacctg

SEQ ID NO: 52733 - DNA, 25 bp, Homo sapien
cgaccacgcctgcaagaggaccgtc

SEQ ID NO: 52734 - DNA, 25 bp, Homo sapien
cagattacaccgcttgcagggcgct

SEQ ID NO: 52735 - DNA, 25 bp, Homo sapien
ggctacagattacaccgcttgcagg

SEQ ID NO: 52736 - DNA, 25 bp, Homo sapien
accctggcgggctacagattacacc

SEQ ID NO: 52737 - DNA, 25 bp, Homo sapien
ctgcacccaggtgcgccaacccttg

SEQ ID NO: 52738 - DNA, 25 bp, Homo sapien
gagctggccgctgggactctgcacc

SEQ ID NO: 52739 - DNA, 25 bp, Homo sapien
aatcgggagctgagccgtcgctgtc

SEQ ID NO: 52740 - DNA, 25 bp, Homo sapien
caagaggatcgtcctgccggagccc

SEQ ID NO: 52741 - DNA, 25 bp, Homo sapien
cagcaagaggatcgtcctgccggag

SEQ ID NO: 52742 - DNA, 25 bp, Homo sapien
ctgcggcgcgcgcagagcgctagtg

SEQ ID NO: 52743 - DNA, 25 bp, Homo sapien
agcaagaggatcgtcctgccggagc

SEQ ID NO: 52744 - DNA, 25 bp, Homo sapien
cattggtgtagtccccgttggctcc

SEQ ID NO: 52745 - DNA, 25 bp, Homo sapien
ggccgccagctaccccctgcttcct

SEQ ID NO: 52746 - DNA, 25 bp, Homo sapien
ctgttgcattggtgtagtccccgtt

SEQ ID NO: 52747 - DNA, 25 bp, Homo sapien
cagagcgctagtggggcgcgcggcg

SEQ ID NO: 52748 - DNA, 25 bp, Homo sapien
ttggcgttaaactttgcagggccga

SEQ ID NO: 52749 - DNA, 25 bp, Homo sapien
caaaatcggggctaggaaccgcacg

SEQ ID NO: 52750 - DNA, 25 bp, Homo sapien
aagcggtggtggctgtccaaaatcg

SEQ ID NO: 52751 - DNA, 25 bp, Homo sapien
gctgaccagggcgactcaggcacca

SEQ ID NO: 52752 - DNA, 25 bp, Homo sapien
gggatctcgctgttcctcgctctgc

SEQ ID NO: 52753 - DNA, 25 bp, Homo sapien
gactccgcgggatctcgctgttcct

SEQ ID NO: 52754 - DNA, 25 bp, Homo sapien
tccctgcactcgctcggcacagact

SEQ ID NO: 52755 - DNA, 25 bp, Homo sapien
tggtggctgtccaaaatcggggcta

SEQ ID NO: 52756 - DNA, 25 bp, Homo sapien
ccgggcgcaggtaagcttcgtctcc

SEQ ID NO: 52757 - DNA, 25 bp, Homo sapien
cgacgcgagcctttcttaatgaatg

SEQ ID NO: 52758 - DNA, 25 bp, Homo sapien
ttcttaatgaatgactgcacgcccg

SEQ ID NO: 52759 - DNA, 25 bp, Homo sapien
atgaatgactgcacgcccgtcgccg

SEQ ID NO: 52760 - DNA, 25 bp, Homo sapien
tgctcgtacgtgctaagcgccgccg

SEQ ID NO: 52761 - DNA, 25 bp, Homo sapien
cgaggccagtgctcgtacgtgctaa

SEQ ID NO: 52762 - DNA, 25 bp, Homo sapien
ccagtgctcgtacgtgctaagcgcc

SEQ ID NO: 52763 - DNA, 25 bp, Homo sapien
gctgcaggcccacggccctccctta

SEQ ID NO: 52764 - DNA, 25 bp, Homo sapien
acgggctgcagaatggctacgtgta

SEQ ID NO: 52765 - DNA, 25 bp, Homo sapien
atgggccgcatccacaagggcatcc

SEQ ID NO: 52766 - DNA, 25 bp, Homo sapien
gagcagggccggtacctcaacagcc

SEQ ID NO: 52767 - DNA, 25 bp, Homo sapien
caagcgctactcctggtccggcatg

SEQ ID NO: 52768 - DNA, 25 bp, Homo sapien
agtgcgtgcgctgcacccacaacga

SEQ ID NO: 52769 - DNA, 25 bp, Homo sapien
tcctcttcgtgtggtactgttatca

SEQ ID NO: 52770 - DNA, 25 bp, Homo sapien
cgagggcctcaaccagaagctgtac

SEQ ID NO: 52771 - DNA, 25 bp, Homo sapien
cctgcaggagtacgccaagcgctac

SEQ ID NO: 52772 - DNA, 25 bp, Homo sapien
tggcacgttgtcgtactgcgatgca

SEQ ID NO: 52773 - DNA, 25 bp, Homo sapien
agcatccagggccttcatctttggc

SEQ ID NO: 52774 - DNA, 25 bp, Homo sapien
atctttggccgcacgtttgacaccc

SEQ ID NO: 52775 - DNA, 25 bp, Homo sapien
gctgctcgacctttgccttccatgg

SEQ ID NO: 52776 - DNA, 25 bp, Homo sapien
tgggcacaaactccttcctgatatt

SEQ ID NO: 52777 - DNA, 25 bp, Homo sapien
tgcgtgattatattgcctggaactg

SEQ ID NO: 52778 - DNA, 25 bp, Homo sapien
cctgtggacccgatgggagttttct

SEQ ID NO: 52779 - DNA, 25 bp, Homo sapien
gacgtctgacggtttattccatttg

SEQ ID NO: 52780 - DNA, 25 bp, Homo sapien
agacacgctcaccaggaaggccgga

SEQ ID NO: 52781 - DNA, 25 bp, Homo sapien
ctcctggtgacgtcctgctgcaact

SEQ ID NO: 52782 - DNA, 25 bp, Homo sapien
tgagggcatacagcgtcaccaagtc

SEQ ID NO: 52783 - DNA, 25 bp, Homo sapien
atgctgtactgtctgccaagccagc

SEQ ID NO: 52784 - DNA, 25 bp, Homo sapien
ttgtcacgtccaccggacctggcgt

SEQ ID NO: 52785 - DNA, 25 bp, Homo sapien
catgtcatgtcctgcttgtcacgtc

SEQ ID NO: 52786 - DNA, 25 bp, Homo sapien
gccgtcacaccggaccatgtcatgt

SEQ ID NO: 52787 - DNA, 25 bp, Homo sapien
ggctccggcataggcctgagaaagc

SEQ ID NO: 52788 - DNA, 25 bp, Homo sapien
gagcttacaggccttcgatcacacg

SEQ ID NO: 52789 - DNA, 25 bp, Homo sapien
ctgtgagcttacaggccttcgatca

SEQ ID NO: 52790 - DNA, 25 bp, Homo sapien
cctgtgagcttaccggccttcgatc

SEQ ID NO: 52791 - DNA, 25 bp, Homo sapien
gagcttaccggccttcaatcacacg

SEQ ID NO: 52792 - DNA, 25 bp, Homo sapien
cctgtgagcttaccggccttcaatc

SEQ ID NO: 52793 - DNA, 25 bp, Homo sapien
gagcttaccggccttcgatcacacg

SEQ ID NO: 52794 - DNA, 25 bp, Homo sapien
cctgtggcacactcctgtgagctta

SEQ ID NO: 52795 - DNA, 25 bp, Homo sapien
tgtggcacactcctgtgagcttacc

SEQ ID NO: 52796 - DNA, 25 bp, Homo sapien
accggagtagccaggcatcccagtg

SEQ ID NO: 52797 - DNA, 25 bp, Homo sapien
tcagagaccaatggctgcggccgca

SEQ ID NO: 52798 - DNA, 25 bp, Homo sapien
caggcagcgactggtaacagcacta

SEQ ID NO: 52799 - DNA, 25 bp, Homo sapien
atggtgggcgaacgcctaaggatta

SEQ ID NO: 52800 - DNA, 25 bp, Homo sapien
catcccagtgctcggggttcgggac

SEQ ID NO: 52801 - DNA, 25 bp, Homo sapien
agctgggtacctgcgacttctgccc

SEQ ID NO: 52802 - DNA, 25 bp, Homo sapien
actctggaccagaaatgtgggcagc

SEQ ID NO: 52803 - DNA, 25 bp, Homo sapien
gcagagaggccttaggtcacgcgcc

SEQ ID NO: 52804 - DNA, 25 bp, Homo sapien
ctcatactgtagctgccggtcattc

SEQ ID NO: 52805 - DNA, 25 bp, Homo sapien
accttgctgaggttcgagatgaccc

SEQ ID NO: 52806 - DNA, 25 bp, Homo sapien
gagatgacccgctcctcgtggtcca

SEQ ID NO: 52807 - DNA, 25 bp, Homo sapien
gtggtccaggacctcggtcatcttc

SEQ ID NO: 52808 - DNA, 25 bp, Homo sapien
atctcctgctccgtgaggtcgatga

SEQ ID NO: 52809 - DNA, 25 bp, Homo sapien
gccggtcattctggatgatctcctg

SEQ ID NO: 52810 - DNA, 25 bp, Homo sapien
ggttgaccaccatgtcccgctcata

SEQ ID NO: 52811 - DNA, 25 bp, Homo sapien
cgaagatgcgggcacactcgtccag

SEQ ID NO: 52812 - DNA, 25 bp, Homo sapien
acagcggatgtcctgctggctgcca

SEQ ID NO: 52813 - DNA, 25 bp, Homo sapien
gcgcgccggaaatgacgttagtcga

SEQ ID NO: 52814 - DNA, 25 bp, Homo sapien
tccgagggtccagcgtaccaaattc

SEQ ID NO: 52815 - DNA, 25 bp, Homo sapien
gtccctactctcactggcgctgagt

SEQ ID NO: 52816 - DNA, 25 bp, Homo sapien
ttggaccgaagctcgccttccctga

SEQ ID NO: 52817 - DNA, 25 bp, Homo sapien
cagagctgtctacgaaatggattcc

SEQ ID NO: 52818 - DNA, 25 bp, Homo sapien
gtgcctcggcagagctgtctacgaa

SEQ ID NO: 52819 - DNA, 25 bp, Homo sapien
gcgtaccaaattcagcttcaccatc

SEQ ID NO: 52820 - DNA, 25 bp, Homo sapien
gcttctcacggccagacttggacca

SEQ ID NO: 52821 - DNA, 25 bp, Homo sapien
gtgcttggcaatcacctccaggatg

SEQ ID NO: 52822 - DNA, 25 bp, Homo sapien
aggcacgccacccacgaagatgagc

SEQ ID NO: 52823 - DNA, 25 bp, Homo sapien
ggccttgccatagcggtattccacg

SEQ ID NO: 52824 - DNA, 25 bp, Homo sapien
ttccacgtggttggtgcccaccatc

SEQ ID NO: 52825 - DNA, 25 bp, Homo sapien
cgcgacaggtagaccgaggacttga

SEQ ID NO: 52826 - DNA, 25 bp, Homo sapien
gcaatggtgactttgcgcgtgatca

SEQ ID NO: 52827 - DNA, 25 bp, Homo sapien
aaatgggtccttgttgcagagcacg

SEQ ID NO: 52828 - DNA, 25 bp, Homo sapien
acgcctccacttctgacgctcctcg

SEQ ID NO: 52829 - DNA, 25 bp, Homo sapien
cccacgcacccagcgactcccggct

SEQ ID NO: 52830 - DNA, 25 bp, Homo sapien
gacgctcctcgcaactccacggctg

SEQ ID NO: 52831 - DNA, 25 bp, Homo sapien
gcaagttaacttccacgcgccctgg

SEQ ID NO: 52832 - DNA, 25 bp, Homo sapien
aacagacgctgagcgtctcccaggc

SEQ ID NO: 52833 - DNA, 25 bp, Homo sapien
agcgggtgcggatcccagaaccgcg

SEQ ID NO: 52834 - DNA, 25 bp, Homo sapien
tccacggctgctgcaagttaacttc

SEQ ID NO: 52835 - DNA, 25 bp, Homo sapien
acctaccgtggcgagacgcggcgag

SEQ ID NO: 52836 - DNA, 25 bp, Homo sapien
agtgctccctccaagaccggttgca

SEQ ID NO: 52837 - DNA, 25 bp, Homo sapien
tctgcggcctaatgtggacgggcaa

SEQ ID NO: 52838 - DNA, 25 bp, Homo sapien
atgggcgctgcagcagctacaaaga

SEQ ID NO: 52839 - DNA, 25 bp, Homo sapien
attaaaatttcatgggcgctgcagc

SEQ ID NO: 52840 - DNA, 25 bp, Homo sapien
cagccgctcccgcattaaaatttca

SEQ ID NO: 52841 - DNA, 25 bp, Homo sapien
ctttcctggccaggactctgggcgc

SEQ ID NO: 52842 - DNA, 25 bp, Homo sapien
aatgtggacgggcaagcgttgccat

SEQ ID NO: 52843 - DNA, 25 bp, Homo sapien
gctacaaagacgacgccggctgcgc

SEQ ID NO: 52844 - DNA, 25 bp, Homo sapien
ctctgcccgtggtatcctgacggcg

SEQ ID NO: 52845 - DNA, 25 bp, Homo sapien
ccgcgcggctgtctgtacaaaggat

SEQ ID NO: 52846 - DNA, 25 bp, Homo sapien
aggatgcgctgttaacacgtgtacg

SEQ ID NO: 52847 - DNA, 25 bp, Homo sapien
acgtgtacggtaatgggctccctca

SEQ ID NO: 52848 - DNA, 25 bp, Homo sapien
cagcctgacggatggcccgagccat

SEQ ID NO: 52849 - DNA, 25 bp, Homo sapien
tggccgtgcgccctacttgggcaac

SEQ ID NO: 52850 - DNA, 25 bp, Homo sapien
ccctctgcggaaggaacctcgtgcg

SEQ ID NO: 52851 - DNA, 25 bp, Homo sapien
gttctgtaaacagccacgaggtgtc

SEQ ID NO: 52852 - DNA, 25 bp, Homo sapien
tgccagtcgcgctcctgctattaga

SEQ ID NO: 52853 - DNA, 25 bp, Homo sapien
attagaaatctcatcggctcctttg

SEQ ID NO: 52854 - DNA, 25 bp, Homo sapien
ggctcctttgatttagggcttacca

SEQ ID NO: 52855 - DNA, 25 bp, Homo sapien
tagggcttaccacaagctgccaatc

SEQ ID NO: 52856 - DNA, 25 bp, Homo sapien
gcttaccacaagctgccaatcgcgg

SEQ ID NO: 52857 - DNA, 25 bp, Homo sapien
ccttgttccggctcacagcagcaga

SEQ ID NO: 52858 - DNA, 25 bp, Homo sapien
cattatttaatttcccgccagcggg

SEQ ID NO: 52859 - DNA, 25 bp, Homo sapien
cgcgctcctgctattagaaatctca

SEQ ID NO: 52860 - DNA, 25 bp, Homo sapien
ttgatgaactttccgaggcccgcta

SEQ ID NO: 52861 - DNA, 25 bp, Homo sapien
ggtcagcacccgtcaggctgattta

SEQ ID NO: 52862 - DNA, 25 bp, Homo sapien
cgccgccgccagatctattattgat

SEQ ID NO: 52863 - DNA, 25 bp, Homo sapien
gaggcccgctaattaactgcgcgca

SEQ ID NO: 52864 - DNA, 25 bp, Homo sapien
gcggctgaaatacggcctgcatgtc

SEQ ID NO: 52865 - DNA, 25 bp, Homo sapien
tgcatgtcccaatgtcacgggcgcc

SEQ ID NO: 52866 - DNA, 25 bp, Homo sapien
gacgggatctcagccgccggctcag

SEQ ID NO: 52867 - DNA, 25 bp, Homo sapien
aggctgatttactggcgctcgccgc

SEQ ID NO: 52868 - DNA, 25 bp, Homo sapien
cgcgggcgcactctactgacaagcg

SEQ ID NO: 52869 - DNA, 25 bp, Homo sapien
ccatccagttgaccgagcttgtgct

SEQ ID NO: 52870 - DNA, 25 bp, Homo sapien
tggagactggcgagtttcgactccc

SEQ ID NO: 52871 - DNA, 25 bp, Homo sapien
aggccgattcccatccagttgaccg

SEQ ID NO: 52872 - DNA, 25 bp, Homo sapien
actgacaagcggtgggcggcctcac

SEQ ID NO: 52873 - DNA, 25 bp, Homo sapien
gtcaccgcggtttccgcaggacaga

SEQ ID NO: 52874 - DNA, 25 bp, Homo sapien
ttcctgtctgaagaccgcatgttgc

SEQ ID NO: 52875 - DNA, 25 bp, Homo sapien
atgttgccgggctgtgcttacggct

SEQ ID NO: 52876 - DNA, 25 bp, Homo sapien
tgttcagttccgctgtcccatcggc

SEQ ID NO: 52877 - DNA, 25 bp, Homo sapien
cgctccggtatttgtttgttcagtt

SEQ ID NO: 52878 - DNA, 25 bp, Homo sapien
gagtgcgacttctcggccgcagagt

SEQ ID NO: 52879 - DNA, 25 bp, Homo sapien
tgtgtgtgcttacacacgtgcatga

SEQ ID NO: 52880 - DNA, 25 bp, Homo sapien
gtgtgtgcaaggtggcttttccatc

SEQ ID NO: 52881 - DNA, 25 bp, Homo sapien
catgacatttagacggctagagcga

SEQ ID NO: 52882 - DNA, 25 bp, Homo sapien
ccgagggctccatgcgtcattaaaa

SEQ ID NO: 52883 - DNA, 25 bp, Homo sapien
tgtgcggagaccagcatgacattta

SEQ ID NO: 52884 - DNA, 25 bp, Homo sapien
cccaaacgtcctcatggtggaaatc

SEQ ID NO: 52885 - DNA, 25 bp, Homo sapien
tcaaccttgacttcagggccgggcc

SEQ ID NO: 52886 - DNA, 25 bp, Homo sapien
tgtgcctgcggatcccggtaacatt

SEQ ID NO: 52887 - DNA, 25 bp, Homo sapien
gcctcctagaccgagatcgcggtga

SEQ ID NO: 52888 - DNA, 25 bp, Homo sapien
agttgtagtcctgtaagcgcgcgga

SEQ ID NO: 52889 - DNA, 25 bp, Homo sapien
gcgcctatggaactcgacccgcagg

SEQ ID NO: 52890 - DNA, 25 bp, Homo sapien
tggggcagacccttagtgatgttca

SEQ ID NO: 52891 - DNA, 25 bp, Homo sapien
ggcccagtttcctccacatgcagat

SEQ ID NO: 52892 - DNA, 25 bp, Homo sapien
cagggtcacacgcataagcacgtta

SEQ ID NO: 52893 - DNA, 25 bp, Homo sapien
gccgtaaacttacacgatgtggtga

SEQ ID NO: 52894 - DNA, 25 bp, Homo sapien
tgaagacatccctataaacgcagcg

SEQ ID NO: 52895 - DNA, 25 bp, Homo sapien
cctgctggtttacagtgatttactc

SEQ ID NO: 52896 - DNA, 25 bp, Homo sapien
ggcccgtgcaaacacttgcctgctg

SEQ ID NO: 52897 - DNA, 25 bp, Homo sapien
ttatcccaaagcacgtacggggctc

SEQ ID NO: 52898 - DNA, 25 bp, Homo sapien
gcacgttactgagaagatttatccc

SEQ ID NO: 52899 - DNA, 25 bp, Homo sapien
cccaatccagatgcgcacagaggct

SEQ ID NO: 52900 - DNA, 25 bp, Homo sapien
ccgggagaagcagcaacaagttttg

SEQ ID NO: 52901 - DNA, 25 bp, Homo sapien
tcgccacggaaagtcgctaagtgtc

SEQ ID NO: 52902 - DNA, 25 bp, Homo sapien
gtcacagtcactcagccactttatg

SEQ ID NO: 52903 - DNA, 25 bp, Homo sapien
gtcactagggcgttcacaattgttc

SEQ ID NO: 52904 - DNA, 25 bp, Homo sapien
gtgtctactgcacttcggctccggg

SEQ ID NO: 52905 - DNA, 25 bp, Homo sapien
gcccagtaaccggagcgacttgcga

SEQ ID NO: 52906 - DNA, 25 bp, Homo sapien
gcaaagaccctagactcgccacgga

SEQ ID NO: 52907 - DNA, 25 bp, Homo sapien
ggagcacatcggttgagcccagtaa

SEQ ID NO: 52908 - DNA, 25 bp, Homo sapien
ctcattggcgtagctcgtgctcacc

SEQ ID NO: 52909 - DNA, 25 bp, Homo sapien
cgaggcgaactcacccacgtttggc

SEQ ID NO: 52910 - DNA, 25 bp, Homo sapien
ccacgtttggcgaactactgtccga

SEQ ID NO: 52911 - DNA, 25 bp, Homo sapien
ggagccgccgagtacttgtcaaaga

SEQ ID NO: 52912 - DNA, 25 bp, Homo sapien
ggctcacgtgaccactgtccctttt

SEQ ID NO: 52913 - DNA, 25 bp, Homo sapien
cgagtccaggtcaatggtgctcatg

SEQ ID NO: 52914 - DNA, 25 bp, Homo sapien
gtgctctgccatcagcgagtccagg

SEQ ID NO: 52915 - DNA, 25 bp, Homo sapien
tgctcgctttaactagtgcctgggg

SEQ ID NO: 52916 - DNA, 25 bp, Homo sapien
catgtcaaaatgtcccgagggcgcc

SEQ ID NO: 52917 - DNA, 25 bp, Homo sapien
gtgcattttggacaagcccaccatg

SEQ ID NO: 52918 - DNA, 25 bp, Homo sapien
acaggctcggaataagggtgcatgc

SEQ ID NO: 52919 - DNA, 25 bp, Homo sapien
tggctctccgccatgtgctcatagc

SEQ ID NO: 52920 - DNA, 25 bp, Homo sapien
cgggcacgaattttgtcggactaga

SEQ ID NO: 52921 - DNA, 25 bp, Homo sapien
tggcgacccgctgcataatgaggca

SEQ ID NO: 52922 - DNA, 25 bp, Homo sapien
gcctcgcccgggtaattgtattcca

SEQ ID NO: 52923 - DNA, 25 bp, Homo sapien
tgggatactcgaattgcgcgtgctg

SEQ ID NO: 52924 - DNA, 25 bp, Homo sapien
gggcgtgttaccacggcaatgcctg

SEQ ID NO: 52925 - DNA, 25 bp, Homo sapien
ggacgttcacctgcttcgcggtctc

SEQ ID NO: 52926 - DNA, 25 bp, Homo sapien
cacataaaagactcctgacaggttc

SEQ ID NO: 52927 - DNA, 25 bp, Homo sapien
ccgttttgcggtgactggttttctg

SEQ ID NO: 52928 - DNA, 25 bp, Homo sapien
gcagcctacgctttccggtgagttt

SEQ ID NO: 52929 - DNA, 25 bp, Homo sapien
agggctcctcccttcagctttggtc

SEQ ID NO: 52930 - DNA, 25 bp, Homo sapien
acacagggctgactccgatttagga

SEQ ID NO: 52931 - DNA, 25 bp, Homo sapien
cgcgcgcactcttgtctgcttacga

SEQ ID NO: 52932 - DNA, 25 bp, Homo sapien
ttcaaaacaacgctctttgatgagc

SEQ ID NO: 52933 - DNA, 25 bp, Homo sapien
cttttcaaaacaacgctctttgatg

SEQ ID NO: 52934 - DNA, 25 bp, Homo sapien
cgcttttcaaaacaacgctctttga

SEQ ID NO: 52935 - DNA, 25 bp, Homo sapien
ttttcaaaacaacgctctttgatga

SEQ ID NO: 52936 - DNA, 25 bp, Homo sapien
gtctcaccgcgggtgccgcttaccg

SEQ ID NO: 52937 - DNA, 25 bp, Homo sapien
ctcaccgcgggtgccgcttaccgct

SEQ ID NO: 52938 - DNA, 25 bp, Homo sapien
acgcttttcaaaacaacgctctttg

SEQ ID NO: 52939 - DNA, 25 bp, Homo sapien
tcaaaacaacgctctttgatgagcc

SEQ ID NO: 52940 - DNA, 25 bp, Homo sapien
cgctaagctgcgatgctgcgtcgca

SEQ ID NO: 52941 - DNA, 25 bp, Homo sapien
agccttatggactggtacgagcgac

SEQ ID NO: 52942 - DNA, 25 bp, Homo sapien
ctcgagactacttcagccttatgga

SEQ ID NO: 52943 - DNA, 25 bp, Homo sapien
gtcgcaggcgggaagcaattatccc

SEQ ID NO: 52944 - DNA, 25 bp, Homo sapien
ttcccagaaggagaccgctaagctg

SEQ ID NO: 52945 - DNA, 25 bp, Homo sapien
cccacgagtgaccacggctagatag

SEQ ID NO: 52946 - DNA, 25 bp, Homo sapien
ttagtctggttagacgctctctttg

SEQ ID NO: 52947 - DNA, 25 bp, Homo sapien
aggacaggttcttctgcccacagtg

SEQ ID NO: 52948 - DNA, 25 bp, Homo sapien
ggcagcggccctctacacacaacaa

SEQ ID NO: 52949 - DNA, 25 bp, Homo sapien
tcgtctcgccggctatggctgcgct

SEQ ID NO: 52950 - DNA, 25 bp, Homo sapien
tctacacacaacaaatcccggcatg

SEQ ID NO: 52951 - DNA, 25 bp, Homo sapien
tggagggttctagaaggcgtgacgt

SEQ ID NO: 52952 - DNA, 25 bp, Homo sapien
tctgagcggcggctcggacttcctg

SEQ ID NO: 52953 - DNA, 25 bp, Homo sapien
gggacctcgcgcagtccctagcagt

SEQ ID NO: 52954 - DNA, 25 bp, Homo sapien
gcagtccctagcagtcccgctggga

SEQ ID NO: 52955 - DNA, 25 bp, Homo sapien
gtccctagcagtcccgctgggagtg

SEQ ID NO: 52956 - DNA, 25 bp, Homo sapien
cagaagcagaactttaggggtcccg

SEQ ID NO: 52957 - DNA, 25 bp, Homo sapien
ccgggactaacagagaattacctca

SEQ ID NO: 52958 - DNA, 25 bp, Homo sapien
aaccgagagctttccagactgacga

SEQ ID NO: 52959 - DNA, 25 bp, Homo sapien
catccggagtgacagaatttaattc

SEQ ID NO: 52960 - DNA, 25 bp, Homo sapien
attttatctcgtgcgccacttcggg

SEQ ID NO: 52961 - DNA, 25 bp, Homo sapien
gcggacttatttccatccggagtga

SEQ ID NO: 52962 - DNA, 25 bp, Homo sapien
gtttcaggaccgtggctatggagtc

SEQ ID NO: 52963 - DNA, 25 bp, Homo sapien
ccgagtggagccgaaagtcgagata

SEQ ID NO: 52964 - DNA, 25 bp, Homo sapien
cggggataacccctcacgtggagca

SEQ ID NO: 52965 - DNA, 25 bp, Homo sapien
gagatcgtgcaggtagctgcccgcc

SEQ ID NO: 52966 - DNA, 25 bp, Homo sapien
cgccgcctccgccacaagatggctc

SEQ ID NO: 52967 - DNA, 25 bp, Homo sapien
agcggcgattacaccacctacacca

SEQ ID NO: 52968 - DNA, 25 bp, Homo sapien
tgctgttcgagtcgagcccaagcgg

SEQ ID NO: 52969 - DNA, 25 bp, Homo sapien
cgagctgagcctgcgacccacaaag

SEQ ID NO: 52970 - DNA, 25 bp, Homo sapien
gagtcgagcccaagcggcgattaca

SEQ ID NO: 52971 - DNA, 25 bp, Homo sapien
tgggggctagagctcctgtgaaccc

SEQ ID NO: 52972 - DNA, 25 bp, Homo sapien
acggcacgtcacctggatagggaca

SEQ ID NO: 52973 - DNA, 25 bp, Homo sapien
cgtcacctggatagggacacgggta

SEQ ID NO: 52974 - DNA, 25 bp, Homo sapien
tacggcacgtcacccgggtgggaca

SEQ ID NO: 52975 - DNA, 25 bp, Homo sapien
acacgggtacggcacgtcacctgga

SEQ ID NO: 52976 - DNA, 25 bp, Homo sapien
ggcacgtcacctggatagggacacg

SEQ ID NO: 52977 - DNA, 25 bp, Homo sapien
gtcacctggatagggacacgggtac

SEQ ID NO: 52978 - DNA, 25 bp, Homo sapien
cgggtacggcacgtcacctggatag

SEQ ID NO: 52979 - DNA, 25 bp, Homo sapien
tgggacacgggtacggcacgtcacc

SEQ ID NO: 52980 - DNA, 25 bp, Homo sapien
ccgaaagtcccggcccgctggattg

SEQ ID NO: 52981 - DNA, 25 bp, Homo sapien
gagaaatatcttctcccggtgggga

SEQ ID NO: 52982 - DNA, 25 bp, Homo sapien
tttaattatggcgagaaatatcttc

SEQ ID NO: 52983 - DNA, 25 bp, Homo sapien
ggcttaatgactttaattatggcga

SEQ ID NO: 52984 - DNA, 25 bp, Homo sapien
gcctttggaggcttaatgactttaa

SEQ ID NO: 52985 - DNA, 25 bp, Homo sapien
cgacgggagcctttggaggcttaat

SEQ ID NO: 52986 - DNA, 25 bp, Homo sapien
tcagaacctgcagccgacgggagcc

SEQ ID NO: 52987 - DNA, 25 bp, Homo sapien
ccctgcagggcggtacacgacgggt

SEQ ID NO: 52988 - DNA, 25 bp, Homo sapien
cttgctgaccatggaccggcacggg

SEQ ID NO: 52989 - DNA, 25 bp, Homo sapien
tcaccttgctgaccatggaccggca

SEQ ID NO: 52990 - DNA, 25 bp, Homo sapien
cgaggacaagcatggactcccacgg

SEQ ID NO: 52991 - DNA, 25 bp, Homo sapien
ctacgaggacaagcatggactccca

SEQ ID NO: 52992 - DNA, 25 bp, Homo sapien
gccatcccagcctaccctacgagga

SEQ ID NO: 52993 - DNA, 25 bp, Homo sapien
gtgcacaggaccaacgccatcccag

SEQ ID NO: 52994 - DNA, 25 bp, Homo sapien
tgtgtggagaccagcaacctctcac

SEQ ID NO: 52995 - DNA, 25 bp, Homo sapien
cagcaacctctcacgtggtcggcag

SEQ ID NO: 52996 - DNA, 25 bp, Homo sapien
ctcactgggaggcaagtgccgaccc

SEQ ID NO: 52997 - DNA, 25 bp, Homo sapien
aactgaagctgtttccggggctgac

SEQ ID NO: 52998 - DNA, 25 bp, Homo sapien
gcagttccacaggtgcgccgagcct

SEQ ID NO: 52999 - DNA, 25 bp, Homo sapien
ctgcccacagtgacgcgagggactc

SEQ ID NO: 53000 - DNA, 25 bp, Homo sapien
gctctgccatgggaagccgtagctt

SEQ ID NO: 53001 - DNA, 25 bp, Homo sapien
accctgcggacaggcgagaccatgt

SEQ ID NO: 53002 - DNA, 25 bp, Homo sapien
tgtgggaagcaactaaaccggcgta

SEQ ID NO: 53003 - DNA, 25 bp, Homo sapien
agaccatgtgtgatctgtgggaagc

SEQ ID NO: 53004 - DNA, 25 bp, Homo sapien
cccggcggtgcacagtcatggtgct

SEQ ID NO: 53005 - DNA, 25 bp, Homo sapien
ctcccggcggtgcacagtcatggtg

SEQ ID NO: 53006 - DNA, 25 bp, Homo sapien
tcccggcggtgcacagtcatggtgc

SEQ ID NO: 53007 - DNA, 25 bp, Homo sapien
gagcccctgtcgtgccagtgaggcg

SEQ ID NO: 53008 - DNA, 25 bp, Homo sapien
gctcccggcggtgcacagtcatggt

SEQ ID NO: 53009 - DNA, 25 bp, Homo sapien
tgtcgtgccagtgaggcggggggct

SEQ ID NO: 53010 - DNA, 25 bp, Homo sapien
ccctgtcgtgccagtgaggcggggg

SEQ ID NO: 53011 - DNA, 25 bp, Homo sapien
agcccctgtcgtgccagtgaggcgg

SEQ ID NO: 53012 - DNA, 25 bp, Homo sapien
tgcagtggctacctggccgactgcc

SEQ ID NO: 53013 - DNA, 25 bp, Homo sapien
ctgttcctccagtgactctgtggta

SEQ ID NO: 53014 - DNA, 25 bp, Homo sapien
gactgcccaggcagcgacagcagca

SEQ ID NO: 53015 - DNA, 25 bp, Homo sapien
ctctgtggtagactgcactgaggtc

SEQ ID NO: 53016 - DNA, 25 bp, Homo sapien
tgtacgggagctgctccaccttccg

SEQ ID NO: 53017 - DNA, 25 bp, Homo sapien
gcagctccctcagcagcgactatga

SEQ ID NO: 53018 - DNA, 25 bp, Homo sapien
tgcctttcctccgagcggcagtggc

SEQ ID NO: 53019 - DNA, 25 bp, Homo sapien
tgaggtcagcaaccagggcgtgtac

SEQ ID NO: 53020 - DNA, 25 bp, Homo sapien
cacgctggggccgaaagtttaagca

SEQ ID NO: 53021 - DNA, 25 bp, Homo sapien
gagtgtacccaaggcgtgccggtcc

SEQ ID NO: 53022 - DNA, 25 bp, Homo sapien
cacactggtgcagatgttcccgccg

SEQ ID NO: 53023 - DNA, 25 bp, Homo sapien
gtctgcacttgcaagcccgggacca

SEQ ID NO: 53024 - DNA, 25 bp, Homo sapien
ccagggacttgaaagcgcccggcgc

SEQ ID NO: 53025 - DNA, 25 bp, Homo sapien
ccgctgcgctttaggcgggaactgt

SEQ ID NO: 53026 - DNA, 25 bp, Homo sapien
gccgaaagtttaagcaagccgcgcg

SEQ ID NO: 53027 - DNA, 25 bp, Homo sapien
gcaaagggcctaccacgctggggcc

SEQ ID NO: 53028 - DNA, 25 bp, Homo sapien
ctcaggccgggatggtcccttcctg

SEQ ID NO: 53029 - DNA, 25 bp, Homo sapien
tctccgccttgagtcttccaagacc

SEQ ID NO: 53030 - DNA, 25 bp, Homo sapien
ccgggctgggacatcttctctgtct

SEQ ID NO: 53031 - DNA, 25 bp, Homo sapien
acatcttctctgtctcgggatctgg

SEQ ID NO: 53032 - DNA, 25 bp, Homo sapien
aagtccttcatcgacgcaccttgca

SEQ ID NO: 53033 - DNA, 25 bp, Homo sapien
atcgacgcaccttgcaccgggacga

SEQ ID NO: 53034 - DNA, 25 bp, Homo sapien
ctccgagacctccagcgacatccct

SEQ ID NO: 53035 - DNA, 25 bp, Homo sapien
tgcaggacccggtgctcctcagcga

SEQ ID NO: 53036 - DNA, 25 bp, Homo sapien
gcaggtaagagctcccggcgccttt

SEQ ID NO: 53037 - DNA, 25 bp, Homo sapien
caaaggtgtcgaaaaaggatgagtc

SEQ ID NO: 53038 - DNA, 25 bp, Homo sapien
gatgagtcccggatatcattcgctc

SEQ ID NO: 53039 - DNA, 25 bp, Homo sapien
tcattcgctcaggtgaggtgggttc

SEQ ID NO: 53040 - DNA, 25 bp, Homo sapien
tcagtttcccagtctacagcccgtg

SEQ ID NO: 53041 - DNA, 25 bp, Homo sapien
tctacagcccgtgggaggacacctc

SEQ ID NO: 53042 - DNA, 25 bp, Homo sapien
ctccgggctccttccgggttggcag

SEQ ID NO: 53043 - DNA, 25 bp, Homo sapien
ctccgttctccggacgcaggtaaga

SEQ ID NO: 53044 - DNA, 25 bp, Homo sapien
agagcctctccggtttcacgctgag

SEQ ID NO: 53045 - DNA, 25 bp, Homo sapien
acgagtaagcggtggttcatccctc

SEQ ID NO: 53046 - DNA, 25 bp, Homo sapien
tagagccagcggacggaaccattcc

SEQ ID NO: 53047 - DNA, 25 bp, Homo sapien
agcctagtctcgtgctgagagcctc

SEQ ID NO: 53048 - DNA, 25 bp, Homo sapien
cccgcggattagtcagcagttgttc

SEQ ID NO: 53049 - DNA, 25 bp, Homo sapien
ttgcggacgcgaagaacgagtaagc

SEQ ID NO: 53050 - DNA, 25 bp, Homo sapien
cacgtcgggcgctctttagagagga

SEQ ID NO: 53051 - DNA, 25 bp, Homo sapien
agatgctattttggcccgagtgtca

SEQ ID NO: 53052 - DNA, 25 bp, Homo sapien
tgtcgttaatgacggcacagccctt

SEQ ID NO: 53053 - DNA, 25 bp, Homo sapien
tcccagagccaacatgtaaaccagg

SEQ ID NO: 53054 - DNA, 25 bp, Homo sapien
ttggggcaccgacatttcccagagc

SEQ ID NO: 53055 - DNA, 25 bp, Homo sapien
gggccttagccgttgtcttcacttc

SEQ ID NO: 53056 - DNA, 25 bp, Homo sapien
acctgggttcctttcgtgtccactg

SEQ ID NO: 53057 - DNA, 25 bp, Homo sapien
taacccactctgaggtcaggacctg

SEQ ID NO: 53058 - DNA, 25 bp, Homo sapien
tggagataatgcctccgcgcgctga

SEQ ID NO: 53059 - DNA, 25 bp, Homo sapien
agcgcggtcgtgctgttacactatt

SEQ ID NO: 53060 - DNA, 25 bp, Homo sapien
gggactcgagcctgctcatctttgt

SEQ ID NO: 53061 - DNA, 25 bp, Homo sapien
agcctgctcatctttgtgcgggtaa

SEQ ID NO: 53062 - DNA, 25 bp, Homo sapien
gctcatctttgtgcgggtaagggcc

SEQ ID NO: 53063 - DNA, 25 bp, Homo sapien
ccgtgacctgcccacacctgcaggt

SEQ ID NO: 53064 - DNA, 25 bp, Homo sapien
gctgggacacgctggagcattacct

SEQ ID NO: 53065 - DNA, 25 bp, Homo sapien
acacgctggagcattacctggacaa

SEQ ID NO: 53066 - DNA, 25 bp, Homo sapien
ttacctggacaagcacgacccgtgc

SEQ ID NO: 53067 - DNA, 25 bp, Homo sapien
ctggagcattacctggacaagcacg

SEQ ID NO: 53068 - DNA, 25 bp, Homo sapien
tctggctgggccatttcccacgctg

SEQ ID NO: 53069 - DNA, 25 bp, Homo sapien
ggaacccgtttgtccgtgcgcgctc

SEQ ID NO: 53070 - DNA, 25 bp, Homo sapien
gactgcatctgcaccgttgctggcc

SEQ ID NO: 53071 - DNA, 25 bp, Homo sapien
tccgtgcgcgctcggaaacctggag

SEQ ID NO: 53072 - DNA, 25 bp, Homo sapien
cccacctggcctgtggcgtgactgt

SEQ ID NO: 53073 - DNA, 25 bp, Homo sapien
tgagtcaggggtctggatcctccga

SEQ ID NO: 53074 - DNA, 25 bp, Homo sapien
atccgggtggatgggccacgtctct

SEQ ID NO: 53075 - DNA, 25 bp, Homo sapien
gggccatttcccacgctgtggcttc

SEQ ID NO: 53076 - DNA, 25 bp, Homo sapien
gcagtgatgacacaggcactggccc

SEQ ID NO: 53077 - DNA, 25 bp, Homo sapien
gctgcttgtgcgcagggatcgagac

SEQ ID NO: 53078 - DNA, 25 bp, Homo sapien
cgccgctactccggggacagtgact

SEQ ID NO: 53079 - DNA, 25 bp, Homo sapien
ccttggtacccgcagtgatgacaca

SEQ ID NO: 53080 - DNA, 25 bp, Homo sapien
tacccgcagtgatgacacaggcact

SEQ ID NO: 53081 - DNA, 25 bp, Homo sapien
cccagccggcggctgaccacaggca

SEQ ID NO: 53082 - DNA, 25 bp, Homo sapien
tcctgcctgcgcagccagtcccgag

SEQ ID NO: 53083 - DNA, 25 bp, Homo sapien
tcccgagaccggctggatcgcggcc

SEQ ID NO: 53084 - DNA, 25 bp, Homo sapien
ggaagccctgcttaatcctgcctgc

SEQ ID NO: 53085 - DNA, 25 bp, Homo sapien
ggaggtctgtcctttactttgcaca

SEQ ID NO: 53086 - DNA, 25 bp, Homo sapien
cctgctggtctttccacctggtatg

SEQ ID NO: 53087 - DNA, 25 bp, Homo sapien
ccacactctcgggaaggcaccgtta

SEQ ID NO: 53088 - DNA, 25 bp, Homo sapien
tttatgaccgtagcgtaagcacctg

SEQ ID NO: 53089 - DNA, 25 bp, Homo sapien
ccagattgtcagctgtaaccgttta

SEQ ID NO: 53090 - DNA, 25 bp, Homo sapien
tcggtgcttaccacggcctctaaga

SEQ ID NO: 53091 - DNA, 25 bp, Homo sapien
cctccctagatgctctcggtgctta

SEQ ID NO: 53092 - DNA, 25 bp, Homo sapien
tgaatgaacgaaccctcagcccttc

SEQ ID NO: 53093 - DNA, 25 bp, Homo sapien
gctcggttcggcttggcaccaaaat

SEQ ID NO: 53094 - DNA, 25 bp, Homo sapien
ttggcaccaaaatgtccgcggcctc

SEQ ID NO: 53095 - DNA, 25 bp, Homo sapien
acttccggtggacgcaaggcctgaa

SEQ ID NO: 53096 - DNA, 25 bp, Homo sapien
gccgcgtcctcttcatgacctctga

SEQ ID NO: 53097 - DNA, 25 bp, Homo sapien
tcccgctagccaattcagcgtgagg

SEQ ID NO: 53098 - DNA, 25 bp, Homo sapien
gagcccttgggaaaccatcccgcta

SEQ ID NO: 53099 - DNA, 25 bp, Homo sapien
ggcgctgctatgctgcagtctcccg

SEQ ID NO: 53100 - DNA, 25 bp, Homo sapien
ggcggtcacacgtgtccattccctg

SEQ ID NO: 53101 - DNA, 25 bp, Homo sapien
tgtctctagcccgaccgaaaggacc

SEQ ID NO: 53102 - DNA, 25 bp, Homo sapien
cgccgttctcggctggaataaaagc

SEQ ID NO: 53103 - DNA, 25 bp, Homo sapien
aggcttcatatttctagggtggaca

SEQ ID NO: 53104 - DNA, 25 bp, Homo sapien
cttggagttgatctcgccaccatta

SEQ ID NO: 53105 - DNA, 25 bp, Homo sapien
aagccacttcagagctccttgggcg

SEQ ID NO: 53106 - DNA, 25 bp, Homo sapien
gggactccgttattcttccacagcg

SEQ ID NO: 53107 - DNA, 25 bp, Homo sapien
aatatccagcctctttatcgcgggg

SEQ ID NO: 53108 - DNA, 25 bp, Homo sapien
ccaggccgttacgatgagggaagcc

SEQ ID NO: 53109 - DNA, 25 bp, Homo sapien
aggagcgctcttcaatcttccgagg

SEQ ID NO: 53110 - DNA, 25 bp, Homo sapien
ccagccgaggcagtatgccgaggca

SEQ ID NO: 53111 - DNA, 25 bp, Homo sapien
cttccgaggccggatgaagcattcg

SEQ ID NO: 53112 - DNA, 25 bp, Homo sapien
cccggcttccctgagccagtttgga

SEQ ID NO: 53113 - DNA, 25 bp, Homo sapien
aaggctacggctaccttcctgcagc

SEQ ID NO: 53114 - DNA, 25 bp, Homo sapien
agggaagccacgacagccaaggcta

SEQ ID NO: 53115 - DNA, 25 bp, Homo sapien
cgcgattctatcaagcgcagagcca

SEQ ID NO: 53116 - DNA, 25 bp, Homo sapien
cctctcactgccaaggggttggacc

SEQ ID NO: 53117 - DNA, 25 bp, Homo sapien
acgccctgaagtgcgacgtgacgtc

SEQ ID NO: 53118 - DNA, 25 bp, Homo sapien
tgcgccagcgcctagacgacgaggc

SEQ ID NO: 53119 - DNA, 25 bp, Homo sapien
cgcgcggtcagctacgcctggagca

SEQ ID NO: 53120 - DNA, 25 bp, Homo sapien
ccgctccgctatgggcgagctgtac

SEQ ID NO: 53121 - DNA, 25 bp, Homo sapien
cggtggccacctcacgcagtgagaa

SEQ ID NO: 53122 - DNA, 25 bp, Homo sapien
tcaggccatgatgagcttcggcggc

SEQ ID NO: 53123 - DNA, 25 bp, Homo sapien
tccactacgcgctagcccgaaaggg

SEQ ID NO: 53124 - DNA, 25 bp, Homo sapien
gggcgatcagcacctcagtcccgga

SEQ ID NO: 53125 - DNA, 25 bp, Homo sapien
ttttcggatgaggtaacagcgcagc

SEQ ID NO: 53126 - DNA, 25 bp, Homo sapien
cgcgcaccatagagaaccggaagta

SEQ ID NO: 53127 - DNA, 25 bp, Homo sapien
ggagcaaagcttgcccgcgcaccat

SEQ ID NO: 53128 - DNA, 25 bp, Homo sapien
tcacctcacagctccaagaacctgg

SEQ ID NO: 53129 - DNA, 25 bp, Homo sapien
cccaggggcgccctttgggcgatca

SEQ ID NO: 53130 - DNA, 25 bp, Homo sapien
aacacttttcggatgaggtaacagc

SEQ ID NO: 53131 - DNA, 25 bp, Homo sapien
acctggcaccgggagtaagccactg

SEQ ID NO: 53132 - DNA, 25 bp, Homo sapien
cgcgccgtcacagagatgctgcaca

SEQ ID NO: 53133 - DNA, 25 bp, Homo sapien
cgtcacagagatgctgcacagccgc

SEQ ID NO: 53134 - DNA, 25 bp, Homo sapien
agccatgttggagccgcaaaggttg

SEQ ID NO: 53135 - DNA, 25 bp, Homo sapien
tgcacagccgcggagccatgttgga

SEQ ID NO: 53136 - DNA, 25 bp, Homo sapien
gccgcagctgcagacgcaacgtccc

SEQ ID NO: 53137 - DNA, 25 bp, Homo sapien
tggccgggctctcaccgcgccgcag

SEQ ID NO: 53138 - DNA, 25 bp, Homo sapien
ccgcgcgcgtctatccctgcctggc

SEQ ID NO: 53139 - DNA, 25 bp, Homo sapien
tcactcacccggtcaggtgggcgtt

SEQ ID NO: 53140 - DNA, 25 bp, Homo sapien
ttcaattgcgaggtaaccggccggc

SEQ ID NO: 53141 - DNA, 25 bp, Homo sapien
ggacgccgagatggagttcaattgc

SEQ ID NO: 53142 - DNA, 25 bp, Homo sapien
gttcaccgtgaggatcgtcaccatg

SEQ ID NO: 53143 - DNA, 25 bp, Homo sapien
atgagcttcagctctctcaagagga

SEQ ID NO: 53144 - DNA, 25 bp, Homo sapien
gggccatcgcttcccgcatgagctt

SEQ ID NO: 53145 - DNA, 25 bp, Homo sapien
gcatctatgcgtcagcctccggttc

SEQ ID NO: 53146 - DNA, 25 bp, Homo sapien
gagcgggaaagtcctgcctaccttg

SEQ ID NO: 53147 - DNA, 25 bp, Homo sapien
ttcccagccaatcgcagcatctatg

SEQ ID NO: 53148 - DNA, 25 bp, Homo sapien
cgcggctctctgctcgcattgacat

SEQ ID NO: 53149 - DNA, 25 bp, Homo sapien
tgctcgcattgacattccgctcgtg

SEQ ID NO: 53150 - DNA, 25 bp, Homo sapien
tgcccaacctgctgtcggagcagcg

SEQ ID NO: 53151 - DNA, 25 bp, Homo sapien
atgtaccggggcatctacaccgtgc

SEQ ID NO: 53152 - DNA, 25 bp, Homo sapien
caagatgccgttccacccggtgacg

SEQ ID NO: 53153 - DNA, 25 bp, Homo sapien
taaaaattcaatctgctcgggcagc

SEQ ID NO: 53154 - DNA, 25 bp, Homo sapien
gcggagcctccaagatgccgttcca

SEQ ID NO: 53155 - DNA, 25 bp, Homo sapien
ccgctcgtgtcgctttaaaaattca

SEQ ID NO: 53156 - DNA, 25 bp, Homo sapien
acttccgattgctggccatctctgg

SEQ ID NO: 53157 - DNA, 25 bp, Homo sapien
gtttggcctccctgaacgcctcgag

SEQ ID NO: 53158 - DNA, 25 bp, Homo sapien
cggcagttttgctcacttccgattg

SEQ ID NO: 53159 - DNA, 25 bp, Homo sapien
cgggctgcagacttgcggcagtttt

SEQ ID NO: 53160 - DNA, 25 bp, Homo sapien
cgggatggaacctgatggaaacgtc

SEQ ID NO: 53161 - DNA, 25 bp, Homo sapien
ccgagagattttcgggatggaacct

SEQ ID NO: 53162 - DNA, 25 bp, Homo sapien
ctgatggaaacgtccgtggtcagga

SEQ ID NO: 53163 - DNA, 25 bp, Homo sapien
ctcgagctccttggcgagcacgtga

SEQ ID NO: 53164 - DNA, 25 bp, Homo sapien
gcatgaagtagacgccacctggatg

SEQ ID NO: 53165 - DNA, 25 bp, Homo sapien
cttgcgtgcgcaagagtctcatctg

SEQ ID NO: 53166 - DNA, 25 bp, Homo sapien
agcagatccgccagacttgcgtgcg

SEQ ID NO: 53167 - DNA, 25 bp, Homo sapien
aagagtctcatctgcgccttcgcca

SEQ ID NO: 53168 - DNA, 25 bp, Homo sapien
ttcgccatcgccttcatcatcagtg

SEQ ID NO: 53169 - DNA, 25 bp, Homo sapien
gtcatgctcattgcggccaaccagg

SEQ ID NO: 53170 - DNA, 25 bp, Homo sapien
ccaaccaggtgctgcgcagtggcat

SEQ ID NO: 53171 - DNA, 25 bp, Homo sapien
gcggctcctgactccatcgctttga

SEQ ID NO: 53172 - DNA, 25 bp, Homo sapien
cttccagtgcggagaaaagagacta

SEQ ID NO: 53173 - DNA, 25 bp, Homo sapien
gtcatgttcttcgagcgcgccttcg

SEQ ID NO: 53174 - DNA, 25 bp, Homo sapien
caccatcatcgtgggcgtcatgttc

SEQ ID NO: 53175 - DNA, 25 bp, Homo sapien
cggccgcgacgttgacttcgaaatt

SEQ ID NO: 53176 - DNA, 25 bp, Homo sapien
gttcgcccttcccagagagctttgg

SEQ ID NO: 53177 - DNA, 25 bp, Homo sapien
ctgggctgtcctgatatgaaccttt

SEQ ID NO: 53178 - DNA, 25 bp, Homo sapien
tcgcgtactgcttgctgggattcgt

SEQ ID NO: 53179 - DNA, 25 bp, Homo sapien
gcggacgctatctacgaccacatca

SEQ ID NO: 53180 - DNA, 25 bp, Homo sapien
atctggcagggaccagccacgcact

SEQ ID NO: 53181 - DNA, 25 bp, Homo sapien
tccgcaggagcagacaggaagtctc

SEQ ID NO: 53182 - DNA, 25 bp, Homo sapien
gaccacggtgacagctccctgagcg

SEQ ID NO: 53183 - DNA, 25 bp, Homo sapien
gggtcccttgccctgcatctggcag

SEQ ID NO: 53184 - DNA, 25 bp, Homo sapien
ggctgcccaaggcatagccgcggct

SEQ ID NO: 53185 - DNA, 25 bp, Homo sapien
ggtccaacgccactctggggccgaa

SEQ ID NO: 53186 - DNA, 25 bp, Homo sapien
agagccgagcaaactaccgccggga

SEQ ID NO: 53187 - DNA, 25 bp, Homo sapien
ccaagtctcgagaggcggctcacaa

SEQ ID NO: 53188 - DNA, 25 bp, Homo sapien
agcagccggacgagacgtcccagcg

SEQ ID NO: 53189 - DNA, 25 bp, Homo sapien
gagcgcccggagttattcccacgaa

SEQ ID NO: 53190 - DNA, 25 bp, Homo sapien
actgtgccgtggagggcctcgccat

SEQ ID NO: 53191 - DNA, 25 bp, Homo sapien
tagcagccggacgagacgtcccagc

SEQ ID NO: 53192 - DNA, 25 bp, Homo sapien
gtagcagccggacgagacgtcccag

SEQ ID NO: 53193 - DNA, 25 bp, Homo sapien
agtagcagccggacgagacgtccca

SEQ ID NO: 53194 - DNA, 25 bp, Homo sapien
gagtagcagccggacgagacgtccc

SEQ ID NO: 53195 - DNA, 25 bp, Homo sapien
tctcctcggcgggtgaggaagagct

SEQ ID NO: 53196 - DNA, 25 bp, Homo sapien
gaaaatggctgctcgcccagctcca

SEQ ID NO: 53197 - DNA, 25 bp, Homo sapien
gagctcatcctgcagggtgaccgca

SEQ ID NO: 53198 - DNA, 25 bp, Homo sapien
tacatcctggactggtggagccagc

SEQ ID NO: 53199 - DNA, 25 bp, Homo sapien
tgaccgcactgtcaggtccaggagc

SEQ ID NO: 53200 - DNA, 25 bp, Homo sapien
gcgccttcccagacgcggatgacgt

SEQ ID NO: 53201 - DNA, 25 bp, Homo sapien
gctccatcaccagcagcggcttgtg

SEQ ID NO: 53202 - DNA, 25 bp, Homo sapien
ggcttgtggacaactcgcccacgca

SEQ ID NO: 53203 - DNA, 25 bp, Homo sapien
tcaggggacactgctcggagacaaa

SEQ ID NO: 53204 - DNA, 25 bp, Homo sapien
ccctgctttgcatattcatgaagtc

SEQ ID NO: 53205 - DNA, 25 bp, Homo sapien
cctgaccgaaggtcgcgtcgggtca

SEQ ID NO: 53206 - DNA, 25 bp, Homo sapien
ttcatgaagtctagcgaggccggtc

SEQ ID NO: 53207 - DNA, 25 bp, Homo sapien
ttcatgaggaaacctctggtcccgc

SEQ ID NO: 53208 - DNA, 25 bp, Homo sapien
gcccagaaaggcctcgttgactatt

SEQ ID NO: 53209 - DNA, 25 bp, Homo sapien
ttgactattcatgagccgaggagcg

SEQ ID NO: 53210 - DNA, 25 bp, Homo sapien
ctgtcgttgtataggtggcccaggc

SEQ ID NO: 53211 - DNA, 25 bp, Homo sapien
gccgtggacgggtcatgaattattc

SEQ ID NO: 53212 - DNA, 25 bp, Homo sapien
catggcccacgtggtacttgctgca

SEQ ID NO: 53213 - DNA, 25 bp, Homo sapien
agcttggccttctccgtgccgttgg

SEQ ID NO: 53214 - DNA, 25 bp, Homo sapien
tgcggtacagctccaccagcttggc

SEQ ID NO: 53215 - DNA, 25 bp, Homo sapien
gtaggtcacgtccacatggcccacg

SEQ ID NO: 53216 - DNA, 25 bp, Homo sapien
ggtacttgctgcacaggcggcacag

SEQ ID NO: 53217 - DNA, 25 bp, Homo sapien
agcacgttgctaaggaggcctcgca

SEQ ID NO: 53218 - DNA, 25 bp, Homo sapien
tgaggatcttctggtcccgggtgat

SEQ ID NO: 53219 - DNA, 25 bp, Homo sapien
tgccaaggtacacgactatgcggta

SEQ ID NO: 53220 - DNA, 25 bp, Homo sapien
ttgggaccatgtgcccgcgctcgct

SEQ ID NO: 53221 - DNA, 25 bp, Homo sapien
gcgcggggcgggtgtatttacctgc

SEQ ID NO: 53222 - DNA, 25 bp, Homo sapien
gtccggctcgcgctgccaagcgccc

SEQ ID NO: 53223 - DNA, 25 bp, Homo sapien
cgccacccagcgcctccggtggctg

SEQ ID NO: 53224 - DNA, 25 bp, Homo sapien
tgcttgggaccatgtgcccgcgctc

SEQ ID NO: 53225 - DNA, 25 bp, Homo sapien
gtgcttgggaccatgtgcccgcgct

SEQ ID NO: 53226 - DNA, 25 bp, Homo sapien
cccaagtgttcgtgtgtctgcggcg

SEQ ID NO: 53227 - DNA, 25 bp, Homo sapien
tgccaagcgccccaagttgccgccg

SEQ ID NO: 53228 - DNA, 25 bp, Homo sapien
ggcgatcctaatcctccgaccctgg

SEQ ID NO: 53229 - DNA, 25 bp, Homo sapien
tttagtactggctcggggatagacc

SEQ ID NO: 53230 - DNA, 25 bp, Homo sapien
ctaggatgtgcagctccatcgcggc

SEQ ID NO: 53231 - DNA, 25 bp, Homo sapien
acccggtgttctaggatgtgcagct

SEQ ID NO: 53232 - DNA, 25 bp, Homo sapien
gagaagcctattgggtggtcacgcc

SEQ ID NO: 53233 - DNA, 25 bp, Homo sapien
attgggtggtcacgcctcctcctaa

SEQ ID NO: 53234 - DNA, 25 bp, Homo sapien
gctccgccttttttagtactggctc

SEQ ID NO: 53235 - DNA, 25 bp, Homo sapien
caactagacccaggccgcacgggag

SEQ ID NO: 53236 - DNA, 25 bp, Homo sapien
tccgggctgccaatcacaagaactc

SEQ ID NO: 53237 - DNA, 25 bp, Homo sapien
cctccgagtcagacccgagagagct

SEQ ID NO: 53238 - DNA, 25 bp, Homo sapien
gcgggcgccaacaagcccgaagtga

SEQ ID NO: 53239 - DNA, 25 bp, Homo sapien
gaagccgttggcctccgagtcagac

SEQ ID NO: 53240 - DNA, 25 bp, Homo sapien
cgagcccacgatgaagccgaacttg

SEQ ID NO: 53241 - DNA, 25 bp, Homo sapien
tgtcacctactgcagagcgcgagcc

SEQ ID NO: 53242 - DNA, 25 bp, Homo sapien
aagaactcacctggacgagctcggg

SEQ ID NO: 53243 - DNA, 25 bp, Homo sapien
gccgaacttgtcgatgcggcgctcg

SEQ ID NO: 53244 - DNA, 25 bp, Homo sapien
cagctccgccggagagcaggcgaac

SEQ ID NO: 53245 - DNA, 25 bp, Homo sapien
gcccggctcttatagtcgcgccagc

SEQ ID NO: 53246 - DNA, 25 bp, Homo sapien
tggagcctcagccagatcccgagcg

SEQ ID NO: 53247 - DNA, 25 bp, Homo sapien
acgcggcgcttggagcctcagccag

SEQ ID NO: 53248 - DNA, 25 bp, Homo sapien
gcccgttctagagaattcaggggcc

SEQ ID NO: 53249 - DNA, 25 bp, Homo sapien
gctgaatgcccgttctagagaattc

SEQ ID NO: 53250 - DNA, 25 bp, Homo sapien
ggccatgctgaatgcccgttctaga

SEQ ID NO: 53251 - DNA, 25 bp, Homo sapien
cgcagagcgccaaggccatgctgaa

SEQ ID NO: 53252 - DNA, 25 bp, Homo sapien
ttcctgtgcgagtaaggagcgccca

SEQ ID NO: 53253 - DNA, 25 bp, Homo sapien
ggctcctttactccacaggccagta

SEQ ID NO: 53254 - DNA, 25 bp, Homo sapien
ccggccgcttattcctgtgcgagta

SEQ ID NO: 53255 - DNA, 25 bp, Homo sapien
cggtcagtacgacgagctcgcaaga

SEQ ID NO: 53256 - DNA, 25 bp, Homo sapien
gccgaccagacacgaaggctgaagc

SEQ ID NO: 53257 - DNA, 25 bp, Homo sapien
cgccgaagacaggtgagatgttgta

SEQ ID NO: 53258 - DNA, 25 bp, Homo sapien
cgcgaaggtacgactggcgcacttc

SEQ ID NO: 53259 - DNA, 25 bp, Homo sapien
agatgttgtacgtcacccgccggac

SEQ ID NO: 53260 - DNA, 25 bp, Homo sapien
ctcaccagcagcagacgaccgccca

SEQ ID NO: 53261 - DNA, 25 bp, Homo sapien
gcgggaaggcggaaagtcagagaga

SEQ ID NO: 53262 - DNA, 25 bp, Homo sapien
gcgagctggcccaacagtggggcca

SEQ ID NO: 53263 - DNA, 25 bp, Homo sapien
cctggcgcggcagtctcacgtccac

SEQ ID NO: 53264 - DNA, 25 bp, Homo sapien
gagccgatcctgacgccctccagga

SEQ ID NO: 53265 - DNA, 25 bp, Homo sapien
gtcggcttcggagccgatcctgacg

SEQ ID NO: 53266 - DNA, 25 bp, Homo sapien
ccgggtcggcttcggagccgatcct

SEQ ID NO: 53267 - DNA, 25 bp, Homo sapien
aggtgcttcggcagcggacgcgtca

SEQ ID NO: 53268 - DNA, 25 bp, Homo sapien
agtctgtgctccatcagctgccgca

SEQ ID NO: 53269 - DNA, 25 bp, Homo sapien
cattggccaaggtgagctgtagccc

SEQ ID NO: 53270 - DNA, 25 bp, Homo sapien
ccaaggtgagctgtagccctggccc

SEQ ID NO: 53271 - DNA, 25 bp, Homo sapien
cctctcgggatcctttaagaggcgg

SEQ ID NO: 53272 - DNA, 25 bp, Homo sapien
cccaggcagaaggaggcattggcca

SEQ ID NO: 53273 - DNA, 25 bp, Homo sapien
ggacgagtctgtgctccatcagctg

SEQ ID NO: 53274 - DNA, 25 bp, Homo sapien
tccgcctctcgggatcctttaagag

SEQ ID NO: 53275 - DNA, 25 bp, Homo sapien
tccccgcggttgagccacgatgagc

SEQ ID NO: 53276 - DNA, 25 bp, Homo sapien
cggcctgggtttacaacgctgttag

SEQ ID NO: 53277 - DNA, 25 bp, Homo sapien
tccacgccagcattgccggtgtttc

SEQ ID NO: 53278 - DNA, 25 bp, Homo sapien
cgatcacgtggttttagggactgtc

SEQ ID NO: 53279 - DNA, 25 bp, Homo sapien
gccatctttgatcagggcactaagg

SEQ ID NO: 53280 - DNA, 25 bp, Homo sapien
cccagcttgccttctgattggtcca

SEQ ID NO: 53281 - DNA, 25 bp, Homo sapien
tctagcgtgagctttcccaaggggc

SEQ ID NO: 53282 - DNA, 25 bp, Homo sapien
agcagccgtttcacgccaatagata

SEQ ID NO: 53283 - DNA, 25 bp, Homo sapien
gtgaaattcaatgcccaccgctagg

SEQ ID NO: 53284 - DNA, 25 bp, Homo sapien
gcggagatttcctgacctgtccttc

SEQ ID NO: 53285 - DNA, 25 bp, Homo sapien
cagtctgtaaaacccgagcctggga

SEQ ID NO: 53286 - DNA, 25 bp, Homo sapien
gcagagcgcgatctctaccgggaca

SEQ ID NO: 53287 - DNA, 25 bp, Homo sapien
cggagactgcagtggagccagtacc

SEQ ID NO: 53288 - DNA, 25 bp, Homo sapien
gctcagagaaaacgtgacgaaaacc

SEQ ID NO: 53289 - DNA, 25 bp, Homo sapien
accaccactgggctggagaagcagg

SEQ ID NO: 53290 - DNA, 25 bp, Homo sapien
agacgctccctgctggcggagattt

SEQ ID NO: 53291 - DNA, 25 bp, Homo sapien
accgggacacgtgggtgcgatacct

SEQ ID NO: 53292 - DNA, 25 bp, Homo sapien
acacttactcctactctggcctctg

SEQ ID NO: 53293 - DNA, 25 bp, Homo sapien
tgggaggcccgctgcacacttactc

SEQ ID NO: 53294 - DNA, 25 bp, Homo sapien
ctctgcttccaggatcgactgcctg

SEQ ID NO: 53295 - DNA, 25 bp, Homo sapien
tccaggatcgactgcctgatgaaga

SEQ ID NO: 53296 - DNA, 25 bp, Homo sapien
atcgactgcctgatgaagacggctc

SEQ ID NO: 53297 - DNA, 25 bp, Homo sapien
actgcctgatgaagacggctcgggc

SEQ ID NO: 53298 - DNA, 25 bp, Homo sapien
cggagggcttcttcggcatgtaccg

SEQ ID NO: 53299 - DNA, 25 bp, Homo sapien
atctgatcagctgggatgtgcccgc

SEQ ID NO: 53300 - DNA, 25 bp, Homo sapien
tggagagcacgcaaggtcagaagac

SEQ ID NO: 53301 - DNA, 25 bp, Homo sapien
aggctcggtgttccagtctgtacca

SEQ ID NO: 53302 - DNA, 25 bp, Homo sapien
aggtcagaagactggattcggctcc

SEQ ID NO: 53303 - DNA, 25 bp, Homo sapien
attcggctcctggtcacgcagagat

SEQ ID NO: 53304 - DNA, 25 bp, Homo sapien
gtgctgcacgtagccgcctcaacaa

SEQ ID NO: 53305 - DNA, 25 bp, Homo sapien
tcaacaaccgcacgctggaccagag

SEQ ID NO: 53306 - DNA, 25 bp, Homo sapien
gggcagaacagaggcgctctctcca

SEQ ID NO: 53307 - DNA, 25 bp, Homo sapien
cctcctgggccagatgttggtcccg

SEQ ID NO: 53308 - DNA, 25 bp, Homo sapien
ccagtgggaagcgggagtagccgcg

SEQ ID NO: 53309 - DNA, 25 bp, Homo sapien
gcaggacgcgaaagggcaggccggt

SEQ ID NO: 53310 - DNA, 25 bp, Homo sapien
ccaccctgcccacaccgcgaccctc

SEQ ID NO: 53311 - DNA, 25 bp, Homo sapien
catccgtctcgcgaccctaccagaa

SEQ ID NO: 53312 - DNA, 25 bp, Homo sapien
taccagaaagtccactccagctttt

SEQ ID NO: 53313 - DNA, 25 bp, Homo sapien
cgtctcgcgaccctaccagaaagtc

SEQ ID NO: 53314 - DNA, 25 bp, Homo sapien
ctaccagaaagtccactccagcttt

SEQ ID NO: 53315 - DNA, 25 bp, Homo sapien
accagaaagtccactccagcttttc

SEQ ID NO: 53316 - DNA, 25 bp, Homo sapien
cccaagaggggccttcagctttggg

SEQ ID NO: 53317 - DNA, 25 bp, Homo sapien
aacaagtttgcgcaaagtggagcgg

SEQ ID NO: 53318 - DNA, 25 bp, Homo sapien
acgatgtagccagctcgcagcgctg

SEQ ID NO: 53319 - DNA, 25 bp, Homo sapien
taagaggacgatgtagccagctcgc

SEQ ID NO: 53320 - DNA, 25 bp, Homo sapien
ccaccttaagaggacgatgtagcca

SEQ ID NO: 53321 - DNA, 25 bp, Homo sapien
ctttggggctcagaggcacgacctc

SEQ ID NO: 53322 - DNA, 25 bp, Homo sapien
cagctttggggctcagaggcacgac

SEQ ID NO: 53323 - DNA, 25 bp, Homo sapien
ccagcctctcgccagtgggaagcgg

SEQ ID NO: 53324 - DNA, 25 bp, Homo sapien
tcttgcaggaactcggtcagcttgt

SEQ ID NO: 53325 - DNA, 25 bp, Homo sapien
cacctcgtcgtagtggaagcgcatg

SEQ ID NO: 53326 - DNA, 25 bp, Homo sapien
gcccgatgctcttcttgaggttgta

SEQ ID NO: 53327 - DNA, 25 bp, Homo sapien
cccaggtcgaagaagagcaggtttc

SEQ ID NO: 53328 - DNA, 25 bp, Homo sapien
agcaccaggtggaagcgacgctcca

SEQ ID NO: 53329 - DNA, 25 bp, Homo sapien
agcttgaagtagagcacgtcctcca

SEQ ID NO: 53330 - DNA, 25 bp, Homo sapien
cccgtcgatgcagatggtccgcatg

SEQ ID NO: 53331 - DNA, 25 bp, Homo sapien
gtagtcgaagtcattgcggccgtta

SEQ ID NO: 53332 - DNA, 25 bp, Homo sapien
ttccagatctttcccgctcacaatg

SEQ ID NO: 53333 - DNA, 25 bp, Homo sapien
gctgcccaatgagatgcctgtacaa

SEQ ID NO: 53334 - DNA, 25 bp, Homo sapien
tgacgattcattgactgtgagcctc

SEQ ID NO: 53335 - DNA, 25 bp, Homo sapien
cggcttcgggttctctttggttcat

SEQ ID NO: 53336 - DNA, 25 bp, Homo sapien
cggttgctaagcgtcgtcagacttc

SEQ ID NO: 53337 - DNA, 25 bp, Homo sapien
ggcttttctgtaatcaccctgatga

SEQ ID NO: 53338 - DNA, 25 bp, Homo sapien
ggtcacgtcgatcccgtctttccag

SEQ ID NO: 53339 - DNA, 25 bp, Homo sapien
tctcgcagctgattacggtcacgtc

SEQ ID NO: 53340 - DNA, 25 bp, Homo sapien
acggccggctgaaattctgcttttc

SEQ ID NO: 53341 - DNA, 25 bp, Homo sapien
ctccgcgctgcgagcctaggcgaag

SEQ ID NO: 53342 - DNA, 25 bp, Homo sapien
gggactcccagatacctgctcggtc

SEQ ID NO: 53343 - DNA, 25 bp, Homo sapien
tctccacacggagagcgcgtttgtg

SEQ ID NO: 53344 - DNA, 25 bp, Homo sapien
ttctttgccttctccacacggagag

SEQ ID NO: 53345 - DNA, 25 bp, Homo sapien
tgaaattctgcttttcgttctttgg

SEQ ID NO: 53346 - DNA, 25 bp, Homo sapien
cgcacggccggctgaaattctgctt

SEQ ID NO: 53347 - DNA, 25 bp, Homo sapien
cgctgccggggattcaccttggctg

SEQ ID NO: 53348 - DNA, 25 bp, Homo sapien
cccagtgtctccagcaatgcgcgtt

SEQ ID NO: 53349 - DNA, 25 bp, Homo sapien
gaagagaggctgaccacgccagctc

SEQ ID NO: 53350 - DNA, 25 bp, Homo sapien
cagagcacgcaggagttcccagggt

SEQ ID NO: 53351 - DNA, 25 bp, Homo sapien
gtctactgggcagatgcgcaggccc

SEQ ID NO: 53352 - DNA, 25 bp, Homo sapien
ggtgctcagcccaattttccgtgta

SEQ ID NO: 53353 - DNA, 25 bp, Homo sapien
gccgcagccaaagcctcagagagca

SEQ ID NO: 53354 - DNA, 25 bp, Homo sapien
tgtcagctcactgcccgggcgctgt

SEQ ID NO: 53355 - DNA, 25 bp, Homo sapien
aatgcgcgttcatctccatggaggg

SEQ ID NO: 53356 - DNA, 25 bp, Homo sapien
agggagcccgaactctttcagactc

SEQ ID NO: 53357 - DNA, 25 bp, Homo sapien
ggtgcccagagccttcgttagactc

SEQ ID NO: 53358 - DNA, 25 bp, Homo sapien
gggctcgaaccaccctctcgatagg

SEQ ID NO: 53359 - DNA, 25 bp, Homo sapien
gagagacccgtcatgatcccgcagc

SEQ ID NO: 53360 - DNA, 25 bp, Homo sapien
ctggcctaacgctttggtttccata

SEQ ID NO: 53361 - DNA, 25 bp, Homo sapien
cctgtgccgggtcttcagagaaatc

SEQ ID NO: 53362 - DNA, 25 bp, Homo sapien
tgtttctcgaacagggaagccgcca

SEQ ID NO: 53363 - DNA, 25 bp, Homo sapien
atgacacagctgactacgcccttgg

SEQ ID NO: 53364 - DNA, 25 bp, Homo sapien
aggagcgacccacagacaggtaatg

SEQ ID NO: 53365 - DNA, 25 bp, Homo sapien
gggcgtcgtctttagcctttagcgc

SEQ ID NO: 53366 - DNA, 25 bp, Homo sapien
cgggctccgcattcatcattgttcc

SEQ ID NO: 53367 - DNA, 25 bp, Homo sapien
ggagttgaccgaccaccaagctctt

SEQ ID NO: 53368 - DNA, 25 bp, Homo sapien
gctcttccgcccacaggtgttgtca

SEQ ID NO: 53369 - DNA, 25 bp, Homo sapien
gtgttgtcagagctccttccaccgg

SEQ ID NO: 53370 - DNA, 25 bp, Homo sapien
cagtgccaagatcggaacctgtgtc

SEQ ID NO: 53371 - DNA, 25 bp, Homo sapien
aacctgtgtccgagacgacgtctga

SEQ ID NO: 53372 - DNA, 25 bp, Homo sapien
tccaggccacgctcgggcattttaa

SEQ ID NO: 53373 - DNA, 25 bp, Homo sapien
ctccagcctcgattggggcgcgata

SEQ ID NO: 53374 - DNA, 25 bp, Homo sapien
gcccttgcagcgctcaggctgacgg

SEQ ID NO: 53375 - DNA, 25 bp, Homo sapien
atcgctctccgagcagtgctccagg

SEQ ID NO: 53376 - DNA, 25 bp, Homo sapien
gaagaaggctaatcccagcctggga

SEQ ID NO: 53377 - DNA, 25 bp, Homo sapien
gctcgcctttatctagccctctggg

SEQ ID NO: 53378 - DNA, 25 bp, Homo sapien
gcccttagtgtcgtgtcgggttcca

SEQ ID NO: 53379 - DNA, 25 bp, Homo sapien
ccctctgggcgagagaagaaggcta

SEQ ID NO: 53380 - DNA, 25 bp, Homo sapien
gctccggctgcctgaataaatttaa

SEQ ID NO: 53381 - DNA, 25 bp, Homo sapien
cgtgatcgatccacgggagcctctg

SEQ ID NO: 53382 - DNA, 25 bp, Homo sapien
tggctttgctgcgtgatcgatccac

SEQ ID NO: 53383 - DNA, 25 bp, Homo sapien
ggggacagcactttcgctcggattt

SEQ ID NO: 53384 - DNA, 25 bp, Homo sapien
accgagctgtgcacgcgtccgtgca

SEQ ID NO: 53385 - DNA, 25 bp, Homo sapien
gttaacgcgctcatgtaccgggtgg

SEQ ID NO: 53386 - DNA, 25 bp, Homo sapien
tgacattgaagtggggagcctgcat

SEQ ID NO: 53387 - DNA, 25 bp, Homo sapien
tcgctcggattttcgcattaaaatg

SEQ ID NO: 53388 - DNA, 25 bp, Homo sapien
ggtgtggtccggctcacaccgcagc

SEQ ID NO: 53389 - DNA, 25 bp, Homo sapien
agggcgtagcgccaaccgacagccg

SEQ ID NO: 53390 - DNA, 25 bp, Homo sapien
cctcaacgagcacgaggagggcgta

SEQ ID NO: 53391 - DNA, 25 bp, Homo sapien
agaacatgtactacttctcagagct

SEQ ID NO: 53392 - DNA, 25 bp, Homo sapien
gaacgcggagaacatgtactacttc

SEQ ID NO: 53393 - DNA, 25 bp, Homo sapien
ccacagggagaacgcggagaacatg

SEQ ID NO: 53394 - DNA, 25 bp, Homo sapien
aggccaataccgagaagcagcggct

SEQ ID NO: 53395 - DNA, 25 bp, Homo sapien
gccgttgggacgaggccaataccga

SEQ ID NO: 53396 - DNA, 25 bp, Homo sapien
ggcagtgcccaagacccgagcaaaa

SEQ ID NO: 53397 - DNA, 25 bp, Homo sapien
gcagatctcgggttcctttacttta

SEQ ID NO: 53398 - DNA, 25 bp, Homo sapien
tgcttttgcacgtcagcatcgctga

SEQ ID NO: 53399 - DNA, 25 bp, Homo sapien
cgcggcttcgtaagacccaaccaag

SEQ ID NO: 53400 - DNA, 25 bp, Homo sapien
ccgacctcttggatctggtgacttg

SEQ ID NO: 53401 - DNA, 25 bp, Homo sapien
gggcaaatctccgtcctcaggccga

SEQ ID NO: 53402 - DNA, 25 bp, Homo sapien
ctcgggtccttctacgtcgctgact

SEQ ID NO: 53403 - DNA, 25 bp, Homo sapien
agtcacatgagctgcggggcaaatc

SEQ ID NO: 53404 - DNA, 25 bp, Homo sapien
gtcttgtcgcttccgcctcgagcgt

SEQ ID NO: 53405 - DNA, 25 bp, Homo sapien
gctcgcgaggcttccaaagcgcatg

SEQ ID NO: 53406 - DNA, 25 bp, Homo sapien
agcaaaaccacgcaggcgtcttgtc

SEQ ID NO: 53407 - DNA, 25 bp, Homo sapien
ttgcggaagccctccacagttcata

SEQ ID NO: 53408 - DNA, 25 bp, Homo sapien
ccgttggctggttatgaaccgttca

SEQ ID NO: 53409 - DNA, 25 bp, Homo sapien
ttagactaagcatggtccacccgcg

SEQ ID NO: 53410 - DNA, 25 bp, Homo sapien
cacccgcgaatcctctacagagatg

SEQ ID NO: 53411 - DNA, 25 bp, Homo sapien
aaagcgcatgcgcaggtcacggtac

SEQ ID NO: 53412 - DNA, 25 bp, Homo sapien
ggcctatgcgtttgcgattcgacga

SEQ ID NO: 53413 - DNA, 25 bp, Homo sapien
tacccggatctcacaactgcctttg

SEQ ID NO: 53414 - DNA, 25 bp, Homo sapien
cgaaattcggcgtttagagctgctc

SEQ ID NO: 53415 - DNA, 25 bp, Homo sapien
agccaccgctttgtctccgatagtg

SEQ ID NO: 53416 - DNA, 25 bp, Homo sapien
tccgcggagcattcagccaatcaca

SEQ ID NO: 53417 - DNA, 25 bp, Homo sapien
aggagccatcttgtctcgtcgccgg

SEQ ID NO: 53418 - DNA, 25 bp, Homo sapien
agagcgctcttggaaccatgtgctg

SEQ ID NO: 53419 - DNA, 25 bp, Homo sapien
gccctgatgtacagcctcctgattg

SEQ ID NO: 53420 - DNA, 25 bp, Homo sapien
tgtcgggtcccgaaagagctaagcc

SEQ ID NO: 53421 - DNA, 25 bp, Homo sapien
gacggcggccaagcttaaacactga

SEQ ID NO: 53422 - DNA, 25 bp, Homo sapien
tgtcctgaaggctctgagactccta

SEQ ID NO: 53423 - DNA, 25 bp, Homo sapien
ggcgtggccgtcaaattgaattttc

SEQ ID NO: 53424 - DNA, 25 bp, Homo sapien
tgaattttcccaatggggcacgaga

SEQ ID NO: 53425 - DNA, 25 bp, Homo sapien
gcacgagagtgggaggtacccaatc

SEQ ID NO: 53426 - DNA, 25 bp, Homo sapien
gcagctctccgcagaatccagggga

SEQ ID NO: 53427 - DNA, 25 bp, Homo sapien
ctgcgcgtgtctaatccgtctgtcg

SEQ ID NO: 53428 - DNA, 25 bp, Homo sapien
agcacagcacggctgggccgcgaga

SEQ ID NO: 53429 - DNA, 25 bp, Homo sapien
cccactttcgaaggaatctgccttg

SEQ ID NO: 53430 - DNA, 25 bp, Homo sapien
gaatctgccttgctgttcctgcggc

SEQ ID NO: 53431 - DNA, 25 bp, Homo sapien
ctgccttgctgttcctgcggccgag

SEQ ID NO: 53432 - DNA, 25 bp, Homo sapien
gccgaggccagaaacaatagtggga

SEQ ID NO: 53433 - DNA, 25 bp, Homo sapien
aggccagaaacaatagtgggaggaa

SEQ ID NO: 53434 - DNA, 25 bp, Homo sapien
tcgaaggaatctgccttgctgttcc

SEQ ID NO: 53435 - DNA, 25 bp, Homo sapien
cggcggggagcttggcgccagcaca

SEQ ID NO: 53436 - DNA, 25 bp, Homo sapien
ggccgggccatataaggaaaagcta

SEQ ID NO: 53437 - DNA, 25 bp, Homo sapien
cggctcccgcacattcttgaggatt

SEQ ID NO: 53438 - DNA, 25 bp, Homo sapien
cccgcacattcttgaggattgggcc

SEQ ID NO: 53439 - DNA, 25 bp, Homo sapien
gagttcgagttcgacctccgccact

SEQ ID NO: 53440 - DNA, 25 bp, Homo sapien
tccgccactcagctgggtgtcctgg

SEQ ID NO: 53441 - DNA, 25 bp, Homo sapien
ttcttccctttagatccggacactg

SEQ ID NO: 53442 - DNA, 25 bp, Homo sapien
tccggacactgaagcaggcggtagc

SEQ ID NO: 53443 - DNA, 25 bp, Homo sapien
cccgctggcctcgtggcaagaacgg

SEQ ID NO: 53444 - DNA, 25 bp, Homo sapien
tgcagcgatccaccagcttcggggt

SEQ ID NO: 53445 - DNA, 25 bp, Homo sapien
ctagatctgtggtgcaaaggcccga

SEQ ID NO: 53446 - DNA, 25 bp, Homo sapien
cgcgcaaggccatgattgagaagct

SEQ ID NO: 53447 - DNA, 25 bp, Homo sapien
aaagagctgatgaaggcgcagagtc

SEQ ID NO: 53448 - DNA, 25 bp, Homo sapien
cccttatagtcgtgtgacctggtcc

SEQ ID NO: 53449 - DNA, 25 bp, Homo sapien
tggactggtgtcgagccaagactcg

SEQ ID NO: 53450 - DNA, 25 bp, Homo sapien
caagactcgcggctacgaggtgagc

SEQ ID NO: 53451 - DNA, 25 bp, Homo sapien
caaaggcccgaaggtcatggaaggc

SEQ ID NO: 53452 - DNA, 25 bp, Homo sapien
acctctagttcctcgtagcggcggc

SEQ ID NO: 53453 - DNA, 25 bp, Homo sapien
ctgcgcggcaagaatgtctagcctg

SEQ ID NO: 53454 - DNA, 25 bp, Homo sapien
agcgcattgatctcttcgcgggtca

SEQ ID NO: 53455 - DNA, 25 bp, Homo sapien
acgggcatcggctctcagcaagaga

SEQ ID NO: 53456 - DNA, 25 bp, Homo sapien
ctcagttaaggcaggagggaattta

SEQ ID NO: 53457 - DNA, 25 bp, Homo sapien
ggatcctcagaggttcttcttccga

SEQ ID NO: 53458 - DNA, 25 bp, Homo sapien
gcaaggtctccaactccagcaggga

SEQ ID NO: 53459 - DNA, 25 bp, Homo sapien
tcagcgtggtccgaagtttcctctg

SEQ ID NO: 53460 - DNA, 25 bp, Homo sapien
atgcgcaagctggaggcgaacctcc

SEQ ID NO: 53461 - DNA, 25 bp, Homo sapien
tggaggccggcgtactcacctctac

SEQ ID NO: 53462 - DNA, 25 bp, Homo sapien
gttacctcccgctagctcagggcga

SEQ ID NO: 53463 - DNA, 25 bp, Homo sapien
ccgtcactttcccaggtccgagagt

SEQ ID NO: 53464 - DNA, 25 bp, Homo sapien
gtccgagagtgtcgacgctcctttt

SEQ ID NO: 53465 - DNA, 25 bp, Homo sapien
acgctccttttgtcgaccgaggatg

SEQ ID NO: 53466 - DNA, 25 bp, Homo sapien
gacactggagtttctgagccgaacc

SEQ ID NO: 53467 - DNA, 25 bp, Homo sapien
acccggccgcagatgatgcgcaagc

SEQ ID NO: 53468 - DNA, 25 bp, Homo sapien
acagcaagaccggtcgtgtctgtcc

SEQ ID NO: 53469 - DNA, 25 bp, Homo sapien
tccgcgtcatgtgactggagtccgc

SEQ ID NO: 53470 - DNA, 25 bp, Homo sapien
aggacacacgggcttgaacatctga

SEQ ID NO: 53471 - DNA, 25 bp, Homo sapien
aactgattgactgggctggcgttaa

SEQ ID NO: 53472 - DNA, 25 bp, Homo sapien
gccgtgtacccgaaaaactgattga

SEQ ID NO: 53473 - DNA, 25 bp, Homo sapien
gcggcgttagtattggccgtgtacc

SEQ ID NO: 53474 - DNA, 25 bp, Homo sapien
gtcggaggtcttacccaacagattg

SEQ ID NO: 53475 - DNA, 25 bp, Homo sapien
cccaacagattgacgcggcgttagt

SEQ ID NO: 53476 - DNA, 25 bp, Homo sapien
taggcggtgcatcccgttcgcgcct

SEQ ID NO: 53477 - DNA, 25 bp, Homo sapien
ggactgtcatccgtgttgagacttc

SEQ ID NO: 53478 - DNA, 25 bp, Homo sapien
ttggtcctcccagggcgccgtaggc

SEQ ID NO: 53479 - DNA, 25 bp, Homo sapien
tgtcccgctgttatctccgaagtcc

SEQ ID NO: 53480 - DNA, 25 bp, Homo sapien
tatctccgaagtccggttccatggc

SEQ ID NO: 53481 - DNA, 25 bp, Homo sapien
gttccatggcgcctgagggaaaccg

SEQ ID NO: 53482 - DNA, 25 bp, Homo sapien
gcctgagggaaaccggctgtctctc

SEQ ID NO: 53483 - DNA, 25 bp, Homo sapien
agaatcaaccttaccggcgggagca

SEQ ID NO: 53484 - DNA, 25 bp, Homo sapien
aatatatccctcaacattctcctca

SEQ ID NO: 53485 - DNA, 25 bp, Homo sapien
aatggtttccggatagagaaagcgc

SEQ ID NO: 53486 - DNA, 25 bp, Homo sapien
ccagttgggacataatctttattta

SEQ ID NO: 53487 - DNA, 25 bp, Homo sapien
ggataaccagttgggacataatctt

SEQ ID NO: 53488 - DNA, 25 bp, Homo sapien
cccaggataaccagttgggacataa

SEQ ID NO: 53489 - DNA, 25 bp, Homo sapien
cctcccaggataaccagttgggaca

SEQ ID NO: 53490 - DNA, 25 bp, Homo sapien
caccctcccaggataaccagttggg

SEQ ID NO: 53491 - DNA, 25 bp, Homo sapien
gtttccggatagagaaagcgcttcg

SEQ ID NO: 53492 - DNA, 25 bp, Homo sapien
gggtttgggtcttcaggtcacatct

SEQ ID NO: 53493 - DNA, 25 bp, Homo sapien
cctcgactccggaaatgatctgaga

SEQ ID NO: 53494 - DNA, 25 bp, Homo sapien
ttccgaacgtcgcaatcagatttgg

SEQ ID NO: 53495 - DNA, 25 bp, Homo sapien
agacagcttcacgtggaaaacccgg

SEQ ID NO: 53496 - DNA, 25 bp, Homo sapien
ttccgacgacgcgtgagtttgagtg

SEQ ID NO: 53497 - DNA, 25 bp, Homo sapien
taggaaagtgcccagagaccgtatc

SEQ ID NO: 53498 - DNA, 25 bp, Homo sapien
ttccggatgtcaggtagttcaggtc

SEQ ID NO: 53499 - DNA, 25 bp, Homo sapien
gtcacatctggacggagagacctcc

SEQ ID NO: 53500 - DNA, 25 bp, Homo sapien
gcacgtgcgccacgagtgtctcagc

SEQ ID NO: 53501 - DNA, 25 bp, Homo sapien
ctccgcaaacggtcaataaacgctg

SEQ ID NO: 53502 - DNA, 25 bp, Homo sapien
ggtggccgttgtcccagaaacagcc

SEQ ID NO: 53503 - DNA, 25 bp, Homo sapien
ccgggtttcggcagtaactgtgatt

SEQ ID NO: 53504 - DNA, 25 bp, Homo sapien
aggtcctcgcaaggccgtttctcag

SEQ ID NO: 53505 - DNA, 25 bp, Homo sapien
gtgtctcagccgcttcctgtcagcg

SEQ ID NO: 53506 - DNA, 25 bp, Homo sapien
ggcctggagacagccctggccaatc

SEQ ID NO: 53507 - DNA, 25 bp, Homo sapien
cagttgtttacaagcgctcgcggcg

SEQ ID NO: 53508 - DNA, 25 bp, Homo sapien
cgcctggcgctgcaaactttacact

SEQ ID NO: 53509 - DNA, 25 bp, Homo sapien
cggcggcagagtaggcccttcctca

SEQ ID NO: 53510 - DNA, 25 bp, Homo sapien
ttacactttctttgtgccgagcgcc

SEQ ID NO: 53511 - DNA, 25 bp, Homo sapien
tcaccaagacgaggatgcacgtccc

SEQ ID NO: 53512 - DNA, 25 bp, Homo sapien
ccagatccgccaatgctagagcagc

SEQ ID NO: 53513 - DNA, 25 bp, Homo sapien
gccaatgctagagcagcctgagccc

SEQ ID NO: 53514 - DNA, 25 bp, Homo sapien
aacgaagcgccgagccagcaaacca

SEQ ID NO: 53515 - DNA, 25 bp, Homo sapien
ccctgcccgctgagagtggcggcta

SEQ ID NO: 53516 - DNA, 25 bp, Homo sapien
agccgggccgactatgacacactct

SEQ ID NO: 53517 - DNA, 25 bp, Homo sapien
catgggttcaacagctacggtagcc

SEQ ID NO: 53518 - DNA, 25 bp, Homo sapien
cggtagccaccgaaccctgcagaga

SEQ ID NO: 53519 - DNA, 25 bp, Homo sapien
tgcggaccctgcagcgattccagag

SEQ ID NO: 53520 - DNA, 25 bp, Homo sapien
acgaccgctacagcctggtgtctga

SEQ ID NO: 53521 - DNA, 25 bp, Homo sapien
gcccgtgtccttccatgagcgcggt

SEQ ID NO: 53522 - DNA, 25 bp, Homo sapien
ggggacgatctgagctctgcagtct

SEQ ID NO: 53523 - DNA, 25 bp, Homo sapien
acctacagggcctttgcgtacgagc

SEQ ID NO: 53524 - DNA, 25 bp, Homo sapien
caccttagctaagatcgcggagata

SEQ ID NO: 53525 - DNA, 25 bp, Homo sapien
taattcgaagtaccgcgcctgcgtg

SEQ ID NO: 53526 - DNA, 25 bp, Homo sapien
ggccacagggtactcgccacgatga

SEQ ID NO: 53527 - DNA, 25 bp, Homo sapien
cgactgccctctgccacgattagga

SEQ ID NO: 53528 - DNA, 25 bp, Homo sapien
cattccttctttggtggcgtcgctc

SEQ ID NO: 53529 - DNA, 25 bp, Homo sapien
agctggcggttcactcttagtctga

SEQ ID NO: 53530 - DNA, 25 bp, Homo sapien
tgaagcgttcagtaccatgcagagc

SEQ ID NO: 53531 - DNA, 25 bp, Homo sapien
gggctctatgacaccgcactggctc

SEQ ID NO: 53532 - DNA, 25 bp, Homo sapien
agaccgtactcactgaggggcggcc

SEQ ID NO: 53533 - DNA, 25 bp, Homo sapien
cccgggcgcttcaagctggagctag

SEQ ID NO: 53534 - DNA, 25 bp, Homo sapien
accggcttgggctgtctctcttcag

SEQ ID NO: 53535 - DNA, 25 bp, Homo sapien
tgtctctcttcagccgccgtaactg

SEQ ID NO: 53536 - DNA, 25 bp, Homo sapien
cggtgccgggcgaaaaagaagcatc

SEQ ID NO: 53537 - DNA, 25 bp, Homo sapien
cgaaaaagaagcatcgccgcgcgct

SEQ ID NO: 53538 - DNA, 25 bp, Homo sapien
ggatagcggaaacccgctcccgtgc

SEQ ID NO: 53539 - DNA, 25 bp, Homo sapien
gcaccggcttcagctccgaaacttg

SEQ ID NO: 53540 - DNA, 25 bp, Homo sapien
tggaacctcatctttagtgctcggc

SEQ ID NO: 53541 - DNA, 25 bp, Homo sapien
tccgagcccggtgaaatctgtccga

SEQ ID NO: 53542 - DNA, 25 bp, Homo sapien
ctgctgcaaagcaacccgaagtgcg

SEQ ID NO: 53543 - DNA, 25 bp, Homo sapien
tgcgcggatccaaatcaggggtttc

SEQ ID NO: 53544 - DNA, 25 bp, Homo sapien
aaaccgattctcattgctgctgctg

SEQ ID NO: 53545 - DNA, 25 bp, Homo sapien
agggctggtatatgggcgaccttac

SEQ ID NO: 53546 - DNA, 25 bp, Homo sapien
aagtgcgccacctacccgactgagg

SEQ ID NO: 53547 - DNA, 25 bp, Homo sapien
ttttctcccaacgtcaggcccgatg

SEQ ID NO: 53548 - DNA, 25 bp, Homo sapien
cgcccggcaggagataagatgtgga

SEQ ID NO: 53549 - DNA, 25 bp, Homo sapien
tcccgtacgctcttcacttcccgta

SEQ ID NO: 53550 - DNA, 25 bp, Homo sapien
aggccctccggcagcaccaaggaga

SEQ ID NO: 53551 - DNA, 25 bp, Homo sapien
gactcgctcaaccttgtccgcgggg

SEQ ID NO: 53552 - DNA, 25 bp, Homo sapien
ctgggagagcccacctgcgaccgaa

SEQ ID NO: 53553 - DNA, 25 bp, Homo sapien
tccctgagaagtcacctggggctcc

SEQ ID NO: 53554 - DNA, 25 bp, Homo sapien
gaagtgagctcacgcagcccgggcc

SEQ ID NO: 53555 - DNA, 25 bp, Homo sapien
acctgcgaccgaaggccctagaagg

SEQ ID NO: 53556 - DNA, 25 bp, Homo sapien
acgcttaaggcgtcacgagtctcga

SEQ ID NO: 53557 - DNA, 25 bp, Homo sapien
acgagtctcgagttcagtgggccaa

SEQ ID NO: 53558 - DNA, 25 bp, Homo sapien
gtgcagtaatcccagacatcggtgc

SEQ ID NO: 53559 - DNA, 25 bp, Homo sapien
caaggtagtctctccgcgctgctat

SEQ ID NO: 53560 - DNA, 25 bp, Homo sapien
gcgagcccgcgacacagaaacatct

SEQ ID NO: 53561 - DNA, 25 bp, Homo sapien
cctaagctcgaggtgaaggtggctc

SEQ ID NO: 53562 - DNA, 25 bp, Homo sapien
gtcgcacctgctcctaagctcgagg

SEQ ID NO: 53563 - DNA, 25 bp, Homo sapien
ttcagtgggccaatgagaaaagcgc

SEQ ID NO: 53564 - DNA, 25 bp, Homo sapien
gcgctaagaaagagcgtacgcctcc

SEQ ID NO: 53565 - DNA, 25 bp, Homo sapien
tctacctgagcctacggagccgaca

SEQ ID NO: 53566 - DNA, 25 bp, Homo sapien
ggcgtcgtcctctccgaggagataa

SEQ ID NO: 53567 - DNA, 25 bp, Homo sapien
atccctgttgtatcgaggttgaaga

SEQ ID NO: 53568 - DNA, 25 bp, Homo sapien
tacgcctccgataaggggcgtcgtc

SEQ ID NO: 53569 - DNA, 25 bp, Homo sapien
gtcggagccatgactcggagaagcc

SEQ ID NO: 53570 - DNA, 25 bp, Homo sapien
aagccgcttttctctagcgacgcgg

SEQ ID NO: 53571 - DNA, 25 bp, Homo sapien
aagaggagtctctctcccgcgtcgg

SEQ ID NO: 53572 - DNA, 25 bp, Homo sapien
gcgctacacggtcggggcgggccta

SEQ ID NO: 53573 - DNA, 25 bp, Homo sapien
gtggcccaaggaagaggccgcacac

SEQ ID NO: 53574 - DNA, 25 bp, Homo sapien
gttctcaggtgagcgctacacggtc

SEQ ID NO: 53575 - DNA, 25 bp, Homo sapien
gcctagtaggcgcttcaggcttagg

SEQ ID NO: 53576 - DNA, 25 bp, Homo sapien
gcttcaggcttaggggcggaacagc

SEQ ID NO: 53577 - DNA, 25 bp, Homo sapien
gatgaggaagtggtgcggccaccga

SEQ ID NO: 53578 - DNA, 25 bp, Homo sapien
gccaccgagacgagacggaggcccg

SEQ ID NO: 53579 - DNA, 25 bp, Homo sapien
ggctctagtgctcgagggcaggaaa

SEQ ID NO: 53580 - DNA, 25 bp, Homo sapien
gcttctccgccagtatgtttgcttg

SEQ ID NO: 53581 - DNA, 25 bp, Homo sapien
cgtcaccttgaaatagaccgttagg

SEQ ID NO: 53582 - DNA, 25 bp, Homo sapien
gctatttatagtaggtgacgtcacc

SEQ ID NO: 53583 - DNA, 25 bp, Homo sapien
tctgcggcggtaaaatgcagcactc

SEQ ID NO: 53584 - DNA, 25 bp, Homo sapien
tggggctatgacaatgcactgcatg

SEQ ID NO: 53585 - DNA, 25 bp, Homo sapien
ccagatctctaacgtggatggagtg

SEQ ID NO: 53586 - DNA, 25 bp, Homo sapien
ttgcttgcttttggggcccttctca

SEQ ID NO: 53587 - DNA, 25 bp, Homo sapien
cgacgacatggcctccgctatgaag

SEQ ID NO: 53588 - DNA, 25 bp, Homo sapien
gattatgttctcatgttcaacccaa

SEQ ID NO: 53589 - DNA, 25 bp, Homo sapien
tggatgtatgagcagtgcgagcatt

SEQ ID NO: 53590 - DNA, 25 bp, Homo sapien
ttctcatgttcaacccaatttttaa

SEQ ID NO: 53591 - DNA, 25 bp, Homo sapien
tatgttctcatgttcaacccaattt

SEQ ID NO: 53592 - DNA, 25 bp, Homo sapien
atgattatgttctcatgttcaaccc

SEQ ID NO: 53593 - DNA, 25 bp, Homo sapien
tatgaatgattatgttctcatgttc

SEQ ID NO: 53594 - DNA, 25 bp, Homo sapien
gatgtatgagcagtgcgagcattta

SEQ ID NO: 53595 - DNA, 25 bp, Homo sapien
gttctcatgttcaacccaattttta

SEQ ID NO: 53596 - DNA, 25 bp, Homo sapien
cgcttcctcactccgaaggcaagaa

SEQ ID NO: 53597 - DNA, 25 bp, Homo sapien
ttcctcactccgaaggcaagaaagg

SEQ ID NO: 53598 - DNA, 25 bp, Homo sapien
ggagtggcgacgtccaccctccctc

SEQ ID NO: 53599 - DNA, 25 bp, Homo sapien
cgcgggtgacggtggtgttctacct

SEQ ID NO: 53600 - DNA, 25 bp, Homo sapien
tggtgttctacctgcggaggccgcc

SEQ ID NO: 53601 - DNA, 25 bp, Homo sapien
gccagagcgcgaagccggaacagca

SEQ ID NO: 53602 - DNA, 25 bp, Homo sapien
ccgtactgctgcctccgcttcctca

SEQ ID NO: 53603 - DNA, 25 bp, Homo sapien
gcctcctccggcgagtcagggcgct

SEQ ID NO: 53604 - DNA, 25 bp, Homo sapien
aggccgcggcgtacctgcgagaact

SEQ ID NO: 53605 - DNA, 25 bp, Homo sapien
ggtagccgctgaagcgctccagcaa

SEQ ID NO: 53606 - DNA, 25 bp, Homo sapien
ggatattgtcttcccggtagccgct

SEQ ID NO: 53607 - DNA, 25 bp, Homo sapien
ctgaagcgctccagcaaagcaaagg

SEQ ID NO: 53608 - DNA, 25 bp, Homo sapien
cacccttcaggaagcgggagacgtc

SEQ ID NO: 53609 - DNA, 25 bp, Homo sapien
ccgtctgggcacacccttcaggaag

SEQ ID NO: 53610 - DNA, 25 bp, Homo sapien
agcccgtgcgctctgcaaggggcca

SEQ ID NO: 53611 - DNA, 25 bp, Homo sapien
cggatatactgggtgcactggaaca

SEQ ID NO: 53612 - DNA, 25 bp, Homo sapien
ctttcaggtcacaggataggtctgc

SEQ ID NO: 53613 - DNA, 25 bp, Homo sapien
tgtcagccgatcagtcagtcgcgtc

SEQ ID NO: 53614 - DNA, 25 bp, Homo sapien
cccagtgcagctggtcatcctgtca

SEQ ID NO: 53615 - DNA, 25 bp, Homo sapien
tggtcatcctgtcagccgatcagtc

SEQ ID NO: 53616 - DNA, 25 bp, Homo sapien
cgcgcagggtctagggcgactctct

SEQ ID NO: 53617 - DNA, 25 bp, Homo sapien
aactgggagtttctttcaggtcaca

SEQ ID NO: 53618 - DNA, 25 bp, Homo sapien
ataggtctgcagtgcgactcaggct

SEQ ID NO: 53619 - DNA, 25 bp, Homo sapien
ccacgcagtgagttggcttgaggca

SEQ ID NO: 53620 - DNA, 25 bp, Homo sapien
cggcctgttgagacccacgagctca

SEQ ID NO: 53621 - DNA, 25 bp, Homo sapien
ctacttcgtggtagtgatggccgtc

SEQ ID NO: 53622 - DNA, 25 bp, Homo sapien
gagctcattcgcaatgcagccgata

SEQ ID NO: 53623 - DNA, 25 bp, Homo sapien
gccaccatggacagtagcacctgga

SEQ ID NO: 53624 - DNA, 25 bp, Homo sapien
aaggacgcaacgctgccaccatgga

SEQ ID NO: 53625 - DNA, 25 bp, Homo sapien
ccgtataaggagctagcggccctgg

SEQ ID NO: 53626 - DNA, 25 bp, Homo sapien
tcattaaccaggaggccgtataagg

SEQ ID NO: 53627 - DNA, 25 bp, Homo sapien
gcagccgatatctccatcatcgtta

SEQ ID NO: 53628 - DNA, 25 bp, Homo sapien
gtccagagggtcaccgaagacgccc

SEQ ID NO: 53629 - DNA, 25 bp, Homo sapien
ggatgcctccagcaacggggactag

SEQ ID NO: 53630 - DNA, 25 bp, Homo sapien
aacagccatctgggaaccgcgaccg

SEQ ID NO: 53631 - DNA, 25 bp, Homo sapien
gcgaccgcgcactgacacacgcagt

SEQ ID NO: 53632 - DNA, 25 bp, Homo sapien
tctgggcaggcgaacgttccacgag

SEQ ID NO: 53633 - DNA, 25 bp, Homo sapien
cgaacgttccacgagggcgtcccag

SEQ ID NO: 53634 - DNA, 25 bp, Homo sapien
cctgaccgagtccagagggtcaccg

SEQ ID NO: 53635 - DNA, 25 bp, Homo sapien
agcaacggggactagccctgcgcgc

SEQ ID NO: 53636 - DNA, 25 bp, Homo sapien
acttagcttgtcctcgtggttcggg

SEQ ID NO: 53637 - DNA, 25 bp, Homo sapien
gaagcccttcttgatcctccagcag

SEQ ID NO: 53638 - DNA, 25 bp, Homo sapien
ctcatcattatagctgcgactcatg

SEQ ID NO: 53639 - DNA, 25 bp, Homo sapien
gcgactcatggtggcgaaaactgta

SEQ ID NO: 53640 - DNA, 25 bp, Homo sapien
tgtagcaaaaactcccggctccgct

SEQ ID NO: 53641 - DNA, 25 bp, Homo sapien
cgcgtagtccggcttctcagagcac

SEQ ID NO: 53642 - DNA, 25 bp, Homo sapien
accagcgccgcagcagatgagcaac

SEQ ID NO: 53643 - DNA, 25 bp, Homo sapien
tacctgcatgttgggcacgaagccc

SEQ ID NO: 53644 - DNA, 25 bp, Homo sapien
gcgcggagtcatcgatcggccgacc

SEQ ID NO: 53645 - DNA, 25 bp, Homo sapien
ggcgctctattccagagaccgagtg

SEQ ID NO: 53646 - DNA, 25 bp, Homo sapien
ggcatttgcgctcgcacctgaggca

SEQ ID NO: 53647 - DNA, 25 bp, Homo sapien
gctaccgttgttccacgcacacagg

SEQ ID NO: 53648 - DNA, 25 bp, Homo sapien
cacagggagtaagtactgggagtcc

SEQ ID NO: 53649 - DNA, 25 bp, Homo sapien
tcagctccggtagtcgccagtccgg

SEQ ID NO: 53650 - DNA, 25 bp, Homo sapien
tgcggcttctgaagcggacctggcc

SEQ ID NO: 53651 - DNA, 25 bp, Homo sapien
gccgcggaaaatctgggatgccagc

SEQ ID NO: 53652 - DNA, 25 bp, Homo sapien
agccaggactgcagcgctgcttagg

SEQ ID NO: 53653 - DNA, 25 bp, Homo sapien
ccgatgaggtaatgcggctctgcca

SEQ ID NO: 53654 - DNA, 25 bp, Homo sapien
ggggcccagcgctatatcactcggc

SEQ ID NO: 53655 - DNA, 25 bp, Homo sapien
cacggcaactttggagaggcgagca

SEQ ID NO: 53656 - DNA, 25 bp, Homo sapien
tccgacatcggtaagcgctcctggt

SEQ ID NO: 53657 - DNA, 25 bp, Homo sapien
tggagaaactcgatgtccttgggcg

SEQ ID NO: 53658 - DNA, 25 bp, Homo sapien
gcccacggcggcattattccctata

SEQ ID NO: 53659 - DNA, 25 bp, Homo sapien
gccttctgcaactccgacatcggta

SEQ ID NO: 53660 - DNA, 25 bp, Homo sapien
cttaccgtgcgagccgccaggaact

SEQ ID NO: 53661 - DNA, 25 bp, Homo sapien
ggaggcagtcttaggatccacagtc

SEQ ID NO: 53662 - DNA, 25 bp, Homo sapien
cacgccgatctgtctgtcccaggga

SEQ ID NO: 53663 - DNA, 25 bp, Homo sapien
aaagtctactttgcggcgccgcgcc

SEQ ID NO: 53664 - DNA, 25 bp, Homo sapien
cgcggacacagagccggagctccag

SEQ ID NO: 53665 - DNA, 25 bp, Homo sapien
ggacgcagcccgacgcgagaacgca

SEQ ID NO: 53666 - DNA, 25 bp, Homo sapien
cggttcctggtttcccgcaagctct

SEQ ID NO: 53667 - DNA, 25 bp, Homo sapien
ttaggatccacagtcttgcgcgccc

SEQ ID NO: 53668 - DNA, 25 bp, Homo sapien
tgctgcccacactcggagctgttgc

SEQ ID NO: 53669 - DNA, 25 bp, Homo sapien
gagctgttgcctgccacgatgccag

SEQ ID NO: 53670 - DNA, 25 bp, Homo sapien
cctcctccatggagtaggtcttgga

SEQ ID NO: 53671 - DNA, 25 bp, Homo sapien
tccagtgccctcctccatggagtag

SEQ ID NO: 53672 - DNA, 25 bp, Homo sapien
gcccgaaggttctcgctgtctccag

SEQ ID NO: 53673 - DNA, 25 bp, Homo sapien
gcgcatgcgcacctccaggctctcg

SEQ ID NO: 53674 - DNA, 25 bp, Homo sapien
ctgccacgatgccagcccgaaggtt

SEQ ID NO: 53675 - DNA, 25 bp, Homo sapien
cgatgccagcccgaaggttctcgct

SEQ ID NO: 53676 - DNA, 25 bp, Homo sapien
ttccctcttggcataagaacccggc

SEQ ID NO: 53677 - DNA, 25 bp, Homo sapien
cgccgaagggctctgacggcatctt

SEQ ID NO: 53678 - DNA, 25 bp, Homo sapien
gccgtcgtgagaagtaggaagtttc

SEQ ID NO: 53679 - DNA, 25 bp, Homo sapien
cggtatccaagaatcctgtccaagg

SEQ ID NO: 53680 - DNA, 25 bp, Homo sapien
gctcgcaggcttgcaggaccatgca

SEQ ID NO: 53681 - DNA, 25 bp, Homo sapien
tgtctgtgtcatgtctgtgcagccg

SEQ ID NO: 53682 - DNA, 25 bp, Homo sapien
cgctcagcagctgcagtgactgtgt

SEQ ID NO: 53683 - DNA, 25 bp, Homo sapien
acggcatctttctgggatcggtatc

SEQ ID NO: 53684 - DNA, 25 bp, Homo sapien
ggcccgcgacatcacctctggggtg

SEQ ID NO: 53685 - DNA, 25 bp, Homo sapien
cgagttttattcgatgcgctcggcg

SEQ ID NO: 53686 - DNA, 25 bp, Homo sapien
gcgctcttggtcgagcgggattccc

SEQ ID NO: 53687 - DNA, 25 bp, Homo sapien
ccgagtctgcgctctgggctcgact

SEQ ID NO: 53688 - DNA, 25 bp, Homo sapien
ctctgggctcgactgaggctccctg

SEQ ID NO: 53689 - DNA, 25 bp, Homo sapien
agctgtgcggctcggaacccgcgat

SEQ ID NO: 53690 - DNA, 25 bp, Homo sapien
gcgctcagcaggctccgagttttat

SEQ ID NO: 53691 - DNA, 25 bp, Homo sapien
aacccgggttcaggtcgagctgtgc

SEQ ID NO: 53692 - DNA, 25 bp, Homo sapien
cgtgccggcagcctgacctaaggct

SEQ ID NO: 53693 - DNA, 25 bp, Homo sapien
acacctgtggatgatgtgctggccg

SEQ ID NO: 53694 - DNA, 25 bp, Homo sapien
cgcgcaggtagtccagagccagtgc

SEQ ID NO: 53695 - DNA, 25 bp, Homo sapien
cgcagatgtacagcctcaccgtgtc

SEQ ID NO: 53696 - DNA, 25 bp, Homo sapien
cagcctgacctaaggctgcttcagc

SEQ ID NO: 53697 - DNA, 25 bp, Homo sapien
cgtgtcctcggagaactgcacgttc

SEQ ID NO: 53698 - DNA, 25 bp, Homo sapien
gagccagtgccatctcgcagatgta

SEQ ID NO: 53699 - DNA, 25 bp, Homo sapien
actgcacgttctgctgcaggtggta

SEQ ID NO: 53700 - DNA, 25 bp, Homo sapien
tgctggactacaaggacgagttctc

SEQ ID NO: 53701 - DNA, 25 bp, Homo sapien
ccacgtcggcgatggccaaataata

SEQ ID NO: 53702 - DNA, 25 bp, Homo sapien
tgacttctagccacgggtctccgca

SEQ ID NO: 53703 - DNA, 25 bp, Homo sapien
tccctctgggttctctagagcaaca

SEQ ID NO: 53704 - DNA, 25 bp, Homo sapien
tcgggctggacaaagacagcttttc

SEQ ID NO: 53705 - DNA, 25 bp, Homo sapien
cagaaccttgattccggaagcgggc

SEQ ID NO: 53706 - DNA, 25 bp, Homo sapien
ctgccgcctacgactgttgtgaaca

SEQ ID NO: 53707 - DNA, 25 bp, Homo sapien
gtgtggcaccaatacctgccgccta

SEQ ID NO: 53708 - DNA, 25 bp, Homo sapien
ccctcgcgcgatcacattctgtaag

SEQ ID NO: 53709 - DNA, 25 bp, Homo sapien
cggatgtactccacggctgagcgca

SEQ ID NO: 53710 - DNA, 25 bp, Homo sapien
cctggaagcccaagttcaccagctt

SEQ ID NO: 53711 - DNA, 25 bp, Homo sapien
ttcaccagcttcacgcggttgcgct

SEQ ID NO: 53712 - DNA, 25 bp, Homo sapien
tgcagcgcaacagttccggggacgc

SEQ ID NO: 53713 - DNA, 25 bp, Homo sapien
caggcggctggtttttaaatgtata

SEQ ID NO: 53714 - DNA, 25 bp, Homo sapien
atgtatagataaccctcctccgcgc

SEQ ID NO: 53715 - DNA, 25 bp, Homo sapien
ttctgtaaggcccaaagcgtgcgca

SEQ ID NO: 53716 - DNA, 25 bp, Homo sapien
caggccacgtggagaggacacaaca

SEQ ID NO: 53717 - DNA, 25 bp, Homo sapien
aggcgcgcggacacggtcgactacc

SEQ ID NO: 53718 - DNA, 25 bp, Homo sapien
gtggagaggacacaacaaagccttc

SEQ ID NO: 53719 - DNA, 25 bp, Homo sapien
tcgactacccgcttcctccttatgg

SEQ ID NO: 53720 - DNA, 25 bp, Homo sapien
gtgtctgcggtgctggaaagaccac

SEQ ID NO: 53721 - DNA, 25 bp, Homo sapien
cagccctgagctccgctcgggagga

SEQ ID NO: 53722 - DNA, 25 bp, Homo sapien
tctgaccgcgctttgtcagccctga

SEQ ID NO: 53723 - DNA, 25 bp, Homo sapien
gccctcaggtcgctgctgaggcctg

SEQ ID NO: 53724 - DNA, 25 bp, Homo sapien
tggcttaaagaggaccgcgcttccc

SEQ ID NO: 53725 - DNA, 25 bp, Homo sapien
acccgttcagctctccagtgggaca

SEQ ID NO: 53726 - DNA, 25 bp, Homo sapien
gcaatggactttctcctggggaacc

SEQ ID NO: 53727 - DNA, 25 bp, Homo sapien
cggcggtagcagcaatggactttct

SEQ ID NO: 53728 - DNA, 25 bp, Homo sapien
tggcggttgctgtcagctgattccc

SEQ ID NO: 53729 - DNA, 25 bp, Homo sapien
caagccgcagtgaggtcatcgccct

SEQ ID NO: 53730 - DNA, 25 bp, Homo sapien
cccagaccctacatcgtgtgtgacg

SEQ ID NO: 53731 - DNA, 25 bp, Homo sapien
ctccgggtgcctagtcacggaggca

SEQ ID NO: 53732 - DNA, 25 bp, Homo sapien
gcataaatgtgaccggccgcggctc

SEQ ID NO: 53733 - DNA, 25 bp, Homo sapien
gccggatggagcgtccgcaacccga

SEQ ID NO: 53734 - DNA, 25 bp, Homo sapien
cgggtgttgcaacgcccggccagaa

SEQ ID NO: 53735 - DNA, 25 bp, Homo sapien
cgtgacccgccgagcataaatgtga

SEQ ID NO: 53736 - DNA, 25 bp, Homo sapien
tcctctcgagcgtcctcagcgcagc

SEQ ID NO: 53737 - DNA, 25 bp, Homo sapien
ggagccagcacgaacgagcccagca

SEQ ID NO: 53738 - DNA, 25 bp, Homo sapien
tggagcgtccgcaacccgacaggca

SEQ ID NO: 53739 - DNA, 25 bp, Homo sapien
cagtcaacgcctgcctcctctcgag

SEQ ID NO: 53740 - DNA, 25 bp, Homo sapien
gcgaggtcatgcactttgcagccaa

SEQ ID NO: 53741 - DNA, 25 bp, Homo sapien
ccagccagaagtttcgcgccaaatt

SEQ ID NO: 53742 - DNA, 25 bp, Homo sapien
cgcacgggcttcaccttcaaataca

SEQ ID NO: 53743 - DNA, 25 bp, Homo sapien
cagaggcgcttcaaggagttcctgc

SEQ ID NO: 53744 - DNA, 25 bp, Homo sapien
tggcattttctacagcgacagcttc

SEQ ID NO: 53745 - DNA, 25 bp, Homo sapien
gagggctcagaacggtccaatcgct

SEQ ID NO: 53746 - DNA, 25 bp, Homo sapien
gggattcgacgatcctggcattttc

SEQ ID NO: 53747 - DNA, 25 bp, Homo sapien
tgttccgcacacaaaatggagcccg

SEQ ID NO: 53748 - DNA, 25 bp, Homo sapien
gttctctaccgcctcaagtgagtcg

SEQ ID NO: 53749 - DNA, 25 bp, Homo sapien
agccagccatgtgctcccacagaaa

SEQ ID NO: 53750 - DNA, 25 bp, Homo sapien
atgtgctcccacagaaatacccgga

SEQ ID NO: 53751 - DNA, 25 bp, Homo sapien
cggagcacgccatccacaaggtgct

SEQ ID NO: 53752 - DNA, 25 bp, Homo sapien
catccacaaggtgctgcagctcatg

SEQ ID NO: 53753 - DNA, 25 bp, Homo sapien
gcggcgagatccagcatcgcatgca

SEQ ID NO: 53754 - DNA, 25 bp, Homo sapien
tcgcatgcagcgcaaggttctctac

SEQ ID NO: 53755 - DNA, 25 bp, Homo sapien
gcagcacgtgccgttagccagccat

SEQ ID NO: 53756 - DNA, 25 bp, Homo sapien
taggagctgctccttcatcactgga

SEQ ID NO: 53757 - DNA, 25 bp, Homo sapien
aagttctcctcatctggggacagga

SEQ ID NO: 53758 - DNA, 25 bp, Homo sapien
taacttggagctgcgaaaccttggg

SEQ ID NO: 53759 - DNA, 25 bp, Homo sapien
aacccagggccacacacaaagttct

SEQ ID NO: 53760 - DNA, 25 bp, Homo sapien
agggatcagcgacctcttcgccctg

SEQ ID NO: 53761 - DNA, 25 bp, Homo sapien
gttctgccacctttcggagggatca

SEQ ID NO: 53762 - DNA, 25 bp, Homo sapien
agggttcgcccacctgggacacgca

SEQ ID NO: 53763 - DNA, 25 bp, Homo sapien
agccgggttgatgctaacttggagc

SEQ ID NO: 53764 - DNA, 25 bp, Homo sapien
cggccaagaagaacaccaacgtgga

SEQ ID NO: 53765 - DNA, 25 bp, Homo sapien
gcctatggcatggtctcgcccttcg

SEQ ID NO: 53766 - DNA, 25 bp, Homo sapien
ggacgagatgttctacgtgctcttc

SEQ ID NO: 53767 - DNA, 25 bp, Homo sapien
gccaagctgccacacgagatgagcc

SEQ ID NO: 53768 - DNA, 25 bp, Homo sapien
tgcatcgcaagatctccgtgcagta

SEQ ID NO: 53769 - DNA, 25 bp, Homo sapien
ctccgtgcagtacggtgacgccttc

SEQ ID NO: 53770 - DNA, 25 bp, Homo sapien
gtgctcttcagcatggccaagctgc

SEQ ID NO: 53771 - DNA, 25 bp, Homo sapien
gccgcgtcaaggagatggacgccta

SEQ ID NO: 53772 - DNA, 25 bp, Homo sapien
aacgagctgactggccgggatcctc

SEQ ID NO: 53773 - DNA, 25 bp, Homo sapien
gtcgtgatgagcactcgctcgcgcc

SEQ ID NO: 53774 - DNA, 25 bp, Homo sapien
cctgggattgtcctggaggcacagc

SEQ ID NO: 53775 - DNA, 25 bp, Homo sapien
aagctcgggaatctccggcacgggc

SEQ ID NO: 53776 - DNA, 25 bp, Homo sapien
gcaatctccgtagtctcctcgctgg

SEQ ID NO: 53777 - DNA, 25 bp, Homo sapien
ggatgtagaactccagcccgcgcgg

SEQ ID NO: 53778 - DNA, 25 bp, Homo sapien
agggaccgggatgtagaactccagc

SEQ ID NO: 53779 - DNA, 25 bp, Homo sapien
tgctcaggccgggatcggctccgtc

SEQ ID NO: 53780 - DNA, 25 bp, Homo sapien
gtccctccggctggcagctagcaat

SEQ ID NO: 53781 - DNA, 25 bp, Homo sapien
gcggtcacgtgactgatgtccctcc

SEQ ID NO: 53782 - DNA, 25 bp, Homo sapien
ttcatggcaggaaatcagcgttttc

SEQ ID NO: 53783 - DNA, 25 bp, Homo sapien
gttttccaagaacgcccagtggcgc

SEQ ID NO: 53784 - DNA, 25 bp, Homo sapien
tgtcaataggccatggcgcgcctcc

SEQ ID NO: 53785 - DNA, 25 bp, Homo sapien
ccaggacgtgcctattaaaggtatc

SEQ ID NO: 53786 - DNA, 25 bp, Homo sapien
cgccttctctttatgtgactctctg

SEQ ID NO: 53787 - DNA, 25 bp, Homo sapien
caatcgtagtttctccttcacggga

SEQ ID NO: 53788 - DNA, 25 bp, Homo sapien
tgtgcgactccaaccaaggccaggc

SEQ ID NO: 53789 - DNA, 25 bp, Homo sapien
agcgggaggagttgtcattcttcac

SEQ ID NO: 53790 - DNA, 25 bp, Homo sapien
ttcttcacggtcttggcgttcccga

SEQ ID NO: 53791 - DNA, 25 bp, Homo sapien
tgcaaggaacccagggacgcagtga

SEQ ID NO: 53792 - DNA, 25 bp, Homo sapien
cagcatgtccaacgtgccaggaaca

SEQ ID NO: 53793 - DNA, 25 bp, Homo sapien
ccggtatcatccaagtgcggccttc

SEQ ID NO: 53794 - DNA, 25 bp, Homo sapien
ccgcgctactcacgaagcgggagga

SEQ ID NO: 53795 - DNA, 25 bp, Homo sapien
cagagccgtgtcagcatgtccaacg

SEQ ID NO: 53796 - DNA, 25 bp, Homo sapien
ccctataagtactgcggagcgaggc

SEQ ID NO: 53797 - DNA, 25 bp, Homo sapien
cgcggattccggactgctgcttcgc

SEQ ID NO: 53798 - DNA, 25 bp, Homo sapien
agtacctgctcttcgtcttcaattt

SEQ ID NO: 53799 - DNA, 25 bp, Homo sapien
cgtcttcaatttcgtcttctgggta

SEQ ID NO: 53800 - DNA, 25 bp, Homo sapien
aggcacacactccacgttgggcagg

SEQ ID NO: 53801 - DNA, 25 bp, Homo sapien
ccctcagctaaggaggggcctgcgc

SEQ ID NO: 53802 - DNA, 25 bp, Homo sapien
agtggagggctgcaccaagtgcatc

SEQ ID NO: 53803 - DNA, 25 bp, Homo sapien
cgcggcgccctataagtactgcgga

SEQ ID NO: 53804 - DNA, 25 bp, Homo sapien
agctgcagcaggtcagccttgctta

SEQ ID NO: 53805 - DNA, 25 bp, Homo sapien
acggtccgactctgactcaggagga

SEQ ID NO: 53806 - DNA, 25 bp, Homo sapien
ctgcttctcccgagaggactttctc

SEQ ID NO: 53807 - DNA, 25 bp, Homo sapien
gctcgctcacctgaacctggatctg

SEQ ID NO: 53808 - DNA, 25 bp, Homo sapien
tccgtgcctcagacgccagaaactt

SEQ ID NO: 53809 - DNA, 25 bp, Homo sapien
acgccctgacagctgccaaacggtg

SEQ ID NO: 53810 - DNA, 25 bp, Homo sapien
ggtcagccttgcttagccttccgtg

SEQ ID NO: 53811 - DNA, 25 bp, Homo sapien
cctggccttgatgggcagacgtatt

SEQ ID NO: 53812 - DNA, 25 bp, Homo sapien
gctgcgcgaggtagctccacacgca

SEQ ID NO: 53813 - DNA, 25 bp, Homo sapien
gctggtgctcacctaacttgtgctc

SEQ ID NO: 53814 - DNA, 25 bp, Homo sapien
tcgtgtcacacagctgcgcgaggta

SEQ ID NO: 53815 - DNA, 25 bp, Homo sapien
ttcagtcagtctcgtgtcacacagc

SEQ ID NO: 53816 - DNA, 25 bp, Homo sapien
acaccagcagcttcagtcagtctcg

SEQ ID NO: 53817 - DNA, 25 bp, Homo sapien
cccatcctaagttggtcagcagtcc

SEQ ID NO: 53818 - DNA, 25 bp, Homo sapien
ttggtcagcagtcccaagtcggtgg

SEQ ID NO: 53819 - DNA, 25 bp, Homo sapien
gagacaggaacacatcccgccagga

SEQ ID NO: 53820 - DNA, 25 bp, Homo sapien
ttcatgtttacagcgagtccctcac

SEQ ID NO: 53821 - DNA, 25 bp, Homo sapien
atcactgcagatgtagccacgcttc

SEQ ID NO: 53822 - DNA, 25 bp, Homo sapien
ccacgtttctgctgtggcaggaaga

SEQ ID NO: 53823 - DNA, 25 bp, Homo sapien
cccacgtagtctcggtgaacgcaga

SEQ ID NO: 53824 - DNA, 25 bp, Homo sapien
cacccgccgtttcaggttacataca

SEQ ID NO: 53825 - DNA, 25 bp, Homo sapien
ccaggttcccgttctcaggatgctc

SEQ ID NO: 53826 - DNA, 25 bp, Homo sapien
aggcctacggccctgtaatcacaca

SEQ ID NO: 53827 - DNA, 25 bp, Homo sapien
cgcgcctcacgacaaccaatggttg

SEQ ID NO: 53828 - DNA, 25 bp, Homo sapien
gggtccctacccaggctaagactca

SEQ ID NO: 53829 - DNA, 25 bp, Homo sapien
tcgtgggtgggtaatccagcacatt

SEQ ID NO: 53830 - DNA, 25 bp, Homo sapien
caaccaactttgtggccgaacaagc

SEQ ID NO: 53831 - DNA, 25 bp, Homo sapien
cctgcgcatccggacacgatgagga

SEQ ID NO: 53832 - DNA, 25 bp, Homo sapien
cgcaggtgacgacaaccgctccata

SEQ ID NO: 53833 - DNA, 25 bp, Homo sapien
aaccgctccataaagggcgccgcgg

SEQ ID NO: 53834 - DNA, 25 bp, Homo sapien
cgcgacgctcgccttatatgggcag

SEQ ID NO: 53835 - DNA, 25 bp, Homo sapien
aacttctctgcgagggtggagcctc

SEQ ID NO: 53836 - DNA, 25 bp, Homo sapien
acgggctactcactccttcaacagg

SEQ ID NO: 53837 - DNA, 25 bp, Homo sapien
cgctatgcagcacgtcgggaaagct

SEQ ID NO: 53838 - DNA, 25 bp, Homo sapien
ttcaacaggatgacatcggccagca

SEQ ID NO: 53839 - DNA, 25 bp, Homo sapien
tcggccagcacaccgaacatctggt

SEQ ID NO: 53840 - DNA, 25 bp, Homo sapien
cgaacatctggtagagcccagaagc

SEQ ID NO: 53841 - DNA, 25 bp, Homo sapien
ccgcacgatggagctggtcagctgt

SEQ ID NO: 53842 - DNA, 25 bp, Homo sapien
ctccaggagccggtgaacagcacgc

SEQ ID NO: 53843 - DNA, 25 bp, Homo sapien
tgaacagcacgcactggaacagcca

SEQ ID NO: 53844 - DNA, 25 bp, Homo sapien
cgaaccctgagaaacgcgcgaacct

SEQ ID NO: 53845 - DNA, 25 bp, Homo sapien
cggactccaccgtttcaagctggga

SEQ ID NO: 53846 - DNA, 25 bp, Homo sapien
cccgtgtaccgcttgttgatgctga

SEQ ID NO: 53847 - DNA, 25 bp, Homo sapien
tgattgtagtaacctccaccctggg

SEQ ID NO: 53848 - DNA, 25 bp, Homo sapien
gagaggcccatcctgcagcagatca

SEQ ID NO: 53849 - DNA, 25 bp, Homo sapien
tgcaacccgtggtctaatgaggccg

SEQ ID NO: 53850 - DNA, 25 bp, Homo sapien
tcagagctcatttgcccggactcca

SEQ ID NO: 53851 - DNA, 25 bp, Homo sapien
gggaactctcactgcaatctgggtc

SEQ ID NO: 53852 - DNA, 25 bp, Homo sapien
ggcgctgtcgtaaactgctctcccg

SEQ ID NO: 53853 - DNA, 25 bp, Homo sapien
accgcgttagcagcagcactcttga

SEQ ID NO: 53854 - DNA, 25 bp, Homo sapien
ctcacgagccgtaaagcgaaggtcc

SEQ ID NO: 53855 - DNA, 25 bp, Homo sapien
attggcactacgtcaggcggtatcc

SEQ ID NO: 53856 - DNA, 25 bp, Homo sapien
cccaaagagggcgttcatcactgaa

SEQ ID NO: 53857 - DNA, 25 bp, Homo sapien
tcatcactgaaacttggcggccgcg

SEQ ID NO: 53858 - DNA, 25 bp, Homo sapien
gcctgttctacctgcctgcttaatg

SEQ ID NO: 53859 - DNA, 25 bp, Homo sapien
gaaacacgccgctcacctgcaatgg

SEQ ID NO: 53860 - DNA, 25 bp, Homo sapien
ctccttctggatacagttgtgaacc

SEQ ID NO: 53861 - DNA, 25 bp, Homo sapien
tgttgaagcccttgatgcccacggg

SEQ ID NO: 53862 - DNA, 25 bp, Homo sapien
cgcagctgtttgtgccggtcgataa

SEQ ID NO: 53863 - DNA, 25 bp, Homo sapien
gtcgataaacatgtgcaccgccagc

SEQ ID NO: 53864 - DNA, 25 bp, Homo sapien
cgttagtttctcaggaagtcggcca

SEQ ID NO: 53865 - DNA, 25 bp, Homo sapien
atgttactcagacctgcggggcgca

SEQ ID NO: 53866 - DNA, 25 bp, Homo sapien
ggtctccggcattggcagatatgta

SEQ ID NO: 53867 - DNA, 25 bp, Homo sapien
ggaccagccgtatgagtaactattc

SEQ ID NO: 53868 - DNA, 25 bp, Homo sapien
cccacctactgcattacgggtggtg

SEQ ID NO: 53869 - DNA, 25 bp, Homo sapien
gggcgctggccagagtcctccctcc

SEQ ID NO: 53870 - DNA, 25 bp, Homo sapien
tactgcattacgggtggtgctgaac

SEQ ID NO: 53871 - DNA, 25 bp, Homo sapien
acctactgcattacgggtggtgctg

SEQ ID NO: 53872 - DNA, 25 bp, Homo sapien
gctcccacctactgcattacgggtg

SEQ ID NO: 53873 - DNA, 25 bp, Homo sapien
ggaggcgctcccacctactgcatta

SEQ ID NO: 53874 - DNA, 25 bp, Homo sapien
actcgctaccggctgggcgcccgcg

SEQ ID NO: 53875 - DNA, 25 bp, Homo sapien
cctactgcattacgggtggtgctga

SEQ ID NO: 53876 - DNA, 25 bp, Homo sapien
cgggccggatgcactctccaagcaa

SEQ ID NO: 53877 - DNA, 25 bp, Homo sapien
gtccttctagaagtgggttcgccta

SEQ ID NO: 53878 - DNA, 25 bp, Homo sapien
tcaaggaaggacgatccggctctcc

SEQ ID NO: 53879 - DNA, 25 bp, Homo sapien
tcagagtctggcttgacccatcttc

SEQ ID NO: 53880 - DNA, 25 bp, Homo sapien
gaccctcgattggttgccgccaaaa

SEQ ID NO: 53881 - DNA, 25 bp, Homo sapien
cgccgctgtagaggtcgttttgact

SEQ ID NO: 53882 - DNA, 25 bp, Homo sapien
tttgacttgctctgacttcgcgcgg

SEQ ID NO: 53883 - DNA, 25 bp, Homo sapien
ccatcttcgggaggaatagggattc

SEQ ID NO: 53884 - DNA, 25 bp, Homo sapien
tctgtgcacccgtgctgtggcgtgc

SEQ ID NO: 53885 - DNA, 25 bp, Homo sapien
tgcacccgtgctgtggcgtgcccgt

SEQ ID NO: 53886 - DNA, 25 bp, Homo sapien
tcgtctgtgtggcatgcctgtctgt

SEQ ID NO: 53887 - DNA, 25 bp, Homo sapien
tgcctgtctgtgcacccgtgctgtg

SEQ ID NO: 53888 - DNA, 25 bp, Homo sapien
tctgtgcacccgtgctgtggtgtgc

SEQ ID NO: 53889 - DNA, 25 bp, Homo sapien
tgcccgtcgtctgtgtggcatgcct

SEQ ID NO: 53890 - DNA, 25 bp, Homo sapien
gtggcgtgcccgtcgtctgtgcacc

SEQ ID NO: 53891 - DNA, 25 bp, Homo sapien
tgtgcacccgtgctgtggcgtgccc

SEQ ID NO: 53892 - DNA, 25 bp, Homo sapien
atcgacatcctgcaactgtttgagc

SEQ ID NO: 53893 - DNA, 25 bp, Homo sapien
gcgcgcttgctcaccgctaaaggct

SEQ ID NO: 53894 - DNA, 25 bp, Homo sapien
cagcgttcagcaagtctgtcatcga

SEQ ID NO: 53895 - DNA, 25 bp, Homo sapien
tgctcatatgaccagcgctgcagtg

SEQ ID NO: 53896 - DNA, 25 bp, Homo sapien
tcaccagctgggtctggaaagtcca

SEQ ID NO: 53897 - DNA, 25 bp, Homo sapien
tggaaagtccacctgccgtcaagga

SEQ ID NO: 53898 - DNA, 25 bp, Homo sapien
cgccgtctcagatctgggaaccttg

SEQ ID NO: 53899 - DNA, 25 bp, Homo sapien
cttcttgatgtcctcagcgttcagc

SEQ ID NO: 53900 - DNA, 25 bp, Homo sapien
ttgactctcgacttggccgggtcct

SEQ ID NO: 53901 - DNA, 25 bp, Homo sapien
ccgggtccttctagtgcggcttata

SEQ ID NO: 53902 - DNA, 25 bp, Homo sapien
agtgcggcttatagcattcaacctc

SEQ ID NO: 53903 - DNA, 25 bp, Homo sapien
ttcaacctcctctaggtggcgctgc

SEQ ID NO: 53904 - DNA, 25 bp, Homo sapien
ctggcggtctgttcccgtcaacatt

SEQ ID NO: 53905 - DNA, 25 bp, Homo sapien
cccgtcaacatttagattaagcgca

SEQ ID NO: 53906 - DNA, 25 bp, Homo sapien
gccagctgcaacttgactctcgact

SEQ ID NO: 53907 - DNA, 25 bp, Homo sapien
attaagcgcagagccggttccgcca

SEQ ID NO: 53908 - DNA, 25 bp, Homo sapien
aatgtgcccacatggccgtggagga

SEQ ID NO: 53909 - DNA, 25 bp, Homo sapien
ccgaggcatgcaagctgtccagtgc

SEQ ID NO: 53910 - DNA, 25 bp, Homo sapien
gccacggcggcaccagggagtctct

SEQ ID NO: 53911 - DNA, 25 bp, Homo sapien
cccacgaagatacagaaaatgccac

SEQ ID NO: 53912 - DNA, 25 bp, Homo sapien
aaaatgccaccggagacgtgcggac

SEQ ID NO: 53913 - DNA, 25 bp, Homo sapien
tgcggacagcgctcactagctatgg

SEQ ID NO: 53914 - DNA, 25 bp, Homo sapien
tagctatggagagctcgcccacggc

SEQ ID NO: 53915 - DNA, 25 bp, Homo sapien
cggagcgtctctgcacaatgtgccc

SEQ ID NO: 53916 - DNA, 25 bp, Homo sapien
cgatggcatcttgggcttagaatcc

SEQ ID NO: 53917 - DNA, 25 bp, Homo sapien
gttacagtactcgatcccgccagga

SEQ ID NO: 53918 - DNA, 25 bp, Homo sapien
agcgcccggtagagcacctgatgaa

SEQ ID NO: 53919 - DNA, 25 bp, Homo sapien
catggcttcagctctgcgtgtcacc

SEQ ID NO: 53920 - DNA, 25 bp, Homo sapien
cgggttccttgtttacagcaagcca

SEQ ID NO: 53921 - DNA, 25 bp, Homo sapien
gcagcgggataagtttgcagattcc

SEQ ID NO: 53922 - DNA, 25 bp, Homo sapien
caagagtttccgaggactccaagta

SEQ ID NO: 53923 - DNA, 25 bp, Homo sapien
cggggatctggctcctagaagttac

SEQ ID NO: 53924 - DNA, 25 bp, Homo sapien
catttcgcggagtacgcaggccgcc

SEQ ID NO: 53925 - DNA, 25 bp, Homo sapien
aggacatcaaggagaacctggaatc

SEQ ID NO: 53926 - DNA, 25 bp, Homo sapien
tcgtgatctacgacgccagcgacca

SEQ ID NO: 53927 - DNA, 25 bp, Homo sapien
tcgacatcgaccagtgcagcgaccg

SEQ ID NO: 53928 - DNA, 25 bp, Homo sapien
gggcgccgctttcttcgacatcgac

SEQ ID NO: 53929 - DNA, 25 bp, Homo sapien
tggacgcctcctggtacctgccgaa

SEQ ID NO: 53930 - DNA, 25 bp, Homo sapien
ggactcccgagccactggcaggttc

SEQ ID NO: 53931 - DNA, 25 bp, Homo sapien
caccacgccgtgtcactgcttgatg

SEQ ID NO: 53932 - DNA, 25 bp, Homo sapien
acggtgttcctgaccacccggcaga

SEQ ID NO: 53933 - DNA, 25 bp, Homo sapien
gcaggccgcggccattagaagctct

SEQ ID NO: 53934 - DNA, 25 bp, Homo sapien
attgccgtggcaacgggacgacgca

SEQ ID NO: 53935 - DNA, 25 bp, Homo sapien
agggatgtacccattgccgtggcaa

SEQ ID NO: 53936 - DNA, 25 bp, Homo sapien
gtctggtagtgagggatgtacccat

SEQ ID NO: 53937 - DNA, 25 bp, Homo sapien
ttcatttccgaggaactggaggcgg

SEQ ID NO: 53938 - DNA, 25 bp, Homo sapien
gcggccattagaagctctccagccg

SEQ ID NO: 53939 - DNA, 25 bp, Homo sapien
tgccgcgagcagaagtccttcctca

SEQ ID NO: 53940 - DNA, 25 bp, Homo sapien
ggcgcagatccgcacggtctccctc

SEQ ID NO: 53941 - DNA, 25 bp, Homo sapien
ccgtaatccagcagtgcaggccggg

SEQ ID NO: 53942 - DNA, 25 bp, Homo sapien
cgcaccaccgggtggtcgagctgca

SEQ ID NO: 53943 - DNA, 25 bp, Homo sapien
ccacgtcgtagtcatggctgtcctc

SEQ ID NO: 53944 - DNA, 25 bp, Homo sapien
tagtcatggctgtcctcttcgtggt

SEQ ID NO: 53945 - DNA, 25 bp, Homo sapien
tcctcttcgtggtacgggtgcagga

SEQ ID NO: 53946 - DNA, 25 bp, Homo sapien
tcaccttgaaggacacctctccagg

SEQ ID NO: 53947 - DNA, 25 bp, Homo sapien
ccagcccgtaatccagcagtgcagg

SEQ ID NO: 53948 - DNA, 25 bp, Homo sapien
gagcgggccaccgtcctgtaacgga

SEQ ID NO: 53949 - DNA, 25 bp, Homo sapien
caggagcggccaccgtcctgtaacg

SEQ ID NO: 53950 - DNA, 25 bp, Homo sapien
agcggccaccgtcctgtaacggagg

SEQ ID NO: 53951 - DNA, 25 bp, Homo sapien
aggagcgggccaccgtcctgtaacg

SEQ ID NO: 53952 - DNA, 25 bp, Homo sapien
gagcggccaccgtcctgtaacggag

SEQ ID NO: 53953 - DNA, 25 bp, Homo sapien
agcgggccaccgtcctgtaacggag

SEQ ID NO: 53954 - DNA, 25 bp, Homo sapien
ccaccgtcctgtaacggaggggcag

SEQ ID NO: 53955 - DNA, 25 bp, Homo sapien
gccaccgtcctgtaacggaggggca

SEQ ID NO: 53956 - DNA, 25 bp, Homo sapien
acgtctccttgtaattccagctgtg

SEQ ID NO: 53957 - DNA, 25 bp, Homo sapien
accctttcgaagagcagcgtctgga

SEQ ID NO: 53958 - DNA, 25 bp, Homo sapien
ggtcgccatgtcaaagcacccatca

SEQ ID NO: 53959 - DNA, 25 bp, Homo sapien
cgcgtacaggatgacagcctctttc

SEQ ID NO: 53960 - DNA, 25 bp, Homo sapien
tgcataatgtgcacgtacgtctcct

SEQ ID NO: 53961 - DNA, 25 bp, Homo sapien
agcctctttctggttatgcataatg

SEQ ID NO: 53962 - DNA, 25 bp, Homo sapien
agtcgttgctgtagatggcgttctc

SEQ ID NO: 53963 - DNA, 25 bp, Homo sapien
cactgagaaggcgaagaagcgcttc

SEQ ID NO: 53964 - DNA, 25 bp, Homo sapien
actgcctttgcacttccggcgtagg

SEQ ID NO: 53965 - DNA, 25 bp, Homo sapien
aaaccctggttcgtgtctccctctg

SEQ ID NO: 53966 - DNA, 25 bp, Homo sapien
ctttctccctgcaaaacgaaggcga

SEQ ID NO: 53967 - DNA, 25 bp, Homo sapien
cccgacacgacagaacagtggcaga

SEQ ID NO: 53968 - DNA, 25 bp, Homo sapien
acctgctgattgttggaggggaaac

SEQ ID NO: 53969 - DNA, 25 bp, Homo sapien
gggcgggctgtcatgttttacaaaa

SEQ ID NO: 53970 - DNA, 25 bp, Homo sapien
acgtcggatcccaaaggtgttcagc

SEQ ID NO: 53971 - DNA, 25 bp, Homo sapien
tcctgggctttcaggacgtcggatc

SEQ ID NO: 53972 - DNA, 25 bp, Homo sapien
catcggcattgctgccatcgtggtc

SEQ ID NO: 53973 - DNA, 25 bp, Homo sapien
ctgccatcgtggtcgctgtgatcat

SEQ ID NO: 53974 - DNA, 25 bp, Homo sapien
cgggaagctgtacctcatcggcatt

SEQ ID NO: 53975 - DNA, 25 bp, Homo sapien
taaaacgggtggaagatagcaagcc

SEQ ID NO: 53976 - DNA, 25 bp, Homo sapien
ttactgcgtgacaacgggaagccgg

SEQ ID NO: 53977 - DNA, 25 bp, Homo sapien
ctgtggtgaccacggattactgcgt

SEQ ID NO: 53978 - DNA, 25 bp, Homo sapien
ccctctacgctttctgtggtgacca

SEQ ID NO: 53979 - DNA, 25 bp, Homo sapien
ctgccaccagaagatcgatgacctc

SEQ ID NO: 53980 - DNA, 25 bp, Homo sapien
cactgcatgtggcaggtgctcatgc

SEQ ID NO: 53981 - DNA, 25 bp, Homo sapien
gatcagaacgccactgacggccagc

SEQ ID NO: 53982 - DNA, 25 bp, Homo sapien
acgcacaccaccaggtagaccaggg

SEQ ID NO: 53983 - DNA, 25 bp, Homo sapien
tgccgcaggaccacatagatgacca

SEQ ID NO: 53984 - DNA, 25 bp, Homo sapien
ggttgatgccatccaccgccatgac

SEQ ID NO: 53985 - DNA, 25 bp, Homo sapien
ctcatgacagtcaggcagaatatgc

SEQ ID NO: 53986 - DNA, 25 bp, Homo sapien
gagaagaccaccacgggcagcacca

SEQ ID NO: 53987 - DNA, 25 bp, Homo sapien
ttgagcacgtagaagggcatccagc

SEQ ID NO: 53988 - DNA, 25 bp, Homo sapien
ccaccttgagcttcagttgagaact

SEQ ID NO: 53989 - DNA, 25 bp, Homo sapien
cagattgcgcgtggcatcctgtctt

SEQ ID NO: 53990 - DNA, 25 bp, Homo sapien
gggcgttgcgagatttccagattgc

SEQ ID NO: 53991 - DNA, 25 bp, Homo sapien
gagaactccgcgtttctccctggga

SEQ ID NO: 53992 - DNA, 25 bp, Homo sapien
ccgaaatatttcatgaatccgcctc

SEQ ID NO: 53993 - DNA, 25 bp, Homo sapien
ccgtggctcctctctccgaaatatt

SEQ ID NO: 53994 - DNA, 25 bp, Homo sapien
ttcttggtgcttttcctctcggccg

SEQ ID NO: 53995 - DNA, 25 bp, Homo sapien
tccctgggaatgtagagatgcgtta

SEQ ID NO: 53996 - DNA, 25 bp, Homo sapien
cagaacaggccacgcgtgtcccagg

SEQ ID NO: 53997 - DNA, 25 bp, Homo sapien
acccaggatgtcgttctccgcatta

SEQ ID NO: 53998 - DNA, 25 bp, Homo sapien
cagagatctcccgaaaaggctggga

SEQ ID NO: 53999 - DNA, 25 bp, Homo sapien
gcaccgctcctttggctggcagagc

SEQ ID NO: 54000 - DNA, 25 bp, Homo sapien
cggcggaaatgaactcccagacttg

SEQ ID NO: 54001 - DNA, 25 bp, Homo sapien
tccataataatcagccagagatctc

SEQ ID NO: 54002 - DNA, 25 bp, Homo sapien
ctgctggggcctgatttccataata

SEQ ID NO: 54003 - DNA, 25 bp, Homo sapien
gctttcgagaaaccgtccgtgcgca

SEQ ID NO: 54004 - DNA, 25 bp, Homo sapien
cgtgctgacctgctggcgacgtcct

SEQ ID NO: 54005 - DNA, 25 bp, Homo sapien
cttggcgatgctgggctcctccagg

SEQ ID NO: 54006 - DNA, 25 bp, Homo sapien
ccctcagtcgcttggcgatgctggg

SEQ ID NO: 54007 - DNA, 25 bp, Homo sapien
tctccagctcgatccgctctggggt

SEQ ID NO: 54008 - DNA, 25 bp, Homo sapien
ggcggtagttctccagctcgatccg

SEQ ID NO: 54009 - DNA, 25 bp, Homo sapien
gcctcagggacaggcggtagttctc

SEQ ID NO: 54010 - DNA, 25 bp, Homo sapien
tcaggttgtgctcggcctgagtctc

SEQ ID NO: 54011 - DNA, 25 bp, Homo sapien
gtccagcacgctgctcaggttgtgc

SEQ ID NO: 54012 - DNA, 25 bp, Homo sapien
ccgggcccagagctcattagccggg

SEQ ID NO: 54013 - DNA, 25 bp, Homo sapien
ttagggcaggcccagaaccgcatcg

SEQ ID NO: 54014 - DNA, 25 bp, Homo sapien
cccagccttggatagggtagtatac

SEQ ID NO: 54015 - DNA, 25 bp, Homo sapien
taggaccgcctatgctcagggactg

SEQ ID NO: 54016 - DNA, 25 bp, Homo sapien
gggccttcattaaagctcagcgacg

SEQ ID NO: 54017 - DNA, 25 bp, Homo sapien
atggcaggtcctagctcagagggtt

SEQ ID NO: 54018 - DNA, 25 bp, Homo sapien
ccgttcgcaggcctgattgagaggc

SEQ ID NO: 54019 - DNA, 25 bp, Homo sapien
acctgtaggctctgccggagaactt

SEQ ID NO: 54020 - DNA, 25 bp, Homo sapien
aggccgagtccagcttgagagcatc

SEQ ID NO: 54021 - DNA, 25 bp, Homo sapien
gtagtacacggctcccagcacgata

SEQ ID NO: 54022 - DNA, 25 bp, Homo sapien
gtccagcgtcacgatctccttcttg

SEQ ID NO: 54023 - DNA, 25 bp, Homo sapien
tagctgttgttgtactgcacgagga

SEQ ID NO: 54024 - DNA, 25 bp, Homo sapien
gcggctccaccgaaaggatctcgtc

SEQ ID NO: 54025 - DNA, 25 bp, Homo sapien
cgcctgtgcgcacctcgatatagtt

SEQ ID NO: 54026 - DNA, 25 bp, Homo sapien
caggatggtcttcttgacgttgaca

SEQ ID NO: 54027 - DNA, 25 bp, Homo sapien
ccattccgacacttggcctggagta

SEQ ID NO: 54028 - DNA, 25 bp, Homo sapien
gctgcaaattctaaacacaggcaag

SEQ ID NO: 54029 - DNA, 25 bp, Homo sapien
tcccagggcagttcacgcggcgcgt

SEQ ID NO: 54030 - DNA, 25 bp, Homo sapien
tggaccatatcgagccaccgctacg

SEQ ID NO: 54031 - DNA, 25 bp, Homo sapien
gcctccgccaagtggatggaccata

SEQ ID NO: 54032 - DNA, 25 bp, Homo sapien
ctgcgaaattggctgcgagcgtcag

SEQ ID NO: 54033 - DNA, 25 bp, Homo sapien
cccagaggctgcgaaattggctgcg

SEQ ID NO: 54034 - DNA, 25 bp, Homo sapien
accgctacgcggctgtgcgtcggtc

SEQ ID NO: 54035 - DNA, 25 bp, Homo sapien
acacaggcaagtaaggaggaaagcc

SEQ ID NO: 54036 - DNA, 25 bp, Homo sapien
tccgccagcgcattcaacagctggg

SEQ ID NO: 54037 - DNA, 25 bp, Homo sapien
gcattcaacagctgggggcaaactt

SEQ ID NO: 54038 - DNA, 25 bp, Homo sapien
tccgccttgtacctccatgccctgc

SEQ ID NO: 54039 - DNA, 25 bp, Homo sapien
cggatccagaggaattcacttaccc

SEQ ID NO: 54040 - DNA, 25 bp, Homo sapien
ggccgcacgctccacggacacacgc

SEQ ID NO: 54041 - DNA, 25 bp, Homo sapien
tccgcaggcctttccgcagcaagcc

SEQ ID NO: 54042 - DNA, 25 bp, Homo sapien
cggcgctcggatccagaggaattca

SEQ ID NO: 54043 - DNA, 25 bp, Homo sapien
gtcctcggtgtcctcccaccgcctc

SEQ ID NO: 54044 - DNA, 25 bp, Homo sapien
ggcgatcatgtagttctcatccttg

SEQ ID NO: 54045 - DNA, 25 bp, Homo sapien
cgctgcagctggctcttgcgagctt

SEQ ID NO: 54046 - DNA, 25 bp, Homo sapien
tagttctcatccttgagccgcagca

SEQ ID NO: 54047 - DNA, 25 bp, Homo sapien
gctggctcttgcgagcttcccgcag

SEQ ID NO: 54048 - DNA, 25 bp, Homo sapien
tgtgccaggcgcatggcgatcatgt

SEQ ID NO: 54049 - DNA, 25 bp, Homo sapien
cagccgagttcttctcctcactgag

SEQ ID NO: 54050 - DNA, 25 bp, Homo sapien
tgcaggtcacggctgcgaagtacag

SEQ ID NO: 54051 - DNA, 25 bp, Homo sapien
cgcagccgttgacagcgctcctgag

SEQ ID NO: 54052 - DNA, 25 bp, Homo sapien
ggaagcggtaggtgctcagcacctc

SEQ ID NO: 54053 - DNA, 25 bp, Homo sapien
cccactctactgatgcggagaccga

SEQ ID NO: 54054 - DNA, 25 bp, Homo sapien
ggcactcaagctgggcttgcccttc

SEQ ID NO: 54055 - DNA, 25 bp, Homo sapien
cagggctccctagggctagatgtgc

SEQ ID NO: 54056 - DNA, 25 bp, Homo sapien
actggcgcagatacggcgtgagctt

SEQ ID NO: 54057 - DNA, 25 bp, Homo sapien
tcgatgacccggcactggcgcagat

SEQ ID NO: 54058 - DNA, 25 bp, Homo sapien
cctagcttcgcgctacacggctgtg

SEQ ID NO: 54059 - DNA, 25 bp, Homo sapien
gcagcagagccctagcttcgcgcta

SEQ ID NO: 54060 - DNA, 25 bp, Homo sapien
tgtcggttagccctcgagcattctg

SEQ ID NO: 54061 - DNA, 25 bp, Homo sapien
agccagcttggcaccgagagttcgt

SEQ ID NO: 54062 - DNA, 25 bp, Homo sapien
cttgggacccacagcatccttgtga

SEQ ID NO: 54063 - DNA, 25 bp, Homo sapien
tcaccgagcgcagctttaatacctg

SEQ ID NO: 54064 - DNA, 25 bp, Homo sapien
cccagaaggagtgacggttaccgct

SEQ ID NO: 54065 - DNA, 25 bp, Homo sapien
tcttggtcaattccggtcttgtttc

SEQ ID NO: 54066 - DNA, 25 bp, Homo sapien
aacggcattcgtcctccgtgcgaga

SEQ ID NO: 54067 - DNA, 25 bp, Homo sapien
cgccgaccaagatggagactgccga

SEQ ID NO: 54068 - DNA, 25 bp, Homo sapien
cggatgaggtcatcccgtccggttc

SEQ ID NO: 54069 - DNA, 25 bp, Homo sapien
ggacacggctgagcggccaaaatgc

SEQ ID NO: 54070 - DNA, 25 bp, Homo sapien
cgcgcgaggaaactccgagctttcg

SEQ ID NO: 54071 - DNA, 25 bp, Homo sapien
ggggactctgcaccctactaggctc

SEQ ID NO: 54072 - DNA, 25 bp, Homo sapien
agcagtgccagacccgcaacattcg

SEQ ID NO: 54073 - DNA, 25 bp, Homo sapien
cgcaacattcgaagcccttttccta

SEQ ID NO: 54074 - DNA, 25 bp, Homo sapien
acgaagcgcgtctcctttccacttt

SEQ ID NO: 54075 - DNA, 25 bp, Homo sapien
gccctccagattgttctgcctttgc

SEQ ID NO: 54076 - DNA, 25 bp, Homo sapien
tcagcaaccacggtggcagctccgg

SEQ ID NO: 54077 - DNA, 25 bp, Homo sapien
ggcaagctcagcttcgacagcagcc

SEQ ID NO: 54078 - DNA, 25 bp, Homo sapien
gacagcctcgtggttggcaagctca

SEQ ID NO: 54079 - DNA, 25 bp, Homo sapien
cagctccgggagcacccatcgctca

SEQ ID NO: 54080 - DNA, 25 bp, Homo sapien
tcggggacacgtccttcctcagcaa

SEQ ID NO: 54081 - DNA, 25 bp, Homo sapien
gtcttcggggacacgtccttcctca

SEQ ID NO: 54082 - DNA, 25 bp, Homo sapien
cacaccatgcatgtgggccgtggcg

SEQ ID NO: 54083 - DNA, 25 bp, Homo sapien
aggccgcctacgacagcctcgtggt

SEQ ID NO: 54084 - DNA, 25 bp, Homo sapien
cagacatctccgtgacgcagaacga

SEQ ID NO: 54085 - DNA, 25 bp, Homo sapien
ctcagaccctggagcgatggaggac

SEQ ID NO: 54086 - DNA, 25 bp, Homo sapien
gaattcttccggaggcggtcacaga

SEQ ID NO: 54087 - DNA, 25 bp, Homo sapien
atggtgctgcccttagcctgcagta

SEQ ID NO: 54088 - DNA, 25 bp, Homo sapien
cgcagaacgagttagagcgtccctt

SEQ ID NO: 54089 - DNA, 25 bp, Homo sapien
aaggctcacattgcttcacggagta

SEQ ID NO: 54090 - DNA, 25 bp, Homo sapien
gcaacatgcccgcagagaattcttc

SEQ ID NO: 54091 - DNA, 25 bp, Homo sapien
agctcgttggcctctctatggtgcc

SEQ ID NO: 54092 - DNA, 25 bp, Homo sapien
acggtgagtgtcacccgcttccagc

SEQ ID NO: 54093 - DNA, 25 bp, Homo sapien
agccgggcacaacctgtggacggcc

SEQ ID NO: 54094 - DNA, 25 bp, Homo sapien
gaatgggcttacctgcttcccgcca

SEQ ID NO: 54095 - DNA, 25 bp, Homo sapien
ggaagagcgaggaaaccaacttgga

SEQ ID NO: 54096 - DNA, 25 bp, Homo sapien
acccatccggggcaagagccgcgcc

SEQ ID NO: 54097 - DNA, 25 bp, Homo sapien
cagctgcaccgcatgcggcagctgg

SEQ ID NO: 54098 - DNA, 25 bp, Homo sapien
cagcttgggacggtgagtgtcaccc

SEQ ID NO: 54099 - DNA, 25 bp, Homo sapien
ggcaggaatgggcttacctgcttcc

SEQ ID NO: 54100 - DNA, 25 bp, Homo sapien
tacctctgcctcatactgcggtgtc

SEQ ID NO: 54101 - DNA, 25 bp, Homo sapien
ccggacgcagggttataagcgcagc

SEQ ID NO: 54102 - DNA, 25 bp, Homo sapien
acgcttggcgcacgctagctccagg

SEQ ID NO: 54103 - DNA, 25 bp, Homo sapien
catcactgagactagaggcgaaggc

SEQ ID NO: 54104 - DNA, 25 bp, Homo sapien
cagggaaggggcatcactgagacta

SEQ ID NO: 54105 - DNA, 25 bp, Homo sapien
ttagctgggaatttcccatgtgccc

SEQ ID NO: 54106 - DNA, 25 bp, Homo sapien
gcaagcccggttccgtgtagggctc

SEQ ID NO: 54107 - DNA, 25 bp, Homo sapien
gtagggctcctcaagatggtttctt

SEQ ID NO: 54108 - DNA, 25 bp, Homo sapien
ttgtgagcaacaacagccggcgcgc

SEQ ID NO: 54109 - DNA, 25 bp, Homo sapien
agcagctcttcagctccgcgctgtg

SEQ ID NO: 54110 - DNA, 25 bp, Homo sapien
caaggcggctctgtttgtgagcaac

SEQ ID NO: 54111 - DNA, 25 bp, Homo sapien
agctagctcttcattggtcccttcc

SEQ ID NO: 54112 - DNA, 25 bp, Homo sapien
tctcccaccgcgtaagagtgtagtc

SEQ ID NO: 54113 - DNA, 25 bp, Homo sapien
cggggagaaggatcaagctagctct

SEQ ID NO: 54114 - DNA, 25 bp, Homo sapien
tgggctacgacgagcacttctcctt

SEQ ID NO: 54115 - DNA, 25 bp, Homo sapien
tctctccaagttccgttagctcgcg

SEQ ID NO: 54116 - DNA, 25 bp, Homo sapien
tggctcctgacgctaagaggtgaga

SEQ ID NO: 54117 - DNA, 25 bp, Homo sapien
gctgcagcctcgtcatctgtaatac

SEQ ID NO: 54118 - DNA, 25 bp, Homo sapien
gtagcctcttaaactaaaccagctg

SEQ ID NO: 54119 - DNA, 25 bp, Homo sapien
ctccctgctgtagcctcttaaacta

SEQ ID NO: 54120 - DNA, 25 bp, Homo sapien
ccagccgccgatgctgcgttttctg

SEQ ID NO: 54121 - DNA, 25 bp, Homo sapien
gggttaacggccagccgccgatgct

SEQ ID NO: 54122 - DNA, 25 bp, Homo sapien
cgtcatctgtaataccttgactccc

SEQ ID NO: 54123 - DNA, 25 bp, Homo sapien
tcctgacgctaagaggtgagaagtg

SEQ ID NO: 54124 - DNA, 25 bp, Homo sapien
ccagatagccggaagctcgggtctc

SEQ ID NO: 54125 - DNA, 25 bp, Homo sapien
gcctcactgctatgggccgcaacaa

SEQ ID NO: 54126 - DNA, 25 bp, Homo sapien
cgaggctcgttcttagcttcgacga

SEQ ID NO: 54127 - DNA, 25 bp, Homo sapien
gatgagtacgctacacccggaagtg

SEQ ID NO: 54128 - DNA, 25 bp, Homo sapien
cggaacttcggtgcgacgctaaagt

SEQ ID NO: 54129 - DNA, 25 bp, Homo sapien
cgggtctcagagcagtggcttcgac

SEQ ID NO: 54130 - DNA, 25 bp, Homo sapien
cctagtgtctgtgcgccgccagata

SEQ ID NO: 54131 - DNA, 25 bp, Homo sapien
cctcgagctgttcttcgcggccaag

SEQ ID NO: 54132 - DNA, 25 bp, Homo sapien
attgccggagtcacctgcaccctgg

SEQ ID NO: 54133 - DNA, 25 bp, Homo sapien
ttgcggcaccagtcacgggtggatt

SEQ ID NO: 54134 - DNA, 25 bp, Homo sapien
cagcctgggcgagtcgtgcccacgc

SEQ ID NO: 54135 - DNA, 25 bp, Homo sapien
ccattggcccgctcgggtcctccca

SEQ ID NO: 54136 - DNA, 25 bp, Homo sapien
ctcatttcccgaaggcgagaggagg

SEQ ID NO: 54137 - DNA, 25 bp, Homo sapien
tccgaagcgctttcggccagaccgg

SEQ ID NO: 54138 - DNA, 25 bp, Homo sapien
agaccggcctcacccttcccgcagg

SEQ ID NO: 54139 - DNA, 25 bp, Homo sapien
tcacacttgcggcaccagtcacggg

SEQ ID NO: 54140 - DNA, 25 bp, Homo sapien
atccaggccgagaagaaccgcgctg

SEQ ID NO: 54141 - DNA, 25 bp, Homo sapien
cccgcaaaggggaaatgtgccggca

SEQ ID NO: 54142 - DNA, 25 bp, Homo sapien
taaatacccggatgcgccgcccaag

SEQ ID NO: 54143 - DNA, 25 bp, Homo sapien
gcactccagactggcccggtagtca

SEQ ID NO: 54144 - DNA, 25 bp, Homo sapien
agatcccgaggcaggctttgctcag

SEQ ID NO: 54145 - DNA, 25 bp, Homo sapien
gaaggcgccttcaacagccggacca

SEQ ID NO: 54146 - DNA, 25 bp, Homo sapien
gacaggccaccatgaccgagaattc

SEQ ID NO: 54147 - DNA, 25 bp, Homo sapien
ggccaaggcctccaagaagtccaca

SEQ ID NO: 54148 - DNA, 25 bp, Homo sapien
tctttgaggattttgcaggcggcca

SEQ ID NO: 54149 - DNA, 25 bp, Homo sapien
ggttctcgctcttctggttcaggtc

SEQ ID NO: 54150 - DNA, 25 bp, Homo sapien
agtccttgagtacgcgggagacctc

SEQ ID NO: 54151 - DNA, 25 bp, Homo sapien
cccagaagtaggtggccatctcgtg

SEQ ID NO: 54152 - DNA, 25 bp, Homo sapien
gagccgtctgtcctctcctatggag

SEQ ID NO: 54153 - DNA, 25 bp, Homo sapien
ggctgtatcgtcctcaccacgtgca

SEQ ID NO: 54154 - DNA, 25 bp, Homo sapien
gtctccaggtgcgacatctctttga

SEQ ID NO: 54155 - DNA, 25 bp, Homo sapien
gggaacctctgccacgctaaatgtc

SEQ ID NO: 54156 - DNA, 25 bp, Homo sapien
tctgcctttggggtccagagggtac

SEQ ID NO: 54157 - DNA, 25 bp, Homo sapien
cttagccggcttctaggcttctgcc

SEQ ID NO: 54158 - DNA, 25 bp, Homo sapien
ccatttccggccgagaggtgagtac

SEQ ID NO: 54159 - DNA, 25 bp, Homo sapien
tgccatccggacttcggcagtctca

SEQ ID NO: 54160 - DNA, 25 bp, Homo sapien
ttcggcagtctcaacttacaagtca

SEQ ID NO: 54161 - DNA, 25 bp, Homo sapien
acaagtcaagcctctcggtccctgg

SEQ ID NO: 54162 - DNA, 25 bp, Homo sapien
cgttccaagacctttcccgagcttg

SEQ ID NO: 54163 - DNA, 25 bp, Homo sapien
cggaacgtgccttagccggcttcta

SEQ ID NO: 54164 - DNA, 25 bp, Homo sapien
cgagatccagacagcggcgcagaaa

SEQ ID NO: 54165 - DNA, 25 bp, Homo sapien
cgtggaccagctgcaagtctgcgtt

SEQ ID NO: 54166 - DNA, 25 bp, Homo sapien
acccagaccgacgtgaggcggcacg

SEQ ID NO: 54167 - DNA, 25 bp, Homo sapien
ccacgacaagctgtagggccacgcg

SEQ ID NO: 54168 - DNA, 25 bp, Homo sapien
ttccgcagtcatccagaaggtgtct

SEQ ID NO: 54169 - DNA, 25 bp, Homo sapien
caatgtccttgttctctgcgtcgcg

SEQ ID NO: 54170 - DNA, 25 bp, Homo sapien
ccgcgggctaccagaagcggcagta

SEQ ID NO: 54171 - DNA, 25 bp, Homo sapien
ggcgcacccaaggtctaggctcacg

SEQ ID NO: 54172 - DNA, 25 bp, Homo sapien
tccgcaggtacctggccgtgcggca

SEQ ID NO: 54173 - DNA, 25 bp, Homo sapien
tgagcctggcctacgggcgcacgct

SEQ ID NO: 54174 - DNA, 25 bp, Homo sapien
agctactacggcaccgtgcgctacg

SEQ ID NO: 54175 - DNA, 25 bp, Homo sapien
tcggcgccctacctcagctactacg

SEQ ID NO: 54176 - DNA, 25 bp, Homo sapien
acgcgctcatcctgtgcttctggta

SEQ ID NO: 54177 - DNA, 25 bp, Homo sapien
gaggctgcccgaggaccggaataaa

SEQ ID NO: 54178 - DNA, 25 bp, Homo sapien
gtctgtctcactcccgttctccgaa

SEQ ID NO: 54179 - DNA, 25 bp, Homo sapien
atggggcaatgccacgagctctctg

SEQ ID NO: 54180 - DNA, 25 bp, Homo sapien
gcctcagccggccagcgggtatctt

SEQ ID NO: 54181 - DNA, 25 bp, Homo sapien
tcagcgtcagtcagcggctccggcg

SEQ ID NO: 54182 - DNA, 25 bp, Homo sapien
gacccgaagtcagcgaaggagaaga

SEQ ID NO: 54183 - DNA, 25 bp, Homo sapien
ccacaggacgtgcaagtagcgcagc

SEQ ID NO: 54184 - DNA, 25 bp, Homo sapien
cctgctgccacaggacgtgcaagta

SEQ ID NO: 54185 - DNA, 25 bp, Homo sapien
ccagcgggtatcttgcagcgcagct

SEQ ID NO: 54186 - DNA, 25 bp, Homo sapien
ccctgagtcgtgctgtcagcgagct

SEQ ID NO: 54187 - DNA, 25 bp, Homo sapien
caaagcgcggccactggtcctctga

SEQ ID NO: 54188 - DNA, 25 bp, Homo sapien
gggccgctcatttcgctctttccgg

SEQ ID NO: 54189 - DNA, 25 bp, Homo sapien
ctctttccggcggtgctcgcaagcg

SEQ ID NO: 54190 - DNA, 25 bp, Homo sapien
cggtgctcgcaagcgaggcagccat

SEQ ID NO: 54191 - DNA, 25 bp, Homo sapien
aggcagccatgtcttatcccgctga

SEQ ID NO: 54192 - DNA, 25 bp, Homo sapien
tcccgctgatgattatgagtctgag

SEQ ID NO: 54193 - DNA, 25 bp, Homo sapien
tgggctccacgacggggtgatctct

SEQ ID NO: 54194 - DNA, 25 bp, Homo sapien
cgacggggtgatctctgggaccact

SEQ ID NO: 54195 - DNA, 25 bp, Homo sapien
ggggctgaacttccggcctcaggac

SEQ ID NO: 54196 - DNA, 25 bp, Homo sapien
agggtactcaccgactagggcttca

SEQ ID NO: 54197 - DNA, 25 bp, Homo sapien
atttagattcgctcgcccacagggg

SEQ ID NO: 54198 - DNA, 25 bp, Homo sapien
cggatactgggtgtctttcccacta

SEQ ID NO: 54199 - DNA, 25 bp, Homo sapien
tgcgatgatcgagacacggatactg

SEQ ID NO: 54200 - DNA, 25 bp, Homo sapien
tgcctgcgggatagaagcacaatga

SEQ ID NO: 54201 - DNA, 25 bp, Homo sapien
gttcaccgcgctgagctagccagag

SEQ ID NO: 54202 - DNA, 25 bp, Homo sapien
agccgctgctcctaatgagctcatg

SEQ ID NO: 54203 - DNA, 25 bp, Homo sapien
cgtccttttgttgcacacgcccggg

SEQ ID NO: 54204 - DNA, 25 bp, Homo sapien
cctcagtaacacgaagcccgggcgg

SEQ ID NO: 54205 - DNA, 25 bp, Homo sapien
cttgacctctttgaaggggtgttga

SEQ ID NO: 54206 - DNA, 25 bp, Homo sapien
atttccgccgaggatcgctgaaccc

SEQ ID NO: 54207 - DNA, 25 bp, Homo sapien
aggctggtccctccgcggggacact

SEQ ID NO: 54208 - DNA, 25 bp, Homo sapien
accgcggcgtggagatccgcgacct

SEQ ID NO: 54209 - DNA, 25 bp, Homo sapien
atgggagcacgaggtgtcccgcctc

SEQ ID NO: 54210 - DNA, 25 bp, Homo sapien
caaagtttcaagctaggggtggaag

SEQ ID NO: 54211 - DNA, 25 bp, Homo sapien
acaaagcgctgatttccgccgagga

SEQ ID NO: 54212 - DNA, 25 bp, Homo sapien
tggcctttgcggcaaccttggaagg

SEQ ID NO: 54213 - DNA, 25 bp, Homo sapien
gatttcctctgggttacggcgcagg

SEQ ID NO: 54214 - DNA, 25 bp, Homo sapien
aaatactgcgcgatctgggctgctg

SEQ ID NO: 54215 - DNA, 25 bp, Homo sapien
gcaccggtgccacgcagaaatactg

SEQ ID NO: 54216 - DNA, 25 bp, Homo sapien
agcgcctctcgctactatagaaacg

SEQ ID NO: 54217 - DNA, 25 bp, Homo sapien
cgcgcgagtcgtagtgtcgctgttt

SEQ ID NO: 54218 - DNA, 25 bp, Homo sapien
cgcaggcgcaagataagctaggagc

SEQ ID NO: 54219 - DNA, 25 bp, Homo sapien
gtgaccactgctttacagccgcatc

SEQ ID NO: 54220 - DNA, 25 bp, Homo sapien
gggctcagctccacctccgataggt

SEQ ID NO: 54221 - DNA, 25 bp, Homo sapien
cggggtcctcgcaaagagtccaacg

SEQ ID NO: 54222 - DNA, 25 bp, Homo sapien
taccctgaatccacccgaagctaga

SEQ ID NO: 54223 - DNA, 25 bp, Homo sapien
gagtccaacgcccacctggatggaa

SEQ ID NO: 54224 - DNA, 25 bp, Homo sapien
actgccagacagtcccgctctgagg

SEQ ID NO: 54225 - DNA, 25 bp, Homo sapien
ggtcttccagccctatccaaggagg

SEQ ID NO: 54226 - DNA, 25 bp, Homo sapien
cggggaacttgtcatcgtccgcctc

SEQ ID NO: 54227 - DNA, 25 bp, Homo sapien
tcgggtgctcacctccagagcttgc

SEQ ID NO: 54228 - DNA, 25 bp, Homo sapien
ggctccacaggacgttcgtgaccca

SEQ ID NO: 54229 - DNA, 25 bp, Homo sapien
acaggacgttcgtgacccaccttgc

SEQ ID NO: 54230 - DNA, 25 bp, Homo sapien
caggcctcgtccctgcatgggacaa

SEQ ID NO: 54231 - DNA, 25 bp, Homo sapien
tccctgcatgggacaagaggcagcc

SEQ ID NO: 54232 - DNA, 25 bp, Homo sapien
agaggcagccctccgccatttcccg

SEQ ID NO: 54233 - DNA, 25 bp, Homo sapien
ccctctgacgactgagtggactgcg

SEQ ID NO: 54234 - DNA, 25 bp, Homo sapien
tgacgactgagtggactgcgcttga

SEQ ID NO: 54235 - DNA, 25 bp, Homo sapien
agagccgtctctgcacccgctccca

SEQ ID NO: 54236 - DNA, 25 bp, Homo sapien
gtgcacctgggcctcctccagaatg

SEQ ID NO: 54237 - DNA, 25 bp, Homo sapien
acagtctacgctggccgttccctat

SEQ ID NO: 54238 - DNA, 25 bp, Homo sapien
ccacacggaccttggtggacgtgct

SEQ ID NO: 54239 - DNA, 25 bp, Homo sapien
acagcaaccacacggaccttggtgg

SEQ ID NO: 54240 - DNA, 25 bp, Homo sapien
gcctcctccagaatgcggcggtgca

SEQ ID NO: 54241 - DNA, 25 bp, Homo sapien
tgcccgctgcccaaacccttctgag

SEQ ID NO: 54242 - DNA, 25 bp, Homo sapien
cagctcgagtcctgtcctcccagag

SEQ ID NO: 54243 - DNA, 25 bp, Homo sapien
gttccctatgcggtactgccacctg

SEQ ID NO: 54244 - DNA, 25 bp, Homo sapien
gttcctctgttttcgcttgttccta

SEQ ID NO: 54245 - DNA, 25 bp, Homo sapien
ggaagtgacgtgacaatcgcggcca

SEQ ID NO: 54246 - DNA, 25 bp, Homo sapien
ggggttagacgctgtcagcctgtcc

SEQ ID NO: 54247 - DNA, 25 bp, Homo sapien
agcctgtccagaccgttcctctgtt

SEQ ID NO: 54248 - DNA, 25 bp, Homo sapien
tgttcctactaacagcgagcttccg

SEQ ID NO: 54249 - DNA, 25 bp, Homo sapien
ttctcgttcttggttccgagcgtcc

SEQ ID NO: 54250 - DNA, 25 bp, Homo sapien
gcgagcttccgccaatacttgttct

SEQ ID NO: 54251 - DNA, 25 bp, Homo sapien
tctgcagggattggagcaaatatcc

SEQ ID NO: 54252 - DNA, 25 bp, Homo sapien
ggtgagcaccggcaactatgagtac

SEQ ID NO: 54253 - DNA, 25 bp, Homo sapien
ctcccagatgcgcaaggatgtgctg

SEQ ID NO: 54254 - DNA, 25 bp, Homo sapien
cgcttctcccagatgcgcaaggatg

SEQ ID NO: 54255 - DNA, 25 bp, Homo sapien
tgagtaccgcctgatcctgcgctgc

SEQ ID NO: 54256 - DNA, 25 bp, Homo sapien
tccctgagcaggcactcctgtccca

SEQ ID NO: 54257 - DNA, 25 bp, Homo sapien
gcgaggccgtccctgagcaggcact

SEQ ID NO: 54258 - DNA, 25 bp, Homo sapien
cggcaactatgagtaccgcctgatc

SEQ ID NO: 54259 - DNA, 25 bp, Homo sapien
agctgctggaccagaagcacggtga

SEQ ID NO: 54260 - DNA, 25 bp, Homo sapien
ggggacaggccaaagagacagcatc

SEQ ID NO: 54261 - DNA, 25 bp, Homo sapien
tagggaaaccgaggacagatcttgc

SEQ ID NO: 54262 - DNA, 25 bp, Homo sapien
cgcgtggcaaaggaagctaggatca

SEQ ID NO: 54263 - DNA, 25 bp, Homo sapien
agccaaagcgggtcacgaggatgct

SEQ ID NO: 54264 - DNA, 25 bp, Homo sapien
gatggcttgagtcctctaaggaata

SEQ ID NO: 54265 - DNA, 25 bp, Homo sapien
aataaggtcacctccggctcaggga

SEQ ID NO: 54266 - DNA, 25 bp, Homo sapien
gccctggcacagactgggattcctc

SEQ ID NO: 54267 - DNA, 25 bp, Homo sapien
cagccgagggacttcgaagactgtc

SEQ ID NO: 54268 - DNA, 25 bp, Homo sapien
gacgagccctccagcttgccgtaga

SEQ ID NO: 54269 - DNA, 25 bp, Homo sapien
gcctcaccatgtccaggcaggtggg

SEQ ID NO: 54270 - DNA, 25 bp, Homo sapien
gttcttcctggcgtctgccctcgat

SEQ ID NO: 54271 - DNA, 25 bp, Homo sapien
ggcacgtgggcaggaagttcttcct

SEQ ID NO: 54272 - DNA, 25 bp, Homo sapien
ccaaaggagttggagcgcgagcttt

SEQ ID NO: 54273 - DNA, 25 bp, Homo sapien
cttccacagcagcacgcggttctgg

SEQ ID NO: 54274 - DNA, 25 bp, Homo sapien
agcttgccgtagagccagccgttct

SEQ ID NO: 54275 - DNA, 25 bp, Homo sapien
tgcggctggcctcagactgctcctt

SEQ ID NO: 54276 - DNA, 25 bp, Homo sapien
tgacgtccgtcatcttggtgtgctc

SEQ ID NO: 54277 - DNA, 25 bp, Homo sapien
acacgcagggctcccgtagaacagc

SEQ ID NO: 54278 - DNA, 25 bp, Homo sapien
ccgtagaacagcctgcagagcgcct

SEQ ID NO: 54279 - DNA, 25 bp, Homo sapien
gccgcgcatgtaggccatggactta

SEQ ID NO: 54280 - DNA, 25 bp, Homo sapien
ttcatgcgaaagtacatgccgcgca

SEQ ID NO: 54281 - DNA, 25 bp, Homo sapien
ggccatggacttacctaggaacaaa

SEQ ID NO: 54282 - DNA, 25 bp, Homo sapien
ggaacacctcatccttcatgcgaaa

SEQ ID NO: 54283 - DNA, 25 bp, Homo sapien
gccagggcttacttgggtttcctga

SEQ ID NO: 54284 - DNA, 25 bp, Homo sapien
tcaggctgagttagcacaggcactc

SEQ ID NO: 54285 - DNA, 25 bp, Homo sapien
ggttgcgcatcaccgccacgtgcag

SEQ ID NO: 54286 - DNA, 25 bp, Homo sapien
tgttgccgtgctctccgcgggcatc

SEQ ID NO: 54287 - DNA, 25 bp, Homo sapien
gggtcagcagcactatggcacagtc

SEQ ID NO: 54288 - DNA, 25 bp, Homo sapien
acagtcgaagcggttgcgcatcacc

SEQ ID NO: 54289 - DNA, 25 bp, Homo sapien
agctggtgctgttcacgttgcagcc

SEQ ID NO: 54290 - DNA, 25 bp, Homo sapien
gggctcaccgacatggccaggtgca

SEQ ID NO: 54291 - DNA, 25 bp, Homo sapien
gcactatggcacagtcgaagcggtt

SEQ ID NO: 54292 - DNA, 25 bp, Homo sapien
attccggaccacacaggaagcccga

SEQ ID NO: 54293 - DNA, 25 bp, Homo sapien
gtccatttagggagctcggcaaaca

SEQ ID NO: 54294 - DNA, 25 bp, Homo sapien
tgcgcgcagctggtttacattccct

SEQ ID NO: 54295 - DNA, 25 bp, Homo sapien
gtttacattcccttgctgccgcaga

SEQ ID NO: 54296 - DNA, 25 bp, Homo sapien
cagaatcacgcggtgcctcgagcaa

SEQ ID NO: 54297 - DNA, 25 bp, Homo sapien
gagcaactcctttgaccctcttaga

SEQ ID NO: 54298 - DNA, 25 bp, Homo sapien
ggattagttccttccgtgcaaaggc

SEQ ID NO: 54299 - DNA, 25 bp, Homo sapien
tgcaaaggcagacagaaacgcgttc

SEQ ID NO: 54300 - DNA, 25 bp, Homo sapien
agctttcggcgggagccaatcctcg

SEQ ID NO: 54301 - DNA, 25 bp, Homo sapien
aggtcactcacctcggcttactcag

SEQ ID NO: 54302 - DNA, 25 bp, Homo sapien
tcggcttactcagcacttctacttc

SEQ ID NO: 54303 - DNA, 25 bp, Homo sapien
acaaacgggcctcgggccacgtgat

SEQ ID NO: 54304 - DNA, 25 bp, Homo sapien
gggccacgtgatggcctgaccaccg

SEQ ID NO: 54305 - DNA, 25 bp, Homo sapien
ctgcccaatggaaggggctccctta

SEQ ID NO: 54306 - DNA, 25 bp, Homo sapien
cacgaggaatatccaaaggagggtc

SEQ ID NO: 54307 - DNA, 25 bp, Homo sapien
ccttagccaggaggacgagctttcg

SEQ ID NO: 54308 - DNA, 25 bp, Homo sapien
gctcctacgtgactcggtgggaaca

SEQ ID NO: 54309 - DNA, 25 bp, Homo sapien
cctgtgagtgagtaattccgggaag

SEQ ID NO: 54310 - DNA, 25 bp, Homo sapien
ttccgggaagctcgccttacaactc

SEQ ID NO: 54311 - DNA, 25 bp, Homo sapien
tccctggggcctgtacaccagcagt

SEQ ID NO: 54312 - DNA, 25 bp, Homo sapien
gaagcggacccgtgcgtcttcgcac

SEQ ID NO: 54313 - DNA, 25 bp, Homo sapien
tcttcgcacggggtctgggaattct

SEQ ID NO: 54314 - DNA, 25 bp, Homo sapien
acgtcaccgcatgactgggttttta

SEQ ID NO: 54315 - DNA, 25 bp, Homo sapien
accagcagtgtgtacctcggagagg

SEQ ID NO: 54316 - DNA, 25 bp, Homo sapien
gctaaggcggtgaaagaggaacacc

SEQ ID NO: 54317 - DNA, 25 bp, Homo sapien
cgcacctgtcggacgaggcgctgat

SEQ ID NO: 54318 - DNA, 25 bp, Homo sapien
ggcgccgcacactcaaaaaccgtgg

SEQ ID NO: 54319 - DNA, 25 bp, Homo sapien
aaaaccgtggctacgccgccagctg

SEQ ID NO: 54320 - DNA, 25 bp, Homo sapien
ctgaaccggcatctgcgcgggctct

SEQ ID NO: 54321 - DNA, 25 bp, Homo sapien
ctgagcgagaacacgccgcacctgt

SEQ ID NO: 54322 - DNA, 25 bp, Homo sapien
cccgcagatcaagcgagagctgagc

SEQ ID NO: 54323 - DNA, 25 bp, Homo sapien
cagtttcctcatgcccgcagatcaa

SEQ ID NO: 54324 - DNA, 25 bp, Homo sapien
tccaagttactagggtggcgcaagc

SEQ ID NO: 54325 - DNA, 25 bp, Homo sapien
ctcccactgggaggtacctgacagt

SEQ ID NO: 54326 - DNA, 25 bp, Homo sapien
acctgacagtggtggtcccatctca

SEQ ID NO: 54327 - DNA, 25 bp, Homo sapien
gaagcgacccgagcgtattcgccgc

SEQ ID NO: 54328 - DNA, 25 bp, Homo sapien
gctcacagtgatcgcggggccagca

SEQ ID NO: 54329 - DNA, 25 bp, Homo sapien
cccaactccggagtggctcagaggg

SEQ ID NO: 54330 - DNA, 25 bp, Homo sapien
gcccggcagtcaaaccaggtccaga

SEQ ID NO: 54331 - DNA, 25 bp, Homo sapien
gacaaggcgcccattctccaagtta

SEQ ID NO: 54332 - DNA, 25 bp, Homo sapien
gtggcgggcgtgtacaccctccact

SEQ ID NO: 54333 - DNA, 25 bp, Homo sapien
cttgcaaagcgccttggtccatccg

SEQ ID NO: 54334 - DNA, 25 bp, Homo sapien
ggacaggtccgattacactccagga

SEQ ID NO: 54335 - DNA, 25 bp, Homo sapien
gcgcgggcctctccgaaacaagcag

SEQ ID NO: 54336 - DNA, 25 bp, Homo sapien
caatccctcttgcaaagcgccttgg

SEQ ID NO: 54337 - DNA, 25 bp, Homo sapien
gctgagatcactgcctgggccttaa

SEQ ID NO: 54338 - DNA, 25 bp, Homo sapien
gatacctcaggagcccatggcggtg

SEQ ID NO: 54339 - DNA, 25 bp, Homo sapien
ccaggcgggatacctcaggagccca

SEQ ID NO: 54340 - DNA, 25 bp, Homo sapien
gcgcgaacgcgcgtgtgtctgccct

SEQ ID NO: 54341 - DNA, 25 bp, Homo sapien
cccgcgagcctgcaaaataacaggc

SEQ ID NO: 54342 - DNA, 25 bp, Homo sapien
gaatcaacagtatccggcgcccagc

SEQ ID NO: 54343 - DNA, 25 bp, Homo sapien
tacgcgggcccgaatcaacagtatc

SEQ ID NO: 54344 - DNA, 25 bp, Homo sapien
ctctccagcaaaaacaaagaggctg

SEQ ID NO: 54345 - DNA, 25 bp, Homo sapien
tgtccgatgaaacgctacgcgggcc

SEQ ID NO: 54346 - DNA, 25 bp, Homo sapien
gtcatccaacgagcgggcgcagcct

SEQ ID NO: 54347 - DNA, 25 bp, Homo sapien
ggcgccggtgattgtccgatgaaac

SEQ ID NO: 54348 - DNA, 25 bp, Homo sapien
ggctctcagggtggcccagatgcca

SEQ ID NO: 54349 - DNA, 25 bp, Homo sapien
ctgaaatgactatccttttctgggg

SEQ ID NO: 54350 - DNA, 25 bp, Homo sapien
caccaaagccttaaacctgaaatga

SEQ ID NO: 54351 - DNA, 25 bp, Homo sapien
ccagatgccagggtcccagaagtgg

SEQ ID NO: 54352 - DNA, 25 bp, Homo sapien
cagggtcccagaagtggccttttct

SEQ ID NO: 54353 - DNA, 25 bp, Homo sapien
agtggccttttctagctcctgtaac

SEQ ID NO: 54354 - DNA, 25 bp, Homo sapien
gctcctgtaactaaacctggcggaa

SEQ ID NO: 54355 - DNA, 25 bp, Homo sapien
caagaatgcgccttcccgtcttcgg

SEQ ID NO: 54356 - DNA, 25 bp, Homo sapien
ctagaaagagcagctagaaagctga

SEQ ID NO: 54357 - DNA, 25 bp, Homo sapien
gcctcgcgcagttttctcggccttt

SEQ ID NO: 54358 - DNA, 25 bp, Homo sapien
aggcctcgcgcagttttctcggcct

SEQ ID NO: 54359 - DNA, 25 bp, Homo sapien
cctagaaagagcagctagaaagctg

SEQ ID NO: 54360 - DNA, 25 bp, Homo sapien
agaaagagcagctagaaagctgaga

SEQ ID NO: 54361 - DNA, 25 bp, Homo sapien
ggcctcgcgcagttttctcggcctt

SEQ ID NO: 54362 - DNA, 25 bp, Homo sapien
gaggcctcgcgcagttttctcggcc

SEQ ID NO: 54363 - DNA, 25 bp, Homo sapien
cctcgcgcagttttctcggcctttt

SEQ ID NO: 54364 - DNA, 25 bp, Homo sapien
gggaaaacaggcgaagaagcccatc

SEQ ID NO: 54365 - DNA, 25 bp, Homo sapien
ctctggtccttctgtgacaggaggg

SEQ ID NO: 54366 - DNA, 25 bp, Homo sapien
gagaatgaggtcactctggtccttc

SEQ ID NO: 54367 - DNA, 25 bp, Homo sapien
gagtgagaataattagtaacagccc

SEQ ID NO: 54368 - DNA, 25 bp, Homo sapien
ccgcggaggagtgagaataattagt

SEQ ID NO: 54369 - DNA, 25 bp, Homo sapien
gagccttgacctgtacacctgagaa

SEQ ID NO: 54370 - DNA, 25 bp, Homo sapien
tccagagccttgacctgtacacctg

SEQ ID NO: 54371 - DNA, 25 bp, Homo sapien
agaaatgggcgtggtgactcctgct

SEQ ID NO: 54372 - DNA, 25 bp, Homo sapien
cggtgatcttactctcctgcagctc

SEQ ID NO: 54373 - DNA, 25 bp, Homo sapien
ccgcggagaagatcatgagcatgta

SEQ ID NO: 54374 - DNA, 25 bp, Homo sapien
gactggaccaccacagcgatgactg

SEQ ID NO: 54375 - DNA, 25 bp, Homo sapien
ggtactcgccctcctgggtcatgta

SEQ ID NO: 54376 - DNA, 25 bp, Homo sapien
tcctcgtcgatctcgtggacaatga

SEQ ID NO: 54377 - DNA, 25 bp, Homo sapien
ccatgccataaagcgggctgtcctc

SEQ ID NO: 54378 - DNA, 25 bp, Homo sapien
cggccacctcgtaggtcttgtgaaa

SEQ ID NO: 54379 - DNA, 25 bp, Homo sapien
aggccgatgtcatagcccacgttga

SEQ ID NO: 54380 - DNA, 25 bp, Homo sapien
cctcggcgtcagcatcgtcgggccc

SEQ ID NO: 54381 - DNA, 25 bp, Homo sapien
caaactgacggacagcgcccggggt

SEQ ID NO: 54382 - DNA, 25 bp, Homo sapien
gcgggacaaactgacggacagcgcc

SEQ ID NO: 54383 - DNA, 25 bp, Homo sapien
acagacacgcacgcggcgggacaaa

SEQ ID NO: 54384 - DNA, 25 bp, Homo sapien
cgggcgctacatcccaaggcgcgat

SEQ ID NO: 54385 - DNA, 25 bp, Homo sapien
acccggctccggatcaggtgcggag

SEQ ID NO: 54386 - DNA, 25 bp, Homo sapien
cgggccgcccaactttcagcgctgc

SEQ ID NO: 54387 - DNA, 25 bp, Homo sapien
gcgagcgggcgctacatcccaaggc

SEQ ID NO: 54388 - DNA, 25 bp, Homo sapien
ttcgcccaggccaactcgggatatc

SEQ ID NO: 54389 - DNA, 25 bp, Homo sapien
ctgggctcggaaatgaaccgatttc

SEQ ID NO: 54390 - DNA, 25 bp, Homo sapien
ggccaggtattccagggatgcaaga

SEQ ID NO: 54391 - DNA, 25 bp, Homo sapien
gccttggacccggactcgttatgaa

SEQ ID NO: 54392 - DNA, 25 bp, Homo sapien
ctttgatcgtaaccaggagcccgga

SEQ ID NO: 54393 - DNA, 25 bp, Homo sapien
ggccgagagctgaggaactacaact

SEQ ID NO: 54394 - DNA, 25 bp, Homo sapien
agcaccagtttgttttctcacggca

SEQ ID NO: 54395 - DNA, 25 bp, Homo sapien
tcctgcaaatctgacgtgtaaactg

SEQ ID NO: 54396 - DNA, 25 bp, Homo sapien
agcctcgctctgtgactcctgaatc

SEQ ID NO: 54397 - DNA, 25 bp, Homo sapien
tgactcctgaatccgggctccgggt

SEQ ID NO: 54398 - DNA, 25 bp, Homo sapien
cggaagtcctcggaatgccagcgca

SEQ ID NO: 54399 - DNA, 25 bp, Homo sapien
caaggacgaagggtggcccagcctc

SEQ ID NO: 54400 - DNA, 25 bp, Homo sapien
ttcgcgcctcgtcactctggagacg

SEQ ID NO: 54401 - DNA, 25 bp, Homo sapien
cggcttgcggttgccgtaggaacct

SEQ ID NO: 54402 - DNA, 25 bp, Homo sapien
ttttggtcaccgagagacacctgtc

SEQ ID NO: 54403 - DNA, 25 bp, Homo sapien
aggcgcacgactccgcgcgctgaga

SEQ ID NO: 54404 - DNA, 25 bp, Homo sapien
ctctggggcacctagagaccggggc

SEQ ID NO: 54405 - DNA, 25 bp, Homo sapien
catgaacgtgttccgaatcctcggc

SEQ ID NO: 54406 - DNA, 25 bp, Homo sapien
ctggaccatgaacgtgttccgaatc

SEQ ID NO: 54407 - DNA, 25 bp, Homo sapien
gcacgactgactggctggaccatga

SEQ ID NO: 54408 - DNA, 25 bp, Homo sapien
tttcctagaagtttgctgggcgcgg

SEQ ID NO: 54409 - DNA, 25 bp, Homo sapien
tgcccgccagaaagtttcctagaag

SEQ ID NO: 54410 - DNA, 25 bp, Homo sapien
cctgcccgccagaaagtttcctaga

SEQ ID NO: 54411 - DNA, 25 bp, Homo sapien
actggctggaccatgaacgtgttcc

SEQ ID NO: 54412 - DNA, 25 bp, Homo sapien
gccggcacgaaggtgcttcctgaga

SEQ ID NO: 54413 - DNA, 25 bp, Homo sapien
tgagtatcgccaccggcgacggccg

SEQ ID NO: 54414 - DNA, 25 bp, Homo sapien
ggtgttggcgcgcacccacgtccag

SEQ ID NO: 54415 - DNA, 25 bp, Homo sapien
agggccgcgtctacaacttcctcga

SEQ ID NO: 54416 - DNA, 25 bp, Homo sapien
ccaccggctggaaatgcttcgttta

SEQ ID NO: 54417 - DNA, 25 bp, Homo sapien
ggaaatgcttcgtttaccacttcgc

SEQ ID NO: 54418 - DNA, 25 bp, Homo sapien
ccacttcgccgtgtgagtatcgcca

SEQ ID NO: 54419 - DNA, 25 bp, Homo sapien
gacccgcgcgtctccatctacagca

SEQ ID NO: 54420 - DNA, 25 bp, Homo sapien
ctctggtgcgacgtaacattctttg

SEQ ID NO: 54421 - DNA, 25 bp, Homo sapien
ctacgggtattcttggaagcacttt

SEQ ID NO: 54422 - DNA, 25 bp, Homo sapien
ccgctgagtcggctccaacttaacg

SEQ ID NO: 54423 - DNA, 25 bp, Homo sapien
tttggctacgctcaaaccgggcagt

SEQ ID NO: 54424 - DNA, 25 bp, Homo sapien
ctccgcgcatggtcccaaaaggata

SEQ ID NO: 54425 - DNA, 25 bp, Homo sapien
cggcctgctgttgctaagatgcgca

SEQ ID NO: 54426 - DNA, 25 bp, Homo sapien
cggccggcttgaagaagttgctttg

SEQ ID NO: 54427 - DNA, 25 bp, Homo sapien
acattctttgcgtcgttagccggcc

SEQ ID NO: 54428 - DNA, 25 bp, Homo sapien
tccgattcgattgaaaatgaggttg

SEQ ID NO: 54429 - DNA, 25 bp, Homo sapien
cctagactcaggtccgattcgattg

SEQ ID NO: 54430 - DNA, 25 bp, Homo sapien
attttcctgacaccggattccctgg

SEQ ID NO: 54431 - DNA, 25 bp, Homo sapien
ccggattccctggtcaggaggatga

SEQ ID NO: 54432 - DNA, 25 bp, Homo sapien
ggttggaaatccctcaagatcacta

SEQ ID NO: 54433 - DNA, 25 bp, Homo sapien
tccctcaagatcactaaaattcctc

SEQ ID NO: 54434 - DNA, 25 bp, Homo sapien
gcggccgccggacattttcctgaca

SEQ ID NO: 54435 - DNA, 25 bp, Homo sapien
atgaggcgggctctcctagactcag

SEQ ID NO: 54436 - DNA, 25 bp, Homo sapien
tgcagatggagccttggcttagaag

SEQ ID NO: 54437 - DNA, 25 bp, Homo sapien
ctttggcgataggtcttggtcgcga

SEQ ID NO: 54438 - DNA, 25 bp, Homo sapien
gttctgaggaggtagccttgagtcg

SEQ ID NO: 54439 - DNA, 25 bp, Homo sapien
gctaaagtccgggagaagaccctga

SEQ ID NO: 54440 - DNA, 25 bp, Homo sapien
ggccttgaagggagaccgttgagct

SEQ ID NO: 54441 - DNA, 25 bp, Homo sapien
ctgagcacctcgctaaagtccggga

SEQ ID NO: 54442 - DNA, 25 bp, Homo sapien
ggggcgtccctcgagctgagcacct

SEQ ID NO: 54443 - DNA, 25 bp, Homo sapien
gtggctgactttggcgataggtctt

SEQ ID NO: 54444 - DNA, 25 bp, Homo sapien
tgttacttgagtccgacagccctgg

SEQ ID NO: 54445 - DNA, 25 bp, Homo sapien
gaggcccattttgctactctgagtc

SEQ ID NO: 54446 - DNA, 25 bp, Homo sapien
tgagtccaggcgttctctaggcaac

SEQ ID NO: 54447 - DNA, 25 bp, Homo sapien
ttgtccgcgagatgccgtttctatg

SEQ ID NO: 54448 - DNA, 25 bp, Homo sapien
aggtcgccgtgaagatgattgcatg

SEQ ID NO: 54449 - DNA, 25 bp, Homo sapien
tctgtccgtccgtcttacctgaaag

SEQ ID NO: 54450 - DNA, 25 bp, Homo sapien
tacctgaaagcatcggcggaatttg

SEQ ID NO: 54451 - DNA, 25 bp, Homo sapien
tccgtttgctatcccgaggtgattc

SEQ ID NO: 54452 - DNA, 25 bp, Homo sapien
actatggggcctgacggagatgttt

SEQ ID NO: 54453 - DNA, 25 bp, Homo sapien
accctgtcggagagactatggggcc

SEQ ID NO: 54454 - DNA, 25 bp, Homo sapien
cagctagatgagaccctgtcggaga

SEQ ID NO: 54455 - DNA, 25 bp, Homo sapien
gcgtctactccaccacagctagatg

SEQ ID NO: 54456 - DNA, 25 bp, Homo sapien
tttcggctaagacccgcgtctactc

SEQ ID NO: 54457 - DNA, 25 bp, Homo sapien
ggccaggaatggatgtcgctttttc

SEQ ID NO: 54458 - DNA, 25 bp, Homo sapien
cgaattgctcccgaaaggcgacgcg

SEQ ID NO: 54459 - DNA, 25 bp, Homo sapien
ggaaaagcagctctgtccgccgttc

SEQ ID NO: 54460 - DNA, 25 bp, Homo sapien
gcttttcggccgaacgttctcgctc

SEQ ID NO: 54461 - DNA, 25 bp, Homo sapien
taagtctgacgtcatcggcaccggc

SEQ ID NO: 54462 - DNA, 25 bp, Homo sapien
ctccttctgcgttgactgttttatg

SEQ ID NO: 54463 - DNA, 25 bp, Homo sapien
tatgtgtggttaacgcgcggctcac

SEQ ID NO: 54464 - DNA, 25 bp, Homo sapien
cgggcgcaaattgccttggttagtg

SEQ ID NO: 54465 - DNA, 25 bp, Homo sapien
tctcgctgggagtcacatttcaagt

SEQ ID NO: 54466 - DNA, 25 bp, Homo sapien
tggcgtcacgcctgacgtaagtctg

SEQ ID NO: 54467 - DNA, 25 bp, Homo sapien
aagcacctgattcggtcgggcgcaa

SEQ ID NO: 54468 - DNA, 25 bp, Homo sapien
ctggacctcaccagcaaggtaggcc

SEQ ID NO: 54469 - DNA, 25 bp, Homo sapien
cgcggctggagttttgcataaatta

SEQ ID NO: 54470 - DNA, 25 bp, Homo sapien
aattattccgataaggagcggggcg

SEQ ID NO: 54471 - DNA, 25 bp, Homo sapien
gccggctacgaattagcctaagtta

SEQ ID NO: 54472 - DNA, 25 bp, Homo sapien
cccacttgaggggattcggagaccg

SEQ ID NO: 54473 - DNA, 25 bp, Homo sapien
agaccgagagtctcctctccctgga

SEQ ID NO: 54474 - DNA, 25 bp, Homo sapien
gccgagacgctcatgaagacaggta

SEQ ID NO: 54475 - DNA, 25 bp, Homo sapien
cggggctctgtgcatagattagtca

SEQ ID NO: 54476 - DNA, 25 bp, Homo sapien
ggccgactctgtatgtgtgcgcctg

SEQ ID NO: 54477 - DNA, 25 bp, Homo sapien
gtgtgcgcctgtcagtcaacgctga

SEQ ID NO: 54478 - DNA, 25 bp, Homo sapien
cccttggtgcactctcggtgaggct

SEQ ID NO: 54479 - DNA, 25 bp, Homo sapien
agaacacctgagacagctctgagcg

SEQ ID NO: 54480 - DNA, 25 bp, Homo sapien
ggactcccgatctggcggctcagaa

SEQ ID NO: 54481 - DNA, 25 bp, Homo sapien
cccattggccggtttgaacacaaag

SEQ ID NO: 54482 - DNA, 25 bp, Homo sapien
tcagtcaacgctgacaggccgcagc

SEQ ID NO: 54483 - DNA, 25 bp, Homo sapien
gctgtcgagggcttgctcaacaccc

SEQ ID NO: 54484 - DNA, 25 bp, Homo sapien
acctaagggagctttgcgtgcagac

SEQ ID NO: 54485 - DNA, 25 bp, Homo sapien
ccacgcgtggaggtctttctcgcaa

SEQ ID NO: 54486 - DNA, 25 bp, Homo sapien
ggcccggaatgtgacagaggaccta

SEQ ID NO: 54487 - DNA, 25 bp, Homo sapien
ggccagatgcagtcacgtctccgaa

SEQ ID NO: 54488 - DNA, 25 bp, Homo sapien
acacccggtgccctttatcgtatgg

SEQ ID NO: 54489 - DNA, 25 bp, Homo sapien
cgctttggtaatagggcagcctccc

SEQ ID NO: 54490 - DNA, 25 bp, Homo sapien
gcgcgattcgcctggctgcatttta

SEQ ID NO: 54491 - DNA, 25 bp, Homo sapien
tctccgaacccagcctaatgtgaca

SEQ ID NO: 54492 - DNA, 25 bp, Homo sapien
ctccgcgaaaggtcgagggatcaag

SEQ ID NO: 54493 - DNA, 25 bp, Homo sapien
ggaccacgaagctgggcaggccttg

SEQ ID NO: 54494 - DNA, 25 bp, Homo sapien
agccggcagagtcgcgatggcaaac

SEQ ID NO: 54495 - DNA, 25 bp, Homo sapien
gcgatggcaaacctgtcacgacaga

SEQ ID NO: 54496 - DNA, 25 bp, Homo sapien
ctgtcacgacagagctcgcaggtcc

SEQ ID NO: 54497 - DNA, 25 bp, Homo sapien
acagagctcgcaggtcccgaagtgg

SEQ ID NO: 54498 - DNA, 25 bp, Homo sapien
ttactccgcgaaaggtcgagggatc

SEQ ID NO: 54499 - DNA, 25 bp, Homo sapien
gagtcgcgatggcaaacctgtcacg

SEQ ID NO: 54500 - DNA, 25 bp, Homo sapien
cggaggcagagatcttctacaacgc

SEQ ID NO: 54501 - DNA, 25 bp, Homo sapien
tcgtgggctgcttcacgccgcagag

SEQ ID NO: 54502 - DNA, 25 bp, Homo sapien
gtcctaccgcctctacgacgagatg

SEQ ID NO: 54503 - DNA, 25 bp, Homo sapien
gtgcgtcctgcggaacctgtcctac

SEQ ID NO: 54504 - DNA, 25 bp, Homo sapien
accacgccctggacgcgggcaaatg

SEQ ID NO: 54505 - DNA, 25 bp, Homo sapien
tggacgccctggtcacctctatcaa

SEQ ID NO: 54506 - DNA, 25 bp, Homo sapien
agatcttctacaacgccaccggctt

SEQ ID NO: 54507 - DNA, 25 bp, Homo sapien
tctcaggccactcgccagaagatgc

SEQ ID NO: 54508 - DNA, 25 bp, Homo sapien
ccggtgagctcacggatggtgtcct

SEQ ID NO: 54509 - DNA, 25 bp, Homo sapien
ctgggaccttatctcgccgcggtca

SEQ ID NO: 54510 - DNA, 25 bp, Homo sapien
tgcagatgacggcaccgaggaacgc

SEQ ID NO: 54511 - DNA, 25 bp, Homo sapien
cagcagcacggccaggaacttcagc

SEQ ID NO: 54512 - DNA, 25 bp, Homo sapien
cacgctggcgatgatgcagatgacg

SEQ ID NO: 54513 - DNA, 25 bp, Homo sapien
cccgaggcgaccgaagcattgtcgg

SEQ ID NO: 54514 - DNA, 25 bp, Homo sapien
tgagctcacggatggtgtcctggtc

SEQ ID NO: 54515 - DNA, 25 bp, Homo sapien
acggccaggaacttcagcgtgaggc

SEQ ID NO: 54516 - DNA, 25 bp, Homo sapien
aggacgctctcgctgaacttcttgc

SEQ ID NO: 54517 - DNA, 25 bp, Homo sapien
tgctcttgcctataacgcggttccg

SEQ ID NO: 54518 - DNA, 25 bp, Homo sapien
cttcaggttcaggatgatgcggttc

SEQ ID NO: 54519 - DNA, 25 bp, Homo sapien
cgcggcttcaccttgcggttgatga

SEQ ID NO: 54520 - DNA, 25 bp, Homo sapien
cggatgtccttcttgagccggtgca

SEQ ID NO: 54521 - DNA, 25 bp, Homo sapien
cggatctgtgtacgcaggacgctct

SEQ ID NO: 54522 - DNA, 25 bp, Homo sapien
tcggcttgacagagaaatgcacatc

SEQ ID NO: 54523 - DNA, 25 bp, Homo sapien
accgtctccgagaagggcgaaatgg

SEQ ID NO: 54524 - DNA, 25 bp, Homo sapien
atttcaccaggtactcgatgcgtcc

SEQ ID NO: 54525 - DNA, 25 bp, Homo sapien
atgcagttgctgttgccttgccagg

SEQ ID NO: 54526 - DNA, 25 bp, Homo sapien
gcagcagcctgcaaacagttaaata

SEQ ID NO: 54527 - DNA, 25 bp, Homo sapien
gacagctccatcttgctcagcggca

SEQ ID NO: 54528 - DNA, 25 bp, Homo sapien
cgtttgatgatggattcggccgcga

SEQ ID NO: 54529 - DNA, 25 bp, Homo sapien
gctcacctttcggatccgccgtttg

SEQ ID NO: 54530 - DNA, 25 bp, Homo sapien
tcgatgcgtccctgaaaaacagagg

SEQ ID NO: 54531 - DNA, 25 bp, Homo sapien
cccacccattatttatgtattcgtg

SEQ ID NO: 54532 - DNA, 25 bp, Homo sapien
cgctgctagagtcgctgagtcctca

SEQ ID NO: 54533 - DNA, 25 bp, Homo sapien
gggatagatcactggctgcagggca

SEQ ID NO: 54534 - DNA, 25 bp, Homo sapien
ctgctagagtcgctgagtcctcaca

SEQ ID NO: 54535 - DNA, 25 bp, Homo sapien
cagcgggatagatcactggctgcag

SEQ ID NO: 54536 - DNA, 25 bp, Homo sapien
gggcgctgtgagtcgccctggccga

SEQ ID NO: 54537 - DNA, 25 bp, Homo sapien
atgagcagcgggatagatcactggc

SEQ ID NO: 54538 - DNA, 25 bp, Homo sapien
gctagagtcgctgagtcctcacaac

SEQ ID NO: 54539 - DNA, 25 bp, Homo sapien
ggcgctgctagagtcgctgagtcct

SEQ ID NO: 54540 - DNA, 25 bp, Homo sapien
cgccgcggatcgaagggattagacc

SEQ ID NO: 54541 - DNA, 25 bp, Homo sapien
gggcggcaccagcatcttaattgtt

SEQ ID NO: 54542 - DNA, 25 bp, Homo sapien
atcttaattgtttggacccagccgg

SEQ ID NO: 54543 - DNA, 25 bp, Homo sapien
ccgggcagctgggtctgagataaca

SEQ ID NO: 54544 - DNA, 25 bp, Homo sapien
gcgcgcgccgggattaccggcaaac

SEQ ID NO: 54545 - DNA, 25 bp, Homo sapien
gctccgagataaacacggccacgtg

SEQ ID NO: 54546 - DNA, 25 bp, Homo sapien
tctgagataacagggtcgcacttgg

SEQ ID NO: 54547 - DNA, 25 bp, Homo sapien
cacgaccatcggagaccctcgggtg

SEQ ID NO: 54548 - DNA, 25 bp, Homo sapien
gacaacttttgttctactcgcccta

SEQ ID NO: 54549 - DNA, 25 bp, Homo sapien
ttccggatgctctccacggcgaaca

SEQ ID NO: 54550 - DNA, 25 bp, Homo sapien
cctacacggtggcagggaaactgag

SEQ ID NO: 54551 - DNA, 25 bp, Homo sapien
ggcgctgaggatccctacgtccgat

SEQ ID NO: 54552 - DNA, 25 bp, Homo sapien
gtccgatcctaatctccagctcagg

SEQ ID NO: 54553 - DNA, 25 bp, Homo sapien
catcctggagcgacaacttttgttc

SEQ ID NO: 54554 - DNA, 25 bp, Homo sapien
gttctactcgccctacacggtggca

SEQ ID NO: 54555 - DNA, 25 bp, Homo sapien
aatctccagctcaggcaggctcggc

SEQ ID NO: 54556 - DNA, 25 bp, Homo sapien
gtgcccagacgcacgggtcagacgc

SEQ ID NO: 54557 - DNA, 25 bp, Homo sapien
cgtgatccttaatacccaggcgggc

SEQ ID NO: 54558 - DNA, 25 bp, Homo sapien
cccagtggagccgacgacaaagtca

SEQ ID NO: 54559 - DNA, 25 bp, Homo sapien
cgacaaagtcaaggctcagagcggg

SEQ ID NO: 54560 - DNA, 25 bp, Homo sapien
cgcggcgcagtttggccagtgtctc

SEQ ID NO: 54561 - DNA, 25 bp, Homo sapien
ccaaacccgcgtgtactgggcgcta

SEQ ID NO: 54562 - DNA, 25 bp, Homo sapien
tttgtggcacgagacgaactcttga

SEQ ID NO: 54563 - DNA, 25 bp, Homo sapien
agcggggaggccatttgctcacctc

SEQ ID NO: 54564 - DNA, 25 bp, Homo sapien
cgggagatctcgaacacctcggtgc

SEQ ID NO: 54565 - DNA, 25 bp, Homo sapien
cgaacacctcggtgcgcgtcttgca

SEQ ID NO: 54566 - DNA, 25 bp, Homo sapien
atgaggcgccgggagatctcgaaca

SEQ ID NO: 54567 - DNA, 25 bp, Homo sapien
gccacaccaggaagttggcgttggt

SEQ ID NO: 54568 - DNA, 25 bp, Homo sapien
tgcacgttgcggttgttgcagcagc

SEQ ID NO: 54569 - DNA, 25 bp, Homo sapien
ggcactgcacgttgcggttgttgca

SEQ ID NO: 54570 - DNA, 25 bp, Homo sapien
acctggacaggtcgcagctgcacct

SEQ ID NO: 54571 - DNA, 25 bp, Homo sapien
cggagcctacgcacctggacaggtc

SEQ ID NO: 54572 - DNA, 25 bp, Homo sapien
gcgcaagcttgcacctcctgggcaa

SEQ ID NO: 54573 - DNA, 25 bp, Homo sapien
gttggaaagaaagccaccgctgttg

SEQ ID NO: 54574 - DNA, 25 bp, Homo sapien
acaagctgcttccagaccgtgctct

SEQ ID NO: 54575 - DNA, 25 bp, Homo sapien
gagtgcccgaaacctacctgcgtct

SEQ ID NO: 54576 - DNA, 25 bp, Homo sapien
cacaggtacggcaaggcctcaggca

SEQ ID NO: 54577 - DNA, 25 bp, Homo sapien
tgttgccttcccttagagcctgtca

SEQ ID NO: 54578 - DNA, 25 bp, Homo sapien
caagggtccaaagttcactgcaggg

SEQ ID NO: 54579 - DNA, 25 bp, Homo sapien
agcagcgattcatgccgactccggg

SEQ ID NO: 54580 - DNA, 25 bp, Homo sapien
gctcggccttcgatgtcagggacct

SEQ ID NO: 54581 - DNA, 25 bp, Homo sapien
tccagtggtgattggagcaaccgcc

SEQ ID NO: 54582 - DNA, 25 bp, Homo sapien
gtgtctgacggatgacgactccaca

SEQ ID NO: 54583 - DNA, 25 bp, Homo sapien
cgcgcctggagatgtgaggtaattc

SEQ ID NO: 54584 - DNA, 25 bp, Homo sapien
ccagcgagtgaaatctgcggcagcc

SEQ ID NO: 54585 - DNA, 25 bp, Homo sapien
tgaggtaattctccggcaggcctgc

SEQ ID NO: 54586 - DNA, 25 bp, Homo sapien
tacgcatgtgtagcgccgaagcttc

SEQ ID NO: 54587 - DNA, 25 bp, Homo sapien
gaggtcagaccctcacgcacagttc

SEQ ID NO: 54588 - DNA, 25 bp, Homo sapien
ggagcccaaaccacagccttgggga

SEQ ID NO: 54589 - DNA, 25 bp, Homo sapien
gctacatgcaactcaggagctgctg

SEQ ID NO: 54590 - DNA, 25 bp, Homo sapien
cccgcatgagggattccgagagcac

SEQ ID NO: 54591 - DNA, 25 bp, Homo sapien
gtgcaggacccgcatgagggattcc

SEQ ID NO: 54592 - DNA, 25 bp, Homo sapien
caaaccacagccttggggaacccag

SEQ ID NO: 54593 - DNA, 25 bp, Homo sapien
tggcacccgccaaggagtgctgagc

SEQ ID NO: 54594 - DNA, 25 bp, Homo sapien
gggcgctcgtgctacatgcaactca

SEQ ID NO: 54595 - DNA, 25 bp, Homo sapien
cgagaagcaaaggtgtttgcagccc

SEQ ID NO: 54596 - DNA, 25 bp, Homo sapien
tgccacgagcgcggggccagaccaa

SEQ ID NO: 54597 - DNA, 25 bp, Homo sapien
actcagcagcggaggctggacgctt

SEQ ID NO: 54598 - DNA, 25 bp, Homo sapien
tcccgacgtggaactcagcagcgga

SEQ ID NO: 54599 - DNA, 25 bp, Homo sapien
cggagcggaacttcggtcccagctc

SEQ ID NO: 54600 - DNA, 25 bp, Homo sapien
ttcagtggaaaacgaaagctgggcg

SEQ ID NO: 54601 - DNA, 25 bp, Homo sapien
ttcgctttccattcagtggaaaacg

SEQ ID NO: 54602 - DNA, 25 bp, Homo sapien
ggaggccgctgtaagtttcgctttc

SEQ ID NO: 54603 - DNA, 25 bp, Homo sapien
ggccgctgtaagtttcgctttccat

SEQ ID NO: 54604 - DNA, 25 bp, Homo sapien
gggcacattcctgccggggagccac

SEQ ID NO: 54605 - DNA, 25 bp, Homo sapien
agcccaccacaggggagccgtgtgc

SEQ ID NO: 54606 - DNA, 25 bp, Homo sapien
gacgggcacattcccgggcacattc

SEQ ID NO: 54607 - DNA, 25 bp, Homo sapien
tgtgcattcccagacgggcacattc

SEQ ID NO: 54608 - DNA, 25 bp, Homo sapien
agccgtgtgcattcccagacgggca

SEQ ID NO: 54609 - DNA, 25 bp, Homo sapien
tctgcccagacactttgagctgccg

SEQ ID NO: 54610 - DNA, 25 bp, Homo sapien
cggggagccactctgccacccgcac

SEQ ID NO: 54611 - DNA, 25 bp, Homo sapien
acacagtgcccattgtctgcccaga

SEQ ID NO: 54612 - DNA, 25 bp, Homo sapien
gggcacgtaccgagcgccatttcca

SEQ ID NO: 54613 - DNA, 25 bp, Homo sapien
gggtgagccacaaatctacggcgtc

SEQ ID NO: 54614 - DNA, 25 bp, Homo sapien
cggtgacaatgaaacggccgccatt

SEQ ID NO: 54615 - DNA, 25 bp, Homo sapien
tcggccttacgggtccgctatataa

SEQ ID NO: 54616 - DNA, 25 bp, Homo sapien
acgtcagcttcggagacagaaatta

SEQ ID NO: 54617 - DNA, 25 bp, Homo sapien
attacacactctacggcgaggggtc

SEQ ID NO: 54618 - DNA, 25 bp, Homo sapien
cgtccggcagcagccaaatttgata

SEQ ID NO: 54619 - DNA, 25 bp, Homo sapien
tccgctcctagctttcgttcagaag

SEQ ID NO: 54620 - DNA, 25 bp, Homo sapien
taaggacggactggccgacggctct

SEQ ID NO: 54621 - DNA, 25 bp, Homo sapien
gcatgccgcgcctgcgatggacgtt

SEQ ID NO: 54622 - DNA, 25 bp, Homo sapien
ttcgtattgcctagcccggcccgtg

SEQ ID NO: 54623 - DNA, 25 bp, Homo sapien
tccaggccgcggctatgccgcgaaa

SEQ ID NO: 54624 - DNA, 25 bp, Homo sapien
cgattgctgtgacctccaggccgcg

SEQ ID NO: 54625 - DNA, 25 bp, Homo sapien
tatgccgcgaaaggctcggattgtg

SEQ ID NO: 54626 - DNA, 25 bp, Homo sapien
atccctggtgctcgcgggagacgcc

SEQ ID NO: 54627 - DNA, 25 bp, Homo sapien
atcctgcgcgtcgtgtcttgggtaa

SEQ ID NO: 54628 - DNA, 25 bp, Homo sapien
atcagcagcgtcaaggaccgcaaga

SEQ ID NO: 54629 - DNA, 25 bp, Homo sapien
gtacttcccgcagatcagcagcgtc

SEQ ID NO: 54630 - DNA, 25 bp, Homo sapien
cctggacgtgtacttcccgcagatc

SEQ ID NO: 54631 - DNA, 25 bp, Homo sapien
gaggagttctgcatctacaaccgca

SEQ ID NO: 54632 - DNA, 25 bp, Homo sapien
tgaacgagggctacctcaacagcgc

SEQ ID NO: 54633 - DNA, 25 bp, Homo sapien
cggctccatcgtgaacgagggctac

SEQ ID NO: 54634 - DNA, 25 bp, Homo sapien
gaccgcaagaaagccgtcctgtccg

SEQ ID NO: 54635 - DNA, 25 bp, Homo sapien
cgtcctgtccgacatcggtgtctcg

SEQ ID NO: 54636 - DNA, 25 bp, Homo sapien
tgtccttgtcctcgccggcctttgt

SEQ ID NO: 54637 - DNA, 25 bp, Homo sapien
tatgggcggcacctaccagcagccg

SEQ ID NO: 54638 - DNA, 25 bp, Homo sapien
atcccgccggtatgggcggcaccta

SEQ ID NO: 54639 - DNA, 25 bp, Homo sapien
tacgtggagcccactgggccggatc

SEQ ID NO: 54640 - DNA, 25 bp, Homo sapien
cagcatgccttacgcgccctacgtg

SEQ ID NO: 54641 - DNA, 25 bp, Homo sapien
agcggtaccagattggcgccgactc

SEQ ID NO: 54642 - DNA, 25 bp, Homo sapien
ggccttccagcggtaccagattggc

SEQ ID NO: 54643 - DNA, 25 bp, Homo sapien
cagcagccggccaacaccttcgaca

SEQ ID NO: 54644 - DNA, 25 bp, Homo sapien
tccgttccaggacacccaggttctg

SEQ ID NO: 54645 - DNA, 25 bp, Homo sapien
cctgtcggatgctgaagaacgaatc

SEQ ID NO: 54646 - DNA, 25 bp, Homo sapien
gcggttcaggtgttcgctccactct

SEQ ID NO: 54647 - DNA, 25 bp, Homo sapien
tgtccacttcccgtcttcgtcgttg

SEQ ID NO: 54648 - DNA, 25 bp, Homo sapien
agtcgctgtcatcccttagtggcca

SEQ ID NO: 54649 - DNA, 25 bp, Homo sapien
gagctaccctgaaggccgaccctga

SEQ ID NO: 54650 - DNA, 25 bp, Homo sapien
ccgtggagtatgtcagcctttcaga

SEQ ID NO: 54651 - DNA, 25 bp, Homo sapien
gtgaaacgtcactgtggtccgcaga

SEQ ID NO: 54652 - DNA, 25 bp, Homo sapien
tatccgagtctcgagcccactgcga

SEQ ID NO: 54653 - DNA, 25 bp, Homo sapien
agtttggacagccaccctctccgtg

SEQ ID NO: 54654 - DNA, 25 bp, Homo sapien
ggctccttctccgagtttggacagc

SEQ ID NO: 54655 - DNA, 25 bp, Homo sapien
tcgggtgcaggaacggctccttctc

SEQ ID NO: 54656 - DNA, 25 bp, Homo sapien
aacaggcccgctctctgggcttggg

SEQ ID NO: 54657 - DNA, 25 bp, Homo sapien
tcccgcaggggttcctccaagatgg

SEQ ID NO: 54658 - DNA, 25 bp, Homo sapien
cccatccctcttcgggcgtggggtg

SEQ ID NO: 54659 - DNA, 25 bp, Homo sapien
accctctccgtggtggggtgtgtca

SEQ ID NO: 54660 - DNA, 25 bp, Homo sapien
cacagatgcctatgcgaaatcccgg

SEQ ID NO: 54661 - DNA, 25 bp, Homo sapien
ctgctgcgtacccacaatgccttgt

SEQ ID NO: 54662 - DNA, 25 bp, Homo sapien
cgcaacacggatctgcacgtccatg

SEQ ID NO: 54663 - DNA, 25 bp, Homo sapien
cagactctgcagacaccgtaacagg

SEQ ID NO: 54664 - DNA, 25 bp, Homo sapien
acacaggccggtgtacagcggtcac

SEQ ID NO: 54665 - DNA, 25 bp, Homo sapien
ccctgagaggaatggcctagagcaa

SEQ ID NO: 54666 - DNA, 25 bp, Homo sapien
aggcctctgcacatggtcacagatg

SEQ ID NO: 54667 - DNA, 25 bp, Homo sapien
atccctgcaccttcgacgatggcgg

SEQ ID NO: 54668 - DNA, 25 bp, Homo sapien
tcgagccgtgctttgtgcgcggcac

SEQ ID NO: 54669 - DNA, 25 bp, Homo sapien
gcagccgaggcccaagcgcagtcgg

SEQ ID NO: 54670 - DNA, 25 bp, Homo sapien
gagccgtgctttgtgcgcggcaccc

SEQ ID NO: 54671 - DNA, 25 bp, Homo sapien
ctcgagccgtgctttgtgcgcggca

SEQ ID NO: 54672 - DNA, 25 bp, Homo sapien
ggagggcagagcctcagcgcccgac

SEQ ID NO: 54673 - DNA, 25 bp, Homo sapien
atgggtgagttgaccccggcgtcct

SEQ ID NO: 54674 - DNA, 25 bp, Homo sapien
cactccccgagcgtgaccttagggg

SEQ ID NO: 54675 - DNA, 25 bp, Homo sapien
aggctgcggcggacgccagcatctc

SEQ ID NO: 54676 - DNA, 25 bp, Homo sapien
tgtttttcacctgggacccgcagct

SEQ ID NO: 54677 - DNA, 25 bp, Homo sapien
aacaaggtcgggtcctgtcctcagc

SEQ ID NO: 54678 - DNA, 25 bp, Homo sapien
ctggggcggtttcccgcagcaccat

SEQ ID NO: 54679 - DNA, 25 bp, Homo sapien
aggagcctgctctgcgcacggcctg

SEQ ID NO: 54680 - DNA, 25 bp, Homo sapien
agcgccctggcctccacttgctcag

SEQ ID NO: 54681 - DNA, 25 bp, Homo sapien
cggccctctctgtggaacaaggtcg

SEQ ID NO: 54682 - DNA, 25 bp, Homo sapien
tctctgtggaacaaggtcgggtcct

SEQ ID NO: 54683 - DNA, 25 bp, Homo sapien
tggtgtttttcacctgggacccgca

SEQ ID NO: 54684 - DNA, 25 bp, Homo sapien
acgcccgagggcatctacttcaagc

SEQ ID NO: 54685 - DNA, 25 bp, Homo sapien
tgcgcaagtcgctctacggcttctt

SEQ ID NO: 54686 - DNA, 25 bp, Homo sapien
tgacggcgtccttttcctcaagctc

SEQ ID NO: 54687 - DNA, 25 bp, Homo sapien
ggcccgacgacgtcttcatcattga

SEQ ID NO: 54688 - DNA, 25 bp, Homo sapien
cttcgagtacatccgccacaaggtg

SEQ ID NO: 54689 - DNA, 25 bp, Homo sapien
gacctgaactacatccgcggcctga

SEQ ID NO: 54690 - DNA, 25 bp, Homo sapien
ttccgggagatgctgaccaatggca

SEQ ID NO: 54691 - DNA, 25 bp, Homo sapien
tgcgagtccaacttcacggcttatg

SEQ ID NO: 54692 - DNA, 25 bp, Homo sapien
ttcgcagctccgtgcgcaaggtcgt

SEQ ID NO: 54693 - DNA, 25 bp, Homo sapien
cttgtagttacagccctcgccgtga

SEQ ID NO: 54694 - DNA, 25 bp, Homo sapien
gtcgcccagcgaccttgtagttaca

SEQ ID NO: 54695 - DNA, 25 bp, Homo sapien
cccggagtcaggataccagcatgca

SEQ ID NO: 54696 - DNA, 25 bp, Homo sapien
cccgagagagagcttggagaagacc

SEQ ID NO: 54697 - DNA, 25 bp, Homo sapien
gcttggagaagaccggaagtccctc

SEQ ID NO: 54698 - DNA, 25 bp, Homo sapien
aggccagtcccttggtgaggtcaca

SEQ ID NO: 54699 - DNA, 25 bp, Homo sapien
cccacggttggtgaagtgcagactg

SEQ ID NO: 54700 - DNA, 25 bp, Homo sapien
tttctcgtcacagctacgccctggg

SEQ ID NO: 54701 - DNA, 25 bp, Homo sapien
ctacgccctgggcataaacggttgg

SEQ ID NO: 54702 - DNA, 25 bp, Homo sapien
ctagggccctgagccaataagagct

SEQ ID NO: 54703 - DNA, 25 bp, Homo sapien
tctctcctttcgtgaggccataaga

SEQ ID NO: 54704 - DNA, 25 bp, Homo sapien
cggcgaaggaaagaacggactctga

SEQ ID NO: 54705 - DNA, 25 bp, Homo sapien
gcgtcctcggccttcacaataaaaa

SEQ ID NO: 54706 - DNA, 25 bp, Homo sapien
tgggccaatcaccttgacgcgcgct

SEQ ID NO: 54707 - DNA, 25 bp, Homo sapien
atatatgattcaccgggcctgggcc

SEQ ID NO: 54708 - DNA, 25 bp, Homo sapien
gcccggcctggattgttttccatcc

SEQ ID NO: 54709 - DNA, 25 bp, Homo sapien
gttggccaatcctctcgggtctcgt

SEQ ID NO: 54710 - DNA, 25 bp, Homo sapien
agcaccggaggcagcactttcagcc

SEQ ID NO: 54711 - DNA, 25 bp, Homo sapien
ccgaacttacccagtgccgacttgg

SEQ ID NO: 54712 - DNA, 25 bp, Homo sapien
ctgggcctgaattgccttcgtcttc

SEQ ID NO: 54713 - DNA, 25 bp, Homo sapien
gtgcccatctttcttaggacgcatg

SEQ ID NO: 54714 - DNA, 25 bp, Homo sapien
acgcatgcgttaggggtttacactt

SEQ ID NO: 54715 - DNA, 25 bp, Homo sapien
cttgggcacctttcccttggccgag

SEQ ID NO: 54716 - DNA, 25 bp, Homo sapien
gtccggacgtccttctgcctcggct

SEQ ID NO: 54717 - DNA, 25 bp, Homo sapien
tttctgccaacgtgccaggtggacc

SEQ ID NO: 54718 - DNA, 25 bp, Homo sapien
agcctcccgcggagttatcagcaca

SEQ ID NO: 54719 - DNA, 25 bp, Homo sapien
gcggagttatcagcacatccgcggg

SEQ ID NO: 54720 - DNA, 25 bp, Homo sapien
cgcatttctgccaataggtggcgcc

SEQ ID NO: 54721 - DNA, 25 bp, Homo sapien
ctgccaataggtggcgccgcaggac

SEQ ID NO: 54722 - DNA, 25 bp, Homo sapien
ttctcacgcggcgagactccaaggc

SEQ ID NO: 54723 - DNA, 25 bp, Homo sapien
tggaggagttttctgccaacgtgcc

SEQ ID NO: 54724 - DNA, 25 bp, Homo sapien
tctcggtgccaatactgaagccagc

SEQ ID NO: 54725 - DNA, 25 bp, Homo sapien
agccagcgctgcagaaatttattca

SEQ ID NO: 54726 - DNA, 25 bp, Homo sapien
ttattcaacaagtcaggctgccggc

SEQ ID NO: 54727 - DNA, 25 bp, Homo sapien
ccgggccacgtccatgccaaggtag

SEQ ID NO: 54728 - DNA, 25 bp, Homo sapien
actttgaccggtcctctctccaagg

SEQ ID NO: 54729 - DNA, 25 bp, Homo sapien
tctccaaggccacgaaagttctctc

SEQ ID NO: 54730 - DNA, 25 bp, Homo sapien
tctctcttcactggggcatttattt

SEQ ID NO: 54731 - DNA, 25 bp, Homo sapien
tcgatgccagtttcttggcgcgttg

SEQ ID NO: 54732 - DNA, 25 bp, Homo sapien
agcaacgggagcaccggctgatgct

SEQ ID NO: 54733 - DNA, 25 bp, Homo sapien
gctacgccgagcctggcgactgcta

SEQ ID NO: 54734 - DNA, 25 bp, Homo sapien
gcgactgctacgaggagatcttcca

SEQ ID NO: 54735 - DNA, 25 bp, Homo sapien
gagatcttccagtatgtctgccaca

SEQ ID NO: 54736 - DNA, 25 bp, Homo sapien
atgtctgccacatcctgcgcaaggc

SEQ ID NO: 54737 - DNA, 25 bp, Homo sapien
actaccgtaagtggccctgcatccg

SEQ ID NO: 54738 - DNA, 25 bp, Homo sapien
ttgtcatagcgacccagttctcgga

SEQ ID NO: 54739 - DNA, 25 bp, Homo sapien
ttctcggagaccaagcaacgggagc

SEQ ID NO: 54740 - DNA, 25 bp, Homo sapien
cgcgagccaagctgcgcggcatcgt

SEQ ID NO: 54741 - DNA, 25 bp, Homo sapien
gcaccacgagcaggccagtgcagcg

SEQ ID NO: 54742 - DNA, 25 bp, Homo sapien
agcatgggcatcgagcaccacgagc

SEQ ID NO: 54743 - DNA, 25 bp, Homo sapien
atcctggtcaacaccgtcagcatgg

SEQ ID NO: 54744 - DNA, 25 bp, Homo sapien
tgcccttgctgccagcatgaggacg

SEQ ID NO: 54745 - DNA, 25 bp, Homo sapien
cagctgcccttgctgccagcatgag

SEQ ID NO: 54746 - DNA, 25 bp, Homo sapien
gccacgctggcttccgatcccgcca

SEQ ID NO: 54747 - DNA, 25 bp, Homo sapien
acaccgtcagcatgggcatcgagca

SEQ ID NO: 54748 - DNA, 25 bp, Homo sapien
tataagcccgactggtgcgaggtcc

SEQ ID NO: 54749 - DNA, 25 bp, Homo sapien
ctcgacaacagggactcggtggacc

SEQ ID NO: 54750 - DNA, 25 bp, Homo sapien
gatgcccagcatcgccaaagacgtc

SEQ ID NO: 54751 - DNA, 25 bp, Homo sapien
tcttcaccaagatgggcgaccgcgg

SEQ ID NO: 54752 - DNA, 25 bp, Homo sapien
tggggccagaactgcccacacctga

SEQ ID NO: 54753 - DNA, 25 bp, Homo sapien
gtccgcaagatgatcgacgtctata

SEQ ID NO: 54754 - DNA, 25 bp, Homo sapien
agcatgagtccctgctctctgcgga

SEQ ID NO: 54755 - DNA, 25 bp, Homo sapien
gaacgggaactccttccagtccagc

SEQ ID NO: 54756 - DNA, 25 bp, Homo sapien
ggcctcatcttctcctcgtactttg

SEQ ID NO: 54757 - DNA, 25 bp, Homo sapien
cccagtgatcgctgggactcgctgc

SEQ ID NO: 54758 - DNA, 25 bp, Homo sapien
agctgataaccaccctgtacatcgg

SEQ ID NO: 54759 - DNA, 25 bp, Homo sapien
ttttctggcctaggagctgataacc

SEQ ID NO: 54760 - DNA, 25 bp, Homo sapien
cgacactgtgtgttttctggcctag

SEQ ID NO: 54761 - DNA, 25 bp, Homo sapien
actcgctgccttaggcgtctgcaca

SEQ ID NO: 54762 - DNA, 25 bp, Homo sapien
cgtactttgtgtacctggctgagaa

SEQ ID NO: 54763 - DNA, 25 bp, Homo sapien
tggagttcggcagctacgcagatgc

SEQ ID NO: 54764 - DNA, 25 bp, Homo sapien
ggcgtacctacgcagcagctggaac

SEQ ID NO: 54765 - DNA, 25 bp, Homo sapien
taccgagaagccacgggtcgaattg

SEQ ID NO: 54766 - DNA, 25 bp, Homo sapien
cccaggtagtctcgctgggcctgta

SEQ ID NO: 54767 - DNA, 25 bp, Homo sapien
tgtacttcggcgagcaggcgtacct

SEQ ID NO: 54768 - DNA, 25 bp, Homo sapien
ctggaacgtgctggatggctttctt

SEQ ID NO: 54769 - DNA, 25 bp, Homo sapien
ggctttcttgtcttcgtgtccatca

SEQ ID NO: 54770 - DNA, 25 bp, Homo sapien
catcatcgacatcgtggtgtccctg

SEQ ID NO: 54771 - DNA, 25 bp, Homo sapien
agtgtcatgcactgtaccgagaagc

SEQ ID NO: 54772 - DNA, 25 bp, Homo sapien
gctgcctgagcagcctgcagtttgt

SEQ ID NO: 54773 - DNA, 25 bp, Homo sapien
agcctgcagtttgtgtcgccgctgt

SEQ ID NO: 54774 - DNA, 25 bp, Homo sapien
gtcgccgctgtacttcgtgagcttc

SEQ ID NO: 54775 - DNA, 25 bp, Homo sapien
tgagcttcgtgctcaccgcgcagtt

SEQ ID NO: 54776 - DNA, 25 bp, Homo sapien
accgcgcagttcgtgctcatcaacg

SEQ ID NO: 54777 - DNA, 25 bp, Homo sapien
cagttcgtgctcatcaacgtggtgg

SEQ ID NO: 54778 - DNA, 25 bp, Homo sapien
acgacagcaacaaggaggcgcagga

SEQ ID NO: 54779 - DNA, 25 bp, Homo sapien
gggactgcacccacgacgagcgcag

SEQ ID NO: 54780 - DNA, 25 bp, Homo sapien
ccaccgggagcgacacgtcgctgga

SEQ ID NO: 54781 - DNA, 25 bp, Homo sapien
acgcccgccaggaagttcagcagca

SEQ ID NO: 54782 - DNA, 25 bp, Homo sapien
ggctgcacccaccacgactccatgg

SEQ ID NO: 54783 - DNA, 25 bp, Homo sapien
agaccacgctcgaggacagcctgac

SEQ ID NO: 54784 - DNA, 25 bp, Homo sapien
agctccttggatggggtctgcctgc

SEQ ID NO: 54785 - DNA, 25 bp, Homo sapien
tgctccgaagggagctccttggatg

SEQ ID NO: 54786 - DNA, 25 bp, Homo sapien
tttgaggcggatgctagctcctctc

SEQ ID NO: 54787 - DNA, 25 bp, Homo sapien
aggacagcctgaccctgagcgacag

SEQ ID NO: 54788 - DNA, 25 bp, Homo sapien
ggccactgggccagaacacgtgctc

SEQ ID NO: 54789 - DNA, 25 bp, Homo sapien
caggcctaccgcgagcggctcaagg

SEQ ID NO: 54790 - DNA, 25 bp, Homo sapien
ccttctactactgcgagcggcggcg

SEQ ID NO: 54791 - DNA, 25 bp, Homo sapien
cgcacgtgaacgagaaggtgaccga

SEQ ID NO: 54792 - DNA, 25 bp, Homo sapien
cccagctgaactgcctggacgaggc

SEQ ID NO: 54793 - DNA, 25 bp, Homo sapien
aatgaactcgtacccgcgacgcggc

SEQ ID NO: 54794 - DNA, 25 bp, Homo sapien
gacggacactggtttctaccgcggc

SEQ ID NO: 54795 - DNA, 25 bp, Homo sapien
tccacgtgcgcggaaaatgaactcg

SEQ ID NO: 54796 - DNA, 25 bp, Homo sapien
tagagccctttgacacggagttccg

SEQ ID NO: 54797 - DNA, 25 bp, Homo sapien
ctccactgtggctcgaaagcttatc

SEQ ID NO: 54798 - DNA, 25 bp, Homo sapien
aagtacgccttggtgtcaggctgcc

SEQ ID NO: 54799 - DNA, 25 bp, Homo sapien
gagagcttcctgaaagacctggtta

SEQ ID NO: 54800 - DNA, 25 bp, Homo sapien
caggatggtctctcacatgcacaga

SEQ ID NO: 54801 - DNA, 25 bp, Homo sapien
agacctgaagcccaaatcccgagag

SEQ ID NO: 54802 - DNA, 25 bp, Homo sapien
tcttcagtcgccgagccaagaggcc

SEQ ID NO: 54803 - DNA, 25 bp, Homo sapien
agctgtacgccatctccgaggaggt

SEQ ID NO: 54804 - DNA, 25 bp, Homo sapien
gtccggtgcccttcagttccagact

SEQ ID NO: 54805 - DNA, 25 bp, Homo sapien
cacgctgtagtggttaaagacgtcc

SEQ ID NO: 54806 - DNA, 25 bp, Homo sapien
gctgtagaggctggacatccgatcc

SEQ ID NO: 54807 - DNA, 25 bp, Homo sapien
cagactaccggtttattcggctgta

SEQ ID NO: 54808 - DNA, 25 bp, Homo sapien
gctcagactctggacaaggaaacga

SEQ ID NO: 54809 - DNA, 25 bp, Homo sapien
cgacgtcgcctccatagtctgcgga

SEQ ID NO: 54810 - DNA, 25 bp, Homo sapien
ctgcgtgacaaggtgaatgcgttcc

SEQ ID NO: 54811 - DNA, 25 bp, Homo sapien
gcacggagagtgtttttacaccttc

SEQ ID NO: 54812 - DNA, 25 bp, Homo sapien
gagaccgcgtgaaggaagtcccgcc

SEQ ID NO: 54813 - DNA, 25 bp, Homo sapien
gttgcctcacgtgttctcagtccga

SEQ ID NO: 54814 - DNA, 25 bp, Homo sapien
tgcttcgtgtttagcgacaggtata

SEQ ID NO: 54815 - DNA, 25 bp, Homo sapien
gcgatcatggttcgcccgacagcta

SEQ ID NO: 54816 - DNA, 25 bp, Homo sapien
ttctcagtccgagagggttcgagac

SEQ ID NO: 54817 - DNA, 25 bp, Homo sapien
ccggctattttcagctgggtgttcc

SEQ ID NO: 54818 - DNA, 25 bp, Homo sapien
tcccgctatgccagcccggagatgt

SEQ ID NO: 54819 - DNA, 25 bp, Homo sapien
tataaattccggacatggcggcagc

SEQ ID NO: 54820 - DNA, 25 bp, Homo sapien
gccacctcaggtgttcggggcgcca

SEQ ID NO: 54821 - DNA, 25 bp, Homo sapien
accttgctcgcgtcgccgttggaat

SEQ ID NO: 54822 - DNA, 25 bp, Homo sapien
ccgaaggcgcccacgagagaagcac

SEQ ID NO: 54823 - DNA, 25 bp, Homo sapien
tcggactgtccgaccgagggtcgta

SEQ ID NO: 54824 - DNA, 25 bp, Homo sapien
agctgctaacccgacccggattggc

SEQ ID NO: 54825 - DNA, 25 bp, Homo sapien
tagtgggcgggaacgactacagccc

SEQ ID NO: 54826 - DNA, 25 bp, Homo sapien
atcatcgctatgcatgctggccttg

SEQ ID NO: 54827 - DNA, 25 bp, Homo sapien
cggtgcagacgaagaaatcatcgct

SEQ ID NO: 54828 - DNA, 25 bp, Homo sapien
gggtggagttttcatcgcccgtgct

SEQ ID NO: 54829 - DNA, 25 bp, Homo sapien
tttcatcgcccgtgctgagcagtga

SEQ ID NO: 54830 - DNA, 25 bp, Homo sapien
cgtcagcgcctcgatctgcttgtct

SEQ ID NO: 54831 - DNA, 25 bp, Homo sapien
cctcgatctgcttgtctttctcctg

SEQ ID NO: 54832 - DNA, 25 bp, Homo sapien
tctcctgcagcatctggtccttgtc

SEQ ID NO: 54833 - DNA, 25 bp, Homo sapien
ccttcacgaggatctgcagtggcga

SEQ ID NO: 54834 - DNA, 25 bp, Homo sapien
tcagctgcgtcagaggtgatgtcac

SEQ ID NO: 54835 - DNA, 25 bp, Homo sapien
tgatgtcaccatctcaccaaaggtg

SEQ ID NO: 54836 - DNA, 25 bp, Homo sapien
acctgtgcaaacatccgcccgctgg

SEQ ID NO: 54837 - DNA, 25 bp, Homo sapien
cagcccgagcctcggccatcgcgcg

SEQ ID NO: 54838 - DNA, 25 bp, Homo sapien
tgcagcccgagcctcggccatcgcg

SEQ ID NO: 54839 - DNA, 25 bp, Homo sapien
tgtgcccggcttggcatcagtgccc

SEQ ID NO: 54840 - DNA, 25 bp, Homo sapien
tttgtgcccggcttggcatcagtgc

SEQ ID NO: 54841 - DNA, 25 bp, Homo sapien
ctgtgcaaacatccgcccgctggcc

SEQ ID NO: 54842 - DNA, 25 bp, Homo sapien
tcccacacctgtgcaaacatccgcc

SEQ ID NO: 54843 - DNA, 25 bp, Homo sapien
ctttgtgcccggcttggcatcagtg

SEQ ID NO: 54844 - DNA, 25 bp, Homo sapien
atgcccaggcgcgagtaattactgc

SEQ ID NO: 54845 - DNA, 25 bp, Homo sapien
tggggctccgaagtcgatcatttca

SEQ ID NO: 54846 - DNA, 25 bp, Homo sapien
cctgccggatcttgcgaagttgcca

SEQ ID NO: 54847 - DNA, 25 bp, Homo sapien
cagccctgtggtcaccctgtgaagg

SEQ ID NO: 54848 - DNA, 25 bp, Homo sapien
ctcatctctgaggaaagtctggaac

SEQ ID NO: 54849 - DNA, 25 bp, Homo sapien
cggcctgacttcctgtgactgacgg

SEQ ID NO: 54850 - DNA, 25 bp, Homo sapien
cggcgctagccaatcagaggcctga

SEQ ID NO: 54851 - DNA, 25 bp, Homo sapien
cctgaagactgtccgctggagaagt

SEQ ID NO: 54852 - DNA, 25 bp, Homo sapien
atgcttcgtaatgcagtctgctcga

SEQ ID NO: 54853 - DNA, 25 bp, Homo sapien
ccataccacttggtcccggcaggag

SEQ ID NO: 54854 - DNA, 25 bp, Homo sapien
caggagtatgacagatgcttcgtaa

SEQ ID NO: 54855 - DNA, 25 bp, Homo sapien
ccggtccctgcgtcctacagagaca

SEQ ID NO: 54856 - DNA, 25 bp, Homo sapien
tacagagacaccgtccacgcggtgc

SEQ ID NO: 54857 - DNA, 25 bp, Homo sapien
caccaggggcccgacgatgccgatg

SEQ ID NO: 54858 - DNA, 25 bp, Homo sapien
gggcccgacgatgccgatgacacgc

SEQ ID NO: 54859 - DNA, 25 bp, Homo sapien
cccggcaggagtatgacagatgctt

SEQ ID NO: 54860 - DNA, 25 bp, Homo sapien
gaagccattggtgcggctcctcgaa

SEQ ID NO: 54861 - DNA, 25 bp, Homo sapien
tcgtaggacagcacggaagccattg

SEQ ID NO: 54862 - DNA, 25 bp, Homo sapien
tgccgcagccagtggagttaggaaa

SEQ ID NO: 54863 - DNA, 25 bp, Homo sapien
gttaggaaaggagcaccggagctca

SEQ ID NO: 54864 - DNA, 25 bp, Homo sapien
agctcagggtgtgagagtcgcaatc

SEQ ID NO: 54865 - DNA, 25 bp, Homo sapien
cgcaaggcggcctgacaccaggtac

SEQ ID NO: 54866 - DNA, 25 bp, Homo sapien
cgtggaccaggctttcgtaggacag

SEQ ID NO: 54867 - DNA, 25 bp, Homo sapien
ccgagaagccttataacccgttgcg

SEQ ID NO: 54868 - DNA, 25 bp, Homo sapien
atttcctcggtgtgcagaacgctcg

SEQ ID NO: 54869 - DNA, 25 bp, Homo sapien
cgctcggatcctgcttacacatttt

SEQ ID NO: 54870 - DNA, 25 bp, Homo sapien
aggcccgaagctcgttcactttgcg

SEQ ID NO: 54871 - DNA, 25 bp, Homo sapien
ggctgccgcaagacagaacagacta

SEQ ID NO: 54872 - DNA, 25 bp, Homo sapien
tgcgcgctccctagaatcttctaga

SEQ ID NO: 54873 - DNA, 25 bp, Homo sapien
ggggcgacgtccaagagcatattgt

SEQ ID NO: 54874 - DNA, 25 bp, Homo sapien
cccgacgcgtgagttaggccgtaat

SEQ ID NO: 54875 - DNA, 25 bp, Homo sapien
tgtactacccaaggctcgcgatctt

SEQ ID NO: 54876 - DNA, 25 bp, Homo sapien
gcgcggagtaaagggtttcatttca

SEQ ID NO: 54877 - DNA, 25 bp, Homo sapien
aagtgttggtttcgctgtgaggcta

SEQ ID NO: 54878 - DNA, 25 bp, Homo sapien
gtttccacccggctagctcacgtag

SEQ ID NO: 54879 - DNA, 25 bp, Homo sapien
cgacagaccgtgtgtttccaaaatg

SEQ ID NO: 54880 - DNA, 25 bp, Homo sapien
gaaaaaggttgggtctcgccagcgc

SEQ ID NO: 54881 - DNA, 25 bp, Homo sapien
accagcgaggactcttgggtttcgg

SEQ ID NO: 54882 - DNA, 25 bp, Homo sapien
aatccctgagcagttcccgaacaga

SEQ ID NO: 54883 - DNA, 25 bp, Homo sapien
tcttagagttgatcggcgtgacggc

SEQ ID NO: 54884 - DNA, 25 bp, Homo sapien
ctgggagcgcaagcattgttaccta

SEQ ID NO: 54885 - DNA, 25 bp, Homo sapien
agcgcctccgaagaagcactcggtg

SEQ ID NO: 54886 - DNA, 25 bp, Homo sapien
actgagtctggaggtcgaccctgaa

SEQ ID NO: 54887 - DNA, 25 bp, Homo sapien
ttatggcctaaactcgagatctccc

SEQ ID NO: 54888 - DNA, 25 bp, Homo sapien
cgggctcttctctttctgatctttt

SEQ ID NO: 54889 - DNA, 25 bp, Homo sapien
caaatccaagtggtctgcgttcacc

SEQ ID NO: 54890 - DNA, 25 bp, Homo sapien
tttctcccgactccaagggcgtctg

SEQ ID NO: 54891 - DNA, 25 bp, Homo sapien
gtcgcgtcggttttgaaatcagata

SEQ ID NO: 54892 - DNA, 25 bp, Homo sapien
cgggttctaggcttaggcgcagacg

SEQ ID NO: 54893 - DNA, 25 bp, Homo sapien
gggttctaggcttaggcgcagacgg

SEQ ID NO: 54894 - DNA, 25 bp, Homo sapien
ggttctaggcttaggcgcagacggg

SEQ ID NO: 54895 - DNA, 25 bp, Homo sapien
gttctaggcttaggcgcagacgggt

SEQ ID NO: 54896 - DNA, 25 bp, Homo sapien
ttctaggcttaggcgcagacgggtt

SEQ ID NO: 54897 - DNA, 25 bp, Homo sapien
tctaggcttaggcgcagacgggtta

SEQ ID NO: 54898 - DNA, 25 bp, Homo sapien
acgggttaggggagccaacatgcca

SEQ ID NO: 54899 - DNA, 25 bp, Homo sapien
taggcttaggcgcagacgggttagg

SEQ ID NO: 54900 - DNA, 25 bp, Homo sapien
caacatgccagtggcccggagctgg

SEQ ID NO: 54901 - DNA, 25 bp, Homo sapien
atctcgtctcgaccaagagctgaag

SEQ ID NO: 54902 - DNA, 25 bp, Homo sapien
aaatctcgtctcgaccaagagctga

SEQ ID NO: 54903 - DNA, 25 bp, Homo sapien
ggccgcccgggaactgctgacgctt

SEQ ID NO: 54904 - DNA, 25 bp, Homo sapien
gagaaatctcgtctcgaccaagagc

SEQ ID NO: 54905 - DNA, 25 bp, Homo sapien
cgcccgggaactgctgacgcttgat

SEQ ID NO: 54906 - DNA, 25 bp, Homo sapien
agccaacatgccagtggcccggagc

SEQ ID NO: 54907 - DNA, 25 bp, Homo sapien
gaaatctcgtctcgaccaagagctg

SEQ ID NO: 54908 - DNA, 25 bp, Homo sapien
gtagcagcggccgtatttatttatt

SEQ ID NO: 54909 - DNA, 25 bp, Homo sapien
cgccgctaccgctagcctgtaagga

SEQ ID NO: 54910 - DNA, 25 bp, Homo sapien
tagcctgtaaggaggattcggcaga

SEQ ID NO: 54911 - DNA, 25 bp, Homo sapien
ttcggcagagggaagaaacaacagc

SEQ ID NO: 54912 - DNA, 25 bp, Homo sapien
gccatcttgtttgtgtgctaggctg

SEQ ID NO: 54913 - DNA, 25 bp, Homo sapien
gtgagtgtctcttgtcgcctcctcc

SEQ ID NO: 54914 - DNA, 25 bp, Homo sapien
tcgggcgagttctctgcggccatta

SEQ ID NO: 54915 - DNA, 25 bp, Homo sapien
ctgagtgctaactgcgggagccaga

SEQ ID NO: 54916 - DNA, 25 bp, Homo sapien
tcacctcagtgcgactgagacaaag

SEQ ID NO: 54917 - DNA, 25 bp, Homo sapien
ggcggccgagtgcttaataatggca

SEQ ID NO: 54918 - DNA, 25 bp, Homo sapien
ctctctctgagctgggcacggtcct

SEQ ID NO: 54919 - DNA, 25 bp, Homo sapien
tgagacaaagcaagggtcccaccgg

SEQ ID NO: 54920 - DNA, 25 bp, Homo sapien
agtcctggcactggtaggacgcccg

SEQ ID NO: 54921 - DNA, 25 bp, Homo sapien
gtccaagcagttagcgccgcgcctg

SEQ ID NO: 54922 - DNA, 25 bp, Homo sapien
cggacactctgagggctctctctga

SEQ ID NO: 54923 - DNA, 25 bp, Homo sapien
aataatggcagttgccctgccagcc

SEQ ID NO: 54924 - DNA, 25 bp, Homo sapien
gcagtcgcgtgagccgtgtgcacct

SEQ ID NO: 54925 - DNA, 25 bp, Homo sapien
ggctggcgttcatcactgttcgtta

SEQ ID NO: 54926 - DNA, 25 bp, Homo sapien
ctgttcgttaacgtgctcatcggta

SEQ ID NO: 54927 - DNA, 25 bp, Homo sapien
gtgctcatcggtacagcctggtttc

SEQ ID NO: 54928 - DNA, 25 bp, Homo sapien
gtacagcctggtttcccgcaatgtg

SEQ ID NO: 54929 - DNA, 25 bp, Homo sapien
ttcccgcaatgtggccgcttctgct

SEQ ID NO: 54930 - DNA, 25 bp, Homo sapien
ctcctgctgtggcagttctgggcag

SEQ ID NO: 54931 - DNA, 25 bp, Homo sapien
ctccgagcctcctgctgtggcagtt

SEQ ID NO: 54932 - DNA, 25 bp, Homo sapien
ccctggtttccacgtcgctatggta

SEQ ID NO: 54933 - DNA, 25 bp, Homo sapien
cgctatggtaacgactcaccctgca

SEQ ID NO: 54934 - DNA, 25 bp, Homo sapien
gcaggcacggaaccggcttttcctc

SEQ ID NO: 54935 - DNA, 25 bp, Homo sapien
ggcgaccaatgagtgctctcgcgga

SEQ ID NO: 54936 - DNA, 25 bp, Homo sapien
atatggcttcctgcacctggtgacg

SEQ ID NO: 54937 - DNA, 25 bp, Homo sapien
acctggtgacgcttggcgaaactga

SEQ ID NO: 54938 - DNA, 25 bp, Homo sapien
ccctgcacacatgcgaactacaatt

SEQ ID NO: 54939 - DNA, 25 bp, Homo sapien
tagcgtgactgggaaagggaactcc

SEQ ID NO: 54940 - DNA, 25 bp, Homo sapien
aagtggttccgcctcaggtccagga

SEQ ID NO: 54941 - DNA, 25 bp, Homo sapien
agccactcgagtaggggccgcgcct

SEQ ID NO: 54942 - DNA, 25 bp, Homo sapien
ttgtggtgtaggctgagccgtctca

SEQ ID NO: 54943 - DNA, 25 bp, Homo sapien
tccgcgatgccgcagtgctgcaggt

SEQ ID NO: 54944 - DNA, 25 bp, Homo sapien
gccaggtttagcgtggccagcgcac

SEQ ID NO: 54945 - DNA, 25 bp, Homo sapien
ccagcacgctgagcgcgttgtgcga

SEQ ID NO: 54946 - DNA, 25 bp, Homo sapien
aggtgcagcgacaccaggtggccca

SEQ ID NO: 54947 - DNA, 25 bp, Homo sapien
cgttgtgcgacagccgcagccagcg

SEQ ID NO: 54948 - DNA, 25 bp, Homo sapien
aggtccctcagctcttccggaaagg

SEQ ID NO: 54949 - DNA, 25 bp, Homo sapien
gcaccgcctccggttgacaacaatg

SEQ ID NO: 54950 - DNA, 25 bp, Homo sapien
gctctggcgagtcagacgcccttta

SEQ ID NO: 54951 - DNA, 25 bp, Homo sapien
gtccagccggctagtctgttagctc

SEQ ID NO: 54952 - DNA, 25 bp, Homo sapien
cggcagtttctttgcttcgatttga

SEQ ID NO: 54953 - DNA, 25 bp, Homo sapien
gggagcgcccagagactacaattcc

SEQ ID NO: 54954 - DNA, 25 bp, Homo sapien
tatgagacgccactgctagcagctg

SEQ ID NO: 54955 - DNA, 25 bp, Homo sapien
tcccagaatgcgttgcacccaggtc

SEQ ID NO: 54956 - DNA, 25 bp, Homo sapien
tcttgaaattttcgtggggcctctc

SEQ ID NO: 54957 - DNA, 25 bp, Homo sapien
tgcggccgcccgtaattaaatagca

SEQ ID NO: 54958 - DNA, 25 bp, Homo sapien
cgtaatcatacctctagtcatagca

SEQ ID NO: 54959 - DNA, 25 bp, Homo sapien
cataccatttatcgggctcggcgca

SEQ ID NO: 54960 - DNA, 25 bp, Homo sapien
catttgctcctttttggggatcccg

SEQ ID NO: 54961 - DNA, 25 bp, Homo sapien
ttctggggtgtccagatgctttgcc

SEQ ID NO: 54962 - DNA, 25 bp, Homo sapien
aatgaaagtaaagcgctccagagcc

SEQ ID NO: 54963 - DNA, 25 bp, Homo sapien
gtttccggtcgcaggatcagtctct

SEQ ID NO: 54964 - DNA, 25 bp, Homo sapien
aaccgcgacctgctcttcgacccgc

SEQ ID NO: 54965 - DNA, 25 bp, Homo sapien
gcaggactgtaagtacggggataac

SEQ ID NO: 54966 - DNA, 25 bp, Homo sapien
cggaacgtgtgtcctgttgcctctt

SEQ ID NO: 54967 - DNA, 25 bp, Homo sapien
accgaggagcggaagggcaccctca

SEQ ID NO: 54968 - DNA, 25 bp, Homo sapien
acggggataactgcaccttcgccta

SEQ ID NO: 54969 - DNA, 25 bp, Homo sapien
gcagacatgattaacaagcaggact

SEQ ID NO: 54970 - DNA, 25 bp, Homo sapien
agcggaagggcaccctcaaccgcga

SEQ ID NO: 54971 - DNA, 25 bp, Homo sapien
gggataactgcaccttcgcctacca

SEQ ID NO: 54972 - DNA, 25 bp, Homo sapien
tcctgaagaagctgatggagaaccc

SEQ ID NO: 54973 - DNA, 25 bp, Homo sapien
tccagagcaacgatccggggaagct

SEQ ID NO: 54974 - DNA, 25 bp, Homo sapien
ctctcgcaggctggaccaatccaga

SEQ ID NO: 54975 - DNA, 25 bp, Homo sapien
aattaatgtgccagagccggtccgc

SEQ ID NO: 54976 - DNA, 25 bp, Homo sapien
tgtctatcttatcccggctgcccga

SEQ ID NO: 54977 - DNA, 25 bp, Homo sapien
cagcaggcgccaatcaggggacaca

SEQ ID NO: 54978 - DNA, 25 bp, Homo sapien
cgaggaaggcccaccacaaagactc

SEQ ID NO: 54979 - DNA, 25 bp, Homo sapien
agcaggagctcggataggtcgcttt

SEQ ID NO: 54980 - DNA, 25 bp, Homo sapien
gcggccacgtctcagcttcattata

SEQ ID NO: 54981 - DNA, 25 bp, Homo sapien
agaatcagatcaccatccgggcagc

SEQ ID NO: 54982 - DNA, 25 bp, Homo sapien
tgcaagaccatcgtgtccaagtatg

SEQ ID NO: 54983 - DNA, 25 bp, Homo sapien
ccctcacacgcgtggagacttatga

SEQ ID NO: 54984 - DNA, 25 bp, Homo sapien
agacttatgactcgtcgtgggcgca

SEQ ID NO: 54985 - DNA, 25 bp, Homo sapien
gcccggcgcctgaaagagaatcaga

SEQ ID NO: 54986 - DNA, 25 bp, Homo sapien
ttcattataccatggcctgcgcacg

SEQ ID NO: 54987 - DNA, 25 bp, Homo sapien
cgcaagaagaacaacgtggcagcta

SEQ ID NO: 54988 - DNA, 25 bp, Homo sapien
gctgtgaccgtcctcgttaggattc

SEQ ID NO: 54989 - DNA, 25 bp, Homo sapien
ttctccagcagagcacggcgggtag

SEQ ID NO: 54990 - DNA, 25 bp, Homo sapien
ggactcgctcccggcaggtgtccta

SEQ ID NO: 54991 - DNA, 25 bp, Homo sapien
cgctttgcgcccaaagggaaactga

SEQ ID NO: 54992 - DNA, 25 bp, Homo sapien
cgcgttccgctttgcgcccaaaggg

SEQ ID NO: 54993 - DNA, 25 bp, Homo sapien
gcgctggtgtcaccaggagtgaaca

SEQ ID NO: 54994 - DNA, 25 bp, Homo sapien
tcagcggtctcgaagctgcggccca

SEQ ID NO: 54995 - DNA, 25 bp, Homo sapien
ctcgttaggattcttgggtccctag

SEQ ID NO: 54996 - DNA, 25 bp, Homo sapien
tgagtcttccgagcgccttgtgatt

SEQ ID NO: 54997 - DNA, 25 bp, Homo sapien
acgcgggctctggaaacatttcgga

SEQ ID NO: 54998 - DNA, 25 bp, Homo sapien
gcccatggttcggacgtttgcccga

SEQ ID NO: 54999 - DNA, 25 bp, Homo sapien
taccactctgaacttgtgcgcgtcg

SEQ ID NO: 55000 - DNA, 25 bp, Homo sapien
cccggcccgaagtgagcaaagtcaa

SEQ ID NO: 55001 - DNA, 25 bp, Homo sapien
gggagtcaccatgcccgccggaaac

SEQ ID NO: 55002 - DNA, 25 bp, Homo sapien
gccgtgaaactagccgagtgccaca

SEQ ID NO: 55003 - DNA, 25 bp, Homo sapien
cagctcgctggtatctcgcggagca

SEQ ID NO: 55004 - DNA, 25 bp, Homo sapien
tgtcattggccgaaagagtctcgtt

SEQ ID NO: 55005 - DNA, 25 bp, Homo sapien
ttctctgcgtgatgtgttcaccacc

SEQ ID NO: 55006 - DNA, 25 bp, Homo sapien
gagtctcgttttgatgccacccggg

SEQ ID NO: 55007 - DNA, 25 bp, Homo sapien
ggaaagtgatgtgccgtgtcctgtc

SEQ ID NO: 55008 - DNA, 25 bp, Homo sapien
tggcaggatcttgctgaggagctcc

SEQ ID NO: 55009 - DNA, 25 bp, Homo sapien
accacgatgactgacgcaccgagga

SEQ ID NO: 55010 - DNA, 25 bp, Homo sapien
ctcagattggcccagcgggtccagc

SEQ ID NO: 55011 - DNA, 25 bp, Homo sapien
agacacgggccagttctctgcgtga

SEQ ID NO: 55012 - DNA, 25 bp, Homo sapien
tccgcccattgcgttcacagggttc

SEQ ID NO: 55013 - DNA, 25 bp, Homo sapien
ctgtccctgcctcgcaagaagcgtg

SEQ ID NO: 55014 - DNA, 25 bp, Homo sapien
atggcgccctacagcctactggtga

SEQ ID NO: 55015 - DNA, 25 bp, Homo sapien
tgtctttgggcagtccgatttcctc

SEQ ID NO: 55016 - DNA, 25 bp, Homo sapien
tcctggcaggtgcatgaaactctta

SEQ ID NO: 55017 - DNA, 25 bp, Homo sapien
cacgtcgctgtgattggttctctaa

SEQ ID NO: 55018 - DNA, 25 bp, Homo sapien
acaccagcctgcttgcggcaaaaga

SEQ ID NO: 55019 - DNA, 25 bp, Homo sapien
ggggccaacttctcgtgtacctgtc

SEQ ID NO: 55020 - DNA, 25 bp, Homo sapien
ggggcctcctcctttcacaggagca

SEQ ID NO: 55021 - DNA, 25 bp, Homo sapien
gcccagtaccttgttggccaacttc

SEQ ID NO: 55022 - DNA, 25 bp, Homo sapien
ctcggcaatggagtcgttgagcttc

SEQ ID NO: 55023 - DNA, 25 bp, Homo sapien
gagcttcctctcaaactgccaaggg

SEQ ID NO: 55024 - DNA, 25 bp, Homo sapien
ggatccggacggtgtccaccatttc

SEQ ID NO: 55025 - DNA, 25 bp, Homo sapien
ggccaacttcttgttcagctcctcg

SEQ ID NO: 55026 - DNA, 25 bp, Homo sapien
ctgcgggcgagattccgaatccatc

SEQ ID NO: 55027 - DNA, 25 bp, Homo sapien
ccgctactacaacatgaggaaactg

SEQ ID NO: 55028 - DNA, 25 bp, Homo sapien
caacggcagaagcagctcagggata

SEQ ID NO: 55029 - DNA, 25 bp, Homo sapien
ggagtcccgaagatgcaacggcaga

SEQ ID NO: 55030 - DNA, 25 bp, Homo sapien
ccagtggactgcctgattggccaaa

SEQ ID NO: 55031 - DNA, 25 bp, Homo sapien
cggggcctgagctgattctcattgc

SEQ ID NO: 55032 - DNA, 25 bp, Homo sapien
gggtcccgtccacgtcaaacaggca

SEQ ID NO: 55033 - DNA, 25 bp, Homo sapien
tgtccacggtcacgctgctgcagac

SEQ ID NO: 55034 - DNA, 25 bp, Homo sapien
cccggtgggagcttccaatcttcag

SEQ ID NO: 55035 - DNA, 25 bp, Homo sapien
atcttcagggtcctacctggcgagc

SEQ ID NO: 55036 - DNA, 25 bp, Homo sapien
ccgctaccggcaacgactactgtga

SEQ ID NO: 55037 - DNA, 25 bp, Homo sapien
gttagccttaagtgtgcgaatccga

SEQ ID NO: 55038 - DNA, 25 bp, Homo sapien
catttgtgttgttcgccagctaggc

SEQ ID NO: 55039 - DNA, 25 bp, Homo sapien
catgcgtggattgtcgtcttctgtc

SEQ ID NO: 55040 - DNA, 25 bp, Homo sapien
ggcctttggacaggtcgtacacgta

SEQ ID NO: 55041 - DNA, 25 bp, Homo sapien
cgcatgtgcttacagtcctgacgta

SEQ ID NO: 55042 - DNA, 25 bp, Homo sapien
cgtacacgtagagcttcaccggata

SEQ ID NO: 55043 - DNA, 25 bp, Homo sapien
cgtgccagcctgacgcgatatagtg

SEQ ID NO: 55044 - DNA, 25 bp, Homo sapien
ttccatccgccaggtggcgacacag

SEQ ID NO: 55045 - DNA, 25 bp, Homo sapien
taagctcagcggcatccgggttcct

SEQ ID NO: 55046 - DNA, 25 bp, Homo sapien
cgccgcagcagctcgagaacacgaa

SEQ ID NO: 55047 - DNA, 25 bp, Homo sapien
ctgggagccataagccggagagtct

SEQ ID NO: 55048 - DNA, 25 bp, Homo sapien
agcgccgatctgggcctgcgcatgc

SEQ ID NO: 55049 - DNA, 25 bp, Homo sapien
gcagcagctcgagaacacgaatccg

SEQ ID NO: 55050 - DNA, 25 bp, Homo sapien
taccgcggccatcgcgcttccatcc

SEQ ID NO: 55051 - DNA, 25 bp, Homo sapien
agcggcatccgggttccttgtggcc

SEQ ID NO: 55052 - DNA, 25 bp, Homo sapien
tggcccagtaggaacactcaccata

SEQ ID NO: 55053 - DNA, 25 bp, Homo sapien
cgccatcgtgtgtaacgtgcgaatc

SEQ ID NO: 55054 - DNA, 25 bp, Homo sapien
cgagtgattcactgcggctaccacc

SEQ ID NO: 55055 - DNA, 25 bp, Homo sapien
tggtgggaccactcatctatagcgc

SEQ ID NO: 55056 - DNA, 25 bp, Homo sapien
gtgacccggagataatggcccagta

SEQ ID NO: 55057 - DNA, 25 bp, Homo sapien
ccatagcgtctgtcttggtagtctc

SEQ ID NO: 55058 - DNA, 25 bp, Homo sapien
gcccagcaccgcaaggacacggatg

SEQ ID NO: 55059 - DNA, 25 bp, Homo sapien
cagcttttctgacacagcgggacca

SEQ ID NO: 55060 - DNA, 25 bp, Homo sapien
ctgtgtcgaagaaggaacgtacttt

SEQ ID NO: 55061 - DNA, 25 bp, Homo sapien
gttaagacccaacgccggcggatga

SEQ ID NO: 55062 - DNA, 25 bp, Homo sapien
ccatctaacaggctagggagtgaac

SEQ ID NO: 55063 - DNA, 25 bp, Homo sapien
gggagtgaacgcaaccctgagtctc

SEQ ID NO: 55064 - DNA, 25 bp, Homo sapien
gagcgcagctgacgtttcagaagca

SEQ ID NO: 55065 - DNA, 25 bp, Homo sapien
cactcgcgtgcaccggaaaaactca

SEQ ID NO: 55066 - DNA, 25 bp, Homo sapien
cggaaactggccctgtgtcgaagaa

SEQ ID NO: 55067 - DNA, 25 bp, Homo sapien
ggcgcaggctctaagcctccatcta

SEQ ID NO: 55068 - DNA, 25 bp, Homo sapien
cgtcctccaagtgcgcatgcgtgca

SEQ ID NO: 55069 - DNA, 25 bp, Homo sapien
attcccttcagctgtcggggtgtga

SEQ ID NO: 55070 - DNA, 25 bp, Homo sapien
gggacctcacccagtctcagggaca

SEQ ID NO: 55071 - DNA, 25 bp, Homo sapien
ctctgcgcctgaaaggacggaaatc

SEQ ID NO: 55072 - DNA, 25 bp, Homo sapien
cagaagacctgggtttggccatttc

SEQ ID NO: 55073 - DNA, 25 bp, Homo sapien
tgcgggcggaaccttttcttcagaa

SEQ ID NO: 55074 - DNA, 25 bp, Homo sapien
cgcttctattcgagagggcccatta

SEQ ID NO: 55075 - DNA, 25 bp, Homo sapien
aggcgcattccacaccgacgcaggt

SEQ ID NO: 55076 - DNA, 25 bp, Homo sapien
gcccgaatcctgcactgagtctctg

SEQ ID NO: 55077 - DNA, 25 bp, Homo sapien
ctctgttccttgagaaggctcgctc

SEQ ID NO: 55078 - DNA, 25 bp, Homo sapien
ctgactgtcctgatcctgcgcaaaa

SEQ ID NO: 55079 - DNA, 25 bp, Homo sapien
cccgccgcacttggcttattagttg

SEQ ID NO: 55080 - DNA, 25 bp, Homo sapien
cggccacagacgacgacacagtttc

SEQ ID NO: 55081 - DNA, 25 bp, Homo sapien
cacaagctaaatccagggccacgta

SEQ ID NO: 55082 - DNA, 25 bp, Homo sapien
cccagtttgctgattcacgccttaa

SEQ ID NO: 55083 - DNA, 25 bp, Homo sapien
ttagcctgttggaccttcgagccta

SEQ ID NO: 55084 - DNA, 25 bp, Homo sapien
tttgccgcgcgaacagcctttcgtt

SEQ ID NO: 55085 - DNA, 25 bp, Homo sapien
tttgggttggcaacctgagccctcc

SEQ ID NO: 55086 - DNA, 25 bp, Homo sapien
ggtccggcgcttccattcatgcctt

SEQ ID NO: 55087 - DNA, 25 bp, Homo sapien
gcaccgtgtgcggatctataatcga

SEQ ID NO: 55088 - DNA, 25 bp, Homo sapien
acagcatcaattgcgggagtccggc

SEQ ID NO: 55089 - DNA, 25 bp, Homo sapien
cacaaaatggctgacgcggcgcacg

SEQ ID NO: 55090 - DNA, 25 bp, Homo sapien
gtggcttggtcaccatcaaaaatag

SEQ ID NO: 55091 - DNA, 25 bp, Homo sapien
ggcttccgcctcactttggacggtg

SEQ ID NO: 55092 - DNA, 25 bp, Homo sapien
gatgagcctggtcccattgacaaca

SEQ ID NO: 55093 - DNA, 25 bp, Homo sapien
atccaacggagaaggcagcggctcc

SEQ ID NO: 55094 - DNA, 25 bp, Homo sapien
cagcggctcctttaaacaaggcgga

SEQ ID NO: 55095 - DNA, 25 bp, Homo sapien
ggacggctactccaggcattcgctc

SEQ ID NO: 55096 - DNA, 25 bp, Homo sapien
gctgctgatcgatgacgcgccatca

SEQ ID NO: 55097 - DNA, 25 bp, Homo sapien
agctgaccctgggagacatcgacgg

SEQ ID NO: 55098 - DNA, 25 bp, Homo sapien
tctggagaccatggagaccctcacg

SEQ ID NO: 55099 - DNA, 25 bp, Homo sapien
gggacctcactatgcaaatctgagc

SEQ ID NO: 55100 - DNA, 25 bp, Homo sapien
aggctgcgagccaagcctgtcttcg

SEQ ID NO: 55101 - DNA, 25 bp, Homo sapien
cccgaggccgttcggtgagaacctg

SEQ ID NO: 55102 - DNA, 25 bp, Homo sapien
gcgcgttgttgaggcgcttcttgtc

SEQ ID NO: 55103 - DNA, 25 bp, Homo sapien
cgtacttggcgtagtctggctgcag

SEQ ID NO: 55104 - DNA, 25 bp, Homo sapien
cggccttgaacgtggcgtacttggc

SEQ ID NO: 55105 - DNA, 25 bp, Homo sapien
agctcaggactggacaaggggtccc

SEQ ID NO: 55106 - DNA, 25 bp, Homo sapien
aacgctgacagaagtcccgcggggc

SEQ ID NO: 55107 - DNA, 25 bp, Homo sapien
aacagggcctggctccgagtcacgc

SEQ ID NO: 55108 - DNA, 25 bp, Homo sapien
cagcagaagctgtaggctccggagc

SEQ ID NO: 55109 - DNA, 25 bp, Homo sapien
cactggcccatcacgtcgtagtagc

SEQ ID NO: 55110 - DNA, 25 bp, Homo sapien
cgcacgtgccgcagcagaagctgta

SEQ ID NO: 55111 - DNA, 25 bp, Homo sapien
gtgtcgtagttggaacagcggctct

SEQ ID NO: 55112 - DNA, 25 bp, Homo sapien
agcagaagcggtagccgcacgtgcc

SEQ ID NO: 55113 - DNA, 25 bp, Homo sapien
cgcacacagcgtagacggccgtatg

SEQ ID NO: 55114 - DNA, 25 bp, Homo sapien
gcgccagcagcaacgcgagccgaag

SEQ ID NO: 55115 - DNA, 25 bp, Homo sapien
tagacggccgtatggctgcgctcgc

SEQ ID NO: 55116 - DNA, 25 bp, Homo sapien
cctttccggccaccttgaggcttgg

SEQ ID NO: 55117 - DNA, 25 bp, Homo sapien
cgcgaggcaactctgactcaggctc

SEQ ID NO: 55118 - DNA, 25 bp, Homo sapien
agccctcagtgtacgtgcgaatccg

SEQ ID NO: 55119 - DNA, 25 bp, Homo sapien
caccgagaccttagcgcgggaacca

SEQ ID NO: 55120 - DNA, 25 bp, Homo sapien
cgctatttggggcagtcgtttctac

SEQ ID NO: 55121 - DNA, 25 bp, Homo sapien
cctgctcctcggtcacagttctgtg

SEQ ID NO: 55122 - DNA, 25 bp, Homo sapien
gctgtctttgtctcccgcgaggcaa

SEQ ID NO: 55123 - DNA, 25 bp, Homo sapien
gatcccagattatccgcagcctagg

SEQ ID NO: 55124 - DNA, 25 bp, Homo sapien
agcaggtcgaagcactcggccggga

SEQ ID NO: 55125 - DNA, 25 bp, Homo sapien
tcatggtgccgacgccgccgcacaa

SEQ ID NO: 55126 - DNA, 25 bp, Homo sapien
tccttgtctccgtcgggggcctctg

SEQ ID NO: 55127 - DNA, 25 bp, Homo sapien
cctgcccacagggtcctttcagccc

SEQ ID NO: 55128 - DNA, 25 bp, Homo sapien
cgcaggccacgcagtggcggaccag

SEQ ID NO: 55129 - DNA, 25 bp, Homo sapien
ggccctcgcctcatggtgccgacgc

SEQ ID NO: 55130 - DNA, 25 bp, Homo sapien
ccgctcagactggttcccctacaca

SEQ ID NO: 55131 - DNA, 25 bp, Homo sapien
acagggtcctttcagccctcggcgc

SEQ ID NO: 55132 - DNA, 25 bp, Homo sapien
cagttgacctagtggctgaagcacc

SEQ ID NO: 55133 - DNA, 25 bp, Homo sapien
cgtgcctccttataggcggggcttc

SEQ ID NO: 55134 - DNA, 25 bp, Homo sapien
atcacagccgcaggaccaaccgttg

SEQ ID NO: 55135 - DNA, 25 bp, Homo sapien
aggggcctcaacaccgacatcacag

SEQ ID NO: 55136 - DNA, 25 bp, Homo sapien
cctaccaagatggtggccgtgttca

SEQ ID NO: 55137 - DNA, 25 bp, Homo sapien
gagcggctactccaattggttcaga

SEQ ID NO: 55138 - DNA, 25 bp, Homo sapien
gggtgcgtccctcaacctcagagag

SEQ ID NO: 55139 - DNA, 25 bp, Homo sapien
cgcagtcctctttgagcatcgagtc

SEQ ID NO: 55140 - DNA, 25 bp, Homo sapien
tctcggtcctcattctggtgggctt

SEQ ID NO: 55141 - DNA, 25 bp, Homo sapien
gacgctaatggtgcgcgacaacctg

SEQ ID NO: 55142 - DNA, 25 bp, Homo sapien
cgcgacctccgcaagacgctaatgg

SEQ ID NO: 55143 - DNA, 25 bp, Homo sapien
ttcggcgcctgcatctactacttcg

SEQ ID NO: 55144 - DNA, 25 bp, Homo sapien
gtctacttggtcatctcggtcctca

SEQ ID NO: 55145 - DNA, 25 bp, Homo sapien
tggactggttcgtgccggtctactt

SEQ ID NO: 55146 - DNA, 25 bp, Homo sapien
cgatgccgcacttcctggactggtt

SEQ ID NO: 55147 - DNA, 25 bp, Homo sapien
atctactacttcgagccgggcctgc

SEQ ID NO: 55148 - DNA, 25 bp, Homo sapien
gcatctccctggaggaacggagaca

SEQ ID NO: 55149 - DNA, 25 bp, Homo sapien
ccacctcgagagagacaatcttgga

SEQ ID NO: 55150 - DNA, 25 bp, Homo sapien
ggtggcacccacctcgagagagaca

SEQ ID NO: 55151 - DNA, 25 bp, Homo sapien
attcatgtccaaaggtagggcggcc

SEQ ID NO: 55152 - DNA, 25 bp, Homo sapien
acgggactgggatgcaggcaccttt

SEQ ID NO: 55153 - DNA, 25 bp, Homo sapien
gatgcaggcacctttccgggcctgg

SEQ ID NO: 55154 - DNA, 25 bp, Homo sapien
agcccacgcgcggtgacagatgcgc

SEQ ID NO: 55155 - DNA, 25 bp, Homo sapien
cggagacaaaggaggattcatgtcc

SEQ ID NO: 55156 - DNA, 25 bp, Homo sapien
cctttccatctacggggcggcagga

SEQ ID NO: 55157 - DNA, 25 bp, Homo sapien
gagacgcgtgtgtccttcgaagaga

SEQ ID NO: 55158 - DNA, 25 bp, Homo sapien
gggcccagacgcatgtctcctcagg

SEQ ID NO: 55159 - DNA, 25 bp, Homo sapien
cgagtcagggactttgccgcctttt

SEQ ID NO: 55160 - DNA, 25 bp, Homo sapien
tagacatggcggctcgcaaactctc

SEQ ID NO: 55161 - DNA, 25 bp, Homo sapien
gcggagccctcatccctaacggtga

SEQ ID NO: 55162 - DNA, 25 bp, Homo sapien
tgaatcagagccacaccgagaaccg

SEQ ID NO: 55163 - DNA, 25 bp, Homo sapien
cccgaagcaagatggcggtgaatca

SEQ ID NO: 55164 - DNA, 25 bp, Homo sapien
ccaggatttacgaggactcggccca

SEQ ID NO: 55165 - DNA, 25 bp, Homo sapien
caacggggcattgttcacggcctca

SEQ ID NO: 55166 - DNA, 25 bp, Homo sapien
ttttacaacgtatgggctggtggca

SEQ ID NO: 55167 - DNA, 25 bp, Homo sapien
gatccgtggggagagattttacaac

SEQ ID NO: 55168 - DNA, 25 bp, Homo sapien
atcccgaccgtaaatggtttctgtg

SEQ ID NO: 55169 - DNA, 25 bp, Homo sapien
tcggtgccaataaaggccgccttta

SEQ ID NO: 55170 - DNA, 25 bp, Homo sapien
cctgacagatgtggcggtgagaaaa

SEQ ID NO: 55171 - DNA, 25 bp, Homo sapien
ggaaacgttcgccattcggtgccaa

SEQ ID NO: 55172 - DNA, 25 bp, Homo sapien
cgccgcttctgactcgaatccggta

SEQ ID NO: 55173 - DNA, 25 bp, Homo sapien
tatcctaccgaagcgttcagacctg

SEQ ID NO: 55174 - DNA, 25 bp, Homo sapien
agccactggcttaaggtcaccaaga

SEQ ID NO: 55175 - DNA, 25 bp, Homo sapien
cgtgtcttggatgtcagacctcaca

SEQ ID NO: 55176 - DNA, 25 bp, Homo sapien
tcacttcccggagcttcagttcttc

SEQ ID NO: 55177 - DNA, 25 bp, Homo sapien
tccggtaacctgataagtccgaagc

SEQ ID NO: 55178 - DNA, 25 bp, Homo sapien
ccgcccgggctcagaaaaaggcagc

SEQ ID NO: 55179 - DNA, 25 bp, Homo sapien
ccctcaaccttaggcgtggatcgta

SEQ ID NO: 55180 - DNA, 25 bp, Homo sapien
ctctcctccaacaaaagaatccagg

SEQ ID NO: 55181 - DNA, 25 bp, Homo sapien
tgacctctgtttagggcgacaaccg

SEQ ID NO: 55182 - DNA, 25 bp, Homo sapien
ccctgaccgaggtgacctctgttta

SEQ ID NO: 55183 - DNA, 25 bp, Homo sapien
ccagggagaccctgaccgaggtgac

SEQ ID NO: 55184 - DNA, 25 bp, Homo sapien
tgggatcgccctcttgggcttcggt

SEQ ID NO: 55185 - DNA, 25 bp, Homo sapien
tgtggctcgggcagttcaccgccct

SEQ ID NO: 55186 - DNA, 25 bp, Homo sapien
ccagtgctgtggctcgggcagttca

SEQ ID NO: 55187 - DNA, 25 bp, Homo sapien
ctggcccccctactggtggagagga

SEQ ID NO: 55188 - DNA, 25 bp, Homo sapien
caaaccggtgaaagtgagtgtcctc

SEQ ID NO: 55189 - DNA, 25 bp, Homo sapien
ggagccaaggccaatcataacgatt

SEQ ID NO: 55190 - DNA, 25 bp, Homo sapien
ctgggcttctcgtgtactcctcaaa

SEQ ID NO: 55191 - DNA, 25 bp, Homo sapien
gtaccgtcgaggtcagtcatcgtta

SEQ ID NO: 55192 - DNA, 25 bp, Homo sapien
ctcgctggctagtattggcacccgt

SEQ ID NO: 55193 - DNA, 25 bp, Homo sapien
taccgtagactggaaggcggaccaa

SEQ ID NO: 55194 - DNA, 25 bp, Homo sapien
tcaaactctcgcgaggcttcgggcg

SEQ ID NO: 55195 - DNA, 25 bp, Homo sapien
cggcgccattttgcccaaaccggtg

SEQ ID NO: 55196 - DNA, 25 bp, Homo sapien
gcaggccttgaagaacctcctcgtg

SEQ ID NO: 55197 - DNA, 25 bp, Homo sapien
ggggtttccctcagcgtcctgctat

SEQ ID NO: 55198 - DNA, 25 bp, Homo sapien
acgccgcttggcctttggactacac

SEQ ID NO: 55199 - DNA, 25 bp, Homo sapien
tgctcatctacagaaacgccgcttg

SEQ ID NO: 55200 - DNA, 25 bp, Homo sapien
tcccattggctaaggaggaacgccc

SEQ ID NO: 55201 - DNA, 25 bp, Homo sapien
gaccgcgggcgaatgtcttttccca

SEQ ID NO: 55202 - DNA, 25 bp, Homo sapien
gtaagccgctacctctcaccagtgt

SEQ ID NO: 55203 - DNA, 25 bp, Homo sapien
ttggcctcgttcatgtcccgactga

SEQ ID NO: 55204 - DNA, 25 bp, Homo sapien
cctccctagtgcaggtggtttcttg

SEQ ID NO: 55205 - DNA, 25 bp, Homo sapien
cgcgtggccatgaaggcattagccc

SEQ ID NO: 55206 - DNA, 25 bp, Homo sapien
ttgtgcatccaccttgctcccttgg

SEQ ID NO: 55207 - DNA, 25 bp, Homo sapien
ggaaatgcgccagcctcacccattg

SEQ ID NO: 55208 - DNA, 25 bp, Homo sapien
cactcgctggcctgtttcatgtcca

SEQ ID NO: 55209 - DNA, 25 bp, Homo sapien
cgggtcccacggaaatctgtctctg

SEQ ID NO: 55210 - DNA, 25 bp, Homo sapien
cttcgacaccggattccagctggga

SEQ ID NO: 55211 - DNA, 25 bp, Homo sapien
tgcccagctcggactacggtcatca

SEQ ID NO: 55212 - DNA, 25 bp, Homo sapien
agggcccactctttgctcacccaca

SEQ ID NO: 55213 - DNA, 25 bp, Homo sapien
acacgtgggcgttgccatgaaggcc

SEQ ID NO: 55214 - DNA, 25 bp, Homo sapien
ggcgctccacaaggtctcccgcagt

SEQ ID NO: 55215 - DNA, 25 bp, Homo sapien
acactgagcccgcagcataggcgcg

SEQ ID NO: 55216 - DNA, 25 bp, Homo sapien
tggcccactgtcctcagcccactcg

SEQ ID NO: 55217 - DNA, 25 bp, Homo sapien
ggcctttatctctgtttcacgtcca

SEQ ID NO: 55218 - DNA, 25 bp, Homo sapien
ttatctctgtttcacgtccaggacc

SEQ ID NO: 55219 - DNA, 25 bp, Homo sapien
ggcgttgccatgaaggccttggccc

SEQ ID NO: 55220 - DNA, 25 bp, Homo sapien
actcaccttgcttgggtcttggccc

SEQ ID NO: 55221 - DNA, 25 bp, Homo sapien
gcgtgtccgtagtgtgccagaaaca

SEQ ID NO: 55222 - DNA, 25 bp, Homo sapien
tctagacacccgcttccagctggga

SEQ ID NO: 55223 - DNA, 25 bp, Homo sapien
ccactcactggcctttctatgtgtc

SEQ ID NO: 55224 - DNA, 25 bp, Homo sapien
ggcctttctatgtgtcccaagtcca

SEQ ID NO: 55225 - DNA, 25 bp, Homo sapien
tctttgctcactcaccttgcttggg

SEQ ID NO: 55226 - DNA, 25 bp, Homo sapien
gactgcctttccactcagggaagat

SEQ ID NO: 55227 - DNA, 25 bp, Homo sapien
agcagagtccatcccggcttctaga

SEQ ID NO: 55228 - DNA, 25 bp, Homo sapien
gcgacggagtctcgcctctaaagtg

SEQ ID NO: 55229 - DNA, 25 bp, Homo sapien
tctccttctgaatgacgcaaggggc

SEQ ID NO: 55230 - DNA, 25 bp, Homo sapien
tcagctgagcgaaaccctccttgca

SEQ ID NO: 55231 - DNA, 25 bp, Homo sapien
agcaggaaggtatgagcctcagctg

SEQ ID NO: 55232 - DNA, 25 bp, Homo sapien
cgctgcgctagggactgtcataaaa

SEQ ID NO: 55233 - DNA, 25 bp, Homo sapien
tctcgcctctaaagtggcccgggga

SEQ ID NO: 55234 - DNA, 25 bp, Homo sapien
tagggtggtcttgtctgtctcactc

SEQ ID NO: 55235 - DNA, 25 bp, Homo sapien
ccgcgatcggggactgtcctaagac

SEQ ID NO: 55236 - DNA, 25 bp, Homo sapien
ataacagagcgtcaggtgacggcgc

SEQ ID NO: 55237 - DNA, 25 bp, Homo sapien
ctcgcgcgaccagcaggtagacctt

SEQ ID NO: 55238 - DNA, 25 bp, Homo sapien
cattctcccaacacacaggaaataa

SEQ ID NO: 55239 - DNA, 25 bp, Homo sapien
tccgcactcccaggttgggtccggc

SEQ ID NO: 55240 - DNA, 25 bp, Homo sapien
caagccctgactcggagtccaggag

SEQ ID NO: 55241 - DNA, 25 bp, Homo sapien
gacaccttagccctctgatgccagg

SEQ ID NO: 55242 - DNA, 25 bp, Homo sapien
agcaggtagaccttccctccgcacc

SEQ ID NO: 55243 - DNA, 25 bp, Homo sapien
cacaggaaataacagagcgtcaggt

SEQ ID NO: 55244 - DNA, 25 bp, Homo sapien
cactcgagcagctgcggcctttgat

SEQ ID NO: 55245 - DNA, 25 bp, Homo sapien
cagctgcggcctttgatggggacaa

SEQ ID NO: 55246 - DNA, 25 bp, Homo sapien
gccctccatcgctctttatggcagt

SEQ ID NO: 55247 - DNA, 25 bp, Homo sapien
tcgcacgccagagcaaactttcacg

SEQ ID NO: 55248 - DNA, 25 bp, Homo sapien
agcaaactttcacgaccgcgggaga

SEQ ID NO: 55249 - DNA, 25 bp, Homo sapien
ttcaaagctacagccgccactcgag

SEQ ID NO: 55250 - DNA, 25 bp, Homo sapien
acaccgttacctttgcagccgcatc

SEQ ID NO: 55251 - DNA, 25 bp, Homo sapien
tttatggcagtttcaaagctacagc

SEQ ID NO: 55252 - DNA, 25 bp, Homo sapien
gccggctctgaaaggcctcctattc

SEQ ID NO: 55253 - DNA, 25 bp, Homo sapien
tgacaagccgcagcgacgcctcgaa

SEQ ID NO: 55254 - DNA, 25 bp, Homo sapien
ggcctcctattctgctggaagctaa

SEQ ID NO: 55255 - DNA, 25 bp, Homo sapien
ctgtgctgtttgtgtgctattttaa

SEQ ID NO: 55256 - DNA, 25 bp, Homo sapien
ccgctttgatgtccgggaccagata

SEQ ID NO: 55257 - DNA, 25 bp, Homo sapien
gaccctccatggagagcgggactgt

SEQ ID NO: 55258 - DNA, 25 bp, Homo sapien
gccagcgcgatgtcatgaggtaact

SEQ ID NO: 55259 - DNA, 25 bp, Homo sapien
cagtcctgctgaaaaatatgctttt

SEQ ID NO: 55260 - DNA, 25 bp, Homo sapien
gcgccagattaatcacaccgaattc

SEQ ID NO: 55261 - DNA, 25 bp, Homo sapien
tccagatattgcgtgcaggccgaac

SEQ ID NO: 55262 - DNA, 25 bp, Homo sapien
caccgaattctccatccagatattg

SEQ ID NO: 55263 - DNA, 25 bp, Homo sapien
aatattaattctccacagccggctc

SEQ ID NO: 55264 - DNA, 25 bp, Homo sapien
ccggggcgatgttccaggaatatta

SEQ ID NO: 55265 - DNA, 25 bp, Homo sapien
cgtaatattctcctcggcgtgtgca

SEQ ID NO: 55266 - DNA, 25 bp, Homo sapien
tcccaccgctaatcgccgtaatatt

SEQ ID NO: 55267 - DNA, 25 bp, Homo sapien
ccggaggctgctacttagcgccaga

SEQ ID NO: 55268 - DNA, 25 bp, Homo sapien
cagctcctgcgacggaggctgccag

SEQ ID NO: 55269 - DNA, 25 bp, Homo sapien
aaaggcggaggcagacagccatgtt

SEQ ID NO: 55270 - DNA, 25 bp, Homo sapien
ctggcgagaggcttaatgaaactgc

SEQ ID NO: 55271 - DNA, 25 bp, Homo sapien
ggcttaatgaaactgctaacgcgtt

SEQ ID NO: 55272 - DNA, 25 bp, Homo sapien
agtgattcctgcctgctcgggaaag

SEQ ID NO: 55273 - DNA, 25 bp, Homo sapien
cagacagccatgttgccagctcctg

SEQ ID NO: 55274 - DNA, 25 bp, Homo sapien
ttgccagctcctgcgacggaggctg

SEQ ID NO: 55275 - DNA, 25 bp, Homo sapien
tgctaacgcgttagtgattcctgcc

SEQ ID NO: 55276 - DNA, 25 bp, Homo sapien
gcgcaagtctacacggtctcacctg

SEQ ID NO: 55277 - DNA, 25 bp, Homo sapien
ttggagttcgcccaaggagcttccg

SEQ ID NO: 55278 - DNA, 25 bp, Homo sapien
tccacaggctcaacagctgcgagtc

SEQ ID NO: 55279 - DNA, 25 bp, Homo sapien
agccttggggatccgtcttgaccac

SEQ ID NO: 55280 - DNA, 25 bp, Homo sapien
tgcaccatccatggctctcgagatc

SEQ ID NO: 55281 - DNA, 25 bp, Homo sapien
ctcgagatccttcagagcgcggacc

SEQ ID NO: 55282 - DNA, 25 bp, Homo sapien
gcagccgcttctctcacacattttg

SEQ ID NO: 55283 - DNA, 25 bp, Homo sapien
ttgtaaatcctcctgcggccacgtg

SEQ ID NO: 55284 - DNA, 25 bp, Homo sapien
gccttagactcaccaggtcgcctta

SEQ ID NO: 55285 - DNA, 25 bp, Homo sapien
ttctaggagaccctgagttagccgg

SEQ ID NO: 55286 - DNA, 25 bp, Homo sapien
ccgcgcattcgccagacgagagcga

SEQ ID NO: 55287 - DNA, 25 bp, Homo sapien
aggtcgccttagactcaccaggtcg

SEQ ID NO: 55288 - DNA, 25 bp, Homo sapien
gactcaccaggtcgccttagactta

SEQ ID NO: 55289 - DNA, 25 bp, Homo sapien
tcgccttagacttagatgggacggg

SEQ ID NO: 55290 - DNA, 25 bp, Homo sapien
tgacggccgcgcattcgccagacga

SEQ ID NO: 55291 - DNA, 25 bp, Homo sapien
ccagacgagagcgatggctgagaac

SEQ ID NO: 55292 - DNA, 25 bp, Homo sapien
gggtggcttacgctccatcttgctc

SEQ ID NO: 55293 - DNA, 25 bp, Homo sapien
gcacccgcaagctggctgcctcagt

SEQ ID NO: 55294 - DNA, 25 bp, Homo sapien
ccgccctcaggagcactggccacag

SEQ ID NO: 55295 - DNA, 25 bp, Homo sapien
tggccacaggcctcatccgtggctg

SEQ ID NO: 55296 - DNA, 25 bp, Homo sapien
aggcctcatccgtggctggggccaa

SEQ ID NO: 55297 - DNA, 25 bp, Homo sapien
tacgctccatcttgctctctcgatg

SEQ ID NO: 55298 - DNA, 25 bp, Homo sapien
atcttgctctctcgatgctgccagg

SEQ ID NO: 55299 - DNA, 25 bp, Homo sapien
gctctctcgatgctgccaggcgtag

SEQ ID NO: 55300 - DNA, 25 bp, Homo sapien
agcccagtgggctggggatacggtc

SEQ ID NO: 55301 - DNA, 25 bp, Homo sapien
acctcccggcgatgcctgaccgccc

SEQ ID NO: 55302 - DNA, 25 bp, Homo sapien
gcgcacttcctcctgcgcgccacca

SEQ ID NO: 55303 - DNA, 25 bp, Homo sapien
cagagataaatcagcgcgcgaaagt

SEQ ID NO: 55304 - DNA, 25 bp, Homo sapien
agagataaatcagcgcgcgaaagtg

SEQ ID NO: 55305 - DNA, 25 bp, Homo sapien
ctcacctgcgtagcccagtgggctg

SEQ ID NO: 55306 - DNA, 25 bp, Homo sapien
tcagagataaatcagcgcgcgaaag

SEQ ID NO: 55307 - DNA, 25 bp, Homo sapien
ctcagagataaatcagcgcgcgaaa

SEQ ID NO: 55308 - DNA, 25 bp, Homo sapien
aggccttgtgcgagcgtcccactgc

SEQ ID NO: 55309 - DNA, 25 bp, Homo sapien
acagcagcgcattcgcgggacgaga

SEQ ID NO: 55310 - DNA, 25 bp, Homo sapien
gaattgcgggcgtcactctgctcct

SEQ ID NO: 55311 - DNA, 25 bp, Homo sapien
acagcttggagatagggcccggaat

SEQ ID NO: 55312 - DNA, 25 bp, Homo sapien
aggcccaactcgctgtggttgctcc

SEQ ID NO: 55313 - DNA, 25 bp, Homo sapien
ttcagaggcccaactcgctgtggtt

SEQ ID NO: 55314 - DNA, 25 bp, Homo sapien
ccacctggttgggacagtagaagag

SEQ ID NO: 55315 - DNA, 25 bp, Homo sapien
ccagcgagcattcagaggcccaact

SEQ ID NO: 55316 - DNA, 25 bp, Homo sapien
ccatcgtccggtgggcgcctgggac

SEQ ID NO: 55317 - DNA, 25 bp, Homo sapien
tgatcccatcgtccggtgggcgcct

SEQ ID NO: 55318 - DNA, 25 bp, Homo sapien
gatcccatcgtccggtgggcgcctg

SEQ ID NO: 55319 - DNA, 25 bp, Homo sapien
atcccatcgtccggtgggcgcctgg

SEQ ID NO: 55320 - DNA, 25 bp, Homo sapien
cccatcgtccggtgggcgcctggga

SEQ ID NO: 55321 - DNA, 25 bp, Homo sapien
ggtgggcgcctgggacctcccgcag

SEQ ID NO: 55322 - DNA, 25 bp, Homo sapien
gtgatcccatcgtccggtgggcgcc

SEQ ID NO: 55323 - DNA, 25 bp, Homo sapien
tcccatcgtccggtgggcgcctggg

SEQ ID NO: 55324 - DNA, 25 bp, Homo sapien
agaggcctcaccctatattcctgac

SEQ ID NO: 55325 - DNA, 25 bp, Homo sapien
gcaccctggcacttcagctgcatgg

SEQ ID NO: 55326 - DNA, 25 bp, Homo sapien
agacttcacaagcaccctggcactt

SEQ ID NO: 55327 - DNA, 25 bp, Homo sapien
ggcttagacttcacaagcaccctgg

SEQ ID NO: 55328 - DNA, 25 bp, Homo sapien
gccagacaagggcttagacttcaca

SEQ ID NO: 55329 - DNA, 25 bp, Homo sapien
ttcctgacaaatgccagacaagggc

SEQ ID NO: 55330 - DNA, 25 bp, Homo sapien
ggcctcaccctatattcctgacaaa

SEQ ID NO: 55331 - DNA, 25 bp, Homo sapien
ccctggcacttcagctgcatggtgg

SEQ ID NO: 55332 - DNA, 25 bp, Homo sapien
tcagaggcaaatcagcgcgccaaag

SEQ ID NO: 55333 - DNA, 25 bp, Homo sapien
ctcagaggcaaatcagcgcgccaaa

SEQ ID NO: 55334 - DNA, 25 bp, Homo sapien
gcgagcttcgtcctgcgcgccacca

SEQ ID NO: 55335 - DNA, 25 bp, Homo sapien
ccgcgccgcgagcttcgtcctgcgc

SEQ ID NO: 55336 - DNA, 25 bp, Homo sapien
cacggtgggctcgggataccgtcct

SEQ ID NO: 55337 - DNA, 25 bp, Homo sapien
tcacctgcgtagcacggtgggctcg

SEQ ID NO: 55338 - DNA, 25 bp, Homo sapien
ctcacctgcgtagcacggtgggctc

SEQ ID NO: 55339 - DNA, 25 bp, Homo sapien
agaggcaaatcagcgcgccaaagtg

SEQ ID NO: 55340 - DNA, 25 bp, Homo sapien
ctagacagcacacgaccatctggtg

SEQ ID NO: 55341 - DNA, 25 bp, Homo sapien
ttatggactgcgcacaaagtgcccg

SEQ ID NO: 55342 - DNA, 25 bp, Homo sapien
attagctaattaaagccatggcgga

SEQ ID NO: 55343 - DNA, 25 bp, Homo sapien
gaccatctggtgtgtggcacgtcct

SEQ ID NO: 55344 - DNA, 25 bp, Homo sapien
ggactcctctcctggacgggccatt

SEQ ID NO: 55345 - DNA, 25 bp, Homo sapien
acgggccattgcagccctctcgggt

SEQ ID NO: 55346 - DNA, 25 bp, Homo sapien
tttcttcgggccctttgtggcctca

SEQ ID NO: 55347 - DNA, 25 bp, Homo sapien
cctctcgggtgtgaaatgcaattta

SEQ ID NO: 55348 - DNA, 25 bp, Homo sapien
ccgcgcttcctgatgagttcgtcca

SEQ ID NO: 55349 - DNA, 25 bp, Homo sapien
gcctcgagctccactaggccgagga

SEQ ID NO: 55350 - DNA, 25 bp, Homo sapien
gttcgtccagggagatgtccgccat

SEQ ID NO: 55351 - DNA, 25 bp, Homo sapien
ctccgccgagcaagccgaaagcagt

SEQ ID NO: 55352 - DNA, 25 bp, Homo sapien
cgctagggagcgacgaactacttcc

SEQ ID NO: 55353 - DNA, 25 bp, Homo sapien
tcgcgacagccagctcaaagcaggc

SEQ ID NO: 55354 - DNA, 25 bp, Homo sapien
tcaggtccacgaggcggcaccctgt

SEQ ID NO: 55355 - DNA, 25 bp, Homo sapien
cggtgctggctgctcatctgcatac

SEQ ID NO: 55356 - DNA, 25 bp, Homo sapien
gttcgccgccataaaggaagcaaga

SEQ ID NO: 55357 - DNA, 25 bp, Homo sapien
cccccggatgggagcgagaataaga

SEQ ID NO: 55358 - DNA, 25 bp, Homo sapien
ggccgggttaaatgctgcggtctca

SEQ ID NO: 55359 - DNA, 25 bp, Homo sapien
aatgctgcggtctcagcacggcccg

SEQ ID NO: 55360 - DNA, 25 bp, Homo sapien
agtagcggtcaccacgtagctcgcc

SEQ ID NO: 55361 - DNA, 25 bp, Homo sapien
ccagggcgtaagtagcggtcaccac

SEQ ID NO: 55362 - DNA, 25 bp, Homo sapien
ccgctgcagactgccagggcgtaag

SEQ ID NO: 55363 - DNA, 25 bp, Homo sapien
tccgcctgcttctgccggggatgga

SEQ ID NO: 55364 - DNA, 25 bp, Homo sapien
agacgggtgattcttgtgagggcac

SEQ ID NO: 55365 - DNA, 25 bp, Homo sapien
gggtccagccggctccatccgaaat

SEQ ID NO: 55366 - DNA, 25 bp, Homo sapien
cgcttgatgtcaggttccggcctcc

SEQ ID NO: 55367 - DNA, 25 bp, Homo sapien
aatctccactcccaccggcttcggc

SEQ ID NO: 55368 - DNA, 25 bp, Homo sapien
ctctggatccgggtctgcctcgagg

SEQ ID NO: 55369 - DNA, 25 bp, Homo sapien
ttcaggttccttcgagtccgtgtcc

SEQ ID NO: 55370 - DNA, 25 bp, Homo sapien
caggcgccctctggatccgggtctg

SEQ ID NO: 55371 - DNA, 25 bp, Homo sapien
ggaggtgttcaggttccttcgagtc

SEQ ID NO: 55372 - DNA, 25 bp, Homo sapien
tggtccacgaagtcccgcatgcaca

SEQ ID NO: 55373 - DNA, 25 bp, Homo sapien
gctcctcggggttgatgtcctcaaa

SEQ ID NO: 55374 - DNA, 25 bp, Homo sapien
gctgcggatggaacaccacttcttg

SEQ ID NO: 55375 - DNA, 25 bp, Homo sapien
cacttcttgaagacccgcgtgagca

SEQ ID NO: 55376 - DNA, 25 bp, Homo sapien
gtcaggttccgcaggttcttgagaa

SEQ ID NO: 55377 - DNA, 25 bp, Homo sapien
atccagccgttgtagtggtccacga

SEQ ID NO: 55378 - DNA, 25 bp, Homo sapien
tgtccaggtagatgccgccgaactt

SEQ ID NO: 55379 - DNA, 25 bp, Homo sapien
ggaagccctttcatcaggaccagca

SEQ ID NO: 55380 - DNA, 25 bp, Homo sapien
aatgtcgcctccagaacaggtggcc

SEQ ID NO: 55381 - DNA, 25 bp, Homo sapien
gccgccagtattacgggttaccatc

SEQ ID NO: 55382 - DNA, 25 bp, Homo sapien
cttcccgcttctgggcaggtccaaa

SEQ ID NO: 55383 - DNA, 25 bp, Homo sapien
ttctgggcaggtccaaatcctcacc

SEQ ID NO: 55384 - DNA, 25 bp, Homo sapien
ttcgtgcgcgcacaaatgtcgcctc

SEQ ID NO: 55385 - DNA, 25 bp, Homo sapien
ctcgtacctctagctccagcggcgg

SEQ ID NO: 55386 - DNA, 25 bp, Homo sapien
tccgcgccgccagtattacgggtta

SEQ ID NO: 55387 - DNA, 25 bp, Homo sapien
acggaggagcgcgactcacccacgg

SEQ ID NO: 55388 - DNA, 25 bp, Homo sapien
cgtaaccacgcagagcgggacgttc

SEQ ID NO: 55389 - DNA, 25 bp, Homo sapien
cgctgtgctcctgttttcggcgaga

SEQ ID NO: 55390 - DNA, 25 bp, Homo sapien
ttcggcgagaccaatgactcacgcg

SEQ ID NO: 55391 - DNA, 25 bp, Homo sapien
tcacgcgagcaaaatgataagaacc

SEQ ID NO: 55392 - DNA, 25 bp, Homo sapien
ctgatgtctggctgccgccatccgt

SEQ ID NO: 55393 - DNA, 25 bp, Homo sapien
tggtcctgtgtaaatccatcccggg

SEQ ID NO: 55394 - DNA, 25 bp, Homo sapien
catcccgggacgcagtgcaaacaat

SEQ ID NO: 55395 - DNA, 25 bp, Homo sapien
caatggtctctgagcccacgtaacc

SEQ ID NO: 55396 - DNA, 25 bp, Homo sapien
gcctaacgggctgcttccatggaaa

SEQ ID NO: 55397 - DNA, 25 bp, Homo sapien
agagtcgacgaaaagcggctaccgc

SEQ ID NO: 55398 - DNA, 25 bp, Homo sapien
gctaccgcctcagcaggagcgacga

SEQ ID NO: 55399 - DNA, 25 bp, Homo sapien
gctgccataggatccaccaacgttt

SEQ ID NO: 55400 - DNA, 25 bp, Homo sapien
gtcgatcgccatttcgcctaacggg

SEQ ID NO: 55401 - DNA, 25 bp, Homo sapien
ccgctaccttgttagtgggcaccga

SEQ ID NO: 55402 - DNA, 25 bp, Homo sapien
caacgtttcgcctggtcgatcgcca

SEQ ID NO: 55403 - DNA, 25 bp, Homo sapien
tggcccagccaaccggtaagagtcg

SEQ ID NO: 55404 - DNA, 25 bp, Homo sapien
agacactcgtgctgcgggtaagacc

SEQ ID NO: 55405 - DNA, 25 bp, Homo sapien
ctgagtcacgtgaaacacaggttcc

SEQ ID NO: 55406 - DNA, 25 bp, Homo sapien
ttgtgcacaagtaacacgacgactg

SEQ ID NO: 55407 - DNA, 25 bp, Homo sapien
cgacgactgaaatctgcaactactg

SEQ ID NO: 55408 - DNA, 25 bp, Homo sapien
tctgcaactactgcaaagacgcggg

SEQ ID NO: 55409 - DNA, 25 bp, Homo sapien
agacgcgggcacttttacagtgttc

SEQ ID NO: 55410 - DNA, 25 bp, Homo sapien
ttctgctacggagccaggacaaagg

SEQ ID NO: 55411 - DNA, 25 bp, Homo sapien
gcgggcactgctgagtcacgtgaaa

SEQ ID NO: 55412 - DNA, 25 bp, Homo sapien
taaatcgcgtccctccaaaagtcgc

SEQ ID NO: 55413 - DNA, 25 bp, Homo sapien
gggtggcgcagattactctcccaaa

SEQ ID NO: 55414 - DNA, 25 bp, Homo sapien
tcctgtcaatcaaacggggagtgcc

SEQ ID NO: 55415 - DNA, 25 bp, Homo sapien
ggacgcgcattggtgacttctcctg

SEQ ID NO: 55416 - DNA, 25 bp, Homo sapien
taccgcttttgctccggcagcactg

SEQ ID NO: 55417 - DNA, 25 bp, Homo sapien
gtctcggattcccagctttctccta

SEQ ID NO: 55418 - DNA, 25 bp, Homo sapien
gcctaacctctgcacgtctcggatt

SEQ ID NO: 55419 - DNA, 25 bp, Homo sapien
ggctctgtccattggctaccggaca

SEQ ID NO: 55420 - DNA, 25 bp, Homo sapien
cgcctcgcggactgggctcagaacc

SEQ ID NO: 55421 - DNA, 25 bp, Homo sapien
aggtgagtgtccacgcggcgccaga

SEQ ID NO: 55422 - DNA, 25 bp, Homo sapien
agtaggtggaggtatcgggccgcct

SEQ ID NO: 55423 - DNA, 25 bp, Homo sapien
ggtaccgagagtaggtggaggtatc

SEQ ID NO: 55424 - DNA, 25 bp, Homo sapien
tgcagaaacgcgggtaccgagagta

SEQ ID NO: 55425 - DNA, 25 bp, Homo sapien
cttcccgggtaagttgacggcgatg

SEQ ID NO: 55426 - DNA, 25 bp, Homo sapien
cagagcggggtggttcgcccctcct

SEQ ID NO: 55427 - DNA, 25 bp, Homo sapien
tccgcctgacccctatgatgaagag

SEQ ID NO: 55428 - DNA, 25 bp, Homo sapien
gtagcagagcccagccattcgcggg

SEQ ID NO: 55429 - DNA, 25 bp, Homo sapien
agagcccagccattcgcgggtgccc

SEQ ID NO: 55430 - DNA, 25 bp, Homo sapien
tcctgtagcagagcccagccattcg

SEQ ID NO: 55431 - DNA, 25 bp, Homo sapien
aggctgcctcctgtagcagagccca

SEQ ID NO: 55432 - DNA, 25 bp, Homo sapien
gaaggctgcctcctgtagcagagcc

SEQ ID NO: 55433 - DNA, 25 bp, Homo sapien
aggaaggctgcctcctgtagcagag

SEQ ID NO: 55434 - DNA, 25 bp, Homo sapien
cgcggccgcacgcagaggaaggctg

SEQ ID NO: 55435 - DNA, 25 bp, Homo sapien
gagcccggggcaccatagcacagcg

SEQ ID NO: 55436 - DNA, 25 bp, Homo sapien
acctgaaggttgtgcacctggattg

SEQ ID NO: 55437 - DNA, 25 bp, Homo sapien
caagagctggctcagatcagggtct

SEQ ID NO: 55438 - DNA, 25 bp, Homo sapien
agtttccatggagatcgggtgccca

SEQ ID NO: 55439 - DNA, 25 bp, Homo sapien
catcttttgtgggatcagggtgccc

SEQ ID NO: 55440 - DNA, 25 bp, Homo sapien
ccagcatcttggaggcccactgagg

SEQ ID NO: 55441 - DNA, 25 bp, Homo sapien
ggggcgcggtttaacctctagcatc

SEQ ID NO: 55442 - DNA, 25 bp, Homo sapien
acctctagcatcagggacttaggcc

SEQ ID NO: 55443 - DNA, 25 bp, Homo sapien
caggagggttctgcacctgaaggtt

SEQ ID NO: 55444 - DNA, 25 bp, Homo sapien
tgcagcgctgcgagctcaaccggca

SEQ ID NO: 55445 - DNA, 25 bp, Homo sapien
caaccggcacacgacggaggcggcc

SEQ ID NO: 55446 - DNA, 25 bp, Homo sapien
tggggctgtacaaccggctgctgca

SEQ ID NO: 55447 - DNA, 25 bp, Homo sapien
cagatcgtggggctgtacaaccggc

SEQ ID NO: 55448 - DNA, 25 bp, Homo sapien
caccttcgcggaggtgtccaaggac

SEQ ID NO: 55449 - DNA, 25 bp, Homo sapien
ccgatgcgctcaccttcgcggaggt

SEQ ID NO: 55450 - DNA, 25 bp, Homo sapien
gaacatcacggcaggcgaccgcagg

SEQ ID NO: 55451 - DNA, 25 bp, Homo sapien
cggggcgctgcagaacatcacggca

SEQ ID NO: 55452 - DNA, 25 bp, Homo sapien
gcggatccggcaagcagcatctgaa

SEQ ID NO: 55453 - DNA, 25 bp, Homo sapien
tgaaccgcattttcgcagccgcgta

SEQ ID NO: 55454 - DNA, 25 bp, Homo sapien
aggacctcacctgtgggctcagagc

SEQ ID NO: 55455 - DNA, 25 bp, Homo sapien
ctcgcaggagtacgcagccgactgc

SEQ ID NO: 55456 - DNA, 25 bp, Homo sapien
gcgctgcactctacttccagggcgg

SEQ ID NO: 55457 - DNA, 25 bp, Homo sapien
cggcgctgcgactatttccggagtc

SEQ ID NO: 55458 - DNA, 25 bp, Homo sapien
gctcctttgggctccatacctcggg

SEQ ID NO: 55459 - DNA, 25 bp, Homo sapien
gcacgaggtaagtcataggaactca

SEQ ID NO: 55460 - DNA, 25 bp, Homo sapien
ccgcctggaagctttctgatttctc

SEQ ID NO: 55461 - DNA, 25 bp, Homo sapien
agctttctgatttctctgttcgccc

SEQ ID NO: 55462 - DNA, 25 bp, Homo sapien
aagctttctgatttctctgttcgcc

SEQ ID NO: 55463 - DNA, 25 bp, Homo sapien
ggaagctttctgatttctctgttcg

SEQ ID NO: 55464 - DNA, 25 bp, Homo sapien
tggaagctttctgatttctctgttc

SEQ ID NO: 55465 - DNA, 25 bp, Homo sapien
gcctggaagctttctgatttctctg

SEQ ID NO: 55466 - DNA, 25 bp, Homo sapien
cgcctggaagctttctgatttctct

SEQ ID NO: 55467 - DNA, 25 bp, Homo sapien
cccgcctggaagctttctgatttct

SEQ ID NO: 55468 - DNA, 25 bp, Homo sapien
gacgcccagaaagtccggaacagga

SEQ ID NO: 55469 - DNA, 25 bp, Homo sapien
gcatgcgaccttgtttggtaaattg

SEQ ID NO: 55470 - DNA, 25 bp, Homo sapien
gacgtctcgggactccggctccgaa

SEQ ID NO: 55471 - DNA, 25 bp, Homo sapien
cggaacaggaacgtgcacacggagc

SEQ ID NO: 55472 - DNA, 25 bp, Homo sapien
acagtcctccagtgcggcttccggg

SEQ ID NO: 55473 - DNA, 25 bp, Homo sapien
gcccaggttttaccgctccagcaag

SEQ ID NO: 55474 - DNA, 25 bp, Homo sapien
gggtggcttacagacgctgccagca

SEQ ID NO: 55475 - DNA, 25 bp, Homo sapien
cgcagacacgaagcctcccgggtgg

SEQ ID NO: 55476 - DNA, 25 bp, Homo sapien
ctcaccgagggctgcaggtgatgta

SEQ ID NO: 55477 - DNA, 25 bp, Homo sapien
atgccacgaagatcgcgggctgaca

SEQ ID NO: 55478 - DNA, 25 bp, Homo sapien
cccgggaagagcagcacggagcact

SEQ ID NO: 55479 - DNA, 25 bp, Homo sapien
ccggacgctcatggtcggacacctg

SEQ ID NO: 55480 - DNA, 25 bp, Homo sapien
tggtccctgacgcatttcctgccgg

SEQ ID NO: 55481 - DNA, 25 bp, Homo sapien
aaaggttccgcagacgctggttccg

SEQ ID NO: 55482 - DNA, 25 bp, Homo sapien
atgtagtttctcgacagcggccagc

SEQ ID NO: 55483 - DNA, 25 bp, Homo sapien
ctcagttccagcaggtcgtagccca

SEQ ID NO: 55484 - DNA, 25 bp, Homo sapien
aatcccaggcggaactcccttgagg

SEQ ID NO: 55485 - DNA, 25 bp, Homo sapien
tcccttgagggtctcagaatatctg

SEQ ID NO: 55486 - DNA, 25 bp, Homo sapien
agaatatctgggagacctcgggctc

SEQ ID NO: 55487 - DNA, 25 bp, Homo sapien
tcgggctcttgatctccgagacacc

SEQ ID NO: 55488 - DNA, 25 bp, Homo sapien
ccgtttcgtagtggagaacagtcca

SEQ ID NO: 55489 - DNA, 25 bp, Homo sapien
gaacagtccagatcggggaagttta

SEQ ID NO: 55490 - DNA, 25 bp, Homo sapien
cctcgattcccagtgcggggctcag

SEQ ID NO: 55491 - DNA, 25 bp, Homo sapien
gcgttgcagcctagacgggtcttac

SEQ ID NO: 55492 - DNA, 25 bp, Homo sapien
ttccacagtgggtgctcatggagga

SEQ ID NO: 55493 - DNA, 25 bp, Homo sapien
ccatggagcacaccgatgccgtgtc

SEQ ID NO: 55494 - DNA, 25 bp, Homo sapien
caccgatgccgtgtctgggacttac

SEQ ID NO: 55495 - DNA, 25 bp, Homo sapien
tgccgtgtctgggacttaccacctt

SEQ ID NO: 55496 - DNA, 25 bp, Homo sapien
ccgctgctggaagtagctgacaaac

SEQ ID NO: 55497 - DNA, 25 bp, Homo sapien
cagctcagtgcgcaggttgaaggtt

SEQ ID NO: 55498 - DNA, 25 bp, Homo sapien
tcctgcaccacggtttccacagtgg

SEQ ID NO: 55499 - DNA, 25 bp, Homo sapien
agctgacaaactggggcagctcagt

SEQ ID NO: 55500 - DNA, 25 bp, Homo sapien
ctctgggtggctcaccgcggctccc

SEQ ID NO: 55501 - DNA, 25 bp, Homo sapien
cagcgccgcgaactcggccaaggcc

SEQ ID NO: 55502 - DNA, 25 bp, Homo sapien
gagcgctcttccctgtcccgcgccg

SEQ ID NO: 55503 - DNA, 25 bp, Homo sapien
cgggcccgggcagatcagggccgca

SEQ ID NO: 55504 - DNA, 25 bp, Homo sapien
atcagggccgcaggtaccccggtct

SEQ ID NO: 55505 - DNA, 25 bp, Homo sapien
tgctgtcactcttcggcccccaact

SEQ ID NO: 55506 - DNA, 25 bp, Homo sapien
ccgctccagagctgcccaggacgcg

SEQ ID NO: 55507 - DNA, 25 bp, Homo sapien
aactccacgccgctccagagctgcc

SEQ ID NO: 55508 - DNA, 25 bp, Homo sapien
ctgcgaccgcgcctgtggtttggct

SEQ ID NO: 55509 - DNA, 25 bp, Homo sapien
atggtggctgagcttttctcgctca

SEQ ID NO: 55510 - DNA, 25 bp, Homo sapien
gctgagcttttctcgctcagcgcgc

SEQ ID NO: 55511 - DNA, 25 bp, Homo sapien
ggtgcctacgtatagggcgctgtca

SEQ ID NO: 55512 - DNA, 25 bp, Homo sapien
atagggcgctgtcaggaccggaaaa

SEQ ID NO: 55513 - DNA, 25 bp, Homo sapien
gcgctgtcaggaccggaaaaggccc

SEQ ID NO: 55514 - DNA, 25 bp, Homo sapien
tgaggcggcgcttctgtgcctgcac

SEQ ID NO: 55515 - DNA, 25 bp, Homo sapien
gcacctgatggtggctgagcttttc

SEQ ID NO: 55516 - DNA, 25 bp, Homo sapien
ggactcgatgtagccggtgtagtca

SEQ ID NO: 55517 - DNA, 25 bp, Homo sapien
ggtgtagtcaccaagctcgccgccg

SEQ ID NO: 55518 - DNA, 25 bp, Homo sapien
actcttcctcatgaccagaacatcg

SEQ ID NO: 55519 - DNA, 25 bp, Homo sapien
ccgcactcatcctcgatgggcagga

SEQ ID NO: 55520 - DNA, 25 bp, Homo sapien
aggaagatctcagggaccacgatga

SEQ ID NO: 55521 - DNA, 25 bp, Homo sapien
accacgatgaggatcctgcgctttg

SEQ ID NO: 55522 - DNA, 25 bp, Homo sapien
cgcattcagcgttggctgggtagtc

SEQ ID NO: 55523 - DNA, 25 bp, Homo sapien
gcgcgatgtgccagacgcattcagc

SEQ ID NO: 55524 - DNA, 25 bp, Homo sapien
cacatctggaagcacagcgggcgta

SEQ ID NO: 55525 - DNA, 25 bp, Homo sapien
ccgagtcggacagcatcacgggatg

SEQ ID NO: 55526 - DNA, 25 bp, Homo sapien
atgagcagtgcacacgccacacgca

SEQ ID NO: 55527 - DNA, 25 bp, Homo sapien
gcaatccttcccgttccagtggagc

SEQ ID NO: 55528 - DNA, 25 bp, Homo sapien
ctgcccttggtgttgacgcagccct

SEQ ID NO: 55529 - DNA, 25 bp, Homo sapien
acagacgcactcgtagctgcccttg

SEQ ID NO: 55530 - DNA, 25 bp, Homo sapien
ctggtcacagctcccgttgctcatg

SEQ ID NO: 55531 - DNA, 25 bp, Homo sapien
gttgctcatgctgcactcgtccaca

SEQ ID NO: 55532 - DNA, 25 bp, Homo sapien
cggactttctgaccaaccaggagca

SEQ ID NO: 55533 - DNA, 25 bp, Homo sapien
gcttcatgcagatgagcgcggcctc

SEQ ID NO: 55534 - DNA, 25 bp, Homo sapien
tggcccgctttcttctccaaacaga

SEQ ID NO: 55535 - DNA, 25 bp, Homo sapien
ggtcaccctcgcctttcatgacaga

SEQ ID NO: 55536 - DNA, 25 bp, Homo sapien
ccgcgtttaattgcgcctttgcaga

SEQ ID NO: 55537 - DNA, 25 bp, Homo sapien
cagatggccgcggaaatgctaattt

SEQ ID NO: 55538 - DNA, 25 bp, Homo sapien
tccggcgagctttaatgcgcgcaca

SEQ ID NO: 55539 - DNA, 25 bp, Homo sapien
ggaagcgcgcttctctcttttcatt

SEQ ID NO: 55540 - DNA, 25 bp, Homo sapien
gagcgaccttaacggattagcacct

SEQ ID NO: 55541 - DNA, 25 bp, Homo sapien
cgcatgcaaagaacgggcgcgagtg

SEQ ID NO: 55542 - DNA, 25 bp, Homo sapien
catgcaaagaacgggcgcgagtgac

SEQ ID NO: 55543 - DNA, 25 bp, Homo sapien
atgcaaagaacgggcgcgagtgaca

SEQ ID NO: 55544 - DNA, 25 bp, Homo sapien
cgcgagtgacagagcgaccttaacg

SEQ ID NO: 55545 - DNA, 25 bp, Homo sapien
agagcgaccttaacggattagcacc

SEQ ID NO: 55546 - DNA, 25 bp, Homo sapien
gcgaccttaacggattagcacctta

SEQ ID NO: 55547 - DNA, 25 bp, Homo sapien
aggagaagcgagcagtttcttctgt

SEQ ID NO: 55548 - DNA, 25 bp, Homo sapien
cccgccatccgtgggcagtgaaacg

SEQ ID NO: 55549 - DNA, 25 bp, Homo sapien
agcagactcgcctgcgctgccgttt

SEQ ID NO: 55550 - DNA, 25 bp, Homo sapien
ctgccgtttgctggacgtttcttga

SEQ ID NO: 55551 - DNA, 25 bp, Homo sapien
cttgagcacctactggggaccgagt

SEQ ID NO: 55552 - DNA, 25 bp, Homo sapien
ggggaaacctcgtgaagatcacttg

SEQ ID NO: 55553 - DNA, 25 bp, Homo sapien
ctcgtcaaaggacagtggcccgtca

SEQ ID NO: 55554 - DNA, 25 bp, Homo sapien
tggcccgtcagtgtgcttgtcacgg

SEQ ID NO: 55555 - DNA, 25 bp, Homo sapien
ctgatgagctgacagcgcgcgctca

SEQ ID NO: 55556 - DNA, 25 bp, Homo sapien
ctgcggaggccacggatccggaggt

SEQ ID NO: 55557 - DNA, 25 bp, Homo sapien
caaggaggctcggagcctcgcggcg

SEQ ID NO: 55558 - DNA, 25 bp, Homo sapien
cccacgaaggaggagtctggctccc

SEQ ID NO: 55559 - DNA, 25 bp, Homo sapien
aggagtctggctcccacttgcagcc

SEQ ID NO: 55560 - DNA, 25 bp, Homo sapien
ctcccacttgcagcctcggacgcgc

SEQ ID NO: 55561 - DNA, 25 bp, Homo sapien
caggggcgcccgcaaagttactttg

SEQ ID NO: 55562 - DNA, 25 bp, Homo sapien
cgcaaagttactttggccgcctttg

SEQ ID NO: 55563 - DNA, 25 bp, Homo sapien
aaggaggagtctggctcccacttgc

SEQ ID NO: 55564 - DNA, 25 bp, Homo sapien
accactgcatcgctcgcgtgctgtg

SEQ ID NO: 55565 - DNA, 25 bp, Homo sapien
tgctgttttgaggaccgggtgtaaa

SEQ ID NO: 55566 - DNA, 25 bp, Homo sapien
cgggtgtaaacgcttcctagctcaa

SEQ ID NO: 55567 - DNA, 25 bp, Homo sapien
agtccctttggtgcagagcggttct

SEQ ID NO: 55568 - DNA, 25 bp, Homo sapien
ctgctgcggctccataaatattaaa

SEQ ID NO: 55569 - DNA, 25 bp, Homo sapien
aatgcagcatttcagcgcggagcgc

SEQ ID NO: 55570 - DNA, 25 bp, Homo sapien
agtttcccggatttctctgagcagg

SEQ ID NO: 55571 - DNA, 25 bp, Homo sapien
gagaatgctcgcctcctcgcacggt

SEQ ID NO: 55572 - DNA, 25 bp, Homo sapien
cgctctaggtgggatgccagcgtcc

SEQ ID NO: 55573 - DNA, 25 bp, Homo sapien
agtcccacgtgatggccgctcggcg

SEQ ID NO: 55574 - DNA, 25 bp, Homo sapien
ggcattctcccagtcccacgtgatg

SEQ ID NO: 55575 - DNA, 25 bp, Homo sapien
gcggcctgggcatggcattctccca

SEQ ID NO: 55576 - DNA, 25 bp, Homo sapien
ccagcgtcctgaaggcggaggccct

SEQ ID NO: 55577 - DNA, 25 bp, Homo sapien
tccgtctcctcagtctgtttccagg

SEQ ID NO: 55578 - DNA, 25 bp, Homo sapien
acagccggctcatcatcgaggtgga

SEQ ID NO: 55579 - DNA, 25 bp, Homo sapien
ctcagtctgtttccaggtctggcgg

SEQ ID NO: 55580 - DNA, 25 bp, Homo sapien
tccatggcctcctgatccgcagtgt

SEQ ID NO: 55581 - DNA, 25 bp, Homo sapien
acccgcttcgtctgcgtctctgata

SEQ ID NO: 55582 - DNA, 25 bp, Homo sapien
tctgatacccactcgaggacggacc

SEQ ID NO: 55583 - DNA, 25 bp, Homo sapien
tccagatgccgtacggcgacgtgct

SEQ ID NO: 55584 - DNA, 25 bp, Homo sapien
atccacgctggggacttcactgagc

SEQ ID NO: 55585 - DNA, 25 bp, Homo sapien
cccgagcgaggtgaagaagttcaac

SEQ ID NO: 55586 - DNA, 25 bp, Homo sapien
caacgagtggctgggtaggtccctc

SEQ ID NO: 55587 - DNA, 25 bp, Homo sapien
tgatccgcagtgtcatctctccctg

SEQ ID NO: 55588 - DNA, 25 bp, Homo sapien
gcagtcgctgactggagaatgagcc

SEQ ID NO: 55589 - DNA, 25 bp, Homo sapien
ccaccgaactgcatagggccgtgta

SEQ ID NO: 55590 - DNA, 25 bp, Homo sapien
ttctcagggcagtgagacccacgga

SEQ ID NO: 55591 - DNA, 25 bp, Homo sapien
tgcccattcggcgtctctaggacgc

SEQ ID NO: 55592 - DNA, 25 bp, Homo sapien
ctctaggacgctgttgcccgagaga

SEQ ID NO: 55593 - DNA, 25 bp, Homo sapien
cgcctggcaagaagctgagctgtga

SEQ ID NO: 55594 - DNA, 25 bp, Homo sapien
tttctgttacgtgggctttagcgcg

SEQ ID NO: 55595 - DNA, 25 bp, Homo sapien
agaatgagcctacgcgcctggcaag

SEQ ID NO: 55596 - DNA, 25 bp, Homo sapien
acttggggtaggtgacgatccacac

SEQ ID NO: 55597 - DNA, 25 bp, Homo sapien
gtctgcagcctcctcagtcgtgcgt

SEQ ID NO: 55598 - DNA, 25 bp, Homo sapien
cgcaccgggaagttggcgatctcct

SEQ ID NO: 55599 - DNA, 25 bp, Homo sapien
gcagccgcacgccatggaactcgaa

SEQ ID NO: 55600 - DNA, 25 bp, Homo sapien
ggaactcgaagtacttgctctcgaa

SEQ ID NO: 55601 - DNA, 25 bp, Homo sapien
ggcagctccgcaggcgtgacgtcat

SEQ ID NO: 55602 - DNA, 25 bp, Homo sapien
ctccgcgggtatgacgtcatggcgc

SEQ ID NO: 55603 - DNA, 25 bp, Homo sapien
ctcagtcgtgcgtgcgttcattccg

SEQ ID NO: 55604 - DNA, 25 bp, Homo sapien
cccactccagttgtgcgccaggtgt

SEQ ID NO: 55605 - DNA, 25 bp, Homo sapien
accgacttgccgcagacgatgctga

SEQ ID NO: 55606 - DNA, 25 bp, Homo sapien
acgatgctgactgcgttgagcgccc

SEQ ID NO: 55607 - DNA, 25 bp, Homo sapien
cccagacgaggaaccgtagatgcgg

SEQ ID NO: 55608 - DNA, 25 bp, Homo sapien
cgccggagaaggacaggttccatct

SEQ ID NO: 55609 - DNA, 25 bp, Homo sapien
tcctcctctaagaagcccatggcgg

SEQ ID NO: 55610 - DNA, 25 bp, Homo sapien
gtcactccgtgacccgggatagggc

SEQ ID NO: 55611 - DNA, 25 bp, Homo sapien
tctgggctcgatccgctttcattaa

SEQ ID NO: 55612 - DNA, 25 bp, Homo sapien
gggctgtcgggacatctgtcttcta

SEQ ID NO: 55613 - DNA, 25 bp, Homo sapien
gtcgcccgacgcagaatgaactcct

SEQ ID NO: 55614 - DNA, 25 bp, Homo sapien
gaactcctcggcatcgctttgaatc

SEQ ID NO: 55615 - DNA, 25 bp, Homo sapien
tgtcgacgcggatttgccatatggt

SEQ ID NO: 55616 - DNA, 25 bp, Homo sapien
tgctcgcctgaaaggcccataaatc

SEQ ID NO: 55617 - DNA, 25 bp, Homo sapien
tgcgggacattctgcgcctgaatga

SEQ ID NO: 55618 - DNA, 25 bp, Homo sapien
attagctggctatctcttggagtta

SEQ ID NO: 55619 - DNA, 25 bp, Homo sapien
ccgggctcacatatggttgctaatt

SEQ ID NO: 55620 - DNA, 25 bp, Homo sapien
gcccgtgcatgaagggagaccctca

SEQ ID NO: 55621 - DNA, 25 bp, Homo sapien
ccgccggctcatttgcatggtccga

SEQ ID NO: 55622 - DNA, 25 bp, Homo sapien
atgccctggccgagacactgaggca

SEQ ID NO: 55623 - DNA, 25 bp, Homo sapien
gatcaggacccgagccgattcccga

SEQ ID NO: 55624 - DNA, 25 bp, Homo sapien
acgcgcgcatgttgttcggcgcttc

SEQ ID NO: 55625 - DNA, 25 bp, Homo sapien
gccgatttgccctgggccggacaaa

SEQ ID NO: 55626 - DNA, 25 bp, Homo sapien
cctctggggattgagggactcaaga

SEQ ID NO: 55627 - DNA, 25 bp, Homo sapien
ggcttcctgggcttctaccacgtcg

SEQ ID NO: 55628 - DNA, 25 bp, Homo sapien
gatgtcagtgaacgctcttcgcttg

SEQ ID NO: 55629 - DNA, 25 bp, Homo sapien
cgccagcagcttcgcggatgtcagt

SEQ ID NO: 55630 - DNA, 25 bp, Homo sapien
ggccagcgagtcttgcagaccttcg

SEQ ID NO: 55631 - DNA, 25 bp, Homo sapien
cggtgagacccgactactgcagctc

SEQ ID NO: 55632 - DNA, 25 bp, Homo sapien
gaacatccgggtcacaggcgcataa

SEQ ID NO: 55633 - DNA, 25 bp, Homo sapien
tcttcgcttgcgcagtcagaacgtc

SEQ ID NO: 55634 - DNA, 25 bp, Homo sapien
cagcaggacttgagtgacacccaac

SEQ ID NO: 55635 - DNA, 25 bp, Homo sapien
tctgatctctttcaggcgccaacgc

SEQ ID NO: 55636 - DNA, 25 bp, Homo sapien
ccgtctctcgaggaaacgcggttca

SEQ ID NO: 55637 - DNA, 25 bp, Homo sapien
gttcccgtgtaccagacatgatgta

SEQ ID NO: 55638 - DNA, 25 bp, Homo sapien
ccagtgtctgcgagtctccgtgttt

SEQ ID NO: 55639 - DNA, 25 bp, Homo sapien
ttcactcaacagtatggcccgcgtg

SEQ ID NO: 55640 - DNA, 25 bp, Homo sapien
cagcgtggatgtggtttgctttcac

SEQ ID NO: 55641 - DNA, 25 bp, Homo sapien
tgttaaagacacactccgaggcagc

SEQ ID NO: 55642 - DNA, 25 bp, Homo sapien
cctcgatgcaccagccgttgtcaga

SEQ ID NO: 55643 - DNA, 25 bp, Homo sapien
cgattctttgactgcggaccctgtg

SEQ ID NO: 55644 - DNA, 25 bp, Homo sapien
cacgttcgtgtgacctgattctctc

SEQ ID NO: 55645 - DNA, 25 bp, Homo sapien
gcctggatccggcaccactagcgga

SEQ ID NO: 55646 - DNA, 25 bp, Homo sapien
ctccaacgcgtagggaaaaggctgc

SEQ ID NO: 55647 - DNA, 25 bp, Homo sapien
aaggacgagtcgttcctgggcaagc

SEQ ID NO: 55648 - DNA, 25 bp, Homo sapien
gtggcctccggagtctgccaaacgc

SEQ ID NO: 55649 - DNA, 25 bp, Homo sapien
cggggtgaccgttcattccatgagc

SEQ ID NO: 55650 - DNA, 25 bp, Homo sapien
acccactactgggtgttgcgcgggc

SEQ ID NO: 55651 - DNA, 25 bp, Homo sapien
ctctccggctttcaggacgtcctga

SEQ ID NO: 55652 - DNA, 25 bp, Homo sapien
ccctggtgcgtaacaaggtcagctc

SEQ ID NO: 55653 - DNA, 25 bp, Homo sapien
tactgcagacttcgcggactacgga

SEQ ID NO: 55654 - DNA, 25 bp, Homo sapien
catccatctgggcattcggagacgc

SEQ ID NO: 55655 - DNA, 25 bp, Homo sapien
cagcatgttggtgagattggccttc

SEQ ID NO: 55656 - DNA, 25 bp, Homo sapien
catgggtcgagtcccgtttgaagta

SEQ ID NO: 55657 - DNA, 25 bp, Homo sapien
taggttctccgcaactctgccagga

SEQ ID NO: 55658 - DNA, 25 bp, Homo sapien
aagtcttcctgatttgggcgcgccg

SEQ ID NO: 55659 - DNA, 25 bp, Homo sapien
gtcagggtgtcaataacgtcatcca

SEQ ID NO: 55660 - DNA, 25 bp, Homo sapien
ggaagcctagcgcttaacacatccc

SEQ ID NO: 55661 - DNA, 25 bp, Homo sapien
cgtcctgtttgcgtggttgctagga

SEQ ID NO: 55662 - DNA, 25 bp, Homo sapien
ccggctgcacacgtcctgtttgcgt

SEQ ID NO: 55663 - DNA, 25 bp, Homo sapien
ctgggcaatgctggtgtcacttaaa

SEQ ID NO: 55664 - DNA, 25 bp, Homo sapien
gcagacctgctgagggtccagcgct

SEQ ID NO: 55665 - DNA, 25 bp, Homo sapien
gaaccaggctcagccacactggcgg

SEQ ID NO: 55666 - DNA, 25 bp, Homo sapien
tcccggaaactaggaggccgctgtg

SEQ ID NO: 55667 - DNA, 25 bp, Homo sapien
actaatcggggatgagggaagccta

SEQ ID NO: 55668 - DNA, 25 bp, Homo sapien
cgcttgccgcacttaggcgagtctc

SEQ ID NO: 55669 - DNA, 25 bp, Homo sapien
ttgggtgaaggtccagcctctccca

SEQ ID NO: 55670 - DNA, 25 bp, Homo sapien
ctctgagtttgtccgcgtctctgtg

SEQ ID NO: 55671 - DNA, 25 bp, Homo sapien
gcgctctctggacgtttgcggcccg

SEQ ID NO: 55672 - DNA, 25 bp, Homo sapien
ctgatttgtcctcccggcttctagc

SEQ ID NO: 55673 - DNA, 25 bp, Homo sapien
ctgagtctgaccgtctgatttgtcc

SEQ ID NO: 55674 - DNA, 25 bp, Homo sapien
acagggactgagtctgaccgtctga

SEQ ID NO: 55675 - DNA, 25 bp, Homo sapien
ccttccctctatctctgagtttgtc

SEQ ID NO: 55676 - DNA, 25 bp, Homo sapien
cgtgcaatgattaacccggcggggc

SEQ ID NO: 55677 - DNA, 25 bp, Homo sapien
actctccgcaggttgaagttcatga

SEQ ID NO: 55678 - DNA, 25 bp, Homo sapien
gtctttccacgtctccactgcggtg

SEQ ID NO: 55679 - DNA, 25 bp, Homo sapien
tccactgcggtgctcgtgacaacct

SEQ ID NO: 55680 - DNA, 25 bp, Homo sapien
cgctgagcctctccgtgcaatgatt

SEQ ID NO: 55681 - DNA, 25 bp, Homo sapien
cggcttcctgctctcgccggagttt

SEQ ID NO: 55682 - DNA, 25 bp, Homo sapien
cgggtcaccatgaggactctccgca

SEQ ID NO: 55683 - DNA, 25 bp, Homo sapien
ttgaagttcatgagttcgcccagcc

SEQ ID NO: 55684 - DNA, 25 bp, Homo sapien
gtcgctcatccaccagggaatccaa

SEQ ID NO: 55685 - DNA, 25 bp, Homo sapien
atgccactgagtccgcctggaggaa

SEQ ID NO: 55686 - DNA, 25 bp, Homo sapien
agggccctcagcactcggataaaga

SEQ ID NO: 55687 - DNA, 25 bp, Homo sapien
tccaaacccggtatgggtcacgtga

SEQ ID NO: 55688 - DNA, 25 bp, Homo sapien
agctgtgctgccttacacgcttgcc

SEQ ID NO: 55689 - DNA, 25 bp, Homo sapien
ggggcctggattctgttttacaaca

SEQ ID NO: 55690 - DNA, 25 bp, Homo sapien
cacccagcgcgtggcttttgtcact

SEQ ID NO: 55691 - DNA, 25 bp, Homo sapien
aactgagctgcctttcttcctgccg

SEQ ID NO: 55692 - DNA, 25 bp, Homo sapien
gtccacttcggtccactgcaggcgt

SEQ ID NO: 55693 - DNA, 25 bp, Homo sapien
ctgcgggccctttaatgccacggga

SEQ ID NO: 55694 - DNA, 25 bp, Homo sapien
gacagcttcttgatcgccgcgccgt

SEQ ID NO: 55695 - DNA, 25 bp, Homo sapien
ctcctcgaggccgtcgagggactca

SEQ ID NO: 55696 - DNA, 25 bp, Homo sapien
ggcaccgagtcgctgtccacttcgg

SEQ ID NO: 55697 - DNA, 25 bp, Homo sapien
cgaagccgctggagggcacaacaac

SEQ ID NO: 55698 - DNA, 25 bp, Homo sapien
acctgcaccgtctcgcggtagaacg

SEQ ID NO: 55699 - DNA, 25 bp, Homo sapien
tcaccggagatcagaggcccggaca

SEQ ID NO: 55700 - DNA, 25 bp, Homo sapien
aggcatctgagtcggcgtttaccca

SEQ ID NO: 55701 - DNA, 25 bp, Homo sapien
gcccaggtctgtttcaggcatctga

SEQ ID NO: 55702 - DNA, 25 bp, Homo sapien
taccagcatccgcaggcactctgtg

SEQ ID NO: 55703 - DNA, 25 bp, Homo sapien
actctgtgtcggagatgacgtcctg

SEQ ID NO: 55704 - DNA, 25 bp, Homo sapien
gattttcattgactttggccggggc

SEQ ID NO: 55705 - DNA, 25 bp, Homo sapien
agctggccttgagtttttactgaca

SEQ ID NO: 55706 - DNA, 25 bp, Homo sapien
aagaaccctgtggtgcgctccaaga

SEQ ID NO: 55707 - DNA, 25 bp, Homo sapien
actggccttggtcactttgtatttc

SEQ ID NO: 55708 - DNA, 25 bp, Homo sapien
gtgctcggctgatgtcgagtgcata

SEQ ID NO: 55709 - DNA, 25 bp, Homo sapien
agtgtataatgggtgctcggctgag

SEQ ID NO: 55710 - DNA, 25 bp, Homo sapien
ctcgactgatgtagagtgtataatg

SEQ ID NO: 55711 - DNA, 25 bp, Homo sapien
gtgctcgactgatgtagagtgtata

SEQ ID NO: 55712 - DNA, 25 bp, Homo sapien
gtatagtgggtgctcgactgatgta

SEQ ID NO: 55713 - DNA, 25 bp, Homo sapien
ctcggctgaggtagggcgtatagtg

SEQ ID NO: 55714 - DNA, 25 bp, Homo sapien
tcggctgatgtcgagtgcataatgg

SEQ ID NO: 55715 - DNA, 25 bp, Homo sapien
agtgcataatgggtgctcggctgag

SEQ ID NO: 55716 - DNA, 25 bp, Homo sapien
cacatggctgacagtgttgttggcg

SEQ ID NO: 55717 - DNA, 25 bp, Homo sapien
ggctggggttcttgacgctgaccac

SEQ ID NO: 55718 - DNA, 25 bp, Homo sapien
ttcttgacgctgaccacggtggcct

SEQ ID NO: 55719 - DNA, 25 bp, Homo sapien
gaccacggtggccttctggaatgtt

SEQ ID NO: 55720 - DNA, 25 bp, Homo sapien
ttgacgctgaccacggtggccttct

SEQ ID NO: 55721 - DNA, 25 bp, Homo sapien
acgctgaccacggtggccttctgga

SEQ ID NO: 55722 - DNA, 25 bp, Homo sapien
agatgatggcgtaggccacccccgc

SEQ ID NO: 55723 - DNA, 25 bp, Homo sapien
ccacggtggccttctggaatgttgg

SEQ ID NO: 55724 - DNA, 25 bp, Homo sapien
aggacgtctgtgaaaccaggtgccc

SEQ ID NO: 55725 - DNA, 25 bp, Homo sapien
accatacggagtgaggcgtgccatt

SEQ ID NO: 55726 - DNA, 25 bp, Homo sapien
gcgcgggccaatgaccgtcaagatg

SEQ ID NO: 55727 - DNA, 25 bp, Homo sapien
accgactccagctgcgcgcaagatg

SEQ ID NO: 55728 - DNA, 25 bp, Homo sapien
gggcaccatttatcctccgttcatc

SEQ ID NO: 55729 - DNA, 25 bp, Homo sapien
cgctgtctgccttgggcaccattta

SEQ ID NO: 55730 - DNA, 25 bp, Homo sapien
gggcccagaggcaacatcctggaca

SEQ ID NO: 55731 - DNA, 25 bp, Homo sapien
gcccaggtaagctccagcaggcgtc

SEQ ID NO: 55732 - DNA, 25 bp, Homo sapien
tggcactttttagggcgccgccaaa

SEQ ID NO: 55733 - DNA, 25 bp, Homo sapien
tgaggtcgccgttctgcggaaacac

SEQ ID NO: 55734 - DNA, 25 bp, Homo sapien
taagagaagactccaggctcgggtc

SEQ ID NO: 55735 - DNA, 25 bp, Homo sapien
gagtccgtgtcgagcaaagctcata

SEQ ID NO: 55736 - DNA, 25 bp, Homo sapien
gcagcgatcgccaaaactacttctg

SEQ ID NO: 55737 - DNA, 25 bp, Homo sapien
tgcagaccctacatcgcttaagaga

SEQ ID NO: 55738 - DNA, 25 bp, Homo sapien
tcctcgatcccgcaaactgtgcagg

SEQ ID NO: 55739 - DNA, 25 bp, Homo sapien
ccatcgcttacttgtttgtcgctga

SEQ ID NO: 55740 - DNA, 25 bp, Homo sapien
tagcgcgcgaacatcctggaagacg

SEQ ID NO: 55741 - DNA, 25 bp, Homo sapien
gaccagcagggtcacctgcgcgcgt

SEQ ID NO: 55742 - DNA, 25 bp, Homo sapien
tcagcggcgactagcgcgcgaacat

SEQ ID NO: 55743 - DNA, 25 bp, Homo sapien
aacatcctggaagacgcgttgccgg

SEQ ID NO: 55744 - DNA, 25 bp, Homo sapien
gcttgcgcgagaccggcattctcag

SEQ ID NO: 55745 - DNA, 25 bp, Homo sapien
gcgcgcttgcgcagtagctgaacgc

SEQ ID NO: 55746 - DNA, 25 bp, Homo sapien
cgcagtagctgaacgcgggcgtttc

SEQ ID NO: 55747 - DNA, 25 bp, Homo sapien
agtggcacctcacacgattcccgag

SEQ ID NO: 55748 - DNA, 25 bp, Homo sapien
ctctctggcctgtcttactgcgttc

SEQ ID NO: 55749 - DNA, 25 bp, Homo sapien
tctggcctgtcttactgcgttcccg

SEQ ID NO: 55750 - DNA, 25 bp, Homo sapien
tgtcctggcgtggtcttctccgttt

SEQ ID NO: 55751 - DNA, 25 bp, Homo sapien
tggcgtggtcttctccgtttccttc

SEQ ID NO: 55752 - DNA, 25 bp, Homo sapien
gtttccttcctagcgattcctctcg

SEQ ID NO: 55753 - DNA, 25 bp, Homo sapien
tagcgattcctctcgagcttcctct

SEQ ID NO: 55754 - DNA, 25 bp, Homo sapien
ttctcttgggcgcattacctctctg

SEQ ID NO: 55755 - DNA, 25 bp, Homo sapien
tgggcgcattacctctctggcctgt

SEQ ID NO: 55756 - DNA, 25 bp, Homo sapien
cttgtagaagccaaacgacatcttc

SEQ ID NO: 55757 - DNA, 25 bp, Homo sapien
tccatgttgctgtacttgtagaagc

SEQ ID NO: 55758 - DNA, 25 bp, Homo sapien
gttggggatgacaacacctatgtcc

SEQ ID NO: 55759 - DNA, 25 bp, Homo sapien
aagtgaacttgacggatgggagccc

SEQ ID NO: 55760 - DNA, 25 bp, Homo sapien
ccttacccgctcgtgcatgggcgaa

SEQ ID NO: 55761 - DNA, 25 bp, Homo sapien
tggagtcctcttcagtcccacaggg

SEQ ID NO: 55762 - DNA, 25 bp, Homo sapien
tcttctgtgccatgcgggcggccac

SEQ ID NO: 55763 - DNA, 25 bp, Homo sapien
ttcatgcgcacaaactccatgttgc

SEQ ID NO: 55764 - DNA, 25 bp, Homo sapien
taagggtgtacccagatcccacgcc

SEQ ID NO: 55765 - DNA, 25 bp, Homo sapien
tcggacggaaagcagagacagaccc

SEQ ID NO: 55766 - DNA, 25 bp, Homo sapien
gccatggaggaagacagggtaccca

SEQ ID NO: 55767 - DNA, 25 bp, Homo sapien
agagaccacgacacccgcgcagaga

SEQ ID NO: 55768 - DNA, 25 bp, Homo sapien
acagaaacacggacgcgcagaggcg

SEQ ID NO: 55769 - DNA, 25 bp, Homo sapien
ctccgctatggcacgcagcatgtgc

SEQ ID NO: 55770 - DNA, 25 bp, Homo sapien
acagacacccggacggactgacagg

SEQ ID NO: 55771 - DNA, 25 bp, Homo sapien
aagaagacccgcagagacacgaaga

SEQ ID NO: 55772 - DNA, 25 bp, Homo sapien
tgttgcacctttgagaggaaaagga

SEQ ID NO: 55773 - DNA, 25 bp, Homo sapien
tgaccgcgtccctgctgaaaggcga

SEQ ID NO: 55774 - DNA, 25 bp, Homo sapien
gcgtccctgctgaaaggcgactccg

SEQ ID NO: 55775 - DNA, 25 bp, Homo sapien
gctgaaaggcgactccgggagcaca

SEQ ID NO: 55776 - DNA, 25 bp, Homo sapien
tcctgatgtccctagcagcgccggg

SEQ ID NO: 55777 - DNA, 25 bp, Homo sapien
ctcgctgggtttttgttgcaccttt

SEQ ID NO: 55778 - DNA, 25 bp, Homo sapien
ccctggaagtgaggcgaagaaggcc

SEQ ID NO: 55779 - DNA, 25 bp, Homo sapien
ccgcctgtggtcgtacccggatcgt

SEQ ID NO: 55780 - DNA, 25 bp, Homo sapien
cgccggatggggtcttcggctgccc

SEQ ID NO: 55781 - DNA, 25 bp, Homo sapien
tcctgcgccagctgacgaggcttgg

SEQ ID NO: 55782 - DNA, 25 bp, Homo sapien
ctgcgccagctgacgaggcttggac

SEQ ID NO: 55783 - DNA, 25 bp, Homo sapien
gcgccagctgacgaggcttggaccc

SEQ ID NO: 55784 - DNA, 25 bp, Homo sapien
gccagctgacgaggcttggacccgc

SEQ ID NO: 55785 - DNA, 25 bp, Homo sapien
cctgcgccggatggggtcttcggct

SEQ ID NO: 55786 - DNA, 25 bp, Homo sapien
ctcctgcgccagctgacgaggcttg

SEQ ID NO: 55787 - DNA, 25 bp, Homo sapien
cagctgacgaggcttggacccgccg

SEQ ID NO: 55788 - DNA, 25 bp, Homo sapien
tagagcctccataaatagttgtaga

SEQ ID NO: 55789 - DNA, 25 bp, Homo sapien
cagccctgcgatgtgtgttgcaaga

SEQ ID NO: 55790 - DNA, 25 bp, Homo sapien
aatccgagggctcacagatggctgc

SEQ ID NO: 55791 - DNA, 25 bp, Homo sapien
gggcctcctctgttgggaatccgag

SEQ ID NO: 55792 - DNA, 25 bp, Homo sapien
agccaacgtttacgggcctcctctg

SEQ ID NO: 55793 - DNA, 25 bp, Homo sapien
gctggggacccagatattactgtta

SEQ ID NO: 55794 - DNA, 25 bp, Homo sapien
acacagtaggcgctttgatgcgggc

SEQ ID NO: 55795 - DNA, 25 bp, Homo sapien
tcaaggtcccattggtgagagacgc

SEQ ID NO: 55796 - DNA, 25 bp, Homo sapien
ggaagtgttcccaggtctggtgata

SEQ ID NO: 55797 - DNA, 25 bp, Homo sapien
gtgggccctgagaactgttggttcc

SEQ ID NO: 55798 - DNA, 25 bp, Homo sapien
ctgttggttccggaaactctcgagg

SEQ ID NO: 55799 - DNA, 25 bp, Homo sapien
actctcgaggttcccttgggacttg

SEQ ID NO: 55800 - DNA, 25 bp, Homo sapien
ttgggacttgcttccagcaacctcc

SEQ ID NO: 55801 - DNA, 25 bp, Homo sapien
ctgatctcagggctaggtttctcca

SEQ ID NO: 55802 - DNA, 25 bp, Homo sapien
gtttctccaacttgaggtccctgga

SEQ ID NO: 55803 - DNA, 25 bp, Homo sapien
agattttctctggactccgagaccc

SEQ ID NO: 55804 - DNA, 25 bp, Homo sapien
aaggagccgaccttgcctgcgctac

SEQ ID NO: 55805 - DNA, 25 bp, Homo sapien
cctgatcctgcgtgttctaaaaacc

SEQ ID NO: 55806 - DNA, 25 bp, Homo sapien
cgacggaaaactgcgctaaaggctt

SEQ ID NO: 55807 - DNA, 25 bp, Homo sapien
tgaaattttccacaagcagcagctc

SEQ ID NO: 55808 - DNA, 25 bp, Homo sapien
tgaacctccggaaggggccaatgac

SEQ ID NO: 55809 - DNA, 25 bp, Homo sapien
ggccgatgatgcaggtgaacctccg

SEQ ID NO: 55810 - DNA, 25 bp, Homo sapien
ctcagttaccagagccgttggggcc

SEQ ID NO: 55811 - DNA, 25 bp, Homo sapien
ggtcttcaacgccagaaacaggata

SEQ ID NO: 55812 - DNA, 25 bp, Homo sapien
gcggggataacctttgatcccgagc

SEQ ID NO: 55813 - DNA, 25 bp, Homo sapien
gtcctagcaaatccagccggctccg

SEQ ID NO: 55814 - DNA, 25 bp, Homo sapien
actcggagtccgtgcgttgccctgc

SEQ ID NO: 55815 - DNA, 25 bp, Homo sapien
ctccctgcgagtttcggaaccacgg

SEQ ID NO: 55816 - DNA, 25 bp, Homo sapien
gcgctccctgcgagtttcggaacca

SEQ ID NO: 55817 - DNA, 25 bp, Homo sapien
cgggataattgaacggcgcggccct

SEQ ID NO: 55818 - DNA, 25 bp, Homo sapien
agcccagggcgccttgcacttgacg

SEQ ID NO: 55819 - DNA, 25 bp, Homo sapien
ggataacctttgatcccgagccctc

SEQ ID NO: 55820 - DNA, 25 bp, Homo sapien
tggcacgcaagatgttccgacagct

SEQ ID NO: 55821 - DNA, 25 bp, Homo sapien
aggacctcatctaccgcatgctgca

SEQ ID NO: 55822 - DNA, 25 bp, Homo sapien
ccaagaacctgacctgcgagtgcaa

SEQ ID NO: 55823 - DNA, 25 bp, Homo sapien
tgggcgcatcatcctcagcaagacc

SEQ ID NO: 55824 - DNA, 25 bp, Homo sapien
ccgggacctcaagtgcgagaacctt

SEQ ID NO: 55825 - DNA, 25 bp, Homo sapien
ttcatcaagtgccagggagccctgc

SEQ ID NO: 55826 - DNA, 25 bp, Homo sapien
agggcgacctcctcgagttcatcaa

SEQ ID NO: 55827 - DNA, 25 bp, Homo sapien
agctgtctgactttggcttctccaa

SEQ ID NO: 55828 - DNA, 25 bp, Homo sapien
gccggcagaggaacaaacggactca

SEQ ID NO: 55829 - DNA, 25 bp, Homo sapien
aaacggactcacaggacgtgcggca

SEQ ID NO: 55830 - DNA, 25 bp, Homo sapien
ctcagccggtgtctgagctgggact

SEQ ID NO: 55831 - DNA, 25 bp, Homo sapien
tgggacccagagtcctcagtcaggc

SEQ ID NO: 55832 - DNA, 25 bp, Homo sapien
tcagtcaggctcttccctccgaggt

SEQ ID NO: 55833 - DNA, 25 bp, Homo sapien
gcccaggtggactccgctgctgcgt

SEQ ID NO: 55834 - DNA, 25 bp, Homo sapien
gccctctcacgctccaggttgtgag

SEQ ID NO: 55835 - DNA, 25 bp, Homo sapien
tccaggttgtgagcgagtatctccc

SEQ ID NO: 55836 - DNA, 25 bp, Homo sapien
tcgacccagctgtgagcggcaagat

SEQ ID NO: 55837 - DNA, 25 bp, Homo sapien
ctttctcagggtgaacctctggttc

SEQ ID NO: 55838 - DNA, 25 bp, Homo sapien
gtctgcgacgcttcccagtcaatca

SEQ ID NO: 55839 - DNA, 25 bp, Homo sapien
tcttcaaagagcagcggaaccggta

SEQ ID NO: 55840 - DNA, 25 bp, Homo sapien
cgtgccggtgatgttgacccaacac

SEQ ID NO: 55841 - DNA, 25 bp, Homo sapien
ttgacccaacacacggttaggcctc

SEQ ID NO: 55842 - DNA, 25 bp, Homo sapien
cccagagtcataaagcgtgtgtttt

SEQ ID NO: 55843 - DNA, 25 bp, Homo sapien
cgagaccctgttacggccacatcaa

SEQ ID NO: 55844 - DNA, 25 bp, Homo sapien
ttctccacgacgacaatgaggcgga

SEQ ID NO: 55845 - DNA, 25 bp, Homo sapien
tccacggcacgtgctttggcttgga

SEQ ID NO: 55846 - DNA, 25 bp, Homo sapien
cggggtcaggagcaacctgctattc

SEQ ID NO: 55847 - DNA, 25 bp, Homo sapien
ctgctattcgtagggtcaggagccc

SEQ ID NO: 55848 - DNA, 25 bp, Homo sapien
aggtgcttgacctctcggggcctca

SEQ ID NO: 55849 - DNA, 25 bp, Homo sapien
ccttctctatgaagcggagctgatc

SEQ ID NO: 55850 - DNA, 25 bp, Homo sapien
tcctgcactgccctctgcgggatgg

SEQ ID NO: 55851 - DNA, 25 bp, Homo sapien
gctgtgacagtccaaggcgagaaca

SEQ ID NO: 55852 - DNA, 25 bp, Homo sapien
gaagacgcttctctcctgcgggatt

SEQ ID NO: 55853 - DNA, 25 bp, Homo sapien
ggggcgcatgtattcgtattcctca

SEQ ID NO: 55854 - DNA, 25 bp, Homo sapien
cgcacgggaaccatcgatcccattg

SEQ ID NO: 55855 - DNA, 25 bp, Homo sapien
aattccatttgtgccggagagaaca

SEQ ID NO: 55856 - DNA, 25 bp, Homo sapien
ccctgatgaatgcagccgcggttga

SEQ ID NO: 55857 - DNA, 25 bp, Homo sapien
atccctattcagagcggagcccttg

SEQ ID NO: 55858 - DNA, 25 bp, Homo sapien
agatatccctgttgcccggtctgcc

SEQ ID NO: 55859 - DNA, 25 bp, Homo sapien
ctggctttcccatcacggtttgtca

SEQ ID NO: 55860 - DNA, 25 bp, Homo sapien
gggctggacaaagccgcccgcttca

SEQ ID NO: 55861 - DNA, 25 bp, Homo sapien
ccatcctgatgggaagctccggtgg

SEQ ID NO: 55862 - DNA, 25 bp, Homo sapien
ctttctttctctgccggaccgtgga

SEQ ID NO: 55863 - DNA, 25 bp, Homo sapien
cgggcggatgcagcccattcactgt

SEQ ID NO: 55864 - DNA, 25 bp, Homo sapien
cattcactgtttggataattcgacc

SEQ ID NO: 55865 - DNA, 25 bp, Homo sapien
gggaccgattctccatcggaaaaca

SEQ ID NO: 55866 - DNA, 25 bp, Homo sapien
cacaaaaagcgtgtggccctttcgc

SEQ ID NO: 55867 - DNA, 25 bp, Homo sapien
aaagacagcggcttcggcctccagc

SEQ ID NO: 55868 - DNA, 25 bp, Homo sapien
cgctcccggaactggcgattgcaaa

SEQ ID NO: 55869 - DNA, 25 bp, Homo sapien
ctcggccagtgagagcgcagaaacc

SEQ ID NO: 55870 - DNA, 25 bp, Homo sapien
ggtccctgttgcaagtcatctcccg

SEQ ID NO: 55871 - DNA, 25 bp, Homo sapien
agcgtcgcacctctgcccaatgagg

SEQ ID NO: 55872 - DNA, 25 bp, Homo sapien
ctcatcccggaaggaccggtgtcta

SEQ ID NO: 55873 - DNA, 25 bp, Homo sapien
accggtgtctaggtcaccctggagc

SEQ ID NO: 55874 - DNA, 25 bp, Homo sapien
ctgcaaaggcaggtactcgagcaca

SEQ ID NO: 55875 - DNA, 25 bp, Homo sapien
tactcgagcacactccggagagggc

SEQ ID NO: 55876 - DNA, 25 bp, Homo sapien
cttctcaatgtacaccaggtctgtc

SEQ ID NO: 55877 - DNA, 25 bp, Homo sapien
cgcagcacatggtgtcacagccgtc

SEQ ID NO: 55878 - DNA, 25 bp, Homo sapien
tgcaggtgttgcacttgacgaagca

SEQ ID NO: 55879 - DNA, 25 bp, Homo sapien
tgaagacctcggtgcgctcgctgca

SEQ ID NO: 55880 - DNA, 25 bp, Homo sapien
ggtctgtctccatgggcttctgata

SEQ ID NO: 55881 - DNA, 25 bp, Homo sapien
gggcttctgatagctgcgcagctgt

SEQ ID NO: 55882 - DNA, 25 bp, Homo sapien
tgcgcagctgtttgatgcgcaggaa

SEQ ID NO: 55883 - DNA, 25 bp, Homo sapien
gttgcactgccacaccttggtgtac

SEQ ID NO: 55884 - DNA, 25 bp, Homo sapien
atggcgtacgtgaaggcagcctcac

SEQ ID NO: 55885 - DNA, 25 bp, Homo sapien
tccagccctcggcttggttgtagta

SEQ ID NO: 55886 - DNA, 25 bp, Homo sapien
cgggagaagtcgatgccgtaacgca

SEQ ID NO: 55887 - DNA, 25 bp, Homo sapien
ttgatctcccgagcgtccacgaagc

SEQ ID NO: 55888 - DNA, 25 bp, Homo sapien
ttgttatgcaggttcatgaggcgcc

SEQ ID NO: 55889 - DNA, 25 bp, Homo sapien
ttcctgccggcctcattgttatgca

SEQ ID NO: 55890 - DNA, 25 bp, Homo sapien
gtgatacagcggtcccagctacggc

SEQ ID NO: 55891 - DNA, 25 bp, Homo sapien
cagccgcagttgctcaggttccctt

SEQ ID NO: 55892 - DNA, 25 bp, Homo sapien
tctctgtgcccggaccttgtaatta

SEQ ID NO: 55893 - DNA, 25 bp, Homo sapien
ttgtaattatgtcccacagcccggg

SEQ ID NO: 55894 - DNA, 25 bp, Homo sapien
cagcatctggctgcggttgcgaact

SEQ ID NO: 55895 - DNA, 25 bp, Homo sapien
ttgtttcaagatgcgcgactattta

SEQ ID NO: 55896 - DNA, 25 bp, Homo sapien
ggagaaattggctgcgtctttatta

SEQ ID NO: 55897 - DNA, 25 bp, Homo sapien
cgaggcgatgtattaggactgcaac

SEQ ID NO: 55898 - DNA, 25 bp, Homo sapien
gtattaggactgcaaccgcatgggg

SEQ ID NO: 55899 - DNA, 25 bp, Homo sapien
ggatagtaatttcctaggagcaaga

SEQ ID NO: 55900 - DNA, 25 bp, Homo sapien
ccatgctaatcagcctggcagcgcg

SEQ ID NO: 55901 - DNA, 25 bp, Homo sapien
acagtggcgcattgttccccggaca

SEQ ID NO: 55902 - DNA, 25 bp, Homo sapien
cgccgcgatttgcatgcgctccagt

SEQ ID NO: 55903 - DNA, 25 bp, Homo sapien
tccagtcacaaaggttcaaggtcag

SEQ ID NO: 55904 - DNA, 25 bp, Homo sapien
tcgcccatgctaatcagcctggcag

SEQ ID NO: 55905 - DNA, 25 bp, Homo sapien
accgtctgaggtgctttgtgtctcg

SEQ ID NO: 55906 - DNA, 25 bp, Homo sapien
gcatgcgctccagtcacaaaggttc

SEQ ID NO: 55907 - DNA, 25 bp, Homo sapien
gccgccaccgtctgaggtgctttgt

SEQ ID NO: 55908 - DNA, 25 bp, Homo sapien
cccgcggcctggaatctaagagact

SEQ ID NO: 55909 - DNA, 25 bp, Homo sapien
tttccctgagctttctgagcgggcc

SEQ ID NO: 55910 - DNA, 25 bp, Homo sapien
tctcgactgtgacgcaacatccgca

SEQ ID NO: 55911 - DNA, 25 bp, Homo sapien
tagaggcccggcgatagacttggcc

SEQ ID NO: 55912 - DNA, 25 bp, Homo sapien
ctttggctacggcactgcgaccgcg

SEQ ID NO: 55913 - DNA, 25 bp, Homo sapien
ccaaacgaggtcgtgcgcgcttcct

SEQ ID NO: 55914 - DNA, 25 bp, Homo sapien
tcctgcgatggttttttgctgtccc

SEQ ID NO: 55915 - DNA, 25 bp, Homo sapien
atctaagagactgccacccagaggc

SEQ ID NO: 55916 - DNA, 25 bp, Homo sapien
aggacccgctgcttgctcgtcgcag

SEQ ID NO: 55917 - DNA, 25 bp, Homo sapien
cgggaagcaacaaggacgacgctga

SEQ ID NO: 55918 - DNA, 25 bp, Homo sapien
gacgacgctgatgcgcccggcgtct

SEQ ID NO: 55919 - DNA, 25 bp, Homo sapien
gcgcctccaatagttggccaatgga

SEQ ID NO: 55920 - DNA, 25 bp, Homo sapien
gcgtctccatcgctatcccaggaaa

SEQ ID NO: 55921 - DNA, 25 bp, Homo sapien
gaggtcgtacctcgatatactcttc

SEQ ID NO: 55922 - DNA, 25 bp, Homo sapien
gactgcaccatttgcgcaggcgcct

SEQ ID NO: 55923 - DNA, 25 bp, Homo sapien
cgctatcccaggaaaaagctcgggc

SEQ ID NO: 55924 - DNA, 25 bp, Homo sapien
cttctgggtagaattggaagttctg

SEQ ID NO: 55925 - DNA, 25 bp, Homo sapien
acgtgaacttgaccctgcgctgtgc

SEQ ID NO: 55926 - DNA, 25 bp, Homo sapien
tccagctccgcgactgtgcagaaag

SEQ ID NO: 55927 - DNA, 25 bp, Homo sapien
tgccaacctcggagccgcgactgaa

SEQ ID NO: 55928 - DNA, 25 bp, Homo sapien
cacgacgaaaaaagcttctgggtag

SEQ ID NO: 55929 - DNA, 25 bp, Homo sapien
ggcgtggaacttgcttgtttaccta

SEQ ID NO: 55930 - DNA, 25 bp, Homo sapien
tcgggacgatctggtaagcgctccc

SEQ ID NO: 55931 - DNA, 25 bp, Homo sapien
agcgtgtccgcgaagcccggaaact

SEQ ID NO: 55932 - DNA, 25 bp, Homo sapien
cgctggaaagttcgccctgcccggg

SEQ ID NO: 55933 - DNA, 25 bp, Homo sapien
cagggccagccgcacagtcggagga

SEQ ID NO: 55934 - DNA, 25 bp, Homo sapien
cggcagacaccgagccgcggccaca

SEQ ID NO: 55935 - DNA, 25 bp, Homo sapien
ggaggcaggcacaaaggagggcagt

SEQ ID NO: 55936 - DNA, 25 bp, Homo sapien
aggagcaggcctcgttgcggggttg

SEQ ID NO: 55937 - DNA, 25 bp, Homo sapien
gccgggcgacctgggcaccagcagg

SEQ ID NO: 55938 - DNA, 25 bp, Homo sapien
ggggcaaacgcggagcacggaggac

SEQ ID NO: 55939 - DNA, 25 bp, Homo sapien
cagccgcacagtcggaggaagggcc

SEQ ID NO: 55940 - DNA, 25 bp, Homo sapien
gcgccctttgttcgccctcaatggg

SEQ ID NO: 55941 - DNA, 25 bp, Homo sapien
tatcgggacgggcagaattctttaa

SEQ ID NO: 55942 - DNA, 25 bp, Homo sapien
cagaattctttaaaatgcagtgccc

SEQ ID NO: 55943 - DNA, 25 bp, Homo sapien
ccctaatccgctttagtcaatatct

SEQ ID NO: 55944 - DNA, 25 bp, Homo sapien
gtcaatatcttatgagctccgcttg

SEQ ID NO: 55945 - DNA, 25 bp, Homo sapien
gctccgcttgggcaaagtaaacagg

SEQ ID NO: 55946 - DNA, 25 bp, Homo sapien
taaacaggcgccgaacaaagcggcg

SEQ ID NO: 55947 - DNA, 25 bp, Homo sapien
ttgttcgccctcaatggggcagccc

SEQ ID NO: 55948 - DNA, 25 bp, Homo sapien
tgcccgcaatcatggcagccggcgc

SEQ ID NO: 55949 - DNA, 25 bp, Homo sapien
actgcagggaccgtcggtcagccag

SEQ ID NO: 55950 - DNA, 25 bp, Homo sapien
gcatcctcggtgccgacccgggaaa

SEQ ID NO: 55951 - DNA, 25 bp, Homo sapien
aagacataaaataggcggcaacggg

SEQ ID NO: 55952 - DNA, 25 bp, Homo sapien
gccaactccgagacaaaagacataa

SEQ ID NO: 55953 - DNA, 25 bp, Homo sapien
attccgggcgcggttgcatccgcga

SEQ ID NO: 55954 - DNA, 25 bp, Homo sapien
ctggagagcctgaccgctgtccgcg

SEQ ID NO: 55955 - DNA, 25 bp, Homo sapien
gacaggtgccaactccgagacaaaa

SEQ ID NO: 55956 - DNA, 25 bp, Homo sapien
cagccgcccagatggtcatcacgga

SEQ ID NO: 55957 - DNA, 25 bp, Homo sapien
tggtcatcacggacctgtcggcacc

SEQ ID NO: 55958 - DNA, 25 bp, Homo sapien
ctctgcttcggcgtcggagtcatcc

SEQ ID NO: 55959 - DNA, 25 bp, Homo sapien
accgaggggctttcgccgctcagct

SEQ ID NO: 55960 - DNA, 25 bp, Homo sapien
cctcttttgctcgtggggcgcgagt

SEQ ID NO: 55961 - DNA, 25 bp, Homo sapien
gcctcggtttcctcttttgctcgtg

SEQ ID NO: 55962 - DNA, 25 bp, Homo sapien
aaggggacactgaccgcctccgtga

SEQ ID NO: 55963 - DNA, 25 bp, Homo sapien
cgagtggccacgtgatgtggctact

SEQ ID NO: 55964 - DNA, 25 bp, Homo sapien
caaagtccgtgtggccgcatttgga

SEQ ID NO: 55965 - DNA, 25 bp, Homo sapien
gcggacgcccttcaaagtccgtgtg

SEQ ID NO: 55966 - DNA, 25 bp, Homo sapien
acgagcagacactggcgcctgtgac

SEQ ID NO: 55967 - DNA, 25 bp, Homo sapien
gcctgtgcggcttctttcaactcga

SEQ ID NO: 55968 - DNA, 25 bp, Homo sapien
gcttcgaggtccagacgagcagaca

SEQ ID NO: 55969 - DNA, 25 bp, Homo sapien
gcctggtgcttcgaggtccagacga

SEQ ID NO: 55970 - DNA, 25 bp, Homo sapien
caactcgatgagaggaggactcctc

SEQ ID NO: 55971 - DNA, 25 bp, Homo sapien
tgcggcttctttcaactcgatgaga

SEQ ID NO: 55972 - DNA, 25 bp, Homo sapien
ttctggcttgaccaccaggtggcgc

SEQ ID NO: 55973 - DNA, 25 bp, Homo sapien
cgcctggtgcccaatgaagcacgtg

SEQ ID NO: 55974 - DNA, 25 bp, Homo sapien
ctgaagaatcagtgtccgggaggcc

SEQ ID NO: 55975 - DNA, 25 bp, Homo sapien
tgcgcagtgtttccagcaccggcct

SEQ ID NO: 55976 - DNA, 25 bp, Homo sapien
gtgggtgcgcagtgtttccagcacc

SEQ ID NO: 55977 - DNA, 25 bp, Homo sapien
ctgagcggccctcgggtcaagagca

SEQ ID NO: 55978 - DNA, 25 bp, Homo sapien
ccctcgggtcaagagcacagaggtg

SEQ ID NO: 55979 - DNA, 25 bp, Homo sapien
ggcatctccggctcggacagccata

SEQ ID NO: 55980 - DNA, 25 bp, Homo sapien
actcttgcgagggatctcggggccc

SEQ ID NO: 55981 - DNA, 25 bp, Homo sapien
ggcgctgacgctcagcggtgtccca

SEQ ID NO: 55982 - DNA, 25 bp, Homo sapien
tcagcggtgtcccatcggtgacctt

SEQ ID NO: 55983 - DNA, 25 bp, Homo sapien
ggtgtcccatcggtgaccttggacg

SEQ ID NO: 55984 - DNA, 25 bp, Homo sapien
gacacacaccgaggactcttgcgag

SEQ ID NO: 55985 - DNA, 25 bp, Homo sapien
accgaggactcttgcgagggatctc

SEQ ID NO: 55986 - DNA, 25 bp, Homo sapien
accgcagcgactctgggtcttcggg

SEQ ID NO: 55987 - DNA, 25 bp, Homo sapien
gcgactctgggtcttcgggttgtcc

SEQ ID NO: 55988 - DNA, 25 bp, Homo sapien
tgccagtcccgagatgtgcggatcg

SEQ ID NO: 55989 - DNA, 25 bp, Homo sapien
tgcggatcaggagaagtgccagtcc

SEQ ID NO: 55990 - DNA, 25 bp, Homo sapien
tcggagatgctcagatcgaagatgt

SEQ ID NO: 55991 - DNA, 25 bp, Homo sapien
tccggagatgcgcagatcaggagat

SEQ ID NO: 55992 - DNA, 25 bp, Homo sapien
ctggagatgtgcagagcagagcaaa

SEQ ID NO: 55993 - DNA, 25 bp, Homo sapien
gcccatagatgtgcaggtctggaga

SEQ ID NO: 55994 - DNA, 25 bp, Homo sapien
caaagatgagctgatcggagatgcc

SEQ ID NO: 55995 - DNA, 25 bp, Homo sapien
atgtgcgggtccaaagatgtgcaaa

SEQ ID NO: 55996 - DNA, 25 bp, Homo sapien
ggtctgcgccgcgttctcctttagc

SEQ ID NO: 55997 - DNA, 25 bp, Homo sapien
gactcctggcgcttggaacccagca

SEQ ID NO: 55998 - DNA, 25 bp, Homo sapien
acctcgcggtggttttccgcctctg

SEQ ID NO: 55999 - DNA, 25 bp, Homo sapien
tgccttgcttttccggtcgccgcgg

SEQ ID NO: 56000 - DNA, 25 bp, Homo sapien
cttctttctgagtgttccgccgggt

SEQ ID NO: 56001 - DNA, 25 bp, Homo sapien
gcccaacggggtctcaggacctgtc

SEQ ID NO: 56002 - DNA, 25 bp, Homo sapien
ctgcgccgactcctggcgcttggaa

SEQ ID NO: 56003 - DNA, 25 bp, Homo sapien
ggacctgtccctgctcctccaaagc

SEQ ID NO: 56004 - DNA, 25 bp, Homo sapien
gcacggagaacacctgccagtactg

SEQ ID NO: 56005 - DNA, 25 bp, Homo sapien
cgcccttctggtccgtgttgatcct

SEQ ID NO: 56006 - DNA, 25 bp, Homo sapien
gtgttgatcctcacgcgctggatga

SEQ ID NO: 56007 - DNA, 25 bp, Homo sapien
acgcaggcgtttatctgacaggaca

SEQ ID NO: 56008 - DNA, 25 bp, Homo sapien
tctgacaggacacggacgactcgac

SEQ ID NO: 56009 - DNA, 25 bp, Homo sapien
actcgacggctctgtggctggacga

SEQ ID NO: 56010 - DNA, 25 bp, Homo sapien
gacgcgcaagtcgaggcagtaccag

SEQ ID NO: 56011 - DNA, 25 bp, Homo sapien
agttgacggcctgcaacatcacgcg

SEQ ID NO: 56012 - DNA, 25 bp, Homo sapien
acgcgggcctctttcgtcaccagag

SEQ ID NO: 56013 - DNA, 25 bp, Homo sapien
gctcgcgcgtactcacgtcaggata

SEQ ID NO: 56014 - DNA, 25 bp, Homo sapien
ctcacgtcaggatactggttctgca

SEQ ID NO: 56015 - DNA, 25 bp, Homo sapien
tggttctgcacgaaaagcgcctcga

SEQ ID NO: 56016 - DNA, 25 bp, Homo sapien
gcctgcagctgctcttcgctgaaga

SEQ ID NO: 56017 - DNA, 25 bp, Homo sapien
tggcgcacccagagacaagggcacc

SEQ ID NO: 56018 - DNA, 25 bp, Homo sapien
ccgccgcgggaatatatacgtcggg

SEQ ID NO: 56019 - DNA, 25 bp, Homo sapien
aggccgtctttgcaaagggcgcccg

SEQ ID NO: 56020 - DNA, 25 bp, Homo sapien
tgctcccaagggacccgtcgcgttg

SEQ ID NO: 56021 - DNA, 25 bp, Homo sapien
cccgaacgccaagtgagtgtgtgcc

SEQ ID NO: 56022 - DNA, 25 bp, Homo sapien
ataaacttgaaagtgaccgctgtcc

SEQ ID NO: 56023 - DNA, 25 bp, Homo sapien
ccgtcgcgttgcagagttgtccggt

SEQ ID NO: 56024 - DNA, 25 bp, Homo sapien
gatcctggaccagggccagtctgtc

SEQ ID NO: 56025 - DNA, 25 bp, Homo sapien
agtctgtccgaaacccaccagtgag

SEQ ID NO: 56026 - DNA, 25 bp, Homo sapien
cgcgactgccaggtacacggaggct

SEQ ID NO: 56027 - DNA, 25 bp, Homo sapien
tgccgaccgcaacgacataaacttg

SEQ ID NO: 56028 - DNA, 25 bp, Homo sapien
cagctgctgattcacgcggccttaa

SEQ ID NO: 56029 - DNA, 25 bp, Homo sapien
agtttctcccatggtgttggtgcca

SEQ ID NO: 56030 - DNA, 25 bp, Homo sapien
tcccgccgtgtaagttcgtcgttga

SEQ ID NO: 56031 - DNA, 25 bp, Homo sapien
ggtgtggcatcaacaccactgtctc

SEQ ID NO: 56032 - DNA, 25 bp, Homo sapien
tacaggagactcacatgcccgattg

SEQ ID NO: 56033 - DNA, 25 bp, Homo sapien
gagagacgtcttcaaccagctgctg

SEQ ID NO: 56034 - DNA, 25 bp, Homo sapien
ccaacaatgtgggtgtgaacgtgtc

SEQ ID NO: 56035 - DNA, 25 bp, Homo sapien
ccgattgacatttcagagagacgtc

SEQ ID NO: 56036 - DNA, 25 bp, Homo sapien
cggagccattcgctgcgctgaagca

SEQ ID NO: 56037 - DNA, 25 bp, Homo sapien
cgacacccttagatggcagttttaa

SEQ ID NO: 56038 - DNA, 25 bp, Homo sapien
ggatcccggcttttcactactgtta

SEQ ID NO: 56039 - DNA, 25 bp, Homo sapien
gctgctatacatggttccggcttga

SEQ ID NO: 56040 - DNA, 25 bp, Homo sapien
tgacgcggatacctagtgacacttg

SEQ ID NO: 56041 - DNA, 25 bp, Homo sapien
tgggccctgacacgtactcactttc

SEQ ID NO: 56042 - DNA, 25 bp, Homo sapien
ccctgggatgcgatcatttcagagc

SEQ ID NO: 56043 - DNA, 25 bp, Homo sapien
tccgttatctcgtctgatggcgttc

SEQ ID NO: 56044 - DNA, 25 bp, Homo sapien
agatagagagcctcgccctggcctg

SEQ ID NO: 56045 - DNA, 25 bp, Homo sapien
acgccctgcttagtggaggagctga

SEQ ID NO: 56046 - DNA, 25 bp, Homo sapien
ccagcacgccctgcttagtggagga

SEQ ID NO: 56047 - DNA, 25 bp, Homo sapien
tgaccagatagagagcctcgccctg

SEQ ID NO: 56048 - DNA, 25 bp, Homo sapien
agggatctcagacccatcctgacgc

SEQ ID NO: 56049 - DNA, 25 bp, Homo sapien
tgacgcagtcactgctggcggagta

SEQ ID NO: 56050 - DNA, 25 bp, Homo sapien
atgctgaggggccttctctgcagag

SEQ ID NO: 56051 - DNA, 25 bp, Homo sapien
agctgagatgaccagatagagagcc

SEQ ID NO: 56052 - DNA, 25 bp, Homo sapien
tgtgagtcatgaagccagagaagcc

SEQ ID NO: 56053 - DNA, 25 bp, Homo sapien
cagagctgcttggatgtgtgagtca

SEQ ID NO: 56054 - DNA, 25 bp, Homo sapien
tgcgtgattctaaagctgccactcg

SEQ ID NO: 56055 - DNA, 25 bp, Homo sapien
aacagcgagtcctctgccgtcgaga

SEQ ID NO: 56056 - DNA, 25 bp, Homo sapien
agacgtctcggtggaaactgccatg

SEQ ID NO: 56057 - DNA, 25 bp, Homo sapien
cttctcacggctgagttgctgcgcc

SEQ ID NO: 56058 - DNA, 25 bp, Homo sapien
aggtaagactttcagccagtcctgc

SEQ ID NO: 56059 - DNA, 25 bp, Homo sapien
caggcgatgccgtggaaagacgtct

SEQ ID NO: 56060 - DNA, 25 bp, Homo sapien
ctctgactttggttcggaggctcct

SEQ ID NO: 56061 - DNA, 25 bp, Homo sapien
ggacaaagttttctccaggagcatt

SEQ ID NO: 56062 - DNA, 25 bp, Homo sapien
gtctgcttgttcagcgtctcctgtg

SEQ ID NO: 56063 - DNA, 25 bp, Homo sapien
ttcacctgtgagaccgtggacactg

SEQ ID NO: 56064 - DNA, 25 bp, Homo sapien
ctgcggcgtccacattcacctgtga

SEQ ID NO: 56065 - DNA, 25 bp, Homo sapien
ctccgactacctgggagcagttccg

SEQ ID NO: 56066 - DNA, 25 bp, Homo sapien
acgggtgcttagcattcctcgggcc

SEQ ID NO: 56067 - DNA, 25 bp, Homo sapien
gtttctcacggatctgcggcgtcca

SEQ ID NO: 56068 - DNA, 25 bp, Homo sapien
ctcccagtgcgcacattcatggcca

SEQ ID NO: 56069 - DNA, 25 bp, Homo sapien
ggccaccccgttgaggtggtcacgc

SEQ ID NO: 56070 - DNA, 25 bp, Homo sapien
catggccaccccgttgaggtggtca

SEQ ID NO: 56071 - DNA, 25 bp, Homo sapien
cattcatggccaccccgttgaggtg

SEQ ID NO: 56072 - DNA, 25 bp, Homo sapien
cacattcatggccaccccgttgagg

SEQ ID NO: 56073 - DNA, 25 bp, Homo sapien
ccagtgcgcacattcatggccaccc

SEQ ID NO: 56074 - DNA, 25 bp, Homo sapien
gctcccagtgcgcacattcatggcc

SEQ ID NO: 56075 - DNA, 25 bp, Homo sapien
tcccagtgcgcacattcatggccac

SEQ ID NO: 56076 - DNA, 25 bp, Homo sapien
tctgctccgtcagcgtcagcggcgg

SEQ ID NO: 56077 - DNA, 25 bp, Homo sapien
ggctctgctcacagtcggccagctt

SEQ ID NO: 56078 - DNA, 25 bp, Homo sapien
cagggctcttgactgtgatggcgca

SEQ ID NO: 56079 - DNA, 25 bp, Homo sapien
ctcttgactgtgatggcgcagtcgg

SEQ ID NO: 56080 - DNA, 25 bp, Homo sapien
ttcagcgtctgctccgtcagcgtca

SEQ ID NO: 56081 - DNA, 25 bp, Homo sapien
atgtggggctctgctcacagtcggc

SEQ ID NO: 56082 - DNA, 25 bp, Homo sapien
agcgtctgctccgtcagcgtcagcg

SEQ ID NO: 56083 - DNA, 25 bp, Homo sapien
agtcggccagcttctcccggagccg

SEQ ID NO: 56084 - DNA, 25 bp, Homo sapien
tgaggcacgagagcggtgctcagca

SEQ ID NO: 56085 - DNA, 25 bp, Homo sapien
ctgaggcacgagagcggtgctcagc

SEQ ID NO: 56086 - DNA, 25 bp, Homo sapien
ccctgaggcacgagagcggtgctca

SEQ ID NO: 56087 - DNA, 25 bp, Homo sapien
cacagcgtcccctgaggcacgagag

SEQ ID NO: 56088 - DNA, 25 bp, Homo sapien
cggaacgtggttggccacagcgtcc

SEQ ID NO: 56089 - DNA, 25 bp, Homo sapien
ccggaacgtggttggccacagcgtc

SEQ ID NO: 56090 - DNA, 25 bp, Homo sapien
cacgagagcggtgctcagcaggcag

SEQ ID NO: 56091 - DNA, 25 bp, Homo sapien
gcacgagagcggtgctcagcaggca

SEQ ID NO: 56092 - DNA, 25 bp, Homo sapien
gggtactctccacggtgactgccct

SEQ ID NO: 56093 - DNA, 25 bp, Homo sapien
actgtcactctcagccaggctctgg

SEQ ID NO: 56094 - DNA, 25 bp, Homo sapien
ctcagccaggctctggtcgggccag

SEQ ID NO: 56095 - DNA, 25 bp, Homo sapien
tcactctcagccaggctctggtcgg

SEQ ID NO: 56096 - DNA, 25 bp, Homo sapien
gtctccaccttcaggcggggcttgc

SEQ ID NO: 56097 - DNA, 25 bp, Homo sapien
tgcagctccacgctgaccttggtct

SEQ ID NO: 56098 - DNA, 25 bp, Homo sapien
ggtgcagctccacgctgaccttggt

SEQ ID NO: 56099 - DNA, 25 bp, Homo sapien
ccgctggggtcctcactgtcactct

SEQ ID NO: 56100 - DNA, 25 bp, Homo sapien
gccgagcacgcccttcaggtgcttc

SEQ ID NO: 56101 - DNA, 25 bp, Homo sapien
ctcctaccgtcagcagggtggccct

SEQ ID NO: 56102 - DNA, 25 bp, Homo sapien
gcgcctcctaccgtcagcagggtgg

SEQ ID NO: 56103 - DNA, 25 bp, Homo sapien
gcggcagccacaccgtgcaccgcgg

SEQ ID NO: 56104 - DNA, 25 bp, Homo sapien
cccgcccctcgagatgccgcccagc

SEQ ID NO: 56105 - DNA, 25 bp, Homo sapien
ggggctgaggctcgatcaccctccc

SEQ ID NO: 56106 - DNA, 25 bp, Homo sapien
caccgtgaggggcatacgggccgca

SEQ ID NO: 56107 - DNA, 25 bp, Homo sapien
cagccacaccgtgcaccgcgggcgg

SEQ ID NO: 56108 - DNA, 25 bp, Homo sapien
accaatgcgcggatgagaacgtgcc

SEQ ID NO: 56109 - DNA, 25 bp, Homo sapien
tctccatgctcagccgtgcgtggct

SEQ ID NO: 56110 - DNA, 25 bp, Homo sapien
agagccttcccagaccaatgcgcgg

SEQ ID NO: 56111 - DNA, 25 bp, Homo sapien
tgaaatccgcacacttctcagagcc

SEQ ID NO: 56112 - DNA, 25 bp, Homo sapien
ctagaggggttttgagatgaaatcc

SEQ ID NO: 56113 - DNA, 25 bp, Homo sapien
cctcagtttcgctggggtgttgagt

SEQ ID NO: 56114 - DNA, 25 bp, Homo sapien
gctcactccggcaggcgacgagtca

SEQ ID NO: 56115 - DNA, 25 bp, Homo sapien
gagcagcgaccctgccatatgggcc

SEQ ID NO: 56116 - DNA, 25 bp, Homo sapien
gtcatcagggtgtcgcctccgcctg

SEQ ID NO: 56117 - DNA, 25 bp, Homo sapien
tgaccagagcgacggcgaactggcc

SEQ ID NO: 56118 - DNA, 25 bp, Homo sapien
aactggccagcgtcatcagggtgtc

SEQ ID NO: 56119 - DNA, 25 bp, Homo sapien
cgacggcgaactggccagcgtcatc

SEQ ID NO: 56120 - DNA, 25 bp, Homo sapien
gcccaggccttaccggaggctgcga

SEQ ID NO: 56121 - DNA, 25 bp, Homo sapien
cccagggtgcggtaaatgatgacca

SEQ ID NO: 56122 - DNA, 25 bp, Homo sapien
tgcggtaaatgatgaccagagcgac

SEQ ID NO: 56123 - DNA, 25 bp, Homo sapien
agggtgtcgcctccgcctgctgatc

SEQ ID NO: 56124 - DNA, 25 bp, Homo sapien
ctcaattgtcagcagcgaacgcgcg

SEQ ID NO: 56125 - DNA, 25 bp, Homo sapien
caagttaatctgctttggtcgctca

SEQ ID NO: 56126 - DNA, 25 bp, Homo sapien
aaaggacggcttagctcctggagcc

SEQ ID NO: 56127 - DNA, 25 bp, Homo sapien
ggggccctcgatagcggccataatc

SEQ ID NO: 56128 - DNA, 25 bp, Homo sapien
acgcccgctaatgcctcttttatca

SEQ ID NO: 56129 - DNA, 25 bp, Homo sapien
tctgttcctttctcagccacaaacg

SEQ ID NO: 56130 - DNA, 25 bp, Homo sapien
ggccgtccggatctcctgattgctt

SEQ ID NO: 56131 - DNA, 25 bp, Homo sapien
ccggggattctgaagccattaggtg

SEQ ID NO: 56132 - DNA, 25 bp, Homo sapien
ttgccaaagagcgtgcccgtgtgct

SEQ ID NO: 56133 - DNA, 25 bp, Homo sapien
ctacctcgtgaaagtcggcgtcctg

SEQ ID NO: 56134 - DNA, 25 bp, Homo sapien
tcctgcgtggctgccaggtcgaagc

SEQ ID NO: 56135 - DNA, 25 bp, Homo sapien
tgccaggtcgaagccctgctgccag

SEQ ID NO: 56136 - DNA, 25 bp, Homo sapien
tgctgccagctctcgtgctgaagga

SEQ ID NO: 56137 - DNA, 25 bp, Homo sapien
gccgtgcgcacgtcattgccaaaga

SEQ ID NO: 56138 - DNA, 25 bp, Homo sapien
cccgtgtgctgtgtagcactgcgca

SEQ ID NO: 56139 - DNA, 25 bp, Homo sapien
tgctgaaggacgtggcccagcagct

SEQ ID NO: 56140 - DNA, 25 bp, Homo sapien
ggcaacggcaggaacatgggaacta

SEQ ID NO: 56141 - DNA, 25 bp, Homo sapien
gctgaacgcactgaccacatttgga

SEQ ID NO: 56142 - DNA, 25 bp, Homo sapien
cacatttggagacgctgggacgcca

SEQ ID NO: 56143 - DNA, 25 bp, Homo sapien
cccgccgaatcggagtggacactca

SEQ ID NO: 56144 - DNA, 25 bp, Homo sapien
tggacactcacacagatacatattc

SEQ ID NO: 56145 - DNA, 25 bp, Homo sapien
gttgacacaggtgcctccattctga

SEQ ID NO: 56146 - DNA, 25 bp, Homo sapien
tgggaactaagaaggtgctgaacgc

SEQ ID NO: 56147 - DNA, 25 bp, Homo sapien
gcctggcaacacagagcgtgcggca

SEQ ID NO: 56148 - DNA, 25 bp, Homo sapien
tggaaatcgatgagcgccagcgcga

SEQ ID NO: 56149 - DNA, 25 bp, Homo sapien
agcggaccgagctcctatcttgcca

SEQ ID NO: 56150 - DNA, 25 bp, Homo sapien
cgaaagtggccctgccctagcggac

SEQ ID NO: 56151 - DNA, 25 bp, Homo sapien
ggagacagccgggaccagaccttca

SEQ ID NO: 56152 - DNA, 25 bp, Homo sapien
cccgcggaagaatgcgctgcagcca

SEQ ID NO: 56153 - DNA, 25 bp, Homo sapien
ttccatagctggaagaggctgtcgc

SEQ ID NO: 56154 - DNA, 25 bp, Homo sapien
ctccacgcagtccaccttgaggatg

SEQ ID NO: 56155 - DNA, 25 bp, Homo sapien
gcggaagtcgatctccttgtggtcg

SEQ ID NO: 56156 - DNA, 25 bp, Homo sapien
ccaggaggacacacgcagtggaagc

SEQ ID NO: 56157 - DNA, 25 bp, Homo sapien
cggaggacatcaacgtcacgatcta

SEQ ID NO: 56158 - DNA, 25 bp, Homo sapien
agccgccgatgagcaggttcacgca

SEQ ID NO: 56159 - DNA, 25 bp, Homo sapien
gggcctctcatactcgccaggagga

SEQ ID NO: 56160 - DNA, 25 bp, Homo sapien
tcacagtagggcctctcatactcgc

SEQ ID NO: 56161 - DNA, 25 bp, Homo sapien
ctcctggtggtcacctcacagtagg

SEQ ID NO: 56162 - DNA, 25 bp, Homo sapien
tcaacgtcacgatctagagggatgg

SEQ ID NO: 56163 - DNA, 25 bp, Homo sapien
cgcacactcacgtgagggagatggt

SEQ ID NO: 56164 - DNA, 25 bp, Homo sapien
ttggtcagcatgtcgtccgtgatga

SEQ ID NO: 56165 - DNA, 25 bp, Homo sapien
ccgagaaggtcacgttcaggatgtt

SEQ ID NO: 56166 - DNA, 25 bp, Homo sapien
ctgggacatgttctccaggcggaca

SEQ ID NO: 56167 - DNA, 25 bp, Homo sapien
acgtcgtccttggtggtggacagca

SEQ ID NO: 56168 - DNA, 25 bp, Homo sapien
agcagcggggacaggaacttctcct

SEQ ID NO: 56169 - DNA, 25 bp, Homo sapien
cagcagcgtccgattcaggtagatc

SEQ ID NO: 56170 - DNA, 25 bp, Homo sapien
tcgcagaacggacacgcacttcatg

SEQ ID NO: 56171 - DNA, 25 bp, Homo sapien
agaggtcgatctccgtctcgcagta

SEQ ID NO: 56172 - DNA, 25 bp, Homo sapien
tttacagcaagacgcacggaggcta

SEQ ID NO: 56173 - DNA, 25 bp, Homo sapien
ccctggactttgaagcccaataggc

SEQ ID NO: 56174 - DNA, 25 bp, Homo sapien
gcccaataggcagctaccggatctg

SEQ ID NO: 56175 - DNA, 25 bp, Homo sapien
ggatctgcgtcccacttggtttaaa

SEQ ID NO: 56176 - DNA, 25 bp, Homo sapien
cccgcagggatttagagctgtgcca

SEQ ID NO: 56177 - DNA, 25 bp, Homo sapien
gggcagagaccttagagctttcaga

SEQ ID NO: 56178 - DNA, 25 bp, Homo sapien
agtgcagcccttaggcctcccagtg

SEQ ID NO: 56179 - DNA, 25 bp, Homo sapien
cccattaaggactgcggaggctgtc

SEQ ID NO: 56180 - DNA, 25 bp, Homo sapien
cacctggatttctaccgaggcgcta

SEQ ID NO: 56181 - DNA, 25 bp, Homo sapien
tccaaccggcggcaacaaatccttg

SEQ ID NO: 56182 - DNA, 25 bp, Homo sapien
tccaggaggcccatcaggagctact

SEQ ID NO: 56183 - DNA, 25 bp, Homo sapien
ttgccctgcacgaaggtgtagttga

SEQ ID NO: 56184 - DNA, 25 bp, Homo sapien
acatgatctgggcattagggccttc

SEQ ID NO: 56185 - DNA, 25 bp, Homo sapien
gccttcatcagggtcgttagcacga

SEQ ID NO: 56186 - DNA, 25 bp, Homo sapien
gtgtacagcagacgcccattgggac

SEQ ID NO: 56187 - DNA, 25 bp, Homo sapien
ccaaaggttgtacacggccacattc

SEQ ID NO: 56188 - DNA, 25 bp, Homo sapien
gtccagtacgctgtccgtgctcacg

SEQ ID NO: 56189 - DNA, 25 bp, Homo sapien
tgcccgccggttcgttctcaaacaa

SEQ ID NO: 56190 - DNA, 25 bp, Homo sapien
ctcctcgccctcgatggtgtagtgc

SEQ ID NO: 56191 - DNA, 25 bp, Homo sapien
tcgcggtactccgactgctcgaaga

SEQ ID NO: 56192 - DNA, 25 bp, Homo sapien
ctctcgttgagctggaagacgtccc

SEQ ID NO: 56193 - DNA, 25 bp, Homo sapien
tggaccacgtagttctgctcgctga

SEQ ID NO: 56194 - DNA, 25 bp, Homo sapien
ccacctggtagttgggcatcggaaa

SEQ ID NO: 56195 - DNA, 25 bp, Homo sapien
gtagtccacggctttcaccctgagg

SEQ ID NO: 56196 - DNA, 25 bp, Homo sapien
gtggccacccaaacaaaggccgcgc

SEQ ID NO: 56197 - DNA, 25 bp, Homo sapien
aggcggtcgaggaaaggcatttcca

SEQ ID NO: 56198 - DNA, 25 bp, Homo sapien
ccatctctagaaaggcgggcggtcc

SEQ ID NO: 56199 - DNA, 25 bp, Homo sapien
gaggccacagcagcgagcgtgctcc

SEQ ID NO: 56200 - DNA, 25 bp, Homo sapien
ttggccccgatatccgctcagggta

SEQ ID NO: 56201 - DNA, 25 bp, Homo sapien
cactctcccttttgggctggcggct

SEQ ID NO: 56202 - DNA, 25 bp, Homo sapien
ggctcgcgacccagctcactcggcc

SEQ ID NO: 56203 - DNA, 25 bp, Homo sapien
cagtccctgacccatctctagaaag

SEQ ID NO: 56204 - DNA, 25 bp, Homo sapien
caaatgagcgacgtcccggagccaa

SEQ ID NO: 56205 - DNA, 25 bp, Homo sapien
tgcttgccatgtggagaaggcttcg

SEQ ID NO: 56206 - DNA, 25 bp, Homo sapien
tgaaggcctcaccatgcttgccatg

SEQ ID NO: 56207 - DNA, 25 bp, Homo sapien
ctgcagaggctgattttgcctttga

SEQ ID NO: 56208 - DNA, 25 bp, Homo sapien
cctagatgagccagagctgatgagg

SEQ ID NO: 56209 - DNA, 25 bp, Homo sapien
cagccaagcctagatgagccagagc

SEQ ID NO: 56210 - DNA, 25 bp, Homo sapien
agccaaacgtgtcgggccctgcagt

SEQ ID NO: 56211 - DNA, 25 bp, Homo sapien
agcgacgtcccggagccaaacgtgt

SEQ ID NO: 56212 - DNA, 25 bp, Homo sapien
gtcgtgacatggagtttgattctta

SEQ ID NO: 56213 - DNA, 25 bp, Homo sapien
cccgaccttacttggaaatggctct

SEQ ID NO: 56214 - DNA, 25 bp, Homo sapien
ttgattcttaactgaccgaagcttg

SEQ ID NO: 56215 - DNA, 25 bp, Homo sapien
agtctgtctttttgatggacccagg

SEQ ID NO: 56216 - DNA, 25 bp, Homo sapien
cctggtgtacagtggagcactcttc

SEQ ID NO: 56217 - DNA, 25 bp, Homo sapien
aatggctctttgcagatgtcactga

SEQ ID NO: 56218 - DNA, 25 bp, Homo sapien
ctgagatgaagtcaccctggtgtac

SEQ ID NO: 56219 - DNA, 25 bp, Homo sapien
ctggaaggtccatccctggcagtgt

SEQ ID NO: 56220 - DNA, 25 bp, Homo sapien
cttcctcgatctagcggagtctcca

SEQ ID NO: 56221 - DNA, 25 bp, Homo sapien
ggagtctccaaatgcctcggacacc

SEQ ID NO: 56222 - DNA, 25 bp, Homo sapien
gacaccgaatgcagcgacgaaatcc

SEQ ID NO: 56223 - DNA, 25 bp, Homo sapien
ttcagaggtcacaagagagatgact

SEQ ID NO: 56224 - DNA, 25 bp, Homo sapien
ttggacaaaatcaggttcagaggtc

SEQ ID NO: 56225 - DNA, 25 bp, Homo sapien
ggacctcagtgctgaacatgctaag

SEQ ID NO: 56226 - DNA, 25 bp, Homo sapien
cccgagcgtcatgttagggtgaagc

SEQ ID NO: 56227 - DNA, 25 bp, Homo sapien
ttagggtgaagcagaggacctcagt

SEQ ID NO: 56228 - DNA, 25 bp, Homo sapien
gcgttgacatgcggatggagcaggg

SEQ ID NO: 56229 - DNA, 25 bp, Homo sapien
gccctgggagcgttgacatgcggat

SEQ ID NO: 56230 - DNA, 25 bp, Homo sapien
ccctgggagcgttgacatgcggatg

SEQ ID NO: 56231 - DNA, 25 bp, Homo sapien
cctgggagcgttgacatgcggatgg

SEQ ID NO: 56232 - DNA, 25 bp, Homo sapien
ctgggagcgttgacatgcggatgga

SEQ ID NO: 56233 - DNA, 25 bp, Homo sapien
ggagcgttgacatgcggatggagca

SEQ ID NO: 56234 - DNA, 25 bp, Homo sapien
gagcgttgacatgcggatggagcag

SEQ ID NO: 56235 - DNA, 25 bp, Homo sapien
ctggccctgggagcgttgacatgcg

SEQ ID NO: 56236 - DNA, 25 bp, Homo sapien
agattcgtgtcctgcccatgctggt

SEQ ID NO: 56237 - DNA, 25 bp, Homo sapien
cacgcacatgtgacgcggaagcctc

SEQ ID NO: 56238 - DNA, 25 bp, Homo sapien
gggtggcagacttctcacgcacatg

SEQ ID NO: 56239 - DNA, 25 bp, Homo sapien
attagcggctggattggttttcctc

SEQ ID NO: 56240 - DNA, 25 bp, Homo sapien
gagccttctgtgttcgcaggtctga

SEQ ID NO: 56241 - DNA, 25 bp, Homo sapien
tgggcctgactctctgtctcacctg

SEQ ID NO: 56242 - DNA, 25 bp, Homo sapien
gaccctgtgagtacctgtcctcgtc

SEQ ID NO: 56243 - DNA, 25 bp, Homo sapien
cggagtctccaaatgcctcggacac

SEQ ID NO: 56244 - DNA, 25 bp, Homo sapien
gcagcccaatcaatctcggacgagg

SEQ ID NO: 56245 - DNA, 25 bp, Homo sapien
cccaacttccgagcgcaagcgtggt

SEQ ID NO: 56246 - DNA, 25 bp, Homo sapien
cgactagcagaatggccgccagcct

SEQ ID NO: 56247 - DNA, 25 bp, Homo sapien
ctcgcgatgaaacccgaagatcagg

SEQ ID NO: 56248 - DNA, 25 bp, Homo sapien
ctggtgcgtcagaatggcccaggca

SEQ ID NO: 56249 - DNA, 25 bp, Homo sapien
agggaatgttccctcaggctggtgc

SEQ ID NO: 56250 - DNA, 25 bp, Homo sapien
ccggatcacgatcgctggcatttta

SEQ ID NO: 56251 - DNA, 25 bp, Homo sapien
gaagtccattcctctttcggaaatg

SEQ ID NO: 56252 - DNA, 25 bp, Homo sapien
ggatgggtagaacctcacggcctgt

SEQ ID NO: 56253 - DNA, 25 bp, Homo sapien
aacctcacggcctgtgtcctttcgt

SEQ ID NO: 56254 - DNA, 25 bp, Homo sapien
ggtagaacctcacggcctgtgtcct

SEQ ID NO: 56255 - DNA, 25 bp, Homo sapien
atgggtagaacctcacggcctgtgt

SEQ ID NO: 56256 - DNA, 25 bp, Homo sapien
gatgggtagaacctcacggcctgtg

SEQ ID NO: 56257 - DNA, 25 bp, Homo sapien
tgggtagaacctcacggcctgtgtc

SEQ ID NO: 56258 - DNA, 25 bp, Homo sapien
gggtagaacctcacggcctgtgtcc

SEQ ID NO: 56259 - DNA, 25 bp, Homo sapien
gaacctcacggcctgtgtcctttcg

SEQ ID NO: 56260 - DNA, 25 bp, Homo sapien
gctcgcatcttcagccctggtggca

SEQ ID NO: 56261 - DNA, 25 bp, Homo sapien
agcaggacttgacgctcatacgctc

SEQ ID NO: 56262 - DNA, 25 bp, Homo sapien
ccgcaatggggctactgagaaagca

SEQ ID NO: 56263 - DNA, 25 bp, Homo sapien
acgctccactgaaacgcaggacttc

SEQ ID NO: 56264 - DNA, 25 bp, Homo sapien
cagcccagtccctcagtggagaaga

SEQ ID NO: 56265 - DNA, 25 bp, Homo sapien
gcgtcatgaggacgggctcgcatct

SEQ ID NO: 56266 - DNA, 25 bp, Homo sapien
gcggcgtttcttccgcacaggcctt

SEQ ID NO: 56267 - DNA, 25 bp, Homo sapien
gagagcgccgtcacccacttgaaaa

SEQ ID NO: 56268 - DNA, 25 bp, Homo sapien
agaagaaaccaacgcggagatgctg

SEQ ID NO: 56269 - DNA, 25 bp, Homo sapien
ctggagcagaaggtgcaggaggtgc

SEQ ID NO: 56270 - DNA, 25 bp, Homo sapien
ccggaagctgcgagaagaaaccaac

SEQ ID NO: 56271 - DNA, 25 bp, Homo sapien
gagctccggaagctgcgagaagaaa

SEQ ID NO: 56272 - DNA, 25 bp, Homo sapien
tggccgttctctcccccatagagga

SEQ ID NO: 56273 - DNA, 25 bp, Homo sapien
ggacatgagcgatggtcacctggcc

SEQ ID NO: 56274 - DNA, 25 bp, Homo sapien
tcgcgtggacatgagcgatggtcac

SEQ ID NO: 56275 - DNA, 25 bp, Homo sapien
tgctgaaggccaggtaccgcgcctt

SEQ ID NO: 56276 - DNA, 25 bp, Homo sapien
ctcgcgcctgcagaagtggttctac

SEQ ID NO: 56277 - DNA, 25 bp, Homo sapien
ccgaggagaacactgtggagacaga

SEQ ID NO: 56278 - DNA, 25 bp, Homo sapien
cggttccagcccgaggagaacactg

SEQ ID NO: 56279 - DNA, 25 bp, Homo sapien
tacgtggaggacttccggttccagc

SEQ ID NO: 56280 - DNA, 25 bp, Homo sapien
cctgccgtgccctcaccgggtccct

SEQ ID NO: 56281 - DNA, 25 bp, Homo sapien
cagaagtggttctacgagcggtttg

SEQ ID NO: 56282 - DNA, 25 bp, Homo sapien
cgcctgcagaagtggttctacgagc

SEQ ID NO: 56283 - DNA, 25 bp, Homo sapien
ttccagcccgaggagaacactgtgg

SEQ ID NO: 56284 - DNA, 25 bp, Homo sapien
tctgacagaaaacgagcgtccgctg

SEQ ID NO: 56285 - DNA, 25 bp, Homo sapien
ccacgagatcttcaatctgacagaa

SEQ ID NO: 56286 - DNA, 25 bp, Homo sapien
caagaagggcaatttccacgagatc

SEQ ID NO: 56287 - DNA, 25 bp, Homo sapien
taaagaggaggacgccggtcgcttc

SEQ ID NO: 56288 - DNA, 25 bp, Homo sapien
tcgtcacggagctacgtacccagcg

SEQ ID NO: 56289 - DNA, 25 bp, Homo sapien
tggcagctgcagacgacctcgtcac

SEQ ID NO: 56290 - DNA, 25 bp, Homo sapien
acctcgacgctgtttgccgttggca

SEQ ID NO: 56291 - DNA, 25 bp, Homo sapien
cgccgacacagactgaaggcccgtg

SEQ ID NO: 56292 - DNA, 25 bp, Homo sapien
gcggcctttcccgaatggggacaga

SEQ ID NO: 56293 - DNA, 25 bp, Homo sapien
gccgcagagtcacacgctggtgccg

SEQ ID NO: 56294 - DNA, 25 bp, Homo sapien
ggagctgcgccgatcaccagattaa

SEQ ID NO: 56295 - DNA, 25 bp, Homo sapien
cgatcaccagattaagcacatgtcc

SEQ ID NO: 56296 - DNA, 25 bp, Homo sapien
cacatgtcctatcccaggcggtgga

SEQ ID NO: 56297 - DNA, 25 bp, Homo sapien
ggacgttggcgtcaggatgaccaca

SEQ ID NO: 56298 - DNA, 25 bp, Homo sapien
tcccgaatggggacagaacccgctc

SEQ ID NO: 56299 - DNA, 25 bp, Homo sapien
caggatgaccacacggcggcctttc

SEQ ID NO: 56300 - DNA, 25 bp, Homo sapien
ggcagcatgaggaacggtgtctaca

SEQ ID NO: 56301 - DNA, 25 bp, Homo sapien
ctgcagaggaaaccagcgatccatc

SEQ ID NO: 56302 - DNA, 25 bp, Homo sapien
gccttccgggaagaatcctctggtc

SEQ ID NO: 56303 - DNA, 25 bp, Homo sapien
gggcacggatacacactaaacaagg

SEQ ID NO: 56304 - DNA, 25 bp, Homo sapien
cagacatcatctacgtgggcacgga

SEQ ID NO: 56305 - DNA, 25 bp, Homo sapien
cccgctccttacagatcaaagttta

SEQ ID NO: 56306 - DNA, 25 bp, Homo sapien
gtctacagcgtgctccaaacggcca

SEQ ID NO: 56307 - DNA, 25 bp, Homo sapien
tccatcgtggcttcgaggcaaaaga

SEQ ID NO: 56308 - DNA, 25 bp, Homo sapien
tgggaaagaactcggcccacactgg

SEQ ID NO: 56309 - DNA, 25 bp, Homo sapien
tgcccacggtggagtaacacacgca

SEQ ID NO: 56310 - DNA, 25 bp, Homo sapien
aggtttctgcgtcgctggtgcccac

SEQ ID NO: 56311 - DNA, 25 bp, Homo sapien
ggaggggctcaccaacaacgatatg

SEQ ID NO: 56312 - DNA, 25 bp, Homo sapien
caacgatatgcagcgccgaggtttc

SEQ ID NO: 56313 - DNA, 25 bp, Homo sapien
gtcctgacaacgtggcctcggagct

SEQ ID NO: 56314 - DNA, 25 bp, Homo sapien
gcatcgcgcatgtggtggattccgt

SEQ ID NO: 56315 - DNA, 25 bp, Homo sapien
acggcaacggctggaacacgcgacg

SEQ ID NO: 56316 - DNA, 25 bp, Homo sapien
gtccactgagtatttgctgatcgtc

SEQ ID NO: 56317 - DNA, 25 bp, Homo sapien
ctccctccgcgatgcgtgtaacgtg

SEQ ID NO: 56318 - DNA, 25 bp, Homo sapien
cgcgtaggcacaacttccggaagga

SEQ ID NO: 56319 - DNA, 25 bp, Homo sapien
gttgcgcggcgtcgccctttaataa

SEQ ID NO: 56320 - DNA, 25 bp, Homo sapien
tctggaagcgcagcaacagcaagct

SEQ ID NO: 56321 - DNA, 25 bp, Homo sapien
acacggggcagttcagctttggaaa

SEQ ID NO: 56322 - DNA, 25 bp, Homo sapien
ccggctccgaaacgcgctcaagaga

SEQ ID NO: 56323 - DNA, 25 bp, Homo sapien
cgtcactcgccaccagggacttagg

SEQ ID NO: 56324 - DNA, 25 bp, Homo sapien
gagagcctgaactccgaggtggtca

SEQ ID NO: 56325 - DNA, 25 bp, Homo sapien
tgcgtaaccacagccagcggcaggg

SEQ ID NO: 56326 - DNA, 25 bp, Homo sapien
gccaaccgtgtgctgcgtaaccaca

SEQ ID NO: 56327 - DNA, 25 bp, Homo sapien
gcctgaactccgaggtggtcatgga

SEQ ID NO: 56328 - DNA, 25 bp, Homo sapien
ccagcggcgacctccggctggtgaa

SEQ ID NO: 56329 - DNA, 25 bp, Homo sapien
ccatggcggcggagagcctgaactc

SEQ ID NO: 56330 - DNA, 25 bp, Homo sapien
gaggacgacgatgagctcctggcca

SEQ ID NO: 56331 - DNA, 25 bp, Homo sapien
tggtcatggagacggccaaccgtgt

SEQ ID NO: 56332 - DNA, 25 bp, Homo sapien
cggggccagaatccttttccataga

SEQ ID NO: 56333 - DNA, 25 bp, Homo sapien
tccttttttgatagaggtccgcgca

SEQ ID NO: 56334 - DNA, 25 bp, Homo sapien
ccttttccatagaggtccgcgcagt

SEQ ID NO: 56335 - DNA, 25 bp, Homo sapien
tccttttccatagaggtccgcgcag

SEQ ID NO: 56336 - DNA, 25 bp, Homo sapien
tttttgatagaggtccgcgcagtgc

SEQ ID NO: 56337 - DNA, 25 bp, Homo sapien
cttttccatagaggtccgcgcagtg

SEQ ID NO: 56338 - DNA, 25 bp, Homo sapien
ccggggccagaatccttttccatag

SEQ ID NO: 56339 - DNA, 25 bp, Homo sapien
cgggaccagaatccttttccataga

SEQ ID NO: 56340 - DNA, 25 bp, Homo sapien
ggtgatgcagatctcgatgccaccc

SEQ ID NO: 56341 - DNA, 25 bp, Homo sapien
ggaacccgctcctgagactcccgcc

SEQ ID NO: 56342 - DNA, 25 bp, Homo sapien
ccgcgccagtgccgcggggaacata

SEQ ID NO: 56343 - DNA, 25 bp, Homo sapien
cttcgggtccgagactccagaactc

SEQ ID NO: 56344 - DNA, 25 bp, Homo sapien
gggtccgagactccagaactccgcg

SEQ ID NO: 56345 - DNA, 25 bp, Homo sapien
gaaggtgatgcagatctcgatgcca

SEQ ID NO: 56346 - DNA, 25 bp, Homo sapien
tgcgaaccgtctgccgcacgcagtc

SEQ ID NO: 56347 - DNA, 25 bp, Homo sapien
gagctaaggccgcggtacaggccca

SEQ ID NO: 56348 - DNA, 25 bp, Homo sapien
acggcgtcttctcagcccagggcgg

SEQ ID NO: 56349 - DNA, 25 bp, Homo sapien
agctccgagcctggctccgggtgca

SEQ ID NO: 56350 - DNA, 25 bp, Homo sapien
cccgtggcaggtgcggtttctccac

SEQ ID NO: 56351 - DNA, 25 bp, Homo sapien
gtttctccaccggttgtcagctgcg

SEQ ID NO: 56352 - DNA, 25 bp, Homo sapien
tcaacctccggccttgtttcaggga

SEQ ID NO: 56353 - DNA, 25 bp, Homo sapien
aggatggggtcgacccttgcgatcc

SEQ ID NO: 56354 - DNA, 25 bp, Homo sapien
gggttctgatgccacctgggccgac

SEQ ID NO: 56355 - DNA, 25 bp, Homo sapien
tgtcttcctcctgtgggttctgatg

SEQ ID NO: 56356 - DNA, 25 bp, Homo sapien
ggcgaccctagcttcgctcgctttg

SEQ ID NO: 56357 - DNA, 25 bp, Homo sapien
ggtggcaccacatcctcgcgggaca

SEQ ID NO: 56358 - DNA, 25 bp, Homo sapien
tatgcaaatattcctccgcgcggcg

SEQ ID NO: 56359 - DNA, 25 bp, Homo sapien
gaaacgccgcgccatatgcaaatat

SEQ ID NO: 56360 - DNA, 25 bp, Homo sapien
gccgcagtcagcaaccaatcacaag

SEQ ID NO: 56361 - DNA, 25 bp, Homo sapien
gcgcggcgcaagtcaactgcgcttc

SEQ ID NO: 56362 - DNA, 25 bp, Homo sapien
ctctctccgcgagcaagacaggctg

SEQ ID NO: 56363 - DNA, 25 bp, Homo sapien
attggccgaggctcctagctcctct

SEQ ID NO: 56364 - DNA, 25 bp, Homo sapien
acacggtggacgtctccggcgtgcc

SEQ ID NO: 56365 - DNA, 25 bp, Homo sapien
gtcccgtgtggctaagtctccttgt

SEQ ID NO: 56366 - DNA, 25 bp, Homo sapien
ccttgtcttttgcatgctcggcgcc

SEQ ID NO: 56367 - DNA, 25 bp, Homo sapien
tgctgtgcaacatcgaggccgacac

SEQ ID NO: 56368 - DNA, 25 bp, Homo sapien
acctactggtgcatgagcaagctgc

SEQ ID NO: 56369 - DNA, 25 bp, Homo sapien
agcaagctgctggatggcattcagg

SEQ ID NO: 56370 - DNA, 25 bp, Homo sapien
atcgaggccgacacctactggtgca

SEQ ID NO: 56371 - DNA, 25 bp, Homo sapien
ctggatggcattcaggtgagcgccc

SEQ ID NO: 56372 - DNA, 25 bp, Homo sapien
ttctgagagtgagtggtcgcgttcc

SEQ ID NO: 56373 - DNA, 25 bp, Homo sapien
agtggtcgcgttcctgtccctcggt

SEQ ID NO: 56374 - DNA, 25 bp, Homo sapien
agtggtcgcattcctgtccctcggt

SEQ ID NO: 56375 - DNA, 25 bp, Homo sapien
tctgagagcgagtggtcgcattcct

SEQ ID NO: 56376 - DNA, 25 bp, Homo sapien
gagtggtcgcattcctgtccctcgg

SEQ ID NO: 56377 - DNA, 25 bp, Homo sapien
agcgagtggtcgcattcctgtccct

SEQ ID NO: 56378 - DNA, 25 bp, Homo sapien
gcccaggttctgagagtgagtggtc

SEQ ID NO: 56379 - DNA, 25 bp, Homo sapien
gcgttcctgtccctcggtccctgtc

SEQ ID NO: 56380 - DNA, 25 bp, Homo sapien
gttgagccacgctgtcttcctcggt

SEQ ID NO: 56381 - DNA, 25 bp, Homo sapien
ccacggtcctggaaaggttgagcca

SEQ ID NO: 56382 - DNA, 25 bp, Homo sapien
ttgagccacgctgtcttcctcggtg

SEQ ID NO: 56383 - DNA, 25 bp, Homo sapien
ctggaaaggttgagccacgctgtct

SEQ ID NO: 56384 - DNA, 25 bp, Homo sapien
caccacggtcctggaaaggttgagc

SEQ ID NO: 56385 - DNA, 25 bp, Homo sapien
cctggaaaggttgagccacgctgtc

SEQ ID NO: 56386 - DNA, 25 bp, Homo sapien
tgagccacgctgtcttcctcggtgc

SEQ ID NO: 56387 - DNA, 25 bp, Homo sapien
tcctggaaaggttgagccacgctgt

SEQ ID NO: 56388 - DNA, 25 bp, Homo sapien
tggcatcgagcagggagagtcaccc

SEQ ID NO: 56389 - DNA, 25 bp, Homo sapien
tcgagcagggagagtcaccccacac

SEQ ID NO: 56390 - DNA, 25 bp, Homo sapien
gcagggagagtcaccccacaccgtg

SEQ ID NO: 56391 - DNA, 25 bp, Homo sapien
ccacaccgtggcatcgagcagggag

SEQ ID NO: 56392 - DNA, 25 bp, Homo sapien
accgtggcatcgagcagggagagtc

SEQ ID NO: 56393 - DNA, 25 bp, Homo sapien
cccacaccgtggcatcgagcaggga

SEQ ID NO: 56394 - DNA, 25 bp, Homo sapien
cgtggcatcgagcagggagagtcac

SEQ ID NO: 56395 - DNA, 25 bp, Homo sapien
cacaccgtggcatcgagcagggaga

SEQ ID NO: 56396 - DNA, 25 bp, Homo sapien
tgtaggcacttcctcgtggtcttga

SEQ ID NO: 56397 - DNA, 25 bp, Homo sapien
tagccattggcctcggcagcttcga

SEQ ID NO: 56398 - DNA, 25 bp, Homo sapien
ggcagcttcgaggttttctttcttc

SEQ ID NO: 56399 - DNA, 25 bp, Homo sapien
tcaagattgtcctccaggcagagtc

SEQ ID NO: 56400 - DNA, 25 bp, Homo sapien
gtggtcttgatatgtaggccctccc

SEQ ID NO: 56401 - DNA, 25 bp, Homo sapien
cctcgagcaggatttaaagcacaca

SEQ ID NO: 56402 - DNA, 25 bp, Homo sapien
tttcagaattacagaccacaccatg

SEQ ID NO: 56403 - DNA, 25 bp, Homo sapien
tgcacagatgagcacctttctatag

SEQ ID NO: 56404 - DNA, 25 bp, Homo sapien
gtgtccacactcaaatatgcgcgtg

SEQ ID NO: 56405 - DNA, 25 bp, Homo sapien
gcgcgtgtccacactcaaatatgtg

SEQ ID NO: 56406 - DNA, 25 bp, Homo sapien
tatgcgcgtgtccacactgaccgtc

SEQ ID NO: 56407 - DNA, 25 bp, Homo sapien
tgtgcgtgtccacactcaaatatgc

SEQ ID NO: 56408 - DNA, 25 bp, Homo sapien
tcaaacatgcgcgtgtccacactga

SEQ ID NO: 56409 - DNA, 25 bp, Homo sapien
tatgagcgtgtccacactgaccgtc

SEQ ID NO: 56410 - DNA, 25 bp, Homo sapien
tatgtgcgtgtccacactgaccgtc

SEQ ID NO: 56411 - DNA, 25 bp, Homo sapien
aatatgcgcgtgtccacactgaccg

SEQ ID NO: 56412 - DNA, 25 bp, Homo sapien
gtccgtggagtgtcagagcctccta

SEQ ID NO: 56413 - DNA, 25 bp, Homo sapien
cgcccgctttctctcggaaacgtga

SEQ ID NO: 56414 - DNA, 25 bp, Homo sapien
aaacgtgaagtgtggcctcagctga

SEQ ID NO: 56415 - DNA, 25 bp, Homo sapien
agcccagtgagccaccgtccgtgga

SEQ ID NO: 56416 - DNA, 25 bp, Homo sapien
agcctcctaggatggccacgccgaa

SEQ ID NO: 56417 - DNA, 25 bp, Homo sapien
gctggcccagcgtcagacgtttcca

SEQ ID NO: 56418 - DNA, 25 bp, Homo sapien
ttgatgacgatgatggagcccagtg

SEQ ID NO: 56419 - DNA, 25 bp, Homo sapien
acgtttccagcatccgcgggagtga

SEQ ID NO: 56420 - DNA, 25 bp, Homo sapien
tttaagtcccgtaatggagtcgcca

SEQ ID NO: 56421 - DNA, 25 bp, Homo sapien
tcagcggatcttagagtggcttttc

SEQ ID NO: 56422 - DNA, 25 bp, Homo sapien
tggagtcgccaaaacccagtagccg

SEQ ID NO: 56423 - DNA, 25 bp, Homo sapien
gtccatcctgacacccgttgggttg

SEQ ID NO: 56424 - DNA, 25 bp, Homo sapien
tccgacatttaaaggtggcattccc

SEQ ID NO: 56425 - DNA, 25 bp, Homo sapien
tctctgtgcctgaatccgacattta

SEQ ID NO: 56426 - DNA, 25 bp, Homo sapien
gctgcagataatacgcctcgcggca

SEQ ID NO: 56427 - DNA, 25 bp, Homo sapien
ggggtttctcacaagcccgacatca

SEQ ID NO: 56428 - DNA, 25 bp, Homo sapien
cagcctgtggtctcatctgtggcca

SEQ ID NO: 56429 - DNA, 25 bp, Homo sapien
ttcgcaggtacaggagaagtcggta

SEQ ID NO: 56430 - DNA, 25 bp, Homo sapien
tgacagtccctcttcgagcgggaaa

SEQ ID NO: 56431 - DNA, 25 bp, Homo sapien
gggttcattatgtctcgatcgctca

SEQ ID NO: 56432 - DNA, 25 bp, Homo sapien
gatcgctcagagaaggcaaccaggt

SEQ ID NO: 56433 - DNA, 25 bp, Homo sapien
ctcctccaaggttatccacgatgtg

SEQ ID NO: 56434 - DNA, 25 bp, Homo sapien
tggccacccggggaaatgacagtcc

SEQ ID NO: 56435 - DNA, 25 bp, Homo sapien
ctcctcacagggattcgcaggtaca

SEQ ID NO: 56436 - DNA, 25 bp, Homo sapien
aggagcagctggagcttccgctttc

SEQ ID NO: 56437 - DNA, 25 bp, Homo sapien
tcgtcaggcgccttctggaaagaga

SEQ ID NO: 56438 - DNA, 25 bp, Homo sapien
cgcggacgtttctcgggtcgtgtct

SEQ ID NO: 56439 - DNA, 25 bp, Homo sapien
cgggctccctgttgcctggagtgaa

SEQ ID NO: 56440 - DNA, 25 bp, Homo sapien
ttggagtcccgggtgcagactccag

SEQ ID NO: 56441 - DNA, 25 bp, Homo sapien
agcatcccggggcacgttcgcggct

SEQ ID NO: 56442 - DNA, 25 bp, Homo sapien
agccagcggcttcccggccgagatg

SEQ ID NO: 56443 - DNA, 25 bp, Homo sapien
ctttctgggcgttcatgatcctggc

SEQ ID NO: 56444 - DNA, 25 bp, Homo sapien
atgtgattatggaagctctgcggtc

SEQ ID NO: 56445 - DNA, 25 bp, Homo sapien
gggtcagttcggttcagagcgactc

SEQ ID NO: 56446 - DNA, 25 bp, Homo sapien
tagaggccaataggccgcccgcatc

SEQ ID NO: 56447 - DNA, 25 bp, Homo sapien
agttcggttcagagcgactcagccc

SEQ ID NO: 56448 - DNA, 25 bp, Homo sapien
gaagctctgcggtcatacaaccagg

SEQ ID NO: 56449 - DNA, 25 bp, Homo sapien
atacaaccaggaggtaagcggccgc

SEQ ID NO: 56450 - DNA, 25 bp, Homo sapien
gaccctgccatccgttctgagcagt

SEQ ID NO: 56451 - DNA, 25 bp, Homo sapien
gcctgagttagaggccaataggccg

SEQ ID NO: 56452 - DNA, 25 bp, Homo sapien
gccctggggacgaaaaccgatcaca

SEQ ID NO: 56453 - DNA, 25 bp, Homo sapien
cgatcacagaggcaaactcaggggc

SEQ ID NO: 56454 - DNA, 25 bp, Homo sapien
aataaggaccgcaggacgccaagga

SEQ ID NO: 56455 - DNA, 25 bp, Homo sapien
ctgcagcgggaatttgtgtgcctcc

SEQ ID NO: 56456 - DNA, 25 bp, Homo sapien
ctggaagtgctcctgaaagcgaaca

SEQ ID NO: 56457 - DNA, 25 bp, Homo sapien
tgccagctacccgagtgaaaggttt

SEQ ID NO: 56458 - DNA, 25 bp, Homo sapien
attaatcctgatggggtctgcggcg

SEQ ID NO: 56459 - DNA, 25 bp, Homo sapien
catgttcacggtcctcccaggcgaa

SEQ ID NO: 56460 - DNA, 25 bp, Homo sapien
cttagcaggcctgacttgcgcttcc

SEQ ID NO: 56461 - DNA, 25 bp, Homo sapien
ggctgacatcgcactgtgtcccaga

SEQ ID NO: 56462 - DNA, 25 bp, Homo sapien
tatctagctcgtagtagcactgggg

SEQ ID NO: 56463 - DNA, 25 bp, Homo sapien
gtgagtcaccagtatctagctcgta

SEQ ID NO: 56464 - DNA, 25 bp, Homo sapien
gcttcccgtgacgacgtggctaatt

SEQ ID NO: 56465 - DNA, 25 bp, Homo sapien
tgtgaaacacgcatacttagcaggc

SEQ ID NO: 56466 - DNA, 25 bp, Homo sapien
ctgagctggagagtaaaccctgtga

SEQ ID NO: 56467 - DNA, 25 bp, Homo sapien
tggctaattgggaagtgagtcacca

SEQ ID NO: 56468 - DNA, 25 bp, Homo sapien
ctccacgtgccgtcccatgggaaag

SEQ ID NO: 56469 - DNA, 25 bp, Homo sapien
ataggatttggggacctccacgtgc

SEQ ID NO: 56470 - DNA, 25 bp, Homo sapien
cgatgccttcgcagcataggatttg

SEQ ID NO: 56471 - DNA, 25 bp, Homo sapien
gtgccgtcaggctcccggcattggt

SEQ ID NO: 56472 - DNA, 25 bp, Homo sapien
gggaggagcgtcactgctctcagca

SEQ ID NO: 56473 - DNA, 25 bp, Homo sapien
ctcagcaggggaccgtttctctaac

SEQ ID NO: 56474 - DNA, 25 bp, Homo sapien
tctctaacgggagcctgtcagtttc

SEQ ID NO: 56475 - DNA, 25 bp, Homo sapien
tcccatgggaaagccgagtccttgt

SEQ ID NO: 56476 - DNA, 25 bp, Homo sapien
ctcctgaaggcgctctgggcactgg

SEQ ID NO: 56477 - DNA, 25 bp, Homo sapien
cacgcgcagttcctcaaagaaggta

SEQ ID NO: 56478 - DNA, 25 bp, Homo sapien
tcgtcctagtgatccacgcgcagtt

SEQ ID NO: 56479 - DNA, 25 bp, Homo sapien
cgcgcaagttcgatcgccgcgggct

SEQ ID NO: 56480 - DNA, 25 bp, Homo sapien
gcggcccgagactttctgctaacct

SEQ ID NO: 56481 - DNA, 25 bp, Homo sapien
tgcccagaaagacacaaatcgcctc

SEQ ID NO: 56482 - DNA, 25 bp, Homo sapien
gactccgcgatgcagctcctgaagg

SEQ ID NO: 56483 - DNA, 25 bp, Homo sapien
ctggaccttcgctgcgcgacttcgg

SEQ ID NO: 56484 - DNA, 25 bp, Homo sapien
agccgcagcctgttgcgtggccctg

SEQ ID NO: 56485 - DNA, 25 bp, Homo sapien
atgagcatggtttcgccagcagccg

SEQ ID NO: 56486 - DNA, 25 bp, Homo sapien
atggatgagcatggtttcgccagca

SEQ ID NO: 56487 - DNA, 25 bp, Homo sapien
accttgcaggatgccctgacggcgg

SEQ ID NO: 56488 - DNA, 25 bp, Homo sapien
ttcgaccttgcaggatgccctgacg

SEQ ID NO: 56489 - DNA, 25 bp, Homo sapien
gagcacaaactccagctgtcacctt

SEQ ID NO: 56490 - DNA, 25 bp, Homo sapien
cggcggtgagcacaaactccagctg

SEQ ID NO: 56491 - DNA, 25 bp, Homo sapien
acgcagcccgtgatgtgtttgtgac

SEQ ID NO: 56492 - DNA, 25 bp, Homo sapien
cccgcctgtgtggacggtaagcacc

SEQ ID NO: 56493 - DNA, 25 bp, Homo sapien
ccggcacctgtgagattgtgacctt

SEQ ID NO: 56494 - DNA, 25 bp, Homo sapien
agcctcggaggacgatcgcccggca

SEQ ID NO: 56495 - DNA, 25 bp, Homo sapien
tagaaaggggcagatcgccggcacc

SEQ ID NO: 56496 - DNA, 25 bp, Homo sapien
cgcggcgtcaccaaaggtgcctctt

SEQ ID NO: 56497 - DNA, 25 bp, Homo sapien
ttggaccgggacagcagccagcctc

SEQ ID NO: 56498 - DNA, 25 bp, Homo sapien
gtcaccaaaggtgcctcttccctga

SEQ ID NO: 56499 - DNA, 25 bp, Homo sapien
gaccgcccgctgtgcgtgtagaaag

SEQ ID NO: 56500 - DNA, 25 bp, Homo sapien
ccgcgtcttcactgggagctgtagt

SEQ ID NO: 56501 - DNA, 25 bp, Homo sapien
actcaggaccgcgtcttcactggga

SEQ ID NO: 56502 - DNA, 25 bp, Homo sapien
gccgcgtcttcactgggagctgtaa

SEQ ID NO: 56503 - DNA, 25 bp, Homo sapien
accgcgtcttcactgggagctgtaa

SEQ ID NO: 56504 - DNA, 25 bp, Homo sapien
ctcaggaccgcgtcttcactgggaa

SEQ ID NO: 56505 - DNA, 25 bp, Homo sapien
cgcgtcttcactgggaactgtaatc

SEQ ID NO: 56506 - DNA, 25 bp, Homo sapien
ctcagggccgcgtcttcactgggag

SEQ ID NO: 56507 - DNA, 25 bp, Homo sapien
ccgcgtcttcactgggagctgtaat

SEQ ID NO: 56508 - DNA, 25 bp, Homo sapien
cccgtcatcttgagaacagtgtaag

SEQ ID NO: 56509 - DNA, 25 bp, Homo sapien
gcccactcggattcccagtagctga

SEQ ID NO: 56510 - DNA, 25 bp, Homo sapien
agtagctgagcgcaggacgtgacct

SEQ ID NO: 56511 - DNA, 25 bp, Homo sapien
ccaaggccgttggaacgctgccctt

SEQ ID NO: 56512 - DNA, 25 bp, Homo sapien
ctcagcagcgtgtttgtcaagggca

SEQ ID NO: 56513 - DNA, 25 bp, Homo sapien
agaacagtgtaagaactccgcgagc

SEQ ID NO: 56514 - DNA, 25 bp, Homo sapien
cgagcccgtgctcactattcacaga

SEQ ID NO: 56515 - DNA, 25 bp, Homo sapien
aagggcacttactcaggcccaaggc

SEQ ID NO: 56516 - DNA, 25 bp, Homo sapien
ctgggcagcatggtgtattagaaga

SEQ ID NO: 56517 - DNA, 25 bp, Homo sapien
gcagcacagtggagcaggcattatg

SEQ ID NO: 56518 - DNA, 25 bp, Homo sapien
agcacagttttagtcagagcccaca

SEQ ID NO: 56519 - DNA, 25 bp, Homo sapien
gacagcagagtcaagcacagtttta

SEQ ID NO: 56520 - DNA, 25 bp, Homo sapien
ttcacagcggaggacacagacagca

SEQ ID NO: 56521 - DNA, 25 bp, Homo sapien
ctggtgttgagaaacctgcttcaca

SEQ ID NO: 56522 - DNA, 25 bp, Homo sapien
cccacgaggatggtcctggtgttga

SEQ ID NO: 56523 - DNA, 25 bp, Homo sapien
gagctcaggtgcgatgaagcccaag

SEQ ID NO: 56524 - DNA, 25 bp, Homo sapien
ctgcccggggttcaccctgagcatg

SEQ ID NO: 56525 - DNA, 25 bp, Homo sapien
gggcacacacggctttgtcgtcggc

SEQ ID NO: 56526 - DNA, 25 bp, Homo sapien
gagcatgggcacacacggctttgtc

SEQ ID NO: 56527 - DNA, 25 bp, Homo sapien
cctgtccggggttcaccctgagcat

SEQ ID NO: 56528 - DNA, 25 bp, Homo sapien
gcatgggcacacacggctttgtcgt

SEQ ID NO: 56529 - DNA, 25 bp, Homo sapien
ggttcaccctgagcattggcacaca

SEQ ID NO: 56530 - DNA, 25 bp, Homo sapien
ctggcctgtccagggttcaccctga

SEQ ID NO: 56531 - DNA, 25 bp, Homo sapien
tgagcatgggcacacacggctttgt

SEQ ID NO: 56532 - DNA, 25 bp, Homo sapien
tcaggttcaccaagaggtcggcgga

SEQ ID NO: 56533 - DNA, 25 bp, Homo sapien
cctcgaaggtgatgaagatgggtct

SEQ ID NO: 56534 - DNA, 25 bp, Homo sapien
taaccatctcccacgtgcacagggg

SEQ ID NO: 56535 - DNA, 25 bp, Homo sapien
agttcacgaacttgcggtcctcggg

SEQ ID NO: 56536 - DNA, 25 bp, Homo sapien
aaggcgtccgaaagcaccacgatga

SEQ ID NO: 56537 - DNA, 25 bp, Homo sapien
tccagagcagcaaggtcaccaggtg

SEQ ID NO: 56538 - DNA, 25 bp, Homo sapien
agacgtaggcgtcgtagagcttccc

SEQ ID NO: 56539 - DNA, 25 bp, Homo sapien
cagggcccattcacaaagcgtggtg

SEQ ID NO: 56540 - DNA, 25 bp, Homo sapien
tctgccaagagcatgttgggtctcc

SEQ ID NO: 56541 - DNA, 25 bp, Homo sapien
cccagactgtccgaattgcttttat

SEQ ID NO: 56542 - DNA, 25 bp, Homo sapien
gcctcttctacagctccatttttga

SEQ ID NO: 56543 - DNA, 25 bp, Homo sapien
tgtcaggcacagaagcggcctcctc

SEQ ID NO: 56544 - DNA, 25 bp, Homo sapien
taacaattaacgtggcagtcccggc

SEQ ID NO: 56545 - DNA, 25 bp, Homo sapien
cttggctcctgattccctctctggt

SEQ ID NO: 56546 - DNA, 25 bp, Homo sapien
tccctgtattggtcaacacttgagc

SEQ ID NO: 56547 - DNA, 25 bp, Homo sapien
ggccgctttattcctctgtacttag

SEQ ID NO: 56548 - DNA, 25 bp, Homo sapien
gccaaagcgcccgcggagcagagca

SEQ ID NO: 56549 - DNA, 25 bp, Homo sapien
ccctggagacaatgctctcagtccg

SEQ ID NO: 56550 - DNA, 25 bp, Homo sapien
ggccctggagacaatgctctcagtc

SEQ ID NO: 56551 - DNA, 25 bp, Homo sapien
caggccctggagacaatgctctcag

SEQ ID NO: 56552 - DNA, 25 bp, Homo sapien
tcccggatcgtgcccggcaggccct

SEQ ID NO: 56553 - DNA, 25 bp, Homo sapien
aaagcagcacggcatgtgcccgcag

SEQ ID NO: 56554 - DNA, 25 bp, Homo sapien
gctgaaagcagcacggcatgtgccc

SEQ ID NO: 56555 - DNA, 25 bp, Homo sapien
ctggctgaaagcagcacggcatgtg

SEQ ID NO: 56556 - DNA, 25 bp, Homo sapien
ccgggcttcggactcgaacgaatgc

SEQ ID NO: 56557 - DNA, 25 bp, Homo sapien
cgcgtgaaacgcaaggccctcgtgt

SEQ ID NO: 56558 - DNA, 25 bp, Homo sapien
cgaccaaccggctagggcctgactg

SEQ ID NO: 56559 - DNA, 25 bp, Homo sapien
catgaacatttggactcggaggagc

SEQ ID NO: 56560 - DNA, 25 bp, Homo sapien
gggcggacgcgtttattagaagatc

SEQ ID NO: 56561 - DNA, 25 bp, Homo sapien
gtcattcatcaacacgcgctattgg

SEQ ID NO: 56562 - DNA, 25 bp, Homo sapien
tcgccagtctgagtccgacttatta

SEQ ID NO: 56563 - DNA, 25 bp, Homo sapien
ggggccgtttgcctagacatgaaca

SEQ ID NO: 56564 - DNA, 25 bp, Homo sapien
caaggacactgtgctgcgtgctttc

SEQ ID NO: 56565 - DNA, 25 bp, Homo sapien
acactgtgctgcgtgctttcaagac

SEQ ID NO: 56566 - DNA, 25 bp, Homo sapien
ccaggaccgggacttctgaaaagtg

SEQ ID NO: 56567 - DNA, 25 bp, Homo sapien
gctgcgtgctttcaagacgctgtga

SEQ ID NO: 56568 - DNA, 25 bp, Homo sapien
tttcaagacgctgtgaaggccagtg

SEQ ID NO: 56569 - DNA, 25 bp, Homo sapien
caagacgctgtgaaggccagtgcga

SEQ ID NO: 56570 - DNA, 25 bp, Homo sapien
ccggacaatacgggcagtggccaca

SEQ ID NO: 56571 - DNA, 25 bp, Homo sapien
cagtggccacagtgcaaggacactg

SEQ ID NO: 56572 - DNA, 25 bp, Homo sapien
agcgtgtctccacggagcttgtaga

SEQ ID NO: 56573 - DNA, 25 bp, Homo sapien
agacaatcaacccatggtaaacgtg

SEQ ID NO: 56574 - DNA, 25 bp, Homo sapien
tgacacgggtgtagcataaatcacg

SEQ ID NO: 56575 - DNA, 25 bp, Homo sapien
cacgggaatgtaaggagcgtgtctc

SEQ ID NO: 56576 - DNA, 25 bp, Homo sapien
acgtgttaacgttttgatgtgatga

SEQ ID NO: 56577 - DNA, 25 bp, Homo sapien
agcgggtcttcgtcagacctggtta

SEQ ID NO: 56578 - DNA, 25 bp, Homo sapien
cctggttaagacctgaggctcacgc

SEQ ID NO: 56579 - DNA, 25 bp, Homo sapien
tctcggccggagagagtatgacacg

SEQ ID NO: 56580 - DNA, 25 bp, Homo sapien
gtctccatcgcttcttccgttcgtg

SEQ ID NO: 56581 - DNA, 25 bp, Homo sapien
ccaagtcaggagtcagcgcacaagc

SEQ ID NO: 56582 - DNA, 25 bp, Homo sapien
catttttgaggtctccaccacggtc

SEQ ID NO: 56583 - DNA, 25 bp, Homo sapien
ccctgcttccgtgttctgccatttt

SEQ ID NO: 56584 - DNA, 25 bp, Homo sapien
ctgccgcaaggactacgtttacttt

SEQ ID NO: 56585 - DNA, 25 bp, Homo sapien
tacccgcgtgtatttcaaactgccg

SEQ ID NO: 56586 - DNA, 25 bp, Homo sapien
gcctcgttctgttaccttctgctgg

SEQ ID NO: 56587 - DNA, 25 bp, Homo sapien
ggtgttctgagcacgcccttaccga

SEQ ID NO: 56588 - DNA, 25 bp, Homo sapien
gcgtgtttctggtgtttccgaactg

SEQ ID NO: 56589 - DNA, 25 bp, Homo sapien
aaagcgacgccaggggcgtgtttct

SEQ ID NO: 56590 - DNA, 25 bp, Homo sapien
cacctagagggaccacgcagggagt

SEQ ID NO: 56591 - DNA, 25 bp, Homo sapien
agcacctggcgtgtcatgctgggcc

SEQ ID NO: 56592 - DNA, 25 bp, Homo sapien
tgtccactcggacgatgcctcgcag

SEQ ID NO: 56593 - DNA, 25 bp, Homo sapien
tgcagattcacacgcacctagaggg

SEQ ID NO: 56594 - DNA, 25 bp, Homo sapien
ttgaggtaactgcagattcacacgc

SEQ ID NO: 56595 - DNA, 25 bp, Homo sapien
ggggctttattgaggtaactgcaga

SEQ ID NO: 56596 - DNA, 25 bp, Homo sapien
tcggcaaatagtgccagcgcctgtg

SEQ ID NO: 56597 - DNA, 25 bp, Homo sapien
gcgtctgggatagaaagggcactca

SEQ ID NO: 56598 - DNA, 25 bp, Homo sapien
gaaggcgtctggatctccaaggccg

SEQ ID NO: 56599 - DNA, 25 bp, Homo sapien
ctccaaggccgggagataagcccgc

SEQ ID NO: 56600 - DNA, 25 bp, Homo sapien
gataagcccgctaaccggcacctta

SEQ ID NO: 56601 - DNA, 25 bp, Homo sapien
ggcatgctgtccgtgtcggcaaata

SEQ ID NO: 56602 - DNA, 25 bp, Homo sapien
tgccagcgcctgtgggcacggactc

SEQ ID NO: 56603 - DNA, 25 bp, Homo sapien
ggcaccttagtgctccaggacgctg

SEQ ID NO: 56604 - DNA, 25 bp, Homo sapien
ccgtgtctctgaaccatggcgtgga

SEQ ID NO: 56605 - DNA, 25 bp, Homo sapien
ctgaaccatggcgtggagatccacc

SEQ ID NO: 56606 - DNA, 25 bp, Homo sapien
ccgtgtctctgaaccgcagcgtgga

SEQ ID NO: 56607 - DNA, 25 bp, Homo sapien
acccgtctctgaaccgcagcgtgga

SEQ ID NO: 56608 - DNA, 25 bp, Homo sapien
cgtggagatccacccgtctctgaac

SEQ ID NO: 56609 - DNA, 25 bp, Homo sapien
tgaaccgcagcgtggagatccaccc

SEQ ID NO: 56610 - DNA, 25 bp, Homo sapien
ctctgaaccgcagcgtggagatcca

SEQ ID NO: 56611 - DNA, 25 bp, Homo sapien
gtgtctctgaaccatggcgtggaga

SEQ ID NO: 56612 - DNA, 25 bp, Homo sapien
cagcatggagatccgcccgtgtact

SEQ ID NO: 56613 - DNA, 25 bp, Homo sapien
tgtccaagggctccgagtccactca

SEQ ID NO: 56614 - DNA, 25 bp, Homo sapien
tggcatggagatccacccgtgtact

SEQ ID NO: 56615 - DNA, 25 bp, Homo sapien
atgtctctgaaccacagcatggaga

SEQ ID NO: 56616 - DNA, 25 bp, Homo sapien
cctgtctctgaaccgcagcgtggag

SEQ ID NO: 56617 - DNA, 25 bp, Homo sapien
agatccgcctgcgtgctctgaacca

SEQ ID NO: 56618 - DNA, 25 bp, Homo sapien
ctgtgtctctgaaccactgcgtgga

SEQ ID NO: 56619 - DNA, 25 bp, Homo sapien
ggatctgcccgcgtgctctgaacca

SEQ ID NO: 56620 - DNA, 25 bp, Homo sapien
gcagaggctttgtgatgagttaacc

SEQ ID NO: 56621 - DNA, 25 bp, Homo sapien
tttgtgatgagttaaccggctgggc

SEQ ID NO: 56622 - DNA, 25 bp, Homo sapien
gagtgtcacagttccgcttgctcca

SEQ ID NO: 56623 - DNA, 25 bp, Homo sapien
aaggaactggaattgcgagaggaca

SEQ ID NO: 56624 - DNA, 25 bp, Homo sapien
aggcagccagaagcatcctccggcg

SEQ ID NO: 56625 - DNA, 25 bp, Homo sapien
gagccatggtgcatccaggcagcca

SEQ ID NO: 56626 - DNA, 25 bp, Homo sapien
accggctgggcgttaccctatggag

SEQ ID NO: 56627 - DNA, 25 bp, Homo sapien
ggcgcgactccacgctgtatgcgtg

SEQ ID NO: 56628 - DNA, 25 bp, Homo sapien
gctgcggctacagacacttcctaga

SEQ ID NO: 56629 - DNA, 25 bp, Homo sapien
tcctagaatctgatgcaaccgccgc

SEQ ID NO: 56630 - DNA, 25 bp, Homo sapien
taggcaactaccaggggctccggat

SEQ ID NO: 56631 - DNA, 25 bp, Homo sapien
gagctgtagttcaacccaatggcga

SEQ ID NO: 56632 - DNA, 25 bp, Homo sapien
ctgagcgtcctgtaataggtgttta

SEQ ID NO: 56633 - DNA, 25 bp, Homo sapien
ttaagtcatgattgcgctaagcgcc

SEQ ID NO: 56634 - DNA, 25 bp, Homo sapien
aatctgccatggctgggaatcccgg

SEQ ID NO: 56635 - DNA, 25 bp, Homo sapien
ggcacccgttgtccttcggatccta

SEQ ID NO: 56636 - DNA, 25 bp, Homo sapien
acgctagctctgtccaagtcggggt

SEQ ID NO: 56637 - DNA, 25 bp, Homo sapien
gagagctgtctgtcgcgccataagc

SEQ ID NO: 56638 - DNA, 25 bp, Homo sapien
gctggtcatcacttctgcgatcatg

SEQ ID NO: 56639 - DNA, 25 bp, Homo sapien
gcccaaaataggtgcctgctggtca

SEQ ID NO: 56640 - DNA, 25 bp, Homo sapien
ccacggtgtaatggtcacggactcc

SEQ ID NO: 56641 - DNA, 25 bp, Homo sapien
cagccacagcgatgtccacggtgta

SEQ ID NO: 56642 - DNA, 25 bp, Homo sapien
aatagaaactcctcatccagccggg

SEQ ID NO: 56643 - DNA, 25 bp, Homo sapien
gcgatcatgctttcatctccactca

SEQ ID NO: 56644 - DNA, 25 bp, Homo sapien
taatgtccatggaaagggacaggcc

SEQ ID NO: 56645 - DNA, 25 bp, Homo sapien
cgggcaaagtacacatgaattctcc

SEQ ID NO: 56646 - DNA, 25 bp, Homo sapien
tgggtgcgggcaaagtacacatgaa

SEQ ID NO: 56647 - DNA, 25 bp, Homo sapien
catcatacaagggacgcgtgggtgc

SEQ ID NO: 56648 - DNA, 25 bp, Homo sapien
gcccacatcatacaagggacgcgtg

SEQ ID NO: 56649 - DNA, 25 bp, Homo sapien
ggcttccatgagagcccacatcata

SEQ ID NO: 56650 - DNA, 25 bp, Homo sapien
catctccacgggcttccatgagagc

SEQ ID NO: 56651 - DNA, 25 bp, Homo sapien
gaaaaggccctcgaggctcagactg

SEQ ID NO: 56652 - DNA, 25 bp, Homo sapien
acccacgcgtgtttactgtccggca

SEQ ID NO: 56653 - DNA, 25 bp, Homo sapien
tactgtccggcacaggggagaccca

SEQ ID NO: 56654 - DNA, 25 bp, Homo sapien
gagacccacgcgtgtttactgtccg

SEQ ID NO: 56655 - DNA, 25 bp, Homo sapien
caggggagacccacgcgtgtttact

SEQ ID NO: 56656 - DNA, 25 bp, Homo sapien
cagggagacccacgcgtgtttactg

SEQ ID NO: 56657 - DNA, 25 bp, Homo sapien
ccacgcgtgtttactgtccggcaca

SEQ ID NO: 56658 - DNA, 25 bp, Homo sapien
gcacaggggagacccacgcgtgttt

SEQ ID NO: 56659 - DNA, 25 bp, Homo sapien
tttactgtccggcacaggggagacc

SEQ ID NO: 56660 - DNA, 25 bp, Homo sapien
ttactgttcggcacacgagagaccc

SEQ ID NO: 56661 - DNA, 25 bp, Homo sapien
tctttaccgtcaggcacacgggaaa

SEQ ID NO: 56662 - DNA, 25 bp, Homo sapien
tatcatccggcacacgggagaccca

SEQ ID NO: 56663 - DNA, 25 bp, Homo sapien
tgtttaccgtttggcacagggagac

SEQ ID NO: 56664 - DNA, 25 bp, Homo sapien
cacacggggcctgtttaccatccgg

SEQ ID NO: 56665 - DNA, 25 bp, Homo sapien
tttaccatccggcacacaggaggcc

SEQ ID NO: 56666 - DNA, 25 bp, Homo sapien
ggaggcccatgcatctttaccgtca

SEQ ID NO: 56667 - DNA, 25 bp, Homo sapien
cgtgtttatcatccggcacacggga

SEQ ID NO: 56668 - DNA, 25 bp, Homo sapien
ctgacagaagaactaatgagcaccg

SEQ ID NO: 56669 - DNA, 25 bp, Homo sapien
cggcacctcgtgatcgactgacaga

SEQ ID NO: 56670 - DNA, 25 bp, Homo sapien
gctgccgtccgccatgtctgggcga

SEQ ID NO: 56671 - DNA, 25 bp, Homo sapien
aggtcgcgctgccactgttcgcagg

SEQ ID NO: 56672 - DNA, 25 bp, Homo sapien
cttcttcgagaagcgccgacaaaca

SEQ ID NO: 56673 - DNA, 25 bp, Homo sapien
gagacctggcgcgaagcctacgcga

SEQ ID NO: 56674 - DNA, 25 bp, Homo sapien
gcaaccaatagcaaccgagggcggc

SEQ ID NO: 56675 - DNA, 25 bp, Homo sapien
tgagcaccgacacattcaatcacgt

SEQ ID NO: 56676 - DNA, 25 bp, Homo sapien
tcctgagctctgaggctgtctcgtt

SEQ ID NO: 56677 - DNA, 25 bp, Homo sapien
tgggctgtgccacttctacctggta

SEQ ID NO: 56678 - DNA, 25 bp, Homo sapien
gggctccactcacggcatttgcatc

SEQ ID NO: 56679 - DNA, 25 bp, Homo sapien
tgttccaggaagctgtccctcccgt

SEQ ID NO: 56680 - DNA, 25 bp, Homo sapien
ccctcccgtggcaaatactgagtta

SEQ ID NO: 56681 - DNA, 25 bp, Homo sapien
tctcgtctaaaacgggagcatcgcc

SEQ ID NO: 56682 - DNA, 25 bp, Homo sapien
gatcattccacgacaagcccggttt

SEQ ID NO: 56683 - DNA, 25 bp, Homo sapien
agcccggtttctgcacttcggtgtg

SEQ ID NO: 56684 - DNA, 25 bp, Homo sapien
acagcaccgcatggagcctctgcta

SEQ ID NO: 56685 - DNA, 25 bp, Homo sapien
actctctcctccgtggtatttcctg

SEQ ID NO: 56686 - DNA, 25 bp, Homo sapien
atggagcctctgctactgtgtgaga

SEQ ID NO: 56687 - DNA, 25 bp, Homo sapien
tactgtgtgagaggaagccacgttc

SEQ ID NO: 56688 - DNA, 25 bp, Homo sapien
tgagaggaagccacgttccctcgcc

SEQ ID NO: 56689 - DNA, 25 bp, Homo sapien
cggtcctcagctgagaatcgccaca

SEQ ID NO: 56690 - DNA, 25 bp, Homo sapien
tgtggccacagaactgctgtctgca

SEQ ID NO: 56691 - DNA, 25 bp, Homo sapien
tgacggactccgtccaatgacgaca

SEQ ID NO: 56692 - DNA, 25 bp, Homo sapien
atgactgctgcgctgggatgactga

SEQ ID NO: 56693 - DNA, 25 bp, Homo sapien
ttgaaagccggggatgatgactgct

SEQ ID NO: 56694 - DNA, 25 bp, Homo sapien
gcaaagatcacagctctcagcgggg

SEQ ID NO: 56695 - DNA, 25 bp, Homo sapien
tgcagaaccttcagggtgttgaaag

SEQ ID NO: 56696 - DNA, 25 bp, Homo sapien
agcgggcagagacgcactgcgcttc

SEQ ID NO: 56697 - DNA, 25 bp, Homo sapien
cttcaaagacacatgcagaaccttc

SEQ ID NO: 56698 - DNA, 25 bp, Homo sapien
ccctgcattctgctcttcaaagaca

SEQ ID NO: 56699 - DNA, 25 bp, Homo sapien
tgcgcttcctgagaccgcggctcac

SEQ ID NO: 56700 - DNA, 25 bp, Homo sapien
ttgcctctgcgctagaacgtccggc

SEQ ID NO: 56701 - DNA, 25 bp, Homo sapien
ggccgtctggctgttgagaagacca

SEQ ID NO: 56702 - DNA, 25 bp, Homo sapien
ccaggttcgagctcgtgtgtctcag

SEQ ID NO: 56703 - DNA, 25 bp, Homo sapien
cccagagcctgcagaattttgtgtc

SEQ ID NO: 56704 - DNA, 25 bp, Homo sapien
cgtgcggaaaaaactcttgcctctg

SEQ ID NO: 56705 - DNA, 25 bp, Homo sapien
tgaccagctcacttctcagggatgc

SEQ ID NO: 56706 - DNA, 25 bp, Homo sapien
cgacggggtctgaaaacctattctg

SEQ ID NO: 56707 - DNA, 25 bp, Homo sapien
agggcccttctgtgaacaagcggca

SEQ ID NO: 56708 - DNA, 25 bp, Homo sapien
gccagcgatttcacggggccgacac

SEQ ID NO: 56709 - DNA, 25 bp, Homo sapien
ttcacggggccgacacgccgtccac

SEQ ID NO: 56710 - DNA, 25 bp, Homo sapien
tccacgcgcagttctcagtgacaga

SEQ ID NO: 56711 - DNA, 25 bp, Homo sapien
cgcgcagttctcagtgacagacgca

SEQ ID NO: 56712 - DNA, 25 bp, Homo sapien
gcagttctcagtgacagacgcagcg

SEQ ID NO: 56713 - DNA, 25 bp, Homo sapien
ttctcagtgacagacgcagcgctcg

SEQ ID NO: 56714 - DNA, 25 bp, Homo sapien
cacaggaaaggccagcgatttcacg

SEQ ID NO: 56715 - DNA, 25 bp, Homo sapien
gccgtccacgcgcagttctcagtga

SEQ ID NO: 56716 - DNA, 25 bp, Homo sapien
tcccaccgtgatatctgcgccgtgg

SEQ ID NO: 56717 - DNA, 25 bp, Homo sapien
tatctgcgccgtgggtacagacgcc

SEQ ID NO: 56718 - DNA, 25 bp, Homo sapien
cactctgatatctgcgccgtgggta

SEQ ID NO: 56719 - DNA, 25 bp, Homo sapien
ggtacagacgccctcccaccgtgat

SEQ ID NO: 56720 - DNA, 25 bp, Homo sapien
accgtgatatctgcgccgtgggtac

SEQ ID NO: 56721 - DNA, 25 bp, Homo sapien
atatctgcgccgtgggtacagacgc

SEQ ID NO: 56722 - DNA, 25 bp, Homo sapien
ggtacagacgccctcccactgtgat

SEQ ID NO: 56723 - DNA, 25 bp, Homo sapien
tcccactctgatatctgcgccgtgg

SEQ ID NO: 56724 - DNA, 25 bp, Homo sapien
cccgctcggggtccagaaaagcgca

SEQ ID NO: 56725 - DNA, 25 bp, Homo sapien
actgaggctcgccaggacttcctct

SEQ ID NO: 56726 - DNA, 25 bp, Homo sapien
ttacccagtggccactgaggctcgc

SEQ ID NO: 56727 - DNA, 25 bp, Homo sapien
ttgataaacacgtccctgtcctgcc

SEQ ID NO: 56728 - DNA, 25 bp, Homo sapien
ttcctccttgataaacacgtccctg

SEQ ID NO: 56729 - DNA, 25 bp, Homo sapien
tccagaaaagcgcactgcttccgct

SEQ ID NO: 56730 - DNA, 25 bp, Homo sapien
cggggtccagaaaagcgcactgctt

SEQ ID NO: 56731 - DNA, 25 bp, Homo sapien
gacttcctctcccgacgtgatcttt

SEQ ID NO: 56732 - DNA, 25 bp, Homo sapien
tcagacgccgggacctgctgttcac

SEQ ID NO: 56733 - DNA, 25 bp, Homo sapien
actcctccgagatgacctccgtata

SEQ ID NO: 56734 - DNA, 25 bp, Homo sapien
accatcttttctgctcgcgctggga

SEQ ID NO: 56735 - DNA, 25 bp, Homo sapien
gacctccgtatagggtcaggagccc

SEQ ID NO: 56736 - DNA, 25 bp, Homo sapien
ggtgagtacgcacccacggagccct

SEQ ID NO: 56737 - DNA, 25 bp, Homo sapien
agcagccagatccatggcggccctg

SEQ ID NO: 56738 - DNA, 25 bp, Homo sapien
ggtcacaggctgacgcgcgattctt

SEQ ID NO: 56739 - DNA, 25 bp, Homo sapien
ggacttccgctcagggcctcagacg

SEQ ID NO: 56740 - DNA, 25 bp, Homo sapien
ctgtcagtctgaacccggaaacacc

SEQ ID NO: 56741 - DNA, 25 bp, Homo sapien
tacacggaaaatataccagggcgga

SEQ ID NO: 56742 - DNA, 25 bp, Homo sapien
cgacgcggccggtcaatctgaatcc

SEQ ID NO: 56743 - DNA, 25 bp, Homo sapien
gacgcggccggtcaatctgaatccc

SEQ ID NO: 56744 - DNA, 25 bp, Homo sapien
ggaaacacctcgacgcggccggtca

SEQ ID NO: 56745 - DNA, 25 bp, Homo sapien
gcctgtcagtctgaacccggaaaca

SEQ ID NO: 56746 - DNA, 25 bp, Homo sapien
cacggaaaatataccagggcggagg

SEQ ID NO: 56747 - DNA, 25 bp, Homo sapien
cacgcaaaatataccagggcggagg

SEQ ID NO: 56748 - DNA, 25 bp, Homo sapien
acttccgtctgaaaggtgccggccg

SEQ ID NO: 56749 - DNA, 25 bp, Homo sapien
gggacatcattgctaccagggcgga

SEQ ID NO: 56750 - DNA, 25 bp, Homo sapien
gcggcaggtcaatccaaacccggga

SEQ ID NO: 56751 - DNA, 25 bp, Homo sapien
ctgcggctcggcaggtcaatccaaa

SEQ ID NO: 56752 - DNA, 25 bp, Homo sapien
agaagaaagtccacgcctccgcgga

SEQ ID NO: 56753 - DNA, 25 bp, Homo sapien
tgcggtcagaacacggcagaagctg

SEQ ID NO: 56754 - DNA, 25 bp, Homo sapien
caactgcgcgaagggtcatgaatcc

SEQ ID NO: 56755 - DNA, 25 bp, Homo sapien
gcgagaccagtcctgcacgtggatc

SEQ ID NO: 56756 - DNA, 25 bp, Homo sapien
cggaatgcaggtatttcggggcaca

SEQ ID NO: 56757 - DNA, 25 bp, Homo sapien
gtgttttggggcacacgcgtgtttc

SEQ ID NO: 56758 - DNA, 25 bp, Homo sapien
acacacggagtgcaggtatttcagg

SEQ ID NO: 56759 - DNA, 25 bp, Homo sapien
tcaggacacacggaatgcaggtatt

SEQ ID NO: 56760 - DNA, 25 bp, Homo sapien
cgtatttcaggacacacagcgtgca

SEQ ID NO: 56761 - DNA, 25 bp, Homo sapien
cggggcacacgtgtttcaggacaca

SEQ ID NO: 56762 - DNA, 25 bp, Homo sapien
aggacacacggagtgcaggtatttc

SEQ ID NO: 56763 - DNA, 25 bp, Homo sapien
ttcaggacacacagcgtgcaggtgt

SEQ ID NO: 56764 - DNA, 25 bp, Homo sapien
tcatgttcggaagacactggctccc

SEQ ID NO: 56765 - DNA, 25 bp, Homo sapien
accagagtacggctcccagatcgga

SEQ ID NO: 56766 - DNA, 25 bp, Homo sapien
gtggaccctgccctgaatgcactca

SEQ ID NO: 56767 - DNA, 25 bp, Homo sapien
ctccgtgtccagtctgggaagtgtc

SEQ ID NO: 56768 - DNA, 25 bp, Homo sapien
ccgaggtgccgatgaacgctcatgt

SEQ ID NO: 56769 - DNA, 25 bp, Homo sapien
cactggctccctggtttatgtattt

SEQ ID NO: 56770 - DNA, 25 bp, Homo sapien
caggatgcagatctcttactgggtg

SEQ ID NO: 56771 - DNA, 25 bp, Homo sapien
tgggaagtgtctcaagaccaccctg

SEQ ID NO: 56772 - DNA, 25 bp, Homo sapien
gcctgcggattgtgacgcttcttct

SEQ ID NO: 56773 - DNA, 25 bp, Homo sapien
aggcaggtggcacccttcgaccagc

SEQ ID NO: 56774 - DNA, 25 bp, Homo sapien
aacaaaacagggtagcagcagggac

SEQ ID NO: 56775 - DNA, 25 bp, Homo sapien
tgcgctcctgtcacacggaggggaa

SEQ ID NO: 56776 - DNA, 25 bp, Homo sapien
gctgagaagcaggacaggaaccaca

SEQ ID NO: 56777 - DNA, 25 bp, Homo sapien
cccgcgccacaggtcagcggagaga

SEQ ID NO: 56778 - DNA, 25 bp, Homo sapien
cgtccaggcagcgtttcggattccc

SEQ ID NO: 56779 - DNA, 25 bp, Homo sapien
ttcgaccagcgtccaggcagcgttt

SEQ ID NO: 56780 - DNA, 25 bp, Homo sapien
ctcgggcggaactaagctacaaatc

SEQ ID NO: 56781 - DNA, 25 bp, Homo sapien
cgtgtccgatttccgcaaagagttc

SEQ ID NO: 56782 - DNA, 25 bp, Homo sapien
cccattgggtatgtgactgagttta

SEQ ID NO: 56783 - DNA, 25 bp, Homo sapien
gcagtaggcttctcttcccaaagta

SEQ ID NO: 56784 - DNA, 25 bp, Homo sapien
ccagacgaatttagtagggcccatt

SEQ ID NO: 56785 - DNA, 25 bp, Homo sapien
agggcccattgtccttacgactaca

SEQ ID NO: 56786 - DNA, 25 bp, Homo sapien
tgcccgtcagcgcttaccatgatgg

SEQ ID NO: 56787 - DNA, 25 bp, Homo sapien
aacagtgtttgcgttcggcctcaga

SEQ ID NO: 56788 - DNA, 25 bp, Homo sapien
atcacagtcgctgggtgagaaagtg

SEQ ID NO: 56789 - DNA, 25 bp, Homo sapien
aagtggccgcagtacccgggtgcaa

SEQ ID NO: 56790 - DNA, 25 bp, Homo sapien
tgcaaggcagggaatggtgcagact

SEQ ID NO: 56791 - DNA, 25 bp, Homo sapien
cgccagaccggggttcacatagaga

SEQ ID NO: 56792 - DNA, 25 bp, Homo sapien
ccggggttcacatagagaaagacgc

SEQ ID NO: 56793 - DNA, 25 bp, Homo sapien
tcccgggaatcacagtcgctgggtg

SEQ ID NO: 56794 - DNA, 25 bp, Homo sapien
tagagaaagacgcagctccaggccc

SEQ ID NO: 56795 - DNA, 25 bp, Homo sapien
gctccaggcccaagcagcccgcagc

SEQ ID NO: 56796 - DNA, 25 bp, Homo sapien
ctgtctgcagaatgagccggtgtgc

SEQ ID NO: 56797 - DNA, 25 bp, Homo sapien
tggcaacgccgttggtcactgtccc

SEQ ID NO: 56798 - DNA, 25 bp, Homo sapien
cagcttctgcaacacgcatgtcgtc

SEQ ID NO: 56799 - DNA, 25 bp, Homo sapien
acacgcatgtcgtcaggcgccgcaa

SEQ ID NO: 56800 - DNA, 25 bp, Homo sapien
atgggtggccctgctccatacagcc

SEQ ID NO: 56801 - DNA, 25 bp, Homo sapien
tggagctcgtgctccctcctctgga

SEQ ID NO: 56802 - DNA, 25 bp, Homo sapien
gccatagccacggacggctgagtcc

SEQ ID NO: 56803 - DNA, 25 bp, Homo sapien
cctgaagcatcatggccgggtcact

SEQ ID NO: 56804 - DNA, 25 bp, Homo sapien
gatgaaggtccacacactaaatgca

SEQ ID NO: 56805 - DNA, 25 bp, Homo sapien
ctcctcagagactcagatgaaggtc

SEQ ID NO: 56806 - DNA, 25 bp, Homo sapien
tgacctcgaagagaagccacatttc

SEQ ID NO: 56807 - DNA, 25 bp, Homo sapien
caggcaggtgtgacctcgaagagaa

SEQ ID NO: 56808 - DNA, 25 bp, Homo sapien
tgggagattcccagccatgtcctgc

SEQ ID NO: 56809 - DNA, 25 bp, Homo sapien
ccatgaggcagatgggcccaccctg

SEQ ID NO: 56810 - DNA, 25 bp, Homo sapien
cactaaatgcagatctggaggaggc

SEQ ID NO: 56811 - DNA, 25 bp, Homo sapien
ccctcattcactgccctgggagatt

SEQ ID NO: 56812 - DNA, 25 bp, Homo sapien
cgtcctcgctacaacgtagttgtcg

SEQ ID NO: 56813 - DNA, 25 bp, Homo sapien
cccgccagagcaggcagacgtgcag

SEQ ID NO: 56814 - DNA, 25 bp, Homo sapien
agcaggcagacgtgcagatgccaag

SEQ ID NO: 56815 - DNA, 25 bp, Homo sapien
agatgccaaggcagacgtgcagatg

SEQ ID NO: 56816 - DNA, 25 bp, Homo sapien
cgtgcagatgccaagccgcacttgc

SEQ ID NO: 56817 - DNA, 25 bp, Homo sapien
tgctcactaaactcacgtcctcgct

SEQ ID NO: 56818 - DNA, 25 bp, Homo sapien
gaaagctcgaggaaggccgagcttc

SEQ ID NO: 56819 - DNA, 25 bp, Homo sapien
tcacaggccggatgccggagctgct

SEQ ID NO: 56820 - DNA, 25 bp, Homo sapien
ggagacagaaccctggagagcgcac

SEQ ID NO: 56821 - DNA, 25 bp, Homo sapien
atccgcgtctgagccgctgggaacc

SEQ ID NO: 56822 - DNA, 25 bp, Homo sapien
ctcttctctcgttagcgccgcggga

SEQ ID NO: 56823 - DNA, 25 bp, Homo sapien
tctggttctgcacctcgcgctctgg

SEQ ID NO: 56824 - DNA, 25 bp, Homo sapien
aagccgagcgcaccgccctggagta

SEQ ID NO: 56825 - DNA, 25 bp, Homo sapien
catggagtaactgcagcttttgaga

SEQ ID NO: 56826 - DNA, 25 bp, Homo sapien
ttcctgggccgtcacggagtgtcgc

SEQ ID NO: 56827 - DNA, 25 bp, Homo sapien
cgccagtcctccgagcatggagtaa

SEQ ID NO: 56828 - DNA, 25 bp, Homo sapien
gagcttgaagcagaagccgtccttc

SEQ ID NO: 56829 - DNA, 25 bp, Homo sapien
aagccgtccttcttggagggccgct

SEQ ID NO: 56830 - DNA, 25 bp, Homo sapien
actggcccaccttgggcgtcttgta

SEQ ID NO: 56831 - DNA, 25 bp, Homo sapien
ttcacggcccagacggactgatcca

SEQ ID NO: 56832 - DNA, 25 bp, Homo sapien
ggcgtcttgtagatgagcagcaccc

SEQ ID NO: 56833 - DNA, 25 bp, Homo sapien
ggcttcagcacgcaccacagcttgg

SEQ ID NO: 56834 - DNA, 25 bp, Homo sapien
tccagctcttcagggtgccgcggat

SEQ ID NO: 56835 - DNA, 25 bp, Homo sapien
tcgatgagctcgcagcagtgcagca

SEQ ID NO: 56836 - DNA, 25 bp, Homo sapien
acaggcgtcagcaggacacggggca

SEQ ID NO: 56837 - DNA, 25 bp, Homo sapien
gcaggcgccacgagagccgtactca

SEQ ID NO: 56838 - DNA, 25 bp, Homo sapien
gagccgtactcaccagtgccgggta

SEQ ID NO: 56839 - DNA, 25 bp, Homo sapien
cgtactcaccagtgccgggtaggag

SEQ ID NO: 56840 - DNA, 25 bp, Homo sapien
acttggcccacaccaccttcagagg

SEQ ID NO: 56841 - DNA, 25 bp, Homo sapien
cggcggcatcagtggagatccacat

SEQ ID NO: 56842 - DNA, 25 bp, Homo sapien
gccacgagagccgtactcaccagtg

SEQ ID NO: 56843 - DNA, 25 bp, Homo sapien
tcagtggagatccacatgctgctct

SEQ ID NO: 56844 - DNA, 25 bp, Homo sapien
tgcaggagatcagctcactgcggtc

SEQ ID NO: 56845 - DNA, 25 bp, Homo sapien
gccttggcgtagttcccattctcga

SEQ ID NO: 56846 - DNA, 25 bp, Homo sapien
cccattctcgatgcaggagatcagc

SEQ ID NO: 56847 - DNA, 25 bp, Homo sapien
actgcggtcctccagcgtgtgccgt

SEQ ID NO: 56848 - DNA, 25 bp, Homo sapien
cccgcccacatttgggcgcattaaa

SEQ ID NO: 56849 - DNA, 25 bp, Homo sapien
gcgcattaaagcttcgggaggaaga

SEQ ID NO: 56850 - DNA, 25 bp, Homo sapien
tcactcgggcttcgtcccgtgagct

SEQ ID NO: 56851 - DNA, 25 bp, Homo sapien
tgccgtcgcacaagagccggtttgc

SEQ ID NO: 56852 - DNA, 25 bp, Homo sapien
ttcactgctggtgagcgtgcagtca

SEQ ID NO: 56853 - DNA, 25 bp, Homo sapien
gcacgtgcacatggagactcgcaac

SEQ ID NO: 56854 - DNA, 25 bp, Homo sapien
catggagactcgcaacaggggtctc

SEQ ID NO: 56855 - DNA, 25 bp, Homo sapien
cggcagcgagtggacaaagacatcc

SEQ ID NO: 56856 - DNA, 25 bp, Homo sapien
ctgggccatcgcaggaacagaagcc

SEQ ID NO: 56857 - DNA, 25 bp, Homo sapien
gcccacagtgagtgcgtcgcctcag

SEQ ID NO: 56858 - DNA, 25 bp, Homo sapien
gccgcttcaggtgacggttcactgc

SEQ ID NO: 56859 - DNA, 25 bp, Homo sapien
cacgtgcacagggagactcgcggca

SEQ ID NO: 56860 - DNA, 25 bp, Homo sapien
gacccaagatctgaaccctcaactt

SEQ ID NO: 56861 - DNA, 25 bp, Homo sapien
ctcctctgtgacttacctggagttc

SEQ ID NO: 56862 - DNA, 25 bp, Homo sapien
cccgagataagacccaagatctgaa

SEQ ID NO: 56863 - DNA, 25 bp, Homo sapien
aaaccgtgctgtcctttccaggagc

SEQ ID NO: 56864 - DNA, 25 bp, Homo sapien
cagaggagagatggaaagccaagtc

SEQ ID NO: 56865 - DNA, 25 bp, Homo sapien
ccaagtcacatcatggaacggaaga

SEQ ID NO: 56866 - DNA, 25 bp, Homo sapien
acggaagatgcggttaactcattca

SEQ ID NO: 56867 - DNA, 25 bp, Homo sapien
acttacctggagttctgtccagccc

SEQ ID NO: 56868 - DNA, 25 bp, Homo sapien
gtccatgtcatactccacctcgttg

SEQ ID NO: 56869 - DNA, 25 bp, Homo sapien
gctgtactccacgatgcgcaccttg

SEQ ID NO: 56870 - DNA, 25 bp, Homo sapien
cggccgacttctcgatgaacttgta

SEQ ID NO: 56871 - DNA, 25 bp, Homo sapien
acggccaggttgcacatgtcgcaga

SEQ ID NO: 56872 - DNA, 25 bp, Homo sapien
ggatcacgttgctgttctgacactc

SEQ ID NO: 56873 - DNA, 25 bp, Homo sapien
cattgacgatctccagccaggcata

SEQ ID NO: 56874 - DNA, 25 bp, Homo sapien
gtcgcccttgcgcttctcattgacg

SEQ ID NO: 56875 - DNA, 25 bp, Homo sapien
tctcgaagcggtccatcaggaactc

SEQ ID NO: 56876 - DNA, 25 bp, Homo sapien
tcatcgtgccgcagccaatcacaga

SEQ ID NO: 56877 - DNA, 25 bp, Homo sapien
ccgtcacgatgttgtggtccaggaa

SEQ ID NO: 56878 - DNA, 25 bp, Homo sapien
ccagggtcacgaagagcgcaacgaa

SEQ ID NO: 56879 - DNA, 25 bp, Homo sapien
agcagcccgcaaaacaggtagagca

SEQ ID NO: 56880 - DNA, 25 bp, Homo sapien
cgcggacgacaatgttggcgaacca

SEQ ID NO: 56881 - DNA, 25 bp, Homo sapien
ggcacagacgggtcgtaaaactcgc

SEQ ID NO: 56882 - DNA, 25 bp, Homo sapien
aggcagccgcctaccatgagcagcg

SEQ ID NO: 56883 - DNA, 25 bp, Homo sapien
gcgccctcagacgtagttcttcttg

SEQ ID NO: 56884 - DNA, 25 bp, Homo sapien
tttcccgtgaactgcgcctcaatcg

SEQ ID NO: 56885 - DNA, 25 bp, Homo sapien
gggcacacacgtagcttctcaagga

SEQ ID NO: 56886 - DNA, 25 bp, Homo sapien
ttaagtacatcgaagagccctgcgg

SEQ ID NO: 56887 - DNA, 25 bp, Homo sapien
gctgggccggccaaacaaaaacatc

SEQ ID NO: 56888 - DNA, 25 bp, Homo sapien
acctggcgacagaccctcaaaaaca

SEQ ID NO: 56889 - DNA, 25 bp, Homo sapien
gcgtccgctcacaagagccgcgttt

SEQ ID NO: 56890 - DNA, 25 bp, Homo sapien
ctgtctgttacataaggggcggccc

SEQ ID NO: 56891 - DNA, 25 bp, Homo sapien
gtcccgctgctacggattctcagaa

SEQ ID NO: 56892 - DNA, 25 bp, Homo sapien
gaagcaaacaatgcggcgagcgctc

SEQ ID NO: 56893 - DNA, 25 bp, Homo sapien
gactccagggccgggtcgctcgctc

SEQ ID NO: 56894 - DNA, 25 bp, Homo sapien
cccagcgaagcaaacaatgcggcga

SEQ ID NO: 56895 - DNA, 25 bp, Homo sapien
cgaagcaaacaatgcggcgagcgct

SEQ ID NO: 56896 - DNA, 25 bp, Homo sapien
gcggccgcggactctcgggcagcgg

SEQ ID NO: 56897 - DNA, 25 bp, Homo sapien
aacaatgcggcgagcgctccgcccg

SEQ ID NO: 56898 - DNA, 25 bp, Homo sapien
gaggaccgggccagaaggtccctga

SEQ ID NO: 56899 - DNA, 25 bp, Homo sapien
cagcgaagcaaacaatgcggcgagc

SEQ ID NO: 56900 - DNA, 25 bp, Homo sapien
ccgcagcgacgcacccggagtgtaa

SEQ ID NO: 56901 - DNA, 25 bp, Homo sapien
tccatcctgcaacccgtagcccggg

SEQ ID NO: 56902 - DNA, 25 bp, Homo sapien
gcgcgatccgggcaccttcctggag

SEQ ID NO: 56903 - DNA, 25 bp, Homo sapien
ccaccaaggttcgtgcggaccgtgg

SEQ ID NO: 56904 - DNA, 25 bp, Homo sapien
aggtgaaacctggtggagaacaatg

SEQ ID NO: 56905 - DNA, 25 bp, Homo sapien
tcacggagacactttcccggtgtgg

SEQ ID NO: 56906 - DNA, 25 bp, Homo sapien
cctcgcagagtcacggagacacttt

SEQ ID NO: 56907 - DNA, 25 bp, Homo sapien
acccggagtgtaacctcgcagagtc

SEQ ID NO: 56908 - DNA, 25 bp, Homo sapien
atcgccttagggtcaacggcttagg

SEQ ID NO: 56909 - DNA, 25 bp, Homo sapien
gaagcgcgcattgcgcctgcgtctt

SEQ ID NO: 56910 - DNA, 25 bp, Homo sapien
acaaagccgcggtaatgaatggagc

SEQ ID NO: 56911 - DNA, 25 bp, Homo sapien
gtaatgaatggagcgtccgcccgcg

SEQ ID NO: 56912 - DNA, 25 bp, Homo sapien
gacactgcgcctgcgagagtaggcc

SEQ ID NO: 56913 - DNA, 25 bp, Homo sapien
gcctgcgtagtttgccctcctggac

SEQ ID NO: 56914 - DNA, 25 bp, Homo sapien
caagccacgggacgaaaccaaggcg

SEQ ID NO: 56915 - DNA, 25 bp, Homo sapien
tgccaactgccaagccacgggacga

SEQ ID NO: 56916 - DNA, 25 bp, Homo sapien
ggcgcgccctttagttgactctgtc

SEQ ID NO: 56917 - DNA, 25 bp, Homo sapien
gcaacgccgggatactgagctctcc

SEQ ID NO: 56918 - DNA, 25 bp, Homo sapien
gcattcaccctaataggcgggcata

SEQ ID NO: 56919 - DNA, 25 bp, Homo sapien
tgcttccagagtcccggccctttaa

SEQ ID NO: 56920 - DNA, 25 bp, Homo sapien
ctgctgcgccgtattcaccgcaata

SEQ ID NO: 56921 - DNA, 25 bp, Homo sapien
atcaggagaaatcccgctggctgcc

SEQ ID NO: 56922 - DNA, 25 bp, Homo sapien
ttcgccgcaatagctgatcaggaga

SEQ ID NO: 56923 - DNA, 25 bp, Homo sapien
tacaaatgccgttgcctggagccgc

SEQ ID NO: 56924 - DNA, 25 bp, Homo sapien
cccatccctcgttctaggtgaaggc

SEQ ID NO: 56925 - DNA, 25 bp, Homo sapien
gccgcgctggaatcccggccggctt

SEQ ID NO: 56926 - DNA, 25 bp, Homo sapien
ccatccctcgttctaggtgaaggcc

SEQ ID NO: 56927 - DNA, 25 bp, Homo sapien
cctcgttctaggtgaaggccgcgct

SEQ ID NO: 56928 - DNA, 25 bp, Homo sapien
ccctcgttctaggtgaaggccgcgc

SEQ ID NO: 56929 - DNA, 25 bp, Homo sapien
cccctcgttctaggtgaaggccgcg

SEQ ID NO: 56930 - DNA, 25 bp, Homo sapien
ctcgttctaggtgaaggccgcgctg

SEQ ID NO: 56931 - DNA, 25 bp, Homo sapien
tgaaggccgcgctggaatcccggcc

SEQ ID NO: 56932 - DNA, 25 bp, Homo sapien
aagcgcctgctgctgaagccgcctc

SEQ ID NO: 56933 - DNA, 25 bp, Homo sapien
cggcatcccagtgcgtacctcctgc

SEQ ID NO: 56934 - DNA, 25 bp, Homo sapien
cggaattcaggggacatgcagccta

SEQ ID NO: 56935 - DNA, 25 bp, Homo sapien
ctctcgttctaggtgaaggccgcgc

SEQ ID NO: 56936 - DNA, 25 bp, Homo sapien
gcctaaatgacccacactggaatcc

SEQ ID NO: 56937 - DNA, 25 bp, Homo sapien
atgcagcctaaatgacccacactgg

SEQ ID NO: 56938 - DNA, 25 bp, Homo sapien
ttgtttcggaattcaggggacatgc

SEQ ID NO: 56939 - DNA, 25 bp, Homo sapien
ttcaggggacatgcagcctaaatga

SEQ ID NO: 56940 - DNA, 25 bp, Homo sapien
cacgctgctggatcctcgctacaag

SEQ ID NO: 56941 - DNA, 25 bp, Homo sapien
gctacaaggcctccctgtttacgga

SEQ ID NO: 56942 - DNA, 25 bp, Homo sapien
atcgacaccatgctgcgctctctga

SEQ ID NO: 56943 - DNA, 25 bp, Homo sapien
cgagtgtaacttccgagagctgatc

SEQ ID NO: 56944 - DNA, 25 bp, Homo sapien
ctcattgagcagaaaagggccatta

SEQ ID NO: 56945 - DNA, 25 bp, Homo sapien
ctgatcgtcagcgaggccattaaga

SEQ ID NO: 56946 - DNA, 25 bp, Homo sapien
tgcgactacagtggcaacagcattc

SEQ ID NO: 56947 - DNA, 25 bp, Homo sapien
cgagcgtgcagtgcttcagccatac

SEQ ID NO: 56948 - DNA, 25 bp, Homo sapien
ttgcccaaatctaaagtggctaccg

SEQ ID NO: 56949 - DNA, 25 bp, Homo sapien
gggcgggtcccatcaaccaatagcg

SEQ ID NO: 56950 - DNA, 25 bp, Homo sapien
cgggtcaggtggtaccaagcactat

SEQ ID NO: 56951 - DNA, 25 bp, Homo sapien
agagtccctccaccgtggtcctgga

SEQ ID NO: 56952 - DNA, 25 bp, Homo sapien
ggcgaactcggattgggccatatca

SEQ ID NO: 56953 - DNA, 25 bp, Homo sapien
gcagagaccctctgtgccctgagta

SEQ ID NO: 56954 - DNA, 25 bp, Homo sapien
gagcccgaatctaaagtccttgccc

SEQ ID NO: 56955 - DNA, 25 bp, Homo sapien
tgccctgagtaaagatggccgccgc

SEQ ID NO: 56956 - DNA, 25 bp, Homo sapien
ccaacggctcctacacgtgcgaagg

SEQ ID NO: 56957 - DNA, 25 bp, Homo sapien
tgcgcagttctgtaagaacgccaac

SEQ ID NO: 56958 - DNA, 25 bp, Homo sapien
tcctacacgtgcgaaggtgggccag

SEQ ID NO: 56959 - DNA, 25 bp, Homo sapien
gttctgtaagaacgccaacggctcc

SEQ ID NO: 56960 - DNA, 25 bp, Homo sapien
ctgtgccgctctgttccagatgtgg

SEQ ID NO: 56961 - DNA, 25 bp, Homo sapien
tgtcaggccatgatcggtccttccc

SEQ ID NO: 56962 - DNA, 25 bp, Homo sapien
cctggccacgggctgtgtcaggcca

SEQ ID NO: 56963 - DNA, 25 bp, Homo sapien
tgccgctctgttccagatgtggacg

SEQ ID NO: 56964 - DNA, 25 bp, Homo sapien
accgtcctggcactactgacccgca

SEQ ID NO: 56965 - DNA, 25 bp, Homo sapien
tcccgccggacacagcggaccctgc

SEQ ID NO: 56966 - DNA, 25 bp, Homo sapien
cagtgaacgctagggagtcctcgga

SEQ ID NO: 56967 - DNA, 25 bp, Homo sapien
ctttgtcgccagtgaacgctaggga

SEQ ID NO: 56968 - DNA, 25 bp, Homo sapien
cgcatatccactttgtcgccagtga

SEQ ID NO: 56969 - DNA, 25 bp, Homo sapien
cgggcgcgcatatccactttgtcgc

SEQ ID NO: 56970 - DNA, 25 bp, Homo sapien
agcggcggtacaggcgcctcccatg

SEQ ID NO: 56971 - DNA, 25 bp, Homo sapien
ttccagccgggacctctgtcctgct

SEQ ID NO: 56972 - DNA, 25 bp, Homo sapien
agggcggccaccactcgagggtcac

SEQ ID NO: 56973 - DNA, 25 bp, Homo sapien
gagggtcacccgcaagcctcggagt

SEQ ID NO: 56974 - DNA, 25 bp, Homo sapien
aagcctcggagtccctgctcggagc

SEQ ID NO: 56975 - DNA, 25 bp, Homo sapien
cgggtcttcggtccgccctttgcag

SEQ ID NO: 56976 - DNA, 25 bp, Homo sapien
cggtccgccctttgcagaggaagga

SEQ ID NO: 56977 - DNA, 25 bp, Homo sapien
tccgccctttgcagaggaaggaccc

SEQ ID NO: 56978 - DNA, 25 bp, Homo sapien
cttcggtccgccctttgcagaggaa

SEQ ID NO: 56979 - DNA, 25 bp, Homo sapien
gccagcgtctttctgcgctcaccca

SEQ ID NO: 56980 - DNA, 25 bp, Homo sapien
cgatggtttcggctgcgtatttgga

SEQ ID NO: 56981 - DNA, 25 bp, Homo sapien
cctctaggctaggtggccacgagtt

SEQ ID NO: 56982 - DNA, 25 bp, Homo sapien
caggacgcttggcagccgcctctag

SEQ ID NO: 56983 - DNA, 25 bp, Homo sapien
gggcggtcaactttctccactccag

SEQ ID NO: 56984 - DNA, 25 bp, Homo sapien
tcaacctctgggttacttgggggca

SEQ ID NO: 56985 - DNA, 25 bp, Homo sapien
aggcacacatctcgggcctcatttc

SEQ ID NO: 56986 - DNA, 25 bp, Homo sapien
ataacgaagtcagcggtcaggagca

SEQ ID NO: 56987 - DNA, 25 bp, Homo sapien
ctgcgtatttggaataacgaagtca

SEQ ID NO: 56988 - DNA, 25 bp, Homo sapien
cctgcgggagcaatgacgatgagca

SEQ ID NO: 56989 - DNA, 25 bp, Homo sapien
ccttggcggcaggtgactccgctta

SEQ ID NO: 56990 - DNA, 25 bp, Homo sapien
gcggttggccttgaccttcttggaa

SEQ ID NO: 56991 - DNA, 25 bp, Homo sapien
aggtgactccgcttagtcacggccc

SEQ ID NO: 56992 - DNA, 25 bp, Homo sapien
ccttcttggaaagcccttggcggca

SEQ ID NO: 56993 - DNA, 25 bp, Homo sapien
gggtggaagccagaacctgcgtccc

SEQ ID NO: 56994 - DNA, 25 bp, Homo sapien
agcaggcgcagaatgagatgcacga

SEQ ID NO: 56995 - DNA, 25 bp, Homo sapien
aatgagatgcacgagcgccaccgcc

SEQ ID NO: 56996 - DNA, 25 bp, Homo sapien
ccgcgacattaaggacgaaaatctg

SEQ ID NO: 56997 - DNA, 25 bp, Homo sapien
gttaacgcctgcaggggcggcacat

SEQ ID NO: 56998 - DNA, 25 bp, Homo sapien
gacacggtctacaccgacttcgacg

SEQ ID NO: 56999 - DNA, 25 bp, Homo sapien
aaaatctgcttgtggacctgcgctc

SEQ ID NO: 57000 - DNA, 25 bp, Homo sapien
cttcgactttatcacggagcgcggc

SEQ ID NO: 57001 - DNA, 25 bp, Homo sapien
ggcgcaggacctcttcgactttatc

SEQ ID NO: 57002 - DNA, 25 bp, Homo sapien
agatcctgcagccaggtacgcgcgg

SEQ ID NO: 57003 - DNA, 25 bp, Homo sapien
ctgcgctccggagagctcaagctca

SEQ ID NO: 57004 - DNA, 25 bp, Homo sapien
tcgaaggagggaactcaccgaggca

SEQ ID NO: 57005 - DNA, 25 bp, Homo sapien
ccctcaggatttcccaaatggggca

SEQ ID NO: 57006 - DNA, 25 bp, Homo sapien
tcctgctgggttcagacgtttggga

SEQ ID NO: 57007 - DNA, 25 bp, Homo sapien
tccggtccacccagtagctgagctt

SEQ ID NO: 57008 - DNA, 25 bp, Homo sapien
gggcacttgcaccagaatcgccttg

SEQ ID NO: 57009 - DNA, 25 bp, Homo sapien
cgtcctcgcaggtgaaccgcttgag

SEQ ID NO: 57010 - DNA, 25 bp, Homo sapien
tccgcagtctgcaaaccgcagaggc

SEQ ID NO: 57011 - DNA, 25 bp, Homo sapien
acgcgctgtgcctctgtcatgcgac

SEQ ID NO: 57012 - DNA, 25 bp, Homo sapien
gctcctacctcctaccgtgccgcga

SEQ ID NO: 57013 - DNA, 25 bp, Homo sapien
ggcggccagaggtcgggacactccg

SEQ ID NO: 57014 - DNA, 25 bp, Homo sapien
taccgtgccgcgagctcggtgctcc

SEQ ID NO: 57015 - DNA, 25 bp, Homo sapien
ggcgcgagctcctggatcccttcgg

SEQ ID NO: 57016 - DNA, 25 bp, Homo sapien
tgcggcgcgagctcctggatccctt

SEQ ID NO: 57017 - DNA, 25 bp, Homo sapien
gcactggctactgccagggtccgcg

SEQ ID NO: 57018 - DNA, 25 bp, Homo sapien
ccgccaggcgccgacccgtcctggc

SEQ ID NO: 57019 - DNA, 25 bp, Homo sapien
gaaatgccagcagatggtccccccg

SEQ ID NO: 57020 - DNA, 25 bp, Homo sapien
ctgggcgcccactgtggcctggact

SEQ ID NO: 57021 - DNA, 25 bp, Homo sapien
aacgggatccgagcaggcctcaggt

SEQ ID NO: 57022 - DNA, 25 bp, Homo sapien
ctgagggctccgcccaggcaaaagg

SEQ ID NO: 57023 - DNA, 25 bp, Homo sapien
aagggcgtctgctctctctcctgac

SEQ ID NO: 57024 - DNA, 25 bp, Homo sapien
tgacttcctggactctgaagcccac

SEQ ID NO: 57025 - DNA, 25 bp, Homo sapien
tctctcctgacttcctggactctga

SEQ ID NO: 57026 - DNA, 25 bp, Homo sapien
cccgcatccaccttcaggagagaaa

SEQ ID NO: 57027 - DNA, 25 bp, Homo sapien
gcggagtatacaggctggacccagc

SEQ ID NO: 57028 - DNA, 25 bp, Homo sapien
gcgggttcaccacaacagcgctgtg

SEQ ID NO: 57029 - DNA, 25 bp, Homo sapien
cagtgaccatcggtcgcccagaagc

SEQ ID NO: 57030 - DNA, 25 bp, Homo sapien
gctgggcacgaggttcccaagaaaa

SEQ ID NO: 57031 - DNA, 25 bp, Homo sapien
cagcgctgtgttctcggcctcagct

SEQ ID NO: 57032 - DNA, 25 bp, Homo sapien
tcagctccgcgcaggtttccacgga

SEQ ID NO: 57033 - DNA, 25 bp, Homo sapien
tttccacggagacgcgcgtggctcc

SEQ ID NO: 57034 - DNA, 25 bp, Homo sapien
tggactgcgtccacagaccctgagc

SEQ ID NO: 57035 - DNA, 25 bp, Homo sapien
ccagaagcccaacggtgaagggatc

SEQ ID NO: 57036 - DNA, 25 bp, Homo sapien
gtcagacacggaaatacacccgcca

SEQ ID NO: 57037 - DNA, 25 bp, Homo sapien
cagacacggaaatacacccgccatt

SEQ ID NO: 57038 - DNA, 25 bp, Homo sapien
gggtcagacacggaaatacacccgc

SEQ ID NO: 57039 - DNA, 25 bp, Homo sapien
cgccacctcagagcggagggtcaga

SEQ ID NO: 57040 - DNA, 25 bp, Homo sapien
ggagggtcagacacggaaatacacc

SEQ ID NO: 57041 - DNA, 25 bp, Homo sapien
tgccactctgcacagccaccacctc

SEQ ID NO: 57042 - DNA, 25 bp, Homo sapien
ccgccacctcagagcggagggtcag

SEQ ID NO: 57043 - DNA, 25 bp, Homo sapien
acacggaaatacacccgccattctg

SEQ ID NO: 57044 - DNA, 25 bp, Homo sapien
cgtcacccgccaggttctacagagg

SEQ ID NO: 57045 - DNA, 25 bp, Homo sapien
cttcagtcccaagtcccgctggaga

SEQ ID NO: 57046 - DNA, 25 bp, Homo sapien
tgcgcatttagctggtttggatccc

SEQ ID NO: 57047 - DNA, 25 bp, Homo sapien
acggcgctgttcaaggtcctaactc

SEQ ID NO: 57048 - DNA, 25 bp, Homo sapien
gagccttcagaaaaccgcacgccaa

SEQ ID NO: 57049 - DNA, 25 bp, Homo sapien
ccctgaagtctgaacgtgtggccga

SEQ ID NO: 57050 - DNA, 25 bp, Homo sapien
tctccgcgactctgaggccaagagc

SEQ ID NO: 57051 - DNA, 25 bp, Homo sapien
ccttcccagcagctttggtgcgggt

SEQ ID NO: 57052 - DNA, 25 bp, Homo sapien
tcacagagcaggatcggtgtcctcc

SEQ ID NO: 57053 - DNA, 25 bp, Homo sapien
tgaagtccctcccaaggacgaagtc

SEQ ID NO: 57054 - DNA, 25 bp, Homo sapien
attgatctcgatcagccagggcctg

SEQ ID NO: 57055 - DNA, 25 bp, Homo sapien
tcgaagttgccgatgtcacagctgc

SEQ ID NO: 57056 - DNA, 25 bp, Homo sapien
aaagctgttcttgcgaggctccacg

SEQ ID NO: 57057 - DNA, 25 bp, Homo sapien
ctgcctccacaggagctcgaagttg

SEQ ID NO: 57058 - DNA, 25 bp, Homo sapien
cctcgcccagtgaccaggtggcaaa

SEQ ID NO: 57059 - DNA, 25 bp, Homo sapien
atggccttcttcatggacgggtaga

SEQ ID NO: 57060 - DNA, 25 bp, Homo sapien
cccagggctgcgttaactgccaggt

SEQ ID NO: 57061 - DNA, 25 bp, Homo sapien
gttagaacagaaaacccgtctgcca

SEQ ID NO: 57062 - DNA, 25 bp, Homo sapien
ctggaaccacgtccgcggcacagga

SEQ ID NO: 57063 - DNA, 25 bp, Homo sapien
gctgcgttaactgccaggtgcttta

SEQ ID NO: 57064 - DNA, 25 bp, Homo sapien
tgccatgagaatcgagagagtctga

SEQ ID NO: 57065 - DNA, 25 bp, Homo sapien
agagtctgaggcatcgctgtatcca

SEQ ID NO: 57066 - DNA, 25 bp, Homo sapien
aacccgtctgccatgagaatcgaga

SEQ ID NO: 57067 - DNA, 25 bp, Homo sapien
gcaggcttccgaccacaggctggaa

SEQ ID NO: 57068 - DNA, 25 bp, Homo sapien
ggttctgagcccacccaggtccaca

SEQ ID NO: 57069 - DNA, 25 bp, Homo sapien
cagcagtcatcagcgcttgggctgg

SEQ ID NO: 57070 - DNA, 25 bp, Homo sapien
ccctgtggaggtcacactccatccc

SEQ ID NO: 57071 - DNA, 25 bp, Homo sapien
aggtcacaaagacccgcgggtcaca

SEQ ID NO: 57072 - DNA, 25 bp, Homo sapien
gagggccttggtatccgcagaacca

SEQ ID NO: 57073 - DNA, 25 bp, Homo sapien
ttggtatccgcagaaccactcgtgg

SEQ ID NO: 57074 - DNA, 25 bp, Homo sapien
ccgacgggcagcagtcatcagcgct

SEQ ID NO: 57075 - DNA, 25 bp, Homo sapien
gcagaaccactcgtggggtcccacg

SEQ ID NO: 57076 - DNA, 25 bp, Homo sapien
aggagccgccctgtgtgctcacaca

SEQ ID NO: 57077 - DNA, 25 bp, Homo sapien
ctcagctctggtgcgtggccgcaga

SEQ ID NO: 57078 - DNA, 25 bp, Homo sapien
cctgggcttgggcttctggtgccct

SEQ ID NO: 57079 - DNA, 25 bp, Homo sapien
tgtgtgctcacacaggctcctggcg

SEQ ID NO: 57080 - DNA, 25 bp, Homo sapien
ctctcacttttggtcaccggtcctt

SEQ ID NO: 57081 - DNA, 25 bp, Homo sapien
ggtcctttcccgagggcagtctggc

SEQ ID NO: 57082 - DNA, 25 bp, Homo sapien
gcgggcagcacagcactctcacttt

SEQ ID NO: 57083 - DNA, 25 bp, Homo sapien
cagatgacccgagcggcctgggctt

SEQ ID NO: 57084 - DNA, 25 bp, Homo sapien
tcagcctgccgtgtagatgcgagac

SEQ ID NO: 57085 - DNA, 25 bp, Homo sapien
tgcacgggcacagggactcagcact

SEQ ID NO: 57086 - DNA, 25 bp, Homo sapien
tgtcagacatggagccctacgaaga

SEQ ID NO: 57087 - DNA, 25 bp, Homo sapien
ttcgtccagaatgttggcgctgtca

SEQ ID NO: 57088 - DNA, 25 bp, Homo sapien
ggacccgagcaggaaatggcacttc

SEQ ID NO: 57089 - DNA, 25 bp, Homo sapien
cgtgacgtttaatccagcctcagtc

SEQ ID NO: 57090 - DNA, 25 bp, Homo sapien
ttcgccaactcggaatcgaaacgtg

SEQ ID NO: 57091 - DNA, 25 bp, Homo sapien
atgcggtgtagacagccaactcttc

SEQ ID NO: 57092 - DNA, 25 bp, Homo sapien
cgcagacttggcctgtcctttcaga

SEQ ID NO: 57093 - DNA, 25 bp, Homo sapien
gcccatctttctaaagcccgggatg

SEQ ID NO: 57094 - DNA, 25 bp, Homo sapien
ccgcgcccataggtctttgagtgca

SEQ ID NO: 57095 - DNA, 25 bp, Homo sapien
tgtgtttacgccgagcagctgccaa

SEQ ID NO: 57096 - DNA, 25 bp, Homo sapien
ggcgtgccatttccttgtctggttt

SEQ ID NO: 57097 - DNA, 25 bp, Homo sapien
agctgccaagtcgtctctccatgtc

SEQ ID NO: 57098 - DNA, 25 bp, Homo sapien
gtcctttcagaacgcgctgcgccaa

SEQ ID NO: 57099 - DNA, 25 bp, Homo sapien
aggcacctcgccttgtcaggagctg

SEQ ID NO: 57100 - DNA, 25 bp, Homo sapien
gcactcaccgtgcagcagggcatgg

SEQ ID NO: 57101 - DNA, 25 bp, Homo sapien
ctctgctgcctgtccgggtgccgga

SEQ ID NO: 57102 - DNA, 25 bp, Homo sapien
ggctgctccagacggagtatccaag

SEQ ID NO: 57103 - DNA, 25 bp, Homo sapien
gacggagtatccaagactttctggg

SEQ ID NO: 57104 - DNA, 25 bp, Homo sapien
ccgctgcagtccaggagctgtgcac

SEQ ID NO: 57105 - DNA, 25 bp, Homo sapien
ccggagacgcgcatcccagctgcac

SEQ ID NO: 57106 - DNA, 25 bp, Homo sapien
tgctgttacctaacacctcggaacg

SEQ ID NO: 57107 - DNA, 25 bp, Homo sapien
gagctgtgcacgctgctgttaccta

SEQ ID NO: 57108 - DNA, 25 bp, Homo sapien
taaaggcacgttcaggactcaggac

SEQ ID NO: 57109 - DNA, 25 bp, Homo sapien
acttgctccgtggatctcttcggta

SEQ ID NO: 57110 - DNA, 25 bp, Homo sapien
ctcttcggtagaacacgcgctcagc

SEQ ID NO: 57111 - DNA, 25 bp, Homo sapien
gctccagctcttggcagcgctcaga

SEQ ID NO: 57112 - DNA, 25 bp, Homo sapien
gcagcgctcagatcctatgcctgta

SEQ ID NO: 57113 - DNA, 25 bp, Homo sapien
tatgcctgtactgtaaccgtcgccc

SEQ ID NO: 57114 - DNA, 25 bp, Homo sapien
cggctgtgttacctggagcacttgc

SEQ ID NO: 57115 - DNA, 25 bp, Homo sapien
ctgggaagctgcagtaaaggcacgt

SEQ ID NO: 57116 - DNA, 25 bp, Homo sapien
ccaatcccagcgtggctcaagcctg

SEQ ID NO: 57117 - DNA, 25 bp, Homo sapien
gcaatcccagcgtggctcaagcctg

SEQ ID NO: 57118 - DNA, 25 bp, Homo sapien
tggcccacgtctccaatcccagcgt

SEQ ID NO: 57119 - DNA, 25 bp, Homo sapien
tcccagcgtggctcaagcctgcaat

SEQ ID NO: 57120 - DNA, 25 bp, Homo sapien
gtctccaatcccagcgtggctcaag

SEQ ID NO: 57121 - DNA, 25 bp, Homo sapien
caatcccagcgtggctcaagcctgc

SEQ ID NO: 57122 - DNA, 25 bp, Homo sapien
tgcaatcccagcgtggcccacgtct

SEQ ID NO: 57123 - DNA, 25 bp, Homo sapien
ccagcgtggctcaagcctgcaatcc

SEQ ID NO: 57124 - DNA, 25 bp, Homo sapien
agcggagggaatgaaggtcagggag

SEQ ID NO: 57125 - DNA, 25 bp, Homo sapien
acgttcgtcctggtatagtgggaag

SEQ ID NO: 57126 - DNA, 25 bp, Homo sapien
acctgcacgagggaaaacggctgcc

SEQ ID NO: 57127 - DNA, 25 bp, Homo sapien
ctgcacgagggaaaacggctgcctc

SEQ ID NO: 57128 - DNA, 25 bp, Homo sapien
cacgagggaaaacggctgcctcgaa

SEQ ID NO: 57129 - DNA, 25 bp, Homo sapien
ctgcctcgaagaggcagggaccacg

SEQ ID NO: 57130 - DNA, 25 bp, Homo sapien
gatgcgcccgcgtctgaagccagac

SEQ ID NO: 57131 - DNA, 25 bp, Homo sapien
gcacgttcgtcctggtatagtggga

SEQ ID NO: 57132 - DNA, 25 bp, Homo sapien
ttttctgcaaagtcatcgcccgcgc

SEQ ID NO: 57133 - DNA, 25 bp, Homo sapien
caggaagagggaccggtcattactc

SEQ ID NO: 57134 - DNA, 25 bp, Homo sapien
ggaccggtcattactcattcatgtc

SEQ ID NO: 57135 - DNA, 25 bp, Homo sapien
ttcaatattttctgcaaagtcatcg

SEQ ID NO: 57136 - DNA, 25 bp, Homo sapien
agagggaccggtcattactcattca

SEQ ID NO: 57137 - DNA, 25 bp, Homo sapien
tcgcccgcgccgcatctgcgtggcg

SEQ ID NO: 57138 - DNA, 25 bp, Homo sapien
catgtcctttcatttcatttcaata

SEQ ID NO: 57139 - DNA, 25 bp, Homo sapien
ggtcattactcattcatgtcctttc

SEQ ID NO: 57140 - DNA, 25 bp, Homo sapien
ccctcgtctctattttattgttgtt

SEQ ID NO: 57141 - DNA, 25 bp, Homo sapien
ccgttcgaccgggtggtcaccatcg

SEQ ID NO: 57142 - DNA, 25 bp, Homo sapien
ggtcaccatcggcaccgtgctggtg

SEQ ID NO: 57143 - DNA, 25 bp, Homo sapien
tgctggtcaccctggtcttcaccaa

SEQ ID NO: 57144 - DNA, 25 bp, Homo sapien
tggtcttcaccaagaacttcgcagg

SEQ ID NO: 57145 - DNA, 25 bp, Homo sapien
ccaagaacttcgcaggtgaggccgg

SEQ ID NO: 57146 - DNA, 25 bp, Homo sapien
cccatcctagcaggtgtcgctggtc

SEQ ID NO: 57147 - DNA, 25 bp, Homo sapien
caggtgtcgctggtcgcacagaccc

SEQ ID NO: 57148 - DNA, 25 bp, Homo sapien
gagcaacttcatcttcgacaagctg

SEQ ID NO: 57149 - DNA, 25 bp, Homo sapien
ccggctccatcaaacggacttactg

SEQ ID NO: 57150 - DNA, 25 bp, Homo sapien
ctgacaagaagcacgcgcgccactt

SEQ ID NO: 57151 - DNA, 25 bp, Homo sapien
gccatcatgcgcgtggagaacagca

SEQ ID NO: 57152 - DNA, 25 bp, Homo sapien
gagcgacctcatgtacgacaacgtg

SEQ ID NO: 57153 - DNA, 25 bp, Homo sapien
cggctggacttcatcaccaacgaga

SEQ ID NO: 57154 - DNA, 25 bp, Homo sapien
acatcaagtcgctcaaccggctgga

SEQ ID NO: 57155 - DNA, 25 bp, Homo sapien
ttactgtcaaggtgagcctcaggcc

SEQ ID NO: 57156 - DNA, 25 bp, Homo sapien
caggccagggtcagattcagggttt

SEQ ID NO: 57157 - DNA, 25 bp, Homo sapien
atggcagcgcgttccctgatcccgt

SEQ ID NO: 57158 - DNA, 25 bp, Homo sapien
tatcggctgtccctttcgtgcggga

SEQ ID NO: 57159 - DNA, 25 bp, Homo sapien
caggcccggatcaggttcaggtttt

SEQ ID NO: 57160 - DNA, 25 bp, Homo sapien
tgcgcgccgatgttccttaggaccc

SEQ ID NO: 57161 - DNA, 25 bp, Homo sapien
tcacagcttgggagctgcgaccaga

SEQ ID NO: 57162 - DNA, 25 bp, Homo sapien
tgaaaaccatcctgtggacgccgtg

SEQ ID NO: 57163 - DNA, 25 bp, Homo sapien
ggactgacggctcacagaacagtta

SEQ ID NO: 57164 - DNA, 25 bp, Homo sapien
tggcggctgctcacaacagcttccg

SEQ ID NO: 57165 - DNA, 25 bp, Homo sapien
ctggcttgtgtgtgtagctagaccc

SEQ ID NO: 57166 - DNA, 25 bp, Homo sapien
gctcctaagagttctggcttgtgtg

SEQ ID NO: 57167 - DNA, 25 bp, Homo sapien
tgctctaatggtccggacttccgtg

SEQ ID NO: 57168 - DNA, 25 bp, Homo sapien
ctcggcagccttgcgctgctctaat

SEQ ID NO: 57169 - DNA, 25 bp, Homo sapien
tgcacaggagtttctttaaggagtt

SEQ ID NO: 57170 - DNA, 25 bp, Homo sapien
gcctcctgttggctgggccgacgca

SEQ ID NO: 57171 - DNA, 25 bp, Homo sapien
gcccggctgcacaggagtttcttta

SEQ ID NO: 57172 - DNA, 25 bp, Homo sapien
caggggcaatgctgggcactggcca

SEQ ID NO: 57173 - DNA, 25 bp, Homo sapien
caccggacggatggtccgaggaccg

SEQ ID NO: 57174 - DNA, 25 bp, Homo sapien
caggctttagagaagggccaccgga

SEQ ID NO: 57175 - DNA, 25 bp, Homo sapien
gggtctggcccggaaagccagggca

SEQ ID NO: 57176 - DNA, 25 bp, Homo sapien
cagcaccgagcggtcagcaggggca

SEQ ID NO: 57177 - DNA, 25 bp, Homo sapien
cgtctgctcgcagagcaggtctgcg

SEQ ID NO: 57178 - DNA, 25 bp, Homo sapien
caggaccatccctgctgacctcggc

SEQ ID NO: 57179 - DNA, 25 bp, Homo sapien
gaaagccagggcaggctttagagaa

SEQ ID NO: 57180 - DNA, 25 bp, Homo sapien
tgcagccgacgtggacgccttcaac

SEQ ID NO: 57181 - DNA, 25 bp, Homo sapien
gttggtgtaagctcctgtgtcctgc

SEQ ID NO: 57182 - DNA, 25 bp, Homo sapien
cacatcccggacacgggttggtgta

SEQ ID NO: 57183 - DNA, 25 bp, Homo sapien
cagcgacgacagcaagagggacgtt

SEQ ID NO: 57184 - DNA, 25 bp, Homo sapien
gggacagcccacttcagcgacgaca

SEQ ID NO: 57185 - DNA, 25 bp, Homo sapien
gccttcaacctgctcctggagatga

SEQ ID NO: 57186 - DNA, 25 bp, Homo sapien
accacaacggcctgtgctgctgttg

SEQ ID NO: 57187 - DNA, 25 bp, Homo sapien
gcactgtgacccagttggtggctga

SEQ ID NO: 57188 - DNA, 25 bp, Homo sapien
ggctgcaggctccagtagaagaccg

SEQ ID NO: 57189 - DNA, 25 bp, Homo sapien
gcccaggacgatgccgtagagcctg

SEQ ID NO: 57190 - DNA, 25 bp, Homo sapien
aggttccagagcaccagcccgttac

SEQ ID NO: 57191 - DNA, 25 bp, Homo sapien
gggcccttcttgatgcggaagccga

SEQ ID NO: 57192 - DNA, 25 bp, Homo sapien
accgcgaaccacaggaaggtgagca

SEQ ID NO: 57193 - DNA, 25 bp, Homo sapien
agacaaagaggaccacgccagccgt

SEQ ID NO: 57194 - DNA, 25 bp, Homo sapien
tggagcagcaggtcacccagacaaa

SEQ ID NO: 57195 - DNA, 25 bp, Homo sapien
gagctgctgttgacgcaggccagca

SEQ ID NO: 57196 - DNA, 25 bp, Homo sapien
gcccggcacaagtaggagactgctc

SEQ ID NO: 57197 - DNA, 25 bp, Homo sapien
gcgcgacgtctacctaacctacatg

SEQ ID NO: 57198 - DNA, 25 bp, Homo sapien
gattggcgagttcccagacctgcac

SEQ ID NO: 57199 - DNA, 25 bp, Homo sapien
acgtgcctggcatcgagaagaactg

SEQ ID NO: 57200 - DNA, 25 bp, Homo sapien
aagaactggagcaccgacctcaaca

SEQ ID NO: 57201 - DNA, 25 bp, Homo sapien
tccaggagatcatgacgtgagtgcc

SEQ ID NO: 57202 - DNA, 25 bp, Homo sapien
tggaggccaaccacatgcggcagtg

SEQ ID NO: 57203 - DNA, 25 bp, Homo sapien
tacagcctgtactggatgggccgcc

SEQ ID NO: 57204 - DNA, 25 bp, Homo sapien
gatagacggacgaggcagccaatta

SEQ ID NO: 57205 - DNA, 25 bp, Homo sapien
acggcgccgccatgtacctgggcga

SEQ ID NO: 57206 - DNA, 25 bp, Homo sapien
tgcggccaccaattcggccagttcg

SEQ ID NO: 57207 - DNA, 25 bp, Homo sapien
gttcttcagcggcaacgcgctcctg

SEQ ID NO: 57208 - DNA, 25 bp, Homo sapien
gctctacgttgtcgggcgccgccat

SEQ ID NO: 57209 - DNA, 25 bp, Homo sapien
cagccaattagagcccggccagaca

SEQ ID NO: 57210 - DNA, 25 bp, Homo sapien
tctcggaggcgttcccatctgtcac

SEQ ID NO: 57211 - DNA, 25 bp, Homo sapien
atggccgtatacagggcagcgctcg

SEQ ID NO: 57212 - DNA, 25 bp, Homo sapien
cgaagccatgttccacctgggagtc

SEQ ID NO: 57213 - DNA, 25 bp, Homo sapien
tttcagggacgtgcaagctgctcac

SEQ ID NO: 57214 - DNA, 25 bp, Homo sapien
aagctgctcacgttacacgcgttcc

SEQ ID NO: 57215 - DNA, 25 bp, Homo sapien
tttccatgtgctgcccggaatcctg

SEQ ID NO: 57216 - DNA, 25 bp, Homo sapien
tgaccggcccacgtagtgaactctg

SEQ ID NO: 57217 - DNA, 25 bp, Homo sapien
tttggtttcagacaggccgacggtc

SEQ ID NO: 57218 - DNA, 25 bp, Homo sapien
tcgcaaggtcctacggtcaagcatc

SEQ ID NO: 57219 - DNA, 25 bp, Homo sapien
tccgggagtttctatgcagcgaagc

SEQ ID NO: 57220 - DNA, 25 bp, Homo sapien
cagaactgtgcgtgacatgatcttc

SEQ ID NO: 57221 - DNA, 25 bp, Homo sapien
tctcagaggcaagcacacgcctgtc

SEQ ID NO: 57222 - DNA, 25 bp, Homo sapien
gcgggtgctgaaactactggagacc

SEQ ID NO: 57223 - DNA, 25 bp, Homo sapien
tgaggaactacatcgcgcagaatgc

SEQ ID NO: 57224 - DNA, 25 bp, Homo sapien
tccagagcccggatgtcattccaga

SEQ ID NO: 57225 - DNA, 25 bp, Homo sapien
aacccgcagctgttcgcgcttatgg

SEQ ID NO: 57226 - DNA, 25 bp, Homo sapien
tgatcttcgtaacggcctcggcacg

SEQ ID NO: 57227 - DNA, 25 bp, Homo sapien
tgatgcacgccaacaacccgaagta

SEQ ID NO: 57228 - DNA, 25 bp, Homo sapien
aagcagacgtccttgagcgcccaca

SEQ ID NO: 57229 - DNA, 25 bp, Homo sapien
cacctgtgcgcttgaggtggaagca

SEQ ID NO: 57230 - DNA, 25 bp, Homo sapien
ctcgtgcttgaacagctgcagctga

SEQ ID NO: 57231 - DNA, 25 bp, Homo sapien
cctggatgaccttcacgaaatgctg

SEQ ID NO: 57232 - DNA, 25 bp, Homo sapien
caggatctggttggcgatgtagccc

SEQ ID NO: 57233 - DNA, 25 bp, Homo sapien
tggccctgaactcgcaccaggtgac

SEQ ID NO: 57234 - DNA, 25 bp, Homo sapien
agacggccttgtgcaggtactctgc

SEQ ID NO: 57235 - DNA, 25 bp, Homo sapien
gcgcccacatcatgagcttcagctg

SEQ ID NO: 57236 - DNA, 25 bp, Homo sapien
aagtagtcgacagcggccttgttca

SEQ ID NO: 57237 - DNA, 25 bp, Homo sapien
cacggggcgcaaaagatgagcaatg

SEQ ID NO: 57238 - DNA, 25 bp, Homo sapien
gcacagcagtctcatcagcggcaga

SEQ ID NO: 57239 - DNA, 25 bp, Homo sapien
agcaactcgctcagctgcacagcag

SEQ ID NO: 57240 - DNA, 25 bp, Homo sapien
cttgttcaccaaggagatgctggca

SEQ ID NO: 57241 - DNA, 25 bp, Homo sapien
cagtgcctcatagtgcgcctccagg

SEQ ID NO: 57242 - DNA, 25 bp, Homo sapien
tccatcagcaggaagtgccgcagtg

SEQ ID NO: 57243 - DNA, 25 bp, Homo sapien
cgcttcatgagcacgggcagcgtca

SEQ ID NO: 57244 - DNA, 25 bp, Homo sapien
tgtcagacacatgtccgtgggtgtt

SEQ ID NO: 57245 - DNA, 25 bp, Homo sapien
catcggacacgtgtccatgggtgtt

SEQ ID NO: 57246 - DNA, 25 bp, Homo sapien
gcgggagccatgtctgacacagact

SEQ ID NO: 57247 - DNA, 25 bp, Homo sapien
ggtgggagccatgtctgacacagac

SEQ ID NO: 57248 - DNA, 25 bp, Homo sapien
aaccctgatgctggtgtcagacaca

SEQ ID NO: 57249 - DNA, 25 bp, Homo sapien
catgggtgttgcaccgtgaccggat

SEQ ID NO: 57250 - DNA, 25 bp, Homo sapien
ggtggaaaccacatccgacacaggc

SEQ ID NO: 57251 - DNA, 25 bp, Homo sapien
atcagacacgtgtccatgggtgttc

SEQ ID NO: 57252 - DNA, 25 bp, Homo sapien
tctccaatgccgaagctcagaactg

SEQ ID NO: 57253 - DNA, 25 bp, Homo sapien
cagagccagcgtttcgtttgagcga

SEQ ID NO: 57254 - DNA, 25 bp, Homo sapien
aggtcttgcggttgctctactcaga

SEQ ID NO: 57255 - DNA, 25 bp, Homo sapien
agccgcgccagtgtgaagagcacta

SEQ ID NO: 57256 - DNA, 25 bp, Homo sapien
ccagctcggcgtttcttctaattca

SEQ ID NO: 57257 - DNA, 25 bp, Homo sapien
tcaacctttagggagtcacagaacc

SEQ ID NO: 57258 - DNA, 25 bp, Homo sapien
cagcggacgaactcggctttgcacc

SEQ ID NO: 57259 - DNA, 25 bp, Homo sapien
ttcactcacgctccggaagacaggg

SEQ ID NO: 57260 - DNA, 25 bp, Homo sapien
agcgcacagaacctaggcaggctcc

SEQ ID NO: 57261 - DNA, 25 bp, Homo sapien
ggctgacaaccgcagacacctctgt

SEQ ID NO: 57262 - DNA, 25 bp, Homo sapien
tcaggacgctcgatctcgcactcgg

SEQ ID NO: 57263 - DNA, 25 bp, Homo sapien
gtggccgtcatgtcctcatggtaca

SEQ ID NO: 57264 - DNA, 25 bp, Homo sapien
tcctcatggtacacaagcgcggtcc

SEQ ID NO: 57265 - DNA, 25 bp, Homo sapien
ctagtggtgcctgccactgcctgtc

SEQ ID NO: 57266 - DNA, 25 bp, Homo sapien
ccttaggcgagtggtcgccgcagcc

SEQ ID NO: 57267 - DNA, 25 bp, Homo sapien
ttcccaaacgccctcgctagtggtg

SEQ ID NO: 57268 - DNA, 25 bp, Homo sapien
gcgatcaccgattgtcagccgggca

SEQ ID NO: 57269 - DNA, 25 bp, Homo sapien
cctgtcgcgatcaccgattgtcagc

SEQ ID NO: 57270 - DNA, 25 bp, Homo sapien
cagccctgtcgcgatcaccgattgt

SEQ ID NO: 57271 - DNA, 25 bp, Homo sapien
gccctgtcgcgatcaccgattgtca

SEQ ID NO: 57272 - DNA, 25 bp, Homo sapien
gtcgcgatcaccgattgtcagccgg

SEQ ID NO: 57273 - DNA, 25 bp, Homo sapien
gatcaccgattgtcagccgggcagt

SEQ ID NO: 57274 - DNA, 25 bp, Homo sapien
tcaccgattgtcagccgggcagtgc

SEQ ID NO: 57275 - DNA, 25 bp, Homo sapien
caccgattgtcagccgggcagtgcc

SEQ ID NO: 57276 - DNA, 25 bp, Homo sapien
cccgcagaggacaagcaggtacgtg

SEQ ID NO: 57277 - DNA, 25 bp, Homo sapien
attgtgacactagcgccttgggcgc

SEQ ID NO: 57278 - DNA, 25 bp, Homo sapien
acccattgtgacactagcgccttgg

SEQ ID NO: 57279 - DNA, 25 bp, Homo sapien
ccggctgtcacccattgtgacacta

SEQ ID NO: 57280 - DNA, 25 bp, Homo sapien
cggccggctgtcacccattgtgaca

SEQ ID NO: 57281 - DNA, 25 bp, Homo sapien
caagcaggtacgtgcgcagcgccgc

SEQ ID NO: 57282 - DNA, 25 bp, Homo sapien
cagaggacaagcaggtacgtgcgca

SEQ ID NO: 57283 - DNA, 25 bp, Homo sapien
gacaagcaggtacgtgcgcagcgcc

SEQ ID NO: 57284 - DNA, 25 bp, Homo sapien
accggcggaacttgtccttgcagca

SEQ ID NO: 57285 - DNA, 25 bp, Homo sapien
ccggccgaggagaatcaaacacata

SEQ ID NO: 57286 - DNA, 25 bp, Homo sapien
tttctctccgcagagcacaggctgc

SEQ ID NO: 57287 - DNA, 25 bp, Homo sapien
tcctgcctcgttcgcaggcacagag

SEQ ID NO: 57288 - DNA, 25 bp, Homo sapien
gcacagagtagatggccggtgtcaa

SEQ ID NO: 57289 - DNA, 25 bp, Homo sapien
cagtgatttcaagtcccgtttcaga

SEQ ID NO: 57290 - DNA, 25 bp, Homo sapien
ccgggagacctcgtgaactcagtga

SEQ ID NO: 57291 - DNA, 25 bp, Homo sapien
acatacagcagcgtcaggctccggg

SEQ ID NO: 57292 - DNA, 25 bp, Homo sapien
aaggccgatacagcttcttgatggc

SEQ ID NO: 57293 - DNA, 25 bp, Homo sapien
gcgaacagctcggactggaaaggcc

SEQ ID NO: 57294 - DNA, 25 bp, Homo sapien
ttctcgtggcgcatgtgcttgagca

SEQ ID NO: 57295 - DNA, 25 bp, Homo sapien
ctggaaaggccgatacagcttcttg

SEQ ID NO: 57296 - DNA, 25 bp, Homo sapien
tgcaggtcccggtacacggcgcgca

SEQ ID NO: 57297 - DNA, 25 bp, Homo sapien
tggtcacctcctggcggtaaaagcc

SEQ ID NO: 57298 - DNA, 25 bp, Homo sapien
ttgatggccaccttagcgccggtgc

SEQ ID NO: 57299 - DNA, 25 bp, Homo sapien
ggccgcgcgactcacgttctcgtgg

SEQ ID NO: 57300 - DNA, 25 bp, Homo sapien
tgagctcacagtcctcgttcacagc

SEQ ID NO: 57301 - DNA, 25 bp, Homo sapien
aattgaacgtgctcgtcgctcagcg

SEQ ID NO: 57302 - DNA, 25 bp, Homo sapien
cgcctggcacttgacgatgttgttc

SEQ ID NO: 57303 - DNA, 25 bp, Homo sapien
cgcccatcagggtggtcaccaagta

SEQ ID NO: 57304 - DNA, 25 bp, Homo sapien
cacttcgctgaagtcctcgatggac

SEQ ID NO: 57305 - DNA, 25 bp, Homo sapien
gtgaagacgtccagaagcccgatga

SEQ ID NO: 57306 - DNA, 25 bp, Homo sapien
acgttctcgtgcttcaggtgcttga

SEQ ID NO: 57307 - DNA, 25 bp, Homo sapien
gaccacgtggtgttctcaagctccg

SEQ ID NO: 57308 - DNA, 25 bp, Homo sapien
ctcggcactggataggaaaataagc

SEQ ID NO: 57309 - DNA, 25 bp, Homo sapien
tgagaaatcaggatcccagtggccc

SEQ ID NO: 57310 - DNA, 25 bp, Homo sapien
gagcattgctccctggaacaccggc

SEQ ID NO: 57311 - DNA, 25 bp, Homo sapien
tcccacttgaaagcgaccggggctc

SEQ ID NO: 57312 - DNA, 25 bp, Homo sapien
ggccgcacagctacttttattccca

SEQ ID NO: 57313 - DNA, 25 bp, Homo sapien
gcctggctttcttgcgcaggacctg

SEQ ID NO: 57314 - DNA, 25 bp, Homo sapien
agcaccttctaaagactcggcactg

SEQ ID NO: 57315 - DNA, 25 bp, Homo sapien
aacggatcctttttgctgcccagaa

SEQ ID NO: 57316 - DNA, 25 bp, Homo sapien
gctcagaggaagatgctacagtcta

SEQ ID NO: 57317 - DNA, 25 bp, Homo sapien
ccggcggtattgctcagaggaagat

SEQ ID NO: 57318 - DNA, 25 bp, Homo sapien
cagcgtggcagcgtaaggcacattt

SEQ ID NO: 57319 - DNA, 25 bp, Homo sapien
gcagcgtaaggcacattttcaaatc

SEQ ID NO: 57320 - DNA, 25 bp, Homo sapien
ttttcaaatcactggagactcgaca

SEQ ID NO: 57321 - DNA, 25 bp, Homo sapien
aacacccgatgctggttctgcggcc

SEQ ID NO: 57322 - DNA, 25 bp, Homo sapien
gagactcgacagtgaacacccgatg

SEQ ID NO: 57323 - DNA, 25 bp, Homo sapien
ctacagtctagacgctgggcgggtt

SEQ ID NO: 57324 - DNA, 25 bp, Homo sapien
atcctggatgttgtgcttctctgcc

SEQ ID NO: 57325 - DNA, 25 bp, Homo sapien
ccacctcgtggacatgcacgtcaaa

SEQ ID NO: 57326 - DNA, 25 bp, Homo sapien
gtgtggagcctcacctgttcgtctt

SEQ ID NO: 57327 - DNA, 25 bp, Homo sapien
gctcgtccaggaagtcgaagaagta

SEQ ID NO: 57328 - DNA, 25 bp, Homo sapien
cagcacgctctggaagaagttgtcc

SEQ ID NO: 57329 - DNA, 25 bp, Homo sapien
cgtcaggtagatctcggtgatggcc

SEQ ID NO: 57330 - DNA, 25 bp, Homo sapien
ttcacgctgcctctcttggacttgc

SEQ ID NO: 57331 - DNA, 25 bp, Homo sapien
atgttcacccagaaccggagcggta

SEQ ID NO: 57332 - DNA, 25 bp, Homo sapien
ctcacagtacaggtcggtctccgtc

SEQ ID NO: 57333 - DNA, 25 bp, Homo sapien
cagcgtcatcgccttgttcagattg

SEQ ID NO: 57334 - DNA, 25 bp, Homo sapien
cttgttgacctgcttcttgacgcca

SEQ ID NO: 57335 - DNA, 25 bp, Homo sapien
acgccacctgtgaagttctcaaagg

SEQ ID NO: 57336 - DNA, 25 bp, Homo sapien
tctcgatcagcaccgtgaggttgta

SEQ ID NO: 57337 - DNA, 25 bp, Homo sapien
acgaccttggtgtcattgtggaaca

SEQ ID NO: 57338 - DNA, 25 bp, Homo sapien
ggctccgcgatgaccaccatggcaa

SEQ ID NO: 57339 - DNA, 25 bp, Homo sapien
aagccctgacccgtgacgttgatgc

SEQ ID NO: 57340 - DNA, 25 bp, Homo sapien
agcctgcctgtcaccggccggcacc

SEQ ID NO: 57341 - DNA, 25 bp, Homo sapien
gagcctgcctgtcaccggccggcac

SEQ ID NO: 57342 - DNA, 25 bp, Homo sapien
ctccctccgtacctgagcctgcctg

SEQ ID NO: 57343 - DNA, 25 bp, Homo sapien
tgagcctgcctgtcaccggccggca

SEQ ID NO: 57344 - DNA, 25 bp, Homo sapien
cctccctccgtacctgagcctgcct

SEQ ID NO: 57345 - DNA, 25 bp, Homo sapien
gcctgcctgtcaccaaccggcaccc

SEQ ID NO: 57346 - DNA, 25 bp, Homo sapien
tgagcctgcctgtcaccaaccggca

SEQ ID NO: 57347 - DNA, 25 bp, Homo sapien
gagcctgcctgtcacagccggcacc

SEQ ID NO: 57348 - DNA, 25 bp, Homo sapien
ccgtgcgaccgagaagggccacccg

SEQ ID NO: 57349 - DNA, 25 bp, Homo sapien
gcacagggccccgtgcgaccgagaa

SEQ ID NO: 57350 - DNA, 25 bp, Homo sapien
agttgcagatgacggcctcgccctc

SEQ ID NO: 57351 - DNA, 25 bp, Homo sapien
gagttgcagatgacggcctcgccct

SEQ ID NO: 57352 - DNA, 25 bp, Homo sapien
ggagttgcagatgacggcctcgccc

SEQ ID NO: 57353 - DNA, 25 bp, Homo sapien
gctgcttggggagttgcagatgacg

SEQ ID NO: 57354 - DNA, 25 bp, Homo sapien
ctggcggtgtgacggggatgctgct

SEQ ID NO: 57355 - DNA, 25 bp, Homo sapien
cgtgcgaccgagaagggccacccgg

SEQ ID NO: 57356 - DNA, 25 bp, Homo sapien
ccaaaaaggcacagcaactcgtcct

SEQ ID NO: 57357 - DNA, 25 bp, Homo sapien
ggcgactccccaaaaaggcacagca

SEQ ID NO: 57358 - DNA, 25 bp, Homo sapien
ctgacggtcagctgcacctgaggga

SEQ ID NO: 57359 - DNA, 25 bp, Homo sapien
actgggaaccccgagtcctgtcagc

SEQ ID NO: 57360 - DNA, 25 bp, Homo sapien
tcctgtcagcccacctgccggtgac

SEQ ID NO: 57361 - DNA, 25 bp, Homo sapien
gcccacctgccggtgacccgacctc

SEQ ID NO: 57362 - DNA, 25 bp, Homo sapien
gcacgtcccagtggagcctccagaa

SEQ ID NO: 57363 - DNA, 25 bp, Homo sapien
aaaaaggcacagcaactcgtcctcc

SEQ ID NO: 57364 - DNA, 25 bp, Homo sapien
gtcgggtagctcaggcactcctgca

SEQ ID NO: 57365 - DNA, 25 bp, Homo sapien
cagcagaggccgcacgggccttccg

SEQ ID NO: 57366 - DNA, 25 bp, Homo sapien
ccgtgagtgggaccacagcagaggc

SEQ ID NO: 57367 - DNA, 25 bp, Homo sapien
ggtagctcaggcactcctgcaccgg

SEQ ID NO: 57368 - DNA, 25 bp, Homo sapien
acgcaccagccgcagtaggggtcct

SEQ ID NO: 57369 - DNA, 25 bp, Homo sapien
aggcactcaccgtccctcgacgacg

SEQ ID NO: 57370 - DNA, 25 bp, Homo sapien
ggccacgaccttccgggatcccaga

SEQ ID NO: 57371 - DNA, 25 bp, Homo sapien
accggcagccggaacacctagggca

SEQ ID NO: 57372 - DNA, 25 bp, Homo sapien
tcggccttccgggtgcatctgcagg

SEQ ID NO: 57373 - DNA, 25 bp, Homo sapien
tggagtcttgttctcccgggacagg

SEQ ID NO: 57374 - DNA, 25 bp, Homo sapien
cctcagcccagggtggagtcttgtt

SEQ ID NO: 57375 - DNA, 25 bp, Homo sapien
cggacactcggccttccgggtgcat

SEQ ID NO: 57376 - DNA, 25 bp, Homo sapien
acgcaggacttgcttcggctccaca

SEQ ID NO: 57377 - DNA, 25 bp, Homo sapien
ttctcccgggacaggacagtgcgat

SEQ ID NO: 57378 - DNA, 25 bp, Homo sapien
ctggtgacggccacgcaggacttgc

SEQ ID NO: 57379 - DNA, 25 bp, Homo sapien
agcccagggtggagtcttgttctcc

SEQ ID NO: 57380 - DNA, 25 bp, Homo sapien
ctgcggaccacagcgtgtcaatggc

SEQ ID NO: 57381 - DNA, 25 bp, Homo sapien
cgccgcactggatatcgccgtggaa

SEQ ID NO: 57382 - DNA, 25 bp, Homo sapien
ttgtagaagatgtcacgggcctccc

SEQ ID NO: 57383 - DNA, 25 bp, Homo sapien
tccatcttggcgtgcaccttgtcca

SEQ ID NO: 57384 - DNA, 25 bp, Homo sapien
gctccggctgtctctgctgaagaca

SEQ ID NO: 57385 - DNA, 25 bp, Homo sapien
actgcaggtccatctccaggtagga

SEQ ID NO: 57386 - DNA, 25 bp, Homo sapien
gtccggtccaacagccgagtgctca

SEQ ID NO: 57387 - DNA, 25 bp, Homo sapien
aggccgccacgaactgctgtgtgtt

SEQ ID NO: 57388 - DNA, 25 bp, Homo sapien
tctgatgaatgtgtcgcgctggtgt

SEQ ID NO: 57389 - DNA, 25 bp, Homo sapien
gcgtctgtgcaatgctggtgtctga

SEQ ID NO: 57390 - DNA, 25 bp, Homo sapien
cgcacacaggtcgtctggcgtctgt

SEQ ID NO: 57391 - DNA, 25 bp, Homo sapien
ggcctttgacctgtcactacatcag

SEQ ID NO: 57392 - DNA, 25 bp, Homo sapien
tgagagcaagtttcccgcacgtggc

SEQ ID NO: 57393 - DNA, 25 bp, Homo sapien
gacctctcctcttgcggaccaagtg

SEQ ID NO: 57394 - DNA, 25 bp, Homo sapien
ggagcgtttcccactctgcgcagtc

SEQ ID NO: 57395 - DNA, 25 bp, Homo sapien
tcgcgctggtgtctgacgtccatgc

SEQ ID NO: 57396 - DNA, 25 bp, Homo sapien
ggtggacaacgcagcctaaggcaga

SEQ ID NO: 57397 - DNA, 25 bp, Homo sapien
tacccgcgctgttgcgcgtgggtcc

SEQ ID NO: 57398 - DNA, 25 bp, Homo sapien
cggaagccgcgcagcacctcttggg

SEQ ID NO: 57399 - DNA, 25 bp, Homo sapien
gcccgcggcccaatttccaggcgac

SEQ ID NO: 57400 - DNA, 25 bp, Homo sapien
ccgcaaaacggggtggacaacgcag

SEQ ID NO: 57401 - DNA, 25 bp, Homo sapien
gcctaaggcagagccgcgccaaggt

SEQ ID NO: 57402 - DNA, 25 bp, Homo sapien
agcttggggccagttcgcccagtca

SEQ ID NO: 57403 - DNA, 25 bp, Homo sapien
acgccgccacagcttggggccagtt

SEQ ID NO: 57404 - DNA, 25 bp, Homo sapien
cgggccaaagctagcgacacacgca

SEQ ID NO: 57405 - DNA, 25 bp, Homo sapien
tcccagagcgctaaacacatcagag

SEQ ID NO: 57406 - DNA, 25 bp, Homo sapien
tctgggacaaacctcaccaggccgg

SEQ ID NO: 57407 - DNA, 25 bp, Homo sapien
ggagcgccctggactattcctcgca

SEQ ID NO: 57408 - DNA, 25 bp, Homo sapien
cattacctaagtcctccgagccgtg

SEQ ID NO: 57409 - DNA, 25 bp, Homo sapien
atcggatcgcacagccggccattac

SEQ ID NO: 57410 - DNA, 25 bp, Homo sapien
tcacacgagcgcaggagacgtcgtc

SEQ ID NO: 57411 - DNA, 25 bp, Homo sapien
gtctgacccgagtaacaatgacggc

SEQ ID NO: 57412 - DNA, 25 bp, Homo sapien
gtctctcaaatgctgcgtcgggcca

SEQ ID NO: 57413 - DNA, 25 bp, Homo sapien
tcgggccacgcgaggattgttttgt

SEQ ID NO: 57414 - DNA, 25 bp, Homo sapien
tgcttgcacaaaactttagccaata

SEQ ID NO: 57415 - DNA, 25 bp, Homo sapien
cgccattttggagcgatcggagtgc

SEQ ID NO: 57416 - DNA, 25 bp, Homo sapien
acgggcctccgaagagctgccgcga

SEQ ID NO: 57417 - DNA, 25 bp, Homo sapien
cccaggtgtgtgtctctcaaatgct

SEQ ID NO: 57418 - DNA, 25 bp, Homo sapien
tgcaagaacccgtagcgcacctgga

SEQ ID NO: 57419 - DNA, 25 bp, Homo sapien
tagcgcacctggagaaaactgtctg

SEQ ID NO: 57420 - DNA, 25 bp, Homo sapien
gctgagcctcctgtacgacttcttg

SEQ ID NO: 57421 - DNA, 25 bp, Homo sapien
ttcttggaccatgagccgcctctca

SEQ ID NO: 57422 - DNA, 25 bp, Homo sapien
gcatctgtgactcttctgcgcaaca

SEQ ID NO: 57423 - DNA, 25 bp, Homo sapien
gccgcgggaacagcatctgtgactc

SEQ ID NO: 57424 - DNA, 25 bp, Homo sapien
ccgtcatggtggatgctgacgtgtc

SEQ ID NO: 57425 - DNA, 25 bp, Homo sapien
cctccgtgacttggggcaccgtcat

SEQ ID NO: 57426 - DNA, 25 bp, Homo sapien
gtaaatcacgtgcaaagcctccgtg

SEQ ID NO: 57427 - DNA, 25 bp, Homo sapien
ctcgccagttttttcagcaagacca

SEQ ID NO: 57428 - DNA, 25 bp, Homo sapien
tggaaggtccgtccgcgtgtggaag

SEQ ID NO: 57429 - DNA, 25 bp, Homo sapien
tgtggaaggtctgtccgcgtgtgga

SEQ ID NO: 57430 - DNA, 25 bp, Homo sapien
gtccgtccgcgtgtggaacgtctgt

SEQ ID NO: 57431 - DNA, 25 bp, Homo sapien
aggtccgtccgcgtgtggaacgtct

SEQ ID NO: 57432 - DNA, 25 bp, Homo sapien
gtggaaggtctgtccgcgtgtggaa

SEQ ID NO: 57433 - DNA, 25 bp, Homo sapien
aacgtctgtcagcgtgtggaaggtc

SEQ ID NO: 57434 - DNA, 25 bp, Homo sapien
ccgtccgcgtgtggaacgtctgtca

SEQ ID NO: 57435 - DNA, 25 bp, Homo sapien
tctgtcagcgtgtggaaggtctgtc

SEQ ID NO: 57436 - DNA, 25 bp, Homo sapien
tggagcctccgcatgagaacgggaa

SEQ ID NO: 57437 - DNA, 25 bp, Homo sapien
tccatgtcagcgctgacgtgtgccg

SEQ ID NO: 57438 - DNA, 25 bp, Homo sapien
actcagaccgtgtccatgtcagcgc

SEQ ID NO: 57439 - DNA, 25 bp, Homo sapien
gcatccatcttatcagcgccaactg

SEQ ID NO: 57440 - DNA, 25 bp, Homo sapien
cacgtgagtccaagaagcatccatc

SEQ ID NO: 57441 - DNA, 25 bp, Homo sapien
agcctccctgacaacacaatggtga

SEQ ID NO: 57442 - DNA, 25 bp, Homo sapien
aggacagaagccagcggatccgaga

SEQ ID NO: 57443 - DNA, 25 bp, Homo sapien
acaatggtgacccacgtgagtccaa

SEQ ID NO: 57444 - DNA, 25 bp, Homo sapien
cccgatggtgcctgttgctttcagg

SEQ ID NO: 57445 - DNA, 25 bp, Homo sapien
gccgggcacttgctctccgaagtga

SEQ ID NO: 57446 - DNA, 25 bp, Homo sapien
aacccggtcatccttctgctggtcg

SEQ ID NO: 57447 - DNA, 25 bp, Homo sapien
cagcgaggtcatccgaggtgagccc

SEQ ID NO: 57448 - DNA, 25 bp, Homo sapien
tgtgcagacgcacatcagcgaggtc

SEQ ID NO: 57449 - DNA, 25 bp, Homo sapien
agacgtgggaacatgggccacctca

SEQ ID NO: 57450 - DNA, 25 bp, Homo sapien
tgctctccgaagtgaacctggaggc

SEQ ID NO: 57451 - DNA, 25 bp, Homo sapien
acacggatcgccaacgcggtggtgc

SEQ ID NO: 57452 - DNA, 25 bp, Homo sapien
tatggggcgtatctcagatgtgacc

SEQ ID NO: 57453 - DNA, 25 bp, Homo sapien
ccagacgagtctgatggcatctcac

SEQ ID NO: 57454 - DNA, 25 bp, Homo sapien
cgaaagtcagagaatatggggcgta

SEQ ID NO: 57455 - DNA, 25 bp, Homo sapien
acacggcagatggactcgaaagtca

SEQ ID NO: 57456 - DNA, 25 bp, Homo sapien
tgatgagagcactgaggacacggca

SEQ ID NO: 57457 - DNA, 25 bp, Homo sapien
aagtcactccaccttgatgagagca

SEQ ID NO: 57458 - DNA, 25 bp, Homo sapien
atctcagatgtgaccgcagcgagcg

SEQ ID NO: 57459 - DNA, 25 bp, Homo sapien
gctcgtctccgagcacgtatggggc

SEQ ID NO: 57460 - DNA, 25 bp, Homo sapien
gcacagaagttgtaaacgcgacgcg

SEQ ID NO: 57461 - DNA, 25 bp, Homo sapien
cagaagttgtaaacgcgacgcgttg

SEQ ID NO: 57462 - DNA, 25 bp, Homo sapien
aacgcgacgcgttgtcttcacctgg

SEQ ID NO: 57463 - DNA, 25 bp, Homo sapien
cgacgcgttgtcttcacctggggaa

SEQ ID NO: 57464 - DNA, 25 bp, Homo sapien
acgcgttgtcttcacctggggaagg

SEQ ID NO: 57465 - DNA, 25 bp, Homo sapien
aagggcgggttactgactccgcagc

SEQ ID NO: 57466 - DNA, 25 bp, Homo sapien
gggcgggttactgactccgcagccc

SEQ ID NO: 57467 - DNA, 25 bp, Homo sapien
tgggcacagaagttgtaaacgcgac

SEQ ID NO: 57468 - DNA, 25 bp, Homo sapien
acacacgcacgaccctggtgtctga

SEQ ID NO: 57469 - DNA, 25 bp, Homo sapien
ggacttacgtgcatgtacgagtgta

SEQ ID NO: 57470 - DNA, 25 bp, Homo sapien
tctggggagcgcctccatcagaccg

SEQ ID NO: 57471 - DNA, 25 bp, Homo sapien
cagctgtcgtaacagggccacacca

SEQ ID NO: 57472 - DNA, 25 bp, Homo sapien
agaccctgctctgggatcacacgca

SEQ ID NO: 57473 - DNA, 25 bp, Homo sapien
gcacgaccctggtgtctgagcgaga

SEQ ID NO: 57474 - DNA, 25 bp, Homo sapien
gtgcatgtacgagtgtacacacaca

SEQ ID NO: 57475 - DNA, 25 bp, Homo sapien
ggtgccaggccagaccctgctctgg

SEQ ID NO: 57476 - DNA, 25 bp, Homo sapien
cacgatggattctgggcaatacagc

SEQ ID NO: 57477 - DNA, 25 bp, Homo sapien
gacacgatggattctgggcaataca

SEQ ID NO: 57478 - DNA, 25 bp, Homo sapien
gcgaccagcgacacgatggattctg

SEQ ID NO: 57479 - DNA, 25 bp, Homo sapien
ccgcgaccagcgacacgatggattc

SEQ ID NO: 57480 - DNA, 25 bp, Homo sapien
ggaccgcgaccagcgacacgatgga

SEQ ID NO: 57481 - DNA, 25 bp, Homo sapien
tgggttgcggacgataagggccacg

SEQ ID NO: 57482 - DNA, 25 bp, Homo sapien
tgggctcacatagctcggtggtgaa

SEQ ID NO: 57483 - DNA, 25 bp, Homo sapien
acgatggattctgggcaatacagca

SEQ ID NO: 57484 - DNA, 25 bp, Homo sapien
cgctaagcgtgttgcgtcccgacgc

SEQ ID NO: 57485 - DNA, 25 bp, Homo sapien
ggctactcgagtccgcctgggactg

SEQ ID NO: 57486 - DNA, 25 bp, Homo sapien
gcctgcaggtacttctcctgctcca

SEQ ID NO: 57487 - DNA, 25 bp, Homo sapien
tggagctgaccacagcctgcaggta

SEQ ID NO: 57488 - DNA, 25 bp, Homo sapien
cggggcatggagctgaccacagcct

SEQ ID NO: 57489 - DNA, 25 bp, Homo sapien
tgttgcgtcccgacgcgtcggcgta

SEQ ID NO: 57490 - DNA, 25 bp, Homo sapien
tccaggctactcgagtccgcctggg

SEQ ID NO: 57491 - DNA, 25 bp, Homo sapien
taagcgtgttgcgtcccgacgcgtc

SEQ ID NO: 57492 - DNA, 25 bp, Homo sapien
ctgtggacgccgtgaggacgctgtc

SEQ ID NO: 57493 - DNA, 25 bp, Homo sapien
agatgttgacgctgtggatgctgtg

SEQ ID NO: 57494 - DNA, 25 bp, Homo sapien
aggacgctgcagatgttgacgctgt

SEQ ID NO: 57495 - DNA, 25 bp, Homo sapien
cagatgttgacgctgtggatgctgt

SEQ ID NO: 57496 - DNA, 25 bp, Homo sapien
tgaggacgctgcagatgttgacgct

SEQ ID NO: 57497 - DNA, 25 bp, Homo sapien
aggacgctgtggacgccgtgaggac

SEQ ID NO: 57498 - DNA, 25 bp, Homo sapien
tgcggacgttgaggacgctgtggac

SEQ ID NO: 57499 - DNA, 25 bp, Homo sapien
acgctgcagatgttgacgctgtgga

SEQ ID NO: 57500 - DNA, 25 bp, Homo sapien
tgcccgtttcccatcagtaaccgtg

SEQ ID NO: 57501 - DNA, 25 bp, Homo sapien
cgtgcaattacgctcaccgggtgtg

SEQ ID NO: 57502 - DNA, 25 bp, Homo sapien
cccttcgccgttataggcagcaaca

SEQ ID NO: 57503 - DNA, 25 bp, Homo sapien
cgacttcgtgaagctgcgcaacatg

SEQ ID NO: 57504 - DNA, 25 bp, Homo sapien
gcacgcatatgcacgacctcaagga

SEQ ID NO: 57505 - DNA, 25 bp, Homo sapien
actacgagaactaccgcgcgcactg

SEQ ID NO: 57506 - DNA, 25 bp, Homo sapien
cctagaaccaagtccagggctgtga

SEQ ID NO: 57507 - DNA, 25 bp, Homo sapien
tctccataactgagggccggtcctg

SEQ ID NO: 57508 - DNA, 25 bp, Homo sapien
cagaccacgtgggacagaactcctg

SEQ ID NO: 57509 - DNA, 25 bp, Homo sapien
cggttcaaggggacacaaacacatc

SEQ ID NO: 57510 - DNA, 25 bp, Homo sapien
acacgggcctgcaaactcgacagga

SEQ ID NO: 57511 - DNA, 25 bp, Homo sapien
ctctgcacgactgacctggaaattc

SEQ ID NO: 57512 - DNA, 25 bp, Homo sapien
ttctgatctggtcttctctgcacga

SEQ ID NO: 57513 - DNA, 25 bp, Homo sapien
ctctggtgctgaataaacccttctg

SEQ ID NO: 57514 - DNA, 25 bp, Homo sapien
accatggggcacaatgcggtccaga

SEQ ID NO: 57515 - DNA, 25 bp, Homo sapien
cacttccaggcttgggaggaccatg

SEQ ID NO: 57516 - DNA, 25 bp, Homo sapien
acacgtggtcatcacggggccactc

SEQ ID NO: 57517 - DNA, 25 bp, Homo sapien
tcctccgacactgcacaggccgggc

SEQ ID NO: 57518 - DNA, 25 bp, Homo sapien
gctgaggacggggtcagcgtgctgg

SEQ ID NO: 57519 - DNA, 25 bp, Homo sapien
tccagctcctccgacactgcacagg

SEQ ID NO: 57520 - DNA, 25 bp, Homo sapien
ggcacacgtggtcatcacggggcca

SEQ ID NO: 57521 - DNA, 25 bp, Homo sapien
cacacgtggtcatcacggggccact

SEQ ID NO: 57522 - DNA, 25 bp, Homo sapien
gggtcagcgtgctgggctccagctc

SEQ ID NO: 57523 - DNA, 25 bp, Homo sapien
acgtggtcatcacggggccactccg

SEQ ID NO: 57524 - DNA, 25 bp, Homo sapien
aagggctcagacttggcccggctca

SEQ ID NO: 57525 - DNA, 25 bp, Homo sapien
tcacctgcggcagatggcatacatg

SEQ ID NO: 57526 - DNA, 25 bp, Homo sapien
cagatggcatacatgcggttgaccg

SEQ ID NO: 57527 - DNA, 25 bp, Homo sapien
agaaatgcggaagggctcagacttg

SEQ ID NO: 57528 - DNA, 25 bp, Homo sapien
tggtagtcgcgacagcaagcccttt

SEQ ID NO: 57529 - DNA, 25 bp, Homo sapien
tagtcgcgacagcaagccctttcca

SEQ ID NO: 57530 - DNA, 25 bp, Homo sapien
ccaggctgctcatggtcatgcggtc

SEQ ID NO: 57531 - DNA, 25 bp, Homo sapien
tacatgcggttgaccggagaaatgc

SEQ ID NO: 57532 - DNA, 25 bp, Homo sapien
ccatccggcagcaggtagacgcgca

SEQ ID NO: 57533 - DNA, 25 bp, Homo sapien
cccgtgaagatgacccggtacgtgg

SEQ ID NO: 57534 - DNA, 25 bp, Homo sapien
ctcagctgggagcaatgctggtccc

SEQ ID NO: 57535 - DNA, 25 bp, Homo sapien
gcaggccgtccagcacacactcctc

SEQ ID NO: 57536 - DNA, 25 bp, Homo sapien
cagcttgggctgctcgaaaacaaga

SEQ ID NO: 57537 - DNA, 25 bp, Homo sapien
gctcgaaaacaagagcaggagctca

SEQ ID NO: 57538 - DNA, 25 bp, Homo sapien
aaccttctggatgggcggcagcctc

SEQ ID NO: 57539 - DNA, 25 bp, Homo sapien
gcgccctcagctgggagcaatgctg

SEQ ID NO: 57540 - DNA, 25 bp, Homo sapien
gtcctgctaccctcgtacgttcttg

SEQ ID NO: 57541 - DNA, 25 bp, Homo sapien
tacgttcttgtagagctgctctgcc

SEQ ID NO: 57542 - DNA, 25 bp, Homo sapien
gggatcaaggcggtacgacgccctc

SEQ ID NO: 57543 - DNA, 25 bp, Homo sapien
cacggctgggtacgggttctcctgt

SEQ ID NO: 57544 - DNA, 25 bp, Homo sapien
tgtaccttgtgcatcgccacggctg

SEQ ID NO: 57545 - DNA, 25 bp, Homo sapien
tctcaccgggcctctgtaccttgtg

SEQ ID NO: 57546 - DNA, 25 bp, Homo sapien
cgtcgcaggtggctgctctcaccgg

SEQ ID NO: 57547 - DNA, 25 bp, Homo sapien
ggggtggttctcatccgcccgcatc

SEQ ID NO: 57548 - DNA, 25 bp, Homo sapien
accagcacgaagtagtccgcgagcc

SEQ ID NO: 57549 - DNA, 25 bp, Homo sapien
atcgctgaccactctggggcccgag

SEQ ID NO: 57550 - DNA, 25 bp, Homo sapien
gcatctccattggtccagagggtgg

SEQ ID NO: 57551 - DNA, 25 bp, Homo sapien
cgctgtcgtcaagccctgagcgggc

SEQ ID NO: 57552 - DNA, 25 bp, Homo sapien
aagtagtccgcgagccgcgccatgg

SEQ ID NO: 57553 - DNA, 25 bp, Homo sapien
ccgaacgccaccagcacgaagtagt

SEQ ID NO: 57554 - DNA, 25 bp, Homo sapien
ggcttcagacggagcaccaaggtca

SEQ ID NO: 57555 - DNA, 25 bp, Homo sapien
ctgcgcgctgtcgtcaagccctgag

SEQ ID NO: 57556 - DNA, 25 bp, Homo sapien
ccagccgtgggatcagctcggacga

SEQ ID NO: 57557 - DNA, 25 bp, Homo sapien
gatcagctcggacgacggttcgccc

SEQ ID NO: 57558 - DNA, 25 bp, Homo sapien
tggaaaggctacgtattcagccctg

SEQ ID NO: 57559 - DNA, 25 bp, Homo sapien
aatcccgcggacttgctggtcaggc

SEQ ID NO: 57560 - DNA, 25 bp, Homo sapien
gtacagccttttaggagcgcagccc

SEQ ID NO: 57561 - DNA, 25 bp, Homo sapien
gtcggtacagccttttaggagcgca

SEQ ID NO: 57562 - DNA, 25 bp, Homo sapien
cgtgcaatactttggtccggggttg

SEQ ID NO: 57563 - DNA, 25 bp, Homo sapien
gacggccgccctgggttgcatcagc

SEQ ID NO: 57564 - DNA, 25 bp, Homo sapien
aacagggcacgctgagcagcgctga

SEQ ID NO: 57565 - DNA, 25 bp, Homo sapien
caccacgctgagcttgtgcagccag

SEQ ID NO: 57566 - DNA, 25 bp, Homo sapien
ggcggcacagcgatctcaattagga

SEQ ID NO: 57567 - DNA, 25 bp, Homo sapien
ccacctgcgagtagaaagcagccaa

SEQ ID NO: 57568 - DNA, 25 bp, Homo sapien
agcagccaagcgcaggcgtcgaatg

SEQ ID NO: 57569 - DNA, 25 bp, Homo sapien
aattaggaaggtggccaccacgctg

SEQ ID NO: 57570 - DNA, 25 bp, Homo sapien
atctcaattaggaaggtggccacca

SEQ ID NO: 57571 - DNA, 25 bp, Homo sapien
gtctgcctctctctgacagctgcgg

SEQ ID NO: 57572 - DNA, 25 bp, Homo sapien
cgtgtagagggaagcgaaagcaaac

SEQ ID NO: 57573 - DNA, 25 bp, Homo sapien
gaaaagaggacatagggtcccgcgc

SEQ ID NO: 57574 - DNA, 25 bp, Homo sapien
accctgggtgccttcacctgggatt

SEQ ID NO: 57575 - DNA, 25 bp, Homo sapien
ccttcacctgggatttgcgtgtaga

SEQ ID NO: 57576 - DNA, 25 bp, Homo sapien
agcgaaagcaaacatgaagacggcc

SEQ ID NO: 57577 - DNA, 25 bp, Homo sapien
agcaaacatgaagacggccgccacg

SEQ ID NO: 57578 - DNA, 25 bp, Homo sapien
ctgggtgccttcacctgggatttgc

SEQ ID NO: 57579 - DNA, 25 bp, Homo sapien
gcctgcaggacacgaaccgccgccc

SEQ ID NO: 57580 - DNA, 25 bp, Homo sapien
tttcctgggcgggaacagcaaaatg

SEQ ID NO: 57581 - DNA, 25 bp, Homo sapien
ttgcccacgttacgtcatagacatg

SEQ ID NO: 57582 - DNA, 25 bp, Homo sapien
cctatggctatctggcgctctggcc

SEQ ID NO: 57583 - DNA, 25 bp, Homo sapien
cgtctccacgcctatggctatctgg

SEQ ID NO: 57584 - DNA, 25 bp, Homo sapien
agcccatccgcgacctcaccaagaa

SEQ ID NO: 57585 - DNA, 25 bp, Homo sapien
cgttccctcccggacatggaggacg

SEQ ID NO: 57586 - DNA, 25 bp, Homo sapien
gcaaaatggcgccagaactagtggc

SEQ ID NO: 57587 - DNA, 25 bp, Homo sapien
cgtcatagacatgcgcgcgacgccg

SEQ ID NO: 57588 - DNA, 25 bp, Homo sapien
cgagccatttcctgagagaccgcgc

SEQ ID NO: 57589 - DNA, 25 bp, Homo sapien
aaagccgctgaccacgtcgggcaga

SEQ ID NO: 57590 - DNA, 25 bp, Homo sapien
tcaccttcgcgggtctgatggcgac

SEQ ID NO: 57591 - DNA, 25 bp, Homo sapien
tgggttcgacgctcagcacccagca

SEQ ID NO: 57592 - DNA, 25 bp, Homo sapien
tcctgaagcaggaacgtgggtaaaa

SEQ ID NO: 57593 - DNA, 25 bp, Homo sapien
tcaggaagcctcgagctgggatcca

SEQ ID NO: 57594 - DNA, 25 bp, Homo sapien
tgcgcgagggtcaccaaaaagccgc

SEQ ID NO: 57595 - DNA, 25 bp, Homo sapien
tctgggaggactgcgacctccactc

SEQ ID NO: 57596 - DNA, 25 bp, Homo sapien
gcattaggcagggacgtgaactcgc

SEQ ID NO: 57597 - DNA, 25 bp, Homo sapien
cgccagcaaaacaaacgcgagcttc

SEQ ID NO: 57598 - DNA, 25 bp, Homo sapien
tcttggggagcgcactttcccacta

SEQ ID NO: 57599 - DNA, 25 bp, Homo sapien
cctgcaccgcaaattcttggggagc

SEQ ID NO: 57600 - DNA, 25 bp, Homo sapien
ttacggctcgcagcacctgcggaca

SEQ ID NO: 57601 - DNA, 25 bp, Homo sapien
gagcatccgagttagcgtctggccg

SEQ ID NO: 57602 - DNA, 25 bp, Homo sapien
ccgaatatgcggtgttagggtatcc

SEQ ID NO: 57603 - DNA, 25 bp, Homo sapien
gggagtctgagccacgatttatcaa

SEQ ID NO: 57604 - DNA, 25 bp, Homo sapien
actgacaaggtttcgcggcaaagga

SEQ ID NO: 57605 - DNA, 25 bp, Homo sapien
cgcgagcgcgttataactgtgcttg

SEQ ID NO: 57606 - DNA, 25 bp, Homo sapien
tcggagagtacgagcgcctcctgca

SEQ ID NO: 57607 - DNA, 25 bp, Homo sapien
aaggagctttattgctgcggcggca

SEQ ID NO: 57608 - DNA, 25 bp, Homo sapien
cttggccgcgagaacaccggtgcct

SEQ ID NO: 57609 - DNA, 25 bp, Homo sapien
ggtcacgtgttcatcgagacggccc

SEQ ID NO: 57610 - DNA, 25 bp, Homo sapien
aaagcgggcgccacacgctcacagg

SEQ ID NO: 57611 - DNA, 25 bp, Homo sapien
tggaccaagcacgagaggaagcgcc

SEQ ID NO: 57612 - DNA, 25 bp, Homo sapien
tctttttcctgctccaaggggcctg

SEQ ID NO: 57613 - DNA, 25 bp, Homo sapien
gggatgctgagtaccctgcacagta

SEQ ID NO: 57614 - DNA, 25 bp, Homo sapien
cgtccgctgatcattggcacctggt

SEQ ID NO: 57615 - DNA, 25 bp, Homo sapien
tagactccagcttatccaaggtgcc

SEQ ID NO: 57616 - DNA, 25 bp, Homo sapien
tctgggctctggatgacattgaatc

SEQ ID NO: 57617 - DNA, 25 bp, Homo sapien
agtgattctggccagggtctccatc

SEQ ID NO: 57618 - DNA, 25 bp, Homo sapien
cgccagccatctgtgattttgacca

SEQ ID NO: 57619 - DNA, 25 bp, Homo sapien
ttccactgatgatttcggcccaggc

SEQ ID NO: 57620 - DNA, 25 bp, Homo sapien
ctcggcccaggtcgcacttttttgc

SEQ ID NO: 57621 - DNA, 25 bp, Homo sapien
tgaagccaccacttggagttccagg

SEQ ID NO: 57622 - DNA, 25 bp, Homo sapien
cggccacagccggaaatgtagagaa

SEQ ID NO: 57623 - DNA, 25 bp, Homo sapien
cgggttcacagttcgcccgcgagtc

SEQ ID NO: 57624 - DNA, 25 bp, Homo sapien
ggagccatccctgacgcgttctcag

SEQ ID NO: 57625 - DNA, 25 bp, Homo sapien
gtgactccagggtttcgcggaaata

SEQ ID NO: 57626 - DNA, 25 bp, Homo sapien
ttttgcccgttttgatcccatcctc

SEQ ID NO: 57627 - DNA, 25 bp, Homo sapien
cgcgttctcagtctacggcagaaaa

SEQ ID NO: 57628 - DNA, 25 bp, Homo sapien
gccctggtgcactgacagcctgtca

SEQ ID NO: 57629 - DNA, 25 bp, Homo sapien
tgacagcctgtcagccgggaagata

SEQ ID NO: 57630 - DNA, 25 bp, Homo sapien
cagccgggaagataagggacttctt

SEQ ID NO: 57631 - DNA, 25 bp, Homo sapien
ctcccgctggtgtttgctcggtaaa

SEQ ID NO: 57632 - DNA, 25 bp, Homo sapien
tgctcggtaaacacttattgggccc

SEQ ID NO: 57633 - DNA, 25 bp, Homo sapien
cgagcaaccctaggcaggcaccaga

SEQ ID NO: 57634 - DNA, 25 bp, Homo sapien
ccggtttcacagaccggccaggaag

SEQ ID NO: 57635 - DNA, 25 bp, Homo sapien
cggtctgcagaaaacgctggctaag

SEQ ID NO: 57636 - DNA, 25 bp, Homo sapien
agctggggaaaccttattgccatgg

SEQ ID NO: 57637 - DNA, 25 bp, Homo sapien
tcaaagcctcaggagagtgtggctc

SEQ ID NO: 57638 - DNA, 25 bp, Homo sapien
cccagctacggaaacgcagcaggtg

SEQ ID NO: 57639 - DNA, 25 bp, Homo sapien
ttgccatggttcttagaagccaccc

SEQ ID NO: 57640 - DNA, 25 bp, Homo sapien
ctcttcttcagtggggacagtcata

SEQ ID NO: 57641 - DNA, 25 bp, Homo sapien
caagaagctccgagaccaacggatc

SEQ ID NO: 57642 - DNA, 25 bp, Homo sapien
gggagaaaagtctagacccgctgcc

SEQ ID NO: 57643 - DNA, 25 bp, Homo sapien
agtcttaacttcagctccagcctca

SEQ ID NO: 57644 - DNA, 25 bp, Homo sapien
aggccgctcctcgagagggatgccc

SEQ ID NO: 57645 - DNA, 25 bp, Homo sapien
gaacaaggccgctcctcgagaggga

SEQ ID NO: 57646 - DNA, 25 bp, Homo sapien
gaagtgacctctcgccctcattggg

SEQ ID NO: 57647 - DNA, 25 bp, Homo sapien
tgacctctcgccctcattgggtgtc

SEQ ID NO: 57648 - DNA, 25 bp, Homo sapien
ggcattccgcgctgctcccacaggt

SEQ ID NO: 57649 - DNA, 25 bp, Homo sapien
cagcggccgcttgaggaacaaggcc

SEQ ID NO: 57650 - DNA, 25 bp, Homo sapien
cccagcggccgcttgaggaacaagg

SEQ ID NO: 57651 - DNA, 25 bp, Homo sapien
ctcacctccagcttggcccgcgctc

SEQ ID NO: 57652 - DNA, 25 bp, Homo sapien
ctgacacctactcccaaatcggggt

SEQ ID NO: 57653 - DNA, 25 bp, Homo sapien
cgtctggggtcaccgtgaactggaa

SEQ ID NO: 57654 - DNA, 25 bp, Homo sapien
gaaggccacggcctggtgagcttcc

SEQ ID NO: 57655 - DNA, 25 bp, Homo sapien
cttccgggtgggcacagccactgtg

SEQ ID NO: 57656 - DNA, 25 bp, Homo sapien
tttgggccttgaaagctccaggagc

SEQ ID NO: 57657 - DNA, 25 bp, Homo sapien
acagctcgggttcactcctgtccgt

SEQ ID NO: 57658 - DNA, 25 bp, Homo sapien
tcactcctgtccgtgcgtggggcca

SEQ ID NO: 57659 - DNA, 25 bp, Homo sapien
tgtttcagggcctcccgactgagcc

SEQ ID NO: 57660 - DNA, 25 bp, Homo sapien
ttccgaaggccgaattccgcagatc

SEQ ID NO: 57661 - DNA, 25 bp, Homo sapien
ggtctctccggctctattcggctca

SEQ ID NO: 57662 - DNA, 25 bp, Homo sapien
gctgcaagccgtctttggccaggca

SEQ ID NO: 57663 - DNA, 25 bp, Homo sapien
tccgggcacttagactgctgcaagc

SEQ ID NO: 57664 - DNA, 25 bp, Homo sapien
aagtactcccggcaccattggtagg

SEQ ID NO: 57665 - DNA, 25 bp, Homo sapien
ggggcgaaaacatggagcatcctga

SEQ ID NO: 57666 - DNA, 25 bp, Homo sapien
cctatgggcaaggaccaatggtctc

SEQ ID NO: 57667 - DNA, 25 bp, Homo sapien
gggcttctccggtcatactcgggtc

SEQ ID NO: 57668 - DNA, 25 bp, Homo sapien
cggcctggacggctgacctgtcaag

SEQ ID NO: 57669 - DNA, 25 bp, Homo sapien
cctgctcggcgaccctcgtgcagac

SEQ ID NO: 57670 - DNA, 25 bp, Homo sapien
gtggggacagctccgatcagcaccc

SEQ ID NO: 57671 - DNA, 25 bp, Homo sapien
acccgacggcggacagctcctcccg

SEQ ID NO: 57672 - DNA, 25 bp, Homo sapien
ctgacctgtcaagggtggaggccct

SEQ ID NO: 57673 - DNA, 25 bp, Homo sapien
tctcgcccagaggaaacagcccacg

SEQ ID NO: 57674 - DNA, 25 bp, Homo sapien
cggatcgcgcggagatgttttctct

SEQ ID NO: 57675 - DNA, 25 bp, Homo sapien
actccctccatcttcaccgcgcgtc

SEQ ID NO: 57676 - DNA, 25 bp, Homo sapien
ctgggccacgacagcgaagaggaca

SEQ ID NO: 57677 - DNA, 25 bp, Homo sapien
gcaacctggtgagccgcatgatctc

SEQ ID NO: 57678 - DNA, 25 bp, Homo sapien
ccgacgacaccaacagcgagtacga

SEQ ID NO: 57679 - DNA, 25 bp, Homo sapien
aactccatcgaggaggcctcgtcgc

SEQ ID NO: 57680 - DNA, 25 bp, Homo sapien
tggggcgcatgatctcgtccatctc

SEQ ID NO: 57681 - DNA, 25 bp, Homo sapien
ggctgacctgagaagccgctcgagc

SEQ ID NO: 57682 - DNA, 25 bp, Homo sapien
cagatcccggcatcgaggctgacct

SEQ ID NO: 57683 - DNA, 25 bp, Homo sapien
gtacgacgcggtcaagtacacgctg

SEQ ID NO: 57684 - DNA, 25 bp, Homo sapien
ttcggaaacatccaggttggagacg

SEQ ID NO: 57685 - DNA, 25 bp, Homo sapien
ggggtaggcttaggatgagagtcgt

SEQ ID NO: 57686 - DNA, 25 bp, Homo sapien
ggtaggcttaggatgagagtcgtgg

SEQ ID NO: 57687 - DNA, 25 bp, Homo sapien
taggcttaggatgagagtcgtggga

SEQ ID NO: 57688 - DNA, 25 bp, Homo sapien
cggaaacatccaggttggagacgtc

SEQ ID NO: 57689 - DNA, 25 bp, Homo sapien
tcggaaacatccaggttggagacgt

SEQ ID NO: 57690 - DNA, 25 bp, Homo sapien
ggcttaggatgagagtcgtgggagc

SEQ ID NO: 57691 - DNA, 25 bp, Homo sapien
ttaggatgagagtcgtgggagcggc

SEQ ID NO: 57692 - DNA, 25 bp, Homo sapien
cctgccatcacggaacgccagtgga

SEQ ID NO: 57693 - DNA, 25 bp, Homo sapien
cgaggaggacgacttctggttccgt

SEQ ID NO: 57694 - DNA, 25 bp, Homo sapien
tggttccgtggcttcaacatgcgca

SEQ ID NO: 57695 - DNA, 25 bp, Homo sapien
gtgtttcctgccttctacgcccatg

SEQ ID NO: 57696 - DNA, 25 bp, Homo sapien
tcccgcggcatccagacgagctgga

SEQ ID NO: 57697 - DNA, 25 bp, Homo sapien
cccaacggcaggttcatcccgcggc

SEQ ID NO: 57698 - DNA, 25 bp, Homo sapien
acgccagtggacacgaccgtcaatc

SEQ ID NO: 57699 - DNA, 25 bp, Homo sapien
agctggatgtggatgaccctgtgtt

SEQ ID NO: 57700 - DNA, 25 bp, Homo sapien
tcgggccctcctgtaagagacctga

SEQ ID NO: 57701 - DNA, 25 bp, Homo sapien
tttgacaccctttctcctgcgtacg

SEQ ID NO: 57702 - DNA, 25 bp, Homo sapien
gcacccggtgaatgagcaaatggca

SEQ ID NO: 57703 - DNA, 25 bp, Homo sapien
attctcgagcggagatctgatcctc

SEQ ID NO: 57704 - DNA, 25 bp, Homo sapien
ccagggcaccttcagattctcgagc

SEQ ID NO: 57705 - DNA, 25 bp, Homo sapien
agcaggctctttccgataccgcaga

SEQ ID NO: 57706 - DNA, 25 bp, Homo sapien
cgaggtcgtcggcaaagatcagcac

SEQ ID NO: 57707 - DNA, 25 bp, Homo sapien
gcgggctcttccttcacgactagca

SEQ ID NO: 57708 - DNA, 25 bp, Homo sapien
taccttggtcttcgtgccccgacgc

SEQ ID NO: 57709 - DNA, 25 bp, Homo sapien
tggtccgcggatgcccgcccttgcc

SEQ ID NO: 57710 - DNA, 25 bp, Homo sapien
agccggggccgatgcagctgagccg

SEQ ID NO: 57711 - DNA, 25 bp, Homo sapien
ggccagcgccgtggtcgtgcgcgtc

SEQ ID NO: 57712 - DNA, 25 bp, Homo sapien
cgtgcgcgtcggcatcccggacctg

SEQ ID NO: 57713 - DNA, 25 bp, Homo sapien
cggacctgcagcagacggtgagccc

SEQ ID NO: 57714 - DNA, 25 bp, Homo sapien
tcgccctaccttggtcttcgtgccc

SEQ ID NO: 57715 - DNA, 25 bp, Homo sapien
cccgcccttgccgctcagccactcc

SEQ ID NO: 57716 - DNA, 25 bp, Homo sapien
ttcatcgccgtgaaggcgcacagcc

SEQ ID NO: 57717 - DNA, 25 bp, Homo sapien
cccgctcccactaggctgccctgac

SEQ ID NO: 57718 - DNA, 25 bp, Homo sapien
cctgaccaccgtcccgcgtccgcgt

SEQ ID NO: 57719 - DNA, 25 bp, Homo sapien
ccaggagctgtattcgaattcgagc

SEQ ID NO: 57720 - DNA, 25 bp, Homo sapien
gcccgaagcggaaactttacagcgc

SEQ ID NO: 57721 - DNA, 25 bp, Homo sapien
gaagcggaaactttacagcgccgtc

SEQ ID NO: 57722 - DNA, 25 bp, Homo sapien
gcggctttgctggtgcccgaagccc

SEQ ID NO: 57723 - DNA, 25 bp, Homo sapien
ggccgcaagttcatcgccgtgaagg

SEQ ID NO: 57724 - DNA, 25 bp, Homo sapien
tctgtctgtgtgcagggtcgggtct

SEQ ID NO: 57725 - DNA, 25 bp, Homo sapien
actgtttgctttcccgccatggacg

SEQ ID NO: 57726 - DNA, 25 bp, Homo sapien
gacactgtttgctttcccgccatgg

SEQ ID NO: 57727 - DNA, 25 bp, Homo sapien
actgacactgtttgctttcccgcca

SEQ ID NO: 57728 - DNA, 25 bp, Homo sapien
gctcattagccactgacactgtttg

SEQ ID NO: 57729 - DNA, 25 bp, Homo sapien
ggttcccgctcattagccactgaca

SEQ ID NO: 57730 - DNA, 25 bp, Homo sapien
cgctgtcaggatgagcgatggccgt

SEQ ID NO: 57731 - DNA, 25 bp, Homo sapien
gggaccctctgtcggctctcaagct

SEQ ID NO: 57732 - DNA, 25 bp, Homo sapien
tctttcctgtgctgagccactcgga

SEQ ID NO: 57733 - DNA, 25 bp, Homo sapien
tgcgcacgggagacttcctcatcga

SEQ ID NO: 57734 - DNA, 25 bp, Homo sapien
aggcggcaattccttcccttcgttg

SEQ ID NO: 57735 - DNA, 25 bp, Homo sapien
ttctggcatgggcaaagggagtttt

SEQ ID NO: 57736 - DNA, 25 bp, Homo sapien
ccgaacctagctggtgaagcgcctt

SEQ ID NO: 57737 - DNA, 25 bp, Homo sapien
tccactgtctttgctctagagtcta

SEQ ID NO: 57738 - DNA, 25 bp, Homo sapien
tcctcatcgaggtgaggtcgttctg

SEQ ID NO: 57739 - DNA, 25 bp, Homo sapien
tcatgtctaggatccttgggccggc

SEQ ID NO: 57740 - DNA, 25 bp, Homo sapien
tgtggatgtacaggcccgggaccca

SEQ ID NO: 57741 - DNA, 25 bp, Homo sapien
cgacacggtgcgctccagcttcaag

SEQ ID NO: 57742 - DNA, 25 bp, Homo sapien
tgccgtatcccgagcggcagaagcg

SEQ ID NO: 57743 - DNA, 25 bp, Homo sapien
gaagcgcgcgcgctccatgatcatc

SEQ ID NO: 57744 - DNA, 25 bp, Homo sapien
cgcgccctactacttcgactcgggg

SEQ ID NO: 57745 - DNA, 25 bp, Homo sapien
gtctgccctgaagccgttggtcagc

SEQ ID NO: 57746 - DNA, 25 bp, Homo sapien
ctgaagccgttggtcagcggcccga

SEQ ID NO: 57747 - DNA, 25 bp, Homo sapien
cctgtttgtggatgtacaggcccgg

SEQ ID NO: 57748 - DNA, 25 bp, Homo sapien
ggagactcgccctgtacattgctta

SEQ ID NO: 57749 - DNA, 25 bp, Homo sapien
aatcgtcctgtttgctgttgctcgg

SEQ ID NO: 57750 - DNA, 25 bp, Homo sapien
gagctccatttcagcgcagcgcagc

SEQ ID NO: 57751 - DNA, 25 bp, Homo sapien
cgactggctggagagcatccaccta

SEQ ID NO: 57752 - DNA, 25 bp, Homo sapien
cgaccgcttcgaggaccatgagata

SEQ ID NO: 57753 - DNA, 25 bp, Homo sapien
ccatgagatagaaggcgcgcaccta

SEQ ID NO: 57754 - DNA, 25 bp, Homo sapien
cgcgcttaccaaggacgacttcgtg

SEQ ID NO: 57755 - DNA, 25 bp, Homo sapien
cgcatgaacatcgagcgcgcgctca

SEQ ID NO: 57756 - DNA, 25 bp, Homo sapien
agtctggactctgcgcgctctcgaa

SEQ ID NO: 57757 - DNA, 25 bp, Homo sapien
ccctcacgtgcggttccgagtgagg

SEQ ID NO: 57758 - DNA, 25 bp, Homo sapien
ccgcgtcctcgcagctgctacgcaa

SEQ ID NO: 57759 - DNA, 25 bp, Homo sapien
cgcagcgcactccacttccggctcg

SEQ ID NO: 57760 - DNA, 25 bp, Homo sapien
ctaagccagccaccggggcggattt

SEQ ID NO: 57761 - DNA, 25 bp, Homo sapien
atttgccctcacgtgcggttccgag

SEQ ID NO: 57762 - DNA, 25 bp, Homo sapien
tcgcccacaccgctagggaggcctc

SEQ ID NO: 57763 - DNA, 25 bp, Homo sapien
acagcctcgcgaagccacctttccg

SEQ ID NO: 57764 - DNA, 25 bp, Homo sapien
ggagcccgattctgctctctccata

SEQ ID NO: 57765 - DNA, 25 bp, Homo sapien
cttcctgatccacgcaagggagctc

SEQ ID NO: 57766 - DNA, 25 bp, Homo sapien
ctagccttgcatcgagccctgagga

SEQ ID NO: 57767 - DNA, 25 bp, Homo sapien
ttacctacccgagtggaagccaagc

SEQ ID NO: 57768 - DNA, 25 bp, Homo sapien
agatgggcggccacaattctccagc

SEQ ID NO: 57769 - DNA, 25 bp, Homo sapien
aacccagcggtgctcagaattctga

SEQ ID NO: 57770 - DNA, 25 bp, Homo sapien
gccggtcccttctgtgtgtatattt

SEQ ID NO: 57771 - DNA, 25 bp, Homo sapien
tggtatactgtctgcccaccaggga

SEQ ID NO: 57772 - DNA, 25 bp, Homo sapien
atgacacgaatgcaccttctctttg

SEQ ID NO: 57773 - DNA, 25 bp, Homo sapien
gacacgaatgcaccttctctttgct

SEQ ID NO: 57774 - DNA, 25 bp, Homo sapien
accttctctttgctaccaacagatc

SEQ ID NO: 57775 - DNA, 25 bp, Homo sapien
ccttctctttgctaccaacagatct

SEQ ID NO: 57776 - DNA, 25 bp, Homo sapien
cttctctttgctaccaacagatctt

SEQ ID NO: 57777 - DNA, 25 bp, Homo sapien
tgacacgaatgcaccttctctttgc

SEQ ID NO: 57778 - DNA, 25 bp, Homo sapien
gcctgggcagcgtccctctgctggg

SEQ ID NO: 57779 - DNA, 25 bp, Homo sapien
gcccaccctccggatgtataagcgt

SEQ ID NO: 57780 - DNA, 25 bp, Homo sapien
accctccggatgtataagcgtcctg

SEQ ID NO: 57781 - DNA, 25 bp, Homo sapien
cctccggatgtataagcgtcctggc

SEQ ID NO: 57782 - DNA, 25 bp, Homo sapien
actgcccaccctccggatgtataag

SEQ ID NO: 57783 - DNA, 25 bp, Homo sapien
tccggatgtataagcgtcctggcca

SEQ ID NO: 57784 - DNA, 25 bp, Homo sapien
aagtgcgcgtgacgctcgggctcgc

SEQ ID NO: 57785 - DNA, 25 bp, Homo sapien
gtgcgcgcaagtgcgcgtgacgctc

SEQ ID NO: 57786 - DNA, 25 bp, Homo sapien
cgggcgcctatggacgcgcggagcc

SEQ ID NO: 57787 - DNA, 25 bp, Homo sapien
gtgcggctgggcacacgcagtcgga

SEQ ID NO: 57788 - DNA, 25 bp, Homo sapien
cgagccagtgcgttcagcatcgcct

SEQ ID NO: 57789 - DNA, 25 bp, Homo sapien
cagggtcctccgaccgggtgaagct

SEQ ID NO: 57790 - DNA, 25 bp, Homo sapien
gctcagggtcctccgaccgggtgaa

SEQ ID NO: 57791 - DNA, 25 bp, Homo sapien
tgcgttcagcatcgcctctctggtt

SEQ ID NO: 57792 - DNA, 25 bp, Homo sapien
agccagtgcgttcagcatcgcctct

SEQ ID NO: 57793 - DNA, 25 bp, Homo sapien
agtgcgttcagcatcgcctctctgg

SEQ ID NO: 57794 - DNA, 25 bp, Homo sapien
aggcgctgtgggacgagttcaacca

SEQ ID NO: 57795 - DNA, 25 bp, Homo sapien
ctaacacctatcctccgccggggcg

SEQ ID NO: 57796 - DNA, 25 bp, Homo sapien
cgctgcctccttcgctgttcgccgt

SEQ ID NO: 57797 - DNA, 25 bp, Homo sapien
gcctccgcctgatccgcgcgagcgg

SEQ ID NO: 57798 - DNA, 25 bp, Homo sapien
tgggacgagttcaaccagctgggca

SEQ ID NO: 57799 - DNA, 25 bp, Homo sapien
tgagcgtgcagctagagatgaaggc

SEQ ID NO: 57800 - DNA, 25 bp, Homo sapien
ccaaggcgccggtgaagaagaacgc

SEQ ID NO: 57801 - DNA, 25 bp, Homo sapien
gttcaaccagctgggcaccgagatg

SEQ ID NO: 57802 - DNA, 25 bp, Homo sapien
gctcaagctgaccaacaacctactg

SEQ ID NO: 57803 - DNA, 25 bp, Homo sapien
acaacggccacgtgagcgactgcct

SEQ ID NO: 57804 - DNA, 25 bp, Homo sapien
agctgaccaacaacctactggacga

SEQ ID NO: 57805 - DNA, 25 bp, Homo sapien
gtgtccttcgacaagctcaagctga

SEQ ID NO: 57806 - DNA, 25 bp, Homo sapien
gtggatgaagcaaatcgtgtccttc

SEQ ID NO: 57807 - DNA, 25 bp, Homo sapien
taccacccggactcgcctgccaagg

SEQ ID NO: 57808 - DNA, 25 bp, Homo sapien
tgccgctccaggtacgccttccaca

SEQ ID NO: 57809 - DNA, 25 bp, Homo sapien
ctactggacgacaacggccacgtga

SEQ ID NO: 57810 - DNA, 25 bp, Homo sapien
tggcaccgactggtcggggaacacc

SEQ ID NO: 57811 - DNA, 25 bp, Homo sapien
cgagggcggccaagagccttctctc

SEQ ID NO: 57812 - DNA, 25 bp, Homo sapien
aggcccggcgagaattccagcgcga

SEQ ID NO: 57813 - DNA, 25 bp, Homo sapien
tacgaccactatctcggggccaaga

SEQ ID NO: 57814 - DNA, 25 bp, Homo sapien
gcggccgccaacatgtactcgtcgg

SEQ ID NO: 57815 - DNA, 25 bp, Homo sapien
caacatgtactcgtcggccggagcc

SEQ ID NO: 57816 - DNA, 25 bp, Homo sapien
ccaagggcaagcaaggaatacgttc

SEQ ID NO: 57817 - DNA, 25 bp, Homo sapien
cttgggctatcgaagtatccggttc

SEQ ID NO: 57818 - DNA, 25 bp, Homo sapien
tgaaggccacgcactggacagcggc

SEQ ID NO: 57819 - DNA, 25 bp, Homo sapien
atcttgcgatctggccggatcgtga

SEQ ID NO: 57820 - DNA, 25 bp, Homo sapien
cctgcggtggccaggatcttgcgat

SEQ ID NO: 57821 - DNA, 25 bp, Homo sapien
cagcacggccagtggctgcatcgtc

SEQ ID NO: 57822 - DNA, 25 bp, Homo sapien
ccagcaagccatcggcggtgaaggc

SEQ ID NO: 57823 - DNA, 25 bp, Homo sapien
tgatccgctgatccttggagcccgc

SEQ ID NO: 57824 - DNA, 25 bp, Homo sapien
gtgaccagaggctgatccgctgatc

SEQ ID NO: 57825 - DNA, 25 bp, Homo sapien
tgcatcgtccgccagtggaacacgc

SEQ ID NO: 57826 - DNA, 25 bp, Homo sapien
gaacggcccaaatgtctccaggtgc

SEQ ID NO: 57827 - DNA, 25 bp, Homo sapien
aggctacgcgaatcgcccgcgaaga

SEQ ID NO: 57828 - DNA, 25 bp, Homo sapien
agaccgattacatcgcgcagccacg

SEQ ID NO: 57829 - DNA, 25 bp, Homo sapien
gcgcagcgtccagagaccgattaca

SEQ ID NO: 57830 - DNA, 25 bp, Homo sapien
ccctctgcggatcagaagtcgggaa

SEQ ID NO: 57831 - DNA, 25 bp, Homo sapien
tcccgagactgcgagaacggcccaa

SEQ ID NO: 57832 - DNA, 25 bp, Homo sapien
gagtccaggcgccacctagaaagtg

SEQ ID NO: 57833 - DNA, 25 bp, Homo sapien
tcctgggatccgtagccacagaccg

SEQ ID NO: 57834 - DNA, 25 bp, Homo sapien
gcaccgtaagtagcagtgaccgctc

SEQ ID NO: 57835 - DNA, 25 bp, Homo sapien
accgtaagtagcagtgaccgctctc

SEQ ID NO: 57836 - DNA, 25 bp, Homo sapien
tgggcgcaccgtaagtagcagtgac

SEQ ID NO: 57837 - DNA, 25 bp, Homo sapien
tagcagtgaccgctctcaggagggt

SEQ ID NO: 57838 - DNA, 25 bp, Homo sapien
ccgtaagtagcagtgaccgctctca

SEQ ID NO: 57839 - DNA, 25 bp, Homo sapien
ccgtggatagcagtgaccgctctca

SEQ ID NO: 57840 - DNA, 25 bp, Homo sapien
gcaccatgagtagcagtgaccgctc

SEQ ID NO: 57841 - DNA, 25 bp, Homo sapien
accatgagtagcagtgaccgctctc

SEQ ID NO: 57842 - DNA, 25 bp, Homo sapien
caccgccgcgcggacaccctcacga

SEQ ID NO: 57843 - DNA, 25 bp, Homo sapien
cacggcctgcgtccgccaccggaag

SEQ ID NO: 57844 - DNA, 25 bp, Homo sapien
cagcgccaccgccattgccgccatc

SEQ ID NO: 57845 - DNA, 25 bp, Homo sapien
gccgccatcgtcgtggggcttctgg

SEQ ID NO: 57846 - DNA, 25 bp, Homo sapien
ccgtcgcgggagaggtgagagcgct

SEQ ID NO: 57847 - DNA, 25 bp, Homo sapien
agcgctggctagaccggggccgaat

SEQ ID NO: 57848 - DNA, 25 bp, Homo sapien
ccggggccgaatgcggccggattcg

SEQ ID NO: 57849 - DNA, 25 bp, Homo sapien
gcgcggacaccctcacgaggacacc

SEQ ID NO: 57850 - DNA, 25 bp, Homo sapien
cggagcctgtgcattgcgcacattc

SEQ ID NO: 57851 - DNA, 25 bp, Homo sapien
tatccaggctgtcggacacgatttc

SEQ ID NO: 57852 - DNA, 25 bp, Homo sapien
tcagccatggcgtagctccctgagg

SEQ ID NO: 57853 - DNA, 25 bp, Homo sapien
agctacctccagttgggacagcgcc

SEQ ID NO: 57854 - DNA, 25 bp, Homo sapien
caccgatgaggtctttgttgcgccg

SEQ ID NO: 57855 - DNA, 25 bp, Homo sapien
gcaccaccttgtcggtctcagactg

SEQ ID NO: 57856 - DNA, 25 bp, Homo sapien
tgcagcagttccacaagcaccggca

SEQ ID NO: 57857 - DNA, 25 bp, Homo sapien
cttcgcttcgcgtaccgattggctg

SEQ ID NO: 57858 - DNA, 25 bp, Homo sapien
gccgcattggccttcacggggtcca

SEQ ID NO: 57859 - DNA, 25 bp, Homo sapien
gccatcatctgctgtgtcctcgtag

SEQ ID NO: 57860 - DNA, 25 bp, Homo sapien
tccttgcgggcgctatccactgagg

SEQ ID NO: 57861 - DNA, 25 bp, Homo sapien
cgtcaccattgggaacgcaggccgc

SEQ ID NO: 57862 - DNA, 25 bp, Homo sapien
ctcgtaggccctgcacaggcaagtg

SEQ ID NO: 57863 - DNA, 25 bp, Homo sapien
caaagcacagatgctgcaggtaggc

SEQ ID NO: 57864 - DNA, 25 bp, Homo sapien
cttgttgtcagtgtcgcggccatag

SEQ ID NO: 57865 - DNA, 25 bp, Homo sapien
gacaccctcgttctcaaagcacaga

SEQ ID NO: 57866 - DNA, 25 bp, Homo sapien
gctggccaagaagcgtccatccggt

SEQ ID NO: 57867 - DNA, 25 bp, Homo sapien
caacctgtctgagttcggccggcat

SEQ ID NO: 57868 - DNA, 25 bp, Homo sapien
ttccctccaacctgtctgagttcgg

SEQ ID NO: 57869 - DNA, 25 bp, Homo sapien
ccagcggctccgcggaacaaaagcg

SEQ ID NO: 57870 - DNA, 25 bp, Homo sapien
gcaagacaatagctgcctcgggcca

SEQ ID NO: 57871 - DNA, 25 bp, Homo sapien
cagccaggggcgcaagacaatagct

SEQ ID NO: 57872 - DNA, 25 bp, Homo sapien
agaagcgtccatccggtccgggccg

SEQ ID NO: 57873 - DNA, 25 bp, Homo sapien
gtgccaagaggagggtcaaactgcc

SEQ ID NO: 57874 - DNA, 25 bp, Homo sapien
gctgcccggaatgcgtcccatatct

SEQ ID NO: 57875 - DNA, 25 bp, Homo sapien
ctggagtgctcagtgcaagacgccc

SEQ ID NO: 57876 - DNA, 25 bp, Homo sapien
gcccggatctcgactccagggatag

SEQ ID NO: 57877 - DNA, 25 bp, Homo sapien
ctgttggaaagtttcggcggctgca

SEQ ID NO: 57878 - DNA, 25 bp, Homo sapien
tttcccattggtcgagagacccggc

SEQ ID NO: 57879 - DNA, 25 bp, Homo sapien
agatgacggcttgccattgggcctc

SEQ ID NO: 57880 - DNA, 25 bp, Homo sapien
agattggctccgacgtccggcccag

SEQ ID NO: 57881 - DNA, 25 bp, Homo sapien
gcccactggctcaggcttacctgga

SEQ ID NO: 57882 - DNA, 25 bp, Homo sapien
actctggcaggtgggaccagactcg

SEQ ID NO: 57883 - DNA, 25 bp, Homo sapien
cccatggcgtccctgcaggcaggga

SEQ ID NO: 57884 - DNA, 25 bp, Homo sapien
cttggccagcatcagggacagctct

SEQ ID NO: 57885 - DNA, 25 bp, Homo sapien
gtcaggggcaaccacgtcgatcccg

SEQ ID NO: 57886 - DNA, 25 bp, Homo sapien
cctttctgaggtatggtatagaatc

SEQ ID NO: 57887 - DNA, 25 bp, Homo sapien
gcccaatggtgaacgcgccggcttc

SEQ ID NO: 57888 - DNA, 25 bp, Homo sapien
gcgcagcccgaagctttggcgcagc

SEQ ID NO: 57889 - DNA, 25 bp, Homo sapien
ctggatcaggaagcgctcagacgcc

SEQ ID NO: 57890 - DNA, 25 bp, Homo sapien
gcgtactccgcgctccctgttcccg

SEQ ID NO: 57891 - DNA, 25 bp, Homo sapien
ggacacacgcgctacgcgccgccga

SEQ ID NO: 57892 - DNA, 25 bp, Homo sapien
cagcgactgttagcgcgaccgcggc

SEQ ID NO: 57893 - DNA, 25 bp, Homo sapien
cgaccggagagcctggacaggcttt

SEQ ID NO: 57894 - DNA, 25 bp, Homo sapien
aaggtggcccgtctgcgtgtccgct

SEQ ID NO: 57895 - DNA, 25 bp, Homo sapien
gccgcacgccgcgaaggcccgccct

SEQ ID NO: 57896 - DNA, 25 bp, Homo sapien
gacaggctttccagatggctgcggc

SEQ ID NO: 57897 - DNA, 25 bp, Homo sapien
cccgcctgggcagcgactgttagcg

SEQ ID NO: 57898 - DNA, 25 bp, Homo sapien
tctcagcggacttgtgcatgttagc

SEQ ID NO: 57899 - DNA, 25 bp, Homo sapien
agcgtgagctttaccgagagctgca

SEQ ID NO: 57900 - DNA, 25 bp, Homo sapien
cacgcacctgcggtccggaagttct

SEQ ID NO: 57901 - DNA, 25 bp, Homo sapien
gcctcctcatagacccgaactgtag

SEQ ID NO: 57902 - DNA, 25 bp, Homo sapien
aggatccttctctaagggccgcctc

SEQ ID NO: 57903 - DNA, 25 bp, Homo sapien
gacagtccgaactccctgctgagga

SEQ ID NO: 57904 - DNA, 25 bp, Homo sapien
ccctgcaaacgtccagtggtgcaga

SEQ ID NO: 57905 - DNA, 25 bp, Homo sapien
gggcttgtaaaactctggtcttgta

SEQ ID NO: 57906 - DNA, 25 bp, Homo sapien
cgcacactgagtgggcggcctttcc

SEQ ID NO: 57907 - DNA, 25 bp, Homo sapien
ggctgcagaccaaagcggcccagga

SEQ ID NO: 57908 - DNA, 25 bp, Homo sapien
tcacaaaggcgcagggtggttgccc

SEQ ID NO: 57909 - DNA, 25 bp, Homo sapien
gcaccatgcaaaacgcgcagggcct

SEQ ID NO: 57910 - DNA, 25 bp, Homo sapien
cgtcggccactcgtgttactggtgg

SEQ ID NO: 57911 - DNA, 25 bp, Homo sapien
tcgtgttactggtggctcactctca

SEQ ID NO: 57912 - DNA, 25 bp, Homo sapien
cagcgctgcggaatgtcacaaaggc

SEQ ID NO: 57913 - DNA, 25 bp, Homo sapien
cggcctttccagagggcaccatgca

SEQ ID NO: 57914 - DNA, 25 bp, Homo sapien
gccaataaagctgtactggttttga

SEQ ID NO: 57915 - DNA, 25 bp, Homo sapien
ctggttttgaatcgcggcgcgtttc

SEQ ID NO: 57916 - DNA, 25 bp, Homo sapien
gtgtccgcctcctgagccaataaag

SEQ ID NO: 57917 - DNA, 25 bp, Homo sapien
actttagccagctctagaggcgcgc

SEQ ID NO: 57918 - DNA, 25 bp, Homo sapien
ggcaacgtcatcgtcacgcgccgga

SEQ ID NO: 57919 - DNA, 25 bp, Homo sapien
tatgatcctggcttctggcaacgtc

SEQ ID NO: 57920 - DNA, 25 bp, Homo sapien
gaggccgagcgtctctatgatcctg

SEQ ID NO: 57921 - DNA, 25 bp, Homo sapien
cgggactcgaacctgcgatgctcag

SEQ ID NO: 57922 - DNA, 25 bp, Homo sapien
ggacccacttgaaggctgcggaagc

SEQ ID NO: 57923 - DNA, 25 bp, Homo sapien
agtccggctgaaagcaaaggttctc

SEQ ID NO: 57924 - DNA, 25 bp, Homo sapien
aaaggttctcgaggctaactgtagc

SEQ ID NO: 57925 - DNA, 25 bp, Homo sapien
ggactgaggagcaattccctttctc

SEQ ID NO: 57926 - DNA, 25 bp, Homo sapien
tccctttctcaaggcctgcggggtc

SEQ ID NO: 57927 - DNA, 25 bp, Homo sapien
gaccctctttggctgtgagtgatgg

SEQ ID NO: 57928 - DNA, 25 bp, Homo sapien
ggaaacttgtgagactcggcctctc

SEQ ID NO: 57929 - DNA, 25 bp, Homo sapien
agagcctccagtctggggacctttc

SEQ ID NO: 57930 - DNA, 25 bp, Homo sapien
ccctcgtgaattccaaggggcttca

SEQ ID NO: 57931 - DNA, 25 bp, Homo sapien
ttgactgagggtctcccgctggcac

SEQ ID NO: 57932 - DNA, 25 bp, Homo sapien
ggacgcgcctcaaacccgccaagta

SEQ ID NO: 57933 - DNA, 25 bp, Homo sapien
cgctgacataagagcgcagcagccg

SEQ ID NO: 57934 - DNA, 25 bp, Homo sapien
attccaaggggcttcagaccagagg

SEQ ID NO: 57935 - DNA, 25 bp, Homo sapien
agccgaccgtctctcaagcctgcag

SEQ ID NO: 57936 - DNA, 25 bp, Homo sapien
cgaggcggtcagaaggcaaacagcc

SEQ ID NO: 57937 - DNA, 25 bp, Homo sapien
ttaaggggcgcgctgacataagagc

SEQ ID NO: 57938 - DNA, 25 bp, Homo sapien
gcccagcagtggctcacacaggtca

SEQ ID NO: 57939 - DNA, 25 bp, Homo sapien
ggaccatcatggcatccatccagga

SEQ ID NO: 57940 - DNA, 25 bp, Homo sapien
cttcggcgactcaggcgtctatgac

SEQ ID NO: 57941 - DNA, 25 bp, Homo sapien
cgctatggctccagagacgaccttg

SEQ ID NO: 57942 - DNA, 25 bp, Homo sapien
accgcaacggcagcctgtcctatga

SEQ ID NO: 57943 - DNA, 25 bp, Homo sapien
agacgtcactgtcctcgctgtccag

SEQ ID NO: 57944 - DNA, 25 bp, Homo sapien
aagctgtcgccttcatccacacgga

SEQ ID NO: 57945 - DNA, 25 bp, Homo sapien
tgtgcgctacgacaacctgtccagg

SEQ ID NO: 57946 - DNA, 25 bp, Homo sapien
gaggaccgcccaccactgcgggccc

SEQ ID NO: 57947 - DNA, 25 bp, Homo sapien
gcgtggccagccttgggtgcctcct

SEQ ID NO: 57948 - DNA, 25 bp, Homo sapien
attggcacctgcacccgtggatggg

SEQ ID NO: 57949 - DNA, 25 bp, Homo sapien
gattggcacctgcacccgtggatgg

SEQ ID NO: 57950 - DNA, 25 bp, Homo sapien
cggattggcacctgcacccgtggat

SEQ ID NO: 57951 - DNA, 25 bp, Homo sapien
tgtagggccccgaagctgacctcca

SEQ ID NO: 57952 - DNA, 25 bp, Homo sapien
ttctctctcacggacgccgcggccc

SEQ ID NO: 57953 - DNA, 25 bp, Homo sapien
ctgcttctctctcacggacgccgcg

SEQ ID NO: 57954 - DNA, 25 bp, Homo sapien
cctgccaagcggtgtcctggattgg

SEQ ID NO: 57955 - DNA, 25 bp, Homo sapien
gcgccctgccaagcggtgtcctgga

SEQ ID NO: 57956 - DNA, 25 bp, Homo sapien
aagcgccctgccaagcggtgtcctg

SEQ ID NO: 57957 - DNA, 25 bp, Homo sapien
tacgctaacaaaggccaagcgccct

SEQ ID NO: 57958 - DNA, 25 bp, Homo sapien
atacgctaacaaaggccaagcgccc

SEQ ID NO: 57959 - DNA, 25 bp, Homo sapien
ctggctggaagccggaactcccggc

SEQ ID NO: 57960 - DNA, 25 bp, Homo sapien
ctggaagccggaactcccggcctcg

SEQ ID NO: 57961 - DNA, 25 bp, Homo sapien
aggctccgggatgtcgtgcaggaca

SEQ ID NO: 57962 - DNA, 25 bp, Homo sapien
cagatagagtgtcatgaggcggcca

SEQ ID NO: 57963 - DNA, 25 bp, Homo sapien
cagcgctgatagattgttggcaaac

SEQ ID NO: 57964 - DNA, 25 bp, Homo sapien
tgagccttctgagtcaccagtcccg

SEQ ID NO: 57965 - DNA, 25 bp, Homo sapien
gttcttgcgtgaacagcctggcctc

SEQ ID NO: 57966 - DNA, 25 bp, Homo sapien
gaagctggtcttccaggctccagta

SEQ ID NO: 57967 - DNA, 25 bp, Homo sapien
actgaggccttgtcagcggcatctg

SEQ ID NO: 57968 - DNA, 25 bp, Homo sapien
cagccctgcaggtcattggcagcta

SEQ ID NO: 57969 - DNA, 25 bp, Homo sapien
acacccaggggttgtcgttgagcct

SEQ ID NO: 57970 - DNA, 25 bp, Homo sapien
ggccctgccgaagccgtcaactttc

SEQ ID NO: 57971 - DNA, 25 bp, Homo sapien
gacgccctcttcatcgtaggggttg

SEQ ID NO: 57972 - DNA, 25 bp, Homo sapien
ccctcttcatcgtaggggttgggcg

SEQ ID NO: 57973 - DNA, 25 bp, Homo sapien
cagatggtgggcgttgctgcctcct

SEQ ID NO: 57974 - DNA, 25 bp, Homo sapien
catcccactgtggactgacctcgga

SEQ ID NO: 57975 - DNA, 25 bp, Homo sapien
ctgtggactgacctcggagaaacgg

SEQ ID NO: 57976 - DNA, 25 bp, Homo sapien
ctcgacttggcccagcatcggggac

SEQ ID NO: 57977 - DNA, 25 bp, Homo sapien
ttggcccagcatcggggaccctcgg

SEQ ID NO: 57978 - DNA, 25 bp, Homo sapien
gttctggagtatgaccaccggagcc

SEQ ID NO: 57979 - DNA, 25 bp, Homo sapien
cgctggtgttctggagtatgaccac

SEQ ID NO: 57980 - DNA, 25 bp, Homo sapien
gacttctaaggagagagcgcggcta

SEQ ID NO: 57981 - DNA, 25 bp, Homo sapien
ggcgtgccagaacccttgaggaaga

SEQ ID NO: 57982 - DNA, 25 bp, Homo sapien
acttcgggatgggttctccagaggt

SEQ ID NO: 57983 - DNA, 25 bp, Homo sapien
ttgggacttcgggatgggttctcca

SEQ ID NO: 57984 - DNA, 25 bp, Homo sapien
aacgcgtaggaggcgtactgcagct

SEQ ID NO: 57985 - DNA, 25 bp, Homo sapien
ctgtggacgcacagaggtctgcagc

SEQ ID NO: 57986 - DNA, 25 bp, Homo sapien
caaggagggttttgctcagcccagg

SEQ ID NO: 57987 - DNA, 25 bp, Homo sapien
actccaaggagggttttgctcagcc

SEQ ID NO: 57988 - DNA, 25 bp, Homo sapien
cgctcctctgcggagactccaagga

SEQ ID NO: 57989 - DNA, 25 bp, Homo sapien
cagcttcacgacatcccgagcgcgg

SEQ ID NO: 57990 - DNA, 25 bp, Homo sapien
gcctgcttattcaggaggcgcgccc

SEQ ID NO: 57991 - DNA, 25 bp, Homo sapien
ccgccgcctgcttattcaggaggcg

SEQ ID NO: 57992 - DNA, 25 bp, Homo sapien
cttttacgattgtcccacgcgcggc

SEQ ID NO: 57993 - DNA, 25 bp, Homo sapien
ccgcgcgacattaaaggcgagactc

SEQ ID NO: 57994 - DNA, 25 bp, Homo sapien
ctgagcgctctcgaggagtacacta

SEQ ID NO: 57995 - DNA, 25 bp, Homo sapien
taagaagctcaacacccagtgaggc

SEQ ID NO: 57996 - DNA, 25 bp, Homo sapien
ctggagagcttcaaggtcagcttcc

SEQ ID NO: 57997 - DNA, 25 bp, Homo sapien
ctgcacgagctgcaagagaagctga

SEQ ID NO: 57998 - DNA, 25 bp, Homo sapien
cttgaggctctcaaggagaacggcg

SEQ ID NO: 57999 - DNA, 25 bp, Homo sapien
agactggccgagtaccacgccaagg

SEQ ID NO: 58000 - DNA, 25 bp, Homo sapien
gccaaggccaccgagcatctgagca

SEQ ID NO: 58001 - DNA, 25 bp, Homo sapien
cccttcccggtgctcagaataaacg

SEQ ID NO: 58002 - DNA, 25 bp, Homo sapien
gtcgaacgggaaggctgctacatcc

SEQ ID NO: 58003 - DNA, 25 bp, Homo sapien
tgctcaccgatgagcggcacgctct

SEQ ID NO: 58004 - DNA, 25 bp, Homo sapien
ctctcggccagcagcaactggaaga

SEQ ID NO: 58005 - DNA, 25 bp, Homo sapien
acaccttctcgcctgagtcggcagg

SEQ ID NO: 58006 - DNA, 25 bp, Homo sapien
gcagcagcaggttgcacacgtaggc

SEQ ID NO: 58007 - DNA, 25 bp, Homo sapien
ttctccacgaagtccgccaggctgg

SEQ ID NO: 58008 - DNA, 25 bp, Homo sapien
ccgtgagtccaggagccgaacgtca

SEQ ID NO: 58009 - DNA, 25 bp, Homo sapien
aggctgctacatccacgcggcacga

SEQ ID NO: 58010 - DNA, 25 bp, Homo sapien
agggacgccttacgccctacgctga

SEQ ID NO: 58011 - DNA, 25 bp, Homo sapien
aggccaggatctcggccagtgccga

SEQ ID NO: 58012 - DNA, 25 bp, Homo sapien
ttccagatgaagaagaacgccgagg

SEQ ID NO: 58013 - DNA, 25 bp, Homo sapien
aggagaagctcaaccaccagcttga

SEQ ID NO: 58014 - DNA, 25 bp, Homo sapien
gccctacgctgacgaattcaaagtc

SEQ ID NO: 58015 - DNA, 25 bp, Homo sapien
gccgacgagctcaaggccaagatcg

SEQ ID NO: 58016 - DNA, 25 bp, Homo sapien
ctacgcacagcgcatggagagagtg

SEQ ID NO: 58017 - DNA, 25 bp, Homo sapien
ccctatgctcaggacacgcaggaga

SEQ ID NO: 58018 - DNA, 25 bp, Homo sapien
gttccccagcaactgcatcattttc

SEQ ID NO: 58019 - DNA, 25 bp, Homo sapien
catgctggcgatctcgaggccgacc

SEQ ID NO: 58020 - DNA, 25 bp, Homo sapien
caaattgttccccagcaactgcatc

SEQ ID NO: 58021 - DNA, 25 bp, Homo sapien
tctccctaaagtggaggagtgggca

SEQ ID NO: 58022 - DNA, 25 bp, Homo sapien
tcagcctgggcatgctggcgatctc

SEQ ID NO: 58023 - DNA, 25 bp, Homo sapien
agcctgggcatgctggcgatctcga

SEQ ID NO: 58024 - DNA, 25 bp, Homo sapien
gcatgctggcgatctcgaggccgac

SEQ ID NO: 58025 - DNA, 25 bp, Homo sapien
cagcctgggcatgctggcgatctcg

SEQ ID NO: 58026 - DNA, 25 bp, Homo sapien
tggagccggtgagctcttcttacgt

SEQ ID NO: 58027 - DNA, 25 bp, Homo sapien
gttcacctggagatacattttaaac

SEQ ID NO: 58028 - DNA, 25 bp, Homo sapien
gtgagctcttcttacgtccccgccg

SEQ ID NO: 58029 - DNA, 25 bp, Homo sapien
agccggtgagctcttcttacgtccc

SEQ ID NO: 58030 - DNA, 25 bp, Homo sapien
gagccggtgagctcttcttacgtcc

SEQ ID NO: 58031 - DNA, 25 bp, Homo sapien
gtggagccggtgagctcttcttacg

SEQ ID NO: 58032 - DNA, 25 bp, Homo sapien
ggagccggtgagctcttcttacgtc

SEQ ID NO: 58033 - DNA, 25 bp, Homo sapien
tgagctcttcttacgtccccgccgc

SEQ ID NO: 58034 - DNA, 25 bp, Homo sapien
tcgagtggtagagccagtcagtccc

SEQ ID NO: 58035 - DNA, 25 bp, Homo sapien
tgcgcaccttgagggtcacacagtc

SEQ ID NO: 58036 - DNA, 25 bp, Homo sapien
cagactcggccaaggcagcggaata

SEQ ID NO: 58037 - DNA, 25 bp, Homo sapien
gagcttcttcaccaggcttgccctg

SEQ ID NO: 58038 - DNA, 25 bp, Homo sapien
gcacgaattcgcatttctgccggta

SEQ ID NO: 58039 - DNA, 25 bp, Homo sapien
tctgccggtagatgatcagcgagtc

SEQ ID NO: 58040 - DNA, 25 bp, Homo sapien
catcttcgcggggaatggaccgacc

SEQ ID NO: 58041 - DNA, 25 bp, Homo sapien
cggtctcaacggcttccgcgcaata

SEQ ID NO: 58042 - DNA, 25 bp, Homo sapien
gccttttcccttctgtctgcctttc

SEQ ID NO: 58043 - DNA, 25 bp, Homo sapien
ttccggcctgttgacgtggagacgc

SEQ ID NO: 58044 - DNA, 25 bp, Homo sapien
cttttcccttctgtctgcctttccg

SEQ ID NO: 58045 - DNA, 25 bp, Homo sapien
ttcccttctgtctgcctttccggcc

SEQ ID NO: 58046 - DNA, 25 bp, Homo sapien
gcgttttcccttctgtctgcctttc

SEQ ID NO: 58047 - DNA, 25 bp, Homo sapien
tttccggcctgttgacgtggagacg

SEQ ID NO: 58048 - DNA, 25 bp, Homo sapien
cttctgtctgcctttccggcctgtt

SEQ ID NO: 58049 - DNA, 25 bp, Homo sapien
ctttccggcctgttgacgtggagac

SEQ ID NO: 58050 - DNA, 25 bp, Homo sapien
gagagtcctgatgggtgaccctata

SEQ ID NO: 58051 - DNA, 25 bp, Homo sapien
acccatctcatgcatgagagtcctg

SEQ ID NO: 58052 - DNA, 25 bp, Homo sapien
gtgaccctatagttccctggcaggt

SEQ ID NO: 58053 - DNA, 25 bp, Homo sapien
gattgtctttttcatgttcccagtc

SEQ ID NO: 58054 - DNA, 25 bp, Homo sapien
ccagtcattttgcttcaggtgctca

SEQ ID NO: 58055 - DNA, 25 bp, Homo sapien
caggtgctcattttgaaggtattta

SEQ ID NO: 58056 - DNA, 25 bp, Homo sapien
cctactttagtgcatgggtgaaatg

SEQ ID NO: 58057 - DNA, 25 bp, Homo sapien
tggcacagccaccagagattgtctt

SEQ ID NO: 58058 - DNA, 25 bp, Homo sapien
ttgctcatgagcacgcaggccagga

SEQ ID NO: 58059 - DNA, 25 bp, Homo sapien
agccctgacagacgtgcaccacgga

SEQ ID NO: 58060 - DNA, 25 bp, Homo sapien
tgcaccacggaagggacgtgattgt

SEQ ID NO: 58061 - DNA, 25 bp, Homo sapien
acgtgattgtggctgccttctcggg

SEQ ID NO: 58062 - DNA, 25 bp, Homo sapien
ccttctcgggagactcaaattcttt

SEQ ID NO: 58063 - DNA, 25 bp, Homo sapien
tcaaattctttggatctgcgcacga

SEQ ID NO: 58064 - DNA, 25 bp, Homo sapien
tgcgcacgattcctgggtcccatcg

SEQ ID NO: 58065 - DNA, 25 bp, Homo sapien
aggggcgtttgctcatgagcacgca

SEQ ID NO: 58066 - DNA, 25 bp, Homo sapien
cgcaggcttccgtaaggcaggccaa

SEQ ID NO: 58067 - DNA, 25 bp, Homo sapien
tttcaactccgctcggctgtaaccg

SEQ ID NO: 58068 - DNA, 25 bp, Homo sapien
gtgcggctccagaaagatcgcgaga

SEQ ID NO: 58069 - DNA, 25 bp, Homo sapien
agagctgcggctatctcgagatccc

SEQ ID NO: 58070 - DNA, 25 bp, Homo sapien
acctgggcgaatgccagctctcttc

SEQ ID NO: 58071 - DNA, 25 bp, Homo sapien
cggggacacgcttctagtaggccaa

SEQ ID NO: 58072 - DNA, 25 bp, Homo sapien
gcgacttctgctccattcttctaac

SEQ ID NO: 58073 - DNA, 25 bp, Homo sapien
agcttcgtcccaactgcgacttctg

SEQ ID NO: 58074 - DNA, 25 bp, Homo sapien
cggagcgcaaatctcagggctggca

SEQ ID NO: 58075 - DNA, 25 bp, Homo sapien
catgcagccactggaacgctctttc

SEQ ID NO: 58076 - DNA, 25 bp, Homo sapien
tgtcaagaacagtcaccaggcgctt

SEQ ID NO: 58077 - DNA, 25 bp, Homo sapien
gcggatcaactcctagctgctgcca

SEQ ID NO: 58078 - DNA, 25 bp, Homo sapien
gactcggagagagccaaacggtttc

SEQ ID NO: 58079 - DNA, 25 bp, Homo sapien
gcgccgctgcaggaaaccaaaaact

SEQ ID NO: 58080 - DNA, 25 bp, Homo sapien
tccgccgcgagcgtctttgaattgc

SEQ ID NO: 58081 - DNA, 25 bp, Homo sapien
ccgtcggccgcacagagtttaacaa

SEQ ID NO: 58082 - DNA, 25 bp, Homo sapien
tgggaaggcttcctagtctctctgc

SEQ ID NO: 58083 - DNA, 25 bp, Homo sapien
ggcatggtaactattcgaccctttc

SEQ ID NO: 58084 - DNA, 25 bp, Homo sapien
gggtggtgacgcaacatagagactc

SEQ ID NO: 58085 - DNA, 25 bp, Homo sapien
tcacacagggcctctcgaagtgggc

SEQ ID NO: 58086 - DNA, 25 bp, Homo sapien
tgggcaacgcgtcttttgaaaccga

SEQ ID NO: 58087 - DNA, 25 bp, Homo sapien
gaccctgttattcattgggcaacgc

SEQ ID NO: 58088 - DNA, 25 bp, Homo sapien
ctagacttcgaagcggagaggccct

SEQ ID NO: 58089 - DNA, 25 bp, Homo sapien
gccactctgggtcgaccctgttatt

SEQ ID NO: 58090 - DNA, 25 bp, Homo sapien
agcgatctcagactggctgaggttt

SEQ ID NO: 58091 - DNA, 25 bp, Homo sapien
agtgggcgcgcagacagtgctttcc

SEQ ID NO: 58092 - DNA, 25 bp, Homo sapien
gggtcagacgtttaaagcgatctca

SEQ ID NO: 58093 - DNA, 25 bp, Homo sapien
cagaaattaggttgaagaactgggc

SEQ ID NO: 58094 - DNA, 25 bp, Homo sapien
gctttggcacgaatcagaaattagg

SEQ ID NO: 58095 - DNA, 25 bp, Homo sapien
cagaggacaagctttggcacgaatc

SEQ ID NO: 58096 - DNA, 25 bp, Homo sapien
ccacgattttgagcagaggacaagc

SEQ ID NO: 58097 - DNA, 25 bp, Homo sapien
atactcggcgtcttccacgattttg

SEQ ID NO: 58098 - DNA, 25 bp, Homo sapien
gaagcgtcccggcagatcgcagacg

SEQ ID NO: 58099 - DNA, 25 bp, Homo sapien
ccaggcacttggatttgcgcagcca

SEQ ID NO: 58100 - DNA, 25 bp, Homo sapien
tccacaaggtggcaggccaggcact

SEQ ID NO: 58101 - DNA, 25 bp, Homo sapien
ggcggttttactcctggtgtccaca

SEQ ID NO: 58102 - DNA, 25 bp, Homo sapien
cgagctaattttgccgaacgaatcc

SEQ ID NO: 58103 - DNA, 25 bp, Homo sapien
tggagccagcccaccggcggtttta

SEQ ID NO: 58104 - DNA, 25 bp, Homo sapien
aacgaatccgcttctcacctgcatt

SEQ ID NO: 58105 - DNA, 25 bp, Homo sapien
gccgcctttctttcaggcgcacaga

SEQ ID NO: 58106 - DNA, 25 bp, Homo sapien
aagcggatcttctcggacgcctctg

SEQ ID NO: 58107 - DNA, 25 bp, Homo sapien
tctcccagccagacgcgggaacttg

SEQ ID NO: 58108 - DNA, 25 bp, Homo sapien
ctcatgcaacgggaccgaaccttgg

SEQ ID NO: 58109 - DNA, 25 bp, Homo sapien
ggaatgggtggtcttccgacacaca

SEQ ID NO: 58110 - DNA, 25 bp, Homo sapien
accaccatctttcttgcgctcggga

SEQ ID NO: 58111 - DNA, 25 bp, Homo sapien
cgaagcttcaaagttgcggcaaaca

SEQ ID NO: 58112 - DNA, 25 bp, Homo sapien
tcacttcatggacctccgaggcgca

SEQ ID NO: 58113 - DNA, 25 bp, Homo sapien
cagactttgctctttcctcgccgga

SEQ ID NO: 58114 - DNA, 25 bp, Homo sapien
gcctggccaaataagggtcagacta

SEQ ID NO: 58115 - DNA, 25 bp, Homo sapien
gaggagtctccaccaggactgaccg

SEQ ID NO: 58116 - DNA, 25 bp, Homo sapien
gtcgtaactcggaagccggagccca

SEQ ID NO: 58117 - DNA, 25 bp, Homo sapien
gtcagactaagcaaggcgcctccgt

SEQ ID NO: 58118 - DNA, 25 bp, Homo sapien
caggacaagttttacgcctggccaa

SEQ ID NO: 58119 - DNA, 25 bp, Homo sapien
ctcagtaggcttttaggcaggacaa

SEQ ID NO: 58120 - DNA, 25 bp, Homo sapien
tctcccgcggattagaccagttagg

SEQ ID NO: 58121 - DNA, 25 bp, Homo sapien
gagcctagtgccatgcagcagcggc

SEQ ID NO: 58122 - DNA, 25 bp, Homo sapien
cgccctgggagagtgccctactctg

SEQ ID NO: 58123 - DNA, 25 bp, Homo sapien
ctgcaagaaagagtgcgcccgcctg

SEQ ID NO: 58124 - DNA, 25 bp, Homo sapien
tggcgcggcttttcacgagctgcgc

SEQ ID NO: 58125 - DNA, 25 bp, Homo sapien
aactgactggctctcgctttggctg

SEQ ID NO: 58126 - DNA, 25 bp, Homo sapien
ccaagctcgcagagccgcgggtaag

SEQ ID NO: 58127 - DNA, 25 bp, Homo sapien
tggactctcccgcttggccgggctt

SEQ ID NO: 58128 - DNA, 25 bp, Homo sapien
tgcgaggctgccctccagatccgat

SEQ ID NO: 58129 - DNA, 25 bp, Homo sapien
accagctgcagcaagccagggacca

SEQ ID NO: 58130 - DNA, 25 bp, Homo sapien
tgcaatgtccagggccttgcgtccc

SEQ ID NO: 58131 - DNA, 25 bp, Homo sapien
tcccatatgcgcatcaggcctggca

SEQ ID NO: 58132 - DNA, 25 bp, Homo sapien
tgcgcatcaggcctggcatcttgtt

SEQ ID NO: 58133 - DNA, 25 bp, Homo sapien
tgcgtccccaggctgcgactttgta

SEQ ID NO: 58134 - DNA, 25 bp, Homo sapien
tcaggcctggcatcttgttctctgc

SEQ ID NO: 58135 - DNA, 25 bp, Homo sapien
cttggaggcggagtaccgctcccat

SEQ ID NO: 58136 - DNA, 25 bp, Homo sapien
gtaccgctcccatatgcgcatcagg

SEQ ID NO: 58137 - DNA, 25 bp, Homo sapien
tggcatcttgttctctgcaatgtcc

SEQ ID NO: 58138 - DNA, 25 bp, Homo sapien
ccacggacctcgaatgcagcaggta

SEQ ID NO: 58139 - DNA, 25 bp, Homo sapien
ttcagctcaatgagtccagccagtc

SEQ ID NO: 58140 - DNA, 25 bp, Homo sapien
agcaccctggcaatcggcaataatc

SEQ ID NO: 58141 - DNA, 25 bp, Homo sapien
catcgcccagcaggaaagccaagga

SEQ ID NO: 58142 - DNA, 25 bp, Homo sapien
gcggagctgcaaggacttaagtttc

SEQ ID NO: 58143 - DNA, 25 bp, Homo sapien
gactcaggcacttggttcagaaatc

SEQ ID NO: 58144 - DNA, 25 bp, Homo sapien
ctcattccaacatctgcagcgctta

SEQ ID NO: 58145 - DNA, 25 bp, Homo sapien
cttaacgcggagaacctggagctcg

SEQ ID NO: 58146 - DNA, 25 bp, Homo sapien
agtgggtgatgacttcgtgacctca

SEQ ID NO: 58147 - DNA, 25 bp, Homo sapien
caccgctctggacgagactgagcta

SEQ ID NO: 58148 - DNA, 25 bp, Homo sapien
tctggacgagactgagctaggcgtc

SEQ ID NO: 58149 - DNA, 25 bp, Homo sapien
gtgcgccaggccagacctgaccgag

SEQ ID NO: 58150 - DNA, 25 bp, Homo sapien
cccgtccctcgacatgttcccgcgc

SEQ ID NO: 58151 - DNA, 25 bp, Homo sapien
atgacttcgtgacctcaacgtcctc

SEQ ID NO: 58152 - DNA, 25 bp, Homo sapien
ttcccgcgcctgaaaggtgcagaaa

SEQ ID NO: 58153 - DNA, 25 bp, Homo sapien
cgcctgaaaggtgcagaaaactccc

SEQ ID NO: 58154 - DNA, 25 bp, Homo sapien
gataacgcggcgaagcttcacagtc

SEQ ID NO: 58155 - DNA, 25 bp, Homo sapien
tcccgctttgtgtttcggggccagc

SEQ ID NO: 58156 - DNA, 25 bp, Homo sapien
ttaccagggacatggcgcaggaacc

SEQ ID NO: 58157 - DNA, 25 bp, Homo sapien
cgcaggaaccgttaacatggcctta

SEQ ID NO: 58158 - DNA, 25 bp, Homo sapien
cggcgggtagaagcccttcatgatt

SEQ ID NO: 58159 - DNA, 25 bp, Homo sapien
ttgcaaggcaattacgtttggtttc

SEQ ID NO: 58160 - DNA, 25 bp, Homo sapien
cttcacagtctttgcgaggccgtca

SEQ ID NO: 58161 - DNA, 25 bp, Homo sapien
ccaagtacatcgagaggagatacgc

SEQ ID NO: 58162 - DNA, 25 bp, Homo sapien
actaggagccagaagcgaagctttc

SEQ ID NO: 58163 - DNA, 25 bp, Homo sapien
cgaagctttccgtcaggaaggcctg

SEQ ID NO: 58164 - DNA, 25 bp, Homo sapien
gtcctctcagcctgcgcgaggaaga

SEQ ID NO: 58165 - DNA, 25 bp, Homo sapien
gggccgcagaaaaccagcacgcacg

SEQ ID NO: 58166 - DNA, 25 bp, Homo sapien
gcacgcacgacatgtaggcaccaaa

SEQ ID NO: 58167 - DNA, 25 bp, Homo sapien
acgcaattcgaacacgaccagtttg

SEQ ID NO: 58168 - DNA, 25 bp, Homo sapien
cgaccagtttgcagaaggcacaaaa

SEQ ID NO: 58169 - DNA, 25 bp, Homo sapien
ggcacaaaatgccacggcgtgacgc

SEQ ID NO: 58170 - DNA, 25 bp, Homo sapien
gaatcacggttcactcggcccgagt

SEQ ID NO: 58171 - DNA, 25 bp, Homo sapien
aaacagccaacgtggtcgcgctttc

SEQ ID NO: 58172 - DNA, 25 bp, Homo sapien
tgcatcacggcctgaccacggattc

SEQ ID NO: 58173 - DNA, 25 bp, Homo sapien
cgtccgaattgctccgggatgaagt

SEQ ID NO: 58174 - DNA, 25 bp, Homo sapien
gtgtcgtctgtgaaccacgtggatg

SEQ ID NO: 58175 - DNA, 25 bp, Homo sapien
ggctcattgctctcattccttggga

SEQ ID NO: 58176 - DNA, 25 bp, Homo sapien
ggtgtggatctcgttcgttttcatg

SEQ ID NO: 58177 - DNA, 25 bp, Homo sapien
ccacgtggatggaaaacggacaatc

SEQ ID NO: 58178 - DNA, 25 bp, Homo sapien
ggttccgccggcactctcgccacca

SEQ ID NO: 58179 - DNA, 25 bp, Homo sapien
cgccaccaccgcgtgggtgagtatg

SEQ ID NO: 58180 - DNA, 25 bp, Homo sapien
gcgcagtttcctctctaagttccgc

SEQ ID NO: 58181 - DNA, 25 bp, Homo sapien
ctgtgggagtcctggtacctgccgt

SEQ ID NO: 58182 - DNA, 25 bp, Homo sapien
agtcctggtacctgccgtcctatcg

SEQ ID NO: 58183 - DNA, 25 bp, Homo sapien
ggagtcctggtacctgccgtcctat

SEQ ID NO: 58184 - DNA, 25 bp, Homo sapien
agtatgggcatggatgtgctgggct

SEQ ID NO: 58185 - DNA, 25 bp, Homo sapien
ggcgcagtttcctctctaagttccg

SEQ ID NO: 58186 - DNA, 25 bp, Homo sapien
tgaggggtaatgctctgcaagtaag

SEQ ID NO: 58187 - DNA, 25 bp, Homo sapien
ctcgccttctttctcgtgctccttc

SEQ ID NO: 58188 - DNA, 25 bp, Homo sapien
ttctttctcgtgctccttctcgctc

SEQ ID NO: 58189 - DNA, 25 bp, Homo sapien
cgagtcagagtacccctgaggggta

SEQ ID NO: 58190 - DNA, 25 bp, Homo sapien
agccatcctcgccttctttctcgtg

SEQ ID NO: 58191 - DNA, 25 bp, Homo sapien
ccctgaggggtaatgctctgcaagt

SEQ ID NO: 58192 - DNA, 25 bp, Homo sapien
tcagcagctcggtgggttccaagtg

SEQ ID NO: 58193 - DNA, 25 bp, Homo sapien
cctgaggggtaatgctctgcaagta

SEQ ID NO: 58194 - DNA, 25 bp, Homo sapien
cgggctcctccagaccatgtagaaa

SEQ ID NO: 58195 - DNA, 25 bp, Homo sapien
tctggctgtctccaaaacggaccta

SEQ ID NO: 58196 - DNA, 25 bp, Homo sapien
actcagcctggataacgggctcctc

SEQ ID NO: 58197 - DNA, 25 bp, Homo sapien
aaactgccgggaaaagtctcgctgc

SEQ ID NO: 58198 - DNA, 25 bp, Homo sapien
ttcctcctgggattggcttgtttgc

SEQ ID NO: 58199 - DNA, 25 bp, Homo sapien
ggaccgttacttggcgcaccgagaa

SEQ ID NO: 58200 - DNA, 25 bp, Homo sapien
gcgactccggcaagaaactttaagc

SEQ ID NO: 58201 - DNA, 25 bp, Homo sapien
taatatcccacctctgatctgcgtg

SEQ ID NO: 58202 - DNA, 25 bp, Homo sapien
ctgcatttgatctccaggaagggcc

SEQ ID NO: 58203 - DNA, 25 bp, Homo sapien
gtggctttcgcctcaacttggaagg

SEQ ID NO: 58204 - DNA, 25 bp, Homo sapien
tcaccagaaaacttggagtaagttg

SEQ ID NO: 58205 - DNA, 25 bp, Homo sapien
gggccctgtaggagtcaccagaaaa

SEQ ID NO: 58206 - DNA, 25 bp, Homo sapien
cacgcgactgtcaatctcactaagg

SEQ ID NO: 58207 - DNA, 25 bp, Homo sapien
tgattaccatgagaaaggctgtgcc

SEQ ID NO: 58208 - DNA, 25 bp, Homo sapien
gccagcttcggtccctgcatttgat

SEQ ID NO: 58209 - DNA, 25 bp, Homo sapien
tggaaaagcctcctccacgcgactg

SEQ ID NO: 58210 - DNA, 25 bp, Homo sapien
gcgtgctctggccaccatgaacttt

SEQ ID NO: 58211 - DNA, 25 bp, Homo sapien
gctacgtgtccgtgaacttcctgca

SEQ ID NO: 58212 - DNA, 25 bp, Homo sapien
taagtcctgtggtctcagcgcgatc

SEQ ID NO: 58213 - DNA, 25 bp, Homo sapien
agaagtttagctcgacaggtccacc

SEQ ID NO: 58214 - DNA, 25 bp, Homo sapien
cccgacgtgactgaattgatgttcc

SEQ ID NO: 58215 - DNA, 25 bp, Homo sapien
tctcctcctgtcacgaaagggtcgc

SEQ ID NO: 58216 - DNA, 25 bp, Homo sapien
tcaccatccgggtctttagggactg

SEQ ID NO: 58217 - DNA, 25 bp, Homo sapien
tctatcgctgcgcaaaagtggagtg

SEQ ID NO: 58218 - DNA, 25 bp, Homo sapien
ggagccagagcctggaccagaactt

SEQ ID NO: 58219 - DNA, 25 bp, Homo sapien
agtcagttcccagactgtccgggcg

SEQ ID NO: 58220 - DNA, 25 bp, Homo sapien
cagcctggcgttttgttccgagaga

SEQ ID NO: 58221 - DNA, 25 bp, Homo sapien
agcggagctgacagtgattttgaca

SEQ ID NO: 58222 - DNA, 25 bp, Homo sapien
tcgcggtatctctagcccaagcagg

SEQ ID NO: 58223 - DNA, 25 bp, Homo sapien
gccgccagtggtcctcggactttag

SEQ ID NO: 58224 - DNA, 25 bp, Homo sapien
tgacagtgatttaaacccgcttttg

SEQ ID NO: 58225 - DNA, 25 bp, Homo sapien
ccacagcttagggactttgaggcgc

SEQ ID NO: 58226 - DNA, 25 bp, Homo sapien
cgctacaatgtcttccgggtcgcta

SEQ ID NO: 58227 - DNA, 25 bp, Homo sapien
aatgtcttccgggtcgctagcgcct

SEQ ID NO: 58228 - DNA, 25 bp, Homo sapien
gtgttaaaagcgtagcgacttcctc

SEQ ID NO: 58229 - DNA, 25 bp, Homo sapien
cgcccaaacacgtgacctcctttcg

SEQ ID NO: 58230 - DNA, 25 bp, Homo sapien
cgctgcggaccgtacacaaccactc

SEQ ID NO: 58231 - DNA, 25 bp, Homo sapien
ctctgctagacttcacctgccgctg

SEQ ID NO: 58232 - DNA, 25 bp, Homo sapien
cgcctgcaggaatcgcttcaccgaa

SEQ ID NO: 58233 - DNA, 25 bp, Homo sapien
ggaatcgcttcaccgaatcgcctgg

SEQ ID NO: 58234 - DNA, 25 bp, Homo sapien
aacgactgcgtctccatcaaccggg

SEQ ID NO: 58235 - DNA, 25 bp, Homo sapien
aggacatgcctgatctcaacgactg

SEQ ID NO: 58236 - DNA, 25 bp, Homo sapien
agtaaactctccttccgagcgcggg

SEQ ID NO: 58237 - DNA, 25 bp, Homo sapien
gccgctgtggtaatgtccgccatgt

SEQ ID NO: 58238 - DNA, 25 bp, Homo sapien
cgccatgttgttgcgtcccagtgtt

SEQ ID NO: 58239 - DNA, 25 bp, Homo sapien
cccagtgttgtgattagctcgcagc

SEQ ID NO: 58240 - DNA, 25 bp, Homo sapien
tcttggcgtacggtctctgtttacc

SEQ ID NO: 58241 - DNA, 25 bp, Homo sapien
cggcggagtagcgtaaaccctctcg

SEQ ID NO: 58242 - DNA, 25 bp, Homo sapien
agtgtgttcgggtgaccctcaagcc

SEQ ID NO: 58243 - DNA, 25 bp, Homo sapien
tcgcgatgacctgctgagaagcgtc

SEQ ID NO: 58244 - DNA, 25 bp, Homo sapien
ttcgatttaccaaacgccttgcctc

SEQ ID NO: 58245 - DNA, 25 bp, Homo sapien
gtgtgagctctgcaacccgcaaatg

SEQ ID NO: 58246 - DNA, 25 bp, Homo sapien
gcatcaaagtgatgtgccggttccg

SEQ ID NO: 58247 - DNA, 25 bp, Homo sapien
gcggatccagccgaatgcagcatca

SEQ ID NO: 58248 - DNA, 25 bp, Homo sapien
ctctcgggtggacctgaccagagac

SEQ ID NO: 58249 - DNA, 25 bp, Homo sapien
tgcttctgggcatcaatcaattcga

SEQ ID NO: 58250 - DNA, 25 bp, Homo sapien
ttaagtacgtgcaagccatttgcgg

SEQ ID NO: 58251 - DNA, 25 bp, Homo sapien
tgagcaccgcagcaattaagtacgt

SEQ ID NO: 58252 - DNA, 25 bp, Homo sapien
ccatttgcggcagcgggtttgagat

SEQ ID NO: 58253 - DNA, 25 bp, Homo sapien
atgcgttcgtagtgggtgacattga

SEQ ID NO: 58254 - DNA, 25 bp, Homo sapien
tcgtagtgggtgacattgagaaccc

SEQ ID NO: 58255 - DNA, 25 bp, Homo sapien
tctgagaggtggcatgctgcctgcc

SEQ ID NO: 58256 - DNA, 25 bp, Homo sapien
tgcaggcggcctgtttccaatttcc

SEQ ID NO: 58257 - DNA, 25 bp, Homo sapien
ctgtttccaatttccaggcgaggag

SEQ ID NO: 58258 - DNA, 25 bp, Homo sapien
cccgcctgggatctcacagatcagg

SEQ ID NO: 58259 - DNA, 25 bp, Homo sapien
tgccaagacgcccagcgtaatggaa

SEQ ID NO: 58260 - DNA, 25 bp, Homo sapien
acgcccagcgtaatggaagccttga

SEQ ID NO: 58261 - DNA, 25 bp, Homo sapien
ccagcgtaatggaagccttgagcca

SEQ ID NO: 58262 - DNA, 25 bp, Homo sapien
tggaagccttgagccagccgagcaa

SEQ ID NO: 58263 - DNA, 25 bp, Homo sapien
gcctgggatctcacagatcaggccc

SEQ ID NO: 58264 - DNA, 25 bp, Homo sapien
gcagaagaagcctgcgccggggtaa

SEQ ID NO: 58265 - DNA, 25 bp, Homo sapien
ggctgaccctctgcacgtctctccc

SEQ ID NO: 58266 - DNA, 25 bp, Homo sapien
cgccctacttggactgaaccgagaa

SEQ ID NO: 58267 - DNA, 25 bp, Homo sapien
gtcaggcctcccaaggtcaagtctc

SEQ ID NO: 58268 - DNA, 25 bp, Homo sapien
accaggaagtccgagggccgatctc

SEQ ID NO: 58269 - DNA, 25 bp, Homo sapien
ccctgcggtcagtaagtcaggcctc

SEQ ID NO: 58270 - DNA, 25 bp, Homo sapien
tcgagtcgtcattcagcaccgtgca

SEQ ID NO: 58271 - DNA, 25 bp, Homo sapien
cccaaaaacaggatgtcgagtcgtc

SEQ ID NO: 58272 - DNA, 25 bp, Homo sapien
gaaagacaagatcagcagaggcgca

SEQ ID NO: 58273 - DNA, 25 bp, Homo sapien
ctggcgtcagcacccaagggaaaga

SEQ ID NO: 58274 - DNA, 25 bp, Homo sapien
atgcgggaccgtaagcgctaccagc

SEQ ID NO: 58275 - DNA, 25 bp, Homo sapien
aaggagaacgccatgcgggaccgta

SEQ ID NO: 58276 - DNA, 25 bp, Homo sapien
tcaaggctctggagagcgcgctgaa

SEQ ID NO: 58277 - DNA, 25 bp, Homo sapien
ctgtgaactgcccaagctggagaag

SEQ ID NO: 58278 - DNA, 25 bp, Homo sapien
cagacctgcgctgtgaactgcccaa

SEQ ID NO: 58279 - DNA, 25 bp, Homo sapien
ccagatcggtacgtgcgtgcacagt

SEQ ID NO: 58280 - DNA, 25 bp, Homo sapien
ctaccagcaggaggtggatcgtatc

SEQ ID NO: 58281 - DNA, 25 bp, Homo sapien
agggcccattcagcccagatcggta

SEQ ID NO: 58282 - DNA, 25 bp, Homo sapien
ggcctcctttcaacctcgtggtgga

SEQ ID NO: 58283 - DNA, 25 bp, Homo sapien
ttcacgcgcgaccagcttgggtgcc

SEQ ID NO: 58284 - DNA, 25 bp, Homo sapien
agcgagcgtgccagctccagtgttt

SEQ ID NO: 58285 - DNA, 25 bp, Homo sapien
ttcaaggccgatcgtggggccaaga

SEQ ID NO: 58286 - DNA, 25 bp, Homo sapien
cggtgtgggtctctaatcgtccaga

SEQ ID NO: 58287 - DNA, 25 bp, Homo sapien
agctgccaacatctggacgggacgg

SEQ ID NO: 58288 - DNA, 25 bp, Homo sapien
aggcgagcagctgccaacatctgga

SEQ ID NO: 58289 - DNA, 25 bp, Homo sapien
tctggtcgctgcctcgaggcgagca

SEQ ID NO: 58290 - DNA, 25 bp, Homo sapien
tcccggcagagcttctctttggagg

SEQ ID NO: 58291 - DNA, 25 bp, Homo sapien
taggctgcttgaagtgtcggaagct

SEQ ID NO: 58292 - DNA, 25 bp, Homo sapien
ctgagcgcccttgggtgctcctggc

SEQ ID NO: 58293 - DNA, 25 bp, Homo sapien
tcctggcgagtgcacgagtgactgt

SEQ ID NO: 58294 - DNA, 25 bp, Homo sapien
ccggcagagcttctctttggaggca

SEQ ID NO: 58295 - DNA, 25 bp, Homo sapien
agagcttctctttggaggcactgcc

SEQ ID NO: 58296 - DNA, 25 bp, Homo sapien
cttctctttggaggcactgccgtcc

SEQ ID NO: 58297 - DNA, 25 bp, Homo sapien
ccttgggtgctcctggcgagtgcac

SEQ ID NO: 58298 - DNA, 25 bp, Homo sapien
tgctcgcttccaacgctcactggga

SEQ ID NO: 58299 - DNA, 25 bp, Homo sapien
ttactgcaaacgtcaagtggtctcc

SEQ ID NO: 58300 - DNA, 25 bp, Homo sapien
cctgggttcggagcttcacttgctc

SEQ ID NO: 58301 - DNA, 25 bp, Homo sapien
gagatttggccagggtcatttcaca

SEQ ID NO: 58302 - DNA, 25 bp, Homo sapien
gtcatttcacactgccgggcctgca

SEQ ID NO: 58303 - DNA, 25 bp, Homo sapien
gagtccctggaactacccgatgcta

SEQ ID NO: 58304 - DNA, 25 bp, Homo sapien
tcccgggagagcacaaaagaacagg

SEQ ID NO: 58305 - DNA, 25 bp, Homo sapien
ggtatcggtgcaccctgagcaaaca

SEQ ID NO: 58306 - DNA, 25 bp, Homo sapien
tgggaaagcaataacccggccttga

SEQ ID NO: 58307 - DNA, 25 bp, Homo sapien
cccgccaaccagcaggttagatcta

SEQ ID NO: 58308 - DNA, 25 bp, Homo sapien
ttctttccctcaacagcggcaattg

SEQ ID NO: 58309 - DNA, 25 bp, Homo sapien
gccttgaacctcagacccatgaata

SEQ ID NO: 58310 - DNA, 25 bp, Homo sapien
tgtcccagcccaagacctcagatgg

SEQ ID NO: 58311 - DNA, 25 bp, Homo sapien
caaactcgctagacaccgctggtta

SEQ ID NO: 58312 - DNA, 25 bp, Homo sapien
gtgggtcctgcttttccatagccga

SEQ ID NO: 58313 - DNA, 25 bp, Homo sapien
ccgcggcgccaataattcaagtaga

SEQ ID NO: 58314 - DNA, 25 bp, Homo sapien
ctcggactcaggagtgctgttgcca

SEQ ID NO: 58315 - DNA, 25 bp, Homo sapien
ctggagcgggcctatactgcaccgc

SEQ ID NO: 58316 - DNA, 25 bp, Homo sapien
ttctgcgacctcgtggcctctgagt

SEQ ID NO: 58317 - DNA, 25 bp, Homo sapien
ctcccttggaggctacgaagaaaag

SEQ ID NO: 58318 - DNA, 25 bp, Homo sapien
cgagcaggcaggttttggtttcgtt

SEQ ID NO: 58319 - DNA, 25 bp, Homo sapien
cagcgaggctgacctgagtttgccc

SEQ ID NO: 58320 - DNA, 25 bp, Homo sapien
cgtgaatttcaggagcgcgcaatgc

SEQ ID NO: 58321 - DNA, 25 bp, Homo sapien
tactgcaccgccgtacgtgaatttc

SEQ ID NO: 58322 - DNA, 25 bp, Homo sapien
tgcctcctgcagaagcgccgcggga

SEQ ID NO: 58323 - DNA, 25 bp, Homo sapien
cagagactgcacagcgggcccagga

SEQ ID NO: 58324 - DNA, 25 bp, Homo sapien
agcagggtctcaactccggcgctgt

SEQ ID NO: 58325 - DNA, 25 bp, Homo sapien
tgtcccacttccgtcggcgctgagg

SEQ ID NO: 58326 - DNA, 25 bp, Homo sapien
ccttcccggaaaacagcagcgcctg

SEQ ID NO: 58327 - DNA, 25 bp, Homo sapien
ttctcgaaactgtcgctgcctcctg

SEQ ID NO: 58328 - DNA, 25 bp, Homo sapien
gccctcgcaggaacagctgggttcc

SEQ ID NO: 58329 - DNA, 25 bp, Homo sapien
cccgggttctcgaaactgtcgctgc

SEQ ID NO: 58330 - DNA, 25 bp, Homo sapien
ggggctgtttccatcggtcactgga

SEQ ID NO: 58331 - DNA, 25 bp, Homo sapien
cgctgactgttggattggctcgaac

SEQ ID NO: 58332 - DNA, 25 bp, Homo sapien
atgtattctaggtgacgttcccggg

SEQ ID NO: 58333 - DNA, 25 bp, Homo sapien
tagcaaatgtgaggacgcccgagtc

SEQ ID NO: 58334 - DNA, 25 bp, Homo sapien
actgacgcttacctgactctgacca

SEQ ID NO: 58335 - DNA, 25 bp, Homo sapien
gaagacccttctgcctcccatggag

SEQ ID NO: 58336 - DNA, 25 bp, Homo sapien
gatctcctccctctgttgaaagctg

SEQ ID NO: 58337 - DNA, 25 bp, Homo sapien
cctgtcctgatcttcctaggtggga

SEQ ID NO: 58338 - DNA, 25 bp, Homo sapien
agctcctcaccctggtgattgaaca

SEQ ID NO: 58339 - DNA, 25 bp, Homo sapien
cgagccgcccacattccgaagtatt

SEQ ID NO: 58340 - DNA, 25 bp, Homo sapien
ggaccgagctcctcaccctggtgat

SEQ ID NO: 58341 - DNA, 25 bp, Homo sapien
tgcataaccaagactgcggaaggcg

SEQ ID NO: 58342 - DNA, 25 bp, Homo sapien
attctagtgaagagaattcccattc

SEQ ID NO: 58343 - DNA, 25 bp, Homo sapien
gaagagaattcccattctcgggcag

SEQ ID NO: 58344 - DNA, 25 bp, Homo sapien
tcgcttatttgcataaccaagactg

SEQ ID NO: 58345 - DNA, 25 bp, Homo sapien
ccacattccgaagtattcggagacc

SEQ ID NO: 58346 - DNA, 25 bp, Homo sapien
agtggtgctgccatcggatcttttc

SEQ ID NO: 58347 - DNA, 25 bp, Homo sapien
cgcacttcggagagcgcggcacctt

SEQ ID NO: 58348 - DNA, 25 bp, Homo sapien
aggacatcgttcagagccgccgcat

SEQ ID NO: 58349 - DNA, 25 bp, Homo sapien
tccattaacaaagactctcagggtg

SEQ ID NO: 58350 - DNA, 25 bp, Homo sapien
ctgcaagcctcgactgctgaaaaga

SEQ ID NO: 58351 - DNA, 25 bp, Homo sapien
gatcttttcaacctgctcctccggg

SEQ ID NO: 58352 - DNA, 25 bp, Homo sapien
tacctgtctgaggatgaagctggtc

SEQ ID NO: 58353 - DNA, 25 bp, Homo sapien
ggccacctggactcgacacacgggg

SEQ ID NO: 58354 - DNA, 25 bp, Homo sapien
gggcctctgtttagacagctctaga

SEQ ID NO: 58355 - DNA, 25 bp, Homo sapien
acttggagcacttgacctttggctg

SEQ ID NO: 58356 - DNA, 25 bp, Homo sapien
acccactgttggacctgaggagcca

SEQ ID NO: 58357 - DNA, 25 bp, Homo sapien
aagtctccggaagcggcacgagctc

SEQ ID NO: 58358 - DNA, 25 bp, Homo sapien
ccttccgcaggggtgtagtaatctg

SEQ ID NO: 58359 - DNA, 25 bp, Homo sapien
ttcaccggttattccgggatccagc

SEQ ID NO: 58360 - DNA, 25 bp, Homo sapien
cgggatcctggcaaagactagcgcg

SEQ ID NO: 58361 - DNA, 25 bp, Homo sapien
aagctgggacttgatcctttgcgcg

SEQ ID NO: 58362 - DNA, 25 bp, Homo sapien
ttcctgctgaggagagcgaccagct

SEQ ID NO: 58363 - DNA, 25 bp, Homo sapien
cacactttcgggatgtctgcgattc

SEQ ID NO: 58364 - DNA, 25 bp, Homo sapien
cgatctgcgtggttccaagctcctc

SEQ ID NO: 58365 - DNA, 25 bp, Homo sapien
ttcatcagtttcaggggagggtatg

SEQ ID NO: 58366 - DNA, 25 bp, Homo sapien
taccggtggctgtgcttccaattta

SEQ ID NO: 58367 - DNA, 25 bp, Homo sapien
cctgctatagagtgaacgggatttt

SEQ ID NO: 58368 - DNA, 25 bp, Homo sapien
ccggagtgacggaagttgtgctctt

SEQ ID NO: 58369 - DNA, 25 bp, Homo sapien
tgctcttggtgaatggggttcttcc

SEQ ID NO: 58370 - DNA, 25 bp, Homo sapien
ttattgtgttgcaccctcccaggcg

SEQ ID NO: 58371 - DNA, 25 bp, Homo sapien
gtcgctgctgtctagctgacactca

SEQ ID NO: 58372 - DNA, 25 bp, Homo sapien
gcccactttctagccggacaaacag

SEQ ID NO: 58373 - DNA, 25 bp, Homo sapien
gggccaagttcttgtcacgaattta

SEQ ID NO: 58374 - DNA, 25 bp, Homo sapien
cgcgtacgcgttacagtcctgtttc

SEQ ID NO: 58375 - DNA, 25 bp, Homo sapien
tttccctagaaacggagctgccggc

SEQ ID NO: 58376 - DNA, 25 bp, Homo sapien
tcccagacttttgtaggggtcaggc

SEQ ID NO: 58377 - DNA, 25 bp, Homo sapien
tgagattctgcgaaagacctgactg

SEQ ID NO: 58378 - DNA, 25 bp, Homo sapien
tgccagcggagcaccatgcacatag

SEQ ID NO: 58379 - DNA, 25 bp, Homo sapien
cagaccgatttcagggcgcacaacg

SEQ ID NO: 58380 - DNA, 25 bp, Homo sapien
aacccattgtctggctggagaggca

SEQ ID NO: 58381 - DNA, 25 bp, Homo sapien
tttgccatcgtgctggtaagtgcgc

SEQ ID NO: 58382 - DNA, 25 bp, Homo sapien
cacaacgtgcctttgaagctgccga

SEQ ID NO: 58383 - DNA, 25 bp, Homo sapien
cagggagcatggattcgcagcagac

SEQ ID NO: 58384 - DNA, 25 bp, Homo sapien
gttctgatttccgacgcgcacgcta

SEQ ID NO: 58385 - DNA, 25 bp, Homo sapien
tgaactggaggagcgatttgccatc

SEQ ID NO: 58386 - DNA, 25 bp, Homo sapien
gttcgatctccgtacgcaccaggtg

SEQ ID NO: 58387 - DNA, 25 bp, Homo sapien
tttcgttgtgtttcgcgccatgtcg

SEQ ID NO: 58388 - DNA, 25 bp, Homo sapien
tcgagctctggtcgaagcgcattcc

SEQ ID NO: 58389 - DNA, 25 bp, Homo sapien
agggagtggatactcgacagccttc

SEQ ID NO: 58390 - DNA, 25 bp, Homo sapien
cccggcgtcgaaaagatgaggcttt

SEQ ID NO: 58391 - DNA, 25 bp, Homo sapien
gggaagacaacagtgtcccagcttc

SEQ ID NO: 58392 - DNA, 25 bp, Homo sapien
cgccaggtagagaggtgcccttaat

SEQ ID NO: 58393 - DNA, 25 bp, Homo sapien
tgagcagttaaggaaccgcgagagc

SEQ ID NO: 58394 - DNA, 25 bp, Homo sapien
cgactgccaggcatgaggactttca

SEQ ID NO: 58395 - DNA, 25 bp, Homo sapien
ggctcctcgctctgctttcgaaagt

SEQ ID NO: 58396 - DNA, 25 bp, Homo sapien
ttatgtacaggctacgctcgtccgg

SEQ ID NO: 58397 - DNA, 25 bp, Homo sapien
accacggtgagtgagagcacgcaca

SEQ ID NO: 58398 - DNA, 25 bp, Homo sapien
tccgacaggtttgcttcgcccagtc

SEQ ID NO: 58399 - DNA, 25 bp, Homo sapien
ctccggtccttcacgaggaagttga

SEQ ID NO: 58400 - DNA, 25 bp, Homo sapien
ccagtctctgatagtgaggggcaca

SEQ ID NO: 58401 - DNA, 25 bp, Homo sapien
cgcgcagcagctaggctcttctaaa

SEQ ID NO: 58402 - DNA, 25 bp, Homo sapien
tgcctgccaagtatcgcgggacttg

SEQ ID NO: 58403 - DNA, 25 bp, Homo sapien
gagggcgccgaagcgtcaagtaccc

SEQ ID NO: 58404 - DNA, 25 bp, Homo sapien
tctctcggctggagagccgacggca

SEQ ID NO: 58405 - DNA, 25 bp, Homo sapien
ccgagggcagtctctgatcctccag

SEQ ID NO: 58406 - DNA, 25 bp, Homo sapien
ctccctggtgcattgggcgaacgcg

SEQ ID NO: 58407 - DNA, 25 bp, Homo sapien
gcgggacttgcgcacatcgcagaag

SEQ ID NO: 58408 - DNA, 25 bp, Homo sapien
acttgcgcacatcgcagaagcgcca

SEQ ID NO: 58409 - DNA, 25 bp, Homo sapien
cctctaagaggctccctggtgcatt

SEQ ID NO: 58410 - DNA, 25 bp, Homo sapien
ccgttccctcttcgcgggatcgttg

SEQ ID NO: 58411 - DNA, 25 bp, Homo sapien
ccctcttcgcgggatcgttggccag

SEQ ID NO: 58412 - DNA, 25 bp, Homo sapien
atcgttggccaggatagcaggtctc

SEQ ID NO: 58413 - DNA, 25 bp, Homo sapien
aggatagcaggtctccgtctctttc

SEQ ID NO: 58414 - DNA, 25 bp, Homo sapien
ttcctcttgattgtctgggacgagc

SEQ ID NO: 58415 - DNA, 25 bp, Homo sapien
ctgcttttctggctaccccggtgag

SEQ ID NO: 58416 - DNA, 25 bp, Homo sapien
ccgcgtggcgcggaactttctgccg

SEQ ID NO: 58417 - DNA, 25 bp, Homo sapien
ttgattgtctgggacgagctccctc

SEQ ID NO: 58418 - DNA, 25 bp, Homo sapien
tctggacagcgaaagctgcgcaagc

SEQ ID NO: 58419 - DNA, 25 bp, Homo sapien
tggacagcgaaagctgcgcaagccc

SEQ ID NO: 58420 - DNA, 25 bp, Homo sapien
actctggacagcgaaagctgcgcaa

SEQ ID NO: 58421 - DNA, 25 bp, Homo sapien
ctactctggacagcgaaagctgcgc

SEQ ID NO: 58422 - DNA, 25 bp, Homo sapien
tgctactctggacagcgaaagctgc

SEQ ID NO: 58423 - DNA, 25 bp, Homo sapien
ctgctactctggacagcgaaagctg

SEQ ID NO: 58424 - DNA, 25 bp, Homo sapien
ctgcgaacctgagcgcactgaggct

SEQ ID NO: 58425 - DNA, 25 bp, Homo sapien
gctgcgaacctgagcgcactgaggc

SEQ ID NO: 58426 - DNA, 25 bp, Homo sapien
agacagcctgcccttgtccaggctg

SEQ ID NO: 58427 - DNA, 25 bp, Homo sapien
cgcgatcccgaagcgccttggttag

SEQ ID NO: 58428 - DNA, 25 bp, Homo sapien
cagagattttcctgcggggtcagtg

SEQ ID NO: 58429 - DNA, 25 bp, Homo sapien
ggtatctccaggtgcagagattttc

SEQ ID NO: 58430 - DNA, 25 bp, Homo sapien
cgcatctaatgggtatctccaggtg

SEQ ID NO: 58431 - DNA, 25 bp, Homo sapien
caagccctggcgcatctaatgggta

SEQ ID NO: 58432 - DNA, 25 bp, Homo sapien
cgccttggttaggggagcaagccct

SEQ ID NO: 58433 - DNA, 25 bp, Homo sapien
tccaggctgtcgtggacctgaagga

SEQ ID NO: 58434 - DNA, 25 bp, Homo sapien
ccaggcaggtaaaggcagcttctta

SEQ ID NO: 58435 - DNA, 25 bp, Homo sapien
tgcaatgtacagcacggcaacctgg

SEQ ID NO: 58436 - DNA, 25 bp, Homo sapien
tcaggtagtgaccacatcgtccagc

SEQ ID NO: 58437 - DNA, 25 bp, Homo sapien
tggacctcaagtggcgctggaacct

SEQ ID NO: 58438 - DNA, 25 bp, Homo sapien
cgtattatgtctgcactccgaagga

SEQ ID NO: 58439 - DNA, 25 bp, Homo sapien
tcaccttggaaagaaggcctccgtc

SEQ ID NO: 58440 - DNA, 25 bp, Homo sapien
caaaattgcgcttgggttcctgttc

SEQ ID NO: 58441 - DNA, 25 bp, Homo sapien
tgggactcgcttgtcaactcattaa

SEQ ID NO: 58442 - DNA, 25 bp, Homo sapien
gcccgcagtcagcatcttgtagaga

SEQ ID NO: 58443 - DNA, 25 bp, Homo sapien
cgcacttcgcggctagggaacaaaa

SEQ ID NO: 58444 - DNA, 25 bp, Homo sapien
tacgcggcaagaaccctgctttctg

SEQ ID NO: 58445 - DNA, 25 bp, Homo sapien
tgtgtctccattttcgccgcagggc

SEQ ID NO: 58446 - DNA, 25 bp, Homo sapien
gctctctccgcaaagtctacgactg

SEQ ID NO: 58447 - DNA, 25 bp, Homo sapien
gggcgggaacgcacaatctatcttc

SEQ ID NO: 58448 - DNA, 25 bp, Homo sapien
ctagggctcattacatgcgttgcga

SEQ ID NO: 58449 - DNA, 25 bp, Homo sapien
cagccctgatctggccacttgacta

SEQ ID NO: 58450 - DNA, 25 bp, Homo sapien
cggcttgcccacacaaaacatggta

SEQ ID NO: 58451 - DNA, 25 bp, Homo sapien
gtccagtcttggatccttcagagcc

SEQ ID NO: 58452 - DNA, 25 bp, Homo sapien
gccgcagcgtcgagtaacgtcattc

SEQ ID NO: 58453 - DNA, 25 bp, Homo sapien
cacgtcgcctgtcagtctgtgaagc

SEQ ID NO: 58454 - DNA, 25 bp, Homo sapien
gattgttgcgcctctgctctgaaga

SEQ ID NO: 58455 - DNA, 25 bp, Homo sapien
cgccgggcatgtccatatccaatgg

SEQ ID NO: 58456 - DNA, 25 bp, Homo sapien
ccactagctgcgatgcatgtgatca

SEQ ID NO: 58457 - DNA, 25 bp, Homo sapien
catggtagcaggagagcagcatttc

SEQ ID NO: 58458 - DNA, 25 bp, Homo sapien
ttcgagggcaaacgacctctccggc

SEQ ID NO: 58459 - DNA, 25 bp, Homo sapien
gacgagggcactgatcagactcacc

SEQ ID NO: 58460 - DNA, 25 bp, Homo sapien
gctcttcggtttcgagggcaaacga

SEQ ID NO: 58461 - DNA, 25 bp, Homo sapien
aagagccctgttagcgccgcttttc

SEQ ID NO: 58462 - DNA, 25 bp, Homo sapien
gaaccactgcaaaggaagagccctg

SEQ ID NO: 58463 - DNA, 25 bp, Homo sapien
ttaaactgtctgtgcgaaccactgc

SEQ ID NO: 58464 - DNA, 25 bp, Homo sapien
cctctccggccttttaaactgtctg

SEQ ID NO: 58465 - DNA, 25 bp, Homo sapien
ttggagtcgacatgggccctgacga

SEQ ID NO: 58466 - DNA, 25 bp, Homo sapien
gcttgttgctcttcggggactccat

SEQ ID NO: 58467 - DNA, 25 bp, Homo sapien
accaaagtgactgcgtgggtgccca

SEQ ID NO: 58468 - DNA, 25 bp, Homo sapien
cgaccttcgcgcgtcaccaaagtga

SEQ ID NO: 58469 - DNA, 25 bp, Homo sapien
gactccaaggggcaacgaccttcgc

SEQ ID NO: 58470 - DNA, 25 bp, Homo sapien
ggccgagcttcttgcaaacggactc

SEQ ID NO: 58471 - DNA, 25 bp, Homo sapien
ttcttccgggaaccacgcagcggga

SEQ ID NO: 58472 - DNA, 25 bp, Homo sapien
cctcgtgggtgttacaggccctcca

SEQ ID NO: 58473 - DNA, 25 bp, Homo sapien
tggccacgcccgtggagacaccgga

SEQ ID NO: 58474 - DNA, 25 bp, Homo sapien
tggcgttttcctctgctcgatcatg

SEQ ID NO: 58475 - DNA, 25 bp, Homo sapien
cccgccattgctcaccttaaagaag

SEQ ID NO: 58476 - DNA, 25 bp, Homo sapien
tttgcagccctcacaggtgcgcacg

SEQ ID NO: 58477 - DNA, 25 bp, Homo sapien
gcacctgcgtgtcgagcagctgaga

SEQ ID NO: 58478 - DNA, 25 bp, Homo sapien
agagatcccgggtcgtcccacatgg

SEQ ID NO: 58479 - DNA, 25 bp, Homo sapien
atctggcaactagacaccggggtgc

SEQ ID NO: 58480 - DNA, 25 bp, Homo sapien
cgatcatgtgcgtagtggccacgta

SEQ ID NO: 58481 - DNA, 25 bp, Homo sapien
cccgtcgaagcgcatctggcaacta

SEQ ID NO: 58482 - DNA, 25 bp, Homo sapien
ccgcaaagcgtaaggtgtgagccta

SEQ ID NO: 58483 - DNA, 25 bp, Homo sapien
cgcttttctactcgcgcagagcgtc

SEQ ID NO: 58484 - DNA, 25 bp, Homo sapien
cgccttctgcagaaaggtactctga

SEQ ID NO: 58485 - DNA, 25 bp, Homo sapien
cagccgggacccttttgcaacttgc

SEQ ID NO: 58486 - DNA, 25 bp, Homo sapien
cccaaaagtcagagtgaagcgtcgc

SEQ ID NO: 58487 - DNA, 25 bp, Homo sapien
gaccgtgacccagctctttagaaac

SEQ ID NO: 58488 - DNA, 25 bp, Homo sapien
tgcagtgcccacgttcgatggagga

SEQ ID NO: 58489 - DNA, 25 bp, Homo sapien
cacgcagttcgggtgggatttccct

SEQ ID NO: 58490 - DNA, 25 bp, Homo sapien
ctattatctcggcttctcgggagga

SEQ ID NO: 58491 - DNA, 25 bp, Homo sapien
tagtcagtcacgcagaagtttctct

SEQ ID NO: 58492 - DNA, 25 bp, Homo sapien
tcttcgcgctacacacccagattgg

SEQ ID NO: 58493 - DNA, 25 bp, Homo sapien
ccgactctaggtccaggatacgtta

SEQ ID NO: 58494 - DNA, 25 bp, Homo sapien
gggaggagcctcatctagtcagtca

SEQ ID NO: 58495 - DNA, 25 bp, Homo sapien
gcgcagcccgcgctataaataacct

SEQ ID NO: 58496 - DNA, 25 bp, Homo sapien
ggcagctgcacacagaagcccattg

SEQ ID NO: 58497 - DNA, 25 bp, Homo sapien
ctgggacaaggggaacttactgata

SEQ ID NO: 58498 - DNA, 25 bp, Homo sapien
agtgctctggagtgaggcttcattg

SEQ ID NO: 58499 - DNA, 25 bp, Homo sapien
gctgcctgcgcaataagcctgggga

SEQ ID NO: 58500 - DNA, 25 bp, Homo sapien
tgccagctccggcaggcattgggca

SEQ ID NO: 58501 - DNA, 25 bp, Homo sapien
tcccgacgtccagcagaagtgctct

SEQ ID NO: 58502 - DNA, 25 bp, Homo sapien
ttctacccggcagcaaagccagagg

SEQ ID NO: 58503 - DNA, 25 bp, Homo sapien
gaggcttcattggtcccaggtgagc

SEQ ID NO: 58504 - DNA, 25 bp, Homo sapien
ccaggtgagcgtttcgttgccagct

SEQ ID NO: 58505 - DNA, 25 bp, Homo sapien
gcagggcaccggatccctccaggat

SEQ ID NO: 58506 - DNA, 25 bp, Homo sapien
ctggcctagctcaggctttccagtc

SEQ ID NO: 58507 - DNA, 25 bp, Homo sapien
cgtctagtcacgttcattgggccac

SEQ ID NO: 58508 - DNA, 25 bp, Homo sapien
gggtccctgcgctgacattcaggcg

SEQ ID NO: 58509 - DNA, 25 bp, Homo sapien
cctcctggacacgtctgtaggccta

SEQ ID NO: 58510 - DNA, 25 bp, Homo sapien
tacagagtaggagaagccagatccc

SEQ ID NO: 58511 - DNA, 25 bp, Homo sapien
cgagaagtcgtcaggtaagccagcc

SEQ ID NO: 58512 - DNA, 25 bp, Homo sapien
tccggcatcgccgaggcacaaagca

SEQ ID NO: 58513 - DNA, 25 bp, Homo sapien
atcccagggcggacaacgagaagtc

SEQ ID NO: 58514 - DNA, 25 bp, Homo sapien
cagctttccgctggaccttggcgca

SEQ ID NO: 58515 - DNA, 25 bp, Homo sapien
cccttgcctggacttgcaggttgga

SEQ ID NO: 58516 - DNA, 25 bp, Homo sapien
ttgcctggacttgcaggttggagct

SEQ ID NO: 58517 - DNA, 25 bp, Homo sapien
cccttcgcctgatgaatttgcgaag

SEQ ID NO: 58518 - DNA, 25 bp, Homo sapien
atttgcgaagggacaccctgcggtc

SEQ ID NO: 58519 - DNA, 25 bp, Homo sapien
ccgctggaccttggcgcagtgaatt

SEQ ID NO: 58520 - DNA, 25 bp, Homo sapien
ccaggagacgttctccgacggcttc

SEQ ID NO: 58521 - DNA, 25 bp, Homo sapien
gatgaatttgcgaagggacaccctg

SEQ ID NO: 58522 - DNA, 25 bp, Homo sapien
cccggcagtgagatcgcccagagct

SEQ ID NO: 58523 - DNA, 25 bp, Homo sapien
cgaaggtcagtttgctcggagcacc

SEQ ID NO: 58524 - DNA, 25 bp, Homo sapien
cgtcgggagagaaaccagcaccgta

SEQ ID NO: 58525 - DNA, 25 bp, Homo sapien
cagcaccgtacctggcgagagctcg

SEQ ID NO: 58526 - DNA, 25 bp, Homo sapien
aggtgatccgctctataacctcccg

SEQ ID NO: 58527 - DNA, 25 bp, Homo sapien
ggaaacttcaactacgcggcgattg

SEQ ID NO: 58528 - DNA, 25 bp, Homo sapien
cgcggcaccgacacccttttgaagt

SEQ ID NO: 58529 - DNA, 25 bp, Homo sapien
agcctccgggactagatactcagga

SEQ ID NO: 58530 - DNA, 25 bp, Homo sapien
gcgctgaacagcatcggtctctatg

SEQ ID NO: 58531 - DNA, 25 bp, Homo sapien
tctccttcccgccaatggggtggcg

SEQ ID NO: 58532 - DNA, 25 bp, Homo sapien
cccattggcctgttcaatatgaggg

SEQ ID NO: 58533 - DNA, 25 bp, Homo sapien
gctcccattggcctgttcaatatga

SEQ ID NO: 58534 - DNA, 25 bp, Homo sapien
gacctgaaaccgcagctcccattgg

SEQ ID NO: 58535 - DNA, 25 bp, Homo sapien
atcggtctctatggcgacctgaaac

SEQ ID NO: 58536 - DNA, 25 bp, Homo sapien
ctctcgcgctgaacagcatcggtct

SEQ ID NO: 58537 - DNA, 25 bp, Homo sapien
cgcgcccgagacctgagacaccttc

SEQ ID NO: 58538 - DNA, 25 bp, Homo sapien
gtctgaccgatgtccttggccttgc

SEQ ID NO: 58539 - DNA, 25 bp, Homo sapien
accaggtactcgacgcagttgctga

SEQ ID NO: 58540 - DNA, 25 bp, Homo sapien
ggcactcacgggaccaggtactcga

SEQ ID NO: 58541 - DNA, 25 bp, Homo sapien
gttcagaaggtagttgcgccgccag

SEQ ID NO: 58542 - DNA, 25 bp, Homo sapien
catctccatgaactcgtcgaacagg

SEQ ID NO: 58543 - DNA, 25 bp, Homo sapien
ggcggatctccacgaggttgctgaa

SEQ ID NO: 58544 - DNA, 25 bp, Homo sapien
ctgcggcctgagatccgagagatta

SEQ ID NO: 58545 - DNA, 25 bp, Homo sapien
tgaagccgtactggatcactgcgcg

SEQ ID NO: 58546 - DNA, 25 bp, Homo sapien
gggctgttcggattcagagctccca

SEQ ID NO: 58547 - DNA, 25 bp, Homo sapien
ctctgcccacgctgggctgttcgga

SEQ ID NO: 58548 - DNA, 25 bp, Homo sapien
gaagtcctgtactccttgccggtcc

SEQ ID NO: 58549 - DNA, 25 bp, Homo sapien
tccctgccaggagttgaagcggagc

SEQ ID NO: 58550 - DNA, 25 bp, Homo sapien
tgcgtgttggctgagtgcgacacac

SEQ ID NO: 58551 - DNA, 25 bp, Homo sapien
ctggcgacagattgtgcaggaatgc

SEQ ID NO: 58552 - DNA, 25 bp, Homo sapien
ggcgcacaagtttcaccctccattt

SEQ ID NO: 58553 - DNA, 25 bp, Homo sapien
ctccatttgcttttcccggcgattc

SEQ ID NO: 58554 - DNA, 25 bp, Homo sapien
gagctggaaactttcccggcaggta

SEQ ID NO: 58555 - DNA, 25 bp, Homo sapien
ttaagccggaggcatggtattgccc

SEQ ID NO: 58556 - DNA, 25 bp, Homo sapien
agttgccgagagaacttaagccgga

SEQ ID NO: 58557 - DNA, 25 bp, Homo sapien
cccagtctgggctgaaagtctattg

SEQ ID NO: 58558 - DNA, 25 bp, Homo sapien
ttgcttccaagaacactgcgattag

SEQ ID NO: 58559 - DNA, 25 bp, Homo sapien
gcatatccacactcctttattgggg

SEQ ID NO: 58560 - DNA, 25 bp, Homo sapien
gggacgatatcagggcactggcttc

SEQ ID NO: 58561 - DNA, 25 bp, Homo sapien
tccgggaataggcacagacatgttg

SEQ ID NO: 58562 - DNA, 25 bp, Homo sapien
tgaatcgagccacagagtgccctgg

SEQ ID NO: 58563 - DNA, 25 bp, Homo sapien
tttcggaaaactgctcacatcgggg

SEQ ID NO: 58564 - DNA, 25 bp, Homo sapien
gcgccgcctactgggaagattctac

SEQ ID NO: 58565 - DNA, 25 bp, Homo sapien
tggcgttaccaaaggccggctcagc

SEQ ID NO: 58566 - DNA, 25 bp, Homo sapien
ccctgggtctttaccgagtctctgg

SEQ ID NO: 58567 - DNA, 25 bp, Homo sapien
cagctcaggcatttggttcagggtc

SEQ ID NO: 58568 - DNA, 25 bp, Homo sapien
tcctttgtcttgatgcccacgtctg

SEQ ID NO: 58569 - DNA, 25 bp, Homo sapien
cgccttcctggacgcagacgtatga

SEQ ID NO: 58570 - DNA, 25 bp, Homo sapien
cggctgtcacgcgaacagtaaattc

SEQ ID NO: 58571 - DNA, 25 bp, Homo sapien
gagctcacccgcaaggggcttcctt

SEQ ID NO: 58572 - DNA, 25 bp, Homo sapien
cacaccaggtcagttggccagcgta

SEQ ID NO: 58573 - DNA, 25 bp, Homo sapien
tggctcctagggtcaaggcgatttc

SEQ ID NO: 58574 - DNA, 25 bp, Homo sapien
agtgatcgcctgaaacgtcgtttta

SEQ ID NO: 58575 - DNA, 25 bp, Homo sapien
gtgtccagcgctcccaaaataaagt

SEQ ID NO: 58576 - DNA, 25 bp, Homo sapien
tggaaagggacttccgtcgcaaatc

SEQ ID NO: 58577 - DNA, 25 bp, Homo sapien
ctgtttttgctaaagctgcggtcgc

SEQ ID NO: 58578 - DNA, 25 bp, Homo sapien
aagtttacgttctcctgaggccgca

SEQ ID NO: 58579 - DNA, 25 bp, Homo sapien
ctgctgtttccaccggctttgtaac

SEQ ID NO: 58580 - DNA, 25 bp, Homo sapien
gcaccgaccggcgaggataaacagc

SEQ ID NO: 58581 - DNA, 25 bp, Homo sapien
gaacggccatcgcaacgctgacaga

SEQ ID NO: 58582 - DNA, 25 bp, Homo sapien
gtcccgcaccggcttctaggaataa

SEQ ID NO: 58583 - DNA, 25 bp, Homo sapien
agcaaaactgttggcggcgacctga

SEQ ID NO: 58584 - DNA, 25 bp, Homo sapien
cagctcgtcagtccgacagggaaga

SEQ ID NO: 58585 - DNA, 25 bp, Homo sapien
ttgcccgagcgcagtttctccgctg

SEQ ID NO: 58586 - DNA, 25 bp, Homo sapien
cttagattcggccaagattgtctta

SEQ ID NO: 58587 - DNA, 25 bp, Homo sapien
agctagttcttctccgtcttgggcg

SEQ ID NO: 58588 - DNA, 25 bp, Homo sapien
cccggcctcgagtcgaagtgacttc

SEQ ID NO: 58589 - DNA, 25 bp, Homo sapien
gcatttcctcagtcacgggcctaga

SEQ ID NO: 58590 - DNA, 25 bp, Homo sapien
ttgtgcttcgctgccgactgcattt

SEQ ID NO: 58591 - DNA, 25 bp, Homo sapien
gggaagaagcctgagccctcctttg

SEQ ID NO: 58592 - DNA, 25 bp, Homo sapien
cactctcgcgagaagccaggaagtc

SEQ ID NO: 58593 - DNA, 25 bp, Homo sapien
ggcagctcttcaacggttcccgcag

SEQ ID NO: 58594 - DNA, 25 bp, Homo sapien
cagagccctcccttattctcggcca

SEQ ID NO: 58595 - DNA, 25 bp, Homo sapien
tcatttcagcccgaaattgccctga

SEQ ID NO: 58596 - DNA, 25 bp, Homo sapien
tctccggccaactggcctaatttgg

SEQ ID NO: 58597 - DNA, 25 bp, Homo sapien
aattgccctgaaacggcgcccgtcg

SEQ ID NO: 58598 - DNA, 25 bp, Homo sapien
tcagcccgaaattgccctgaaacgg

SEQ ID NO: 58599 - DNA, 25 bp, Homo sapien
gcaggggaaatcgccaccaacgtcc

SEQ ID NO: 58600 - DNA, 25 bp, Homo sapien
agaggtgacccggagccaggaccca

SEQ ID NO: 58601 - DNA, 25 bp, Homo sapien
gtgcgactccaagtccctcagttct

SEQ ID NO: 58602 - DNA, 25 bp, Homo sapien
accagaagagcagcatgaggagccc

SEQ ID NO: 58603 - DNA, 25 bp, Homo sapien
ggccaatcagacgtgcgtctcctcg

SEQ ID NO: 58604 - DNA, 25 bp, Homo sapien
ggctccgcgagatcgaagaaccaga

SEQ ID NO: 58605 - DNA, 25 bp, Homo sapien
ccaacagcaaagcagccgtgacctg

SEQ ID NO: 58606 - DNA, 25 bp, Homo sapien
aaaaagcctccgtgcgcctactcta

SEQ ID NO: 58607 - DNA, 25 bp, Homo sapien
tggccctgtggccaaggtgaccaag

SEQ ID NO: 58608 - DNA, 25 bp, Homo sapien
taggcgcagtgaaatccgggaatcg

SEQ ID NO: 58609 - DNA, 25 bp, Homo sapien
ctagatacctgcgtggggtaggacc

SEQ ID NO: 58610 - DNA, 25 bp, Homo sapien
ggaagcggatccgtagcctcctccg

SEQ ID NO: 58611 - DNA, 25 bp, Homo sapien
tgaaccgacactcggggctctgggc

SEQ ID NO: 58612 - DNA, 25 bp, Homo sapien
cgacagcagcatcgctaaccactgg

SEQ ID NO: 58613 - DNA, 25 bp, Homo sapien
cgaccctgggagactcaccctgcca

SEQ ID NO: 58614 - DNA, 25 bp, Homo sapien
cgcgcggaagcggatccgtagcctc

SEQ ID NO: 58615 - DNA, 25 bp, Homo sapien
tggagacccactccgccaccgctgt

SEQ ID NO: 58616 - DNA, 25 bp, Homo sapien
tgtctccacagtgaaccgacactcg

SEQ ID NO: 58617 - DNA, 25 bp, Homo sapien
tcgctaaccactgggctctccggga

SEQ ID NO: 58618 - DNA, 25 bp, Homo sapien
cagctgccctgaaccttcaaagtca

SEQ ID NO: 58619 - DNA, 25 bp, Homo sapien
agtctgaccaacaacgctcacaatg

SEQ ID NO: 58620 - DNA, 25 bp, Homo sapien
caacgctcacaatgagggcgctgcc

SEQ ID NO: 58621 - DNA, 25 bp, Homo sapien
ctgcgctccagtcttacgaggaacc

SEQ ID NO: 58622 - DNA, 25 bp, Homo sapien
tgcagagctcgcgtctgacggctga

SEQ ID NO: 58623 - DNA, 25 bp, Homo sapien
cattttgcggggctggaattccttc

SEQ ID NO: 58624 - DNA, 25 bp, Homo sapien
tctgacggctgaggaacaaaacacc

SEQ ID NO: 58625 - DNA, 25 bp, Homo sapien
cacgggagacactctggagccattt

SEQ ID NO: 58626 - DNA, 25 bp, Homo sapien
ctcgctggtctcattgccggggcct

SEQ ID NO: 58627 - DNA, 25 bp, Homo sapien
ggtgccaacgaggaaagcacagttg

SEQ ID NO: 58628 - DNA, 25 bp, Homo sapien
ggcgcccgagtccactgaatgagcc

SEQ ID NO: 58629 - DNA, 25 bp, Homo sapien
gacccagggcgcactagctaggtgc

SEQ ID NO: 58630 - DNA, 25 bp, Homo sapien
ccagatggcgcgcaagtgagtgcca

SEQ ID NO: 58631 - DNA, 25 bp, Homo sapien
ggcgacctagcaaacagccgatccg

SEQ ID NO: 58632 - DNA, 25 bp, Homo sapien
tcccaagggtctcgttagctctgct

SEQ ID NO: 58633 - DNA, 25 bp, Homo sapien
gcagcgcgacaagttgccatggccc

SEQ ID NO: 58634 - DNA, 25 bp, Homo sapien
cctcacctgcttgcgatagggcgtc

SEQ ID NO: 58635 - DNA, 25 bp, Homo sapien
ctccgccttcgacctccgcactcgc

SEQ ID NO: 58636 - DNA, 25 bp, Homo sapien
tcgcctaaaagtacggcgcggcagc

SEQ ID NO: 58637 - DNA, 25 bp, Homo sapien
cctgcttgcgatagggcgtccggca

SEQ ID NO: 58638 - DNA, 25 bp, Homo sapien
ccctgcgtgccatggacgggagttc

SEQ ID NO: 58639 - DNA, 25 bp, Homo sapien
ggcgtcgccgactctcccggcggca

SEQ ID NO: 58640 - DNA, 25 bp, Homo sapien
tcaaccaccgccctgagagcgcgcc

SEQ ID NO: 58641 - DNA, 25 bp, Homo sapien
tccgcactcgcctaaaagtacggcg

SEQ ID NO: 58642 - DNA, 25 bp, Homo sapien
ggtggctctttcctgtctagtctct

SEQ ID NO: 58643 - DNA, 25 bp, Homo sapien
cggggctgagaggtgatcaatacaa

SEQ ID NO: 58644 - DNA, 25 bp, Homo sapien
cccaggccagcgctatagttagcaa

SEQ ID NO: 58645 - DNA, 25 bp, Homo sapien
cctttaccttggcttgcagatactg

SEQ ID NO: 58646 - DNA, 25 bp, Homo sapien
tactgagggtacatctgctgtttcc

SEQ ID NO: 58647 - DNA, 25 bp, Homo sapien
acactttgcccatgaagctggaagg

SEQ ID NO: 58648 - DNA, 25 bp, Homo sapien
cctcccaggcagaaagaaagacact

SEQ ID NO: 58649 - DNA, 25 bp, Homo sapien
agttacagcttacagggcgaggccc

SEQ ID NO: 58650 - DNA, 25 bp, Homo sapien
tgccctctgaactggaacaaaatgc

SEQ ID NO: 58651 - DNA, 25 bp, Homo sapien
tgtcagcatagcatcgtcggcctct

SEQ ID NO: 58652 - DNA, 25 bp, Homo sapien
tgcgggagaaaccacgcgagtcctt

SEQ ID NO: 58653 - DNA, 25 bp, Homo sapien
cgaggagcagcggagacaaccaatt

SEQ ID NO: 58654 - DNA, 25 bp, Homo sapien
caagcacgacgtcggagaatttgta

SEQ ID NO: 58655 - DNA, 25 bp, Homo sapien
tgcaacttccggttggagtcactcg

SEQ ID NO: 58656 - DNA, 25 bp, Homo sapien
cccggctgctttgcccgggaaatgg

SEQ ID NO: 58657 - DNA, 25 bp, Homo sapien
ttggtgtgtccgaatccgtcaagca

SEQ ID NO: 58658 - DNA, 25 bp, Homo sapien
aatgatgcgccgagcttctcccgag

SEQ ID NO: 58659 - DNA, 25 bp, Homo sapien
ctgctcgatgctagagatgaccctc

SEQ ID NO: 58660 - DNA, 25 bp, Homo sapien
ctcggtcactgccttcatgcaggtg

SEQ ID NO: 58661 - DNA, 25 bp, Homo sapien
cccaagatggaagcgaccgttggcc

SEQ ID NO: 58662 - DNA, 25 bp, Homo sapien
atcgacaaccggctgctctcaaggg

SEQ ID NO: 58663 - DNA, 25 bp, Homo sapien
gtcccaccactttgatctgcttttg

SEQ ID NO: 58664 - DNA, 25 bp, Homo sapien
tagctgaggaccctcccgtgtcagc

SEQ ID NO: 58665 - DNA, 25 bp, Homo sapien
atctgcttttggctttagctgagga

SEQ ID NO: 58666 - DNA, 25 bp, Homo sapien
tcgcctgctgaacggtgacagattg

SEQ ID NO: 58667 - DNA, 25 bp, Homo sapien
gcacacatgtatacgcgaaaggtta

SEQ ID NO: 58668 - DNA, 25 bp, Homo sapien
agcagcaggctgattacgaggtgtc

SEQ ID NO: 58669 - DNA, 25 bp, Homo sapien
ctcgcccaaataagcaccgggattg

SEQ ID NO: 58670 - DNA, 25 bp, Homo sapien
gcgagcgctgctgcatgctaatcag

SEQ ID NO: 58671 - DNA, 25 bp, Homo sapien
cgtgcggggcaactaattatccgtc

SEQ ID NO: 58672 - DNA, 25 bp, Homo sapien
cgaggtgtcaaaactgccaggagca

SEQ ID NO: 58673 - DNA, 25 bp, Homo sapien
ccactcgctgtctggtgaatcgacc

SEQ ID NO: 58674 - DNA, 25 bp, Homo sapien
aggcccttccatgaggcctggactg

SEQ ID NO: 58675 - DNA, 25 bp, Homo sapien
gcccttccatgaggcctggactgga

SEQ ID NO: 58676 - DNA, 25 bp, Homo sapien
ggaccgactgctcttggcgcccggg

SEQ ID NO: 58677 - DNA, 25 bp, Homo sapien
cttccatgaggcctggactggaggc

SEQ ID NO: 58678 - DNA, 25 bp, Homo sapien
tccatgaggcctggactggaggcct

SEQ ID NO: 58679 - DNA, 25 bp, Homo sapien
ccgcctgccgccacgcaggggccgc

SEQ ID NO: 58680 - DNA, 25 bp, Homo sapien
ggcaggcccttccatgaggcctgga

SEQ ID NO: 58681 - DNA, 25 bp, Homo sapien
gaggcaggcccttccatgaggcctg

SEQ ID NO: 58682 - DNA, 25 bp, Homo sapien
ttcgcgtcaccacagaggcaagaca

SEQ ID NO: 58683 - DNA, 25 bp, Homo sapien
ttcatcgccggtttgcagacagagc

SEQ ID NO: 58684 - DNA, 25 bp, Homo sapien
gaggcccgggcaactcttttgaatg

SEQ ID NO: 58685 - DNA, 25 bp, Homo sapien
tcgtctccaattggccgtcggggaa

SEQ ID NO: 58686 - DNA, 25 bp, Homo sapien
tggacatccgcttgactctccgtcg

SEQ ID NO: 58687 - DNA, 25 bp, Homo sapien
gtgctttcctgagtcacgttgccca

SEQ ID NO: 58688 - DNA, 25 bp, Homo sapien
gttgcccagctgagttgccacagga

SEQ ID NO: 58689 - DNA, 25 bp, Homo sapien
gacaagggtccatatcgcggcatcc

SEQ ID NO: 58690 - DNA, 25 bp, Homo sapien
ctctgaaaatgcaccacagtggcga

SEQ ID NO: 58691 - DNA, 25 bp, Homo sapien
cccgggtaggacagacgcgctcgct

SEQ ID NO: 58692 - DNA, 25 bp, Homo sapien
gcgagtctggataacccgtctccgc

SEQ ID NO: 58693 - DNA, 25 bp, Homo sapien
tcctcctgctcattcccgcgcggct

SEQ ID NO: 58694 - DNA, 25 bp, Homo sapien
cgaagcggcgagtctggataacccg

SEQ ID NO: 58695 - DNA, 25 bp, Homo sapien
ccaccgaggcgcagctctgaaaatg

SEQ ID NO: 58696 - DNA, 25 bp, Homo sapien
aatgcaccacagtggcgaagcggcg

SEQ ID NO: 58697 - DNA, 25 bp, Homo sapien
ggcgcagctctgaaaatgcaccaca

SEQ ID NO: 58698 - DNA, 25 bp, Homo sapien
ggacaagtgcacctaggctgtgact

SEQ ID NO: 58699 - DNA, 25 bp, Homo sapien
atactacatttttggctgccgctgc

SEQ ID NO: 58700 - DNA, 25 bp, Homo sapien
cggcaccaaacggagatgatcatca

SEQ ID NO: 58701 - DNA, 25 bp, Homo sapien
ctttggctgaaatttcaccggcacc

SEQ ID NO: 58702 - DNA, 25 bp, Homo sapien
gcccggcaaagcacaggtgtacctg

SEQ ID NO: 58703 - DNA, 25 bp, Homo sapien
ccaaggagctccgttctaccagttc

SEQ ID NO: 58704 - DNA, 25 bp, Homo sapien
gcagtacggccactcctaccaagga

SEQ ID NO: 58705 - DNA, 25 bp, Homo sapien
cggtcatcaccaacggagcctacaa

SEQ ID NO: 58706 - DNA, 25 bp, Homo sapien
ccgcctaccagaacacggatgtaag

SEQ ID NO: 58707 - DNA, 25 bp, Homo sapien
gcgtgcagacgttcactttccctga

SEQ ID NO: 58708 - DNA, 25 bp, Homo sapien
ccgcctgcatgtggtggaagtgaac

SEQ ID NO: 58709 - DNA, 25 bp, Homo sapien
ggtggttttacagtccttgcacaag

SEQ ID NO: 58710 - DNA, 25 bp, Homo sapien
ccggcttatcttcgctcccagaggt

SEQ ID NO: 58711 - DNA, 25 bp, Homo sapien
agtcccgcggtcagttagcctggaa

SEQ ID NO: 58712 - DNA, 25 bp, Homo sapien
ttcttcccgccggacagatggtggt

SEQ ID NO: 58713 - DNA, 25 bp, Homo sapien
cctgagactcagttcatcgccgtca

SEQ ID NO: 58714 - DNA, 25 bp, Homo sapien
actcaaagtgaagaagcctggttcc

SEQ ID NO: 58715 - DNA, 25 bp, Homo sapien
aacctccggagtcagggagcagctc

SEQ ID NO: 58716 - DNA, 25 bp, Homo sapien
aaaggcagagttatctacccacctc

SEQ ID NO: 58717 - DNA, 25 bp, Homo sapien
agcctggttccgcagcgtccaatgg

SEQ ID NO: 58718 - DNA, 25 bp, Homo sapien
tccaatggcccagcgtcagaagctg

SEQ ID NO: 58719 - DNA, 25 bp, Homo sapien
gcagctcagcacttagggccagaga

SEQ ID NO: 58720 - DNA, 25 bp, Homo sapien
ccagaatactacacccggctctagg

SEQ ID NO: 58721 - DNA, 25 bp, Homo sapien
tgcgggatctgacttcagaaaaggc

SEQ ID NO: 58722 - DNA, 25 bp, Homo sapien
gaagaactgcgccaaggacattagc

SEQ ID NO: 58723 - DNA, 25 bp, Homo sapien
cccgcaggatctacaccggctgtga

SEQ ID NO: 58724 - DNA, 25 bp, Homo sapien
ttcctgcaggaccagttcgtgagca

SEQ ID NO: 58725 - DNA, 25 bp, Homo sapien
ttcgtgagcaactacgccaaggccc

SEQ ID NO: 58726 - DNA, 25 bp, Homo sapien
cagtactgcggcaccaagtcgggct

SEQ ID NO: 58727 - DNA, 25 bp, Homo sapien
aaggacctgtccgattccagctgga

SEQ ID NO: 58728 - DNA, 25 bp, Homo sapien
agctggatcgagacgccctcctcga

SEQ ID NO: 58729 - DNA, 25 bp, Homo sapien
tcgactccagcgactcggggattta

SEQ ID NO: 58730 - DNA, 25 bp, Homo sapien
accatctgctgcgtggactgagtca

SEQ ID NO: 58731 - DNA, 25 bp, Homo sapien
ccttgttctgaaagacgcgctttgg

SEQ ID NO: 58732 - DNA, 25 bp, Homo sapien
aaagttcgcgtctcctgttagaaga

SEQ ID NO: 58733 - DNA, 25 bp, Homo sapien
ctcttaggagccgaggatagatttc

SEQ ID NO: 58734 - DNA, 25 bp, Homo sapien
cctctcggaggcattgtgctgtctt

SEQ ID NO: 58735 - DNA, 25 bp, Homo sapien
ggcgattcctctccgtaaactcaga

SEQ ID NO: 58736 - DNA, 25 bp, Homo sapien
tgcggctagcactgtattctggctc

SEQ ID NO: 58737 - DNA, 25 bp, Homo sapien
taactttcaatgtccctcggggctg

SEQ ID NO: 58738 - DNA, 25 bp, Homo sapien
aaacattagtgagcgccgagcccgc

SEQ ID NO: 58739 - DNA, 25 bp, Homo sapien
tggctctccgggacattcaaagctc

SEQ ID NO: 58740 - DNA, 25 bp, Homo sapien
gccagggtccgaaagctaagcgaga

SEQ ID NO: 58741 - DNA, 25 bp, Homo sapien
tgggacgtcccttcacctgtcagag

SEQ ID NO: 58742 - DNA, 25 bp, Homo sapien
tttcgccagcttttgggccatttgg

SEQ ID NO: 58743 - DNA, 25 bp, Homo sapien
gtctcctcggaagtgagcgttcaga

SEQ ID NO: 58744 - DNA, 25 bp, Homo sapien
agtcactcgccgctggcaagtttcg

SEQ ID NO: 58745 - DNA, 25 bp, Homo sapien
ttcaaagctcgacgccagggtccta

SEQ ID NO: 58746 - DNA, 25 bp, Homo sapien
gcgagcattgatcctgggctgactt

SEQ ID NO: 58747 - DNA, 25 bp, Homo sapien
ttagtgcgcctttcagcctcacctg

SEQ ID NO: 58748 - DNA, 25 bp, Homo sapien
tgtgctttttctcccagcactgcgg

SEQ ID NO: 58749 - DNA, 25 bp, Homo sapien
gctcgtcatggcctacccgggatac

SEQ ID NO: 58750 - DNA, 25 bp, Homo sapien
gagtcccagccgcttggtcgtgtcc

SEQ ID NO: 58751 - DNA, 25 bp, Homo sapien
acttggagccgcaggttttctggtc

SEQ ID NO: 58752 - DNA, 25 bp, Homo sapien
ttgaggaccctcgaggagcgtcctg

SEQ ID NO: 58753 - DNA, 25 bp, Homo sapien
aactgtgcggttagtgcgcctttca

SEQ ID NO: 58754 - DNA, 25 bp, Homo sapien
atcctaggcgcggatctcgcgtttc

SEQ ID NO: 58755 - DNA, 25 bp, Homo sapien
tggttggttttggttctcaagagta

SEQ ID NO: 58756 - DNA, 25 bp, Homo sapien
agcagtaggcgtcgcccactttctt

SEQ ID NO: 58757 - DNA, 25 bp, Homo sapien
cttgatcaaaccactcagcagtagg

SEQ ID NO: 58758 - DNA, 25 bp, Homo sapien
cgtcggaacggagcttgatcaaacc

SEQ ID NO: 58759 - DNA, 25 bp, Homo sapien
tctgtcttggaatgaatgatcgtcg

SEQ ID NO: 58760 - DNA, 25 bp, Homo sapien
gctttggtaaagaggctggagtttc

SEQ ID NO: 58761 - DNA, 25 bp, Homo sapien
aagctgcgctcgctacccgggtaac

SEQ ID NO: 58762 - DNA, 25 bp, Homo sapien
ctactctgactcctggcgcggacag

SEQ ID NO: 58763 - DNA, 25 bp, Homo sapien
tgtcattcgcgtgcctctcggtgcg

SEQ ID NO: 58764 - DNA, 25 bp, Homo sapien
ggacagttgcgccaatccccgaagc

SEQ ID NO: 58765 - DNA, 25 bp, Homo sapien
aggaatgagaagaatttgcttgctc

SEQ ID NO: 58766 - DNA, 25 bp, Homo sapien
atttgcttgctcagaagatgggagc

SEQ ID NO: 58767 - DNA, 25 bp, Homo sapien
agatgggagcgatagggactcccta

SEQ ID NO: 58768 - DNA, 25 bp, Homo sapien
agggactccctactctgactcctgg

SEQ ID NO: 58769 - DNA, 25 bp, Homo sapien
acagctgttgccactcgggctgtcg

SEQ ID NO: 58770 - DNA, 25 bp, Homo sapien
ggctttctttcccacgcgtgaccag

SEQ ID NO: 58771 - DNA, 25 bp, Homo sapien
cctaagtgtctaggtgtgcggtccc

SEQ ID NO: 58772 - DNA, 25 bp, Homo sapien
tcgagagcctggacctcaccggcac

SEQ ID NO: 58773 - DNA, 25 bp, Homo sapien
gccagaaaacgacttgatctgctta

SEQ ID NO: 58774 - DNA, 25 bp, Homo sapien
cgacttgatctgcttagaagaggca

SEQ ID NO: 58775 - DNA, 25 bp, Homo sapien
cttagaagaggcaacttcggggaga

SEQ ID NO: 58776 - DNA, 25 bp, Homo sapien
gagaaaattcgcgttcgcccagttc

SEQ ID NO: 58777 - DNA, 25 bp, Homo sapien
cccgaggtcatgattacgcgcgcgg

SEQ ID NO: 58778 - DNA, 25 bp, Homo sapien
cgccacacacctgggcggccagcgg

SEQ ID NO: 58779 - DNA, 25 bp, Homo sapien
agacgcgcggccgagctatctgcga

SEQ ID NO: 58780 - DNA, 25 bp, Homo sapien
ttgcagggaagtggtcattgtcgcc

SEQ ID NO: 58781 - DNA, 25 bp, Homo sapien
cggcgctctgcccatcttgcaggga

SEQ ID NO: 58782 - DNA, 25 bp, Homo sapien
gttgcctacctgtctgcagcacagc

SEQ ID NO: 58783 - DNA, 25 bp, Homo sapien
ctccagggttgcctacctgtctgca

SEQ ID NO: 58784 - DNA, 25 bp, Homo sapien
cactggcattgctcccgcgccgtcc

SEQ ID NO: 58785 - DNA, 25 bp, Homo sapien
atcttgcagggaagtggtcattgtc

SEQ ID NO: 58786 - DNA, 25 bp, Homo sapien
agttgggagggctgatctctctttt

SEQ ID NO: 58787 - DNA, 25 bp, Homo sapien
gtctctacaaggtctagcgggcgcc

SEQ ID NO: 58788 - DNA, 25 bp, Homo sapien
tcctccggccgagtttgcacaaaca

SEQ ID NO: 58789 - DNA, 25 bp, Homo sapien
tttccaaaggagacagtagctcgcc

SEQ ID NO: 58790 - DNA, 25 bp, Homo sapien
gctcggctctcaagccaggacttga

SEQ ID NO: 58791 - DNA, 25 bp, Homo sapien
gacttgaatggagaagcggcaaccc

SEQ ID NO: 58792 - DNA, 25 bp, Homo sapien
gccgcacataagtggggaccagctc

SEQ ID NO: 58793 - DNA, 25 bp, Homo sapien
gtttactgggtagccatttggcgcc

SEQ ID NO: 58794 - DNA, 25 bp, Homo sapien
ccatttaaatggctcggcggccgcg

SEQ ID NO: 58795 - DNA, 25 bp, Homo sapien
gtcgccacagttgcggctcagtaga

SEQ ID NO: 58796 - DNA, 25 bp, Homo sapien
tgctctaacgcagcccaggggtacc

SEQ ID NO: 58797 - DNA, 25 bp, Homo sapien
ggggcaaccgacacactgctctcga

SEQ ID NO: 58798 - DNA, 25 bp, Homo sapien
cctttcgggatctctccaggggcaa

SEQ ID NO: 58799 - DNA, 25 bp, Homo sapien
accaggtctttggtctccgtccagc

SEQ ID NO: 58800 - DNA, 25 bp, Homo sapien
aagccatgtctttcgctgtcgcggg

SEQ ID NO: 58801 - DNA, 25 bp, Homo sapien
ccgcggtttgcagcctagaactgtt

SEQ ID NO: 58802 - DNA, 25 bp, Homo sapien
ccctcagaaggactccggcgtgtca

SEQ ID NO: 58803 - DNA, 25 bp, Homo sapien
cgcttgtttcctggcaacggctaaa

SEQ ID NO: 58804 - DNA, 25 bp, Homo sapien
cggcgtgtcataggcgaaggcctct

SEQ ID NO: 58805 - DNA, 25 bp, Homo sapien
ttcactcacggaacgccgaacctgg

SEQ ID NO: 58806 - DNA, 25 bp, Homo sapien
cccgagcaaggacgcttgtttcctg

SEQ ID NO: 58807 - DNA, 25 bp, Homo sapien
ctcattggctgagccggaccaaacc

SEQ ID NO: 58808 - DNA, 25 bp, Homo sapien
ctgggcaatggcgtgccagctcatt

SEQ ID NO: 58809 - DNA, 25 bp, Homo sapien
aggagcaccgcctctcctcttggtt

SEQ ID NO: 58810 - DNA, 25 bp, Homo sapien
agtctgtttcctgtcactggttgta

SEQ ID NO: 58811 - DNA, 25 bp, Homo sapien
caccttcaattcctgcgagtccatg

SEQ ID NO: 58812 - DNA, 25 bp, Homo sapien
tctcgccgcagcctaaaggaagacg

SEQ ID NO: 58813 - DNA, 25 bp, Homo sapien
gtcacactgggaaacggctgtctga

SEQ ID NO: 58814 - DNA, 25 bp, Homo sapien
gaagacaccattttctgcacgtttg

SEQ ID NO: 58815 - DNA, 25 bp, Homo sapien
agcggtcaactttcacgtgggcaag

SEQ ID NO: 58816 - DNA, 25 bp, Homo sapien
acagaaatacggtgcgcttgggccc

SEQ ID NO: 58817 - DNA, 25 bp, Homo sapien
tgcagctggaaaaggaggtcacact

SEQ ID NO: 58818 - DNA, 25 bp, Homo sapien
agctggcggaattggaaagccgaca

SEQ ID NO: 58819 - DNA, 25 bp, Homo sapien
ggggttgcacgacctgccatccacg

SEQ ID NO: 58820 - DNA, 25 bp, Homo sapien
ccatgcgctaatagaaggcggagga

SEQ ID NO: 58821 - DNA, 25 bp, Homo sapien
agcctctgcaccatgcgctaataga

SEQ ID NO: 58822 - DNA, 25 bp, Homo sapien
tggcgacgctgtagcctctgcacca

SEQ ID NO: 58823 - DNA, 25 bp, Homo sapien
ggcgaccgcctgcaagcagactgcg

SEQ ID NO: 58824 - DNA, 25 bp, Homo sapien
gagcgctggcgaccgcctgcaagca

SEQ ID NO: 58825 - DNA, 25 bp, Homo sapien
attggaaagccgacagccgccgctg

SEQ ID NO: 58826 - DNA, 25 bp, Homo sapien
gagccgagcaaattgaactttattg

SEQ ID NO: 58827 - DNA, 25 bp, Homo sapien
actttgcagcgagaacagtgggtcc

SEQ ID NO: 58828 - DNA, 25 bp, Homo sapien
ctcacagactttgacagcgcgggga

SEQ ID NO: 58829 - DNA, 25 bp, Homo sapien
gagcagcagcatcttcgggaccctg

SEQ ID NO: 58830 - DNA, 25 bp, Homo sapien
ttgggccttccgctctgattggtct

SEQ ID NO: 58831 - DNA, 25 bp, Homo sapien
gaaagtccaccgtggctcgtaaaga

SEQ ID NO: 58832 - DNA, 25 bp, Homo sapien
gcgtggcccgacgtccttcaaggac

SEQ ID NO: 58833 - DNA, 25 bp, Homo sapien
ttaaaaggagctgtggacctggcgc

SEQ ID NO: 58834 - DNA, 25 bp, Homo sapien
gcacgcggcaaccaaccggagcgga

SEQ ID NO: 58835 - DNA, 25 bp, Homo sapien
gtggagaacacgcagccttgggtct

SEQ ID NO: 58836 - DNA, 25 bp, Homo sapien
ttaacactggccacaacaagcggtg

SEQ ID NO: 58837 - DNA, 25 bp, Homo sapien
tggcggtcaccgcagttaacactgg

SEQ ID NO: 58838 - DNA, 25 bp, Homo sapien
ccaaccggagcggactactgcggag

SEQ ID NO: 58839 - DNA, 25 bp, Homo sapien
cacaacaagcggtggagaacacgca

SEQ ID NO: 58840 - DNA, 25 bp, Homo sapien
atagcgccaagctgctctggcggtc

SEQ ID NO: 58841 - DNA, 25 bp, Homo sapien
cactttacatcctgaggcagcgctg

SEQ ID NO: 58842 - DNA, 25 bp, Homo sapien
cgtgcatgcaggctagcccagcatc

SEQ ID NO: 58843 - DNA, 25 bp, Homo sapien
aaaagtttgcagcatgcggctcgtc

SEQ ID NO: 58844 - DNA, 25 bp, Homo sapien
cagctcgtacgcgtccctgcagatg

SEQ ID NO: 58845 - DNA, 25 bp, Homo sapien
gatgggccagccgacagcctgtgcc

SEQ ID NO: 58846 - DNA, 25 bp, Homo sapien
gccgacggacgaccttccacttgaa

SEQ ID NO: 58847 - DNA, 25 bp, Homo sapien
acttgaaacttcctttgcctcgccg

SEQ ID NO: 58848 - DNA, 25 bp, Homo sapien
cccggcgatccctgagataaaagtt

SEQ ID NO: 58849 - DNA, 25 bp, Homo sapien
ctgcagcaccaacgctcatagaacg

SEQ ID NO: 58850 - DNA, 25 bp, Homo sapien
tgacagcctgcgagaaccgagaggt

SEQ ID NO: 58851 - DNA, 25 bp, Homo sapien
ccaggagaagggacattccggagac

SEQ ID NO: 58852 - DNA, 25 bp, Homo sapien
gctctttgttcggtcggagcctcgg

SEQ ID NO: 58853 - DNA, 25 bp, Homo sapien
cggctcagagcgagaaaagcaaacc

SEQ ID NO: 58854 - DNA, 25 bp, Homo sapien
gatcgggtgtactgtcccaacccga

SEQ ID NO: 58855 - DNA, 25 bp, Homo sapien
caacccgaaagtccagttctgcggc

SEQ ID NO: 58856 - DNA, 25 bp, Homo sapien
ggcgcgatgacacaggagtacgaca

SEQ ID NO: 58857 - DNA, 25 bp, Homo sapien
ttagccctgccgtgctctttgttcg

SEQ ID NO: 58858 - DNA, 25 bp, Homo sapien
taggtcgtcgccctaagcgcaaagc

SEQ ID NO: 58859 - DNA, 25 bp, Homo sapien
tgcggctcatcttcgagaggtaaga

SEQ ID NO: 58860 - DNA, 25 bp, Homo sapien
gctgaggacctctatctcgcttttc

SEQ ID NO: 58861 - DNA, 25 bp, Homo sapien
cacaatgtcacctgggcggacctga

SEQ ID NO: 58862 - DNA, 25 bp, Homo sapien
agaggttttggctcccgcacaatgt

SEQ ID NO: 58863 - DNA, 25 bp, Homo sapien
ttgacgcgaagacgagccaatcagg

SEQ ID NO: 58864 - DNA, 25 bp, Homo sapien
tgtgtgcctcgctgtttgacgcgaa

SEQ ID NO: 58865 - DNA, 25 bp, Homo sapien
gtctggcttgccacggatttcctcc

SEQ ID NO: 58866 - DNA, 25 bp, Homo sapien
tcactttcccttattgcgacagggg

SEQ ID NO: 58867 - DNA, 25 bp, Homo sapien
ccttaccttcgcaggcaggcctgag

SEQ ID NO: 58868 - DNA, 25 bp, Homo sapien
agatccgcgcccactctagccaaca

SEQ ID NO: 58869 - DNA, 25 bp, Homo sapien
caacagccggactctaggctcagct

SEQ ID NO: 58870 - DNA, 25 bp, Homo sapien
aggctggccttctgattggccgata

SEQ ID NO: 58871 - DNA, 25 bp, Homo sapien
ccctcaaattcactttcccttattg

SEQ ID NO: 58872 - DNA, 25 bp, Homo sapien
atttcaaacctagtgcacttcccgc

SEQ ID NO: 58873 - DNA, 25 bp, Homo sapien
caactttccgatttcaaacctagtg

SEQ ID NO: 58874 - DNA, 25 bp, Homo sapien
gcggggctgctttctcaagtttgct

SEQ ID NO: 58875 - DNA, 25 bp, Homo sapien
tccagacagtgcataaagcccttta

SEQ ID NO: 58876 - DNA, 25 bp, Homo sapien
tccgccagctcctagtggccaaaag

SEQ ID NO: 58877 - DNA, 25 bp, Homo sapien
ctgcaaacggcggagaacctcgttc

SEQ ID NO: 58878 - DNA, 25 bp, Homo sapien
agtttgctgccgctcagttcctggc

SEQ ID NO: 58879 - DNA, 25 bp, Homo sapien
tttccaggagcatcggaccaacgcc

SEQ ID NO: 58880 - DNA, 25 bp, Homo sapien
gttctcccgcaaagtgctttccagg

SEQ ID NO: 58881 - DNA, 25 bp, Homo sapien
gcctctgctagcgaacgctccttta

SEQ ID NO: 58882 - DNA, 25 bp, Homo sapien
gctgggctccctccagtgcgcccgt

SEQ ID NO: 58883 - DNA, 25 bp, Homo sapien
cgacttacaaagagcggccgccggc

SEQ ID NO: 58884 - DNA, 25 bp, Homo sapien
cgcacctccgacttacaaagagcgg

SEQ ID NO: 58885 - DNA, 25 bp, Homo sapien
gcgctgcatagtcaatgagcgtccc

SEQ ID NO: 58886 - DNA, 25 bp, Homo sapien
gggccgcgctgcatagtcaatgagc

SEQ ID NO: 58887 - DNA, 25 bp, Homo sapien
ttcgcgggtgatttatgccggttcc

SEQ ID NO: 58888 - DNA, 25 bp, Homo sapien
ttgatgctgcactccagtcttcgcg

SEQ ID NO: 58889 - DNA, 25 bp, Homo sapien
cactccagtcttcgcgggtgattta

SEQ ID NO: 58890 - DNA, 25 bp, Homo sapien
cgtcatccattggaacagctgccta

SEQ ID NO: 58891 - DNA, 25 bp, Homo sapien
agtcgctacgttcgcacctggagtt

SEQ ID NO: 58892 - DNA, 25 bp, Homo sapien
cctggagtttcttcttggacctggc

SEQ ID NO: 58893 - DNA, 25 bp, Homo sapien
ttccctgatgcccacagatgtggtc

SEQ ID NO: 58894 - DNA, 25 bp, Homo sapien
ttcgaggccttcgaccgcacagaga

SEQ ID NO: 58895 - DNA, 25 bp, Homo sapien
tactgactacagtgggcgatacacc

SEQ ID NO: 58896 - DNA, 25 bp, Homo sapien
tgcctttcgcattgccaagctgatg

SEQ ID NO: 58897 - DNA, 25 bp, Homo sapien
ggcgccagtacctctatagctttta

SEQ ID NO: 58898 - DNA, 25 bp, Homo sapien
gattcccgagggatcttcaaccctg

SEQ ID NO: 58899 - DNA, 25 bp, Homo sapien
gagcgcatcggcattacacagtttt

SEQ ID NO: 58900 - DNA, 25 bp, Homo sapien
ttcaaccctgtagagggcgccgccg

SEQ ID NO: 58901 - DNA, 25 bp, Homo sapien
tccgcgcagtgagtttccaagattc

SEQ ID NO: 58902 - DNA, 25 bp, Homo sapien
atcgggatgtccgtttcgacctgtc

SEQ ID NO: 58903 - DNA, 25 bp, Homo sapien
cacgggccttgttcaccatgtcggt

SEQ ID NO: 58904 - DNA, 25 bp, Homo sapien
gcactctcgcggaagcttgagtctc

SEQ ID NO: 58905 - DNA, 25 bp, Homo sapien
tcggcttaacgacgcgaaagagctg

SEQ ID NO: 58906 - DNA, 25 bp, Homo sapien
cagcagtgcctttgccgctgttgca

SEQ ID NO: 58907 - DNA, 25 bp, Homo sapien
ttttgccgcacaagctgtaacatgg

SEQ ID NO: 58908 - DNA, 25 bp, Homo sapien
aacgctggccgatgctgacaaccca

SEQ ID NO: 58909 - DNA, 25 bp, Homo sapien
acgctgtctctccatgccaggactg

SEQ ID NO: 58910 - DNA, 25 bp, Homo sapien
cggcggtagatttgaagcgcttcaa

SEQ ID NO: 58911 - DNA, 25 bp, Homo sapien
agcgcttcaaaggaccggacccaga

SEQ ID NO: 58912 - DNA, 25 bp, Homo sapien
tttccctcgaggtatcggggctgct

SEQ ID NO: 58913 - DNA, 25 bp, Homo sapien
cggcgtcatttcagcagtccctgcg

SEQ ID NO: 58914 - DNA, 25 bp, Homo sapien
gacgccagccgtagccgaggaacaa

SEQ ID NO: 58915 - DNA, 25 bp, Homo sapien
accagcatctctgacgaggtgtcca

SEQ ID NO: 58916 - DNA, 25 bp, Homo sapien
ggtgtccatgatgctcctagatctg

SEQ ID NO: 58917 - DNA, 25 bp, Homo sapien
gttactcgtaccacgcggttgcttg

SEQ ID NO: 58918 - DNA, 25 bp, Homo sapien
aggccaaaggactgaacccgcagga

SEQ ID NO: 58919 - DNA, 25 bp, Homo sapien
gtgtgaggagcaaagccctccctta

SEQ ID NO: 58920 - DNA, 25 bp, Homo sapien
aacccgcggattcgctgacataaac

SEQ ID NO: 58921 - DNA, 25 bp, Homo sapien
ctagatctggaaaagtgactgtggc

SEQ ID NO: 58922 - DNA, 25 bp, Homo sapien
agcggcactagctggcggcttccga

SEQ ID NO: 58923 - DNA, 25 bp, Homo sapien
tcttccaaagatggtcagaggggcc

SEQ ID NO: 58924 - DNA, 25 bp, Homo sapien
ccgctcgctactagcccgcgggcca

SEQ ID NO: 58925 - DNA, 25 bp, Homo sapien
ccaaaataggagctgcttgtggggt

SEQ ID NO: 58926 - DNA, 25 bp, Homo sapien
actagctggcggcttccgagcgcct

SEQ ID NO: 58927 - DNA, 25 bp, Homo sapien
cgggacaccaaaataggagctgctt

SEQ ID NO: 58928 - DNA, 25 bp, Homo sapien
ccgagcgcctcttccaaagatggtc

SEQ ID NO: 58929 - DNA, 25 bp, Homo sapien
gagccgccgggacaccaaaatagga

SEQ ID NO: 58930 - DNA, 25 bp, Homo sapien
atgaagcccactcagccttggccgg

SEQ ID NO: 58931 - DNA, 25 bp, Homo sapien
ccgacggtttcctggaggcattcta

SEQ ID NO: 58932 - DNA, 25 bp, Homo sapien
tcatttccaggaagcacaggcggga

SEQ ID NO: 58933 - DNA, 25 bp, Homo sapien
cacgaccttagaggaacagaaactc

SEQ ID NO: 58934 - DNA, 25 bp, Homo sapien
tgggcgccaacttcagctcccgttt

SEQ ID NO: 58935 - DNA, 25 bp, Homo sapien
ggcctcgattcggtccttggtccca

SEQ ID NO: 58936 - DNA, 25 bp, Homo sapien
cttcttcgtcctcgggcaggtaaag

SEQ ID NO: 58937 - DNA, 25 bp, Homo sapien
agcaggggtgcgtccttccaaccca

SEQ ID NO: 58938 - DNA, 25 bp, Homo sapien
ccttaaaggtgagtaactctcggtg

SEQ ID NO: 58939 - DNA, 25 bp, Homo sapien
ggcagccgcgcatgctcagagcaca

SEQ ID NO: 58940 - DNA, 25 bp, Homo sapien
ggcagttccgcggttgcttagagac

SEQ ID NO: 58941 - DNA, 25 bp, Homo sapien
tgctcagagcacagggaccgctcca

SEQ ID NO: 58942 - DNA, 25 bp, Homo sapien
tctttactgcttctcgcggcgtccg

SEQ ID NO: 58943 - DNA, 25 bp, Homo sapien
gcgactgcgcgtttccgttctttac

SEQ ID NO: 58944 - DNA, 25 bp, Homo sapien
caaaagggtccgctttgctggtgcg

SEQ ID NO: 58945 - DNA, 25 bp, Homo sapien
tctcggtggctaatgagaagctaca

SEQ ID NO: 58946 - DNA, 25 bp, Homo sapien
tgcacgatgcacacgccggacttcg

SEQ ID NO: 58947 - DNA, 25 bp, Homo sapien
aggcctctaggtgggtctccgctac

SEQ ID NO: 58948 - DNA, 25 bp, Homo sapien
tggtgcggcactcgcgcgcctgtaa

SEQ ID NO: 58949 - DNA, 25 bp, Homo sapien
caaaagccaggttgaggcctctagg

SEQ ID NO: 58950 - DNA, 25 bp, Homo sapien
tctccgctaccgatggattcagccg

SEQ ID NO: 58951 - DNA, 25 bp, Homo sapien
caggaggttcctataagcgtggtcc

SEQ ID NO: 58952 - DNA, 25 bp, Homo sapien
ccgcggcgggactactcgtctgagc

SEQ ID NO: 58953 - DNA, 25 bp, Homo sapien
gcagctttgtcttgcgcttcctggg

SEQ ID NO: 58954 - DNA, 25 bp, Homo sapien
cgaagacgcgccctaaggagacgcc

SEQ ID NO: 58955 - DNA, 25 bp, Homo sapien
tctgacccacctcccggctaaccca

SEQ ID NO: 58956 - DNA, 25 bp, Homo sapien
agcagcctcaggatccctcgcgcca

SEQ ID NO: 58957 - DNA, 25 bp, Homo sapien
cgcgccacgaccacgcacctctgga

SEQ ID NO: 58958 - DNA, 25 bp, Homo sapien
aaagcctgcgctacttgctgaccca

SEQ ID NO: 58959 - DNA, 25 bp, Homo sapien
acctctggaggcgacccgcacctcg

SEQ ID NO: 58960 - DNA, 25 bp, Homo sapien
cagcgtttatcttgagccggggttc

SEQ ID NO: 58961 - DNA, 25 bp, Homo sapien
gcctgcaaagcctgcgctacttgct

SEQ ID NO: 58962 - DNA, 25 bp, Homo sapien
gctggccctggactctccaaattct

SEQ ID NO: 58963 - DNA, 25 bp, Homo sapien
gccgagcaatcgcagcagtctattc

SEQ ID NO: 58964 - DNA, 25 bp, Homo sapien
gacttcaacatgttccgcagccagg

SEQ ID NO: 58965 - DNA, 25 bp, Homo sapien
aattctgagctctcatcatggcggc

SEQ ID NO: 58966 - DNA, 25 bp, Homo sapien
gcctggtctggacagccaacttcgt

SEQ ID NO: 58967 - DNA, 25 bp, Homo sapien
atctcgccctgcatgtcgctgtgcg

SEQ ID NO: 58968 - DNA, 25 bp, Homo sapien
gagtgcttccaccagggcgaccaca

SEQ ID NO: 58969 - DNA, 25 bp, Homo sapien
agggcgaccacaccggacacgactt

SEQ ID NO: 58970 - DNA, 25 bp, Homo sapien
gcgctcggtctttgatgtctcttta

SEQ ID NO: 58971 - DNA, 25 bp, Homo sapien
cttcctctcgcaggtggcatgcagt

SEQ ID NO: 58972 - DNA, 25 bp, Homo sapien
gcaagtgtcactgcgggttcaccta

SEQ ID NO: 58973 - DNA, 25 bp, Homo sapien
aaatcttccctcctgtgaactcgcg

SEQ ID NO: 58974 - DNA, 25 bp, Homo sapien
aggcaggaggaccacataggagttc

SEQ ID NO: 58975 - DNA, 25 bp, Homo sapien
cgccacggttaaagtttgctccaca

SEQ ID NO: 58976 - DNA, 25 bp, Homo sapien
cgccaggagactggtattcaacctc

SEQ ID NO: 58977 - DNA, 25 bp, Homo sapien
gcccgcccgcaaagaaacggcaatg

SEQ ID NO: 58978 - DNA, 25 bp, Homo sapien
aatcgcagcgtgagcaggtggagcc

SEQ ID NO: 58979 - DNA, 25 bp, Homo sapien
gcctctcctcaacagcagcagtgtg

SEQ ID NO: 58980 - DNA, 25 bp, Homo sapien
gctaaagctgaaccggagcgtgcag

SEQ ID NO: 58981 - DNA, 25 bp, Homo sapien
gctgctaaagctgaaccggagcgtg

SEQ ID NO: 58982 - DNA, 25 bp, Homo sapien
gggccatggagctgctaaagctgaa

SEQ ID NO: 58983 - DNA, 25 bp, Homo sapien
cccgccgggtcgagctgagtaaggc

SEQ ID NO: 58984 - DNA, 25 bp, Homo sapien
caacagcagcagtgtgggcaacctc

SEQ ID NO: 58985 - DNA, 25 bp, Homo sapien
tgtgggcaacctcagctgcgagccc

SEQ ID NO: 58986 - DNA, 25 bp, Homo sapien
tgacgccgcagaagacgcacctgca

SEQ ID NO: 58987 - DNA, 25 bp, Homo sapien
tcaccagaataagaagctcaaagtc

SEQ ID NO: 58988 - DNA, 25 bp, Homo sapien
acctcgcgaagcacgtcaagactca

SEQ ID NO: 58989 - DNA, 25 bp, Homo sapien
gagaagcgctttgcctgtcccgagt

SEQ ID NO: 58990 - DNA, 25 bp, Homo sapien
tcggactttgcgcagtaccagagcc

SEQ ID NO: 58991 - DNA, 25 bp, Homo sapien
cgccctacaaagaggcctggtgttg

SEQ ID NO: 58992 - DNA, 25 bp, Homo sapien
ccctacgagttctcgccggtcaaga

SEQ ID NO: 58993 - DNA, 25 bp, Homo sapien
ccggtcaagatgctgccctcgagca

SEQ ID NO: 58994 - DNA, 25 bp, Homo sapien
gccttcgggatcctctctcgtatga

SEQ ID NO: 58995 - DNA, 25 bp, Homo sapien
tgtgggaccacaacaaccaggcttc

SEQ ID NO: 58996 - DNA, 25 bp, Homo sapien
acctctgacgctgcatcgggagata

SEQ ID NO: 58997 - DNA, 25 bp, Homo sapien
tcgaccgcgccttttttccagtagc

SEQ ID NO: 58998 - DNA, 25 bp, Homo sapien
gctcgcgttttagaggggacaactc

SEQ ID NO: 58999 - DNA, 25 bp, Homo sapien
ccgcgcctggtgaggaactttttct

SEQ ID NO: 59000 - DNA, 25 bp, Homo sapien
tacagtccagattccgagtccgttg

SEQ ID NO: 59001 - DNA, 25 bp, Homo sapien
gcggagggcatccttatacagtcca

SEQ ID NO: 59002 - DNA, 25 bp, Homo sapien
gcgctgcgtcggtgcaaatctttaa

SEQ ID NO: 59003 - DNA, 25 bp, Homo sapien
gaagagtgtctcgagcaacccaagc

SEQ ID NO: 59004 - DNA, 25 bp, Homo sapien
cgtgtccggatctctcctggtactc

SEQ ID NO: 59005 - DNA, 25 bp, Homo sapien
gtactccgtgcaccttgaacctcaa

SEQ ID NO: 59006 - DNA, 25 bp, Homo sapien
aatcttccctctgactggctggcgg

SEQ ID NO: 59007 - DNA, 25 bp, Homo sapien
gccgctattctttgatgattgggta

SEQ ID NO: 59008 - DNA, 25 bp, Homo sapien
acactttgtcactttgggcgctgcg

SEQ ID NO: 59009 - DNA, 25 bp, Homo sapien
ttcgcttctgaaagagccgctattc

SEQ ID NO: 59010 - DNA, 25 bp, Homo sapien
tctacacgggtgtggagataactgg

SEQ ID NO: 59011 - DNA, 25 bp, Homo sapien
taccattctttgaccggccggtgca

SEQ ID NO: 59012 - DNA, 25 bp, Homo sapien
gccgccagctggtaagacactccga

SEQ ID NO: 59013 - DNA, 25 bp, Homo sapien
tgcgcacgtcaatccgagggtgtgt

SEQ ID NO: 59014 - DNA, 25 bp, Homo sapien
ggcttgtctacactaccattctttg

SEQ ID NO: 59015 - DNA, 25 bp, Homo sapien
gctcctgaaggtaaccggtgcgcgt

SEQ ID NO: 59016 - DNA, 25 bp, Homo sapien
actgggcgattctgacaggcttgtc

SEQ ID NO: 59017 - DNA, 25 bp, Homo sapien
aggaagcgccgttcgtgtctacacg

SEQ ID NO: 59018 - DNA, 25 bp, Homo sapien
caatcgaaacagctgggcggacacc

SEQ ID NO: 59019 - DNA, 25 bp, Homo sapien
gcgccgcgttcccatttcttcaaag

SEQ ID NO: 59020 - DNA, 25 bp, Homo sapien
cttcttctgcctttgagcgccgcgt

SEQ ID NO: 59021 - DNA, 25 bp, Homo sapien
tccctaatgccggagagagactgga

SEQ ID NO: 59022 - DNA, 25 bp, Homo sapien
ggggctgcaagctcgcaaatcccta

SEQ ID NO: 59023 - DNA, 25 bp, Homo sapien
tcccagcggtggttgacctaaggaa

SEQ ID NO: 59024 - DNA, 25 bp, Homo sapien
gagggtcgtgttcccaagtcccagc

SEQ ID NO: 59025 - DNA, 25 bp, Homo sapien
ggaaacgttatcctcggcagacagg

SEQ ID NO: 59026 - DNA, 25 bp, Homo sapien
agcgtctcgtttagggaaggctcta

SEQ ID NO: 59027 - DNA, 25 bp, Homo sapien
cgtttcctacgtggagcagacaccc

SEQ ID NO: 59028 - DNA, 25 bp, Homo sapien
ggacgtttcctacgtggagcagaca

SEQ ID NO: 59029 - DNA, 25 bp, Homo sapien
cttcaagcagcgcagagcagctgcc

SEQ ID NO: 59030 - DNA, 25 bp, Homo sapien
tgtatgccgcccacttcaagcagcg

SEQ ID NO: 59031 - DNA, 25 bp, Homo sapien
ttcacctggttgtatgccgcccact

SEQ ID NO: 59032 - DNA, 25 bp, Homo sapien
gaattccgagcttcacctggttgta

SEQ ID NO: 59033 - DNA, 25 bp, Homo sapien
ccggtggatggaattccgagcttca

SEQ ID NO: 59034 - DNA, 25 bp, Homo sapien
aggcgctactaggaacggtaacctg

SEQ ID NO: 59035 - DNA, 25 bp, Homo sapien
ggtaagctagcgaccacctggactt

SEQ ID NO: 59036 - DNA, 25 bp, Homo sapien
gcgattttcccttgagcttccatgc

SEQ ID NO: 59037 - DNA, 25 bp, Homo sapien
tggggtcctcgatctacccagatta

SEQ ID NO: 59038 - DNA, 25 bp, Homo sapien
ctctggatctgtaccgcgagaaatc

SEQ ID NO: 59039 - DNA, 25 bp, Homo sapien
ctcgccctaggcttagcgatggcta

SEQ ID NO: 59040 - DNA, 25 bp, Homo sapien
cgatggctaaaaaccggctgggata

SEQ ID NO: 59041 - DNA, 25 bp, Homo sapien
acctcccgaaatgagtgcttcctgc

SEQ ID NO: 59042 - DNA, 25 bp, Homo sapien
tgcgggcccttagcctagctacgca

SEQ ID NO: 59043 - DNA, 25 bp, Homo sapien
ctttcgccttgatggatttcttttc

SEQ ID NO: 59044 - DNA, 25 bp, Homo sapien
agtcgccggcgcaaatgccaagtca

SEQ ID NO: 59045 - DNA, 25 bp, Homo sapien
caagtcaccggtaggagacacaaca

SEQ ID NO: 59046 - DNA, 25 bp, Homo sapien
cacaacagaggcgatgacctgaatc

SEQ ID NO: 59047 - DNA, 25 bp, Homo sapien
acctgaatccgcacgtggcctggtt

SEQ ID NO: 59048 - DNA, 25 bp, Homo sapien
ctggttcgcctggaagctgccaaag

SEQ ID NO: 59049 - DNA, 25 bp, Homo sapien
cagcaagcagcacgtgtcccaggca

SEQ ID NO: 59050 - DNA, 25 bp, Homo sapien
atcgggccagaaaatacggatgtcc

SEQ ID NO: 59051 - DNA, 25 bp, Homo sapien
ggcggtgtatctgcctaaagctgta

SEQ ID NO: 59052 - DNA, 25 bp, Homo sapien
ggtcgcattgaaagtggtctctcca

SEQ ID NO: 59053 - DNA, 25 bp, Homo sapien
tctctccaccttgaggggttttgcc

SEQ ID NO: 59054 - DNA, 25 bp, Homo sapien
tgccctgagatgtcataacggattc

SEQ ID NO: 59055 - DNA, 25 bp, Homo sapien
gaggcctcactttcctggctacatt

SEQ ID NO: 59056 - DNA, 25 bp, Homo sapien
tccctgcatttctggggctctgtcc

SEQ ID NO: 59057 - DNA, 25 bp, Homo sapien
aaaggattgcctggagccctccatg

SEQ ID NO: 59058 - DNA, 25 bp, Homo sapien
tggtccctcagctgcaccggactga

SEQ ID NO: 59059 - DNA, 25 bp, Homo sapien
gggctgttcatcatcggttaccgcc

SEQ ID NO: 59060 - DNA, 25 bp, Homo sapien
cgtcggcacagccttaggagctgca

SEQ ID NO: 59061 - DNA, 25 bp, Homo sapien
gtccgtgggccgtgattcccactca

SEQ ID NO: 59062 - DNA, 25 bp, Homo sapien
gaccgctcagcacgcgctgcttata

SEQ ID NO: 59063 - DNA, 25 bp, Homo sapien
aaactcccgcgctgtgcattcaggg

SEQ ID NO: 59064 - DNA, 25 bp, Homo sapien
caggcggtcactcctgggcctgaaa

SEQ ID NO: 59065 - DNA, 25 bp, Homo sapien
tgcttataaatcaggggtgcgcttc

SEQ ID NO: 59066 - DNA, 25 bp, Homo sapien
tgcggctcccacactcaccgcgctc

SEQ ID NO: 59067 - DNA, 25 bp, Homo sapien
cctgtcccggccttctggaattgct

SEQ ID NO: 59068 - DNA, 25 bp, Homo sapien
cccggccttctggaattgctgaacc

SEQ ID NO: 59069 - DNA, 25 bp, Homo sapien
ttctggaattgctgaaccctgcggg

SEQ ID NO: 59070 - DNA, 25 bp, Homo sapien
ggcccggctgagtttgttcatttat

SEQ ID NO: 59071 - DNA, 25 bp, Homo sapien
ccggctgagtttgttcatttatgga

SEQ ID NO: 59072 - DNA, 25 bp, Homo sapien
aggcgcagcgtctcgtccctgccgt

SEQ ID NO: 59073 - DNA, 25 bp, Homo sapien
agtttgttcatttatggaaacgctc

SEQ ID NO: 59074 - DNA, 25 bp, Homo sapien
gcgggaacgcgtctgcataaatcta

SEQ ID NO: 59075 - DNA, 25 bp, Homo sapien
ctccaaagtggtgactgtgaaggca

SEQ ID NO: 59076 - DNA, 25 bp, Homo sapien
gggacaaccttgctctttttccgca

SEQ ID NO: 59077 - DNA, 25 bp, Homo sapien
gcgcatttctgttctctcgcgagca

SEQ ID NO: 59078 - DNA, 25 bp, Homo sapien
ctgcggcggcaggtgttaaatcacc

SEQ ID NO: 59079 - DNA, 25 bp, Homo sapien
gagggctaccacgttctgcgggtaa

SEQ ID NO: 59080 - DNA, 25 bp, Homo sapien
gcagcctttgcgctttcctaggaga

SEQ ID NO: 59081 - DNA, 25 bp, Homo sapien
gtcccaagtgctacgcggaggatta

SEQ ID NO: 59082 - DNA, 25 bp, Homo sapien
gcaaagttccctgccgcgccgggaa

SEQ ID NO: 59083 - DNA, 25 bp, Homo sapien
ccatcctgcccagaaccttatcctc

SEQ ID NO: 59084 - DNA, 25 bp, Homo sapien
catcctgcccagaaccttatcctca

SEQ ID NO: 59085 - DNA, 25 bp, Homo sapien
atcctgcccagaaccttatcctcac

SEQ ID NO: 59086 - DNA, 25 bp, Homo sapien
acgcaggtcaggcatttctgcttcc

SEQ ID NO: 59087 - DNA, 25 bp, Homo sapien
tccgacacgaccctctctcctcccg

SEQ ID NO: 59088 - DNA, 25 bp, Homo sapien
caaagttccctgccgcgccgggaag

SEQ ID NO: 59089 - DNA, 25 bp, Homo sapien
cgcaggtcaggcatttctgcttcct

SEQ ID NO: 59090 - DNA, 25 bp, Homo sapien
gctaagcctcgtggccatcgcactg

SEQ ID NO: 59091 - DNA, 25 bp, Homo sapien
tgtccggactactcatggtgcccta

SEQ ID NO: 59092 - DNA, 25 bp, Homo sapien
ccatcgcactggagcggtacagcgc

SEQ ID NO: 59093 - DNA, 25 bp, Homo sapien
gccgaccactgcaggcacgagtgtg

SEQ ID NO: 59094 - DNA, 25 bp, Homo sapien
cacgcggctcgcgtgattgtagcca

SEQ ID NO: 59095 - DNA, 25 bp, Homo sapien
cccgtgtacactgtcgtgcaaccag

SEQ ID NO: 59096 - DNA, 25 bp, Homo sapien
cctcgtgtgctgcagtgcgtgcatc

SEQ ID NO: 59097 - DNA, 25 bp, Homo sapien
acgagtgtggcagacgcgctcccac

SEQ ID NO: 59098 - DNA, 25 bp, Homo sapien
tgagaaaccctcagacgccgtggaa

SEQ ID NO: 59099 - DNA, 25 bp, Homo sapien
tgaatccacgtaggtctgcccggtc

SEQ ID NO: 59100 - DNA, 25 bp, Homo sapien
gttcctggaacgacattcacctttg

SEQ ID NO: 59101 - DNA, 25 bp, Homo sapien
atctcagacccagtgcggaaacgtg

SEQ ID NO: 59102 - DNA, 25 bp, Homo sapien
caggtgtcccgaatccaaaagcatc

SEQ ID NO: 59103 - DNA, 25 bp, Homo sapien
tcccactgcgctgcctgtaaattag

SEQ ID NO: 59104 - DNA, 25 bp, Homo sapien
gacacccttcggtggctgagaaacc

SEQ ID NO: 59105 - DNA, 25 bp, Homo sapien
atctgatgtgaaggcaaatctctcc

SEQ ID NO: 59106 - DNA, 25 bp, Homo sapien
tcaagctactttctgggaacccgac

SEQ ID NO: 59107 - DNA, 25 bp, Homo sapien
ctccaaacttccactgctactttgg

SEQ ID NO: 59108 - DNA, 25 bp, Homo sapien
cgccacccgcgaaccaccatccaca

SEQ ID NO: 59109 - DNA, 25 bp, Homo sapien
ggacactcatcaagctactttctgg

SEQ ID NO: 59110 - DNA, 25 bp, Homo sapien
accggcacccgcctccgtcatggcg

SEQ ID NO: 59111 - DNA, 25 bp, Homo sapien
ctgctactttggacactcatcaagc

SEQ ID NO: 59112 - DNA, 25 bp, Homo sapien
gcggcggtgcttaccttccctgggc

SEQ ID NO: 59113 - DNA, 25 bp, Homo sapien
ggcctcgcgtccacctcgccaccat

SEQ ID NO: 59114 - DNA, 25 bp, Homo sapien
cgtacctttagcacgggacgctgct

SEQ ID NO: 59115 - DNA, 25 bp, Homo sapien
gggatccctaagtgcagggcgcaca

SEQ ID NO: 59116 - DNA, 25 bp, Homo sapien
gcagcacagagaagcgcgcccgcaa

SEQ ID NO: 59117 - DNA, 25 bp, Homo sapien
cacgaggcactaggaactacatttc

SEQ ID NO: 59118 - DNA, 25 bp, Homo sapien
gcagatcgaaaagggagtgcttctt

SEQ ID NO: 59119 - DNA, 25 bp, Homo sapien
ttctctccgcgctctggcggtgcaa

SEQ ID NO: 59120 - DNA, 25 bp, Homo sapien
gaaagtctgggcctcgaaattcgaa

SEQ ID NO: 59121 - DNA, 25 bp, Homo sapien
aagcccaacgtgtgcagccggctga

SEQ ID NO: 59122 - DNA, 25 bp, Homo sapien
atcccacaaagcaaaccactgtgtg

SEQ ID NO: 59123 - DNA, 25 bp, Homo sapien
ctgtgtgcagcttattacgactttc

SEQ ID NO: 59124 - DNA, 25 bp, Homo sapien
acgactttctgttagcatactggac

SEQ ID NO: 59125 - DNA, 25 bp, Homo sapien
ctgtacagctgcatcggctgctcca

SEQ ID NO: 59126 - DNA, 25 bp, Homo sapien
ggatcctcagaagagcagcatactg

SEQ ID NO: 59127 - DNA, 25 bp, Homo sapien
gagcagcatactggacttctgtatg

SEQ ID NO: 59128 - DNA, 25 bp, Homo sapien
tcaaaagacagatggcatctagggc

SEQ ID NO: 59129 - DNA, 25 bp, Homo sapien
atgcaacattattttgtggaagttc

SEQ ID NO: 59130 - DNA, 25 bp, Homo sapien
cggaaacactttcgcctcagccttt

SEQ ID NO: 59131 - DNA, 25 bp, Homo sapien
cccgacttgtttatgtggcagaaga

SEQ ID NO: 59132 - DNA, 25 bp, Homo sapien
ctgcccagtcattggacggtcttga

SEQ ID NO: 59133 - DNA, 25 bp, Homo sapien
aactcagtcgagtccgggaagctgc

SEQ ID NO: 59134 - DNA, 25 bp, Homo sapien
ccggagcgagaatttgcccgtattt

SEQ ID NO: 59135 - DNA, 25 bp, Homo sapien
gtcaccggcttcgtcttcatccagg

SEQ ID NO: 59136 - DNA, 25 bp, Homo sapien
ctccactaccgagaggggcttggct

SEQ ID NO: 59137 - DNA, 25 bp, Homo sapien
tttgtaacatcctcggccctgggta

SEQ ID NO: 59138 - DNA, 25 bp, Homo sapien
cggcttggcagttcctgctgacatc

SEQ ID NO: 59139 - DNA, 25 bp, Homo sapien
tctcgatcgtgtcagtttgtaaggc

SEQ ID NO: 59140 - DNA, 25 bp, Homo sapien
ccggcttctgctttacgacaggtaa

SEQ ID NO: 59141 - DNA, 25 bp, Homo sapien
ccttttatttctgggagcgacctcg

SEQ ID NO: 59142 - DNA, 25 bp, Homo sapien
aggggctacaattcctcgcagcagg

SEQ ID NO: 59143 - DNA, 25 bp, Homo sapien
cgcccatccctctttgtgtgctttg

SEQ ID NO: 59144 - DNA, 25 bp, Homo sapien
ctcgttctggtgaggctatttgtcc

SEQ ID NO: 59145 - DNA, 25 bp, Homo sapien
atttgtccctaagctctcgccgtag

SEQ ID NO: 59146 - DNA, 25 bp, Homo sapien
gcgtggttgccacagctaggtcgcc

SEQ ID NO: 59147 - DNA, 25 bp, Homo sapien
ccatgctgtgctcggaagccgggga

SEQ ID NO: 59148 - DNA, 25 bp, Homo sapien
ccgcgcgcgtccctatgcaaatgaa

SEQ ID NO: 59149 - DNA, 25 bp, Homo sapien
gcgcgtccctatgcaaatgaactcg

SEQ ID NO: 59150 - DNA, 25 bp, Homo sapien
cgccgcgtggttgccacagctaggt

SEQ ID NO: 59151 - DNA, 25 bp, Homo sapien
tatgcaaatgaactcggggcgcgcc

SEQ ID NO: 59152 - DNA, 25 bp, Homo sapien
acggggaaaacaagcgcgacccatg

SEQ ID NO: 59153 - DNA, 25 bp, Homo sapien
aagcgcgacccatgggatcccgacg

SEQ ID NO: 59154 - DNA, 25 bp, Homo sapien
tatgtcagactgtgcggtcacttcc

SEQ ID NO: 59155 - DNA, 25 bp, Homo sapien
ccgcctagaactttcgggctgtagc

SEQ ID NO: 59156 - DNA, 25 bp, Homo sapien
cgggttgattcgtccttcctcagcc

SEQ ID NO: 59157 - DNA, 25 bp, Homo sapien
ccgcgggtgatcgtagctcggaaat

SEQ ID NO: 59158 - DNA, 25 bp, Homo sapien
acggcattcgcagtggctaggcaac

SEQ ID NO: 59159 - DNA, 25 bp, Homo sapien
ggtggtgacaatgcccgcctagaac

SEQ ID NO: 59160 - DNA, 25 bp, Homo sapien
tcctggacacgcctcctttaattgg

SEQ ID NO: 59161 - DNA, 25 bp, Homo sapien
tttaattggctaacgtcacgctggg

SEQ ID NO: 59162 - DNA, 25 bp, Homo sapien
tcactaggtacgcacccgggtccaa

SEQ ID NO: 59163 - DNA, 25 bp, Homo sapien
aaagggatgcgcacccgcgctcaga

SEQ ID NO: 59164 - DNA, 25 bp, Homo sapien
gtgtttacgaacacacgcaggcaca

SEQ ID NO: 59165 - DNA, 25 bp, Homo sapien
cgactgtactttcagtgtttacgaa

SEQ ID NO: 59166 - DNA, 25 bp, Homo sapien
gtccacctgctcgtccgcagaggta

SEQ ID NO: 59167 - DNA, 25 bp, Homo sapien
ctcgacgcctcagggcttcggcagg

SEQ ID NO: 59168 - DNA, 25 bp, Homo sapien
ggttcgcacggttgctcactaggta

SEQ ID NO: 59169 - DNA, 25 bp, Homo sapien
tctcggcgcacacgactgtactttc

SEQ ID NO: 59170 - DNA, 25 bp, Homo sapien
gcctcccgtgcagaccaatggtgga

SEQ ID NO: 59171 - DNA, 25 bp, Homo sapien
cgcgctaaccttggcctgagacctg

SEQ ID NO: 59172 - DNA, 25 bp, Homo sapien
atgcagatgtcaaaacgcgcgctca

SEQ ID NO: 59173 - DNA, 25 bp, Homo sapien
ttccgccaggaatcccgacgcttag

SEQ ID NO: 59174 - DNA, 25 bp, Homo sapien
agcgagaccctcgtctgtttactta

SEQ ID NO: 59175 - DNA, 25 bp, Homo sapien
gatggcgacttcacccggcctttaa

SEQ ID NO: 59176 - DNA, 25 bp, Homo sapien
cggcctttaacaacacgtacgcatc

SEQ ID NO: 59177 - DNA, 25 bp, Homo sapien
cagccttttggaagtcgcgctaacc

SEQ ID NO: 59178 - DNA, 25 bp, Homo sapien
tgcctggaaacttgcgctcgctgct

SEQ ID NO: 59179 - DNA, 25 bp, Homo sapien
ttcatgcaccgtcgctttcgccagg

SEQ ID NO: 59180 - DNA, 25 bp, Homo sapien
ttcacttgctgagctacgcctcggc

SEQ ID NO: 59181 - DNA, 25 bp, Homo sapien
cgggtgctcctatctccttcattca

SEQ ID NO: 59182 - DNA, 25 bp, Homo sapien
gtgccaacacgtggcgcgcctttga

SEQ ID NO: 59183 - DNA, 25 bp, Homo sapien
tgccagtttatagtgccaacacgtg

SEQ ID NO: 59184 - DNA, 25 bp, Homo sapien
acccaggccaagctgctggctaaga

SEQ ID NO: 59185 - DNA, 25 bp, Homo sapien
agcgatggctgctacgtgcaacttc

SEQ ID NO: 59186 - DNA, 25 bp, Homo sapien
caaatcctggccctggactcggttt

SEQ ID NO: 59187 - DNA, 25 bp, Homo sapien
gcgcagttcgagcacacggttctga

SEQ ID NO: 59188 - DNA, 25 bp, Homo sapien
gcgtggctcctgatagcgtttggaa

SEQ ID NO: 59189 - DNA, 25 bp, Homo sapien
ggaactcggatctgaagccctgctg

SEQ ID NO: 59190 - DNA, 25 bp, Homo sapien
cacggttctgatcacgtcgaggggc

SEQ ID NO: 59191 - DNA, 25 bp, Homo sapien
gggcgcgcagatcctgaccaaacta

SEQ ID NO: 59192 - DNA, 25 bp, Homo sapien
tggctggagaacttttagaagaaac

SEQ ID NO: 59193 - DNA, 25 bp, Homo sapien
aaatgaccggtggtgcggtaacctg

SEQ ID NO: 59194 - DNA, 25 bp, Homo sapien
caggagccgcaaacgtcagctgttc

SEQ ID NO: 59195 - DNA, 25 bp, Homo sapien
cgcatttgagagcaagggcctactt

SEQ ID NO: 59196 - DNA, 25 bp, Homo sapien
agcttgcgagttgagctccagttcg

SEQ ID NO: 59197 - DNA, 25 bp, Homo sapien
gtgggcggtctagtctctaaaatga

SEQ ID NO: 59198 - DNA, 25 bp, Homo sapien
cccaggtgtgaacagtggctgatta

SEQ ID NO: 59199 - DNA, 25 bp, Homo sapien
ctgcactaggaattcgagcttgggc

SEQ ID NO: 59200 - DNA, 25 bp, Homo sapien
gcacgctagaccgtttgctgcacta

SEQ ID NO: 59201 - DNA, 25 bp, Homo sapien
agactggcccttctcgcatcgggac

SEQ ID NO: 59202 - DNA, 25 bp, Homo sapien
ccaccttgcaagtctctggaataca

SEQ ID NO: 59203 - DNA, 25 bp, Homo sapien
tgcgacacagaaatcaggacgagcc

SEQ ID NO: 59204 - DNA, 25 bp, Homo sapien
caggcactaggaaggagcaattaaa

SEQ ID NO: 59205 - DNA, 25 bp, Homo sapien
gtggcactccataccctaaaacagg

SEQ ID NO: 59206 - DNA, 25 bp, Homo sapien
ccggcagtatccgagcgactgtgct

SEQ ID NO: 59207 - DNA, 25 bp, Homo sapien
ccgcggcgatcacttacttgggcaa

SEQ ID NO: 59208 - DNA, 25 bp, Homo sapien
ctggaatacactgtccctaggcggc

SEQ ID NO: 59209 - DNA, 25 bp, Homo sapien
cctgagctccgggaattaccaattc

SEQ ID NO: 59210 - DNA, 25 bp, Homo sapien
ctcaggaggccggaaaatgaccacc

SEQ ID NO: 59211 - DNA, 25 bp, Homo sapien
gctttaatcagacccgtgcagcctc

SEQ ID NO: 59212 - DNA, 25 bp, Homo sapien
gctgcgctaggcacaaggctcttag

SEQ ID NO: 59213 - DNA, 25 bp, Homo sapien
agaacctctgtctgttggccgcctc

SEQ ID NO: 59214 - DNA, 25 bp, Homo sapien
aagtgtggatgcgtcttacccgagg

SEQ ID NO: 59215 - DNA, 25 bp, Homo sapien
ctccacgcgcactgctttaatcaga

SEQ ID NO: 59216 - DNA, 25 bp, Homo sapien
aggctcttaggagaacctctgtctg

SEQ ID NO: 59217 - DNA, 25 bp, Homo sapien
tagctctgcgccgaactgagtggca

SEQ ID NO: 59218 - DNA, 25 bp, Homo sapien
actcgctctcggctgttcgcactaa

SEQ ID NO: 59219 - DNA, 25 bp, Homo sapien
tgtgactaatcactcggggcctggg

SEQ ID NO: 59220 - DNA, 25 bp, Homo sapien
tctgtccctggacaatctgattagg

SEQ ID NO: 59221 - DNA, 25 bp, Homo sapien
tctgtcactgctctcggtatcccga

SEQ ID NO: 59222 - DNA, 25 bp, Homo sapien
cttcatttgttgctcgctgggactc

SEQ ID NO: 59223 - DNA, 25 bp, Homo sapien
tttgggactcacacagactcaggta

SEQ ID NO: 59224 - DNA, 25 bp, Homo sapien
actcagtacctagctctgccggaga

SEQ ID NO: 59225 - DNA, 25 bp, Homo sapien
ttgcaggctttgaaccggaggttcc

SEQ ID NO: 59226 - DNA, 25 bp, Homo sapien
ctaactcttcatccgggaagggctc

SEQ ID NO: 59227 - DNA, 25 bp, Homo sapien
cgcaccaagaagctatgcagcaacc

SEQ ID NO: 59228 - DNA, 25 bp, Homo sapien
catccatcccgtccggaaaagaagg

SEQ ID NO: 59229 - DNA, 25 bp, Homo sapien
gtggtacccttcagcgcaccaagaa

SEQ ID NO: 59230 - DNA, 25 bp, Homo sapien
aacttatgtgaggttgcccgcccgt

SEQ ID NO: 59231 - DNA, 25 bp, Homo sapien
gctcaggaggaaacgcgggctccta

SEQ ID NO: 59232 - DNA, 25 bp, Homo sapien
ggctggaaccctaactcttcatccg

SEQ ID NO: 59233 - DNA, 25 bp, Homo sapien
cagctacacatcgtggtacccttca

SEQ ID NO: 59234 - DNA, 25 bp, Homo sapien
ccgcagggcggaatgtaacatcttg

SEQ ID NO: 59235 - DNA, 25 bp, Homo sapien
cacagggcggatattcacaattttc

SEQ ID NO: 59236 - DNA, 25 bp, Homo sapien
catcagtctgggatcgttacacagg

SEQ ID NO: 59237 - DNA, 25 bp, Homo sapien
taggatcctgctagaggccgccagt

SEQ ID NO: 59238 - DNA, 25 bp, Homo sapien
ttgcactcgagttttactgcccgta

SEQ ID NO: 59239 - DNA, 25 bp, Homo sapien
gggcttcttgctcccggacattgtt

SEQ ID NO: 59240 - DNA, 25 bp, Homo sapien
ggggaccacttcagagcttctcttt

SEQ ID NO: 59241 - DNA, 25 bp, Homo sapien
aagccactggtggtcgctgttccat

SEQ ID NO: 59242 - DNA, 25 bp, Homo sapien
agctctcagttcagtcccgaagggc

SEQ ID NO: 59243 - DNA, 25 bp, Homo sapien
tgagctctgagcacgtgactgaccg

SEQ ID NO: 59244 - DNA, 25 bp, Homo sapien
tcaggctgctgcagagctcaggtcc

SEQ ID NO: 59245 - DNA, 25 bp, Homo sapien
gggtgactcacagagctctcagttc

SEQ ID NO: 59246 - DNA, 25 bp, Homo sapien
agccagccatgcctcccgagggtga

SEQ ID NO: 59247 - DNA, 25 bp, Homo sapien
gtcggcttgcattccagagcagcca

SEQ ID NO: 59248 - DNA, 25 bp, Homo sapien
tgtaaacgtagctctcggccggctg

SEQ ID NO: 59249 - DNA, 25 bp, Homo sapien
gcagcctcggaaagatgtaaacgta

SEQ ID NO: 59250 - DNA, 25 bp, Homo sapien
gctcgctccggcaaggccaagtatt

SEQ ID NO: 59251 - DNA, 25 bp, Homo sapien
ccaggactgctggtgtacgtgcact

SEQ ID NO: 59252 - DNA, 25 bp, Homo sapien
gctccctggggaggtaattgccaaa

SEQ ID NO: 59253 - DNA, 25 bp, Homo sapien
gtaagaacagcgcaacccaggggtc

SEQ ID NO: 59254 - DNA, 25 bp, Homo sapien
tggcttcccgttcactatccgaatt

SEQ ID NO: 59255 - DNA, 25 bp, Homo sapien
ttgagtcttttggaaacgccgctga

SEQ ID NO: 59256 - DNA, 25 bp, Homo sapien
gagggccagttatttcacccgctta

SEQ ID NO: 59257 - DNA, 25 bp, Homo sapien
ggcgcaggcctggaaatccttaaaa

SEQ ID NO: 59258 - DNA, 25 bp, Homo sapien
gctattgggcgtcctccgctgcaca

SEQ ID NO: 59259 - DNA, 25 bp, Homo sapien
cacagaaagccagcccagttgggta

SEQ ID NO: 59260 - DNA, 25 bp, Homo sapien
agtagctctaggaacctgcgctttc

SEQ ID NO: 59261 - DNA, 25 bp, Homo sapien
gatgcctcctgtcggcagggagcta

SEQ ID NO: 59262 - DNA, 25 bp, Homo sapien
tcacagtctcgtcgagggtcccgga

SEQ ID NO: 59263 - DNA, 25 bp, Homo sapien
tggtccaagaggcaatgccagtttc

SEQ ID NO: 59264 - DNA, 25 bp, Homo sapien
caatgccagtttcggtacctttgtg

SEQ ID NO: 59265 - DNA, 25 bp, Homo sapien
gcgctttgctctgccgggctattgg

SEQ ID NO: 59266 - DNA, 25 bp, Homo sapien
tggctgggactcagaccaaattctg

SEQ ID NO: 59267 - DNA, 25 bp, Homo sapien
gcagcccgaaactcactccttaatt

SEQ ID NO: 59268 - DNA, 25 bp, Homo sapien
gaaaccttttacctccgcagccaga

SEQ ID NO: 59269 - DNA, 25 bp, Homo sapien
aaagcgctggctgggacttcaccct

SEQ ID NO: 59270 - DNA, 25 bp, Homo sapien
cgtgcgaactgcaaaacgctgtaaa

SEQ ID NO: 59271 - DNA, 25 bp, Homo sapien
tgcccgcagtcacggaatgcccttt

SEQ ID NO: 59272 - DNA, 25 bp, Homo sapien
ccaaattctgcggacgtggcctgag

SEQ ID NO: 59273 - DNA, 25 bp, Homo sapien
tgtgacggacacagcactgatcctg

SEQ ID NO: 59274 - DNA, 25 bp, Homo sapien
cttggtcgacaaggagaacacggtg

SEQ ID NO: 59275 - DNA, 25 bp, Homo sapien
tgcgcttgaaaatcgcgcgcggccc

SEQ ID NO: 59276 - DNA, 25 bp, Homo sapien
cacggatcgaaagggtcgcagcaac

SEQ ID NO: 59277 - DNA, 25 bp, Homo sapien
caggagcgttttccaggcctttgca

SEQ ID NO: 59278 - DNA, 25 bp, Homo sapien
gctcctcacgcaatcctaaacggtt

SEQ ID NO: 59279 - DNA, 25 bp, Homo sapien
gccgcattgtttcctcagctgttca

SEQ ID NO: 59280 - DNA, 25 bp, Homo sapien
tttgcaccaacctcgttggctaagc

SEQ ID NO: 59281 - DNA, 25 bp, Homo sapien
cagcaagaccgcgaggaggatcttc

SEQ ID NO: 59282 - DNA, 25 bp, Homo sapien
gccagctccgcggaacagattggaa

SEQ ID NO: 59283 - DNA, 25 bp, Homo sapien
cccgggaagattcctgaacagactc

SEQ ID NO: 59284 - DNA, 25 bp, Homo sapien
gaacagactcgagcctctgcggaga

SEQ ID NO: 59285 - DNA, 25 bp, Homo sapien
acctgatgttttgttcccgctggga

SEQ ID NO: 59286 - DNA, 25 bp, Homo sapien
aagttatctttgctccctgctgggg

SEQ ID NO: 59287 - DNA, 25 bp, Homo sapien
tcatcggttactcgacgcttccagc

SEQ ID NO: 59288 - DNA, 25 bp, Homo sapien
cccaggggcttgaaccgaaatcatc

SEQ ID NO: 59289 - DNA, 25 bp, Homo sapien
gaaggcggcaccacacttacttctc

SEQ ID NO: 59290 - DNA, 25 bp, Homo sapien
gacagctctttcagaccgcagcgaa

SEQ ID NO: 59291 - DNA, 25 bp, Homo sapien
tcgcactgtggccttaggaatgtgg

SEQ ID NO: 59292 - DNA, 25 bp, Homo sapien
cacgtcccggggctaggatcttgcc

SEQ ID NO: 59293 - DNA, 25 bp, Homo sapien
tcacggaaacgggtggtcctcgcgc

SEQ ID NO: 59294 - DNA, 25 bp, Homo sapien
ctcggacggcacgaacgagcggacc

SEQ ID NO: 59295 - DNA, 25 bp, Homo sapien
gctgacctgcaccacccttggggaa

SEQ ID NO: 59296 - DNA, 25 bp, Homo sapien
ccacagacggctcggacggcacgaa

SEQ ID NO: 59297 - DNA, 25 bp, Homo sapien
cgcagcgaagtttgcacacacgaca

SEQ ID NO: 59298 - DNA, 25 bp, Homo sapien
gcctggagataacaggaccactttg

SEQ ID NO: 59299 - DNA, 25 bp, Homo sapien
tctccggcttcaaagacaaaaggca

SEQ ID NO: 59300 - DNA, 25 bp, Homo sapien
taataatccattgtcggtctccggc

SEQ ID NO: 59301 - DNA, 25 bp, Homo sapien
cagctgcggagcaatcgttatgttt

SEQ ID NO: 59302 - DNA, 25 bp, Homo sapien
tgacgagttctgcaaataacagctg

SEQ ID NO: 59303 - DNA, 25 bp, Homo sapien
gctcaacggcagcatcggcagcatc

SEQ ID NO: 59304 - DNA, 25 bp, Homo sapien
ttcctcttctggcagcgagtgcgac

SEQ ID NO: 59305 - DNA, 25 bp, Homo sapien
cagcatcgagaaaggtgacgagttc

SEQ ID NO: 59306 - DNA, 25 bp, Homo sapien
ccaggatggtctaggcctttcccaa

SEQ ID NO: 59307 - DNA, 25 bp, Homo sapien
ttcaacttggacactcgggaggaca

SEQ ID NO: 59308 - DNA, 25 bp, Homo sapien
agctgtgcttgctctacctgtcggc

SEQ ID NO: 59309 - DNA, 25 bp, Homo sapien
tctccagagaacaacgggctcattc

SEQ ID NO: 59310 - DNA, 25 bp, Homo sapien
tggcacgctttgctgagcttcacgt

SEQ ID NO: 59311 - DNA, 25 bp, Homo sapien
ccggcgtcctcgtcacttgataaaa

SEQ ID NO: 59312 - DNA, 25 bp, Homo sapien
acaagcggctgtgagttcccagacc

SEQ ID NO: 59313 - DNA, 25 bp, Homo sapien
cgctggccatgcactggcaactgca

SEQ ID NO: 59314 - DNA, 25 bp, Homo sapien
ttgttgaaaacaaaccagctgggcc

SEQ ID NO: 59315 - DNA, 25 bp, Homo sapien
gcgtttctggaacgcgctcgcagca

SEQ ID NO: 59316 - DNA, 25 bp, Homo sapien
tcgcagcacgacaccgcggtgtgtg

SEQ ID NO: 59317 - DNA, 25 bp, Homo sapien
tcccatcacccgacgtgtacgggga

SEQ ID NO: 59318 - DNA, 25 bp, Homo sapien
aaacctggcgtactggctgtggctt

SEQ ID NO: 59319 - DNA, 25 bp, Homo sapien
cttctctagcgggactcggcatgag

SEQ ID NO: 59320 - DNA, 25 bp, Homo sapien
aggtggacttctacgcgcgcttctc

SEQ ID NO: 59321 - DNA, 25 bp, Homo sapien
cgtgtggctttgaccgtattgttga

SEQ ID NO: 59322 - DNA, 25 bp, Homo sapien
gagtggatcgcctgcctggataaaa

SEQ ID NO: 59323 - DNA, 25 bp, Homo sapien
tgaggtcctcgtccgggagacagga

SEQ ID NO: 59324 - DNA, 25 bp, Homo sapien
acgcagcggacacctgtcgcaggtg

SEQ ID NO: 59325 - DNA, 25 bp, Homo sapien
cctggataaaaggtagctcgccggg

SEQ ID NO: 59326 - DNA, 25 bp, Homo sapien
caggaggacaaggatccccgcctct

SEQ ID NO: 59327 - DNA, 25 bp, Homo sapien
tgcctggataaaaggtagctcgccg

SEQ ID NO: 59328 - DNA, 25 bp, Homo sapien
gctcaacatggtcgctgcgcacgct

SEQ ID NO: 59329 - DNA, 25 bp, Homo sapien
agggacgcagcggacacctgtcgca

SEQ ID NO: 59330 - DNA, 25 bp, Homo sapien
gaggagggacgacgaacttctgctt

SEQ ID NO: 59331 - DNA, 25 bp, Homo sapien
tgctgttgccgtgactgtcttcctc

SEQ ID NO: 59332 - DNA, 25 bp, Homo sapien
cccaaatcagggtagggtgcaggcc

SEQ ID NO: 59333 - DNA, 25 bp, Homo sapien
cggtcccatggagaagttggcgcct

SEQ ID NO: 59334 - DNA, 25 bp, Homo sapien
tcaactcctaactgcagcggaaacg

SEQ ID NO: 59335 - DNA, 25 bp, Homo sapien
tgcagagaggcggaatgttcaactc

SEQ ID NO: 59336 - DNA, 25 bp, Homo sapien
tgtcttcctcattggcgccgtgcag

SEQ ID NO: 59337 - DNA, 25 bp, Homo sapien
gcttttctaagaactcgaccgcgag

SEQ ID NO: 59338 - DNA, 25 bp, Homo sapien
ttgagtcgtttgcaggatggctagc

SEQ ID NO: 59339 - DNA, 25 bp, Homo sapien
ggtcaaagcgttcgccgaccatttg

SEQ ID NO: 59340 - DNA, 25 bp, Homo sapien
acgcagtgtgaagcgaccgtagtcc

SEQ ID NO: 59341 - DNA, 25 bp, Homo sapien
ttgcgaaccggtctcctagaacttg

SEQ ID NO: 59342 - DNA, 25 bp, Homo sapien
cctgattttgtgcacctgggataac

SEQ ID NO: 59343 - DNA, 25 bp, Homo sapien
ccagcgcgtctgaggtttaaggtct

SEQ ID NO: 59344 - DNA, 25 bp, Homo sapien
agacgcgtccgcttctaaccgctga

SEQ ID NO: 59345 - DNA, 25 bp, Homo sapien
ctggaaagccctaggcacgtgcgtc

SEQ ID NO: 59346 - DNA, 25 bp, Homo sapien
cccgccgccttacacatggtgagga

SEQ ID NO: 59347 - DNA, 25 bp, Homo sapien
gtcatagtgtgtttagggcacctca

SEQ ID NO: 59348 - DNA, 25 bp, Homo sapien
tcggctttacgtaccggtcatagtg

SEQ ID NO: 59349 - DNA, 25 bp, Homo sapien
gcaagggttgctctctcggctttac

SEQ ID NO: 59350 - DNA, 25 bp, Homo sapien
tatccacgtccaaggcagccatttc

SEQ ID NO: 59351 - DNA, 25 bp, Homo sapien
tttcacgggcttttcgggagctgca

SEQ ID NO: 59352 - DNA, 25 bp, Homo sapien
gcgggccgaagcgaaattactccca

SEQ ID NO: 59353 - DNA, 25 bp, Homo sapien
acagacactcggtcgcacacacggg

SEQ ID NO: 59354 - DNA, 25 bp, Homo sapien
aaggagacgtcttccaccgaccaca

SEQ ID NO: 59355 - DNA, 25 bp, Homo sapien
tacggagcgtcactccgccagagct

SEQ ID NO: 59356 - DNA, 25 bp, Homo sapien
cccgtgtaggaagcgcgacaatgcc

SEQ ID NO: 59357 - DNA, 25 bp, Homo sapien
tggagctccaaagcacgagcacggc

SEQ ID NO: 59358 - DNA, 25 bp, Homo sapien
cggtctggcagctattccgggaatc

SEQ ID NO: 59359 - DNA, 25 bp, Homo sapien
ctacagagaagggtaatcgggtgtc

SEQ ID NO: 59360 - DNA, 25 bp, Homo sapien
cgcggagcagtcagccgactacaga

SEQ ID NO: 59361 - DNA, 25 bp, Homo sapien
cgccaccgagagatcagctgtcaga

SEQ ID NO: 59362 - DNA, 25 bp, Homo sapien
tcacgctgcccttcgacgggagaaa

SEQ ID NO: 59363 - DNA, 25 bp, Homo sapien
ggtgcctccggctgcgcagtaagaa

SEQ ID NO: 59364 - DNA, 25 bp, Homo sapien
ctgcgcagtaagaagccgaggttca

SEQ ID NO: 59365 - DNA, 25 bp, Homo sapien
acgggagaaactgccggcggcctca

SEQ ID NO: 59366 - DNA, 25 bp, Homo sapien
gcgtggcttggccacgctccgaagc

SEQ ID NO: 59367 - DNA, 25 bp, Homo sapien
ccgcaaacccacgtgtgagaggctc

SEQ ID NO: 59368 - DNA, 25 bp, Homo sapien
agaagccgaggttcacgctgccctt

SEQ ID NO: 59369 - DNA, 25 bp, Homo sapien
acgtgtgagaggctcccgcctctct

SEQ ID NO: 59370 - DNA, 25 bp, Homo sapien
ctcgtgggcatccatgtgtgcctta

SEQ ID NO: 59371 - DNA, 25 bp, Homo sapien
tgggtcgcctgtgagcttctgccaa

SEQ ID NO: 59372 - DNA, 25 bp, Homo sapien
ccttaggtgtgcacattttggactg

SEQ ID NO: 59373 - DNA, 25 bp, Homo sapien
tttggactgcgtttgtggaattgtg

SEQ ID NO: 59374 - DNA, 25 bp, Homo sapien
ttccttttgtctttctgggcggcga

SEQ ID NO: 59375 - DNA, 25 bp, Homo sapien
gcgtagcttaggagcctcgaggaca

SEQ ID NO: 59376 - DNA, 25 bp, Homo sapien
ccgcgtttctctgcgcggtggagtt

SEQ ID NO: 59377 - DNA, 25 bp, Homo sapien
tgtgtctttcgaatggcgtgtactc

SEQ ID NO: 59378 - DNA, 25 bp, Homo sapien
gggtgcctgcacaagcctcatcaaa

SEQ ID NO: 59379 - DNA, 25 bp, Homo sapien
cgcttggctcgcgttctgaagctta

SEQ ID NO: 59380 - DNA, 25 bp, Homo sapien
ccgcttaagagggtcaacgtgttct

SEQ ID NO: 59381 - DNA, 25 bp, Homo sapien
tccagcaggcgacccacattgcatt

SEQ ID NO: 59382 - DNA, 25 bp, Homo sapien
tgctcctcggggacaagtttccacg

SEQ ID NO: 59383 - DNA, 25 bp, Homo sapien
ggccgtcaaggaagatgaatgtctc

SEQ ID NO: 59384 - DNA, 25 bp, Homo sapien
ttgatcagatgcaggccagattgcc

SEQ ID NO: 59385 - DNA, 25 bp, Homo sapien
ctcatcaaaatcgagggcgtcctcc

SEQ ID NO: 59386 - DNA, 25 bp, Homo sapien
caagctttcccagctggactgcgga

SEQ ID NO: 59387 - DNA, 25 bp, Homo sapien
aggcgtaggccgatctcccgacgcg

SEQ ID NO: 59388 - DNA, 25 bp, Homo sapien
cagcgagagaaaggtcctgccggca

SEQ ID NO: 59389 - DNA, 25 bp, Homo sapien
ggagctctagtcttccgcttcggca

SEQ ID NO: 59390 - DNA, 25 bp, Homo sapien
cttctcggttctaggtctccgcttc

SEQ ID NO: 59391 - DNA, 25 bp, Homo sapien
tgggttacctgctcacgttcactcg

SEQ ID NO: 59392 - DNA, 25 bp, Homo sapien
cggggcgtctgaagtcaggcaaaca

SEQ ID NO: 59393 - DNA, 25 bp, Homo sapien
aggtctccgcttccgtctggctgcg

SEQ ID NO: 59394 - DNA, 25 bp, Homo sapien
agtcatttacttgccctgaaggagc

SEQ ID NO: 59395 - DNA, 25 bp, Homo sapien
atccctgacgttctagcccggcgaa

SEQ ID NO: 59396 - DNA, 25 bp, Homo sapien
tgtcgcgaacttggggcaacccacc

SEQ ID NO: 59397 - DNA, 25 bp, Homo sapien
ggtgtcacctccacgaagtcattta

SEQ ID NO: 59398 - DNA, 25 bp, Homo sapien
ctggaccgatgattccgcgagctct

SEQ ID NO: 59399 - DNA, 25 bp, Homo sapien
cgcgagctctgtaattatgcacaca

SEQ ID NO: 59400 - DNA, 25 bp, Homo sapien
gctggggccctgcatattgattaaa

SEQ ID NO: 59401 - DNA, 25 bp, Homo sapien
gcgccagattctgccgctcggaagt

SEQ ID NO: 59402 - DNA, 25 bp, Homo sapien
cgctccttccgaagtctcgctggaa

SEQ ID NO: 59403 - DNA, 25 bp, Homo sapien
taagctctttcttaggaagcggaga

SEQ ID NO: 59404 - DNA, 25 bp, Homo sapien
cctctctggggacagactctaggga

SEQ ID NO: 59405 - DNA, 25 bp, Homo sapien
taaacaaatatgtaagtcgtcctcc

SEQ ID NO: 59406 - DNA, 25 bp, Homo sapien
tcttgacgtaattaggaggccacgc

SEQ ID NO: 59407 - DNA, 25 bp, Homo sapien
cttcaagggctgatggttctgtgtt

SEQ ID NO: 59408 - DNA, 25 bp, Homo sapien
tctcgctggaaacttcaagggctga

SEQ ID NO: 59409 - DNA, 25 bp, Homo sapien
ggggcagaaaacgtgcacctcgcca

SEQ ID NO: 59410 - DNA, 25 bp, Homo sapien
gaagtgcaactttccggcgcctgga

SEQ ID NO: 59411 - DNA, 25 bp, Homo sapien
cctggtacaagtcgggcttccattc

SEQ ID NO: 59412 - DNA, 25 bp, Homo sapien
tttccaaggtgcacacgacggcagc

SEQ ID NO: 59413 - DNA, 25 bp, Homo sapien
gctcacgggtgcactttgtttcttc

SEQ ID NO: 59414 - DNA, 25 bp, Homo sapien
cacggaggcatctttgatttatagc

SEQ ID NO: 59415 - DNA, 25 bp, Homo sapien
gcggcgacctgcaacaagatcggca

SEQ ID NO: 59416 - DNA, 25 bp, Homo sapien
ccactctaggaagagccgcgcttcg

SEQ ID NO: 59417 - DNA, 25 bp, Homo sapien
gcacccgtacgagtcctggtacaag

SEQ ID NO: 59418 - DNA, 25 bp, Homo sapien
ggcatttcctgtcccatagcttcca

SEQ ID NO: 59419 - DNA, 25 bp, Homo sapien
ggttggccctggtcttagaattgtc

SEQ ID NO: 59420 - DNA, 25 bp, Homo sapien
ttctggaacgtgctaactgaaaatc

SEQ ID NO: 59421 - DNA, 25 bp, Homo sapien
acatggcagtggcttttgggcaaaa

SEQ ID NO: 59422 - DNA, 25 bp, Homo sapien
tcctgcgaagaaacgcgacagtttg

SEQ ID NO: 59423 - DNA, 25 bp, Homo sapien
cccgcccatttgtgtaattggtata

SEQ ID NO: 59424 - DNA, 25 bp, Homo sapien
gtgcgtctggactttccgtcaaatc

SEQ ID NO: 59425 - DNA, 25 bp, Homo sapien
tctgcccttggaatgaattggattc

SEQ ID NO: 59426 - DNA, 25 bp, Homo sapien
cgaccagaaaaattcgctcgctttc

SEQ ID NO: 59427 - DNA, 25 bp, Homo sapien
cgtttcttttcattccaggcagctc

SEQ ID NO: 59428 - DNA, 25 bp, Homo sapien
ccttcaagcccaagggactggagaa

SEQ ID NO: 59429 - DNA, 25 bp, Homo sapien
tccagaaggaaaccaccagagcacg

SEQ ID NO: 59430 - DNA, 25 bp, Homo sapien
ttgccagacggtgcatccagaagga

SEQ ID NO: 59431 - DNA, 25 bp, Homo sapien
gggtgttttcgcaaggttgccagac

SEQ ID NO: 59432 - DNA, 25 bp, Homo sapien
agcgaaaaggcctgagaattgcttc

SEQ ID NO: 59433 - DNA, 25 bp, Homo sapien
tttcctaactgctgaaggcgagtcc

SEQ ID NO: 59434 - DNA, 25 bp, Homo sapien
tgatctcacacgttccacaggcagg

SEQ ID NO: 59435 - DNA, 25 bp, Homo sapien
ctgcttcgtctgcaaccttggagtg

SEQ ID NO: 59436 - DNA, 25 bp, Homo sapien
ggcttccctgctcccacaaaatggt

SEQ ID NO: 59437 - DNA, 25 bp, Homo sapien
gcagggagaagaccaccgtcatctc

SEQ ID NO: 59438 - DNA, 25 bp, Homo sapien
cagcagcttaggcacgttccgataa

SEQ ID NO: 59439 - DNA, 25 bp, Homo sapien
aacttccagcaagacgggccgcttc

SEQ ID NO: 59440 - DNA, 25 bp, Homo sapien
ccatttccaggagccttgagcccag

SEQ ID NO: 59441 - DNA, 25 bp, Homo sapien
tgcccgcaagggagaaccaggaccc

SEQ ID NO: 59442 - DNA, 25 bp, Homo sapien
tggtcccgcacccacgccgggagac

SEQ ID NO: 59443 - DNA, 25 bp, Homo sapien
aaggattcccgggaggcactctgcg

SEQ ID NO: 59444 - DNA, 25 bp, Homo sapien
cccagatgacggaggtggctcaggc

SEQ ID NO: 59445 - DNA, 25 bp, Homo sapien
ccgtcctccactactattccacaga

SEQ ID NO: 59446 - DNA, 25 bp, Homo sapien
gggacacctcctacctgcgcggtga

SEQ ID NO: 59447 - DNA, 25 bp, Homo sapien
ccgctggtgatcgggacgcagccac

SEQ ID NO: 59448 - DNA, 25 bp, Homo sapien
ctcgcttcgcgtcctccatacccgc

SEQ ID NO: 59449 - DNA, 25 bp, Homo sapien
ggaccctgcgatggtgggtatgaga

SEQ ID NO: 59450 - DNA, 25 bp, Homo sapien
ccctctgtcctagctggggtgtagg

SEQ ID NO: 59451 - DNA, 25 bp, Homo sapien
gctggagtccgcagtttcctcagtc

SEQ ID NO: 59452 - DNA, 25 bp, Homo sapien
aacttcgccgagatgtgggccctcc

SEQ ID NO: 59453 - DNA, 25 bp, Homo sapien
cctacggagatagtgggtcccgagc

SEQ ID NO: 59454 - DNA, 25 bp, Homo sapien
ggcacggttcccatagacaggcagg

SEQ ID NO: 59455 - DNA, 25 bp, Homo sapien
ctggagatgtctctaaggtcgacgc

SEQ ID NO: 59456 - DNA, 25 bp, Homo sapien
gcgaaaagcactgaccgggactgga

SEQ ID NO: 59457 - DNA, 25 bp, Homo sapien
aggctgcgaccatccgggaacttcg

SEQ ID NO: 59458 - DNA, 25 bp, Homo sapien
ctacaaaagccgctcgcaagagtgc

SEQ ID NO: 59459 - DNA, 25 bp, Homo sapien
aaagccgctcgcaagagtgcgccct

SEQ ID NO: 59460 - DNA, 25 bp, Homo sapien
tcgaccggtggtaaagcacccagga

SEQ ID NO: 59461 - DNA, 25 bp, Homo sapien
tgcccgcaaatcgaccggtggtaaa

SEQ ID NO: 59462 - DNA, 25 bp, Homo sapien
actgcccgcaaatcgaccggtggta

SEQ ID NO: 59463 - DNA, 25 bp, Homo sapien
ggtaagtaaggaggtctctgtacca

SEQ ID NO: 59464 - DNA, 25 bp, Homo sapien
atcgaccggtggtaaagcacccagg

SEQ ID NO: 59465 - DNA, 25 bp, Homo sapien
ctggctacaaaagccgctcgcaaga

SEQ ID NO: 59466 - DNA, 25 bp, Homo sapien
ggccacctgaccgtggacgagttca

SEQ ID NO: 59467 - DNA, 25 bp, Homo sapien
gggcttatttggtctctccggcaca

SEQ ID NO: 59468 - DNA, 25 bp, Homo sapien
cctggacggcaacggctacatcagc

SEQ ID NO: 59469 - DNA, 25 bp, Homo sapien
cgccagccgccatgggcaaacagaa

SEQ ID NO: 59470 - DNA, 25 bp, Homo sapien
gagttcaccgaccacgagctgcagg

SEQ ID NO: 59471 - DNA, 25 bp, Homo sapien
aagtgggccttcagcatgtacgacc

SEQ ID NO: 59472 - DNA, 25 bp, Homo sapien
cgcttgcacagcgatgggcttattt

SEQ ID NO: 59473 - DNA, 25 bp, Homo sapien
ttccgggagttcatcattgcgctga

SEQ ID NO: 59474 - DNA, 25 bp, Homo sapien
cgaggatttcttacgcgttcaagcg

SEQ ID NO: 59475 - DNA, 25 bp, Homo sapien
cagggctagatgtaccttctgcagc

SEQ ID NO: 59476 - DNA, 25 bp, Homo sapien
cggagctgagtctgacgaggatttc

SEQ ID NO: 59477 - DNA, 25 bp, Homo sapien
gtaggtctgtgcttcttccttggtc

SEQ ID NO: 59478 - DNA, 25 bp, Homo sapien
acgcggctattaaacgctgctttta

SEQ ID NO: 59479 - DNA, 25 bp, Homo sapien
gtgtgagatgttcccttccgccgaa

SEQ ID NO: 59480 - DNA, 25 bp, Homo sapien
cgtcaacaccgcaagccaagtggta

SEQ ID NO: 59481 - DNA, 25 bp, Homo sapien
tgcagcttctgcagcgacttgaggc

SEQ ID NO: 59482 - DNA, 25 bp, Homo sapien
gcacttgtcgctgccatcaggcgcg

SEQ ID NO: 59483 - DNA, 25 bp, Homo sapien
ttgcgatagcgtctcccacgagctc

SEQ ID NO: 59484 - DNA, 25 bp, Homo sapien
gggagacggctgcacttaccaaaca

SEQ ID NO: 59485 - DNA, 25 bp, Homo sapien
ttaccaaacagggtcagggccattg

SEQ ID NO: 59486 - DNA, 25 bp, Homo sapien
ggccattgtaaaggcgctcgccgcc

SEQ ID NO: 59487 - DNA, 25 bp, Homo sapien
cgcacccacacctcggagagagtgg

SEQ ID NO: 59488 - DNA, 25 bp, Homo sapien
ttcacgcgttattgtcgggcgcacc

SEQ ID NO: 59489 - DNA, 25 bp, Homo sapien
ggaccgctgcaagaaaaagttattc

SEQ ID NO: 59490 - DNA, 25 bp, Homo sapien
cgtcgccatgttagcgccttctttc

SEQ ID NO: 59491 - DNA, 25 bp, Homo sapien
ggcccaaggagcgttacttctgtaa

SEQ ID NO: 59492 - DNA, 25 bp, Homo sapien
actcgggcgctcatgattggacaag

SEQ ID NO: 59493 - DNA, 25 bp, Homo sapien
acctttccaggtcactagttcatga

SEQ ID NO: 59494 - DNA, 25 bp, Homo sapien
ggcccagccagtcaggttcccaaag

SEQ ID NO: 59495 - DNA, 25 bp, Homo sapien
ctctgccttaggaaagcgcgcgaga

SEQ ID NO: 59496 - DNA, 25 bp, Homo sapien
gaggacctctgaactgacccaagta

SEQ ID NO: 59497 - DNA, 25 bp, Homo sapien
ctctctcgcgagatcggactgacaa

SEQ ID NO: 59498 - DNA, 25 bp, Homo sapien
ggtccggctcttattcgcgccgcag

SEQ ID NO: 59499 - DNA, 25 bp, Homo sapien
cgtggacgctctaggccaaaacgcc

SEQ ID NO: 59500 - DNA, 25 bp, Homo sapien
actcaatgcgcaagcgcggtccggc

SEQ ID NO: 59501 - DNA, 25 bp, Homo sapien
tggcgcaggcgaacatcttacactc

SEQ ID NO: 59502 - DNA, 25 bp, Homo sapien
cgccggcacaatgaatgggtcccta

SEQ ID NO: 59503 - DNA, 25 bp, Homo sapien
tcttacactcttcgggactgcgcgg

SEQ ID NO: 59504 - DNA, 25 bp, Homo sapien
ctctctgcggaggaaaagaggctta

SEQ ID NO: 59505 - DNA, 25 bp, Homo sapien
cccattcaacaacgtggacgctcta

SEQ ID NO: 59506 - DNA, 25 bp, Homo sapien
ccgcagcttatttcccaggggcaca

SEQ ID NO: 59507 - DNA, 25 bp, Homo sapien
ttcccaggggcacagctcagcatgc

SEQ ID NO: 59508 - DNA, 25 bp, Homo sapien
aactgccctcgccttgagcgttcta

SEQ ID NO: 59509 - DNA, 25 bp, Homo sapien
gttctacctgcaagaagcgggcgca

SEQ ID NO: 59510 - DNA, 25 bp, Homo sapien
agccagcttaggctgctcggtgtcg

SEQ ID NO: 59511 - DNA, 25 bp, Homo sapien
gcagccgccactgacagagagacaa

SEQ ID NO: 59512 - DNA, 25 bp, Homo sapien
ggatcttgtgtttgtggcctccgca

SEQ ID NO: 59513 - DNA, 25 bp, Homo sapien
acagagagacaagccgggccaactc

SEQ ID NO: 59514 - DNA, 25 bp, Homo sapien
tttttcagctaggagcgcttcggcc

SEQ ID NO: 59515 - DNA, 25 bp, Homo sapien
ctcggtgattttcgccggtgcctaa

SEQ ID NO: 59516 - DNA, 25 bp, Homo sapien
cctgttcccggaaacgaggcctgct

SEQ ID NO: 59517 - DNA, 25 bp, Homo sapien
ggcgagttgtagaaaagtccctcca

SEQ ID NO: 59518 - DNA, 25 bp, Homo sapien
tggcacttgaattgggcccacggtt

SEQ ID NO: 59519 - DNA, 25 bp, Homo sapien
aaggcgcactccttttcaggaaatc

SEQ ID NO: 59520 - DNA, 25 bp, Homo sapien
caacgtctgggaagccgacacttta

SEQ ID NO: 59521 - DNA, 25 bp, Homo sapien
tccaccgcgaggacaacactgaagg

SEQ ID NO: 59522 - DNA, 25 bp, Homo sapien
actgctcgctcccaaggtcaggatc

SEQ ID NO: 59523 - DNA, 25 bp, Homo sapien
aggtcaggatcttacggggccactt

SEQ ID NO: 59524 - DNA, 25 bp, Homo sapien
cgggccacagtgctttaacgacgtc

SEQ ID NO: 59525 - DNA, 25 bp, Homo sapien
aacgacgtcgtcgttccgcttgatg

SEQ ID NO: 59526 - DNA, 25 bp, Homo sapien
tggtgaactgttggcgacgtcgttc

SEQ ID NO: 59527 - DNA, 25 bp, Homo sapien
tcgcagcccgaagtccctgtagcag

SEQ ID NO: 59528 - DNA, 25 bp, Homo sapien
ccctgtagcaggtcggtatcacaca

SEQ ID NO: 59529 - DNA, 25 bp, Homo sapien
cacatctgctacttgccttgcgctg

SEQ ID NO: 59530 - DNA, 25 bp, Homo sapien
ggaacatgtgtctccaccgcgccca

SEQ ID NO: 59531 - DNA, 25 bp, Homo sapien
gctgctcccggaacatgtgtctcca

SEQ ID NO: 59532 - DNA, 25 bp, Homo sapien
gccgtccgcggggttcctgtgctct

SEQ ID NO: 59533 - DNA, 25 bp, Homo sapien
atttcatcaactggctgctcccgga

SEQ ID NO: 59534 - DNA, 25 bp, Homo sapien
ggcagcgttacctgatttcatcaac

SEQ ID NO: 59535 - DNA, 25 bp, Homo sapien
ttgggcagcgttacctgatttcatc

SEQ ID NO: 59536 - DNA, 25 bp, Homo sapien
tctctttgggcagcgttacctgatt

SEQ ID NO: 59537 - DNA, 25 bp, Homo sapien
accgcgcccacgtcttcttcaggcg

SEQ ID NO: 59538 - DNA, 25 bp, Homo sapien
ttttggcaaccgcagggaacacgca

SEQ ID NO: 59539 - DNA, 25 bp, Homo sapien
gtgcacgagttcgaagtggccactc

SEQ ID NO: 59540 - DNA, 25 bp, Homo sapien
ccatcgcagaaaggctgggccaacc

SEQ ID NO: 59541 - DNA, 25 bp, Homo sapien
acccgtctcggctgctccgaagaga

SEQ ID NO: 59542 - DNA, 25 bp, Homo sapien
aagaccgggcgcaaacagtcgctgg

SEQ ID NO: 59543 - DNA, 25 bp, Homo sapien
cacgcatcctcaggttggcacggga

SEQ ID NO: 59544 - DNA, 25 bp, Homo sapien
tctcttccgtcgaacccttttggca

SEQ ID NO: 59545 - DNA, 25 bp, Homo sapien
tgcgacagctctgaaggctcgagtc

SEQ ID NO: 59546 - DNA, 25 bp, Homo sapien
tcagcggccgcctctgaataatggc

SEQ ID NO: 59547 - DNA, 25 bp, Homo sapien
gggcagctttttatacggcctctaa

SEQ ID NO: 59548 - DNA, 25 bp, Homo sapien
tgtgctgcaggttgaacaaagtgtc

SEQ ID NO: 59549 - DNA, 25 bp, Homo sapien
ttttccttaagctgagcggcgccga

SEQ ID NO: 59550 - DNA, 25 bp, Homo sapien
gttcagagtagttgcccagggtacc

SEQ ID NO: 59551 - DNA, 25 bp, Homo sapien
gaggcttcctccgacttacccagaa

SEQ ID NO: 59552 - DNA, 25 bp, Homo sapien
cgagcacagcattgccagccgagtt

SEQ ID NO: 59553 - DNA, 25 bp, Homo sapien
ctgcgaattttccagggcctcgagc

SEQ ID NO: 59554 - DNA, 25 bp, Homo sapien
tttgggaaaccaagcgctcaggaca

SEQ ID NO: 59555 - DNA, 25 bp, Homo sapien
cagacggctgggtggcaaatacaaa

SEQ ID NO: 59556 - DNA, 25 bp, Homo sapien
ccgccttgctcctgaacgtagtaaa

SEQ ID NO: 59557 - DNA, 25 bp, Homo sapien
gctgaaagaacgtttgccacctccc

SEQ ID NO: 59558 - DNA, 25 bp, Homo sapien
tcttactaagcaccgcggccgagta

SEQ ID NO: 59559 - DNA, 25 bp, Homo sapien
gggctcacggccgtcttactaagca

SEQ ID NO: 59560 - DNA, 25 bp, Homo sapien
acgtagttatctggtgagcggagcc

SEQ ID NO: 59561 - DNA, 25 bp, Homo sapien
cactcttcgggcagggtccctaata

SEQ ID NO: 59562 - DNA, 25 bp, Homo sapien
tttctgcagtgtcgaacgctccatg

SEQ ID NO: 59563 - DNA, 25 bp, Homo sapien
acccgtctctcaatcccaggatttg

SEQ ID NO: 59564 - DNA, 25 bp, Homo sapien
tcagcttttctgagaggtcgccgcg

SEQ ID NO: 59565 - DNA, 25 bp, Homo sapien
ggcacgggtccgattttgatattga

SEQ ID NO: 59566 - DNA, 25 bp, Homo sapien
ctccatgaagggctcaccaaatcgc

SEQ ID NO: 59567 - DNA, 25 bp, Homo sapien
ggctatctctcccagacgtataata

SEQ ID NO: 59568 - DNA, 25 bp, Homo sapien
tcaggccggacaaccgttcggattc

SEQ ID NO: 59569 - DNA, 25 bp, Homo sapien
ttgagccctccgaactgcaaggacc

SEQ ID NO: 59570 - DNA, 25 bp, Homo sapien
tcctgaggggaaacgaactaggctg

SEQ ID NO: 59571 - DNA, 25 bp, Homo sapien
cgctttcttgctacgtggccgcgga

SEQ ID NO: 59572 - DNA, 25 bp, Homo sapien
acggaaatcattaggtcctctctga

SEQ ID NO: 59573 - DNA, 25 bp, Homo sapien
tgattttctaacaccgtctgcagag

SEQ ID NO: 59574 - DNA, 25 bp, Homo sapien
tctgcagagtgagatctgaactcga

SEQ ID NO: 59575 - DNA, 25 bp, Homo sapien
ataatcctgctgatagaaagccttc

SEQ ID NO: 59576 - DNA, 25 bp, Homo sapien
agaaagccttctcgcctacgcattt

SEQ ID NO: 59577 - DNA, 25 bp, Homo sapien
gctggacgatttgatagcagaattc

SEQ ID NO: 59578 - DNA, 25 bp, Homo sapien
aaacacaggcttgtcgtgccgttta

SEQ ID NO: 59579 - DNA, 25 bp, Homo sapien
cccagcagtgccagtcagttctgag

SEQ ID NO: 59580 - DNA, 25 bp, Homo sapien
ccctggacagttgcagagaaacaca

SEQ ID NO: 59581 - DNA, 25 bp, Homo sapien
gtcgtgccgtttaagctttgcttgc

SEQ ID NO: 59582 - DNA, 25 bp, Homo sapien
gctttgcttgcaagagtggatgccc

SEQ ID NO: 59583 - DNA, 25 bp, Homo sapien
ctggggcatgcgttgcacctgccca

SEQ ID NO: 59584 - DNA, 25 bp, Homo sapien
cctccacctgaccaacgcgacattc

SEQ ID NO: 59585 - DNA, 25 bp, Homo sapien
ccagtcagttctgagcgagcggccc

SEQ ID NO: 59586 - DNA, 25 bp, Homo sapien
cctcttggcgacaactttgatagtc

SEQ ID NO: 59587 - DNA, 25 bp, Homo sapien
gagcctcttggcgacaactttgata

SEQ ID NO: 59588 - DNA, 25 bp, Homo sapien
cagagagtcgccgaacagccttaca

SEQ ID NO: 59589 - DNA, 25 bp, Homo sapien
agtcgccgaacagccttacagcagc

SEQ ID NO: 59590 - DNA, 25 bp, Homo sapien
atagtcataatgacgccggtggcaa

SEQ ID NO: 59591 - DNA, 25 bp, Homo sapien
gaggctgagcctcttggcgacaact

SEQ ID NO: 59592 - DNA, 25 bp, Homo sapien
ggcgacaactttgatagtcataatg

SEQ ID NO: 59593 - DNA, 25 bp, Homo sapien
acagccttacagcagctctctgcgg

SEQ ID NO: 59594 - DNA, 25 bp, Homo sapien
gaaaatcaattccacatctttaagg

SEQ ID NO: 59595 - DNA, 25 bp, Homo sapien
acgcgagctttgcttagaaaatcaa

SEQ ID NO: 59596 - DNA, 25 bp, Homo sapien
caccgggactgggacttgacccagc

SEQ ID NO: 59597 - DNA, 25 bp, Homo sapien
acgcagagtgggcatccagcgcacc

SEQ ID NO: 59598 - DNA, 25 bp, Homo sapien
taaacggaaagctcgataggcaggc

SEQ ID NO: 59599 - DNA, 25 bp, Homo sapien
ctgagttctcattgcgccggctttg

SEQ ID NO: 59600 - DNA, 25 bp, Homo sapien
gctccgagctccctgagttctcatt

SEQ ID NO: 59601 - DNA, 25 bp, Homo sapien
ggcgccaacttatttcaacaacgcg

SEQ ID NO: 59602 - DNA, 25 bp, Homo sapien
agactcagatttcgagccctcggca

SEQ ID NO: 59603 - DNA, 25 bp, Homo sapien
gtttcgctgcataagggaagactca

SEQ ID NO: 59604 - DNA, 25 bp, Homo sapien
tgggacagtaggaccgcgaaagcct

SEQ ID NO: 59605 - DNA, 25 bp, Homo sapien
tcttcaggcgaagtgcggtttccac

SEQ ID NO: 59606 - DNA, 25 bp, Homo sapien
acttgcagggacatctagcgccagg

SEQ ID NO: 59607 - DNA, 25 bp, Homo sapien
cctcagacgccacgggaaaacttgc

SEQ ID NO: 59608 - DNA, 25 bp, Homo sapien
caattggggccgacaacttgcggtc

SEQ ID NO: 59609 - DNA, 25 bp, Homo sapien
cggcaggccagcttctagctctctg

SEQ ID NO: 59610 - DNA, 25 bp, Homo sapien
tgggtggtgactgcaaaatgcgagg

SEQ ID NO: 59611 - DNA, 25 bp, Homo sapien
gtgggtggtgactgcaaaatgcgag

SEQ ID NO: 59612 - DNA, 25 bp, Homo sapien
agtgggtggtgactgcaaaatgcga

SEQ ID NO: 59613 - DNA, 25 bp, Homo sapien
ggagtgggtggtgactgcaaaatgc

SEQ ID NO: 59614 - DNA, 25 bp, Homo sapien
gggtggtgactgcaaaatgcgaggc

SEQ ID NO: 59615 - DNA, 25 bp, Homo sapien
gtgactgcaaaatgcgaggccggtc

SEQ ID NO: 59616 - DNA, 25 bp, Homo sapien
cggctgctggagagacacagaagtt

SEQ ID NO: 59617 - DNA, 25 bp, Homo sapien
ggtggtgactgcaaaatgcgaggcc

SEQ ID NO: 59618 - DNA, 25 bp, Homo sapien
agagacacagaagtttcacggtggg

SEQ ID NO: 59619 - DNA, 25 bp, Homo sapien
tggcccaagagtagaggcgaagagc

SEQ ID NO: 59620 - DNA, 25 bp, Homo sapien
aagcactcccggctggcccaagagt

SEQ ID NO: 59621 - DNA, 25 bp, Homo sapien
aggcccaggtcggaagcactcccgg

SEQ ID NO: 59622 - DNA, 25 bp, Homo sapien
ctgagaggcccaggtcggaagcact

SEQ ID NO: 59623 - DNA, 25 bp, Homo sapien
tctttctgcgggtcgaagaaggacc

SEQ ID NO: 59624 - DNA, 25 bp, Homo sapien
tctcagggtctttctgcgggtcgaa

SEQ ID NO: 59625 - DNA, 25 bp, Homo sapien
cacagaagtttcacggtgggaggct

SEQ ID NO: 59626 - DNA, 25 bp, Homo sapien
cgtgggcttacagcagaatgcgctc

SEQ ID NO: 59627 - DNA, 25 bp, Homo sapien
tgggctacggctaccacttcggcaa

SEQ ID NO: 59628 - DNA, 25 bp, Homo sapien
tcgtcctcttctgccgttgtagcgg

SEQ ID NO: 59629 - DNA, 25 bp, Homo sapien
gcggctttctctccgcgcctgtgtt

SEQ ID NO: 59630 - DNA, 25 bp, Homo sapien
ctttcccgtggagaagtacatggac

SEQ ID NO: 59631 - DNA, 25 bp, Homo sapien
aatgcgctcaagtcatcgccgcacg

SEQ ID NO: 59632 - DNA, 25 bp, Homo sapien
cttcggcaacggctactacagctgc

SEQ ID NO: 59633 - DNA, 25 bp, Homo sapien
acgtcccgcgatgagctaacctgtt

SEQ ID NO: 59634 - DNA, 25 bp, Homo sapien
ttgccgccaagatctccggctttcg

SEQ ID NO: 59635 - DNA, 25 bp, Homo sapien
ccgtgtcgcgtgattcaagaggcga

SEQ ID NO: 59636 - DNA, 25 bp, Homo sapien
aaggaagcattggagccgggactca

SEQ ID NO: 59637 - DNA, 25 bp, Homo sapien
ccgggactcacggtcagacaaaggg

SEQ ID NO: 59638 - DNA, 25 bp, Homo sapien
agacaaaggggcgactgcagtgctt

SEQ ID NO: 59639 - DNA, 25 bp, Homo sapien
ctgttgatcttgaccgtgcggctgc

SEQ ID NO: 59640 - DNA, 25 bp, Homo sapien
gtccctctggctccgctgtcagggg

SEQ ID NO: 59641 - DNA, 25 bp, Homo sapien
atctccggctttcggaggcgctagg

SEQ ID NO: 59642 - DNA, 25 bp, Homo sapien
aaggaccagttccagctgtgcattc

SEQ ID NO: 59643 - DNA, 25 bp, Homo sapien
acggcgcttcacatcgtccggggaa

SEQ ID NO: 59644 - DNA, 25 bp, Homo sapien
tgcgcgctgtgtacactagctcata

SEQ ID NO: 59645 - DNA, 25 bp, Homo sapien
gccggtgatctctgcacgcagctca

SEQ ID NO: 59646 - DNA, 25 bp, Homo sapien
tgcgcccagattgagcaccgatcgc

SEQ ID NO: 59647 - DNA, 25 bp, Homo sapien
ctgtgcattctcatgtggccgctcc

SEQ ID NO: 59648 - DNA, 25 bp, Homo sapien
agccgctctcgcatgtgcttgcgca

SEQ ID NO: 59649 - DNA, 25 bp, Homo sapien
cgcccgtccttgtctttggtagtga

SEQ ID NO: 59650 - DNA, 25 bp, Homo sapien
cagccgaagccctttgttggagatg

SEQ ID NO: 59651 - DNA, 25 bp, Homo sapien
gcgaccttcactgcccgacggtaaa

SEQ ID NO: 59652 - DNA, 25 bp, Homo sapien
aagggcccgctcaacttgaacatga

SEQ ID NO: 59653 - DNA, 25 bp, Homo sapien
atgtgggctcgcttctgaatctgca

SEQ ID NO: 59654 - DNA, 25 bp, Homo sapien
tttcgtccaatcgtctgagcctgtc

SEQ ID NO: 59655 - DNA, 25 bp, Homo sapien
accggctttgaagaacctgcaggca

SEQ ID NO: 59656 - DNA, 25 bp, Homo sapien
aacctgatttggctctgctggcagc

SEQ ID NO: 59657 - DNA, 25 bp, Homo sapien
aggctaagttctatgcgcccgaagc

SEQ ID NO: 59658 - DNA, 25 bp, Homo sapien
ccagacacataaagacccgggttga

SEQ ID NO: 59659 - DNA, 25 bp, Homo sapien
aaagctctttctcgcggagcggctg

SEQ ID NO: 59660 - DNA, 25 bp, Homo sapien
caggcaaggacaaggccacagagtc

SEQ ID NO: 59661 - DNA, 25 bp, Homo sapien
gggtcttcacggtaggttctcgagc

SEQ ID NO: 59662 - DNA, 25 bp, Homo sapien
actggaatgaaagcgctctgggttg

SEQ ID NO: 59663 - DNA, 25 bp, Homo sapien
gccgtcgccatgtcgttgaacttga

SEQ ID NO: 59664 - DNA, 25 bp, Homo sapien
cagcgtccagggagccattttagga

SEQ ID NO: 59665 - DNA, 25 bp, Homo sapien
cttttccctcttcggcggtcagcag

SEQ ID NO: 59666 - DNA, 25 bp, Homo sapien
aacgactttgacgagtgcggccaga

SEQ ID NO: 59667 - DNA, 25 bp, Homo sapien
catggcgtcacgtgacataattacc

SEQ ID NO: 59668 - DNA, 25 bp, Homo sapien
cgtctgacttcgctagcaagccttc

SEQ ID NO: 59669 - DNA, 25 bp, Homo sapien
atgaattgcacgtcagcgcccggtg

SEQ ID NO: 59670 - DNA, 25 bp, Homo sapien
tttgcttagttgatcctggcccaag

SEQ ID NO: 59671 - DNA, 25 bp, Homo sapien
cgccgcggagtcatgaacgactttg

SEQ ID NO: 59672 - DNA, 25 bp, Homo sapien
taaggacatttctcttcatggcgtc

SEQ ID NO: 59673 - DNA, 25 bp, Homo sapien
gcccaagcctcttgtgcaatcgatg

SEQ ID NO: 59674 - DNA, 25 bp, Homo sapien
ccacgacgcaggcagggcctttcgg

SEQ ID NO: 59675 - DNA, 25 bp, Homo sapien
caagtaccagatccgcgaactggaa

SEQ ID NO: 59676 - DNA, 25 bp, Homo sapien
tttcggccgcggcagagaacgtccc

SEQ ID NO: 59677 - DNA, 25 bp, Homo sapien
tggtctctttgccttgcagttgccc

SEQ ID NO: 59678 - DNA, 25 bp, Homo sapien
cgcgaactggaacgcgagtttttct

SEQ ID NO: 59679 - DNA, 25 bp, Homo sapien
gaacacatgtccacgcccgcactct

SEQ ID NO: 59680 - DNA, 25 bp, Homo sapien
gctgtccctataccaagtaccagat

SEQ ID NO: 59681 - DNA, 25 bp, Homo sapien
ccctggtctctttgccttgcagttg

SEQ ID NO: 59682 - DNA, 25 bp, Homo sapien
ggaatcaaacccacacgcctgggga

SEQ ID NO: 59683 - DNA, 25 bp, Homo sapien
gcagcgatgtatcccggcccagagt

SEQ ID NO: 59684 - DNA, 25 bp, Homo sapien
gaggcaagtggtcccgcgctagtcc

SEQ ID NO: 59685 - DNA, 25 bp, Homo sapien
ccctgaaaggaacaagaagaaaatg

SEQ ID NO: 59686 - DNA, 25 bp, Homo sapien
gctgggcgccgttgggaatcaaacc

SEQ ID NO: 59687 - DNA, 25 bp, Homo sapien
agcctcggccgtcggggaacagact

SEQ ID NO: 59688 - DNA, 25 bp, Homo sapien
gggttcatccgtggcgtggccttcc

SEQ ID NO: 59689 - DNA, 25 bp, Homo sapien
ccgtcggggaacagactccggcttg

SEQ ID NO: 59690 - DNA, 25 bp, Homo sapien
tgacgctacctttcccgaggctgaa

SEQ ID NO: 59691 - DNA, 25 bp, Homo sapien
cgccggtccaccttgtctatagtga

SEQ ID NO: 59692 - DNA, 25 bp, Homo sapien
gaacggggtcctcggtctatgtgaa

SEQ ID NO: 59693 - DNA, 25 bp, Homo sapien
tctatgtgaagtgagagctgccctc

SEQ ID NO: 59694 - DNA, 25 bp, Homo sapien
ccttgtctatagtgacgctaccttt

SEQ ID NO: 59695 - DNA, 25 bp, Homo sapien
gccgcctgcgaaacaccgcttctca

SEQ ID NO: 59696 - DNA, 25 bp, Homo sapien
aatgtcgttgtcctctcaaggcggc

SEQ ID NO: 59697 - DNA, 25 bp, Homo sapien
gagctgccctccctaaatgtcgttg

SEQ ID NO: 59698 - DNA, 25 bp, Homo sapien
ctagagacaccttggccgcttctta

SEQ ID NO: 59699 - DNA, 25 bp, Homo sapien
ccaggctctggagcacgtgacccga

SEQ ID NO: 59700 - DNA, 25 bp, Homo sapien
agatgtcgctgttgtccgtgcttac

SEQ ID NO: 59701 - DNA, 25 bp, Homo sapien
gccggttgtctccagcgcgcactat

SEQ ID NO: 59702 - DNA, 25 bp, Homo sapien
agagctgagactttccttccgccgg

SEQ ID NO: 59703 - DNA, 25 bp, Homo sapien
ctcttaagcgcgttctgcctggttg

SEQ ID NO: 59704 - DNA, 25 bp, Homo sapien
ccgggactaaattaaccagcctgcg

SEQ ID NO: 59705 - DNA, 25 bp, Homo sapien
acgcagggaccaacccatccatggg

SEQ ID NO: 59706 - DNA, 25 bp, Homo sapien
aggaaagcaaaggtcggtatgagca

SEQ ID NO: 59707 - DNA, 25 bp, Homo sapien
cccgaagtgcaggagaaggaaagca

SEQ ID NO: 59708 - DNA, 25 bp, Homo sapien
ccaaagtctcccaggtggagagccc

SEQ ID NO: 59709 - DNA, 25 bp, Homo sapien
ctccgtgtccagtcccgaagtgcag

SEQ ID NO: 59710 - DNA, 25 bp, Homo sapien
gtcggtatgagcagagttgccaccc

SEQ ID NO: 59711 - DNA, 25 bp, Homo sapien
aaagaagatgaacgagcccgtgagc

SEQ ID NO: 59712 - DNA, 25 bp, Homo sapien
gcccagctgcagatggaaaagaaga

SEQ ID NO: 59713 - DNA, 25 bp, Homo sapien
cggccttcccgaagagaggagctgc

SEQ ID NO: 59714 - DNA, 25 bp, Homo sapien
gcggactgatttactcccggtattg

SEQ ID NO: 59715 - DNA, 25 bp, Homo sapien
gtggcaccctcagcaactactacgt

SEQ ID NO: 59716 - DNA, 25 bp, Homo sapien
acgtggactcgcttataggccatga

SEQ ID NO: 59717 - DNA, 25 bp, Homo sapien
gtgcgggacgcctcaaaatgtcttc

SEQ ID NO: 59718 - DNA, 25 bp, Homo sapien
gcggcgcttatgttgatgatttttt

SEQ ID NO: 59719 - DNA, 25 bp, Homo sapien
gcgggctctaattgcggcgcttatg

SEQ ID NO: 59720 - DNA, 25 bp, Homo sapien
gccgagttcgcctcgtgtagttttg

SEQ ID NO: 59721 - DNA, 25 bp, Homo sapien
taaatatgatcacgtgggccgcgcg

SEQ ID NO: 59722 - DNA, 25 bp, Homo sapien
tcctcagtgcattggacgcgctgct

SEQ ID NO: 59723 - DNA, 25 bp, Homo sapien
tggggtttgtcctcagtgcattgga

SEQ ID NO: 59724 - DNA, 25 bp, Homo sapien
ctcccctgaaggctgggctcgcgtg

SEQ ID NO: 59725 - DNA, 25 bp, Homo sapien
cctcggtggagatctccagtgaggc

SEQ ID NO: 59726 - DNA, 25 bp, Homo sapien
cctttcctcagggagcacgcgggac

SEQ ID NO: 59727 - DNA, 25 bp, Homo sapien
ggttgcccaccagttgcgaaagccc

SEQ ID NO: 59728 - DNA, 25 bp, Homo sapien
gcggggttgcccaccagttgcgaaa

SEQ ID NO: 59729 - DNA, 25 bp, Homo sapien
aacagtgcggacaccccggctgcta

SEQ ID NO: 59730 - DNA, 25 bp, Homo sapien
gcactcaccgcgttggaacaggatg

SEQ ID NO: 59731 - DNA, 25 bp, Homo sapien
cgcctcaaaacagggacctcacgtg

SEQ ID NO: 59732 - DNA, 25 bp, Homo sapien
catggacacgcctcacgtgggcaga

SEQ ID NO: 59733 - DNA, 25 bp, Homo sapien
cagagagaggcacagcttttgaaaa

SEQ ID NO: 59734 - DNA, 25 bp, Homo sapien
caggaatacaaacgcacccttgggg

SEQ ID NO: 59735 - DNA, 25 bp, Homo sapien
gactccagtagggaagacccaccca

SEQ ID NO: 59736 - DNA, 25 bp, Homo sapien
gtgagcagccacagcccgaagaatc

SEQ ID NO: 59737 - DNA, 25 bp, Homo sapien
ccagacccgggctgacaggaataca

SEQ ID NO: 59738 - DNA, 25 bp, Homo sapien
cggacacaagtcaggatcgcgctcg

SEQ ID NO: 59739 - DNA, 25 bp, Homo sapien
aagtcaggatcgcgctcgcaggctg

SEQ ID NO: 59740 - DNA, 25 bp, Homo sapien
caagtcaggatcgcgctcgcaggct

SEQ ID NO: 59741 - DNA, 25 bp, Homo sapien
acaagtcaggatcgcgctcgcaggc

SEQ ID NO: 59742 - DNA, 25 bp, Homo sapien
cacaagtcaggatcgcgctcgcagg

SEQ ID NO: 59743 - DNA, 25 bp, Homo sapien
acacaagtcaggatcgcgctcgcag

SEQ ID NO: 59744 - DNA, 25 bp, Homo sapien
gacacaagtcaggatcgcgctcgca

SEQ ID NO: 59745 - DNA, 25 bp, Homo sapien
ggacacaagtcaggatcgcgctcgc

SEQ ID NO: 59746 - DNA, 25 bp, Homo sapien
tggcgccctcacgacattgtaccta

SEQ ID NO: 59747 - DNA, 25 bp, Homo sapien
agctgaaatcgctcgccagcctgca

SEQ ID NO: 59748 - DNA, 25 bp, Homo sapien
atctctgaggccgtctggggttttc

SEQ ID NO: 59749 - DNA, 25 bp, Homo sapien
tttgcatttggtgtggaaagccggc

SEQ ID NO: 59750 - DNA, 25 bp, Homo sapien
cccacaaggagctaggggtagctga

SEQ ID NO: 59751 - DNA, 25 bp, Homo sapien
aaagccggcgtggtgcgtttagctt

SEQ ID NO: 59752 - DNA, 25 bp, Homo sapien
gggcgccttggaggtctatttccaa

SEQ ID NO: 59753 - DNA, 25 bp, Homo sapien
gtctatttccaaggctgtgggcctg

SEQ ID NO: 59754 - DNA, 25 bp, Homo sapien
agcccttggcagtgcgtctttatgg

SEQ ID NO: 59755 - DNA, 25 bp, Homo sapien
ctcaaatgcacggtccggtccgtca

SEQ ID NO: 59756 - DNA, 25 bp, Homo sapien
cacccgcgtgtccagagctgcaaaa

SEQ ID NO: 59757 - DNA, 25 bp, Homo sapien
cacgggcaacctctgcttttgcagc

SEQ ID NO: 59758 - DNA, 25 bp, Homo sapien
cgtcacgctgactttccgtgcagtg

SEQ ID NO: 59759 - DNA, 25 bp, Homo sapien
tggggccacactcgcggcttttaat

SEQ ID NO: 59760 - DNA, 25 bp, Homo sapien
gtttgtaaaccgaggccagagtgtc

SEQ ID NO: 59761 - DNA, 25 bp, Homo sapien
cttttttcttgtccgggtgcgctca

SEQ ID NO: 59762 - DNA, 25 bp, Homo sapien
ttctaacctttgtctctgcagaggt

SEQ ID NO: 59763 - DNA, 25 bp, Homo sapien
tagctcggcagccttcgggtaagaa

SEQ ID NO: 59764 - DNA, 25 bp, Homo sapien
gattacagcagacgcccggaccgac

SEQ ID NO: 59765 - DNA, 25 bp, Homo sapien
gcagcgcctagtggattacagcaga

SEQ ID NO: 59766 - DNA, 25 bp, Homo sapien
ctctgcgtccgagagtgagcgcagc

SEQ ID NO: 59767 - DNA, 25 bp, Homo sapien
ttcaccaacatgagcgggtctctgc

SEQ ID NO: 59768 - DNA, 25 bp, Homo sapien
tggcgcggcttcttcaccaacatga

SEQ ID NO: 59769 - DNA, 25 bp, Homo sapien
agcagccggcctgctcgaggtgact

SEQ ID NO: 59770 - DNA, 25 bp, Homo sapien
agaggtccagcgcatgtgcagtgaa

SEQ ID NO: 59771 - DNA, 25 bp, Homo sapien
ctcgagcaggaagatacacccgatc

SEQ ID NO: 59772 - DNA, 25 bp, Homo sapien
attcgatcggcaaagcacgggtgtg

SEQ ID NO: 59773 - DNA, 25 bp, Homo sapien
atgtgcagtgaaatggcctagcccg

SEQ ID NO: 59774 - DNA, 25 bp, Homo sapien
cttatccgcactgcgcggtgcaagc

SEQ ID NO: 59775 - DNA, 25 bp, Homo sapien
agcagtgcgcggtaccttatccgca

SEQ ID NO: 59776 - DNA, 25 bp, Homo sapien
agatacacccgatctttccattctc

SEQ ID NO: 59777 - DNA, 25 bp, Homo sapien
ctagcccgggaattcgatcggcaaa

SEQ ID NO: 59778 - DNA, 25 bp, Homo sapien
aggcgctgtaggacaagcgtctcgc

SEQ ID NO: 59779 - DNA, 25 bp, Homo sapien
ggttcctttccccagactggcagtg

SEQ ID NO: 59780 - DNA, 25 bp, Homo sapien
aacaagggtcgacggtgctgcgccc

SEQ ID NO: 59781 - DNA, 25 bp, Homo sapien
ggttggcgggccacctcgctttctc

SEQ ID NO: 59782 - DNA, 25 bp, Homo sapien
ctcgaacaagggtcgacggtgctgc

SEQ ID NO: 59783 - DNA, 25 bp, Homo sapien
cgccaagtgtgtggggcctcgaaca

SEQ ID NO: 59784 - DNA, 25 bp, Homo sapien
gcggagggatcggtacccgctcctc

SEQ ID NO: 59785 - DNA, 25 bp, Homo sapien
taggacaagcgtctcgccggctgcg

SEQ ID NO: 59786 - DNA, 25 bp, Homo sapien
ggatcacccttatccagccgcggga

SEQ ID NO: 59787 - DNA, 25 bp, Homo sapien
tcgccatggagacgcaccagctcaa

SEQ ID NO: 59788 - DNA, 25 bp, Homo sapien
tcaaaccagccacgatcggttccgg

SEQ ID NO: 59789 - DNA, 25 bp, Homo sapien
tccctacttatagcaccggcgggtc

SEQ ID NO: 59790 - DNA, 25 bp, Homo sapien
ctgtagctgcacagctgtgcttcca

SEQ ID NO: 59791 - DNA, 25 bp, Homo sapien
ctgtgcttccacctggcgttcagta

SEQ ID NO: 59792 - DNA, 25 bp, Homo sapien
ggcgttcagtacctcgtgcccgaga

SEQ ID NO: 59793 - DNA, 25 bp, Homo sapien
gcagctgaacggcagagcctgtagc

SEQ ID NO: 59794 - DNA, 25 bp, Homo sapien
gggtctcgcccttgtctccttgggc

SEQ ID NO: 59795 - DNA, 25 bp, Homo sapien
gcctggttcacagacacctgcctga

SEQ ID NO: 59796 - DNA, 25 bp, Homo sapien
atcgaggtcccggaaagcttttctg

SEQ ID NO: 59797 - DNA, 25 bp, Homo sapien
gaggcgctaaatcgaggtcccggaa

SEQ ID NO: 59798 - DNA, 25 bp, Homo sapien
ctcgctctgcgaggttagcccgctt

SEQ ID NO: 59799 - DNA, 25 bp, Homo sapien
ccgaatcgcgaagagacggtactga

SEQ ID NO: 59800 - DNA, 25 bp, Homo sapien
ttcccgcttcttccgaatcgcgaag

SEQ ID NO: 59801 - DNA, 25 bp, Homo sapien
cgctgtaagtaccttcccgcttctt

SEQ ID NO: 59802 - DNA, 25 bp, Homo sapien
gtggtatccgtatagtcacagattc

SEQ ID NO: 59803 - DNA, 25 bp, Homo sapien
cctaggtacctcactctgggtggga

SEQ ID NO: 59804 - DNA, 25 bp, Homo sapien
tataccctgtagaaccgaatttgtg

SEQ ID NO: 59805 - DNA, 25 bp, Homo sapien
ttctaggggaatatatggtcgatgc

SEQ ID NO: 59806 - DNA, 25 bp, Homo sapien
tggtcgatgcaaaaacttcacgttt

SEQ ID NO: 59807 - DNA, 25 bp, Homo sapien
tagccagagaccaaagtgcgacatg

SEQ ID NO: 59808 - DNA, 25 bp, Homo sapien
tgcgacatggagactagaagcagcc

SEQ ID NO: 59809 - DNA, 25 bp, Homo sapien
cccagaggttgtaacgttgtctata

SEQ ID NO: 59810 - DNA, 25 bp, Homo sapien
cagggcggctacctaggcgagcagg

SEQ ID NO: 59811 - DNA, 25 bp, Homo sapien
ggagtatttgcagggcggctaccta

SEQ ID NO: 59812 - DNA, 25 bp, Homo sapien
cgagcagggcgccgactactacggc

SEQ ID NO: 59813 - DNA, 25 bp, Homo sapien
cccgacttcggtgagcagcctttcg

SEQ ID NO: 59814 - DNA, 25 bp, Homo sapien
cgacttcggtgagcagcctttcgga

SEQ ID NO: 59815 - DNA, 25 bp, Homo sapien
cttcggtgagcagcctttcggaggc

SEQ ID NO: 59816 - DNA, 25 bp, Homo sapien
tgcgcggggtcacggacaagagcca

SEQ ID NO: 59817 - DNA, 25 bp, Homo sapien
tacccacggcccgacttcggtgagc

SEQ ID NO: 59818 - DNA, 25 bp, Homo sapien
aacaggtatctgacaaggcgccgtc

SEQ ID NO: 59819 - DNA, 25 bp, Homo sapien
ggattgaaatcgctcacaccctgtg

SEQ ID NO: 59820 - DNA, 25 bp, Homo sapien
aggcgccgtcggattgaaatcgctc

SEQ ID NO: 59821 - DNA, 25 bp, Homo sapien
ctcacaccctgtgtctgtcggagcg

SEQ ID NO: 59822 - DNA, 25 bp, Homo sapien
tcctagaactggaaaaagaatttca

SEQ ID NO: 59823 - DNA, 25 bp, Homo sapien
cacccggcagcaagtcctagaactg

SEQ ID NO: 59824 - DNA, 25 bp, Homo sapien
gtctgttttgtctcgcagtgaaccc

SEQ ID NO: 59825 - DNA, 25 bp, Homo sapien
ctgcctgtcctgtctgttttgtctc

SEQ ID NO: 59826 - DNA, 25 bp, Homo sapien
tcgcattcctgcacacatcgcggga

SEQ ID NO: 59827 - DNA, 25 bp, Homo sapien
actcggcggaaatgacgtcctctcc

SEQ ID NO: 59828 - DNA, 25 bp, Homo sapien
ccacgtcgcagattataagggcgga

SEQ ID NO: 59829 - DNA, 25 bp, Homo sapien
cagggcgatactcgagctagctctc

SEQ ID NO: 59830 - DNA, 25 bp, Homo sapien
ctcgagatcagcgagaggttacttc

SEQ ID NO: 59831 - DNA, 25 bp, Homo sapien
aactaagtcgtttcgaggccagacg

SEQ ID NO: 59832 - DNA, 25 bp, Homo sapien
aggccagacgttcagctcgcattcc

SEQ ID NO: 59833 - DNA, 25 bp, Homo sapien
agttcccgtcgcgatcctagcagca

SEQ ID NO: 59834 - DNA, 25 bp, Homo sapien
ctcggggtcacgtgaacaaatatgc

SEQ ID NO: 59835 - DNA, 25 bp, Homo sapien
tccggggctctctccaaatccagaa

SEQ ID NO: 59836 - DNA, 25 bp, Homo sapien
tgctacgcgccttttctgtctcaga

SEQ ID NO: 59837 - DNA, 25 bp, Homo sapien
aggcagcgtctgtatttcccgacta

SEQ ID NO: 59838 - DNA, 25 bp, Homo sapien
tctgtctcagaagtggcggtgactc

SEQ ID NO: 59839 - DNA, 25 bp, Homo sapien
acgcttctaagagaggcagtttcta

SEQ ID NO: 59840 - DNA, 25 bp, Homo sapien
cccggagctgcgaaaatgtgttctt

SEQ ID NO: 59841 - DNA, 25 bp, Homo sapien
atcagtacaagcttccctcggggtc

SEQ ID NO: 59842 - DNA, 25 bp, Homo sapien
cgtccgcccacgtgaatgtattata

SEQ ID NO: 59843 - DNA, 25 bp, Homo sapien
ccgggtgtagtttagtgctcgcaaa

SEQ ID NO: 59844 - DNA, 25 bp, Homo sapien
aacgctttgtgtgaggctttcccgg

SEQ ID NO: 59845 - DNA, 25 bp, Homo sapien
tggctgcgcgctttagtctttagaa

SEQ ID NO: 59846 - DNA, 25 bp, Homo sapien
cttcaaaggcttatggctgcgcgct

SEQ ID NO: 59847 - DNA, 25 bp, Homo sapien
tgcgagccaaaggtcacttcaaagg

SEQ ID NO: 59848 - DNA, 25 bp, Homo sapien
tgggatctcttcgaggcgcttctgt

SEQ ID NO: 59849 - DNA, 25 bp, Homo sapien
ggcgcttctgttgggtgttcattaa

SEQ ID NO: 59850 - DNA, 25 bp, Homo sapien
gcggagcctgctttccactgctgaa

SEQ ID NO: 59851 - DNA, 25 bp, Homo sapien
cactgctgaaaagtgccgggccttg

SEQ ID NO: 59852 - DNA, 25 bp, Homo sapien
tctttcaacttggatgggctgactc

SEQ ID NO: 59853 - DNA, 25 bp, Homo sapien
gggctgactctacccgtcggtgatt

SEQ ID NO: 59854 - DNA, 25 bp, Homo sapien
tacgacgattgcagcgctagtcaca

SEQ ID NO: 59855 - DNA, 25 bp, Homo sapien
caggcgccggtcactttatataatc

SEQ ID NO: 59856 - DNA, 25 bp, Homo sapien
ccagctcgagcactagcggattttg

SEQ ID NO: 59857 - DNA, 25 bp, Homo sapien
ggccaccacgggcagcagatttttg

SEQ ID NO: 59858 - DNA, 25 bp, Homo sapien
ggaggctcccaaactgacgcatctg

SEQ ID NO: 59859 - DNA, 25 bp, Homo sapien
actcgcggcaaaattacctctcttg

SEQ ID NO: 59860 - DNA, 25 bp, Homo sapien
ggcggcaacttcgtcgagtccatgg

SEQ ID NO: 59861 - DNA, 25 bp, Homo sapien
tgcctgccacaacagaagcgctacg

SEQ ID NO: 59862 - DNA, 25 bp, Homo sapien
tttcgccaaatcacagcccaatatg

SEQ ID NO: 59863 - DNA, 25 bp, Homo sapien
aaggccaagggcatcctgcactcgc

SEQ ID NO: 59864 - DNA, 25 bp, Homo sapien
ggccaacctgctgaatctcacggaa

SEQ ID NO: 59865 - DNA, 25 bp, Homo sapien
gcgtcctttgggtgactcgccataa

SEQ ID NO: 59866 - DNA, 25 bp, Homo sapien
gcccgcggcacagccatttaaaact

SEQ ID NO: 59867 - DNA, 25 bp, Homo sapien
gccgccttggccttcgcaataaatt

SEQ ID NO: 59868 - DNA, 25 bp, Homo sapien
tccgctccttttgagcctgcaatta

SEQ ID NO: 59869 - DNA, 25 bp, Homo sapien
caatagctgctctatcggctgcgga

SEQ ID NO: 59870 - DNA, 25 bp, Homo sapien
tctccgactgaggtttgcacacaca

SEQ ID NO: 59871 - DNA, 25 bp, Homo sapien
ctctgcaagggaaggtcacaatagc

SEQ ID NO: 59872 - DNA, 25 bp, Homo sapien
ctgaagggcccaactgcctgaggtt

SEQ ID NO: 59873 - DNA, 25 bp, Homo sapien
gcctgaggttgcaaacctttatttc

SEQ ID NO: 59874 - DNA, 25 bp, Homo sapien
agcgctaactgaaggcgcgacctga

SEQ ID NO: 59875 - DNA, 25 bp, Homo sapien
tgcaaagacagacggtgagttaatc

SEQ ID NO: 59876 - DNA, 25 bp, Homo sapien
gagttaatcaccctaccggctggcg

SEQ ID NO: 59877 - DNA, 25 bp, Homo sapien
agagttcatcaatcacccggtgtgc

SEQ ID NO: 59878 - DNA, 25 bp, Homo sapien
cggtgtgcacttttcgctcgacagc

SEQ ID NO: 59879 - DNA, 25 bp, Homo sapien
cgacagcggttcctcctacttcaga

SEQ ID NO: 59880 - DNA, 25 bp, Homo sapien
tgggatccgaccagaaatcgcaagc

SEQ ID NO: 59881 - DNA, 25 bp, Homo sapien
tggcgctcctgatccacctggaaca

SEQ ID NO: 59882 - DNA, 25 bp, Homo sapien
cggggcctgtcccaacaagactgag

SEQ ID NO: 59883 - DNA, 25 bp, Homo sapien
gccatctgacaagcccggggcctgt

SEQ ID NO: 59884 - DNA, 25 bp, Homo sapien
cccgtgtggagacaactgcacagtc

SEQ ID NO: 59885 - DNA, 25 bp, Homo sapien
gtgagatccagaacccggccggagc

SEQ ID NO: 59886 - DNA, 25 bp, Homo sapien
agactgaggcccgtgtggagacaac

SEQ ID NO: 59887 - DNA, 25 bp, Homo sapien
actgcacagtcgtgaccggttgtcc

SEQ ID NO: 59888 - DNA, 25 bp, Homo sapien
ggttgtcctgacagacctgctagca

SEQ ID NO: 59889 - DNA, 25 bp, Homo sapien
ctgctagcacctcccgaggctggga

SEQ ID NO: 59890 - DNA, 25 bp, Homo sapien
ttccggcttgtctcaaagcgtcagc

SEQ ID NO: 59891 - DNA, 25 bp, Homo sapien
cccgccggtatattaggccactatt

SEQ ID NO: 59892 - DNA, 25 bp, Homo sapien
tggggcccgaaccatgagctcctac

SEQ ID NO: 59893 - DNA, 25 bp, Homo sapien
tcctacctggagtacgtgtcatgca

SEQ ID NO: 59894 - DNA, 25 bp, Homo sapien
cgtgctcagcttggcacccaagttc

SEQ ID NO: 59895 - DNA, 25 bp, Homo sapien
ctgggctgctttggctaacttggct

SEQ ID NO: 59896 - DNA, 25 bp, Homo sapien
gccgccttcagcacgttcgagtgga

SEQ ID NO: 59897 - DNA, 25 bp, Homo sapien
gacggccaccctggtgctttccaga

SEQ ID NO: 59898 - DNA, 25 bp, Homo sapien
agtgggctttgcgagtctgaacgtt

SEQ ID NO: 59899 - DNA, 25 bp, Homo sapien
tcctccagccttgcggcattatacg

SEQ ID NO: 59900 - DNA, 25 bp, Homo sapien
tctcccagattgcaggtagcgcggc

SEQ ID NO: 59901 - DNA, 25 bp, Homo sapien
tggcggaagccttcgtctcccagat

SEQ ID NO: 59902 - DNA, 25 bp, Homo sapien
cctagccaggcctggcggtaacctt

SEQ ID NO: 59903 - DNA, 25 bp, Homo sapien
gggctaggctcgttaactgccgaga

SEQ ID NO: 59904 - DNA, 25 bp, Homo sapien
cattatacgctgaacccggcccgga

SEQ ID NO: 59905 - DNA, 25 bp, Homo sapien
cgacatgtctctagtggcggaagcc

SEQ ID NO: 59906 - DNA, 25 bp, Homo sapien
ctgcacggcctgagctgcagactgc

SEQ ID NO: 59907 - DNA, 25 bp, Homo sapien
tcttgctgcaaagggaacgaggacc

SEQ ID NO: 59908 - DNA, 25 bp, Homo sapien
acagcggcgcttctgtccacagcag

SEQ ID NO: 59909 - DNA, 25 bp, Homo sapien
gcaggggataccaacgcagccgttg

SEQ ID NO: 59910 - DNA, 25 bp, Homo sapien
caacagtgcgaggaccggctggaaa

SEQ ID NO: 59911 - DNA, 25 bp, Homo sapien
gtttcccgtgtctctgtcgccattc

SEQ ID NO: 59912 - DNA, 25 bp, Homo sapien
actcagattgccaacggggcggcta

SEQ ID NO: 59913 - DNA, 25 bp, Homo sapien
tgcagactgcctggagcagcttccg

SEQ ID NO: 59914 - DNA, 25 bp, Homo sapien
tgggcacgctacaacgcgaccttga

SEQ ID NO: 59915 - DNA, 25 bp, Homo sapien
tgacccacgtgattcgccaagacga

SEQ ID NO: 59916 - DNA, 25 bp, Homo sapien
ccagaatgtgcccagctcgaatttc

SEQ ID NO: 59917 - DNA, 25 bp, Homo sapien
ggtaaccctgctagcttctccgatc

SEQ ID NO: 59918 - DNA, 25 bp, Homo sapien
tgcacttcagggtatcttcgcgccg

SEQ ID NO: 59919 - DNA, 25 bp, Homo sapien
cagtgatgtaccagagcgcgtcttc

SEQ ID NO: 59920 - DNA, 25 bp, Homo sapien
ttcctgagtctcgaagaggcgccca

SEQ ID NO: 59921 - DNA, 25 bp, Homo sapien
gctcggtctccagtcagctccagta

SEQ ID NO: 59922 - DNA, 25 bp, Homo sapien
cttccgatttggagaaaatgtcacg

SEQ ID NO: 59923 - DNA, 25 bp, Homo sapien
ttttccaggcggagcctccacgatg

SEQ ID NO: 59924 - DNA, 25 bp, Homo sapien
tggagccgcgacgtccaaacccgga

SEQ ID NO: 59925 - DNA, 25 bp, Homo sapien
ggacgcacttgaacccgcagcgagg

SEQ ID NO: 59926 - DNA, 25 bp, Homo sapien
cccgaatctgaaagcggagaccaag

SEQ ID NO: 59927 - DNA, 25 bp, Homo sapien
tgcctgcggcaaagctcgacataca

SEQ ID NO: 59928 - DNA, 25 bp, Homo sapien
aggctggcagttcgggtcatttcct

SEQ ID NO: 59929 - DNA, 25 bp, Homo sapien
gtcttcagcaaagcgagggccggct

SEQ ID NO: 59930 - DNA, 25 bp, Homo sapien
cgcaaatggcctcgaagcatgggga

SEQ ID NO: 59931 - DNA, 25 bp, Homo sapien
tggacgctcaccattggcggagacc

SEQ ID NO: 59932 - DNA, 25 bp, Homo sapien
tcggtcccatattgaactcgagttg

SEQ ID NO: 59933 - DNA, 25 bp, Homo sapien
cgagtccggtctcaaaatggaggta

SEQ ID NO: 59934 - DNA, 25 bp, Homo sapien
tcccgcgctcttgcgttgagacagg

SEQ ID NO: 59935 - DNA, 25 bp, Homo sapien
ccgcgttacgaaatggcgcattggc

SEQ ID NO: 59936 - DNA, 25 bp, Homo sapien
cgctgaagttctgccgacgcttttc

SEQ ID NO: 59937 - DNA, 25 bp, Homo sapien
gcggcggccacattgacattgatcc

SEQ ID NO: 59938 - DNA, 25 bp, Homo sapien
gccgctcaaacttaggggctccgga

SEQ ID NO: 59939 - DNA, 25 bp, Homo sapien
ctgggctttcaagagagctcaaggc

SEQ ID NO: 59940 - DNA, 25 bp, Homo sapien
aggcacatttttgccggcaccgagg

SEQ ID NO: 59941 - DNA, 25 bp, Homo sapien
ggcagctccaagtccatcatgatga

SEQ ID NO: 59942 - DNA, 25 bp, Homo sapien
atcatgatgagctgtggaccgtgtg

SEQ ID NO: 59943 - DNA, 25 bp, Homo sapien
cggcactcggtaatcggctacacgc

SEQ ID NO: 59944 - DNA, 25 bp, Homo sapien
agatggatgacttcgcaaagccgcg

SEQ ID NO: 59945 - DNA, 25 bp, Homo sapien
agcccgctgggcacttaaggcgctc

SEQ ID NO: 59946 - DNA, 25 bp, Homo sapien
ggcgccgctctgagtgacctttcac

SEQ ID NO: 59947 - DNA, 25 bp, Homo sapien
tgtgaagctccagacgcatggcacc

SEQ ID NO: 59948 - DNA, 25 bp, Homo sapien
gttctctctggccatctgctgggcc

SEQ ID NO: 59949 - DNA, 25 bp, Homo sapien
cgggaggctctgagtaccaatgagt

SEQ ID NO: 59950 - DNA, 25 bp, Homo sapien
caatgagtgcaaagcgcggagagcc

SEQ ID NO: 59951 - DNA, 25 bp, Homo sapien
ccatcccaaagaagcggtgagtagc

SEQ ID NO: 59952 - DNA, 25 bp, Homo sapien
ggccaaccgggagtcagctcgaact

SEQ ID NO: 59953 - DNA, 25 bp, Homo sapien
agctcgaactcacctgcttggcagg

SEQ ID NO: 59954 - DNA, 25 bp, Homo sapien
gactgaatctactcgtcccggcatg

SEQ ID NO: 59955 - DNA, 25 bp, Homo sapien
agggaccactctcgtcagtctctca

SEQ ID NO: 59956 - DNA, 25 bp, Homo sapien
atcttcaaatactctggactgcgga

SEQ ID NO: 59957 - DNA, 25 bp, Homo sapien
ccggcatgcaccgttccagtggttc

SEQ ID NO: 59958 - DNA, 25 bp, Homo sapien
cgctcactgtgtctgttatggcacc

SEQ ID NO: 59959 - DNA, 25 bp, Homo sapien
ggtgcggttactatggcaacagagc

SEQ ID NO: 59960 - DNA, 25 bp, Homo sapien
gcctcttaaagatgaggggcgctca

SEQ ID NO: 59961 - DNA, 25 bp, Homo sapien
gactgccggtttccttgtcgcaaga

SEQ ID NO: 59962 - DNA, 25 bp, Homo sapien
cggctgttatgcgtgcggttaccac

SEQ ID NO: 59963 - DNA, 25 bp, Homo sapien
aggcgtagtccctgttgcaccgacc

SEQ ID NO: 59964 - DNA, 25 bp, Homo sapien
agactgaatcttcccggtcccggca

SEQ ID NO: 59965 - DNA, 25 bp, Homo sapien
tcagaaggggaaagacgactactcc

SEQ ID NO: 59966 - DNA, 25 bp, Homo sapien
ttcaaatattctggactgcagcgtg

SEQ ID NO: 59967 - DNA, 25 bp, Homo sapien
actttgccacggaaggaatctgtta

SEQ ID NO: 59968 - DNA, 25 bp, Homo sapien
gccggtacactagcgcggtaaactc

SEQ ID NO: 59969 - DNA, 25 bp, Homo sapien
agggaccgttctcgttagtctctca

SEQ ID NO: 59970 - DNA, 25 bp, Homo sapien
caagtgttgatgttttgcagggatc

SEQ ID NO: 59971 - DNA, 25 bp, Homo sapien
gcgcctgggtacaggactcctgatt

SEQ ID NO: 59972 - DNA, 25 bp, Homo sapien
gactcctgattggaacacgattaga

SEQ ID NO: 59973 - DNA, 25 bp, Homo sapien
cccagtgggagtccgagatacaagt

SEQ ID NO: 59974 - DNA, 25 bp, Homo sapien
gggatctgaacacagaagcggactc

SEQ ID NO: 59975 - DNA, 25 bp, Homo sapien
cggactccgaggaatcgagagtgtc

SEQ ID NO: 59976 - DNA, 25 bp, Homo sapien
gaagagtctctggacggccggaatc

SEQ ID NO: 59977 - DNA, 25 bp, Homo sapien
tagaagagggaaacgcaccttgttc

SEQ ID NO: 59978 - DNA, 25 bp, Homo sapien
tcacctcaggaagggacttgccgca

SEQ ID NO: 59979 - DNA, 25 bp, Homo sapien
cccggaaattgtcagccgcctctgg

SEQ ID NO: 59980 - DNA, 25 bp, Homo sapien
gcagctgaggctgtaaatcttcacc

SEQ ID NO: 59981 - DNA, 25 bp, Homo sapien
atggcgccgcacaacactgttcaag

SEQ ID NO: 59982 - DNA, 25 bp, Homo sapien
tggcgccgactgatgacgcacttcc

SEQ ID NO: 59983 - DNA, 25 bp, Homo sapien
actagtgaggctctgacaacccggc

SEQ ID NO: 59984 - DNA, 25 bp, Homo sapien
acggcagtgtccttgtctcccaatg

SEQ ID NO: 59985 - DNA, 25 bp, Homo sapien
acctcattgaggctggagacctgca

SEQ ID NO: 59986 - DNA, 25 bp, Homo sapien
agccgcatcttccttgtgatcagca

SEQ ID NO: 59987 - DNA, 25 bp, Homo sapien
tggaacatccgttcccggcagctga

SEQ ID NO: 59988 - DNA, 25 bp, Homo sapien
ccaagcccatcaaggtgcgggtgcc

SEQ ID NO: 59989 - DNA, 25 bp, Homo sapien
caccatggacgaagctggcagctct

SEQ ID NO: 59990 - DNA, 25 bp, Homo sapien
gccttttggcgacatccaggacatc

SEQ ID NO: 59991 - DNA, 25 bp, Homo sapien
tgcgggacaagcacaccaaggagtc

SEQ ID NO: 59992 - DNA, 25 bp, Homo sapien
tcctgcattcgggtggagcaccatg

SEQ ID NO: 59993 - DNA, 25 bp, Homo sapien
caagggcattgctttcgtcaagttc

SEQ ID NO: 59994 - DNA, 25 bp, Homo sapien
gatgtaattgtcagcggaaaaccga

SEQ ID NO: 59995 - DNA, 25 bp, Homo sapien
cggatggcaactcggggtttccact

SEQ ID NO: 59996 - DNA, 25 bp, Homo sapien
actgcgggtgatctcgggacaccac

SEQ ID NO: 59997 - DNA, 25 bp, Homo sapien
gtccttagcccatctggcggcgcag

SEQ ID NO: 59998 - DNA, 25 bp, Homo sapien
gccctccaggtaggtgtcctagctg

SEQ ID NO: 59999 - DNA, 25 bp, Homo sapien
gtcctagctgcaaagggattgcttg

SEQ ID NO: 60000 - DNA, 25 bp, Homo sapien
gtcagcccattctcgcggccgggat

SEQ ID NO: 60001 - DNA, 25 bp, Homo sapien
gtctgtatcgcggtcccggtttgcc

SEQ ID NO: 60002 - DNA, 25 bp, Homo sapien
acgcttggccgctgttcgcagctca

SEQ ID NO: 60003 - DNA, 25 bp, Homo sapien
ttggccgctgttcgcagctcaactc

SEQ ID NO: 60004 - DNA, 25 bp, Homo sapien
gagaacgcagccgtctggtcccgaa

SEQ ID NO: 60005 - DNA, 25 bp, Homo sapien
gaacgcagccgtctggtcccgaact

SEQ ID NO: 60006 - DNA, 25 bp, Homo sapien
ggccgctgttcgcagctcaactcgg

SEQ ID NO: 60007 - DNA, 25 bp, Homo sapien
cgctgttcgcagctcaactcgggaa

SEQ ID NO: 60008 - DNA, 25 bp, Homo sapien
agtcgttccccggattccaggcacg

SEQ ID NO: 60009 - DNA, 25 bp, Homo sapien
gattccaggcacgcagatccggcag

SEQ ID NO: 60010 - DNA, 25 bp, Homo sapien
gctgggatccaccaatgtccgcttc

SEQ ID NO: 60011 - DNA, 25 bp, Homo sapien
tcgcggcctgaaacagctcccattg

SEQ ID NO: 60012 - DNA, 25 bp, Homo sapien
gcgagtcactcaccttgttttgcga

SEQ ID NO: 60013 - DNA, 25 bp, Homo sapien
gcccactcaggctcttcgaacatga

SEQ ID NO: 60014 - DNA, 25 bp, Homo sapien
tcctctggaagtcggagcgctcaga

SEQ ID NO: 60015 - DNA, 25 bp, Homo sapien
cccggaaaccaaagcgtgacagcca

SEQ ID NO: 60016 - DNA, 25 bp, Homo sapien
cggcgcagcgaaccatcgagtttag

SEQ ID NO: 60017 - DNA, 25 bp, Homo sapien
cgcccttaacggtgccacaggtgtc

SEQ ID NO: 60018 - DNA, 25 bp, Homo sapien
cgtgcttggttttccggaccttgct

SEQ ID NO: 60019 - DNA, 25 bp, Homo sapien
ttgctcgtgcttggttttccggacc

SEQ ID NO: 60020 - DNA, 25 bp, Homo sapien
gcctcttgctcgtgcttggttttcc

SEQ ID NO: 60021 - DNA, 25 bp, Homo sapien
tccctctgaattcgccgggcaggga

SEQ ID NO: 60022 - DNA, 25 bp, Homo sapien
cttcgttgctcttgggtggccgcgg

SEQ ID NO: 60023 - DNA, 25 bp, Homo sapien
gctccctctgaattcgccgggcagg

SEQ ID NO: 60024 - DNA, 25 bp, Homo sapien
cttcattggcgacctggtggggcct

SEQ ID NO: 60025 - DNA, 25 bp, Homo sapien
attcgccgggcagggatacagccgc

SEQ ID NO: 60026 - DNA, 25 bp, Homo sapien
tacgaaggcagaattccagggagtc

SEQ ID NO: 60027 - DNA, 25 bp, Homo sapien
gggcctggtcctgaagcttgagacc

SEQ ID NO: 60028 - DNA, 25 bp, Homo sapien
ccctgaccagcctgtagtaactggc

SEQ ID NO: 60029 - DNA, 25 bp, Homo sapien
actgcccgcacgctgacctgaaggt

SEQ ID NO: 60030 - DNA, 25 bp, Homo sapien
tttgtccttagcaggaggccgtttc

SEQ ID NO: 60031 - DNA, 25 bp, Homo sapien
gccgcagcctctcagggaaaacctg

SEQ ID NO: 60032 - DNA, 25 bp, Homo sapien
cgccgggcacggctttacccagaat

SEQ ID NO: 60033 - DNA, 25 bp, Homo sapien
ctcctgcttgcgttgctccagcgag

SEQ ID NO: 60034 - DNA, 25 bp, Homo sapien
aacgctgtttctaggccctcgggct

SEQ ID NO: 60035 - DNA, 25 bp, Homo sapien
tccgacgcgtggcaggcgttgtcct

SEQ ID NO: 60036 - DNA, 25 bp, Homo sapien
actcgctccgcttcttctcgctaaa

SEQ ID NO: 60037 - DNA, 25 bp, Homo sapien
ttaagatcgcaacgcacactcgctc

SEQ ID NO: 60038 - DNA, 25 bp, Homo sapien
ggctggctgtcctcagtctttaaga

SEQ ID NO: 60039 - DNA, 25 bp, Homo sapien
ggctcagcgcggttaacgctgtttc

SEQ ID NO: 60040 - DNA, 25 bp, Homo sapien
gcgttgtcctgcgtcacaaagggcc

SEQ ID NO: 60041 - DNA, 25 bp, Homo sapien
tcagtctttaagatcgcaacgcaca

SEQ ID NO: 60042 - DNA, 25 bp, Homo sapien
agcctcgggactgttggccaccggc

SEQ ID NO: 60043 - DNA, 25 bp, Homo sapien
agagaactaagtgcccgcgggatga

SEQ ID NO: 60044 - DNA, 25 bp, Homo sapien
gggcagctcctccttaggtaggcac

SEQ ID NO: 60045 - DNA, 25 bp, Homo sapien
cgcagcggagctcgaaggtcttgtc

SEQ ID NO: 60046 - DNA, 25 bp, Homo sapien
ccctttcatccaggaagtgaaatcg

SEQ ID NO: 60047 - DNA, 25 bp, Homo sapien
catccaggaagtgaaatcgacgtcg

SEQ ID NO: 60048 - DNA, 25 bp, Homo sapien
atcgacgtcggggtcaatgaaaaca

SEQ ID NO: 60049 - DNA, 25 bp, Homo sapien
cctccttaggtaggcaccggggctg

SEQ ID NO: 60050 - DNA, 25 bp, Homo sapien
caagggcgctcaggaacggaaaagc

SEQ ID NO: 60051 - DNA, 25 bp, Homo sapien
gggagccacatctggttcctgcacg

SEQ ID NO: 60052 - DNA, 25 bp, Homo sapien
tgcacgctggcaaaagagacccgct

SEQ ID NO: 60053 - DNA, 25 bp, Homo sapien
gagacccgctggaaaataaggacta

SEQ ID NO: 60054 - DNA, 25 bp, Homo sapien
aggactaacgcccaaacctgttgca

SEQ ID NO: 60055 - DNA, 25 bp, Homo sapien
cctgttgcacaattcgggtcccttt

SEQ ID NO: 60056 - DNA, 25 bp, Homo sapien
tcgggtccctttcacccagaaatga

SEQ ID NO: 60057 - DNA, 25 bp, Homo sapien
ggccggtcaccggtcacacaaagga

SEQ ID NO: 60058 - DNA, 25 bp, Homo sapien
ccgggaagctgttgctcacgctccg

SEQ ID NO: 60059 - DNA, 25 bp, Homo sapien
gcagagacttgcgaggcacacagag

SEQ ID NO: 60060 - DNA, 25 bp, Homo sapien
ggggctcgttgacactgcagagcct

SEQ ID NO: 60061 - DNA, 25 bp, Homo sapien
gtgacggtttactaagcagagactt

SEQ ID NO: 60062 - DNA, 25 bp, Homo sapien
gcgccgaagctgtgacggtttacta

SEQ ID NO: 60063 - DNA, 25 bp, Homo sapien
ggggcttcgcgcagacgttctcccg

SEQ ID NO: 60064 - DNA, 25 bp, Homo sapien
tgggcgcccagagcttacctcggcg

SEQ ID NO: 60065 - DNA, 25 bp, Homo sapien
tttggacgtgccaacgccactctcg

SEQ ID NO: 60066 - DNA, 25 bp, Homo sapien
tgcggggactccacggagttcgata

SEQ ID NO: 60067 - DNA, 25 bp, Homo sapien
tcacagccgtatcagtgagcccgca

SEQ ID NO: 60068 - DNA, 25 bp, Homo sapien
gtagcgagaagacccacgcacactc

SEQ ID NO: 60069 - DNA, 25 bp, Homo sapien
acggagttcgataattacctagagc

SEQ ID NO: 60070 - DNA, 25 bp, Homo sapien
cccgagcgtagcgagaagacccacg

SEQ ID NO: 60071 - DNA, 25 bp, Homo sapien
aatgccgctcacagccgtatcagtg

SEQ ID NO: 60072 - DNA, 25 bp, Homo sapien
gccattacaccggacgtacgtcact

SEQ ID NO: 60073 - DNA, 25 bp, Homo sapien
ttcccgagcaccgacggtaggaaga

SEQ ID NO: 60074 - DNA, 25 bp, Homo sapien
gcaagtggcagctcttctccgcctg

SEQ ID NO: 60075 - DNA, 25 bp, Homo sapien
tgcgtgcctggcctcgtcaacaaca

SEQ ID NO: 60076 - DNA, 25 bp, Homo sapien
ggcctcgtcaacaacacccattagt

SEQ ID NO: 60077 - DNA, 25 bp, Homo sapien
acgcgggtagcccaatgggcagcct

SEQ ID NO: 60078 - DNA, 25 bp, Homo sapien
ccctccgccaggcaagcagcgagca

SEQ ID NO: 60079 - DNA, 25 bp, Homo sapien
gcgctcgcctcggaacttgctgact

SEQ ID NO: 60080 - DNA, 25 bp, Homo sapien
tcggaacttgctgactgcgcggccg

SEQ ID NO: 60081 - DNA, 25 bp, Homo sapien
cacccattagtctcccgtctcccgg

SEQ ID NO: 60082 - DNA, 25 bp, Homo sapien
gtcccacgcggacacaggaactatg

SEQ ID NO: 60083 - DNA, 25 bp, Homo sapien
acgcggacacaggaactatggcacc

SEQ ID NO: 60084 - DNA, 25 bp, Homo sapien
cggacacaggaactatggcaccgtc

SEQ ID NO: 60085 - DNA, 25 bp, Homo sapien
cacgcggacacaggaactatggcac

SEQ ID NO: 60086 - DNA, 25 bp, Homo sapien
tcccacgcggacacaggaactatgg

SEQ ID NO: 60087 - DNA, 25 bp, Homo sapien
cccacgcggacacaggaactatggc

SEQ ID NO: 60088 - DNA, 25 bp, Homo sapien
gtcccacgcggacacaggaactatt

SEQ ID NO: 60089 - DNA, 25 bp, Homo sapien
ccacgcggacacaggaactatggca

SEQ ID NO: 60090 - DNA, 25 bp, Homo sapien
agcctgcgctttcccattggaaacg

SEQ ID NO: 60091 - DNA, 25 bp, Homo sapien
tatgcaaatatcctgcggggccggg

SEQ ID NO: 60092 - DNA, 25 bp, Homo sapien
gcggacggcccgtatgcaaatatcc

SEQ ID NO: 60093 - DNA, 25 bp, Homo sapien
gacacctgtgaaggagcagcacgaa

SEQ ID NO: 60094 - DNA, 25 bp, Homo sapien
agatccgcgcatgtctctgtgaggc

SEQ ID NO: 60095 - DNA, 25 bp, Homo sapien
ccattggaaacgtgggcagcgtgca

SEQ ID NO: 60096 - DNA, 25 bp, Homo sapien
gagagaacaaaatgccctcggattg

SEQ ID NO: 60097 - DNA, 25 bp, Homo sapien
ggctcctcagagcttatcctgcttt

SEQ ID NO: 60098 - DNA, 25 bp, Homo sapien
ttctgtctgacgctcaagacctggc

SEQ ID NO: 60099 - DNA, 25 bp, Homo sapien
gctgcatcaagaagtccaccaaagg

SEQ ID NO: 60100 - DNA, 25 bp, Homo sapien
cgcctgtctctgttagtgctctcca

SEQ ID NO: 60101 - DNA, 25 bp, Homo sapien
gctctgggacacctcattctgtctg

SEQ ID NO: 60102 - DNA, 25 bp, Homo sapien
aagacctggcttcgacgtttatggc

SEQ ID NO: 60103 - DNA, 25 bp, Homo sapien
tatggccctatgtccctcgactacg

SEQ ID NO: 60104 - DNA, 25 bp, Homo sapien
cccaccgtaggcgtgtaatcttcca

SEQ ID NO: 60105 - DNA, 25 bp, Homo sapien
cctcccatagtggatctgcgggtta

SEQ ID NO: 60106 - DNA, 25 bp, Homo sapien
gagttggactgatgcgccctcagca

SEQ ID NO: 60107 - DNA, 25 bp, Homo sapien
ctagggattccctgcccgattcaaa

SEQ ID NO: 60108 - DNA, 25 bp, Homo sapien
gcctcatctcttggggcgttcttcc

SEQ ID NO: 60109 - DNA, 25 bp, Homo sapien
tcgcatcccgtgcaactttggggta

SEQ ID NO: 60110 - DNA, 25 bp, Homo sapien
tggccgtttagtgttgaatgttccc

SEQ ID NO: 60111 - DNA, 25 bp, Homo sapien
aactaacttatcttggggcggcagc

SEQ ID NO: 60112 - DNA, 25 bp, Homo sapien
caacacgctgttcggctactcggtc

SEQ ID NO: 60113 - DNA, 25 bp, Homo sapien
tacaacgtggacactgagagcgcgc

SEQ ID NO: 60114 - DNA, 25 bp, Homo sapien
tgtccctcccgatctcgaagatgcc

SEQ ID NO: 60115 - DNA, 25 bp, Homo sapien
tcctccagggcatggcggagtcgca

SEQ ID NO: 60116 - DNA, 25 bp, Homo sapien
gcaaaagctcgtgggtgtaggcctt

SEQ ID NO: 60117 - DNA, 25 bp, Homo sapien
ttaacagcgccggaggcacagcggc

SEQ ID NO: 60118 - DNA, 25 bp, Homo sapien
cctccgtctgctgcggggacgttaa

SEQ ID NO: 60119 - DNA, 25 bp, Homo sapien
ctgctgcggggacgttaacagcgcc

SEQ ID NO: 60120 - DNA, 25 bp, Homo sapien
aggctaggtagcgaaagaatccctg

SEQ ID NO: 60121 - DNA, 25 bp, Homo sapien
actcggtaacctgtccgggcagtga

SEQ ID NO: 60122 - DNA, 25 bp, Homo sapien
gcgaagcattcacagggccaagata

SEQ ID NO: 60123 - DNA, 25 bp, Homo sapien
acagatgctcgctcttgcaaaggga

SEQ ID NO: 60124 - DNA, 25 bp, Homo sapien
tagctcggaggctcttgagagcttc

SEQ ID NO: 60125 - DNA, 25 bp, Homo sapien
ctggcggtgacctgtttctcaggga

SEQ ID NO: 60126 - DNA, 25 bp, Homo sapien
tttcatgactcactgccctcgagca

SEQ ID NO: 60127 - DNA, 25 bp, Homo sapien
cgcgcggacaacaaaagcctctttc

SEQ ID NO: 60128 - DNA, 25 bp, Homo sapien
ctttggacttgtttggacggttgca

SEQ ID NO: 60129 - DNA, 25 bp, Homo sapien
cgagagaagagagtcagccggatcc

SEQ ID NO: 60130 - DNA, 25 bp, Homo sapien
acacagacaactgggtgccatccga

SEQ ID NO: 60131 - DNA, 25 bp, Homo sapien
tcgcgatatggctcaaggactgccg

SEQ ID NO: 60132 - DNA, 25 bp, Homo sapien
tgcccaacgagaagatcgcgatatg

SEQ ID NO: 60133 - DNA, 25 bp, Homo sapien
gctgcatttgccgtggtagattttc

SEQ ID NO: 60134 - DNA, 25 bp, Homo sapien
actgagacgtgtcgcttaggctgca

SEQ ID NO: 60135 - DNA, 25 bp, Homo sapien
tgccatccgatttccctgccaaggg

SEQ ID NO: 60136 - DNA, 25 bp, Homo sapien
tgccacgagttctgggagagcctcg

SEQ ID NO: 60137 - DNA, 25 bp, Homo sapien
cggagacggaggatctgtccacaga

SEQ ID NO: 60138 - DNA, 25 bp, Homo sapien
gtggctgcacctcaccaatcccgtg

SEQ ID NO: 60139 - DNA, 25 bp, Homo sapien
gaagaggcgggcttcgccatccacc

SEQ ID NO: 60140 - DNA, 25 bp, Homo sapien
agaccggcgcgtgaggaacctaccg

SEQ ID NO: 60141 - DNA, 25 bp, Homo sapien
ctcaccaatcccgtgcgccgcggct

SEQ ID NO: 60142 - DNA, 25 bp, Homo sapien
tgtgcttctctcctgcacgcggtgc

SEQ ID NO: 60143 - DNA, 25 bp, Homo sapien
ctcctgcacgcggtgcttgggctcg

SEQ ID NO: 60144 - DNA, 25 bp, Homo sapien
ggggagtagctacaggaagcgaccc

SEQ ID NO: 60145 - DNA, 25 bp, Homo sapien
gcgcacaccgccacgtcaacctaaa

SEQ ID NO: 60146 - DNA, 25 bp, Homo sapien
cgcagaccatgatcccggcaggatg

SEQ ID NO: 60147 - DNA, 25 bp, Homo sapien
ccgcagtaacgatggcctcgggaga

SEQ ID NO: 60148 - DNA, 25 bp, Homo sapien
caggccaggttctccggccacgagt

SEQ ID NO: 60149 - DNA, 25 bp, Homo sapien
cttgatgagtatgggctcacagccc

SEQ ID NO: 60150 - DNA, 25 bp, Homo sapien
ctcgcacacagacttacagggcttg

SEQ ID NO: 60151 - DNA, 25 bp, Homo sapien
ggcatcttagtcatgttccagggca

SEQ ID NO: 60152 - DNA, 25 bp, Homo sapien
tcgtacactggcagctcctcgcagg

SEQ ID NO: 60153 - DNA, 25 bp, Homo sapien
agcagaccttcgaactgctcgatgg

SEQ ID NO: 60154 - DNA, 25 bp, Homo sapien
gctgctcttcccgagaatggagtgg

SEQ ID NO: 60155 - DNA, 25 bp, Homo sapien
tttcctacctcccgcctgagaggga

SEQ ID NO: 60156 - DNA, 25 bp, Homo sapien
cgggcggctctgcactttcctacct

SEQ ID NO: 60157 - DNA, 25 bp, Homo sapien
ccaagacagcgccgagtcgagcgcg

SEQ ID NO: 60158 - DNA, 25 bp, Homo sapien
ctgctcttcccgagaatggagtggg

SEQ ID NO: 60159 - DNA, 25 bp, Homo sapien
ccgcagggacgtctgtgcctctgcc

SEQ ID NO: 60160 - DNA, 25 bp, Homo sapien
aagccgtgcgagtgcgagaccccaa

SEQ ID NO: 60161 - DNA, 25 bp, Homo sapien
tgcgagtgcgagaccccaagacagc

SEQ ID NO: 60162 - DNA, 25 bp, Homo sapien
gctgcagcactgagcgcgacatggt

SEQ ID NO: 60163 - DNA, 25 bp, Homo sapien
ggtcgcgttgtgtgctctttccact

SEQ ID NO: 60164 - DNA, 25 bp, Homo sapien
gcccactacgcctgatgccgggatg

SEQ ID NO: 60165 - DNA, 25 bp, Homo sapien
cagcttctgctgactgggctgcagc

SEQ ID NO: 60166 - DNA, 25 bp, Homo sapien
atggtgagcttctccgccagcttct

SEQ ID NO: 60167 - DNA, 25 bp, Homo sapien
ccgtgcgcaccttcttgatgttgta

SEQ ID NO: 60168 - DNA, 25 bp, Homo sapien
ggcgacgccgagatttctacacccg

SEQ ID NO: 60169 - DNA, 25 bp, Homo sapien
ctccttcaagttcccaaaagttgct

SEQ ID NO: 60170 - DNA, 25 bp, Homo sapien
caacttgcgcatgggattcggctta

SEQ ID NO: 60171 - DNA, 25 bp, Homo sapien
ggcttactgtccgtgactgcccgcg

SEQ ID NO: 60172 - DNA, 25 bp, Homo sapien
attcggcttactgtccgtgactgcc

SEQ ID NO: 60173 - DNA, 25 bp, Homo sapien
acttgcgcatgggattcggcttact

SEQ ID NO: 60174 - DNA, 25 bp, Homo sapien
cagtttgcaagtggctgcgccaagg

SEQ ID NO: 60175 - DNA, 25 bp, Homo sapien
cacccagcagtttgcaagtggctgc

SEQ ID NO: 60176 - DNA, 25 bp, Homo sapien
gtgtccacccagcagtttgcaagtg

SEQ ID NO: 60177 - DNA, 25 bp, Homo sapien
atgggattcggcttactgtccgtga

SEQ ID NO: 60178 - DNA, 25 bp, Homo sapien
gctcgtcgtcccgacgcgaatctga

SEQ ID NO: 60179 - DNA, 25 bp, Homo sapien
ctataataacactcatgcctgccag

SEQ ID NO: 60180 - DNA, 25 bp, Homo sapien
gccgctcactataataacactcatg

SEQ ID NO: 60181 - DNA, 25 bp, Homo sapien
ggcaacgccgctcactataataaca

SEQ ID NO: 60182 - DNA, 25 bp, Homo sapien
cagcaactccgagtgcaggcgccga

SEQ ID NO: 60183 - DNA, 25 bp, Homo sapien
agccagtctccagaggacgtgccgg

SEQ ID NO: 60184 - DNA, 25 bp, Homo sapien
tgaggagaaacaggagcgagagact

SEQ ID NO: 60185 - DNA, 25 bp, Homo sapien
gtcccgacgcgaatctgaggagaaa

SEQ ID NO: 60186 - DNA, 25 bp, Homo sapien
ccgccagatgccagccgataggaca

SEQ ID NO: 60187 - DNA, 25 bp, Homo sapien
tgaggccaccactgtcagtacgtgc

SEQ ID NO: 60188 - DNA, 25 bp, Homo sapien
ggcgcatgctcattctcgtcctgca

SEQ ID NO: 60189 - DNA, 25 bp, Homo sapien
caccagtgcttgagtgcagccggaa

SEQ ID NO: 60190 - DNA, 25 bp, Homo sapien
ttctcatccgtgacgaagacgcgcg

SEQ ID NO: 60191 - DNA, 25 bp, Homo sapien
ccaccagtgtgtaggtgagtgcacc

SEQ ID NO: 60192 - DNA, 25 bp, Homo sapien
agtaggcgcctcgtcgttgacgtca

SEQ ID NO: 60193 - DNA, 25 bp, Homo sapien
ctcagctcgttgttcgcggtccaac

SEQ ID NO: 60194 - DNA, 25 bp, Homo sapien
agggaattcctcttgtgcccgacga

SEQ ID NO: 60195 - DNA, 25 bp, Homo sapien
tccgtggacacacatttgctccgca

SEQ ID NO: 60196 - DNA, 25 bp, Homo sapien
ccacgcacgagttcgagaagagccc

SEQ ID NO: 60197 - DNA, 25 bp, Homo sapien
ccctgcgactctccgggaatacaga

SEQ ID NO: 60198 - DNA, 25 bp, Homo sapien
ggggcaacctagcagctcctccgga

SEQ ID NO: 60199 - DNA, 25 bp, Homo sapien
gtgcccgacgaatattccgtggaca

SEQ ID NO: 60200 - DNA, 25 bp, Homo sapien
tcgctcactcacatatccaatggga

SEQ ID NO: 60201 - DNA, 25 bp, Homo sapien
taccgagcaccaggagagccatgcc

SEQ ID NO: 60202 - DNA, 25 bp, Homo sapien
agggatcgccacacacgggtcgcga

SEQ ID NO: 60203 - DNA, 25 bp, Homo sapien
gctcggactgtaccggccgcaactg

SEQ ID NO: 60204 - DNA, 25 bp, Homo sapien
ccgctaccattggaagcctggaacg

SEQ ID NO: 60205 - DNA, 25 bp, Homo sapien
ccattcctggtcaggtccggacaga

SEQ ID NO: 60206 - DNA, 25 bp, Homo sapien
ctgtgccggccatggagctgtacct

SEQ ID NO: 60207 - DNA, 25 bp, Homo sapien
gacacccagcagtgcagagacgtga

SEQ ID NO: 60208 - DNA, 25 bp, Homo sapien
cggaccgattttcccagctctgcgg

SEQ ID NO: 60209 - DNA, 25 bp, Homo sapien
caaagtcgccgtcaccaagacggtc

SEQ ID NO: 60210 - DNA, 25 bp, Homo sapien
attactatagtgacgctgctggcgc

SEQ ID NO: 60211 - DNA, 25 bp, Homo sapien
ccctgacggtattcagctgcgcgta

SEQ ID NO: 60212 - DNA, 25 bp, Homo sapien
cctcgggactggcacagggttttat

SEQ ID NO: 60213 - DNA, 25 bp, Homo sapien
tcgacctgtcgcaaaggccgcgttt

SEQ ID NO: 60214 - DNA, 25 bp, Homo sapien
tggactcaaccagctcgcccagatt

SEQ ID NO: 60215 - DNA, 25 bp, Homo sapien
cacgagtgacgcgtagtcattttcc

SEQ ID NO: 60216 - DNA, 25 bp, Homo sapien
cggggccaatgagcgactcgctttc

SEQ ID NO: 60217 - DNA, 25 bp, Homo sapien
ttttgccatctgaaaagggcctatc

SEQ ID NO: 60218 - DNA, 25 bp, Homo sapien
gtgctcagcctgaggccttcgtcca

SEQ ID NO: 60219 - DNA, 25 bp, Homo sapien
cgcgtcttcgtaagtggccgcactt

SEQ ID NO: 60220 - DNA, 25 bp, Homo sapien
gccgtggatttcttcgtgcccagcg

SEQ ID NO: 60221 - DNA, 25 bp, Homo sapien
cgtggacagtcctgccgagtactct

SEQ ID NO: 60222 - DNA, 25 bp, Homo sapien
gccgcgccttcaacctagacgtgga

SEQ ID NO: 60223 - DNA, 25 bp, Homo sapien
gcgcacttcggcgatggcttttccg

SEQ ID NO: 60224 - DNA, 25 bp, Homo sapien
ctcacggaagtacgctgagctctcc

SEQ ID NO: 60225 - DNA, 25 bp, Homo sapien
cccagcgtttctccattgggattga

SEQ ID NO: 60226 - DNA, 25 bp, Homo sapien
cgcggccgccagagcggaactcagc

SEQ ID NO: 60227 - DNA, 25 bp, Homo sapien
gccgccagagcggaactcagccgct

SEQ ID NO: 60228 - DNA, 25 bp, Homo sapien
tgcttctcggcctggccgtggtgct

SEQ ID NO: 60229 - DNA, 25 bp, Homo sapien
ccggcgtgtcccctgcaccctgctt

SEQ ID NO: 60230 - DNA, 25 bp, Homo sapien
atggcgaggctctgccggcgtgtcc

SEQ ID NO: 60231 - DNA, 25 bp, Homo sapien
tggctctaggccatggcgaggctct

SEQ ID NO: 60232 - DNA, 25 bp, Homo sapien
ccgcaatatgccgccgcggccctct

SEQ ID NO: 60233 - DNA, 25 bp, Homo sapien
cctctggctctaggccatggcgagg

SEQ ID NO: 60234 - DNA, 25 bp, Homo sapien
agcctccactgcgtttcgaagcgac

SEQ ID NO: 60235 - DNA, 25 bp, Homo sapien
tcggctcactgaggcgccagccggt

SEQ ID NO: 60236 - DNA, 25 bp, Homo sapien
aggcgccagccggtctccaagacga

SEQ ID NO: 60237 - DNA, 25 bp, Homo sapien
tctccaagacgacggcgtgcaggct

SEQ ID NO: 60238 - DNA, 25 bp, Homo sapien
tcccggtgtgccctgcgccgaagaa

SEQ ID NO: 60239 - DNA, 25 bp, Homo sapien
cgccgaagaagagcgggcgacaaag

SEQ ID NO: 60240 - DNA, 25 bp, Homo sapien
tgcgggatggcatggattctgcaac

SEQ ID NO: 60241 - DNA, 25 bp, Homo sapien
atggcatggattctgcaactctccc

SEQ ID NO: 60242 - DNA, 25 bp, Homo sapien
cgccgtgttggcgtagagaaacttt

SEQ ID NO: 60243 - DNA, 25 bp, Homo sapien
atctaggctcttccctggctgcgaa

SEQ ID NO: 60244 - DNA, 25 bp, Homo sapien
gctggccagcaggttgtaaaaaatt

SEQ ID NO: 60245 - DNA, 25 bp, Homo sapien
ctaagacctgttgacgcctgctatg

SEQ ID NO: 60246 - DNA, 25 bp, Homo sapien
agcaggcaagtcatcgtcgggtcac

SEQ ID NO: 60247 - DNA, 25 bp, Homo sapien
cgggccgcggatactttaaagctca

SEQ ID NO: 60248 - DNA, 25 bp, Homo sapien
acatggttacccttctgctgcgcgg

SEQ ID NO: 60249 - DNA, 25 bp, Homo sapien
tcagggagtcgtccagcactaaagg

SEQ ID NO: 60250 - DNA, 25 bp, Homo sapien
ctgtgttctctgcagattctaagta

SEQ ID NO: 60251 - DNA, 25 bp, Homo sapien
cggctcaacgaaggaagttcagggc

SEQ ID NO: 60252 - DNA, 25 bp, Homo sapien
ggaccagagattggccattccgcta

SEQ ID NO: 60253 - DNA, 25 bp, Homo sapien
aacatccgcgtggttcgttgtggcg

SEQ ID NO: 60254 - DNA, 25 bp, Homo sapien
attctaagtatgaggggcaccgcgc

SEQ ID NO: 60255 - DNA, 25 bp, Homo sapien
ggaattgtcagtcgcgttcggactc

SEQ ID NO: 60256 - DNA, 25 bp, Homo sapien
cggatatcggctttgggtagagcac

SEQ ID NO: 60257 - DNA, 25 bp, Homo sapien
tccgctactgcgcaaagatggtgga

SEQ ID NO: 60258 - DNA, 25 bp, Homo sapien
cgtagggagattctgcgcgaaacta

SEQ ID NO: 60259 - DNA, 25 bp, Homo sapien
gacggtcgcagtgcaaagctccagc

SEQ ID NO: 60260 - DNA, 25 bp, Homo sapien
ggaagaaagcgctgcgcaccggcta

SEQ ID NO: 60261 - DNA, 25 bp, Homo sapien
tctgcgcgaaactaagcgtcaggtg

SEQ ID NO: 60262 - DNA, 25 bp, Homo sapien
gcgagacgagctcccgtcaaccttg

SEQ ID NO: 60263 - DNA, 25 bp, Homo sapien
gcccagctcttataccgagtcgggg

SEQ ID NO: 60264 - DNA, 25 bp, Homo sapien
gccgggcccagctcttataccgagt

SEQ ID NO: 60265 - DNA, 25 bp, Homo sapien
actaagcgtcaggtgctggaagaaa

SEQ ID NO: 60266 - DNA, 25 bp, Homo sapien
ggacgcgaccagaggacagctctgt

SEQ ID NO: 60267 - DNA, 25 bp, Homo sapien
cactggaccctgaaggtggtccgca

SEQ ID NO: 60268 - DNA, 25 bp, Homo sapien
acgcgacgaaaaggctcctggactc

SEQ ID NO: 60269 - DNA, 25 bp, Homo sapien
cccacacaaggaggatctaagcagc

SEQ ID NO: 60270 - DNA, 25 bp, Homo sapien
aaatgcccagccgagggacgcgacc

SEQ ID NO: 60271 - DNA, 25 bp, Homo sapien
gtggctaatgccgtaggctccttca

SEQ ID NO: 60272 - DNA, 25 bp, Homo sapien
cgcgcagacgctattggtaagactc

SEQ ID NO: 60273 - DNA, 25 bp, Homo sapien
acccggcctgcgcatgcgttcaagt

SEQ ID NO: 60274 - DNA, 25 bp, Homo sapien
cgccgaggatgcgagctccgctgcc

SEQ ID NO: 60275 - DNA, 25 bp, Homo sapien
cactccgacgatgcactggaacaca

SEQ ID NO: 60276 - DNA, 25 bp, Homo sapien
gacgatgcactggaacacaacgctg

SEQ ID NO: 60277 - DNA, 25 bp, Homo sapien
gcactggaacacaacgctgtcgcac

SEQ ID NO: 60278 - DNA, 25 bp, Homo sapien
cattgtctccggctcagaacaaagc

SEQ ID NO: 60279 - DNA, 25 bp, Homo sapien
ttggccgtcgatcggtccgtccgct

SEQ ID NO: 60280 - DNA, 25 bp, Homo sapien
ctgacacactccgacgatgcactgg

SEQ ID NO: 60281 - DNA, 25 bp, Homo sapien
atcgtccgcagtcgctgtctccgag

SEQ ID NO: 60282 - DNA, 25 bp, Homo sapien
ctggactaagcgctaagcgggcttg

SEQ ID NO: 60283 - DNA, 25 bp, Homo sapien
tgctgcgggacgcaccaggcctagt

SEQ ID NO: 60284 - DNA, 25 bp, Homo sapien
aagttcctctcagttccttccggtg

SEQ ID NO: 60285 - DNA, 25 bp, Homo sapien
cccgcgagaagccatctgaggcggc

SEQ ID NO: 60286 - DNA, 25 bp, Homo sapien
ctgaggcggcgacgactgttctcag

SEQ ID NO: 60287 - DNA, 25 bp, Homo sapien
gtttcggtgttttagcagaggcaga

SEQ ID NO: 60288 - DNA, 25 bp, Homo sapien
tgcccacggcatgccgctggactaa

SEQ ID NO: 60289 - DNA, 25 bp, Homo sapien
gcgctgtctcctctgctactctgtt

SEQ ID NO: 60290 - DNA, 25 bp, Homo sapien
ggcaagcgcgagttctactttgaca

SEQ ID NO: 60291 - DNA, 25 bp, Homo sapien
tggcggagctcatcaactgcttggc

SEQ ID NO: 60292 - DNA, 25 bp, Homo sapien
tacggggacctcctcagtcagtacc

SEQ ID NO: 60293 - DNA, 25 bp, Homo sapien
cgctgccagcgacgacatagagata

SEQ ID NO: 60294 - DNA, 25 bp, Homo sapien
gtgtgtcatcgaggtgtactatttc

SEQ ID NO: 60295 - DNA, 25 bp, Homo sapien
gacgactgttgcaagagccacctga

SEQ ID NO: 60296 - DNA, 25 bp, Homo sapien
atcctcgtctcgtccgtggtcatgt

SEQ ID NO: 60297 - DNA, 25 bp, Homo sapien
cccggacgccttcaagtgtgtcatc

SEQ ID NO: 60298 - DNA, 25 bp, Homo sapien
ggcgcgaacgctatagggcagctaa

SEQ ID NO: 60299 - DNA, 25 bp, Homo sapien
gcgagcagcgccaatctcacgttgc

SEQ ID NO: 60300 - DNA, 25 bp, Homo sapien
gaagctttcccggacagactcgctg

SEQ ID NO: 60301 - DNA, 25 bp, Homo sapien
ttccctaccgacgaaggcgactgta

SEQ ID NO: 60302 - DNA, 25 bp, Homo sapien
agcctctgaggccacttggctctta

SEQ ID NO: 60303 - DNA, 25 bp, Homo sapien
accctggcaagacaacgaggatttg

SEQ ID NO: 60304 - DNA, 25 bp, Homo sapien
atggtaattgcctgcctcgcgctag

SEQ ID NO: 60305 - DNA, 25 bp, Homo sapien
ccacgactggcaaacaatgacctta

SEQ ID NO: 60306 - DNA, 25 bp, Homo sapien
tccgatgcgcctgggtaggagcacc

SEQ ID NO: 60307 - DNA, 25 bp, Homo sapien
ggagcaccgactgcggggcctctac

SEQ ID NO: 60308 - DNA, 25 bp, Homo sapien
atgcgcctgggtaggagcaccgact

SEQ ID NO: 60309 - DNA, 25 bp, Homo sapien
ggatccgttgctgtgcaccctggtc

SEQ ID NO: 60310 - DNA, 25 bp, Homo sapien
cgttggcacgggacatgtgggccgc

SEQ ID NO: 60311 - DNA, 25 bp, Homo sapien
tgtcctgcgtgagagggcagaggca

SEQ ID NO: 60312 - DNA, 25 bp, Homo sapien
ctgcctgcgcgtgtcctgcgtgaga

SEQ ID NO: 60313 - DNA, 25 bp, Homo sapien
tccgttgctgtgcaccctggtcggg

SEQ ID NO: 60314 - DNA, 25 bp, Homo sapien
tgccctggcagctggactgcacttt

SEQ ID NO: 60315 - DNA, 25 bp, Homo sapien
tccacatgctgccacttggctgagc

SEQ ID NO: 60316 - DNA, 25 bp, Homo sapien
ctctgccacccgaagttcgtgggtc

SEQ ID NO: 60317 - DNA, 25 bp, Homo sapien
gaagtatcgaggcaaccctctgcca

SEQ ID NO: 60318 - DNA, 25 bp, Homo sapien
gaccctgcgcctgaggaagtatcga

SEQ ID NO: 60319 - DNA, 25 bp, Homo sapien
tcattgacctttgcgggtctgttcc

SEQ ID NO: 60320 - DNA, 25 bp, Homo sapien
cctcgctggcttctgctttcattga

SEQ ID NO: 60321 - DNA, 25 bp, Homo sapien
cctcgctggctcttactttcattga

SEQ ID NO: 60322 - DNA, 25 bp, Homo sapien
tcgaaacttcgaggccagcagtctc

SEQ ID NO: 60323 - DNA, 25 bp, Homo sapien
ccgccgggcacagatgacaagtcct

SEQ ID NO: 60324 - DNA, 25 bp, Homo sapien
gagcgagaatctcccggaccgttcc

SEQ ID NO: 60325 - DNA, 25 bp, Homo sapien
ctccaggaagccagagcgaccgttt

SEQ ID NO: 60326 - DNA, 25 bp, Homo sapien
ctccgaagctaaagcagcagagcga

SEQ ID NO: 60327 - DNA, 25 bp, Homo sapien
gagtgccgctgaagagcctgccctt

SEQ ID NO: 60328 - DNA, 25 bp, Homo sapien
gagcgaccgtttccgctacgcgacg

SEQ ID NO: 60329 - DNA, 25 bp, Homo sapien
aacgacgcctggaggaaatagttga

SEQ ID NO: 60330 - DNA, 25 bp, Homo sapien
ctcggatccggtgccgagccaagcg

SEQ ID NO: 60331 - DNA, 25 bp, Homo sapien
gcgctccacttgtgacgtcgcggac

SEQ ID NO: 60332 - DNA, 25 bp, Homo sapien
cacttgtgacgtcgcggacgcccgg

SEQ ID NO: 60333 - DNA, 25 bp, Homo sapien
cctggctgaggccaagctcggatcc

SEQ ID NO: 60334 - DNA, 25 bp, Homo sapien
ggggcttcgccttcgctcgcgtgac

SEQ ID NO: 60335 - DNA, 25 bp, Homo sapien
ttccgtttctcgagggaaaggctgc

SEQ ID NO: 60336 - DNA, 25 bp, Homo sapien
tcctccttggatctggggcccgggc

SEQ ID NO: 60337 - DNA, 25 bp, Homo sapien
cctctccgcgggtaggtgagtcgat

SEQ ID NO: 60338 - DNA, 25 bp, Homo sapien
cttccgcaaacgtaactggagtcgg

SEQ ID NO: 60339 - DNA, 25 bp, Homo sapien
agaaggggctcgcagacccgccctg

SEQ ID NO: 60340 - DNA, 25 bp, Homo sapien
tgaaacgggtccagccggtagtgac

SEQ ID NO: 60341 - DNA, 25 bp, Homo sapien
agtgctttcgcctcctcagcgtgct

SEQ ID NO: 60342 - DNA, 25 bp, Homo sapien
gggatggagcctcgcccagtgcttt

SEQ ID NO: 60343 - DNA, 25 bp, Homo sapien
cgctcaaggaataagggatgttagt

SEQ ID NO: 60344 - DNA, 25 bp, Homo sapien
gtgccacttaaaaggcgctcaagga

SEQ ID NO: 60345 - DNA, 25 bp, Homo sapien
cttccgtgtcgggtgtcatctttgt

SEQ ID NO: 60346 - DNA, 25 bp, Homo sapien
cgagagactacggaagcccagtaag

SEQ ID NO: 60347 - DNA, 25 bp, Homo sapien
cccgggccaaagagcgcgccctcag

SEQ ID NO: 60348 - DNA, 25 bp, Homo sapien
gtcccgggttacctgataacgctgc

SEQ ID NO: 60349 - DNA, 25 bp, Homo sapien
ggttacctgataacgctgccgccgc

SEQ ID NO: 60350 - DNA, 25 bp, Homo sapien
tacggaagcccagtaagacaggaag

SEQ ID NO: 60351 - DNA, 25 bp, Homo sapien
agagttgggctcgttgctccagcct

SEQ ID NO: 60352 - DNA, 25 bp, Homo sapien
taggggtcagctccgtgcgacccga

SEQ ID NO: 60353 - DNA, 25 bp, Homo sapien
cccatttcgttaggggtcagctccg

SEQ ID NO: 60354 - DNA, 25 bp, Homo sapien
ggtccgccaagtgcgggacactttc

SEQ ID NO: 60355 - DNA, 25 bp, Homo sapien
cgggtgtgctctttgaaatactata

SEQ ID NO: 60356 - DNA, 25 bp, Homo sapien
atcgggaacctcacacataattttt

SEQ ID NO: 60357 - DNA, 25 bp, Homo sapien
ggttcctcccagctgccgtgtgaat

SEQ ID NO: 60358 - DNA, 25 bp, Homo sapien
agcggaatctcccaatgtgacagcg

SEQ ID NO: 60359 - DNA, 25 bp, Homo sapien
cggcgaatgtagcaagagcggaatc

SEQ ID NO: 60360 - DNA, 25 bp, Homo sapien
tgcagccgctggctgagtacgtacc

SEQ ID NO: 60361 - DNA, 25 bp, Homo sapien
cagttcactccgcagctggagagca

SEQ ID NO: 60362 - DNA, 25 bp, Homo sapien
ccagccctgtgagcaagttccgcaa

SEQ ID NO: 60363 - DNA, 25 bp, Homo sapien
atttcgtccacacgcgcccatggtg

SEQ ID NO: 60364 - DNA, 25 bp, Homo sapien
gcgtctgaagagaaaggcacccgga

SEQ ID NO: 60365 - DNA, 25 bp, Homo sapien
gcttcaggcatccagagcgctctgt

SEQ ID NO: 60366 - DNA, 25 bp, Homo sapien
agagcctgcctcgttggcaatctcg

SEQ ID NO: 60367 - DNA, 25 bp, Homo sapien
tcagggaacgcatgcgccttagctc

SEQ ID NO: 60368 - DNA, 25 bp, Homo sapien
tgcagcgaccgacagccgcatgttt

SEQ ID NO: 60369 - DNA, 25 bp, Homo sapien
ggaccgaggcccatacggcgaaata

SEQ ID NO: 60370 - DNA, 25 bp, Homo sapien
gctttagcctcagtgcggagcctta

SEQ ID NO: 60371 - DNA, 25 bp, Homo sapien
gatttgagccaatcgcagcgggcga

SEQ ID NO: 60372 - DNA, 25 bp, Homo sapien
aagagaaccggtcgcggcaatccta

SEQ ID NO: 60373 - DNA, 25 bp, Homo sapien
agccggaaccacacccaagtagctg

SEQ ID NO: 60374 - DNA, 25 bp, Homo sapien
gctctccttcggagatcttgcagga

SEQ ID NO: 60375 - DNA, 25 bp, Homo sapien
cgcgtttggcaacagcgagggcaaa

SEQ ID NO: 60376 - DNA, 25 bp, Homo sapien
cgccgtctgcgccatgtgattaggc

SEQ ID NO: 60377 - DNA, 25 bp, Homo sapien
cctcaggtgaaaagtgagtgtctcc

SEQ ID NO: 60378 - DNA, 25 bp, Homo sapien
cagtcccgtgttgccacgctgggaa

SEQ ID NO: 60379 - DNA, 25 bp, Homo sapien
tcactctgcgcgcaggatccggaag

SEQ ID NO: 60380 - DNA, 25 bp, Homo sapien
tgggatcactattcgcgggtcagca

SEQ ID NO: 60381 - DNA, 25 bp, Homo sapien
actacccggcaggagaaaaggcagc

SEQ ID NO: 60382 - DNA, 25 bp, Homo sapien
ggctccgcgctcagccaattagacg

SEQ ID NO: 60383 - DNA, 25 bp, Homo sapien
tgtagtagtttcatcgccgagaatc

SEQ ID NO: 60384 - DNA, 25 bp, Homo sapien
tctgcgcaggaaagcgaaactaccc

SEQ ID NO: 60385 - DNA, 25 bp, Homo sapien
ggaactggcgttctgtttacatatc

SEQ ID NO: 60386 - DNA, 25 bp, Homo sapien
ctgggcaagctcaacgcggccatca

SEQ ID NO: 60387 - DNA, 25 bp, Homo sapien
aacgcggccatcagcttcttgtgtg

SEQ ID NO: 60388 - DNA, 25 bp, Homo sapien
agcttcttgtgtggtgtcatcgcca

SEQ ID NO: 60389 - DNA, 25 bp, Homo sapien
ccatcatcaacaactttgtcaggta

SEQ ID NO: 60390 - DNA, 25 bp, Homo sapien
gtcaggtactacaacaagcagcgcg

SEQ ID NO: 60391 - DNA, 25 bp, Homo sapien
tgatggaactcaactccagcagcgg

SEQ ID NO: 60392 - DNA, 25 bp, Homo sapien
cggccaagcacgagctggagctgat

SEQ ID NO: 60393 - DNA, 25 bp, Homo sapien
aacaagcagcgcgtcctggagaccg

SEQ ID NO: 60394 - DNA, 25 bp, Homo sapien
ttagctctgcacacgacggaaggcg

SEQ ID NO: 60395 - DNA, 25 bp, Homo sapien
caggaacgctttggagccctagctt

SEQ ID NO: 60396 - DNA, 25 bp, Homo sapien
cacgcgcgagtgttagctctgcaca

SEQ ID NO: 60397 - DNA, 25 bp, Homo sapien
ccgaaaagcgaaagttagagcctgc

SEQ ID NO: 60398 - DNA, 25 bp, Homo sapien
tgggattgagaggaaaccgaaaagc

SEQ ID NO: 60399 - DNA, 25 bp, Homo sapien
tgaaccgcttcggaaacagctggcc

SEQ ID NO: 60400 - DNA, 25 bp, Homo sapien
ccctagctttccgagcgcaggtaga

SEQ ID NO: 60401 - DNA, 25 bp, Homo sapien
tgcgcggtgcagtttgaaccgcttc

SEQ ID NO: 60402 - DNA, 25 bp, Homo sapien
gccgctgagcactccgcagctgggt

SEQ ID NO: 60403 - DNA, 25 bp, Homo sapien
acagccttggcagaacagccgcggc

SEQ ID NO: 60404 - DNA, 25 bp, Homo sapien
gggcttgtaaactaagttgctctta

SEQ ID NO: 60405 - DNA, 25 bp, Homo sapien
catgcctctcgtacctgtgggcaga

SEQ ID NO: 60406 - DNA, 25 bp, Homo sapien
tacctgtgggcagagtcgaatctcg

SEQ ID NO: 60407 - DNA, 25 bp, Homo sapien
cgaatctcggctgtcctcgtgttca

SEQ ID NO: 60408 - DNA, 25 bp, Homo sapien
aaagacacggtgtggcttcctccgg

SEQ ID NO: 60409 - DNA, 25 bp, Homo sapien
cgaatcccaggcagcgaggtcgccg

SEQ ID NO: 60410 - DNA, 25 bp, Homo sapien
cggtgttctgtctccgctcccgttt

SEQ ID NO: 60411 - DNA, 25 bp, Homo sapien
cggtccctgactaacggctttctgc

SEQ ID NO: 60412 - DNA, 25 bp, Homo sapien
agaactgctgctgcgcggcgacagc

SEQ ID NO: 60413 - DNA, 25 bp, Homo sapien
cgggcgtgttcatcagtcgctgttt

SEQ ID NO: 60414 - DNA, 25 bp, Homo sapien
aagaacggggcagttagtacgcttg

SEQ ID NO: 60415 - DNA, 25 bp, Homo sapien
gttagtacgcttgccttcctgtcgc

SEQ ID NO: 60416 - DNA, 25 bp, Homo sapien
tttttaggctcagtgctgtccgggc

SEQ ID NO: 60417 - DNA, 25 bp, Homo sapien
caggcgtgccgacgcagcgtgactt

SEQ ID NO: 60418 - DNA, 25 bp, Homo sapien
gcttcctcccggtagtggtcgaaga

SEQ ID NO: 60419 - DNA, 25 bp, Homo sapien
agcccactgacctgctgtcgccatc

SEQ ID NO: 60420 - DNA, 25 bp, Homo sapien
tggtagtagtctttgcccacggccc

SEQ ID NO: 60421 - DNA, 25 bp, Homo sapien
cacctcataggcctcggcgatctcc

SEQ ID NO: 60422 - DNA, 25 bp, Homo sapien
gcgcgggtctctgagcacctcatag

SEQ ID NO: 60423 - DNA, 25 bp, Homo sapien
ggccgctgccctttagggcttcctc

SEQ ID NO: 60424 - DNA, 25 bp, Homo sapien
cgccgctaccgccactggggccgct

SEQ ID NO: 60425 - DNA, 25 bp, Homo sapien
tctctgagcacctcataggcctcgg

SEQ ID NO: 60426 - DNA, 25 bp, Homo sapien
gcgcatgatctcgagagtttcagca

SEQ ID NO: 60427 - DNA, 25 bp, Homo sapien
atccctctggcgtttgggaagcagc

SEQ ID NO: 60428 - DNA, 25 bp, Homo sapien
ctgctgccataaggagggagctctg

SEQ ID NO: 60429 - DNA, 25 bp, Homo sapien
gtgggctacccgcacactcatatac

SEQ ID NO: 60430 - DNA, 25 bp, Homo sapien
ttagaaccgctcttgccgacctgga

SEQ ID NO: 60431 - DNA, 25 bp, Homo sapien
tggctcaaatgagaagctcgggctt

SEQ ID NO: 60432 - DNA, 25 bp, Homo sapien
gcagcatctcccacaagagcgtgca

SEQ ID NO: 60433 - DNA, 25 bp, Homo sapien
tttcagcaacatccagggactgggc

SEQ ID NO: 60434 - DNA, 25 bp, Homo sapien
ctgctcctactagttttctcccgga

SEQ ID NO: 60435 - DNA, 25 bp, Homo sapien
ccatagcgtagcacccataggcgga

SEQ ID NO: 60436 - DNA, 25 bp, Homo sapien
tgagtggaccttgtacgccgcaagc

SEQ ID NO: 60437 - DNA, 25 bp, Homo sapien
gcgcagtctgctttggtgaatacac

SEQ ID NO: 60438 - DNA, 25 bp, Homo sapien
aatacacgatttggtgcagccgggg

SEQ ID NO: 60439 - DNA, 25 bp, Homo sapien
ggcactcgagtgtgaggtaactata

SEQ ID NO: 60440 - DNA, 25 bp, Homo sapien
ttctctctggtctgtaatggggcga

SEQ ID NO: 60441 - DNA, 25 bp, Homo sapien
acgcaactggcgttatccgaagtga

SEQ ID NO: 60442 - DNA, 25 bp, Homo sapien
gcgcaggttccatttccggtcatct

SEQ ID NO: 60443 - DNA, 25 bp, Homo sapien
agcctggcaaagagcagccctctca

SEQ ID NO: 60444 - DNA, 25 bp, Homo sapien
caggaggggcttccaccacttccga

SEQ ID NO: 60445 - DNA, 25 bp, Homo sapien
ttccggtcatctgttccttctgggg

SEQ ID NO: 60446 - DNA, 25 bp, Homo sapien
tcaccggtgcttctgggttgctcct

SEQ ID NO: 60447 - DNA, 25 bp, Homo sapien
ccgggcagcgtttgttgctaagcaa

SEQ ID NO: 60448 - DNA, 25 bp, Homo sapien
accagagccgtctagcgtccgggca

SEQ ID NO: 60449 - DNA, 25 bp, Homo sapien
ttccgaaacgcctgggaagcgtcgc

SEQ ID NO: 60450 - DNA, 25 bp, Homo sapien
gcgccggaagtatgacgctcatttc

SEQ ID NO: 60451 - DNA, 25 bp, Homo sapien
gggattcctagttgcagcgtgatta

SEQ ID NO: 60452 - DNA, 25 bp, Homo sapien
ctcctctgagaactggcgcttgtga

SEQ ID NO: 60453 - DNA, 25 bp, Homo sapien
gtgctcacgggtatcgttctcgtca

SEQ ID NO: 60454 - DNA, 25 bp, Homo sapien
gtccatgcggaacgtgcagcttacc

SEQ ID NO: 60455 - DNA, 25 bp, Homo sapien
agcttgcttgcagttacccagtttc

SEQ ID NO: 60456 - DNA, 25 bp, Homo sapien
gccctccaaggtctgtgccggaaaa

SEQ ID NO: 60457 - DNA, 25 bp, Homo sapien
gttccgcggcaatttatgaaactcg

SEQ ID NO: 60458 - DNA, 25 bp, Homo sapien
tccacgagtcccgatgggaacgcgc

SEQ ID NO: 60459 - DNA, 25 bp, Homo sapien
gacgagttctctagctccagccggg

SEQ ID NO: 60460 - DNA, 25 bp, Homo sapien
ctcacgtatgaggtctctgtaccga

SEQ ID NO: 60461 - DNA, 25 bp, Homo sapien
tgaagtgactcctggcgacagcagc

SEQ ID NO: 60462 - DNA, 25 bp, Homo sapien
cagcggagaggactaccgaagcttg

SEQ ID NO: 60463 - DNA, 25 bp, Homo sapien
ccgaagcttgcagtcgcggtttgaa

SEQ ID NO: 60464 - DNA, 25 bp, Homo sapien
cagcagcaatcagccacctcagggg

SEQ ID NO: 60465 - DNA, 25 bp, Homo sapien
ttgtgacctggcttctcgtgaagtg

SEQ ID NO: 60466 - DNA, 25 bp, Homo sapien
cgcgcgttgcatgcagctcacggct

SEQ ID NO: 60467 - DNA, 25 bp, Homo sapien
tttgtgctggcatcttcctagctcc

SEQ ID NO: 60468 - DNA, 25 bp, Homo sapien
tctcggctcgcctttgtgctggcat

SEQ ID NO: 60469 - DNA, 25 bp, Homo sapien
ccacggagccgagagtctctgcgct

SEQ ID NO: 60470 - DNA, 25 bp, Homo sapien
acccgccgattgtgtcgagtcagca

SEQ ID NO: 60471 - DNA, 25 bp, Homo sapien
attgtgtcgagtcagcagcggcagc

SEQ ID NO: 60472 - DNA, 25 bp, Homo sapien
ccgctagacgcttcggcggcatctg

SEQ ID NO: 60473 - DNA, 25 bp, Homo sapien
aggagggacagccagaccttggcca

SEQ ID NO: 60474 - DNA, 25 bp, Homo sapien
gctcgcgagcacagtggagcctgcc

SEQ ID NO: 60475 - DNA, 25 bp, Homo sapien
gagcctgccgccattcggttcacgg

SEQ ID NO: 60476 - DNA, 25 bp, Homo sapien
gttcacggcgctacgcattccctga

SEQ ID NO: 60477 - DNA, 25 bp, Homo sapien
tgcgcctgcgtaccggagctactgc

SEQ ID NO: 60478 - DNA, 25 bp, Homo sapien
atgctgtgttagttccacggaaacc

SEQ ID NO: 60479 - DNA, 25 bp, Homo sapien
cctgctgcagtacggagcctcaggc

SEQ ID NO: 60480 - DNA, 25 bp, Homo sapien
ccggaaactacatatcccggcgtgc

SEQ ID NO: 60481 - DNA, 25 bp, Homo sapien
gcctcaggcggacagatggactgta

SEQ ID NO: 60482 - DNA, 25 bp, Homo sapien
agggcccactcagatctcacggttc

SEQ ID NO: 60483 - DNA, 25 bp, Homo sapien
cagtgaggccttggccaaccgggct

SEQ ID NO: 60484 - DNA, 25 bp, Homo sapien
gaacctaagacagaggcggcgcctt

SEQ ID NO: 60485 - DNA, 25 bp, Homo sapien
tttctcgactccgaagccctgtgcg

SEQ ID NO: 60486 - DNA, 25 bp, Homo sapien
tctcacggttcctgagcgatggccg

SEQ ID NO: 60487 - DNA, 25 bp, Homo sapien
gggacaccagcgcatttctcgactc

SEQ ID NO: 60488 - DNA, 25 bp, Homo sapien
gagacttgcttgcatccggatggaa

SEQ ID NO: 60489 - DNA, 25 bp, Homo sapien
gtgcggagtctcctggaacctaaga

SEQ ID NO: 60490 - DNA, 25 bp, Homo sapien
tcccttccaagtagtcgatgagttc

SEQ ID NO: 60491 - DNA, 25 bp, Homo sapien
tccgccgttcgaactcctcaaagga

SEQ ID NO: 60492 - DNA, 25 bp, Homo sapien
ttccggactgaaccctgacatgttt

SEQ ID NO: 60493 - DNA, 25 bp, Homo sapien
gaagagcagcgccttccagaagcta

SEQ ID NO: 60494 - DNA, 25 bp, Homo sapien
ccagcaagagcaaggaaccggcgtc

SEQ ID NO: 60495 - DNA, 25 bp, Homo sapien
gcgccagaccgggacgtataaatgg

SEQ ID NO: 60496 - DNA, 25 bp, Homo sapien
atgctgactccctaggccgcgtctt

SEQ ID NO: 60497 - DNA, 25 bp, Homo sapien
gtggcctagcatcgcctcactttct

SEQ ID NO: 60498 - DNA, 25 bp, Homo sapien
gctagacactgtccgaccgccaccc

SEQ ID NO: 60499 - DNA, 25 bp, Homo sapien
aggagtaggtgttgcagcgcgagcg

SEQ ID NO: 60500 - DNA, 25 bp, Homo sapien
agcgtgctagacactgtccgaccgc

SEQ ID NO: 60501 - DNA, 25 bp, Homo sapien
actgagcgtgctagacactgtccga

SEQ ID NO: 60502 - DNA, 25 bp, Homo sapien
cggactgagcgtgctagacactgtc

SEQ ID NO: 60503 - DNA, 25 bp, Homo sapien
agcccggactgagcgtgctagacac

SEQ ID NO: 60504 - DNA, 25 bp, Homo sapien
cgcctgcgctgatgcccggcctgcc

SEQ ID NO: 60505 - DNA, 25 bp, Homo sapien
cccggcctgcccgttcgccagccgc

SEQ ID NO: 60506 - DNA, 25 bp, Homo sapien
ggcctccgctcatttgggcctgccg

SEQ ID NO: 60507 - DNA, 25 bp, Homo sapien
gctttctcgccaccaggcctccgct

SEQ ID NO: 60508 - DNA, 25 bp, Homo sapien
tggtagcggaagacctttccctctg

SEQ ID NO: 60509 - DNA, 25 bp, Homo sapien
cggacgtccgctttctcgccaccag

SEQ ID NO: 60510 - DNA, 25 bp, Homo sapien
gcggctcctgggtgggaaagaaaca

SEQ ID NO: 60511 - DNA, 25 bp, Homo sapien
tgaagagcagcgctcagaagagccc

SEQ ID NO: 60512 - DNA, 25 bp, Homo sapien
cccagctgaagagcagcgctcagaa

SEQ ID NO: 60513 - DNA, 25 bp, Homo sapien
tagcggaagacctttccctctgagg

SEQ ID NO: 60514 - DNA, 25 bp, Homo sapien
cggccacacaagagccgcattctgg

SEQ ID NO: 60515 - DNA, 25 bp, Homo sapien
gcccgatccgaaagggcggtctcca

SEQ ID NO: 60516 - DNA, 25 bp, Homo sapien
gataaataaagacagcccggccaca

SEQ ID NO: 60517 - DNA, 25 bp, Homo sapien
cgcattctgggcaggactcctgcta

SEQ ID NO: 60518 - DNA, 25 bp, Homo sapien
gggtcccagtctgcgatcctttctc

SEQ ID NO: 60519 - DNA, 25 bp, Homo sapien
cgccgagaggctgacactggctagt

SEQ ID NO: 60520 - DNA, 25 bp, Homo sapien
tcggtgagtttgagcactgccattc

SEQ ID NO: 60521 - DNA, 25 bp, Homo sapien
cacagcctggcgcaactaaagagga

SEQ ID NO: 60522 - DNA, 25 bp, Homo sapien
ttcgattcagtctgccggaaaagcg

SEQ ID NO: 60523 - DNA, 25 bp, Homo sapien
ccgccgccacggagaaaaatagctg

SEQ ID NO: 60524 - DNA, 25 bp, Homo sapien
cggaactggcgctcccaagaacttc

SEQ ID NO: 60525 - DNA, 25 bp, Homo sapien
accttcgtgagtcttggcgatcttc

SEQ ID NO: 60526 - DNA, 25 bp, Homo sapien
tctggtcagagaagagaagctactc

SEQ ID NO: 60527 - DNA, 25 bp, Homo sapien
cgaatcctactgaggaagccgctta

SEQ ID NO: 60528 - DNA, 25 bp, Homo sapien
cggctgccgtatttcagtgcttttc

SEQ ID NO: 60529 - DNA, 25 bp, Homo sapien
ccgtcgggtgacacgtgacagaact

SEQ ID NO: 60530 - DNA, 25 bp, Homo sapien
cccgtgcggaatggcaggtaatcaa

SEQ ID NO: 60531 - DNA, 25 bp, Homo sapien
tctatcatggcagctcggactggtc

SEQ ID NO: 60532 - DNA, 25 bp, Homo sapien
tgcgtttggcatctgagggactcaa

SEQ ID NO: 60533 - DNA, 25 bp, Homo sapien
cggactggtcatacggccttgagaa

SEQ ID NO: 60534 - DNA, 25 bp, Homo sapien
tagtctcgggatgccgtccgaagtc

SEQ ID NO: 60535 - DNA, 25 bp, Homo sapien
gaccggcttcggagagtctatcatg

SEQ ID NO: 60536 - DNA, 25 bp, Homo sapien
acgtttacggtcagcgtgtgtcagc

SEQ ID NO: 60537 - DNA, 25 bp, Homo sapien
gactcggtgcatttccgtgtcttta

SEQ ID NO: 60538 - DNA, 25 bp, Homo sapien
tcgccgtcttggagtccaggactgt

SEQ ID NO: 60539 - DNA, 25 bp, Homo sapien
tcattctgcctgtggttgctcctca

SEQ ID NO: 60540 - DNA, 25 bp, Homo sapien
tgtcctgctgtcgaagcttcacctg

SEQ ID NO: 60541 - DNA, 25 bp, Homo sapien
ggtttcccagcaaccaggcgtcatc

SEQ ID NO: 60542 - DNA, 25 bp, Homo sapien
gcaccgagtccgaggtctacgacga

SEQ ID NO: 60543 - DNA, 25 bp, Homo sapien
gccatccgcagcttggttcctgcga

SEQ ID NO: 60544 - DNA, 25 bp, Homo sapien
cggggatgtctgtggttacctccaa

SEQ ID NO: 60545 - DNA, 25 bp, Homo sapien
acgtcggaccacaaggcccagcatg

SEQ ID NO: 60546 - DNA, 25 bp, Homo sapien
gagcccacgtgtccttctttccgaa

SEQ ID NO: 60547 - DNA, 25 bp, Homo sapien
tagttctttcacctcggctgggcgc

SEQ ID NO: 60548 - DNA, 25 bp, Homo sapien
ggctcaagggtcaaatcgcgtcatt

SEQ ID NO: 60549 - DNA, 25 bp, Homo sapien
ggcctcgctcggttccagaactttc

SEQ ID NO: 60550 - DNA, 25 bp, Homo sapien
ggcgcacaccgcaatgagcccgtgt

SEQ ID NO: 60551 - DNA, 25 bp, Homo sapien
cgcacgtgatggaacccgcatggac

SEQ ID NO: 60552 - DNA, 25 bp, Homo sapien
cagcgggcctaagtggttacaatcc

SEQ ID NO: 60553 - DNA, 25 bp, Homo sapien
tgggcgcctagaaaagcctagaaac

SEQ ID NO: 60554 - DNA, 25 bp, Homo sapien
gcctgtcagcagcaacggcttcttc

SEQ ID NO: 60555 - DNA, 25 bp, Homo sapien
cggtcgccactatacgaagttcgtt

SEQ ID NO: 60556 - DNA, 25 bp, Homo sapien
cccgtgtaactaacgagagcccata

SEQ ID NO: 60557 - DNA, 25 bp, Homo sapien
agagcccataccaacgtgcaacgca

SEQ ID NO: 60558 - DNA, 25 bp, Homo sapien
gctgcgatcacgacctttcaaaccg

SEQ ID NO: 60559 - DNA, 25 bp, Homo sapien
cgcctagacgctggcactatggtca

SEQ ID NO: 60560 - DNA, 25 bp, Homo sapien
ggggtgtaaacacagcctacctcga

SEQ ID NO: 60561 - DNA, 25 bp, Homo sapien
ctgcacttttcttgtcgggcaacta

SEQ ID NO: 60562 - DNA, 25 bp, Homo sapien
gtctgctctacaagggcgtctatga

SEQ ID NO: 60563 - DNA, 25 bp, Homo sapien
gacctgtccgtgtctcgcagaagta

SEQ ID NO: 60564 - DNA, 25 bp, Homo sapien
tgcgcctctcacacgtgctgtcaga

SEQ ID NO: 60565 - DNA, 25 bp, Homo sapien
attttctacgtgaacgcggcgccgc

SEQ ID NO: 60566 - DNA, 25 bp, Homo sapien
atcgggcacctgtactcggcactac

SEQ ID NO: 60567 - DNA, 25 bp, Homo sapien
tgcgaccgagtctctgagcagttcc

SEQ ID NO: 60568 - DNA, 25 bp, Homo sapien
ggccggtatctcctgcacagatttc

SEQ ID NO: 60569 - DNA, 25 bp, Homo sapien
ttcggcccacgctactacagttcgg

SEQ ID NO: 60570 - DNA, 25 bp, Homo sapien
aagcggtttacctgctcggacttcg

SEQ ID NO: 60571 - DNA, 25 bp, Homo sapien
ggccacgtttcttcccaaccagata

SEQ ID NO: 60572 - DNA, 25 bp, Homo sapien
agacgctgcctagcccaatttcggc

SEQ ID NO: 60573 - DNA, 25 bp, Homo sapien
ttcccaaccagatagcgagcgtttg

SEQ ID NO: 60574 - DNA, 25 bp, Homo sapien
cgctgcttgtcctgcctgggactct

SEQ ID NO: 60575 - DNA, 25 bp, Homo sapien
tcgccttctctcagacggctgggga

SEQ ID NO: 60576 - DNA, 25 bp, Homo sapien
cgagcggtcaggcaaagctccatgc

SEQ ID NO: 60577 - DNA, 25 bp, Homo sapien
ccatgacacagccagacgaggtctg

SEQ ID NO: 60578 - DNA, 25 bp, Homo sapien
cccaggagagcctcggctcgaagta

SEQ ID NO: 60579 - DNA, 25 bp, Homo sapien
taggggctcggggtgctcttcccac

SEQ ID NO: 60580 - DNA, 25 bp, Homo sapien
gccttccgagtttacttctggagct

SEQ ID NO: 60581 - DNA, 25 bp, Homo sapien
tcagccttccgagtttacttctgga

SEQ ID NO: 60582 - DNA, 25 bp, Homo sapien
atctccgctgtgctagcggcgcgca

SEQ ID NO: 60583 - DNA, 25 bp, Homo sapien
ctgccgcagatctccgctgtgctag

SEQ ID NO: 60584 - DNA, 25 bp, Homo sapien
tggggctgtgtaactggagcacgct

SEQ ID NO: 60585 - DNA, 25 bp, Homo sapien
tgcgccgcgctgaagctgccgcaga

SEQ ID NO: 60586 - DNA, 25 bp, Homo sapien
tcatcaaggtaagcaaagccgcgcc

SEQ ID NO: 60587 - DNA, 25 bp, Homo sapien
cccaagggctgtcaaaacaagtctc

SEQ ID NO: 60588 - DNA, 25 bp, Homo sapien
tacaccctggctcgagtacattagc

SEQ ID NO: 60589 - DNA, 25 bp, Homo sapien
acacattccattcttcgcgctcggg

SEQ ID NO: 60590 - DNA, 25 bp, Homo sapien
cgaggctcctaagaggcccagacgc

SEQ ID NO: 60591 - DNA, 25 bp, Homo sapien
tcacaacagagctgagtggaggccg

SEQ ID NO: 60592 - DNA, 25 bp, Homo sapien
cggcgtttgcatcacatttcggata

SEQ ID NO: 60593 - DNA, 25 bp, Homo sapien
ggactgctagcctcctagaccgaag

SEQ ID NO: 60594 - DNA, 25 bp, Homo sapien
tccaggagccgacagaaggtgcctt

SEQ ID NO: 60595 - DNA, 25 bp, Homo sapien
tttccaaagtgtgatgcccggtgtc

SEQ ID NO: 60596 - DNA, 25 bp, Homo sapien
ccttattattggctgggacctgttc

SEQ ID NO: 60597 - DNA, 25 bp, Homo sapien
tggtgcccacccaattgcaaagctc

SEQ ID NO: 60598 - DNA, 25 bp, Homo sapien
tcaactattgagacagcgacccaga

SEQ ID NO: 60599 - DNA, 25 bp, Homo sapien
cgtgtcgggcttagaggacttcact

SEQ ID NO: 60600 - DNA, 25 bp, Homo sapien
cgcctcgcctgttttctcggtatca

SEQ ID NO: 60601 - DNA, 25 bp, Homo sapien
cggcggcccaaactcgtaaggagtg

SEQ ID NO: 60602 - DNA, 25 bp, Homo sapien
gggaaaaccgctcatacacgtgata

SEQ ID NO: 60603 - DNA, 25 bp, Homo sapien
cggagcaagtcctgagataagcaca

SEQ ID NO: 60604 - DNA, 25 bp, Homo sapien
ccacccggtaaatgcgctgtgaatg

SEQ ID NO: 60605 - DNA, 25 bp, Homo sapien
ccaccggcaggtcgcaataaaacgc

SEQ ID NO: 60606 - DNA, 25 bp, Homo sapien
ggcgcctagaagtggtccattcatt

SEQ ID NO: 60607 - DNA, 25 bp, Homo sapien
aaccgttcctgggtgctacagccta

SEQ ID NO: 60608 - DNA, 25 bp, Homo sapien
tgtgcgcaagtccataaccgaatta

SEQ ID NO: 60609 - DNA, 25 bp, Homo sapien
ggcgggcgctacaatcgttattatt

SEQ ID NO: 60610 - DNA, 25 bp, Homo sapien
tgctgtatccttccttaccttgatg

SEQ ID NO: 60611 - DNA, 25 bp, Homo sapien
aggatcacttcgctaacctcacagg

SEQ ID NO: 60612 - DNA, 25 bp, Homo sapien
aggatctttcctgtctgattcgtca

SEQ ID NO: 60613 - DNA, 25 bp, Homo sapien
gttgaactgcgaatcctcctccgga

SEQ ID NO: 60614 - DNA, 25 bp, Homo sapien
tggggctgcaaagaaacaaactgta

SEQ ID NO: 60615 - DNA, 25 bp, Homo sapien
atagcaattcttaggggagccaccc

SEQ ID NO: 60616 - DNA, 25 bp, Homo sapien
cggtcggatcccagccgagaaaaga

SEQ ID NO: 60617 - DNA, 25 bp, Homo sapien
ttccaaagaagtccgaggcgacctg

SEQ ID NO: 60618 - DNA, 25 bp, Homo sapien
agaaagggcccacatctcgagtctc

SEQ ID NO: 60619 - DNA, 25 bp, Homo sapien
gggagagcccactacaggcaaggca

SEQ ID NO: 60620 - DNA, 25 bp, Homo sapien
gcaaggcaggaaggttaatcatttt

SEQ ID NO: 60621 - DNA, 25 bp, Homo sapien
cgtcgtcaccgagcgtgtcagtcac

SEQ ID NO: 60622 - DNA, 25 bp, Homo sapien
cgccgcagaattacctgctcaaaga

SEQ ID NO: 60623 - DNA, 25 bp, Homo sapien
tctgcgggaagtaaacggcgtcctc

SEQ ID NO: 60624 - DNA, 25 bp, Homo sapien
cgtcctccctccaaagaagtggatg

SEQ ID NO: 60625 - DNA, 25 bp, Homo sapien
gagtctccagtctctccttgaaaag

SEQ ID NO: 60626 - DNA, 25 bp, Homo sapien
ggaattgcacccttgccggagcctc

SEQ ID NO: 60627 - DNA, 25 bp, Homo sapien
acttaagcgcctctgaactcgggga

SEQ ID NO: 60628 - DNA, 25 bp, Homo sapien
tgagatcagccctaatcccttggta

SEQ ID NO: 60629 - DNA, 25 bp, Homo sapien
tggtcgtttacctctcctgagatca

SEQ ID NO: 60630 - DNA, 25 bp, Homo sapien
tccgtgttccaaggatggtcgttta

SEQ ID NO: 60631 - DNA, 25 bp, Homo sapien
ggggactcctctgctcaccttagtc

SEQ ID NO: 60632 - DNA, 25 bp, Homo sapien
ccaaaggactttgctgcggacgctg

SEQ ID NO: 60633 - DNA, 25 bp, Homo sapien
caccgtgcgcccttcaaagagctgg

SEQ ID NO: 60634 - DNA, 25 bp, Homo sapien
gaggtgaccacagcgaactgcctga

SEQ ID NO: 60635 - DNA, 25 bp, Homo sapien
cggaatgcgtcaaaactcgggaatc

SEQ ID NO: 60636 - DNA, 25 bp, Homo sapien
tgcgattggagacaaggccgcctcc

SEQ ID NO: 60637 - DNA, 25 bp, Homo sapien
gggaatcccacagcttcacatgtta

SEQ ID NO: 60638 - DNA, 25 bp, Homo sapien
atgttagccatgtgcgctggcggca

SEQ ID NO: 60639 - DNA, 25 bp, Homo sapien
ttaatttgtcactcgggaaagcaga

SEQ ID NO: 60640 - DNA, 25 bp, Homo sapien
ctgcgctgagcaatggcaacctcga

SEQ ID NO: 60641 - DNA, 25 bp, Homo sapien
cggccgcttcagacgttttaatttg

SEQ ID NO: 60642 - DNA, 25 bp, Homo sapien
acgggctgcccaagtgtaagcacca

SEQ ID NO: 60643 - DNA, 25 bp, Homo sapien
cggagctactggcttcggagaattc

SEQ ID NO: 60644 - DNA, 25 bp, Homo sapien
cgaggacgcaccagcattaatggaa

SEQ ID NO: 60645 - DNA, 25 bp, Homo sapien
tcctgattggccagaagtatcccgc

SEQ ID NO: 60646 - DNA, 25 bp, Homo sapien
tcctcctgagagttcatgtcactta

SEQ ID NO: 60647 - DNA, 25 bp, Homo sapien
accggagtagcttctcagtccctga

SEQ ID NO: 60648 - DNA, 25 bp, Homo sapien
ggagagaagccgtgatgtacccatc

SEQ ID NO: 60649 - DNA, 25 bp, Homo sapien
aacggttctctaggagcgggatctc

SEQ ID NO: 60650 - DNA, 25 bp, Homo sapien
tcaagcgagataacggagcccggcc

SEQ ID NO: 60651 - DNA, 25 bp, Homo sapien
caagcgagataacggagcccggccg

SEQ ID NO: 60652 - DNA, 25 bp, Homo sapien
ttcaagcgagataacggagcccggc

SEQ ID NO: 60653 - DNA, 25 bp, Homo sapien
tattcaagcgagataacggagcccg

SEQ ID NO: 60654 - DNA, 25 bp, Homo sapien
ttttattcaagcgagataacggagc

SEQ ID NO: 60655 - DNA, 25 bp, Homo sapien
gcatttttattcaagcgagataacg

SEQ ID NO: 60656 - DNA, 25 bp, Homo sapien
cggcatttttattcaagcgagataa

SEQ ID NO: 60657 - DNA, 25 bp, Homo sapien
agggcgcgaagcgagctggtggatc

SEQ ID NO: 60658 - DNA, 25 bp, Homo sapien
agcaagtgcaaagtgcagcagttca

SEQ ID NO: 60659 - DNA, 25 bp, Homo sapien
gctgaaagggaacccgaagtgactc

SEQ ID NO: 60660 - DNA, 25 bp, Homo sapien
acccgcggagaacctagcctagcaa

SEQ ID NO: 60661 - DNA, 25 bp, Homo sapien
cgcaacgcgtgctggggccagaacc

SEQ ID NO: 60662 - DNA, 25 bp, Homo sapien
attccctgcgcggtgccgactaggt

SEQ ID NO: 60663 - DNA, 25 bp, Homo sapien
ttgccttttcgtttgctcttccgta

SEQ ID NO: 60664 - DNA, 25 bp, Homo sapien
tcccaggaccacgtgggctgaaagg

SEQ ID NO: 60665 - DNA, 25 bp, Homo sapien
gtgcctggcgtccttgaacgcttca

SEQ ID NO: 60666 - DNA, 25 bp, Homo sapien
ggtatctgttccttcctctcgtgta

SEQ ID NO: 60667 - DNA, 25 bp, Homo sapien
tgctccataactgccgcttgctata

SEQ ID NO: 60668 - DNA, 25 bp, Homo sapien
tgcagctttccaccgtgcctggagc

SEQ ID NO: 60669 - DNA, 25 bp, Homo sapien
cgcagctcggaatcggaaacgcctc

SEQ ID NO: 60670 - DNA, 25 bp, Homo sapien
tccgggatcccaagaccgatttcgc

SEQ ID NO: 60671 - DNA, 25 bp, Homo sapien
cagacttctgttcgaacttcccggc

SEQ ID NO: 60672 - DNA, 25 bp, Homo sapien
gcttgctatagctgggagtactgta

SEQ ID NO: 60673 - DNA, 25 bp, Homo sapien
ttccctggggatgtgcaggtaactc

SEQ ID NO: 60674 - DNA, 25 bp, Homo sapien
ccaggtcttcggaacttcggctcta

SEQ ID NO: 60675 - DNA, 25 bp, Homo sapien
cgtcggccacactttgctacttctg

SEQ ID NO: 60676 - DNA, 25 bp, Homo sapien
ttcggctctaaagcgttcctcagcg

SEQ ID NO: 60677 - DNA, 25 bp, Homo sapien
gtctctttctccgacaccgctgagg

SEQ ID NO: 60678 - DNA, 25 bp, Homo sapien
ggtgctgcatgaactgctcccgaga

SEQ ID NO: 60679 - DNA, 25 bp, Homo sapien
gcggcgttatttccacgaagcgcta

SEQ ID NO: 60680 - DNA, 25 bp, Homo sapien
aggctgcagcaacaggtccactttg

SEQ ID NO: 60681 - DNA, 25 bp, Homo sapien
taaagacgtgtctctcgctggtttc

SEQ ID NO: 60682 - DNA, 25 bp, Homo sapien
ttcctttctccagccggcgcgggca

SEQ ID NO: 60683 - DNA, 25 bp, Homo sapien
aggtcgccgtccttcctttctccag

SEQ ID NO: 60684 - DNA, 25 bp, Homo sapien
cccggatctgaatcgcccgcggccg

SEQ ID NO: 60685 - DNA, 25 bp, Homo sapien
ccggagttgtgtcagtgaaggaatc

SEQ ID NO: 60686 - DNA, 25 bp, Homo sapien
gagccggcgctcgacacagaggtaa

SEQ ID NO: 60687 - DNA, 25 bp, Homo sapien
tgtcagtgaaggaatccagtccggg

SEQ ID NO: 60688 - DNA, 25 bp, Homo sapien
ttgtgtcagtgaaggaatccagtcc

SEQ ID NO: 60689 - DNA, 25 bp, Homo sapien
ctcgacacagaggtaagcccaggac

SEQ ID NO: 60690 - DNA, 25 bp, Homo sapien
ggccgccttgcagtccctcagccag

SEQ ID NO: 60691 - DNA, 25 bp, Homo sapien
ataatagcgaccgagctcggcgccc

SEQ ID NO: 60692 - DNA, 25 bp, Homo sapien
actcagcgcgcagctatgcgggcct

SEQ ID NO: 60693 - DNA, 25 bp, Homo sapien
tttctttcccttcctgcgtctgtcc

SEQ ID NO: 60694 - DNA, 25 bp, Homo sapien
cgcgcccaaataatagcgaccgagc

SEQ ID NO: 60695 - DNA, 25 bp, Homo sapien
tctagctccggcttcgggtctccaa

SEQ ID NO: 60696 - DNA, 25 bp, Homo sapien
ttctctgaggcgaatagccgggcgc

SEQ ID NO: 60697 - DNA, 25 bp, Homo sapien
cctggcgaggttctctgaggcgaat

SEQ ID NO: 60698 - DNA, 25 bp, Homo sapien
agtgaacgccttctcagctgctcgg

SEQ ID NO: 60699 - DNA, 25 bp, Homo sapien
ggacgcggaagtgaacgccttctca

SEQ ID NO: 60700 - DNA, 25 bp, Homo sapien
gtcggcagcttcccagactgacctg

SEQ ID NO: 60701 - DNA, 25 bp, Homo sapien
actcctcttccgaagcgggaagagc

SEQ ID NO: 60702 - DNA, 25 bp, Homo sapien
aggggctcacactcctcttccgaag

SEQ ID NO: 60703 - DNA, 25 bp, Homo sapien
aaaaacatcgctcaaggggctcaca

SEQ ID NO: 60704 - DNA, 25 bp, Homo sapien
cccactttgaaaaacatcgctcaag

SEQ ID NO: 60705 - DNA, 25 bp, Homo sapien
tcagctgctcggcaactcgggagca

SEQ ID NO: 60706 - DNA, 25 bp, Homo sapien
cccacgctgaaagagaggtaagtta

SEQ ID NO: 60707 - DNA, 25 bp, Homo sapien
ctgtggcgtttaaacccaagccgca

SEQ ID NO: 60708 - DNA, 25 bp, Homo sapien
atcggtgtcgttcttgagtcggttc

SEQ ID NO: 60709 - DNA, 25 bp, Homo sapien
ttgacggagtcctgttttggctttg

SEQ ID NO: 60710 - DNA, 25 bp, Homo sapien
tttggctttgagtcgctgcctcttg

SEQ ID NO: 60711 - DNA, 25 bp, Homo sapien
gtttctgagatttgagcgtccggca

SEQ ID NO: 60712 - DNA, 25 bp, Homo sapien
gacccgattggctgatggggcaacc

SEQ ID NO: 60713 - DNA, 25 bp, Homo sapien
gctccatcttcgcaggacccgattg

SEQ ID NO: 60714 - DNA, 25 bp, Homo sapien
aatcaaggctttctccgtcggggtg

SEQ ID NO: 60715 - DNA, 25 bp, Homo sapien
gccggatgatttccgcccacataga

SEQ ID NO: 60716 - DNA, 25 bp, Homo sapien
agctcaggaacgttggatcttaatc

SEQ ID NO: 60717 - DNA, 25 bp, Homo sapien
cttctacgtgaacggccgcaaggtg

SEQ ID NO: 60718 - DNA, 25 bp, Homo sapien
gcccgccgtttaaggcactcaggca

SEQ ID NO: 60719 - DNA, 25 bp, Homo sapien
cactcaggcacggactggctttctc

SEQ ID NO: 60720 - DNA, 25 bp, Homo sapien
gctttctcccgtaacagcggctttg

SEQ ID NO: 60721 - DNA, 25 bp, Homo sapien
cacacacgtgctggtgtcccgggaa

SEQ ID NO: 60722 - DNA, 25 bp, Homo sapien
ggcctctgttgtgtgatgtacgcgt

SEQ ID NO: 60723 - DNA, 25 bp, Homo sapien
ggaggacgcgtccaacttcgagacc

SEQ ID NO: 60724 - DNA, 25 bp, Homo sapien
tccaggcgacgtggaacccagtaag

SEQ ID NO: 60725 - DNA, 25 bp, Homo sapien
ctaatccgcgcgcaatagaaaaggc

SEQ ID NO: 60726 - DNA, 25 bp, Homo sapien
agacaccgccgcagttgccggtaca

SEQ ID NO: 60727 - DNA, 25 bp, Homo sapien
tacatcggggatttctggctctttc

SEQ ID NO: 60728 - DNA, 25 bp, Homo sapien
cttaaattcggtgagacgcggcgcc

SEQ ID NO: 60729 - DNA, 25 bp, Homo sapien
tggctctttcctcttcgccttaaat

SEQ ID NO: 60730 - DNA, 25 bp, Homo sapien
ggagagtacacccaccgcgattacg

SEQ ID NO: 60731 - DNA, 25 bp, Homo sapien
tgaccgaccgttcgaccggcaaaca

SEQ ID NO: 60732 - DNA, 25 bp, Homo sapien
caaacatggttgaagcggatcgccc

SEQ ID NO: 60733 - DNA, 25 bp, Homo sapien
caggccaccaaaccggcgttcgaga

SEQ ID NO: 60734 - DNA, 25 bp, Homo sapien
ccttgagaggctacagcgaccgaga

SEQ ID NO: 60735 - DNA, 25 bp, Homo sapien
cgcgaccgtgactacggggatcatc

SEQ ID NO: 60736 - DNA, 25 bp, Homo sapien
catcgagagccctttgagagctacg

SEQ ID NO: 60737 - DNA, 25 bp, Homo sapien
tcgtcgaggtgctcctgatgaaaga

SEQ ID NO: 60738 - DNA, 25 bp, Homo sapien
ccgaggcggttcacaacatggcgcc

SEQ ID NO: 60739 - DNA, 25 bp, Homo sapien
gagactcgtctcgaaaacactgatg

SEQ ID NO: 60740 - DNA, 25 bp, Homo sapien
ccagagcccgctgtggcggatgaaa

SEQ ID NO: 60741 - DNA, 25 bp, Homo sapien
tcacgggaatcacgcagctgactgc

SEQ ID NO: 60742 - DNA, 25 bp, Homo sapien
agcttgtaacgcaatcacgggaatc

SEQ ID NO: 60743 - DNA, 25 bp, Homo sapien
tcctgcgtcttaccgtcctggacaa

SEQ ID NO: 60744 - DNA, 25 bp, Homo sapien
aggaacggccctgtcacctagtccg

SEQ ID NO: 60745 - DNA, 25 bp, Homo sapien
tgcgtcgcgcaccaacaacaaaatg

SEQ ID NO: 60746 - DNA, 25 bp, Homo sapien
ctgagatgcgcgacttgggacgcta

SEQ ID NO: 60747 - DNA, 25 bp, Homo sapien
tcacacgccgcgagctaagcagaaa

SEQ ID NO: 60748 - DNA, 25 bp, Homo sapien
cgctaggtttccgtctggcgccgat

SEQ ID NO: 60749 - DNA, 25 bp, Homo sapien
ggaagcctgcgtgcggcacaccgaa

SEQ ID NO: 60750 - DNA, 25 bp, Homo sapien
cggtgcccgaggaagccaataggaa

SEQ ID NO: 60751 - DNA, 25 bp, Homo sapien
gcagcgaggcgcaaagaccatgccc

SEQ ID NO: 60752 - DNA, 25 bp, Homo sapien
agtcggccaagagcgacggctctgc

SEQ ID NO: 60753 - DNA, 25 bp, Homo sapien
cccaagtgccgagggaaagtcctga

SEQ ID NO: 60754 - DNA, 25 bp, Homo sapien
tccctctctgctggcgccaccgcag

SEQ ID NO: 60755 - DNA, 25 bp, Homo sapien
gaccctcccaagatgctacctggtt

SEQ ID NO: 60756 - DNA, 25 bp, Homo sapien
tgctacctggtttacgagaggttcc

SEQ ID NO: 60757 - DNA, 25 bp, Homo sapien
gagaggttccgggaccaccaacaca

SEQ ID NO: 60758 - DNA, 25 bp, Homo sapien
cgcctttccagaccaccctcgccag

SEQ ID NO: 60759 - DNA, 25 bp, Homo sapien
cgtctgtagtttccgcggccgaagg

SEQ ID NO: 60760 - DNA, 25 bp, Homo sapien
cagctcccgtctgtagtttccgcgg

SEQ ID NO: 60761 - DNA, 25 bp, Homo sapien
ctacctgtcaccctgctgtctccgg

SEQ ID NO: 60762 - DNA, 25 bp, Homo sapien
tttgcctccatcttgggtgcgcctt

SEQ ID NO: 60763 - DNA, 25 bp, Homo sapien
ttaccgcgggctttgcggaatgccc

SEQ ID NO: 60764 - DNA, 25 bp, Homo sapien
cggattcccagaaaggggcgacctg

SEQ ID NO: 60765 - DNA, 25 bp, Homo sapien
gacctgggccacagcggtacaagct

SEQ ID NO: 60766 - DNA, 25 bp, Homo sapien
tggacctgagagaccggaagtaacc

SEQ ID NO: 60767 - DNA, 25 bp, Homo sapien
cggaagtaacccttggccaactctg

SEQ ID NO: 60768 - DNA, 25 bp, Homo sapien
tgagtcagcattgcagcaggccctg

SEQ ID NO: 60769 - DNA, 25 bp, Homo sapien
cctgactcagttttgtaggttcctt

SEQ ID NO: 60770 - DNA, 25 bp, Homo sapien
tccgcagacaggattctagaattta

SEQ ID NO: 60771 - DNA, 25 bp, Homo sapien
cgtgagtagaccgagaatcctgccc

SEQ ID NO: 60772 - DNA, 25 bp, Homo sapien
tcgcacgtaacggtcctgagctatg

SEQ ID NO: 60773 - DNA, 25 bp, Homo sapien
attttaccacccagagacacgcgag

SEQ ID NO: 60774 - DNA, 25 bp, Homo sapien
ccacctgttgatgcttttgactttc

SEQ ID NO: 60775 - DNA, 25 bp, Homo sapien
tgtccttgttcctcgtcccatctgg

SEQ ID NO: 60776 - DNA, 25 bp, Homo sapien
ccaattctggttttgcggagcagca

SEQ ID NO: 60777 - DNA, 25 bp, Homo sapien
gccgtttgaccacgcatggagaatt

SEQ ID NO: 60778 - DNA, 25 bp, Homo sapien
tggggaagccaaaggagagccactc

SEQ ID NO: 60779 - DNA, 25 bp, Homo sapien
ggcgggcgacttcacaacatcatca

SEQ ID NO: 60780 - DNA, 25 bp, Homo sapien
ccagcgcaagacctgctgggaattg

SEQ ID NO: 60781 - DNA, 25 bp, Homo sapien
tggtgcagagttccaagcccacggc

SEQ ID NO: 60782 - DNA, 25 bp, Homo sapien
ttctgcgcggacagcttactcactg

SEQ ID NO: 60783 - DNA, 25 bp, Homo sapien
ccgcaccgctggcagcctgaagaga

SEQ ID NO: 60784 - DNA, 25 bp, Homo sapien
ttgtcaagggcaagttcgggttctg

SEQ ID NO: 60785 - DNA, 25 bp, Homo sapien
tcactggagtggttcggcatcctct

SEQ ID NO: 60786 - DNA, 25 bp, Homo sapien
cgtcccgtcccggagcttaccagca

SEQ ID NO: 60787 - DNA, 25 bp, Homo sapien
agacgacccagacgacggccagcgg

SEQ ID NO: 60788 - DNA, 25 bp, Homo sapien
gagcagacgacccagacgacggcca

SEQ ID NO: 60789 - DNA, 25 bp, Homo sapien
cggagcgctcccacgcaccgatcct

SEQ ID NO: 60790 - DNA, 25 bp, Homo sapien
ccggagcttaccagcaggccctcca

SEQ ID NO: 60791 - DNA, 25 bp, Homo sapien
ctcggcaccgacggcgaaccgtctc

SEQ ID NO: 60792 - DNA, 25 bp, Homo sapien
acgcaccgatcctctcccggcggct

SEQ ID NO: 60793 - DNA, 25 bp, Homo sapien
gcgcagttcgcagcacgtgatgggc

SEQ ID NO: 60794 - DNA, 25 bp, Homo sapien
tgtgcatgatatccgggctgctgta

SEQ ID NO: 60795 - DNA, 25 bp, Homo sapien
tagggattcctctgcaatagcgggg

SEQ ID NO: 60796 - DNA, 25 bp, Homo sapien
ctgcccgctgcggttatcaagtgtg

SEQ ID NO: 60797 - DNA, 25 bp, Homo sapien
gcctccgaccctttaatgtgcatga

SEQ ID NO: 60798 - DNA, 25 bp, Homo sapien
cctatttgtctcttggggtggctcc

SEQ ID NO: 60799 - DNA, 25 bp, Homo sapien
ctcacattttcccagcgcgtgcgtg

SEQ ID NO: 60800 - DNA, 25 bp, Homo sapien
gctcactcacgttcagcagccggtg

SEQ ID NO: 60801 - DNA, 25 bp, Homo sapien
gttcttgttcttaggcagggccgtc

SEQ ID NO: 60802 - DNA, 25 bp, Homo sapien
aggctcgcttaccacaggattcttc

SEQ ID NO: 60803 - DNA, 25 bp, Homo sapien
cctcaaaagtaggacggctcaactg

SEQ ID NO: 60804 - DNA, 25 bp, Homo sapien
ccgtggcgctgcaatcacagctttc

SEQ ID NO: 60805 - DNA, 25 bp, Homo sapien
cacagctttcccgtggtttcctaag

SEQ ID NO: 60806 - DNA, 25 bp, Homo sapien
actccgcaggcgaacagatctcttc

SEQ ID NO: 60807 - DNA, 25 bp, Homo sapien
tcccttagtgattcccagctcgttg

SEQ ID NO: 60808 - DNA, 25 bp, Homo sapien
ccactgccaagtgtagctgtttacc

SEQ ID NO: 60809 - DNA, 25 bp, Homo sapien
gggcagctacagacctctcctcgga

SEQ ID NO: 60810 - DNA, 25 bp, Homo sapien
cctcaaactgcaagggccggaagta

SEQ ID NO: 60811 - DNA, 25 bp, Homo sapien
agcagcagtcgtttgttaccacctc

SEQ ID NO: 60812 - DNA, 25 bp, Homo sapien
tgcgctttgatgatgacgtagaata

SEQ ID NO: 60813 - DNA, 25 bp, Homo sapien
ctatcagtcctgagatgcgctttga

SEQ ID NO: 60814 - DNA, 25 bp, Homo sapien
agcacagtctctcccttagtttagg

SEQ ID NO: 60815 - DNA, 25 bp, Homo sapien
aggctacgtacttgggagcacagtc

SEQ ID NO: 60816 - DNA, 25 bp, Homo sapien
cttggaatccgagctcctgggaatt

SEQ ID NO: 60817 - DNA, 25 bp, Homo sapien
cgcatacaaggggtcccagccgata

SEQ ID NO: 60818 - DNA, 25 bp, Homo sapien
ccgagccaggagagtgatcaagaac

SEQ ID NO: 60819 - DNA, 25 bp, Homo sapien
aaagcctgaccgaccggctggcgaa

SEQ ID NO: 60820 - DNA, 25 bp, Homo sapien
tggcgaagagctgcatgcaaccggt

SEQ ID NO: 60821 - DNA, 25 bp, Homo sapien
ggatttcatttaccacctgcgggac

SEQ ID NO: 60822 - DNA, 25 bp, Homo sapien
tgatcaagaaccagcgcactgtggc

SEQ ID NO: 60823 - DNA, 25 bp, Homo sapien
gcactgtggcctgatgctgtaacca

SEQ ID NO: 60824 - DNA, 25 bp, Homo sapien
acttcccgggctatctgcactcaga

SEQ ID NO: 60825 - DNA, 25 bp, Homo sapien
aggctcgcaccgtttctcggcaggt

SEQ ID NO: 60826 - DNA, 25 bp, Homo sapien
agagaagggcatctccgtgccggac

SEQ ID NO: 60827 - DNA, 25 bp, Homo sapien
aaggtgcagtgttctcccgaactcc

SEQ ID NO: 60828 - DNA, 25 bp, Homo sapien
ttccaaaaagaactcgccgtgctcc

SEQ ID NO: 60829 - DNA, 25 bp, Homo sapien
tcggactcagcaagagccggccgtt

SEQ ID NO: 60830 - DNA, 25 bp, Homo sapien
ttggctgaaacttggggccgagctt

SEQ ID NO: 60831 - DNA, 25 bp, Homo sapien
gaactccgctttttcttatgctcca

SEQ ID NO: 60832 - DNA, 25 bp, Homo sapien
tcgtcgcactcctcaggctgagagc

SEQ ID NO: 60833 - DNA, 25 bp, Homo sapien
ttatgctccatgtatgcgcccgtgt

SEQ ID NO: 60834 - DNA, 25 bp, Homo sapien
ccgaagggtcacttctccgagtgtg

SEQ ID NO: 60835 - DNA, 25 bp, Homo sapien
ggagcagcttctctcggggcctgcc

SEQ ID NO: 60836 - DNA, 25 bp, Homo sapien
gcctgccgcgtttatggcttcaata

SEQ ID NO: 60837 - DNA, 25 bp, Homo sapien
tatggcttcaatagcgccgctccgg

SEQ ID NO: 60838 - DNA, 25 bp, Homo sapien
tcggagaggcttctgcctagcgcct

SEQ ID NO: 60839 - DNA, 25 bp, Homo sapien
ctagcgcctctctgctgcgcgaggt

SEQ ID NO: 60840 - DNA, 25 bp, Homo sapien
ggccttacaaaaggagctcctcgct

SEQ ID NO: 60841 - DNA, 25 bp, Homo sapien
gcgcgaggtcgtcccggccttacaa

SEQ ID NO: 60842 - DNA, 25 bp, Homo sapien
cggaggcaggattcccaacaacatc

SEQ ID NO: 60843 - DNA, 25 bp, Homo sapien
gcctcgggtaagcagaacctcgctc

SEQ ID NO: 60844 - DNA, 25 bp, Homo sapien
cccggtacctggtcagacatgatga

SEQ ID NO: 60845 - DNA, 25 bp, Homo sapien
tgcacctagtcgacccgggagaaag

SEQ ID NO: 60846 - DNA, 25 bp, Homo sapien
gggccctgcttctgcgattagtcct

SEQ ID NO: 60847 - DNA, 25 bp, Homo sapien
cccagtcagggattctctcccgtta

SEQ ID NO: 60848 - DNA, 25 bp, Homo sapien
cctcccgacgaagaagcaaaaagtg

SEQ ID NO: 60849 - DNA, 25 bp, Homo sapien
acaacaccgcggctgcagtaacttc

SEQ ID NO: 60850 - DNA, 25 bp, Homo sapien
aaaggctccgttcaggccctagatc

SEQ ID NO: 60851 - DNA, 25 bp, Homo sapien
cgagcgcatttgtgctttgcccgcc

SEQ ID NO: 60852 - DNA, 25 bp, Homo sapien
ttctggaagtgacggcaatctctgc

SEQ ID NO: 60853 - DNA, 25 bp, Homo sapien
gaagtgacgttgctatcccagaatc

SEQ ID NO: 60854 - DNA, 25 bp, Homo sapien
tgcgtcctagttccagtacagcgtg

SEQ ID NO: 60855 - DNA, 25 bp, Homo sapien
cagcgtgttctgattctttgcggga

SEQ ID NO: 60856 - DNA, 25 bp, Homo sapien
tgaaacgtctgtgggttacgccatc

SEQ ID NO: 60857 - DNA, 25 bp, Homo sapien
ccatgttggtgctgtttgaaacgtc

SEQ ID NO: 60858 - DNA, 25 bp, Homo sapien
ctgctcggagccactggaagtgcct

SEQ ID NO: 60859 - DNA, 25 bp, Homo sapien
ggcaggcaccttttttgatccagtc

SEQ ID NO: 60860 - DNA, 25 bp, Homo sapien
ccctctcacggttgttctgcgaagg

SEQ ID NO: 60861 - DNA, 25 bp, Homo sapien
tgtgattcgctcacaggagccattg

SEQ ID NO: 60862 - DNA, 25 bp, Homo sapien
agccctcggccattcaccggagaga

SEQ ID NO: 60863 - DNA, 25 bp, Homo sapien
cgcgaatcccaagccatgcacattt

SEQ ID NO: 60864 - DNA, 25 bp, Homo sapien
gtggccgtcgtctcttaaacaaata

SEQ ID NO: 60865 - DNA, 25 bp, Homo sapien
caggcaagatcgagccgcaggaata

SEQ ID NO: 60866 - DNA, 25 bp, Homo sapien
cccggtttgcaaagcaggtaagtgc

SEQ ID NO: 60867 - DNA, 25 bp, Homo sapien
acactattgttgatgaggagcggcg

SEQ ID NO: 60868 - DNA, 25 bp, Homo sapien
cggttccgttccagctgaagcagca

SEQ ID NO: 60869 - DNA, 25 bp, Homo sapien
acccacctgtggaccggcgaggtga

SEQ ID NO: 60870 - DNA, 25 bp, Homo sapien
ccgagctgctcgtagccaatgggag

SEQ ID NO: 60871 - DNA, 25 bp, Homo sapien
cggcaacaacaacggtggctgctgt

SEQ ID NO: 60872 - DNA, 25 bp, Homo sapien
cttgcagcccatgagggcgacggtt

SEQ ID NO: 60873 - DNA, 25 bp, Homo sapien
tgacgctgcaccaatgggcgatcgt

SEQ ID NO: 60874 - DNA, 25 bp, Homo sapien
tgcgcctccaacagccagggtcgag

SEQ ID NO: 60875 - DNA, 25 bp, Homo sapien
tcctgagtcttctcgctcctgtcgg

SEQ ID NO: 60876 - DNA, 25 bp, Homo sapien
ggctcctgagtcttctcgctcctgt

SEQ ID NO: 60877 - DNA, 25 bp, Homo sapien
gagtcttctcgctcctgtcggccaa

SEQ ID NO: 60878 - DNA, 25 bp, Homo sapien
tcttctcgctcctgtcggccaaagg

SEQ ID NO: 60879 - DNA, 25 bp, Homo sapien
gctcctgtcggccaaaggccgtgac

SEQ ID NO: 60880 - DNA, 25 bp, Homo sapien
gagaccaggcctcactgcgcctcca

SEQ ID NO: 60881 - DNA, 25 bp, Homo sapien
gggcggctcctgagtcttctcgctc

SEQ ID NO: 60882 - DNA, 25 bp, Homo sapien
gcctgcgttcccaagtgacaaaatg

SEQ ID NO: 60883 - DNA, 25 bp, Homo sapien
tgacaaaatgacctcgctcctccga

SEQ ID NO: 60884 - DNA, 25 bp, Homo sapien
ggggtctcccaacctctgtccagat

SEQ ID NO: 60885 - DNA, 25 bp, Homo sapien
ctaagtgccctgtcaccggagggga

SEQ ID NO: 60886 - DNA, 25 bp, Homo sapien
acggcgacaccgctgagcgcagacg

SEQ ID NO: 60887 - DNA, 25 bp, Homo sapien
tgcgaggttccgtccatctttctga

SEQ ID NO: 60888 - DNA, 25 bp, Homo sapien
catctttctgaacccacgcaggtgg

SEQ ID NO: 60889 - DNA, 25 bp, Homo sapien
tcagcctgtaggctgggctagcctc

SEQ ID NO: 60890 - DNA, 25 bp, Homo sapien
ctcttgaatgaactcggggaccctc

SEQ ID NO: 60891 - DNA, 25 bp, Homo sapien
tccttcactacagcgagcgtggccg

SEQ ID NO: 60892 - DNA, 25 bp, Homo sapien
agcagaagcttaccggcgccgctct

SEQ ID NO: 60893 - DNA, 25 bp, Homo sapien
gcatctctcggtctgctcttgaatg

SEQ ID NO: 60894 - DNA, 25 bp, Homo sapien
gcgttcgcccgctgtatttaactcc

SEQ ID NO: 60895 - DNA, 25 bp, Homo sapien
ccggtcagaacattacgaggagctg

SEQ ID NO: 60896 - DNA, 25 bp, Homo sapien
agcaccagtgctccttaggcggaaa

SEQ ID NO: 60897 - DNA, 25 bp, Homo sapien
ccgactcgggatcggagcatctctc

SEQ ID NO: 60898 - DNA, 25 bp, Homo sapien
gaaaagaacggatgagagaggaaac

SEQ ID NO: 60899 - DNA, 25 bp, Homo sapien
tctaactgcggcttttagagagagg

SEQ ID NO: 60900 - DNA, 25 bp, Homo sapien
tcgacggtggccgatagtggtccta

SEQ ID NO: 60901 - DNA, 25 bp, Homo sapien
ggcgagaggcggaaatacaaagaaa

SEQ ID NO: 60902 - DNA, 25 bp, Homo sapien
gcgcattatgctggtctccatggcg

SEQ ID NO: 60903 - DNA, 25 bp, Homo sapien
gcattatgctggtctccatggcggg

SEQ ID NO: 60904 - DNA, 25 bp, Homo sapien
gtcctactgtcgtgggactgctctg

SEQ ID NO: 60905 - DNA, 25 bp, Homo sapien
tggccgatagtggtcctactgtcgt

SEQ ID NO: 60906 - DNA, 25 bp, Homo sapien
aggcgcaacctctcctagaaacgga

SEQ ID NO: 60907 - DNA, 25 bp, Homo sapien
ggcaggggcagatgcaaggcatccc

SEQ ID NO: 60908 - DNA, 25 bp, Homo sapien
gtttctgcagcaggcgcaacctctc

SEQ ID NO: 60909 - DNA, 25 bp, Homo sapien
cccggagtttctgcagcaggcgcaa

SEQ ID NO: 60910 - DNA, 25 bp, Homo sapien
ctggcgagcccggagtttctgcagc

SEQ ID NO: 60911 - DNA, 25 bp, Homo sapien
agatgcaaggcatcccggcgccctc

SEQ ID NO: 60912 - DNA, 25 bp, Homo sapien
tgcagcaggcgcaacctctcctaga

SEQ ID NO: 60913 - DNA, 25 bp, Homo sapien
agccggcgccctggtctgcactccc

SEQ ID NO: 60914 - DNA, 25 bp, Homo sapien
atgctccgaagggtttctgctctgg

SEQ ID NO: 60915 - DNA, 25 bp, Homo sapien
ccagagctacgaaccacggggacgt

SEQ ID NO: 60916 - DNA, 25 bp, Homo sapien
cccgtcgggagcattacctagggag

SEQ ID NO: 60917 - DNA, 25 bp, Homo sapien
tcgcttctgggctctcatgtttgaa

SEQ ID NO: 60918 - DNA, 25 bp, Homo sapien
cgctttcattccctgtgaccggaga

SEQ ID NO: 60919 - DNA, 25 bp, Homo sapien
tgcctctaatgtgggttttctatgc

SEQ ID NO: 60920 - DNA, 25 bp, Homo sapien
ttctgctctgggagtgcctctaatg

SEQ ID NO: 60921 - DNA, 25 bp, Homo sapien
gggttggctgcgaatctccacccaa

SEQ ID NO: 60922 - DNA, 25 bp, Homo sapien
gggtctcacgccctcagatgactca

SEQ ID NO: 60923 - DNA, 25 bp, Homo sapien
actcacggaaatgacgccatcagcg

SEQ ID NO: 60924 - DNA, 25 bp, Homo sapien
cgatactgtagtgcaggctgggatc

SEQ ID NO: 60925 - DNA, 25 bp, Homo sapien
tgtcagggagtgttccgatactgta

SEQ ID NO: 60926 - DNA, 25 bp, Homo sapien
tcctcagcggccgaaatgattagcc

SEQ ID NO: 60927 - DNA, 25 bp, Homo sapien
tccagctgagggaaggctcgtttca

SEQ ID NO: 60928 - DNA, 25 bp, Homo sapien
cgcccaacggctgggtaaatcctca

SEQ ID NO: 60929 - DNA, 25 bp, Homo sapien
ctacgcgaccattgaacagctgccg

SEQ ID NO: 60930 - DNA, 25 bp, Homo sapien
tagagctgctgaggaaaagcccgcg

SEQ ID NO: 60931 - DNA, 25 bp, Homo sapien
gatcttcgccgttaccttcttgctg

SEQ ID NO: 60932 - DNA, 25 bp, Homo sapien
ttcgggttcgctccagagcttcagc

SEQ ID NO: 60933 - DNA, 25 bp, Homo sapien
accatgttggacttcgcgatcttcg

SEQ ID NO: 60934 - DNA, 25 bp, Homo sapien
cgcccacacgctatgccttaaattg

SEQ ID NO: 60935 - DNA, 25 bp, Homo sapien
gctcctcggcgatccattgctcttt

SEQ ID NO: 60936 - DNA, 25 bp, Homo sapien
tcgcgggcatattctgtctgaaatc

SEQ ID NO: 60937 - DNA, 25 bp, Homo sapien
gccgtgctctacctctatccggtga

SEQ ID NO: 60938 - DNA, 25 bp, Homo sapien
ctaggccgatgacctccatggggac

SEQ ID NO: 60939 - DNA, 25 bp, Homo sapien
gggccctcttcgacagctacacaaa

SEQ ID NO: 60940 - DNA, 25 bp, Homo sapien
tacacaaatctggaacgggtggccg

SEQ ID NO: 60941 - DNA, 25 bp, Homo sapien
tggccgattactgcgagaacaacta

SEQ ID NO: 60942 - DNA, 25 bp, Homo sapien
aactacatacaggtgcgaagcatcc

SEQ ID NO: 60943 - DNA, 25 bp, Homo sapien
gagtggcattttctgtttgacggaa

SEQ ID NO: 60944 - DNA, 25 bp, Homo sapien
ggcggaagggttaactgcaccacca

SEQ ID NO: 60945 - DNA, 25 bp, Homo sapien
gctccctctgcgacctgtatgagga

SEQ ID NO: 60946 - DNA, 25 bp, Homo sapien
ccgcgcgctcagtgactgactgact

SEQ ID NO: 60947 - DNA, 25 bp, Homo sapien
ctgggtcggagaagcctaaccgcac

SEQ ID NO: 60948 - DNA, 25 bp, Homo sapien
cgagggcgaggctaaccactcaccg

SEQ ID NO: 60949 - DNA, 25 bp, Homo sapien
tccctcgccagagacgcagcgactg

SEQ ID NO: 60950 - DNA, 25 bp, Homo sapien
gagccgagtgtgctcgcgtccagcc

SEQ ID NO: 60951 - DNA, 25 bp, Homo sapien
cgcgtccagccgagacgcagaaggc

SEQ ID NO: 60952 - DNA, 25 bp, Homo sapien
actgccgactgtagggccgactcgc

SEQ ID NO: 60953 - DNA, 25 bp, Homo sapien
gaggctaaccactcaccgcggcagt

SEQ ID NO: 60954 - DNA, 25 bp, Homo sapien
ctcttccctcgggtgttctttctga

SEQ ID NO: 60955 - DNA, 25 bp, Homo sapien
acccaggtgacgagacgaggctccc

SEQ ID NO: 60956 - DNA, 25 bp, Homo sapien
gggtcagacacctgttcggcccggc

SEQ ID NO: 60957 - DNA, 25 bp, Homo sapien
aatcctcgagcgtgtagccctcagg

SEQ ID NO: 60958 - DNA, 25 bp, Homo sapien
tccggtttcaatcctcgagcgtgta

SEQ ID NO: 60959 - DNA, 25 bp, Homo sapien
gcgcaaaagtttcctcccaactctg

SEQ ID NO: 60960 - DNA, 25 bp, Homo sapien
gtgttctttctgagatccggtttca

SEQ ID NO: 60961 - DNA, 25 bp, Homo sapien
tgggagccggcgcaaaagtttcctc

SEQ ID NO: 60962 - DNA, 25 bp, Homo sapien
cctgttcgaacgcatggctgagctg

SEQ ID NO: 60963 - DNA, 25 bp, Homo sapien
tcttgtaacgccatcgcgcgtggca

SEQ ID NO: 60964 - DNA, 25 bp, Homo sapien
gatgggcgccgccttaacttcgatc

SEQ ID NO: 60965 - DNA, 25 bp, Homo sapien
ccgcggctgcctctttaatcaggaa

SEQ ID NO: 60966 - DNA, 25 bp, Homo sapien
taatcggatagctctgccgcggctc

SEQ ID NO: 60967 - DNA, 25 bp, Homo sapien
tggggttttattcagaccgggctga

SEQ ID NO: 60968 - DNA, 25 bp, Homo sapien
ggctctgacatccacatgctgctcg

SEQ ID NO: 60969 - DNA, 25 bp, Homo sapien
tgctgctcggcctgaaaaggcagtg

SEQ ID NO: 60970 - DNA, 25 bp, Homo sapien
cccaaaatgcgatctcaagccgtga

SEQ ID NO: 60971 - DNA, 25 bp, Homo sapien
atacctctgactcacccggtgtgcg

SEQ ID NO: 60972 - DNA, 25 bp, Homo sapien
cgccggcgacgagaaccaattctgg

SEQ ID NO: 60973 - DNA, 25 bp, Homo sapien
caactgagcaaataacacggcggtc

SEQ ID NO: 60974 - DNA, 25 bp, Homo sapien
ctggcccaactaggtgagaggaaac

SEQ ID NO: 60975 - DNA, 25 bp, Homo sapien
gcgcgcaacttgcacagcctctaga

SEQ ID NO: 60976 - DNA, 25 bp, Homo sapien
cgcatcgatttgtttgggctacgca

SEQ ID NO: 60977 - DNA, 25 bp, Homo sapien
agagcccagcgatccataaacattc

SEQ ID NO: 60978 - DNA, 25 bp, Homo sapien
gctgggctcccggtgtttgctccgt

SEQ ID NO: 60979 - DNA, 25 bp, Homo sapien
ctagtgcccgccagcaacatgaaca

SEQ ID NO: 60980 - DNA, 25 bp, Homo sapien
tgtttgctccgtggtgcttctgtcc

SEQ ID NO: 60981 - DNA, 25 bp, Homo sapien
agcgagcctggagcgccacctagtg

SEQ ID NO: 60982 - DNA, 25 bp, Homo sapien
aacacacgccaaggagcgctgccag

SEQ ID NO: 60983 - DNA, 25 bp, Homo sapien
gcaacatgaacacacgccaaggagc

SEQ ID NO: 60984 - DNA, 25 bp, Homo sapien
gtccggggccgcttctcgagacagc

SEQ ID NO: 60985 - DNA, 25 bp, Homo sapien
gcttctcgagacagccgggcatcct

SEQ ID NO: 60986 - DNA, 25 bp, Homo sapien
agcttgccaagaccaactacgtggt

SEQ ID NO: 60987 - DNA, 25 bp, Homo sapien
ccgcattgtgttgcagccgcggacc

SEQ ID NO: 60988 - DNA, 25 bp, Homo sapien
tcgagtgtgcttactccctggccga

SEQ ID NO: 60989 - DNA, 25 bp, Homo sapien
ctccgagatgttccggctgttggtc

SEQ ID NO: 60990 - DNA, 25 bp, Homo sapien
atggaggacctggagcagatcttcc

SEQ ID NO: 60991 - DNA, 25 bp, Homo sapien
agtcgcacctgaccgagatccggca

SEQ ID NO: 60992 - DNA, 25 bp, Homo sapien
agatccggcagtaccagcaggcgcc

SEQ ID NO: 60993 - DNA, 25 bp, Homo sapien
gcaacgacagcgtgcacgtcatcga

SEQ ID NO: 60994 - DNA, 25 bp, Homo sapien
tggacaggaactggcaaagagtttc

SEQ ID NO: 60995 - DNA, 25 bp, Homo sapien
actcaccctttcattctccgcccgg

SEQ ID NO: 60996 - DNA, 25 bp, Homo sapien
agtttcaaaatagccgagtgcgctc

SEQ ID NO: 60997 - DNA, 25 bp, Homo sapien
taccttcttcaatggacaggaactg

SEQ ID NO: 60998 - DNA, 25 bp, Homo sapien
ggcggagtaccttcttcaatggaca

SEQ ID NO: 60999 - DNA, 25 bp, Homo sapien
gcaggggcggagtaccttcttcaat

SEQ ID NO: 61000 - DNA, 25 bp, Homo sapien
cgcggctgcacctgactcctcaccg

SEQ ID NO: 61001 - DNA, 25 bp, Homo sapien
ccggcctcacgtaagcgcgctcgcc

SEQ ID NO: 61002 - DNA, 25 bp, Homo sapien
attcgacatacctcatgggcgccta

SEQ ID NO: 61003 - DNA, 25 bp, Homo sapien
cagctgcaaagagcgcgcgaatata

SEQ ID NO: 61004 - DNA, 25 bp, Homo sapien
ttgaagacgtgtactccgagcgctc

SEQ ID NO: 61005 - DNA, 25 bp, Homo sapien
agtaggcacagttagagggtcttca

SEQ ID NO: 61006 - DNA, 25 bp, Homo sapien
actggagtctcagccttccggaatc

SEQ ID NO: 61007 - DNA, 25 bp, Homo sapien
cttcacggtgcgtttcggaaccttg

SEQ ID NO: 61008 - DNA, 25 bp, Homo sapien
ccgtcccgacggagatatttcttca

SEQ ID NO: 61009 - DNA, 25 bp, Homo sapien
cttacttaagctcggcaaggctgga

SEQ ID NO: 61010 - DNA, 25 bp, Homo sapien
cgacaccatgggtttcggagacctg

SEQ ID NO: 61011 - DNA, 25 bp, Homo sapien
gtcccgtcaataaataagcctctgg

SEQ ID NO: 61012 - DNA, 25 bp, Homo sapien
cgcggaggctgttctgctaaactgt

SEQ ID NO: 61013 - DNA, 25 bp, Homo sapien
gaggccgggtcgcttattcaatatg

SEQ ID NO: 61014 - DNA, 25 bp, Homo sapien
gcggcgcccagtcaaggacaacaga

SEQ ID NO: 61015 - DNA, 25 bp, Homo sapien
agggaaacgcctccgtctctatata

SEQ ID NO: 61016 - DNA, 25 bp, Homo sapien
tacctggcggacaagagctacatcg

SEQ ID NO: 61017 - DNA, 25 bp, Homo sapien
ccggagggactagaatccttgcatt

SEQ ID NO: 61018 - DNA, 25 bp, Homo sapien
ggttttcgcaccttccctgacgtca

SEQ ID NO: 61019 - DNA, 25 bp, Homo sapien
cctgacgtcaaacctccatcagggt

SEQ ID NO: 61020 - DNA, 25 bp, Homo sapien
tccatcagggttgcaacgccacgtt

SEQ ID NO: 61021 - DNA, 25 bp, Homo sapien
cacgttgccttggatgcctgcgtga

SEQ ID NO: 61022 - DNA, 25 bp, Homo sapien
accgcaggggccgaagtcgcctatt

SEQ ID NO: 61023 - DNA, 25 bp, Homo sapien
agtcgcctatttctggctccgcggg

SEQ ID NO: 61024 - DNA, 25 bp, Homo sapien
cgcaggctgcattgcgcttctgtcc

SEQ ID NO: 61025 - DNA, 25 bp, Homo sapien
cctgcgtcagaaggggtctggtttt

SEQ ID NO: 61026 - DNA, 25 bp, Homo sapien
tctcgccggccacacggagcggcgc

SEQ ID NO: 61027 - DNA, 25 bp, Homo sapien
ggtccgtgtgctccgggcttgtccc

SEQ ID NO: 61028 - DNA, 25 bp, Homo sapien
ccctgcagaggaaagcgaagggcgc

SEQ ID NO: 61029 - DNA, 25 bp, Homo sapien
gtgccctttgcgttggctttcccgc

SEQ ID NO: 61030 - DNA, 25 bp, Homo sapien
gcctgcttctcgtccttctcctgct

SEQ ID NO: 61031 - DNA, 25 bp, Homo sapien
ggctgcagccttgccggcgcttcct

SEQ ID NO: 61032 - DNA, 25 bp, Homo sapien
gcgcccgggagctatgagccatgaa

SEQ ID NO: 61033 - DNA, 25 bp, Homo sapien
ctatgagccatgaagccgcccggca

SEQ ID NO: 61034 - DNA, 25 bp, Homo sapien
tagaggctcaattccggcaggtgca

SEQ ID NO: 61035 - DNA, 25 bp, Homo sapien
agctgggccctaactttgcagttcc

SEQ ID NO: 61036 - DNA, 25 bp, Homo sapien
ttccaggagctttgacgtagacttg

SEQ ID NO: 61037 - DNA, 25 bp, Homo sapien
gccgagcactcccactgcttaagta

SEQ ID NO: 61038 - DNA, 25 bp, Homo sapien
agcctgagcgtttcctctccgcgta

SEQ ID NO: 61039 - DNA, 25 bp, Homo sapien
tccgcgtactcgagggaactctctc

SEQ ID NO: 61040 - DNA, 25 bp, Homo sapien
agcccttgtgccatctgggagtaga

SEQ ID NO: 61041 - DNA, 25 bp, Homo sapien
caagcccgctggtttcctgaaccga

SEQ ID NO: 61042 - DNA, 25 bp, Homo sapien
gcccagcagaggttaggtgtttaaa

SEQ ID NO: 61043 - DNA, 25 bp, Homo sapien
ttaggacctgaatgggttacgttgc

SEQ ID NO: 61044 - DNA, 25 bp, Homo sapien
gttgtcggcgttttgagcaatctgc

SEQ ID NO: 61045 - DNA, 25 bp, Homo sapien
ggttacgttgcgatacacgatcaaa

SEQ ID NO: 61046 - DNA, 25 bp, Homo sapien
cggtccgtatagaggctgccaagcc

SEQ ID NO: 61047 - DNA, 25 bp, Homo sapien
tcacccgcgatgacgaatttggcca

SEQ ID NO: 61048 - DNA, 25 bp, Homo sapien
tttggccatggtcgagagagactca

SEQ ID NO: 61049 - DNA, 25 bp, Homo sapien
gcactacaaagtctggcgcccagca

SEQ ID NO: 61050 - DNA, 25 bp, Homo sapien
gttctccgcgcagccgtgggatctc

SEQ ID NO: 61051 - DNA, 25 bp, Homo sapien
ggatctccctgctgccttacaaggc

SEQ ID NO: 61052 - DNA, 25 bp, Homo sapien
ggtcgtggcgacactcgcgccagct

SEQ ID NO: 61053 - DNA, 25 bp, Homo sapien
tccactagatgcctggcagagcccg

SEQ ID NO: 61054 - DNA, 25 bp, Homo sapien
ggcgagctatttttagagggctata

SEQ ID NO: 61055 - DNA, 25 bp, Homo sapien
ggattggcacgctgcggatctccct

SEQ ID NO: 61056 - DNA, 25 bp, Homo sapien
tcactgaggaccaatggggagcccg

SEQ ID NO: 61057 - DNA, 25 bp, Homo sapien
gccgcgtgtgaccatgtaaggtaaa

SEQ ID NO: 61058 - DNA, 25 bp, Homo sapien
gcaaggtgccacagtatcggggcca

SEQ ID NO: 61059 - DNA, 25 bp, Homo sapien
gcagaggcgcagcagaccttcttcc

SEQ ID NO: 61060 - DNA, 25 bp, Homo sapien
cgctgccggctttaccgatgcgaaa

SEQ ID NO: 61061 - DNA, 25 bp, Homo sapien
agccgcggtggagtttagaccactc

SEQ ID NO: 61062 - DNA, 25 bp, Homo sapien
tctccgcggagtctcggaaaggaaa

SEQ ID NO: 61063 - DNA, 25 bp, Homo sapien
taaaactccagcgagatccgggccg

SEQ ID NO: 61064 - DNA, 25 bp, Homo sapien
gatccgggccgtgaacgaaagcagt

SEQ ID NO: 61065 - DNA, 25 bp, Homo sapien
tgtaccaccggtaagaggagcagga

SEQ ID NO: 61066 - DNA, 25 bp, Homo sapien
cctctgactttgtcgcttgcgcgtt

SEQ ID NO: 61067 - DNA, 25 bp, Homo sapien
acctggcgctgaatgtgcctctcga

SEQ ID NO: 61068 - DNA, 25 bp, Homo sapien
tttctatcatgtgctccgccgctct

SEQ ID NO: 61069 - DNA, 25 bp, Homo sapien
tgcgcgttgtgcctgttttttaaag

SEQ ID NO: 61070 - DNA, 25 bp, Homo sapien
cgctccgaagaaggcatggtcactc

SEQ ID NO: 61071 - DNA, 25 bp, Homo sapien
ttggcggcaatcgagtggaaaagtc

SEQ ID NO: 61072 - DNA, 25 bp, Homo sapien
gggtcacagggcctcttaggatccc

SEQ ID NO: 61073 - DNA, 25 bp, Homo sapien
gtgcctctcgaccttttctatcatg

SEQ ID NO: 61074 - DNA, 25 bp, Homo sapien
attcctttcctcacttgtatttatc

SEQ ID NO: 61075 - DNA, 25 bp, Homo sapien
tcctatctggtcctagggaacctta

SEQ ID NO: 61076 - DNA, 25 bp, Homo sapien
gcacccaggcttgaattcttaaatt

SEQ ID NO: 61077 - DNA, 25 bp, Homo sapien
cccaggcttgaattcttaaattcta

SEQ ID NO: 61078 - DNA, 25 bp, Homo sapien
actatttcatctaattcctttcctc

SEQ ID NO: 61079 - DNA, 25 bp, Homo sapien
ctcacttgtatttatcttatgatta

SEQ ID NO: 61080 - DNA, 25 bp, Homo sapien
aagttatcctatctggtcctaggga

SEQ ID NO: 61081 - DNA, 25 bp, Homo sapien
tctatttccttcatactatttcatc

SEQ ID NO: 61082 - DNA, 25 bp, Homo sapien
cgtctcgtcgtggtcctggcctccc

SEQ ID NO: 61083 - DNA, 25 bp, Homo sapien
acccgagctctgctgatcccagaag

SEQ ID NO: 61084 - DNA, 25 bp, Homo sapien
tgcccagcgtctggcctcacccgag

SEQ ID NO: 61085 - DNA, 25 bp, Homo sapien
ctgctgatcccagaaggacgtcttc

SEQ ID NO: 61086 - DNA, 25 bp, Homo sapien
tgatcccagaaggacgtcttcagtc

SEQ ID NO: 61087 - DNA, 25 bp, Homo sapien
agaaggacgtcttcagtcctgaccc

SEQ ID NO: 61088 - DNA, 25 bp, Homo sapien
aggcccggcgctcagacccacgctt

SEQ ID NO: 61089 - DNA, 25 bp, Homo sapien
ctgccctggaaacggtcctgcctgc

SEQ ID NO: 61090 - DNA, 25 bp, Homo sapien
cacccagtcattttggcctccattg

SEQ ID NO: 61091 - DNA, 25 bp, Homo sapien
gcctcagcgcaagctccagcgcaga

SEQ ID NO: 61092 - DNA, 25 bp, Homo sapien
caggctgcacccagtcattttggcc

SEQ ID NO: 61093 - DNA, 25 bp, Homo sapien
gtcattttggcctccattgtggaca

SEQ ID NO: 61094 - DNA, 25 bp, Homo sapien
gcctccattgtggacagctacgaga

SEQ ID NO: 61095 - DNA, 25 bp, Homo sapien
cattgtggacagctacgagagacgc

SEQ ID NO: 61096 - DNA, 25 bp, Homo sapien
caacgagggtgctgcccgagttatc

SEQ ID NO: 61097 - DNA, 25 bp, Homo sapien
ctacgagagacgcaacgagggtgct

SEQ ID NO: 61098 - DNA, 25 bp, Homo sapien
cgctggagatcacgcagaacctcct

SEQ ID NO: 61099 - DNA, 25 bp, Homo sapien
actacacgtcggtggagacgctgga

SEQ ID NO: 61100 - DNA, 25 bp, Homo sapien
caggacctttgttctcgtgcagcac

SEQ ID NO: 61101 - DNA, 25 bp, Homo sapien
cagcgcggtgatcaggacctttgtt

SEQ ID NO: 61102 - DNA, 25 bp, Homo sapien
cagacatggtctctctgtgttcctt

SEQ ID NO: 61103 - DNA, 25 bp, Homo sapien
cgcggccgtcacagacatggtctct

SEQ ID NO: 61104 - DNA, 25 bp, Homo sapien
ccacgggctcatggtcctgctgcgg

SEQ ID NO: 61105 - DNA, 25 bp, Homo sapien
ggcctcccgcagatgaagaactaca

SEQ ID NO: 61106 - DNA, 25 bp, Homo sapien
ggggaactctgaccatgattggttc

SEQ ID NO: 61107 - DNA, 25 bp, Homo sapien
tcctaaccaggtgaccgcaggtcgc

SEQ ID NO: 61108 - DNA, 25 bp, Homo sapien
accgcaggtcgcgttccggttggca

SEQ ID NO: 61109 - DNA, 25 bp, Homo sapien
cgttccggttggcaggcaccggcca

SEQ ID NO: 61110 - DNA, 25 bp, Homo sapien
cgccctcgcagacgagtcagcttaa

SEQ ID NO: 61111 - DNA, 25 bp, Homo sapien
cggagctgtactgcgcgtccgacat

SEQ ID NO: 61112 - DNA, 25 bp, Homo sapien
cagcaggtcacgtgcctggcttcga

SEQ ID NO: 61113 - DNA, 25 bp, Homo sapien
tgattggttcctcctaaccaggtga

SEQ ID NO: 61114 - DNA, 25 bp, Homo sapien
ggtccggcgagcattggatctccac

SEQ ID NO: 61115 - DNA, 25 bp, Homo sapien
atgggcaccgtgatttcctggcaca

SEQ ID NO: 61116 - DNA, 25 bp, Homo sapien
cctcgctgcggttgtaatccatgca

SEQ ID NO: 61117 - DNA, 25 bp, Homo sapien
agggctcgcgacacttgcacacgaa

SEQ ID NO: 61118 - DNA, 25 bp, Homo sapien
cgggtgtgactccttcagaatgggc

SEQ ID NO: 61119 - DNA, 25 bp, Homo sapien
gcccgtccgcaccttgttgtagagc

SEQ ID NO: 61120 - DNA, 25 bp, Homo sapien
tatccagaaggtggcgaacgtgcgc

SEQ ID NO: 61121 - DNA, 25 bp, Homo sapien
gctcggattccagggaaaggactct

SEQ ID NO: 61122 - DNA, 25 bp, Homo sapien
ggaaaggccctttggagataatctc

SEQ ID NO: 61123 - DNA, 25 bp, Homo sapien
acgggagccgtctgagatttatgac

SEQ ID NO: 61124 - DNA, 25 bp, Homo sapien
atttatgactcttacctgcggcgga

SEQ ID NO: 61125 - DNA, 25 bp, Homo sapien
gctgcccggcagctgaacaaatagg

SEQ ID NO: 61126 - DNA, 25 bp, Homo sapien
gcgttctcctgctggatgtcgatga

SEQ ID NO: 61127 - DNA, 25 bp, Homo sapien
cgatgagcggctcttcgtacacgta

SEQ ID NO: 61128 - DNA, 25 bp, Homo sapien
ggcctgcttcgacacctacaaaaca

SEQ ID NO: 61129 - DNA, 25 bp, Homo sapien
ccacaaaattagaggcggtccgtgc

SEQ ID NO: 61130 - DNA, 25 bp, Homo sapien
ggctctgtttacaagcggcttctcg

SEQ ID NO: 61131 - DNA, 25 bp, Homo sapien
aggacgagtctttcctgcccgaggg

SEQ ID NO: 61132 - DNA, 25 bp, Homo sapien
ggacacacaaggttccaggccgcga

SEQ ID NO: 61133 - DNA, 25 bp, Homo sapien
gccagagccggacacacaaggttcc

SEQ ID NO: 61134 - DNA, 25 bp, Homo sapien
actctgaaatgcttccgccggcggc

SEQ ID NO: 61135 - DNA, 25 bp, Homo sapien
tcgcggtcccactctgaaatgcttc

SEQ ID NO: 61136 - DNA, 25 bp, Homo sapien
gccgcgaggacgagtctttcctgcc

SEQ ID NO: 61137 - DNA, 25 bp, Homo sapien
gtttacaagcggcttctcgcggtcc

SEQ ID NO: 61138 - DNA, 25 bp, Homo sapien
ccccgccatgcagggagctaccggg

SEQ ID NO: 61139 - DNA, 25 bp, Homo sapien
gcatcccatcgcctgtcgtgtgaat

SEQ ID NO: 61140 - DNA, 25 bp, Homo sapien
ccgccatgcagggagctaccggggg

SEQ ID NO: 61141 - DNA, 25 bp, Homo sapien
gcccccgccatgcagggagctaccg

SEQ ID NO: 61142 - DNA, 25 bp, Homo sapien
cccccgccatgcagggagctaccgg

SEQ ID NO: 61143 - DNA, 25 bp, Homo sapien
cccgccatgcagggagctaccgggg

SEQ ID NO: 61144 - DNA, 25 bp, Homo sapien
cgccatgcagggagctaccgggggg

SEQ ID NO: 61145 - DNA, 25 bp, Homo sapien
gccatgcagggagctaccggggggc

SEQ ID NO: 61146 - DNA, 25 bp, Homo sapien
ctcgtagagggtgatctgcaaggca

SEQ ID NO: 61147 - DNA, 25 bp, Homo sapien
gagtagttgggctgctcatagagca

SEQ ID NO: 61148 - DNA, 25 bp, Homo sapien
agcggaccgagtcgctgaggcccat

SEQ ID NO: 61149 - DNA, 25 bp, Homo sapien
ccatccactgctggtggtcggcata

SEQ ID NO: 61150 - DNA, 25 bp, Homo sapien
cccggtcctcgtagagggtgatctg

SEQ ID NO: 61151 - DNA, 25 bp, Homo sapien
ggaccgagtcgctgaggcccatcca

SEQ ID NO: 61152 - DNA, 25 bp, Homo sapien
ggcccgagtagttgggctgctcata

SEQ ID NO: 61153 - DNA, 25 bp, Homo sapien
cactgctggtggtcggcatagtcgc

SEQ ID NO: 61154 - DNA, 25 bp, Homo sapien
tggcccccgcgatggaggaagctcc

SEQ ID NO: 61155 - DNA, 25 bp, Homo sapien
cccccgcgatggaggaagctccggg

SEQ ID NO: 61156 - DNA, 25 bp, Homo sapien
ggcccccgcgatggaggaagctccg

SEQ ID NO: 61157 - DNA, 25 bp, Homo sapien
ctggcccccgcgatggaggaagctc

SEQ ID NO: 61158 - DNA, 25 bp, Homo sapien
tctggcccccgcgatggaggaagct

SEQ ID NO: 61159 - DNA, 25 bp, Homo sapien
agtctctggcccccgcgatggagga

SEQ ID NO: 61160 - DNA, 25 bp, Homo sapien
cagtctctggcccccgcgatggagg

SEQ ID NO: 61161 - DNA, 25 bp, Homo sapien
gcccccgcgatggaggaagctccgg

SEQ ID NO: 61162 - DNA, 25 bp, Homo sapien
tttggctgaagaaagagtgctcccg

SEQ ID NO: 61163 - DNA, 25 bp, Homo sapien
cacagagtgtttccaggtcggcaca

SEQ ID NO: 61164 - DNA, 25 bp, Homo sapien
cgaagagacttgtatgccacctgca

SEQ ID NO: 61165 - DNA, 25 bp, Homo sapien
gtcccgaatcccgacagcgaagaga

SEQ ID NO: 61166 - DNA, 25 bp, Homo sapien
cgcccggcagagattcagtcccgaa

SEQ ID NO: 61167 - DNA, 25 bp, Homo sapien
atggagaatccatggtgccactttc

SEQ ID NO: 61168 - DNA, 25 bp, Homo sapien
tggccacagtcaaagatggagaatc

SEQ ID NO: 61169 - DNA, 25 bp, Homo sapien
gccacacgccaattcccgtgggatg

SEQ ID NO: 61170 - DNA, 25 bp, Homo sapien
ctcggccaaaagatcaggacgactc

SEQ ID NO: 61171 - DNA, 25 bp, Homo sapien
agcgagaagccgcatcaaccatgta

SEQ ID NO: 61172 - DNA, 25 bp, Homo sapien
acgactcgatctgggctggactcct

SEQ ID NO: 61173 - DNA, 25 bp, Homo sapien
tggactccttctgcctgagcatctg

SEQ ID NO: 61174 - DNA, 25 bp, Homo sapien
ctgaagcggcctaatctcggccaaa

SEQ ID NO: 61175 - DNA, 25 bp, Homo sapien
atgcgtgacgctcacgcgcgcagtc

SEQ ID NO: 61176 - DNA, 25 bp, Homo sapien
tgagcatctgatccgagcgtcggcc

SEQ ID NO: 61177 - DNA, 25 bp, Homo sapien
gccgcatcaaccatgtaagcagctt

SEQ ID NO: 61178 - DNA, 25 bp, Homo sapien
tgaggtcctccctcaggcgctgggc

SEQ ID NO: 61179 - DNA, 25 bp, Homo sapien
tgttctcccgccttctgcgtgagca

SEQ ID NO: 61180 - DNA, 25 bp, Homo sapien
tactggtccctaggaactttcgcca

SEQ ID NO: 61181 - DNA, 25 bp, Homo sapien
aggaactttcgccacacccggagcg

SEQ ID NO: 61182 - DNA, 25 bp, Homo sapien
gcagcgtgctcctcgcaggttactt

SEQ ID NO: 61183 - DNA, 25 bp, Homo sapien
ttacttggtcctgaggtcctccctc

SEQ ID NO: 61184 - DNA, 25 bp, Homo sapien
cagacccggctgagactgtgcttgt

SEQ ID NO: 61185 - DNA, 25 bp, Homo sapien
ctcctcgcaggttacttggtcctga

SEQ ID NO: 61186 - DNA, 25 bp, Homo sapien
ctagtgacgccggaaaagatggagc

SEQ ID NO: 61187 - DNA, 25 bp, Homo sapien
acagccgctggagctatgacaggta

SEQ ID NO: 61188 - DNA, 25 bp, Homo sapien
aggtttgaaagcagcggtgccctag

SEQ ID NO: 61189 - DNA, 25 bp, Homo sapien
tgctgaccctcgatctcctgcggga

SEQ ID NO: 61190 - DNA, 25 bp, Homo sapien
cggaccctgtcttacagccgctgga

SEQ ID NO: 61191 - DNA, 25 bp, Homo sapien
ggagtcagcagccaccggaccctgt

SEQ ID NO: 61192 - DNA, 25 bp, Homo sapien
ttgtcatggcgacgcggagcacacc

SEQ ID NO: 61193 - DNA, 25 bp, Homo sapien
ccactgggactagcgagctggcacc

SEQ ID NO: 61194 - DNA, 25 bp, Homo sapien
ctcagctttagcgacacggaggcca

SEQ ID NO: 61195 - DNA, 25 bp, Homo sapien
gcgacacctgttttcgcggagcctc

SEQ ID NO: 61196 - DNA, 25 bp, Homo sapien
cggcagcagcgacatgagatccttt

SEQ ID NO: 61197 - DNA, 25 bp, Homo sapien
tctccggaagacaagaccaacctcg

SEQ ID NO: 61198 - DNA, 25 bp, Homo sapien
cgcgtcgttactggccacaagtttg

SEQ ID NO: 61199 - DNA, 25 bp, Homo sapien
ttcctacagccgttccgggcatggc

SEQ ID NO: 61200 - DNA, 25 bp, Homo sapien
cgctccacgtctggggttggctaat

SEQ ID NO: 61201 - DNA, 25 bp, Homo sapien
tgcgcgcgagagctcattcatgttc

SEQ ID NO: 61202 - DNA, 25 bp, Homo sapien
ttcttgcccaagctcgtgtacgaca

SEQ ID NO: 61203 - DNA, 25 bp, Homo sapien
caggtgtcggtcacctcgtcgtgct

SEQ ID NO: 61204 - DNA, 25 bp, Homo sapien
tacgacatggttgtgtccactgaca

SEQ ID NO: 61205 - DNA, 25 bp, Homo sapien
gcaagaccatgacatccaccgagca

SEQ ID NO: 61206 - DNA, 25 bp, Homo sapien
agcagtccctctactaccggcagtg

SEQ ID NO: 61207 - DNA, 25 bp, Homo sapien
cagccacatggactacggcaaccgg

SEQ ID NO: 61208 - DNA, 25 bp, Homo sapien
tcaggaccggccagaggagcgtcca

SEQ ID NO: 61209 - DNA, 25 bp, Homo sapien
cctcggtcatgtgggccagctcttt

SEQ ID NO: 61210 - DNA, 25 bp, Homo sapien
gcagcagtgaccacaccggtctgca

SEQ ID NO: 61211 - DNA, 25 bp, Homo sapien
ccacaccggtctgcagccctacttg

SEQ ID NO: 61212 - DNA, 25 bp, Homo sapien
cgaatgcagcagtgaccacaccggt

SEQ ID NO: 61213 - DNA, 25 bp, Homo sapien
agcagtgaccacaccggtctgcagc

SEQ ID NO: 61214 - DNA, 25 bp, Homo sapien
tgcagcagtgaccacaccggtctgc

SEQ ID NO: 61215 - DNA, 25 bp, Homo sapien
atgcagcagtgaccacaccggtctg

SEQ ID NO: 61216 - DNA, 25 bp, Homo sapien
gaatgcagcagtgaccacaccggtc

SEQ ID NO: 61217 - DNA, 25 bp, Homo sapien
gtgaccacaccggtctgcagcccta

SEQ ID NO: 61218 - DNA, 25 bp, Homo sapien
tgctctatgagcagcccaactactc

SEQ ID NO: 61219 - DNA, 25 bp, Homo sapien
cagcgactcggtccgctcctgccgc

SEQ ID NO: 61220 - DNA, 25 bp, Homo sapien
atgggcctcagcgactcggtccgct

SEQ ID NO: 61221 - DNA, 25 bp, Homo sapien
tatgccgaccaccagcagtggatgg

SEQ ID NO: 61222 - DNA, 25 bp, Homo sapien
gactatgccgaccaccagcagtgga

SEQ ID NO: 61223 - DNA, 25 bp, Homo sapien
gcgactatgccgaccaccagcagtg

SEQ ID NO: 61224 - DNA, 25 bp, Homo sapien
agcccaactactcgggcctccagta

SEQ ID NO: 61225 - DNA, 25 bp, Homo sapien
tatgagcagcccaactactcgggcc

SEQ ID NO: 61226 - DNA, 25 bp, Homo sapien
gccagacgctctgggaaacaggtgt

SEQ ID NO: 61227 - DNA, 25 bp, Homo sapien
ttccagactcaccaatttggcgggc

SEQ ID NO: 61228 - DNA, 25 bp, Homo sapien
tggagttcgggtttgaccctcagtc

SEQ ID NO: 61229 - DNA, 25 bp, Homo sapien
ttcctggagcccaagagaagcttcc

SEQ ID NO: 61230 - DNA, 25 bp, Homo sapien
ggggcgcaagatccagcgacaccta

SEQ ID NO: 61231 - DNA, 25 bp, Homo sapien
tcccactatctgaggggaaccgctg

SEQ ID NO: 61232 - DNA, 25 bp, Homo sapien
tgcgcgccgcttcgctaacgcagag

SEQ ID NO: 61233 - DNA, 25 bp, Homo sapien
aacttgtagccggaagcgaggcgca

SEQ ID NO: 61234 - DNA, 25 bp, Homo sapien
gggcactggcctcactttgtcgcgg

SEQ ID NO: 61235 - DNA, 25 bp, Homo sapien
gctcgcggagtctggcgggacctgc

SEQ ID NO: 61236 - DNA, 25 bp, Homo sapien
cgggcactggcctcactttgtcgcg

SEQ ID NO: 61237 - DNA, 25 bp, Homo sapien
ggcactggcctcactttgtcgcggg

SEQ ID NO: 61238 - DNA, 25 bp, Homo sapien
cgattttccaaggacgccagtgagg

SEQ ID NO: 61239 - DNA, 25 bp, Homo sapien
aaggcgaagcggtcgtgctccccct

SEQ ID NO: 61240 - DNA, 25 bp, Homo sapien
gtgaggaaggcccgcctgtcccgcc

SEQ ID NO: 61241 - DNA, 25 bp, Homo sapien
gattttccaaggacgccagtgagga

SEQ ID NO: 61242 - DNA, 25 bp, Homo sapien
gagcgtggacttcttgggccgtacc

SEQ ID NO: 61243 - DNA, 25 bp, Homo sapien
ccattatggtgaagaggaagagctc

SEQ ID NO: 61244 - DNA, 25 bp, Homo sapien
agctgggtcctgcagtaggactccc

SEQ ID NO: 61245 - DNA, 25 bp, Homo sapien
cggattcgcttctccggccgtgcag

SEQ ID NO: 61246 - DNA, 25 bp, Homo sapien
cctgcgatgcggagcgtggacttct

SEQ ID NO: 61247 - DNA, 25 bp, Homo sapien
tcccgggagccaccattatggtgaa

SEQ ID NO: 61248 - DNA, 25 bp, Homo sapien
cgcagccatgttccacgcgcgggga

SEQ ID NO: 61249 - DNA, 25 bp, Homo sapien
cagaccttcctgtggcggcaaacca

SEQ ID NO: 61250 - DNA, 25 bp, Homo sapien
cctagtgagtgggtcgcctgcgcta

SEQ ID NO: 61251 - DNA, 25 bp, Homo sapien
ggtcgcctgcgctacttctgcgcta

SEQ ID NO: 61252 - DNA, 25 bp, Homo sapien
tgcactcattgctccaaggctcggc

SEQ ID NO: 61253 - DNA, 25 bp, Homo sapien
agcggctgcactcattgctccaagg

SEQ ID NO: 61254 - DNA, 25 bp, Homo sapien
ccaattggcgcgaaagtgataaaga

SEQ ID NO: 61255 - DNA, 25 bp, Homo sapien
gaggcacgcctccaattggcgcgaa

SEQ ID NO: 61256 - DNA, 25 bp, Homo sapien
cccacttgctcagagcgtggcctta

SEQ ID NO: 61257 - DNA, 25 bp, Homo sapien
tctgcgctactcagcgacctcgttg

SEQ ID NO: 61258 - DNA, 25 bp, Homo sapien
gccatgtccggacccacactggtga

SEQ ID NO: 61259 - DNA, 25 bp, Homo sapien
gtccggacccacactggtgagaagc

SEQ ID NO: 61260 - DNA, 25 bp, Homo sapien
tcaagaagtaccagtgccaggcgtg

SEQ ID NO: 61261 - DNA, 25 bp, Homo sapien
agtgccaggcgtgcgctcgaacctt

SEQ ID NO: 61262 - DNA, 25 bp, Homo sapien
ctccagacccacttggacgtcaaga

SEQ ID NO: 61263 - DNA, 25 bp, Homo sapien
gctgcccttcgcctgcgaaacctgc

SEQ ID NO: 61264 - DNA, 25 bp, Homo sapien
ttggacgtcaagaagtaccagtgcc

SEQ ID NO: 61265 - DNA, 25 bp, Homo sapien
agcccttctcctgtacccactgcag

SEQ ID NO: 61266 - DNA, 25 bp, Homo sapien
ggccgattatctgcacctggacgta

SEQ ID NO: 61267 - DNA, 25 bp, Homo sapien
gcctcactctgaacgcgatgctaga

SEQ ID NO: 61268 - DNA, 25 bp, Homo sapien
gggcggatcagtgcacctttattga

SEQ ID NO: 61269 - DNA, 25 bp, Homo sapien
cgcagagtggctgcttccggtagaa

SEQ ID NO: 61270 - DNA, 25 bp, Homo sapien
ggctgcaagattggcccgtccatcc

SEQ ID NO: 61271 - DNA, 25 bp, Homo sapien
tcaacagcgacctggccaatttagg

SEQ ID NO: 61272 - DNA, 25 bp, Homo sapien
atgctagactctggggccgattatc

SEQ ID NO: 61273 - DNA, 25 bp, Homo sapien
ctgcttgttggatgtaccgcgtccc

SEQ ID NO: 61274 - DNA, 25 bp, Homo sapien
agctgccaaggctgttaggtttagc

SEQ ID NO: 61275 - DNA, 25 bp, Homo sapien
tttaaatttggctgcggtcagaccc

SEQ ID NO: 61276 - DNA, 25 bp, Homo sapien
gaccagagtccagcagcccagagga

SEQ ID NO: 61277 - DNA, 25 bp, Homo sapien
tgctgaggtgatctctagctgcccg

SEQ ID NO: 61278 - DNA, 25 bp, Homo sapien
gagcacgactcccttaactctggtg

SEQ ID NO: 61279 - DNA, 25 bp, Homo sapien
gctatttttgtacctccgtgacaga

SEQ ID NO: 61280 - DNA, 25 bp, Homo sapien
ccctgaggaaaagtcaggcgacttc

SEQ ID NO: 61281 - DNA, 25 bp, Homo sapien
aactctggtgcagggtttacctcgg

SEQ ID NO: 61282 - DNA, 25 bp, Homo sapien
catgcgcgatctgctggcagtggcc

SEQ ID NO: 61283 - DNA, 25 bp, Homo sapien
cgagctggccatgcgcgatctgctg

SEQ ID NO: 61284 - DNA, 25 bp, Homo sapien
cttccgcggggtgtcatctgtctgg

SEQ ID NO: 61285 - DNA, 25 bp, Homo sapien
ggggtcgattccagtctggcctctg

SEQ ID NO: 61286 - DNA, 25 bp, Homo sapien
tgtcctggaacagcttgggggccac

SEQ ID NO: 61287 - DNA, 25 bp, Homo sapien
ccacggcgtgtcctggaacagcttg

SEQ ID NO: 61288 - DNA, 25 bp, Homo sapien
caggcccacggcgtgtcctggaaca

SEQ ID NO: 61289 - DNA, 25 bp, Homo sapien
tggccatgcgcgatctgctggcagt

SEQ ID NO: 61290 - DNA, 25 bp, Homo sapien
tggtgtcctcccaaaaaagcgctcg

SEQ ID NO: 61291 - DNA, 25 bp, Homo sapien
tggggctccggaatgaacttctgga

SEQ ID NO: 61292 - DNA, 25 bp, Homo sapien
gcccagatgctggttgcacccagtc

SEQ ID NO: 61293 - DNA, 25 bp, Homo sapien
cacagctcgaactgggacacagatc

SEQ ID NO: 61294 - DNA, 25 bp, Homo sapien
ttcaagccagcgacaggagtgactc

SEQ ID NO: 61295 - DNA, 25 bp, Homo sapien
ccgctgaactagacgggttggattg

SEQ ID NO: 61296 - DNA, 25 bp, Homo sapien
ctgagtccgggtcccaagttcacta

SEQ ID NO: 61297 - DNA, 25 bp, Homo sapien
acgatcagctgaggcgtccacctgt

SEQ ID NO: 61298 - DNA, 25 bp, Homo sapien
ccggacagtaacagaagggctattt

SEQ ID NO: 61299 - DNA, 25 bp, Homo sapien
tgccaggagggccaatcagagcctt

SEQ ID NO: 61300 - DNA, 25 bp, Homo sapien
aatcagagccttcgccgttcccgag

SEQ ID NO: 61301 - DNA, 25 bp, Homo sapien
tgcggcccaactgctaggacatggc

SEQ ID NO: 61302 - DNA, 25 bp, Homo sapien
acttgaagcaagtgcgcctcccgcg

SEQ ID NO: 61303 - DNA, 25 bp, Homo sapien
ggacatggcgccttcgcgaaaaagc

SEQ ID NO: 61304 - DNA, 25 bp, Homo sapien
ccacgcccgcgacttgaagcaagtg

SEQ ID NO: 61305 - DNA, 25 bp, Homo sapien
atcgagccgtctcggcggtccgagt

SEQ ID NO: 61306 - DNA, 25 bp, Homo sapien
gacatcatgcactacgccctgctgg

SEQ ID NO: 61307 - DNA, 25 bp, Homo sapien
ctgcggaagtggtccagcaagaccc

SEQ ID NO: 61308 - DNA, 25 bp, Homo sapien
agcgaggtgcaagagcccttctccc

SEQ ID NO: 61309 - DNA, 25 bp, Homo sapien
gctgccacgtgcacaacttcatcat

SEQ ID NO: 61310 - DNA, 25 bp, Homo sapien
catcctgaacgtggacctgacccag

SEQ ID NO: 61311 - DNA, 25 bp, Homo sapien
tggacctgacccagaacgtgcagta

SEQ ID NO: 61312 - DNA, 25 bp, Homo sapien
cgtgcagtacaaccagaaccggtga

SEQ ID NO: 61313 - DNA, 25 bp, Homo sapien
cagaaccggtgagctcctgcacctg

SEQ ID NO: 61314 - DNA, 25 bp, Homo sapien
ggagtgccagaaggaacccacctga

SEQ ID NO: 61315 - DNA, 25 bp, Homo sapien
cacacaggtgcaaagcccgattttc

SEQ ID NO: 61316 - DNA, 25 bp, Homo sapien
tctcctctgactggggatttgggtc

SEQ ID NO: 61317 - DNA, 25 bp, Homo sapien
gcgccaccagaagggatcccgctta

SEQ ID NO: 61318 - DNA, 25 bp, Homo sapien
cacctgactgagaatcgctgggctg

SEQ ID NO: 61319 - DNA, 25 bp, Homo sapien
cctgtcgccggcttcattttttgga

SEQ ID NO: 61320 - DNA, 25 bp, Homo sapien
tttggaagtctcagatcccgtgctg

SEQ ID NO: 61321 - DNA, 25 bp, Homo sapien
ggtctcccatgtcccgaacaacagg

SEQ ID NO: 61322 - DNA, 25 bp, Homo sapien
ttagcggtcctacacctagcggtcc

SEQ ID NO: 61323 - DNA, 25 bp, Homo sapien
tgcaggtccctgaatcctctttgga

SEQ ID NO: 61324 - DNA, 25 bp, Homo sapien
tccagctggccgtgtacaaggacct

SEQ ID NO: 61325 - DNA, 25 bp, Homo sapien
atgaactcctgcctctgggacctcg

SEQ ID NO: 61326 - DNA, 25 bp, Homo sapien
gaactgagcttcgagcgcgacatgc

SEQ ID NO: 61327 - DNA, 25 bp, Homo sapien
tggtgcgcttctacttcctcacgcg

SEQ ID NO: 61328 - DNA, 25 bp, Homo sapien
cctgcttcagaaggactgcctgctg

SEQ ID NO: 61329 - DNA, 25 bp, Homo sapien
acgtcctgccttctgttgtggaaca

SEQ ID NO: 61330 - DNA, 25 bp, Homo sapien
gcgcgctcggcaatcgattacagga

SEQ ID NO: 61331 - DNA, 25 bp, Homo sapien
cccatttcggaaagcgcaccgcatt

SEQ ID NO: 61332 - DNA, 25 bp, Homo sapien
catttcggccgcgtgaagttttctt

SEQ ID NO: 61333 - DNA, 25 bp, Homo sapien
cggtgaggtgacgttcatttcggcc

SEQ ID NO: 61334 - DNA, 25 bp, Homo sapien
aatctcacgttttctgccggctgga

SEQ ID NO: 61335 - DNA, 25 bp, Homo sapien
cccgtgtcataataaatctcacgtt

SEQ ID NO: 61336 - DNA, 25 bp, Homo sapien
gcaccgcattgaccgggacctgaag

SEQ ID NO: 61337 - DNA, 25 bp, Homo sapien
aggtaacccgcttccgagtgtgcca

SEQ ID NO: 61338 - DNA, 25 bp, Homo sapien
tgctcagcgagggatgcccagctcc

SEQ ID NO: 61339 - DNA, 25 bp, Homo sapien
ccgaagcgccagagatggctgctca

SEQ ID NO: 61340 - DNA, 25 bp, Homo sapien
ctcgcgttaactaggcaacatcgtt

SEQ ID NO: 61341 - DNA, 25 bp, Homo sapien
aacatcgttgccacggtaactggga

SEQ ID NO: 61342 - DNA, 25 bp, Homo sapien
gggcgcctactacctggaacgtatc

SEQ ID NO: 61343 - DNA, 25 bp, Homo sapien
agatgccggaatctcgcgagagctc

SEQ ID NO: 61344 - DNA, 25 bp, Homo sapien
tgcgcccgagctctcgcgttaacta

SEQ ID NO: 61345 - DNA, 25 bp, Homo sapien
tagcgtcttcgctgttgcccttagg

SEQ ID NO: 61346 - DNA, 25 bp, Homo sapien
tccaggtggaaagccagtcgacgtt

SEQ ID NO: 61347 - DNA, 25 bp, Homo sapien
ggccggacggctgaaacttgccaaa

SEQ ID NO: 61348 - DNA, 25 bp, Homo sapien
ctggaggctgaaacttgccaaagtc

SEQ ID NO: 61349 - DNA, 25 bp, Homo sapien
ccaaaatagggactcgcagggcaca

SEQ ID NO: 61350 - DNA, 25 bp, Homo sapien
gcggccgcaatgctcccaaaatagg

SEQ ID NO: 61351 - DNA, 25 bp, Homo sapien
ctcgggaaaccacagggaagctgca

SEQ ID NO: 61352 - DNA, 25 bp, Homo sapien
catcgtcccgccttcggatgaaagg

SEQ ID NO: 61353 - DNA, 25 bp, Homo sapien
tccgtctttaccaacgcgagcagcg

SEQ ID NO: 61354 - DNA, 25 bp, Homo sapien
tcgccctgaacccagtgcctgcagc

SEQ ID NO: 61355 - DNA, 25 bp, Homo sapien
gggccacgtgataagcccggaaaca

SEQ ID NO: 61356 - DNA, 25 bp, Homo sapien
gatcttgcatctgaaactgagcaga

SEQ ID NO: 61357 - DNA, 25 bp, Homo sapien
ggcgcggatcttgcatctgaaactg

SEQ ID NO: 61358 - DNA, 25 bp, Homo sapien
ttccagcccaagcactccgcccagg

SEQ ID NO: 61359 - DNA, 25 bp, Homo sapien
cacgcctggacttcgggatcgcagg

SEQ ID NO: 61360 - DNA, 25 bp, Homo sapien
agccctcctacctgcgcacgtggtg

SEQ ID NO: 61361 - DNA, 25 bp, Homo sapien
ggctcccacgcctggacttcgggat

SEQ ID NO: 61362 - DNA, 25 bp, Homo sapien
cggtcagtactcacgcttgctttga

SEQ ID NO: 61363 - DNA, 25 bp, Homo sapien
catccctgaggcagcctgtttcagc

SEQ ID NO: 61364 - DNA, 25 bp, Homo sapien
ttgctttgactgacagccaccgggg

SEQ ID NO: 61365 - DNA, 25 bp, Homo sapien
tgagcctgcctcttgctcttcgagg

SEQ ID NO: 61366 - DNA, 25 bp, Homo sapien
ggcaagttgccaccaagtttgcttc

SEQ ID NO: 61367 - DNA, 25 bp, Homo sapien
gtttgcttcccttcgcaacctgcgg

SEQ ID NO: 61368 - DNA, 25 bp, Homo sapien
gtcggctttagggtcccatccctga

SEQ ID NO: 61369 - DNA, 25 bp, Homo sapien
actggggctgaaccatttgctgagc

SEQ ID NO: 61370 - DNA, 25 bp, Homo sapien
tgcacgactggattccttctccatc

SEQ ID NO: 61371 - DNA, 25 bp, Homo sapien
ttcccatcccatagcgcagataggt

SEQ ID NO: 61372 - DNA, 25 bp, Homo sapien
cgcagataggtagggcaggtacaca

SEQ ID NO: 61373 - DNA, 25 bp, Homo sapien
acacagggaggtgttcgaatgatcc

SEQ ID NO: 61374 - DNA, 25 bp, Homo sapien
cgcactcccggagcttcgcccatct

SEQ ID NO: 61375 - DNA, 25 bp, Homo sapien
tcttcctgcacgactggattccttc

SEQ ID NO: 61376 - DNA, 25 bp, Homo sapien
agtactcccgccttggcgccagagg

SEQ ID NO: 61377 - DNA, 25 bp, Homo sapien
caaatccgcgcatcggtttcccatc

SEQ ID NO: 61378 - DNA, 25 bp, Homo sapien
gctacggcccaggtaagcccagatc

SEQ ID NO: 61379 - DNA, 25 bp, Homo sapien
ccctcctctccttgcgttttgtttg

SEQ ID NO: 61380 - DNA, 25 bp, Homo sapien
caatttggggcgcatgcgtccacga

SEQ ID NO: 61381 - DNA, 25 bp, Homo sapien
acacggttctcagccagtccctcag

SEQ ID NO: 61382 - DNA, 25 bp, Homo sapien
cccgagcgcaatttggggcgcatgc

SEQ ID NO: 61383 - DNA, 25 bp, Homo sapien
tccaagcactcgcacccgcagcagc

SEQ ID NO: 61384 - DNA, 25 bp, Homo sapien
ggctccttctcaggcagggcgcgct

SEQ ID NO: 61385 - DNA, 25 bp, Homo sapien
acccacctgacgaggggctccttct

SEQ ID NO: 61386 - DNA, 25 bp, Homo sapien
gtgagactgctcgttcgtttcttta

SEQ ID NO: 61387 - DNA, 25 bp, Homo sapien
cccgccggtgacgatggccacttgg

SEQ ID NO: 61388 - DNA, 25 bp, Homo sapien
ctccttcacgatggcttttccgatg

SEQ ID NO: 61389 - DNA, 25 bp, Homo sapien
ggcggtgctcgagcccacgtgacca

SEQ ID NO: 61390 - DNA, 25 bp, Homo sapien
cttctgggtctcagggacattcgag

SEQ ID NO: 61391 - DNA, 25 bp, Homo sapien
cagctgagcgcaggcccttctgggt

SEQ ID NO: 61392 - DNA, 25 bp, Homo sapien
tgcagcaaaccaggcgccaggtagc

SEQ ID NO: 61393 - DNA, 25 bp, Homo sapien
cgatggccacttggccctgcagcaa

SEQ ID NO: 61394 - DNA, 25 bp, Homo sapien
ctagcaggaaacgaagcggctcttt

SEQ ID NO: 61395 - DNA, 25 bp, Homo sapien
cgtactagcgtttcaggcggctcaa

SEQ ID NO: 61396 - DNA, 25 bp, Homo sapien
atctgcgcatgctcagagttccggg

SEQ ID NO: 61397 - DNA, 25 bp, Homo sapien
ggctctttccgctatctgccgcttg

SEQ ID NO: 61398 - DNA, 25 bp, Homo sapien
cttgtccaccggaagcgagttgcga

SEQ ID NO: 61399 - DNA, 25 bp, Homo sapien
cgaccaaagcgcctgaggaccggca

SEQ ID NO: 61400 - DNA, 25 bp, Homo sapien
atggacttgggctttacccggactg

SEQ ID NO: 61401 - DNA, 25 bp, Homo sapien
tttcaggcggctcaaacaccacacg

SEQ ID NO: 61402 - DNA, 25 bp, Homo sapien
tcccgcgccgtcttatctgcgtttg

SEQ ID NO: 61403 - DNA, 25 bp, Homo sapien
gtggcatgtcctcgctcgacgaggc

SEQ ID NO: 61404 - DNA, 25 bp, Homo sapien
gtcagagccgccctctctaggggtc

SEQ ID NO: 61405 - DNA, 25 bp, Homo sapien
tccatgaacacagtgagcccgtggc

SEQ ID NO: 61406 - DNA, 25 bp, Homo sapien
tcaccgttcccggtgcgggtctgaa

SEQ ID NO: 61407 - DNA, 25 bp, Homo sapien
cggcttaaacggaggttgcaccatc

SEQ ID NO: 61408 - DNA, 25 bp, Homo sapien
gcttcttgcctttcctgcttcctgg

SEQ ID NO: 61409 - DNA, 25 bp, Homo sapien
ttatctgcgtttggactgggagctg

SEQ ID NO: 61410 - DNA, 25 bp, Homo sapien
ctgttgctacctctcctcgcagatg

SEQ ID NO: 61411 - DNA, 25 bp, Homo sapien
tcggttctcaggcaagagtgcttct

SEQ ID NO: 61412 - DNA, 25 bp, Homo sapien
tcgcagatgcaacgaggtaaggctt

SEQ ID NO: 61413 - DNA, 25 bp, Homo sapien
gtaaggcttgtttgcggtgccagct

SEQ ID NO: 61414 - DNA, 25 bp, Homo sapien
caaatcagattccaggctgctgcca

SEQ ID NO: 61415 - DNA, 25 bp, Homo sapien
ttgtctcgtcttccgccgttgctca

SEQ ID NO: 61416 - DNA, 25 bp, Homo sapien
cactggctcgattcccaaaggggtg

SEQ ID NO: 61417 - DNA, 25 bp, Homo sapien
gctgaccgtccgagaactggaaaca

SEQ ID NO: 61418 - DNA, 25 bp, Homo sapien
tcgcgttctcgtctcatcattctta

SEQ ID NO: 61419 - DNA, 25 bp, Homo sapien
ttacttttggaagcgaaactgcggc

SEQ ID NO: 61420 - DNA, 25 bp, Homo sapien
ccgctacaataaggctggcgaactc

SEQ ID NO: 61421 - DNA, 25 bp, Homo sapien
ctggcgaactcgcagcgcttgaata

SEQ ID NO: 61422 - DNA, 25 bp, Homo sapien
agcgcttgaatacccgtggcctaac

SEQ ID NO: 61423 - DNA, 25 bp, Homo sapien
gtggcctaaccgtccactcggaaga

SEQ ID NO: 61424 - DNA, 25 bp, Homo sapien
tctaggcctccctgggtgagaaagt

SEQ ID NO: 61425 - DNA, 25 bp, Homo sapien
gcccatgacgttgcagctcccgttt

SEQ ID NO: 61426 - DNA, 25 bp, Homo sapien
tctctgtgcggcctagaactctatc

SEQ ID NO: 61427 - DNA, 25 bp, Homo sapien
gctcgtccgcctaataccgcgcctg

SEQ ID NO: 61428 - DNA, 25 bp, Homo sapien
ggagacaccattgtcggaagctccc

SEQ ID NO: 61429 - DNA, 25 bp, Homo sapien
tgcctttgcaggagacaccattgtc

SEQ ID NO: 61430 - DNA, 25 bp, Homo sapien
tctgtccttgttttcttctcccgca

SEQ ID NO: 61431 - DNA, 25 bp, Homo sapien
ctagaactctatctgcctgcatctg

SEQ ID NO: 61432 - DNA, 25 bp, Homo sapien
gctcggacctaggtcgcggcgacat

SEQ ID NO: 61433 - DNA, 25 bp, Homo sapien
cctgcatctgtccttgttttcttct

SEQ ID NO: 61434 - DNA, 25 bp, Homo sapien
ctggaacaagtagttgggagaaact

SEQ ID NO: 61435 - DNA, 25 bp, Homo sapien
gcagacaaaagcacgcgctcttctc

SEQ ID NO: 61436 - DNA, 25 bp, Homo sapien
cgcgagttatccgtattctccttca

SEQ ID NO: 61437 - DNA, 25 bp, Homo sapien
tctccttcaggagtcatagtcaggc

SEQ ID NO: 61438 - DNA, 25 bp, Homo sapien
tcatagtcaggccagaagagtgcgg

SEQ ID NO: 61439 - DNA, 25 bp, Homo sapien
caggtaacgcggtctggaacaagta

SEQ ID NO: 61440 - DNA, 25 bp, Homo sapien
gccgagaccttggaccaaatcaagg

SEQ ID NO: 61441 - DNA, 25 bp, Homo sapien
gaccgccagcatgctgccgagagtg

SEQ ID NO: 61442 - DNA, 25 bp, Homo sapien
tcttgcttgggactgaagtgtcgtg

SEQ ID NO: 61443 - DNA, 25 bp, Homo sapien
tgttcgggaagaagatgtcggcacc

SEQ ID NO: 61444 - DNA, 25 bp, Homo sapien
agaagatgtcggcaccagcagcggt

SEQ ID NO: 61445 - DNA, 25 bp, Homo sapien
ttggcccaaaggcactcagaaggtg

SEQ ID NO: 61446 - DNA, 25 bp, Homo sapien
gggaattctacaggggatcttgctt

SEQ ID NO: 61447 - DNA, 25 bp, Homo sapien
tccgtgctcgcctagcaattgcgcg

SEQ ID NO: 61448 - DNA, 25 bp, Homo sapien
gctaaaacgccctttccaggagcgc

SEQ ID NO: 61449 - DNA, 25 bp, Homo sapien
ctcccatcccatctgttcgggaaga

SEQ ID NO: 61450 - DNA, 25 bp, Homo sapien
tcgaagccacttgctgcgcaaagcg

SEQ ID NO: 61451 - DNA, 25 bp, Homo sapien
ccagggcgcaggtcatgcagcagcc

SEQ ID NO: 61452 - DNA, 25 bp, Homo sapien
tagctcttttcgttgaggcaaaccc

SEQ ID NO: 61453 - DNA, 25 bp, Homo sapien
tcttgacttgctcgcggtagctctt

SEQ ID NO: 61454 - DNA, 25 bp, Homo sapien
agcgcgctcaccgatcttgacttgc

SEQ ID NO: 61455 - DNA, 25 bp, Homo sapien
tgactggcacactgagcgcgctcac

SEQ ID NO: 61456 - DNA, 25 bp, Homo sapien
gccgcgtaactgactggcacactga

SEQ ID NO: 61457 - DNA, 25 bp, Homo sapien
ctcgcagtgcacgaaggagcccagg

SEQ ID NO: 61458 - DNA, 25 bp, Homo sapien
tacgccatgactgctcacggtggtc

SEQ ID NO: 61459 - DNA, 25 bp, Homo sapien
ccgctgataacaacggaaccgtggg

SEQ ID NO: 61460 - DNA, 25 bp, Homo sapien
gggcattggcccttcaacgccgtct

SEQ ID NO: 61461 - DNA, 25 bp, Homo sapien
ccgccctctccagtcagtttggtgg

SEQ ID NO: 61462 - DNA, 25 bp, Homo sapien
atatttcggtgaaggctgcagactc

SEQ ID NO: 61463 - DNA, 25 bp, Homo sapien
tcaagcagcgttctccgtactcttc

SEQ ID NO: 61464 - DNA, 25 bp, Homo sapien
gctggcctgctcttaccttcaggtg

SEQ ID NO: 61465 - DNA, 25 bp, Homo sapien
ctctgcactgtggagtacgccatga

SEQ ID NO: 61466 - DNA, 25 bp, Homo sapien
atggtggggccggtaacccaacatg

SEQ ID NO: 61467 - DNA, 25 bp, Homo sapien
acgctctggtgtgggcagcccgaga

SEQ ID NO: 61468 - DNA, 25 bp, Homo sapien
gtttcagtaaatcatggcggggagt

SEQ ID NO: 61469 - DNA, 25 bp, Homo sapien
ttcagtaaatcatggcggggagttc

SEQ ID NO: 61470 - DNA, 25 bp, Homo sapien
gagttcaggccaccgccggagtcca

SEQ ID NO: 61471 - DNA, 25 bp, Homo sapien
ccagtgggtagggctctctacggcc

SEQ ID NO: 61472 - DNA, 25 bp, Homo sapien
gtaacccaacatggggcccaggagc

SEQ ID NO: 61473 - DNA, 25 bp, Homo sapien
gtagggctctctacggccggaggtg

SEQ ID NO: 61474 - DNA, 25 bp, Homo sapien
cctcacgtgccctcacgcacgtatg

SEQ ID NO: 61475 - DNA, 25 bp, Homo sapien
gctctggccggcacggccctcacgt

SEQ ID NO: 61476 - DNA, 25 bp, Homo sapien
acgcacgtatgccccgcatgggttc

SEQ ID NO: 61477 - DNA, 25 bp, Homo sapien
gcatgggttcccccagcgagctatc

SEQ ID NO: 61478 - DNA, 25 bp, Homo sapien
ccagcgagctatccctgcgcccacc

SEQ ID NO: 61479 - DNA, 25 bp, Homo sapien
ctccggagctgctcacacgcaggtg

SEQ ID NO: 61480 - DNA, 25 bp, Homo sapien
cgcaggtgaagactgccccctggtg

SEQ ID NO: 61481 - DNA, 25 bp, Homo sapien
gtgtgcacgcacgcaaggccgcgca

SEQ ID NO: 61482 - DNA, 25 bp, Homo sapien
ccttaccttggcctggcatttccga

SEQ ID NO: 61483 - DNA, 25 bp, Homo sapien
ggtatgaaatggaaactccgcgaaa

SEQ ID NO: 61484 - DNA, 25 bp, Homo sapien
gccgcgaggtatgaaatggaaactc

SEQ ID NO: 61485 - DNA, 25 bp, Homo sapien
aagaaagttttagccgcgaggtatg

SEQ ID NO: 61486 - DNA, 25 bp, Homo sapien
acacagaaagaaagttttagccgcg

SEQ ID NO: 61487 - DNA, 25 bp, Homo sapien
ctgcagactgcaagagggcgagaca

SEQ ID NO: 61488 - DNA, 25 bp, Homo sapien
accttggcctggcatttccgatgac

SEQ ID NO: 61489 - DNA, 25 bp, Homo sapien
ccgcaatccgcgctcgggaaggaag

SEQ ID NO: 61490 - DNA, 25 bp, Homo sapien
agggactcttcctccgcggctttct

SEQ ID NO: 61491 - DNA, 25 bp, Homo sapien
gggcttacaccctcagggactcttc

SEQ ID NO: 61492 - DNA, 25 bp, Homo sapien
ggagaagcaccaactcagccgagtc

SEQ ID NO: 61493 - DNA, 25 bp, Homo sapien
cccatcggatcacgcaggagaagca

SEQ ID NO: 61494 - DNA, 25 bp, Homo sapien
gagcatttacctggctgcggaggca

SEQ ID NO: 61495 - DNA, 25 bp, Homo sapien
caggtgtggccgagagcatttacct

SEQ ID NO: 61496 - DNA, 25 bp, Homo sapien
agtaagtcagatcgaatgcccagga

SEQ ID NO: 61497 - DNA, 25 bp, Homo sapien
caacttctgaggttcggggagccgc

SEQ ID NO: 61498 - DNA, 25 bp, Homo sapien
ccgaaagggtgtccctgagccaacg

SEQ ID NO: 61499 - DNA, 25 bp, Homo sapien
ccttacctggataaagacttggagc

SEQ ID NO: 61500 - DNA, 25 bp, Homo sapien
tctctgggaacctctagaactggga

SEQ ID NO: 61501 - DNA, 25 bp, Homo sapien
cgtagagcgcggtgaacagcacctt

SEQ ID NO: 61502 - DNA, 25 bp, Homo sapien
aagctgtagagctccaccggcacgc

SEQ ID NO: 61503 - DNA, 25 bp, Homo sapien
tagtggaaccacacgaagctgtaga

SEQ ID NO: 61504 - DNA, 25 bp, Homo sapien
tgccagcccgttagcgtcggtcaca

SEQ ID NO: 61505 - DNA, 25 bp, Homo sapien
agctcgtgcacgaagtagtagccgc

SEQ ID NO: 61506 - DNA, 25 bp, Homo sapien
ttcgcagcacaccaggctcacagtg

SEQ ID NO: 61507 - DNA, 25 bp, Homo sapien
cacagtgcagcccatccggcctggc

SEQ ID NO: 61508 - DNA, 25 bp, Homo sapien
cagagcgcctgcgacattggcaggc

SEQ ID NO: 61509 - DNA, 25 bp, Homo sapien
tgaagcggtagctgccttctctctg

SEQ ID NO: 61510 - DNA, 25 bp, Homo sapien
tacctgaagcggtagctgccttctc

SEQ ID NO: 61511 - DNA, 25 bp, Homo sapien
cgtcgtccctcacccattcccgcag

SEQ ID NO: 61512 - DNA, 25 bp, Homo sapien
acattggcaggcgagcagcaacgac

SEQ ID NO: 61513 - DNA, 25 bp, Homo sapien
cccggactcccagcactcagcccgc

SEQ ID NO: 61514 - DNA, 25 bp, Homo sapien
ttcacgagtggttgaagcggaaatg

SEQ ID NO: 61515 - DNA, 25 bp, Homo sapien
tgggtgtctccacagtctgcgtgcg

SEQ ID NO: 61516 - DNA, 25 bp, Homo sapien
gcgctcgcgttcacgagtggttgaa

SEQ ID NO: 61517 - DNA, 25 bp, Homo sapien
cctgcgctcgcgttcacgagtggtt

SEQ ID NO: 61518 - DNA, 25 bp, Homo sapien
ggcatcacacatacgcaagcgcagc

SEQ ID NO: 61519 - DNA, 25 bp, Homo sapien
gcggcggcatcacacatacgcaagc

SEQ ID NO: 61520 - DNA, 25 bp, Homo sapien
acgcactggtaggcggtagacgtaa

SEQ ID NO: 61521 - DNA, 25 bp, Homo sapien
tgtctccacagtctgcgtgcgtggg

SEQ ID NO: 61522 - DNA, 25 bp, Homo sapien
cggccgttcggccaatagctacgaa

SEQ ID NO: 61523 - DNA, 25 bp, Homo sapien
cgattcggactccatgcggcgcaag

SEQ ID NO: 61524 - DNA, 25 bp, Homo sapien
ggcaggactgcagaagatccctttt

SEQ ID NO: 61525 - DNA, 25 bp, Homo sapien
agatgtagtttctggtctgtaggca

SEQ ID NO: 61526 - DNA, 25 bp, Homo sapien
aagagtagttctcctgggtccgctc

SEQ ID NO: 61527 - DNA, 25 bp, Homo sapien
atagctacgaaggttggctggccgc

SEQ ID NO: 61528 - DNA, 25 bp, Homo sapien
cagagtcagctctgcgcgacgacgc

SEQ ID NO: 61529 - DNA, 25 bp, Homo sapien
gcgtggcggagagaacccaaactcc

SEQ ID NO: 61530 - DNA, 25 bp, Homo sapien
cttgcctgcgccgttccagacggag

SEQ ID NO: 61531 - DNA, 25 bp, Homo sapien
gcgccgttccagacggagcgttcct

SEQ ID NO: 61532 - DNA, 25 bp, Homo sapien
gttccagacggagcgttcctggcct

SEQ ID NO: 61533 - DNA, 25 bp, Homo sapien
ttcctggcctcggagtgttgcaagt

SEQ ID NO: 61534 - DNA, 25 bp, Homo sapien
ggcctcggagtgttgcaagtcctcc

SEQ ID NO: 61535 - DNA, 25 bp, Homo sapien
ctcggagtgttgcaagtcctccggg

SEQ ID NO: 61536 - DNA, 25 bp, Homo sapien
atctggaacgggctccttgggccca

SEQ ID NO: 61537 - DNA, 25 bp, Homo sapien
cgcccagggagagcgaaacgccaag

SEQ ID NO: 61538 - DNA, 25 bp, Homo sapien
agcggctgctcttccgaatcgggtt

SEQ ID NO: 61539 - DNA, 25 bp, Homo sapien
tgtggaccccgatcagcgcaggctc

SEQ ID NO: 61540 - DNA, 25 bp, Homo sapien
cccccagcatggcttggcagggctg

SEQ ID NO: 61541 - DNA, 25 bp, Homo sapien
acagccagcggctgctcttccgaat

SEQ ID NO: 61542 - DNA, 25 bp, Homo sapien
tcccagggctcaggcgactgtggac

SEQ ID NO: 61543 - DNA, 25 bp, Homo sapien
ggctgctcttccgaatcgggttagt

SEQ ID NO: 61544 - DNA, 25 bp, Homo sapien
gctcttccgaatcgggttagtgccc

SEQ ID NO: 61545 - DNA, 25 bp, Homo sapien
cgtccttgtcctcgtcctacttgtg

SEQ ID NO: 61546 - DNA, 25 bp, Homo sapien
gacctgggttagacgtgaggacaca

SEQ ID NO: 61547 - DNA, 25 bp, Homo sapien
ttagacgtgaggacacactccggtg

SEQ ID NO: 61548 - DNA, 25 bp, Homo sapien
ctgggttagacgtgaggacacactc

SEQ ID NO: 61549 - DNA, 25 bp, Homo sapien
acgtgaggacacactccggtggatg

SEQ ID NO: 61550 - DNA, 25 bp, Homo sapien
tgaggacacactccggtggatgtcg

SEQ ID NO: 61551 - DNA, 25 bp, Homo sapien
acctgggttagacgtgaggacacac

SEQ ID NO: 61552 - DNA, 25 bp, Homo sapien
cctgggttagacgtgaggacacact

SEQ ID NO: 61553 - DNA, 25 bp, Homo sapien
ggttagacgtgaggacacactccgg

SEQ ID NO: 61554 - DNA, 25 bp, Homo sapien
aggacgtggtcaccttcgccgccga

SEQ ID NO: 61555 - DNA, 25 bp, Homo sapien
gccacgccagctatctgcggcagca

SEQ ID NO: 61556 - DNA, 25 bp, Homo sapien
agccggaggacgtggtcaccttcgc

SEQ ID NO: 61557 - DNA, 25 bp, Homo sapien
tggcgtccgtcgtcaccggccttgg

SEQ ID NO: 61558 - DNA, 25 bp, Homo sapien
cgtcgacagcgtccctggctagcgt

SEQ ID NO: 61559 - DNA, 25 bp, Homo sapien
tccctggctagcgtctagtgtctcg

SEQ ID NO: 61560 - DNA, 25 bp, Homo sapien
tagcgtctagtgtctcgggctagaa

SEQ ID NO: 61561 - DNA, 25 bp, Homo sapien
gctcatctccgacttcctgctcttc

SEQ ID NO: 61562 - DNA, 25 bp, Homo sapien
gagaaatggtgaccgcggcgtggtt

SEQ ID NO: 61563 - DNA, 25 bp, Homo sapien
aggctcctccctgcagtatgtggtg

SEQ ID NO: 61564 - DNA, 25 bp, Homo sapien
ctccctgcagtatgtggtggcgcgt

SEQ ID NO: 61565 - DNA, 25 bp, Homo sapien
gctcctccctgcagtatgtggtggc

SEQ ID NO: 61566 - DNA, 25 bp, Homo sapien
aggctgagaaatggtgaccgcggcg

SEQ ID NO: 61567 - DNA, 25 bp, Homo sapien
cctgcagtatgtggtggcgcgtcct

SEQ ID NO: 61568 - DNA, 25 bp, Homo sapien
ctgttcctgccctcgtgcccgggct

SEQ ID NO: 61569 - DNA, 25 bp, Homo sapien
ggagcgcttcttcggggcctgttcc

SEQ ID NO: 61570 - DNA, 25 bp, Homo sapien
cggccctctacatctgggccatagg

SEQ ID NO: 61571 - DNA, 25 bp, Homo sapien
gacgggcacctacgcgggacagttc

SEQ ID NO: 61572 - DNA, 25 bp, Homo sapien
agagctccaccatgacgggcaccta

SEQ ID NO: 61573 - DNA, 25 bp, Homo sapien
ctgggccataggtctcctggcggct

SEQ ID NO: 61574 - DNA, 25 bp, Homo sapien
acactcgtccctgcagggcgtgatc

SEQ ID NO: 61575 - DNA, 25 bp, Homo sapien
ggccaccggtcctaccacactcgtc

SEQ ID NO: 61576 - DNA, 25 bp, Homo sapien
accgtggccgtggacatttaccagg

SEQ ID NO: 61577 - DNA, 25 bp, Homo sapien
ctgggcagagctccaccatgacggg

SEQ ID NO: 61578 - DNA, 25 bp, Homo sapien
ggtagtgctatctccaagtcctcaa

SEQ ID NO: 61579 - DNA, 25 bp, Homo sapien
cctcgcgggaaggaaactccatgtt

SEQ ID NO: 61580 - DNA, 25 bp, Homo sapien
tttggctacgcgaaaggaacagcgc

SEQ ID NO: 61581 - DNA, 25 bp, Homo sapien
cccagggcagagagttagaatttca

SEQ ID NO: 61582 - DNA, 25 bp, Homo sapien
cggcgaccgtcccattcaagagcgt

SEQ ID NO: 61583 - DNA, 25 bp, Homo sapien
aggtttgcacagctgtttcgggcca

SEQ ID NO: 61584 - DNA, 25 bp, Homo sapien
cttgacgtccttgcgaggtgatctc

SEQ ID NO: 61585 - DNA, 25 bp, Homo sapien
gtcccgggtcttcagaaaacgcaga

SEQ ID NO: 61586 - DNA, 25 bp, Homo sapien
ccagcggcagaacttgttggcctgg

SEQ ID NO: 61587 - DNA, 25 bp, Homo sapien
gctccagcggcagaacttgttggcc

SEQ ID NO: 61588 - DNA, 25 bp, Homo sapien
ggaggcacttcctttgcgaaaccgc

SEQ ID NO: 61589 - DNA, 25 bp, Homo sapien
ggctggaaagatggggcccacctca

SEQ ID NO: 61590 - DNA, 25 bp, Homo sapien
ctgtcctcgcggacgcaggaactcc

SEQ ID NO: 61591 - DNA, 25 bp, Homo sapien
cacgccagccgctagaggcctccct

SEQ ID NO: 61592 - DNA, 25 bp, Homo sapien
ggcacttcctttgcgaaaccgcgcg

SEQ ID NO: 61593 - DNA, 25 bp, Homo sapien
agcctttgcttgcttcccacgccag

SEQ ID NO: 61594 - DNA, 25 bp, Homo sapien
cctggacttttacctggctgccttt

SEQ ID NO: 61595 - DNA, 25 bp, Homo sapien
ataggtcaacgcgattgcgccttta

SEQ ID NO: 61596 - DNA, 25 bp, Homo sapien
cgccactggtgataagcgggaccca

SEQ ID NO: 61597 - DNA, 25 bp, Homo sapien
tgtttgcaatacaaaggcggccacg

SEQ ID NO: 61598 - DNA, 25 bp, Homo sapien
cgggacccataggaccgacgtgatc

SEQ ID NO: 61599 - DNA, 25 bp, Homo sapien
cacgagtttggctctggaaaggaaa

SEQ ID NO: 61600 - DNA, 25 bp, Homo sapien
ccagtcatcggcataggtcaagtca

SEQ ID NO: 61601 - DNA, 25 bp, Homo sapien
tgcgcctttaaggtggaagaaacga

SEQ ID NO: 61602 - DNA, 25 bp, Homo sapien
cgtgcgcgtcagtcgaaaactccgc

SEQ ID NO: 61603 - DNA, 25 bp, Homo sapien
gactgtagtaggcacgcgcactttc

SEQ ID NO: 61604 - DNA, 25 bp, Homo sapien
acccagtcgggcatgcgcaatagtt

SEQ ID NO: 61605 - DNA, 25 bp, Homo sapien
caatagttgtcttgccgggactgtc

SEQ ID NO: 61606 - DNA, 25 bp, Homo sapien
ccgccgttcactggcttttggagga

SEQ ID NO: 61607 - DNA, 25 bp, Homo sapien
tcacgccgctctctggaaataactg

SEQ ID NO: 61608 - DNA, 25 bp, Homo sapien
ttaaggggcaaaggacatactctgg

SEQ ID NO: 61609 - DNA, 25 bp, Homo sapien
cttctctcctaattcccggtgtcgg

SEQ ID NO: 61610 - DNA, 25 bp, Homo sapien
cctgaagccggagaagcaccatcga

SEQ ID NO: 61611 - DNA, 25 bp, Homo sapien
ggtccagaaccgtgacgcgactgca

SEQ ID NO: 61612 - DNA, 25 bp, Homo sapien
cggctcagccgcctctaggatattg

SEQ ID NO: 61613 - DNA, 25 bp, Homo sapien
ggatgtggaagccactctctcttcc

SEQ ID NO: 61614 - DNA, 25 bp, Homo sapien
gccggggtactctatgttttgtctc

SEQ ID NO: 61615 - DNA, 25 bp, Homo sapien
gtgaaaccatcgagacggagggcca

SEQ ID NO: 61616 - DNA, 25 bp, Homo sapien
cctctaggatattggggatgtggaa

SEQ ID NO: 61617 - DNA, 25 bp, Homo sapien
gcaccatcgagagctctggggtaga

SEQ ID NO: 61618 - DNA, 25 bp, Homo sapien
cgacagctgctaggcctctggacta

SEQ ID NO: 61619 - DNA, 25 bp, Homo sapien
tacggaccgtctgcgacagctgcta

SEQ ID NO: 61620 - DNA, 25 bp, Homo sapien
cctctggactagatccaggctgtca

SEQ ID NO: 61621 - DNA, 25 bp, Homo sapien
cagccggaaccggaaatgcccttag

SEQ ID NO: 61622 - DNA, 25 bp, Homo sapien
agctagcgtcgtttctaggcaaccg

SEQ ID NO: 61623 - DNA, 25 bp, Homo sapien
tctaggcaaccgcagactccgggtc

SEQ ID NO: 61624 - DNA, 25 bp, Homo sapien
cccagtccagctttcccagagatgt

SEQ ID NO: 61625 - DNA, 25 bp, Homo sapien
cagctttcccagagatgtcagcatc

SEQ ID NO: 61626 - DNA, 25 bp, Homo sapien
ctctacctgagtcctttcgcgcggg

SEQ ID NO: 61627 - DNA, 25 bp, Homo sapien
tccgggtgcccgaacactgcctcat

SEQ ID NO: 61628 - DNA, 25 bp, Homo sapien
ccgcgaacttagtcggcctcgcctc

SEQ ID NO: 61629 - DNA, 25 bp, Homo sapien
tcccctagttatggcctccgagctt

SEQ ID NO: 61630 - DNA, 25 bp, Homo sapien
cagactctcggtctgtccgctgggg

SEQ ID NO: 61631 - DNA, 25 bp, Homo sapien
tcttcttccagactctcggtctgtc

SEQ ID NO: 61632 - DNA, 25 bp, Homo sapien
tgcgcgagtcaggtgacgacccgcc

SEQ ID NO: 61633 - DNA, 25 bp, Homo sapien
cggatcccaccgcactgaagggact

SEQ ID NO: 61634 - DNA, 25 bp, Homo sapien
ccgcgctcagagagacagggagcta

SEQ ID NO: 61635 - DNA, 25 bp, Homo sapien
gcagctagcgggctctaattacccg

SEQ ID NO: 61636 - DNA, 25 bp, Homo sapien
gagcagcagcctcagacacgaaatg

SEQ ID NO: 61637 - DNA, 25 bp, Homo sapien
aagccgctgatttgctcggcgctca

SEQ ID NO: 61638 - DNA, 25 bp, Homo sapien
gccggcacaagaggcggctctcttt

SEQ ID NO: 61639 - DNA, 25 bp, Homo sapien
cactgaggctcgaccacggaaggtc

SEQ ID NO: 61640 - DNA, 25 bp, Homo sapien
ccctgcagttttctagggcgcactg

SEQ ID NO: 61641 - DNA, 25 bp, Homo sapien
accgagtcacgctcatgcagatgtc

SEQ ID NO: 61642 - DNA, 25 bp, Homo sapien
ttcagctgttcgttcaaggctatgc

SEQ ID NO: 61643 - DNA, 25 bp, Homo sapien
tccacgtctaggacagctgcgcttc

SEQ ID NO: 61644 - DNA, 25 bp, Homo sapien
cggcaacggagcttagaggagattc

SEQ ID NO: 61645 - DNA, 25 bp, Homo sapien
ggactcagcactcgacccaaaggtg

SEQ ID NO: 61646 - DNA, 25 bp, Homo sapien
gcccagagttcagaccaagcgaaaa

SEQ ID NO: 61647 - DNA, 25 bp, Homo sapien
cgctccgaactgactccgggatcaa

SEQ ID NO: 61648 - DNA, 25 bp, Homo sapien
tcccgatttcgaaagaatctcgctg

SEQ ID NO: 61649 - DNA, 25 bp, Homo sapien
aaggctatgccctgcaactgcacca

SEQ ID NO: 61650 - DNA, 25 bp, Homo sapien
cccttcttcaaggagaggctgacga

SEQ ID NO: 61651 - DNA, 25 bp, Homo sapien
ggcggtcacgatgctgccgccctta

SEQ ID NO: 61652 - DNA, 25 bp, Homo sapien
gagctccgcaggagacacaggcgct

SEQ ID NO: 61653 - DNA, 25 bp, Homo sapien
ggctctgatttcttctcccgagcga

SEQ ID NO: 61654 - DNA, 25 bp, Homo sapien
agtcaacaaacctgtcaaacgtctc

SEQ ID NO: 61655 - DNA, 25 bp, Homo sapien
agtttgacaaccctcgccgaagcac

SEQ ID NO: 61656 - DNA, 25 bp, Homo sapien
ggcatgaggcatcgaacagggacac

SEQ ID NO: 61657 - DNA, 25 bp, Homo sapien
cctgtcgggcggtccagtttgacaa

SEQ ID NO: 61658 - DNA, 25 bp, Homo sapien
gattgcacctgtctgcattcacaga

SEQ ID NO: 61659 - DNA, 25 bp, Homo sapien
ttcacagacattcgggagacggcct

SEQ ID NO: 61660 - DNA, 25 bp, Homo sapien
gagacggccttcgtgttcgccatca

SEQ ID NO: 61661 - DNA, 25 bp, Homo sapien
ttcgtgttcgccatcactgcggccg

SEQ ID NO: 61662 - DNA, 25 bp, Homo sapien
gggacgagaagtcgaggctctttat

SEQ ID NO: 61663 - DNA, 25 bp, Homo sapien
ggctctttatggacgcgcggcacaa

SEQ ID NO: 61664 - DNA, 25 bp, Homo sapien
atccgcgcgttggtgcaactgcaca

SEQ ID NO: 61665 - DNA, 25 bp, Homo sapien
cacaagcggggacgcggagacatcc

SEQ ID NO: 61666 - DNA, 25 bp, Homo sapien
cagaagctgcctccatttcgcgagg

SEQ ID NO: 61667 - DNA, 25 bp, Homo sapien
tcgaagagaactgcctgtgccgctt

SEQ ID NO: 61668 - DNA, 25 bp, Homo sapien
ccgagtgcaaatgccacgggctgtc

SEQ ID NO: 61669 - DNA, 25 bp, Homo sapien
ggccgctagactgacttcgcgcagc

SEQ ID NO: 61670 - DNA, 25 bp, Homo sapien
gcttgagaggaacgcccacccacga

SEQ ID NO: 61671 - DNA, 25 bp, Homo sapien
ctggtgctgcgtagtacagtgccac

SEQ ID NO: 61672 - DNA, 25 bp, Homo sapien
actcccagggctctggaaatggtga

SEQ ID NO: 61673 - DNA, 25 bp, Homo sapien
cgcgtcatgggcaccaacgacggca

SEQ ID NO: 61674 - DNA, 25 bp, Homo sapien
atcttcctgtgcacgcgcgcacaga

SEQ ID NO: 61675 - DNA, 25 bp, Homo sapien
gtggcctcgggactcgtacacgcct

SEQ ID NO: 61676 - DNA, 25 bp, Homo sapien
gggtagagccctgagacactaaatg

SEQ ID NO: 61677 - DNA, 25 bp, Homo sapien
cgagccgggacagtcacttactcta

SEQ ID NO: 61678 - DNA, 25 bp, Homo sapien
cacttactctacaggcagtggggcc

SEQ ID NO: 61679 - DNA, 25 bp, Homo sapien
acccttgagaggcaccgggagttgt

SEQ ID NO: 61680 - DNA, 25 bp, Homo sapien
gccctgacccgagtcggagctgtgt

SEQ ID NO: 61681 - DNA, 25 bp, Homo sapien
tcggagctgtgtgtcgcagccgccc

SEQ ID NO: 61682 - DNA, 25 bp, Homo sapien
cctggctttggtttctgcccgccgg

SEQ ID NO: 61683 - DNA, 25 bp, Homo sapien
cgggcgctgtttctacccggccgag

SEQ ID NO: 61684 - DNA, 25 bp, Homo sapien
tggcggcatgcagccgcgaactaat

SEQ ID NO: 61685 - DNA, 25 bp, Homo sapien
cgacacgaacggacgggcctctgca

SEQ ID NO: 61686 - DNA, 25 bp, Homo sapien
atgaggactccgtagccctggcttt

SEQ ID NO: 61687 - DNA, 25 bp, Homo sapien
ggaggttctcacttctgccgcttcg

SEQ ID NO: 61688 - DNA, 25 bp, Homo sapien
gataggcgcggaggttctcacttct

SEQ ID NO: 61689 - DNA, 25 bp, Homo sapien
ggacgggcctctgcaccattcatgc

SEQ ID NO: 61690 - DNA, 25 bp, Homo sapien
tccttccagcggagatccttccgga

SEQ ID NO: 61691 - DNA, 25 bp, Homo sapien
gacgggctgagggacctcccttcca

SEQ ID NO: 61692 - DNA, 25 bp, Homo sapien
atgcaagcgacaacggagcccggtc

SEQ ID NO: 61693 - DNA, 25 bp, Homo sapien
tccggactcgcaaaacatgcaagcg

SEQ ID NO: 61694 - DNA, 25 bp, Homo sapien
gatccttccggactcgcaaaacatg

SEQ ID NO: 61695 - DNA, 25 bp, Homo sapien
gcgaccaccgggagatcacgaaagg

SEQ ID NO: 61696 - DNA, 25 bp, Homo sapien
atcacgaaaggtaccgcgggcctcg

SEQ ID NO: 61697 - DNA, 25 bp, Homo sapien
ggcctcagcgaccaccgggagatca

SEQ ID NO: 61698 - DNA, 25 bp, Homo sapien
cgccgacctggtctacttcgaaaag

SEQ ID NO: 61699 - DNA, 25 bp, Homo sapien
ccgcatcaccgagtgggtcagcgtc

SEQ ID NO: 61700 - DNA, 25 bp, Homo sapien
tggtctgcgaagagtgccgcatcac

SEQ ID NO: 61701 - DNA, 25 bp, Homo sapien
ccactggtgctgtttcgtggtctgc

SEQ ID NO: 61702 - DNA, 25 bp, Homo sapien
agtctcccgacttctgcgagcgcga

SEQ ID NO: 61703 - DNA, 25 bp, Homo sapien
ggcagctgccagctcaagacgtgct

SEQ ID NO: 61704 - DNA, 25 bp, Homo sapien
aacatgcggcggaagtgcaagtgcc

SEQ ID NO: 61705 - DNA, 25 bp, Homo sapien
ctgtgcaacaagagcagcgccggct

SEQ ID NO: 61706 - DNA, 25 bp, Homo sapien
cggcgcatcagctttcgggccttgg

SEQ ID NO: 61707 - DNA, 25 bp, Homo sapien
caccgcgaactgctgaggacacagc

SEQ ID NO: 61708 - DNA, 25 bp, Homo sapien
tccagctgtctacatctggccagca

SEQ ID NO: 61709 - DNA, 25 bp, Homo sapien
gctgccctttgacttgggaaccacc

SEQ ID NO: 61710 - DNA, 25 bp, Homo sapien
aatccgacttcacgggcccattgct

SEQ ID NO: 61711 - DNA, 25 bp, Homo sapien
tcgcacggcgcccaaatccgacttc

SEQ ID NO: 61712 - DNA, 25 bp, Homo sapien
catccgctgccctttgacttgggaa

SEQ ID NO: 61713 - DNA, 25 bp, Homo sapien
gtctcgggttcaactcatccgctgc

SEQ ID NO: 61714 - DNA, 25 bp, Homo sapien
tcaaccaacacgtaggcgaggatgc

SEQ ID NO: 61715 - DNA, 25 bp, Homo sapien
ctatcgcgagatcggtgggacctac

SEQ ID NO: 61716 - DNA, 25 bp, Homo sapien
gtgcgcagcacaacacgaccgtggg

SEQ ID NO: 61717 - DNA, 25 bp, Homo sapien
agagtccagtcgatgctgccacgtg

SEQ ID NO: 61718 - DNA, 25 bp, Homo sapien
agccggtggccttaagagtccagtc

SEQ ID NO: 61719 - DNA, 25 bp, Homo sapien
cagtttcatctttgggaagctaccc

SEQ ID NO: 61720 - DNA, 25 bp, Homo sapien
gcctagcctctcgataggaaccttc

SEQ ID NO: 61721 - DNA, 25 bp, Homo sapien
tttgaaacctgagacggagacctgc

SEQ ID NO: 61722 - DNA, 25 bp, Homo sapien
gtccgtgagaaagttcccagccgga

SEQ ID NO: 61723 - DNA, 25 bp, Homo sapien
ccagccggactagcgccgaggatac

SEQ ID NO: 61724 - DNA, 25 bp, Homo sapien
tggtccaacaccatggtcccgacgg

SEQ ID NO: 61725 - DNA, 25 bp, Homo sapien
atccgttccgcagtagggtgcggaa

SEQ ID NO: 61726 - DNA, 25 bp, Homo sapien
ggagacttcctaatcccgccgccgc

SEQ ID NO: 61727 - DNA, 25 bp, Homo sapien
gcaagagtccgtgagaaagttccca

SEQ ID NO: 61728 - DNA, 25 bp, Homo sapien
cttccgggaagccacccatcagccg

SEQ ID NO: 61729 - DNA, 25 bp, Homo sapien
cccgcaaggcggcaagagtccgtga

SEQ ID NO: 61730 - DNA, 25 bp, Homo sapien
gccgacgctgctatcgcctcaagga

SEQ ID NO: 61731 - DNA, 25 bp, Homo sapien
gaaggtgacacccaagccggcatcc

SEQ ID NO: 61732 - DNA, 25 bp, Homo sapien
gccgcgtccgccaagaagaagaaag

SEQ ID NO: 61733 - DNA, 25 bp, Homo sapien
tcatctcggcgctcacctggaagcg

SEQ ID NO: 61734 - DNA, 25 bp, Homo sapien
ggcacagtgctgtctctttcgcctg

SEQ ID NO: 61735 - DNA, 25 bp, Homo sapien
cattacgcctgcaaacctggtgttc

SEQ ID NO: 61736 - DNA, 25 bp, Homo sapien
ctggcaagaccaggccttcattacg

SEQ ID NO: 61737 - DNA, 25 bp, Homo sapien
ctggtccagcaacgcaaccgcgaga

SEQ ID NO: 61738 - DNA, 25 bp, Homo sapien
ccattggctggaatttggcgcagtc

SEQ ID NO: 61739 - DNA, 25 bp, Homo sapien
ggctgtcgccatagtaaccagactg

SEQ ID NO: 61740 - DNA, 25 bp, Homo sapien
ggcctcaactaggtcttccggataa

SEQ ID NO: 61741 - DNA, 25 bp, Homo sapien
tgtcatctattctggcggcgagtta

SEQ ID NO: 61742 - DNA, 25 bp, Homo sapien
cggcgagttatagaagtctggctcc

SEQ ID NO: 61743 - DNA, 25 bp, Homo sapien
tccagatttgtgaattgagttcccg

SEQ ID NO: 61744 - DNA, 25 bp, Homo sapien
cggtgccgtcatctctcttggtttg

SEQ ID NO: 61745 - DNA, 25 bp, Homo sapien
cctcccgggacgacaggactcgatt

SEQ ID NO: 61746 - DNA, 25 bp, Homo sapien
gcaccttgctcatgatgttcttgtc

SEQ ID NO: 61747 - DNA, 25 bp, Homo sapien
tccgggtccgtgagcttgaactcgc

SEQ ID NO: 61748 - DNA, 25 bp, Homo sapien
ccaggccctggaagtcgaagcggta

SEQ ID NO: 61749 - DNA, 25 bp, Homo sapien
tgagcttgaactcgccgtgaccgcc

SEQ ID NO: 61750 - DNA, 25 bp, Homo sapien
cgtagcgcttgccatgcaccttgct

SEQ ID NO: 61751 - DNA, 25 bp, Homo sapien
acagctggatctgtccgctgcctgt

SEQ ID NO: 61752 - DNA, 25 bp, Homo sapien
tgcaagtcaaactgcagctgcgttc

SEQ ID NO: 61753 - DNA, 25 bp, Homo sapien
ggcagcttgtagagcgcgccgtcct

SEQ ID NO: 61754 - DNA, 25 bp, Homo sapien
agagctctctatctgcctttaggtc

SEQ ID NO: 61755 - DNA, 25 bp, Homo sapien
gcaataaagtctccaacgcgccgcg

SEQ ID NO: 61756 - DNA, 25 bp, Homo sapien
cgttttaattaaagcgctgccgcct

SEQ ID NO: 61757 - DNA, 25 bp, Homo sapien
cctggcaggtacatgttgatcagca

SEQ ID NO: 61758 - DNA, 25 bp, Homo sapien
acagagtactccaccacgccagaga

SEQ ID NO: 61759 - DNA, 25 bp, Homo sapien
acagccttctggtacggctcggcca

SEQ ID NO: 61760 - DNA, 25 bp, Homo sapien
gggccggctggagccttataaagcc

SEQ ID NO: 61761 - DNA, 25 bp, Homo sapien
agaaacgcttccagctaaggggccg

SEQ ID NO: 61762 - DNA, 25 bp, Homo sapien
cccaacctgggtagcggatgaagaa

SEQ ID NO: 61763 - DNA, 25 bp, Homo sapien
ccgagctttatacctgggccttgtc

SEQ ID NO: 61764 - DNA, 25 bp, Homo sapien
cccgcgggaaagacaacagaaagtg

SEQ ID NO: 61765 - DNA, 25 bp, Homo sapien
gctgactccgcgctttctttctttc

SEQ ID NO: 61766 - DNA, 25 bp, Homo sapien
ttcccagagtctaatcgccagcctt

SEQ ID NO: 61767 - DNA, 25 bp, Homo sapien
caggcctctcttttgggcgatgcta

SEQ ID NO: 61768 - DNA, 25 bp, Homo sapien
ggctctgcccaaaggattcgcttca

SEQ ID NO: 61769 - DNA, 25 bp, Homo sapien
gaagtcctcctcgtcccagagcgtg

SEQ ID NO: 61770 - DNA, 25 bp, Homo sapien
tcccacggcggcattctgcaggagt

SEQ ID NO: 61771 - DNA, 25 bp, Homo sapien
tgcgtcgcgccttttccagggttag

SEQ ID NO: 61772 - DNA, 25 bp, Homo sapien
gtccctgacgcggacgccaagtgtt

SEQ ID NO: 61773 - DNA, 25 bp, Homo sapien
acgcggacgccaagtgttggtcaga

SEQ ID NO: 61774 - DNA, 25 bp, Homo sapien
tgtctgtcggagactggacactgtg

SEQ ID NO: 61775 - DNA, 25 bp, Homo sapien
agactggacactgtgcaccgagcgg

SEQ ID NO: 61776 - DNA, 25 bp, Homo sapien
acgcgtgggtcccacggcggcattc

SEQ ID NO: 61777 - DNA, 25 bp, Homo sapien
acgtactctcgagggtcgggctcca

SEQ ID NO: 61778 - DNA, 25 bp, Homo sapien
cgcccgtttgctcggggcaaatatt

SEQ ID NO: 61779 - DNA, 25 bp, Homo sapien
cctcgtctgaggactgattcacagt

SEQ ID NO: 61780 - DNA, 25 bp, Homo sapien
gctccgtgtgctcttatactgcctg

SEQ ID NO: 61781 - DNA, 25 bp, Homo sapien
gattcacagtgggagtcgcttagca

SEQ ID NO: 61782 - DNA, 25 bp, Homo sapien
ggcgcctctggaacaacaccagatg

SEQ ID NO: 61783 - DNA, 25 bp, Homo sapien
tggcccgaaatccagtggtgacctc

SEQ ID NO: 61784 - DNA, 25 bp, Homo sapien
actcagttactgtgcaccaaggtgc

SEQ ID NO: 61785 - DNA, 25 bp, Homo sapien
caggtctcagtccagctgcagtgtg

SEQ ID NO: 61786 - DNA, 25 bp, Homo sapien
tagcagcccgggtactcatccagat

SEQ ID NO: 61787 - DNA, 25 bp, Homo sapien
catcgccgactgctttggggtaaca

SEQ ID NO: 61788 - DNA, 25 bp, Homo sapien
agactgcacaaactaccgcgggctc

SEQ ID NO: 61789 - DNA, 25 bp, Homo sapien
agcgctgaccgcaccaagttaaatg

SEQ ID NO: 61790 - DNA, 25 bp, Homo sapien
caatcttttgttggcagcgctgacc

SEQ ID NO: 61791 - DNA, 25 bp, Homo sapien
gggcttctaactctttctccacgca

SEQ ID NO: 61792 - DNA, 25 bp, Homo sapien
gccgcaactctgtgcccagcttttg

SEQ ID NO: 61793 - DNA, 25 bp, Homo sapien
tctggctgcattcggaggaagacct

SEQ ID NO: 61794 - DNA, 25 bp, Homo sapien
gctcagaacttacatcgcctccata

SEQ ID NO: 61795 - DNA, 25 bp, Homo sapien
ggcagcccgagtaagtcaagattcg

SEQ ID NO: 61796 - DNA, 25 bp, Homo sapien
gcgtcttcagatatcccagggcaac

SEQ ID NO: 61797 - DNA, 25 bp, Homo sapien
acgcgcaggaaacggcgtcttcaga

SEQ ID NO: 61798 - DNA, 25 bp, Homo sapien
ctccatattgccgtctccatagata

SEQ ID NO: 61799 - DNA, 25 bp, Homo sapien
ccttgggactaacgctcagaactta

SEQ ID NO: 61800 - DNA, 25 bp, Homo sapien
tccctgagaccctgggaccttggga

SEQ ID NO: 61801 - DNA, 25 bp, Homo sapien
tctccatagatacaggacgcgcagg

SEQ ID NO: 61802 - DNA, 25 bp, Homo sapien
accagcacgtactggccaggctgca

SEQ ID NO: 61803 - DNA, 25 bp, Homo sapien
agcacatcgctgaaggtggggctcc

SEQ ID NO: 61804 - DNA, 25 bp, Homo sapien
cgcggtccaggaaaatgagcacatc

SEQ ID NO: 61805 - DNA, 25 bp, Homo sapien
ctctcagcctgtgaggctcgcggtc

SEQ ID NO: 61806 - DNA, 25 bp, Homo sapien
agtctcgatgacctggaaggctctc

SEQ ID NO: 61807 - DNA, 25 bp, Homo sapien
ctgcacgtggctggcaaatgtggcc

SEQ ID NO: 61808 - DNA, 25 bp, Homo sapien
cacgtgtgtagagacagctgccacg

SEQ ID NO: 61809 - DNA, 25 bp, Homo sapien
gctccgtgtgattgtcagccgtaaa

SEQ ID NO: 61810 - DNA, 25 bp, Homo sapien
accagcctagggttgtgagcgccaa

SEQ ID NO: 61811 - DNA, 25 bp, Homo sapien
ctcgcctggtccaaacaaagttccg

SEQ ID NO: 61812 - DNA, 25 bp, Homo sapien
tgcaaaggcgcacggatttccaaga

SEQ ID NO: 61813 - DNA, 25 bp, Homo sapien
agtacggtcccgactgctaggctgt

SEQ ID NO: 61814 - DNA, 25 bp, Homo sapien
ctcgggagacgcgaccgaaacttgc

SEQ ID NO: 61815 - DNA, 25 bp, Homo sapien
tccgcggcatcaaggcagtcattta

SEQ ID NO: 61816 - DNA, 25 bp, Homo sapien
ccattgtttcccttccaagaggatc

SEQ ID NO: 61817 - DNA, 25 bp, Homo sapien
ggcagtcatttaaaggcacgaagtt

SEQ ID NO: 61818 - DNA, 25 bp, Homo sapien
acactcggcgcaggctgtcgctgag

SEQ ID NO: 61819 - DNA, 25 bp, Homo sapien
agccggccggcagcgagatacccag

SEQ ID NO: 61820 - DNA, 25 bp, Homo sapien
tcgctgagcccggaattctgcaccg

SEQ ID NO: 61821 - DNA, 25 bp, Homo sapien
agcgagatacccagaggcccgtttt

SEQ ID NO: 61822 - DNA, 25 bp, Homo sapien
tttttccaccgcgttgccatagcaa

SEQ ID NO: 61823 - DNA, 25 bp, Homo sapien
gactccagggaccactcaccgcggc

SEQ ID NO: 61824 - DNA, 25 bp, Homo sapien
gtctccgacaggtgcgcacactcgg

SEQ ID NO: 61825 - DNA, 25 bp, Homo sapien
cccgcagagcaaccgcagggcagtg

SEQ ID NO: 61826 - DNA, 25 bp, Homo sapien
gcacgtgggcctttgactcgtaata

SEQ ID NO: 61827 - DNA, 25 bp, Homo sapien
tgaagtgctccctccctagcataca

SEQ ID NO: 61828 - DNA, 25 bp, Homo sapien
gcgcgccagcagtccatacttattg

SEQ ID NO: 61829 - DNA, 25 bp, Homo sapien
catcaccgagatagccagcgagttc

SEQ ID NO: 61830 - DNA, 25 bp, Homo sapien
cgcacggcggtatcacaaatctgga

SEQ ID NO: 61831 - DNA, 25 bp, Homo sapien
tgctgtcttcagctccgggtatcca

SEQ ID NO: 61832 - DNA, 25 bp, Homo sapien
gggtatccatccctccacagacagg

SEQ ID NO: 61833 - DNA, 25 bp, Homo sapien
ccgcgcggccctcataatgcaggga

SEQ ID NO: 61834 - DNA, 25 bp, Homo sapien
cgtggcccggatccttatctgcatt

SEQ ID NO: 61835 - DNA, 25 bp, Homo sapien
gcttgctccttcgtagaccctgccg

SEQ ID NO: 61836 - DNA, 25 bp, Homo sapien
gaccctgccgtcaggcttctagccc

SEQ ID NO: 61837 - DNA, 25 bp, Homo sapien
ggcgtgcgctgtcaatgattgccca

SEQ ID NO: 61838 - DNA, 25 bp, Homo sapien
ctgtcaatgattgcccagcccgtgg

SEQ ID NO: 61839 - DNA, 25 bp, Homo sapien
ggcccggatccttatctgcattcct

SEQ ID NO: 61840 - DNA, 25 bp, Homo sapien
tatctgcattcctcggcgcccggcc

SEQ ID NO: 61841 - DNA, 25 bp, Homo sapien
gatccttatctgcattcctcggcgc

SEQ ID NO: 61842 - DNA, 25 bp, Homo sapien
gcacattggggctgaactgcttgta

SEQ ID NO: 61843 - DNA, 25 bp, Homo sapien
atcttgccttcatagcgtccgctgg

SEQ ID NO: 61844 - DNA, 25 bp, Homo sapien
ctgaactgcttgtaggcgagcggca

SEQ ID NO: 61845 - DNA, 25 bp, Homo sapien
gcagcagcaacaggaccaggcagaa

SEQ ID NO: 61846 - DNA, 25 bp, Homo sapien
tcgccggccgccaataaataggccg

SEQ ID NO: 61847 - DNA, 25 bp, Homo sapien
tcctgtgcgctcgacagcgaacctg

SEQ ID NO: 61848 - DNA, 25 bp, Homo sapien
cgacagcgaacctgcagcaagggca

SEQ ID NO: 61849 - DNA, 25 bp, Homo sapien
caggcgcaaacctcccggacaggag

SEQ ID NO: 61850 - DNA, 25 bp, Homo sapien
cacattaacgagattcacgggttta

SEQ ID NO: 61851 - DNA, 25 bp, Homo sapien
cacgggtttatttctcttgagtgga

SEQ ID NO: 61852 - DNA, 25 bp, Homo sapien
tgagaacctttatctgcaccgagtc

SEQ ID NO: 61853 - DNA, 25 bp, Homo sapien
gcgcggcttcaaggggcaacaaagc

SEQ ID NO: 61854 - DNA, 25 bp, Homo sapien
cagcggcttcgtcgcaccaaacagg

SEQ ID NO: 61855 - DNA, 25 bp, Homo sapien
aggcgaccaacgagtaccttcactc

SEQ ID NO: 61856 - DNA, 25 bp, Homo sapien
cgttctgcgtccgaagcttctacac

SEQ ID NO: 61857 - DNA, 25 bp, Homo sapien
aggctgcctctaacattcacattaa

SEQ ID NO: 61858 - DNA, 25 bp, Homo sapien
gccaggcgtagcaatggagaagtta

SEQ ID NO: 61859 - DNA, 25 bp, Homo sapien
agccgccctgcctactgtgggataa

SEQ ID NO: 61860 - DNA, 25 bp, Homo sapien
ccctaccggggatactgggaatctg

SEQ ID NO: 61861 - DNA, 25 bp, Homo sapien
cgaatgtaaggcctcaaaacgtgtc

SEQ ID NO: 61862 - DNA, 25 bp, Homo sapien
aactcctggtctcacggaacgtggc

SEQ ID NO: 61863 - DNA, 25 bp, Homo sapien
cacgccgcactgaggatgaacaagc

SEQ ID NO: 61864 - DNA, 25 bp, Homo sapien
gcctctgagaaatggggacaattcg

SEQ ID NO: 61865 - DNA, 25 bp, Homo sapien
gtgtcaacacgtccacccaaaagta

SEQ ID NO: 61866 - DNA, 25 bp, Homo sapien
gcctcgggacagtcttccgactcag

SEQ ID NO: 61867 - DNA, 25 bp, Homo sapien
gacctcggcgctcactgttcggagc

SEQ ID NO: 61868 - DNA, 25 bp, Homo sapien
cttggcgatggagtttccggacctc

SEQ ID NO: 61869 - DNA, 25 bp, Homo sapien
agcactcgtcgcttctcctagcaga

SEQ ID NO: 61870 - DNA, 25 bp, Homo sapien
gagccctaaagacgctcagcactcg

SEQ ID NO: 61871 - DNA, 25 bp, Homo sapien
tgcggacttcgagcacgagccctaa

SEQ ID NO: 61872 - DNA, 25 bp, Homo sapien
ctcactgttcggagccgagctgtca

SEQ ID NO: 61873 - DNA, 25 bp, Homo sapien
tccgactcagccttctagagcaagg

SEQ ID NO: 61874 - DNA, 25 bp, Homo sapien
ctccagcacggaggccagaagtaga

SEQ ID NO: 61875 - DNA, 25 bp, Homo sapien
tggtgcaggcaacgaatgcaaatta

SEQ ID NO: 61876 - DNA, 25 bp, Homo sapien
acagcgaatcagcaccagcgggccg

SEQ ID NO: 61877 - DNA, 25 bp, Homo sapien
gcctcgcagtagttgcccacagtca

SEQ ID NO: 61878 - DNA, 25 bp, Homo sapien
tcccattggccaaatgtctccgagg

SEQ ID NO: 61879 - DNA, 25 bp, Homo sapien
ccgagctggaaacctccacggaatc

SEQ ID NO: 61880 - DNA, 25 bp, Homo sapien
tggaaacagacctcacggaatcctg

SEQ ID NO: 61881 - DNA, 25 bp, Homo sapien
ccacgggaatgctcggtgttggact

SEQ ID NO: 61882 - DNA, 25 bp, Homo sapien
cctgggattccaataaccggtctca

SEQ ID NO: 61883 - DNA, 25 bp, Homo sapien
gcggcccaatagtgtgctctacgtg

SEQ ID NO: 61884 - DNA, 25 bp, Homo sapien
gtcttggacagtcagcggcccaata

SEQ ID NO: 61885 - DNA, 25 bp, Homo sapien
ccaattctcggcttcagggacggga

SEQ ID NO: 61886 - DNA, 25 bp, Homo sapien
gggcggagacacaacggccaattct

SEQ ID NO: 61887 - DNA, 25 bp, Homo sapien
ggtctcacgtcttacctcaggaaca

SEQ ID NO: 61888 - DNA, 25 bp, Homo sapien
atccggcaatcgacctgaggacttg

SEQ ID NO: 61889 - DNA, 25 bp, Homo sapien
gcgcgcgccagcaatcaaaacattc

SEQ ID NO: 61890 - DNA, 25 bp, Homo sapien
gggttgcctacttcttctcggatga

SEQ ID NO: 61891 - DNA, 25 bp, Homo sapien
ttgctcccagctcactggccttagg

SEQ ID NO: 61892 - DNA, 25 bp, Homo sapien
ggactctgacggtgtctctgcctct

SEQ ID NO: 61893 - DNA, 25 bp, Homo sapien
aactacagcgagttgcccacagggg

SEQ ID NO: 61894 - DNA, 25 bp, Homo sapien
tggtcctcaacgagactcagttttc

SEQ ID NO: 61895 - DNA, 25 bp, Homo sapien
ctttcggggccaggaatgcatcttt

SEQ ID NO: 61896 - DNA, 25 bp, Homo sapien
ttttccaaagtgagcggtggccctc

SEQ ID NO: 61897 - DNA, 25 bp, Homo sapien
ttgatgggcaaccaactggaccgca

SEQ ID NO: 61898 - DNA, 25 bp, Homo sapien
cccgtctaggagaaaccggtcatga

SEQ ID NO: 61899 - DNA, 25 bp, Homo sapien
tcgcatcttcaaaagccggtcggcc

SEQ ID NO: 61900 - DNA, 25 bp, Homo sapien
caggctggttcaccgtctcatctta

SEQ ID NO: 61901 - DNA, 25 bp, Homo sapien
tacagcgctcctctagtctgagacg

SEQ ID NO: 61902 - DNA, 25 bp, Homo sapien
cttcttgggagccatggcgtttaca

SEQ ID NO: 61903 - DNA, 25 bp, Homo sapien
acgaacgaccgagtgtctgcctata

SEQ ID NO: 61904 - DNA, 25 bp, Homo sapien
cccgaaagtagtgcaggctgccaga

SEQ ID NO: 61905 - DNA, 25 bp, Homo sapien
tgcgagcacttcttacaactgtatg

SEQ ID NO: 61906 - DNA, 25 bp, Homo sapien
tcctttttcgtctgggctgccaaca

SEQ ID NO: 61907 - DNA, 25 bp, Homo sapien
cgagacttggcgaaggccttccttt

SEQ ID NO: 61908 - DNA, 25 bp, Homo sapien
ggcggcgtgcagtacagcacaccta

SEQ ID NO: 61909 - DNA, 25 bp, Homo sapien
ggttccctgaccaaggcgccagaaa

SEQ ID NO: 61910 - DNA, 25 bp, Homo sapien
ctcagacaacgaggcccttagggtc

SEQ ID NO: 61911 - DNA, 25 bp, Homo sapien
cccgggcagaccactaagaactgtg

SEQ ID NO: 61912 - DNA, 25 bp, Homo sapien
agccgcccgagcttcaggaaaccga

SEQ ID NO: 61913 - DNA, 25 bp, Homo sapien
ccgggagacaaaccagtagccacta

SEQ ID NO: 61914 - DNA, 25 bp, Homo sapien
ccgaaggccaagtagagaaccctca

SEQ ID NO: 61915 - DNA, 25 bp, Homo sapien
atgcccagcggttgctgagataccg

SEQ ID NO: 61916 - DNA, 25 bp, Homo sapien
ctatgctctgcttttgcggcgcgat

SEQ ID NO: 61917 - DNA, 25 bp, Homo sapien
ggactgatgatgtcagcactgcttc

SEQ ID NO: 61918 - DNA, 25 bp, Homo sapien
tctggcccgagccaggtcagtccgg

SEQ ID NO: 61919 - DNA, 25 bp, Homo sapien
cagtccggcagtgcagatggcccat

SEQ ID NO: 61920 - DNA, 25 bp, Homo sapien
gcacgtcctctgaaactacgctatg

SEQ ID NO: 61921 - DNA, 25 bp, Homo sapien
tcctgaggccgtaaggcgcctgacc

SEQ ID NO: 61922 - DNA, 25 bp, Homo sapien
ccggtcatccaggtgttctgactta

SEQ ID NO: 61923 - DNA, 25 bp, Homo sapien
gtcgggacacaaatgctcgtaaggc

SEQ ID NO: 61924 - DNA, 25 bp, Homo sapien
cgcgattcgggctttaaccattctt

SEQ ID NO: 61925 - DNA, 25 bp, Homo sapien
gggcccgcgtgactctcatacagag

SEQ ID NO: 61926 - DNA, 25 bp, Homo sapien
aagggttcctctctgttactgaaga

SEQ ID NO: 61927 - DNA, 25 bp, Homo sapien
aggtgaactatacggctcggccaaa

SEQ ID NO: 61928 - DNA, 25 bp, Homo sapien
cccgagcatgcctggaagaagtgtc

SEQ ID NO: 61929 - DNA, 25 bp, Homo sapien
ccgctgggattaagagtcgcgattc

SEQ ID NO: 61930 - DNA, 25 bp, Homo sapien
gttgccatggcatcctactacgaga

SEQ ID NO: 61931 - DNA, 25 bp, Homo sapien
gtctctagtagtttccgcaccgctg

SEQ ID NO: 61932 - DNA, 25 bp, Homo sapien
gtcgtcctggtgtgtgcccaaaata

SEQ ID NO: 61933 - DNA, 25 bp, Homo sapien
tgcgagcgcttctcgcttggatgga

SEQ ID NO: 61934 - DNA, 25 bp, Homo sapien
cgagatcctagacgtgccgcgaagt

SEQ ID NO: 61935 - DNA, 25 bp, Homo sapien
gggctcttggttctttccgcctgac

SEQ ID NO: 61936 - DNA, 25 bp, Homo sapien
gcctgacgactgaccagttgccatg

SEQ ID NO: 61937 - DNA, 25 bp, Homo sapien
agtgcgtccgctgatgacatcaaga

SEQ ID NO: 61938 - DNA, 25 bp, Homo sapien
gcaccagaaagtcctcgcaccagat

SEQ ID NO: 61939 - DNA, 25 bp, Homo sapien
tgggtctgcacgttcttcaggtaga

SEQ ID NO: 61940 - DNA, 25 bp, Homo sapien
ggccagaagtcagaggccgaggctc

SEQ ID NO: 61941 - DNA, 25 bp, Homo sapien
cccgcccatgcggtccctccaggcg

SEQ ID NO: 61942 - DNA, 25 bp, Homo sapien
ctcgcgaccttctcggtctctccaa

SEQ ID NO: 61943 - DNA, 25 bp, Homo sapien
tgcgcgcgctctcctcgcgaccttc

SEQ ID NO: 61944 - DNA, 25 bp, Homo sapien
cctctgccggccagctgaggaagtg

SEQ ID NO: 61945 - DNA, 25 bp, Homo sapien
gcaccagatgtgctccgacaccagg

SEQ ID NO: 61946 - DNA, 25 bp, Homo sapien
ttgtattctgccaacccacagcgtc

SEQ ID NO: 61947 - DNA, 25 bp, Homo sapien
acccacagcgtcacaggaagtactc

SEQ ID NO: 61948 - DNA, 25 bp, Homo sapien
cttggaggcggttaccagagaggaa

SEQ ID NO: 61949 - DNA, 25 bp, Homo sapien
aaggggtcacagagcgaggactctc

SEQ ID NO: 61950 - DNA, 25 bp, Homo sapien
gagcgaggactctccactagacctg

SEQ ID NO: 61951 - DNA, 25 bp, Homo sapien
cactagacctgagccctctgttgta

SEQ ID NO: 61952 - DNA, 25 bp, Homo sapien
cacaggaagtactctgcctctcggg

SEQ ID NO: 61953 - DNA, 25 bp, Homo sapien
tgagccctctgttgtattctgccaa

SEQ ID NO: 61954 - DNA, 25 bp, Homo sapien
cctctcgctgcaacgcggccaaccg

SEQ ID NO: 61955 - DNA, 25 bp, Homo sapien
tttgcgtcacatatggcgtaagagc

SEQ ID NO: 61956 - DNA, 25 bp, Homo sapien
gctaatttgcgtcacatatggcgta

SEQ ID NO: 61957 - DNA, 25 bp, Homo sapien
aggcgggtgctgacgacacctccac

SEQ ID NO: 61958 - DNA, 25 bp, Homo sapien
gaccgtgggcactaacggcgctgca

SEQ ID NO: 61959 - DNA, 25 bp, Homo sapien
cccgccagcccaagtttcctcctga

SEQ ID NO: 61960 - DNA, 25 bp, Homo sapien
cccggctcgtaagctaatttgcgtc

SEQ ID NO: 61961 - DNA, 25 bp, Homo sapien
ggcgccgcatctttccgagctccgg

SEQ ID NO: 61962 - DNA, 25 bp, Homo sapien
aggagttctcgagtgtgcgcagtct

SEQ ID NO: 61963 - DNA, 25 bp, Homo sapien
tgggcgagacatctccgcaaggctt

SEQ ID NO: 61964 - DNA, 25 bp, Homo sapien
tgcgcagtctggcacgtgagtcagc

SEQ ID NO: 61965 - DNA, 25 bp, Homo sapien
gctctgcgcaggagttctcgagtgt

SEQ ID NO: 61966 - DNA, 25 bp, Homo sapien
cgacagactaggagtttgcgctctc

SEQ ID NO: 61967 - DNA, 25 bp, Homo sapien
atccgctgcattggcctctaaaacc

SEQ ID NO: 61968 - DNA, 25 bp, Homo sapien
agctgttcctgaatccgctgcattg

SEQ ID NO: 61969 - DNA, 25 bp, Homo sapien
tctccgcaaggcttggcggtccttc

SEQ ID NO: 61970 - DNA, 25 bp, Homo sapien
tgtccaagctcgagcaccaggtgga

SEQ ID NO: 61971 - DNA, 25 bp, Homo sapien
ttggtttgacgtggctcccaaaggc

SEQ ID NO: 61972 - DNA, 25 bp, Homo sapien
tgagagcacccaggcatccgcacag

SEQ ID NO: 61973 - DNA, 25 bp, Homo sapien
gaagccctccgcattggtgtccaag

SEQ ID NO: 61974 - DNA, 25 bp, Homo sapien
agcgcgtctcacatggcccggatct

SEQ ID NO: 61975 - DNA, 25 bp, Homo sapien
ctccgaattggagttcttgtagttc

SEQ ID NO: 61976 - DNA, 25 bp, Homo sapien
ttcctcctgacggtggggactaatg

SEQ ID NO: 61977 - DNA, 25 bp, Homo sapien
cggagaaggctaggattcctcccaa

SEQ ID NO: 61978 - DNA, 25 bp, Homo sapien
tgcagcaccgcgctaagcttgggcc

SEQ ID NO: 61979 - DNA, 25 bp, Homo sapien
accgagagacccaaacccagggctg

SEQ ID NO: 61980 - DNA, 25 bp, Homo sapien
ggatcgaaattcaagtggggccgtc

SEQ ID NO: 61981 - DNA, 25 bp, Homo sapien
ggaaagtcgtcaggtcaccctccgc

SEQ ID NO: 61982 - DNA, 25 bp, Homo sapien
tgttctgctcccaaactccgggatc

SEQ ID NO: 61983 - DNA, 25 bp, Homo sapien
ccctgcccagctaggaaatcctgtt

SEQ ID NO: 61984 - DNA, 25 bp, Homo sapien
tccgttgaaagcttcagcccgccgg

SEQ ID NO: 61985 - DNA, 25 bp, Homo sapien
cccagggctgaaactccgttgaaag

SEQ ID NO: 61986 - DNA, 25 bp, Homo sapien
cgccaagctggctgctgctgtagat

SEQ ID NO: 61987 - DNA, 25 bp, Homo sapien
atgggcctggttcacctgtacttca

SEQ ID NO: 61988 - DNA, 25 bp, Homo sapien
ggtggccactcggtgttgaccaaca

SEQ ID NO: 61989 - DNA, 25 bp, Homo sapien
tgcctggactcaaagccggccctga

SEQ ID NO: 61990 - DNA, 25 bp, Homo sapien
gtgtctctacggaatccctcacagg

SEQ ID NO: 61991 - DNA, 25 bp, Homo sapien
aggacaagcttctctatccgcggcc

SEQ ID NO: 61992 - DNA, 25 bp, Homo sapien
tatccgcggccgcttttgtttcacg

SEQ ID NO: 61993 - DNA, 25 bp, Homo sapien
acgtggctcctgctacgtggctcta

SEQ ID NO: 61994 - DNA, 25 bp, Homo sapien
cgtttaagaacagtgggcgtggcct

SEQ ID NO: 61995 - DNA, 25 bp, Homo sapien
cccttcgaagcggaggaatggccaa

SEQ ID NO: 61996 - DNA, 25 bp, Homo sapien
atcggccgcgttcatcagtcagcac

SEQ ID NO: 61997 - DNA, 25 bp, Homo sapien
ccagtggtgcgcgagcgcagataac

SEQ ID NO: 61998 - DNA, 25 bp, Homo sapien
tcacaacacagaccggaccttgggt

SEQ ID NO: 61999 - DNA, 25 bp, Homo sapien
cggcacctgagaaccacttccggtg

SEQ ID NO: 62000 - DNA, 25 bp, Homo sapien
ccacttccggtgagtagcttctact

SEQ ID NO: 62001 - DNA, 25 bp, Homo sapien
cttctacttccggagacgatgactc

SEQ ID NO: 62002 - DNA, 25 bp, Homo sapien
tggacttctcactggccgacgcggt

SEQ ID NO: 62003 - DNA, 25 bp, Homo sapien
tcgagcgcgacaacctgctcgacga

SEQ ID NO: 62004 - DNA, 25 bp, Homo sapien
tcgccgccgaagtgaaccggctcaa

SEQ ID NO: 62005 - DNA, 25 bp, Homo sapien
gtttcggctctaagggctcctccag

SEQ ID NO: 62006 - DNA, 25 bp, Homo sapien
ccgacgcggtgaaccaggagtttct

SEQ ID NO: 62007 - DNA, 25 bp, Homo sapien
caggcgagctgctggacttctcact

SEQ ID NO: 62008 - DNA, 25 bp, Homo sapien
tcccgcgtgtaccaggtgtcgcgca

SEQ ID NO: 62009 - DNA, 25 bp, Homo sapien
aggagtttctgaccacgcgcaccaa

SEQ ID NO: 62010 - DNA, 25 bp, Homo sapien
tgtacagctgcatggcccagaacga

SEQ ID NO: 62011 - DNA, 25 bp, Homo sapien
tactggatactggttccgccgcctt

SEQ ID NO: 62012 - DNA, 25 bp, Homo sapien
cccggtgaccttctgggtagcacag

SEQ ID NO: 62013 - DNA, 25 bp, Homo sapien
gaccttctgggtagcacaggccgaa

SEQ ID NO: 62014 - DNA, 25 bp, Homo sapien
caggacgccggcgtgtacagctgca

SEQ ID NO: 62015 - DNA, 25 bp, Homo sapien
ctcagaggtagaaaagggctgccca

SEQ ID NO: 62016 - DNA, 25 bp, Homo sapien
ccacgcgggtaaggtactggatact

SEQ ID NO: 62017 - DNA, 25 bp, Homo sapien
ccagacttgtctcctagggcaccgt

SEQ ID NO: 62018 - DNA, 25 bp, Homo sapien
gcaacgcacacggatccgcgctgag

SEQ ID NO: 62019 - DNA, 25 bp, Homo sapien
cccgggtctgtgtcctgagcgcgca

SEQ ID NO: 62020 - DNA, 25 bp, Homo sapien
ctgtgggtgaagaagcgtttccagg

SEQ ID NO: 62021 - DNA, 25 bp, Homo sapien
ggagcgcccacttgcttctttgcca

SEQ ID NO: 62022 - DNA, 25 bp, Homo sapien
tgcttctttgccacatcttctctct

SEQ ID NO: 62023 - DNA, 25 bp, Homo sapien
actctgaagctttccatcttccgga

SEQ ID NO: 62024 - DNA, 25 bp, Homo sapien
tgaaagcaacgcacacggatccgcg

SEQ ID NO: 62025 - DNA, 25 bp, Homo sapien
cagcgttcggcgtggagcgcccact

SEQ ID NO: 62026 - DNA, 25 bp, Homo sapien
ggcgctctctatccacgtgtaagta

SEQ ID NO: 62027 - DNA, 25 bp, Homo sapien
cctgtacagaggacgggcgctctct

SEQ ID NO: 62028 - DNA, 25 bp, Homo sapien
cggcagcgcattcagcctgtacaga

SEQ ID NO: 62029 - DNA, 25 bp, Homo sapien
ggcagcccaaggcaagcacaggcaa

SEQ ID NO: 62030 - DNA, 25 bp, Homo sapien
tgacctgtacggcagcgcattcagc

SEQ ID NO: 62031 - DNA, 25 bp, Homo sapien
aggatagcctttccgtggccagtga

SEQ ID NO: 62032 - DNA, 25 bp, Homo sapien
tcgagctaatctggtgggcgcaagc

SEQ ID NO: 62033 - DNA, 25 bp, Homo sapien
tggtgcgggcatctcgagctaatct

SEQ ID NO: 62034 - DNA, 25 bp, Homo sapien
agctgcagttcttcgaggagcgacg

SEQ ID NO: 62035 - DNA, 25 bp, Homo sapien
aattcccgctgacccggagcagagc

SEQ ID NO: 62036 - DNA, 25 bp, Homo sapien
agacgccactgagcgaggcctcagg

SEQ ID NO: 62037 - DNA, 25 bp, Homo sapien
gctctctggagcagcccaagtcgga

SEQ ID NO: 62038 - DNA, 25 bp, Homo sapien
gcgccgcctgttccagcagaaagcg

SEQ ID NO: 62039 - DNA, 25 bp, Homo sapien
taggcgtcgggaccaattcccgctg

SEQ ID NO: 62040 - DNA, 25 bp, Homo sapien
ccatccaggagtgcaggagccctgt

SEQ ID NO: 62041 - DNA, 25 bp, Homo sapien
gaggacaccaccaccgaagagaagc

SEQ ID NO: 62042 - DNA, 25 bp, Homo sapien
ctgagcttcaccctggagcggctgt

SEQ ID NO: 62043 - DNA, 25 bp, Homo sapien
gctgtccagccgattgcagcgcagt

SEQ ID NO: 62044 - DNA, 25 bp, Homo sapien
ttggccttccgcacaaccagttggc

SEQ ID NO: 62045 - DNA, 25 bp, Homo sapien
aagttcaagcgcagccgcgagtcgc

SEQ ID NO: 62046 - DNA, 25 bp, Homo sapien
ccaggcagcagtctcagtagcagca

SEQ ID NO: 62047 - DNA, 25 bp, Homo sapien
gaggatggcatataccggcccagcc

SEQ ID NO: 62048 - DNA, 25 bp, Homo sapien
gtagcagcatcgaaaacttggagtc

SEQ ID NO: 62049 - DNA, 25 bp, Homo sapien
gtgctagccgagaaagcccgagttc

SEQ ID NO: 62050 - DNA, 25 bp, Homo sapien
accaccgtgacgctgactgcggaga

SEQ ID NO: 62051 - DNA, 25 bp, Homo sapien
ccgctagtcccgacgaagattcaaa

SEQ ID NO: 62052 - DNA, 25 bp, Homo sapien
catctgtatttagtgccgggtatta

SEQ ID NO: 62053 - DNA, 25 bp, Homo sapien
tgctcaacgtcacactgcgagttta

SEQ ID NO: 62054 - DNA, 25 bp, Homo sapien
tgtgaacattcaggggctttcgccc

SEQ ID NO: 62055 - DNA, 25 bp, Homo sapien
gcgtgtttacctctgggcctagcta

SEQ ID NO: 62056 - DNA, 25 bp, Homo sapien
gtgttcttcgagatcggcagcacca

SEQ ID NO: 62057 - DNA, 25 bp, Homo sapien
ttccactacccggagcggtctctga

SEQ ID NO: 62058 - DNA, 25 bp, Homo sapien
tcactttttttctcagctgctggtt

SEQ ID NO: 62059 - DNA, 25 bp, Homo sapien
tcctctccctgctgctcattagcgc

SEQ ID NO: 62060 - DNA, 25 bp, Homo sapien
cagcgggtggacctcgggctctaat

SEQ ID NO: 62061 - DNA, 25 bp, Homo sapien
agcagctgccgtttccctcagatcg

SEQ ID NO: 62062 - DNA, 25 bp, Homo sapien
cgtttccctcagatcgattcctttc

SEQ ID NO: 62063 - DNA, 25 bp, Homo sapien
ctcagatcgattcctttctcacttt

SEQ ID NO: 62064 - DNA, 25 bp, Homo sapien
cggcttggatcgatggagccacctc

SEQ ID NO: 62065 - DNA, 25 bp, Homo sapien
cagctgctggttctgcggcttggat

SEQ ID NO: 62066 - DNA, 25 bp, Homo sapien
tttccctccgcggtggaagcctctg

SEQ ID NO: 62067 - DNA, 25 bp, Homo sapien
ggcctcgtgctgatcatgtctcact

SEQ ID NO: 62068 - DNA, 25 bp, Homo sapien
tctagggtgtaaggcctaagcggtc

SEQ ID NO: 62069 - DNA, 25 bp, Homo sapien
ctccactgtataagcaaaactcttg

SEQ ID NO: 62070 - DNA, 25 bp, Homo sapien
ctgtgggagtgtgctccactgtata

SEQ ID NO: 62071 - DNA, 25 bp, Homo sapien
ttctgtcttgtctcctgaactcccg

SEQ ID NO: 62072 - DNA, 25 bp, Homo sapien
ggggaatgcaaatgaggcagaccca

SEQ ID NO: 62073 - DNA, 25 bp, Homo sapien
ggttccgtttctggtcgcagcctcc

SEQ ID NO: 62074 - DNA, 25 bp, Homo sapien
cggatcaaagcgtcggtagccattc

SEQ ID NO: 62075 - DNA, 25 bp, Homo sapien
acaggcaagatctccacgcggctca

SEQ ID NO: 62076 - DNA, 25 bp, Homo sapien
tggcgcggctcatacagtagcagca

SEQ ID NO: 62077 - DNA, 25 bp, Homo sapien
gcaagtccagcgtgtattccatacc

SEQ ID NO: 62078 - DNA, 25 bp, Homo sapien
gaagacatctgcatgggccacgcgc

SEQ ID NO: 62079 - DNA, 25 bp, Homo sapien
gctgtctgcacactgagccatggca

SEQ ID NO: 62080 - DNA, 25 bp, Homo sapien
gggctgccacatagtcggagttgta

SEQ ID NO: 62081 - DNA, 25 bp, Homo sapien
gctgcagtggcaaaggcctccaaga

SEQ ID NO: 62082 - DNA, 25 bp, Homo sapien
gctgatatcttctcccggatgccca

SEQ ID NO: 62083 - DNA, 25 bp, Homo sapien
tctgtccaaataaccgaagctggcg

SEQ ID NO: 62084 - DNA, 25 bp, Homo sapien
cggcgaccttcccatgctgatatct

SEQ ID NO: 62085 - DNA, 25 bp, Homo sapien
ggctgcgccttggacactttccttt

SEQ ID NO: 62086 - DNA, 25 bp, Homo sapien
tccttttgggcgtctctcttgcacg

SEQ ID NO: 62087 - DNA, 25 bp, Homo sapien
ctcttgcacgccgaagggcttctgt

SEQ ID NO: 62088 - DNA, 25 bp, Homo sapien
gacactttccttttgggcgtctctc

SEQ ID NO: 62089 - DNA, 25 bp, Homo sapien
gaagggcttctgtccaaataaccga

SEQ ID NO: 62090 - DNA, 25 bp, Homo sapien
acacatccaaccacggcgcgagaat

SEQ ID NO: 62091 - DNA, 25 bp, Homo sapien
ccacggcgcgagaatcaaggtgcca

SEQ ID NO: 62092 - DNA, 25 bp, Homo sapien
cgcgagaatcaaggtgccagaatca

SEQ ID NO: 62093 - DNA, 25 bp, Homo sapien
tcaaggtgccagaatcacaggacgc

SEQ ID NO: 62094 - DNA, 25 bp, Homo sapien
tgccagaatcacaggacgcgggaat

SEQ ID NO: 62095 - DNA, 25 bp, Homo sapien
cgcgggaatcacagggtgccggaat

SEQ ID NO: 62096 - DNA, 25 bp, Homo sapien
cgctcggggtagcacagccacacat

SEQ ID NO: 62097 - DNA, 25 bp, Homo sapien
cagaatcacaggacgcgggaatcac

SEQ ID NO: 62098 - DNA, 25 bp, Homo sapien
ggcgcgggaatcaagcttctccata

SEQ ID NO: 62099 - DNA, 25 bp, Homo sapien
cgcaggggagacatgccagaattct

SEQ ID NO: 62100 - DNA, 25 bp, Homo sapien
ctttgacggaaatgaggctgcgctg

SEQ ID NO: 62101 - DNA, 25 bp, Homo sapien
tgttgtccagtgactactctccctc

SEQ ID NO: 62102 - DNA, 25 bp, Homo sapien
gctcatacacgggttgggctcaaca

SEQ ID NO: 62103 - DNA, 25 bp, Homo sapien
tgccggaatcaagggacgccagaat

SEQ ID NO: 62104 - DNA, 25 bp, Homo sapien
cagcttttcaccgagctttgacgga

SEQ ID NO: 62105 - DNA, 25 bp, Homo sapien
gggctcaacacacgcaaacagcttt

SEQ ID NO: 62106 - DNA, 25 bp, Homo sapien
tcggaggacgattcttcccaggagc

SEQ ID NO: 62107 - DNA, 25 bp, Homo sapien
cttaacgtggcagtgaccctttggg

SEQ ID NO: 62108 - DNA, 25 bp, Homo sapien
tgggcctcctgcctcttaacgtggc

SEQ ID NO: 62109 - DNA, 25 bp, Homo sapien
tcggctgcaaaatctaggcggcggc

SEQ ID NO: 62110 - DNA, 25 bp, Homo sapien
tctccacttggctttcctgccagtg

SEQ ID NO: 62111 - DNA, 25 bp, Homo sapien
ctccggtgcgtttgtggaaactctg

SEQ ID NO: 62112 - DNA, 25 bp, Homo sapien
gtgctccgaacacatggtgcccaga

SEQ ID NO: 62113 - DNA, 25 bp, Homo sapien
tgccagtgcaccttcggctgcaaaa

SEQ ID NO: 62114 - DNA, 25 bp, Homo sapien
agccactcgtcagggcgcgcactga

SEQ ID NO: 62115 - DNA, 25 bp, Homo sapien
catcgagaatgcagcgacccagcca

SEQ ID NO: 62116 - DNA, 25 bp, Homo sapien
cactgacgatgtcgttgcggcagcc

SEQ ID NO: 62117 - DNA, 25 bp, Homo sapien
caaagcctccgtggcagtagcggcc

SEQ ID NO: 62118 - DNA, 25 bp, Homo sapien
ctctccgccgatgaagtcctggggc

SEQ ID NO: 62119 - DNA, 25 bp, Homo sapien
agaaccagtcaaagtcgtcgccgtg

SEQ ID NO: 62120 - DNA, 25 bp, Homo sapien
caatgggtcgctcctcgcctagcgt

SEQ ID NO: 62121 - DNA, 25 bp, Homo sapien
agcgtcaccactgccatgccaggtg

SEQ ID NO: 62122 - DNA, 25 bp, Homo sapien
gggcgcagccgatcactacctgacg

SEQ ID NO: 62123 - DNA, 25 bp, Homo sapien
acctgacggcctttttggcggcctg

SEQ ID NO: 62124 - DNA, 25 bp, Homo sapien
agaggccggagctgtccatcagcac

SEQ ID NO: 62125 - DNA, 25 bp, Homo sapien
tcccatgtgacgtcagaagcagccc

SEQ ID NO: 62126 - DNA, 25 bp, Homo sapien
agctgtccgacgtgtcactgcaagg

SEQ ID NO: 62127 - DNA, 25 bp, Homo sapien
tcttgcgctcggcactggagcctca

SEQ ID NO: 62128 - DNA, 25 bp, Homo sapien
acagcagcagcgatgcccgcatggc

SEQ ID NO: 62129 - DNA, 25 bp, Homo sapien
ctgagcaggctcagggtgaagccca

SEQ ID NO: 62130 - DNA, 25 bp, Homo sapien
tgctgggctccgcaccctactacca

SEQ ID NO: 62131 - DNA, 25 bp, Homo sapien
agctgctactgctggggcgctacgt

SEQ ID NO: 62132 - DNA, 25 bp, Homo sapien
ctacttcgccgagctgctactgctg

SEQ ID NO: 62133 - DNA, 25 bp, Homo sapien
tgccgctgactacttcgccgagctg

SEQ ID NO: 62134 - DNA, 25 bp, Homo sapien
tggtgctgcgctgatcgccactgcc

SEQ ID NO: 62135 - DNA, 25 bp, Homo sapien
cctactaccagccaggctccgtgtg

SEQ ID NO: 62136 - DNA, 25 bp, Homo sapien
gctggtggccatgctagtgcgcagc

SEQ ID NO: 62137 - DNA, 25 bp, Homo sapien
caccgccgtgactggtgctgcgctg

SEQ ID NO: 62138 - DNA, 25 bp, Homo sapien
gcggcgcaccctttgttgatgccaa

SEQ ID NO: 62139 - DNA, 25 bp, Homo sapien
gcgcagctcgctaagcaccagaatg

SEQ ID NO: 62140 - DNA, 25 bp, Homo sapien
gttcggacgccgttagtgtatgcta

SEQ ID NO: 62141 - DNA, 25 bp, Homo sapien
cagaccttcctgtcggatgcggacg

SEQ ID NO: 62142 - DNA, 25 bp, Homo sapien
ctccgacacggtgcactcgaacgta

SEQ ID NO: 62143 - DNA, 25 bp, Homo sapien
cggggaagacagctccgcaagtctc

SEQ ID NO: 62144 - DNA, 25 bp, Homo sapien
cagctcggagagtaccgccacagta

SEQ ID NO: 62145 - DNA, 25 bp, Homo sapien
ctttctagaagcacgcgcggtcatc

SEQ ID NO: 62146 - DNA, 25 bp, Homo sapien
catcctgggccatggacaggcgaga

SEQ ID NO: 62147 - DNA, 25 bp, Homo sapien
cactcggcctgtctccacttcgaga

SEQ ID NO: 62148 - DNA, 25 bp, Homo sapien
gtcggccagtatgacaccatggatg

SEQ ID NO: 62149 - DNA, 25 bp, Homo sapien
cgtaggtgccctggtcggccagtat

SEQ ID NO: 62150 - DNA, 25 bp, Homo sapien
gtggctctcgcagccgtaggtgccc

SEQ ID NO: 62151 - DNA, 25 bp, Homo sapien
tgcgatcgtggtggctctcgcagcc

SEQ ID NO: 62152 - DNA, 25 bp, Homo sapien
gcctcacgctgagcctggccagggt

SEQ ID NO: 62153 - DNA, 25 bp, Homo sapien
tatgacaccatggatgaagaggcgg

SEQ ID NO: 62154 - DNA, 25 bp, Homo sapien
tcctcgagctggacagcgggcagca

SEQ ID NO: 62155 - DNA, 25 bp, Homo sapien
actcgccggagtcctcgagctggac

SEQ ID NO: 62156 - DNA, 25 bp, Homo sapien
ggccggcatagctcacaggtcagca

SEQ ID NO: 62157 - DNA, 25 bp, Homo sapien
atagctcacaggtcagcaccacacg

SEQ ID NO: 62158 - DNA, 25 bp, Homo sapien
ccttgccgctgggatacacgatcca

SEQ ID NO: 62159 - DNA, 25 bp, Homo sapien
gggatacacgatccacgaggagacg

SEQ ID NO: 62160 - DNA, 25 bp, Homo sapien
tttcacacaagtactcgccggagtc

SEQ ID NO: 62161 - DNA, 25 bp, Homo sapien
agtgtcttccttctgcaggagcagc

SEQ ID NO: 62162 - DNA, 25 bp, Homo sapien
ttatggcatgcacgaacacatgttc

SEQ ID NO: 62163 - DNA, 25 bp, Homo sapien
cgtccttgtaccaacgcacaggggc

SEQ ID NO: 62164 - DNA, 25 bp, Homo sapien
gccagcatgacacactcggaagtta

SEQ ID NO: 62165 - DNA, 25 bp, Homo sapien
acactcggaagttatggcatgcacg

SEQ ID NO: 62166 - DNA, 25 bp, Homo sapien
gtaccaacgcacaggggcgtcctct

SEQ ID NO: 62167 - DNA, 25 bp, Homo sapien
tcacaggccagcatgacacactcgg

SEQ ID NO: 62168 - DNA, 25 bp, Homo sapien
catgcacgaacacatgttctcgggg

SEQ ID NO: 62169 - DNA, 25 bp, Homo sapien
ggcgtcctctcggtccacctcacag

SEQ ID NO: 62170 - DNA, 25 bp, Homo sapien
gcatctcgcacaggtagataccatc

SEQ ID NO: 62171 - DNA, 25 bp, Homo sapien
gataccatcatcgtctgccttcagc

SEQ ID NO: 62172 - DNA, 25 bp, Homo sapien
ctgccttcagcctgtggatgatgag

SEQ ID NO: 62173 - DNA, 25 bp, Homo sapien
atgaggcgccggacagtgccctctt

SEQ ID NO: 62174 - DNA, 25 bp, Homo sapien
cagtgccctcttcgatctgctcgta

SEQ ID NO: 62175 - DNA, 25 bp, Homo sapien
atctgctcgtacttgcggcagggca

SEQ ID NO: 62176 - DNA, 25 bp, Homo sapien
tgcgggagttgggtactttacattc

SEQ ID NO: 62177 - DNA, 25 bp, Homo sapien
tttacattccagcacggcaatcccg

SEQ ID NO: 62178 - DNA, 25 bp, Homo sapien
gtgcgcctccacccaagacagagag

SEQ ID NO: 62179 - DNA, 25 bp, Homo sapien
gcccggaggcgcttacctctgcgtt

SEQ ID NO: 62180 - DNA, 25 bp, Homo sapien
ttcaaggagcctgcatacaagctgc

SEQ ID NO: 62181 - DNA, 25 bp, Homo sapien
tcgaatgccgccaccgagaggcaag

SEQ ID NO: 62182 - DNA, 25 bp, Homo sapien
tccaggtaggagctcgaatgccgcc

SEQ ID NO: 62183 - DNA, 25 bp, Homo sapien
gcctgcatacaagctgcaacagctc

SEQ ID NO: 62184 - DNA, 25 bp, Homo sapien
ctcccaggacgtcccgagatcgggt

SEQ ID NO: 62185 - DNA, 25 bp, Homo sapien
cacgcgcgtactcacggagctggac

SEQ ID NO: 62186 - DNA, 25 bp, Homo sapien
ttggcctggcagtaaagcaccttga

SEQ ID NO: 62187 - DNA, 25 bp, Homo sapien
agtggctgctgtcccacacttcgtc

SEQ ID NO: 62188 - DNA, 25 bp, Homo sapien
cgtggcacacgtagacgccggaatc

SEQ ID NO: 62189 - DNA, 25 bp, Homo sapien
acccagaaggtcttaggcgcgcact

SEQ ID NO: 62190 - DNA, 25 bp, Homo sapien
tgcttgccctcgttcacccagaagg

SEQ ID NO: 62191 - DNA, 25 bp, Homo sapien
gcccatcacgtagcagcggaacttg

SEQ ID NO: 62192 - DNA, 25 bp, Homo sapien
ccagtgccattcgatctcgggctcg

SEQ ID NO: 62193 - DNA, 25 bp, Homo sapien
aagcaccttgagcacgaagccgccg

SEQ ID NO: 62194 - DNA, 25 bp, Homo sapien
tttgcatgatctacggcgcggtttc

SEQ ID NO: 62195 - DNA, 25 bp, Homo sapien
gcaaacgagtcagggtttcctcacc

SEQ ID NO: 62196 - DNA, 25 bp, Homo sapien
acgccctgggcttttggcactaccg

SEQ ID NO: 62197 - DNA, 25 bp, Homo sapien
cttatgttcctcgaaagggcggcca

SEQ ID NO: 62198 - DNA, 25 bp, Homo sapien
gttcggtatgtctgaccaggactta

SEQ ID NO: 62199 - DNA, 25 bp, Homo sapien
ttccatcattgataggcgccgggca

SEQ ID NO: 62200 - DNA, 25 bp, Homo sapien
cagagacatgttttccggtcgtccc

SEQ ID NO: 62201 - DNA, 25 bp, Homo sapien
ggcgggacttcctttccatcattga

SEQ ID NO: 62202 - DNA, 25 bp, Homo sapien
gcactcctgaggttgcatttttaca

SEQ ID NO: 62203 - DNA, 25 bp, Homo sapien
ggcttctgcgaaaagaaattccctc

SEQ ID NO: 62204 - DNA, 25 bp, Homo sapien
ctcgtgagagctagaattctgcagc

SEQ ID NO: 62205 - DNA, 25 bp, Homo sapien
ggtgggcttagagagcttccaatta

SEQ ID NO: 62206 - DNA, 25 bp, Homo sapien
gtttccaaagttgcggagcctcgcc

SEQ ID NO: 62207 - DNA, 25 bp, Homo sapien
ggagacccgccctaatccttttgca

SEQ ID NO: 62208 - DNA, 25 bp, Homo sapien
ttttcccagaaaagccagttccagc

SEQ ID NO: 62209 - DNA, 25 bp, Homo sapien
cccaggcagtgccttgtgtgaatga

SEQ ID NO: 62210 - DNA, 25 bp, Homo sapien
atggccaacggagtgatcccgccgc

SEQ ID NO: 62211 - DNA, 25 bp, Homo sapien
gtcccctagtgagcgagagcgtccc

SEQ ID NO: 62212 - DNA, 25 bp, Homo sapien
acggcccgcccgctcccattgtgcg

SEQ ID NO: 62213 - DNA, 25 bp, Homo sapien
gggcgccagcgcaaggaacctgacc

SEQ ID NO: 62214 - DNA, 25 bp, Homo sapien
gcctacctggccatggccaacggag

SEQ ID NO: 62215 - DNA, 25 bp, Homo sapien
cctggccatggccaacggagtgatc

SEQ ID NO: 62216 - DNA, 25 bp, Homo sapien
ggccatggccaacggagtgatcccg

SEQ ID NO: 62217 - DNA, 25 bp, Homo sapien
cggctctgcgctgcgagaggccgga

SEQ ID NO: 62218 - DNA, 25 bp, Homo sapien
gcttctttaggagagtcgacgtgtc

SEQ ID NO: 62219 - DNA, 25 bp, Homo sapien
agcagcgggctgaagacattgccaa

SEQ ID NO: 62220 - DNA, 25 bp, Homo sapien
cggggagttttgtggctctatcact

SEQ ID NO: 62221 - DNA, 25 bp, Homo sapien
agggctccgtcactgtctccagaga

SEQ ID NO: 62222 - DNA, 25 bp, Homo sapien
ctgttttgtctttatggcgcttccc

SEQ ID NO: 62223 - DNA, 25 bp, Homo sapien
agctgacctgcggttgcttctttag

SEQ ID NO: 62224 - DNA, 25 bp, Homo sapien
ctgccgcttctatcccagtggaata

SEQ ID NO: 62225 - DNA, 25 bp, Homo sapien
ctccagagactgaacgaatgacttt

SEQ ID NO: 62226 - DNA, 25 bp, Homo sapien
ttcgtgttagtgaaccgcccagccc

SEQ ID NO: 62227 - DNA, 25 bp, Homo sapien
tgcagcccggcgagctaagcttcga

SEQ ID NO: 62228 - DNA, 25 bp, Homo sapien
agctaagcttcgagccggccagaga

SEQ ID NO: 62229 - DNA, 25 bp, Homo sapien
tgcctctgctccagtctcagcgcgg

SEQ ID NO: 62230 - DNA, 25 bp, Homo sapien
ctatggagctggagggatgtatcca

SEQ ID NO: 62231 - DNA, 25 bp, Homo sapien
tgtatccagcaagggtgcatcatgc

SEQ ID NO: 62232 - DNA, 25 bp, Homo sapien
gcatcatgcttagcgcgcgcccgtt

SEQ ID NO: 62233 - DNA, 25 bp, Homo sapien
gatgcctcggccaggacttggctcc

SEQ ID NO: 62234 - DNA, 25 bp, Homo sapien
ggcgttgtcacctgctttaagagaa

SEQ ID NO: 62235 - DNA, 25 bp, Homo sapien
agaaatcttctttggggcgtcctca

SEQ ID NO: 62236 - DNA, 25 bp, Homo sapien
ggagaggccacctcccaatagctga

SEQ ID NO: 62237 - DNA, 25 bp, Homo sapien
tacctgacggcacggtgtttcgatc

SEQ ID NO: 62238 - DNA, 25 bp, Homo sapien
acagaccgcgtccttgagtaatttg

SEQ ID NO: 62239 - DNA, 25 bp, Homo sapien
tctcggatttcccagctgaacatgc

SEQ ID NO: 62240 - DNA, 25 bp, Homo sapien
tgcccgggttctctcttttgtattc

SEQ ID NO: 62241 - DNA, 25 bp, Homo sapien
ttcttctccacgtcaggcgttgtca

SEQ ID NO: 62242 - DNA, 25 bp, Homo sapien
tcaccttgggcttgctgccgccgat

SEQ ID NO: 62243 - DNA, 25 bp, Homo sapien
ggtgggccatctccacgatcttgtg

SEQ ID NO: 62244 - DNA, 25 bp, Homo sapien
caccaggacgtatggagccagtctc

SEQ ID NO: 62245 - DNA, 25 bp, Homo sapien
tcagaaataactcattggagagccc

SEQ ID NO: 62246 - DNA, 25 bp, Homo sapien
tacctgcacaggatcttggagacgc

SEQ ID NO: 62247 - DNA, 25 bp, Homo sapien
aaacaccgccgagctggttgacgcg

SEQ ID NO: 62248 - DNA, 25 bp, Homo sapien
ggcctgccgttgataaaaacaccgc

SEQ ID NO: 62249 - DNA, 25 bp, Homo sapien
tttacgcaccttcacaaacctcaga

SEQ ID NO: 62250 - DNA, 25 bp, Homo sapien
ggcagcttcgctcggaaattatatc

SEQ ID NO: 62251 - DNA, 25 bp, Homo sapien
tgattgggcaacagcgaccactttc

SEQ ID NO: 62252 - DNA, 25 bp, Homo sapien
cgggctcgggagcatttattagttc

SEQ ID NO: 62253 - DNA, 25 bp, Homo sapien
cgcggatgaccctcgggaactatcc

SEQ ID NO: 62254 - DNA, 25 bp, Homo sapien
ttcctggaagcaccaaaggagcctg

SEQ ID NO: 62255 - DNA, 25 bp, Homo sapien
gagcagcgcgctccatttgcagaaa

SEQ ID NO: 62256 - DNA, 25 bp, Homo sapien
ccgcggcatttccaaaacaacaggg

SEQ ID NO: 62257 - DNA, 25 bp, Homo sapien
ttggtacgagtctgggcaaatgttc

SEQ ID NO: 62258 - DNA, 25 bp, Homo sapien
tgacacggtcgagcagagaagttcc

SEQ ID NO: 62259 - DNA, 25 bp, Homo sapien
cccaggcgtgattctcaggatgcag

SEQ ID NO: 62260 - DNA, 25 bp, Homo sapien
tttgtcaaaagcattggcgccgctc

SEQ ID NO: 62261 - DNA, 25 bp, Homo sapien
gccgctgcctcagtgacagtcatta

SEQ ID NO: 62262 - DNA, 25 bp, Homo sapien
cttccggtccggatgtgatgataca

SEQ ID NO: 62263 - DNA, 25 bp, Homo sapien
gggaggacatcaaaacgccaggttc

SEQ ID NO: 62264 - DNA, 25 bp, Homo sapien
cgccaggttcgtgatcatgagcttc

SEQ ID NO: 62265 - DNA, 25 bp, Homo sapien
ggcaaacgccgagaaaccctcaatc

SEQ ID NO: 62266 - DNA, 25 bp, Homo sapien
ggtccctcttcctagaatagcgttg

SEQ ID NO: 62267 - DNA, 25 bp, Homo sapien
cacctagagaaacagccggcagccg

SEQ ID NO: 62268 - DNA, 25 bp, Homo sapien
caaggctggctctagaagtgctgga

SEQ ID NO: 62269 - DNA, 25 bp, Homo sapien
acgttccctgcagcgttcagcaagg

SEQ ID NO: 62270 - DNA, 25 bp, Homo sapien
catggacaactgtttggcggccgca

SEQ ID NO: 62271 - DNA, 25 bp, Homo sapien
tgcccactcagggagccatggacaa

SEQ ID NO: 62272 - DNA, 25 bp, Homo sapien
ccggcgtttgtacgttgtgtgccca

SEQ ID NO: 62273 - DNA, 25 bp, Homo sapien
tcccacccggatttggagcagggtc

SEQ ID NO: 62274 - DNA, 25 bp, Homo sapien
tcacgggaaccagaggcaagaggct

SEQ ID NO: 62275 - DNA, 25 bp, Homo sapien
gcgaatgagtccaacacccgcgttc

SEQ ID NO: 62276 - DNA, 25 bp, Homo sapien
gcgttcctcgagttttaaaagcaca

SEQ ID NO: 62277 - DNA, 25 bp, Homo sapien
cgttttgaagagtgctgcgcgcacc

SEQ ID NO: 62278 - DNA, 25 bp, Homo sapien
tgcctctcggagatatccaactcca

SEQ ID NO: 62279 - DNA, 25 bp, Homo sapien
gcgtctcctgagagcgcacagtcca

SEQ ID NO: 62280 - DNA, 25 bp, Homo sapien
ctgagcctggaagctcgccaccgtg

SEQ ID NO: 62281 - DNA, 25 bp, Homo sapien
ctgcacagccaactaaacggagtaa

SEQ ID NO: 62282 - DNA, 25 bp, Homo sapien
cctttccggaaacaccggctggctg

SEQ ID NO: 62283 - DNA, 25 bp, Homo sapien
tagcgcgccgttcgcatcaatcacg

SEQ ID NO: 62284 - DNA, 25 bp, Homo sapien
tattaattacgcagcccttagcgcg

SEQ ID NO: 62285 - DNA, 25 bp, Homo sapien
tacgcagaaactcgcacagggactc

SEQ ID NO: 62286 - DNA, 25 bp, Homo sapien
agccgccgagggaattttccaaatg

SEQ ID NO: 62287 - DNA, 25 bp, Homo sapien
tccgcagaaggcaaggaggcccact

SEQ ID NO: 62288 - DNA, 25 bp, Homo sapien
cgggtacacttgatccggaacaaga

SEQ ID NO: 62289 - DNA, 25 bp, Homo sapien
cgcgctagcaggaccgctctagatc

SEQ ID NO: 62290 - DNA, 25 bp, Homo sapien
ggcctctgtgcaaaccgaagtatac

SEQ ID NO: 62291 - DNA, 25 bp, Homo sapien
tgggcacctctgctattgttacaaa

SEQ ID NO: 62292 - DNA, 25 bp, Homo sapien
agcccttgaaatccgggacgtcaca

SEQ ID NO: 62293 - DNA, 25 bp, Homo sapien
gcaagatagtgtggcctctggttcc

SEQ ID NO: 62294 - DNA, 25 bp, Homo sapien
tggttccctccacgcgtgataagtg

SEQ ID NO: 62295 - DNA, 25 bp, Homo sapien
acagcgtccttgtgccttcgatttg

SEQ ID NO: 62296 - DNA, 25 bp, Homo sapien
tccagggtgcaggattctgcccttc

SEQ ID NO: 62297 - DNA, 25 bp, Homo sapien
ctaacccgtaatggagctggcaagt

SEQ ID NO: 62298 - DNA, 25 bp, Homo sapien
gtcatccggagcaagggtcttcaga

SEQ ID NO: 62299 - DNA, 25 bp, Homo sapien
gcatcggacacatggcaggtgttcc

SEQ ID NO: 62300 - DNA, 25 bp, Homo sapien
ggcacctccatcactttgaaatgtc

SEQ ID NO: 62301 - DNA, 25 bp, Homo sapien
gcggctgcgttgaaactaacaaaaa

SEQ ID NO: 62302 - DNA, 25 bp, Homo sapien
ccctccgctgtcagtaggtgccgaa

SEQ ID NO: 62303 - DNA, 25 bp, Homo sapien
tggcatgcactctcctcctggtcat

SEQ ID NO: 62304 - DNA, 25 bp, Homo sapien
agcccggctctctgtttaacaacca

SEQ ID NO: 62305 - DNA, 25 bp, Homo sapien
tcatctcatttggtttggaaacggc

SEQ ID NO: 62306 - DNA, 25 bp, Homo sapien
gcttgcagttctggcagctgtcgta

SEQ ID NO: 62307 - DNA, 25 bp, Homo sapien
tcgggccgatacttgagccagcaga

SEQ ID NO: 62308 - DNA, 25 bp, Homo sapien
tttgcactcgtagtcctcaagcgga

SEQ ID NO: 62309 - DNA, 25 bp, Homo sapien
tcctggcagaaggtgtgcaagcacg

SEQ ID NO: 62310 - DNA, 25 bp, Homo sapien
ccgccgtagtggttgacgaagatga

SEQ ID NO: 62311 - DNA, 25 bp, Homo sapien
cgaccgagaagagtgccaggatgct

SEQ ID NO: 62312 - DNA, 25 bp, Homo sapien
gagccagcagatgacccaggtgaca

SEQ ID NO: 62313 - DNA, 25 bp, Homo sapien
tccgcgtcgaagtagttgtagcaga

SEQ ID NO: 62314 - DNA, 25 bp, Homo sapien
gggcaaccgggtctattgagatatc

SEQ ID NO: 62315 - DNA, 25 bp, Homo sapien
ggccttccagtaaccaggatgccac

SEQ ID NO: 62316 - DNA, 25 bp, Homo sapien
ctccgtccagttacaggcggtcctg

SEQ ID NO: 62317 - DNA, 25 bp, Homo sapien
tgccagcaaatatgtaagagttacg

SEQ ID NO: 62318 - DNA, 25 bp, Homo sapien
gtccatttagagacttcccactttc

SEQ ID NO: 62319 - DNA, 25 bp, Homo sapien
tagttaaattcacgtagatgccagc

SEQ ID NO: 62320 - DNA, 25 bp, Homo sapien
ccagacgctttcaatgcagtccatt

SEQ ID NO: 62321 - DNA, 25 bp, Homo sapien
cgcagttcggagatcggcactcctc

SEQ ID NO: 62322 - DNA, 25 bp, Homo sapien
cagtcggcatggtgtgtcgaactca

SEQ ID NO: 62323 - DNA, 25 bp, Homo sapien
gagcagatcacgcttcacgctgaca

SEQ ID NO: 62324 - DNA, 25 bp, Homo sapien
taggacccgcctcttcttgtgcgtg

SEQ ID NO: 62325 - DNA, 25 bp, Homo sapien
atgccggttccgaggctaccacagc

SEQ ID NO: 62326 - DNA, 25 bp, Homo sapien
ccttcaggaaggcatgaatgtcgcc

SEQ ID NO: 62327 - DNA, 25 bp, Homo sapien
tgtcgccacattgcccttttggagg

SEQ ID NO: 62328 - DNA, 25 bp, Homo sapien
gtatagggccgccactcactgtagg

SEQ ID NO: 62329 - DNA, 25 bp, Homo sapien
ccgggcttccctagcgaagcgcgta

SEQ ID NO: 62330 - DNA, 25 bp, Homo sapien
ggcacttcccacaggcgccgcagag

SEQ ID NO: 62331 - DNA, 25 bp, Homo sapien
ccgctcaacatccagctggcgcggc

SEQ ID NO: 62332 - DNA, 25 bp, Homo sapien
ggtagagtttgcaccgctcaacatc

SEQ ID NO: 62333 - DNA, 25 bp, Homo sapien
catgaaggtagagtttgcaccgctc

SEQ ID NO: 62334 - DNA, 25 bp, Homo sapien
cggccaggccatgaaggtagagttt

SEQ ID NO: 62335 - DNA, 25 bp, Homo sapien
tcccacgcggcgcactctcgccaac

SEQ ID NO: 62336 - DNA, 25 bp, Homo sapien
gctcgggctggctgccagttgaccc

SEQ ID NO: 62337 - DNA, 25 bp, Homo sapien
ccaggccatgaaggtagagtttgca

SEQ ID NO: 62338 - DNA, 25 bp, Homo sapien
gtcccaggcggttccgctcaacaga

SEQ ID NO: 62339 - DNA, 25 bp, Homo sapien
cgggctgcgacactgcagttgtcta

SEQ ID NO: 62340 - DNA, 25 bp, Homo sapien
tgtccgtggaaggagactcagccct

SEQ ID NO: 62341 - DNA, 25 bp, Homo sapien
ctcagccctgcgatttcggaaaacc

SEQ ID NO: 62342 - DNA, 25 bp, Homo sapien
tctctgcataggcaacgagtgccgg

SEQ ID NO: 62343 - DNA, 25 bp, Homo sapien
caatgggtggcagcctctctgcata

SEQ ID NO: 62344 - DNA, 25 bp, Homo sapien
gctcaacagacgctgctgtggctgc

SEQ ID NO: 62345 - DNA, 25 bp, Homo sapien
ggctccgcggaatgacccgtagtaa

SEQ ID NO: 62346 - DNA, 25 bp, Homo sapien
tgtcctgcaccctctgttccatgga

SEQ ID NO: 62347 - DNA, 25 bp, Homo sapien
tctggttgtcatgtccttctacggc

SEQ ID NO: 62348 - DNA, 25 bp, Homo sapien
ctacggcattttcttgatcggaatc

SEQ ID NO: 62349 - DNA, 25 bp, Homo sapien
gcctcctgctgctgtacaaagacga

SEQ ID NO: 62350 - DNA, 25 bp, Homo sapien
cagcggcaatggcaacgagtacttc

SEQ ID NO: 62351 - DNA, 25 bp, Homo sapien
cggacgtgcacctcaccattcagga

SEQ ID NO: 62352 - DNA, 25 bp, Homo sapien
cagacgatgagctggaggagacctc

SEQ ID NO: 62353 - DNA, 25 bp, Homo sapien
ctgggctacatgaaatccaagaggc

SEQ ID NO: 62354 - DNA, 25 bp, Homo sapien
ccaggcacgacaggctgagcaagga

SEQ ID NO: 62355 - DNA, 25 bp, Homo sapien
gagccatgcctttccgggatgccca

SEQ ID NO: 62356 - DNA, 25 bp, Homo sapien
gcccagtagagctttgcatctcttg

SEQ ID NO: 62357 - DNA, 25 bp, Homo sapien
cttggatatctttcccgggcgcaga

SEQ ID NO: 62358 - DNA, 25 bp, Homo sapien
tcgccattgcgctggaaagtcctcc

SEQ ID NO: 62359 - DNA, 25 bp, Homo sapien
agtgtcacacagtcgcctctggcga

SEQ ID NO: 62360 - DNA, 25 bp, Homo sapien
atgcccaccgccagtcaaagggttg

SEQ ID NO: 62361 - DNA, 25 bp, Homo sapien
ttggcagacccagtttccgcaaggc

SEQ ID NO: 62362 - DNA, 25 bp, Homo sapien
gcccggcttagaccatggctgcttc

SEQ ID NO: 62363 - DNA, 25 bp, Homo sapien
acctggcaaagatacttccgataca

SEQ ID NO: 62364 - DNA, 25 bp, Homo sapien
tccgcaaacgtttatcaaacctggc

SEQ ID NO: 62365 - DNA, 25 bp, Homo sapien
gagtgtgtcctgtattccttccgca

SEQ ID NO: 62366 - DNA, 25 bp, Homo sapien
acaccggggacttttcgcgattctg

SEQ ID NO: 62367 - DNA, 25 bp, Homo sapien
gcacctggagcgaatgcacctgcgc

SEQ ID NO: 62368 - DNA, 25 bp, Homo sapien
actgaaagtgtgcagactcctccca

SEQ ID NO: 62369 - DNA, 25 bp, Homo sapien
ttccgatacactcgcagaaagtgcc

SEQ ID NO: 62370 - DNA, 25 bp, Homo sapien
tggagtggatttcggccgccatgtt

SEQ ID NO: 62371 - DNA, 25 bp, Homo sapien
acgaaggtcccaggctagtgcgaca

SEQ ID NO: 62372 - DNA, 25 bp, Homo sapien
ccaggctagtgcgacaccgcaggtc

SEQ ID NO: 62373 - DNA, 25 bp, Homo sapien
cagcgcggtgagacagagttcccgc

SEQ ID NO: 62374 - DNA, 25 bp, Homo sapien
agcattggaacaggggtcctgagca

SEQ ID NO: 62375 - DNA, 25 bp, Homo sapien
tcctgggctggaaagacacgttgga

SEQ ID NO: 62376 - DNA, 25 bp, Homo sapien
ggcagcccatcagctgacgcctggg

SEQ ID NO: 62377 - DNA, 25 bp, Homo sapien
cccaggctggaaaggtgcaagtcga

SEQ ID NO: 62378 - DNA, 25 bp, Homo sapien
tccgggctggtaagattgctgcagc

SEQ ID NO: 62379 - DNA, 25 bp, Homo sapien
aacgccctcaagtccggatcattgg

SEQ ID NO: 62380 - DNA, 25 bp, Homo sapien
actagcgcaagcgtagcctcaaggc

SEQ ID NO: 62381 - DNA, 25 bp, Homo sapien
gacactggcccgactactttcgttc

SEQ ID NO: 62382 - DNA, 25 bp, Homo sapien
ttttctctcgtgcaatggcgtccgg

SEQ ID NO: 62383 - DNA, 25 bp, Homo sapien
cgccttccgcttccagaaggagtta

SEQ ID NO: 62384 - DNA, 25 bp, Homo sapien
cggtcgcagacactgggtcttcttc

SEQ ID NO: 62385 - DNA, 25 bp, Homo sapien
aagtttgcgatggagacacccgtga

SEQ ID NO: 62386 - DNA, 25 bp, Homo sapien
tcagtcctccgggtgatggggaaac

SEQ ID NO: 62387 - DNA, 25 bp, Homo sapien
ggtgctcccagctgcgggtatcact

SEQ ID NO: 62388 - DNA, 25 bp, Homo sapien
agctgcgggtatcactggacgccac

SEQ ID NO: 62389 - DNA, 25 bp, Homo sapien
ccgcgggaggctgagaaagttctct

SEQ ID NO: 62390 - DNA, 25 bp, Homo sapien
gaataccagggctcgtaccgcgtcc

SEQ ID NO: 62391 - DNA, 25 bp, Homo sapien
taccgcgtccctgagacgcagggca

SEQ ID NO: 62392 - DNA, 25 bp, Homo sapien
cagagggcgccctgagacagcgctc

SEQ ID NO: 62393 - DNA, 25 bp, Homo sapien
acgcagggcatgtcgtcttggctgc

SEQ ID NO: 62394 - DNA, 25 bp, Homo sapien
gcaccagcaccatctaggggcgcta

SEQ ID NO: 62395 - DNA, 25 bp, Homo sapien
agcagctaggctctgcattgcaggg

SEQ ID NO: 62396 - DNA, 25 bp, Homo sapien
gctctgcattgcaggggtcccaccg

SEQ ID NO: 62397 - DNA, 25 bp, Homo sapien
tccctcggctgagcagctaggctct

SEQ ID NO: 62398 - DNA, 25 bp, Homo sapien
ctccgctggcatccgtgggtcgccg

SEQ ID NO: 62399 - DNA, 25 bp, Homo sapien
cagcaccatctaggggcgctacgac

SEQ ID NO: 62400 - DNA, 25 bp, Homo sapien
tctaggggcgctacgacagcaggaa

SEQ ID NO: 62401 - DNA, 25 bp, Homo sapien
tgcattgcaggggtcccaccgggcc

SEQ ID NO: 62402 - DNA, 25 bp, Homo sapien
gcactatcccggaaagcttcctgga

SEQ ID NO: 62403 - DNA, 25 bp, Homo sapien
acacagggctggctggattcgcctc

SEQ ID NO: 62404 - DNA, 25 bp, Homo sapien
gctggctggattcgcctctcggcca

SEQ ID NO: 62405 - DNA, 25 bp, Homo sapien
cggccacagctctgcgctccacgag

SEQ ID NO: 62406 - DNA, 25 bp, Homo sapien
caagaccgaggacgcgccgagccga

SEQ ID NO: 62407 - DNA, 25 bp, Homo sapien
gggacctggtccatccggttctgat

SEQ ID NO: 62408 - DNA, 25 bp, Homo sapien
ccatccggttctgatggggtccgca

SEQ ID NO: 62409 - DNA, 25 bp, Homo sapien
aaggacgccgaagcgtagcgtcccg

SEQ ID NO: 62410 - DNA, 25 bp, Homo sapien
ctccgcctgagcgagacgagatccg

SEQ ID NO: 62411 - DNA, 25 bp, Homo sapien
gagactcaccggaaaggcccggatc

SEQ ID NO: 62412 - DNA, 25 bp, Homo sapien
ccggatccgcatcttggtgtccttc

SEQ ID NO: 62413 - DNA, 25 bp, Homo sapien
tttgctcagattcgacatggtgctc

SEQ ID NO: 62414 - DNA, 25 bp, Homo sapien
cgcgacgccggtgtcacatttaagg

SEQ ID NO: 62415 - DNA, 25 bp, Homo sapien
atctcactgcgcaggccgaacgtcg

SEQ ID NO: 62416 - DNA, 25 bp, Homo sapien
gggacgctcagatctcgcgagaaga

SEQ ID NO: 62417 - DNA, 25 bp, Homo sapien
ggcggcgacggacaaacatctcact

SEQ ID NO: 62418 - DNA, 25 bp, Homo sapien
tgagcgtcccgcgtgcacaaacgcg

SEQ ID NO: 62419 - DNA, 25 bp, Homo sapien
tctcaacaggctccgggtgaacctg

SEQ ID NO: 62420 - DNA, 25 bp, Homo sapien
cgaagactttccaaactctgcgctc

SEQ ID NO: 62421 - DNA, 25 bp, Homo sapien
tatccacccgccgttcaggaagcgg

SEQ ID NO: 62422 - DNA, 25 bp, Homo sapien
tcaactcgcaagaggcgggtttttc

SEQ ID NO: 62423 - DNA, 25 bp, Homo sapien
tcttcctcgctcaactcgcaagagg

SEQ ID NO: 62424 - DNA, 25 bp, Homo sapien
tccctcctctgaagcttctcgaaga

SEQ ID NO: 62425 - DNA, 25 bp, Homo sapien
tcaggaagcggaactcggagccttc

SEQ ID NO: 62426 - DNA, 25 bp, Homo sapien
ccttacgacgctgtgcattcgggca

SEQ ID NO: 62427 - DNA, 25 bp, Homo sapien
actcagctgagcacatctttcgatg

SEQ ID NO: 62428 - DNA, 25 bp, Homo sapien
tacatcgagatggtggggaacattc

SEQ ID NO: 62429 - DNA, 25 bp, Homo sapien
gggccaagacgccaaatgtgacttc

SEQ ID NO: 62430 - DNA, 25 bp, Homo sapien
agctgttcttcgcagtgtgctactc

SEQ ID NO: 62431 - DNA, 25 bp, Homo sapien
ttggacttcgccaaggcctcagtgc

SEQ ID NO: 62432 - DNA, 25 bp, Homo sapien
cccggccatgcgaaactggagaaag

SEQ ID NO: 62433 - DNA, 25 bp, Homo sapien
tcttacatgaaacagccagccgggg

SEQ ID NO: 62434 - DNA, 25 bp, Homo sapien
gaatacagctgagggcacaacgtcc

SEQ ID NO: 62435 - DNA, 25 bp, Homo sapien
gacgaaggaacgtggcctcgtagta

SEQ ID NO: 62436 - DNA, 25 bp, Homo sapien
caaaatggggctcgtcacatggtta

SEQ ID NO: 62437 - DNA, 25 bp, Homo sapien
catggttacggcctggatttttctc

SEQ ID NO: 62438 - DNA, 25 bp, Homo sapien
gtgggctggttggactttttcattc

SEQ ID NO: 62439 - DNA, 25 bp, Homo sapien
cgcggctcagccgtttcacatgctg

SEQ ID NO: 62440 - DNA, 25 bp, Homo sapien
tcgcggatctcgagaccggaagacg

SEQ ID NO: 62441 - DNA, 25 bp, Homo sapien
aagagcaagtgtgtgtttccggccc

SEQ ID NO: 62442 - DNA, 25 bp, Homo sapien
agcgctccggatttctccaacttca

SEQ ID NO: 62443 - DNA, 25 bp, Homo sapien
agtccgagaatccaccgcggccttt

SEQ ID NO: 62444 - DNA, 25 bp, Homo sapien
cgcgccttttatagccgagcgtgac

SEQ ID NO: 62445 - DNA, 25 bp, Homo sapien
tgaggagccctgagtaaaacatcgc

SEQ ID NO: 62446 - DNA, 25 bp, Homo sapien
gtggatgaactgcaccgcctgcttc

SEQ ID NO: 62447 - DNA, 25 bp, Homo sapien
ttggacgagcccagcttcttgaggc

SEQ ID NO: 62448 - DNA, 25 bp, Homo sapien
gtgactcagtgaaagccgcaacggc

SEQ ID NO: 62449 - DNA, 25 bp, Homo sapien
tgctcggcttctcagaaacgcacct

SEQ ID NO: 62450 - DNA, 25 bp, Homo sapien
agcctggtaccagctgtcttgctcg

SEQ ID NO: 62451 - DNA, 25 bp, Homo sapien
gagccaccaggtgcttgttcttgga

SEQ ID NO: 62452 - DNA, 25 bp, Homo sapien
cagcccgcttgttgatgttgaagca

SEQ ID NO: 62453 - DNA, 25 bp, Homo sapien
ccgcgcgcagtacgaagaagcgttt

SEQ ID NO: 62454 - DNA, 25 bp, Homo sapien
ttgcgcacgtccgagaagccatcgc

SEQ ID NO: 62455 - DNA, 25 bp, Homo sapien
gcagcgattcccgaggcaaattaaa

SEQ ID NO: 62456 - DNA, 25 bp, Homo sapien
cgggttgccaagtcccaacgttgca

SEQ ID NO: 62457 - DNA, 25 bp, Homo sapien
cccttagcacggttgtgcagctgta

SEQ ID NO: 62458 - DNA, 25 bp, Homo sapien
gcgagggtccacactctccttactg

SEQ ID NO: 62459 - DNA, 25 bp, Homo sapien
acgggaacgacgtgcccacactcgg

SEQ ID NO: 62460 - DNA, 25 bp, Homo sapien
agcttcccggcagagaacctgggca

SEQ ID NO: 62461 - DNA, 25 bp, Homo sapien
cccttgaacgcaggtcgcttgtttg

SEQ ID NO: 62462 - DNA, 25 bp, Homo sapien
tcagcggccagtggctatttatggc

SEQ ID NO: 62463 - DNA, 25 bp, Homo sapien
cgtagagagcgtgagtttccgcgtc

SEQ ID NO: 62464 - DNA, 25 bp, Homo sapien
ggtcttgtcgaagttgccgcatctc

SEQ ID NO: 62465 - DNA, 25 bp, Homo sapien
cgcttgtttgccttacgcgtagtca

SEQ ID NO: 62466 - DNA, 25 bp, Homo sapien
ttgaagccacaaccaaaaagcctgg

SEQ ID NO: 62467 - DNA, 25 bp, Homo sapien
gggcgggacctgagccacgtcttcc

SEQ ID NO: 62468 - DNA, 25 bp, Homo sapien
tagaagggacactgcctggtaagtt

SEQ ID NO: 62469 - DNA, 25 bp, Homo sapien
tcctgggcacgatgcccgggtagaa

SEQ ID NO: 62470 - DNA, 25 bp, Homo sapien
ggaccttgggagcatcacctcctta

SEQ ID NO: 62471 - DNA, 25 bp, Homo sapien
tcccgcttaatctgggcagggccgc

SEQ ID NO: 62472 - DNA, 25 bp, Homo sapien
gaggcgagctttccagccgggctcc

SEQ ID NO: 62473 - DNA, 25 bp, Homo sapien
aacaagcggggcctcccgagtgcag

SEQ ID NO: 62474 - DNA, 25 bp, Homo sapien
gtttcgcccacaacaaagatgtctg

SEQ ID NO: 62475 - DNA, 25 bp, Homo sapien
tcgcttaccgtggagccgttccagt

SEQ ID NO: 62476 - DNA, 25 bp, Homo sapien
gcgtcacatgaccacgaacactctt

SEQ ID NO: 62477 - DNA, 25 bp, Homo sapien
ggtagtgtctccctgacccgagtcc

SEQ ID NO: 62478 - DNA, 25 bp, Homo sapien
tttgggcgaacctcttcaccttgtg

SEQ ID NO: 62479 - DNA, 25 bp, Homo sapien
tcttcaccttgtgtggttcggcgtc

SEQ ID NO: 62480 - DNA, 25 bp, Homo sapien
tcggcgtctccttttgtgtattaac

SEQ ID NO: 62481 - DNA, 25 bp, Homo sapien
agatgtctgcgcatcgcttaccgtg

SEQ ID NO: 62482 - DNA, 25 bp, Homo sapien
tcccgcacaaccgaaagtgcttcga

SEQ ID NO: 62483 - DNA, 25 bp, Homo sapien
atgctgcgggacatgaccggcctcc

SEQ ID NO: 62484 - DNA, 25 bp, Homo sapien
aagtgcttcgactgcgaccagcgcg

SEQ ID NO: 62485 - DNA, 25 bp, Homo sapien
gtccatgcgggtcctttgtgtgccc

SEQ ID NO: 62486 - DNA, 25 bp, Homo sapien
ctacgttaacatgacggtcggctcc

SEQ ID NO: 62487 - DNA, 25 bp, Homo sapien
ggctccttcgtgtgtacctcctgct

SEQ ID NO: 62488 - DNA, 25 bp, Homo sapien
gaggagaagcacctgaagatgctgc

SEQ ID NO: 62489 - DNA, 25 bp, Homo sapien
cgagggtttacgttctgggcagcct

SEQ ID NO: 62490 - DNA, 25 bp, Homo sapien
cactgcggctccagagcgaagggct

SEQ ID NO: 62491 - DNA, 25 bp, Homo sapien
tccgcgctccgggtttccgcggtca

SEQ ID NO: 62492 - DNA, 25 bp, Homo sapien
gtcaccagcactggcggaagagccc

SEQ ID NO: 62493 - DNA, 25 bp, Homo sapien
cactggcggaagagccctgccgaga

SEQ ID NO: 62494 - DNA, 25 bp, Homo sapien
ctttgcgcaaccttcccgaggcgtc

SEQ ID NO: 62495 - DNA, 25 bp, Homo sapien
gcagtgcgcactgcggctccagagc

SEQ ID NO: 62496 - DNA, 25 bp, Homo sapien
gcccgccagattctaaacgtgctcg

SEQ ID NO: 62497 - DNA, 25 bp, Homo sapien
agattctaaacgtgctcggctgccg

SEQ ID NO: 62498 - DNA, 25 bp, Homo sapien
acgctttgcatatgcgaatccgggc

SEQ ID NO: 62499 - DNA, 25 bp, Homo sapien
cgacactgctaagaccgagggatga

SEQ ID NO: 62500 - DNA, 25 bp, Homo sapien
agggatgacggtgcttcttcaatta

SEQ ID NO: 62501 - DNA, 25 bp, Homo sapien
ctcctcacgcggctcagagtgtagc

SEQ ID NO: 62502 - DNA, 25 bp, Homo sapien
cccgagatattcttacctacagaag

SEQ ID NO: 62503 - DNA, 25 bp, Homo sapien
cagaagggagtgtctgttcaccaaa

SEQ ID NO: 62504 - DNA, 25 bp, Homo sapien
tgttcaccaaatcgctcacttgccg

SEQ ID NO: 62505 - DNA, 25 bp, Homo sapien
ctgtcggatggatccaggcgctctt

SEQ ID NO: 62506 - DNA, 25 bp, Homo sapien
gtattacccgccaggtacgcaccag

SEQ ID NO: 62507 - DNA, 25 bp, Homo sapien
ctgctccggtattacccgccaggta

SEQ ID NO: 62508 - DNA, 25 bp, Homo sapien
tcaagagcctcctgctccggtatta

SEQ ID NO: 62509 - DNA, 25 bp, Homo sapien
gcaagaaaatgaagctcaagagcct

SEQ ID NO: 62510 - DNA, 25 bp, Homo sapien
tacgaagcccatcggccggggataa

SEQ ID NO: 62511 - DNA, 25 bp, Homo sapien
cccgctgctgtttagccgtttccaa

SEQ ID NO: 62512 - DNA, 25 bp, Homo sapien
gcggagccagacctcccagctctgc

SEQ ID NO: 62513 - DNA, 25 bp, Homo sapien
cgtttccaaggctacgaagcccatc

SEQ ID NO: 62514 - DNA, 25 bp, Homo sapien
gataagtctgtggtgctaggaccca

SEQ ID NO: 62515 - DNA, 25 bp, Homo sapien
gggtcttaccttggtaccgagagca

SEQ ID NO: 62516 - DNA, 25 bp, Homo sapien
acggagtttgatcgacatggtattg

SEQ ID NO: 62517 - DNA, 25 bp, Homo sapien
aggctgggccggacttatttacaag

SEQ ID NO: 62518 - DNA, 25 bp, Homo sapien
gccatccattgttggtgggcgccca

SEQ ID NO: 62519 - DNA, 25 bp, Homo sapien
tgagcgactcacaacgcggaacgga

SEQ ID NO: 62520 - DNA, 25 bp, Homo sapien
cgagagcagggagttgccatccatt

SEQ ID NO: 62521 - DNA, 25 bp, Homo sapien
cccgtgcaaaccgaagcgctctggg

SEQ ID NO: 62522 - DNA, 25 bp, Homo sapien
ctcagctgccggcaacttgtgggca

SEQ ID NO: 62523 - DNA, 25 bp, Homo sapien
ctgccggcaacttgtgggcacggcc

SEQ ID NO: 62524 - DNA, 25 bp, Homo sapien
cggcgctcagctgccggcaacttgt

SEQ ID NO: 62525 - DNA, 25 bp, Homo sapien
ttccagccctgggttttggcagagg

SEQ ID NO: 62526 - DNA, 25 bp, Homo sapien
cgctttacatctggggtcggtgtcc

SEQ ID NO: 62527 - DNA, 25 bp, Homo sapien
agacgctggcgagactgtcgatcgc

SEQ ID NO: 62528 - DNA, 25 bp, Homo sapien
tgccacatcttccagccctgggttt

SEQ ID NO: 62529 - DNA, 25 bp, Homo sapien
gctggggtcccgctttacatctggg

SEQ ID NO: 62530 - DNA, 25 bp, Homo sapien
ctcttgcacggacaggggccgacac

SEQ ID NO: 62531 - DNA, 25 bp, Homo sapien
ccgcgtgctggttccgttagccagc

SEQ ID NO: 62532 - DNA, 25 bp, Homo sapien
agcccttgagtttgggcgtctccgg

SEQ ID NO: 62533 - DNA, 25 bp, Homo sapien
cgagctgcagcagctacagggctga

SEQ ID NO: 62534 - DNA, 25 bp, Homo sapien
catgttgaggttggaacgagctgca

SEQ ID NO: 62535 - DNA, 25 bp, Homo sapien
tgtgctgcgtttcctctgagttttg

SEQ ID NO: 62536 - DNA, 25 bp, Homo sapien
ctgtgtcatctccacgtgaccggca

SEQ ID NO: 62537 - DNA, 25 bp, Homo sapien
tgggagccaggagtctgtgtcatct

SEQ ID NO: 62538 - DNA, 25 bp, Homo sapien
cgaagtcacgggtgtgtccagaagc

SEQ ID NO: 62539 - DNA, 25 bp, Homo sapien
tccacgcgggccaagagactggatc

SEQ ID NO: 62540 - DNA, 25 bp, Homo sapien
gactggatccatcttcttcccaaag

SEQ ID NO: 62541 - DNA, 25 bp, Homo sapien
tcccaaagtgggaaagcctgtgtca

SEQ ID NO: 62542 - DNA, 25 bp, Homo sapien
caggcgtgcccattgtcgggcagca

SEQ ID NO: 62543 - DNA, 25 bp, Homo sapien
tgtgtccagaagcagccctggtaca

SEQ ID NO: 62544 - DNA, 25 bp, Homo sapien
cactcagtggccaaccggagcgtct

SEQ ID NO: 62545 - DNA, 25 bp, Homo sapien
cgggcaccgctcaagtggttcttgg

SEQ ID NO: 62546 - DNA, 25 bp, Homo sapien
cggctccgggttccttcaattatca

SEQ ID NO: 62547 - DNA, 25 bp, Homo sapien
gcgatgacacaaccgggcttcctgg

SEQ ID NO: 62548 - DNA, 25 bp, Homo sapien
gccggagactctctttgaaactgta

SEQ ID NO: 62549 - DNA, 25 bp, Homo sapien
ttctgccagctcataagcgtggttc

SEQ ID NO: 62550 - DNA, 25 bp, Homo sapien
ccctccgtggtagcaggaactaatt

SEQ ID NO: 62551 - DNA, 25 bp, Homo sapien
atctacttggtatccctccgccggg

SEQ ID NO: 62552 - DNA, 25 bp, Homo sapien
ggtggcgcggcagtaacttccacta

SEQ ID NO: 62553 - DNA, 25 bp, Homo sapien
aagggccctcctcattgcgggaagc

SEQ ID NO: 62554 - DNA, 25 bp, Homo sapien
gagcctcaatcggaagcgctaaggg

SEQ ID NO: 62555 - DNA, 25 bp, Homo sapien
atccctcggcgcgttcggaagccag

SEQ ID NO: 62556 - DNA, 25 bp, Homo sapien
tgcgcctcatcactgtccagttcga

SEQ ID NO: 62557 - DNA, 25 bp, Homo sapien
ttcgagtcccaaacgggcctagaga

SEQ ID NO: 62558 - DNA, 25 bp, Homo sapien
gcggtctgccctgaaccgccggtta

SEQ ID NO: 62559 - DNA, 25 bp, Homo sapien
gtgcagcggccatctgaaacctagg

SEQ ID NO: 62560 - DNA, 25 bp, Homo sapien
atttcagcctctcttgaggagcctc

SEQ ID NO: 62561 - DNA, 25 bp, Homo sapien
ggcagaacgcgcttctccagccgga

SEQ ID NO: 62562 - DNA, 25 bp, Homo sapien
ttgtcgggaggcagataccagcttt

SEQ ID NO: 62563 - DNA, 25 bp, Homo sapien
cggagcgttctggagttcaatggaa

SEQ ID NO: 62564 - DNA, 25 bp, Homo sapien
actgatttctggttaggaattgggc

SEQ ID NO: 62565 - DNA, 25 bp, Homo sapien
ccagctttgtgaccaattcaggaaa

SEQ ID NO: 62566 - DNA, 25 bp, Homo sapien
cagagaagggaacgcccggcccagc

SEQ ID NO: 62567 - DNA, 25 bp, Homo sapien
accgaacgagcagcccgaagcggcg

SEQ ID NO: 62568 - DNA, 25 bp, Homo sapien
cagtgcgcacgtcaaagccgggctc

SEQ ID NO: 62569 - DNA, 25 bp, Homo sapien
tgggagacacagagccttcaggcgc

SEQ ID NO: 62570 - DNA, 25 bp, Homo sapien
caggctcggagcaggcttctcaaac

SEQ ID NO: 62571 - DNA, 25 bp, Homo sapien
tctgcggctttcactgggccgcgtc

SEQ ID NO: 62572 - DNA, 25 bp, Homo sapien
ggctcccaggtctgcggctttcact

SEQ ID NO: 62573 - DNA, 25 bp, Homo sapien
ccaaactaggctgccgtgaggacca

SEQ ID NO: 62574 - DNA, 25 bp, Homo sapien
ttctcaaactgcagggtccacgcca

SEQ ID NO: 62575 - DNA, 25 bp, Homo sapien
aaccagaacgttccgccctgctggg

SEQ ID NO: 62576 - DNA, 25 bp, Homo sapien
ccctgacaggttagaaccagaacgt

SEQ ID NO: 62577 - DNA, 25 bp, Homo sapien
tggggcccgagactccaaactaggc

SEQ ID NO: 62578 - DNA, 25 bp, Homo sapien
tcccggaggcctcaagggccctcag

SEQ ID NO: 62579 - DNA, 25 bp, Homo sapien
gcgccgccggaacccagtttctctc

SEQ ID NO: 62580 - DNA, 25 bp, Homo sapien
gtttctctcgaggtcttcgccccga

SEQ ID NO: 62581 - DNA, 25 bp, Homo sapien
tccaggcctgcggtccgcgaacgtg

SEQ ID NO: 62582 - DNA, 25 bp, Homo sapien
tgcggtccgcgaacgtgcctcttgc

SEQ ID NO: 62583 - DNA, 25 bp, Homo sapien
tctgcaggttctcccaaccgcggga

SEQ ID NO: 62584 - DNA, 25 bp, Homo sapien
gcaggttctcccaaccgcgggaaga

SEQ ID NO: 62585 - DNA, 25 bp, Homo sapien
gcggccctgcagactgccacaaggg

SEQ ID NO: 62586 - DNA, 25 bp, Homo sapien
tagccggactcccttttcctatata

SEQ ID NO: 62587 - DNA, 25 bp, Homo sapien
ccaggttcggtaaccactgggcgtg

SEQ ID NO: 62588 - DNA, 25 bp, Homo sapien
tgctaaaatctggagacgtggaatc

SEQ ID NO: 62589 - DNA, 25 bp, Homo sapien
atgcgccatcgccaggcggcttttg

SEQ ID NO: 62590 - DNA, 25 bp, Homo sapien
gcttttggtcacaggctcccgagtt

SEQ ID NO: 62591 - DNA, 25 bp, Homo sapien
ctccagggaccctaggttttctatg

SEQ ID NO: 62592 - DNA, 25 bp, Homo sapien
tgcagcagagatttacccgagcgtg

SEQ ID NO: 62593 - DNA, 25 bp, Homo sapien
aaagcggctccacgtgttccatctc

SEQ ID NO: 62594 - DNA, 25 bp, Homo sapien
gccaaaagctgaagtccgaagagtg

SEQ ID NO: 62595 - DNA, 25 bp, Homo sapien
cgcagccatggtgaagattagcttc

SEQ ID NO: 62596 - DNA, 25 bp, Homo sapien
aagattagcttccagcccgccgtgg

SEQ ID NO: 62597 - DNA, 25 bp, Homo sapien
gtcccgtactaaagcggcagccaaa

SEQ ID NO: 62598 - DNA, 25 bp, Homo sapien
gtgctcgaggtctcttccaaaagtg

SEQ ID NO: 62599 - DNA, 25 bp, Homo sapien
gtacgcgtctggttccaatcaactg

SEQ ID NO: 62600 - DNA, 25 bp, Homo sapien
tgctggcctgcaccggaattgacag

SEQ ID NO: 62601 - DNA, 25 bp, Homo sapien
gtctcgaatggttgcttatcccaga

SEQ ID NO: 62602 - DNA, 25 bp, Homo sapien
gttgatcatttcctgtccgctgagg

SEQ ID NO: 62603 - DNA, 25 bp, Homo sapien
ccgagaggagaagctgttgatcatt

SEQ ID NO: 62604 - DNA, 25 bp, Homo sapien
agtccacgtggatccgagaggagaa

SEQ ID NO: 62605 - DNA, 25 bp, Homo sapien
tttgggaatagaattccacctttgc

SEQ ID NO: 62606 - DNA, 25 bp, Homo sapien
agtcacgcggttccgggactttgca

SEQ ID NO: 62607 - DNA, 25 bp, Homo sapien
tctggtggccggtgacgctcagcca

SEQ ID NO: 62608 - DNA, 25 bp, Homo sapien
taactcatccggagtcacgcggttc

SEQ ID NO: 62609 - DNA, 25 bp, Homo sapien
cccggagattccttgagtccacgtg

SEQ ID NO: 62610 - DNA, 25 bp, Homo sapien
ccagcaagtgcacagggtctccctg

SEQ ID NO: 62611 - DNA, 25 bp, Homo sapien
agggcaccctggacttccaagcgcg

SEQ ID NO: 62612 - DNA, 25 bp, Homo sapien
tgctgctgatcagcgggctctggaa

SEQ ID NO: 62613 - DNA, 25 bp, Homo sapien
agcctgcagagctttccaggagaca

SEQ ID NO: 62614 - DNA, 25 bp, Homo sapien
ccaggagacactgcagccgatcagc

SEQ ID NO: 62615 - DNA, 25 bp, Homo sapien
gaacgctcaaacacgcagccctgga

SEQ ID NO: 62616 - DNA, 25 bp, Homo sapien
tccatgaactgcgacgactgcccgg

SEQ ID NO: 62617 - DNA, 25 bp, Homo sapien
cttcaccaagaagtcgcggcgctcg

SEQ ID NO: 62618 - DNA, 25 bp, Homo sapien
ttccgctgacagaaaagtctctgga

SEQ ID NO: 62619 - DNA, 25 bp, Homo sapien
cccaaagaaagaaacggcaaagctg

SEQ ID NO: 62620 - DNA, 25 bp, Homo sapien
agaaacggcaaagctgccaccgcct

SEQ ID NO: 62621 - DNA, 25 bp, Homo sapien
ctgctcgccggcgacggtctgacta

SEQ ID NO: 62622 - DNA, 25 bp, Homo sapien
cgacggtctgactagcaggcgctct

SEQ ID NO: 62623 - DNA, 25 bp, Homo sapien
caggcgctctggaggcatccggacc

SEQ ID NO: 62624 - DNA, 25 bp, Homo sapien
taaacactcttcctggccctgcctg

SEQ ID NO: 62625 - DNA, 25 bp, Homo sapien
aacaggcgctgttccgctgacagaa

SEQ ID NO: 62626 - DNA, 25 bp, Homo sapien
gccgcccttccaggcgttggtggaa

SEQ ID NO: 62627 - DNA, 25 bp, Homo sapien
ttattgagcaccgaggtaaactgag

SEQ ID NO: 62628 - DNA, 25 bp, Homo sapien
ttcccttattgagcaccgaggtaaa

SEQ ID NO: 62629 - DNA, 25 bp, Homo sapien
tttggccattcccttattgagcacc

SEQ ID NO: 62630 - DNA, 25 bp, Homo sapien
agccgggcaaccaggtgagactgcg

SEQ ID NO: 62631 - DNA, 25 bp, Homo sapien
cgctggtcttcgtgctgtgccgcgc

SEQ ID NO: 62632 - DNA, 25 bp, Homo sapien
agccaggcctcgcagctagcggaga

SEQ ID NO: 62633 - DNA, 25 bp, Homo sapien
cgctcgccgctggtcttcgtgctgt

SEQ ID NO: 62634 - DNA, 25 bp, Homo sapien
ctgccaggtaggtggatccagccat

SEQ ID NO: 62635 - DNA, 25 bp, Homo sapien
ttactctaaaaacgtgtggctcgtg

SEQ ID NO: 62636 - DNA, 25 bp, Homo sapien
ctcgtgtgttgtacgtgaaacagcc

SEQ ID NO: 62637 - DNA, 25 bp, Homo sapien
gcgtttcgcatctctgctcccatga

SEQ ID NO: 62638 - DNA, 25 bp, Homo sapien
atgctctgggcagctcggaaaccac

SEQ ID NO: 62639 - DNA, 25 bp, Homo sapien
cagagatttgattcccgggctccca

SEQ ID NO: 62640 - DNA, 25 bp, Homo sapien
aaacccggggatttgaatgcctgca

SEQ ID NO: 62641 - DNA, 25 bp, Homo sapien
cctcgtgctgagtagccgtaaaatc

SEQ ID NO: 62642 - DNA, 25 bp, Homo sapien
ggactcctgacctcgaggaggttta

SEQ ID NO: 62643 - DNA, 25 bp, Homo sapien
tataccgccgcgcagaagacgcagg

SEQ ID NO: 62644 - DNA, 25 bp, Homo sapien
cttctctggcttgagggaatcgagc

SEQ ID NO: 62645 - DNA, 25 bp, Homo sapien
ctgacagatacactgcgcagctgga

SEQ ID NO: 62646 - DNA, 25 bp, Homo sapien
gcagccatgatcacctcggccggtg

SEQ ID NO: 62647 - DNA, 25 bp, Homo sapien
ccgcgccggcttttagctgagtcag

SEQ ID NO: 62648 - DNA, 25 bp, Homo sapien
gatcaggtcactgcgtgcttctctg

SEQ ID NO: 62649 - DNA, 25 bp, Homo sapien
gtgttctctgtgtacccttccgcga

SEQ ID NO: 62650 - DNA, 25 bp, Homo sapien
ctgggctgtggaccctcacttccgc

SEQ ID NO: 62651 - DNA, 25 bp, Homo sapien
gcgtgaaccttcaccactgctgggc

SEQ ID NO: 62652 - DNA, 25 bp, Homo sapien
agggatctttcttcggcaagggccg

SEQ ID NO: 62653 - DNA, 25 bp, Homo sapien
ttctcgcctgcggtccagggatctt

SEQ ID NO: 62654 - DNA, 25 bp, Homo sapien
ggatgctaccacttctcgcctgcgg

SEQ ID NO: 62655 - DNA, 25 bp, Homo sapien
tgcggacctcttgttccgaggaaaa

SEQ ID NO: 62656 - DNA, 25 bp, Homo sapien
cacttccgccgccaggaagtttcgg

SEQ ID NO: 62657 - DNA, 25 bp, Homo sapien
aggctctgcggacctcttgttccga

SEQ ID NO: 62658 - DNA, 25 bp, Homo sapien
gaccaccgcccacccgtgcacacct

SEQ ID NO: 62659 - DNA, 25 bp, Homo sapien
cccacccgtgcacacctccacggga

SEQ ID NO: 62660 - DNA, 25 bp, Homo sapien
gagaccaccgcccacccgtgcacac

SEQ ID NO: 62661 - DNA, 25 bp, Homo sapien
acccgtgcacacctccacgggaggg

SEQ ID NO: 62662 - DNA, 25 bp, Homo sapien
agaccaccgcccacccgtgcacacc

SEQ ID NO: 62663 - DNA, 25 bp, Homo sapien
ccgtgcacacctccacgggagggag

SEQ ID NO: 62664 - DNA, 25 bp, Homo sapien
ccacccgtgcacacctccacgggag

SEQ ID NO: 62665 - DNA, 25 bp, Homo sapien
accgcccacccgtgcacacctccac

SEQ ID NO: 62666 - DNA, 25 bp, Homo sapien
ctactaggcgcgcttggggagccta

SEQ ID NO: 62667 - DNA, 25 bp, Homo sapien
ccctacgaatggagcggacccggca

SEQ ID NO: 62668 - DNA, 25 bp, Homo sapien
ccgggctttccctacgaatggagcg

SEQ ID NO: 62669 - DNA, 25 bp, Homo sapien
tgcgtccgggccactctcctcctct

SEQ ID NO: 62670 - DNA, 25 bp, Homo sapien
cgggactcccgggataggagatgcc

SEQ ID NO: 62671 - DNA, 25 bp, Homo sapien
atgcactgtctactaggcgcgcttg

SEQ ID NO: 62672 - DNA, 25 bp, Homo sapien
gcctcggccatgcactgtctactag

SEQ ID NO: 62673 - DNA, 25 bp, Homo sapien
gggaccccaggtcttgccggcagct

SEQ ID NO: 62674 - DNA, 25 bp, Homo sapien
gccaacaagtcgaagtctcccaaag

SEQ ID NO: 62675 - DNA, 25 bp, Homo sapien
tttgttcgctgctcctccgaaaacg

SEQ ID NO: 62676 - DNA, 25 bp, Homo sapien
tggcttacggacgagctctttgttc

SEQ ID NO: 62677 - DNA, 25 bp, Homo sapien
ggcgctggattcgaaacgcttcctg

SEQ ID NO: 62678 - DNA, 25 bp, Homo sapien
gcacagtagttaggattcaggccaa

SEQ ID NO: 62679 - DNA, 25 bp, Homo sapien
aaggggcttcttccagagccaagga

SEQ ID NO: 62680 - DNA, 25 bp, Homo sapien
cgggtcctcccactgattcctttga

SEQ ID NO: 62681 - DNA, 25 bp, Homo sapien
cggccgcaggagaaggtagattccc

SEQ ID NO: 62682 - DNA, 25 bp, Homo sapien
gccctgtacggcaaggccagctatc

SEQ ID NO: 62683 - DNA, 25 bp, Homo sapien
aaacctgttcgtgggcgatgtcctg

SEQ ID NO: 62684 - DNA, 25 bp, Homo sapien
ggagctctacccgatcgacgacgtc

SEQ ID NO: 62685 - DNA, 25 bp, Homo sapien
ggcccacgagggcttcaagactttc

SEQ ID NO: 62686 - DNA, 25 bp, Homo sapien
gctcggcccattcgcaggaaagaca

SEQ ID NO: 62687 - DNA, 25 bp, Homo sapien
tgctggcctacgaagaccgcctcta

SEQ ID NO: 62688 - DNA, 25 bp, Homo sapien
tgaccggcagccacaggaaaacctg

SEQ ID NO: 62689 - DNA, 25 bp, Homo sapien
cctcaagtggctggacatctactgc

SEQ ID NO: 62690 - DNA, 25 bp, Homo sapien
cggccgaatcccacaggaatgcgtg

SEQ ID NO: 62691 - DNA, 25 bp, Homo sapien
taaggcggcgtagacctcccagtgc

SEQ ID NO: 62692 - DNA, 25 bp, Homo sapien
catctcggcgccacccggtgcgcgc

SEQ ID NO: 62693 - DNA, 25 bp, Homo sapien
aggggacaacgcgttcggctgtcga

SEQ ID NO: 62694 - DNA, 25 bp, Homo sapien
tgccctcacccatggcgaagctgcc

SEQ ID NO: 62695 - DNA, 25 bp, Homo sapien
ccacaggaatgcgtggaatccctgc

SEQ ID NO: 62696 - DNA, 25 bp, Homo sapien
ccgaatcccacaggaatgcgtggaa

SEQ ID NO: 62697 - DNA, 25 bp, Homo sapien
aggcggcgtagacctcccagtgccg

SEQ ID NO: 62698 - DNA, 25 bp, Homo sapien
ctggggacgcatcgtcaggacacaa

SEQ ID NO: 62699 - DNA, 25 bp, Homo sapien
acacgtggggacacctggaaatgca

SEQ ID NO: 62700 - DNA, 25 bp, Homo sapien
gcacaatgcacacctggagggcaca

SEQ ID NO: 62701 - DNA, 25 bp, Homo sapien
gtgtcccgcttctgcacaatgcaca

SEQ ID NO: 62702 - DNA, 25 bp, Homo sapien
tcatggcgtacatcttctccgtgtc

SEQ ID NO: 62703 - DNA, 25 bp, Homo sapien
cactgctgcttgttcatgtacttca

SEQ ID NO: 62704 - DNA, 25 bp, Homo sapien
aagacgttgcggacctcgtcgcgct

SEQ ID NO: 62705 - DNA, 25 bp, Homo sapien
cgtgctcgatctcctgcaggatctc

SEQ ID NO: 62706 - DNA, 25 bp, Homo sapien
cagctggacggcataaggtcagccc

SEQ ID NO: 62707 - DNA, 25 bp, Homo sapien
cctgggcctgtcaggcggttccgtc

SEQ ID NO: 62708 - DNA, 25 bp, Homo sapien
tgtcaggcggttccgtccgggtctc

SEQ ID NO: 62709 - DNA, 25 bp, Homo sapien
gccaccgtcgagttccgtcgagttc

SEQ ID NO: 62710 - DNA, 25 bp, Homo sapien
ggcgtctggccatcccgaatgctat

SEQ ID NO: 62711 - DNA, 25 bp, Homo sapien
caggcagcgcgatcctgcggcgtct

SEQ ID NO: 62712 - DNA, 25 bp, Homo sapien
gcaagtgggcccatgtgtctccggc

SEQ ID NO: 62713 - DNA, 25 bp, Homo sapien
atcccgaatgctatggccgccgtcg

SEQ ID NO: 62714 - DNA, 25 bp, Homo sapien
tgactgcttggtcgcccgcaactgc

SEQ ID NO: 62715 - DNA, 25 bp, Homo sapien
ctccgtgtccagtccgcagatgaca

SEQ ID NO: 62716 - DNA, 25 bp, Homo sapien
cacccgacagctcgtccggctccag

SEQ ID NO: 62717 - DNA, 25 bp, Homo sapien
ccagtccgcagatgacaaagtagtc

SEQ ID NO: 62718 - DNA, 25 bp, Homo sapien
tgacaaagtagtcggcgaagcgact

SEQ ID NO: 62719 - DNA, 25 bp, Homo sapien
aggatgacgtgatgctcttcggacc

SEQ ID NO: 62720 - DNA, 25 bp, Homo sapien
cgcagccggtgactgcttggtcgcc

SEQ ID NO: 62721 - DNA, 25 bp, Homo sapien
cgccgaagacgtggccactgcgcag

SEQ ID NO: 62722 - DNA, 25 bp, Homo sapien
tggaggcacagcttatccctgcttg

SEQ ID NO: 62723 - DNA, 25 bp, Homo sapien
ggcagccttggagttcctcagagac

SEQ ID NO: 62724 - DNA, 25 bp, Homo sapien
tcccgttggcccttttggaggcaca

SEQ ID NO: 62725 - DNA, 25 bp, Homo sapien
tgagcctgcccagtaatcgcctgtg

SEQ ID NO: 62726 - DNA, 25 bp, Homo sapien
cctcggaaagcaggcctacacgtct

SEQ ID NO: 62727 - DNA, 25 bp, Homo sapien
aggccgtttaccttcgcgagcttca

SEQ ID NO: 62728 - DNA, 25 bp, Homo sapien
gcgctcagtgactctgtctttcccg

SEQ ID NO: 62729 - DNA, 25 bp, Homo sapien
atcgcgagcctctaaccgtgaacgg

SEQ ID NO: 62730 - DNA, 25 bp, Homo sapien
cggccctaagagtgcttccctagca

SEQ ID NO: 62731 - DNA, 25 bp, Homo sapien
tgcggtttcccaggctgtgtctttt

SEQ ID NO: 62732 - DNA, 25 bp, Homo sapien
agcatccgtcgtgcagacctgacgc

SEQ ID NO: 62733 - DNA, 25 bp, Homo sapien
gctgtgtcttttcagcgggtgcgca

SEQ ID NO: 62734 - DNA, 25 bp, Homo sapien
ctctcgagtgtgctcaggaagccgt

SEQ ID NO: 62735 - DNA, 25 bp, Homo sapien
acagtccatgcagtttgcccggggc

SEQ ID NO: 62736 - DNA, 25 bp, Homo sapien
tgcagagcacagtccatgcagtttg

SEQ ID NO: 62737 - DNA, 25 bp, Homo sapien
gctgccattgtcaaggcggcacaga

SEQ ID NO: 62738 - DNA, 25 bp, Homo sapien
ggtctctccgttaaggctgtcgctg

SEQ ID NO: 62739 - DNA, 25 bp, Homo sapien
cacgtaaagatacggcgccctggtg

SEQ ID NO: 62740 - DNA, 25 bp, Homo sapien
agcggacattttgctgcggtctagc

SEQ ID NO: 62741 - DNA, 25 bp, Homo sapien
tagcactcgttaaaagcgaccagtc

SEQ ID NO: 62742 - DNA, 25 bp, Homo sapien
tcccgcccagtgagggctatgttag

SEQ ID NO: 62743 - DNA, 25 bp, Homo sapien
gctatgttagcgtcctcgccgtttc

SEQ ID NO: 62744 - DNA, 25 bp, Homo sapien
ctggtgacgccctctcagctattgc

SEQ ID NO: 62745 - DNA, 25 bp, Homo sapien
ccgtgaaggaggcactgagacgaca

SEQ ID NO: 62746 - DNA, 25 bp, Homo sapien
ctcgggaaccagttgggaacgcgca

SEQ ID NO: 62747 - DNA, 25 bp, Homo sapien
gccgttggaggcgacacctccacaa

SEQ ID NO: 62748 - DNA, 25 bp, Homo sapien
tccacaagcagcgtggaggcgacac

SEQ ID NO: 62749 - DNA, 25 bp, Homo sapien
atgacccgagaagttgcgaggctcc

SEQ ID NO: 62750 - DNA, 25 bp, Homo sapien
ccctggccggaagacacaaatgacc

SEQ ID NO: 62751 - DNA, 25 bp, Homo sapien
aggaagggtcgcaagcccgcagccc

SEQ ID NO: 62752 - DNA, 25 bp, Homo sapien
cctggtcctcgaggaagggtcgcaa

SEQ ID NO: 62753 - DNA, 25 bp, Homo sapien
tccgagcgacggacacagacgcggc

SEQ ID NO: 62754 - DNA, 25 bp, Homo sapien
caccgcttccgcgagggaagagcag

SEQ ID NO: 62755 - DNA, 25 bp, Homo sapien
aatggggctttctccggccacaggc

SEQ ID NO: 62756 - DNA, 25 bp, Homo sapien
cacaatggggctttctccggccaca

SEQ ID NO: 62757 - DNA, 25 bp, Homo sapien
ctcaggccacaatggggctttctcc

SEQ ID NO: 62758 - DNA, 25 bp, Homo sapien
cgcactcaggccacaatggggcttt

SEQ ID NO: 62759 - DNA, 25 bp, Homo sapien
cgagggaagagcagctcccgtgtcg

SEQ ID NO: 62760 - DNA, 25 bp, Homo sapien
cgagagaaatcccgactggctgcgg

SEQ ID NO: 62761 - DNA, 25 bp, Homo sapien
ggccgacggggcctgcaagaccggc

SEQ ID NO: 62762 - DNA, 25 bp, Homo sapien
ttcgcagttgcaaaaggcttcacgt

SEQ ID NO: 62763 - DNA, 25 bp, Homo sapien
gccagggattttttctgctccgcga

SEQ ID NO: 62764 - DNA, 25 bp, Homo sapien
cccgatgggtttttccatgactgca

SEQ ID NO: 62765 - DNA, 25 bp, Homo sapien
cctgggattttccagggctcaattg

SEQ ID NO: 62766 - DNA, 25 bp, Homo sapien
ctcaattggagcactggcgagccgc

SEQ ID NO: 62767 - DNA, 25 bp, Homo sapien
agaggtctcctctgcttcgcagttg

SEQ ID NO: 62768 - DNA, 25 bp, Homo sapien
tcacgttttcaccaaggggcagatg

SEQ ID NO: 62769 - DNA, 25 bp, Homo sapien
ccctagtcaaccaggtggccgtgtg

SEQ ID NO: 62770 - DNA, 25 bp, Homo sapien
tccagccctttgtgttctagcgcgc

SEQ ID NO: 62771 - DNA, 25 bp, Homo sapien
gagcttgcagcgttgcccaaatatg

SEQ ID NO: 62772 - DNA, 25 bp, Homo sapien
aggcgcctctacctcctcaagaagg

SEQ ID NO: 62773 - DNA, 25 bp, Homo sapien
ggaagtgtgcgcatacccttgctta

SEQ ID NO: 62774 - DNA, 25 bp, Homo sapien
ccgcgggtttccatgttttcgtatg

SEQ ID NO: 62775 - DNA, 25 bp, Homo sapien
cgacctcgaggatgtacttggaccc

SEQ ID NO: 62776 - DNA, 25 bp, Homo sapien
ttggacccgagaatgtccgcatttg

SEQ ID NO: 62777 - DNA, 25 bp, Homo sapien
tgcgcctttctgtatgtgcacaacc

SEQ ID NO: 62778 - DNA, 25 bp, Homo sapien
gcttggcattctggcgccgccttcg

SEQ ID NO: 62779 - DNA, 25 bp, Homo sapien
ctgggcacgctcgtgtgcccttggc

SEQ ID NO: 62780 - DNA, 25 bp, Homo sapien
tgagccgtctttcagcctgcggcct

SEQ ID NO: 62781 - DNA, 25 bp, Homo sapien
cggcctcctccactaactggtctta

SEQ ID NO: 62782 - DNA, 25 bp, Homo sapien
gttctctgagcgctctcccagtcca

SEQ ID NO: 62783 - DNA, 25 bp, Homo sapien
ccaggcccaggacggagtcgctttc

SEQ ID NO: 62784 - DNA, 25 bp, Homo sapien
ccaggacggagtcgctttctgggcc

SEQ ID NO: 62785 - DNA, 25 bp, Homo sapien
ggcctccaatcactgcctggccgga

SEQ ID NO: 62786 - DNA, 25 bp, Homo sapien
tgagcgctctcgctcagtgcagcga

SEQ ID NO: 62787 - DNA, 25 bp, Homo sapien
ctcttccattcgtccttccgaaagg

SEQ ID NO: 62788 - DNA, 25 bp, Homo sapien
tcaacgtcggctgaaggcatcgtcc

SEQ ID NO: 62789 - DNA, 25 bp, Homo sapien
ctggtttgttcctcaacgtcggctg

SEQ ID NO: 62790 - DNA, 25 bp, Homo sapien
agcgaggccagcgatgccttctgga

SEQ ID NO: 62791 - DNA, 25 bp, Homo sapien
ctggctgttaactgagcgctctcgc

SEQ ID NO: 62792 - DNA, 25 bp, Homo sapien
ctcctcctggctgttaactgagcgc

SEQ ID NO: 62793 - DNA, 25 bp, Homo sapien
gatgccttctggaccacacgctgtc

SEQ ID NO: 62794 - DNA, 25 bp, Homo sapien
gcctctaggaacagcggtcggattt

SEQ ID NO: 62795 - DNA, 25 bp, Homo sapien
gtctccaaggcaagggacgcactcg

SEQ ID NO: 62796 - DNA, 25 bp, Homo sapien
acttggcccgccgaatgcagacatt

SEQ ID NO: 62797 - DNA, 25 bp, Homo sapien
ggcttttttagatacctgtcctggc

SEQ ID NO: 62798 - DNA, 25 bp, Homo sapien
tttggaacataacctgccgcctttc

SEQ ID NO: 62799 - DNA, 25 bp, Homo sapien
ctctttgcacttggaagcaggctga

SEQ ID NO: 62800 - DNA, 25 bp, Homo sapien
ggcgccacatggctcctttttcctg

SEQ ID NO: 62801 - DNA, 25 bp, Homo sapien
gacgccggacctctgttggtattgg

SEQ ID NO: 62802 - DNA, 25 bp, Homo sapien
agccatgtcgcccattacctaatga

SEQ ID NO: 62803 - DNA, 25 bp, Homo sapien
gaaccctacgtctcgccatcttgtg

SEQ ID NO: 62804 - DNA, 25 bp, Homo sapien
cgtagtcctcgggaacagcactgtg

SEQ ID NO: 62805 - DNA, 25 bp, Homo sapien
ttcttcaggctaaactaccgggatc

SEQ ID NO: 62806 - DNA, 25 bp, Homo sapien
cagcgtagcctgttgttctcggatc

SEQ ID NO: 62807 - DNA, 25 bp, Homo sapien
atcgcccacgtgagctagatcgcta

SEQ ID NO: 62808 - DNA, 25 bp, Homo sapien
agatcgctacgtcacgccacgcttg

SEQ ID NO: 62809 - DNA, 25 bp, Homo sapien
actcgctccggaaaggccaacagtc

SEQ ID NO: 62810 - DNA, 25 bp, Homo sapien
cctcgaaactcgtctgtggccggta

SEQ ID NO: 62811 - DNA, 25 bp, Homo sapien
gccgggcgcacggaaataactttga

SEQ ID NO: 62812 - DNA, 25 bp, Homo sapien
tggactgtctcaagcccgctgttgc

SEQ ID NO: 62813 - DNA, 25 bp, Homo sapien
gagcgccgcccactaatctatatta

SEQ ID NO: 62814 - DNA, 25 bp, Homo sapien
gcacgcttgtccattgttcggaatc

SEQ ID NO: 62815 - DNA, 25 bp, Homo sapien
ggcactgccgctttaagcacgcttg

SEQ ID NO: 62816 - DNA, 25 bp, Homo sapien
ccttgaatgacagtgcgatcggcga

SEQ ID NO: 62817 - DNA, 25 bp, Homo sapien
cctcaggcagcccactctttgtgtg

SEQ ID NO: 62818 - DNA, 25 bp, Homo sapien
ccctggcgtctaaagcgtagcctta

SEQ ID NO: 62819 - DNA, 25 bp, Homo sapien
cccagtaaccgcgagacaagtcagg

SEQ ID NO: 62820 - DNA, 25 bp, Homo sapien
tttcgccatggctgctgcaaggtga

SEQ ID NO: 62821 - DNA, 25 bp, Homo sapien
cgagacgacctcagcccagcgagta

SEQ ID NO: 62822 - DNA, 25 bp, Homo sapien
caactgcgatcgttcggcgactctg

SEQ ID NO: 62823 - DNA, 25 bp, Homo sapien
tgcaggctccttactacgccgaagc

SEQ ID NO: 62824 - DNA, 25 bp, Homo sapien
tcacccttctggtggtctctgctgc

SEQ ID NO: 62825 - DNA, 25 bp, Homo sapien
gcctgtgattagtcggcatttcgcg

SEQ ID NO: 62826 - DNA, 25 bp, Homo sapien
gcagtgccctcctggaaccaatgga

SEQ ID NO: 62827 - DNA, 25 bp, Homo sapien
tgcgacgcgacagagactacatttc

SEQ ID NO: 62828 - DNA, 25 bp, Homo sapien
ccagccttggcgattggcatctcaa

SEQ ID NO: 62829 - DNA, 25 bp, Homo sapien
ggcttctccgacagcgtttccgacg

SEQ ID NO: 62830 - DNA, 25 bp, Homo sapien
ctcccggacggatacagtttgaagc

SEQ ID NO: 62831 - DNA, 25 bp, Homo sapien
ccgggaagtcccataggacacaata

SEQ ID NO: 62832 - DNA, 25 bp, Homo sapien
cactgagcacactagccgtctgaga

SEQ ID NO: 62833 - DNA, 25 bp, Homo sapien
ccgctcgtccttggctgacatgatg

SEQ ID NO: 62834 - DNA, 25 bp, Homo sapien
gacggttgggctgcagtaccgtcta

SEQ ID NO: 62835 - DNA, 25 bp, Homo sapien
gcagtaccgtctaggccgcattcct

SEQ ID NO: 62836 - DNA, 25 bp, Homo sapien
caccggaggtcgaaggctgtaaacg

SEQ ID NO: 62837 - DNA, 25 bp, Homo sapien
cggagacagaaaagcgccggacgcc

SEQ ID NO: 62838 - DNA, 25 bp, Homo sapien
cggggtgatcatggacgcttgacaa

SEQ ID NO: 62839 - DNA, 25 bp, Homo sapien
atggacgcttgacaacctgcgggca

SEQ ID NO: 62840 - DNA, 25 bp, Homo sapien
ccgagccagcgactaagaggaccga

SEQ ID NO: 62841 - DNA, 25 bp, Homo sapien
tcggccagacgatccggcttagagc

SEQ ID NO: 62842 - DNA, 25 bp, Homo sapien
gagagcacggacttcccttctgccg

SEQ ID NO: 62843 - DNA, 25 bp, Homo sapien
ccgcaggaccagcagtggccaaggc

SEQ ID NO: 62844 - DNA, 25 bp, Homo sapien
gggacccaagcagctgtctgtcgcg

SEQ ID NO: 62845 - DNA, 25 bp, Homo sapien
caaggccggcgcttacagtcccagg

SEQ ID NO: 62846 - DNA, 25 bp, Homo sapien
ggcgcttacagtcccagggatcaga

SEQ ID NO: 62847 - DNA, 25 bp, Homo sapien
cgtggtcgtgcgaatgcaccgcaca

SEQ ID NO: 62848 - DNA, 25 bp, Homo sapien
agcagccggcgagagcacggacttc

SEQ ID NO: 62849 - DNA, 25 bp, Homo sapien
tcgtgcgaatgcaccgcacagaagc

SEQ ID NO: 62850 - DNA, 25 bp, Homo sapien
tcccaggccgctcatggagccgatt

SEQ ID NO: 62851 - DNA, 25 bp, Homo sapien
ttcgcgggacctgtccgaggaaaga

SEQ ID NO: 62852 - DNA, 25 bp, Homo sapien
gtcgcgaccggtcgcccttgagatt

SEQ ID NO: 62853 - DNA, 25 bp, Homo sapien
tgctcttgcagaaggcgagcccacg

SEQ ID NO: 62854 - DNA, 25 bp, Homo sapien
ggctcctttgtatttgcgcgcgttg

SEQ ID NO: 62855 - DNA, 25 bp, Homo sapien
gagccgattcggtccagcttgaggc

SEQ ID NO: 62856 - DNA, 25 bp, Homo sapien
ccacgcgcatctcggaggagacagc

SEQ ID NO: 62857 - DNA, 25 bp, Homo sapien
gcccttggacaagcccttcttgttg

SEQ ID NO: 62858 - DNA, 25 bp, Homo sapien
ctgtgggaacaatgcgcacctgacc

SEQ ID NO: 62859 - DNA, 25 bp, Homo sapien
tgcgagcgcggaaccaagatattca

SEQ ID NO: 62860 - DNA, 25 bp, Homo sapien
ccacacagaacgtcccggggtctga

SEQ ID NO: 62861 - DNA, 25 bp, Homo sapien
tctaggttcacgttcagccggtttc

SEQ ID NO: 62862 - DNA, 25 bp, Homo sapien
cgccagttactgctctaggttcacg

SEQ ID NO: 62863 - DNA, 25 bp, Homo sapien
attcatgctcatgcgtgtgctccgc

SEQ ID NO: 62864 - DNA, 25 bp, Homo sapien
gactccgctggtgaactccctctgt

SEQ ID NO: 62865 - DNA, 25 bp, Homo sapien
cgcggcatcgtatgctcgccagtta

SEQ ID NO: 62866 - DNA, 25 bp, Homo sapien
ttctccttagcaactgcgggactgc

SEQ ID NO: 62867 - DNA, 25 bp, Homo sapien
ttgctgtagagaggacgcctcccga

SEQ ID NO: 62868 - DNA, 25 bp, Homo sapien
ggcgcctggcacaaggcgtctcaga

SEQ ID NO: 62869 - DNA, 25 bp, Homo sapien
gtgacccggaagagcattctcctta

SEQ ID NO: 62870 - DNA, 25 bp, Homo sapien
gcccttgtagcctaggatggcgtga

SEQ ID NO: 62871 - DNA, 25 bp, Homo sapien
cgagaccagaattagagcctgttgc

SEQ ID NO: 62872 - DNA, 25 bp, Homo sapien
tctgccgtgcaagacctggcccagt

SEQ ID NO: 62873 - DNA, 25 bp, Homo sapien
atttcgcccttgtcgcagctgaacc

SEQ ID NO: 62874 - DNA, 25 bp, Homo sapien
agaagtccgcaggatcgaccactcc

SEQ ID NO: 62875 - DNA, 25 bp, Homo sapien
ctgcgggaaaaacagtgtcaagctc

SEQ ID NO: 62876 - DNA, 25 bp, Homo sapien
aacagtgtcaagctcaggaggcgcc

SEQ ID NO: 62877 - DNA, 25 bp, Homo sapien
tgcacacatgtgtcggtccctgggt

SEQ ID NO: 62878 - DNA, 25 bp, Homo sapien
ccagggtggcgaatacacagcccac

SEQ ID NO: 62879 - DNA, 25 bp, Homo sapien
agccgcgaggaagtagatgaagcca

SEQ ID NO: 62880 - DNA, 25 bp, Homo sapien
ggcaggtgcccacccaaggcaggac

SEQ ID NO: 62881 - DNA, 25 bp, Homo sapien
ctgcggacctcattcaccgcggaaa

SEQ ID NO: 62882 - DNA, 25 bp, Homo sapien
ccaggtcacagacgttggtcacata

SEQ ID NO: 62883 - DNA, 25 bp, Homo sapien
cacagacgttggtcacatatactga

SEQ ID NO: 62884 - DNA, 25 bp, Homo sapien
atactgacctctgacacccttaggg

SEQ ID NO: 62885 - DNA, 25 bp, Homo sapien
gttggtcacatatactgacctctga

SEQ ID NO: 62886 - DNA, 25 bp, Homo sapien
ggtcacagacgttggtcacatatac

SEQ ID NO: 62887 - DNA, 25 bp, Homo sapien
acggccaggtcacagacgttggtca

SEQ ID NO: 62888 - DNA, 25 bp, Homo sapien
tgacctctgacacccttagggaagt

SEQ ID NO: 62889 - DNA, 25 bp, Homo sapien
tgggtcacggccaggtcacagacgt

SEQ ID NO: 62890 - DNA, 25 bp, Homo sapien
gcccgctttaaccagtgcaacacga

SEQ ID NO: 62891 - DNA, 25 bp, Homo sapien
ttaaccagtgcaacacgacacgcgg

SEQ ID NO: 62892 - DNA, 25 bp, Homo sapien
cccacacggtgaaccgcaactggta

SEQ ID NO: 62893 - DNA, 25 bp, Homo sapien
cacgacacgcggcaacgaggtcatc

SEQ ID NO: 62894 - DNA, 25 bp, Homo sapien
aagtcagtgggagtggtaaccacca

SEQ ID NO: 62895 - DNA, 25 bp, Homo sapien
ctccgtgatgaatcgggccaagaaa

SEQ ID NO: 62896 - DNA, 25 bp, Homo sapien
cggtgaaccgcaactggtactcgga

SEQ ID NO: 62897 - DNA, 25 bp, Homo sapien
aacgaggtcatctccgtgatgaatc

SEQ ID NO: 62898 - DNA, 25 bp, Homo sapien
gcctggaactgaatgaaccctccta

SEQ ID NO: 62899 - DNA, 25 bp, Homo sapien
cctggaactgaatgaaccctcctac

SEQ ID NO: 62900 - DNA, 25 bp, Homo sapien
tggaactgaatgaaccctcctaccg

SEQ ID NO: 62901 - DNA, 25 bp, Homo sapien
gaactgaatgaaccctcctaccgga

SEQ ID NO: 62902 - DNA, 25 bp, Homo sapien
tgaatgaaccctcctaccggaactg

SEQ ID NO: 62903 - DNA, 25 bp, Homo sapien
tgcctggaactgaatgaaccctcct

SEQ ID NO: 62904 - DNA, 25 bp, Homo sapien
ctgcctggaactgaatgaaccctcc

SEQ ID NO: 62905 - DNA, 25 bp, Homo sapien
gaatgaaccctcctaccggaactga

SEQ ID NO: 62906 - DNA, 25 bp, Homo sapien
cccgagtatcggcagcagtcagcag

SEQ ID NO: 62907 - DNA, 25 bp, Homo sapien
gtatcggcagcagtcagcagtgccc

SEQ ID NO: 62908 - DNA, 25 bp, Homo sapien
gcgtgcaggagcagaccttcatagc

SEQ ID NO: 62909 - DNA, 25 bp, Homo sapien
ggagcagaccttcatagcgcacgtc

SEQ ID NO: 62910 - DNA, 25 bp, Homo sapien
ccttcatagcgcacgtcatggcctt

SEQ ID NO: 62911 - DNA, 25 bp, Homo sapien
ggctatgtgctcaaggacggcgccc

SEQ ID NO: 62912 - DNA, 25 bp, Homo sapien
ctcctatacggaaacggtccaggct

SEQ ID NO: 62913 - DNA, 25 bp, Homo sapien
aacggtccaggctatgtgctcaagg

SEQ ID NO: 62914 - DNA, 25 bp, Homo sapien
acagttgcagggaagagcgaaccca

SEQ ID NO: 62915 - DNA, 25 bp, Homo sapien
gcagagcactttccgtccttctggg

SEQ ID NO: 62916 - DNA, 25 bp, Homo sapien
aaggctccgcctgttgcgtgaactg

SEQ ID NO: 62917 - DNA, 25 bp, Homo sapien
ctcggggaaggtatttaggatcagc

SEQ ID NO: 62918 - DNA, 25 bp, Homo sapien
cttcctcgagaggaggcgctttcct

SEQ ID NO: 62919 - DNA, 25 bp, Homo sapien
gcttgtaaatgcttcccgggccgtc

SEQ ID NO: 62920 - DNA, 25 bp, Homo sapien
ttctccgggcgaccctgcaacttta

SEQ ID NO: 62921 - DNA, 25 bp, Homo sapien
cctttgccctgcagctgtgctaggc

SEQ ID NO: 62922 - DNA, 25 bp, Homo sapien
aagagctgagtcaccgcaggcgacg

SEQ ID NO: 62923 - DNA, 25 bp, Homo sapien
aatgcagcgcatttggagaaggccc

SEQ ID NO: 62924 - DNA, 25 bp, Homo sapien
tgaccggaagagctgagtcaccgca

SEQ ID NO: 62925 - DNA, 25 bp, Homo sapien
aaccaccagtgacggcggtgaccgg

SEQ ID NO: 62926 - DNA, 25 bp, Homo sapien
cttcactgcagtcgggaaccaccag

SEQ ID NO: 62927 - DNA, 25 bp, Homo sapien
ttggcgtccgcaccttcactgcagt

SEQ ID NO: 62928 - DNA, 25 bp, Homo sapien
attactgagcagtgacttggcgtcc

SEQ ID NO: 62929 - DNA, 25 bp, Homo sapien
ccggcggctccagcattactgagca

SEQ ID NO: 62930 - DNA, 25 bp, Homo sapien
ggaagtccgcaggatctaccactca

SEQ ID NO: 62931 - DNA, 25 bp, Homo sapien
ttcgcctttctggtccaggacctgc

SEQ ID NO: 62932 - DNA, 25 bp, Homo sapien
ctgcacacacgtgcgggtccctggg

SEQ ID NO: 62933 - DNA, 25 bp, Homo sapien
aggcaggctaatgagacgccgcagc

SEQ ID NO: 62934 - DNA, 25 bp, Homo sapien
gcaggttcaacttgcgccgcttcca

SEQ ID NO: 62935 - DNA, 25 bp, Homo sapien
tgcgctcaggacagccttcaggaca

SEQ ID NO: 62936 - DNA, 25 bp, Homo sapien
acagacagaggctccacaaagcggc

SEQ ID NO: 62937 - DNA, 25 bp, Homo sapien
tgcactttccgctttccgcgctgga

SEQ ID NO: 62938 - DNA, 25 bp, Homo sapien
ctatcgcatatcctgacctctatca

SEQ ID NO: 62939 - DNA, 25 bp, Homo sapien
tatcctgacctctatcaccctcagg

SEQ ID NO: 62940 - DNA, 25 bp, Homo sapien
agacctctatcgcatatcctgacct

SEQ ID NO: 62941 - DNA, 25 bp, Homo sapien
gacagacctctatcgcatatcctga

SEQ ID NO: 62942 - DNA, 25 bp, Homo sapien
aggtgacagacctctatcgcatatc

SEQ ID NO: 62943 - DNA, 25 bp, Homo sapien
ggccaggtgacagacctctatcgca

SEQ ID NO: 62944 - DNA, 25 bp, Homo sapien
cagggccaggtgacagacctctatc

SEQ ID NO: 62945 - DNA, 25 bp, Homo sapien
ggtcagggccaggtgacagacctct

SEQ ID NO: 62946 - DNA, 25 bp, Homo sapien
ttcctactgaaactgaaccctccaa

SEQ ID NO: 62947 - DNA, 25 bp, Homo sapien
cttcctactgaaactgaaccctcca

SEQ ID NO: 62948 - DNA, 25 bp, Homo sapien
ctgaaacttcctactgaaactgaac

SEQ ID NO: 62949 - DNA, 25 bp, Homo sapien
tggaactgaaacttcctactgaaac

SEQ ID NO: 62950 - DNA, 25 bp, Homo sapien
gaactgaaacttcctactgaaactg

SEQ ID NO: 62951 - DNA, 25 bp, Homo sapien
aactgaaacttcctactgaaactga

SEQ ID NO: 62952 - DNA, 25 bp, Homo sapien
actgaaacttcctactgaaactgaa

SEQ ID NO: 62953 - DNA, 25 bp, Homo sapien
tgaaacttcctactgaaactgaacc

SEQ ID NO: 62954 - DNA, 25 bp, Homo sapien
tggcctcctagtgggcctctgcatg

SEQ ID NO: 62955 - DNA, 25 bp, Homo sapien
gcacacacgtgtcggatgctggatt

SEQ ID NO: 62956 - DNA, 25 bp, Homo sapien
aggctcacctcacgcagggttccag

SEQ ID NO: 62957 - DNA, 25 bp, Homo sapien
tggcgctgctccttgagagaagcct

SEQ ID NO: 62958 - DNA, 25 bp, Homo sapien
gcgccacagcagcttaggtacttga

SEQ ID NO: 62959 - DNA, 25 bp, Homo sapien
ggggccttcattgcatctctcttcc

SEQ ID NO: 62960 - DNA, 25 bp, Homo sapien
cgaataccgggctccatggcaccga

SEQ ID NO: 62961 - DNA, 25 bp, Homo sapien
agtctgcgggatctaccacttcaaa

SEQ ID NO: 62962 - DNA, 25 bp, Homo sapien
gtagcgcatgtcatggccttcgctg

SEQ ID NO: 62963 - DNA, 25 bp, Homo sapien
gtgttcaactcaggcgtgcgaccag

SEQ ID NO: 62964 - DNA, 25 bp, Homo sapien
cgtgcgaccagacgtgaatgagagc

SEQ ID NO: 62965 - DNA, 25 bp, Homo sapien
accagacgtgaatgagagcgagagc

SEQ ID NO: 62966 - DNA, 25 bp, Homo sapien
caatggcccgggctacgtgttcaac

SEQ ID NO: 62967 - DNA, 25 bp, Homo sapien
ccgagacccacggaggcgaagacgt

SEQ ID NO: 62968 - DNA, 25 bp, Homo sapien
caggagcagagcttcgtagcgcatg

SEQ ID NO: 62969 - DNA, 25 bp, Homo sapien
gtccatcctgtacggcaatggcccg

SEQ ID NO: 62970 - DNA, 25 bp, Homo sapien
acctcgcgccggttccagcgcggca

SEQ ID NO: 62971 - DNA, 25 bp, Homo sapien
ggctcacgtacttgacctcttggaa

SEQ ID NO: 62972 - DNA, 25 bp, Homo sapien
tgcacacacttgagggccgcagggt

SEQ ID NO: 62973 - DNA, 25 bp, Homo sapien
ttgggagggctcttattggaagcaa

SEQ ID NO: 62974 - DNA, 25 bp, Homo sapien
ttattggaagcaagaggcgccaggc

SEQ ID NO: 62975 - DNA, 25 bp, Homo sapien
cccagggtggcggacacacaaccca

SEQ ID NO: 62976 - DNA, 25 bp, Homo sapien
aaccagggactatgagggttcggcg

SEQ ID NO: 62977 - DNA, 25 bp, Homo sapien
gcgccgcagcggctcacgtacttga

SEQ ID NO: 62978 - DNA, 25 bp, Homo sapien
ttagttcattgaatcaggcggcccg

SEQ ID NO: 62979 - DNA, 25 bp, Homo sapien
cacatctgtcttgccgggaattagt

SEQ ID NO: 62980 - DNA, 25 bp, Homo sapien
gggcactcagtctccgctaatggca

SEQ ID NO: 62981 - DNA, 25 bp, Homo sapien
agcgctctccaaatataggtcaatg

SEQ ID NO: 62982 - DNA, 25 bp, Homo sapien
ataggtcaatgtcccgctcagcctc

SEQ ID NO: 62983 - DNA, 25 bp, Homo sapien
cgggtgccgataaaggcggctaatt

SEQ ID NO: 62984 - DNA, 25 bp, Homo sapien
ggggcgactgttccagtcaacactt

SEQ ID NO: 62985 - DNA, 25 bp, Homo sapien
gccagtttgtcctagcggtttagga

SEQ ID NO: 62986 - DNA, 25 bp, Homo sapien
ccgggttgccttggaaaaatgctgc

SEQ ID NO: 62987 - DNA, 25 bp, Homo sapien
gcaggtgaatgcagcgtcctctctc

SEQ ID NO: 62988 - DNA, 25 bp, Homo sapien
cctagagaggtcctgttcggagtca

SEQ ID NO: 62989 - DNA, 25 bp, Homo sapien
acacccgcgtggcagtgttcaagga

SEQ ID NO: 62990 - DNA, 25 bp, Homo sapien
ttgactcgtgccaggtatgaaccca

SEQ ID NO: 62991 - DNA, 25 bp, Homo sapien
cccagtctgatgagaaaaggccggc

SEQ ID NO: 62992 - DNA, 25 bp, Homo sapien
aatgctgcctgctctttcaaagggg

SEQ ID NO: 62993 - DNA, 25 bp, Homo sapien
ccctcttcgaaggtactgggcgtgg

SEQ ID NO: 62994 - DNA, 25 bp, Homo sapien
gcggaagtcactccctgaggcagtg

SEQ ID NO: 62995 - DNA, 25 bp, Homo sapien
ggcgtcccgagatagccgcttccaa

SEQ ID NO: 62996 - DNA, 25 bp, Homo sapien
ggccaggacacgctcccttaggaga

SEQ ID NO: 62997 - DNA, 25 bp, Homo sapien
gtttttaccaagcagcgagtccaga

SEQ ID NO: 62998 - DNA, 25 bp, Homo sapien
cggcgagaggatgaacaacaagttc

SEQ ID NO: 62999 - DNA, 25 bp, Homo sapien
ctccgggaggtcaaaagagatacca

SEQ ID NO: 63000 - DNA, 25 bp, Homo sapien
gccgcgaccgacaaaggaaagcctc

SEQ ID NO: 63001 - DNA, 25 bp, Homo sapien
acgcggtgctgccttttttccgagc

SEQ ID NO: 63002 - DNA, 25 bp, Homo sapien
agtcactgacaaggcggcggtatcc

SEQ ID NO: 63003 - DNA, 25 bp, Homo sapien
ctgcgatcggctgggcttttaagcc

SEQ ID NO: 63004 - DNA, 25 bp, Homo sapien
tggtccagaataggtgcgcggtaat

SEQ ID NO: 63005 - DNA, 25 bp, Homo sapien
aggcgatttttactctggtccagaa

SEQ ID NO: 63006 - DNA, 25 bp, Homo sapien
tcacccttgagagtctacgattttc

SEQ ID NO: 63007 - DNA, 25 bp, Homo sapien
tgaaggccaagatctgtaacgctga

SEQ ID NO: 63008 - DNA, 25 bp, Homo sapien
tgcctttctccgtactgtccctgtg

SEQ ID NO: 63009 - DNA, 25 bp, Homo sapien
gcgcggtaattcctggctttcgcca

SEQ ID NO: 63010 - DNA, 25 bp, Homo sapien
ccacgccgaggcgaagaggttctat

SEQ ID NO: 63011 - DNA, 25 bp, Homo sapien
gcctttgcttcggatcctgagctgg

SEQ ID NO: 63012 - DNA, 25 bp, Homo sapien
aacaccattatcgaggccctgcggg

SEQ ID NO: 63013 - DNA, 25 bp, Homo sapien
cccacaggaagtcgccggagcatct

SEQ ID NO: 63014 - DNA, 25 bp, Homo sapien
agtggcgctattcctggcccagtag

SEQ ID NO: 63015 - DNA, 25 bp, Homo sapien
cgcggagcgccagctcaatgaagta

SEQ ID NO: 63016 - DNA, 25 bp, Homo sapien
tcaatgaagtaaggacgcccggcta

SEQ ID NO: 63017 - DNA, 25 bp, Homo sapien
tgcggggcactatggacccagccct

SEQ ID NO: 63018 - DNA, 25 bp, Homo sapien
acagtcttcccgtgcatgaggccgg

SEQ ID NO: 63019 - DNA, 25 bp, Homo sapien
aggcccacacctggagcatttcctg

SEQ ID NO: 63020 - DNA, 25 bp, Homo sapien
cctggagcatttcctggcagaaggc

SEQ ID NO: 63021 - DNA, 25 bp, Homo sapien
tttcctggcagaaggcgcgcaccga

SEQ ID NO: 63022 - DNA, 25 bp, Homo sapien
cggtgatcagcacagtcttcccgtg

SEQ ID NO: 63023 - DNA, 25 bp, Homo sapien
acccaagagaccacctgtacgcgga

SEQ ID NO: 63024 - DNA, 25 bp, Homo sapien
agaccacctgtacgcggagaacgct

SEQ ID NO: 63025 - DNA, 25 bp, Homo sapien
agctcccggactatgagctcgccca

SEQ ID NO: 63026 - DNA, 25 bp, Homo sapien
cctggagagcatgttcaaactgtga

SEQ ID NO: 63027 - DNA, 25 bp, Homo sapien
cggagtgttgtagagcctcgagcct

SEQ ID NO: 63028 - DNA, 25 bp, Homo sapien
tttgctccgaaagcaacttctagga

SEQ ID NO: 63029 - DNA, 25 bp, Homo sapien
ccgccagtccggagatttgctccga

SEQ ID NO: 63030 - DNA, 25 bp, Homo sapien
agcccaaaagttctcggcggctgcc

SEQ ID NO: 63031 - DNA, 25 bp, Homo sapien
tttggcccaacgcagccagatcttg

SEQ ID NO: 63032 - DNA, 25 bp, Homo sapien
gtgcaggtagcatttggcccaacgc

SEQ ID NO: 63033 - DNA, 25 bp, Homo sapien
tgttcaaactgtgagctcccgctgc

SEQ ID NO: 63034 - DNA, 25 bp, Homo sapien
tctgcttgcttctccgcgccagaca

SEQ ID NO: 63035 - DNA, 25 bp, Homo sapien
tgcgtggcgacgtgtcggccatctt

SEQ ID NO: 63036 - DNA, 25 bp, Homo sapien
ggccatcttgtgttgttgaggctga

SEQ ID NO: 63037 - DNA, 25 bp, Homo sapien
gactgactggggttctgagactccc

SEQ ID NO: 63038 - DNA, 25 bp, Homo sapien
cgcatggacacccacaggccgctcc

SEQ ID NO: 63039 - DNA, 25 bp, Homo sapien
accgcaggtaaccagccgttccgtg

SEQ ID NO: 63040 - DNA, 25 bp, Homo sapien
tggggttctgagactccctgtcccg

SEQ ID NO: 63041 - DNA, 25 bp, Homo sapien
ggtaaccagccgttccgtgtcgctc

SEQ ID NO: 63042 - DNA, 25 bp, Homo sapien
cgtgcaccacggctggagtgcctca

SEQ ID NO: 63043 - DNA, 25 bp, Homo sapien
gtgcgtgagcgcacagcatgtccga

SEQ ID NO: 63044 - DNA, 25 bp, Homo sapien
ttctgcctcctgaagcgaataaagg

SEQ ID NO: 63045 - DNA, 25 bp, Homo sapien
gtcgtcgcgctgagaaagttttctg

SEQ ID NO: 63046 - DNA, 25 bp, Homo sapien
gctatcgcggccatcgtgatcgccg

SEQ ID NO: 63047 - DNA, 25 bp, Homo sapien
aggtgacatggtcctccgtcctccg

SEQ ID NO: 63048 - DNA, 25 bp, Homo sapien
acccgaggacagcaccgcgcaggag

SEQ ID NO: 63049 - DNA, 25 bp, Homo sapien
atcccgctccgctggggttcagagc

SEQ ID NO: 63050 - DNA, 25 bp, Homo sapien
ttccctgttacttaaggcagttcag

SEQ ID NO: 63051 - DNA, 25 bp, Homo sapien
acggtctccttatgatccagggttc

SEQ ID NO: 63052 - DNA, 25 bp, Homo sapien
gctctttacctacacggtctcctta

SEQ ID NO: 63053 - DNA, 25 bp, Homo sapien
aaagctcgaggctgcgcgatttctc

SEQ ID NO: 63054 - DNA, 25 bp, Homo sapien
ggccgggactacagtgtctgtcctc

SEQ ID NO: 63055 - DNA, 25 bp, Homo sapien
ttcacggtcaaacatgggccatgct

SEQ ID NO: 63056 - DNA, 25 bp, Homo sapien
tatgatccagggttcgccgtggacc

SEQ ID NO: 63057 - DNA, 25 bp, Homo sapien
cagcttgtcctgcagttcacggtca

SEQ ID NO: 63058 - DNA, 25 bp, Homo sapien
agtcgcgcgcgtcgctttccgaggt

SEQ ID NO: 63059 - DNA, 25 bp, Homo sapien
tttccgaggtggaactgtcgtggtc

SEQ ID NO: 63060 - DNA, 25 bp, Homo sapien
aaggcagcggccagcagctccatag

SEQ ID NO: 63061 - DNA, 25 bp, Homo sapien
ccagcagctccatagggtcggcggc

SEQ ID NO: 63062 - DNA, 25 bp, Homo sapien
gtctccgtcttgtctctgctccagg

SEQ ID NO: 63063 - DNA, 25 bp, Homo sapien
gtcttgtctctgctccaggcggaga

SEQ ID NO: 63064 - DNA, 25 bp, Homo sapien
ggctcaacacccacccgatggggtg

SEQ ID NO: 63065 - DNA, 25 bp, Homo sapien
aactgtcgtggtccacggcgcaggc

SEQ ID NO: 63066 - DNA, 25 bp, Homo sapien
gacgggagcttcctcgtgcgtgcca

SEQ ID NO: 63067 - DNA, 25 bp, Homo sapien
ccctgctggaaccatggcaacatca

SEQ ID NO: 63068 - DNA, 25 bp, Homo sapien
atggcaacatcacccgctccaaggc

SEQ ID NO: 63069 - DNA, 25 bp, Homo sapien
ttcctcgtgcgtgccagcgagtcca

SEQ ID NO: 63070 - DNA, 25 bp, Homo sapien
agcgagtccatctcccgggcatacg

SEQ ID NO: 63071 - DNA, 25 bp, Homo sapien
atctcccgggcatacgcgctctgcg

SEQ ID NO: 63072 - DNA, 25 bp, Homo sapien
ctccgctcccctcggtggtgtgtgg

SEQ ID NO: 63073 - DNA, 25 bp, Homo sapien
tggaaccatggcaacatcacccgct

SEQ ID NO: 63074 - DNA, 25 bp, Homo sapien
aagggccgcgactaccgcgacaaca

SEQ ID NO: 63075 - DNA, 25 bp, Homo sapien
atcttgtcgcccagcatcgtgctca

SEQ ID NO: 63076 - DNA, 25 bp, Homo sapien
cggtgccggccaagaggcccatcaa

SEQ ID NO: 63077 - DNA, 25 bp, Homo sapien
ggcccatcaagccttccagatcgga

SEQ ID NO: 63078 - DNA, 25 bp, Homo sapien
tccagatcggaaatcaaccagcaga

SEQ ID NO: 63079 - DNA, 25 bp, Homo sapien
tgcacctccagcactccaagggccg

SEQ ID NO: 63080 - DNA, 25 bp, Homo sapien
gacaacaccgagctcccgcatcacg

SEQ ID NO: 63081 - DNA, 25 bp, Homo sapien
tgccagtcaagagcccggcggtgct

SEQ ID NO: 63082 - DNA, 25 bp, Homo sapien
gagctccgggattgccggcattccc

SEQ ID NO: 63083 - DNA, 25 bp, Homo sapien
ctggttgcttcatgctgcaggctgc

SEQ ID NO: 63084 - DNA, 25 bp, Homo sapien
tggaagcgccacatctcggagcaac

SEQ ID NO: 63085 - DNA, 25 bp, Homo sapien
agacaggcgttcgaggagatcatcc

SEQ ID NO: 63086 - DNA, 25 bp, Homo sapien
attcccgcttctgctggttgcttca

SEQ ID NO: 63087 - DNA, 25 bp, Homo sapien
tcgaaaatcatttccggcatgagcc

SEQ ID NO: 63088 - DNA, 25 bp, Homo sapien
ggtcttccggccctctcgaaaatca

SEQ ID NO: 63089 - DNA, 25 bp, Homo sapien
agcaagtgacatgtcgtcgggcctc

SEQ ID NO: 63090 - DNA, 25 bp, Homo sapien
gccagccttcggctcttgtcgagca

SEQ ID NO: 63091 - DNA, 25 bp, Homo sapien
ttcggctcttgtcgagcaggtggtc

SEQ ID NO: 63092 - DNA, 25 bp, Homo sapien
tgtcccagtcatcaccggcgttcct

SEQ ID NO: 63093 - DNA, 25 bp, Homo sapien
acaggtgcacccgtcggttttgtgc

SEQ ID NO: 63094 - DNA, 25 bp, Homo sapien
ggcatgccgtgtgcccttccaggca

SEQ ID NO: 63095 - DNA, 25 bp, Homo sapien
cctggcgtgcagatggatcgtctgt

SEQ ID NO: 63096 - DNA, 25 bp, Homo sapien
agatggatcgtctgtgccagccttc

SEQ ID NO: 63097 - DNA, 25 bp, Homo sapien
cacccgtcggttttgtgcccggcat

SEQ ID NO: 63098 - DNA, 25 bp, Homo sapien
cagtcagacacaggagctttgattc

SEQ ID NO: 63099 - DNA, 25 bp, Homo sapien
ccagaatcggtatgactcgctagtc

SEQ ID NO: 63100 - DNA, 25 bp, Homo sapien
gctccctcccgggtaatcacaagga

SEQ ID NO: 63101 - DNA, 25 bp, Homo sapien
tccgtctgggataagcggttatgtc

SEQ ID NO: 63102 - DNA, 25 bp, Homo sapien
cggagcttttttcgttgaggactca

SEQ ID NO: 63103 - DNA, 25 bp, Homo sapien
tgtgcattattctccgcctggccgc

SEQ ID NO: 63104 - DNA, 25 bp, Homo sapien
ggcctcagacacactatgcgggttg

SEQ ID NO: 63105 - DNA, 25 bp, Homo sapien
tttcgcgtcgaccaaacgtgggcca

SEQ ID NO: 63106 - DNA, 25 bp, Homo sapien
ctcctcgtggaaagagctcgcactt

SEQ ID NO: 63107 - DNA, 25 bp, Homo sapien
cctgagacactgtgagaagccggtc

SEQ ID NO: 63108 - DNA, 25 bp, Homo sapien
ttgcttagcagagcgactcaccctc

SEQ ID NO: 63109 - DNA, 25 bp, Homo sapien
acgagagtcatctgaacacggagga

SEQ ID NO: 63110 - DNA, 25 bp, Homo sapien
tttaactcagaccaaagggcagacg

SEQ ID NO: 63111 - DNA, 25 bp, Homo sapien
gcttctgctcagcaccagcgcggtg

SEQ ID NO: 63112 - DNA, 25 bp, Homo sapien
agcggctgcccttgcttagcagagc

SEQ ID NO: 63113 - DNA, 25 bp, Homo sapien
gctcgcacttttcagcatcgcagtt

SEQ ID NO: 63114 - DNA, 25 bp, Homo sapien
cgaggaacacgcgtgtaaaagctgc

SEQ ID NO: 63115 - DNA, 25 bp, Homo sapien
gcggtggccacaactcgcatggagc

SEQ ID NO: 63116 - DNA, 25 bp, Homo sapien
cccgcctttgctggggtactgcggt

SEQ ID NO: 63117 - DNA, 25 bp, Homo sapien
agcgccgagacctgacccatcagat

SEQ ID NO: 63118 - DNA, 25 bp, Homo sapien
cccaccagatcaaaccagagcagca

SEQ ID NO: 63119 - DNA, 25 bp, Homo sapien
agcagcctttggtctcgcgccaaga

SEQ ID NO: 63120 - DNA, 25 bp, Homo sapien
cacagcagcagcctttggtctcgcg

SEQ ID NO: 63121 - DNA, 25 bp, Homo sapien
gtggccacaactcgcatggagcgcc

SEQ ID NO: 63122 - DNA, 25 bp, Homo sapien
tgcgcgaatattccagcggctgcga

SEQ ID NO: 63123 - DNA, 25 bp, Homo sapien
cgtagaacgacctcatggatgccca

SEQ ID NO: 63124 - DNA, 25 bp, Homo sapien
tggatgcccagtaggcagcctcgta

SEQ ID NO: 63125 - DNA, 25 bp, Homo sapien
tgcgctggctggaggacttccactc

SEQ ID NO: 63126 - DNA, 25 bp, Homo sapien
gcggatttcccgcacgatgccttgg

SEQ ID NO: 63127 - DNA, 25 bp, Homo sapien
ccaggcctccggattctcttgcatt

SEQ ID NO: 63128 - DNA, 25 bp, Homo sapien
ctcttgcattttggtgctgcgccgg

SEQ ID NO: 63129 - DNA, 25 bp, Homo sapien
ctcggacagagagttgcggtccagc

SEQ ID NO: 63130 - DNA, 25 bp, Homo sapien
tggccgagtggacccgcgaactcac

SEQ ID NO: 63131 - DNA, 25 bp, Homo sapien
tcttggagcagaagagttacatttc

SEQ ID NO: 63132 - DNA, 25 bp, Homo sapien
acaacgagctcgaggctagactctc

SEQ ID NO: 63133 - DNA, 25 bp, Homo sapien
tgggaagcatagtccacgatccata

SEQ ID NO: 63134 - DNA, 25 bp, Homo sapien
gcgaactcaccagcggacttgtaag

SEQ ID NO: 63135 - DNA, 25 bp, Homo sapien
aaatcactttctggagacccgccct

SEQ ID NO: 63136 - DNA, 25 bp, Homo sapien
ttcaggaatgcagacaacgagctcg

SEQ ID NO: 63137 - DNA, 25 bp, Homo sapien
ttgtaagcgagctcaccttgcccgc

SEQ ID NO: 63138 - DNA, 25 bp, Homo sapien
cggggcacgtccagcacctcgtagt

SEQ ID NO: 63139 - DNA, 25 bp, Homo sapien
ctccctgaagacgtcggctgggtcg

SEQ ID NO: 63140 - DNA, 25 bp, Homo sapien
tccgcttcctccttgttctcagggt

SEQ ID NO: 63141 - DNA, 25 bp, Homo sapien
tagtagtccaccatgctggatggcc

SEQ ID NO: 63142 - DNA, 25 bp, Homo sapien
ttgatggcctcggatgaggcctgcc

SEQ ID NO: 63143 - DNA, 25 bp, Homo sapien
tacgccttcttgatggcctcggatg

SEQ ID NO: 63144 - DNA, 25 bp, Homo sapien
ctccttgttctcagggtttttgtcg

SEQ ID NO: 63145 - DNA, 25 bp, Homo sapien
tgctggatggccagaacggcccacc

SEQ ID NO: 63146 - DNA, 25 bp, Homo sapien
tacgccttcttgataccctcggacg

SEQ ID NO: 63147 - DNA, 25 bp, Homo sapien
cgcacaggtcagaggcttggcgacc

SEQ ID NO: 63148 - DNA, 25 bp, Homo sapien
agcacccgcgcacaggtcagaggct

SEQ ID NO: 63149 - DNA, 25 bp, Homo sapien
tgctggactgccaaagagcctgcgg

SEQ ID NO: 63150 - DNA, 25 bp, Homo sapien
tagtagtccactatgctggactgcc

SEQ ID NO: 63151 - DNA, 25 bp, Homo sapien
tgataccctcggacgaggcctaccg

SEQ ID NO: 63152 - DNA, 25 bp, Homo sapien
tccctgaagacctcggcggggtcac

SEQ ID NO: 63153 - DNA, 25 bp, Homo sapien
ctaccggggtactcccagcacctcg

SEQ ID NO: 63154 - DNA, 25 bp, Homo sapien
cttcctctcggttttctattggcta

SEQ ID NO: 63155 - DNA, 25 bp, Homo sapien
ctggagatttctgcgtgacttgctc

SEQ ID NO: 63156 - DNA, 25 bp, Homo sapien
tcatcagcggtgctgtgcgagatcc

SEQ ID NO: 63157 - DNA, 25 bp, Homo sapien
caaacagctgtgtgcttattcatca

SEQ ID NO: 63158 - DNA, 25 bp, Homo sapien
ccgggcactgattgggcctttcaaa

SEQ ID NO: 63159 - DNA, 25 bp, Homo sapien
tgcagcagctggtcgtcttccacgt

SEQ ID NO: 63160 - DNA, 25 bp, Homo sapien
ttcctgtcaggttccagggccacga

SEQ ID NO: 63161 - DNA, 25 bp, Homo sapien
cggccggtggtagttgtacaaacag

SEQ ID NO: 63162 - DNA, 25 bp, Homo sapien
ctccgtcggcggcttgcgtccgcgt

SEQ ID NO: 63163 - DNA, 25 bp, Homo sapien
gacggcgtccgacgggagcgtccca

SEQ ID NO: 63164 - DNA, 25 bp, Homo sapien
acacgtagcgccggctgcgcgacag

SEQ ID NO: 63165 - DNA, 25 bp, Homo sapien
gatttaacgcgaagagagaaaccca

SEQ ID NO: 63166 - DNA, 25 bp, Homo sapien
cacggcaggggagatttaacgcgaa

SEQ ID NO: 63167 - DNA, 25 bp, Homo sapien
gagcctacgcggcaccaggctgcac

SEQ ID NO: 63168 - DNA, 25 bp, Homo sapien
cacgggagcctacgcggcaccaggc

SEQ ID NO: 63169 - DNA, 25 bp, Homo sapien
tccgacgggagcgtcccacgggagc

SEQ ID NO: 63170 - DNA, 25 bp, Homo sapien
atctacatcgcgcagtccaaaggtg

SEQ ID NO: 63171 - DNA, 25 bp, Homo sapien
cggaaatcctttacgagctgctgac

SEQ ID NO: 63172 - DNA, 25 bp, Homo sapien
cagcgaccgcgggttcttccattcg

SEQ ID NO: 63173 - DNA, 25 bp, Homo sapien
gaacttcgccctgaagccgcgcatg

SEQ ID NO: 63174 - DNA, 25 bp, Homo sapien
tggcacctgaaaacacccaacctgg

SEQ ID NO: 63175 - DNA, 25 bp, Homo sapien
tgctgacccagcactggcacctgaa

SEQ ID NO: 63176 - DNA, 25 bp, Homo sapien
tcctgcgacacggacgcggaaatcc

SEQ ID NO: 63177 - DNA, 25 bp, Homo sapien
gcgcaagatcttcagccggctcatc

SEQ ID NO: 63178 - DNA, 25 bp, Homo sapien
agcggctgacgcgtttgcaaaaata

SEQ ID NO: 63179 - DNA, 25 bp, Homo sapien
cgtgccgttgctcagcttgatcttc

SEQ ID NO: 63180 - DNA, 25 bp, Homo sapien
tgggcaccgtgttcacgaactcgtt

SEQ ID NO: 63181 - DNA, 25 bp, Homo sapien
tcgttgaacttgagccggtagagca

SEQ ID NO: 63182 - DNA, 25 bp, Homo sapien
ggccgagtccaagcccaacatgacg

SEQ ID NO: 63183 - DNA, 25 bp, Homo sapien
ttagaggagatgttgcccatggctc

SEQ ID NO: 63184 - DNA, 25 bp, Homo sapien
gcaaaaatagctctcggctcccgga

SEQ ID NO: 63185 - DNA, 25 bp, Homo sapien
ccaacatgacgatatgcagggactg

SEQ ID NO: 63186 - DNA, 25 bp, Homo sapien
tctcgccctgcagcgactgtgagga

SEQ ID NO: 63187 - DNA, 25 bp, Homo sapien
caggctcgctcataggcccggaaca

SEQ ID NO: 63188 - DNA, 25 bp, Homo sapien
tcccgccaaaatcgcgtagctggtc

SEQ ID NO: 63189 - DNA, 25 bp, Homo sapien
ctgggcactcacgtggttaacggtc

SEQ ID NO: 63190 - DNA, 25 bp, Homo sapien
ggagcccgaacctgagactggacct

SEQ ID NO: 63191 - DNA, 25 bp, Homo sapien
caccttgcggcagaagctgatcttc

SEQ ID NO: 63192 - DNA, 25 bp, Homo sapien
ggaggactcggcctttcaagagccc

SEQ ID NO: 63193 - DNA, 25 bp, Homo sapien
acttcctgggtagctctttctcgcc

SEQ ID NO: 63194 - DNA, 25 bp, Homo sapien
aacttgttggtgacaatgcatattt

SEQ ID NO: 63195 - DNA, 25 bp, Homo sapien
agactggatacccgcctggacccgg

SEQ ID NO: 63196 - DNA, 25 bp, Homo sapien
tttgcactcccttgcgggcgcagat

SEQ ID NO: 63197 - DNA, 25 bp, Homo sapien
tctccggttaaacttgttggtgaca

SEQ ID NO: 63198 - DNA, 25 bp, Homo sapien
gatccctcctgtgaggatgaaattg

SEQ ID NO: 63199 - DNA, 25 bp, Homo sapien
tgaggatgaaattgaaaactccggt

SEQ ID NO: 63200 - DNA, 25 bp, Homo sapien
aaactccggtttctggcttggcgat

SEQ ID NO: 63201 - DNA, 25 bp, Homo sapien
aacttcttcggagatccctcctgtg

SEQ ID NO: 63202 - DNA, 25 bp, Homo sapien
tgacgccctgggctacgtgaacctg

SEQ ID NO: 63203 - DNA, 25 bp, Homo sapien
tgaacctgccgctcacctttttctg

SEQ ID NO: 63204 - DNA, 25 bp, Homo sapien
tatgcctccgtgaggaccctgctca

SEQ ID NO: 63205 - DNA, 25 bp, Homo sapien
gaccctgctcatggagaacatcagc

SEQ ID NO: 63206 - DNA, 25 bp, Homo sapien
ccaaggagtggtacatcggctacta

SEQ ID NO: 63207 - DNA, 25 bp, Homo sapien
tgcggccctgcaaattcctcacgta

SEQ ID NO: 63208 - DNA, 25 bp, Homo sapien
tgggcctcgtgcacaccaagaacgt

SEQ ID NO: 63209 - DNA, 25 bp, Homo sapien
catcggctactaccagggcagggtg

SEQ ID NO: 63210 - DNA, 25 bp, Homo sapien
accagcgtggcaatgtggacctctc

SEQ ID NO: 63211 - DNA, 25 bp, Homo sapien
gtcctcacaaagaaagtcgcgactg

SEQ ID NO: 63212 - DNA, 25 bp, Homo sapien
gcgcattatgcagccctggtcctca

SEQ ID NO: 63213 - DNA, 25 bp, Homo sapien
gctctattcggggatgcgcattatg

SEQ ID NO: 63214 - DNA, 25 bp, Homo sapien
tgtctcccgggtgacggggctctat

SEQ ID NO: 63215 - DNA, 25 bp, Homo sapien
tcaccagcctgcgaaagaaaaggcc

SEQ ID NO: 63216 - DNA, 25 bp, Homo sapien
cggcctgggaatgtacagtgaagtc

SEQ ID NO: 63217 - DNA, 25 bp, Homo sapien
gaagagaggcttcccagtgcttccc

SEQ ID NO: 63218 - DNA, 25 bp, Homo sapien
acgtaatggaatgcctctgtggacc

SEQ ID NO: 63219 - DNA, 25 bp, Homo sapien
gcagcactggcctgcgagttccttt

SEQ ID NO: 63220 - DNA, 25 bp, Homo sapien
ccactgattcaagaagaggacgctg

SEQ ID NO: 63221 - DNA, 25 bp, Homo sapien
cgtgttagtggagacgaaccgattc

SEQ ID NO: 63222 - DNA, 25 bp, Homo sapien
ctgtggacctcattcaagccttgtg

SEQ ID NO: 63223 - DNA, 25 bp, Homo sapien
tcaagccttgtgttccagcccgagg

SEQ ID NO: 63224 - DNA, 25 bp, Homo sapien
ctgggcactccaagtcaagggctcc

SEQ ID NO: 63225 - DNA, 25 bp, Homo sapien
ccatgacgtcacagaggcttcgcgc

SEQ ID NO: 63226 - DNA, 25 bp, Homo sapien
gggcctggcgcaattccccgggatc

SEQ ID NO: 63227 - DNA, 25 bp, Homo sapien
ctgggctttaatggctgctccgcgg

SEQ ID NO: 63228 - DNA, 25 bp, Homo sapien
gctgcctgggctttaatggctgctc

SEQ ID NO: 63229 - DNA, 25 bp, Homo sapien
ctcaggaagtcacccgagcaagcct

SEQ ID NO: 63230 - DNA, 25 bp, Homo sapien
ccacactgcccaggggtcggccctc

SEQ ID NO: 63231 - DNA, 25 bp, Homo sapien
cgcctttcttctcgcgcctcctccg

SEQ ID NO: 63232 - DNA, 25 bp, Homo sapien
gcgcgtcccggccatgaactgagcc

SEQ ID NO: 63233 - DNA, 25 bp, Homo sapien
ggaagtcacccgagcaagcctcctt

SEQ ID NO: 63234 - DNA, 25 bp, Homo sapien
ctgcatgcgacgagcaagtttattg

SEQ ID NO: 63235 - DNA, 25 bp, Homo sapien
ccatcgtttgcaggagcggaagacc

SEQ ID NO: 63236 - DNA, 25 bp, Homo sapien
cccgatggagcaggtttcacagtgc

SEQ ID NO: 63237 - DNA, 25 bp, Homo sapien
ccgtttcatctgcacgtctctttca

SEQ ID NO: 63238 - DNA, 25 bp, Homo sapien
cgtctctttcaatgcgggcgtgcga

SEQ ID NO: 63239 - DNA, 25 bp, Homo sapien
cgtgcgaacttccaggtagagccga

SEQ ID NO: 63240 - DNA, 25 bp, Homo sapien
ccaggtagagccgagttcaagaaaa

SEQ ID NO: 63241 - DNA, 25 bp, Homo sapien
gcaccaggttgcctcccatcgtttg

SEQ ID NO: 63242 - DNA, 25 bp, Homo sapien
cgctcccgtgtttcctttgtgtgga

SEQ ID NO: 63243 - DNA, 25 bp, Homo sapien
cacgcgctcccgtgtttcctgtgtg

SEQ ID NO: 63244 - DNA, 25 bp, Homo sapien
ctcccgtgtttcctgtgtggagcgt

SEQ ID NO: 63245 - DNA, 25 bp, Homo sapien
ccgtgtttcctttgtgtggagcgtg

SEQ ID NO: 63246 - DNA, 25 bp, Homo sapien
gtttcctttgtgtggagcgtgcacg

SEQ ID NO: 63247 - DNA, 25 bp, Homo sapien
gcgctcccgtgtttcctttgtgtgg

SEQ ID NO: 63248 - DNA, 25 bp, Homo sapien
acgcgctcccgtgtttcctttgtgt

SEQ ID NO: 63249 - DNA, 25 bp, Homo sapien
tttcctttgtgtggagcgtgcacgc

SEQ ID NO: 63250 - DNA, 25 bp, Homo sapien
tgggaacgcagtaagagcaagaacc

SEQ ID NO: 63251 - DNA, 25 bp, Homo sapien
cgcgggcgacatgtacttgttggac

SEQ ID NO: 63252 - DNA, 25 bp, Homo sapien
gtctaccgcatctccgtgaccatgg

SEQ ID NO: 63253 - DNA, 25 bp, Homo sapien
tgaccatggtcaggaaggagcagct

SEQ ID NO: 63254 - DNA, 25 bp, Homo sapien
gcgcttgggatttccgcaccttccg

SEQ ID NO: 63255 - DNA, 25 bp, Homo sapien
cggagaagcgcaacaccctggacgt

SEQ ID NO: 63256 - DNA, 25 bp, Homo sapien
ttcttcagcggcatcttcgcgcgca

SEQ ID NO: 63257 - DNA, 25 bp, Homo sapien
tgctcagcaagaacgacgcgctctc

SEQ ID NO: 63258 - DNA, 25 bp, Homo sapien
tgacaggtcactgccacaacagcta

SEQ ID NO: 63259 - DNA, 25 bp, Homo sapien
gtctccttatctctgctgcgtcctg

SEQ ID NO: 63260 - DNA, 25 bp, Homo sapien
cccatgggtggtagtctcacgctgc

SEQ ID NO: 63261 - DNA, 25 bp, Homo sapien
ccctccagtgggaacatgtgcctgc

SEQ ID NO: 63262 - DNA, 25 bp, Homo sapien
catgtaaattaatcagcagcagtcc

SEQ ID NO: 63263 - DNA, 25 bp, Homo sapien
tcaggatttcagaactcagtcactg

SEQ ID NO: 63264 - DNA, 25 bp, Homo sapien
agcagcagtccagcctaaaaagaga

SEQ ID NO: 63265 - DNA, 25 bp, Homo sapien
tgcctgcactttttagtcgaacatg

SEQ ID NO: 63266 - DNA, 25 bp, Homo sapien
acagtaacacgtgtggcgccgaccc

SEQ ID NO: 63267 - DNA, 25 bp, Homo sapien
agctgacctgtgtgtggcgcagcct

SEQ ID NO: 63268 - DNA, 25 bp, Homo sapien
gccgtgcgcaatcggggctttatac

SEQ ID NO: 63269 - DNA, 25 bp, Homo sapien
cgcaaatagggcacccacagtaaca

SEQ ID NO: 63270 - DNA, 25 bp, Homo sapien
gccggcgctttgaagcctgtgctgt

SEQ ID NO: 63271 - DNA, 25 bp, Homo sapien
gctgtgcgattttctcagcagtgag

SEQ ID NO: 63272 - DNA, 25 bp, Homo sapien
cgcagccttgggttccgcaaatagg

SEQ ID NO: 63273 - DNA, 25 bp, Homo sapien
tagacgcggctaatgacaggaaggt

SEQ ID NO: 63274 - DNA, 25 bp, Homo sapien
gcctccttctatgccggtttcctgg

SEQ ID NO: 63275 - DNA, 25 bp, Homo sapien
gcgctgattttccaggtcactcgga

SEQ ID NO: 63276 - DNA, 25 bp, Homo sapien
ccgagcctctgtgtctagatgagtt

SEQ ID NO: 63277 - DNA, 25 bp, Homo sapien
gagcttcctgggttccacgtctcta

SEQ ID NO: 63278 - DNA, 25 bp, Homo sapien
ggaccactgcaggaagcgttattga

SEQ ID NO: 63279 - DNA, 25 bp, Homo sapien
acgcgctgacaacccacatctggaa

SEQ ID NO: 63280 - DNA, 25 bp, Homo sapien
ccgcgtttacgtgccgaagtctcaa

SEQ ID NO: 63281 - DNA, 25 bp, Homo sapien
cccggagagacccaatgactgcgtt

SEQ ID NO: 63282 - DNA, 25 bp, Homo sapien
tgtggagtaatgaggcgctcgcttt

SEQ ID NO: 63283 - DNA, 25 bp, Homo sapien
tcccggtgcccggtaattgatacaa

SEQ ID NO: 63284 - DNA, 25 bp, Homo sapien
cattctttgtatgcagccaggagga

SEQ ID NO: 63285 - DNA, 25 bp, Homo sapien
gctcgcttttttaatttggcatggc

SEQ ID NO: 63286 - DNA, 25 bp, Homo sapien
ggcatggcttttttctcttagcctc

SEQ ID NO: 63287 - DNA, 25 bp, Homo sapien
tacttaacgccgtcgacagtagtcg

SEQ ID NO: 63288 - DNA, 25 bp, Homo sapien
acagtagtcgtctgtcccggtgccc

SEQ ID NO: 63289 - DNA, 25 bp, Homo sapien
cagtccctccgtcagagccggttta

SEQ ID NO: 63290 - DNA, 25 bp, Homo sapien
ccgctgttatggtgaacggaattca

SEQ ID NO: 63291 - DNA, 25 bp, Homo sapien
acagcgagggcttacatccacttta

SEQ ID NO: 63292 - DNA, 25 bp, Homo sapien
tccactttacgggatccggagcgga

SEQ ID NO: 63293 - DNA, 25 bp, Homo sapien
aagccgatcacatcagccgctgtta

SEQ ID NO: 63294 - DNA, 25 bp, Homo sapien
ggaattcactgtgatggcggctgca

SEQ ID NO: 63295 - DNA, 25 bp, Homo sapien
ccgccgtgggcttcatgccacgtta

SEQ ID NO: 63296 - DNA, 25 bp, Homo sapien
catgccacgttacgcggagtctagg

SEQ ID NO: 63297 - DNA, 25 bp, Homo sapien
atgcgatatgttccaaagccgatca

SEQ ID NO: 63298 - DNA, 25 bp, Homo sapien
ggatccgtgccaagtacgagcagaa

SEQ ID NO: 63299 - DNA, 25 bp, Homo sapien
cagctcctgatctgggtaggtggtc

SEQ ID NO: 63300 - DNA, 25 bp, Homo sapien
cacacggctcccgggacgaggtgaa

SEQ ID NO: 63301 - DNA, 25 bp, Homo sapien
tacgagcagaagctcttcctggccc

SEQ ID NO: 63302 - DNA, 25 bp, Homo sapien
caagtacgagcagaagctcttcctg

SEQ ID NO: 63303 - DNA, 25 bp, Homo sapien
tgccaagtacgagcagaagctcttc

SEQ ID NO: 63304 - DNA, 25 bp, Homo sapien
ccgtgccaagtacgagcagaagctc

SEQ ID NO: 63305 - DNA, 25 bp, Homo sapien
atctgggtaggtggtcggcacgcct

SEQ ID NO: 63306 - DNA, 25 bp, Homo sapien
tcgccgcattctcgctcagaagtcg

SEQ ID NO: 63307 - DNA, 25 bp, Homo sapien
atcatctgaggaacagccgtgcccg

SEQ ID NO: 63308 - DNA, 25 bp, Homo sapien
gagggtgcccaccatcatctgagga

SEQ ID NO: 63309 - DNA, 25 bp, Homo sapien
caataaccggaacaacagcagtggg

SEQ ID NO: 63310 - DNA, 25 bp, Homo sapien
cctgtccaggagaaacaataaccgg

SEQ ID NO: 63311 - DNA, 25 bp, Homo sapien
gacgagcgcttcgtgctcatggcca

SEQ ID NO: 63312 - DNA, 25 bp, Homo sapien
cagtacggagtggacgtcacggccc

SEQ ID NO: 63313 - DNA, 25 bp, Homo sapien
tcagaagtcgcagcacgtgagtccc

SEQ ID NO: 63314 - DNA, 25 bp, Homo sapien
caatgttggagaggtggaaggtccc

SEQ ID NO: 63315 - DNA, 25 bp, Homo sapien
cggctccgcggagctttcgttcttt

SEQ ID NO: 63316 - DNA, 25 bp, Homo sapien
ttttaatgcagtttcccttccgcca

SEQ ID NO: 63317 - DNA, 25 bp, Homo sapien
aatgcagtttcccttccgccacgtg

SEQ ID NO: 63318 - DNA, 25 bp, Homo sapien
ccgccacgtgagtaccgccttttgg

SEQ ID NO: 63319 - DNA, 25 bp, Homo sapien
gccttttggccaagagtttagccgc

SEQ ID NO: 63320 - DNA, 25 bp, Homo sapien
agtttagccgcgtcctaggggagca

SEQ ID NO: 63321 - DNA, 25 bp, Homo sapien
gccaagagtttagccgcgtcctagg

SEQ ID NO: 63322 - DNA, 25 bp, Homo sapien
ccagggacccagtggctgtgaaata

SEQ ID NO: 63323 - DNA, 25 bp, Homo sapien
acactggcgtccttcggtgcctgtt

SEQ ID NO: 63324 - DNA, 25 bp, Homo sapien
catgtcggtgtaatcccatttcagc

SEQ ID NO: 63325 - DNA, 25 bp, Homo sapien
ccatttcagccattgtcattcagga

SEQ ID NO: 63326 - DNA, 25 bp, Homo sapien
gccctttaggacgaaggcggccaca

SEQ ID NO: 63327 - DNA, 25 bp, Homo sapien
accagagacgcaccggcatgacaaa

SEQ ID NO: 63328 - DNA, 25 bp, Homo sapien
ccgggagtatcaggagaacaaggtc

SEQ ID NO: 63329 - DNA, 25 bp, Homo sapien
cggtcaggcttaataggatcatgtc

SEQ ID NO: 63330 - DNA, 25 bp, Homo sapien
tccaggccgcagtaatagatcgctc

SEQ ID NO: 63331 - DNA, 25 bp, Homo sapien
gcgcggttcctctttgctaactgca

SEQ ID NO: 63332 - DNA, 25 bp, Homo sapien
cgggtctagacgtcagccctgaacc

SEQ ID NO: 63333 - DNA, 25 bp, Homo sapien
aagggcattgttagttcggtcatta

SEQ ID NO: 63334 - DNA, 25 bp, Homo sapien
ccgtgttggacgtgtgttatgtatc

SEQ ID NO: 63335 - DNA, 25 bp, Homo sapien
ggggacgtcttaatcccagatcagc

SEQ ID NO: 63336 - DNA, 25 bp, Homo sapien
ttgcgaacgcaaggagtgctcaccc

SEQ ID NO: 63337 - DNA, 25 bp, Homo sapien
ctgtgcctccagattgtataacgtg

SEQ ID NO: 63338 - DNA, 25 bp, Homo sapien
cggccatgatgacagcggccatcaa

SEQ ID NO: 63339 - DNA, 25 bp, Homo sapien
accctgcgcctgaagtttgggtgga

SEQ ID NO: 63340 - DNA, 25 bp, Homo sapien
tctgggccattttccgccaccggaa

SEQ ID NO: 63341 - DNA, 25 bp, Homo sapien
ttgggctcgaaaaccaagtctgggc

SEQ ID NO: 63342 - DNA, 25 bp, Homo sapien
aggactggcccttctattttattgg

SEQ ID NO: 63343 - DNA, 25 bp, Homo sapien
catccctgccatgggcttttggaga

SEQ ID NO: 63344 - DNA, 25 bp, Homo sapien
agcgctgcttgtttatcttcctccc

SEQ ID NO: 63345 - DNA, 25 bp, Homo sapien
tttgtgcggtcaaagcttcgggtcc

SEQ ID NO: 63346 - DNA, 25 bp, Homo sapien
tgtcatccgagctgtagtccacatc

SEQ ID NO: 63347 - DNA, 25 bp, Homo sapien
caccctttagcggattgtctttcta

SEQ ID NO: 63348 - DNA, 25 bp, Homo sapien
acacattgtgatttcctggcctttg

SEQ ID NO: 63349 - DNA, 25 bp, Homo sapien
gaggcccaagagattgcccgctttg

SEQ ID NO: 63350 - DNA, 25 bp, Homo sapien
gaacctcaattgcttcctaaccgga

SEQ ID NO: 63351 - DNA, 25 bp, Homo sapien
ggacgtgcagatcccagaccatctt

SEQ ID NO: 63352 - DNA, 25 bp, Homo sapien
cgtttctcccagacaagtagcaaga

SEQ ID NO: 63353 - DNA, 25 bp, Homo sapien
tcgggtcgtcttccacctttgactc

SEQ ID NO: 63354 - DNA, 25 bp, Homo sapien
cgccgccagagtcgaggtaacgggt

SEQ ID NO: 63355 - DNA, 25 bp, Homo sapien
gtacggtgtggccacccgtggtctc

SEQ ID NO: 63356 - DNA, 25 bp, Homo sapien
tcgcccagtcctaggcgacaggctg

SEQ ID NO: 63357 - DNA, 25 bp, Homo sapien
tcctaggcgacaggctggtttctcg

SEQ ID NO: 63358 - DNA, 25 bp, Homo sapien
ttatttacagggattttgagaagcc

SEQ ID NO: 63359 - DNA, 25 bp, Homo sapien
tttgagaagcccgatcgtttggtca

SEQ ID NO: 63360 - DNA, 25 bp, Homo sapien
aagcccgatcgtttggtcattgccg

SEQ ID NO: 63361 - DNA, 25 bp, Homo sapien
aagcaccgcgaatggcgcgcttcgc

SEQ ID NO: 63362 - DNA, 25 bp, Homo sapien
ctccgggagcacctagccaggcaaa

SEQ ID NO: 63363 - DNA, 25 bp, Homo sapien
caggcattgtttgcgggacttcaca

SEQ ID NO: 63364 - DNA, 25 bp, Homo sapien
gcgggtgtcctagttctttttcaga

SEQ ID NO: 63365 - DNA, 25 bp, Homo sapien
ggggtaactgatcgcccatcgccct

SEQ ID NO: 63366 - DNA, 25 bp, Homo sapien
cccggccgggatccagatgtccgag

SEQ ID NO: 63367 - DNA, 25 bp, Homo sapien
caggcgcttctcacctgggtttatc

SEQ ID NO: 63368 - DNA, 25 bp, Homo sapien
ttcggggacttcaaacgcgccctgc

SEQ ID NO: 63369 - DNA, 25 bp, Homo sapien
tttttcagagcagccgtaacgattg

SEQ ID NO: 63370 - DNA, 25 bp, Homo sapien
atgcggcccaattatctcgtttgca

SEQ ID NO: 63371 - DNA, 25 bp, Homo sapien
tcgacatcaataccggggccgcatc

SEQ ID NO: 63372 - DNA, 25 bp, Homo sapien
catgggtcatttacaggggaattta

SEQ ID NO: 63373 - DNA, 25 bp, Homo sapien
actctcgtcctgaaactgcaatgca

SEQ ID NO: 63374 - DNA, 25 bp, Homo sapien
ggggcactgtctcattaaaaccact

SEQ ID NO: 63375 - DNA, 25 bp, Homo sapien
tctcagggctcagtcgagcaatctc

SEQ ID NO: 63376 - DNA, 25 bp, Homo sapien
ggcgtcggctgtaaacactcccttc

SEQ ID NO: 63377 - DNA, 25 bp, Homo sapien
tttgcatataaagcgcgtcggggcc

SEQ ID NO: 63378 - DNA, 25 bp, Homo sapien
ccatgccctcggttggatgtgttag

SEQ ID NO: 63379 - DNA, 25 bp, Homo sapien
tggcttgactcgcagaacccacact

SEQ ID NO: 63380 - DNA, 25 bp, Homo sapien
aacccacactctggcggctgtgggc

SEQ ID NO: 63381 - DNA, 25 bp, Homo sapien
agccatctggcacgccttcaccgca

SEQ ID NO: 63382 - DNA, 25 bp, Homo sapien
accaggaccacagcggcaaggtctc

SEQ ID NO: 63383 - DNA, 25 bp, Homo sapien
ttgccttcgggccatgccctcggtt

SEQ ID NO: 63384 - DNA, 25 bp, Homo sapien
ctcggttggatgtgttagttcccgc

SEQ ID NO: 63385 - DNA, 25 bp, Homo sapien
gcgctctgtacttcccttgggtgga

SEQ ID NO: 63386 - DNA, 25 bp, Homo sapien
gcttccgaagccgtgacactacttt

SEQ ID NO: 63387 - DNA, 25 bp, Homo sapien
taagctcgctgtgaaaccttttgcc

SEQ ID NO: 63388 - DNA, 25 bp, Homo sapien
tgcctcggtaattctgcgctccatg

SEQ ID NO: 63389 - DNA, 25 bp, Homo sapien
cgctccatgggtgtctctttacatc

SEQ ID NO: 63390 - DNA, 25 bp, Homo sapien
ttcacagtacggctgctgcccacgg

SEQ ID NO: 63391 - DNA, 25 bp, Homo sapien
ccctgtgacagtgctggtgactcta

SEQ ID NO: 63392 - DNA, 25 bp, Homo sapien
ggtgactctacgctcggctcgccat

SEQ ID NO: 63393 - DNA, 25 bp, Homo sapien
ttgattctcactgcagagcactgcg

SEQ ID NO: 63394 - DNA, 25 bp, Homo sapien
ctgcgctcgtcctcgtcgcgcgcgt

SEQ ID NO: 63395 - DNA, 25 bp, Homo sapien
cccgccatagtcgagcgcgcccgcg

SEQ ID NO: 63396 - DNA, 25 bp, Homo sapien
tgagcagcgcctgcaccgtgcgctg

SEQ ID NO: 63397 - DNA, 25 bp, Homo sapien
gccgttcctcgcgtccacgtgcgcc

SEQ ID NO: 63398 - DNA, 25 bp, Homo sapien
caggccgcgctcagagccgtctctc

SEQ ID NO: 63399 - DNA, 25 bp, Homo sapien
gcgcacctgtgggaagccagggcct

SEQ ID NO: 63400 - DNA, 25 bp, Homo sapien
ctcgcgtggccgcaggctttgtgca

SEQ ID NO: 63401 - DNA, 25 bp, Homo sapien
gggcctgtcactcgggcgccacgca

SEQ ID NO: 63402 - DNA, 25 bp, Homo sapien
gatcttggatctgggtcccgaggca

SEQ ID NO: 63403 - DNA, 25 bp, Homo sapien
ttccgagacccggagcacacgctgg

SEQ ID NO: 63404 - DNA, 25 bp, Homo sapien
gctccgcttccgagcgggcctggaa

SEQ ID NO: 63405 - DNA, 25 bp, Homo sapien
ccgcccgaggagctaaccatttatg

SEQ ID NO: 63406 - DNA, 25 bp, Homo sapien
gtcacactgtgacaattattctgca

SEQ ID NO: 63407 - DNA, 25 bp, Homo sapien
gtgatcaccgcgctcattacctcgg

SEQ ID NO: 63408 - DNA, 25 bp, Homo sapien
atcaagcgctaattaaacccgcggg

SEQ ID NO: 63409 - DNA, 25 bp, Homo sapien
gcgcgctcgcaatcaagcgctaatt

SEQ ID NO: 63410 - DNA, 25 bp, Homo sapien
tcacttcggccactcaggtgggcgc

SEQ ID NO: 63411 - DNA, 25 bp, Homo sapien
agagactcgcgaacctcacttcggc

SEQ ID NO: 63412 - DNA, 25 bp, Homo sapien
actccttcccgtcgcgacccagaga

SEQ ID NO: 63413 - DNA, 25 bp, Homo sapien
ggtgtttcactccttcccgtcgcga

SEQ ID NO: 63414 - DNA, 25 bp, Homo sapien
tagcaacggaaacgccgcgcctgcg

SEQ ID NO: 63415 - DNA, 25 bp, Homo sapien
cagagaggtgtttcactccttcccg

SEQ ID NO: 63416 - DNA, 25 bp, Homo sapien
ttgcttcgcaggcacggagcgcgca

SEQ ID NO: 63417 - DNA, 25 bp, Homo sapien
cgcctgcgcattgccttccgcctgc

SEQ ID NO: 63418 - DNA, 25 bp, Homo sapien
cgtacatttccagcgggctcagaca

SEQ ID NO: 63419 - DNA, 25 bp, Homo sapien
ttcttccagcgacagtacacttagc

SEQ ID NO: 63420 - DNA, 25 bp, Homo sapien
acacgaagagtgattgcgccgccct

SEQ ID NO: 63421 - DNA, 25 bp, Homo sapien
gtccttggtgccgatgtgacacgaa

SEQ ID NO: 63422 - DNA, 25 bp, Homo sapien
cagccgctggcagttttcctttcca

SEQ ID NO: 63423 - DNA, 25 bp, Homo sapien
aggtctcgcctagatcttgggtgtg

SEQ ID NO: 63424 - DNA, 25 bp, Homo sapien
agaacggattgacacccactctgtg

SEQ ID NO: 63425 - DNA, 25 bp, Homo sapien
ctacgttagcatcctgtccggggtc

SEQ ID NO: 63426 - DNA, 25 bp, Homo sapien
gcgaccgagcttggccggatcttct

SEQ ID NO: 63427 - DNA, 25 bp, Homo sapien
ggaagcgcgcatccaccaagctgga

SEQ ID NO: 63428 - DNA, 25 bp, Homo sapien
cttgagcgctggaacgctgcctcca

SEQ ID NO: 63429 - DNA, 25 bp, Homo sapien
ctgccaaggccaggttggcaaaatc

SEQ ID NO: 63430 - DNA, 25 bp, Homo sapien
ttggcaaaatcaaagcgcggcttgg

SEQ ID NO: 63431 - DNA, 25 bp, Homo sapien
ccggatcttcttgcgttgctgccaa

SEQ ID NO: 63432 - DNA, 25 bp, Homo sapien
ccgtgcccggcactttggagaaaga

SEQ ID NO: 63433 - DNA, 25 bp, Homo sapien
gatctcgggcttgggttgaatgaca

SEQ ID NO: 63434 - DNA, 25 bp, Homo sapien
gctttaaacgtcatcgcgggcgcga

SEQ ID NO: 63435 - DNA, 25 bp, Homo sapien
ggggacgctgcccaacaagcaggtt

SEQ ID NO: 63436 - DNA, 25 bp, Homo sapien
ttgcggagactcacaccttagattc

SEQ ID NO: 63437 - DNA, 25 bp, Homo sapien
agagcagggaactcacgaacgtttc

SEQ ID NO: 63438 - DNA, 25 bp, Homo sapien
acctacggtatgcagggtacggtgc

SEQ ID NO: 63439 - DNA, 25 bp, Homo sapien
aaccctttgcgtcgcgctgggagaa

SEQ ID NO: 63440 - DNA, 25 bp, Homo sapien
aactgcggagtagtcttaggccctg

SEQ ID NO: 63441 - DNA, 25 bp, Homo sapien
gaacgtttcgtgagcacctacggta

SEQ ID NO: 63442 - DNA, 25 bp, Homo sapien
gggtcgtccacctcatcgtcagact

SEQ ID NO: 63443 - DNA, 25 bp, Homo sapien
gtcagactttccagacgagatgagg

SEQ ID NO: 63444 - DNA, 25 bp, Homo sapien
cccaggggcctcttgaagatgttcc

SEQ ID NO: 63445 - DNA, 25 bp, Homo sapien
ctggacacgtactccagggcattgc

SEQ ID NO: 63446 - DNA, 25 bp, Homo sapien
aggtgctcaccgagaacacatattc

SEQ ID NO: 63447 - DNA, 25 bp, Homo sapien
cagggcattgcccacgttgatctgc

SEQ ID NO: 63448 - DNA, 25 bp, Homo sapien
ggggccacgccaaactgcttgagct

SEQ ID NO: 63449 - DNA, 25 bp, Homo sapien
attcggggctcagcgagatcttcac

SEQ ID NO: 63450 - DNA, 25 bp, Homo sapien
cttggcagagaggatactgacatcg

SEQ ID NO: 63451 - DNA, 25 bp, Homo sapien
agccgcttgctgtaacgaggggctc

SEQ ID NO: 63452 - DNA, 25 bp, Homo sapien
ctcccggcaacatgacgtggggctg

SEQ ID NO: 63453 - DNA, 25 bp, Homo sapien
actgacatcggtctggaggccgtac

SEQ ID NO: 63454 - DNA, 25 bp, Homo sapien
caggagccgagctcggtttcaccgc

SEQ ID NO: 63455 - DNA, 25 bp, Homo sapien
ctacaagcaggagctttggcggcgc

SEQ ID NO: 63456 - DNA, 25 bp, Homo sapien
taaaggtcctagtggccactgattc

SEQ ID NO: 63457 - DNA, 25 bp, Homo sapien
ttccaaggaaacaatgcgtgggcgc

SEQ ID NO: 63458 - DNA, 25 bp, Homo sapien
tttggcgttgccacttactggtcgg

SEQ ID NO: 63459 - DNA, 25 bp, Homo sapien
tgactttttcttggcgggcaaggcc

SEQ ID NO: 63460 - DNA, 25 bp, Homo sapien
gccgaagtacatagcgctttccctg

SEQ ID NO: 63461 - DNA, 25 bp, Homo sapien
tttgcccgcggatcttgactttttc

SEQ ID NO: 63462 - DNA, 25 bp, Homo sapien
aaatttcgacgatgtgccgcgcgct

SEQ ID NO: 63463 - DNA, 25 bp, Homo sapien
cggcgcgatgtcacctatgcaaagt

SEQ ID NO: 63464 - DNA, 25 bp, Homo sapien
cgcaactcacgggaatcgcagctgt

SEQ ID NO: 63465 - DNA, 25 bp, Homo sapien
atcgcagctgtgtgctcaactttcc

SEQ ID NO: 63466 - DNA, 25 bp, Homo sapien
cttgcggcatccgtggtcacgattc

SEQ ID NO: 63467 - DNA, 25 bp, Homo sapien
aaacgaccctgtggcgcaggtctgc

SEQ ID NO: 63468 - DNA, 25 bp, Homo sapien
agcactgagcgcctcctgagagcca

SEQ ID NO: 63469 - DNA, 25 bp, Homo sapien
ccagccctgacgtgaactcatttta

SEQ ID NO: 63470 - DNA, 25 bp, Homo sapien
tatctgccacgacccagaaggtggg

SEQ ID NO: 63471 - DNA, 25 bp, Homo sapien
agaaggtgggcgcaattttcctatg

SEQ ID NO: 63472 - DNA, 25 bp, Homo sapien
aatgcatacgctttcgagggaagga

SEQ ID NO: 63473 - DNA, 25 bp, Homo sapien
ctcagggagctaggcagttgcccaa

SEQ ID NO: 63474 - DNA, 25 bp, Homo sapien
ggcaactcaggcctctgaaagcctt

SEQ ID NO: 63475 - DNA, 25 bp, Homo sapien
gtcagggtctctccggcgtccgtct

SEQ ID NO: 63476 - DNA, 25 bp, Homo sapien
gaggacgacgcgctcaaccagatcg

SEQ ID NO: 63477 - DNA, 25 bp, Homo sapien
ggctgaaccaaatcctgtgctcacc

SEQ ID NO: 63478 - DNA, 25 bp, Homo sapien
cgctcaaccagatcgcgcgggaggt

SEQ ID NO: 63479 - DNA, 25 bp, Homo sapien
gggagcgccaggctgaaccaaatcc

SEQ ID NO: 63480 - DNA, 25 bp, Homo sapien
cgcggtcgatggacatgggcaccca

SEQ ID NO: 63481 - DNA, 25 bp, Homo sapien
cgtctgtcccgctgtgcgtctgtgc

SEQ ID NO: 63482 - DNA, 25 bp, Homo sapien
ctcaaagccgggagatcgactgttt

SEQ ID NO: 63483 - DNA, 25 bp, Homo sapien
cagctgcgtcgtcctggaagtcggc

SEQ ID NO: 63484 - DNA, 25 bp, Homo sapien
tggaagtcggcccttctcgggatgc

SEQ ID NO: 63485 - DNA, 25 bp, Homo sapien
gggcctaggcttccgcgtccaggaa

SEQ ID NO: 63486 - DNA, 25 bp, Homo sapien
ttccgcgtccaggaagctcagcgtg

SEQ ID NO: 63487 - DNA, 25 bp, Homo sapien
gggagccgggaactcataccctcgc

SEQ ID NO: 63488 - DNA, 25 bp, Homo sapien
accaggaagatccttccgagacgga

SEQ ID NO: 63489 - DNA, 25 bp, Homo sapien
aagatccttccgagacggagcgcgg

SEQ ID NO: 63490 - DNA, 25 bp, Homo sapien
aagcgccgagtcaccgggctaaccg

SEQ ID NO: 63491 - DNA, 25 bp, Homo sapien
tctgtgttggatgaaggcagcttcg

SEQ ID NO: 63492 - DNA, 25 bp, Homo sapien
cattctcaggaggaagcgccgagtc

SEQ ID NO: 63493 - DNA, 25 bp, Homo sapien
tgtaaggcgctttcggtgatacctc

SEQ ID NO: 63494 - DNA, 25 bp, Homo sapien
tcccgtgctgtaaggcgctttcggt

SEQ ID NO: 63495 - DNA, 25 bp, Homo sapien
tccggctcccgtgctgtaaggcgct

SEQ ID NO: 63496 - DNA, 25 bp, Homo sapien
ggtgactggccattctcaggaggaa

SEQ ID NO: 63497 - DNA, 25 bp, Homo sapien
gcgctttcggtgatacctcctttcc

SEQ ID NO: 63498 - DNA, 25 bp, Homo sapien
catatgcttcttcttgccgtggaga

SEQ ID NO: 63499 - DNA, 25 bp, Homo sapien
ccggggaaagctagaaattcgcaca

SEQ ID NO: 63500 - DNA, 25 bp, Homo sapien
ggccgctggtgactgttacccaaca

SEQ ID NO: 63501 - DNA, 25 bp, Homo sapien
ccagacgagggtttcaggctgcaaa

SEQ ID NO: 63502 - DNA, 25 bp, Homo sapien
agcagcgcttccaagtattttcata

SEQ ID NO: 63503 - DNA, 25 bp, Homo sapien
tgggccaatcacagtgccgcacttt

SEQ ID NO: 63504 - DNA, 25 bp, Homo sapien
agttcgttccgtactcaggcgtgtg

SEQ ID NO: 63505 - DNA, 25 bp, Homo sapien
cgcacttttcatactgcccgacagg

SEQ ID NO: 63506 - DNA, 25 bp, Homo sapien
gccctgcacactggagaactagttt

SEQ ID NO: 63507 - DNA, 25 bp, Homo sapien
gcaccttgcagaagacgcagtgttc

SEQ ID NO: 63508 - DNA, 25 bp, Homo sapien
ttgcaaaacctgcagacgggcacct

SEQ ID NO: 63509 - DNA, 25 bp, Homo sapien
aggccgtcccgcgttgcaaaacctg

SEQ ID NO: 63510 - DNA, 25 bp, Homo sapien
tggcgagcggactcgactcggcacc

SEQ ID NO: 63511 - DNA, 25 bp, Homo sapien
gactcggcaccgctgtgcaccatgg

SEQ ID NO: 63512 - DNA, 25 bp, Homo sapien
gggcgcacagatccgctgcccttga

SEQ ID NO: 63513 - DNA, 25 bp, Homo sapien
acctcgtttctcaggctgtgcgccg

SEQ ID NO: 63514 - DNA, 25 bp, Homo sapien
tgggcgcggctacttggccctcacg

SEQ ID NO: 63515 - DNA, 25 bp, Homo sapien
cgggttccaggaacagccaggacca

SEQ ID NO: 63516 - DNA, 25 bp, Homo sapien
cccaccatccaaagggcgacaggga

SEQ ID NO: 63517 - DNA, 25 bp, Homo sapien
ctgagtcctaaccacacgccgtgga

SEQ ID NO: 63518 - DNA, 25 bp, Homo sapien
cgccgctgagtccaaggaccgagct

SEQ ID NO: 63519 - DNA, 25 bp, Homo sapien
ctggttctggcggtgtctccactca

SEQ ID NO: 63520 - DNA, 25 bp, Homo sapien
tgtctccactcagccctcggaggga

SEQ ID NO: 63521 - DNA, 25 bp, Homo sapien
ggcgatgcctcctgagtcctaacca

SEQ ID NO: 63522 - DNA, 25 bp, Homo sapien
atggaacatctacacgccgccggtc

SEQ ID NO: 63523 - DNA, 25 bp, Homo sapien
cctgcaccaggacaatcaagggttc

SEQ ID NO: 63524 - DNA, 25 bp, Homo sapien
tccctaagttagagcgcgagtgcaa

SEQ ID NO: 63525 - DNA, 25 bp, Homo sapien
tgtgaacctgggacacctagccttg

SEQ ID NO: 63526 - DNA, 25 bp, Homo sapien
cccgctactgcctgagctgctgaaa

SEQ ID NO: 63527 - DNA, 25 bp, Homo sapien
tctccaacgagtggtgacaggcgtc

SEQ ID NO: 63528 - DNA, 25 bp, Homo sapien
gaccggcaccggatacttctatagc

SEQ ID NO: 63529 - DNA, 25 bp, Homo sapien
gggctccacagagtttccactagtg

SEQ ID NO: 63530 - DNA, 25 bp, Homo sapien
gctgcctgccttgtacggaggaagc

SEQ ID NO: 63531 - DNA, 25 bp, Homo sapien
gggctccagagccaactcggaatcc

SEQ ID NO: 63532 - DNA, 25 bp, Homo sapien
ctctgccaatgagcgaggtccgaga

SEQ ID NO: 63533 - DNA, 25 bp, Homo sapien
ttaaagcgcccgctgctgtctcggc

SEQ ID NO: 63534 - DNA, 25 bp, Homo sapien
ctgttcgcgtgtctggttccaaata

SEQ ID NO: 63535 - DNA, 25 bp, Homo sapien
cctaaaccctgcagaccacgaagtg

SEQ ID NO: 63536 - DNA, 25 bp, Homo sapien
tgaacccgtgttggaaccaggtgca

SEQ ID NO: 63537 - DNA, 25 bp, Homo sapien
caatcagcggcggttgcgaaatccg

SEQ ID NO: 63538 - DNA, 25 bp, Homo sapien
tggggtgcttcgctcagccaatccg

SEQ ID NO: 63539 - DNA, 25 bp, Homo sapien
ggaagctctgtgacgcgctaagccc

SEQ ID NO: 63540 - DNA, 25 bp, Homo sapien
agacgcggcttctagcgcccggttc

SEQ ID NO: 63541 - DNA, 25 bp, Homo sapien
cagacagcaaaggtcacggggctcc

SEQ ID NO: 63542 - DNA, 25 bp, Homo sapien
tcccgcgctcatgcggctagaggga

SEQ ID NO: 63543 - DNA, 25 bp, Homo sapien
ctcatcactgtccagggtggcctgc

SEQ ID NO: 63544 - DNA, 25 bp, Homo sapien
gtccagcggacctgctcatcactgt

SEQ ID NO: 63545 - DNA, 25 bp, Homo sapien
tccgactaacggacgcgcaggtcca

SEQ ID NO: 63546 - DNA, 25 bp, Homo sapien
cccagcgcatgacgccgctgccacg

SEQ ID NO: 63547 - DNA, 25 bp, Homo sapien
tcaagttcttggtgcagcgggccca

SEQ ID NO: 63548 - DNA, 25 bp, Homo sapien
gcccgggcatcaccgatgctctggg

SEQ ID NO: 63549 - DNA, 25 bp, Homo sapien
tgcccggcaaccagcgggcccacaa

SEQ ID NO: 63550 - DNA, 25 bp, Homo sapien
cctggactgcgtcaagttcttggtg

SEQ ID NO: 63551 - DNA, 25 bp, Homo sapien
ctggccacctggactgcgtcaagtt

SEQ ID NO: 63552 - DNA, 25 bp, Homo sapien
cctggttcaccacgccacccgggct

SEQ ID NO: 63553 - DNA, 25 bp, Homo sapien
tgggcccgggcatcaccgatgctct

SEQ ID NO: 63554 - DNA, 25 bp, Homo sapien
cccggcttcctgtgaacgcagttgc

SEQ ID NO: 63555 - DNA, 25 bp, Homo sapien
gtgaacgcagttgctcctccggcct

SEQ ID NO: 63556 - DNA, 25 bp, Homo sapien
tgccagtgcatctgcctgggtgaga

SEQ ID NO: 63557 - DNA, 25 bp, Homo sapien
ttcactgttccctgcgctcagagtg

SEQ ID NO: 63558 - DNA, 25 bp, Homo sapien
ggggtgcgaaagtgttcactgttcc

SEQ ID NO: 63559 - DNA, 25 bp, Homo sapien
cttcgcggcatccttgctgtgcctg

SEQ ID NO: 63560 - DNA, 25 bp, Homo sapien
agcttccgttgcgtggacacggcac

SEQ ID NO: 63561 - DNA, 25 bp, Homo sapien
cgcgtacggctgatgagttttaaca

SEQ ID NO: 63562 - DNA, 25 bp, Homo sapien
tgccctcaggcgacatcgacgggct

SEQ ID NO: 63563 - DNA, 25 bp, Homo sapien
gggctgccctcaggcgacatcgacg

SEQ ID NO: 63564 - DNA, 25 bp, Homo sapien
ggccgcactacagctggatgggctg

SEQ ID NO: 63565 - DNA, 25 bp, Homo sapien
ctcagatggcctggccgcactacag

SEQ ID NO: 63566 - DNA, 25 bp, Homo sapien
ggacacctcagatggcctggccgca

SEQ ID NO: 63567 - DNA, 25 bp, Homo sapien
agcccatcccagagtggaagcggca

SEQ ID NO: 63568 - DNA, 25 bp, Homo sapien
ccagcccatcccagagtggaagcgg

SEQ ID NO: 63569 - DNA, 25 bp, Homo sapien
cctcaggcgacatcgacgggctggt

SEQ ID NO: 63570 - DNA, 25 bp, Homo sapien
agccactggaggagatcggcctaca

SEQ ID NO: 63571 - DNA, 25 bp, Homo sapien
cttcaacggtgaggacatctgcggc

SEQ ID NO: 63572 - DNA, 25 bp, Homo sapien
tggccgcaagtcaggtctgaccctg

SEQ ID NO: 63573 - DNA, 25 bp, Homo sapien
ttcgaggacatcaaagcccgcttct

SEQ ID NO: 63574 - DNA, 25 bp, Homo sapien
ttccacaaggccgtgaccgacgagg

SEQ ID NO: 63575 - DNA, 25 bp, Homo sapien
ttcgaggtcttcgagcacctgggca

SEQ ID NO: 63576 - DNA, 25 bp, Homo sapien
cctcaagacagtggcctgcaggacc

SEQ ID NO: 63577 - DNA, 25 bp, Homo sapien
cacctgctgggcaactggaaggcca

SEQ ID NO: 63578 - DNA, 25 bp, Homo sapien
tgcgcagcctttcgccctggggtga

SEQ ID NO: 63579 - DNA, 25 bp, Homo sapien
ggccctgtgggctcccaggtgcttc

SEQ ID NO: 63580 - DNA, 25 bp, Homo sapien
ttcttggcctcctggttctccagct

SEQ ID NO: 63581 - DNA, 25 bp, Homo sapien
ggttctccagctgagctttgtcatt

SEQ ID NO: 63582 - DNA, 25 bp, Homo sapien
ccagctgagctttgtcatttccatg

SEQ ID NO: 63583 - DNA, 25 bp, Homo sapien
tgtcatttccatgcgtggcgttccc

SEQ ID NO: 63584 - DNA, 25 bp, Homo sapien
gtggcgttcccacgcattttgtacc

SEQ ID NO: 63585 - DNA, 25 bp, Homo sapien
cattttgtacctgtggacgcgcggc

SEQ ID NO: 63586 - DNA, 25 bp, Homo sapien
tgacttcgccgagagcttctctgcg

SEQ ID NO: 63587 - DNA, 25 bp, Homo sapien
ctacctgcagcagcaactggatgcc

SEQ ID NO: 63588 - DNA, 25 bp, Homo sapien
agctgctcagcctagtgcacctgga

SEQ ID NO: 63589 - DNA, 25 bp, Homo sapien
gcaaagccgactcgaggccctgatg

SEQ ID NO: 63590 - DNA, 25 bp, Homo sapien
cgtgaggacgagttcctgcagcttc

SEQ ID NO: 63591 - DNA, 25 bp, Homo sapien
gggccttcctgcgagagaactttga

SEQ ID NO: 63592 - DNA, 25 bp, Homo sapien
tccatgccatgtttgcgggtgactt

SEQ ID NO: 63593 - DNA, 25 bp, Homo sapien
gacttcgtgtacacaggccggctga

SEQ ID NO: 63594 - DNA, 25 bp, Homo sapien
acagcctgcatgagaatggcgcgct

SEQ ID NO: 63595 - DNA, 25 bp, Homo sapien
gctaacccgctgaccgtgcacaggt

SEQ ID NO: 63596 - DNA, 25 bp, Homo sapien
tcacagcacagcctgcatgagaatg

SEQ ID NO: 63597 - DNA, 25 bp, Homo sapien
ccactgggtgatgcgctgtacgtga

SEQ ID NO: 63598 - DNA, 25 bp, Homo sapien
ctaccacgtggagatggaggcctac

SEQ ID NO: 63599 - DNA, 25 bp, Homo sapien
cctacgacacggttcgggacacctg

SEQ ID NO: 63600 - DNA, 25 bp, Homo sapien
cgtgcacaggtgcagtcacagcaca

SEQ ID NO: 63601 - DNA, 25 bp, Homo sapien
cagggcatggaaggtgactaccacg

SEQ ID NO: 63602 - DNA, 25 bp, Homo sapien
ggattcaagcgcgttataaggcgag

SEQ ID NO: 63603 - DNA, 25 bp, Homo sapien
agcccgcctgctgctcgtctacgcg

SEQ ID NO: 63604 - DNA, 25 bp, Homo sapien
cgagggctgctgcatcgcctggcac

SEQ ID NO: 63605 - DNA, 25 bp, Homo sapien
gactcagggccgtgtagacgccgcc

SEQ ID NO: 63606 - DNA, 25 bp, Homo sapien
cgcagagactcagggccgtgtagac

SEQ ID NO: 63607 - DNA, 25 bp, Homo sapien
tgctgcatcgcctggcaccggggct

SEQ ID NO: 63608 - DNA, 25 bp, Homo sapien
aagcgcgttataaggcgaggagccc

SEQ ID NO: 63609 - DNA, 25 bp, Homo sapien
ctccgcagagactcagggccgtgta

SEQ ID NO: 63610 - DNA, 25 bp, Homo sapien
ctgcagggtcaggacgcaaagactc

SEQ ID NO: 63611 - DNA, 25 bp, Homo sapien
ctgaacttgaccagcggccagtaca

SEQ ID NO: 63612 - DNA, 25 bp, Homo sapien
cacgagcttggcgtctactacctgg

SEQ ID NO: 63613 - DNA, 25 bp, Homo sapien
tggtctcgctagcacctgtcgttca

SEQ ID NO: 63614 - DNA, 25 bp, Homo sapien
ggagcccgaaccctgtacgtgtggc

SEQ ID NO: 63615 - DNA, 25 bp, Homo sapien
tgctcatctgcatccagtcccggtg

SEQ ID NO: 63616 - DNA, 25 bp, Homo sapien
attcgctcggcctccacaagctgga

SEQ ID NO: 63617 - DNA, 25 bp, Homo sapien
ttaaacaggcactggacggggcttc

SEQ ID NO: 63618 - DNA, 25 bp, Homo sapien
gctgtggaccgcactgaacccagtc

SEQ ID NO: 63619 - DNA, 25 bp, Homo sapien
ccggactaccgcttggatggattga

SEQ ID NO: 63620 - DNA, 25 bp, Homo sapien
acatgtgtttaggactcgcgaggac

SEQ ID NO: 63621 - DNA, 25 bp, Homo sapien
attgatcacgttaagcgggccctgc

SEQ ID NO: 63622 - DNA, 25 bp, Homo sapien
ctcggtagctaggacccaacagttc

SEQ ID NO: 63623 - DNA, 25 bp, Homo sapien
tgcagcttctgctagctcggagcct

SEQ ID NO: 63624 - DNA, 25 bp, Homo sapien
acaacccgccagtcgatgtgaggtc

SEQ ID NO: 63625 - DNA, 25 bp, Homo sapien
cgcgaggacgtcacgtttcgaattt

SEQ ID NO: 63626 - DNA, 25 bp, Homo sapien
gagagtcccggacgccaccaatcgg

SEQ ID NO: 63627 - DNA, 25 bp, Homo sapien
cacctgcagggagagtcccggacgc

SEQ ID NO: 63628 - DNA, 25 bp, Homo sapien
ggccgttccacagcccgcgggtgaa

SEQ ID NO: 63629 - DNA, 25 bp, Homo sapien
gcgacagacactcagcccgcgagca

SEQ ID NO: 63630 - DNA, 25 bp, Homo sapien
ccttcctgcgtagcgaaaatggcgg

SEQ ID NO: 63631 - DNA, 25 bp, Homo sapien
ggccctttccttcctgcgtagcgaa

SEQ ID NO: 63632 - DNA, 25 bp, Homo sapien
cggcgcctttcaccgccacgcagag

SEQ ID NO: 63633 - DNA, 25 bp, Homo sapien
ttcagagccggtccctcgggtcggc

SEQ ID NO: 63634 - DNA, 25 bp, Homo sapien
tgagcccattgaaataccatcggaa

SEQ ID NO: 63635 - DNA, 25 bp, Homo sapien
ctttctcaagcgtaaatcgggcggc

SEQ ID NO: 63636 - DNA, 25 bp, Homo sapien
tcaccgttgggcaagtgctttaaga

SEQ ID NO: 63637 - DNA, 25 bp, Homo sapien
cacgaggatgtcgagtgtcaaatgc

SEQ ID NO: 63638 - DNA, 25 bp, Homo sapien
tcaaatgcggcaaagggctcagagc

SEQ ID NO: 63639 - DNA, 25 bp, Homo sapien
tgtagtcccgcctcaacttgtggtg

SEQ ID NO: 63640 - DNA, 25 bp, Homo sapien
accgaagatgagaacgatgagccca

SEQ ID NO: 63641 - DNA, 25 bp, Homo sapien
gtccacggttacagcccagtttcca

SEQ ID NO: 63642 - DNA, 25 bp, Homo sapien
tcgaacttcacaccttgaccgagga

SEQ ID NO: 63643 - DNA, 25 bp, Homo sapien
ccaggtcctggaatcacgcggggat

SEQ ID NO: 63644 - DNA, 25 bp, Homo sapien
gcggagccacctgttccacccgggc

SEQ ID NO: 63645 - DNA, 25 bp, Homo sapien
gcgtcccggaacagtctgcgccaga

SEQ ID NO: 63646 - DNA, 25 bp, Homo sapien
ccggaacagtctgcgccagacgggc

SEQ ID NO: 63647 - DNA, 25 bp, Homo sapien
gttggggattttcacggtgctgtcc

SEQ ID NO: 63648 - DNA, 25 bp, Homo sapien
cgcgctcctcgctctgactagggga

SEQ ID NO: 63649 - DNA, 25 bp, Homo sapien
tcctcgctctgactaggggagcccg

SEQ ID NO: 63650 - DNA, 25 bp, Homo sapien
atgaagtagtcagccagccgggcca

SEQ ID NO: 63651 - DNA, 25 bp, Homo sapien
taccacgatgaagtagtcagccagc

SEQ ID NO: 63652 - DNA, 25 bp, Homo sapien
tcagcccagccgagaaggccggacg

SEQ ID NO: 63653 - DNA, 25 bp, Homo sapien
ggtcatagcctaccacgatgaagta

SEQ ID NO: 63654 - DNA, 25 bp, Homo sapien
gaccgcccgctcctccgagactcgg

SEQ ID NO: 63655 - DNA, 25 bp, Homo sapien
ggcttctcgtggtcatagcctacca

SEQ ID NO: 63656 - DNA, 25 bp, Homo sapien
gctgggcagacgcggcgtcttccct

SEQ ID NO: 63657 - DNA, 25 bp, Homo sapien
gaagtagtcagccagccgggccatg

SEQ ID NO: 63658 - DNA, 25 bp, Homo sapien
tagccgcttatttgcatctcaatgc

SEQ ID NO: 63659 - DNA, 25 bp, Homo sapien
gcgcttgtttctctccgtctgctgc

SEQ ID NO: 63660 - DNA, 25 bp, Homo sapien
ctgctgctctaggaccactgatctg

SEQ ID NO: 63661 - DNA, 25 bp, Homo sapien
cgatggcgcctccagagttgagcgc

SEQ ID NO: 63662 - DNA, 25 bp, Homo sapien
agccacagtcaagtccgcggtctct

SEQ ID NO: 63663 - DNA, 25 bp, Homo sapien
tctcaatgcgccgattggccgcgcg

SEQ ID NO: 63664 - DNA, 25 bp, Homo sapien
ggtctctggacctagaggggtttca

SEQ ID NO: 63665 - DNA, 25 bp, Homo sapien
ccaggagatgcgtccctggtgtgca

SEQ ID NO: 63666 - DNA, 25 bp, Homo sapien
agtggtctcatccacttccggcgtc

SEQ ID NO: 63667 - DNA, 25 bp, Homo sapien
tggaactccatgttcacctcgtcgg

SEQ ID NO: 63668 - DNA, 25 bp, Homo sapien
ccgtttcaagccgaggagtccagca

SEQ ID NO: 63669 - DNA, 25 bp, Homo sapien
gtccagcagcccaaggaacttccgg

SEQ ID NO: 63670 - DNA, 25 bp, Homo sapien
cacctcgtcggttcctcaatggaga

SEQ ID NO: 63671 - DNA, 25 bp, Homo sapien
gagtcgccgctgtcacatagtggaa

SEQ ID NO: 63672 - DNA, 25 bp, Homo sapien
catagtggaaaacgtgaccgcgcgc

SEQ ID NO: 63673 - DNA, 25 bp, Homo sapien
cgcgcccgtcgctctttttacataa

SEQ ID NO: 63674 - DNA, 25 bp, Homo sapien
ctccggtgcactgtgggatggaaac

SEQ ID NO: 63675 - DNA, 25 bp, Homo sapien
tctaacgcgagcgaacaccggcttc

SEQ ID NO: 63676 - DNA, 25 bp, Homo sapien
tggcacagccgcactcccgcaaatc

SEQ ID NO: 63677 - DNA, 25 bp, Homo sapien
cgcagccctagtgaccgaacgccct

SEQ ID NO: 63678 - DNA, 25 bp, Homo sapien
aaagtgattcggaggccgccgctga

SEQ ID NO: 63679 - DNA, 25 bp, Homo sapien
tacctgcacgacatcatcacggagg

SEQ ID NO: 63680 - DNA, 25 bp, Homo sapien
cacgacatcatcacggaggtgggcg

SEQ ID NO: 63681 - DNA, 25 bp, Homo sapien
cgcgtccgttgctaaggccgcgcag

SEQ ID NO: 63682 - DNA, 25 bp, Homo sapien
cttccagctctgagcgcacggatca

SEQ ID NO: 63683 - DNA, 25 bp, Homo sapien
ggctttccgactccttggcttctta

SEQ ID NO: 63684 - DNA, 25 bp, Homo sapien
cgcgctagattttctttccggtgga

SEQ ID NO: 63685 - DNA, 25 bp, Homo sapien
tccggtggaacttgctcgtaacttc

SEQ ID NO: 63686 - DNA, 25 bp, Homo sapien
cccgttagccgatacagatttgata

SEQ ID NO: 63687 - DNA, 25 bp, Homo sapien
ggagggcaggcactttttcaccatt

SEQ ID NO: 63688 - DNA, 25 bp, Homo sapien
gcacggatcaggaaagccagccaga

SEQ ID NO: 63689 - DNA, 25 bp, Homo sapien
ccggaccgaaattcccagactgctg

SEQ ID NO: 63690 - DNA, 25 bp, Homo sapien
agagtacccagatccttctcgaagc

SEQ ID NO: 63691 - DNA, 25 bp, Homo sapien
cgaatcgcggccactgcaggccatg

SEQ ID NO: 63692 - DNA, 25 bp, Homo sapien
cttcctcatccggaagggggccgag

SEQ ID NO: 63693 - DNA, 25 bp, Homo sapien
tggatctggtggacgtaaaaggaca

SEQ ID NO: 63694 - DNA, 25 bp, Homo sapien
cgggcacctagagagtacccagatc

SEQ ID NO: 63695 - DNA, 25 bp, Homo sapien
cagatccttctcgaagctggcgcgg

SEQ ID NO: 63696 - DNA, 25 bp, Homo sapien
aacggaagccggcaccatcgcagca

SEQ ID NO: 63697 - DNA, 25 bp, Homo sapien
acagacggccctgtatgtggctgtg

SEQ ID NO: 63698 - DNA, 25 bp, Homo sapien
ggacatgccctcacacgtaacgtgg

SEQ ID NO: 63699 - DNA, 25 bp, Homo sapien
gacatgccctcacacgtaacgtggc

SEQ ID NO: 63700 - DNA, 25 bp, Homo sapien
cgtaacgtggcccaggacatgccct

SEQ ID NO: 63701 - DNA, 25 bp, Homo sapien
cacacgtaacgtggcccaggacatg

SEQ ID NO: 63702 - DNA, 25 bp, Homo sapien
tcacacgtaacgtggcccaggacat

SEQ ID NO: 63703 - DNA, 25 bp, Homo sapien
gtaacgtggcccaggacatgccctc

SEQ ID NO: 63704 - DNA, 25 bp, Homo sapien
taacgtggcccaggacatgccctca

SEQ ID NO: 63705 - DNA, 25 bp, Homo sapien
caggacatgccctcacacgtaacgt

SEQ ID NO: 63706 - DNA, 25 bp, Homo sapien
tcagtcagttcagcgcgtcgccttc

SEQ ID NO: 63707 - DNA, 25 bp, Homo sapien
cgtcgccttccttgtcagtcagttc

SEQ ID NO: 63708 - DNA, 25 bp, Homo sapien
gtcgccttccttgtcagtcagttca

SEQ ID NO: 63709 - DNA, 25 bp, Homo sapien
agttcagcgcgtcgccttccttgtc

SEQ ID NO: 63710 - DNA, 25 bp, Homo sapien
cttccttgtcagtcggttcagcgcg

SEQ ID NO: 63711 - DNA, 25 bp, Homo sapien
gccttccttgtcagtcggttcagcg

SEQ ID NO: 63712 - DNA, 25 bp, Homo sapien
tcagcgcgtcgccttccttgtcagt

SEQ ID NO: 63713 - DNA, 25 bp, Homo sapien
tcgccttccttgtcagtcggttcag

SEQ ID NO: 63714 - DNA, 25 bp, Homo sapien
ggcatctccacggatcttggcggca

SEQ ID NO: 63715 - DNA, 25 bp, Homo sapien
cagcaagccagggtaagaaatggtc

SEQ ID NO: 63716 - DNA, 25 bp, Homo sapien
gctcgctgtggcgttgttttaaagc

SEQ ID NO: 63717 - DNA, 25 bp, Homo sapien
acctgggaataggttcaaaggcatc

SEQ ID NO: 63718 - DNA, 25 bp, Homo sapien
ttgatcacgcggcttgcctgacagc

SEQ ID NO: 63719 - DNA, 25 bp, Homo sapien
taggcgttctgccttcctggacgga

SEQ ID NO: 63720 - DNA, 25 bp, Homo sapien
gcgctgctaccgactcacatgcatg

SEQ ID NO: 63721 - DNA, 25 bp, Homo sapien
gctctgcagaacctttaggcaccga

SEQ ID NO: 63722 - DNA, 25 bp, Homo sapien
accggagggttattatctgcagagc

SEQ ID NO: 63723 - DNA, 25 bp, Homo sapien
tccggctgcgaggtttcgagattct

SEQ ID NO: 63724 - DNA, 25 bp, Homo sapien
ctgggacgcaatcctaaagaaaacg

SEQ ID NO: 63725 - DNA, 25 bp, Homo sapien
tcgagattctgggacgcaatcctaa

SEQ ID NO: 63726 - DNA, 25 bp, Homo sapien
ttccagacaccggagggttattatc

SEQ ID NO: 63727 - DNA, 25 bp, Homo sapien
attaaacatttccagacaccggagg

SEQ ID NO: 63728 - DNA, 25 bp, Homo sapien
ttcgcggtaattaaacatttccaga

SEQ ID NO: 63729 - DNA, 25 bp, Homo sapien
atctgcagagcgatttccggcgatg

SEQ ID NO: 63730 - DNA, 25 bp, Homo sapien
gagatgtctgctcgtcacccacagg

SEQ ID NO: 63731 - DNA, 25 bp, Homo sapien
ttccggagcccaccaagacgctgaa

SEQ ID NO: 63732 - DNA, 25 bp, Homo sapien
gcttcgggttaagcctctgtcttta

SEQ ID NO: 63733 - DNA, 25 bp, Homo sapien
aatcctgcccgtgcctctgtctagg

SEQ ID NO: 63734 - DNA, 25 bp, Homo sapien
aagttcgcccgagttgcaatcctgc

SEQ ID NO: 63735 - DNA, 25 bp, Homo sapien
ttgcatttctagagccacccgtgta

SEQ ID NO: 63736 - DNA, 25 bp, Homo sapien
cacccgtgtagttgcgagacagtga

SEQ ID NO: 63737 - DNA, 25 bp, Homo sapien
tcttggtttaacgaaggctctagcc

SEQ ID NO: 63738 - DNA, 25 bp, Homo sapien
gcagcggtcccagggctctcgcagc

SEQ ID NO: 63739 - DNA, 25 bp, Homo sapien
gcggtcccagggctctcgcagcccg

SEQ ID NO: 63740 - DNA, 25 bp, Homo sapien
gcctcggcttgcttccctcgcagcg

SEQ ID NO: 63741 - DNA, 25 bp, Homo sapien
ctcggcttgcttccctcgcagcggt

SEQ ID NO: 63742 - DNA, 25 bp, Homo sapien
tccctcgcagcggtcccagggctct

SEQ ID NO: 63743 - DNA, 25 bp, Homo sapien
cctcgcagcggtcccagggctctcg

SEQ ID NO: 63744 - DNA, 25 bp, Homo sapien
tcgcagcggtcccagggctctcgca

SEQ ID NO: 63745 - DNA, 25 bp, Homo sapien
cgcctcggcttgcttccctcgcagc

SEQ ID NO: 63746 - DNA, 25 bp, Homo sapien
tacgcaatcctccaaggagcctcgg

SEQ ID NO: 63747 - DNA, 25 bp, Homo sapien
aggcttttacgcaatcctccaagga

SEQ ID NO: 63748 - DNA, 25 bp, Homo sapien
cgggatcctcccgaactgggctggc

SEQ ID NO: 63749 - DNA, 25 bp, Homo sapien
agattccaccgaggaacgcggcatc

SEQ ID NO: 63750 - DNA, 25 bp, Homo sapien
aaggagcctcgggtttcaatgccgg

SEQ ID NO: 63751 - DNA, 25 bp, Homo sapien
tccaaggagcctcgggtttcaatgc

SEQ ID NO: 63752 - DNA, 25 bp, Homo sapien
atcctccaaggagcctcgggtttca

SEQ ID NO: 63753 - DNA, 25 bp, Homo sapien
ggagggagaggcttttacgcaatcc

SEQ ID NO: 63754 - DNA, 25 bp, Homo sapien
gctgtgtctgcctagctgtttctca

SEQ ID NO: 63755 - DNA, 25 bp, Homo sapien
ttgatctcaggtgttcgtgggcctc

SEQ ID NO: 63756 - DNA, 25 bp, Homo sapien
ttcctcgggtcagcgtctgcatcaa

SEQ ID NO: 63757 - DNA, 25 bp, Homo sapien
tgagtcttcaatcgtctgccggatg

SEQ ID NO: 63758 - DNA, 25 bp, Homo sapien
cggatgttttcatgatgcgggccaa

SEQ ID NO: 63759 - DNA, 25 bp, Homo sapien
gcgggccaattttgaagctcctgga

SEQ ID NO: 63760 - DNA, 25 bp, Homo sapien
tggaattgggatcttctcacgtgcc

SEQ ID NO: 63761 - DNA, 25 bp, Homo sapien
cacgtgccctgtgggttttgatctc

SEQ ID NO: 63762 - DNA, 25 bp, Homo sapien
cccgccagagtgtgcttggcttccg

SEQ ID NO: 63763 - DNA, 25 bp, Homo sapien
tgtccctgggtgctccaagagagcc

SEQ ID NO: 63764 - DNA, 25 bp, Homo sapien
tgtcaactgaattcggcagctcggc

SEQ ID NO: 63765 - DNA, 25 bp, Homo sapien
ttcttccacggcgtcccttgcggga

SEQ ID NO: 63766 - DNA, 25 bp, Homo sapien
tcccgtgttccctgtgaggctgcca

SEQ ID NO: 63767 - DNA, 25 bp, Homo sapien
cgtgcatgtgcgtctcgagacctgt

SEQ ID NO: 63768 - DNA, 25 bp, Homo sapien
aaggcttcccgtggctgttgcacgc

SEQ ID NO: 63769 - DNA, 25 bp, Homo sapien
gctgccacgcccaggcgtgcatgtg

SEQ ID NO: 63770 - DNA, 25 bp, Homo sapien
cgcgtctcatggcatcgtaagaaga

SEQ ID NO: 63771 - DNA, 25 bp, Homo sapien
gcacagcccagaaacgcgtctcatg

SEQ ID NO: 63772 - DNA, 25 bp, Homo sapien
cctgcaacgggaaacgggagactgc

SEQ ID NO: 63773 - DNA, 25 bp, Homo sapien
gtcaggtacccgaagcctgcaacgg

SEQ ID NO: 63774 - DNA, 25 bp, Homo sapien
ggcccatcagctgcttcgtcaggta

SEQ ID NO: 63775 - DNA, 25 bp, Homo sapien
tcgagggccaggacaatccggccgc

SEQ ID NO: 63776 - DNA, 25 bp, Homo sapien
caaatggcggtcaggtcgtggcctc

SEQ ID NO: 63777 - DNA, 25 bp, Homo sapien
agacacatggccaggccgggtttcg

SEQ ID NO: 63778 - DNA, 25 bp, Homo sapien
cacggccacggagttgaagtagcaa

SEQ ID NO: 63779 - DNA, 25 bp, Homo sapien
aactgacgctggagacgaagcgcag

SEQ ID NO: 63780 - DNA, 25 bp, Homo sapien
acggcaaaggagcaacctgagctgc

SEQ ID NO: 63781 - DNA, 25 bp, Homo sapien
aaggcggctctgcttacccagtcca

SEQ ID NO: 63782 - DNA, 25 bp, Homo sapien
tcacgctcaacctctgctgcagaag

SEQ ID NO: 63783 - DNA, 25 bp, Homo sapien
gccagagagccactcggggtccacg

SEQ ID NO: 63784 - DNA, 25 bp, Homo sapien
ctgctgtccgctcggggacggcaaa

SEQ ID NO: 63785 - DNA, 25 bp, Homo sapien
acccagtccacgatgaggatcttgc

SEQ ID NO: 63786 - DNA, 25 bp, Homo sapien
ttccctgtacacgaaggagactctg

SEQ ID NO: 63787 - DNA, 25 bp, Homo sapien
tctgctctaacacgcggatctgact

SEQ ID NO: 63788 - DNA, 25 bp, Homo sapien
actctgctctaacacgcggatctga

SEQ ID NO: 63789 - DNA, 25 bp, Homo sapien
tccctgcacatgaaggagactctgc

SEQ ID NO: 63790 - DNA, 25 bp, Homo sapien
ctctgctctaacacgcggatctgac

SEQ ID NO: 63791 - DNA, 25 bp, Homo sapien
cgcggatctgactatctctcacgta

SEQ ID NO: 63792 - DNA, 25 bp, Homo sapien
cggatctgactatctcgcacgtaca

SEQ ID NO: 63793 - DNA, 25 bp, Homo sapien
gactctgctctaacacgcggatctg

SEQ ID NO: 63794 - DNA, 25 bp, Homo sapien
atcagcgcacatccaggggcgagcc

SEQ ID NO: 63795 - DNA, 25 bp, Homo sapien
cagaggggccaagatcagcgcacat

SEQ ID NO: 63796 - DNA, 25 bp, Homo sapien
tcagcgtgtcatacacgaggcctgg

SEQ ID NO: 63797 - DNA, 25 bp, Homo sapien
actggtgcttcagcatcagcgtgtc

SEQ ID NO: 63798 - DNA, 25 bp, Homo sapien
tactcccgcaggtgcactggtgctt

SEQ ID NO: 63799 - DNA, 25 bp, Homo sapien
caggcgggaccagatgctctggatc

SEQ ID NO: 63800 - DNA, 25 bp, Homo sapien
ggtcggcgttacctcgcatttgccc

SEQ ID NO: 63801 - DNA, 25 bp, Homo sapien
taatggtgcccaaagccgcagctgc

SEQ ID NO: 63802 - DNA, 25 bp, Homo sapien
ttacctgtcgtgaacctcggcttgg

SEQ ID NO: 63803 - DNA, 25 bp, Homo sapien
tcaggctgcacaaaggccacgtgtt

SEQ ID NO: 63804 - DNA, 25 bp, Homo sapien
ctgcacaaaggccacgtgttacctg

SEQ ID NO: 63805 - DNA, 25 bp, Homo sapien
aaaggccacgtgttacctgtcgtga

SEQ ID NO: 63806 - DNA, 25 bp, Homo sapien
cacagacacggggaaggtggcagac

SEQ ID NO: 63807 - DNA, 25 bp, Homo sapien
tccatggacgcctggtagttcctca

SEQ ID NO: 63808 - DNA, 25 bp, Homo sapien
acgcctggtagttcctcagctggtg

SEQ ID NO: 63809 - DNA, 25 bp, Homo sapien
gttgcaccctcaggctgcacaaagg

SEQ ID NO: 63810 - DNA, 25 bp, Homo sapien
cgttatatgacattccggcgtgccg

SEQ ID NO: 63811 - DNA, 25 bp, Homo sapien
tgtggctgcgttatatgacattcca

SEQ ID NO: 63812 - DNA, 25 bp, Homo sapien
cgtgtggccgcgttatatgacattc

SEQ ID NO: 63813 - DNA, 25 bp, Homo sapien
gtgtggccgcgttatatgacattcc

SEQ ID NO: 63814 - DNA, 25 bp, Homo sapien
cgtgtggctgcgttatatgacattc

SEQ ID NO: 63815 - DNA, 25 bp, Homo sapien
gtggccgcgttatatgacattccat

SEQ ID NO: 63816 - DNA, 25 bp, Homo sapien
ttatatgacattccggcgtgccggc

SEQ ID NO: 63817 - DNA, 25 bp, Homo sapien
ggccgcgttatatgacattccatgt

SEQ ID NO: 63818 - DNA, 25 bp, Homo sapien
taccctggtgagtgttactccatgc

SEQ ID NO: 63819 - DNA, 25 bp, Homo sapien
ctgcggaggcagaaataccctggtg

SEQ ID NO: 63820 - DNA, 25 bp, Homo sapien
ctgacgctcccggagctgttgttgg

SEQ ID NO: 63821 - DNA, 25 bp, Homo sapien
cccgagtccgactctagccgtagga

SEQ ID NO: 63822 - DNA, 25 bp, Homo sapien
ggcgcgataccgttctccgcgctga

SEQ ID NO: 63823 - DNA, 25 bp, Homo sapien
aggacaaacgcttcgcactgacctc

SEQ ID NO: 63824 - DNA, 25 bp, Homo sapien
tctagccgtaggacacaggacaaac

SEQ ID NO: 63825 - DNA, 25 bp, Homo sapien
ttccacggacctgctcgttagcttg

SEQ ID NO: 63826 - DNA, 25 bp, Homo sapien
aggggccgcgccttctctaactgac

SEQ ID NO: 63827 - DNA, 25 bp, Homo sapien
ttccacacctggtggagcgcctggg

SEQ ID NO: 63828 - DNA, 25 bp, Homo sapien
aggctcttctttctgctcctgtcgc

SEQ ID NO: 63829 - DNA, 25 bp, Homo sapien
ttcccacgtggagttcccacagggc

SEQ ID NO: 63830 - DNA, 25 bp, Homo sapien
ggcttcacaggcttcgtggagagca

SEQ ID NO: 63831 - DNA, 25 bp, Homo sapien
cgccggcatcttccggatgaggctc

SEQ ID NO: 63832 - DNA, 25 bp, Homo sapien
tccggatgaggctctctagacaaca

SEQ ID NO: 63833 - DNA, 25 bp, Homo sapien
atgggatgcaagtgcccgccaagcc

SEQ ID NO: 63834 - DNA, 25 bp, Homo sapien
tggtcaccgagcaggcgttcagtaa

SEQ ID NO: 63835 - DNA, 25 bp, Homo sapien
tgaaagtaaaacctgtcctggcgcg

SEQ ID NO: 63836 - DNA, 25 bp, Homo sapien
accaagtggaagctggcgacaagta

SEQ ID NO: 63837 - DNA, 25 bp, Homo sapien
tcctcagagcgactgatagccagtc

SEQ ID NO: 63838 - DNA, 25 bp, Homo sapien
cgaagagcttgactcgcagaggata

SEQ ID NO: 63839 - DNA, 25 bp, Homo sapien
agtaatagctgctgtctgcggtgca

SEQ ID NO: 63840 - DNA, 25 bp, Homo sapien
ccagtcctggatctgcgcgaagagc

SEQ ID NO: 63841 - DNA, 25 bp, Homo sapien
cgcgcgcgggagaaatgaaagtaaa

SEQ ID NO: 63842 - DNA, 25 bp, Homo sapien
cttcaatccctctacgacaggggtc

SEQ ID NO: 63843 - DNA, 25 bp, Homo sapien
atttagtgaatcaggggctccgggc

SEQ ID NO: 63844 - DNA, 25 bp, Homo sapien
ccaccagctggtgattcttcctgga

SEQ ID NO: 63845 - DNA, 25 bp, Homo sapien
ccagggaaaggatgagcaaagcata

SEQ ID NO: 63846 - DNA, 25 bp, Homo sapien
aggcagccactggatgcctgtgctc

SEQ ID NO: 63847 - DNA, 25 bp, Homo sapien
tgtcgtccctgtgtattcttcaatc

SEQ ID NO: 63848 - DNA, 25 bp, Homo sapien
gcccgaggaactttctgtggaggaa

SEQ ID NO: 63849 - DNA, 25 bp, Homo sapien
tgggatgccacccacgtcacactgt

SEQ ID NO: 63850 - DNA, 25 bp, Homo sapien
tccaggtaactgtgagcgtgcaagg

SEQ ID NO: 63851 - DNA, 25 bp, Homo sapien
accttcagcggcgttggcaaggtga

SEQ ID NO: 63852 - DNA, 25 bp, Homo sapien
agcatgtgtgctccaggtaactgtg

SEQ ID NO: 63853 - DNA, 25 bp, Homo sapien
tgcccgcacggaggaacctgcacat

SEQ ID NO: 63854 - DNA, 25 bp, Homo sapien
tacagggctcgctgctccaagacaa

SEQ ID NO: 63855 - DNA, 25 bp, Homo sapien
acccaagtgtgcgttctgaatgtga

SEQ ID NO: 63856 - DNA, 25 bp, Homo sapien
ggcggcacaagccttctgctacagg

SEQ ID NO: 63857 - DNA, 25 bp, Homo sapien
atcaacgtgcttgtgcacccaagtg

SEQ ID NO: 63858 - DNA, 25 bp, Homo sapien
ttgttgcctggtgttaccgtcccaa

SEQ ID NO: 63859 - DNA, 25 bp, Homo sapien
gcccgcggtttgttgcctggtgtta

SEQ ID NO: 63860 - DNA, 25 bp, Homo sapien
tacacgcaagtgctgcccgcggttt

SEQ ID NO: 63861 - DNA, 25 bp, Homo sapien
acgtcctccacaatacacgcaagtg

SEQ ID NO: 63862 - DNA, 25 bp, Homo sapien
gttcccactcagcaccacgtcctcc

SEQ ID NO: 63863 - DNA, 25 bp, Homo sapien
cgcctcaccttgatgtgctcgtgga

SEQ ID NO: 63864 - DNA, 25 bp, Homo sapien
caccttgatgtgctcgtggagctgc

SEQ ID NO: 63865 - DNA, 25 bp, Homo sapien
tggtgttaccgtcccaacgcagaag

SEQ ID NO: 63866 - DNA, 25 bp, Homo sapien
tccagacagacgctcgagacccgga

SEQ ID NO: 63867 - DNA, 25 bp, Homo sapien
cggagcccgtttccatggtgagaca

SEQ ID NO: 63868 - DNA, 25 bp, Homo sapien
tgtgagagccacaagagcgtgtgcc

SEQ ID NO: 63869 - DNA, 25 bp, Homo sapien
tttaccagacacagccaacgagacg

SEQ ID NO: 63870 - DNA, 25 bp, Homo sapien
cctggctcttggcacaagtgcgttc

SEQ ID NO: 63871 - DNA, 25 bp, Homo sapien
cacaagtgcgttcctctgggcatgc

SEQ ID NO: 63872 - DNA, 25 bp, Homo sapien
ctgggcatgcgtttctgcacctcgc

SEQ ID NO: 63873 - DNA, 25 bp, Homo sapien
caccgtgccgctgtgagagccacaa

SEQ ID NO: 63874 - DNA, 25 bp, Homo sapien
ctcaaccgaggttgctgagcacctg

SEQ ID NO: 63875 - DNA, 25 bp, Homo sapien
ccctctcctcaatcgaggctgctga

SEQ ID NO: 63876 - DNA, 25 bp, Homo sapien
ggatgcctgaggtaggcgtcctccc

SEQ ID NO: 63877 - DNA, 25 bp, Homo sapien
cggatgcctgaggtaggcgtcctcc

SEQ ID NO: 63878 - DNA, 25 bp, Homo sapien
ctcaatcgaggctgctgagcacctg

SEQ ID NO: 63879 - DNA, 25 bp, Homo sapien
cggatgcctgaggtaggtgtcctcc

SEQ ID NO: 63880 - DNA, 25 bp, Homo sapien
ctcaaccgaggctgctgagcacctg

SEQ ID NO: 63881 - DNA, 25 bp, Homo sapien
ctctcctcaatcgaggctgctgagc

SEQ ID NO: 63882 - DNA, 25 bp, Homo sapien
cgctatcattaccatctcacccatc

SEQ ID NO: 63883 - DNA, 25 bp, Homo sapien
ggaagccagcacacgctacgctatc

SEQ ID NO: 63884 - DNA, 25 bp, Homo sapien
gccagcacacgctacgctatcatta

SEQ ID NO: 63885 - DNA, 25 bp, Homo sapien
acgctacgctatcattaccatctca

SEQ ID NO: 63886 - DNA, 25 bp, Homo sapien
gcacacgctacgctatcattaccat

SEQ ID NO: 63887 - DNA, 25 bp, Homo sapien
tctcacccatctcccgtggctgacg

SEQ ID NO: 63888 - DNA, 25 bp, Homo sapien
aggctggcctcctgaggctgtccct

SEQ ID NO: 63889 - DNA, 25 bp, Homo sapien
gtaggaagccagcacacgctacgct

SEQ ID NO: 63890 - DNA, 25 bp, Homo sapien
gcaccgcatgtctgcgagcctaatt

SEQ ID NO: 63891 - DNA, 25 bp, Homo sapien
attggcccgctgaaacctgcgcaca

SEQ ID NO: 63892 - DNA, 25 bp, Homo sapien
cacacaatggggtgcaggctaacgc

SEQ ID NO: 63893 - DNA, 25 bp, Homo sapien
cgcctggtttctaatgaagagctcg

SEQ ID NO: 63894 - DNA, 25 bp, Homo sapien
ctggagctgccaattctagagggtg

SEQ ID NO: 63895 - DNA, 25 bp, Homo sapien
attcgcgcttagagggcacacaatg

SEQ ID NO: 63896 - DNA, 25 bp, Homo sapien
ccgcggcgtccatcttggatactgg

SEQ ID NO: 63897 - DNA, 25 bp, Homo sapien
gacccacgttgaaccatgatgcttc

SEQ ID NO: 63898 - DNA, 25 bp, Homo sapien
tgtcacgagggtgcaccatcacgaa

SEQ ID NO: 63899 - DNA, 25 bp, Homo sapien
gcactgtcacgagggtgcaccatca

SEQ ID NO: 63900 - DNA, 25 bp, Homo sapien
gtgccatcacgagggtgcaccgtca

SEQ ID NO: 63901 - DNA, 25 bp, Homo sapien
ctgtcacgagggtgcaccatcacga

SEQ ID NO: 63902 - DNA, 25 bp, Homo sapien
tcacgagggtgcaccatcacgaagg

SEQ ID NO: 63903 - DNA, 25 bp, Homo sapien
caccgtcacgagagtgcactgtcac

SEQ ID NO: 63904 - DNA, 25 bp, Homo sapien
actgtcacgagggtgcaccatcacg

SEQ ID NO: 63905 - DNA, 25 bp, Homo sapien
cacgagggtgcaccatcacgaaggc

SEQ ID NO: 63906 - DNA, 25 bp, Homo sapien
tgaagccgtccatccagttatgacc

SEQ ID NO: 63907 - DNA, 25 bp, Homo sapien
ggtgaagccgtccatccagttatga

SEQ ID NO: 63908 - DNA, 25 bp, Homo sapien
gaagccgtccatccagttatgacca

SEQ ID NO: 63909 - DNA, 25 bp, Homo sapien
aggtgaagccgtccatccagttatg

SEQ ID NO: 63910 - DNA, 25 bp, Homo sapien
tccatccagttatgaccacagtttg

SEQ ID NO: 63911 - DNA, 25 bp, Homo sapien
caggtgaagccgtccatccagttat

SEQ ID NO: 63912 - DNA, 25 bp, Homo sapien
tgacgtctgcgtagatacacacagg

SEQ ID NO: 63913 - DNA, 25 bp, Homo sapien
cgtctgcgtagatacacacaggtga

SEQ ID NO: 63914 - DNA, 25 bp, Homo sapien
cccagggctgtcactttttagatca

SEQ ID NO: 63915 - DNA, 25 bp, Homo sapien
cctcaggaatcgcaagaagggccgc

SEQ ID NO: 63916 - DNA, 25 bp, Homo sapien
tccttctgagaaatgggacagactg

SEQ ID NO: 63917 - DNA, 25 bp, Homo sapien
tctggccctcagctttatccttctg

SEQ ID NO: 63918 - DNA, 25 bp, Homo sapien
tgcagtcatagaaaccctctggccc

SEQ ID NO: 63919 - DNA, 25 bp, Homo sapien
ctgcttttgcagcagtgcagtcata

SEQ ID NO: 63920 - DNA, 25 bp, Homo sapien
ggctctgccgctcactgcttttgca

SEQ ID NO: 63921 - DNA, 25 bp, Homo sapien
gaccatggtcatcactcttgcctta

SEQ ID NO: 63922 - DNA, 25 bp, Homo sapien
gggctcttgctgttcttcgccagga

SEQ ID NO: 63923 - DNA, 25 bp, Homo sapien
cccaaagagggctgtggcagttcct

SEQ ID NO: 63924 - DNA, 25 bp, Homo sapien
tggagcccatacctaagccctctgg

SEQ ID NO: 63925 - DNA, 25 bp, Homo sapien
cccaaaggaagcaatgcgcgcgtcc

SEQ ID NO: 63926 - DNA, 25 bp, Homo sapien
cggcgtactgtctgaaccctgtgcc

SEQ ID NO: 63927 - DNA, 25 bp, Homo sapien
acctcaagaggttgtagtggcgccc

SEQ ID NO: 63928 - DNA, 25 bp, Homo sapien
gcgcggtccacttgaggccacagct

SEQ ID NO: 63929 - DNA, 25 bp, Homo sapien
ggactagtgagtcctgctcctctcg

SEQ ID NO: 63930 - DNA, 25 bp, Homo sapien
gaagccgcggttctgtttcttaatg

SEQ ID NO: 63931 - DNA, 25 bp, Homo sapien
gctgcgagacactatccgtttgtta

SEQ ID NO: 63932 - DNA, 25 bp, Homo sapien
ccaagtccgttgtctgatgctgcga

SEQ ID NO: 63933 - DNA, 25 bp, Homo sapien
cagtggcccttgtgaactatgtttc

SEQ ID NO: 63934 - DNA, 25 bp, Homo sapien
cagccaaggcctagttttcggtgta

SEQ ID NO: 63935 - DNA, 25 bp, Homo sapien
gcctccgcgtactctccattgttga

SEQ ID NO: 63936 - DNA, 25 bp, Homo sapien
tcgcgatagttacctcccgggactc

SEQ ID NO: 63937 - DNA, 25 bp, Homo sapien
ttcccgccagctaaaatcacgagtg

SEQ ID NO: 63938 - DNA, 25 bp, Homo sapien
gttactacgcaggaggggaacatgc

SEQ ID NO: 63939 - DNA, 25 bp, Homo sapien
cggcgtagctctggcggcgctccat

SEQ ID NO: 63940 - DNA, 25 bp, Homo sapien
cgctccatcaatgctggtggaaaga

SEQ ID NO: 63941 - DNA, 25 bp, Homo sapien
atcaatgctggtggaaagagtccca

SEQ ID NO: 63942 - DNA, 25 bp, Homo sapien
tgaggtcggccatcacgggcctgct

SEQ ID NO: 63943 - DNA, 25 bp, Homo sapien
cctgctccctgtgcacaggcaggga

SEQ ID NO: 63944 - DNA, 25 bp, Homo sapien
cacaggcagggacagttgtccgaga

SEQ ID NO: 63945 - DNA, 25 bp, Homo sapien
gctctcccggctggaactgttacta

SEQ ID NO: 63946 - DNA, 25 bp, Homo sapien
gcatgtttgcattctcgagggagga

SEQ ID NO: 63947 - DNA, 25 bp, Homo sapien
ggacgcgtgcatgtttgcattctcg

SEQ ID NO: 63948 - DNA, 25 bp, Homo sapien
actgggacgcgtgcatgtttgcatt

SEQ ID NO: 63949 - DNA, 25 bp, Homo sapien
ctgggacgcgtgcatgtttgcattc

SEQ ID NO: 63950 - DNA, 25 bp, Homo sapien
gtttgcattctcgagggaggaactg

SEQ ID NO: 63951 - DNA, 25 bp, Homo sapien
gggacgcgtgcatgtttgcattctc

SEQ ID NO: 63952 - DNA, 25 bp, Homo sapien
catgtttgcattctcgagggaggaa

SEQ ID NO: 63953 - DNA, 25 bp, Homo sapien
tgtttgcattctcgagggaggaact

SEQ ID NO: 63954 - DNA, 25 bp, Homo sapien
tgacatgttcttcacgggatgctgc

SEQ ID NO: 63955 - DNA, 25 bp, Homo sapien
ggtatgtgcgtctacacgcgtgtga

SEQ ID NO: 63956 - DNA, 25 bp, Homo sapien
ctgagcaatgctgattgacatgttc

SEQ ID NO: 63957 - DNA, 25 bp, Homo sapien
gtgtgaggccaacagcacctgctgt

SEQ ID NO: 63958 - DNA, 25 bp, Homo sapien
agcctgaggtcagtcggatttcctt

SEQ ID NO: 63959 - DNA, 25 bp, Homo sapien
atttgcaccgggactctcggctacc

SEQ ID NO: 63960 - DNA, 25 bp, Homo sapien
ggtttacgcagcaaagcctgaggtc

SEQ ID NO: 63961 - DNA, 25 bp, Homo sapien
acctgctgtcggttctgcactgagc

SEQ ID NO: 63962 - DNA, 25 bp, Homo sapien
ggcgtctccaaagccgggatgcagc

SEQ ID NO: 63963 - DNA, 25 bp, Homo sapien
tcgtaacaagatcgccacccggcgt

SEQ ID NO: 63964 - DNA, 25 bp, Homo sapien
tggctaacgagatcgtaacaagatc

SEQ ID NO: 63965 - DNA, 25 bp, Homo sapien
agaacgctgcatctggctaacgaga

SEQ ID NO: 63966 - DNA, 25 bp, Homo sapien
ctttaaaaatgaagagaacgctgca

SEQ ID NO: 63967 - DNA, 25 bp, Homo sapien
tgaagacaagaaccaaagcaggctt

SEQ ID NO: 63968 - DNA, 25 bp, Homo sapien
gactccgaaacgctttgtctcccat

SEQ ID NO: 63969 - DNA, 25 bp, Homo sapien
ccagccttgactccgaaacgctttg

SEQ ID NO: 63970 - DNA, 25 bp, Homo sapien
cccgcaatgctcagccgttgggttg

SEQ ID NO: 63971 - DNA, 25 bp, Homo sapien
gacggcgcagcgaatgcaccatcca

SEQ ID NO: 63972 - DNA, 25 bp, Homo sapien
tccagcgagcatcggtgcacaagtg

SEQ ID NO: 63973 - DNA, 25 bp, Homo sapien
tgcatgagctgagcaacacataccc

SEQ ID NO: 63974 - DNA, 25 bp, Homo sapien
gccgttgagttggaggaaacattcc

SEQ ID NO: 63975 - DNA, 25 bp, Homo sapien
atgctctcctttcgcagggcttagg

SEQ ID NO: 63976 - DNA, 25 bp, Homo sapien
acccgcggacagtcaggatccagct

SEQ ID NO: 63977 - DNA, 25 bp, Homo sapien
cttggttcctgtttagccgttgagt

SEQ ID NO: 63978 - DNA, 25 bp, Homo sapien
tcaggatcaaggacccaaggggacg

SEQ ID NO: 63979 - DNA, 25 bp, Homo sapien
ggacgtcgctgccagcttcaggagc

SEQ ID NO: 63980 - DNA, 25 bp, Homo sapien
ctacccggtcagctcaggatcaagg

SEQ ID NO: 63981 - DNA, 25 bp, Homo sapien
gctctcagaacgttctcgctgggga

SEQ ID NO: 63982 - DNA, 25 bp, Homo sapien
agcgacttctgcgtctcgtcccagg

SEQ ID NO: 63983 - DNA, 25 bp, Homo sapien
gtgtggacgtcaaagcgacctccta

SEQ ID NO: 63984 - DNA, 25 bp, Homo sapien
gcgacctcctagagaacattcctag

SEQ ID NO: 63985 - DNA, 25 bp, Homo sapien
ttcaggagccgcaaggccatggcta

SEQ ID NO: 63986 - DNA, 25 bp, Homo sapien
ctgaagaggcgtagatgaagagact

SEQ ID NO: 63987 - DNA, 25 bp, Homo sapien
tgttagaaacaagaagacaggtgtt

SEQ ID NO: 63988 - DNA, 25 bp, Homo sapien
ttgaaggtggccctggcagacagca

SEQ ID NO: 63989 - DNA, 25 bp, Homo sapien
tggccctggcagacagcagcaagac

SEQ ID NO: 63990 - DNA, 25 bp, Homo sapien
aagacattgccctgctgtgagaagc

SEQ ID NO: 63991 - DNA, 25 bp, Homo sapien
tgtgagaagcccaccaggcaagagc

SEQ ID NO: 63992 - DNA, 25 bp, Homo sapien
gcgtagatgaagagacttggatgaa

SEQ ID NO: 63993 - DNA, 25 bp, Homo sapien
accaggcaagagctgtggctgaaga

SEQ ID NO: 63994 - DNA, 25 bp, Homo sapien
ttccgacaccacaggccgctctgct

SEQ ID NO: 63995 - DNA, 25 bp, Homo sapien
cgctggaaaccctgctcctcgcctg

SEQ ID NO: 63996 - DNA, 25 bp, Homo sapien
gaaacaaagcggcagcctcaacgtg

SEQ ID NO: 63997 - DNA, 25 bp, Homo sapien
ggcagcctcaacgtgcggcccagtg

SEQ ID NO: 63998 - DNA, 25 bp, Homo sapien
tgcggcccagtgcagaccttcttac

SEQ ID NO: 63999 - DNA, 25 bp, Homo sapien
agtgcagaccttcttacagagatgc

SEQ ID NO: 64000 - DNA, 25 bp, Homo sapien
acgtgcacgcctggccgctggaaac

SEQ ID NO: 64001 - DNA, 25 bp, Homo sapien
tcttacagagatgcacttcttacct

SEQ ID NO: 64002 - DNA, 25 bp, Homo sapien
agaaaccgggatttgctctccgcgg

SEQ ID NO: 64003 - DNA, 25 bp, Homo sapien
cgcgccacatggcagatctagacgc

SEQ ID NO: 64004 - DNA, 25 bp, Homo sapien
agacgccggaggaccgcgcctctgt

SEQ ID NO: 64005 - DNA, 25 bp, Homo sapien
ggccaccggcgtttgtctttgcgct

SEQ ID NO: 64006 - DNA, 25 bp, Homo sapien
ggcgggcgtctgcaacgcctctgat

SEQ ID NO: 64007 - DNA, 25 bp, Homo sapien
tctgcaacgcctctgatgggcggcc

SEQ ID NO: 64008 - DNA, 25 bp, Homo sapien
tttcaccaggtgctcggagaaaccg

SEQ ID NO: 64009 - DNA, 25 bp, Homo sapien
tggcagatctagacgccggaggacc

SEQ ID NO: 64010 - DNA, 25 bp, Homo sapien
ggactctggtgtcttctaagccaca

SEQ ID NO: 64011 - DNA, 25 bp, Homo sapien
gtctcagcgaggtgtaaagttgttc

SEQ ID NO: 64012 - DNA, 25 bp, Homo sapien
tttctttaggatttaggcgcccatg

SEQ ID NO: 64013 - DNA, 25 bp, Homo sapien
ggcgcccatggtacaaggaatagtc

SEQ ID NO: 64014 - DNA, 25 bp, Homo sapien
aatagtcgcgcaagcatcccgctgg

SEQ ID NO: 64015 - DNA, 25 bp, Homo sapien
agaatccgagtgtttgccaggctta

SEQ ID NO: 64016 - DNA, 25 bp, Homo sapien
agggcgcaagcctcactattacttg

SEQ ID NO: 64017 - DNA, 25 bp, Homo sapien
gtgctcgcccacaaactgatttctc

SEQ ID NO: 64018 - DNA, 25 bp, Homo sapien
taccacatcctgacgcacctgaatg

SEQ ID NO: 64019 - DNA, 25 bp, Homo sapien
cctgacgcacctgaatgtggggtac

SEQ ID NO: 64020 - DNA, 25 bp, Homo sapien
tggtaccacatcctgacgcacctga

SEQ ID NO: 64021 - DNA, 25 bp, Homo sapien
catcctgacgcacctgaatgtgggg

SEQ ID NO: 64022 - DNA, 25 bp, Homo sapien
ggtaccacatcctgacgcacctgaa

SEQ ID NO: 64023 - DNA, 25 bp, Homo sapien
gcacctgaatgtggggtacacgtca

SEQ ID NO: 64024 - DNA, 25 bp, Homo sapien
cgcacctgaatgtggggtacacgtc

SEQ ID NO: 64025 - DNA, 25 bp, Homo sapien
tcctgacgcacctgaatgtggggta

SEQ ID NO: 64026 - DNA, 25 bp, Homo sapien
cgctaaggccctcgacaagtaacgg

SEQ ID NO: 64027 - DNA, 25 bp, Homo sapien
cgcgcctcaggtggcattactataa

SEQ ID NO: 64028 - DNA, 25 bp, Homo sapien
atgatcgctatggagccgcgcctca

SEQ ID NO: 64029 - DNA, 25 bp, Homo sapien
cgccacacctgtgatgatcgctatg

SEQ ID NO: 64030 - DNA, 25 bp, Homo sapien
agtaacggttctacgtctccaatcg

SEQ ID NO: 64031 - DNA, 25 bp, Homo sapien
tcaggtagaagaacatcgtgggatc

SEQ ID NO: 64032 - DNA, 25 bp, Homo sapien
ggaaactcactttcttgctcaggta

SEQ ID NO: 64033 - DNA, 25 bp, Homo sapien
ctccaatcgggagtaccagcagctc

SEQ ID NO: 64034 - DNA, 25 bp, Homo sapien
cgcagctgttggttgggaaagactt

SEQ ID NO: 64035 - DNA, 25 bp, Homo sapien
ggaaagacttttccgagcagctgga

SEQ ID NO: 64036 - DNA, 25 bp, Homo sapien
ctgcgggtctgcaatgagtcgtgac

SEQ ID NO: 64037 - DNA, 25 bp, Homo sapien
tgcaatgagtcgtgaccacggggtc

SEQ ID NO: 64038 - DNA, 25 bp, Homo sapien
cgtgaccacggggtcgcacagatgt

SEQ ID NO: 64039 - DNA, 25 bp, Homo sapien
tggattgtttgagagccggcgctca

SEQ ID NO: 64040 - DNA, 25 bp, Homo sapien
cagctgctccgggtgctcagatggc

SEQ ID NO: 64041 - DNA, 25 bp, Homo sapien
tgctcagatggcctgtgcatgctcc

SEQ ID NO: 64042 - DNA, 25 bp, Homo sapien
gaaatgacggggcatccaataagcc

SEQ ID NO: 64043 - DNA, 25 bp, Homo sapien
cacaaagatccacgtgctcagagtg

SEQ ID NO: 64044 - DNA, 25 bp, Homo sapien
cagtctaacattctgggctgagcca

SEQ ID NO: 64045 - DNA, 25 bp, Homo sapien
ctgagccacgttgcccgtcaaggat

SEQ ID NO: 64046 - DNA, 25 bp, Homo sapien
caggtgccttccaaaacgttacaca

SEQ ID NO: 64047 - DNA, 25 bp, Homo sapien
ctgctgcggtgaaacaagaggactc

SEQ ID NO: 64048 - DNA, 25 bp, Homo sapien
gccatcagacccgacgtgccgagga

SEQ ID NO: 64049 - DNA, 25 bp, Homo sapien
aacgttacacatgcacctgctgcgg

SEQ ID NO: 64050 - DNA, 25 bp, Homo sapien
gctatgactcggccgagtccaggtg

SEQ ID NO: 64051 - DNA, 25 bp, Homo sapien
atgactcggccgagtccaggtggga

SEQ ID NO: 64052 - DNA, 25 bp, Homo sapien
aggggctatgactcggccgagtcca

SEQ ID NO: 64053 - DNA, 25 bp, Homo sapien
gaggggctatgactcggccgagtcc

SEQ ID NO: 64054 - DNA, 25 bp, Homo sapien
ctatgactcggccgagtccaggtgg

SEQ ID NO: 64055 - DNA, 25 bp, Homo sapien
ggctatgactcggccgagtccaggt

SEQ ID NO: 64056 - DNA, 25 bp, Homo sapien
cgagaggggctatgactcggccgag

SEQ ID NO: 64057 - DNA, 25 bp, Homo sapien
ggggctatgactcggccgagtccag

SEQ ID NO: 64058 - DNA, 25 bp, Homo sapien
ccggcttcttccctgcggagctgat

SEQ ID NO: 64059 - DNA, 25 bp, Homo sapien
cctggtcttcccgacgcggctactc

SEQ ID NO: 64060 - DNA, 25 bp, Homo sapien
ctacggagccaagggcttcagcctg

SEQ ID NO: 64061 - DNA, 25 bp, Homo sapien
ccagatctacggagccaagggcttc

SEQ ID NO: 64062 - DNA, 25 bp, Homo sapien
ctgcggcgaggtccgccagatctac

SEQ ID NO: 64063 - DNA, 25 bp, Homo sapien
ccgccggcttttgttgtctccgcct

SEQ ID NO: 64064 - DNA, 25 bp, Homo sapien
ctgggtccctaagagccagaggagc

SEQ ID NO: 64065 - DNA, 25 bp, Homo sapien
ttcttccctgcggagctgatctcgc

SEQ ID NO: 64066 - DNA, 25 bp, Homo sapien
ctcctgtcgggagtccgtggcccgt

SEQ ID NO: 64067 - DNA, 25 bp, Homo sapien
acccgcatccgcaggcgcgccaccc

SEQ ID NO: 64068 - DNA, 25 bp, Homo sapien
cgggccgtcgcagcccttcgagccc

SEQ ID NO: 64069 - DNA, 25 bp, Homo sapien
tccggctgcgcggtttgccgtcttc

SEQ ID NO: 64070 - DNA, 25 bp, Homo sapien
gctgcgcggtttgccgtcttcgtcc

SEQ ID NO: 64071 - DNA, 25 bp, Homo sapien
gctggcgactggcatcggggcgccc

SEQ ID NO: 64072 - DNA, 25 bp, Homo sapien
accgtacccgcatccgcaggcgcgc

SEQ ID NO: 64073 - DNA, 25 bp, Homo sapien
ctggaagccaggcccgaggacctct

SEQ ID NO: 64074 - DNA, 25 bp, Homo sapien
tatcttacgggtgtttcgggcctca

SEQ ID NO: 64075 - DNA, 25 bp, Homo sapien
ctgcctttgactgccgtgcgtccag

SEQ ID NO: 64076 - DNA, 25 bp, Homo sapien
cgagctctggctccgtgtcttcact

SEQ ID NO: 64077 - DNA, 25 bp, Homo sapien
tccgtgtcttcactcccgtgcttgt

SEQ ID NO: 64078 - DNA, 25 bp, Homo sapien
actcccgtgcttgtccgaggaggga

SEQ ID NO: 64079 - DNA, 25 bp, Homo sapien
ggggagctcccatatcttacgggtg

SEQ ID NO: 64080 - DNA, 25 bp, Homo sapien
cagcctctcccgtctgcgtggtggg

SEQ ID NO: 64081 - DNA, 25 bp, Homo sapien
ggcagctggaacaacgcaggtcgcc

SEQ ID NO: 64082 - DNA, 25 bp, Homo sapien
tgctgctgcctgatgactacctgga

SEQ ID NO: 64083 - DNA, 25 bp, Homo sapien
gccttcggagagctgtacacgcaga

SEQ ID NO: 64084 - DNA, 25 bp, Homo sapien
gtacacgcagaacgcgagggccttc

SEQ ID NO: 64085 - DNA, 25 bp, Homo sapien
ttccgggacctgtactcagagctgc

SEQ ID NO: 64086 - DNA, 25 bp, Homo sapien
tgtactaccgcggtgccaacctgca

SEQ ID NO: 64087 - DNA, 25 bp, Homo sapien
actacctggactgcctgggcaagca

SEQ ID NO: 64088 - DNA, 25 bp, Homo sapien
tcagagctgcgcctgtactaccgcg

SEQ ID NO: 64089 - DNA, 25 bp, Homo sapien
cagcacctgctgaacgactcggagc

SEQ ID NO: 64090 - DNA, 25 bp, Homo sapien
tagactccatggtgctcatcaccga

SEQ ID NO: 64091 - DNA, 25 bp, Homo sapien
ttaacgcctgtcctagactccatgg

SEQ ID NO: 64092 - DNA, 25 bp, Homo sapien
gcctgcgtgtgcgtgtcaacgcctg

SEQ ID NO: 64093 - DNA, 25 bp, Homo sapien
tgcgcgcgttaacgcctgtgtgtcc

SEQ ID NO: 64094 - DNA, 25 bp, Homo sapien
gtgtgtccgcgtgttaacgcctgtc

SEQ ID NO: 64095 - DNA, 25 bp, Homo sapien
tcatcggcagcgtgcacacgtggct

SEQ ID NO: 64096 - DNA, 25 bp, Homo sapien
ctccaggacaacagggacacgctca

SEQ ID NO: 64097 - DNA, 25 bp, Homo sapien
catcaccgacaagttctggggtaca

SEQ ID NO: 64098 - DNA, 25 bp, Homo sapien
tcaagtttcccgttggcggcgcggc

SEQ ID NO: 64099 - DNA, 25 bp, Homo sapien
tgagcgggcagcatcccgattccct

SEQ ID NO: 64100 - DNA, 25 bp, Homo sapien
ggtggcgctgactccggtccgatcc

SEQ ID NO: 64101 - DNA, 25 bp, Homo sapien
gccttccctgctcgcagaggcggtg

SEQ ID NO: 64102 - DNA, 25 bp, Homo sapien
ggcggcatggccctgtcgtccgaac

SEQ ID NO: 64103 - DNA, 25 bp, Homo sapien
ggcccgggcgcttcaggtagcctct

SEQ ID NO: 64104 - DNA, 25 bp, Homo sapien
ctgctgctctcaagtttcccgttgg

SEQ ID NO: 64105 - DNA, 25 bp, Homo sapien
tcaggtagcctctcggctctctctg

SEQ ID NO: 64106 - DNA, 25 bp, Homo sapien
agcagcagcttgatggtccgccagc

SEQ ID NO: 64107 - DNA, 25 bp, Homo sapien
acagcccaggtggtcgcctgcaaga

SEQ ID NO: 64108 - DNA, 25 bp, Homo sapien
ggaacaggacctgcatgggcacgca

SEQ ID NO: 64109 - DNA, 25 bp, Homo sapien
tgcactgcgcccagaacggggccat

SEQ ID NO: 64110 - DNA, 25 bp, Homo sapien
ccggccttcacagcaaggaacagga

SEQ ID NO: 64111 - DNA, 25 bp, Homo sapien
cggaaagcagatgtcggtcctcgcc

SEQ ID NO: 64112 - DNA, 25 bp, Homo sapien
ttcctccgcctgaaaaagacggtgc

SEQ ID NO: 64113 - DNA, 25 bp, Homo sapien
ctacctgcggcggaaagcagatgtc

SEQ ID NO: 64114 - DNA, 25 bp, Homo sapien
agacagcgtagttcttcagggaccc

SEQ ID NO: 64115 - DNA, 25 bp, Homo sapien
ctgtggtcttccaacctgcaagcga

SEQ ID NO: 64116 - DNA, 25 bp, Homo sapien
gagacttcgtcctctaagctaaggg

SEQ ID NO: 64117 - DNA, 25 bp, Homo sapien
cccgcaccttgtggcgaagacagcg

SEQ ID NO: 64118 - DNA, 25 bp, Homo sapien
aagcgacgtcaggaccgcacatgtg

SEQ ID NO: 64119 - DNA, 25 bp, Homo sapien
tcgcgagaccgcaccaagcaagact

SEQ ID NO: 64120 - DNA, 25 bp, Homo sapien
caagactcgaagagctcgcgccgga

SEQ ID NO: 64121 - DNA, 25 bp, Homo sapien
ctgtcggaaccatgggtaaacttca

SEQ ID NO: 64122 - DNA, 25 bp, Homo sapien
tcacacggataccacgaatgccacg

SEQ ID NO: 64123 - DNA, 25 bp, Homo sapien
tgtcccttccgttctcctgggtcat

SEQ ID NO: 64124 - DNA, 25 bp, Homo sapien
gtgcgttcccttctcctgggtcatc

SEQ ID NO: 64125 - DNA, 25 bp, Homo sapien
tgcaaattcaatcacaaggcgcctg

SEQ ID NO: 64126 - DNA, 25 bp, Homo sapien
ttcctccagcttcctgtgaggcttc

SEQ ID NO: 64127 - DNA, 25 bp, Homo sapien
cctcagtctgctcttcacacggata

SEQ ID NO: 64128 - DNA, 25 bp, Homo sapien
cggtggcctcctgaagacggagtct

SEQ ID NO: 64129 - DNA, 25 bp, Homo sapien
gacggagtctggtctcacattcctc

SEQ ID NO: 64130 - DNA, 25 bp, Homo sapien
gcccacgcgaggctcggatttaaag

SEQ ID NO: 64131 - DNA, 25 bp, Homo sapien
tgggctcggctgctgtcgcaacctc

SEQ ID NO: 64132 - DNA, 25 bp, Homo sapien
tccagcggcagaaacggaatgtctg

SEQ ID NO: 64133 - DNA, 25 bp, Homo sapien
acaaggagccttgtccgcgcattcc

SEQ ID NO: 64134 - DNA, 25 bp, Homo sapien
tgggcttctcctcgttcgatgctca

SEQ ID NO: 64135 - DNA, 25 bp, Homo sapien
atgaagcgcgcttggtggatgccct

SEQ ID NO: 64136 - DNA, 25 bp, Homo sapien
ccgcgcattccagcggcagaaacgg

SEQ ID NO: 64137 - DNA, 25 bp, Homo sapien
ttctcctcgttcgatgctcacgcgt

SEQ ID NO: 64138 - DNA, 25 bp, Homo sapien
aagagccacagacgcaagcccagtg

SEQ ID NO: 64139 - DNA, 25 bp, Homo sapien
cttcgggattgggacaggcacttcc

SEQ ID NO: 64140 - DNA, 25 bp, Homo sapien
ggcgcctgcctagtctactgcaaga

SEQ ID NO: 64141 - DNA, 25 bp, Homo sapien
gagtcacgctgtgcgtcaacgtctc

SEQ ID NO: 64142 - DNA, 25 bp, Homo sapien
gtacctccaccgttggtgcgcgtcg

SEQ ID NO: 64143 - DNA, 25 bp, Homo sapien
aaagcagactcttcggcgggcgcca

SEQ ID NO: 64144 - DNA, 25 bp, Homo sapien
aaatagatcctcagggcccaaaagc

SEQ ID NO: 64145 - DNA, 25 bp, Homo sapien
cggctcccacaaatagactcctggg

SEQ ID NO: 64146 - DNA, 25 bp, Homo sapien
ctcccgctccatggggtgcagtagg

SEQ ID NO: 64147 - DNA, 25 bp, Homo sapien
tcctcacatacgtgcgcggtgggag

SEQ ID NO: 64148 - DNA, 25 bp, Homo sapien
agctcctcacatacgtgcgcggtgg

SEQ ID NO: 64149 - DNA, 25 bp, Homo sapien
gcagctcctcacatacgtgcgcggt

SEQ ID NO: 64150 - DNA, 25 bp, Homo sapien
gggcagctcctcacatacgtgcgcg

SEQ ID NO: 64151 - DNA, 25 bp, Homo sapien
gtgcagtagggcagctcctcacata

SEQ ID NO: 64152 - DNA, 25 bp, Homo sapien
gcctcccgctccatggggtgcagta

SEQ ID NO: 64153 - DNA, 25 bp, Homo sapien
cagtagggcagctcctcacatacgt

SEQ ID NO: 64154 - DNA, 25 bp, Homo sapien
gatgacattgagttcgcgacgctgc

SEQ ID NO: 64155 - DNA, 25 bp, Homo sapien
attgagttcgcgacgctgcgctcct

SEQ ID NO: 64156 - DNA, 25 bp, Homo sapien
acgctgcgctcctcgggaacacgaa

SEQ ID NO: 64157 - DNA, 25 bp, Homo sapien
ctcgggaacacgaaccacacctgga

SEQ ID NO: 64158 - DNA, 25 bp, Homo sapien
cccggatgaaaggatgacattgagt

SEQ ID NO: 64159 - DNA, 25 bp, Homo sapien
acgaaccacacctggaagcagcctg

SEQ ID NO: 64160 - DNA, 25 bp, Homo sapien
tcccgggtcccttcagcggctgccc

SEQ ID NO: 64161 - DNA, 25 bp, Homo sapien
gagcagcgatcccgcctcctgggat

SEQ ID NO: 64162 - DNA, 25 bp, Homo sapien
caggtgctgatgagtgccacccgga

SEQ ID NO: 64163 - DNA, 25 bp, Homo sapien
ccacccggagtgcatacatggagga

SEQ ID NO: 64164 - DNA, 25 bp, Homo sapien
gaggaagaaggcgtcttccacttcc

SEQ ID NO: 64165 - DNA, 25 bp, Homo sapien
ccgtgcccgcctacctcgtggccct

SEQ ID NO: 64166 - DNA, 25 bp, Homo sapien
cggagacctcaagccggcagacatc

SEQ ID NO: 64167 - DNA, 25 bp, Homo sapien
ggtctcagtccggcctccttacagg

SEQ ID NO: 64168 - DNA, 25 bp, Homo sapien
ggcctccttacaggcgccatcgggg

SEQ ID NO: 64169 - DNA, 25 bp, Homo sapien
gtgcaggtgctgatgagtgccaccc

SEQ ID NO: 64170 - DNA, 25 bp, Homo sapien
tggtttctgagatctccgctcctcg

SEQ ID NO: 64171 - DNA, 25 bp, Homo sapien
ggagctgtagtctgcgacgcaactc

SEQ ID NO: 64172 - DNA, 25 bp, Homo sapien
gaaaaaatacagtgcggtccgccgc

SEQ ID NO: 64173 - DNA, 25 bp, Homo sapien
cgctaaactaggtcgtggcctccgc

SEQ ID NO: 64174 - DNA, 25 bp, Homo sapien
ggactcctcgctcttctgcgacttg

SEQ ID NO: 64175 - DNA, 25 bp, Homo sapien
tccgccgttgttctcctcagaagtg

SEQ ID NO: 64176 - DNA, 25 bp, Homo sapien
tcggcgctaccctaaggacgctaaa

SEQ ID NO: 64177 - DNA, 25 bp, Homo sapien
ccgcctggttaccaatgggagacta

SEQ ID NO: 64178 - DNA, 25 bp, Homo sapien
cgtagagttctctgcgacatccagg

SEQ ID NO: 64179 - DNA, 25 bp, Homo sapien
gcgacatccaggtgtgccgtagagt

SEQ ID NO: 64180 - DNA, 25 bp, Homo sapien
gtagagttctctgcgacatccaggt

SEQ ID NO: 64181 - DNA, 25 bp, Homo sapien
acatccaggtgtgccgtagagttct

SEQ ID NO: 64182 - DNA, 25 bp, Homo sapien
agttctctgcgacatccaggtgtgc

SEQ ID NO: 64183 - DNA, 25 bp, Homo sapien
gccgtagagttctctgcgacatcca

SEQ ID NO: 64184 - DNA, 25 bp, Homo sapien
cgacatccaggtgtgccgtagagtt

SEQ ID NO: 64185 - DNA, 25 bp, Homo sapien
gttctctgcgacatccaggtgtgcc

SEQ ID NO: 64186 - DNA, 25 bp, Homo sapien
cgccgacatccaggtgtgccgaaga

SEQ ID NO: 64187 - DNA, 25 bp, Homo sapien
tcgcatttggcagtttggacgctgg

SEQ ID NO: 64188 - DNA, 25 bp, Homo sapien
gggctccttcacctgtcgcatttgg

SEQ ID NO: 64189 - DNA, 25 bp, Homo sapien
catggcaggtcattcctccgggaca

SEQ ID NO: 64190 - DNA, 25 bp, Homo sapien
cgccttttgcttctccctgtgcatg

SEQ ID NO: 64191 - DNA, 25 bp, Homo sapien
tggtgcttatatcacgctcgccttt

SEQ ID NO: 64192 - DNA, 25 bp, Homo sapien
gccgaagagttctctgcgacatcca

SEQ ID NO: 64193 - DNA, 25 bp, Homo sapien
ttagagttctctgcagaccgcggtg

SEQ ID NO: 64194 - DNA, 25 bp, Homo sapien
ctggagcagctagcaagggaaacac

SEQ ID NO: 64195 - DNA, 25 bp, Homo sapien
acgggcgtcaatagaatggcctccc

SEQ ID NO: 64196 - DNA, 25 bp, Homo sapien
gagccggcggcaatattcaaacaac

SEQ ID NO: 64197 - DNA, 25 bp, Homo sapien
ctcctcaagcgcacctggacattta

SEQ ID NO: 64198 - DNA, 25 bp, Homo sapien
aggttcaaggcatcgcgcaccctgc

SEQ ID NO: 64199 - DNA, 25 bp, Homo sapien
agcccacagctcagacctgcgggtg

SEQ ID NO: 64200 - DNA, 25 bp, Homo sapien
cggtcgcacctctgtgacgcaaagc

SEQ ID NO: 64201 - DNA, 25 bp, Homo sapien
ccaacagctaagtccggcggccgaa

SEQ ID NO: 64202 - DNA, 25 bp, Homo sapien
ggtccacctgcgttgtgagctctca

SEQ ID NO: 64203 - DNA, 25 bp, Homo sapien
gggagttcctgctccgagtcttctc

SEQ ID NO: 64204 - DNA, 25 bp, Homo sapien
tgtgagctctcaccgggctactacc

SEQ ID NO: 64205 - DNA, 25 bp, Homo sapien
tgccatgcatacgaccgggaggtcc

SEQ ID NO: 64206 - DNA, 25 bp, Homo sapien
ggtcaatctgcctagggtcctgtcc

SEQ ID NO: 64207 - DNA, 25 bp, Homo sapien
agcctcctgcacgtgctcacaggta

SEQ ID NO: 64208 - DNA, 25 bp, Homo sapien
cgagtctcccttaggtgagaggaac

SEQ ID NO: 64209 - DNA, 25 bp, Homo sapien
gagtcttctctaccgggcgagtctc

SEQ ID NO: 64210 - DNA, 25 bp, Homo sapien
cgccgacgacgactgagcacctgat

SEQ ID NO: 64211 - DNA, 25 bp, Homo sapien
taaaatcaaacagggtgaagggctg

SEQ ID NO: 64212 - DNA, 25 bp, Homo sapien
cccagtgcgcagaaagggttactta

SEQ ID NO: 64213 - DNA, 25 bp, Homo sapien
gagtcccacaagcacaagcccagtg

SEQ ID NO: 64214 - DNA, 25 bp, Homo sapien
ggaagcagatagagtcccacaagca

SEQ ID NO: 64215 - DNA, 25 bp, Homo sapien
acagggcaggaagcagatagagtcc

SEQ ID NO: 64216 - DNA, 25 bp, Homo sapien
gacgactgagcacctgatatgtccc

SEQ ID NO: 64217 - DNA, 25 bp, Homo sapien
ctggaaacaggtcatgagggcgcaa

SEQ ID NO: 64218 - DNA, 25 bp, Homo sapien
aggctgcccgcatggtctgggccaa

SEQ ID NO: 64219 - DNA, 25 bp, Homo sapien
ggagcacccggcacaatttcaactc

SEQ ID NO: 64220 - DNA, 25 bp, Homo sapien
aatttcaactccatggcgttcccgc

SEQ ID NO: 64221 - DNA, 25 bp, Homo sapien
gtggtcttctgctccctgaaggtgg

SEQ ID NO: 64222 - DNA, 25 bp, Homo sapien
aaggtggtgactgccctggcccaga

SEQ ID NO: 64223 - DNA, 25 bp, Homo sapien
tcctggtgttcgtggtctgcttcct

SEQ ID NO: 64224 - DNA, 25 bp, Homo sapien
ctgacagtgcgcctcgcagtgggct

SEQ ID NO: 64225 - DNA, 25 bp, Homo sapien
tgtgccctcctggagacgatccgtc

SEQ ID NO: 64226 - DNA, 25 bp, Homo sapien
cccgaagctcctacacgctcggtcg

SEQ ID NO: 64227 - DNA, 25 bp, Homo sapien
ctcctacacgctcggtcggggccca

SEQ ID NO: 64228 - DNA, 25 bp, Homo sapien
agctcctacacgctcggtcggggcc

SEQ ID NO: 64229 - DNA, 25 bp, Homo sapien
ctacacgctcggtcggggcccagtg

SEQ ID NO: 64230 - DNA, 25 bp, Homo sapien
aagctcctacacgctcggtcggggc

SEQ ID NO: 64231 - DNA, 25 bp, Homo sapien
cgaagctcctacacgctcggtcggg

SEQ ID NO: 64232 - DNA, 25 bp, Homo sapien
ccgaagctcctacacgctcggtcgg

SEQ ID NO: 64233 - DNA, 25 bp, Homo sapien
gaagctcctacacgctcggtcgggg

SEQ ID NO: 64234 - DNA, 25 bp, Homo sapien
caaacggctgtttcacggcctccaa

SEQ ID NO: 64235 - DNA, 25 bp, Homo sapien
actgcggttccgcttgaaactcatg

SEQ ID NO: 64236 - DNA, 25 bp, Homo sapien
tcatggacaccatcgtaacaggcgg

SEQ ID NO: 64237 - DNA, 25 bp, Homo sapien
tggatggaccggacttctgattgga

SEQ ID NO: 64238 - DNA, 25 bp, Homo sapien
ccgtagtgcactattcccgagatga

SEQ ID NO: 64239 - DNA, 25 bp, Homo sapien
cacgtactggatgggaagcgtcaca

SEQ ID NO: 64240 - DNA, 25 bp, Homo sapien
aacgtgacctttgcgcgcagctcaa

SEQ ID NO: 64241 - DNA, 25 bp, Homo sapien
ttggggattgacaagacctcacgcc

SEQ ID NO: 64242 - DNA, 25 bp, Homo sapien
cgcagtagcggaatttgttcgtaca

SEQ ID NO: 64243 - DNA, 25 bp, Homo sapien
ttcgtacaggaccaagcccagcttt

SEQ ID NO: 64244 - DNA, 25 bp, Homo sapien
gccgttcgagttgtggaaaggatta

SEQ ID NO: 64245 - DNA, 25 bp, Homo sapien
aaggattagctgctgagcgtcaggc

SEQ ID NO: 64246 - DNA, 25 bp, Homo sapien
tacggtcctgggcaaggccagcaac

SEQ ID NO: 64247 - DNA, 25 bp, Homo sapien
cgggaacaaacaggacacgcgctct

SEQ ID NO: 64248 - DNA, 25 bp, Homo sapien
cttcgttgatggagctggaagcttc

SEQ ID NO: 64249 - DNA, 25 bp, Homo sapien
ctctgcatgagctgggcttcgttga

SEQ ID NO: 64250 - DNA, 25 bp, Homo sapien
agtccgctttctacaagacggcctc

SEQ ID NO: 64251 - DNA, 25 bp, Homo sapien
ttcgacctgctgctgatcgcccagc

SEQ ID NO: 64252 - DNA, 25 bp, Homo sapien
cgccgccgccttgtagggtggcaac

SEQ ID NO: 64253 - DNA, 25 bp, Homo sapien
tggacttaggcttcgaccacaacgc

SEQ ID NO: 64254 - DNA, 25 bp, Homo sapien
ctcatggccttggacttaggcttcg

SEQ ID NO: 64255 - DNA, 25 bp, Homo sapien
aagacggcctctcccttcgtcggag

SEQ ID NO: 64256 - DNA, 25 bp, Homo sapien
ctcgtcctggagtccgctttctaca

SEQ ID NO: 64257 - DNA, 25 bp, Homo sapien
aggcaccatggccacaacctcatgg

SEQ ID NO: 64258 - DNA, 25 bp, Homo sapien
cactgtggtcgaagcccaggtcgaa

SEQ ID NO: 64259 - DNA, 25 bp, Homo sapien
gatcgaagcgcgtggccaccgcttc

SEQ ID NO: 64260 - DNA, 25 bp, Homo sapien
acggggaaggtcaccaggtcatcca

SEQ ID NO: 64261 - DNA, 25 bp, Homo sapien
gcccaggtcgaaggccatgaagttg

SEQ ID NO: 64262 - DNA, 25 bp, Homo sapien
aggccctagtggctgtctggccgtc

SEQ ID NO: 64263 - DNA, 25 bp, Homo sapien
gcgaggccatcttgtaccaggagaa

SEQ ID NO: 64264 - DNA, 25 bp, Homo sapien
accaggagaaggtggactccaggac

SEQ ID NO: 64265 - DNA, 25 bp, Homo sapien
cgcaggtacagacgcctggcgaact

SEQ ID NO: 64266 - DNA, 25 bp, Homo sapien
ggtctctacatagggcctcgttaca

SEQ ID NO: 64267 - DNA, 25 bp, Homo sapien
tccattcaggaaaacggcagtcact

SEQ ID NO: 64268 - DNA, 25 bp, Homo sapien
gagttctttacacagttccacgcga

SEQ ID NO: 64269 - DNA, 25 bp, Homo sapien
cacaggcttctcagtgtcccacggg

SEQ ID NO: 64270 - DNA, 25 bp, Homo sapien
agtccctcaaggagctctcgccgtt

SEQ ID NO: 64271 - DNA, 25 bp, Homo sapien
tctcgcgcggctccttcaaaagtct

SEQ ID NO: 64272 - DNA, 25 bp, Homo sapien
cacgcggtgcttccacatgtcagtc

SEQ ID NO: 64273 - DNA, 25 bp, Homo sapien
gccggtcacaccattcatcaagttt

SEQ ID NO: 64274 - DNA, 25 bp, Homo sapien
gcgagttcctccgagttcccgcacg

SEQ ID NO: 64275 - DNA, 25 bp, Homo sapien
agtgtcctccacatttccacagatc

SEQ ID NO: 64276 - DNA, 25 bp, Homo sapien
gagtccctgacgcagcgttcacacg

SEQ ID NO: 64277 - DNA, 25 bp, Homo sapien
ctcggcgtccctcacacgattccca

SEQ ID NO: 64278 - DNA, 25 bp, Homo sapien
gacgcagcgttcacacggttcctca

SEQ ID NO: 64279 - DNA, 25 bp, Homo sapien
gttcacacggttcctcatgcctttc

SEQ ID NO: 64280 - DNA, 25 bp, Homo sapien
gagcagctgcatggctcctcggcgt

SEQ ID NO: 64281 - DNA, 25 bp, Homo sapien
tcatgcctttcccagcagccacccg

SEQ ID NO: 64282 - DNA, 25 bp, Homo sapien
ttttagctttccagccttcgcacta

SEQ ID NO: 64283 - DNA, 25 bp, Homo sapien
cctcccaacgtcatgaggacggtga

SEQ ID NO: 64284 - DNA, 25 bp, Homo sapien
agcaggcaagggtcttcgttggctt

SEQ ID NO: 64285 - DNA, 25 bp, Homo sapien
gtcttcgttggcttccgcccaaatc

SEQ ID NO: 64286 - DNA, 25 bp, Homo sapien
gcccaaatctcacacagtgcgtctg

SEQ ID NO: 64287 - DNA, 25 bp, Homo sapien
acacagtgcgtctgattcgctgagc

SEQ ID NO: 64288 - DNA, 25 bp, Homo sapien
ttcgctgagccttaacgccctcgga

SEQ ID NO: 64289 - DNA, 25 bp, Homo sapien
accgcatgggaatctgggaaacgta

SEQ ID NO: 64290 - DNA, 25 bp, Homo sapien
ggttatcaccgctcctcacagttca

SEQ ID NO: 64291 - DNA, 25 bp, Homo sapien
acgcctacggctgctcagagtccag

SEQ ID NO: 64292 - DNA, 25 bp, Homo sapien
tttcccagtgagcacctcgcggatc

SEQ ID NO: 64293 - DNA, 25 bp, Homo sapien
gggccgcacagctcttcacaattca

SEQ ID NO: 64294 - DNA, 25 bp, Homo sapien
agtctcttggaactcctcacacggg

SEQ ID NO: 64295 - DNA, 25 bp, Homo sapien
cccacgtgttcttagtctcttggaa

SEQ ID NO: 64296 - DNA, 25 bp, Homo sapien
tgaaggaagccgcttaccttgttgg

SEQ ID NO: 64297 - DNA, 25 bp, Homo sapien
gcagtgtcctgtgccgtttcccaca

SEQ ID NO: 64298 - DNA, 25 bp, Homo sapien
cctctccagggaagcggaatagccg

SEQ ID NO: 64299 - DNA, 25 bp, Homo sapien
agggaccttttccagcggcacctga

SEQ ID NO: 64300 - DNA, 25 bp, Homo sapien
agcggcacctgaagggcggacaccc

SEQ ID NO: 64301 - DNA, 25 bp, Homo sapien
cccattgttctctgcggagatggag

SEQ ID NO: 64302 - DNA, 25 bp, Homo sapien
tgcctgcgctttgggcggcaacaag

SEQ ID NO: 64303 - DNA, 25 bp, Homo sapien
tccgagctccagtcgccagctggtt

SEQ ID NO: 64304 - DNA, 25 bp, Homo sapien
ggctgtgacgtcaccgctgacaccg

SEQ ID NO: 64305 - DNA, 25 bp, Homo sapien
gagatcgcggcaaagggaccttttc

SEQ ID NO: 64306 - DNA, 25 bp, Homo sapien
gctccgtgggctcgcgctgcaccgc

SEQ ID NO: 64307 - DNA, 25 bp, Homo sapien
ctcagcagcgccgttgccatagcaa

SEQ ID NO: 64308 - DNA, 25 bp, Homo sapien
ggttgccggcttcgctagcctctca

SEQ ID NO: 64309 - DNA, 25 bp, Homo sapien
ccggcttcgctagcctctcagcagc

SEQ ID NO: 64310 - DNA, 25 bp, Homo sapien
gtcccgtgcccggaccctgaagtgc

SEQ ID NO: 64311 - DNA, 25 bp, Homo sapien
agcatcctgtggggtagactatggc

SEQ ID NO: 64312 - DNA, 25 bp, Homo sapien
agctgagctagggtgagcatcctgt

SEQ ID NO: 64313 - DNA, 25 bp, Homo sapien
cgagctgagctagggtgagcatcct

SEQ ID NO: 64314 - DNA, 25 bp, Homo sapien
ctgccctgcagcaggttgcgctgcg

SEQ ID NO: 64315 - DNA, 25 bp, Homo sapien
ctccacgcgctggtagatggcacca

SEQ ID NO: 64316 - DNA, 25 bp, Homo sapien
tacacggcgccctgcagttctgccc

SEQ ID NO: 64317 - DNA, 25 bp, Homo sapien
agcaggcggtacacggcgccctgca

SEQ ID NO: 64318 - DNA, 25 bp, Homo sapien
agcaccaccagcaggcggtacacgg

SEQ ID NO: 64319 - DNA, 25 bp, Homo sapien
cgcgtggccaggcaacagagcagca

SEQ ID NO: 64320 - DNA, 25 bp, Homo sapien
aagtggggcagcttccgcgtggcca

SEQ ID NO: 64321 - DNA, 25 bp, Homo sapien
cgcgctggtagatggcaccaaggtc

SEQ ID NO: 64322 - DNA, 25 bp, Homo sapien
gccctgcctgtacccgccggcgcag

SEQ ID NO: 64323 - DNA, 25 bp, Homo sapien
ggacgccctgcctgtacccgccggc

SEQ ID NO: 64324 - DNA, 25 bp, Homo sapien
gacgccctgcctgtacccgccggcg

SEQ ID NO: 64325 - DNA, 25 bp, Homo sapien
cgccctgcctgtacccgccggcgca

SEQ ID NO: 64326 - DNA, 25 bp, Homo sapien
cctgcctgtacccgccggcgcaggt

SEQ ID NO: 64327 - DNA, 25 bp, Homo sapien
ctgcctgtacccgccggcgcaggtg

SEQ ID NO: 64328 - DNA, 25 bp, Homo sapien
cctgtacccgccggcgcaggtggca

SEQ ID NO: 64329 - DNA, 25 bp, Homo sapien
acgccctgcctgtacccgccggcgc

SEQ ID NO: 64330 - DNA, 25 bp, Homo sapien
agcatcggcggggtcctaagcgctt

SEQ ID NO: 64331 - DNA, 25 bp, Homo sapien
tgggcggtgccgaccctcaggacca

SEQ ID NO: 64332 - DNA, 25 bp, Homo sapien
ggtgccgaccctcaggaccaccctg

SEQ ID NO: 64333 - DNA, 25 bp, Homo sapien
gccgaccctcaggaccaccctggag

SEQ ID NO: 64334 - DNA, 25 bp, Homo sapien
ccgtggggaaggaagcagcatcggc

SEQ ID NO: 64335 - DNA, 25 bp, Homo sapien
catcggcggggtcctaagcgcttag

SEQ ID NO: 64336 - DNA, 25 bp, Homo sapien
cctaagcgcttaggctggcggcaca

SEQ ID NO: 64337 - DNA, 25 bp, Homo sapien
tcctaagcgcttaggctggcggcac

SEQ ID NO: 64338 - DNA, 25 bp, Homo sapien
gccgagctccgccttataataaacc

SEQ ID NO: 64339 - DNA, 25 bp, Homo sapien
tccttagccgttgcaaaaactggcc

SEQ ID NO: 64340 - DNA, 25 bp, Homo sapien
acaggcccttccttagccgttgcaa

SEQ ID NO: 64341 - DNA, 25 bp, Homo sapien
gttccgctgctcgatgctctcttgg

SEQ ID NO: 64342 - DNA, 25 bp, Homo sapien
gcacccaccgacagcggaggaaatt

SEQ ID NO: 64343 - DNA, 25 bp, Homo sapien
gttttacataattgagcgcggggcc

SEQ ID NO: 64344 - DNA, 25 bp, Homo sapien
acagatgtggagacgttttacataa

SEQ ID NO: 64345 - DNA, 25 bp, Homo sapien
ccaaacttgccctggcgcaaggggc

SEQ ID NO: 64346 - DNA, 25 bp, Homo sapien
cctctgtaaatgttaggaatgagtc

SEQ ID NO: 64347 - DNA, 25 bp, Homo sapien
gtccacagatggaacccattacgcc

SEQ ID NO: 64348 - DNA, 25 bp, Homo sapien
gtcaagtttactccgcgctgcagcc

SEQ ID NO: 64349 - DNA, 25 bp, Homo sapien
taggaatgagtcaagtttactccgc

SEQ ID NO: 64350 - DNA, 25 bp, Homo sapien
ctattgcaggcacccgtccacagat

SEQ ID NO: 64351 - DNA, 25 bp, Homo sapien
taagtgaccctctgtaaatgttagg

SEQ ID NO: 64352 - DNA, 25 bp, Homo sapien
tcccgctaataagtgaccctctgta

SEQ ID NO: 64353 - DNA, 25 bp, Homo sapien
gcctctcgggacgtcccgctaataa

SEQ ID NO: 64354 - DNA, 25 bp, Homo sapien
catccgtgagatcgtggccggcagc

SEQ ID NO: 64355 - DNA, 25 bp, Homo sapien
tgaggagccaccccaaggtgatggt

SEQ ID NO: 64356 - DNA, 25 bp, Homo sapien
tcgcggctggccaaggtgatggcgt

SEQ ID NO: 64357 - DNA, 25 bp, Homo sapien
tccgtgagatcgtggccggcagcct

SEQ ID NO: 64358 - DNA, 25 bp, Homo sapien
cgctgaccgtgcgtggggaaggccg

SEQ ID NO: 64359 - DNA, 25 bp, Homo sapien
cgtgcccacccgcatccgtgagatc

SEQ ID NO: 64360 - DNA, 25 bp, Homo sapien
cgcatccgtgagatcgtggccggca

SEQ ID NO: 64361 - DNA, 25 bp, Homo sapien
acccgcatccgtgagatcgtggccg

SEQ ID NO: 64362 - DNA, 25 bp, Homo sapien
gaggccgcagctcagagctcatgga

SEQ ID NO: 64363 - DNA, 25 bp, Homo sapien
tctctgggaagaacacctgctgtcc

SEQ ID NO: 64364 - DNA, 25 bp, Homo sapien
ccctcgcccacacccggaggccgca

SEQ ID NO: 64365 - DNA, 25 bp, Homo sapien
ctcagagctcatggatgtggccacc

SEQ ID NO: 64366 - DNA, 25 bp, Homo sapien
actttgtgcagaagctccgggaagc

SEQ ID NO: 64367 - DNA, 25 bp, Homo sapien
agctcatggatgtggccaccgtgca

SEQ ID NO: 64368 - DNA, 25 bp, Homo sapien
gggtctctgggaagaacacctgctg

SEQ ID NO: 64369 - DNA, 25 bp, Homo sapien
tgtgcagaagctccgggaagcccag

SEQ ID NO: 64370 - DNA, 25 bp, Homo sapien
tggcccacgcatgcttctgtgtcct

SEQ ID NO: 64371 - DNA, 25 bp, Homo sapien
gctctcagaaactcgggccctccca

SEQ ID NO: 64372 - DNA, 25 bp, Homo sapien
ggcagcggtggtccttagagaggaa

SEQ ID NO: 64373 - DNA, 25 bp, Homo sapien
tcagctcgcacaggtaggcggcagc

SEQ ID NO: 64374 - DNA, 25 bp, Homo sapien
tgcgcgctcagctcgcacaggtagg

SEQ ID NO: 64375 - DNA, 25 bp, Homo sapien
cacgcccagcgtcttcggcccaggt

SEQ ID NO: 64376 - DNA, 25 bp, Homo sapien
ggccctcccaatccctggcccacgc

SEQ ID NO: 64377 - DNA, 25 bp, Homo sapien
cggggtggcactaagctcagggtca

SEQ ID NO: 64378 - DNA, 25 bp, Homo sapien
caagttttcattcggggccgcgcca

SEQ ID NO: 64379 - DNA, 25 bp, Homo sapien
cgacttcgctcgacttcgtttctga

SEQ ID NO: 64380 - DNA, 25 bp, Homo sapien
agcggctacgccttccaagttttca

SEQ ID NO: 64381 - DNA, 25 bp, Homo sapien
acgccagatggttccgaaggtcctg

SEQ ID NO: 64382 - DNA, 25 bp, Homo sapien
cacaagctgagctcgcgtagggcac

SEQ ID NO: 64383 - DNA, 25 bp, Homo sapien
gccgtccgctgctcgttgtttaagc

SEQ ID NO: 64384 - DNA, 25 bp, Homo sapien
ctcacctctggattagcctgaagcg

SEQ ID NO: 64385 - DNA, 25 bp, Homo sapien
gagacacttgctcgccttttgaccc

SEQ ID NO: 64386 - DNA, 25 bp, Homo sapien
cgctttaagagacgcccgatttgca

SEQ ID NO: 64387 - DNA, 25 bp, Homo sapien
ccgcgtgatgacacgccttcagggc

SEQ ID NO: 64388 - DNA, 25 bp, Homo sapien
caggccttagggacacaggtctgtc

SEQ ID NO: 64389 - DNA, 25 bp, Homo sapien
caggcgcctccaccagggtagggac

SEQ ID NO: 64390 - DNA, 25 bp, Homo sapien
gaccgccgggctggatatttaaatc

SEQ ID NO: 64391 - DNA, 25 bp, Homo sapien
ttcttcggtgccgagcactccggac

SEQ ID NO: 64392 - DNA, 25 bp, Homo sapien
tctgtcccaggacggcactgagggc

SEQ ID NO: 64393 - DNA, 25 bp, Homo sapien
cccagcgtctcaggccttagggaca

SEQ ID NO: 64394 - DNA, 25 bp, Homo sapien
cgagggcaagcgactgatccgctcc

SEQ ID NO: 64395 - DNA, 25 bp, Homo sapien
ggcaagcgactgatccgctccactg

SEQ ID NO: 64396 - DNA, 25 bp, Homo sapien
cgactgatccgctccactgagggcg

SEQ ID NO: 64397 - DNA, 25 bp, Homo sapien
ctgagggcggcgcatcacaagccct

SEQ ID NO: 64398 - DNA, 25 bp, Homo sapien
gagggcggcgcatcacaagccctgc

SEQ ID NO: 64399 - DNA, 25 bp, Homo sapien
tggggccgcagtgaggctcgcaccg

SEQ ID NO: 64400 - DNA, 25 bp, Homo sapien
ccagccgcgagcatctaggctacga

SEQ ID NO: 64401 - DNA, 25 bp, Homo sapien
ccgcgagcatctaggctacgagagg

SEQ ID NO: 64402 - DNA, 25 bp, Homo sapien
tgctccgacctaaagtgaaacctga

SEQ ID NO: 64403 - DNA, 25 bp, Homo sapien
cttgcatctgagcttagggagtccg

SEQ ID NO: 64404 - DNA, 25 bp, Homo sapien
gcggagtgtgccagtttttagacct

SEQ ID NO: 64405 - DNA, 25 bp, Homo sapien
tgaaacctgaaacctggctgctttg

SEQ ID NO: 64406 - DNA, 25 bp, Homo sapien
ctccctatgtctgcagcgtccgtgt

SEQ ID NO: 64407 - DNA, 25 bp, Homo sapien
cctcaacggcggcaagtgcatcgac

SEQ ID NO: 64408 - DNA, 25 bp, Homo sapien
atcgacgactgcgtcacgggcaacc

SEQ ID NO: 64409 - DNA, 25 bp, Homo sapien
aacgctgacatgacggctgagtgcc

SEQ ID NO: 64410 - DNA, 25 bp, Homo sapien
atgacgactcctacacctgcgagtg

SEQ ID NO: 64411 - DNA, 25 bp, Homo sapien
gtctctctccttgtttcgcgaattg

SEQ ID NO: 64412 - DNA, 25 bp, Homo sapien
ccttgtttcgcgaattgctgacctc

SEQ ID NO: 64413 - DNA, 25 bp, Homo sapien
cacggcaagcactgcgagaaaggta

SEQ ID NO: 64414 - DNA, 25 bp, Homo sapien
tgcgatgcccatgacgactcctaca

SEQ ID NO: 64415 - DNA, 25 bp, Homo sapien
acggaggctcctgcgatgcccatga

SEQ ID NO: 64416 - DNA, 25 bp, Homo sapien
atgcggcgtaagctccaggaccacc

SEQ ID NO: 64417 - DNA, 25 bp, Homo sapien
ttgccgcccgcacagatgcggcgta

SEQ ID NO: 64418 - DNA, 25 bp, Homo sapien
cgcggtggccctgtatgcatgtgac

SEQ ID NO: 64419 - DNA, 25 bp, Homo sapien
gcgagacaggctgccgtgccttgca

SEQ ID NO: 64420 - DNA, 25 bp, Homo sapien
ccctgtatgcatgtgaccgtggcta

SEQ ID NO: 64421 - DNA, 25 bp, Homo sapien
atgtgaccgtggctacagcctgagc

SEQ ID NO: 64422 - DNA, 25 bp, Homo sapien
ccgcatccgggtctgccagccacac

SEQ ID NO: 64423 - DNA, 25 bp, Homo sapien
actgcgcttcaacggcacgcggctg

SEQ ID NO: 64424 - DNA, 25 bp, Homo sapien
ggtgaagcacgccacactgcgcttc

SEQ ID NO: 64425 - DNA, 25 bp, Homo sapien
cccggaggaggtgaagcacgccaca

SEQ ID NO: 64426 - DNA, 25 bp, Homo sapien
gcacagactttgtggacaggacccg

SEQ ID NO: 64427 - DNA, 25 bp, Homo sapien
atcagcaggcctgccgtgctgctgg

SEQ ID NO: 64428 - DNA, 25 bp, Homo sapien
ggcagggcctacaacatctccgtct

SEQ ID NO: 64429 - DNA, 25 bp, Homo sapien
tacaacatctccgtcttctcagtga

SEQ ID NO: 64430 - DNA, 25 bp, Homo sapien
cttctcagtgaagcgaaacagtaac

SEQ ID NO: 64431 - DNA, 25 bp, Homo sapien
gcgaaacagtaacaacaagaatgac

SEQ ID NO: 64432 - DNA, 25 bp, Homo sapien
aagaatgacatcagcaggcctgccg

SEQ ID NO: 64433 - DNA, 25 bp, Homo sapien
tcctaccgccgcacagactttgtgg

SEQ ID NO: 64434 - DNA, 25 bp, Homo sapien
ttgccaaacgctgtgttcgactgtc

SEQ ID NO: 64435 - DNA, 25 bp, Homo sapien
gggtactcctggcatttcgcttcca

SEQ ID NO: 64436 - DNA, 25 bp, Homo sapien
gggcctcgccttctgaatcttctta

SEQ ID NO: 64437 - DNA, 25 bp, Homo sapien
agagcgcaggcgtactgttgccaaa

SEQ ID NO: 64438 - DNA, 25 bp, Homo sapien
aggcgcggctccttttaatgccttg

SEQ ID NO: 64439 - DNA, 25 bp, Homo sapien
ggtggcggcaatgtcttctttctcc

SEQ ID NO: 64440 - DNA, 25 bp, Homo sapien
aacgcggactgacttacagggctgc

SEQ ID NO: 64441 - DNA, 25 bp, Homo sapien
tcctacccggttgctcactgttttc

SEQ ID NO: 64442 - DNA, 25 bp, Homo sapien
ctgccgtgtcccgtttcgcagagct

SEQ ID NO: 64443 - DNA, 25 bp, Homo sapien
ttgttcccgttgcactgccgtgtcc

SEQ ID NO: 64444 - DNA, 25 bp, Homo sapien
agggctccacgacctggccgtgaaa

SEQ ID NO: 64445 - DNA, 25 bp, Homo sapien
tggccgtgaaacactcggcggccgc

SEQ ID NO: 64446 - DNA, 25 bp, Homo sapien
agctcgagcttacctgacggccgaa

SEQ ID NO: 64447 - DNA, 25 bp, Homo sapien
gaacgcagccatagcgcggagaaga

SEQ ID NO: 64448 - DNA, 25 bp, Homo sapien
tggatcgtgattccggcccggagct

SEQ ID NO: 64449 - DNA, 25 bp, Homo sapien
agaagatggcagcagttacggcgcc

SEQ ID NO: 64450 - DNA, 25 bp, Homo sapien
gcgcggcctcatgacggaactacaa

SEQ ID NO: 64451 - DNA, 25 bp, Homo sapien
taagtcaactctcaagcccagggcg

SEQ ID NO: 64452 - DNA, 25 bp, Homo sapien
cctccgaggtcgagacagtgacata

SEQ ID NO: 64453 - DNA, 25 bp, Homo sapien
gttcggcccattgtacagacgcagc

SEQ ID NO: 64454 - DNA, 25 bp, Homo sapien
tcgcacagcgactagcaccgattga

SEQ ID NO: 64455 - DNA, 25 bp, Homo sapien
ggcggcatttcgcatgggtaaaatc

SEQ ID NO: 64456 - DNA, 25 bp, Homo sapien
tcccgactcgcgatcaaaatgggtg

SEQ ID NO: 64457 - DNA, 25 bp, Homo sapien
gccagagtctagaagcccgcgctaa

SEQ ID NO: 64458 - DNA, 25 bp, Homo sapien
tggaccacggtcacacccggcgagg

SEQ ID NO: 64459 - DNA, 25 bp, Homo sapien
gcggaagagcgccacgctggcctac

SEQ ID NO: 64460 - DNA, 25 bp, Homo sapien
gctgttcgaccacggcggcaccgtg

SEQ ID NO: 64461 - DNA, 25 bp, Homo sapien
cgagccctacttccctgagaggagc

SEQ ID NO: 64462 - DNA, 25 bp, Homo sapien
gctgggactgctctgactacgagga

SEQ ID NO: 64463 - DNA, 25 bp, Homo sapien
gctggcctaccgctgggactgctct

SEQ ID NO: 64464 - DNA, 25 bp, Homo sapien
ggcaccgtgttcttcagcttgttca

SEQ ID NO: 64465 - DNA, 25 bp, Homo sapien
catgctggccggctctgtggtgatc

SEQ ID NO: 64466 - DNA, 25 bp, Homo sapien
tagagctccgactcactgctggcgc

SEQ ID NO: 64467 - DNA, 25 bp, Homo sapien
ggcctggccaacactgacgttttcc

SEQ ID NO: 64468 - DNA, 25 bp, Homo sapien
actttccaggtatctgaagcgcaga

SEQ ID NO: 64469 - DNA, 25 bp, Homo sapien
gggacggcctcaaactcagctcaga

SEQ ID NO: 64470 - DNA, 25 bp, Homo sapien
aggcgtgtctgaagccgaacttatc

SEQ ID NO: 64471 - DNA, 25 bp, Homo sapien
aacttatcactcttggggcagccga

SEQ ID NO: 64472 - DNA, 25 bp, Homo sapien
catattcgcgaagtctctgaggctg

SEQ ID NO: 64473 - DNA, 25 bp, Homo sapien
ttgtaccactcgagaagaagcgacc

SEQ ID NO: 64474 - DNA, 25 bp, Homo sapien
tcatcctgtaccgtgccatcatggc

SEQ ID NO: 64475 - DNA, 25 bp, Homo sapien
ccatcatggccatcgtggtgtccag

SEQ ID NO: 64476 - DNA, 25 bp, Homo sapien
tgtgcctcgtgtctatcatcctgta

SEQ ID NO: 64477 - DNA, 25 bp, Homo sapien
tggtgtccaggtcgggcaacaccct

SEQ ID NO: 64478 - DNA, 25 bp, Homo sapien
aggtcgggcaacacccttctcgcag

SEQ ID NO: 64479 - DNA, 25 bp, Homo sapien
acacccttctcgcagcctgggtgag

SEQ ID NO: 64480 - DNA, 25 bp, Homo sapien
tcccgttaggcctctcgcatcgcca

SEQ ID NO: 64481 - DNA, 25 bp, Homo sapien
gtggtcatgtgcctcgtgtctatca

SEQ ID NO: 64482 - DNA, 25 bp, Homo sapien
agatccgcttggacgcgcgcaagtt

SEQ ID NO: 64483 - DNA, 25 bp, Homo sapien
ttcctcaacttcacgctggcgcgag

SEQ ID NO: 64484 - DNA, 25 bp, Homo sapien
cacctggcggtcatcagcaacgtga

SEQ ID NO: 64485 - DNA, 25 bp, Homo sapien
atctggttccacatcctggcgggcc

SEQ ID NO: 64486 - DNA, 25 bp, Homo sapien
aagttcgtctgcgagtaccggcgcc

SEQ ID NO: 64487 - DNA, 25 bp, Homo sapien
tgaccagccagaagcacggagcgca

SEQ ID NO: 64488 - DNA, 25 bp, Homo sapien
ctgcagttcggcttcgtcaccatct

SEQ ID NO: 64489 - DNA, 25 bp, Homo sapien
tcaacaactgggtggagatccgctt

SEQ ID NO: 64490 - DNA, 25 bp, Homo sapien
caatgatggtgatcaggtcctggtc

SEQ ID NO: 64491 - DNA, 25 bp, Homo sapien
ccgctccctaccaggttttggatca

SEQ ID NO: 64492 - DNA, 25 bp, Homo sapien
ggttttggatcaaggcctccagctc

SEQ ID NO: 64493 - DNA, 25 bp, Homo sapien
aatttgtggtattctggcttggcgc

SEQ ID NO: 64494 - DNA, 25 bp, Homo sapien
gacggcgtcctcctttccaatgatg

SEQ ID NO: 64495 - DNA, 25 bp, Homo sapien
tgctgtcgcgcaccttgcgaatttt

SEQ ID NO: 64496 - DNA, 25 bp, Homo sapien
ctcagccgcagggaagatgacacgt

SEQ ID NO: 64497 - DNA, 25 bp, Homo sapien
atgacacgtgctccagtgctgtcgc

SEQ ID NO: 64498 - DNA, 25 bp, Homo sapien
aagttgcactccaggcccaagaaga

SEQ ID NO: 64499 - DNA, 25 bp, Homo sapien
cacggccacgcgcagaagagactcg

SEQ ID NO: 64500 - DNA, 25 bp, Homo sapien
cgaacacgtagactgacgcgggccc

SEQ ID NO: 64501 - DNA, 25 bp, Homo sapien
accctggggcacgtccaagttgcac

SEQ ID NO: 64502 - DNA, 25 bp, Homo sapien
gaagtcggcacccatcctgcatgga

SEQ ID NO: 64503 - DNA, 25 bp, Homo sapien
ttctcaccaagttctggaagtcggc

SEQ ID NO: 64504 - DNA, 25 bp, Homo sapien
gcgccaccggacttgagaaagtttg

SEQ ID NO: 64505 - DNA, 25 bp, Homo sapien
ggaactttcgcagatgccacctcag

SEQ ID NO: 64506 - DNA, 25 bp, Homo sapien
agcccaggctcttcggcacttatcg

SEQ ID NO: 64507 - DNA, 25 bp, Homo sapien
caccgcaaggcgaagattctcatta

SEQ ID NO: 64508 - DNA, 25 bp, Homo sapien
ccgagctcataaggtaggaactgtg

SEQ ID NO: 64509 - DNA, 25 bp, Homo sapien
ctctatatggccaactgccgtggga

SEQ ID NO: 64510 - DNA, 25 bp, Homo sapien
tcgtcccatactctcgggcggtggt

SEQ ID NO: 64511 - DNA, 25 bp, Homo sapien
agtgggcacttgtctccttctaaca

SEQ ID NO: 64512 - DNA, 25 bp, Homo sapien
gccgccatcttcttggaggacagga

SEQ ID NO: 64513 - DNA, 25 bp, Homo sapien
gtcgcactgagccaggaagcagttg

SEQ ID NO: 64514 - DNA, 25 bp, Homo sapien
gccgagcgctgcacagatttatatc

SEQ ID NO: 64515 - DNA, 25 bp, Homo sapien
gcgagccttggcttcgcctaggaca

SEQ ID NO: 64516 - DNA, 25 bp, Homo sapien
gcctaggacattgcctcgctcagca

SEQ ID NO: 64517 - DNA, 25 bp, Homo sapien
gatttatatcctacgcagctgcctg

SEQ ID NO: 64518 - DNA, 25 bp, Homo sapien
cgtccgttcaccaatcagaactcga

SEQ ID NO: 64519 - DNA, 25 bp, Homo sapien
aggccaatcgactgcgcgtccgcgt

SEQ ID NO: 64520 - DNA, 25 bp, Homo sapien
ctctgaaggccatcgtgaggcggct

SEQ ID NO: 64521 - DNA, 25 bp, Homo sapien
agaactcgatcttgcgctttcaggc

SEQ ID NO: 64522 - DNA, 25 bp, Homo sapien
aagcctgctggcgttggactacaag

SEQ ID NO: 64523 - DNA, 25 bp, Homo sapien
aggccgctagtcttcctgacctgca

SEQ ID NO: 64524 - DNA, 25 bp, Homo sapien
tcagtccactgcgagggacaccagg

SEQ ID NO: 64525 - DNA, 25 bp, Homo sapien
gttcagtcatctgagaccgacctcc

SEQ ID NO: 64526 - DNA, 25 bp, Homo sapien
tcccagcccgcgaagcaacggtggt

SEQ ID NO: 64527 - DNA, 25 bp, Homo sapien
cctagtcctgctcccgaaaggtttg

SEQ ID NO: 64528 - DNA, 25 bp, Homo sapien
cacgtggtcgttgtcgcgtcgcgcc

SEQ ID NO: 64529 - DNA, 25 bp, Homo sapien
tcccgaaaggtttggactgcgtctc

SEQ ID NO: 64530 - DNA, 25 bp, Homo sapien
ttgtcttgtatgctcagcgaggccc

SEQ ID NO: 64531 - DNA, 25 bp, Homo sapien
cggactctttaaatagcgggcgcta

SEQ ID NO: 64532 - DNA, 25 bp, Homo sapien
ctcatgtgcttctcggtggacagcc

SEQ ID NO: 64533 - DNA, 25 bp, Homo sapien
agcccggactcgctggagaacatcc

SEQ ID NO: 64534 - DNA, 25 bp, Homo sapien
ggtgaagcacttctgtcccaatgtg

SEQ ID NO: 64535 - DNA, 25 bp, Homo sapien
gcccatcatcctggtggccaacaaa

SEQ ID NO: 64536 - DNA, 25 bp, Homo sapien
tggcccgcatgaagcaggaacccgt

SEQ ID NO: 64537 - DNA, 25 bp, Homo sapien
gctggtttcccattggacggctata

SEQ ID NO: 64538 - DNA, 25 bp, Homo sapien
aagattcctcgggtcacgactctga

SEQ ID NO: 64539 - DNA, 25 bp, Homo sapien
tcccggcttcaagagcgcagtagcg

SEQ ID NO: 64540 - DNA, 25 bp, Homo sapien
cccacagggcagaagtgcccttgtt

SEQ ID NO: 64541 - DNA, 25 bp, Homo sapien
agaaccttcagaatgtgccgcggaa

SEQ ID NO: 64542 - DNA, 25 bp, Homo sapien
aggcttccgctaggctgagacgcgc

SEQ ID NO: 64543 - DNA, 25 bp, Homo sapien
cccgaagctgtgtaacccagggaca

SEQ ID NO: 64544 - DNA, 25 bp, Homo sapien
tctctccatcggcagaaccttcaga

SEQ ID NO: 64545 - DNA, 25 bp, Homo sapien
cacaggtgcgaagctcccggcttca

SEQ ID NO: 64546 - DNA, 25 bp, Homo sapien
gcagatcctgaagccagaactccac

SEQ ID NO: 64547 - DNA, 25 bp, Homo sapien
gcggcgagcagatcctgaagccaga

SEQ ID NO: 64548 - DNA, 25 bp, Homo sapien
cacgcactcgtcttcgagggcgggc

SEQ ID NO: 64549 - DNA, 25 bp, Homo sapien
cctcggggaatgtctgtagctgaat

SEQ ID NO: 64550 - DNA, 25 bp, Homo sapien
ctgtagctgaattcgggctctgaaa

SEQ ID NO: 64551 - DNA, 25 bp, Homo sapien
tcttcgccgccgagatcatggacgc

SEQ ID NO: 64552 - DNA, 25 bp, Homo sapien
atcatggacgcctttgaccgctcgc

SEQ ID NO: 64553 - DNA, 25 bp, Homo sapien
ttggggcacaaaaaacgagagcgga

SEQ ID NO: 64554 - DNA, 25 bp, Homo sapien
cagggcatcaccgtgcagttcgcgg

SEQ ID NO: 64555 - DNA, 25 bp, Homo sapien
cgcagaagatttccgagaggatggc

SEQ ID NO: 64556 - DNA, 25 bp, Homo sapien
aacatcatcgtcaccaacggcgcgg

SEQ ID NO: 64557 - DNA, 25 bp, Homo sapien
aggtgttggccaccatccacggcca

SEQ ID NO: 64558 - DNA, 25 bp, Homo sapien
tggccaacggcttcccaagtgcgca

SEQ ID NO: 64559 - DNA, 25 bp, Homo sapien
tcccaagtgcgcacgaggccctgaa

SEQ ID NO: 64560 - DNA, 25 bp, Homo sapien
gaggccctgaagagcgcacccagct

SEQ ID NO: 64561 - DNA, 25 bp, Homo sapien
ctcgttatggcgcagaagatttccg

SEQ ID NO: 64562 - DNA, 25 bp, Homo sapien
agtgcccatgttcctcttttcattt

SEQ ID NO: 64563 - DNA, 25 bp, Homo sapien
ttccactgaatgttatgaccctccc

SEQ ID NO: 64564 - DNA, 25 bp, Homo sapien
ggacgttttactgtctttccactga

SEQ ID NO: 64565 - DNA, 25 bp, Homo sapien
ggccagtgcccatgttcctcttttc

SEQ ID NO: 64566 - DNA, 25 bp, Homo sapien
gcttcccttggccagtgcccatgtt

SEQ ID NO: 64567 - DNA, 25 bp, Homo sapien
ggagcagcttcccttggccagtgcc

SEQ ID NO: 64568 - DNA, 25 bp, Homo sapien
tgacgcgcacctgtctggtggatgg

SEQ ID NO: 64569 - DNA, 25 bp, Homo sapien
actgtctttccactgaatgttatga

SEQ ID NO: 64570 - DNA, 25 bp, Homo sapien
ggcgagctaacccacggcgagctaa

SEQ ID NO: 64571 - DNA, 25 bp, Homo sapien
taatccacggcgagctaacccacgg

SEQ ID NO: 64572 - DNA, 25 bp, Homo sapien
gcgagcttacccacggcgagctaac

SEQ ID NO: 64573 - DNA, 25 bp, Homo sapien
ggcgagcttacccacggcgagctaa

SEQ ID NO: 64574 - DNA, 25 bp, Homo sapien
ggcgagctaacccacggccagctaa

SEQ ID NO: 64575 - DNA, 25 bp, Homo sapien
ggcgagctaacccacggcgagctta

SEQ ID NO: 64576 - DNA, 25 bp, Homo sapien
cggtgagctaatccacggcgagcta

SEQ ID NO: 64577 - DNA, 25 bp, Homo sapien
ggccagctaacccacggcgagctaa

SEQ ID NO: 64578 - DNA, 25 bp, Homo sapien
ctggggagcagcgatccagagtcca

SEQ ID NO: 64579 - DNA, 25 bp, Homo sapien
actcaagagctccagcaagagcaga

SEQ ID NO: 64580 - DNA, 25 bp, Homo sapien
gtcacagggctcactcaagagctcc

SEQ ID NO: 64581 - DNA, 25 bp, Homo sapien
agcaggcgtcacagggctcactcaa

SEQ ID NO: 64582 - DNA, 25 bp, Homo sapien
acctcacctagcaggcgtcacaggg

SEQ ID NO: 64583 - DNA, 25 bp, Homo sapien
agggtcacgccaccgcgccctgttt

SEQ ID NO: 64584 - DNA, 25 bp, Homo sapien
ctccacagaccacagcgaccgcgcc

SEQ ID NO: 64585 - DNA, 25 bp, Homo sapien
gcagcgatccagagtccaggttctg

SEQ ID NO: 64586 - DNA, 25 bp, Homo sapien
gctacttggataggggacgctcact

SEQ ID NO: 64587 - DNA, 25 bp, Homo sapien
tcagctcatccagcttctcctgtag

SEQ ID NO: 64588 - DNA, 25 bp, Homo sapien
agtgagtcgatgagcttgcaggccc

SEQ ID NO: 64589 - DNA, 25 bp, Homo sapien
ctgacgccgacaggatgacctcgtt

SEQ ID NO: 64590 - DNA, 25 bp, Homo sapien
tgacctcgttgatggacatggggct

SEQ ID NO: 64591 - DNA, 25 bp, Homo sapien
tctgcacggcttccgtggctggctt

SEQ ID NO: 64592 - DNA, 25 bp, Homo sapien
tgggcgacagcaggctacttggata

SEQ ID NO: 64593 - DNA, 25 bp, Homo sapien
gcaggctcttcagctcgccgttctt

SEQ ID NO: 64594 - DNA, 25 bp, Homo sapien
agcagatcaccatcgcgggccttgg

SEQ ID NO: 64595 - DNA, 25 bp, Homo sapien
agttcacggccgcacagcagatcac

SEQ ID NO: 64596 - DNA, 25 bp, Homo sapien
ggcaagtccgtaccgcgacatgggc

SEQ ID NO: 64597 - DNA, 25 bp, Homo sapien
cgtccgtaccgcaagatggctgctc

SEQ ID NO: 64598 - DNA, 25 bp, Homo sapien
ctctaagaggaggaagcgccaccca

SEQ ID NO: 64599 - DNA, 25 bp, Homo sapien
atggcacacagtgtcccgtcggaca

SEQ ID NO: 64600 - DNA, 25 bp, Homo sapien
tcggacagcagaaccagccgtcgtc

SEQ ID NO: 64601 - DNA, 25 bp, Homo sapien
gcgtatttccgctcgcgcgccgtat

SEQ ID NO: 64602 - DNA, 25 bp, Homo sapien
gcaacggattccctgccggagctga

SEQ ID NO: 64603 - DNA, 25 bp, Homo sapien
ggtccttggaaccaggtgccactcc

SEQ ID NO: 64604 - DNA, 25 bp, Homo sapien
ttctgcaagtgtcaaggcgagtgtc

SEQ ID NO: 64605 - DNA, 25 bp, Homo sapien
gcacgtgctgctttcgttctgcaag

SEQ ID NO: 64606 - DNA, 25 bp, Homo sapien
tgaggcacgtccatcagtaggcacg

SEQ ID NO: 64607 - DNA, 25 bp, Homo sapien
tcactttcagcgcatcgtcgtcacg

SEQ ID NO: 64608 - DNA, 25 bp, Homo sapien
ggcgccactgcgtttcctgcagatt

SEQ ID NO: 64609 - DNA, 25 bp, Homo sapien
tcgtcgtcacgtggccatttgtgca

SEQ ID NO: 64610 - DNA, 25 bp, Homo sapien
gacgtgccagaagccctggctgccg

SEQ ID NO: 64611 - DNA, 25 bp, Homo sapien
cgggaaacgaaaagctgcgtgacca

SEQ ID NO: 64612 - DNA, 25 bp, Homo sapien
acgaaaagctgcgtgaccagcatca

SEQ ID NO: 64613 - DNA, 25 bp, Homo sapien
tgcgtgaccagcatcatctgcaggc

SEQ ID NO: 64614 - DNA, 25 bp, Homo sapien
gaccagcatcatctgcaggcacagc

SEQ ID NO: 64615 - DNA, 25 bp, Homo sapien
aagggactgaagctccgcgggccgt

SEQ ID NO: 64616 - DNA, 25 bp, Homo sapien
ggccgtggccacaagcgacagtgct

SEQ ID NO: 64617 - DNA, 25 bp, Homo sapien
acaagcgacagtgctggcgcccgac

SEQ ID NO: 64618 - DNA, 25 bp, Homo sapien
cgcgagacgaacgagcgagatgctt

SEQ ID NO: 64619 - DNA, 25 bp, Homo sapien
gcctcggccaaattcgaagggattg

SEQ ID NO: 64620 - DNA, 25 bp, Homo sapien
ttagctagtatttcccggcctcggc

SEQ ID NO: 64621 - DNA, 25 bp, Homo sapien
cgcgcgccgtgattagctagtattt

SEQ ID NO: 64622 - DNA, 25 bp, Homo sapien
attggccggcgtcaacagcgcgcgc

SEQ ID NO: 64623 - DNA, 25 bp, Homo sapien
tccacgccctccagcactatgagag

SEQ ID NO: 64624 - DNA, 25 bp, Homo sapien
ccagcttgcggctctgcgtgctctt

SEQ ID NO: 64625 - DNA, 25 bp, Homo sapien
acgagcgagatgcttcccgaagcgc

SEQ ID NO: 64626 - DNA, 25 bp, Homo sapien
tggcgaccgccatgtacttggagca

SEQ ID NO: 64627 - DNA, 25 bp, Homo sapien
gccggcctcttgtgtgaccgcggct

SEQ ID NO: 64628 - DNA, 25 bp, Homo sapien
ggtcgcgccaattccaggtgcgtca

SEQ ID NO: 64629 - DNA, 25 bp, Homo sapien
catgtacttggagcactatctggac

SEQ ID NO: 64630 - DNA, 25 bp, Homo sapien
cccgccggaagctgaaaggcgtgtc

SEQ ID NO: 64631 - DNA, 25 bp, Homo sapien
catgaatagtgagcgcgctggcacc

SEQ ID NO: 64632 - DNA, 25 bp, Homo sapien
agcgcgcgcgactcatgaatagtga

SEQ ID NO: 64633 - DNA, 25 bp, Homo sapien
cactatctggacagtaagcgcgccc

SEQ ID NO: 64634 - DNA, 25 bp, Homo sapien
agccgttagagagacgggactctgc

SEQ ID NO: 64635 - DNA, 25 bp, Homo sapien
cgctaaagtttagccgttagagaga

SEQ ID NO: 64636 - DNA, 25 bp, Homo sapien
gtctgttttgcgctaaagtttagcc

SEQ ID NO: 64637 - DNA, 25 bp, Homo sapien
aaccttaatcggtgtgtctgttttg

SEQ ID NO: 64638 - DNA, 25 bp, Homo sapien
cacggtgaaccttaatcggtgtgtc

SEQ ID NO: 64639 - DNA, 25 bp, Homo sapien
ccctggcacacggtgaaccttaatc

SEQ ID NO: 64640 - DNA, 25 bp, Homo sapien
gccgcaaccacctagaagaagccca

SEQ ID NO: 64641 - DNA, 25 bp, Homo sapien
tcggagcttccggagcacccaggct

SEQ ID NO: 64642 - DNA, 25 bp, Homo sapien
ctcacggtgtcatgtggcgtcaaca

SEQ ID NO: 64643 - DNA, 25 bp, Homo sapien
cgcccgagttggtaagagccagtta

SEQ ID NO: 64644 - DNA, 25 bp, Homo sapien
cgtggcagcgtgtttgaaactccgg

SEQ ID NO: 64645 - DNA, 25 bp, Homo sapien
ttgaaactccggcagactcgcccga

SEQ ID NO: 64646 - DNA, 25 bp, Homo sapien
agagccagttatccttggtgttcgg

SEQ ID NO: 64647 - DNA, 25 bp, Homo sapien
ccttggtgttcggtgtgaggacaca

SEQ ID NO: 64648 - DNA, 25 bp, Homo sapien
acacagggaaaggatgccgtgtctc

SEQ ID NO: 64649 - DNA, 25 bp, Homo sapien
tgtggcgtcaacacaggctgtcctg

SEQ ID NO: 64650 - DNA, 25 bp, Homo sapien
atcgcctaggccatctccatagaga

SEQ ID NO: 64651 - DNA, 25 bp, Homo sapien
gcagttccaggaagcggccatttca

SEQ ID NO: 64652 - DNA, 25 bp, Homo sapien
cagaacctcggctgctgtgcattta

SEQ ID NO: 64653 - DNA, 25 bp, Homo sapien
gcagattcctgggtactgccagata

SEQ ID NO: 64654 - DNA, 25 bp, Homo sapien
cggtcgccggtctgaagataaattt

SEQ ID NO: 64655 - DNA, 25 bp, Homo sapien
cggacgcttgtcgagaatgcagatt

SEQ ID NO: 64656 - DNA, 25 bp, Homo sapien
cggccatttcagagcgcaccgctta

SEQ ID NO: 64657 - DNA, 25 bp, Homo sapien
tgaacagggtcaacagccagtcgtc

SEQ ID NO: 64658 - DNA, 25 bp, Homo sapien
cctgttcgcacagaagggcgacctt

SEQ ID NO: 64659 - DNA, 25 bp, Homo sapien
ctcgcgtagctttcctgtggttttc

SEQ ID NO: 64660 - DNA, 25 bp, Homo sapien
cgccgcctttttagcttggacttca

SEQ ID NO: 64661 - DNA, 25 bp, Homo sapien
tcacctccggagtaaacggctcttc

SEQ ID NO: 64662 - DNA, 25 bp, Homo sapien
tcttcattagcttggagtggccgca

SEQ ID NO: 64663 - DNA, 25 bp, Homo sapien
gaagcgctggatgtttcctagaaca

SEQ ID NO: 64664 - DNA, 25 bp, Homo sapien
ctgtcccttcattcgtgtcgcaata

SEQ ID NO: 64665 - DNA, 25 bp, Homo sapien
actgcgcctttcttgtcacaggttc

SEQ ID NO: 64666 - DNA, 25 bp, Homo sapien
acctggccgcctttgagcgcatcgt

SEQ ID NO: 64667 - DNA, 25 bp, Homo sapien
cgagcctgcgcgtcgctaagtccag

SEQ ID NO: 64668 - DNA, 25 bp, Homo sapien
tcgctaagtccaggcctgctgcgtg

SEQ ID NO: 64669 - DNA, 25 bp, Homo sapien
ccctgcttctgcaagcgtgtttcaa

SEQ ID NO: 64670 - DNA, 25 bp, Homo sapien
cgtgtttcaatttgtacaacgtgca

SEQ ID NO: 64671 - DNA, 25 bp, Homo sapien
aacatgaaattacccttggccactt

SEQ ID NO: 64672 - DNA, 25 bp, Homo sapien
cgttctccacggtgtctaagcagga

SEQ ID NO: 64673 - DNA, 25 bp, Homo sapien
gctcgtcacgtgaccgcgtggaaca

SEQ ID NO: 64674 - DNA, 25 bp, Homo sapien
gcccgcgggttaacacagactccga

SEQ ID NO: 64675 - DNA, 25 bp, Homo sapien
tgcagccacgcggaaagagcaatga

SEQ ID NO: 64676 - DNA, 25 bp, Homo sapien
gactccgagtgactccgacgcagga

SEQ ID NO: 64677 - DNA, 25 bp, Homo sapien
cgaatctgcgtgaggcaggccacca

SEQ ID NO: 64678 - DNA, 25 bp, Homo sapien
cccaacggccatgtgacggcgttga

SEQ ID NO: 64679 - DNA, 25 bp, Homo sapien
agacgcgcagagaattccacgccgt

SEQ ID NO: 64680 - DNA, 25 bp, Homo sapien
ttctgacggaattctgcagcggctc

SEQ ID NO: 64681 - DNA, 25 bp, Homo sapien
atcgcatccaggcaggccgtgttct

SEQ ID NO: 64682 - DNA, 25 bp, Homo sapien
agctccagtacatggcccgcctgta

SEQ ID NO: 64683 - DNA, 25 bp, Homo sapien
tggcgcctgtacgagcatttcaacc

SEQ ID NO: 64684 - DNA, 25 bp, Homo sapien
caacatgtggttcgacttcggcttc

SEQ ID NO: 64685 - DNA, 25 bp, Homo sapien
tcgccgcggacgttctacaacgaca

SEQ ID NO: 64686 - DNA, 25 bp, Homo sapien
gctggagtcctccttcatctactac

SEQ ID NO: 64687 - DNA, 25 bp, Homo sapien
tgtcgccacacaggtgcagaaagtc

SEQ ID NO: 64688 - DNA, 25 bp, Homo sapien
ggcttgtgatgcctgagctccagta

SEQ ID NO: 64689 - DNA, 25 bp, Homo sapien
ggccgacatcctgggttacaacctc

SEQ ID NO: 64690 - DNA, 25 bp, Homo sapien
gttcccactgtctgcagctgtgcca

SEQ ID NO: 64691 - DNA, 25 bp, Homo sapien
tgtgcgtgctcacgctcggctccgt

SEQ ID NO: 64692 - DNA, 25 bp, Homo sapien
aggaccagcgttcccactgtctgca

SEQ ID NO: 64693 - DNA, 25 bp, Homo sapien
accgctcctgcatggtggaggacca

SEQ ID NO: 64694 - DNA, 25 bp, Homo sapien
gccgtggatctgaccgctcctgcat

SEQ ID NO: 64695 - DNA, 25 bp, Homo sapien
gtggtgtccggcatccggccatctc

SEQ ID NO: 64696 - DNA, 25 bp, Homo sapien
gcctttacccgggtctctgtcagtg

SEQ ID NO: 64697 - DNA, 25 bp, Homo sapien
acgctcggctccgtctgcctttgtg

SEQ ID NO: 64698 - DNA, 25 bp, Homo sapien
agaggacgggcctgacctaccgcgt

SEQ ID NO: 64699 - DNA, 25 bp, Homo sapien
cgtgcagatcgccacgggaaggaac

SEQ ID NO: 64700 - DNA, 25 bp, Homo sapien
ctgccctgtgcacgatgctggcacg

SEQ ID NO: 64701 - DNA, 25 bp, Homo sapien
tgggccacacgcctgaggccgtgca

SEQ ID NO: 64702 - DNA, 25 bp, Homo sapien
acgtcctggtcagcggaacttcctc

SEQ ID NO: 64703 - DNA, 25 bp, Homo sapien
aggctcagcgatcctgggtgccctg

SEQ ID NO: 64704 - DNA, 25 bp, Homo sapien
ggacctcaccgaggaggccatcggt

SEQ ID NO: 64705 - DNA, 25 bp, Homo sapien
atcgccacgggaaggaacgccgcgc

SEQ ID NO: 64706 - DNA, 25 bp, Homo sapien
tgcaatgcccggagcccactgggca

SEQ ID NO: 64707 - DNA, 25 bp, Homo sapien
gggcaggccggcagcttcctctact

SEQ ID NO: 64708 - DNA, 25 bp, Homo sapien
aacctgcgctcaggcgagtgccagc

SEQ ID NO: 64709 - DNA, 25 bp, Homo sapien
tcagcactgacgagggcacctcctt

SEQ ID NO: 64710 - DNA, 25 bp, Homo sapien
ccgccgagagtgttttggcaagatc

SEQ ID NO: 64711 - DNA, 25 bp, Homo sapien
tttggcaagatctgccggaccagcc

SEQ ID NO: 64712 - DNA, 25 bp, Homo sapien
ttcgccttctacagcgatgaccacg

SEQ ID NO: 64713 - DNA, 25 bp, Homo sapien
ttctacagcgatgaccacggccgca

SEQ ID NO: 64714 - DNA, 25 bp, Homo sapien
tgcatcctctcatgtgtgtgtcctg

SEQ ID NO: 64715 - DNA, 25 bp, Homo sapien
tcgcgtgctgggtgcatcctctcat

SEQ ID NO: 64716 - DNA, 25 bp, Homo sapien
aggtcgcgtgctgggtgcatcctct

SEQ ID NO: 64717 - DNA, 25 bp, Homo sapien
gctgggtgcatcctctcatgtgtgt

SEQ ID NO: 64718 - DNA, 25 bp, Homo sapien
gtgcatcctctcatgtgtgtgtcct

SEQ ID NO: 64719 - DNA, 25 bp, Homo sapien
gcatcctgtcatgcgtgtgtcctgg

SEQ ID NO: 64720 - DNA, 25 bp, Homo sapien
tgtcctggctcgtggcccgtgtgta

SEQ ID NO: 64721 - DNA, 25 bp, Homo sapien
gggtgcatcctgtcatgcgtgtgtc

SEQ ID NO: 64722 - DNA, 25 bp, Homo sapien
cgtggcttccgaaaccgttgtctca

SEQ ID NO: 64723 - DNA, 25 bp, Homo sapien
gcgagaccgtcagctgctatcactg

SEQ ID NO: 64724 - DNA, 25 bp, Homo sapien
tgcttcaagcgcgtcgttccgttta

SEQ ID NO: 64725 - DNA, 25 bp, Homo sapien
ttccagatgtggagatcaaggcccg

SEQ ID NO: 64726 - DNA, 25 bp, Homo sapien
accagagtgtcgttccgtcccattc

SEQ ID NO: 64727 - DNA, 25 bp, Homo sapien
tgtgtgtgtatctatctcccgtttc

SEQ ID NO: 64728 - DNA, 25 bp, Homo sapien
tctcaggtggtagaaacgatctcgc

SEQ ID NO: 64729 - DNA, 25 bp, Homo sapien
agtcctctgttgttgacggttctca

SEQ ID NO: 64730 - DNA, 25 bp, Homo sapien
gctgccgtcctcatttcgagctctt

SEQ ID NO: 64731 - DNA, 25 bp, Homo sapien
cccgcgatccggaacgcgactttga

SEQ ID NO: 64732 - DNA, 25 bp, Homo sapien
ccgctgcaatcctttggggtctgtg

SEQ ID NO: 64733 - DNA, 25 bp, Homo sapien
aggtctcttacaggcctgccctttc

SEQ ID NO: 64734 - DNA, 25 bp, Homo sapien
ttggctcccgctgaagcgcaacttc

SEQ ID NO: 64735 - DNA, 25 bp, Homo sapien
gtcgccagttggacgcacagccaaa

SEQ ID NO: 64736 - DNA, 25 bp, Homo sapien
cacagccggtagctggttttcgtta

SEQ ID NO: 64737 - DNA, 25 bp, Homo sapien
ggtccgcgtccaaaggtctcttaca

SEQ ID NO: 64738 - DNA, 25 bp, Homo sapien
cagtgcctcggtctccgctcgggga

SEQ ID NO: 64739 - DNA, 25 bp, Homo sapien
tctgctggaagcttcggcagcggct

SEQ ID NO: 64740 - DNA, 25 bp, Homo sapien
ggttcttcgtgctcctcgctcggcg

SEQ ID NO: 64741 - DNA, 25 bp, Homo sapien
tgagcggccgtaatgagcactcgca

SEQ ID NO: 64742 - DNA, 25 bp, Homo sapien
tccgctcggggacgcggtgattttc

SEQ ID NO: 64743 - DNA, 25 bp, Homo sapien
ccgtaatgagcactcgcaggagcaa

SEQ ID NO: 64744 - DNA, 25 bp, Homo sapien
gctcctccgtcagaagggcggccag

SEQ ID NO: 64745 - DNA, 25 bp, Homo sapien
tccggtccgcctgcactgtgacgtg

SEQ ID NO: 64746 - DNA, 25 bp, Homo sapien
cccgtgcagagtaaggcgtccaacg

SEQ ID NO: 64747 - DNA, 25 bp, Homo sapien
gctccatccacgaggcccacaggac

SEQ ID NO: 64748 - DNA, 25 bp, Homo sapien
ctgcacccagatcgccagcccggtc

SEQ ID NO: 64749 - DNA, 25 bp, Homo sapien
gagtaaggcgtccaacgcccacgca

SEQ ID NO: 64750 - DNA, 25 bp, Homo sapien
agcccggtctcctgtagcccgaggg

SEQ ID NO: 64751 - DNA, 25 bp, Homo sapien
ccgcggtctctcagccgccaacaca

SEQ ID NO: 64752 - DNA, 25 bp, Homo sapien
cagccggggacggaaaaagtgagtg

SEQ ID NO: 64753 - DNA, 25 bp, Homo sapien
ctctcgctccgggtcccacgcgccc

SEQ ID NO: 64754 - DNA, 25 bp, Homo sapien
ccagctctcagctgatggaggctcc

SEQ ID NO: 64755 - DNA, 25 bp, Homo sapien
tgacctctgggaagtgtttcgacga

SEQ ID NO: 64756 - DNA, 25 bp, Homo sapien
ccagcgccgtgagctcgtgggctct

SEQ ID NO: 64757 - DNA, 25 bp, Homo sapien
ctttggacggctttgccgttgccga

SEQ ID NO: 64758 - DNA, 25 bp, Homo sapien
gcaaagggcaagtgcccaccgccta

SEQ ID NO: 64759 - DNA, 25 bp, Homo sapien
acggctttgccgttgccgagccagc

SEQ ID NO: 64760 - DNA, 25 bp, Homo sapien
acatgtttgccggtgacctctggga

SEQ ID NO: 64761 - DNA, 25 bp, Homo sapien
ctctgcgtctgcacatgtttgccgg

SEQ ID NO: 64762 - DNA, 25 bp, Homo sapien
tgtctctctcctgctcacaggcggt

SEQ ID NO: 64763 - DNA, 25 bp, Homo sapien
acgtgccccgtggttctctgtctct

SEQ ID NO: 64764 - DNA, 25 bp, Homo sapien
tctcgctcctgctcatgggcagtgc

SEQ ID NO: 64765 - DNA, 25 bp, Homo sapien
cgtggtgctctgtctcgctcctgct

SEQ ID NO: 64766 - DNA, 25 bp, Homo sapien
gtctctctcctgctcacaggcggtg

SEQ ID NO: 64767 - DNA, 25 bp, Homo sapien
tcgtggttctctgtctcactcctgc

SEQ ID NO: 64768 - DNA, 25 bp, Homo sapien
gtggtgctctgtctcgctcctgctc

SEQ ID NO: 64769 - DNA, 25 bp, Homo sapien
tcgctcctgctcatgggcagtgccc

SEQ ID NO: 64770 - DNA, 25 bp, Homo sapien
tgcatgaacgttggggaaggaaacc

SEQ ID NO: 64771 - DNA, 25 bp, Homo sapien
tgtttctcatccagccacgtctcgg

SEQ ID NO: 64772 - DNA, 25 bp, Homo sapien
atccagccacgtctcggaaggtctg

SEQ ID NO: 64773 - DNA, 25 bp, Homo sapien
ctcggaaggtctgtgactgctgaaa

SEQ ID NO: 64774 - DNA, 25 bp, Homo sapien
gtccgccggcgtgtttctcatccag

SEQ ID NO: 64775 - DNA, 25 bp, Homo sapien
acattctgtgcatgaacgttgggga

SEQ ID NO: 64776 - DNA, 25 bp, Homo sapien
ccaagccgcagagaacggaggcagc

SEQ ID NO: 64777 - DNA, 25 bp, Homo sapien
ctgtgactgctgaaaacattctgtg

SEQ ID NO: 64778 - DNA, 25 bp, Homo sapien
cgtggggacgtctgcactcacagaa

SEQ ID NO: 64779 - DNA, 25 bp, Homo sapien
ccatggggacgtctgcactcacagt

SEQ ID NO: 64780 - DNA, 25 bp, Homo sapien
gtaaatggggacgtctgcactcaca

SEQ ID NO: 64781 - DNA, 25 bp, Homo sapien
tcggcactgccctccgtaaatgggg

SEQ ID NO: 64782 - DNA, 25 bp, Homo sapien
taaatggggacgtctgcactcacag

SEQ ID NO: 64783 - DNA, 25 bp, Homo sapien
cggcactgccctccgtaaatgggga

SEQ ID NO: 64784 - DNA, 25 bp, Homo sapien
ccgtccatggggacgtctgcactca

SEQ ID NO: 64785 - DNA, 25 bp, Homo sapien
gggacgtctgcactcacagaatgtc

SEQ ID NO: 64786 - DNA, 25 bp, Homo sapien
gaccgcgtgattgccagtgcataca

SEQ ID NO: 64787 - DNA, 25 bp, Homo sapien
cacacagtgtgaccgcgtgattgcc

SEQ ID NO: 64788 - DNA, 25 bp, Homo sapien
aacacacagtgtggccgcgtgattg

SEQ ID NO: 64789 - DNA, 25 bp, Homo sapien
gtggctgcgtgattgccagtgcata

SEQ ID NO: 64790 - DNA, 25 bp, Homo sapien
gaccgcgtgattgccagtgcgtaca

SEQ ID NO: 64791 - DNA, 25 bp, Homo sapien
tgaccgcgtgattgccagtgcacac

SEQ ID NO: 64792 - DNA, 25 bp, Homo sapien
cacagagtgtgaccgcgtgattgcc

SEQ ID NO: 64793 - DNA, 25 bp, Homo sapien
acacacagtgtgaccgcgtgattgc

SEQ ID NO: 64794 - DNA, 25 bp, Homo sapien
gtgaccgcgtgattgccagtgcaca

SEQ ID NO: 64795 - DNA, 25 bp, Homo sapien
aacacacagtgtggccgcgtgattg

SEQ ID NO: 64796 - DNA, 25 bp, Homo sapien
acacacagtgtgaccgcgtgattgc

SEQ ID NO: 64797 - DNA, 25 bp, Homo sapien
tgaccgcgtgattgccagtgcacac

SEQ ID NO: 64798 - DNA, 25 bp, Homo sapien
gaccgcgtgattgccagtgcgtaca

SEQ ID NO: 64799 - DNA, 25 bp, Homo sapien
tgaccgcgtgattgccagtgcgtac

SEQ ID NO: 64800 - DNA, 25 bp, Homo sapien
ccgcgtgattgccagtgcgtacagg

SEQ ID NO: 64801 - DNA, 25 bp, Homo sapien
ccgcgtgattgccagtgtgtacagg

SEQ ID NO: 64802 - DNA, 25 bp, Homo sapien
acacacagtgtgaccgcgtgattgc

SEQ ID NO: 64803 - DNA, 25 bp, Homo sapien
ccgcgtgattgccagtgtgtacagg

SEQ ID NO: 64804 - DNA, 25 bp, Homo sapien
gtggccgcgtgattgccaatgcaca

SEQ ID NO: 64805 - DNA, 25 bp, Homo sapien
gaccgcgtgattgccagtgcataca

SEQ ID NO: 64806 - DNA, 25 bp, Homo sapien
cacacagtgtgaccgcgtgattgcc

SEQ ID NO: 64807 - DNA, 25 bp, Homo sapien
gtgaccgcgtgattgccagtgcaca

SEQ ID NO: 64808 - DNA, 25 bp, Homo sapien
gaccgcgtgattgccagtgcgtaca

SEQ ID NO: 64809 - DNA, 25 bp, Homo sapien
tgaccgcgtgattgccagtgcacac

SEQ ID NO: 64810 - DNA, 25 bp, Homo sapien
atggtgtcccgtgaactgagtgggg

SEQ ID NO: 64811 - DNA, 25 bp, Homo sapien
aactgagcgggggtgtcccatgaac

SEQ ID NO: 64812 - DNA, 25 bp, Homo sapien
tcccatgaactgagcgggggtgtcc

SEQ ID NO: 64813 - DNA, 25 bp, Homo sapien
actgagcgggggtgtcccatgaact

SEQ ID NO: 64814 - DNA, 25 bp, Homo sapien
cgtgaactgagcgatggtgtcccgt

SEQ ID NO: 64815 - DNA, 25 bp, Homo sapien
tgtcccgtgaactgagcgatggtgt

SEQ ID NO: 64816 - DNA, 25 bp, Homo sapien
gtcccatgaactgagcgggggtgtc

SEQ ID NO: 64817 - DNA, 25 bp, Homo sapien
tgaactgagcgatggtgtcccgtga

SEQ ID NO: 64818 - DNA, 25 bp, Homo sapien
ctggtaaaacagtggacgcaaatcc

SEQ ID NO: 64819 - DNA, 25 bp, Homo sapien
ataatcaaaagggacatcgggtggc

SEQ ID NO: 64820 - DNA, 25 bp, Homo sapien
ggacgcaaatcccaccttttcagtg

SEQ ID NO: 64821 - DNA, 25 bp, Homo sapien
agcagagacgcgtcagagtccaacg

SEQ ID NO: 64822 - DNA, 25 bp, Homo sapien
ccagagatgggcttcccgcagcgga

SEQ ID NO: 64823 - DNA, 25 bp, Homo sapien
cacattcagtggaatcgcggccaga

SEQ ID NO: 64824 - DNA, 25 bp, Homo sapien
cgggtggctgaatgcagacaaaata

SEQ ID NO: 64825 - DNA, 25 bp, Homo sapien
ccagaaagcaaagggcggcagaaca

SEQ ID NO: 64826 - DNA, 25 bp, Homo sapien
accgcccacaggtgcatcgcgtgtc

SEQ ID NO: 64827 - DNA, 25 bp, Homo sapien
gcgtcaggacccggcagcaacactg

SEQ ID NO: 64828 - DNA, 25 bp, Homo sapien
gggcgtcaggacccggcagcaacac

SEQ ID NO: 64829 - DNA, 25 bp, Homo sapien
gaccgcccacaggtgcatcgcgtgt

SEQ ID NO: 64830 - DNA, 25 bp, Homo sapien
ggaccgcccacaggtgcatcgcgtg

SEQ ID NO: 64831 - DNA, 25 bp, Homo sapien
gggaccgcccacaggtgcatcgcgt

SEQ ID NO: 64832 - DNA, 25 bp, Homo sapien
cggcagcaacactgccacgcgaatc

SEQ ID NO: 64833 - DNA, 25 bp, Homo sapien
tcaggacccggcagcaacactgcca

SEQ ID NO: 64834 - DNA, 25 bp, Homo sapien
aaagagagcttattccgggagatcc

SEQ ID NO: 64835 - DNA, 25 bp, Homo sapien
cgcgctgacagtgtgcaggatttgc

SEQ ID NO: 64836 - DNA, 25 bp, Homo sapien
ggcagccgaaacaggccagagcttc

SEQ ID NO: 64837 - DNA, 25 bp, Homo sapien
acgtgtccagccttaacgacgcaga

SEQ ID NO: 64838 - DNA, 25 bp, Homo sapien
agggcctttgcgacttccctttgcg

SEQ ID NO: 64839 - DNA, 25 bp, Homo sapien
ttcagacgctgctcaactccatggc

SEQ ID NO: 64840 - DNA, 25 bp, Homo sapien
tcgacgccgccaacaacgttgtcta

SEQ ID NO: 64841 - DNA, 25 bp, Homo sapien
cagagcttcctgttcgacgtgtcca

SEQ ID NO: 64842 - DNA, 25 bp, Homo sapien
ccacccggagagaccttgacaaagg

SEQ ID NO: 64843 - DNA, 25 bp, Homo sapien
aggttctccaaagcccggtccgctg

SEQ ID NO: 64844 - DNA, 25 bp, Homo sapien
ttagtcatgccgctcaggatcacgc

SEQ ID NO: 64845 - DNA, 25 bp, Homo sapien
cccgcacatacacgctggcgatgta

SEQ ID NO: 64846 - DNA, 25 bp, Homo sapien
ggtccagccgctcaataatcttcag

SEQ ID NO: 64847 - DNA, 25 bp, Homo sapien
cccgtaccttgaatgtgctgcttga

SEQ ID NO: 64848 - DNA, 25 bp, Homo sapien
agctagctgcacacatccgctcgtg

SEQ ID NO: 64849 - DNA, 25 bp, Homo sapien
gccgtgcccaagtttgcagctcctg

SEQ ID NO: 64850 - DNA, 25 bp, Homo sapien
ctgatccgggaagccgatgtcagcc

SEQ ID NO: 64851 - DNA, 25 bp, Homo sapien
caacaggggctctgcgaggaaccat

SEQ ID NO: 64852 - DNA, 25 bp, Homo sapien
tgcccggcctgcaactcaagggact

SEQ ID NO: 64853 - DNA, 25 bp, Homo sapien
attatttttgctgctacgggccatc

SEQ ID NO: 64854 - DNA, 25 bp, Homo sapien
tcctttgggcagtcaccctgagctc

SEQ ID NO: 64855 - DNA, 25 bp, Homo sapien
gctcggcaagctgtacctcacctgt

SEQ ID NO: 64856 - DNA, 25 bp, Homo sapien
gtacctcacctgtccacctggaagg

SEQ ID NO: 64857 - DNA, 25 bp, Homo sapien
ctcgcgagctgtcggaacagtatta

SEQ ID NO: 64858 - DNA, 25 bp, Homo sapien
cagcaaccgagaagggcactcagcc

SEQ ID NO: 64859 - DNA, 25 bp, Homo sapien
agcaaccgagaagggcactcagccc

SEQ ID NO: 64860 - DNA, 25 bp, Homo sapien
agaagggcactcagccccgcaggtc

SEQ ID NO: 64861 - DNA, 25 bp, Homo sapien
ggcagcaaccgagaagggcactcag

SEQ ID NO: 64862 - DNA, 25 bp, Homo sapien
cggcagcaaccgagaagggcactca

SEQ ID NO: 64863 - DNA, 25 bp, Homo sapien
gcggcagcaaccgagaagggcactc

SEQ ID NO: 64864 - DNA, 25 bp, Homo sapien
gtccatcgccagctgcggtggggcg

SEQ ID NO: 64865 - DNA, 25 bp, Homo sapien
gcagcaaccgagaagggcactcagc

SEQ ID NO: 64866 - DNA, 25 bp, Homo sapien
agctgcctcgaccaccagaacaatg

SEQ ID NO: 64867 - DNA, 25 bp, Homo sapien
cgaggggcacaagctgcctcgacca

SEQ ID NO: 64868 - DNA, 25 bp, Homo sapien
aagctgcctcgaccaccagaacaat

SEQ ID NO: 64869 - DNA, 25 bp, Homo sapien
agaacaacaccgcaagcgtccagca

SEQ ID NO: 64870 - DNA, 25 bp, Homo sapien
gaacaatgccgccagcgtccagcag

SEQ ID NO: 64871 - DNA, 25 bp, Homo sapien
agcagtgaggggcacaagctgcctc

SEQ ID NO: 64872 - DNA, 25 bp, Homo sapien
tgaggggcacaagctgcctcgacca

SEQ ID NO: 64873 - DNA, 25 bp, Homo sapien
gcacaagctgcctcgaccaccagaa

SEQ ID NO: 64874 - DNA, 25 bp, Homo sapien
gagggaacccgcacagaccttattg

SEQ ID NO: 64875 - DNA, 25 bp, Homo sapien
ttcccttgacaccttgtgggtgcca

SEQ ID NO: 64876 - DNA, 25 bp, Homo sapien
tagatgagctcgaaaaccgtcggga

SEQ ID NO: 64877 - DNA, 25 bp, Homo sapien
cccaagtaactttcgaggtagatga

SEQ ID NO: 64878 - DNA, 25 bp, Homo sapien
ggggactgggtctctttactcaatc

SEQ ID NO: 64879 - DNA, 25 bp, Homo sapien
cctctgatctcgcatttggggactg

SEQ ID NO: 64880 - DNA, 25 bp, Homo sapien
cctctgtgcagcgagaagccaggtt

SEQ ID NO: 64881 - DNA, 25 bp, Homo sapien
cactgtcacggtgttcggaggtgct

SEQ ID NO: 64882 - DNA, 25 bp, Homo sapien
atgcgtgactaaggaacgccgagga

SEQ ID NO: 64883 - DNA, 25 bp, Homo sapien
gtggtgttcattgccagcgcatgca

SEQ ID NO: 64884 - DNA, 25 bp, Homo sapien
ccagcgcatgcagttcagaggaacg

SEQ ID NO: 64885 - DNA, 25 bp, Homo sapien
aaccagagctgtggtcagggcatgc

SEQ ID NO: 64886 - DNA, 25 bp, Homo sapien
cagagggaccacaaatgctgcgctc

SEQ ID NO: 64887 - DNA, 25 bp, Homo sapien
cgtgcagtcgtggtgttcattgcca

SEQ ID NO: 64888 - DNA, 25 bp, Homo sapien
caaatgctgcgctcttggcctggca

SEQ ID NO: 64889 - DNA, 25 bp, Homo sapien
acagcccatgcgtgactaaggaacg

SEQ ID NO: 64890 - DNA, 25 bp, Homo sapien
tgggaccaccagcatctgcagtgtc

SEQ ID NO: 64891 - DNA, 25 bp, Homo sapien
agatgtcccggcaccatagccgctt

SEQ ID NO: 64892 - DNA, 25 bp, Homo sapien
catagccgcttcgaaagagattacc

SEQ ID NO: 64893 - DNA, 25 bp, Homo sapien
cgcttcgaaagagattaccgggtgg

SEQ ID NO: 64894 - DNA, 25 bp, Homo sapien
agcctcgtggccagctctgcgtctg

SEQ ID NO: 64895 - DNA, 25 bp, Homo sapien
gtcaacgggacgcatgggaccacca

SEQ ID NO: 64896 - DNA, 25 bp, Homo sapien
agcgaggccatcaccagcctcgtgg

SEQ ID NO: 64897 - DNA, 25 bp, Homo sapien
accgccgcgaatggagcgtcaacgg

SEQ ID NO: 64898 - DNA, 25 bp, Homo sapien
accaatgccgcggtgaccagaaaca

SEQ ID NO: 64899 - DNA, 25 bp, Homo sapien
cccactctggcgacacgattggaga

SEQ ID NO: 64900 - DNA, 25 bp, Homo sapien
cgacacgattggagagggtcaccgt

SEQ ID NO: 64901 - DNA, 25 bp, Homo sapien
cgattggagagggtcaccgtgctca

SEQ ID NO: 64902 - DNA, 25 bp, Homo sapien
agggcgctgccttgtcaccaatgcc

SEQ ID NO: 64903 - DNA, 25 bp, Homo sapien
tgccttgtcaccaatgccgcggtga

SEQ ID NO: 64904 - DNA, 25 bp, Homo sapien
caggacgggccgctacaaggaacgc

SEQ ID NO: 64905 - DNA, 25 bp, Homo sapien
tgccgcggtgaccagaaacaggcag

SEQ ID NO: 64906 - DNA, 25 bp, Homo sapien
ccagaggtaagtcctgctgccacgt

SEQ ID NO: 64907 - DNA, 25 bp, Homo sapien
cgtggggaagtatgagttcaccgac

SEQ ID NO: 64908 - DNA, 25 bp, Homo sapien
tgcagatgctgcggaccattggcgt

SEQ ID NO: 64909 - DNA, 25 bp, Homo sapien
agaggtaagtcctgctgccacgtgc

SEQ ID NO: 64910 - DNA, 25 bp, Homo sapien
tatgagttcaccgacccggggcacc

SEQ ID NO: 64911 - DNA, 25 bp, Homo sapien
ccacaaccgactcggcccacgggct

SEQ ID NO: 64912 - DNA, 25 bp, Homo sapien
ggtaagtcctgctgccacgtgcctc

SEQ ID NO: 64913 - DNA, 25 bp, Homo sapien
agtatgagttcaccgacccggggca

SEQ ID NO: 64914 - DNA, 25 bp, Homo sapien
gaagcagggctactcagaggagcca

SEQ ID NO: 64915 - DNA, 25 bp, Homo sapien
gcaagggacccgtcacaagcatctt

SEQ ID NO: 64916 - DNA, 25 bp, Homo sapien
agggacccgtcacaagcatcttgcc

SEQ ID NO: 64917 - DNA, 25 bp, Homo sapien
gtcacaagcatcttgccctgtggcc

SEQ ID NO: 64918 - DNA, 25 bp, Homo sapien
gctcgcttgctggacacctcgacag

SEQ ID NO: 64919 - DNA, 25 bp, Homo sapien
gcctcctgagaagcgagtgagtgga

SEQ ID NO: 64920 - DNA, 25 bp, Homo sapien
accgccagccgcaggtgcgcgcaag

SEQ ID NO: 64921 - DNA, 25 bp, Homo sapien
agtgagtggaccacagaggtcattt

SEQ ID NO: 64922 - DNA, 25 bp, Homo sapien
tggcctcatccagagtgacgccggc

SEQ ID NO: 64923 - DNA, 25 bp, Homo sapien
ctcttccgggtgttcaccatggtcc

SEQ ID NO: 64924 - DNA, 25 bp, Homo sapien
gtcagctcggtggtttccagctctc

SEQ ID NO: 64925 - DNA, 25 bp, Homo sapien
tggggcgaccagaaaagccagacta

SEQ ID NO: 64926 - DNA, 25 bp, Homo sapien
agccagactaatcaggacgagttcg

SEQ ID NO: 64927 - DNA, 25 bp, Homo sapien
tggaattgggcctgaagccctcatg

SEQ ID NO: 64928 - DNA, 25 bp, Homo sapien
agcggtctccactgtaggcttccta

SEQ ID NO: 64929 - DNA, 25 bp, Homo sapien
gttctcgctctcgagctccgtgcgt

SEQ ID NO: 64930 - DNA, 25 bp, Homo sapien
ccgaggtgactagaagctagcgaca

SEQ ID NO: 64931 - DNA, 25 bp, Homo sapien
agggagtcccgagatggaacgtcca

SEQ ID NO: 64932 - DNA, 25 bp, Homo sapien
ggaacgtccagctctcctctaacga

SEQ ID NO: 64933 - DNA, 25 bp, Homo sapien
ccaattctgtacctcccggggctga

SEQ ID NO: 64934 - DNA, 25 bp, Homo sapien
tctctcttgagctagcgagccgccg

SEQ ID NO: 64935 - DNA, 25 bp, Homo sapien
gactgccgctgccattctctcttga

SEQ ID NO: 64936 - DNA, 25 bp, Homo sapien
aggcctccgctattgctggagcgca

SEQ ID NO: 64937 - DNA, 25 bp, Homo sapien
cgaaaagcgtttgcatggctgtctc

SEQ ID NO: 64938 - DNA, 25 bp, Homo sapien
ttctattttcaaaggcgaacgctgc

SEQ ID NO: 64939 - DNA, 25 bp, Homo sapien
tctgaagggctccagccaaacggag

SEQ ID NO: 64940 - DNA, 25 bp, Homo sapien
ggttctctcgcagggcgttccgaaa

SEQ ID NO: 64941 - DNA, 25 bp, Homo sapien
tgaaggcacagctcctggttctctc

SEQ ID NO: 64942 - DNA, 25 bp, Homo sapien
ggcttgacttgcgagctagctgaag

SEQ ID NO: 64943 - DNA, 25 bp, Homo sapien
ggcgttccgaaacttacagttatgc

SEQ ID NO: 64944 - DNA, 25 bp, Homo sapien
cctgactcgcctgcggcttgacttg

SEQ ID NO: 64945 - DNA, 25 bp, Homo sapien
acagttatgcgcaacacaatgtttc

SEQ ID NO: 64946 - DNA, 25 bp, Homo sapien
ccaaggagaacggtcctgagggcct

SEQ ID NO: 64947 - DNA, 25 bp, Homo sapien
cccgcgttgccagcagccactcgcg

SEQ ID NO: 64948 - DNA, 25 bp, Homo sapien
tgcccttcgcggtttctgcgtttcc

SEQ ID NO: 64949 - DNA, 25 bp, Homo sapien
ggggctcggcccaaacctgccagct

SEQ ID NO: 64950 - DNA, 25 bp, Homo sapien
gctgccctcgcggggttacacggct

SEQ ID NO: 64951 - DNA, 25 bp, Homo sapien
ccggcgccggaaagagactaggacg

SEQ ID NO: 64952 - DNA, 25 bp, Homo sapien
tcttcgctgtttccctttggggtgc

SEQ ID NO: 64953 - DNA, 25 bp, Homo sapien
cccgcggattttggttcttcgctgt

SEQ ID NO: 64954 - DNA, 25 bp, Homo sapien
ctcttccgcgctcacctaggggaat

SEQ ID NO: 64955 - DNA, 25 bp, Homo sapien
tgcccgcttccggatctcgctttat

SEQ ID NO: 64956 - DNA, 25 bp, Homo sapien
aggacctgctctcggatacccgctg

SEQ ID NO: 64957 - DNA, 25 bp, Homo sapien
cggcgagctctggaaagcaggacct

SEQ ID NO: 64958 - DNA, 25 bp, Homo sapien
ccagcctgggtttcggcttcgcttt

SEQ ID NO: 64959 - DNA, 25 bp, Homo sapien
tcggttatccgctgctgctgatacc

SEQ ID NO: 64960 - DNA, 25 bp, Homo sapien
ttccggatctcgctttatcctgccg

SEQ ID NO: 64961 - DNA, 25 bp, Homo sapien
cggctgcagtcgttcggttatccgc

SEQ ID NO: 64962 - DNA, 25 bp, Homo sapien
acgcttgccaggcatgacgcctcga

SEQ ID NO: 64963 - DNA, 25 bp, Homo sapien
agggcgtgctcacttgctgttattg

SEQ ID NO: 64964 - DNA, 25 bp, Homo sapien
gcacctacgactagggagcggccga

SEQ ID NO: 64965 - DNA, 25 bp, Homo sapien
agaagttcagaaccatcggtccctc

SEQ ID NO: 64966 - DNA, 25 bp, Homo sapien
cagagggaacaaggccgtgcccgct

SEQ ID NO: 64967 - DNA, 25 bp, Homo sapien
ttcttcctgggtcatcctgagctcg

SEQ ID NO: 64968 - DNA, 25 bp, Homo sapien
ctcggcagtgagagcacctacgact

SEQ ID NO: 64969 - DNA, 25 bp, Homo sapien
cctgagactgtaaatggagcggata

SEQ ID NO: 64970 - DNA, 25 bp, Homo sapien
ctccaaaaggcgagatgttccggtc

SEQ ID NO: 64971 - DNA, 25 bp, Homo sapien
gtccaagacacttccgggctctgta

SEQ ID NO: 64972 - DNA, 25 bp, Homo sapien
gtaaaaccgagcctgagcgagactc

SEQ ID NO: 64973 - DNA, 25 bp, Homo sapien
gttacagcggaatagcgccgtctta

SEQ ID NO: 64974 - DNA, 25 bp, Homo sapien
caggacccgccggaagctgttacag

SEQ ID NO: 64975 - DNA, 25 bp, Homo sapien
tacaccgcgttagatgcaggacatc

SEQ ID NO: 64976 - DNA, 25 bp, Homo sapien
tccacgccgctaagaaagtcaaacc

SEQ ID NO: 64977 - DNA, 25 bp, Homo sapien
aagaatgctccgatccacgccgcta

SEQ ID NO: 64978 - DNA, 25 bp, Homo sapien
ttctggcggcttgtgtcacggctga

SEQ ID NO: 64979 - DNA, 25 bp, Homo sapien
gcgtcagctgatcgggcctcagtaa

SEQ ID NO: 64980 - DNA, 25 bp, Homo sapien
ctagctgtgcgcaaggcggaatatg

SEQ ID NO: 64981 - DNA, 25 bp, Homo sapien
tcacggctgacgctgtaactatacc

SEQ ID NO: 64982 - DNA, 25 bp, Homo sapien
gtaactatacccagaatctccgtcc

SEQ ID NO: 64983 - DNA, 25 bp, Homo sapien
ccagaatctccgtccctggaggggc

SEQ ID NO: 64984 - DNA, 25 bp, Homo sapien
ctcaggttgagcgtcagctgatcgg

SEQ ID NO: 64985 - DNA, 25 bp, Homo sapien
ggcctgggcctctagctgtgcgcaa

SEQ ID NO: 64986 - DNA, 25 bp, Homo sapien
gctgagccctgggtacctgcattaa

SEQ ID NO: 64987 - DNA, 25 bp, Homo sapien
gagttacttactcctggcccggctc

SEQ ID NO: 64988 - DNA, 25 bp, Homo sapien
ccggcgcccgtatgagttacttact

SEQ ID NO: 64989 - DNA, 25 bp, Homo sapien
tcacactccctctgagttggaagcc

SEQ ID NO: 64990 - DNA, 25 bp, Homo sapien
aagtgcacggctaacatattgtctg

SEQ ID NO: 64991 - DNA, 25 bp, Homo sapien
cttggccacctccttcacgtagagg

SEQ ID NO: 64992 - DNA, 25 bp, Homo sapien
acctgcattaagtccgcccggttca

SEQ ID NO: 64993 - DNA, 25 bp, Homo sapien
ggccgccaccttcaggaggacttca

SEQ ID NO: 64994 - DNA, 25 bp, Homo sapien
ctcggggaggacttcgagccgctca

SEQ ID NO: 64995 - DNA, 25 bp, Homo sapien
gactcgctgtggaacccgcggcgca

SEQ ID NO: 64996 - DNA, 25 bp, Homo sapien
tcaccgagaagcagcgactccagcc

SEQ ID NO: 64997 - DNA, 25 bp, Homo sapien
aattccctggcaccgaggactcgag

SEQ ID NO: 64998 - DNA, 25 bp, Homo sapien
ggtgagcggtgaattccctggcacc

SEQ ID NO: 64999 - DNA, 25 bp, Homo sapien
cactgccttccagtggtttggtccc

SEQ ID NO: 65000 - DNA, 25 bp, Homo sapien
agccgctcagagctcgaagactcgc

SEQ ID NO: 65001 - DNA, 25 bp, Homo sapien
gagctcgaagactcgcgcagtatga

SEQ ID NO: 65002 - DNA, 25 bp, Homo sapien
gtttgctgtgaaatcaaatggcgcc

SEQ ID NO: 65003 - DNA, 25 bp, Homo sapien
gaagtcggtgtcaccgcccgtttgc

SEQ ID NO: 65004 - DNA, 25 bp, Homo sapien
gctgggcttcatcactgcgtttccg

SEQ ID NO: 65005 - DNA, 25 bp, Homo sapien
cactgcgtttccgttttctgtgaaa

SEQ ID NO: 65006 - DNA, 25 bp, Homo sapien
ggcttcatcactgcgtttccgtttt

SEQ ID NO: 65007 - DNA, 25 bp, Homo sapien
caccgcccgtttgctgtgaaatcaa

SEQ ID NO: 65008 - DNA, 25 bp, Homo sapien
ttcggcgtcaccgtccagctggcgt

SEQ ID NO: 65009 - DNA, 25 bp, Homo sapien
gttttctgtgaaatcaaatggcgcc

SEQ ID NO: 65010 - DNA, 25 bp, Homo sapien
gagagtgtggccaagagtgtttcca

SEQ ID NO: 65011 - DNA, 25 bp, Homo sapien
cctcgagtttgggaactgtttatct

SEQ ID NO: 65012 - DNA, 25 bp, Homo sapien
ccgtttctttaatggaggtgagata

SEQ ID NO: 65013 - DNA, 25 bp, Homo sapien
aaggggaatgttcgggctcagattt

SEQ ID NO: 65014 - DNA, 25 bp, Homo sapien
cttaatttcgcttctgttctcagga

SEQ ID NO: 65015 - DNA, 25 bp, Homo sapien
ttctcaggattgtgacagtgcctgc

SEQ ID NO: 65016 - DNA, 25 bp, Homo sapien
aagagtgtttccagtcgccagcctg

SEQ ID NO: 65017 - DNA, 25 bp, Homo sapien
cgtggcgttttgagacgtcattttg

SEQ ID NO: 65018 - DNA, 25 bp, Homo sapien
ctcaacctcgcggaacatctcattg

SEQ ID NO: 65019 - DNA, 25 bp, Homo sapien
cgcaatttgtgctgcgtgtcctcca

SEQ ID NO: 65020 - DNA, 25 bp, Homo sapien
acatctcattgagggtggcctcctc

SEQ ID NO: 65021 - DNA, 25 bp, Homo sapien
ctgtgtgtcccggaacgcgatcaga

SEQ ID NO: 65022 - DNA, 25 bp, Homo sapien
tcctcgagcacaagctgagctctgc

SEQ ID NO: 65023 - DNA, 25 bp, Homo sapien
cgaacccggatcctctacgctaata

SEQ ID NO: 65024 - DNA, 25 bp, Homo sapien
tcctcgaccaggtcagagtgcccga

SEQ ID NO: 65025 - DNA, 25 bp, Homo sapien
tccaccaagagaggctgagctcagc

SEQ ID NO: 65026 - DNA, 25 bp, Homo sapien
aaccctgaaggtctgctccgagtcg

SEQ ID NO: 65027 - DNA, 25 bp, Homo sapien
gatgcggctcacctgacattcggca

SEQ ID NO: 65028 - DNA, 25 bp, Homo sapien
cggcaccaacccttgccaggaagga

SEQ ID NO: 65029 - DNA, 25 bp, Homo sapien
gccactgcagctggcttggtcgtca

SEQ ID NO: 65030 - DNA, 25 bp, Homo sapien
cgaacctgttgcgtagcctgtcaca

SEQ ID NO: 65031 - DNA, 25 bp, Homo sapien
tccggggcattgaaccctgaaggtc

SEQ ID NO: 65032 - DNA, 25 bp, Homo sapien
ctactttgacgcaccgggatgcggc

SEQ ID NO: 65033 - DNA, 25 bp, Homo sapien
gtcctctcgtgactcgggctacttt

SEQ ID NO: 65034 - DNA, 25 bp, Homo sapien
gagcggctgaaatgcctgttcttca

SEQ ID NO: 65035 - DNA, 25 bp, Homo sapien
aatcgctgcagcagcgacttctctc

SEQ ID NO: 65036 - DNA, 25 bp, Homo sapien
gtctgacgcgatttgctgagctctg

SEQ ID NO: 65037 - DNA, 25 bp, Homo sapien
atttgctgagctctgtcctccgacg

SEQ ID NO: 65038 - DNA, 25 bp, Homo sapien
gcctcccggtgggtgcagctgtcac

SEQ ID NO: 65039 - DNA, 25 bp, Homo sapien
gcctcttttccagttgccctagtta

SEQ ID NO: 65040 - DNA, 25 bp, Homo sapien
ccagttgccctagttagcgcggaga

SEQ ID NO: 65041 - DNA, 25 bp, Homo sapien
ggagcctgcgtcaggttccctctgc

SEQ ID NO: 65042 - DNA, 25 bp, Homo sapien
ggagcttgtgatagatcctttcgta

SEQ ID NO: 65043 - DNA, 25 bp, Homo sapien
acctcgaggaccactttgcgcatgc

SEQ ID NO: 65044 - DNA, 25 bp, Homo sapien
caccaagtattgtaccaggacctgc

SEQ ID NO: 65045 - DNA, 25 bp, Homo sapien
tgagcgccgccatgcttttgtacgg

SEQ ID NO: 65046 - DNA, 25 bp, Homo sapien
ttgtacggcaggatcgcaaagcacg

SEQ ID NO: 65047 - DNA, 25 bp, Homo sapien
gaattctcgcttctggcctgggtga

SEQ ID NO: 65048 - DNA, 25 bp, Homo sapien
tggcgggctgaacggccttcttaaa

SEQ ID NO: 65049 - DNA, 25 bp, Homo sapien
ggatcctagccgtgacatttgtgtc

SEQ ID NO: 65050 - DNA, 25 bp, Homo sapien
ctcaggtttggggaccgctccgccg

SEQ ID NO: 65051 - DNA, 25 bp, Homo sapien
tctaggaggatggaagcccgggacg

SEQ ID NO: 65052 - DNA, 25 bp, Homo sapien
cccggtctaggaggatggaagcccg

SEQ ID NO: 65053 - DNA, 25 bp, Homo sapien
gaatccaccccttccagcgaggagg

SEQ ID NO: 65054 - DNA, 25 bp, Homo sapien
gctcggcgtgctgcacagctattcc

SEQ ID NO: 65055 - DNA, 25 bp, Homo sapien
gctgggagatccgtgggcgccggcc

SEQ ID NO: 65056 - DNA, 25 bp, Homo sapien
gcacgtggggcctaagtatccccgc

SEQ ID NO: 65057 - DNA, 25 bp, Homo sapien
cgatctcccgccgtcaggcccggga

SEQ ID NO: 65058 - DNA, 25 bp, Homo sapien
ttctgcgctctcaaggaggactgta

SEQ ID NO: 65059 - DNA, 25 bp, Homo sapien
gggtccattgtgctcccagagtttc

SEQ ID NO: 65060 - DNA, 25 bp, Homo sapien
gcctgcggctcctctgtcattataa

SEQ ID NO: 65061 - DNA, 25 bp, Homo sapien
ccgtgcatacagtcggtgccacata

SEQ ID NO: 65062 - DNA, 25 bp, Homo sapien
tccctggggcaaagcctgacttcca

SEQ ID NO: 65063 - DNA, 25 bp, Homo sapien
ccctgagaactgaagaaaccctggt

SEQ ID NO: 65064 - DNA, 25 bp, Homo sapien
ttgcttgaggcaacacggtcatcca

SEQ ID NO: 65065 - DNA, 25 bp, Homo sapien
agtccagctgtcaccttgtctccaa

SEQ ID NO: 65066 - DNA, 25 bp, Homo sapien
tcaggcctcctcgtccaatggcgga

SEQ ID NO: 65067 - DNA, 25 bp, Homo sapien
gttacgctctctcgtgacgggaatg

SEQ ID NO: 65068 - DNA, 25 bp, Homo sapien
tcatggggacccaggccttcttact

SEQ ID NO: 65069 - DNA, 25 bp, Homo sapien
gcgttgcccatggagatgactttga

SEQ ID NO: 65070 - DNA, 25 bp, Homo sapien
cgcgactgcagttaccgagtttcta

SEQ ID NO: 65071 - DNA, 25 bp, Homo sapien
tttacccttcgaggtgagcgcgtcc

SEQ ID NO: 65072 - DNA, 25 bp, Homo sapien
aggcgtttgttgctttcgcagccga

SEQ ID NO: 65073 - DNA, 25 bp, Homo sapien
cccagacaccatctccggaagagtg

SEQ ID NO: 65074 - DNA, 25 bp, Homo sapien
acagcctcggaaaaggcgcatctcc

SEQ ID NO: 65075 - DNA, 25 bp, Homo sapien
agccagtggccgagtctcgtctcgc

SEQ ID NO: 65076 - DNA, 25 bp, Homo sapien
agcggtttgtgcctgggagttttct

SEQ ID NO: 65077 - DNA, 25 bp, Homo sapien
gcagcatttgcggaattaacaaaag

SEQ ID NO: 65078 - DNA, 25 bp, Homo sapien
gaggagcattagtattagcatagcc

SEQ ID NO: 65079 - DNA, 25 bp, Homo sapien
cgcaggtgcacgctgcggcccttag

SEQ ID NO: 65080 - DNA, 25 bp, Homo sapien
agcttccgagcgctccgacaggagc

SEQ ID NO: 65081 - DNA, 25 bp, Homo sapien
tgcgctgcgaggacaaagatgcctc

SEQ ID NO: 65082 - DNA, 25 bp, Homo sapien
atcatcaaggagcacgaggagcgca

SEQ ID NO: 65083 - DNA, 25 bp, Homo sapien
gctgcggctcagcatcgactacgcg

SEQ ID NO: 65084 - DNA, 25 bp, Homo sapien
ttccaggaggccgtcatcaagaccg

SEQ ID NO: 65085 - DNA, 25 bp, Homo sapien
cgactacgcgctgaccgggagctac

SEQ ID NO: 65086 - DNA, 25 bp, Homo sapien
tttcctcgggagaagtccgccagga

SEQ ID NO: 65087 - DNA, 25 bp, Homo sapien
gaggctgccgcctcttacagagaga

SEQ ID NO: 65088 - DNA, 25 bp, Homo sapien
catcgtggaagtcttgtcggaagcc

SEQ ID NO: 65089 - DNA, 25 bp, Homo sapien
ctggagatgttcaacacgctgctga

SEQ ID NO: 65090 - DNA, 25 bp, Homo sapien
gcgtctggctcttctcggaggtcat

SEQ ID NO: 65091 - DNA, 25 bp, Homo sapien
gaaaccgccgtagcgcttgtccttg

SEQ ID NO: 65092 - DNA, 25 bp, Homo sapien
cggaagtgctccatcctgtaggggc

SEQ ID NO: 65093 - DNA, 25 bp, Homo sapien
agtcagctccctcttgaactccagg

SEQ ID NO: 65094 - DNA, 25 bp, Homo sapien
gcgccgttagggtacaccttcactg

SEQ ID NO: 65095 - DNA, 25 bp, Homo sapien
tttttgaacagcgtcaccaggggcg

SEQ ID NO: 65096 - DNA, 25 bp, Homo sapien
catttcccgggaacatgggagtctc

SEQ ID NO: 65097 - DNA, 25 bp, Homo sapien
aagtggcccatgacgtacttccggg

SEQ ID NO: 65098 - DNA, 25 bp, Homo sapien
ggactttgaccttcccggcagcaca

SEQ ID NO: 65099 - DNA, 25 bp, Homo sapien
agctcagctactggcggcttctcat

SEQ ID NO: 65100 - DNA, 25 bp, Homo sapien
atatacttgccgagctctcctggtg

SEQ ID NO: 65101 - DNA, 25 bp, Homo sapien
ttagcactgtcctgccgaaggcgca

SEQ ID NO: 65102 - DNA, 25 bp, Homo sapien
gccgctcgccctcaggaagaactta

SEQ ID NO: 65103 - DNA, 25 bp, Homo sapien
cctggttcgcatttggcggtaaata

SEQ ID NO: 65104 - DNA, 25 bp, Homo sapien
ggcggtaaatatcaccgtctgcaca

SEQ ID NO: 65105 - DNA, 25 bp, Homo sapien
gcagtcggcgcagaaagtttgtcga

SEQ ID NO: 65106 - DNA, 25 bp, Homo sapien
acaggaagttaagttgggccaaatg

SEQ ID NO: 65107 - DNA, 25 bp, Homo sapien
ggctccgtgctgtcctgtcattggc

SEQ ID NO: 65108 - DNA, 25 bp, Homo sapien
gtgctgcctgtcacctggcagaaga

SEQ ID NO: 65109 - DNA, 25 bp, Homo sapien
acttcccaggattggggctccgagc

SEQ ID NO: 65110 - DNA, 25 bp, Homo sapien
agaacgcaataaaagcctcccaccg

SEQ ID NO: 65111 - DNA, 25 bp, Homo sapien
caagcctagaaaatcgcaagcgcca

SEQ ID NO: 65112 - DNA, 25 bp, Homo sapien
cagcccgcgcgactttcggtaaggc

SEQ ID NO: 65113 - DNA, 25 bp, Homo sapien
ctggccggcctctgaaccaattaga

SEQ ID NO: 65114 - DNA, 25 bp, Homo sapien
ctgctctgttttcaagaaagccgcg

SEQ ID NO: 65115 - DNA, 25 bp, Homo sapien
cagcaagatggcgaggccgcgcctt

SEQ ID NO: 65116 - DNA, 25 bp, Homo sapien
agaaggtagccggcgccaccgagtc

SEQ ID NO: 65117 - DNA, 25 bp, Homo sapien
tctgttttcaagaaagccgcgcgcc

SEQ ID NO: 65118 - DNA, 25 bp, Homo sapien
tgcagctccagagcgcctgcagggt

SEQ ID NO: 65119 - DNA, 25 bp, Homo sapien
gccgaatccggtgccttctagaaat

SEQ ID NO: 65120 - DNA, 25 bp, Homo sapien
gcattaggccgaatccggtgccttc

SEQ ID NO: 65121 - DNA, 25 bp, Homo sapien
cacgggcggcaatcgcccgcgagcc

SEQ ID NO: 65122 - DNA, 25 bp, Homo sapien
ttcaggacccgcacccagctacgct

SEQ ID NO: 65123 - DNA, 25 bp, Homo sapien
tcgaccgcgcgcagcttgcaggcag

SEQ ID NO: 65124 - DNA, 25 bp, Homo sapien
gaggcatttatcctaaaaaacgaca

SEQ ID NO: 65125 - DNA, 25 bp, Homo sapien
tacgcccgaggcatttatcctaaaa

SEQ ID NO: 65126 - DNA, 25 bp, Homo sapien
cgctcagcctttctggggcaaattt

SEQ ID NO: 65127 - DNA, 25 bp, Homo sapien
ttctggggcaaatttagtaatatgg

SEQ ID NO: 65128 - DNA, 25 bp, Homo sapien
agtaatatgggacccgagccctcga

SEQ ID NO: 65129 - DNA, 25 bp, Homo sapien
cgacccgaaatacgcccgaggcatt

SEQ ID NO: 65130 - DNA, 25 bp, Homo sapien
cgtcatcgcctgctttggtggcatt

SEQ ID NO: 65131 - DNA, 25 bp, Homo sapien
tcgcctgctttggtggcattcttgt

SEQ ID NO: 65132 - DNA, 25 bp, Homo sapien
tggcattcttgtccccagcatcgga

SEQ ID NO: 65133 - DNA, 25 bp, Homo sapien
actctggctcgtcatcgcctgcttt

SEQ ID NO: 65134 - DNA, 25 bp, Homo sapien
tcgtactctggctcgtcatcgcctg

SEQ ID NO: 65135 - DNA, 25 bp, Homo sapien
acggctggtgaagaagccgctcacc

SEQ ID NO: 65136 - DNA, 25 bp, Homo sapien
ccacggctggtgaagaagccgctca

SEQ ID NO: 65137 - DNA, 25 bp, Homo sapien
ctggctcgtcatcgcctgctttggt

SEQ ID NO: 65138 - DNA, 25 bp, Homo sapien
ctgcagtcgcgctcaggtgtgagcc

SEQ ID NO: 65139 - DNA, 25 bp, Homo sapien
gtccaggaacctacccataaggcca

SEQ ID NO: 65140 - DNA, 25 bp, Homo sapien
cactcttttcaaacccggagggctg

SEQ ID NO: 65141 - DNA, 25 bp, Homo sapien
gaacctacccataaggccaggtgca

SEQ ID NO: 65142 - DNA, 25 bp, Homo sapien
gcggccctgaagctctggaagtagc

SEQ ID NO: 65143 - DNA, 25 bp, Homo sapien
tctggaagtagctgcccgtcttggg

SEQ ID NO: 65144 - DNA, 25 bp, Homo sapien
gcgggccagcactaagtcagcatct

SEQ ID NO: 65145 - DNA, 25 bp, Homo sapien
gccggggaggcatacttcactcttt

SEQ ID NO: 65146 - DNA, 25 bp, Homo sapien
agcgctccagatcggggattgtttg

SEQ ID NO: 65147 - DNA, 25 bp, Homo sapien
tcctgtttgcaaggttggtcgcggc

SEQ ID NO: 65148 - DNA, 25 bp, Homo sapien
ttttcctgtttgcaaggttggtcgc

SEQ ID NO: 65149 - DNA, 25 bp, Homo sapien
tccctggatttctcattttcctgtt

SEQ ID NO: 65150 - DNA, 25 bp, Homo sapien
ctgcgtcactctgggccttccctgg

SEQ ID NO: 65151 - DNA, 25 bp, Homo sapien
cgcctccacactacaggtgaataga

SEQ ID NO: 65152 - DNA, 25 bp, Homo sapien
cgcaggcattgggagcgctccagat

SEQ ID NO: 65153 - DNA, 25 bp, Homo sapien
cactacaggtgaatagagaagcggg

SEQ ID NO: 65154 - DNA, 25 bp, Homo sapien
agccgaacgggcctcggactgaccg

SEQ ID NO: 65155 - DNA, 25 bp, Homo sapien
cagggaagaattaggagcacgcaca

SEQ ID NO: 65156 - DNA, 25 bp, Homo sapien
agcacgcacaaagcggggacgctcg

SEQ ID NO: 65157 - DNA, 25 bp, Homo sapien
catgtgggtgctttacagacgaggc

SEQ ID NO: 65158 - DNA, 25 bp, Homo sapien
gggcctcggactgaccgctccagat

SEQ ID NO: 65159 - DNA, 25 bp, Homo sapien
cgcccacgacgccacgccaaaagta

SEQ ID NO: 65160 - DNA, 25 bp, Homo sapien
atcccagcatgtgggtgctttacag

SEQ ID NO: 65161 - DNA, 25 bp, Homo sapien
tgttacccagggaagaattaggagc

SEQ ID NO: 65162 - DNA, 25 bp, Homo sapien
tgaaaaacaccagcatctacagatc

SEQ ID NO: 65163 - DNA, 25 bp, Homo sapien
ggacagccacggctcctctgctggg

SEQ ID NO: 65164 - DNA, 25 bp, Homo sapien
cgcgtattaaacacacagaacgctg

SEQ ID NO: 65165 - DNA, 25 bp, Homo sapien
gggcaccgaagttcacacgggaaga

SEQ ID NO: 65166 - DNA, 25 bp, Homo sapien
aacgctgacacaggcgcacgggaca

SEQ ID NO: 65167 - DNA, 25 bp, Homo sapien
tacagatcccacagagaccttgacg

SEQ ID NO: 65168 - DNA, 25 bp, Homo sapien
ccggggcagctcttgaaaaacacca

SEQ ID NO: 65169 - DNA, 25 bp, Homo sapien
ttgacgcccacgttgccctgaggtt

SEQ ID NO: 65170 - DNA, 25 bp, Homo sapien
tgaccggccttttaagggctgtctc

SEQ ID NO: 65171 - DNA, 25 bp, Homo sapien
tcctggactggttttgggctgaccc

SEQ ID NO: 65172 - DNA, 25 bp, Homo sapien
cctgctcgcgatcaggtggcggcct

SEQ ID NO: 65173 - DNA, 25 bp, Homo sapien
actcgccagcgctttgttcgtgacc

SEQ ID NO: 65174 - DNA, 25 bp, Homo sapien
cagacctcgttgctctgcccggtga

SEQ ID NO: 65175 - DNA, 25 bp, Homo sapien
acagcgctgtcctccgtggttctgt

SEQ ID NO: 65176 - DNA, 25 bp, Homo sapien
agggctgtctcacccatcttgtctg

SEQ ID NO: 65177 - DNA, 25 bp, Homo sapien
tggtgacagcgactcccgctagcta

SEQ ID NO: 65178 - DNA, 25 bp, Homo sapien
tttcaaggacacgtctgcaccggcc

SEQ ID NO: 65179 - DNA, 25 bp, Homo sapien
ctgcggctccgaagctcgaggtctc

SEQ ID NO: 65180 - DNA, 25 bp, Homo sapien
ctccgaagctcgaggtctcccgggg

SEQ ID NO: 65181 - DNA, 25 bp, Homo sapien
cgaggcctcgtccttcactgtgcag

SEQ ID NO: 65182 - DNA, 25 bp, Homo sapien
ttcactgtgcagatgcgaagctttc

SEQ ID NO: 65183 - DNA, 25 bp, Homo sapien
tgcagatgcgaagctttcaaggaca

SEQ ID NO: 65184 - DNA, 25 bp, Homo sapien
tgcgaagctttcaaggacacgtctg

SEQ ID NO: 65185 - DNA, 25 bp, Homo sapien
cgaagctttcaaggacacgtctgca

SEQ ID NO: 65186 - DNA, 25 bp, Homo sapien
tggcgctgcttctgcgctgggtccc

SEQ ID NO: 65187 - DNA, 25 bp, Homo sapien
actctgctctacagggccaaggtcg

SEQ ID NO: 65188 - DNA, 25 bp, Homo sapien
cctcgagtcgtagccgagctccggg

SEQ ID NO: 65189 - DNA, 25 bp, Homo sapien
tgccgccgcggagtagaggccactc

SEQ ID NO: 65190 - DNA, 25 bp, Homo sapien
tgcagttctcccgacctccgccaga

SEQ ID NO: 65191 - DNA, 25 bp, Homo sapien
tagaggccactctgctctacagggc

SEQ ID NO: 65192 - DNA, 25 bp, Homo sapien
agtcgtagccgagctccgggcctcg

SEQ ID NO: 65193 - DNA, 25 bp, Homo sapien
agcgctggcccaaccgcgccgcaac

SEQ ID NO: 65194 - DNA, 25 bp, Homo sapien
ctggacctgctgacgtcctctggca

SEQ ID NO: 65195 - DNA, 25 bp, Homo sapien
catttcccaagtttccgctgcagct

SEQ ID NO: 65196 - DNA, 25 bp, Homo sapien
agcccgcagacagtgcgatccagta

SEQ ID NO: 65197 - DNA, 25 bp, Homo sapien
tgattccttcttggggaaactcgga

SEQ ID NO: 65198 - DNA, 25 bp, Homo sapien
tccgtttggaaagccgcagcctcag

SEQ ID NO: 65199 - DNA, 25 bp, Homo sapien
cttggaataattccgcttccgtttg

SEQ ID NO: 65200 - DNA, 25 bp, Homo sapien
tcgctcttactcgttgccttcattg

SEQ ID NO: 65201 - DNA, 25 bp, Homo sapien
gcgtgagctgcctcaaatgcttgga

SEQ ID NO: 65202 - DNA, 25 bp, Homo sapien
gaacgggacttgatcacgtgtgccc

SEQ ID NO: 65203 - DNA, 25 bp, Homo sapien
aacgggacttgatcacgtgtgcccg

SEQ ID NO: 65204 - DNA, 25 bp, Homo sapien
acgggacttgatcacgtgtgcccga

SEQ ID NO: 65205 - DNA, 25 bp, Homo sapien
gggacttgatcacgtgtgcccgagc

SEQ ID NO: 65206 - DNA, 25 bp, Homo sapien
gagcccaatcgacccctaaggcgag

SEQ ID NO: 65207 - DNA, 25 bp, Homo sapien
aatcgacccctaaggcgagaggctg

SEQ ID NO: 65208 - DNA, 25 bp, Homo sapien
gcggcggcatcacacggggcgggcg

SEQ ID NO: 65209 - DNA, 25 bp, Homo sapien
ggaacgggacttgatcacgtgtgcc

SEQ ID NO: 65210 - DNA, 25 bp, Homo sapien
cgggaagctggctccatccaggctt

SEQ ID NO: 65211 - DNA, 25 bp, Homo sapien
gccatgtacacaaccaagtccgatg

SEQ ID NO: 65212 - DNA, 25 bp, Homo sapien
gggtcacaagcctgtgcccgagtga

SEQ ID NO: 65213 - DNA, 25 bp, Homo sapien
gtgaatcattctccgcgcctgggtc

SEQ ID NO: 65214 - DNA, 25 bp, Homo sapien
ccgacaaagaatgcaaagagccacc

SEQ ID NO: 65215 - DNA, 25 bp, Homo sapien
gcccgacgtgactacccgacaaaga

SEQ ID NO: 65216 - DNA, 25 bp, Homo sapien
caagtccgatgacccgtgcagagcc

SEQ ID NO: 65217 - DNA, 25 bp, Homo sapien
gggtgtctttccatccgcaggtatc

SEQ ID NO: 65218 - DNA, 25 bp, Homo sapien
gggtaaattctatccagctccagcg

SEQ ID NO: 65219 - DNA, 25 bp, Homo sapien
agccttctcctatctgcatccaatg

SEQ ID NO: 65220 - DNA, 25 bp, Homo sapien
ccctcatgtcgggtcttgaactgac

SEQ ID NO: 65221 - DNA, 25 bp, Homo sapien
catattgggttcttactgtacaggc

SEQ ID NO: 65222 - DNA, 25 bp, Homo sapien
acaggctgccgctacggtcatgtga

SEQ ID NO: 65223 - DNA, 25 bp, Homo sapien
cccggcagtagctgtagtctgacgc

SEQ ID NO: 65224 - DNA, 25 bp, Homo sapien
ctggcgctcacacctacagcgaata

SEQ ID NO: 65225 - DNA, 25 bp, Homo sapien
gctggatgcacgcacaagccttctc

SEQ ID NO: 65226 - DNA, 25 bp, Homo sapien
gatcattcattgcagccagcgcggc

SEQ ID NO: 65227 - DNA, 25 bp, Homo sapien
tggccatcttgctgctctgaccttc

SEQ ID NO: 65228 - DNA, 25 bp, Homo sapien
ctatcctgctcgctaggtcgggatc

SEQ ID NO: 65229 - DNA, 25 bp, Homo sapien
aatccgcatgcagcctcctagggtg

SEQ ID NO: 65230 - DNA, 25 bp, Homo sapien
ttcctctagggatccatagcgtggg

SEQ ID NO: 65231 - DNA, 25 bp, Homo sapien
tggcccagtttcacgtccatggtca

SEQ ID NO: 65232 - DNA, 25 bp, Homo sapien
cgtccatggtcaggatctgctcgtg

SEQ ID NO: 65233 - DNA, 25 bp, Homo sapien
ggcgcagctcttcaatccgcatgca

SEQ ID NO: 65234 - DNA, 25 bp, Homo sapien
ttcctggggctatgtaactgagctc

SEQ ID NO: 65235 - DNA, 25 bp, Homo sapien
gcgcggctttttctcgcgtttacga

SEQ ID NO: 65236 - DNA, 25 bp, Homo sapien
aggagcattccactcgccacttcgg

SEQ ID NO: 65237 - DNA, 25 bp, Homo sapien
gagctcgtcgacttaggggtccttc

SEQ ID NO: 65238 - DNA, 25 bp, Homo sapien
gaggccattttgtcccgaccgactc

SEQ ID NO: 65239 - DNA, 25 bp, Homo sapien
ctgtcggggcttcctcaaagctgtt

SEQ ID NO: 65240 - DNA, 25 bp, Homo sapien
tcaaagctgttcgtaggtcgcccgc

SEQ ID NO: 65241 - DNA, 25 bp, Homo sapien
gctccacctacacgggaacacatgg

SEQ ID NO: 65242 - DNA, 25 bp, Homo sapien
tgccgctcgggacttcgttgtccct

SEQ ID NO: 65243 - DNA, 25 bp, Homo sapien
cggacacacccagccagaaggagga

SEQ ID NO: 65244 - DNA, 25 bp, Homo sapien
ccggacacacccagccagaaggagg

SEQ ID NO: 65245 - DNA, 25 bp, Homo sapien
cgctcgggacttcgttgtccctcca

SEQ ID NO: 65246 - DNA, 25 bp, Homo sapien
atgccgctcgggacttcgttgtccc

SEQ ID NO: 65247 - DNA, 25 bp, Homo sapien
cgcagatgccgctcgggacttcgtt

SEQ ID NO: 65248 - DNA, 25 bp, Homo sapien
gactccgcagatgccgctcgggact

SEQ ID NO: 65249 - DNA, 25 bp, Homo sapien
tggggtcctccatcacccgccgtca

SEQ ID NO: 65250 - DNA, 25 bp, Homo sapien
ggacagagttttcccgcccagctgg

SEQ ID NO: 65251 - DNA, 25 bp, Homo sapien
atgaatgctaatggggcccgcggcc

SEQ ID NO: 65252 - DNA, 25 bp, Homo sapien
ggcacactcgcttccatgaatgcta

SEQ ID NO: 65253 - DNA, 25 bp, Homo sapien
tttggcccgcgttggcacactcgct

SEQ ID NO: 65254 - DNA, 25 bp, Homo sapien
tgtcccacttcttaataggacctgg

SEQ ID NO: 65255 - DNA, 25 bp, Homo sapien
cccgaatcttgtcccacttcttaat

SEQ ID NO: 65256 - DNA, 25 bp, Homo sapien
atccctgggacccggactctgtctt

SEQ ID NO: 65257 - DNA, 25 bp, Homo sapien
ttcccgcccagctggagtccggaaa

SEQ ID NO: 65258 - DNA, 25 bp, Homo sapien
aggcgcgtccacagcagcctcgtgt

SEQ ID NO: 65259 - DNA, 25 bp, Homo sapien
cggctctgtcagctccagggacaca

SEQ ID NO: 65260 - DNA, 25 bp, Homo sapien
aacagggtgaatccgcagagtcctc

SEQ ID NO: 65261 - DNA, 25 bp, Homo sapien
ctcgtgtctccacatgggacgtttc

SEQ ID NO: 65262 - DNA, 25 bp, Homo sapien
gactccattttgtcgctgcggagga

SEQ ID NO: 65263 - DNA, 25 bp, Homo sapien
agcagcgtggcctgatgactccatt

SEQ ID NO: 65264 - DNA, 25 bp, Homo sapien
cggcccgacttgtgaggaaacagca

SEQ ID NO: 65265 - DNA, 25 bp, Homo sapien
gaaagacgaacacgggccaccctca

SEQ ID NO: 65266 - DNA, 25 bp, Homo sapien
tgaattaataatggcgctcgggcgg

SEQ ID NO: 65267 - DNA, 25 bp, Homo sapien
ttttcgcggggctgcttctgtccgc

SEQ ID NO: 65268 - DNA, 25 bp, Homo sapien
ctgagtgcacggctgggctccacgc

SEQ ID NO: 65269 - DNA, 25 bp, Homo sapien
tgggctccacgctgatttctcctaa

SEQ ID NO: 65270 - DNA, 25 bp, Homo sapien
gctccacgctgatttctcctaatga

SEQ ID NO: 65271 - DNA, 25 bp, Homo sapien
ctgctccgggagtcagggagacctg

SEQ ID NO: 65272 - DNA, 25 bp, Homo sapien
tcctaatgaattaataatggcgctc

SEQ ID NO: 65273 - DNA, 25 bp, Homo sapien
cacgctgatttctcctaatgaatta

SEQ ID NO: 65274 - DNA, 25 bp, Homo sapien
gggctcgatctcatctccttcgggg

SEQ ID NO: 65275 - DNA, 25 bp, Homo sapien
atcatctccaagacggtggtgctgg

SEQ ID NO: 65276 - DNA, 25 bp, Homo sapien
acaagctggttagcatcatctccaa

SEQ ID NO: 65277 - DNA, 25 bp, Homo sapien
ctcccaaatccgaggcggtgagtga

SEQ ID NO: 65278 - DNA, 25 bp, Homo sapien
gagggtcattgctacaagctggtta

SEQ ID NO: 65279 - DNA, 25 bp, Homo sapien
gcgagcacacggtgcgcgccatcat

SEQ ID NO: 65280 - DNA, 25 bp, Homo sapien
ctgcagatgcaagagggcgagcaca

SEQ ID NO: 65281 - DNA, 25 bp, Homo sapien
atgtggcagacgaggtgtcttcctc

SEQ ID NO: 65282 - DNA, 25 bp, Homo sapien
aagcactttgcagactcgcttccac

SEQ ID NO: 65283 - DNA, 25 bp, Homo sapien
cgtccaggcacaggccatgcagtga

SEQ ID NO: 65284 - DNA, 25 bp, Homo sapien
gcgcgacttgccaggacgccaagtt

SEQ ID NO: 65285 - DNA, 25 bp, Homo sapien
ctcgcgggccgctctttctttgcgg

SEQ ID NO: 65286 - DNA, 25 bp, Homo sapien
gcaggccgcatgacgtcaccgaggc

SEQ ID NO: 65287 - DNA, 25 bp, Homo sapien
cctgtcctcattccgaacattctta

SEQ ID NO: 65288 - DNA, 25 bp, Homo sapien
aacattcttagcatcgctcgcgccg

SEQ ID NO: 65289 - DNA, 25 bp, Homo sapien
ggcgccgaagtttgcctcggactcg

SEQ ID NO: 65290 - DNA, 25 bp, Homo sapien
cgagtggcaccagactcagaaagtt

SEQ ID NO: 65291 - DNA, 25 bp, Homo sapien
gacttttctcccgtagcctggcagc

SEQ ID NO: 65292 - DNA, 25 bp, Homo sapien
aaagcggctgaggatgccaatcgcc

SEQ ID NO: 65293 - DNA, 25 bp, Homo sapien
ccggcaggccaccatcttgagctga

SEQ ID NO: 65294 - DNA, 25 bp, Homo sapien
acagcagtggagagcgcctctaacg

SEQ ID NO: 65295 - DNA, 25 bp, Homo sapien
gagcactgcctgactaaaacccaga

SEQ ID NO: 65296 - DNA, 25 bp, Homo sapien
cccgcggaaaggtgacagaacgagt

SEQ ID NO: 65297 - DNA, 25 bp, Homo sapien
ctaacatggccgaaaggtcgtattc

SEQ ID NO: 65298 - DNA, 25 bp, Homo sapien
atgggtttgcccgatttctgctgta

SEQ ID NO: 65299 - DNA, 25 bp, Homo sapien
accctggtctgcgtagaagtgtgtg

SEQ ID NO: 65300 - DNA, 25 bp, Homo sapien
ccaggtcggcggctatagagattgt

SEQ ID NO: 65301 - DNA, 25 bp, Homo sapien
tatagagattgtggacggcgccatg

SEQ ID NO: 65302 - DNA, 25 bp, Homo sapien
ctgctgtaaagaataagactaggtc

SEQ ID NO: 65303 - DNA, 25 bp, Homo sapien
atccggctccgttatccagataatc

SEQ ID NO: 65304 - DNA, 25 bp, Homo sapien
atccagataatcctgcgctctcggg

SEQ ID NO: 65305 - DNA, 25 bp, Homo sapien
tcggccttaatgtaaccctggtctg

SEQ ID NO: 65306 - DNA, 25 bp, Homo sapien
tactaaatttctacggcacgcagcg

SEQ ID NO: 65307 - DNA, 25 bp, Homo sapien
gtcatggctggctacgaatacgtga

SEQ ID NO: 65308 - DNA, 25 bp, Homo sapien
cagctggctggctttgataagtaca

SEQ ID NO: 65309 - DNA, 25 bp, Homo sapien
agcccgctgggaaattgacctttca

SEQ ID NO: 65310 - DNA, 25 bp, Homo sapien
cgcaagtgcggataccacagaaatc

SEQ ID NO: 65311 - DNA, 25 bp, Homo sapien
tgaggcactgctgaactggttcgca

SEQ ID NO: 65312 - DNA, 25 bp, Homo sapien
tgttgcctgatccacgccgattgga

SEQ ID NO: 65313 - DNA, 25 bp, Homo sapien
tcgctgcagcgggagaactaagtcc

SEQ ID NO: 65314 - DNA, 25 bp, Homo sapien
ttcgtgggcctgacaacagacctga

SEQ ID NO: 65315 - DNA, 25 bp, Homo sapien
gacaactctcaggagcgcatccagg

SEQ ID NO: 65316 - DNA, 25 bp, Homo sapien
gacgagcacttgtccacccagattc

SEQ ID NO: 65317 - DNA, 25 bp, Homo sapien
tggacccgaacgtggacgagcactt

SEQ ID NO: 65318 - DNA, 25 bp, Homo sapien
gactcctgccatgaatccgccgggg

SEQ ID NO: 65319 - DNA, 25 bp, Homo sapien
tttgttcctagcaaccagcctgagg

SEQ ID NO: 65320 - DNA, 25 bp, Homo sapien
acagacctgacatcccacgggcggg

SEQ ID NO: 65321 - DNA, 25 bp, Homo sapien
tctccctggcaacggtttgttccta

SEQ ID NO: 65322 - DNA, 25 bp, Homo sapien
acagcgtttcttgatggatattctc

SEQ ID NO: 65323 - DNA, 25 bp, Homo sapien
tagggagttggccaaacagcgtttc

SEQ ID NO: 65324 - DNA, 25 bp, Homo sapien
ttcctagagggccacgcatcactgg

SEQ ID NO: 65325 - DNA, 25 bp, Homo sapien
gcggcacctgtcctacctggtcttt

SEQ ID NO: 65326 - DNA, 25 bp, Homo sapien
tgctctaattaaaacactgggcttc

SEQ ID NO: 65327 - DNA, 25 bp, Homo sapien
ctcctccttgtgagaccggtttttg

SEQ ID NO: 65328 - DNA, 25 bp, Homo sapien
ttgccgagcttcatggcggagaaca

SEQ ID NO: 65329 - DNA, 25 bp, Homo sapien
ggccctagggcgtctccttcctaga

SEQ ID NO: 65330 - DNA, 25 bp, Homo sapien
ttccaagccgggtcaccgcaagacg

SEQ ID NO: 65331 - DNA, 25 bp, Homo sapien
caagccgggtcaccgcaagacggat

SEQ ID NO: 65332 - DNA, 25 bp, Homo sapien
gccaggcctctccagcgatgttctg

SEQ ID NO: 65333 - DNA, 25 bp, Homo sapien
tctgagcctctgcacatcccgcagg

SEQ ID NO: 65334 - DNA, 25 bp, Homo sapien
gtcacccagcagagctcgcggaaat

SEQ ID NO: 65335 - DNA, 25 bp, Homo sapien
cccagcagagctcgcggaaatggga

SEQ ID NO: 65336 - DNA, 25 bp, Homo sapien
cgcagtgtctcggaacgcgaggacc

SEQ ID NO: 65337 - DNA, 25 bp, Homo sapien
atcccgcaggcagcaaggcagagag

SEQ ID NO: 65338 - DNA, 25 bp, Homo sapien
agccgtagttaatgggtcatgtgtg

SEQ ID NO: 65339 - DNA, 25 bp, Homo sapien
aggtcagtacttgttggttgaagga

SEQ ID NO: 65340 - DNA, 25 bp, Homo sapien
ccagcattcgggcaaggtcagtact

SEQ ID NO: 65341 - DNA, 25 bp, Homo sapien
cagcctccagcgcttagagaaaatg

SEQ ID NO: 65342 - DNA, 25 bp, Homo sapien
gcaaggccggaagagccgtagttaa

SEQ ID NO: 65343 - DNA, 25 bp, Homo sapien
tgcccgctcgaagaacctggcaagg

SEQ ID NO: 65344 - DNA, 25 bp, Homo sapien
tgcgagaaaatcaggcccttccgtc

SEQ ID NO: 65345 - DNA, 25 bp, Homo sapien
ggtcatgtgtgcagtacccgcccga

SEQ ID NO: 65346 - DNA, 25 bp, Homo sapien
ggccaccctataacggcggctgtga

SEQ ID NO: 65347 - DNA, 25 bp, Homo sapien
atgaggatgtcggaatgcggcactt

SEQ ID NO: 65348 - DNA, 25 bp, Homo sapien
ccagtgctccgtatccctgaggatc

SEQ ID NO: 65349 - DNA, 25 bp, Homo sapien
agaaacccgagttcagcctggcgtg

SEQ ID NO: 65350 - DNA, 25 bp, Homo sapien
gtgctgcgcctcaagccgcacaagg

SEQ ID NO: 65351 - DNA, 25 bp, Homo sapien
gggcgcgctacaacctcagccaggg

SEQ ID NO: 65352 - DNA, 25 bp, Homo sapien
tggcgctcatcgtgtgcaccttcac

SEQ ID NO: 65353 - DNA, 25 bp, Homo sapien
atgaagcggcagaacgtgcgcacgc

SEQ ID NO: 65354 - DNA, 25 bp, Homo sapien
gacgcttttcagagacaagtcttgg

SEQ ID NO: 65355 - DNA, 25 bp, Homo sapien
gtgctgcagacgcttttcagagaca

SEQ ID NO: 65356 - DNA, 25 bp, Homo sapien
ccacgcgtgctgcagacgcttttca

SEQ ID NO: 65357 - DNA, 25 bp, Homo sapien
cggcggttcccacgcgtgctgcaga

SEQ ID NO: 65358 - DNA, 25 bp, Homo sapien
tctttgtgctggacggaggcaatgc

SEQ ID NO: 65359 - DNA, 25 bp, Homo sapien
ctggacggaggcaatgctgctaatg

SEQ ID NO: 65360 - DNA, 25 bp, Homo sapien
taatgggaggcggagcccacctgct

SEQ ID NO: 65361 - DNA, 25 bp, Homo sapien
gacaagtcttggtctttgtgctgga

SEQ ID NO: 65362 - DNA, 25 bp, Homo sapien
ccatgtgctcgtgcctgtggtacaa

SEQ ID NO: 65363 - DNA, 25 bp, Homo sapien
cgctcacgctcgtcatgttccagag

SEQ ID NO: 65364 - DNA, 25 bp, Homo sapien
ggcgagcgcatcaacaccttggtga

SEQ ID NO: 65365 - DNA, 25 bp, Homo sapien
cgccgacgtgtccatggccaacatg

SEQ ID NO: 65366 - DNA, 25 bp, Homo sapien
tcatcggcttcttctcgtgcatcag

SEQ ID NO: 65367 - DNA, 25 bp, Homo sapien
ttcatgaccatgaacgccgaggacg

SEQ ID NO: 65368 - DNA, 25 bp, Homo sapien
ctcatgaagcgcaggagctccgtgt

SEQ ID NO: 65369 - DNA, 25 bp, Homo sapien
gtctacatccttacgggcctcacgg

SEQ ID NO: 65370 - DNA, 25 bp, Homo sapien
tcactacgaggccaaggtgcacctg

SEQ ID NO: 65371 - DNA, 25 bp, Homo sapien
tggaccgcgagatcgatcactacga

SEQ ID NO: 65372 - DNA, 25 bp, Homo sapien
gttgcgccatggatccttcggaaaa

SEQ ID NO: 65373 - DNA, 25 bp, Homo sapien
accacttgctccgacgttgtgcgag

SEQ ID NO: 65374 - DNA, 25 bp, Homo sapien
ggaccacacaattcgccagcaggtg

SEQ ID NO: 65375 - DNA, 25 bp, Homo sapien
gggtcaactacgtgcaggacactta

SEQ ID NO: 65376 - DNA, 25 bp, Homo sapien
agcagacaccgtcgtcctgttcgtc

SEQ ID NO: 65377 - DNA, 25 bp, Homo sapien
gcctttcgcaaactggccaagctca

SEQ ID NO: 65378 - DNA, 25 bp, Homo sapien
gcgcgttatgaccacccaagggatg

SEQ ID NO: 65379 - DNA, 25 bp, Homo sapien
ctcggcaaagtgagtctgggccctg

SEQ ID NO: 65380 - DNA, 25 bp, Homo sapien
tccatcaacacgctctcggcaaagt

SEQ ID NO: 65381 - DNA, 25 bp, Homo sapien
gggctcatgcttgttaccggctcca

SEQ ID NO: 65382 - DNA, 25 bp, Homo sapien
gtggccaccaaagcgctccaggacg

SEQ ID NO: 65383 - DNA, 25 bp, Homo sapien
gcccggcgccgctaactggagcgaa

SEQ ID NO: 65384 - DNA, 25 bp, Homo sapien
ccgacatggcctggaccaagtacca

SEQ ID NO: 65385 - DNA, 25 bp, Homo sapien
tggaccaagtaccagctgttcctgg

SEQ ID NO: 65386 - DNA, 25 bp, Homo sapien
gaccggcttagccacttggctccta

SEQ ID NO: 65387 - DNA, 25 bp, Homo sapien
tcggtgcatactctcattggcccta

SEQ ID NO: 65388 - DNA, 25 bp, Homo sapien
taaggggcgttccagagtcagccac

SEQ ID NO: 65389 - DNA, 25 bp, Homo sapien
cgccgtcttcttgttaggactagtg

SEQ ID NO: 65390 - DNA, 25 bp, Homo sapien
cgctatatttgtgtctcggtgcata

SEQ ID NO: 65391 - DNA, 25 bp, Homo sapien
caggcattgcctcccactgttcgtg

SEQ ID NO: 65392 - DNA, 25 bp, Homo sapien
tacctgcagtcgctctacgtaaggg

SEQ ID NO: 65393 - DNA, 25 bp, Homo sapien
aggactagtggttacccagcgccca

SEQ ID NO: 65394 - DNA, 25 bp, Homo sapien
cccttctgtttctgcgtgaggcgca

SEQ ID NO: 65395 - DNA, 25 bp, Homo sapien
tgcagcatcgatctcagcgggcacc

SEQ ID NO: 65396 - DNA, 25 bp, Homo sapien
ggagcccgccttgcagcatcgatct

SEQ ID NO: 65397 - DNA, 25 bp, Homo sapien
cttctcgcctccgagctgggatctg

SEQ ID NO: 65398 - DNA, 25 bp, Homo sapien
ctagcacgcagtgggccgctttcct

SEQ ID NO: 65399 - DNA, 25 bp, Homo sapien
taagcgtttaatgcgtgctcgcggg

SEQ ID NO: 65400 - DNA, 25 bp, Homo sapien
gtcctctttgtacgcccgcgaagcg

SEQ ID NO: 65401 - DNA, 25 bp, Homo sapien
gggccttgctcatagtaagcgttta

SEQ ID NO: 65402 - DNA, 25 bp, Homo sapien
agccgcctcgtgcactgtgagtccg

SEQ ID NO: 65403 - DNA, 25 bp, Homo sapien
aacgcagtgggcctgttcctgtcgc

SEQ ID NO: 65404 - DNA, 25 bp, Homo sapien
ccgccgcaatcgctaaggcaaggtg

SEQ ID NO: 65405 - DNA, 25 bp, Homo sapien
cgcacacgtctgaagcggtctcttc

SEQ ID NO: 65406 - DNA, 25 bp, Homo sapien
ccgcggctcagttgccttggagacg

SEQ ID NO: 65407 - DNA, 25 bp, Homo sapien
cggtctcttctcctcgttgctacgg

SEQ ID NO: 65408 - DNA, 25 bp, Homo sapien
gttgctacggcaacgcagtgggcct

SEQ ID NO: 65409 - DNA, 25 bp, Homo sapien
cccgcagtctctgtgcgttgaagcc

SEQ ID NO: 65410 - DNA, 25 bp, Homo sapien
cgacgctcaatgaacgttctcagaa

SEQ ID NO: 65411 - DNA, 25 bp, Homo sapien
gtggccttcacatcgacgctcaatg

SEQ ID NO: 65412 - DNA, 25 bp, Homo sapien
ttcccgatgctcttcgctcaggaga

SEQ ID NO: 65413 - DNA, 25 bp, Homo sapien
cggcccaggagagggactacaagtc

SEQ ID NO: 65414 - DNA, 25 bp, Homo sapien
ggctgcgagccatggcgaccaagac

SEQ ID NO: 65415 - DNA, 25 bp, Homo sapien
gcaaacggagtgtggaaatacgacc

SEQ ID NO: 65416 - DNA, 25 bp, Homo sapien
ggaaatacgacctgacccgtgagta

SEQ ID NO: 65417 - DNA, 25 bp, Homo sapien
gttctcagaagggaatctcctctcc

SEQ ID NO: 65418 - DNA, 25 bp, Homo sapien
aatgtcgttcgcgtcaggagagcac

SEQ ID NO: 65419 - DNA, 25 bp, Homo sapien
gcgttcgcggtccaggagaaaccac

SEQ ID NO: 65420 - DNA, 25 bp, Homo sapien
caaagtggcccatcggctctcgagc

SEQ ID NO: 65421 - DNA, 25 bp, Homo sapien
atcccaggtctaccgcaggggaatc

SEQ ID NO: 65422 - DNA, 25 bp, Homo sapien
gacgaatagagcctgacaaaacctg

SEQ ID NO: 65423 - DNA, 25 bp, Homo sapien
tctcttgcactggtcaggacgaata

SEQ ID NO: 65424 - DNA, 25 bp, Homo sapien
ggggttcggcacagcccgataatgc

SEQ ID NO: 65425 - DNA, 25 bp, Homo sapien
cctgagttaattggccgagcgaatg

SEQ ID NO: 65426 - DNA, 25 bp, Homo sapien
actcgctcaggtacccactaacgtg

SEQ ID NO: 65427 - DNA, 25 bp, Homo sapien
cggccaataggcgagagacttcttg

SEQ ID NO: 65428 - DNA, 25 bp, Homo sapien
gaggaaccctgagagctgaccaatg

SEQ ID NO: 65429 - DNA, 25 bp, Homo sapien
tccggaagacgctgctagaaccctc

SEQ ID NO: 65430 - DNA, 25 bp, Homo sapien
tatttcgcagttgagtcccagtttc

SEQ ID NO: 65431 - DNA, 25 bp, Homo sapien
gcgataaggagtttcacacgatgtc

SEQ ID NO: 65432 - DNA, 25 bp, Homo sapien
gcagtgggctacgtgtttcatttta

SEQ ID NO: 65433 - DNA, 25 bp, Homo sapien
ctgaccaatggtagcgagctttact

SEQ ID NO: 65434 - DNA, 25 bp, Homo sapien
gccactttcattcctgcttcttggg

SEQ ID NO: 65435 - DNA, 25 bp, Homo sapien
agtcagagacctggaccggaacttc

SEQ ID NO: 65436 - DNA, 25 bp, Homo sapien
accagcgaacaagcccgaagtcaga

SEQ ID NO: 65437 - DNA, 25 bp, Homo sapien
ggcgagctgcacgtccgtgatcatc

SEQ ID NO: 65438 - DNA, 25 bp, Homo sapien
agaagagcgacacgcccagcatgtt

SEQ ID NO: 65439 - DNA, 25 bp, Homo sapien
cggccacgtagtgatagagaacgac

SEQ ID NO: 65440 - DNA, 25 bp, Homo sapien
tcttgggattgttgacggccacgta

SEQ ID NO: 65441 - DNA, 25 bp, Homo sapien
gaccggaacttcgtagcgccagctc

SEQ ID NO: 65442 - DNA, 25 bp, Homo sapien
gctagatggcttccgccggcagcag

SEQ ID NO: 65443 - DNA, 25 bp, Homo sapien
cagcggttgcaggagtcctgctccg

SEQ ID NO: 65444 - DNA, 25 bp, Homo sapien
tcgtggccggctcagtgacagtgct

SEQ ID NO: 65445 - DNA, 25 bp, Homo sapien
ctcaggaatgctgctctccagagct

SEQ ID NO: 65446 - DNA, 25 bp, Homo sapien
gaggagcggcaacggcacctcgcag

SEQ ID NO: 65447 - DNA, 25 bp, Homo sapien
ggctgcgagcgatggagaagctgct

SEQ ID NO: 65448 - DNA, 25 bp, Homo sapien
agcagcggttgcaggagtcctgctc

SEQ ID NO: 65449 - DNA, 25 bp, Homo sapien
tgcctggccgggctagatggcttcc

SEQ ID NO: 65450 - DNA, 25 bp, Homo sapien
acttactacgctgctgtgggacttg

SEQ ID NO: 65451 - DNA, 25 bp, Homo sapien
ttcatggcattgctaggtccagata

SEQ ID NO: 65452 - DNA, 25 bp, Homo sapien
atttcctggtggtcgctgtaatacg

SEQ ID NO: 65453 - DNA, 25 bp, Homo sapien
cctctcgcggtaatttcatggcatt

SEQ ID NO: 65454 - DNA, 25 bp, Homo sapien
gcccttctcacgaaacttgcgcttg

SEQ ID NO: 65455 - DNA, 25 bp, Homo sapien
gggcgccaaatcctctctcgtgaga

SEQ ID NO: 65456 - DNA, 25 bp, Homo sapien
aatccacagaggagggcgccaaatc

SEQ ID NO: 65457 - DNA, 25 bp, Homo sapien
gatctgtcagacgaacccggcacgg

SEQ ID NO: 65458 - DNA, 25 bp, Homo sapien
gcatagcgcgtctttgtgcctcagt

SEQ ID NO: 65459 - DNA, 25 bp, Homo sapien
gtgcctcagtttcgtcacgcagaca

SEQ ID NO: 65460 - DNA, 25 bp, Homo sapien
cttgtttctcctctgcagtcccagg

SEQ ID NO: 65461 - DNA, 25 bp, Homo sapien
cagtcccaggtctcggcttagctgt

SEQ ID NO: 65462 - DNA, 25 bp, Homo sapien
tttgcgtgtcttgtcccttctgctg

SEQ ID NO: 65463 - DNA, 25 bp, Homo sapien
tgccgcactccgtgctaacggtaaa

SEQ ID NO: 65464 - DNA, 25 bp, Homo sapien
tgtcctgcatgcgactgaggcccac

SEQ ID NO: 65465 - DNA, 25 bp, Homo sapien
cctgccagaaataaggggagcatgc

SEQ ID NO: 65466 - DNA, 25 bp, Homo sapien
cgacatttagggaaggcagaaagta

SEQ ID NO: 65467 - DNA, 25 bp, Homo sapien
gaggtgcctgtttacccgcgccgga

SEQ ID NO: 65468 - DNA, 25 bp, Homo sapien
gacgtgcccgctgccggccttaaag

SEQ ID NO: 65469 - DNA, 25 bp, Homo sapien
aagtgttcgctggagtacccaccgc

SEQ ID NO: 65470 - DNA, 25 bp, Homo sapien
ctcttaaagggatagctctgccctt

SEQ ID NO: 65471 - DNA, 25 bp, Homo sapien
gactcggccgaagaggactcctaga

SEQ ID NO: 65472 - DNA, 25 bp, Homo sapien
agcctgcgaactttcgtggggcctg

SEQ ID NO: 65473 - DNA, 25 bp, Homo sapien
aagtaggttagtggtgcgacattta

SEQ ID NO: 65474 - DNA, 25 bp, Homo sapien
aggagccgctcaccatcttcagcgg

SEQ ID NO: 65475 - DNA, 25 bp, Homo sapien
cgatcgaggaataaagacacttggt

SEQ ID NO: 65476 - DNA, 25 bp, Homo sapien
caccgccatactaaacgatcgagga

SEQ ID NO: 65477 - DNA, 25 bp, Homo sapien
tggccctccaggtcgattccctggg

SEQ ID NO: 65478 - DNA, 25 bp, Homo sapien
catgcagacttttggcctggcgcga

SEQ ID NO: 65479 - DNA, 25 bp, Homo sapien
gacgtgtctacgtcggctgaagaga

SEQ ID NO: 65480 - DNA, 25 bp, Homo sapien
cccagagcttgaacacgcgtagact

SEQ ID NO: 65481 - DNA, 25 bp, Homo sapien
ggccctgctctatggggacccagag

SEQ ID NO: 65482 - DNA, 25 bp, Homo sapien
gaccagaggctggaggccacctacc

SEQ ID NO: 65483 - DNA, 25 bp, Homo sapien
tccggagccagtgccagccgccgcc

SEQ ID NO: 65484 - DNA, 25 bp, Homo sapien
cctggccgggcagagtccggagcca

SEQ ID NO: 65485 - DNA, 25 bp, Homo sapien
cggggtgtcacccacctgctgcggc

SEQ ID NO: 65486 - DNA, 25 bp, Homo sapien
ctctcgggatctggaccagaggctg

SEQ ID NO: 65487 - DNA, 25 bp, Homo sapien
ggactgcgctctcgggatctggacc

SEQ ID NO: 65488 - DNA, 25 bp, Homo sapien
cgccgcgtctgagccgcaggggatg

SEQ ID NO: 65489 - DNA, 25 bp, Homo sapien
gggccgctccacgtggccgctccac

SEQ ID NO: 65490 - DNA, 25 bp, Homo sapien
gactgcgagcgcctaagggactctg

SEQ ID NO: 65491 - DNA, 25 bp, Homo sapien
ggtcactcgggttagatccgcgcga

SEQ ID NO: 65492 - DNA, 25 bp, Homo sapien
aggccattcgcaggtcactcgggtt

SEQ ID NO: 65493 - DNA, 25 bp, Homo sapien
gctgcacagccaagaaccgcggagg

SEQ ID NO: 65494 - DNA, 25 bp, Homo sapien
aggccgcttgtctcgggctgcacag

SEQ ID NO: 65495 - DNA, 25 bp, Homo sapien
agcagcgcaaactgcctgcagcggg

SEQ ID NO: 65496 - DNA, 25 bp, Homo sapien
actctggccaggctgctggactcgg

SEQ ID NO: 65497 - DNA, 25 bp, Homo sapien
atccgcgcgaggcactaggcgacca

SEQ ID NO: 65498 - DNA, 25 bp, Homo sapien
ggcaagcgggtcttcccaacagaag

SEQ ID NO: 65499 - DNA, 25 bp, Homo sapien
acgccattctttatgcctgtcttgg

SEQ ID NO: 65500 - DNA, 25 bp, Homo sapien
ggagttgccaaaaccctgaccatca

SEQ ID NO: 65501 - DNA, 25 bp, Homo sapien
tctcacaccggggagttgccaaaac

SEQ ID NO: 65502 - DNA, 25 bp, Homo sapien
ggagcgccgacacgcgtcagcacta

SEQ ID NO: 65503 - DNA, 25 bp, Homo sapien
gcccgctgagttctcgactgaaatt

SEQ ID NO: 65504 - DNA, 25 bp, Homo sapien
acctgaagcgcgtacaacgggaacg

SEQ ID NO: 65505 - DNA, 25 bp, Homo sapien
gctccgtccaagtcggtctcgcaga

SEQ ID NO: 65506 - DNA, 25 bp, Homo sapien
tgcgccaggccttcttggccttgca

SEQ ID NO: 65507 - DNA, 25 bp, Homo sapien
tggccgcccttcctgcgtggactcc

SEQ ID NO: 65508 - DNA, 25 bp, Homo sapien
gcacactcggccacgagttgcctgg

SEQ ID NO: 65509 - DNA, 25 bp, Homo sapien
gccgccagctacatagcccacctca

SEQ ID NO: 65510 - DNA, 25 bp, Homo sapien
tggtgctcgccgccagctacatagc

SEQ ID NO: 65511 - DNA, 25 bp, Homo sapien
tctccaagttggacgtgctggtgct

SEQ ID NO: 65512 - DNA, 25 bp, Homo sapien
aagctctccaagttggacgtgctgg

SEQ ID NO: 65513 - DNA, 25 bp, Homo sapien
gcgccaggccttcttggccttgcag

SEQ ID NO: 65514 - DNA, 25 bp, Homo sapien
tacccgaggtacagaagcaagtttg

SEQ ID NO: 65515 - DNA, 25 bp, Homo sapien
taccgctcgcacttaagatctcaga

SEQ ID NO: 65516 - DNA, 25 bp, Homo sapien
gtagtcttacgaccctggtgccctg

SEQ ID NO: 65517 - DNA, 25 bp, Homo sapien
tcctgccgactttcaaagacctgtg

SEQ ID NO: 65518 - DNA, 25 bp, Homo sapien
cctgcggttctgatttcgtccctga

SEQ ID NO: 65519 - DNA, 25 bp, Homo sapien
gccaggtcctgttcccaagtactca

SEQ ID NO: 65520 - DNA, 25 bp, Homo sapien
cgagtttctgcgaagccgcgacctc

SEQ ID NO: 65521 - DNA, 25 bp, Homo sapien
gggaacggaaaatggcgcctcacga

SEQ ID NO: 65522 - DNA, 25 bp, Homo sapien
tttcaaaccggcatggtcggctacc

SEQ ID NO: 65523 - DNA, 25 bp, Homo sapien
tcctcacgtggttccagtggagttt

SEQ ID NO: 65524 - DNA, 25 bp, Homo sapien
ccagccctgcttctttcttgcagtg

SEQ ID NO: 65525 - DNA, 25 bp, Homo sapien
gcagcctccactggggcgtgctcat

SEQ ID NO: 65526 - DNA, 25 bp, Homo sapien
ttatcccactctgtgatgcgcctct

SEQ ID NO: 65527 - DNA, 25 bp, Homo sapien
gcgccgttagccacgtggaccgact

SEQ ID NO: 65528 - DNA, 25 bp, Homo sapien
tggagtttgcagtccttcccgcttc

SEQ ID NO: 65529 - DNA, 25 bp, Homo sapien
cccggttaggctgcagaccttatcc

SEQ ID NO: 65530 - DNA, 25 bp, Homo sapien
ttgtgcactcgaagctgtgacagtc

SEQ ID NO: 65531 - DNA, 25 bp, Homo sapien
cacctgccgccactgtagaatggga

SEQ ID NO: 65532 - DNA, 25 bp, Homo sapien
tggccgagcctcaagtcgaagcttc

SEQ ID NO: 65533 - DNA, 25 bp, Homo sapien
tggtgtcacggccactgtttatgga

SEQ ID NO: 65534 - DNA, 25 bp, Homo sapien
aagtcgagccgcctatctggtgtca

SEQ ID NO: 65535 - DNA, 25 bp, Homo sapien
cactggcaactggagagcgctcaca

SEQ ID NO: 65536 - DNA, 25 bp, Homo sapien
gctgccaatcactgtaccgcgaatg

SEQ ID NO: 65537 - DNA, 25 bp, Homo sapien
ggtcggaattcacgagcccagtctg

SEQ ID NO: 65538 - DNA, 25 bp, Homo sapien
atgcacctggctgacctggctgaaa

SEQ ID NO: 65539 - DNA, 25 bp, Homo sapien
agagaccgcagcatcacccaaatcg

SEQ ID NO: 65540 - DNA, 25 bp, Homo sapien
cccgggaggatctcaataaagaact

SEQ ID NO: 65541 - DNA, 25 bp, Homo sapien
tagtcacgcagacagtgccctggtg

SEQ ID NO: 65542 - DNA, 25 bp, Homo sapien
cctctgtgatgccaggagcgaactg

SEQ ID NO: 65543 - DNA, 25 bp, Homo sapien
tgcctctacgacaaaagccaacggg

SEQ ID NO: 65544 - DNA, 25 bp, Homo sapien
cttgcccaccgagtcgaatatgatg

SEQ ID NO: 65545 - DNA, 25 bp, Homo sapien
ataaagaactcgagcgtcccagacc

SEQ ID NO: 65546 - DNA, 25 bp, Homo sapien
tctggatccctgaatccggcctttc

SEQ ID NO: 65547 - DNA, 25 bp, Homo sapien
cctcatgggagttgcagtgtcaaaa

SEQ ID NO: 65548 - DNA, 25 bp, Homo sapien
tattccataatgcagcgcggccaga

SEQ ID NO: 65549 - DNA, 25 bp, Homo sapien
gccgggctagttttctcttagactc

SEQ ID NO: 65550 - DNA, 25 bp, Homo sapien
ctggtcgcggtcttatgacgaaatc

SEQ ID NO: 65551 - DNA, 25 bp, Homo sapien
tctaagttcgaagatggcgccgcct

SEQ ID NO: 65552 - DNA, 25 bp, Homo sapien
cggagccaggagtttgttcccaata

SEQ ID NO: 65553 - DNA, 25 bp, Homo sapien
agagtctgtacctgcaaccctggcg

SEQ ID NO: 65554 - DNA, 25 bp, Homo sapien
ccgtctattcttgcggccacacgaa

SEQ ID NO: 65555 - DNA, 25 bp, Homo sapien
tcttgcggccacacgaacgtgcgtg

SEQ ID NO: 65556 - DNA, 25 bp, Homo sapien
gcccagcgtgcgaacacgccaaggt

SEQ ID NO: 65557 - DNA, 25 bp, Homo sapien
acacgccaaggtgtgactgtcggca

SEQ ID NO: 65558 - DNA, 25 bp, Homo sapien
gtgactgtcggcacggcactgccga

SEQ ID NO: 65559 - DNA, 25 bp, Homo sapien
tgcatccgagcgtctgcagagcaca

SEQ ID NO: 65560 - DNA, 25 bp, Homo sapien
cgggtccacaccttgggtgcagcga

SEQ ID NO: 65561 - DNA, 25 bp, Homo sapien
agcgcgtccgcagagcgggtccaca

SEQ ID NO: 65562 - DNA, 25 bp, Homo sapien
ccacaggctgtggttaggtgttttc

SEQ ID NO: 65563 - DNA, 25 bp, Homo sapien
ggttaggtgttttctgagcgctctg

SEQ ID NO: 65564 - DNA, 25 bp, Homo sapien
tgagagtatgtcagctatggtgtcc

SEQ ID NO: 65565 - DNA, 25 bp, Homo sapien
agtatgtcagctatggtgtccttca

SEQ ID NO: 65566 - DNA, 25 bp, Homo sapien
tttctgagcgctctgggttttggct

SEQ ID NO: 65567 - DNA, 25 bp, Homo sapien
tggctgtggactggaatcatggcac

SEQ ID NO: 65568 - DNA, 25 bp, Homo sapien
gctgctctccagggactctctgctg

SEQ ID NO: 65569 - DNA, 25 bp, Homo sapien
tatggtgtccttcacacaggggccc

SEQ ID NO: 65570 - DNA, 25 bp, Homo sapien
gtgccgtagggaacatgcacttttc

SEQ ID NO: 65571 - DNA, 25 bp, Homo sapien
cactacgggttgcaatgagggccaa

SEQ ID NO: 65572 - DNA, 25 bp, Homo sapien
ctccctatccggacaggtggctctt

SEQ ID NO: 65573 - DNA, 25 bp, Homo sapien
ggctcttgccctttagactacagtt

SEQ ID NO: 65574 - DNA, 25 bp, Homo sapien
caggcgattgcgtcccagaaccgac

SEQ ID NO: 65575 - DNA, 25 bp, Homo sapien
tcccaaaatggcgagtgaggctgcg

SEQ ID NO: 65576 - DNA, 25 bp, Homo sapien
actgcgctcgagactgtgtagaccg

SEQ ID NO: 65577 - DNA, 25 bp, Homo sapien
cacatcggatcgcagggctcccaaa

SEQ ID NO: 65578 - DNA, 25 bp, Homo sapien
ccctgcgtgggtacgctgatgccgc

SEQ ID NO: 65579 - DNA, 25 bp, Homo sapien
ctcgagtagtgggacacgaaggtgc

SEQ ID NO: 65580 - DNA, 25 bp, Homo sapien
tgccgcttcaggtggctcgagtagt

SEQ ID NO: 65581 - DNA, 25 bp, Homo sapien
tcgtggagtacagcagcggaagcca

SEQ ID NO: 65582 - DNA, 25 bp, Homo sapien
cttctctccgctgtgtgtctgcatg

SEQ ID NO: 65583 - DNA, 25 bp, Homo sapien
agtacagcagcggaagccacaggtc

SEQ ID NO: 65584 - DNA, 25 bp, Homo sapien
tatgtcgtgtcaggttgacgagctg

SEQ ID NO: 65585 - DNA, 25 bp, Homo sapien
gcgtgggtacgctgatgccgcctca

SEQ ID NO: 65586 - DNA, 25 bp, Homo sapien
ggctttgcttccttcggggcatcgt

SEQ ID NO: 65587 - DNA, 25 bp, Homo sapien
ggctctcctatacacgcgcaggaca

SEQ ID NO: 65588 - DNA, 25 bp, Homo sapien
agcagctcgctctgggctctcctat

SEQ ID NO: 65589 - DNA, 25 bp, Homo sapien
gggaactagatcatttctggctgca

SEQ ID NO: 65590 - DNA, 25 bp, Homo sapien
agaccagctggtacctccgtactcg

SEQ ID NO: 65591 - DNA, 25 bp, Homo sapien
catttcacgggctgcgggtggcttt

SEQ ID NO: 65592 - DNA, 25 bp, Homo sapien
catgctacagatgggaccaagtcgg

SEQ ID NO: 65593 - DNA, 25 bp, Homo sapien
agcctcaatggcgtgaccgggaagt

SEQ ID NO: 65594 - DNA, 25 bp, Homo sapien
tagtaagccacgcacaggtaaatgg

SEQ ID NO: 65595 - DNA, 25 bp, Homo sapien
catcgctgtcaaagtagtaagccac

SEQ ID NO: 65596 - DNA, 25 bp, Homo sapien
tcaaagtagtaagccacgcacaggt

SEQ ID NO: 65597 - DNA, 25 bp, Homo sapien
taagccacgcacaggtaaatggagg

SEQ ID NO: 65598 - DNA, 25 bp, Homo sapien
ccacgcacaggtaaatggaggaggc

SEQ ID NO: 65599 - DNA, 25 bp, Homo sapien
cagtccgagggcatggtgaagaggt

SEQ ID NO: 65600 - DNA, 25 bp, Homo sapien
agaacgtctcaacttttaattatca

SEQ ID NO: 65601 - DNA, 25 bp, Homo sapien
cgctgtcaaagtagtaagccacgca

SEQ ID NO: 65602 - DNA, 25 bp, Homo sapien
ctgacgcctcttttgtgtcggactc

SEQ ID NO: 65603 - DNA, 25 bp, Homo sapien
aaggtgcctcttcccacatggccga

SEQ ID NO: 65604 - DNA, 25 bp, Homo sapien
tgtcggactcgacgctttcagcccg

SEQ ID NO: 65605 - DNA, 25 bp, Homo sapien
cagcctcttggcgttttgtctgacg

SEQ ID NO: 65606 - DNA, 25 bp, Homo sapien
caggtcgcctctggcagaacctctt

SEQ ID NO: 65607 - DNA, 25 bp, Homo sapien
gcgggcagtcatttccttagcaact

SEQ ID NO: 65608 - DNA, 25 bp, Homo sapien
cgaccgacgcaaggtgccggtgaaa

SEQ ID NO: 65609 - DNA, 25 bp, Homo sapien
ccggagcacttcaccgtgttgggct

SEQ ID NO: 65610 - DNA, 25 bp, Homo sapien
ctgcgctgtcggtccggcctttgat

SEQ ID NO: 65611 - DNA, 25 bp, Homo sapien
ggctgccttccagacgcagggcatg

SEQ ID NO: 65612 - DNA, 25 bp, Homo sapien
gcgttcgcttggaactccggctgcg

SEQ ID NO: 65613 - DNA, 25 bp, Homo sapien
ccagctgggaccgaaaacatcgacc

SEQ ID NO: 65614 - DNA, 25 bp, Homo sapien
acgtcacccaatggaaacctgccgg

SEQ ID NO: 65615 - DNA, 25 bp, Homo sapien
actcagtagcccaggcccgatcggg

SEQ ID NO: 65616 - DNA, 25 bp, Homo sapien
cacccagaacgtcacccaatggaaa

SEQ ID NO: 65617 - DNA, 25 bp, Homo sapien
aggccctggcgttcgcttggaactc

SEQ ID NO: 65618 - DNA, 25 bp, Homo sapien
agtctactttttgctaaaagcgtcg

SEQ ID NO: 65619 - DNA, 25 bp, Homo sapien
ggcactaggggagccgaattctaca

SEQ ID NO: 65620 - DNA, 25 bp, Homo sapien
cgaattctacaatcccgctggggcg

SEQ ID NO: 65621 - DNA, 25 bp, Homo sapien
ggggccattcgattcgcctcagttg

SEQ ID NO: 65622 - DNA, 25 bp, Homo sapien
cattcgattcgcctcagttgctgct

SEQ ID NO: 65623 - DNA, 25 bp, Homo sapien
ctcagttgctgctgtaataaaagtc

SEQ ID NO: 65624 - DNA, 25 bp, Homo sapien
tgctgctgtaataaaagtctacttt

SEQ ID NO: 65625 - DNA, 25 bp, Homo sapien
aaaagcgtcgtgtgttcgcgccttt

SEQ ID NO: 65626 - DNA, 25 bp, Homo sapien
gcggcgctgtcacgccggagtacac

SEQ ID NO: 65627 - DNA, 25 bp, Homo sapien
gcagtctctgcgctttcggtaactt

SEQ ID NO: 65628 - DNA, 25 bp, Homo sapien
tctgcgctttcggtaacttccgggc

SEQ ID NO: 65629 - DNA, 25 bp, Homo sapien
atgcgtgtgggcctcgcgctgatct

SEQ ID NO: 65630 - DNA, 25 bp, Homo sapien
tgcatggcaccgtcctgcggcacgt

SEQ ID NO: 65631 - DNA, 25 bp, Homo sapien
caatgtcatctctgtcggctcgggg

SEQ ID NO: 65632 - DNA, 25 bp, Homo sapien
cgctgatcttggtgggccacgtgaa

SEQ ID NO: 65633 - DNA, 25 bp, Homo sapien
ccggagtacaccgtagccaatgtca

SEQ ID NO: 65634 - DNA, 25 bp, Homo sapien
aacacgcgtcgcaaggtcacacgta

SEQ ID NO: 65635 - DNA, 25 bp, Homo sapien
gtcctacgtcatagcggtccgtctc

SEQ ID NO: 65636 - DNA, 25 bp, Homo sapien
gtcgccgcatgcaaactcaagacca

SEQ ID NO: 65637 - DNA, 25 bp, Homo sapien
atgttctccttgaccaatcccgtcg

SEQ ID NO: 65638 - DNA, 25 bp, Homo sapien
gacaactcccgtggttacctggaca

SEQ ID NO: 65639 - DNA, 25 bp, Homo sapien
tcacacgtaactttgcggcgaagca

SEQ ID NO: 65640 - DNA, 25 bp, Homo sapien
gcagcgacaggcactgacgcttatg

SEQ ID NO: 65641 - DNA, 25 bp, Homo sapien
ccttgagagggcttcatgaatgttc

SEQ ID NO: 65642 - DNA, 25 bp, Homo sapien
atgtcgctgcgttcgtctgagatga

SEQ ID NO: 65643 - DNA, 25 bp, Homo sapien
gcagcagccgcaaaactcaagtctt

SEQ ID NO: 65644 - DNA, 25 bp, Homo sapien
cctctcctaattgggtgctcgtggc

SEQ ID NO: 65645 - DNA, 25 bp, Homo sapien
tctcctcacagacatcagctcgggt

SEQ ID NO: 65646 - DNA, 25 bp, Homo sapien
ccgttagagaaaagtggacagcgtc

SEQ ID NO: 65647 - DNA, 25 bp, Homo sapien
acagcgtctcggtcacagagttgga

SEQ ID NO: 65648 - DNA, 25 bp, Homo sapien
ggagagcgttttcctcatcaaagca

SEQ ID NO: 65649 - DNA, 25 bp, Homo sapien
aaaatcgcttctgccggcgtggacc

SEQ ID NO: 65650 - DNA, 25 bp, Homo sapien
gcccatcgcccgactcggtggcgct

SEQ ID NO: 65651 - DNA, 25 bp, Homo sapien
tccgccggtcctcgcggttggtcag

SEQ ID NO: 65652 - DNA, 25 bp, Homo sapien
ctcgagcgggccacggagtctgtcc

SEQ ID NO: 65653 - DNA, 25 bp, Homo sapien
ccctgcagcgggatgtgaccgtccc

SEQ ID NO: 65654 - DNA, 25 bp, Homo sapien
cgaccctcccaatggcgcctccgga

SEQ ID NO: 65655 - DNA, 25 bp, Homo sapien
tctcccagctgaagcggacgagtcg

SEQ ID NO: 65656 - DNA, 25 bp, Homo sapien
tagggtctccggcacctgggagatc

SEQ ID NO: 65657 - DNA, 25 bp, Homo sapien
ccagagtgcggtccgccctgcccac

SEQ ID NO: 65658 - DNA, 25 bp, Homo sapien
gggagctctcacgtaaacgcgctgc

SEQ ID NO: 65659 - DNA, 25 bp, Homo sapien
gctctgatgtaaacgcgctgcctgc

SEQ ID NO: 65660 - DNA, 25 bp, Homo sapien
tggactcgggagctctcacgtaaac

SEQ ID NO: 65661 - DNA, 25 bp, Homo sapien
ctcgggagctctgatgtaaacgcgc

SEQ ID NO: 65662 - DNA, 25 bp, Homo sapien
tcgggagctctcacgtaaacgcgct

SEQ ID NO: 65663 - DNA, 25 bp, Homo sapien
agctctcacgtaaacgcgctgcctg

SEQ ID NO: 65664 - DNA, 25 bp, Homo sapien
agctctgaggtaaacgcgctgcctg

SEQ ID NO: 65665 - DNA, 25 bp, Homo sapien
gactcgggagctctgacgtaaacgc

SEQ ID NO: 65666 - DNA, 25 bp, Homo sapien
tctcagaggaatcggagggtgactc

SEQ ID NO: 65667 - DNA, 25 bp, Homo sapien
tgactcatcacgtgactcgctccgg

SEQ ID NO: 65668 - DNA, 25 bp, Homo sapien
cggagcccttgggtgaaattgttag

SEQ ID NO: 65669 - DNA, 25 bp, Homo sapien
tgtcttccagactcggtgctgtacc

SEQ ID NO: 65670 - DNA, 25 bp, Homo sapien
cgccgtgagtttcttggtttgaccg

SEQ ID NO: 65671 - DNA, 25 bp, Homo sapien
tggtttgaccgttatgctttagagg

SEQ ID NO: 65672 - DNA, 25 bp, Homo sapien
gctttagaggtagcgctgtcgagcc

SEQ ID NO: 65673 - DNA, 25 bp, Homo sapien
agctgctaggcggaagtagaagttc

SEQ ID NO: 65674 - DNA, 25 bp, Homo sapien
ggcggcactatccttggcacccgta

SEQ ID NO: 65675 - DNA, 25 bp, Homo sapien
cctcagccggactgcggtgatttta

SEQ ID NO: 65676 - DNA, 25 bp, Homo sapien
cctcagtggggacttcaagaagcca

SEQ ID NO: 65677 - DNA, 25 bp, Homo sapien
ctccaggtcgtgaaggagcaacttc

SEQ ID NO: 65678 - DNA, 25 bp, Homo sapien
actgcgttgcaggactccaattctg

SEQ ID NO: 65679 - DNA, 25 bp, Homo sapien
gcacagcatcccgataaccgttttg

SEQ ID NO: 65680 - DNA, 25 bp, Homo sapien
cgccggaagcgcttcttctcaatca

SEQ ID NO: 65681 - DNA, 25 bp, Homo sapien
gccgggcttctacctctacgatctg

SEQ ID NO: 65682 - DNA, 25 bp, Homo sapien
tgcgggagcttcgttcacgcccttt

SEQ ID NO: 65683 - DNA, 25 bp, Homo sapien
ttactgggaagtgccaagagaaaga

SEQ ID NO: 65684 - DNA, 25 bp, Homo sapien
cccttctgggaagggccttgatgca

SEQ ID NO: 65685 - DNA, 25 bp, Homo sapien
gctgattctaatccgaggcccaaga

SEQ ID NO: 65686 - DNA, 25 bp, Homo sapien
tgggcaagcacttcccatcgcggca

SEQ ID NO: 65687 - DNA, 25 bp, Homo sapien
cgggccgtgggcaagcacttcccat

SEQ ID NO: 65688 - DNA, 25 bp, Homo sapien
ttcccaggaacagctcaggggcctg

SEQ ID NO: 65689 - DNA, 25 bp, Homo sapien
agggccttgatgcaagggcacaccc

SEQ ID NO: 65690 - DNA, 25 bp, Homo sapien
aattgccgtcctcacggaccgttga

SEQ ID NO: 65691 - DNA, 25 bp, Homo sapien
gatgtcctcttccagaaccgggccg

SEQ ID NO: 65692 - DNA, 25 bp, Homo sapien
tcctctccgcggtcttctgtaagtg

SEQ ID NO: 65693 - DNA, 25 bp, Homo sapien
tgcgtacttttccaggccttcagga

SEQ ID NO: 65694 - DNA, 25 bp, Homo sapien
tctgcggtgtctggattcaattgcc

SEQ ID NO: 65695 - DNA, 25 bp, Homo sapien
aaccgaggaacgagccagacgactg

SEQ ID NO: 65696 - DNA, 25 bp, Homo sapien
ttcaggaccacagcgtccggcatgc

SEQ ID NO: 65697 - DNA, 25 bp, Homo sapien
gtgtggtcaccatgttcctctccgc

SEQ ID NO: 65698 - DNA, 25 bp, Homo sapien
tagtcgccggttaccgatcggacta

SEQ ID NO: 65699 - DNA, 25 bp, Homo sapien
gggccctcctgatatggcgagactc

SEQ ID NO: 65700 - DNA, 25 bp, Homo sapien
tcggtgcacagcctcacgtaacagg

SEQ ID NO: 65701 - DNA, 25 bp, Homo sapien
cttcctggaatagtctcggtgcaca

SEQ ID NO: 65702 - DNA, 25 bp, Homo sapien
tcggtcatgcaggagcccaccacta

SEQ ID NO: 65703 - DNA, 25 bp, Homo sapien
gatcggactaagttccaggtacctg

SEQ ID NO: 65704 - DNA, 25 bp, Homo sapien
gccatcgctcaaaggtgctgctgtc

SEQ ID NO: 65705 - DNA, 25 bp, Homo sapien
cccgagccgcagactgagtaactgg

SEQ ID NO: 65706 - DNA, 25 bp, Homo sapien
ctcgtaaatagcgtagccgggcgtt

SEQ ID NO: 65707 - DNA, 25 bp, Homo sapien
cgccgtcagggctgtgattattttc

SEQ ID NO: 65708 - DNA, 25 bp, Homo sapien
caccatcatctcagcggaaggattg

SEQ ID NO: 65709 - DNA, 25 bp, Homo sapien
gcggccggaatgtcttgactggtta

SEQ ID NO: 65710 - DNA, 25 bp, Homo sapien
agatgcgtcctaattgcccggcgta

SEQ ID NO: 65711 - DNA, 25 bp, Homo sapien
cctgctctaaggtctgtgctctgta

SEQ ID NO: 65712 - DNA, 25 bp, Homo sapien
ttcgtccaagatctcacagctcgta

SEQ ID NO: 65713 - DNA, 25 bp, Homo sapien
gggcctaaggtcatgtctccaaact

SEQ ID NO: 65714 - DNA, 25 bp, Homo sapien
ttctttcttggacccacgttacagc

SEQ ID NO: 65715 - DNA, 25 bp, Homo sapien
gcaggagcccgctaaattcaccagg

SEQ ID NO: 65716 - DNA, 25 bp, Homo sapien
gcaccgttaccaccctggcgagtga

SEQ ID NO: 65717 - DNA, 25 bp, Homo sapien
acccacgttacagcgtcggcggaga

SEQ ID NO: 65718 - DNA, 25 bp, Homo sapien
gacagtgacgaaagccttagagttg

SEQ ID NO: 65719 - DNA, 25 bp, Homo sapien
ttctggctagtgtctgaagggtctc

SEQ ID NO: 65720 - DNA, 25 bp, Homo sapien
agacgggcgtttctggctagtgtct

SEQ ID NO: 65721 - DNA, 25 bp, Homo sapien
ggagatgagaacatcggcaccgtta

SEQ ID NO: 65722 - DNA, 25 bp, Homo sapien
gcgctctgcgtaaccgggacttcct

SEQ ID NO: 65723 - DNA, 25 bp, Homo sapien
caaccaccacgtctggaggaggcca

SEQ ID NO: 65724 - DNA, 25 bp, Homo sapien
agcgaggccgaaagggcgcaaccac

SEQ ID NO: 65725 - DNA, 25 bp, Homo sapien
acgcacctgcgcgaagacggcagcg

SEQ ID NO: 65726 - DNA, 25 bp, Homo sapien
agaagccgctccagtgcggttgcgc

SEQ ID NO: 65727 - DNA, 25 bp, Homo sapien
ccgcgtgacttgtaggtgagagaac

SEQ ID NO: 65728 - DNA, 25 bp, Homo sapien
agtctgtgccgacaagatggcggac

SEQ ID NO: 65729 - DNA, 25 bp, Homo sapien
ggagctgaacgtggacagcctcatc

SEQ ID NO: 65730 - DNA, 25 bp, Homo sapien
cggatgtcgaaaagaggcgccgctc

SEQ ID NO: 65731 - DNA, 25 bp, Homo sapien
agctggtagttctccgaacggatcc

SEQ ID NO: 65732 - DNA, 25 bp, Homo sapien
atagcgctaagcacgccacaatggc

SEQ ID NO: 65733 - DNA, 25 bp, Homo sapien
gtgtgcgcgagagccaatcaaaagc

SEQ ID NO: 65734 - DNA, 25 bp, Homo sapien
gctccagccagtcacgtcgcgaggt

SEQ ID NO: 65735 - DNA, 25 bp, Homo sapien
ctgagcctctgcgtctaggtgagaa

SEQ ID NO: 65736 - DNA, 25 bp, Homo sapien
gcgcagctattgctggacggccagt

SEQ ID NO: 65737 - DNA, 25 bp, Homo sapien
tcgctgcgtgctcccaaccttggga

SEQ ID NO: 65738 - DNA, 25 bp, Homo sapien
ctgctggctagcgaccgacgagcaa

SEQ ID NO: 65739 - DNA, 25 bp, Homo sapien
ctggttgtctaatcgaagggaagta

SEQ ID NO: 65740 - DNA, 25 bp, Homo sapien
aagcctgactgcgagacgtgcccaa

SEQ ID NO: 65741 - DNA, 25 bp, Homo sapien
accgacgagcaaccgtctgaggcca

SEQ ID NO: 65742 - DNA, 25 bp, Homo sapien
gcctcgcaggcgaatctccagtttc

SEQ ID NO: 65743 - DNA, 25 bp, Homo sapien
tctccagtttcgagtgtgcccggtc

SEQ ID NO: 65744 - DNA, 25 bp, Homo sapien
ccaccgcccgccttagatgagaagg

SEQ ID NO: 65745 - DNA, 25 bp, Homo sapien
tgcgacggagccttgaccgccgttg

SEQ ID NO: 65746 - DNA, 25 bp, Homo sapien
tagcatagtgtttcgcgaaggcgcc

SEQ ID NO: 65747 - DNA, 25 bp, Homo sapien
gtcgcagacgagtgacgcaagccta

SEQ ID NO: 65748 - DNA, 25 bp, Homo sapien
ggaccgcggcaccatgccattagca

SEQ ID NO: 65749 - DNA, 25 bp, Homo sapien
ccagtcccaatgtccgagatgctca

SEQ ID NO: 65750 - DNA, 25 bp, Homo sapien
ttccagtgacgaaagacatccagtc

SEQ ID NO: 65751 - DNA, 25 bp, Homo sapien
tcgagctctcgaggggatgactctt

SEQ ID NO: 65752 - DNA, 25 bp, Homo sapien
cctgcgagagcatcgaaggatcctc

SEQ ID NO: 65753 - DNA, 25 bp, Homo sapien
ttaccgctaacagacgacctccagg

SEQ ID NO: 65754 - DNA, 25 bp, Homo sapien
gagcttcggtatcttttctccgggc

SEQ ID NO: 65755 - DNA, 25 bp, Homo sapien
cccacctgcgccacaagggagaaga

SEQ ID NO: 65756 - DNA, 25 bp, Homo sapien
gtcgtcaagccggtccagagcgcgc

SEQ ID NO: 65757 - DNA, 25 bp, Homo sapien
gaagctgagaacctttggccaggga

SEQ ID NO: 65758 - DNA, 25 bp, Homo sapien
aaatgtccctgattagaagctgaga

SEQ ID NO: 65759 - DNA, 25 bp, Homo sapien
tgtggactagaaatgtccctgatta

SEQ ID NO: 65760 - DNA, 25 bp, Homo sapien
atggcttcgaggctgtggactagaa

SEQ ID NO: 65761 - DNA, 25 bp, Homo sapien
cctgcgctgcgtctccaagtgctgg

SEQ ID NO: 65762 - DNA, 25 bp, Homo sapien
ttacgagtatgggagacggccaaca

SEQ ID NO: 65763 - DNA, 25 bp, Homo sapien
ccagaacaagatagcgacaggccct

SEQ ID NO: 65764 - DNA, 25 bp, Homo sapien
cagaagctctcctgcgacgcgaaga

SEQ ID NO: 65765 - DNA, 25 bp, Homo sapien
tcagtggtacctgcacctgtctggc

SEQ ID NO: 65766 - DNA, 25 bp, Homo sapien
ctctaccgacggtcacttacgagta

SEQ ID NO: 65767 - DNA, 25 bp, Homo sapien
ccaacaaccggctgcaccaggagta

SEQ ID NO: 65768 - DNA, 25 bp, Homo sapien
gtgccttccgcgcacctcagtggta

SEQ ID NO: 65769 - DNA, 25 bp, Homo sapien
gcgacgcgaagatccactccctgag

SEQ ID NO: 65770 - DNA, 25 bp, Homo sapien
gagcgcgcctctcggcctttcctcc

SEQ ID NO: 65771 - DNA, 25 bp, Homo sapien
cccgcagacgctgtcagccggggtc

SEQ ID NO: 65772 - DNA, 25 bp, Homo sapien
gggctctgggccacgaccgccagcc

SEQ ID NO: 65773 - DNA, 25 bp, Homo sapien
gccgctgacggacggcccaacttta

SEQ ID NO: 65774 - DNA, 25 bp, Homo sapien
ctctggggagcccaagacgggtaag

SEQ ID NO: 65775 - DNA, 25 bp, Homo sapien
cgccgcaggttagagacgtgaggcc

SEQ ID NO: 65776 - DNA, 25 bp, Homo sapien
gcgtgcgcccgatcatctgactgct

SEQ ID NO: 65777 - DNA, 25 bp, Homo sapien
tgcgcccgatcatctgactgctggg

SEQ ID NO: 65778 - DNA, 25 bp, Homo sapien
gcgtgcgcgcaagtctcttgctttc

SEQ ID NO: 65779 - DNA, 25 bp, Homo sapien
ggactgtctgcctgctgaacttctg

SEQ ID NO: 65780 - DNA, 25 bp, Homo sapien
gggcagcctccaatctctgcaactt

SEQ ID NO: 65781 - DNA, 25 bp, Homo sapien
cgctcggtacagaggaactactatg

SEQ ID NO: 65782 - DNA, 25 bp, Homo sapien
ggctctgaacagtccttggtaccca

SEQ ID NO: 65783 - DNA, 25 bp, Homo sapien
caggggcgagtccagagacactcaa

SEQ ID NO: 65784 - DNA, 25 bp, Homo sapien
tccacctgatctccagaggactgtg

SEQ ID NO: 65785 - DNA, 25 bp, Homo sapien
ctcactggctgggaccttgagcctc

SEQ ID NO: 65786 - DNA, 25 bp, Homo sapien
cttcgaggcactcgggaatcggccc

SEQ ID NO: 65787 - DNA, 25 bp, Homo sapien
agggcctgactaaacctggagactc

SEQ ID NO: 65788 - DNA, 25 bp, Homo sapien
cgtgaaccgtcctgagcagggccca

SEQ ID NO: 65789 - DNA, 25 bp, Homo sapien
gcgaccggtgcgacaacagccgcaa

SEQ ID NO: 65790 - DNA, 25 bp, Homo sapien
gccgaggggcttcataccagctgaa

SEQ ID NO: 65791 - DNA, 25 bp, Homo sapien
ggtgactgacgttgaggcccaacca

SEQ ID NO: 65792 - DNA, 25 bp, Homo sapien
tgtttgctctttgtgaggcctggcg

SEQ ID NO: 65793 - DNA, 25 bp, Homo sapien
agtcggaacttgaccgagttgtttg

SEQ ID NO: 65794 - DNA, 25 bp, Homo sapien
tgtcatcctcactcgggacgcaggg

SEQ ID NO: 65795 - DNA, 25 bp, Homo sapien
cgcagggaccgtttttaaatcacag

SEQ ID NO: 65796 - DNA, 25 bp, Homo sapien
tgcaagtctcaacgtcgaggccggc

SEQ ID NO: 65797 - DNA, 25 bp, Homo sapien
gagcccgtgcaggagtcaacgtcaa

SEQ ID NO: 65798 - DNA, 25 bp, Homo sapien
gaactcggagccctcacctaagtga

SEQ ID NO: 65799 - DNA, 25 bp, Homo sapien
agcctgccctaggacttcatgtcta

SEQ ID NO: 65800 - DNA, 25 bp, Homo sapien
tgaaaccaccctatgcggagagctg

SEQ ID NO: 65801 - DNA, 25 bp, Homo sapien
cattcactggtgagtaccctgcgcc

SEQ ID NO: 65802 - DNA, 25 bp, Homo sapien
tcccgtcggtgtttacgctaggagc

SEQ ID NO: 65803 - DNA, 25 bp, Homo sapien
cgtgccctgcttgtcacaggtggga

SEQ ID NO: 65804 - DNA, 25 bp, Homo sapien
cgcctccgcgttacgggatgaatta

SEQ ID NO: 65805 - DNA, 25 bp, Homo sapien
taaaacgtctcaagtggtcaccacg

SEQ ID NO: 65806 - DNA, 25 bp, Homo sapien
agccttccgggacgcattactaggg

SEQ ID NO: 65807 - DNA, 25 bp, Homo sapien
tgcactgtcccggaacgcaacctga

SEQ ID NO: 65808 - DNA, 25 bp, Homo sapien
tgcagccaatcaggacgtagccttc

SEQ ID NO: 65809 - DNA, 25 bp, Homo sapien
aggtctgaccctgttaaatcccatg

SEQ ID NO: 65810 - DNA, 25 bp, Homo sapien
cgcagctcccagaccatcgtgggtt

SEQ ID NO: 65811 - DNA, 25 bp, Homo sapien
tacccagaagaacagcagcaccgtg

SEQ ID NO: 65812 - DNA, 25 bp, Homo sapien
gtctgcacttcaggtcccgtcggca

SEQ ID NO: 65813 - DNA, 25 bp, Homo sapien
gagctctagacccaggatccggttg

SEQ ID NO: 65814 - DNA, 25 bp, Homo sapien
tggtagccacatccggcggctgtta

SEQ ID NO: 65815 - DNA, 25 bp, Homo sapien
ggcacctccaacttcctcttggtta

SEQ ID NO: 65816 - DNA, 25 bp, Homo sapien
ggaatccgaggctgtgccaagcacc

SEQ ID NO: 65817 - DNA, 25 bp, Homo sapien
ctgccgccgatagggaaactgactc

SEQ ID NO: 65818 - DNA, 25 bp, Homo sapien
gtggtcccagacgagatagagtatc

SEQ ID NO: 65819 - DNA, 25 bp, Homo sapien
ggcagttcgaccagcaccgatctga

SEQ ID NO: 65820 - DNA, 25 bp, Homo sapien
cagcctaaagctcctcgaaagggtc

SEQ ID NO: 65821 - DNA, 25 bp, Homo sapien
agctcggcgcggatcataatccagc

SEQ ID NO: 65822 - DNA, 25 bp, Homo sapien
cggcttccctggataggtcccttca

SEQ ID NO: 65823 - DNA, 25 bp, Homo sapien
gagggtacccgattctcaaagactg

SEQ ID NO: 65824 - DNA, 25 bp, Homo sapien
ccgtctgcaggagggaagtaaaact

SEQ ID NO: 65825 - DNA, 25 bp, Homo sapien
accgatctgaagacgcctgactctg

SEQ ID NO: 65826 - DNA, 25 bp, Homo sapien
tgctgcccttggaagagcattaccg

SEQ ID NO: 65827 - DNA, 25 bp, Homo sapien
tggcatttaaaccaccgcctggggc

SEQ ID NO: 65828 - DNA, 25 bp, Homo sapien
tgccttgccagtactaggggacttc

SEQ ID NO: 65829 - DNA, 25 bp, Homo sapien
cctcctcaagcccagattatttatc

SEQ ID NO: 65830 - DNA, 25 bp, Homo sapien
gcggagactgagacaccggcactct

SEQ ID NO: 65831 - DNA, 25 bp, Homo sapien
ctggcagtttccttgcaggttcaac

SEQ ID NO: 65832 - DNA, 25 bp, Homo sapien
gagggcgctgttcccaaatcgaagc

SEQ ID NO: 65833 - DNA, 25 bp, Homo sapien
cggagccgaagcatcccttgctgca

SEQ ID NO: 65834 - DNA, 25 bp, Homo sapien
ttgtcaactctctagcgtccaagcc

SEQ ID NO: 65835 - DNA, 25 bp, Homo sapien
ctcgagcagccagaggatttggagc

SEQ ID NO: 65836 - DNA, 25 bp, Homo sapien
agaggcccagaagtaccgtcccagg

SEQ ID NO: 65837 - DNA, 25 bp, Homo sapien
aggctctccgtgtgcttcccgtagc

SEQ ID NO: 65838 - DNA, 25 bp, Homo sapien
ggcttcgcgacgtacaaggccagtg

SEQ ID NO: 65839 - DNA, 25 bp, Homo sapien
cactgaacctgcatcgcgccgtgtt

SEQ ID NO: 65840 - DNA, 25 bp, Homo sapien
gcaggacctctttctctcgagcagc

SEQ ID NO: 65841 - DNA, 25 bp, Homo sapien
ccgcaagggaaaaacgctacctgtg

SEQ ID NO: 65842 - DNA, 25 bp, Homo sapien
ctgagctcgggtgatcatgcacaga

SEQ ID NO: 65843 - DNA, 25 bp, Homo sapien
agtcgagattctgcgcgtcctctcc

SEQ ID NO: 65844 - DNA, 25 bp, Homo sapien
catgcacagattggggccagaagtc

SEQ ID NO: 65845 - DNA, 25 bp, Homo sapien
ttcctcagcggtttctctctgcatc

SEQ ID NO: 65846 - DNA, 25 bp, Homo sapien
cggccctaattcctcagcggtttct

SEQ ID NO: 65847 - DNA, 25 bp, Homo sapien
actctcagcatcagtgccagctctg

SEQ ID NO: 65848 - DNA, 25 bp, Homo sapien
tccttagccactctcagcatcagtg

SEQ ID NO: 65849 - DNA, 25 bp, Homo sapien
agattggggccagaagtcgagattc

SEQ ID NO: 65850 - DNA, 25 bp, Homo sapien
gctctaggccattcggggaaccgct

SEQ ID NO: 65851 - DNA, 25 bp, Homo sapien
cagtgtcttactggaaacttgcagg

SEQ ID NO: 65852 - DNA, 25 bp, Homo sapien
acttgcaggctttgctcctccagcg

SEQ ID NO: 65853 - DNA, 25 bp, Homo sapien
tcctccagcgtcttctaaggtttgg

SEQ ID NO: 65854 - DNA, 25 bp, Homo sapien
tactgcgtgggaagtagtgctttcc

SEQ ID NO: 65855 - DNA, 25 bp, Homo sapien
gtgctttccagaatttgggatttga

SEQ ID NO: 65856 - DNA, 25 bp, Homo sapien
gccaggtctgagttggccagtttga

SEQ ID NO: 65857 - DNA, 25 bp, Homo sapien
ggatttgagattggcccggcattgc

SEQ ID NO: 65858 - DNA, 25 bp, Homo sapien
accggacaggcctgacggcatctgg

SEQ ID NO: 65859 - DNA, 25 bp, Homo sapien
aaccggacaggcctgacggcatctg

SEQ ID NO: 65860 - DNA, 25 bp, Homo sapien
cggaaaccggacaggcctgacggca

SEQ ID NO: 65861 - DNA, 25 bp, Homo sapien
gccgcgcggcgaggttaacggcgga

SEQ ID NO: 65862 - DNA, 25 bp, Homo sapien
cccaactccggagagcgtgaggccg

SEQ ID NO: 65863 - DNA, 25 bp, Homo sapien
cgcccaactccggagagcgtgaggc

SEQ ID NO: 65864 - DNA, 25 bp, Homo sapien
tctcgcccaactccggagagcgtga

SEQ ID NO: 65865 - DNA, 25 bp, Homo sapien
ctgccgaggcggcaactctccctct

SEQ ID NO: 65866 - DNA, 25 bp, Homo sapien
gcagaccactcggttggacatcttg

SEQ ID NO: 65867 - DNA, 25 bp, Homo sapien
cgcctatggtgcacgaggatgaatg

SEQ ID NO: 65868 - DNA, 25 bp, Homo sapien
tgtgtaccagctcccggcgtgactg

SEQ ID NO: 65869 - DNA, 25 bp, Homo sapien
gtgactggcttctcggcagaccact

SEQ ID NO: 65870 - DNA, 25 bp, Homo sapien
cctgaggctgtgtaccagctcccgg

SEQ ID NO: 65871 - DNA, 25 bp, Homo sapien
cggcggcagcaacaatcaccacaaa

SEQ ID NO: 65872 - DNA, 25 bp, Homo sapien
tgcctgtgccgcctatggtgcacga

SEQ ID NO: 65873 - DNA, 25 bp, Homo sapien
aaactccggcgaccgccggaagatg

SEQ ID NO: 65874 - DNA, 25 bp, Homo sapien
tctgcagtccgcgtgagtcctggcc

SEQ ID NO: 65875 - DNA, 25 bp, Homo sapien
gcgcccaagccgttcgttcttaaga

SEQ ID NO: 65876 - DNA, 25 bp, Homo sapien
gctccggccgtaagtgacggctgtc

SEQ ID NO: 65877 - DNA, 25 bp, Homo sapien
tgacggctgtcgcacgactgccgcg

SEQ ID NO: 65878 - DNA, 25 bp, Homo sapien
tccgcgtgagtcctggccaaggtct

SEQ ID NO: 65879 - DNA, 25 bp, Homo sapien
tgcgcagaacctcccggcggacaag

SEQ ID NO: 65880 - DNA, 25 bp, Homo sapien
gcagaaccatcgtcagtccccgagg

SEQ ID NO: 65881 - DNA, 25 bp, Homo sapien
gttcgttcttaagagccctgcaccg

SEQ ID NO: 65882 - DNA, 25 bp, Homo sapien
tccgtggatcgattacgaaggcttc

SEQ ID NO: 65883 - DNA, 25 bp, Homo sapien
ttgccctgcgcatcgatgaggatga

SEQ ID NO: 65884 - DNA, 25 bp, Homo sapien
gccgaactgcacattgggaactgta

SEQ ID NO: 65885 - DNA, 25 bp, Homo sapien
ccgcataagcggaacctgtactatt

SEQ ID NO: 65886 - DNA, 25 bp, Homo sapien
tacccgctgtttgtaggcttcgcgc

SEQ ID NO: 65887 - DNA, 25 bp, Homo sapien
agcgcgtccgagtcttccacaaaca

SEQ ID NO: 65888 - DNA, 25 bp, Homo sapien
ccacaaacaggccttcgagtacatc

SEQ ID NO: 65889 - DNA, 25 bp, Homo sapien
acacctgcgtcccttttctgcggga

SEQ ID NO: 65890 - DNA, 25 bp, Homo sapien
cgaaaaactcctcgttgctccttgc

SEQ ID NO: 65891 - DNA, 25 bp, Homo sapien
ttaacctcaacgcttcaggtcccga

SEQ ID NO: 65892 - DNA, 25 bp, Homo sapien
agagggagccgctctagccgccttc

SEQ ID NO: 65893 - DNA, 25 bp, Homo sapien
ccttccgccacggagtgcagggaca

SEQ ID NO: 65894 - DNA, 25 bp, Homo sapien
cggaggccagagcacgcacttcctc

SEQ ID NO: 65895 - DNA, 25 bp, Homo sapien
cttccgttctgggaaaactcgagca

SEQ ID NO: 65896 - DNA, 25 bp, Homo sapien
ggaaaactcgagcacccagaacggc

SEQ ID NO: 65897 - DNA, 25 bp, Homo sapien
tcgttgctccttgccttgcccttaa

SEQ ID NO: 65898 - DNA, 25 bp, Homo sapien
ggtggtcgccaccaagaagactttg

SEQ ID NO: 65899 - DNA, 25 bp, Homo sapien
ctgtcactgttatggtcctgtcagg

SEQ ID NO: 65900 - DNA, 25 bp, Homo sapien
tttctggcctcgctcgcagcttgca

SEQ ID NO: 65901 - DNA, 25 bp, Homo sapien
cgcagcttgcacgtcgagactcgta

SEQ ID NO: 65902 - DNA, 25 bp, Homo sapien
ggggacttcacctttgtctcctcag

SEQ ID NO: 65903 - DNA, 25 bp, Homo sapien
tctcctcagcagacgcggaaggtga

SEQ ID NO: 65904 - DNA, 25 bp, Homo sapien
ctggaagggctatcacccggaggaa

SEQ ID NO: 65905 - DNA, 25 bp, Homo sapien
agctgactggtgactgcagcccacc

SEQ ID NO: 65906 - DNA, 25 bp, Homo sapien
ggactgtcactgagccgcttcccag

SEQ ID NO: 65907 - DNA, 25 bp, Homo sapien
ctgcgtccggttagatgagagcgaa

SEQ ID NO: 65908 - DNA, 25 bp, Homo sapien
tcaaagtcatcgacggcacctcggg

SEQ ID NO: 65909 - DNA, 25 bp, Homo sapien
ctcagtggtgagtcttccgcacgcc

SEQ ID NO: 65910 - DNA, 25 bp, Homo sapien
ggacttggctttttcagcggctgca

SEQ ID NO: 65911 - DNA, 25 bp, Homo sapien
ccgcttcccagtgtgattgtgctga

SEQ ID NO: 65912 - DNA, 25 bp, Homo sapien
ggcgcctgacttcacttccggctaa

SEQ ID NO: 65913 - DNA, 25 bp, Homo sapien
tagccgcgggaccatcaaagtcatc

SEQ ID NO: 65914 - DNA, 25 bp, Homo sapien
ccagcagctgcctgatgaccgagtg

SEQ ID NO: 65915 - DNA, 25 bp, Homo sapien
ggtgcgactccaatgccgctggcct

SEQ ID NO: 65916 - DNA, 25 bp, Homo sapien
ctgcccactgaggaaacggagaagt

SEQ ID NO: 65917 - DNA, 25 bp, Homo sapien
tatgtgaagcagttcccggaggacg

SEQ ID NO: 65918 - DNA, 25 bp, Homo sapien
cacctgcaccatgtccgagtggatc

SEQ ID NO: 65919 - DNA, 25 bp, Homo sapien
agcgttcactcggtgtgttgcagac

SEQ ID NO: 65920 - DNA, 25 bp, Homo sapien
tgccaccgtgcactgctgcagcgtt

SEQ ID NO: 65921 - DNA, 25 bp, Homo sapien
ccacctgcggcatgggcatgaagaa

SEQ ID NO: 65922 - DNA, 25 bp, Homo sapien
aagccagaccagagagcgtgcgtgt

SEQ ID NO: 65923 - DNA, 25 bp, Homo sapien
ttacggtaactgtcgccactagatt

SEQ ID NO: 65924 - DNA, 25 bp, Homo sapien
attctagggccgcaggtgtatttac

SEQ ID NO: 65925 - DNA, 25 bp, Homo sapien
gcctccttgaggtagtatccgcaca

SEQ ID NO: 65926 - DNA, 25 bp, Homo sapien
tcgggttcttctcctaggcggaagc

SEQ ID NO: 65927 - DNA, 25 bp, Homo sapien
aggctccttactcaagctcgggttc

SEQ ID NO: 65928 - DNA, 25 bp, Homo sapien
tggggcataaccacccaacaggctc

SEQ ID NO: 65929 - DNA, 25 bp, Homo sapien
tatccgcacatggaattctagggcc

SEQ ID NO: 65930 - DNA, 25 bp, Homo sapien
ccgcgttcgcggacattcaacgtcg

SEQ ID NO: 65931 - DNA, 25 bp, Homo sapien
tcaacgtcgcgctcaacgccaggta

SEQ ID NO: 65932 - DNA, 25 bp, Homo sapien
ctgcggaggatcacctacgtggtgc

SEQ ID NO: 65933 - DNA, 25 bp, Homo sapien
cactcggggccacgggagagaaact

SEQ ID NO: 65934 - DNA, 25 bp, Homo sapien
attggctgctcaggtctgacactcg

SEQ ID NO: 65935 - DNA, 25 bp, Homo sapien
caattaggatctgccgcctgacgtc

SEQ ID NO: 65936 - DNA, 25 bp, Homo sapien
cctgacgtcacgtctgccggagatt

SEQ ID NO: 65937 - DNA, 25 bp, Homo sapien
ttcaccaaacaaggcaggcaagttg

SEQ ID NO: 65938 - DNA, 25 bp, Homo sapien
agccttagcttgcaggtcatgtaga

SEQ ID NO: 65939 - DNA, 25 bp, Homo sapien
tgccggcatgtgctagccttagctt

SEQ ID NO: 65940 - DNA, 25 bp, Homo sapien
tgtccggagcgtgcgcaagaaactt

SEQ ID NO: 65941 - DNA, 25 bp, Homo sapien
tacagggcccgcagttttgcacatg

SEQ ID NO: 65942 - DNA, 25 bp, Homo sapien
tactggatcgtgaagctagccgccc

SEQ ID NO: 65943 - DNA, 25 bp, Homo sapien
ctctcggctctcgttattgggtgta

SEQ ID NO: 65944 - DNA, 25 bp, Homo sapien
ggctgttaaaccgagtctctgcatc

SEQ ID NO: 65945 - DNA, 25 bp, Homo sapien
tctgcatcccagacaggagatcggg

SEQ ID NO: 65946 - DNA, 25 bp, Homo sapien
acacgtaggggctattgatgaacac

SEQ ID NO: 65947 - DNA, 25 bp, Homo sapien
ggcgtaagccacacaggcgatgcca

SEQ ID NO: 65948 - DNA, 25 bp, Homo sapien
gggctattgatgaacacgaagatga

SEQ ID NO: 65949 - DNA, 25 bp, Homo sapien
gccacacaggcgatgccagagaaga

SEQ ID NO: 65950 - DNA, 25 bp, Homo sapien
acaggcgatgccagagaagacgatg

SEQ ID NO: 65951 - DNA, 25 bp, Homo sapien
ttgtggtacacgtaggggctattga

SEQ ID NO: 65952 - DNA, 25 bp, Homo sapien
aggccatgtagtcagtgatctcgcc

SEQ ID NO: 65953 - DNA, 25 bp, Homo sapien
aacacgaagatgaggcaggccacga

SEQ ID NO: 65954 - DNA, 25 bp, Homo sapien
caactgtaatgtatttattctaagg

SEQ ID NO: 65955 - DNA, 25 bp, Homo sapien
gaagctgtgaattacaactgtaatg

SEQ ID NO: 65956 - DNA, 25 bp, Homo sapien
ggcctatttctgctagaagctgtga

SEQ ID NO: 65957 - DNA, 25 bp, Homo sapien
cagctggcctatttctgctagaagc

SEQ ID NO: 65958 - DNA, 25 bp, Homo sapien
cctgcaagcagctggcctatttctg

SEQ ID NO: 65959 - DNA, 25 bp, Homo sapien
ctgtcctgcaagcagctggcctatt

SEQ ID NO: 65960 - DNA, 25 bp, Homo sapien
acggggctttctgagcttgggagct

SEQ ID NO: 65961 - DNA, 25 bp, Homo sapien
tttattctaaggactaacatggcac

SEQ ID NO: 65962 - DNA, 25 bp, Homo sapien
tcaccgagtacgaagcgggcgtttg

SEQ ID NO: 65963 - DNA, 25 bp, Homo sapien
tcaatggcgactccctcaccgagta

SEQ ID NO: 65964 - DNA, 25 bp, Homo sapien
acacgtgcgccagccagaggaacga

SEQ ID NO: 65965 - DNA, 25 bp, Homo sapien
tgcctgccctgtgacgagtccaagt

SEQ ID NO: 65966 - DNA, 25 bp, Homo sapien
cgccgcgccagaagtttgggttgaa

SEQ ID NO: 65967 - DNA, 25 bp, Homo sapien
acgccgcggatcttgtgctgcgcca

SEQ ID NO: 65968 - DNA, 25 bp, Homo sapien
cagccataaacaagcgcccggagga

SEQ ID NO: 65969 - DNA, 25 bp, Homo sapien
ctgcggcggcaccttcgggatttac

SEQ ID NO: 65970 - DNA, 25 bp, Homo sapien
agccagcaccgtccagggaacggtt

SEQ ID NO: 65971 - DNA, 25 bp, Homo sapien
gagttattttgatgtggctaacggg

SEQ ID NO: 65972 - DNA, 25 bp, Homo sapien
ggcacggttcggtaagcatcagtta

SEQ ID NO: 65973 - DNA, 25 bp, Homo sapien
gcatcagttaaaagtgggatccctg

SEQ ID NO: 65974 - DNA, 25 bp, Homo sapien
gttaaaagtgggatccctgctctgg

SEQ ID NO: 65975 - DNA, 25 bp, Homo sapien
tccctgctctggctgacgttgggct

SEQ ID NO: 65976 - DNA, 25 bp, Homo sapien
cacgcagcagcctcgtttctgggga

SEQ ID NO: 65977 - DNA, 25 bp, Homo sapien
acgttgggctgatgatgctgttccg

SEQ ID NO: 65978 - DNA, 25 bp, Homo sapien
ggcggaagcacaggctcagcttctc

SEQ ID NO: 65979 - DNA, 25 bp, Homo sapien
ttctcctccaagctgcaggccgggg

SEQ ID NO: 65980 - DNA, 25 bp, Homo sapien
ccggctcctggaactcatagaaatc

SEQ ID NO: 65981 - DNA, 25 bp, Homo sapien
ttacagttctcctggtccaggaggc

SEQ ID NO: 65982 - DNA, 25 bp, Homo sapien
gcgttacagttctcctggtccagga

SEQ ID NO: 65983 - DNA, 25 bp, Homo sapien
ggctcgcgttacagttctcctggtc

SEQ ID NO: 65984 - DNA, 25 bp, Homo sapien
tcctggaactcatagaaatcctgcc

SEQ ID NO: 65985 - DNA, 25 bp, Homo sapien
aggctcggggctcgcgttacagttc

SEQ ID NO: 65986 - DNA, 25 bp, Homo sapien
ttccgacacggacacgcgcatcggg

SEQ ID NO: 65987 - DNA, 25 bp, Homo sapien
acctgcttgaactcggctgacattg

SEQ ID NO: 65988 - DNA, 25 bp, Homo sapien
gggccgtgcagtacacctacgaaca

SEQ ID NO: 65989 - DNA, 25 bp, Homo sapien
aagagtttgagatttccgacacgga

SEQ ID NO: 65990 - DNA, 25 bp, Homo sapien
gtgaccaacctcaccaaagagtttg

SEQ ID NO: 65991 - DNA, 25 bp, Homo sapien
ttccgcaccgtcctccagtttgtga

SEQ ID NO: 65992 - DNA, 25 bp, Homo sapien
ggcttcgtcatcgacggctccagca

SEQ ID NO: 65993 - DNA, 25 bp, Homo sapien
cacctacgaacagcggctggagttt

SEQ ID NO: 65994 - DNA, 25 bp, Homo sapien
cagtcttcctcgcacgcggaagttc

SEQ ID NO: 65995 - DNA, 25 bp, Homo sapien
gcggcgcaccctgttgcattcaaaa

SEQ ID NO: 65996 - DNA, 25 bp, Homo sapien
cgggagggtctttacctgcagctcc

SEQ ID NO: 65997 - DNA, 25 bp, Homo sapien
cacacacggaagttgtcacgccaag

SEQ ID NO: 65998 - DNA, 25 bp, Homo sapien
tgtcacgccaagatacctgcccgag

SEQ ID NO: 65999 - DNA, 25 bp, Homo sapien
tgcccgagctgcacatcttttaagg

SEQ ID NO: 66000 - DNA, 25 bp, Homo sapien
tcctggccgttctgtgaaggaacag

SEQ ID NO: 66001 - DNA, 25 bp, Homo sapien
ttgttgctgaagaagacgccgggac

SEQ ID NO: 66002 - DNA, 25 bp, Homo sapien
cgcccggaccctcggagcagtaaag

SEQ ID NO: 66003 - DNA, 25 bp, Homo sapien
ggtacttctcctggccggagccgtc

SEQ ID NO: 66004 - DNA, 25 bp, Homo sapien
cgagccggtacttctcctggccgga

SEQ ID NO: 66005 - DNA, 25 bp, Homo sapien
agcgccgccacaaatggccgtctgg

SEQ ID NO: 66006 - DNA, 25 bp, Homo sapien
aggcccgctccaggtacctggatga

SEQ ID NO: 66007 - DNA, 25 bp, Homo sapien
gaccacattcctgagaagccctact

SEQ ID NO: 66008 - DNA, 25 bp, Homo sapien
caataaggtggatcggtgcttccca

SEQ ID NO: 66009 - DNA, 25 bp, Homo sapien
tggcctcggccagagcaataaggtg

SEQ ID NO: 66010 - DNA, 25 bp, Homo sapien
tgcgctggccatgactaccgtatca

SEQ ID NO: 66011 - DNA, 25 bp, Homo sapien
gccgcgaatttccaatagagtctgc

SEQ ID NO: 66012 - DNA, 25 bp, Homo sapien
ggcgacctcacctcgtagtctggaa

SEQ ID NO: 66013 - DNA, 25 bp, Homo sapien
caacatgcatgcttcggcgacctca

SEQ ID NO: 66014 - DNA, 25 bp, Homo sapien
aggagtccgtgcgtgtcaacatgca

SEQ ID NO: 66015 - DNA, 25 bp, Homo sapien
gttccgcaggctgtcaatagcacga

SEQ ID NO: 66016 - DNA, 25 bp, Homo sapien
tggctactccaagaaccgcaagcgg

SEQ ID NO: 66017 - DNA, 25 bp, Homo sapien
cgtcagtgacaacaccaggcggtcc

SEQ ID NO: 66018 - DNA, 25 bp, Homo sapien
tcctagggttctccgctggcctagt

SEQ ID NO: 66019 - DNA, 25 bp, Homo sapien
aattggcgctggatccagagtgcgc

SEQ ID NO: 66020 - DNA, 25 bp, Homo sapien
tggcctagtccgctggccgcactag

SEQ ID NO: 66021 - DNA, 25 bp, Homo sapien
gcacaagccctcgtctgctacggga

SEQ ID NO: 66022 - DNA, 25 bp, Homo sapien
agagctggttctcagtttcgttttc

SEQ ID NO: 66023 - DNA, 25 bp, Homo sapien
ttcgggagagctggttctcagtttc

SEQ ID NO: 66024 - DNA, 25 bp, Homo sapien
cttcggatcagcgtccgcgtcctga

SEQ ID NO: 66025 - DNA, 25 bp, Homo sapien
tctgctacgggattggggtaaattg

SEQ ID NO: 66026 - DNA, 25 bp, Homo sapien
ggcttccgacccagcattgcacatt

SEQ ID NO: 66027 - DNA, 25 bp, Homo sapien
cccgtgtgatgttaactgcatgaca

SEQ ID NO: 66028 - DNA, 25 bp, Homo sapien
cgcacctcaggtaagactctggcga

SEQ ID NO: 66029 - DNA, 25 bp, Homo sapien
ggtgtcactgccttaattcactgga

SEQ ID NO: 66030 - DNA, 25 bp, Homo sapien
agctctcggcctctgttgaaaagtc

SEQ ID NO: 66031 - DNA, 25 bp, Homo sapien
ttgctgcttgaaaccgcgtagcctg

SEQ ID NO: 66032 - DNA, 25 bp, Homo sapien
tgaaaagtcgtcctctgcacagcta

SEQ ID NO: 66033 - DNA, 25 bp, Homo sapien
cagaggcggcttcgtgttaaacttc

SEQ ID NO: 66034 - DNA, 25 bp, Homo sapien
aggccgcttggcatggaactccaaa

SEQ ID NO: 66035 - DNA, 25 bp, Homo sapien
acgcgcgtgaaactcagcctatttc

SEQ ID NO: 66036 - DNA, 25 bp, Homo sapien
tcttctcccggaaatggtctaagcc

SEQ ID NO: 66037 - DNA, 25 bp, Homo sapien
gcgccttcctcagctcttcagttga

SEQ ID NO: 66038 - DNA, 25 bp, Homo sapien
gtccggtacaaacgcaatagggctg

SEQ ID NO: 66039 - DNA, 25 bp, Homo sapien
gcagtcagcctagccaccttcggaa

SEQ ID NO: 66040 - DNA, 25 bp, Homo sapien
cccattctcggcttcactagtatta

SEQ ID NO: 66041 - DNA, 25 bp, Homo sapien
cacatgcttcagaggctgggatctc

SEQ ID NO: 66042 - DNA, 25 bp, Homo sapien
gtcgcgagcgtgtctatcagttaca

SEQ ID NO: 66043 - DNA, 25 bp, Homo sapien
gagagctgcttccaccctgagatgt

SEQ ID NO: 66044 - DNA, 25 bp, Homo sapien
acttgtaaggcgtccagagcagaga

SEQ ID NO: 66045 - DNA, 25 bp, Homo sapien
tctactgccgtgcactcttgaggga

SEQ ID NO: 66046 - DNA, 25 bp, Homo sapien
ctgttgccgacggtactgtcttttc

SEQ ID NO: 66047 - DNA, 25 bp, Homo sapien
cgcgaactttttcggtgtctgttca

SEQ ID NO: 66048 - DNA, 25 bp, Homo sapien
cccgaggcgactacttacagtggca

SEQ ID NO: 66049 - DNA, 25 bp, Homo sapien
tgagatgtcacagccctcccgcatg

SEQ ID NO: 66050 - DNA, 25 bp, Homo sapien
tgaagcctagaagccgcccacagac

SEQ ID NO: 66051 - DNA, 25 bp, Homo sapien
ccacagacggcagaactgaaaccta

SEQ ID NO: 66052 - DNA, 25 bp, Homo sapien
ggccgcccacagacggcagaactga

SEQ ID NO: 66053 - DNA, 25 bp, Homo sapien
aactgaagcctagaagccgcccaca

SEQ ID NO: 66054 - DNA, 25 bp, Homo sapien
ccacagacggcagaactgaagccta

SEQ ID NO: 66055 - DNA, 25 bp, Homo sapien
ccacggatggcagaactgaaaccta

SEQ ID NO: 66056 - DNA, 25 bp, Homo sapien
ctgaagcctagaagccgcccacaga

SEQ ID NO: 66057 - DNA, 25 bp, Homo sapien
agaactgaagcctacaagccgccca

SEQ ID NO: 66058 - DNA, 25 bp, Homo sapien
atactcgccggggtgcctcggccag

SEQ ID NO: 66059 - DNA, 25 bp, Homo sapien
ctgataggcacaggaaatgtgtctc

SEQ ID NO: 66060 - DNA, 25 bp, Homo sapien
aggagtcggggctctgcatactcgc

SEQ ID NO: 66061 - DNA, 25 bp, Homo sapien
tacttgagcggctctggtccgatgc

SEQ ID NO: 66062 - DNA, 25 bp, Homo sapien
ctgcgtagttgtacttgagcggctc

SEQ ID NO: 66063 - DNA, 25 bp, Homo sapien
ggggctgtttctgcgtagttgtact

SEQ ID NO: 66064 - DNA, 25 bp, Homo sapien
tcccagacagactcggagagatggc

SEQ ID NO: 66065 - DNA, 25 bp, Homo sapien
cacaggaaatgtgtctcgccggcgg

SEQ ID NO: 66066 - DNA, 25 bp, Homo sapien
cgggacagactcacagacaggtaga

SEQ ID NO: 66067 - DNA, 25 bp, Homo sapien
cgtggtgcctgctcaccgcattatc

SEQ ID NO: 66068 - DNA, 25 bp, Homo sapien
ccagtaggcgacttctctcggagaa

SEQ ID NO: 66069 - DNA, 25 bp, Homo sapien
gaagatgccgctttcgactccctaa

SEQ ID NO: 66070 - DNA, 25 bp, Homo sapien
tgcacggggacaataggactccgcc

SEQ ID NO: 66071 - DNA, 25 bp, Homo sapien
gagggtcgcgttctgtcagtttcta

SEQ ID NO: 66072 - DNA, 25 bp, Homo sapien
ctgagcaactggacacgcgacgaac

SEQ ID NO: 66073 - DNA, 25 bp, Homo sapien
agctgcagccaaaacccggagagtg

SEQ ID NO: 66074 - DNA, 25 bp, Homo sapien
cccatagtggcttcccgggttcatc

SEQ ID NO: 66075 - DNA, 25 bp, Homo sapien
gcaaaaggtgcacccaacgccagtc

SEQ ID NO: 66076 - DNA, 25 bp, Homo sapien
gccagtcccggtagagttgaaccca

SEQ ID NO: 66077 - DNA, 25 bp, Homo sapien
gcctccgctatctgggtcaggacgc

SEQ ID NO: 66078 - DNA, 25 bp, Homo sapien
tggtctccgctctccaacagctgaa

SEQ ID NO: 66079 - DNA, 25 bp, Homo sapien
agtgaacacaggtgcgtgcgcagtc

SEQ ID NO: 66080 - DNA, 25 bp, Homo sapien
cctggcgaagcttgagcctgctagc

SEQ ID NO: 66081 - DNA, 25 bp, Homo sapien
cccgcgacgtgcaattttattttgc

SEQ ID NO: 66082 - DNA, 25 bp, Homo sapien
ggcgtcaattcccatgcccttgcgg

SEQ ID NO: 66083 - DNA, 25 bp, Homo sapien
tcgaggtttcctcacagcgttgaga

SEQ ID NO: 66084 - DNA, 25 bp, Homo sapien
ccactcgagtctcttggcgtcgtca

SEQ ID NO: 66085 - DNA, 25 bp, Homo sapien
atccatctgaagaggtcgccgggca

SEQ ID NO: 66086 - DNA, 25 bp, Homo sapien
gcggtggcgcttgatttcctttaaa

SEQ ID NO: 66087 - DNA, 25 bp, Homo sapien
cgcgtaacggttcctgcaatctggg

SEQ ID NO: 66088 - DNA, 25 bp, Homo sapien
ggcgtgtttccacctcgctgtaacc

SEQ ID NO: 66089 - DNA, 25 bp, Homo sapien
ccttgcggctctcacaactggagtc

SEQ ID NO: 66090 - DNA, 25 bp, Homo sapien
tcgaggagctaggaagctgtaagcc

SEQ ID NO: 66091 - DNA, 25 bp, Homo sapien
agccatcatgaagcggctccctggc

SEQ ID NO: 66092 - DNA, 25 bp, Homo sapien
tgtaagcctgtgaaaagccaagcca

SEQ ID NO: 66093 - DNA, 25 bp, Homo sapien
ctagcaggctgtgctcgaggagcta

SEQ ID NO: 66094 - DNA, 25 bp, Homo sapien
agctagaacatgctggggcaccgcg

SEQ ID NO: 66095 - DNA, 25 bp, Homo sapien
gctcaggagcccttggcattcctcg

SEQ ID NO: 66096 - DNA, 25 bp, Homo sapien
ctccggaagggcactgagctagaac

SEQ ID NO: 66097 - DNA, 25 bp, Homo sapien
cgtgccgacggtcgccagcagacag

SEQ ID NO: 66098 - DNA, 25 bp, Homo sapien
agcgaacgcccaccagctaacgggt

SEQ ID NO: 66099 - DNA, 25 bp, Homo sapien
tcgtggacgagacgtggttaaccgc

SEQ ID NO: 66100 - DNA, 25 bp, Homo sapien
cgtccaagtgactcgtaaacggctc

SEQ ID NO: 66101 - DNA, 25 bp, Homo sapien
gtttgacacgaaaatctagacttgc

SEQ ID NO: 66102 - DNA, 25 bp, Homo sapien
tgcggactgcggttccctccaggaa

SEQ ID NO: 66103 - DNA, 25 bp, Homo sapien
tgtctaaggagctttcggacccggc

SEQ ID NO: 66104 - DNA, 25 bp, Homo sapien
cgccatcttgtaccgatttaaaatt

SEQ ID NO: 66105 - DNA, 25 bp, Homo sapien
gacccggcagcaaggtgtctgctcc

SEQ ID NO: 66106 - DNA, 25 bp, Homo sapien
aggtggcgccacacggctacctgcg

SEQ ID NO: 66107 - DNA, 25 bp, Homo sapien
agcggtcgcagttctgttagccagg

SEQ ID NO: 66108 - DNA, 25 bp, Homo sapien
gagaagatcctccaggctaaggtcc

SEQ ID NO: 66109 - DNA, 25 bp, Homo sapien
caggctaaggtccaaggcccatctc

SEQ ID NO: 66110 - DNA, 25 bp, Homo sapien
cctgggctttggctttgtcctcaac

SEQ ID NO: 66111 - DNA, 25 bp, Homo sapien
ccagttcggtgccaagaggcacgcc

SEQ ID NO: 66112 - DNA, 25 bp, Homo sapien
cctgggtctccctccttagcggaga

SEQ ID NO: 66113 - DNA, 25 bp, Homo sapien
ctgttagccagggttgcgttcccac

SEQ ID NO: 66114 - DNA, 25 bp, Homo sapien
cgcgctttgttaccggctgagagaa

SEQ ID NO: 66115 - DNA, 25 bp, Homo sapien
cttcctcggccgagtagtcgatctc

SEQ ID NO: 66116 - DNA, 25 bp, Homo sapien
cctcctcggtcttgagacgcttggc

SEQ ID NO: 66117 - DNA, 25 bp, Homo sapien
ctgtgagggccgttcgtcaaaagcc

SEQ ID NO: 66118 - DNA, 25 bp, Homo sapien
tccctgcccggaggagcgaatctaa

SEQ ID NO: 66119 - DNA, 25 bp, Homo sapien
aggatcgaatccagccgcagcctgc

SEQ ID NO: 66120 - DNA, 25 bp, Homo sapien
cctgggagtagttgcgacccgcaac

SEQ ID NO: 66121 - DNA, 25 bp, Homo sapien
cgcagcggaaaaggctaactgaagc

SEQ ID NO: 66122 - DNA, 25 bp, Homo sapien
ccacgatcttacagctgcggccaga

SEQ ID NO: 66123 - DNA, 25 bp, Homo sapien
acggtcctcaatgtgcgcaaaatgg

SEQ ID NO: 66124 - DNA, 25 bp, Homo sapien
gtaccgcccgtaacgcgacatgatg

SEQ ID NO: 66125 - DNA, 25 bp, Homo sapien
cgacatgatgacagacccgcgtgct

SEQ ID NO: 66126 - DNA, 25 bp, Homo sapien
cgcgtgctcggctctttagcaagca

SEQ ID NO: 66127 - DNA, 25 bp, Homo sapien
agagcccgggttcgcgtttatatat

SEQ ID NO: 66128 - DNA, 25 bp, Homo sapien
gctcacagctgccaatttcgttcta

SEQ ID NO: 66129 - DNA, 25 bp, Homo sapien
cgtcatctcgttgttctgcgcggca

SEQ ID NO: 66130 - DNA, 25 bp, Homo sapien
ggagctgtcctagcgcctagttctc

SEQ ID NO: 66131 - DNA, 25 bp, Homo sapien
acaacgcgcatcacttgtccgcaga

SEQ ID NO: 66132 - DNA, 25 bp, Homo sapien
tccgcagaagtggaagacgtacctg

SEQ ID NO: 66133 - DNA, 25 bp, Homo sapien
tggacttggccaccctcacgattct

SEQ ID NO: 66134 - DNA, 25 bp, Homo sapien
acgattctcacttggagcagcctgc

SEQ ID NO: 66135 - DNA, 25 bp, Homo sapien
aaccaagtcgcacctggagctgtcc

SEQ ID NO: 66136 - DNA, 25 bp, Homo sapien
ggcggcagacacactgacaaacagg

SEQ ID NO: 66137 - DNA, 25 bp, Homo sapien
ccctcgcgtattcgcttccgggtga

SEQ ID NO: 66138 - DNA, 25 bp, Homo sapien
agagccttctggcaccgacgcagtt

SEQ ID NO: 66139 - DNA, 25 bp, Homo sapien
accggccgtaagcacagctcttttg

SEQ ID NO: 66140 - DNA, 25 bp, Homo sapien
gagaggcctgcactaaccggccgta

SEQ ID NO: 66141 - DNA, 25 bp, Homo sapien
ccgcggcctacgaagagttcgagta

SEQ ID NO: 66142 - DNA, 25 bp, Homo sapien
gccctacgacgaggagccgttccag

SEQ ID NO: 66143 - DNA, 25 bp, Homo sapien
gtccagcctggacatctgcttcctg

SEQ ID NO: 66144 - DNA, 25 bp, Homo sapien
tctctcaaagagttcccgcgtgcgc

SEQ ID NO: 66145 - DNA, 25 bp, Homo sapien
tctgcaggaagcatcccgagttctc

SEQ ID NO: 66146 - DNA, 25 bp, Homo sapien
cctggaagctgctctatcttaactt

SEQ ID NO: 66147 - DNA, 25 bp, Homo sapien
cgtcctcaagatcgaaaagcccaga

SEQ ID NO: 66148 - DNA, 25 bp, Homo sapien
ctctatcttaactttgggcggtttg

SEQ ID NO: 66149 - DNA, 25 bp, Homo sapien
gccttcgccctcagggacttcggaa

SEQ ID NO: 66150 - DNA, 25 bp, Homo sapien
ggcggcgcaaaacacccgccgtgta

SEQ ID NO: 66151 - DNA, 25 bp, Homo sapien
ccaccgcccagctcttgagagggga

SEQ ID NO: 66152 - DNA, 25 bp, Homo sapien
tatgcgaactcgaacgacaggcacc

SEQ ID NO: 66153 - DNA, 25 bp, Homo sapien
ttgcggttaacagacgcgcgaccta

SEQ ID NO: 66154 - DNA, 25 bp, Homo sapien
ctgactgactgttgacggcaagccg

SEQ ID NO: 66155 - DNA, 25 bp, Homo sapien
gaggaaacccgatggcctagccagc

SEQ ID NO: 66156 - DNA, 25 bp, Homo sapien
cgtagtaaccggaaggctcagtcca

SEQ ID NO: 66157 - DNA, 25 bp, Homo sapien
ctccagacgaggcaaccggaaggct

SEQ ID NO: 66158 - DNA, 25 bp, Homo sapien
caacccgaaggctccgtgcagacga

SEQ ID NO: 66159 - DNA, 25 bp, Homo sapien
cagacgaggaaacccgatggcctag

SEQ ID NO: 66160 - DNA, 25 bp, Homo sapien
gccagccgctgactgactgttgacg

SEQ ID NO: 66161 - DNA, 25 bp, Homo sapien
ccagacgacgaaacccgaaggctcg

SEQ ID NO: 66162 - DNA, 25 bp, Homo sapien
acacaggtaccagccgtggagaacg

SEQ ID NO: 66163 - DNA, 25 bp, Homo sapien
tgaacctgctcgctactgagcatgc

SEQ ID NO: 66164 - DNA, 25 bp, Homo sapien
cttcctactagcgaactgaacctgc

SEQ ID NO: 66165 - DNA, 25 bp, Homo sapien
gctccgcgtagttgggactccgaaa

SEQ ID NO: 66166 - DNA, 25 bp, Homo sapien
ctcttcgctgaaaaactcgtagggc

SEQ ID NO: 66167 - DNA, 25 bp, Homo sapien
tttttcagcgcaggcaccagtagtc

SEQ ID NO: 66168 - DNA, 25 bp, Homo sapien
ccgtccttttggagacgcggcgaga

SEQ ID NO: 66169 - DNA, 25 bp, Homo sapien
ggtgtagcgctggagcttcctacta

SEQ ID NO: 66170 - DNA, 25 bp, Homo sapien
cgtgcggactcagaaacgtgcagac

SEQ ID NO: 66171 - DNA, 25 bp, Homo sapien
tctaaggagcctcacgccacggcgg

SEQ ID NO: 66172 - DNA, 25 bp, Homo sapien
aggcgcagaggcttcttttcgcttc

SEQ ID NO: 66173 - DNA, 25 bp, Homo sapien
cctcagcttttaccgccgacgggtg

SEQ ID NO: 66174 - DNA, 25 bp, Homo sapien
tgtagacgtaaaagtgtcgcccacc

SEQ ID NO: 66175 - DNA, 25 bp, Homo sapien
tcagaaacgtgcagacgggtaggca

SEQ ID NO: 66176 - DNA, 25 bp, Homo sapien
tccaggcgggctagccgagttccga

SEQ ID NO: 66177 - DNA, 25 bp, Homo sapien
acgccacggcggacgtgacgcacga

SEQ ID NO: 66178 - DNA, 25 bp, Homo sapien
atggcggattccctccagtttctcc

SEQ ID NO: 66179 - DNA, 25 bp, Homo sapien
gccaggccggagatgctgaatcact

SEQ ID NO: 66180 - DNA, 25 bp, Homo sapien
tggttgcggcctccagcaaaactga

SEQ ID NO: 66181 - DNA, 25 bp, Homo sapien
tcgctcagcgatctacagagaagtc

SEQ ID NO: 66182 - DNA, 25 bp, Homo sapien
tcgggattcaacgtaccatggtggc

SEQ ID NO: 66183 - DNA, 25 bp, Homo sapien
cgtagcccttctaggttcctgtgta

SEQ ID NO: 66184 - DNA, 25 bp, Homo sapien
ggctgcatctaaagtcgtccgagtc

SEQ ID NO: 66185 - DNA, 25 bp, Homo sapien
gcagggtagcgcagtctattccaga

SEQ ID NO: 66186 - DNA, 25 bp, Homo sapien
aggaggcgccgtgtacccagcgact

SEQ ID NO: 66187 - DNA, 25 bp, Homo sapien
tttcttggttcctgcaactgggatc

SEQ ID NO: 66188 - DNA, 25 bp, Homo sapien
tgggatccgcagtctagacctcgcg

SEQ ID NO: 66189 - DNA, 25 bp, Homo sapien
ttactgcacccacagggcgacggtg

SEQ ID NO: 66190 - DNA, 25 bp, Homo sapien
ggtcagtgctgccacctcgaatccg

SEQ ID NO: 66191 - DNA, 25 bp, Homo sapien
aagcttcgagcagcgccgaacagcc

SEQ ID NO: 66192 - DNA, 25 bp, Homo sapien
tgtacccagcgacttcggagccagc

SEQ ID NO: 66193 - DNA, 25 bp, Homo sapien
cgacggtgacgaagcttcgagcagc

SEQ ID NO: 66194 - DNA, 25 bp, Homo sapien
ggacaaatcgaagccggggttcatg

SEQ ID NO: 66195 - DNA, 25 bp, Homo sapien
tggcgccagcgtctcccgaggacag

SEQ ID NO: 66196 - DNA, 25 bp, Homo sapien
gccgctgccgatgcgctgaatcagc

SEQ ID NO: 66197 - DNA, 25 bp, Homo sapien
tcagctcgaagtcctcctgcgggtt

SEQ ID NO: 66198 - DNA, 25 bp, Homo sapien
actccaacatggcttccgctttcgc

SEQ ID NO: 66199 - DNA, 25 bp, Homo sapien
ccacaaggagaggagaaccctcgca

SEQ ID NO: 66200 - DNA, 25 bp, Homo sapien
ctcgctcggggtgaaactccaacat

SEQ ID NO: 66201 - DNA, 25 bp, Homo sapien
gcgctgaatcagctcgaagtcctcc

SEQ ID NO: 66202 - DNA, 25 bp, Homo sapien
cccggaccagaagaaccgcctgatg

SEQ ID NO: 66203 - DNA, 25 bp, Homo sapien
gggctgctcgtcacggccatcttca

SEQ ID NO: 66204 - DNA, 25 bp, Homo sapien
agaaccgcctgatgccgctgtcgca

SEQ ID NO: 66205 - DNA, 25 bp, Homo sapien
ttcgccacctactcgggcctctgga

SEQ ID NO: 66206 - DNA, 25 bp, Homo sapien
ctctggaggaagtgctacttcctgg

SEQ ID NO: 66207 - DNA, 25 bp, Homo sapien
acttcctgggcatcgaccgggacat

SEQ ID NO: 66208 - DNA, 25 bp, Homo sapien
cgccacaaggagagctgcgagcgca

SEQ ID NO: 66209 - DNA, 25 bp, Homo sapien
catcttcaccgaccactggtacgag

SEQ ID NO: 66210 - DNA, 25 bp, Homo sapien
cgcgacccgcagtgcagaagaatcg

SEQ ID NO: 66211 - DNA, 25 bp, Homo sapien
gaagcgcctgccagtcaacctcggg

SEQ ID NO: 66212 - DNA, 25 bp, Homo sapien
gtgcagaagaatcgggcgccagcct

SEQ ID NO: 66213 - DNA, 25 bp, Homo sapien
attacgaacggctccaggccgcgac

SEQ ID NO: 66214 - DNA, 25 bp, Homo sapien
tctcgcattacgaacggctccaggc

SEQ ID NO: 66215 - DNA, 25 bp, Homo sapien
gcagcgaggccaactcacctgcgtg

SEQ ID NO: 66216 - DNA, 25 bp, Homo sapien
agaggggcgccagcgacgctttccc

SEQ ID NO: 66217 - DNA, 25 bp, Homo sapien
ctccacgcgcctccgacatggcggc

SEQ ID NO: 66218 - DNA, 25 bp, Homo sapien
tggacttagctcttcgcgccctgaa

SEQ ID NO: 66219 - DNA, 25 bp, Homo sapien
tgcattcggggtggacttagctctt

SEQ ID NO: 66220 - DNA, 25 bp, Homo sapien
cccagcagctctgcattcggggtgg

SEQ ID NO: 66221 - DNA, 25 bp, Homo sapien
atgagcacccaacgcccgctggaaa

SEQ ID NO: 66222 - DNA, 25 bp, Homo sapien
tccgtggtgaatgagcacccaacgc

SEQ ID NO: 66223 - DNA, 25 bp, Homo sapien
ctccgcagtccgtggtgaatgagca

SEQ ID NO: 66224 - DNA, 25 bp, Homo sapien
ctcctctccgcagtccgtggtgaat

SEQ ID NO: 66225 - DNA, 25 bp, Homo sapien
gcgccctgaatcctcagagcccagc

SEQ ID NO: 66226 - DNA, 25 bp, Homo sapien
cagcgtgcaggtcttcacggggcac

SEQ ID NO: 66227 - DNA, 25 bp, Homo sapien
gtcttcacggggcaccgtgcaggtc

SEQ ID NO: 66228 - DNA, 25 bp, Homo sapien
agcgtgcaggtcttcacggggcacc

SEQ ID NO: 66229 - DNA, 25 bp, Homo sapien
tcacggggcaccgtgcaggtcttca

SEQ ID NO: 66230 - DNA, 25 bp, Homo sapien
caccgtgcaggtcttcacgaggcag

SEQ ID NO: 66231 - DNA, 25 bp, Homo sapien
gtcttcacgaggcagcgtgcaggtc

SEQ ID NO: 66232 - DNA, 25 bp, Homo sapien
cacggggcaccgtgcaggtcttcac

SEQ ID NO: 66233 - DNA, 25 bp, Homo sapien
accgtgcaggtcttcacgaggcagc

SEQ ID NO: 66234 - DNA, 25 bp, Homo sapien
ttccggggacgcagtgataagcgca

SEQ ID NO: 66235 - DNA, 25 bp, Homo sapien
tctgcggggcaacagcacgaggcat

SEQ ID NO: 66236 - DNA, 25 bp, Homo sapien
ggctaagtctcttaagggacgtctg

SEQ ID NO: 66237 - DNA, 25 bp, Homo sapien
ccgtggatgataattggctaagtct

SEQ ID NO: 66238 - DNA, 25 bp, Homo sapien
gacagcgctaggctctccacggtaa

SEQ ID NO: 66239 - DNA, 25 bp, Homo sapien
gcacgctgcacggttcttctccggg

SEQ ID NO: 66240 - DNA, 25 bp, Homo sapien
gccgtccgtcctgagttggagagaa

SEQ ID NO: 66241 - DNA, 25 bp, Homo sapien
gcaagtagggctccttccgcacgct

SEQ ID NO: 66242 - DNA, 25 bp, Homo sapien
ttgcgctgcagtccggatggagctc

SEQ ID NO: 66243 - DNA, 25 bp, Homo sapien
gatggagctcggttctgacccagaa

SEQ ID NO: 66244 - DNA, 25 bp, Homo sapien
ttctgacccagaacatgagatcggg

SEQ ID NO: 66245 - DNA, 25 bp, Homo sapien
agatcgggttctcattaattcagcc

SEQ ID NO: 66246 - DNA, 25 bp, Homo sapien
tctcattaattcagcccagggcctt

SEQ ID NO: 66247 - DNA, 25 bp, Homo sapien
gttcttggccgcttcagctcggttt

SEQ ID NO: 66248 - DNA, 25 bp, Homo sapien
cagctcggtttgctgcttaccaacc

SEQ ID NO: 66249 - DNA, 25 bp, Homo sapien
catttctttggcttgcgctgcagtc

SEQ ID NO: 66250 - DNA, 25 bp, Homo sapien
tttcctgatggtcccaacacgtcgg

SEQ ID NO: 66251 - DNA, 25 bp, Homo sapien
gggcgctctccaagtcctgcttcag

SEQ ID NO: 66252 - DNA, 25 bp, Homo sapien
gatggtcccaacacgtcggcctacg

SEQ ID NO: 66253 - DNA, 25 bp, Homo sapien
gtcctgcttcagtccctgtctcgtg

SEQ ID NO: 66254 - DNA, 25 bp, Homo sapien
agagcgctggcatttcctgatggtc

SEQ ID NO: 66255 - DNA, 25 bp, Homo sapien
ctgatacgataagtagagcgctggc

SEQ ID NO: 66256 - DNA, 25 bp, Homo sapien
ctcgtggctttgactgatacgataa

SEQ ID NO: 66257 - DNA, 25 bp, Homo sapien
gtccctgtctcgtggctttgactga

SEQ ID NO: 66258 - DNA, 25 bp, Homo sapien
tttcctccacgctgcgcggtatgtg

SEQ ID NO: 66259 - DNA, 25 bp, Homo sapien
gcgccgcaggaggaatcccagccat

SEQ ID NO: 66260 - DNA, 25 bp, Homo sapien
cgggccaccagaccggcctttccag

SEQ ID NO: 66261 - DNA, 25 bp, Homo sapien
tccgccgtgctgctcgggattccgg

SEQ ID NO: 66262 - DNA, 25 bp, Homo sapien
acgctgcgcggtatgtggcctgccc

SEQ ID NO: 66263 - DNA, 25 bp, Homo sapien
cgctccagggacgaggactcaggtc

SEQ ID NO: 66264 - DNA, 25 bp, Homo sapien
ttcacggggctctggaggcccagat

SEQ ID NO: 66265 - DNA, 25 bp, Homo sapien
ccttctcgagggttcacggggctct

SEQ ID NO: 66266 - DNA, 25 bp, Homo sapien
tcagcatcgcctgtgccttcttctt

SEQ ID NO: 66267 - DNA, 25 bp, Homo sapien
gcggcagctaaactggtcctggaga

SEQ ID NO: 66268 - DNA, 25 bp, Homo sapien
agcgagacgccaaagccatgcggtc

SEQ ID NO: 66269 - DNA, 25 bp, Homo sapien
cccgagagtctgaggaacggctacg

SEQ ID NO: 66270 - DNA, 25 bp, Homo sapien
tgccgcttctgcaacgtggagctgc

SEQ ID NO: 66271 - DNA, 25 bp, Homo sapien
ccagcttcgtctggtgggtctcctt

SEQ ID NO: 66272 - DNA, 25 bp, Homo sapien
agcgtgtgttcgcacagcttgagcc

SEQ ID NO: 66273 - DNA, 25 bp, Homo sapien
cagccctgacgggttgcgaaccagg

SEQ ID NO: 66274 - DNA, 25 bp, Homo sapien
cgacaccgcgtgaatctggaaagcc

SEQ ID NO: 66275 - DNA, 25 bp, Homo sapien
gagacggaacattgttccgccttta

SEQ ID NO: 66276 - DNA, 25 bp, Homo sapien
aggcccaaccatcggcggctttgca

SEQ ID NO: 66277 - DNA, 25 bp, Homo sapien
tttcaacaggcccaaccatcggcgg

SEQ ID NO: 66278 - DNA, 25 bp, Homo sapien
cgtgaatctggaaagccccgagttt

SEQ ID NO: 66279 - DNA, 25 bp, Homo sapien
tccgcctttaattcttcccaggagc

SEQ ID NO: 66280 - DNA, 25 bp, Homo sapien
cgcctttaattcttcccaggagctg

SEQ ID NO: 66281 - DNA, 25 bp, Homo sapien
ccgcaaaggcgacaccgcgtgaatc

SEQ ID NO: 66282 - DNA, 25 bp, Homo sapien
gccactctgtcggtccgctgaatga

SEQ ID NO: 66283 - DNA, 25 bp, Homo sapien
agtcctgcgtcttctgcgaagggta

SEQ ID NO: 66284 - DNA, 25 bp, Homo sapien
caagatggacggtttcgccggcagt

SEQ ID NO: 66285 - DNA, 25 bp, Homo sapien
ggcagcggctccactgcacatgttc

SEQ ID NO: 66286 - DNA, 25 bp, Homo sapien
tcaggctcagcgtcggccactctgt

SEQ ID NO: 66287 - DNA, 25 bp, Homo sapien
cctagagaacgagcgggtcaggctc

SEQ ID NO: 66288 - DNA, 25 bp, Homo sapien
ctctcaacgtgacggggaagtggtt

SEQ ID NO: 66289 - DNA, 25 bp, Homo sapien
tgcacatgttcccttcgaggctgcc

SEQ ID NO: 66290 - DNA, 25 bp, Homo sapien
gcgtctcttgctttaccgaacttta

SEQ ID NO: 66291 - DNA, 25 bp, Homo sapien
catgctcctgccaacttctgcgtga

SEQ ID NO: 66292 - DNA, 25 bp, Homo sapien
ccactcgtacctgcgggctataggc

SEQ ID NO: 66293 - DNA, 25 bp, Homo sapien
tctgcgtgaagccactaaacttgta

SEQ ID NO: 66294 - DNA, 25 bp, Homo sapien
tcgaagccggttgggaattccacca

SEQ ID NO: 66295 - DNA, 25 bp, Homo sapien
ttccaccatccgagagagtctgtgc

SEQ ID NO: 66296 - DNA, 25 bp, Homo sapien
atgcgcaagcgctccacggactaag

SEQ ID NO: 66297 - DNA, 25 bp, Homo sapien
ggctgcccgaagatcgcctaactta

SEQ ID NO: 66298 - DNA, 25 bp, Homo sapien
gccatcgggatgaattgggcagtcc

SEQ ID NO: 66299 - DNA, 25 bp, Homo sapien
cacgttcagcaccaccgaggccgcc

SEQ ID NO: 66300 - DNA, 25 bp, Homo sapien
ccgctgcgcccgaaggtcatggctg

SEQ ID NO: 66301 - DNA, 25 bp, Homo sapien
gtccctgggctcgagtatctccggc

SEQ ID NO: 66302 - DNA, 25 bp, Homo sapien
ggctcgagtatctccggcgctgcta

SEQ ID NO: 66303 - DNA, 25 bp, Homo sapien
gcgctgctagtagcgcgccctccgc

SEQ ID NO: 66304 - DNA, 25 bp, Homo sapien
agcagctcccgggacagcgaatacc

SEQ ID NO: 66305 - DNA, 25 bp, Homo sapien
acacctcgagcacgtcgcgctcgga

SEQ ID NO: 66306 - DNA, 25 bp, Homo sapien
ctccacgaaaccctcatcggggtag

SEQ ID NO: 66307 - DNA, 25 bp, Homo sapien
tgcacgccaactgccgggagccaag

SEQ ID NO: 66308 - DNA, 25 bp, Homo sapien
ccgcccagtgtttagggccaggcct

SEQ ID NO: 66309 - DNA, 25 bp, Homo sapien
gcccagtgtttagggccaggcctct

SEQ ID NO: 66310 - DNA, 25 bp, Homo sapien
cgagtgcacgccaactgccgggagc

SEQ ID NO: 66311 - DNA, 25 bp, Homo sapien
tcggaggtaggcaggctcggcccga

SEQ ID NO: 66312 - DNA, 25 bp, Homo sapien
tgtttagggccaggcctctacttgg

SEQ ID NO: 66313 - DNA, 25 bp, Homo sapien
caggcctctacttgggggtacgaat

SEQ ID NO: 66314 - DNA, 25 bp, Homo sapien
gttggaagtcccagcacctgagaac

SEQ ID NO: 66315 - DNA, 25 bp, Homo sapien
taaccagaatcccaagctcacgagg

SEQ ID NO: 66316 - DNA, 25 bp, Homo sapien
ctcccggcggaggacaaagaatcca

SEQ ID NO: 66317 - DNA, 25 bp, Homo sapien
gcgctgggctcaagatttggctttc

SEQ ID NO: 66318 - DNA, 25 bp, Homo sapien
cccgcaggtcccgattcaaggtgag

SEQ ID NO: 66319 - DNA, 25 bp, Homo sapien
cgtgctgaactccttaggcgtctta

SEQ ID NO: 66320 - DNA, 25 bp, Homo sapien
ggcgtcttaggaacatactcagttc

SEQ ID NO: 66321 - DNA, 25 bp, Homo sapien
cccatctggaaaaggggaatgactg

SEQ ID NO: 66322 - DNA, 25 bp, Homo sapien
caagagctgccggaacctcgcgagc

SEQ ID NO: 66323 - DNA, 25 bp, Homo sapien
cctcgcgagccggaccaggcgccaa

SEQ ID NO: 66324 - DNA, 25 bp, Homo sapien
ccggaccgcgtcaccaccgcggcga

SEQ ID NO: 66325 - DNA, 25 bp, Homo sapien
gctccgggacgcgaagcccatagag

SEQ ID NO: 66326 - DNA, 25 bp, Homo sapien
ctccgggacgcgaagcccatagagg

SEQ ID NO: 66327 - DNA, 25 bp, Homo sapien
agctgccggaacctcgcgagccgga

SEQ ID NO: 66328 - DNA, 25 bp, Homo sapien
gggctatctccgcgtcctccgcttg

SEQ ID NO: 66329 - DNA, 25 bp, Homo sapien
agggcccaagagctgccggaacctc

SEQ ID NO: 66330 - DNA, 25 bp, Homo sapien
accaataagactgcgggcccttctc

SEQ ID NO: 66331 - DNA, 25 bp, Homo sapien
ggcacgtcacaaatcctggttcaga

SEQ ID NO: 66332 - DNA, 25 bp, Homo sapien
ccgtccctgggcagatttgcagttt

SEQ ID NO: 66333 - DNA, 25 bp, Homo sapien
ttctgtctgcagagaccaataagac

SEQ ID NO: 66334 - DNA, 25 bp, Homo sapien
tccgcccttgtaactcgtgatgagt

SEQ ID NO: 66335 - DNA, 25 bp, Homo sapien
gccgaccattcccaggcgttggggc

SEQ ID NO: 66336 - DNA, 25 bp, Homo sapien
ttcattctacagtgtgagcccgagc

SEQ ID NO: 66337 - DNA, 25 bp, Homo sapien
ttctcctagcggcacgtcacaaatc

SEQ ID NO: 66338 - DNA, 25 bp, Homo sapien
caccggccttgacagtggactatta

SEQ ID NO: 66339 - DNA, 25 bp, Homo sapien
gctgccggggaatcatgggatttcc

SEQ ID NO: 66340 - DNA, 25 bp, Homo sapien
accgctgtcaggagggacatggacc

SEQ ID NO: 66341 - DNA, 25 bp, Homo sapien
gaccctaccaggacaagaatcgcgg

SEQ ID NO: 66342 - DNA, 25 bp, Homo sapien
ggcctatccgtagctttcagcgttt

SEQ ID NO: 66343 - DNA, 25 bp, Homo sapien
ggctctgccatagaaggctcctctc

SEQ ID NO: 66344 - DNA, 25 bp, Homo sapien
tacaaggatttctgtgggcccgctc

SEQ ID NO: 66345 - DNA, 25 bp, Homo sapien
tgcagacggacttctaccacacggt

SEQ ID NO: 66346 - DNA, 25 bp, Homo sapien
ctcaaggccctcaatgcgcactgga

SEQ ID NO: 66347 - DNA, 25 bp, Homo sapien
gtgcgcagcatcgtggcttctctct

SEQ ID NO: 66348 - DNA, 25 bp, Homo sapien
cgcgctctttgggaacctgtccacg

SEQ ID NO: 66349 - DNA, 25 bp, Homo sapien
ggtacttgcacagccatcatgggcg

SEQ ID NO: 66350 - DNA, 25 bp, Homo sapien
gccggcctcgaacttccagagtctt

SEQ ID NO: 66351 - DNA, 25 bp, Homo sapien
ttgacctcgttcctggacgcgtcca

SEQ ID NO: 66352 - DNA, 25 bp, Homo sapien
tccagagtcttacaaagggtgcacg

SEQ ID NO: 66353 - DNA, 25 bp, Homo sapien
agggtcatcgtgagctcctgtgcag

SEQ ID NO: 66354 - DNA, 25 bp, Homo sapien
cacactcatcagtacgggaagaact

SEQ ID NO: 66355 - DNA, 25 bp, Homo sapien
cacggtcaccgagaacacggctatc

SEQ ID NO: 66356 - DNA, 25 bp, Homo sapien
aacacggctatcctgcggggacaca

SEQ ID NO: 66357 - DNA, 25 bp, Homo sapien
ggggctccataaccatcactagtga

SEQ ID NO: 66358 - DNA, 25 bp, Homo sapien
atgctgccgaggcaaggtcaccctg

SEQ ID NO: 66359 - DNA, 25 bp, Homo sapien
gtgacacagctccaactacgacttc

SEQ ID NO: 66360 - DNA, 25 bp, Homo sapien
ctacgacttcaaaacggccgctgta

SEQ ID NO: 66361 - DNA, 25 bp, Homo sapien
cgatcctctcgtcgtgcagcacggt

SEQ ID NO: 66362 - DNA, 25 bp, Homo sapien
cttccacagagctgcgaggccgact

SEQ ID NO: 66363 - DNA, 25 bp, Homo sapien
tcgactgcagacaccgaagaacctg

SEQ ID NO: 66364 - DNA, 25 bp, Homo sapien
gccagggaatagatgttgccgataa

SEQ ID NO: 66365 - DNA, 25 bp, Homo sapien
gggcggccataagtccaaccaggaa

SEQ ID NO: 66366 - DNA, 25 bp, Homo sapien
cggcattaccatctgcgctgtagga

SEQ ID NO: 66367 - DNA, 25 bp, Homo sapien
cccgcagcggattttagtcatcaat

SEQ ID NO: 66368 - DNA, 25 bp, Homo sapien
cgcgttcacaatcgtttcccagggc

SEQ ID NO: 66369 - DNA, 25 bp, Homo sapien
ttgattttccgacaagccgcgtgca

SEQ ID NO: 66370 - DNA, 25 bp, Homo sapien
cccggcgcgcactgaggggctttct

SEQ ID NO: 66371 - DNA, 25 bp, Homo sapien
gcgcagctgaatcgccgctctgttc

SEQ ID NO: 66372 - DNA, 25 bp, Homo sapien
cagggcgcagctgaatcgccgctct

SEQ ID NO: 66373 - DNA, 25 bp, Homo sapien
acaagggaacggcagaagacgcagc

SEQ ID NO: 66374 - DNA, 25 bp, Homo sapien
actgaggggctttcttcgcggccgt

SEQ ID NO: 66375 - DNA, 25 bp, Homo sapien
gtcgccgtgtggaccgtaattagcc

SEQ ID NO: 66376 - DNA, 25 bp, Homo sapien
tgtggaccgtaattagccggattag

SEQ ID NO: 66377 - DNA, 25 bp, Homo sapien
ctctttgtccgcgcaaacggcgggg

SEQ ID NO: 66378 - DNA, 25 bp, Homo sapien
agactgggagctctgtctctcgcgc

SEQ ID NO: 66379 - DNA, 25 bp, Homo sapien
ggcccgggacaaaggcgcccattca

SEQ ID NO: 66380 - DNA, 25 bp, Homo sapien
tttctaaaaactgcagccagctggg

SEQ ID NO: 66381 - DNA, 25 bp, Homo sapien
tgggccgcagagaaacgtcagctct

SEQ ID NO: 66382 - DNA, 25 bp, Homo sapien
gcttctctaattcgcggccctttgt

SEQ ID NO: 66383 - DNA, 25 bp, Homo sapien
tgtcagcgagacaagggcacataca

SEQ ID NO: 66384 - DNA, 25 bp, Homo sapien
tcagctctgtgggagaatgagcgcc

SEQ ID NO: 66385 - DNA, 25 bp, Homo sapien
cgcgcataattaatcgggcttcaca

SEQ ID NO: 66386 - DNA, 25 bp, Homo sapien
tgaaatgctcgcttccactcagggc

SEQ ID NO: 66387 - DNA, 25 bp, Homo sapien
aatgctcgcttccactcagggccag

SEQ ID NO: 66388 - DNA, 25 bp, Homo sapien
agggccagcgcactccctccacgtc

SEQ ID NO: 66389 - DNA, 25 bp, Homo sapien
cgcagatctgtcctgctttgacaaa

SEQ ID NO: 66390 - DNA, 25 bp, Homo sapien
tgctttgacaaataacccgctcagc

SEQ ID NO: 66391 - DNA, 25 bp, Homo sapien
ccgctcagccttcgggtttatggtt

SEQ ID NO: 66392 - DNA, 25 bp, Homo sapien
gcagaagtgttaatgggcctccttc

SEQ ID NO: 66393 - DNA, 25 bp, Homo sapien
ctccacgtccctggccgcagatctg

SEQ ID NO: 66394 - DNA, 25 bp, Homo sapien
caccgccttcttgtccagcatgttg

SEQ ID NO: 66395 - DNA, 25 bp, Homo sapien
ggtcgacatgtttctggatcccgca

SEQ ID NO: 66396 - DNA, 25 bp, Homo sapien
tccctggcctaccttgcacaagaag

SEQ ID NO: 66397 - DNA, 25 bp, Homo sapien
gtccaagaactacaacggctgctgc

SEQ ID NO: 66398 - DNA, 25 bp, Homo sapien
gggcgctcggacactcttttgcaaa

SEQ ID NO: 66399 - DNA, 25 bp, Homo sapien
tgggtttcgacacgtgatcctccgc

SEQ ID NO: 66400 - DNA, 25 bp, Homo sapien
cgggcttgagccacgacgaataacg

SEQ ID NO: 66401 - DNA, 25 bp, Homo sapien
cagggatttctctgtctgccaaagg

SEQ ID NO: 66402 - DNA, 25 bp, Homo sapien
acgtcggcgtctgagaagagtcgca

SEQ ID NO: 66403 - DNA, 25 bp, Homo sapien
gccgccgaatcctggcgataccaaa

SEQ ID NO: 66404 - DNA, 25 bp, Homo sapien
tgggagccaaacctcgtgcacgtcg

SEQ ID NO: 66405 - DNA, 25 bp, Homo sapien
aggtctccttctacggcgtctccga

SEQ ID NO: 66406 - DNA, 25 bp, Homo sapien
acctggaggagtcatcgcgagaatt

SEQ ID NO: 66407 - DNA, 25 bp, Homo sapien
cgcgagaattgaccaaacgcagctc

SEQ ID NO: 66408 - DNA, 25 bp, Homo sapien
ttaaccagccactgtaccgtcagcg

SEQ ID NO: 66409 - DNA, 25 bp, Homo sapien
cgccgcgcgttcctcatggcgttag

SEQ ID NO: 66410 - DNA, 25 bp, Homo sapien
gagatccaccaggatctccggggcg

SEQ ID NO: 66411 - DNA, 25 bp, Homo sapien
tgtggtctcccattggctacaccgg

SEQ ID NO: 66412 - DNA, 25 bp, Homo sapien
cggggacccgctgctgagatagaca

SEQ ID NO: 66413 - DNA, 25 bp, Homo sapien
ctgagatagacaggtgagaaagccc

SEQ ID NO: 66414 - DNA, 25 bp, Homo sapien
ggctgactcgggatccgccgctgca

SEQ ID NO: 66415 - DNA, 25 bp, Homo sapien
cccaagtctggatgtcgccgggaga

SEQ ID NO: 66416 - DNA, 25 bp, Homo sapien
tcccgtgacgttctgtttggaaaca

SEQ ID NO: 66417 - DNA, 25 bp, Homo sapien
ctcgccttaggcttcgggagatcca

SEQ ID NO: 66418 - DNA, 25 bp, Homo sapien
gtgcaaaggtactcagtttgccctc

SEQ ID NO: 66419 - DNA, 25 bp, Homo sapien
ctctagagtgaaggagtgacgagca

SEQ ID NO: 66420 - DNA, 25 bp, Homo sapien
cggtgtagtgcagcgtctcgcgcac

SEQ ID NO: 66421 - DNA, 25 bp, Homo sapien
ctgctcagcagggtgtcgctctgca

SEQ ID NO: 66422 - DNA, 25 bp, Homo sapien
agactcgggcgtcagtgtagcctaa

SEQ ID NO: 66423 - DNA, 25 bp, Homo sapien
cccacctgcaggacgtaggagaagc

SEQ ID NO: 66424 - DNA, 25 bp, Homo sapien
aagcagtcctggaactgctcccggc

SEQ ID NO: 66425 - DNA, 25 bp, Homo sapien
cgtccagcagcgtggttttcccgga

SEQ ID NO: 66426 - DNA, 25 bp, Homo sapien
ttcactctcagaaacgcgggccgga

SEQ ID NO: 66427 - DNA, 25 bp, Homo sapien
ctccgaggacagaagacccaatgta

SEQ ID NO: 66428 - DNA, 25 bp, Homo sapien
gaaggcgcttaaccctgtcacccga

SEQ ID NO: 66429 - DNA, 25 bp, Homo sapien
atctgggcatcgtgttcattcgctg

SEQ ID NO: 66430 - DNA, 25 bp, Homo sapien
tgtgggaggccaactagtaaaaata

SEQ ID NO: 66431 - DNA, 25 bp, Homo sapien
ccgactatgaagatcccaggacgtg

SEQ ID NO: 66432 - DNA, 25 bp, Homo sapien
gccctgacgccatgtccaataggaa

SEQ ID NO: 66433 - DNA, 25 bp, Homo sapien
accgtggaggtcttttgcaccttgc

SEQ ID NO: 66434 - DNA, 25 bp, Homo sapien
gcagccctcgttttcctctagctga

SEQ ID NO: 66435 - DNA, 25 bp, Homo sapien
tctagctgaggtcacggaggagctt

SEQ ID NO: 66436 - DNA, 25 bp, Homo sapien
cgggacagcgcagtaacgcccaatg

SEQ ID NO: 66437 - DNA, 25 bp, Homo sapien
gcgccattgaggacactctcctcga

SEQ ID NO: 66438 - DNA, 25 bp, Homo sapien
aatggcccggattacgcagccctcg

SEQ ID NO: 66439 - DNA, 25 bp, Homo sapien
acactctcctcgaggtggcagtaga

SEQ ID NO: 66440 - DNA, 25 bp, Homo sapien
agtagagagccgttcactgcccagt

SEQ ID NO: 66441 - DNA, 25 bp, Homo sapien
cgctgacgtcaccttgtttacccgg

SEQ ID NO: 66442 - DNA, 25 bp, Homo sapien
ggacagctgaccttgcctattgaaa

SEQ ID NO: 66443 - DNA, 25 bp, Homo sapien
agcggcttctgctcaatggcggaaa

SEQ ID NO: 66444 - DNA, 25 bp, Homo sapien
cttggaaattggctcagtgactgac

SEQ ID NO: 66445 - DNA, 25 bp, Homo sapien
cgccttttgcgcgttcatttgaaaa

SEQ ID NO: 66446 - DNA, 25 bp, Homo sapien
tttctaggacgaaccaatcgctttc

SEQ ID NO: 66447 - DNA, 25 bp, Homo sapien
atccgtacagactctccgggtttga

SEQ ID NO: 66448 - DNA, 25 bp, Homo sapien
gggcacggtcctcacagaacggaaa

SEQ ID NO: 66449 - DNA, 25 bp, Homo sapien
gcgcttcttttacgcgaggcttaga

SEQ ID NO: 66450 - DNA, 25 bp, Homo sapien
cttcggacctacactctgctcgggg

SEQ ID NO: 66451 - DNA, 25 bp, Homo sapien
ccctttgatctggaggcgctgtttc

SEQ ID NO: 66452 - DNA, 25 bp, Homo sapien
tgtgaatgccaaccaagactgcgtc

SEQ ID NO: 66453 - DNA, 25 bp, Homo sapien
cgagtgcttgttcttatctgagtac

SEQ ID NO: 66454 - DNA, 25 bp, Homo sapien
acacctggtaaccttcgggcctgca

SEQ ID NO: 66455 - DNA, 25 bp, Homo sapien
aggcagctgtgcaaaacggtctcta

SEQ ID NO: 66456 - DNA, 25 bp, Homo sapien
gtggcttgttattctgggcaccgca

SEQ ID NO: 66457 - DNA, 25 bp, Homo sapien
tgggcaccgcaaagggtttcacttc

SEQ ID NO: 66458 - DNA, 25 bp, Homo sapien
acagcagtgtaagagccgccacgag

SEQ ID NO: 66459 - DNA, 25 bp, Homo sapien
acagcagtgtaagagccgccacgtg

SEQ ID NO: 66460 - DNA, 25 bp, Homo sapien
tcacgacacagcagtgtaagagccg

SEQ ID NO: 66461 - DNA, 25 bp, Homo sapien
cgacacagcagtgtaagagctgcca

SEQ ID NO: 66462 - DNA, 25 bp, Homo sapien
cacagcagtgtaagagccgccacga

SEQ ID NO: 66463 - DNA, 25 bp, Homo sapien
cgacacagcagtgtaagagccgcca

SEQ ID NO: 66464 - DNA, 25 bp, Homo sapien
gacacagcagtgtaagagccgccac

SEQ ID NO: 66465 - DNA, 25 bp, Homo sapien
cacagcagtgtaagagccgccacgt

SEQ ID NO: 66466 - DNA, 25 bp, Homo sapien
acagctcggccctggttgccaagga

SEQ ID NO: 66467 - DNA, 25 bp, Homo sapien
tccggcagttggctgcaccactcgg

SEQ ID NO: 66468 - DNA, 25 bp, Homo sapien
ctccagtgagatggagtcgcgagtc

SEQ ID NO: 66469 - DNA, 25 bp, Homo sapien
acctccgggtgtggaaggctccagt

SEQ ID NO: 66470 - DNA, 25 bp, Homo sapien
tgccgggcgtcacaggtcctgacag

SEQ ID NO: 66471 - DNA, 25 bp, Homo sapien
tgcgagtaccggaaatgcggaattc

SEQ ID NO: 66472 - DNA, 25 bp, Homo sapien
ttgccaaggagatgcgagtaccgga

SEQ ID NO: 66473 - DNA, 25 bp, Homo sapien
ggagaacctgctcgcctcacctttg

SEQ ID NO: 66474 - DNA, 25 bp, Homo sapien
tgagtttccccaaagccgtcggtgc

SEQ ID NO: 66475 - DNA, 25 bp, Homo sapien
cagaaacgctttgcccacagccacc

SEQ ID NO: 66476 - DNA, 25 bp, Homo sapien
gccgcttgggcgtgatcccttggct

SEQ ID NO: 66477 - DNA, 25 bp, Homo sapien
gagggaaggaccagcgtttccaagc

SEQ ID NO: 66478 - DNA, 25 bp, Homo sapien
accagcgtttccaagccgggctctg

SEQ ID NO: 66479 - DNA, 25 bp, Homo sapien
ggacggcccagaaacgctttgccca

SEQ ID NO: 66480 - DNA, 25 bp, Homo sapien
ccgtcggtgcgacccggcgccgact

SEQ ID NO: 66481 - DNA, 25 bp, Homo sapien
tcgggacggcccagaaacgctttgc

SEQ ID NO: 66482 - DNA, 25 bp, Homo sapien
cgagccgcccgagaaagttttcaat

SEQ ID NO: 66483 - DNA, 25 bp, Homo sapien
caggggctgagctccttagaaagct

SEQ ID NO: 66484 - DNA, 25 bp, Homo sapien
tcaggggctgagctccttagaaagc

SEQ ID NO: 66485 - DNA, 25 bp, Homo sapien
gttttcaattcgatggggctgcagc

SEQ ID NO: 66486 - DNA, 25 bp, Homo sapien
ccctgcgtgttgattttcaggccca

SEQ ID NO: 66487 - DNA, 25 bp, Homo sapien
gcccgagaaagttttcaattcgatg

SEQ ID NO: 66488 - DNA, 25 bp, Homo sapien
gattttcaggcccaccgagccgccc

SEQ ID NO: 66489 - DNA, 25 bp, Homo sapien
aaagttttcaattcgatggggctgc

SEQ ID NO: 66490 - DNA, 25 bp, Homo sapien
gtccatgtgggtgacactgccttca

SEQ ID NO: 66491 - DNA, 25 bp, Homo sapien
tcgactgagtcagcctagggagact

SEQ ID NO: 66492 - DNA, 25 bp, Homo sapien
aacgcccgagcgcatctcgactgag

SEQ ID NO: 66493 - DNA, 25 bp, Homo sapien
aaagggcgacgctccagacataacg

SEQ ID NO: 66494 - DNA, 25 bp, Homo sapien
aggttcctccaaagcggtatcatta

SEQ ID NO: 66495 - DNA, 25 bp, Homo sapien
tgccgagcctcgtatgcaacaggtt

SEQ ID NO: 66496 - DNA, 25 bp, Homo sapien
ttccaaggttacaaattgccgagcc

SEQ ID NO: 66497 - DNA, 25 bp, Homo sapien
cccatttggactcaggcctgacctg

SEQ ID NO: 66498 - DNA, 25 bp, Homo sapien
catctagggcgtctctcggtggact

SEQ ID NO: 66499 - DNA, 25 bp, Homo sapien
gccttgccaccctttgggaaggata

SEQ ID NO: 66500 - DNA, 25 bp, Homo sapien
cacctcgaggtcgagtgcgccctgg

SEQ ID NO: 66501 - DNA, 25 bp, Homo sapien
acccaagccacctcgaggtcgagtg

SEQ ID NO: 66502 - DNA, 25 bp, Homo sapien
gtctcctggctctcgattgctccca

SEQ ID NO: 66503 - DNA, 25 bp, Homo sapien
ataggaccatcatctagggcgtctc

SEQ ID NO: 66504 - DNA, 25 bp, Homo sapien
ccctttgggaaggataggaccatca

SEQ ID NO: 66505 - DNA, 25 bp, Homo sapien
gcgtctcggggcgaatgatatgcac

SEQ ID NO: 66506 - DNA, 25 bp, Homo sapien
ggggctgaccatataaccagaattc

SEQ ID NO: 66507 - DNA, 25 bp, Homo sapien
ccagaccaaggagctaagagtgatc

SEQ ID NO: 66508 - DNA, 25 bp, Homo sapien
aggcgctcttctgccggctattgta

SEQ ID NO: 66509 - DNA, 25 bp, Homo sapien
gtggcgcgctctggaaacattttcc

SEQ ID NO: 66510 - DNA, 25 bp, Homo sapien
gacagagagactatgcgcccgcaag

SEQ ID NO: 66511 - DNA, 25 bp, Homo sapien
cccggccacctgttgagaatccatg

SEQ ID NO: 66512 - DNA, 25 bp, Homo sapien
cggctgtacaaccaagatcgacttt

SEQ ID NO: 66513 - DNA, 25 bp, Homo sapien
gacgccctggatttctcgcctttgc

SEQ ID NO: 66514 - DNA, 25 bp, Homo sapien
gcttggttcccagaccagcgtggaa

SEQ ID NO: 66515 - DNA, 25 bp, Homo sapien
tgcaagctgacctatccacccgaga

SEQ ID NO: 66516 - DNA, 25 bp, Homo sapien
ccacctgaaggcgatattttagatc

SEQ ID NO: 66517 - DNA, 25 bp, Homo sapien
tggtccgggtacaaggagaacacta

SEQ ID NO: 66518 - DNA, 25 bp, Homo sapien
ctccagatgtggttgagactttccc

SEQ ID NO: 66519 - DNA, 25 bp, Homo sapien
tgcagacccgttggctttccctgta

SEQ ID NO: 66520 - DNA, 25 bp, Homo sapien
ctcctggtcggctgtttagagctga

SEQ ID NO: 66521 - DNA, 25 bp, Homo sapien
ctcgactgagatcctatggagcctg

SEQ ID NO: 66522 - DNA, 25 bp, Homo sapien
cctttggtcctctaagctgggaagc

SEQ ID NO: 66523 - DNA, 25 bp, Homo sapien
ttgccggcaagttggccacaaagtc

SEQ ID NO: 66524 - DNA, 25 bp, Homo sapien
ggcttgaccaacatcacaggagctg

SEQ ID NO: 66525 - DNA, 25 bp, Homo sapien
aaagccctgatgtggagcctgtgtc

SEQ ID NO: 66526 - DNA, 25 bp, Homo sapien
tgtgtctttctctatccagccagga

SEQ ID NO: 66527 - DNA, 25 bp, Homo sapien
gtggagcccacttttcgtctgatga

SEQ ID NO: 66528 - DNA, 25 bp, Homo sapien
gtttcagccgaggagaatccctttg

SEQ ID NO: 66529 - DNA, 25 bp, Homo sapien
tcggcgatcctctggagcctagaga

SEQ ID NO: 66530 - DNA, 25 bp, Homo sapien
actcggcgtcttggagcagtctctt

SEQ ID NO: 66531 - DNA, 25 bp, Homo sapien
ggtcagctgagcacaactttccatt

SEQ ID NO: 66532 - DNA, 25 bp, Homo sapien
agcggctgattgagctccactgtgc

SEQ ID NO: 66533 - DNA, 25 bp, Homo sapien
ggctccaatttctccggtcagctga

SEQ ID NO: 66534 - DNA, 25 bp, Homo sapien
taagcctttgtgtggccgtcacctg

SEQ ID NO: 66535 - DNA, 25 bp, Homo sapien
ttcgagtgtattcatgcagcggctg

SEQ ID NO: 66536 - DNA, 25 bp, Homo sapien
tgtcagtcccgcctaagcctttgtg

SEQ ID NO: 66537 - DNA, 25 bp, Homo sapien
ctcgaagtccattcccaggcctgtg

SEQ ID NO: 66538 - DNA, 25 bp, Homo sapien
tccctagtctggtgtctcatctctc

SEQ ID NO: 66539 - DNA, 25 bp, Homo sapien
tgagtgagcatttccggcagccatc

SEQ ID NO: 66540 - DNA, 25 bp, Homo sapien
ctcgcaaaacactactgggaagatc

SEQ ID NO: 66541 - DNA, 25 bp, Homo sapien
gcgcttttactatggtcaggcatta

SEQ ID NO: 66542 - DNA, 25 bp, Homo sapien
gctcacacctttttcaacccggatg

SEQ ID NO: 66543 - DNA, 25 bp, Homo sapien
ctgtcatgaaggacgtaccgggctt

SEQ ID NO: 66544 - DNA, 25 bp, Homo sapien
catgttccgcgcagtccaaggagtc

SEQ ID NO: 66545 - DNA, 25 bp, Homo sapien
cccggatggcggtgatagttaatac

SEQ ID NO: 66546 - DNA, 25 bp, Homo sapien
ggaagcgctgctaattccctgcgta

SEQ ID NO: 66547 - DNA, 25 bp, Homo sapien
tgcaggcagacctaccaagccagga

SEQ ID NO: 66548 - DNA, 25 bp, Homo sapien
tctttcttctttcaggccgctggga

SEQ ID NO: 66549 - DNA, 25 bp, Homo sapien
cccgcactgcctttggtttgttgga

SEQ ID NO: 66550 - DNA, 25 bp, Homo sapien
acacttgtacatgtgcgggcgcacg

SEQ ID NO: 66551 - DNA, 25 bp, Homo sapien
cggctacgcttataccgggaggtga

SEQ ID NO: 66552 - DNA, 25 bp, Homo sapien
tctctgggcacgcaagatgaggcaa

SEQ ID NO: 66553 - DNA, 25 bp, Homo sapien
agcgctcagcaagcagctacgtgca

SEQ ID NO: 66554 - DNA, 25 bp, Homo sapien
ctgtgtgatggatgtgatgcttgca

SEQ ID NO: 66555 - DNA, 25 bp, Homo sapien
ttctggttctgtgtgatggatgtga

SEQ ID NO: 66556 - DNA, 25 bp, Homo sapien
ctcctggctgccgaacctgaagtca

SEQ ID NO: 66557 - DNA, 25 bp, Homo sapien
gaacctgaagtcagggtccgccgca

SEQ ID NO: 66558 - DNA, 25 bp, Homo sapien
agggtccgccgcagaacacgtcttc

SEQ ID NO: 66559 - DNA, 25 bp, Homo sapien
tcagggcagctgtgcgctccgcgct

SEQ ID NO: 66560 - DNA, 25 bp, Homo sapien
ccgtgctcagggcagctgtgcgctc

SEQ ID NO: 66561 - DNA, 25 bp, Homo sapien
tgatgcttgcatggtgctgtccctg

SEQ ID NO: 66562 - DNA, 25 bp, Homo sapien
acctcgcggcgatggtgcatagcat

SEQ ID NO: 66563 - DNA, 25 bp, Homo sapien
cttttgggacattcagagaggcttt

SEQ ID NO: 66564 - DNA, 25 bp, Homo sapien
tccaggcagcttggcgatcttgtta

SEQ ID NO: 66565 - DNA, 25 bp, Homo sapien
acacgcgagagtttagagacccaga

SEQ ID NO: 66566 - DNA, 25 bp, Homo sapien
cctgcgattcttccattgcacattg

SEQ ID NO: 66567 - DNA, 25 bp, Homo sapien
gggcctttcacatctgctcctagcg

SEQ ID NO: 66568 - DNA, 25 bp, Homo sapien
gcccgcaactgtctccgactgtgtg

SEQ ID NO: 66569 - DNA, 25 bp, Homo sapien
ccagcgcgggaatgttccatttgcc

SEQ ID NO: 66570 - DNA, 25 bp, Homo sapien
tgcgttggttactctccctggaaag

SEQ ID NO: 66571 - DNA, 25 bp, Homo sapien
ggcctctccgatttgtgggtccttc

SEQ ID NO: 66572 - DNA, 25 bp, Homo sapien
ctgggctcacccttacacctgtgta

SEQ ID NO: 66573 - DNA, 25 bp, Homo sapien
gccgctgctagctcttgatttagtc

SEQ ID NO: 66574 - DNA, 25 bp, Homo sapien
gcacccgcggagttgccaaaagaga

SEQ ID NO: 66575 - DNA, 25 bp, Homo sapien
accatttccgagttccagccgcaga

SEQ ID NO: 66576 - DNA, 25 bp, Homo sapien
tcggaaccttgaccctgacacctgg

SEQ ID NO: 66577 - DNA, 25 bp, Homo sapien
cattcacttaggtgcgggagccctg

SEQ ID NO: 66578 - DNA, 25 bp, Homo sapien
gcgccacgagcgcctcatcccctcc

SEQ ID NO: 66579 - DNA, 25 bp, Homo sapien
tggtcgctgagggacgcggtcagta

SEQ ID NO: 66580 - DNA, 25 bp, Homo sapien
cctggtcgctgagggacgcggtcag

SEQ ID NO: 66581 - DNA, 25 bp, Homo sapien
ggggcgccacgagcgcctcatcccc

SEQ ID NO: 66582 - DNA, 25 bp, Homo sapien
ctgagggacgcggtcagtacctacc

SEQ ID NO: 66583 - DNA, 25 bp, Homo sapien
cggggcgccacgagcgcctcatccc

SEQ ID NO: 66584 - DNA, 25 bp, Homo sapien
tgagggacgcggtcagtacctaccg

SEQ ID NO: 66585 - DNA, 25 bp, Homo sapien
gagggacgcggtcagtacctaccgc

SEQ ID NO: 66586 - DNA, 25 bp, Homo sapien
ggcgctgcaggttaattgatagcca

SEQ ID NO: 66587 - DNA, 25 bp, Homo sapien
gactggttcagatgcgtcgtttaaa

SEQ ID NO: 66588 - DNA, 25 bp, Homo sapien
ctgcctggactggttcagatgcgtc

SEQ ID NO: 66589 - DNA, 25 bp, Homo sapien
tgcccactacggatctgcctggact

SEQ ID NO: 66590 - DNA, 25 bp, Homo sapien
tctcggagtcctgcccactacggat

SEQ ID NO: 66591 - DNA, 25 bp, Homo sapien
cgagaagggaaagcctcaacttctt

SEQ ID NO: 66592 - DNA, 25 bp, Homo sapien
taccgccactgcgacccgagaaggg

SEQ ID NO: 66593 - DNA, 25 bp, Homo sapien
ttgatagccacggaagcacctaggc

SEQ ID NO: 66594 - DNA, 25 bp, Homo sapien
ccgcgggccttgtggcatataacca

SEQ ID NO: 66595 - DNA, 25 bp, Homo sapien
gctgtagtcacagtcccgggaggaa

SEQ ID NO: 66596 - DNA, 25 bp, Homo sapien
tcaccagagagcatcgccaaccaga

SEQ ID NO: 66597 - DNA, 25 bp, Homo sapien
tggctgtttcgggactcaccagaga

SEQ ID NO: 66598 - DNA, 25 bp, Homo sapien
caagtcgtgtgtataggaaggcgtc

SEQ ID NO: 66599 - DNA, 25 bp, Homo sapien
gctttggcatctccgaaggcacgta

SEQ ID NO: 66600 - DNA, 25 bp, Homo sapien
ttggtagggaaatcagacacagctg

SEQ ID NO: 66601 - DNA, 25 bp, Homo sapien
gtgccttcacctagcgactgacaca

SEQ ID NO: 66602 - DNA, 25 bp, Homo sapien
ggagtcaaattattcgccatggaga

SEQ ID NO: 66603 - DNA, 25 bp, Homo sapien
tcagtcactggtaacccgagcctcg

SEQ ID NO: 66604 - DNA, 25 bp, Homo sapien
ccagcgccagacaatagtcggagtc

SEQ ID NO: 66605 - DNA, 25 bp, Homo sapien
cgccctgattggtccggttatctga

SEQ ID NO: 66606 - DNA, 25 bp, Homo sapien
atattattctaagcgggcatgaggc

SEQ ID NO: 66607 - DNA, 25 bp, Homo sapien
ctggctctcagctttcttaataata

SEQ ID NO: 66608 - DNA, 25 bp, Homo sapien
cttgctcctgcgtgaagccgaaggt

SEQ ID NO: 66609 - DNA, 25 bp, Homo sapien
gccatggagacgctgtcagtcactg

SEQ ID NO: 66610 - DNA, 25 bp, Homo sapien
gggctcacgagggatcttgttcaaa

SEQ ID NO: 66611 - DNA, 25 bp, Homo sapien
ggcccacaagagcaaacggtttaga

SEQ ID NO: 66612 - DNA, 25 bp, Homo sapien
ctgggcgacgtgtttcgttgaaagc

SEQ ID NO: 66613 - DNA, 25 bp, Homo sapien
cctgcaccagcggttttccgtgttg

SEQ ID NO: 66614 - DNA, 25 bp, Homo sapien
agtcggctcacacgaattctctgtg

SEQ ID NO: 66615 - DNA, 25 bp, Homo sapien
tccaccgccgggttgttttgcaatg

SEQ ID NO: 66616 - DNA, 25 bp, Homo sapien
ggtcgcactcttggaaccgcgcgaa

SEQ ID NO: 66617 - DNA, 25 bp, Homo sapien
gccttagtcctggagtcccttcctg

SEQ ID NO: 66618 - DNA, 25 bp, Homo sapien
gtgacggggctcacaccattccagc

SEQ ID NO: 66619 - DNA, 25 bp, Homo sapien
ggatgagccagaccttcccggcttt

SEQ ID NO: 66620 - DNA, 25 bp, Homo sapien
gctgggaaccggaaaggtgcatttc

SEQ ID NO: 66621 - DNA, 25 bp, Homo sapien
caccagccctgtagatacggagcca

SEQ ID NO: 66622 - DNA, 25 bp, Homo sapien
cgggtttgctccgacccgaagctga

SEQ ID NO: 66623 - DNA, 25 bp, Homo sapien
gcagccaagtgttctgcagctccga

SEQ ID NO: 66624 - DNA, 25 bp, Homo sapien
tctagctccgggcagacgaaacacc

SEQ ID NO: 66625 - DNA, 25 bp, Homo sapien
ccgttccctttgcagtcacttggtg

SEQ ID NO: 66626 - DNA, 25 bp, Homo sapien
tcctccgcgagtatcctcagtgcat

SEQ ID NO: 66627 - DNA, 25 bp, Homo sapien
gcgagtatcctcagttcatcctccg

SEQ ID NO: 66628 - DNA, 25 bp, Homo sapien
agtatcctcagtccatcctccgcga

SEQ ID NO: 66629 - DNA, 25 bp, Homo sapien
cctccgcgagtatcctcagtccatc

SEQ ID NO: 66630 - DNA, 25 bp, Homo sapien
atcctccgcgagtatcctcagtgca

SEQ ID NO: 66631 - DNA, 25 bp, Homo sapien
tccgcgagtatcctcagtgcatcct

SEQ ID NO: 66632 - DNA, 25 bp, Homo sapien
tgcatcctccgcgagtatcctcagt

SEQ ID NO: 66633 - DNA, 25 bp, Homo sapien
atcctcagtccatcctccgcgagta

SEQ ID NO: 66634 - DNA, 25 bp, Homo sapien
gagtgtaaactgcacaggcgcgtgt

SEQ ID NO: 66635 - DNA, 25 bp, Homo sapien
cgcaggcgagcgtaaacagtgcacg

SEQ ID NO: 66636 - DNA, 25 bp, Homo sapien
tcactgtgtgcgcaggcgagtgtaa

SEQ ID NO: 66637 - DNA, 25 bp, Homo sapien
tgcgcaggcgagtgtaaactgcacg

SEQ ID NO: 66638 - DNA, 25 bp, Homo sapien
actgcgcaggcgagtgtaaactgca

SEQ ID NO: 66639 - DNA, 25 bp, Homo sapien
ctgtgcgcaggcgagtgtaaactgc

SEQ ID NO: 66640 - DNA, 25 bp, Homo sapien
agtgtaaactgcacaggcgcgtgtg

SEQ ID NO: 66641 - DNA, 25 bp, Homo sapien
cactgcgcaggcgagtgtaaactgc

SEQ ID NO: 66642 - DNA, 25 bp, Homo sapien
tttcaaacgccagaaggtccgcctc

SEQ ID NO: 66643 - DNA, 25 bp, Homo sapien
gaccaagttagccacagacctccaa

SEQ ID NO: 66644 - DNA, 25 bp, Homo sapien
gcctcgcttcttccggaccaagtta

SEQ ID NO: 66645 - DNA, 25 bp, Homo sapien
gattccgtgagtgccaccgcacctt

SEQ ID NO: 66646 - DNA, 25 bp, Homo sapien
tcagaagacccgagattccgtgagt

SEQ ID NO: 66647 - DNA, 25 bp, Homo sapien
agaacccgcaagacgaccgccaagg

SEQ ID NO: 66648 - DNA, 25 bp, Homo sapien
gacgccgggctcttgagaacccgca

SEQ ID NO: 66649 - DNA, 25 bp, Homo sapien
ttccggaccaagttagccacagacc

SEQ ID NO: 66650 - DNA, 25 bp, Homo sapien
actagaccggccaggacgtagaagg

SEQ ID NO: 66651 - DNA, 25 bp, Homo sapien
gacagagaaactagaccggccagga

SEQ ID NO: 66652 - DNA, 25 bp, Homo sapien
ccggtagccgacgacagagaaacta

SEQ ID NO: 66653 - DNA, 25 bp, Homo sapien
gacccggtagccgacgacagagaaa

SEQ ID NO: 66654 - DNA, 25 bp, Homo sapien
gctctcttcgcctctccatccggct

SEQ ID NO: 66655 - DNA, 25 bp, Homo sapien
gccaggacgtagaagggtcgcttcc

SEQ ID NO: 66656 - DNA, 25 bp, Homo sapien
agaagggtcgcttcccccaggctgg

SEQ ID NO: 66657 - DNA, 25 bp, Homo sapien
ctaagccgggatggcaggcggactc

SEQ ID NO: 66658 - DNA, 25 bp, Homo sapien
taactggacacgtgtctcccacagg

SEQ ID NO: 66659 - DNA, 25 bp, Homo sapien
aagcaccaggccgtagggacctcac

SEQ ID NO: 66660 - DNA, 25 bp, Homo sapien
taaatccacactgcccatctcggag

SEQ ID NO: 66661 - DNA, 25 bp, Homo sapien
ggaactcccgagctgagatgcggaa

SEQ ID NO: 66662 - DNA, 25 bp, Homo sapien
gagatgcggaaagcaccaggccgta

SEQ ID NO: 66663 - DNA, 25 bp, Homo sapien
ccacaggacacgcactggcactaaa

SEQ ID NO: 66664 - DNA, 25 bp, Homo sapien
ctctcccgataactggacacgtgtc

SEQ ID NO: 66665 - DNA, 25 bp, Homo sapien
cactgcccatctcggagacaggcgg

SEQ ID NO: 66666 - DNA, 25 bp, Homo sapien
cgcggatgtgagattccgggctcct

SEQ ID NO: 66667 - DNA, 25 bp, Homo sapien
tgcgaagaggatccgggttgaaatc

SEQ ID NO: 66668 - DNA, 25 bp, Homo sapien
ggaccatttcctctcgacatgcatc

SEQ ID NO: 66669 - DNA, 25 bp, Homo sapien
gagggagactcgctcgcacaccgac

SEQ ID NO: 66670 - DNA, 25 bp, Homo sapien
actgacgtcttttgcgcatttcctg

SEQ ID NO: 66671 - DNA, 25 bp, Homo sapien
accgttgtctcctcggctcactttt

SEQ ID NO: 66672 - DNA, 25 bp, Homo sapien
catccctccggatagactgaacatc

SEQ ID NO: 66673 - DNA, 25 bp, Homo sapien
ggctcactttttccgtattgctccc

SEQ ID NO: 66674 - DNA, 25 bp, Homo sapien
gtgctcggcgtctgaacgtctcaaa

SEQ ID NO: 66675 - DNA, 25 bp, Homo sapien
ccgcaccttgactctggggagagta

SEQ ID NO: 66676 - DNA, 25 bp, Homo sapien
ggttggagaacccacttcctcgtgc

SEQ ID NO: 66677 - DNA, 25 bp, Homo sapien
agtccttccaaatgcgctcctgtgc

SEQ ID NO: 66678 - DNA, 25 bp, Homo sapien
tttctctggattcgcggagtccttc

SEQ ID NO: 66679 - DNA, 25 bp, Homo sapien
tggtctctcattttggggcagcatc

SEQ ID NO: 66680 - DNA, 25 bp, Homo sapien
tcagcagctttgcagtggagacttc

SEQ ID NO: 66681 - DNA, 25 bp, Homo sapien
gtctcaaagggccacagcgacaatg

SEQ ID NO: 66682 - DNA, 25 bp, Homo sapien
tacctgcatgagaagaaccagcggc

SEQ ID NO: 66683 - DNA, 25 bp, Homo sapien
ctcacgcggctcaagtacctgcatg

SEQ ID NO: 66684 - DNA, 25 bp, Homo sapien
cgcaatcccgagatggagctggaga

SEQ ID NO: 66685 - DNA, 25 bp, Homo sapien
tggcgacggacccaaacccgcagag

SEQ ID NO: 66686 - DNA, 25 bp, Homo sapien
gtgcgcatggagttcgagctcacgc

SEQ ID NO: 66687 - DNA, 25 bp, Homo sapien
tgccaagggccgcttaaatcgctgt

SEQ ID NO: 66688 - DNA, 25 bp, Homo sapien
ccgtgctaccaaaggccaggctggc

SEQ ID NO: 66689 - DNA, 25 bp, Homo sapien
ccaagtcctgccgtgctaccaaagg

SEQ ID NO: 66690 - DNA, 25 bp, Homo sapien
gcctttggacgcttccgggcgctgc

SEQ ID NO: 66691 - DNA, 25 bp, Homo sapien
ctattgcgtcatcgtggaggtcgtc

SEQ ID NO: 66692 - DNA, 25 bp, Homo sapien
tataatttggcatgactattgcgtc

SEQ ID NO: 66693 - DNA, 25 bp, Homo sapien
ttccgggtggaggtgaaatatgcat

SEQ ID NO: 66694 - DNA, 25 bp, Homo sapien
ttgtgcacttagaggccgagaggat

SEQ ID NO: 66695 - DNA, 25 bp, Homo sapien
tcctccttgatttctagttccgttg

SEQ ID NO: 66696 - DNA, 25 bp, Homo sapien
tacccttttggtctctcctccttga

SEQ ID NO: 66697 - DNA, 25 bp, Homo sapien
ctagttccgttgtgcacttagaggc

SEQ ID NO: 66698 - DNA, 25 bp, Homo sapien
aactgctgactaaggggccgctccc

SEQ ID NO: 66699 - DNA, 25 bp, Homo sapien
gaccactacgcaggtaagcctcgga

SEQ ID NO: 66700 - DNA, 25 bp, Homo sapien
actacgcaggtaagcctcggaactg

SEQ ID NO: 66701 - DNA, 25 bp, Homo sapien
cgcaggtaagcctcggaactgctga

SEQ ID NO: 66702 - DNA, 25 bp, Homo sapien
ggtaagcctcggaactgctgactaa

SEQ ID NO: 66703 - DNA, 25 bp, Homo sapien
aagcctcggaactgctgactaaggg

SEQ ID NO: 66704 - DNA, 25 bp, Homo sapien
cctcggaactgctgactaaggggcc

SEQ ID NO: 66705 - DNA, 25 bp, Homo sapien
tcttcgaccactacgcaggtaagcc

SEQ ID NO: 66706 - DNA, 25 bp, Homo sapien
tgtccatcagggcacgccggaagag

SEQ ID NO: 66707 - DNA, 25 bp, Homo sapien
acgcctaacagccagtcgcagaaag

SEQ ID NO: 66708 - DNA, 25 bp, Homo sapien
tcctaccatcaggtacgacgggcgg

SEQ ID NO: 66709 - DNA, 25 bp, Homo sapien
agcggggaactactgcctcctacca

SEQ ID NO: 66710 - DNA, 25 bp, Homo sapien
caaggctcagggctgcttcggcaat

SEQ ID NO: 66711 - DNA, 25 bp, Homo sapien
cagaggcgaaaactcggatccgaaa

SEQ ID NO: 66712 - DNA, 25 bp, Homo sapien
aaggctcttccgagcggcacccaga

SEQ ID NO: 66713 - DNA, 25 bp, Homo sapien
cttgcacctcgtgaggcgagacgcc

SEQ ID NO: 66714 - DNA, 25 bp, Homo sapien
gctctcgatgcatttctgtggaatt

SEQ ID NO: 66715 - DNA, 25 bp, Homo sapien
ccggattggccgctaggaatcccgc

SEQ ID NO: 66716 - DNA, 25 bp, Homo sapien
gtcacggtaggctgcccttcagaga

SEQ ID NO: 66717 - DNA, 25 bp, Homo sapien
ctccgtccggaggaagcgacgctgc

SEQ ID NO: 66718 - DNA, 25 bp, Homo sapien
gccctgcctgctattggtcacggta

SEQ ID NO: 66719 - DNA, 25 bp, Homo sapien
cgctcacagtgggagcttgcgctta

SEQ ID NO: 66720 - DNA, 25 bp, Homo sapien
cttgcgcttagtaggctctcgatgc

SEQ ID NO: 66721 - DNA, 25 bp, Homo sapien
gaaaaggactgctagcccgggccgc

SEQ ID NO: 66722 - DNA, 25 bp, Homo sapien
gggcacgagcctggtataaatcgcg

SEQ ID NO: 66723 - DNA, 25 bp, Homo sapien
tccaacctagggcacgagcctggta

SEQ ID NO: 66724 - DNA, 25 bp, Homo sapien
ttgagactgtccgatccaacctagg

SEQ ID NO: 66725 - DNA, 25 bp, Homo sapien
taagactggagtccgcagccgagca

SEQ ID NO: 66726 - DNA, 25 bp, Homo sapien
gcctaagcctgtgtgcagtgcgaga

SEQ ID NO: 66727 - DNA, 25 bp, Homo sapien
cctgagtgtcccgagactggcctaa

SEQ ID NO: 66728 - DNA, 25 bp, Homo sapien
tctgcggaaagtttctcttgcctca

SEQ ID NO: 66729 - DNA, 25 bp, Homo sapien
gtccctgatcgcaccgtctgcggaa

SEQ ID NO: 66730 - DNA, 25 bp, Homo sapien
gggactgacgcagttcttctacctg

SEQ ID NO: 66731 - DNA, 25 bp, Homo sapien
gactactcctgcctctcatcttgag

SEQ ID NO: 66732 - DNA, 25 bp, Homo sapien
acggctcgcgtgagtccacgtgtaa

SEQ ID NO: 66733 - DNA, 25 bp, Homo sapien
tctacctgctttcccaagggcgaca

SEQ ID NO: 66734 - DNA, 25 bp, Homo sapien
cgccggaagccctcaggaacgtagt

SEQ ID NO: 66735 - DNA, 25 bp, Homo sapien
tgcgctagttcactcacccttacgg

SEQ ID NO: 66736 - DNA, 25 bp, Homo sapien
agcagacgcgaagccctccaacgtg

SEQ ID NO: 66737 - DNA, 25 bp, Homo sapien
tcctagccggttaagcgtcccgaga

SEQ ID NO: 66738 - DNA, 25 bp, Homo sapien
gggccaccacacaaagccaggtcgt

SEQ ID NO: 66739 - DNA, 25 bp, Homo sapien
ccatttttgtgacgtgtcaggggca

SEQ ID NO: 66740 - DNA, 25 bp, Homo sapien
cagtggtctcccaggctaagagccc

SEQ ID NO: 66741 - DNA, 25 bp, Homo sapien
tccgcgcgggattaaagtgagctcc

SEQ ID NO: 66742 - DNA, 25 bp, Homo sapien
aggttgctcctgtacgcgtacgggc

SEQ ID NO: 66743 - DNA, 25 bp, Homo sapien
ttcttggccgcaccttccatgacag

SEQ ID NO: 66744 - DNA, 25 bp, Homo sapien
cagctgcagacgctgagcatgcccg

SEQ ID NO: 66745 - DNA, 25 bp, Homo sapien
agcgcagcgttcacctttccggaca

SEQ ID NO: 66746 - DNA, 25 bp, Homo sapien
aggagcttcaccacctcgggaactg

SEQ ID NO: 66747 - DNA, 25 bp, Homo sapien
cgccgcatccagataacggaacatc

SEQ ID NO: 66748 - DNA, 25 bp, Homo sapien
cggtttccgagacgcgaccacacaa

SEQ ID NO: 66749 - DNA, 25 bp, Homo sapien
gcagctcagcgatgcactcaccatg

SEQ ID NO: 66750 - DNA, 25 bp, Homo sapien
gtccggccctcaactcactagagga

SEQ ID NO: 66751 - DNA, 25 bp, Homo sapien
tcatttccagcgagccgttaaaagg

SEQ ID NO: 66752 - DNA, 25 bp, Homo sapien
ttgacctttccagacgcccgacaga

SEQ ID NO: 66753 - DNA, 25 bp, Homo sapien
tgtttagtcagttcgctccagtctc

SEQ ID NO: 66754 - DNA, 25 bp, Homo sapien
tccagcattggaggcagccgtgacg

SEQ ID NO: 66755 - DNA, 25 bp, Homo sapien
ttccagcgttggaggcagccgtgat

SEQ ID NO: 66756 - DNA, 25 bp, Homo sapien
gttccagcgttggaggcagccgtga

SEQ ID NO: 66757 - DNA, 25 bp, Homo sapien
tgggttccagcattggaggcagccg

SEQ ID NO: 66758 - DNA, 25 bp, Homo sapien
acgcaggggacgtgggttccagcat

SEQ ID NO: 66759 - DNA, 25 bp, Homo sapien
ttccagcattggaggcagccgtgac

SEQ ID NO: 66760 - DNA, 25 bp, Homo sapien
tccagcgttggaggcagccgtgacg

SEQ ID NO: 66761 - DNA, 25 bp, Homo sapien
ttccagcgttggaggcagccgtgac

SEQ ID NO: 66762 - DNA, 25 bp, Homo sapien
ccagggacggcagcagatgatggtt

SEQ ID NO: 66763 - DNA, 25 bp, Homo sapien
agccctgttgcacctgtcgtggtca

SEQ ID NO: 66764 - DNA, 25 bp, Homo sapien
agctcgagccctgttgcacctgtcg

SEQ ID NO: 66765 - DNA, 25 bp, Homo sapien
ccgttgcgccctctgtcggccgcca

SEQ ID NO: 66766 - DNA, 25 bp, Homo sapien
ccagcggctccgttgcgccctctgt

SEQ ID NO: 66767 - DNA, 25 bp, Homo sapien
aggagtggcctaggaaggcctccct

SEQ ID NO: 66768 - DNA, 25 bp, Homo sapien
ctaagttgaccggaaatggggctag

SEQ ID NO: 66769 - DNA, 25 bp, Homo sapien
gcagcgaggtagtcgggaaagagca

SEQ ID NO: 66770 - DNA, 25 bp, Homo sapien
cggagtctttacgacagggaccagc

SEQ ID NO: 66771 - DNA, 25 bp, Homo sapien
aactcccgggcggtgactcatcaac

SEQ ID NO: 66772 - DNA, 25 bp, Homo sapien
tgactcatcaacgagcaccagcggc

SEQ ID NO: 66773 - DNA, 25 bp, Homo sapien
acagagcgctagtccttcggcgagc

SEQ ID NO: 66774 - DNA, 25 bp, Homo sapien
cgacggcgacttttgccgcagctca

SEQ ID NO: 66775 - DNA, 25 bp, Homo sapien
gcgctttccagcgtggagaccggac

SEQ ID NO: 66776 - DNA, 25 bp, Homo sapien
tggccacgtccaggtttcctgcggc

SEQ ID NO: 66777 - DNA, 25 bp, Homo sapien
cttcgcagctttgctcgccttggta

SEQ ID NO: 66778 - DNA, 25 bp, Homo sapien
tcgcgcattttcttcaaccaggagg

SEQ ID NO: 66779 - DNA, 25 bp, Homo sapien
ggagaagccgaccaccacagtgcgc

SEQ ID NO: 66780 - DNA, 25 bp, Homo sapien
ggcttcgtgcgcttctttcagggca

SEQ ID NO: 66781 - DNA, 25 bp, Homo sapien
tctttcagggcatgccggagaagcc

SEQ ID NO: 66782 - DNA, 25 bp, Homo sapien
tcctttcccgcctcagagagtgggc

SEQ ID NO: 66783 - DNA, 25 bp, Homo sapien
gtagctaaagtcaccagcgtgcgcg

SEQ ID NO: 66784 - DNA, 25 bp, Homo sapien
ccgcgtctgcttatgattggttgcc

SEQ ID NO: 66785 - DNA, 25 bp, Homo sapien
cttgtgatcacggagtgtttacgtc

SEQ ID NO: 66786 - DNA, 25 bp, Homo sapien
ccgtaggcgatgaggaaggccttcc

SEQ ID NO: 66787 - DNA, 25 bp, Homo sapien
gccagccggttgttcatgatgccca

SEQ ID NO: 66788 - DNA, 25 bp, Homo sapien
gctcagcttgcgcagcatccagttg

SEQ ID NO: 66789 - DNA, 25 bp, Homo sapien
atccagttgagcacctgcttgatga

SEQ ID NO: 66790 - DNA, 25 bp, Homo sapien
agcagaagtagagcgagtccacgta

SEQ ID NO: 66791 - DNA, 25 bp, Homo sapien
atgagcagcacgtggtacaccgagg

SEQ ID NO: 66792 - DNA, 25 bp, Homo sapien
gtggtcatgccgaaacctgtggaga

SEQ ID NO: 66793 - DNA, 25 bp, Homo sapien
ttgaagaacaggatggtcccagcgc

SEQ ID NO: 66794 - DNA, 25 bp, Homo sapien
ggaagcgctcctttctcagctccag

SEQ ID NO: 66795 - DNA, 25 bp, Homo sapien
ggaatctctcccttatctcatgccg

SEQ ID NO: 66796 - DNA, 25 bp, Homo sapien
gacgcagcgggttccactggaaacg

SEQ ID NO: 66797 - DNA, 25 bp, Homo sapien
tcctttgccctggatcgaaccgcag

SEQ ID NO: 66798 - DNA, 25 bp, Homo sapien
acactggattctcgggcgttagtcc

SEQ ID NO: 66799 - DNA, 25 bp, Homo sapien
cgcgacgcgaatcgccgacactgga

SEQ ID NO: 66800 - DNA, 25 bp, Homo sapien
tttgctcaagttggtggtgctctga

SEQ ID NO: 66801 - DNA, 25 bp, Homo sapien
tcatgccgcggtgaaactttgctca

SEQ ID NO: 66802 - DNA, 25 bp, Homo sapien
aggagacttgctgataaattttgta

SEQ ID NO: 66803 - DNA, 25 bp, Homo sapien
gacataaacagctagccatcatctt

SEQ ID NO: 66804 - DNA, 25 bp, Homo sapien
cagctagccatcatcttaaattatt

SEQ ID NO: 66805 - DNA, 25 bp, Homo sapien
acataaaaacaacaggaacggctgg

SEQ ID NO: 66806 - DNA, 25 bp, Homo sapien
cttaaattattttcttgctgataaa

SEQ ID NO: 66807 - DNA, 25 bp, Homo sapien
agacttgctgataaattttgtaaca

SEQ ID NO: 66808 - DNA, 25 bp, Homo sapien
ttccatgagacataaacagctagcc

SEQ ID NO: 66809 - DNA, 25 bp, Homo sapien
ctagccatcatcttaaattattttc

SEQ ID NO: 66810 - DNA, 25 bp, Homo sapien
gggtatctaagactcgctctccgca

SEQ ID NO: 66811 - DNA, 25 bp, Homo sapien
ccttcttaactacagcgagggaata

SEQ ID NO: 66812 - DNA, 25 bp, Homo sapien
cgggaacgcctaacttctaagatgc

SEQ ID NO: 66813 - DNA, 25 bp, Homo sapien
tcgtgtccgcacctttgtcctcagt

SEQ ID NO: 66814 - DNA, 25 bp, Homo sapien
tccagagtggcaagaaagaagcttt

SEQ ID NO: 66815 - DNA, 25 bp, Homo sapien
ttcagctcagcagaggtagggacta

SEQ ID NO: 66816 - DNA, 25 bp, Homo sapien
cgcacgacgatgacctgcttgcatc

SEQ ID NO: 66817 - DNA, 25 bp, Homo sapien
cagttccactgtgcctgagcgttca

SEQ ID NO: 66818 - DNA, 25 bp, Homo sapien
gtgcttttaggagctccgtccgaca

SEQ ID NO: 66819 - DNA, 25 bp, Homo sapien
ccgcgcggtagatgcggtgctttta

SEQ ID NO: 66820 - DNA, 25 bp, Homo sapien
tccgacagaacggttgggccttgcc

SEQ ID NO: 66821 - DNA, 25 bp, Homo sapien
gtatgtcgcgacagagcaccctgta

SEQ ID NO: 66822 - DNA, 25 bp, Homo sapien
agtctccggcgctgagtgatgccaa

SEQ ID NO: 66823 - DNA, 25 bp, Homo sapien
tgatgccaacaaggcctcggccagg

SEQ ID NO: 66824 - DNA, 25 bp, Homo sapien
gcccaaggcgaagaacctcaacgga

SEQ ID NO: 66825 - DNA, 25 bp, Homo sapien
agatttcccgccagcaggagccgcg

SEQ ID NO: 66826 - DNA, 25 bp, Homo sapien
cgcccgtacaaccttccggccaatg

SEQ ID NO: 66827 - DNA, 25 bp, Homo sapien
aagtgattaatccttcggttcgccg

SEQ ID NO: 66828 - DNA, 25 bp, Homo sapien
atggggagaagtgattaatccttcg

SEQ ID NO: 66829 - DNA, 25 bp, Homo sapien
agcgccagtgcgtagcgacgattct

SEQ ID NO: 66830 - DNA, 25 bp, Homo sapien
cgtccaggcggccaatctaaggcgc

SEQ ID NO: 66831 - DNA, 25 bp, Homo sapien
cgctcttatcgcgaagtcccttcaa

SEQ ID NO: 66832 - DNA, 25 bp, Homo sapien
cggccaatctaaggcgcccgtacaa

SEQ ID NO: 66833 - DNA, 25 bp, Homo sapien
tggggaggtatcagggcaaataata

SEQ ID NO: 66834 - DNA, 25 bp, Homo sapien
ggaatctgctgttagggaagtaccc

SEQ ID NO: 66835 - DNA, 25 bp, Homo sapien
ttttgtccagtgaggaatttgcgcc

SEQ ID NO: 66836 - DNA, 25 bp, Homo sapien
gcactcctataggtccttcctcgga

SEQ ID NO: 66837 - DNA, 25 bp, Homo sapien
ctcggacatgcgaggcctttgcatt

SEQ ID NO: 66838 - DNA, 25 bp, Homo sapien
cggtgctctgccatattgtgtcttc

SEQ ID NO: 66839 - DNA, 25 bp, Homo sapien
gtgacgcgcccggacatttttgtcc

SEQ ID NO: 66840 - DNA, 25 bp, Homo sapien
ttttcctgagaggtaatgaccgccc

SEQ ID NO: 66841 - DNA, 25 bp, Homo sapien
aagcacctcggagcctttgcaacgc

SEQ ID NO: 66842 - DNA, 25 bp, Homo sapien
ggccctctggtcttcgcaattatcg

SEQ ID NO: 66843 - DNA, 25 bp, Homo sapien
agcgaggctacgcacgcacgtattc

SEQ ID NO: 66844 - DNA, 25 bp, Homo sapien
gatactgcctgacccgttcccggga

SEQ ID NO: 66845 - DNA, 25 bp, Homo sapien
gaatgtttcttcttccggccctctg

SEQ ID NO: 66846 - DNA, 25 bp, Homo sapien
catgagtctcttcccgtcttgattc

SEQ ID NO: 66847 - DNA, 25 bp, Homo sapien
ccgcccattctataggctctcatga

SEQ ID NO: 66848 - DNA, 25 bp, Homo sapien
ggccagaattcttgatgcgcttaga

SEQ ID NO: 66849 - DNA, 25 bp, Homo sapien
tactcgaaggtacccatcgtggtct

SEQ ID NO: 66850 - DNA, 25 bp, Homo sapien
gaagttctcgtccagccggtaaagc

SEQ ID NO: 66851 - DNA, 25 bp, Homo sapien
cactgcatcagcatgtgggtgaact

SEQ ID NO: 66852 - DNA, 25 bp, Homo sapien
ccacgatcttcctggtctcatagta

SEQ ID NO: 66853 - DNA, 25 bp, Homo sapien
tctcatagtagatggtgtcgccgtc

SEQ ID NO: 66854 - DNA, 25 bp, Homo sapien
ctcccgtacacgttggatgcgtcta

SEQ ID NO: 66855 - DNA, 25 bp, Homo sapien
ttgacaagcgtgtggccaaacctga

SEQ ID NO: 66856 - DNA, 25 bp, Homo sapien
acacgttgctgcagtgctgtccgtc

SEQ ID NO: 66857 - DNA, 25 bp, Homo sapien
cccgcgggtacacggagttcatgag

SEQ ID NO: 66858 - DNA, 25 bp, Homo sapien
ggtccgactctaaagagaaaactca

SEQ ID NO: 66859 - DNA, 25 bp, Homo sapien
accgcgctgccggtgagtgaccagc

SEQ ID NO: 66860 - DNA, 25 bp, Homo sapien
atggcctcccggcagggactcctcg

SEQ ID NO: 66861 - DNA, 25 bp, Homo sapien
ctctaaagagaaaactcaaacagca

SEQ ID NO: 66862 - DNA, 25 bp, Homo sapien
aaggaatatcgactcagttccgagg

SEQ ID NO: 66863 - DNA, 25 bp, Homo sapien
atatcgactcagttccgagggcggg

SEQ ID NO: 66864 - DNA, 25 bp, Homo sapien
tcgacctctcggacccgggccacca

SEQ ID NO: 66865 - DNA, 25 bp, Homo sapien
tcccgccgtgtctgggaaagtttgc

SEQ ID NO: 66866 - DNA, 25 bp, Homo sapien
tcaaacccgctccatctattaacgt

SEQ ID NO: 66867 - DNA, 25 bp, Homo sapien
tctattaacgttctcttctgcccag

SEQ ID NO: 66868 - DNA, 25 bp, Homo sapien
gtgtttccctccgagggcactgcgt

SEQ ID NO: 66869 - DNA, 25 bp, Homo sapien
aacgtgcccagtgtttccctccgag

SEQ ID NO: 66870 - DNA, 25 bp, Homo sapien
tacatcgttcaaaacgtgcccagtg

SEQ ID NO: 66871 - DNA, 25 bp, Homo sapien
gttgcgcacctgacgtacatcgttc

SEQ ID NO: 66872 - DNA, 25 bp, Homo sapien
cggcgttctccgtggttgcgcacct

SEQ ID NO: 66873 - DNA, 25 bp, Homo sapien
tagcgggtctcttttctcacacagg

SEQ ID NO: 66874 - DNA, 25 bp, Homo sapien
aactgggcttctgcggcttgccagt

SEQ ID NO: 66875 - DNA, 25 bp, Homo sapien
ttcatggccggcgaactgggcttct

SEQ ID NO: 66876 - DNA, 25 bp, Homo sapien
aaccgctgcttcatggccggcgaac

SEQ ID NO: 66877 - DNA, 25 bp, Homo sapien
gctgcagcgccgagaaccgctgctt

SEQ ID NO: 66878 - DNA, 25 bp, Homo sapien
tcacagtcgagtgagaccggccgtg

SEQ ID NO: 66879 - DNA, 25 bp, Homo sapien
gcgctgtgtactcacagtcgagtga

SEQ ID NO: 66880 - DNA, 25 bp, Homo sapien
gcgacgggagcgctgtgtactcaca

SEQ ID NO: 66881 - DNA, 25 bp, Homo sapien
cttgccagtgtcttggacggcctct

SEQ ID NO: 66882 - DNA, 25 bp, Homo sapien
cagggctccaggttctcgagagata

SEQ ID NO: 66883 - DNA, 25 bp, Homo sapien
tccttcggacagtcttctcggggtc

SEQ ID NO: 66884 - DNA, 25 bp, Homo sapien
tcctgacacttacgcccggcgaggg

SEQ ID NO: 66885 - DNA, 25 bp, Homo sapien
ggaaggtcctcacttctacatgaca

SEQ ID NO: 66886 - DNA, 25 bp, Homo sapien
ccaccgcgaatccactaggtaaatc

SEQ ID NO: 66887 - DNA, 25 bp, Homo sapien
catttagctttgtgtgcggggacta

SEQ ID NO: 66888 - DNA, 25 bp, Homo sapien
ggcccaacctcctttcaagacagaa

SEQ ID NO: 66889 - DNA, 25 bp, Homo sapien
gcaccggagcatcctctggtacatg

SEQ ID NO: 66890 - DNA, 25 bp, Homo sapien
ggagttgaccctcacgtcacgaatc

SEQ ID NO: 66891 - DNA, 25 bp, Homo sapien
tcctggacaccgtgacgaagaaata

SEQ ID NO: 66892 - DNA, 25 bp, Homo sapien
cagaagccctcgtcgtcgaagtaga

SEQ ID NO: 66893 - DNA, 25 bp, Homo sapien
cgcgtcagaatcagctccaggaagt

SEQ ID NO: 66894 - DNA, 25 bp, Homo sapien
ttggcctccacctggtcgatgaaga

SEQ ID NO: 66895 - DNA, 25 bp, Homo sapien
aaaggccgctgaacaccgtcatgtc

SEQ ID NO: 66896 - DNA, 25 bp, Homo sapien
gaagcgaactgccacacgtttgcca

SEQ ID NO: 66897 - DNA, 25 bp, Homo sapien
tgtccctgcgcttggacttgacctc

SEQ ID NO: 66898 - DNA, 25 bp, Homo sapien
gtccttcgggagcatgtttcgttcc

SEQ ID NO: 66899 - DNA, 25 bp, Homo sapien
gcgagtcctgagacacccgtaactg

SEQ ID NO: 66900 - DNA, 25 bp, Homo sapien
atctgctgctaaaacgcgctccggc

SEQ ID NO: 66901 - DNA, 25 bp, Homo sapien
ttccggtccggatctaaggcagtgt

SEQ ID NO: 66902 - DNA, 25 bp, Homo sapien
tggcagtttctcctaccagtgcgag

SEQ ID NO: 66903 - DNA, 25 bp, Homo sapien
gtcctaccttacagcggtggtccta

SEQ ID NO: 66904 - DNA, 25 bp, Homo sapien
cggtcggtcctttgattggctagtc

SEQ ID NO: 66905 - DNA, 25 bp, Homo sapien
gtcgccaggtgaggaacttcccatt

SEQ ID NO: 66906 - DNA, 25 bp, Homo sapien
gctgtcatacatcactcaggccgtg

SEQ ID NO: 66907 - DNA, 25 bp, Homo sapien
tgaccctggacggacagaccctgaa

SEQ ID NO: 66908 - DNA, 25 bp, Homo sapien
aggcggtcatgatagccctcaccca

SEQ ID NO: 66909 - DNA, 25 bp, Homo sapien
tacaacaggggctccacgctcaact

SEQ ID NO: 66910 - DNA, 25 bp, Homo sapien
cctctgcagcagtagcggcactagc

SEQ ID NO: 66911 - DNA, 25 bp, Homo sapien
ttgcccagcaccaacctgaatcgtg

SEQ ID NO: 66912 - DNA, 25 bp, Homo sapien
ccttgaatgccctgtctctggagca

SEQ ID NO: 66913 - DNA, 25 bp, Homo sapien
cctcatagtgacaggacagtctccc

SEQ ID NO: 66914 - DNA, 25 bp, Homo sapien
gagccttcggtcttcttgtctgtga

SEQ ID NO: 66915 - DNA, 25 bp, Homo sapien
caccagtatcatgaggagaggaaac

SEQ ID NO: 66916 - DNA, 25 bp, Homo sapien
cagagccgctcacacttggaaaacg

SEQ ID NO: 66917 - DNA, 25 bp, Homo sapien
gtgacctactacttcgaccacaacg

SEQ ID NO: 66918 - DNA, 25 bp, Homo sapien
agccagcctcccaaaaattcgcaga

SEQ ID NO: 66919 - DNA, 25 bp, Homo sapien
ccgggtgtcctgcttcttatagctt

SEQ ID NO: 66920 - DNA, 25 bp, Homo sapien
gtgaacccgtcactatgggaactgc

SEQ ID NO: 66921 - DNA, 25 bp, Homo sapien
caacgcggtgacttggaggaacttt

SEQ ID NO: 66922 - DNA, 25 bp, Homo sapien
tacagcaggcgcttctggcagggca

SEQ ID NO: 66923 - DNA, 25 bp, Homo sapien
gtcggatacatcaccaactacagca

SEQ ID NO: 66924 - DNA, 25 bp, Homo sapien
cgacagctagggttcacggccactg

SEQ ID NO: 66925 - DNA, 25 bp, Homo sapien
tttggttacgggtccctgatctgga

SEQ ID NO: 66926 - DNA, 25 bp, Homo sapien
tcaggacaagctggtcggatacatc

SEQ ID NO: 66927 - DNA, 25 bp, Homo sapien
tcaccaactacagcaggcgcttctg

SEQ ID NO: 66928 - DNA, 25 bp, Homo sapien
ttctggcagggcagcacggaccacc

SEQ ID NO: 66929 - DNA, 25 bp, Homo sapien
ggttactcgcttaccggaggcttca

SEQ ID NO: 66930 - DNA, 25 bp, Homo sapien
cagcgatgacatccctttccgagtc

SEQ ID NO: 66931 - DNA, 25 bp, Homo sapien
gagcccttcctcaactcagcgatga

SEQ ID NO: 66932 - DNA, 25 bp, Homo sapien
cccggatgttgatatgtcgtctgcc

SEQ ID NO: 66933 - DNA, 25 bp, Homo sapien
atgctgcagccgtccgaaaacgaga

SEQ ID NO: 66934 - DNA, 25 bp, Homo sapien
gtctccagagctgcgtcccagaagc

SEQ ID NO: 66935 - DNA, 25 bp, Homo sapien
gtgctgccacttctacaccgaaatg

SEQ ID NO: 66936 - DNA, 25 bp, Homo sapien
ggttcacactgtcttcttcccgcta

SEQ ID NO: 66937 - DNA, 25 bp, Homo sapien
cactccgtgtgggtcaaacctctgc

SEQ ID NO: 66938 - DNA, 25 bp, Homo sapien
caggactagaggcatcatcgccatc

SEQ ID NO: 66939 - DNA, 25 bp, Homo sapien
agaggcgcagtcacggagacgccga

SEQ ID NO: 66940 - DNA, 25 bp, Homo sapien
gcctgccgctctggatgatgcagga

SEQ ID NO: 66941 - DNA, 25 bp, Homo sapien
tctccggcatcgtggggttgtcctc

SEQ ID NO: 66942 - DNA, 25 bp, Homo sapien
gcgctcctcgctatcccgccagcct

SEQ ID NO: 66943 - DNA, 25 bp, Homo sapien
caccaggaagacaggtacgcggagc

SEQ ID NO: 66944 - DNA, 25 bp, Homo sapien
cctgcaggccgcaccaggaagacag

SEQ ID NO: 66945 - DNA, 25 bp, Homo sapien
gacgggcgagaaggctaccctgcag

SEQ ID NO: 66946 - DNA, 25 bp, Homo sapien
aaagcggtggcatggacgctgtcaa

SEQ ID NO: 66947 - DNA, 25 bp, Homo sapien
gttcacccgcgggtcaactggcaag

SEQ ID NO: 66948 - DNA, 25 bp, Homo sapien
ccgccagaaggcgtgatgttcaccc

SEQ ID NO: 66949 - DNA, 25 bp, Homo sapien
ctctcgtccaggagatccgcggcgg

SEQ ID NO: 66950 - DNA, 25 bp, Homo sapien
cgacgttctgtatgtaaagcccgcc

SEQ ID NO: 66951 - DNA, 25 bp, Homo sapien
ttggtcgcagagcacgcatactctc

SEQ ID NO: 66952 - DNA, 25 bp, Homo sapien
cgctgtcaatgttgttggtcgcaga

SEQ ID NO: 66953 - DNA, 25 bp, Homo sapien
agggtgtgcggtcacctctcgtcca

SEQ ID NO: 66954 - DNA, 25 bp, Homo sapien
tggagtcccagtcgccacgacaggc

SEQ ID NO: 66955 - DNA, 25 bp, Homo sapien
tgttgtagacgatctccttctgcgg

SEQ ID NO: 66956 - DNA, 25 bp, Homo sapien
ccacgcggctctcagttcgttggcg

SEQ ID NO: 66957 - DNA, 25 bp, Homo sapien
gaggctgcctcaccggaaacacgag

SEQ ID NO: 66958 - DNA, 25 bp, Homo sapien
cacgaggccgaattccaagctattg

SEQ ID NO: 66959 - DNA, 25 bp, Homo sapien
aagctattgtcctgcttcgccgggg

SEQ ID NO: 66960 - DNA, 25 bp, Homo sapien
aagcggcagcccactggagtcccag

SEQ ID NO: 66961 - DNA, 25 bp, Homo sapien
gggcagcagcttgttgtagacgatc

SEQ ID NO: 66962 - DNA, 25 bp, Homo sapien
tctcatttgccgcttccgacgcgtg

SEQ ID NO: 66963 - DNA, 25 bp, Homo sapien
agtatgccttttcccgttgtggctg

SEQ ID NO: 66964 - DNA, 25 bp, Homo sapien
agaaagctgtgagaagcgcctccca

SEQ ID NO: 66965 - DNA, 25 bp, Homo sapien
cctctacggtgggagatcaaaaagg

SEQ ID NO: 66966 - DNA, 25 bp, Homo sapien
actacgaggtgttcggaagagtgca

SEQ ID NO: 66967 - DNA, 25 bp, Homo sapien
tcactcaaatccgtggactacgagg

SEQ ID NO: 66968 - DNA, 25 bp, Homo sapien
atgtctaccgcccagtcactcaaat

SEQ ID NO: 66969 - DNA, 25 bp, Homo sapien
gtgcgccaagcagtcccatgtgtcc

SEQ ID NO: 66970 - DNA, 25 bp, Homo sapien
tccaagcggccatcaaacatatctg

SEQ ID NO: 66971 - DNA, 25 bp, Homo sapien
cttccagagcatagtcgagagtagc

SEQ ID NO: 66972 - DNA, 25 bp, Homo sapien
ctgcgacccgcatcgaccaagatgt

SEQ ID NO: 66973 - DNA, 25 bp, Homo sapien
ttgatggctccatgactgcgacccg

SEQ ID NO: 66974 - DNA, 25 bp, Homo sapien
ctcttcacccggaaagccatttttg

SEQ ID NO: 66975 - DNA, 25 bp, Homo sapien
gcgtcaacgttcctcacacaaaatg

SEQ ID NO: 66976 - DNA, 25 bp, Homo sapien
atctgccattacctctgtcgccttg

SEQ ID NO: 66977 - DNA, 25 bp, Homo sapien
ctgtcgccttgctcttttctcggga

SEQ ID NO: 66978 - DNA, 25 bp, Homo sapien
cctcctggccctacaatgggaaggg

SEQ ID NO: 66979 - DNA, 25 bp, Homo sapien
gtcgcttagcaacgcgcgagtcaca

SEQ ID NO: 66980 - DNA, 25 bp, Homo sapien
ttccgaggactagcgcccgtcgctt

SEQ ID NO: 66981 - DNA, 25 bp, Homo sapien
gcgcagtcgcgcacagtgagcaaca

SEQ ID NO: 66982 - DNA, 25 bp, Homo sapien
agggcaagttcaaacgcagggcgtc

SEQ ID NO: 66983 - DNA, 25 bp, Homo sapien
tggcagcgctttgacgacgacctgc

SEQ ID NO: 66984 - DNA, 25 bp, Homo sapien
ggcccgcacttttgcagccagcttg

SEQ ID NO: 66985 - DNA, 25 bp, Homo sapien
ggcgtcgagcccacacgcctagaga

SEQ ID NO: 66986 - DNA, 25 bp, Homo sapien
gtccttgggaggctgcgaccgcctc

SEQ ID NO: 66987 - DNA, 25 bp, Homo sapien
gggcaccgaaatagcctcgtagtcc

SEQ ID NO: 66988 - DNA, 25 bp, Homo sapien
aatagcctcgtagtcccgcggagac

SEQ ID NO: 66989 - DNA, 25 bp, Homo sapien
ggtctctaattaggcctgaccgcgt

SEQ ID NO: 66990 - DNA, 25 bp, Homo sapien
ggagcccggtctctaattaggcctg

SEQ ID NO: 66991 - DNA, 25 bp, Homo sapien
cagatgttggcatgcggggcacctt

SEQ ID NO: 66992 - DNA, 25 bp, Homo sapien
ggccgctcgcactaccagcctgtct

SEQ ID NO: 66993 - DNA, 25 bp, Homo sapien
ccctctccagatgttggcatgcggg

SEQ ID NO: 66994 - DNA, 25 bp, Homo sapien
ttttcaggtgccctctctgtggccc

SEQ ID NO: 66995 - DNA, 25 bp, Homo sapien
cggacagccggagggtctattttca

SEQ ID NO: 66996 - DNA, 25 bp, Homo sapien
cattggtactcggatgatgcgggac

SEQ ID NO: 66997 - DNA, 25 bp, Homo sapien
agatgccaactcactggggctgcct

SEQ ID NO: 66998 - DNA, 25 bp, Homo sapien
gaggcagggagatgccaactcactg

SEQ ID NO: 66999 - DNA, 25 bp, Homo sapien
aatcagtgccgctgttgccgtgcag

SEQ ID NO: 67000 - DNA, 25 bp, Homo sapien
cccggaatcagtgccgctgttgccg

SEQ ID NO: 67001 - DNA, 25 bp, Homo sapien
ggtctattttcaggtgccctctctg

SEQ ID NO: 67002 - DNA, 25 bp, Homo sapien
aggacgtctagtatctccgggccgc

SEQ ID NO: 67003 - DNA, 25 bp, Homo sapien
tcgcggagctaaggtggactctctt

SEQ ID NO: 67004 - DNA, 25 bp, Homo sapien
agatgcctgtgtggtaactcctcgc

SEQ ID NO: 67005 - DNA, 25 bp, Homo sapien
ttatttcgagcttccaggcaagggc

SEQ ID NO: 67006 - DNA, 25 bp, Homo sapien
gcgagtggctcctgataaaattaca

SEQ ID NO: 67007 - DNA, 25 bp, Homo sapien
ctcctcgtggtatagcctgcatttc

SEQ ID NO: 67008 - DNA, 25 bp, Homo sapien
ggcgcgctagccttttcaagtgata

SEQ ID NO: 67009 - DNA, 25 bp, Homo sapien
agctctgtttgggaaggcactaccg

SEQ ID NO: 67010 - DNA, 25 bp, Homo sapien
gcgtggcccacatggagttctgtta

SEQ ID NO: 67011 - DNA, 25 bp, Homo sapien
atttacatccgggagcagtgggcca

SEQ ID NO: 67012 - DNA, 25 bp, Homo sapien
gccactttgagcaggccatcaagga

SEQ ID NO: 67013 - DNA, 25 bp, Homo sapien
gcgtcatgcgcctgctcagcaagca

SEQ ID NO: 67014 - DNA, 25 bp, Homo sapien
cgattacgggaaagacctgaccagc

SEQ ID NO: 67015 - DNA, 25 bp, Homo sapien
agaagatcctgtcctcggacgatta

SEQ ID NO: 67016 - DNA, 25 bp, Homo sapien
agttctgttatcaagagctttgcca

SEQ ID NO: 67017 - DNA, 25 bp, Homo sapien
tagagcagctctcggccattcggaa

SEQ ID NO: 67018 - DNA, 25 bp, Homo sapien
ctggggagaagtacacgatttttgc

SEQ ID NO: 67019 - DNA, 25 bp, Homo sapien
cctcgaccaggagcgtttgtaggta

SEQ ID NO: 67020 - DNA, 25 bp, Homo sapien
agtgcctcgtttcttccgagtaaga

SEQ ID NO: 67021 - DNA, 25 bp, Homo sapien
tgcatattcgccctcgcttattagg

SEQ ID NO: 67022 - DNA, 25 bp, Homo sapien
ggcagcagcatttacgcatatttca

SEQ ID NO: 67023 - DNA, 25 bp, Homo sapien
tcgcttcctggatatagactgtcaa

SEQ ID NO: 67024 - DNA, 25 bp, Homo sapien
ctcacccgggttgcctgtcaaatca

SEQ ID NO: 67025 - DNA, 25 bp, Homo sapien
tttcggatccaaagacggcgatggc

SEQ ID NO: 67026 - DNA, 25 bp, Homo sapien
cccaaagcatctggggctgcacaca

SEQ ID NO: 67027 - DNA, 25 bp, Homo sapien
gagccaatcggctacaggatcgaga

SEQ ID NO: 67028 - DNA, 25 bp, Homo sapien
ggactctccgcccagtttggcgtga

SEQ ID NO: 67029 - DNA, 25 bp, Homo sapien
gacggctcccggaacaatgagactg

SEQ ID NO: 67030 - DNA, 25 bp, Homo sapien
tccgaggacgagaccagaggagact

SEQ ID NO: 67031 - DNA, 25 bp, Homo sapien
gggctccctcacgaactggtacttg

SEQ ID NO: 67032 - DNA, 25 bp, Homo sapien
tcatttccgaagtccatcaggggcg

SEQ ID NO: 67033 - DNA, 25 bp, Homo sapien
gccggcggcacgaagtcatttccga

SEQ ID NO: 67034 - DNA, 25 bp, Homo sapien
cctcaatgatgtcaaaagtaacagt

SEQ ID NO: 67035 - DNA, 25 bp, Homo sapien
tagctttcaagcagccgcattatgc

SEQ ID NO: 67036 - DNA, 25 bp, Homo sapien
tttcagagtatagctttcaagcagc

SEQ ID NO: 67037 - DNA, 25 bp, Homo sapien
tcagtaaagaatcatgggcggcggc

SEQ ID NO: 67038 - DNA, 25 bp, Homo sapien
cgcgaccgctctcggctttggggac

SEQ ID NO: 67039 - DNA, 25 bp, Homo sapien
acccgctcagcggtccctgctcaca

SEQ ID NO: 67040 - DNA, 25 bp, Homo sapien
gtaacagtatttttcagagtatagc

SEQ ID NO: 67041 - DNA, 25 bp, Homo sapien
cgcattatgccgctttcagtaaaga

SEQ ID NO: 67042 - DNA, 25 bp, Homo sapien
ccgcagggcgaacaaaggcccagcg

SEQ ID NO: 67043 - DNA, 25 bp, Homo sapien
cagcagatgcatgcagcgcacggtg

SEQ ID NO: 67044 - DNA, 25 bp, Homo sapien
caacttcccagtcctgcggggattc

SEQ ID NO: 67045 - DNA, 25 bp, Homo sapien
tccgagttccgaacaaaggcggcta

SEQ ID NO: 67046 - DNA, 25 bp, Homo sapien
gcctccagcagcagatgcatgcagc

SEQ ID NO: 67047 - DNA, 25 bp, Homo sapien
cgcggcactcacaggatggaggtct

SEQ ID NO: 67048 - DNA, 25 bp, Homo sapien
gcagaacagcacgagcgccaacagg

SEQ ID NO: 67049 - DNA, 25 bp, Homo sapien
agctgtgcacatgcgcgaggctcct

SEQ ID NO: 67050 - DNA, 25 bp, Homo sapien
ggctcacgcagggattaaatgcatc

SEQ ID NO: 67051 - DNA, 25 bp, Homo sapien
gtgcacatgccttcgtgaatgccta

SEQ ID NO: 67052 - DNA, 25 bp, Homo sapien
ggcttccgaacgcacaatgtttatg

SEQ ID NO: 67053 - DNA, 25 bp, Homo sapien
gttcgcgtgatttgtgccactgaca

SEQ ID NO: 67054 - DNA, 25 bp, Homo sapien
cgcttccgagagaacagtgcacatg

SEQ ID NO: 67055 - DNA, 25 bp, Homo sapien
cctgcaccggacaaccctggttaag

SEQ ID NO: 67056 - DNA, 25 bp, Homo sapien
gcggagatcaccttctggacccgga

SEQ ID NO: 67057 - DNA, 25 bp, Homo sapien
ttctttccggaattcagagagttgc

SEQ ID NO: 67058 - DNA, 25 bp, Homo sapien
gtgagaacgtcgctcctggaatatt

SEQ ID NO: 67059 - DNA, 25 bp, Homo sapien
aggcgcctgttgagagctcccgcag

SEQ ID NO: 67060 - DNA, 25 bp, Homo sapien
ttcgcaagccggagccctcagcgga

SEQ ID NO: 67061 - DNA, 25 bp, Homo sapien
cctcagcggacgatgttcagggact

SEQ ID NO: 67062 - DNA, 25 bp, Homo sapien
atccacactgaggtcgtggagcacc

SEQ ID NO: 67063 - DNA, 25 bp, Homo sapien
ccctagaagcgaccgccgagacagg

SEQ ID NO: 67064 - DNA, 25 bp, Homo sapien
ctgagatcaggtgtcccagggtcaa

SEQ ID NO: 67065 - DNA, 25 bp, Homo sapien
ccagggtcaatgtaccgtgagaacg

SEQ ID NO: 67066 - DNA, 25 bp, Homo sapien
ccctctatggagaagccggagtaac

SEQ ID NO: 67067 - DNA, 25 bp, Homo sapien
ccacgttaaggataccgaggcgcca

SEQ ID NO: 67068 - DNA, 25 bp, Homo sapien
catggagccgctttcgacccgcgga

SEQ ID NO: 67069 - DNA, 25 bp, Homo sapien
ctcagtaccaacaggcagggctcgc

SEQ ID NO: 67070 - DNA, 25 bp, Homo sapien
gcctttcagcgcgtctctgggaatc

SEQ ID NO: 67071 - DNA, 25 bp, Homo sapien
agtaacggcctcagaaccgcagtgc

SEQ ID NO: 67072 - DNA, 25 bp, Homo sapien
tgtgggagaagaaaaccgctgcatg

SEQ ID NO: 67073 - DNA, 25 bp, Homo sapien
tctgggaatccctggcacaaaatca

SEQ ID NO: 67074 - DNA, 25 bp, Homo sapien
gtcgtgagaaatggccctcgcctgg

SEQ ID NO: 67075 - DNA, 25 bp, Homo sapien
gaggtcagcgaggacccgggaggca

SEQ ID NO: 67076 - DNA, 25 bp, Homo sapien
cttctgcccgagcggaggtcagcga

SEQ ID NO: 67077 - DNA, 25 bp, Homo sapien
ctggagaaaaacgtggctgggcttc

SEQ ID NO: 67078 - DNA, 25 bp, Homo sapien
cagcgggtcgtgagaaatggccctc

SEQ ID NO: 67079 - DNA, 25 bp, Homo sapien
cagttctccgctgcggacggtaggt

SEQ ID NO: 67080 - DNA, 25 bp, Homo sapien
tcggcctgcagttctccgctgcgga

SEQ ID NO: 67081 - DNA, 25 bp, Homo sapien
gccgccgagcgagggagaaccgcgc

SEQ ID NO: 67082 - DNA, 25 bp, Homo sapien
ctggttggtagcttctatcctgggg

SEQ ID NO: 67083 - DNA, 25 bp, Homo sapien
atagcgaccattttgcattaactgg

SEQ ID NO: 67084 - DNA, 25 bp, Homo sapien
ctctcggctccttgtggcccaaagg

SEQ ID NO: 67085 - DNA, 25 bp, Homo sapien
gctcctggaaagttgtcttcacttc

SEQ ID NO: 67086 - DNA, 25 bp, Homo sapien
aagttgtcttcacttccgggccgcg

SEQ ID NO: 67087 - DNA, 25 bp, Homo sapien
ctagggcggctacgtgtgttgccat

SEQ ID NO: 67088 - DNA, 25 bp, Homo sapien
tgtgttgccatagcgaccattttgc

SEQ ID NO: 67089 - DNA, 25 bp, Homo sapien
cattaactggttggtagcttctatc

SEQ ID NO: 67090 - DNA, 25 bp, Homo sapien
ctcactcttaggagacggtaaaggc

SEQ ID NO: 67091 - DNA, 25 bp, Homo sapien
ctccaaaggttcagccgcgagaagg

SEQ ID NO: 67092 - DNA, 25 bp, Homo sapien
cggccgacaagtcccatgagcagca

SEQ ID NO: 67093 - DNA, 25 bp, Homo sapien
tatccgacatggtggctgctgtctc

SEQ ID NO: 67094 - DNA, 25 bp, Homo sapien
gggtatagaccttcactcgccgccg

SEQ ID NO: 67095 - DNA, 25 bp, Homo sapien
tgccggtcttcgttcagggtataga

SEQ ID NO: 67096 - DNA, 25 bp, Homo sapien
cggagaggcccgaattcaccatggc

SEQ ID NO: 67097 - DNA, 25 bp, Homo sapien
gccgccgcggtaactactacagatc

SEQ ID NO: 67098 - DNA, 25 bp, Homo sapien
ctgattggctcactccgcagaccgt

SEQ ID NO: 67099 - DNA, 25 bp, Homo sapien
gggtcaaacctatcagaacgcgatt

SEQ ID NO: 67100 - DNA, 25 bp, Homo sapien
agtgctcgcacttgcaactgggtga

SEQ ID NO: 67101 - DNA, 25 bp, Homo sapien
ccgatcccgccgtggcagaaggaaa

SEQ ID NO: 67102 - DNA, 25 bp, Homo sapien
ttggccaccttctacgaagactaga

SEQ ID NO: 67103 - DNA, 25 bp, Homo sapien
aggaaaggaccatcgctcaggggcc

SEQ ID NO: 67104 - DNA, 25 bp, Homo sapien
tgttgcctaagtccacggccacagc

SEQ ID NO: 67105 - DNA, 25 bp, Homo sapien
cgagaccctgcgctactccatagtg

SEQ ID NO: 67106 - DNA, 25 bp, Homo sapien
ccgagtactcgcacttgctgacaga

SEQ ID NO: 67107 - DNA, 25 bp, Homo sapien
cggcttaaatctcgcacactggtcc

SEQ ID NO: 67108 - DNA, 25 bp, Homo sapien
gctaccttcggtttcaggctgccta

SEQ ID NO: 67109 - DNA, 25 bp, Homo sapien
accgcagcccaaggtaccagtttcg

SEQ ID NO: 67110 - DNA, 25 bp, Homo sapien
taacagcaagctaacgcggcggtcc

SEQ ID NO: 67111 - DNA, 25 bp, Homo sapien
atggaatccaggtgcggcttaaatc

SEQ ID NO: 67112 - DNA, 25 bp, Homo sapien
acagatcgcattccgaggctgcaca

SEQ ID NO: 67113 - DNA, 25 bp, Homo sapien
cagggcagttctcgggtactcaaca

SEQ ID NO: 67114 - DNA, 25 bp, Homo sapien
cggtggaggacctgtccaaagtgtc

SEQ ID NO: 67115 - DNA, 25 bp, Homo sapien
cggcgcgccctccaagctaggagag

SEQ ID NO: 67116 - DNA, 25 bp, Homo sapien
ccctcaccatggacttgcgcggagt

SEQ ID NO: 67117 - DNA, 25 bp, Homo sapien
tcaccatggacttgcgcggagttgg

SEQ ID NO: 67118 - DNA, 25 bp, Homo sapien
cgcggataccatgtcgaaggcggcc

SEQ ID NO: 67119 - DNA, 25 bp, Homo sapien
ctgtccaaagtgtcggacgaggagc

SEQ ID NO: 67120 - DNA, 25 bp, Homo sapien
cacagcaacctcatccgcgaggtga

SEQ ID NO: 67121 - DNA, 25 bp, Homo sapien
aggtaggatggccacccagcgcgac

SEQ ID NO: 67122 - DNA, 25 bp, Homo sapien
gagtttctctttttgccggtgcaga

SEQ ID NO: 67123 - DNA, 25 bp, Homo sapien
gtgcttatttcgtaccaaactggtc

SEQ ID NO: 67124 - DNA, 25 bp, Homo sapien
gaggtagtaacacagctcccattcc

SEQ ID NO: 67125 - DNA, 25 bp, Homo sapien
gtcagtctcttgctctggggtcttg

SEQ ID NO: 67126 - DNA, 25 bp, Homo sapien
cgctgcttccgcgtttggttctttt

SEQ ID NO: 67127 - DNA, 25 bp, Homo sapien
tgccaaaagcgggtccgacgtgtta

SEQ ID NO: 67128 - DNA, 25 bp, Homo sapien
gcttctcgttaccttccgcagggtc

SEQ ID NO: 67129 - DNA, 25 bp, Homo sapien
cttctactcacgtttgccaaaagcg

SEQ ID NO: 67130 - DNA, 25 bp, Homo sapien
gtacctgagccgagatgaatccctc

SEQ ID NO: 67131 - DNA, 25 bp, Homo sapien
ttagctagaaagcaaccactgggcg

SEQ ID NO: 67132 - DNA, 25 bp, Homo sapien
ccatggctcgaagtccggagaaaca

SEQ ID NO: 67133 - DNA, 25 bp, Homo sapien
tttcgaccggttctggggcagaagc

SEQ ID NO: 67134 - DNA, 25 bp, Homo sapien
tgaatccctcatacacggttttcga

SEQ ID NO: 67135 - DNA, 25 bp, Homo sapien
agcggcgcttctcaaacctttagtc

SEQ ID NO: 67136 - DNA, 25 bp, Homo sapien
ttagtctcccaagagccgttacgcg

SEQ ID NO: 67137 - DNA, 25 bp, Homo sapien
agctacgctgcaagaggctctctta

SEQ ID NO: 67138 - DNA, 25 bp, Homo sapien
gctcaagtttccagcgtcgcctttg

SEQ ID NO: 67139 - DNA, 25 bp, Homo sapien
actcggttctgtttttgtctaaatg

SEQ ID NO: 67140 - DNA, 25 bp, Homo sapien
gctgcctgattgcttcgacatttaa

SEQ ID NO: 67141 - DNA, 25 bp, Homo sapien
ttgtgacaggatgagaagaaacgcc

SEQ ID NO: 67142 - DNA, 25 bp, Homo sapien
agaagccgctgaagtgttagtaccc

SEQ ID NO: 67143 - DNA, 25 bp, Homo sapien
tccgagcggggctttaattagaagc

SEQ ID NO: 67144 - DNA, 25 bp, Homo sapien
tcagacctcggggagcttcttatcc

SEQ ID NO: 67145 - DNA, 25 bp, Homo sapien
agtctgtttccctccgttcctgtca

SEQ ID NO: 67146 - DNA, 25 bp, Homo sapien
gtctccctccatccggcacaggcgc

SEQ ID NO: 67147 - DNA, 25 bp, Homo sapien
ctccatccggcacaggcgcggcggt

SEQ ID NO: 67148 - DNA, 25 bp, Homo sapien
tcttctccggcacaggcgcggcggt

SEQ ID NO: 67149 - DNA, 25 bp, Homo sapien
acaggcgcggcggtctccctccatc

SEQ ID NO: 67150 - DNA, 25 bp, Homo sapien
ggcggtctccctccatccggcacag

SEQ ID NO: 67151 - DNA, 25 bp, Homo sapien
ccctccatccggcacaggcgcggcg

SEQ ID NO: 67152 - DNA, 25 bp, Homo sapien
aggcgcggcggtctccctccatccg

SEQ ID NO: 67153 - DNA, 25 bp, Homo sapien
ggtctccctccatccggcacaggcg

SEQ ID NO: 67154 - DNA, 25 bp, Homo sapien
ctcctgcggcagacacataagtatg

SEQ ID NO: 67155 - DNA, 25 bp, Homo sapien
cataagtatgagttcagaccctgca

SEQ ID NO: 67156 - DNA, 25 bp, Homo sapien
tcagaccctgcacgacacatttttc

SEQ ID NO: 67157 - DNA, 25 bp, Homo sapien
acatttttcggaccggcgctggtga

SEQ ID NO: 67158 - DNA, 25 bp, Homo sapien
gccagctccggggattacaacagga

SEQ ID NO: 67159 - DNA, 25 bp, Homo sapien
acaacaggatggattgtgcgggccc

SEQ ID NO: 67160 - DNA, 25 bp, Homo sapien
gagtggcattttccaacctcggcca

SEQ ID NO: 67161 - DNA, 25 bp, Homo sapien
agaggcgcctgcgatctgcagactc

SEQ ID NO: 67162 - DNA, 25 bp, Homo sapien
aaaggcgattgtctggagtctccga

SEQ ID NO: 67163 - DNA, 25 bp, Homo sapien
ctccgaagctaaggaagggatcttt

SEQ ID NO: 67164 - DNA, 25 bp, Homo sapien
tcgctcttgaacttggccaccacgg

SEQ ID NO: 67165 - DNA, 25 bp, Homo sapien
agccgcggccattaacagtgccatc

SEQ ID NO: 67166 - DNA, 25 bp, Homo sapien
tgccatcgtctatgcggtccgactc

SEQ ID NO: 67167 - DNA, 25 bp, Homo sapien
agtcttcgtcgcaagtgtccctgtg

SEQ ID NO: 67168 - DNA, 25 bp, Homo sapien
gcaccaccaggttgctctgaaattt

SEQ ID NO: 67169 - DNA, 25 bp, Homo sapien
ccttctcgagcttgatgcgcttaga

SEQ ID NO: 67170 - DNA, 25 bp, Homo sapien
ggcggctgcggttattcattattaa

SEQ ID NO: 67171 - DNA, 25 bp, Homo sapien
gctgcctgcccgcatcattatgatg

SEQ ID NO: 67172 - DNA, 25 bp, Homo sapien
gccaccgaggtctgtgctttgcatg

SEQ ID NO: 67173 - DNA, 25 bp, Homo sapien
ccggccagaagcatttttaaagtca

SEQ ID NO: 67174 - DNA, 25 bp, Homo sapien
acaggttcaagttcgctgagctttc

SEQ ID NO: 67175 - DNA, 25 bp, Homo sapien
ctcctagcgaccgaatggctcattc

SEQ ID NO: 67176 - DNA, 25 bp, Homo sapien
tcccagcctagagtgtcccaagatg

SEQ ID NO: 67177 - DNA, 25 bp, Homo sapien
cgcgggtcctgagattcattctgtg

SEQ ID NO: 67178 - DNA, 25 bp, Homo sapien
gagtttcacccagccgatttcgcag

SEQ ID NO: 67179 - DNA, 25 bp, Homo sapien
gcgcagaacgcgcttttacagttgc

SEQ ID NO: 67180 - DNA, 25 bp, Homo sapien
aagcacgtggtgacctcctcgcggt

SEQ ID NO: 67181 - DNA, 25 bp, Homo sapien
agacgtctgagaaagtacccagggc

SEQ ID NO: 67182 - DNA, 25 bp, Homo sapien
gttgccctgcaaaataaaaatgctt

SEQ ID NO: 67183 - DNA, 25 bp, Homo sapien
atgctttgcaaagccgagtttcacc

SEQ ID NO: 67184 - DNA, 25 bp, Homo sapien
ccgatttcgcagtctgggaggtcga

SEQ ID NO: 67185 - DNA, 25 bp, Homo sapien
tcccgagctgtggacaagagacgtc

SEQ ID NO: 67186 - DNA, 25 bp, Homo sapien
cacccacctctggccggaacaaaag

SEQ ID NO: 67187 - DNA, 25 bp, Homo sapien
gcagcgggacaaacacccacctctg

SEQ ID NO: 67188 - DNA, 25 bp, Homo sapien
aacaaaaggcggcagtgccggccgc

SEQ ID NO: 67189 - DNA, 25 bp, Homo sapien
gcgaggagccggcacaaaaggcagc

SEQ ID NO: 67190 - DNA, 25 bp, Homo sapien
cgaggagccggcacaaaaggcagcg

SEQ ID NO: 67191 - DNA, 25 bp, Homo sapien
ggcagcgggacaaacacccacctct

SEQ ID NO: 67192 - DNA, 25 bp, Homo sapien
agcgggacaaacacccacctctggc

SEQ ID NO: 67193 - DNA, 25 bp, Homo sapien
aaggcagcgggacaaacacccacct

SEQ ID NO: 67194 - DNA, 25 bp, Homo sapien
tgaatgcaactgaaagcgccgagtc

SEQ ID NO: 67195 - DNA, 25 bp, Homo sapien
tcctaagggtcgcagaaagagagcc

SEQ ID NO: 67196 - DNA, 25 bp, Homo sapien
cgaggcgtccacctctctgagaggc

SEQ ID NO: 67197 - DNA, 25 bp, Homo sapien
ccagtccctgggaatgtgctcacgg

SEQ ID NO: 67198 - DNA, 25 bp, Homo sapien
tcttacgggcagagcacaactgttc

SEQ ID NO: 67199 - DNA, 25 bp, Homo sapien
cgccaagcgactgggtctgaatgca

SEQ ID NO: 67200 - DNA, 25 bp, Homo sapien
acaactgttcctgtgctgttaccca

SEQ ID NO: 67201 - DNA, 25 bp, Homo sapien
gcaacgcggaatccagcctaagttt

SEQ ID NO: 67202 - DNA, 25 bp, Homo sapien
atggcccgcgagaccctgagctgca

SEQ ID NO: 67203 - DNA, 25 bp, Homo sapien
cttgcacgcgctcacccatcccgca

SEQ ID NO: 67204 - DNA, 25 bp, Homo sapien
cgagaccctgagctgcaggtggata

SEQ ID NO: 67205 - DNA, 25 bp, Homo sapien
cctctcctcggagcggttccacaac

SEQ ID NO: 67206 - DNA, 25 bp, Homo sapien
ctcttcagtctaaagggtgtcgctt

SEQ ID NO: 67207 - DNA, 25 bp, Homo sapien
cagtctaaagggtgtcgcttccgta

SEQ ID NO: 67208 - DNA, 25 bp, Homo sapien
ccctgagctgcaggtggatatgtgt

SEQ ID NO: 67209 - DNA, 25 bp, Homo sapien
ggtgtcgcttccgtaaactcaccca

SEQ ID NO: 67210 - DNA, 25 bp, Homo sapien
ttgtcctttagcacaagggcgagca

SEQ ID NO: 67211 - DNA, 25 bp, Homo sapien
gaaccaccaagcgtggctccaagct

SEQ ID NO: 67212 - DNA, 25 bp, Homo sapien
ggcgagcagcgtaggacaaagactc

SEQ ID NO: 67213 - DNA, 25 bp, Homo sapien
gcccgatgcccgtctttgtctgtgc

SEQ ID NO: 67214 - DNA, 25 bp, Homo sapien
catcgtgcggcctgagctggacact

SEQ ID NO: 67215 - DNA, 25 bp, Homo sapien
cgcggaggcgcgaaccaccaagcgt

SEQ ID NO: 67216 - DNA, 25 bp, Homo sapien
tccacggggacgctggtgtcatcgt

SEQ ID NO: 67217 - DNA, 25 bp, Homo sapien
cctcgtcctctttgcttgtccttta

SEQ ID NO: 67218 - DNA, 25 bp, Homo sapien
gtgtcactgatcctctccaaatcga

SEQ ID NO: 67219 - DNA, 25 bp, Homo sapien
tctccaaatcgattcacacaccatt

SEQ ID NO: 67220 - DNA, 25 bp, Homo sapien
ttccagtccactaccgcttgcctcg

SEQ ID NO: 67221 - DNA, 25 bp, Homo sapien
tacgtgttcgttaggccgccgccac

SEQ ID NO: 67222 - DNA, 25 bp, Homo sapien
ggacgcatgaagtgagaagaaaatt

SEQ ID NO: 67223 - DNA, 25 bp, Homo sapien
tgagaagaaaattacgtgttcgtta

SEQ ID NO: 67224 - DNA, 25 bp, Homo sapien
gcacacctgccatgtcagatggaga

SEQ ID NO: 67225 - DNA, 25 bp, Homo sapien
ggctcgctgccgtgtcactgatcct

SEQ ID NO: 67226 - DNA, 25 bp, Homo sapien
accaacggtatactgagagccctga

SEQ ID NO: 67227 - DNA, 25 bp, Homo sapien
cgcaggaagcgatgaaagagatgtc

SEQ ID NO: 67228 - DNA, 25 bp, Homo sapien
cggccgcgctgtattgtcataaata

SEQ ID NO: 67229 - DNA, 25 bp, Homo sapien
cgcggacaaaggagagtaccaaata

SEQ ID NO: 67230 - DNA, 25 bp, Homo sapien
tccgactgtgtccttgtttccgttc

SEQ ID NO: 67231 - DNA, 25 bp, Homo sapien
cggcattgacagtaccgcggacaaa

SEQ ID NO: 67232 - DNA, 25 bp, Homo sapien
cgagctactagcgaccggaggaaag

SEQ ID NO: 67233 - DNA, 25 bp, Homo sapien
tcactactcggttggatgcctcagc

SEQ ID NO: 67234 - DNA, 25 bp, Homo sapien
cttccaggagaactgggagccattc

SEQ ID NO: 67235 - DNA, 25 bp, Homo sapien
gggacgcgtacttcccagtgatgtg

SEQ ID NO: 67236 - DNA, 25 bp, Homo sapien
ggagccattcaggtacccgtctttc

SEQ ID NO: 67237 - DNA, 25 bp, Homo sapien
tccgtcttgaccgacttccaggaga

SEQ ID NO: 67238 - DNA, 25 bp, Homo sapien
tggggcaggacatgccttccgtctt

SEQ ID NO: 67239 - DNA, 25 bp, Homo sapien
actcacctgcggtgtgtgaggaagc

SEQ ID NO: 67240 - DNA, 25 bp, Homo sapien
tcataaccagccgtgccagtcggct

SEQ ID NO: 67241 - DNA, 25 bp, Homo sapien
tctttctgcctcttggccgccaagg

SEQ ID NO: 67242 - DNA, 25 bp, Homo sapien
gtcctgatcgtcttccctgcggcat

SEQ ID NO: 67243 - DNA, 25 bp, Homo sapien
atttcctcccgatcgttggagcgga

SEQ ID NO: 67244 - DNA, 25 bp, Homo sapien
catccgcgcgactgcccgattaaaa

SEQ ID NO: 67245 - DNA, 25 bp, Homo sapien
tgccgatgccctcagcttgactctg

SEQ ID NO: 67246 - DNA, 25 bp, Homo sapien
gtccggggcaaaggctcatatgagt

SEQ ID NO: 67247 - DNA, 25 bp, Homo sapien
tcagactggcaatacgtaaggtagc

SEQ ID NO: 67248 - DNA, 25 bp, Homo sapien
cccagtcgatgagaagagcgaattt

SEQ ID NO: 67249 - DNA, 25 bp, Homo sapien
gggactcacctcgagcctgttgtca

SEQ ID NO: 67250 - DNA, 25 bp, Homo sapien
acggctgagcaaacgttcgggctga

SEQ ID NO: 67251 - DNA, 25 bp, Homo sapien
gcggaatcaattttcggggaactca

SEQ ID NO: 67252 - DNA, 25 bp, Homo sapien
agcagccaaaccatccacctttggg

SEQ ID NO: 67253 - DNA, 25 bp, Homo sapien
cggggaactcagcagccaaaccatc

SEQ ID NO: 67254 - DNA, 25 bp, Homo sapien
cggcaacatgcggaatcaattttcg

SEQ ID NO: 67255 - DNA, 25 bp, Homo sapien
gctgatgtcggcaacatgcggaatc

SEQ ID NO: 67256 - DNA, 25 bp, Homo sapien
caaacgttcgggctgatgtcggcaa

SEQ ID NO: 67257 - DNA, 25 bp, Homo sapien
gggccctcacggctgagcaaacgtt

SEQ ID NO: 67258 - DNA, 25 bp, Homo sapien
accacactcggaagaacaacctgga

SEQ ID NO: 67259 - DNA, 25 bp, Homo sapien
gctcctgaactttaaaccacactcg

SEQ ID NO: 67260 - DNA, 25 bp, Homo sapien
cgggcctacgtcagccgcgggaaat

SEQ ID NO: 67261 - DNA, 25 bp, Homo sapien
aggtgtgagccgcaaacccagcgga

SEQ ID NO: 67262 - DNA, 25 bp, Homo sapien
ggcctcctgactgactgactgcggc

SEQ ID NO: 67263 - DNA, 25 bp, Homo sapien
ccatggcctccggtgagtgttcatg

SEQ ID NO: 67264 - DNA, 25 bp, Homo sapien
atttgcatgtgcgaagtcgggaaga

SEQ ID NO: 67265 - DNA, 25 bp, Homo sapien
ctcccgtacggtggacggcgacgct

SEQ ID NO: 67266 - DNA, 25 bp, Homo sapien
aggacgcgccgcgtagtgagcctcc

SEQ ID NO: 67267 - DNA, 25 bp, Homo sapien
ccgcccggtccatgtccctgcagac

SEQ ID NO: 67268 - DNA, 25 bp, Homo sapien
cgcgcctcgagcagccagctggccc

SEQ ID NO: 67269 - DNA, 25 bp, Homo sapien
catggggcggtaccgctcacagcca

SEQ ID NO: 67270 - DNA, 25 bp, Homo sapien
accactgcaggtaacagaggcgctg

SEQ ID NO: 67271 - DNA, 25 bp, Homo sapien
gccgaccactgcaggtaacagaggc

SEQ ID NO: 67272 - DNA, 25 bp, Homo sapien
agtttctgtgcctccacgggcggga

SEQ ID NO: 67273 - DNA, 25 bp, Homo sapien
ccctcggcgctagtctccgcagccg

SEQ ID NO: 67274 - DNA, 25 bp, Homo sapien
atttggatctcagttcgcgcccacc

SEQ ID NO: 67275 - DNA, 25 bp, Homo sapien
tcctcgagagctatagggagcctgc

SEQ ID NO: 67276 - DNA, 25 bp, Homo sapien
ctacactgccggttggactctcagg

SEQ ID NO: 67277 - DNA, 25 bp, Homo sapien
ccgccctagcgttaggagacgcgca

SEQ ID NO: 67278 - DNA, 25 bp, Homo sapien
accaacgtgaacaactggcgctggc

SEQ ID NO: 67279 - DNA, 25 bp, Homo sapien
gagtgacttccgacagacctttcca

SEQ ID NO: 67280 - DNA, 25 bp, Homo sapien
agtccttgagtacggagaccggcta

SEQ ID NO: 67281 - DNA, 25 bp, Homo sapien
ggttgcagctgcctctttttgaaag

SEQ ID NO: 67282 - DNA, 25 bp, Homo sapien
cggttgagttttcagcccatggcgc

SEQ ID NO: 67283 - DNA, 25 bp, Homo sapien
cgggaatcaggatccgcccttcgga

SEQ ID NO: 67284 - DNA, 25 bp, Homo sapien
tcattggcccgagcgccagtcaatc

SEQ ID NO: 67285 - DNA, 25 bp, Homo sapien
cgcgccatgagcctatctctcattg

SEQ ID NO: 67286 - DNA, 25 bp, Homo sapien
ccggttcagactgggagattccatc

SEQ ID NO: 67287 - DNA, 25 bp, Homo sapien
tcagcagcgatttgcccgcagagtg

SEQ ID NO: 67288 - DNA, 25 bp, Homo sapien
cgttcgaacgagctgtcaatcaaga

SEQ ID NO: 67289 - DNA, 25 bp, Homo sapien
ttggtcagttccagctacagccgcg

SEQ ID NO: 67290 - DNA, 25 bp, Homo sapien
cgtggcctcggaggcgaaagcgcag

SEQ ID NO: 67291 - DNA, 25 bp, Homo sapien
aggaagaggaagtggccgtacaggc

SEQ ID NO: 67292 - DNA, 25 bp, Homo sapien
ccgtacaggccgaagccttgtggag

SEQ ID NO: 67293 - DNA, 25 bp, Homo sapien
ggccgaagccttgtggagcctcagt

SEQ ID NO: 67294 - DNA, 25 bp, Homo sapien
catccacgaggtctgtgggccagcg

SEQ ID NO: 67295 - DNA, 25 bp, Homo sapien
cagtgcggggcttggccaggtccta

SEQ ID NO: 67296 - DNA, 25 bp, Homo sapien
cggcatccacgaggtctgtgggcca

SEQ ID NO: 67297 - DNA, 25 bp, Homo sapien
cgaagccttgtggagcctcagtgcg

SEQ ID NO: 67298 - DNA, 25 bp, Homo sapien
cgcggcgtttctatcctgagatgtt

SEQ ID NO: 67299 - DNA, 25 bp, Homo sapien
catcccggggtaaagacctcgcata

SEQ ID NO: 67300 - DNA, 25 bp, Homo sapien
gccgtggtcaaacaaggccctccta

SEQ ID NO: 67301 - DNA, 25 bp, Homo sapien
agccgtttctatgggtgacgacgta

SEQ ID NO: 67302 - DNA, 25 bp, Homo sapien
cggacagctcgtgacctcagaagga

SEQ ID NO: 67303 - DNA, 25 bp, Homo sapien
tggtactgccgaacccgaggaatga

SEQ ID NO: 67304 - DNA, 25 bp, Homo sapien
tattgtgttcccaaagtcgccctga

SEQ ID NO: 67305 - DNA, 25 bp, Homo sapien
cgccctgaaatgaggacagaagttc

SEQ ID NO: 67306 - DNA, 25 bp, Homo sapien
gccgccagggaccaaaagtcacgca

SEQ ID NO: 67307 - DNA, 25 bp, Homo sapien
tcttcgcgttcgtactgggcgaccc

SEQ ID NO: 67308 - DNA, 25 bp, Homo sapien
gtctggagactggaggccaccagct

SEQ ID NO: 67309 - DNA, 25 bp, Homo sapien
accagcttcgccactcggtgggagg

SEQ ID NO: 67310 - DNA, 25 bp, Homo sapien
agtcacgcaaaatccactcaggctg

SEQ ID NO: 67311 - DNA, 25 bp, Homo sapien
gcctagctagggagccggttgctat

SEQ ID NO: 67312 - DNA, 25 bp, Homo sapien
ccgtaactggggacgctacaggagc

SEQ ID NO: 67313 - DNA, 25 bp, Homo sapien
acccgcgctccagtgatgggattta

SEQ ID NO: 67314 - DNA, 25 bp, Homo sapien
tcaggccatgagagtgatacctttg

SEQ ID NO: 67315 - DNA, 25 bp, Homo sapien
cacattctcgggcatggcaaactcc

SEQ ID NO: 67316 - DNA, 25 bp, Homo sapien
ggccggccgcagtgtaataacggta

SEQ ID NO: 67317 - DNA, 25 bp, Homo sapien
ggtaagccctcactgccttcacgaa

SEQ ID NO: 67318 - DNA, 25 bp, Homo sapien
ttcacgaaccttccagaaagcggcg

SEQ ID NO: 67319 - DNA, 25 bp, Homo sapien
gaacctttacgcgaggcagcaatga

SEQ ID NO: 67320 - DNA, 25 bp, Homo sapien
gcagcaatgacaacgcgcgatttta

SEQ ID NO: 67321 - DNA, 25 bp, Homo sapien
gcccacgatgagagcgcagagcaca

SEQ ID NO: 67322 - DNA, 25 bp, Homo sapien
actggagtctcgctaggcgatgcgc

SEQ ID NO: 67323 - DNA, 25 bp, Homo sapien
aggaagccgtccctaggtggctcct

SEQ ID NO: 67324 - DNA, 25 bp, Homo sapien
tcagacgaaccgcaagaggggccac

SEQ ID NO: 67325 - DNA, 25 bp, Homo sapien
gctggagctgagtttcattagtgtt

SEQ ID NO: 67326 - DNA, 25 bp, Homo sapien
tgtttttggagctgccaggcatttc

SEQ ID NO: 67327 - DNA, 25 bp, Homo sapien
cagcttaaccctcggctttgcagga

SEQ ID NO: 67328 - DNA, 25 bp, Homo sapien
aacaagtgccggaggctagcagagc

SEQ ID NO: 67329 - DNA, 25 bp, Homo sapien
ctaggtggctcctgccgcatttaag

SEQ ID NO: 67330 - DNA, 25 bp, Homo sapien
gtgtggcagccaggagtggacggtt

SEQ ID NO: 67331 - DNA, 25 bp, Homo sapien
ccgcagccttttgtgtctttccact

SEQ ID NO: 67332 - DNA, 25 bp, Homo sapien
cctgcgatctctcgcgcggccagca

SEQ ID NO: 67333 - DNA, 25 bp, Homo sapien
cagagactgccttgggtgtggcagc

SEQ ID NO: 67334 - DNA, 25 bp, Homo sapien
aggcgatagccaccctgcgatctct

SEQ ID NO: 67335 - DNA, 25 bp, Homo sapien
ctctgctctcccgaggcgatagcca

SEQ ID NO: 67336 - DNA, 25 bp, Homo sapien
catcccccgcggaaagggtcgctgg

SEQ ID NO: 67337 - DNA, 25 bp, Homo sapien
ctccccgtcgcggacctggaggaag

SEQ ID NO: 67338 - DNA, 25 bp, Homo sapien
ctagcgacccgggttttcttcatga

SEQ ID NO: 67339 - DNA, 25 bp, Homo sapien
cgtcagtcggccaaacccacaatta

SEQ ID NO: 67340 - DNA, 25 bp, Homo sapien
cgagtaaactttatcccggcgagag

SEQ ID NO: 67341 - DNA, 25 bp, Homo sapien
tgacctccggctacaactaagacag

SEQ ID NO: 67342 - DNA, 25 bp, Homo sapien
gcctgcggcggtaacaagagataca

SEQ ID NO: 67343 - DNA, 25 bp, Homo sapien
tgtctacgtatggatcagcccttgg

SEQ ID NO: 67344 - DNA, 25 bp, Homo sapien
gctcgcaagggaagcccgttttgtc

SEQ ID NO: 67345 - DNA, 25 bp, Homo sapien
tggcgtctcagtcacacagcgaatc

SEQ ID NO: 67346 - DNA, 25 bp, Homo sapien
caggttctgcggcatctcgcggcag

SEQ ID NO: 67347 - DNA, 25 bp, Homo sapien
cacccgccaggtggctccacctgcc

SEQ ID NO: 67348 - DNA, 25 bp, Homo sapien
tggacaggttgaggatggcggtggc

SEQ ID NO: 67349 - DNA, 25 bp, Homo sapien
tgtgggccgcctccatgtcgtgcgt

SEQ ID NO: 67350 - DNA, 25 bp, Homo sapien
gccgcctccatgtcgtgcgtgtagt

SEQ ID NO: 67351 - DNA, 25 bp, Homo sapien
ccgcctccatgtcgtgcgtgtagtc

SEQ ID NO: 67352 - DNA, 25 bp, Homo sapien
cgcctccatgtcgtgcgtgtagtcg

SEQ ID NO: 67353 - DNA, 25 bp, Homo sapien
agctgccccgaaagcgccgcgtgtc

SEQ ID NO: 67354 - DNA, 25 bp, Homo sapien
tcagctgccgcgcttgcaacaagct

SEQ ID NO: 67355 - DNA, 25 bp, Homo sapien
tttctccgggacaatgatgggcctt

SEQ ID NO: 67356 - DNA, 25 bp, Homo sapien
acccggaccctcattggactctgga

SEQ ID NO: 67357 - DNA, 25 bp, Homo sapien
ggcgacatcgccattttaggtacgg

SEQ ID NO: 67358 - DNA, 25 bp, Homo sapien
attggaatcactgaacacggcccgg

SEQ ID NO: 67359 - DNA, 25 bp, Homo sapien
ctctggaccggtccgattggaatca

SEQ ID NO: 67360 - DNA, 25 bp, Homo sapien
gtacgggcaaattctggacgctcca

SEQ ID NO: 67361 - DNA, 25 bp, Homo sapien
gcgccgcagaggcaaaacaacttgg

SEQ ID NO: 67362 - DNA, 25 bp, Homo sapien
gtcttctggtatcgcctgggtgaca

SEQ ID NO: 67363 - DNA, 25 bp, Homo sapien
cagactcagcccgacagcgggatta

SEQ ID NO: 67364 - DNA, 25 bp, Homo sapien
cctgtgcgtcgcattccggcttcgg

SEQ ID NO: 67365 - DNA, 25 bp, Homo sapien
aaccacctcccgagcaagggcaagg

SEQ ID NO: 67366 - DNA, 25 bp, Homo sapien
tgatgggcaggcagttctaccaatg

SEQ ID NO: 67367 - DNA, 25 bp, Homo sapien
aggcagttctaccaatgaggtgccc

SEQ ID NO: 67368 - DNA, 25 bp, Homo sapien
ctggcttggctgttccatgtggctc

SEQ ID NO: 67369 - DNA, 25 bp, Homo sapien
aaaaggtagcctgtgcgtcgcattc

SEQ ID NO: 67370 - DNA, 25 bp, Homo sapien
gaaagttcaatccagaggtcgcggg

SEQ ID NO: 67371 - DNA, 25 bp, Homo sapien
tgggtaactagcctcccgtcttctg

SEQ ID NO: 67372 - DNA, 25 bp, Homo sapien
gccgagaagtgtgcggaaagttcaa

SEQ ID NO: 67373 - DNA, 25 bp, Homo sapien
atgcgctcgtcagggacctggacgc

SEQ ID NO: 67374 - DNA, 25 bp, Homo sapien
cctggtgaacaagcgcgatgcgctc

SEQ ID NO: 67375 - DNA, 25 bp, Homo sapien
cgcgaacagcttctgctagatgagc

SEQ ID NO: 67376 - DNA, 25 bp, Homo sapien
ggcccagaagcgacgcgaacagctt

SEQ ID NO: 67377 - DNA, 25 bp, Homo sapien
cagactggcagaagaccgaggccca

SEQ ID NO: 67378 - DNA, 25 bp, Homo sapien
accctttgaggtgctaggccagtca

SEQ ID NO: 67379 - DNA, 25 bp, Homo sapien
ttcagctacaaggatggcagcacgc

SEQ ID NO: 67380 - DNA, 25 bp, Homo sapien
gcctagttctctgttctcgaccgtg

SEQ ID NO: 67381 - DNA, 25 bp, Homo sapien
ggcttgcttcacagcgatcccgcta

SEQ ID NO: 67382 - DNA, 25 bp, Homo sapien
agcccaggtcttgggtcccagaaga

SEQ ID NO: 67383 - DNA, 25 bp, Homo sapien
tgagtcccattttccttcggcccta

SEQ ID NO: 67384 - DNA, 25 bp, Homo sapien
gcctcctccgaagtaaccaagctga

SEQ ID NO: 67385 - DNA, 25 bp, Homo sapien
ggagcgcgttggttacccttatctc

SEQ ID NO: 67386 - DNA, 25 bp, Homo sapien
tatgggctgagcgttaagaaaattc

SEQ ID NO: 67387 - DNA, 25 bp, Homo sapien
aacggtcatggcttctggcccagca

SEQ ID NO: 67388 - DNA, 25 bp, Homo sapien
cacctggatgctggatccttgtctc

SEQ ID NO: 67389 - DNA, 25 bp, Homo sapien
tggtcagatccctcggcctcagatc

SEQ ID NO: 67390 - DNA, 25 bp, Homo sapien
ctgcgggaaaagagactatcggtcc

SEQ ID NO: 67391 - DNA, 25 bp, Homo sapien
ctctcggggtttcaatttgggctgc

SEQ ID NO: 67392 - DNA, 25 bp, Homo sapien
tggacatttgcctagcgacggccgc

SEQ ID NO: 67393 - DNA, 25 bp, Homo sapien
acccagtttacgcttgattcgagga

SEQ ID NO: 67394 - DNA, 25 bp, Homo sapien
cgcctagcttagagttggaacgaaa

SEQ ID NO: 67395 - DNA, 25 bp, Homo sapien
tcccgggtcctttgagaagcagtta

SEQ ID NO: 67396 - DNA, 25 bp, Homo sapien
gtgtgccctccatcatattctgtta

SEQ ID NO: 67397 - DNA, 25 bp, Homo sapien
agtccacccaggtagacgtgtttgg

SEQ ID NO: 67398 - DNA, 25 bp, Homo sapien
tgggcttcgcccgtacgaacaatcc

SEQ ID NO: 67399 - DNA, 25 bp, Homo sapien
aaggaggatccttacgcagcatgtg

SEQ ID NO: 67400 - DNA, 25 bp, Homo sapien
ggggtctgtggccacattttccatc

SEQ ID NO: 67401 - DNA, 25 bp, Homo sapien
cgctgggctccaacgtttcagtaga

SEQ ID NO: 67402 - DNA, 25 bp, Homo sapien
tcaacctgccggagtctagagtcca

SEQ ID NO: 67403 - DNA, 25 bp, Homo sapien
aggtggcgctcaagatcaacctgcc

SEQ ID NO: 67404 - DNA, 25 bp, Homo sapien
accctgacatcttcatgcgggagga

SEQ ID NO: 67405 - DNA, 25 bp, Homo sapien
gtgctcgaggcgctcttcgccaaga

SEQ ID NO: 67406 - DNA, 25 bp, Homo sapien
accttcacgcgttcacagctggacg

SEQ ID NO: 67407 - DNA, 25 bp, Homo sapien
cgagtcctctatcgcgggtccacgt

SEQ ID NO: 67408 - DNA, 25 bp, Homo sapien
ttcttttgcgaaggccgagatctgg

SEQ ID NO: 67409 - DNA, 25 bp, Homo sapien
ttcccagttcggctttcttttgcga

SEQ ID NO: 67410 - DNA, 25 bp, Homo sapien
tccgaaagcagtggccaattcacgc

SEQ ID NO: 67411 - DNA, 25 bp, Homo sapien
ggcagctacggccaaggctacccta

SEQ ID NO: 67412 - DNA, 25 bp, Homo sapien
attgcgatattctggaccgggagtt

SEQ ID NO: 67413 - DNA, 25 bp, Homo sapien
tcttatcccatgtcctacggccagg

SEQ ID NO: 67414 - DNA, 25 bp, Homo sapien
acctcgtgtatgcagcgctccgtag

SEQ ID NO: 67415 - DNA, 25 bp, Homo sapien
gtcgctgagtacaccagctgcctca

SEQ ID NO: 67416 - DNA, 25 bp, Homo sapien
agaagaagtcctctccagtgcggga

SEQ ID NO: 67417 - DNA, 25 bp, Homo sapien
cgcgcctagcaacacctcgtgtatg

SEQ ID NO: 67418 - DNA, 25 bp, Homo sapien
gctgccctcgattttgctccacgcc

SEQ ID NO: 67419 - DNA, 25 bp, Homo sapien
ccagagcctcccggcgtttcttccg

SEQ ID NO: 67420 - DNA, 25 bp, Homo sapien
gcgccagggctaggcccgccggagg

SEQ ID NO: 67421 - DNA, 25 bp, Homo sapien
ttccgcgcacagagccgcatcccgc

SEQ ID NO: 67422 - DNA, 25 bp, Homo sapien
tggactggttcaagcttccgcctcg

SEQ ID NO: 67423 - DNA, 25 bp, Homo sapien
actggttcaagcttccgcctcggcg

SEQ ID NO: 67424 - DNA, 25 bp, Homo sapien
tcaagcttccgcctcggcgggaacg

SEQ ID NO: 67425 - DNA, 25 bp, Homo sapien
ttcagctgccctcgattttgctcca

SEQ ID NO: 67426 - DNA, 25 bp, Homo sapien
ttgttatttgaacccactcggcctg

SEQ ID NO: 67427 - DNA, 25 bp, Homo sapien
cttggctgctaaatggaacgaaacc

SEQ ID NO: 67428 - DNA, 25 bp, Homo sapien
ggctttgcactcgtttggacaactg

SEQ ID NO: 67429 - DNA, 25 bp, Homo sapien
gcctcagtttcgtcgcagttgttat

SEQ ID NO: 67430 - DNA, 25 bp, Homo sapien
ggcttcgaaaagaggcacgtgcttc

SEQ ID NO: 67431 - DNA, 25 bp, Homo sapien
ggacgtgccagagcttcacacttta

SEQ ID NO: 67432 - DNA, 25 bp, Homo sapien
gtctagaagcttcggcacctgcata

SEQ ID NO: 67433 - DNA, 25 bp, Homo sapien
tggcctccggagcaaggtacccaaa

SEQ ID NO: 67434 - DNA, 25 bp, Homo sapien
ctttacgcagcggaaggtctcttta

SEQ ID NO: 67435 - DNA, 25 bp, Homo sapien
gccgccacagtttcctcaggtgcta

SEQ ID NO: 67436 - DNA, 25 bp, Homo sapien
ctgtccggtcgtcccaacttatcaa

SEQ ID NO: 67437 - DNA, 25 bp, Homo sapien
tccgggtcgatccagctttacgcag

SEQ ID NO: 67438 - DNA, 25 bp, Homo sapien
tgttgtcgtcctccaatcacagggg

SEQ ID NO: 67439 - DNA, 25 bp, Homo sapien
gggactactttgcaatcggcgcaga

SEQ ID NO: 67440 - DNA, 25 bp, Homo sapien
accagggcagcgtaaactacagttc

SEQ ID NO: 67441 - DNA, 25 bp, Homo sapien
ccctccagagtgtcaatcgtttttt

SEQ ID NO: 67442 - DNA, 25 bp, Homo sapien
cgcaccgcaaccagcaaaggcaatt

SEQ ID NO: 67443 - DNA, 25 bp, Homo sapien
actcgcaaaaggaaaggcgcgcacg

SEQ ID NO: 67444 - DNA, 25 bp, Homo sapien
ctccagagaagaggcgcgaactcgc

SEQ ID NO: 67445 - DNA, 25 bp, Homo sapien
aggcaattcggctttgctaactttg

SEQ ID NO: 67446 - DNA, 25 bp, Homo sapien
tctgtgttgtccgaatgtccctgcg

SEQ ID NO: 67447 - DNA, 25 bp, Homo sapien
gcagcagtcgctgcctctgtgttgt

SEQ ID NO: 67448 - DNA, 25 bp, Homo sapien
ggctgacttacctgcccgcagcagt

SEQ ID NO: 67449 - DNA, 25 bp, Homo sapien
tttgctaactttggcctcgcacctc

SEQ ID NO: 67450 - DNA, 25 bp, Homo sapien
gcaggaaatagttgcttggcccagc

SEQ ID NO: 67451 - DNA, 25 bp, Homo sapien
tcagcccagaatctcatatccaatc

SEQ ID NO: 67452 - DNA, 25 bp, Homo sapien
acttaaccatcgtcctggccgaagt

SEQ ID NO: 67453 - DNA, 25 bp, Homo sapien
gttgcttggcccagcgtggcattct

SEQ ID NO: 67454 - DNA, 25 bp, Homo sapien
ggaaatagttgcttggcccagcgtg

SEQ ID NO: 67455 - DNA, 25 bp, Homo sapien
ttggcaggaaatagttgcttggccc

SEQ ID NO: 67456 - DNA, 25 bp, Homo sapien
aacattggcaggaaatagttgcttg

SEQ ID NO: 67457 - DNA, 25 bp, Homo sapien
aaatagttgcttggcccagcgtggc

SEQ ID NO: 67458 - DNA, 25 bp, Homo sapien
gagaaggccctaatgtccacagcca

SEQ ID NO: 67459 - DNA, 25 bp, Homo sapien
ggccctaatgtccacagccatcaga

SEQ ID NO: 67460 - DNA, 25 bp, Homo sapien
gcaagtcgagaaggccctaatgtcc

SEQ ID NO: 67461 - DNA, 25 bp, Homo sapien
gccctaatgtccacagccatcagat

SEQ ID NO: 67462 - DNA, 25 bp, Homo sapien
gcacatcgagaaggccctaatgtcc

SEQ ID NO: 67463 - DNA, 25 bp, Homo sapien
aggccctaatgtccacagccatcag

SEQ ID NO: 67464 - DNA, 25 bp, Homo sapien
aggccctaatgtccgcggccatcag

SEQ ID NO: 67465 - DNA, 25 bp, Homo sapien
aatgtccgcggccatcagatcgcac

SEQ ID NO: 67466 - DNA, 25 bp, Homo sapien
ggcaagtcgagaaggccctaatgtc

SEQ ID NO: 67467 - DNA, 25 bp, Homo sapien
atcgtacgtcgagaaggccctaacg

SEQ ID NO: 67468 - DNA, 25 bp, Homo sapien
cgtccgcagccatcagatcgtacgt

SEQ ID NO: 67469 - DNA, 25 bp, Homo sapien
gcgagaaagccctaacgtctgcggc

SEQ ID NO: 67470 - DNA, 25 bp, Homo sapien
gcacatcaagaaggtcctaatgtct

SEQ ID NO: 67471 - DNA, 25 bp, Homo sapien
gcacagcgagaaagccctaacgtct

SEQ ID NO: 67472 - DNA, 25 bp, Homo sapien
atcaagaaggtcctaatgtctgcag

SEQ ID NO: 67473 - DNA, 25 bp, Homo sapien
actgagaaggccctaacatccgcgg

SEQ ID NO: 67474 - DNA, 25 bp, Homo sapien
ccctggatgagtgtgtttcccgctc

SEQ ID NO: 67475 - DNA, 25 bp, Homo sapien
ccctaccgagaaaaagctgcggccg

SEQ ID NO: 67476 - DNA, 25 bp, Homo sapien
agcgtggaattggtagcgcctccta

SEQ ID NO: 67477 - DNA, 25 bp, Homo sapien
gctggtgaaaatggttgcactgccc

SEQ ID NO: 67478 - DNA, 25 bp, Homo sapien
cacacgtctcattggccagagcctg

SEQ ID NO: 67479 - DNA, 25 bp, Homo sapien
atttccgcattgaaggggctgctcc

SEQ ID NO: 67480 - DNA, 25 bp, Homo sapien
aagggcgcctcagaggtgactttca

SEQ ID NO: 67481 - DNA, 25 bp, Homo sapien
gtgactttcagcctgcgagccttct

SEQ ID NO: 67482 - DNA, 25 bp, Homo sapien
ctcctctaatagtcctacacgcaga

SEQ ID NO: 67483 - DNA, 25 bp, Homo sapien
acgcagacaaatccacgctgaattc

SEQ ID NO: 67484 - DNA, 25 bp, Homo sapien
caggcgcagccagagttctctcggg

SEQ ID NO: 67485 - DNA, 25 bp, Homo sapien
ggtgtcctgtcagccagcagtttcc

SEQ ID NO: 67486 - DNA, 25 bp, Homo sapien
ccagcttcactcaggggtgagaggt

SEQ ID NO: 67487 - DNA, 25 bp, Homo sapien
ccctctctccgctgtaggtcggggt

SEQ ID NO: 67488 - DNA, 25 bp, Homo sapien
ggtcagctgtgaccgaaactcggtc

SEQ ID NO: 67489 - DNA, 25 bp, Homo sapien
actcccagttttcaggaacacccag

SEQ ID NO: 67490 - DNA, 25 bp, Homo sapien
attgttgtccagcaccctaccaggc

SEQ ID NO: 67491 - DNA, 25 bp, Homo sapien
gggtcactgacatacactcgcaagg

SEQ ID NO: 67492 - DNA, 25 bp, Homo sapien
ggaccaattcgaccgcaccgcggga

SEQ ID NO: 67493 - DNA, 25 bp, Homo sapien
acaattgctggtggccgggatccca

SEQ ID NO: 67494 - DNA, 25 bp, Homo sapien
acaaaggcgcttcctcgagccaggg

SEQ ID NO: 67495 - DNA, 25 bp, Homo sapien
cgcggtcacacttaccggacaattg

SEQ ID NO: 67496 - DNA, 25 bp, Homo sapien
accgagaaggctcttgggaattgta

SEQ ID NO: 67497 - DNA, 25 bp, Homo sapien
tggtcaccgacacacttagcgaacg

SEQ ID NO: 67498 - DNA, 25 bp, Homo sapien
ctcccgagagaagttgagcacggcc

SEQ ID NO: 67499 - DNA, 25 bp, Homo sapien
accctctggccggtgagagccgaca

SEQ ID NO: 67500 - DNA, 25 bp, Homo sapien
cccggaggcctttaaatgctgccca

SEQ ID NO: 67501 - DNA, 25 bp, Homo sapien
gcctttaaatgctgcccagggccga

SEQ ID NO: 67502 - DNA, 25 bp, Homo sapien
tcgccacttttcttggtcgggcagc

SEQ ID NO: 67503 - DNA, 25 bp, Homo sapien
gatcagtggccgacagcgatgccgt

SEQ ID NO: 67504 - DNA, 25 bp, Homo sapien
tgtgccgtgcaaccgccagccaggt

SEQ ID NO: 67505 - DNA, 25 bp, Homo sapien
gcccggtacctgttagcagccgctg

SEQ ID NO: 67506 - DNA, 25 bp, Homo sapien
tccgcgtcggaatagacggtccttc

SEQ ID NO: 67507 - DNA, 25 bp, Homo sapien
gcctgcgcagggataagcgttctgt

SEQ ID NO: 67508 - DNA, 25 bp, Homo sapien
ttgcccgcacccaaaatggcggtcg

SEQ ID NO: 67509 - DNA, 25 bp, Homo sapien
tacagctctatgactcgcaaggaag

SEQ ID NO: 67510 - DNA, 25 bp, Homo sapien
ctgagtgcgggaagacgtctatccc

SEQ ID NO: 67511 - DNA, 25 bp, Homo sapien
aaggagcacctgtccttcgccagga

SEQ ID NO: 67512 - DNA, 25 bp, Homo sapien
cttgagctgaacgttaaccggctga

SEQ ID NO: 67513 - DNA, 25 bp, Homo sapien
taagcgttctgtgacaccaattccc

SEQ ID NO: 67514 - DNA, 25 bp, Homo sapien
ccgcgtcgcgctcccaaggcccggc

SEQ ID NO: 67515 - DNA, 25 bp, Homo sapien
ctgcgctgccgaaccgcccggagcc

SEQ ID NO: 67516 - DNA, 25 bp, Homo sapien
cggagccacgcgagccggtcgtggc

SEQ ID NO: 67517 - DNA, 25 bp, Homo sapien
ccgcgcttcactctcggccgctccc

SEQ ID NO: 67518 - DNA, 25 bp, Homo sapien
gccctctccgcgcttcactctcggc

SEQ ID NO: 67519 - DNA, 25 bp, Homo sapien
ccgctccctctacagaggacaaccg

SEQ ID NO: 67520 - DNA, 25 bp, Homo sapien
ctgggatctgagcccgggccgtctc

SEQ ID NO: 67521 - DNA, 25 bp, Homo sapien
agtgaaggcgtgacaggcctcagcc

SEQ ID NO: 67522 - DNA, 25 bp, Homo sapien
ctgattttctcgtaaggacgggctg

SEQ ID NO: 67523 - DNA, 25 bp, Homo sapien
gctccacctgggaactaacgcatca

SEQ ID NO: 67524 - DNA, 25 bp, Homo sapien
taacgcatcaggaggggtttccgcc

SEQ ID NO: 67525 - DNA, 25 bp, Homo sapien
agcggtacgtcgtgctccagcactc

SEQ ID NO: 67526 - DNA, 25 bp, Homo sapien
ctctagaagtgctcaggcgaatgac

SEQ ID NO: 67527 - DNA, 25 bp, Homo sapien
ccgcgcgaccgcaaatatgacaagc

SEQ ID NO: 67528 - DNA, 25 bp, Homo sapien
ggctgaagctaagactccgccgttc

SEQ ID NO: 67529 - DNA, 25 bp, Homo sapien
cgacgccgggagaacttaccacatg

SEQ ID NO: 67530 - DNA, 25 bp, Homo sapien
tacccaatggtgaggcccatcgttc

SEQ ID NO: 67531 - DNA, 25 bp, Homo sapien
tcagatcacgcagtgcccactcttg

SEQ ID NO: 67532 - DNA, 25 bp, Homo sapien
tggctcctaactctgcgtgcaggcg

SEQ ID NO: 67533 - DNA, 25 bp, Homo sapien
actggctgtgctgcctactctgatc

SEQ ID NO: 67534 - DNA, 25 bp, Homo sapien
gctcgggtcagtcacgcaaataaca

SEQ ID NO: 67535 - DNA, 25 bp, Homo sapien
gaagtgcgccttctgccaatccgag

SEQ ID NO: 67536 - DNA, 25 bp, Homo sapien
tcttctaaggacactgccgcgagcg

SEQ ID NO: 67537 - DNA, 25 bp, Homo sapien
ccctggcccaatgagtcttctaagg

SEQ ID NO: 67538 - DNA, 25 bp, Homo sapien
gaaggcgaactctcccagcaaagta

SEQ ID NO: 67539 - DNA, 25 bp, Homo sapien
tgccagttgcgcactctgagacatc

SEQ ID NO: 67540 - DNA, 25 bp, Homo sapien
ccgctccagagcatcggggaaacta

SEQ ID NO: 67541 - DNA, 25 bp, Homo sapien
tctggccgaactcctcatctaaacg

SEQ ID NO: 67542 - DNA, 25 bp, Homo sapien
accagagcctctgtcttgccagttg

SEQ ID NO: 67543 - DNA, 25 bp, Homo sapien
gccgagctttgtttacgtgcctaag

SEQ ID NO: 67544 - DNA, 25 bp, Homo sapien
agagctgactccgtactccctggga

SEQ ID NO: 67545 - DNA, 25 bp, Homo sapien
gacacgcgcgtattctgaaattctg

SEQ ID NO: 67546 - DNA, 25 bp, Homo sapien
gaagtgttctaataccgacagggtg

SEQ ID NO: 67547 - DNA, 25 bp, Homo sapien
acagggtgcgtcatagcgtccctcc

SEQ ID NO: 67548 - DNA, 25 bp, Homo sapien
tctccctcctaggagctggagacct

SEQ ID NO: 67549 - DNA, 25 bp, Homo sapien
cccgagctcagggttgcgttagacc

SEQ ID NO: 67550 - DNA, 25 bp, Homo sapien
tgcgttagacccactccggggcgca

SEQ ID NO: 67551 - DNA, 25 bp, Homo sapien
ggagaacaataacccgagcgcgcct

SEQ ID NO: 67552 - DNA, 25 bp, Homo sapien
agcgcaccgcgcgttctcgctgtgt

SEQ ID NO: 67553 - DNA, 25 bp, Homo sapien
gcggtcggaggagtgtctataaata

SEQ ID NO: 67554 - DNA, 25 bp, Homo sapien
ttaccggggaccagcacggcagctg

SEQ ID NO: 67555 - DNA, 25 bp, Homo sapien
gctcgcgcgcctgcaggccctttgc

SEQ ID NO: 67556 - DNA, 25 bp, Homo sapien
ctaggaactggagccggtttgtgct

SEQ ID NO: 67557 - DNA, 25 bp, Homo sapien
gccgggacacgaagagggaggcgag

SEQ ID NO: 67558 - DNA, 25 bp, Homo sapien
tctggaggccgccgtctgcgactgc

SEQ ID NO: 67559 - DNA, 25 bp, Homo sapien
ggctgcgtccattggcggccgcagc

SEQ ID NO: 67560 - DNA, 25 bp, Homo sapien
gcccatggcccagacggaggctcgg

SEQ ID NO: 67561 - DNA, 25 bp, Homo sapien
aactggagccggtttgtgctcgcgc

SEQ ID NO: 67562 - DNA, 25 bp, Homo sapien
ccgagtcccgcgttccttacgtgag

SEQ ID NO: 67563 - DNA, 25 bp, Homo sapien
ttccttacgtgagggggacgcagcc

SEQ ID NO: 67564 - DNA, 25 bp, Homo sapien
tccttccgtgagggggacgcagcca

SEQ ID NO: 67565 - DNA, 25 bp, Homo sapien
cgttccttacgtgagggggacgcag

SEQ ID NO: 67566 - DNA, 25 bp, Homo sapien
gcgttccttacgtgagggggacgca

SEQ ID NO: 67567 - DNA, 25 bp, Homo sapien
ttccttccgtgagggggacgcagcc

SEQ ID NO: 67568 - DNA, 25 bp, Homo sapien
cttcccgagtcccgcgttccttctg

SEQ ID NO: 67569 - DNA, 25 bp, Homo sapien
cgagtcccgcgttccttacgtgagg

SEQ ID NO: 67570 - DNA, 25 bp, Homo sapien
cccgttttcaggaggagcgcctgcg

SEQ ID NO: 67571 - DNA, 25 bp, Homo sapien
cttgggcaccggctctgaacctgcc

SEQ ID NO: 67572 - DNA, 25 bp, Homo sapien
gccaggttctgtgccgcgtcgtcct

SEQ ID NO: 67573 - DNA, 25 bp, Homo sapien
atcagaccggactctggctctcctc

SEQ ID NO: 67574 - DNA, 25 bp, Homo sapien
aacccgttttcaggaggagcgcctg

SEQ ID NO: 67575 - DNA, 25 bp, Homo sapien
tgtgcgtttccaggcgcctctgtcc

SEQ ID NO: 67576 - DNA, 25 bp, Homo sapien
cgtgctggctccacgcgcggctctc

SEQ ID NO: 67577 - DNA, 25 bp, Homo sapien
ggcgtgtgcgtttccaggcgcctct

SEQ ID NO: 67578 - DNA, 25 bp, Homo sapien
actggccgaccgacccattcattgg

SEQ ID NO: 67579 - DNA, 25 bp, Homo sapien
gaggaacgccgctgcgttctaagtt

SEQ ID NO: 67580 - DNA, 25 bp, Homo sapien
acggctaccttgacagcgctcaggc

SEQ ID NO: 67581 - DNA, 25 bp, Homo sapien
tgccacctctagctcggagcggcgt

SEQ ID NO: 67582 - DNA, 25 bp, Homo sapien
cagaacctgcggagcacaactggcc

SEQ ID NO: 67583 - DNA, 25 bp, Homo sapien
gcggctcccgtttgcatcatctcca

SEQ ID NO: 67584 - DNA, 25 bp, Homo sapien
gctgcgttctaagttctcccgggcc

SEQ ID NO: 67585 - DNA, 25 bp, Homo sapien
gagcaacgagaccaacggctacctt

SEQ ID NO: 67586 - DNA, 25 bp, Homo sapien
atgactcctggagcgaccttcacga

SEQ ID NO: 67587 - DNA, 25 bp, Homo sapien
tgaacgaatgtacgcatgactcctg

SEQ ID NO: 67588 - DNA, 25 bp, Homo sapien
tttacacaacccagctcgcaggcga

SEQ ID NO: 67589 - DNA, 25 bp, Homo sapien
ctcatcttgcaggagcgtccacgta

SEQ ID NO: 67590 - DNA, 25 bp, Homo sapien
ccgcggacttagagctgcgattcgc

SEQ ID NO: 67591 - DNA, 25 bp, Homo sapien
ctgcgcgaaattgccgaaagccctc

SEQ ID NO: 67592 - DNA, 25 bp, Homo sapien
agccgggaacatcagtgcgtccaga

SEQ ID NO: 67593 - DNA, 25 bp, Homo sapien
ccggcttcccataggccaggacgaa

SEQ ID NO: 67594 - DNA, 25 bp, Homo sapien
gaccggtgctctcctgaactcacta

SEQ ID NO: 67595 - DNA, 25 bp, Homo sapien
ctcactattcgggattcatgctgga

SEQ ID NO: 67596 - DNA, 25 bp, Homo sapien
gattcatgctggacatgtcactgca

SEQ ID NO: 67597 - DNA, 25 bp, Homo sapien
tccgcgccacgggtaatcgaaagaa

SEQ ID NO: 67598 - DNA, 25 bp, Homo sapien
atggccgccggcgaaccaggaaata

SEQ ID NO: 67599 - DNA, 25 bp, Homo sapien
aaaggaatgagataggctgttccgg

SEQ ID NO: 67600 - DNA, 25 bp, Homo sapien
tcagctatcgcttccacccaaaatg

SEQ ID NO: 67601 - DNA, 25 bp, Homo sapien
tgttccgggagagcaaacgtcttcc

SEQ ID NO: 67602 - DNA, 25 bp, Homo sapien
cacctgggttcggtcatcgtccatt

SEQ ID NO: 67603 - DNA, 25 bp, Homo sapien
ggaggacgtccgctctaagaacaga

SEQ ID NO: 67604 - DNA, 25 bp, Homo sapien
tgaccagcttgaggcttgcgccacc

SEQ ID NO: 67605 - DNA, 25 bp, Homo sapien
ggctgttgctgacctgaccagcttg

SEQ ID NO: 67606 - DNA, 25 bp, Homo sapien
ttcggtcatcgtccattgttggccc

SEQ ID NO: 67607 - DNA, 25 bp, Homo sapien
tcctgcctccgttgcggctgttgct

SEQ ID NO: 67608 - DNA, 25 bp, Homo sapien
gagcgtgtcggctcctgcctccgtt

SEQ ID NO: 67609 - DNA, 25 bp, Homo sapien
acggagcggttcttctcgtcactca

SEQ ID NO: 67610 - DNA, 25 bp, Homo sapien
gcactggacatggagcctactgacc

SEQ ID NO: 67611 - DNA, 25 bp, Homo sapien
ttcagctaaatgacgggcggagccc

SEQ ID NO: 67612 - DNA, 25 bp, Homo sapien
cccttttcgtgcaggcattcagcta

SEQ ID NO: 67613 - DNA, 25 bp, Homo sapien
ttattggagctcaccgctgccagtc

SEQ ID NO: 67614 - DNA, 25 bp, Homo sapien
tcgacgctcctccatcttttattgg

SEQ ID NO: 67615 - DNA, 25 bp, Homo sapien
cgcccggaactagaagcagcgaaga

SEQ ID NO: 67616 - DNA, 25 bp, Homo sapien
caccggcgatgttggccgccattaa

SEQ ID NO: 67617 - DNA, 25 bp, Homo sapien
cgcccttagctcctgtgacacttta

SEQ ID NO: 67618 - DNA, 25 bp, Homo sapien
ggccaaagtctgaggagtccacgta

SEQ ID NO: 67619 - DNA, 25 bp, Homo sapien
ttgtagtcatgcttggggacctcgc

SEQ ID NO: 67620 - DNA, 25 bp, Homo sapien
cgtggttgaacatgtccctgcagta

SEQ ID NO: 67621 - DNA, 25 bp, Homo sapien
gctcacccggcggatgcaagttctc

SEQ ID NO: 67622 - DNA, 25 bp, Homo sapien
tgatagagcatgctgtccgcgcacc

SEQ ID NO: 67623 - DNA, 25 bp, Homo sapien
cctcggggtccgacatacagtgata

SEQ ID NO: 67624 - DNA, 25 bp, Homo sapien
tcgcacgagcaagggtctgtatagt

SEQ ID NO: 67625 - DNA, 25 bp, Homo sapien
ggcaaaacttctcgtcgctagtatc

SEQ ID NO: 67626 - DNA, 25 bp, Homo sapien
agagcagagctcgtccgatggcaca

SEQ ID NO: 67627 - DNA, 25 bp, Homo sapien
aggaacagtctgttgcccgatggca

SEQ ID NO: 67628 - DNA, 25 bp, Homo sapien
tcacgccgtacagctgggttcgctt

SEQ ID NO: 67629 - DNA, 25 bp, Homo sapien
cctgaagtttgtgctgtggatgccc

SEQ ID NO: 67630 - DNA, 25 bp, Homo sapien
ctgcggctcgtcttcttcgtgaacg

SEQ ID NO: 67631 - DNA, 25 bp, Homo sapien
tggccatgcgtgagatctacgactt

SEQ ID NO: 67632 - DNA, 25 bp, Homo sapien
ctacgacttcatggatgacccgtga

SEQ ID NO: 67633 - DNA, 25 bp, Homo sapien
aagaggatcgccttccagttcacgc

SEQ ID NO: 67634 - DNA, 25 bp, Homo sapien
tttcttgttcacctagacgcctgtc

SEQ ID NO: 67635 - DNA, 25 bp, Homo sapien
catctccggagatcgcctgatttgg

SEQ ID NO: 67636 - DNA, 25 bp, Homo sapien
cccaacgccgaaaggtcagcgagtc

SEQ ID NO: 67637 - DNA, 25 bp, Homo sapien
tgggtgtgtttcttcggtcattttc

SEQ ID NO: 67638 - DNA, 25 bp, Homo sapien
gggcagctttgctcccttcatcttc

SEQ ID NO: 67639 - DNA, 25 bp, Homo sapien
gaccaaacttactcgtctgggtgtg

SEQ ID NO: 67640 - DNA, 25 bp, Homo sapien
gctccgccgtgttttttatgaatga

SEQ ID NO: 67641 - DNA, 25 bp, Homo sapien
cggcgggagtcacaaagtcactgtg

SEQ ID NO: 67642 - DNA, 25 bp, Homo sapien
tgcaatccgctctctcgttcgtgtc

SEQ ID NO: 67643 - DNA, 25 bp, Homo sapien
ggacattttagcctcctctgcaatc

SEQ ID NO: 67644 - DNA, 25 bp, Homo sapien
tatttctcaatgaccggcgctccga

SEQ ID NO: 67645 - DNA, 25 bp, Homo sapien
ctcgggcgatctggtgcctttatta

SEQ ID NO: 67646 - DNA, 25 bp, Homo sapien
cccgctggcaggaatggaaacccaa

SEQ ID NO: 67647 - DNA, 25 bp, Homo sapien
ccaagctctctcgtaatgcagggga

SEQ ID NO: 67648 - DNA, 25 bp, Homo sapien
tggctggagcccgattgcataatcc

SEQ ID NO: 67649 - DNA, 25 bp, Homo sapien
cccgcaggtcctgtttcactgggaa

SEQ ID NO: 67650 - DNA, 25 bp, Homo sapien
caccttttgctcttcccaggggaca

SEQ ID NO: 67651 - DNA, 25 bp, Homo sapien
cgccaaaccaggtgcgagcaaactc

SEQ ID NO: 67652 - DNA, 25 bp, Homo sapien
aattccagctctcggtcggttctgc

SEQ ID NO: 67653 - DNA, 25 bp, Homo sapien
ggttctgcagcgcactctcttactc

SEQ ID NO: 67654 - DNA, 25 bp, Homo sapien
gggttccacgcctcctcaagaggtg

SEQ ID NO: 67655 - DNA, 25 bp, Homo sapien
cgtctgatcccattagcgcacctga

SEQ ID NO: 67656 - DNA, 25 bp, Homo sapien
cggaggcgagaagcttccagaatta

SEQ ID NO: 67657 - DNA, 25 bp, Homo sapien
ccttggccacaaatgcgcgcttgtt

SEQ ID NO: 67658 - DNA, 25 bp, Homo sapien
aagctcgttctcaggaccgcacggg

SEQ ID NO: 67659 - DNA, 25 bp, Homo sapien
tctcaggaccgcacggggagaagct

SEQ ID NO: 67660 - DNA, 25 bp, Homo sapien
ggagaagctcgttctcaggaccgca

SEQ ID NO: 67661 - DNA, 25 bp, Homo sapien
gaagctcgttctcaggaccgcacgg

SEQ ID NO: 67662 - DNA, 25 bp, Homo sapien
gctcgttctcaggaccgcacgggga

SEQ ID NO: 67663 - DNA, 25 bp, Homo sapien
cacggggagaagctcgttctcagga

SEQ ID NO: 67664 - DNA, 25 bp, Homo sapien
tcgttctcaggaccgcacggggaga

SEQ ID NO: 67665 - DNA, 25 bp, Homo sapien
ttctcaggaccgcacggggagaagc

SEQ ID NO: 67666 - DNA, 25 bp, Homo sapien
gctgcttggagggagtcagcctttt

SEQ ID NO: 67667 - DNA, 25 bp, Homo sapien
tggagggagtcagccttttggccac

SEQ ID NO: 67668 - DNA, 25 bp, Homo sapien
tttggccaccttcagggcgggaata

SEQ ID NO: 67669 - DNA, 25 bp, Homo sapien
actggcagttcgcattccccgcaga

SEQ ID NO: 67670 - DNA, 25 bp, Homo sapien
cgcagatcgaagctccctgctgatc

SEQ ID NO: 67671 - DNA, 25 bp, Homo sapien
agctccctgctgatcgattatttga

SEQ ID NO: 67672 - DNA, 25 bp, Homo sapien
cctgctgatcgattatttgataatt

SEQ ID NO: 67673 - DNA, 25 bp, Homo sapien
tgattttccccgcagccaatgcgcg

SEQ ID NO: 67674 - DNA, 25 bp, Homo sapien
gggtttcgctttccgacgatcataa

SEQ ID NO: 67675 - DNA, 25 bp, Homo sapien
cctcccttcctctctacttcgcgca

SEQ ID NO: 67676 - DNA, 25 bp, Homo sapien
gctcagctcattgttccctcccttc

SEQ ID NO: 67677 - DNA, 25 bp, Homo sapien
gatcataaatagcttggtgtttgta

SEQ ID NO: 67678 - DNA, 25 bp, Homo sapien
tcgctttccgacgatcataaatagc

SEQ ID NO: 67679 - DNA, 25 bp, Homo sapien
agcgggtcggagaaagagcctccct

SEQ ID NO: 67680 - DNA, 25 bp, Homo sapien
ggagcctagcactccggcagcgtcg

SEQ ID NO: 67681 - DNA, 25 bp, Homo sapien
tccgacgatcataaatagcttggtg

SEQ ID NO: 67682 - DNA, 25 bp, Homo sapien
acgcgacctgttatggccaccacta

SEQ ID NO: 67683 - DNA, 25 bp, Homo sapien
ggagcctacttgctgcagcccaatg

SEQ ID NO: 67684 - DNA, 25 bp, Homo sapien
gttctagcattctggtcggaatcca

SEQ ID NO: 67685 - DNA, 25 bp, Homo sapien
ctacttccgggttctagcattctgg

SEQ ID NO: 67686 - DNA, 25 bp, Homo sapien
gcctgtgcaacacacactttacaca

SEQ ID NO: 67687 - DNA, 25 bp, Homo sapien
gcattgtgtaagacgcgacctgtta

SEQ ID NO: 67688 - DNA, 25 bp, Homo sapien
ggaatccacctctccgcctgtgcaa

SEQ ID NO: 67689 - DNA, 25 bp, Homo sapien
ttgctgcagcccaatgcattgtgta

SEQ ID NO: 67690 - DNA, 25 bp, Homo sapien
cggcggaaatccacttgaccttgta

SEQ ID NO: 67691 - DNA, 25 bp, Homo sapien
tttccactccaagaacgcgttggga

SEQ ID NO: 67692 - DNA, 25 bp, Homo sapien
cagccagtttgagcctccgcagagg

SEQ ID NO: 67693 - DNA, 25 bp, Homo sapien
acgctgggccttgttagctcattaa

SEQ ID NO: 67694 - DNA, 25 bp, Homo sapien
ggacctgggatcgacgactttgata

SEQ ID NO: 67695 - DNA, 25 bp, Homo sapien
cctgtttggcttcagagaacgatgc

SEQ ID NO: 67696 - DNA, 25 bp, Homo sapien
ttgctagactttaggccgcactcca

SEQ ID NO: 67697 - DNA, 25 bp, Homo sapien
tgcgcgccactccttgaatctaagc

SEQ ID NO: 67698 - DNA, 25 bp, Homo sapien
tgctttgtagtagcctggagacttc

SEQ ID NO: 67699 - DNA, 25 bp, Homo sapien
cctaatagactttgccacatcgggg

SEQ ID NO: 67700 - DNA, 25 bp, Homo sapien
cctcggaacctcacggagtgctttg

SEQ ID NO: 67701 - DNA, 25 bp, Homo sapien
ctgaaacattctctccctaggcgga

SEQ ID NO: 67702 - DNA, 25 bp, Homo sapien
acccgccaaggagtctgaaacattc

SEQ ID NO: 67703 - DNA, 25 bp, Homo sapien
gctagcggcgcgtttcacttaaggt

SEQ ID NO: 67704 - DNA, 25 bp, Homo sapien
gctgggcacttttccttgtctcatt

SEQ ID NO: 67705 - DNA, 25 bp, Homo sapien
cttcatgctgcaaagctcccgggta

SEQ ID NO: 67706 - DNA, 25 bp, Homo sapien
gctgccgcatgtagggcgatcttca

SEQ ID NO: 67707 - DNA, 25 bp, Homo sapien
gcagggcttctccaactcggccttt

SEQ ID NO: 67708 - DNA, 25 bp, Homo sapien
tccgcgctggcgtgaaagcaaatgt

SEQ ID NO: 67709 - DNA, 25 bp, Homo sapien
ccgcacttgagcgaggaccgacttc

SEQ ID NO: 67710 - DNA, 25 bp, Homo sapien
gtctgggaacctttcaggacgcctc

SEQ ID NO: 67711 - DNA, 25 bp, Homo sapien
tgggagccgcgtaactaacagttgc

SEQ ID NO: 67712 - DNA, 25 bp, Homo sapien
ccaccgcggaagcacagatcatctt

SEQ ID NO: 67713 - DNA, 25 bp, Homo sapien
tgcgttgctccctttttcctagcgg

SEQ ID NO: 67714 - DNA, 25 bp, Homo sapien
cttggcggattgtaagctgctggtt

SEQ ID NO: 67715 - DNA, 25 bp, Homo sapien
tctgcgttctgtagtggcgctgctt

SEQ ID NO: 67716 - DNA, 25 bp, Homo sapien
tcgggccagtatgcaatgaatcaga

SEQ ID NO: 67717 - DNA, 25 bp, Homo sapien
cacatcttttttattcgggccagta

SEQ ID NO: 67718 - DNA, 25 bp, Homo sapien
caaggatgagtgctgccagagagtc

SEQ ID NO: 67719 - DNA, 25 bp, Homo sapien
ccagagagtctcacccgcatggggt

SEQ ID NO: 67720 - DNA, 25 bp, Homo sapien
ttgtagttttagtcacggacacatc

SEQ ID NO: 67721 - DNA, 25 bp, Homo sapien
gccacacagcgcgaattgagcctcg

SEQ ID NO: 67722 - DNA, 25 bp, Homo sapien
tcatccctttgcaaaatgtgaaaga

SEQ ID NO: 67723 - DNA, 25 bp, Homo sapien
tgctgttgccctactcatccctttg

SEQ ID NO: 67724 - DNA, 25 bp, Homo sapien
gcggtttgtagtgctgttgccctac

SEQ ID NO: 67725 - DNA, 25 bp, Homo sapien
ccataggcaatgagtcggcgaagga

SEQ ID NO: 67726 - DNA, 25 bp, Homo sapien
ctagcccgaagaaaacgccgcacaa

SEQ ID NO: 67727 - DNA, 25 bp, Homo sapien
tgcggcagcgagagcagcctccgac

SEQ ID NO: 67728 - DNA, 25 bp, Homo sapien
ccgccgccctgtgcagtaaaagtaa

SEQ ID NO: 67729 - DNA, 25 bp, Homo sapien
gaaacatgatgacagccctagcccg

SEQ ID NO: 67730 - DNA, 25 bp, Homo sapien
aaacattcctcagtcggcggtcagc

SEQ ID NO: 67731 - DNA, 25 bp, Homo sapien
cagccggcagcgctttaagatttcc

SEQ ID NO: 67732 - DNA, 25 bp, Homo sapien
tgcgctcctgcgatcgcacagaatg

SEQ ID NO: 67733 - DNA, 25 bp, Homo sapien
tgccctggcatgttggctgtagtta

SEQ ID NO: 67734 - DNA, 25 bp, Homo sapien
ggccgacatggtgcagccaatttca

SEQ ID NO: 67735 - DNA, 25 bp, Homo sapien
acaccgtgtagttgaagcccttctg

SEQ ID NO: 67736 - DNA, 25 bp, Homo sapien
ccgtgcgaagttgcccatggtcaca

SEQ ID NO: 67737 - DNA, 25 bp, Homo sapien
cccgtgctggatctcgtacagctga

SEQ ID NO: 67738 - DNA, 25 bp, Homo sapien
ctcaccattttgctcggcgggtcgg

SEQ ID NO: 67739 - DNA, 25 bp, Homo sapien
gagcccttccggtcatgtggctgga

SEQ ID NO: 67740 - DNA, 25 bp, Homo sapien
tgacccgcaacctcaaggcacgaaa

SEQ ID NO: 67741 - DNA, 25 bp, Homo sapien
ctcggagaagtgttgcgctcaggct

SEQ ID NO: 67742 - DNA, 25 bp, Homo sapien
tggtgcatcgaggaagccaaggtct

SEQ ID NO: 67743 - DNA, 25 bp, Homo sapien
ctcaggctggctcgcaggaaacggc

SEQ ID NO: 67744 - DNA, 25 bp, Homo sapien
aattaaggtcgagattcagagccgg

SEQ ID NO: 67745 - DNA, 25 bp, Homo sapien
cgtgacggactcactgcagcggctc

SEQ ID NO: 67746 - DNA, 25 bp, Homo sapien
ctgcagcgtgctgggtttaatcttc

SEQ ID NO: 67747 - DNA, 25 bp, Homo sapien
ttaagcgaccactatgccaaggagc

SEQ ID NO: 67748 - DNA, 25 bp, Homo sapien
agcggacatttaggctcctcctaga

SEQ ID NO: 67749 - DNA, 25 bp, Homo sapien
ccttcagctggggaagcggacattt

SEQ ID NO: 67750 - DNA, 25 bp, Homo sapien
cgagggagttaatcctgtttacgca

SEQ ID NO: 67751 - DNA, 25 bp, Homo sapien
ccgggcttttgaggagcagctcctt

SEQ ID NO: 67752 - DNA, 25 bp, Homo sapien
cgctgcccgtccaccttgtaaaaga

SEQ ID NO: 67753 - DNA, 25 bp, Homo sapien
ctcaaccttgtaggaggagccggtg

SEQ ID NO: 67754 - DNA, 25 bp, Homo sapien
ctcactgctgcgtccctgagatctg

SEQ ID NO: 67755 - DNA, 25 bp, Homo sapien
tcctcaaacgcaggatgtcagcacc

SEQ ID NO: 67756 - DNA, 25 bp, Homo sapien
attatgggcacatttgcctcctgcc

SEQ ID NO: 67757 - DNA, 25 bp, Homo sapien
gcacacaggacggtttcaggcatta

SEQ ID NO: 67758 - DNA, 25 bp, Homo sapien
gtcacatctgatttgctcgctgctg

SEQ ID NO: 67759 - DNA, 25 bp, Homo sapien
atgggactccgtctcacccacaggg

SEQ ID NO: 67760 - DNA, 25 bp, Homo sapien
ttactcgtgtagaaatgggactccg

SEQ ID NO: 67761 - DNA, 25 bp, Homo sapien
cggtttcaggcattatgggcacatt

SEQ ID NO: 67762 - DNA, 25 bp, Homo sapien
gtctccgctcgggaaaggaagtgaa

SEQ ID NO: 67763 - DNA, 25 bp, Homo sapien
cgcgatttaaatccaccggaattcg

SEQ ID NO: 67764 - DNA, 25 bp, Homo sapien
cttctacctactaggccgcggtagc

SEQ ID NO: 67765 - DNA, 25 bp, Homo sapien
ccgggagcgtagacacctaagccaa

SEQ ID NO: 67766 - DNA, 25 bp, Homo sapien
aaccgtcagcgttgactgtcactgc

SEQ ID NO: 67767 - DNA, 25 bp, Homo sapien
ttgcagctgctggaacccaagaaca

SEQ ID NO: 67768 - DNA, 25 bp, Homo sapien
caaatcccgcgggtcagggctaatc

SEQ ID NO: 67769 - DNA, 25 bp, Homo sapien
aacagtagttttgaggcggcgagac

SEQ ID NO: 67770 - DNA, 25 bp, Homo sapien
gaagaagcgtctcctgatccggccc

SEQ ID NO: 67771 - DNA, 25 bp, Homo sapien
ggctcctcggtcctttgcaagctcg

SEQ ID NO: 67772 - DNA, 25 bp, Homo sapien
actccgacggcgctgggctgccaag

SEQ ID NO: 67773 - DNA, 25 bp, Homo sapien
ccgttccgaagcctgagccgggcaa

SEQ ID NO: 67774 - DNA, 25 bp, Homo sapien
cagcggcggcgcgaaggtaactccc

SEQ ID NO: 67775 - DNA, 25 bp, Homo sapien
cctgccggcttctggaagaagcgtc

SEQ ID NO: 67776 - DNA, 25 bp, Homo sapien
ggattgacgcagagccctgcccgga

SEQ ID NO: 67777 - DNA, 25 bp, Homo sapien
tcctttgcaagctcgcggctgagcg

SEQ ID NO: 67778 - DNA, 25 bp, Homo sapien
cgtgtttgtgaaggagaagcactac

SEQ ID NO: 67779 - DNA, 25 bp, Homo sapien
ctcaccgcctacgtgctatgctggg

SEQ ID NO: 67780 - DNA, 25 bp, Homo sapien
atgctgggcgcccttctacggcttc

SEQ ID NO: 67781 - DNA, 25 bp, Homo sapien
ttctacggcttcaccatcgtgcgcg

SEQ ID NO: 67782 - DNA, 25 bp, Homo sapien
cccaccgtgtttgtgaaggagaagc

SEQ ID NO: 67783 - DNA, 25 bp, Homo sapien
actctgtgcttcgtgaccgtcaaga

SEQ ID NO: 67784 - DNA, 25 bp, Homo sapien
ttcgtgaccgtcaagaacgacaccg

SEQ ID NO: 67785 - DNA, 25 bp, Homo sapien
gcttcaccatcgtgcgcgacttctt

SEQ ID NO: 67786 - DNA, 25 bp, Homo sapien
aggtggcagcctttgaactttcttc

SEQ ID NO: 67787 - DNA, 25 bp, Homo sapien
cgtcgggacggaactccttccattg

SEQ ID NO: 67788 - DNA, 25 bp, Homo sapien
tttcgccgcctttgtccacaaggtg

SEQ ID NO: 67789 - DNA, 25 bp, Homo sapien
ccagacaattgcttccggggagttg

SEQ ID NO: 67790 - DNA, 25 bp, Homo sapien
atcggcttccagtggctctctttgg

SEQ ID NO: 67791 - DNA, 25 bp, Homo sapien
ctacggcggatttgacctgtacttc

SEQ ID NO: 67792 - DNA, 25 bp, Homo sapien
tttggacaagtaagtgccgcgagtt

SEQ ID NO: 67793 - DNA, 25 bp, Homo sapien
ttccattgcaaaagctcggcgcggc

SEQ ID NO: 67794 - DNA, 25 bp, Homo sapien
cccaagaccattgatgccctgtgtt

SEQ ID NO: 67795 - DNA, 25 bp, Homo sapien
cccgcagagcgagaaatgtaaggaa

SEQ ID NO: 67796 - DNA, 25 bp, Homo sapien
ctgccctagactgcgctggatggat

SEQ ID NO: 67797 - DNA, 25 bp, Homo sapien
gtgcctgaagctcaagggccgctct

SEQ ID NO: 67798 - DNA, 25 bp, Homo sapien
cgacacaagataccgcaaggccgga

SEQ ID NO: 67799 - DNA, 25 bp, Homo sapien
gaaactgagctttccgcgtgggtgc

SEQ ID NO: 67800 - DNA, 25 bp, Homo sapien
tcctggctccagctacggaggcaga

SEQ ID NO: 67801 - DNA, 25 bp, Homo sapien
cgtctgtgctcattcaggctgggaa

SEQ ID NO: 67802 - DNA, 25 bp, Homo sapien
caaccacagccgattttgggaagcg

SEQ ID NO: 67803 - DNA, 25 bp, Homo sapien
gggcgccggctcaatgaattctctt

SEQ ID NO: 67804 - DNA, 25 bp, Homo sapien
caccgatcaaagcacgtggcgcagc

SEQ ID NO: 67805 - DNA, 25 bp, Homo sapien
ctctgctgctgaggtaatcctgtta

SEQ ID NO: 67806 - DNA, 25 bp, Homo sapien
ttgcagaaactccagcggccagcta

SEQ ID NO: 67807 - DNA, 25 bp, Homo sapien
tctgtacttggagacccgattttta

SEQ ID NO: 67808 - DNA, 25 bp, Homo sapien
tgagtaatggcaccggagtcccagc

SEQ ID NO: 67809 - DNA, 25 bp, Homo sapien
aaagcctctgcattcctccgggaag

SEQ ID NO: 67810 - DNA, 25 bp, Homo sapien
cacacacgagcttcggtgggcaatc

SEQ ID NO: 67811 - DNA, 25 bp, Homo sapien
atgatgccggagacacggcccgcga

SEQ ID NO: 67812 - DNA, 25 bp, Homo sapien
ctccctcggggatgcgacggccaag

SEQ ID NO: 67813 - DNA, 25 bp, Homo sapien
acggccaaggcaacgacagccttct

SEQ ID NO: 67814 - DNA, 25 bp, Homo sapien
taggctccattgaaccgctcacgcg

SEQ ID NO: 67815 - DNA, 25 bp, Homo sapien
ctcgtggccgcgtccgcctggagtt

SEQ ID NO: 67816 - DNA, 25 bp, Homo sapien
tccgcctggagttcctggagacgcc

SEQ ID NO: 67817 - DNA, 25 bp, Homo sapien
cccttaccacacatgatgccggaga

SEQ ID NO: 67818 - DNA, 25 bp, Homo sapien
ttaggccacagaagcgccgagctcc

SEQ ID NO: 67819 - DNA, 25 bp, Homo sapien
cgccatcttagtccggagtgcctaa

SEQ ID NO: 67820 - DNA, 25 bp, Homo sapien
cttggttaattcacgcagcactgtg

SEQ ID NO: 67821 - DNA, 25 bp, Homo sapien
tcccgtttgcgccaacgcttggtta

SEQ ID NO: 67822 - DNA, 25 bp, Homo sapien
ctgcgtcaccctgaccaagagaggc

SEQ ID NO: 67823 - DNA, 25 bp, Homo sapien
agtgcctaagggtctccctgacaga

SEQ ID NO: 67824 - DNA, 25 bp, Homo sapien
agcggcacacctattcggagctcca

SEQ ID NO: 67825 - DNA, 25 bp, Homo sapien
ccgaggtttgcaggctactgcgtca

SEQ ID NO: 67826 - DNA, 25 bp, Homo sapien
gcttcatgtattttcccggcgagaa

SEQ ID NO: 67827 - DNA, 25 bp, Homo sapien
agccatcatcctggggaaacgcttc

SEQ ID NO: 67828 - DNA, 25 bp, Homo sapien
aaccgccgttctgtcgccacggatg

SEQ ID NO: 67829 - DNA, 25 bp, Homo sapien
ctgttgatatcacccgagccgcagg

SEQ ID NO: 67830 - DNA, 25 bp, Homo sapien
tccacggcctcgaaggagatttgtg

SEQ ID NO: 67831 - DNA, 25 bp, Homo sapien
ggggactcggcaatttaaacacatc

SEQ ID NO: 67832 - DNA, 25 bp, Homo sapien
gttccacccttctggagccatctta

SEQ ID NO: 67833 - DNA, 25 bp, Homo sapien
cccgtgaagaaactgccaacaacta

SEQ ID NO: 67834 - DNA, 25 bp, Homo sapien
caaccaggaacttgggctcagtctc

SEQ ID NO: 67835 - DNA, 25 bp, Homo sapien
gtctcgtgggcagaggaacaaccag

SEQ ID NO: 67836 - DNA, 25 bp, Homo sapien
gatccgtcccggataagacccgctg

SEQ ID NO: 67837 - DNA, 25 bp, Homo sapien
taagacccgctgtctggccctgagt

SEQ ID NO: 67838 - DNA, 25 bp, Homo sapien
tgcttaaccgctggcaccatccagg

SEQ ID NO: 67839 - DNA, 25 bp, Homo sapien
catccaggacatccagggccgctta

SEQ ID NO: 67840 - DNA, 25 bp, Homo sapien
cacgacctgccgttgggagacgaac

SEQ ID NO: 67841 - DNA, 25 bp, Homo sapien
ggcgatactggggacactgtccaat

SEQ ID NO: 67842 - DNA, 25 bp, Homo sapien
ttctgttactgtgcgggcagccaca

SEQ ID NO: 67843 - DNA, 25 bp, Homo sapien
aaccacagacgcttccagggtgttg

SEQ ID NO: 67844 - DNA, 25 bp, Homo sapien
cagcgggtccttctgctactgtcac

SEQ ID NO: 67845 - DNA, 25 bp, Homo sapien
actgtcaccctgactcggagacgga

SEQ ID NO: 67846 - DNA, 25 bp, Homo sapien
agacgccaggtgttccgcattttca

SEQ ID NO: 67847 - DNA, 25 bp, Homo sapien
agctcgcgtctcgttaaaccttaga

SEQ ID NO: 67848 - DNA, 25 bp, Homo sapien
taacactacgtctacgccgaagttc

SEQ ID NO: 67849 - DNA, 25 bp, Homo sapien
cgaagttcgggttagtcagaggcca

SEQ ID NO: 67850 - DNA, 25 bp, Homo sapien
tatttgccggagaaccagctggttc

SEQ ID NO: 67851 - DNA, 25 bp, Homo sapien
tccgggaaacgctgctccttagatg

SEQ ID NO: 67852 - DNA, 25 bp, Homo sapien
tgctccttagatggacgaatacgta

SEQ ID NO: 67853 - DNA, 25 bp, Homo sapien
agcacatcctggacgagttaacttc

SEQ ID NO: 67854 - DNA, 25 bp, Homo sapien
agcgcacagcaaacgggagaagtta

SEQ ID NO: 67855 - DNA, 25 bp, Homo sapien
gcagacctcacctttgctggcaacg

SEQ ID NO: 67856 - DNA, 25 bp, Homo sapien
ttctccactggtgccttttccggga

SEQ ID NO: 67857 - DNA, 25 bp, Homo sapien
acgaatacgtactcggtacccagca

SEQ ID NO: 67858 - DNA, 25 bp, Homo sapien
cagccaatgccagacccggtgagga

SEQ ID NO: 67859 - DNA, 25 bp, Homo sapien
cttctgcagctcttggccaatacta

SEQ ID NO: 67860 - DNA, 25 bp, Homo sapien
ggcggagttgcgaatcctgtcacca

SEQ ID NO: 67861 - DNA, 25 bp, Homo sapien
gcccgggccttgtcaagtgtgacca

SEQ ID NO: 67862 - DNA, 25 bp, Homo sapien
tccgaaggcttcaccaatgggagac

SEQ ID NO: 67863 - DNA, 25 bp, Homo sapien
tccctctcttgtcgagcgtggttgc

SEQ ID NO: 67864 - DNA, 25 bp, Homo sapien
acatcatcgtagctgggaggtttcc

SEQ ID NO: 67865 - DNA, 25 bp, Homo sapien
cctggcctggagaaaggtgacatca

SEQ ID NO: 67866 - DNA, 25 bp, Homo sapien
tgtaaatcctgccctcccgcgaatg

SEQ ID NO: 67867 - DNA, 25 bp, Homo sapien
actcaggtctcagtgcaaacgtccc

SEQ ID NO: 67868 - DNA, 25 bp, Homo sapien
ccgactccacctgtataaaatcgca

SEQ ID NO: 67869 - DNA, 25 bp, Homo sapien
ggactgcgcttcactcaggtctcag

SEQ ID NO: 67870 - DNA, 25 bp, Homo sapien
atcgcagctccctggtcactttcta

SEQ ID NO: 67871 - DNA, 25 bp, Homo sapien
ggtcactttctatccgctgtccgcg

SEQ ID NO: 67872 - DNA, 25 bp, Homo sapien
tgtataaaatcgcagctccctggtc

SEQ ID NO: 67873 - DNA, 25 bp, Homo sapien
aatgccgtccggctgacagcactca

SEQ ID NO: 67874 - DNA, 25 bp, Homo sapien
tctcgaagcagagtggggatgactt

SEQ ID NO: 67875 - DNA, 25 bp, Homo sapien
aaacggggcctctcgaagcagagtg

SEQ ID NO: 67876 - DNA, 25 bp, Homo sapien
caatcacgctggaaaacggggcctc

SEQ ID NO: 67877 - DNA, 25 bp, Homo sapien
tgtcggcgcaatcacgctggaaaac

SEQ ID NO: 67878 - DNA, 25 bp, Homo sapien
acagagcagtgtcggcgcaatcacg

SEQ ID NO: 67879 - DNA, 25 bp, Homo sapien
tcagcagcaacccacgccaagaaga

SEQ ID NO: 67880 - DNA, 25 bp, Homo sapien
gctctcctctggaacctcagcagca

SEQ ID NO: 67881 - DNA, 25 bp, Homo sapien
cttgcccggccttgggcaagcagga

SEQ ID NO: 67882 - DNA, 25 bp, Homo sapien
cagccgccaaagacttgaccacgta

SEQ ID NO: 67883 - DNA, 25 bp, Homo sapien
atggacgccattctttttaggacca

SEQ ID NO: 67884 - DNA, 25 bp, Homo sapien
tttaggaccacgtttctagcacgcc

SEQ ID NO: 67885 - DNA, 25 bp, Homo sapien
tctggtcacctcacgcgcatgtttt

SEQ ID NO: 67886 - DNA, 25 bp, Homo sapien
ttttttcaaggggtcctgcgcagca

SEQ ID NO: 67887 - DNA, 25 bp, Homo sapien
ccatgtaagggttggcgcaatcttg

SEQ ID NO: 67888 - DNA, 25 bp, Homo sapien
cccgccagtgccgttagagttaata

SEQ ID NO: 67889 - DNA, 25 bp, Homo sapien
ttccgcccatcgtgcgcttcatttt

SEQ ID NO: 67890 - DNA, 25 bp, Homo sapien
actcgatgaagtagctggcgccctc

SEQ ID NO: 67891 - DNA, 25 bp, Homo sapien
tcggaggccgccaaacaacttgggc

SEQ ID NO: 67892 - DNA, 25 bp, Homo sapien
acaaaacgttgagtgtggccgcggc

SEQ ID NO: 67893 - DNA, 25 bp, Homo sapien
gcaggtctgcggaaacgccagaaaa

SEQ ID NO: 67894 - DNA, 25 bp, Homo sapien
cgccagaaaagtcgggtcaaacttg

SEQ ID NO: 67895 - DNA, 25 bp, Homo sapien
cacctgagcggatcatgtggcccga

SEQ ID NO: 67896 - DNA, 25 bp, Homo sapien
cctcgcgccgcacttgatgaagaag

SEQ ID NO: 67897 - DNA, 25 bp, Homo sapien
tgctcaggtaaagtgtcccgcccga

SEQ ID NO: 67898 - DNA, 25 bp, Homo sapien
gctctggggactgacattcatcgcg

SEQ ID NO: 67899 - DNA, 25 bp, Homo sapien
ctggagggacagagttctcagatcc

SEQ ID NO: 67900 - DNA, 25 bp, Homo sapien
atctgggaaagcaggcacggatgcg

SEQ ID NO: 67901 - DNA, 25 bp, Homo sapien
gtcaccctggcaaagcgctcgcagg

SEQ ID NO: 67902 - DNA, 25 bp, Homo sapien
ctggagggtcccatctgggaaagca

SEQ ID NO: 67903 - DNA, 25 bp, Homo sapien
atgcggggacatttccgcccgtcac

SEQ ID NO: 67904 - DNA, 25 bp, Homo sapien
cacggatgcggggacatttccgccc

SEQ ID NO: 67905 - DNA, 25 bp, Homo sapien
cagagttctcagatccaagtagaga

SEQ ID NO: 67906 - DNA, 25 bp, Homo sapien
acaaagacagctgcgtacggcggga

SEQ ID NO: 67907 - DNA, 25 bp, Homo sapien
gccactctgctcagggtcatttata

SEQ ID NO: 67908 - DNA, 25 bp, Homo sapien
ctcacgcggctaggatgacgcccgt

SEQ ID NO: 67909 - DNA, 25 bp, Homo sapien
agggtcatttatagtctctccgttc

SEQ ID NO: 67910 - DNA, 25 bp, Homo sapien
tagtctctccgttctttgttaaata

SEQ ID NO: 67911 - DNA, 25 bp, Homo sapien
tgttaaataaagacggtgagacacg

SEQ ID NO: 67912 - DNA, 25 bp, Homo sapien
tgcgcgcagggcctaaatcgcctgt

SEQ ID NO: 67913 - DNA, 25 bp, Homo sapien
aagctcggcgctcacgcggctagga

SEQ ID NO: 67914 - DNA, 25 bp, Homo sapien
gaagcggatcccgatgtacaaaggg

SEQ ID NO: 67915 - DNA, 25 bp, Homo sapien
cggtcggcgcgtttctctttctctt

SEQ ID NO: 67916 - DNA, 25 bp, Homo sapien
acttacgtcatctggcggaggcgtg

SEQ ID NO: 67917 - DNA, 25 bp, Homo sapien
cgagtggagaacgtgacttacgtca

SEQ ID NO: 67918 - DNA, 25 bp, Homo sapien
aggcattggcaactgagcgtcctgc

SEQ ID NO: 67919 - DNA, 25 bp, Homo sapien
tctccagaaaagacgcgaaggtggt

SEQ ID NO: 67920 - DNA, 25 bp, Homo sapien
ggctagactaggcatcggcaccacc

SEQ ID NO: 67921 - DNA, 25 bp, Homo sapien
tgtacaaaggggaaaacagcggctg

SEQ ID NO: 67922 - DNA, 25 bp, Homo sapien
acctgagctcgcgttgtcttatggg

SEQ ID NO: 67923 - DNA, 25 bp, Homo sapien
caatcgttattggtcagagccgccc

SEQ ID NO: 67924 - DNA, 25 bp, Homo sapien
cggtcccaagtaggcccaggcagaa

SEQ ID NO: 67925 - DNA, 25 bp, Homo sapien
ggggccaaactgttcgctgtaacga

SEQ ID NO: 67926 - DNA, 25 bp, Homo sapien
cggtggtagaacatacgccgaccta

SEQ ID NO: 67927 - DNA, 25 bp, Homo sapien
gggtctgcagcgacacacacatatc

SEQ ID NO: 67928 - DNA, 25 bp, Homo sapien
ggcagccgctccttggacatgcttt

SEQ ID NO: 67929 - DNA, 25 bp, Homo sapien
ttggacatgctttccgctgggaacc

SEQ ID NO: 67930 - DNA, 25 bp, Homo sapien
tccataggttcacttgttgcgcagc

SEQ ID NO: 67931 - DNA, 25 bp, Homo sapien
atcgcggtgtccacggagaacaata

SEQ ID NO: 67932 - DNA, 25 bp, Homo sapien
tttctcggctgaccagaggttactc

SEQ ID NO: 67933 - DNA, 25 bp, Homo sapien
agcctaggagcagccagcaaagtta

SEQ ID NO: 67934 - DNA, 25 bp, Homo sapien
tgcgcaggcgcaagtattaactact

SEQ ID NO: 67935 - DNA, 25 bp, Homo sapien
aacttttttgtcttctggctgcgga

SEQ ID NO: 67936 - DNA, 25 bp, Homo sapien
ctcctccggcggcaattacactaaa

SEQ ID NO: 67937 - DNA, 25 bp, Homo sapien
ctcacagagtcttgggcatctcgtc

SEQ ID NO: 67938 - DNA, 25 bp, Homo sapien
tgctccgccagataaaatcggtagg

SEQ ID NO: 67939 - DNA, 25 bp, Homo sapien
gcggctttcagctctggtcggaata

SEQ ID NO: 67940 - DNA, 25 bp, Homo sapien
cattcacacttcagggcggctttca

SEQ ID NO: 67941 - DNA, 25 bp, Homo sapien
agccgcgacgcagtccagcggtgca

SEQ ID NO: 67942 - DNA, 25 bp, Homo sapien
cgagctgcgtgctccgccagataaa

SEQ ID NO: 67943 - DNA, 25 bp, Homo sapien
ccagctgcagagcttgtggaggcca

SEQ ID NO: 67944 - DNA, 25 bp, Homo sapien
ctggtcggaataggactgtgcattc

SEQ ID NO: 67945 - DNA, 25 bp, Homo sapien
agccagctgcgcaggtcgcgctttc

SEQ ID NO: 67946 - DNA, 25 bp, Homo sapien
gctctgacaatgaatccgcgccttc

SEQ ID NO: 67947 - DNA, 25 bp, Homo sapien
ggccagtttctgtctccgccaagca

SEQ ID NO: 67948 - DNA, 25 bp, Homo sapien
ggcagaactcagatccggcccggag

SEQ ID NO: 67949 - DNA, 25 bp, Homo sapien
tcagggctcaaaccgggcagaactc

SEQ ID NO: 67950 - DNA, 25 bp, Homo sapien
cggccctcattaatcagggctcaaa

SEQ ID NO: 67951 - DNA, 25 bp, Homo sapien
gcgctctaattaacggccctcatta

SEQ ID NO: 67952 - DNA, 25 bp, Homo sapien
agccaggtccatgacactgggaata

SEQ ID NO: 67953 - DNA, 25 bp, Homo sapien
cactgggaatacagcgctctaatta

SEQ ID NO: 67954 - DNA, 25 bp, Homo sapien
tcggtcatcgttgagcttccggtta

SEQ ID NO: 67955 - DNA, 25 bp, Homo sapien
tcggtttggctctcacacatactta

SEQ ID NO: 67956 - DNA, 25 bp, Homo sapien
ttgctcatggtgtatactccgcggg

SEQ ID NO: 67957 - DNA, 25 bp, Homo sapien
ccgcgggctcacagatgccttggaa

SEQ ID NO: 67958 - DNA, 25 bp, Homo sapien
tcgcgatatctcagcgcctcggtca

SEQ ID NO: 67959 - DNA, 25 bp, Homo sapien
cttccggttatgtcctcagcgattg

SEQ ID NO: 67960 - DNA, 25 bp, Homo sapien
cggctcaagacattcggctaacgga

SEQ ID NO: 67961 - DNA, 25 bp, Homo sapien
atcgacctcgttagccaatggattg

SEQ ID NO: 67962 - DNA, 25 bp, Homo sapien
aagcttccgaagtcctgtccgaggc

SEQ ID NO: 67963 - DNA, 25 bp, Homo sapien
ccgctacctgcatcttccggatgtt

SEQ ID NO: 67964 - DNA, 25 bp, Homo sapien
tccgatccgccaaagcttccgaagt

SEQ ID NO: 67965 - DNA, 25 bp, Homo sapien
cacggcaagggcacacggatttcat

SEQ ID NO: 67966 - DNA, 25 bp, Homo sapien
cggaaaacagcctcgcgcacggcaa

SEQ ID NO: 67967 - DNA, 25 bp, Homo sapien
gtcctcgcctttctggtctttcacg

SEQ ID NO: 67968 - DNA, 25 bp, Homo sapien
ggcgcaagagaagcaggcatgacct

SEQ ID NO: 67969 - DNA, 25 bp, Homo sapien
ccggcgcccatatggaatcggcgta

SEQ ID NO: 67970 - DNA, 25 bp, Homo sapien
tctgaaaagagatcgagggcgcctc

SEQ ID NO: 67971 - DNA, 25 bp, Homo sapien
ggcgcctctgccgatcttgaacatc

SEQ ID NO: 67972 - DNA, 25 bp, Homo sapien
tgaacatctctgctcgtcgctgggg

SEQ ID NO: 67973 - DNA, 25 bp, Homo sapien
cagctgcggcggattaaagttcaag

SEQ ID NO: 67974 - DNA, 25 bp, Homo sapien
ccaggcagccactttcccggggaag

SEQ ID NO: 67975 - DNA, 25 bp, Homo sapien
ggcgccaacccattgagactactcg

SEQ ID NO: 67976 - DNA, 25 bp, Homo sapien
ggcgtacgtacccagagcgaacagg

SEQ ID NO: 67977 - DNA, 25 bp, Homo sapien
ataggaaggcggctaccgtcacctc

SEQ ID NO: 67978 - DNA, 25 bp, Homo sapien
gtggacgccgagatcacaaagattc

SEQ ID NO: 67979 - DNA, 25 bp, Homo sapien
cgccagcttgcgtcgaaattccctg

SEQ ID NO: 67980 - DNA, 25 bp, Homo sapien
ccttgttgccagagcgggaatttga

SEQ ID NO: 67981 - DNA, 25 bp, Homo sapien
cccggcatgcatcggtctttggtca

SEQ ID NO: 67982 - DNA, 25 bp, Homo sapien
tcagcgtcgcaagagatcgtcaatc

SEQ ID NO: 67983 - DNA, 25 bp, Homo sapien
tgtgtgactacatctcccgaaatgc

SEQ ID NO: 67984 - DNA, 25 bp, Homo sapien
ggaagccacccaacacgcaggaagt

SEQ ID NO: 67985 - DNA, 25 bp, Homo sapien
ggcgtcgcttcacccgagacaaatg

SEQ ID NO: 67986 - DNA, 25 bp, Homo sapien
tgggtacacgtcctgaagagccagc

SEQ ID NO: 67987 - DNA, 25 bp, Homo sapien
ctcattttcccggtgggtttgcaat

SEQ ID NO: 67988 - DNA, 25 bp, Homo sapien
ggggaccgtctcttcgctcattttc

SEQ ID NO: 67989 - DNA, 25 bp, Homo sapien
ctctgagaagcggtcaaagtaaggc

SEQ ID NO: 67990 - DNA, 25 bp, Homo sapien
cccggttgcgaaggcgcatgtactc

SEQ ID NO: 67991 - DNA, 25 bp, Homo sapien
tcaggttgaagtcctgccgcaggtc

SEQ ID NO: 67992 - DNA, 25 bp, Homo sapien
cactcacgggactctgcaggatcat

SEQ ID NO: 67993 - DNA, 25 bp, Homo sapien
gcaggatcatggtgacgcgcttctt

SEQ ID NO: 67994 - DNA, 25 bp, Homo sapien
aattaaagccatttcccgcacgagg

SEQ ID NO: 67995 - DNA, 25 bp, Homo sapien
cgatctcaatgtaggcggctgccga

SEQ ID NO: 67996 - DNA, 25 bp, Homo sapien
tcctaagagcctcggatgctacatc

SEQ ID NO: 67997 - DNA, 25 bp, Homo sapien
ttaggcgcaaaacacaccgctgccg

SEQ ID NO: 67998 - DNA, 25 bp, Homo sapien
ggcatcttagctatctccggtcggc

SEQ ID NO: 67999 - DNA, 25 bp, Homo sapien
cccagctaatctgcagggcagcgtt

SEQ ID NO: 68000 - DNA, 25 bp, Homo sapien
ccgacgccgcagttccttgacaaaa

SEQ ID NO: 68001 - DNA, 25 bp, Homo sapien
acagccctgccgtcagaattaaagc

SEQ ID NO: 68002 - DNA, 25 bp, Homo sapien
tcgcgttgaataagccgcacaggtg

SEQ ID NO: 68003 - DNA, 25 bp, Homo sapien
caccagcgcctacggtgtgagatga

SEQ ID NO: 68004 - DNA, 25 bp, Homo sapien
ccctgggcgcgaagcttttaaagca

SEQ ID NO: 68005 - DNA, 25 bp, Homo sapien
acccgggtcctgcacaaatcctgga

SEQ ID NO: 68006 - DNA, 25 bp, Homo sapien
aggccactgccattctcctgacaag

SEQ ID NO: 68007 - DNA, 25 bp, Homo sapien
ggacgtcgaccctagggatccctca

SEQ ID NO: 68008 - DNA, 25 bp, Homo sapien
ggagctggaccacctgcaaccattc

SEQ ID NO: 68009 - DNA, 25 bp, Homo sapien
ctgcgtccaggcatcgcgttgaata

SEQ ID NO: 68010 - DNA, 25 bp, Homo sapien
ggagagccctgtcagtgtgaaatta

SEQ ID NO: 68011 - DNA, 25 bp, Homo sapien
aaattagcctgaagactggggcgtg

SEQ ID NO: 68012 - DNA, 25 bp, Homo sapien
gcctgcgcaaggaagtcggcgaaga

SEQ ID NO: 68013 - DNA, 25 bp, Homo sapien
ccctcggtgctgtaagtttgcgacc

SEQ ID NO: 68014 - DNA, 25 bp, Homo sapien
tattagtgcgtacgccaggggcacg

SEQ ID NO: 68015 - DNA, 25 bp, Homo sapien
gccctgtcagtgtgaaattagcctg

SEQ ID NO: 68016 - DNA, 25 bp, Homo sapien
ctgtaagtttgcgaccagcagaggg

SEQ ID NO: 68017 - DNA, 25 bp, Homo sapien
cctgacacccaggacactgtcgtta

SEQ ID NO: 68018 - DNA, 25 bp, Homo sapien
cggccaccctgagccgaaggctgtt

SEQ ID NO: 68019 - DNA, 25 bp, Homo sapien
cagcgatcccgaaagtgcccatgta

SEQ ID NO: 68020 - DNA, 25 bp, Homo sapien
ccgcgctttgtctagggcgcgagtc

SEQ ID NO: 68021 - DNA, 25 bp, Homo sapien
cgatcgatccctttggactggcttc

SEQ ID NO: 68022 - DNA, 25 bp, Homo sapien
agtgcccatgtatccgtccatctgg

SEQ ID NO: 68023 - DNA, 25 bp, Homo sapien
cgggctccatttctccaggcgacat

SEQ ID NO: 68024 - DNA, 25 bp, Homo sapien
ctcttcggttctccgtggaaaatca

SEQ ID NO: 68025 - DNA, 25 bp, Homo sapien
tcttagatcatccaccaaggccggg

SEQ ID NO: 68026 - DNA, 25 bp, Homo sapien
ggacctcgtcgccttgcttagctct

SEQ ID NO: 68027 - DNA, 25 bp, Homo sapien
ctggcgacctcggatacattcattg

SEQ ID NO: 68028 - DNA, 25 bp, Homo sapien
tcggggaccttgacctcgcgcggac

SEQ ID NO: 68029 - DNA, 25 bp, Homo sapien
cattcattgaagttgccgcgcactc

SEQ ID NO: 68030 - DNA, 25 bp, Homo sapien
ccaaggcccatggtcagaggtgtcc

SEQ ID NO: 68031 - DNA, 25 bp, Homo sapien
gggcgcggcctacactcgaatgccg

SEQ ID NO: 68032 - DNA, 25 bp, Homo sapien
tccacgcgctcggaacttgggcttc

SEQ ID NO: 68033 - DNA, 25 bp, Homo sapien
tgacctgcttttgaacccgctaatc

SEQ ID NO: 68034 - DNA, 25 bp, Homo sapien
gctgggagtcttggaaacctgactc

SEQ ID NO: 68035 - DNA, 25 bp, Homo sapien
tgcagctgacacctctcaattcata

SEQ ID NO: 68036 - DNA, 25 bp, Homo sapien
agcgtctattgtgtgctggacatta

SEQ ID NO: 68037 - DNA, 25 bp, Homo sapien
aggcccattcggaacggctactgtg

SEQ ID NO: 68038 - DNA, 25 bp, Homo sapien
cgtcccgtgaccctcaaggcaagtg

SEQ ID NO: 68039 - DNA, 25 bp, Homo sapien
agaaaagcgtcttgcgcgctccgcg

SEQ ID NO: 68040 - DNA, 25 bp, Homo sapien
gccgccgcatactggtgcgaggtaa

SEQ ID NO: 68041 - DNA, 25 bp, Homo sapien
acaaagcagcgaatgggaccgaagc

SEQ ID NO: 68042 - DNA, 25 bp, Homo sapien
cgcgacgtttctgatatttcaaaca

SEQ ID NO: 68043 - DNA, 25 bp, Homo sapien
aacaagtcttcggtgcgttccagtc

SEQ ID NO: 68044 - DNA, 25 bp, Homo sapien
cgaactcgtcaacttcctgtcggta

SEQ ID NO: 68045 - DNA, 25 bp, Homo sapien
tgtcggtacttgaagaagcggagcc

SEQ ID NO: 68046 - DNA, 25 bp, Homo sapien
cggtaaccgcggctcctcgagagct

SEQ ID NO: 68047 - DNA, 25 bp, Homo sapien
ggcatagaacatcccgaacccgcga

SEQ ID NO: 68048 - DNA, 25 bp, Homo sapien
ggaacagaagccagctcatcgctca

SEQ ID NO: 68049 - DNA, 25 bp, Homo sapien
ggaagcatttcgactcccggcccag

SEQ ID NO: 68050 - DNA, 25 bp, Homo sapien
gctcgctttctgcttggattaccaa

SEQ ID NO: 68051 - DNA, 25 bp, Homo sapien
gtggagtccagtccttcggagaatc

SEQ ID NO: 68052 - DNA, 25 bp, Homo sapien
atcccttgaagaagtgactcgctgc

SEQ ID NO: 68053 - DNA, 25 bp, Homo sapien
tacagacaatgcgtggcgtccgttc

SEQ ID NO: 68054 - DNA, 25 bp, Homo sapien
cgggaaattctgtccaccagcgtca

SEQ ID NO: 68055 - DNA, 25 bp, Homo sapien
cgcgtgcacagtccctagaccagtg

SEQ ID NO: 68056 - DNA, 25 bp, Homo sapien
cccatttgtaccctaaggcctgaga

SEQ ID NO: 68057 - DNA, 25 bp, Homo sapien
ggacgcagcgatcctcccatttgta

SEQ ID NO: 68058 - DNA, 25 bp, Homo sapien
aggacactctacgaggcacagcctc

SEQ ID NO: 68059 - DNA, 25 bp, Homo sapien
tggagccaaaaataaccgcgcagtt

SEQ ID NO: 68060 - DNA, 25 bp, Homo sapien
cgcagttgacgccacggtttcttta

SEQ ID NO: 68061 - DNA, 25 bp, Homo sapien
cgccacggtttctttagcgtcttgc

SEQ ID NO: 68062 - DNA, 25 bp, Homo sapien
ctttagcgtcttgctggagacattg

SEQ ID NO: 68063 - DNA, 25 bp, Homo sapien
gccgggcaaaggacactctacgagg

SEQ ID NO: 68064 - DNA, 25 bp, Homo sapien
cagcccacggctggagccaaaaata

SEQ ID NO: 68065 - DNA, 25 bp, Homo sapien
ctggagacattgactttcagagccc

SEQ ID NO: 68066 - DNA, 25 bp, Homo sapien
gtcagacgcgggcacccaaggcact

SEQ ID NO: 68067 - DNA, 25 bp, Homo sapien
gggccgcgacaagagacccttccag

SEQ ID NO: 68068 - DNA, 25 bp, Homo sapien
agccgccacagtccgagccattttt

SEQ ID NO: 68069 - DNA, 25 bp, Homo sapien
gccagccaagcgcagcacgtcactt

SEQ ID NO: 68070 - DNA, 25 bp, Homo sapien
cttccggacagggaagcaccgcctt

SEQ ID NO: 68071 - DNA, 25 bp, Homo sapien
cccgcccggacttgttgcgaattgg

SEQ ID NO: 68072 - DNA, 25 bp, Homo sapien
ggccctgagtccgaagacccgctaa

SEQ ID NO: 68073 - DNA, 25 bp, Homo sapien
tgagtccgaagacccgctaaacagg

SEQ ID NO: 68074 - DNA, 25 bp, Homo sapien
actcccggtgctgcggaagaactga

SEQ ID NO: 68075 - DNA, 25 bp, Homo sapien
ctgaaggttgcgatgccttactctg

SEQ ID NO: 68076 - DNA, 25 bp, Homo sapien
gaaccgctcggtgttcgagtcgctg

SEQ ID NO: 68077 - DNA, 25 bp, Homo sapien
tgggctggaagctgctgcgcatctt

SEQ ID NO: 68078 - DNA, 25 bp, Homo sapien
cccaaggagatgctgaagcgcattc

SEQ ID NO: 68079 - DNA, 25 bp, Homo sapien
aagcgcattccgcaggccgtgatcg

SEQ ID NO: 68080 - DNA, 25 bp, Homo sapien
aggccgtgatcgacgagttctattc

SEQ ID NO: 68081 - DNA, 25 bp, Homo sapien
tcgacgagttctattcccgcgaggg

SEQ ID NO: 68082 - DNA, 25 bp, Homo sapien
caaggagtccgaccagacggcaatc

SEQ ID NO: 68083 - DNA, 25 bp, Homo sapien
tgcagcaggcgaacaaagtctcctt

SEQ ID NO: 68084 - DNA, 25 bp, Homo sapien
ctccagctagagaggcagccgaacc

SEQ ID NO: 68085 - DNA, 25 bp, Homo sapien
actccaagtggctccatgcagcagg

SEQ ID NO: 68086 - DNA, 25 bp, Homo sapien
ccaccgacgacaaggtaaggtcttg

SEQ ID NO: 68087 - DNA, 25 bp, Homo sapien
ttctgtctgaaccagagcctcaggg

SEQ ID NO: 68088 - DNA, 25 bp, Homo sapien
cgggagctactaccagctgttcgca

SEQ ID NO: 68089 - DNA, 25 bp, Homo sapien
tccttgaaggccacctggactgacg

SEQ ID NO: 68090 - DNA, 25 bp, Homo sapien
cccgctccactgaggggaatgaatg

SEQ ID NO: 68091 - DNA, 25 bp, Homo sapien
ggagcggactctgtgacacctggaa

SEQ ID NO: 68092 - DNA, 25 bp, Homo sapien
ccgcagcggttagcggtccgcagac

SEQ ID NO: 68093 - DNA, 25 bp, Homo sapien
cctggatgaagagcgacagccagct

SEQ ID NO: 68094 - DNA, 25 bp, Homo sapien
gggaatgaatgcagaccgctgcagc

SEQ ID NO: 68095 - DNA, 25 bp, Homo sapien
ggagacgaccaagcgcccatactgg

SEQ ID NO: 68096 - DNA, 25 bp, Homo sapien
tgtgcactcccgtaccagcctggag

SEQ ID NO: 68097 - DNA, 25 bp, Homo sapien
ggtcgtgcagtctcaccgacagcca

SEQ ID NO: 68098 - DNA, 25 bp, Homo sapien
ttcacacgagcgcagggcaacaatc

SEQ ID NO: 68099 - DNA, 25 bp, Homo sapien
ggccgagcatgcgtcacaacctacg

SEQ ID NO: 68100 - DNA, 25 bp, Homo sapien
tttctgttacaggtccatgggcgca

SEQ ID NO: 68101 - DNA, 25 bp, Homo sapien
tcgcgtggcagatgttcagtagaac

SEQ ID NO: 68102 - DNA, 25 bp, Homo sapien
cctcctcttgggattagtgtccatc

SEQ ID NO: 68103 - DNA, 25 bp, Homo sapien
tgccagcaacttccgggcgtttaca

SEQ ID NO: 68104 - DNA, 25 bp, Homo sapien
tagcagcagcatggccgcgatctat

SEQ ID NO: 68105 - DNA, 25 bp, Homo sapien
ggcttgtctgtttaggtcccaattc

SEQ ID NO: 68106 - DNA, 25 bp, Homo sapien
cagcacccgcgccattttggaaagc

SEQ ID NO: 68107 - DNA, 25 bp, Homo sapien
ggcccgagtgcttcctcacgtaagt

SEQ ID NO: 68108 - DNA, 25 bp, Homo sapien
ttttggaaagcaacccgccacgtca

SEQ ID NO: 68109 - DNA, 25 bp, Homo sapien
ttcctgctacaacgggcctacttta

SEQ ID NO: 68110 - DNA, 25 bp, Homo sapien
ggctgaccatggagatttttgtttc

SEQ ID NO: 68111 - DNA, 25 bp, Homo sapien
ccgcggaactttcggctctgaaatc

SEQ ID NO: 68112 - DNA, 25 bp, Homo sapien
acgtcaagactagccacggaggttg

SEQ ID NO: 68113 - DNA, 25 bp, Homo sapien
tgaaatccaagttgcgctgggcgca

SEQ ID NO: 68114 - DNA, 25 bp, Homo sapien
aggttatctcttactgcacactgcc

SEQ ID NO: 68115 - DNA, 25 bp, Homo sapien
cgcgcgggtcaatttgcctagcatt

SEQ ID NO: 68116 - DNA, 25 bp, Homo sapien
tattgggccaaagaagatgccgttc

SEQ ID NO: 68117 - DNA, 25 bp, Homo sapien
agcgccactaccacttgccaggtta

SEQ ID NO: 68118 - DNA, 25 bp, Homo sapien
acgtgaagcacagcacccgagaagc

SEQ ID NO: 68119 - DNA, 25 bp, Homo sapien
gtcgccacaacagtctcggccttta

SEQ ID NO: 68120 - DNA, 25 bp, Homo sapien
actcctccgagagcttaagccgttg

SEQ ID NO: 68121 - DNA, 25 bp, Homo sapien
ttgcacctgggtagaaatgggactc

SEQ ID NO: 68122 - DNA, 25 bp, Homo sapien
cccaggctaccggtctttagcgcta

SEQ ID NO: 68123 - DNA, 25 bp, Homo sapien
ctttagcgctaagttgcatgggctg

SEQ ID NO: 68124 - DNA, 25 bp, Homo sapien
gtgagctctgcctttgccctatatg

SEQ ID NO: 68125 - DNA, 25 bp, Homo sapien
tggactcgctgaagcggtgagctct

SEQ ID NO: 68126 - DNA, 25 bp, Homo sapien
tgccagtcggtcagcgaatagcggc

SEQ ID NO: 68127 - DNA, 25 bp, Homo sapien
gagtcctgcgccttgaggctcaagc

SEQ ID NO: 68128 - DNA, 25 bp, Homo sapien
gcgaatagcggcagaacgcctggcc

SEQ ID NO: 68129 - DNA, 25 bp, Homo sapien
gcaccgcaggttttggactcgctga

SEQ ID NO: 68130 - DNA, 25 bp, Homo sapien
gatccagctgttagtcgggtaggca

SEQ ID NO: 68131 - DNA, 25 bp, Homo sapien
gtactcgtgaaggaccctgcctcga

SEQ ID NO: 68132 - DNA, 25 bp, Homo sapien
ctgagcccttcctgtgagatccggg

SEQ ID NO: 68133 - DNA, 25 bp, Homo sapien
atccgggccgactattgtatctgtg

SEQ ID NO: 68134 - DNA, 25 bp, Homo sapien
tattcacttcgctacccgggagggc

SEQ ID NO: 68135 - DNA, 25 bp, Homo sapien
ccctgcctcgagaagagctgcctga

SEQ ID NO: 68136 - DNA, 25 bp, Homo sapien
ccagcgacattgtgcaagaagcgtg

SEQ ID NO: 68137 - DNA, 25 bp, Homo sapien
cgaggatcgtgaagagccctttggc

SEQ ID NO: 68138 - DNA, 25 bp, Homo sapien
ggaggccggggtgttaatacacaca

SEQ ID NO: 68139 - DNA, 25 bp, Homo sapien
aggccggggcgttaatacacacaca

SEQ ID NO: 68140 - DNA, 25 bp, Homo sapien
gccggggcgttaatacacacacagg

SEQ ID NO: 68141 - DNA, 25 bp, Homo sapien
ggccggggcgttaatacacacacag

SEQ ID NO: 68142 - DNA, 25 bp, Homo sapien
cggggcgttaatacacacacaggta

SEQ ID NO: 68143 - DNA, 25 bp, Homo sapien
aggccggggtgttaatacacacaca

SEQ ID NO: 68144 - DNA, 25 bp, Homo sapien
ggaggccggcgtgttaatacacaca

SEQ ID NO: 68145 - DNA, 25 bp, Homo sapien
tacacacacaggtagcgaggaggcc

SEQ ID NO: 68146 - DNA, 25 bp, Homo sapien
gcggcctgctctccgacagaacttt

SEQ ID NO: 68147 - DNA, 25 bp, Homo sapien
cggattttgacgtgctctcgcgaga

SEQ ID NO: 68148 - DNA, 25 bp, Homo sapien
attacccgccctgtgctttccgatg

SEQ ID NO: 68149 - DNA, 25 bp, Homo sapien
gccatgttcagttcgagcgccaaga

SEQ ID NO: 68150 - DNA, 25 bp, Homo sapien
agcgccaagatcgtgaagcccaatg

SEQ ID NO: 68151 - DNA, 25 bp, Homo sapien
cggtcctgctgttcgttgcttctta

SEQ ID NO: 68152 - DNA, 25 bp, Homo sapien
tctcagtgatgttccggtttccgcc

SEQ ID NO: 68153 - DNA, 25 bp, Homo sapien
ttctcccaggagaaagccatgttca

SEQ ID NO: 68154 - DNA, 25 bp, Homo sapien
cctgtttcgtactgggagcaggtgc

SEQ ID NO: 68155 - DNA, 25 bp, Homo sapien
ccgcctctgacgagtcccggattta

SEQ ID NO: 68156 - DNA, 25 bp, Homo sapien
ctgccacggattggcttccagggtc

SEQ ID NO: 68157 - DNA, 25 bp, Homo sapien
gaacatggcctctgctactgcggca

SEQ ID NO: 68158 - DNA, 25 bp, Homo sapien
ccaatcctgggcgtcgcttcgctgt

SEQ ID NO: 68159 - DNA, 25 bp, Homo sapien
cgctgcagctacatcctgtttcgta

SEQ ID NO: 68160 - DNA, 25 bp, Homo sapien
cgccttagcatgctggccgggacat

SEQ ID NO: 68161 - DNA, 25 bp, Homo sapien
ccgggacatctggtgaacatggcct

SEQ ID NO: 68162 - DNA, 25 bp, Homo sapien
cagatccgcctcttctctgagaaaa

SEQ ID NO: 68163 - DNA, 25 bp, Homo sapien
caagctgggccgctttgtcaaagac

SEQ ID NO: 68164 - DNA, 25 bp, Homo sapien
tgtatacagcatccatgttccctta

SEQ ID NO: 68165 - DNA, 25 bp, Homo sapien
gttagacaccatgctaatcactgta

SEQ ID NO: 68166 - DNA, 25 bp, Homo sapien
gtgaacatttacagaggacttacta

SEQ ID NO: 68167 - DNA, 25 bp, Homo sapien
ccgcactcagtagagtaagtgaaca

SEQ ID NO: 68168 - DNA, 25 bp, Homo sapien
tagccctgaacagaagccgcactca

SEQ ID NO: 68169 - DNA, 25 bp, Homo sapien
tcctggcggcttctctcaaggatga

SEQ ID NO: 68170 - DNA, 25 bp, Homo sapien
ggcaaccgatttggcgcagcactca

SEQ ID NO: 68171 - DNA, 25 bp, Homo sapien
gcgccaagcatgctgagggtcttca

SEQ ID NO: 68172 - DNA, 25 bp, Homo sapien
ctgttctcggaacgccggctgacaa

SEQ ID NO: 68173 - DNA, 25 bp, Homo sapien
tccgcagccggagcattagattaca

SEQ ID NO: 68174 - DNA, 25 bp, Homo sapien
atgccgtgtcattgggagactccgc

SEQ ID NO: 68175 - DNA, 25 bp, Homo sapien
ccagccaggtgcaaaatgccgtgtc

SEQ ID NO: 68176 - DNA, 25 bp, Homo sapien
atcctctatgccgagaacgtccaca

SEQ ID NO: 68177 - DNA, 25 bp, Homo sapien
agccgagcctttctcctgtccaaga

SEQ ID NO: 68178 - DNA, 25 bp, Homo sapien
caggcattggtcacttctccgcgga

SEQ ID NO: 68179 - DNA, 25 bp, Homo sapien
gcaagcctgactttccgaggtgaga

SEQ ID NO: 68180 - DNA, 25 bp, Homo sapien
tcaccctttcgtcgagcgcacaggg

SEQ ID NO: 68181 - DNA, 25 bp, Homo sapien
tcagcgctcactcagacttggtttc

SEQ ID NO: 68182 - DNA, 25 bp, Homo sapien
aacggccacctagacagcctgcgga

SEQ ID NO: 68183 - DNA, 25 bp, Homo sapien
gggtcccagcaaaccagaacggcca

SEQ ID NO: 68184 - DNA, 25 bp, Homo sapien
gtggggactcgaacctcggagtctc

SEQ ID NO: 68185 - DNA, 25 bp, Homo sapien
gcgaccctgtcgcaagcctgacttt

SEQ ID NO: 68186 - DNA, 25 bp, Homo sapien
cgggctgggcgcataaatcaccctg

SEQ ID NO: 68187 - DNA, 25 bp, Homo sapien
tggttctgcatagctcggggaaatt

SEQ ID NO: 68188 - DNA, 25 bp, Homo sapien
caccctcggggcagtaaatattata

SEQ ID NO: 68189 - DNA, 25 bp, Homo sapien
tgcagtacgtgacctgagacaggcc

SEQ ID NO: 68190 - DNA, 25 bp, Homo sapien
gaaaaatgtagtgcgccgagggcct

SEQ ID NO: 68191 - DNA, 25 bp, Homo sapien
aatcaccctggttggctcggctctc

SEQ ID NO: 68192 - DNA, 25 bp, Homo sapien
gctcggggaaattggcagaaaaata

SEQ ID NO: 68193 - DNA, 25 bp, Homo sapien
ctccggcggtaattggttctgcata

SEQ ID NO: 68194 - DNA, 25 bp, Homo sapien
ccgccggagtagtgatggctctgaa

SEQ ID NO: 68195 - DNA, 25 bp, Homo sapien
cacagtgctttacggtgctgacacc

SEQ ID NO: 68196 - DNA, 25 bp, Homo sapien
gccggcccttcatcacagtgcttta

SEQ ID NO: 68197 - DNA, 25 bp, Homo sapien
gtgaaagtcaccttctgccgctctc

SEQ ID NO: 68198 - DNA, 25 bp, Homo sapien
cttcttggctgtaaatcagggccgc

SEQ ID NO: 68199 - DNA, 25 bp, Homo sapien
ctgctccgccggagtagtgatggct

SEQ ID NO: 68200 - DNA, 25 bp, Homo sapien
ggaggaggcttcttggctgtaaatc

SEQ ID NO: 68201 - DNA, 25 bp, Homo sapien
ggacataaatccttcctcatccctg

SEQ ID NO: 68202 - DNA, 25 bp, Homo sapien
tttggaacccattatttaatcatta

SEQ ID NO: 68203 - DNA, 25 bp, Homo sapien
atcattaatttcctcctctcgtcga

SEQ ID NO: 68204 - DNA, 25 bp, Homo sapien
catctccgccgcctacttgggcctc

SEQ ID NO: 68205 - DNA, 25 bp, Homo sapien
gagccgctacatttggaacccatta

SEQ ID NO: 68206 - DNA, 25 bp, Homo sapien
ggggatttcactcggagccgctaca

SEQ ID NO: 68207 - DNA, 25 bp, Homo sapien
ccggcttgcggctggggatttcact

SEQ ID NO: 68208 - DNA, 25 bp, Homo sapien
ccgagagcgtgcagcctgccggctt

SEQ ID NO: 68209 - DNA, 25 bp, Homo sapien
ggccaggactgtttgaccgggccta

SEQ ID NO: 68210 - DNA, 25 bp, Homo sapien
ctggctccgctttcgggttactgca

SEQ ID NO: 68211 - DNA, 25 bp, Homo sapien
tcctccagtcgctcgggaaatccaa

SEQ ID NO: 68212 - DNA, 25 bp, Homo sapien
gttcaaacagcacgtgccgccagcg

SEQ ID NO: 68213 - DNA, 25 bp, Homo sapien
ctgcagttcaaacagcacgtgccgc

SEQ ID NO: 68214 - DNA, 25 bp, Homo sapien
tgggtgcgctttgatccccgctcgt

SEQ ID NO: 68215 - DNA, 25 bp, Homo sapien
ttcgggttactgcagttcaaacagc

SEQ ID NO: 68216 - DNA, 25 bp, Homo sapien
ccgctttcgggttactgcagttcaa

SEQ ID NO: 68217 - DNA, 25 bp, Homo sapien
gctcgggaaatccaagggataaaca

SEQ ID NO: 68218 - DNA, 25 bp, Homo sapien
cagcgcctacagacggacgagatga

SEQ ID NO: 68219 - DNA, 25 bp, Homo sapien
acacacggtgcgcactcgcttagtg

SEQ ID NO: 68220 - DNA, 25 bp, Homo sapien
tcgcttagtgcctgcttggcttcta

SEQ ID NO: 68221 - DNA, 25 bp, Homo sapien
ccaaagccctcgaaactgtgcctta

SEQ ID NO: 68222 - DNA, 25 bp, Homo sapien
tgtctcttaccctacggaacctgga

SEQ ID NO: 68223 - DNA, 25 bp, Homo sapien
agacgggcacaaacgttcattgata

SEQ ID NO: 68224 - DNA, 25 bp, Homo sapien
gccgccgcaggatcaaactcagttc

SEQ ID NO: 68225 - DNA, 25 bp, Homo sapien
gatcccgctggctcttatctccagg

SEQ ID NO: 68226 - DNA, 25 bp, Homo sapien
cacaagaactgcgaagtagggccta

SEQ ID NO: 68227 - DNA, 25 bp, Homo sapien
cacacagacgagcacgcaggtttta

SEQ ID NO: 68228 - DNA, 25 bp, Homo sapien
gggagcctctcggaataaatatttc

SEQ ID NO: 68229 - DNA, 25 bp, Homo sapien
ggccgcaggccaaagattatttata

SEQ ID NO: 68230 - DNA, 25 bp, Homo sapien
tgcccggaggcagcaactacagatg

SEQ ID NO: 68231 - DNA, 25 bp, Homo sapien
gcccagagccgcgattttcctaatg

SEQ ID NO: 68232 - DNA, 25 bp, Homo sapien
ttgccctggaaataacggagacgga

SEQ ID NO: 68233 - DNA, 25 bp, Homo sapien
tgctcgcccatgaggatcttgcgca

SEQ ID NO: 68234 - DNA, 25 bp, Homo sapien
cgccgcaggaacacagttttaaatc

SEQ ID NO: 68235 - DNA, 25 bp, Homo sapien
cccgaaagcctagagccctggattc

SEQ ID NO: 68236 - DNA, 25 bp, Homo sapien
ttacctacctgggtctggtccctga

SEQ ID NO: 68237 - DNA, 25 bp, Homo sapien
tctggcacttgatgaggtgaactcc

SEQ ID NO: 68238 - DNA, 25 bp, Homo sapien
tcacctctctagtgcggggattgtc

SEQ ID NO: 68239 - DNA, 25 bp, Homo sapien
aagccaagctttcgcacctgtaaac

SEQ ID NO: 68240 - DNA, 25 bp, Homo sapien
cggattgcacgcgtctgttaatttc

SEQ ID NO: 68241 - DNA, 25 bp, Homo sapien
cgcgacccaggcaagtccatcttgg

SEQ ID NO: 68242 - DNA, 25 bp, Homo sapien
gcctcgcccggtatgcagggtctct

SEQ ID NO: 68243 - DNA, 25 bp, Homo sapien
ccggtatgcagggtctctccgaagg

SEQ ID NO: 68244 - DNA, 25 bp, Homo sapien
ccgatgcaggccgtgtcagtgctct

SEQ ID NO: 68245 - DNA, 25 bp, Homo sapien
tcagtgctctcgatctctcgcagga

SEQ ID NO: 68246 - DNA, 25 bp, Homo sapien
cgatctctcgcaggatccgctcgtg

SEQ ID NO: 68247 - DNA, 25 bp, Homo sapien
ggatccgctcgtgctctgccgctgt

SEQ ID NO: 68248 - DNA, 25 bp, Homo sapien
cagcctctggctacccgcaggccga

SEQ ID NO: 68249 - DNA, 25 bp, Homo sapien
ttgcgtcaccgcgtccgtcggcgtt

SEQ ID NO: 68250 - DNA, 25 bp, Homo sapien
tttggcgccacctagtggtgtcttg

SEQ ID NO: 68251 - DNA, 25 bp, Homo sapien
gctctggcgtaagccggcttaggat

SEQ ID NO: 68252 - DNA, 25 bp, Homo sapien
tgctgttgggaaggagtctccgcca

SEQ ID NO: 68253 - DNA, 25 bp, Homo sapien
cagcggagctacgagctctccagga

SEQ ID NO: 68254 - DNA, 25 bp, Homo sapien
cccggttaccgatggcacttgcttt

SEQ ID NO: 68255 - DNA, 25 bp, Homo sapien
cacttgctttcttggcggcttctgg

SEQ ID NO: 68256 - DNA, 25 bp, Homo sapien
gagctctccaggatccgcccggtta

SEQ ID NO: 68257 - DNA, 25 bp, Homo sapien
ttaccgacgtcgctagtcctgaggc

SEQ ID NO: 68258 - DNA, 25 bp, Homo sapien
ctgctgcttatcaacaacgcgggta

SEQ ID NO: 68259 - DNA, 25 bp, Homo sapien
tctctgttgtcccacttggcacgga

SEQ ID NO: 68260 - DNA, 25 bp, Homo sapien
ttagcgcccgcaacgacgaggcact

SEQ ID NO: 68261 - DNA, 25 bp, Homo sapien
ggaaccagatcccaagggaaccagc

SEQ ID NO: 68262 - DNA, 25 bp, Homo sapien
gccaccagcaaccaagggaaccaga

SEQ ID NO: 68263 - DNA, 25 bp, Homo sapien
acggtttgacttccgccaccagcaa

SEQ ID NO: 68264 - DNA, 25 bp, Homo sapien
ctgggctaccgccacggtttgactt

SEQ ID NO: 68265 - DNA, 25 bp, Homo sapien
tcccacttggcacggactgggctac

SEQ ID NO: 68266 - DNA, 25 bp, Homo sapien
aatgccgttaagattcccgccaagg

SEQ ID NO: 68267 - DNA, 25 bp, Homo sapien
gtaggtgccaaaccgagaccctggc

SEQ ID NO: 68268 - DNA, 25 bp, Homo sapien
ttcgcctgccttgccagagcagaga

SEQ ID NO: 68269 - DNA, 25 bp, Homo sapien
ggaactgtcgccatggcagccagga

SEQ ID NO: 68270 - DNA, 25 bp, Homo sapien
tcagcaatcgcgaaccggaccaatc

SEQ ID NO: 68271 - DNA, 25 bp, Homo sapien
tgacagccattctccgacctgcgtg

SEQ ID NO: 68272 - DNA, 25 bp, Homo sapien
gtgggtgcggttacaaatgccgtta

SEQ ID NO: 68273 - DNA, 25 bp, Homo sapien
cgccaatcggcgtcgtcagcaatcg

SEQ ID NO: 68274 - DNA, 25 bp, Homo sapien
ctctctaaatagcagccatgaggcg

SEQ ID NO: 68275 - DNA, 25 bp, Homo sapien
cccgagataacgctgcggccgggcg

SEQ ID NO: 68276 - DNA, 25 bp, Homo sapien
tgatttgctgggctgtctgatggcc

SEQ ID NO: 68277 - DNA, 25 bp, Homo sapien
atttgctgggctgtctgatggcccg

SEQ ID NO: 68278 - DNA, 25 bp, Homo sapien
tgcggccgcctctctaaatagcagc

SEQ ID NO: 68279 - DNA, 25 bp, Homo sapien
gccgcctctctaaatagcagccatg

SEQ ID NO: 68280 - DNA, 25 bp, Homo sapien
aggaagctccccgagataacgctgc

SEQ ID NO: 68281 - DNA, 25 bp, Homo sapien
ggcctgatttgctgggctgtctgat

SEQ ID NO: 68282 - DNA, 25 bp, Homo sapien
caagtgtggctgcattttcggaccc

SEQ ID NO: 68283 - DNA, 25 bp, Homo sapien
cgcaactacaatgggccggagcttc

SEQ ID NO: 68284 - DNA, 25 bp, Homo sapien
gccatcagtcccagcgggtacgtta

SEQ ID NO: 68285 - DNA, 25 bp, Homo sapien
ggaatgaggttatctccgccgcctg

SEQ ID NO: 68286 - DNA, 25 bp, Homo sapien
tccgttgggcactgaaggacttttc

SEQ ID NO: 68287 - DNA, 25 bp, Homo sapien
ggacttttcgaaccctgtagcgctg

SEQ ID NO: 68288 - DNA, 25 bp, Homo sapien
gtgggccgcatttcggtactgtttc

SEQ ID NO: 68289 - DNA, 25 bp, Homo sapien
tccagtcaggcgaggcggataaatc

SEQ ID NO: 68290 - DNA, 25 bp, Homo sapien
ttctcttgagatgggctcgggctac

SEQ ID NO: 68291 - DNA, 25 bp, Homo sapien
gggctacttggccagcttcaattta

SEQ ID NO: 68292 - DNA, 25 bp, Homo sapien
aaaactggccggagcagagtcgtcc

SEQ ID NO: 68293 - DNA, 25 bp, Homo sapien
ttaagccacagtgtctccgaggccc

SEQ ID NO: 68294 - DNA, 25 bp, Homo sapien
tcacagcctgtcgtgagaactgccc

SEQ ID NO: 68295 - DNA, 25 bp, Homo sapien
gcgctcaggccgctagaatggaccc

SEQ ID NO: 68296 - DNA, 25 bp, Homo sapien
gtcaggaggcccaacccagatctgc

SEQ ID NO: 68297 - DNA, 25 bp, Homo sapien
attccttccgaaggcgcctctgcgg

SEQ ID NO: 68298 - DNA, 25 bp, Homo sapien
acgtgcctctcctacccaaggtggg

SEQ ID NO: 68299 - DNA, 25 bp, Homo sapien
gcggggctgtttagaagttactgcc

SEQ ID NO: 68300 - DNA, 25 bp, Homo sapien
tgggatgtttctcggcaaccttggc

SEQ ID NO: 68301 - DNA, 25 bp, Homo sapien
agggcgaatcggagagttaatgttc

SEQ ID NO: 68302 - DNA, 25 bp, Homo sapien
tataccagttcggacgcaagcccag

SEQ ID NO: 68303 - DNA, 25 bp, Homo sapien
gagacctccaggcttttctagaaaa

SEQ ID NO: 68304 - DNA, 25 bp, Homo sapien
ctgggtcctgcggaaccgcttcttc

SEQ ID NO: 68305 - DNA, 25 bp, Homo sapien
taagcaaactggcttccgccgttgc

SEQ ID NO: 68306 - DNA, 25 bp, Homo sapien
cttcctcgagactgcgtgcagcctg

SEQ ID NO: 68307 - DNA, 25 bp, Homo sapien
aatgcaaactgtatcccgagcccgg

SEQ ID NO: 68308 - DNA, 25 bp, Homo sapien
tctgtctgtacctgcgtgtgttgcc

SEQ ID NO: 68309 - DNA, 25 bp, Homo sapien
agcgcgccttcgagaagaaccacta

SEQ ID NO: 68310 - DNA, 25 bp, Homo sapien
gtcaagcccgtctttagagcctctt

SEQ ID NO: 68311 - DNA, 25 bp, Homo sapien
cccgcaggacttttgtcaagcgcta

SEQ ID NO: 68312 - DNA, 25 bp, Homo sapien
cctagcaggaggcagagtaaatgca

SEQ ID NO: 68313 - DNA, 25 bp, Homo sapien
agcctctccgagacgcaggtaatca

SEQ ID NO: 68314 - DNA, 25 bp, Homo sapien
agaccctccgcggagaacacagcga

SEQ ID NO: 68315 - DNA, 25 bp, Homo sapien
cgccagcagctcgaaaggaacgtca

SEQ ID NO: 68316 - DNA, 25 bp, Homo sapien
agttagaaggcatcccggccacgcc

SEQ ID NO: 68317 - DNA, 25 bp, Homo sapien
atccagggccagactagaactttgc

SEQ ID NO: 68318 - DNA, 25 bp, Homo sapien
gagtttgctcgtcctctctttgcca

SEQ ID NO: 68319 - DNA, 25 bp, Homo sapien
cgccgatgctgtagtcgctgtatcc

SEQ ID NO: 68320 - DNA, 25 bp, Homo sapien
gcgtcagcgaatcctcagcccgaga

SEQ ID NO: 68321 - DNA, 25 bp, Homo sapien
gctgtatccgccatggccactgacg

SEQ ID NO: 68322 - DNA, 25 bp, Homo sapien
tctaaaagtccctgctccggaaagc

SEQ ID NO: 68323 - DNA, 25 bp, Homo sapien
cagttcctgggatggccagcctctt

SEQ ID NO: 68324 - DNA, 25 bp, Homo sapien
cggcagctcgaaggagcactcctca

SEQ ID NO: 68325 - DNA, 25 bp, Homo sapien
cagcaccgtcacctggacgtgcgtg

SEQ ID NO: 68326 - DNA, 25 bp, Homo sapien
caggacctggtgacaaacccggccg

SEQ ID NO: 68327 - DNA, 25 bp, Homo sapien
gcagaaggcggtcaggaaccaactc

SEQ ID NO: 68328 - DNA, 25 bp, Homo sapien
gccaggtacgaaaaacccgctctgc

SEQ ID NO: 68329 - DNA, 25 bp, Homo sapien
caggaacttgtcgacgccgatgagc

SEQ ID NO: 68330 - DNA, 25 bp, Homo sapien
acacccggtgatgtccagggaactc

SEQ ID NO: 68331 - DNA, 25 bp, Homo sapien
gcgccgtcttgaggcctggttctaa

SEQ ID NO: 68332 - DNA, 25 bp, Homo sapien
agtcctatgctattggtgcttctga

SEQ ID NO: 68333 - DNA, 25 bp, Homo sapien
gggtccctctgcgaaggtctttagc

SEQ ID NO: 68334 - DNA, 25 bp, Homo sapien
gctcagagggctgtgcgcaaattta

SEQ ID NO: 68335 - DNA, 25 bp, Homo sapien
tgtaaccagccctcttcttggaagg

SEQ ID NO: 68336 - DNA, 25 bp, Homo sapien
ttggtctaggataggatccctcatc

SEQ ID NO: 68337 - DNA, 25 bp, Homo sapien
caggcggactgctcattcctacaaa

SEQ ID NO: 68338 - DNA, 25 bp, Homo sapien
ccaccgtttaccttgcagttgaagc

SEQ ID NO: 68339 - DNA, 25 bp, Homo sapien
gtgtttcgcccaggatcaccagcga

SEQ ID NO: 68340 - DNA, 25 bp, Homo sapien
ggaccgcgacagtcttgctgaaaaa

SEQ ID NO: 68341 - DNA, 25 bp, Homo sapien
agcgtaggtttttaccctgtgccag

SEQ ID NO: 68342 - DNA, 25 bp, Homo sapien
tgcccgcctacctgagcgtaggttt

SEQ ID NO: 68343 - DNA, 25 bp, Homo sapien
gaggttcccagacaaccggtcttgc

SEQ ID NO: 68344 - DNA, 25 bp, Homo sapien
actctttggtgctgtgcccaccttg

SEQ ID NO: 68345 - DNA, 25 bp, Homo sapien
ccaaatttaagagccttcgccgagc

SEQ ID NO: 68346 - DNA, 25 bp, Homo sapien
ctccatgtgcgacgtgttctccttc

SEQ ID NO: 68347 - DNA, 25 bp, Homo sapien
gtctccgtggaagtccgtttcgtga

SEQ ID NO: 68348 - DNA, 25 bp, Homo sapien
aagtccgtttcgtgagcagcgccaa

SEQ ID NO: 68349 - DNA, 25 bp, Homo sapien
ttctgtgccgctcggacgctacggc

SEQ ID NO: 68350 - DNA, 25 bp, Homo sapien
gcggtcacgcgatagacccgggcct

SEQ ID NO: 68351 - DNA, 25 bp, Homo sapien
gcctccggagtctccgtgcgcattt

SEQ ID NO: 68352 - DNA, 25 bp, Homo sapien
gtgcgcatttcctcccagcggaatt

SEQ ID NO: 68353 - DNA, 25 bp, Homo sapien
ctgctgtatccctggaacggtgggc

SEQ ID NO: 68354 - DNA, 25 bp, Homo sapien
cggcccaagcttctgggtatttcta

SEQ ID NO: 68355 - DNA, 25 bp, Homo sapien
ggggctgattggcttaaactcttaa

SEQ ID NO: 68356 - DNA, 25 bp, Homo sapien
gccggacttgcttcagctgtcgata

SEQ ID NO: 68357 - DNA, 25 bp, Homo sapien
tgtcgatagtcgaggccgttaaccc

SEQ ID NO: 68358 - DNA, 25 bp, Homo sapien
aggccgcctcgattgacgacgatta

SEQ ID NO: 68359 - DNA, 25 bp, Homo sapien
ccttcacgggaaggcactcgtcttg

SEQ ID NO: 68360 - DNA, 25 bp, Homo sapien
tgcgccttagcctacttcctattgg

SEQ ID NO: 68361 - DNA, 25 bp, Homo sapien
gcgtcccacacttttgcctttattg

SEQ ID NO: 68362 - DNA, 25 bp, Homo sapien
cttgccctggaaggaagtgctctcg

SEQ ID NO: 68363 - DNA, 25 bp, Homo sapien
ggatctcgatctcgcgcagcgcata

SEQ ID NO: 68364 - DNA, 25 bp, Homo sapien
gacgccacggacttgcgggcgaaca

SEQ ID NO: 68365 - DNA, 25 bp, Homo sapien
agtgctctcgaagacctctcgccgg

SEQ ID NO: 68366 - DNA, 25 bp, Homo sapien
ttcgtaggccacatcagcgggtgag

SEQ ID NO: 68367 - DNA, 25 bp, Homo sapien
cgtcgcagatgctgttggtcttgga

SEQ ID NO: 68368 - DNA, 25 bp, Homo sapien
tcttggagaggatgtagagcgtctc

SEQ ID NO: 68369 - DNA, 25 bp, Homo sapien
tctcgtaggtgtggctgtactccag

SEQ ID NO: 68370 - DNA, 25 bp, Homo sapien
ggaaatccaggcgacttcgcagttg

SEQ ID NO: 68371 - DNA, 25 bp, Homo sapien
ggctgtgtctccgtcaactctttac

SEQ ID NO: 68372 - DNA, 25 bp, Homo sapien
cgcagttgccgaagggatctgaaga

SEQ ID NO: 68373 - DNA, 25 bp, Homo sapien
gcgccaacggtaagatgtcgctctg

SEQ ID NO: 68374 - DNA, 25 bp, Homo sapien
tcctgcagtgcgaacctgggaaatc

SEQ ID NO: 68375 - DNA, 25 bp, Homo sapien
ttactaagcgaacccagaggatgcc

SEQ ID NO: 68376 - DNA, 25 bp, Homo sapien
ggatcccggtctcaatttactaagc

SEQ ID NO: 68377 - DNA, 25 bp, Homo sapien
accgactgcggtcagcatcttcctt

SEQ ID NO: 68378 - DNA, 25 bp, Homo sapien
gttgcccaccttgaatcagggcctc

SEQ ID NO: 68379 - DNA, 25 bp, Homo sapien
ctagcactctggcttgggcctgctt

SEQ ID NO: 68380 - DNA, 25 bp, Homo sapien
ttttccgctcaaggtggtttcgatg

SEQ ID NO: 68381 - DNA, 25 bp, Homo sapien
acctcgggtcagatgcttggtctcc

SEQ ID NO: 68382 - DNA, 25 bp, Homo sapien
acctccagctgtggcttctgttgcc

SEQ ID NO: 68383 - DNA, 25 bp, Homo sapien
cacggtccctaagcggcctcatggg

SEQ ID NO: 68384 - DNA, 25 bp, Homo sapien
tactcctgagacatgcgccacggtc

SEQ ID NO: 68385 - DNA, 25 bp, Homo sapien
gcgcaggcgctactcctgagacatg

SEQ ID NO: 68386 - DNA, 25 bp, Homo sapien
tccacatctcctgcagcacggagat

SEQ ID NO: 68387 - DNA, 25 bp, Homo sapien
ctctccgatgctttcctgggctctg

SEQ ID NO: 68388 - DNA, 25 bp, Homo sapien
ttgctgggccgctgtcccgacttac

SEQ ID NO: 68389 - DNA, 25 bp, Homo sapien
taccggcaaaccctgagctctgatc

SEQ ID NO: 68390 - DNA, 25 bp, Homo sapien
tgagctctgatccctgcagccagcg

SEQ ID NO: 68391 - DNA, 25 bp, Homo sapien
acacacagcgcctggtgtgcgaagc

SEQ ID NO: 68392 - DNA, 25 bp, Homo sapien
tggtgtgcgaagcagagtcgcctcc

SEQ ID NO: 68393 - DNA, 25 bp, Homo sapien
cctcgcacgcactgcagttgctggg

SEQ ID NO: 68394 - DNA, 25 bp, Homo sapien
tgcccgacatgaggttgaagagtgc

SEQ ID NO: 68395 - DNA, 25 bp, Homo sapien
gggcgctccgataaccgcacaggtt

SEQ ID NO: 68396 - DNA, 25 bp, Homo sapien
gggcccgcatacgtcccaaggagca

SEQ ID NO: 68397 - DNA, 25 bp, Homo sapien
ctcttggtgcccacggatatacaca

SEQ ID NO: 68398 - DNA, 25 bp, Homo sapien
atcaaagggtgcacctgagtccaca

SEQ ID NO: 68399 - DNA, 25 bp, Homo sapien
gcaggaatcagctctgggcacatca

SEQ ID NO: 68400 - DNA, 25 bp, Homo sapien
tgcctgaatgaagaagctaccgctg

SEQ ID NO: 68401 - DNA, 25 bp, Homo sapien
ttgcgccgcagctgttcaaagccca

SEQ ID NO: 68402 - DNA, 25 bp, Homo sapien
ttggactccgactctcactacgggc

SEQ ID NO: 68403 - DNA, 25 bp, Homo sapien
ggcaacgtcgcctgtagcaaacctc

SEQ ID NO: 68404 - DNA, 25 bp, Homo sapien
tacagtacagttcgcaaggtcccgg

SEQ ID NO: 68405 - DNA, 25 bp, Homo sapien
ccagtcccggtttattgtgagctta

SEQ ID NO: 68406 - DNA, 25 bp, Homo sapien
ctttgtggcaaagacttctcgtttc

SEQ ID NO: 68407 - DNA, 25 bp, Homo sapien
ccgtagacgttcaggggagcctgca

SEQ ID NO: 68408 - DNA, 25 bp, Homo sapien
aactacactgtccttgcgcggggcc

SEQ ID NO: 68409 - DNA, 25 bp, Homo sapien
tcacgccgcctgacggagaaaacgc

SEQ ID NO: 68410 - DNA, 25 bp, Homo sapien
tcttcgagccagtttccggataggc

SEQ ID NO: 68411 - DNA, 25 bp, Homo sapien
ttgagaaataccaaccgcagccgtt

SEQ ID NO: 68412 - DNA, 25 bp, Homo sapien
cgcagccgttgtcccaaagacacta

SEQ ID NO: 68413 - DNA, 25 bp, Homo sapien
ctgcccgttagagcgcaaggaaaac

SEQ ID NO: 68414 - DNA, 25 bp, Homo sapien
caacttccggaagcgatggccaatc

SEQ ID NO: 68415 - DNA, 25 bp, Homo sapien
ggccatctgtttccgggtcctggta

SEQ ID NO: 68416 - DNA, 25 bp, Homo sapien
acaggggctgtatatcacttccggc

SEQ ID NO: 68417 - DNA, 25 bp, Homo sapien
gctccgaaacaaagctcacaacttc

SEQ ID NO: 68418 - DNA, 25 bp, Homo sapien
cggcgccctcaatgccaggataaga

SEQ ID NO: 68419 - DNA, 25 bp, Homo sapien
tgccaagtcggccaaaagcgccagt

SEQ ID NO: 68420 - DNA, 25 bp, Homo sapien
cactggctcatgtgggtcccaagaa

SEQ ID NO: 68421 - DNA, 25 bp, Homo sapien
cgtcctgaaaagtcgcgtctccggc

SEQ ID NO: 68422 - DNA, 25 bp, Homo sapien
ccttcttcttggctgaggagcgtcc

SEQ ID NO: 68423 - DNA, 25 bp, Homo sapien
cacgccaagggaccaagacatacta

SEQ ID NO: 68424 - DNA, 25 bp, Homo sapien
ccacgagctggaaaggccacgccaa

SEQ ID NO: 68425 - DNA, 25 bp, Homo sapien
ccagcgtctcgctattgcgcatgtg

SEQ ID NO: 68426 - DNA, 25 bp, Homo sapien
tactagctctccgttccaagtccta

SEQ ID NO: 68427 - DNA, 25 bp, Homo sapien
gcgccggatgtgacgtttccggaac

SEQ ID NO: 68428 - DNA, 25 bp, Homo sapien
tgtcgttcgctcctcattggtcgga

SEQ ID NO: 68429 - DNA, 25 bp, Homo sapien
attggtcggattttccgcaggtgcc

SEQ ID NO: 68430 - DNA, 25 bp, Homo sapien
tgtaatagacagacgaacgggagtg

SEQ ID NO: 68431 - DNA, 25 bp, Homo sapien
cgttccaagtcctaaatcactggga

SEQ ID NO: 68432 - DNA, 25 bp, Homo sapien
cctccgagcgtggttggactttgaa

SEQ ID NO: 68433 - DNA, 25 bp, Homo sapien
tcgaggcacccgacggcttctgtct

SEQ ID NO: 68434 - DNA, 25 bp, Homo sapien
ctctccatcgaaggcaacattggta

SEQ ID NO: 68435 - DNA, 25 bp, Homo sapien
gagcacccttcagttccatggccaa

SEQ ID NO: 68436 - DNA, 25 bp, Homo sapien
gcgggccgcctctttctaagtcggc

SEQ ID NO: 68437 - DNA, 25 bp, Homo sapien
atctccttacgtcaacggtgcgctg

SEQ ID NO: 68438 - DNA, 25 bp, Homo sapien
cacttcctgtctgacgatctcctta

SEQ ID NO: 68439 - DNA, 25 bp, Homo sapien
caaacatcgcgatagcggagcggtc

SEQ ID NO: 68440 - DNA, 25 bp, Homo sapien
tctaagtcggcttcgagcacccttc

SEQ ID NO: 68441 - DNA, 25 bp, Homo sapien
ccaagagcccactcgagggcgtttc

SEQ ID NO: 68442 - DNA, 25 bp, Homo sapien
tgtcccggacagatctggcccgcag

SEQ ID NO: 68443 - DNA, 25 bp, Homo sapien
tcggattagtctttgttttcgacgc

SEQ ID NO: 68444 - DNA, 25 bp, Homo sapien
cattgtcctgcctcggaatgagcca

SEQ ID NO: 68445 - DNA, 25 bp, Homo sapien
tcggtacgcaaacgcgcgatgtccc

SEQ ID NO: 68446 - DNA, 25 bp, Homo sapien
gccaggctgactcggtacgcaaacg

SEQ ID NO: 68447 - DNA, 25 bp, Homo sapien
tccacctggacagggcattcggccg

SEQ ID NO: 68448 - DNA, 25 bp, Homo sapien
ttttcgacgcgaaagaatcgagcgc

SEQ ID NO: 68449 - DNA, 25 bp, Homo sapien
cgcggacgccttcattgctgctgct

SEQ ID NO: 68450 - DNA, 25 bp, Homo sapien
gccggccgatgcaccagaggaggcc

SEQ ID NO: 68451 - DNA, 25 bp, Homo sapien
agtctgtcatctttgatcctggagg

SEQ ID NO: 68452 - DNA, 25 bp, Homo sapien
ctgtcatctttgatcctggaggcgc

SEQ ID NO: 68453 - DNA, 25 bp, Homo sapien
tcatctttgatcctggaggcgcaga

SEQ ID NO: 68454 - DNA, 25 bp, Homo sapien
atctttgatcctggaggcgcagagg

SEQ ID NO: 68455 - DNA, 25 bp, Homo sapien
cgcagaggacgccttctgggtatta

SEQ ID NO: 68456 - DNA, 25 bp, Homo sapien
ggggtcgccgtcctctcggatctcg

SEQ ID NO: 68457 - DNA, 25 bp, Homo sapien
cgcagtctgtcatctttgatcctgg

SEQ ID NO: 68458 - DNA, 25 bp, Homo sapien
cttgtctccgcgctgcggacttgaa

SEQ ID NO: 68459 - DNA, 25 bp, Homo sapien
ctggactttggcaccggaagagact

SEQ ID NO: 68460 - DNA, 25 bp, Homo sapien
tcctggaggaagctagttccggctc

SEQ ID NO: 68461 - DNA, 25 bp, Homo sapien
gctctatcagtctgggtctcctcga

SEQ ID NO: 68462 - DNA, 25 bp, Homo sapien
gtctggaaacgcctccgcgctctat

SEQ ID NO: 68463 - DNA, 25 bp, Homo sapien
cctgtcactgcggtctggaaacgcc

SEQ ID NO: 68464 - DNA, 25 bp, Homo sapien
agttccggctcgtccagccacgagg

SEQ ID NO: 68465 - DNA, 25 bp, Homo sapien
tgcggacttgaaacgcctgtcactg

SEQ ID NO: 68466 - DNA, 25 bp, Homo sapien
ccatcttgttgaggagggaccggaa

SEQ ID NO: 68467 - DNA, 25 bp, Homo sapien
ctctcggcaagactttccgccgggg

SEQ ID NO: 68468 - DNA, 25 bp, Homo sapien
atggcgggcgacgtccgtacctctc

SEQ ID NO: 68469 - DNA, 25 bp, Homo sapien
ggagtcgcgaatggccggttattca

SEQ ID NO: 68470 - DNA, 25 bp, Homo sapien
ggccggttattcacacgttcaagta

SEQ ID NO: 68471 - DNA, 25 bp, Homo sapien
ttcaagtacccaaggcaggcggccc

SEQ ID NO: 68472 - DNA, 25 bp, Homo sapien
tgcaggcgtcgtcgcgggttcttcc

SEQ ID NO: 68473 - DNA, 25 bp, Homo sapien
cggccactaggagctcaggaggcaa

SEQ ID NO: 68474 - DNA, 25 bp, Homo sapien
accattttgcaggacaggcatcttc

SEQ ID NO: 68475 - DNA, 25 bp, Homo sapien
acaattgccggctgcgaccattttg

SEQ ID NO: 68476 - DNA, 25 bp, Homo sapien
caccctgtggatacagccggcctga

SEQ ID NO: 68477 - DNA, 25 bp, Homo sapien
cttctctgtgcttgggtgcaccctg

SEQ ID NO: 68478 - DNA, 25 bp, Homo sapien
caacaacgtctggacccggggatcg

SEQ ID NO: 68479 - DNA, 25 bp, Homo sapien
cactgctggcggacttgaaccgaga

SEQ ID NO: 68480 - DNA, 25 bp, Homo sapien
gctggagctcacaagccactgctgg

SEQ ID NO: 68481 - DNA, 25 bp, Homo sapien
cgctccttttggtggcccgaagaag

SEQ ID NO: 68482 - DNA, 25 bp, Homo sapien
cgtcacatcccacagcggacaccca

SEQ ID NO: 68483 - DNA, 25 bp, Homo sapien
cccgtcacatcccacggtggacacc

SEQ ID NO: 68484 - DNA, 25 bp, Homo sapien
cgtcacatcccacggtggacaccca

SEQ ID NO: 68485 - DNA, 25 bp, Homo sapien
caccatgtagatcccacagtggaca

SEQ ID NO: 68486 - DNA, 25 bp, Homo sapien
tgtagatcccacagtggacacccac

SEQ ID NO: 68487 - DNA, 25 bp, Homo sapien
cgtcacatcccacggcggacaccca

SEQ ID NO: 68488 - DNA, 25 bp, Homo sapien
ccgtcacatcccacggcggacaccc

SEQ ID NO: 68489 - DNA, 25 bp, Homo sapien
cccgtcacatcccacagcggacacc

SEQ ID NO: 68490 - DNA, 25 bp, Homo sapien
ccatgcccggccgacgtgacccgcc

SEQ ID NO: 68491 - DNA, 25 bp, Homo sapien
cgcccggaggccgtcagcctcccgg

SEQ ID NO: 68492 - DNA, 25 bp, Homo sapien
ctgtatgcccgaaagacgcggagcg

SEQ ID NO: 68493 - DNA, 25 bp, Homo sapien
cactgtatgcccgaaagacgcggag

SEQ ID NO: 68494 - DNA, 25 bp, Homo sapien
aggtcactgtatgcccgaaagacgc

SEQ ID NO: 68495 - DNA, 25 bp, Homo sapien
gagccagtcctcaagccccgacagc

SEQ ID NO: 68496 - DNA, 25 bp, Homo sapien
ccgaggtcactgtatgcccgaaaga

SEQ ID NO: 68497 - DNA, 25 bp, Homo sapien
cgaggtcactgtatgcccgaaagac

SEQ ID NO: 68498 - DNA, 25 bp, Homo sapien
ggggcggcatttaacaccgacaata

SEQ ID NO: 68499 - DNA, 25 bp, Homo sapien
tcgtcctagaactcggccaatcatc

SEQ ID NO: 68500 - DNA, 25 bp, Homo sapien
cggcaaggacggtttctagaagctc

SEQ ID NO: 68501 - DNA, 25 bp, Homo sapien
cgcggacccgaacagaggcaaaaca

SEQ ID NO: 68502 - DNA, 25 bp, Homo sapien
ctggatcaggattcggagctggcta

SEQ ID NO: 68503 - DNA, 25 bp, Homo sapien
cgtccttagctcacgggcagcggaa

SEQ ID NO: 68504 - DNA, 25 bp, Homo sapien
ctggacctataaccgagcaacgagt

SEQ ID NO: 68505 - DNA, 25 bp, Homo sapien
atctcgcgagctaaggtttcgctgc

SEQ ID NO: 68506 - DNA, 25 bp, Homo sapien
tctaatgtctgctttggctgcccgg

SEQ ID NO: 68507 - DNA, 25 bp, Homo sapien
tgcggaacgcgaaggcatcagttta

SEQ ID NO: 68508 - DNA, 25 bp, Homo sapien
gcggtctatggctgcgacttctcta

SEQ ID NO: 68509 - DNA, 25 bp, Homo sapien
ggcctgccacgaggccgcagtataa

SEQ ID NO: 68510 - DNA, 25 bp, Homo sapien
ttctggctccaatcaaaagcagggc

SEQ ID NO: 68511 - DNA, 25 bp, Homo sapien
ggcttcagcgccttacaggacctcg

SEQ ID NO: 68512 - DNA, 25 bp, Homo sapien
gtttgacttcctcagcctatcatgg

SEQ ID NO: 68513 - DNA, 25 bp, Homo sapien
ccacctcgcggcagttcggtaagag

SEQ ID NO: 68514 - DNA, 25 bp, Homo sapien
gcctgggaagccgattaggaccata

SEQ ID NO: 68515 - DNA, 25 bp, Homo sapien
taggaccataagaaatcggcgtgtc

SEQ ID NO: 68516 - DNA, 25 bp, Homo sapien
gccggcaacctcacgaacacgtagg

SEQ ID NO: 68517 - DNA, 25 bp, Homo sapien
gcgcctccgtacctgcactgtgagg

SEQ ID NO: 68518 - DNA, 25 bp, Homo sapien
tctgggtcgagtgaaccctcttttc

SEQ ID NO: 68519 - DNA, 25 bp, Homo sapien
gccctgactgaaaactgcgcaccga

SEQ ID NO: 68520 - DNA, 25 bp, Homo sapien
gaccgcagccgggattacatcaatc

SEQ ID NO: 68521 - DNA, 25 bp, Homo sapien
ggcacaaagctggacacctgggaca

SEQ ID NO: 68522 - DNA, 25 bp, Homo sapien
ctcctgaggagtgtacttcgccttg

SEQ ID NO: 68523 - DNA, 25 bp, Homo sapien
gagaaggctcccaagattccatctg

SEQ ID NO: 68524 - DNA, 25 bp, Homo sapien
ccgacagttggaagctcgcgctcaa

SEQ ID NO: 68525 - DNA, 25 bp, Homo sapien
ccaggtacggatccagagaagggtc

SEQ ID NO: 68526 - DNA, 25 bp, Homo sapien
ggcatgcaacagtagaggtcttcca

SEQ ID NO: 68527 - DNA, 25 bp, Homo sapien
ccgcgtccagttgaggcatgcaaca

SEQ ID NO: 68528 - DNA, 25 bp, Homo sapien
tggggtcctcagctactgcagattc

SEQ ID NO: 68529 - DNA, 25 bp, Homo sapien
actcggtgatctgcagcatggcctc

SEQ ID NO: 68530 - DNA, 25 bp, Homo sapien
cctggtcgcaaatgcggatgccttc

SEQ ID NO: 68531 - DNA, 25 bp, Homo sapien
tctctaaggactagttggaaaagtg

SEQ ID NO: 68532 - DNA, 25 bp, Homo sapien
ccgtcctttttctgcttggaggcca

SEQ ID NO: 68533 - DNA, 25 bp, Homo sapien
caagggctggctggacttcgagctc

SEQ ID NO: 68534 - DNA, 25 bp, Homo sapien
tcttcccttctctaaggactagttg

SEQ ID NO: 68535 - DNA, 25 bp, Homo sapien
tgcatgctccggtttgccgggagca

SEQ ID NO: 68536 - DNA, 25 bp, Homo sapien
aaatgcggatgccttcctggagccg

SEQ ID NO: 68537 - DNA, 25 bp, Homo sapien
ggacttcgagctcgactcgctcatc

SEQ ID NO: 68538 - DNA, 25 bp, Homo sapien
gtaagccacctaacagtcgcctggg

SEQ ID NO: 68539 - DNA, 25 bp, Homo sapien
ggttcatggaccaagcgcccagctt

SEQ ID NO: 68540 - DNA, 25 bp, Homo sapien
gccggctcgcaacctcacgtatttt

SEQ ID NO: 68541 - DNA, 25 bp, Homo sapien
cgccctgtgcaacaacctcagtgtg

SEQ ID NO: 68542 - DNA, 25 bp, Homo sapien
gacccagtctcaggcatcttccgaa

SEQ ID NO: 68543 - DNA, 25 bp, Homo sapien
tggtcatctaaactcccgcgcggtg

SEQ ID NO: 68544 - DNA, 25 bp, Homo sapien
ccgacgtggcttccttggtcatcta

SEQ ID NO: 68545 - DNA, 25 bp, Homo sapien
aatgctcgatgatagccgccctcgg

SEQ ID NO: 68546 - DNA, 25 bp, Homo sapien
tctgccaggcgtgtcagcacgtatt

SEQ ID NO: 68547 - DNA, 25 bp, Homo sapien
tttcttggacacaaagcgggccctc

SEQ ID NO: 68548 - DNA, 25 bp, Homo sapien
gttgcagttgcctttcttggacaca

SEQ ID NO: 68549 - DNA, 25 bp, Homo sapien
tcccggatgttcttgtgggccacgt

SEQ ID NO: 68550 - DNA, 25 bp, Homo sapien
tattcctcggggatgatgcccttgc

SEQ ID NO: 68551 - DNA, 25 bp, Homo sapien
atgcccttgcgggacagcatggctc

SEQ ID NO: 68552 - DNA, 25 bp, Homo sapien
gtggtgaacacgtcctgcaggaagc

SEQ ID NO: 68553 - DNA, 25 bp, Homo sapien
tgtcagcacgtattcctcggggatg

SEQ ID NO: 68554 - DNA, 25 bp, Homo sapien
gtaccagggcgctggaggtccctcc

SEQ ID NO: 68555 - DNA, 25 bp, Homo sapien
cgcgcgaggtccagagagctgcact

SEQ ID NO: 68556 - DNA, 25 bp, Homo sapien
aaggctcctggccttcacgacgtgc

SEQ ID NO: 68557 - DNA, 25 bp, Homo sapien
cgccggtgacatcagctcccaattg

SEQ ID NO: 68558 - DNA, 25 bp, Homo sapien
tcaaggcggtgcctccaccgagact

SEQ ID NO: 68559 - DNA, 25 bp, Homo sapien
agcccgctccattgcgagaggcgcg

SEQ ID NO: 68560 - DNA, 25 bp, Homo sapien
ccgcgagagcaactgaggggtacca

SEQ ID NO: 68561 - DNA, 25 bp, Homo sapien
tcagctcccaattgccgcgagagca

SEQ ID NO: 68562 - DNA, 25 bp, Homo sapien
agagtcttcggggtagctattcgcc

SEQ ID NO: 68563 - DNA, 25 bp, Homo sapien
tggggatccaacaggttaacgcgtg

SEQ ID NO: 68564 - DNA, 25 bp, Homo sapien
agctggggccctacaaattgagacc

SEQ ID NO: 68565 - DNA, 25 bp, Homo sapien
cagataatcctaaccaggccgcgga

SEQ ID NO: 68566 - DNA, 25 bp, Homo sapien
ggatccgatgaaaatgcagaccgtc

SEQ ID NO: 68567 - DNA, 25 bp, Homo sapien
aagcggccgcgtttgaactccatct

SEQ ID NO: 68568 - DNA, 25 bp, Homo sapien
cattttggggttcaggcacatttta

SEQ ID NO: 68569 - DNA, 25 bp, Homo sapien
caacccgggctttttccaggctcag

SEQ ID NO: 68570 - DNA, 25 bp, Homo sapien
tcagggacgattttggacgcgaagc

SEQ ID NO: 68571 - DNA, 25 bp, Homo sapien
gtaactggttgttttgctggctcca

SEQ ID NO: 68572 - DNA, 25 bp, Homo sapien
ggttgccatgaaccggaagtaactg

SEQ ID NO: 68573 - DNA, 25 bp, Homo sapien
cccgcacaaggatggttgccatgaa

SEQ ID NO: 68574 - DNA, 25 bp, Homo sapien
agccaggggaaagccctgcccattt

SEQ ID NO: 68575 - DNA, 25 bp, Homo sapien
catttgggctgtcccgacctcagag

SEQ ID NO: 68576 - DNA, 25 bp, Homo sapien
aaggatcctcgtttctcagggacga

SEQ ID NO: 68577 - DNA, 25 bp, Homo sapien
ttgctggctccagtttttccgcggg

SEQ ID NO: 68578 - DNA, 25 bp, Homo sapien
gcacgctgagcatgcccaaggacga

SEQ ID NO: 68579 - DNA, 25 bp, Homo sapien
atggccgcatacctggcgcaagccg

SEQ ID NO: 68580 - DNA, 25 bp, Homo sapien
ctggcccgtgtcttcatcggcatca

SEQ ID NO: 68581 - DNA, 25 bp, Homo sapien
ccttcaacaagtggcgcagcggtga

SEQ ID NO: 68582 - DNA, 25 bp, Homo sapien
gggcgccttcgtgtactctgaccac

SEQ ID NO: 68583 - DNA, 25 bp, Homo sapien
ctgccaatggcctgatggccgcata

SEQ ID NO: 68584 - DNA, 25 bp, Homo sapien
cgcgagacggagagcaagatctacc

SEQ ID NO: 68585 - DNA, 25 bp, Homo sapien
atcggcatcaacgacctggagaagg

SEQ ID NO: 68586 - DNA, 25 bp, Homo sapien
cggtgcttcggcttgtacagaactg

SEQ ID NO: 68587 - DNA, 25 bp, Homo sapien
atctgttcctattggcccgtccgtc

SEQ ID NO: 68588 - DNA, 25 bp, Homo sapien
tggtcacagggagaaacctctgatc

SEQ ID NO: 68589 - DNA, 25 bp, Homo sapien
cctttggcgtcattccgaaaacata

SEQ ID NO: 68590 - DNA, 25 bp, Homo sapien
ccagtctccggtatacacgtatttt

SEQ ID NO: 68591 - DNA, 25 bp, Homo sapien
gtgctaccgcatcaacctgcagatg

SEQ ID NO: 68592 - DNA, 25 bp, Homo sapien
caggccaggcactctgtagtcttca

SEQ ID NO: 68593 - DNA, 25 bp, Homo sapien
gacttttgggactccgcctcttcca

SEQ ID NO: 68594 - DNA, 25 bp, Homo sapien
ggtccaccgggattgcgtttatctg

SEQ ID NO: 68595 - DNA, 25 bp, Homo sapien
cgccacgttaggttaagtcccagag

SEQ ID NO: 68596 - DNA, 25 bp, Homo sapien
cccagattaggagtccgcctgcctg

SEQ ID NO: 68597 - DNA, 25 bp, Homo sapien
actgaggtccgcgtcacaagagctc

SEQ ID NO: 68598 - DNA, 25 bp, Homo sapien
taagtcccagagtccggaaccgctg

SEQ ID NO: 68599 - DNA, 25 bp, Homo sapien
gaaccgctgcctgcggcttgacaca

SEQ ID NO: 68600 - DNA, 25 bp, Homo sapien
acacagggttggtacgtagcgtctg

SEQ ID NO: 68601 - DNA, 25 bp, Homo sapien
ctgcgggtcttcatgccgaagtaga

SEQ ID NO: 68602 - DNA, 25 bp, Homo sapien
tttccagagcggtgagatgagcgcc

SEQ ID NO: 68603 - DNA, 25 bp, Homo sapien
cgaccagtatcagcgcccggcttgt

SEQ ID NO: 68604 - DNA, 25 bp, Homo sapien
cgcgcataatcaggcgatgcccgtc

SEQ ID NO: 68605 - DNA, 25 bp, Homo sapien
acgtccgcaatcactgagcagttga

SEQ ID NO: 68606 - DNA, 25 bp, Homo sapien
gttgagattagtggagcggaccttc

SEQ ID NO: 68607 - DNA, 25 bp, Homo sapien
tccacgtttttctcgaagggacaga

SEQ ID NO: 68608 - DNA, 25 bp, Homo sapien
gaactgaacccgaacctgtttgaca

SEQ ID NO: 68609 - DNA, 25 bp, Homo sapien
cgcttctgcgggatagacttccggc

SEQ ID NO: 68610 - DNA, 25 bp, Homo sapien
gggaccttcatggactctctcgtgc

SEQ ID NO: 68611 - DNA, 25 bp, Homo sapien
acgataacgagtggaggcaggctac

SEQ ID NO: 68612 - DNA, 25 bp, Homo sapien
agagcgcgaagctgcatctcgatga

SEQ ID NO: 68613 - DNA, 25 bp, Homo sapien
gcatctcgatgacagcctccaggca

SEQ ID NO: 68614 - DNA, 25 bp, Homo sapien
tcagggtcttcatgagtcgcacagc

SEQ ID NO: 68615 - DNA, 25 bp, Homo sapien
gtcgcacagccgactgtaggtggta

SEQ ID NO: 68616 - DNA, 25 bp, Homo sapien
aggccgcagcatcagcctcgtagtc

SEQ ID NO: 68617 - DNA, 25 bp, Homo sapien
ggacgtggctcaaggcttttctctg

SEQ ID NO: 68618 - DNA, 25 bp, Homo sapien
gcctttgcaggctcactcgtttacc

SEQ ID NO: 68619 - DNA, 25 bp, Homo sapien
cggagaccagaactgtgatccctta

SEQ ID NO: 68620 - DNA, 25 bp, Homo sapien
ttcagaggtgcagggtcaaaccttc

SEQ ID NO: 68621 - DNA, 25 bp, Homo sapien
ttggtcacccggaaagactcgactc

SEQ ID NO: 68622 - DNA, 25 bp, Homo sapien
cctcaggctgagcaggctataagtt

SEQ ID NO: 68623 - DNA, 25 bp, Homo sapien
gacggtctgcccttttcccttggca

SEQ ID NO: 68624 - DNA, 25 bp, Homo sapien
accttgccggctctataccttcaga

SEQ ID NO: 68625 - DNA, 25 bp, Homo sapien
cgcgcgtcaagtccgcggaaagttt

SEQ ID NO: 68626 - DNA, 25 bp, Homo sapien
cgcctttggatgtgagtcctggaaa

SEQ ID NO: 68627 - DNA, 25 bp, Homo sapien
cgccctggacgctgttttgcaaaga

SEQ ID NO: 68628 - DNA, 25 bp, Homo sapien
aaatcctggtgctgtcgcctttgga

SEQ ID NO: 68629 - DNA, 25 bp, Homo sapien
gccagcttcagccaccttgggagac

SEQ ID NO: 68630 - DNA, 25 bp, Homo sapien
tccggcctcggcacattaatcttca

SEQ ID NO: 68631 - DNA, 25 bp, Homo sapien
tcagacccggctttttcgacgccga

SEQ ID NO: 68632 - DNA, 25 bp, Homo sapien
ggccttccagggagtcccagtcaga

SEQ ID NO: 68633 - DNA, 25 bp, Homo sapien
tcctctgtgccaaaggcgggagcaa

SEQ ID NO: 68634 - DNA, 25 bp, Homo sapien
gtgcacatacaccagctgctccagg

SEQ ID NO: 68635 - DNA, 25 bp, Homo sapien
tcacatcgcagtcggccaacctggg

SEQ ID NO: 68636 - DNA, 25 bp, Homo sapien
cagtcggccaacctgggtgaagcag

SEQ ID NO: 68637 - DNA, 25 bp, Homo sapien
tggcaccgcactgaccggcagagca

SEQ ID NO: 68638 - DNA, 25 bp, Homo sapien
tcacgcaggctgtggttggccaaca

SEQ ID NO: 68639 - DNA, 25 bp, Homo sapien
cccaggcagttgttgctgaggtcca

SEQ ID NO: 68640 - DNA, 25 bp, Homo sapien
tgcagctgctgtcactcacatcgca

SEQ ID NO: 68641 - DNA, 25 bp, Homo sapien
gttgttgctgaggtccagctcacgc

SEQ ID NO: 68642 - DNA, 25 bp, Homo sapien
cttgtacactgactggagctggttc

SEQ ID NO: 68643 - DNA, 25 bp, Homo sapien
cttgtctcccagcaacgaggttcta

SEQ ID NO: 68644 - DNA, 25 bp, Homo sapien
ttccgtagcgggtccatcttgtaca

SEQ ID NO: 68645 - DNA, 25 bp, Homo sapien
ctgtgacgacgaccctgctgaagaa

SEQ ID NO: 68646 - DNA, 25 bp, Homo sapien
cggagtttggcaacccgatcgcaac

SEQ ID NO: 68647 - DNA, 25 bp, Homo sapien
ttcccaggggagactacacaacgtc

SEQ ID NO: 68648 - DNA, 25 bp, Homo sapien
gggtcgcctccttcatcacactaga

SEQ ID NO: 68649 - DNA, 25 bp, Homo sapien
tcggattcgctcaccctctgtaagg

SEQ ID NO: 68650 - DNA, 25 bp, Homo sapien
gcagcccagcgtctatttgcgctta

SEQ ID NO: 68651 - DNA, 25 bp, Homo sapien
gtctccctcgcatcccaggggaagg

SEQ ID NO: 68652 - DNA, 25 bp, Homo sapien
tctgtagtcccactgtccacgcgtg

SEQ ID NO: 68653 - DNA, 25 bp, Homo sapien
ttagctttctgctccaactcaagga

SEQ ID NO: 68654 - DNA, 25 bp, Homo sapien
gctcacgggtgaggttgtctgaccc

SEQ ID NO: 68655 - DNA, 25 bp, Homo sapien
ctttgccaaggaccggctcacgggt

SEQ ID NO: 68656 - DNA, 25 bp, Homo sapien
ttctcgggtggataccacggagcct

SEQ ID NO: 68657 - DNA, 25 bp, Homo sapien
cgcttaagagccagcaaggaagctc

SEQ ID NO: 68658 - DNA, 25 bp, Homo sapien
ccgggtctcttaccggtgcgagtca

SEQ ID NO: 68659 - DNA, 25 bp, Homo sapien
cacgagcagtaggaagcagtcaccc

SEQ ID NO: 68660 - DNA, 25 bp, Homo sapien
ggccctgagggaagctccataactg

SEQ ID NO: 68661 - DNA, 25 bp, Homo sapien
cataactgctgcttcaggagcgccc

SEQ ID NO: 68662 - DNA, 25 bp, Homo sapien
gcggagaccacaattcccggcattc

SEQ ID NO: 68663 - DNA, 25 bp, Homo sapien
tcccggcgtgcacttctgaaggact

SEQ ID NO: 68664 - DNA, 25 bp, Homo sapien
ccctgctgacgtcaggaacttctga

SEQ ID NO: 68665 - DNA, 25 bp, Homo sapien
ccgggcacaactgactgcggtgacc

SEQ ID NO: 68666 - DNA, 25 bp, Homo sapien
gctcagatgtctcccaaggctattc

SEQ ID NO: 68667 - DNA, 25 bp, Homo sapien
tggtgtgcctgctgtaaacccagtg

SEQ ID NO: 68668 - DNA, 25 bp, Homo sapien
ccagctttgcaacggcctccatatt

SEQ ID NO: 68669 - DNA, 25 bp, Homo sapien
tcacctgtagaaggccgcgttgacc

SEQ ID NO: 68670 - DNA, 25 bp, Homo sapien
tgaccctcttttcgctggggaagcc

SEQ ID NO: 68671 - DNA, 25 bp, Homo sapien
tcctccacttgcaggtgatgctcta

SEQ ID NO: 68672 - DNA, 25 bp, Homo sapien
gccgcgtccttactgaactcggaaa

SEQ ID NO: 68673 - DNA, 25 bp, Homo sapien
gggcacctttcgtggtcccacaaga

SEQ ID NO: 68674 - DNA, 25 bp, Homo sapien
ccatctagtgggaaaagaggacgag

SEQ ID NO: 68675 - DNA, 25 bp, Homo sapien
gcgtgtatttctcagagccctctga

SEQ ID NO: 68676 - DNA, 25 bp, Homo sapien
cagagccctctgaagcgtgggctga

SEQ ID NO: 68677 - DNA, 25 bp, Homo sapien
gctgagatggatgagcgcagacaca

SEQ ID NO: 68678 - DNA, 25 bp, Homo sapien
gatggatgagcgcagacacacagcc

SEQ ID NO: 68679 - DNA, 25 bp, Homo sapien
cgtggctccatactgccatctagtg

SEQ ID NO: 68680 - DNA, 25 bp, Homo sapien
ctggcacgcgtgtatttctcagagc

SEQ ID NO: 68681 - DNA, 25 bp, Homo sapien
ggagagctggcacgcgtgtatttct

SEQ ID NO: 68682 - DNA, 25 bp, Homo sapien
gaagttgctttgcacactcccggga

SEQ ID NO: 68683 - DNA, 25 bp, Homo sapien
tgccgaaacgcctttccggtgagga

SEQ ID NO: 68684 - DNA, 25 bp, Homo sapien
actgcaaagtgatccgtctggctga

SEQ ID NO: 68685 - DNA, 25 bp, Homo sapien
agtggcatcgtccttgggaaacttc

SEQ ID NO: 68686 - DNA, 25 bp, Homo sapien
agcctgtgactttcccgtgaagttg

SEQ ID NO: 68687 - DNA, 25 bp, Homo sapien
tctggcgcatggatgccgaacctta

SEQ ID NO: 68688 - DNA, 25 bp, Homo sapien
tttgcagagtcagcgctttgggacc

SEQ ID NO: 68689 - DNA, 25 bp, Homo sapien
cgcggctcgagttctttgaccataa

SEQ ID NO: 68690 - DNA, 25 bp, Homo sapien
cttcaggtggcgcttcaggaaaacg

SEQ ID NO: 68691 - DNA, 25 bp, Homo sapien
acctgcctgaggactggcccgagct

SEQ ID NO: 68692 - DNA, 25 bp, Homo sapien
cccagcctgcgaagtggtgccggct

SEQ ID NO: 68693 - DNA, 25 bp, Homo sapien
cgacagcgatttcggagcctctctc

SEQ ID NO: 68694 - DNA, 25 bp, Homo sapien
ggagggatgactccgacagcgattt

SEQ ID NO: 68695 - DNA, 25 bp, Homo sapien
cggagcctctctcggcgtcagtctt

SEQ ID NO: 68696 - DNA, 25 bp, Homo sapien
ccagaacagtatgcggagggatgac

SEQ ID NO: 68697 - DNA, 25 bp, Homo sapien
gcgtggagaaccgtacctgtcttcg

SEQ ID NO: 68698 - DNA, 25 bp, Homo sapien
tctcagcctggtgtatggcgtttca

SEQ ID NO: 68699 - DNA, 25 bp, Homo sapien
cgaggtcgttcatttcgaagttccg

SEQ ID NO: 68700 - DNA, 25 bp, Homo sapien
accggggcgagatcttcgcacttca

SEQ ID NO: 68701 - DNA, 25 bp, Homo sapien
cttccaatctctggtaaggcgcgga

SEQ ID NO: 68702 - DNA, 25 bp, Homo sapien
tcagcctcaggctgagccggaccga

SEQ ID NO: 68703 - DNA, 25 bp, Homo sapien
gggcggtgtttcatccctcagcctc

SEQ ID NO: 68704 - DNA, 25 bp, Homo sapien
gagcgtccagtcctcaccgtgcaga

SEQ ID NO: 68705 - DNA, 25 bp, Homo sapien
ccaggcggagccaaagatgccggcc

SEQ ID NO: 68706 - DNA, 25 bp, Homo sapien
ctccgacttcggatggaacacatca

SEQ ID NO: 68707 - DNA, 25 bp, Homo sapien
acctaagtaagcgtcgtgggccctg

SEQ ID NO: 68708 - DNA, 25 bp, Homo sapien
ggccggctctgcacatttcgtaagg

SEQ ID NO: 68709 - DNA, 25 bp, Homo sapien
tcgtaaggccttacatggctgcacc

SEQ ID NO: 68710 - DNA, 25 bp, Homo sapien
catccatttaaaccctcgagccgag

SEQ ID NO: 68711 - DNA, 25 bp, Homo sapien
cggagttagacacaaaagtaagatc

SEQ ID NO: 68712 - DNA, 25 bp, Homo sapien
gtaagatcacatgaactccgacttc

SEQ ID NO: 68713 - DNA, 25 bp, Homo sapien
tcgagccgagctcaactggaaactc

SEQ ID NO: 68714 - DNA, 25 bp, Homo sapien
accctggccagcttgataggctgca

SEQ ID NO: 68715 - DNA, 25 bp, Homo sapien
acggggccttttacattgcggatga

SEQ ID NO: 68716 - DNA, 25 bp, Homo sapien
ttgataggctgcacacggctggtgt

SEQ ID NO: 68717 - DNA, 25 bp, Homo sapien
ggccttttacattgcggatgatgga

SEQ ID NO: 68718 - DNA, 25 bp, Homo sapien
cctggccagcttgataggctgcaca

SEQ ID NO: 68719 - DNA, 25 bp, Homo sapien
ggccagcttgataggctgcacacgg

SEQ ID NO: 68720 - DNA, 25 bp, Homo sapien
agcttgataggctgcacacggctgg

SEQ ID NO: 68721 - DNA, 25 bp, Homo sapien
ggggccttttacattgcggatgatg

SEQ ID NO: 68722 - DNA, 25 bp, Homo sapien
ccaatcccagggctggcggaaatta

SEQ ID NO: 68723 - DNA, 25 bp, Homo sapien
ggatcctgcgttctctggagtcacc

SEQ ID NO: 68724 - DNA, 25 bp, Homo sapien
tggagtttttctgatccgcggaacc

SEQ ID NO: 68725 - DNA, 25 bp, Homo sapien
tctgatccgcggaacccagaggttc

SEQ ID NO: 68726 - DNA, 25 bp, Homo sapien
tcctgcccacgctctacgaaagtgg

SEQ ID NO: 68727 - DNA, 25 bp, Homo sapien
cccatccgtatttgggtcagtaatc

SEQ ID NO: 68728 - DNA, 25 bp, Homo sapien
ctgtctccttgggatcctgcgttct

SEQ ID NO: 68729 - DNA, 25 bp, Homo sapien
tttgggtcagtaatccgcctctcgg

SEQ ID NO: 68730 - DNA, 25 bp, Homo sapien
ggctctggcaaagtggtctggcctc

SEQ ID NO: 68731 - DNA, 25 bp, Homo sapien
tagtcagggattgctgcgcccacgt

SEQ ID NO: 68732 - DNA, 25 bp, Homo sapien
cccgcaggtagtcagggattgctgc

SEQ ID NO: 68733 - DNA, 25 bp, Homo sapien
tccgctaagcacagccggcgagtgc

SEQ ID NO: 68734 - DNA, 25 bp, Homo sapien
caggagccacgtccgctaagcacag

SEQ ID NO: 68735 - DNA, 25 bp, Homo sapien
aagtggtctggcctccatcagtctc

SEQ ID NO: 68736 - DNA, 25 bp, Homo sapien
ccaagtgcagaaggtaagtcagcgc

SEQ ID NO: 68737 - DNA, 25 bp, Homo sapien
agtctcttcctcgaccctgcgggga

SEQ ID NO: 68738 - DNA, 25 bp, Homo sapien
gcggtgacctcaggactgacgcact

SEQ ID NO: 68739 - DNA, 25 bp, Homo sapien
aatgcagatctcgagggagcctcca

SEQ ID NO: 68740 - DNA, 25 bp, Homo sapien
tgacctcaggactgacgcactgcct

SEQ ID NO: 68741 - DNA, 25 bp, Homo sapien
cagcctgcgtcaggggcgctgttct

SEQ ID NO: 68742 - DNA, 25 bp, Homo sapien
ggacccgtcgcctcctaaatgcaga

SEQ ID NO: 68743 - DNA, 25 bp, Homo sapien
cccgcagttgttttaggaacattca

SEQ ID NO: 68744 - DNA, 25 bp, Homo sapien
taggaacattcactggagagcgaga

SEQ ID NO: 68745 - DNA, 25 bp, Homo sapien
gtcgcctcctaaatgcagatctcga

SEQ ID NO: 68746 - DNA, 25 bp, Homo sapien
ggaagccatcttcattctggcacga

SEQ ID NO: 68747 - DNA, 25 bp, Homo sapien
tcgccggtagcgtcaaccaagtgca

SEQ ID NO: 68748 - DNA, 25 bp, Homo sapien
tgacgctagcgggacaggaagccat

SEQ ID NO: 68749 - DNA, 25 bp, Homo sapien
aggcagatcccgacgtgacgctagc

SEQ ID NO: 68750 - DNA, 25 bp, Homo sapien
ggccttggtgaaggcagatcccgac

SEQ ID NO: 68751 - DNA, 25 bp, Homo sapien
gctcgtctctcgaggttgcctctgg

SEQ ID NO: 68752 - DNA, 25 bp, Homo sapien
ttcctggcagcgcactgccgcgtag

SEQ ID NO: 68753 - DNA, 25 bp, Homo sapien
ccaagtgcacgacagcccacgggtg

SEQ ID NO: 68754 - DNA, 25 bp, Homo sapien
cgtcttctgactttgaggcctcgta

SEQ ID NO: 68755 - DNA, 25 bp, Homo sapien
agcctctgctcaatcactggggaca

SEQ ID NO: 68756 - DNA, 25 bp, Homo sapien
gtccgcagctggaatcgtcgttgca

SEQ ID NO: 68757 - DNA, 25 bp, Homo sapien
tcaaacggtagaactggtgccagac

SEQ ID NO: 68758 - DNA, 25 bp, Homo sapien
gttacctggctagctgattcacctg

SEQ ID NO: 68759 - DNA, 25 bp, Homo sapien
ggagccacactcataggcagcttgt

SEQ ID NO: 68760 - DNA, 25 bp, Homo sapien
gaggcctcgtatcccagtccaagac

SEQ ID NO: 68761 - DNA, 25 bp, Homo sapien
gcgctccagctaccgagaagccaga

SEQ ID NO: 68762 - DNA, 25 bp, Homo sapien
cgcgctccgtactgcgtgccaacac

SEQ ID NO: 68763 - DNA, 25 bp, Homo sapien
ctccgtactgcgtgccaacacctcc

SEQ ID NO: 68764 - DNA, 25 bp, Homo sapien
acgcagacctcccagatagagcagc

SEQ ID NO: 68765 - DNA, 25 bp, Homo sapien
gcagacctcccagatagagcagcgt

SEQ ID NO: 68766 - DNA, 25 bp, Homo sapien
atagagcagcgtggactgtctgcgc

SEQ ID NO: 68767 - DNA, 25 bp, Homo sapien
ccagatagagcagcgtggactgtct

SEQ ID NO: 68768 - DNA, 25 bp, Homo sapien
cccagatagagcagcgtggactgtc

SEQ ID NO: 68769 - DNA, 25 bp, Homo sapien
cagacctcccagatagagcagcgtg

SEQ ID NO: 68770 - DNA, 25 bp, Homo sapien
ccaggtaaatagtccacggtgcagc

SEQ ID NO: 68771 - DNA, 25 bp, Homo sapien
tccaaaagcaaagcgtcccactggg

SEQ ID NO: 68772 - DNA, 25 bp, Homo sapien
ttcactccctgatgcactcggcttt

SEQ ID NO: 68773 - DNA, 25 bp, Homo sapien
tgatgcactcggctttcggggtcct

SEQ ID NO: 68774 - DNA, 25 bp, Homo sapien
ggctgcctccgaaacaaaccaggta

SEQ ID NO: 68775 - DNA, 25 bp, Homo sapien
agcacgtacatttctggcaggtccg

SEQ ID NO: 68776 - DNA, 25 bp, Homo sapien
ggcgagttggctgcctccgaaacaa

SEQ ID NO: 68777 - DNA, 25 bp, Homo sapien
aatagtccacggtgcagcacgtaca

SEQ ID NO: 68778 - DNA, 25 bp, Homo sapien
acagatgtcgcgtggctctcaatcg

SEQ ID NO: 68779 - DNA, 25 bp, Homo sapien
ttcatccggatgctcctcccttagg

SEQ ID NO: 68780 - DNA, 25 bp, Homo sapien
tcccttaggcctgaaactgctctcg

SEQ ID NO: 68781 - DNA, 25 bp, Homo sapien
ggcctgaaactgctctcgcgctctg

SEQ ID NO: 68782 - DNA, 25 bp, Homo sapien
cgcgtggctctcaatcgtccttatt

SEQ ID NO: 68783 - DNA, 25 bp, Homo sapien
aatcgtccttattcgcgggcagcta

SEQ ID NO: 68784 - DNA, 25 bp, Homo sapien
cttattcgcgggcagctattcatcc

SEQ ID NO: 68785 - DNA, 25 bp, Homo sapien
cgggcagctattcatccggatgctc

SEQ ID NO: 68786 - DNA, 25 bp, Homo sapien
tcagtgggaggaaaaggttgtctca

SEQ ID NO: 68787 - DNA, 25 bp, Homo sapien
gcaccagtacctcggaaaggaatcc

SEQ ID NO: 68788 - DNA, 25 bp, Homo sapien
ggttgtctcatttccttcgatctcc

SEQ ID NO: 68789 - DNA, 25 bp, Homo sapien
cgcgaaacctgaacggctgcggcgt

SEQ ID NO: 68790 - DNA, 25 bp, Homo sapien
gcgccaagttagttcacgctcccaa

SEQ ID NO: 68791 - DNA, 25 bp, Homo sapien
agttagttcacgctcccaactcctg

SEQ ID NO: 68792 - DNA, 25 bp, Homo sapien
tgggccggcaccagtacctcggaaa

SEQ ID NO: 68793 - DNA, 25 bp, Homo sapien
ggcgcccgcaagacgcgaaacctga

SEQ ID NO: 68794 - DNA, 25 bp, Homo sapien
gagagttctgacctccgtcgtccgc

SEQ ID NO: 68795 - DNA, 25 bp, Homo sapien
cggaacgcaggtgaggcactgccct

SEQ ID NO: 68796 - DNA, 25 bp, Homo sapien
cgaacctggagatcagaggcaaccc

SEQ ID NO: 68797 - DNA, 25 bp, Homo sapien
ccgccgaaaccggtcatcgtggaca

SEQ ID NO: 68798 - DNA, 25 bp, Homo sapien
tcagggttggcacgagagttctgac

SEQ ID NO: 68799 - DNA, 25 bp, Homo sapien
cggagtttccaagccgccaggactc

SEQ ID NO: 68800 - DNA, 25 bp, Homo sapien
ctgcagtaagtggagccggacttgc

SEQ ID NO: 68801 - DNA, 25 bp, Homo sapien
gccggcctctatcgcctgcagtaag

SEQ ID NO: 68802 - DNA, 25 bp, Homo sapien
tgtcgctggaatcagccgcgcgctg

SEQ ID NO: 68803 - DNA, 25 bp, Homo sapien
acctgagccttcgtccgcgcgggga

SEQ ID NO: 68804 - DNA, 25 bp, Homo sapien
agggcggctcttcctccgcagaacc

SEQ ID NO: 68805 - DNA, 25 bp, Homo sapien
cgcgcgctgccgaaaagtccttttc

SEQ ID NO: 68806 - DNA, 25 bp, Homo sapien
gaaaagtccttttcggcctgtgagc

SEQ ID NO: 68807 - DNA, 25 bp, Homo sapien
tccttttcggcctgtgagccatggc

SEQ ID NO: 68808 - DNA, 25 bp, Homo sapien
ctagaacccgctgaaccgcaagccg

SEQ ID NO: 68809 - DNA, 25 bp, Homo sapien
tgccttctgctcaccgctactctgt

SEQ ID NO: 68810 - DNA, 25 bp, Homo sapien
tcccgtgcccatgctgctaggggag

SEQ ID NO: 68811 - DNA, 25 bp, Homo sapien
gccagctgtcactcaagacacctga

SEQ ID NO: 68812 - DNA, 25 bp, Homo sapien
agagcagccttgctttaccgcttta

SEQ ID NO: 68813 - DNA, 25 bp, Homo sapien
tccctggacaggtccggttgctggt

SEQ ID NO: 68814 - DNA, 25 bp, Homo sapien
gcagcagtcctaggcctcctcgtgt

SEQ ID NO: 68815 - DNA, 25 bp, Homo sapien
tctccttgtgatgtcgcagcagtcc

SEQ ID NO: 68816 - DNA, 25 bp, Homo sapien
gacaccggctccaaatctccttgtg

SEQ ID NO: 68817 - DNA, 25 bp, Homo sapien
agatcagggccgctctctgtccttc

SEQ ID NO: 68818 - DNA, 25 bp, Homo sapien
ctgggactgtcagagatcacggacc

SEQ ID NO: 68819 - DNA, 25 bp, Homo sapien
cagcccggtgaaagcataggggtta

SEQ ID NO: 68820 - DNA, 25 bp, Homo sapien
gtttcccactgcgtgctgagacctc

SEQ ID NO: 68821 - DNA, 25 bp, Homo sapien
cttggccctgcagaagcaaaacttg

SEQ ID NO: 68822 - DNA, 25 bp, Homo sapien
tgatcccatgggtcacaaacgtccg

SEQ ID NO: 68823 - DNA, 25 bp, Homo sapien
tgagaagttgcgctctggagacaca

SEQ ID NO: 68824 - DNA, 25 bp, Homo sapien
tgcgcgcactcaccaatgaagagga

SEQ ID NO: 68825 - DNA, 25 bp, Homo sapien
gcgcgtccacaaagcagccgttgtt

SEQ ID NO: 68826 - DNA, 25 bp, Homo sapien
gggcctcgcgactccggcgattcag

SEQ ID NO: 68827 - DNA, 25 bp, Homo sapien
cccgcagggtaacgcggttgtcatg

SEQ ID NO: 68828 - DNA, 25 bp, Homo sapien
agggtaacgcggttgtcatggacac

SEQ ID NO: 68829 - DNA, 25 bp, Homo sapien
gtaacgcggttgtcatggacacggc

SEQ ID NO: 68830 - DNA, 25 bp, Homo sapien
tcgatgcccggtgcctttccaggcg

SEQ ID NO: 68831 - DNA, 25 bp, Homo sapien
ctgccgctcgcgcttgggcaggacg

SEQ ID NO: 68832 - DNA, 25 bp, Homo sapien
cagccccgagtgaggcggagaccca

SEQ ID NO: 68833 - DNA, 25 bp, Homo sapien
gcggcaccgcacctcggccagaggc

SEQ ID NO: 68834 - DNA, 25 bp, Homo sapien
ctcgttgcccgacaagtccattttc

SEQ ID NO: 68835 - DNA, 25 bp, Homo sapien
accaagtcgttgtgctcgaggtgca

SEQ ID NO: 68836 - DNA, 25 bp, Homo sapien
gggcgaagttcaccttgaccaagtc

SEQ ID NO: 68837 - DNA, 25 bp, Homo sapien
agcgcctgcagcttgttgtacgaga

SEQ ID NO: 68838 - DNA, 25 bp, Homo sapien
ccgatgtcgagaaacttgaggctgc

SEQ ID NO: 68839 - DNA, 25 bp, Homo sapien
gggctccatgtactcgatctcgttg

SEQ ID NO: 68840 - DNA, 25 bp, Homo sapien
gcgccagactcttgagctgattgta

SEQ ID NO: 68841 - DNA, 25 bp, Homo sapien
cggtctcgaacacatggggctccat

SEQ ID NO: 68842 - DNA, 25 bp, Homo sapien
gtccgtcattggaaacgaccactga

SEQ ID NO: 68843 - DNA, 25 bp, Homo sapien
tctcactttgctgctcggctcgggg

SEQ ID NO: 68844 - DNA, 25 bp, Homo sapien
gcgacttctaggacccgcaagtttc

SEQ ID NO: 68845 - DNA, 25 bp, Homo sapien
gcaagtttcccaactacgtgccgga

SEQ ID NO: 68846 - DNA, 25 bp, Homo sapien
tctgacagtctggttaatgtccgtc

SEQ ID NO: 68847 - DNA, 25 bp, Homo sapien
tactccgcggaaacagcctgccatt

SEQ ID NO: 68848 - DNA, 25 bp, Homo sapien
tttccctctgcagttcggactgtga

SEQ ID NO: 68849 - DNA, 25 bp, Homo sapien
tggcaggcgcacaatgtctcacttt

SEQ ID NO: 68850 - DNA, 25 bp, Homo sapien
gttcccttgcttgggcggctacgct

SEQ ID NO: 68851 - DNA, 25 bp, Homo sapien
cccagccgccgcgtgtgttgtcagg

SEQ ID NO: 68852 - DNA, 25 bp, Homo sapien
cgtgtgttgtcaggacgatcggaaa

SEQ ID NO: 68853 - DNA, 25 bp, Homo sapien
aattgttcccttgcttgggcggcta

SEQ ID NO: 68854 - DNA, 25 bp, Homo sapien
cgagaggcaattgttcccttgcttg

SEQ ID NO: 68855 - DNA, 25 bp, Homo sapien
tgttgtcaggacgatcggaaacgcg

SEQ ID NO: 68856 - DNA, 25 bp, Homo sapien
agacttaatcccgagaggcaattgt

SEQ ID NO: 68857 - DNA, 25 bp, Homo sapien
atcccgagaggcaattgttcccttg

SEQ ID NO: 68858 - DNA, 25 bp, Homo sapien
ctgcagacgtagcttttcccggacc

SEQ ID NO: 68859 - DNA, 25 bp, Homo sapien
cgcaccgcggcaacaacataaagtc

SEQ ID NO: 68860 - DNA, 25 bp, Homo sapien
tcatgcggttgtacttgtggtccaa

SEQ ID NO: 68861 - DNA, 25 bp, Homo sapien
gctctctaggggcatgttttaaacc

SEQ ID NO: 68862 - DNA, 25 bp, Homo sapien
tgcccagcagtgaacctgcagaatc

SEQ ID NO: 68863 - DNA, 25 bp, Homo sapien
tggcgtgatgcagcacagaatcttg

SEQ ID NO: 68864 - DNA, 25 bp, Homo sapien
ttctactgctcgatgctgtgctgca

SEQ ID NO: 68865 - DNA, 25 bp, Homo sapien
ggtgtgccctacttgctctcgttca

SEQ ID NO: 68866 - DNA, 25 bp, Homo sapien
tcacgtgacactcaagtggccgcca

SEQ ID NO: 68867 - DNA, 25 bp, Homo sapien
ctgccacagctaggtctcggggcgt

SEQ ID NO: 68868 - DNA, 25 bp, Homo sapien
tggccgccattattatggcccgaca

SEQ ID NO: 68869 - DNA, 25 bp, Homo sapien
caaagtcgctgagtcctcgcggctc

SEQ ID NO: 68870 - DNA, 25 bp, Homo sapien
gggctttgtctaggcccgacaggat

SEQ ID NO: 68871 - DNA, 25 bp, Homo sapien
cccgacaggattggaccgagagacc

SEQ ID NO: 68872 - DNA, 25 bp, Homo sapien
tgccatcaggtctccaggcggaata

SEQ ID NO: 68873 - DNA, 25 bp, Homo sapien
cggctctgtcacgtgacactcaagt

SEQ ID NO: 68874 - DNA, 25 bp, Homo sapien
ttctacgtgggcaagaagttcgtgc

SEQ ID NO: 68875 - DNA, 25 bp, Homo sapien
ccagggtcccttcctatggggcagg

SEQ ID NO: 68876 - DNA, 25 bp, Homo sapien
catctttcggcgtggatccagcgca

SEQ ID NO: 68877 - DNA, 25 bp, Homo sapien
ttcaaggagctcgagtaagtgcgcc

SEQ ID NO: 68878 - DNA, 25 bp, Homo sapien
cgcccgccaagaccatcgtggtgta

SEQ ID NO: 68879 - DNA, 25 bp, Homo sapien
aatcgcccagggtcgcgtcaacacg

SEQ ID NO: 68880 - DNA, 25 bp, Homo sapien
caggcggtcacaatcgcccagggtc

SEQ ID NO: 68881 - DNA, 25 bp, Homo sapien
ccctcttgggtctgagcgtggtcag

SEQ ID NO: 68882 - DNA, 25 bp, Homo sapien
ctacggggcttgtgatgccgcccgc

SEQ ID NO: 68883 - DNA, 25 bp, Homo sapien
tccgcagcgtaacctcgcagatccc

SEQ ID NO: 68884 - DNA, 25 bp, Homo sapien
tgcgtgtgtcctcgcaagactagct

SEQ ID NO: 68885 - DNA, 25 bp, Homo sapien
aagcggtcgcagcacgtcaggcccg

SEQ ID NO: 68886 - DNA, 25 bp, Homo sapien
actttgtgacacagccgcttgcgga

SEQ ID NO: 68887 - DNA, 25 bp, Homo sapien
gatgccgcccgctgaactttgtgac

SEQ ID NO: 68888 - DNA, 25 bp, Homo sapien
gacagcgcgccactccgcagcgtaa

SEQ ID NO: 68889 - DNA, 25 bp, Homo sapien
ccctgcgtgtgtcctcgcaagacta

SEQ ID NO: 68890 - DNA, 25 bp, Homo sapien
gccggagaccatggtagcgatgtca

SEQ ID NO: 68891 - DNA, 25 bp, Homo sapien
gccgcgactggttcgtagcttttga

SEQ ID NO: 68892 - DNA, 25 bp, Homo sapien
ggcagataataactcggctccttcc

SEQ ID NO: 68893 - DNA, 25 bp, Homo sapien
tggccacagcagtcgcctgaacaaa

SEQ ID NO: 68894 - DNA, 25 bp, Homo sapien
agacagtactggctggactcacgga

SEQ ID NO: 68895 - DNA, 25 bp, Homo sapien
agcaaagctccttccaccgtagggg

SEQ ID NO: 68896 - DNA, 25 bp, Homo sapien
ggccgagagcaagctcccaaatttg

SEQ ID NO: 68897 - DNA, 25 bp, Homo sapien
ttcttcacgaaacagcgggaatggc

SEQ ID NO: 68898 - DNA, 25 bp, Homo sapien
taattggctcgattgcctggcgcgc

SEQ ID NO: 68899 - DNA, 25 bp, Homo sapien
agtactttctactcccgaccaggca

SEQ ID NO: 68900 - DNA, 25 bp, Homo sapien
acattccgcgctaccgagtactttc

SEQ ID NO: 68901 - DNA, 25 bp, Homo sapien
tggttgctacgcagcaacaggaaac

SEQ ID NO: 68902 - DNA, 25 bp, Homo sapien
cgcagtgcttccgtagaggccagct

SEQ ID NO: 68903 - DNA, 25 bp, Homo sapien
cgtgttactcagtggcgcagtgctt

SEQ ID NO: 68904 - DNA, 25 bp, Homo sapien
atgtttcggagacactaattggctc

SEQ ID NO: 68905 - DNA, 25 bp, Homo sapien
cgctcctggaccgaaagctgtggct

SEQ ID NO: 68906 - DNA, 25 bp, Homo sapien
cagctctgaccttatgccggaattc

SEQ ID NO: 68907 - DNA, 25 bp, Homo sapien
tctcgggccacttttcggtccatgg

SEQ ID NO: 68908 - DNA, 25 bp, Homo sapien
ttgcacgacccgttccttcgggtgc

SEQ ID NO: 68909 - DNA, 25 bp, Homo sapien
agctgcgtcgttgcacgacccgttc

SEQ ID NO: 68910 - DNA, 25 bp, Homo sapien
gccaggtccagctgcgtcgttgcac

SEQ ID NO: 68911 - DNA, 25 bp, Homo sapien
cacttttcggtccatggctgggcca

SEQ ID NO: 68912 - DNA, 25 bp, Homo sapien
atgccggaattctcgggccactttt

SEQ ID NO: 68913 - DNA, 25 bp, Homo sapien
gttccttcgggtgcccggctgccag

SEQ ID NO: 68914 - DNA, 25 bp, Homo sapien
tccgaaagcgctgcttcgcggggtt

SEQ ID NO: 68915 - DNA, 25 bp, Homo sapien
caaaggccagggcactgagtcgctt

SEQ ID NO: 68916 - DNA, 25 bp, Homo sapien
cggtgctaggtgaaagcccagccgc

SEQ ID NO: 68917 - DNA, 25 bp, Homo sapien
gagggaaaccatcccaaggaggtgc

SEQ ID NO: 68918 - DNA, 25 bp, Homo sapien
agggactcatcctcctcaaggcggc

SEQ ID NO: 68919 - DNA, 25 bp, Homo sapien
cagcggagtcccgaaccgcgtttct

SEQ ID NO: 68920 - DNA, 25 bp, Homo sapien
ccgaaagctcgcgaaaatggctggc

SEQ ID NO: 68921 - DNA, 25 bp, Homo sapien
cgcgccttacttggggcttgagctc

SEQ ID NO: 68922 - DNA, 25 bp, Homo sapien
aggcaaactgcgagccttctcggga

SEQ ID NO: 68923 - DNA, 25 bp, Homo sapien
cccaacctgagcaaagagcgctgga

SEQ ID NO: 68924 - DNA, 25 bp, Homo sapien
ctggaaccgcccagttcagggaaca

SEQ ID NO: 68925 - DNA, 25 bp, Homo sapien
acagcccttcacacaatgcgtctaa

SEQ ID NO: 68926 - DNA, 25 bp, Homo sapien
agctcgacgagaaaaggcaaactgc

SEQ ID NO: 68927 - DNA, 25 bp, Homo sapien
tacagtgtttctaggagctcgacga

SEQ ID NO: 68928 - DNA, 25 bp, Homo sapien
cgcacccgctgatacagtgtttcta

SEQ ID NO: 68929 - DNA, 25 bp, Homo sapien
cagcatttaaggaacacccgccacg

SEQ ID NO: 68930 - DNA, 25 bp, Homo sapien
acgcgcccagatcctcggccttggg

SEQ ID NO: 68931 - DNA, 25 bp, Homo sapien
tcggcacgccttggcgcgagtgcca

SEQ ID NO: 68932 - DNA, 25 bp, Homo sapien
ttttgtttcttgctgcagcaacgcg

SEQ ID NO: 68933 - DNA, 25 bp, Homo sapien
tcttgctgcagcaacgcgagtggga

SEQ ID NO: 68934 - DNA, 25 bp, Homo sapien
acgcgagtgggagcaccaggatctc

SEQ ID NO: 68935 - DNA, 25 bp, Homo sapien
ctcgggctcggaacgagactgcacg

SEQ ID NO: 68936 - DNA, 25 bp, Homo sapien
gcccacccagggtgtggtcggatcc

SEQ ID NO: 68937 - DNA, 25 bp, Homo sapien
ctcggaacgagactgcacggtgagt

SEQ ID NO: 68938 - DNA, 25 bp, Homo sapien
gtctgaactaggatgtcccgacatg

SEQ ID NO: 68939 - DNA, 25 bp, Homo sapien
caccgtctgaactaggatgtcccga

SEQ ID NO: 68940 - DNA, 25 bp, Homo sapien
gccgccaccgtctgaactaggatgt

SEQ ID NO: 68941 - DNA, 25 bp, Homo sapien
caggcccgagagtgaccggagtcac

SEQ ID NO: 68942 - DNA, 25 bp, Homo sapien
atttcctcttcctccctacgcgcgg

SEQ ID NO: 68943 - DNA, 25 bp, Homo sapien
cggagactttggccgagcccgagcc

SEQ ID NO: 68944 - DNA, 25 bp, Homo sapien
ctaggatgtcccgacatgaaggtga

SEQ ID NO: 68945 - DNA, 25 bp, Homo sapien
tcccgacatgaaggtgagaggagcc

SEQ ID NO: 68946 - DNA, 25 bp, Homo sapien
ccagtgcctggatgaaagtaaagtt

SEQ ID NO: 68947 - DNA, 25 bp, Homo sapien
cgaggtcaagtcgtccctggtcaac

SEQ ID NO: 68948 - DNA, 25 bp, Homo sapien
tcggactcggaggtaaggaagcacc

SEQ ID NO: 68949 - DNA, 25 bp, Homo sapien
tatttcgccgaaggtatgtgcccgc

SEQ ID NO: 68950 - DNA, 25 bp, Homo sapien
tcttgttcgcagtgagaaggcctca

SEQ ID NO: 68951 - DNA, 25 bp, Homo sapien
caggacagcgcgttctttaaaggac

SEQ ID NO: 68952 - DNA, 25 bp, Homo sapien
agttgaactactctctggcggccga

SEQ ID NO: 68953 - DNA, 25 bp, Homo sapien
tgcgccgatcccaagcagaacttgt

SEQ ID NO: 68954 - DNA, 25 bp, Homo sapien
gtctttttgggtctttgcctccgca

SEQ ID NO: 68955 - DNA, 25 bp, Homo sapien
tctttttgggtctttgcctccgcac

SEQ ID NO: 68956 - DNA, 25 bp, Homo sapien
ctttgcctccgcacccgacttgttg

SEQ ID NO: 68957 - DNA, 25 bp, Homo sapien
ctgtctttttgggtctttgcctccg

SEQ ID NO: 68958 - DNA, 25 bp, Homo sapien
cttttgtggtctgcgcctccgaacc

SEQ ID NO: 68959 - DNA, 25 bp, Homo sapien
tcttttgtggtctgcgcctccgaac

SEQ ID NO: 68960 - DNA, 25 bp, Homo sapien
tttgcctccgcacccgacttgttgg

SEQ ID NO: 68961 - DNA, 25 bp, Homo sapien
gtcttctggggtctgcgcctccgca

SEQ ID NO: 68962 - DNA, 25 bp, Homo sapien
atcttttgtggtctgcgcctccgaa

SEQ ID NO: 68963 - DNA, 25 bp, Homo sapien
cccgatttgccagtgctgtcttttg

SEQ ID NO: 68964 - DNA, 25 bp, Homo sapien
ctccggatgcgacttactagtgctg

SEQ ID NO: 68965 - DNA, 25 bp, Homo sapien
tccgaacccgacttgctagtgctgc

SEQ ID NO: 68966 - DNA, 25 bp, Homo sapien
cccgacttgttggagctgtcttttt

SEQ ID NO: 68967 - DNA, 25 bp, Homo sapien
gcggcacggctcctgaaatagaaaa

SEQ ID NO: 68968 - DNA, 25 bp, Homo sapien
aggccgtactccagcttcttcttgc

SEQ ID NO: 68969 - DNA, 25 bp, Homo sapien
ccgcactcgacttgctagggctgtc

SEQ ID NO: 68970 - DNA, 25 bp, Homo sapien
ggctagttcgctctccagtcaggag

SEQ ID NO: 68971 - DNA, 25 bp, Homo sapien
actgcgctcagcctctaggactgtg

SEQ ID NO: 68972 - DNA, 25 bp, Homo sapien
ggaagccacatcacgccggcgtcgg

SEQ ID NO: 68973 - DNA, 25 bp, Homo sapien
tttgggtttccattgcctactggga

SEQ ID NO: 68974 - DNA, 25 bp, Homo sapien
tcaggtgatgattgaccctcccggc

SEQ ID NO: 68975 - DNA, 25 bp, Homo sapien
gagccaactctcaggtgatgattga

SEQ ID NO: 68976 - DNA, 25 bp, Homo sapien
agccagccagcgaagagccaactct

SEQ ID NO: 68977 - DNA, 25 bp, Homo sapien
tttgagcactgattaaccagccagc

SEQ ID NO: 68978 - DNA, 25 bp, Homo sapien
ctccacgtgcagtgaacctctcgtg

SEQ ID NO: 68979 - DNA, 25 bp, Homo sapien
aacctctcgtgcagatgtgtcccgc

SEQ ID NO: 68980 - DNA, 25 bp, Homo sapien
gcagtgaacctctcgtgcagatgtg

SEQ ID NO: 68981 - DNA, 25 bp, Homo sapien
cctctgatgtggatgtttcccgccc

SEQ ID NO: 68982 - DNA, 25 bp, Homo sapien
acggaacctctgatgtggatgtttc

SEQ ID NO: 68983 - DNA, 25 bp, Homo sapien
ctgtgcacggaacctctgatgtgga

SEQ ID NO: 68984 - DNA, 25 bp, Homo sapien
cgcctgtgcacggaacctctgatgt

SEQ ID NO: 68985 - DNA, 25 bp, Homo sapien
tcgtgcagatgtgtcccgcctgtgc

SEQ ID NO: 68986 - DNA, 25 bp, Homo sapien
ttttttaccagacgcacagtgttcc

SEQ ID NO: 68987 - DNA, 25 bp, Homo sapien
gcagtgttcacttccattcaatcgt

SEQ ID NO: 68988 - DNA, 25 bp, Homo sapien
ctttgcgagagaattgcagtgttca

SEQ ID NO: 68989 - DNA, 25 bp, Homo sapien
gcttactgtgctgtaaactttgcga

SEQ ID NO: 68990 - DNA, 25 bp, Homo sapien
gaagcgcactacttgcctgccaacg

SEQ ID NO: 68991 - DNA, 25 bp, Homo sapien
cgccttttcttacaggaagccagga

SEQ ID NO: 68992 - DNA, 25 bp, Homo sapien
actactgcttagtttgtcccaaatg

SEQ ID NO: 68993 - DNA, 25 bp, Homo sapien
gcacagtgttcctacccttgtggtc

SEQ ID NO: 68994 - DNA, 25 bp, Homo sapien
ggcagaaagtgccaccgggagccca

SEQ ID NO: 68995 - DNA, 25 bp, Homo sapien
tttgtgcctcggtttgcccacctag

SEQ ID NO: 68996 - DNA, 25 bp, Homo sapien
cgggtacatctcagggtcggcagaa

SEQ ID NO: 68997 - DNA, 25 bp, Homo sapien
ccagatccagggctcacgagaaaaa

SEQ ID NO: 68998 - DNA, 25 bp, Homo sapien
gcctgtggtgcctttgctgagccca

SEQ ID NO: 68999 - DNA, 25 bp, Homo sapien
gtgctgatccggacgcaaagattgc

SEQ ID NO: 69000 - DNA, 25 bp, Homo sapien
ggggacgggagcaccacaacagacc

SEQ ID NO: 69001 - DNA, 25 bp, Homo sapien
tttgcccacctagaggtcagtcccg

SEQ ID NO: 69002 - DNA, 25 bp, Homo sapien
aggcctgtgggctcgttagccccgc

SEQ ID NO: 69003 - DNA, 25 bp, Homo sapien
aactggcttcatcccgccctggagg

SEQ ID NO: 69004 - DNA, 25 bp, Homo sapien
agggctaatgctgtgtgaccgccgc

SEQ ID NO: 69005 - DNA, 25 bp, Homo sapien
cgcagggctaatgctgtgtgaccgc

SEQ ID NO: 69006 - DNA, 25 bp, Homo sapien
gccgcagggctaatgctgtgtgacc

SEQ ID NO: 69007 - DNA, 25 bp, Homo sapien
agggattaggggcagtggccgcacc

SEQ ID NO: 69008 - DNA, 25 bp, Homo sapien
tggcgtcgttcaggcccggcttagc

SEQ ID NO: 69009 - DNA, 25 bp, Homo sapien
ccagctgtggcgtcgttcaggcccg

SEQ ID NO: 69010 - DNA, 25 bp, Homo sapien
gcgcagcgaaacaaagggcggctct

SEQ ID NO: 69011 - DNA, 25 bp, Homo sapien
cctcgagctcaggctggcaccgagg

SEQ ID NO: 69012 - DNA, 25 bp, Homo sapien
ccgtgccggaagctccatgtgaccg

SEQ ID NO: 69013 - DNA, 25 bp, Homo sapien
tgccggaagctccatgtgaccgtga

SEQ ID NO: 69014 - DNA, 25 bp, Homo sapien
cggaagctccatgtgaccgtgactc

SEQ ID NO: 69015 - DNA, 25 bp, Homo sapien
agctccatgtgaccgtgactccgca

SEQ ID NO: 69016 - DNA, 25 bp, Homo sapien
gtgaccgtgactccgcagaagccgc

SEQ ID NO: 69017 - DNA, 25 bp, Homo sapien
catgtgaccgtgactccgcagaagc

SEQ ID NO: 69018 - DNA, 25 bp, Homo sapien
gctcaagatagctgaacggtctctg

SEQ ID NO: 69019 - DNA, 25 bp, Homo sapien
gggcacattccttttcacctcagag

SEQ ID NO: 69020 - DNA, 25 bp, Homo sapien
acggcttccacgaggcgttcatcga

SEQ ID NO: 69021 - DNA, 25 bp, Homo sapien
acgctgtccgcagcttgcgcatttc

SEQ ID NO: 69022 - DNA, 25 bp, Homo sapien
gggcgctgctctataaataccgggc

SEQ ID NO: 69023 - DNA, 25 bp, Homo sapien
ctcctagctctagcggctcaagata

SEQ ID NO: 69024 - DNA, 25 bp, Homo sapien
acgtctcctcgcgtctgcatttttc

SEQ ID NO: 69025 - DNA, 25 bp, Homo sapien
ctgctacgagtagaacgctgtccgc

SEQ ID NO: 69026 - DNA, 25 bp, Homo sapien
gcgccagcactgtcgtaaatactac

SEQ ID NO: 69027 - DNA, 25 bp, Homo sapien
gccgccaggagaatttgcttcccta

SEQ ID NO: 69028 - DNA, 25 bp, Homo sapien
cacagctgccgcgtctgaacggagg

SEQ ID NO: 69029 - DNA, 25 bp, Homo sapien
gacaccgccattgctctgcggagga

SEQ ID NO: 69030 - DNA, 25 bp, Homo sapien
ctcaccgggagacactgggcgtcct

SEQ ID NO: 69031 - DNA, 25 bp, Homo sapien
cctctgagaccagcgctcctaggaa

SEQ ID NO: 69032 - DNA, 25 bp, Homo sapien
ggggtcctaagcctacctgagctgg

SEQ ID NO: 69033 - DNA, 25 bp, Homo sapien
tcctaggaactctccgccggagggc

SEQ ID NO: 69034 - DNA, 25 bp, Homo sapien
gtttctgtcgccactcgcggaaggc

SEQ ID NO: 69035 - DNA, 25 bp, Homo sapien
gacttggtttctgtcgccactcgcg

SEQ ID NO: 69036 - DNA, 25 bp, Homo sapien
gtggcccatcgctttcgatttgact

SEQ ID NO: 69037 - DNA, 25 bp, Homo sapien
tcgctgtggcccatcgctttcgatt

SEQ ID NO: 69038 - DNA, 25 bp, Homo sapien
cgactctacggacccaggtcgctgt

SEQ ID NO: 69039 - DNA, 25 bp, Homo sapien
tgtcatccgaattcaggctcctggg

SEQ ID NO: 69040 - DNA, 25 bp, Homo sapien
ccaggcagaggtgtcatccgaattc

SEQ ID NO: 69041 - DNA, 25 bp, Homo sapien
aggtgtgcccgttcaccaggcagag

SEQ ID NO: 69042 - DNA, 25 bp, Homo sapien
cctctctcagctcgtcagtttattg

SEQ ID NO: 69043 - DNA, 25 bp, Homo sapien
ggagacgcgaaccaacatgctgctg

SEQ ID NO: 69044 - DNA, 25 bp, Homo sapien
ccatggcgtcctatttcgatgaaca

SEQ ID NO: 69045 - DNA, 25 bp, Homo sapien
gcccgtccctcggatactctgattg

SEQ ID NO: 69046 - DNA, 25 bp, Homo sapien
attggcgttagtctctggtcacctg

SEQ ID NO: 69047 - DNA, 25 bp, Homo sapien
tctgtactgtcgaagccctctgagc

SEQ ID NO: 69048 - DNA, 25 bp, Homo sapien
agaggcctctagcatctgtactgtc

SEQ ID NO: 69049 - DNA, 25 bp, Homo sapien
tcgatgaacacgactgcgagccgtc

SEQ ID NO: 69050 - DNA, 25 bp, Homo sapien
ctcggagcagccctgaaaggtttaa

SEQ ID NO: 69051 - DNA, 25 bp, Homo sapien
tctaggaagctctctcaacgtggcg

SEQ ID NO: 69052 - DNA, 25 bp, Homo sapien
cccgttgggtctctgagcgtccaaa

SEQ ID NO: 69053 - DNA, 25 bp, Homo sapien
aacgtgaacaccctctggcactggg

SEQ ID NO: 69054 - DNA, 25 bp, Homo sapien
ctgtggcgtgaagaccgctctaaaa

SEQ ID NO: 69055 - DNA, 25 bp, Homo sapien
ccgagatgactagaggttccgttta

SEQ ID NO: 69056 - DNA, 25 bp, Homo sapien
tacctgggattgtcgccgtgcacat

SEQ ID NO: 69057 - DNA, 25 bp, Homo sapien
cggccaacggtgagtcctctaggaa

SEQ ID NO: 69058 - DNA, 25 bp, Homo sapien
ttcttgtcatagtcgtccctgcggg

SEQ ID NO: 69059 - DNA, 25 bp, Homo sapien
ccaagcgatgcagcgcacggagttt

SEQ ID NO: 69060 - DNA, 25 bp, Homo sapien
ccgcatcctgacttccggtctggga

SEQ ID NO: 69061 - DNA, 25 bp, Homo sapien
acgaagccgtggttcatgtccagcc

SEQ ID NO: 69062 - DNA, 25 bp, Homo sapien
ccgagcgatctggttccgtcggata

SEQ ID NO: 69063 - DNA, 25 bp, Homo sapien
tacacctgcaggtctggcttgcggg

SEQ ID NO: 69064 - DNA, 25 bp, Homo sapien
tcacctcggtgtcgcggcaggtaca

SEQ ID NO: 69065 - DNA, 25 bp, Homo sapien
tccgtcggatatggtgcacgaagcc

SEQ ID NO: 69066 - DNA, 25 bp, Homo sapien
tagtggagatgtccggccggtctaa

SEQ ID NO: 69067 - DNA, 25 bp, Homo sapien
ctcctgattggccttgtgccgcgcg

SEQ ID NO: 69068 - DNA, 25 bp, Homo sapien
ggctaggcgcgagagcctgtttttt

SEQ ID NO: 69069 - DNA, 25 bp, Homo sapien
agtctcgcggttccactcgcgggaa

SEQ ID NO: 69070 - DNA, 25 bp, Homo sapien
actcgtagagagttcggggctcgct

SEQ ID NO: 69071 - DNA, 25 bp, Homo sapien
ccactcgcgggaagcgagagtctga

SEQ ID NO: 69072 - DNA, 25 bp, Homo sapien
ccggcttctgttgtcccgtttgtgc

SEQ ID NO: 69073 - DNA, 25 bp, Homo sapien
tctaatcttccgctaggtcactgcg

SEQ ID NO: 69074 - DNA, 25 bp, Homo sapien
gggcacgttatgttgtccacgtgat

SEQ ID NO: 69075 - DNA, 25 bp, Homo sapien
cgtgtgggcacgttatgttgtccac

SEQ ID NO: 69076 - DNA, 25 bp, Homo sapien
tgtccacgtgatccacggggacgtg

SEQ ID NO: 69077 - DNA, 25 bp, Homo sapien
gtccacgtgatccacggggacgtgt

SEQ ID NO: 69078 - DNA, 25 bp, Homo sapien
tgggcacgttatgttgtccacgtga

SEQ ID NO: 69079 - DNA, 25 bp, Homo sapien
acgtgtgggcacgttatgttgtcca

SEQ ID NO: 69080 - DNA, 25 bp, Homo sapien
gtgtgggcacgttatgttgtccacg

SEQ ID NO: 69081 - DNA, 25 bp, Homo sapien
gacgtgtgggcacgttatgttgtcc

SEQ ID NO: 69082 - DNA, 25 bp, Homo sapien
ttgtccatgtgatccgtggggacgt

SEQ ID NO: 69083 - DNA, 25 bp, Homo sapien
atgttgtccatgtgatccgtgggga

SEQ ID NO: 69084 - DNA, 25 bp, Homo sapien
cgtgtaggcacgtcatgttgtccat

SEQ ID NO: 69085 - DNA, 25 bp, Homo sapien
taggcacgtcatgttgtccatgtga

SEQ ID NO: 69086 - DNA, 25 bp, Homo sapien
tgatgtccacgtgatccacggggac

SEQ ID NO: 69087 - DNA, 25 bp, Homo sapien
cgtcatgttgtccatgtgatccgtg

SEQ ID NO: 69088 - DNA, 25 bp, Homo sapien
gatgtgtgggcatgttatgatgtcc

SEQ ID NO: 69089 - DNA, 25 bp, Homo sapien
atgtccacgtgatccacggggacgt

SEQ ID NO: 69090 - DNA, 25 bp, Homo sapien
cggcgctgactgatctcgcgaactg

SEQ ID NO: 69091 - DNA, 25 bp, Homo sapien
gaaacgctgcttcgccctaggcgca

SEQ ID NO: 69092 - DNA, 25 bp, Homo sapien
tttccgactggacttggaagcgccc

SEQ ID NO: 69093 - DNA, 25 bp, Homo sapien
gcgcgcgaacggctataaaactttc

SEQ ID NO: 69094 - DNA, 25 bp, Homo sapien
cggcggcccagctgttttgaaaaat

SEQ ID NO: 69095 - DNA, 25 bp, Homo sapien
tgggcttctgtgtaaactgaggcta

SEQ ID NO: 69096 - DNA, 25 bp, Homo sapien
tgtttctttaaaggcgctcgcggct

SEQ ID NO: 69097 - DNA, 25 bp, Homo sapien
gcagcgggcgttctccagaaatgct

SEQ ID NO: 69098 - DNA, 25 bp, Homo sapien
aacgcagcggacgtcggccaacggc

SEQ ID NO: 69099 - DNA, 25 bp, Homo sapien
cgattggttcggtcccgtccgctct

SEQ ID NO: 69100 - DNA, 25 bp, Homo sapien
acggcgggttttccacactgagccg

SEQ ID NO: 69101 - DNA, 25 bp, Homo sapien
cgggttttccacactgagccgcgaa

SEQ ID NO: 69102 - DNA, 25 bp, Homo sapien
actgagccgcgaaagcctgtagacg

SEQ ID NO: 69103 - DNA, 25 bp, Homo sapien
cgaaagcctgtagacgacgaagaac

SEQ ID NO: 69104 - DNA, 25 bp, Homo sapien
ccggcgcccgtggtcaccatggcaa

SEQ ID NO: 69105 - DNA, 25 bp, Homo sapien
ccatggcaacgcagcggacgtcggc

SEQ ID NO: 69106 - DNA, 25 bp, Homo sapien
gcagcgcgaacgtgaagatcttttt

SEQ ID NO: 69107 - DNA, 25 bp, Homo sapien
tctgtctcaaagtactgggcccggg

SEQ ID NO: 69108 - DNA, 25 bp, Homo sapien
ggaactgctacgaaggcgcctacta

SEQ ID NO: 69109 - DNA, 25 bp, Homo sapien
ccttgctgtttgcagatggactaca

SEQ ID NO: 69110 - DNA, 25 bp, Homo sapien
tccgctatatcgagggcctgcaggc

SEQ ID NO: 69111 - DNA, 25 bp, Homo sapien
ggcccggaactagagccttaggcta

SEQ ID NO: 69112 - DNA, 25 bp, Homo sapien
gggccaggatccttcccgagagaga

SEQ ID NO: 69113 - DNA, 25 bp, Homo sapien
ctacaggaattggtgttcgggcctc

SEQ ID NO: 69114 - DNA, 25 bp, Homo sapien
ctggagccggagaggaaatactaaa

SEQ ID NO: 69115 - DNA, 25 bp, Homo sapien
gagtcaccaggtttgctcagccgca

SEQ ID NO: 69116 - DNA, 25 bp, Homo sapien
tcctgtgtacacaacttctgtctgg

SEQ ID NO: 69117 - DNA, 25 bp, Homo sapien
ccattcaagcttttacaggccctca

SEQ ID NO: 69118 - DNA, 25 bp, Homo sapien
gcactggacgccattcaagctttta

SEQ ID NO: 69119 - DNA, 25 bp, Homo sapien
cttaggcaaaccacgccgcactgga

SEQ ID NO: 69120 - DNA, 25 bp, Homo sapien
ccgggagccgagcttaggcaaacca

SEQ ID NO: 69121 - DNA, 25 bp, Homo sapien
cctgtgtgggctgctttgactcagc

SEQ ID NO: 69122 - DNA, 25 bp, Homo sapien
ggccaatcggagagcacgatgcctc

SEQ ID NO: 69123 - DNA, 25 bp, Homo sapien
gcccgggaagagacaagtcgccgcc

SEQ ID NO: 69124 - DNA, 25 bp, Homo sapien
cgccttcgtccgcatactaatgagg

SEQ ID NO: 69125 - DNA, 25 bp, Homo sapien
gttcgaggcggaaacgccgcgccca

SEQ ID NO: 69126 - DNA, 25 bp, Homo sapien
aatgaattaaatcccgagctgcagc

SEQ ID NO: 69127 - DNA, 25 bp, Homo sapien
ctccgaagcttccagcaatgaatta

SEQ ID NO: 69128 - DNA, 25 bp, Homo sapien
gttaactcggctctgctaactccga

SEQ ID NO: 69129 - DNA, 25 bp, Homo sapien
tctaccgcgtacacacctgcgtggg

SEQ ID NO: 69130 - DNA, 25 bp, Homo sapien
gtcgaggcacgctttcccaacatgc

SEQ ID NO: 69131 - DNA, 25 bp, Homo sapien
tcgcgtgcccttaagaccaggtacg

SEQ ID NO: 69132 - DNA, 25 bp, Homo sapien
accgcggagtcaccttagtcctatg

SEQ ID NO: 69133 - DNA, 25 bp, Homo sapien
gagacgcttagggtatccgcgaaga

SEQ ID NO: 69134 - DNA, 25 bp, Homo sapien
cgcagctgcaggtaagagacgctta

SEQ ID NO: 69135 - DNA, 25 bp, Homo sapien
tttgtgtgaacaggcacgcagctgc

SEQ ID NO: 69136 - DNA, 25 bp, Homo sapien
tgagcttgcaacctcccattttatg

SEQ ID NO: 69137 - DNA, 25 bp, Homo sapien
tccaggtccgttttgaattccgaca

SEQ ID NO: 69138 - DNA, 25 bp, Homo sapien
gcccgtcgaccttcagcactgaaaa

SEQ ID NO: 69139 - DNA, 25 bp, Homo sapien
ggaactgtagttctcgcccgtcgac

SEQ ID NO: 69140 - DNA, 25 bp, Homo sapien
cagcgcggccctgattggactacat

SEQ ID NO: 69141 - DNA, 25 bp, Homo sapien
gcggcggtcacacccgataactgac

SEQ ID NO: 69142 - DNA, 25 bp, Homo sapien
cggctgcggaaacgccaactccagg

SEQ ID NO: 69143 - DNA, 25 bp, Homo sapien
ggagagcgctctgaaatccattctt

SEQ ID NO: 69144 - DNA, 25 bp, Homo sapien
tccgctcgtcctgacgggaactgta

SEQ ID NO: 69145 - DNA, 25 bp, Homo sapien
acggttctagttcagcctcctcacg

SEQ ID NO: 69146 - DNA, 25 bp, Homo sapien
cccattcggggcctctgcaaatcga

SEQ ID NO: 69147 - DNA, 25 bp, Homo sapien
cgttcccggaacgtcagtcagctca

SEQ ID NO: 69148 - DNA, 25 bp, Homo sapien
accagcctggagatgatccatgaca

SEQ ID NO: 69149 - DNA, 25 bp, Homo sapien
ggagaaggccacttacaccaccagc

SEQ ID NO: 69150 - DNA, 25 bp, Homo sapien
ttaatagcccgagccactgggaccg

SEQ ID NO: 69151 - DNA, 25 bp, Homo sapien
tagctgcgccgggtattaatagccc

SEQ ID NO: 69152 - DNA, 25 bp, Homo sapien
gcggctactgtacctgctaaattta

SEQ ID NO: 69153 - DNA, 25 bp, Homo sapien
cctcagcgttccagcggagaaactg

SEQ ID NO: 69154 - DNA, 25 bp, Homo sapien
cgtgtcttgtgagagctcttgaacc

SEQ ID NO: 69155 - DNA, 25 bp, Homo sapien
ccactcgagccgcagataatttttc

SEQ ID NO: 69156 - DNA, 25 bp, Homo sapien
ggggctgagcactttcaaatccact

SEQ ID NO: 69157 - DNA, 25 bp, Homo sapien
cttgaaccaagtcagcgctggagtc

SEQ ID NO: 69158 - DNA, 25 bp, Homo sapien
ccagctcctgtgtttcagccaatga

SEQ ID NO: 69159 - DNA, 25 bp, Homo sapien
gcggagggatcactcgcttattctc

SEQ ID NO: 69160 - DNA, 25 bp, Homo sapien
ctctctgcaccaggggccttttctt

SEQ ID NO: 69161 - DNA, 25 bp, Homo sapien
ggccaatggtgatgatctgtttccc

SEQ ID NO: 69162 - DNA, 25 bp, Homo sapien
gaagagtgtcctgtcatttaccaac

SEQ ID NO: 69163 - DNA, 25 bp, Homo sapien
cccatgacgaactgaacccgtcttg

SEQ ID NO: 69164 - DNA, 25 bp, Homo sapien
ttctcctgggtctttccaaacagcc

SEQ ID NO: 69165 - DNA, 25 bp, Homo sapien
cgccgtagcccttaccagttctttg

SEQ ID NO: 69166 - DNA, 25 bp, Homo sapien
tacctgttcgagagccatggcacca

SEQ ID NO: 69167 - DNA, 25 bp, Homo sapien
tggcgaggtggagaaactcttcatc

SEQ ID NO: 69168 - DNA, 25 bp, Homo sapien
tccaaacaacgcttcgggcaggaga

SEQ ID NO: 69169 - DNA, 25 bp, Homo sapien
taccagttctttgggcggcttctcc

SEQ ID NO: 69170 - DNA, 25 bp, Homo sapien
taacaactgacgtcgcgatgaggcg

SEQ ID NO: 69171 - DNA, 25 bp, Homo sapien
ggccggagccgagacataacaactg

SEQ ID NO: 69172 - DNA, 25 bp, Homo sapien
agagctcgcggggaagaacaaaacg

SEQ ID NO: 69173 - DNA, 25 bp, Homo sapien
ggtctctgcagatggaatcggtctc

SEQ ID NO: 69174 - DNA, 25 bp, Homo sapien
ggcctcccagtcaagagccgacaaa

SEQ ID NO: 69175 - DNA, 25 bp, Homo sapien
gacgcagagacgcagagcctcgcgc

SEQ ID NO: 69176 - DNA, 25 bp, Homo sapien
acaaccgtgtatcagcggcggccgc

SEQ ID NO: 69177 - DNA, 25 bp, Homo sapien
cccatccattaagcacagaaaggag

SEQ ID NO: 69178 - DNA, 25 bp, Homo sapien
cccggattggctgaaggcttacgcc

SEQ ID NO: 69179 - DNA, 25 bp, Homo sapien
actcgtttctcggtacgctctccaa

SEQ ID NO: 69180 - DNA, 25 bp, Homo sapien
ctcggccagggattggcttcttacc

SEQ ID NO: 69181 - DNA, 25 bp, Homo sapien
tttagctcctcaggccaattggggc

SEQ ID NO: 69182 - DNA, 25 bp, Homo sapien
cacaccattagagtggcggcgcgtg

SEQ ID NO: 69183 - DNA, 25 bp, Homo sapien
tcatcggtcggttcccgtgaaaaca

SEQ ID NO: 69184 - DNA, 25 bp, Homo sapien
cctccggcatggatcagtgcgtgac

SEQ ID NO: 69185 - DNA, 25 bp, Homo sapien
tggaggagctcatcgactacaccgg

SEQ ID NO: 69186 - DNA, 25 bp, Homo sapien
aggccggcgtgttaatacacacaca

SEQ ID NO: 69187 - DNA, 25 bp, Homo sapien
gaggccggggtgttaatacacacac

SEQ ID NO: 69188 - DNA, 25 bp, Homo sapien
acacacacaggtagcgaggaggccg

SEQ ID NO: 69189 - DNA, 25 bp, Homo sapien
acacacacaggtagtgaggaggccg

SEQ ID NO: 69190 - DNA, 25 bp, Homo sapien
gaggccggcgtgttaatacacacac

SEQ ID NO: 69191 - DNA, 25 bp, Homo sapien
tacacacacaggtagcgaggaggcc

SEQ ID NO: 69192 - DNA, 25 bp, Homo sapien
ggaggccggcgtgttaatacacaca

SEQ ID NO: 69193 - DNA, 25 bp, Homo sapien
aggccggggtgttaatacacacaca

SEQ ID NO: 69194 - DNA, 25 bp, Homo sapien
cgagagcgagcgcatcgtgatcaac

SEQ ID NO: 69195 - DNA, 25 bp, Homo sapien
ggcacccgacaaagcgcccggagag

SEQ ID NO: 69196 - DNA, 25 bp, Homo sapien
cccaaaagctttgtgccgatttctc

SEQ ID NO: 69197 - DNA, 25 bp, Homo sapien
cacctcacagaggagcgcgaatttc

SEQ ID NO: 69198 - DNA, 25 bp, Homo sapien
cgctcggcgttagccgcacgagcaa

SEQ ID NO: 69199 - DNA, 25 bp, Homo sapien
tcacggagagcagcgctcggcgtta

SEQ ID NO: 69200 - DNA, 25 bp, Homo sapien
cccggagaggcttggctcgctcgtt

SEQ ID NO: 69201 - DNA, 25 bp, Homo sapien
ctcgagcccgggctcacggagagca

SEQ ID NO: 69202 - DNA, 25 bp, Homo sapien
gctctcaaggctgcatcggggaccc

SEQ ID NO: 69203 - DNA, 25 bp, Homo sapien
ggctctcaaggctgcatcggggacc

SEQ ID NO: 69204 - DNA, 25 bp, Homo sapien
ttccggctctcaaggctgcatcggg

SEQ ID NO: 69205 - DNA, 25 bp, Homo sapien
ggctctcaaggctccatcggggacc

SEQ ID NO: 69206 - DNA, 25 bp, Homo sapien
ttccggctctcaaggctccatcggg

SEQ ID NO: 69207 - DNA, 25 bp, Homo sapien
cggctctcaaggctccatcggggac

SEQ ID NO: 69208 - DNA, 25 bp, Homo sapien
ttcccgctctcaaggctgcatcggg

SEQ ID NO: 69209 - DNA, 25 bp, Homo sapien
cttccggctctcaaggctgcatcgg

SEQ ID NO: 69210 - DNA, 25 bp, Homo sapien
tccaggtgcgctaagaggcttgaaa

SEQ ID NO: 69211 - DNA, 25 bp, Homo sapien
agatctcggtttcccaccacttgga

SEQ ID NO: 69212 - DNA, 25 bp, Homo sapien
ggacagcccttgactctacctacag

SEQ ID NO: 69213 - DNA, 25 bp, Homo sapien
cgggttgattgctgtccgcatttta

SEQ ID NO: 69214 - DNA, 25 bp, Homo sapien
cagcctcgcgttagcctcagtttgc

SEQ ID NO: 69215 - DNA, 25 bp, Homo sapien
ctcagggccgagcagaaatagtagc

SEQ ID NO: 69216 - DNA, 25 bp, Homo sapien
agccctcgttctctcggcggaagtc

SEQ ID NO: 69217 - DNA, 25 bp, Homo sapien
tttacccacgagcaaacggaggcgc

SEQ ID NO: 69218 - DNA, 25 bp, Homo sapien
cgcggacaggcgcacgaggagccca

SEQ ID NO: 69219 - DNA, 25 bp, Homo sapien
tgacccggcaccaattcctgttctg

SEQ ID NO: 69220 - DNA, 25 bp, Homo sapien
ggcaccaattcctgttctgcaggtc

SEQ ID NO: 69221 - DNA, 25 bp, Homo sapien
cctgttctgcaggtctcaccgcaga

SEQ ID NO: 69222 - DNA, 25 bp, Homo sapien
gtctcaccgcagaggggcacgccag

SEQ ID NO: 69223 - DNA, 25 bp, Homo sapien
gggaacacgtgatgccacgatgggg

SEQ ID NO: 69224 - DNA, 25 bp, Homo sapien
gagggccaccaaggcgacgagagcc

SEQ ID NO: 69225 - DNA, 25 bp, Homo sapien
gggcacgccagccatgaggacagat

SEQ ID NO: 69226 - DNA, 25 bp, Homo sapien
ggcctctgatgtcccgcgcaggaca

SEQ ID NO: 69227 - DNA, 25 bp, Homo sapien
tttggcttattcaccgatttcattc

SEQ ID NO: 69228 - DNA, 25 bp, Homo sapien
ttcgctggctcattcgcatccgcag

SEQ ID NO: 69229 - DNA, 25 bp, Homo sapien
cacccgacaggaaggagatgggctt

SEQ ID NO: 69230 - DNA, 25 bp, Homo sapien
gcttgaggatctgacagccttgccc

SEQ ID NO: 69231 - DNA, 25 bp, Homo sapien
acggggaaaggctcgcagaactaag

SEQ ID NO: 69232 - DNA, 25 bp, Homo sapien
cctctgaggttcgtttggcttattc

SEQ ID NO: 69233 - DNA, 25 bp, Homo sapien
tgccaaggtccctctgaggttcgtt

SEQ ID NO: 69234 - DNA, 25 bp, Homo sapien
gcagacccttgggtagcccgcgcgc

SEQ ID NO: 69235 - DNA, 25 bp, Homo sapien
agcgcagacccttgggtagcccgcg

SEQ ID NO: 69236 - DNA, 25 bp, Homo sapien
gagcgcagacccttgggtagcccgc

SEQ ID NO: 69237 - DNA, 25 bp, Homo sapien
gggagcgcagacccttgggtagccc

SEQ ID NO: 69238 - DNA, 25 bp, Homo sapien
cgggagcgcagacccttgggtagcc

SEQ ID NO: 69239 - DNA, 25 bp, Homo sapien
ccgggagcgcagacccttgggtagc

SEQ ID NO: 69240 - DNA, 25 bp, Homo sapien
gcgcagacccttgggtagcccgcgc

SEQ ID NO: 69241 - DNA, 25 bp, Homo sapien
cgcagacccttgggtagcccgcgcg

SEQ ID NO: 69242 - DNA, 25 bp, Homo sapien
tgcgatatgggggtattttatttcc

SEQ ID NO: 69243 - DNA, 25 bp, Homo sapien
ctcctgcgtccaggcttttgagggg

SEQ ID NO: 69244 - DNA, 25 bp, Homo sapien
cggtcccccggggtaatgcgatatg

SEQ ID NO: 69245 - DNA, 25 bp, Homo sapien
cgccaccgcgggctcgacgctgcac

SEQ ID NO: 69246 - DNA, 25 bp, Homo sapien
gccttacctgtcagctgcgcggcca

SEQ ID NO: 69247 - DNA, 25 bp, Homo sapien
gccctcatcctcctagcattgcaaa

SEQ ID NO: 69248 - DNA, 25 bp, Homo sapien
ccttctcctgcgtccaggcttttga

SEQ ID NO: 69249 - DNA, 25 bp, Homo sapien
gacgctgcaccctgccaggaccagg

SEQ ID NO: 69250 - DNA, 25 bp, Homo sapien
actgtagaatgctgaatggaaaacc

SEQ ID NO: 69251 - DNA, 25 bp, Homo sapien
gccagaaccaccagagctcatagta

SEQ ID NO: 69252 - DNA, 25 bp, Homo sapien
ctcatagtagtaggtgcagcagcca

SEQ ID NO: 69253 - DNA, 25 bp, Homo sapien
actctcacagaggtagggctggttg

SEQ ID NO: 69254 - DNA, 25 bp, Homo sapien
ggcacagctctcgaagctgctgttg

SEQ ID NO: 69255 - DNA, 25 bp, Homo sapien
gagcccacattcttatctgagcata

SEQ ID NO: 69256 - DNA, 25 bp, Homo sapien
cccatcacaagagaacgccagttta

SEQ ID NO: 69257 - DNA, 25 bp, Homo sapien
atgaggacagtccagagcagccaga

SEQ ID NO: 69258 - DNA, 25 bp, Homo sapien
ctttataagggtccaactccactca

SEQ ID NO: 69259 - DNA, 25 bp, Homo sapien
ttataagggtccaactccactcata

SEQ ID NO: 69260 - DNA, 25 bp, Homo sapien
tataagggtccaactccactcatac

SEQ ID NO: 69261 - DNA, 25 bp, Homo sapien
ataagggtccaactccactcatact

SEQ ID NO: 69262 - DNA, 25 bp, Homo sapien
tttataagggtccaactccactcat

SEQ ID NO: 69263 - DNA, 25 bp, Homo sapien
taagggtccaactccactcatactc

SEQ ID NO: 69264 - DNA, 25 bp, Homo sapien
aagggtccaactccactcatactca

SEQ ID NO: 69265 - DNA, 25 bp, Homo sapien
gggtccaactccactcatactcacc

SEQ ID NO: 69266 - DNA, 25 bp, Homo sapien
tgttttcacgggaaccgaccgatga

SEQ ID NO: 69267 - DNA, 25 bp, Homo sapien
gtgtagtcgatgagctcctccaggc

SEQ ID NO: 69268 - DNA, 25 bp, Homo sapien
gcgcggccgattgtttttgttttca

SEQ ID NO: 69269 - DNA, 25 bp, Homo sapien
cacgcgccgccactctaatggtgtg

SEQ ID NO: 69270 - DNA, 25 bp, Homo sapien
cccaattggcctgaggagctaaata

SEQ ID NO: 69271 - DNA, 25 bp, Homo sapien
gaagccaatccctggccgaggcgta

SEQ ID NO: 69272 - DNA, 25 bp, Homo sapien
ggcgtaagccttcagccaatccggg

SEQ ID NO: 69273 - DNA, 25 bp, Homo sapien
tcacgcactgatccatgccggaggc

SEQ ID NO: 69274 - DNA, 25 bp, Homo sapien
gggcctcgagccacttcctcaggag

SEQ ID NO: 69275 - DNA, 25 bp, Homo sapien
ggactctggagttcagtcttgaagg

SEQ ID NO: 69276 - DNA, 25 bp, Homo sapien
ctctggagttcagtcttgaaggaca

SEQ ID NO: 69277 - DNA, 25 bp, Homo sapien
tagtgggagaagcatgtgaaagttc

SEQ ID NO: 69278 - DNA, 25 bp, Homo sapien
catgtgaaagttccctaagagggct

SEQ ID NO: 69279 - DNA, 25 bp, Homo sapien
ggagaagcatgtgaaagttccctaa

SEQ ID NO: 69280 - DNA, 25 bp, Homo sapien
aagcatgtgaaagttccctaagagg

SEQ ID NO: 69281 - DNA, 25 bp, Homo sapien
tggggactctggagttcagtcttga

SEQ ID NO: 69282 - DNA, 25 bp, Homo sapien
gcctgtcctccaaggcagccaagga

SEQ ID NO: 69283 - DNA, 25 bp, Homo sapien
gcgcatcttgcgcatctttaagctg

SEQ ID NO: 69284 - DNA, 25 bp, Homo sapien
cccgtgcccgtcatcgtgaacaatt

SEQ ID NO: 69285 - DNA, 25 bp, Homo sapien
cgagttcctcatgcgtgtcatcttc

SEQ ID NO: 69286 - DNA, 25 bp, Homo sapien
ggaggccttccttacctacatcgag

SEQ ID NO: 69287 - DNA, 25 bp, Homo sapien
cacgcaagtgcgctactaccgggag

SEQ ID NO: 69288 - DNA, 25 bp, Homo sapien
atcgagaacgttcgcaatggcacgc

SEQ ID NO: 69289 - DNA, 25 bp, Homo sapien
cccatcgtgaacaagacggagatcg

SEQ ID NO: 69290 - DNA, 25 bp, Homo sapien
gctgtaaaccattcatttgcttatt

SEQ ID NO: 69291 - DNA, 25 bp, Homo sapien
aaccattcatttgcttatttcaata

SEQ ID NO: 69292 - DNA, 25 bp, Homo sapien
gtgctgtaaaccattcatttgctta

SEQ ID NO: 69293 - DNA, 25 bp, Homo sapien
cgggtgctgtaaaccattcatttgc

SEQ ID NO: 69294 - DNA, 25 bp, Homo sapien
ggcgggtgctgtaaaccattcattt

SEQ ID NO: 69295 - DNA, 25 bp, Homo sapien
aggcgggtgctgtaaaccattcatt

SEQ ID NO: 69296 - DNA, 25 bp, Homo sapien
gccgaggcgggtgctgtaaaccatt

SEQ ID NO: 69297 - DNA, 25 bp, Homo sapien
atattttcatttgtatgctttcaga

SEQ ID NO: 69298 - DNA, 25 bp, Homo sapien
ccggcagcagcggtccaggcttaca

SEQ ID NO: 69299 - DNA, 25 bp, Homo sapien
ggagctgggagcatacatgcccacc

SEQ ID NO: 69300 - DNA, 25 bp, Homo sapien
atggcacctgccaccgtgcatcaga

SEQ ID NO: 69301 - DNA, 25 bp, Homo sapien
ctcagcggaaaacgcatggcacctg

SEQ ID NO: 69302 - DNA, 25 bp, Homo sapien
ggcactgttcacaacggcgtggaca

SEQ ID NO: 69303 - DNA, 25 bp, Homo sapien
taatcgtgccggtcaggatctcagc

SEQ ID NO: 69304 - DNA, 25 bp, Homo sapien
gcgtggacagagtgcaaggaacaaa

SEQ ID NO: 69305 - DNA, 25 bp, Homo sapien
ccgcctggaacgctgttaatcgtgc

SEQ ID NO: 69306 - DNA, 25 bp, Homo sapien
gcccaggagtgaacaaccagcccta

SEQ ID NO: 69307 - DNA, 25 bp, Homo sapien
tatgctcagataagaatgtgggctc

SEQ ID NO: 69308 - DNA, 25 bp, Homo sapien
aactggcgttctcttgtgatgggga

SEQ ID NO: 69309 - DNA, 25 bp, Homo sapien
ggactgtcctcatcctctttagctg

SEQ ID NO: 69310 - DNA, 25 bp, Homo sapien
actactatgagctctggtggttctg

SEQ ID NO: 69311 - DNA, 25 bp, Homo sapien
ctggctgctgcacctactactatga

SEQ ID NO: 69312 - DNA, 25 bp, Homo sapien
aaccagccctacctctgtgagagtg

SEQ ID NO: 69313 - DNA, 25 bp, Homo sapien
ggttttccattcagcattctacagt

SEQ ID NO: 69314 - DNA, 25 bp, Homo sapien
tttggcgagttcaggccccgcagct

SEQ ID NO: 69315 - DNA, 25 bp, Homo sapien
ttgcatgtcccacccgctctgcgcc

SEQ ID NO: 69316 - DNA, 25 bp, Homo sapien
tgaagtggccgtaaaagtgtgggac

SEQ ID NO: 69317 - DNA, 25 bp, Homo sapien
catgggggaggagtcactaataaga

SEQ ID NO: 69318 - DNA, 25 bp, Homo sapien
gacagggcggccttgtaacgccctc

SEQ ID NO: 69319 - DNA, 25 bp, Homo sapien
cggccttgtaacgccctcggtgttg

SEQ ID NO: 69320 - DNA, 25 bp, Homo sapien
gcgacggtcaaggtgccttgaagcg

SEQ ID NO: 69321 - DNA, 25 bp, Homo sapien
tcgcgagggccgttcatttgcatgt

SEQ ID NO: 69322 - DNA, 25 bp, Homo sapien
tggcgcgactggttttgatcctgtc

SEQ ID NO: 69323 - DNA, 25 bp, Homo sapien
tcctccgggtctagatttcctcttg

SEQ ID NO: 69324 - DNA, 25 bp, Homo sapien
cactcggaagccctggcgtctcttt

SEQ ID NO: 69325 - DNA, 25 bp, Homo sapien
tcggccatttcgcacactcggggcg

SEQ ID NO: 69326 - DNA, 25 bp, Homo sapien
ggcgggcgtctacaactactgtccc

SEQ ID NO: 69327 - DNA, 25 bp, Homo sapien
ggaagtcgccgccactaccggctta

SEQ ID NO: 69328 - DNA, 25 bp, Homo sapien
cggctctaatgtcttgctggcgcga

SEQ ID NO: 69329 - DNA, 25 bp, Homo sapien
taccggcttatgactggacagcaca

SEQ ID NO: 69330 - DNA, 25 bp, Homo sapien
gatttgagcagtcctttgagaaccc

SEQ ID NO: 69331 - DNA, 25 bp, Homo sapien
ctgatgctttgcgttttctgcggga

SEQ ID NO: 69332 - DNA, 25 bp, Homo sapien
ttccggcgctcggacttgaggaact

SEQ ID NO: 69333 - DNA, 25 bp, Homo sapien
cgggcgagatttctgagctccggac

SEQ ID NO: 69334 - DNA, 25 bp, Homo sapien
agtgcgcacattcgcagcccgggca

SEQ ID NO: 69335 - DNA, 25 bp, Homo sapien
tgactggcaccggtagcctcagaga

SEQ ID NO: 69336 - DNA, 25 bp, Homo sapien
tgcgaagctgagaaccctagctccg

SEQ ID NO: 69337 - DNA, 25 bp, Homo sapien
ctgcgagtcccttgaggatttaggc

SEQ ID NO: 69338 - DNA, 25 bp, Homo sapien
gggtgccagcatcttcgcggatgtt

SEQ ID NO: 69339 - DNA, 25 bp, Homo sapien
gagttgtctcttatcctccagggaa

SEQ ID NO: 69340 - DNA, 25 bp, Homo sapien
aggcgaccactgtctttatagagga

SEQ ID NO: 69341 - DNA, 25 bp, Homo sapien
ccaagccacggaggatgactggact

SEQ ID NO: 69342 - DNA, 25 bp, Homo sapien
aaccctttctgtcgtcaggtgccca

SEQ ID NO: 69343 - DNA, 25 bp, Homo sapien
cagcggtcacgtcgccgtcattcaa

SEQ ID NO: 69344 - DNA, 25 bp, Homo sapien
ggcatcttcgtaatcacagcggtca

SEQ ID NO: 69345 - DNA, 25 bp, Homo sapien
ctccagggaaccagaaataggcagg

SEQ ID NO: 69346 - DNA, 25 bp, Homo sapien
ctggcccacctgagaattcgcagtg

SEQ ID NO: 69347 - DNA, 25 bp, Homo sapien
ctgggcagcctctagccaggagacc

SEQ ID NO: 69348 - DNA, 25 bp, Homo sapien
gcgagccttcttcctgccacttgtt

SEQ ID NO: 69349 - DNA, 25 bp, Homo sapien
cagcttctacctcagcaagtgtggc

SEQ ID NO: 69350 - DNA, 25 bp, Homo sapien
ttggacctctaggtggcgcgattct

SEQ ID NO: 69351 - DNA, 25 bp, Homo sapien
tcaggccgcgaaccaacttgcagga

SEQ ID NO: 69352 - DNA, 25 bp, Homo sapien
aaacacctagcactgcgcgggagga

SEQ ID NO: 69353 - DNA, 25 bp, Homo sapien
cgggccgtttgtccgaaggcattat

SEQ ID NO: 69354 - DNA, 25 bp, Homo sapien
gcccacgtttcttaacatcataata

SEQ ID NO: 69355 - DNA, 25 bp, Homo sapien
gagcgcctgctagccggcctcttat

SEQ ID NO: 69356 - DNA, 25 bp, Homo sapien
actccgaagttgtcgccgcagtaga

SEQ ID NO: 69357 - DNA, 25 bp, Homo sapien
gggctgcgaatacactccgaagttg

SEQ ID NO: 69358 - DNA, 25 bp, Homo sapien
atcttcatcaggtcctcgcggctgg

SEQ ID NO: 69359 - DNA, 25 bp, Homo sapien
ggcggccgcaccatcttcatcaggt

SEQ ID NO: 69360 - DNA, 25 bp, Homo sapien
ggccacctgcctagtcatccttttg

SEQ ID NO: 69361 - DNA, 25 bp, Homo sapien
taacccgaacagtacgaatgatttc

SEQ ID NO: 69362 - DNA, 25 bp, Homo sapien
gctttgcctcggcatctgtcgtccc

SEQ ID NO: 69363 - DNA, 25 bp, Homo sapien
gacggcatcctcctatctttcatct

SEQ ID NO: 69364 - DNA, 25 bp, Homo sapien
cgagaatccagacggcatcctccta

SEQ ID NO: 69365 - DNA, 25 bp, Homo sapien
tggctgcgcccgagccagattccct

SEQ ID NO: 69366 - DNA, 25 bp, Homo sapien
ttgaaacgacaattcctgccgcggc

SEQ ID NO: 69367 - DNA, 25 bp, Homo sapien
ggccaggtctttgaaacgacaattc

SEQ ID NO: 69368 - DNA, 25 bp, Homo sapien
ctcctgggccaggtctttgaaacga

SEQ ID NO: 69369 - DNA, 25 bp, Homo sapien
tctccaaaccctccggccatgctgc

SEQ ID NO: 69370 - DNA, 25 bp, Homo sapien
tggagcaccgtgcatcgtccgggcc

SEQ ID NO: 69371 - DNA, 25 bp, Homo sapien
gccgcgctggcgaacgaagactgcc

SEQ ID NO: 69372 - DNA, 25 bp, Homo sapien
gagatacggaccctgcttcctctta

SEQ ID NO: 69373 - DNA, 25 bp, Homo sapien
gcttcctcttatcaaccggggagta

SEQ ID NO: 69374 - DNA, 25 bp, Homo sapien
atcaaccggggagtacgcgtgccca

SEQ ID NO: 69375 - DNA, 25 bp, Homo sapien
gcacccgcgagagatacggaccctg

SEQ ID NO: 69376 - DNA, 25 bp, Homo sapien
tgagggcctgccctttacgcgctcg

SEQ ID NO: 69377 - DNA, 25 bp, Homo sapien
tacgcgtgcccacctggtggaggaa

SEQ ID NO: 69378 - DNA, 25 bp, Homo sapien
ccgacgtctttttacctgattggtg

SEQ ID NO: 69379 - DNA, 25 bp, Homo sapien
gtgcgctcatcagttcccggaatac

SEQ ID NO: 69380 - DNA, 25 bp, Homo sapien
ggtcgcaactctgtctcatcgtctg

SEQ ID NO: 69381 - DNA, 25 bp, Homo sapien
gcctatctcggacatcgcccattga

SEQ ID NO: 69382 - DNA, 25 bp, Homo sapien
aactttccgcgcgtttgctctctca

SEQ ID NO: 69383 - DNA, 25 bp, Homo sapien
cttccggacgcaattaccaatgaga

SEQ ID NO: 69384 - DNA, 25 bp, Homo sapien
ctcgcgcgcgtaaacaagttgcctc

SEQ ID NO: 69385 - DNA, 25 bp, Homo sapien
tccctggtggtcaacatcgcaccta

SEQ ID NO: 69386 - DNA, 25 bp, Homo sapien
tcagcaccctctacgggcgggtctt

SEQ ID NO: 69387 - DNA, 25 bp, Homo sapien
gctgcggggactccaacagcatctg

SEQ ID NO: 69388 - DNA, 25 bp, Homo sapien
tgtgcgtaagcgaccagatttccgg

SEQ ID NO: 69389 - DNA, 25 bp, Homo sapien
cgcagataggggttcctcgaagcca

SEQ ID NO: 69390 - DNA, 25 bp, Homo sapien
tgcgcattccgtcgcggagagcatt

SEQ ID NO: 69391 - DNA, 25 bp, Homo sapien
ttcacagagcgaagtgccggagccc

SEQ ID NO: 69392 - DNA, 25 bp, Homo sapien
cgcggctaatggtacttcacagagc

SEQ ID NO: 69393 - DNA, 25 bp, Homo sapien
accacgtgagggtgagcacttcgaa

SEQ ID NO: 69394 - DNA, 25 bp, Homo sapien
tcactattccagcaccgacacgggg

SEQ ID NO: 69395 - DNA, 25 bp, Homo sapien
tggggacgctcactattccagcacc

SEQ ID NO: 69396 - DNA, 25 bp, Homo sapien
accgacacggggacgatcactattc

SEQ ID NO: 69397 - DNA, 25 bp, Homo sapien
cacggggacgttcactatttcagca

SEQ ID NO: 69398 - DNA, 25 bp, Homo sapien
tttcagcaccgacacggggacgatc

SEQ ID NO: 69399 - DNA, 25 bp, Homo sapien
acacggggacgctcactattccagc

SEQ ID NO: 69400 - DNA, 25 bp, Homo sapien
cacggggacgctcactattccagca

SEQ ID NO: 69401 - DNA, 25 bp, Homo sapien
cggggacgttcactatttcagcacc

SEQ ID NO: 69402 - DNA, 25 bp, Homo sapien
cactgacaggggaatgcacactatt

SEQ ID NO: 69403 - DNA, 25 bp, Homo sapien
ccgatacggggcaccaacatgagga

SEQ ID NO: 69404 - DNA, 25 bp, Homo sapien
ttccagcgctaatacggggacgttc

SEQ ID NO: 69405 - DNA, 25 bp, Homo sapien
ttccagcacggacacgggtcactga

SEQ ID NO: 69406 - DNA, 25 bp, Homo sapien
gtgacggtcactattccagcacgga

SEQ ID NO: 69407 - DNA, 25 bp, Homo sapien
tatggggacgctcactattcaagcg

SEQ ID NO: 69408 - DNA, 25 bp, Homo sapien
ttcaagcgccgacatgggaacactc

SEQ ID NO: 69409 - DNA, 25 bp, Homo sapien
tattgcagcaccgatacagggatgc

SEQ ID NO: 69410 - DNA, 25 bp, Homo sapien
ctacagtttgtagccgacgattgtg

SEQ ID NO: 69411 - DNA, 25 bp, Homo sapien
cagtttgtagccgacgattgtggaa

SEQ ID NO: 69412 - DNA, 25 bp, Homo sapien
tgtagccgacgattgtggaagacta

SEQ ID NO: 69413 - DNA, 25 bp, Homo sapien
agccgacgattgtggaagactagga

SEQ ID NO: 69414 - DNA, 25 bp, Homo sapien
cgacgattgtggaagactaggagcc

SEQ ID NO: 69415 - DNA, 25 bp, Homo sapien
tccagggagccacgccagcccgctg

SEQ ID NO: 69416 - DNA, 25 bp, Homo sapien
catcacacgacctgggcgactgggt

SEQ ID NO: 69417 - DNA, 25 bp, Homo sapien
gtcctgcgctcagggcaggggtcaa

SEQ ID NO: 69418 - DNA, 25 bp, Homo sapien
atttgcggctatttgcacctgccac

SEQ ID NO: 69419 - DNA, 25 bp, Homo sapien
gtgcccatcaccgtagctttttgcc

SEQ ID NO: 69420 - DNA, 25 bp, Homo sapien
cttttggtgaccgccgccacggctt

SEQ ID NO: 69421 - DNA, 25 bp, Homo sapien
agttttgccccgtatgcggcttccg

SEQ ID NO: 69422 - DNA, 25 bp, Homo sapien
cgcagctttttcaggcttttggtga

SEQ ID NO: 69423 - DNA, 25 bp, Homo sapien
ccgcggctatttgcggctatttgca

SEQ ID NO: 69424 - DNA, 25 bp, Homo sapien
ttttggcacccgtcgccgcagcttt

SEQ ID NO: 69425 - DNA, 25 bp, Homo sapien
tatccccgctgtcatggctttttgc

SEQ ID NO: 69426 - DNA, 25 bp, Homo sapien
cccacggcgggtattgcacaccgcc

SEQ ID NO: 69427 - DNA, 25 bp, Homo sapien
gctttatgtccaccgcggcttttgc

SEQ ID NO: 69428 - DNA, 25 bp, Homo sapien
gtgccgcacttatttgcccgcagcg

SEQ ID NO: 69429 - DNA, 25 bp, Homo sapien
accgcccgccgcagctttatgtcca

SEQ ID NO: 69430 - DNA, 25 bp, Homo sapien
ccgcctccacggctttctgccgccg

SEQ ID NO: 69431 - DNA, 25 bp, Homo sapien
cgggtattgcacaccgcccgccgca

SEQ ID NO: 69432 - DNA, 25 bp, Homo sapien
tgccgcacttatttgcccgcagcgg

SEQ ID NO: 69433 - DNA, 25 bp, Homo sapien
cagctttatgtccaccgcggctttt

SEQ ID NO: 69434 - DNA, 25 bp, Homo sapien
agggaactttcacatgcttctccca

SEQ ID NO: 69435 - DNA, 25 bp, Homo sapien
cttagggaactttcacatgcttctc

SEQ ID NO: 69436 - DNA, 25 bp, Homo sapien
ctcttagggaactttcacatgcttc

SEQ ID NO: 69437 - DNA, 25 bp, Homo sapien
tgtccttcaagactgaactccagag

SEQ ID NO: 69438 - DNA, 25 bp, Homo sapien
agccctcttagggaactttcacatg

SEQ ID NO: 69439 - DNA, 25 bp, Homo sapien
cttcaagactgaactccagagtccc

SEQ ID NO: 69440 - DNA, 25 bp, Homo sapien
ctcctgaggaagtggctcgaggccc

SEQ ID NO: 69441 - DNA, 25 bp, Homo sapien
gaactttcacatgcttctcccacta

SEQ ID NO: 69442 - DNA, 25 bp, Homo sapien
gagctcgtagaatcctgggtcagcg

SEQ ID NO: 69443 - DNA, 25 bp, Homo sapien
caccggctggtgagtccaggcaccg

SEQ ID NO: 69444 - DNA, 25 bp, Homo sapien
tcgtagaatcctgggtcagcggggt

SEQ ID NO: 69445 - DNA, 25 bp, Homo sapien
cgagcgcctcagtcgcggggtcatc

SEQ ID NO: 69446 - DNA, 25 bp, Homo sapien
ctcagtcgcggggtcatcggggccc

SEQ ID NO: 69447 - DNA, 25 bp, Homo sapien
agctcgtagaatcctgggtcagcgg

SEQ ID NO: 69448 - DNA, 25 bp, Homo sapien
ctggtgagtccaggcaccgggcaag

SEQ ID NO: 69449 - DNA, 25 bp, Homo sapien
ctgcaccggctggtgagtccaggca

SEQ ID NO: 69450 - DNA, 25 bp, Homo sapien
acctgctgtgcttcctgacggcgct

SEQ ID NO: 69451 - DNA, 25 bp, Homo sapien
aagagcgacctgctgtgcttcctga

SEQ ID NO: 69452 - DNA, 25 bp, Homo sapien
atgctgtggtacgtgggccgcagct

SEQ ID NO: 69453 - DNA, 25 bp, Homo sapien
tgtgcttcctgacggcgctcatgct

SEQ ID NO: 69454 - DNA, 25 bp, Homo sapien
tgagcaagagcgacctgctgtgctt

SEQ ID NO: 69455 - DNA, 25 bp, Homo sapien
agcagccagtatgggctgatcgtgt

SEQ ID NO: 69456 - DNA, 25 bp, Homo sapien
ccagtatgggctgatcgtgttcgtg

SEQ ID NO: 69457 - DNA, 25 bp, Homo sapien
gcctcttccgcctcaaggacacgca

SEQ ID NO: 69458 - DNA, 25 bp, Homo sapien
agggcgctcaccatgagctgcgccg

SEQ ID NO: 69459 - DNA, 25 bp, Homo sapien
aaggccacccagacgtcgcagaacg

SEQ ID NO: 69460 - DNA, 25 bp, Homo sapien
cgctgacagccagggctgttctcgg

SEQ ID NO: 69461 - DNA, 25 bp, Homo sapien
agcacatgatgtcgaaggccaccca

SEQ ID NO: 69462 - DNA, 25 bp, Homo sapien
gccaggttgtttggcaggtccagcc

SEQ ID NO: 69463 - DNA, 25 bp, Homo sapien
cgcctggtccctgtgccagttgagc

SEQ ID NO: 69464 - DNA, 25 bp, Homo sapien
ccagttgagctggaccggaatgaag

SEQ ID NO: 69465 - DNA, 25 bp, Homo sapien
agaagagagcaagccgccactgagg

SEQ ID NO: 69466 - DNA, 25 bp, Homo sapien
gtactgggttatgctctgtgccgca

SEQ ID NO: 69467 - DNA, 25 bp, Homo sapien
aacgaggcgtacgtgcggaaacaca

SEQ ID NO: 69468 - DNA, 25 bp, Homo sapien
ccagaactcagggtcaggtacgcca

SEQ ID NO: 69469 - DNA, 25 bp, Homo sapien
cttcaggtgctatggcaacgaggcg

SEQ ID NO: 69470 - DNA, 25 bp, Homo sapien
tctgaacattctaaacggggaaatc

SEQ ID NO: 69471 - DNA, 25 bp, Homo sapien
gggagaagcgtaccagaagcagctc

SEQ ID NO: 69472 - DNA, 25 bp, Homo sapien
ggggccgctttcctctaccagagag

SEQ ID NO: 69473 - DNA, 25 bp, Homo sapien
gaacgccgccagattgttcaaatct

SEQ ID NO: 69474 - DNA, 25 bp, Homo sapien
ttccagggccgcctaccagtgagct

SEQ ID NO: 69475 - DNA, 25 bp, Homo sapien
cacctgcttctacccgaaggctgga

SEQ ID NO: 69476 - DNA, 25 bp, Homo sapien
cttctgctgcctgcaactggtggca

SEQ ID NO: 69477 - DNA, 25 bp, Homo sapien
cagcagatctttgacttccagggcc

SEQ ID NO: 69478 - DNA, 25 bp, Homo sapien
ctagccaatttcctgcgcctcgtgg

SEQ ID NO: 69479 - DNA, 25 bp, Homo sapien
taccgatccagggatggagaatcgc

SEQ ID NO: 69480 - DNA, 25 bp, Homo sapien
gcgtttatcacctgcttctacccga

SEQ ID NO: 69481 - DNA, 25 bp, Homo sapien
ggctggcctgagtgcgtttatcacc

SEQ ID NO: 69482 - DNA, 25 bp, Homo sapien
cgaccgttactttgctgtctcctgg

SEQ ID NO: 69483 - DNA, 25 bp, Homo sapien
gggaaatacaactgccgggtgactg

SEQ ID NO: 69484 - DNA, 25 bp, Homo sapien
tgggccttcaacagctcgctcatcg

SEQ ID NO: 69485 - DNA, 25 bp, Homo sapien
gtgcctgtcctcaacagcgaatttg

SEQ ID NO: 69486 - DNA, 25 bp, Homo sapien
cagcgaatttgctcaccgggaagcc

SEQ ID NO: 69487 - DNA, 25 bp, Homo sapien
caggggacagcttaacgtggccaaa

SEQ ID NO: 69488 - DNA, 25 bp, Homo sapien
ttgtgctgaagatctaccacctccg

SEQ ID NO: 69489 - DNA, 25 bp, Homo sapien
aggctcagaatgttcccgaccgtta

SEQ ID NO: 69490 - DNA, 25 bp, Homo sapien
gtaggtgctcgctgaatactgtaca

SEQ ID NO: 69491 - DNA, 25 bp, Homo sapien
tttccgccctgcaatgcctagcatg

SEQ ID NO: 69492 - DNA, 25 bp, Homo sapien
gcccgctccacctaattatcttgaa

SEQ ID NO: 69493 - DNA, 25 bp, Homo sapien
tgtagattccggctaatggtttccc

SEQ ID NO: 69494 - DNA, 25 bp, Homo sapien
ccctggcatttgacttcgtgatgtg

SEQ ID NO: 69495 - DNA, 25 bp, Homo sapien
cgtgatgtgtaaccgagttctcttc

SEQ ID NO: 69496 - DNA, 25 bp, Homo sapien
cgggctcatgtaggaatagatcttt

SEQ ID NO: 69497 - DNA, 25 bp, Homo sapien
ttgactgcccggtaaatacgctctc

SEQ ID NO: 69498 - DNA, 25 bp, Homo sapien
ggcggcaactccgttgcccagggaa

SEQ ID NO: 69499 - DNA, 25 bp, Homo sapien
cagggtgtgtgctttgatgggctct

SEQ ID NO: 69500 - DNA, 25 bp, Homo sapien
cctgtcgcggtgctggctgaacctc

SEQ ID NO: 69501 - DNA, 25 bp, Homo sapien
gtgtgcgctcccgagtctgcaccag

SEQ ID NO: 69502 - DNA, 25 bp, Homo sapien
cagccattgaagtgtgcgctcccga

SEQ ID NO: 69503 - DNA, 25 bp, Homo sapien
ttgcccagggaacagccattgaagt

SEQ ID NO: 69504 - DNA, 25 bp, Homo sapien
tacagacggccgcacgggctgctgc

SEQ ID NO: 69505 - DNA, 25 bp, Homo sapien
ccagggaacagccattgaagtgtgc

SEQ ID NO: 69506 - DNA, 25 bp, Homo sapien
tatttgcccaccagggctttttgca

SEQ ID NO: 69507 - DNA, 25 bp, Homo sapien
ccctcctcaggtgccgtggttattt

SEQ ID NO: 69508 - DNA, 25 bp, Homo sapien
tcctcaggtgccgtggttatttgcc

SEQ ID NO: 69509 - DNA, 25 bp, Homo sapien
ctcaggtgccgtggttatttgccca

SEQ ID NO: 69510 - DNA, 25 bp, Homo sapien
aggtgccgtggttatttgcccacca

SEQ ID NO: 69511 - DNA, 25 bp, Homo sapien
tgccgtggttatttgcccaccaggg

SEQ ID NO: 69512 - DNA, 25 bp, Homo sapien
ccgtggttatttgcccaccagggct

SEQ ID NO: 69513 - DNA, 25 bp, Homo sapien
ttatttgcccaccagggctttttgc

SEQ ID NO: 69514 - DNA, 25 bp, Homo sapien
ccgacctcgggaaagtagatgtgga

SEQ ID NO: 69515 - DNA, 25 bp, Homo sapien
gcacgtgccggcacctagcccgcaa

SEQ ID NO: 69516 - DNA, 25 bp, Homo sapien
ctagaagacgcttcccgacctcggg

SEQ ID NO: 69517 - DNA, 25 bp, Homo sapien
atgcctgacccctcgtcctagaaga

SEQ ID NO: 69518 - DNA, 25 bp, Homo sapien
tgaaggagacggcagcacccacctg

SEQ ID NO: 69519 - DNA, 25 bp, Homo sapien
tcacatgaaggagacggcagcaccc

SEQ ID NO: 69520 - DNA, 25 bp, Homo sapien
ccaagctcgaatcacatgaaggaga

SEQ ID NO: 69521 - DNA, 25 bp, Homo sapien
gagggtggcgccttgcgtaaccctc

SEQ ID NO: 69522 - DNA, 25 bp, Homo sapien
tgccattttggaaagcgttctaccc

SEQ ID NO: 69523 - DNA, 25 bp, Homo sapien
gtgccattttggaaagcgttctacc

SEQ ID NO: 69524 - DNA, 25 bp, Homo sapien
agtgccattttggaaagcgttctac

SEQ ID NO: 69525 - DNA, 25 bp, Homo sapien
gagtgccattttggaaagcgttcta

SEQ ID NO: 69526 - DNA, 25 bp, Homo sapien
ggtctaccgcctgtctgcctcagtt

SEQ ID NO: 69527 - DNA, 25 bp, Homo sapien
tggtctaccgcctgtctgcctcagt

SEQ ID NO: 69528 - DNA, 25 bp, Homo sapien
gccattttggaaagcgttctaccca

SEQ ID NO: 69529 - DNA, 25 bp, Homo sapien
tggacctggtctaccgcctgtctgc

SEQ ID NO: 69530 - DNA, 25 bp, Homo sapien
tgcaaagagccgccgccggtaaata

SEQ ID NO: 69531 - DNA, 25 bp, Homo sapien
gcgatggtgggagcggggggacaaa

SEQ ID NO: 69532 - DNA, 25 bp, Homo sapien
gcaaagagccgccgccggtaaataa

SEQ ID NO: 69533 - DNA, 25 bp, Homo sapien
gtgcaaagagccgccgccggtaaat

SEQ ID NO: 69534 - DNA, 25 bp, Homo sapien
ggtgcaaagagccgccgccggtaaa

SEQ ID NO: 69535 - DNA, 25 bp, Homo sapien
ggggtgcaaagagccgccgccggta

SEQ ID NO: 69536 - DNA, 25 bp, Homo sapien
ggtggagagcgcaaaaagccgctgc

SEQ ID NO: 69537 - DNA, 25 bp, Homo sapien
attttactatccgccacggtggctt

SEQ ID NO: 69538 - DNA, 25 bp, Homo sapien
ttgccgccactgctttttatcccca

SEQ ID NO: 69539 - DNA, 25 bp, Homo sapien
ttgcggcattttactatccgccacg

SEQ ID NO: 69540 - DNA, 25 bp, Homo sapien
cggcattttactatccgccacggtg

SEQ ID NO: 69541 - DNA, 25 bp, Homo sapien
gcattttactatccgccacggtggc

SEQ ID NO: 69542 - DNA, 25 bp, Homo sapien
cccttctaagcaggtttttgtgatt

SEQ ID NO: 69543 - DNA, 25 bp, Homo sapien
cttctaagcaggtttttgtgatttt

SEQ ID NO: 69544 - DNA, 25 bp, Homo sapien
ggcattttactatccgccacggtgg

SEQ ID NO: 69545 - DNA, 25 bp, Homo sapien
gctccttcgcgtttttgtctccttg

SEQ ID NO: 69546 - DNA, 25 bp, Homo sapien
tgtgcgttcgcaaacatctgagggg

SEQ ID NO: 69547 - DNA, 25 bp, Homo sapien
agcccgctttggtgtgcgttcgcaa

SEQ ID NO: 69548 - DNA, 25 bp, Homo sapien
gcgcaattgtcttgagcccgctttg

SEQ ID NO: 69549 - DNA, 25 bp, Homo sapien
cagggcagcgatggcatcaccattt

SEQ ID NO: 69550 - DNA, 25 bp, Homo sapien
ttcatgtttcatgcaggtgcactgc

SEQ ID NO: 69551 - DNA, 25 bp, Homo sapien
agtcacgtacccaggcgaagagcgc

SEQ ID NO: 69552 - DNA, 25 bp, Homo sapien
ggcatcaccatttgcgggaacagga

SEQ ID NO: 69553 - DNA, 25 bp, Homo sapien
ccgaataacttcatggcggtgacta

SEQ ID NO: 69554 - DNA, 25 bp, Homo sapien
cgaataacttcatggcggtgactac

SEQ ID NO: 69555 - DNA, 25 bp, Homo sapien
acttcatggcggtgactacttctca

SEQ ID NO: 69556 - DNA, 25 bp, Homo sapien
aacttcatggcggtgactacttctc

SEQ ID NO: 69557 - DNA, 25 bp, Homo sapien
ttcatggcggtgactacttctcaga

SEQ ID NO: 69558 - DNA, 25 bp, Homo sapien
catggcggtgactacttctcagacc

SEQ ID NO: 69559 - DNA, 25 bp, Homo sapien
atggcggtgactacttctcagaccc

SEQ ID NO: 69560 - DNA, 25 bp, Homo sapien
gaataacttcatggcggtgactact

SEQ ID NO: 69561 - DNA, 25 bp, Homo sapien
gacgcgggacctcgcggccagcgag

SEQ ID NO: 69562 - DNA, 25 bp, Homo sapien
tgggacctgtgcgaagtccacgtga

SEQ ID NO: 69563 - DNA, 25 bp, Homo sapien
gggacctgtgcgaagtccacgtgaa

SEQ ID NO: 69564 - DNA, 25 bp, Homo sapien
gacctgtgcgaagtccacgtgaacg

SEQ ID NO: 69565 - DNA, 25 bp, Homo sapien
acctgtgcgaagtccacgtgaacgc

SEQ ID NO: 69566 - DNA, 25 bp, Homo sapien
cccagacgcgggacctcgcggccag

SEQ ID NO: 69567 - DNA, 25 bp, Homo sapien
cctgtgcgaagtccacgtgaacgcg

SEQ ID NO: 69568 - DNA, 25 bp, Homo sapien
ccctgggacctgtgcgaagtccacg

SEQ ID NO: 69569 - DNA, 25 bp, Homo sapien
acctcgtgcgcgaccatgtggaaac

SEQ ID NO: 69570 - DNA, 25 bp, Homo sapien
gcagcaagactccacgcgcacagtg

SEQ ID NO: 69571 - DNA, 25 bp, Homo sapien
gctgaccgcactaggctgaccgcaa

SEQ ID NO: 69572 - DNA, 25 bp, Homo sapien
cggcaggcaccatggcgcagacagt

SEQ ID NO: 69573 - DNA, 25 bp, Homo sapien
cctccaagtacctgctggaggagtg

SEQ ID NO: 69574 - DNA, 25 bp, Homo sapien
ctggacgccacagaggtgcccttct

SEQ ID NO: 69575 - DNA, 25 bp, Homo sapien
gacaacctgcagtgccgtgagcgcc

SEQ ID NO: 69576 - DNA, 25 bp, Homo sapien
tgcaaagagtacgacgtggcccgta

SEQ ID NO: 69577 - DNA, 25 bp, Homo sapien
aaggccgcgccacggctgcacgtaa

SEQ ID NO: 69578 - DNA, 25 bp, Homo sapien
cacagaaggccgtgccacggctgca

SEQ ID NO: 69579 - DNA, 25 bp, Homo sapien
tgcacgtaagctgggcacatggaga

SEQ ID NO: 69580 - DNA, 25 bp, Homo sapien
ctgcacgtaagctgggcacatggag

SEQ ID NO: 69581 - DNA, 25 bp, Homo sapien
aaggccgtgccacggctgcacgtaa

SEQ ID NO: 69582 - DNA, 25 bp, Homo sapien
gctgcacgtaagctgggcacatgga

SEQ ID NO: 69583 - DNA, 25 bp, Homo sapien
cacggctgcacgtaagctgggcaca

SEQ ID NO: 69584 - DNA, 25 bp, Homo sapien
ccacggctgcacgtaagctgggcac

SEQ ID NO: 69585 - DNA, 25 bp, Homo sapien
ctttgtggggcagcatggggtgcat

SEQ ID NO: 69586 - DNA, 25 bp, Homo sapien
tgcatcggagtccatgcacgtcctc

SEQ ID NO: 69587 - DNA, 25 bp, Homo sapien
gtgcatcggagtccatgcacgtcct

SEQ ID NO: 69588 - DNA, 25 bp, Homo sapien
ggtgcatcggagtccatgcacgtcc

SEQ ID NO: 69589 - DNA, 25 bp, Homo sapien
agcatggggtgcatcggagtccatg

SEQ ID NO: 69590 - DNA, 25 bp, Homo sapien
cagcatggggtgcatcggagtccat

SEQ ID NO: 69591 - DNA, 25 bp, Homo sapien
cggagacccgggccaagttcacgca

SEQ ID NO: 69592 - DNA, 25 bp, Homo sapien
tttgtggggcagcatggggtgcatc

SEQ ID NO: 69593 - DNA, 25 bp, Homo sapien
gaacctggccttcgggcgccgctgt

SEQ ID NO: 69594 - DNA, 25 bp, Homo sapien
catccttcgcgacacctccgaggac

SEQ ID NO: 69595 - DNA, 25 bp, Homo sapien
cagcggtgctgggaacggggtcgcg

SEQ ID NO: 69596 - DNA, 25 bp, Homo sapien
tgcatccttcgcgacacctccgagg

SEQ ID NO: 69597 - DNA, 25 bp, Homo sapien
gacgccgtgaacctggccttcgggc

SEQ ID NO: 69598 - DNA, 25 bp, Homo sapien
acgccgtgaacctggccttcgggcg

SEQ ID NO: 69599 - DNA, 25 bp, Homo sapien
gtgaacctggccttcgggcgccgct

SEQ ID NO: 69600 - DNA, 25 bp, Homo sapien
gtggactgcatccttcgcgacacct

SEQ ID NO: 69601 - DNA, 25 bp, Homo sapien
ctcgcagagctacgggagaaggatc

SEQ ID NO: 69602 - DNA, 25 bp, Homo sapien
ttcccttgaaggcacctgcgcaggg

SEQ ID NO: 69603 - DNA, 25 bp, Homo sapien
tctgaagcagaacaccggctggtgc

SEQ ID NO: 69604 - DNA, 25 bp, Homo sapien
ccctccttgtcagtccggtcaccgc

SEQ ID NO: 69605 - DNA, 25 bp, Homo sapien
gggactttcgcatgaagcccctcct

SEQ ID NO: 69606 - DNA, 25 bp, Homo sapien
caggaacatgggctcgcagagctac

SEQ ID NO: 69607 - DNA, 25 bp, Homo sapien
tcctatcttcccttgaaggcacctg

SEQ ID NO: 69608 - DNA, 25 bp, Homo sapien
ctgagggaccgtggccaggaacatg

SEQ ID NO: 69609 - DNA, 25 bp, Homo sapien
acggctcttggttcgctggtcccaa

SEQ ID NO: 69610 - DNA, 25 bp, Homo sapien
tgtgcccttctagaccaacagaatg

SEQ ID NO: 69611 - DNA, 25 bp, Homo sapien
ctggaacgcaggagtcagacccaca

SEQ ID NO: 69612 - DNA, 25 bp, Homo sapien
tggttttgccctgcttcccgcaaga

SEQ ID NO: 69613 - DNA, 25 bp, Homo sapien
ggagcgcctgaccaaagtggttttg

SEQ ID NO: 69614 - DNA, 25 bp, Homo sapien
cccagcacagctgtcggacgggatc

SEQ ID NO: 69615 - DNA, 25 bp, Homo sapien
attcttacgagatgctggtcaccta

SEQ ID NO: 69616 - DNA, 25 bp, Homo sapien
tcccaactggggtcagatgtaggca

SEQ ID NO: 69617 - DNA, 25 bp, Homo sapien
actctcgtgaaactccagtgcccaa

SEQ ID NO: 69618 - DNA, 25 bp, Homo sapien
tcgcggagcaaacaccgagtggtgc

SEQ ID NO: 69619 - DNA, 25 bp, Homo sapien
ggggcgtccagacccgcacagaacg

SEQ ID NO: 69620 - DNA, 25 bp, Homo sapien
gctcctcaaaccagcagcagctaag

SEQ ID NO: 69621 - DNA, 25 bp, Homo sapien
gagactgccggggacacggaacaaa

SEQ ID NO: 69622 - DNA, 25 bp, Homo sapien
gacacggaacaaagcctccttcctg

SEQ ID NO: 69623 - DNA, 25 bp, Homo sapien
accgagtggtgctcgcttactcgcc

SEQ ID NO: 69624 - DNA, 25 bp, Homo sapien
ggcgcctcagcactctcgtgaaact

SEQ ID NO: 69625 - DNA, 25 bp, Homo sapien
ttttacagacaagagctccgcgacc

SEQ ID NO: 69626 - DNA, 25 bp, Homo sapien
ttatgctggacgacaaacccacgtc

SEQ ID NO: 69627 - DNA, 25 bp, Homo sapien
cccaaaggcgatgcttgccagtttc

SEQ ID NO: 69628 - DNA, 25 bp, Homo sapien
cttcgccaagcacgctcaagcggtt

SEQ ID NO: 69629 - DNA, 25 bp, Homo sapien
caagcggtttcgtgaactgggaaga

SEQ ID NO: 69630 - DNA, 25 bp, Homo sapien
cagcggaattcctgaggcccgagtc

SEQ ID NO: 69631 - DNA, 25 bp, Homo sapien
gctcctcgtcaaacggcaagccttg

SEQ ID NO: 69632 - DNA, 25 bp, Homo sapien
gcgtctcctagagataaacgttatg

SEQ ID NO: 69633 - DNA, 25 bp, Homo sapien
gctgggaggaaacctcacaaaaaca

SEQ ID NO: 69634 - DNA, 25 bp, Homo sapien
ccctcgaacctgctagttctggaca

SEQ ID NO: 69635 - DNA, 25 bp, Homo sapien
caggcgacgcgcaaaagttcccggt

SEQ ID NO: 69636 - DNA, 25 bp, Homo sapien
agacacgggccacgctcaggcgacg

SEQ ID NO: 69637 - DNA, 25 bp, Homo sapien
accctctagggagacacgggccacg

SEQ ID NO: 69638 - DNA, 25 bp, Homo sapien
gcggggccaccctctagggagacac

SEQ ID NO: 69639 - DNA, 25 bp, Homo sapien
gggtgaagcctgacgtccgcatccc

SEQ ID NO: 69640 - DNA, 25 bp, Homo sapien
gttctggacaccctgctgcagacta

SEQ ID NO: 69641 - DNA, 25 bp, Homo sapien
gggaccgactctatcagcccggttc

SEQ ID NO: 69642 - DNA, 25 bp, Homo sapien
agggcagggacctacaagcatttcc

SEQ ID NO: 69643 - DNA, 25 bp, Homo sapien
cggagggacacacccagctctgtaa

SEQ ID NO: 69644 - DNA, 25 bp, Homo sapien
agcctcacaggagcagggaccgact

SEQ ID NO: 69645 - DNA, 25 bp, Homo sapien
agctgcccggaaacagcagggattc

SEQ ID NO: 69646 - DNA, 25 bp, Homo sapien
tgggctcagactaccaggagacacg

SEQ ID NO: 69647 - DNA, 25 bp, Homo sapien
aggaccaggctctggaacccagctc

SEQ ID NO: 69648 - DNA, 25 bp, Homo sapien
gtctccgaacgctcacaggaccagg

SEQ ID NO: 69649 - DNA, 25 bp, Homo sapien
tctgggcacccattgtatgtcggtc

SEQ ID NO: 69650 - DNA, 25 bp, Homo sapien
tggatcctgttcagccacgggaagc

SEQ ID NO: 69651 - DNA, 25 bp, Homo sapien
tggtttcccgacctgaagaggcgcc

SEQ ID NO: 69652 - DNA, 25 bp, Homo sapien
ggaagccggcgtttgcacacatttt

SEQ ID NO: 69653 - DNA, 25 bp, Homo sapien
gctaaggcgacagcgctgccatttt

SEQ ID NO: 69654 - DNA, 25 bp, Homo sapien
cgacactagaggcaggcagtacttc

SEQ ID NO: 69655 - DNA, 25 bp, Homo sapien
agctggacacgaggcaccatgatca

SEQ ID NO: 69656 - DNA, 25 bp, Homo sapien
ttcggacgtcatattaaagcgcacc

SEQ ID NO: 69657 - DNA, 25 bp, Homo sapien
ctggcagggttcagccagctggtca

SEQ ID NO: 69658 - DNA, 25 bp, Homo sapien
ccgggaaggatcctgcgtaggtcaa

SEQ ID NO: 69659 - DNA, 25 bp, Homo sapien
ttccgccctcacagtagcggagatg

SEQ ID NO: 69660 - DNA, 25 bp, Homo sapien
agatgcgaaaagtcccacgccgggc

SEQ ID NO: 69661 - DNA, 25 bp, Homo sapien
tggtagttcggcctcatggttggcc

SEQ ID NO: 69662 - DNA, 25 bp, Homo sapien
ccgccggctgttagatgcctttgtc

SEQ ID NO: 69663 - DNA, 25 bp, Homo sapien
cttttaatctgagtgtccgggagga

SEQ ID NO: 69664 - DNA, 25 bp, Homo sapien
agcggcccttccagagtcgctggca

SEQ ID NO: 69665 - DNA, 25 bp, Homo sapien
cgcgcgtttccagaacgggagaact

SEQ ID NO: 69666 - DNA, 25 bp, Homo sapien
cgcctcgaagtttgccggctgactc

SEQ ID NO: 69667 - DNA, 25 bp, Homo sapien
tttggagaccaacttctgcattttc

SEQ ID NO: 69668 - DNA, 25 bp, Homo sapien
ccggctgactcggaaagttgcgctc

SEQ ID NO: 69669 - DNA, 25 bp, Homo sapien
gcgaccaagctctgttccgcagacg

SEQ ID NO: 69670 - DNA, 25 bp, Homo sapien
tcacgcagcaaagtcagcgaccaag

SEQ ID NO: 69671 - DNA, 25 bp, Homo sapien
cgagtccgtgactcgaccaaggtca

SEQ ID NO: 69672 - DNA, 25 bp, Homo sapien
gcccagtttaatctccggcggagga

SEQ ID NO: 69673 - DNA, 25 bp, Homo sapien
tcccaggcttctcggctgcaggaga

SEQ ID NO: 69674 - DNA, 25 bp, Homo sapien
agaattggccgctcgggtttagaag

SEQ ID NO: 69675 - DNA, 25 bp, Homo sapien
gcttctcggctgcaggagagatttc

SEQ ID NO: 69676 - DNA, 25 bp, Homo sapien
gtccagagacggtggccagcgtgcc

SEQ ID NO: 69677 - DNA, 25 bp, Homo sapien
tctcggctgcaggagagatttcgca

SEQ ID NO: 69678 - DNA, 25 bp, Homo sapien
tgcaggagagatttcgcaggagaca

SEQ ID NO: 69679 - DNA, 25 bp, Homo sapien
aggcgttcgagtgctgcgtccccca

SEQ ID NO: 69680 - DNA, 25 bp, Homo sapien
ttccagagaattggccgctcgggtt

SEQ ID NO: 69681 - DNA, 25 bp, Homo sapien
tccgggaccctcgcacggagcagaa

SEQ ID NO: 69682 - DNA, 25 bp, Homo sapien
tctccgggaccctcgcacggagcag

SEQ ID NO: 69683 - DNA, 25 bp, Homo sapien
gggaccctcgcacggagcagaagtc

SEQ ID NO: 69684 - DNA, 25 bp, Homo sapien
ccgggaccctcgcacggagcagaag

SEQ ID NO: 69685 - DNA, 25 bp, Homo sapien
agaagtcaccgactgtctccgggac

SEQ ID NO: 69686 - DNA, 25 bp, Homo sapien
ctccgggaccctcgcacggagcaga

SEQ ID NO: 69687 - DNA, 25 bp, Homo sapien
gtcaccgactgtctccgggaccctc

SEQ ID NO: 69688 - DNA, 25 bp, Homo sapien
cgggaccctcgcacggagcagaagt

SEQ ID NO: 69689 - DNA, 25 bp, Homo sapien
cgagctctaaccctacagcgcagga

SEQ ID NO: 69690 - DNA, 25 bp, Homo sapien
ggcggacctgtgtgagcactcacta

SEQ ID NO: 69691 - DNA, 25 bp, Homo sapien
ctgaccacacagacggggcggacct

SEQ ID NO: 69692 - DNA, 25 bp, Homo sapien
gagcgcagaactagtaccggatccc

SEQ ID NO: 69693 - DNA, 25 bp, Homo sapien
gcactcactaactgtcggggctgga

SEQ ID NO: 69694 - DNA, 25 bp, Homo sapien
gcgcccgcttttctctcgggtgatc

SEQ ID NO: 69695 - DNA, 25 bp, Homo sapien
ctagtggccattgcctgtgacgtca

SEQ ID NO: 69696 - DNA, 25 bp, Homo sapien
gctgaacccgtagcctgaagacccg

SEQ ID NO: 69697 - DNA, 25 bp, Homo sapien
gccagtgtagcggaaggctaaatac

SEQ ID NO: 69698 - DNA, 25 bp, Homo sapien
ttccaggcaggagttgtgactgtcc

SEQ ID NO: 69699 - DNA, 25 bp, Homo sapien
gttgtgactgtccttccctggaata

SEQ ID NO: 69700 - DNA, 25 bp, Homo sapien
cgtaggtgatcagaaaacagctgtc

SEQ ID NO: 69701 - DNA, 25 bp, Homo sapien
tcctcctgaggagctatgagttcca

SEQ ID NO: 69702 - DNA, 25 bp, Homo sapien
ctcgttctgatactgaggctgcata

SEQ ID NO: 69703 - DNA, 25 bp, Homo sapien
ttaaaggaaggcacctggagaccca

SEQ ID NO: 69704 - DNA, 25 bp, Homo sapien
ccgttaacctcctggctcgttctga

SEQ ID NO: 69705 - DNA, 25 bp, Homo sapien
ccagctccagcgtcaagatgccaga

SEQ ID NO: 69706 - DNA, 25 bp, Homo sapien
ccagcgtcaagatgccagaagaaca

SEQ ID NO: 69707 - DNA, 25 bp, Homo sapien
ccggcctgcaagacaccacgccctc

SEQ ID NO: 69708 - DNA, 25 bp, Homo sapien
cctcctctgctctgcgtggtgcgtg

SEQ ID NO: 69709 - DNA, 25 bp, Homo sapien
atagccgccaccatagtcgctgagg

SEQ ID NO: 69710 - DNA, 25 bp, Homo sapien
cgccaccatagtcgctgaggcaggc

SEQ ID NO: 69711 - DNA, 25 bp, Homo sapien
ggttgcatgcccactcgcctctgcc

SEQ ID NO: 69712 - DNA, 25 bp, Homo sapien
cagaagaacaagaacccagcgccgg

SEQ ID NO: 69713 - DNA, 25 bp, Homo sapien
atgtaaagaaaggaggtttctgccg

SEQ ID NO: 69714 - DNA, 25 bp, Homo sapien
ggaacgcagccctaaatacagctgc

SEQ ID NO: 69715 - DNA, 25 bp, Homo sapien
gtaaccccacactgacgtcaactgg

SEQ ID NO: 69716 - DNA, 25 bp, Homo sapien
ttagctgagtaaccccacactgacg

SEQ ID NO: 69717 - DNA, 25 bp, Homo sapien
catagcctgggacgactctgtaccc

SEQ ID NO: 69718 - DNA, 25 bp, Homo sapien
agcatagcctgggacgactctgtac

SEQ ID NO: 69719 - DNA, 25 bp, Homo sapien
tgcagcatagcctgggacgactctg

SEQ ID NO: 69720 - DNA, 25 bp, Homo sapien
gaacgcagccctaaatacagctgca

SEQ ID NO: 69721 - DNA, 25 bp, Homo sapien
ccagtaggtgcaggctgggtcggcc

SEQ ID NO: 69722 - DNA, 25 bp, Homo sapien
cgccgccaaagcctcgacggcggtc

SEQ ID NO: 69723 - DNA, 25 bp, Homo sapien
tcactcacctcgggcgccagtaggt

SEQ ID NO: 69724 - DNA, 25 bp, Homo sapien
gctgcctgtctcttatagaagcggg

SEQ ID NO: 69725 - DNA, 25 bp, Homo sapien
tgtctcttatagaagcgggcgtcgg

SEQ ID NO: 69726 - DNA, 25 bp, Homo sapien
tctcttatagaagcgggcgtcggag

SEQ ID NO: 69727 - DNA, 25 bp, Homo sapien
cgcgcctgccaagcgccgccaaagc

SEQ ID NO: 69728 - DNA, 25 bp, Homo sapien
cctgtctcttatagaagcgggcgtc

SEQ ID NO: 69729 - DNA, 25 bp, Homo sapien
aagggcagcataaaggcagcggcca

SEQ ID NO: 69730 - DNA, 25 bp, Homo sapien
gccgctggctccacaaaggcctccc

SEQ ID NO: 69731 - DNA, 25 bp, Homo sapien
agggcagcataaaggcagcggccac

SEQ ID NO: 69732 - DNA, 25 bp, Homo sapien
agagtagcataagccgctcggccta

SEQ ID NO: 69733 - DNA, 25 bp, Homo sapien
cgcagagtagcataagccgctcggc

SEQ ID NO: 69734 - DNA, 25 bp, Homo sapien
tgccccgagagcaccttgtgctggg

SEQ ID NO: 69735 - DNA, 25 bp, Homo sapien
ctagcggccgctggctccacaaagg

SEQ ID NO: 69736 - DNA, 25 bp, Homo sapien
gggcgcagagtagcataagccgctc

SEQ ID NO: 69737 - DNA, 25 bp, Homo sapien
gcctgcctcagcgactatggtggcg

SEQ ID NO: 69738 - DNA, 25 bp, Homo sapien
cctcagcgactatggtggcggctat

SEQ ID NO: 69739 - DNA, 25 bp, Homo sapien
cacgcaccacgcagagcagaggagg

SEQ ID NO: 69740 - DNA, 25 bp, Homo sapien
gctgggttcttgttcttctggcatc

SEQ ID NO: 69741 - DNA, 25 bp, Homo sapien
tcttgttcttctggcatcttgacgc

SEQ ID NO: 69742 - DNA, 25 bp, Homo sapien
tctggcatcttgacgctggagctgg

SEQ ID NO: 69743 - DNA, 25 bp, Homo sapien
ggcagaggcgagtgggcatgcaacc

SEQ ID NO: 69744 - DNA, 25 bp, Homo sapien
tcttctggcatcttgacgctggagc

SEQ ID NO: 69745 - DNA, 25 bp, Homo sapien
gacagctgttttctgatcacctacg

SEQ ID NO: 69746 - DNA, 25 bp, Homo sapien
ggatccttctttttatgcagcctca

SEQ ID NO: 69747 - DNA, 25 bp, Homo sapien
agtatttagccttccgctacactgg

SEQ ID NO: 69748 - DNA, 25 bp, Homo sapien
tgggtctccaggtgccttcctttaa

SEQ ID NO: 69749 - DNA, 25 bp, Homo sapien
tcagtatcagaacgagccaggaggt

SEQ ID NO: 69750 - DNA, 25 bp, Homo sapien
ttccagggaaggacagtcacaactc

SEQ ID NO: 69751 - DNA, 25 bp, Homo sapien
agtcacaactcctgcctggaactca

SEQ ID NO: 69752 - DNA, 25 bp, Homo sapien
tggaactcatagctcctcaggagga

SEQ ID NO: 69753 - DNA, 25 bp, Homo sapien
gccacgttgagtgtcgcagagtacg

SEQ ID NO: 69754 - DNA, 25 bp, Homo sapien
cgcctgtcacgggtctgacgaggaa

SEQ ID NO: 69755 - DNA, 25 bp, Homo sapien
actggaaaacggagcaggccatccc

SEQ ID NO: 69756 - DNA, 25 bp, Homo sapien
agcgcgcatcccaattggctctcgg

SEQ ID NO: 69757 - DNA, 25 bp, Homo sapien
ttcccttgagcagtccacgccttgt

SEQ ID NO: 69758 - DNA, 25 bp, Homo sapien
ccaggggctttcctgcttcaagagc

SEQ ID NO: 69759 - DNA, 25 bp, Homo sapien
ccttcgcacatcttggggtagctcg

SEQ ID NO: 69760 - DNA, 25 bp, Homo sapien
tgggcaatccgctccttcccttgag

SEQ ID NO: 69761 - DNA, 25 bp, Homo sapien
tggtctctaagattccttccagctc

SEQ ID NO: 69762 - DNA, 25 bp, Homo sapien
cggctccttgtcatccataatggtc

SEQ ID NO: 69763 - DNA, 25 bp, Homo sapien
aatacatggtctctaagattccttc

SEQ ID NO: 69764 - DNA, 25 bp, Homo sapien
tgtcatccataatggtcggctgcaa

SEQ ID NO: 69765 - DNA, 25 bp, Homo sapien
gctccttgtcatccataatggtcgg

SEQ ID NO: 69766 - DNA, 25 bp, Homo sapien
ccttgtcatccataatggtcggctg

SEQ ID NO: 69767 - DNA, 25 bp, Homo sapien
gggccacctcttcggctccttgtca

SEQ ID NO: 69768 - DNA, 25 bp, Homo sapien
cttcggctccttgtcatccataatg

SEQ ID NO: 69769 - DNA, 25 bp, Homo sapien
cggagggcagaactagaaccaggtt

SEQ ID NO: 69770 - DNA, 25 bp, Homo sapien
tgcacacccacgtttcaggctactg

SEQ ID NO: 69771 - DNA, 25 bp, Homo sapien
ctcactaattgcaggggacgaagct

SEQ ID NO: 69772 - DNA, 25 bp, Homo sapien
cggccgtttccgaccacacggatgg

SEQ ID NO: 69773 - DNA, 25 bp, Homo sapien
cgagccctaactcagcgcaggagga

SEQ ID NO: 69774 - DNA, 25 bp, Homo sapien
tgacttcgccgctgctgtagttccc

SEQ ID NO: 69775 - DNA, 25 bp, Homo sapien
cgcttctcgctggagtgcgcaccga

SEQ ID NO: 69776 - DNA, 25 bp, Homo sapien
gcggacccatgtgagccctcactaa

SEQ ID NO: 69777 - DNA, 25 bp, Homo sapien
caccacactccagaaagttcgttca

SEQ ID NO: 69778 - DNA, 25 bp, Homo sapien
gttcaccacgctccggaaagctcgt

SEQ ID NO: 69779 - DNA, 25 bp, Homo sapien
gaaagctcgttcaccacactccaga

SEQ ID NO: 69780 - DNA, 25 bp, Homo sapien
gttcaccacgctccagaaagctcgt

SEQ ID NO: 69781 - DNA, 25 bp, Homo sapien
tccagaaagctcgttcaccacaatc

SEQ ID NO: 69782 - DNA, 25 bp, Homo sapien
agcgcgttcaccacgctccagaaag

SEQ ID NO: 69783 - DNA, 25 bp, Homo sapien
ttcaccacgctccagaaagctcgtt

SEQ ID NO: 69784 - DNA, 25 bp, Homo sapien
gttcaccacactccagaaagctcgt

SEQ ID NO: 69785 - DNA, 25 bp, Homo sapien
gcttcctcgtcagacccgtgacagg

SEQ ID NO: 69786 - DNA, 25 bp, Homo sapien
cgtactctgcgacactcaacgtggc

SEQ ID NO: 69787 - DNA, 25 bp, Homo sapien
ccgccacaaggcgtggactgctcaa

SEQ ID NO: 69788 - DNA, 25 bp, Homo sapien
ggccgctcagaccaggctcttgaag

SEQ ID NO: 69789 - DNA, 25 bp, Homo sapien
ggcaaagcggggctctccacaacac

SEQ ID NO: 69790 - DNA, 25 bp, Homo sapien
cctgcccgacatcaggtcctggatg

SEQ ID NO: 69791 - DNA, 25 bp, Homo sapien
atggcctgctccgttttccagtcgg

SEQ ID NO: 69792 - DNA, 25 bp, Homo sapien
cccaagatgtgcgaagggcacctgc

SEQ ID NO: 69793 - DNA, 25 bp, Homo sapien
ttgccgaagatggtaaagagaatga

SEQ ID NO: 69794 - DNA, 25 bp, Homo sapien
agcgagcggctggtcaacacagcca

SEQ ID NO: 69795 - DNA, 25 bp, Homo sapien
gatgaccagagcgttgccgaagatg

SEQ ID NO: 69796 - DNA, 25 bp, Homo sapien
tgatggccgccgctatggccgctgt

SEQ ID NO: 69797 - DNA, 25 bp, Homo sapien
cccggctcggctagacaagagcgtc

SEQ ID NO: 69798 - DNA, 25 bp, Homo sapien
gtcgggaacacccaggaccagcagc

SEQ ID NO: 69799 - DNA, 25 bp, Homo sapien
acaccaggaacaggttctgaggggc

SEQ ID NO: 69800 - DNA, 25 bp, Homo sapien
tgcgcaccgtggacgacagcgctgc

SEQ ID NO: 69801 - DNA, 25 bp, Homo sapien
aagagcacgatcagcagggaaagcc

SEQ ID NO: 69802 - DNA, 25 bp, Homo sapien
ggggtcaatactcacctggtcgtag

SEQ ID NO: 69803 - DNA, 25 bp, Homo sapien
cctcagagcacagatcgggacagca

SEQ ID NO: 69804 - DNA, 25 bp, Homo sapien
gcttgctcacctcgcaggaagtaca

SEQ ID NO: 69805 - DNA, 25 bp, Homo sapien
agcagcgcgttccaaggcactggcc

SEQ ID NO: 69806 - DNA, 25 bp, Homo sapien
cggggcaccatacaagggcagagca

SEQ ID NO: 69807 - DNA, 25 bp, Homo sapien
tacccggagtcggagggactagcac

SEQ ID NO: 69808 - DNA, 25 bp, Homo sapien
cctggtcgtagacaggagccctgga

SEQ ID NO: 69809 - DNA, 25 bp, Homo sapien
gactttgtcgcgtcccgcgcttgaa

SEQ ID NO: 69810 - DNA, 25 bp, Homo sapien
gggttgcggtccatgactttgtcgc

SEQ ID NO: 69811 - DNA, 25 bp, Homo sapien
ccggcgaaacgcaaggagcaaggtc

SEQ ID NO: 69812 - DNA, 25 bp, Homo sapien
tgtagaccgtgctccctatgcagtc

SEQ ID NO: 69813 - DNA, 25 bp, Homo sapien
cgccgaagagccagtgtttgctgta

SEQ ID NO: 69814 - DNA, 25 bp, Homo sapien
atgagtccgctgaggacgccgaaga

SEQ ID NO: 69815 - DNA, 25 bp, Homo sapien
caaggagcaaggtcccgcagcgcac

SEQ ID NO: 69816 - DNA, 25 bp, Homo sapien
ggcgcgagtttccacacctggatga

SEQ ID NO: 69817 - DNA, 25 bp, Homo sapien
acgccgccatcaaggcagaggcatg

SEQ ID NO: 69818 - DNA, 25 bp, Homo sapien
cactgattggccagaagcgccagca

SEQ ID NO: 69819 - DNA, 25 bp, Homo sapien
aggagccgccgctcatctgtctctg

SEQ ID NO: 69820 - DNA, 25 bp, Homo sapien
cagccaccgctgaggaagagtctcc

SEQ ID NO: 69821 - DNA, 25 bp, Homo sapien
gatggctccgcgactgctacaccag

SEQ ID NO: 69822 - DNA, 25 bp, Homo sapien
agcagaccagtcagccctgtggctc

SEQ ID NO: 69823 - DNA, 25 bp, Homo sapien
attggcgccgtgaagtgctcgtcac

SEQ ID NO: 69824 - DNA, 25 bp, Homo sapien
gcattggagagtgaccctcggaccc

SEQ ID NO: 69825 - DNA, 25 bp, Homo sapien
atggtgctgctcagcccagtcacgg

SEQ ID NO: 69826 - DNA, 25 bp, Homo sapien
ctgtcagggttgacaccagaggata

SEQ ID NO: 69827 - DNA, 25 bp, Homo sapien
ggggatcggctactgctagagcaaa

SEQ ID NO: 69828 - DNA, 25 bp, Homo sapien
ctgctagagcaaagacccggagtca

SEQ ID NO: 69829 - DNA, 25 bp, Homo sapien
tggaggatagcaacgctccgggttc

SEQ ID NO: 69830 - DNA, 25 bp, Homo sapien
cagggtctcagccagaggatgccga

SEQ ID NO: 69831 - DNA, 25 bp, Homo sapien
ggggccgatgcacttccggcttcct

SEQ ID NO: 69832 - DNA, 25 bp, Homo sapien
cgacctgtgcgcagaaaagaccctc

SEQ ID NO: 69833 - DNA, 25 bp, Homo sapien
tctggccgcccgctggcactaagga

SEQ ID NO: 69834 - DNA, 25 bp, Homo sapien
caccgccttgtactcgtattgcaga

SEQ ID NO: 69835 - DNA, 25 bp, Homo sapien
tacgggcggttacatccgccatggc

SEQ ID NO: 69836 - DNA, 25 bp, Homo sapien
gctgctcggaggcttcagaccacca

SEQ ID NO: 69837 - DNA, 25 bp, Homo sapien
cggaacgacgcaggaaagacgcact

SEQ ID NO: 69838 - DNA, 25 bp, Homo sapien
tgcaaacggccgcagatctctgctc

SEQ ID NO: 69839 - DNA, 25 bp, Homo sapien
taccgcaagctgcaaacggccgcag

SEQ ID NO: 69840 - DNA, 25 bp, Homo sapien
tccgcacccttctgagcgggatatg

SEQ ID NO: 69841 - DNA, 25 bp, Homo sapien
acgagcgctcgctgcaatcacatga

SEQ ID NO: 69842 - DNA, 25 bp, Homo sapien
cggggcttgccagcacgatttacaa

SEQ ID NO: 69843 - DNA, 25 bp, Homo sapien
agtgcgtctcctttttcattccgaa

SEQ ID NO: 69844 - DNA, 25 bp, Homo sapien
gcgcaaagcgtctctagcggtccta

SEQ ID NO: 69845 - DNA, 25 bp, Homo sapien
cttccttctagggaccggtagctca

SEQ ID NO: 69846 - DNA, 25 bp, Homo sapien
ccagatcggtcgaaggcaggtcttc

SEQ ID NO: 69847 - DNA, 25 bp, Homo sapien
taatgcggtcactagagcctcgatg

SEQ ID NO: 69848 - DNA, 25 bp, Homo sapien
ggtcctaggcgcacctgtttctgta

SEQ ID NO: 69849 - DNA, 25 bp, Homo sapien
agccagacgttcagacgctcggaca

SEQ ID NO: 69850 - DNA, 25 bp, Homo sapien
gcggtcaggccgcgctgtctcttta

SEQ ID NO: 69851 - DNA, 25 bp, Homo sapien
ccctgccgggaaaaaagcagtggcg

SEQ ID NO: 69852 - DNA, 25 bp, Homo sapien
ccaccctgccgggaaaaaagcagtg

SEQ ID NO: 69853 - DNA, 25 bp, Homo sapien
aagcatggtctataacccaggaaag

SEQ ID NO: 69854 - DNA, 25 bp, Homo sapien
gacgctcggacaagcatggtctata

SEQ ID NO: 69855 - DNA, 25 bp, Homo sapien
gcgctcagccagacgttcagacgct

SEQ ID NO: 69856 - DNA, 25 bp, Homo sapien
ctcggacaagcatggtctataaccc

SEQ ID NO: 69857 - DNA, 25 bp, Homo sapien
ggcggaccttgtgcgctcagccaat

SEQ ID NO: 69858 - DNA, 25 bp, Homo sapien
aaaccagctcaggagacgccaagga

SEQ ID NO: 69859 - DNA, 25 bp, Homo sapien
gatatgctcagctcgggtcttggcc

SEQ ID NO: 69860 - DNA, 25 bp, Homo sapien
gacgccaaggaaagatgggacctcc

SEQ ID NO: 69861 - DNA, 25 bp, Homo sapien
gacgcgcgcgatttaaaaccagctc

SEQ ID NO: 69862 - DNA, 25 bp, Homo sapien
gtcacgcggccgttacggcgctcag

SEQ ID NO: 69863 - DNA, 25 bp, Homo sapien
ctcaggcgtctcgacgcgcgcgatt

SEQ ID NO: 69864 - DNA, 25 bp, Homo sapien
ccctagcgaagcagtacttcgggcg

SEQ ID NO: 69865 - DNA, 25 bp, Homo sapien
cagccggcgttgaccttggcgaaga

SEQ ID NO: 69866 - DNA, 25 bp, Homo sapien
ttgaccttggcgaagaggcagccgc

SEQ ID NO: 69867 - DNA, 25 bp, Homo sapien
tccaggcgcgtgaagcccacgcgga

SEQ ID NO: 69868 - DNA, 25 bp, Homo sapien
gcaccggccgctggctgaacacgat

SEQ ID NO: 69869 - DNA, 25 bp, Homo sapien
gctggctgaacacgatgccgtcgtg

SEQ ID NO: 69870 - DNA, 25 bp, Homo sapien
cgcgatgcagccacgcgtgtccaga

SEQ ID NO: 69871 - DNA, 25 bp, Homo sapien
acgcgtgtccagacgcacctgtgcg

SEQ ID NO: 69872 - DNA, 25 bp, Homo sapien
cctcggcatggaagcgaagtgcctc

SEQ ID NO: 69873 - DNA, 25 bp, Homo sapien
gcgctggcagcttttcatggctcta

SEQ ID NO: 69874 - DNA, 25 bp, Homo sapien
tggctctaatttcccgaggactctg

SEQ ID NO: 69875 - DNA, 25 bp, Homo sapien
ccatatgtcattggggcgccgcgct

SEQ ID NO: 69876 - DNA, 25 bp, Homo sapien
gagcacacacgctggccatatgtca

SEQ ID NO: 69877 - DNA, 25 bp, Homo sapien
gcaacatcggcggatgcagagcaca

SEQ ID NO: 69878 - DNA, 25 bp, Homo sapien
ccggagagcaccacccggggagcaa

SEQ ID NO: 69879 - DNA, 25 bp, Homo sapien
gagggtggcactagctgacccagcc

SEQ ID NO: 69880 - DNA, 25 bp, Homo sapien
cggtcttcattagcagcgggtcaca

SEQ ID NO: 69881 - DNA, 25 bp, Homo sapien
agggacgcctacctatgacacttgc

SEQ ID NO: 69882 - DNA, 25 bp, Homo sapien
cacatgtcttcacgcaggttatctc

SEQ ID NO: 69883 - DNA, 25 bp, Homo sapien
ccaacctggggcactgtcaggcagc

SEQ ID NO: 69884 - DNA, 25 bp, Homo sapien
cgccgggccaaaatctcagagggca

SEQ ID NO: 69885 - DNA, 25 bp, Homo sapien
cccgctgcaaacctttgctctgaga

SEQ ID NO: 69886 - DNA, 25 bp, Homo sapien
ctggcacacgaggaagccactgctg

SEQ ID NO: 69887 - DNA, 25 bp, Homo sapien
tgcagtcggcctctcttgcccagag

SEQ ID NO: 69888 - DNA, 25 bp, Homo sapien
ggcgccgaggctcactataccgcag

SEQ ID NO: 69889 - DNA, 25 bp, Homo sapien
cgtcctgagaacccgagagagcagg

SEQ ID NO: 69890 - DNA, 25 bp, Homo sapien
ctttttgagtcagatccggcggcag

SEQ ID NO: 69891 - DNA, 25 bp, Homo sapien
attctttcggtttgagccagctccc

SEQ ID NO: 69892 - DNA, 25 bp, Homo sapien
cgaattattctttcggtttgagcca

SEQ ID NO: 69893 - DNA, 25 bp, Homo sapien
ggcgctttggctaaccgaattattc

SEQ ID NO: 69894 - DNA, 25 bp, Homo sapien
gccagaaaagcgctttctgaaaccc

SEQ ID NO: 69895 - DNA, 25 bp, Homo sapien
acacgacggtccggcagcagagcct

SEQ ID NO: 69896 - DNA, 25 bp, Homo sapien
aaatatcggcgctttggctaaccga

SEQ ID NO: 69897 - DNA, 25 bp, Homo sapien
tggccctcatgaagtaccacggctg

SEQ ID NO: 69898 - DNA, 25 bp, Homo sapien
ccacggctggatcgtgcagatcttc

SEQ ID NO: 69899 - DNA, 25 bp, Homo sapien
tgcagatcttccaggcagcactgta

SEQ ID NO: 69900 - DNA, 25 bp, Homo sapien
tgtacgcagcctcctgtaagtccga

SEQ ID NO: 69901 - DNA, 25 bp, Homo sapien
aaagcgctctccaaggggcagaatg

SEQ ID NO: 69902 - DNA, 25 bp, Homo sapien
agtgcctggaaaagatccgcctctt

SEQ ID NO: 69903 - DNA, 25 bp, Homo sapien
atggcgaccatcgatgtcatctacg

SEQ ID NO: 69904 - DNA, 25 bp, Homo sapien
cgtatacccagatgaacgctgagct

SEQ ID NO: 69905 - DNA, 25 bp, Homo sapien
gcgcgggtgtgaagaacttgctcaa

SEQ ID NO: 69906 - DNA, 25 bp, Homo sapien
ctgggctcagctaatttgttgtgac

SEQ ID NO: 69907 - DNA, 25 bp, Homo sapien
cggtttccacctcgagctgggctca

SEQ ID NO: 69908 - DNA, 25 bp, Homo sapien
gtcgtcccacttcctgctgcggttt

SEQ ID NO: 69909 - DNA, 25 bp, Homo sapien
actcttttcgccgtctcttgcctga

SEQ ID NO: 69910 - DNA, 25 bp, Homo sapien
tccgcgcgagcttcgagaaaaggaa

SEQ ID NO: 69911 - DNA, 25 bp, Homo sapien
atgcgctttgtaggatccactgttc

SEQ ID NO: 69912 - DNA, 25 bp, Homo sapien
ccttgtcttccctcggtctgcagaa

SEQ ID NO: 69913 - DNA, 25 bp, Homo sapien
cacgaggtgcccttgcaggtgaccg

SEQ ID NO: 69914 - DNA, 25 bp, Homo sapien
tgcagtccttcgagtccctgcgagg

SEQ ID NO: 69915 - DNA, 25 bp, Homo sapien
gcagctgccaaactgcagtccttcg

SEQ ID NO: 69916 - DNA, 25 bp, Homo sapien
gtatgcgccgtcctcagagctgcgg

SEQ ID NO: 69917 - DNA, 25 bp, Homo sapien
tctggaagaacgtgtacgacgagct

SEQ ID NO: 69918 - DNA, 25 bp, Homo sapien
acgcgccgccactacgagaggtacg

SEQ ID NO: 69919 - DNA, 25 bp, Homo sapien
ctgcggggctttggccgaccttgcc

SEQ ID NO: 69920 - DNA, 25 bp, Homo sapien
cgcctctggaagaacgtgtacgacg

SEQ ID NO: 69921 - DNA, 25 bp, Homo sapien
aagcgcgtgcgcgttaacgcctcca

SEQ ID NO: 69922 - DNA, 25 bp, Homo sapien
aacggatgaagctccggcgcctctg

SEQ ID NO: 69923 - DNA, 25 bp, Homo sapien
tccggaagaggagagccaagaacac

SEQ ID NO: 69924 - DNA, 25 bp, Homo sapien
gaggactaggctggcttctacggcc

SEQ ID NO: 69925 - DNA, 25 bp, Homo sapien
gcgagcatgtccgaagcagaaagtc

SEQ ID NO: 69926 - DNA, 25 bp, Homo sapien
accgtgttggtcctttgtgccctct

SEQ ID NO: 69927 - DNA, 25 bp, Homo sapien
agtcaacaactaggctggagtttcc

SEQ ID NO: 69928 - DNA, 25 bp, Homo sapien
ctcgcgcatattcagtagggaaagc

SEQ ID NO: 69929 - DNA, 25 bp, Homo sapien
gcgcctcaccctggtagggcttcga

SEQ ID NO: 69930 - DNA, 25 bp, Homo sapien
ttcgacagcgagtgctcccgtttca

SEQ ID NO: 69931 - DNA, 25 bp, Homo sapien
agtgctcccgtttcaagtactcgaa

SEQ ID NO: 69932 - DNA, 25 bp, Homo sapien
tcaagtactcgaacgtttgacccgc

SEQ ID NO: 69933 - DNA, 25 bp, Homo sapien
agccatctgccctgcgtcctattgg

SEQ ID NO: 69934 - DNA, 25 bp, Homo sapien
acccattggcccgaagagccatctg

SEQ ID NO: 69935 - DNA, 25 bp, Homo sapien
gagtaacatcctggacccatcccga

SEQ ID NO: 69936 - DNA, 25 bp, Homo sapien
cgtcctattggctttcgtcaagccc

SEQ ID NO: 69937 - DNA, 25 bp, Homo sapien
ccgaggaacaggaacggcgtagcta

SEQ ID NO: 69938 - DNA, 25 bp, Homo sapien
gctgctccaccttaagcgactgtac

SEQ ID NO: 69939 - DNA, 25 bp, Homo sapien
acaggaacggcgtagctaggagacc

SEQ ID NO: 69940 - DNA, 25 bp, Homo sapien
cggcgtagctaggagaccaggtccc

SEQ ID NO: 69941 - DNA, 25 bp, Homo sapien
tcccggagaaggagagctggcccca

SEQ ID NO: 69942 - DNA, 25 bp, Homo sapien
gctggccccactggcagagaaaggc

SEQ ID NO: 69943 - DNA, 25 bp, Homo sapien
gcgctgctccaccttaagcgactgt

SEQ ID NO: 69944 - DNA, 25 bp, Homo sapien
cccttaagggcgggcgctcaagcag

SEQ ID NO: 69945 - DNA, 25 bp, Homo sapien
tcaccaaggacctggtcgtccagca

SEQ ID NO: 69946 - DNA, 25 bp, Homo sapien
tggtcgtccagcagctggtcaacgt

SEQ ID NO: 69947 - DNA, 25 bp, Homo sapien
tggtcaacgtgagccgcgggaacac

SEQ ID NO: 69948 - DNA, 25 bp, Homo sapien
gctggtggtgctcaccaagttcctc

SEQ ID NO: 69949 - DNA, 25 bp, Homo sapien
gtgctcaccaagttcctccggagga

SEQ ID NO: 69950 - DNA, 25 bp, Homo sapien
tcctccggaggagcgagagcatgaa

SEQ ID NO: 69951 - DNA, 25 bp, Homo sapien
catgaagctgtatgcactgtgcacc

SEQ ID NO: 69952 - DNA, 25 bp, Homo sapien
ccagctgcctcgagctcaccaagga

SEQ ID NO: 69953 - DNA, 25 bp, Homo sapien
cccggcgcagcctagtccgaccctg

SEQ ID NO: 69954 - DNA, 25 bp, Homo sapien
cgggcttcgccaacagctcttggtc

SEQ ID NO: 69955 - DNA, 25 bp, Homo sapien
cctgcgcctcttcggcccgggcttc

SEQ ID NO: 69956 - DNA, 25 bp, Homo sapien
ttaggctggttgttcgccgcgctct

SEQ ID NO: 69957 - DNA, 25 bp, Homo sapien
cgaagagccgtaacgattggcccgg

SEQ ID NO: 69958 - DNA, 25 bp, Homo sapien
cgcgaagagccgtaacgattggccc

SEQ ID NO: 69959 - DNA, 25 bp, Homo sapien
gcccaccgcctattggccgaggagg

SEQ ID NO: 69960 - DNA, 25 bp, Homo sapien
ttcgccaacagctcttggtcctggg

SEQ ID NO: 69961 - DNA, 25 bp, Homo sapien
gagcaacggtgtgggtcagtccctt

SEQ ID NO: 69962 - DNA, 25 bp, Homo sapien
aggcagtcaagcttctgcctccgcg

SEQ ID NO: 69963 - DNA, 25 bp, Homo sapien
cggatgccgcgctgccagtctcgag

SEQ ID NO: 69964 - DNA, 25 bp, Homo sapien
cagtctcgagccagctgcaccgggg

SEQ ID NO: 69965 - DNA, 25 bp, Homo sapien
gggtcagtcccttgcaggcgctcca

SEQ ID NO: 69966 - DNA, 25 bp, Homo sapien
ttcatggctttgtagctgccgtgcc

SEQ ID NO: 69967 - DNA, 25 bp, Homo sapien
cccatagagcagcagtagcttcatg

SEQ ID NO: 69968 - DNA, 25 bp, Homo sapien
tcctgctgagaacgcaggcagtcaa

SEQ ID NO: 69969 - DNA, 25 bp, Homo sapien
gctgaccgagctgagggcctactgt

SEQ ID NO: 69970 - DNA, 25 bp, Homo sapien
cactgaccgagctgagggcctactg

SEQ ID NO: 69971 - DNA, 25 bp, Homo sapien
gcactgaccgagctgagggcctact

SEQ ID NO: 69972 - DNA, 25 bp, Homo sapien
tgctgaccgagctgagggcctactg

SEQ ID NO: 69973 - DNA, 25 bp, Homo sapien
tgaccgagctgagggcctactgtgt

SEQ ID NO: 69974 - DNA, 25 bp, Homo sapien
ctgaccgagctgagggcctactgtg

SEQ ID NO: 69975 - DNA, 25 bp, Homo sapien
gtgctgaccgagctgagggcctact

SEQ ID NO: 69976 - DNA, 25 bp, Homo sapien
actgaccgagctgagggcctactgt

SEQ ID NO: 69977 - DNA, 25 bp, Homo sapien
ttacggaaaccagtgcttccgcttc

SEQ ID NO: 69978 - DNA, 25 bp, Homo sapien
cgagaaccaattgcaacggtagggc

SEQ ID NO: 69979 - DNA, 25 bp, Homo sapien
gagctttcccgttaccttcgccatg

SEQ ID NO: 69980 - DNA, 25 bp, Homo sapien
gcgtccaaggccaagcgaggactga

SEQ ID NO: 69981 - DNA, 25 bp, Homo sapien
ctaggccttagctcgagaaccaatt

SEQ ID NO: 69982 - DNA, 25 bp, Homo sapien
ctgaccaatcaaacgcctaggcctt

SEQ ID NO: 69983 - DNA, 25 bp, Homo sapien
tccagcgtctgctgtacgccgagca

SEQ ID NO: 69984 - DNA, 25 bp, Homo sapien
gaggctctcagtacacgggaaccgt

SEQ ID NO: 69985 - DNA, 25 bp, Homo sapien
ccggcaaaagggaactgcgacttct

SEQ ID NO: 69986 - DNA, 25 bp, Homo sapien
cgcctctcgcggtgctaaaaggatg

SEQ ID NO: 69987 - DNA, 25 bp, Homo sapien
ccgcctttgacctagcttcaggaga

SEQ ID NO: 69988 - DNA, 25 bp, Homo sapien
tcaggagattactttccgggtcagc

SEQ ID NO: 69989 - DNA, 25 bp, Homo sapien
atgcgtgtgtgtcaagcgtatgccc

SEQ ID NO: 69990 - DNA, 25 bp, Homo sapien
accaaaatagctcggcgggcacttc

SEQ ID NO: 69991 - DNA, 25 bp, Homo sapien
ggagcatgtgcttcactgccagttc

SEQ ID NO: 69992 - DNA, 25 bp, Homo sapien
ccgttcttccgaggcgttaccatca

SEQ ID NO: 69993 - DNA, 25 bp, Homo sapien
cgcgcggaatcagttgagtctcttc

SEQ ID NO: 69994 - DNA, 25 bp, Homo sapien
tcctgcggtgggtatttgtccggct

SEQ ID NO: 69995 - DNA, 25 bp, Homo sapien
aaggaccgggctcccctcgcatatg

SEQ ID NO: 69996 - DNA, 25 bp, Homo sapien
ccctcgcatatggttggagagaggt

SEQ ID NO: 69997 - DNA, 25 bp, Homo sapien
ctttctcctgcggtgggtatttgtc

SEQ ID NO: 69998 - DNA, 25 bp, Homo sapien
cgcgcgcggaatcagttgagtctct

SEQ ID NO: 69999 - DNA, 25 bp, Homo sapien
agttgagtctcttcggttcccggct

SEQ ID NO: 70000 - DNA, 25 bp, Homo sapien
ttggagagaggtgaaacgcgcccag

SEQ ID NO: 70001 - DNA, 25 bp, Homo sapien
ggagccggcaaagagcagcttctgc

SEQ ID NO: 70002 - DNA, 25 bp, Homo sapien
tgttgacgctccaggcgcaataggg

SEQ ID NO: 70003 - DNA, 25 bp, Homo sapien
cccgggcgaggacacagtctgcaca

SEQ ID NO: 70004 - DNA, 25 bp, Homo sapien
gtctgcacaggagcgatacttcatg

SEQ ID NO: 70005 - DNA, 25 bp, Homo sapien
cacaggagcgatacttcatgcagtc

SEQ ID NO: 70006 - DNA, 25 bp, Homo sapien
tacttcatgcagtcggccacgggca

SEQ ID NO: 70007 - DNA, 25 bp, Homo sapien
acgggcagctgcaccagctgagagc

SEQ ID NO: 70008 - DNA, 25 bp, Homo sapien
cacacagcggctggtgttgacgctc

SEQ ID NO: 70009 - DNA, 25 bp, Homo sapien
tgagactcggtaccttgcagacacg

SEQ ID NO: 70010 - DNA, 25 bp, Homo sapien
gaagaagtagaccttgtcgtcgtcc

SEQ ID NO: 70011 - DNA, 25 bp, Homo sapien
ctccctgaagaagaagtagaccttg

SEQ ID NO: 70012 - DNA, 25 bp, Homo sapien
tcggtaccttgcagacacgggccac

SEQ ID NO: 70013 - DNA, 25 bp, Homo sapien
ggcccaccgctgtgagactcggtac

SEQ ID NO: 70014 - DNA, 25 bp, Homo sapien
gcaaggggacactgccggtcagccc

SEQ ID NO: 70015 - DNA, 25 bp, Homo sapien
aggaacgtggtccacttcctctgca

SEQ ID NO: 70016 - DNA, 25 bp, Homo sapien
tgctcggcatagcagtcggactcca

SEQ ID NO: 70017 - DNA, 25 bp, Homo sapien
agcctcacgcaagcccggcctcgct

SEQ ID NO: 70018 - DNA, 25 bp, Homo sapien
ctcgctcacctattgcgcgcagctc

SEQ ID NO: 70019 - DNA, 25 bp, Homo sapien
cccagctccagggatttgaacgcaa

SEQ ID NO: 70020 - DNA, 25 bp, Homo sapien
gggaaatccgatcccacaacatcgg

SEQ ID NO: 70021 - DNA, 25 bp, Homo sapien
gccgcggcagggaaatccgatccca

SEQ ID NO: 70022 - DNA, 25 bp, Homo sapien
tctcggctccttacccgaggatcgg

SEQ ID NO: 70023 - DNA, 25 bp, Homo sapien
ttgaacgcaaacaaagcggcggcgc

SEQ ID NO: 70024 - DNA, 25 bp, Homo sapien
cccactcccgagaccctgcgaagca

SEQ ID NO: 70025 - DNA, 25 bp, Homo sapien
caggaacctgaaaagcgccagagta

SEQ ID NO: 70026 - DNA, 25 bp, Homo sapien
acctgtaaaatggagccgctgatcc

SEQ ID NO: 70027 - DNA, 25 bp, Homo sapien
cacctggaagccttggccacatagg

SEQ ID NO: 70028 - DNA, 25 bp, Homo sapien
gccgccaacgtggaacctaaagatc

SEQ ID NO: 70029 - DNA, 25 bp, Homo sapien
tgcgcatccacgtgcgcgggaattg

SEQ ID NO: 70030 - DNA, 25 bp, Homo sapien
cgctgatcctgcctcctgagttgtg

SEQ ID NO: 70031 - DNA, 25 bp, Homo sapien
tccagttctggggattgagttccga

SEQ ID NO: 70032 - DNA, 25 bp, Homo sapien
caagagttgcgtccctagatccagg

SEQ ID NO: 70033 - DNA, 25 bp, Homo sapien
ccctgcaattagtgagggctcacat

SEQ ID NO: 70034 - DNA, 25 bp, Homo sapien
ctcggtgcgcactccagcgagaagc

SEQ ID NO: 70035 - DNA, 25 bp, Homo sapien
cagtagcctgaaacgtgggtgtgca

SEQ ID NO: 70036 - DNA, 25 bp, Homo sapien
ccatccgtgtggtcggaaacggccg

SEQ ID NO: 70037 - DNA, 25 bp, Homo sapien
aacctggttctagttctgccctccg

SEQ ID NO: 70038 - DNA, 25 bp, Homo sapien
cagccggtcctcctgcgctgagtta

SEQ ID NO: 70039 - DNA, 25 bp, Homo sapien
gtcaccgcatccagccggggaacta

SEQ ID NO: 70040 - DNA, 25 bp, Homo sapien
gggaactacagcagcggcgaagtca

SEQ ID NO: 70041 - DNA, 25 bp, Homo sapien
aaatacggctgcaggctacaatttg

SEQ ID NO: 70042 - DNA, 25 bp, Homo sapien
gaaatacggctgcaggctacaattt

SEQ ID NO: 70043 - DNA, 25 bp, Homo sapien
tgaaatacggctgcaggctacaatt

SEQ ID NO: 70044 - DNA, 25 bp, Homo sapien
ctgaaatacggctgcaggctacaat

SEQ ID NO: 70045 - DNA, 25 bp, Homo sapien
gctgaaatacggctgcaggctacaa

SEQ ID NO: 70046 - DNA, 25 bp, Homo sapien
cgggagcctgtggaagagaagagcg

SEQ ID NO: 70047 - DNA, 25 bp, Homo sapien
aatacggctgcaggctacaatttgc

SEQ ID NO: 70048 - DNA, 25 bp, Homo sapien
tcgggagcctgtggaagagaagagc

SEQ ID NO: 70049 - DNA, 25 bp, Homo sapien
gcaaattgtagcctgcagccgtatt

SEQ ID NO: 70050 - DNA, 25 bp, Homo sapien
aaattgtagcctgcagccgtatttc

SEQ ID NO: 70051 - DNA, 25 bp, Homo sapien
aattgtagcctgcagccgtatttca

SEQ ID NO: 70052 - DNA, 25 bp, Homo sapien
attgtagcctgcagccgtatttcag

SEQ ID NO: 70053 - DNA, 25 bp, Homo sapien
ttgtagcctgcagccgtatttcagc

SEQ ID NO: 70054 - DNA, 25 bp, Homo sapien
gctcttctcttccacaggctcccga

SEQ ID NO: 70055 - DNA, 25 bp, Homo sapien
ctcttctcttccacaggctcccgac

SEQ ID NO: 70056 - DNA, 25 bp, Homo sapien
caaattgtagcctgcagccgtattt

SEQ ID NO: 70057 - DNA, 25 bp, Homo sapien
gaccagagtgttgccctcccagggt

SEQ ID NO: 70058 - DNA, 25 bp, Homo sapien
cgcggacgcaatggcttcaaggtta

SEQ ID NO: 70059 - DNA, 25 bp, Homo sapien
gttcccggaagttttgctgctagtc

SEQ ID NO: 70060 - DNA, 25 bp, Homo sapien
tgtaattctggaccgctgctcctgc

SEQ ID NO: 70061 - DNA, 25 bp, Homo sapien
ctccgctgcgaaagtatcctaaacg

SEQ ID NO: 70062 - DNA, 25 bp, Homo sapien
cctgtctctgcagcttgttcccgga

SEQ ID NO: 70063 - DNA, 25 bp, Homo sapien
agagctgggcatgcgcaatttccgc

SEQ ID NO: 70064 - DNA, 25 bp, Homo sapien
ttcaaggttacttcgcggagctgga

SEQ ID NO: 70065 - DNA, 25 bp, Homo sapien
tccaggaagacgtctttcccgcgtc

SEQ ID NO: 70066 - DNA, 25 bp, Homo sapien
gggcctcacgttgtcgatgaccaca

SEQ ID NO: 70067 - DNA, 25 bp, Homo sapien
ctgtggagctggaaattcaccggtc

SEQ ID NO: 70068 - DNA, 25 bp, Homo sapien
agcaccggtccagaaagacgtcttt

SEQ ID NO: 70069 - DNA, 25 bp, Homo sapien
cagccaattgaggtcgtccggaaaa

SEQ ID NO: 70070 - DNA, 25 bp, Homo sapien
acctggcccgattgacagcaggtgc

SEQ ID NO: 70071 - DNA, 25 bp, Homo sapien
tgatgtcatggctccgtcttaaagg

SEQ ID NO: 70072 - DNA, 25 bp, Homo sapien
ggcgatgatgtcgtaggactccatg

SEQ ID NO: 70073 - DNA, 25 bp, Homo sapien
agaacagcttccgtagtggccactt

SEQ ID NO: 70074 - DNA, 25 bp, Homo sapien
gtggccacttcctatttttcggatg

SEQ ID NO: 70075 - DNA, 25 bp, Homo sapien
ctaagaatcgctcacgccgtagttg

SEQ ID NO: 70076 - DNA, 25 bp, Homo sapien
ctggaagtctttctggcccagaaca

SEQ ID NO: 70077 - DNA, 25 bp, Homo sapien
tgggaccgcgcatgctatcaacagc

SEQ ID NO: 70078 - DNA, 25 bp, Homo sapien
gatcactggtgcatcgtcctccatg

SEQ ID NO: 70079 - DNA, 25 bp, Homo sapien
ggcgtgttcccagcgcccattcatt

SEQ ID NO: 70080 - DNA, 25 bp, Homo sapien
cggcgattagccttagctagccatc

SEQ ID NO: 70081 - DNA, 25 bp, Homo sapien
gcactaagagcggaacgtgaacttc

SEQ ID NO: 70082 - DNA, 25 bp, Homo sapien
ccggggaactcaccgcgcactaaga

SEQ ID NO: 70083 - DNA, 25 bp, Homo sapien
cttgctgacgtcatccaggagagcc

SEQ ID NO: 70084 - DNA, 25 bp, Homo sapien
atcggatcttgtctcccggcttagc

SEQ ID NO: 70085 - DNA, 25 bp, Homo sapien
acggcacttcctcatcacgtgacga

SEQ ID NO: 70086 - DNA, 25 bp, Homo sapien
cgcagctctcagtagatcggatctt

SEQ ID NO: 70087 - DNA, 25 bp, Homo sapien
tcgcgattacgctctctacggcctg

SEQ ID NO: 70088 - DNA, 25 bp, Homo sapien
ccgcagactggaaacaacgctacta

SEQ ID NO: 70089 - DNA, 25 bp, Homo sapien
tgggcccaacgcaccaggttcagga

SEQ ID NO: 70090 - DNA, 25 bp, Homo sapien
cgaccctctgtgaacccgcaggttt

SEQ ID NO: 70091 - DNA, 25 bp, Homo sapien
ttcttctacggcagcatctcgcgtg

SEQ ID NO: 70092 - DNA, 25 bp, Homo sapien
gctatgtgctgtcgctcgtgcacga

SEQ ID NO: 70093 - DNA, 25 bp, Homo sapien
gcacgatgtgcgcttccaccacttt

SEQ ID NO: 70094 - DNA, 25 bp, Homo sapien
cggcagagctctgcgagttctactc

SEQ ID NO: 70095 - DNA, 25 bp, Homo sapien
cttcgactgcctgcgagacgccatg

SEQ ID NO: 70096 - DNA, 25 bp, Homo sapien
gtgcgtgactacgtgcgccagacgt

SEQ ID NO: 70097 - DNA, 25 bp, Homo sapien
gctgacattgaacttggctgcggca

SEQ ID NO: 70098 - DNA, 25 bp, Homo sapien
aaaccgcggccgatgcccatggaca

SEQ ID NO: 70099 - DNA, 25 bp, Homo sapien
cctacagcgacccagaggagctcaa

SEQ ID NO: 70100 - DNA, 25 bp, Homo sapien
gctcaaggacaagaagctcttcctg

SEQ ID NO: 70101 - DNA, 25 bp, Homo sapien
tgcccatggacacgagcgtgtatga

SEQ ID NO: 70102 - DNA, 25 bp, Homo sapien
gataacctcctcatagctgacattg

SEQ ID NO: 70103 - DNA, 25 bp, Homo sapien
tgcggcaactttggctcagtgcgcc

SEQ ID NO: 70104 - DNA, 25 bp, Homo sapien
gctcttcctgaagcgcgataacctc

SEQ ID NO: 70105 - DNA, 25 bp, Homo sapien
cagacacggaagagatgatgcgcga

SEQ ID NO: 70106 - DNA, 25 bp, Homo sapien
atgcgcgaggcgcagatcatgcacc

SEQ ID NO: 70107 - DNA, 25 bp, Homo sapien
acatgcacccgcgtgcatgcgtgtg

SEQ ID NO: 70108 - DNA, 25 bp, Homo sapien
gctcattggcgtctgccaggccgag

SEQ ID NO: 70109 - DNA, 25 bp, Homo sapien
ccgaggccctcatgctggtcatgga

SEQ ID NO: 70110 - DNA, 25 bp, Homo sapien
ccctcatgctggtcatggagatggc

SEQ ID NO: 70111 - DNA, 25 bp, Homo sapien
cgctgcacaagttcctggtcggcaa

SEQ ID NO: 70112 - DNA, 25 bp, Homo sapien
tcctggtcggcaagaggtgagcacc

SEQ ID NO: 70113 - DNA, 25 bp, Homo sapien
ctcccgggtgatgtccgctaggaaa

SEQ ID NO: 70114 - DNA, 25 bp, Homo sapien
ggtgatgtccgctaggaaagctccc

SEQ ID NO: 70115 - DNA, 25 bp, Homo sapien
cctcccgggtgatgtccgctaggaa

SEQ ID NO: 70116 - DNA, 25 bp, Homo sapien
tgatgtccgctaggaaagctccccg

SEQ ID NO: 70117 - DNA, 25 bp, Homo sapien
gtgatgtccgctaggaaagctcccc

SEQ ID NO: 70118 - DNA, 25 bp, Homo sapien
gggtgatgtccgctaggaaagctcc

SEQ ID NO: 70119 - DNA, 25 bp, Homo sapien
cccgggtgatgtccgctaggaaagc

SEQ ID NO: 70120 - DNA, 25 bp, Homo sapien
tcccgggtgatgtccgctaggaaag

SEQ ID NO: 70121 - DNA, 25 bp, Homo sapien
tctgtcctacagtggtagagccttc

SEQ ID NO: 70122 - DNA, 25 bp, Homo sapien
cctgcggcttcacggccagacagaa

SEQ ID NO: 70123 - DNA, 25 bp, Homo sapien
cagtcacggtctttgcctgggcatc

SEQ ID NO: 70124 - DNA, 25 bp, Homo sapien
ctgggcatcgcctacaagcagtcgg

SEQ ID NO: 70125 - DNA, 25 bp, Homo sapien
cgttaccgctacctggcgcaggaga

SEQ ID NO: 70126 - DNA, 25 bp, Homo sapien
ccaggacttatgatggcggcttctg

SEQ ID NO: 70127 - DNA, 25 bp, Homo sapien
gcagccactacgagggtcatcacca

SEQ ID NO: 70128 - DNA, 25 bp, Homo sapien
gggcaatcctccgtgctctgtccta

SEQ ID NO: 70129 - DNA, 25 bp, Homo sapien
gcgcgggtcacagagacctagaaca

SEQ ID NO: 70130 - DNA, 25 bp, Homo sapien
cgctgccttatccaccagcgggatg

SEQ ID NO: 70131 - DNA, 25 bp, Homo sapien
acctagaacagctggaatccttcgc

SEQ ID NO: 70132 - DNA, 25 bp, Homo sapien
cgtcgtcaacagaccgcgctcggaa

SEQ ID NO: 70133 - DNA, 25 bp, Homo sapien
gaggtgccgagccttccaacaagcg

SEQ ID NO: 70134 - DNA, 25 bp, Homo sapien
cctagtaagtgtgggagcgatgcct

SEQ ID NO: 70135 - DNA, 25 bp, Homo sapien
ctgtgattggccgtgtccaggcaac

SEQ ID NO: 70136 - DNA, 25 bp, Homo sapien
tccacccgacatattgcctagtaag

SEQ ID NO: 70137 - DNA, 25 bp, Homo sapien
tgtgtaatctccctactgagcggcg

SEQ ID NO: 70138 - DNA, 25 bp, Homo sapien
gtgaaaaaggatcggctacggcctc

SEQ ID NO: 70139 - DNA, 25 bp, Homo sapien
atacatttcctcctgtcacgctgtc

SEQ ID NO: 70140 - DNA, 25 bp, Homo sapien
gcgggctctctgatcctctgcaatc

SEQ ID NO: 70141 - DNA, 25 bp, Homo sapien
gggctcccagccgtcaggcttttct

SEQ ID NO: 70142 - DNA, 25 bp, Homo sapien
gccgggtgattcatttttctccctg

SEQ ID NO: 70143 - DNA, 25 bp, Homo sapien
cgcagctgggactttaacttcggcc

SEQ ID NO: 70144 - DNA, 25 bp, Homo sapien
ttttctctttagctcagcccgcggc

SEQ ID NO: 70145 - DNA, 25 bp, Homo sapien
ttcgctgctggtttgccgccgggtc

SEQ ID NO: 70146 - DNA, 25 bp, Homo sapien
aattgcactgcctaacggtgccagt

SEQ ID NO: 70147 - DNA, 25 bp, Homo sapien
ccagtggtccacctgcggtggcgtc

SEQ ID NO: 70148 - DNA, 25 bp, Homo sapien
gcggtggcgtcttttgagaacaatc

SEQ ID NO: 70149 - DNA, 25 bp, Homo sapien
ttttgagaacaatccgagcccggcc

SEQ ID NO: 70150 - DNA, 25 bp, Homo sapien
gcgcccgcggttttcatggaaattg

SEQ ID NO: 70151 - DNA, 25 bp, Homo sapien
cgcagcccgcgacttcacagccagg

SEQ ID NO: 70152 - DNA, 25 bp, Homo sapien
gttttcatggaaattgcactgccta

SEQ ID NO: 70153 - DNA, 25 bp, Homo sapien
ctgcggcttgtcctcataatactta

SEQ ID NO: 70154 - DNA, 25 bp, Homo sapien
cctgggacaggggtcgtcaccaccg

SEQ ID NO: 70155 - DNA, 25 bp, Homo sapien
taatacttaggcatgacggcgcttc

SEQ ID NO: 70156 - DNA, 25 bp, Homo sapien
ctgcggcctggcagtgaccatgtcg

SEQ ID NO: 70157 - DNA, 25 bp, Homo sapien
agcggcaacaacttccggcgggccg

SEQ ID NO: 70158 - DNA, 25 bp, Homo sapien
gaccggaagccagcggcaacaactt

SEQ ID NO: 70159 - DNA, 25 bp, Homo sapien
ccagtctcaggggaccggaagccag

SEQ ID NO: 70160 - DNA, 25 bp, Homo sapien
cgcaacacttgcaaccgggtcggga

SEQ ID NO: 70161 - DNA, 25 bp, Homo sapien
tttaccagcaggtggatctcccgca

SEQ ID NO: 70162 - DNA, 25 bp, Homo sapien
acatctggctgagatcctcccggcg

SEQ ID NO: 70163 - DNA, 25 bp, Homo sapien
agtggcccgcgcgactgtcacttag

SEQ ID NO: 70164 - DNA, 25 bp, Homo sapien
ggcgcagtaggctcctttaccagca

SEQ ID NO: 70165 - DNA, 25 bp, Homo sapien
ccggatcagcactttgctccacttt

SEQ ID NO: 70166 - DNA, 25 bp, Homo sapien
gactgtcacttaggggcgccgccac

SEQ ID NO: 70167 - DNA, 25 bp, Homo sapien
ggctggcccggctcatcggtgtcac

SEQ ID NO: 70168 - DNA, 25 bp, Homo sapien
ctcatcggtgtcacggcgaggtccg

SEQ ID NO: 70169 - DNA, 25 bp, Homo sapien
gctgccgccgattccggatctcatt

SEQ ID NO: 70170 - DNA, 25 bp, Homo sapien
tcggagcccatagagccaaaaaagc

SEQ ID NO: 70171 - DNA, 25 bp, Homo sapien
cggtgcaaaactcgaggtccagttc

SEQ ID NO: 70172 - DNA, 25 bp, Homo sapien
atacctctgggctcgaaatcggcgg

SEQ ID NO: 70173 - DNA, 25 bp, Homo sapien
acaacgcatgtgttcggagctcgcc

SEQ ID NO: 70174 - DNA, 25 bp, Homo sapien
gtaccacgcggcttgcatttttctc

SEQ ID NO: 70175 - DNA, 25 bp, Homo sapien
tcagcatagctgttccacttaaggc

SEQ ID NO: 70176 - DNA, 25 bp, Homo sapien
tgctctaagcgggaaccatggcttc

SEQ ID NO: 70177 - DNA, 25 bp, Homo sapien
aggtcggggtgtctgctgctgttcc

SEQ ID NO: 70178 - DNA, 25 bp, Homo sapien
gaggtcggggtgtctgctgctgttc

SEQ ID NO: 70179 - DNA, 25 bp, Homo sapien
ggaggtcggggtgtctgctgctgtt

SEQ ID NO: 70180 - DNA, 25 bp, Homo sapien
aggaggtcggggtgtctgctgctgt

SEQ ID NO: 70181 - DNA, 25 bp, Homo sapien
gaggaggtcggggtgtctgctgctg

SEQ ID NO: 70182 - DNA, 25 bp, Homo sapien
agcgaggaggtcggggtgtctgctg

SEQ ID NO: 70183 - DNA, 25 bp, Homo sapien
gtcggggtgtctgctgctgttccca

SEQ ID NO: 70184 - DNA, 25 bp, Homo sapien
tcggggtgtctgctgctgttcccat

SEQ ID NO: 70185 - DNA, 25 bp, Homo sapien
ggaggccggggtgttaatacacaca

SEQ ID NO: 70186 - DNA, 25 bp, Homo sapien
acacacacaggtagcgaggaggccg

SEQ ID NO: 70187 - DNA, 25 bp, Homo sapien
ggccggcgtgttaatacacacacag

SEQ ID NO: 70188 - DNA, 25 bp, Homo sapien
tacacacacaggtagcgaggaggcc

SEQ ID NO: 70189 - DNA, 25 bp, Homo sapien
ggaggccggcgtgttaatacacaca

SEQ ID NO: 70190 - DNA, 25 bp, Homo sapien
aggccggcgtgttaatacacacaca

SEQ ID NO: 70191 - DNA, 25 bp, Homo sapien
cggcgtgttaatacacacacaggta

SEQ ID NO: 70192 - DNA, 25 bp, Homo sapien
aggccggggtgttaatacacacaca

SEQ ID NO: 70193 - DNA, 25 bp, Homo sapien
cctgcatcgggcctgagcagaacta

SEQ ID NO: 70194 - DNA, 25 bp, Homo sapien
ctctccacgtctgcagagggctgga

SEQ ID NO: 70195 - DNA, 25 bp, Homo sapien
gaccttctctgggaccgatgctaga

SEQ ID NO: 70196 - DNA, 25 bp, Homo sapien
tgtcaccttcctcacggaccttggt

SEQ ID NO: 70197 - DNA, 25 bp, Homo sapien
gcccacagcagacgaaccggaaacg

SEQ ID NO: 70198 - DNA, 25 bp, Homo sapien
ttgcctgtgcgcgttcacacctagg

SEQ ID NO: 70199 - DNA, 25 bp, Homo sapien
aactaccggctcctggttgcctgtg

SEQ ID NO: 70200 - DNA, 25 bp, Homo sapien
agggagcacactggctttggcctca

SEQ ID NO: 70201 - DNA, 25 bp, Homo sapien
agaccctggaggtcgtcaagagccg

SEQ ID NO: 70202 - DNA, 25 bp, Homo sapien
tgagaggcgccatccctgtatttga

SEQ ID NO: 70203 - DNA, 25 bp, Homo sapien
ggcacgaggacaccgagaacttctt

SEQ ID NO: 70204 - DNA, 25 bp, Homo sapien
gtgtttcaggcagctcttgggcgcc

SEQ ID NO: 70205 - DNA, 25 bp, Homo sapien
ggtcccaattctctcgggctcggtc

SEQ ID NO: 70206 - DNA, 25 bp, Homo sapien
cgcttccttcgggacactgcgttct

SEQ ID NO: 70207 - DNA, 25 bp, Homo sapien
acactgcgttctggcccgtcgcgag

SEQ ID NO: 70208 - DNA, 25 bp, Homo sapien
ctcgcgacgtcttcgggagcacaga

SEQ ID NO: 70209 - DNA, 25 bp, Homo sapien
gggactccaggtgacctccggatcc

SEQ ID NO: 70210 - DNA, 25 bp, Homo sapien
tctcagctgcgctcgcctttcttta

SEQ ID NO: 70211 - DNA, 25 bp, Homo sapien
aggctaattagggaagctgccgccc

SEQ ID NO: 70212 - DNA, 25 bp, Homo sapien
gtcctgagcgtctccaggctaatta

SEQ ID NO: 70213 - DNA, 25 bp, Homo sapien
ctggtccatttagggagaccgcgca

SEQ ID NO: 70214 - DNA, 25 bp, Homo sapien
tgttttataaccctgtgggtcctga

SEQ ID NO: 70215 - DNA, 25 bp, Homo sapien
ccggatccgccctctaagtcagtgg

SEQ ID NO: 70216 - DNA, 25 bp, Homo sapien
tttcttgtaaagacagggctggtcc

SEQ ID NO: 70217 - DNA, 25 bp, Homo sapien
ttgaaacacctgctgcttcgcggcg

SEQ ID NO: 70218 - DNA, 25 bp, Homo sapien
aacgcgcatgcgcaaggctgtctct

SEQ ID NO: 70219 - DNA, 25 bp, Homo sapien
ggggatacaagaaccgcccactctc

SEQ ID NO: 70220 - DNA, 25 bp, Homo sapien
ccctcacgctctgtaccggagtggg

SEQ ID NO: 70221 - DNA, 25 bp, Homo sapien
gaccttccttctcgcggggtctaca

SEQ ID NO: 70222 - DNA, 25 bp, Homo sapien
tgcctgccttacagggcacctagga

SEQ ID NO: 70223 - DNA, 25 bp, Homo sapien
gagcgtcccgtctcctagtaaccag

SEQ ID NO: 70224 - DNA, 25 bp, Homo sapien
gagaccttccagtccagtagcagca

SEQ ID NO: 70225 - DNA, 25 bp, Homo sapien
cttttattcgaacgtagcctgcgtc

SEQ ID NO: 70226 - DNA, 25 bp, Homo sapien
gctggccgttatctctgtgctgtca

SEQ ID NO: 70227 - DNA, 25 bp, Homo sapien
gtcacgcggggaagtcccatctgaa

SEQ ID NO: 70228 - DNA, 25 bp, Homo sapien
ctggggccttatgaccttcggtact

SEQ ID NO: 70229 - DNA, 25 bp, Homo sapien
agcggaaacgcttcaaaccgggatg

SEQ ID NO: 70230 - DNA, 25 bp, Homo sapien
cggggtcgtatgacgcacttttcca

SEQ ID NO: 70231 - DNA, 25 bp, Homo sapien
cgccctgaaggacccttacttagca

SEQ ID NO: 70232 - DNA, 25 bp, Homo sapien
ttacttagcactcctgcgggctgcc

SEQ ID NO: 70233 - DNA, 25 bp, Homo sapien
tgcccgctttagcacagtggctgca

SEQ ID NO: 70234 - DNA, 25 bp, Homo sapien
tgcctcagtttggaggtcgcgctca

SEQ ID NO: 70235 - DNA, 25 bp, Homo sapien
ttcgccggaacaaaaatgcctcagt

SEQ ID NO: 70236 - DNA, 25 bp, Homo sapien
ctgcgctctctttctagggactttc

SEQ ID NO: 70237 - DNA, 25 bp, Homo sapien
tggtcatgtgatacccaggcgcctg

SEQ ID NO: 70238 - DNA, 25 bp, Homo sapien
tcagcccggacttcgccataattct

SEQ ID NO: 70239 - DNA, 25 bp, Homo sapien
ggataccgcgactccgaatctagtt

SEQ ID NO: 70240 - DNA, 25 bp, Homo sapien
tccgcctcaacccaggatgaagttg

SEQ ID NO: 70241 - DNA, 25 bp, Homo sapien
agcttcattgtccacctccgggttc

SEQ ID NO: 70242 - DNA, 25 bp, Homo sapien
ctgagaggtccctattttgtcctga

SEQ ID NO: 70243 - DNA, 25 bp, Homo sapien
agtattcacggtccagtgcgccaga

SEQ ID NO: 70244 - DNA, 25 bp, Homo sapien
ccggactttctcaggagcgtgcttc

SEQ ID NO: 70245 - DNA, 25 bp, Homo sapien
agccgtgacgcttgaactgcgtttc

SEQ ID NO: 70246 - DNA, 25 bp, Homo sapien
gcagtttcttagtgcgcaggctgtc

SEQ ID NO: 70247 - DNA, 25 bp, Homo sapien
actgaacttcgtgcggctgagaata

SEQ ID NO: 70248 - DNA, 25 bp, Homo sapien
cactcctgaaccgaagcgtgcgttc

SEQ ID NO: 70249 - DNA, 25 bp, Homo sapien
ggaggggaggtcacacattacataa

SEQ ID NO: 70250 - DNA, 25 bp, Homo sapien
cacattacataacccggcggctgcg

SEQ ID NO: 70251 - DNA, 25 bp, Homo sapien
aatggcgcggaactgaatggccggc

SEQ ID NO: 70252 - DNA, 25 bp, Homo sapien
acctcaggccgaccgcgctctggcc

SEQ ID NO: 70253 - DNA, 25 bp, Homo sapien
cggcacgtgaccgtctcgctagctg

SEQ ID NO: 70254 - DNA, 25 bp, Homo sapien
gggtcgctcaccttccgcgttgccc

SEQ ID NO: 70255 - DNA, 25 bp, Homo sapien
ttcgttgaccgggtcgcggctcttc

SEQ ID NO: 70256 - DNA, 25 bp, Homo sapien
acgtgaccgtctcgctagctgggcg

SEQ ID NO: 70257 - DNA, 25 bp, Homo sapien
tctcggtgcgcctggtgggcttctt

SEQ ID NO: 70258 - DNA, 25 bp, Homo sapien
tgcggcgcttctcgcaggtcacgga

SEQ ID NO: 70259 - DNA, 25 bp, Homo sapien
ttctcgcaggtcacggaggagcgca

SEQ ID NO: 70260 - DNA, 25 bp, Homo sapien
agctccttgcggtggctcgctctgt

SEQ ID NO: 70261 - DNA, 25 bp, Homo sapien
tggctcgctctgttgttgccacagg

SEQ ID NO: 70262 - DNA, 25 bp, Homo sapien
tctgttgttgccacagggcctggtt

SEQ ID NO: 70263 - DNA, 25 bp, Homo sapien
cggctgaggtcctctcggtgcgcct

SEQ ID NO: 70264 - DNA, 25 bp, Homo sapien
gttgttgccacagggcctggttttg

SEQ ID NO: 70265 - DNA, 25 bp, Homo sapien
cgccctgcgcgctgtaatgcgcatg

SEQ ID NO: 70266 - DNA, 25 bp, Homo sapien
ccaacggccggaggccgctagacta

SEQ ID NO: 70267 - DNA, 25 bp, Homo sapien
cagccttctgccttctggcccgatg

SEQ ID NO: 70268 - DNA, 25 bp, Homo sapien
cgctagactaatcggcttcgccctg

SEQ ID NO: 70269 - DNA, 25 bp, Homo sapien
gcgttcggaggacccagcaattagt

SEQ ID NO: 70270 - DNA, 25 bp, Homo sapien
aggacccagcaattagtctgatttc

SEQ ID NO: 70271 - DNA, 25 bp, Homo sapien
gcaattagtctgatttccgcccacc

SEQ ID NO: 70272 - DNA, 25 bp, Homo sapien
gaaggagagccacaaagcgcgcatg

SEQ ID NO: 70273 - DNA, 25 bp, Homo sapien
tggctacctagatcaccagtccctg

SEQ ID NO: 70274 - DNA, 25 bp, Homo sapien
cgggtggatccccaggcattagtga

SEQ ID NO: 70275 - DNA, 25 bp, Homo sapien
gcagcaccaactccagggggtcggt

SEQ ID NO: 70276 - DNA, 25 bp, Homo sapien
ctaagggcacttcgcagcagcacca

SEQ ID NO: 70277 - DNA, 25 bp, Homo sapien
tcctctaagggcacttcgcagcagc

SEQ ID NO: 70278 - DNA, 25 bp, Homo sapien
gagcatcctctaagggcacttcgca

SEQ ID NO: 70279 - DNA, 25 bp, Homo sapien
gcatcccacccggggaggcagaaaa

SEQ ID NO: 70280 - DNA, 25 bp, Homo sapien
gctacctagatcaccagtccctggg

SEQ ID NO: 70281 - DNA, 25 bp, Homo sapien
cccgcagggctgcaatcgttccggg

SEQ ID NO: 70282 - DNA, 25 bp, Homo sapien
ccagcccggctagcatggagcgaaa

SEQ ID NO: 70283 - DNA, 25 bp, Homo sapien
ccggctagcatggagcgaaagagct

SEQ ID NO: 70284 - DNA, 25 bp, Homo sapien
agcgaaagagctcggctgccatctc

SEQ ID NO: 70285 - DNA, 25 bp, Homo sapien
cttaggtaacccaggtcgctgcggt

SEQ ID NO: 70286 - DNA, 25 bp, Homo sapien
ctgcggtaacgcagtgaccgcgctc

SEQ ID NO: 70287 - DNA, 25 bp, Homo sapien
taacccaggtcgctgcggtaacgca

SEQ ID NO: 70288 - DNA, 25 bp, Homo sapien
agctcggctgccatctcgtagtcgc

SEQ ID NO: 70289 - DNA, 25 bp, Homo sapien
ttccaggaggaaaccatcgatcttg

SEQ ID NO: 70290 - DNA, 25 bp, Homo sapien
ttcgcgcacatccaggcagtgtttg

SEQ ID NO: 70291 - DNA, 25 bp, Homo sapien
gcctcggacttcttcgactccttta

SEQ ID NO: 70292 - DNA, 25 bp, Homo sapien
ccagcctcagcacgttcttcggaga

SEQ ID NO: 70293 - DNA, 25 bp, Homo sapien
cgcagatggtgaagtcgcccagctt

SEQ ID NO: 70294 - DNA, 25 bp, Homo sapien
cgcggacaagctgaacgaacacatg

SEQ ID NO: 70295 - DNA, 25 bp, Homo sapien
cgggcctcaggttcgacaacatcca

SEQ ID NO: 70296 - DNA, 25 bp, Homo sapien
gaaggctcgagtcctctcgcggaca

SEQ ID NO: 70297 - DNA, 25 bp, Homo sapien
cgggtcacagcatcccgcacaagga

SEQ ID NO: 70298 - DNA, 25 bp, Homo sapien
aggacgccttcttattgcataatta

SEQ ID NO: 70299 - DNA, 25 bp, Homo sapien
cgcgaactagggaggtcttcaagtc

SEQ ID NO: 70300 - DNA, 25 bp, Homo sapien
ttcaagtcgccaaaacacaccggga

SEQ ID NO: 70301 - DNA, 25 bp, Homo sapien
atgtggctcgccaggacaaaacccg

SEQ ID NO: 70302 - DNA, 25 bp, Homo sapien
tctgccgctgcaaaagcgttctttc

SEQ ID NO: 70303 - DNA, 25 bp, Homo sapien
agcgttctttctgaccgagacctgc

SEQ ID NO: 70304 - DNA, 25 bp, Homo sapien
taattaacgcgaggaaggctcttcc

SEQ ID NO: 70305 - DNA, 25 bp, Homo sapien
ggtcttgccggatcccgcctaacaa

SEQ ID NO: 70306 - DNA, 25 bp, Homo sapien
cggcacagctggtttgagcaactga

SEQ ID NO: 70307 - DNA, 25 bp, Homo sapien
gtcttccgcacgtaaagcagcgcca

SEQ ID NO: 70308 - DNA, 25 bp, Homo sapien
gtgcgcgtgcacaaaagagagctga

SEQ ID NO: 70309 - DNA, 25 bp, Homo sapien
cgtcctccgggactatgtcttctcg

SEQ ID NO: 70310 - DNA, 25 bp, Homo sapien
ggcgcagactcaaggctgttgcttc

SEQ ID NO: 70311 - DNA, 25 bp, Homo sapien
gcatgcgaacgcttctgtgccagtt

SEQ ID NO: 70312 - DNA, 25 bp, Homo sapien
cgtgttccctatctgaccgctcggg

SEQ ID NO: 70313 - DNA, 25 bp, Homo sapien
cttgacccattttccggaccagcta

SEQ ID NO: 70314 - DNA, 25 bp, Homo sapien
tcggctggcagcctctagtccactt

SEQ ID NO: 70315 - DNA, 25 bp, Homo sapien
aactttaatgggacctcggctggca

SEQ ID NO: 70316 - DNA, 25 bp, Homo sapien
cccgcactgcgagggtctacactag

SEQ ID NO: 70317 - DNA, 25 bp, Homo sapien
cgctcattgagaaatcgcagtggtc

SEQ ID NO: 70318 - DNA, 25 bp, Homo sapien
cggaccagctacgttcgccttagga

SEQ ID NO: 70319 - DNA, 25 bp, Homo sapien
ttagccggttcctttccatccttga

SEQ ID NO: 70320 - DNA, 25 bp, Homo sapien
ccttaggacaggcactggttattcc

SEQ ID NO: 70321 - DNA, 25 bp, Homo sapien
gacagccacgactggcaatcctgtg

SEQ ID NO: 70322 - DNA, 25 bp, Homo sapien
cgcaagttccttcgcggagccagaa

SEQ ID NO: 70323 - DNA, 25 bp, Homo sapien
ggccctgctcccatacatctgtagg

SEQ ID NO: 70324 - DNA, 25 bp, Homo sapien
atgggaaaaacgaagtctctctctc

SEQ ID NO: 70325 - DNA, 25 bp, Homo sapien
cagtcagtgttggtcggatgcatga

SEQ ID NO: 70326 - DNA, 25 bp, Homo sapien
atccgtcgagaagcgggacctcaag

SEQ ID NO: 70327 - DNA, 25 bp, Homo sapien
ggcgcgcgccgcttacatcatagct

SEQ ID NO: 70328 - DNA, 25 bp, Homo sapien
gttgcgtcttagtgaccctgggacc

SEQ ID NO: 70329 - DNA, 25 bp, Homo sapien
gcgtctcccaagaaatcgcctctgg

SEQ ID NO: 70330 - DNA, 25 bp, Homo sapien
gaggaagtccaatcctgcgccaggc

SEQ ID NO: 70331 - DNA, 25 bp, Homo sapien
tcctcgggcttgagccacatcgcgg

SEQ ID NO: 70332 - DNA, 25 bp, Homo sapien
ctgcaggatgaagtagcagctgctc

SEQ ID NO: 70333 - DNA, 25 bp, Homo sapien
gaagacacctgcctcgcccggaaaa

SEQ ID NO: 70334 - DNA, 25 bp, Homo sapien
cggcgtttctccttcgattcccaag

SEQ ID NO: 70335 - DNA, 25 bp, Homo sapien
agcttcagcgcgttcttcagcagca

SEQ ID NO: 70336 - DNA, 25 bp, Homo sapien
tcgattcccaagtcgagtccggcct

SEQ ID NO: 70337 - DNA, 25 bp, Homo sapien
cggtgctcgtcatgctgctccagca

SEQ ID NO: 70338 - DNA, 25 bp, Homo sapien
cgctctacctgctctgggagatgta

SEQ ID NO: 70339 - DNA, 25 bp, Homo sapien
actacttcagcaaggccgaccactt

SEQ ID NO: 70340 - DNA, 25 bp, Homo sapien
tgctgagcatcatatcggaggaggc

SEQ ID NO: 70341 - DNA, 25 bp, Homo sapien
aaggagctctcgagcctgctgagca

SEQ ID NO: 70342 - DNA, 25 bp, Homo sapien
ctgtcgtgtaacagcgcgctttacg

SEQ ID NO: 70343 - DNA, 25 bp, Homo sapien
ggacctcggcagacctaaccctgaa

SEQ ID NO: 70344 - DNA, 25 bp, Homo sapien
aaagggcggcttaacctcgcagctg

SEQ ID NO: 70345 - DNA, 25 bp, Homo sapien
gccgcaccgagcaaacgagggcttc

SEQ ID NO: 70346 - DNA, 25 bp, Homo sapien
gggcttccctgaaagttccaacagc

SEQ ID NO: 70347 - DNA, 25 bp, Homo sapien
tcacccgcgtgagacatgggcaagg

SEQ ID NO: 70348 - DNA, 25 bp, Homo sapien
tgatgttcccgtagcgctcctcatt

SEQ ID NO: 70349 - DNA, 25 bp, Homo sapien
cctcattgtagaggacgacggccga

SEQ ID NO: 70350 - DNA, 25 bp, Homo sapien
ctccacaccgtcaggttggtctgcg

SEQ ID NO: 70351 - DNA, 25 bp, Homo sapien
tcgatgtttaccacggccgagaacc

SEQ ID NO: 70352 - DNA, 25 bp, Homo sapien
gcgggtccacgtactcgatgtttac

SEQ ID NO: 70353 - DNA, 25 bp, Homo sapien
tgcccaaggatggttctgtgtctcc

SEQ ID NO: 70354 - DNA, 25 bp, Homo sapien
atcacacctgcgatgcctgcacgag

SEQ ID NO: 70355 - DNA, 25 bp, Homo sapien
cgcgggagcgaattgtttttgccca

SEQ ID NO: 70356 - DNA, 25 bp, Homo sapien
ctcttgagtgagtggccatgagctg

SEQ ID NO: 70357 - DNA, 25 bp, Homo sapien
tgcctcgatgagctttaacgccatt

SEQ ID NO: 70358 - DNA, 25 bp, Homo sapien
ggttcatctccttcgtgcctcgatg

SEQ ID NO: 70359 - DNA, 25 bp, Homo sapien
gcgtctgttagtcggcggttcatct

SEQ ID NO: 70360 - DNA, 25 bp, Homo sapien
tgtgtctccgccaggcggcatgtga

SEQ ID NO: 70361 - DNA, 25 bp, Homo sapien
aggcaccatcgccttccattatgta

SEQ ID NO: 70362 - DNA, 25 bp, Homo sapien
caggctcgcagaagaccaggttcca

SEQ ID NO: 70363 - DNA, 25 bp, Homo sapien
gcccaagacacggagctcacgatca

SEQ ID NO: 70364 - DNA, 25 bp, Homo sapien
ccacctcgttggtgacggcccaaga

SEQ ID NO: 70365 - DNA, 25 bp, Homo sapien
aatcctctagcagcgcgggcatagc

SEQ ID NO: 70366 - DNA, 25 bp, Homo sapien
tttgctgccagatgctgcccgaatc

SEQ ID NO: 70367 - DNA, 25 bp, Homo sapien
gcgctcaccttcttgtgggtggaca

SEQ ID NO: 70368 - DNA, 25 bp, Homo sapien
tatgtacagtgtcgagggtcccatc

SEQ ID NO: 70369 - DNA, 25 bp, Homo sapien
gctcaccactggatgacgccgctgt

SEQ ID NO: 70370 - DNA, 25 bp, Homo sapien
acttacaccttttccaatctggtcg

SEQ ID NO: 70371 - DNA, 25 bp, Homo sapien
cagaccggatggctttccgcgggaa

SEQ ID NO: 70372 - DNA, 25 bp, Homo sapien
cgagcatcagaaagcgctgggcctg

SEQ ID NO: 70373 - DNA, 25 bp, Homo sapien
tgggttgcaccggtcctgctaccgc

SEQ ID NO: 70374 - DNA, 25 bp, Homo sapien
tgtttactttagaaaggagcgcgcg

SEQ ID NO: 70375 - DNA, 25 bp, Homo sapien
cagtcaaacagggacgcgaacaaca

SEQ ID NO: 70376 - DNA, 25 bp, Homo sapien
caccggcgtagcaaccagtcaaaca

SEQ ID NO: 70377 - DNA, 25 bp, Homo sapien
cttagtgtcggtccagctcagtttc

SEQ ID NO: 70378 - DNA, 25 bp, Homo sapien
cgcctcccgggttatctttgtctcg

SEQ ID NO: 70379 - DNA, 25 bp, Homo sapien
tgtcatttgttgttagcgcgaggta

SEQ ID NO: 70380 - DNA, 25 bp, Homo sapien
tgatgaatattcacgccgcgcgggc

SEQ ID NO: 70381 - DNA, 25 bp, Homo sapien
gttatctttgtctcgctgcctcgcg

SEQ ID NO: 70382 - DNA, 25 bp, Homo sapien
gccggtttttcctgcctgaggagga

SEQ ID NO: 70383 - DNA, 25 bp, Homo sapien
cctcagaatatatttttggtgtccc

SEQ ID NO: 70384 - DNA, 25 bp, Homo sapien
agggtccatggcctcttagtgtcgg

SEQ ID NO: 70385 - DNA, 25 bp, Homo sapien
catgatttcctttggtgccgttttc

SEQ ID NO: 70386 - DNA, 25 bp, Homo sapien
aatgagtccagaatgttaaacatga

SEQ ID NO: 70387 - DNA, 25 bp, Homo sapien
ttgctcctgccaaaaattgctctca

SEQ ID NO: 70388 - DNA, 25 bp, Homo sapien
tgctctcagtagattcagggaactg

SEQ ID NO: 70389 - DNA, 25 bp, Homo sapien
ttcatcaaagactgattcgagtctg

SEQ ID NO: 70390 - DNA, 25 bp, Homo sapien
tccagtgggtgaggagagtcaaaca

SEQ ID NO: 70391 - DNA, 25 bp, Homo sapien
ggtgccgttttccattagctcctcc

SEQ ID NO: 70392 - DNA, 25 bp, Homo sapien
gtctgtgttcagcatgtgtgtttta

SEQ ID NO: 70393 - DNA, 25 bp, Homo sapien
tccaatgctttggaaccggcgggac

SEQ ID NO: 70394 - DNA, 25 bp, Homo sapien
gtggctaggtgagttgtctcaacta

SEQ ID NO: 70395 - DNA, 25 bp, Homo sapien
ggaccacagccttgacaccttcgag

SEQ ID NO: 70396 - DNA, 25 bp, Homo sapien
aactaactctagtggagccgccgca

SEQ ID NO: 70397 - DNA, 25 bp, Homo sapien
gccaactcaattcgcgggtcgcagc

SEQ ID NO: 70398 - DNA, 25 bp, Homo sapien
gaatgtgacaatcgcgcgcccgcgc

SEQ ID NO: 70399 - DNA, 25 bp, Homo sapien
cgagcgtttgcttcgggatctgatg

SEQ ID NO: 70400 - DNA, 25 bp, Homo sapien
ggatctgatgccctggagtcgccaa

SEQ ID NO: 70401 - DNA, 25 bp, Homo sapien
cggctattttcagctccagcggctc

SEQ ID NO: 70402 - DNA, 25 bp, Homo sapien
tctgtcacagcaggtacgttccgtg

SEQ ID NO: 70403 - DNA, 25 bp, Homo sapien
ggaaacagagaaccagctccacgtg

SEQ ID NO: 70404 - DNA, 25 bp, Homo sapien
gtctttgagattccgaggtcgccca

SEQ ID NO: 70405 - DNA, 25 bp, Homo sapien
ttcgctgtcaggtggcagaagcagc

SEQ ID NO: 70406 - DNA, 25 bp, Homo sapien
gtttctgtttagaccgccaggctcg

SEQ ID NO: 70407 - DNA, 25 bp, Homo sapien
agccgactccgtctctgggtcgagg

SEQ ID NO: 70408 - DNA, 25 bp, Homo sapien
tggacaccagcctgcttcgctgtca

SEQ ID NO: 70409 - DNA, 25 bp, Homo sapien
gcaaagctccctcgtcggaacggtc

SEQ ID NO: 70410 - DNA, 25 bp, Homo sapien
ccgtctcagggtttaggagcgaacg

SEQ ID NO: 70411 - DNA, 25 bp, Homo sapien
gcggaacgtgctttgtgacctgcgc

SEQ ID NO: 70412 - DNA, 25 bp, Homo sapien
cgggctgtaggcagcttctaaaagc

SEQ ID NO: 70413 - DNA, 25 bp, Homo sapien
cggggcagctttcgagtcattttca

SEQ ID NO: 70414 - DNA, 25 bp, Homo sapien
agggcggcagatgcagatcttatga

SEQ ID NO: 70415 - DNA, 25 bp, Homo sapien
cgaattggttcagagacgggtagca

SEQ ID NO: 70416 - DNA, 25 bp, Homo sapien
tcattttcagcgagtgcaaagctcc

SEQ ID NO: 70417 - DNA, 25 bp, Homo sapien
ctctgctgtgaaccgcggcctgcag

SEQ ID NO: 70418 - DNA, 25 bp, Homo sapien
tcctggcatcctctgctgtgaaccg

SEQ ID NO: 70419 - DNA, 25 bp, Homo sapien
tagctccggtaactccacgcggggc

SEQ ID NO: 70420 - DNA, 25 bp, Homo sapien
cgcgatccagtagctccggtaactc

SEQ ID NO: 70421 - DNA, 25 bp, Homo sapien
cgctgggttttccagcagcaacctt

SEQ ID NO: 70422 - DNA, 25 bp, Homo sapien
ccagaccgggacctccgagtcaggg

SEQ ID NO: 70423 - DNA, 25 bp, Homo sapien
caaggcgctgggttttccagcagca

SEQ ID NO: 70424 - DNA, 25 bp, Homo sapien
tccgagtcagggaggattctacgcc

SEQ ID NO: 70425 - DNA, 25 bp, Homo sapien
gcggcacccatggaaccactgggca

SEQ ID NO: 70426 - DNA, 25 bp, Homo sapien
gaggacctagccctctggttgcaga

SEQ ID NO: 70427 - DNA, 25 bp, Homo sapien
ttgcggcgattccacccacagttcg

SEQ ID NO: 70428 - DNA, 25 bp, Homo sapien
cttcactggatggacgtccgacgct

SEQ ID NO: 70429 - DNA, 25 bp, Homo sapien
ggtcgcgctggttccttcactggat

SEQ ID NO: 70430 - DNA, 25 bp, Homo sapien
atgccttgtcttggcctccgcagcg

SEQ ID NO: 70431 - DNA, 25 bp, Homo sapien
gccactgcctccgatgctgttgctg

SEQ ID NO: 70432 - DNA, 25 bp, Homo sapien
tacgtccagagaatcccatgccttg

SEQ ID NO: 70433 - DNA, 25 bp, Homo sapien
ccgacggcaccggagtcggcagcct

SEQ ID NO: 70434 - DNA, 25 bp, Homo sapien
tgctacctggcagctccgcgggtgc

SEQ ID NO: 70435 - DNA, 25 bp, Homo sapien
ccaagctccatacccgcgccggccg

SEQ ID NO: 70436 - DNA, 25 bp, Homo sapien
gagttcatgtcccagtgacccccaa

SEQ ID NO: 70437 - DNA, 25 bp, Homo sapien
cgagaccagcctcggggccgagttc

SEQ ID NO: 70438 - DNA, 25 bp, Homo sapien
tgtttccgctctgcggtctccgaga

SEQ ID NO: 70439 - DNA, 25 bp, Homo sapien
ttctgctcctgtttccgctctgcgg

SEQ ID NO: 70440 - DNA, 25 bp, Homo sapien
gcctcggttcctgtcttctgctcct

SEQ ID NO: 70441 - DNA, 25 bp, Homo sapien
ggacaccattttcttgagctggctc

SEQ ID NO: 70442 - DNA, 25 bp, Homo sapien
agtgccggaatcagcaggacgaatc

SEQ ID NO: 70443 - DNA, 25 bp, Homo sapien
ggcctcaaacaacaggaagtcggca

SEQ ID NO: 70444 - DNA, 25 bp, Homo sapien
gcagcctcaccttggacaccatttt

SEQ ID NO: 70445 - DNA, 25 bp, Homo sapien
ctgaggaggtcgctaaggactgcac

SEQ ID NO: 70446 - DNA, 25 bp, Homo sapien
ggattcccgcaccaggcgacaggcg

SEQ ID NO: 70447 - DNA, 25 bp, Homo sapien
cacgcctttgttgactgtcgccgtc

SEQ ID NO: 70448 - DNA, 25 bp, Homo sapien
ggaagtcggcaccactacaccactt

SEQ ID NO: 70449 - DNA, 25 bp, Homo sapien
tgggaatgcgatgtcccttgcgccc

SEQ ID NO: 70450 - DNA, 25 bp, Homo sapien
tttctcctcgcctgcgactgtgaca

SEQ ID NO: 70451 - DNA, 25 bp, Homo sapien
actgtgacaagcctgcggccgcaca

SEQ ID NO: 70452 - DNA, 25 bp, Homo sapien
cggccgcacattgtcagcgattgtg

SEQ ID NO: 70453 - DNA, 25 bp, Homo sapien
cctaatgagggaacaatcgggctac

SEQ ID NO: 70454 - DNA, 25 bp, Homo sapien
ccctggagaaaagagccgccgccga

SEQ ID NO: 70455 - DNA, 25 bp, Homo sapien
taaattggccgtgcaaagccgagcg

SEQ ID NO: 70456 - DNA, 25 bp, Homo sapien
ccctgacagcgccataaattggccg

SEQ ID NO: 70457 - DNA, 25 bp, Homo sapien
ctgagcttcgtgtagtgtctgtccc

SEQ ID NO: 70458 - DNA, 25 bp, Homo sapien
gatggccgaatgtaccagaagtctc

SEQ ID NO: 70459 - DNA, 25 bp, Homo sapien
aatgggtgtccagcttcctttctca

SEQ ID NO: 70460 - DNA, 25 bp, Homo sapien
gaagatgcctcctgagcagacctga

SEQ ID NO: 70461 - DNA, 25 bp, Homo sapien
ttccgcaaacactccagaggggttc

SEQ ID NO: 70462 - DNA, 25 bp, Homo sapien
ctctcccaagagaaggaccctattt

SEQ ID NO: 70463 - DNA, 25 bp, Homo sapien
tcctaccacttgagggacgaaggtg

SEQ ID NO: 70464 - DNA, 25 bp, Homo sapien
gcccgttccgcagcagagttcgaag

SEQ ID NO: 70465 - DNA, 25 bp, Homo sapien
ctggccgacagcctgcagctcgaga

SEQ ID NO: 70466 - DNA, 25 bp, Homo sapien
tccgcgcaggagatcaccaacctgg

SEQ ID NO: 70467 - DNA, 25 bp, Homo sapien
accacgggctgcagacgagcgttca

SEQ ID NO: 70468 - DNA, 25 bp, Homo sapien
gcccgacgacgtctactcgcaggtg

SEQ ID NO: 70469 - DNA, 25 bp, Homo sapien
ccacaagcatcgacaagatcgcggc

SEQ ID NO: 70470 - DNA, 25 bp, Homo sapien
tgcaatcggcgccaaaaggagaagc

SEQ ID NO: 70471 - DNA, 25 bp, Homo sapien
tgaacggcatgctgagcgcgccacc

SEQ ID NO: 70472 - DNA, 25 bp, Homo sapien
gccgcagagtctgctctactcgcag

SEQ ID NO: 70473 - DNA, 25 bp, Homo sapien
gggcaggcccgttcacattttaatc

SEQ ID NO: 70474 - DNA, 25 bp, Homo sapien
tcaaatacatcgcacggctccgctg

SEQ ID NO: 70475 - DNA, 25 bp, Homo sapien
ggtcggactgattgcttttcaaata

SEQ ID NO: 70476 - DNA, 25 bp, Homo sapien
gccattggggtcgaatacacttacg

SEQ ID NO: 70477 - DNA, 25 bp, Homo sapien
tgagaaagcatttgtcgccgccagc

SEQ ID NO: 70478 - DNA, 25 bp, Homo sapien
tgaggttcctctgtgcagcgtttcc

SEQ ID NO: 70479 - DNA, 25 bp, Homo sapien
cattttaatcggagcgcaccggcgg

SEQ ID NO: 70480 - DNA, 25 bp, Homo sapien
ggcacgcacgctacttgcacgaatc

SEQ ID NO: 70481 - DNA, 25 bp, Homo sapien
tgcaccatcgcaagaagttttccta

SEQ ID NO: 70482 - DNA, 25 bp, Homo sapien
gagctccggcaatagcaacttcaga

SEQ ID NO: 70483 - DNA, 25 bp, Homo sapien
tgtttcagaggcaaccaagagctcc

SEQ ID NO: 70484 - DNA, 25 bp, Homo sapien
tgtcgcatcagactgtgactgttgc

SEQ ID NO: 70485 - DNA, 25 bp, Homo sapien
caaggtaacagagcgattcgacatc

SEQ ID NO: 70486 - DNA, 25 bp, Homo sapien
gcccactggagttgttgtgtatcaa

SEQ ID NO: 70487 - DNA, 25 bp, Homo sapien
gtcggtgcactctacgagccgtgca

SEQ ID NO: 70488 - DNA, 25 bp, Homo sapien
gccggttgctggtcatccgtaattt

SEQ ID NO: 70489 - DNA, 25 bp, Homo sapien
caagttgttttcctcgtggcgacca

SEQ ID NO: 70490 - DNA, 25 bp, Homo sapien
tggcgaccattcagcaaaacgcacg

SEQ ID NO: 70491 - DNA, 25 bp, Homo sapien
ccaaagctcgcttctctccgggagg

SEQ ID NO: 70492 - DNA, 25 bp, Homo sapien
tgtaaggcctgcctccggtgaaaac

SEQ ID NO: 70493 - DNA, 25 bp, Homo sapien
aacagtcattctcttggcggcacga

SEQ ID NO: 70494 - DNA, 25 bp, Homo sapien
agagttggctctggaagtgacctca

SEQ ID NO: 70495 - DNA, 25 bp, Homo sapien
tgcgttcttgatgagtccggtcttc

SEQ ID NO: 70496 - DNA, 25 bp, Homo sapien
gcctatgatgtcactgccggccaga

SEQ ID NO: 70497 - DNA, 25 bp, Homo sapien
cctgccacgctgagtggtctgagtg

SEQ ID NO: 70498 - DNA, 25 bp, Homo sapien
gaacctgccacgctgagtggtctga

SEQ ID NO: 70499 - DNA, 25 bp, Homo sapien
cccggaacctgccacgctgagtggt

SEQ ID NO: 70500 - DNA, 25 bp, Homo sapien
ggggagaagacacgccttcaccaca

SEQ ID NO: 70501 - DNA, 25 bp, Homo sapien
ttcaccacaaaagcacacggcccgg

SEQ ID NO: 70502 - DNA, 25 bp, Homo sapien
cgtgcagcctcagacccgaaccctg

SEQ ID NO: 70503 - DNA, 25 bp, Homo sapien
gacagaggcctctgcgtcggggaca

SEQ ID NO: 70504 - DNA, 25 bp, Homo sapien
gaagacacgccttcaccacaaaagc

SEQ ID NO: 70505 - DNA, 25 bp, Homo sapien
agtcagagcggaacagcctagtgca

SEQ ID NO: 70506 - DNA, 25 bp, Homo sapien
gcctagtgcactggcagggctcatt

SEQ ID NO: 70507 - DNA, 25 bp, Homo sapien
tccgcttcccgcgtgtgggaaactc

SEQ ID NO: 70508 - DNA, 25 bp, Homo sapien
gagatgcgctgacttgttccaaccc

SEQ ID NO: 70509 - DNA, 25 bp, Homo sapien
gccgtggtgagccttagaaagatcc

SEQ ID NO: 70510 - DNA, 25 bp, Homo sapien
ccctacaggcaccagggtaaactgc

SEQ ID NO: 70511 - DNA, 25 bp, Homo sapien
tgggaaactcgagcaccctacaggc

SEQ ID NO: 70512 - DNA, 25 bp, Homo sapien
ctttgtggaagtttcgcgccgccag

SEQ ID NO: 70513 - DNA, 25 bp, Homo sapien
gggcatttcccagcagccaaggctg

SEQ ID NO: 70514 - DNA, 25 bp, Homo sapien
cacgacgcgctgtgggcactcacag

SEQ ID NO: 70515 - DNA, 25 bp, Homo sapien
ctgcaatctggcctgacgaggcagg

SEQ ID NO: 70516 - DNA, 25 bp, Homo sapien
tcacagcggctagttgggcatttcc

SEQ ID NO: 70517 - DNA, 25 bp, Homo sapien
ctccgcagacgtgcccgggttgtca

SEQ ID NO: 70518 - DNA, 25 bp, Homo sapien
aaggatcacacaccttgcaggcgtg

SEQ ID NO: 70519 - DNA, 25 bp, Homo sapien
gctgacaaagctataacaaaggctc

SEQ ID NO: 70520 - DNA, 25 bp, Homo sapien
cccgctgggcgatcagaagagcgtt

SEQ ID NO: 70521 - DNA, 25 bp, Homo sapien
cggcctcttcgggacaacatttgaa

SEQ ID NO: 70522 - DNA, 25 bp, Homo sapien
cacgcccacgcagtacgcttaggta

SEQ ID NO: 70523 - DNA, 25 bp, Homo sapien
gcgcgctccctaatcacctgttaaa

SEQ ID NO: 70524 - DNA, 25 bp, Homo sapien
ggagacgcatcccttcttgacagtg

SEQ ID NO: 70525 - DNA, 25 bp, Homo sapien
caaaagaaggtctccgcgctggttc

SEQ ID NO: 70526 - DNA, 25 bp, Homo sapien
ggcccgcgtgcagcattaaatattc

SEQ ID NO: 70527 - DNA, 25 bp, Homo sapien
tgcacctgcgccattctcttaaaaa

SEQ ID NO: 70528 - DNA, 25 bp, Homo sapien
tggagcccgcttcttgcagaaaacc

SEQ ID NO: 70529 - DNA, 25 bp, Homo sapien
gtgagtcccgaagagactgagttca

SEQ ID NO: 70530 - DNA, 25 bp, Homo sapien
cgatccttcttgaggtcgacaccga

SEQ ID NO: 70531 - DNA, 25 bp, Homo sapien
tgcacccaatcagcgacgagctgtc

SEQ ID NO: 70532 - DNA, 25 bp, Homo sapien
gcccgagaagctcttgcacaggaca

SEQ ID NO: 70533 - DNA, 25 bp, Homo sapien
cggagcagtttcgtaccggcttctt

SEQ ID NO: 70534 - DNA, 25 bp, Homo sapien
tgggaagactggaagcggcttacct

SEQ ID NO: 70535 - DNA, 25 bp, Homo sapien
cgcccggaagcaaggcctctggaaa

SEQ ID NO: 70536 - DNA, 25 bp, Homo sapien
aatgtcagatcccaggtaaggcctg

SEQ ID NO: 70537 - DNA, 25 bp, Homo sapien
agggttcttcctagaggtgaccagg

SEQ ID NO: 70538 - DNA, 25 bp, Homo sapien
acagacgtgcggcttgggtgcaaat

SEQ ID NO: 70539 - DNA, 25 bp, Homo sapien
atcacgattaagaaggaacacacgc

SEQ ID NO: 70540 - DNA, 25 bp, Homo sapien
tgcaaatcctgtttctctgggcaga

SEQ ID NO: 70541 - DNA, 25 bp, Homo sapien
tgggtggagagcatcacgattaaga

SEQ ID NO: 70542 - DNA, 25 bp, Homo sapien
ttcataagattgctcgcggacgcgg

SEQ ID NO: 70543 - DNA, 25 bp, Homo sapien
ggccgggagtcgagcattttcataa

SEQ ID NO: 70544 - DNA, 25 bp, Homo sapien
cccagcgcaggcgtaagtgaccggt

SEQ ID NO: 70545 - DNA, 25 bp, Homo sapien
ctggaaattccacccgcattcaacg

SEQ ID NO: 70546 - DNA, 25 bp, Homo sapien
cggccagaaacgcattggcgtcaag

SEQ ID NO: 70547 - DNA, 25 bp, Homo sapien
cggaagccgctgaggaccaaacttc

SEQ ID NO: 70548 - DNA, 25 bp, Homo sapien
accttcttccggacttgctgcagga

SEQ ID NO: 70549 - DNA, 25 bp, Homo sapien
ggtcccgagctaggtcccaggactc

SEQ ID NO: 70550 - DNA, 25 bp, Homo sapien
tgaggacccaaactggcccagcgga

SEQ ID NO: 70551 - DNA, 25 bp, Homo sapien
cggaggcaacctggccaaaggcaga

SEQ ID NO: 70552 - DNA, 25 bp, Homo sapien
aagtgacgagggcacggccagaaac

SEQ ID NO: 70553 - DNA, 25 bp, Homo sapien
gccaataggaatggatgctccgaca

SEQ ID NO: 70554 - DNA, 25 bp, Homo sapien
caacacctttcgacgcagagctggg

SEQ ID NO: 70555 - DNA, 25 bp, Homo sapien
atcaggggttggcagccttacacca

SEQ ID NO: 70556 - DNA, 25 bp, Homo sapien
gcctcgatcccacagggtccaggtg

SEQ ID NO: 70557 - DNA, 25 bp, Homo sapien
cactgcgcatatgagcgcttccttc

SEQ ID NO: 70558 - DNA, 25 bp, Homo sapien
gcaccgggatgcacgcaacaccttt

SEQ ID NO: 70559 - DNA, 25 bp, Homo sapien
tgctccgacagacgaagccacgtgg

SEQ ID NO: 70560 - DNA, 25 bp, Homo sapien
ttacaccaggaacgcacctgggcgc

SEQ ID NO: 70561 - DNA, 25 bp, Homo sapien
gacacaataatccattccgccgtcg

SEQ ID NO: 70562 - DNA, 25 bp, Homo sapien
cacgcagtgcctttcgaccattcag

SEQ ID NO: 70563 - DNA, 25 bp, Homo sapien
tttcgaccattcagtttcagcgctg

SEQ ID NO: 70564 - DNA, 25 bp, Homo sapien
tcaccgaccggttgccaggaagtct

SEQ ID NO: 70565 - DNA, 25 bp, Homo sapien
ggaagtctacctcctccacgtggca

SEQ ID NO: 70566 - DNA, 25 bp, Homo sapien
cagggtccggcggatcgtcttcacg

SEQ ID NO: 70567 - DNA, 25 bp, Homo sapien
gggacgggacctcagacacaataat

SEQ ID NO: 70568 - DNA, 25 bp, Homo sapien
cccgcttcaatcagggtccggcgga

SEQ ID NO: 70569 - DNA, 25 bp, Homo sapien
tgcgcgtgcacaaccagtcggacag

SEQ ID NO: 70570 - DNA, 25 bp, Homo sapien
tgcatcctcaacacggtccgcaaga

SEQ ID NO: 70571 - DNA, 25 bp, Homo sapien
gctgtgcgcctacatgtgcatcctc

SEQ ID NO: 70572 - DNA, 25 bp, Homo sapien
tgaccgcgcctacgtggtcaccttg

SEQ ID NO: 70573 - DNA, 25 bp, Homo sapien
ccaaggtgatcatcgcggtctcctg

SEQ ID NO: 70574 - DNA, 25 bp, Homo sapien
agcgtggaccgcttcctcatcatcg

SEQ ID NO: 70575 - DNA, 25 bp, Homo sapien
atcctgctcatcatcagcgtggacc

SEQ ID NO: 70576 - DNA, 25 bp, Homo sapien
ctcagccacgctctactggtttttt

SEQ ID NO: 70577 - DNA, 25 bp, Homo sapien
atggccagcagcgtgtgaaagagtt

SEQ ID NO: 70578 - DNA, 25 bp, Homo sapien
ccagcatgcaggtagatggccagca

SEQ ID NO: 70579 - DNA, 25 bp, Homo sapien
cctcggagcaccacaggcagtagtc

SEQ ID NO: 70580 - DNA, 25 bp, Homo sapien
ggcagtagtcctcggccgctgcaaa

SEQ ID NO: 70581 - DNA, 25 bp, Homo sapien
gcccagcttcccgtgcaggatggcg

SEQ ID NO: 70582 - DNA, 25 bp, Homo sapien
gctgcaaagtcctgcagctcgtgca

SEQ ID NO: 70583 - DNA, 25 bp, Homo sapien
gtgcaccaggatatgcagcgccttc

SEQ ID NO: 70584 - DNA, 25 bp, Homo sapien
atatgcagcgccttctcatgctcgc

SEQ ID NO: 70585 - DNA, 25 bp, Homo sapien
tacctgctgcgtgaatgaataaatg

SEQ ID NO: 70586 - DNA, 25 bp, Homo sapien
tgaatgaaatgcttgggccctggga

SEQ ID NO: 70587 - DNA, 25 bp, Homo sapien
ccaccaggagacgaaggcatggttg

SEQ ID NO: 70588 - DNA, 25 bp, Homo sapien
ttgggatgcgcagccctcccacgag

SEQ ID NO: 70589 - DNA, 25 bp, Homo sapien
cgcccgggaaatacctgctgcgtga

SEQ ID NO: 70590 - DNA, 25 bp, Homo sapien
tttctgtcacctacacaggaggagg

SEQ ID NO: 70591 - DNA, 25 bp, Homo sapien
aagccgggctttgcctggctcgctc

SEQ ID NO: 70592 - DNA, 25 bp, Homo sapien
ctggctccgagcacaggccgagacg

SEQ ID NO: 70593 - DNA, 25 bp, Homo sapien
aggacagctgtcacctcggacatcg

SEQ ID NO: 70594 - DNA, 25 bp, Homo sapien
ccgcgcagttcagcggcagagatgc

SEQ ID NO: 70595 - DNA, 25 bp, Homo sapien
cttgaagcacaggtcgaggagtccc

SEQ ID NO: 70596 - DNA, 25 bp, Homo sapien
tgcggctccacagactctccttgaa

SEQ ID NO: 70597 - DNA, 25 bp, Homo sapien
aatgcacacctgtccaccaggatcg

SEQ ID NO: 70598 - DNA, 25 bp, Homo sapien
ggagaaagcacagcactcccacctt

SEQ ID NO: 70599 - DNA, 25 bp, Homo sapien
cccgcctgggtatgaaatgcacacc

SEQ ID NO: 70600 - DNA, 25 bp, Homo sapien
tctcgtccaccgtgaagcggtgata

SEQ ID NO: 70601 - DNA, 25 bp, Homo sapien
cagagtgacgacacacgcgagtctc

SEQ ID NO: 70602 - DNA, 25 bp, Homo sapien
acgccatttgtttctacgtctgaca

SEQ ID NO: 70603 - DNA, 25 bp, Homo sapien
ggactcggaactgctgctgcacccg

SEQ ID NO: 70604 - DNA, 25 bp, Homo sapien
agcttgccttaagtagccctcggca

SEQ ID NO: 70605 - DNA, 25 bp, Homo sapien
cgagtacgtcacttccgcaacgctt

SEQ ID NO: 70606 - DNA, 25 bp, Homo sapien
ctcctcttttctctggtccgtggga

SEQ ID NO: 70607 - DNA, 25 bp, Homo sapien
cctgcgaaacttgacacgccatttg

SEQ ID NO: 70608 - DNA, 25 bp, Homo sapien
cgaaccagcagcgagagaaggagcc

SEQ ID NO: 70609 - DNA, 25 bp, Homo sapien
ccctccgggtcttgggagcacagta

SEQ ID NO: 70610 - DNA, 25 bp, Homo sapien
ttggaggtactcacggcaccgcagc

SEQ ID NO: 70611 - DNA, 25 bp, Homo sapien
cccgccgtgtcatttgaccatataa

SEQ ID NO: 70612 - DNA, 25 bp, Homo sapien
accatataaggagatgcacgcctcg

SEQ ID NO: 70613 - DNA, 25 bp, Homo sapien
cacagtagttatcgggagcgtcgcc

SEQ ID NO: 70614 - DNA, 25 bp, Homo sapien
gaagcaggcggacagcgtcacctcc

SEQ ID NO: 70615 - DNA, 25 bp, Homo sapien
tctccttgggtctcgcaccggattc

SEQ ID NO: 70616 - DNA, 25 bp, Homo sapien
gggatctctgcctggtcccaggagc

SEQ ID NO: 70617 - DNA, 25 bp, Homo sapien
cgcagacaaagagcggcgcctgggc

SEQ ID NO: 70618 - DNA, 25 bp, Homo sapien
gccgcgatcggccgggagaacttaa

SEQ ID NO: 70619 - DNA, 25 bp, Homo sapien
cggcccacggcgaggtaagcgcggc

SEQ ID NO: 70620 - DNA, 25 bp, Homo sapien
ccggcacggagctcggggctagcgt

SEQ ID NO: 70621 - DNA, 25 bp, Homo sapien
ccgcggggatcgtcaggccggagcc

SEQ ID NO: 70622 - DNA, 25 bp, Homo sapien
gccagggtcgccagggcgcgtgtgc

SEQ ID NO: 70623 - DNA, 25 bp, Homo sapien
gcgtgtgccggggaagaatagccgc

SEQ ID NO: 70624 - DNA, 25 bp, Homo sapien
agaatagccgcggatcgcagggccc

SEQ ID NO: 70625 - DNA, 25 bp, Homo sapien
agataagctacaccgggccctcgtc

SEQ ID NO: 70626 - DNA, 25 bp, Homo sapien
ccttcgtcaagttcgcctatgtggc

SEQ ID NO: 70627 - DNA, 25 bp, Homo sapien
cgcgtcaccgtcatggagaagtgca

SEQ ID NO: 70628 - DNA, 25 bp, Homo sapien
ccttcagctcagtcaccgaggagga

SEQ ID NO: 70629 - DNA, 25 bp, Homo sapien
tcctcattagggacagcgagtcctc

SEQ ID NO: 70630 - DNA, 25 bp, Homo sapien
agctccggctgcaggcagtaaatgc

SEQ ID NO: 70631 - DNA, 25 bp, Homo sapien
ctgcatgtggtccagacgctgtacc

SEQ ID NO: 70632 - DNA, 25 bp, Homo sapien
aaactacgtggtggtcctcagtgac

SEQ ID NO: 70633 - DNA, 25 bp, Homo sapien
gctcgctggaatctaaggcactaga

SEQ ID NO: 70634 - DNA, 25 bp, Homo sapien
cgtgcaccgcgatgacgtcctcaag

SEQ ID NO: 70635 - DNA, 25 bp, Homo sapien
ctgacgcaccgctggagctactgac

SEQ ID NO: 70636 - DNA, 25 bp, Homo sapien
agctactgacctcgggacgactggc

SEQ ID NO: 70637 - DNA, 25 bp, Homo sapien
gacggcctacttcgttctcgagcca

SEQ ID NO: 70638 - DNA, 25 bp, Homo sapien
ctcgagccagcagaacgggttgaac

SEQ ID NO: 70639 - DNA, 25 bp, Homo sapien
ctaagcacagtcttggcgcagcggc

SEQ ID NO: 70640 - DNA, 25 bp, Homo sapien
ggcacgcaagtctcagcaattcctg

SEQ ID NO: 70641 - DNA, 25 bp, Homo sapien
gttcgtctcccatttgccatccagg

SEQ ID NO: 70642 - DNA, 25 bp, Homo sapien
ggaacactacaaaaaggcgcccatc

SEQ ID NO: 70643 - DNA, 25 bp, Homo sapien
cacggggagaagctctacctcgtca

SEQ ID NO: 70644 - DNA, 25 bp, Homo sapien
gagcagggcgagttcacattattcc

SEQ ID NO: 70645 - DNA, 25 bp, Homo sapien
tctctctttatgttcaggtcgcttg

SEQ ID NO: 70646 - DNA, 25 bp, Homo sapien
cggcttctctgcgagtctctcttta

SEQ ID NO: 70647 - DNA, 25 bp, Homo sapien
ccatggacgagctggtggaacacta

SEQ ID NO: 70648 - DNA, 25 bp, Homo sapien
tggcgctcgtgcattcaactcgttc

SEQ ID NO: 70649 - DNA, 25 bp, Homo sapien
ctcggtggtactcgcccgtgcgctg

SEQ ID NO: 70650 - DNA, 25 bp, Homo sapien
ccggcagcgacgcagggataacccg

SEQ ID NO: 70651 - DNA, 25 bp, Homo sapien
agcgacgcagggataacccgcggcc

SEQ ID NO: 70652 - DNA, 25 bp, Homo sapien
cctcgcagcacctcgaagtgcgccc

SEQ ID NO: 70653 - DNA, 25 bp, Homo sapien
cgatgccaggctgattgatagcggc

SEQ ID NO: 70654 - DNA, 25 bp, Homo sapien
caggctgattgatagcggcaccagg

SEQ ID NO: 70655 - DNA, 25 bp, Homo sapien
ccatgtggcgcttccatggtgcccg

SEQ ID NO: 70656 - DNA, 25 bp, Homo sapien
gagaggacctcggtggtactcgccc

SEQ ID NO: 70657 - DNA, 25 bp, Homo sapien
tcccagcgcgacatggacgacagcg

SEQ ID NO: 70658 - DNA, 25 bp, Homo sapien
agttgccgcctttcttgccttggtt

SEQ ID NO: 70659 - DNA, 25 bp, Homo sapien
tctgccaatggccacagtattttta

SEQ ID NO: 70660 - DNA, 25 bp, Homo sapien
cgctgagtaattttcctgaggagca

SEQ ID NO: 70661 - DNA, 25 bp, Homo sapien
agcttcatcctcctgcggttgacgg

SEQ ID NO: 70662 - DNA, 25 bp, Homo sapien
tgttttccctgagttaaagcgcgcg

SEQ ID NO: 70663 - DNA, 25 bp, Homo sapien
gccttggttttcgaagaatgtgacc

SEQ ID NO: 70664 - DNA, 25 bp, Homo sapien
aagttggcccgctttgctgcaagag

SEQ ID NO: 70665 - DNA, 25 bp, Homo sapien
tttgaacaaacggtcctgcaaggtc

SEQ ID NO: 70666 - DNA, 25 bp, Homo sapien
gccaggtgcatggtcactgaacaga

SEQ ID NO: 70667 - DNA, 25 bp, Homo sapien
gcctggcggatcctgcttcatcaaa

SEQ ID NO: 70668 - DNA, 25 bp, Homo sapien
tttactctgtgtccgtcaacccgcg

SEQ ID NO: 70669 - DNA, 25 bp, Homo sapien
gggcgttgccagagcagcatcataa

SEQ ID NO: 70670 - DNA, 25 bp, Homo sapien
ttgggagatattccacaccctggtc

SEQ ID NO: 70671 - DNA, 25 bp, Homo sapien
agtacataggtctgcccacgtcggg

SEQ ID NO: 70672 - DNA, 25 bp, Homo sapien
actggcccatgtactagaagtcgta

SEQ ID NO: 70673 - DNA, 25 bp, Homo sapien
ctttcttgctgtcgcctggttgttc

SEQ ID NO: 70674 - DNA, 25 bp, Homo sapien
gccttgggaaggcatcgccatctcc

SEQ ID NO: 70675 - DNA, 25 bp, Homo sapien
gcctcaccacgatcgcggcagagat

SEQ ID NO: 70676 - DNA, 25 bp, Homo sapien
agcacggttgctctcgcacccaagg

SEQ ID NO: 70677 - DNA, 25 bp, Homo sapien
tgcctctcgaggactctgcttgttc

SEQ ID NO: 70678 - DNA, 25 bp, Homo sapien
atacttcagtcgttccgtgtcagcc

SEQ ID NO: 70679 - DNA, 25 bp, Homo sapien
ggggcggctggaacagcatacttca

SEQ ID NO: 70680 - DNA, 25 bp, Homo sapien
cttgttcctcatcacagcacggttg

SEQ ID NO: 70681 - DNA, 25 bp, Homo sapien
cttcaggtcgctgccaatcccggag

SEQ ID NO: 70682 - DNA, 25 bp, Homo sapien
tcggccgcgctttgtcttataggga

SEQ ID NO: 70683 - DNA, 25 bp, Homo sapien
ccgtaaacttcgctgctgagcatgc

SEQ ID NO: 70684 - DNA, 25 bp, Homo sapien
tgggctcgcgtaccttccagtagag

SEQ ID NO: 70685 - DNA, 25 bp, Homo sapien
gcgtcgtccatataccaggcctgca

SEQ ID NO: 70686 - DNA, 25 bp, Homo sapien
caggcctgcaccatgacgcgcagtg

SEQ ID NO: 70687 - DNA, 25 bp, Homo sapien
cggctccgctgttttcggaagcaaa

SEQ ID NO: 70688 - DNA, 25 bp, Homo sapien
cccaggacactttcaagcggagtcc

SEQ ID NO: 70689 - DNA, 25 bp, Homo sapien
ttgcaatgctaggaggatgagggcg

SEQ ID NO: 70690 - DNA, 25 bp, Homo sapien
cgcagctgacaggtaaggcggcggc

SEQ ID NO: 70691 - DNA, 25 bp, Homo sapien
cagggtgcagcgtcgagcccgcggt

SEQ ID NO: 70692 - DNA, 25 bp, Homo sapien
tggaaataaaatacccccatatcgc

SEQ ID NO: 70693 - DNA, 25 bp, Homo sapien
tcaaaagcctggacgcaggagaagg

SEQ ID NO: 70694 - DNA, 25 bp, Homo sapien
ggggaggcagtgaaaaggggagcga

SEQ ID NO: 70695 - DNA, 25 bp, Homo sapien
tggccgcgcagctgacaggtaaggc

SEQ ID NO: 70696 - DNA, 25 bp, Homo sapien
ccctcaaaagcctggacgcaggaga

SEQ ID NO: 70697 - DNA, 25 bp, Homo sapien
cgcctgcagacatgacgacagcgca

SEQ ID NO: 70698 - DNA, 25 bp, Homo sapien
aggagtacagcctgtcgccgtcgtc

SEQ ID NO: 70699 - DNA, 25 bp, Homo sapien
ccctggacatggaggagtacagcct

SEQ ID NO: 70700 - DNA, 25 bp, Homo sapien
ttccagagccggtacaggaaggccc

SEQ ID NO: 70701 - DNA, 25 bp, Homo sapien
tcagcattttggaagagacgttccc

SEQ ID NO: 70702 - DNA, 25 bp, Homo sapien
ggtaatccttcatcgccttctgcag

SEQ ID NO: 70703 - DNA, 25 bp, Homo sapien
tgcttgttggcggtcaggtaatcct

SEQ ID NO: 70704 - DNA, 25 bp, Homo sapien
agcccagcgcagaaaagggcgcctc

SEQ ID NO: 70705 - DNA, 25 bp, Homo sapien
ttgttcatctcgctcaaccaggctc

SEQ ID NO: 70706 - DNA, 25 bp, Homo sapien
cggctgcctaaaaaggcgtgtttct

SEQ ID NO: 70707 - DNA, 25 bp, Homo sapien
tgcacgcctcattgtttcgggcagc

SEQ ID NO: 70708 - DNA, 25 bp, Homo sapien
cgcggatttctgcttgtcgcggaga

SEQ ID NO: 70709 - DNA, 25 bp, Homo sapien
catccagccctagttcttccgaagg

SEQ ID NO: 70710 - DNA, 25 bp, Homo sapien
ggttacctgcacagtacccgcctgg

SEQ ID NO: 70711 - DNA, 25 bp, Homo sapien
agtgagtctttgtgtaccctgtcca

SEQ ID NO: 70712 - DNA, 25 bp, Homo sapien
cggctcgctagctccctttgttcat

SEQ ID NO: 70713 - DNA, 25 bp, Homo sapien
gcgcggtcttgtcatcttgttgctc

SEQ ID NO: 70714 - DNA, 25 bp, Homo sapien
cacgggtaggcgcttagatccaaaa

SEQ ID NO: 70715 - DNA, 25 bp, Homo sapien
gcggcgccacaacagctgaacagac

SEQ ID NO: 70716 - DNA, 25 bp, Homo sapien
ctacttgtgtctaggcgctcgcgaa

SEQ ID NO: 70717 - DNA, 25 bp, Homo sapien
acttccgcttttaggccgagacacg

SEQ ID NO: 70718 - DNA, 25 bp, Homo sapien
gcagggactaggcattttagcaacc

SEQ ID NO: 70719 - DNA, 25 bp, Homo sapien
gtggtcctgtcttggatgcccatta

SEQ ID NO: 70720 - DNA, 25 bp, Homo sapien
cgtgcgcttacctcctactcagatg

SEQ ID NO: 70721 - DNA, 25 bp, Homo sapien
aggcggacgtgaaaccgagtggaga

SEQ ID NO: 70722 - DNA, 25 bp, Homo sapien
cgcactgagcggtggacgtgaacct

SEQ ID NO: 70723 - DNA, 25 bp, Homo sapien
atggaaagagactggcgcactgagc

SEQ ID NO: 70724 - DNA, 25 bp, Homo sapien
gaagatggaaagagactggcgcact

SEQ ID NO: 70725 - DNA, 25 bp, Homo sapien
aagcggacgtgaaactgagggaaga

SEQ ID NO: 70726 - DNA, 25 bp, Homo sapien
agagatggaaagacacgcggtgcac

SEQ ID NO: 70727 - DNA, 25 bp, Homo sapien
actgagtagagatggaaagacacgc

SEQ ID NO: 70728 - DNA, 25 bp, Homo sapien
cactgagcggtggacgtgaacctga

SEQ ID NO: 70729 - DNA, 25 bp, Homo sapien
tcagggtgcaagaggctacaaagtc

SEQ ID NO: 70730 - DNA, 25 bp, Homo sapien
ttgctgtctggcaccgttgctgtca

SEQ ID NO: 70731 - DNA, 25 bp, Homo sapien
gtttttccctctcggtgggatgcga

SEQ ID NO: 70732 - DNA, 25 bp, Homo sapien
tcggaaacgccttgggcaccgagcc

SEQ ID NO: 70733 - DNA, 25 bp, Homo sapien
cgtgcagccaccactccaggtagga

SEQ ID NO: 70734 - DNA, 25 bp, Homo sapien
tcccaggttcttggagacgccgagt

SEQ ID NO: 70735 - DNA, 25 bp, Homo sapien
gggacttttcccaatactcgatcga

SEQ ID NO: 70736 - DNA, 25 bp, Homo sapien
gtccgcctccggatgtctgacgatc

SEQ ID NO: 70737 - DNA, 25 bp, Homo sapien
tgtacgaattgccacagcgaccgcc

SEQ ID NO: 70738 - DNA, 25 bp, Homo sapien
caataaccggcagtggcgggaccca

SEQ ID NO: 70739 - DNA, 25 bp, Homo sapien
ccaggtagaacgtctagacggactc

SEQ ID NO: 70740 - DNA, 25 bp, Homo sapien
ttctcccggacgcagacacggaagc

SEQ ID NO: 70741 - DNA, 25 bp, Homo sapien
agtgctgccgagctgtagctatgga

SEQ ID NO: 70742 - DNA, 25 bp, Homo sapien
agcgcgacctttgacctgcagtaga

SEQ ID NO: 70743 - DNA, 25 bp, Homo sapien
tagagcccgtttgtgtacgaattgc

SEQ ID NO: 70744 - DNA, 25 bp, Homo sapien
atctttcgtaaactctatccctggg

SEQ ID NO: 70745 - DNA, 25 bp, Homo sapien
gccgcgcagccacgcgagtggaatc

SEQ ID NO: 70746 - DNA, 25 bp, Homo sapien
agacggctgctgttcactcccgggt

SEQ ID NO: 70747 - DNA, 25 bp, Homo sapien
ggatgacccacaggtacgggccgca

SEQ ID NO: 70748 - DNA, 25 bp, Homo sapien
catccttgttgtagggaactcggcc

SEQ ID NO: 70749 - DNA, 25 bp, Homo sapien
acgcgagtggaatcagaggagcctc

SEQ ID NO: 70750 - DNA, 25 bp, Homo sapien
gggcggaaccctgtgtagctcccac

SEQ ID NO: 70751 - DNA, 25 bp, Homo sapien
ggtgaccgatccagaccaggtcctc

SEQ ID NO: 70752 - DNA, 25 bp, Homo sapien
ccgtcaccgccatccttgttgtagg

SEQ ID NO: 70753 - DNA, 25 bp, Homo sapien
atctgatcccggcttgccaagacac

SEQ ID NO: 70754 - DNA, 25 bp, Homo sapien
gcctcgcgctgctcaggcgtcatgg

SEQ ID NO: 70755 - DNA, 25 bp, Homo sapien
caaggctgacgtggagcggtacatc

SEQ ID NO: 70756 - DNA, 25 bp, Homo sapien
cactggtttgcaggcgctttcctct

SEQ ID NO: 70757 - DNA, 25 bp, Homo sapien
acggcgctgcgtcactggtttgcag

SEQ ID NO: 70758 - DNA, 25 bp, Homo sapien
ggctgcgccgcaagttcgtcacagt

SEQ ID NO: 70759 - DNA, 25 bp, Homo sapien
caacgtggcgcacactgctgacgca

SEQ ID NO: 70760 - DNA, 25 bp, Homo sapien
ctgctgacgcagtacgcaagttcgt

SEQ ID NO: 70761 - DNA, 25 bp, Homo sapien
accggtctatgtggtgagcgcaacg

SEQ ID NO: 70762 - DNA, 25 bp, Homo sapien
tgagcgcaacgcacaccaaacttaa

SEQ ID NO: 70763 - DNA, 25 bp, Homo sapien
ctcagttacgaggtgtgtagtgcta

SEQ ID NO: 70764 - DNA, 25 bp, Homo sapien
gactggtacggttgctgtgtgctat

SEQ ID NO: 70765 - DNA, 25 bp, Homo sapien
caggatttagtagtggagagtctca

SEQ ID NO: 70766 - DNA, 25 bp, Homo sapien
ggagagtctcaaaagccgctacgga

SEQ ID NO: 70767 - DNA, 25 bp, Homo sapien
acgagaaacttggaggacgcgctga

SEQ ID NO: 70768 - DNA, 25 bp, Homo sapien
atcgcggggagatgcaatactactc

SEQ ID NO: 70769 - DNA, 25 bp, Homo sapien
tctgaatagcaagggcgcagcctga

SEQ ID NO: 70770 - DNA, 25 bp, Homo sapien
tctccagagaactgtggtccaggca

SEQ ID NO: 70771 - DNA, 25 bp, Homo sapien
acggggcagtcacagcttgatcagc

SEQ ID NO: 70772 - DNA, 25 bp, Homo sapien
gtgaggaagagactagcggcaaaca

SEQ ID NO: 70773 - DNA, 25 bp, Homo sapien
ggggccgaatcctatctgaatagca

SEQ ID NO: 70774 - DNA, 25 bp, Homo sapien
gctgccagatggtgtcaacgctgca

SEQ ID NO: 70775 - DNA, 25 bp, Homo sapien
ctgcactgggcttccgaggaggtct

SEQ ID NO: 70776 - DNA, 25 bp, Homo sapien
aacagattggacagaagcggcttca

SEQ ID NO: 70777 - DNA, 25 bp, Homo sapien
ccttcattttgtgagtctgcgctga

SEQ ID NO: 70778 - DNA, 25 bp, Homo sapien
cgttctagaagacataaatggtgcc

SEQ ID NO: 70779 - DNA, 25 bp, Homo sapien
cctgcggttccagcgcgttcctgtt

SEQ ID NO: 70780 - DNA, 25 bp, Homo sapien
aaatggtgccttcattttgtgagtc

SEQ ID NO: 70781 - DNA, 25 bp, Homo sapien
cctttcaagacggcgggagccctgc

SEQ ID NO: 70782 - DNA, 25 bp, Homo sapien
tgctttccacgccagaggcctttca

SEQ ID NO: 70783 - DNA, 25 bp, Homo sapien
aggcgggcggttccgccacctgctt

SEQ ID NO: 70784 - DNA, 25 bp, Homo sapien
tctccctcccgttctagaagacata

SEQ ID NO: 70785 - DNA, 25 bp, Homo sapien
ctctgccggtggcaacctggacgcg

SEQ ID NO: 70786 - DNA, 25 bp, Homo sapien
gagagcgccgcttcagcgtcggcca

SEQ ID NO: 70787 - DNA, 25 bp, Homo sapien
cagtgaagttctgctgtgtgcaccc

SEQ ID NO: 70788 - DNA, 25 bp, Homo sapien
agtccgcgggtctctagcgcacggc

SEQ ID NO: 70789 - DNA, 25 bp, Homo sapien
gctgcaccgagtccgcgggtctcta

SEQ ID NO: 70790 - DNA, 25 bp, Homo sapien
ccggcgagacctgcgccaacgccta

SEQ ID NO: 70791 - DNA, 25 bp, Homo sapien
ccaacgcctacctccgggccacagg

SEQ ID NO: 70792 - DNA, 25 bp, Homo sapien
tcagacccagcagtcggctctgccc

SEQ ID NO: 70793 - DNA, 25 bp, Homo sapien
cgtcacggggctagctgacagaacc

SEQ ID NO: 70794 - DNA, 25 bp, Homo sapien
tttgtagaatcgtcgccggcttacc

SEQ ID NO: 70795 - DNA, 25 bp, Homo sapien
cgtgactcggaagcgtgactttgtt

SEQ ID NO: 70796 - DNA, 25 bp, Homo sapien
tcggaagcgtgactttgttgatctc

SEQ ID NO: 70797 - DNA, 25 bp, Homo sapien
tctccatgtatttggcgcgggtcgg

SEQ ID NO: 70798 - DNA, 25 bp, Homo sapien
cagagttccgcgtaggcggaccaca

SEQ ID NO: 70799 - DNA, 25 bp, Homo sapien
cgctcgggaggtattgtccgtccct

SEQ ID NO: 70800 - DNA, 25 bp, Homo sapien
tccctccgggctttgtagaatcgtc

SEQ ID NO: 70801 - DNA, 25 bp, Homo sapien
agaacccgttgagcttcgtgcccgg

SEQ ID NO: 70802 - DNA, 25 bp, Homo sapien
ggaccaggctaatcgccggcttgcg

SEQ ID NO: 70803 - DNA, 25 bp, Homo sapien
atcctctggaggacagcgactagcg

SEQ ID NO: 70804 - DNA, 25 bp, Homo sapien
gttggcaggaaacgtccctctctga

SEQ ID NO: 70805 - DNA, 25 bp, Homo sapien
gaacggtcctgctgaatcctctgga

SEQ ID NO: 70806 - DNA, 25 bp, Homo sapien
tgcgcccaagcgaagggaagtcctg

SEQ ID NO: 70807 - DNA, 25 bp, Homo sapien
ccaccagccggggtgaagaaagtca

SEQ ID NO: 70808 - DNA, 25 bp, Homo sapien
ccgcttgcagcacagaacccgttga

SEQ ID NO: 70809 - DNA, 25 bp, Homo sapien
gaatccaggtgaccgccgagcccga

SEQ ID NO: 70810 - DNA, 25 bp, Homo sapien
ggcgccaagtacgtgcacctcaaga

SEQ ID NO: 70811 - DNA, 25 bp, Homo sapien
cccgcgcgcacttcaaggagctggt

SEQ ID NO: 70812 - DNA, 25 bp, Homo sapien
cctctggcctcagacgcgtaggctg

SEQ ID NO: 70813 - DNA, 25 bp, Homo sapien
aactgcggagcagtgattgcggccc

SEQ ID NO: 70814 - DNA, 25 bp, Homo sapien
aggagctaccctcgacgcctgagga

SEQ ID NO: 70815 - DNA, 25 bp, Homo sapien
tgagcgttttgcctgcgccaagcga

SEQ ID NO: 70816 - DNA, 25 bp, Homo sapien
ctcgcaggaagaactcgcggcgcga

SEQ ID NO: 70817 - DNA, 25 bp, Homo sapien
gtcactaatgcctggggatccaccc

SEQ ID NO: 70818 - DNA, 25 bp, Homo sapien
acctcgagtcactgtggtaagtccc

SEQ ID NO: 70819 - DNA, 25 bp, Homo sapien
cagggactggtgatctaggtagcca

SEQ ID NO: 70820 - DNA, 25 bp, Homo sapien
tgctccaggaatgggacctcgagtc

SEQ ID NO: 70821 - DNA, 25 bp, Homo sapien
ccaccgagatggaaaagtgaacatc

SEQ ID NO: 70822 - DNA, 25 bp, Homo sapien
tcccaccatggacagcttcgactta

SEQ ID NO: 70823 - DNA, 25 bp, Homo sapien
agcttcgacttagccctgctccagg

SEQ ID NO: 70824 - DNA, 25 bp, Homo sapien
tgcgaagtgcccttagaggatgctc

SEQ ID NO: 70825 - DNA, 25 bp, Homo sapien
acagtgctgaggcagaacgcaggtt

SEQ ID NO: 70826 - DNA, 25 bp, Homo sapien
gatacacagtgctgaggcagaacgc

SEQ ID NO: 70827 - DNA, 25 bp, Homo sapien
tgctgaggcagaacgcaggttcgtc

SEQ ID NO: 70828 - DNA, 25 bp, Homo sapien
ggcagaacgcaggttcgtcacagtg

SEQ ID NO: 70829 - DNA, 25 bp, Homo sapien
aacgcaggttcgtcacagtgggcct

SEQ ID NO: 70830 - DNA, 25 bp, Homo sapien
aggttcgtcacagtgggcctccgtg

SEQ ID NO: 70831 - DNA, 25 bp, Homo sapien
gctgagcggtgctcgcacgcgtctc

SEQ ID NO: 70832 - DNA, 25 bp, Homo sapien
caaggccgatgtggagcggtacgtc

SEQ ID NO: 70833 - DNA, 25 bp, Homo sapien
gcgcacccttgtttggtgaccaatg

SEQ ID NO: 70834 - DNA, 25 bp, Homo sapien
gacccatgaggtaaggaggacttcc

SEQ ID NO: 70835 - DNA, 25 bp, Homo sapien
tcccagggagaaagcgaacccgctg

SEQ ID NO: 70836 - DNA, 25 bp, Homo sapien
gtagtcaagcgacccgacaagcctc

SEQ ID NO: 70837 - DNA, 25 bp, Homo sapien
ctctgctttcggtctttctcggttc

SEQ ID NO: 70838 - DNA, 25 bp, Homo sapien
gtcttccgatgcctgcgggacacag

SEQ ID NO: 70839 - DNA, 25 bp, Homo sapien
ttccctgctcattgggctgctcagc

SEQ ID NO: 70840 - DNA, 25 bp, Homo sapien
cgcagcccgcacgttgtagtcaagc

SEQ ID NO: 70841 - DNA, 25 bp, Homo sapien
tgtctatgcgaagcaccgacgcagc

SEQ ID NO: 70842 - DNA, 25 bp, Homo sapien
tcttgcaacagtggccgcacgcata

SEQ ID NO: 70843 - DNA, 25 bp, Homo sapien
acgcataggcaagtggctcggcacc

SEQ ID NO: 70844 - DNA, 25 bp, Homo sapien
gtggttcgggagcacccaagtgaaa

SEQ ID NO: 70845 - DNA, 25 bp, Homo sapien
ccatccttgtcgtgccaagcggtta

SEQ ID NO: 70846 - DNA, 25 bp, Homo sapien
agtgggtgcatggaactcctcgcac

SEQ ID NO: 70847 - DNA, 25 bp, Homo sapien
gtcagtttcctcgtcatcgttgtca

SEQ ID NO: 70848 - DNA, 25 bp, Homo sapien
gcttggtgtcgtttttccttgagct

SEQ ID NO: 70849 - DNA, 25 bp, Homo sapien
aagatcctgagagtttgcacgggcc

SEQ ID NO: 70850 - DNA, 25 bp, Homo sapien
tcgagtaaccgaacccagctctcag

SEQ ID NO: 70851 - DNA, 25 bp, Homo sapien
tctgcccacctgatgtcactcgagg

SEQ ID NO: 70852 - DNA, 25 bp, Homo sapien
catagggtgccttcccggtaagatc

SEQ ID NO: 70853 - DNA, 25 bp, Homo sapien
cccgactgagcaaaaaggggcttca

SEQ ID NO: 70854 - DNA, 25 bp, Homo sapien
ggcgcccagtgacccgactgagcaa

SEQ ID NO: 70855 - DNA, 25 bp, Homo sapien
atgagccggtgtcccgttttagcgc

SEQ ID NO: 70856 - DNA, 25 bp, Homo sapien
cacccagtggtgcattcgagtaacc

SEQ ID NO: 70857 - DNA, 25 bp, Homo sapien
ccagcggcatcggatggctctgcct

SEQ ID NO: 70858 - DNA, 25 bp, Homo sapien
tgcagccagcagatcctcagtgggc

SEQ ID NO: 70859 - DNA, 25 bp, Homo sapien
aacgttccagccgagcaggtccttc

SEQ ID NO: 70860 - DNA, 25 bp, Homo sapien
gcgcgcagcctgtcaaatatcacct

SEQ ID NO: 70861 - DNA, 25 bp, Homo sapien
cactcaccagctcgggcaggaagaa

SEQ ID NO: 70862 - DNA, 25 bp, Homo sapien
ggtctctctcttctcggtccggtct

SEQ ID NO: 70863 - DNA, 25 bp, Homo sapien
tctgcctcttgagtacagctgcgcc

SEQ ID NO: 70864 - DNA, 25 bp, Homo sapien
ccgagtggcatctgcctcttgagta

SEQ ID NO: 70865 - DNA, 25 bp, Homo sapien
cgaacacggcacgatcgccggggtc

SEQ ID NO: 70866 - DNA, 25 bp, Homo sapien
tcgcacgatttcaggacgaggctgc

SEQ ID NO: 70867 - DNA, 25 bp, Homo sapien
aggcttctagctcacaatcgcacga

SEQ ID NO: 70868 - DNA, 25 bp, Homo sapien
gtttatgagtgacccagaaggcttc

SEQ ID NO: 70869 - DNA, 25 bp, Homo sapien
cgagtgcaccttattttctctttgg

SEQ ID NO: 70870 - DNA, 25 bp, Homo sapien
tttagacgggaaactcgagtgcacc

SEQ ID NO: 70871 - DNA, 25 bp, Homo sapien
atctccagggaaaatatttagacgg

SEQ ID NO: 70872 - DNA, 25 bp, Homo sapien
agcgcacctttccatctccagggaa

SEQ ID NO: 70873 - DNA, 25 bp, Homo sapien
ctgcacagcctgaccatacctgttg

SEQ ID NO: 70874 - DNA, 25 bp, Homo sapien
gattgctccagttgccagggaaacc

SEQ ID NO: 70875 - DNA, 25 bp, Homo sapien
cggtgctctgattgctccagttgcc

SEQ ID NO: 70876 - DNA, 25 bp, Homo sapien
ggatctcgctgtcgtctcgccagca

SEQ ID NO: 70877 - DNA, 25 bp, Homo sapien
ctggagaggatctcgctgtcgtctc

SEQ ID NO: 70878 - DNA, 25 bp, Homo sapien
tcagctcctgattgcggcgccgcag

SEQ ID NO: 70879 - DNA, 25 bp, Homo sapien
ccatacctgttgcttcagctcctga

SEQ ID NO: 70880 - DNA, 25 bp, Homo sapien
agaaggtgacgccatcgatgtgcgc

SEQ ID NO: 70881 - DNA, 25 bp, Homo sapien
gcaagaaagtagcagaaagtgaggc

SEQ ID NO: 70882 - DNA, 25 bp, Homo sapien
caggaagtctgtgcccgagaacagc

SEQ ID NO: 70883 - DNA, 25 bp, Homo sapien
acagcagaaataagagccagggagg

SEQ ID NO: 70884 - DNA, 25 bp, Homo sapien
gatcttcgagttcaaagagaccctc

SEQ ID NO: 70885 - DNA, 25 bp, Homo sapien
caaagagaccctcggaacgtaagtg

SEQ ID NO: 70886 - DNA, 25 bp, Homo sapien
taccgcggcagaaacccagcctgtc

SEQ ID NO: 70887 - DNA, 25 bp, Homo sapien
tcattgtcccgttctcggcgctgcg

SEQ ID NO: 70888 - DNA, 25 bp, Homo sapien
gcgcgacttcccacttctcctgcca

SEQ ID NO: 70889 - DNA, 25 bp, Homo sapien
aatcgccgctgtccttgagcgtgca

SEQ ID NO: 70890 - DNA, 25 bp, Homo sapien
tgagcttggcgctcaggtcctggac

SEQ ID NO: 70891 - DNA, 25 bp, Homo sapien
ggcgccagtccttcttctcgtaggg

SEQ ID NO: 70892 - DNA, 25 bp, Homo sapien
ggttcccaaggaaggcgcaggtcat

SEQ ID NO: 70893 - DNA, 25 bp, Homo sapien
acacgccgctggtggagttgtacca

SEQ ID NO: 70894 - DNA, 25 bp, Homo sapien
gttctccaccagcacgctgtaatcg

SEQ ID NO: 70895 - DNA, 25 bp, Homo sapien
accatagacggtgagcgtgcagctg

SEQ ID NO: 70896 - DNA, 25 bp, Homo sapien
gtgatgttgacgtcgcccttgtaga

SEQ ID NO: 70897 - DNA, 25 bp, Homo sapien
tccaagtagcgcctccgcagtcggt

SEQ ID NO: 70898 - DNA, 25 bp, Homo sapien
gacaaaaatgaagcgaaggcggcga

SEQ ID NO: 70899 - DNA, 25 bp, Homo sapien
aggtccagcttcttctgcgtcgccg

SEQ ID NO: 70900 - DNA, 25 bp, Homo sapien
tccttttcctccagtccaagtagcg

SEQ ID NO: 70901 - DNA, 25 bp, Homo sapien
ccaggagtactccagaagcgaaggc

SEQ ID NO: 70902 - DNA, 25 bp, Homo sapien
tactagcacggacaactgcagtgtc

SEQ ID NO: 70903 - DNA, 25 bp, Homo sapien
tccagaagcgaaggctactagcacg

SEQ ID NO: 70904 - DNA, 25 bp, Homo sapien
tgcagtgtcctctctgacacatccg

SEQ ID NO: 70905 - DNA, 25 bp, Homo sapien
gcagattatcgcacgcgctcctctg

SEQ ID NO: 70906 - DNA, 25 bp, Homo sapien
ctttcacttgggtgctcccgaacca

SEQ ID NO: 70907 - DNA, 25 bp, Homo sapien
agccacttgcctatgcgtgcggcca

SEQ ID NO: 70908 - DNA, 25 bp, Homo sapien
cgtgcggccactgttgcaagacgtt

SEQ ID NO: 70909 - DNA, 25 bp, Homo sapien
ccgggagagagccaagcacctcctt

SEQ ID NO: 70910 - DNA, 25 bp, Homo sapien
tgcgaggagttccatgcacccactg

SEQ ID NO: 70911 - DNA, 25 bp, Homo sapien
gctatgtaaccgcttggcacgacaa

SEQ ID NO: 70912 - DNA, 25 bp, Homo sapien
gctgcgtcggtgcttcgcatagaca

SEQ ID NO: 70913 - DNA, 25 bp, Homo sapien
accaaacaagggtgcgcgcctcact

SEQ ID NO: 70914 - DNA, 25 bp, Homo sapien
ggaagtcctccttacctcatgggtc

SEQ ID NO: 70915 - DNA, 25 bp, Homo sapien
ctgtgtcccgcaggcatcggaagac

SEQ ID NO: 70916 - DNA, 25 bp, Homo sapien
aagacccggggctgcatcagcactc

SEQ ID NO: 70917 - DNA, 25 bp, Homo sapien
gcgttttcctgctgccttggagttc

SEQ ID NO: 70918 - DNA, 25 bp, Homo sapien
ggggacgcgcattggtcaccaaaca

SEQ ID NO: 70919 - DNA, 25 bp, Homo sapien
ttccagcgggttcgctttctccctg

SEQ ID NO: 70920 - DNA, 25 bp, Homo sapien
tgtcgggtcgcttgactacaacgtg

SEQ ID NO: 70921 - DNA, 25 bp, Homo sapien
cccattcctggagcagggctaagtc

SEQ ID NO: 70922 - DNA, 25 bp, Homo sapien
tctaagggcacttcgcagcagcacc

SEQ ID NO: 70923 - DNA, 25 bp, Homo sapien
ctaagtcgaagctgtccatggtggg

SEQ ID NO: 70924 - DNA, 25 bp, Homo sapien
ggctacctagatcaccagtccctgg

SEQ ID NO: 70925 - DNA, 25 bp, Homo sapien
acggggacttaccacagtgactcga

SEQ ID NO: 70926 - DNA, 25 bp, Homo sapien
ttttccatctcggtggaagtgggtg

SEQ ID NO: 70927 - DNA, 25 bp, Homo sapien
agtgactcgaggtcccattcctgga

SEQ ID NO: 70928 - DNA, 25 bp, Homo sapien
gccctggatgttcacttttccatct

SEQ ID NO: 70929 - DNA, 25 bp, Homo sapien
ggcccactgtgacgaacctgcgttc

SEQ ID NO: 70930 - DNA, 25 bp, Homo sapien
gacgtaccgctccacatcggccttg

SEQ ID NO: 70931 - DNA, 25 bp, Homo sapien
cccactgtgacgaacctgcgttctg

SEQ ID NO: 70932 - DNA, 25 bp, Homo sapien
cacggaggcccactgtgacgaacct

SEQ ID NO: 70933 - DNA, 25 bp, Homo sapien
gagacgcgtgcgagcaccgctcagc

SEQ ID NO: 70934 - DNA, 25 bp, Homo sapien
cgacggggtgagacccagcaccgag

SEQ ID NO: 70935 - DNA, 25 bp, Homo sapien
gacgaacctgcgttctgcctcagca

SEQ ID NO: 70936 - DNA, 25 bp, Homo sapien
ctgtgacgaacctgcgttctgcctc

SEQ ID NO: 70937 - DNA, 25 bp, Homo sapien
cttgctgggtgggacacattccaaa

SEQ ID NO: 70938 - DNA, 25 bp, Homo sapien
tggccggcagcggccaaacctgaac

SEQ ID NO: 70939 - DNA, 25 bp, Homo sapien
tgtccatggccagaggacgctggcc

SEQ ID NO: 70940 - DNA, 25 bp, Homo sapien
ccagacggacacttactgaaggaca

SEQ ID NO: 70941 - DNA, 25 bp, Homo sapien
tgctgggtgggacacattccaaacc

SEQ ID NO: 70942 - DNA, 25 bp, Homo sapien
ggctctcaagcagcccacggccttg

SEQ ID NO: 70943 - DNA, 25 bp, Homo sapien
gggcctcagcggaacccaaggtgcc

SEQ ID NO: 70944 - DNA, 25 bp, Homo sapien
cccaccagacggacacttactgaag

SEQ ID NO: 70945 - DNA, 25 bp, Homo sapien
gagggcgttctagggtcggctgcgt

SEQ ID NO: 70946 - DNA, 25 bp, Homo sapien
gcgttctagggtcggctgcgtaatt

SEQ ID NO: 70947 - DNA, 25 bp, Homo sapien
cgttctagggtcggctgcgtaatta

SEQ ID NO: 70948 - DNA, 25 bp, Homo sapien
gttctagggtcggctgcgtaattat

SEQ ID NO: 70949 - DNA, 25 bp, Homo sapien
ttctagggtcggctgcgtaattata

SEQ ID NO: 70950 - DNA, 25 bp, Homo sapien
tctagggtcggctgcgtaattatac

SEQ ID NO: 70951 - DNA, 25 bp, Homo sapien
ggagggcgttctagggtcggctgcg

SEQ ID NO: 70952 - DNA, 25 bp, Homo sapien
ctagggtcggctgcgtaattatacg

SEQ ID NO: 70953 - DNA, 25 bp, Homo sapien
gttttgggcttagcgccttcatgta

SEQ ID NO: 70954 - DNA, 25 bp, Homo sapien
cctcccgctttctggcagttttcta

SEQ ID NO: 70955 - DNA, 25 bp, Homo sapien
gcagttttctattcagcgtcctcgg

SEQ ID NO: 70956 - DNA, 25 bp, Homo sapien
cgtcctcggctgtgagaaaacatcc

SEQ ID NO: 70957 - DNA, 25 bp, Homo sapien
ccagatgctgaaaccaatagtctta

SEQ ID NO: 70958 - DNA, 25 bp, Homo sapien
tgacgacggcctgtggaaaaacctg

SEQ ID NO: 70959 - DNA, 25 bp, Homo sapien
aaaatccgtgtgcagggtcgagact

SEQ ID NO: 70960 - DNA, 25 bp, Homo sapien
ttagcccagaatctcaaacgccgtg

SEQ ID NO: 70961 - DNA, 25 bp, Homo sapien
ctgggcaagcgctggaaaatgctga

SEQ ID NO: 70962 - DNA, 25 bp, Homo sapien
ggtgccaagacctccaagggctcca

SEQ ID NO: 70963 - DNA, 25 bp, Homo sapien
ctccagcaagaaatgcggcaagctc

SEQ ID NO: 70964 - DNA, 25 bp, Homo sapien
ggcaagacggtcaagtgcgtgtttc

SEQ ID NO: 70965 - DNA, 25 bp, Homo sapien
acccagactggtgcaagacggcgtc

SEQ ID NO: 70966 - DNA, 25 bp, Homo sapien
aattcatggcttgcagcccggtggc

SEQ ID NO: 70967 - DNA, 25 bp, Homo sapien
tcgaacgcaggaagatcatggagca

SEQ ID NO: 70968 - DNA, 25 bp, Homo sapien
gacagcgagaagatcccgttcatcc

SEQ ID NO: 70969 - DNA, 25 bp, Homo sapien
gggtcctctgctcattccggcaata

SEQ ID NO: 70970 - DNA, 25 bp, Homo sapien
ttctcggtaactggacttgggcttg

SEQ ID NO: 70971 - DNA, 25 bp, Homo sapien
tggctcactcgccttgtggacacgc

SEQ ID NO: 70972 - DNA, 25 bp, Homo sapien
ccggttgaggcttctccacgaactc

SEQ ID NO: 70973 - DNA, 25 bp, Homo sapien
ccaggctctgccagggtttagcatt

SEQ ID NO: 70974 - DNA, 25 bp, Homo sapien
gtagaatatcttggcggactccttg

SEQ ID NO: 70975 - DNA, 25 bp, Homo sapien
tctcgggcaatgacagctgcttttc

SEQ ID NO: 70976 - DNA, 25 bp, Homo sapien
aggacgcgttttcgcctcttagcca

SEQ ID NO: 70977 - DNA, 25 bp, Homo sapien
ttgttgaacctgtttcttgagtccc

SEQ ID NO: 70978 - DNA, 25 bp, Homo sapien
ggaggccaccgtagaagcgcccgct

SEQ ID NO: 70979 - DNA, 25 bp, Homo sapien
tgcaccgctacctggacggcgactt

SEQ ID NO: 70980 - DNA, 25 bp, Homo sapien
acggcgacttctggagcctcaagaa

SEQ ID NO: 70981 - DNA, 25 bp, Homo sapien
tcttccggcaaaggtaccgcgctgc

SEQ ID NO: 70982 - DNA, 25 bp, Homo sapien
tgacaggcgcggtgtctacgaagac

SEQ ID NO: 70983 - DNA, 25 bp, Homo sapien
accgtgtggctggaagatcggcctt

SEQ ID NO: 70984 - DNA, 25 bp, Homo sapien
atcggccttgctggtttgttgaacc

SEQ ID NO: 70985 - DNA, 25 bp, Homo sapien
tgtagaccttgcaggcgttcgcttc

SEQ ID NO: 70986 - DNA, 25 bp, Homo sapien
cacggtgtgcacctcagagaagttc

SEQ ID NO: 70987 - DNA, 25 bp, Homo sapien
aagttctgtctgattcggtgcggcg

SEQ ID NO: 70988 - DNA, 25 bp, Homo sapien
cgagccgcgctggagttacaaactc

SEQ ID NO: 70989 - DNA, 25 bp, Homo sapien
tgtgacgcacttactacgactgacg

SEQ ID NO: 70990 - DNA, 25 bp, Homo sapien
ccctcagcattttcggcaaacaatg

SEQ ID NO: 70991 - DNA, 25 bp, Homo sapien
cctgcggacctagttgtagaccttg

SEQ ID NO: 70992 - DNA, 25 bp, Homo sapien
ctcggaggcgagtttgtcaacaatc

SEQ ID NO: 70993 - DNA, 25 bp, Homo sapien
acgctgtagtctgtcctttagaaga

SEQ ID NO: 70994 - DNA, 25 bp, Homo sapien
aagtcgttcccgctgcttgcagagg

SEQ ID NO: 70995 - DNA, 25 bp, Homo sapien
cggagggtgatctcgacctttaaca

SEQ ID NO: 70996 - DNA, 25 bp, Homo sapien
tttccgtacggcaagacaaggcgcg

SEQ ID NO: 70997 - DNA, 25 bp, Homo sapien
aagaactcggcttgtcctcccaggc

SEQ ID NO: 70998 - DNA, 25 bp, Homo sapien
cagtgaatcagacgctctggggctc

SEQ ID NO: 70999 - DNA, 25 bp, Homo sapien
ctcctgctgttagcggtgactcaca

SEQ ID NO: 71000 - DNA, 25 bp, Homo sapien
tttcggaactaggagagaccacgtc

SEQ ID NO: 71001 - DNA, 25 bp, Homo sapien
gcagtttgttggagctctgcgtcca

SEQ ID NO: 71002 - DNA, 25 bp, Homo sapien
tatctgcgagcccagcaaatcttgg

SEQ ID NO: 71003 - DNA, 25 bp, Homo sapien
gggtcctagccaaatgcagtgcgca

SEQ ID NO: 71004 - DNA, 25 bp, Homo sapien
gtgcgcaacgttctctctcacttgg

SEQ ID NO: 71005 - DNA, 25 bp, Homo sapien
tctctcacttggaggccgccattca

SEQ ID NO: 71006 - DNA, 25 bp, Homo sapien
cggcttagaaactcagggcacagtg

SEQ ID NO: 71007 - DNA, 25 bp, Homo sapien
gcaggcagagttactccggtaaaca

SEQ ID NO: 71008 - DNA, 25 bp, Homo sapien
gcagccgcctggtctgcagtttgtt

SEQ ID NO: 71009 - DNA, 25 bp, Homo sapien
ttgcagatggcgtattctggacatc

SEQ ID NO: 71010 - DNA, 25 bp, Homo sapien
cagatggcgtattctggacatccgg

SEQ ID NO: 71011 - DNA, 25 bp, Homo sapien
ggaaacaggacgagttcagttttgc

SEQ ID NO: 71012 - DNA, 25 bp, Homo sapien
ctggacatccgggagatacattcgg

SEQ ID NO: 71013 - DNA, 25 bp, Homo sapien
ctggacatccgggagatacattctg

SEQ ID NO: 71014 - DNA, 25 bp, Homo sapien
tcagttttgcagatggcgtattctg

SEQ ID NO: 71015 - DNA, 25 bp, Homo sapien
ggaaagaggacgagttcagttttgc

SEQ ID NO: 71016 - DNA, 25 bp, Homo sapien
tggacatccgggagatacattcggg

SEQ ID NO: 71017 - DNA, 25 bp, Homo sapien
ccttcacagtgactcttgggccgca

SEQ ID NO: 71018 - DNA, 25 bp, Homo sapien
tgcgagacgttcaaatggacgcgtc

SEQ ID NO: 71019 - DNA, 25 bp, Homo sapien
ggacgcgtccatcttgactttcccg

SEQ ID NO: 71020 - DNA, 25 bp, Homo sapien
gcacctgtataactcgggacgcgtc

SEQ ID NO: 71021 - DNA, 25 bp, Homo sapien
aacagcagcgggctcgagtgctaat

SEQ ID NO: 71022 - DNA, 25 bp, Homo sapien
ttctggaggaagaacgggcaacagc

SEQ ID NO: 71023 - DNA, 25 bp, Homo sapien
accaccaagtgctgcggtacggcgc

SEQ ID NO: 71024 - DNA, 25 bp, Homo sapien
accttccgtgcgactgatgcgaacc

SEQ ID NO: 71025 - DNA, 25 bp, Homo sapien
cggcgagcggaatggatgtggagga

SEQ ID NO: 71026 - DNA, 25 bp, Homo sapien
cgccagggccgtgtcgcgcacctcg

SEQ ID NO: 71027 - DNA, 25 bp, Homo sapien
tcctcgccgccagggccgtgtcgcg

SEQ ID NO: 71028 - DNA, 25 bp, Homo sapien
gctcctcgccgccagggccgtgtcg

SEQ ID NO: 71029 - DNA, 25 bp, Homo sapien
cacggcaaagcgtcctttcccagga

SEQ ID NO: 71030 - DNA, 25 bp, Homo sapien
gtcacggagccacggcaaagcgtcc

SEQ ID NO: 71031 - DNA, 25 bp, Homo sapien
cgtcacggagccacggcaaagcgtc

SEQ ID NO: 71032 - DNA, 25 bp, Homo sapien
tgtggaggagcgctcggcagggagc

SEQ ID NO: 71033 - DNA, 25 bp, Homo sapien
tccgtccggagagaaattacagatc

SEQ ID NO: 71034 - DNA, 25 bp, Homo sapien
gcctggctgctggacaagtttgcaa

SEQ ID NO: 71035 - DNA, 25 bp, Homo sapien
cgtaggcgaacctaccgtccactga

SEQ ID NO: 71036 - DNA, 25 bp, Homo sapien
caggttcgggacgtccatctgtcca

SEQ ID NO: 71037 - DNA, 25 bp, Homo sapien
cgcgctgcaagtcctgaagttccga

SEQ ID NO: 71038 - DNA, 25 bp, Homo sapien
tccgacgagtggaacgtaggtagca

SEQ ID NO: 71039 - DNA, 25 bp, Homo sapien
gtctgggatgcgacgagaactttcc

SEQ ID NO: 71040 - DNA, 25 bp, Homo sapien
ccgcgatagactgaggccgagcgac

SEQ ID NO: 71041 - DNA, 25 bp, Homo sapien
cactgcgcctcatctcccagacagg

SEQ ID NO: 71042 - DNA, 25 bp, Homo sapien
actcaggcccgtctcctcactcagg

SEQ ID NO: 71043 - DNA, 25 bp, Homo sapien
agtcccgtctccgtactagggcttg

SEQ ID NO: 71044 - DNA, 25 bp, Homo sapien
cgtctccgtactagggcttgctcca

SEQ ID NO: 71045 - DNA, 25 bp, Homo sapien
cgtactagggcttgctccaagccct

SEQ ID NO: 71046 - DNA, 25 bp, Homo sapien
tactgcctggtcctcaactccgcct

SEQ ID NO: 71047 - DNA, 25 bp, Homo sapien
aagccctgcttcctcgcccaacctg

SEQ ID NO: 71048 - DNA, 25 bp, Homo sapien
tccgtactagggcttgctccaagcc

SEQ ID NO: 71049 - DNA, 25 bp, Homo sapien
gccttttgtctgttacagccgggga

SEQ ID NO: 71050 - DNA, 25 bp, Homo sapien
agcttcctggtcaagatggtcgccg

SEQ ID NO: 71051 - DNA, 25 bp, Homo sapien
ctgcaggcaagagccgtcaggattg

SEQ ID NO: 71052 - DNA, 25 bp, Homo sapien
cgggtttcccagaactgcacggcgc

SEQ ID NO: 71053 - DNA, 25 bp, Homo sapien
tgataccctccctgagccttttgtc

SEQ ID NO: 71054 - DNA, 25 bp, Homo sapien
cagtcaacgacgtaagtggagtgtc

SEQ ID NO: 71055 - DNA, 25 bp, Homo sapien
ctcgggctctggttagagacagtca

SEQ ID NO: 71056 - DNA, 25 bp, Homo sapien
ctcggactgttactgagggtcacca

SEQ ID NO: 71057 - DNA, 25 bp, Homo sapien
gctacggcaactgccagagggaccc

SEQ ID NO: 71058 - DNA, 25 bp, Homo sapien
gtgggagcagcgcatccatttcatt

SEQ ID NO: 71059 - DNA, 25 bp, Homo sapien
tctgcgcggagtctccgcagtcgtc

SEQ ID NO: 71060 - DNA, 25 bp, Homo sapien
tcccgagcaactctgcgcggagtct

SEQ ID NO: 71061 - DNA, 25 bp, Homo sapien
cttcagctgcagagtcgctggcgca

SEQ ID NO: 71062 - DNA, 25 bp, Homo sapien
tcaccaaatgcgcttcagctgcaga

SEQ ID NO: 71063 - DNA, 25 bp, Homo sapien
cgccgagctctgtgcgtctgcgtgt

SEQ ID NO: 71064 - DNA, 25 bp, Homo sapien
tccctgcttgtgtctgtgccagtgt

SEQ ID NO: 71065 - DNA, 25 bp, Homo sapien
ctgtgcgatccgagtcgcggtctcc

SEQ ID NO: 71066 - DNA, 25 bp, Homo sapien
ggtcggtgtctgtttccttctgtcc

SEQ ID NO: 71067 - DNA, 25 bp, Homo sapien
acatggcatggcctctgtgcgatcc

SEQ ID NO: 71068 - DNA, 25 bp, Homo sapien
acgcgcaaggcagagccctgacgct

SEQ ID NO: 71069 - DNA, 25 bp, Homo sapien
cgcatcttgattgttctccgggagc

SEQ ID NO: 71070 - DNA, 25 bp, Homo sapien
ccatttttcctgaccggcctgtgtc

SEQ ID NO: 71071 - DNA, 25 bp, Homo sapien
aacgccgccgcagtgtttgacctct

SEQ ID NO: 71072 - DNA, 25 bp, Homo sapien
ccgcaacgaaggtggatccgcatct

SEQ ID NO: 71073 - DNA, 25 bp, Homo sapien
tctctccaggtcagcgtccctcccg

SEQ ID NO: 71074 - DNA, 25 bp, Homo sapien
tctccacgccagtgtccctcccgcc

SEQ ID NO: 71075 - DNA, 25 bp, Homo sapien
tcacgcctctctccaggtcagtgtc

SEQ ID NO: 71076 - DNA, 25 bp, Homo sapien
tctctccacgccagtgtccctcccg

SEQ ID NO: 71077 - DNA, 25 bp, Homo sapien
cccgcctctctccacgccagtgtcc

SEQ ID NO: 71078 - DNA, 25 bp, Homo sapien
acgcctctctccaggtcagtgtccc

SEQ ID NO: 71079 - DNA, 25 bp, Homo sapien
cgcctctctccaggtcagtgtccct

SEQ ID NO: 71080 - DNA, 25 bp, Homo sapien
cgcgcctctctccacgccagtgtcc

SEQ ID NO: 71081 - DNA, 25 bp, Homo sapien
tgtctcagcaaacagcagctcctct

SEQ ID NO: 71082 - DNA, 25 bp, Homo sapien
ttgagtgagcttcaaacgcggtttg

SEQ ID NO: 71083 - DNA, 25 bp, Homo sapien
tcggcgatttcggaagctcagacaa

SEQ ID NO: 71084 - DNA, 25 bp, Homo sapien
tcagacaagcatgtgggactgagtc

SEQ ID NO: 71085 - DNA, 25 bp, Homo sapien
ttctctccgcagaactgtctcagca

SEQ ID NO: 71086 - DNA, 25 bp, Homo sapien
gcaggtcacttttacgttgcgttga

SEQ ID NO: 71087 - DNA, 25 bp, Homo sapien
atccgccacatgaagagccggctgg

SEQ ID NO: 71088 - DNA, 25 bp, Homo sapien
gtggcggcgatgtcttctctccgca

SEQ ID NO: 71089 - DNA, 25 bp, Homo sapien
agcgtggccggcgactccgccttca

SEQ ID NO: 71090 - DNA, 25 bp, Homo sapien
ctccgccaggacactggggacagca

SEQ ID NO: 71091 - DNA, 25 bp, Homo sapien
ctgcgaggccggattccacctgagc

SEQ ID NO: 71092 - DNA, 25 bp, Homo sapien
ggcccggcactgagcgtgtcttctc

SEQ ID NO: 71093 - DNA, 25 bp, Homo sapien
gccgtgcctccgtcttggttctgct

SEQ ID NO: 71094 - DNA, 25 bp, Homo sapien
tgagaaggggccgtgcctccgtctt

SEQ ID NO: 71095 - DNA, 25 bp, Homo sapien
tcgtctgggtctgtggttgattact

SEQ ID NO: 71096 - DNA, 25 bp, Homo sapien
tctgtggttgattacttgtctctcc

SEQ ID NO: 71097 - DNA, 25 bp, Homo sapien
aacagccgcggccactttgtgatgc

SEQ ID NO: 71098 - DNA, 25 bp, Homo sapien
aggtggacgtcgacatgtcggaata

SEQ ID NO: 71099 - DNA, 25 bp, Homo sapien
cttgtgcagaacctggaggggcctc

SEQ ID NO: 71100 - DNA, 25 bp, Homo sapien
ctgatccttgtgcagaacctggagg

SEQ ID NO: 71101 - DNA, 25 bp, Homo sapien
cggcagactggggatctgatccttg

SEQ ID NO: 71102 - DNA, 25 bp, Homo sapien
atgcagcgttcagaccggcagactg

SEQ ID NO: 71103 - DNA, 25 bp, Homo sapien
tcgacatgtcggaatacctggaccg

SEQ ID NO: 71104 - DNA, 25 bp, Homo sapien
gccactttgtgatgcagcgttcaga

SEQ ID NO: 71105 - DNA, 25 bp, Homo sapien
ctctataggtcagacggtggcgccc

SEQ ID NO: 71106 - DNA, 25 bp, Homo sapien
taaagacagacgctacgggaccaca

SEQ ID NO: 71107 - DNA, 25 bp, Homo sapien
tatgggatcacctttcgtcagagtc

SEQ ID NO: 71108 - DNA, 25 bp, Homo sapien
ctccctttcgcgagccgggaagcta

SEQ ID NO: 71109 - DNA, 25 bp, Homo sapien
tacagagtaacaacccgagagagtg

SEQ ID NO: 71110 - DNA, 25 bp, Homo sapien
agtgacaacccggacgcgacgagac

SEQ ID NO: 71111 - DNA, 25 bp, Homo sapien
cggtctcgtggaaacaggcaacaac

SEQ ID NO: 71112 - DNA, 25 bp, Homo sapien
tctcaaaatccatgacccagacagg

SEQ ID NO: 71113 - DNA, 25 bp, Homo sapien
acgggcactctcctccaatggtcaa

SEQ ID NO: 71114 - DNA, 25 bp, Homo sapien
gcggaggaatctctcttgcccttta

SEQ ID NO: 71115 - DNA, 25 bp, Homo sapien
tgcagacactcgaggagccatccgg

SEQ ID NO: 71116 - DNA, 25 bp, Homo sapien
catctctctggcgtggttgttaata

SEQ ID NO: 71117 - DNA, 25 bp, Homo sapien
gccattttctcgagccgcctgtttc

SEQ ID NO: 71118 - DNA, 25 bp, Homo sapien
tctgtgtcgctcactagtaaccgtg

SEQ ID NO: 71119 - DNA, 25 bp, Homo sapien
tttaccacttcgtcacctgtcggcg

SEQ ID NO: 71120 - DNA, 25 bp, Homo sapien
ccgccatgttggtgaggagaaatca

SEQ ID NO: 71121 - DNA, 25 bp, Homo sapien
gaacctgcgttctgcctcagcactg

SEQ ID NO: 71122 - DNA, 25 bp, Homo sapien
gcgttctgcctcagcactgtgtatc

SEQ ID NO: 71123 - DNA, 25 bp, Homo sapien
gacgtaccgctccacatcggccttg

SEQ ID NO: 71124 - DNA, 25 bp, Homo sapien
ggcccactgtgacgaacctgcgttc

SEQ ID NO: 71125 - DNA, 25 bp, Homo sapien
cacggaggcccactgtgacgaacct

SEQ ID NO: 71126 - DNA, 25 bp, Homo sapien
gagacgcgtgcgagcaccgctcagc

SEQ ID NO: 71127 - DNA, 25 bp, Homo sapien
ctgagggtgtcttgacatgatctta

SEQ ID NO: 71128 - DNA, 25 bp, Homo sapien
gtgtcttgacatgatcttatctata

SEQ ID NO: 71129 - DNA, 25 bp, Homo sapien
acagcagcgtctacgccgaggtctc

SEQ ID NO: 71130 - DNA, 25 bp, Homo sapien
aacccagatcgagccctgcaaactg

SEQ ID NO: 71131 - DNA, 25 bp, Homo sapien
tgcaaactgggatcttccgccggca

SEQ ID NO: 71132 - DNA, 25 bp, Homo sapien
gcgcttcgccatgtacaccttcgtg

SEQ ID NO: 71133 - DNA, 25 bp, Homo sapien
accttcgtggtacgcgatgagaaca

SEQ ID NO: 71134 - DNA, 25 bp, Homo sapien
tttctcctctgtcgcttgtcgggca

SEQ ID NO: 71135 - DNA, 25 bp, Homo sapien
acctgtcgtttttaatgctttcttg

SEQ ID NO: 71136 - DNA, 25 bp, Homo sapien
tgtcgggcacatcagaaacggattc

SEQ ID NO: 71137 - DNA, 25 bp, Homo sapien
gctctcctccgatcctaattgactg

SEQ ID NO: 71138 - DNA, 25 bp, Homo sapien
agcaacgactttggccggatgactc

SEQ ID NO: 71139 - DNA, 25 bp, Homo sapien
cgctctggctggacacggccttaat

SEQ ID NO: 71140 - DNA, 25 bp, Homo sapien
gggcctagcctaaagcacttgactg

SEQ ID NO: 71141 - DNA, 25 bp, Homo sapien
cctcttatggaatcccgcgggaaca

SEQ ID NO: 71142 - DNA, 25 bp, Homo sapien
ggcgcacgtggagtccttcaactac

SEQ ID NO: 71143 - DNA, 25 bp, Homo sapien
caactacgctgtgcacgagggtctc

SEQ ID NO: 71144 - DNA, 25 bp, Homo sapien
gcccggcatccgctttttcgttgaa

SEQ ID NO: 71145 - DNA, 25 bp, Homo sapien
ggtgacacacctgattcggacccgc

SEQ ID NO: 71146 - DNA, 25 bp, Homo sapien
gggagcctggaaacaccacgaacga

SEQ ID NO: 71147 - DNA, 25 bp, Homo sapien
gaaattgtctctgaggcgactggga

SEQ ID NO: 71148 - DNA, 25 bp, Homo sapien
agcctctggcgagctgttcacagcg

SEQ ID NO: 71149 - DNA, 25 bp, Homo sapien
acttgcctagtagcctcagccgctg

SEQ ID NO: 71150 - DNA, 25 bp, Homo sapien
cacgaacgatgctggaaattgtctc

SEQ ID NO: 71151 - DNA, 25 bp, Homo sapien
gcggcagtcgctacttgcctagtag

SEQ ID NO: 71152 - DNA, 25 bp, Homo sapien
tctccgggaccgattgacggctcag

SEQ ID NO: 71153 - DNA, 25 bp, Homo sapien
gcgctgccatggcaagccggaaata

SEQ ID NO: 71154 - DNA, 25 bp, Homo sapien
aacaacatgttgagacgctgcagca

SEQ ID NO: 71155 - DNA, 25 bp, Homo sapien
tcccaccagctacagtcggagattt

SEQ ID NO: 71156 - DNA, 25 bp, Homo sapien
agcgcttgtgtctgaggctcaatcc

SEQ ID NO: 71157 - DNA, 25 bp, Homo sapien
tggacccgaggcaccaccatacttt

SEQ ID NO: 71158 - DNA, 25 bp, Homo sapien
gcgccgccgtgacagattagtccta

SEQ ID NO: 71159 - DNA, 25 bp, Homo sapien
tgaccctcaggattcagcgccttcg

SEQ ID NO: 71160 - DNA, 25 bp, Homo sapien
actcagcggcgcattctctttggac

SEQ ID NO: 71161 - DNA, 25 bp, Homo sapien
tgggcacgcagccatgccgactaga

SEQ ID NO: 71162 - DNA, 25 bp, Homo sapien
aagatgatttcactggatttccgcg

SEQ ID NO: 71163 - DNA, 25 bp, Homo sapien
agtgagccagtttttcgcaaagatg

SEQ ID NO: 71164 - DNA, 25 bp, Homo sapien
cgttcacgaccgcatcttaaaaagc

SEQ ID NO: 71165 - DNA, 25 bp, Homo sapien
ccatgccgactagaaggacctgaga

SEQ ID NO: 71166 - DNA, 25 bp, Homo sapien
tgggactggttccaccgacactgga

SEQ ID NO: 71167 - DNA, 25 bp, Homo sapien
tttccgcgtttagcgtcacgatatg

SEQ ID NO: 71168 - DNA, 25 bp, Homo sapien
acggaggtgccctagctcccgttca

SEQ ID NO: 71169 - DNA, 25 bp, Homo sapien
tctggctctaacctgtgaggacggg

SEQ ID NO: 71170 - DNA, 25 bp, Homo sapien
ggccactcgctggacactgaacgtg

SEQ ID NO: 71171 - DNA, 25 bp, Homo sapien
ggcaccagctccgttctggaaaaga

SEQ ID NO: 71172 - DNA, 25 bp, Homo sapien
tctgaggcctgaacgacttggtttc

SEQ ID NO: 71173 - DNA, 25 bp, Homo sapien
ctaagtccgtggagacgtagccctc

SEQ ID NO: 71174 - DNA, 25 bp, Homo sapien
accctggcaggtgcttcggatgaag

SEQ ID NO: 71175 - DNA, 25 bp, Homo sapien
tgcctcgtggactctgctctccaga

SEQ ID NO: 71176 - DNA, 25 bp, Homo sapien
gactctggagctttgctaacctgcc

SEQ ID NO: 71177 - DNA, 25 bp, Homo sapien
cttttccctggtgagtagtggcgcc

SEQ ID NO: 71178 - DNA, 25 bp, Homo sapien
tgcttcctgggaaggtcgtgagtcc

SEQ ID NO: 71179 - DNA, 25 bp, Homo sapien
tggttcttcttctcggccgctgaaa

SEQ ID NO: 71180 - DNA, 25 bp, Homo sapien
ccagacggtgccgagactccagggc

SEQ ID NO: 71181 - DNA, 25 bp, Homo sapien
ccctcgatctctggctgtaatcagc

SEQ ID NO: 71182 - DNA, 25 bp, Homo sapien
gactttggtcgcagcctctgtaacc

SEQ ID NO: 71183 - DNA, 25 bp, Homo sapien
agaggagctaggaatgactttggtc

SEQ ID NO: 71184 - DNA, 25 bp, Homo sapien
tggcgccgcctcgtaaaggctcttt

SEQ ID NO: 71185 - DNA, 25 bp, Homo sapien
gacgaactcactcggtggcctccta

SEQ ID NO: 71186 - DNA, 25 bp, Homo sapien
agtttttcttcaaacgccgcgcctg

SEQ ID NO: 71187 - DNA, 25 bp, Homo sapien
gccgtgttccaacgcctgagaataa

SEQ ID NO: 71188 - DNA, 25 bp, Homo sapien
tcattggctcctgcgggtttgaaac

SEQ ID NO: 71189 - DNA, 25 bp, Homo sapien
cgggtttgaaactcgctagtcgtca

SEQ ID NO: 71190 - DNA, 25 bp, Homo sapien
cgggacaacaggcaataggctcttt

SEQ ID NO: 71191 - DNA, 25 bp, Homo sapien
gctctggccttgagaacccgacctt

SEQ ID NO: 71192 - DNA, 25 bp, Homo sapien
tgattggaagaacgtgcagcgcacc

SEQ ID NO: 71193 - DNA, 25 bp, Homo sapien
gcctctcagcgtggcctcccgatcc

SEQ ID NO: 71194 - DNA, 25 bp, Homo sapien
ggcctcccgatccttgaatcggagg

SEQ ID NO: 71195 - DNA, 25 bp, Homo sapien
tcagcgtggcctcccgatccttgaa

SEQ ID NO: 71196 - DNA, 25 bp, Homo sapien
gtggcctcccgatccttgaatcgga

SEQ ID NO: 71197 - DNA, 25 bp, Homo sapien
cccgatccttgaatcggaggccgtg

SEQ ID NO: 71198 - DNA, 25 bp, Homo sapien
atccttgaatcggaggccgtgcctc

SEQ ID NO: 71199 - DNA, 25 bp, Homo sapien
cgatccttgaatcggaggccgtgcc

SEQ ID NO: 71200 - DNA, 25 bp, Homo sapien
ccttgaatcggaggccgtgcctctc

SEQ ID NO: 71201 - DNA, 25 bp, Homo sapien
atcctggcccggcacactgagagcg

SEQ ID NO: 71202 - DNA, 25 bp, Homo sapien
tgccggtagatcctggcccggcaca

SEQ ID NO: 71203 - DNA, 25 bp, Homo sapien
cgacctagcctggtggagagcgccc

SEQ ID NO: 71204 - DNA, 25 bp, Homo sapien
tggcctcccgacctagcctggtgga

SEQ ID NO: 71205 - DNA, 25 bp, Homo sapien
tgatccttgaatcggaggccgtgcc

SEQ ID NO: 71206 - DNA, 25 bp, Homo sapien
tcctgatccttgaatcggaggccgt

SEQ ID NO: 71207 - DNA, 25 bp, Homo sapien
ggcctcctgatccttgaatcggagg

SEQ ID NO: 71208 - DNA, 25 bp, Homo sapien
ctggcccggcacactgagagcggca

SEQ ID NO: 71209 - DNA, 25 bp, Homo sapien
aaggggacgctgtctccactgaagg

SEQ ID NO: 71210 - DNA, 25 bp, Homo sapien
ctttgcagagcctgcggcccggtag

SEQ ID NO: 71211 - DNA, 25 bp, Homo sapien
tgaggatccagcctaaccgagcggc

SEQ ID NO: 71212 - DNA, 25 bp, Homo sapien
gcccggtagcgcacaggccagacga

SEQ ID NO: 71213 - DNA, 25 bp, Homo sapien
ctcagtttccggttcaggtactgga

SEQ ID NO: 71214 - DNA, 25 bp, Homo sapien
agcggtcagaccagtcccacagctt

SEQ ID NO: 71215 - DNA, 25 bp, Homo sapien
ctccactgaaggagtcagcctgggc

SEQ ID NO: 71216 - DNA, 25 bp, Homo sapien
gccctcgacggtgaccgtgtgccgt

SEQ ID NO: 71217 - DNA, 25 bp, Homo sapien
tggatctacagaggaacctgccgga

SEQ ID NO: 71218 - DNA, 25 bp, Homo sapien
gcatcaacttggctgcggccacgca

SEQ ID NO: 71219 - DNA, 25 bp, Homo sapien
agcgcagattcgtgcggcccatcct

SEQ ID NO: 71220 - DNA, 25 bp, Homo sapien
aactgggaatgtgcacctggagccc

SEQ ID NO: 71221 - DNA, 25 bp, Homo sapien
cctgcggaaggagtacctggagtac

SEQ ID NO: 71222 - DNA, 25 bp, Homo sapien
tcccacgagaactgcctggacgctg

SEQ ID NO: 71223 - DNA, 25 bp, Homo sapien
aggagcagcatcgatcccacgagaa

SEQ ID NO: 71224 - DNA, 25 bp, Homo sapien
ggcgtgcacaaagagtgtgtgtccc

SEQ ID NO: 71225 - DNA, 25 bp, Homo sapien
cggggagggaacacgcacaagccaa

SEQ ID NO: 71226 - DNA, 25 bp, Homo sapien
cagcgaaaatggagagacccggaag

SEQ ID NO: 71227 - DNA, 25 bp, Homo sapien
ttctgcagcgaaaatggagagaccc

SEQ ID NO: 71228 - DNA, 25 bp, Homo sapien
gctgcgcttctgcagcgaaaatgga

SEQ ID NO: 71229 - DNA, 25 bp, Homo sapien
gagagagaagctagacctccctgct

SEQ ID NO: 71230 - DNA, 25 bp, Homo sapien
gcaggctcagctgccctcagagtct

SEQ ID NO: 71231 - DNA, 25 bp, Homo sapien
gggaacacgcacaagccaagccgtg

SEQ ID NO: 71232 - DNA, 25 bp, Homo sapien
cgcacaagccaagccgtgggatgtg

SEQ ID NO: 71233 - DNA, 25 bp, Homo sapien
ttaagactctctgcaaggcaagacc

SEQ ID NO: 71234 - DNA, 25 bp, Homo sapien
gcaagaccagccaacgacgaggcga

SEQ ID NO: 71235 - DNA, 25 bp, Homo sapien
ttaaggaacgttcagcccatcgctg

SEQ ID NO: 71236 - DNA, 25 bp, Homo sapien
cgctgacctgcgcacgttaaaatga

SEQ ID NO: 71237 - DNA, 25 bp, Homo sapien
cgcacgttaaaatgattcgcgttca

SEQ ID NO: 71238 - DNA, 25 bp, Homo sapien
tgattcgcgttcaacattcctgcag

SEQ ID NO: 71239 - DNA, 25 bp, Homo sapien
cattcctgcagaataaagctgtagg

SEQ ID NO: 71240 - DNA, 25 bp, Homo sapien
tgtaggaaagacaacgttaagactc

SEQ ID NO: 71241 - DNA, 25 bp, Homo sapien
tgccagtaaattccttcagcaaacg

SEQ ID NO: 71242 - DNA, 25 bp, Homo sapien
acgccaacaaatgccagtaaattcc

SEQ ID NO: 71243 - DNA, 25 bp, Homo sapien
gtaaattccttcagcaaacggatcg

SEQ ID NO: 71244 - DNA, 25 bp, Homo sapien
ctgagcggagaacgccaacaaatgc

SEQ ID NO: 71245 - DNA, 25 bp, Homo sapien
gaacgccaacaaatgccagtaaatt

SEQ ID NO: 71246 - DNA, 25 bp, Homo sapien
cccactgagcggagaacgccaacaa

SEQ ID NO: 71247 - DNA, 25 bp, Homo sapien
cggagaacgccaacaaatgccagta

SEQ ID NO: 71248 - DNA, 25 bp, Homo sapien
aaattccttcagcaaacggatcggc

SEQ ID NO: 71249 - DNA, 25 bp, Homo sapien
cccagcgaatactttaggaagcacc

SEQ ID NO: 71250 - DNA, 25 bp, Homo sapien
gacttcaagcaacccacggaatttc

SEQ ID NO: 71251 - DNA, 25 bp, Homo sapien
acggatcggcggtcctaagacttca

SEQ ID NO: 71252 - DNA, 25 bp, Homo sapien
taggaagcacccacctgttcgcaga

SEQ ID NO: 71253 - DNA, 25 bp, Homo sapien
ctgttcgcagatcagggctccggac

SEQ ID NO: 71254 - DNA, 25 bp, Homo sapien
cggactaagcgcacgagcccaggtc

SEQ ID NO: 71255 - DNA, 25 bp, Homo sapien
cggaatttctagtgacagccctctc

SEQ ID NO: 71256 - DNA, 25 bp, Homo sapien
ccatctgtagaaaaggcgagccatt

SEQ ID NO: 71257 - DNA, 25 bp, Homo sapien
aatcgatagcgatgcgccctggccc

SEQ ID NO: 71258 - DNA, 25 bp, Homo sapien
ccatgtggtccctcgaaaccgggca

SEQ ID NO: 71259 - DNA, 25 bp, Homo sapien
ctgggaatggagctcaaaggaaacc

SEQ ID NO: 71260 - DNA, 25 bp, Homo sapien
accggctccattgccgttggcttga

SEQ ID NO: 71261 - DNA, 25 bp, Homo sapien
cccgcagtgcgcttggctaaataga

SEQ ID NO: 71262 - DNA, 25 bp, Homo sapien
ataaatcgccttctctgcggccggc

SEQ ID NO: 71263 - DNA, 25 bp, Homo sapien
cccgtttgcagagcgggacatcata

SEQ ID NO: 71264 - DNA, 25 bp, Homo sapien
cgagtgtgtttgaaggccctgcttc

SEQ ID NO: 71265 - DNA, 25 bp, Homo sapien
tccaccgccgcagtgaacggtgacg

SEQ ID NO: 71266 - DNA, 25 bp, Homo sapien
cgcagtgaacggtgacgctgtacct

SEQ ID NO: 71267 - DNA, 25 bp, Homo sapien
ccgcagtgaacggtgacgctgtacc

SEQ ID NO: 71268 - DNA, 25 bp, Homo sapien
accgccgcagtgaacggtgacgctg

SEQ ID NO: 71269 - DNA, 25 bp, Homo sapien
caccgccgcagtgaacggtgacgct

SEQ ID NO: 71270 - DNA, 25 bp, Homo sapien
cagtgaacggtgacgctgtacctcc

SEQ ID NO: 71271 - DNA, 25 bp, Homo sapien
gcagtgaacggtgacgctgtacctc

SEQ ID NO: 71272 - DNA, 25 bp, Homo sapien
agtgaacggtgacgctgtacctcca

SEQ ID NO: 71273 - DNA, 25 bp, Homo sapien
ctatgccggggcaccgaagaaagca

SEQ ID NO: 71274 - DNA, 25 bp, Homo sapien
ctgcggcggcctctgaagatgcccg

SEQ ID NO: 71275 - DNA, 25 bp, Homo sapien
ggagacgcccttacgctctgctgca

SEQ ID NO: 71276 - DNA, 25 bp, Homo sapien
atggcagctttctccggcgtaggaa

SEQ ID NO: 71277 - DNA, 25 bp, Homo sapien
cctcacttggtcctcagccttggga

SEQ ID NO: 71278 - DNA, 25 bp, Homo sapien
atgttcgacaatggcagctttctcc

SEQ ID NO: 71279 - DNA, 25 bp, Homo sapien
aagatgcccggcagccggcaaagcc

SEQ ID NO: 71280 - DNA, 25 bp, Homo sapien
ttcccgtgctgcagccctcacttgg

SEQ ID NO: 71281 - DNA, 25 bp, Homo sapien
ccgcgcacgcctgaccggagcaccc

SEQ ID NO: 71282 - DNA, 25 bp, Homo sapien
acgcgctttgctctcgccgagaccc

SEQ ID NO: 71283 - DNA, 25 bp, Homo sapien
acgcactgaagaagacgctacggaa

SEQ ID NO: 71284 - DNA, 25 bp, Homo sapien
gcagcacgcactgaagaagacgcta

SEQ ID NO: 71285 - DNA, 25 bp, Homo sapien
tgcccgccaatgacgccgatgacag

SEQ ID NO: 71286 - DNA, 25 bp, Homo sapien
ccggagtttctctccggagtctgga

SEQ ID NO: 71287 - DNA, 25 bp, Homo sapien
ctcgcagcacgcactgaagaagacg

SEQ ID NO: 71288 - DNA, 25 bp, Homo sapien
agccggagtttctctccggagtctg

SEQ ID NO: 71289 - DNA, 25 bp, Homo sapien
ctgttcgctgatggcaaaaggtttc

SEQ ID NO: 71290 - DNA, 25 bp, Homo sapien
tctttcgcaggctcacaacatagtc

SEQ ID NO: 71291 - DNA, 25 bp, Homo sapien
cacacaaacttctttcgcaggctca

SEQ ID NO: 71292 - DNA, 25 bp, Homo sapien
tacccggccctgtagattccaaggc

SEQ ID NO: 71293 - DNA, 25 bp, Homo sapien
ggacattctcttacccggccctgta

SEQ ID NO: 71294 - DNA, 25 bp, Homo sapien
gctcatttttctttcggacattctc

SEQ ID NO: 71295 - DNA, 25 bp, Homo sapien
cgcacctgctcatttttctttcgga

SEQ ID NO: 71296 - DNA, 25 bp, Homo sapien
cactgggttctattagtacccaccg

SEQ ID NO: 71297 - DNA, 25 bp, Homo sapien
aaagagtccgtctctccggcatgtg

SEQ ID NO: 71298 - DNA, 25 bp, Homo sapien
tctccggcatgtgtgtaaagagtcc

SEQ ID NO: 71299 - DNA, 25 bp, Homo sapien
ccgtctctccggcatgtgtgtaaag

SEQ ID NO: 71300 - DNA, 25 bp, Homo sapien
tctccggcatgtgtgtaaagaatcc

SEQ ID NO: 71301 - DNA, 25 bp, Homo sapien
ctctccggcatgtgtgtaaagaatc

SEQ ID NO: 71302 - DNA, 25 bp, Homo sapien
aaagaatccgtctctccggcatgtg

SEQ ID NO: 71303 - DNA, 25 bp, Homo sapien
agaatccgtctctccggcatgtgtg

SEQ ID NO: 71304 - DNA, 25 bp, Homo sapien
gtaaagagtccgtctctccggcatg

SEQ ID NO: 71305 - DNA, 25 bp, Homo sapien
cccggagcttcctccctggagccgc

SEQ ID NO: 71306 - DNA, 25 bp, Homo sapien
tggcggacagcttggccctgagctt

SEQ ID NO: 71307 - DNA, 25 bp, Homo sapien
ggcggcctgacgctcggaagacaac

SEQ ID NO: 71308 - DNA, 25 bp, Homo sapien
ttctgggaagcctcgcgcggctctt

SEQ ID NO: 71309 - DNA, 25 bp, Homo sapien
agcacttcgaaagtataaaccgcgg

SEQ ID NO: 71310 - DNA, 25 bp, Homo sapien
tgcccggccctagcagggaagccaa

SEQ ID NO: 71311 - DNA, 25 bp, Homo sapien
ctgcagagcagaaagcacgggtagg

SEQ ID NO: 71312 - DNA, 25 bp, Homo sapien
ggctccgagcacttcgaaagtataa

SEQ ID NO: 71313 - DNA, 25 bp, Homo sapien
ctggcttagcacgcggggacagccc

SEQ ID NO: 71314 - DNA, 25 bp, Homo sapien
tgctcaccgctccactccctctagg

SEQ ID NO: 71315 - DNA, 25 bp, Homo sapien
gcactcggccgcatgcgcactccct

SEQ ID NO: 71316 - DNA, 25 bp, Homo sapien
ttcgagagcgcgcagagtccagact

SEQ ID NO: 71317 - DNA, 25 bp, Homo sapien
aaccgcacgtgagggcaaatccgcc

SEQ ID NO: 71318 - DNA, 25 bp, Homo sapien
aagcacggaaaggtggcttcgcgag

SEQ ID NO: 71319 - DNA, 25 bp, Homo sapien
ccctccgaggcctccctagcggtgt

SEQ ID NO: 71320 - DNA, 25 bp, Homo sapien
actcggaaccgcacgtgagggcaaa

SEQ ID NO: 71321 - DNA, 25 bp, Homo sapien
gtcggggagacacttcgatccttcg

SEQ ID NO: 71322 - DNA, 25 bp, Homo sapien
cgatccttcgtcctcactttgcaga

SEQ ID NO: 71323 - DNA, 25 bp, Homo sapien
ggcagctttagcctggttccctgta

SEQ ID NO: 71324 - DNA, 25 bp, Homo sapien
gcccagcggtgagaactcaggtgta

SEQ ID NO: 71325 - DNA, 25 bp, Homo sapien
atgcatgattgtgctgcccaccgtc

SEQ ID NO: 71326 - DNA, 25 bp, Homo sapien
actcccgcctctacggcagagttgg

SEQ ID NO: 71327 - DNA, 25 bp, Homo sapien
gcccgcgtacctggcagtcagtctt

SEQ ID NO: 71328 - DNA, 25 bp, Homo sapien
ggtctccgagcctcaggcagcttta

SEQ ID NO: 71329 - DNA, 25 bp, Homo sapien
tccgcccgccttagaacgaaagctg

SEQ ID NO: 71330 - DNA, 25 bp, Homo sapien
cggatatccctttctcgatgacagc

SEQ ID NO: 71331 - DNA, 25 bp, Homo sapien
gctggccgttccgtttcacaaactg

SEQ ID NO: 71332 - DNA, 25 bp, Homo sapien
aagggacggcacagtcagctatggc

SEQ ID NO: 71333 - DNA, 25 bp, Homo sapien
cggcctcggactcacagagctgtca

SEQ ID NO: 71334 - DNA, 25 bp, Homo sapien
ctgcgaacctgaaacttcggatatc

SEQ ID NO: 71335 - DNA, 25 bp, Homo sapien
ccttcacggtttcggtcaaggcgct

SEQ ID NO: 71336 - DNA, 25 bp, Homo sapien
acggcttcctcaattgccagcggtg

SEQ ID NO: 71337 - DNA, 25 bp, Homo sapien
ctccgcgcccgtttttgccagtcgg

SEQ ID NO: 71338 - DNA, 25 bp, Homo sapien
tcccagcggctttctccgcgcgacc

SEQ ID NO: 71339 - DNA, 25 bp, Homo sapien
gatggtcagatagcccttgtctccc

SEQ ID NO: 71340 - DNA, 25 bp, Homo sapien
tgtggatggtcagatagcccttgtc

SEQ ID NO: 71341 - DNA, 25 bp, Homo sapien
cccagctgtggatggtcagatagcc

SEQ ID NO: 71342 - DNA, 25 bp, Homo sapien
ttgctactgcttcggcttcccggct

SEQ ID NO: 71343 - DNA, 25 bp, Homo sapien
cctgctgctttcttgctactgcttc

SEQ ID NO: 71344 - DNA, 25 bp, Homo sapien
ctgtcagtcctagacccgccggcca

SEQ ID NO: 71345 - DNA, 25 bp, Homo sapien
gcatccgggcaccaactggcttttg

SEQ ID NO: 71346 - DNA, 25 bp, Homo sapien
actggcttttgcgaaccgctctccg

SEQ ID NO: 71347 - DNA, 25 bp, Homo sapien
agcccggagccgtttacagtttgag

SEQ ID NO: 71348 - DNA, 25 bp, Homo sapien
tcccgccatatacattccgtgcttt

SEQ ID NO: 71349 - DNA, 25 bp, Homo sapien
aaacacccgccgtgggctaagcatg

SEQ ID NO: 71350 - DNA, 25 bp, Homo sapien
cacggcgataaagagccaggccctc

SEQ ID NO: 71351 - DNA, 25 bp, Homo sapien
gctgccaaggagctttcccgtaaca

SEQ ID NO: 71352 - DNA, 25 bp, Homo sapien
cagtctccaggtaggataatccgtc

SEQ ID NO: 71353 - DNA, 25 bp, Homo sapien
gctccggagctgcagagaagcttcc

SEQ ID NO: 71354 - DNA, 25 bp, Homo sapien
caacttgaatgcgtgtgtcagaccc

SEQ ID NO: 71355 - DNA, 25 bp, Homo sapien
tgtcagacccgcgaccactacaaga

SEQ ID NO: 71356 - DNA, 25 bp, Homo sapien
ttcgcgggacgcagacaacttgaat

SEQ ID NO: 71357 - DNA, 25 bp, Homo sapien
agacacttccggttctcagagggcg

SEQ ID NO: 71358 - DNA, 25 bp, Homo sapien
agagggcgccgttcttccctgagaa

SEQ ID NO: 71359 - DNA, 25 bp, Homo sapien
gtccaaaatctcctcggcacgcggg

SEQ ID NO: 71360 - DNA, 25 bp, Homo sapien
cccaggagctccagaaagaacgtga

SEQ ID NO: 71361 - DNA, 25 bp, Homo sapien
gaggagccgctactgccggttatct

SEQ ID NO: 71362 - DNA, 25 bp, Homo sapien
ctgccggttatcttcggacacgttg

SEQ ID NO: 71363 - DNA, 25 bp, Homo sapien
agctctcgcggagggcttcgttaaa

SEQ ID NO: 71364 - DNA, 25 bp, Homo sapien
cacgttgtgggccagccagttcact

SEQ ID NO: 71365 - DNA, 25 bp, Homo sapien
atcttcggacacgttgtgggccagc

SEQ ID NO: 71366 - DNA, 25 bp, Homo sapien
ggccagccagttcactcggtttcca

SEQ ID NO: 71367 - DNA, 25 bp, Homo sapien
tcgcggagggcttcgttaaacttca

SEQ ID NO: 71368 - DNA, 25 bp, Homo sapien
agttcactcggtttccagctctcgc

SEQ ID NO: 71369 - DNA, 25 bp, Homo sapien
ctctgcgggaagttagagcctctgc

SEQ ID NO: 71370 - DNA, 25 bp, Homo sapien
cgtgacctgcgaacgctgccaagtg

SEQ ID NO: 71371 - DNA, 25 bp, Homo sapien
cccattaacgcacgctgaagaaatc

SEQ ID NO: 71372 - DNA, 25 bp, Homo sapien
tgcttctccacggactctgcgggaa

SEQ ID NO: 71373 - DNA, 25 bp, Homo sapien
acccgagcaggcgaatgacctttag

SEQ ID NO: 71374 - DNA, 25 bp, Homo sapien
gagtgtcccagacatccgtagtctg

SEQ ID NO: 71375 - DNA, 25 bp, Homo sapien
ggagcggcgaggcattaacgattaa

SEQ ID NO: 71376 - DNA, 25 bp, Homo sapien
gctgaagaaatctgctgcgctcctg

SEQ ID NO: 71377 - DNA, 25 bp, Homo sapien
ctgccgatgaaactcctgcgtaaga

SEQ ID NO: 71378 - DNA, 25 bp, Homo sapien
ctaggcacttgttgggcagaatgtc

SEQ ID NO: 71379 - DNA, 25 bp, Homo sapien
tagctgtactgtgtggcgccttatt

SEQ ID NO: 71380 - DNA, 25 bp, Homo sapien
tgccagcgttcctgtgacgcgtttc

SEQ ID NO: 71381 - DNA, 25 bp, Homo sapien
tccgctctggagcattttcgttccg

SEQ ID NO: 71382 - DNA, 25 bp, Homo sapien
cgcgcgtctggaagcatttccgctc

SEQ ID NO: 71383 - DNA, 25 bp, Homo sapien
tttggtcgccaaagatatcacggtg

SEQ ID NO: 71384 - DNA, 25 bp, Homo sapien
ttgcggcagcggaacctaaagtttc

SEQ ID NO: 71385 - DNA, 25 bp, Homo sapien
ctgcactttcaacgccgtaggtctc

SEQ ID NO: 71386 - DNA, 25 bp, Homo sapien
acgcgacccagtcatgccgagagca

SEQ ID NO: 71387 - DNA, 25 bp, Homo sapien
ctgtgccgactcaggacagctgctg

SEQ ID NO: 71388 - DNA, 25 bp, Homo sapien
gccggctacgcttgtcagagcagca

SEQ ID NO: 71389 - DNA, 25 bp, Homo sapien
cagctggtgattttggacttgcctt

SEQ ID NO: 71390 - DNA, 25 bp, Homo sapien
ggagcgctatcgagggttcatttta

SEQ ID NO: 71391 - DNA, 25 bp, Homo sapien
gggttcattttatccagcttgagga

SEQ ID NO: 71392 - DNA, 25 bp, Homo sapien
tggaaggacagtcttacccggacgc

SEQ ID NO: 71393 - DNA, 25 bp, Homo sapien
tggatctccttccacggctgtgctg

SEQ ID NO: 71394 - DNA, 25 bp, Homo sapien
tctcggacgaactagtggcagcgct

SEQ ID NO: 71395 - DNA, 25 bp, Homo sapien
gtgccgcataacttggtggcctcga

SEQ ID NO: 71396 - DNA, 25 bp, Homo sapien
gaacctgctggttccggtcaccatc

SEQ ID NO: 71397 - DNA, 25 bp, Homo sapien
ctgatcgctgccactttcctgtgga

SEQ ID NO: 71398 - DNA, 25 bp, Homo sapien
gagctgcgatcccaagcgccatgga

SEQ ID NO: 71399 - DNA, 25 bp, Homo sapien
cggtccacgccgaactcactgagga

SEQ ID NO: 71400 - DNA, 25 bp, Homo sapien
tgccgtttgtctaccggaagatcta

SEQ ID NO: 71401 - DNA, 25 bp, Homo sapien
atcgcgcccgtactctgaagttttc

SEQ ID NO: 71402 - DNA, 25 bp, Homo sapien
gtggcattccctcccgacagcaagg

SEQ ID NO: 71403 - DNA, 25 bp, Homo sapien
cgggagcggcttaagtttgtcctca

SEQ ID NO: 71404 - DNA, 25 bp, Homo sapien
cctccaagaagagggtcggcgcttc

SEQ ID NO: 71405 - DNA, 25 bp, Homo sapien
cccatgatccgaccgggctgtcgta

SEQ ID NO: 71406 - DNA, 25 bp, Homo sapien
gcttccctgaggtggatacgcctga

SEQ ID NO: 71407 - DNA, 25 bp, Homo sapien
tccacgcaaggagggtggcattccc

SEQ ID NO: 71408 - DNA, 25 bp, Homo sapien
tggtgcgcgcaagtctcccaaactt

SEQ ID NO: 71409 - DNA, 25 bp, Homo sapien
gccctctccaggttcttgtgtctga

SEQ ID NO: 71410 - DNA, 25 bp, Homo sapien
ggtccctctgtgtttgctgttggca

SEQ ID NO: 71411 - DNA, 25 bp, Homo sapien
accgctatttgtggatccttctgta

SEQ ID NO: 71412 - DNA, 25 bp, Homo sapien
cctcctctctgtgtgctagtcttta

SEQ ID NO: 71413 - DNA, 25 bp, Homo sapien
tctgcgcctctgttttctagctacg

SEQ ID NO: 71414 - DNA, 25 bp, Homo sapien
ctagctacgtctgtctccgaatgta

SEQ ID NO: 71415 - DNA, 25 bp, Homo sapien
ttgctgtgcctgtctgtccatacgt

SEQ ID NO: 71416 - DNA, 25 bp, Homo sapien
gtgccacctcctgtgcttgttcttg

SEQ ID NO: 71417 - DNA, 25 bp, Homo sapien
cgtcttattgacagcaggaaccgga

SEQ ID NO: 71418 - DNA, 25 bp, Homo sapien
cctggtcagcaaacaacagcagatc

SEQ ID NO: 71419 - DNA, 25 bp, Homo sapien
cgtcattacctacggctgcctggtc

SEQ ID NO: 71420 - DNA, 25 bp, Homo sapien
tgattcctttactccgcccacaggg

SEQ ID NO: 71421 - DNA, 25 bp, Homo sapien
gaacgcgctcctttcggctacgaga

SEQ ID NO: 71422 - DNA, 25 bp, Homo sapien
tgtgcgtgtatcagtgcatgattcc

SEQ ID NO: 71423 - DNA, 25 bp, Homo sapien
ggctcgcaggtccacgtcttattga

SEQ ID NO: 71424 - DNA, 25 bp, Homo sapien
cccacagggtctgggcatccgtcat

SEQ ID NO: 71425 - DNA, 25 bp, Homo sapien
tttttgctttcgtgcggttctgcga

SEQ ID NO: 71426 - DNA, 25 bp, Homo sapien
cttccggcctaaaccaaatctcatt

SEQ ID NO: 71427 - DNA, 25 bp, Homo sapien
attttctcgttgttggcgcagcccg

SEQ ID NO: 71428 - DNA, 25 bp, Homo sapien
agctcgccactttattttctcgttg

SEQ ID NO: 71429 - DNA, 25 bp, Homo sapien
gcgctctcgcctttgtcagtttcat

SEQ ID NO: 71430 - DNA, 25 bp, Homo sapien
tgctccggagagatggctttgtttt

SEQ ID NO: 71431 - DNA, 25 bp, Homo sapien
acgtctgttctatttctgctccgga

SEQ ID NO: 71432 - DNA, 25 bp, Homo sapien
gtcagtttcatcagccggcgtttca

SEQ ID NO: 71433 - DNA, 25 bp, Homo sapien
cgccgctgcgataggttggttttac

SEQ ID NO: 71434 - DNA, 25 bp, Homo sapien
ggacgcaaacagcattttacacttt

SEQ ID NO: 71435 - DNA, 25 bp, Homo sapien
agacaaagtgccttcgccgctgcga

SEQ ID NO: 71436 - DNA, 25 bp, Homo sapien
ttccgaaagggacccggcagagaca

SEQ ID NO: 71437 - DNA, 25 bp, Homo sapien
caaaacgcttggagaggaccgtgca

SEQ ID NO: 71438 - DNA, 25 bp, Homo sapien
cggggcgagttgtaaacctcagaga

SEQ ID NO: 71439 - DNA, 25 bp, Homo sapien
caacggctcgggtttagtgtgatct

SEQ ID NO: 71440 - DNA, 25 bp, Homo sapien
ttctcccgtccaagtcgatcaaaga

SEQ ID NO: 71441 - DNA, 25 bp, Homo sapien
tctgagtctccgtttaccgatttta

SEQ ID NO: 71442 - DNA, 25 bp, Homo sapien
aaagcctcagtagcggacccggccg

SEQ ID NO: 71443 - DNA, 25 bp, Homo sapien
aacgccgggttagcgccaggctgaa

SEQ ID NO: 71444 - DNA, 25 bp, Homo sapien
gccaggctgaatcctcgctctgact

SEQ ID NO: 71445 - DNA, 25 bp, Homo sapien
ggctgaaagcctcagtagcggaccc

SEQ ID NO: 71446 - DNA, 25 bp, Homo sapien
gatgtggtctctgagtctccgttta

SEQ ID NO: 71447 - DNA, 25 bp, Homo sapien
actcctattgcggtgggatgtggtc

SEQ ID NO: 71448 - DNA, 25 bp, Homo sapien
tgaatcctcgctctgactcctattg

SEQ ID NO: 71449 - DNA, 25 bp, Homo sapien
ctcttcctggtttgaccctggcctg

SEQ ID NO: 71450 - DNA, 25 bp, Homo sapien
ggctactctcattaccaggggaagg

SEQ ID NO: 71451 - DNA, 25 bp, Homo sapien
ctgcggcccaagcacagctttcaga

SEQ ID NO: 71452 - DNA, 25 bp, Homo sapien
gcgcgcctcgtgtaaccattcagga

SEQ ID NO: 71453 - DNA, 25 bp, Homo sapien
gtcaggtctcttcagccttgctgtc

SEQ ID NO: 71454 - DNA, 25 bp, Homo sapien
ccggcctaaacaaatcgaaactgtg

SEQ ID NO: 71455 - DNA, 25 bp, Homo sapien
agccgacattgcgtggctactctca

SEQ ID NO: 71456 - DNA, 25 bp, Homo sapien
aactgtgcaatgaacgtggcccggg

SEQ ID NO: 71457 - DNA, 25 bp, Homo sapien
tcccggggctgacaccgaatgaggc

SEQ ID NO: 71458 - DNA, 25 bp, Homo sapien
ctcgaactcgcccaagtgcgggcgt

SEQ ID NO: 71459 - DNA, 25 bp, Homo sapien
cttgccgggtgtcagggtcatccag

SEQ ID NO: 71460 - DNA, 25 bp, Homo sapien
tcacgggcacgcacagcgagtagct

SEQ ID NO: 71461 - DNA, 25 bp, Homo sapien
cagtcgggaagctccaggacgaagc

SEQ ID NO: 71462 - DNA, 25 bp, Homo sapien
tgtgcgcgataaacggccggcgctc

SEQ ID NO: 71463 - DNA, 25 bp, Homo sapien
cccaaggtagctccgtgtgcgttct

SEQ ID NO: 71464 - DNA, 25 bp, Homo sapien
ctcgccgcgagatgtgcgcgataaa

SEQ ID NO: 71465 - DNA, 25 bp, Homo sapien
tcctccggcattgcgggcccaggag

SEQ ID NO: 71466 - DNA, 25 bp, Homo sapien
agacgtgcgcccacctcgggttcaa

SEQ ID NO: 71467 - DNA, 25 bp, Homo sapien
ctccgaacagctttcccagcatttg

SEQ ID NO: 71468 - DNA, 25 bp, Homo sapien
ttgcgggcccaggagatccgagccc

SEQ ID NO: 71469 - DNA, 25 bp, Homo sapien
gaagccctcccgcaaacgaagtgca

SEQ ID NO: 71470 - DNA, 25 bp, Homo sapien
caaacgaagtgcagtgagtccaggc

SEQ ID NO: 71471 - DNA, 25 bp, Homo sapien
cggccaagaggccaggccaaagtgc

SEQ ID NO: 71472 - DNA, 25 bp, Homo sapien
acctcgggttcaaggcccaagcagc

SEQ ID NO: 71473 - DNA, 25 bp, Homo sapien
gccgttcttgatgcctgtggctttc

SEQ ID NO: 71474 - DNA, 25 bp, Homo sapien
tactcgctctcgtctttgtcctgga

SEQ ID NO: 71475 - DNA, 25 bp, Homo sapien
atctttggcttgtagcggcggttca

SEQ ID NO: 71476 - DNA, 25 bp, Homo sapien
ggggtcgtatttctcaacaagtctc

SEQ ID NO: 71477 - DNA, 25 bp, Homo sapien
tgcgtttcaacgtcattgtccattc

SEQ ID NO: 71478 - DNA, 25 bp, Homo sapien
ggagttcgcagtttcgtcccttata

SEQ ID NO: 71479 - DNA, 25 bp, Homo sapien
gatagcacctgtccgagtctttctc

SEQ ID NO: 71480 - DNA, 25 bp, Homo sapien
ccctccttggagcagatgctttctc

SEQ ID NO: 71481 - DNA, 25 bp, Homo sapien
tggcctgagcctgacctgttttctc

SEQ ID NO: 71482 - DNA, 25 bp, Homo sapien
ccgccgttggctgagcccataagta

SEQ ID NO: 71483 - DNA, 25 bp, Homo sapien
ggaaactggctctcatgcccttgga

SEQ ID NO: 71484 - DNA, 25 bp, Homo sapien
cacccgggtcagactcttttcgcta

SEQ ID NO: 71485 - DNA, 25 bp, Homo sapien
gggacggctttcagacgctttcctc

SEQ ID NO: 71486 - DNA, 25 bp, Homo sapien
ctcctgtgccacgagctgtagcttc

SEQ ID NO: 71487 - DNA, 25 bp, Homo sapien
ccataagtaggatagccgggttgcc

SEQ ID NO: 71488 - DNA, 25 bp, Homo sapien
gtcaaatctggccttcggacgatca

SEQ ID NO: 71489 - DNA, 25 bp, Homo sapien
tgacactcgggcctcggcccaatgg

SEQ ID NO: 71490 - DNA, 25 bp, Homo sapien
tttgccttcaaaccggaagcacgtg

SEQ ID NO: 71491 - DNA, 25 bp, Homo sapien
tgcacaaactctctcgcttaaaaaa

SEQ ID NO: 71492 - DNA, 25 bp, Homo sapien
gacagctcggatctttgcacaaact

SEQ ID NO: 71493 - DNA, 25 bp, Homo sapien
ttttttcaaatctctgacagctcgg

SEQ ID NO: 71494 - DNA, 25 bp, Homo sapien
gctggcagcgcctttaatcgccttt

SEQ ID NO: 71495 - DNA, 25 bp, Homo sapien
agtgtcacgctcagctgtgcccaga

SEQ ID NO: 71496 - DNA, 25 bp, Homo sapien
cgcgcgggactttgcggataaataa

SEQ ID NO: 71497 - DNA, 25 bp, Homo sapien
gccttgcctctatctagctcacgga

SEQ ID NO: 71498 - DNA, 25 bp, Homo sapien
tagctcacggagcatgtgcagaccc

SEQ ID NO: 71499 - DNA, 25 bp, Homo sapien
gccgcctctgtctcttccaaagggg

SEQ ID NO: 71500 - DNA, 25 bp, Homo sapien
aaggggcctcctcacttcggagatg

SEQ ID NO: 71501 - DNA, 25 bp, Homo sapien
gttaatatgggcgtccaagcctctg

SEQ ID NO: 71502 - DNA, 25 bp, Homo sapien
cctgagcgcccagagctcttgaaag

SEQ ID NO: 71503 - DNA, 25 bp, Homo sapien
cgcgctcgcccgattgcttcgagtt

SEQ ID NO: 71504 - DNA, 25 bp, Homo sapien
ggccacaccctctttgcagtgagac

SEQ ID NO: 71505 - DNA, 25 bp, Homo sapien
gagccagttgcctggaccttccctg

SEQ ID NO: 71506 - DNA, 25 bp, Homo sapien
tttgtggggaatccgcacccatgcc

SEQ ID NO: 71507 - DNA, 25 bp, Homo sapien
gactttcgacaacaccctggagctg

SEQ ID NO: 71508 - DNA, 25 bp, Homo sapien
aagcccagagggctaggaatagccc

SEQ ID NO: 71509 - DNA, 25 bp, Homo sapien
accttccctggcagtgggagtccgg

SEQ ID NO: 71510 - DNA, 25 bp, Homo sapien
ggagtccgggcaacgcagattaatc

SEQ ID NO: 71511 - DNA, 25 bp, Homo sapien
acgcagattaatctcaggagggccc

SEQ ID NO: 71512 - DNA, 25 bp, Homo sapien
ctggcgccatagagccaagcccaga

SEQ ID NO: 71513 - DNA, 25 bp, Homo sapien
cgagaaaggcgtcagcaaacgaggc

SEQ ID NO: 71514 - DNA, 25 bp, Homo sapien
tggactgaagctctaggcacctgcg

SEQ ID NO: 71515 - DNA, 25 bp, Homo sapien
aattttctcataaccgggaatgtga

SEQ ID NO: 71516 - DNA, 25 bp, Homo sapien
ttcgctatttcctggtcgaggcacc

SEQ ID NO: 71517 - DNA, 25 bp, Homo sapien
gtctgccgatctctttttcgctatt

SEQ ID NO: 71518 - DNA, 25 bp, Homo sapien
gacttgtctccggattcgttttgga

SEQ ID NO: 71519 - DNA, 25 bp, Homo sapien
tcgttttggaggaccagtatccgac

SEQ ID NO: 71520 - DNA, 25 bp, Homo sapien
agtatccgactatgctgaagcctgc

SEQ ID NO: 71521 - DNA, 25 bp, Homo sapien
cgcgctggcaagacgcttaatcaaa

SEQ ID NO: 71522 - DNA, 25 bp, Homo sapien
cgcctgatcagcttggcgttcatca

SEQ ID NO: 71523 - DNA, 25 bp, Homo sapien
gacgccttatctcgcctgcaggaga

SEQ ID NO: 71524 - DNA, 25 bp, Homo sapien
ctttcagcgcggtaaatagggtctc

SEQ ID NO: 71525 - DNA, 25 bp, Homo sapien
ccagctgaataatacggcggccctt

SEQ ID NO: 71526 - DNA, 25 bp, Homo sapien
ggcggccctttggagacaccattta

SEQ ID NO: 71527 - DNA, 25 bp, Homo sapien
gtggagcccggatttgttacagtaa

SEQ ID NO: 71528 - DNA, 25 bp, Homo sapien
ggatgataaatgcacccgcggccca

SEQ ID NO: 71529 - DNA, 25 bp, Homo sapien
tgcgttcgttttgtctctctaattc

SEQ ID NO: 71530 - DNA, 25 bp, Homo sapien
gggcgtgcatctttgggaccctctt

SEQ ID NO: 71531 - DNA, 25 bp, Homo sapien
gcgtgtttgttcgtgactcagaggc

SEQ ID NO: 71532 - DNA, 25 bp, Homo sapien
tgcccgagtgtgcacgcaaaaattg

SEQ ID NO: 71533 - DNA, 25 bp, Homo sapien
gggtcactgcaatgccaaggccttc

SEQ ID NO: 71534 - DNA, 25 bp, Homo sapien
ggtgcaagaaaagctccgggttcca

SEQ ID NO: 71535 - DNA, 25 bp, Homo sapien
taattctcgtgtggttgcgctttgc

SEQ ID NO: 71536 - DNA, 25 bp, Homo sapien
cacctccttcctcgtattgaatcgg

SEQ ID NO: 71537 - DNA, 25 bp, Homo sapien
agcgtctgtagacacctgtgccttg

SEQ ID NO: 71538 - DNA, 25 bp, Homo sapien
ccctgagaagcgaaactgcccttgg

SEQ ID NO: 71539 - DNA, 25 bp, Homo sapien
tgatccggagatcgcttataacctc

SEQ ID NO: 71540 - DNA, 25 bp, Homo sapien
gccacatcgaactggagaccctctg

SEQ ID NO: 71541 - DNA, 25 bp, Homo sapien
cggaacggtcctcgccagacatagc

SEQ ID NO: 71542 - DNA, 25 bp, Homo sapien
tggaggtctcgcatagcattccctg

SEQ ID NO: 71543 - DNA, 25 bp, Homo sapien
acctctgcttggagttccgagttcg

SEQ ID NO: 71544 - DNA, 25 bp, Homo sapien
agccacgcttgacctttccatgaaa

SEQ ID NO: 71545 - DNA, 25 bp, Homo sapien
tttctaaccgcgctgaggcagtcgc

SEQ ID NO: 71546 - DNA, 25 bp, Homo sapien
ctcccaacagggatcttcgtttgca

SEQ ID NO: 71547 - DNA, 25 bp, Homo sapien
accaggatgacccagcgttttctaa

SEQ ID NO: 71548 - DNA, 25 bp, Homo sapien
gaggcccgtgacaaaaccaggatga

SEQ ID NO: 71549 - DNA, 25 bp, Homo sapien
cggagccgcacctcaactgtcaggg

SEQ ID NO: 71550 - DNA, 25 bp, Homo sapien
ggcaatgactccgactggtacgtga

SEQ ID NO: 71551 - DNA, 25 bp, Homo sapien
aagggtcgagcatccgactccggca

SEQ ID NO: 71552 - DNA, 25 bp, Homo sapien
ttcgtttgcatcacccagaggagct

SEQ ID NO: 71553 - DNA, 25 bp, Homo sapien
tgggcgcttagggacctggcgtccc

SEQ ID NO: 71554 - DNA, 25 bp, Homo sapien
gactcgcgggctccgttcagaggac

SEQ ID NO: 71555 - DNA, 25 bp, Homo sapien
tgcccgtgtccctgacctcgtccct

SEQ ID NO: 71556 - DNA, 25 bp, Homo sapien
ccaagaggaggtctgggaaaggacg

SEQ ID NO: 71557 - DNA, 25 bp, Homo sapien
gcccaggtagagtgacgcgcgtccc

SEQ ID NO: 71558 - DNA, 25 bp, Homo sapien
aactggccaagaggatgccccgcac

SEQ ID NO: 71559 - DNA, 25 bp, Homo sapien
aaaggacgacgcgtccggggcatcg

SEQ ID NO: 71560 - DNA, 25 bp, Homo sapien
gctccgttcagaggacgcccgccct

SEQ ID NO: 71561 - DNA, 25 bp, Homo sapien
tctcccggcacgcggggtcgctgca

SEQ ID NO: 71562 - DNA, 25 bp, Homo sapien
cgcctctcttcagctgtaccggccc

SEQ ID NO: 71563 - DNA, 25 bp, Homo sapien
agacgcctctcttcagctgtaccgg

SEQ ID NO: 71564 - DNA, 25 bp, Homo sapien
gacagacgcctctcttcagctgtac

SEQ ID NO: 71565 - DNA, 25 bp, Homo sapien
agacagacgcctctcttcagctgta

SEQ ID NO: 71566 - DNA, 25 bp, Homo sapien
gaagacagacgcctctcttcagctg

SEQ ID NO: 71567 - DNA, 25 bp, Homo sapien
ctcggaagacagacgcctctcttca

SEQ ID NO: 71568 - DNA, 25 bp, Homo sapien
acctcggaagacagacgcctctctt

SEQ ID NO: 71569 - DNA, 25 bp, Homo sapien
actggtcacttcaccctcggaatcg

SEQ ID NO: 71570 - DNA, 25 bp, Homo sapien
aacatttggctctacgtcccggtga

SEQ ID NO: 71571 - DNA, 25 bp, Homo sapien
ggtcactgacctgcccgttcttgca

SEQ ID NO: 71572 - DNA, 25 bp, Homo sapien
atcatctcatagtgcgcggcgcctc

SEQ ID NO: 71573 - DNA, 25 bp, Homo sapien
ccgcgtacctggcagctgaacttgc

SEQ ID NO: 71574 - DNA, 25 bp, Homo sapien
ttcagcacctcatagccttcgtggg

SEQ ID NO: 71575 - DNA, 25 bp, Homo sapien
gggctcttgagacccacatagaagg

SEQ ID NO: 71576 - DNA, 25 bp, Homo sapien
gcgctgaggtcctgcatgacttcca

SEQ ID NO: 71577 - DNA, 25 bp, Homo sapien
tcacttcagccgtgtgccgggcact

SEQ ID NO: 71578 - DNA, 25 bp, Homo sapien
tgccgggcactgcaaatcaggaagt

SEQ ID NO: 71579 - DNA, 25 bp, Homo sapien
ctcgggtgccgccacacgtctggag

SEQ ID NO: 71580 - DNA, 25 bp, Homo sapien
ccacacgtctggaggcgacttctgt

SEQ ID NO: 71581 - DNA, 25 bp, Homo sapien
cttccttccctaggcgtggaagccg

SEQ ID NO: 71582 - DNA, 25 bp, Homo sapien
ccctaggcgtggaagccgcttgcgc

SEQ ID NO: 71583 - DNA, 25 bp, Homo sapien
gtcccggagttctgctcacttcagc

SEQ ID NO: 71584 - DNA, 25 bp, Homo sapien
ccggctgagtccacaggtcccgtgt

SEQ ID NO: 71585 - DNA, 25 bp, Homo sapien
agctttattagaacgcgggctgata

SEQ ID NO: 71586 - DNA, 25 bp, Homo sapien
cggcctgatacacaggtgagcttta

SEQ ID NO: 71587 - DNA, 25 bp, Homo sapien
tgagctttattagaacgcggcctga

SEQ ID NO: 71588 - DNA, 25 bp, Homo sapien
gagctttattagaacgcggcctgat

SEQ ID NO: 71589 - DNA, 25 bp, Homo sapien
cgcgggctgatacacaggtgagctt

SEQ ID NO: 71590 - DNA, 25 bp, Homo sapien
cgggctgatacacaggtgagcttta

SEQ ID NO: 71591 - DNA, 25 bp, Homo sapien
gcgggctgatacacaggtgagcttt

SEQ ID NO: 71592 - DNA, 25 bp, Homo sapien
agctttattagaacgcggcctgata

SEQ ID NO: 71593 - DNA, 25 bp, Homo sapien
ggcttctccgaaagccgcgagggca

SEQ ID NO: 71594 - DNA, 25 bp, Homo sapien
agatctccgtgtttcttcctaaagg

SEQ ID NO: 71595 - DNA, 25 bp, Homo sapien
tgagccgcgcgcattccttagatct

SEQ ID NO: 71596 - DNA, 25 bp, Homo sapien
agctagacgacattttcagaacata

SEQ ID NO: 71597 - DNA, 25 bp, Homo sapien
tctggcttttctcaggtaagaacta

SEQ ID NO: 71598 - DNA, 25 bp, Homo sapien
gtgtccgctgtgcaaaccggtcctt

SEQ ID NO: 71599 - DNA, 25 bp, Homo sapien
cagctcccgtgtgtccgctgtgcaa

SEQ ID NO: 71600 - DNA, 25 bp, Homo sapien
cttcctaaaggaacgtggcctgata

SEQ ID NO: 71601 - DNA, 25 bp, Homo sapien
caccgcaagcagatcgggctgctca

SEQ ID NO: 71602 - DNA, 25 bp, Homo sapien
cgtgtccgtggtcaacaccacactg

SEQ ID NO: 71603 - DNA, 25 bp, Homo sapien
ggtcaacaccacactgccgtgcgtg

SEQ ID NO: 71604 - DNA, 25 bp, Homo sapien
gtgctgctgtcactcgtgtacttgc

SEQ ID NO: 71605 - DNA, 25 bp, Homo sapien
ggcgcggcaccaagtaccagcgctt

SEQ ID NO: 71606 - DNA, 25 bp, Homo sapien
ctggctacagcaccgcaagcagatc

SEQ ID NO: 71607 - DNA, 25 bp, Homo sapien
tctacagcttctgcttgccgctgcg

SEQ ID NO: 71608 - DNA, 25 bp, Homo sapien
ccgactggctggaccactggctaca

SEQ ID NO: 71609 - DNA, 25 bp, Homo sapien
cagactcgccaggatccggagaggc

SEQ ID NO: 71610 - DNA, 25 bp, Homo sapien
tgcatcagccgcagactcgccagga

SEQ ID NO: 71611 - DNA, 25 bp, Homo sapien
tggtgccctgcgtcgtcatcctggc

SEQ ID NO: 71612 - DNA, 25 bp, Homo sapien
gagagggagagcaccatcaagttca

SEQ ID NO: 71613 - DNA, 25 bp, Homo sapien
gtcatcctggccaaagccctgtttc

SEQ ID NO: 71614 - DNA, 25 bp, Homo sapien
cctggccgagaagacgagccacgta

SEQ ID NO: 71615 - DNA, 25 bp, Homo sapien
gacgagccacgtatgaggtgcctgc

SEQ ID NO: 71616 - DNA, 25 bp, Homo sapien
gagagcaccatcaagttcacgctgc

SEQ ID NO: 71617 - DNA, 25 bp, Homo sapien
cttctgattggctttccggtgctcg

SEQ ID NO: 71618 - DNA, 25 bp, Homo sapien
cctagcgcatagctggcttctgatt

SEQ ID NO: 71619 - DNA, 25 bp, Homo sapien
gacccttgtctgagaccgagctatg

SEQ ID NO: 71620 - DNA, 25 bp, Homo sapien
tctaaaggcgcttgccagtgcaatc

SEQ ID NO: 71621 - DNA, 25 bp, Homo sapien
gtctccctggagttcttgcaagtcg

SEQ ID NO: 71622 - DNA, 25 bp, Homo sapien
ttgcaagtcggccaggatgtctcag

SEQ ID NO: 71623 - DNA, 25 bp, Homo sapien
atgtctcaggtacagcgcgtgcaca

SEQ ID NO: 71624 - DNA, 25 bp, Homo sapien
ccctgattcgttggacagagccttg

SEQ ID NO: 71625 - DNA, 25 bp, Homo sapien
aggaatcgaaccctcaggccctcgt

SEQ ID NO: 71626 - DNA, 25 bp, Homo sapien
catgactgccgtcggcgtgcaggta

SEQ ID NO: 71627 - DNA, 25 bp, Homo sapien
gttaatcgccgagctttgaacgccc

SEQ ID NO: 71628 - DNA, 25 bp, Homo sapien
ctcgctgactcagcgtaatccgagc

SEQ ID NO: 71629 - DNA, 25 bp, Homo sapien
gtcggagtgacttcccgatcctttc

SEQ ID NO: 71630 - DNA, 25 bp, Homo sapien
cccagccctcgaggaatctgcgccc

SEQ ID NO: 71631 - DNA, 25 bp, Homo sapien
agctggaacaggaatcgaaccctca

SEQ ID NO: 71632 - DNA, 25 bp, Homo sapien
gactcagcgtaatccgagccgcgga

SEQ ID NO: 71633 - DNA, 25 bp, Homo sapien
gtctatccgctggactgtctccagg

SEQ ID NO: 71634 - DNA, 25 bp, Homo sapien
tctccaggattagagaggcccgttg

SEQ ID NO: 71635 - DNA, 25 bp, Homo sapien
gaggcccgttgacttcgtgtacaaa

SEQ ID NO: 71636 - DNA, 25 bp, Homo sapien
agagaggcccgttgacttcgtgtac

SEQ ID NO: 71637 - DNA, 25 bp, Homo sapien
ttagagaggcccgttgacttcgtgt

SEQ ID NO: 71638 - DNA, 25 bp, Homo sapien
caggattagagaggcccgttgactt

SEQ ID NO: 71639 - DNA, 25 bp, Homo sapien
tccaggattagagaggcccgttgac

SEQ ID NO: 71640 - DNA, 25 bp, Homo sapien
actgtctccaggattagagaggccc

SEQ ID NO: 71641 - DNA, 25 bp, Homo sapien
gaagaagcccgtgtctccgaagatt

SEQ ID NO: 71642 - DNA, 25 bp, Homo sapien
cgcggacacctcagggaaaggctct

SEQ ID NO: 71643 - DNA, 25 bp, Homo sapien
cccgctgcagagtctatccgctgga

SEQ ID NO: 71644 - DNA, 25 bp, Homo sapien
tgttggctaagaacctacacattcc

SEQ ID NO: 71645 - DNA, 25 bp, Homo sapien
tgcacgatgtttatgttggctaaga

SEQ ID NO: 71646 - DNA, 25 bp, Homo sapien
tctccgaagatttggcttctcctta

SEQ ID NO: 71647 - DNA, 25 bp, Homo sapien
acacctcagggaaaggctctggcga

SEQ ID NO: 71648 - DNA, 25 bp, Homo sapien
cttctccttagcgtagtgcacgatg

SEQ ID NO: 71649 - DNA, 25 bp, Homo sapien
gcgcagtactcaccgagtgcgcggc

SEQ ID NO: 71650 - DNA, 25 bp, Homo sapien
ccattgatcaggacgcggctttgcc

SEQ ID NO: 71651 - DNA, 25 bp, Homo sapien
tgctcctcctcggaccaggtggccg

SEQ ID NO: 71652 - DNA, 25 bp, Homo sapien
tgcagaagggcgcagtactcaccga

SEQ ID NO: 71653 - DNA, 25 bp, Homo sapien
agagggcacgctggcttagccttct

SEQ ID NO: 71654 - DNA, 25 bp, Homo sapien
tggcttagccttctacgcggcaatc

SEQ ID NO: 71655 - DNA, 25 bp, Homo sapien
aaagggcgagactgtcgctccctcg

SEQ ID NO: 71656 - DNA, 25 bp, Homo sapien
gcgagcagcaccggcagtagtagct

SEQ ID NO: 71657 - DNA, 25 bp, Homo sapien
cccatgccataagtcgcgctgtcta

SEQ ID NO: 71658 - DNA, 25 bp, Homo sapien
cagcctagctgctgaggcgaccgag

SEQ ID NO: 71659 - DNA, 25 bp, Homo sapien
gctccgctcttgaagggttccagtg

SEQ ID NO: 71660 - DNA, 25 bp, Homo sapien
ggaatccattcgtatcccatgccat

SEQ ID NO: 71661 - DNA, 25 bp, Homo sapien
gtctattcttgaccaggcccggcaa

SEQ ID NO: 71662 - DNA, 25 bp, Homo sapien
cctgacccttagcaggagtggaatg

SEQ ID NO: 71663 - DNA, 25 bp, Homo sapien
aactgctccgagctcccaggaatca

SEQ ID NO: 71664 - DNA, 25 bp, Homo sapien
gtgtgtggtgtttccaactttctca

SEQ ID NO: 71665 - DNA, 25 bp, Homo sapien
cagtcctggagctcagaattctgaa

SEQ ID NO: 71666 - DNA, 25 bp, Homo sapien
tgggtggctcagaacagcagaaatg

SEQ ID NO: 71667 - DNA, 25 bp, Homo sapien
tctggctgctgtgacaaagcgctgc

SEQ ID NO: 71668 - DNA, 25 bp, Homo sapien
actgttctctttgcacgtggcccgg

SEQ ID NO: 71669 - DNA, 25 bp, Homo sapien
tctagagagttggtttgagctcctc

SEQ ID NO: 71670 - DNA, 25 bp, Homo sapien
ggcgtactgccctctggtctagaga

SEQ ID NO: 71671 - DNA, 25 bp, Homo sapien
attgcgtggcacaggaattatgtcc

SEQ ID NO: 71672 - DNA, 25 bp, Homo sapien
tgagctcctctgactgttctctttg

SEQ ID NO: 71673 - DNA, 25 bp, Homo sapien
cgcgcacatgtaggcgttccgagcg

SEQ ID NO: 71674 - DNA, 25 bp, Homo sapien
ccatcccaagatccggggccggcga

SEQ ID NO: 71675 - DNA, 25 bp, Homo sapien
ccaccggcgggctgcatggtactgt

SEQ ID NO: 71676 - DNA, 25 bp, Homo sapien
cgcgttcagactgcggagtagccta

SEQ ID NO: 71677 - DNA, 25 bp, Homo sapien
ttctccggcctgatgcgacccggta

SEQ ID NO: 71678 - DNA, 25 bp, Homo sapien
cctgccgcgcgcacatgtaggcgtt

SEQ ID NO: 71679 - DNA, 25 bp, Homo sapien
catggtactgtgttctaggcccacc

SEQ ID NO: 71680 - DNA, 25 bp, Homo sapien
tgcgacccggtaacgcgttcagact

SEQ ID NO: 71681 - DNA, 25 bp, Homo sapien
ggggtcgcagtccaaacaaccaatc

SEQ ID NO: 71682 - DNA, 25 bp, Homo sapien
gggtgactgagctcctcttgcactc

SEQ ID NO: 71683 - DNA, 25 bp, Homo sapien
accaacattgttctctcaggactcc

SEQ ID NO: 71684 - DNA, 25 bp, Homo sapien
gtggattatctcatccctgcaggga

SEQ ID NO: 71685 - DNA, 25 bp, Homo sapien
ttttctccagccgagaggacgcggc

SEQ ID NO: 71686 - DNA, 25 bp, Homo sapien
tgcgacttctccctgcgctagcgag

SEQ ID NO: 71687 - DNA, 25 bp, Homo sapien
gacgcggctgtgatatacgaaggta

SEQ ID NO: 71688 - DNA, 25 bp, Homo sapien
ccgccatgttcggttgctatgctgc

SEQ ID NO: 71689 - DNA, 25 bp, Homo sapien
tggacacagggcgagttgtttgatt

SEQ ID NO: 71690 - DNA, 25 bp, Homo sapien
cggcagtggcgaagggcccactgaa

SEQ ID NO: 71691 - DNA, 25 bp, Homo sapien
cacagggcgagttgtttgatttggc

SEQ ID NO: 71692 - DNA, 25 bp, Homo sapien
gacacagggcgagttgtttgatttg

SEQ ID NO: 71693 - DNA, 25 bp, Homo sapien
cgcttggacacagggcgagttgttt

SEQ ID NO: 71694 - DNA, 25 bp, Homo sapien
cgagttgtttgatttggcggaggcg

SEQ ID NO: 71695 - DNA, 25 bp, Homo sapien
cccaccggcggcagtggcgaagggc

SEQ ID NO: 71696 - DNA, 25 bp, Homo sapien
gggcccactgaagcgccgggtgcca

SEQ ID NO: 71697 - DNA, 25 bp, Homo sapien
tcgtcgggccggcagggcattaatc

SEQ ID NO: 71698 - DNA, 25 bp, Homo sapien
taatgtttgccgagcggacgcgctc

SEQ ID NO: 71699 - DNA, 25 bp, Homo sapien
cagggcattaatcccgccggaggga

SEQ ID NO: 71700 - DNA, 25 bp, Homo sapien
ccagctcaggtaagcgcgaggcccg

SEQ ID NO: 71701 - DNA, 25 bp, Homo sapien
ccatttctcggcgtctaccgaggag

SEQ ID NO: 71702 - DNA, 25 bp, Homo sapien
ttgtgggcgccatttctcggcgtct

SEQ ID NO: 71703 - DNA, 25 bp, Homo sapien
cgcccgtttaagagcggagcgctcc

SEQ ID NO: 71704 - DNA, 25 bp, Homo sapien
cgagtttcggtcgataccgcgcgac

SEQ ID NO: 71705 - DNA, 25 bp, Homo sapien
gttcactccgtacccatcaagaagg

SEQ ID NO: 71706 - DNA, 25 bp, Homo sapien
gcgatgtgcatgagcgcagacctgt

SEQ ID NO: 71707 - DNA, 25 bp, Homo sapien
gcggttacaaactgggcgctgcctc

SEQ ID NO: 71708 - DNA, 25 bp, Homo sapien
caggcaggtgtagatgagaaactta

SEQ ID NO: 71709 - DNA, 25 bp, Homo sapien
ccttacctgggatgaagactcgcgg

SEQ ID NO: 71710 - DNA, 25 bp, Homo sapien
acggcccagtagctccattggatga

SEQ ID NO: 71711 - DNA, 25 bp, Homo sapien
gctcaaaggaaaaggcccgcgcgta

SEQ ID NO: 71712 - DNA, 25 bp, Homo sapien
gcgggtgtatccctggctcaaagga

SEQ ID NO: 71713 - DNA, 25 bp, Homo sapien
gcttctcattggtgaaacctcctcc

SEQ ID NO: 71714 - DNA, 25 bp, Homo sapien
ctgcttggaaaatcagcctcggatt

SEQ ID NO: 71715 - DNA, 25 bp, Homo sapien
agcccggcagctcaatgacaaatcg

SEQ ID NO: 71716 - DNA, 25 bp, Homo sapien
cttgtagccgcggttccttccctat

SEQ ID NO: 71717 - DNA, 25 bp, Homo sapien
tgcaaaaacttaactgccctcggaa

SEQ ID NO: 71718 - DNA, 25 bp, Homo sapien
cctcggaacttgcacgcgccgtgaa

SEQ ID NO: 71719 - DNA, 25 bp, Homo sapien
tggtcctgtcttgcaaatgagcata

SEQ ID NO: 71720 - DNA, 25 bp, Homo sapien
tccactgccgcagggttaccagctg

SEQ ID NO: 71721 - DNA, 25 bp, Homo sapien
aactcccatcgtgcttctgccttga

SEQ ID NO: 71722 - DNA, 25 bp, Homo sapien
agttttgcccgccagcttcgggtcg

SEQ ID NO: 71723 - DNA, 25 bp, Homo sapien
agcttcgggtcggttcctccgattg

SEQ ID NO: 71724 - DNA, 25 bp, Homo sapien
gggcgctcggcttccagacttgcag

SEQ ID NO: 71725 - DNA, 25 bp, Homo sapien
ccaatatcctgggaaagccaggatg

SEQ ID NO: 71726 - DNA, 25 bp, Homo sapien
gggaaagccaggatgaactcccatc

SEQ ID NO: 71727 - DNA, 25 bp, Homo sapien
ccaggatgaactcccatcgtgcttc

SEQ ID NO: 71728 - DNA, 25 bp, Homo sapien
ctcacacccgccctagttttgcccg

SEQ ID NO: 71729 - DNA, 25 bp, Homo sapien
gccaagttgcgtggacccgctcttt

SEQ ID NO: 71730 - DNA, 25 bp, Homo sapien
gacgctgcgagacttttcggcgctc

SEQ ID NO: 71731 - DNA, 25 bp, Homo sapien
gacttttcggcgctcgagccgacct

SEQ ID NO: 71732 - DNA, 25 bp, Homo sapien
cgcccagggatcctggagacaactt

SEQ ID NO: 71733 - DNA, 25 bp, Homo sapien
cctggagacaactttgccgtgtgac

SEQ ID NO: 71734 - DNA, 25 bp, Homo sapien
acaactttgccgtgtgacgcgccgg

SEQ ID NO: 71735 - DNA, 25 bp, Homo sapien
ttcgcttccgtctcagccaagttgc

SEQ ID NO: 71736 - DNA, 25 bp, Homo sapien
tgacgctgctttcgcttcacccgaa

SEQ ID NO: 71737 - DNA, 25 bp, Homo sapien
tgccaggattgctgaagcctcgctg

SEQ ID NO: 71738 - DNA, 25 bp, Homo sapien
ctggggagagctaggcaacctctct

SEQ ID NO: 71739 - DNA, 25 bp, Homo sapien
ggcaacctctcttccgattgtgtgg

SEQ ID NO: 71740 - DNA, 25 bp, Homo sapien
ttccgattgtgtgggcaccggaatc

SEQ ID NO: 71741 - DNA, 25 bp, Homo sapien
gaaggcaggcttctcaacaggtcca

SEQ ID NO: 71742 - DNA, 25 bp, Homo sapien
tttacacagagaaagccgcggttcg

SEQ ID NO: 71743 - DNA, 25 bp, Homo sapien
ggcttctcaacaggtccatcattta

SEQ ID NO: 71744 - DNA, 25 bp, Homo sapien
aacaggtccatcatttacacagaga

SEQ ID NO: 71745 - DNA, 25 bp, Homo sapien
ccatgtccatgctgtacttcgatga

SEQ ID NO: 71746 - DNA, 25 bp, Homo sapien
cctcatcggctggaacgactggatc

SEQ ID NO: 71747 - DNA, 25 bp, Homo sapien
cggcacggtgaactcctgctgcatt

SEQ ID NO: 71748 - DNA, 25 bp, Homo sapien
gcgggacgtgcccaacatgattgtg

SEQ ID NO: 71749 - DNA, 25 bp, Homo sapien
gatggccggaccaacctctgttgca

SEQ ID NO: 71750 - DNA, 25 bp, Homo sapien
agcggcgactcaacctagacgtgca

SEQ ID NO: 71751 - DNA, 25 bp, Homo sapien
cggctactacgggaactactgtgag

SEQ ID NO: 71752 - DNA, 25 bp, Homo sapien
tccacacggctgtggtgaaccagta

SEQ ID NO: 71753 - DNA, 25 bp, Homo sapien
aaggctccagaacccggcaagtgca

SEQ ID NO: 71754 - DNA, 25 bp, Homo sapien
tcaagatatcaatcacggcgcgggg

SEQ ID NO: 71755 - DNA, 25 bp, Homo sapien
ctcctggcgcctaatcaagatatca

SEQ ID NO: 71756 - DNA, 25 bp, Homo sapien
cgaggtaacacctggtccgccaact

SEQ ID NO: 71757 - DNA, 25 bp, Homo sapien
aaaggctcattgctgccgcggaaca

SEQ ID NO: 71758 - DNA, 25 bp, Homo sapien
ctgcgcctttcagggccgggttcgc

SEQ ID NO: 71759 - DNA, 25 bp, Homo sapien
cgcggaacatgcctgcgcctttcag

SEQ ID NO: 71760 - DNA, 25 bp, Homo sapien
cagaacccggcaagtgcaggtagcc

SEQ ID NO: 71761 - DNA, 25 bp, Homo sapien
ctctgaaagccttattgattgctca

SEQ ID NO: 71762 - DNA, 25 bp, Homo sapien
ctccagctgtgagagaggctttttc

SEQ ID NO: 71763 - DNA, 25 bp, Homo sapien
tgccgctcacaatggccggccagtg

SEQ ID NO: 71764 - DNA, 25 bp, Homo sapien
tttcaaatgctcgacagctgggcca

SEQ ID NO: 71765 - DNA, 25 bp, Homo sapien
ttttctgtcctggtctctgaaagcc

SEQ ID NO: 71766 - DNA, 25 bp, Homo sapien
cgcgcctcggccttttacatttcaa

SEQ ID NO: 71767 - DNA, 25 bp, Homo sapien
agtgaacttctcagcccacggtttc

SEQ ID NO: 71768 - DNA, 25 bp, Homo sapien
cttccgcccaaagaagggctctttg

SEQ ID NO: 71769 - DNA, 25 bp, Homo sapien
gccaccttctctcccgtgaccgccg

SEQ ID NO: 71770 - DNA, 25 bp, Homo sapien
aggcgaaccgcaggcccgggcttct

SEQ ID NO: 71771 - DNA, 25 bp, Homo sapien
cctggaaaacgccgtccgtggcgcg

SEQ ID NO: 71772 - DNA, 25 bp, Homo sapien
ccgcccagcacctgcgcaggtagcg

SEQ ID NO: 71773 - DNA, 25 bp, Homo sapien
gcccggaaagaccaggcccactgcc

SEQ ID NO: 71774 - DNA, 25 bp, Homo sapien
gcatcagggcgagccactcggctcg

SEQ ID NO: 71775 - DNA, 25 bp, Homo sapien
gggctccgcatcagggcgagccact

SEQ ID NO: 71776 - DNA, 25 bp, Homo sapien
gcgccaggggcatgcctgacagcca

SEQ ID NO: 71777 - DNA, 25 bp, Homo sapien
taacgccctgggtaccgactgctgt

SEQ ID NO: 71778 - DNA, 25 bp, Homo sapien
gtgtcatcctcaggacgggtccagt

SEQ ID NO: 71779 - DNA, 25 bp, Homo sapien
caggacgggtccagtgcgctctcct

SEQ ID NO: 71780 - DNA, 25 bp, Homo sapien
gcgctctcctgggtgcctaggccag

SEQ ID NO: 71781 - DNA, 25 bp, Homo sapien
aggacaggtccaatgcgctctcccg

SEQ ID NO: 71782 - DNA, 25 bp, Homo sapien
ctctgggcacctaacgccctgggta

SEQ ID NO: 71783 - DNA, 25 bp, Homo sapien
cccaccgaacaggaacagggcggcg

SEQ ID NO: 71784 - DNA, 25 bp, Homo sapien
tgggtaccgactgctgtccacgctg

SEQ ID NO: 71785 - DNA, 25 bp, Homo sapien
tggtcgcacagcatctcgacctcgg

SEQ ID NO: 71786 - DNA, 25 bp, Homo sapien
tcgctcaggggcctccactcggagg

SEQ ID NO: 71787 - DNA, 25 bp, Homo sapien
gcgtacacgatggtctcggccagct

SEQ ID NO: 71788 - DNA, 25 bp, Homo sapien
tcgacctcggccgagtagaagaggc

SEQ ID NO: 71789 - DNA, 25 bp, Homo sapien
ataggagtagtcctggaccacggtg

SEQ ID NO: 71790 - DNA, 25 bp, Homo sapien
cctggctctaggtaacggcgacctc

SEQ ID NO: 71791 - DNA, 25 bp, Homo sapien
cagcaccctggcgtacacgatggtc

SEQ ID NO: 71792 - DNA, 25 bp, Homo sapien
agtggcacgagaagtagcccaggcc

SEQ ID NO: 71793 - DNA, 25 bp, Homo sapien
cccagaaatgagttccggtggattc

SEQ ID NO: 71794 - DNA, 25 bp, Homo sapien
cgctccttggagttccgccatttca

SEQ ID NO: 71795 - DNA, 25 bp, Homo sapien
agcggcttctaggacacggtgattt

SEQ ID NO: 71796 - DNA, 25 bp, Homo sapien
agattttcacctggaatgtcccggc

SEQ ID NO: 71797 - DNA, 25 bp, Homo sapien
gggcttgctgatgtacttctgcttc

SEQ ID NO: 71798 - DNA, 25 bp, Homo sapien
aatgcgctcacctgcgagtctttca

SEQ ID NO: 71799 - DNA, 25 bp, Homo sapien
ggtggattcccgcattgactccgcc

SEQ ID NO: 71800 - DNA, 25 bp, Homo sapien
gccgtttccgaacccttgcaattga

SEQ ID NO: 71801 - DNA, 25 bp, Homo sapien
ggctctccacagaggggcccgtatt

SEQ ID NO: 71802 - DNA, 25 bp, Homo sapien
gctggattagatgggtcagcgccct

SEQ ID NO: 71803 - DNA, 25 bp, Homo sapien
tttgcacctttttacccggcatctg

SEQ ID NO: 71804 - DNA, 25 bp, Homo sapien
gcgccctgattgacagtgacacttc

SEQ ID NO: 71805 - DNA, 25 bp, Homo sapien
tcttggcaagattaagccggctctc

SEQ ID NO: 71806 - DNA, 25 bp, Homo sapien
cggagagcgtcttttggacagctta

SEQ ID NO: 71807 - DNA, 25 bp, Homo sapien
ttaccgcagctctgcacgtgaggcg

SEQ ID NO: 71808 - DNA, 25 bp, Homo sapien
cccggcatctgtccctgggatcagg

SEQ ID NO: 71809 - DNA, 25 bp, Homo sapien
tggcgctttgggaatattcattctt

SEQ ID NO: 71810 - DNA, 25 bp, Homo sapien
ccgcggcttaattagggcatcgcca

SEQ ID NO: 71811 - DNA, 25 bp, Homo sapien
attcattcttggctcgcaccgcgca

SEQ ID NO: 71812 - DNA, 25 bp, Homo sapien
agcacttccttctgttggcgctttg

SEQ ID NO: 71813 - DNA, 25 bp, Homo sapien
cctcgggctccgtttttatgaagca

SEQ ID NO: 71814 - DNA, 25 bp, Homo sapien
tgtgaacagggcttgttttcccttc

SEQ ID NO: 71815 - DNA, 25 bp, Homo sapien
cgagctgggcaggaaaagagcctcc

SEQ ID NO: 71816 - DNA, 25 bp, Homo sapien
gctgggaaatgtacccgcggcttaa

SEQ ID NO: 71817 - DNA, 25 bp, Homo sapien
ttgttcccagaacgggtggcattta

SEQ ID NO: 71818 - DNA, 25 bp, Homo sapien
ccgccgcgtgtttatctggggaaat

SEQ ID NO: 71819 - DNA, 25 bp, Homo sapien
cgggtggcatttaggtcaattaata

SEQ ID NO: 71820 - DNA, 25 bp, Homo sapien
aaggcctgtcctctgcgaggcttca

SEQ ID NO: 71821 - DNA, 25 bp, Homo sapien
gcgccaaagggcctcttaattgttc

SEQ ID NO: 71822 - DNA, 25 bp, Homo sapien
ggatcccacctgtgagccactgagc

SEQ ID NO: 71823 - DNA, 25 bp, Homo sapien
agccgaggcatttgctaggcagcga

SEQ ID NO: 71824 - DNA, 25 bp, Homo sapien
agtaaatcatctcattcgcgggccc

SEQ ID NO: 71825 - DNA, 25 bp, Homo sapien
cggcgagcgagccaatggacgcggc

SEQ ID NO: 71826 - DNA, 25 bp, Homo sapien
tggcccgctcttttaccgtcgcgca

SEQ ID NO: 71827 - DNA, 25 bp, Homo sapien
ccctgtctgaatgcggggaacgtct

SEQ ID NO: 71828 - DNA, 25 bp, Homo sapien
gaatgggctgagtgccctgtctgaa

SEQ ID NO: 71829 - DNA, 25 bp, Homo sapien
agggctcgtgagagccaatgagagc

SEQ ID NO: 71830 - DNA, 25 bp, Homo sapien
gcacacccaaagaccgcgcctctcg

SEQ ID NO: 71831 - DNA, 25 bp, Homo sapien
tctgccaccgcacacccaaagaccg

SEQ ID NO: 71832 - DNA, 25 bp, Homo sapien
agtgccctgtctgaatgcggggaac

SEQ ID NO: 71833 - DNA, 25 bp, Homo sapien
gcttttcgtgacgaagcgcctccca

SEQ ID NO: 71834 - DNA, 25 bp, Homo sapien
cctgcgtgctagaggcaaacttttg

SEQ ID NO: 71835 - DNA, 25 bp, Homo sapien
ttcccaaagggatccgcacgtaatc

SEQ ID NO: 71836 - DNA, 25 bp, Homo sapien
tcggccctgagatccgcttgacttc

SEQ ID NO: 71837 - DNA, 25 bp, Homo sapien
tgcagccagccacttgagaacttcg

SEQ ID NO: 71838 - DNA, 25 bp, Homo sapien
aggtcgatgttgcaccctctcccta

SEQ ID NO: 71839 - DNA, 25 bp, Homo sapien
tctctctcggtaaagttgcattggc

SEQ ID NO: 71840 - DNA, 25 bp, Homo sapien
ggccttcttttgcttgcttttcgtg

SEQ ID NO: 71841 - DNA, 25 bp, Homo sapien
cctggtttgcagctcccaaacaatg

SEQ ID NO: 71842 - DNA, 25 bp, Homo sapien
tggcgagtcgggaagaaagccaacg

SEQ ID NO: 71843 - DNA, 25 bp, Homo sapien
aggccggactctgctcgtggcgagt

SEQ ID NO: 71844 - DNA, 25 bp, Homo sapien
atggccacattgtcgcagccgcaca

SEQ ID NO: 71845 - DNA, 25 bp, Homo sapien
gcttttccgccacgcggagcgctgg

SEQ ID NO: 71846 - DNA, 25 bp, Homo sapien
gtttgcagctcccaaacaatggcca

SEQ ID NO: 71847 - DNA, 25 bp, Homo sapien
cggcctggtttgcagctcccaaaca

SEQ ID NO: 71848 - DNA, 25 bp, Homo sapien
gcagctcccaaacaatggccacatt

SEQ ID NO: 71849 - DNA, 25 bp, Homo sapien
aggcggaattcatgcgggccctagt

SEQ ID NO: 71850 - DNA, 25 bp, Homo sapien
cggttataaatgattcatgcagccc

SEQ ID NO: 71851 - DNA, 25 bp, Homo sapien
gtggacagcatgctgcccgccagca

SEQ ID NO: 71852 - DNA, 25 bp, Homo sapien
tcatgcgggccctagtctgagaaag

SEQ ID NO: 71853 - DNA, 25 bp, Homo sapien
ggccgccgccggttataaatgattc

SEQ ID NO: 71854 - DNA, 25 bp, Homo sapien
tcggcggccacttgatgttccctgc

SEQ ID NO: 71855 - DNA, 25 bp, Homo sapien
cccgcacgctgggtaagttgaagga

SEQ ID NO: 71856 - DNA, 25 bp, Homo sapien
tagtctgagaaaggcacccgcaggg

SEQ ID NO: 71857 - DNA, 25 bp, Homo sapien
tgcctgcacgtcagagccatcaaga

SEQ ID NO: 71858 - DNA, 25 bp, Homo sapien
cagatgcccacgtcaccaagaagca

SEQ ID NO: 71859 - DNA, 25 bp, Homo sapien
agcagcgcaatgacgtgcacctccg

SEQ ID NO: 71860 - DNA, 25 bp, Homo sapien
ccaggccgtggaggactgcctgcac

SEQ ID NO: 71861 - DNA, 25 bp, Homo sapien
catcaagaccgagagctccggggta

SEQ ID NO: 71862 - DNA, 25 bp, Homo sapien
atgtgaaaacggtccacggcccaga

SEQ ID NO: 71863 - DNA, 25 bp, Homo sapien
aggcgactccatagccgtgcccagg

SEQ ID NO: 71864 - DNA, 25 bp, Homo sapien
cgcacaccgctgctcaaagagaatg

SEQ ID NO: 71865 - DNA, 25 bp, Homo sapien
aaagcactggcttctctgacaaccc

SEQ ID NO: 71866 - DNA, 25 bp, Homo sapien
gggcaggtgtatcccacggaaagca

SEQ ID NO: 71867 - DNA, 25 bp, Homo sapien
acgtggtgcagtacatcaaggcgca

SEQ ID NO: 71868 - DNA, 25 bp, Homo sapien
aggacgacctggtgcttccagacga

SEQ ID NO: 71869 - DNA, 25 bp, Homo sapien
cctagcatcagcgagaacgtggcga

SEQ ID NO: 71870 - DNA, 25 bp, Homo sapien
agcgacgggccgacctatggccacg

SEQ ID NO: 71871 - DNA, 25 bp, Homo sapien
gcgggccaagtacgcggcagccact

SEQ ID NO: 71872 - DNA, 25 bp, Homo sapien
agctgtccgcgagcgaggtgaccat

SEQ ID NO: 71873 - DNA, 25 bp, Homo sapien
gccggccgtgctaccaaataaggca

SEQ ID NO: 71874 - DNA, 25 bp, Homo sapien
catggttcacctgctctcactaaga

SEQ ID NO: 71875 - DNA, 25 bp, Homo sapien
cgtagcctagtgcttctgaggaacc

SEQ ID NO: 71876 - DNA, 25 bp, Homo sapien
agggcctgtcccatttgtgagcagc

SEQ ID NO: 71877 - DNA, 25 bp, Homo sapien
ccagccaggtgtcccgttcgaggac

SEQ ID NO: 71878 - DNA, 25 bp, Homo sapien
cgaggacgcgagctcttccacttgt

SEQ ID NO: 71879 - DNA, 25 bp, Homo sapien
gctctcactaagacggggcaaacga

SEQ ID NO: 71880 - DNA, 25 bp, Homo sapien
cactgtccggagtgcgtgtttaccc

SEQ ID NO: 71881 - DNA, 25 bp, Homo sapien
tggcccgcccgctaaagcactttga

SEQ ID NO: 71882 - DNA, 25 bp, Homo sapien
ctctcgtcgaggtgatggttttata

SEQ ID NO: 71883 - DNA, 25 bp, Homo sapien
tgggcttagcaaacgtctccaagta

SEQ ID NO: 71884 - DNA, 25 bp, Homo sapien
cacagtgtcctctctcttgggctta

SEQ ID NO: 71885 - DNA, 25 bp, Homo sapien
tccgcgcatgcctagtacctgaatg

SEQ ID NO: 71886 - DNA, 25 bp, Homo sapien
cgtgtgctcaagttcactccgagga

SEQ ID NO: 71887 - DNA, 25 bp, Homo sapien
ggcccgcgcgcatcaattttgcata

SEQ ID NO: 71888 - DNA, 25 bp, Homo sapien
ctcacattgcctgacgtagggtctc

SEQ ID NO: 71889 - DNA, 25 bp, Homo sapien
cacggtaaacaccactgccacggtg

SEQ ID NO: 71890 - DNA, 25 bp, Homo sapien
tgtctacacacacgggaacacggta

SEQ ID NO: 71891 - DNA, 25 bp, Homo sapien
cgtggtaaacaccactgccacggtg

SEQ ID NO: 71892 - DNA, 25 bp, Homo sapien
cacgggaacacggtaaacaccactg

SEQ ID NO: 71893 - DNA, 25 bp, Homo sapien
tgccacggtgtctacacacacggga

SEQ ID NO: 71894 - DNA, 25 bp, Homo sapien
gtggtaaacaccactgccacggtgt

SEQ ID NO: 71895 - DNA, 25 bp, Homo sapien
acggtaaacaccactgccacggtgc

SEQ ID NO: 71896 - DNA, 25 bp, Homo sapien
cacacacacgggaacacggtaaaca

SEQ ID NO: 71897 - DNA, 25 bp, Homo sapien
cacgcgcaagaccatcgcgggaagt

SEQ ID NO: 71898 - DNA, 25 bp, Homo sapien
ctcggcgcatttatcggcggcccag

SEQ ID NO: 71899 - DNA, 25 bp, Homo sapien
tgccagaagagcatggctggaactc

SEQ ID NO: 71900 - DNA, 25 bp, Homo sapien
ccaaactccgatgtggggctcaggt

SEQ ID NO: 71901 - DNA, 25 bp, Homo sapien
ttaccgcaggtagctgccggagttg

SEQ ID NO: 71902 - DNA, 25 bp, Homo sapien
ttcctctgcttctccgatacgcggg

SEQ ID NO: 71903 - DNA, 25 bp, Homo sapien
ggcgtccatctgtcagtccctaggc

SEQ ID NO: 71904 - DNA, 25 bp, Homo sapien
caggctgctggcaggaagtttcctc

SEQ ID NO: 71905 - DNA, 25 bp, Homo sapien
ccggcgagaaaagcgtatgcaaatt

SEQ ID NO: 71906 - DNA, 25 bp, Homo sapien
atctgcgccttgaaccgatcctgca

SEQ ID NO: 71907 - DNA, 25 bp, Homo sapien
aacaccgggagcctgttagcagccg

SEQ ID NO: 71908 - DNA, 25 bp, Homo sapien
cccagacgcagtccgagagtccaga

SEQ ID NO: 71909 - DNA, 25 bp, Homo sapien
gccgactggaggaccaaagagatta

SEQ ID NO: 71910 - DNA, 25 bp, Homo sapien
gcaatacagcgtagccaaacccggg

SEQ ID NO: 71911 - DNA, 25 bp, Homo sapien
gaaccacctgcagcgggaaacaccg

SEQ ID NO: 71912 - DNA, 25 bp, Homo sapien
tatgcaaattttcgagcggccgacg

SEQ ID NO: 71913 - DNA, 25 bp, Homo sapien
ccaaagtgcacccaagagccgatga

SEQ ID NO: 71914 - DNA, 25 bp, Homo sapien
cccgggtacaccatagagagcgtaa

SEQ ID NO: 71915 - DNA, 25 bp, Homo sapien
ggcggctgcctctctatggtaacgc

SEQ ID NO: 71916 - DNA, 25 bp, Homo sapien
tagttgaccctgatggggacccgta

SEQ ID NO: 71917 - DNA, 25 bp, Homo sapien
tctttcacttctgggttagggcgtc

SEQ ID NO: 71918 - DNA, 25 bp, Homo sapien
ggctcagcgacctactggttggata

SEQ ID NO: 71919 - DNA, 25 bp, Homo sapien
tgatactcgaaggaaacggtctttc

SEQ ID NO: 71920 - DNA, 25 bp, Homo sapien
ctgaccgggtacttacagccctgtt

SEQ ID NO: 71921 - DNA, 25 bp, Homo sapien
gtcggtccctgattcggtcgaatcc

SEQ ID NO: 71922 - DNA, 25 bp, Homo sapien
ttaagcgacaggattggcccagccg

SEQ ID NO: 71923 - DNA, 25 bp, Homo sapien
ttgaaactcgacatcttcctgcgga

SEQ ID NO: 71924 - DNA, 25 bp, Homo sapien
ctttcgtctcggaaaccgtggcctg

SEQ ID NO: 71925 - DNA, 25 bp, Homo sapien
gaacctgcgccacctccttttgaaa

SEQ ID NO: 71926 - DNA, 25 bp, Homo sapien
tcgaatccacttgggagaccctgga

SEQ ID NO: 71927 - DNA, 25 bp, Homo sapien
ctgcaagcttaagaggtcggtccct

SEQ ID NO: 71928 - DNA, 25 bp, Homo sapien
tcacctgggttatgcgcttgcgaac

SEQ ID NO: 71929 - DNA, 25 bp, Homo sapien
tttttggctgccgagcaggacatcc

SEQ ID NO: 71930 - DNA, 25 bp, Homo sapien
ccctttgcctttccatgcctagttg

SEQ ID NO: 71931 - DNA, 25 bp, Homo sapien
cctagcgacggtcgtggcgtaagac

SEQ ID NO: 71932 - DNA, 25 bp, Homo sapien
cgccatgtctgtgagcgagatcttc

SEQ ID NO: 71933 - DNA, 25 bp, Homo sapien
cccttgctacactggctgattgttg

SEQ ID NO: 71934 - DNA, 25 bp, Homo sapien
ttgcgattgattgcgctggttgcct

SEQ ID NO: 71935 - DNA, 25 bp, Homo sapien
tctggcgatgcctgtctgaaggcct

SEQ ID NO: 71936 - DNA, 25 bp, Homo sapien
tccatgcctagttgggccacttcgc

SEQ ID NO: 71937 - DNA, 25 bp, Homo sapien
gctggctactgcgaatttgggattc

SEQ ID NO: 71938 - DNA, 25 bp, Homo sapien
ggattctttaccacggctgaccagc

SEQ ID NO: 71939 - DNA, 25 bp, Homo sapien
gagacccatcagcttttcccatttg

SEQ ID NO: 71940 - DNA, 25 bp, Homo sapien
acgcgtctcgttagctcattacaaa

SEQ ID NO: 71941 - DNA, 25 bp, Homo sapien
ggagcgcgcacaacgttaaaccttg

SEQ ID NO: 71942 - DNA, 25 bp, Homo sapien
gcgtctgtcttgcaactcctattag

SEQ ID NO: 71943 - DNA, 25 bp, Homo sapien
tagcatccttcgacagcggcctttg

SEQ ID NO: 71944 - DNA, 25 bp, Homo sapien
cggcgcctgtcgttctaattgggtt

SEQ ID NO: 71945 - DNA, 25 bp, Homo sapien
gcgctccgagctggagaagccgcca

SEQ ID NO: 71946 - DNA, 25 bp, Homo sapien
tgcccgggctgacgcccaggaatgt

SEQ ID NO: 71947 - DNA, 25 bp, Homo sapien
cccaggaatgtggtcgacgagaagc

SEQ ID NO: 71948 - DNA, 25 bp, Homo sapien
cacggccacggacgccctggtgtcc

SEQ ID NO: 71949 - DNA, 25 bp, Homo sapien
gaggcgtccgctgggctcagatccc

SEQ ID NO: 71950 - DNA, 25 bp, Homo sapien
cacgcgctccgagctggagaagccg

SEQ ID NO: 71951 - DNA, 25 bp, Homo sapien
tcctctcgccgccgagggtcaggag

SEQ ID NO: 71952 - DNA, 25 bp, Homo sapien
gagtgtgacccaggtgccgcttcct

SEQ ID NO: 71953 - DNA, 25 bp, Homo sapien
cttctgcacggtcctcgctgggcaa

SEQ ID NO: 71954 - DNA, 25 bp, Homo sapien
aggggctcatatcggctggcacagc

SEQ ID NO: 71955 - DNA, 25 bp, Homo sapien
cagccaccacgggtaccgaaacttg

SEQ ID NO: 71956 - DNA, 25 bp, Homo sapien
ccgcattgcttagaagtctcgcttc

SEQ ID NO: 71957 - DNA, 25 bp, Homo sapien
ggttcagctcattactcttccggtg

SEQ ID NO: 71958 - DNA, 25 bp, Homo sapien
actcttccggtgaccctgggtatgc

SEQ ID NO: 71959 - DNA, 25 bp, Homo sapien
gagccttttaagaccgagtattcga

SEQ ID NO: 71960 - DNA, 25 bp, Homo sapien
gggtatgccacgcttattctccagg

SEQ ID NO: 71961 - DNA, 25 bp, Homo sapien
caaacgcaccctcgcggcgcttcag

SEQ ID NO: 71962 - DNA, 25 bp, Homo sapien
actgatcaggctcacgtggccgacc

SEQ ID NO: 71963 - DNA, 25 bp, Homo sapien
tggccctagcccagctgcaagcaaa

SEQ ID NO: 71964 - DNA, 25 bp, Homo sapien
gcgttgaacccaggagccaggccat

SEQ ID NO: 71965 - DNA, 25 bp, Homo sapien
cccacaggactgatcaggctcacgt

SEQ ID NO: 71966 - DNA, 25 bp, Homo sapien
caaaggctctgtgcctagcgtggcc

SEQ ID NO: 71967 - DNA, 25 bp, Homo sapien
cccagctgcaagcaaaggctctgtg

SEQ ID NO: 71968 - DNA, 25 bp, Homo sapien
cggtcgggcccatcacccagagccc

SEQ ID NO: 71969 - DNA, 25 bp, Homo sapien
ctgcggctaagacctgtgactaatg

SEQ ID NO: 71970 - DNA, 25 bp, Homo sapien
caaggctgagctttctgtctatttc

SEQ ID NO: 71971 - DNA, 25 bp, Homo sapien
gtgcgtcctgccattcactgttatg

SEQ ID NO: 71972 - DNA, 25 bp, Homo sapien
tttaaggtccttgcctacgctgcgg

SEQ ID NO: 71973 - DNA, 25 bp, Homo sapien
ctgccgaaacctgccttggatagta

SEQ ID NO: 71974 - DNA, 25 bp, Homo sapien
cagccaacagagtgagagcgcattt

SEQ ID NO: 71975 - DNA, 25 bp, Homo sapien
aaggtcaccctttgcaggcttcgga

SEQ ID NO: 71976 - DNA, 25 bp, Homo sapien
ctcgcgttctttgtctcaaggctga

SEQ ID NO: 71977 - DNA, 25 bp, Homo sapien
tgtcccactttatggtctggaaatg

SEQ ID NO: 71978 - DNA, 25 bp, Homo sapien
ctactgcccacgtatcaagaaatgg

SEQ ID NO: 71979 - DNA, 25 bp, Homo sapien
cgtgctgagattgacgggaagtcta

SEQ ID NO: 71980 - DNA, 25 bp, Homo sapien
tctaggattactcctgtcctctggg

SEQ ID NO: 71981 - DNA, 25 bp, Homo sapien
cggtggcaccatcgtactctggact

SEQ ID NO: 71982 - DNA, 25 bp, Homo sapien
cggcgccatcatactctggactggg

SEQ ID NO: 71983 - DNA, 25 bp, Homo sapien
agccggattacccagtggcaccatc

SEQ ID NO: 71984 - DNA, 25 bp, Homo sapien
tggcaccatcacactctgggctggg

SEQ ID NO: 71985 - DNA, 25 bp, Homo sapien
agctttctggctacggccgcgcaag

SEQ ID NO: 71986 - DNA, 25 bp, Homo sapien
tccgaagcagctttctggctacggc

SEQ ID NO: 71987 - DNA, 25 bp, Homo sapien
gctggtacttcagagcgctgcctga

SEQ ID NO: 71988 - DNA, 25 bp, Homo sapien
acttcagagcgctgcctgacaagcc

SEQ ID NO: 71989 - DNA, 25 bp, Homo sapien
tgctcgccctatttctggacccgga

SEQ ID NO: 71990 - DNA, 25 bp, Homo sapien
agctgccaggatagctcggctgtga

SEQ ID NO: 71991 - DNA, 25 bp, Homo sapien
gcggagccaactgcggggctctatc

SEQ ID NO: 71992 - DNA, 25 bp, Homo sapien
ctggcggagcagagctggtacttca

SEQ ID NO: 71993 - DNA, 25 bp, Homo sapien
ggccacgtcagggacatttctcggg

SEQ ID NO: 71994 - DNA, 25 bp, Homo sapien
actcacgcagcgaggtgccgcatca

SEQ ID NO: 71995 - DNA, 25 bp, Homo sapien
gccgcatcagactgaaatgtaatta

SEQ ID NO: 71996 - DNA, 25 bp, Homo sapien
tagagtgtaatgcaagccaggacgc

SEQ ID NO: 71997 - DNA, 25 bp, Homo sapien
caggacgcgcggagactcttaattg

SEQ ID NO: 71998 - DNA, 25 bp, Homo sapien
cgcggagactcttaattgaaaattc

SEQ ID NO: 71999 - DNA, 25 bp, Homo sapien
cagcgccgatgctatcagagataga

SEQ ID NO: 72000 - DNA, 25 bp, Homo sapien
atcacggctcacagcgccgatgcta

SEQ ID NO: 72001 - DNA, 25 bp, Homo sapien
tgctctgcggtagcaacggcacata

SEQ ID NO: 72002 - DNA, 25 bp, Homo sapien
gcacataaccgcagcgatgaccagg

SEQ ID NO: 72003 - DNA, 25 bp, Homo sapien
tgctcttggcacatgatccgactcc

SEQ ID NO: 72004 - DNA, 25 bp, Homo sapien
tgcctttgcgggtcctgtactcccg

SEQ ID NO: 72005 - DNA, 25 bp, Homo sapien
ctgtactcccgcgaggtccaggatt

SEQ ID NO: 72006 - DNA, 25 bp, Homo sapien
caaccggccgttgggaatcttcgca

SEQ ID NO: 72007 - DNA, 25 bp, Homo sapien
atcttcgcagcagcagaacccgctg

SEQ ID NO: 72008 - DNA, 25 bp, Homo sapien
gatgaccagggcagccaagccagca

SEQ ID NO: 72009 - DNA, 25 bp, Homo sapien
gcactgcacacagagccagattacg

SEQ ID NO: 72010 - DNA, 25 bp, Homo sapien
ctgccggtacctgttcttctttctg

SEQ ID NO: 72011 - DNA, 25 bp, Homo sapien
ttcccacccaacacgcacacgacag

SEQ ID NO: 72012 - DNA, 25 bp, Homo sapien
gcagcactcactgccggtacctgtt

SEQ ID NO: 72013 - DNA, 25 bp, Homo sapien
caaggcgcatgcacagggccagcca

SEQ ID NO: 72014 - DNA, 25 bp, Homo sapien
gccagattacgggttagtggcacct

SEQ ID NO: 72015 - DNA, 25 bp, Homo sapien
ctcactgccggtacctgttcttctt

SEQ ID NO: 72016 - DNA, 25 bp, Homo sapien
gcacacagagccagattacgggtta

SEQ ID NO: 72017 - DNA, 25 bp, Homo sapien
cagccgagccacgaaggtgcaaagc

SEQ ID NO: 72018 - DNA, 25 bp, Homo sapien
cttggcctccaaagcggggtagcct

SEQ ID NO: 72019 - DNA, 25 bp, Homo sapien
acgcaaacctaagagggcacccaga

SEQ ID NO: 72020 - DNA, 25 bp, Homo sapien
cttctgcacgttgctggcgatcttt

SEQ ID NO: 72021 - DNA, 25 bp, Homo sapien
cccgacagcggagccaactgacgga

SEQ ID NO: 72022 - DNA, 25 bp, Homo sapien
ccctccggacaataagctgcctttt

SEQ ID NO: 72023 - DNA, 25 bp, Homo sapien
cccaggggcagagggacatactccc

SEQ ID NO: 72024 - DNA, 25 bp, Homo sapien
ctcgaaagcgctcctctagaggtga

SEQ ID NO: 72025 - DNA, 25 bp, Homo sapien
aggagctagggaacctagcgctccc

SEQ ID NO: 72026 - DNA, 25 bp, Homo sapien
cagtcccggcgcgaactccaggtgt

SEQ ID NO: 72027 - DNA, 25 bp, Homo sapien
caactccggcttagagcctacggca

SEQ ID NO: 72028 - DNA, 25 bp, Homo sapien
ctccgcagagcctagaggagctagg

SEQ ID NO: 72029 - DNA, 25 bp, Homo sapien
ctaaggacaccgagctccgcagagc

SEQ ID NO: 72030 - DNA, 25 bp, Homo sapien
ggactagaaatgaatacacacggtc

SEQ ID NO: 72031 - DNA, 25 bp, Homo sapien
ggtctcggccacctaaggacaccga

SEQ ID NO: 72032 - DNA, 25 bp, Homo sapien
tacacacggtctcggccacctaagg

SEQ ID NO: 72033 - DNA, 25 bp, Homo sapien
ccctaggccgagttcgctgggctgc

SEQ ID NO: 72034 - DNA, 25 bp, Homo sapien
aactcctagctaagagccacctgca

SEQ ID NO: 72035 - DNA, 25 bp, Homo sapien
ggtccgctcggtctcttttgcccat

SEQ ID NO: 72036 - DNA, 25 bp, Homo sapien
ggctcaatccggaagctccctgttg

SEQ ID NO: 72037 - DNA, 25 bp, Homo sapien
cctgttgtccacacaggatgtcccg

SEQ ID NO: 72038 - DNA, 25 bp, Homo sapien
gagagccagcgaccgccgatctgtt

SEQ ID NO: 72039 - DNA, 25 bp, Homo sapien
ccgatctgttagctcgtgcgaccca

SEQ ID NO: 72040 - DNA, 25 bp, Homo sapien
gcaccgcttggcagcatttcacctg

SEQ ID NO: 72041 - DNA, 25 bp, Homo sapien
atacgcacctgggttgtctcgagcc

SEQ ID NO: 72042 - DNA, 25 bp, Homo sapien
gtagatcccgtgaaaaggtctccca

SEQ ID NO: 72043 - DNA, 25 bp, Homo sapien
ctctttcacatgaagcccgggccgg

SEQ ID NO: 72044 - DNA, 25 bp, Homo sapien
agcgtcctggtcgttgttttcgtcg

SEQ ID NO: 72045 - DNA, 25 bp, Homo sapien
gcagcctgtgctgttccgtgtgcgc

SEQ ID NO: 72046 - DNA, 25 bp, Homo sapien
cggtagtggccagatcccagacatc

SEQ ID NO: 72047 - DNA, 25 bp, Homo sapien
cccagacatccgagtagatcccgtg

SEQ ID NO: 72048 - DNA, 25 bp, Homo sapien
actacacacggacccgtgacgtcgg

SEQ ID NO: 72049 - DNA, 25 bp, Homo sapien
gcgcacgtgctctcggggtcacctt

SEQ ID NO: 72050 - DNA, 25 bp, Homo sapien
agaccaagccgggtaggcgctgtct

SEQ ID NO: 72051 - DNA, 25 bp, Homo sapien
tgctcctgctgcgtcgtgaggaccc

SEQ ID NO: 72052 - DNA, 25 bp, Homo sapien
ccctccgcgtatgggaccgagctgg

SEQ ID NO: 72053 - DNA, 25 bp, Homo sapien
ataccgtggggtatgcccagtgatg

SEQ ID NO: 72054 - DNA, 25 bp, Homo sapien
tatgcccagtgatgccagcagcttg

SEQ ID NO: 72055 - DNA, 25 bp, Homo sapien
agcagcttgtggcacctgggcgcac

SEQ ID NO: 72056 - DNA, 25 bp, Homo sapien
cccttccgatgggtctgctggctca

SEQ ID NO: 72057 - DNA, 25 bp, Homo sapien
cgggttggcgtgactcatcaccgcc

SEQ ID NO: 72058 - DNA, 25 bp, Homo sapien
tctgatccagtgtcccgcagtcctg

SEQ ID NO: 72059 - DNA, 25 bp, Homo sapien
atcccggaccatcctgttgaaggca

SEQ ID NO: 72060 - DNA, 25 bp, Homo sapien
ggagctcttagctgaggatggaacc

SEQ ID NO: 72061 - DNA, 25 bp, Homo sapien
ggatggaaccgactgcaccaggagc

SEQ ID NO: 72062 - DNA, 25 bp, Homo sapien
aatcgggcctccctgttacagcagg

SEQ ID NO: 72063 - DNA, 25 bp, Homo sapien
tgttatgtcttattgctcagcaacc

SEQ ID NO: 72064 - DNA, 25 bp, Homo sapien
agcaggagtcgcatctatttatata

SEQ ID NO: 72065 - DNA, 25 bp, Homo sapien
ctctcagctgacgaggtttccaaga

SEQ ID NO: 72066 - DNA, 25 bp, Homo sapien
ccctagaatgctggctgtggaccga

SEQ ID NO: 72067 - DNA, 25 bp, Homo sapien
cgcgctgtctgaaacctctccagag

SEQ ID NO: 72068 - DNA, 25 bp, Homo sapien
cgactgcagcctcgtccactgtgag

SEQ ID NO: 72069 - DNA, 25 bp, Homo sapien
ccaccgagagcacctggaagggcca

SEQ ID NO: 72070 - DNA, 25 bp, Homo sapien
ctgtggaccgatgggattcttagac

SEQ ID NO: 72071 - DNA, 25 bp, Homo sapien
ctgcctcggatgagggcagcacctg

SEQ ID NO: 72072 - DNA, 25 bp, Homo sapien
tcttagacccgggtcacctgcgtca

SEQ ID NO: 72073 - DNA, 25 bp, Homo sapien
atccgtttgggccgcctgcctggaa

SEQ ID NO: 72074 - DNA, 25 bp, Homo sapien
acagggccctggaaacgcgggtctg

SEQ ID NO: 72075 - DNA, 25 bp, Homo sapien
gacaggaaggagaccgcggctctcc

SEQ ID NO: 72076 - DNA, 25 bp, Homo sapien
acaggaaggagaccgcggctctccc

SEQ ID NO: 72077 - DNA, 25 bp, Homo sapien
cgggcctccagacggccagactctc

SEQ ID NO: 72078 - DNA, 25 bp, Homo sapien
ctgcgtagatccgtttgggccgcct

SEQ ID NO: 72079 - DNA, 25 bp, Homo sapien
ctggctgcgtagatccgtttgggcc

SEQ ID NO: 72080 - DNA, 25 bp, Homo sapien
gtagatccgtttgggccgcctgcct

SEQ ID NO: 72081 - DNA, 25 bp, Homo sapien
gcaggactgtccctacctcgagaag

SEQ ID NO: 72082 - DNA, 25 bp, Homo sapien
cagagaccctgggatcgcaggaacg

SEQ ID NO: 72083 - DNA, 25 bp, Homo sapien
ccggctggaaccaggtgtaactgca

SEQ ID NO: 72084 - DNA, 25 bp, Homo sapien
acctgacaagtaaagcgggtgaggc

SEQ ID NO: 72085 - DNA, 25 bp, Homo sapien
ggggcgactcacacctgacaagtaa

SEQ ID NO: 72086 - DNA, 25 bp, Homo sapien
gacctgaccgcgttcgggtgcacgt

SEQ ID NO: 72087 - DNA, 25 bp, Homo sapien
gtgtaactgcagagaccctgggatc

SEQ ID NO: 72088 - DNA, 25 bp, Homo sapien
tgtccctacctcgagaaggtgacgg

SEQ ID NO: 72089 - DNA, 25 bp, Homo sapien
ttcctcaattgctcgctggacaacg

SEQ ID NO: 72090 - DNA, 25 bp, Homo sapien
cccgcagaggtgagcttcctcaatt

SEQ ID NO: 72091 - DNA, 25 bp, Homo sapien
accagtgcttggtcttgcccttgga

SEQ ID NO: 72092 - DNA, 25 bp, Homo sapien
cacgtcggtgagtgcgttctagatc

SEQ ID NO: 72093 - DNA, 25 bp, Homo sapien
ggccttctggtccaagcacgtcggt

SEQ ID NO: 72094 - DNA, 25 bp, Homo sapien
ccggggccactgttagcgcaatcag

SEQ ID NO: 72095 - DNA, 25 bp, Homo sapien
gatccctgtttgtctggaagccctc

SEQ ID NO: 72096 - DNA, 25 bp, Homo sapien
gcggctgcacgcattactgcctaga

SEQ ID NO: 72097 - DNA, 25 bp, Homo sapien
aagagaaaccgcaccttcgtcctca

SEQ ID NO: 72098 - DNA, 25 bp, Homo sapien
ttgcagagcgcgagctcaatcaggc

SEQ ID NO: 72099 - DNA, 25 bp, Homo sapien
tggggctaccacagcagccgagaga

SEQ ID NO: 72100 - DNA, 25 bp, Homo sapien
gtcctcaacttcatcaagattcccg

SEQ ID NO: 72101 - DNA, 25 bp, Homo sapien
aagattcccgtggtcccgcacaatg

SEQ ID NO: 72102 - DNA, 25 bp, Homo sapien
ccgcacaatgagtgcagcgaggtca

SEQ ID NO: 72103 - DNA, 25 bp, Homo sapien
tggtgtctgagaacatgctgtgtgc

SEQ ID NO: 72104 - DNA, 25 bp, Homo sapien
cgaggtcatgagcaacatggtgtct

SEQ ID NO: 72105 - DNA, 25 bp, Homo sapien
gccgctgtaatattccgagtccatg

SEQ ID NO: 72106 - DNA, 25 bp, Homo sapien
cggtagcggcaaaggcgaattcttt

SEQ ID NO: 72107 - DNA, 25 bp, Homo sapien
gcgttactaactggcgcgatccaca

SEQ ID NO: 72108 - DNA, 25 bp, Homo sapien
tcctagattctgtgtccgtgccttg

SEQ ID NO: 72109 - DNA, 25 bp, Homo sapien
ccgtgccttgtttgaagagcttttg

SEQ ID NO: 72110 - DNA, 25 bp, Homo sapien
acttgtagtatgacgcccgcgagct

SEQ ID NO: 72111 - DNA, 25 bp, Homo sapien
cccgcgagctgtgatgcgttactaa

SEQ ID NO: 72112 - DNA, 25 bp, Homo sapien
cgagccggcgttctacttcctagaa

SEQ ID NO: 72113 - DNA, 25 bp, Homo sapien
agttctcgcagaggttcggcgtgtt

SEQ ID NO: 72114 - DNA, 25 bp, Homo sapien
ggggacggtcacctctggccatccg

SEQ ID NO: 72115 - DNA, 25 bp, Homo sapien
ttcggcgtgttgctgcccaacgcca

SEQ ID NO: 72116 - DNA, 25 bp, Homo sapien
tccgctacacgttcgaggagttctc

SEQ ID NO: 72117 - DNA, 25 bp, Homo sapien
gatggagaccgtgcacatccgcaag

SEQ ID NO: 72118 - DNA, 25 bp, Homo sapien
gcagctgcgatactcgggcatgatg

SEQ ID NO: 72119 - DNA, 25 bp, Homo sapien
ccacagctgttcgaccgggagctgt

SEQ ID NO: 72120 - DNA, 25 bp, Homo sapien
caacgccatgcggatgcaggtcagc

SEQ ID NO: 72121 - DNA, 25 bp, Homo sapien
tggcctcagttctggtccctgggca

SEQ ID NO: 72122 - DNA, 25 bp, Homo sapien
tggggcatgcaacagccgctaaccc

SEQ ID NO: 72123 - DNA, 25 bp, Homo sapien
gtctggtctggcgagtacagcttcg

SEQ ID NO: 72124 - DNA, 25 bp, Homo sapien
tatttaccgccaagtcctccgagga

SEQ ID NO: 72125 - DNA, 25 bp, Homo sapien
tgtcagcaccgagcttatttaccgc

SEQ ID NO: 72126 - DNA, 25 bp, Homo sapien
ctggcgcatctacttccggaaggaa

SEQ ID NO: 72127 - DNA, 25 bp, Homo sapien
gcgcgaccacatgatggatgccatc

SEQ ID NO: 72128 - DNA, 25 bp, Homo sapien
tgccatcgcccggtgtgagcagatg

SEQ ID NO: 72129 - DNA, 25 bp, Homo sapien
acgagagctcgctgagtgccaagtc

SEQ ID NO: 72130 - DNA, 25 bp, Homo sapien
tcgaagggaaaaccaacgagagctc

SEQ ID NO: 72131 - DNA, 25 bp, Homo sapien
tctgtggcaaaaggctcaagggccc

SEQ ID NO: 72132 - DNA, 25 bp, Homo sapien
cacgccctgtgcaacttgctctgtg

SEQ ID NO: 72133 - DNA, 25 bp, Homo sapien
ttcttcgtggctgagaagttccgcc

SEQ ID NO: 72134 - DNA, 25 bp, Homo sapien
gatcgccatagtgctggccatcttc

SEQ ID NO: 72135 - DNA, 25 bp, Homo sapien
caaggcagtgcgcatgatcgccata

SEQ ID NO: 72136 - DNA, 25 bp, Homo sapien
ggccatcttcctggtctgcttcgtg

SEQ ID NO: 72137 - DNA, 25 bp, Homo sapien
gacaaaagtcatcttccgggctgca

SEQ ID NO: 72138 - DNA, 25 bp, Homo sapien
ccgggctgcaacattaaccgtcatc

SEQ ID NO: 72139 - DNA, 25 bp, Homo sapien
cacagccatgtgctcgttagcgtca

SEQ ID NO: 72140 - DNA, 25 bp, Homo sapien
cgctaaccgctcatcccaggaaaaa

SEQ ID NO: 72141 - DNA, 25 bp, Homo sapien
gaggacctgccagaactgtcggaca

SEQ ID NO: 72142 - DNA, 25 bp, Homo sapien
ttctgtaacaggttcgtccgcctca

SEQ ID NO: 72143 - DNA, 25 bp, Homo sapien
tgtccgaggccgatctgattgttgt

SEQ ID NO: 72144 - DNA, 25 bp, Homo sapien
taacgcctgccgcaacccaaggagg

SEQ ID NO: 72145 - DNA, 25 bp, Homo sapien
accctgtcggcgacgttgctggtca

SEQ ID NO: 72146 - DNA, 25 bp, Homo sapien
acaagctgctcaatgccaggcaccg

SEQ ID NO: 72147 - DNA, 25 bp, Homo sapien
gcccttcatttagacaagctgctca

SEQ ID NO: 72148 - DNA, 25 bp, Homo sapien
acgagctcctggtgctgtccctcgg

SEQ ID NO: 72149 - DNA, 25 bp, Homo sapien
tctctcacgggcagcacacggacaa

SEQ ID NO: 72150 - DNA, 25 bp, Homo sapien
gcagcacacggacaagagctcggta

SEQ ID NO: 72151 - DNA, 25 bp, Homo sapien
cacggacaagagctcggtagtgtcg

SEQ ID NO: 72152 - DNA, 25 bp, Homo sapien
cgttgctggtcagcacgagctcctg

SEQ ID NO: 72153 - DNA, 25 bp, Homo sapien
tccaaagggcagcagagtcaactcc

SEQ ID NO: 72154 - DNA, 25 bp, Homo sapien
tgtcgccaacccagggcccatccga

SEQ ID NO: 72155 - DNA, 25 bp, Homo sapien
cacgttacgcgctgggatctccaaa

SEQ ID NO: 72156 - DNA, 25 bp, Homo sapien
tagaaaggatattgttcgcgccgcg

SEQ ID NO: 72157 - DNA, 25 bp, Homo sapien
gcgagctcacgttacgcgctgggat

SEQ ID NO: 72158 - DNA, 25 bp, Homo sapien
ccagacaccaagacgggacgggcgt

SEQ ID NO: 72159 - DNA, 25 bp, Homo sapien
gcagagtcaactccaaatagaaagg

SEQ ID NO: 72160 - DNA, 25 bp, Homo sapien
ttacgcgctgggatctccaaagggc

SEQ ID NO: 72161 - DNA, 25 bp, Homo sapien
tggctagacgaggttcacgtgggtt

SEQ ID NO: 72162 - DNA, 25 bp, Homo sapien
tagacgaggttcacgtgggtttgcc

SEQ ID NO: 72163 - DNA, 25 bp, Homo sapien
ctagacgaggttcacgtgggtttgc

SEQ ID NO: 72164 - DNA, 25 bp, Homo sapien
gcctgtggctagacgaggttcacgt

SEQ ID NO: 72165 - DNA, 25 bp, Homo sapien
agacgaggttcacgtgggtttgcct

SEQ ID NO: 72166 - DNA, 25 bp, Homo sapien
gctagacgaggttcacgtgggtttg

SEQ ID NO: 72167 - DNA, 25 bp, Homo sapien
ggcctgtggctagacgaggttcacg

SEQ ID NO: 72168 - DNA, 25 bp, Homo sapien
gacgaggttcacgtgggtttgcctg

SEQ ID NO: 72169 - DNA, 25 bp, Homo sapien
gtcagaaaaacaggtcgtcctcgcc

SEQ ID NO: 72170 - DNA, 25 bp, Homo sapien
gcgcctgcagcaggttcctcttctg

SEQ ID NO: 72171 - DNA, 25 bp, Homo sapien
cagcaggttcctcttctgggagcca

SEQ ID NO: 72172 - DNA, 25 bp, Homo sapien
tgggagccagcacgcagccagagct

SEQ ID NO: 72173 - DNA, 25 bp, Homo sapien
gacacctcgcccactgccgtgacta

SEQ ID NO: 72174 - DNA, 25 bp, Homo sapien
cccactgccgcagcatgccacgccc

SEQ ID NO: 72175 - DNA, 25 bp, Homo sapien
gctgggtcagaaaaacaggtcgtcc

SEQ ID NO: 72176 - DNA, 25 bp, Homo sapien
ttcctcttctgggagccagcacgca

SEQ ID NO: 72177 - DNA, 25 bp, Homo sapien
ctgcgagaatccgacgcgccagggc

SEQ ID NO: 72178 - DNA, 25 bp, Homo sapien
ctgcaggcgctcgcccagaggaaga

SEQ ID NO: 72179 - DNA, 25 bp, Homo sapien
aggcacgcaacctttgaaccttttg

SEQ ID NO: 72180 - DNA, 25 bp, Homo sapien
accttttgcccgtggttggtgtctg

SEQ ID NO: 72181 - DNA, 25 bp, Homo sapien
gagcagacggctgtcccatcttgca

SEQ ID NO: 72182 - DNA, 25 bp, Homo sapien
ctgtcccatcttgcagcgggcgggt

SEQ ID NO: 72183 - DNA, 25 bp, Homo sapien
gagctccaccttccgctgcaggcgc

SEQ ID NO: 72184 - DNA, 25 bp, Homo sapien
ccggcagctgcgagaatccgacgcg

SEQ ID NO: 72185 - DNA, 25 bp, Homo sapien
ccgcaaacgcgtgcaggagatggta

SEQ ID NO: 72186 - DNA, 25 bp, Homo sapien
gttgcgggccatcgccctaacttgg

SEQ ID NO: 72187 - DNA, 25 bp, Homo sapien
tcttcagtcgcaaagctgctttccc

SEQ ID NO: 72188 - DNA, 25 bp, Homo sapien
gtccctcttcagtcgcaaagctgct

SEQ ID NO: 72189 - DNA, 25 bp, Homo sapien
aggctaaagccgagaggcgtccctc

SEQ ID NO: 72190 - DNA, 25 bp, Homo sapien
ctagcccggagttcccaccgcggat

SEQ ID NO: 72191 - DNA, 25 bp, Homo sapien
cccaaccgcaaacgcgtgcaggaga

SEQ ID NO: 72192 - DNA, 25 bp, Homo sapien
gatctgggcactgactccctcccga

SEQ ID NO: 72193 - DNA, 25 bp, Homo sapien
actggacaagccgacgctacgaagg

SEQ ID NO: 72194 - DNA, 25 bp, Homo sapien
acaagccgacgctacgaaggcctga

SEQ ID NO: 72195 - DNA, 25 bp, Homo sapien
cgacgctacgaaggcctgagggaca

SEQ ID NO: 72196 - DNA, 25 bp, Homo sapien
gcctgagggacagcgaggcatcctg

SEQ ID NO: 72197 - DNA, 25 bp, Homo sapien
cctggctcagacgctcctgtgggag

SEQ ID NO: 72198 - DNA, 25 bp, Homo sapien
tcagtttccccaggacgcgtaagga

SEQ ID NO: 72199 - DNA, 25 bp, Homo sapien
ccacgtccaagagcccgaccgttcg

SEQ ID NO: 72200 - DNA, 25 bp, Homo sapien
acgggcggtgccaactggacaagcc

SEQ ID NO: 72201 - DNA, 25 bp, Homo sapien
ccgaagaccgaaccgcttcagcgga

SEQ ID NO: 72202 - DNA, 25 bp, Homo sapien
gaccacggtacttggggacaccaca

SEQ ID NO: 72203 - DNA, 25 bp, Homo sapien
agtgagccgcagcttttcctttctg

SEQ ID NO: 72204 - DNA, 25 bp, Homo sapien
ttctgccaccgccttgtccaagatg

SEQ ID NO: 72205 - DNA, 25 bp, Homo sapien
ctctacgcaccggtgttgctgctgc

SEQ ID NO: 72206 - DNA, 25 bp, Homo sapien
taacagcctgcgagtctaatccggg

SEQ ID NO: 72207 - DNA, 25 bp, Homo sapien
caagttcgcgctgctctggtcactg

SEQ ID NO: 72208 - DNA, 25 bp, Homo sapien
acaggcagcacctgcgaccacggta

SEQ ID NO: 72209 - DNA, 25 bp, Homo sapien
ccctcgctgaattccctgtgatcag

SEQ ID NO: 72210 - DNA, 25 bp, Homo sapien
tcgctgaattccctgtgatcagggg

SEQ ID NO: 72211 - DNA, 25 bp, Homo sapien
ttccctgtgatcagggggaaacgga

SEQ ID NO: 72212 - DNA, 25 bp, Homo sapien
cacttctcttcttgcggtaaaggtc

SEQ ID NO: 72213 - DNA, 25 bp, Homo sapien
tcttcttgcggtaaaggtcctcctc

SEQ ID NO: 72214 - DNA, 25 bp, Homo sapien
tcttgcggtaaaggtcctcctcgcc

SEQ ID NO: 72215 - DNA, 25 bp, Homo sapien
ctcaaattcacgtaaccggtggcca

SEQ ID NO: 72216 - DNA, 25 bp, Homo sapien
attcacgtaaccggtggccaaagcg

SEQ ID NO: 72217 - DNA, 25 bp, Homo sapien
cctctgtgaggttcgatctgcgcat

SEQ ID NO: 72218 - DNA, 25 bp, Homo sapien
tgagtatatttgtacggggccagta

SEQ ID NO: 72219 - DNA, 25 bp, Homo sapien
gctaacgtgtatgctctgaaaaaca

SEQ ID NO: 72220 - DNA, 25 bp, Homo sapien
cagagcgcttcctttgttccggagc

SEQ ID NO: 72221 - DNA, 25 bp, Homo sapien
accgaacgcacgctctggggtcatc

SEQ ID NO: 72222 - DNA, 25 bp, Homo sapien
ttagttctaaccatggccgcttttc

SEQ ID NO: 72223 - DNA, 25 bp, Homo sapien
accgctcccagtcagggccttagtt

SEQ ID NO: 72224 - DNA, 25 bp, Homo sapien
ctgcgtttcgcagtgctgacttttt

SEQ ID NO: 72225 - DNA, 25 bp, Homo sapien
cagccaagtctgtgcgccctggaac

SEQ ID NO: 72226 - DNA, 25 bp, Homo sapien
tctccagggttcaaaagcgactttc

SEQ ID NO: 72227 - DNA, 25 bp, Homo sapien
tttaggcagaaacactcgtaggtcc

SEQ ID NO: 72228 - DNA, 25 bp, Homo sapien
cgcattcgtcttgagccctctcgga

SEQ ID NO: 72229 - DNA, 25 bp, Homo sapien
aggcctgccttctacagttctcgca

SEQ ID NO: 72230 - DNA, 25 bp, Homo sapien
cagagggaggcctacaccgatcttt

SEQ ID NO: 72231 - DNA, 25 bp, Homo sapien
ctggccagaaccttccaaagtcgtg

SEQ ID NO: 72232 - DNA, 25 bp, Homo sapien
gcgtagactctccattcgcacctgg

SEQ ID NO: 72233 - DNA, 25 bp, Homo sapien
cctttctggacggaggaggtcagat

SEQ ID NO: 72234 - DNA, 25 bp, Homo sapien
aaagatgagctgtgaggcgtcctcc

SEQ ID NO: 72235 - DNA, 25 bp, Homo sapien
gtcagatgagatgcaggaacgcctg

SEQ ID NO: 72236 - DNA, 25 bp, Homo sapien
ggcaggtccctacgcctttctggac

SEQ ID NO: 72237 - DNA, 25 bp, Homo sapien
tgtgaggcgtcctcctctacgtcgc

SEQ ID NO: 72238 - DNA, 25 bp, Homo sapien
cagggcagccggctccgaaagtacc

SEQ ID NO: 72239 - DNA, 25 bp, Homo sapien
caggcctgcggcgaccacgcgaagt

SEQ ID NO: 72240 - DNA, 25 bp, Homo sapien
cgaagcgcgcataacgccaggcctg

SEQ ID NO: 72241 - DNA, 25 bp, Homo sapien
actccttctagcgagccgcggaaac

SEQ ID NO: 72242 - DNA, 25 bp, Homo sapien
agccgcggaaaccatagagatcagg

SEQ ID NO: 72243 - DNA, 25 bp, Homo sapien
ccatagagatcagggctcagccgga

SEQ ID NO: 72244 - DNA, 25 bp, Homo sapien
gctttattggctggtgctggcttta

SEQ ID NO: 72245 - DNA, 25 bp, Homo sapien
ccgagtttcaggcagctggaataaa

SEQ ID NO: 72246 - DNA, 25 bp, Homo sapien
ccctccgctgggacatggcctgagg

SEQ ID NO: 72247 - DNA, 25 bp, Homo sapien
tgccattcgtgggaccgagtttcag

SEQ ID NO: 72248 - DNA, 25 bp, Homo sapien
tcctcttgcttcatggagccatgcg

SEQ ID NO: 72249 - DNA, 25 bp, Homo sapien
gccgtaacgagcctcccgtctattg

SEQ ID NO: 72250 - DNA, 25 bp, Homo sapien
gaggcccaggaccaatccacagcga

SEQ ID NO: 72251 - DNA, 25 bp, Homo sapien
tccacagcgacctgcacgttcagag

SEQ ID NO: 72252 - DNA, 25 bp, Homo sapien
ccctcgaggctgagccaatggcaga

SEQ ID NO: 72253 - DNA, 25 bp, Homo sapien
gcccggatgtggagagtcactttaa

SEQ ID NO: 72254 - DNA, 25 bp, Homo sapien
gtcactttaaactgctccaggagcc

SEQ ID NO: 72255 - DNA, 25 bp, Homo sapien
aggagacgaggatcctctgcccttc

SEQ ID NO: 72256 - DNA, 25 bp, Homo sapien
aaccgccgtgaccagctcgcgaaag

SEQ ID NO: 72257 - DNA, 25 bp, Homo sapien
cggcagctgggcaattgctttgcga

SEQ ID NO: 72258 - DNA, 25 bp, Homo sapien
cgagttgccctcagtggtcttcttg

SEQ ID NO: 72259 - DNA, 25 bp, Homo sapien
actcagtttaccctctggtgtccta

SEQ ID NO: 72260 - DNA, 25 bp, Homo sapien
ctgtcacattgagcttccgcctcta

SEQ ID NO: 72261 - DNA, 25 bp, Homo sapien
ttcttggcaaggtatcgcttccgcg

SEQ ID NO: 72262 - DNA, 25 bp, Homo sapien
cggtatccggaagtcctccagcgtt

SEQ ID NO: 72263 - DNA, 25 bp, Homo sapien
gctgctaggtctcgactcggtatcc

SEQ ID NO: 72264 - DNA, 25 bp, Homo sapien
tccgcctctaccgtgactcagttta

SEQ ID NO: 72265 - DNA, 25 bp, Homo sapien
gcctgttcccaaactgcgatccatg

SEQ ID NO: 72266 - DNA, 25 bp, Homo sapien
ggagcctcaggtggggctactacaa

SEQ ID NO: 72267 - DNA, 25 bp, Homo sapien
ctactacaaagtgcgactggggcgg

SEQ ID NO: 72268 - DNA, 25 bp, Homo sapien
gccgagaagccacgcgggctcctgt

SEQ ID NO: 72269 - DNA, 25 bp, Homo sapien
cagcctggagccgacagcagggcca

SEQ ID NO: 72270 - DNA, 25 bp, Homo sapien
cccgggatctgtccgtgtgcccgga

SEQ ID NO: 72271 - DNA, 25 bp, Homo sapien
ggcgaggctaccgagtcaccacgac

SEQ ID NO: 72272 - DNA, 25 bp, Homo sapien
cagtaaaggctgttggttcctcccg

SEQ ID NO: 72273 - DNA, 25 bp, Homo sapien
ggcggagtcaccttgcgctctacct

SEQ ID NO: 72274 - DNA, 25 bp, Homo sapien
tcctcgccagcattgggttccctga

SEQ ID NO: 72275 - DNA, 25 bp, Homo sapien
ccactgccttaggaggccgttctcg

SEQ ID NO: 72276 - DNA, 25 bp, Homo sapien
tgcagaaaaagaagaccaatagacg

SEQ ID NO: 72277 - DNA, 25 bp, Homo sapien
aaagaagaccaatagacgatgtccc

SEQ ID NO: 72278 - DNA, 25 bp, Homo sapien
gccaggctccttcttcggcacagaa

SEQ ID NO: 72279 - DNA, 25 bp, Homo sapien
agagaggacaggtttcctccggtcg

SEQ ID NO: 72280 - DNA, 25 bp, Homo sapien
tcccttccaggcgagcttggggacg

SEQ ID NO: 72281 - DNA, 25 bp, Homo sapien
tgaactcctgtagcgtgcagcccga

SEQ ID NO: 72282 - DNA, 25 bp, Homo sapien
gtactgcgtcttgcgctggaactcg

SEQ ID NO: 72283 - DNA, 25 bp, Homo sapien
tgtacgggcagtccatgaactcctg

SEQ ID NO: 72284 - DNA, 25 bp, Homo sapien
ctgcatgtccaggtcgttgagctcc

SEQ ID NO: 72285 - DNA, 25 bp, Homo sapien
ttgtactgcatgaagggccggatga

SEQ ID NO: 72286 - DNA, 25 bp, Homo sapien
ccggatgaacttgaggttgaacgtc

SEQ ID NO: 72287 - DNA, 25 bp, Homo sapien
tgaacgtccgctcgaacaggtactg

SEQ ID NO: 72288 - DNA, 25 bp, Homo sapien
cgcaggttcttcttggcgctctcga

SEQ ID NO: 72289 - DNA, 25 bp, Homo sapien
ttagacgctagcctactgggctgca

SEQ ID NO: 72290 - DNA, 25 bp, Homo sapien
gggaggaaaggccttgaccttgcac

SEQ ID NO: 72291 - DNA, 25 bp, Homo sapien
ctgggaagtgattccgccctcaggg

SEQ ID NO: 72292 - DNA, 25 bp, Homo sapien
cgactgggaagtgattccgccctca

SEQ ID NO: 72293 - DNA, 25 bp, Homo sapien
gccagcgactgggaagtgattccgc

SEQ ID NO: 72294 - DNA, 25 bp, Homo sapien
cgctgaagttagacgctagcctact

SEQ ID NO: 72295 - DNA, 25 bp, Homo sapien
aaggccttgaccttgcacgctgggg

SEQ ID NO: 72296 - DNA, 25 bp, Homo sapien
cccgtggcgtctcttgccgtcgccg

SEQ ID NO: 72297 - DNA, 25 bp, Homo sapien
cgcttccctcgtcgttcgtccggcg

SEQ ID NO: 72298 - DNA, 25 bp, Homo sapien
gcggccgcccattgttgtttgccaa

SEQ ID NO: 72299 - DNA, 25 bp, Homo sapien
aggagggcagtcgtgtctgtcctca

SEQ ID NO: 72300 - DNA, 25 bp, Homo sapien
tcctcagagcctcccgtggggctgg

SEQ ID NO: 72301 - DNA, 25 bp, Homo sapien
cttttagaggggactccggctcgcg

SEQ ID NO: 72302 - DNA, 25 bp, Homo sapien
ctgcgcgccgtggacgccaccttct

SEQ ID NO: 72303 - DNA, 25 bp, Homo sapien
ttcccaggacccgagggacgcgctc

SEQ ID NO: 72304 - DNA, 25 bp, Homo sapien
tcctgcggttcggttcgaggaccgc

SEQ ID NO: 72305 - DNA, 25 bp, Homo sapien
cgcctgcttggcatccatccatttg

SEQ ID NO: 72306 - DNA, 25 bp, Homo sapien
ttcttctagatgaagcccgcaggcc

SEQ ID NO: 72307 - DNA, 25 bp, Homo sapien
cacgtggcagtgaaggttttaaaat

SEQ ID NO: 72308 - DNA, 25 bp, Homo sapien
acgttgcccaaaccacgtgttggtg

SEQ ID NO: 72309 - DNA, 25 bp, Homo sapien
ggcgagcatataagacggaccctgc

SEQ ID NO: 72310 - DNA, 25 bp, Homo sapien
gaggtggcctctctttacccaggga

SEQ ID NO: 72311 - DNA, 25 bp, Homo sapien
gccggtggctctgccttactcttct

SEQ ID NO: 72312 - DNA, 25 bp, Homo sapien
gcccaggacgctctgtcaccggagt

SEQ ID NO: 72313 - DNA, 25 bp, Homo sapien
cgttgccacccaggtaagcaggttg

SEQ ID NO: 72314 - DNA, 25 bp, Homo sapien
gtggggtcttgcaaactcagtagcc

SEQ ID NO: 72315 - DNA, 25 bp, Homo sapien
cgcgctgcactgtaagatccctttt

SEQ ID NO: 72316 - DNA, 25 bp, Homo sapien
agatcccttttctgcgaggcccgga

SEQ ID NO: 72317 - DNA, 25 bp, Homo sapien
tgctggccacggatggaatcacgtc

SEQ ID NO: 72318 - DNA, 25 bp, Homo sapien
agcaggttgcattacggcccgcaca

SEQ ID NO: 72319 - DNA, 25 bp, Homo sapien
aaactttccagtcagcggacgcgcg

SEQ ID NO: 72320 - DNA, 25 bp, Homo sapien
tgcacgtatgctgatggggaaaccg

SEQ ID NO: 72321 - DNA, 25 bp, Homo sapien
gatccactcactgtggcgggcggga

SEQ ID NO: 72322 - DNA, 25 bp, Homo sapien
ggaggaggctgggatccgctcactg

SEQ ID NO: 72323 - DNA, 25 bp, Homo sapien
gaggaggctgggatccgctcactgt

SEQ ID NO: 72324 - DNA, 25 bp, Homo sapien
ggatccgctcactgtggcgggagga

SEQ ID NO: 72325 - DNA, 25 bp, Homo sapien
ggaggctgggatccgctcactgtgg

SEQ ID NO: 72326 - DNA, 25 bp, Homo sapien
ctgggatccactcactgtggcgggc

SEQ ID NO: 72327 - DNA, 25 bp, Homo sapien
aggctgggatccactcactgtggcg

SEQ ID NO: 72328 - DNA, 25 bp, Homo sapien
ctgggatccgctcactgtggcggga

SEQ ID NO: 72329 - DNA, 25 bp, Homo sapien
gtgcccactaattacagtccctcgg

SEQ ID NO: 72330 - DNA, 25 bp, Homo sapien
tcaggccatcattgccggtgcgacg

SEQ ID NO: 72331 - DNA, 25 bp, Homo sapien
gtgcggccaggtccttgttctaatc

SEQ ID NO: 72332 - DNA, 25 bp, Homo sapien
gttctaatctgtccggtgcccacta

SEQ ID NO: 72333 - DNA, 25 bp, Homo sapien
ataaagaggcttggctcaccgctgc

SEQ ID NO: 72334 - DNA, 25 bp, Homo sapien
tgctgctgaatgaggaaagtgcttc

SEQ ID NO: 72335 - DNA, 25 bp, Homo sapien
agtgcttctcctgtgctgaaggata

SEQ ID NO: 72336 - DNA, 25 bp, Homo sapien
gcactgcttgcacgtcagccgcgtg

SEQ ID NO: 72337 - DNA, 25 bp, Homo sapien
gcggacctgcgctcaggtttccctg

SEQ ID NO: 72338 - DNA, 25 bp, Homo sapien
gccctgccatcgctacctgtgtata

SEQ ID NO: 72339 - DNA, 25 bp, Homo sapien
ggactacaggcagctgcgaccgtct

SEQ ID NO: 72340 - DNA, 25 bp, Homo sapien
ctctgttgccgttcactgtcccggg

SEQ ID NO: 72341 - DNA, 25 bp, Homo sapien
ccgcacgcggcagggcaataaagcc

SEQ ID NO: 72342 - DNA, 25 bp, Homo sapien
ccgaaggaatttgcgctggcagctc

SEQ ID NO: 72343 - DNA, 25 bp, Homo sapien
ataaagcctgcaaacgtgtgggagc

SEQ ID NO: 72344 - DNA, 25 bp, Homo sapien
agcgggtcctctgccgaaggaattt

SEQ ID NO: 72345 - DNA, 25 bp, Homo sapien
caacgttgctgtcgccgtgtggaca

SEQ ID NO: 72346 - DNA, 25 bp, Homo sapien
ccgtgtggacaggacaccgacatta

SEQ ID NO: 72347 - DNA, 25 bp, Homo sapien
accgacattagcgtggcattgctgg

SEQ ID NO: 72348 - DNA, 25 bp, Homo sapien
accaggggtgttcctgaggactcca

SEQ ID NO: 72349 - DNA, 25 bp, Homo sapien
gacagttgtgcaggcccatgttata

SEQ ID NO: 72350 - DNA, 25 bp, Homo sapien
ctctggctggccagtagccttcatc

SEQ ID NO: 72351 - DNA, 25 bp, Homo sapien
gtgagagctgccatttttctgggtg

SEQ ID NO: 72352 - DNA, 25 bp, Homo sapien
cccatgttatagacagagagactga

SEQ ID NO: 72353 - DNA, 25 bp, Homo sapien
gctaaccagggcgatgtgcgctcca

SEQ ID NO: 72354 - DNA, 25 bp, Homo sapien
tccaccagctagagcgcaaatcctt

SEQ ID NO: 72355 - DNA, 25 bp, Homo sapien
cgcgcacgcactctaactggaaagg

SEQ ID NO: 72356 - DNA, 25 bp, Homo sapien
cctggagatgcagccttaggtcctg

SEQ ID NO: 72357 - DNA, 25 bp, Homo sapien
gctgaatctgggagtaaacgcctta

SEQ ID NO: 72358 - DNA, 25 bp, Homo sapien
cgggttcctcctcactgaagtcatg

SEQ ID NO: 72359 - DNA, 25 bp, Homo sapien
tgcagtttgattccggacaagtccg

SEQ ID NO: 72360 - DNA, 25 bp, Homo sapien
ctcgggttttgcttttggtgccgca

SEQ ID NO: 72361 - DNA, 25 bp, Homo sapien
cagcgagaaaggatagtgtgacaaa

SEQ ID NO: 72362 - DNA, 25 bp, Homo sapien
tgaaaaccgcactcctctcctggga

SEQ ID NO: 72363 - DNA, 25 bp, Homo sapien
tgacagctcacagatcgcctctgcg

SEQ ID NO: 72364 - DNA, 25 bp, Homo sapien
gatagtgtgacaaatgcatcgcata

SEQ ID NO: 72365 - DNA, 25 bp, Homo sapien
ttcccgttgaataatgctgcagagg

SEQ ID NO: 72366 - DNA, 25 bp, Homo sapien
tgggcacaacctcgcctttggtcgt

SEQ ID NO: 72367 - DNA, 25 bp, Homo sapien
agctcgtggtgctctgggcacaacc

SEQ ID NO: 72368 - DNA, 25 bp, Homo sapien
tgcatcgcatatgacagctcacaga

SEQ ID NO: 72369 - DNA, 25 bp, Homo sapien
caggcgacttttctgcgtggctgct

SEQ ID NO: 72370 - DNA, 25 bp, Homo sapien
tgaggtcgcaggaaagtgagcttca

SEQ ID NO: 72371 - DNA, 25 bp, Homo sapien
tagcagccagggaccgtgccctgcg

SEQ ID NO: 72372 - DNA, 25 bp, Homo sapien
atcgcgctcctgtatgcctggtcac

SEQ ID NO: 72373 - DNA, 25 bp, Homo sapien
agtgagcttcagaggaagtggcctc

SEQ ID NO: 72374 - DNA, 25 bp, Homo sapien
cagaacccggactgtgcagcccagg

SEQ ID NO: 72375 - DNA, 25 bp, Homo sapien
tgttttaagactgggatcgcgctcc

SEQ ID NO: 72376 - DNA, 25 bp, Homo sapien
cccggtgacgccaggcgacttttct

SEQ ID NO: 72377 - DNA, 25 bp, Homo sapien
cgaactctttgtgaagtcggtgtga

SEQ ID NO: 72378 - DNA, 25 bp, Homo sapien
gacctctccgtgaagtcggtgtgaa

SEQ ID NO: 72379 - DNA, 25 bp, Homo sapien
tgctgagtcctgcacgtgcggaagc

SEQ ID NO: 72380 - DNA, 25 bp, Homo sapien
aaggaagcgacctctttgtgacgtc

SEQ ID NO: 72381 - DNA, 25 bp, Homo sapien
tctttgtgacgtcggcccttgccgg

SEQ ID NO: 72382 - DNA, 25 bp, Homo sapien
ctttgtgacgtctgcgacctctttg

SEQ ID NO: 72383 - DNA, 25 bp, Homo sapien
tgcgacctctttgtgacgtcggccc

SEQ ID NO: 72384 - DNA, 25 bp, Homo sapien
acgtgcggaagcgaactctttgtga

SEQ ID NO: 72385 - DNA, 25 bp, Homo sapien
cgcggcttgcgaccgcagccgccct

SEQ ID NO: 72386 - DNA, 25 bp, Homo sapien
aagcgcccacggcacagagcagggc

SEQ ID NO: 72387 - DNA, 25 bp, Homo sapien
gcgcccacggcacagagcagggcca

SEQ ID NO: 72388 - DNA, 25 bp, Homo sapien
ctggctgaaagcagcgcggcttgcg

SEQ ID NO: 72389 - DNA, 25 bp, Homo sapien
aagcagcgcggcttgcgaccgcagc

SEQ ID NO: 72390 - DNA, 25 bp, Homo sapien
tcctgcgcaccccatgggcagcgca

SEQ ID NO: 72391 - DNA, 25 bp, Homo sapien
cctgaggcactgacgtgccacccgg

SEQ ID NO: 72392 - DNA, 25 bp, Homo sapien
aaagcagcgcggcttgcgaccgcag

SEQ ID NO: 72393 - DNA, 25 bp, Homo sapien
tcccagggagtcgaaacccgcagca

SEQ ID NO: 72394 - DNA, 25 bp, Homo sapien
tgcagtccagatcctcgcagttctg

SEQ ID NO: 72395 - DNA, 25 bp, Homo sapien
tcttgctgctagtaaccggctttcc

SEQ ID NO: 72396 - DNA, 25 bp, Homo sapien
ctgggatctctttgccctgctcgga

SEQ ID NO: 72397 - DNA, 25 bp, Homo sapien
ccctcgagagcgatgccgatggatt

SEQ ID NO: 72398 - DNA, 25 bp, Homo sapien
cctcaggatccaggctcatttgctt

SEQ ID NO: 72399 - DNA, 25 bp, Homo sapien
cgctagcaagtttggcggctccaag

SEQ ID NO: 72400 - DNA, 25 bp, Homo sapien
gttcccgaacttgtaaggtgctgtg

SEQ ID NO: 72401 - DNA, 25 bp, Homo sapien
gagatcccggatacatctgcggttt

SEQ ID NO: 72402 - DNA, 25 bp, Homo sapien
agatcccggatacatctgcggtttg

SEQ ID NO: 72403 - DNA, 25 bp, Homo sapien
gatcccggatacatctgcggtttgg

SEQ ID NO: 72404 - DNA, 25 bp, Homo sapien
atcccggatacatctgcggtttggg

SEQ ID NO: 72405 - DNA, 25 bp, Homo sapien
tcccggatacatctgcggtttgggc

SEQ ID NO: 72406 - DNA, 25 bp, Homo sapien
cccggatacatctgcggtttgggct

SEQ ID NO: 72407 - DNA, 25 bp, Homo sapien
ccggatacatctgcggtttgggctc

SEQ ID NO: 72408 - DNA, 25 bp, Homo sapien
cggatacatctgcggtttgggctcc

SEQ ID NO: 72409 - DNA, 25 bp, Homo sapien
aaccgggcgagcacgcgagctaccg

SEQ ID NO: 72410 - DNA, 25 bp, Homo sapien
cgctgctaggagagcgccagccagc

SEQ ID NO: 72411 - DNA, 25 bp, Homo sapien
agcgctgctaggagagcgccagcca

SEQ ID NO: 72412 - DNA, 25 bp, Homo sapien
gcacgcgagctaccggagagcgggc

SEQ ID NO: 72413 - DNA, 25 bp, Homo sapien
gcgagcacgcgagctaccggagagc

SEQ ID NO: 72414 - DNA, 25 bp, Homo sapien
gctgctaggagagcgccagccagcg

SEQ ID NO: 72415 - DNA, 25 bp, Homo sapien
gaaccgggcgagcacgcgagctacc

SEQ ID NO: 72416 - DNA, 25 bp, Homo sapien
cgagcacgcgagctaccggagagcg

SEQ ID NO: 72417 - DNA, 25 bp, Homo sapien
ctccgaacgacggtgcctccggttg

SEQ ID NO: 72418 - DNA, 25 bp, Homo sapien
aacgacggtgcctccggttgacagc

SEQ ID NO: 72419 - DNA, 25 bp, Homo sapien
acggtgcctccggttgacagcaacc

SEQ ID NO: 72420 - DNA, 25 bp, Homo sapien
tccggttgacagcaacctgagcgga

SEQ ID NO: 72421 - DNA, 25 bp, Homo sapien
cccagcgcacgtcgcggctgccagc

SEQ ID NO: 72422 - DNA, 25 bp, Homo sapien
tgaccgccggcccagacgtgcccgc

SEQ ID NO: 72423 - DNA, 25 bp, Homo sapien
tgacagcaacctgagcggacccgcg

SEQ ID NO: 72424 - DNA, 25 bp, Homo sapien
ccctggcgtcccagcagcgccttcc

SEQ ID NO: 72425 - DNA, 25 bp, Homo sapien
actccattcggtccacagggctgga

SEQ ID NO: 72426 - DNA, 25 bp, Homo sapien
tccattcggtccacagggctggatg

SEQ ID NO: 72427 - DNA, 25 bp, Homo sapien
attcggtccacagggctggatggcc

SEQ ID NO: 72428 - DNA, 25 bp, Homo sapien
ggactccattcggtccacagggctg

SEQ ID NO: 72429 - DNA, 25 bp, Homo sapien
gccaagtgaatccatcctgccgtcc

SEQ ID NO: 72430 - DNA, 25 bp, Homo sapien
actcaccggtgtccgtcttcccagc

SEQ ID NO: 72431 - DNA, 25 bp, Homo sapien
gtctgcgtcctattacccgaacact

SEQ ID NO: 72432 - DNA, 25 bp, Homo sapien
tgcgtcctattacccgaacactgca

SEQ ID NO: 72433 - DNA, 25 bp, Homo sapien
cgatgcatgcaacgcgcctgcttaa

SEQ ID NO: 72434 - DNA, 25 bp, Homo sapien
gcaacgcgcctgcttaagtcttggc

SEQ ID NO: 72435 - DNA, 25 bp, Homo sapien
cgcgtgcggcgtgcttatctcaggt

SEQ ID NO: 72436 - DNA, 25 bp, Homo sapien
ttacaggccggccaaaccgttatgc

SEQ ID NO: 72437 - DNA, 25 bp, Homo sapien
tatctcaggtggcgtcagggcacgt

SEQ ID NO: 72438 - DNA, 25 bp, Homo sapien
gacactggccgatgcatgcaacgcg

SEQ ID NO: 72439 - DNA, 25 bp, Homo sapien
atgcaacgcgcctgcttaagtcttg

SEQ ID NO: 72440 - DNA, 25 bp, Homo sapien
ggccaaaccgttatgcgcgtgcggc

SEQ ID NO: 72441 - DNA, 25 bp, Homo sapien
cgcgctttgtagtagtaatgagggc

SEQ ID NO: 72442 - DNA, 25 bp, Homo sapien
ctttgtagtagtaatgagggcgcga

SEQ ID NO: 72443 - DNA, 25 bp, Homo sapien
tgtagtagtaatgagggcgcgaatc

SEQ ID NO: 72444 - DNA, 25 bp, Homo sapien
gcgcgaatcgcgctaggctctgcgc

SEQ ID NO: 72445 - DNA, 25 bp, Homo sapien
atcgcgctaggctctgcgcgcgcga

SEQ ID NO: 72446 - DNA, 25 bp, Homo sapien
gaggactggggctgcacatcctccc

SEQ ID NO: 72447 - DNA, 25 bp, Homo sapien
ggactggggctgcacatcctcccgg

SEQ ID NO: 72448 - DNA, 25 bp, Homo sapien
tagtagtaatgagggcgcgaatcgc

SEQ ID NO: 72449 - DNA, 25 bp, Homo sapien
gagtgcggcctgcatggccctcacg

SEQ ID NO: 72450 - DNA, 25 bp, Homo sapien
tgtcaccgtgagcatcctcgcgagt

SEQ ID NO: 72451 - DNA, 25 bp, Homo sapien
tagagggactgtcaccgtgagcatc

SEQ ID NO: 72452 - DNA, 25 bp, Homo sapien
caggatggcacgctccgccacaggt

SEQ ID NO: 72453 - DNA, 25 bp, Homo sapien
ttgttcttcggggtctgcttcagtg

SEQ ID NO: 72454 - DNA, 25 bp, Homo sapien
tgcctctcggcaaagttgttcttcg

SEQ ID NO: 72455 - DNA, 25 bp, Homo sapien
aggcgccgtttctgcattgcctgca

SEQ ID NO: 72456 - DNA, 25 bp, Homo sapien
tcaaagcaccgagcgatgcaggcgc

SEQ ID NO: 72457 - DNA, 25 bp, Homo sapien
tgcggcctcaaggactggacgccca

SEQ ID NO: 72458 - DNA, 25 bp, Homo sapien
tctgcgggtcgctctgcctgagctg

SEQ ID NO: 72459 - DNA, 25 bp, Homo sapien
ccaggttccgtttctgcgggtcgct

SEQ ID NO: 72460 - DNA, 25 bp, Homo sapien
ccagcatctccgagtgctgctgctg

SEQ ID NO: 72461 - DNA, 25 bp, Homo sapien
ctcctcatggagcttggccagcatc

SEQ ID NO: 72462 - DNA, 25 bp, Homo sapien
ttcagatgctcgatctcctcatgga

SEQ ID NO: 72463 - DNA, 25 bp, Homo sapien
cttgttttcccgcttcagatgctcg

SEQ ID NO: 72464 - DNA, 25 bp, Homo sapien
gctcatatcgccatcgccaggtact

SEQ ID NO: 72465 - DNA, 25 bp, Homo sapien
ccacggcgccgaaagtcgtcatcaa

SEQ ID NO: 72466 - DNA, 25 bp, Homo sapien
ccaaggtactttctccccagcaagg

SEQ ID NO: 72467 - DNA, 25 bp, Homo sapien
ggcgccgaaagtcgtcatcaagctg

SEQ ID NO: 72468 - DNA, 25 bp, Homo sapien
agtctatcagggaggcccagatcgc

SEQ ID NO: 72469 - DNA, 25 bp, Homo sapien
caatgcagtctatcagggaggccca

SEQ ID NO: 72470 - DNA, 25 bp, Homo sapien
aggcatttaccgagcgcccaatgta

SEQ ID NO: 72471 - DNA, 25 bp, Homo sapien
tcttgaaagaggcatttaccgagcg

SEQ ID NO: 72472 - DNA, 25 bp, Homo sapien
tcccggctcctagagcgccgctcag

SEQ ID NO: 72473 - DNA, 25 bp, Homo sapien
cggcggcccacagtcagattcagca

SEQ ID NO: 72474 - DNA, 25 bp, Homo sapien
agtggaaaggatcctggcgagcacc

SEQ ID NO: 72475 - DNA, 25 bp, Homo sapien
tgctcagcgcgaaaccgggactgcg

SEQ ID NO: 72476 - DNA, 25 bp, Homo sapien
cccagtggaaaaggacgtgcgaagc

SEQ ID NO: 72477 - DNA, 25 bp, Homo sapien
agatctccacgtctgtctcagctgc

SEQ ID NO: 72478 - DNA, 25 bp, Homo sapien
cgacccggatctcctggaagtgttg

SEQ ID NO: 72479 - DNA, 25 bp, Homo sapien
aggcaccagtgccattaacgagctg

SEQ ID NO: 72480 - DNA, 25 bp, Homo sapien
ctgtacagaatggagcaggccggcc

SEQ ID NO: 72481 - DNA, 25 bp, Homo sapien
ctgcaatgacctgcccacgcgcgcc

SEQ ID NO: 72482 - DNA, 25 bp, Homo sapien
cgtgtagtggggatgctctctgatt

SEQ ID NO: 72483 - DNA, 25 bp, Homo sapien
caacacgtgtagtggggatgctctc

SEQ ID NO: 72484 - DNA, 25 bp, Homo sapien
ttgctcaacacgtgtagtggggatg

SEQ ID NO: 72485 - DNA, 25 bp, Homo sapien
agcgcccaactgcaatgacctgccc

SEQ ID NO: 72486 - DNA, 25 bp, Homo sapien
tcaatggtccccgtccactaaaggc

SEQ ID NO: 72487 - DNA, 25 bp, Homo sapien
ggataccgtcaatggtccccgtcca

SEQ ID NO: 72488 - DNA, 25 bp, Homo sapien
ctcaacacgtgtagtggggatgctc

SEQ ID NO: 72489 - DNA, 25 bp, Homo sapien
tcatcaaaggctgcgcggttgctga

SEQ ID NO: 72490 - DNA, 25 bp, Homo sapien
tggaacagctactgcgctgcctctg

SEQ ID NO: 72491 - DNA, 25 bp, Homo sapien
agggccggatcccagttctgattgg

SEQ ID NO: 72492 - DNA, 25 bp, Homo sapien
ttaccatggcgaactccgctgcttc

SEQ ID NO: 72493 - DNA, 25 bp, Homo sapien
ggccaacttcgtctgcctgggcatc

SEQ ID NO: 72494 - DNA, 25 bp, Homo sapien
ggaaacgatcccgtgtcctcctgtc

SEQ ID NO: 72495 - DNA, 25 bp, Homo sapien
ttcatctaaaacaaaagccgccgtc

SEQ ID NO: 72496 - DNA, 25 bp, Homo sapien
ggaggcgacgccactatttgctctc

SEQ ID NO: 72497 - DNA, 25 bp, Homo sapien
ccgagaagcatataaggaagacgtc

SEQ ID NO: 72498 - DNA, 25 bp, Homo sapien
gtcactgggtaagataaaggcctca

SEQ ID NO: 72499 - DNA, 25 bp, Homo sapien
ataaaggcctcagacagtcatagtc

SEQ ID NO: 72500 - DNA, 25 bp, Homo sapien
tcatagtcttcctgtccggccgtgt

SEQ ID NO: 72501 - DNA, 25 bp, Homo sapien
ccgtgtcatagagtcctaggaggta

SEQ ID NO: 72502 - DNA, 25 bp, Homo sapien
ctggatttaccaccgagaagcatat

SEQ ID NO: 72503 - DNA, 25 bp, Homo sapien
ccgccggatcataagcatctttttt

SEQ ID NO: 72504 - DNA, 25 bp, Homo sapien
aagacgtcggtcactgggtaagata

SEQ ID NO: 72505 - DNA, 25 bp, Homo sapien
ccagctgcgggctggtgtcatggca

SEQ ID NO: 72506 - DNA, 25 bp, Homo sapien
tggcgttctcgcaggcgcatgccct

SEQ ID NO: 72507 - DNA, 25 bp, Homo sapien
tgagggcactctggccgcgtccggc

SEQ ID NO: 72508 - DNA, 25 bp, Homo sapien
agaagaggcgccgtcggcacccaaa

SEQ ID NO: 72509 - DNA, 25 bp, Homo sapien
aagaggcgccgtcggcacccaaagg

SEQ ID NO: 72510 - DNA, 25 bp, Homo sapien
gcagcctggcgttctcgcaggcgca

SEQ ID NO: 72511 - DNA, 25 bp, Homo sapien
gaccctgagggcactctggccgcgt

SEQ ID NO: 72512 - DNA, 25 bp, Homo sapien
agcctggcgttctcgcaggcgcatg

SEQ ID NO: 72513 - DNA, 25 bp, Homo sapien
gatttgtgggagctctttgcatagg

SEQ ID NO: 72514 - DNA, 25 bp, Homo sapien
ctgcccgcaccgagcacgcgaacgc

SEQ ID NO: 72515 - DNA, 25 bp, Homo sapien
tttattgttgatttgtgggagctct

SEQ ID NO: 72516 - DNA, 25 bp, Homo sapien
ctgacggtggacgagttcctagctt

SEQ ID NO: 72517 - DNA, 25 bp, Homo sapien
cgccctgcgtggtgttcgtggcgct

SEQ ID NO: 72518 - DNA, 25 bp, Homo sapien
tggacgagttcctagcttcgggctt

SEQ ID NO: 72519 - DNA, 25 bp, Homo sapien
acgagttcctagcttcgggctttga

SEQ ID NO: 72520 - DNA, 25 bp, Homo sapien
agttcctagcttcgggctttgactc

SEQ ID NO: 72521 - DNA, 25 bp, Homo sapien
tctgacagtcggctcccagctgtgt

SEQ ID NO: 72522 - DNA, 25 bp, Homo sapien
agggccaacaggtgcagaccctgca

SEQ ID NO: 72523 - DNA, 25 bp, Homo sapien
ccctatgaaacgcggctcagtcatg

SEQ ID NO: 72524 - DNA, 25 bp, Homo sapien
tcccatgacccggatctttaaacgc

SEQ ID NO: 72525 - DNA, 25 bp, Homo sapien
gaacttcagagtcccatgacccgga

SEQ ID NO: 72526 - DNA, 25 bp, Homo sapien
gactgccgtcctcacaacccgacta

SEQ ID NO: 72527 - DNA, 25 bp, Homo sapien
ccgtcgcagggccaacaggtgcaga

SEQ ID NO: 72528 - DNA, 25 bp, Homo sapien
agggatggcgcaccagaacttcaga

SEQ ID NO: 72529 - DNA, 25 bp, Homo sapien
aatgggagctcagggtctcctgaga

SEQ ID NO: 72530 - DNA, 25 bp, Homo sapien
gcgcaatgggagctcagggtctcct

SEQ ID NO: 72531 - DNA, 25 bp, Homo sapien
atcttgtgtgcaggctcgaggcacc

SEQ ID NO: 72532 - DNA, 25 bp, Homo sapien
tgtgcaggctcgaggcacctccact

SEQ ID NO: 72533 - DNA, 25 bp, Homo sapien
acctccactcgcttccacaggggaa

SEQ ID NO: 72534 - DNA, 25 bp, Homo sapien
cacaggggaacacggaggacacaag

SEQ ID NO: 72535 - DNA, 25 bp, Homo sapien
cacggaggacacaagaaacccttca

SEQ ID NO: 72536 - DNA, 25 bp, Homo sapien
agaaacccttcacacacacgattct

SEQ ID NO: 72537 - DNA, 25 bp, Homo sapien
ggtcccacgagagcagctgcgagaa

SEQ ID NO: 72538 - DNA, 25 bp, Homo sapien
tgttcatagtctgggacctccggtc

SEQ ID NO: 72539 - DNA, 25 bp, Homo sapien
ggggcacttggaccatttgttcata

SEQ ID NO: 72540 - DNA, 25 bp, Homo sapien
aacacctacgggacggctcgagatc

SEQ ID NO: 72541 - DNA, 25 bp, Homo sapien
cgatgaacggcgcaaacacctacgg

SEQ ID NO: 72542 - DNA, 25 bp, Homo sapien
gagcctcggccaagctcccgggaaa

SEQ ID NO: 72543 - DNA, 25 bp, Homo sapien
cgcagtgatgagattaccgcgtgga

SEQ ID NO: 72544 - DNA, 25 bp, Homo sapien
aaggccactagcaagcgcgcgatga

SEQ ID NO: 72545 - DNA, 25 bp, Homo sapien
tccttccggaagctgccgaatctta

SEQ ID NO: 72546 - DNA, 25 bp, Homo sapien
acccacgtggaagcggcactcaaga

SEQ ID NO: 72547 - DNA, 25 bp, Homo sapien
ttccttgtcaccctccgcagtttgg

SEQ ID NO: 72548 - DNA, 25 bp, Homo sapien
caaggcctctgggtcagcttcttta

SEQ ID NO: 72549 - DNA, 25 bp, Homo sapien
cttcagtcggtgtgcggtttttaca

SEQ ID NO: 72550 - DNA, 25 bp, Homo sapien
atggccaatcgccttgagatgtccc

SEQ ID NO: 72551 - DNA, 25 bp, Homo sapien
gaagcctgggcggacatatttatta

SEQ ID NO: 72552 - DNA, 25 bp, Homo sapien
gctgcaggcaccagtgaagcgtcta

SEQ ID NO: 72553 - DNA, 25 bp, Homo sapien
cacagctgtgagaacaaaacccggg

SEQ ID NO: 72554 - DNA, 25 bp, Homo sapien
ttacgggccggtctgtcgctgccac

SEQ ID NO: 72555 - DNA, 25 bp, Homo sapien
tcacgggcggaatggacacagctgt

SEQ ID NO: 72556 - DNA, 25 bp, Homo sapien
gagtcgaggggaaccgcaccaacac

SEQ ID NO: 72557 - DNA, 25 bp, Homo sapien
gcgcctggcgccagagagtctgctc

SEQ ID NO: 72558 - DNA, 25 bp, Homo sapien
gccaattcatcacctgtcagggatc

SEQ ID NO: 72559 - DNA, 25 bp, Homo sapien
gagctgcttctgattaccgcgaggg

SEQ ID NO: 72560 - DNA, 25 bp, Homo sapien
tgtcagggatcactcgcggggtcac

SEQ ID NO: 72561 - DNA, 25 bp, Homo sapien
atcccgatctgagggcgggtcccaa

SEQ ID NO: 72562 - DNA, 25 bp, Homo sapien
ttgctgtctccgtcttcactctctg

SEQ ID NO: 72563 - DNA, 25 bp, Homo sapien
tcccggaacaacctggctgcgggcg

SEQ ID NO: 72564 - DNA, 25 bp, Homo sapien
gctctgcctttctgtctcggtgtcc

SEQ ID NO: 72565 - DNA, 25 bp, Homo sapien
gtcctcgccggcgagttcagcgtga

SEQ ID NO: 72566 - DNA, 25 bp, Homo sapien
cgcttccattggctgccgaggcaag

SEQ ID NO: 72567 - DNA, 25 bp, Homo sapien
gcacttctctgtcgctcttgctgtc

SEQ ID NO: 72568 - DNA, 25 bp, Homo sapien
tacgcgggctcagaacacggtggct

SEQ ID NO: 72569 - DNA, 25 bp, Homo sapien
tgctgaccaaagtcctgccggatct

SEQ ID NO: 72570 - DNA, 25 bp, Homo sapien
gcaatacttgtcttggccgcgccca

SEQ ID NO: 72571 - DNA, 25 bp, Homo sapien
ggaaccatcctgcagtggtccgtca

SEQ ID NO: 72572 - DNA, 25 bp, Homo sapien
gagtcgaggcttgctccttctcagg

SEQ ID NO: 72573 - DNA, 25 bp, Homo sapien
aggcgccgctctacagcaaggtgac

SEQ ID NO: 72574 - DNA, 25 bp, Homo sapien
catggctgacacctacgcggtggtg

SEQ ID NO: 72575 - DNA, 25 bp, Homo sapien
cctgcctgcaggagcatctctgtgc

SEQ ID NO: 72576 - DNA, 25 bp, Homo sapien
ctcagggcatcatcctgctgtgatc

SEQ ID NO: 72577 - DNA, 25 bp, Homo sapien
gctgttgactactccgctgcctgaa

SEQ ID NO: 72578 - DNA, 25 bp, Homo sapien
cagcgtactccggacctctgtgtgc

SEQ ID NO: 72579 - DNA, 25 bp, Homo sapien
tttatgcaaacactgccaccgccag

SEQ ID NO: 72580 - DNA, 25 bp, Homo sapien
tttactcaccgatgctctcgtcttg

SEQ ID NO: 72581 - DNA, 25 bp, Homo sapien
cggtggctctcagaatttacgctcc

SEQ ID NO: 72582 - DNA, 25 bp, Homo sapien
tctcagctgctgttgactactccgc

SEQ ID NO: 72583 - DNA, 25 bp, Homo sapien
cgcgtcggttattcatctcagctgc

SEQ ID NO: 72584 - DNA, 25 bp, Homo sapien
ctcgtcttgtctgactttatgcaaa

SEQ ID NO: 72585 - DNA, 25 bp, Homo sapien
cccttacgtggcttatttcgtgtca

SEQ ID NO: 72586 - DNA, 25 bp, Homo sapien
tggaggagcccatactttctgaaca

SEQ ID NO: 72587 - DNA, 25 bp, Homo sapien
gaacagccgctttgatctacttaag

SEQ ID NO: 72588 - DNA, 25 bp, Homo sapien
gcactgccgtgttttcatagctatg

SEQ ID NO: 72589 - DNA, 25 bp, Homo sapien
gccggcagcactgtatcagtttcta

SEQ ID NO: 72590 - DNA, 25 bp, Homo sapien
tttcgtgtcaattctagggaggttc

SEQ ID NO: 72591 - DNA, 25 bp, Homo sapien
ggccggcacctggacatgaatccca

SEQ ID NO: 72592 - DNA, 25 bp, Homo sapien
tggcccagctatatcataggacata

SEQ ID NO: 72593 - DNA, 25 bp, Homo sapien
ctgcgcagcacacaagtgacaagcc

SEQ ID NO: 72594 - DNA, 25 bp, Homo sapien
gccagacctacagcaagaattctcc

SEQ ID NO: 72595 - DNA, 25 bp, Homo sapien
acacaagtgacaagcccgaccactg

SEQ ID NO: 72596 - DNA, 25 bp, Homo sapien
ggcacatctgcgcagcacacaagtg

SEQ ID NO: 72597 - DNA, 25 bp, Homo sapien
ggctacggccagacctacagcaaga

SEQ ID NO: 72598 - DNA, 25 bp, Homo sapien
acccagcccggccttcatgaggcgc

SEQ ID NO: 72599 - DNA, 25 bp, Homo sapien
tggccctggtttgggacacccagcc

SEQ ID NO: 72600 - DNA, 25 bp, Homo sapien
acggccagacctacagcaagaattc

SEQ ID NO: 72601 - DNA, 25 bp, Homo sapien
ccgcacgcggttgcgccttcattgc

SEQ ID NO: 72602 - DNA, 25 bp, Homo sapien
cgggccaccgcattgatgcaggtcc

SEQ ID NO: 72603 - DNA, 25 bp, Homo sapien
ggtaagaggccctgtgattcggtcc

SEQ ID NO: 72604 - DNA, 25 bp, Homo sapien
cctgaccgctgtggtaagaggccct

SEQ ID NO: 72605 - DNA, 25 bp, Homo sapien
tccagacgcctgaccgctgtggtaa

SEQ ID NO: 72606 - DNA, 25 bp, Homo sapien
acctctgcaggtgcatcttcggggc

SEQ ID NO: 72607 - DNA, 25 bp, Homo sapien
tcttctcagtgaatgcggcgccctg

SEQ ID NO: 72608 - DNA, 25 bp, Homo sapien
attgatgcaggtccccgtcttctca

SEQ ID NO: 72609 - DNA, 25 bp, Homo sapien
aacgagagacagtccgcgcacaatc

SEQ ID NO: 72610 - DNA, 25 bp, Homo sapien
aacgcctgcgtccatcaggatgctg

SEQ ID NO: 72611 - DNA, 25 bp, Homo sapien
gcacaatcccgtctgcagtagcatt

SEQ ID NO: 72612 - DNA, 25 bp, Homo sapien
cggcccagtgttctcccagactgaa

SEQ ID NO: 72613 - DNA, 25 bp, Homo sapien
tgcctgctacagaagggatgtactg

SEQ ID NO: 72614 - DNA, 25 bp, Homo sapien
atgccgtttgtgatggcgcagaagc

SEQ ID NO: 72615 - DNA, 25 bp, Homo sapien
ttttcccaggcctcaatgccgtttg

SEQ ID NO: 72616 - DNA, 25 bp, Homo sapien
actgtagaggcctgagatccaaccc

SEQ ID NO: 72617 - DNA, 25 bp, Homo sapien
cgcgcagtggagcagtacatccctt

SEQ ID NO: 72618 - DNA, 25 bp, Homo sapien
gcgagatccagtcccagcatcctga

SEQ ID NO: 72619 - DNA, 25 bp, Homo sapien
catcctgatggacgcaggcgttttc

SEQ ID NO: 72620 - DNA, 25 bp, Homo sapien
gatctcaggcctctacagtccagcg

SEQ ID NO: 72621 - DNA, 25 bp, Homo sapien
tgctactgcagacgggattgtgcgc

SEQ ID NO: 72622 - DNA, 25 bp, Homo sapien
ttcgcttcagtctgggagaacactg

SEQ ID NO: 72623 - DNA, 25 bp, Homo sapien
ttctgcgccatcacaaacggcattg

SEQ ID NO: 72624 - DNA, 25 bp, Homo sapien
gcggactgtctctcgttcgcttcag

SEQ ID NO: 72625 - DNA, 25 bp, Homo sapien
agggcgccgcattcactgagaagac

SEQ ID NO: 72626 - DNA, 25 bp, Homo sapien
gcaatgaaggcgcaaccgcgtgcgg

SEQ ID NO: 72627 - DNA, 25 bp, Homo sapien
gggaccgaatcacagggcctcttac

SEQ ID NO: 72628 - DNA, 25 bp, Homo sapien
tcacagggcctcttaccacagcggt

SEQ ID NO: 72629 - DNA, 25 bp, Homo sapien
agggcctcttaccacagcggtcagg

SEQ ID NO: 72630 - DNA, 25 bp, Homo sapien
ttaccacagcggtcaggcgtctgga

SEQ ID NO: 72631 - DNA, 25 bp, Homo sapien
agaagacggggacctgcatcaatgc

SEQ ID NO: 72632 - DNA, 25 bp, Homo sapien
acctgcatcaatgcggtggcccgcg

SEQ ID NO: 72633 - DNA, 25 bp, Homo sapien
ttcttgctgtaggtctggccgtagc

SEQ ID NO: 72634 - DNA, 25 bp, Homo sapien
tcacttgtgtgctgcgcagatgtgc

SEQ ID NO: 72635 - DNA, 25 bp, Homo sapien
gggcttgtcacttgtgtgctgcgca

SEQ ID NO: 72636 - DNA, 25 bp, Homo sapien
cagtggtcgggcttgtcacttgtgt

SEQ ID NO: 72637 - DNA, 25 bp, Homo sapien
cttccatcccagtggcagtggtcgg

SEQ ID NO: 72638 - DNA, 25 bp, Homo sapien
agctgcttccatcccagtggcagtg

SEQ ID NO: 72639 - DNA, 25 bp, Homo sapien
agcgttagcttgtctgagtgagcac

SEQ ID NO: 72640 - DNA, 25 bp, Homo sapien
gagaattcttgctgtaggtctggcc

SEQ ID NO: 72641 - DNA, 25 bp, Homo sapien
tctgggctgtcactaggagatccgt

SEQ ID NO: 72642 - DNA, 25 bp, Homo sapien
atccgtagcccagacggtgactttc

SEQ ID NO: 72643 - DNA, 25 bp, Homo sapien
gaagcgcccgctcgtcttgatagac

SEQ ID NO: 72644 - DNA, 25 bp, Homo sapien
ctcgcggtcagcatgaaagccttca

SEQ ID NO: 72645 - DNA, 25 bp, Homo sapien
ccttcagtcccgtgaggtccgttag

SEQ ID NO: 72646 - DNA, 25 bp, Homo sapien
ggacgacccgatgagcctgctatac

SEQ ID NO: 72647 - DNA, 25 bp, Homo sapien
tagacgtgccaccttccgccaatgg

SEQ ID NO: 72648 - DNA, 25 bp, Homo sapien
ttgtcagcctgcatcaccagagacc

SEQ ID NO: 72649 - DNA, 25 bp, Homo sapien
tgcagtgttcgggtaataggacgca

SEQ ID NO: 72650 - DNA, 25 bp, Homo sapien
gctgggaagacggacaccggtgagt

SEQ ID NO: 72651 - DNA, 25 bp, Homo sapien
ggacggcaggatggattcacttggc

SEQ ID NO: 72652 - DNA, 25 bp, Homo sapien
cagccctgtggaccgaatggagtcc

SEQ ID NO: 72653 - DNA, 25 bp, Homo sapien
tccagccctgtggaccgaatggagt

SEQ ID NO: 72654 - DNA, 25 bp, Homo sapien
catccagccctgtggaccgaatgga

SEQ ID NO: 72655 - DNA, 25 bp, Homo sapien
agtgttcgggtaataggacgcagac

SEQ ID NO: 72656 - DNA, 25 bp, Homo sapien
gccatccagccctgtggaccgaatg

SEQ ID NO: 72657 - DNA, 25 bp, Homo sapien
cgatgccgaggaaacagtgaccctg

SEQ ID NO: 72658 - DNA, 25 bp, Homo sapien
gagttctctccaggcggcacgatgc

SEQ ID NO: 72659 - DNA, 25 bp, Homo sapien
gcaggttccctggtcagcgtcccat

SEQ ID NO: 72660 - DNA, 25 bp, Homo sapien
tgacgccttagagcagtccctgttc

SEQ ID NO: 72661 - DNA, 25 bp, Homo sapien
ttgattaacgccgtcacagtgacgc

SEQ ID NO: 72662 - DNA, 25 bp, Homo sapien
ctccgcacactgcatttgattaatg

SEQ ID NO: 72663 - DNA, 25 bp, Homo sapien
ctccactacgggatctgcgggaaga

SEQ ID NO: 72664 - DNA, 25 bp, Homo sapien
acacggggaagacgaactccgcaca

SEQ ID NO: 72665 - DNA, 25 bp, Homo sapien
tgaaaaatgggaatgggtcagcatc

SEQ ID NO: 72666 - DNA, 25 bp, Homo sapien
gtcatcaaggaggtgggcaacgtct

SEQ ID NO: 72667 - DNA, 25 bp, Homo sapien
tgtggacatggtcaacaacagcacc

SEQ ID NO: 72668 - DNA, 25 bp, Homo sapien
gcatctccttcggtatccgctgcaa

SEQ ID NO: 72669 - DNA, 25 bp, Homo sapien
acaccggggagacaatcgagctgac

SEQ ID NO: 72670 - DNA, 25 bp, Homo sapien
tacctaagccgccaagtccttgact

SEQ ID NO: 72671 - DNA, 25 bp, Homo sapien
ggccaagggcacctgcagaatgtga

SEQ ID NO: 72672 - DNA, 25 bp, Homo sapien
tgctggagaagaagcaagacaccgg

SEQ ID NO: 72673 - DNA, 25 bp, Homo sapien
cgtaatcggccaaaaaggcgcaggc

SEQ ID NO: 72674 - DNA, 25 bp, Homo sapien
taatcggccaaaaaggcgcaggcgc

SEQ ID NO: 72675 - DNA, 25 bp, Homo sapien
ctggcagctgcgtaacaggctctca

SEQ ID NO: 72676 - DNA, 25 bp, Homo sapien
tgctcctggcagctgcgtaacaggc

SEQ ID NO: 72677 - DNA, 25 bp, Homo sapien
tctgggcgtggtctttggctgtgat

SEQ ID NO: 72678 - DNA, 25 bp, Homo sapien
gtaacaggctctcagaggaggacgc

SEQ ID NO: 72679 - DNA, 25 bp, Homo sapien
tcccagggctgcgatgatggtggtc

SEQ ID NO: 72680 - DNA, 25 bp, Homo sapien
agctgcgtaacaggctctcagagga

SEQ ID NO: 72681 - DNA, 25 bp, Homo sapien
atttggtgcattctctggcgcgatg

SEQ ID NO: 72682 - DNA, 25 bp, Homo sapien
acggggcgatacgaacagacaaagc

SEQ ID NO: 72683 - DNA, 25 bp, Homo sapien
cccagaaacagagacggggcgatac

SEQ ID NO: 72684 - DNA, 25 bp, Homo sapien
cgagcccttccgagagtgctgcggt

SEQ ID NO: 72685 - DNA, 25 bp, Homo sapien
gaaccctgggtaagactcgtgacga

SEQ ID NO: 72686 - DNA, 25 bp, Homo sapien
caggaagcagggtcgacaccctcca

SEQ ID NO: 72687 - DNA, 25 bp, Homo sapien
taagactcgtgacgaggctccgggt

SEQ ID NO: 72688 - DNA, 25 bp, Homo sapien
caaggattggggaatttggtgcatt

SEQ ID NO: 72689 - DNA, 25 bp, Homo sapien
aggcgccttcattcctcaggccgag

SEQ ID NO: 72690 - DNA, 25 bp, Homo sapien
acgggtcactgctgcctgctaaagc

SEQ ID NO: 72691 - DNA, 25 bp, Homo sapien
cacaggactggcttcgcaccactgg

SEQ ID NO: 72692 - DNA, 25 bp, Homo sapien
gcgagatccgctttcctagaggctg

SEQ ID NO: 72693 - DNA, 25 bp, Homo sapien
tgggccgtttcatctcaccgagagc

SEQ ID NO: 72694 - DNA, 25 bp, Homo sapien
cggggcctgacttcttagcgcagtc

SEQ ID NO: 72695 - DNA, 25 bp, Homo sapien
tgctaaagcgacacaaggcgccttc

SEQ ID NO: 72696 - DNA, 25 bp, Homo sapien
gaacgccttggctctggccgacagt

SEQ ID NO: 72697 - DNA, 25 bp, Homo sapien
gggacccactcagttgggacgcctc

SEQ ID NO: 72698 - DNA, 25 bp, Homo sapien
tcacgtgcctccagtggccaggttt

SEQ ID NO: 72699 - DNA, 25 bp, Homo sapien
gtcgtgcacttcctccggagcttct

SEQ ID NO: 72700 - DNA, 25 bp, Homo sapien
ccaactttccgacgtgcagaccgga

SEQ ID NO: 72701 - DNA, 25 bp, Homo sapien
cgcttggcgcagtaccagctgtttt

SEQ ID NO: 72702 - DNA, 25 bp, Homo sapien
gcagtaccagctgttttgggaagga

SEQ ID NO: 72703 - DNA, 25 bp, Homo sapien
agaagtggttgctgttgttattccc

SEQ ID NO: 72704 - DNA, 25 bp, Homo sapien
ccatccgggacccactcagttggga

SEQ ID NO: 72705 - DNA, 25 bp, Homo sapien
ttttccaaggtgacctccttcagga

SEQ ID NO: 72706 - DNA, 25 bp, Homo sapien
gcctggcccgagtttgtcccgcagg

SEQ ID NO: 72707 - DNA, 25 bp, Homo sapien
ccgcctctgcaccacggggacgcca

SEQ ID NO: 72708 - DNA, 25 bp, Homo sapien
cccagggagaatccgcccgctgcgg

SEQ ID NO: 72709 - DNA, 25 bp, Homo sapien
aggcccttggccactgagagcccag

SEQ ID NO: 72710 - DNA, 25 bp, Homo sapien
acctccttcaggaagggcaggccct

SEQ ID NO: 72711 - DNA, 25 bp, Homo sapien
caaggtgacctccttcaggaagggc

SEQ ID NO: 72712 - DNA, 25 bp, Homo sapien
gcccgagtttgtcccgcaggctgca

SEQ ID NO: 72713 - DNA, 25 bp, Homo sapien
tccttgcggtgaaaaagtgggcgcc

SEQ ID NO: 72714 - DNA, 25 bp, Homo sapien
aaccgtctgagctggaatccttgcg

SEQ ID NO: 72715 - DNA, 25 bp, Homo sapien
acgagtggcgatctcggcactagca

SEQ ID NO: 72716 - DNA, 25 bp, Homo sapien
gtcgcctcctaaggatggccctgtc

SEQ ID NO: 72717 - DNA, 25 bp, Homo sapien
atggccctgtcctaacacacgcgtg

SEQ ID NO: 72718 - DNA, 25 bp, Homo sapien
ctaacacacgcgtgcggacacaggt

SEQ ID NO: 72719 - DNA, 25 bp, Homo sapien
tcggctgagagcctccttaacggag

SEQ ID NO: 72720 - DNA, 25 bp, Homo sapien
cccagcgagtcaagcgggcagacga

SEQ ID NO: 72721 - DNA, 25 bp, Homo sapien
cgtctctgcgagtaaccgaggatgc

SEQ ID NO: 72722 - DNA, 25 bp, Homo sapien
cgaccctttccaaggaggtgccaag

SEQ ID NO: 72723 - DNA, 25 bp, Homo sapien
ctggttctcatcaacgtcgtactga

SEQ ID NO: 72724 - DNA, 25 bp, Homo sapien
caacgtcgtactgatcttcctgctg

SEQ ID NO: 72725 - DNA, 25 bp, Homo sapien
catgtgctcactaccagggcctggt

SEQ ID NO: 72726 - DNA, 25 bp, Homo sapien
gcacgtgtgtcacagggtccttctg

SEQ ID NO: 72727 - DNA, 25 bp, Homo sapien
ctgtatctctgaaacgaggaggtcc

SEQ ID NO: 72728 - DNA, 25 bp, Homo sapien
tgccaggcgttttggcctctgtatc

SEQ ID NO: 72729 - DNA, 25 bp, Homo sapien
cagctgcgtaccatcttcgggaaca

SEQ ID NO: 72730 - DNA, 25 bp, Homo sapien
ccgcaagcgcgcagacatgttcagc

SEQ ID NO: 72731 - DNA, 25 bp, Homo sapien
acatcaagcacctgcgcgacatctg

SEQ ID NO: 72732 - DNA, 25 bp, Homo sapien
gcactgagcgggactacatcaagca

SEQ ID NO: 72733 - DNA, 25 bp, Homo sapien
tgcggaccaacgtcatcaacgagat

SEQ ID NO: 72734 - DNA, 25 bp, Homo sapien
ggagtcgtcattcctcggtccagga

SEQ ID NO: 72735 - DNA, 25 bp, Homo sapien
ttcgggaacatcgaggacatctacc

SEQ ID NO: 72736 - DNA, 25 bp, Homo sapien
attcggatcacactgacggcggctg

SEQ ID NO: 72737 - DNA, 25 bp, Homo sapien
gtgccgaggagacctgctacgataa

SEQ ID NO: 72738 - DNA, 25 bp, Homo sapien
agaaacctttgtgtgtgcccagacg

SEQ ID NO: 72739 - DNA, 25 bp, Homo sapien
ccgcgccgcagaaacctttgtgtgt

SEQ ID NO: 72740 - DNA, 25 bp, Homo sapien
ggcgacctgggcctcagtgaccagc

SEQ ID NO: 72741 - DNA, 25 bp, Homo sapien
tattttgagatagtcccgcgccgca

SEQ ID NO: 72742 - DNA, 25 bp, Homo sapien
ctgctacgataagaggctgaccctc

SEQ ID NO: 72743 - DNA, 25 bp, Homo sapien
ggaccgcacctgcacgcgtacgtgt

SEQ ID NO: 72744 - DNA, 25 bp, Homo sapien
acgctcgcattcctgacggctgtga

SEQ ID NO: 72745 - DNA, 25 bp, Homo sapien
ttgatcatcatacccggaggaagcc

SEQ ID NO: 72746 - DNA, 25 bp, Homo sapien
gcggtcgtgtggttgatcatcatac

SEQ ID NO: 72747 - DNA, 25 bp, Homo sapien
actggtctgcgttttcagtcccggg

SEQ ID NO: 72748 - DNA, 25 bp, Homo sapien
tggccacgtgctcaagactggtctg

SEQ ID NO: 72749 - DNA, 25 bp, Homo sapien
ggcagaagcctttcccagccaaaga

SEQ ID NO: 72750 - DNA, 25 bp, Homo sapien
tttcgatcgccctcagccttgactg

SEQ ID NO: 72751 - DNA, 25 bp, Homo sapien
cgcattttcccggacttttcgatcg

SEQ ID NO: 72752 - DNA, 25 bp, Homo sapien
cactgggaacccgaggagcaatccg

SEQ ID NO: 72753 - DNA, 25 bp, Homo sapien
atcctactgcgggtgcgtaaagaaa

SEQ ID NO: 72754 - DNA, 25 bp, Homo sapien
tggaaattaaattcccggcagactg

SEQ ID NO: 72755 - DNA, 25 bp, Homo sapien
ttacttgcagcttcgcgccgggaag

SEQ ID NO: 72756 - DNA, 25 bp, Homo sapien
attcccggcagactgggttgcgatc

SEQ ID NO: 72757 - DNA, 25 bp, Homo sapien
actgggttgcgatctcacatcttga

SEQ ID NO: 72758 - DNA, 25 bp, Homo sapien
tctcacatcttgatcctactgcggg

SEQ ID NO: 72759 - DNA, 25 bp, Homo sapien
atcttgatcctactgcgggtgcgta

SEQ ID NO: 72760 - DNA, 25 bp, Homo sapien
catcttacttgcagcttcgcgccgg

SEQ ID NO: 72761 - DNA, 25 bp, Homo sapien
ccacatgtctgactgccgggacctg

SEQ ID NO: 72762 - DNA, 25 bp, Homo sapien
ggtgagtgtccctgtttagtccgga

SEQ ID NO: 72763 - DNA, 25 bp, Homo sapien
tctccacgctggttcgcaggtgagt

SEQ ID NO: 72764 - DNA, 25 bp, Homo sapien
tgtttagtccggacgaccctagctc

SEQ ID NO: 72765 - DNA, 25 bp, Homo sapien
agattctcctctagagctgcccagc

SEQ ID NO: 72766 - DNA, 25 bp, Homo sapien
ccctaattttccctgaggctcctgg

SEQ ID NO: 72767 - DNA, 25 bp, Homo sapien
tagagcagcccattcgagagccctc

SEQ ID NO: 72768 - DNA, 25 bp, Homo sapien
cgtcttggtgttctccacgctggtt

SEQ ID NO: 72769 - DNA, 25 bp, Homo sapien
gaacctgggtgcgtagccgccgcca

SEQ ID NO: 72770 - DNA, 25 bp, Homo sapien
aacctgggtgcgtagccgccgccat

SEQ ID NO: 72771 - DNA, 25 bp, Homo sapien
acctgggtgcgtagccgccgccatc

SEQ ID NO: 72772 - DNA, 25 bp, Homo sapien
cctgggtgcgtagccgccgccatct

SEQ ID NO: 72773 - DNA, 25 bp, Homo sapien
ctgggtgcgtagccgccgccatctg

SEQ ID NO: 72774 - DNA, 25 bp, Homo sapien
ccgctctccggtagctcgcgtgctc

SEQ ID NO: 72775 - DNA, 25 bp, Homo sapien
cggtagctcgcgtgctcgcccggtt

SEQ ID NO: 72776 - DNA, 25 bp, Homo sapien
gctggctggcgctctcctagcagcg

SEQ ID NO: 72777 - DNA, 25 bp, Homo sapien
tggctggcgctctcctagcagcgct

SEQ ID NO: 72778 - DNA, 25 bp, Homo sapien
ggctggcgctctcctagcagcgctc

SEQ ID NO: 72779 - DNA, 25 bp, Homo sapien
ggtagctcgcgtgctcgcccggttc

SEQ ID NO: 72780 - DNA, 25 bp, Homo sapien
gcccgctctccggtagctcgcgtgc

SEQ ID NO: 72781 - DNA, 25 bp, Homo sapien
agctcgcgtgctcgcccggttccgc

SEQ ID NO: 72782 - DNA, 25 bp, Homo sapien
ctctctgcgcccctgcaagggccgg

SEQ ID NO: 72783 - DNA, 25 bp, Homo sapien
ggtgtgctttggcttcccaaggcta

SEQ ID NO: 72784 - DNA, 25 bp, Homo sapien
gtgtgctttggcttcccaaggctag

SEQ ID NO: 72785 - DNA, 25 bp, Homo sapien
tgtgctttggcttcccaaggctagg

SEQ ID NO: 72786 - DNA, 25 bp, Homo sapien
gtgctttggcttcccaaggctaggg

SEQ ID NO: 72787 - DNA, 25 bp, Homo sapien
gctttggcttcccaaggctagggcc

SEQ ID NO: 72788 - DNA, 25 bp, Homo sapien
ggatctctcacgcgcggcgcttcgg

SEQ ID NO: 72789 - DNA, 25 bp, Homo sapien
caggggtgtgctttggcttcccaag

SEQ ID NO: 72790 - DNA, 25 bp, Homo sapien
cgggtagctgacagcctctaggccc

SEQ ID NO: 72791 - DNA, 25 bp, Homo sapien
aggatctccgatgtccctgctccgc

SEQ ID NO: 72792 - DNA, 25 bp, Homo sapien
gatctccgatgtccctgctccgcgg

SEQ ID NO: 72793 - DNA, 25 bp, Homo sapien
tctccgatgtccctgctccgcgggc

SEQ ID NO: 72794 - DNA, 25 bp, Homo sapien
cgatgtccctgctccgcgggcgccc

SEQ ID NO: 72795 - DNA, 25 bp, Homo sapien
gcgggtagctgacagcctctaggcc

SEQ ID NO: 72796 - DNA, 25 bp, Homo sapien
gggtagctgacagcctctaggcccg

SEQ ID NO: 72797 - DNA, 25 bp, Homo sapien
ctgagccgaagctcggcggggctga

SEQ ID NO: 72798 - DNA, 25 bp, Homo sapien
tctccaggggacaccgctgagagcg

SEQ ID NO: 72799 - DNA, 25 bp, Homo sapien
ggacaccgctgagagcggactgtca

SEQ ID NO: 72800 - DNA, 25 bp, Homo sapien
acaccgctgagagcggactgtcaga

SEQ ID NO: 72801 - DNA, 25 bp, Homo sapien
caccgctgagagcggactgtcagag

SEQ ID NO: 72802 - DNA, 25 bp, Homo sapien
accgctgagagcggactgtcagagc

SEQ ID NO: 72803 - DNA, 25 bp, Homo sapien
ccgctgagagcggactgtcagagcg

SEQ ID NO: 72804 - DNA, 25 bp, Homo sapien
cgctgagagcggactgtcagagcgt

SEQ ID NO: 72805 - DNA, 25 bp, Homo sapien
gacaccgctgagagcggactgtcag

SEQ ID NO: 72806 - DNA, 25 bp, Homo sapien
gttcccgtggatcccgttgctcagg

SEQ ID NO: 72807 - DNA, 25 bp, Homo sapien
gactgtcagagcgtccagaaggctc

SEQ ID NO: 72808 - DNA, 25 bp, Homo sapien
cagagcgtccagaaggctcgtctta

SEQ ID NO: 72809 - DNA, 25 bp, Homo sapien
tccagaaggctcgtcttaccgcagc

SEQ ID NO: 72810 - DNA, 25 bp, Homo sapien
aggctcgtcttaccgcagccctttt

SEQ ID NO: 72811 - DNA, 25 bp, Homo sapien
ccgtggatcccgttgctcaggcggc

SEQ ID NO: 72812 - DNA, 25 bp, Homo sapien
tcttggttcccgtggatcccgttgc

SEQ ID NO: 72813 - DNA, 25 bp, Homo sapien
cttccacagggtctccaggggacac

SEQ ID NO: 72814 - DNA, 25 bp, Homo sapien
ctgggtcgacgggagaagcgaagcg

SEQ ID NO: 72815 - DNA, 25 bp, Homo sapien
gatggtctgggtcgacgggagaagc

SEQ ID NO: 72816 - DNA, 25 bp, Homo sapien
gcagcgagaactcatccaccggggt

SEQ ID NO: 72817 - DNA, 25 bp, Homo sapien
cacacacgccttcccgccatcgctc

SEQ ID NO: 72818 - DNA, 25 bp, Homo sapien
tgctcacatcgcgcacacacgcctt

SEQ ID NO: 72819 - DNA, 25 bp, Homo sapien
tggcagcgagaactcatccaccggg

SEQ ID NO: 72820 - DNA, 25 bp, Homo sapien
agcgagaactcatccaccggggtgt

SEQ ID NO: 72821 - DNA, 25 bp, Homo sapien
ctggcagcgagaactcatccaccgg

SEQ ID NO: 72822 - DNA, 25 bp, Homo sapien
tcgatctcgtcgttgatccgccggg

SEQ ID NO: 72823 - DNA, 25 bp, Homo sapien
gatctcgtcgttgatccgccgggct

SEQ ID NO: 72824 - DNA, 25 bp, Homo sapien
tgccgctcgatctcgtcgttgatcc

SEQ ID NO: 72825 - DNA, 25 bp, Homo sapien
gctgccgctcgatctcgtcgttgat

SEQ ID NO: 72826 - DNA, 25 bp, Homo sapien
cggagctgccgctcgatctcgtcgt

SEQ ID NO: 72827 - DNA, 25 bp, Homo sapien
tcccgcttgtccctgcggagctgcc

SEQ ID NO: 72828 - DNA, 25 bp, Homo sapien
ctcgctcaggcagcacgccatgatg

SEQ ID NO: 72829 - DNA, 25 bp, Homo sapien
tctcgtcgttgatccgccgggcttc

SEQ ID NO: 72830 - DNA, 25 bp, Homo sapien
catgcccagccgagtagctttacgg

SEQ ID NO: 72831 - DNA, 25 bp, Homo sapien
tagctttacggttctcccaccgcag

SEQ ID NO: 72832 - DNA, 25 bp, Homo sapien
tgccatgataccagcctgcagcttg

SEQ ID NO: 72833 - DNA, 25 bp, Homo sapien
agcctgcagcttgcggcccacttcc

SEQ ID NO: 72834 - DNA, 25 bp, Homo sapien
gccgagtagctttacggttctccca

SEQ ID NO: 72835 - DNA, 25 bp, Homo sapien
tcggcctcttggtgctgcggtgccc

SEQ ID NO: 72836 - DNA, 25 bp, Homo sapien
gacggcggctcttccgcggcccttc

SEQ ID NO: 72837 - DNA, 25 bp, Homo sapien
tgataccagcctgcagcttgcggcc

SEQ ID NO: 72838 - DNA, 25 bp, Homo sapien
acacggccggacaggaagactatga

SEQ ID NO: 72839 - DNA, 25 bp, Homo sapien
actatgactgtctgaggcctttatc

SEQ ID NO: 72840 - DNA, 25 bp, Homo sapien
tacctcctaggactctatgacacgg

SEQ ID NO: 72841 - DNA, 25 bp, Homo sapien
tcggtggtaaatccagcctcatttc

SEQ ID NO: 72842 - DNA, 25 bp, Homo sapien
gaggcctttatcttacccagtgacc

SEQ ID NO: 72843 - DNA, 25 bp, Homo sapien
cccagtgaccgacgtcttccttata

SEQ ID NO: 72844 - DNA, 25 bp, Homo sapien
cttccttatatgcttctcggtggta

SEQ ID NO: 72845 - DNA, 25 bp, Homo sapien
aaaaaagatgcttatgatccggcgg

SEQ ID NO: 72846 - DNA, 25 bp, Homo sapien
ccgcctgggtcttcatcagagagtc

SEQ ID NO: 72847 - DNA, 25 bp, Homo sapien
ctcggaaaagcgatccaggtgctgc

SEQ ID NO: 72848 - DNA, 25 bp, Homo sapien
ttgttctgaggcaagcgctcccaca

SEQ ID NO: 72849 - DNA, 25 bp, Homo sapien
ctctctgcgtactgattggaacatc

SEQ ID NO: 72850 - DNA, 25 bp, Homo sapien
caccaggtggtaacgagctgcatcc

SEQ ID NO: 72851 - DNA, 25 bp, Homo sapien
tttcaccttggagacggcgactctc

SEQ ID NO: 72852 - DNA, 25 bp, Homo sapien
ccaggctctcttggagtgtctcctc

SEQ ID NO: 72853 - DNA, 25 bp, Homo sapien
tgggttctctctatagccattgaag

SEQ ID NO: 72854 - DNA, 25 bp, Homo sapien
ccgctcggctgcaggcgatgtcaga

SEQ ID NO: 72855 - DNA, 25 bp, Homo sapien
ttccgcgcactcctcggctgtccca

SEQ ID NO: 72856 - DNA, 25 bp, Homo sapien
caatcccgcggcaaagcttcgcgga

SEQ ID NO: 72857 - DNA, 25 bp, Homo sapien
tgacggtctcccaacctggtcctca

SEQ ID NO: 72858 - DNA, 25 bp, Homo sapien
caagagacggcgactgcaagcgcgt

SEQ ID NO: 72859 - DNA, 25 bp, Homo sapien
tctccgcgaactgacagatcacgtg

SEQ ID NO: 72860 - DNA, 25 bp, Homo sapien
aactgacagatcacgtgccctgggt

SEQ ID NO: 72861 - DNA, 25 bp, Homo sapien
gcggcaaagcttcgcggaccggcct

SEQ ID NO: 72862 - DNA, 25 bp, Homo sapien
tgctactcgaaacaactgaggagcc

SEQ ID NO: 72863 - DNA, 25 bp, Homo sapien
gcgcgcacaggcaggaggttgcagt

SEQ ID NO: 72864 - DNA, 25 bp, Homo sapien
tcgtttcctggatctttgggtccca

SEQ ID NO: 72865 - DNA, 25 bp, Homo sapien
ttcctggatctttgggtcccagggc

SEQ ID NO: 72866 - DNA, 25 bp, Homo sapien
tgccggcctttagtgaacgggacca

SEQ ID NO: 72867 - DNA, 25 bp, Homo sapien
ggcctttagtgaacgggaccattga

SEQ ID NO: 72868 - DNA, 25 bp, Homo sapien
tgaacgggaccattgacggtgtccc

SEQ ID NO: 72869 - DNA, 25 bp, Homo sapien
ggccaatcccgtgcggcgcgcacag

SEQ ID NO: 72870 - DNA, 25 bp, Homo sapien
tgctcccgcttcacacgtctttgtg

SEQ ID NO: 72871 - DNA, 25 bp, Homo sapien
agatgcccaggcagacgaagttggc

SEQ ID NO: 72872 - DNA, 25 bp, Homo sapien
gacaggaggacacgggatcgtttcc

SEQ ID NO: 72873 - DNA, 25 bp, Homo sapien
ggacggcggcttttgttttagatga

SEQ ID NO: 72874 - DNA, 25 bp, Homo sapien
gcttttgttttagatgaagctgccg

SEQ ID NO: 72875 - DNA, 25 bp, Homo sapien
cccagagagcaaatagtggcgtcgc

SEQ ID NO: 72876 - DNA, 25 bp, Homo sapien
aaatagtggcgtcgcctcctgaaga

SEQ ID NO: 72877 - DNA, 25 bp, Homo sapien
tgaagcagcggagttcgccatggta

SEQ ID NO: 72878 - DNA, 25 bp, Homo sapien
gggcgtccctgatagacttgcattg

SEQ ID NO: 72879 - DNA, 25 bp, Homo sapien
atacattgggcgctcagtcaatacc

SEQ ID NO: 72880 - DNA, 25 bp, Homo sapien
gggcgctcagtcaatacctgtttca

SEQ ID NO: 72881 - DNA, 25 bp, Homo sapien
tcaatacctgtttcaagaaagcgtg

SEQ ID NO: 72882 - DNA, 25 bp, Homo sapien
cgcattccttgctagggagaaagtg

SEQ ID NO: 72883 - DNA, 25 bp, Homo sapien
tgagccctaccttggggcgccagag

SEQ ID NO: 72884 - DNA, 25 bp, Homo sapien
cggtcagggcgtccctgatagactt

SEQ ID NO: 72885 - DNA, 25 bp, Homo sapien
tccttgctagggagaaagtgcgtga

SEQ ID NO: 72886 - DNA, 25 bp, Homo sapien
cagctcaggcagagcgacccgcaga

SEQ ID NO: 72887 - DNA, 25 bp, Homo sapien
gcgtccagtccttgaggccgcagag

SEQ ID NO: 72888 - DNA, 25 bp, Homo sapien
agtacctggcgatggcgatatgagc

SEQ ID NO: 72889 - DNA, 25 bp, Homo sapien
gcactcggagatgctggccaagctc

SEQ ID NO: 72890 - DNA, 25 bp, Homo sapien
atgctggccaagctccatgaggaga

SEQ ID NO: 72891 - DNA, 25 bp, Homo sapien
ctccatgaggagatcgagcatctga

SEQ ID NO: 72892 - DNA, 25 bp, Homo sapien
cgagcatctgaagcgggaaaacaag

SEQ ID NO: 72893 - DNA, 25 bp, Homo sapien
agcgacccgcagaaacggaacctgg

SEQ ID NO: 72894 - DNA, 25 bp, Homo sapien
gccaagacttaagcacgtgggttgc

SEQ ID NO: 72895 - DNA, 25 bp, Homo sapien
ccgtcagactggcctgtaacggctt

SEQ ID NO: 72896 - DNA, 25 bp, Homo sapien
aagacttaagcacgtgggttgcacg

SEQ ID NO: 72897 - DNA, 25 bp, Homo sapien
ttaagcacgtgggttgcacgcatcg

SEQ ID NO: 72898 - DNA, 25 bp, Homo sapien
tgggttgcacgcatcggccagtgtc

SEQ ID NO: 72899 - DNA, 25 bp, Homo sapien
actgacgccccctgagatgtgcaca

SEQ ID NO: 72900 - DNA, 25 bp, Homo sapien
ctgagatgtgcacaccgcacgcgca

SEQ ID NO: 72901 - DNA, 25 bp, Homo sapien
gcacgcgcacgtcgcacgcgcggca

SEQ ID NO: 72902 - DNA, 25 bp, Homo sapien
gtcgttgctcctcctagaagtccgg

SEQ ID NO: 72903 - DNA, 25 bp, Homo sapien
accagcggtttatgggcggatggcg

SEQ ID NO: 72904 - DNA, 25 bp, Homo sapien
tgacgtcgttgctcctcctagaagt

SEQ ID NO: 72905 - DNA, 25 bp, Homo sapien
gacgtcgttgctcctcctagaagtc

SEQ ID NO: 72906 - DNA, 25 bp, Homo sapien
cgtcgttgctcctcctagaagtccg

SEQ ID NO: 72907 - DNA, 25 bp, Homo sapien
acgtcgttgctcctcctagaagtcc

SEQ ID NO: 72908 - DNA, 25 bp, Homo sapien
caccagcggtttatgggcggatggc

SEQ ID NO: 72909 - DNA, 25 bp, Homo sapien
tcgttgctcctcctagaagtccggg

SEQ ID NO: 72910 - DNA, 25 bp, Homo sapien
tgggacggctgttctgctatgctgt

SEQ ID NO: 72911 - DNA, 25 bp, Homo sapien
ggctgttctgctatgctgtagtgca

SEQ ID NO: 72912 - DNA, 25 bp, Homo sapien
tgttctgctatgctgtagtgcagga

SEQ ID NO: 72913 - DNA, 25 bp, Homo sapien
ggacggctgttctgctatgctgtag

SEQ ID NO: 72914 - DNA, 25 bp, Homo sapien
gtcctgcagtcaccatgcacgagac

SEQ ID NO: 72915 - DNA, 25 bp, Homo sapien
tcgtcctgcagtcaccatgcacgag

SEQ ID NO: 72916 - DNA, 25 bp, Homo sapien
gggtcacctcgtcctgcagtcacca

SEQ ID NO: 72917 - DNA, 25 bp, Homo sapien
acggctgttctgctatgctgtagtg

SEQ ID NO: 72918 - DNA, 25 bp, Homo sapien
aaccctaagcggcttctggcaagtc

SEQ ID NO: 72919 - DNA, 25 bp, Homo sapien
cagctggcggtaaaacgcgggacct

SEQ ID NO: 72920 - DNA, 25 bp, Homo sapien
cacagctggcggtaaaacgcgggac

SEQ ID NO: 72921 - DNA, 25 bp, Homo sapien
tcagagcgagcttctgagcggtggt

SEQ ID NO: 72922 - DNA, 25 bp, Homo sapien
tgtgccgcaaccctaagcggcttct

SEQ ID NO: 72923 - DNA, 25 bp, Homo sapien
ggctcagcctgtgccgcaaccctaa

SEQ ID NO: 72924 - DNA, 25 bp, Homo sapien
ggaggcggtcacagggagcgctcct

SEQ ID NO: 72925 - DNA, 25 bp, Homo sapien
ttcgtgcccgcacttcttcgtgggc

SEQ ID NO: 72926 - DNA, 25 bp, Homo sapien
gggtcgtccctagcacctaccagag

SEQ ID NO: 72927 - DNA, 25 bp, Homo sapien
atagggtcgtccctagcacctacca

SEQ ID NO: 72928 - DNA, 25 bp, Homo sapien
tagggtcgtccctagcacctaccag

SEQ ID NO: 72929 - DNA, 25 bp, Homo sapien
agggtcgtccctagcacctaccaga

SEQ ID NO: 72930 - DNA, 25 bp, Homo sapien
tccctggagacccatgcagcgggtc

SEQ ID NO: 72931 - DNA, 25 bp, Homo sapien
cctggagacccatgcagcgggtcag

SEQ ID NO: 72932 - DNA, 25 bp, Homo sapien
ccctggagacccatgcagcgggtca

SEQ ID NO: 72933 - DNA, 25 bp, Homo sapien
ggagacccatgcagcgggtcaggtg

SEQ ID NO: 72934 - DNA, 25 bp, Homo sapien
cgccgcagcgtgcgcgcaccgcagc

SEQ ID NO: 72935 - DNA, 25 bp, Homo sapien
cctcaggaacgaggcggggaagagt

SEQ ID NO: 72936 - DNA, 25 bp, Homo sapien
tgcctgtctactgcacccggggcgg

SEQ ID NO: 72937 - DNA, 25 bp, Homo sapien
tggcccagttctgcgccaacgccgc

SEQ ID NO: 72938 - DNA, 25 bp, Homo sapien
gtgagcacgactggctggcccagtt

SEQ ID NO: 72939 - DNA, 25 bp, Homo sapien
cggagcccaagcgcctctgagagcc

SEQ ID NO: 72940 - DNA, 25 bp, Homo sapien
gagaggtcattaaaaaataacctca

SEQ ID NO: 72941 - DNA, 25 bp, Homo sapien
aacgaggcggggaagagtgaagagc

SEQ ID NO: 72942 - DNA, 25 bp, Homo sapien
ggggctcctctgtatagaagaactg

SEQ ID NO: 72943 - DNA, 25 bp, Homo sapien
cgcggcccttctccgtcagcgacgt

SEQ ID NO: 72944 - DNA, 25 bp, Homo sapien
gggctcctctgtatagaagaactgg

SEQ ID NO: 72945 - DNA, 25 bp, Homo sapien
tggggctcctctgtatagaagaact

SEQ ID NO: 72946 - DNA, 25 bp, Homo sapien
cttggggctcctctgtatagaagaa

SEQ ID NO: 72947 - DNA, 25 bp, Homo sapien
ccgggcaccgtgaggccgtggaact

SEQ ID NO: 72948 - DNA, 25 bp, Homo sapien
cgtcgcagtagaacgcccggggatc

SEQ ID NO: 72949 - DNA, 25 bp, Homo sapien
gtcgcagtagaacgcccggggatcc

SEQ ID NO: 72950 - DNA, 25 bp, Homo sapien
agagcatggaagagcgtctttgccc

SEQ ID NO: 72951 - DNA, 25 bp, Homo sapien
ggctctgggacaataaccggcttgt

SEQ ID NO: 72952 - DNA, 25 bp, Homo sapien
ctgggacaataaccggcttgttgcc

SEQ ID NO: 72953 - DNA, 25 bp, Homo sapien
agacagctgcgcgacccaatcgcgg

SEQ ID NO: 72954 - DNA, 25 bp, Homo sapien
tctcctccctggaatgtcgcggccc

SEQ ID NO: 72955 - DNA, 25 bp, Homo sapien
tctctgggagagacggcagacaaca

SEQ ID NO: 72956 - DNA, 25 bp, Homo sapien
agacggcagacaacaaaggggcccg

SEQ ID NO: 72957 - DNA, 25 bp, Homo sapien
gtacctggtcgatgggcagctgcac

SEQ ID NO: 72958 - DNA, 25 bp, Homo sapien
caaaaaggcacggtggctggggcaa

SEQ ID NO: 72959 - DNA, 25 bp, Homo sapien
tccgggtgccgcaacagcgagggaa

SEQ ID NO: 72960 - DNA, 25 bp, Homo sapien
agtaagggaatgtcggcacgcagcc

SEQ ID NO: 72961 - DNA, 25 bp, Homo sapien
ctccgggtgccgcaacagcgaggga

SEQ ID NO: 72962 - DNA, 25 bp, Homo sapien
tcctccgggtgccgcaacagcgagg

SEQ ID NO: 72963 - DNA, 25 bp, Homo sapien
ccgggtgccgcaacagcgagggaag

SEQ ID NO: 72964 - DNA, 25 bp, Homo sapien
gggaatgtcggcacgcagcccacct

SEQ ID NO: 72965 - DNA, 25 bp, Homo sapien
acccgagggaggtatccgggctgct

SEQ ID NO: 72966 - DNA, 25 bp, Homo sapien
cgtggcttcgctcttctctgttaat

SEQ ID NO: 72967 - DNA, 25 bp, Homo sapien
ggcttcgctcttctctgttaatgat

SEQ ID NO: 72968 - DNA, 25 bp, Homo sapien
acatggcggcgtctccgtggcttcg

SEQ ID NO: 72969 - DNA, 25 bp, Homo sapien
cacaggggaacacggtcagccaagg

SEQ ID NO: 72970 - DNA, 25 bp, Homo sapien
ccatgcatgcgccacaggggaacac

SEQ ID NO: 72971 - DNA, 25 bp, Homo sapien
aagggcacgactccgcccatgcatg

SEQ ID NO: 72972 - DNA, 25 bp, Homo sapien
cccacacgcatgtctctttctaccc

SEQ ID NO: 72973 - DNA, 25 bp, Homo sapien
cgacacacacatgggggccacagca

SEQ ID NO: 72974 - DNA, 25 bp, Homo sapien
taggatgccggacggccctcggcac

SEQ ID NO: 72975 - DNA, 25 bp, Homo sapien
gaggctggcggaacccttgctttcc

SEQ ID NO: 72976 - DNA, 25 bp, Homo sapien
agccggactgaacgccaggcacagc

SEQ ID NO: 72977 - DNA, 25 bp, Homo sapien
aacgggtcacaagccggactgaacg

SEQ ID NO: 72978 - DNA, 25 bp, Homo sapien
tcaagctccaggagaccggcatgcc

SEQ ID NO: 72979 - DNA, 25 bp, Homo sapien
gcagcgacccgcctaggatgccgga

SEQ ID NO: 72980 - DNA, 25 bp, Homo sapien
cggacaacgggccaaccagtggcta

SEQ ID NO: 72981 - DNA, 25 bp, Homo sapien
cggctcacagcggaacgggtcacaa

SEQ ID NO: 72982 - DNA, 25 bp, Homo sapien
tatcccagtggctgcgatcaagcca

SEQ ID NO: 72983 - DNA, 25 bp, Homo sapien
atgtcgccgtgactgaggccaagtc

SEQ ID NO: 72984 - DNA, 25 bp, Homo sapien
ccaggtatcccagtggctgcgatca

SEQ ID NO: 72985 - DNA, 25 bp, Homo sapien
tgtcgccgtgactgaggccaagtca

SEQ ID NO: 72986 - DNA, 25 bp, Homo sapien
ggtggctgtagaggacccctagcta

SEQ ID NO: 72987 - DNA, 25 bp, Homo sapien
agtgcccgtgccagcggcccagatc

SEQ ID NO: 72988 - DNA, 25 bp, Homo sapien
gcgatcaagccagtcattctgcccg

SEQ ID NO: 72989 - DNA, 25 bp, Homo sapien
ggctgcgatcaagccagtcattctg

SEQ ID NO: 72990 - DNA, 25 bp, Homo sapien
tagtgaatcctgcaagcctgcttgg

SEQ ID NO: 72991 - DNA, 25 bp, Homo sapien
cggctgcaccttggagcgaaactga

SEQ ID NO: 72992 - DNA, 25 bp, Homo sapien
agccagccaggagtttagaacgttc

SEQ ID NO: 72993 - DNA, 25 bp, Homo sapien
agctcgagagccacgatctgatttc

SEQ ID NO: 72994 - DNA, 25 bp, Homo sapien
agaggaagtttgtctttctcccagc

SEQ ID NO: 72995 - DNA, 25 bp, Homo sapien
agagcccagctgtccttggcaaaca

SEQ ID NO: 72996 - DNA, 25 bp, Homo sapien
gatctgatttcagggaccgtgccta

SEQ ID NO: 72997 - DNA, 25 bp, Homo sapien
cacaatccgctgtggttaatgatta

SEQ ID NO: 72998 - DNA, 25 bp, Homo sapien
catcttcggcgccttcgtggtctac

SEQ ID NO: 72999 - DNA, 25 bp, Homo sapien
tgctggaacatgatgcaggtgctca

SEQ ID NO: 73000 - DNA, 25 bp, Homo sapien
tccagccgctggaccgtgttccagt

SEQ ID NO: 73001 - DNA, 25 bp, Homo sapien
gagacctccaatatgtccatctgta

SEQ ID NO: 73002 - DNA, 25 bp, Homo sapien
ggggtctcacttgcaaccgctccag

SEQ ID NO: 73003 - DNA, 25 bp, Homo sapien
tccgtagccttcatgtgctggaaca

SEQ ID NO: 73004 - DNA, 25 bp, Homo sapien
tgctcatgaaaagccagaagggctc

SEQ ID NO: 73005 - DNA, 25 bp, Homo sapien
accgtgttccagtccagcatcttcg

SEQ ID NO: 73006 - DNA, 25 bp, Homo sapien
tcctgccgcttcagatttggaaacg

SEQ ID NO: 73007 - DNA, 25 bp, Homo sapien
cagtttgcgaactgctggggttctc

SEQ ID NO: 73008 - DNA, 25 bp, Homo sapien
tggacttcgaaccgccggcgcggct

SEQ ID NO: 73009 - DNA, 25 bp, Homo sapien
tcagctggtgctcgaggtggccagt

SEQ ID NO: 73010 - DNA, 25 bp, Homo sapien
cgcttcagatttggaaacgcatttc

SEQ ID NO: 73011 - DNA, 25 bp, Homo sapien
tccctcctgccgcttcagatttgga

SEQ ID NO: 73012 - DNA, 25 bp, Homo sapien
ggaaacgcatttcggggcgtgatca

SEQ ID NO: 73013 - DNA, 25 bp, Homo sapien
ccccgggatgcgtgttgtaggcact

SEQ ID NO: 73014 - DNA, 25 bp, Homo sapien
gcgactttccgagcaccttctttta

SEQ ID NO: 73015 - DNA, 25 bp, Homo sapien
ccgcaacccgaggacaggtgctcaa

SEQ ID NO: 73016 - DNA, 25 bp, Homo sapien
agatctacacggaggcgacggccta

SEQ ID NO: 73017 - DNA, 25 bp, Homo sapien
acagccgcctttcgacaactttttg

SEQ ID NO: 73018 - DNA, 25 bp, Homo sapien
tgctctactcaccaggtccggcgtg

SEQ ID NO: 73019 - DNA, 25 bp, Homo sapien
aagcaatgtcttttcgcgccgaatt

SEQ ID NO: 73020 - DNA, 25 bp, Homo sapien
agctcaggcgtataagcgactttcc

SEQ ID NO: 73021 - DNA, 25 bp, Homo sapien
gccctatgaagatccggcgcagcta

SEQ ID NO: 73022 - DNA, 25 bp, Homo sapien
tgtgctgccgcctgtcgctgcagca

SEQ ID NO: 73023 - DNA, 25 bp, Homo sapien
caaccacgagaagcgcctgcgcgta

SEQ ID NO: 73024 - DNA, 25 bp, Homo sapien
tgcggccaaacccaagcacgactgg

SEQ ID NO: 73025 - DNA, 25 bp, Homo sapien
gcacgactggacgaggtcctacttc

SEQ ID NO: 73026 - DNA, 25 bp, Homo sapien
ctacttccgggcgtacatgatcctc

SEQ ID NO: 73027 - DNA, 25 bp, Homo sapien
ttctcggagacgtttttctacctca

SEQ ID NO: 73028 - DNA, 25 bp, Homo sapien
ctgtacacggtgtcctcgcagcagt

SEQ ID NO: 73029 - DNA, 25 bp, Homo sapien
tttctacctcagctcggtcatcaac

SEQ ID NO: 73030 - DNA, 25 bp, Homo sapien
tgggtccagcccacacaactgaggc

SEQ ID NO: 73031 - DNA, 25 bp, Homo sapien
ggcctctgggtattctcacctggaa

SEQ ID NO: 73032 - DNA, 25 bp, Homo sapien
aaaagttgccgcgatgcctaggacc

SEQ ID NO: 73033 - DNA, 25 bp, Homo sapien
gcggctgagactgaaggaactactg

SEQ ID NO: 73034 - DNA, 25 bp, Homo sapien
aactactggcgatcgggagcaccca

SEQ ID NO: 73035 - DNA, 25 bp, Homo sapien
actccaggcatcacgtgacggctgc

SEQ ID NO: 73036 - DNA, 25 bp, Homo sapien
ctgcgccttccaggactggtcggta

SEQ ID NO: 73037 - DNA, 25 bp, Homo sapien
cggctggcccttcgcacataggaag

SEQ ID NO: 73038 - DNA, 25 bp, Homo sapien
cggaccagatctccgtgtcggaatt

SEQ ID NO: 73039 - DNA, 25 bp, Homo sapien
agcgcggccaactttgtccagagtc

SEQ ID NO: 73040 - DNA, 25 bp, Homo sapien
cagaagccctttgttcccgcctagg

SEQ ID NO: 73041 - DNA, 25 bp, Homo sapien
cctgcccgagacagaagccctttgt

SEQ ID NO: 73042 - DNA, 25 bp, Homo sapien
atccgcatcccgagaaaactttctt

SEQ ID NO: 73043 - DNA, 25 bp, Homo sapien
gccggaacactgtggcggccatcga

SEQ ID NO: 73044 - DNA, 25 bp, Homo sapien
ccatgaggactacaaggcgcccacg

SEQ ID NO: 73045 - DNA, 25 bp, Homo sapien
aattcgtggccgagacccatgagga

SEQ ID NO: 73046 - DNA, 25 bp, Homo sapien
gagccgggagttgccaaacttgcca

SEQ ID NO: 73047 - DNA, 25 bp, Homo sapien
cgttaaagatctgcctgggagcgcc

SEQ ID NO: 73048 - DNA, 25 bp, Homo sapien
ggcagtgccactttcctcctggagg

SEQ ID NO: 73049 - DNA, 25 bp, Homo sapien
ccgcgggacgtttcactggcgctca

SEQ ID NO: 73050 - DNA, 25 bp, Homo sapien
aaacttgccatgtccagagcgcgga

SEQ ID NO: 73051 - DNA, 25 bp, Homo sapien
gtctccttacctggccttcggtgga

SEQ ID NO: 73052 - DNA, 25 bp, Homo sapien
cggaagcatacagtctgcggggaca

SEQ ID NO: 73053 - DNA, 25 bp, Homo sapien
cgcgctcctccgctttgttgtgttc

SEQ ID NO: 73054 - DNA, 25 bp, Homo sapien
gagccacagcttcactctggggctt

SEQ ID NO: 73055 - DNA, 25 bp, Homo sapien
aaggagccacagcttcactctgggg

SEQ ID NO: 73056 - DNA, 25 bp, Homo sapien
gagaaggagccacagcttcactctg

SEQ ID NO: 73057 - DNA, 25 bp, Homo sapien
tcactctggggcttgacggcgctgg

SEQ ID NO: 73058 - DNA, 25 bp, Homo sapien
aggagccacagcttcactctggggc

SEQ ID NO: 73059 - DNA, 25 bp, Homo sapien
ggagccacagcttcactctggggct

SEQ ID NO: 73060 - DNA, 25 bp, Homo sapien
gcttgacggcgctggggacacggga

SEQ ID NO: 73061 - DNA, 25 bp, Homo sapien
gaaggagccacagcttcactctggg

SEQ ID NO: 73062 - DNA, 25 bp, Homo sapien
aagtagcgcagggaaagcccgctcg

SEQ ID NO: 73063 - DNA, 25 bp, Homo sapien
tagcgcagggaaagcccgctcgctc

SEQ ID NO: 73064 - DNA, 25 bp, Homo sapien
ggagccacactgctcttagcaagta

SEQ ID NO: 73065 - DNA, 25 bp, Homo sapien
gccacactgctcttagcaagtagcg

SEQ ID NO: 73066 - DNA, 25 bp, Homo sapien
tgctcttagcaagtagcgcagggaa

SEQ ID NO: 73067 - DNA, 25 bp, Homo sapien
tcttagcaagtagcgcagggaaagc

SEQ ID NO: 73068 - DNA, 25 bp, Homo sapien
tagcaagtagcgcagggaaagcccg

SEQ ID NO: 73069 - DNA, 25 bp, Homo sapien
ggagaaggagccacactgctcttag

SEQ ID NO: 73070 - DNA, 25 bp, Homo sapien
gaagcgacccaaggctctaagggga

SEQ ID NO: 73071 - DNA, 25 bp, Homo sapien
ctgggcagtggccttcccgcgtgcc

SEQ ID NO: 73072 - DNA, 25 bp, Homo sapien
ggtgggaagcgacccaaggctctaa

SEQ ID NO: 73073 - DNA, 25 bp, Homo sapien
cgtccagtggtgtcccaggggacgc

SEQ ID NO: 73074 - DNA, 25 bp, Homo sapien
tgcccacatccaggcggagtggagc

SEQ ID NO: 73075 - DNA, 25 bp, Homo sapien
cgcgtgcccacatccaggcggagtg

SEQ ID NO: 73076 - DNA, 25 bp, Homo sapien
cccaaggctctaaggggaatggaca

SEQ ID NO: 73077 - DNA, 25 bp, Homo sapien
cgccgacctcacagggacgcctggg

SEQ ID NO: 73078 - DNA, 25 bp, Homo sapien
cgcctcagttgagctacgcgcactg

SEQ ID NO: 73079 - DNA, 25 bp, Homo sapien
ccggccctcagctcgcaaagttggg

SEQ ID NO: 73080 - DNA, 25 bp, Homo sapien
aacttcctgccgagtcgtgagccgc

SEQ ID NO: 73081 - DNA, 25 bp, Homo sapien
acagtccaaaggaagctctggttgc

SEQ ID NO: 73082 - DNA, 25 bp, Homo sapien
tgttggcattcctagggacagtcca

SEQ ID NO: 73083 - DNA, 25 bp, Homo sapien
cgggagacgcgccttgagaagccca

SEQ ID NO: 73084 - DNA, 25 bp, Homo sapien
tgcccaacaaggaggtaagagctgc

SEQ ID NO: 73085 - DNA, 25 bp, Homo sapien
cggctgccctcacagccgggattgg

SEQ ID NO: 73086 - DNA, 25 bp, Homo sapien
tctggcgcaagtgggtttctcatgg

SEQ ID NO: 73087 - DNA, 25 bp, Homo sapien
aagggtggattcgtgccctccttct

SEQ ID NO: 73088 - DNA, 25 bp, Homo sapien
cttcctgatggaagggtggattcgt

SEQ ID NO: 73089 - DNA, 25 bp, Homo sapien
ctccttctggcgcaagtgggtttct

SEQ ID NO: 73090 - DNA, 25 bp, Homo sapien
tgggtgagttcacgccctctttctc

SEQ ID NO: 73091 - DNA, 25 bp, Homo sapien
cttcctgatgggtgggtgagttcac

SEQ ID NO: 73092 - DNA, 25 bp, Homo sapien
tcctccttgcgctagcaggttcctg

SEQ ID NO: 73093 - DNA, 25 bp, Homo sapien
ttgcgctagcaggttcctgatggta

SEQ ID NO: 73094 - DNA, 25 bp, Homo sapien
tgccgctctcggctagcggcgttct

SEQ ID NO: 73095 - DNA, 25 bp, Homo sapien
gctcgactccgaacgcaaaaaatgc

SEQ ID NO: 73096 - DNA, 25 bp, Homo sapien
ggtccctccgagctgagtagggccc

SEQ ID NO: 73097 - DNA, 25 bp, Homo sapien
gctacacccgcagagggaagttctc

SEQ ID NO: 73098 - DNA, 25 bp, Homo sapien
cagagggaagttctcccaggcagcc

SEQ ID NO: 73099 - DNA, 25 bp, Homo sapien
actcgagtcagaagtgcgaggcgcc

SEQ ID NO: 73100 - DNA, 25 bp, Homo sapien
gagtggcccagaagcgctcgactcc

SEQ ID NO: 73101 - DNA, 25 bp, Homo sapien
tacggaaaggaggatgcaacgagcc

SEQ ID NO: 73102 - DNA, 25 bp, Homo sapien
gtgtatccttttctgttcgccgccg

SEQ ID NO: 73103 - DNA, 25 bp, Homo sapien
ctcgctggttctttactcgggaaca

SEQ ID NO: 73104 - DNA, 25 bp, Homo sapien
ggcggccaacctcatccaggagatg

SEQ ID NO: 73105 - DNA, 25 bp, Homo sapien
gagcctgcgttgtgtaatctgtttg

SEQ ID NO: 73106 - DNA, 25 bp, Homo sapien
tgggacagcgtctcaatgtgtatcc

SEQ ID NO: 73107 - DNA, 25 bp, Homo sapien
ttcggcgcctcccaatgacaagcgg

SEQ ID NO: 73108 - DNA, 25 bp, Homo sapien
ataaagagctctcgtgccgccagca

SEQ ID NO: 73109 - DNA, 25 bp, Homo sapien
ctcgggaacagctggagaacacgcc

SEQ ID NO: 73110 - DNA, 25 bp, Homo sapien
gcagtcgacagtggtaagaggcctc

SEQ ID NO: 73111 - DNA, 25 bp, Homo sapien
tgagcgagtagatcaagcaccagcc

SEQ ID NO: 73112 - DNA, 25 bp, Homo sapien
cctggccatggtaggacgcagcgct

SEQ ID NO: 73113 - DNA, 25 bp, Homo sapien
cgacagtggtaagaggcctctggca

SEQ ID NO: 73114 - DNA, 25 bp, Homo sapien
ccagccgcagaacatcaacaaattc

SEQ ID NO: 73115 - DNA, 25 bp, Homo sapien
tcaacaaattcgaacgccgacaagc

SEQ ID NO: 73116 - DNA, 25 bp, Homo sapien
aacacctgaggcagttcgacgtgac

SEQ ID NO: 73117 - DNA, 25 bp, Homo sapien
ggtgggcacctaccacaactacatc

SEQ ID NO: 73118 - DNA, 25 bp, Homo sapien
ggcctgccaagagcgtggtactgct

SEQ ID NO: 73119 - DNA, 25 bp, Homo sapien
gaaaggtttccgagtccctgccatg

SEQ ID NO: 73120 - DNA, 25 bp, Homo sapien
gcgcttcagccagggccttctgacg

SEQ ID NO: 73121 - DNA, 25 bp, Homo sapien
ggctgccgctcaaagagaacgaaga

SEQ ID NO: 73122 - DNA, 25 bp, Homo sapien
taacgcgggtaagagatgcccttcc

SEQ ID NO: 73123 - DNA, 25 bp, Homo sapien
acctatgaatagtcggctgccgctc

SEQ ID NO: 73124 - DNA, 25 bp, Homo sapien
cggggacgtacaacctatgaatagt

SEQ ID NO: 73125 - DNA, 25 bp, Homo sapien
cgccaaccggtagcgctaacggaga

SEQ ID NO: 73126 - DNA, 25 bp, Homo sapien
actcgccaacgagagaaggtcctgg

SEQ ID NO: 73127 - DNA, 25 bp, Homo sapien
agactacacaccgagcgagcgcctg

SEQ ID NO: 73128 - DNA, 25 bp, Homo sapien
ttcatcctcttgtatacctcagccg

SEQ ID NO: 73129 - DNA, 25 bp, Homo sapien
ctgtcggctcgcacaattgccacta

SEQ ID NO: 73130 - DNA, 25 bp, Homo sapien
ccagcctttcctcagtgtctgcgag

SEQ ID NO: 73131 - DNA, 25 bp, Homo sapien
ttcgtttgagatacagtgggcctgg

SEQ ID NO: 73132 - DNA, 25 bp, Homo sapien
aggaccctctttgtgctgcttgaac

SEQ ID NO: 73133 - DNA, 25 bp, Homo sapien
cgccgacgtgtcttagcggttagtc

SEQ ID NO: 73134 - DNA, 25 bp, Homo sapien
aagtcgcttttttccagacgctgca

SEQ ID NO: 73135 - DNA, 25 bp, Homo sapien
agctggagatttcgcgccaaacctg

SEQ ID NO: 73136 - DNA, 25 bp, Homo sapien
cgccgcgaggtccatatttgcttag

SEQ ID NO: 73137 - DNA, 25 bp, Homo sapien
agggctcgagatgggttttactcca

SEQ ID NO: 73138 - DNA, 25 bp, Homo sapien
caccgagggctgtgcaaataccagg

SEQ ID NO: 73139 - DNA, 25 bp, Homo sapien
agttactatactcagcgagcccagg

SEQ ID NO: 73140 - DNA, 25 bp, Homo sapien
caccgacgagattcaatggcacttc

SEQ ID NO: 73141 - DNA, 25 bp, Homo sapien
cggaaagggatttcgcgccaaatgc

SEQ ID NO: 73142 - DNA, 25 bp, Homo sapien
ggtccactcgttatggaaaggaagc

SEQ ID NO: 73143 - DNA, 25 bp, Homo sapien
ctcgctgcgagccacagtgtctcag

SEQ ID NO: 73144 - DNA, 25 bp, Homo sapien
ggcagcacggagaaagtgattaatt

SEQ ID NO: 73145 - DNA, 25 bp, Homo sapien
gtcgcggatggtcccttcttcctct

SEQ ID NO: 73146 - DNA, 25 bp, Homo sapien
ttgccatggctcctggtagcggagc

SEQ ID NO: 73147 - DNA, 25 bp, Homo sapien
aaaacccagagaggggctagagctc

SEQ ID NO: 73148 - DNA, 25 bp, Homo sapien
ggttccgaaaatgccgccagcctgg

SEQ ID NO: 73149 - DNA, 25 bp, Homo sapien
agaggattctagatcccagcccggg

SEQ ID NO: 73150 - DNA, 25 bp, Homo sapien
gcctcagagcccagtatttcccacg

SEQ ID NO: 73151 - DNA, 25 bp, Homo sapien
agaagttcccgggtccagcctcaga

SEQ ID NO: 73152 - DNA, 25 bp, Homo sapien
tggagctcgcactgctgttgccaag

SEQ ID NO: 73153 - DNA, 25 bp, Homo sapien
ctggctgtgggtcacacgcagacaa

SEQ ID NO: 73154 - DNA, 25 bp, Homo sapien
gcagacaagatcagcgaccctcgtt

SEQ ID NO: 73155 - DNA, 25 bp, Homo sapien
cgaccctcgttttgcgagtgcaaca

SEQ ID NO: 73156 - DNA, 25 bp, Homo sapien
gagtgcaacactcccagccacagaa

SEQ ID NO: 73157 - DNA, 25 bp, Homo sapien
agccacagaagttcccgggtccagc

SEQ ID NO: 73158 - DNA, 25 bp, Homo sapien
ttcctctcccggcttgagtcagacg

SEQ ID NO: 73159 - DNA, 25 bp, Homo sapien
agacgctccgctagtgcagacagga

SEQ ID NO: 73160 - DNA, 25 bp, Homo sapien
tggagctagcaaggggatattcctc

SEQ ID NO: 73161 - DNA, 25 bp, Homo sapien
agcgttgtccaacacgtgagactca

SEQ ID NO: 73162 - DNA, 25 bp, Homo sapien
tcacagggtagaacacgtagctcca

SEQ ID NO: 73163 - DNA, 25 bp, Homo sapien
cagggagcacacaccgccagtctgt

SEQ ID NO: 73164 - DNA, 25 bp, Homo sapien
ccaggggatttcaaagagctcagac

SEQ ID NO: 73165 - DNA, 25 bp, Homo sapien
ccaggagacgggaacttacttcatt

SEQ ID NO: 73166 - DNA, 25 bp, Homo sapien
gcctcctgtgtagatgctgtcactt

SEQ ID NO: 73167 - DNA, 25 bp, Homo sapien
ctggggaatgtcactttaaagactt

SEQ ID NO: 73168 - DNA, 25 bp, Homo sapien
gcttttcgtatattcgggtaggatc

SEQ ID NO: 73169 - DNA, 25 bp, Homo sapien
atgtggtgtcttccgttgaagtccc

SEQ ID NO: 73170 - DNA, 25 bp, Homo sapien
tgctgtcacttgaggtctagaaagg

SEQ ID NO: 73171 - DNA, 25 bp, Homo sapien
tctagaaagggtcagtgcgtgacgc

SEQ ID NO: 73172 - DNA, 25 bp, Homo sapien
gttgaagtccctcggctccagttca

SEQ ID NO: 73173 - DNA, 25 bp, Homo sapien
agcctggtctggatcccgaagtcca

SEQ ID NO: 73174 - DNA, 25 bp, Homo sapien
caggacgcactcctctgtcagtttc

SEQ ID NO: 73175 - DNA, 25 bp, Homo sapien
cggtgatgtagagccggttgttgca

SEQ ID NO: 73176 - DNA, 25 bp, Homo sapien
acgcactcctctgtcagtttctggg

SEQ ID NO: 73177 - DNA, 25 bp, Homo sapien
acgacttcctgatggtgacgctgcc

SEQ ID NO: 73178 - DNA, 25 bp, Homo sapien
tgccgtcagacagacactgctccgg

SEQ ID NO: 73179 - DNA, 25 bp, Homo sapien
cacgatcctgcggatgtgggtgtac

SEQ ID NO: 73180 - DNA, 25 bp, Homo sapien
gatgtgggtgtacgacttcctgatg

SEQ ID NO: 73181 - DNA, 25 bp, Homo sapien
ggcgataacctcgttcttctcgtcc

SEQ ID NO: 73182 - DNA, 25 bp, Homo sapien
agcgattgcgaaatgcactcggcac

SEQ ID NO: 73183 - DNA, 25 bp, Homo sapien
actcggcactgtcacctgaccgtta

SEQ ID NO: 73184 - DNA, 25 bp, Homo sapien
ccctgcgagcctttgtttaccacga

SEQ ID NO: 73185 - DNA, 25 bp, Homo sapien
tgtttaccacgatcgcgacacccgg

SEQ ID NO: 73186 - DNA, 25 bp, Homo sapien
ccgcttggtagctacagccctgagg

SEQ ID NO: 73187 - DNA, 25 bp, Homo sapien
ttattgtcactaggtgggcctgccc

SEQ ID NO: 73188 - DNA, 25 bp, Homo sapien
cagccttcttgtttggtgggacgac

SEQ ID NO: 73189 - DNA, 25 bp, Homo sapien
aatggacccgccctcaagttctgga

SEQ ID NO: 73190 - DNA, 25 bp, Homo sapien
cccggagaaagggtgagtgttggcg

SEQ ID NO: 73191 - DNA, 25 bp, Homo sapien
cgctgaggggatacgggaccccgag

SEQ ID NO: 73192 - DNA, 25 bp, Homo sapien
accgcgccgtgtgcttccgcaggtt

SEQ ID NO: 73193 - DNA, 25 bp, Homo sapien
cgcgccgtgtgcttccgcaggttgc

SEQ ID NO: 73194 - DNA, 25 bp, Homo sapien
gcccgctctctcacctcgccgtgct

SEQ ID NO: 73195 - DNA, 25 bp, Homo sapien
tctcacctcgccgtgctctctcgcg

SEQ ID NO: 73196 - DNA, 25 bp, Homo sapien
tcgccgtgctctctcgcggcggccg

SEQ ID NO: 73197 - DNA, 25 bp, Homo sapien
ctgcagccggagacccggagaaagg

SEQ ID NO: 73198 - DNA, 25 bp, Homo sapien
caccttcggagaggtctgagcgcta

SEQ ID NO: 73199 - DNA, 25 bp, Homo sapien
gcctcagtctgtccaccttcggaga

SEQ ID NO: 73200 - DNA, 25 bp, Homo sapien
ttcagtcccttagtcggcctcagtc

SEQ ID NO: 73201 - DNA, 25 bp, Homo sapien
cagctcctttcttggcgaggcttca

SEQ ID NO: 73202 - DNA, 25 bp, Homo sapien
cagcgcgagtgacaacccggtctct

SEQ ID NO: 73203 - DNA, 25 bp, Homo sapien
agtgaatgtgtagccctgtgacctc

SEQ ID NO: 73204 - DNA, 25 bp, Homo sapien
ccgaatcctcgggagaagcgggact

SEQ ID NO: 73205 - DNA, 25 bp, Homo sapien
cgctagccggagacaggtagacacc

SEQ ID NO: 73206 - DNA, 25 bp, Homo sapien
tgatacagggccacgccatgccagc

SEQ ID NO: 73207 - DNA, 25 bp, Homo sapien
agcccatacctgtacgacgtggtca

SEQ ID NO: 73208 - DNA, 25 bp, Homo sapien
ggcgtggtccacaagccgaagtccc

SEQ ID NO: 73209 - DNA, 25 bp, Homo sapien
cgaagtcccgctggtactgagtgag

SEQ ID NO: 73210 - DNA, 25 bp, Homo sapien
ccaggcagcacaggcggctgataca

SEQ ID NO: 73211 - DNA, 25 bp, Homo sapien
accggaaaccgcctgcattcattta

SEQ ID NO: 73212 - DNA, 25 bp, Homo sapien
tgtccatctcgaagaatgcctcaga

SEQ ID NO: 73213 - DNA, 25 bp, Homo sapien
gctcctcgctgtcgaggtccgagta

SEQ ID NO: 73214 - DNA, 25 bp, Homo sapien
ggcggctattacctgcgtccgagga

SEQ ID NO: 73215 - DNA, 25 bp, Homo sapien
tacacggccagagctcagggaccaa

SEQ ID NO: 73216 - DNA, 25 bp, Homo sapien
cccgaggatacacggccagagctca

SEQ ID NO: 73217 - DNA, 25 bp, Homo sapien
cttccggggcgaaggcaacaccata

SEQ ID NO: 73218 - DNA, 25 bp, Homo sapien
acaccatagagcacgaggagcagtc

SEQ ID NO: 73219 - DNA, 25 bp, Homo sapien
agcggcagccgaaccagccacggtg

SEQ ID NO: 73220 - DNA, 25 bp, Homo sapien
ggacgactggctggcgcccttctgt

SEQ ID NO: 73221 - DNA, 25 bp, Homo sapien
tcagggaccaagaggcgagaagacc

SEQ ID NO: 73222 - DNA, 25 bp, Homo sapien
tgggcgtttctctcagacccgcttc

SEQ ID NO: 73223 - DNA, 25 bp, Homo sapien
ggacgcggcgaaggactacatttcc

SEQ ID NO: 73224 - DNA, 25 bp, Homo sapien
agccctgcagcaaaacaagccttta

SEQ ID NO: 73225 - DNA, 25 bp, Homo sapien
gaaggtcatcgtagcccgcgtctaa

SEQ ID NO: 73226 - DNA, 25 bp, Homo sapien
aaccgtggccctgtgttcgcacaca

SEQ ID NO: 73227 - DNA, 25 bp, Homo sapien
tggaatcttctcaggggtcgtgttc

SEQ ID NO: 73228 - DNA, 25 bp, Homo sapien
gcgcaagcgcgctgcacaaagcatt

SEQ ID NO: 73229 - DNA, 25 bp, Homo sapien
tgcctctgcgagactgtctggaatc

SEQ ID NO: 73230 - DNA, 25 bp, Homo sapien
agcagttctggtggccgatagcttc

SEQ ID NO: 73231 - DNA, 25 bp, Homo sapien
ttcgtggcgaccacaagtcctatca

SEQ ID NO: 73232 - DNA, 25 bp, Homo sapien
aagaatctcggcttgttcacctaca

SEQ ID NO: 73233 - DNA, 25 bp, Homo sapien
tgaaggccgacgatacttgcagacc

SEQ ID NO: 73234 - DNA, 25 bp, Homo sapien
accgagtctgacatctatgggaccc

SEQ ID NO: 73235 - DNA, 25 bp, Homo sapien
tcgcatttcaagtgctggatccttt

SEQ ID NO: 73236 - DNA, 25 bp, Homo sapien
ttagtcgggctaacaagcgcagcgg

SEQ ID NO: 73237 - DNA, 25 bp, Homo sapien
ggcgattacagattcccgatggagc

SEQ ID NO: 73238 - DNA, 25 bp, Homo sapien
gtccgtttcgacttgcctcgctaca

SEQ ID NO: 73239 - DNA, 25 bp, Homo sapien
gccgctctggcttctaagggatgac

SEQ ID NO: 73240 - DNA, 25 bp, Homo sapien
cttcaagtctatggacgacgatttc

SEQ ID NO: 73241 - DNA, 25 bp, Homo sapien
agcgcgtcaccttggcggactttaa

SEQ ID NO: 73242 - DNA, 25 bp, Homo sapien
taccacttggatgggcaggagacgc

SEQ ID NO: 73243 - DNA, 25 bp, Homo sapien
ccatgggcgagaccaagatcatcta

SEQ ID NO: 73244 - DNA, 25 bp, Homo sapien
ggaacgccgccatcccggtgaatct

SEQ ID NO: 73245 - DNA, 25 bp, Homo sapien
gcgttttgcagcgacccagctataa

SEQ ID NO: 73246 - DNA, 25 bp, Homo sapien
agcgccagcagtcagcacagcgaag

SEQ ID NO: 73247 - DNA, 25 bp, Homo sapien
agcggcagcgaatcggaccacacca

SEQ ID NO: 73248 - DNA, 25 bp, Homo sapien
gctccaaccgtagcggcagcgatcg

SEQ ID NO: 73249 - DNA, 25 bp, Homo sapien
tcggagcagtggctccaaccgtagc

SEQ ID NO: 73250 - DNA, 25 bp, Homo sapien
tcagcacagcgaaggtaaggtagag

SEQ ID NO: 73251 - DNA, 25 bp, Homo sapien
ggcccatggctttcccgtaccagta

SEQ ID NO: 73252 - DNA, 25 bp, Homo sapien
cacgatcacgatggctccagtggcg

SEQ ID NO: 73253 - DNA, 25 bp, Homo sapien
ggccctgtttgcctcctacaggcag

SEQ ID NO: 73254 - DNA, 25 bp, Homo sapien
ttctcgaaggcagtcggtagttgta

SEQ ID NO: 73255 - DNA, 25 bp, Homo sapien
gtgacaggtctcacgccatgcggca

SEQ ID NO: 73256 - DNA, 25 bp, Homo sapien
tgagctggcggaaagctgcccacac

SEQ ID NO: 73257 - DNA, 25 bp, Homo sapien
tcccagagcaggaacgctgcgcagc

SEQ ID NO: 73258 - DNA, 25 bp, Homo sapien
ggataccgcttggaatcctcccaga

SEQ ID NO: 73259 - DNA, 25 bp, Homo sapien
ctggcgcctcccatgagagggatac

SEQ ID NO: 73260 - DNA, 25 bp, Homo sapien
agttttgctaaacctagagcgcttc

SEQ ID NO: 73261 - DNA, 25 bp, Homo sapien
ttcaaattgcaagcaaggaggccgc

SEQ ID NO: 73262 - DNA, 25 bp, Homo sapien
aatgtctaggagagaacggaggtgc

SEQ ID NO: 73263 - DNA, 25 bp, Homo sapien
tggccgtgtgagcccatatcccact

SEQ ID NO: 73264 - DNA, 25 bp, Homo sapien
cgaccttcccgtgctgctcggcctt

SEQ ID NO: 73265 - DNA, 25 bp, Homo sapien
cccacgcgacttccggcggcgccga

SEQ ID NO: 73266 - DNA, 25 bp, Homo sapien
cgcccgggacgagcttcccaggatt

SEQ ID NO: 73267 - DNA, 25 bp, Homo sapien
cgcgcgccataagttggagctcccg

SEQ ID NO: 73268 - DNA, 25 bp, Homo sapien
catatcccactctcacggcggtccc

SEQ ID NO: 73269 - DNA, 25 bp, Homo sapien
aggcacgcgcgccataagttggagc

SEQ ID NO: 73270 - DNA, 25 bp, Homo sapien
tgaaactgcttgtgtgtccacccta

SEQ ID NO: 73271 - DNA, 25 bp, Homo sapien
gcgagaaccgcacatgtggctaatc

SEQ ID NO: 73272 - DNA, 25 bp, Homo sapien
gggacccgcgaaagcaaagcactga

SEQ ID NO: 73273 - DNA, 25 bp, Homo sapien
caaaatgggcctgactgggtacgca

SEQ ID NO: 73274 - DNA, 25 bp, Homo sapien
tcctgagtggaacatggcgacttgc

SEQ ID NO: 73275 - DNA, 25 bp, Homo sapien
cgtgaccggtaagcagaactgaatc

SEQ ID NO: 73276 - DNA, 25 bp, Homo sapien
gtgccagcgcatgtacaacactctg

SEQ ID NO: 73277 - DNA, 25 bp, Homo sapien
cgccgaaatcctgcggagcgagttc

SEQ ID NO: 73278 - DNA, 25 bp, Homo sapien
tcccacatcagctctgccggggtag

SEQ ID NO: 73279 - DNA, 25 bp, Homo sapien
ggatcccgtgggcacctagaactcc

SEQ ID NO: 73280 - DNA, 25 bp, Homo sapien
gagtgagactctcgcgctggcctct

SEQ ID NO: 73281 - DNA, 25 bp, Homo sapien
cccaggtaacgcgtgaggatgccct

SEQ ID NO: 73282 - DNA, 25 bp, Homo sapien
gcgttaatcattaaccctccgcggc

SEQ ID NO: 73283 - DNA, 25 bp, Homo sapien
gccgaagcgcgcgttaatcattaac

SEQ ID NO: 73284 - DNA, 25 bp, Homo sapien
ttttcgctttcccagctcgttcttc

SEQ ID NO: 73285 - DNA, 25 bp, Homo sapien
gagcggtaacctggcggctcccacg

SEQ ID NO: 73286 - DNA, 25 bp, Homo sapien
tcggaagagcgctcatcactggctg

SEQ ID NO: 73287 - DNA, 25 bp, Homo sapien
cgagagacacctgcctaggacccta

SEQ ID NO: 73288 - DNA, 25 bp, Homo sapien
gccggtgacatcactcctgaagata

SEQ ID NO: 73289 - DNA, 25 bp, Homo sapien
gaccctacgcgtctggaagtctctc

SEQ ID NO: 73290 - DNA, 25 bp, Homo sapien
gtctctcccagtgaattgggtctca

SEQ ID NO: 73291 - DNA, 25 bp, Homo sapien
attgggtctcatctcctgccgagta

SEQ ID NO: 73292 - DNA, 25 bp, Homo sapien
tgccgagtacgcaagttcaattatc

SEQ ID NO: 73293 - DNA, 25 bp, Homo sapien
atcggcagattaggtttctactctc

SEQ ID NO: 73294 - DNA, 25 bp, Homo sapien
ggcctcattgccctgggcacttctg

SEQ ID NO: 73295 - DNA, 25 bp, Homo sapien
tgaaggcagcgaccatgactacctg

SEQ ID NO: 73296 - DNA, 25 bp, Homo sapien
actgacagcggccaaggctgattgc

SEQ ID NO: 73297 - DNA, 25 bp, Homo sapien
gggccgccgtcacaaactctgtagc

SEQ ID NO: 73298 - DNA, 25 bp, Homo sapien
actacctgcccttggtgaggactcg

SEQ ID NO: 73299 - DNA, 25 bp, Homo sapien
gggcgctgtttcagctcgcttctcc

SEQ ID NO: 73300 - DNA, 25 bp, Homo sapien
tgccttcgacgagtgggaactgaca

SEQ ID NO: 73301 - DNA, 25 bp, Homo sapien
gcacttgcctgacggccttgacctg

SEQ ID NO: 73302 - DNA, 25 bp, Homo sapien
agcagcgtgtagcgcggctcccgca

SEQ ID NO: 73303 - DNA, 25 bp, Homo sapien
gccatcttaacggtgcgccgcttgt

SEQ ID NO: 73304 - DNA, 25 bp, Homo sapien
ggaccggccgcgtttccgcagccca

SEQ ID NO: 73305 - DNA, 25 bp, Homo sapien
tgcttgcagagtccctctgcctggg

SEQ ID NO: 73306 - DNA, 25 bp, Homo sapien
agccattgcttgcagagtccctctg

SEQ ID NO: 73307 - DNA, 25 bp, Homo sapien
gtgcgccgcttgtgtgggcccacca

SEQ ID NO: 73308 - DNA, 25 bp, Homo sapien
agcaggcgccgctcttgccaggcgc

SEQ ID NO: 73309 - DNA, 25 bp, Homo sapien
gcgcgctgcagccattgcttgcaga

SEQ ID NO: 73310 - DNA, 25 bp, Homo sapien
gcatcctgccttccgtattggctga

SEQ ID NO: 73311 - DNA, 25 bp, Homo sapien
gcccgaggaccgtatccttgtgcta

SEQ ID NO: 73312 - DNA, 25 bp, Homo sapien
gtcgagtactgggatcagcgctacc

SEQ ID NO: 73313 - DNA, 25 bp, Homo sapien
ccacgtgtttgtgttgagcaactgc

SEQ ID NO: 73314 - DNA, 25 bp, Homo sapien
cggaggattcttcgaagagcgctta

SEQ ID NO: 73315 - DNA, 25 bp, Homo sapien
tccttgtgctaggtgggtaatcccg

SEQ ID NO: 73316 - DNA, 25 bp, Homo sapien
ccgcctgtctatccctcttggagga

SEQ ID NO: 73317 - DNA, 25 bp, Homo sapien
gacgatagttttcccagccggagga

SEQ ID NO: 73318 - DNA, 25 bp, Homo sapien
tcttggggaatagtaccagccaacc

SEQ ID NO: 73319 - DNA, 25 bp, Homo sapien
cggaatgacgatgagcgcccgactg

SEQ ID NO: 73320 - DNA, 25 bp, Homo sapien
atgaagtcatgcagcatccggggct

SEQ ID NO: 73321 - DNA, 25 bp, Homo sapien
ggaccggccctacctcagcagggga

SEQ ID NO: 73322 - DNA, 25 bp, Homo sapien
cgctgtagggcaggatctcggacat

SEQ ID NO: 73323 - DNA, 25 bp, Homo sapien
agcggcccatcttgtcttcgctgta

SEQ ID NO: 73324 - DNA, 25 bp, Homo sapien
cccgcgaagaaggagttggtgtcct

SEQ ID NO: 73325 - DNA, 25 bp, Homo sapien
tctgcttccagaggtggcgagcatc

SEQ ID NO: 73326 - DNA, 25 bp, Homo sapien
acgggccacgcttcgggatgaagac

SEQ ID NO: 73327 - DNA, 25 bp, Homo sapien
tcgggatgaagacgcacccgagacc

SEQ ID NO: 73328 - DNA, 25 bp, Homo sapien
gtggagtacaaacgggccacgcttc

SEQ ID NO: 73329 - DNA, 25 bp, Homo sapien
cgtgggcaaatagccctctctgcct

SEQ ID NO: 73330 - DNA, 25 bp, Homo sapien
cagggtcgtgggcaaatagccctct

SEQ ID NO: 73331 - DNA, 25 bp, Homo sapien
tccaccatgaacgtcgcgctgcagg

SEQ ID NO: 73332 - DNA, 25 bp, Homo sapien
agccctgaatcaccgcctggcccga

SEQ ID NO: 73333 - DNA, 25 bp, Homo sapien
tctgcctgacctcggttggcaaccc

SEQ ID NO: 73334 - DNA, 25 bp, Homo sapien
aatctagtttgtctgtcgcgccacg

SEQ ID NO: 73335 - DNA, 25 bp, Homo sapien
tcgcgccacgcagtcaactggagtg

SEQ ID NO: 73336 - DNA, 25 bp, Homo sapien
gtcactgtgggttctatttacaccg

SEQ ID NO: 73337 - DNA, 25 bp, Homo sapien
gtaaaactcggtaactccgctcgca

SEQ ID NO: 73338 - DNA, 25 bp, Homo sapien
gcagaccgcccatctacagcagtga

SEQ ID NO: 73339 - DNA, 25 bp, Homo sapien
atgccggggacaaggacaaagaaca

SEQ ID NO: 73340 - DNA, 25 bp, Homo sapien
aggcggcaatcaagcgtcctggacg

SEQ ID NO: 73341 - DNA, 25 bp, Homo sapien
gtcctggacgtcaagaaatctagtt

SEQ ID NO: 73342 - DNA, 25 bp, Homo sapien
acacgttgttctttggcactggccc

SEQ ID NO: 73343 - DNA, 25 bp, Homo sapien
cggcaggcctagcttctggcccagt

SEQ ID NO: 73344 - DNA, 25 bp, Homo sapien
caaatcccatgtgctcggcggcgca

SEQ ID NO: 73345 - DNA, 25 bp, Homo sapien
cgcctggccttttagggcctgactc

SEQ ID NO: 73346 - DNA, 25 bp, Homo sapien
ccggaaatggttgtggactacgtct

SEQ ID NO: 73347 - DNA, 25 bp, Homo sapien
cggactgaaggagactgaaggtaaa

SEQ ID NO: 73348 - DNA, 25 bp, Homo sapien
actgaaggtaaagccgccatgtccg

SEQ ID NO: 73349 - DNA, 25 bp, Homo sapien
aagcagctagctccgttcgtgatcc

SEQ ID NO: 73350 - DNA, 25 bp, Homo sapien
accggcttgatcgtgcgcggacacc

SEQ ID NO: 73351 - DNA, 25 bp, Homo sapien
tgcgcggacacctgctaccaagcgg

SEQ ID NO: 73352 - DNA, 25 bp, Homo sapien
acacctgctaccaagcggagcttca

SEQ ID NO: 73353 - DNA, 25 bp, Homo sapien
ccaagcggagcttcagcaaggaagt

SEQ ID NO: 73354 - DNA, 25 bp, Homo sapien
tgcgcaaggcagctagcctcacgga

SEQ ID NO: 73355 - DNA, 25 bp, Homo sapien
ctggagaccgaggagaccgcctaga

SEQ ID NO: 73356 - DNA, 25 bp, Homo sapien
tagcctcacggaggatcgggaccgt

SEQ ID NO: 73357 - DNA, 25 bp, Homo sapien
agcggagtagagaacggccctccca

SEQ ID NO: 73358 - DNA, 25 bp, Homo sapien
cccgaaagctttgcagtgcgcaggc

SEQ ID NO: 73359 - DNA, 25 bp, Homo sapien
ccatggccgcgaatgtgagtatccc

SEQ ID NO: 73360 - DNA, 25 bp, Homo sapien
gagtccacgcggattttcgaagctg

SEQ ID NO: 73361 - DNA, 25 bp, Homo sapien
atagtttccaggacgtctcgccgcg

SEQ ID NO: 73362 - DNA, 25 bp, Homo sapien
aggtactgcaatgtcccggaccgta

SEQ ID NO: 73363 - DNA, 25 bp, Homo sapien
tgcgcaggcgcatcaatgaggtact

SEQ ID NO: 73364 - DNA, 25 bp, Homo sapien
gggtcctctaggtccatttcgccgc

SEQ ID NO: 73365 - DNA, 25 bp, Homo sapien
ggcagctgcacctttacgccgtgac

SEQ ID NO: 73366 - DNA, 25 bp, Homo sapien
cctgccttcaggtggcagtcggctc

SEQ ID NO: 73367 - DNA, 25 bp, Homo sapien
gaggagaggaccggcattttcgaac

SEQ ID NO: 73368 - DNA, 25 bp, Homo sapien
ctctgcgtggctgtgacgtcgctgc

SEQ ID NO: 73369 - DNA, 25 bp, Homo sapien
cccgcctactttgggtggtgacgcg

SEQ ID NO: 73370 - DNA, 25 bp, Homo sapien
gaccctaccctctgcaaggcgatgg

SEQ ID NO: 73371 - DNA, 25 bp, Homo sapien
cagggcagacgcatggtctcgccgc

SEQ ID NO: 73372 - DNA, 25 bp, Homo sapien
cccggccatgggctgtatcggctct

SEQ ID NO: 73373 - DNA, 25 bp, Homo sapien
atggtctcgccgctggctgccgtgt

SEQ ID NO: 73374 - DNA, 25 bp, Homo sapien
gattgcagtgcgctcgctgaggctc

SEQ ID NO: 73375 - DNA, 25 bp, Homo sapien
cctcactgtggcactggacgcgcgg

SEQ ID NO: 73376 - DNA, 25 bp, Homo sapien
ggttgttcccagagtagccgctaag

SEQ ID NO: 73377 - DNA, 25 bp, Homo sapien
cggctacagcaggtgtcggattgca

SEQ ID NO: 73378 - DNA, 25 bp, Homo sapien
ccggaccttggagcgtctagagtct

SEQ ID NO: 73379 - DNA, 25 bp, Homo sapien
tagagtctggctactgttcctccgc

SEQ ID NO: 73380 - DNA, 25 bp, Homo sapien
ggcagctccctaagccggctgggac

SEQ ID NO: 73381 - DNA, 25 bp, Homo sapien
catgacaacgacaccggcgggcgcg

SEQ ID NO: 73382 - DNA, 25 bp, Homo sapien
gcatcccgggccgtatcccgggaga

SEQ ID NO: 73383 - DNA, 25 bp, Homo sapien
cccgtgccggtctgctctgctcggc

SEQ ID NO: 73384 - DNA, 25 bp, Homo sapien
gacgtcagcgcatcccgggccgtat

SEQ ID NO: 73385 - DNA, 25 bp, Homo sapien
accctgttgcgtggtgatgggttgc

SEQ ID NO: 73386 - DNA, 25 bp, Homo sapien
gttgccagggagacatacacctttt

SEQ ID NO: 73387 - DNA, 25 bp, Homo sapien
gagacatacaccttttctctgggcc

SEQ ID NO: 73388 - DNA, 25 bp, Homo sapien
gccagggagacatacaccttttctc

SEQ ID NO: 73389 - DNA, 25 bp, Homo sapien
tctgctcggcgctgtgccagcaggc

SEQ ID NO: 73390 - DNA, 25 bp, Homo sapien
ccagcaccaggagtaaggggcattt

SEQ ID NO: 73391 - DNA, 25 bp, Homo sapien
gccttgtgatagaagccagcactca

SEQ ID NO: 73392 - DNA, 25 bp, Homo sapien
gcaggctttcctcttctccatagcg

SEQ ID NO: 73393 - DNA, 25 bp, Homo sapien
catagcgacgtcatggcaaattccc

SEQ ID NO: 73394 - DNA, 25 bp, Homo sapien
ttcccaaactggacggatccggctc

SEQ ID NO: 73395 - DNA, 25 bp, Homo sapien
cccgtcaggggtgaaaagcaaagct

SEQ ID NO: 73396 - DNA, 25 bp, Homo sapien
ggaggaacccaagtcgctgcttcca

SEQ ID NO: 73397 - DNA, 25 bp, Homo sapien
tccgaagagacgagcggcccagaca

SEQ ID NO: 73398 - DNA, 25 bp, Homo sapien
agggtaagtcttgctccgccctgcg

SEQ ID NO: 73399 - DNA, 25 bp, Homo sapien
cacgatactaggtcccgggccactt

SEQ ID NO: 73400 - DNA, 25 bp, Homo sapien
gtcggactggcctttcccatggcca

SEQ ID NO: 73401 - DNA, 25 bp, Homo sapien
tggccagctgaagcccgtgttctta

SEQ ID NO: 73402 - DNA, 25 bp, Homo sapien
cggcctgtccttcgagtatccgcgg

SEQ ID NO: 73403 - DNA, 25 bp, Homo sapien
ggacccggagcatcgcagttatagc

SEQ ID NO: 73404 - DNA, 25 bp, Homo sapien
tgggccaccaaagcggcgtttgaca

SEQ ID NO: 73405 - DNA, 25 bp, Homo sapien
gtttgacagtgctcaggccatcttc

SEQ ID NO: 73406 - DNA, 25 bp, Homo sapien
acacatgcttcttcgaggggcagca

SEQ ID NO: 73407 - DNA, 25 bp, Homo sapien
tgcctggtctcccggccctagcgcc

SEQ ID NO: 73408 - DNA, 25 bp, Homo sapien
ccaacacatgcttcttcgaggggca

SEQ ID NO: 73409 - DNA, 25 bp, Homo sapien
ctgcgccgcctgtggtgcctggtct

SEQ ID NO: 73410 - DNA, 25 bp, Homo sapien
ccggatacagcctctgctgcgccgc

SEQ ID NO: 73411 - DNA, 25 bp, Homo sapien
gctccggatacagcctctgctgcgc

SEQ ID NO: 73412 - DNA, 25 bp, Homo sapien
ccgccaaacctggtggtcctgggcg

SEQ ID NO: 73413 - DNA, 25 bp, Homo sapien
aacacatgcttcttcgaggggcagc

SEQ ID NO: 73414 - DNA, 25 bp, Homo sapien
tcagccttctggacccggtacctcc

SEQ ID NO: 73415 - DNA, 25 bp, Homo sapien
cagcagccccaggacggacgggtac

SEQ ID NO: 73416 - DNA, 25 bp, Homo sapien
tccctcgggcgctagctctggaaat

SEQ ID NO: 73417 - DNA, 25 bp, Homo sapien
ggcgctagctctggaaatcgcgcta

SEQ ID NO: 73418 - DNA, 25 bp, Homo sapien
agctctggaaatcgcgctaggcaga

SEQ ID NO: 73419 - DNA, 25 bp, Homo sapien
cagaggtgggcttgtgtccgcaccc

SEQ ID NO: 73420 - DNA, 25 bp, Homo sapien
ctccgcgtcaacaccctaggggaga

SEQ ID NO: 73421 - DNA, 25 bp, Homo sapien
gtgggcttgtgtccgcacccgcagc

SEQ ID NO: 73422 - DNA, 25 bp, Homo sapien
acctgagcaggggaattaaatctcc

SEQ ID NO: 73423 - DNA, 25 bp, Homo sapien
ttaaatctccggagcgtcacccgtg

SEQ ID NO: 73424 - DNA, 25 bp, Homo sapien
ggacgcttcgtcctgcagttgaacg

SEQ ID NO: 73425 - DNA, 25 bp, Homo sapien
tagggtctatgagctcctctgcagc

SEQ ID NO: 73426 - DNA, 25 bp, Homo sapien
agaaccagtctacgcggacgccgga

SEQ ID NO: 73427 - DNA, 25 bp, Homo sapien
tctagtgggcgagctttgaacttcc

SEQ ID NO: 73428 - DNA, 25 bp, Homo sapien
tgaacttccctgaggccctacactg

SEQ ID NO: 73429 - DNA, 25 bp, Homo sapien
gtgtcttctgggaaacgcgccaatg

SEQ ID NO: 73430 - DNA, 25 bp, Homo sapien
tataaagggagaaccgccttgctgc

SEQ ID NO: 73431 - DNA, 25 bp, Homo sapien
atcgcccttcctacgcactcagatc

SEQ ID NO: 73432 - DNA, 25 bp, Homo sapien
tgatcctcggggactgagcgcccat

SEQ ID NO: 73433 - DNA, 25 bp, Homo sapien
cccaaagggtcccgcaggtgatcct

SEQ ID NO: 73434 - DNA, 25 bp, Homo sapien
cccagagagtcctcggggtcagagt

SEQ ID NO: 73435 - DNA, 25 bp, Homo sapien
tcagagtggtcacgtcaccgtcatt

SEQ ID NO: 73436 - DNA, 25 bp, Homo sapien
cgtcattcttttcctgcccgactag

SEQ ID NO: 73437 - DNA, 25 bp, Homo sapien
tcacgtcaccgtcattcttttcctg

SEQ ID NO: 73438 - DNA, 25 bp, Homo sapien
gattactgtgcatcccgaatcacga

SEQ ID NO: 73439 - DNA, 25 bp, Homo sapien
cacactcacggcagagaagtggggc

SEQ ID NO: 73440 - DNA, 25 bp, Homo sapien
tccgacccggattgagcgcacgtcg

SEQ ID NO: 73441 - DNA, 25 bp, Homo sapien
gctcctagagctgccacggccatgg

SEQ ID NO: 73442 - DNA, 25 bp, Homo sapien
tggatctcctgggacccgacgcgag

SEQ ID NO: 73443 - DNA, 25 bp, Homo sapien
tgagcggcgcagcaagatcccagct

SEQ ID NO: 73444 - DNA, 25 bp, Homo sapien
ggattgcattccctcctctcctgga

SEQ ID NO: 73445 - DNA, 25 bp, Homo sapien
cagctgaccgccagattactgtgca

SEQ ID NO: 73446 - DNA, 25 bp, Homo sapien
ctcggtctccctgtctttgtagtca

SEQ ID NO: 73447 - DNA, 25 bp, Homo sapien
gtctctcggtctccctgtctttgta

SEQ ID NO: 73448 - DNA, 25 bp, Homo sapien
tccctgtctttgtagtcagccgccg

SEQ ID NO: 73449 - DNA, 25 bp, Homo sapien
tctttgtagtcagccgccggccatc

SEQ ID NO: 73450 - DNA, 25 bp, Homo sapien
tccgcacatccctccggctccgtgc

SEQ ID NO: 73451 - DNA, 25 bp, Homo sapien
ggcttctgagcatctcggcttccct

SEQ ID NO: 73452 - DNA, 25 bp, Homo sapien
tgagcatctcggcttccctcgagta

SEQ ID NO: 73453 - DNA, 25 bp, Homo sapien
ctcccgggactgacactcgcgctgc

SEQ ID NO: 73454 - DNA, 25 bp, Homo sapien
ccgagccatgttgcttgtctgggca

SEQ ID NO: 73455 - DNA, 25 bp, Homo sapien
tggccactaaaaaactgcgggaagc

SEQ ID NO: 73456 - DNA, 25 bp, Homo sapien
aaaccgctctgggtgcgcaggacaa

SEQ ID NO: 73457 - DNA, 25 bp, Homo sapien
ccttggatttctggctgcgcagttc

SEQ ID NO: 73458 - DNA, 25 bp, Homo sapien
caggtttctctctatttccggtgta

SEQ ID NO: 73459 - DNA, 25 bp, Homo sapien
tgaaacatggcggacgacgtagacc

SEQ ID NO: 73460 - DNA, 25 bp, Homo sapien
cgtttccggagattgacgttgctct

SEQ ID NO: 73461 - DNA, 25 bp, Homo sapien
ccggtgtattgtatcctcacgtttc

SEQ ID NO: 73462 - DNA, 25 bp, Homo sapien
ggcctctgaatcatgggcatcttca

SEQ ID NO: 73463 - DNA, 25 bp, Homo sapien
tgcagtcagcagagaaaccggcgta

SEQ ID NO: 73464 - DNA, 25 bp, Homo sapien
gtgcgcccgtcatagggactgagca

SEQ ID NO: 73465 - DNA, 25 bp, Homo sapien
attcctctcaggctcgccactttgg

SEQ ID NO: 73466 - DNA, 25 bp, Homo sapien
cgacctggtggaattgctgcagctc

SEQ ID NO: 73467 - DNA, 25 bp, Homo sapien
ggccaaggggagacaacagcgacct

SEQ ID NO: 73468 - DNA, 25 bp, Homo sapien
atctggcccgccaagttcaaactgg

SEQ ID NO: 73469 - DNA, 25 bp, Homo sapien
cctcgtcaaactggaagctctggtg

SEQ ID NO: 73470 - DNA, 25 bp, Homo sapien
tccgtgcgcgccttctacaagaagt

SEQ ID NO: 73471 - DNA, 25 bp, Homo sapien
agaagtgtgcatccaccaccgcagg

SEQ ID NO: 73472 - DNA, 25 bp, Homo sapien
tgcatgtcgctcatctccgtgcgcg

SEQ ID NO: 73473 - DNA, 25 bp, Homo sapien
ggtcattgctcctggcacctgcatc

SEQ ID NO: 73474 - DNA, 25 bp, Homo sapien
tgggccactttccaaggctggcttc

SEQ ID NO: 73475 - DNA, 25 bp, Homo sapien
ctgcatccctaacgccgtggaggtg

SEQ ID NO: 73476 - DNA, 25 bp, Homo sapien
gatgccggccgtgtcaacaccaagg

SEQ ID NO: 73477 - DNA, 25 bp, Homo sapien
tgtcggtgccactcaagctctactg

SEQ ID NO: 73478 - DNA, 25 bp, Homo sapien
caagatcgtggtcgtttagcgccaa

SEQ ID NO: 73479 - DNA, 25 bp, Homo sapien
aaccacacgatcaggggaactcttg

SEQ ID NO: 73480 - DNA, 25 bp, Homo sapien
gcctggaagcatgcgaccgtgattt

SEQ ID NO: 73481 - DNA, 25 bp, Homo sapien
cgcataggtgtgacatcgccctcta

SEQ ID NO: 73482 - DNA, 25 bp, Homo sapien
ccctgacctttatagcgggagtctg

SEQ ID NO: 73483 - DNA, 25 bp, Homo sapien
gagctcctgctcaagggtccacttc

SEQ ID NO: 73484 - DNA, 25 bp, Homo sapien
accgtgatttcaggctctggggtga

SEQ ID NO: 73485 - DNA, 25 bp, Homo sapien
cttcccaggggaaatctaagcgaga

SEQ ID NO: 73486 - DNA, 25 bp, Homo sapien
acctttgatctgcaaccttcagggg

SEQ ID NO: 73487 - DNA, 25 bp, Homo sapien
tgacctcccagtctgccgcccgggc

SEQ ID NO: 73488 - DNA, 25 bp, Homo sapien
gcctcgtacaagcacctttgatctg

SEQ ID NO: 73489 - DNA, 25 bp, Homo sapien
gattaagagcctgagagcccccctc

SEQ ID NO: 73490 - DNA, 25 bp, Homo sapien
aaccttcagggggattaagagcctg

SEQ ID NO: 73491 - DNA, 25 bp, Homo sapien
ctcggcctcgtacaagcacctttga

SEQ ID NO: 73492 - DNA, 25 bp, Homo sapien
ccacttggattacaggggcagcagc

SEQ ID NO: 73493 - DNA, 25 bp, Homo sapien
cacctccgggcaggccacttggatt

SEQ ID NO: 73494 - DNA, 25 bp, Homo sapien
gttatctctgcggagatccgccgcc

SEQ ID NO: 73495 - DNA, 25 bp, Homo sapien
gtatttatacagctgcggcccctcg

SEQ ID NO: 73496 - DNA, 25 bp, Homo sapien
cttgactgggttatctctgcggaga

SEQ ID NO: 73497 - DNA, 25 bp, Homo sapien
tgggttatctctgcggagatccgcc

SEQ ID NO: 73498 - DNA, 25 bp, Homo sapien
cccggtatttatacagctgcggccc

SEQ ID NO: 73499 - DNA, 25 bp, Homo sapien
ggagaaagaaaaggcttagcacacg

SEQ ID NO: 73500 - DNA, 25 bp, Homo sapien
gaaaaggcttagcacacggtcccac

SEQ ID NO: 73501 - DNA, 25 bp, Homo sapien
gactgggttatctctgcggagatcc

SEQ ID NO: 73502 - DNA, 25 bp, Homo sapien
aaccgagatggtggctgcagaaacc

SEQ ID NO: 73503 - DNA, 25 bp, Homo sapien
acgttcagtagtcggacctgggcca

SEQ ID NO: 73504 - DNA, 25 bp, Homo sapien
ggcacagcggccactctttctgaga

SEQ ID NO: 73505 - DNA, 25 bp, Homo sapien
cggccactctttctgagaggcagag

SEQ ID NO: 73506 - DNA, 25 bp, Homo sapien
gcagaggtcggtgggctccaccctc

SEQ ID NO: 73507 - DNA, 25 bp, Homo sapien
tgctccgggcttgctgacggtacag

SEQ ID NO: 73508 - DNA, 25 bp, Homo sapien
ccctggctgggcgagaaaccgagat

SEQ ID NO: 73509 - DNA, 25 bp, Homo sapien
ttttcatcagatctcgtctcccgca

SEQ ID NO: 73510 - DNA, 25 bp, Homo sapien
gggccgcaccgcacgggagtcaaac

SEQ ID NO: 73511 - DNA, 25 bp, Homo sapien
aggccctcgcgcctttccgggtgag

SEQ ID NO: 73512 - DNA, 25 bp, Homo sapien
agccaggacggcgaccctagtgccg

SEQ ID NO: 73513 - DNA, 25 bp, Homo sapien
cgggagtcaaacctgcggccgcaac

SEQ ID NO: 73514 - DNA, 25 bp, Homo sapien
ccttgccaaggctttggccgccaag

SEQ ID NO: 73515 - DNA, 25 bp, Homo sapien
accgtccgattcagccggcggtagg

SEQ ID NO: 73516 - DNA, 25 bp, Homo sapien
gcaacatgttttcgggcaggcaggt

SEQ ID NO: 73517 - DNA, 25 bp, Homo sapien
cctgctctctggtgtctgcaacatg

SEQ ID NO: 73518 - DNA, 25 bp, Homo sapien
tccacggccggaatggcagcaagct

SEQ ID NO: 73519 - DNA, 25 bp, Homo sapien
tggcagcaagctcaggtaacgagtt

SEQ ID NO: 73520 - DNA, 25 bp, Homo sapien
tcaggtaacgagtttccagagagcg

SEQ ID NO: 73521 - DNA, 25 bp, Homo sapien
agagcgcgcgacaggtctctgagcc

SEQ ID NO: 73522 - DNA, 25 bp, Homo sapien
aggtctctgagcctcggcgtctcct

SEQ ID NO: 73523 - DNA, 25 bp, Homo sapien
tgacgggctaaccggacccgagcca

SEQ ID NO: 73524 - DNA, 25 bp, Homo sapien
cgtgtcgtacgttggcccggaactg

SEQ ID NO: 73525 - DNA, 25 bp, Homo sapien
gacggcgtatctctggccctttaaa

SEQ ID NO: 73526 - DNA, 25 bp, Homo sapien
tggccaccgagaactgacacacgcg

SEQ ID NO: 73527 - DNA, 25 bp, Homo sapien
ctcggccgctttgtactcacatgca

SEQ ID NO: 73528 - DNA, 25 bp, Homo sapien
agacgcggctcgacttacagtgaca

SEQ ID NO: 73529 - DNA, 25 bp, Homo sapien
ggccgtggtgaacacacactcctcg

SEQ ID NO: 73530 - DNA, 25 bp, Homo sapien
gtcacagcgaggtcctcctcacata

SEQ ID NO: 73531 - DNA, 25 bp, Homo sapien
taggtgacagcaccagtgcagcttg

SEQ ID NO: 73532 - DNA, 25 bp, Homo sapien
catcgcgtagcgaggatctcacaca

SEQ ID NO: 73533 - DNA, 25 bp, Homo sapien
cagggcctgagcctcatctagtttc

SEQ ID NO: 73534 - DNA, 25 bp, Homo sapien
gagagtcaaagcctccggagccaga

SEQ ID NO: 73535 - DNA, 25 bp, Homo sapien
tgtttcctctatcaccgagggcacc

SEQ ID NO: 73536 - DNA, 25 bp, Homo sapien
cgtatactcggccatgtttcctcta

SEQ ID NO: 73537 - DNA, 25 bp, Homo sapien
aaggcgttgtgcagccgcgtatact

SEQ ID NO: 73538 - DNA, 25 bp, Homo sapien
cggattagcgccaaggcgttgtgca

SEQ ID NO: 73539 - DNA, 25 bp, Homo sapien
acctgatcgcgttgaccggcgggtt

SEQ ID NO: 73540 - DNA, 25 bp, Homo sapien
cgagcccgttacctgatcgcgttga

SEQ ID NO: 73541 - DNA, 25 bp, Homo sapien
ctcgccgtcaggcaaaccacttttc

SEQ ID NO: 73542 - DNA, 25 bp, Homo sapien
cgacaggtaacctgcgggcggatct

SEQ ID NO: 73543 - DNA, 25 bp, Homo sapien
tggcctagatcgctcggggccctaa

SEQ ID NO: 73544 - DNA, 25 bp, Homo sapien
ggcggagaagcaaaccggcgaaata

SEQ ID NO: 73545 - DNA, 25 bp, Homo sapien
tgccaggtgaactcaaagacaggtc

SEQ ID NO: 73546 - DNA, 25 bp, Homo sapien
agacaggtcggaagtgacgtcacta

SEQ ID NO: 73547 - DNA, 25 bp, Homo sapien
acgtcactagccgagtcgggcgctc

SEQ ID NO: 73548 - DNA, 25 bp, Homo sapien
cgacaagcaagatctggagcgcatc

SEQ ID NO: 73549 - DNA, 25 bp, Homo sapien
gacgtggcgcacaggaagttacgca

SEQ ID NO: 73550 - DNA, 25 bp, Homo sapien
agctgtgaacgaagaaggcgtcccg

SEQ ID NO: 73551 - DNA, 25 bp, Homo sapien
ttggaattttggcgggttcagctgt

SEQ ID NO: 73552 - DNA, 25 bp, Homo sapien
cgtccaatgacgtaaaccaatccga

SEQ ID NO: 73553 - DNA, 25 bp, Homo sapien
ccaatccgattgctctgtgccaggg

SEQ ID NO: 73554 - DNA, 25 bp, Homo sapien
ctggcgtagccagtcagtgctgccc

SEQ ID NO: 73555 - DNA, 25 bp, Homo sapien
tcgcacgtctctgcgcgggttgcaa

SEQ ID NO: 73556 - DNA, 25 bp, Homo sapien
ttcagctgtgaacgaagaaggcgtc

SEQ ID NO: 73557 - DNA, 25 bp, Homo sapien
ccgggattcgctggcgtagccagtc

SEQ ID NO: 73558 - DNA, 25 bp, Homo sapien
aaattagtcggctgcagtggcgcgc

SEQ ID NO: 73559 - DNA, 25 bp, Homo sapien
gacgcacatcctagctctttcaaac

SEQ ID NO: 73560 - DNA, 25 bp, Homo sapien
ccaagcacatagacgcacatcctag

SEQ ID NO: 73561 - DNA, 25 bp, Homo sapien
ctcagcgtggtccagttaaaccgta

SEQ ID NO: 73562 - DNA, 25 bp, Homo sapien
cccaaacttgaggttccaacgctgc

SEQ ID NO: 73563 - DNA, 25 bp, Homo sapien
agaacccgactcagcggtgccggtg

SEQ ID NO: 73564 - DNA, 25 bp, Homo sapien
aacaggccggcgagagaacccgact

SEQ ID NO: 73565 - DNA, 25 bp, Homo sapien
ccacaagttgccacaggggagcgaa

SEQ ID NO: 73566 - DNA, 25 bp, Homo sapien
ctcctggaggcactgacgcccgcag

SEQ ID NO: 73567 - DNA, 25 bp, Homo sapien
gcatcccgctgtgtgatcgggcacg

SEQ ID NO: 73568 - DNA, 25 bp, Homo sapien
tgacgcccgcagatgggcaggggat

SEQ ID NO: 73569 - DNA, 25 bp, Homo sapien
tcctggccctgcgtgggcgaacacg

SEQ ID NO: 73570 - DNA, 25 bp, Homo sapien
agccgtgagaacacccgggaagcgc

SEQ ID NO: 73571 - DNA, 25 bp, Homo sapien
cgcgcagagccgtgagaacacccgg

SEQ ID NO: 73572 - DNA, 25 bp, Homo sapien
gcgtgggcgaacacgtgcaggccct

SEQ ID NO: 73573 - DNA, 25 bp, Homo sapien
cgtggagcgcatcccgctgtgtgat

SEQ ID NO: 73574 - DNA, 25 bp, Homo sapien
ccacttattctgcaggcatggcgcg

SEQ ID NO: 73575 - DNA, 25 bp, Homo sapien
ccagtccgataagtgaacctcaatt

SEQ ID NO: 73576 - DNA, 25 bp, Homo sapien
acccttctgtccgagaccgtgcgga

SEQ ID NO: 73577 - DNA, 25 bp, Homo sapien
agtcgcgtcgacagcaagtacaagg

SEQ ID NO: 73578 - DNA, 25 bp, Homo sapien
agaagctcacttgcactccgggacg

SEQ ID NO: 73579 - DNA, 25 bp, Homo sapien
agcacgttcactgacggaccaggga

SEQ ID NO: 73580 - DNA, 25 bp, Homo sapien
cgccctctctgtccttcggtggaga

SEQ ID NO: 73581 - DNA, 25 bp, Homo sapien
ccgtctgtctgtgcttgtttttcta

SEQ ID NO: 73582 - DNA, 25 bp, Homo sapien
tggctccgccgaagagaaaaccctg

SEQ ID NO: 73583 - DNA, 25 bp, Homo sapien
tcctcggccgtgatagctttgattc

SEQ ID NO: 73584 - DNA, 25 bp, Homo sapien
gggctcttgaatcgcgtcacaaatc

SEQ ID NO: 73585 - DNA, 25 bp, Homo sapien
tgcgcagattgagaatggagctttc

SEQ ID NO: 73586 - DNA, 25 bp, Homo sapien
ttcagccaggctcacccgaaacagg

SEQ ID NO: 73587 - DNA, 25 bp, Homo sapien
ttactcttgttgctgggctcggaaa

SEQ ID NO: 73588 - DNA, 25 bp, Homo sapien
ttccgatctcgtcagcgattgggcc

SEQ ID NO: 73589 - DNA, 25 bp, Homo sapien
cgggaccgtcccacaattactcttg

SEQ ID NO: 73590 - DNA, 25 bp, Homo sapien
agcctcgggagccttcggagcggca

SEQ ID NO: 73591 - DNA, 25 bp, Homo sapien
aggaagagacgctggatttggggaa

SEQ ID NO: 73592 - DNA, 25 bp, Homo sapien
tctccctctcaaggcggtggcggga

SEQ ID NO: 73593 - DNA, 25 bp, Homo sapien
tctctccctctcaaggcggtggcgg

SEQ ID NO: 73594 - DNA, 25 bp, Homo sapien
gcgcgcggacaaagcgctctctctg

SEQ ID NO: 73595 - DNA, 25 bp, Homo sapien
gctgagtgctcacccgagagggtct

SEQ ID NO: 73596 - DNA, 25 bp, Homo sapien
ggccgcgctgagtgctcacccgaga

SEQ ID NO: 73597 - DNA, 25 bp, Homo sapien
agaagtgagacaggggacgctcaaa

SEQ ID NO: 73598 - DNA, 25 bp, Homo sapien
ggcactaaggcactatccacaaagg

SEQ ID NO: 73599 - DNA, 25 bp, Homo sapien
tccgtcctttccgtggaggcaaaga

SEQ ID NO: 73600 - DNA, 25 bp, Homo sapien
cgggctctaactctaccggatgtga

SEQ ID NO: 73601 - DNA, 25 bp, Homo sapien
gtcgccggtcgatgtgcttcaatcg

SEQ ID NO: 73602 - DNA, 25 bp, Homo sapien
tcgctcatgactcctggctgctgtc

SEQ ID NO: 73603 - DNA, 25 bp, Homo sapien
tacgtacccgctcgccgtagttctg

SEQ ID NO: 73604 - DNA, 25 bp, Homo sapien
gccgacgggcctagaaaaagatgca

SEQ ID NO: 73605 - DNA, 25 bp, Homo sapien
tcccgcacaggaagtgacgtgaccc

SEQ ID NO: 73606 - DNA, 25 bp, Homo sapien
cgattttctcgagtcgccgcacagc

SEQ ID NO: 73607 - DNA, 25 bp, Homo sapien
caccctctgaaaatgcggccggaac

SEQ ID NO: 73608 - DNA, 25 bp, Homo sapien
acctgaaacttgcaaggcctgcgta

SEQ ID NO: 73609 - DNA, 25 bp, Homo sapien
gcctgcgtaagttcctggtcgaccc

SEQ ID NO: 73610 - DNA, 25 bp, Homo sapien
ctcggggctctcgaatctccagaga

SEQ ID NO: 73611 - DNA, 25 bp, Homo sapien
actgtgaaagcctcgcaactccgcg

SEQ ID NO: 73612 - DNA, 25 bp, Homo sapien
tgaatcagcccgtgaactctagccg

SEQ ID NO: 73613 - DNA, 25 bp, Homo sapien
ttcataaaaacgaggtgcggcgccc

SEQ ID NO: 73614 - DNA, 25 bp, Homo sapien
gcctgcgtgcccattctccagagtt

SEQ ID NO: 73615 - DNA, 25 bp, Homo sapien
tcctgcgccgtgacctcaaaagggc

SEQ ID NO: 73616 - DNA, 25 bp, Homo sapien
tcacagaattctaggcagaggccgc

SEQ ID NO: 73617 - DNA, 25 bp, Homo sapien
agacgcgctagggaacttgtaatcc

SEQ ID NO: 73618 - DNA, 25 bp, Homo sapien
cgcatgaaatcgtgctcctgggtgc

SEQ ID NO: 73619 - DNA, 25 bp, Homo sapien
ctccaactgttccatgacgtcatcg

SEQ ID NO: 73620 - DNA, 25 bp, Homo sapien
gcctcgcgatcgtgcactgatttcc

SEQ ID NO: 73621 - DNA, 25 bp, Homo sapien
gcgggttcccgagctaaatcctcca

SEQ ID NO: 73622 - DNA, 25 bp, Homo sapien
taccaagttgctgcaccgggtgctc

SEQ ID NO: 73623 - DNA, 25 bp, Homo sapien
ggaaatccgaccagttgctttagca

SEQ ID NO: 73624 - DNA, 25 bp, Homo sapien
cctggagcgcgaactggatatcaag

SEQ ID NO: 73625 - DNA, 25 bp, Homo sapien
gcggccagacattaggaaaagcatc

SEQ ID NO: 73626 - DNA, 25 bp, Homo sapien
ccgtgttcgcttcagcttcccttta

SEQ ID NO: 73627 - DNA, 25 bp, Homo sapien
gacacatcttgtgactctgagacta

SEQ ID NO: 73628 - DNA, 25 bp, Homo sapien
ggggcagcacgtcaaatcacctgta

SEQ ID NO: 73629 - DNA, 25 bp, Homo sapien
tagtcccaagctttccactgcagtg

SEQ ID NO: 73630 - DNA, 25 bp, Homo sapien
gtagctgacccgagacgcggtaagc

SEQ ID NO: 73631 - DNA, 25 bp, Homo sapien
cacagacgctcacgctgacagggtc

SEQ ID NO: 73632 - DNA, 25 bp, Homo sapien
tcgacccaagcctgaagcctgacta

SEQ ID NO: 73633 - DNA, 25 bp, Homo sapien
cagtgcgcggttacctgctaatgca

SEQ ID NO: 73634 - DNA, 25 bp, Homo sapien
tgcggctcaagcgtctgagaaaatc

SEQ ID NO: 73635 - DNA, 25 bp, Homo sapien
tggagccagacccaccgctttctgg

SEQ ID NO: 73636 - DNA, 25 bp, Homo sapien
cgctttctggtgtcgcgcctttcaa

SEQ ID NO: 73637 - DNA, 25 bp, Homo sapien
cgcgaccggacttcaggaacacaga

SEQ ID NO: 73638 - DNA, 25 bp, Homo sapien
ctgacgtctccgcttctaattggtc

SEQ ID NO: 73639 - DNA, 25 bp, Homo sapien
ctgtctctgcggaccaaggagaccc

SEQ ID NO: 73640 - DNA, 25 bp, Homo sapien
ggcaacgattggctctcgcctaccg

SEQ ID NO: 73641 - DNA, 25 bp, Homo sapien
gtgaagtgtactgcgctgattggct

SEQ ID NO: 73642 - DNA, 25 bp, Homo sapien
attttctacgactcgcggtagctca

SEQ ID NO: 73643 - DNA, 25 bp, Homo sapien
aagcctaactggttgcccgtgccgc

SEQ ID NO: 73644 - DNA, 25 bp, Homo sapien
gcgactgcagttctgaagcctaact

SEQ ID NO: 73645 - DNA, 25 bp, Homo sapien
ctaattggtcaagagctgcgactgc

SEQ ID NO: 73646 - DNA, 25 bp, Homo sapien
gcccgcactcacagcgcttgggtga

SEQ ID NO: 73647 - DNA, 25 bp, Homo sapien
gctcttcaaggttgcagagcgcagc

SEQ ID NO: 73648 - DNA, 25 bp, Homo sapien
aaacacccagactctggctcgctgt

SEQ ID NO: 73649 - DNA, 25 bp, Homo sapien
tggcctctcaatgcagcggctcttc

SEQ ID NO: 73650 - DNA, 25 bp, Homo sapien
gctgctccatggacgcgcagaggca

SEQ ID NO: 73651 - DNA, 25 bp, Homo sapien
gggttgcacgctctggttcccaaac

SEQ ID NO: 73652 - DNA, 25 bp, Homo sapien
ttcccttctagggttgcacgctctg

SEQ ID NO: 73653 - DNA, 25 bp, Homo sapien
tgcagcggctcttcaaggttgcaga

SEQ ID NO: 73654 - DNA, 25 bp, Homo sapien
gattattcacgtggggactcgcttc

SEQ ID NO: 73655 - DNA, 25 bp, Homo sapien
tgacccagccaagcagatgttcagg

SEQ ID NO: 73656 - DNA, 25 bp, Homo sapien
ctcctcggcatgcaggcagcgctgg

SEQ ID NO: 73657 - DNA, 25 bp, Homo sapien
ccggcggagcccgattattcacgtg

SEQ ID NO: 73658 - DNA, 25 bp, Homo sapien
tgaccttctgacatccgctgtgagc

SEQ ID NO: 73659 - DNA, 25 bp, Homo sapien
ggagcagagcgacctgaccttctga

SEQ ID NO: 73660 - DNA, 25 bp, Homo sapien
gcccgggcattgtcatagcagctga

SEQ ID NO: 73661 - DNA, 25 bp, Homo sapien
cacgtgcttacgacccggaagtccg

SEQ ID NO: 73662 - DNA, 25 bp, Homo sapien
gcctcatcctaggagcctggcggaa

SEQ ID NO: 73663 - DNA, 25 bp, Homo sapien
tgccgcacctggcaacgaacgttcg

SEQ ID NO: 73664 - DNA, 25 bp, Homo sapien
ggcataccgagtctcccagaacgtg

SEQ ID NO: 73665 - DNA, 25 bp, Homo sapien
ccctggcacagcctgagcagatgct

SEQ ID NO: 73666 - DNA, 25 bp, Homo sapien
agctgttcacccagcgggtcagaga

SEQ ID NO: 73667 - DNA, 25 bp, Homo sapien
ttcaccaccgcggaagggaccgaga

SEQ ID NO: 73668 - DNA, 25 bp, Homo sapien
cgaggtcaggaagaagccgcttata

SEQ ID NO: 73669 - DNA, 25 bp, Homo sapien
tggtatttttccacccagcaggatg

SEQ ID NO: 73670 - DNA, 25 bp, Homo sapien
ccctaggatttccagcgaccctgta

SEQ ID NO: 73671 - DNA, 25 bp, Homo sapien
tcacaattttgtagctgaccgaagc

SEQ ID NO: 73672 - DNA, 25 bp, Homo sapien
ccgaagcacggcgagaaaattcctc

SEQ ID NO: 73673 - DNA, 25 bp, Homo sapien
ctccgcggattataacaggtatgca

SEQ ID NO: 73674 - DNA, 25 bp, Homo sapien
cccagtgtagagcacgggaaacatg

SEQ ID NO: 73675 - DNA, 25 bp, Homo sapien
gtccgagttcggtacactgtaacca

SEQ ID NO: 73676 - DNA, 25 bp, Homo sapien
ttttcggtcatccacacgagttggg

SEQ ID NO: 73677 - DNA, 25 bp, Homo sapien
gcagctatattcttccgccgcgagg

SEQ ID NO: 73678 - DNA, 25 bp, Homo sapien
cgagatggtctcgaagtcttagctc

SEQ ID NO: 73679 - DNA, 25 bp, Homo sapien
gctcgttcctcaggtttccgcgata

SEQ ID NO: 73680 - DNA, 25 bp, Homo sapien
cgggcccaggagacttacgatcact

SEQ ID NO: 73681 - DNA, 25 bp, Homo sapien
tgagccagccggactttcaggcaga

SEQ ID NO: 73682 - DNA, 25 bp, Homo sapien
actggactggaacaggcatggccta

SEQ ID NO: 73683 - DNA, 25 bp, Homo sapien
gtgcattgctcccacttcagacgtg

SEQ ID NO: 73684 - DNA, 25 bp, Homo sapien
cccgagcccgctatcttcgtaggtg

SEQ ID NO: 73685 - DNA, 25 bp, Homo sapien
gctccgtcacctaatctgagaataa

SEQ ID NO: 73686 - DNA, 25 bp, Homo sapien
ccgccgcccggcgaaggacctcgcg

SEQ ID NO: 73687 - DNA, 25 bp, Homo sapien
ggtgccctgcgtgctcgtctagctc

SEQ ID NO: 73688 - DNA, 25 bp, Homo sapien
cgtccacgccggctgactcctgcgg

SEQ ID NO: 73689 - DNA, 25 bp, Homo sapien
cggcagcaccaagaaggagcgtgct

SEQ ID NO: 73690 - DNA, 25 bp, Homo sapien
cgaccggcagcaccaagaaggagcg

SEQ ID NO: 73691 - DNA, 25 bp, Homo sapien
cagggcgaccggcagcaccaagaag

SEQ ID NO: 73692 - DNA, 25 bp, Homo sapien
gaggaaaactaagcgcctctgtggg

SEQ ID NO: 73693 - DNA, 25 bp, Homo sapien
ggaggccacgcctcctaaggctcgg

SEQ ID NO: 73694 - DNA, 25 bp, Homo sapien
tctttcgagactccctagtggggtc

SEQ ID NO: 73695 - DNA, 25 bp, Homo sapien
tggacgcactgcatacccttagggg

SEQ ID NO: 73696 - DNA, 25 bp, Homo sapien
cgacccagtcttcgcaactctattt

SEQ ID NO: 73697 - DNA, 25 bp, Homo sapien
tctatttgcatacggaggcgactcg

SEQ ID NO: 73698 - DNA, 25 bp, Homo sapien
agtcccttccactgtgcgtcttctg

SEQ ID NO: 73699 - DNA, 25 bp, Homo sapien
gcgagcctgcggatccacaacaaac

SEQ ID NO: 73700 - DNA, 25 bp, Homo sapien
cttgcagagtctgggtttacggatc

SEQ ID NO: 73701 - DNA, 25 bp, Homo sapien
tttacggatcgacaaattgaggccc

SEQ ID NO: 73702 - DNA, 25 bp, Homo sapien
ttcccactctaggacgcaaatctcg

SEQ ID NO: 73703 - DNA, 25 bp, Homo sapien
cggtacttagcacacagcgtgactt

SEQ ID NO: 73704 - DNA, 25 bp, Homo sapien
ttacctcagcgcgttgtctagctgc

SEQ ID NO: 73705 - DNA, 25 bp, Homo sapien
cgactcctgcgtgtgatgtgtcacc

SEQ ID NO: 73706 - DNA, 25 bp, Homo sapien
cgccggatgctaagaccgcgatttc

SEQ ID NO: 73707 - DNA, 25 bp, Homo sapien
ctcgctgggcgcagcaattcaaccg

SEQ ID NO: 73708 - DNA, 25 bp, Homo sapien
aaatctcgatctgcaagggcctggg

SEQ ID NO: 73709 - DNA, 25 bp, Homo sapien
ccagaggctcacagcttgggttccc

SEQ ID NO: 73710 - DNA, 25 bp, Homo sapien
gcggagagttctgcgaggcctgcca

SEQ ID NO: 73711 - DNA, 25 bp, Homo sapien
cgagcagtgctacggcgagcgtggc

SEQ ID NO: 73712 - DNA, 25 bp, Homo sapien
cgagcgtggcggccagtaccgcatc

SEQ ID NO: 73713 - DNA, 25 bp, Homo sapien
caccgcggagagttctgcgaggcct

SEQ ID NO: 73714 - DNA, 25 bp, Homo sapien
accgcggagagttctgcgaggcctg

SEQ ID NO: 73715 - DNA, 25 bp, Homo sapien
ccgcggagagttctgcgaggcctgc

SEQ ID NO: 73716 - DNA, 25 bp, Homo sapien
cgcggagagttctgcgaggcctgcc

SEQ ID NO: 73717 - DNA, 25 bp, Homo sapien
aggaggcgaccacctacaccttctc

SEQ ID NO: 73718 - DNA, 25 bp, Homo sapien
accagcctgcgcgagcagtgctacg

SEQ ID NO: 73719 - DNA, 25 bp, Homo sapien
cgcgtcttcaagcagctgtgctatg

SEQ ID NO: 73720 - DNA, 25 bp, Homo sapien
ccagtaccgcatccacgtggccagc

SEQ ID NO: 73721 - DNA, 25 bp, Homo sapien
cgcggctggacgagtccagcatgct

SEQ ID NO: 73722 - DNA, 25 bp, Homo sapien
tccagcatgctggaggagaacatcg

SEQ ID NO: 73723 - DNA, 25 bp, Homo sapien
tcatcaccagcctgcgcgagcagtg

SEQ ID NO: 73724 - DNA, 25 bp, Homo sapien
tgcgcatgcgcgtcttcaagcagct

SEQ ID NO: 73725 - DNA, 25 bp, Homo sapien
aagcagctgtgctatgagtgcggca

SEQ ID NO: 73726 - DNA, 25 bp, Homo sapien
gatggctccgaacctcgctcctaaa

SEQ ID NO: 73727 - DNA, 25 bp, Homo sapien
atcagcaggcagcagcgatggctcc

SEQ ID NO: 73728 - DNA, 25 bp, Homo sapien
ctggtcaaactctaggcgcggatca

SEQ ID NO: 73729 - DNA, 25 bp, Homo sapien
gctggagagtggctggtcaaactct

SEQ ID NO: 73730 - DNA, 25 bp, Homo sapien
aggacagcatctcggcgccgcgaaa

SEQ ID NO: 73731 - DNA, 25 bp, Homo sapien
gccaggacgatggacagcgcagcca

SEQ ID NO: 73732 - DNA, 25 bp, Homo sapien
gagacgtcgagggagtctccttacc

SEQ ID NO: 73733 - DNA, 25 bp, Homo sapien
cttctgcagaaactgacggagtctg

SEQ ID NO: 73734 - DNA, 25 bp, Homo sapien
ccaccatcctcctcgtagcactgct

SEQ ID NO: 73735 - DNA, 25 bp, Homo sapien
ccatcctcctcgtagcactgctcgc

SEQ ID NO: 73736 - DNA, 25 bp, Homo sapien
ccgctgtccgggcggctggccacgt

SEQ ID NO: 73737 - DNA, 25 bp, Homo sapien
accatcctcctcgtagcactgctcg

SEQ ID NO: 73738 - DNA, 25 bp, Homo sapien
caccatcctcctcgtagcactgctc

SEQ ID NO: 73739 - DNA, 25 bp, Homo sapien
gatgcggtactggccaccatcctcc

SEQ ID NO: 73740 - DNA, 25 bp, Homo sapien
atgcggcccgctgtccgggcggctg

SEQ ID NO: 73741 - DNA, 25 bp, Homo sapien
tgcggcccgctgtccgggcggctgg

SEQ ID NO: 73742 - DNA, 25 bp, Homo sapien
agctgcttgaagacgcgcatgcgca

SEQ ID NO: 73743 - DNA, 25 bp, Homo sapien
cgatgttctcctccagcatgctgga

SEQ ID NO: 73744 - DNA, 25 bp, Homo sapien
tagcacagctgcttgaagacgcgca

SEQ ID NO: 73745 - DNA, 25 bp, Homo sapien
cgtagcactgctcgcgcaggctggt

SEQ ID NO: 73746 - DNA, 25 bp, Homo sapien
ccaccaggccctcgatgttctcctc

SEQ ID NO: 73747 - DNA, 25 bp, Homo sapien
agcatgctggactcgtccagccgcg

SEQ ID NO: 73748 - DNA, 25 bp, Homo sapien
tgccgcactcatagcacagctgctt

SEQ ID NO: 73749 - DNA, 25 bp, Homo sapien
cactgctcgcgcaggctggtgatga

SEQ ID NO: 73750 - DNA, 25 bp, Homo sapien
accggctagtatcgcgagatcagga

SEQ ID NO: 73751 - DNA, 25 bp, Homo sapien
taagcgcccttcctagagccaggca

SEQ ID NO: 73752 - DNA, 25 bp, Homo sapien
tgccttggaacagtccgtgtgaaca

SEQ ID NO: 73753 - DNA, 25 bp, Homo sapien
tgcttctgctgtgctcaccaaggga

SEQ ID NO: 73754 - DNA, 25 bp, Homo sapien
cgggtctccgaatgctgcttctgct

SEQ ID NO: 73755 - DNA, 25 bp, Homo sapien
ccgttctcgtgctgtacaggcaatg

SEQ ID NO: 73756 - DNA, 25 bp, Homo sapien
acttgcggctttttaggtcggcctg

SEQ ID NO: 73757 - DNA, 25 bp, Homo sapien
caatgagtgtagtctgtgcgaaccg

SEQ ID NO: 73758 - DNA, 25 bp, Homo sapien
tacgccgtcaatgcagcaggcaatg

SEQ ID NO: 73759 - DNA, 25 bp, Homo sapien
gcggcccttaatttagttacattca

SEQ ID NO: 73760 - DNA, 25 bp, Homo sapien
acctcggtagctaacattgtgtgta

SEQ ID NO: 73761 - DNA, 25 bp, Homo sapien
acgtagtcaatctcggctctgcgga

SEQ ID NO: 73762 - DNA, 25 bp, Homo sapien
ctgcggatttcacagaacacacttt

SEQ ID NO: 73763 - DNA, 25 bp, Homo sapien
taactttccaggaagctgccggccc

SEQ ID NO: 73764 - DNA, 25 bp, Homo sapien
aacttttggtgcacctcggtagcta

SEQ ID NO: 73765 - DNA, 25 bp, Homo sapien
tgccggctccaacaagaagtaactt

SEQ ID NO: 73766 - DNA, 25 bp, Homo sapien
ggtcctaaaactagccagtggcgtc

SEQ ID NO: 73767 - DNA, 25 bp, Homo sapien
ctaggggacagcgaaagactcagcc

SEQ ID NO: 73768 - DNA, 25 bp, Homo sapien
tccaaagttgcctcgccttcctgtg

SEQ ID NO: 73769 - DNA, 25 bp, Homo sapien
aagggtcagagtcggtctgcaaaga

SEQ ID NO: 73770 - DNA, 25 bp, Homo sapien
cctaattggtctcggtagcaggctc

SEQ ID NO: 73771 - DNA, 25 bp, Homo sapien
ccacaaaggccgcagtctggtccta

SEQ ID NO: 73772 - DNA, 25 bp, Homo sapien
gctcatcccttctgcggcaagcgga

SEQ ID NO: 73773 - DNA, 25 bp, Homo sapien
cccgggtgccatgtcctaattggtc

SEQ ID NO: 73774 - DNA, 25 bp, Homo sapien
gcacctttgagacgccgcctcacca

SEQ ID NO: 73775 - DNA, 25 bp, Homo sapien
cccggagttgctaaaatagataatc

SEQ ID NO: 73776 - DNA, 25 bp, Homo sapien
gccctcccggagttgctaaaataga

SEQ ID NO: 73777 - DNA, 25 bp, Homo sapien
cgctaactggcacaggctgggcgct

SEQ ID NO: 73778 - DNA, 25 bp, Homo sapien
tgcttgcgctaactggcacaggctg

SEQ ID NO: 73779 - DNA, 25 bp, Homo sapien
ccacttgagtgacaccgccagcatt

SEQ ID NO: 73780 - DNA, 25 bp, Homo sapien
gctccagagctgcttgcgctaactg

SEQ ID NO: 73781 - DNA, 25 bp, Homo sapien
agtgacaccgccagcattgtgccct

SEQ ID NO: 73782 - DNA, 25 bp, Homo sapien
cgccagcatgcggacgcgcgtttgc

SEQ ID NO: 73783 - DNA, 25 bp, Homo sapien
gcgtttgccatcttaagtcacgagc

SEQ ID NO: 73784 - DNA, 25 bp, Homo sapien
gcgtttctccgacgcggcctccgac

SEQ ID NO: 73785 - DNA, 25 bp, Homo sapien
agtccgaacagaggcgcgtttctcc

SEQ ID NO: 73786 - DNA, 25 bp, Homo sapien
tttccagtccgaacagaggcgcgtt

SEQ ID NO: 73787 - DNA, 25 bp, Homo sapien
gttcccagattcgtttccagtccga

SEQ ID NO: 73788 - DNA, 25 bp, Homo sapien
cggacgcgcgtttgccatcttaagt

SEQ ID NO: 73789 - DNA, 25 bp, Homo sapien
cgcgcttcaaactcgttcccagatt

SEQ ID NO: 73790 - DNA, 25 bp, Homo sapien
aagaagccctgtcccgccatcagtc

SEQ ID NO: 73791 - DNA, 25 bp, Homo sapien
cccgcacactgaaaggcatcgcagg

SEQ ID NO: 73792 - DNA, 25 bp, Homo sapien
tcacgcagcgcccaaaatacaaaca

SEQ ID NO: 73793 - DNA, 25 bp, Homo sapien
acaaacaccgcagcggccagaaatc

SEQ ID NO: 73794 - DNA, 25 bp, Homo sapien
ccaggctgtcctgtcgaggttccct

SEQ ID NO: 73795 - DNA, 25 bp, Homo sapien
gtcctgtcgaggttccctgagtccc

SEQ ID NO: 73796 - DNA, 25 bp, Homo sapien
cactgaaaggcatcgcaggtgcagt

SEQ ID NO: 73797 - DNA, 25 bp, Homo sapien
gccatcagtctctctcctcgggatg

SEQ ID NO: 73798 - DNA, 25 bp, Homo sapien
agccctgccgaagtttcactttttg

SEQ ID NO: 73799 - DNA, 25 bp, Homo sapien
ctcagggcaccgcacgggagaccaa

SEQ ID NO: 73800 - DNA, 25 bp, Homo sapien
tcactttttgtctgtgggttcgttc

SEQ ID NO: 73801 - DNA, 25 bp, Homo sapien
cccgggataagtagctttagcgatc

SEQ ID NO: 73802 - DNA, 25 bp, Homo sapien
tagctttagcgatcgggagacagcc

SEQ ID NO: 73803 - DNA, 25 bp, Homo sapien
tcccgcgcgagctttcccgggataa

SEQ ID NO: 73804 - DNA, 25 bp, Homo sapien
tggacaaatgcgtgcaggcaaagtc

SEQ ID NO: 73805 - DNA, 25 bp, Homo sapien
cctccctgaggtattgttgcaaatc

SEQ ID NO: 73806 - DNA, 25 bp, Homo sapien
ggccgctttccattcacgtctataa

SEQ ID NO: 73807 - DNA, 25 bp, Homo sapien
tttgtatctagcacggtagcacctg

SEQ ID NO: 73808 - DNA, 25 bp, Homo sapien
cgtctataattagcgcgcaggctgc

SEQ ID NO: 73809 - DNA, 25 bp, Homo sapien
cgatcattcagaagcggccgctttc

SEQ ID NO: 73810 - DNA, 25 bp, Homo sapien
agcacctgcttctaagcttccaacg

SEQ ID NO: 73811 - DNA, 25 bp, Homo sapien
gcgtgcgtgacagagggcttttaaa

SEQ ID NO: 73812 - DNA, 25 bp, Homo sapien
ccagaggattcgtcagtaagtgtgc

SEQ ID NO: 73813 - DNA, 25 bp, Homo sapien
cagctcgagcaacgcgatcattcag

SEQ ID NO: 73814 - DNA, 25 bp, Homo sapien
cagccagagagctagcgccgcttga

SEQ ID NO: 73815 - DNA, 25 bp, Homo sapien
acagcgcgtgcggatttcccgcagg

SEQ ID NO: 73816 - DNA, 25 bp, Homo sapien
ctgcgctggaagtcgctgcgcacat

SEQ ID NO: 73817 - DNA, 25 bp, Homo sapien
gctgggtctcacagctgcgataaca

SEQ ID NO: 73818 - DNA, 25 bp, Homo sapien
tcgctcgtagtctccgctgtagtag

SEQ ID NO: 73819 - DNA, 25 bp, Homo sapien
agccgctcttaaagggacgcccaca

SEQ ID NO: 73820 - DNA, 25 bp, Homo sapien
tcctgctgcctgagactccgagagc

SEQ ID NO: 73821 - DNA, 25 bp, Homo sapien
tgcgcacatcctcgctgacgcggtg

SEQ ID NO: 73822 - DNA, 25 bp, Homo sapien
tgtcgccggcataggagtaaatcct

SEQ ID NO: 73823 - DNA, 25 bp, Homo sapien
ctgggcgccgcgatttaaagcagct

SEQ ID NO: 73824 - DNA, 25 bp, Homo sapien
tcccaggctcgggaactgagacgca

SEQ ID NO: 73825 - DNA, 25 bp, Homo sapien
cgtggatcttctcgctcctgtaagg

SEQ ID NO: 73826 - DNA, 25 bp, Homo sapien
tctggatactagaagctgcggttgc

SEQ ID NO: 73827 - DNA, 25 bp, Homo sapien
atggcgccgatccatcccaggaagg

SEQ ID NO: 73828 - DNA, 25 bp, Homo sapien
gtaaatcctccactggggcagggca

SEQ ID NO: 73829 - DNA, 25 bp, Homo sapien
tgctcgctttctctcgtggatcttc

SEQ ID NO: 73830 - DNA, 25 bp, Homo sapien
ctcaactgcgagagcacgatcttgc

SEQ ID NO: 73831 - DNA, 25 bp, Homo sapien
tgcggagatcgcatctacatcctgc

SEQ ID NO: 73832 - DNA, 25 bp, Homo sapien
tgcgaaaatcgtgcagtctgaattg

SEQ ID NO: 73833 - DNA, 25 bp, Homo sapien
tcaaggccttgcagcatgattgcta

SEQ ID NO: 73834 - DNA, 25 bp, Homo sapien
agggtggcaccgatctcaactgcga

SEQ ID NO: 73835 - DNA, 25 bp, Homo sapien
cgatcttgcaatgagcgcatgtgtg

SEQ ID NO: 73836 - DNA, 25 bp, Homo sapien
aggggcgtagcttcccacagcgcct

SEQ ID NO: 73837 - DNA, 25 bp, Homo sapien
tacgtcgagacaggaagaaagggca

SEQ ID NO: 73838 - DNA, 25 bp, Homo sapien
gctattggtttactctgctgcctta

SEQ ID NO: 73839 - DNA, 25 bp, Homo sapien
tcctgcactacggagcttgcgaacg

SEQ ID NO: 73840 - DNA, 25 bp, Homo sapien
agcttcgattggtcaaacggcgccg

SEQ ID NO: 73841 - DNA, 25 bp, Homo sapien
tgcgcccgggtcagacattatttag

SEQ ID NO: 73842 - DNA, 25 bp, Homo sapien
agcggtgggtgtctcattaaagccc

SEQ ID NO: 73843 - DNA, 25 bp, Homo sapien
cggagtcacatcgtggttccgattc

SEQ ID NO: 73844 - DNA, 25 bp, Homo sapien
gcgaacgcgagcacacaatgaaatc

SEQ ID NO: 73845 - DNA, 25 bp, Homo sapien
tgctgccttaaacacgccggcttaa

SEQ ID NO: 73846 - DNA, 25 bp, Homo sapien
taacgcggttgtgggacgtctgctc

SEQ ID NO: 73847 - DNA, 25 bp, Homo sapien
gtgggacgtctgctcgttgccgccc

SEQ ID NO: 73848 - DNA, 25 bp, Homo sapien
ttggtttctccagaccgctgctgga

SEQ ID NO: 73849 - DNA, 25 bp, Homo sapien
ttctccagaccgctgctggaagcgc

SEQ ID NO: 73850 - DNA, 25 bp, Homo sapien
ccagaccgctgctggaagcgccgag

SEQ ID NO: 73851 - DNA, 25 bp, Homo sapien
cgccgaggacagaaggaagcggtgt

SEQ ID NO: 73852 - DNA, 25 bp, Homo sapien
tgtgtcccagcacgcccactcggta

SEQ ID NO: 73853 - DNA, 25 bp, Homo sapien
cccactcggtatcacgtcgctctca

SEQ ID NO: 73854 - DNA, 25 bp, Homo sapien
gaccagggacctgccgatctggcca

SEQ ID NO: 73855 - DNA, 25 bp, Homo sapien
ccaggagtcacccagcagaagacaa

SEQ ID NO: 73856 - DNA, 25 bp, Homo sapien
agacaaagtcactcgcgctctgggc

SEQ ID NO: 73857 - DNA, 25 bp, Homo sapien
aaccggtgacgtgagccaggagtca

SEQ ID NO: 73858 - DNA, 25 bp, Homo sapien
agaggctgtcaaaccggtgacgtga

SEQ ID NO: 73859 - DNA, 25 bp, Homo sapien
ctctgtgatttggtgagaggctgtc

SEQ ID NO: 73860 - DNA, 25 bp, Homo sapien
ggagctcccggtgacgcccagagct

SEQ ID NO: 73861 - DNA, 25 bp, Homo sapien
gcgagttctaatctgcgggagctcc

SEQ ID NO: 73862 - DNA, 25 bp, Homo sapien
ggcgcgtcactgagcacaaaggaga

SEQ ID NO: 73863 - DNA, 25 bp, Homo sapien
tcgccagccactcgcaattgcggtt

SEQ ID NO: 73864 - DNA, 25 bp, Homo sapien
ttgcggttacagacctgcagctccc

SEQ ID NO: 73865 - DNA, 25 bp, Homo sapien
ttccgggctccggatatttggtatc

SEQ ID NO: 73866 - DNA, 25 bp, Homo sapien
gaagtcagcatcgaccagtccaagc

SEQ ID NO: 73867 - DNA, 25 bp, Homo sapien
cagcccgaggttctctcaggtcagg

SEQ ID NO: 73868 - DNA, 25 bp, Homo sapien
gttgggcaagtctccgacgttccaa

SEQ ID NO: 73869 - DNA, 25 bp, Homo sapien
cttgcccggacgtgaaaggaattga

SEQ ID NO: 73870 - DNA, 25 bp, Homo sapien
cctggcatatgcaaggcgaaaactt

SEQ ID NO: 73871 - DNA, 25 bp, Homo sapien
cctgtcgttgtgcatgcagcaggcc

SEQ ID NO: 73872 - DNA, 25 bp, Homo sapien
tgctcgcgccctgcgcgaatgaagc

SEQ ID NO: 73873 - DNA, 25 bp, Homo sapien
caccggcacagcgatgcgctggttc

SEQ ID NO: 73874 - DNA, 25 bp, Homo sapien
gcctgtggctgtccatgtcctcgat

SEQ ID NO: 73875 - DNA, 25 bp, Homo sapien
ccatcgtttcatgctgtgagaagtc

SEQ ID NO: 73876 - DNA, 25 bp, Homo sapien
cgttctcgtagacccagtggttcca

SEQ ID NO: 73877 - DNA, 25 bp, Homo sapien
ggttccacagaatcgagtccatcgt

SEQ ID NO: 73878 - DNA, 25 bp, Homo sapien
gacggccagcgaaagatctagaccc

SEQ ID NO: 73879 - DNA, 25 bp, Homo sapien
ggccagcgaaagatctagacccagc

SEQ ID NO: 73880 - DNA, 25 bp, Homo sapien
acggccagcgaaagatctagaccca

SEQ ID NO: 73881 - DNA, 25 bp, Homo sapien
agacggccagcgaaagatctagacc

SEQ ID NO: 73882 - DNA, 25 bp, Homo sapien
cccagcaattagacggccagcgaaa

SEQ ID NO: 73883 - DNA, 25 bp, Homo sapien
gccagcgaaagatctagacccagca

SEQ ID NO: 73884 - DNA, 25 bp, Homo sapien
tagacccagcaattagacggccagc

SEQ ID NO: 73885 - DNA, 25 bp, Homo sapien
acccagcaattagacggccagcgaa

SEQ ID NO: 73886 - DNA, 25 bp, Homo sapien
cccgagttctggaattccgagaggc

SEQ ID NO: 73887 - DNA, 25 bp, Homo sapien
gacgggcacagttggtgattattta

SEQ ID NO: 73888 - DNA, 25 bp, Homo sapien
tctacagaatgcatcgcgccggctg

SEQ ID NO: 73889 - DNA, 25 bp, Homo sapien
ttctgaagattaggaggtccgtccc

SEQ ID NO: 73890 - DNA, 25 bp, Homo sapien
cccgtttacaaagcagagtctggac

SEQ ID NO: 73891 - DNA, 25 bp, Homo sapien
gcgcaagcgttgtaaggtgtccaaa

SEQ ID NO: 73892 - DNA, 25 bp, Homo sapien
cgatgccgaaggtgtcctctccagc

SEQ ID NO: 73893 - DNA, 25 bp, Homo sapien
tgggcgctctttctctttccgcttg

SEQ ID NO: 73894 - DNA, 25 bp, Homo sapien
gcgctctccctacaaagcgtcgatg

SEQ ID NO: 73895 - DNA, 25 bp, Homo sapien
tcggtgcttccttacaggtgccttc

SEQ ID NO: 73896 - DNA, 25 bp, Homo sapien
ctccgccacaggcagcgctgaatga

SEQ ID NO: 73897 - DNA, 25 bp, Homo sapien
agagagacccgcaggtttcagccca

SEQ ID NO: 73898 - DNA, 25 bp, Homo sapien
gaacattttctcaccacttgggctg

SEQ ID NO: 73899 - DNA, 25 bp, Homo sapien
gcatatgcactcctttcttcagaga

SEQ ID NO: 73900 - DNA, 25 bp, Homo sapien
tgcgctagtagtccaaccaacaggc

SEQ ID NO: 73901 - DNA, 25 bp, Homo sapien
gcgtcgatgacttcagggatttaaa

SEQ ID NO: 73902 - DNA, 25 bp, Homo sapien
tttcggccagcgctaagacaataca

SEQ ID NO: 73903 - DNA, 25 bp, Homo sapien
tccgggaacgcaggcttgttgttac

SEQ ID NO: 73904 - DNA, 25 bp, Homo sapien
ccgctggtcgtgcttcgtaaattct

SEQ ID NO: 73905 - DNA, 25 bp, Homo sapien
gccgcgagacgacagaagcaacttg

SEQ ID NO: 73906 - DNA, 25 bp, Homo sapien
cctagactacttcagcgggttactc

SEQ ID NO: 73907 - DNA, 25 bp, Homo sapien
ccagcgctctctggtcgtcgtattc

SEQ ID NO: 73908 - DNA, 25 bp, Homo sapien
tggcttatacccaaggcaccggctc

SEQ ID NO: 73909 - DNA, 25 bp, Homo sapien
ggcaatgggttttctactccgcttc

SEQ ID NO: 73910 - DNA, 25 bp, Homo sapien
ccaagcgaggtctagccggagcgac

SEQ ID NO: 73911 - DNA, 25 bp, Homo sapien
cacagcgcctggtgccctaaacgtt

SEQ ID NO: 73912 - DNA, 25 bp, Homo sapien
tgccctaaacgttggctgcgggaac

SEQ ID NO: 73913 - DNA, 25 bp, Homo sapien
gaataactggttgcgcggcgctttg

SEQ ID NO: 73914 - DNA, 25 bp, Homo sapien
catggtcagagcctcgtgccggctc

SEQ ID NO: 73915 - DNA, 25 bp, Homo sapien
tctcccgggtacagatggagtcgtc

SEQ ID NO: 73916 - DNA, 25 bp, Homo sapien
ctgcctcccggtgcgagaagaagac

SEQ ID NO: 73917 - DNA, 25 bp, Homo sapien
attatctttataaccgcggcgccta

SEQ ID NO: 73918 - DNA, 25 bp, Homo sapien
acgcactgtgcgcatgcgctggtcc

SEQ ID NO: 73919 - DNA, 25 bp, Homo sapien
ttccaaatcggaagcaagagggcgg

SEQ ID NO: 73920 - DNA, 25 bp, Homo sapien
atggattgctccagtccgttcccga

SEQ ID NO: 73921 - DNA, 25 bp, Homo sapien
ctgtcaggctcttgcggaagtccat

SEQ ID NO: 73922 - DNA, 25 bp, Homo sapien
gtgctgcccgcctagaaagggtgaa

SEQ ID NO: 73923 - DNA, 25 bp, Homo sapien
tgaagtggttgtttccgtgacggac

SEQ ID NO: 73924 - DNA, 25 bp, Homo sapien
ttcctgggtcattcctggaccggga

SEQ ID NO: 73925 - DNA, 25 bp, Homo sapien
tgcggaagtccatgcgccattggga

SEQ ID NO: 73926 - DNA, 25 bp, Homo sapien
ccgccgcacggagctaaaagtgttc

SEQ ID NO: 73927 - DNA, 25 bp, Homo sapien
tgagaaagcgggaaccctctaagcc

SEQ ID NO: 73928 - DNA, 25 bp, Homo sapien
agccagcgcccgaaactcgcgggga

SEQ ID NO: 73929 - DNA, 25 bp, Homo sapien
cggacctgggctcagtgaggcatcc

SEQ ID NO: 73930 - DNA, 25 bp, Homo sapien
ccgactgactcggacctgggctcag

SEQ ID NO: 73931 - DNA, 25 bp, Homo sapien
gctctctggctcttcggtccggaaa

SEQ ID NO: 73932 - DNA, 25 bp, Homo sapien
tccagctgattggtggctctgtcca

SEQ ID NO: 73933 - DNA, 25 bp, Homo sapien
cccagaaagaagcatccagcgagga

SEQ ID NO: 73934 - DNA, 25 bp, Homo sapien
ctgcccacatgaaaggctcgctgtc

SEQ ID NO: 73935 - DNA, 25 bp, Homo sapien
cggacgctgtctttgggaagctcca

SEQ ID NO: 73936 - DNA, 25 bp, Homo sapien
actcgcaggctgcttagagacggcc

SEQ ID NO: 73937 - DNA, 25 bp, Homo sapien
aacaggacctttgtgctgcgctcca

SEQ ID NO: 73938 - DNA, 25 bp, Homo sapien
gccgcggccacaacaggacctttgt

SEQ ID NO: 73939 - DNA, 25 bp, Homo sapien
agagactgagtcaccaccatccaga

SEQ ID NO: 73940 - DNA, 25 bp, Homo sapien
cccggagccgcacaaaggaaatggc

SEQ ID NO: 73941 - DNA, 25 bp, Homo sapien
agctccaggcgtaggttcgcattgc

SEQ ID NO: 73942 - DNA, 25 bp, Homo sapien
gcacagccgctgataaagcaccata

SEQ ID NO: 73943 - DNA, 25 bp, Homo sapien
gccgcctcttttcataaactttatc

SEQ ID NO: 73944 - DNA, 25 bp, Homo sapien
tcataaactttatcgccgcggtgca

SEQ ID NO: 73945 - DNA, 25 bp, Homo sapien
aagccctggctgatcctaatcagtg

SEQ ID NO: 73946 - DNA, 25 bp, Homo sapien
cgagatccttaactgcagcttccaa

SEQ ID NO: 73947 - DNA, 25 bp, Homo sapien
caccataaataaacgagcgggcggg

SEQ ID NO: 73948 - DNA, 25 bp, Homo sapien
cgggcacccgagatccttaactgca

SEQ ID NO: 73949 - DNA, 25 bp, Homo sapien
cctaatcagtgtgggaaaggagcgc

SEQ ID NO: 73950 - DNA, 25 bp, Homo sapien
tggcgcagctgctcaaaggtcacgc

SEQ ID NO: 73951 - DNA, 25 bp, Homo sapien
ggaagcgaaagctgcggcgacctcc

SEQ ID NO: 73952 - DNA, 25 bp, Homo sapien
agcctctcaggcacgcggcatctct

SEQ ID NO: 73953 - DNA, 25 bp, Homo sapien
accggcagcgccttgaaataccaaa

SEQ ID NO: 73954 - DNA, 25 bp, Homo sapien
cctagccaaagatggaaccgttttg

SEQ ID NO: 73955 - DNA, 25 bp, Homo sapien
gctcaaaggtcacgcccgagacacg

SEQ ID NO: 73956 - DNA, 25 bp, Homo sapien
gacgttcagccccttcggaaatgta

SEQ ID NO: 73957 - DNA, 25 bp, Homo sapien
ataccaaaggcctagccaaagatgg

SEQ ID NO: 73958 - DNA, 25 bp, Homo sapien
ctgccgacgagcaggttccgacttt

SEQ ID NO: 73959 - DNA, 25 bp, Homo sapien
ccaggcctggctgcgagtcaaggca

SEQ ID NO: 73960 - DNA, 25 bp, Homo sapien
ggcggtgacacatggcgctcacaca

SEQ ID NO: 73961 - DNA, 25 bp, Homo sapien
cgttttcccacagtctggggcggtg

SEQ ID NO: 73962 - DNA, 25 bp, Homo sapien
gcggagcagcgttttcccacagtct

SEQ ID NO: 73963 - DNA, 25 bp, Homo sapien
gggccaaaccgcagcttcttgcagc

SEQ ID NO: 73964 - DNA, 25 bp, Homo sapien
agagctctctcaccactgggcctga

SEQ ID NO: 73965 - DNA, 25 bp, Homo sapien
tggggcctcccgttcagagctctct

SEQ ID NO: 73966 - DNA, 25 bp, Homo sapien
gtcctgaggtgatcctccaggctcc

SEQ ID NO: 73967 - DNA, 25 bp, Homo sapien
ccgcgtcttaccttcgtccggcagc

SEQ ID NO: 73968 - DNA, 25 bp, Homo sapien
tcgcgtcctgaggtgatcctccagg

SEQ ID NO: 73969 - DNA, 25 bp, Homo sapien
tcgagggctcagacccttcgctcca

SEQ ID NO: 73970 - DNA, 25 bp, Homo sapien
caactttgagtaaccgcggactccg

SEQ ID NO: 73971 - DNA, 25 bp, Homo sapien
tcctcgcaactttgagtaaccgcgg

SEQ ID NO: 73972 - DNA, 25 bp, Homo sapien
ccactgctggctttccgggaccagg

SEQ ID NO: 73973 - DNA, 25 bp, Homo sapien
ctacgcttttcgagcgcgcgctttc

SEQ ID NO: 73974 - DNA, 25 bp, Homo sapien
tcattgacaacgttatctcagtggg

SEQ ID NO: 73975 - DNA, 25 bp, Homo sapien
ccgggacgagatctggcgaaatcat

SEQ ID NO: 73976 - DNA, 25 bp, Homo sapien
gggacgagatctggcgaaatcattg

SEQ ID NO: 73977 - DNA, 25 bp, Homo sapien
cgagatctggcgaaatcattgacaa

SEQ ID NO: 73978 - DNA, 25 bp, Homo sapien
tggcgaaatcattgacaacgttatc

SEQ ID NO: 73979 - DNA, 25 bp, Homo sapien
tgacaacgttatctcagtggggagc

SEQ ID NO: 73980 - DNA, 25 bp, Homo sapien
acaacgttatctcagtggggagctg

SEQ ID NO: 73981 - DNA, 25 bp, Homo sapien
tctggcgaaatcattgacaacgtta

SEQ ID NO: 73982 - DNA, 25 bp, Homo sapien
cggctcggcaaatcccccagggagg

SEQ ID NO: 73983 - DNA, 25 bp, Homo sapien
catcaaacaagacgctgggctcccg

SEQ ID NO: 73984 - DNA, 25 bp, Homo sapien
ccggaaggaatgaagtgtctgagaa

SEQ ID NO: 73985 - DNA, 25 bp, Homo sapien
ggaggccacatcaaacaagacgctg

SEQ ID NO: 73986 - DNA, 25 bp, Homo sapien
ggcgggaggccacatcaaacaagac

SEQ ID NO: 73987 - DNA, 25 bp, Homo sapien
gtctgagaaccgtgcgccaggcctc

SEQ ID NO: 73988 - DNA, 25 bp, Homo sapien
aagtgtctgagaaccgtgcgccagg

SEQ ID NO: 73989 - DNA, 25 bp, Homo sapien
atgaagtgtctgagaaccgtgcgcc

SEQ ID NO: 73990 - DNA, 25 bp, Homo sapien
tgacccggccgcttcctaagtgcgg

SEQ ID NO: 73991 - DNA, 25 bp, Homo sapien
cgccgggaagagctgaccttggcct

SEQ ID NO: 73992 - DNA, 25 bp, Homo sapien
tgcggctttcggccgagtgaaaacc

SEQ ID NO: 73993 - DNA, 25 bp, Homo sapien
ccgggctgttgcgaatgcggctttc

SEQ ID NO: 73994 - DNA, 25 bp, Homo sapien
cgaggagcaaacttggaggccccca

SEQ ID NO: 73995 - DNA, 25 bp, Homo sapien
gccgcttcctaagtgcggtcaggca

SEQ ID NO: 73996 - DNA, 25 bp, Homo sapien
gctttaaccgcagtcgccgagcgga

SEQ ID NO: 73997 - DNA, 25 bp, Homo sapien
agtgcggtcaggcatcccgtgaccg

SEQ ID NO: 73998 - DNA, 25 bp, Homo sapien
tgtccacgtgcgagggcgttaatac

SEQ ID NO: 73999 - DNA, 25 bp, Homo sapien
attgtccaaggtcacatcgcgcgcg

SEQ ID NO: 74000 - DNA, 25 bp, Homo sapien
ggggtcactggtttagcactccttc

SEQ ID NO: 74001 - DNA, 25 bp, Homo sapien
cacggtctggggcttatttatagcc

SEQ ID NO: 74002 - DNA, 25 bp, Homo sapien
ttggctcactcttgcgttcccacgg

SEQ ID NO: 74003 - DNA, 25 bp, Homo sapien
tcttccagacttccgcccgtggttg

SEQ ID NO: 74004 - DNA, 25 bp, Homo sapien
tcgcctcgcggtgatttcttccaga

SEQ ID NO: 74005 - DNA, 25 bp, Homo sapien
tcggcttttggcagcaacgctagtg

SEQ ID NO: 74006 - DNA, 25 bp, Homo sapien
ctcccagatgagctcaggcaacctg

SEQ ID NO: 74007 - DNA, 25 bp, Homo sapien
ttctggcaggaaatgaatagctccc

SEQ ID NO: 74008 - DNA, 25 bp, Homo sapien
gccaaggtggttcgcttagcaggcc

SEQ ID NO: 74009 - DNA, 25 bp, Homo sapien
cccggctcctaagtgcaaccagatg

SEQ ID NO: 74010 - DNA, 25 bp, Homo sapien
agagccctctccaagcgcagaagcg

SEQ ID NO: 74011 - DNA, 25 bp, Homo sapien
tcttcggtcaacacgagagccctct

SEQ ID NO: 74012 - DNA, 25 bp, Homo sapien
ccgcatttagtagctggggaaactg

SEQ ID NO: 74013 - DNA, 25 bp, Homo sapien
gccgcctgccagtgtttttccagtt

SEQ ID NO: 74014 - DNA, 25 bp, Homo sapien
tggccctttgtcaccagctgccaaa

SEQ ID NO: 74015 - DNA, 25 bp, Homo sapien
ccctttgtgcagaggggtctcttta

SEQ ID NO: 74016 - DNA, 25 bp, Homo sapien
tatttcccgattacggccggagcgc

SEQ ID NO: 74017 - DNA, 25 bp, Homo sapien
ggggtctctttaactgctgagattc

SEQ ID NO: 74018 - DNA, 25 bp, Homo sapien
tggcgcaaaataaaagccgtcccgc

SEQ ID NO: 74019 - DNA, 25 bp, Homo sapien
gtgcagccctttatggcgcaaaata

SEQ ID NO: 74020 - DNA, 25 bp, Homo sapien
gcctcggtccctgacagcgagggca

SEQ ID NO: 74021 - DNA, 25 bp, Homo sapien
ctgagattccagcagacactgtgca

SEQ ID NO: 74022 - DNA, 25 bp, Homo sapien
cgatctcagtgtgagccgaacctca

SEQ ID NO: 74023 - DNA, 25 bp, Homo sapien
atggactcctatcgcccggattaca

SEQ ID NO: 74024 - DNA, 25 bp, Homo sapien
acctcggacaaatccgttggctctg

SEQ ID NO: 74025 - DNA, 25 bp, Homo sapien
agacgctttttaagggcgacacagg

SEQ ID NO: 74026 - DNA, 25 bp, Homo sapien
aaacgctccgctccaaaatctgact

SEQ ID NO: 74027 - DNA, 25 bp, Homo sapien
ttacagcggggccaagaagactacc

SEQ ID NO: 74028 - DNA, 25 bp, Homo sapien
cgacacagggttggctttacagcgg

SEQ ID NO: 74029 - DNA, 25 bp, Homo sapien
gtccaaggtgctgaatggactccta

SEQ ID NO: 74030 - DNA, 25 bp, Homo sapien
tgccgactgctcctgctagtgggga

SEQ ID NO: 74031 - DNA, 25 bp, Homo sapien
ggcagccaggccctctgaaattccg

SEQ ID NO: 74032 - DNA, 25 bp, Homo sapien
agccacgcggagaatccatccctgg

SEQ ID NO: 74033 - DNA, 25 bp, Homo sapien
acccctcagcgttgccggatgtgcg

SEQ ID NO: 74034 - DNA, 25 bp, Homo sapien
tttgccctcccatccagccacgcgg

SEQ ID NO: 74035 - DNA, 25 bp, Homo sapien
agcacgagccggctttgccctccca

SEQ ID NO: 74036 - DNA, 25 bp, Homo sapien
gcggctgaggtccaaggtttggaga

SEQ ID NO: 74037 - DNA, 25 bp, Homo sapien
gagaatccatccctggcggtgccga

SEQ ID NO: 74038 - DNA, 25 bp, Homo sapien
cattacgggctcgttggccacacca

SEQ ID NO: 74039 - DNA, 25 bp, Homo sapien
gttgtttcaccgttggcctcttggc

SEQ ID NO: 74040 - DNA, 25 bp, Homo sapien
cagcggcattcaggaaaattcggcg

SEQ ID NO: 74041 - DNA, 25 bp, Homo sapien
acccacgcggcctgagtgatttacc

SEQ ID NO: 74042 - DNA, 25 bp, Homo sapien
aaattcggcgatgcgtgccaccgtt

SEQ ID NO: 74043 - DNA, 25 bp, Homo sapien
ccggcaatggcgagatttctttcta

SEQ ID NO: 74044 - DNA, 25 bp, Homo sapien
tgcgactccggccattgtcctcatt

SEQ ID NO: 74045 - DNA, 25 bp, Homo sapien
agtgatttacccattcccggcaatg

SEQ ID NO: 74046 - DNA, 25 bp, Homo sapien
cgaggccgcggccagcattaattag

SEQ ID NO: 74047 - DNA, 25 bp, Homo sapien
atcgcaggctcgcagcctgggagcc

SEQ ID NO: 74048 - DNA, 25 bp, Homo sapien
ccgtcagaagaatcgcaggctcgca

SEQ ID NO: 74049 - DNA, 25 bp, Homo sapien
ccggaaagcgccgtcagaagaatcg

SEQ ID NO: 74050 - DNA, 25 bp, Homo sapien
cctagtggccgtcgtccggaaagcg

SEQ ID NO: 74051 - DNA, 25 bp, Homo sapien
agcattaattaggtgccgatgcacg

SEQ ID NO: 74052 - DNA, 25 bp, Homo sapien
acatcactgacgtcaagcgcggcga

SEQ ID NO: 74053 - DNA, 25 bp, Homo sapien
cagcacggagcacatcactgacgtc

SEQ ID NO: 74054 - DNA, 25 bp, Homo sapien
gagcaccatcttatccagcagcgca

SEQ ID NO: 74055 - DNA, 25 bp, Homo sapien
cgcaaggtggtttctcgaaagcgtc

SEQ ID NO: 74056 - DNA, 25 bp, Homo sapien
cccttagcgcattgtggtccaaaaa

SEQ ID NO: 74057 - DNA, 25 bp, Homo sapien
gctcctgcaggttaaccagtttctg

SEQ ID NO: 74058 - DNA, 25 bp, Homo sapien
gtcaggttgtttcccgataaatcca

SEQ ID NO: 74059 - DNA, 25 bp, Homo sapien
tttcggtggaactgcagctccgtca

SEQ ID NO: 74060 - DNA, 25 bp, Homo sapien
cgtgattttgttgcgcgacagcctc

SEQ ID NO: 74061 - DNA, 25 bp, Homo sapien
cagcctcagggttttcagttttatc

SEQ ID NO: 74062 - DNA, 25 bp, Homo sapien
tgccaccctcgaacgggcaaaagaa

SEQ ID NO: 74063 - DNA, 25 bp, Homo sapien
ccagctcctaatgcaaggctctttc

SEQ ID NO: 74064 - DNA, 25 bp, Homo sapien
cgttgcccagagtcatggtcatgga

SEQ ID NO: 74065 - DNA, 25 bp, Homo sapien
ctcagtgactagacagacgttgccc

SEQ ID NO: 74066 - DNA, 25 bp, Homo sapien
ggccgtccaaaaacgctgggtgtca

SEQ ID NO: 74067 - DNA, 25 bp, Homo sapien
ttccctccgcagaagacttatctcg

SEQ ID NO: 74068 - DNA, 25 bp, Homo sapien
ttctcatatgaccacggactctgcg

SEQ ID NO: 74069 - DNA, 25 bp, Homo sapien
ctcttccgaccgtcctggatgcaaa

SEQ ID NO: 74070 - DNA, 25 bp, Homo sapien
tgagctgacaaactcgcgtcgcaaa

SEQ ID NO: 74071 - DNA, 25 bp, Homo sapien
tatgaggtaactccacgggctccgg

SEQ ID NO: 74072 - DNA, 25 bp, Homo sapien
tagcgtcaacctccgcactctatga

SEQ ID NO: 74073 - DNA, 25 bp, Homo sapien
gccctcaagatgaccttagcagtta

SEQ ID NO: 74074 - DNA, 25 bp, Homo sapien
atggcgcccacaccaatccttgtta

SEQ ID NO: 74075 - DNA, 25 bp, Homo sapien
ggcgtccatcgcaatcaaaagcttt

SEQ ID NO: 74076 - DNA, 25 bp, Homo sapien
cgagacgctcgagttcacttactta

SEQ ID NO: 74077 - DNA, 25 bp, Homo sapien
catggaccgtaggaaaaagcctttg

SEQ ID NO: 74078 - DNA, 25 bp, Homo sapien
acggagacgccctcgacagttcttt

SEQ ID NO: 74079 - DNA, 25 bp, Homo sapien
tgacagctgccagaccctgaggaga

SEQ ID NO: 74080 - DNA, 25 bp, Homo sapien
ggcccgtgccaacagtggttcctct

SEQ ID NO: 74081 - DNA, 25 bp, Homo sapien
cctctggcacgatcgtggatgaacc

SEQ ID NO: 74082 - DNA, 25 bp, Homo sapien
ccctggcaactgaaatgggaaaggc

SEQ ID NO: 74083 - DNA, 25 bp, Homo sapien
cgcaattccgttcttcccggaagtg

SEQ ID NO: 74084 - DNA, 25 bp, Homo sapien
gaggcctctgctacgaacactggca

SEQ ID NO: 74085 - DNA, 25 bp, Homo sapien
ccgaagtccacggtagtgacagctg

SEQ ID NO: 74086 - DNA, 25 bp, Homo sapien
gtttccgtcggcatcactgataggg

SEQ ID NO: 74087 - DNA, 25 bp, Homo sapien
tgtttccgtcggcatcactgatagg

SEQ ID NO: 74088 - DNA, 25 bp, Homo sapien
tacgctgtcgtactgcctcccgaag

SEQ ID NO: 74089 - DNA, 25 bp, Homo sapien
gtatgctgtcgtacctgcctccaga

SEQ ID NO: 74090 - DNA, 25 bp, Homo sapien
tttccatcggcgtcactgatagggc

SEQ ID NO: 74091 - DNA, 25 bp, Homo sapien
tgctgtcgtacctgcctccagaagg

SEQ ID NO: 74092 - DNA, 25 bp, Homo sapien
gctggctgtttccatcggcgtcact

SEQ ID NO: 74093 - DNA, 25 bp, Homo sapien
atggggcctctgaaatacgttgtcg

SEQ ID NO: 74094 - DNA, 25 bp, Homo sapien
gcgcagatccacaggccgaaggaga

SEQ ID NO: 74095 - DNA, 25 bp, Homo sapien
cagcaattagttgcgctgctgaagc

SEQ ID NO: 74096 - DNA, 25 bp, Homo sapien
ttcctgagccaacagcaattagttg

SEQ ID NO: 74097 - DNA, 25 bp, Homo sapien
cgtattgtccacatttcctgagcca

SEQ ID NO: 74098 - DNA, 25 bp, Homo sapien
ggcgtcccttcctgcgtattgtcca

SEQ ID NO: 74099 - DNA, 25 bp, Homo sapien
gtcgctgtaaggcacggcgtccctt

SEQ ID NO: 74100 - DNA, 25 bp, Homo sapien
agctgcgcgcgcacaaagactgcgg

SEQ ID NO: 74101 - DNA, 25 bp, Homo sapien
tccaggtagtcccagtcccagagcg

SEQ ID NO: 74102 - DNA, 25 bp, Homo sapien
ctggcgaatgtctcgagtttggata

SEQ ID NO: 74103 - DNA, 25 bp, Homo sapien
atggcggttcctattcgcggcacta

SEQ ID NO: 74104 - DNA, 25 bp, Homo sapien
agcacgtcggaaacatggcggttcc

SEQ ID NO: 74105 - DNA, 25 bp, Homo sapien
atttgtgcgtcggtctttagcgtcc

SEQ ID NO: 74106 - DNA, 25 bp, Homo sapien
gctccgctgagtctgatggcgcata

SEQ ID NO: 74107 - DNA, 25 bp, Homo sapien
catggcaacacgaccgctggacgaa

SEQ ID NO: 74108 - DNA, 25 bp, Homo sapien
ccggaagtgacgataagcgagccca

SEQ ID NO: 74109 - DNA, 25 bp, Homo sapien
gtccggcgagaaactagagcacgtc

SEQ ID NO: 74110 - DNA, 25 bp, Homo sapien
accgctggggaacttgttgcttatc

SEQ ID NO: 74111 - DNA, 25 bp, Homo sapien
actgcgtttgctctaatgggttatg

SEQ ID NO: 74112 - DNA, 25 bp, Homo sapien
gcgagccactagttgcccacaggaa

SEQ ID NO: 74113 - DNA, 25 bp, Homo sapien
tactgatgactaggcgagaggcacc

SEQ ID NO: 74114 - DNA, 25 bp, Homo sapien
tctgcatgcgtcgaagcgcgaacca

SEQ ID NO: 74115 - DNA, 25 bp, Homo sapien
ttgtccttgggaacatctgcatgcg

SEQ ID NO: 74116 - DNA, 25 bp, Homo sapien
cggcgacgactaacctcgctgttta

SEQ ID NO: 74117 - DNA, 25 bp, Homo sapien
gcgccggcagactaccgctttaata

SEQ ID NO: 74118 - DNA, 25 bp, Homo sapien
cggccaacgcgctggcggaatttaa

SEQ ID NO: 74119 - DNA, 25 bp, Homo sapien
tgctgctctaccagacgtcggccaa

SEQ ID NO: 74120 - DNA, 25 bp, Homo sapien
tgcacactcgaagctgaatattttc

SEQ ID NO: 74121 - DNA, 25 bp, Homo sapien
tgcggggttcctaagcactctctct

SEQ ID NO: 74122 - DNA, 25 bp, Homo sapien
cagggccgctcccagtagttttatt

SEQ ID NO: 74123 - DNA, 25 bp, Homo sapien
tattcttcgatcttgcccgggccga

SEQ ID NO: 74124 - DNA, 25 bp, Homo sapien
tgctggtgtccaagcccgaaaaggc

SEQ ID NO: 74125 - DNA, 25 bp, Homo sapien
tagcgaggacccaacttacaccgtg

SEQ ID NO: 74126 - DNA, 25 bp, Homo sapien
gacttgtcaagcacggcaatggcga

SEQ ID NO: 74127 - DNA, 25 bp, Homo sapien
tttgaactgtcagcaggctcgggtg

SEQ ID NO: 74128 - DNA, 25 bp, Homo sapien
gtgcagtgatctgtcagcgggttgg

SEQ ID NO: 74129 - DNA, 25 bp, Homo sapien
atctgtcggcgctctgtgatctgtc

SEQ ID NO: 74130 - DNA, 25 bp, Homo sapien
tcaagcacggcaatggcgaggcaca

SEQ ID NO: 74131 - DNA, 25 bp, Homo sapien
cggcaatggcgaggcacagcaagcc

SEQ ID NO: 74132 - DNA, 25 bp, Homo sapien
tggggtttgaactgtcagcaggctc

SEQ ID NO: 74133 - DNA, 25 bp, Homo sapien
ccacgacttgtcaagcacggcaatg

SEQ ID NO: 74134 - DNA, 25 bp, Homo sapien
aggcctgtaaggtggcatccgagtc

SEQ ID NO: 74135 - DNA, 25 bp, Homo sapien
atccgagtccctcccgcaattaagg

SEQ ID NO: 74136 - DNA, 25 bp, Homo sapien
ccgccttgtccaaagggctcatcaa

SEQ ID NO: 74137 - DNA, 25 bp, Homo sapien
tcagtgctttcgaaaccacaagggc

SEQ ID NO: 74138 - DNA, 25 bp, Homo sapien
ccgccgactgcctttcagttcagtg

SEQ ID NO: 74139 - DNA, 25 bp, Homo sapien
ccaggaaggaaatgaccgcccgccg

SEQ ID NO: 74140 - DNA, 25 bp, Homo sapien
agggctcatcaaagccggtttaccg

SEQ ID NO: 74141 - DNA, 25 bp, Homo sapien
ccgcaattaaggacgccgggctcca

SEQ ID NO: 74142 - DNA, 25 bp, Homo sapien
ctcctcgctcacgaagtgaaggtta

SEQ ID NO: 74143 - DNA, 25 bp, Homo sapien
gtgctccgccttggtgaacatcatc

SEQ ID NO: 74144 - DNA, 25 bp, Homo sapien
ccttcagcctcttggtggcgctgga

SEQ ID NO: 74145 - DNA, 25 bp, Homo sapien
tcccggctgagaaatggcgccctac

SEQ ID NO: 74146 - DNA, 25 bp, Homo sapien
ccagaggatatccaagctgagtgtt

SEQ ID NO: 74147 - DNA, 25 bp, Homo sapien
aggcgcccgaacagaggaacttagg

SEQ ID NO: 74148 - DNA, 25 bp, Homo sapien
ctggaggcaccaagaggtaaaactt

SEQ ID NO: 74149 - DNA, 25 bp, Homo sapien
accttgcacttgaagccagcggcgg

SEQ ID NO: 74150 - DNA, 25 bp, Homo sapien
ctggtcatagcagccgcgaagacgg

SEQ ID NO: 74151 - DNA, 25 bp, Homo sapien
agaggatgccctgaaagctccctca

SEQ ID NO: 74152 - DNA, 25 bp, Homo sapien
gaaatccacagtcatcttcatcctg

SEQ ID NO: 74153 - DNA, 25 bp, Homo sapien
cgaagacggcgacgactagtcaggc

SEQ ID NO: 74154 - DNA, 25 bp, Homo sapien
caacgggtctgagcgacggcaaccc

SEQ ID NO: 74155 - DNA, 25 bp, Homo sapien
caacccgagccaatgagcagcgcga

SEQ ID NO: 74156 - DNA, 25 bp, Homo sapien
ggggcgagtccttcagacactcctc

SEQ ID NO: 74157 - DNA, 25 bp, Homo sapien
gcgcaaagaggaactaaatgaactg

SEQ ID NO: 74158 - DNA, 25 bp, Homo sapien
tgaccacggacgcaggttcacgatg

SEQ ID NO: 74159 - DNA, 25 bp, Homo sapien
ctttcgctcactcgagtggggagca

SEQ ID NO: 74160 - DNA, 25 bp, Homo sapien
tcctgggaaaaactgcgtgccagtc

SEQ ID NO: 74161 - DNA, 25 bp, Homo sapien
gccagtcatccagcggactttcgct

SEQ ID NO: 74162 - DNA, 25 bp, Homo sapien
gtgcttcaaaagtgaccacggacgc

SEQ ID NO: 74163 - DNA, 25 bp, Homo sapien
caggttcacgatgggagaaaggatc

SEQ ID NO: 74164 - DNA, 25 bp, Homo sapien
gcgcagtgagcagccgtgcttcaaa

SEQ ID NO: 74165 - DNA, 25 bp, Homo sapien
gcgacacggacacagacagtggcta

SEQ ID NO: 74166 - DNA, 25 bp, Homo sapien
tcctctcgccgaggaggctgagaac

SEQ ID NO: 74167 - DNA, 25 bp, Homo sapien
ctcggcataccggaaggaggattcc

SEQ ID NO: 74168 - DNA, 25 bp, Homo sapien
gcccttcagtactcggcataccgga

SEQ ID NO: 74169 - DNA, 25 bp, Homo sapien
gctctcttcgactccgggaccagtt

SEQ ID NO: 74170 - DNA, 25 bp, Homo sapien
tcgcaaaagcgacttcgtctggccc

SEQ ID NO: 74171 - DNA, 25 bp, Homo sapien
ctgaatctctgaccgagcaggggaa

SEQ ID NO: 74172 - DNA, 25 bp, Homo sapien
aaatccttcctcttcgggagcggag

SEQ ID NO: 74173 - DNA, 25 bp, Homo sapien
ggaccggtccttgctcatctctcag

SEQ ID NO: 74174 - DNA, 25 bp, Homo sapien
ttcaggccctctcggtctgggagat

SEQ ID NO: 74175 - DNA, 25 bp, Homo sapien
gtccttagcaggtaggccgcgtccc

SEQ ID NO: 74176 - DNA, 25 bp, Homo sapien
gaggtctggacgttcaggccctctc

SEQ ID NO: 74177 - DNA, 25 bp, Homo sapien
gagcgcgggacctccgtggccaccc

SEQ ID NO: 74178 - DNA, 25 bp, Homo sapien
aggccctctcggtctgggagatccc

SEQ ID NO: 74179 - DNA, 25 bp, Homo sapien
ctctcggtctgggagatcccggaga

SEQ ID NO: 74180 - DNA, 25 bp, Homo sapien
atagggcccgccctatctcggtcgg

SEQ ID NO: 74181 - DNA, 25 bp, Homo sapien
gccgcgtcccggtgaaggtcgcgac

SEQ ID NO: 74182 - DNA, 25 bp, Homo sapien
cgaatagtttttcctcgtcagagcg

SEQ ID NO: 74183 - DNA, 25 bp, Homo sapien
cgtcagagcgtaattcttaggcaaa

SEQ ID NO: 74184 - DNA, 25 bp, Homo sapien
tcaacacgccttcaacctgggtttg

SEQ ID NO: 74185 - DNA, 25 bp, Homo sapien
cgctggattcgtccggagcaaaaga

SEQ ID NO: 74186 - DNA, 25 bp, Homo sapien
tactccacaggggtcgctggattcg

SEQ ID NO: 74187 - DNA, 25 bp, Homo sapien
ccagctgagaagtcttcgtgcttca

SEQ ID NO: 74188 - DNA, 25 bp, Homo sapien
tctcctggaccgtagtggtagtcgc

SEQ ID NO: 74189 - DNA, 25 bp, Homo sapien
cgcggcgcattcaggttctcctgga

SEQ ID NO: 74190 - DNA, 25 bp, Homo sapien
ctccgagatgaccatccagtgttgg

SEQ ID NO: 74191 - DNA, 25 bp, Homo sapien
acgtggtataagaacgcctccacca

SEQ ID NO: 74192 - DNA, 25 bp, Homo sapien
ctggttgttcaggaagtcaatgacc

SEQ ID NO: 74193 - DNA, 25 bp, Homo sapien
gcggtactggaactccgagatgacc

SEQ ID NO: 74194 - DNA, 25 bp, Homo sapien
tcactcctccgtggaacgtggtata

SEQ ID NO: 74195 - DNA, 25 bp, Homo sapien
gaagaccacgtcgttcctgggctcc

SEQ ID NO: 74196 - DNA, 25 bp, Homo sapien
gactcacgggctgtcacatcgcgca

SEQ ID NO: 74197 - DNA, 25 bp, Homo sapien
catccagtgttggatggggcttccc

SEQ ID NO: 74198 - DNA, 25 bp, Homo sapien
aggaagccaggtcggcaccacggcc

SEQ ID NO: 74199 - DNA, 25 bp, Homo sapien
ctgatgctcccttagagcgggcgga

SEQ ID NO: 74200 - DNA, 25 bp, Homo sapien
gcgcgatcaccgagacggtggccca

SEQ ID NO: 74201 - DNA, 25 bp, Homo sapien
cagccgtcgaagctggccgagacct

SEQ ID NO: 74202 - DNA, 25 bp, Homo sapien
ccctccgtgcggttctggtactcgg

SEQ ID NO: 74203 - DNA, 25 bp, Homo sapien
ccgagacctcagagccgttgcggct

SEQ ID NO: 74204 - DNA, 25 bp, Homo sapien
actccggtggcgttgaacgtctcct

SEQ ID NO: 74205 - DNA, 25 bp, Homo sapien
ggcgttgaacgtctcctggcctgga

SEQ ID NO: 74206 - DNA, 25 bp, Homo sapien
tatccagcaggacacggattgcgtc

SEQ ID NO: 74207 - DNA, 25 bp, Homo sapien
acacggattgcgtcgtgaggctcaa

SEQ ID NO: 74208 - DNA, 25 bp, Homo sapien
atggtcaggctgaaatgtcacagtc

SEQ ID NO: 74209 - DNA, 25 bp, Homo sapien
cgccgtcttcatggtcaggctgaaa

SEQ ID NO: 74210 - DNA, 25 bp, Homo sapien
tgtcacagtctggttatccagcagg

SEQ ID NO: 74211 - DNA, 25 bp, Homo sapien
caaggagccattggacctggaagga

SEQ ID NO: 74212 - DNA, 25 bp, Homo sapien
tacctccgccgtcttcatggtcagg

SEQ ID NO: 74213 - DNA, 25 bp, Homo sapien
ggctcaaggagccattggacctgga

SEQ ID NO: 74214 - DNA, 25 bp, Homo sapien
gagcgtcacccgcatcaaaagattc

SEQ ID NO: 74215 - DNA, 25 bp, Homo sapien
ggcacgagagcgtcacccgcatcaa

SEQ ID NO: 74216 - DNA, 25 bp, Homo sapien
aggcggcacgagagcgtcacccgca

SEQ ID NO: 74217 - DNA, 25 bp, Homo sapien
tcaaaagattctcggggtctcggga

SEQ ID NO: 74218 - DNA, 25 bp, Homo sapien
ccgcatcaaaagattctcggggtct

SEQ ID NO: 74219 - DNA, 25 bp, Homo sapien
gtcacccgcatcaaaagattctcgg

SEQ ID NO: 74220 - DNA, 25 bp, Homo sapien
gcacgagagcgtcacccgcatcaaa

SEQ ID NO: 74221 - DNA, 25 bp, Homo sapien
cgcatcaaaagattctcggggtctc

SEQ ID NO: 74222 - DNA, 25 bp, Homo sapien
tcatcctgggccacgtcgtcatagg

SEQ ID NO: 74223 - DNA, 25 bp, Homo sapien
agttgcctcatgcactcctgctgta

SEQ ID NO: 74224 - DNA, 25 bp, Homo sapien
ctgctgtagcgcctggaagatctct

SEQ ID NO: 74225 - DNA, 25 bp, Homo sapien
aagatctctgcggtctgtgcggagc

SEQ ID NO: 74226 - DNA, 25 bp, Homo sapien
cctgctcaggcacaaaggcgtagtt

SEQ ID NO: 74227 - DNA, 25 bp, Homo sapien
caaaggcgtagttggtctggccctg

SEQ ID NO: 74228 - DNA, 25 bp, Homo sapien
atctcaaagtcatcctcatcctggg

SEQ ID NO: 74229 - DNA, 25 bp, Homo sapien
tgctgttgatggagcagatctcaaa

SEQ ID NO: 74230 - DNA, 25 bp, Homo sapien
accactccatcaggagggcggaacc

SEQ ID NO: 74231 - DNA, 25 bp, Homo sapien
ggcacaccattagtgcaggcacgga

SEQ ID NO: 74232 - DNA, 25 bp, Homo sapien
cctgtcacggcacaccattagtgca

SEQ ID NO: 74233 - DNA, 25 bp, Homo sapien
tggcgagttagtgagccctcatccc

SEQ ID NO: 74234 - DNA, 25 bp, Homo sapien
ctcctgcgccctggcgagttagtga

SEQ ID NO: 74235 - DNA, 25 bp, Homo sapien
tgacgctgcctccaccagcacaaga

SEQ ID NO: 74236 - DNA, 25 bp, Homo sapien
ctgcagcaagcaacactggctcctg

SEQ ID NO: 74237 - DNA, 25 bp, Homo sapien
tcgctccgtctaagctgcagcaagc

SEQ ID NO: 74238 - DNA, 25 bp, Homo sapien
cgacagagatggcacggtgaacgcc

SEQ ID NO: 74239 - DNA, 25 bp, Homo sapien
tgaagagcagattccgcccacgcgt

SEQ ID NO: 74240 - DNA, 25 bp, Homo sapien
tactcactcgtcaatcctgtccggg

SEQ ID NO: 74241 - DNA, 25 bp, Homo sapien
ggtcactgtcgccatgccctgtgtg

SEQ ID NO: 74242 - DNA, 25 bp, Homo sapien
tgccctgtgtggatgaagctgttct

SEQ ID NO: 74243 - DNA, 25 bp, Homo sapien
tcaccacgttgcgagggaagggccc

SEQ ID NO: 74244 - DNA, 25 bp, Homo sapien
gttctcggccctgcgcgacagagat

SEQ ID NO: 74245 - DNA, 25 bp, Homo sapien
tggccacgccaccagtagttctcgg

SEQ ID NO: 74246 - DNA, 25 bp, Homo sapien
cacgcacgctccgaggcacaagaaa

SEQ ID NO: 74247 - DNA, 25 bp, Homo sapien
cgcccacgcacgctccgaggcacaa

SEQ ID NO: 74248 - DNA, 25 bp, Homo sapien
cacgctccgaggcacaggaagctcc

SEQ ID NO: 74249 - DNA, 25 bp, Homo sapien
cacgcacgctccgaggcacaggaag

SEQ ID NO: 74250 - DNA, 25 bp, Homo sapien
cgcacgctccgaggcacaagaagct

SEQ ID NO: 74251 - DNA, 25 bp, Homo sapien
cacgctcggaggcacaggaagctcc

SEQ ID NO: 74252 - DNA, 25 bp, Homo sapien
cccacgcacgctccgaggcacaaga

SEQ ID NO: 74253 - DNA, 25 bp, Homo sapien
cacgcacgctccgaggcacaagaag

SEQ ID NO: 74254 - DNA, 25 bp, Homo sapien
gtgcccaaggcaggtcactccgtct

SEQ ID NO: 74255 - DNA, 25 bp, Homo sapien
cgagaaaacatgcttgctcctgggg

SEQ ID NO: 74256 - DNA, 25 bp, Homo sapien
tcctgacaccactcgagaaaacatg

SEQ ID NO: 74257 - DNA, 25 bp, Homo sapien
cctcccttagtgcaggtatggccga

SEQ ID NO: 74258 - DNA, 25 bp, Homo sapien
ggaaaggagacatcaagcccacctc

SEQ ID NO: 74259 - DNA, 25 bp, Homo sapien
gcacagaagcctcctttgggaccca

SEQ ID NO: 74260 - DNA, 25 bp, Homo sapien
cagagcagcgtgactcgtgcccaag

SEQ ID NO: 74261 - DNA, 25 bp, Homo sapien
ctttgggacccacttctgagaggga

SEQ ID NO: 74262 - DNA, 25 bp, Homo sapien
cgtgcgcgacgtccacgagttttta

SEQ ID NO: 74263 - DNA, 25 bp, Homo sapien
ctacagacgctctgctgagcggctg

SEQ ID NO: 74264 - DNA, 25 bp, Homo sapien
gcttcttccaacaacagacactttg

SEQ ID NO: 74265 - DNA, 25 bp, Homo sapien
tccagaagccttggctaagcgagaa

SEQ ID NO: 74266 - DNA, 25 bp, Homo sapien
tttttaggacgaccagcccttcagc

SEQ ID NO: 74267 - DNA, 25 bp, Homo sapien
gcctgcgccatttaagccacatatc

SEQ ID NO: 74268 - DNA, 25 bp, Homo sapien
caaggccggcggcagctacgtagcc

SEQ ID NO: 74269 - DNA, 25 bp, Homo sapien
cagacactttgcgagccttccagaa

SEQ ID NO: 74270 - DNA, 25 bp, Homo sapien
ggtcctgtacaaagtgccggcagaa

SEQ ID NO: 74271 - DNA, 25 bp, Homo sapien
cacaggctgctcacgtgtccgtatc

SEQ ID NO: 74272 - DNA, 25 bp, Homo sapien
cacgtgtccgtatctggcggagaca

SEQ ID NO: 74273 - DNA, 25 bp, Homo sapien
gcggagacagacacttagcccagca

SEQ ID NO: 74274 - DNA, 25 bp, Homo sapien
ctgcccgataagaccctggacgagg

SEQ ID NO: 74275 - DNA, 25 bp, Homo sapien
accttactcatccacgacttgcgtt

SEQ ID NO: 74276 - DNA, 25 bp, Homo sapien
cgacttgcgtttgcacaaggccttc

SEQ ID NO: 74277 - DNA, 25 bp, Homo sapien
agctctacaagtgccctgcccgata

SEQ ID NO: 74278 - DNA, 25 bp, Homo sapien
aatgcacgcaaatccaaacgttgga

SEQ ID NO: 74279 - DNA, 25 bp, Homo sapien
cagcacgttaagcagggcgcactca

SEQ ID NO: 74280 - DNA, 25 bp, Homo sapien
ccgctccagcacgttaagcagggcg

SEQ ID NO: 74281 - DNA, 25 bp, Homo sapien
aacgacatctttaatcgcgccctcg

SEQ ID NO: 74282 - DNA, 25 bp, Homo sapien
ccctctcgttgggaaacgacatctt

SEQ ID NO: 74283 - DNA, 25 bp, Homo sapien
ggaggcgaaacgatgctaaatctta

SEQ ID NO: 74284 - DNA, 25 bp, Homo sapien
gcagcaattcagacccgttcaccgg

SEQ ID NO: 74285 - DNA, 25 bp, Homo sapien
caaacgttggaagaggcagcaattc

SEQ ID NO: 74286 - DNA, 25 bp, Homo sapien
agggcccggactcctgctcaaaagc

SEQ ID NO: 74287 - DNA, 25 bp, Homo sapien
atcctccagaagtgcagggccgcta

SEQ ID NO: 74288 - DNA, 25 bp, Homo sapien
cagagccaccaactggggccttggg

SEQ ID NO: 74289 - DNA, 25 bp, Homo sapien
cgtattcacggtaaggggccatccg

SEQ ID NO: 74290 - DNA, 25 bp, Homo sapien
aggggccatccgagaagcccacagc

SEQ ID NO: 74291 - DNA, 25 bp, Homo sapien
acgcactgacctccttgacttcaga

SEQ ID NO: 74292 - DNA, 25 bp, Homo sapien
ccttgacttcagagcggtgacacga

SEQ ID NO: 74293 - DNA, 25 bp, Homo sapien
cgggcctcgagcatcctccagaagt

SEQ ID NO: 74294 - DNA, 25 bp, Homo sapien
ccgggcagccaattcgcctcttgca

SEQ ID NO: 74295 - DNA, 25 bp, Homo sapien
cgttcaggtaggtttcctggacagc

SEQ ID NO: 74296 - DNA, 25 bp, Homo sapien
gccgctcccaggaccaccgcctccc

SEQ ID NO: 74297 - DNA, 25 bp, Homo sapien
cccgcccgacgctctcccactgccg

SEQ ID NO: 74298 - DNA, 25 bp, Homo sapien
tgcgccacaggccagcccgccgagc

SEQ ID NO: 74299 - DNA, 25 bp, Homo sapien
ctcggcccagcgcactcgcttgccc

SEQ ID NO: 74300 - DNA, 25 bp, Homo sapien
ccctccagatggtgctgccctcggc

SEQ ID NO: 74301 - DNA, 25 bp, Homo sapien
taggtttcctggacagcccgcacca

SEQ ID NO: 74302 - DNA, 25 bp, Homo sapien
tggaggaaatgtcccgcgccgcgac

SEQ ID NO: 74303 - DNA, 25 bp, Homo sapien
ggaggaaatgtcccgcgccgcgacc

SEQ ID NO: 74304 - DNA, 25 bp, Homo sapien
ttggaggaaatgtcccgcgccgcga

SEQ ID NO: 74305 - DNA, 25 bp, Homo sapien
cgcttggaggaaatgtcccgcgccg

SEQ ID NO: 74306 - DNA, 25 bp, Homo sapien
atcctccggcgcaggccacctgcgc

SEQ ID NO: 74307 - DNA, 25 bp, Homo sapien
aggaaatgtcccgcgccgcgacccg

SEQ ID NO: 74308 - DNA, 25 bp, Homo sapien
gaggaaatgtcccgcgccgcgaccc

SEQ ID NO: 74309 - DNA, 25 bp, Homo sapien
gcgcttggaggaaatgtcccgcgcc

SEQ ID NO: 74310 - DNA, 25 bp, Homo sapien
tggctcacagccgccatcatgctag

SEQ ID NO: 74311 - DNA, 25 bp, Homo sapien
tgctagcgctcatctgccgcctgcc

SEQ ID NO: 74312 - DNA, 25 bp, Homo sapien
ccttcgctcgtctggaaggaggaga

SEQ ID NO: 74313 - DNA, 25 bp, Homo sapien
agccgatgctcgtgggctgcagtac

SEQ ID NO: 74314 - DNA, 25 bp, Homo sapien
gggcaaggccaccttcgtcactgcc

SEQ ID NO: 74315 - DNA, 25 bp, Homo sapien
ttcgtcactgccatcacgtcaggtg

SEQ ID NO: 74316 - DNA, 25 bp, Homo sapien
gtcaggtgaattcagcggagatatg

SEQ ID NO: 74317 - DNA, 25 bp, Homo sapien
tgccatcacgtcaggtgaattcagc

SEQ ID NO: 74318 - DNA, 25 bp, Homo sapien
ggctccctatggctgctggacagca

SEQ ID NO: 74319 - DNA, 25 bp, Homo sapien
agctttgtccctttccgcagtgaga

SEQ ID NO: 74320 - DNA, 25 bp, Homo sapien
tcattcgtcgctctgtgaccgagga

SEQ ID NO: 74321 - DNA, 25 bp, Homo sapien
cggtgtagttctagaagcccgcact

SEQ ID NO: 74322 - DNA, 25 bp, Homo sapien
acccgatatcccgacgctctgaggg

SEQ ID NO: 74323 - DNA, 25 bp, Homo sapien
tgtgcgtcacttcctgaggcacgta

SEQ ID NO: 74324 - DNA, 25 bp, Homo sapien
acgtacgctcgcgaggtgctctgac

SEQ ID NO: 74325 - DNA, 25 bp, Homo sapien
ggtacacctggtctcgtcattcgtc

SEQ ID NO: 74326 - DNA, 25 bp, Homo sapien
gagctcacggacagtgcctggatca

SEQ ID NO: 74327 - DNA, 25 bp, Homo sapien
taccttgcccttgtaggtgcggtcg

SEQ ID NO: 74328 - DNA, 25 bp, Homo sapien
ccaccacgatgctgcgcgggttaag

SEQ ID NO: 74329 - DNA, 25 bp, Homo sapien
gcagcaggagggacagcggcaccag

SEQ ID NO: 74330 - DNA, 25 bp, Homo sapien
cttgcccttgtaggtgcggtcggcc

SEQ ID NO: 74331 - DNA, 25 bp, Homo sapien
tcggccgagctcacggacagtgcct

SEQ ID NO: 74332 - DNA, 25 bp, Homo sapien
gaggtgcaagctgaccacccgcggc

SEQ ID NO: 74333 - DNA, 25 bp, Homo sapien
gcgtaccttgcccttgtaggtgcgg

SEQ ID NO: 74334 - DNA, 25 bp, Homo sapien
tccgaggtcaccgtgtttcgcattc

SEQ ID NO: 74335 - DNA, 25 bp, Homo sapien
tcccgtgtccaactcgggctgtgtc

SEQ ID NO: 74336 - DNA, 25 bp, Homo sapien
tacggatgtgaaccggcccaagtgc

SEQ ID NO: 74337 - DNA, 25 bp, Homo sapien
gacacagtagttccgcctcctcaga

SEQ ID NO: 74338 - DNA, 25 bp, Homo sapien
ccgcgtcactgactagggaagttga

SEQ ID NO: 74339 - DNA, 25 bp, Homo sapien
ctgtcactggccctcggtcacagta

SEQ ID NO: 74340 - DNA, 25 bp, Homo sapien
tttcgcattcactgctcctgggtca

SEQ ID NO: 74341 - DNA, 25 bp, Homo sapien
tgcctcgccgcagcgttagctttta

SEQ ID NO: 74342 - DNA, 25 bp, Homo sapien
tccttactcaggacgccatcgcggg

SEQ ID NO: 74343 - DNA, 25 bp, Homo sapien
cgtgtgcacagtcaccctcgaatca

SEQ ID NO: 74344 - DNA, 25 bp, Homo sapien
acactccgatggacgtggccatgcc

SEQ ID NO: 74345 - DNA, 25 bp, Homo sapien
caggccgcagaatataggtgttctc

SEQ ID NO: 74346 - DNA, 25 bp, Homo sapien
gcccggcgcccaaacactgaggaag

SEQ ID NO: 74347 - DNA, 25 bp, Homo sapien
ctcgaatcacggctgaacggcatcc

SEQ ID NO: 74348 - DNA, 25 bp, Homo sapien
gatcccacccgggtaggacttcgca

SEQ ID NO: 74349 - DNA, 25 bp, Homo sapien
ctacccgcctctgctggaaaacagg

SEQ ID NO: 74350 - DNA, 25 bp, Homo sapien
ccgccttatagttggccctccgcca

SEQ ID NO: 74351 - DNA, 25 bp, Homo sapien
gggctggctaattggcgcccagata

SEQ ID NO: 74352 - DNA, 25 bp, Homo sapien
cttctagtccgcctttggcggccgt

SEQ ID NO: 74353 - DNA, 25 bp, Homo sapien
tccgcttctagtccgcctttggcgg

SEQ ID NO: 74354 - DNA, 25 bp, Homo sapien
ttctcgacggagatggctccggctg

SEQ ID NO: 74355 - DNA, 25 bp, Homo sapien
ttttgttctcgacggagatggctcc

SEQ ID NO: 74356 - DNA, 25 bp, Homo sapien
cgcccggcgctttgcatagtgggcc

SEQ ID NO: 74357 - DNA, 25 bp, Homo sapien
ccgccattttgttctcgacggagat

SEQ ID NO: 74358 - DNA, 25 bp, Homo sapien
cccgactcccaggatctgggatcga

SEQ ID NO: 74359 - DNA, 25 bp, Homo sapien
ccctggccgcgaacgcgctctgggc

SEQ ID NO: 74360 - DNA, 25 bp, Homo sapien
cgaaccgagggtgtggcgttcgcga

SEQ ID NO: 74361 - DNA, 25 bp, Homo sapien
gggtgcagtcacgacgccgcgactc

SEQ ID NO: 74362 - DNA, 25 bp, Homo sapien
tccccacaggcgaggagcaaatcct

SEQ ID NO: 74363 - DNA, 25 bp, Homo sapien
ttccaggagtctttggctgtggtcc

SEQ ID NO: 74364 - DNA, 25 bp, Homo sapien
ctgggatcgattccaggagtctttg

SEQ ID NO: 74365 - DNA, 25 bp, Homo sapien
cccaggatctgggatcgattccagg

SEQ ID NO: 74366 - DNA, 25 bp, Homo sapien
ttttgccattgctggtgccttcctc

SEQ ID NO: 74367 - DNA, 25 bp, Homo sapien
gggatctccctccacgctactagga

SEQ ID NO: 74368 - DNA, 25 bp, Homo sapien
ctaggagacagagaacgagggtatc

SEQ ID NO: 74369 - DNA, 25 bp, Homo sapien
ctgcctgctcagtgcatcctttttg

SEQ ID NO: 74370 - DNA, 25 bp, Homo sapien
cgcggtgtcgattcctagattccga

SEQ ID NO: 74371 - DNA, 25 bp, Homo sapien
aaggaagcttcggtctcggcagata

SEQ ID NO: 74372 - DNA, 25 bp, Homo sapien
ggcagatagttcttcgcatttcagc

SEQ ID NO: 74373 - DNA, 25 bp, Homo sapien
accgcgtctcttaccggtaatggtg

SEQ ID NO: 74374 - DNA, 25 bp, Homo sapien
gggcggcgtctttgtccattttcaa

SEQ ID NO: 74375 - DNA, 25 bp, Homo sapien
aaaccctattcgttgcggcagcgca

SEQ ID NO: 74376 - DNA, 25 bp, Homo sapien
gggacagcataaactcgccttttcg

SEQ ID NO: 74377 - DNA, 25 bp, Homo sapien
gtcgactggaagcacggtttacaca

SEQ ID NO: 74378 - DNA, 25 bp, Homo sapien
ggctccacgaggatttccatgcaga

SEQ ID NO: 74379 - DNA, 25 bp, Homo sapien
ctcagggtcaggcaaacaggaatac

SEQ ID NO: 74380 - DNA, 25 bp, Homo sapien
cggctgcagcataacttccgcttta

SEQ ID NO: 74381 - DNA, 25 bp, Homo sapien
ggcgtctttgggtagagccatttca

SEQ ID NO: 74382 - DNA, 25 bp, Homo sapien
tcttcaagtacggagaactgcggtg

SEQ ID NO: 74383 - DNA, 25 bp, Homo sapien
agcacgcccttgtaggacgtgtccc

SEQ ID NO: 74384 - DNA, 25 bp, Homo sapien
ctgcggaggccgcatttccactcag

SEQ ID NO: 74385 - DNA, 25 bp, Homo sapien
gggacagatctaagggacatttata

SEQ ID NO: 74386 - DNA, 25 bp, Homo sapien
gacatttataactccgcagggactc

SEQ ID NO: 74387 - DNA, 25 bp, Homo sapien
gtccgtctcaggtgcgtctccggaa

SEQ ID NO: 74388 - DNA, 25 bp, Homo sapien
agctttgctagctcagcctccagca

SEQ ID NO: 74389 - DNA, 25 bp, Homo sapien
gtccctgcagccgactgaaaaggtg

SEQ ID NO: 74390 - DNA, 25 bp, Homo sapien
tcctcggcgcctagtgataacctca

SEQ ID NO: 74391 - DNA, 25 bp, Homo sapien
ggccgagaggaaccgcgaacgagct

SEQ ID NO: 74392 - DNA, 25 bp, Homo sapien
caaacagtcacatccggggccgaga

SEQ ID NO: 74393 - DNA, 25 bp, Homo sapien
caatcccgtcgagcgtcaggcgtga

SEQ ID NO: 74394 - DNA, 25 bp, Homo sapien
ggcgccagcctcatacctgcgcttc

SEQ ID NO: 74395 - DNA, 25 bp, Homo sapien
gaaagcagcatcgaagccaccggcg

SEQ ID NO: 74396 - DNA, 25 bp, Homo sapien
tcgaagtcaccggaaagcagcatcg

SEQ ID NO: 74397 - DNA, 25 bp, Homo sapien
ggcgcagccaaacagtcacatccgg

SEQ ID NO: 74398 - DNA, 25 bp, Homo sapien
gtttctcatccgagcttctgagtca

SEQ ID NO: 74399 - DNA, 25 bp, Homo sapien
gcaagcactggtaccgctgcctgca

SEQ ID NO: 74400 - DNA, 25 bp, Homo sapien
gcctgcacggcgatgagaacagcga

SEQ ID NO: 74401 - DNA, 25 bp, Homo sapien
ccgcagcctggcagaagaggctctg

SEQ ID NO: 74402 - DNA, 25 bp, Homo sapien
gctctgcgcacggacatcctgtgca

SEQ ID NO: 74403 - DNA, 25 bp, Homo sapien
ctgcccagctacaaggccaaggtga

SEQ ID NO: 74404 - DNA, 25 bp, Homo sapien
gtcgttcgcggtgtttctcatccga

SEQ ID NO: 74405 - DNA, 25 bp, Homo sapien
cgccctggtgtgcaagcactggtac

SEQ ID NO: 74406 - DNA, 25 bp, Homo sapien
cgcccttcgctgttagcgcttagga

SEQ ID NO: 74407 - DNA, 25 bp, Homo sapien
ttagcgcttaggatctggtgccttt

SEQ ID NO: 74408 - DNA, 25 bp, Homo sapien
ggctaaactgcccaactgccgatta

SEQ ID NO: 74409 - DNA, 25 bp, Homo sapien
agccaatcaccttccaggctcaggg

SEQ ID NO: 74410 - DNA, 25 bp, Homo sapien
gcttgatagcaaaccacactcggca

SEQ ID NO: 74411 - DNA, 25 bp, Homo sapien
cccgggcctccatgaaatcagcaag

SEQ ID NO: 74412 - DNA, 25 bp, Homo sapien
gccgggagtcgctctagccaatcac

SEQ ID NO: 74413 - DNA, 25 bp, Homo sapien
tgaaatcagcaagggcgcgctcctc

SEQ ID NO: 74414 - DNA, 25 bp, Homo sapien
cttccctctaagaggccgggtctga

SEQ ID NO: 74415 - DNA, 25 bp, Homo sapien
aagctgtggcttgctgcgtccaagc

SEQ ID NO: 74416 - DNA, 25 bp, Homo sapien
cgttccttccgctggtgctaaaata

SEQ ID NO: 74417 - DNA, 25 bp, Homo sapien
tctccatgtgacttcagtttccgtc

SEQ ID NO: 74418 - DNA, 25 bp, Homo sapien
tctgagtgagcctgtgctgagtcgc

SEQ ID NO: 74419 - DNA, 25 bp, Homo sapien
tgctggaagatcgtctaaacatccc

SEQ ID NO: 74420 - DNA, 25 bp, Homo sapien
gcctcggtcgcattgctggaagatc

SEQ ID NO: 74421 - DNA, 25 bp, Homo sapien
gagcagcccgctctccatgtgactt

SEQ ID NO: 74422 - DNA, 25 bp, Homo sapien
gaagaattctcctccagcgacctcg

SEQ ID NO: 74423 - DNA, 25 bp, Homo sapien
cagttcctcctcgtggacggcaacg

SEQ ID NO: 74424 - DNA, 25 bp, Homo sapien
ggcttctaccgggacctgtacaaca

SEQ ID NO: 74425 - DNA, 25 bp, Homo sapien
gctgcgcgacaacaacatgggcttc

SEQ ID NO: 74426 - DNA, 25 bp, Homo sapien
gtacagcaagttgcggaccctcctg

SEQ ID NO: 74427 - DNA, 25 bp, Homo sapien
ctacaacgtcctggagtggttcctc

SEQ ID NO: 74428 - DNA, 25 bp, Homo sapien
cggggaacaccatcatgcggctgga

SEQ ID NO: 74429 - DNA, 25 bp, Homo sapien
tgcgggtcctcaacgtcagctacaa

SEQ ID NO: 74430 - DNA, 25 bp, Homo sapien
cctaagccgactgtgagaccgggcg

SEQ ID NO: 74431 - DNA, 25 bp, Homo sapien
cccggcgcgggacctagatcagtag

SEQ ID NO: 74432 - DNA, 25 bp, Homo sapien
agcactcggtcccagccgataaatc

SEQ ID NO: 74433 - DNA, 25 bp, Homo sapien
tggcctagcggtttccacagcgaca

SEQ ID NO: 74434 - DNA, 25 bp, Homo sapien
tcggcgtacagggattccaggtccc

SEQ ID NO: 74435 - DNA, 25 bp, Homo sapien
caggaagaggcgacagccacagccc

SEQ ID NO: 74436 - DNA, 25 bp, Homo sapien
ccctactgacgagcccgaggggtga

SEQ ID NO: 74437 - DNA, 25 bp, Homo sapien
tcagacactagagccgtgtgccctc

SEQ ID NO: 74438 - DNA, 25 bp, Homo sapien
gggcggtggctcattgtctgctccc

SEQ ID NO: 74439 - DNA, 25 bp, Homo sapien
acggtctctgccgactctcggtctt

SEQ ID NO: 74440 - DNA, 25 bp, Homo sapien
cagcggcggcggttgttccgcttcc

SEQ ID NO: 74441 - DNA, 25 bp, Homo sapien
caacgtctatcaccgaactactact

SEQ ID NO: 74442 - DNA, 25 bp, Homo sapien
tcgctggctttagccagaaatggga

SEQ ID NO: 74443 - DNA, 25 bp, Homo sapien
ccttgcccggggtaagtgcacacag

SEQ ID NO: 74444 - DNA, 25 bp, Homo sapien
cctagcggtagcagcggctgctcca

SEQ ID NO: 74445 - DNA, 25 bp, Homo sapien
cagggccgttttcttcgctggcttt

SEQ ID NO: 74446 - DNA, 25 bp, Homo sapien
agtggcaatgccgtagtccagcagg

SEQ ID NO: 74447 - DNA, 25 bp, Homo sapien
ccgaggtggcccagaacaatctgca

SEQ ID NO: 74448 - DNA, 25 bp, Homo sapien
cgcgcagcccaaaggatacgacagc

SEQ ID NO: 74449 - DNA, 25 bp, Homo sapien
cggctcctggaagagacgcgaccca

SEQ ID NO: 74450 - DNA, 25 bp, Homo sapien
cgccggtgaaacgacgtctccacaa

SEQ ID NO: 74451 - DNA, 25 bp, Homo sapien
ggacatctctgggtctctggacagc

SEQ ID NO: 74452 - DNA, 25 bp, Homo sapien
gggagccctagtccgctagagtccg

SEQ ID NO: 74453 - DNA, 25 bp, Homo sapien
cgtgcgcctgtgattggacatctct

SEQ ID NO: 74454 - DNA, 25 bp, Homo sapien
gactcgggacctcacgttaccagca

SEQ ID NO: 74455 - DNA, 25 bp, Homo sapien
agacgcacaggagacgcttcccggc

SEQ ID NO: 74456 - DNA, 25 bp, Homo sapien
gaaaggactagctagcacccgcgcg

SEQ ID NO: 74457 - DNA, 25 bp, Homo sapien
cctggctcagatattgcagggtgcg

SEQ ID NO: 74458 - DNA, 25 bp, Homo sapien
cacggagtccttgaacaccacgttc

SEQ ID NO: 74459 - DNA, 25 bp, Homo sapien
tcactgtcatgaccttcacggagtc

SEQ ID NO: 74460 - DNA, 25 bp, Homo sapien
tgcagcttcgctttaggacgccttc

SEQ ID NO: 74461 - DNA, 25 bp, Homo sapien
caggctggcacgactagcaggttac

SEQ ID NO: 74462 - DNA, 25 bp, Homo sapien
cttagcagctcctgaacgcggttcc

SEQ ID NO: 74463 - DNA, 25 bp, Homo sapien
ggcttcccttggagctgacgaaggc

SEQ ID NO: 74464 - DNA, 25 bp, Homo sapien
acgagtgacggactcagcgatcgcc

SEQ ID NO: 74465 - DNA, 25 bp, Homo sapien
gctcctcctgaagccgggaaagctc

SEQ ID NO: 74466 - DNA, 25 bp, Homo sapien
tttttatttgcttagaccgctctgc

SEQ ID NO: 74467 - DNA, 25 bp, Homo sapien
gtcttttcccttcggtctgctctga

SEQ ID NO: 74468 - DNA, 25 bp, Homo sapien
ctgctctgagcggtatcagcctccg

SEQ ID NO: 74469 - DNA, 25 bp, Homo sapien
ggttcccatcccagcgcgttctgag

SEQ ID NO: 74470 - DNA, 25 bp, Homo sapien
cgtttctcagcgttcttgcccaggg

SEQ ID NO: 74471 - DNA, 25 bp, Homo sapien
tttagagacgccttcacccaggagc

SEQ ID NO: 74472 - DNA, 25 bp, Homo sapien
gctcaaacctctcggcactggctgg

SEQ ID NO: 74473 - DNA, 25 bp, Homo sapien
cccgtcttccagagcaagtggcttc

SEQ ID NO: 74474 - DNA, 25 bp, Homo sapien
aggaggccacccgacatagtgcaga

SEQ ID NO: 74475 - DNA, 25 bp, Homo sapien
ggcgagcatctcattggacccaatc

SEQ ID NO: 74476 - DNA, 25 bp, Homo sapien
ttcagtgatatccaagcgcccttcc

SEQ ID NO: 74477 - DNA, 25 bp, Homo sapien
ccacttggcgtttgcggatttcagc

SEQ ID NO: 74478 - DNA, 25 bp, Homo sapien
caagcagcagggagagaccatctca

SEQ ID NO: 74479 - DNA, 25 bp, Homo sapien
aggcattgacaaccacgccgacagg

SEQ ID NO: 74480 - DNA, 25 bp, Homo sapien
tcagagacaggggaacagccaagca

SEQ ID NO: 74481 - DNA, 25 bp, Homo sapien
agccaagcagaaaccactgtgctgg

SEQ ID NO: 74482 - DNA, 25 bp, Homo sapien
aggccgggaaagacagcacatctgc

SEQ ID NO: 74483 - DNA, 25 bp, Homo sapien
gagtagaaacactgctcccgccagc

SEQ ID NO: 74484 - DNA, 25 bp, Homo sapien
tgtgtgcgcagaaccgtgtctgctc

SEQ ID NO: 74485 - DNA, 25 bp, Homo sapien
ctttaggatgaagcgacagggccca

SEQ ID NO: 74486 - DNA, 25 bp, Homo sapien
ctcctctcgttcgaaatgaccattt

SEQ ID NO: 74487 - DNA, 25 bp, Homo sapien
cctcggcgaacagcctttcggcgcg

SEQ ID NO: 74488 - DNA, 25 bp, Homo sapien
tcgaaatgaccatttcggggttctc

SEQ ID NO: 74489 - DNA, 25 bp, Homo sapien
ttcgtggcccgaaacgcctcgcaat

SEQ ID NO: 74490 - DNA, 25 bp, Homo sapien
aaacgcctcgcaatggagtcactca

SEQ ID NO: 74491 - DNA, 25 bp, Homo sapien
tcactcatgacaggggactcagcgc

SEQ ID NO: 74492 - DNA, 25 bp, Homo sapien
tcatgacaggggactcagcgcacgg

SEQ ID NO: 74493 - DNA, 25 bp, Homo sapien
gccgacggggacctgacacggtcac

SEQ ID NO: 74494 - DNA, 25 bp, Homo sapien
agcccggactcagcggtttcctggg

SEQ ID NO: 74495 - DNA, 25 bp, Homo sapien
gaagcccggactcagcggtttcctg

SEQ ID NO: 74496 - DNA, 25 bp, Homo sapien
gccgctgtcccacgcgccgggtccc

SEQ ID NO: 74497 - DNA, 25 bp, Homo sapien
ccctcccagcgcacgggcggtcgga

SEQ ID NO: 74498 - DNA, 25 bp, Homo sapien
gcgcctcaggtagcagcgccaggtg

SEQ ID NO: 74499 - DNA, 25 bp, Homo sapien
tcacctccggctcccttcaggcggg

SEQ ID NO: 74500 - DNA, 25 bp, Homo sapien
ttctggattccagcgcgaagccgcc

SEQ ID NO: 74501 - DNA, 25 bp, Homo sapien
gagcttccttctggattccagcgcg

SEQ ID NO: 74502 - DNA, 25 bp, Homo sapien
tggatgcccgcttcccggaaggcct

SEQ ID NO: 74503 - DNA, 25 bp, Homo sapien
ggcgcaccaccgcacctccatgcca

SEQ ID NO: 74504 - DNA, 25 bp, Homo sapien
tccgaggtggcgcaccaccgcacct

SEQ ID NO: 74505 - DNA, 25 bp, Homo sapien
tcatgttgccgcacttgtgctgctc

SEQ ID NO: 74506 - DNA, 25 bp, Homo sapien
ggaaggcctcgctcatgttgccgca

SEQ ID NO: 74507 - DNA, 25 bp, Homo sapien
caccgcgatgagctggacgcagtgg

SEQ ID NO: 74508 - DNA, 25 bp, Homo sapien
catgccaccgagcactgcgggcagg

SEQ ID NO: 74509 - DNA, 25 bp, Homo sapien
gcctcgctcatgttgccgcacttgt

SEQ ID NO: 74510 - DNA, 25 bp, Homo sapien
tcgcgccctagaaagactccagata

SEQ ID NO: 74511 - DNA, 25 bp, Homo sapien
ctgccggtcagtccctctgaatctt

SEQ ID NO: 74512 - DNA, 25 bp, Homo sapien
aagtcttcctgagttcctgcgcccg

SEQ ID NO: 74513 - DNA, 25 bp, Homo sapien
cccgtctgcgcttcagtgctagttc

SEQ ID NO: 74514 - DNA, 25 bp, Homo sapien
agctccttaagtgcggccgcgagtt

SEQ ID NO: 74515 - DNA, 25 bp, Homo sapien
cagataccgtgtctaactggagaga

SEQ ID NO: 74516 - DNA, 25 bp, Homo sapien
aggtcagaatcccagagtcggggct

SEQ ID NO: 74517 - DNA, 25 bp, Homo sapien
aggatgatctcattcacgcagcagc

SEQ ID NO: 74518 - DNA, 25 bp, Homo sapien
ggccgctgaagtggctctgagaaca

SEQ ID NO: 74519 - DNA, 25 bp, Homo sapien
gggagcatcctaagggaacctcttc

SEQ ID NO: 74520 - DNA, 25 bp, Homo sapien
actcggactccacaggtggcccggg

SEQ ID NO: 74521 - DNA, 25 bp, Homo sapien
gcgcgtcccgcagttccgaactaaa

SEQ ID NO: 74522 - DNA, 25 bp, Homo sapien
cagttccgaactaaacgcgccaggc

SEQ ID NO: 74523 - DNA, 25 bp, Homo sapien
gcgccgccacaaagttccggtgagc

SEQ ID NO: 74524 - DNA, 25 bp, Homo sapien
cgcgctgctaccttcgggttggaag

SEQ ID NO: 74525 - DNA, 25 bp, Homo sapien
tctgagaacaaaggagttaacactc

SEQ ID NO: 74526 - DNA, 25 bp, Homo sapien
ccggtctgagccacccaggttatag

SEQ ID NO: 74527 - DNA, 25 bp, Homo sapien
tctgagccacccaggttatagaagg

SEQ ID NO: 74528 - DNA, 25 bp, Homo sapien
cccaggttatagaaggggaatctcg

SEQ ID NO: 74529 - DNA, 25 bp, Homo sapien
gaagctttccaagtcactgcccacg

SEQ ID NO: 74530 - DNA, 25 bp, Homo sapien
tgcccacgtcttcgaacttcctcgg

SEQ ID NO: 74531 - DNA, 25 bp, Homo sapien
tctcgggaagctttccaagtcactg

SEQ ID NO: 74532 - DNA, 25 bp, Homo sapien
ttatagaaggggaatctcgggaagc

SEQ ID NO: 74533 - DNA, 25 bp, Homo sapien
agtcactgcccacgtcttcgaactt

SEQ ID NO: 74534 - DNA, 25 bp, Homo sapien
ctgaggtctgtgtcaggtacaggca

SEQ ID NO: 74535 - DNA, 25 bp, Homo sapien
ggtgtctcctgaaactcatcttgaa

SEQ ID NO: 74536 - DNA, 25 bp, Homo sapien
aataatctcagccaggcacaggggc

SEQ ID NO: 74537 - DNA, 25 bp, Homo sapien
agggttggcctctgacctgaggtct

SEQ ID NO: 74538 - DNA, 25 bp, Homo sapien
cagaggaacaaaggccaaaatggtg

SEQ ID NO: 74539 - DNA, 25 bp, Homo sapien
ggcagagggcaatgcactcagcacc

SEQ ID NO: 74540 - DNA, 25 bp, Homo sapien
gagtgccacttggtgtctcctgaaa

SEQ ID NO: 74541 - DNA, 25 bp, Homo sapien
ccaaaatggtgctgagtgccacttg

SEQ ID NO: 74542 - DNA, 25 bp, Homo sapien
agatgcccggaaccgctgcagcagc

SEQ ID NO: 74543 - DNA, 25 bp, Homo sapien
tctaatagcgcagatgcccggaacc

SEQ ID NO: 74544 - DNA, 25 bp, Homo sapien
ccgcgagccgggagaattctaatag

SEQ ID NO: 74545 - DNA, 25 bp, Homo sapien
accacgtgactggattcctgcggcc

SEQ ID NO: 74546 - DNA, 25 bp, Homo sapien
aggcaccacgtctaccacgtgactg

SEQ ID NO: 74547 - DNA, 25 bp, Homo sapien
tttctctcagactgagcgctcgctg

SEQ ID NO: 74548 - DNA, 25 bp, Homo sapien
ggaagtgccagactcctacttccca

SEQ ID NO: 74549 - DNA, 25 bp, Homo sapien
tacttcccaccggatgcggggctcg

SEQ ID NO: 74550 - DNA, 25 bp, Homo sapien
tgtgtgcagggatgccacccgaaac

SEQ ID NO: 74551 - DNA, 25 bp, Homo sapien
caggttctcctgcagagtgcgcact

SEQ ID NO: 74552 - DNA, 25 bp, Homo sapien
tggtcatactcgtcctgcagctgcc

SEQ ID NO: 74553 - DNA, 25 bp, Homo sapien
tgtctgctgctggtcatactcgtcc

SEQ ID NO: 74554 - DNA, 25 bp, Homo sapien
gggacagctcgatggccttctctgt

SEQ ID NO: 74555 - DNA, 25 bp, Homo sapien
agagtgcgcacttcatccatgcggc

SEQ ID NO: 74556 - DNA, 25 bp, Homo sapien
gaaactgctccctttctcgttccaa

SEQ ID NO: 74557 - DNA, 25 bp, Homo sapien
cgttcacgcaacatctgcagctgtt

SEQ ID NO: 74558 - DNA, 25 bp, Homo sapien
cttcatcccagtcacaggtggcagg

SEQ ID NO: 74559 - DNA, 25 bp, Homo sapien
acgacctcactgtgcagggcgcacg

SEQ ID NO: 74560 - DNA, 25 bp, Homo sapien
ggaaaccggcagacaggttctgatc

SEQ ID NO: 74561 - DNA, 25 bp, Homo sapien
ggattttcctcacctggaaaacaca

SEQ ID NO: 74562 - DNA, 25 bp, Homo sapien
agctctcctcggtggggattttcct

SEQ ID NO: 74563 - DNA, 25 bp, Homo sapien
acgttcactcgggacaggtgcatga

SEQ ID NO: 74564 - DNA, 25 bp, Homo sapien
ggttctgatcgagcccttcatccca

SEQ ID NO: 74565 - DNA, 25 bp, Homo sapien
ccacgtccctaagcgcggagctggg

SEQ ID NO: 74566 - DNA, 25 bp, Homo sapien
acgatgagtcgtttcacctgggagc

SEQ ID NO: 74567 - DNA, 25 bp, Homo sapien
gtgaggccgaaccaaaccgagtaga

SEQ ID NO: 74568 - DNA, 25 bp, Homo sapien
gccacgcttcccattggttgagaca

SEQ ID NO: 74569 - DNA, 25 bp, Homo sapien
tcccggcttcggagctaaaggaaca

SEQ ID NO: 74570 - DNA, 25 bp, Homo sapien
ctcctgcctggcacattattccgaa

SEQ ID NO: 74571 - DNA, 25 bp, Homo sapien
ccttcagtaagatgcgccggcagga

SEQ ID NO: 74572 - DNA, 25 bp, Homo sapien
tacgacgtgaccttgaggacggttc

SEQ ID NO: 74573 - DNA, 25 bp, Homo sapien
ggctcggcctttgactacgacgtga

SEQ ID NO: 74574 - DNA, 25 bp, Homo sapien
ccctatttcggagaggtgtttggca

SEQ ID NO: 74575 - DNA, 25 bp, Homo sapien
tcggagaggtgtttggcaccaacat

SEQ ID NO: 74576 - DNA, 25 bp, Homo sapien
tttcggagaggtgtttggcaccaac

SEQ ID NO: 74577 - DNA, 25 bp, Homo sapien
tatttcggagaggtgtttggcacca

SEQ ID NO: 74578 - DNA, 25 bp, Homo sapien
cctatttcggagaggtgtttggcac

SEQ ID NO: 74579 - DNA, 25 bp, Homo sapien
ctccggacccccgatacgtctgcag

SEQ ID NO: 74580 - DNA, 25 bp, Homo sapien
ttcggagaggtgtttggcaccaaca

SEQ ID NO: 74581 - DNA, 25 bp, Homo sapien
ctatttcggagaggtgtttggcacc

SEQ ID NO: 74582 - DNA, 25 bp, Homo sapien
acctcagcccgcgaggtcgccggac

SEQ ID NO: 74583 - DNA, 25 bp, Homo sapien
gagggcctgaacgtccagacctcag

SEQ ID NO: 74584 - DNA, 25 bp, Homo sapien
accgagagggcctgaacgtccagac

SEQ ID NO: 74585 - DNA, 25 bp, Homo sapien
tctcccagaccgagagggcctgaac

SEQ ID NO: 74586 - DNA, 25 bp, Homo sapien
gggatctcccagaccgagagggcct

SEQ ID NO: 74587 - DNA, 25 bp, Homo sapien
ccgaccgagatagggcgggccctat

SEQ ID NO: 74588 - DNA, 25 bp, Homo sapien
gggacgcggcctacctgctaaggac

SEQ ID NO: 74589 - DNA, 25 bp, Homo sapien
gtcgcgaccttcaccgggacgcggc

SEQ ID NO: 74590 - DNA, 25 bp, Homo sapien
ggcacctgcggccacgggcgacctc

SEQ ID NO: 74591 - DNA, 25 bp, Homo sapien
cacctgcggccacgggcgacctcag

SEQ ID NO: 74592 - DNA, 25 bp, Homo sapien
acctgcggccacgggcgacctcaga

SEQ ID NO: 74593 - DNA, 25 bp, Homo sapien
cctgcggccacgggcgacctcagag

SEQ ID NO: 74594 - DNA, 25 bp, Homo sapien
ctgcggccacgggcgacctcagagc

SEQ ID NO: 74595 - DNA, 25 bp, Homo sapien
gcacctgcggccacgggcgacctca

SEQ ID NO: 74596 - DNA, 25 bp, Homo sapien
cgacctcagagcgactgtgcttccg

SEQ ID NO: 74597 - DNA, 25 bp, Homo sapien
ctcagagcgactgtgcttccgcctc

SEQ ID NO: 74598 - DNA, 25 bp, Homo sapien
acggcatgtctgtgaagatggcttc

SEQ ID NO: 74599 - DNA, 25 bp, Homo sapien
gggcacacggactgacggcaaccct

SEQ ID NO: 74600 - DNA, 25 bp, Homo sapien
gagcctcaaggacggcatgtctgtg

SEQ ID NO: 74601 - DNA, 25 bp, Homo sapien
gtctgtgaagatggcttcacccagc

SEQ ID NO: 74602 - DNA, 25 bp, Homo sapien
agcggtgacggagccgtgacctcac

SEQ ID NO: 74603 - DNA, 25 bp, Homo sapien
tgacctcacgggacagcctttgccg

SEQ ID NO: 74604 - DNA, 25 bp, Homo sapien
acgggacagcctttgccgtgtggtt

SEQ ID NO: 74605 - DNA, 25 bp, Homo sapien
tgtgcatgtgtgagagcctcaagga

SEQ ID NO: 74606 - DNA, 25 bp, Homo sapien
agtcaccgggaactcacctggaagg

SEQ ID NO: 74607 - DNA, 25 bp, Homo sapien
acctgcaggcgcctccatgggtgac

SEQ ID NO: 74608 - DNA, 25 bp, Homo sapien
aggcgcctccatgggtgacggaaga

SEQ ID NO: 74609 - DNA, 25 bp, Homo sapien
caggccgagagtcaccgggaactca

SEQ ID NO: 74610 - DNA, 25 bp, Homo sapien
gagagtcaccgggaactcacctgga

SEQ ID NO: 74611 - DNA, 25 bp, Homo sapien
ggccgtggagcccttggacgtatct

SEQ ID NO: 74612 - DNA, 25 bp, Homo sapien
gtggagcccttggacgtatctgttt

SEQ ID NO: 74613 - DNA, 25 bp, Homo sapien
ggccgagagtcaccgggaactcacc

SEQ ID NO: 74614 - DNA, 25 bp, Homo sapien
ggccgcgctcgtggattactacgca

SEQ ID NO: 74615 - DNA, 25 bp, Homo sapien
ctgcgaaatgcttcccaaacaagtc

SEQ ID NO: 74616 - DNA, 25 bp, Homo sapien
tggattactacgcacccggtggttg

SEQ ID NO: 74617 - DNA, 25 bp, Homo sapien
ggaccttggtctcaggaatccgtgc

SEQ ID NO: 74618 - DNA, 25 bp, Homo sapien
tgccggggcgtatccttattcaccc

SEQ ID NO: 74619 - DNA, 25 bp, Homo sapien
acattacacgctggggaccgaactc

SEQ ID NO: 74620 - DNA, 25 bp, Homo sapien
gaccgaactcagtccgagatgtaga

SEQ ID NO: 74621 - DNA, 25 bp, Homo sapien
ggcaataacgctaatctaatcccgg

SEQ ID NO: 74622 - DNA, 25 bp, Homo sapien
tgcaatgcctcgtccgatcctgcga

SEQ ID NO: 74623 - DNA, 25 bp, Homo sapien
gaactgctcacaacggcggtcctcg

SEQ ID NO: 74624 - DNA, 25 bp, Homo sapien
tttgggcggaaagtcgaactgctca

SEQ ID NO: 74625 - DNA, 25 bp, Homo sapien
ataagattcagaggtgcccgcggtc

SEQ ID NO: 74626 - DNA, 25 bp, Homo sapien
ccgaaggcccgcagcaatgaaaacc

SEQ ID NO: 74627 - DNA, 25 bp, Homo sapien
ctcgccggctctttgtgaggaaaga

SEQ ID NO: 74628 - DNA, 25 bp, Homo sapien
acgtctccagccatgaaccggtttg

SEQ ID NO: 74629 - DNA, 25 bp, Homo sapien
tgtaccgaagtataggggacctgtc

SEQ ID NO: 74630 - DNA, 25 bp, Homo sapien
cagctcgcccgatggaccaagcagg

SEQ ID NO: 74631 - DNA, 25 bp, Homo sapien
gcgccaggactgtcactgtcgtcct

SEQ ID NO: 74632 - DNA, 25 bp, Homo sapien
gttggttggcgccaggactgtcact

SEQ ID NO: 74633 - DNA, 25 bp, Homo sapien
agcaaatccgaccttgggctggttg

SEQ ID NO: 74634 - DNA, 25 bp, Homo sapien
cccgatggaccaagcaggcagtggc

SEQ ID NO: 74635 - DNA, 25 bp, Homo sapien
ctccctagacacctctcccagctcg

SEQ ID NO: 74636 - DNA, 25 bp, Homo sapien
acacacaaataaccagaagcccacg

SEQ ID NO: 74637 - DNA, 25 bp, Homo sapien
cagtggcagcgctatgccccggact

SEQ ID NO: 74638 - DNA, 25 bp, Homo sapien
ggtgctgcccatcacgggaaccgtc

SEQ ID NO: 74639 - DNA, 25 bp, Homo sapien
taacctccctggtgttcactgcggc

SEQ ID NO: 74640 - DNA, 25 bp, Homo sapien
gagcggccaaccacgacctgacgga

SEQ ID NO: 74641 - DNA, 25 bp, Homo sapien
tggacctgctaagacgggaacgtta

SEQ ID NO: 74642 - DNA, 25 bp, Homo sapien
ttctgcaggccctttcggatttggg

SEQ ID NO: 74643 - DNA, 25 bp, Homo sapien
ccggagtgattgatggatgattttt

SEQ ID NO: 74644 - DNA, 25 bp, Homo sapien
gtggagccgctctctcgatcgagcc

SEQ ID NO: 74645 - DNA, 25 bp, Homo sapien
atcagtttctgccacggcggaggta

SEQ ID NO: 74646 - DNA, 25 bp, Homo sapien
gctgtccaatcggaaagcgcctttc

SEQ ID NO: 74647 - DNA, 25 bp, Homo sapien
ttctagcgggtgacgctgtccaatc

SEQ ID NO: 74648 - DNA, 25 bp, Homo sapien
atcttctgcggcgaacttctagcgg

SEQ ID NO: 74649 - DNA, 25 bp, Homo sapien
gaggcgtcacgcactccatggtaac

SEQ ID NO: 74650 - DNA, 25 bp, Homo sapien
cgatggacgtgatcgccgccctcat

SEQ ID NO: 74651 - DNA, 25 bp, Homo sapien
gcttcgcgccacgagacgcgatgga

SEQ ID NO: 74652 - DNA, 25 bp, Homo sapien
cgaagcgttttactcctgttgggcg

SEQ ID NO: 74653 - DNA, 25 bp, Homo sapien
tggtaacgacgctcggcccgaagat

SEQ ID NO: 74654 - DNA, 25 bp, Homo sapien
atctccatcggtcgctcggaactcg

SEQ ID NO: 74655 - DNA, 25 bp, Homo sapien
tgcggttcttacgtcccgaattcga

SEQ ID NO: 74656 - DNA, 25 bp, Homo sapien
acaagctggtagacgcctgtcgagc

SEQ ID NO: 74657 - DNA, 25 bp, Homo sapien
gactgggcctgaccctctgtatgta

SEQ ID NO: 74658 - DNA, 25 bp, Homo sapien
ctccgttctggaggagtcgtgtccc

SEQ ID NO: 74659 - DNA, 25 bp, Homo sapien
caagcgaaacgcacggcctgaaagc

SEQ ID NO: 74660 - DNA, 25 bp, Homo sapien
gactcaatcccgtgaagcagacatg

SEQ ID NO: 74661 - DNA, 25 bp, Homo sapien
gctcggtaattttgtgcggttctta

SEQ ID NO: 74662 - DNA, 25 bp, Homo sapien
ctcatggggcgacttctcctcagac

SEQ ID NO: 74663 - DNA, 25 bp, Homo sapien
tctgacctctcagcccgcgaagccg

SEQ ID NO: 74664 - DNA, 25 bp, Homo sapien
tcccgtagtcgcaggcgcgcaaccc

SEQ ID NO: 74665 - DNA, 25 bp, Homo sapien
ctccagcgagcttgggagctgccag

SEQ ID NO: 74666 - DNA, 25 bp, Homo sapien
gccgcagccactggtacatctggct

SEQ ID NO: 74667 - DNA, 25 bp, Homo sapien
actggtacatctggctccggttctg

SEQ ID NO: 74668 - DNA, 25 bp, Homo sapien
atggggcgacttctcctcagacgcc

SEQ ID NO: 74669 - DNA, 25 bp, Homo sapien
gccagcgcgcccaactgagggtccc

SEQ ID NO: 74670 - DNA, 25 bp, Homo sapien
tagattctgctacgcgatgtggaca

SEQ ID NO: 74671 - DNA, 25 bp, Homo sapien
atttagattctgctacgggatgtgg

SEQ ID NO: 74672 - DNA, 25 bp, Homo sapien
tgggagaggagacgcatgcaaattt

SEQ ID NO: 74673 - DNA, 25 bp, Homo sapien
ggagacgcgtgcaaatttagattct

SEQ ID NO: 74674 - DNA, 25 bp, Homo sapien
tagattctgctacgggatgtggaca

SEQ ID NO: 74675 - DNA, 25 bp, Homo sapien
gttctgctacgcgatgtggacagtg

SEQ ID NO: 74676 - DNA, 25 bp, Homo sapien
gagacgcgtgcaaatttagattctg

SEQ ID NO: 74677 - DNA, 25 bp, Homo sapien
agacgcgtgcaaatttagattctgc

SEQ ID NO: 74678 - DNA, 25 bp, Homo sapien
tgggagaggagacgcatgcaaattt

SEQ ID NO: 74679 - DNA, 25 bp, Homo sapien
ttctgctacgcgatgtggacagtgg

SEQ ID NO: 74680 - DNA, 25 bp, Homo sapien
ttagattctgctacgcgatgtggac

SEQ ID NO: 74681 - DNA, 25 bp, Homo sapien
gagagacgcgtgcaaatttagattc

SEQ ID NO: 74682 - DNA, 25 bp, Homo sapien
tagattctgctatgcgatgtggaca

SEQ ID NO: 74683 - DNA, 25 bp, Homo sapien
gagacgcgtgcaaatttagattccg

SEQ ID NO: 74684 - DNA, 25 bp, Homo sapien
tagattctgctacgcgatgtggaca

SEQ ID NO: 74685 - DNA, 25 bp, Homo sapien
atttagattctgctacgcgatgtgg

SEQ ID NO: 74686 - DNA, 25 bp, Homo sapien
gagccagagccggatgccccgaaca

SEQ ID NO: 74687 - DNA, 25 bp, Homo sapien
ttcacggaccgcacatcgccgggcc

SEQ ID NO: 74688 - DNA, 25 bp, Homo sapien
tcccgaaacacccaagggccgcagc

SEQ ID NO: 74689 - DNA, 25 bp, Homo sapien
gctcacgtccctccggatcgcccgc

SEQ ID NO: 74690 - DNA, 25 bp, Homo sapien
agcagttccgactcccgaggaacgg

SEQ ID NO: 74691 - DNA, 25 bp, Homo sapien
gtctcagcagttccgactcccgagg

SEQ ID NO: 74692 - DNA, 25 bp, Homo sapien
cgaccggagcgtgacttcggattcc

SEQ ID NO: 74693 - DNA, 25 bp, Homo sapien
ccgcggagagagtctcagcagttcc

SEQ ID NO: 74694 - DNA, 25 bp, Homo sapien
aggggcgaggccacagctcgaccgc

SEQ ID NO: 74695 - DNA, 25 bp, Homo sapien
agctcgaccgcgagcacctgagcat

SEQ ID NO: 74696 - DNA, 25 bp, Homo sapien
gaacagtgaacttcggagatccacc

SEQ ID NO: 74697 - DNA, 25 bp, Homo sapien
cagtgaacttcggagatccaccgga

SEQ ID NO: 74698 - DNA, 25 bp, Homo sapien
gttccggcacagacggcctgcggct

SEQ ID NO: 74699 - DNA, 25 bp, Homo sapien
tgaacttcggagatccaccggaggg

SEQ ID NO: 74700 - DNA, 25 bp, Homo sapien
gagccgtctcctcaggacctacgca

SEQ ID NO: 74701 - DNA, 25 bp, Homo sapien
cacagacggcctgcggctccagggg

SEQ ID NO: 74702 - DNA, 25 bp, Homo sapien
tgtcgacgaaaacagcctcgccctg

SEQ ID NO: 74703 - DNA, 25 bp, Homo sapien
gccgctactccgaggcggtgtttta

SEQ ID NO: 74704 - DNA, 25 bp, Homo sapien
ttcagcgcgaccacgaaggccgcta

SEQ ID NO: 74705 - DNA, 25 bp, Homo sapien
caacgggaaggcgagctctcctcca

SEQ ID NO: 74706 - DNA, 25 bp, Homo sapien
gcttctaaggagctcgtgagggcca

SEQ ID NO: 74707 - DNA, 25 bp, Homo sapien
tgcacagcggcaggcctttttgccc

SEQ ID NO: 74708 - DNA, 25 bp, Homo sapien
ctctactgcccactgtcgacgaaaa

SEQ ID NO: 74709 - DNA, 25 bp, Homo sapien
cctcctcttgttgggagcggcaagc

SEQ ID NO: 74710 - DNA, 25 bp, Homo sapien
gcgtagacaccgacctccgtagcag

SEQ ID NO: 74711 - DNA, 25 bp, Homo sapien
caggatttcggctggctcctccgag

SEQ ID NO: 74712 - DNA, 25 bp, Homo sapien
cttcagtgccgcgtccatgcaggca

SEQ ID NO: 74713 - DNA, 25 bp, Homo sapien
tgcgaagtggctgtacgcgtagaca

SEQ ID NO: 74714 - DNA, 25 bp, Homo sapien
cctcctcattgtggagacgatgaaa

SEQ ID NO: 74715 - DNA, 25 bp, Homo sapien
acgcgggcactgtagcctcctcatt

SEQ ID NO: 74716 - DNA, 25 bp, Homo sapien
ccgcaatagagtcaggccgcatcca

SEQ ID NO: 74717 - DNA, 25 bp, Homo sapien
ggatccggggatccacctcttcttc

SEQ ID NO: 74718 - DNA, 25 bp, Homo sapien
ttctcccggacgtctctttgtggtg

SEQ ID NO: 74719 - DNA, 25 bp, Homo sapien
tgtgtggactcgcatcttgcccgaa

SEQ ID NO: 74720 - DNA, 25 bp, Homo sapien
tcctctcagtggtagcgcggggact

SEQ ID NO: 74721 - DNA, 25 bp, Homo sapien
cgcttgccgtcctctcagtggtagc

SEQ ID NO: 74722 - DNA, 25 bp, Homo sapien
acgtctctttgtggtggcgttgagc

SEQ ID NO: 74723 - DNA, 25 bp, Homo sapien
gactcgcatcttgcccgaagccggg

SEQ ID NO: 74724 - DNA, 25 bp, Homo sapien
gtgtccgctctaggcttctcccgga

SEQ ID NO: 74725 - DNA, 25 bp, Homo sapien
ttgtggtggcgttgagctcctctag

SEQ ID NO: 74726 - DNA, 25 bp, Homo sapien
ctgaggaccacgaattcggattatc

SEQ ID NO: 74727 - DNA, 25 bp, Homo sapien
gagaacttgcttctggacccgggtg

SEQ ID NO: 74728 - DNA, 25 bp, Homo sapien
ggctcggctctccttgtcttccaga

SEQ ID NO: 74729 - DNA, 25 bp, Homo sapien
agacgccagcgccagaagctcggat

SEQ ID NO: 74730 - DNA, 25 bp, Homo sapien
gaatgggaccgcaaacccgctgctg

SEQ ID NO: 74731 - DNA, 25 bp, Homo sapien
ctggaccgcgaggaacattgcctga

SEQ ID NO: 74732 - DNA, 25 bp, Homo sapien
ctattcgttgtaagtcagcgctccc

SEQ ID NO: 74733 - DNA, 25 bp, Homo sapien
cgggagttcttttgccatggcaccg

SEQ ID NO: 74734 - DNA, 25 bp, Homo sapien
tttcagggcctgagcgatgacttta

SEQ ID NO: 74735 - DNA, 25 bp, Homo sapien
ctgcgctctgcgaagttactgtccg

SEQ ID NO: 74736 - DNA, 25 bp, Homo sapien
tgtccggcatcttccaccgaaaagc

SEQ ID NO: 74737 - DNA, 25 bp, Homo sapien
tctggtactgcacctctgacggaca

SEQ ID NO: 74738 - DNA, 25 bp, Homo sapien
gaggcggtctaaattcgtccacttc

SEQ ID NO: 74739 - DNA, 25 bp, Homo sapien
cccgggagaggtgagaatgtaaaca

SEQ ID NO: 74740 - DNA, 25 bp, Homo sapien
aggtccatcgtacttgcgttttcag

SEQ ID NO: 74741 - DNA, 25 bp, Homo sapien
cgccagcttccgtaggagcctttca

SEQ ID NO: 74742 - DNA, 25 bp, Homo sapien
cccactgcggacaaagaggacttct

SEQ ID NO: 74743 - DNA, 25 bp, Homo sapien
ccgccttcagacagggcgtgatccg

SEQ ID NO: 74744 - DNA, 25 bp, Homo sapien
gcctgttgacacaacgtcacgtttc

SEQ ID NO: 74745 - DNA, 25 bp, Homo sapien
cgtttccgactgcagccctttcatg

SEQ ID NO: 74746 - DNA, 25 bp, Homo sapien
ttcctggaagcagacgtgcctggca

SEQ ID NO: 74747 - DNA, 25 bp, Homo sapien
tggcaccgcgtcagcagaaacctga

SEQ ID NO: 74748 - DNA, 25 bp, Homo sapien
cccagcaggagggaattcgagcgct

SEQ ID NO: 74749 - DNA, 25 bp, Homo sapien
cggcatccaaatgcgctcagaggga

SEQ ID NO: 74750 - DNA, 25 bp, Homo sapien
ctcacctacctggtcacggagtttg

SEQ ID NO: 74751 - DNA, 25 bp, Homo sapien
ctcagccagggcaagactaaggagc

SEQ ID NO: 74752 - DNA, 25 bp, Homo sapien
gaggccagagtaagccgagcgccca

SEQ ID NO: 74753 - DNA, 25 bp, Homo sapien
gcggcatccaaactccacaatatta

SEQ ID NO: 74754 - DNA, 25 bp, Homo sapien
gcggcggcatccaaactccacaata

SEQ ID NO: 74755 - DNA, 25 bp, Homo sapien
actgcgctgagaagacctgcgggca

SEQ ID NO: 74756 - DNA, 25 bp, Homo sapien
ttgaggaacgccatggcggtcgcct

SEQ ID NO: 74757 - DNA, 25 bp, Homo sapien
acctggtcacggagtttgaggaacg

SEQ ID NO: 74758 - DNA, 25 bp, Homo sapien
tggatggggtaaatgataacacaga

SEQ ID NO: 74759 - DNA, 25 bp, Homo sapien
cccagaaggtcacgctgaagacgcc

SEQ ID NO: 74760 - DNA, 25 bp, Homo sapien
gacttcctgattcttccaggattca

SEQ ID NO: 74761 - DNA, 25 bp, Homo sapien
acaacgacttcctgattcttccagg

SEQ ID NO: 74762 - DNA, 25 bp, Homo sapien
ctgacggcctcacccacaacgactt

SEQ ID NO: 74763 - DNA, 25 bp, Homo sapien
taatcttaaaactctagactgtccc

SEQ ID NO: 74764 - DNA, 25 bp, Homo sapien
tcatagctgatgaggtggacctgac

SEQ ID NO: 74765 - DNA, 25 bp, Homo sapien
cgtggccgcggtgcagcatcagcat

SEQ ID NO: 74766 - DNA, 25 bp, Homo sapien
ttcctggtgacggacgaacagttcc

SEQ ID NO: 74767 - DNA, 25 bp, Homo sapien
ttcaccgagtgaccttgagcccagg

SEQ ID NO: 74768 - DNA, 25 bp, Homo sapien
gcgcagcaaaggctacccaatgatg

SEQ ID NO: 74769 - DNA, 25 bp, Homo sapien
caaactgcgcttgcttgggtgaacc

SEQ ID NO: 74770 - DNA, 25 bp, Homo sapien
ccgagtcctcgtcatattggaagtc

SEQ ID NO: 74771 - DNA, 25 bp, Homo sapien
cccttccggcgcataggcaatgacg

SEQ ID NO: 74772 - DNA, 25 bp, Homo sapien
gccctgcgcggccaaatggataacc

SEQ ID NO: 74773 - DNA, 25 bp, Homo sapien
ctgcaactaaacgtggccgggtctg

SEQ ID NO: 74774 - DNA, 25 bp, Homo sapien
ggcgtcccaaggatcagcccaggtc

SEQ ID NO: 74775 - DNA, 25 bp, Homo sapien
tgctacgctgcatcttcagggaaag

SEQ ID NO: 74776 - DNA, 25 bp, Homo sapien
cctctgaactcatgtgcaaaatatg

SEQ ID NO: 74777 - DNA, 25 bp, Homo sapien
ccgggaggaaagtttgtgccataca

SEQ ID NO: 74778 - DNA, 25 bp, Homo sapien
ctgcgtccttcctaggcgcttctga

SEQ ID NO: 74779 - DNA, 25 bp, Homo sapien
ggaaacctggactccgcgaccagct

SEQ ID NO: 74780 - DNA, 25 bp, Homo sapien
gcagtgtgtcctggacccacctgta

SEQ ID NO: 74781 - DNA, 25 bp, Homo sapien
ggcccaagatccaggcgtcccaagg

SEQ ID NO: 74782 - DNA, 25 bp, Homo sapien
gagcttttctgtcgccgccacacga

SEQ ID NO: 74783 - DNA, 25 bp, Homo sapien
gaaggcaagtccctcagcaggcccg

SEQ ID NO: 74784 - DNA, 25 bp, Homo sapien
gaagtttaagaaggcaagtccctca

SEQ ID NO: 74785 - DNA, 25 bp, Homo sapien
ttcctaaggaagctccggccctcga

SEQ ID NO: 74786 - DNA, 25 bp, Homo sapien
ccaccaagtacagggaccaggaggg

SEQ ID NO: 74787 - DNA, 25 bp, Homo sapien
gaccagaggcacttccggcccagcc

SEQ ID NO: 74788 - DNA, 25 bp, Homo sapien
aagatggcgtcaggcgagcttttct

SEQ ID NO: 74789 - DNA, 25 bp, Homo sapien
cagctacagggccatgccttcagga

SEQ ID NO: 74790 - DNA, 25 bp, Homo sapien
gctggaacccgctgcgcggcttcga

SEQ ID NO: 74791 - DNA, 25 bp, Homo sapien
aaccaagagcgggtgacaaggctga

SEQ ID NO: 74792 - DNA, 25 bp, Homo sapien
tcaaaggagccaaagatgaagagaa

SEQ ID NO: 74793 - DNA, 25 bp, Homo sapien
cccgctgcgcggcttcgagtggtca

SEQ ID NO: 74794 - DNA, 25 bp, Homo sapien
gctgctgtgaggtccgctggaaccc

SEQ ID NO: 74795 - DNA, 25 bp, Homo sapien
tgtgcttggcgcaccacttctgggg

SEQ ID NO: 74796 - DNA, 25 bp, Homo sapien
agaggctgtgcttggcgcaccactt

SEQ ID NO: 74797 - DNA, 25 bp, Homo sapien
cggtgcctcagtcccaggaaggcgc

SEQ ID NO: 74798 - DNA, 25 bp, Homo sapien
cggcaatctcgacagggagctaggc

SEQ ID NO: 74799 - DNA, 25 bp, Homo sapien
ggcgagagctcgaaacaaacatcac

SEQ ID NO: 74800 - DNA, 25 bp, Homo sapien
gcgactttaaccgtgcgcaaggcga

SEQ ID NO: 74801 - DNA, 25 bp, Homo sapien
tccgataattctgccgccgcgactt

SEQ ID NO: 74802 - DNA, 25 bp, Homo sapien
ccctgcaggaatcttccgataattc

SEQ ID NO: 74803 - DNA, 25 bp, Homo sapien
gccggagctgactcgtctctctctt

SEQ ID NO: 74804 - DNA, 25 bp, Homo sapien
ccgcctccgcgtgtccagagagtgt

SEQ ID NO: 74805 - DNA, 25 bp, Homo sapien
ggccgcacggcgattgtcatacccg

SEQ ID NO: 74806 - DNA, 25 bp, Homo sapien
gggcaagacttttctccggagcctc

SEQ ID NO: 74807 - DNA, 25 bp, Homo sapien
cctctggcaactcgtggagtctata

SEQ ID NO: 74808 - DNA, 25 bp, Homo sapien
cacattctttcggagagggagggca

SEQ ID NO: 74809 - DNA, 25 bp, Homo sapien
ggacacccgggtgacacattctttc

SEQ ID NO: 74810 - DNA, 25 bp, Homo sapien
ctgaacttgtctccagcactgcgga

SEQ ID NO: 74811 - DNA, 25 bp, Homo sapien
accgcacttacacctgaacttgtct

SEQ ID NO: 74812 - DNA, 25 bp, Homo sapien
ggaggctgacataaagttccacgtg

SEQ ID NO: 74813 - DNA, 25 bp, Homo sapien
gttccacgtgcttctgtccaccgag

SEQ ID NO: 74814 - DNA, 25 bp, Homo sapien
agtctgcgcgcgagcgcaacgcgct

SEQ ID NO: 74815 - DNA, 25 bp, Homo sapien
acctctaataacctcgcggcccgcg

SEQ ID NO: 74816 - DNA, 25 bp, Homo sapien
cacgtgaccacgctcgcgccgtaac

SEQ ID NO: 74817 - DNA, 25 bp, Homo sapien
agcgcatgcgcctgagggcttttac

SEQ ID NO: 74818 - DNA, 25 bp, Homo sapien
gctcgctctcgggtccgggtttctg

SEQ ID NO: 74819 - DNA, 25 bp, Homo sapien
gcccggcccgacctgaaagagaaca

SEQ ID NO: 74820 - DNA, 25 bp, Homo sapien
agagctctccttggctgagccggca

SEQ ID NO: 74821 - DNA, 25 bp, Homo sapien
gcccgcacgggacctgaagtctgcg

SEQ ID NO: 74822 - DNA, 25 bp, Homo sapien
tagttgactcatcccggccgctgtc

SEQ ID NO: 74823 - DNA, 25 bp, Homo sapien
attagttgactcatcccggccgctg

SEQ ID NO: 74824 - DNA, 25 bp, Homo sapien
ttattagttgactcatcccggccgc

SEQ ID NO: 74825 - DNA, 25 bp, Homo sapien
taaattattagttgactcatcccgg

SEQ ID NO: 74826 - DNA, 25 bp, Homo sapien
cgtctctgcccccattaaattatta

SEQ ID NO: 74827 - DNA, 25 bp, Homo sapien
cggctgttgttgttgtgacgaggcc

SEQ ID NO: 74828 - DNA, 25 bp, Homo sapien
ggcagcgtcctctagagtcgccctg

SEQ ID NO: 74829 - DNA, 25 bp, Homo sapien
cccgggcaggatagagggcggccgc

SEQ ID NO: 74830 - DNA, 25 bp, Homo sapien
cgcctggagcgtcgcagagggacag

SEQ ID NO: 74831 - DNA, 25 bp, Homo sapien
tgtacagcaataaaggccaggagcc

SEQ ID NO: 74832 - DNA, 25 bp, Homo sapien
cagaaacgtgtacagcaataaaggc

SEQ ID NO: 74833 - DNA, 25 bp, Homo sapien
gggtgcagaaacgtgtacagcaata

SEQ ID NO: 74834 - DNA, 25 bp, Homo sapien
aaggcagttctctccggggaagcgc

SEQ ID NO: 74835 - DNA, 25 bp, Homo sapien
ggtacagacggaaggcagttctctc

SEQ ID NO: 74836 - DNA, 25 bp, Homo sapien
ctgaggaatgaggtagggagccatc

SEQ ID NO: 74837 - DNA, 25 bp, Homo sapien
cgggtacgcaggtgacaggcgctga

SEQ ID NO: 74838 - DNA, 25 bp, Homo sapien
cgggatgctcttggtctcctagaca

SEQ ID NO: 74839 - DNA, 25 bp, Homo sapien
aaagagactgacgtcgccggtggcc

SEQ ID NO: 74840 - DNA, 25 bp, Homo sapien
ccggccgcaggaagtggaattcttc

SEQ ID NO: 74841 - DNA, 25 bp, Homo sapien
cgagaggtgtcatcctgcgaaacca

SEQ ID NO: 74842 - DNA, 25 bp, Homo sapien
tgtgaccgaggagatgcagtaaacg

SEQ ID NO: 74843 - DNA, 25 bp, Homo sapien
ctcctagacaacagtgtgtgaccga

SEQ ID NO: 74844 - DNA, 25 bp, Homo sapien
ttccctgtgagaagtcaacggctcc

SEQ ID NO: 74845 - DNA, 25 bp, Homo sapien
cctgccctggcaggcgctgatgcaa

SEQ ID NO: 74846 - DNA, 25 bp, Homo sapien
gcgggcctgaaaccaagaacggctc

SEQ ID NO: 74847 - DNA, 25 bp, Homo sapien
gcagaactcactcaggcatggacgt

SEQ ID NO: 74848 - DNA, 25 bp, Homo sapien
gctcggaagaccgttgaagccctgc

SEQ ID NO: 74849 - DNA, 25 bp, Homo sapien
tccaaggtccgtctgcgtgagaaaa

SEQ ID NO: 74850 - DNA, 25 bp, Homo sapien
aaggagtttgttcagccagggtcta

SEQ ID NO: 74851 - DNA, 25 bp, Homo sapien
ccataccggtgacctgaaggagttt

SEQ ID NO: 74852 - DNA, 25 bp, Homo sapien
ggctccagaacgcaccgagaggctc

SEQ ID NO: 74853 - DNA, 25 bp, Homo sapien
cggctgccgcggaagttaattgcaa

SEQ ID NO: 74854 - DNA, 25 bp, Homo sapien
cagctagcctagagcctctgccgga

SEQ ID NO: 74855 - DNA, 25 bp, Homo sapien
cacgcccgagttcctggagatcaga

SEQ ID NO: 74856 - DNA, 25 bp, Homo sapien
cccaacagccgagataattgaaaca

SEQ ID NO: 74857 - DNA, 25 bp, Homo sapien
agcccaaggcagacgtgacgaaacc

SEQ ID NO: 74858 - DNA, 25 bp, Homo sapien
ctctgccggatcttctcgaatttca

SEQ ID NO: 74859 - DNA, 25 bp, Homo sapien
cacgttggtagcttctcttctggga

SEQ ID NO: 74860 - DNA, 25 bp, Homo sapien
tttcaacacaaagggaatcctcggc

SEQ ID NO: 74861 - DNA, 25 bp, Homo sapien
gactccacccgcgtgagctcggttt

SEQ ID NO: 74862 - DNA, 25 bp, Homo sapien
tggacaaactttgatggagaatttc

SEQ ID NO: 74863 - DNA, 25 bp, Homo sapien
ccggttatgaaaggattactggcgc

SEQ ID NO: 74864 - DNA, 25 bp, Homo sapien
atggagaatttcacaccacgctgga

SEQ ID NO: 74865 - DNA, 25 bp, Homo sapien
ctaagttctaggttgaggccggata

SEQ ID NO: 74866 - DNA, 25 bp, Homo sapien
gaaccatccttctggacaaactttg

SEQ ID NO: 74867 - DNA, 25 bp, Homo sapien
ccacgctggaaaaatgccggttatg

SEQ ID NO: 74868 - DNA, 25 bp, Homo sapien
ttggcactttcctttcgaaccatcc

SEQ ID NO: 74869 - DNA, 25 bp, Homo sapien
gaaaggattactggcgccgcaaaac

SEQ ID NO: 74870 - DNA, 25 bp, Homo sapien
ccagttcggatctgagccactcgca

SEQ ID NO: 74871 - DNA, 25 bp, Homo sapien
gtcaccctttcccttctcaagatgg

SEQ ID NO: 74872 - DNA, 25 bp, Homo sapien
cgaacccggcgtcttgttctgccag

SEQ ID NO: 74873 - DNA, 25 bp, Homo sapien
gccctggaccagagaactatcgaac

SEQ ID NO: 74874 - DNA, 25 bp, Homo sapien
gcttgctgcggtctcaggtaaccga

SEQ ID NO: 74875 - DNA, 25 bp, Homo sapien
agatacactctcatcctacgggcca

SEQ ID NO: 74876 - DNA, 25 bp, Homo sapien
gccactcgcagggtcacgtgacatc

SEQ ID NO: 74877 - DNA, 25 bp, Homo sapien
attagtcggaactccagcgccggcg

SEQ ID NO: 74878 - DNA, 25 bp, Homo sapien
tcgccgtgaagaaagcgcaactacg

SEQ ID NO: 74879 - DNA, 25 bp, Homo sapien
acacctagtccgcagtcccgaggaa

SEQ ID NO: 74880 - DNA, 25 bp, Homo sapien
gtcccgaggaacatgtccgcagcca

SEQ ID NO: 74881 - DNA, 25 bp, Homo sapien
gctcggcccgaatcgccgtgaagaa

SEQ ID NO: 74882 - DNA, 25 bp, Homo sapien
tccgcgggccaagaaactggagaaa

SEQ ID NO: 74883 - DNA, 25 bp, Homo sapien
tgtactccgcctgcaaggtacgcgc

SEQ ID NO: 74884 - DNA, 25 bp, Homo sapien
tgcaccgcggaagtgctcttgtcgc

SEQ ID NO: 74885 - DNA, 25 bp, Homo sapien
tcccgactaccagagcccgagaggg

SEQ ID NO: 74886 - DNA, 25 bp, Homo sapien
tcgctcctccattggttggctggga

SEQ ID NO: 74887 - DNA, 25 bp, Homo sapien
tcggccaccgaatttagaatgatac

SEQ ID NO: 74888 - DNA, 25 bp, Homo sapien
gcaggcgcgtccagaacgatacctt

SEQ ID NO: 74889 - DNA, 25 bp, Homo sapien
taccgccgccacattcgaaattttc

SEQ ID NO: 74890 - DNA, 25 bp, Homo sapien
gtcacgtgacgcacattcgctcaag

SEQ ID NO: 74891 - DNA, 25 bp, Homo sapien
attcgctcaagtccacatccgggca

SEQ ID NO: 74892 - DNA, 25 bp, Homo sapien
gacccgccgggactttctaatcaga

SEQ ID NO: 74893 - DNA, 25 bp, Homo sapien
ttggccactacttctgcaacagcta

SEQ ID NO: 74894 - DNA, 25 bp, Homo sapien
ttcctctagtgctcggcaccgggct

SEQ ID NO: 74895 - DNA, 25 bp, Homo sapien
ctcctgcctctgtagagaagaaatc

SEQ ID NO: 74896 - DNA, 25 bp, Homo sapien
ggatcgggccaacacaatgcaccca

SEQ ID NO: 74897 - DNA, 25 bp, Homo sapien
cggctcctgagcctctagaaaaatg

SEQ ID NO: 74898 - DNA, 25 bp, Homo sapien
cgggactttctagtaaacagctcgc

SEQ ID NO: 74899 - DNA, 25 bp, Homo sapien
ctgacggattccaaccggctcctga

SEQ ID NO: 74900 - DNA, 25 bp, Homo sapien
ttcgctcaggggttgaaaatcagcc

SEQ ID NO: 74901 - DNA, 25 bp, Homo sapien
atcaacttcactggggcatccttaa

SEQ ID NO: 74902 - DNA, 25 bp, Homo sapien
acctgaaccgagacacctctttttg

SEQ ID NO: 74903 - DNA, 25 bp, Homo sapien
tcgcacacacccaatgaaagacaga

SEQ ID NO: 74904 - DNA, 25 bp, Homo sapien
ctcgactctggacagaaccaggctg

SEQ ID NO: 74905 - DNA, 25 bp, Homo sapien
acatctcttctccttggcaccgaga

SEQ ID NO: 74906 - DNA, 25 bp, Homo sapien
gcaggggcgcaaccctagctccttg

SEQ ID NO: 74907 - DNA, 25 bp, Homo sapien
agaacggtctccgttgcgcagcgcg

SEQ ID NO: 74908 - DNA, 25 bp, Homo sapien
gacagcaggacgtccttaccgggtg

SEQ ID NO: 74909 - DNA, 25 bp, Homo sapien
tgcgggataccgaaaaggtggtcca

SEQ ID NO: 74910 - DNA, 25 bp, Homo sapien
cttcactttccaggactcaggggca

SEQ ID NO: 74911 - DNA, 25 bp, Homo sapien
ttagtgtgtcaacagggtcagtccc

SEQ ID NO: 74912 - DNA, 25 bp, Homo sapien
tccggctttcggtgactagacggtc

SEQ ID NO: 74913 - DNA, 25 bp, Homo sapien
gcgggacccagctgtcactttactt

SEQ ID NO: 74914 - DNA, 25 bp, Homo sapien
ccagccggcgtttccctttaatgcg

SEQ ID NO: 74915 - DNA, 25 bp, Homo sapien
tttccctttaatgcgcgtgcccggc

SEQ ID NO: 74916 - DNA, 25 bp, Homo sapien
cccgtatctactttgcgaaagcttc

SEQ ID NO: 74917 - DNA, 25 bp, Homo sapien
actgcctgcaccgtcttggggtaac

SEQ ID NO: 74918 - DNA, 25 bp, Homo sapien
ttatgtcttcgctgcggaggccgac

SEQ ID NO: 74919 - DNA, 25 bp, Homo sapien
ctcattgttatgtcttcgctgcgga

SEQ ID NO: 74920 - DNA, 25 bp, Homo sapien
cgcccggccgcatagctgtgagcag

SEQ ID NO: 74921 - DNA, 25 bp, Homo sapien
ctccagaccgttttcccacagcgtt

SEQ ID NO: 74922 - DNA, 25 bp, Homo sapien
aaacaagccgcgtccgatttgcaaa

SEQ ID NO: 74923 - DNA, 25 bp, Homo sapien
cgtccgatttgcaaaagccttaatg

SEQ ID NO: 74924 - DNA, 25 bp, Homo sapien
gccttaatgggcctgcagactttga

SEQ ID NO: 74925 - DNA, 25 bp, Homo sapien
tgggcctgcagactttgaaaagcga

SEQ ID NO: 74926 - DNA, 25 bp, Homo sapien
ttgagcgaggcctcggaccttcggc

SEQ ID NO: 74927 - DNA, 25 bp, Homo sapien
cttcgtcactgaggactccgggcgg

SEQ ID NO: 74928 - DNA, 25 bp, Homo sapien
ttggcttcgtcactgaggactccgg

SEQ ID NO: 74929 - DNA, 25 bp, Homo sapien
ccatgttggcttcgtcactgaggac

SEQ ID NO: 74930 - DNA, 25 bp, Homo sapien
agcggccatgttggcttcgtcactg

SEQ ID NO: 74931 - DNA, 25 bp, Homo sapien
cccgccacggctggcaggtcactcg

SEQ ID NO: 74932 - DNA, 25 bp, Homo sapien
ggtgttcgcgccctgctttcgcgcg

SEQ ID NO: 74933 - DNA, 25 bp, Homo sapien
aggcctcggaccttcggcctgtcgg

SEQ ID NO: 74934 - DNA, 25 bp, Homo sapien
ccttgtcaacgccaagggtgttttg

SEQ ID NO: 74935 - DNA, 25 bp, Homo sapien
atttggacgctctgaatccgttttc

SEQ ID NO: 74936 - DNA, 25 bp, Homo sapien
acccgatgttatcaacagcgtttta

SEQ ID NO: 74937 - DNA, 25 bp, Homo sapien
ttttggacggatgtgtctatcctga

SEQ ID NO: 74938 - DNA, 25 bp, Homo sapien
tctatcctgaaagcttccagcctgg

SEQ ID NO: 74939 - DNA, 25 bp, Homo sapien
gctttgaacttgacttggcaacgga

SEQ ID NO: 74940 - DNA, 25 bp, Homo sapien
cttggcaacggatgaaaacctcggc

SEQ ID NO: 74941 - DNA, 25 bp, Homo sapien
gcgaccaccagctggaaccaaaagg

SEQ ID NO: 74942 - DNA, 25 bp, Homo sapien
aggccgctcaggctcgaatcttgcg

SEQ ID NO: 74943 - DNA, 25 bp, Homo sapien
tgtcagcggcatctcctttcaggtc

SEQ ID NO: 74944 - DNA, 25 bp, Homo sapien
gaggccgcagctttccaccggaaag

SEQ ID NO: 74945 - DNA, 25 bp, Homo sapien
gcattgtgggagtacagctctttcc

SEQ ID NO: 74946 - DNA, 25 bp, Homo sapien
gccgcagcagtaccttgtcctgtga

SEQ ID NO: 74947 - DNA, 25 bp, Homo sapien
ggcgcgatgccggaactacatgtcc

SEQ ID NO: 74948 - DNA, 25 bp, Homo sapien
ccgcggtgcgtgaaacaaacctgtt

SEQ ID NO: 74949 - DNA, 25 bp, Homo sapien
gctgcgttgaggatctttgctcttc

SEQ ID NO: 74950 - DNA, 25 bp, Homo sapien
gcataccttgcagattccgaggagg

SEQ ID NO: 74951 - DNA, 25 bp, Homo sapien
cgcgtgacgcggcattacataatgg

SEQ ID NO: 74952 - DNA, 25 bp, Homo sapien
gaggctggtagctgcataccttgca

SEQ ID NO: 74953 - DNA, 25 bp, Homo sapien
gccgcacgctcttttcgcgaggtga

SEQ ID NO: 74954 - DNA, 25 bp, Homo sapien
agcgggcgctgacaccgcagtgcac

SEQ ID NO: 74955 - DNA, 25 bp, Homo sapien
tgcagcctgctgtgcgctgcacggc

SEQ ID NO: 74956 - DNA, 25 bp, Homo sapien
cacgtgcgcgctgtgtttacgttcg

SEQ ID NO: 74957 - DNA, 25 bp, Homo sapien
atgcaggtaagaaccggactgcggc

SEQ ID NO: 74958 - DNA, 25 bp, Homo sapien
ggtctcttttccaagcgcactcaca

SEQ ID NO: 74959 - DNA, 25 bp, Homo sapien
cgcgcgagtcctgcaaaatgtcaac

SEQ ID NO: 74960 - DNA, 25 bp, Homo sapien
gcgcggtcctctagccaaattacca

SEQ ID NO: 74961 - DNA, 25 bp, Homo sapien
gtctgcgaaccggtgacctggtttc

SEQ ID NO: 74962 - DNA, 25 bp, Homo sapien
aggatgtgcgccttccttggccaag

SEQ ID NO: 74963 - DNA, 25 bp, Homo sapien
cgaggaaatggcctcctggcgcaca

SEQ ID NO: 74964 - DNA, 25 bp, Homo sapien
ggtttgggcgtcattactctagttg

SEQ ID NO: 74965 - DNA, 25 bp, Homo sapien
cacccgattgcctgcgcgcataggt

SEQ ID NO: 74966 - DNA, 25 bp, Homo sapien
accgggctgcctaacgcgcagcgga

SEQ ID NO: 74967 - DNA, 25 bp, Homo sapien
cgcgggagttcaaagcccggcactg

SEQ ID NO: 74968 - DNA, 25 bp, Homo sapien
agtctcagtcctgcagcctaaggca

SEQ ID NO: 74969 - DNA, 25 bp, Homo sapien
cgaaggtgtaaagcccgagcgagca

SEQ ID NO: 74970 - DNA, 25 bp, Homo sapien
tcagagcaagaaacaccgaaggtgt

SEQ ID NO: 74971 - DNA, 25 bp, Homo sapien
ctcagggagcttcagagcaagaaac

SEQ ID NO: 74972 - DNA, 25 bp, Homo sapien
ctgagggaagagacactccgagtcc

SEQ ID NO: 74973 - DNA, 25 bp, Homo sapien
ctctcagccggctcgtagagccagg

SEQ ID NO: 74974 - DNA, 25 bp, Homo sapien
gcagtcctcttccaagttcccttta

SEQ ID NO: 74975 - DNA, 25 bp, Homo sapien
gaccagggcatttgcatggcatcca

SEQ ID NO: 74976 - DNA, 25 bp, Homo sapien
accggctgcctagcagggattttgc

SEQ ID NO: 74977 - DNA, 25 bp, Homo sapien
caggacatctggactcgcggacaac

SEQ ID NO: 74978 - DNA, 25 bp, Homo sapien
tcgcggacaactttgcgcagcagtc

SEQ ID NO: 74979 - DNA, 25 bp, Homo sapien
ccggactccagctttgttctcatta

SEQ ID NO: 74980 - DNA, 25 bp, Homo sapien
cagcccgccaaaaggtaaagccagg

SEQ ID NO: 74981 - DNA, 25 bp, Homo sapien
acccaggagtcgctggcaagttgca

SEQ ID NO: 74982 - DNA, 25 bp, Homo sapien
tagagcgaagccaaaggcgcctttc

SEQ ID NO: 74983 - DNA, 25 bp, Homo sapien
gggtagcagcgcctatgtgaagtta

SEQ ID NO: 74984 - DNA, 25 bp, Homo sapien
gcgaacacgtcggaacagtgacttc

SEQ ID NO: 74985 - DNA, 25 bp, Homo sapien
gctcggccagaaacgcgaacacgtc

SEQ ID NO: 74986 - DNA, 25 bp, Homo sapien
gagcgtcgcttctgagctgtgccac

SEQ ID NO: 74987 - DNA, 25 bp, Homo sapien
agcggtgaccggttaccatagagac

SEQ ID NO: 74988 - DNA, 25 bp, Homo sapien
acgccactccatagaagcggtgacc

SEQ ID NO: 74989 - DNA, 25 bp, Homo sapien
aggcgcctttcttcacagtttggga

SEQ ID NO: 74990 - DNA, 25 bp, Homo sapien
ccatcgcgaagatccggagcggacg

SEQ ID NO: 74991 - DNA, 25 bp, Homo sapien
ccatgctgtccaatccgggccttgt

SEQ ID NO: 74992 - DNA, 25 bp, Homo sapien
catggcgagtgcctccagctcacag

SEQ ID NO: 74993 - DNA, 25 bp, Homo sapien
ttgtccttctcacactccgcgaagg

SEQ ID NO: 74994 - DNA, 25 bp, Homo sapien
gccagccactcgagtcgccagagta

SEQ ID NO: 74995 - DNA, 25 bp, Homo sapien
caccgagagggacaataaacagagc

SEQ ID NO: 74996 - DNA, 25 bp, Homo sapien
cacacatttgcacaccggggagaga

SEQ ID NO: 74997 - DNA, 25 bp, Homo sapien
ctggaggattctgcaagcacaggcc

SEQ ID NO: 74998 - DNA, 25 bp, Homo sapien
tgccctctgaagctcaggccggacg

SEQ ID NO: 74999 - DNA, 25 bp, Homo sapien
tcctttaggacggaggagctcggct

SEQ ID NO: 75000 - DNA, 25 bp, Homo sapien
gcagcagcttggaggcctccaaaaa

SEQ ID NO: 75001 - DNA, 25 bp, Homo sapien
agtccctggccgaacaaggtgccgc

SEQ ID NO: 75002 - DNA, 25 bp, Homo sapien
ctcggacgttaggagcagaaccagc

SEQ ID NO: 75003 - DNA, 25 bp, Homo sapien
gcagtgtctgaagcacgccttccta

SEQ ID NO: 75004 - DNA, 25 bp, Homo sapien
tgtcagcataggtgagcagcagctt

SEQ ID NO: 75005 - DNA, 25 bp, Homo sapien
gactgcaggtgccaagtcacaactg

SEQ ID NO: 75006 - DNA, 25 bp, Homo sapien
ggctgggctctgactgtcacgttaa

SEQ ID NO: 75007 - DNA, 25 bp, Homo sapien
gcagccgcctgttgcttttcgcaga

SEQ ID NO: 75008 - DNA, 25 bp, Homo sapien
ccgcagcaacgcgagccaagtcgtg

SEQ ID NO: 75009 - DNA, 25 bp, Homo sapien
tgctcttcctgcaaggctacggcgc

SEQ ID NO: 75010 - DNA, 25 bp, Homo sapien
ctcctgtctttgtctgctcttcctg

SEQ ID NO: 75011 - DNA, 25 bp, Homo sapien
ttgactgagccgactgcatctctgg

SEQ ID NO: 75012 - DNA, 25 bp, Homo sapien
aggcgatttccctctattgactgag

SEQ ID NO: 75013 - DNA, 25 bp, Homo sapien
cacgttaattccctgctgctttttc

SEQ ID NO: 75014 - DNA, 25 bp, Homo sapien
tccacaaatcgcacctgggcggagc

SEQ ID NO: 75015 - DNA, 25 bp, Homo sapien
gcgcggcgagtaaacaggggtccaa

SEQ ID NO: 75016 - DNA, 25 bp, Homo sapien
cacaaatcgcacctgggcggagcga

SEQ ID NO: 75017 - DNA, 25 bp, Homo sapien
ccagcgcgcggcgagtaaacagggg

SEQ ID NO: 75018 - DNA, 25 bp, Homo sapien
tggggagcgcagagctggagggcgt

SEQ ID NO: 75019 - DNA, 25 bp, Homo sapien
tccaaagtggttggaggagagcgca

SEQ ID NO: 75020 - DNA, 25 bp, Homo sapien
tgcggtgggagccactttcccccgc

SEQ ID NO: 75021 - DNA, 25 bp, Homo sapien
ccacaaatcgcacctgggcggagcg

SEQ ID NO: 75022 - DNA, 25 bp, Homo sapien
cggagaccctgactcaagctgctcg

SEQ ID NO: 75023 - DNA, 25 bp, Homo sapien
ccttatcattgtccctgctgctgtc

SEQ ID NO: 75024 - DNA, 25 bp, Homo sapien
tccacagggacctgaggacgtctcc

SEQ ID NO: 75025 - DNA, 25 bp, Homo sapien
tcagccaatcgggagcagccatgct

SEQ ID NO: 75026 - DNA, 25 bp, Homo sapien
ctggccaggccaatgccgacaattc

SEQ ID NO: 75027 - DNA, 25 bp, Homo sapien
agctgcaccgttggttttccaatca

SEQ ID NO: 75028 - DNA, 25 bp, Homo sapien
gggaatcgccgtagcaaccagagac

SEQ ID NO: 75029 - DNA, 25 bp, Homo sapien
gtgcagaacgccatagcgacggatg

SEQ ID NO: 75030 - DNA, 25 bp, Homo sapien
gtagggcgagtcatatgatccgctc

SEQ ID NO: 75031 - DNA, 25 bp, Homo sapien
gactggttccgttcgctcttctgga

SEQ ID NO: 75032 - DNA, 25 bp, Homo sapien
cttcgtcaatgtcatcgcggtgagc

SEQ ID NO: 75033 - DNA, 25 bp, Homo sapien
cgaagctgggcctgtcatctcccga

SEQ ID NO: 75034 - DNA, 25 bp, Homo sapien
ctcccgagggccagcatttggaatt

SEQ ID NO: 75035 - DNA, 25 bp, Homo sapien
catttggaatttcccgcgtgttggc

SEQ ID NO: 75036 - DNA, 25 bp, Homo sapien
gtcagtgtagacattttccaagggc

SEQ ID NO: 75037 - DNA, 25 bp, Homo sapien
ttccaagggctgtgtcctcaacgcc

SEQ ID NO: 75038 - DNA, 25 bp, Homo sapien
agccgccgtcctccttagaaggaga

SEQ ID NO: 75039 - DNA, 25 bp, Homo sapien
ctagaactgagcgaaccggcggacc

SEQ ID NO: 75040 - DNA, 25 bp, Homo sapien
cggcgtggaacctgaagctagaact

SEQ ID NO: 75041 - DNA, 25 bp, Homo sapien
tgagtagcggtctcatctgctcgcc

SEQ ID NO: 75042 - DNA, 25 bp, Homo sapien
ccctgctcgttacccgggtgagtag

SEQ ID NO: 75043 - DNA, 25 bp, Homo sapien
taatctgaaactcctgcgccaaggc

SEQ ID NO: 75044 - DNA, 25 bp, Homo sapien
gataggttttcgagggctaatctga

SEQ ID NO: 75045 - DNA, 25 bp, Homo sapien
tcaccactgcctggggctagagaca

SEQ ID NO: 75046 - DNA, 25 bp, Homo sapien
gaaagctaaaggtgatgtggccgcc

SEQ ID NO: 75047 - DNA, 25 bp, Homo sapien
cgagaaagctaaaggtgatgtggcc

SEQ ID NO: 75048 - DNA, 25 bp, Homo sapien
cgaggcgtaagaccgcgcagggcct

SEQ ID NO: 75049 - DNA, 25 bp, Homo sapien
agtgaaacgccagatctaggccctg

SEQ ID NO: 75050 - DNA, 25 bp, Homo sapien
tggaggcagtgaaacgccagatcta

SEQ ID NO: 75051 - DNA, 25 bp, Homo sapien
cagctacctggaggcagtgaaacgc

SEQ ID NO: 75052 - DNA, 25 bp, Homo sapien
atgtggccgccctcaaccgacgcat

SEQ ID NO: 75053 - DNA, 25 bp, Homo sapien
gccctcaaccgacgcatccagctcg

SEQ ID NO: 75054 - DNA, 25 bp, Homo sapien
tcccagagctgtcgaaatctccgcg

SEQ ID NO: 75055 - DNA, 25 bp, Homo sapien
atctccgcggggtgaaagctaaact

SEQ ID NO: 75056 - DNA, 25 bp, Homo sapien
tgggactcaatcgtgctcagcaaca

SEQ ID NO: 75057 - DNA, 25 bp, Homo sapien
ccttggggttcgcatatttgaaagc

SEQ ID NO: 75058 - DNA, 25 bp, Homo sapien
aaaatccagcgcaggtcgggttccg

SEQ ID NO: 75059 - DNA, 25 bp, Homo sapien
tcctgcgcccggaagaaaatccagc

SEQ ID NO: 75060 - DNA, 25 bp, Homo sapien
aaacttttggagtcgctgtgtagcc

SEQ ID NO: 75061 - DNA, 25 bp, Homo sapien
ggagagaatctgacctccgacattc

SEQ ID NO: 75062 - DNA, 25 bp, Homo sapien
gaggtacaaggtcctggcggcctta

SEQ ID NO: 75063 - DNA, 25 bp, Homo sapien
ctggcggccttaattgggcgcagaa

SEQ ID NO: 75064 - DNA, 25 bp, Homo sapien
gacagtcgaggtacaaggtcctggc

SEQ ID NO: 75065 - DNA, 25 bp, Homo sapien
gacaggacagtcgaggtacaaggtc

SEQ ID NO: 75066 - DNA, 25 bp, Homo sapien
aaacgcggagcaggagttcgagccc

SEQ ID NO: 75067 - DNA, 25 bp, Homo sapien
caaagtgttttgagtaggccgttcg

SEQ ID NO: 75068 - DNA, 25 bp, Homo sapien
cgcctttgccaaagtgttttgagta

SEQ ID NO: 75069 - DNA, 25 bp, Homo sapien
agttcggggcgcctttgccaaagtg

SEQ ID NO: 75070 - DNA, 25 bp, Homo sapien
cagtcctattggttacgagagccgc

SEQ ID NO: 75071 - DNA, 25 bp, Homo sapien
cagtttccagaggaggggtcctaga

SEQ ID NO: 75072 - DNA, 25 bp, Homo sapien
tttggcactggttctgataggacgg

SEQ ID NO: 75073 - DNA, 25 bp, Homo sapien
gtttgcgttcccagagttcctattg

SEQ ID NO: 75074 - DNA, 25 bp, Homo sapien
cgaccgtcctttcgtagggcgcact

SEQ ID NO: 75075 - DNA, 25 bp, Homo sapien
ctattgggttaacactggaggctct

SEQ ID NO: 75076 - DNA, 25 bp, Homo sapien
gccagcaagagcaacgtcaccagtt

SEQ ID NO: 75077 - DNA, 25 bp, Homo sapien
aatacgccttccgattggttggctc

SEQ ID NO: 75078 - DNA, 25 bp, Homo sapien
actgtttgcagagcggcagtgcacg

SEQ ID NO: 75079 - DNA, 25 bp, Homo sapien
cagcgtctgggttcagaagaaagcc

SEQ ID NO: 75080 - DNA, 25 bp, Homo sapien
cggagtttgactgcagctactgagg

SEQ ID NO: 75081 - DNA, 25 bp, Homo sapien
ctcagaccgagtccgggcggagttt

SEQ ID NO: 75082 - DNA, 25 bp, Homo sapien
tttgtaagtgccacgcccgtcccta

SEQ ID NO: 75083 - DNA, 25 bp, Homo sapien
agtgcacggaacgactggaatcctc

SEQ ID NO: 75084 - DNA, 25 bp, Homo sapien
cgcaaggtgaactgctccaaggtca

SEQ ID NO: 75085 - DNA, 25 bp, Homo sapien
tcccgtggagcgtgggccaaataaa

SEQ ID NO: 75086 - DNA, 25 bp, Homo sapien
ttgcgcgcggtgaaacactctaagc

SEQ ID NO: 75087 - DNA, 25 bp, Homo sapien
cactgacacagagggacaccgcatt

SEQ ID NO: 75088 - DNA, 25 bp, Homo sapien
agccgtaacattggcaccctgcaag

SEQ ID NO: 75089 - DNA, 25 bp, Homo sapien
gcaccgcgcggaacaactgggttca

SEQ ID NO: 75090 - DNA, 25 bp, Homo sapien
cacctgccctgtttcgtaatgatca

SEQ ID NO: 75091 - DNA, 25 bp, Homo sapien
agagactgccggaaaacttcttgga

SEQ ID NO: 75092 - DNA, 25 bp, Homo sapien
ccctggctgtactgataggtgcccg

SEQ ID NO: 75093 - DNA, 25 bp, Homo sapien
ttgagccacagaggccggttgcaca

SEQ ID NO: 75094 - DNA, 25 bp, Homo sapien
cgaacgcgatcacacgggaaactct

SEQ ID NO: 75095 - DNA, 25 bp, Homo sapien
gtctccgagaacgaggtccttaatg

SEQ ID NO: 75096 - DNA, 25 bp, Homo sapien
tgcgaagctttccaacccagttttc

SEQ ID NO: 75097 - DNA, 25 bp, Homo sapien
tcttcgcccacaacagatgagatgg

SEQ ID NO: 75098 - DNA, 25 bp, Homo sapien
agagcggggccgtcatattttatcg

SEQ ID NO: 75099 - DNA, 25 bp, Homo sapien
cgctgcgtttcctcagatagattca

SEQ ID NO: 75100 - DNA, 25 bp, Homo sapien
gcacttagactctccagggcattta

SEQ ID NO: 75101 - DNA, 25 bp, Homo sapien
tgctgagtgcgcacacgcaagtgta

SEQ ID NO: 75102 - DNA, 25 bp, Homo sapien
tcaaacccaggcgtcaggcgctgca

SEQ ID NO: 75103 - DNA, 25 bp, Homo sapien
ctggtacgcgcagcccgggaaaaag

SEQ ID NO: 75104 - DNA, 25 bp, Homo sapien
ctctgagcgagtggcgaatgctccc

SEQ ID NO: 75105 - DNA, 25 bp, Homo sapien
gcctcagaggagtcttttagggctc

SEQ ID NO: 75106 - DNA, 25 bp, Homo sapien
actcctctctgggactgcgcacttg

SEQ ID NO: 75107 - DNA, 25 bp, Homo sapien
ttacgacgcagagaaggataagggc

SEQ ID NO: 75108 - DNA, 25 bp, Homo sapien
tgcagtcagggaaggctcccttagg

SEQ ID NO: 75109 - DNA, 25 bp, Homo sapien
gggttcctggcgcttacgacgcaga

SEQ ID NO: 75110 - DNA, 25 bp, Homo sapien
aagcggctacgttcttctcggcccg

SEQ ID NO: 75111 - DNA, 25 bp, Homo sapien
gggtagcattgcttccaccagcgtc

SEQ ID NO: 75112 - DNA, 25 bp, Homo sapien
ccgagtgaggcacagtcccaaagtc

SEQ ID NO: 75113 - DNA, 25 bp, Homo sapien
acccgggtctgcaactggtgcacaa

SEQ ID NO: 75114 - DNA, 25 bp, Homo sapien
tgcgaagtcagttccactctagtta

SEQ ID NO: 75115 - DNA, 25 bp, Homo sapien
gtgctttgcaaagggcccgtgtttc

SEQ ID NO: 75116 - DNA, 25 bp, Homo sapien
ggactttggcccagtcaccgagtga

SEQ ID NO: 75117 - DNA, 25 bp, Homo sapien
cccgtgtttctgttgcgggaagctc

SEQ ID NO: 75118 - DNA, 25 bp, Homo sapien
gtcccatttcttctgactcggcagg

SEQ ID NO: 75119 - DNA, 25 bp, Homo sapien
agagaaggcccgttacccagcaata

SEQ ID NO: 75120 - DNA, 25 bp, Homo sapien
gccgccgagtttcgattccttagtg

SEQ ID NO: 75121 - DNA, 25 bp, Homo sapien
gcgagtcactcacccagaagccagg

SEQ ID NO: 75122 - DNA, 25 bp, Homo sapien
gtttcttcgaagacaccgccgcttc

SEQ ID NO: 75123 - DNA, 25 bp, Homo sapien
gcgtactacatgtcccgtgagcctc

SEQ ID NO: 75124 - DNA, 25 bp, Homo sapien
tggtgcgtctttttcactcagtgtc

SEQ ID NO: 75125 - DNA, 25 bp, Homo sapien
gacgtgtctttttggaccggcaaca

SEQ ID NO: 75126 - DNA, 25 bp, Homo sapien
gctttaaaataatgcccgcggcgcc

SEQ ID NO: 75127 - DNA, 25 bp, Homo sapien
tttggctacgacaactacatggctc

SEQ ID NO: 75128 - DNA, 25 bp, Homo sapien
cccggacgagtacgagaagcgctac

SEQ ID NO: 75129 - DNA, 25 bp, Homo sapien
ctcagcttcggcttccagcgtctga

SEQ ID NO: 75130 - DNA, 25 bp, Homo sapien
agcatgggcttctaccagcgctttc

SEQ ID NO: 75131 - DNA, 25 bp, Homo sapien
ccatggagtattgtggctcgtcttc

SEQ ID NO: 75132 - DNA, 25 bp, Homo sapien
ccggcttggcctccatggagtattg

SEQ ID NO: 75133 - DNA, 25 bp, Homo sapien
acggggcatgttcgtctttggctac

SEQ ID NO: 75134 - DNA, 25 bp, Homo sapien
cgcttttgtcttgccctccagtgaa

SEQ ID NO: 75135 - DNA, 25 bp, Homo sapien
ctactccagttctttagtgcagggc

SEQ ID NO: 75136 - DNA, 25 bp, Homo sapien
tttgccgttggcttctccttctcta

SEQ ID NO: 75137 - DNA, 25 bp, Homo sapien
gagctctgggatacacacacgcgca

SEQ ID NO: 75138 - DNA, 25 bp, Homo sapien
ttgcacctgagagtccctattcttg

SEQ ID NO: 75139 - DNA, 25 bp, Homo sapien
cgaccaggttggttcttccagcaac

SEQ ID NO: 75140 - DNA, 25 bp, Homo sapien
ttctaacctgcgacctggccagagg

SEQ ID NO: 75141 - DNA, 25 bp, Homo sapien
aggtcgacttcctgcccggaatttg

SEQ ID NO: 75142 - DNA, 25 bp, Homo sapien
ctgttggcgaggagtttcctgtttc

SEQ ID NO: 75143 - DNA, 25 bp, Homo sapien
ccgcagcgctgagttgaagttgagt

SEQ ID NO: 75144 - DNA, 25 bp, Homo sapien
tcctgtggacgcgtatcgccagcac

SEQ ID NO: 75145 - DNA, 25 bp, Homo sapien
ggccgctgcacatcgtcctgtggac

SEQ ID NO: 75146 - DNA, 25 bp, Homo sapien
agaagttggttatctgaaggcggcc

SEQ ID NO: 75147 - DNA, 25 bp, Homo sapien
gatcccaccgcacgttcagaagtcg

SEQ ID NO: 75148 - DNA, 25 bp, Homo sapien
ttgagtgagtcactcgcgcgcacgg

SEQ ID NO: 75149 - DNA, 25 bp, Homo sapien
cccgtagctgcagggattgtgagtt

SEQ ID NO: 75150 - DNA, 25 bp, Homo sapien
aacaccagtgcaaacggagggacga

SEQ ID NO: 75151 - DNA, 25 bp, Homo sapien
agccgcgctgagtcgttaccgtcca

SEQ ID NO: 75152 - DNA, 25 bp, Homo sapien
gccgcggagagaacaccagtgcaaa

SEQ ID NO: 75153 - DNA, 25 bp, Homo sapien
gtcgttaccgtccacaggacactgg

SEQ ID NO: 75154 - DNA, 25 bp, Homo sapien
ggcggtccgagtcgctgctcatctc

SEQ ID NO: 75155 - DNA, 25 bp, Homo sapien
ccacaggacactggcggtccgagtc

SEQ ID NO: 75156 - DNA, 25 bp, Homo sapien
taccgtccacaggacactggcggtc

SEQ ID NO: 75157 - DNA, 25 bp, Homo sapien
cgctgagtcgttaccgtccacagga

SEQ ID NO: 75158 - DNA, 25 bp, Homo sapien
ttctcggactaagtgggccagactc

SEQ ID NO: 75159 - DNA, 25 bp, Homo sapien
cacttgggtgtgtccagtgtctaca

SEQ ID NO: 75160 - DNA, 25 bp, Homo sapien
aggcggaccctagctgatttgactc

SEQ ID NO: 75161 - DNA, 25 bp, Homo sapien
ggggtcaatcgctagtctcaccaga

SEQ ID NO: 75162 - DNA, 25 bp, Homo sapien
ccagtgtccgtcctatattgttttc

SEQ ID NO: 75163 - DNA, 25 bp, Homo sapien
gacgcttattcatgtcgccttaatg

SEQ ID NO: 75164 - DNA, 25 bp, Homo sapien
ccagaggtctcttgtggaacatttc

SEQ ID NO: 75165 - DNA, 25 bp, Homo sapien
ttgcgagtgacagaagcatcctttg

SEQ ID NO: 75166 - DNA, 25 bp, Homo sapien
ccctaacggacctgtcgctttgtga

SEQ ID NO: 75167 - DNA, 25 bp, Homo sapien
gccgtcatccgcttcgaaagcatca

SEQ ID NO: 75168 - DNA, 25 bp, Homo sapien
agtcagaggttgcttgagctccgcc

SEQ ID NO: 75169 - DNA, 25 bp, Homo sapien
gcgcgaaaccgcgtctttcaactga

SEQ ID NO: 75170 - DNA, 25 bp, Homo sapien
ccgcagctgcactggggatacggat

SEQ ID NO: 75171 - DNA, 25 bp, Homo sapien
aagcacaagtcgtccctcaactcgt

SEQ ID NO: 75172 - DNA, 25 bp, Homo sapien
actgacaatgaagccgtagccgcgc

SEQ ID NO: 75173 - DNA, 25 bp, Homo sapien
ggtggcagtcgcttctctccttcac

SEQ ID NO: 75174 - DNA, 25 bp, Homo sapien
ggcgaaagggaatctctgcacgtca

SEQ ID NO: 75175 - DNA, 25 bp, Homo sapien
ctgaaggcacaatcgcgcgcgcaca

SEQ ID NO: 75176 - DNA, 25 bp, Homo sapien
tggcgcgttacctgttctgccagcc

SEQ ID NO: 75177 - DNA, 25 bp, Homo sapien
ttggtgtatttgctgagcacgccct

SEQ ID NO: 75178 - DNA, 25 bp, Homo sapien
tggactgccctctccatggtccgtg

SEQ ID NO: 75179 - DNA, 25 bp, Homo sapien
ctccgcactagtttcccgggcaagt

SEQ ID NO: 75180 - DNA, 25 bp, Homo sapien
tgccaccctctcttggatccgaagg

SEQ ID NO: 75181 - DNA, 25 bp, Homo sapien
catcactgggttcgctgaaggcaca

SEQ ID NO: 75182 - DNA, 25 bp, Homo sapien
tggaggctcgagcattcttactgca

SEQ ID NO: 75183 - DNA, 25 bp, Homo sapien
ggcgcgtcgtatcaggaagaaaatc

SEQ ID NO: 75184 - DNA, 25 bp, Homo sapien
cttactgcagtttcggtgttgagga

SEQ ID NO: 75185 - DNA, 25 bp, Homo sapien
tcctaagggcgtattccgttctcca

SEQ ID NO: 75186 - DNA, 25 bp, Homo sapien
ccctgaaagtgtgcatcgtgggctc

SEQ ID NO: 75187 - DNA, 25 bp, Homo sapien
ctccctgaggcgttgagaattctcc

SEQ ID NO: 75188 - DNA, 25 bp, Homo sapien
ggtccactatcttaggcgcgtcgta

SEQ ID NO: 75189 - DNA, 25 bp, Homo sapien
atccaagtttcaacaggccgctctc

SEQ ID NO: 75190 - DNA, 25 bp, Homo sapien
ctgcctcggtcgtcgctcagtcatt

SEQ ID NO: 75191 - DNA, 25 bp, Homo sapien
tggttcctcaaattgttcccgacag

SEQ ID NO: 75192 - DNA, 25 bp, Homo sapien
tctcatcgatctcgggtctaaggtc

SEQ ID NO: 75193 - DNA, 25 bp, Homo sapien
gccgggtcatcattcctgccatttc

SEQ ID NO: 75194 - DNA, 25 bp, Homo sapien
gggcaggaaataacaccgggctctg

SEQ ID NO: 75195 - DNA, 25 bp, Homo sapien
agcagcttcgcctacgaccgggagt

SEQ ID NO: 75196 - DNA, 25 bp, Homo sapien
agctccttcgcagagaacttctcca

SEQ ID NO: 75197 - DNA, 25 bp, Homo sapien
tccacagcattcgaggtaccacatc

SEQ ID NO: 75198 - DNA, 25 bp, Homo sapien
gtcgctaaagttcgcggcaggcttc

SEQ ID NO: 75199 - DNA, 25 bp, Homo sapien
gggactgccgctacctttctggaag

SEQ ID NO: 75200 - DNA, 25 bp, Homo sapien
ctgactgaaaccacgggcaaagttc

SEQ ID NO: 75201 - DNA, 25 bp, Homo sapien
ggccctgctgaaagtggcgcaaatg

SEQ ID NO: 75202 - DNA, 25 bp, Homo sapien
agcctgacccgcctactgactgaaa

SEQ ID NO: 75203 - DNA, 25 bp, Homo sapien
taacttccgcgcatctacgagggcc

SEQ ID NO: 75204 - DNA, 25 bp, Homo sapien
tgctctgtgtgcagtttcgctcgaa

SEQ ID NO: 75205 - DNA, 25 bp, Homo sapien
tgagggagcgaaacccgacctcttc

SEQ ID NO: 75206 - DNA, 25 bp, Homo sapien
cggaaatcgcgagcagagcccttct

SEQ ID NO: 75207 - DNA, 25 bp, Homo sapien
cgctcctgggcggaaatcgcgagca

SEQ ID NO: 75208 - DNA, 25 bp, Homo sapien
gctgggacgcggtcactgctccagc

SEQ ID NO: 75209 - DNA, 25 bp, Homo sapien
tgctcattccctggcagggctcgcg

SEQ ID NO: 75210 - DNA, 25 bp, Homo sapien
actactttggctcagtggtttcctg

SEQ ID NO: 75211 - DNA, 25 bp, Homo sapien
ctttgttactactttggctcagtgg

SEQ ID NO: 75212 - DNA, 25 bp, Homo sapien
ctggccttctttgttactactttgg

SEQ ID NO: 75213 - DNA, 25 bp, Homo sapien
aaatcgcgagcagagcccttctcag

SEQ ID NO: 75214 - DNA, 25 bp, Homo sapien
atgcttcctagcgaacccaggggca

SEQ ID NO: 75215 - DNA, 25 bp, Homo sapien
ctggcggccatcgggaagcatcgcc

SEQ ID NO: 75216 - DNA, 25 bp, Homo sapien
tctggcagatgcttcctagcgaacc

SEQ ID NO: 75217 - DNA, 25 bp, Homo sapien
gccggtctggcagatgcttcctagc

SEQ ID NO: 75218 - DNA, 25 bp, Homo sapien
ctagcgaacccaggggcagcgcgct

SEQ ID NO: 75219 - DNA, 25 bp, Homo sapien
tggacacagctctcctgtagcgaaa

SEQ ID NO: 75220 - DNA, 25 bp, Homo sapien
aaaacccaccaagcaggtggctgca

SEQ ID NO: 75221 - DNA, 25 bp, Homo sapien
tctcctgtagcgaaaacaaaaccca

SEQ ID NO: 75222 - DNA, 25 bp, Homo sapien
tcgtccaggcgctcatccagaagga

SEQ ID NO: 75223 - DNA, 25 bp, Homo sapien
gaacagtcgcttactttcgtccagg

SEQ ID NO: 75224 - DNA, 25 bp, Homo sapien
ccagggacacttacgcgctcgaaca

SEQ ID NO: 75225 - DNA, 25 bp, Homo sapien
gcgcggatcctggacacttgttcca

SEQ ID NO: 75226 - DNA, 25 bp, Homo sapien
aacctactgcccaacgtgacgctgg

SEQ ID NO: 75227 - DNA, 25 bp, Homo sapien
tggaagcgatgctctacgccctgga

SEQ ID NO: 75228 - DNA, 25 bp, Homo sapien
ctgcggcgacatcaagagggaaaac

SEQ ID NO: 75229 - DNA, 25 bp, Homo sapien
ccgcgtcctgactttgatgaagttc

SEQ ID NO: 75230 - DNA, 25 bp, Homo sapien
tggggctgtacaccgctccgttctc

SEQ ID NO: 75231 - DNA, 25 bp, Homo sapien
agctgcaagcccttgagaacgcgcc

SEQ ID NO: 75232 - DNA, 25 bp, Homo sapien
gagccggcccatgaaaaagtaggca

SEQ ID NO: 75233 - DNA, 25 bp, Homo sapien
tcctcctccgtagtggggctgtaca

SEQ ID NO: 75234 - DNA, 25 bp, Homo sapien
tgaccgcggactcaccagctgcaag

SEQ ID NO: 75235 - DNA, 25 bp, Homo sapien
gttctccatcgcctcgggccgggga

SEQ ID NO: 75236 - DNA, 25 bp, Homo sapien
gcaaccgcgccgttgacttctcgga

SEQ ID NO: 75237 - DNA, 25 bp, Homo sapien
gccgttgacttctcggactccagaa

SEQ ID NO: 75238 - DNA, 25 bp, Homo sapien
cttacccagcagtagcacgttcttc

SEQ ID NO: 75239 - DNA, 25 bp, Homo sapien
tgggccgctatgctgcaactgaagc

SEQ ID NO: 75240 - DNA, 25 bp, Homo sapien
accactcccggcaagactaaatgtg

SEQ ID NO: 75241 - DNA, 25 bp, Homo sapien
cgccatcttggtcgggaatcacacc

SEQ ID NO: 75242 - DNA, 25 bp, Homo sapien
ccgccagtgtaagtcgaggataatc

SEQ ID NO: 75243 - DNA, 25 bp, Homo sapien
cgacgctatctcgttgcccaagggg

SEQ ID NO: 75244 - DNA, 25 bp, Homo sapien
gacctcgctgaggatgcaggaccta

SEQ ID NO: 75245 - DNA, 25 bp, Homo sapien
tgtgtcaggtgaaaagtgctccctc

SEQ ID NO: 75246 - DNA, 25 bp, Homo sapien
ctcgaccgcgaagcaactaatagga

SEQ ID NO: 75247 - DNA, 25 bp, Homo sapien
gagcgccactcccagcatcgaaatg

SEQ ID NO: 75248 - DNA, 25 bp, Homo sapien
cacggcaattcccagtctgctaatg

SEQ ID NO: 75249 - DNA, 25 bp, Homo sapien
gaccgagagagactttccaaacttc

SEQ ID NO: 75250 - DNA, 25 bp, Homo sapien
gcggggacaccgcttctccaacaga

SEQ ID NO: 75251 - DNA, 25 bp, Homo sapien
ggccggagcctcaactcgatgagaa

SEQ ID NO: 75252 - DNA, 25 bp, Homo sapien
agccgcgttttcagggtagccgaag

SEQ ID NO: 75253 - DNA, 25 bp, Homo sapien
tgtcaatttggatgctccgcgcctc

SEQ ID NO: 75254 - DNA, 25 bp, Homo sapien
cgcgtcagccctgtgaacatccaga

SEQ ID NO: 75255 - DNA, 25 bp, Homo sapien
aggttccagccagagtacgtccggc

SEQ ID NO: 75256 - DNA, 25 bp, Homo sapien
tgctgttgctagacgacgggaacta

SEQ ID NO: 75257 - DNA, 25 bp, Homo sapien
gcacagagttgtcctcggaggtcca

SEQ ID NO: 75258 - DNA, 25 bp, Homo sapien
ccacctgcagggaagaacccgagtc

SEQ ID NO: 75259 - DNA, 25 bp, Homo sapien
cgacttgaatttgggcgtgcatttc

SEQ ID NO: 75260 - DNA, 25 bp, Homo sapien
catcctctgtctcggctgtcgctaa

SEQ ID NO: 75261 - DNA, 25 bp, Homo sapien
ctgtcgctaacatgagtcttcgggc

SEQ ID NO: 75262 - DNA, 25 bp, Homo sapien
ggcgtgacactaggggctccaaact

SEQ ID NO: 75263 - DNA, 25 bp, Homo sapien
acgtggttcgtcttcagtggcatcc

SEQ ID NO: 75264 - DNA, 25 bp, Homo sapien
agtggcatccaagcgaccgcaggtg

SEQ ID NO: 75265 - DNA, 25 bp, Homo sapien
tgtcctgtggcgaacacgctgtgtt

SEQ ID NO: 75266 - DNA, 25 bp, Homo sapien
gagccgggcaggtgaacatttttta

SEQ ID NO: 75267 - DNA, 25 bp, Homo sapien
ctactttctgaatggatagcctttc

SEQ ID NO: 75268 - DNA, 25 bp, Homo sapien
gccgtcatttatttcatcccggtta

SEQ ID NO: 75269 - DNA, 25 bp, Homo sapien
attgtcccggcgcatttgcatgtga

SEQ ID NO: 75270 - DNA, 25 bp, Homo sapien
cagcgaactctccttttgggaactc

SEQ ID NO: 75271 - DNA, 25 bp, Homo sapien
cgagaccgatttccagatctgcttg

SEQ ID NO: 75272 - DNA, 25 bp, Homo sapien
gctgggttgcaaatggcttcgttcc

SEQ ID NO: 75273 - DNA, 25 bp, Homo sapien
aggcctaatcgatgcatttttctga

SEQ ID NO: 75274 - DNA, 25 bp, Homo sapien
ccggctcccggattgcaggcctaat

SEQ ID NO: 75275 - DNA, 25 bp, Homo sapien
cgccgctggatagtggcatttaatg

SEQ ID NO: 75276 - DNA, 25 bp, Homo sapien
ttgggaactcctttcgtctatcgcg

SEQ ID NO: 75277 - DNA, 25 bp, Homo sapien
gaaccaaattctgctctcgccggga

SEQ ID NO: 75278 - DNA, 25 bp, Homo sapien
cagggtctcgacttccttggaaaag

SEQ ID NO: 75279 - DNA, 25 bp, Homo sapien
aaggcagccgtacgctgctggaacg

SEQ ID NO: 75280 - DNA, 25 bp, Homo sapien
tgcaaaggcttttagggctacattg

SEQ ID NO: 75281 - DNA, 25 bp, Homo sapien
ggctacattgcaaccctcgggctcg

SEQ ID NO: 75282 - DNA, 25 bp, Homo sapien
tcgggctcgatttcgccctttgggc

SEQ ID NO: 75283 - DNA, 25 bp, Homo sapien
cgtgaaatcgccgttcgtgggccca

SEQ ID NO: 75284 - DNA, 25 bp, Homo sapien
taggaggtatccacccggctcaacc

SEQ ID NO: 75285 - DNA, 25 bp, Homo sapien
gacgacgttaccttcaccagcctga

SEQ ID NO: 75286 - DNA, 25 bp, Homo sapien
tccaaggcgaggaatccgaggtcgc

SEQ ID NO: 75287 - DNA, 25 bp, Homo sapien
aatccaaggcgaggaatccgaggtc

SEQ ID NO: 75288 - DNA, 25 bp, Homo sapien
gcgcaggtagagtcgccgcgggcct

SEQ ID NO: 75289 - DNA, 25 bp, Homo sapien
gcgaggaatccgaggtcgccgtccc

SEQ ID NO: 75290 - DNA, 25 bp, Homo sapien
tcgccgtccccggaacagctggccg

SEQ ID NO: 75291 - DNA, 25 bp, Homo sapien
caggcacccgctggggtattcacgg

SEQ ID NO: 75292 - DNA, 25 bp, Homo sapien
gcacccgctggggtattcacggccg

SEQ ID NO: 75293 - DNA, 25 bp, Homo sapien
cgcaggcacccgctggggtattcac

SEQ ID NO: 75294 - DNA, 25 bp, Homo sapien
aacgcacaagcgaccgagctgcctg

SEQ ID NO: 75295 - DNA, 25 bp, Homo sapien
cacttgactaaggacccacggcctg

SEQ ID NO: 75296 - DNA, 25 bp, Homo sapien
cggccgcttcgcgtcacttgactaa

SEQ ID NO: 75297 - DNA, 25 bp, Homo sapien
gggtcccgcagacttacgcgcaagc

SEQ ID NO: 75298 - DNA, 25 bp, Homo sapien
tctcaacacctcgttacagatgggg

SEQ ID NO: 75299 - DNA, 25 bp, Homo sapien
aggaaatgtttacacgcacctcgtc

SEQ ID NO: 75300 - DNA, 25 bp, Homo sapien
tccgcagagcaccaactgggaaagc

SEQ ID NO: 75301 - DNA, 25 bp, Homo sapien
gggcccagaagcagcagaaccagca

SEQ ID NO: 75302 - DNA, 25 bp, Homo sapien
cctgcagttcgcttacttcaaggca

SEQ ID NO: 75303 - DNA, 25 bp, Homo sapien
ccgtagggccgatgtatataatcta

SEQ ID NO: 75304 - DNA, 25 bp, Homo sapien
tataatctattagggccgcgtcggc

SEQ ID NO: 75305 - DNA, 25 bp, Homo sapien
tccaagtgaatgagcggcagagtcc

SEQ ID NO: 75306 - DNA, 25 bp, Homo sapien
cggcagagtcccatcatgcgcatca

SEQ ID NO: 75307 - DNA, 25 bp, Homo sapien
gcgcatcagcctgcgtgaaccagtg

SEQ ID NO: 75308 - DNA, 25 bp, Homo sapien
gggcgcgcccaatacgaacgctaca

SEQ ID NO: 75309 - DNA, 25 bp, Homo sapien
cgtagattatatagaccgtagggcc

SEQ ID NO: 75310 - DNA, 25 bp, Homo sapien
tgcgtttggggttgcccaggccact

SEQ ID NO: 75311 - DNA, 25 bp, Homo sapien
tccctcggcagtcatggtccgggag

SEQ ID NO: 75312 - DNA, 25 bp, Homo sapien
aggaccgcggctcgttcgttcctct

SEQ ID NO: 75313 - DNA, 25 bp, Homo sapien
gacctacgcgctcggcgctaaggga

SEQ ID NO: 75314 - DNA, 25 bp, Homo sapien
cgctcggctcacgaatcgcaggctt

SEQ ID NO: 75315 - DNA, 25 bp, Homo sapien
gctgggcacctggaaacctcggtgc

SEQ ID NO: 75316 - DNA, 25 bp, Homo sapien
aacctcggtgccaaaaggggctgcg

SEQ ID NO: 75317 - DNA, 25 bp, Homo sapien
tgacgcagtctgacaggcggagccc

SEQ ID NO: 75318 - DNA, 25 bp, Homo sapien
tctaaattacatgtgcgatccggcc

SEQ ID NO: 75319 - DNA, 25 bp, Homo sapien
tgatttcccgacctgtagccagcct

SEQ ID NO: 75320 - DNA, 25 bp, Homo sapien
tcctcggcttggaggacgattcccg

SEQ ID NO: 75321 - DNA, 25 bp, Homo sapien
atgagctcacgcgaaacgaaatcgc

SEQ ID NO: 75322 - DNA, 25 bp, Homo sapien
tgggcgatcagctttccactcctgc

SEQ ID NO: 75323 - DNA, 25 bp, Homo sapien
cgggcaatattttgcaccgtctaaa

SEQ ID NO: 75324 - DNA, 25 bp, Homo sapien
cggttggtttgctccgggcaatatt

SEQ ID NO: 75325 - DNA, 25 bp, Homo sapien
agacctcagcccagggatgagctca

SEQ ID NO: 75326 - DNA, 25 bp, Homo sapien
tcaccaggacaacgggcgtcgccgg

SEQ ID NO: 75327 - DNA, 25 bp, Homo sapien
acgtgctcgccgaccaccaatggcc

SEQ ID NO: 75328 - DNA, 25 bp, Homo sapien
ctggcgtcaccaggacaacgggcgt

SEQ ID NO: 75329 - DNA, 25 bp, Homo sapien
tcgctcgcggctcttcggccatggt

SEQ ID NO: 75330 - DNA, 25 bp, Homo sapien
tcttcggccatggtgagtctgggac

SEQ ID NO: 75331 - DNA, 25 bp, Homo sapien
tctgggacccgcgtctgcctagctg

SEQ ID NO: 75332 - DNA, 25 bp, Homo sapien
gtaacctgggggattcagagcgccc

SEQ ID NO: 75333 - DNA, 25 bp, Homo sapien
cgatgcagcgttccctgccgctgga

SEQ ID NO: 75334 - DNA, 25 bp, Homo sapien
ccctttctggatgtggaccggcgag

SEQ ID NO: 75335 - DNA, 25 bp, Homo sapien
tctcagaccaacagaaggacccggg

SEQ ID NO: 75336 - DNA, 25 bp, Homo sapien
aaggacccgggatccctcagcagct

SEQ ID NO: 75337 - DNA, 25 bp, Homo sapien
cccgcgcgggaatatgaccatgtag

SEQ ID NO: 75338 - DNA, 25 bp, Homo sapien
ccatgtaggagtaacccggggctct

SEQ ID NO: 75339 - DNA, 25 bp, Homo sapien
gggctctcaaggactctacggtttg

SEQ ID NO: 75340 - DNA, 25 bp, Homo sapien
ttgtcacggtttgaacgcaagcgca

SEQ ID NO: 75341 - DNA, 25 bp, Homo sapien
gtcggcctctttctgcccttgggaa

SEQ ID NO: 75342 - DNA, 25 bp, Homo sapien
gagaagagccaagcaaacgccctcc

SEQ ID NO: 75343 - DNA, 25 bp, Homo sapien
ccctgcttctccagtatcgagaaga

SEQ ID NO: 75344 - DNA, 25 bp, Homo sapien
atcgagaagagccaagcaaacgccc

SEQ ID NO: 75345 - DNA, 25 bp, Homo sapien
tccagtatcgagaagagccaagcaa

SEQ ID NO: 75346 - DNA, 25 bp, Homo sapien
agcttcgaaaactcgggcgggctgt

SEQ ID NO: 75347 - DNA, 25 bp, Homo sapien
cgcagcttcgaaaactcgggcgggc

SEQ ID NO: 75348 - DNA, 25 bp, Homo sapien
gggcgtcgcgagtccctgtgtcctc

SEQ ID NO: 75349 - DNA, 25 bp, Homo sapien
gcgggctgttcttaagggcccagcc

SEQ ID NO: 75350 - DNA, 25 bp, Homo sapien
agggagcccagtacctcatgctgta

SEQ ID NO: 75351 - DNA, 25 bp, Homo sapien
agcagccgcatctggcagagactca

SEQ ID NO: 75352 - DNA, 25 bp, Homo sapien
gactccgacttaggttcacgcgccg

SEQ ID NO: 75353 - DNA, 25 bp, Homo sapien
gacgctggcttcaacgcgactccga

SEQ ID NO: 75354 - DNA, 25 bp, Homo sapien
acgacgagcccagcgagcaattgca

SEQ ID NO: 75355 - DNA, 25 bp, Homo sapien
tcgatcacctcgtccatcttgagca

SEQ ID NO: 75356 - DNA, 25 bp, Homo sapien
tcgaagtcgtgcaccagcccggact

SEQ ID NO: 75357 - DNA, 25 bp, Homo sapien
ctgtccagagagtgcaatgcggccc

SEQ ID NO: 75358 - DNA, 25 bp, Homo sapien
aacagctacgctgctcagaaggccc

SEQ ID NO: 75359 - DNA, 25 bp, Homo sapien
tgaagagaacgtcaaggcccgggct

SEQ ID NO: 75360 - DNA, 25 bp, Homo sapien
cgccactgcggccaaaagacagaaa

SEQ ID NO: 75361 - DNA, 25 bp, Homo sapien
gcaggagccagaggctgacttacag

SEQ ID NO: 75362 - DNA, 25 bp, Homo sapien
acttacagagccagtgtgcggatca

SEQ ID NO: 75363 - DNA, 25 bp, Homo sapien
tgcggatcagagttccttaggagcg

SEQ ID NO: 75364 - DNA, 25 bp, Homo sapien
cgggcggaatccttgctgaagagaa

SEQ ID NO: 75365 - DNA, 25 bp, Homo sapien
cagaaggcccgaagggtcttcctca

SEQ ID NO: 75366 - DNA, 25 bp, Homo sapien
agcgcgtcgactgtcttgcctaggc

SEQ ID NO: 75367 - DNA, 25 bp, Homo sapien
aaaccgctgggagcgataggacctc

SEQ ID NO: 75368 - DNA, 25 bp, Homo sapien
ctccagtccggctagcgttttgctg

SEQ ID NO: 75369 - DNA, 25 bp, Homo sapien
tgagcggccaactttcgccgagagc

SEQ ID NO: 75370 - DNA, 25 bp, Homo sapien
cagaagtactccatgctgcggggct

SEQ ID NO: 75371 - DNA, 25 bp, Homo sapien
tccttctgctgcacctgggcgcaga

SEQ ID NO: 75372 - DNA, 25 bp, Homo sapien
cgccaaggtagagcaggagctcctg

SEQ ID NO: 75373 - DNA, 25 bp, Homo sapien
gtcctcctccaggtccgagatggcg

SEQ ID NO: 75374 - DNA, 25 bp, Homo sapien
tctcggtgcagctgaaaaagacctc

SEQ ID NO: 75375 - DNA, 25 bp, Homo sapien
accttcacgtgaccgcggacagctt

SEQ ID NO: 75376 - DNA, 25 bp, Homo sapien
ttctttgctggtgagcaggacccgc

SEQ ID NO: 75377 - DNA, 25 bp, Homo sapien
gccaagccgctggtgaagttcatcc

SEQ ID NO: 75378 - DNA, 25 bp, Homo sapien
ggcgctgatcatggcgacattcatc

SEQ ID NO: 75379 - DNA, 25 bp, Homo sapien
agtctgtcagccagtcagtccgcca

SEQ ID NO: 75380 - DNA, 25 bp, Homo sapien
tgcacgtctgctctagcccttggtc

SEQ ID NO: 75381 - DNA, 25 bp, Homo sapien
ttcaatcctgtaacctgggcggagc

SEQ ID NO: 75382 - DNA, 25 bp, Homo sapien
acccacagacggtcggactgacaga

SEQ ID NO: 75383 - DNA, 25 bp, Homo sapien
ccgagctgctagtcggacccacaga

SEQ ID NO: 75384 - DNA, 25 bp, Homo sapien
cagctttgagagcagagcgcagcaa

SEQ ID NO: 75385 - DNA, 25 bp, Homo sapien
gacggacagaccagcgcacagactg

SEQ ID NO: 75386 - DNA, 25 bp, Homo sapien
tggagccacgtgcaacacgcgcgtt

SEQ ID NO: 75387 - DNA, 25 bp, Homo sapien
ttctgattaatgatgctcacgctgc

SEQ ID NO: 75388 - DNA, 25 bp, Homo sapien
ggcaacgtgccagttttctttctga

SEQ ID NO: 75389 - DNA, 25 bp, Homo sapien
gcgcgtggctcatgcgctttgtctc

SEQ ID NO: 75390 - DNA, 25 bp, Homo sapien
ctgccctcactactccaggcgctgg

SEQ ID NO: 75391 - DNA, 25 bp, Homo sapien
gaagcctcgctgttcctccgggagc

SEQ ID NO: 75392 - DNA, 25 bp, Homo sapien
aggacagaagcctcgctgttcctcc

SEQ ID NO: 75393 - DNA, 25 bp, Homo sapien
cagtcacgactgtgaggtcgccggc

SEQ ID NO: 75394 - DNA, 25 bp, Homo sapien
tgccgagtggcagtcacgactgtga

SEQ ID NO: 75395 - DNA, 25 bp, Homo sapien
gcccgctgccgagtggcagtcacga

SEQ ID NO: 75396 - DNA, 25 bp, Homo sapien
tcctgcgggcgagcagaagcccgct

SEQ ID NO: 75397 - DNA, 25 bp, Homo sapien
ggccacgatgatccctccgagcagc

SEQ ID NO: 75398 - DNA, 25 bp, Homo sapien
ggagtccagcctttctgctctcctt

SEQ ID NO: 75399 - DNA, 25 bp, Homo sapien
aacctggctgcgctgggttttgaac

SEQ ID NO: 75400 - DNA, 25 bp, Homo sapien
gggacttagcaaccgcgcaccagct

SEQ ID NO: 75401 - DNA, 25 bp, Homo sapien
tgcttctccagtgagcgcccaaagg

SEQ ID NO: 75402 - DNA, 25 bp, Homo sapien
cttctccagtgagcgcccaaaggcg

SEQ ID NO: 75403 - DNA, 25 bp, Homo sapien
tctctgcgccggtcccgccatgcgc

SEQ ID NO: 75404 - DNA, 25 bp, Homo sapien
cagcggagtccagcctttctgctct

SEQ ID NO: 75405 - DNA, 25 bp, Homo sapien
agtgagcgcccaaaggcggtcccgc

SEQ ID NO: 75406 - DNA, 25 bp, Homo sapien
gcgagagcccaaaaactgtcacgtg

SEQ ID NO: 75407 - DNA, 25 bp, Homo sapien
gagtgcttcgaaccctttaccagga

SEQ ID NO: 75408 - DNA, 25 bp, Homo sapien
cggccgcctttgaataaacgagtgc

SEQ ID NO: 75409 - DNA, 25 bp, Homo sapien
tcgggcatgcgagaattcggctttc

SEQ ID NO: 75410 - DNA, 25 bp, Homo sapien
tcatcgcgttcaaaaggggcgtttc

SEQ ID NO: 75411 - DNA, 25 bp, Homo sapien
gtttccacgtagttgcgagagccca

SEQ ID NO: 75412 - DNA, 25 bp, Homo sapien
tgcagccgcagacctattccaagtt

SEQ ID NO: 75413 - DNA, 25 bp, Homo sapien
cggtgtctcccgtcatgcaagcaaa

SEQ ID NO: 75414 - DNA, 25 bp, Homo sapien
ccagcggccagctaatgctatcaaa

SEQ ID NO: 75415 - DNA, 25 bp, Homo sapien
ggctacgacttaacgggccgcgtca

SEQ ID NO: 75416 - DNA, 25 bp, Homo sapien
ccgggctcacttaagggctacgact

SEQ ID NO: 75417 - DNA, 25 bp, Homo sapien
gaggctccaccaccaaataacgctg

SEQ ID NO: 75418 - DNA, 25 bp, Homo sapien
aaggcacttccgttgagcatctaga

SEQ ID NO: 75419 - DNA, 25 bp, Homo sapien
ggttccggcatctctgctcctattg

SEQ ID NO: 75420 - DNA, 25 bp, Homo sapien
gcgcaagcgcatatccttctaggta

SEQ ID NO: 75421 - DNA, 25 bp, Homo sapien
ttctggcgccaaaatgtcgttcgtg

SEQ ID NO: 75422 - DNA, 25 bp, Homo sapien
ccgcggccatgctgacgtcagggca

SEQ ID NO: 75423 - DNA, 25 bp, Homo sapien
cagctccgctcgctgccacagtgca

SEQ ID NO: 75424 - DNA, 25 bp, Homo sapien
ccacagtgcagagacctccctgagg

SEQ ID NO: 75425 - DNA, 25 bp, Homo sapien
gttttagagggagtcccgctctcca

SEQ ID NO: 75426 - DNA, 25 bp, Homo sapien
ccgctcgagggatagaagggagctg

SEQ ID NO: 75427 - DNA, 25 bp, Homo sapien
ctctccaattaaagcggcccagctg

SEQ ID NO: 75428 - DNA, 25 bp, Homo sapien
aggcccgcgaacttggccattcagc

SEQ ID NO: 75429 - DNA, 25 bp, Homo sapien
gggagtcccgctctccaattaaagc

SEQ ID NO: 75430 - DNA, 25 bp, Homo sapien
tgtcggccgcattctttcgtactcc

SEQ ID NO: 75431 - DNA, 25 bp, Homo sapien
tccgaaggtgctcccagaagaccta

SEQ ID NO: 75432 - DNA, 25 bp, Homo sapien
ctctagactttgttgcggtccagcc

SEQ ID NO: 75433 - DNA, 25 bp, Homo sapien
agaaggtccacttcccactgcgaag

SEQ ID NO: 75434 - DNA, 25 bp, Homo sapien
cgcccggctgaaccacaagttagtc

SEQ ID NO: 75435 - DNA, 25 bp, Homo sapien
agcccgcgttctagctcagtgagaa

SEQ ID NO: 75436 - DNA, 25 bp, Homo sapien
tcacacgctgggagctttacgcgct

SEQ ID NO: 75437 - DNA, 25 bp, Homo sapien
gtactccgcgtctttctgagaaacg

SEQ ID NO: 75438 - DNA, 25 bp, Homo sapien
aggcatcctttctggttgtcacagc

SEQ ID NO: 75439 - DNA, 25 bp, Homo sapien
ggccttgggcaccacagagcctctt

SEQ ID NO: 75440 - DNA, 25 bp, Homo sapien
agagcctcttcgtcttttcccgcgg

SEQ ID NO: 75441 - DNA, 25 bp, Homo sapien
cgcgggctttcgctggaagtagaaa

SEQ ID NO: 75442 - DNA, 25 bp, Homo sapien
ggagacctgtctgaatattgcaata

SEQ ID NO: 75443 - DNA, 25 bp, Homo sapien
ctgctgttgttgcttgaagaccaca

SEQ ID NO: 75444 - DNA, 25 bp, Homo sapien
tgagagttttctccacggatgttgc

SEQ ID NO: 75445 - DNA, 25 bp, Homo sapien
tgcgtggaaacttctccggcccaac

SEQ ID NO: 75446 - DNA, 25 bp, Homo sapien
tctgtccgaactggaggcgagtatc

SEQ ID NO: 75447 - DNA, 25 bp, Homo sapien
ttaattgcggctaccaacacgcccg

SEQ ID NO: 75448 - DNA, 25 bp, Homo sapien
cgagacaactcgcaggtcgccattt

SEQ ID NO: 75449 - DNA, 25 bp, Homo sapien
caagactcaagtccgctgtgcatga

SEQ ID NO: 75450 - DNA, 25 bp, Homo sapien
cggttgccagaggtgtgtacaaaac

SEQ ID NO: 75451 - DNA, 25 bp, Homo sapien
ggctgcttcccatgtgtcaatattt

SEQ ID NO: 75452 - DNA, 25 bp, Homo sapien
tttgcctcggaaagaagcagccgta

SEQ ID NO: 75453 - DNA, 25 bp, Homo sapien
agcgaccgagtggattagcaccttc

SEQ ID NO: 75454 - DNA, 25 bp, Homo sapien
aacggagggacagctgcccaattta

SEQ ID NO: 75455 - DNA, 25 bp, Homo sapien
ctcgtcctgggacagaaccgtagtg

SEQ ID NO: 75456 - DNA, 25 bp, Homo sapien
agaaccgtagtgtggcgtctaagga

SEQ ID NO: 75457 - DNA, 25 bp, Homo sapien
cagctggacgactcagtcctgggtc

SEQ ID NO: 75458 - DNA, 25 bp, Homo sapien
gcccaatttaatttctcccacagtg

SEQ ID NO: 75459 - DNA, 25 bp, Homo sapien
cctgttccgccattgcgagccgtta

SEQ ID NO: 75460 - DNA, 25 bp, Homo sapien
ttaaacccgcgcgatccagctcagg

SEQ ID NO: 75461 - DNA, 25 bp, Homo sapien
cccttacctgtgttagggcgcgcgc

SEQ ID NO: 75462 - DNA, 25 bp, Homo sapien
aaccttgcgtcctccagtgcagcga

SEQ ID NO: 75463 - DNA, 25 bp, Homo sapien
tgtcccatccggtgctccgtagtta

SEQ ID NO: 75464 - DNA, 25 bp, Homo sapien
ccgtagttagcctctgtgagctcca

SEQ ID NO: 75465 - DNA, 25 bp, Homo sapien
gcgcacagttcacctgctgccgttg

SEQ ID NO: 75466 - DNA, 25 bp, Homo sapien
tccctggtgtaaagaagtcgccgta

SEQ ID NO: 75467 - DNA, 25 bp, Homo sapien
gcccttcaggtttcgttgacactca

SEQ ID NO: 75468 - DNA, 25 bp, Homo sapien
cgtacgctgcgccatgttcaagaaa

SEQ ID NO: 75469 - DNA, 25 bp, Homo sapien
ggtctccgcacgcaacgaaatcagg

SEQ ID NO: 75470 - DNA, 25 bp, Homo sapien
cgacaacacgcgctggtgagtgccc

SEQ ID NO: 75471 - DNA, 25 bp, Homo sapien
ctctctgaatcgaaaagtaacttgg

SEQ ID NO: 75472 - DNA, 25 bp, Homo sapien
tctggagcatttccacgacaacacg

SEQ ID NO: 75473 - DNA, 25 bp, Homo sapien
cgctgactcgttcttcggctacgca

SEQ ID NO: 75474 - DNA, 25 bp, Homo sapien
gatttaaatgtctccgttgcgcgcg

SEQ ID NO: 75475 - DNA, 25 bp, Homo sapien
agagccgctagagttgtctcctccg

SEQ ID NO: 75476 - DNA, 25 bp, Homo sapien
gtaacttggctcctctgcctccggg

SEQ ID NO: 75477 - DNA, 25 bp, Homo sapien
tcgttcttcggctacgcagttctgg

SEQ ID NO: 75478 - DNA, 25 bp, Homo sapien
ggccgtctgggtgtcactaccgctc

SEQ ID NO: 75479 - DNA, 25 bp, Homo sapien
agcatccgaacaacctgagcctctg

SEQ ID NO: 75480 - DNA, 25 bp, Homo sapien
ggtccgcagactccctctctgcaca

SEQ ID NO: 75481 - DNA, 25 bp, Homo sapien
cggtctccatcacagcagcgccgcg

SEQ ID NO: 75482 - DNA, 25 bp, Homo sapien
tgggtgtcactaccgctcctgggca

SEQ ID NO: 75483 - DNA, 25 bp, Homo sapien
tcgcggtaaatatccctcctcgggc

SEQ ID NO: 75484 - DNA, 25 bp, Homo sapien
tgcacccttccgaatccttccagtg

SEQ ID NO: 75485 - DNA, 25 bp, Homo sapien
cgcccagcaccttcccgagacaccc

SEQ ID NO: 75486 - DNA, 25 bp, Homo sapien
acgagtccgactgcttctgcagcta

SEQ ID NO: 75487 - DNA, 25 bp, Homo sapien
ggcgtccagcgacctgcactactgg

SEQ ID NO: 75488 - DNA, 25 bp, Homo sapien
acctgcactactgggtcgggaagca

SEQ ID NO: 75489 - DNA, 25 bp, Homo sapien
cagggccacgagtccgactgcttct

SEQ ID NO: 75490 - DNA, 25 bp, Homo sapien
gtccgactgcttctgcagctacttc

SEQ ID NO: 75491 - DNA, 25 bp, Homo sapien
cttccgcccgggaatcatgtgagtg

SEQ ID NO: 75492 - DNA, 25 bp, Homo sapien
ttccagcagcgcctacaggacgagc

SEQ ID NO: 75493 - DNA, 25 bp, Homo sapien
atatacacaaacacccggaccctag

SEQ ID NO: 75494 - DNA, 25 bp, Homo sapien
aagcggcgcaggaaccagaagctcg

SEQ ID NO: 75495 - DNA, 25 bp, Homo sapien
aacgcttcttggagctcggctgtcc

SEQ ID NO: 75496 - DNA, 25 bp, Homo sapien
agtggactctcagggtcgcaggact

SEQ ID NO: 75497 - DNA, 25 bp, Homo sapien
tcgcaggactgacgatgccttccgc

SEQ ID NO: 75498 - DNA, 25 bp, Homo sapien
gctacccgacctacaccaacgtgga

SEQ ID NO: 75499 - DNA, 25 bp, Homo sapien
agtcggccgcgttcaagcagctctt

SEQ ID NO: 75500 - DNA, 25 bp, Homo sapien
tcaagcagctcttccggacttggtc

SEQ ID NO: 75501 - DNA, 25 bp, Homo sapien
ggttaattaacgcttcttggagctc

SEQ ID NO: 75502 - DNA, 25 bp, Homo sapien
catccaagaggggtgggactaacga

SEQ ID NO: 75503 - DNA, 25 bp, Homo sapien
cgggacgagaagaaaatctgggcta

SEQ ID NO: 75504 - DNA, 25 bp, Homo sapien
ggcggagtgggacaaatccataacc

SEQ ID NO: 75505 - DNA, 25 bp, Homo sapien
ggaagcaaatctgtgtcgaagcctg

SEQ ID NO: 75506 - DNA, 25 bp, Homo sapien
gaggcagagccatacccaggaagca

SEQ ID NO: 75507 - DNA, 25 bp, Homo sapien
atcccgcactggaagggcggtgtcc

SEQ ID NO: 75508 - DNA, 25 bp, Homo sapien
cagtgccgcctccagtgttttatgc

SEQ ID NO: 75509 - DNA, 25 bp, Homo sapien
attgagcgccgccaccttaaggctc

SEQ ID NO: 75510 - DNA, 25 bp, Homo sapien
gactcacttgagtagcgacagcacc

SEQ ID NO: 75511 - DNA, 25 bp, Homo sapien
tggatgctgtttccttccttcgccg

SEQ ID NO: 75512 - DNA, 25 bp, Homo sapien
ggagcccagactttcatgaccagga

SEQ ID NO: 75513 - DNA, 25 bp, Homo sapien
actcaccgtgcagggtcaggaagtc

SEQ ID NO: 75514 - DNA, 25 bp, Homo sapien
tcatcccggggaagggatcgtgtaa

SEQ ID NO: 75515 - DNA, 25 bp, Homo sapien
cccgaccagaaatagccagattcct

SEQ ID NO: 75516 - DNA, 25 bp, Homo sapien
tgctggaaagaatccggcgtcatcc

SEQ ID NO: 75517 - DNA, 25 bp, Homo sapien
ggctgagattttcccagtccggaga

SEQ ID NO: 75518 - DNA, 25 bp, Homo sapien
tgaggccttccactacagcttcgca

SEQ ID NO: 75519 - DNA, 25 bp, Homo sapien
ccaggagctccaaaacgcggaggtc

SEQ ID NO: 75520 - DNA, 25 bp, Homo sapien
ttagcgtcccggaccaacgagtgcc

SEQ ID NO: 75521 - DNA, 25 bp, Homo sapien
gcgcacccaagatatctcgcacttg

SEQ ID NO: 75522 - DNA, 25 bp, Homo sapien
ttccgcaacttgtactcagccgagg

SEQ ID NO: 75523 - DNA, 25 bp, Homo sapien
aagcttgatcaaggcccgcggcagc

SEQ ID NO: 75524 - DNA, 25 bp, Homo sapien
ttcgtggaccagctgcagcaggtaa

SEQ ID NO: 75525 - DNA, 25 bp, Homo sapien
tcggcgacgaagtgagcgcaagctt

SEQ ID NO: 75526 - DNA, 25 bp, Homo sapien
agacgcgagcgaccctccaaaagtc

SEQ ID NO: 75527 - DNA, 25 bp, Homo sapien
gtggttcgctcaccgacacagatgt

SEQ ID NO: 75528 - DNA, 25 bp, Homo sapien
ttcacgtccttgagaaccgcggtca

SEQ ID NO: 75529 - DNA, 25 bp, Homo sapien
tcatgactgccgagagaagctcgtc

SEQ ID NO: 75530 - DNA, 25 bp, Homo sapien
ccggcgtccaggataaccaaacata

SEQ ID NO: 75531 - DNA, 25 bp, Homo sapien
ctctgcattgcgcaggtcaaccctg

SEQ ID NO: 75532 - DNA, 25 bp, Homo sapien
ctgaccgcggagttaacagacagcc

SEQ ID NO: 75533 - DNA, 25 bp, Homo sapien
tgcagaccagccaccagtccgggaa

SEQ ID NO: 75534 - DNA, 25 bp, Homo sapien
tacgagggaccgtttctgctgggtc

SEQ ID NO: 75535 - DNA, 25 bp, Homo sapien
gcttcttggcgctgcgggtcgcctc

SEQ ID NO: 75536 - DNA, 25 bp, Homo sapien
gggatccggtgctcactgaggacct

SEQ ID NO: 75537 - DNA, 25 bp, Homo sapien
caagtcggtgccgtcggcgaagacc

SEQ ID NO: 75538 - DNA, 25 bp, Homo sapien
ccaccctggtctccggcgactgacc

SEQ ID NO: 75539 - DNA, 25 bp, Homo sapien
ttctggagccgacagtcctccaggc

SEQ ID NO: 75540 - DNA, 25 bp, Homo sapien
cacccgaactcggtgttctttctgg

SEQ ID NO: 75541 - DNA, 25 bp, Homo sapien
ggtgttctttctggagccgacagtc

SEQ ID NO: 75542 - DNA, 25 bp, Homo sapien
tcctccgactggttcgggctactgc

SEQ ID NO: 75543 - DNA, 25 bp, Homo sapien
tgcgggaagccttcaagtcagctcc

SEQ ID NO: 75544 - DNA, 25 bp, Homo sapien
aaataagtttgttgcgctgcgaggc

SEQ ID NO: 75545 - DNA, 25 bp, Homo sapien
ccttctcagccggaaaataagtttg

SEQ ID NO: 75546 - DNA, 25 bp, Homo sapien
cggcggggcttttcttctgacagcc

SEQ ID NO: 75547 - DNA, 25 bp, Homo sapien
tgcctgctcttagggaaggtacctg

SEQ ID NO: 75548 - DNA, 25 bp, Homo sapien
tcgacgccaggattggctgcaagta

SEQ ID NO: 75549 - DNA, 25 bp, Homo sapien
agcctgttgggtggcattcgtttcc

SEQ ID NO: 75550 - DNA, 25 bp, Homo sapien
ggagaccgccgcgtttctcttccga

SEQ ID NO: 75551 - DNA, 25 bp, Homo sapien
gggagggtcaaaatcagcaacgttc

SEQ ID NO: 75552 - DNA, 25 bp, Homo sapien
gcttcggtggaaacccggttctgca

SEQ ID NO: 75553 - DNA, 25 bp, Homo sapien
ccagttcctcgggatgttcagcggc

SEQ ID NO: 75554 - DNA, 25 bp, Homo sapien
ccactgcaaatgagcgggaatcctc

SEQ ID NO: 75555 - DNA, 25 bp, Homo sapien
gcgtgcttgtcccattcccaggaac

SEQ ID NO: 75556 - DNA, 25 bp, Homo sapien
cggcgatgcttaggtgcttcatgaa

SEQ ID NO: 75557 - DNA, 25 bp, Homo sapien
ggtacctcctctgagccactgcaaa

SEQ ID NO: 75558 - DNA, 25 bp, Homo sapien
catgcgggtcccgttccttcttaat

SEQ ID NO: 75559 - DNA, 25 bp, Homo sapien
tccgcacttttgctcggggctccag

SEQ ID NO: 75560 - DNA, 25 bp, Homo sapien
cccgcctcgagacctcaagggtaga

SEQ ID NO: 75561 - DNA, 25 bp, Homo sapien
gctgctctcaacatgcgagtgcggc

SEQ ID NO: 75562 - DNA, 25 bp, Homo sapien
ctctgttcttgaacgtgcggacaca

SEQ ID NO: 75563 - DNA, 25 bp, Homo sapien
gccgactgctcgagctgcttaccaa

SEQ ID NO: 75564 - DNA, 25 bp, Homo sapien
ctcagcatcctgtctcccatggaga

SEQ ID NO: 75565 - DNA, 25 bp, Homo sapien
gtggacctctccagatctcaaaagg

SEQ ID NO: 75566 - DNA, 25 bp, Homo sapien
cctaacacggagaagcgcgctaaga

SEQ ID NO: 75567 - DNA, 25 bp, Homo sapien
gaggctctcctacggcttttcgatg

SEQ ID NO: 75568 - DNA, 25 bp, Homo sapien
gatgccttcgatgaacctctaccta

SEQ ID NO: 75569 - DNA, 25 bp, Homo sapien
ccttctcgggtttctagcttgctca

SEQ ID NO: 75570 - DNA, 25 bp, Homo sapien
cctggtccatcaacagggacgatta

SEQ ID NO: 75571 - DNA, 25 bp, Homo sapien
gggagcgcagccctcataggaattc

SEQ ID NO: 75572 - DNA, 25 bp, Homo sapien
cctggaggcgggaccaatttatgac

SEQ ID NO: 75573 - DNA, 25 bp, Homo sapien
tggctactgcctctgtgctacttga

SEQ ID NO: 75574 - DNA, 25 bp, Homo sapien
gacggacgcgcagccttacccgaaa

SEQ ID NO: 75575 - DNA, 25 bp, Homo sapien
ttctgggcacccagtgacggggatc

SEQ ID NO: 75576 - DNA, 25 bp, Homo sapien
aatgccacccgctcgcaagatgcgg

SEQ ID NO: 75577 - DNA, 25 bp, Homo sapien
gctgtcacccggacgcgggaaaaca

SEQ ID NO: 75578 - DNA, 25 bp, Homo sapien
cagcaggtacagtcgcctggccgca

SEQ ID NO: 75579 - DNA, 25 bp, Homo sapien
gggacttcagcacgcagcaggtaca

SEQ ID NO: 75580 - DNA, 25 bp, Homo sapien
cgtcgattgcacaggacgcggtccc

SEQ ID NO: 75581 - DNA, 25 bp, Homo sapien
gccttacccgaaaggccatggcgga

SEQ ID NO: 75582 - DNA, 25 bp, Homo sapien
gtcactaagtgtagcgaagcgaagg

SEQ ID NO: 75583 - DNA, 25 bp, Homo sapien
gaccgctttgtttgggcacttggga

SEQ ID NO: 75584 - DNA, 25 bp, Homo sapien
gcgccgcgcggtgtttaccaacaaa

SEQ ID NO: 75585 - DNA, 25 bp, Homo sapien
cgatcttgtctgtgcagtcatctgc

SEQ ID NO: 75586 - DNA, 25 bp, Homo sapien
ggttgcatgtccctcagagtcacta

SEQ ID NO: 75587 - DNA, 25 bp, Homo sapien
ggggcggcttcacgcagcccaaagt

SEQ ID NO: 75588 - DNA, 25 bp, Homo sapien
ttgccaccagtctgcgtcgcgttac

SEQ ID NO: 75589 - DNA, 25 bp, Homo sapien
gtcatctgcgggattctggttccta

SEQ ID NO: 75590 - DNA, 25 bp, Homo sapien
cgggcatcttcgttttctgcacaga

SEQ ID NO: 75591 - DNA, 25 bp, Homo sapien
tagcctggcccttggtttctgacct

SEQ ID NO: 75592 - DNA, 25 bp, Homo sapien
cctacctggagtgtgaatggcagtc

SEQ ID NO: 75593 - DNA, 25 bp, Homo sapien
cggccctgcagttcttccggagtca

SEQ ID NO: 75594 - DNA, 25 bp, Homo sapien
tctgacctttattctcccggctcgg

SEQ ID NO: 75595 - DNA, 25 bp, Homo sapien
ggctatcaagagtatcgcttcccgc

SEQ ID NO: 75596 - DNA, 25 bp, Homo sapien
tacctcgggcaagatggctatcaag

SEQ ID NO: 75597 - DNA, 25 bp, Homo sapien
taggcatcccggtttgtcaccaggg

SEQ ID NO: 75598 - DNA, 25 bp, Homo sapien
agtcgccgctctgaccttggggtct

SEQ ID NO: 75599 - DNA, 25 bp, Homo sapien
aaccacattcatggcgcgcctagtc

SEQ ID NO: 75600 - DNA, 25 bp, Homo sapien
ccgctctctggaaccacattcatgg

SEQ ID NO: 75601 - DNA, 25 bp, Homo sapien
atctcgtcccacagagaggacagcc

SEQ ID NO: 75602 - DNA, 25 bp, Homo sapien
cgcacggtgtttagagacgtctccc

SEQ ID NO: 75603 - DNA, 25 bp, Homo sapien
gcagagatctcgtcccacagagagg

SEQ ID NO: 75604 - DNA, 25 bp, Homo sapien
gagcgatccctgcatcctacgggcg

SEQ ID NO: 75605 - DNA, 25 bp, Homo sapien
cagacagacataggcgggggtacac

SEQ ID NO: 75606 - DNA, 25 bp, Homo sapien
cgggcccactccagctagaaggtgc

SEQ ID NO: 75607 - DNA, 25 bp, Homo sapien
cgctctgagccacctccggaagtga

SEQ ID NO: 75608 - DNA, 25 bp, Homo sapien
cggaagtgacgtcggagtgtcaaca

SEQ ID NO: 75609 - DNA, 25 bp, Homo sapien
agtgtcaacatgcaagatggcggcc

SEQ ID NO: 75610 - DNA, 25 bp, Homo sapien
atggcggcccatcaccggcagaaca

SEQ ID NO: 75611 - DNA, 25 bp, Homo sapien
cgggattgcttgtcgccgctcttct

SEQ ID NO: 75612 - DNA, 25 bp, Homo sapien
tgtctttcttcgaagcgctctgccc

SEQ ID NO: 75613 - DNA, 25 bp, Homo sapien
ccgctcttctgtaggagtggacttg

SEQ ID NO: 75614 - DNA, 25 bp, Homo sapien
ttacgaccctacgactggcaggacg

SEQ ID NO: 75615 - DNA, 25 bp, Homo sapien
ccgactggtagtggtgcattcttca

SEQ ID NO: 75616 - DNA, 25 bp, Homo sapien
cgattcctgcgccttgtgacgtgag

SEQ ID NO: 75617 - DNA, 25 bp, Homo sapien
aggcgttttgttcctcccactccag

SEQ ID NO: 75618 - DNA, 25 bp, Homo sapien
gcagctcggtttccaaggactgtaa

SEQ ID NO: 75619 - DNA, 25 bp, Homo sapien
cggcccgagatgagcagcaatgact

SEQ ID NO: 75620 - DNA, 25 bp, Homo sapien
aatgactcctcccttatggtgcgtg

SEQ ID NO: 75621 - DNA, 25 bp, Homo sapien
actatcccgtggctggtttgcaccg

SEQ ID NO: 75622 - DNA, 25 bp, Homo sapien
cccaggaaactagtcttgccgagtg

SEQ ID NO: 75623 - DNA, 25 bp, Homo sapien
tcctgtatggcgtagagtcgatccc

SEQ ID NO: 75624 - DNA, 25 bp, Homo sapien
ccgccgtcctgtatggcgtagagtc

SEQ ID NO: 75625 - DNA, 25 bp, Homo sapien
ttggcccggcctgtgactgctctag

SEQ ID NO: 75626 - DNA, 25 bp, Homo sapien
ctgcgccgactagttttccggccgg

SEQ ID NO: 75627 - DNA, 25 bp, Homo sapien
cagctctgcgccgactagttttccg

SEQ ID NO: 75628 - DNA, 25 bp, Homo sapien
actttccttaatatccacgccagcg

SEQ ID NO: 75629 - DNA, 25 bp, Homo sapien
actagtcttgccgagtgcgctcctc

SEQ ID NO: 75630 - DNA, 25 bp, Homo sapien
agccaccacggctgggcacactggt

SEQ ID NO: 75631 - DNA, 25 bp, Homo sapien
acgggcttgctcctgcgcaaactca

SEQ ID NO: 75632 - DNA, 25 bp, Homo sapien
ccaaagagaagcgacggcaagcact

SEQ ID NO: 75633 - DNA, 25 bp, Homo sapien
aagcactgtggcgaagggccatacc

SEQ ID NO: 75634 - DNA, 25 bp, Homo sapien
aagggccatacccagagtacagcca

SEQ ID NO: 75635 - DNA, 25 bp, Homo sapien
gtgatcccatcaaaggctacacggc

SEQ ID NO: 75636 - DNA, 25 bp, Homo sapien
ggaagtagaagacggtgatcccatc

SEQ ID NO: 75637 - DNA, 25 bp, Homo sapien
gcacactggtgaagccctggcagcg

SEQ ID NO: 75638 - DNA, 25 bp, Homo sapien
cgtcagtggaaaactccggggctca

SEQ ID NO: 75639 - DNA, 25 bp, Homo sapien
ttctcaggcaactgggtcaaaagga

SEQ ID NO: 75640 - DNA, 25 bp, Homo sapien
aatccggacgctcgcggaggacaac

SEQ ID NO: 75641 - DNA, 25 bp, Homo sapien
aggtgagcctacgacacaatccctc

SEQ ID NO: 75642 - DNA, 25 bp, Homo sapien
ctctgagagtgacggcgactgacaa

SEQ ID NO: 75643 - DNA, 25 bp, Homo sapien
cgtgactcacagcagtggcctctga

SEQ ID NO: 75644 - DNA, 25 bp, Homo sapien
aggcgacaaatgtcacctgctccgg

SEQ ID NO: 75645 - DNA, 25 bp, Homo sapien
gagccgtgacttctctcggggttac

SEQ ID NO: 75646 - DNA, 25 bp, Homo sapien
gccaccgagactcggccagggagtc

SEQ ID NO: 75647 - DNA, 25 bp, Homo sapien
gcttaagggcttgtactgcgcatgc

SEQ ID NO: 75648 - DNA, 25 bp, Homo sapien
catcctcctcaaagggagggacctc

SEQ ID NO: 75649 - DNA, 25 bp, Homo sapien
gcagagccggatacccgggcccagt

SEQ ID NO: 75650 - DNA, 25 bp, Homo sapien
ccagggagtccatggtcgctcccga

SEQ ID NO: 75651 - DNA, 25 bp, Homo sapien
agcactcaccttcatgactgccagg

SEQ ID NO: 75652 - DNA, 25 bp, Homo sapien
tctccttaaggcgaggacatcctcc

SEQ ID NO: 75653 - DNA, 25 bp, Homo sapien
gcctcatcctttctccttaaggcga

SEQ ID NO: 75654 - DNA, 25 bp, Homo sapien
cgtctggaatccgaagggagcctca

SEQ ID NO: 75655 - DNA, 25 bp, Homo sapien
gcccgaacgttctgaactcggcggc

SEQ ID NO: 75656 - DNA, 25 bp, Homo sapien
ttagtcctcatcgtcaccttggcga

SEQ ID NO: 75657 - DNA, 25 bp, Homo sapien
tgggaacacgccctgcgggctccgg

SEQ ID NO: 75658 - DNA, 25 bp, Homo sapien
gtctggtcgccacgcgctccgcctc

SEQ ID NO: 75659 - DNA, 25 bp, Homo sapien
aatccgaagggagcctcagcgagag

SEQ ID NO: 75660 - DNA, 25 bp, Homo sapien
gccagtccctggctgcacgcctgcc

SEQ ID NO: 75661 - DNA, 25 bp, Homo sapien
catcgtcaccttggcgacggccggt

SEQ ID NO: 75662 - DNA, 25 bp, Homo sapien
gaacctcatctcctacggtgctgaa

SEQ ID NO: 75663 - DNA, 25 bp, Homo sapien
gaactcacgtccgtcgctgctgcaa

SEQ ID NO: 75664 - DNA, 25 bp, Homo sapien
ctccggcgttcgattggtcatcgtg

SEQ ID NO: 75665 - DNA, 25 bp, Homo sapien
ctgacgctgagaagccgttgatgcc

SEQ ID NO: 75666 - DNA, 25 bp, Homo sapien
cgttgctaaggctcggctacccttt

SEQ ID NO: 75667 - DNA, 25 bp, Homo sapien
tcgcgggcctcatctccaatgattc

SEQ ID NO: 75668 - DNA, 25 bp, Homo sapien
cgtaattcccgcagcaagattgttc

SEQ ID NO: 75669 - DNA, 25 bp, Homo sapien
ccgggcagatttgggacggtcacaa

SEQ ID NO: 75670 - DNA, 25 bp, Homo sapien
cctgtgttgctatcccttcggagtc

SEQ ID NO: 75671 - DNA, 25 bp, Homo sapien
tgctacctgcagaggggtccatacg

SEQ ID NO: 75672 - DNA, 25 bp, Homo sapien
gctcgactttctttgccattggctg

SEQ ID NO: 75673 - DNA, 25 bp, Homo sapien
taggcccaggcgctgatttacacca

SEQ ID NO: 75674 - DNA, 25 bp, Homo sapien
tccgcgctctggacaggaattatgc

SEQ ID NO: 75675 - DNA, 25 bp, Homo sapien
ccgcctggctgactaacttgagttc

SEQ ID NO: 75676 - DNA, 25 bp, Homo sapien
cgctcatattcgcaggtacaagggc

SEQ ID NO: 75677 - DNA, 25 bp, Homo sapien
ccattggctgacaacggagtacata

SEQ ID NO: 75678 - DNA, 25 bp, Homo sapien
tcggctccgggttaggctccgacac

SEQ ID NO: 75679 - DNA, 25 bp, Homo sapien
gtcagagcgccagccaagccacggt

SEQ ID NO: 75680 - DNA, 25 bp, Homo sapien
agaggcccaagcaacagccagctgc

SEQ ID NO: 75681 - DNA, 25 bp, Homo sapien
ttcttttggccctctcagaaccagc

SEQ ID NO: 75682 - DNA, 25 bp, Homo sapien
tccagcttcttttggccctctcaga

SEQ ID NO: 75683 - DNA, 25 bp, Homo sapien
tgccagcgtcgcttaagcagcagag

SEQ ID NO: 75684 - DNA, 25 bp, Homo sapien
ggagcagggccttcctacctgtttc

SEQ ID NO: 75685 - DNA, 25 bp, Homo sapien
tccgacaccggaaggcactccaggg

SEQ ID NO: 75686 - DNA, 25 bp, Homo sapien
gcgggacgcctcaaaccatccgtta

SEQ ID NO: 75687 - DNA, 25 bp, Homo sapien
agcccagctttagcgcgcagaccga

SEQ ID NO: 75688 - DNA, 25 bp, Homo sapien
agcctctaatccacgcggcgcgttg

SEQ ID NO: 75689 - DNA, 25 bp, Homo sapien
ttccgatcccggatggccacgtagt

SEQ ID NO: 75690 - DNA, 25 bp, Homo sapien
ttgaacttgctcagggatcatcgcg

SEQ ID NO: 75691 - DNA, 25 bp, Homo sapien
atcgcggagccagaatcgcctcttt

SEQ ID NO: 75692 - DNA, 25 bp, Homo sapien
tctgcgtttccctcgcgttttccga

SEQ ID NO: 75693 - DNA, 25 bp, Homo sapien
gcggttcaccgcgtacctactgtgc

SEQ ID NO: 75694 - DNA, 25 bp, Homo sapien
accggcctcacactagtatcgcatg

SEQ ID NO: 75695 - DNA, 25 bp, Homo sapien
ggcgatcctatttcgtggactccta

SEQ ID NO: 75696 - DNA, 25 bp, Homo sapien
catcggccattttgtgcgagaagcc

SEQ ID NO: 75697 - DNA, 25 bp, Homo sapien
cgggcgcggctaaatagtctccatc

SEQ ID NO: 75698 - DNA, 25 bp, Homo sapien
actccgtgacgggaattgcggtctc

SEQ ID NO: 75699 - DNA, 25 bp, Homo sapien
cgcttgaacacttcgcgggtcttcc

SEQ ID NO: 75700 - DNA, 25 bp, Homo sapien
gagagacgcttgagtcccttgactg

SEQ ID NO: 75701 - DNA, 25 bp, Homo sapien
tggactcctagatcggccctgctac

SEQ ID NO: 75702 - DNA, 25 bp, Homo sapien
agcgctagtcgccttctccgaatcg

SEQ ID NO: 75703 - DNA, 25 bp, Homo sapien
agcctgcatggatccgcagatgtgc

SEQ ID NO: 75704 - DNA, 25 bp, Homo sapien
gcgcttagatgcctgcggctatgca

SEQ ID NO: 75705 - DNA, 25 bp, Homo sapien
tgagctgacacctccttagcgctgg

SEQ ID NO: 75706 - DNA, 25 bp, Homo sapien
ggcgcgtctttaccgacagcctgca

SEQ ID NO: 75707 - DNA, 25 bp, Homo sapien
gtggtccctgtcatgcccacgacgg

SEQ ID NO: 75708 - DNA, 25 bp, Homo sapien
caaaatcggatttcctcagagggcc

SEQ ID NO: 75709 - DNA, 25 bp, Homo sapien
tcggctccgcacaggtaagatcagg

SEQ ID NO: 75710 - DNA, 25 bp, Homo sapien
gccacactggctcgcattgcgggaa

SEQ ID NO: 75711 - DNA, 25 bp, Homo sapien
taggccttcctagctggccagtttc

SEQ ID NO: 75712 - DNA, 25 bp, Homo sapien
tgtaccaaccctaggccgccgagag

SEQ ID NO: 75713 - DNA, 25 bp, Homo sapien
ccaggccattaagtgtgcgcaaatc

SEQ ID NO: 75714 - DNA, 25 bp, Homo sapien
ctgcctgtcaataaagggcgcgttc

SEQ ID NO: 75715 - DNA, 25 bp, Homo sapien
tcgacctcggagcactctggagacc

SEQ ID NO: 75716 - DNA, 25 bp, Homo sapien
tggagaccctaccagaaatctagtg

SEQ ID NO: 75717 - DNA, 25 bp, Homo sapien
cgctgcctcagctggattcttggag

SEQ ID NO: 75718 - DNA, 25 bp, Homo sapien
ctccctctccgtgattggacgagca

SEQ ID NO: 75719 - DNA, 25 bp, Homo sapien
gcggccatcttgattcctggcatca

SEQ ID NO: 75720 - DNA, 25 bp, Homo sapien
cctctctgtgattgaggaaccaatc

SEQ ID NO: 75721 - DNA, 25 bp, Homo sapien
gagcccgtccaaaacgccatatttg

SEQ ID NO: 75722 - DNA, 25 bp, Homo sapien
tccggacgcaccttgagtagaggcc

SEQ ID NO: 75723 - DNA, 25 bp, Homo sapien
tccacatttaagagccgactgcgcc

SEQ ID NO: 75724 - DNA, 25 bp, Homo sapien
gcgacggtttacaggacagctcgta

SEQ ID NO: 75725 - DNA, 25 bp, Homo sapien
aggcacacagccgaccaaccagaga

SEQ ID NO: 75726 - DNA, 25 bp, Homo sapien
tttcccagtgagcttgcgagcgcgt

SEQ ID NO: 75727 - DNA, 25 bp, Homo sapien
cgactccgccatgttttcccagtga

SEQ ID NO: 75728 - DNA, 25 bp, Homo sapien
agctactgaggcgtttgctgatttc

SEQ ID NO: 75729 - DNA, 25 bp, Homo sapien
ttgggaaccgggcttaagctactga

SEQ ID NO: 75730 - DNA, 25 bp, Homo sapien
gccgccaacatggtgagtcttactg

SEQ ID NO: 75731 - DNA, 25 bp, Homo sapien
gttcttctacacatgcgcagggttg

SEQ ID NO: 75732 - DNA, 25 bp, Homo sapien
caatcggtgctcacgtcggtgactc

SEQ ID NO: 75733 - DNA, 25 bp, Homo sapien
tgctgatttcgtccatccaggttgg

SEQ ID NO: 75734 - DNA, 25 bp, Homo sapien
aggtcaggctttgggcccttgcaga

SEQ ID NO: 75735 - DNA, 25 bp, Homo sapien
ggaaccatagagaagggccagcctc

SEQ ID NO: 75736 - DNA, 25 bp, Homo sapien
tcctagagaggctgtagggaccgac

SEQ ID NO: 75737 - DNA, 25 bp, Homo sapien
agtcttcagagacgccctcgacctt

SEQ ID NO: 75738 - DNA, 25 bp, Homo sapien
cctgactcggctacctgttctggag

SEQ ID NO: 75739 - DNA, 25 bp, Homo sapien
accttgcgagcgctcgggttgagtt

SEQ ID NO: 75740 - DNA, 25 bp, Homo sapien
aatgcttccgtcttggccaccttgc

SEQ ID NO: 75741 - DNA, 25 bp, Homo sapien
gacggccggccagctaatgcttccg

SEQ ID NO: 75742 - DNA, 25 bp, Homo sapien
gttcccgcaactcgtgcagagccgt

SEQ ID NO: 75743 - DNA, 25 bp, Homo sapien
cagagccgtgctcatggtcttctcg

SEQ ID NO: 75744 - DNA, 25 bp, Homo sapien
agcaccacatctggcgcctgcttga

SEQ ID NO: 75745 - DNA, 25 bp, Homo sapien
ctggcttgaaggtggtcatcatctc

SEQ ID NO: 75746 - DNA, 25 bp, Homo sapien
aacatcttctcggtgggcgtcacgg

SEQ ID NO: 75747 - DNA, 25 bp, Homo sapien
ccgctgagctgttggggaacatctt

SEQ ID NO: 75748 - DNA, 25 bp, Homo sapien
ctgcaggtcacatggtgcccgactt

SEQ ID NO: 75749 - DNA, 25 bp, Homo sapien
ttgaccgtgttctgcctctcgagtt

SEQ ID NO: 75750 - DNA, 25 bp, Homo sapien
tttccacgctttatctgcgcctgcg

SEQ ID NO: 75751 - DNA, 25 bp, Homo sapien
cccgtgttgtctcaggcagtaggga

SEQ ID NO: 75752 - DNA, 25 bp, Homo sapien
tcggcggcaggtggaatttccacgc

SEQ ID NO: 75753 - DNA, 25 bp, Homo sapien
attcgcggtccgagctgaagaggtt

SEQ ID NO: 75754 - DNA, 25 bp, Homo sapien
acttccggcggagggtctcaagctt

SEQ ID NO: 75755 - DNA, 25 bp, Homo sapien
ggaaaccacagagactggcaacttc

SEQ ID NO: 75756 - DNA, 25 bp, Homo sapien
tggcaacttcccaggttcctagaga

SEQ ID NO: 75757 - DNA, 25 bp, Homo sapien
ggaggggcatggaaaacgcacttcc

SEQ ID NO: 75758 - DNA, 25 bp, Homo sapien
cccacttgtgcctagagggcgaggt

SEQ ID NO: 75759 - DNA, 25 bp, Homo sapien
agcgagttctacgtgccaggtccgc

SEQ ID NO: 75760 - DNA, 25 bp, Homo sapien
agttagtgaccagctcctcggcgtt

SEQ ID NO: 75761 - DNA, 25 bp, Homo sapien
tccggctcggcctttagttagtgac

SEQ ID NO: 75762 - DNA, 25 bp, Homo sapien
aagccgggcttagagcgccacagtt

SEQ ID NO: 75763 - DNA, 25 bp, Homo sapien
ggctgtatcagtccgtgacactcca

SEQ ID NO: 75764 - DNA, 25 bp, Homo sapien
ggtctcggtagagccaggctgtatc

SEQ ID NO: 75765 - DNA, 25 bp, Homo sapien
tgaacttggtcccaatggcggcccg

SEQ ID NO: 75766 - DNA, 25 bp, Homo sapien
tcattaccgtcaggcccatgcggct

SEQ ID NO: 75767 - DNA, 25 bp, Homo sapien
ttctcatttctcattaccgtcaggc

SEQ ID NO: 75768 - DNA, 25 bp, Homo sapien
caggcgccggcattagcatactgcg

SEQ ID NO: 75769 - DNA, 25 bp, Homo sapien
cgctgtgtgccagcctgcgcaatct

SEQ ID NO: 75770 - DNA, 25 bp, Homo sapien
ctgcgcaatctgcaggcgccatcaa

SEQ ID NO: 75771 - DNA, 25 bp, Homo sapien
ctgcaggcgccatcaatttttcagc

SEQ ID NO: 75772 - DNA, 25 bp, Homo sapien
aggcgccatcaatttttcagcactt

SEQ ID NO: 75773 - DNA, 25 bp, Homo sapien
ctgtcatgtccctgccgaccctccg

SEQ ID NO: 75774 - DNA, 25 bp, Homo sapien
gatacagcggcttctgcgcgactta

SEQ ID NO: 75775 - DNA, 25 bp, Homo sapien
tttccttatccttccggggctgctc

SEQ ID NO: 75776 - DNA, 25 bp, Homo sapien
tcctctcggagccaaacttcgtagc

SEQ ID NO: 75777 - DNA, 25 bp, Homo sapien
aggtctgaggagcagcttcagtccc

SEQ ID NO: 75778 - DNA, 25 bp, Homo sapien
gccattttaagcctctcggtctgtg

SEQ ID NO: 75779 - DNA, 25 bp, Homo sapien
agagctccttgtgcggcgccatttt

SEQ ID NO: 75780 - DNA, 25 bp, Homo sapien
ctgcgcgacttataagagctccttg

SEQ ID NO: 75781 - DNA, 25 bp, Homo sapien
ccaaacttcgtagcaggcgcgcggt

SEQ ID NO: 75782 - DNA, 25 bp, Homo sapien
ccctccaggtttggattcgtccata

SEQ ID NO: 75783 - DNA, 25 bp, Homo sapien
cacgcacctggtagctaagtcaaga

SEQ ID NO: 75784 - DNA, 25 bp, Homo sapien
gcggcttttttaacacgagcgcaaa

SEQ ID NO: 75785 - DNA, 25 bp, Homo sapien
tgtgcccttaactaacgcccggata

SEQ ID NO: 75786 - DNA, 25 bp, Homo sapien
tcgccgcacttcacagactcaatta

SEQ ID NO: 75787 - DNA, 25 bp, Homo sapien
cgtccatacggtttccacggcagca

SEQ ID NO: 75788 - DNA, 25 bp, Homo sapien
ccgcttaggcagacacgaactcaga

SEQ ID NO: 75789 - DNA, 25 bp, Homo sapien
tcaattatcacagactcaggggcgc

SEQ ID NO: 75790 - DNA, 25 bp, Homo sapien
tccaggtctttaccggatacttctc

SEQ ID NO: 75791 - DNA, 25 bp, Homo sapien
gtggcctggattccgcgctccggca

SEQ ID NO: 75792 - DNA, 25 bp, Homo sapien
ggggacagccctcctaatgcaccgg

SEQ ID NO: 75793 - DNA, 25 bp, Homo sapien
ctttaccggatacttctctgtgccc

SEQ ID NO: 75794 - DNA, 25 bp, Homo sapien
cagcttttccggatccaggtcttta

SEQ ID NO: 75795 - DNA, 25 bp, Homo sapien
gagggatgtgatcagcttttccgga

SEQ ID NO: 75796 - DNA, 25 bp, Homo sapien
tagaagtaaataagcgctcggggag

SEQ ID NO: 75797 - DNA, 25 bp, Homo sapien
ccgtgcacctcttgcgggtaagcca

SEQ ID NO: 75798 - DNA, 25 bp, Homo sapien
acgtggcgctaatgcagaaatcttg

SEQ ID NO: 75799 - DNA, 25 bp, Homo sapien
agccagagtctctttgcacggcggg

SEQ ID NO: 75800 - DNA, 25 bp, Homo sapien
agttgcctcggccttgatcttctcc

SEQ ID NO: 75801 - DNA, 25 bp, Homo sapien
ccttcgcagatttgaaagttgcctc

SEQ ID NO: 75802 - DNA, 25 bp, Homo sapien
cggggcaaacgctcttctctcattc

SEQ ID NO: 75803 - DNA, 25 bp, Homo sapien
gaatagctgtcaaggggccactttg

SEQ ID NO: 75804 - DNA, 25 bp, Homo sapien
cgaggaaccgaaagccgagagaata

SEQ ID NO: 75805 - DNA, 25 bp, Homo sapien
ctgcattattcatttcggggacgtg

SEQ ID NO: 75806 - DNA, 25 bp, Homo sapien
ttggtccctgatccacctgcggaag

SEQ ID NO: 75807 - DNA, 25 bp, Homo sapien
ctgcctgagaagctccagatcgtga

SEQ ID NO: 75808 - DNA, 25 bp, Homo sapien
ggcttctctggcatgtccttcagca

SEQ ID NO: 75809 - DNA, 25 bp, Homo sapien
ttctccgagttcaccggcttctctg

SEQ ID NO: 75810 - DNA, 25 bp, Homo sapien
tcacacccactgagagcatcatgtc

SEQ ID NO: 75811 - DNA, 25 bp, Homo sapien
cctctcggagaggaggttctttgag

SEQ ID NO: 75812 - DNA, 25 bp, Homo sapien
cgccgggagaactacctctcggaga

SEQ ID NO: 75813 - DNA, 25 bp, Homo sapien
aggctcccacgacctggagacggcg

SEQ ID NO: 75814 - DNA, 25 bp, Homo sapien
aggtgcgctcgggactcgccatccg

SEQ ID NO: 75815 - DNA, 25 bp, Homo sapien
gacaaacacaggtgctccagacccg

SEQ ID NO: 75816 - DNA, 25 bp, Homo sapien
gactcgccatccgttctctgcgata

SEQ ID NO: 75817 - DNA, 25 bp, Homo sapien
caagcacgagggctcgccaagcgct

SEQ ID NO: 75818 - DNA, 25 bp, Homo sapien
gttcatggctgtagcgagcaaagga

SEQ ID NO: 75819 - DNA, 25 bp, Homo sapien
cgcgttaactgaaaggctgggcaac

SEQ ID NO: 75820 - DNA, 25 bp, Homo sapien
cagaagcgggcttaggacaaacaca

SEQ ID NO: 75821 - DNA, 25 bp, Homo sapien
acacgccgctgttcatggctgtagc

SEQ ID NO: 75822 - DNA, 25 bp, Homo sapien
gagttaatccctcccacgcgcggtg

SEQ ID NO: 75823 - DNA, 25 bp, Homo sapien
gctgccgctagcttagttcgctttg

SEQ ID NO: 75824 - DNA, 25 bp, Homo sapien
aggcgctggtcttcatacctgtgtc

SEQ ID NO: 75825 - DNA, 25 bp, Homo sapien
ggggtcttcactttcttctcagccg

SEQ ID NO: 75826 - DNA, 25 bp, Homo sapien
gccgcattaaaagccctcgcagttc

SEQ ID NO: 75827 - DNA, 25 bp, Homo sapien
cagttctccaggtttccgagggcca

SEQ ID NO: 75828 - DNA, 25 bp, Homo sapien
gggcctctcttgacgcagctgtaaa

SEQ ID NO: 75829 - DNA, 25 bp, Homo sapien
cgacaaccggttgaagtggctcctg

SEQ ID NO: 75830 - DNA, 25 bp, Homo sapien
gtaatcggatttgcgcgcacgaacc

SEQ ID NO: 75831 - DNA, 25 bp, Homo sapien
atcgttttaggtcagctgcggagtc

SEQ ID NO: 75832 - DNA, 25 bp, Homo sapien
agtggcacttcctgtctcgtaatcg

SEQ ID NO: 75833 - DNA, 25 bp, Homo sapien
tctcacgacggaagaccaaggtgtg

SEQ ID NO: 75834 - DNA, 25 bp, Homo sapien
aatgtgttcgggtctcgagattccc

SEQ ID NO: 75835 - DNA, 25 bp, Homo sapien
gaaggcctataaatgtctcacgacg

SEQ ID NO: 75836 - DNA, 25 bp, Homo sapien
tcacccgggagcagggaacaccaag

SEQ ID NO: 75837 - DNA, 25 bp, Homo sapien
aacccgatctctgtcagcgcctgga

SEQ ID NO: 75838 - DNA, 25 bp, Homo sapien
acgtcgccatcctccgcttctcagg

SEQ ID NO: 75839 - DNA, 25 bp, Homo sapien
aggtcgacctcatcgagtgcccttc

SEQ ID NO: 75840 - DNA, 25 bp, Homo sapien
gagtgcccttcggagagcgccttct

SEQ ID NO: 75841 - DNA, 25 bp, Homo sapien
agcgccttcttgtcagggtagttga

SEQ ID NO: 75842 - DNA, 25 bp, Homo sapien
ttgatgctgccagcgctcccgaacg

SEQ ID NO: 75843 - DNA, 25 bp, Homo sapien
ctggggatggctgctccatcagatc

SEQ ID NO: 75844 - DNA, 25 bp, Homo sapien
tggctgctccatcagatcgtaaccg

SEQ ID NO: 75845 - DNA, 25 bp, Homo sapien
tgtcagggtagttgatgctgccagc

SEQ ID NO: 75846 - DNA, 25 bp, Homo sapien
gcgtcctgggctggaaccccaaata

SEQ ID NO: 75847 - DNA, 25 bp, Homo sapien
agcttccaagccgaagtctccctgg

SEQ ID NO: 75848 - DNA, 25 bp, Homo sapien
atgctgacccgcgtcagcccaggtg

SEQ ID NO: 75849 - DNA, 25 bp, Homo sapien
caggtttccatgctgacccgcgtca

SEQ ID NO: 75850 - DNA, 25 bp, Homo sapien
accggcacccgtcgggaggcagcaa

SEQ ID NO: 75851 - DNA, 25 bp, Homo sapien
aagccgaagtctccctggtctgacc

SEQ ID NO: 75852 - DNA, 25 bp, Homo sapien
agtctccctggtctgaccaccagga

SEQ ID NO: 75853 - DNA, 25 bp, Homo sapien
ggcgccacgtgcagcacgcaggttt

SEQ ID NO: 75854 - DNA, 25 bp, Homo sapien
agccttcgtgatctaagctcgattc

SEQ ID NO: 75855 - DNA, 25 bp, Homo sapien
caagcctgtaattctcacgtccgga

SEQ ID NO: 75856 - DNA, 25 bp, Homo sapien
cggcggtttgagatccaagcctgta

SEQ ID NO: 75857 - DNA, 25 bp, Homo sapien
agctcgattcctgccggggtagcaa

SEQ ID NO: 75858 - DNA, 25 bp, Homo sapien
ggtagcaaccggactgacgtctgga

SEQ ID NO: 75859 - DNA, 25 bp, Homo sapien
aggctccgcgtgacagagtgataac

SEQ ID NO: 75860 - DNA, 25 bp, Homo sapien
taaagggctgcgacccaaacggaga

SEQ ID NO: 75861 - DNA, 25 bp, Homo sapien
caatcttagccgaccgggagggctc

SEQ ID NO: 75862 - DNA, 25 bp, Homo sapien
agtatagctcttgcgcgtccagtca

SEQ ID NO: 75863 - DNA, 25 bp, Homo sapien
caatcaagagactatccagcgggtg

SEQ ID NO: 75864 - DNA, 25 bp, Homo sapien
gaagcatcctgtagtgagcggcctc

SEQ ID NO: 75865 - DNA, 25 bp, Homo sapien
agcggcctcccagctgactgtgaag

SEQ ID NO: 75866 - DNA, 25 bp, Homo sapien
cacctatcgtgggtcgagttgcttg

SEQ ID NO: 75867 - DNA, 25 bp, Homo sapien
caatcaacttcgagagcgtaggccc

SEQ ID NO: 75868 - DNA, 25 bp, Homo sapien
taggcgggagcatccaatcaacttc

SEQ ID NO: 75869 - DNA, 25 bp, Homo sapien
gtccagtcacaaatgacgtcccttc

SEQ ID NO: 75870 - DNA, 25 bp, Homo sapien
tctcgcggtatttgtcccgactctc

SEQ ID NO: 75871 - DNA, 25 bp, Homo sapien
agaagtctcgcggtatcggaaaatg

SEQ ID NO: 75872 - DNA, 25 bp, Homo sapien
gctcacagccacacctgacgagatg

SEQ ID NO: 75873 - DNA, 25 bp, Homo sapien
ccatctagactgtactctcgcggta

SEQ ID NO: 75874 - DNA, 25 bp, Homo sapien
gctgcagtggcagtgctttctcttc

SEQ ID NO: 75875 - DNA, 25 bp, Homo sapien
ggccgcagtgccacttcgacatcga

SEQ ID NO: 75876 - DNA, 25 bp, Homo sapien
tcgacatcgagatcaaccgggagcc

SEQ ID NO: 75877 - DNA, 25 bp, Homo sapien
caggcgcatccacggctttcagatt

SEQ ID NO: 75878 - DNA, 25 bp, Homo sapien
ttcccggcagaaaggaggctcagca

SEQ ID NO: 75879 - DNA, 25 bp, Homo sapien
tgaggtcttgctaggcaccggcgaa

SEQ ID NO: 75880 - DNA, 25 bp, Homo sapien
cagcgatgtttgactcccggacgaa

SEQ ID NO: 75881 - DNA, 25 bp, Homo sapien
cggcctggccctttaagcgtccaga

SEQ ID NO: 75882 - DNA, 25 bp, Homo sapien
ccggggtctatctgctcggatatga

SEQ ID NO: 75883 - DNA, 25 bp, Homo sapien
ttcctgatttcacggcagcttccta

SEQ ID NO: 75884 - DNA, 25 bp, Homo sapien
gtggaagccttttctgttcggatcc

SEQ ID NO: 75885 - DNA, 25 bp, Homo sapien
agcgccacggcaccatggtacgcag

SEQ ID NO: 75886 - DNA, 25 bp, Homo sapien
agccggtcccacgtcgagaggcgct

SEQ ID NO: 75887 - DNA, 25 bp, Homo sapien
ccggagcttgggaggcgaccgccag

SEQ ID NO: 75888 - DNA, 25 bp, Homo sapien
gcctacagcgggcagccgagcggct

SEQ ID NO: 75889 - DNA, 25 bp, Homo sapien
tcggcttctttagggggcctacagc

SEQ ID NO: 75890 - DNA, 25 bp, Homo sapien
tgggttgggagaagttctgctggtc

SEQ ID NO: 75891 - DNA, 25 bp, Homo sapien
gggagaccaaagagtctccactccc

SEQ ID NO: 75892 - DNA, 25 bp, Homo sapien
cggcgggagttgcaccgccacagcc

SEQ ID NO: 75893 - DNA, 25 bp, Homo sapien
agaagttctgctggtcgtgggctcg

SEQ ID NO: 75894 - DNA, 25 bp, Homo sapien
agagctgctggacgcccgctctcta

SEQ ID NO: 75895 - DNA, 25 bp, Homo sapien
ggccaacgtccacgaggtgctcagc

SEQ ID NO: 75896 - DNA, 25 bp, Homo sapien
agcgccgcctcattgctgcagatgg

SEQ ID NO: 75897 - DNA, 25 bp, Homo sapien
tgacatcaagcaggaggccgacacc

SEQ ID NO: 75898 - DNA, 25 bp, Homo sapien
gccgccctactactgtgacatcaag

SEQ ID NO: 75899 - DNA, 25 bp, Homo sapien
tgacatcgctgcgtcctgccaagag

SEQ ID NO: 75900 - DNA, 25 bp, Homo sapien
acccttactcggtgcgtgttgagga

SEQ ID NO: 75901 - DNA, 25 bp, Homo sapien
ctgcccaagatctatgcccgcgagg

SEQ ID NO: 75902 - DNA, 25 bp, Homo sapien
tctgcgctcacttcacgctggtggc

SEQ ID NO: 75903 - DNA, 25 bp, Homo sapien
gacgctgacttcctcggactctcgg

SEQ ID NO: 75904 - DNA, 25 bp, Homo sapien
gcaggatttgttcgccgcggcacac

SEQ ID NO: 75905 - DNA, 25 bp, Homo sapien
ggtgctgcactacctgtacacatca

SEQ ID NO: 75906 - DNA, 25 bp, Homo sapien
tggaccatggcaagttcctcgactg

SEQ ID NO: 75907 - DNA, 25 bp, Homo sapien
gacgctcctgcaagacgggctcaaa

SEQ ID NO: 75908 - DNA, 25 bp, Homo sapien
gcggttgtaccagcagacgctcctg

SEQ ID NO: 75909 - DNA, 25 bp, Homo sapien
atcatctccagcgacggccttaacg

SEQ ID NO: 75910 - DNA, 25 bp, Homo sapien
gtcaccagggaaacaagcgacgtca

SEQ ID NO: 75911 - DNA, 25 bp, Homo sapien
tccaagcgagcacgatctcgagtgc

SEQ ID NO: 75912 - DNA, 25 bp, Homo sapien
cgctgggctggatccaagcgagcac

SEQ ID NO: 75913 - DNA, 25 bp, Homo sapien
ggcgccaagagttctgaaagtgaca

SEQ ID NO: 75914 - DNA, 25 bp, Homo sapien
ttcaacgctactctacgggggccga

SEQ ID NO: 75915 - DNA, 25 bp, Homo sapien
cttgcgcgttttcaacgctactcta

SEQ ID NO: 75916 - DNA, 25 bp, Homo sapien
aaacaagcgacgtcacttgcgcgtt

SEQ ID NO: 75917 - DNA, 25 bp, Homo sapien
cccggcacttacagcggtctctctc

SEQ ID NO: 75918 - DNA, 25 bp, Homo sapien
gcttagcccgctcttcagaatgttc

SEQ ID NO: 75919 - DNA, 25 bp, Homo sapien
gcctctcttcctgtgaccttgtcgt

SEQ ID NO: 75920 - DNA, 25 bp, Homo sapien
accttgtcgtgactccgtgaccgga

SEQ ID NO: 75921 - DNA, 25 bp, Homo sapien
ccaaagtcctttcggcctggccaag

SEQ ID NO: 75922 - DNA, 25 bp, Homo sapien
cccggcttgtttcgcttacctagag

SEQ ID NO: 75923 - DNA, 25 bp, Homo sapien
cttacctagagcgagaaaacctctc

SEQ ID NO: 75924 - DNA, 25 bp, Homo sapien
ctctagcgtactggcggagacagac

SEQ ID NO: 75925 - DNA, 25 bp, Homo sapien
ctggcccaaggactcctcagatttc

SEQ ID NO: 75926 - DNA, 25 bp, Homo sapien
ccctggcagttttcacggcataagc

SEQ ID NO: 75927 - DNA, 25 bp, Homo sapien
agctgtttccgactcgcgcgctgaa

SEQ ID NO: 75928 - DNA, 25 bp, Homo sapien
tgctgatggcgctgctttcttcctt

SEQ ID NO: 75929 - DNA, 25 bp, Homo sapien
ccttctttgtgctcaggagcggtga

SEQ ID NO: 75930 - DNA, 25 bp, Homo sapien
tgcggcacttcgcaccttctttgtg

SEQ ID NO: 75931 - DNA, 25 bp, Homo sapien
cccgaagcctcagcgagggagtctc

SEQ ID NO: 75932 - DNA, 25 bp, Homo sapien
ggccaggtaggaccaaagacacacg

SEQ ID NO: 75933 - DNA, 25 bp, Homo sapien
aatacgggctcttcctcgggaggag

SEQ ID NO: 75934 - DNA, 25 bp, Homo sapien
acaaaagactcgtgcgctgcccgga

SEQ ID NO: 75935 - DNA, 25 bp, Homo sapien
taagtgtttcccaggcgccatctcg

SEQ ID NO: 75936 - DNA, 25 bp, Homo sapien
ttcggattccttcttcgcagacgcg

SEQ ID NO: 75937 - DNA, 25 bp, Homo sapien
acgctgggcaccgagctaagtgttt

SEQ ID NO: 75938 - DNA, 25 bp, Homo sapien
ctcctgtacaccgagaggcggcttc

SEQ ID NO: 75939 - DNA, 25 bp, Homo sapien
tctctaggccctgcacaaaagactc

SEQ ID NO: 75940 - DNA, 25 bp, Homo sapien
cagtcccacaaggagggctgtgtca

SEQ ID NO: 75941 - DNA, 25 bp, Homo sapien
tgaaagcgggctcctaagccatctc

SEQ ID NO: 75942 - DNA, 25 bp, Homo sapien
cccgagcgagaaaggaggaccacag

SEQ ID NO: 75943 - DNA, 25 bp, Homo sapien
aggaccacagagatgcggcgccctc

SEQ ID NO: 75944 - DNA, 25 bp, Homo sapien
cgccgtcctagagcaaccggagcgg

SEQ ID NO: 75945 - DNA, 25 bp, Homo sapien
ctggaagcagtcttggccctgccct

SEQ ID NO: 75946 - DNA, 25 bp, Homo sapien
ctgagcctcaaggagagcagacgtg

SEQ ID NO: 75947 - DNA, 25 bp, Homo sapien
gtccctgggatcgtccgtgtctcca

SEQ ID NO: 75948 - DNA, 25 bp, Homo sapien
cgtgtctccaggagaaccggaccgc

SEQ ID NO: 75949 - DNA, 25 bp, Homo sapien
acaggcagcacagcggagtcgacac

SEQ ID NO: 75950 - DNA, 25 bp, Homo sapien
gcgcccaccatctctgcttgctgaa

SEQ ID NO: 75951 - DNA, 25 bp, Homo sapien
ctctgtagcgtcgagatgcggcgct

SEQ ID NO: 75952 - DNA, 25 bp, Homo sapien
cccgagcttggctctgtagcgtcga

SEQ ID NO: 75953 - DNA, 25 bp, Homo sapien
tggctactgctggtactggggtcct

SEQ ID NO: 75954 - DNA, 25 bp, Homo sapien
tgcttgctgaaaagctgcagaggcc

SEQ ID NO: 75955 - DNA, 25 bp, Homo sapien
ggccgccttcgtttttgtcgcgcga

SEQ ID NO: 75956 - DNA, 25 bp, Homo sapien
cgccttcgtttttgtcgcgcgaggt

SEQ ID NO: 75957 - DNA, 25 bp, Homo sapien
cgcgaggttttggtttgtgaggatc

SEQ ID NO: 75958 - DNA, 25 bp, Homo sapien
gcgatcggctttcctgccgctctta

SEQ ID NO: 75959 - DNA, 25 bp, Homo sapien
cggcggctttcatttctgcaccaga

SEQ ID NO: 75960 - DNA, 25 bp, Homo sapien
acgtgtgcaccttcagtccgggaaa

SEQ ID NO: 75961 - DNA, 25 bp, Homo sapien
ccacttggctgcagagaacgtgtgc

SEQ ID NO: 75962 - DNA, 25 bp, Homo sapien
atctcagtagatccggcgtgtattc

SEQ ID NO: 75963 - DNA, 25 bp, Homo sapien
agtcccgagtagaccgcagaggctc

SEQ ID NO: 75964 - DNA, 25 bp, Homo sapien
cggcagggactttgcaaactctgca

SEQ ID NO: 75965 - DNA, 25 bp, Homo sapien
cccggcagggcttttattgtgaagg

SEQ ID NO: 75966 - DNA, 25 bp, Homo sapien
tgcctggatataggccgactgtcca

SEQ ID NO: 75967 - DNA, 25 bp, Homo sapien
cgactgtccacttctgcttccgtgg

SEQ ID NO: 75968 - DNA, 25 bp, Homo sapien
accacgcgccgtatggtttgaatga

SEQ ID NO: 75969 - DNA, 25 bp, Homo sapien
accttggtgtcctggtagattcgga

SEQ ID NO: 75970 - DNA, 25 bp, Homo sapien
agccactcggggttccggcaacaga

SEQ ID NO: 75971 - DNA, 25 bp, Homo sapien
ggcaacagagatgccgtgggacctc

SEQ ID NO: 75972 - DNA, 25 bp, Homo sapien
tcacggctttgcaggatacgggctt

SEQ ID NO: 75973 - DNA, 25 bp, Homo sapien
aggcgccatgcactgacgcctggca

SEQ ID NO: 75974 - DNA, 25 bp, Homo sapien
tctgcgaagcagaaacggcggcagc

SEQ ID NO: 75975 - DNA, 25 bp, Homo sapien
cgcacgtcattacccgatgggacgg

SEQ ID NO: 75976 - DNA, 25 bp, Homo sapien
attacccgatgggacggtgccagct

SEQ ID NO: 75977 - DNA, 25 bp, Homo sapien
gaaccgcgcgtctagggctggaaac

SEQ ID NO: 75978 - DNA, 25 bp, Homo sapien
gccacagcgggctagaggtcgtccc

SEQ ID NO: 75979 - DNA, 25 bp, Homo sapien
ccgcccgcaacatatgcgcgaagga

SEQ ID NO: 75980 - DNA, 25 bp, Homo sapien
tgctacgaacgtcaaatggccgccc

SEQ ID NO: 75981 - DNA, 25 bp, Homo sapien
cgcgaaggaaagtgctacgaacgtc

SEQ ID NO: 75982 - DNA, 25 bp, Homo sapien
cgagggttcgacacctccacttcaa

SEQ ID NO: 75983 - DNA, 25 bp, Homo sapien
aatgttgggagtgataatttgcgcc

SEQ ID NO: 75984 - DNA, 25 bp, Homo sapien
caccagcctgcggaatgttgggagt

SEQ ID NO: 75985 - DNA, 25 bp, Homo sapien
tagttttgcgtacgaggacagcccg

SEQ ID NO: 75986 - DNA, 25 bp, Homo sapien
cacaaccttggctcgcggaatcctg

SEQ ID NO: 75987 - DNA, 25 bp, Homo sapien
agccagcacaggtttggccgcgccg

SEQ ID NO: 75988 - DNA, 25 bp, Homo sapien
cgcgtcttacctgaagcctggactc

SEQ ID NO: 75989 - DNA, 25 bp, Homo sapien
ctccacttcaagtcccaggcgggtg

SEQ ID NO: 75990 - DNA, 25 bp, Homo sapien
tcgccgcaggcggaaagtaagttgc

SEQ ID NO: 75991 - DNA, 25 bp, Homo sapien
ccagcgctgacgtcacagtgacgcg

SEQ ID NO: 75992 - DNA, 25 bp, Homo sapien
ccattgttccgtgtccctggtgctt

SEQ ID NO: 75993 - DNA, 25 bp, Homo sapien
tcgcgctactttttcccggccattg

SEQ ID NO: 75994 - DNA, 25 bp, Homo sapien
agtcctgtacagacgcggtcccttc

SEQ ID NO: 75995 - DNA, 25 bp, Homo sapien
ccgccaagacgcagtcctgtacaga

SEQ ID NO: 75996 - DNA, 25 bp, Homo sapien
cggcagcccgctcggtattatgatt

SEQ ID NO: 75997 - DNA, 25 bp, Homo sapien
cagtagcctccgctgttgccgggct

SEQ ID NO: 75998 - DNA, 25 bp, Homo sapien
cccgtctgagcaacttgcaggggcg

SEQ ID NO: 75999 - DNA, 25 bp, Homo sapien
gcctgggcttaactcactggggcct

SEQ ID NO: 76000 - DNA, 25 bp, Homo sapien
tgggcttaactcactggggcctccc

SEQ ID NO: 76001 - DNA, 25 bp, Homo sapien
tgagaacggggcctgggcttaactc

SEQ ID NO: 76002 - DNA, 25 bp, Homo sapien
cttctccgaggtcgcaggtggaacg

SEQ ID NO: 76003 - DNA, 25 bp, Homo sapien
gtggaacgggcttgcgcgtgagaac

SEQ ID NO: 76004 - DNA, 25 bp, Homo sapien
agagcccgtctgagcaacttgcagg

SEQ ID NO: 76005 - DNA, 25 bp, Homo sapien
acctagagcccgtctgagcaacttg

SEQ ID NO: 76006 - DNA, 25 bp, Homo sapien
tctgtggctgcaaggggccgggctc

SEQ ID NO: 76007 - DNA, 25 bp, Homo sapien
gaggccgggcgaaagagtgctcggt

SEQ ID NO: 76008 - DNA, 25 bp, Homo sapien
gagagccggcgagaaccggaggccg

SEQ ID NO: 76009 - DNA, 25 bp, Homo sapien
gcgggtccgagagccggcgagaacc

SEQ ID NO: 76010 - DNA, 25 bp, Homo sapien
cccgcaacaccttcactcgtccctg

SEQ ID NO: 76011 - DNA, 25 bp, Homo sapien
tccacgtcttcggaggcgggtccga

SEQ ID NO: 76012 - DNA, 25 bp, Homo sapien
gctccacgtcttcggaggcgggtcc

SEQ ID NO: 76013 - DNA, 25 bp, Homo sapien
gccgccgcagcgctccacgtcttcg

SEQ ID NO: 76014 - DNA, 25 bp, Homo sapien
tactgtaccacccatcgaaatccgg

SEQ ID NO: 76015 - DNA, 25 bp, Homo sapien
tgggctctccaaccgcgagcggtcg

SEQ ID NO: 76016 - DNA, 25 bp, Homo sapien
gtggacgagaacctagactggaacc

SEQ ID NO: 76017 - DNA, 25 bp, Homo sapien
cctggttgggctgtcactccgagcc

SEQ ID NO: 76018 - DNA, 25 bp, Homo sapien
aaaaggcagccctcattgggctgtc

SEQ ID NO: 76019 - DNA, 25 bp, Homo sapien
ggggcgtgcctaacgtactgtacca

SEQ ID NO: 76020 - DNA, 25 bp, Homo sapien
acccatcgaaatccggacggcagcg

SEQ ID NO: 76021 - DNA, 25 bp, Homo sapien
ggctgtcgcctggaacaggagacca

SEQ ID NO: 76022 - DNA, 25 bp, Homo sapien
aggtactacctgtgctctgtccagc

SEQ ID NO: 76023 - DNA, 25 bp, Homo sapien
ctcattcgggtgagtctcgccagtc

SEQ ID NO: 76024 - DNA, 25 bp, Homo sapien
caccgacggggtgatgcatgaatac

SEQ ID NO: 76025 - DNA, 25 bp, Homo sapien
actagctaggctcttccaggaccgg

SEQ ID NO: 76026 - DNA, 25 bp, Homo sapien
tgcaccatctatcggacactagcta

SEQ ID NO: 76027 - DNA, 25 bp, Homo sapien
agccactggacgatccttcccgtag

SEQ ID NO: 76028 - DNA, 25 bp, Homo sapien
tgtcagccggcttcgagataagtcc

SEQ ID NO: 76029 - DNA, 25 bp, Homo sapien
cgcggcttccgtctacaggtactac

SEQ ID NO: 76030 - DNA, 25 bp, Homo sapien
ttcctcttgcagttgaggccggcgc

SEQ ID NO: 76031 - DNA, 25 bp, Homo sapien
cgccgagccggacttcaggcggatc

SEQ ID NO: 76032 - DNA, 25 bp, Homo sapien
gggtggccttcctcttgcagttgag

SEQ ID NO: 76033 - DNA, 25 bp, Homo sapien
ctcttctggtgtttcagcttgggga

SEQ ID NO: 76034 - DNA, 25 bp, Homo sapien
gccaccgtgactcgtagcctgactt

SEQ ID NO: 76035 - DNA, 25 bp, Homo sapien
actcgtagcctgacttccgtttccg

SEQ ID NO: 76036 - DNA, 25 bp, Homo sapien
gtgacctgaccgcaagaggccaatg

SEQ ID NO: 76037 - DNA, 25 bp, Homo sapien
aacggccgagtgtggctcttctggt

SEQ ID NO: 76038 - DNA, 25 bp, Homo sapien
aggcctgagttcctccacgtaatga

SEQ ID NO: 76039 - DNA, 25 bp, Homo sapien
ccacgtaatgacctgggagacctca

SEQ ID NO: 76040 - DNA, 25 bp, Homo sapien
gcatctatgaagtggcagtggtcta

SEQ ID NO: 76041 - DNA, 25 bp, Homo sapien
ccgccgtgagtttctctcgggtaca

SEQ ID NO: 76042 - DNA, 25 bp, Homo sapien
agcgtctgctcggttacaaatggcc

SEQ ID NO: 76043 - DNA, 25 bp, Homo sapien
gagcctttcctctccgggttcagcg

SEQ ID NO: 76044 - DNA, 25 bp, Homo sapien
ctcgggtacaatgtgctggtgtgca

SEQ ID NO: 76045 - DNA, 25 bp, Homo sapien
tggtctacactgagcgtgcccttgc

SEQ ID NO: 76046 - DNA, 25 bp, Homo sapien
ggaggcgctctccacgcgcatcttt

SEQ ID NO: 76047 - DNA, 25 bp, Homo sapien
aaagactgaggtggtcattgacccg

SEQ ID NO: 76048 - DNA, 25 bp, Homo sapien
ccaaaccctggcttgaggaaagact

SEQ ID NO: 76049 - DNA, 25 bp, Homo sapien
cgagtggctttgtccggagatgcca

SEQ ID NO: 76050 - DNA, 25 bp, Homo sapien
gcgccagccttgtagcatctgcagg

SEQ ID NO: 76051 - DNA, 25 bp, Homo sapien
cggagacgccaaggagactgaatgc

SEQ ID NO: 76052 - DNA, 25 bp, Homo sapien
ccgctgcaccctacaggaggtcgtg

SEQ ID NO: 76053 - DNA, 25 bp, Homo sapien
tcgcggatcgctgacctatgagctc

SEQ ID NO: 76054 - DNA, 25 bp, Homo sapien
cgtcgcatccaggagaagggtttta

SEQ ID NO: 76055 - DNA, 25 bp, Homo sapien
tcgcacagagtaattcccagacgtg

SEQ ID NO: 76056 - DNA, 25 bp, Homo sapien
atctcgaggcgctgaatctgttctc

SEQ ID NO: 76057 - DNA, 25 bp, Homo sapien
tccctgccagatccgctcggaatta

SEQ ID NO: 76058 - DNA, 25 bp, Homo sapien
gagttacctgtctcacgtcagcagc

SEQ ID NO: 76059 - DNA, 25 bp, Homo sapien
cttgtgcactcggagggactacatc

SEQ ID NO: 76060 - DNA, 25 bp, Homo sapien
tctagcgtttatgcccgaagcttta

SEQ ID NO: 76061 - DNA, 25 bp, Homo sapien
cggaattagctcttctggcggtgca

SEQ ID NO: 76062 - DNA, 25 bp, Homo sapien
cagggtaagtaacggagccgcgctc

SEQ ID NO: 76063 - DNA, 25 bp, Homo sapien
gactcgcatccgctgtaccaggagc

SEQ ID NO: 76064 - DNA, 25 bp, Homo sapien
ggagcccactgccacctcgggattt

SEQ ID NO: 76065 - DNA, 25 bp, Homo sapien
acgtgtcatttctcacggggcattg

SEQ ID NO: 76066 - DNA, 25 bp, Homo sapien
agaggtttctcctcaatctaacgga

SEQ ID NO: 76067 - DNA, 25 bp, Homo sapien
atctattaataacgccgacagggta

SEQ ID NO: 76068 - DNA, 25 bp, Homo sapien
tctcttgctggtgtattacgtgtca

SEQ ID NO: 76069 - DNA, 25 bp, Homo sapien
tcccggcttgggattgatttttggc

SEQ ID NO: 76070 - DNA, 25 bp, Homo sapien
ataagtcggttgcagcatcaggggc

SEQ ID NO: 76071 - DNA, 25 bp, Homo sapien
cgagaggccctccaaaaagacgctg

SEQ ID NO: 76072 - DNA, 25 bp, Homo sapien
aaagacgctggcacggaactcgcgg

SEQ ID NO: 76073 - DNA, 25 bp, Homo sapien
tgcccgttggatcccgaagcaccag

SEQ ID NO: 76074 - DNA, 25 bp, Homo sapien
ggtcagagggcagtaggtacctcca

SEQ ID NO: 76075 - DNA, 25 bp, Homo sapien
aatgtgcgaaacctgcagaagcggc

SEQ ID NO: 76076 - DNA, 25 bp, Homo sapien
gtgagcccgtcagactcgtcagacc

SEQ ID NO: 76077 - DNA, 25 bp, Homo sapien
ctcagggcctgaaggcaatgtgcga

SEQ ID NO: 76078 - DNA, 25 bp, Homo sapien
acgcgggataccaccgccaaagcga

SEQ ID NO: 76079 - DNA, 25 bp, Homo sapien
cggcagctcagcgaccaatgggcgc

SEQ ID NO: 76080 - DNA, 25 bp, Homo sapien
ctcaggctaacttgctggagggccc

SEQ ID NO: 76081 - DNA, 25 bp, Homo sapien
gggaccccagcttggagatcgccgc

SEQ ID NO: 76082 - DNA, 25 bp, Homo sapien
ccctagcaacaagatcgcggggagg

SEQ ID NO: 76083 - DNA, 25 bp, Homo sapien
cgaaagcgaaatcgcgcgcgcggcc

SEQ ID NO: 76084 - DNA, 25 bp, Homo sapien
caccgccaaagcgaaagcgaaatcg

SEQ ID NO: 76085 - DNA, 25 bp, Homo sapien
ggataccaccgccaaagcgaaagcg

SEQ ID NO: 76086 - DNA, 25 bp, Homo sapien
aggttgaatccacgccctggctgtg

SEQ ID NO: 76087 - DNA, 25 bp, Homo sapien
ggttgcccttctccgttccttgcag

SEQ ID NO: 76088 - DNA, 25 bp, Homo sapien
ctgccggaccatcattttccgagtc

SEQ ID NO: 76089 - DNA, 25 bp, Homo sapien
gcagttaccagggtgctgacgtcag

SEQ ID NO: 76090 - DNA, 25 bp, Homo sapien
ggcaccgcggaaggttgaatccacg

SEQ ID NO: 76091 - DNA, 25 bp, Homo sapien
gactgtcctcccttctggtgtactg

SEQ ID NO: 76092 - DNA, 25 bp, Homo sapien
actagtcggacaaagccctcgcgtc

SEQ ID NO: 76093 - DNA, 25 bp, Homo sapien
ctgacgtcagctagaggcagggcac

SEQ ID NO: 76094 - DNA, 25 bp, Homo sapien
ggcggggcttgtccaacatccctca

SEQ ID NO: 76095 - DNA, 25 bp, Homo sapien
actgggaggcccaacgtctctgctt

SEQ ID NO: 76096 - DNA, 25 bp, Homo sapien
caggcccgagaatgccgcggacttc

SEQ ID NO: 76097 - DNA, 25 bp, Homo sapien
aggttctagatacgccctcagcgtg

SEQ ID NO: 76098 - DNA, 25 bp, Homo sapien
tggacatttcccttccacgctcgga

SEQ ID NO: 76099 - DNA, 25 bp, Homo sapien
acgcctgggaggcaaagaggttcta

SEQ ID NO: 76100 - DNA, 25 bp, Homo sapien
gttttcttgcatccctcctgtcgtg

SEQ ID NO: 76101 - DNA, 25 bp, Homo sapien
cggcctctctaggaaactgggaggc

SEQ ID NO: 76102 - DNA, 25 bp, Homo sapien
gccgagaagtaagccctgccagctc

SEQ ID NO: 76103 - DNA, 25 bp, Homo sapien
cgcccgatgtagagccgcttctttg

SEQ ID NO: 76104 - DNA, 25 bp, Homo sapien
atctgcgggtacagcgatgaacagg

SEQ ID NO: 76105 - DNA, 25 bp, Homo sapien
cctgaccattcgtgcgtggcacgga

SEQ ID NO: 76106 - DNA, 25 bp, Homo sapien
tctaacgggcagtagagtgtccggc

SEQ ID NO: 76107 - DNA, 25 bp, Homo sapien
ttcgcaaacgagacttccgggatcc

SEQ ID NO: 76108 - DNA, 25 bp, Homo sapien
gctgctgaagcctggtttaacacga

SEQ ID NO: 76109 - DNA, 25 bp, Homo sapien
ctcggccattgtttttggtctaacg

SEQ ID NO: 76110 - DNA, 25 bp, Homo sapien
ggcacttctgcgagtactgctccga

SEQ ID NO: 76111 - DNA, 25 bp, Homo sapien
cagcagcgtccgcaaccgtgtgatc

SEQ ID NO: 76112 - DNA, 25 bp, Homo sapien
aaccgtgtgatctctgcagccaggc

SEQ ID NO: 76113 - DNA, 25 bp, Homo sapien
cagccaggcggttgttcagctcctg

SEQ ID NO: 76114 - DNA, 25 bp, Homo sapien
ttcagctcctggttgtgggcattga

SEQ ID NO: 76115 - DNA, 25 bp, Homo sapien
tggttctcacgctggcactgccgca

SEQ ID NO: 76116 - DNA, 25 bp, Homo sapien
tgtgggcattgagctcctggttctc

SEQ ID NO: 76117 - DNA, 25 bp, Homo sapien
cagatgggcattctccaggcacttc

SEQ ID NO: 76118 - DNA, 25 bp, Homo sapien
gggacggaactcagcccagtcaaag

SEQ ID NO: 76119 - DNA, 25 bp, Homo sapien
cgcctccgtgcacgctcccgctcca

SEQ ID NO: 76120 - DNA, 25 bp, Homo sapien
tggatgggacggaactcagcccagt

SEQ ID NO: 76121 - DNA, 25 bp, Homo sapien
cggaactcagcccagtcaaaggtct

SEQ ID NO: 76122 - DNA, 25 bp, Homo sapien
ctcagcccagtcaaaggtcttggag

SEQ ID NO: 76123 - DNA, 25 bp, Homo sapien
ggctcctcttctgctcagggtccgg

SEQ ID NO: 76124 - DNA, 25 bp, Homo sapien
cctgctggatgggacggaactcagc

SEQ ID NO: 76125 - DNA, 25 bp, Homo sapien
gaactcagcccagtcaaaggtcttg

SEQ ID NO: 76126 - DNA, 25 bp, Homo sapien
tcttaagatatgtgaaaaaccattc

SEQ ID NO: 76127 - DNA, 25 bp, Homo sapien
aaaccattcagttgtagcaaacatc

SEQ ID NO: 76128 - DNA, 25 bp, Homo sapien
agcaaacatcatacaccagagactt

SEQ ID NO: 76129 - DNA, 25 bp, Homo sapien
accagagactttgtttgacatcaga

SEQ ID NO: 76130 - DNA, 25 bp, Homo sapien
tgacatcagataaatcacacgggtt

SEQ ID NO: 76131 - DNA, 25 bp, Homo sapien
atcacacgggttagagaactttttg

SEQ ID NO: 76132 - DNA, 25 bp, Homo sapien
tttagaggtcaaggaatcattcatc

SEQ ID NO: 76133 - DNA, 25 bp, Homo sapien
ggccgctgcaaatgaccaattctta

SEQ ID NO: 76134 - DNA, 25 bp, Homo sapien
ttccttctgcgctttgttcaagatg

SEQ ID NO: 76135 - DNA, 25 bp, Homo sapien
ccgtggtgacagcactgtgtcgtcc

SEQ ID NO: 76136 - DNA, 25 bp, Homo sapien
gcacagagatgtggaaacctcacga

SEQ ID NO: 76137 - DNA, 25 bp, Homo sapien
gggagttgctgacgcagttccttct

SEQ ID NO: 76138 - DNA, 25 bp, Homo sapien
tcctcgtagctgctcgcttggacca

SEQ ID NO: 76139 - DNA, 25 bp, Homo sapien
acctcacgaagcctagaagggccgg

SEQ ID NO: 76140 - DNA, 25 bp, Homo sapien
cctttgtcttgggtccagtctctga

SEQ ID NO: 76141 - DNA, 25 bp, Homo sapien
tgttcaagatgtgggtctggcgctt

SEQ ID NO: 76142 - DNA, 25 bp, Homo sapien
cacagcttcgacagccaatcaggtg

SEQ ID NO: 76143 - DNA, 25 bp, Homo sapien
catgtgagactcgagccagtagcaa

SEQ ID NO: 76144 - DNA, 25 bp, Homo sapien
cgacggcgtaactgacaggagcttt

SEQ ID NO: 76145 - DNA, 25 bp, Homo sapien
ctccaaccagaatacgccatttgtg

SEQ ID NO: 76146 - DNA, 25 bp, Homo sapien
gccaatcggcgacaagaggctagcc

SEQ ID NO: 76147 - DNA, 25 bp, Homo sapien
gctcctccctctgcgagagcaatgg

SEQ ID NO: 76148 - DNA, 25 bp, Homo sapien
gctccgtccggtttcgagcattttc

SEQ ID NO: 76149 - DNA, 25 bp, Homo sapien
gcgcagtggtttcgctcatgtgaga

SEQ ID NO: 76150 - DNA, 25 bp, Homo sapien
ctgtgtcatctcctagcggcctggc

SEQ ID NO: 76151 - DNA, 25 bp, Homo sapien
ggtgcaaccggaagtcgcagtattc

SEQ ID NO: 76152 - DNA, 25 bp, Homo sapien
tcgcagtattctcggctcggccatt

SEQ ID NO: 76153 - DNA, 25 bp, Homo sapien
tctcggctcggccattattctgtgc

SEQ ID NO: 76154 - DNA, 25 bp, Homo sapien
ttattctgtgcctcggctgccggaa

SEQ ID NO: 76155 - DNA, 25 bp, Homo sapien
ggctcgttcctgtgtcatctcctag

SEQ ID NO: 76156 - DNA, 25 bp, Homo sapien
tgggactgcacagccctcggtagcc

SEQ ID NO: 76157 - DNA, 25 bp, Homo sapien
ccggaagggctcgttcctgtgtcat

SEQ ID NO: 76158 - DNA, 25 bp, Homo sapien
cgaggcacttcctgtccggtcattg

SEQ ID NO: 76159 - DNA, 25 bp, Homo sapien
cggtcattgttctcgtgccggtaga

SEQ ID NO: 76160 - DNA, 25 bp, Homo sapien
cgacattggacacccatcgagagga

SEQ ID NO: 76161 - DNA, 25 bp, Homo sapien
ttctcagctgcgcacagtgagtggg

SEQ ID NO: 76162 - DNA, 25 bp, Homo sapien
ctcgtgccggtagaagctgaagtac

SEQ ID NO: 76163 - DNA, 25 bp, Homo sapien
tgaagtaccggtcagccagcctcct

SEQ ID NO: 76164 - DNA, 25 bp, Homo sapien
agaggatgcacacggaccggccaag

SEQ ID NO: 76165 - DNA, 25 bp, Homo sapien
cgagaggaaagcacctccgaggttc

SEQ ID NO: 76166 - DNA, 25 bp, Homo sapien
ggacagaatttcttggggatccttc

SEQ ID NO: 76167 - DNA, 25 bp, Homo sapien
cgtacagtcctcgtgcacccttttt

SEQ ID NO: 76168 - DNA, 25 bp, Homo sapien
ggccgtatttctccctaggctctta

SEQ ID NO: 76169 - DNA, 25 bp, Homo sapien
gaaggcggcccattctggacagaaa

SEQ ID NO: 76170 - DNA, 25 bp, Homo sapien
ggctgcgcagggacaaagtgttcaa

SEQ ID NO: 76171 - DNA, 25 bp, Homo sapien
agcggtgtctgcaccactgaaagtc

SEQ ID NO: 76172 - DNA, 25 bp, Homo sapien
ccacagctctatccaggcggaaggg

SEQ ID NO: 76173 - DNA, 25 bp, Homo sapien
ccgccgcggatctgaacttgaatcc

SEQ ID NO: 76174 - DNA, 25 bp, Homo sapien
ggtctctttcgctcaccagaggcta

SEQ ID NO: 76175 - DNA, 25 bp, Homo sapien
tttcgctcaccagaggctacggggc

SEQ ID NO: 76176 - DNA, 25 bp, Homo sapien
ggatcctctcgcgagcttcagtacc

SEQ ID NO: 76177 - DNA, 25 bp, Homo sapien
cgcgagcttcagtacccaaggaaga

SEQ ID NO: 76178 - DNA, 25 bp, Homo sapien
cagtacccaaggaagatgggccgtc

SEQ ID NO: 76179 - DNA, 25 bp, Homo sapien
tcgccgaccgctctaggaatctcgg

SEQ ID NO: 76180 - DNA, 25 bp, Homo sapien
taggaatctcggaggtcttttgacc

SEQ ID NO: 76181 - DNA, 25 bp, Homo sapien
ggattcccgccagtcactcccgcca

SEQ ID NO: 76182 - DNA, 25 bp, Homo sapien
tccgcggagagtccgtggatctcac

SEQ ID NO: 76183 - DNA, 25 bp, Homo sapien
gtagggcactcctagcggctcggcc

SEQ ID NO: 76184 - DNA, 25 bp, Homo sapien
gagctcgctgctgacgcactaccgg

SEQ ID NO: 76185 - DNA, 25 bp, Homo sapien
gcgccaccattcttccggtttcaga

SEQ ID NO: 76186 - DNA, 25 bp, Homo sapien
ttcagaagttaaggctggtgtcctg

SEQ ID NO: 76187 - DNA, 25 bp, Homo sapien
gagagtccgtggatctcacagtgag

SEQ ID NO: 76188 - DNA, 25 bp, Homo sapien
tgctgcccggacgtagggcactcct

SEQ ID NO: 76189 - DNA, 25 bp, Homo sapien
cttccggtttcagaagttaaggctg

SEQ ID NO: 76190 - DNA, 25 bp, Homo sapien
actgctgacgtcacgccggctgggc

SEQ ID NO: 76191 - DNA, 25 bp, Homo sapien
ttctggtgccggcttaaccggcgca

SEQ ID NO: 76192 - DNA, 25 bp, Homo sapien
aggcgcggactgctgacgtcacgcc

SEQ ID NO: 76193 - DNA, 25 bp, Homo sapien
gttattagccgaggcgcggactgct

SEQ ID NO: 76194 - DNA, 25 bp, Homo sapien
ggcgcagcaccgaaacccgtagctg

SEQ ID NO: 76195 - DNA, 25 bp, Homo sapien
gaggagacggtagtggttattagcc

SEQ ID NO: 76196 - DNA, 25 bp, Homo sapien
cgctcccaccttcctagagaggaga

SEQ ID NO: 76197 - DNA, 25 bp, Homo sapien
cgaaacccgtagctgcgtgcgggaa

SEQ ID NO: 76198 - DNA, 25 bp, Homo sapien
tgtagccgacccgttccttgaagcg

SEQ ID NO: 76199 - DNA, 25 bp, Homo sapien
tggcacccggctgcaaaagtaagtc

SEQ ID NO: 76200 - DNA, 25 bp, Homo sapien
ttccaccggaattgggttcgagcgc

SEQ ID NO: 76201 - DNA, 25 bp, Homo sapien
tgcgcttccgaagaaacacgactgg

SEQ ID NO: 76202 - DNA, 25 bp, Homo sapien
ctcatggtagctctgggtaaagaca

SEQ ID NO: 76203 - DNA, 25 bp, Homo sapien
attcgcgacgatacagaggcgctta

SEQ ID NO: 76204 - DNA, 25 bp, Homo sapien
ggaatcccgctctgtcgctcaaaga

SEQ ID NO: 76205 - DNA, 25 bp, Homo sapien
gccgcacgtacgatacctggttccg

SEQ ID NO: 76206 - DNA, 25 bp, Homo sapien
agtttaccttctaccacagcgtcca

SEQ ID NO: 76207 - DNA, 25 bp, Homo sapien
cggctaagccgcgagaagtttacct

SEQ ID NO: 76208 - DNA, 25 bp, Homo sapien
cgcttttggggcgtattcaactgtc

SEQ ID NO: 76209 - DNA, 25 bp, Homo sapien
acagcgtccacagtacccggcttgg

SEQ ID NO: 76210 - DNA, 25 bp, Homo sapien
cgcgtcacgtgaggctgccatccaa

SEQ ID NO: 76211 - DNA, 25 bp, Homo sapien
gccctctgccgaggcatctcttggt

SEQ ID NO: 76212 - DNA, 25 bp, Homo sapien
caggcacggtgtcagcaggcaacat

SEQ ID NO: 76213 - DNA, 25 bp, Homo sapien
gtattcaactgtctgtgcgccggcg

SEQ ID NO: 76214 - DNA, 25 bp, Homo sapien
cggcgactctccgtttaccttgtga

SEQ ID NO: 76215 - DNA, 25 bp, Homo sapien
aggtgtacatcgtgcatggcgtcca

SEQ ID NO: 76216 - DNA, 25 bp, Homo sapien
ccttgtgattaaacggttctgctgc

SEQ ID NO: 76217 - DNA, 25 bp, Homo sapien
agtctcggaggccttttcttagtga

SEQ ID NO: 76218 - DNA, 25 bp, Homo sapien
gcatttgcagttttgcgggtctata

SEQ ID NO: 76219 - DNA, 25 bp, Homo sapien
tttcttagtgagagagcatcggccc

SEQ ID NO: 76220 - DNA, 25 bp, Homo sapien
tccattcggcgttcgcgcacagatc

SEQ ID NO: 76221 - DNA, 25 bp, Homo sapien
ttcagagctggcaacgtggacgttt

SEQ ID NO: 76222 - DNA, 25 bp, Homo sapien
cgcatcgcctacaagaactgggaga

SEQ ID NO: 76223 - DNA, 25 bp, Homo sapien
gaacgacgccctgtatgagtacctg

SEQ ID NO: 76224 - DNA, 25 bp, Homo sapien
agactgagatcaccgcgcaacccga

SEQ ID NO: 76225 - DNA, 25 bp, Homo sapien
cggccaacggcaagtggttcgacaa

SEQ ID NO: 76226 - DNA, 25 bp, Homo sapien
agctgccctacatctgccagttcgg

SEQ ID NO: 76227 - DNA, 25 bp, Homo sapien
cgcttggagcctctttttgcaaata

SEQ ID NO: 76228 - DNA, 25 bp, Homo sapien
cgaaagctccctccgtgatgaagta

SEQ ID NO: 76229 - DNA, 25 bp, Homo sapien
agaccttccacgaggccagcgagga

SEQ ID NO: 76230 - DNA, 25 bp, Homo sapien
ggacactctcacgtgccgagggcaa

SEQ ID NO: 76231 - DNA, 25 bp, Homo sapien
aatgtccagtctctgcggtggcgca

SEQ ID NO: 76232 - DNA, 25 bp, Homo sapien
aatgcggacgtgaaagcactttttt

SEQ ID NO: 76233 - DNA, 25 bp, Homo sapien
gagccacccgcgcattttgactacg

SEQ ID NO: 76234 - DNA, 25 bp, Homo sapien
caccttggacatgtcgcctgggatc

SEQ ID NO: 76235 - DNA, 25 bp, Homo sapien
gggtgctttcaagaatcccggcaaa

SEQ ID NO: 76236 - DNA, 25 bp, Homo sapien
cgagcctggagaggaaagatctctt

SEQ ID NO: 76237 - DNA, 25 bp, Homo sapien
ccgggcgctttcatttttgcaccaa

SEQ ID NO: 76238 - DNA, 25 bp, Homo sapien
cttgggggtgctcacgctgtcgccc

SEQ ID NO: 76239 - DNA, 25 bp, Homo sapien
cggccgccttgaaggcgctggacgg

SEQ ID NO: 76240 - DNA, 25 bp, Homo sapien
ccgcgagttccgcatgtagtgctcg

SEQ ID NO: 76241 - DNA, 25 bp, Homo sapien
cacgctgtcgcccacccagtagggc

SEQ ID NO: 76242 - DNA, 25 bp, Homo sapien
aagaggccgaagtagccaggcttgg

SEQ ID NO: 76243 - DNA, 25 bp, Homo sapien
acgcagtagtggaagaggccgaagt

SEQ ID NO: 76244 - DNA, 25 bp, Homo sapien
ccgctgcccacgcagtagtggaaga

SEQ ID NO: 76245 - DNA, 25 bp, Homo sapien
ctggatgaagaccaccacgttgatg

SEQ ID NO: 76246 - DNA, 25 bp, Homo sapien
atgggcttacggttcagccgccagc

SEQ ID NO: 76247 - DNA, 25 bp, Homo sapien
tccacaccacgatgaccagggtcat

SEQ ID NO: 76248 - DNA, 25 bp, Homo sapien
accagggtcatgaagcaggccacca

SEQ ID NO: 76249 - DNA, 25 bp, Homo sapien
caccagcgtggactcaatgggctta

SEQ ID NO: 76250 - DNA, 25 bp, Homo sapien
ctaggcagcagaaatgcagcggctc

SEQ ID NO: 76251 - DNA, 25 bp, Homo sapien
ttgactgaagcattggagggcaccc

SEQ ID NO: 76252 - DNA, 25 bp, Homo sapien
tgccgctgcacgctgatgttgcaca

SEQ ID NO: 76253 - DNA, 25 bp, Homo sapien
agcgagctcagcatctgccgctgca

SEQ ID NO: 76254 - DNA, 25 bp, Homo sapien
tgcgtatgtacgcagtactccatca

SEQ ID NO: 76255 - DNA, 25 bp, Homo sapien
gcggagctcgttacgcgctgacaaa

SEQ ID NO: 76256 - DNA, 25 bp, Homo sapien
cgttacgcgctgacaaaggaccctc

SEQ ID NO: 76257 - DNA, 25 bp, Homo sapien
ggaccctcaggataaaacatgcgta

SEQ ID NO: 76258 - DNA, 25 bp, Homo sapien
cgcagtactccatcatgacgtgaga

SEQ ID NO: 76259 - DNA, 25 bp, Homo sapien
actccatcatgacgtgagaaaaccc

SEQ ID NO: 76260 - DNA, 25 bp, Homo sapien
ggtgcaggcttctgttccacagccc

SEQ ID NO: 76261 - DNA, 25 bp, Homo sapien
gcgctgacaaaggaccctcaggata

SEQ ID NO: 76262 - DNA, 25 bp, Homo sapien
gctccttcttcagctcgaaagagta

SEQ ID NO: 76263 - DNA, 25 bp, Homo sapien
tgtgcgccgcagttactaggcaacc

SEQ ID NO: 76264 - DNA, 25 bp, Homo sapien
ctaggcaaccctatcgcagacgcgg

SEQ ID NO: 76265 - DNA, 25 bp, Homo sapien
gccggccaagttcacccaaagttga

SEQ ID NO: 76266 - DNA, 25 bp, Homo sapien
tcccgctcacaggaagaaggtccca

SEQ ID NO: 76267 - DNA, 25 bp, Homo sapien
tgggaacgacgtccacaaagcgctg

SEQ ID NO: 76268 - DNA, 25 bp, Homo sapien
tagtcccgatgaaggtaaattcctc

SEQ ID NO: 76269 - DNA, 25 bp, Homo sapien
gagtggactccgtgtttaatattta

SEQ ID NO: 76270 - DNA, 25 bp, Homo sapien
gttgctgttttgacaacatggcggc

SEQ ID NO: 76271 - DNA, 25 bp, Homo sapien
ccagagcctgtgagcaggtaaaccc

SEQ ID NO: 76272 - DNA, 25 bp, Homo sapien
ccgtctgtctgtgtcgactgcggac

SEQ ID NO: 76273 - DNA, 25 bp, Homo sapien
ctgcggacgctatcgataaagttgc

SEQ ID NO: 76274 - DNA, 25 bp, Homo sapien
ctcgcctaaaggtggagaacgagga

SEQ ID NO: 76275 - DNA, 25 bp, Homo sapien
agccgcaggccagagcctgtgagca

SEQ ID NO: 76276 - DNA, 25 bp, Homo sapien
agagacgaggcccagtctcctcttc

SEQ ID NO: 76277 - DNA, 25 bp, Homo sapien
cgtggcccggcagtgctcgcctaaa

SEQ ID NO: 76278 - DNA, 25 bp, Homo sapien
tcagtctcccgacctgtcaaagagg

SEQ ID NO: 76279 - DNA, 25 bp, Homo sapien
ggtccctctacgaataacgagccta

SEQ ID NO: 76280 - DNA, 25 bp, Homo sapien
tacgttggcatgttgggcatttccc

SEQ ID NO: 76281 - DNA, 25 bp, Homo sapien
cgggctcccatctacgctttgctgg

SEQ ID NO: 76282 - DNA, 25 bp, Homo sapien
cgcgcaggcacaacgagactttctt

SEQ ID NO: 76283 - DNA, 25 bp, Homo sapien
tagggcacgtgcttttactgctgca

SEQ ID NO: 76284 - DNA, 25 bp, Homo sapien
cggcgtcctcgaaagtcctcgcaaa

SEQ ID NO: 76285 - DNA, 25 bp, Homo sapien
aagtcccgtgcagtcccagtgctag

SEQ ID NO: 76286 - DNA, 25 bp, Homo sapien
gattacctgaggtcttcttacggta

SEQ ID NO: 76287 - DNA, 25 bp, Homo sapien
cgattgagtgattggttaacggaca

SEQ ID NO: 76288 - DNA, 25 bp, Homo sapien
cgagtccctttaggccgcagacgtt

SEQ ID NO: 76289 - DNA, 25 bp, Homo sapien
gtccaagtcgcgcatccatacaatg

SEQ ID NO: 76290 - DNA, 25 bp, Homo sapien
tgcagattctgacgctttgtggacc

SEQ ID NO: 76291 - DNA, 25 bp, Homo sapien
gcagccgcaccgcaggttttcttcg

SEQ ID NO: 76292 - DNA, 25 bp, Homo sapien
tttcgcgccttctcgggtgtccaag

SEQ ID NO: 76293 - DNA, 25 bp, Homo sapien
cggacagtgtccgatgactcatata

SEQ ID NO: 76294 - DNA, 25 bp, Homo sapien
ccgagtagccataggccgggaacca

SEQ ID NO: 76295 - DNA, 25 bp, Homo sapien
tccgggtaccaacgatccattttgc

SEQ ID NO: 76296 - DNA, 25 bp, Homo sapien
cttgcttgcgcactaatttgtcctc

SEQ ID NO: 76297 - DNA, 25 bp, Homo sapien
cccacggctgaagagagaagctgcc

SEQ ID NO: 76298 - DNA, 25 bp, Homo sapien
gggcttctgagtcccggattgcaga

SEQ ID NO: 76299 - DNA, 25 bp, Homo sapien
tcggcgttatgatgcggcccttcag

SEQ ID NO: 76300 - DNA, 25 bp, Homo sapien
gagctcctcgcatttaccggttttc

SEQ ID NO: 76301 - DNA, 25 bp, Homo sapien
gcatctctcgcgtgctcttgcttgc

SEQ ID NO: 76302 - DNA, 25 bp, Homo sapien
tttcttcaggctgcggaactcctcg

SEQ ID NO: 76303 - DNA, 25 bp, Homo sapien
cgggtctgtaacttcggacaaatca

SEQ ID NO: 76304 - DNA, 25 bp, Homo sapien
cctcagtgtgccgttctgtaacttg

SEQ ID NO: 76305 - DNA, 25 bp, Homo sapien
ctccgccgtacatctggcacaggta

SEQ ID NO: 76306 - DNA, 25 bp, Homo sapien
cgccgacgcagctagctggttttta

SEQ ID NO: 76307 - DNA, 25 bp, Homo sapien
gctaatctcattaacggcgcgcccg

SEQ ID NO: 76308 - DNA, 25 bp, Homo sapien
tcctgggaacactcccgggtctgta

SEQ ID NO: 76309 - DNA, 25 bp, Homo sapien
ggacaaatcacgctcgctttcccgg

SEQ ID NO: 76310 - DNA, 25 bp, Homo sapien
tcggttactcaccatggcggcaggc

SEQ ID NO: 76311 - DNA, 25 bp, Homo sapien
gccagttcacttttgggagctgact

SEQ ID NO: 76312 - DNA, 25 bp, Homo sapien
gcgtaaccggttgactgccacatgc

SEQ ID NO: 76313 - DNA, 25 bp, Homo sapien
ttggtcctcaggatcacgcgacagg

SEQ ID NO: 76314 - DNA, 25 bp, Homo sapien
gaagcctctggttgctaacggaaac

SEQ ID NO: 76315 - DNA, 25 bp, Homo sapien
aacgaggccacgtaatcattccggg

SEQ ID NO: 76316 - DNA, 25 bp, Homo sapien
cttgggctgcggttaaccgaatctc

SEQ ID NO: 76317 - DNA, 25 bp, Homo sapien
ccgaggcacgtggactgcaattatg

SEQ ID NO: 76318 - DNA, 25 bp, Homo sapien
ctgtaagggcaacaggtgacaagcc

SEQ ID NO: 76319 - DNA, 25 bp, Homo sapien
gagcgaagctctcgcctcagggatc

SEQ ID NO: 76320 - DNA, 25 bp, Homo sapien
ctcagggatcgtgagcgacccaggt

SEQ ID NO: 76321 - DNA, 25 bp, Homo sapien
ggcacttacgcgctcgtgggtccac

SEQ ID NO: 76322 - DNA, 25 bp, Homo sapien
cgccgggcagaaccgaaactttctg

SEQ ID NO: 76323 - DNA, 25 bp, Homo sapien
ggtgctgacggccatgacgcgcaca

SEQ ID NO: 76324 - DNA, 25 bp, Homo sapien
tgaggcctgcaactcccatcggact

SEQ ID NO: 76325 - DNA, 25 bp, Homo sapien
ccatgacgcgcacaccaagagggtg

SEQ ID NO: 76326 - DNA, 25 bp, Homo sapien
ggaccaaagcgcctagcagacaggg

SEQ ID NO: 76327 - DNA, 25 bp, Homo sapien
ccggacacagggaccaaagcgccta

SEQ ID NO: 76328 - DNA, 25 bp, Homo sapien
aaacgaaggctctgccacttgcgcc

SEQ ID NO: 76329 - DNA, 25 bp, Homo sapien
ggcgacttggcaaacgaaggctctg

SEQ ID NO: 76330 - DNA, 25 bp, Homo sapien
gtctggaggcgacttggcaaacgaa

SEQ ID NO: 76331 - DNA, 25 bp, Homo sapien
acaagtttcatgtctgcggtctgga

SEQ ID NO: 76332 - DNA, 25 bp, Homo sapien
caggacgaggaagacaagtttcatg

SEQ ID NO: 76333 - DNA, 25 bp, Homo sapien
cagccaaccggacacagggaccaaa

SEQ ID NO: 76334 - DNA, 25 bp, Homo sapien
gaggctgtttacacccgctgagcag

SEQ ID NO: 76335 - DNA, 25 bp, Homo sapien
gccggaagaagcctcccgtgcctgt

SEQ ID NO: 76336 - DNA, 25 bp, Homo sapien
gtacgcgcaggggaactgctaagcc

SEQ ID NO: 76337 - DNA, 25 bp, Homo sapien
ccaccatagtcctggacctcagata

SEQ ID NO: 76338 - DNA, 25 bp, Homo sapien
cagataacggtggatgcctaagccc

SEQ ID NO: 76339 - DNA, 25 bp, Homo sapien
cggcagattgcaggtcaccaaggca

SEQ ID NO: 76340 - DNA, 25 bp, Homo sapien
gctaagccggagcaagattcactcg

SEQ ID NO: 76341 - DNA, 25 bp, Homo sapien
aggattaaacaactgagcgcccggg

SEQ ID NO: 76342 - DNA, 25 bp, Homo sapien
gcctccatcttgctcgggttctccc

SEQ ID NO: 76343 - DNA, 25 bp, Homo sapien
ctgggactgctggacacggggcgag

SEQ ID NO: 76344 - DNA, 25 bp, Homo sapien
gtaggctggagggagcctaggattg

SEQ ID NO: 76345 - DNA, 25 bp, Homo sapien
agggagcctaggattggcgggccag

SEQ ID NO: 76346 - DNA, 25 bp, Homo sapien
gactggcacggcctaggcgccgcgg

SEQ ID NO: 76347 - DNA, 25 bp, Homo sapien
aagggtgctcctggttctggcagtt

SEQ ID NO: 76348 - DNA, 25 bp, Homo sapien
agggggggctgtcctcagaagccag

SEQ ID NO: 76349 - DNA, 25 bp, Homo sapien
accaacctgggcacggccggaggca

SEQ ID NO: 76350 - DNA, 25 bp, Homo sapien
acgggtttgattagagcgcgctgtc

SEQ ID NO: 76351 - DNA, 25 bp, Homo sapien
gaactcgggcccaaggatgcccgtg

SEQ ID NO: 76352 - DNA, 25 bp, Homo sapien
tcggcgggcaaagaccggcctcaaa

SEQ ID NO: 76353 - DNA, 25 bp, Homo sapien
agaagcttatcggacacgggtttga

SEQ ID NO: 76354 - DNA, 25 bp, Homo sapien
aggctccttgtacaggccttggagg

SEQ ID NO: 76355 - DNA, 25 bp, Homo sapien
agtggccaaggtagcgcctttccca

SEQ ID NO: 76356 - DNA, 25 bp, Homo sapien
caaccttgaccgtgcgctaagaggc

SEQ ID NO: 76357 - DNA, 25 bp, Homo sapien
gaggtctcttttaattagaagctta

SEQ ID NO: 76358 - DNA, 25 bp, Homo sapien
aggctgagataaattcccgtgattg

SEQ ID NO: 76359 - DNA, 25 bp, Homo sapien
cggctcccgcgtcctttcaggaatt

SEQ ID NO: 76360 - DNA, 25 bp, Homo sapien
tttttcctggaacaggccggcactc

SEQ ID NO: 76361 - DNA, 25 bp, Homo sapien
gaaatggcctcccatgccggactgc

SEQ ID NO: 76362 - DNA, 25 bp, Homo sapien
cctgcaagcggcacatcagagtccg

SEQ ID NO: 76363 - DNA, 25 bp, Homo sapien
cgtctggcacttagtggaaccactc

SEQ ID NO: 76364 - DNA, 25 bp, Homo sapien
tcatagacgcgcctctccatctggg

SEQ ID NO: 76365 - DNA, 25 bp, Homo sapien
ccggactgccgtggttctagaactt

SEQ ID NO: 76366 - DNA, 25 bp, Homo sapien
gttcgtggaacttggagcctgtaga

SEQ ID NO: 76367 - DNA, 25 bp, Homo sapien
tgccatgccgctcccatgcgaaaag

SEQ ID NO: 76368 - DNA, 25 bp, Homo sapien
acgacgctgtgagcggggtatctta

SEQ ID NO: 76369 - DNA, 25 bp, Homo sapien
tatcttacgagggactcggacggcc

SEQ ID NO: 76370 - DNA, 25 bp, Homo sapien
cccacctggacgagctaagcgtgga

SEQ ID NO: 76371 - DNA, 25 bp, Homo sapien
tggagcgcagacacccgtccgcaga

SEQ ID NO: 76372 - DNA, 25 bp, Homo sapien
tcacagaagccagcacacgcggagc

SEQ ID NO: 76373 - DNA, 25 bp, Homo sapien
cgcccttacctgagcgctgtggttg

SEQ ID NO: 76374 - DNA, 25 bp, Homo sapien
atgctcgctgactacccgtggccaa

SEQ ID NO: 76375 - DNA, 25 bp, Homo sapien
aatgatgctcgctgactacccgtgg

SEQ ID NO: 76376 - DNA, 25 bp, Homo sapien
gctcgctgactacccgtggccaaag

SEQ ID NO: 76377 - DNA, 25 bp, Homo sapien
gcaagcggcgcggtggcacgaagat

SEQ ID NO: 76378 - DNA, 25 bp, Homo sapien
ataaatgatgctcgctgactacccg

SEQ ID NO: 76379 - DNA, 25 bp, Homo sapien
cgcgggaacctgacaccgaggatga

SEQ ID NO: 76380 - DNA, 25 bp, Homo sapien
ggatgaataaatgatgctcgctgac

SEQ ID NO: 76381 - DNA, 25 bp, Homo sapien
caccgaggatgaataaatgatgctc

SEQ ID NO: 76382 - DNA, 25 bp, Homo sapien
cgccacggcgctcgtggtgtctgac

SEQ ID NO: 76383 - DNA, 25 bp, Homo sapien
gactgcgtctctccggaaggcgctc

SEQ ID NO: 76384 - DNA, 25 bp, Homo sapien
tggcagccgactgcgtctctccgga

SEQ ID NO: 76385 - DNA, 25 bp, Homo sapien
tgcagacctcagcaacagaagcagc

SEQ ID NO: 76386 - DNA, 25 bp, Homo sapien
agggactcacctgcagacctcagca

SEQ ID NO: 76387 - DNA, 25 bp, Homo sapien
cagcaacctgcggaggacgtcgagc

SEQ ID NO: 76388 - DNA, 25 bp, Homo sapien
tgttggccgcatgccgcggcctctg

SEQ ID NO: 76389 - DNA, 25 bp, Homo sapien
ctcgtggtgtctgacccgcaagggc

SEQ ID NO: 76390 - DNA, 25 bp, Homo sapien
tggtagggacattagccacggtgtc

SEQ ID NO: 76391 - DNA, 25 bp, Homo sapien
ccgcactgtagcacgtgatggcgcc

SEQ ID NO: 76392 - DNA, 25 bp, Homo sapien
ccggcatgtgcctggcgtctgcaca

SEQ ID NO: 76393 - DNA, 25 bp, Homo sapien
aggctcgaccgtgagacggccatga

SEQ ID NO: 76394 - DNA, 25 bp, Homo sapien
taagatcctggaatcgccctggcga

SEQ ID NO: 76395 - DNA, 25 bp, Homo sapien
cagcgaaaggggttcccgcaccgct

SEQ ID NO: 76396 - DNA, 25 bp, Homo sapien
cgtctgcacacgtgaccgcactgta

SEQ ID NO: 76397 - DNA, 25 bp, Homo sapien
ccacggtgtccagactggcagcgaa

SEQ ID NO: 76398 - DNA, 25 bp, Homo sapien
tcccagcctcactgagcaggggttg

SEQ ID NO: 76399 - DNA, 25 bp, Homo sapien
acccgcggcgaacaggagctggcct

SEQ ID NO: 76400 - DNA, 25 bp, Homo sapien
gctcacctggtgaagacggggaccc

SEQ ID NO: 76401 - DNA, 25 bp, Homo sapien
gtgcacaggagacgtccgggcttct

SEQ ID NO: 76402 - DNA, 25 bp, Homo sapien
ggcaccgtcagcacgcctcgtggtg

SEQ ID NO: 76403 - DNA, 25 bp, Homo sapien
ttgccggggtcattctggaatcctc

SEQ ID NO: 76404 - DNA, 25 bp, Homo sapien
ctcctcgggtcggtatggctcacct

SEQ ID NO: 76405 - DNA, 25 bp, Homo sapien
ggttgaaggaactgaagccagatca

SEQ ID NO: 76406 - DNA, 25 bp, Homo sapien
ttccacgccggccatgggttctggc

SEQ ID NO: 76407 - DNA, 25 bp, Homo sapien
cgggcctcttcgagccatggctgaa

SEQ ID NO: 76408 - DNA, 25 bp, Homo sapien
tcgagccatggctgaagaagcaaga

SEQ ID NO: 76409 - DNA, 25 bp, Homo sapien
tgaagaagcaagaaccaggccagga

SEQ ID NO: 76410 - DNA, 25 bp, Homo sapien
tgccgctctgggacgccatggatac

SEQ ID NO: 76411 - DNA, 25 bp, Homo sapien
ggaagagcagtgctacgcctccctg

SEQ ID NO: 76412 - DNA, 25 bp, Homo sapien
gccatggatactgccggcgacctca

SEQ ID NO: 76413 - DNA, 25 bp, Homo sapien
gttctggcggcaacttggagcgccc

SEQ ID NO: 76414 - DNA, 25 bp, Homo sapien
cggtcctgctagattccttgtctga

SEQ ID NO: 76415 - DNA, 25 bp, Homo sapien
tggaaatggccgagccgacttgttg

SEQ ID NO: 76416 - DNA, 25 bp, Homo sapien
gccgccagaggacatgtcatggata

SEQ ID NO: 76417 - DNA, 25 bp, Homo sapien
cagtgagtcacctggaaaggacgta

SEQ ID NO: 76418 - DNA, 25 bp, Homo sapien
tcggccacacactggggtgaggata

SEQ ID NO: 76419 - DNA, 25 bp, Homo sapien
cccacgattctcagaggggttcggc

SEQ ID NO: 76420 - DNA, 25 bp, Homo sapien
ccgctcctcacctggaaatgcagtg

SEQ ID NO: 76421 - DNA, 25 bp, Homo sapien
gcactccggcttcactgtgagtttt

SEQ ID NO: 76422 - DNA, 25 bp, Homo sapien
atgcgtcgctggtgtcaccgtgtgt

SEQ ID NO: 76423 - DNA, 25 bp, Homo sapien
cagcatgcgtcgctggtgtcaccgt

SEQ ID NO: 76424 - DNA, 25 bp, Homo sapien
cggccaccagcatgcgtcgctggtg

SEQ ID NO: 76425 - DNA, 25 bp, Homo sapien
gagtgtgtatcactggcgcgtcgcc

SEQ ID NO: 76426 - DNA, 25 bp, Homo sapien
cgcggctgtgaagggaacagaacac

SEQ ID NO: 76427 - DNA, 25 bp, Homo sapien
tccacgcggctgtgaagggaacaga

SEQ ID NO: 76428 - DNA, 25 bp, Homo sapien
gctgcggtttccacgcggctgtgaa

SEQ ID NO: 76429 - DNA, 25 bp, Homo sapien
ggctgtgaagggaacagaacacaga

SEQ ID NO: 76430 - DNA, 25 bp, Homo sapien
agtcgcggagctaaaaataacagtc

SEQ ID NO: 76431 - DNA, 25 bp, Homo sapien
ggtatcccgagagctccatgaagtc

SEQ ID NO: 76432 - DNA, 25 bp, Homo sapien
tcggtggcttttttggaaacttgca

SEQ ID NO: 76433 - DNA, 25 bp, Homo sapien
ccgctggaagaactgaggccaaggc

SEQ ID NO: 76434 - DNA, 25 bp, Homo sapien
cagacaggcagaccgacagagcgtc

SEQ ID NO: 76435 - DNA, 25 bp, Homo sapien
cctaagggctcagtgtggctgcaaa

SEQ ID NO: 76436 - DNA, 25 bp, Homo sapien
tggctgcaaagttgagatcgcaccc

SEQ ID NO: 76437 - DNA, 25 bp, Homo sapien
ccctacgccgaaagtcgcggagcta

SEQ ID NO: 76438 - DNA, 25 bp, Homo sapien
ggtgctcctggacattttagcgctg

SEQ ID NO: 76439 - DNA, 25 bp, Homo sapien
cggaatctctcggactctaaggggc

SEQ ID NO: 76440 - DNA, 25 bp, Homo sapien
atcctcacggcccttgggaagcagc

SEQ ID NO: 76441 - DNA, 25 bp, Homo sapien
ggcctacttaccctgattgcgaata

SEQ ID NO: 76442 - DNA, 25 bp, Homo sapien
actggaggtgcatgtgctcattcta

SEQ ID NO: 76443 - DNA, 25 bp, Homo sapien
gctatccacggacacgacgctgttc

SEQ ID NO: 76444 - DNA, 25 bp, Homo sapien
cgacgctgttccagaaagccattta

SEQ ID NO: 76445 - DNA, 25 bp, Homo sapien
aagcgctacgcttggtgacaatttg

SEQ ID NO: 76446 - DNA, 25 bp, Homo sapien
cagctggctagatgcctggcaagga

SEQ ID NO: 76447 - DNA, 25 bp, Homo sapien
cccatactcgactcctgctcgcctg

SEQ ID NO: 76448 - DNA, 25 bp, Homo sapien
tcgccacccgcccaagctgcgagcc

SEQ ID NO: 76449 - DNA, 25 bp, Homo sapien
ggatctaggctagggcagtcgccac

SEQ ID NO: 76450 - DNA, 25 bp, Homo sapien
gctcaacgtcaccttcgactcggtg

SEQ ID NO: 76451 - DNA, 25 bp, Homo sapien
acgggcgccagctggctagatgcct

SEQ ID NO: 76452 - DNA, 25 bp, Homo sapien
tggaatgaaggtcacgtgcccgacg

SEQ ID NO: 76453 - DNA, 25 bp, Homo sapien
aacgtcaccttcgactcggtggcgc

SEQ ID NO: 76454 - DNA, 25 bp, Homo sapien
gacgcggtcaattaacttctccctg

SEQ ID NO: 76455 - DNA, 25 bp, Homo sapien
cgccctatgcccagaaatacatgtg

SEQ ID NO: 76456 - DNA, 25 bp, Homo sapien
gtgcatgctcacaaacacgtccggc

SEQ ID NO: 76457 - DNA, 25 bp, Homo sapien
tcgcgtcccatactgacaggctgga

SEQ ID NO: 76458 - DNA, 25 bp, Homo sapien
tctccatgtgagaacgcgcacggac

SEQ ID NO: 76459 - DNA, 25 bp, Homo sapien
ggccactcgagaatgcgctgccact

SEQ ID NO: 76460 - DNA, 25 bp, Homo sapien
ggctccgctaagtggaaccagcaga

SEQ ID NO: 76461 - DNA, 25 bp, Homo sapien
ggccgagccaattggagactccttg

SEQ ID NO: 76462 - DNA, 25 bp, Homo sapien
cgccacgcttgatgaggctgagcgc

SEQ ID NO: 76463 - DNA, 25 bp, Homo sapien
gcaactacatccacatgcacctgtt

SEQ ID NO: 76464 - DNA, 25 bp, Homo sapien
tgttcctgtccttcatgctgcgcgc

SEQ ID NO: 76465 - DNA, 25 bp, Homo sapien
tactctggcgccacgcttgatgagg

SEQ ID NO: 76466 - DNA, 25 bp, Homo sapien
gcgccgtgagcatcttcgtcaagga

SEQ ID NO: 76467 - DNA, 25 bp, Homo sapien
tcgtcaaggacgctgtgctctactc

SEQ ID NO: 76468 - DNA, 25 bp, Homo sapien
ggctgcactgcacgcgcaactacat

SEQ ID NO: 76469 - DNA, 25 bp, Homo sapien
gacgctgtgctctactctggcgcca

SEQ ID NO: 76470 - DNA, 25 bp, Homo sapien
tttctcccgtcttgcatcgcgcagg

SEQ ID NO: 76471 - DNA, 25 bp, Homo sapien
accagccgtagttgcctccatcttg

SEQ ID NO: 76472 - DNA, 25 bp, Homo sapien
attagccctttgctctcctcaagcg

SEQ ID NO: 76473 - DNA, 25 bp, Homo sapien
cctcggcagctgtctttccttatta

SEQ ID NO: 76474 - DNA, 25 bp, Homo sapien
agcgccagaggagtcccacgccaag

SEQ ID NO: 76475 - DNA, 25 bp, Homo sapien
gtggataaatgtctcgcggccaatc

SEQ ID NO: 76476 - DNA, 25 bp, Homo sapien
gacgaccgcaccagcgccagaggag

SEQ ID NO: 76477 - DNA, 25 bp, Homo sapien
cttgcatcgcgcaggcctaaggaga

SEQ ID NO: 76478 - DNA, 25 bp, Homo sapien
cccttccctgaatggcggcaaatgc

SEQ ID NO: 76479 - DNA, 25 bp, Homo sapien
gattcagaccctggggaagtctgga

SEQ ID NO: 76480 - DNA, 25 bp, Homo sapien
aggctggcccttccaatggcactgg

SEQ ID NO: 76481 - DNA, 25 bp, Homo sapien
cccttccaatggcactggtggggca

SEQ ID NO: 76482 - DNA, 25 bp, Homo sapien
gctgtacgagttgtggctgctctac

SEQ ID NO: 76483 - DNA, 25 bp, Homo sapien
acgagttgtggctgctctactacgc

SEQ ID NO: 76484 - DNA, 25 bp, Homo sapien
aatggcggcaaatgcagtcaggcga

SEQ ID NO: 76485 - DNA, 25 bp, Homo sapien
gcgtcctgggcggattcagaccctg

SEQ ID NO: 76486 - DNA, 25 bp, Homo sapien
cgatctcttcatggggtcgccttcg

SEQ ID NO: 76487 - DNA, 25 bp, Homo sapien
ttcgtcaaagcacgagggccgcctg

SEQ ID NO: 76488 - DNA, 25 bp, Homo sapien
cggcttccaagtcgctgtttcgtca

SEQ ID NO: 76489 - DNA, 25 bp, Homo sapien
cggccgcagcagcactttttgcaca

SEQ ID NO: 76490 - DNA, 25 bp, Homo sapien
tcctcgggagagacggaatacaacc

SEQ ID NO: 76491 - DNA, 25 bp, Homo sapien
ctcggcaataaaccaggcctagttt

SEQ ID NO: 76492 - DNA, 25 bp, Homo sapien
gccgcctgtggccttaattcctaac

SEQ ID NO: 76493 - DNA, 25 bp, Homo sapien
ggcctagttttgtagctgctccgtc

SEQ ID NO: 76494 - DNA, 25 bp, Homo sapien
gagacacccgagacatcagccttct

SEQ ID NO: 76495 - DNA, 25 bp, Homo sapien
aaacagcaggcgacgtcgggagaac

SEQ ID NO: 76496 - DNA, 25 bp, Homo sapien
ctaccgtgtcacagctggcgactga

SEQ ID NO: 76497 - DNA, 25 bp, Homo sapien
tgtggctctccggaacaataaaccc

SEQ ID NO: 76498 - DNA, 25 bp, Homo sapien
cgaggccaccgtgggcctgttactc

SEQ ID NO: 76499 - DNA, 25 bp, Homo sapien
tgcagctgcttcatcgggagcggct

SEQ ID NO: 76500 - DNA, 25 bp, Homo sapien
gatacttactcaggggtcgggtgct

SEQ ID NO: 76501 - DNA, 25 bp, Homo sapien
ggccgcggagctgatacttactcag

SEQ ID NO: 76502 - DNA, 25 bp, Homo sapien
ttagctccgaagaccgtaagccgcg

SEQ ID NO: 76503 - DNA, 25 bp, Homo sapien
gctgtgtacatagtcgccatggcaa

SEQ ID NO: 76504 - DNA, 25 bp, Homo sapien
tcggcggatgcacatgcgaagtcaa

SEQ ID NO: 76505 - DNA, 25 bp, Homo sapien
aggatctggtgcacttctccgtgtc

SEQ ID NO: 76506 - DNA, 25 bp, Homo sapien
ctccgtgtctgagttgcctagtcgc

SEQ ID NO: 76507 - DNA, 25 bp, Homo sapien
ccctttgtgggaccaatgaacatta

SEQ ID NO: 76508 - DNA, 25 bp, Homo sapien
tgaccctcaaggtaccgcggactgg

SEQ ID NO: 76509 - DNA, 25 bp, Homo sapien
agccgcggtcaggttgaaaggactc

SEQ ID NO: 76510 - DNA, 25 bp, Homo sapien
cgtggccaatctgcacgggagaatg

SEQ ID NO: 76511 - DNA, 25 bp, Homo sapien
gtaaccaggctaaagccgccggcga

SEQ ID NO: 76512 - DNA, 25 bp, Homo sapien
ggagaatgcttcacgctgggccatt

SEQ ID NO: 76513 - DNA, 25 bp, Homo sapien
cgcaaataccgcgtgaagaattccc

SEQ ID NO: 76514 - DNA, 25 bp, Homo sapien
ccgagtgtcaggaatcgcaaatacc

SEQ ID NO: 76515 - DNA, 25 bp, Homo sapien
ccgggatctttgttggaaccgagtg

SEQ ID NO: 76516 - DNA, 25 bp, Homo sapien
tgaccctcggttgcaacaaagaccc

SEQ ID NO: 76517 - DNA, 25 bp, Homo sapien
gggccatttgcggttcctgaccctc

SEQ ID NO: 76518 - DNA, 25 bp, Homo sapien
ccgcgcctctcagtttagtggatga

SEQ ID NO: 76519 - DNA, 25 bp, Homo sapien
ctgaccgtgcggattcttttgctgc

SEQ ID NO: 76520 - DNA, 25 bp, Homo sapien
gtcctccacggctcttgacaatacg

SEQ ID NO: 76521 - DNA, 25 bp, Homo sapien
tccgcgcgaagaagactgagcatgc

SEQ ID NO: 76522 - DNA, 25 bp, Homo sapien
cggcaggccgctggcatttttcatt

SEQ ID NO: 76523 - DNA, 25 bp, Homo sapien
tgcccatgatctggctggacctgaa

SEQ ID NO: 76524 - DNA, 25 bp, Homo sapien
aggaggccggtgactttcacttcca

SEQ ID NO: 76525 - DNA, 25 bp, Homo sapien
gagtcatccgctgttcccactgagg

SEQ ID NO: 76526 - DNA, 25 bp, Homo sapien
ccatggcggccaaaaagatcctgta

SEQ ID NO: 76527 - DNA, 25 bp, Homo sapien
tttctacaagtatttccgggatgag

SEQ ID NO: 76528 - DNA, 25 bp, Homo sapien
cgcggcttctccgacaaggacaaga

SEQ ID NO: 76529 - DNA, 25 bp, Homo sapien
gccaggtggacttcgccttcttcat

SEQ ID NO: 76530 - DNA, 25 bp, Homo sapien
ctccgtgaagatcaccaagcgcttc

SEQ ID NO: 76531 - DNA, 25 bp, Homo sapien
cgctgcgcccagagtacaagaagaa

SEQ ID NO: 76532 - DNA, 25 bp, Homo sapien
gctgtggtcccgtagaggaaactga

SEQ ID NO: 76533 - DNA, 25 bp, Homo sapien
tggctgacctgatcctggaccagtg

SEQ ID NO: 76534 - DNA, 25 bp, Homo sapien
acacgcagacgtggcctgccaggca

SEQ ID NO: 76535 - DNA, 25 bp, Homo sapien
gcatagccgtagtcgtcgcagggca

SEQ ID NO: 76536 - DNA, 25 bp, Homo sapien
acaagcggcacgatctccgtctcgg

SEQ ID NO: 76537 - DNA, 25 bp, Homo sapien
caccaagacgatgccggtggccagg

SEQ ID NO: 76538 - DNA, 25 bp, Homo sapien
cactcgatgtcctgcagaagcccgg

SEQ ID NO: 76539 - DNA, 25 bp, Homo sapien
cgcggaatgcgcgttaggcaatccc

SEQ ID NO: 76540 - DNA, 25 bp, Homo sapien
agctgcccgtagttgcgcgggcata

SEQ ID NO: 76541 - DNA, 25 bp, Homo sapien
ctgctcaccatgaggtggccgcgca

SEQ ID NO: 76542 - DNA, 25 bp, Homo sapien
cgcagatgggcttctgagcagctca

SEQ ID NO: 76543 - DNA, 25 bp, Homo sapien
ggattccttggcttccctcagcact

SEQ ID NO: 76544 - DNA, 25 bp, Homo sapien
caacccatgtgcgttggtgacgtca

SEQ ID NO: 76545 - DNA, 25 bp, Homo sapien
tttacaccggggtcactcgagagct

SEQ ID NO: 76546 - DNA, 25 bp, Homo sapien
ggaatggtttttctctgcaggttta

SEQ ID NO: 76547 - DNA, 25 bp, Homo sapien
ccacccgcttccgtggaatggaatg

SEQ ID NO: 76548 - DNA, 25 bp, Homo sapien
ccagagcgttttcctaagtcgaggc

SEQ ID NO: 76549 - DNA, 25 bp, Homo sapien
ttttcactgggccttgtcgccagca

SEQ ID NO: 76550 - DNA, 25 bp, Homo sapien
cagtggcctccctggtggatagaag

SEQ ID NO: 76551 - DNA, 25 bp, Homo sapien
atcacgcggtatcagccagtggcct

SEQ ID NO: 76552 - DNA, 25 bp, Homo sapien
attggccagagtcggagtaaacatc

SEQ ID NO: 76553 - DNA, 25 bp, Homo sapien
tccagagctccgattggccagagtc

SEQ ID NO: 76554 - DNA, 25 bp, Homo sapien
tcagtaccgggccaaggatggcagc

SEQ ID NO: 76555 - DNA, 25 bp, Homo sapien
ttcaggcaaccagccgcctcaggag

SEQ ID NO: 76556 - DNA, 25 bp, Homo sapien
cccgcttgaggcacactgaggggac

SEQ ID NO: 76557 - DNA, 25 bp, Homo sapien
tggatagaaggatcgctctgcgccg

SEQ ID NO: 76558 - DNA, 25 bp, Homo sapien
cgcatgcgtagtcgaaccacattcg

SEQ ID NO: 76559 - DNA, 25 bp, Homo sapien
acattcgcgtctcccgttcgccctc

SEQ ID NO: 76560 - DNA, 25 bp, Homo sapien
cgtgcgcatgcgtagtcgaaccaca

SEQ ID NO: 76561 - DNA, 25 bp, Homo sapien
tgagcacccgcgtgacggtacctgt

SEQ ID NO: 76562 - DNA, 25 bp, Homo sapien
tgacggtacctgtggtggcagcacc

SEQ ID NO: 76563 - DNA, 25 bp, Homo sapien
ctccttgccggcctgcggtctccag

SEQ ID NO: 76564 - DNA, 25 bp, Homo sapien
ccattccggaactcccagctccacg

SEQ ID NO: 76565 - DNA, 25 bp, Homo sapien
ggcagcacctcccaagctgcggcgg

SEQ ID NO: 76566 - DNA, 25 bp, Homo sapien
ccacagccaatgaggcgggtgcctc

SEQ ID NO: 76567 - DNA, 25 bp, Homo sapien
tggtaggaaacgatgggcttctctg

SEQ ID NO: 76568 - DNA, 25 bp, Homo sapien
cgaacattccgagctcctgggacta

SEQ ID NO: 76569 - DNA, 25 bp, Homo sapien
cgggtcgatcctctgcggactacaa

SEQ ID NO: 76570 - DNA, 25 bp, Homo sapien
tgccacttttgcgagccagccacag

SEQ ID NO: 76571 - DNA, 25 bp, Homo sapien
gcctcccggatgcagtattccgctg

SEQ ID NO: 76572 - DNA, 25 bp, Homo sapien
tggagagcaaaacacacccgacagc

SEQ ID NO: 76573 - DNA, 25 bp, Homo sapien
cgttgagaatatgcgagatggccca

SEQ ID NO: 76574 - DNA, 25 bp, Homo sapien
agcctgccaggggaacagacagacc

SEQ ID NO: 76575 - DNA, 25 bp, Homo sapien
cagctcggcccacccataagtctca

SEQ ID NO: 76576 - DNA, 25 bp, Homo sapien
tctcaccctcgggaacccaccctga

SEQ ID NO: 76577 - DNA, 25 bp, Homo sapien
cacctcctgggaccattccgccgcc

SEQ ID NO: 76578 - DNA, 25 bp, Homo sapien
ttgccacagctcacagctccacctg

SEQ ID NO: 76579 - DNA, 25 bp, Homo sapien
ggcgcagtcatacctacccggcacg

SEQ ID NO: 76580 - DNA, 25 bp, Homo sapien
cctcagcccacgatgggcagcgcga

SEQ ID NO: 76581 - DNA, 25 bp, Homo sapien
cccttggtcagcctgccaggggaac

SEQ ID NO: 76582 - DNA, 25 bp, Homo sapien
cttcttgtagtgcttgcccagccag

SEQ ID NO: 76583 - DNA, 25 bp, Homo sapien
cgcgaacccaccttcttgtagtgct

SEQ ID NO: 76584 - DNA, 25 bp, Homo sapien
tgcctttgttgtccctcgtggcgtg

SEQ ID NO: 76585 - DNA, 25 bp, Homo sapien
caccttcttgtagtgcttgcccagc

SEQ ID NO: 76586 - DNA, 25 bp, Homo sapien
agacccgcaccgaatccagctggga

SEQ ID NO: 76587 - DNA, 25 bp, Homo sapien
agctgggacaccgtctccgggctct

SEQ ID NO: 76588 - DNA, 25 bp, Homo sapien
ctccgggctctcccaaaacttggtg

SEQ ID NO: 76589 - DNA, 25 bp, Homo sapien
gcctgcctttgttgtccctcgtggc

SEQ ID NO: 76590 - DNA, 25 bp, Homo sapien
gctggagggaaaaggcctggtgcga

SEQ ID NO: 76591 - DNA, 25 bp, Homo sapien
cctgcacccggactgggactgcgcc

SEQ ID NO: 76592 - DNA, 25 bp, Homo sapien
tggccgagggccctgcacccggact

SEQ ID NO: 76593 - DNA, 25 bp, Homo sapien
ctgtctagggtatcgagtgctggcc

SEQ ID NO: 76594 - DNA, 25 bp, Homo sapien
aaagcctgtctagggtatcgagtgc

SEQ ID NO: 76595 - DNA, 25 bp, Homo sapien
caagggaaagcctgtctagggtatc

SEQ ID NO: 76596 - DNA, 25 bp, Homo sapien
tggtgcgagaaatgcccaagggaaa

SEQ ID NO: 76597 - DNA, 25 bp, Homo sapien
cctggtgcgagaaatgcccaaggga

SEQ ID NO: 76598 - DNA, 25 bp, Homo sapien
tttgagccttgctcttccctcgcta

SEQ ID NO: 76599 - DNA, 25 bp, Homo sapien
tagtgagcgccggtttttgagcctt

SEQ ID NO: 76600 - DNA, 25 bp, Homo sapien
gccatcctccgtaggctgcattctg

SEQ ID NO: 76601 - DNA, 25 bp, Homo sapien
gtgcggccgtgccttggaatagcac

SEQ ID NO: 76602 - DNA, 25 bp, Homo sapien
tggaatagcacgtcctgcggcctca

SEQ ID NO: 76603 - DNA, 25 bp, Homo sapien
gcgcacgcgcatgcgtagcactcgt

SEQ ID NO: 76604 - DNA, 25 bp, Homo sapien
cctcgctaccgacgtcgaatcatta

SEQ ID NO: 76605 - DNA, 25 bp, Homo sapien
tgggttatgtgtcatagcccgcctc

SEQ ID NO: 76606 - DNA, 25 bp, Homo sapien
gcggtgcacagaggcttgtttcaca

SEQ ID NO: 76607 - DNA, 25 bp, Homo sapien
caacaggtgaattgggctttttatt

SEQ ID NO: 76608 - DNA, 25 bp, Homo sapien
gtcgccgagaaaggcagcaacttga

SEQ ID NO: 76609 - DNA, 25 bp, Homo sapien
ccgctttcacactgcaggcagctaa

SEQ ID NO: 76610 - DNA, 25 bp, Homo sapien
tcgcagagggcgagaagacccttcc

SEQ ID NO: 76611 - DNA, 25 bp, Homo sapien
cccgggctgtttattcgcatcagga

SEQ ID NO: 76612 - DNA, 25 bp, Homo sapien
gctcagccatgacccgggctgttta

SEQ ID NO: 76613 - DNA, 25 bp, Homo sapien
agaggccgcttcattggcgcaacga

SEQ ID NO: 76614 - DNA, 25 bp, Homo sapien
ctaggagactcatggcgctggccgc

SEQ ID NO: 76615 - DNA, 25 bp, Homo sapien
ggccaagttcgccatccgtcggcgg

SEQ ID NO: 76616 - DNA, 25 bp, Homo sapien
agcgcccttgactcctgggatggca

SEQ ID NO: 76617 - DNA, 25 bp, Homo sapien
ggggtcctctcttccatagtggcca

SEQ ID NO: 76618 - DNA, 25 bp, Homo sapien
ttccatagtggccaagttcgccatc

SEQ ID NO: 76619 - DNA, 25 bp, Homo sapien
gaccacaccaaggaagccgccgagg

SEQ ID NO: 76620 - DNA, 25 bp, Homo sapien
tcgcgcggcttctcttcaagctgcg

SEQ ID NO: 76621 - DNA, 25 bp, Homo sapien
cgatggcggccgctaggagactcat

SEQ ID NO: 76622 - DNA, 25 bp, Homo sapien
acccgccacactagaaggctgctga

SEQ ID NO: 76623 - DNA, 25 bp, Homo sapien
gggctgctcagacccggagtctgct

SEQ ID NO: 76624 - DNA, 25 bp, Homo sapien
cgtccagactactgcagctgcggta

SEQ ID NO: 76625 - DNA, 25 bp, Homo sapien
gctccatctgcagggtcgaggtctg

SEQ ID NO: 76626 - DNA, 25 bp, Homo sapien
gggatctcaagccagagacccttcc

SEQ ID NO: 76627 - DNA, 25 bp, Homo sapien
cgctgagcagccaataggggtgcta

SEQ ID NO: 76628 - DNA, 25 bp, Homo sapien
aactggggagagttttccgcgatgc

SEQ ID NO: 76629 - DNA, 25 bp, Homo sapien
cggacgccgactccaactggggaga

SEQ ID NO: 76630 - DNA, 25 bp, Homo sapien
tcaacgccattgagcagcacccggt

SEQ ID NO: 76631 - DNA, 25 bp, Homo sapien
tgtggacccacatcgggacaccatc

SEQ ID NO: 76632 - DNA, 25 bp, Homo sapien
gctgtgggaagaccacgcgcatccc

SEQ ID NO: 76633 - DNA, 25 bp, Homo sapien
cgaggtgcccgctgcaatgttatca

SEQ ID NO: 76634 - DNA, 25 bp, Homo sapien
ggtgcccgctgcaatgttatcatca

SEQ ID NO: 76635 - DNA, 25 bp, Homo sapien
tccaggtgcggttggaaagtaagcc

SEQ ID NO: 76636 - DNA, 25 bp, Homo sapien
gcaatgttatcatcacccaacctcg

SEQ ID NO: 76637 - DNA, 25 bp, Homo sapien
agcgggtcagccacgaactgggccc

SEQ ID NO: 76638 - DNA, 25 bp, Homo sapien
cgtatttcatggcagtcaagtccaa

SEQ ID NO: 76639 - DNA, 25 bp, Homo sapien
gccaccatctcactgagcgacagtg

SEQ ID NO: 76640 - DNA, 25 bp, Homo sapien
caagtccaatggcagcgtcttcgtc

SEQ ID NO: 76641 - DNA, 25 bp, Homo sapien
gtcttcgtccgggactcctctcagg

SEQ ID NO: 76642 - DNA, 25 bp, Homo sapien
acccgctagctgtgctgctgctgac

SEQ ID NO: 76643 - DNA, 25 bp, Homo sapien
cattccctcagatgacgggcgccgg

SEQ ID NO: 76644 - DNA, 25 bp, Homo sapien
actcgcgtaccgtgcggctgctgaa

SEQ ID NO: 76645 - DNA, 25 bp, Homo sapien
cggagccgatggctgacgtatttca

SEQ ID NO: 76646 - DNA, 25 bp, Homo sapien
cctgtgggctctgtgatgtaacttg

SEQ ID NO: 76647 - DNA, 25 bp, Homo sapien
ggccgtcgctctctctcagagtctg

SEQ ID NO: 76648 - DNA, 25 bp, Homo sapien
atccagagcccaaggcatgtcgctc

SEQ ID NO: 76649 - DNA, 25 bp, Homo sapien
tcgcgcctcaaagactccgaaggtc

SEQ ID NO: 76650 - DNA, 25 bp, Homo sapien
ccgctccggccaataagcgtggcga

SEQ ID NO: 76651 - DNA, 25 bp, Homo sapien
cgctgttctatgatggccgtcgctc

SEQ ID NO: 76652 - DNA, 25 bp, Homo sapien
atctgggctctggaaggaaccctta

SEQ ID NO: 76653 - DNA, 25 bp, Homo sapien
ccgatcgactgccttcgctgttcta

SEQ ID NO: 76654 - DNA, 25 bp, Homo sapien
tccagtccgcagagccatggttcct

SEQ ID NO: 76655 - DNA, 25 bp, Homo sapien
gtcccggccaccaagattgaaatta

SEQ ID NO: 76656 - DNA, 25 bp, Homo sapien
ccatggttcctggacagcgatttcc

SEQ ID NO: 76657 - DNA, 25 bp, Homo sapien
tgattgataacacgctgaacccaga

SEQ ID NO: 76658 - DNA, 25 bp, Homo sapien
ggatgatccactctgtctgtctgtt

SEQ ID NO: 76659 - DNA, 25 bp, Homo sapien
ggaacctgctagaccttgatacctt

SEQ ID NO: 76660 - DNA, 25 bp, Homo sapien
acctgcagtggtggtgctttacacg

SEQ ID NO: 76661 - DNA, 25 bp, Homo sapien
cccagacttcgtgcgcaaattcgtc

SEQ ID NO: 76662 - DNA, 25 bp, Homo sapien
ctttcgcggtaatagcggctcagtg

SEQ ID NO: 76663 - DNA, 25 bp, Homo sapien
gactctgccaggtcatcggctctca

SEQ ID NO: 76664 - DNA, 25 bp, Homo sapien
tagttggcgccaaacggaatccacc

SEQ ID NO: 76665 - DNA, 25 bp, Homo sapien
cgccggcaacctgaagattaaatcc

SEQ ID NO: 76666 - DNA, 25 bp, Homo sapien
gcccgcgggtcaaacacaaacacga

SEQ ID NO: 76667 - DNA, 25 bp, Homo sapien
tgcagctggtccatagtgacggtca

SEQ ID NO: 76668 - DNA, 25 bp, Homo sapien
cgtttcctggcctgatctctccgag

SEQ ID NO: 76669 - DNA, 25 bp, Homo sapien
tcctctcaaccgaatggcagctagg

SEQ ID NO: 76670 - DNA, 25 bp, Homo sapien
aagtcttaggcacgcccagctactc

SEQ ID NO: 76671 - DNA, 25 bp, Homo sapien
ggcagagatgtccacagtggatagt

SEQ ID NO: 76672 - DNA, 25 bp, Homo sapien
cacagtggatagtttggaaaaggct

SEQ ID NO: 76673 - DNA, 25 bp, Homo sapien
agcttggagtagttggagccgtctt

SEQ ID NO: 76674 - DNA, 25 bp, Homo sapien
gtagttggagccgtcttagaaagtc

SEQ ID NO: 76675 - DNA, 25 bp, Homo sapien
gttggagccgtcttagaaagtctta

SEQ ID NO: 76676 - DNA, 25 bp, Homo sapien
ttagaaagtcttaggcacgcccagc

SEQ ID NO: 76677 - DNA, 25 bp, Homo sapien
gagccgtcttagaaagtcttaggca

SEQ ID NO: 76678 - DNA, 25 bp, Homo sapien
tccgtttcacacacggtgctgctac

SEQ ID NO: 76679 - DNA, 25 bp, Homo sapien
tcaaagtgcgcctcagcattttctc

SEQ ID NO: 76680 - DNA, 25 bp, Homo sapien
gtgctgctacctcgtttgcttcgtg

SEQ ID NO: 76681 - DNA, 25 bp, Homo sapien
ccgcggtgcgcattctaatccgttt

SEQ ID NO: 76682 - DNA, 25 bp, Homo sapien
tcggccgtatccaccagggatgcgc

SEQ ID NO: 76683 - DNA, 25 bp, Homo sapien
agcattttctctcgccctgcacaag

SEQ ID NO: 76684 - DNA, 25 bp, Homo sapien
gacctagaaggtcaaagtgcgcctc

SEQ ID NO: 76685 - DNA, 25 bp, Homo sapien
gcttctttcttctggcgccgccagt

SEQ ID NO: 76686 - DNA, 25 bp, Homo sapien
atgaagccgttctgggcgccggaac

SEQ ID NO: 76687 - DNA, 25 bp, Homo sapien
gcgggttttccaggcgcatgcattt

SEQ ID NO: 76688 - DNA, 25 bp, Homo sapien
caggcgccacgctggatagcctgcg

SEQ ID NO: 76689 - DNA, 25 bp, Homo sapien
ggttcaccttgtcctccggcacagg

SEQ ID NO: 76690 - DNA, 25 bp, Homo sapien
agaagtccggctgcgggttcacctt

SEQ ID NO: 76691 - DNA, 25 bp, Homo sapien
gccggaactcgcttgtgggaaccgc

SEQ ID NO: 76692 - DNA, 25 bp, Homo sapien
cccagtgcagcagaagtccggctgc

SEQ ID NO: 76693 - DNA, 25 bp, Homo sapien
ccagattctgggtcattcggagccc

SEQ ID NO: 76694 - DNA, 25 bp, Homo sapien
tgctggtggaacagcgtcccggcct

SEQ ID NO: 76695 - DNA, 25 bp, Homo sapien
ctcgcctccttggaaccggaactgg

SEQ ID NO: 76696 - DNA, 25 bp, Homo sapien
agacaaagccgcgtcggccgggctc

SEQ ID NO: 76697 - DNA, 25 bp, Homo sapien
gttccaggcggagtcgccagagttt

SEQ ID NO: 76698 - DNA, 25 bp, Homo sapien
ccagagtttcccttcgcgcggagaa

SEQ ID NO: 76699 - DNA, 25 bp, Homo sapien
tccagagccgggtagcacccgagtc

SEQ ID NO: 76700 - DNA, 25 bp, Homo sapien
cgcggagaagtgtggtcccaactct

SEQ ID NO: 76701 - DNA, 25 bp, Homo sapien
gaactgggaactttcctggttgcca

SEQ ID NO: 76702 - DNA, 25 bp, Homo sapien
ggcaggacaaccctagctcctcgta

SEQ ID NO: 76703 - DNA, 25 bp, Homo sapien
tcgtacctggcgtggcccgaccaat

SEQ ID NO: 76704 - DNA, 25 bp, Homo sapien
tgccactcagttgacctctgacctg

SEQ ID NO: 76705 - DNA, 25 bp, Homo sapien
ctacggttccgattctaccctggca

SEQ ID NO: 76706 - DNA, 25 bp, Homo sapien
acttcctgactaggagccaatcagc

SEQ ID NO: 76707 - DNA, 25 bp, Homo sapien
gccgcctcgctgtctacgacagagg

SEQ ID NO: 76708 - DNA, 25 bp, Homo sapien
agtgttccggaaccgtgaggactgc

SEQ ID NO: 76709 - DNA, 25 bp, Homo sapien
catccggtagcgagagttcaacttc

SEQ ID NO: 76710 - DNA, 25 bp, Homo sapien
gacccgacaggaagtctccgtacga

SEQ ID NO: 76711 - DNA, 25 bp, Homo sapien
gacgataggcgctctcctgtacctc

SEQ ID NO: 76712 - DNA, 25 bp, Homo sapien
tctgcgggagacctgaggttttcca

SEQ ID NO: 76713 - DNA, 25 bp, Homo sapien
ctttgttgtgggtaacgttctctgc

SEQ ID NO: 76714 - DNA, 25 bp, Homo sapien
gctggggaactgacgtactcctgca

SEQ ID NO: 76715 - DNA, 25 bp, Homo sapien
tgcccggaagcccaggcgacactaa

SEQ ID NO: 76716 - DNA, 25 bp, Homo sapien
ttggcgccctgagctaagcaccagg

SEQ ID NO: 76717 - DNA, 25 bp, Homo sapien
gcccgacttggacttctccgactaa

SEQ ID NO: 76718 - DNA, 25 bp, Homo sapien
cgccgcactgagtccttgcagcaaa

SEQ ID NO: 76719 - DNA, 25 bp, Homo sapien
gtcacggagaccacatccctgaatg

SEQ ID NO: 76720 - DNA, 25 bp, Homo sapien
atccctgaatgatgcctggctcgac

SEQ ID NO: 76721 - DNA, 25 bp, Homo sapien
cgcaacacgcgtgaatgctagggca

SEQ ID NO: 76722 - DNA, 25 bp, Homo sapien
acttcactgccgacgacctggagga

SEQ ID NO: 76723 - DNA, 25 bp, Homo sapien
aggagcttgacaccctcgcgtcaca

SEQ ID NO: 76724 - DNA, 25 bp, Homo sapien
ccttttgctcggagggagttgtcaa

SEQ ID NO: 76725 - DNA, 25 bp, Homo sapien
tggctcgactcaaacgcaacacgcg

SEQ ID NO: 76726 - DNA, 25 bp, Homo sapien
ttcgctgacggcctcggggcaatca

SEQ ID NO: 76727 - DNA, 25 bp, Homo sapien
ccacagcctcagtgatccgcgcggc

SEQ ID NO: 76728 - DNA, 25 bp, Homo sapien
gcacggagtttccttctgctcaccg

SEQ ID NO: 76729 - DNA, 25 bp, Homo sapien
cgccgggcgacgcacggagtttcct

SEQ ID NO: 76730 - DNA, 25 bp, Homo sapien
ccttctgctcaccggatgcatgggg

SEQ ID NO: 76731 - DNA, 25 bp, Homo sapien
caacggcaacaggatccgcggcgcg

SEQ ID NO: 76732 - DNA, 25 bp, Homo sapien
gaagtgtctgcccggtcccagggca

SEQ ID NO: 76733 - DNA, 25 bp, Homo sapien
caacagcaacggcaacaggatccgc

SEQ ID NO: 76734 - DNA, 25 bp, Homo sapien
gggccgcccattgctgtatggcatc

SEQ ID NO: 76735 - DNA, 25 bp, Homo sapien
atggcatccagatcttcttcagggg

SEQ ID NO: 76736 - DNA, 25 bp, Homo sapien
ctacctccttgctagggagcccagg

SEQ ID NO: 76737 - DNA, 25 bp, Homo sapien
agcggcacgcgtgaattctgctacc

SEQ ID NO: 76738 - DNA, 25 bp, Homo sapien
acctgcccgcgctgatttgcatagg

SEQ ID NO: 76739 - DNA, 25 bp, Homo sapien
tgcgcatgctcaactccggattgta

SEQ ID NO: 76740 - DNA, 25 bp, Homo sapien
gcccagttcttcaggccaggatcga

SEQ ID NO: 76741 - DNA, 25 bp, Homo sapien
agcccatgtctatcttcccgcaggt

SEQ ID NO: 76742 - DNA, 25 bp, Homo sapien
cgggcagagcagagaaaagtccctg

SEQ ID NO: 76743 - DNA, 25 bp, Homo sapien
tttagggaacccagcaccgatcgcg

SEQ ID NO: 76744 - DNA, 25 bp, Homo sapien
ccagaatttgggtaggaacaggata

SEQ ID NO: 76745 - DNA, 25 bp, Homo sapien
gacttgggactgaggtcagcctcta

SEQ ID NO: 76746 - DNA, 25 bp, Homo sapien
aggcctcatcttatgcaaaccaggg

SEQ ID NO: 76747 - DNA, 25 bp, Homo sapien
ggagccatccagtaagaacacaatg

SEQ ID NO: 76748 - DNA, 25 bp, Homo sapien
ctcgcggaaattgctgcggccaatg

SEQ ID NO: 76749 - DNA, 25 bp, Homo sapien
cgcagcgtcatcctaggcagtaaaa

SEQ ID NO: 76750 - DNA, 25 bp, Homo sapien
aaagtgcagctcagtagcgccgcgg

SEQ ID NO: 76751 - DNA, 25 bp, Homo sapien
tgggagcctccattgttccagcagc

SEQ ID NO: 76752 - DNA, 25 bp, Homo sapien
ccagatcccgagtacggtgacttca

SEQ ID NO: 76753 - DNA, 25 bp, Homo sapien
gagcacggtctttcgagcctcagcg

SEQ ID NO: 76754 - DNA, 25 bp, Homo sapien
gtcctttctgaatcccggagcacgg

SEQ ID NO: 76755 - DNA, 25 bp, Homo sapien
tccagaaactccactctaagatggg

SEQ ID NO: 76756 - DNA, 25 bp, Homo sapien
tcaccgtccgtggttgcagattcgc

SEQ ID NO: 76757 - DNA, 25 bp, Homo sapien
gtcagctcaggaatcccggggagcc

SEQ ID NO: 76758 - DNA, 25 bp, Homo sapien
cgggaaccgggacagtctattgtgc

SEQ ID NO: 76759 - DNA, 25 bp, Homo sapien
gcaggccgttgtccagcaggctaac

SEQ ID NO: 76760 - DNA, 25 bp, Homo sapien
attatgtttctcaccagccgcgctg

SEQ ID NO: 76761 - DNA, 25 bp, Homo sapien
agttgcagccacagcgtgtccgcag

SEQ ID NO: 76762 - DNA, 25 bp, Homo sapien
tgagcgaaggttgccgtactccgca

SEQ ID NO: 76763 - DNA, 25 bp, Homo sapien
ggctaacctgcgtctccggcacgaa

SEQ ID NO: 76764 - DNA, 25 bp, Homo sapien
taccgtacagttggtgctcggccgc

SEQ ID NO: 76765 - DNA, 25 bp, Homo sapien
taggcaagcggcgagatacctttcc

SEQ ID NO: 76766 - DNA, 25 bp, Homo sapien
aactggaactaagcacccgcgccgg

SEQ ID NO: 76767 - DNA, 25 bp, Homo sapien
ctggatgggactgcagaactggaac

SEQ ID NO: 76768 - DNA, 25 bp, Homo sapien
ccatggctcgcaagttgtccggtgc

SEQ ID NO: 76769 - DNA, 25 bp, Homo sapien
ccaccgggaatgtgcgctgaactca

SEQ ID NO: 76770 - DNA, 25 bp, Homo sapien
atcagcagaggtaaaccgaggcgtc

SEQ ID NO: 76771 - DNA, 25 bp, Homo sapien
ggcagccgcctgcagaaaatcagca

SEQ ID NO: 76772 - DNA, 25 bp, Homo sapien
ctcgggactcagctgaaagcagcta

SEQ ID NO: 76773 - DNA, 25 bp, Homo sapien
gctttccgcacagcccaagggactg

SEQ ID NO: 76774 - DNA, 25 bp, Homo sapien
atctttgggctccagtcggcctggt

SEQ ID NO: 76775 - DNA, 25 bp, Homo sapien
tctctagaagagtagcggctggctg

SEQ ID NO: 76776 - DNA, 25 bp, Homo sapien
aggcagcgtgctcaaccactctcga

SEQ ID NO: 76777 - DNA, 25 bp, Homo sapien
agtcgagcgcatcccgtgacccgaa

SEQ ID NO: 76778 - DNA, 25 bp, Homo sapien
agccatggcgccagggtagtcccga

SEQ ID NO: 76779 - DNA, 25 bp, Homo sapien
cggcctggtgcagcatccatgcatt

SEQ ID NO: 76780 - DNA, 25 bp, Homo sapien
tcctctagtcgctcacggctcagtt

SEQ ID NO: 76781 - DNA, 25 bp, Homo sapien
gcaggtccagctgttctctagaaga

SEQ ID NO: 76782 - DNA, 25 bp, Homo sapien
cgcaggccgcgaaacatgacgaacg

SEQ ID NO: 76783 - DNA, 25 bp, Homo sapien
ggcttctggcctaagcgcgtccata

SEQ ID NO: 76784 - DNA, 25 bp, Homo sapien
tgactcccagtactcactcgcattg

SEQ ID NO: 76785 - DNA, 25 bp, Homo sapien
agaggtcgagctcggtctcgcaaaa

SEQ ID NO: 76786 - DNA, 25 bp, Homo sapien
gtctcgcaaaagtctcccgtgaatc

SEQ ID NO: 76787 - DNA, 25 bp, Homo sapien
ggagcacggacacgcatttcatgta

SEQ ID NO: 76788 - DNA, 25 bp, Homo sapien
tctcgcaggcacacgttgtcgtcga

SEQ ID NO: 76789 - DNA, 25 bp, Homo sapien
gtggcctcagaagtgactcccagta

SEQ ID NO: 76790 - DNA, 25 bp, Homo sapien
acggtggtacaacccatcgcgcatg

SEQ ID NO: 76791 - DNA, 25 bp, Homo sapien
gccgccatctttattgaggacgtga

SEQ ID NO: 76792 - DNA, 25 bp, Homo sapien
gactccggacaaagagctaaggctc

SEQ ID NO: 76793 - DNA, 25 bp, Homo sapien
cccaatggctggacgccgtgttcaa

SEQ ID NO: 76794 - DNA, 25 bp, Homo sapien
tctgggcgccagtataacacagacc

SEQ ID NO: 76795 - DNA, 25 bp, Homo sapien
cctggtgacagactacctctttgca

SEQ ID NO: 76796 - DNA, 25 bp, Homo sapien
ccgtggtgccgaatcaaaaagtctg

SEQ ID NO: 76797 - DNA, 25 bp, Homo sapien
ctcctggtgctgaacagagcgcgaa

SEQ ID NO: 76798 - DNA, 25 bp, Homo sapien
cccgcgctggcggtgaaaatttcaa

SEQ ID NO: 76799 - DNA, 25 bp, Homo sapien
actcttcggaatctgcccactcggg

SEQ ID NO: 76800 - DNA, 25 bp, Homo sapien
cgggagaggaacaagctttcgacta

SEQ ID NO: 76801 - DNA, 25 bp, Homo sapien
aataaagagtggctcgacctcgctg

SEQ ID NO: 76802 - DNA, 25 bp, Homo sapien
gcggccgcggacaactgaataaaca

SEQ ID NO: 76803 - DNA, 25 bp, Homo sapien
ggcgctgtccactgcatctgacaga

SEQ ID NO: 76804 - DNA, 25 bp, Homo sapien
ggcccgcaggccgtaataaagagtg

SEQ ID NO: 76805 - DNA, 25 bp, Homo sapien
cagggcaagtgtttaggatggttcc

SEQ ID NO: 76806 - DNA, 25 bp, Homo sapien
cggcgacctcgaaaggatgatcttg

SEQ ID NO: 76807 - DNA, 25 bp, Homo sapien
tactaattgcaaggacggcgacctc

SEQ ID NO: 76808 - DNA, 25 bp, Homo sapien
tcttgctgatccgacacttggaagc

SEQ ID NO: 76809 - DNA, 25 bp, Homo sapien
cagtgggtcccatctactaattgca

SEQ ID NO: 76810 - DNA, 25 bp, Homo sapien
gcttaagtccgagcgctgcgtcccg

SEQ ID NO: 76811 - DNA, 25 bp, Homo sapien
gggctgtatcgttccacgcatcgga

SEQ ID NO: 76812 - DNA, 25 bp, Homo sapien
gcgctgcttcgctctagcaccagga

SEQ ID NO: 76813 - DNA, 25 bp, Homo sapien
cggaacgcgtacagcgcgcggtaca

SEQ ID NO: 76814 - DNA, 25 bp, Homo sapien
gacagcctgaaaggcgctgttgcta

SEQ ID NO: 76815 - DNA, 25 bp, Homo sapien
ttctctcgcaccaaaatggctgcgg

SEQ ID NO: 76816 - DNA, 25 bp, Homo sapien
cgcacgcggactggacagcctgaaa

SEQ ID NO: 76817 - DNA, 25 bp, Homo sapien
tagggtgccaggattcgctgcagca

SEQ ID NO: 76818 - DNA, 25 bp, Homo sapien
cgctgcagcagcttccggaaaaggc

SEQ ID NO: 76819 - DNA, 25 bp, Homo sapien
gcggagcattgtcctccgtctggga

SEQ ID NO: 76820 - DNA, 25 bp, Homo sapien
actattggctcgtcctaggagctgc

SEQ ID NO: 76821 - DNA, 25 bp, Homo sapien
gcgtttccgtcctattgtttctctc

SEQ ID NO: 76822 - DNA, 25 bp, Homo sapien
caaatcactcggtgcgctctagggc

SEQ ID NO: 76823 - DNA, 25 bp, Homo sapien
caaggctggatctgacaaatcactc

SEQ ID NO: 76824 - DNA, 25 bp, Homo sapien
agctcaatttggaagtggcgcacgc

SEQ ID NO: 76825 - DNA, 25 bp, Homo sapien
cggtgtctcagggaaacgctagaaa

SEQ ID NO: 76826 - DNA, 25 bp, Homo sapien
aaacgcggctacagagctcccaatc

SEQ ID NO: 76827 - DNA, 25 bp, Homo sapien
gggtgaagtactccactgcgaattc

SEQ ID NO: 76828 - DNA, 25 bp, Homo sapien
gtgcgcttgcgccactagatgaccc

SEQ ID NO: 76829 - DNA, 25 bp, Homo sapien
acagcgcgcacgtttccttcaaggc

SEQ ID NO: 76830 - DNA, 25 bp, Homo sapien
cggccatggtcagtccgtctgtcac

SEQ ID NO: 76831 - DNA, 25 bp, Homo sapien
ttctcgggccgtcctggcttctcag

SEQ ID NO: 76832 - DNA, 25 bp, Homo sapien
agtccgtctgtcactccgtctgtca

SEQ ID NO: 76833 - DNA, 25 bp, Homo sapien
ccagcaggttcttgagcgggctgat

SEQ ID NO: 76834 - DNA, 25 bp, Homo sapien
actccgtctgtcagttctcgggccg

SEQ ID NO: 76835 - DNA, 25 bp, Homo sapien
cgcaccttgaccgtgtccagagggt

SEQ ID NO: 76836 - DNA, 25 bp, Homo sapien
gcccagttggcacggtagggcttcc

SEQ ID NO: 76837 - DNA, 25 bp, Homo sapien
tccagagggtgaccgacgaacacca

SEQ ID NO: 76838 - DNA, 25 bp, Homo sapien
ctctgggtcagagcgctaagtttca

SEQ ID NO: 76839 - DNA, 25 bp, Homo sapien
tagcggccgagaaacaatggttatc

SEQ ID NO: 76840 - DNA, 25 bp, Homo sapien
gggctcaccactcgagtcatctttg

SEQ ID NO: 76841 - DNA, 25 bp, Homo sapien
gcacgtcacggccttgtttaccttg

SEQ ID NO: 76842 - DNA, 25 bp, Homo sapien
gccggtgagaaacgcgctggttaaa

SEQ ID NO: 76843 - DNA, 25 bp, Homo sapien
cccgatcccggagtacaaacagtga

SEQ ID NO: 76844 - DNA, 25 bp, Homo sapien
tccactgacgccaggatgtcttctc

SEQ ID NO: 76845 - DNA, 25 bp, Homo sapien
ttgtccgagcattacccgccgtcag

SEQ ID NO: 76846 - DNA, 25 bp, Homo sapien
ggcgggcgcagaagagaataatact

SEQ ID NO: 76847 - DNA, 25 bp, Homo sapien
tggctctgaagacggacagccctga

SEQ ID NO: 76848 - DNA, 25 bp, Homo sapien
gcccagatggaactcgttagcgccc

SEQ ID NO: 76849 - DNA, 25 bp, Homo sapien
cctgatttctcattggcgcctccta

SEQ ID NO: 76850 - DNA, 25 bp, Homo sapien
ctcggattggctacctctaggtgaa

SEQ ID NO: 76851 - DNA, 25 bp, Homo sapien
tttgatgacccgcaaagggcgaggc

SEQ ID NO: 76852 - DNA, 25 bp, Homo sapien
ttcgctccggttcttggtgaagaca

SEQ ID NO: 76853 - DNA, 25 bp, Homo sapien
aaatgagcggtggttgagccctact

SEQ ID NO: 76854 - DNA, 25 bp, Homo sapien
tgcagacgatacttttcccggaggc

SEQ ID NO: 76855 - DNA, 25 bp, Homo sapien
atgccgcactgttgagtcatctcag

SEQ ID NO: 76856 - DNA, 25 bp, Homo sapien
gcaccgagaagctcccactagtgta

SEQ ID NO: 76857 - DNA, 25 bp, Homo sapien
gtatgccttaatggtgccgctcttg

SEQ ID NO: 76858 - DNA, 25 bp, Homo sapien
gtctacgcttgggaccttggcttct

SEQ ID NO: 76859 - DNA, 25 bp, Homo sapien
agtgtacagctctgcccgacggcaa

SEQ ID NO: 76860 - DNA, 25 bp, Homo sapien
ttcgtgcacctgtacctgggtaacg

SEQ ID NO: 76861 - DNA, 25 bp, Homo sapien
tcttcgtgcactacagcaacggcga

SEQ ID NO: 76862 - DNA, 25 bp, Homo sapien
cgccgcggcgcttcataaacttcag

SEQ ID NO: 76863 - DNA, 25 bp, Homo sapien
agcttatactcctcccagtgacggg

SEQ ID NO: 76864 - DNA, 25 bp, Homo sapien
ccgcgggcaacctcggagcttatac

SEQ ID NO: 76865 - DNA, 25 bp, Homo sapien
tggacgctctcgaggactacgtttg

SEQ ID NO: 76866 - DNA, 25 bp, Homo sapien
gagttcagctcccttcttagccgtg

SEQ ID NO: 76867 - DNA, 25 bp, Homo sapien
cggcgcagttcctatattcatgtta

SEQ ID NO: 76868 - DNA, 25 bp, Homo sapien
taaaggtctggccaatgtcttgccc

SEQ ID NO: 76869 - DNA, 25 bp, Homo sapien
gggtcgccagttgcccaagatcagg

SEQ ID NO: 76870 - DNA, 25 bp, Homo sapien
tcgctttctaggtacccggcagtcc

SEQ ID NO: 76871 - DNA, 25 bp, Homo sapien
cagtgtagtaagacgcgctggccca

SEQ ID NO: 76872 - DNA, 25 bp, Homo sapien
agggttctttcgctgtgacccaggc

SEQ ID NO: 76873 - DNA, 25 bp, Homo sapien
gatctgaaatctcggggccctccct

SEQ ID NO: 76874 - DNA, 25 bp, Homo sapien
agccctgtcggctgctttcgaccta

SEQ ID NO: 76875 - DNA, 25 bp, Homo sapien
cttccggaaaggaccgactagctgg

SEQ ID NO: 76876 - DNA, 25 bp, Homo sapien
tgcggtgccagaaagtctcgggaac

SEQ ID NO: 76877 - DNA, 25 bp, Homo sapien
agcaccgtacgcagctggctcaagc

SEQ ID NO: 76878 - DNA, 25 bp, Homo sapien
cctagagaacccgagaagccaatcc

SEQ ID NO: 76879 - DNA, 25 bp, Homo sapien
ctgcctgcagacttggagccatttt

SEQ ID NO: 76880 - DNA, 25 bp, Homo sapien
ccgctctcgcgctacgtagcttgta

SEQ ID NO: 76881 - DNA, 25 bp, Homo sapien
cttccgcgtctagccggagaaactt

SEQ ID NO: 76882 - DNA, 25 bp, Homo sapien
caaggtgatgctccacgcgcttcta

SEQ ID NO: 76883 - DNA, 25 bp, Homo sapien
tctcgcgccagtaggcccttgactt

SEQ ID NO: 76884 - DNA, 25 bp, Homo sapien
cgggtagcgaaagcgacaatgttcc

SEQ ID NO: 76885 - DNA, 25 bp, Homo sapien
tctacttcaagtctggtccggttcg

SEQ ID NO: 76886 - DNA, 25 bp, Homo sapien
cgcagctgttctacacgcgagaatg

SEQ ID NO: 76887 - DNA, 25 bp, Homo sapien
tcggcgtcgggactcatttctgacg

SEQ ID NO: 76888 - DNA, 25 bp, Homo sapien
gtggaggcccagtaagtcccaccca

SEQ ID NO: 76889 - DNA, 25 bp, Homo sapien
agcgcgcgataggattggctctcaa

SEQ ID NO: 76890 - DNA, 25 bp, Homo sapien
acccggaagcagttgcgccagcagc

SEQ ID NO: 76891 - DNA, 25 bp, Homo sapien
gtcccggccttcatcgacatcagtg

SEQ ID NO: 76892 - DNA, 25 bp, Homo sapien
aagatcaggtgtgcttcggtctacg

SEQ ID NO: 76893 - DNA, 25 bp, Homo sapien
tcctagtagcgcaagggaccgctgc

SEQ ID NO: 76894 - DNA, 25 bp, Homo sapien
agccgatttcgtcactgcgctgcgc

SEQ ID NO: 76895 - DNA, 25 bp, Homo sapien
ctgggccgcgccaatataaaccagc

SEQ ID NO: 76896 - DNA, 25 bp, Homo sapien
cccataggcccgcacttgtaggtga

SEQ ID NO: 76897 - DNA, 25 bp, Homo sapien
cgtctccgcagttgaagagctgctg

SEQ ID NO: 76898 - DNA, 25 bp, Homo sapien
gtcggccatggccaacacaggacac

SEQ ID NO: 76899 - DNA, 25 bp, Homo sapien
ctaatcaggtagtcggccatggcca

SEQ ID NO: 76900 - DNA, 25 bp, Homo sapien
agtccgtcgtctggcacgtaggacg

SEQ ID NO: 76901 - DNA, 25 bp, Homo sapien
ggacaccgccgcgtgtctccgagga

SEQ ID NO: 76902 - DNA, 25 bp, Homo sapien
gcgctagcccaggaacgttttcggc

SEQ ID NO: 76903 - DNA, 25 bp, Homo sapien
gctagggctccaagctagctctttg

SEQ ID NO: 76904 - DNA, 25 bp, Homo sapien
ggccacagctcctagagcagagata

SEQ ID NO: 76905 - DNA, 25 bp, Homo sapien
agaccgacagggttttctcctcaca

SEQ ID NO: 76906 - DNA, 25 bp, Homo sapien
tccctgggcgccatcttacattcaa

SEQ ID NO: 76907 - DNA, 25 bp, Homo sapien
gagccgattgctcctctcgcgataa

SEQ ID NO: 76908 - DNA, 25 bp, Homo sapien
tgggactgcctaccggccaaaatta

SEQ ID NO: 76909 - DNA, 25 bp, Homo sapien
gcccgggaacgtcaccagaccagaa

SEQ ID NO: 76910 - DNA, 25 bp, Homo sapien
agcgacagggagtctagagccgcca

SEQ ID NO: 76911 - DNA, 25 bp, Homo sapien
cgctgcgttgcagcatggtctgcaa

SEQ ID NO: 76912 - DNA, 25 bp, Homo sapien
ttctgctcgctcaggccgaggctag

SEQ ID NO: 76913 - DNA, 25 bp, Homo sapien
gccattgcagagacaccggaaacta

SEQ ID NO: 76914 - DNA, 25 bp, Homo sapien
ccagtctgcaggtcggcattcactc

SEQ ID NO: 76915 - DNA, 25 bp, Homo sapien
ggcattcactcgctgaccaatgaga

SEQ ID NO: 76916 - DNA, 25 bp, Homo sapien
ccaatgagagtgaagcctccgggga

SEQ ID NO: 76917 - DNA, 25 bp, Homo sapien
tcagagccgagttcttgagcgtctc

SEQ ID NO: 76918 - DNA, 25 bp, Homo sapien
cagcgcggggttactgaccacagat

SEQ ID NO: 76919 - DNA, 25 bp, Homo sapien
gcgtaacggccctgccggcatcagt

SEQ ID NO: 76920 - DNA, 25 bp, Homo sapien
gcacggcccgtgaccttgaacaggc

SEQ ID NO: 76921 - DNA, 25 bp, Homo sapien
caagccagcgagttgcagcctgctc

SEQ ID NO: 76922 - DNA, 25 bp, Homo sapien
cgccaccgccttagcggcttgtttt

SEQ ID NO: 76923 - DNA, 25 bp, Homo sapien
ttcgacttctagctaaggccgaggg

SEQ ID NO: 76924 - DNA, 25 bp, Homo sapien
gagcgccaagctggtgacgcacttc

SEQ ID NO: 76925 - DNA, 25 bp, Homo sapien
ctggccacaggcatagcgtaacggc

SEQ ID NO: 76926 - DNA, 25 bp, Homo sapien
aagagttggccgcttgcccgtccgc

SEQ ID NO: 76927 - DNA, 25 bp, Homo sapien
tcaggctgggaatgcacgtccttag

SEQ ID NO: 76928 - DNA, 25 bp, Homo sapien
aatgcacgtccttagggcccaagcc

SEQ ID NO: 76929 - DNA, 25 bp, Homo sapien
tccttagggcccaagccgtgaggcg

SEQ ID NO: 76930 - DNA, 25 bp, Homo sapien
ggtcactgaggcagcgaaatgtaca

SEQ ID NO: 76931 - DNA, 25 bp, Homo sapien
gaaatgtacagggtgaacggtgcta

SEQ ID NO: 76932 - DNA, 25 bp, Homo sapien
tgaacggtgctagccctaccgggac

SEQ ID NO: 76933 - DNA, 25 bp, Homo sapien
agcttcggaaacagaggctcctgcc

SEQ ID NO: 76934 - DNA, 25 bp, Homo sapien
gtccaagtgtccgtttatctgtccg

SEQ ID NO: 76935 - DNA, 25 bp, Homo sapien
atttctactcttgcccgaggtcgga

SEQ ID NO: 76936 - DNA, 25 bp, Homo sapien
tatgaccgtagatcggcacgccctg

SEQ ID NO: 76937 - DNA, 25 bp, Homo sapien
atctgtccgtttgcatatgaccgta

SEQ ID NO: 76938 - DNA, 25 bp, Homo sapien
atacacgtgttgtgtcgctcgccgc

SEQ ID NO: 76939 - DNA, 25 bp, Homo sapien
cgaggtcggacgctaaattctgtca

SEQ ID NO: 76940 - DNA, 25 bp, Homo sapien
ttctgtcaggcccagtgtccaagtg

SEQ ID NO: 76941 - DNA, 25 bp, Homo sapien
cgccgggaagcctgtaattgggctc

SEQ ID NO: 76942 - DNA, 25 bp, Homo sapien
attgggaggcgaggcaccgctccaa

SEQ ID NO: 76943 - DNA, 25 bp, Homo sapien
ttaagcggggtccatttcacagagg

SEQ ID NO: 76944 - DNA, 25 bp, Homo sapien
gagatctcctgctggacgcttcccg

SEQ ID NO: 76945 - DNA, 25 bp, Homo sapien
ggtggaggccatctccctgcttctg

SEQ ID NO: 76946 - DNA, 25 bp, Homo sapien
ggcccggagagatgattttcaaatc

SEQ ID NO: 76947 - DNA, 25 bp, Homo sapien
aaggatacccagaggctaggggctc

SEQ ID NO: 76948 - DNA, 25 bp, Homo sapien
agtggccactccttgggaaaggata

SEQ ID NO: 76949 - DNA, 25 bp, Homo sapien
cctgcttctggtcagagatctcctg

SEQ ID NO: 76950 - DNA, 25 bp, Homo sapien
tccgcgcttatccttggagagcagt

SEQ ID NO: 76951 - DNA, 25 bp, Homo sapien
gggcccacaatcagcgcggttgaga

SEQ ID NO: 76952 - DNA, 25 bp, Homo sapien
cgcgagttgccgttaggacagttaa

SEQ ID NO: 76953 - DNA, 25 bp, Homo sapien
agttaaaaccgttagctgcctgtcg

SEQ ID NO: 76954 - DNA, 25 bp, Homo sapien
tgggttcaggataccagcggtcctc

SEQ ID NO: 76955 - DNA, 25 bp, Homo sapien
aggaggcttcacttccgcgcttatc

SEQ ID NO: 76956 - DNA, 25 bp, Homo sapien
gagagcagttttcatccgattcgca

SEQ ID NO: 76957 - DNA, 25 bp, Homo sapien
tgccctttctttccctatggcgatg

SEQ ID NO: 76958 - DNA, 25 bp, Homo sapien
tgaaggtcagacaaaaaatcccgga

SEQ ID NO: 76959 - DNA, 25 bp, Homo sapien
gaggaacccgccatctgccagaagc

SEQ ID NO: 76960 - DNA, 25 bp, Homo sapien
ccctttggcgagtcggcagccacgt

SEQ ID NO: 76961 - DNA, 25 bp, Homo sapien
gagtcggcagccacgtccttgtcct

SEQ ID NO: 76962 - DNA, 25 bp, Homo sapien
cgcagtgacgccgacccatccaacg

SEQ ID NO: 76963 - DNA, 25 bp, Homo sapien
atccaacggtcatcgcatgcgcgtg

SEQ ID NO: 76964 - DNA, 25 bp, Homo sapien
cccacggattaggttgaaggtcaga

SEQ ID NO: 76965 - DNA, 25 bp, Homo sapien
tcagacaaaaaatcccggacccata

SEQ ID NO: 76966 - DNA, 25 bp, Homo sapien
gaagctctgttcagcccgccgatct

SEQ ID NO: 76967 - DNA, 25 bp, Homo sapien
cgcgttggagtgtggtcctcattaa

SEQ ID NO: 76968 - DNA, 25 bp, Homo sapien
tggcgctacacttcgaagctctgtt

SEQ ID NO: 76969 - DNA, 25 bp, Homo sapien
acttctgagtctccgcatccggtcg

SEQ ID NO: 76970 - DNA, 25 bp, Homo sapien
ttcctctgctcaggatggcgctaca

SEQ ID NO: 76971 - DNA, 25 bp, Homo sapien
tcctcattaagggtccaagctcgga

SEQ ID NO: 76972 - DNA, 25 bp, Homo sapien
ctcaccggcgaacagtggagcggaa

SEQ ID NO: 76973 - DNA, 25 bp, Homo sapien
atctcagggagttaggcagcaagcc

SEQ ID NO: 76974 - DNA, 25 bp, Homo sapien
ggactgggttggattcgaacacata

SEQ ID NO: 76975 - DNA, 25 bp, Homo sapien
aggtgcccgatcagccctcggcagg

SEQ ID NO: 76976 - DNA, 25 bp, Homo sapien
ccgaaatgcttcctgaattaggatc

SEQ ID NO: 76977 - DNA, 25 bp, Homo sapien
taggatcattgagaacgccgagtgc

SEQ ID NO: 76978 - DNA, 25 bp, Homo sapien
gggccatccagaccctgcggagagc

SEQ ID NO: 76979 - DNA, 25 bp, Homo sapien
ttcgaacacatagcgagggttgccc

SEQ ID NO: 76980 - DNA, 25 bp, Homo sapien
ggcgctctgcttaagactgagaacc

SEQ ID NO: 76981 - DNA, 25 bp, Homo sapien
cgccgagtgcagacacaaatcgaaa

SEQ ID NO: 76982 - DNA, 25 bp, Homo sapien
ggtcacgtggcacaggcagttttcc

SEQ ID NO: 76983 - DNA, 25 bp, Homo sapien
agcaggcgcctccttttaactggcc

SEQ ID NO: 76984 - DNA, 25 bp, Homo sapien
caagcactgtaaggggaggccagca

SEQ ID NO: 76985 - DNA, 25 bp, Homo sapien
agtagccagactctccgcgcatgga

SEQ ID NO: 76986 - DNA, 25 bp, Homo sapien
agaggaatttcagcagctacgagca

SEQ ID NO: 76987 - DNA, 25 bp, Homo sapien
ctccatgcgcaatcccaagggcgga

SEQ ID NO: 76988 - DNA, 25 bp, Homo sapien
caagggagattttctatgagtcacc

SEQ ID NO: 76989 - DNA, 25 bp, Homo sapien
tcaccgggattttgccctccatgcg

SEQ ID NO: 76990 - DNA, 25 bp, Homo sapien
gccaactcttcacgcacgcgaagta

SEQ ID NO: 76991 - DNA, 25 bp, Homo sapien
atccactattgctcaggagcccgtc

SEQ ID NO: 76992 - DNA, 25 bp, Homo sapien
taaccaatcattgcagccgcgtggg

SEQ ID NO: 76993 - DNA, 25 bp, Homo sapien
cggggctataaaagacctggttgct

SEQ ID NO: 76994 - DNA, 25 bp, Homo sapien
gttgctattttgtactcccggagtc

SEQ ID NO: 76995 - DNA, 25 bp, Homo sapien
ctgggtttacgcgtgcgcactaacg

SEQ ID NO: 76996 - DNA, 25 bp, Homo sapien
cgcgtgcgcggttttaatactcctc

SEQ ID NO: 76997 - DNA, 25 bp, Homo sapien
ggagtcactcatcccttaagcaagc

SEQ ID NO: 76998 - DNA, 25 bp, Homo sapien
cagccaatcaccgaagctcaggatc

SEQ ID NO: 76999 - DNA, 25 bp, Homo sapien
agccgagcctcaagaactacaaatc

SEQ ID NO: 77000 - DNA, 25 bp, Homo sapien
gcaactaagtgcaaccgccgctcta

SEQ ID NO: 77001 - DNA, 25 bp, Homo sapien
gacatggtgacagcagccgcaacta

SEQ ID NO: 77002 - DNA, 25 bp, Homo sapien
gcaaggcaccaaaacgcgggacatg

SEQ ID NO: 77003 - DNA, 25 bp, Homo sapien
gggctacggagcctttcacatggca

SEQ ID NO: 77004 - DNA, 25 bp, Homo sapien
tgacatcgatgaccagcacgccagg

SEQ ID NO: 77005 - DNA, 25 bp, Homo sapien
ttgctcacctcgaagggagcgacgc

SEQ ID NO: 77006 - DNA, 25 bp, Homo sapien
tgcaacactcgcgtgtcaggcggtt

SEQ ID NO: 77007 - DNA, 25 bp, Homo sapien
ggcttccataatggggcgtgacttt

SEQ ID NO: 77008 - DNA, 25 bp, Homo sapien
ccagttgggccggattccgactgtg

SEQ ID NO: 77009 - DNA, 25 bp, Homo sapien
tccctggcttccaataggggttgtg

SEQ ID NO: 77010 - DNA, 25 bp, Homo sapien
aggagcgaacacctgccgcggtcct

SEQ ID NO: 77011 - DNA, 25 bp, Homo sapien
cccggtacgtgctcgcgcgaaggct

SEQ ID NO: 77012 - DNA, 25 bp, Homo sapien
tggccgctggattggctgcaacact

SEQ ID NO: 77013 - DNA, 25 bp, Homo sapien
gctcgcgcctcttaggcttggcggt

SEQ ID NO: 77014 - DNA, 25 bp, Homo sapien
cggacgaaaatctccggcagcgcgg

SEQ ID NO: 77015 - DNA, 25 bp, Homo sapien
cgagtagcccaaccgcggggagcca

SEQ ID NO: 77016 - DNA, 25 bp, Homo sapien
gtggcgccagaggattaagtcgcca

SEQ ID NO: 77017 - DNA, 25 bp, Homo sapien
ccagaggattaagtcgccagcggtg

SEQ ID NO: 77018 - DNA, 25 bp, Homo sapien
gcggggctaataacgccgccagctc

SEQ ID NO: 77019 - DNA, 25 bp, Homo sapien
cgggagcggacgaaaatctccggca

SEQ ID NO: 77020 - DNA, 25 bp, Homo sapien
gggcgaagcccgcgagtagcccaac

SEQ ID NO: 77021 - DNA, 25 bp, Homo sapien
cgctcgggagcggacgaaaatctcc

SEQ ID NO: 77022 - DNA, 25 bp, Homo sapien
gttgctactctcgagttcaccgagg

SEQ ID NO: 77023 - DNA, 25 bp, Homo sapien
tctgactccaaagcagggctcagcg

SEQ ID NO: 77024 - DNA, 25 bp, Homo sapien
tcagcatgatacaaccgcgtcggcc

SEQ ID NO: 77025 - DNA, 25 bp, Homo sapien
cggcgcaggaaagccgccttcagca

SEQ ID NO: 77026 - DNA, 25 bp, Homo sapien
gatcccgcgatctagtgtggacagc

SEQ ID NO: 77027 - DNA, 25 bp, Homo sapien
aaccctgccggattggcgtgaactg

SEQ ID NO: 77028 - DNA, 25 bp, Homo sapien
ctgcagaccgtgactccgtcacgaa

SEQ ID NO: 77029 - DNA, 25 bp, Homo sapien
gttacccggaggagagttgctactc

SEQ ID NO: 77030 - DNA, 25 bp, Homo sapien
acttgtcacccatcgaggatgcctc

SEQ ID NO: 77031 - DNA, 25 bp, Homo sapien
cgcaggcagcgtctagaagaagcaa

SEQ ID NO: 77032 - DNA, 25 bp, Homo sapien
tctagaagaagcaaagcagcagcgc

SEQ ID NO: 77033 - DNA, 25 bp, Homo sapien
aagaggagctgcttcgtgagcaaga

SEQ ID NO: 77034 - DNA, 25 bp, Homo sapien
ctgcttcgtgagcaagagaagatgc

SEQ ID NO: 77035 - DNA, 25 bp, Homo sapien
agcagcagcgcatccgcagcacggc

SEQ ID NO: 77036 - DNA, 25 bp, Homo sapien
ccagtaacttgtcacccatcgagga

SEQ ID NO: 77037 - DNA, 25 bp, Homo sapien
caagacaccacccagtaacttgtca

SEQ ID NO: 77038 - DNA, 25 bp, Homo sapien
cccgctcggagcatagatggtaccg

SEQ ID NO: 77039 - DNA, 25 bp, Homo sapien
cccaagcgttcgtaagggctctcta

SEQ ID NO: 77040 - DNA, 25 bp, Homo sapien
cgagacagccctaggtggaaaactt

SEQ ID NO: 77041 - DNA, 25 bp, Homo sapien
gctgggctgtaccattgcatacctg

SEQ ID NO: 77042 - DNA, 25 bp, Homo sapien
cggcttgtcctaatttggtgcccaa

SEQ ID NO: 77043 - DNA, 25 bp, Homo sapien
gagatctccgcgctgcagttagccc

SEQ ID NO: 77044 - DNA, 25 bp, Homo sapien
gtcctcgttctctagggacacccta

SEQ ID NO: 77045 - DNA, 25 bp, Homo sapien
atgtcccgccttcagagtcctcgtt

SEQ ID NO: 77046 - DNA, 25 bp, Homo sapien
ccctcggtaagaggcccaggactca

SEQ ID NO: 77047 - DNA, 25 bp, Homo sapien
tggacccgaaggaaccctacagtca

SEQ ID NO: 77048 - DNA, 25 bp, Homo sapien
acggtcctcacccattagccgaagg

SEQ ID NO: 77049 - DNA, 25 bp, Homo sapien
gaagcctcacttccgggcgcgagca

SEQ ID NO: 77050 - DNA, 25 bp, Homo sapien
actatggaacgtcaggtgagggctc

SEQ ID NO: 77051 - DNA, 25 bp, Homo sapien
tcaccacgcagtacggcggccaata

SEQ ID NO: 77052 - DNA, 25 bp, Homo sapien
cactgtgtagtgaatgtcggcctcg

SEQ ID NO: 77053 - DNA, 25 bp, Homo sapien
ggccaataccggacggtgcacactg

SEQ ID NO: 77054 - DNA, 25 bp, Homo sapien
ctcgggatctgtgagacccaggatt

SEQ ID NO: 77055 - DNA, 25 bp, Homo sapien
gtgcatcctgggaaatccaccaaca

SEQ ID NO: 77056 - DNA, 25 bp, Homo sapien
atccaccaacatggggcgcagcggc

SEQ ID NO: 77057 - DNA, 25 bp, Homo sapien
cccacgatggacaggaactacgcga

SEQ ID NO: 77058 - DNA, 25 bp, Homo sapien
ctgatgactcctacggggtggtcgc

SEQ ID NO: 77059 - DNA, 25 bp, Homo sapien
ggctccgtcacctcttgggtcctgg

SEQ ID NO: 77060 - DNA, 25 bp, Homo sapien
cctgggctctcacatggtgaagttt

SEQ ID NO: 77061 - DNA, 25 bp, Homo sapien
tgaagtttgggctcgtggctgaact

SEQ ID NO: 77062 - DNA, 25 bp, Homo sapien
gggctagtccagtgcgagggcacct

SEQ ID NO: 77063 - DNA, 25 bp, Homo sapien
ccttcgcggtccgggctagtccagt

SEQ ID NO: 77064 - DNA, 25 bp, Homo sapien
gctagtccagtgcgagggcacctgc

SEQ ID NO: 77065 - DNA, 25 bp, Homo sapien
ccgggctagtccagtgcgagggcac

SEQ ID NO: 77066 - DNA, 25 bp, Homo sapien
tccgggctagtccagtgcgagggca

SEQ ID NO: 77067 - DNA, 25 bp, Homo sapien
cgcggtccgggctagtccagtgcga

SEQ ID NO: 77068 - DNA, 25 bp, Homo sapien
acttgggggagccatgcgccgccct

SEQ ID NO: 77069 - DNA, 25 bp, Homo sapien
ttcgcggtccgggctagtccagtgc

SEQ ID NO: 77070 - DNA, 25 bp, Homo sapien
agcgtgcgcgtgatttggccctgaa

SEQ ID NO: 77071 - DNA, 25 bp, Homo sapien
ccagacggagtaggttcagttctga

SEQ ID NO: 77072 - DNA, 25 bp, Homo sapien
ttgggctcccagacggagtaggttc

SEQ ID NO: 77073 - DNA, 25 bp, Homo sapien
aaactccgagcggaagctggtctgg

SEQ ID NO: 77074 - DNA, 25 bp, Homo sapien
atttggccctgaacggacgccgtag

SEQ ID NO: 77075 - DNA, 25 bp, Homo sapien
cctttcggcgaagctgaggcctgga

SEQ ID NO: 77076 - DNA, 25 bp, Homo sapien
tgcgaaactccgagcggaagctggt

SEQ ID NO: 77077 - DNA, 25 bp, Homo sapien
cgaagctgaggcctggaacaacccg

SEQ ID NO: 77078 - DNA, 25 bp, Homo sapien
ctcgtccaagtgcaccaagcggtta

SEQ ID NO: 77079 - DNA, 25 bp, Homo sapien
ggactcaccctcttctgctctagtg

SEQ ID NO: 77080 - DNA, 25 bp, Homo sapien
agcgcccgcaacgtgttagatgata

SEQ ID NO: 77081 - DNA, 25 bp, Homo sapien
ttgaaggccaagcatacgtactcgc

SEQ ID NO: 77082 - DNA, 25 bp, Homo sapien
cgcgacccagcgcatctagttcgtt

SEQ ID NO: 77083 - DNA, 25 bp, Homo sapien
ggtgcctaacccaacgcgcagcatg

SEQ ID NO: 77084 - DNA, 25 bp, Homo sapien
caccagggacagtacagagcagctc

SEQ ID NO: 77085 - DNA, 25 bp, Homo sapien
aggtcggcagcgcagatacatttgt

SEQ ID NO: 77086 - DNA, 25 bp, Homo sapien
cgcctccacttggtgcagcaagatg

SEQ ID NO: 77087 - DNA, 25 bp, Homo sapien
gggccacgggattttcacaaagaca

SEQ ID NO: 77088 - DNA, 25 bp, Homo sapien
actctgatcccgacccagggtctta

SEQ ID NO: 77089 - DNA, 25 bp, Homo sapien
ggcttattgcagaagtccaccagtg

SEQ ID NO: 77090 - DNA, 25 bp, Homo sapien
aagatcagtgccttcatcgcgcctg

SEQ ID NO: 77091 - DNA, 25 bp, Homo sapien
gcgctgcgacagacgtagccaatga

SEQ ID NO: 77092 - DNA, 25 bp, Homo sapien
tcagctggccattggcggatccaaa

SEQ ID NO: 77093 - DNA, 25 bp, Homo sapien
ctcgcctccgtttctagcggcttta

SEQ ID NO: 77094 - DNA, 25 bp, Homo sapien
caggtcagctcacgtgtcagtcaga

SEQ ID NO: 77095 - DNA, 25 bp, Homo sapien
gcggagttttcgctggctactacga

SEQ ID NO: 77096 - DNA, 25 bp, Homo sapien
ctcgagcgatgttccagtgatggcc

SEQ ID NO: 77097 - DNA, 25 bp, Homo sapien
acagtctttttgctcgtcgccaggg

SEQ ID NO: 77098 - DNA, 25 bp, Homo sapien
ccgggcgtcatagtaaccaggactg

SEQ ID NO: 77099 - DNA, 25 bp, Homo sapien
ggacacactttagcgctccggatca

SEQ ID NO: 77100 - DNA, 25 bp, Homo sapien
cagagaagctggtttcccgctacta

SEQ ID NO: 77101 - DNA, 25 bp, Homo sapien
gcgtcttgtcatacacttgcgcaca

SEQ ID NO: 77102 - DNA, 25 bp, Homo sapien
catggacatgcacagcgctcggctt

SEQ ID NO: 77103 - DNA, 25 bp, Homo sapien
gagggaccgctatttcaccattgaa

SEQ ID NO: 77104 - DNA, 25 bp, Homo sapien
cgtcacgcagcaaacgcagggtcca

SEQ ID NO: 77105 - DNA, 25 bp, Homo sapien
gcagtcccgtctagctcggttggga

SEQ ID NO: 77106 - DNA, 25 bp, Homo sapien
cgctcggcttgacagcttccttagc

SEQ ID NO: 77107 - DNA, 25 bp, Homo sapien
ccaaggccagcctcacgaatgggtc

SEQ ID NO: 77108 - DNA, 25 bp, Homo sapien
gcatatggctcagatggcccgcgtc

SEQ ID NO: 77109 - DNA, 25 bp, Homo sapien
cgcagggtccactcaacagtctggg

SEQ ID NO: 77110 - DNA, 25 bp, Homo sapien
cttcgcctggattggacaaattctc

SEQ ID NO: 77111 - DNA, 25 bp, Homo sapien
tgccacttgagagcgcagcattata

SEQ ID NO: 77112 - DNA, 25 bp, Homo sapien
acaaattctcggatgggcggaacta

SEQ ID NO: 77113 - DNA, 25 bp, Homo sapien
cagcattatatcaaggcggggagca

SEQ ID NO: 77114 - DNA, 25 bp, Homo sapien
gcggagcgtgaatacttcgcctgga

SEQ ID NO: 77115 - DNA, 25 bp, Homo sapien
cttcaaatttggctccgcagcacga

SEQ ID NO: 77116 - DNA, 25 bp, Homo sapien
aaactgctacaggtccggcttcgta

SEQ ID NO: 77117 - DNA, 25 bp, Homo sapien
gggagactcgacctgccacttgaga

SEQ ID NO: 77118 - DNA, 25 bp, Homo sapien
taagggcagaatcccactggagagc

SEQ ID NO: 77119 - DNA, 25 bp, Homo sapien
ttcggctagcgaacctccagcatcg

SEQ ID NO: 77120 - DNA, 25 bp, Homo sapien
cgggttgtcgcccataaagaactct

SEQ ID NO: 77121 - DNA, 25 bp, Homo sapien
ccctggcggagccttaagggcagaa

SEQ ID NO: 77122 - DNA, 25 bp, Homo sapien
gcgccagatgcagccgcttcggcta

SEQ ID NO: 77123 - DNA, 25 bp, Homo sapien
tttcacaattccgagccgcagaagc

SEQ ID NO: 77124 - DNA, 25 bp, Homo sapien
cacgaatcttcgagggttaatcttt

SEQ ID NO: 77125 - DNA, 25 bp, Homo sapien
ctctccgttgtcatggaaattagtg

SEQ ID NO: 77126 - DNA, 25 bp, Homo sapien
gccttgagacgcctgatagacactg

SEQ ID NO: 77127 - DNA, 25 bp, Homo sapien
tgacaacgccacaaagcccggtgcg

SEQ ID NO: 77128 - DNA, 25 bp, Homo sapien
gcctgcgttttggagcaaatctgca

SEQ ID NO: 77129 - DNA, 25 bp, Homo sapien
gtcgaggaccagctcccgatagtca

SEQ ID NO: 77130 - DNA, 25 bp, Homo sapien
cccaactctggctcagtggcgctaa

SEQ ID NO: 77131 - DNA, 25 bp, Homo sapien
actaggatcatctgtcacgctggcc

SEQ ID NO: 77132 - DNA, 25 bp, Homo sapien
ctcccgtgtggaagctgtgcacgta

SEQ ID NO: 77133 - DNA, 25 bp, Homo sapien
gccggctgtacagtcaggaagtata

SEQ ID NO: 77134 - DNA, 25 bp, Homo sapien
cgagttccgtccacccaggaggctg

SEQ ID NO: 77135 - DNA, 25 bp, Homo sapien
tttccaaggcaatagcaaacggggc

SEQ ID NO: 77136 - DNA, 25 bp, Homo sapien
cctacagcggctgcgaggacgacaa

SEQ ID NO: 77137 - DNA, 25 bp, Homo sapien
gtgcccagggaatggtttccaaggc

SEQ ID NO: 77138 - DNA, 25 bp, Homo sapien
gaacggaggacaaggctcgagccta

SEQ ID NO: 77139 - DNA, 25 bp, Homo sapien
ctcgagcctaggcaggaacttcccg

SEQ ID NO: 77140 - DNA, 25 bp, Homo sapien
tgtgcaactggctgcggaagccgca

SEQ ID NO: 77141 - DNA, 25 bp, Homo sapien
gcgccttcaagacgctggtcccagg

SEQ ID NO: 77142 - DNA, 25 bp, Homo sapien
agccgccgctgtacactggcgctta

SEQ ID NO: 77143 - DNA, 25 bp, Homo sapien
tgacgcctgcggacgcacgacagca

SEQ ID NO: 77144 - DNA, 25 bp, Homo sapien
tcgggtctgagcacctgacgcctgc

SEQ ID NO: 77145 - DNA, 25 bp, Homo sapien
ggccaaatttaagcagcggtcccga

SEQ ID NO: 77146 - DNA, 25 bp, Homo sapien
ctagaggatccctaccggcctgggc

SEQ ID NO: 77147 - DNA, 25 bp, Homo sapien
gagctgggaccctagaggatcccta

SEQ ID NO: 77148 - DNA, 25 bp, Homo sapien
cgtcaaagtcgcgagaggccgcgta

SEQ ID NO: 77149 - DNA, 25 bp, Homo sapien
cagcaacaggaaggactgaggcagc

SEQ ID NO: 77150 - DNA, 25 bp, Homo sapien
agttgcgagttgcattggcagccgc

SEQ ID NO: 77151 - DNA, 25 bp, Homo sapien
attgatttcaaaagttgcgagttgc

SEQ ID NO: 77152 - DNA, 25 bp, Homo sapien
gcgcaaaaatgtcggcgggcgaaaa

SEQ ID NO: 77153 - DNA, 25 bp, Homo sapien
cgggctcccttaagcgtcgcctgaa

SEQ ID NO: 77154 - DNA, 25 bp, Homo sapien
taagcgtcgcctgaataaaaatgcc

SEQ ID NO: 77155 - DNA, 25 bp, Homo sapien
ccgagcgcggcaatgattggtctcg

SEQ ID NO: 77156 - DNA, 25 bp, Homo sapien
cggtggcatccgttgcatgatgcaa

SEQ ID NO: 77157 - DNA, 25 bp, Homo sapien
catgatgcaaaaaaggattgatttc

SEQ ID NO: 77158 - DNA, 25 bp, Homo sapien
gcacagttaacagacgggcgctcag

SEQ ID NO: 77159 - DNA, 25 bp, Homo sapien
cggatcgagttcctctctggctggt

SEQ ID NO: 77160 - DNA, 25 bp, Homo sapien
cgagttaatctacggcaggccgcgg

SEQ ID NO: 77161 - DNA, 25 bp, Homo sapien
atcgcgcccgaggaaacttggatcg

SEQ ID NO: 77162 - DNA, 25 bp, Homo sapien
cgggctacgttcagtggttgccaga

SEQ ID NO: 77163 - DNA, 25 bp, Homo sapien
tggttgccagagagacacgtgaccg

SEQ ID NO: 77164 - DNA, 25 bp, Homo sapien
gcacagcacagctgcgaccacttgg

SEQ ID NO: 77165 - DNA, 25 bp, Homo sapien
ccaccgtgcaggagaaggctgctgc

SEQ ID NO: 77166 - DNA, 25 bp, Homo sapien
agctgcgcaccggtaagaaggctta

SEQ ID NO: 77167 - DNA, 25 bp, Homo sapien
tactaccttgtagccatctgagagc

SEQ ID NO: 77168 - DNA, 25 bp, Homo sapien
tcacggtcagtggagacaagcagca

SEQ ID NO: 77169 - DNA, 25 bp, Homo sapien
aattggtcctttcggcgcacgagtg

SEQ ID NO: 77170 - DNA, 25 bp, Homo sapien
gtaggcgccgcaaatcatagttctg

SEQ ID NO: 77171 - DNA, 25 bp, Homo sapien
tgcaaagaagtcctcacggtcagtg

SEQ ID NO: 77172 - DNA, 25 bp, Homo sapien
gctccggcgcacgaatactaccttg

SEQ ID NO: 77173 - DNA, 25 bp, Homo sapien
tgcttctgctggaagatgtggctca

SEQ ID NO: 77174 - DNA, 25 bp, Homo sapien
gggtccgcgattgcctcatccggcg

SEQ ID NO: 77175 - DNA, 25 bp, Homo sapien
tgggctcctagtcccagcagagccg

SEQ ID NO: 77176 - DNA, 25 bp, Homo sapien
actggttctgggctcctagtcccag

SEQ ID NO: 77177 - DNA, 25 bp, Homo sapien
tagtccttagcgtttggccgcctgc

SEQ ID NO: 77178 - DNA, 25 bp, Homo sapien
tgcgtacacagacatggccacagcg

SEQ ID NO: 77179 - DNA, 25 bp, Homo sapien
aatgtagtccttagcgtttggccgc

SEQ ID NO: 77180 - DNA, 25 bp, Homo sapien
gaagatagctttcgccggcctctcg

SEQ ID NO: 77181 - DNA, 25 bp, Homo sapien
ccgccggtgcaggaagatagctttc

SEQ ID NO: 77182 - DNA, 25 bp, Homo sapien
ccttcttattggatggcgatggaca

SEQ ID NO: 77183 - DNA, 25 bp, Homo sapien
tgtacttcatctcccagcgggccga

SEQ ID NO: 77184 - DNA, 25 bp, Homo sapien
gacaggcccgctctagacatcgcag

SEQ ID NO: 77185 - DNA, 25 bp, Homo sapien
cgcgcagcctgaaagctgtggcttc

SEQ ID NO: 77186 - DNA, 25 bp, Homo sapien
cctcgctcgggaagaagaccaagca

SEQ ID NO: 77187 - DNA, 25 bp, Homo sapien
cggctctgtgctcctactcttcgga

SEQ ID NO: 77188 - DNA, 25 bp, Homo sapien
tggcatcactaggaagggagctctt

SEQ ID NO: 77189 - DNA, 25 bp, Homo sapien
gcacgtagcctcgtcctcagacttg

SEQ ID NO: 77190 - DNA, 25 bp, Homo sapien
ctgtaacgacggtaggttcttgcca

SEQ ID NO: 77191 - DNA, 25 bp, Homo sapien
gcttcgaggattggacttctccgca

SEQ ID NO: 77192 - DNA, 25 bp, Homo sapien
ctggaactgatttttcggacctcgc

SEQ ID NO: 77193 - DNA, 25 bp, Homo sapien
cccatctgcgggtttggaacctctt

SEQ ID NO: 77194 - DNA, 25 bp, Homo sapien
aaaagctgttcggtgatcgcccatc

SEQ ID NO: 77195 - DNA, 25 bp, Homo sapien
gttgccagctctgtcagtttccaga

SEQ ID NO: 77196 - DNA, 25 bp, Homo sapien
gccattttgtgtagccgccgaacct

SEQ ID NO: 77197 - DNA, 25 bp, Homo sapien
taatcttcagcccaacggagcagtg

SEQ ID NO: 77198 - DNA, 25 bp, Homo sapien
ctgcagcccttctcgccagggagtt

SEQ ID NO: 77199 - DNA, 25 bp, Homo sapien
cgagaccagagcgagcgaacgaacc

SEQ ID NO: 77200 - DNA, 25 bp, Homo sapien
cgctatgcaaatgtcgcccacgggc

SEQ ID NO: 77201 - DNA, 25 bp, Homo sapien
ttcacagagagacaaagccagggcg

SEQ ID NO: 77202 - DNA, 25 bp, Homo sapien
gcgatgtgtgcggtgtattcacaga

SEQ ID NO: 77203 - DNA, 25 bp, Homo sapien
ttgaatgcccgggtaaacaccaggc

SEQ ID NO: 77204 - DNA, 25 bp, Homo sapien
ttctcgccagggagttgaatgcccg

SEQ ID NO: 77205 - DNA, 25 bp, Homo sapien
caggagagcgcagcgcttcgaagcc

SEQ ID NO: 77206 - DNA, 25 bp, Homo sapien
gtacgacccatacgctagcccagga

SEQ ID NO: 77207 - DNA, 25 bp, Homo sapien
gctgagcgcctacgacatggtgcta

SEQ ID NO: 77208 - DNA, 25 bp, Homo sapien
tgcacatggcagacactatcgagga

SEQ ID NO: 77209 - DNA, 25 bp, Homo sapien
gcgcctcggagtaccagctcaacga

SEQ ID NO: 77210 - DNA, 25 bp, Homo sapien
tcgcgagtcaagaccactggcatca

SEQ ID NO: 77211 - DNA, 25 bp, Homo sapien
ctggcatcatcgagacgcagttctc

SEQ ID NO: 77212 - DNA, 25 bp, Homo sapien
gactccggtatccaggcctgttttg

SEQ ID NO: 77213 - DNA, 25 bp, Homo sapien
ttcaaggatctcaacttccggtacg

SEQ ID NO: 77214 - DNA, 25 bp, Homo sapien
tgtcgctgttgcagccgagttcagc

SEQ ID NO: 77215 - DNA, 25 bp, Homo sapien
ccaggtaccgcttcgggagttcatc

SEQ ID NO: 77216 - DNA, 25 bp, Homo sapien
ggagttcatcccacccgcacagggg

SEQ ID NO: 77217 - DNA, 25 bp, Homo sapien
ctcagcgccgagcttaagcagggcc

SEQ ID NO: 77218 - DNA, 25 bp, Homo sapien
ggcggcacaccacaggcttcctgag

SEQ ID NO: 77219 - DNA, 25 bp, Homo sapien
cacgatgggaatccgggtatattta

SEQ ID NO: 77220 - DNA, 25 bp, Homo sapien
ggtatatttatctcggctgctccgg

SEQ ID NO: 77221 - DNA, 25 bp, Homo sapien
agacttggtttgcaagagcccgccc

SEQ ID NO: 77222 - DNA, 25 bp, Homo sapien
ctggcagatccgtgggaagaaagcc

SEQ ID NO: 77223 - DNA, 25 bp, Homo sapien
gcggtgacccaccacacgttgccca

SEQ ID NO: 77224 - DNA, 25 bp, Homo sapien
tgtggctgggatggtcggtacccat

SEQ ID NO: 77225 - DNA, 25 bp, Homo sapien
tacccatggccgtgcggtcgagcct

SEQ ID NO: 77226 - DNA, 25 bp, Homo sapien
gcggtcgagccttgatgctccagga

SEQ ID NO: 77227 - DNA, 25 bp, Homo sapien
aggcttcctggcagatccgtgggaa

SEQ ID NO: 77228 - DNA, 25 bp, Homo sapien
tccaggacagtcctggaaggcttcc

SEQ ID NO: 77229 - DNA, 25 bp, Homo sapien
gccttgatgctccaggacagtcctg

SEQ ID NO: 77230 - DNA, 25 bp, Homo sapien
atgggcgatgcggagctactccgcc

SEQ ID NO: 77231 - DNA, 25 bp, Homo sapien
tcccggccaccgaaatcccgcgctc

SEQ ID NO: 77232 - DNA, 25 bp, Homo sapien
tgccacagagggctagttgcaagag

SEQ ID NO: 77233 - DNA, 25 bp, Homo sapien
aagacgctaggctggacgaagcaga

SEQ ID NO: 77234 - DNA, 25 bp, Homo sapien
ctaatctctgctgtgaagtggaagc

SEQ ID NO: 77235 - DNA, 25 bp, Homo sapien
acatcaccgtctaatctctgctgtg

SEQ ID NO: 77236 - DNA, 25 bp, Homo sapien
agcgggagaatcacccacatcaccg

SEQ ID NO: 77237 - DNA, 25 bp, Homo sapien
tgcggagctactccgccctcaggaa

SEQ ID NO: 77238 - DNA, 25 bp, Homo sapien
tggagtgtcaatcggaatggtgacc

SEQ ID NO: 77239 - DNA, 25 bp, Homo sapien
gtcagctggagtgtcaatcggaatg

SEQ ID NO: 77240 - DNA, 25 bp, Homo sapien
gctgattggtcagctggagtgtcaa

SEQ ID NO: 77241 - DNA, 25 bp, Homo sapien
aggacagcgcgcatgtgcgtccaga

SEQ ID NO: 77242 - DNA, 25 bp, Homo sapien
tccatctcccgagccaggacagcgc

SEQ ID NO: 77243 - DNA, 25 bp, Homo sapien
ggcttcggtgccaaagcctgcgtcc

SEQ ID NO: 77244 - DNA, 25 bp, Homo sapien
ctagcctccgtcccgcatgagagag

SEQ ID NO: 77245 - DNA, 25 bp, Homo sapien
aatcaccgggcttcggtgccaaagc

SEQ ID NO: 77246 - DNA, 25 bp, Homo sapien
tccgtatggaaacatggcgcctagg

SEQ ID NO: 77247 - DNA, 25 bp, Homo sapien
cgaaagaccctttctgctggggagc

SEQ ID NO: 77248 - DNA, 25 bp, Homo sapien
tcgctggcctgaacagctgtttaca

SEQ ID NO: 77249 - DNA, 25 bp, Homo sapien
ggtccaagtcgcaggcatctcttcg

SEQ ID NO: 77250 - DNA, 25 bp, Homo sapien
tcccgcctttccgtacgaagacatg

SEQ ID NO: 77251 - DNA, 25 bp, Homo sapien
gtacgaaaacatggcgcctcactgc

SEQ ID NO: 77252 - DNA, 25 bp, Homo sapien
tgcctctcgcgtttccgtacgaaaa

SEQ ID NO: 77253 - DNA, 25 bp, Homo sapien
cttcttggcaagtgcgaggatcctc

SEQ ID NO: 77254 - DNA, 25 bp, Homo sapien
atcgacaagaacctgcgggaggacg

SEQ ID NO: 77255 - DNA, 25 bp, Homo sapien
cgacccgagtgcttcccgcagaggg

SEQ ID NO: 77256 - DNA, 25 bp, Homo sapien
agtcacaggcttggttcgcccaggc

SEQ ID NO: 77257 - DNA, 25 bp, Homo sapien
ccggcccagtcacaggcttggttcg

SEQ ID NO: 77258 - DNA, 25 bp, Homo sapien
atcaacagcctctaatctcctctgg

SEQ ID NO: 77259 - DNA, 25 bp, Homo sapien
cgctctaagatgatcgacaagaacc

SEQ ID NO: 77260 - DNA, 25 bp, Homo sapien
ggctgtccagcaacagagctcccgg

SEQ ID NO: 77261 - DNA, 25 bp, Homo sapien
cggccgagcgctctaagatgatcga

SEQ ID NO: 77262 - DNA, 25 bp, Homo sapien
ttgcgttgggcgcttgcctcttcct

SEQ ID NO: 77263 - DNA, 25 bp, Homo sapien
tcgacgcggcggaatgcccgtcgct

SEQ ID NO: 77264 - DNA, 25 bp, Homo sapien
aaatggcatccgcttcgctgctgcc

SEQ ID NO: 77265 - DNA, 25 bp, Homo sapien
aggtttcaaaatggcatccgcttcg

SEQ ID NO: 77266 - DNA, 25 bp, Homo sapien
gctgctttgcgttgggcgcttgcct

SEQ ID NO: 77267 - DNA, 25 bp, Homo sapien
gcacagccttggaggtttcaaaatg

SEQ ID NO: 77268 - DNA, 25 bp, Homo sapien
ggggcacagccttggaggtttcaaa

SEQ ID NO: 77269 - DNA, 25 bp, Homo sapien
ccttggaggtttcaaaatggcatcc

SEQ ID NO: 77270 - DNA, 25 bp, Homo sapien
ccgctgagccgcagatgtgcgagca

SEQ ID NO: 77271 - DNA, 25 bp, Homo sapien
ctgagtgccatcgaggcgcctggac

SEQ ID NO: 77272 - DNA, 25 bp, Homo sapien
ctcgcggaaaggctggcctcgactg

SEQ ID NO: 77273 - DNA, 25 bp, Homo sapien
tggctggtcacagaggctgacgtca

SEQ ID NO: 77274 - DNA, 25 bp, Homo sapien
gccgctggacacaaaggcagctttg

SEQ ID NO: 77275 - DNA, 25 bp, Homo sapien
cactggcaggagatgaaaggctgct

SEQ ID NO: 77276 - DNA, 25 bp, Homo sapien
ccgacgacacggagaacaggatcct

SEQ ID NO: 77277 - DNA, 25 bp, Homo sapien
ggagaacaggatcctgcgcccaacc

SEQ ID NO: 77278 - DNA, 25 bp, Homo sapien
tgtttctgttgtcctcgcgggacca

SEQ ID NO: 77279 - DNA, 25 bp, Homo sapien
cctggtcaacaagtggacgacgttc

SEQ ID NO: 77280 - DNA, 25 bp, Homo sapien
ccctttgatcgtcccggcagaacga

SEQ ID NO: 77281 - DNA, 25 bp, Homo sapien
cttcttctttcgtgagacggcggta

SEQ ID NO: 77282 - DNA, 25 bp, Homo sapien
caaggtattttggatcccggagagc

SEQ ID NO: 77283 - DNA, 25 bp, Homo sapien
gtcagagcccaagtttgtcaaggta

SEQ ID NO: 77284 - DNA, 25 bp, Homo sapien
tcgcaggccctgatcctttggattc

SEQ ID NO: 77285 - DNA, 25 bp, Homo sapien
gagggcgacacccacttcgatcagc

SEQ ID NO: 77286 - DNA, 25 bp, Homo sapien
ggattctcccttgaagaccaccagc

SEQ ID NO: 77287 - DNA, 25 bp, Homo sapien
cgcgctgctggaacacaaggtgttc

SEQ ID NO: 77288 - DNA, 25 bp, Homo sapien
ttgagtgctacgcaggccgaacgac

SEQ ID NO: 77289 - DNA, 25 bp, Homo sapien
tcgagcagggctttacgcaaccgct

SEQ ID NO: 77290 - DNA, 25 bp, Homo sapien
tcggctcccaatgactctttgcttc

SEQ ID NO: 77291 - DNA, 25 bp, Homo sapien
ccctgccttgcctaaatctgacttt

SEQ ID NO: 77292 - DNA, 25 bp, Homo sapien
cagcgcctttctggagtgtgagccc

SEQ ID NO: 77293 - DNA, 25 bp, Homo sapien
tgtccagtttggtccctcacctgca

SEQ ID NO: 77294 - DNA, 25 bp, Homo sapien
gctgaccacccttccggagcgtgtt

SEQ ID NO: 77295 - DNA, 25 bp, Homo sapien
agtgcacggtggttaactccgaagc

SEQ ID NO: 77296 - DNA, 25 bp, Homo sapien
attcaggcccacatccacgaggcta

SEQ ID NO: 77297 - DNA, 25 bp, Homo sapien
cacgtggccaatgactgctggggca

SEQ ID NO: 77298 - DNA, 25 bp, Homo sapien
ccagggccctcgagaacaaccaagg

SEQ ID NO: 77299 - DNA, 25 bp, Homo sapien
acgtgccagcctcggtagagttatg

SEQ ID NO: 77300 - DNA, 25 bp, Homo sapien
ctgcgctgagacttggccagacgac

SEQ ID NO: 77301 - DNA, 25 bp, Homo sapien
acgacgcgctggctgaactatgcac

SEQ ID NO: 77302 - DNA, 25 bp, Homo sapien
cggactcctcggtccgacaacgttg

SEQ ID NO: 77303 - DNA, 25 bp, Homo sapien
agctgggtatctcactcagtcgcca

SEQ ID NO: 77304 - DNA, 25 bp, Homo sapien
tcctagctccgcacagctgggtatc

SEQ ID NO: 77305 - DNA, 25 bp, Homo sapien
actgacatgttgatgctggcctctg

SEQ ID NO: 77306 - DNA, 25 bp, Homo sapien
ctcggcatggtctggaaacgaacga

SEQ ID NO: 77307 - DNA, 25 bp, Homo sapien
cttcgagagctcgactctgtgggca

SEQ ID NO: 77308 - DNA, 25 bp, Homo sapien
ctccctcctagtgggtcacaggctg

SEQ ID NO: 77309 - DNA, 25 bp, Homo sapien
gtcctcagagagtggcttctccgtc

SEQ ID NO: 77310 - DNA, 25 bp, Homo sapien
cgtttctgcagcatcttccggtgtg

SEQ ID NO: 77311 - DNA, 25 bp, Homo sapien
tccggtgtgcccaaaggctgacatt

SEQ ID NO: 77312 - DNA, 25 bp, Homo sapien
aggctgacattctgtggcacaccac

SEQ ID NO: 77313 - DNA, 25 bp, Homo sapien
ccggcagaatcgaagcgtggataca

SEQ ID NO: 77314 - DNA, 25 bp, Homo sapien
ccgcagactcctgtgtccgaatgta

SEQ ID NO: 77315 - DNA, 25 bp, Homo sapien
tgataaccggcgatacacatctttg

SEQ ID NO: 77316 - DNA, 25 bp, Homo sapien
acacatctttgtcctgccagttgcg

SEQ ID NO: 77317 - DNA, 25 bp, Homo sapien
tccgaatgtagtgctccacacgttt

SEQ ID NO: 77318 - DNA, 25 bp, Homo sapien
gggcagcaccagatctggctctgca

SEQ ID NO: 77319 - DNA, 25 bp, Homo sapien
cgggctttctatgggagtctcagcc

SEQ ID NO: 77320 - DNA, 25 bp, Homo sapien
gagtctcagccacgagcgccagtca

SEQ ID NO: 77321 - DNA, 25 bp, Homo sapien
tggccgcccatttaggaccctaatg

SEQ ID NO: 77322 - DNA, 25 bp, Homo sapien
tggtccacctttctcggtgccggtg

SEQ ID NO: 77323 - DNA, 25 bp, Homo sapien
cctttaagactccagtgcggaggtg

SEQ ID NO: 77324 - DNA, 25 bp, Homo sapien
tttctgggacgcctctccgcgagca

SEQ ID NO: 77325 - DNA, 25 bp, Homo sapien
gcgccagtcagcctgaaatgtttcc

SEQ ID NO: 77326 - DNA, 25 bp, Homo sapien
ccgtgcgaaaccacctcggctcttc

SEQ ID NO: 77327 - DNA, 25 bp, Homo sapien
cctaggtccgctcccttgtgcgaga

SEQ ID NO: 77328 - DNA, 25 bp, Homo sapien
agaccctggcgagccccgtgcgaaa

SEQ ID NO: 77329 - DNA, 25 bp, Homo sapien
ctacgctccacaggcctctcccggt

SEQ ID NO: 77330 - DNA, 25 bp, Homo sapien
gtccgctcccttgtgcgagactcaa

SEQ ID NO: 77331 - DNA, 25 bp, Homo sapien
tgtgcgagactcaactcccaaaagg

SEQ ID NO: 77332 - DNA, 25 bp, Homo sapien
gcgagactcaactcccaaaagggcc

SEQ ID NO: 77333 - DNA, 25 bp, Homo sapien
aaaagggcccgcgtctgcaccacca

SEQ ID NO: 77334 - DNA, 25 bp, Homo sapien
cggggctaatttcgcgactctggtt

SEQ ID NO: 77335 - DNA, 25 bp, Homo sapien
aagctgtttcgcctggaggctcgcg

SEQ ID NO: 77336 - DNA, 25 bp, Homo sapien
acgtcactaccctggcttggagagg

SEQ ID NO: 77337 - DNA, 25 bp, Homo sapien
ccaattcctgggctgacgtcactac

SEQ ID NO: 77338 - DNA, 25 bp, Homo sapien
ttattccgagcgtgcagaaagcagc

SEQ ID NO: 77339 - DNA, 25 bp, Homo sapien
gccaccgcccactcaaatatgaatt

SEQ ID NO: 77340 - DNA, 25 bp, Homo sapien
ggtgtgtggcttccgcattaacttc

SEQ ID NO: 77341 - DNA, 25 bp, Homo sapien
ttccgcattaacttccggggcagtg

SEQ ID NO: 77342 - DNA, 25 bp, Homo sapien
tcagaccgcctgtcaagggctgtcc

SEQ ID NO: 77343 - DNA, 25 bp, Homo sapien
tccgcttcccagcgcaggctgggtg

SEQ ID NO: 77344 - DNA, 25 bp, Homo sapien
ccgactctgagccatcgggatgcct

SEQ ID NO: 77345 - DNA, 25 bp, Homo sapien
actctgagccatcgggatgcctgtc

SEQ ID NO: 77346 - DNA, 25 bp, Homo sapien
ccagaaaagaggagacccgaggccg

SEQ ID NO: 77347 - DNA, 25 bp, Homo sapien
gtggggccgatggccattaaagccc

SEQ ID NO: 77348 - DNA, 25 bp, Homo sapien
agaggagacccgaggccgtcagacc

SEQ ID NO: 77349 - DNA, 25 bp, Homo sapien
tgtccaggctgaccccgactctgag

SEQ ID NO: 77350 - DNA, 25 bp, Homo sapien
gaggccgcaccaaagcttgctcagc

SEQ ID NO: 77351 - DNA, 25 bp, Homo sapien
ggctcggctgtctccacggaaacct

SEQ ID NO: 77352 - DNA, 25 bp, Homo sapien
cgccagggtggaacccatgccctta

SEQ ID NO: 77353 - DNA, 25 bp, Homo sapien
gcacgctgccacctctgattggctg

SEQ ID NO: 77354 - DNA, 25 bp, Homo sapien
tgggcgcccttagatgctgggcatc

SEQ ID NO: 77355 - DNA, 25 bp, Homo sapien
tcccagcatgcgttgcgagatccca

SEQ ID NO: 77356 - DNA, 25 bp, Homo sapien
gatcccaggtcccagcaagcgcgat

SEQ ID NO: 77357 - DNA, 25 bp, Homo sapien
tgggacagctcccaccgaggaaagt

SEQ ID NO: 77358 - DNA, 25 bp, Homo sapien
ccgggaaatcggcaattagaacgct

SEQ ID NO: 77359 - DNA, 25 bp, Homo sapien
cccgcgcagaattagcctctctgtg

SEQ ID NO: 77360 - DNA, 25 bp, Homo sapien
gatcgccgggatctagctcttgtct

SEQ ID NO: 77361 - DNA, 25 bp, Homo sapien
gaatgcctgcactgtggcctgccca

SEQ ID NO: 77362 - DNA, 25 bp, Homo sapien
cgcgccgcaaccgttaagactgaaa

SEQ ID NO: 77363 - DNA, 25 bp, Homo sapien
gctgctccaggtcatttcgaaagaa

SEQ ID NO: 77364 - DNA, 25 bp, Homo sapien
tgaagtactgctcgagctccgagtc

SEQ ID NO: 77365 - DNA, 25 bp, Homo sapien
tcttgtctcattggggcaggaacgc

SEQ ID NO: 77366 - DNA, 25 bp, Homo sapien
gtgcgacaagggataaaccattttc

SEQ ID NO: 77367 - DNA, 25 bp, Homo sapien
gcactgcaggcctttgcgcacgacg

SEQ ID NO: 77368 - DNA, 25 bp, Homo sapien
cccagatgaagtcgccacagaggtc

SEQ ID NO: 77369 - DNA, 25 bp, Homo sapien
tcgccacagaggtcgcaccacgtgt

SEQ ID NO: 77370 - DNA, 25 bp, Homo sapien
gccgcgcaatggaaacctgggtgca

SEQ ID NO: 77371 - DNA, 25 bp, Homo sapien
gaccgcaaagcaccacgcggagata

SEQ ID NO: 77372 - DNA, 25 bp, Homo sapien
ttcgcgcactcttcagcgatggggc

SEQ ID NO: 77373 - DNA, 25 bp, Homo sapien
taacggacctagtcctcgggagctg

SEQ ID NO: 77374 - DNA, 25 bp, Homo sapien
atttggattcccagcgctttctcgg

SEQ ID NO: 77375 - DNA, 25 bp, Homo sapien
agttccaggtctcccatatcgaggc

SEQ ID NO: 77376 - DNA, 25 bp, Homo sapien
tgctgtcacattcggggacgacgga

SEQ ID NO: 77377 - DNA, 25 bp, Homo sapien
cccgacggtgccaaagtctgggaca

SEQ ID NO: 77378 - DNA, 25 bp, Homo sapien
gagcgtcagttctcgcagccatgga

SEQ ID NO: 77379 - DNA, 25 bp, Homo sapien
ctcgcgcctaaatccgggcgggtct

SEQ ID NO: 77380 - DNA, 25 bp, Homo sapien
agcccatctcgcgtagcgggaagct

SEQ ID NO: 77381 - DNA, 25 bp, Homo sapien
cgcgactgccaatcgccatagtatt

SEQ ID NO: 77382 - DNA, 25 bp, Homo sapien
aatatgcattcgatgcggcagccgc

SEQ ID NO: 77383 - DNA, 25 bp, Homo sapien
ggccagcgattggtaccagttcaga

SEQ ID NO: 77384 - DNA, 25 bp, Homo sapien
tacaatttccatagtgctccgcgcc

SEQ ID NO: 77385 - DNA, 25 bp, Homo sapien
gaccgcagcagggaactacaatttc

SEQ ID NO: 77386 - DNA, 25 bp, Homo sapien
gattcacgctgtaactgggaccgca

SEQ ID NO: 77387 - DNA, 25 bp, Homo sapien
cggagtatcccgctttctttggagg

SEQ ID NO: 77388 - DNA, 25 bp, Homo sapien
tcgcacccggaagtaaagcggctcc

SEQ ID NO: 77389 - DNA, 25 bp, Homo sapien
ccacctcctgtgaacacttgtcaga

SEQ ID NO: 77390 - DNA, 25 bp, Homo sapien
taaaggatccgcttccgatcgggtg

SEQ ID NO: 77391 - DNA, 25 bp, Homo sapien
tagaggaatagtaccgccgcacaca

SEQ ID NO: 77392 - DNA, 25 bp, Homo sapien
tggcctatggccctggtaaaggatc

SEQ ID NO: 77393 - DNA, 25 bp, Homo sapien
gactggtgcctcgttctgtacccga

SEQ ID NO: 77394 - DNA, 25 bp, Homo sapien
tacccgagtcaagcctggtcagctc

SEQ ID NO: 77395 - DNA, 25 bp, Homo sapien
ggctgtcctctaagcgcctgtcttc

SEQ ID NO: 77396 - DNA, 25 bp, Homo sapien
ccggctcctctgcatgctgggatac

SEQ ID NO: 77397 - DNA, 25 bp, Homo sapien
tggcagggcacgttgcatcttcctg

SEQ ID NO: 77398 - DNA, 25 bp, Homo sapien
ctcactgtcgcgttgtagtcgaagc

SEQ ID NO: 77399 - DNA, 25 bp, Homo sapien
taccgagccgaagtagtactgggtc

SEQ ID NO: 77400 - DNA, 25 bp, Homo sapien
cgcggccacagtctgaggtatcttc

SEQ ID NO: 77401 - DNA, 25 bp, Homo sapien
ggtctgtttcatgacgcagctgctc

SEQ ID NO: 77402 - DNA, 25 bp, Homo sapien
ctggagcagtttccgcagtcgatga

SEQ ID NO: 77403 - DNA, 25 bp, Homo sapien
ggggcaggatacagtgcgtctcctt

SEQ ID NO: 77404 - DNA, 25 bp, Homo sapien
atcgcggtctctgcactagctcaca

SEQ ID NO: 77405 - DNA, 25 bp, Homo sapien
tagtcgaagcagatgtgcgggcctc

SEQ ID NO: 77406 - DNA, 25 bp, Homo sapien
tcccggggcttgaagatcttgcctt

SEQ ID NO: 77407 - DNA, 25 bp, Homo sapien
ccgggacctgcgctcaaatagcagc

SEQ ID NO: 77408 - DNA, 25 bp, Homo sapien
tccattcaagatgcggcgccgcggg

SEQ ID NO: 77409 - DNA, 25 bp, Homo sapien
ggcaccgccatgtttccattcaaga

SEQ ID NO: 77410 - DNA, 25 bp, Homo sapien
ccgaggccacttacgtgtgctgctg

SEQ ID NO: 77411 - DNA, 25 bp, Homo sapien
agatcttgccttgcctcattcgggg

SEQ ID NO: 77412 - DNA, 25 bp, Homo sapien
aatcagctgacaagctcggaccgcc

SEQ ID NO: 77413 - DNA, 25 bp, Homo sapien
agtttcgcgacgcagccagagcgcc

SEQ ID NO: 77414 - DNA, 25 bp, Homo sapien
aattggaccgttcgcttgtcgctcg

SEQ ID NO: 77415 - DNA, 25 bp, Homo sapien
gtcgcagtttttagagactaccctc

SEQ ID NO: 77416 - DNA, 25 bp, Homo sapien
ggagcctagaacctggtcgcagttt

SEQ ID NO: 77417 - DNA, 25 bp, Homo sapien
ttcgcttgtcgctcgggtctggctc

SEQ ID NO: 77418 - DNA, 25 bp, Homo sapien
tgtcgggcctagagcccgcccagaa

SEQ ID NO: 77419 - DNA, 25 bp, Homo sapien
ggatccccgaagctacagcgccttg

SEQ ID NO: 77420 - DNA, 25 bp, Homo sapien
cccagagggagcctagaacctggtc

SEQ ID NO: 77421 - DNA, 25 bp, Homo sapien
agcccgcccagaattggaccgttcg

SEQ ID NO: 77422 - DNA, 25 bp, Homo sapien
tccgcagtcctaggccgtaactacg

SEQ ID NO: 77423 - DNA, 25 bp, Homo sapien
tgtttagtcccacggggagcctctc

SEQ ID NO: 77424 - DNA, 25 bp, Homo sapien
gctcttcccagcaaccgaagttttg

SEQ ID NO: 77425 - DNA, 25 bp, Homo sapien
caaggttgcgcaacggctcttccca

SEQ ID NO: 77426 - DNA, 25 bp, Homo sapien
cctctcagccgccaggacaagatgg

SEQ ID NO: 77427 - DNA, 25 bp, Homo sapien
ggtgtttcgccgtttcctctcagcc

SEQ ID NO: 77428 - DNA, 25 bp, Homo sapien
ggcgacctgaggagatcaagccgca

SEQ ID NO: 77429 - DNA, 25 bp, Homo sapien
tgcctcagtgacgactgccggcatc

SEQ ID NO: 77430 - DNA, 25 bp, Homo sapien
aacactgaagctgggctacggcgtc

SEQ ID NO: 77431 - DNA, 25 bp, Homo sapien
cccaaagttggaccagccttcaaca

SEQ ID NO: 77432 - DNA, 25 bp, Homo sapien
tcctaaacgccagctcggagcaatc

SEQ ID NO: 77433 - DNA, 25 bp, Homo sapien
ggctggagccaaatccctgctgtga

SEQ ID NO: 77434 - DNA, 25 bp, Homo sapien
ccctgctgtgattttaaggaagacc

SEQ ID NO: 77435 - DNA, 25 bp, Homo sapien
cactttcctgtatgcaggcctgcga

SEQ ID NO: 77436 - DNA, 25 bp, Homo sapien
gacctcggtagggtcacgacactgg

SEQ ID NO: 77437 - DNA, 25 bp, Homo sapien
aacccaccagcgataggaacactga

SEQ ID NO: 77438 - DNA, 25 bp, Homo sapien
ccatagagtcggtcctccagagaca

SEQ ID NO: 77439 - DNA, 25 bp, Homo sapien
cgcgtcgccatgcactaccagatga

SEQ ID NO: 77440 - DNA, 25 bp, Homo sapien
cgactttcagcaccgggagcgcgtc

SEQ ID NO: 77441 - DNA, 25 bp, Homo sapien
gcaccgacggcagcgactttcagca

SEQ ID NO: 77442 - DNA, 25 bp, Homo sapien
gcacaatggcgtctcgagcaggccc

SEQ ID NO: 77443 - DNA, 25 bp, Homo sapien
cccggtgccttgaggggatccagcc

SEQ ID NO: 77444 - DNA, 25 bp, Homo sapien
tgtcgttgcggtaccaggtccgcgt

SEQ ID NO: 77445 - DNA, 25 bp, Homo sapien
gaagttctcttcacggagccgcgcg

SEQ ID NO: 77446 - DNA, 25 bp, Homo sapien
aatcctttgtctgccgcgttccagc

SEQ ID NO: 77447 - DNA, 25 bp, Homo sapien
cgagctgaccaatcgcgacgctgaa

SEQ ID NO: 77448 - DNA, 25 bp, Homo sapien
gcgagctgctgcctaatcctttgtc

SEQ ID NO: 77449 - DNA, 25 bp, Homo sapien
caatgcccggcagctagcacgaagc

SEQ ID NO: 77450 - DNA, 25 bp, Homo sapien
gccctcttatctcgcggtggaactc

SEQ ID NO: 77451 - DNA, 25 bp, Homo sapien
tgccttctggcattctgcgtcgttg

SEQ ID NO: 77452 - DNA, 25 bp, Homo sapien
ctcctggaccctaggactctgtgtg

SEQ ID NO: 77453 - DNA, 25 bp, Homo sapien
agcagcgtcttcctagaaccgcggg

SEQ ID NO: 77454 - DNA, 25 bp, Homo sapien
ggaagccacgcctcctattttgttc

SEQ ID NO: 77455 - DNA, 25 bp, Homo sapien
gctgtcacgttctaggttgcgagta

SEQ ID NO: 77456 - DNA, 25 bp, Homo sapien
actgccagtacaggggcctccctgg

SEQ ID NO: 77457 - DNA, 25 bp, Homo sapien
tacctcagcaaggtgcgttgccgcc

SEQ ID NO: 77458 - DNA, 25 bp, Homo sapien
cgtctgtactctcaggccgttcgtc

SEQ ID NO: 77459 - DNA, 25 bp, Homo sapien
gcccagttcagaggctccaaggctg

SEQ ID NO: 77460 - DNA, 25 bp, Homo sapien
aggtgccactagaagcgccaggctg

SEQ ID NO: 77461 - DNA, 25 bp, Homo sapien
cgcacagtagcggactgccagtaca

SEQ ID NO: 77462 - DNA, 25 bp, Homo sapien
gcctgtgagggatgcgccgcccact

SEQ ID NO: 77463 - DNA, 25 bp, Homo sapien
cccgcctggattcgcatcctcgtgc

SEQ ID NO: 77464 - DNA, 25 bp, Homo sapien
ccaatagcttctcgcggatttccct

SEQ ID NO: 77465 - DNA, 25 bp, Homo sapien
tccggggccgggcagtccaatagct

SEQ ID NO: 77466 - DNA, 25 bp, Homo sapien
cagcgattctagaagccggtccggg

SEQ ID NO: 77467 - DNA, 25 bp, Homo sapien
cccggaccagcgattctagaagccg

SEQ ID NO: 77468 - DNA, 25 bp, Homo sapien
ccctccggggtttgctgcagctgag

SEQ ID NO: 77469 - DNA, 25 bp, Homo sapien
agtccaatagcttctcgcggatttc

SEQ ID NO: 77470 - DNA, 25 bp, Homo sapien
cagtcgctgcccttacccaagatgg

SEQ ID NO: 77471 - DNA, 25 bp, Homo sapien
ctcaacagatgtaaggcgtggccga

SEQ ID NO: 77472 - DNA, 25 bp, Homo sapien
ggatccgttgcccacgcgaatgaaa

SEQ ID NO: 77473 - DNA, 25 bp, Homo sapien
tatcagcctatgcacggcgggctcc

SEQ ID NO: 77474 - DNA, 25 bp, Homo sapien
ttccttcagatgtcccgcagtccgt

SEQ ID NO: 77475 - DNA, 25 bp, Homo sapien
ggcgcttccctccacggtctagagt

SEQ ID NO: 77476 - DNA, 25 bp, Homo sapien
cctaacctgttgtcttggctgaccc

SEQ ID NO: 77477 - DNA, 25 bp, Homo sapien
gggtacgcgggtcaactcaacagat

SEQ ID NO: 77478 - DNA, 25 bp, Homo sapien
gacggcgcaccttgataacgcaatg

SEQ ID NO: 77479 - DNA, 25 bp, Homo sapien
tgaatttccggcacccacaggacgc

SEQ ID NO: 77480 - DNA, 25 bp, Homo sapien
gccgtgtggcctacgtgaatttccg

SEQ ID NO: 77481 - DNA, 25 bp, Homo sapien
aagcgcttcggcgagatcagcctcc

SEQ ID NO: 77482 - DNA, 25 bp, Homo sapien
ggctcttccaccagttcaagcgctt

SEQ ID NO: 77483 - DNA, 25 bp, Homo sapien
ccgcgcctgagtacaagacgttgct

SEQ ID NO: 77484 - DNA, 25 bp, Homo sapien
ccgcgccgagtccttttgtccaaga

SEQ ID NO: 77485 - DNA, 25 bp, Homo sapien
gcccgctcaaggtagagcccgtgta

SEQ ID NO: 77486 - DNA, 25 bp, Homo sapien
cacaccttctgtactcagaccgaga

SEQ ID NO: 77487 - DNA, 25 bp, Homo sapien
acccattcaccatatgaggaacgga

SEQ ID NO: 77488 - DNA, 25 bp, Homo sapien
gtgaccgtgggaggacaacccattc

SEQ ID NO: 77489 - DNA, 25 bp, Homo sapien
cggagaagcctttccagtgaccgtg

SEQ ID NO: 77490 - DNA, 25 bp, Homo sapien
cagatggagaccgtggtttgcccaa

SEQ ID NO: 77491 - DNA, 25 bp, Homo sapien
cagccttgagggctacagtcgctca

SEQ ID NO: 77492 - DNA, 25 bp, Homo sapien
ctcagaccgagaccggacttttttg

SEQ ID NO: 77493 - DNA, 25 bp, Homo sapien
gctctgaccgccgaaacagccttga

SEQ ID NO: 77494 - DNA, 25 bp, Homo sapien
ggcccgccgtatagtacggaagatg

SEQ ID NO: 77495 - DNA, 25 bp, Homo sapien
agcccgtacggaacagagactagga

SEQ ID NO: 77496 - DNA, 25 bp, Homo sapien
ctcctccaggtaggggcggacacac

SEQ ID NO: 77497 - DNA, 25 bp, Homo sapien
ctccgggcggaagagttactctcgg

SEQ ID NO: 77498 - DNA, 25 bp, Homo sapien
cacagcggcccacatattatgcgtc

SEQ ID NO: 77499 - DNA, 25 bp, Homo sapien
tattatgcgtcactcgcgcgctacg

SEQ ID NO: 77500 - DNA, 25 bp, Homo sapien
gaacgcctgcacgatcggggaaaaa

SEQ ID NO: 77501 - DNA, 25 bp, Homo sapien
attgacgcatgagctcttcgcctgg

SEQ ID NO: 77502 - DNA, 25 bp, Homo sapien
cggggcctcagtggcttgatatttg

SEQ ID NO: 77503 - DNA, 25 bp, Homo sapien
tatttgaggatttcgtagccgggga

SEQ ID NO: 77504 - DNA, 25 bp, Homo sapien
ggacacggagacttaactgttgccc

SEQ ID NO: 77505 - DNA, 25 bp, Homo sapien
ctctgcgcttttggctctggatgct

SEQ ID NO: 77506 - DNA, 25 bp, Homo sapien
tcagtcggctctcagcggaactttc

SEQ ID NO: 77507 - DNA, 25 bp, Homo sapien
cgcagactttgcctaggcgggcgaa

SEQ ID NO: 77508 - DNA, 25 bp, Homo sapien
gaagctgaacgtgaggtccctcggc

SEQ ID NO: 77509 - DNA, 25 bp, Homo sapien
cgcaacaatggggaccgactggaga

SEQ ID NO: 77510 - DNA, 25 bp, Homo sapien
gccaccgacgctgctgctgggactt

SEQ ID NO: 77511 - DNA, 25 bp, Homo sapien
gccaagcctcagggctcaagggaag

SEQ ID NO: 77512 - DNA, 25 bp, Homo sapien
tctgagctgcggtagcactcgcggc

SEQ ID NO: 77513 - DNA, 25 bp, Homo sapien
cgacgctgctgctgggacttctgct

SEQ ID NO: 77514 - DNA, 25 bp, Homo sapien
tccggaggctacgtgctttctttgt

SEQ ID NO: 77515 - DNA, 25 bp, Homo sapien
ggctacgtgctttctttgtcaatga

SEQ ID NO: 77516 - DNA, 25 bp, Homo sapien
ctttgtcaatgaggcgccgctctga

SEQ ID NO: 77517 - DNA, 25 bp, Homo sapien
gccgctctgagctgcggtagcactc

SEQ ID NO: 77518 - DNA, 25 bp, Homo sapien
gcaggctccgtaaccgaaccctgag

SEQ ID NO: 77519 - DNA, 25 bp, Homo sapien
tagcaccgaagtttagcccaggacg

SEQ ID NO: 77520 - DNA, 25 bp, Homo sapien
cgccctctgctagcaccgaagttta

SEQ ID NO: 77521 - DNA, 25 bp, Homo sapien
gctctgagtaaataggcaaggcccg

SEQ ID NO: 77522 - DNA, 25 bp, Homo sapien
tcctttaagttacagacgtgcgtgg

SEQ ID NO: 77523 - DNA, 25 bp, Homo sapien
agcctgggctgcaaactttagcgtc

SEQ ID NO: 77524 - DNA, 25 bp, Homo sapien
gggccgctctttgcatcttgtcttg

SEQ ID NO: 77525 - DNA, 25 bp, Homo sapien
aggcatacccactggggcgtaggtc

SEQ ID NO: 77526 - DNA, 25 bp, Homo sapien
acagcgttccctgagagctccggga

SEQ ID NO: 77527 - DNA, 25 bp, Homo sapien
cacctatgctctctaggtggtagtc

SEQ ID NO: 77528 - DNA, 25 bp, Homo sapien
gcctttcttctccagaaaacgcacg

SEQ ID NO: 77529 - DNA, 25 bp, Homo sapien
tgtgtccagacagcgttccctgaga

SEQ ID NO: 77530 - DNA, 25 bp, Homo sapien
ccttacctcacgtcccagggtcctg

SEQ ID NO: 77531 - DNA, 25 bp, Homo sapien
tgccgctgccgacctttttggccct

SEQ ID NO: 77532 - DNA, 25 bp, Homo sapien
ctccagcgcagagcgagagcgctcg

SEQ ID NO: 77533 - DNA, 25 bp, Homo sapien
ctctctaggtggtagtctgactatg

SEQ ID NO: 77534 - DNA, 25 bp, Homo sapien
cggcgcgtacccaagcctgaaagtg

SEQ ID NO: 77535 - DNA, 25 bp, Homo sapien
tccttcgccggccatgtctgtttac

SEQ ID NO: 77536 - DNA, 25 bp, Homo sapien
tgcgcagcgtcctgctgatctcctt

SEQ ID NO: 77537 - DNA, 25 bp, Homo sapien
cgactacagggaactactccgggcg

SEQ ID NO: 77538 - DNA, 25 bp, Homo sapien
ggccgacgtgaagcagctttccggt

SEQ ID NO: 77539 - DNA, 25 bp, Homo sapien
gaaagcgccgcgactccatcgctgg

SEQ ID NO: 77540 - DNA, 25 bp, Homo sapien
ctcggggcaacagagcagcgaagaa

SEQ ID NO: 77541 - DNA, 25 bp, Homo sapien
tctgtttacccgcaaaggaggctgg

SEQ ID NO: 77542 - DNA, 25 bp, Homo sapien
gacgactggccgaaaagccgcattc

SEQ ID NO: 77543 - DNA, 25 bp, Homo sapien
aggcgagcaccctacggtatcccga

SEQ ID NO: 77544 - DNA, 25 bp, Homo sapien
tgctgctgctcgcttacttcagtcg

SEQ ID NO: 77545 - DNA, 25 bp, Homo sapien
acttcagtcgcctctgcgccaaggg

SEQ ID NO: 77546 - DNA, 25 bp, Homo sapien
gcccgacttgcagacctaggttgag

SEQ ID NO: 77547 - DNA, 25 bp, Homo sapien
acgcaacggacactggctggaaccc

SEQ ID NO: 77548 - DNA, 25 bp, Homo sapien
ccctgaaatccttggggtgcctcga

SEQ ID NO: 77549 - DNA, 25 bp, Homo sapien
ggaatgagccttcgaccctgaaatc

SEQ ID NO: 77550 - DNA, 25 bp, Homo sapien
ttatctcgggccagctgctcatcgt

SEQ ID NO: 77551 - DNA, 25 bp, Homo sapien
cgcattgcacgcatcttcggtgggg

SEQ ID NO: 77552 - DNA, 25 bp, Homo sapien
gcaaccaccgcgatgcaagtatgtt

SEQ ID NO: 77553 - DNA, 25 bp, Homo sapien
tgcctcacaggtggccatctgcctg

SEQ ID NO: 77554 - DNA, 25 bp, Homo sapien
aggtggtgacactgcgctgcaacca

SEQ ID NO: 77555 - DNA, 25 bp, Homo sapien
ggcctacaatgtgctcctcatcgcg

SEQ ID NO: 77556 - DNA, 25 bp, Homo sapien
gcgctctgcacgctttatgccttca

SEQ ID NO: 77557 - DNA, 25 bp, Homo sapien
tatgccttcaagactcgcaagtgcc

SEQ ID NO: 77558 - DNA, 25 bp, Homo sapien
cccggccttggatatgccagatcga

SEQ ID NO: 77559 - DNA, 25 bp, Homo sapien
ggcgctagacccaacggggatccaa

SEQ ID NO: 77560 - DNA, 25 bp, Homo sapien
gcgccctttcgcgttctggaacgtg

SEQ ID NO: 77561 - DNA, 25 bp, Homo sapien
tcgaagtcggagcaagagccttctc

SEQ ID NO: 77562 - DNA, 25 bp, Homo sapien
gaagttcctaggctcccgcaccagg

SEQ ID NO: 77563 - DNA, 25 bp, Homo sapien
tactgctccattgggtccttctgca

SEQ ID NO: 77564 - DNA, 25 bp, Homo sapien
gccgcagaactcacgtggcagctga

SEQ ID NO: 77565 - DNA, 25 bp, Homo sapien
cccgcgtattgataggcttccaccg

SEQ ID NO: 77566 - DNA, 25 bp, Homo sapien
ggactctctggatagccgcctttcc

SEQ ID NO: 77567 - DNA, 25 bp, Homo sapien
tggcgcacctgtgcgtcgtggacct

SEQ ID NO: 77568 - DNA, 25 bp, Homo sapien
cgactccactcggactctctggata

SEQ ID NO: 77569 - DNA, 25 bp, Homo sapien
ccgtgggccaatttgcagcctgctg

SEQ ID NO: 77570 - DNA, 25 bp, Homo sapien
agcctgctggctgccttatggctgc

SEQ ID NO: 77571 - DNA, 25 bp, Homo sapien
tgctcggcgcctacggcggcatctt

SEQ ID NO: 77572 - DNA, 25 bp, Homo sapien
gggactgcgcgacgcgctctacctg

SEQ ID NO: 77573 - DNA, 25 bp, Homo sapien
aagcggctgtcacctgggtcgccta

SEQ ID NO: 77574 - DNA, 25 bp, Homo sapien
taaactcgttctcacagcggcgtca

SEQ ID NO: 77575 - DNA, 25 bp, Homo sapien
tgctgagcacggtttcgaactcttc

SEQ ID NO: 77576 - DNA, 25 bp, Homo sapien
agcggcgtcagtttcccaaagcctc

SEQ ID NO: 77577 - DNA, 25 bp, Homo sapien
gcgtccatagactccgctaaactcg

SEQ ID NO: 77578 - DNA, 25 bp, Homo sapien
tggccacaagctcgcagcgtccata

SEQ ID NO: 77579 - DNA, 25 bp, Homo sapien
ctcgctagctctggaagggagcacc

SEQ ID NO: 77580 - DNA, 25 bp, Homo sapien
ggactacggttctggctcgctagct

SEQ ID NO: 77581 - DNA, 25 bp, Homo sapien
ttgacctcgcggtcaggttgcttcc

SEQ ID NO: 77582 - DNA, 25 bp, Homo sapien
acgcagacgactcggtaactgggtt

SEQ ID NO: 77583 - DNA, 25 bp, Homo sapien
cagacgactcggtaactgggttgca

SEQ ID NO: 77584 - DNA, 25 bp, Homo sapien
ctcggtaactgggttgcaggcccgc

SEQ ID NO: 77585 - DNA, 25 bp, Homo sapien
gctcctggccgcctagagccggagc

SEQ ID NO: 77586 - DNA, 25 bp, Homo sapien
gcccgcccgctcatcccgttgggcc

SEQ ID NO: 77587 - DNA, 25 bp, Homo sapien
gccggctctcaagccaaaaacagtt

SEQ ID NO: 77588 - DNA, 25 bp, Homo sapien
cgactcggtaactgggttgcaggcc

SEQ ID NO: 77589 - DNA, 25 bp, Homo sapien
ctccacgcagacgactcggtaactg

SEQ ID NO: 77590 - DNA, 25 bp, Homo sapien
ggccctcactgacggtcttcggtct

SEQ ID NO: 77591 - DNA, 25 bp, Homo sapien
agggctttgcagctctgcatcttga

SEQ ID NO: 77592 - DNA, 25 bp, Homo sapien
ctctgcatcttgagagcctcggggc

SEQ ID NO: 77593 - DNA, 25 bp, Homo sapien
ctccagtaatctcgctgaggcccga

SEQ ID NO: 77594 - DNA, 25 bp, Homo sapien
ggtcctgagcctgcgacctcgcagg

SEQ ID NO: 77595 - DNA, 25 bp, Homo sapien
caggcgacctcgctggaccctaagt

SEQ ID NO: 77596 - DNA, 25 bp, Homo sapien
ctaagtccaggccacagtcagggaa

SEQ ID NO: 77597 - DNA, 25 bp, Homo sapien
gggatccggatctaatcctccagta

SEQ ID NO: 77598 - DNA, 25 bp, Homo sapien
gctctcggcccaacttcagctgcgg

SEQ ID NO: 77599 - DNA, 25 bp, Homo sapien
gcgtcctcgggacgcacgcaccacc

SEQ ID NO: 77600 - DNA, 25 bp, Homo sapien
tcttttctgcacgtctgcccgggga

SEQ ID NO: 77601 - DNA, 25 bp, Homo sapien
cggcgcgttcttttctgcacgtctg

SEQ ID NO: 77602 - DNA, 25 bp, Homo sapien
taccgcaacgcagccagtgggcgcg

SEQ ID NO: 77603 - DNA, 25 bp, Homo sapien
atgcaaatgacctggtccctcagcc

SEQ ID NO: 77604 - DNA, 25 bp, Homo sapien
ccaacctgggatccctcgcgcgtca

SEQ ID NO: 77605 - DNA, 25 bp, Homo sapien
atgacctggtccctcagccaatggc

SEQ ID NO: 77606 - DNA, 25 bp, Homo sapien
ccgaagcgcctagaaccggaagaga

SEQ ID NO: 77607 - DNA, 25 bp, Homo sapien
gcagcttttgctcccgacagacaca

SEQ ID NO: 77608 - DNA, 25 bp, Homo sapien
ccacccgtaagtcgcggatggcatc

SEQ ID NO: 77609 - DNA, 25 bp, Homo sapien
tgcagcacgggaaatagggtcaaca

SEQ ID NO: 77610 - DNA, 25 bp, Homo sapien
tcaacaacgccggaaagtactactg

SEQ ID NO: 77611 - DNA, 25 bp, Homo sapien
gctccgcgaagaaaagttccgaagc

SEQ ID NO: 77612 - DNA, 25 bp, Homo sapien
tccgaagcccggaagaacgcaagcc

SEQ ID NO: 77613 - DNA, 25 bp, Homo sapien
acagacacacggtcggtcaccagtc

SEQ ID NO: 77614 - DNA, 25 bp, Homo sapien
gtcaccgtttcagaggacctcatcg

SEQ ID NO: 77615 - DNA, 25 bp, Homo sapien
atgagaactgaacgcctactacgtg

SEQ ID NO: 77616 - DNA, 25 bp, Homo sapien
gatggtcaagctgagcaacctctcc

SEQ ID NO: 77617 - DNA, 25 bp, Homo sapien
caacagcatagttttcctgggacgg

SEQ ID NO: 77618 - DNA, 25 bp, Homo sapien
caagctcttctggacactgcgggaa

SEQ ID NO: 77619 - DNA, 25 bp, Homo sapien
ctcatgggttcactctgcgcgtgct

SEQ ID NO: 77620 - DNA, 25 bp, Homo sapien
gagctgactacgatccgcctaggga

SEQ ID NO: 77621 - DNA, 25 bp, Homo sapien
ccctggactagctcggagctgacta

SEQ ID NO: 77622 - DNA, 25 bp, Homo sapien
gaaatgcagttccaagccgcccacg

SEQ ID NO: 77623 - DNA, 25 bp, Homo sapien
tcgcagccatcgctctggccattag

SEQ ID NO: 77624 - DNA, 25 bp, Homo sapien
tttttgcccgacgactggaagcaga

SEQ ID NO: 77625 - DNA, 25 bp, Homo sapien
tccggctactctaacggcgagcgca

SEQ ID NO: 77626 - DNA, 25 bp, Homo sapien
ggtggagctacacttcccaacatga

SEQ ID NO: 77627 - DNA, 25 bp, Homo sapien
gattgcgttaaagcacccgcgcgcg

SEQ ID NO: 77628 - DNA, 25 bp, Homo sapien
cccgcaggaacctattgagagctga

SEQ ID NO: 77629 - DNA, 25 bp, Homo sapien
aactctcagtggttcgccgtccgaa

SEQ ID NO: 77630 - DNA, 25 bp, Homo sapien
tcctccagatcttttgcctagacgg

SEQ ID NO: 77631 - DNA, 25 bp, Homo sapien
cggtcactcccgctgtatattaagg

SEQ ID NO: 77632 - DNA, 25 bp, Homo sapien
gccgctttagaattcccttctcata

SEQ ID NO: 77633 - DNA, 25 bp, Homo sapien
ccgatatccgcagagcccaagaagt

SEQ ID NO: 77634 - DNA, 25 bp, Homo sapien
gctgtatattaaggcgccggcgatc

SEQ ID NO: 77635 - DNA, 25 bp, Homo sapien
gcaacgagcgtttcgtttggacttc

SEQ ID NO: 77636 - DNA, 25 bp, Homo sapien
tggacttctcgacttgagtgcccgc

SEQ ID NO: 77637 - DNA, 25 bp, Homo sapien
cgccgccttgaggtcagcgtttatc

SEQ ID NO: 77638 - DNA, 25 bp, Homo sapien
taaaggcagacgctgtttttctacc

SEQ ID NO: 77639 - DNA, 25 bp, Homo sapien
acgtaatggcacatggcccgtcgcc

SEQ ID NO: 77640 - DNA, 25 bp, Homo sapien
tttaaagcccggacaggtgcagctc

SEQ ID NO: 77641 - DNA, 25 bp, Homo sapien
cggggctggcaaacgtcattcccta

SEQ ID NO: 77642 - DNA, 25 bp, Homo sapien
tttttctacccatgtggcccacacg

SEQ ID NO: 77643 - DNA, 25 bp, Homo sapien
tagacctgtggagccgtcgtgaact

SEQ ID NO: 77644 - DNA, 25 bp, Homo sapien
ctactcagccgatgactcgggtttc

SEQ ID NO: 77645 - DNA, 25 bp, Homo sapien
acacgcgtctccgtttcagtggcgg

SEQ ID NO: 77646 - DNA, 25 bp, Homo sapien
gtcagggctcaggatcaccagcacc

SEQ ID NO: 77647 - DNA, 25 bp, Homo sapien
agagaccactgacccggtccgtgtg

SEQ ID NO: 77648 - DNA, 25 bp, Homo sapien
gtgggccagcacaaacagcgtcttg

SEQ ID NO: 77649 - DNA, 25 bp, Homo sapien
ctgccatagaccgaggcccacaggt

SEQ ID NO: 77650 - DNA, 25 bp, Homo sapien
ccacaggttctcaaagagggttttg

SEQ ID NO: 77651 - DNA, 25 bp, Homo sapien
cgaagctcgttgtacacccagtctg

SEQ ID NO: 77652 - DNA, 25 bp, Homo sapien
tgtcgaagaccacgaaggcatcgta

SEQ ID NO: 77653 - DNA, 25 bp, Homo sapien
ctgcgctctgcgttttgtcgaagac

SEQ ID NO: 77654 - DNA, 25 bp, Homo sapien
cggcaacgctcgctggaccaagaga

SEQ ID NO: 77655 - DNA, 25 bp, Homo sapien
atcatggccgctaggctttgccctc

SEQ ID NO: 77656 - DNA, 25 bp, Homo sapien
agcgtacacgggtttgcacccagga

SEQ ID NO: 77657 - DNA, 25 bp, Homo sapien
tctccgaataggagtgggtcccagc

SEQ ID NO: 77658 - DNA, 25 bp, Homo sapien
cccaagccaggtgggtctccgaata

SEQ ID NO: 77659 - DNA, 25 bp, Homo sapien
gatgatgattgatccgccgtgcgca

SEQ ID NO: 77660 - DNA, 25 bp, Homo sapien
ggcgcttccgagagcccagaccgag

SEQ ID NO: 77661 - DNA, 25 bp, Homo sapien
cagcgcgttcctctgtggcaggaga

SEQ ID NO: 77662 - DNA, 25 bp, Homo sapien
gccgcgccatgtccgccggctggtt

SEQ ID NO: 77663 - DNA, 25 bp, Homo sapien
ccctggaatgcaggctacgccgagt

SEQ ID NO: 77664 - DNA, 25 bp, Homo sapien
taccctggaatgcaggctacgccga

SEQ ID NO: 77665 - DNA, 25 bp, Homo sapien
acgctaccctggaatgcaggctacg

SEQ ID NO: 77666 - DNA, 25 bp, Homo sapien
gcacgctaccctggaatgcaggcta

SEQ ID NO: 77667 - DNA, 25 bp, Homo sapien
aggacgcacgctaccctggaatgca

SEQ ID NO: 77668 - DNA, 25 bp, Homo sapien
cacgaggacgcacgctaccctggaa

SEQ ID NO: 77669 - DNA, 25 bp, Homo sapien
ggcctgaacccgcttcgggtcctgc

SEQ ID NO: 77670 - DNA, 25 bp, Homo sapien
tcttcttcctgcttggtcgagggtc

SEQ ID NO: 77671 - DNA, 25 bp, Homo sapien
cgcagcgtccgcttagacagcttcg

SEQ ID NO: 77672 - DNA, 25 bp, Homo sapien
ggcaggaacgcgtgcaaaataggct

SEQ ID NO: 77673 - DNA, 25 bp, Homo sapien
gtcgtcgctactcgagatgaccgtc

SEQ ID NO: 77674 - DNA, 25 bp, Homo sapien
ttttcgcggaacaccttagcgacgc

SEQ ID NO: 77675 - DNA, 25 bp, Homo sapien
tcgccggctcattgtgtccgccatt

SEQ ID NO: 77676 - DNA, 25 bp, Homo sapien
gtccgccattttggggcgacaggca

SEQ ID NO: 77677 - DNA, 25 bp, Homo sapien
tcgcaggcaagcttgaccgctagtc

SEQ ID NO: 77678 - DNA, 25 bp, Homo sapien
taaggccctaccttaggatgacgtc

SEQ ID NO: 77679 - DNA, 25 bp, Homo sapien
ttcagccagagctcgcacccgcctg

SEQ ID NO: 77680 - DNA, 25 bp, Homo sapien
ccagggctcgcatggccttcagaag

SEQ ID NO: 77681 - DNA, 25 bp, Homo sapien
atggccttcagaagcggtccctggg

SEQ ID NO: 77682 - DNA, 25 bp, Homo sapien
ttctttctcgcatcaccgggcatta

SEQ ID NO: 77683 - DNA, 25 bp, Homo sapien
tcaccgggcattacgcggcagccat

SEQ ID NO: 77684 - DNA, 25 bp, Homo sapien
ctaccttaggatgacgtcacttccg

SEQ ID NO: 77685 - DNA, 25 bp, Homo sapien
agccatttccctcgctaaggcccta

SEQ ID NO: 77686 - DNA, 25 bp, Homo sapien
tgtccgtgacgcagttggatcagtc

SEQ ID NO: 77687 - DNA, 25 bp, Homo sapien
tcctgctcgggacgccgcctgaggt

SEQ ID NO: 77688 - DNA, 25 bp, Homo sapien
ggtctgggacagtgctaacgcagtc

SEQ ID NO: 77689 - DNA, 25 bp, Homo sapien
tagatccacctcagacatcggcagc

SEQ ID NO: 77690 - DNA, 25 bp, Homo sapien
catcggcagcaagaccagaatggcc

SEQ ID NO: 77691 - DNA, 25 bp, Homo sapien
accagaatggccgagtctacagggc

SEQ ID NO: 77692 - DNA, 25 bp, Homo sapien
cagatgtccagaggccctgtgtccg

SEQ ID NO: 77693 - DNA, 25 bp, Homo sapien
gcctccttcacgcagatgtccagag

SEQ ID NO: 77694 - DNA, 25 bp, Homo sapien
gcctgtgtcaacgactaaagctcca

SEQ ID NO: 77695 - DNA, 25 bp, Homo sapien
gcggcagacgtcaccaaggcgcgac

SEQ ID NO: 77696 - DNA, 25 bp, Homo sapien
aggtagctaccacggcctgtgtcaa

SEQ ID NO: 77697 - DNA, 25 bp, Homo sapien
taaagctccagtacagcggcgccct

SEQ ID NO: 77698 - DNA, 25 bp, Homo sapien
gccgcgattcccgaaggtcatagtc

SEQ ID NO: 77699 - DNA, 25 bp, Homo sapien
tgggctcgtcttccgcctgtcggac

SEQ ID NO: 77700 - DNA, 25 bp, Homo sapien
cctgtcggacagcagatgcgggcat

SEQ ID NO: 77701 - DNA, 25 bp, Homo sapien
ttctactaacggtaggcgtcgccgc

SEQ ID NO: 77702 - DNA, 25 bp, Homo sapien
cggcggagacccgaacatggcgacc

SEQ ID NO: 77703 - DNA, 25 bp, Homo sapien
cggcgccacgcaggtagattacgca

SEQ ID NO: 77704 - DNA, 25 bp, Homo sapien
ttggaaaagggtacgcgatcagaaa

SEQ ID NO: 77705 - DNA, 25 bp, Homo sapien
attacgcaagcgagcacctcgcacg

SEQ ID NO: 77706 - DNA, 25 bp, Homo sapien
ggctcggagcttgtggacacttata

SEQ ID NO: 77707 - DNA, 25 bp, Homo sapien
cgcaggtagattacgcaagcgagca

SEQ ID NO: 77708 - DNA, 25 bp, Homo sapien
ttgtggacacttatacggtgtgttg

SEQ ID NO: 77709 - DNA, 25 bp, Homo sapien
gagacccgaacatggcgaccgcgcg

SEQ ID NO: 77710 - DNA, 25 bp, Homo sapien
cttcggcatcgcagtcttcgagatc

SEQ ID NO: 77711 - DNA, 25 bp, Homo sapien
aagttccacttcctgcgcgtctaca

SEQ ID NO: 77712 - DNA, 25 bp, Homo sapien
ggtaccgctttgtcactgccatctt

SEQ ID NO: 77713 - DNA, 25 bp, Homo sapien
cgcctttgctgatggccacgtgcta

SEQ ID NO: 77714 - DNA, 25 bp, Homo sapien
cgccggggactactcaggcaacatc

SEQ ID NO: 77715 - DNA, 25 bp, Homo sapien
cggcacagtgagaacacgctcttca

SEQ ID NO: 77716 - DNA, 25 bp, Homo sapien
tttggcttcctcatgccggagctgt

SEQ ID NO: 77717 - DNA, 25 bp, Homo sapien
ttttgcttcccgcatggcgacctca

SEQ ID NO: 77718 - DNA, 25 bp, Homo sapien
gcacttcattgaccgtgtcctgctg

SEQ ID NO: 77719 - DNA, 25 bp, Homo sapien
tacctcaatgacttcgcgcgcgtgg

SEQ ID NO: 77720 - DNA, 25 bp, Homo sapien
agcgcccttgtgtccttccgaggac

SEQ ID NO: 77721 - DNA, 25 bp, Homo sapien
cccagggcagcatatacctcaatga

SEQ ID NO: 77722 - DNA, 25 bp, Homo sapien
gtgaacggcatcctgcacttcattg

SEQ ID NO: 77723 - DNA, 25 bp, Homo sapien
aagaaccgggactgcctgcaccctg

SEQ ID NO: 77724 - DNA, 25 bp, Homo sapien
agggcacccactgcgcttcagcgag

SEQ ID NO: 77725 - DNA, 25 bp, Homo sapien
ctggtgtttcgctaccacgtggttg

SEQ ID NO: 77726 - DNA, 25 bp, Homo sapien
tgcggaagatgctgccgaactgcgc

SEQ ID NO: 77727 - DNA, 25 bp, Homo sapien
aacagggccttggtgatgcacctgg

SEQ ID NO: 77728 - DNA, 25 bp, Homo sapien
tagaaggtgaagtccacgcggtagt

SEQ ID NO: 77729 - DNA, 25 bp, Homo sapien
ccacgcggtagttgagcaggcagct

SEQ ID NO: 77730 - DNA, 25 bp, Homo sapien
ccatgtagaggtcagagaagcgcac

SEQ ID NO: 77731 - DNA, 25 bp, Homo sapien
agcgcacgaggcgccttgagaagta

SEQ ID NO: 77732 - DNA, 25 bp, Homo sapien
ctgcgcattgaacagggccttggtg

SEQ ID NO: 77733 - DNA, 25 bp, Homo sapien
atgctgccgaactgcgcattgaaca

SEQ ID NO: 77734 - DNA, 25 bp, Homo sapien
aagctgcctgcaccaacgttgctgg

SEQ ID NO: 77735 - DNA, 25 bp, Homo sapien
cggatgaggctcttgctgatgtcca

SEQ ID NO: 77736 - DNA, 25 bp, Homo sapien
ctgctcccagcaggagtgggttttg

SEQ ID NO: 77737 - DNA, 25 bp, Homo sapien
aggtctgtcgcgagcaaccctacac

SEQ ID NO: 77738 - DNA, 25 bp, Homo sapien
cttagcccagcaagcgtgctccgtg

SEQ ID NO: 77739 - DNA, 25 bp, Homo sapien
agcagttattgggtcgctccggcac

SEQ ID NO: 77740 - DNA, 25 bp, Homo sapien
gctgggccctgcatagcagttattg

SEQ ID NO: 77741 - DNA, 25 bp, Homo sapien
gccgcagcgctggaacacactgtct

SEQ ID NO: 77742 - DNA, 25 bp, Homo sapien
catgtcctggtagcgagcccatagg

SEQ ID NO: 77743 - DNA, 25 bp, Homo sapien
gtgcaccagtctccgcatgtcctgg

SEQ ID NO: 77744 - DNA, 25 bp, Homo sapien
cgtccatcagtccacgcggaagaca

SEQ ID NO: 77745 - DNA, 25 bp, Homo sapien
gccctggaagtcagcgggcctaaga

SEQ ID NO: 77746 - DNA, 25 bp, Homo sapien
ctaagagcggccgtccctgagaggc

SEQ ID NO: 77747 - DNA, 25 bp, Homo sapien
accctgcgcctctggatgcttctga

SEQ ID NO: 77748 - DNA, 25 bp, Homo sapien
ggactgactgcccactgaccagagc

SEQ ID NO: 77749 - DNA, 25 bp, Homo sapien
tggtctaacaaataaagagcccttc

SEQ ID NO: 77750 - DNA, 25 bp, Homo sapien
cgggaagcagcgatttggcatctac

SEQ ID NO: 77751 - DNA, 25 bp, Homo sapien
cgagcatgttcaccagggcccaggt

SEQ ID NO: 77752 - DNA, 25 bp, Homo sapien
tccacgacctcggtcgagcatgttc

SEQ ID NO: 77753 - DNA, 25 bp, Homo sapien
ggcgatccagtgcttagttccgtca

SEQ ID NO: 77754 - DNA, 25 bp, Homo sapien
ccaggtcgcggtacacggcgagaac

SEQ ID NO: 77755 - DNA, 25 bp, Homo sapien
actcgtgcgcctaccagacagtggc

SEQ ID NO: 77756 - DNA, 25 bp, Homo sapien
cgctttagaaggtcggcgcccagtt

SEQ ID NO: 77757 - DNA, 25 bp, Homo sapien
tggcggatccgcctcgctttagaag

SEQ ID NO: 77758 - DNA, 25 bp, Homo sapien
tggaagtccctacggcgatcatgtt

SEQ ID NO: 77759 - DNA, 25 bp, Homo sapien
tgtgcttccttctacagccaatatg

SEQ ID NO: 77760 - DNA, 25 bp, Homo sapien
ccacgtctggaagttgctgcagcca

SEQ ID NO: 77761 - DNA, 25 bp, Homo sapien
ggccttggccctatttcctggtaga

SEQ ID NO: 77762 - DNA, 25 bp, Homo sapien
acgctcgtcagtggcttcagttcac

SEQ ID NO: 77763 - DNA, 25 bp, Homo sapien
cgatcatgttaaccgcgcgggctca

SEQ ID NO: 77764 - DNA, 25 bp, Homo sapien
cgcgggctcattctgcggaacgaag

SEQ ID NO: 77765 - DNA, 25 bp, Homo sapien
gacgctcttctacggctacggcttt

SEQ ID NO: 77766 - DNA, 25 bp, Homo sapien
aagcccatgttggagcaccgacccg

SEQ ID NO: 77767 - DNA, 25 bp, Homo sapien
tcctcgcagggaaaaaggccgtcgc

SEQ ID NO: 77768 - DNA, 25 bp, Homo sapien
ggccgcgcaagtactgtcaaggaca

SEQ ID NO: 77769 - DNA, 25 bp, Homo sapien
caacagcactgacggcgaacacttc

SEQ ID NO: 77770 - DNA, 25 bp, Homo sapien
tactgacgcgcagtgccagacctta

SEQ ID NO: 77771 - DNA, 25 bp, Homo sapien
tcacggtccttaagtctcggtcgcc

SEQ ID NO: 77772 - DNA, 25 bp, Homo sapien
tgcctggcagcttcgaagcccatgt

SEQ ID NO: 77773 - DNA, 25 bp, Homo sapien
agctcgctgcccacgcagatggtga

SEQ ID NO: 77774 - DNA, 25 bp, Homo sapien
agcaactccagctccttaatccgga

SEQ ID NO: 77775 - DNA, 25 bp, Homo sapien
agtcgaagccgtccccagtgatggt

SEQ ID NO: 77776 - DNA, 25 bp, Homo sapien
cctggcgaggtcacgcacagctctg

SEQ ID NO: 77777 - DNA, 25 bp, Homo sapien
aggtcacgcacagctctgggagtcg

SEQ ID NO: 77778 - DNA, 25 bp, Homo sapien
cagtgatggtgagcaactccagctc

SEQ ID NO: 77779 - DNA, 25 bp, Homo sapien
gaccaggggcgaggcaaccacctca

SEQ ID NO: 77780 - DNA, 25 bp, Homo sapien
aggggcgaggcaaccacctcaggcc

SEQ ID NO: 77781 - DNA, 25 bp, Homo sapien
gtgagtagaagaagcgcagaggctc

SEQ ID NO: 77782 - DNA, 25 bp, Homo sapien
acccgcaggtagcagtaggcggcca

SEQ ID NO: 77783 - DNA, 25 bp, Homo sapien
gggcggcaacaagaagctcggttca

SEQ ID NO: 77784 - DNA, 25 bp, Homo sapien
gcagttctgcgcatgctcctgcgtc

SEQ ID NO: 77785 - DNA, 25 bp, Homo sapien
ccaaaggacggccatagagcggacg

SEQ ID NO: 77786 - DNA, 25 bp, Homo sapien
cacgagcggccagagaggttccgca

SEQ ID NO: 77787 - DNA, 25 bp, Homo sapien
aggacccgccatagagcagaggctc

SEQ ID NO: 77788 - DNA, 25 bp, Homo sapien
gcgcactttctgtgcgtccgttcca

SEQ ID NO: 77789 - DNA, 25 bp, Homo sapien
catccgagatgagcctcttgcgacc

SEQ ID NO: 77790 - DNA, 25 bp, Homo sapien
atcgcagtgcctgattggcgcagcc

SEQ ID NO: 77791 - DNA, 25 bp, Homo sapien
caccgcagaccggaatgagagcctg

SEQ ID NO: 77792 - DNA, 25 bp, Homo sapien
ctgggaatcacgagctccaggtccg

SEQ ID NO: 77793 - DNA, 25 bp, Homo sapien
ttaacgtgctgaaggccacgacgcc

SEQ ID NO: 77794 - DNA, 25 bp, Homo sapien
ggggtcccagactcacgcattaacg

SEQ ID NO: 77795 - DNA, 25 bp, Homo sapien
cgcgcgtaacccgacgtctgagatc

SEQ ID NO: 77796 - DNA, 25 bp, Homo sapien
aagctgtgcatgagcgcgccgctct

SEQ ID NO: 77797 - DNA, 25 bp, Homo sapien
ccctgcaggaagatgccgaagctgt

SEQ ID NO: 77798 - DNA, 25 bp, Homo sapien
gctgggtactaaactggctctactg

SEQ ID NO: 77799 - DNA, 25 bp, Homo sapien
cgctgctcgcctagctgttgatcgc

SEQ ID NO: 77800 - DNA, 25 bp, Homo sapien
ttcagctaccactgcaagggcctgc

SEQ ID NO: 77801 - DNA, 25 bp, Homo sapien
gctgttgatcgcctggctgttgatg

SEQ ID NO: 77802 - DNA, 25 bp, Homo sapien
ccgaccaccatggagggagcattca

SEQ ID NO: 77803 - DNA, 25 bp, Homo sapien
cttgtcatccatgcgtaagccgggg

SEQ ID NO: 77804 - DNA, 25 bp, Homo sapien
gactggcccacaacgtcttcagcta

SEQ ID NO: 77805 - DNA, 25 bp, Homo sapien
tggctctactgtgagccgccctcgg

SEQ ID NO: 77806 - DNA, 25 bp, Homo sapien
gcgctcgctcgatcgctcgcttttc

SEQ ID NO: 77807 - DNA, 25 bp, Homo sapien
cgcgcggaagctttttcctcccgtg

SEQ ID NO: 77808 - DNA, 25 bp, Homo sapien
ggaagctttttcctcccgtgctgcc

SEQ ID NO: 77809 - DNA, 25 bp, Homo sapien
cgcgctccgactcattccaatatgg

SEQ ID NO: 77810 - DNA, 25 bp, Homo sapien
ttccaatatggcacggacgcagggc

SEQ ID NO: 77811 - DNA, 25 bp, Homo sapien
cacctcgggttgtagacagagcggc

SEQ ID NO: 77812 - DNA, 25 bp, Homo sapien
tgcccggagttttcgcgcgcgcgct

SEQ ID NO: 77813 - DNA, 25 bp, Homo sapien
cctcacctcgggttgtagacagagc

SEQ ID NO: 77814 - DNA, 25 bp, Homo sapien
cccggctgcagtacaagctggaacc

SEQ ID NO: 77815 - DNA, 25 bp, Homo sapien
tggtcctttaagtgggcctgtctcg

SEQ ID NO: 77816 - DNA, 25 bp, Homo sapien
gggcacgagaagttctggtccttta

SEQ ID NO: 77817 - DNA, 25 bp, Homo sapien
cctcgctgtctgattgatggccttg

SEQ ID NO: 77818 - DNA, 25 bp, Homo sapien
gccactccgtttagtcgcgataaga

SEQ ID NO: 77819 - DNA, 25 bp, Homo sapien
acctgaagggcagagagtacctgca

SEQ ID NO: 77820 - DNA, 25 bp, Homo sapien
atttcggtaggttttgcgctgtctg

SEQ ID NO: 77821 - DNA, 25 bp, Homo sapien
agtgtggcgagtactaagagatacc

SEQ ID NO: 77822 - DNA, 25 bp, Homo sapien
ttttatagcggggtttgcgtcacgc

SEQ ID NO: 77823 - DNA, 25 bp, Homo sapien
gaatagagccgggtgttttatagcg

SEQ ID NO: 77824 - DNA, 25 bp, Homo sapien
ccggctcggaaaggcttccctgagg

SEQ ID NO: 77825 - DNA, 25 bp, Homo sapien
ggggactttgtgctggtgcacgggg

SEQ ID NO: 77826 - DNA, 25 bp, Homo sapien
cgccgactggcgtgtacgtggttgt

SEQ ID NO: 77827 - DNA, 25 bp, Homo sapien
gtgtacgtggttgtgcggtgggtat

SEQ ID NO: 77828 - DNA, 25 bp, Homo sapien
cggtgggtatggaggtgtgtgcacg

SEQ ID NO: 77829 - DNA, 25 bp, Homo sapien
tttatagcggggtttgcgtcacgcg

SEQ ID NO: 77830 - DNA, 25 bp, Homo sapien
atctcgggttacctctcctcctcct

SEQ ID NO: 77831 - DNA, 25 bp, Homo sapien
cgcgtccctgcagccgatcgccgcg

SEQ ID NO: 77832 - DNA, 25 bp, Homo sapien
gcatcctccgagatgctcagactcg

SEQ ID NO: 77833 - DNA, 25 bp, Homo sapien
gagatgctcagactcggctaacaga

SEQ ID NO: 77834 - DNA, 25 bp, Homo sapien
gctcagactcggctaacagagcccg

SEQ ID NO: 77835 - DNA, 25 bp, Homo sapien
actcggctaacagagcccggcgctg

SEQ ID NO: 77836 - DNA, 25 bp, Homo sapien
gctggtccatctcgggttacctctc

SEQ ID NO: 77837 - DNA, 25 bp, Homo sapien
ggagctggtccatctcgggttacct

SEQ ID NO: 77838 - DNA, 25 bp, Homo sapien
gctgaggtccttctgtctgcccgct

SEQ ID NO: 77839 - DNA, 25 bp, Homo sapien
ctgtgtgtccctccgctagacagtg

SEQ ID NO: 77840 - DNA, 25 bp, Homo sapien
gagccgcggtcagcgaaagtcccgc

SEQ ID NO: 77841 - DNA, 25 bp, Homo sapien
actgagaaactgagccgcggtcagc

SEQ ID NO: 77842 - DNA, 25 bp, Homo sapien
gccgcttggcccatcccagtcagcg

SEQ ID NO: 77843 - DNA, 25 bp, Homo sapien
cgggccacacctcactggccgcttg

SEQ ID NO: 77844 - DNA, 25 bp, Homo sapien
gcggctgtagcccacatctcccgag

SEQ ID NO: 77845 - DNA, 25 bp, Homo sapien
gcctctccgagacccgatccttctg

SEQ ID NO: 77846 - DNA, 25 bp, Homo sapien
ctgcgcagagccagttggggaatct

SEQ ID NO: 77847 - DNA, 25 bp, Homo sapien
acctgcctgtatggcccagtcttgg

SEQ ID NO: 77848 - DNA, 25 bp, Homo sapien
ccggctttctcacttcgtgtcacta

SEQ ID NO: 77849 - DNA, 25 bp, Homo sapien
cgtgtcactactccctggggaaata

SEQ ID NO: 77850 - DNA, 25 bp, Homo sapien
ctgggtgaccattttggagaggttc

SEQ ID NO: 77851 - DNA, 25 bp, Homo sapien
acgtggaggttacagctagacagcc

SEQ ID NO: 77852 - DNA, 25 bp, Homo sapien
ctggtgaagccagaaaatgctactc

SEQ ID NO: 77853 - DNA, 25 bp, Homo sapien
ggccacaccctggaaggcgaagtca

SEQ ID NO: 77854 - DNA, 25 bp, Homo sapien
ttggccgtgtccttcaaggcctgca

SEQ ID NO: 77855 - DNA, 25 bp, Homo sapien
ggccgcgttctgtagaacagcagta

SEQ ID NO: 77856 - DNA, 25 bp, Homo sapien
aacagcagtaatggtggccttcccg

SEQ ID NO: 77857 - DNA, 25 bp, Homo sapien
caccctagagggtacttggcgagtc

SEQ ID NO: 77858 - DNA, 25 bp, Homo sapien
cttcccggcatcaccctagagggta

SEQ ID NO: 77859 - DNA, 25 bp, Homo sapien
tcgtctaggcatctcgcagcgcgac

SEQ ID NO: 77860 - DNA, 25 bp, Homo sapien
gtcaggcttgtggtagctctccatg

SEQ ID NO: 77861 - DNA, 25 bp, Homo sapien
cacacagagatagcggctgctcccg

SEQ ID NO: 77862 - DNA, 25 bp, Homo sapien
cccgcccacctcggctggccgcacc

SEQ ID NO: 77863 - DNA, 25 bp, Homo sapien
ttgctctgcgaccccgctggcttcc

SEQ ID NO: 77864 - DNA, 25 bp, Homo sapien
gccgcaccccgcagttagaaagcca

SEQ ID NO: 77865 - DNA, 25 bp, Homo sapien
cgcaccccgcagttagaaagccacg

SEQ ID NO: 77866 - DNA, 25 bp, Homo sapien
caccccgcagttagaaagccacgcc

SEQ ID NO: 77867 - DNA, 25 bp, Homo sapien
ccgcagttagaaagccacgccccct

SEQ ID NO: 77868 - DNA, 25 bp, Homo sapien
agttagaaagccacgccccctggct

SEQ ID NO: 77869 - DNA, 25 bp, Homo sapien
tcgcctcccgtccctcgactccgcc

SEQ ID NO: 77870 - DNA, 25 bp, Homo sapien
catcgtttgaatgagggtctgcgtg

SEQ ID NO: 77871 - DNA, 25 bp, Homo sapien
ctttggcatcgtttgaatgagggtc

SEQ ID NO: 77872 - DNA, 25 bp, Homo sapien
cggagccgaccgctggctcatggtg

SEQ ID NO: 77873 - DNA, 25 bp, Homo sapien
ggacgaggagatgccgcggtcgtac

SEQ ID NO: 77874 - DNA, 25 bp, Homo sapien
tccagatgttgaagtcgctgagcgg

SEQ ID NO: 77875 - DNA, 25 bp, Homo sapien
cttcttccagatgttgaagtcgctg

SEQ ID NO: 77876 - DNA, 25 bp, Homo sapien
cggcacgaagagcttcttccagatg

SEQ ID NO: 77877 - DNA, 25 bp, Homo sapien
cgaagagcttcttccagatgttgaa

SEQ ID NO: 77878 - DNA, 25 bp, Homo sapien
ttcagggccgctaggctcatctcct

SEQ ID NO: 77879 - DNA, 25 bp, Homo sapien
agcgcctccatcttgaatcccagag

SEQ ID NO: 77880 - DNA, 25 bp, Homo sapien
ggcggtacgtcagccattctggtcc

SEQ ID NO: 77881 - DNA, 25 bp, Homo sapien
gccgagctctttccaggcaaaggtt

SEQ ID NO: 77882 - DNA, 25 bp, Homo sapien
gccctacgatgtgggcggtgtccaa

SEQ ID NO: 77883 - DNA, 25 bp, Homo sapien
ccaaggctgcgtagtggagcttgca

SEQ ID NO: 77884 - DNA, 25 bp, Homo sapien
cctgagctaaaacgactgggtcctg

SEQ ID NO: 77885 - DNA, 25 bp, Homo sapien
ggcactcacccactggttggccttg

SEQ ID NO: 77886 - DNA, 25 bp, Homo sapien
ggacatgcgtgacagccactccgcg

SEQ ID NO: 77887 - DNA, 25 bp, Homo sapien
tccaggccctgaatgtcagagttaa

SEQ ID NO: 77888 - DNA, 25 bp, Homo sapien
agccagttctcctttgcagcaaaaa

SEQ ID NO: 77889 - DNA, 25 bp, Homo sapien
ccctgctgaagcgagaataagggca

SEQ ID NO: 77890 - DNA, 25 bp, Homo sapien
accacgcgaacggtgagcagccaga

SEQ ID NO: 77891 - DNA, 25 bp, Homo sapien
gctgccaaatccgatcctgtcatgg

SEQ ID NO: 77892 - DNA, 25 bp, Homo sapien
accgcggctcctacctcttggtgat

SEQ ID NO: 77893 - DNA, 25 bp, Homo sapien
ctgccagctcggtgtcgtctacaca

SEQ ID NO: 77894 - DNA, 25 bp, Homo sapien
gcctccaggaatgcgcagtgcagcg

SEQ ID NO: 77895 - DNA, 25 bp, Homo sapien
cccacggacgtagaccatggcattg

SEQ ID NO: 77896 - DNA, 25 bp, Homo sapien
tgcacctctgtgtggtagcaccagt

SEQ ID NO: 77897 - DNA, 25 bp, Homo sapien
tagcaccagttgtacctgtcgtcgc

SEQ ID NO: 77898 - DNA, 25 bp, Homo sapien
ctgtcgtcgcacaggttggccacca

SEQ ID NO: 77899 - DNA, 25 bp, Homo sapien
ccgcgggcatgtggatcttccacga

SEQ ID NO: 77900 - DNA, 25 bp, Homo sapien
tggatcttccacgagagccgcttgc

SEQ ID NO: 77901 - DNA, 25 bp, Homo sapien
acatagctgtactcgtcccggctct

SEQ ID NO: 77902 - DNA, 25 bp, Homo sapien
cgatgtcgctcgtgctgctaagcct

SEQ ID NO: 77903 - DNA, 25 bp, Homo sapien
ctcacttggtggaaacagacattta

SEQ ID NO: 77904 - DNA, 25 bp, Homo sapien
atcgccagtgctgacggcttccgct

SEQ ID NO: 77905 - DNA, 25 bp, Homo sapien
cccgcgtagctgaaagaattcgctc

SEQ ID NO: 77906 - DNA, 25 bp, Homo sapien
tccctcaaaggagtcagtgagcttc

SEQ ID NO: 77907 - DNA, 25 bp, Homo sapien
tgttgctgtccgaactcacttggtg

SEQ ID NO: 77908 - DNA, 25 bp, Homo sapien
cctggctcactgcatgcacgtgtgc

SEQ ID NO: 77909 - DNA, 25 bp, Homo sapien
gaaccgcagctccaaatcgccagtg

SEQ ID NO: 77910 - DNA, 25 bp, Homo sapien
cccaagcaagggcaaagagttccaa

SEQ ID NO: 77911 - DNA, 25 bp, Homo sapien
aaagagttccaacccagccagagcc

SEQ ID NO: 77912 - DNA, 25 bp, Homo sapien
tcattatggccggagacacccacca

SEQ ID NO: 77913 - DNA, 25 bp, Homo sapien
cgggcaggagcgcacacaaccagac

SEQ ID NO: 77914 - DNA, 25 bp, Homo sapien
tgcagccacgactgccgggatggaa

SEQ ID NO: 77915 - DNA, 25 bp, Homo sapien
gccggctgcccacagtcaagatggc

SEQ ID NO: 77916 - DNA, 25 bp, Homo sapien
cagcggaggacccaagcaagggcaa

SEQ ID NO: 77917 - DNA, 25 bp, Homo sapien
cagcctgggtcattatggccggaga

SEQ ID NO: 77918 - DNA, 25 bp, Homo sapien
accggatatgacgttaaggactgcc

SEQ ID NO: 77919 - DNA, 25 bp, Homo sapien
gggaagctgttttctcgtcgattga

SEQ ID NO: 77920 - DNA, 25 bp, Homo sapien
cctggagtccgatcttacaagtcac

SEQ ID NO: 77921 - DNA, 25 bp, Homo sapien
tcacaggccgcgattagacaaaatg

SEQ ID NO: 77922 - DNA, 25 bp, Homo sapien
catctgcgacttctggttaggcgga

SEQ ID NO: 77923 - DNA, 25 bp, Homo sapien
cgtgtacagcgtcggcatcattgtc

SEQ ID NO: 77924 - DNA, 25 bp, Homo sapien
ggttgccagtcctctatccgacttg

SEQ ID NO: 77925 - DNA, 25 bp, Homo sapien
acgggcgtttttgcatcgtcacatc

SEQ ID NO: 77926 - DNA, 25 bp, Homo sapien
ggcgcgtcttagcagcccagagtca

SEQ ID NO: 77927 - DNA, 25 bp, Homo sapien
atcgcaggactagcggcacacccta

SEQ ID NO: 77928 - DNA, 25 bp, Homo sapien
cgccgctaattgacctgctgttttc

SEQ ID NO: 77929 - DNA, 25 bp, Homo sapien
atttcctggttgatggcttttcttc

SEQ ID NO: 77930 - DNA, 25 bp, Homo sapien
ttttcttcccgagccatctgggacc

SEQ ID NO: 77931 - DNA, 25 bp, Homo sapien
agagcccggcatgttcagatgcgtg

SEQ ID NO: 77932 - DNA, 25 bp, Homo sapien
cagcgtggagccttcctttgagcgt

SEQ ID NO: 77933 - DNA, 25 bp, Homo sapien
gctcagagaagaggcgcgtcttagc

SEQ ID NO: 77934 - DNA, 25 bp, Homo sapien
ctgtgtctttgtccaggctgggagg

SEQ ID NO: 77935 - DNA, 25 bp, Homo sapien
gtcacctgtggtcctggagcagccg

SEQ ID NO: 77936 - DNA, 25 bp, Homo sapien
acccatgggaagatccgggggctca

SEQ ID NO: 77937 - DNA, 25 bp, Homo sapien
gggtgaccctcacctgaggcctctg

SEQ ID NO: 77938 - DNA, 25 bp, Homo sapien
acccgcagagagtgcccgcctgtgt

SEQ ID NO: 77939 - DNA, 25 bp, Homo sapien
cgtatccatggagacccgacgccgc

SEQ ID NO: 77940 - DNA, 25 bp, Homo sapien
cactcggtcacctgtggtcctggag

SEQ ID NO: 77941 - DNA, 25 bp, Homo sapien
cacctgaggcctctggaggcgctga

SEQ ID NO: 77942 - DNA, 25 bp, Homo sapien
tttggaaagggctggcacgcttcct

SEQ ID NO: 77943 - DNA, 25 bp, Homo sapien
catccgtagaggctgtagacactgc

SEQ ID NO: 77944 - DNA, 25 bp, Homo sapien
taaccggttagtcatccgtagaggc

SEQ ID NO: 77945 - DNA, 25 bp, Homo sapien
gcggagaattcattataaccggtta

SEQ ID NO: 77946 - DNA, 25 bp, Homo sapien
ggtatgcacagaagcggagaattca

SEQ ID NO: 77947 - DNA, 25 bp, Homo sapien
tcctcaggcggagggtatgcacaga

SEQ ID NO: 77948 - DNA, 25 bp, Homo sapien
tagaggctgtagacactgcccgcgg

SEQ ID NO: 77949 - DNA, 25 bp, Homo sapien
cacgcttcctcaggcggagggtatg

SEQ ID NO: 77950 - DNA, 25 bp, Homo sapien
gagcctgtgctcctttctgagattt

SEQ ID NO: 77951 - DNA, 25 bp, Homo sapien
gcggagcgggcatgctacgccctct

SEQ ID NO: 77952 - DNA, 25 bp, Homo sapien
tgtaaagaactcagcggccgcagta

SEQ ID NO: 77953 - DNA, 25 bp, Homo sapien
cgcggccaaggacactggagtttcc

SEQ ID NO: 77954 - DNA, 25 bp, Homo sapien
tcctttctgagatttctgcttcttc

SEQ ID NO: 77955 - DNA, 25 bp, Homo sapien
ccaaggacactggagtttccgagtc

SEQ ID NO: 77956 - DNA, 25 bp, Homo sapien
tgcgcccaagccgtggtggcagcac

SEQ ID NO: 77957 - DNA, 25 bp, Homo sapien
cggactgcggagttgtaaagaactc

SEQ ID NO: 77958 - DNA, 25 bp, Homo sapien
tggaccgctagagcttcccttgaga

SEQ ID NO: 77959 - DNA, 25 bp, Homo sapien
gcccgacacctgcttttcaaaatta

SEQ ID NO: 77960 - DNA, 25 bp, Homo sapien
attacacatttagaccgcgagggga

SEQ ID NO: 77961 - DNA, 25 bp, Homo sapien
ggcgcagtttctctggaccgctaga

SEQ ID NO: 77962 - DNA, 25 bp, Homo sapien
ttcccttgagacgaaagcgatggca

SEQ ID NO: 77963 - DNA, 25 bp, Homo sapien
tcctcgtagataaaatgaagccagc

SEQ ID NO: 77964 - DNA, 25 bp, Homo sapien
gaagccagcgttcggctaggacacc

SEQ ID NO: 77965 - DNA, 25 bp, Homo sapien
ccgtgaccacggagggctggccttt

SEQ ID NO: 77966 - DNA, 25 bp, Homo sapien
ggcgcggaccagagagctcttttct

SEQ ID NO: 77967 - DNA, 25 bp, Homo sapien
ggaccagagagctcttttctgagga

SEQ ID NO: 77968 - DNA, 25 bp, Homo sapien
ccagagagctcttttctgaggatcc

SEQ ID NO: 77969 - DNA, 25 bp, Homo sapien
ggacatgtcctacaagcggctgatg

SEQ ID NO: 77970 - DNA, 25 bp, Homo sapien
catgtcctacaagcggctgatgccg

SEQ ID NO: 77971 - DNA, 25 bp, Homo sapien
cctacaagcggctgatgccgctgta

SEQ ID NO: 77972 - DNA, 25 bp, Homo sapien
caagcggctgatgccgctgtacagt

SEQ ID NO: 77973 - DNA, 25 bp, Homo sapien
cgcggaccagagagctcttttctga

SEQ ID NO: 77974 - DNA, 25 bp, Homo sapien
tctgcacggtcttgaactggtcgta

SEQ ID NO: 77975 - DNA, 25 bp, Homo sapien
ccagcgagccggtgctctcattgcg

SEQ ID NO: 77976 - DNA, 25 bp, Homo sapien
cggtgctctcattgcgcacgcagta

SEQ ID NO: 77977 - DNA, 25 bp, Homo sapien
attgcgcacgcagtagtcagggctg

SEQ ID NO: 77978 - DNA, 25 bp, Homo sapien
ctggggtcgatgtagaccaggtctt

SEQ ID NO: 77979 - DNA, 25 bp, Homo sapien
tgttgagccgcatggccgccgcgct

SEQ ID NO: 77980 - DNA, 25 bp, Homo sapien
cgctccgtctgcacggtcttgaact

SEQ ID NO: 77981 - DNA, 25 bp, Homo sapien
gcggctgttgacctgtaccaacttg

SEQ ID NO: 77982 - DNA, 25 bp, Homo sapien
gagcccttggcgtggatgcgctccc

SEQ ID NO: 77983 - DNA, 25 bp, Homo sapien
cgagcactctcgtaggagcccttgg

SEQ ID NO: 77984 - DNA, 25 bp, Homo sapien
acaagggatcactggccgcctgcct

SEQ ID NO: 77985 - DNA, 25 bp, Homo sapien
tcaccgcgtatgtgaaggccgtctc

SEQ ID NO: 77986 - DNA, 25 bp, Homo sapien
agccatagtcgatgttgtcgccgca

SEQ ID NO: 77987 - DNA, 25 bp, Homo sapien
ctccttggcaaagcggtagccatag

SEQ ID NO: 77988 - DNA, 25 bp, Homo sapien
cgggcgtccacgaactccttggcaa

SEQ ID NO: 77989 - DNA, 25 bp, Homo sapien
caggttcatgaggatgcgagcactc

SEQ ID NO: 77990 - DNA, 25 bp, Homo sapien
ccgagcaacaagtggagccagaatt

SEQ ID NO: 77991 - DNA, 25 bp, Homo sapien
tctgttgagtcaaagccctggtgcc

SEQ ID NO: 77992 - DNA, 25 bp, Homo sapien
ccctctagttggtgctgtgctcagt

SEQ ID NO: 77993 - DNA, 25 bp, Homo sapien
taattcactcaggaacccgctgcgg

SEQ ID NO: 77994 - DNA, 25 bp, Homo sapien
cagaattaattccatgggcgagagg

SEQ ID NO: 77995 - DNA, 25 bp, Homo sapien
ctgggaaatgcagctccgaattaac

SEQ ID NO: 77996 - DNA, 25 bp, Homo sapien
cgccagcgattacaaacgtgtctca

SEQ ID NO: 77997 - DNA, 25 bp, Homo sapien
tgtgctcagtccctcctgggtaatt

SEQ ID NO: 77998 - DNA, 25 bp, Homo sapien
gtaagtctaaccctgccgcactgca

SEQ ID NO: 77999 - DNA, 25 bp, Homo sapien
cagagcccttgcagatgagtccaga

SEQ ID NO: 78000 - DNA, 25 bp, Homo sapien
cttgcagatgagtccagacggggcc

SEQ ID NO: 78001 - DNA, 25 bp, Homo sapien
gcttccgagccgcagctgggcgcat

SEQ ID NO: 78002 - DNA, 25 bp, Homo sapien
ctgggcgcatcgattccagggcaaa

SEQ ID NO: 78003 - DNA, 25 bp, Homo sapien
gcggcgaaggttcccttcctgaaga

SEQ ID NO: 78004 - DNA, 25 bp, Homo sapien
ctgaagaatttcaggggtaggagtt

SEQ ID NO: 78005 - DNA, 25 bp, Homo sapien
actggtgacttctccacctgtaggc

SEQ ID NO: 78006 - DNA, 25 bp, Homo sapien
tatgtatccctcaaagccttcgcgt

SEQ ID NO: 78007 - DNA, 25 bp, Homo sapien
cgacgtggctccctttctatgtatc

SEQ ID NO: 78008 - DNA, 25 bp, Homo sapien
tccagagcagctcaacgacgtggct

SEQ ID NO: 78009 - DNA, 25 bp, Homo sapien
cgtttgaggggctcagcgcaccaga

SEQ ID NO: 78010 - DNA, 25 bp, Homo sapien
gtagcaaaattgttcagaggacgtt

SEQ ID NO: 78011 - DNA, 25 bp, Homo sapien
gaggaaacctcagtagcaaaattgt

SEQ ID NO: 78012 - DNA, 25 bp, Homo sapien
tcgcgtcggattaaaggtgttcttg

SEQ ID NO: 78013 - DNA, 25 bp, Homo sapien
tgatccttctttaccaaccacggtg

SEQ ID NO: 78014 - DNA, 25 bp, Homo sapien
agttctgcgcgcatagtgctaaccc

SEQ ID NO: 78015 - DNA, 25 bp, Homo sapien
caggagtcctacctcaaggcggcca

SEQ ID NO: 78016 - DNA, 25 bp, Homo sapien
accgaggctcgcaggagtcctacct

SEQ ID NO: 78017 - DNA, 25 bp, Homo sapien
cggcgcagcgaaactggtcctctgg

SEQ ID NO: 78018 - DNA, 25 bp, Homo sapien
aaggatccacacactcggacacaca

SEQ ID NO: 78019 - DNA, 25 bp, Homo sapien
gaaggctactacgtcctggacccga

SEQ ID NO: 78020 - DNA, 25 bp, Homo sapien
gcagccaaggatccacacactcgga

SEQ ID NO: 78021 - DNA, 25 bp, Homo sapien
cttccgtattgcagcggccggcggc

SEQ ID NO: 78022 - DNA, 25 bp, Homo sapien
tttggggccacagaacaatcaggcg

SEQ ID NO: 78023 - DNA, 25 bp, Homo sapien
tggtgcgaccagaagtgatctcctg

SEQ ID NO: 78024 - DNA, 25 bp, Homo sapien
agaggcgctccgtttccaacgtcca

SEQ ID NO: 78025 - DNA, 25 bp, Homo sapien
cgtccatcagcgacggcggtaatta

SEQ ID NO: 78026 - DNA, 25 bp, Homo sapien
gggcgtgattgtgcaaaagacctta

SEQ ID NO: 78027 - DNA, 25 bp, Homo sapien
ggtctgtagccgaaacgtctgcttc

SEQ ID NO: 78028 - DNA, 25 bp, Homo sapien
tctgcttccagacgctgatcctgca

SEQ ID NO: 78029 - DNA, 25 bp, Homo sapien
aatcaggcgcgcatggctttttctc

SEQ ID NO: 78030 - DNA, 25 bp, Homo sapien
agttgcttctctctgacgtcgcctc

SEQ ID NO: 78031 - DNA, 25 bp, Homo sapien
cctaatctctaagtccgggccgcgg

SEQ ID NO: 78032 - DNA, 25 bp, Homo sapien
ctatgcccggctagcacagaactct

SEQ ID NO: 78033 - DNA, 25 bp, Homo sapien
cagaactctgctgcagcggtgagcc

SEQ ID NO: 78034 - DNA, 25 bp, Homo sapien
ttattgccttcagctgggctgcccg

SEQ ID NO: 78035 - DNA, 25 bp, Homo sapien
caatggtcgtagtctctcgaggccc

SEQ ID NO: 78036 - DNA, 25 bp, Homo sapien
gcggtgagcccagcttattgccttc

SEQ ID NO: 78037 - DNA, 25 bp, Homo sapien
agcttctcttcaccggggcgcagtt

SEQ ID NO: 78038 - DNA, 25 bp, Homo sapien
tgcaggattttaaagccgtactacg

SEQ ID NO: 78039 - DNA, 25 bp, Homo sapien
gttgtctgcgctccttccagagcca

SEQ ID NO: 78040 - DNA, 25 bp, Homo sapien
gcctatgacaaactctgcaggattt

SEQ ID NO: 78041 - DNA, 25 bp, Homo sapien
gctgaaagagagaggtccactccgc

SEQ ID NO: 78042 - DNA, 25 bp, Homo sapien
tggctcgcccgcgtatcccagaccg

SEQ ID NO: 78043 - DNA, 25 bp, Homo sapien
aagagagaggtccactccgcagccg

SEQ ID NO: 78044 - DNA, 25 bp, Homo sapien
gcctggttgtctgcgctccttccag

SEQ ID NO: 78045 - DNA, 25 bp, Homo sapien
tgaggccggcctatgacaaactctg

SEQ ID NO: 78046 - DNA, 25 bp, Homo sapien
ccaggtgcttgacagaaacagctga

SEQ ID NO: 78047 - DNA, 25 bp, Homo sapien
aaacagctgaaggagcccaagcttc

SEQ ID NO: 78048 - DNA, 25 bp, Homo sapien
cccaagcttcacaggggctgttgtg

SEQ ID NO: 78049 - DNA, 25 bp, Homo sapien
gtgtgtacagttgatacccaccatc

SEQ ID NO: 78050 - DNA, 25 bp, Homo sapien
atcatcgctattagaattggggtca

SEQ ID NO: 78051 - DNA, 25 bp, Homo sapien
agacttgaggccgatacccgtcatc

SEQ ID NO: 78052 - DNA, 25 bp, Homo sapien
cgctattagagtaggggctgatatc

SEQ ID NO: 78053 - DNA, 25 bp, Homo sapien
ccaccttcagaaaaccaggtgcttg

SEQ ID NO: 78054 - DNA, 25 bp, Homo sapien
gtcgcttctcatacctgggcccagg

SEQ ID NO: 78055 - DNA, 25 bp, Homo sapien
aggggttgcctatcttctcctctcg

SEQ ID NO: 78056 - DNA, 25 bp, Homo sapien
actacctccttctcttgcaagtggg

SEQ ID NO: 78057 - DNA, 25 bp, Homo sapien
tctcgcatcccggttcgtaaacttg

SEQ ID NO: 78058 - DNA, 25 bp, Homo sapien
agtgcgagttcagcccgctttcttc

SEQ ID NO: 78059 - DNA, 25 bp, Homo sapien
tttgttatgtaaccgccgggccagc

SEQ ID NO: 78060 - DNA, 25 bp, Homo sapien
tgcgtgtcgtcccattacttgatta

SEQ ID NO: 78061 - DNA, 25 bp, Homo sapien
cccagccgctctcacaggtttgtta

SEQ ID NO: 78062 - DNA, 25 bp, Homo sapien
ggggtttatacatcagggcaaagcc

SEQ ID NO: 78063 - DNA, 25 bp, Homo sapien
cgtgcacttgttccaatccgggggt

SEQ ID NO: 78064 - DNA, 25 bp, Homo sapien
cgctggaggaaaccgtgcacttgtt

SEQ ID NO: 78065 - DNA, 25 bp, Homo sapien
atacatcagggcaaagcctccctta

SEQ ID NO: 78066 - DNA, 25 bp, Homo sapien
ccgcgcgctggaggaaaccgtgcac

SEQ ID NO: 78067 - DNA, 25 bp, Homo sapien
agaagaaaggcgatggcagtgaggg

SEQ ID NO: 78068 - DNA, 25 bp, Homo sapien
ccctcgaggcaagaggggacgccag

SEQ ID NO: 78069 - DNA, 25 bp, Homo sapien
gtttatacatcagggcaaagcctcc

SEQ ID NO: 78070 - DNA, 25 bp, Homo sapien
ttaggctccccacgataacgcattg

SEQ ID NO: 78071 - DNA, 25 bp, Homo sapien
ttttacaacctctcgtcgccttggc

SEQ ID NO: 78072 - DNA, 25 bp, Homo sapien
gggccgtcccacatggatttttaca

SEQ ID NO: 78073 - DNA, 25 bp, Homo sapien
gcgtcggcgtctcacctttccgatg

SEQ ID NO: 78074 - DNA, 25 bp, Homo sapien
ataacgcattgcagctccccacgag

SEQ ID NO: 78075 - DNA, 25 bp, Homo sapien
gcggatggttcacccttaggctccc

SEQ ID NO: 78076 - DNA, 25 bp, Homo sapien
ccgtaggaggcggatggttcaccct

SEQ ID NO: 78077 - DNA, 25 bp, Homo sapien
acccggcacgaggaatgcccgggca

SEQ ID NO: 78078 - DNA, 25 bp, Homo sapien
cgcgctttggaaggctacaattgcg

SEQ ID NO: 78079 - DNA, 25 bp, Homo sapien
ggaacaaacggcatacgcaaccgtc

SEQ ID NO: 78080 - DNA, 25 bp, Homo sapien
gattggtccacttgctcagctcgcc

SEQ ID NO: 78081 - DNA, 25 bp, Homo sapien
ttccgctgtgcgtaggggaacaaac

SEQ ID NO: 78082 - DNA, 25 bp, Homo sapien
tcataagccgggtcaggccaaattc

SEQ ID NO: 78083 - DNA, 25 bp, Homo sapien
ccaattggcgtagcgcttgctgagc

SEQ ID NO: 78084 - DNA, 25 bp, Homo sapien
tacaattgcgagaagcgcaggtctc

SEQ ID NO: 78085 - DNA, 25 bp, Homo sapien
aggtctccgccaccgaagctttaga

SEQ ID NO: 78086 - DNA, 25 bp, Homo sapien
aagcttctgcccacaaggtcgacgg

SEQ ID NO: 78087 - DNA, 25 bp, Homo sapien
ggcctaaggagctctgggaagcttc

SEQ ID NO: 78088 - DNA, 25 bp, Homo sapien
gaagcgcctgcttcatctcgtcgtc

SEQ ID NO: 78089 - DNA, 25 bp, Homo sapien
aggactcaagctccggaagcgcctg

SEQ ID NO: 78090 - DNA, 25 bp, Homo sapien
cgccattttgttgggaggactcaag

SEQ ID NO: 78091 - DNA, 25 bp, Homo sapien
tcctaacaggcctttcgggctcttc

SEQ ID NO: 78092 - DNA, 25 bp, Homo sapien
ctctgctcttcctggggatctgaaa

SEQ ID NO: 78093 - DNA, 25 bp, Homo sapien
ggcgctgcatgcgtgtttacgtatc

SEQ ID NO: 78094 - DNA, 25 bp, Homo sapien
accgtgccagccacgccttgatggg

SEQ ID NO: 78095 - DNA, 25 bp, Homo sapien
gcagacgagacaggcagatgaccca

SEQ ID NO: 78096 - DNA, 25 bp, Homo sapien
ctgcagttcgctctcttgaccgtga

SEQ ID NO: 78097 - DNA, 25 bp, Homo sapien
gaaggggtaatccttggccaccatg

SEQ ID NO: 78098 - DNA, 25 bp, Homo sapien
ctttgggatgtcaccgctgacccta

SEQ ID NO: 78099 - DNA, 25 bp, Homo sapien
ctgaccctaggcgactacaaaactc

SEQ ID NO: 78100 - DNA, 25 bp, Homo sapien
cacggagaccgacagccggcttcta

SEQ ID NO: 78101 - DNA, 25 bp, Homo sapien
gatgacccatagaggtccaggtgca

SEQ ID NO: 78102 - DNA, 25 bp, Homo sapien
acgccgagacctagcagggtaactc

SEQ ID NO: 78103 - DNA, 25 bp, Homo sapien
tgtcccgccaaaggggtgtctagcc

SEQ ID NO: 78104 - DNA, 25 bp, Homo sapien
catgcacggcctaggtctacaggga

SEQ ID NO: 78105 - DNA, 25 bp, Homo sapien
tggctccgggaattttcgctcaagg

SEQ ID NO: 78106 - DNA, 25 bp, Homo sapien
tcaggcggagagaattgaccgagtc

SEQ ID NO: 78107 - DNA, 25 bp, Homo sapien
cggaagacggtctcactccgggaga

SEQ ID NO: 78108 - DNA, 25 bp, Homo sapien
gccacctaaatcagactcaggcgga

SEQ ID NO: 78109 - DNA, 25 bp, Homo sapien
tccaggctggaaaactcaccgcggc

SEQ ID NO: 78110 - DNA, 25 bp, Homo sapien
ccctggtttgcacatgacatcattt

SEQ ID NO: 78111 - DNA, 25 bp, Homo sapien
tccgtcgagagtccttccatcagtg

SEQ ID NO: 78112 - DNA, 25 bp, Homo sapien
tgacaccgccaccaggaagagctct

SEQ ID NO: 78113 - DNA, 25 bp, Homo sapien
cgataaacttgctgagcgccgcgga

SEQ ID NO: 78114 - DNA, 25 bp, Homo sapien
ccctcgcaggaataatcaaagtaga

SEQ ID NO: 78115 - DNA, 25 bp, Homo sapien
agtagttccttctgctgccctgtcg

SEQ ID NO: 78116 - DNA, 25 bp, Homo sapien
accagtcgggctcctcgtcaataaa

SEQ ID NO: 78117 - DNA, 25 bp, Homo sapien
cgctctccgtcagggaagacgtttc

SEQ ID NO: 78118 - DNA, 25 bp, Homo sapien
gccgcacctcattagcaacacaaag

SEQ ID NO: 78119 - DNA, 25 bp, Homo sapien
ggcagccgctttcatctcggccagg

SEQ ID NO: 78120 - DNA, 25 bp, Homo sapien
cccagacagtgtcaaaggagcgctc

SEQ ID NO: 78121 - DNA, 25 bp, Homo sapien
cggctcaatgcacacggcgaaagtc

SEQ ID NO: 78122 - DNA, 25 bp, Homo sapien
agccgcgagaccttcacaagacgaa

SEQ ID NO: 78123 - DNA, 25 bp, Homo sapien
ccaggcgaggaggaacaaagctact

SEQ ID NO: 78124 - DNA, 25 bp, Homo sapien
tcggttccacgaagacggctcaatg

SEQ ID NO: 78125 - DNA, 25 bp, Homo sapien
agctactagaagagcggggcgcatc

SEQ ID NO: 78126 - DNA, 25 bp, Homo sapien
agcggatgtctagtctccaaggtaa

SEQ ID NO: 78127 - DNA, 25 bp, Homo sapien
aaagaagagcggatgtctagtctcc

SEQ ID NO: 78128 - DNA, 25 bp, Homo sapien
cccagactaccctgcactgcgaccg

SEQ ID NO: 78129 - DNA, 25 bp, Homo sapien
cccatagttctggagcggtgcgtac

SEQ ID NO: 78130 - DNA, 25 bp, Homo sapien
cgtaccttggccactacacggaatt

SEQ ID NO: 78131 - DNA, 25 bp, Homo sapien
ttggccactacacggaattcaccgg

SEQ ID NO: 78132 - DNA, 25 bp, Homo sapien
agcggtgcgtaccttggccactaca

SEQ ID NO: 78133 - DNA, 25 bp, Homo sapien
cagtccaggtcggagaccgccgccc

SEQ ID NO: 78134 - DNA, 25 bp, Homo sapien
ccgagagtgcgagaggctcccactc

SEQ ID NO: 78135 - DNA, 25 bp, Homo sapien
cctgctgaactctgagggtctcacg

SEQ ID NO: 78136 - DNA, 25 bp, Homo sapien
gagggtctcacgctccaaagtggcg

SEQ ID NO: 78137 - DNA, 25 bp, Homo sapien
gtctcacgctccaaagtggcggccg

SEQ ID NO: 78138 - DNA, 25 bp, Homo sapien
gccgctgttcgtggcgcctggcaac

SEQ ID NO: 78139 - DNA, 25 bp, Homo sapien
ggcgcctggcaaccgcctttgtgac

SEQ ID NO: 78140 - DNA, 25 bp, Homo sapien
ggcaaccgcctttgtgacccaggac

SEQ ID NO: 78141 - DNA, 25 bp, Homo sapien
cctttgtgacccaggacggcagggc

SEQ ID NO: 78142 - DNA, 25 bp, Homo sapien
caaagagccaggcttcgaaagctgc

SEQ ID NO: 78143 - DNA, 25 bp, Homo sapien
aagtggccggcgatgtcccgaaagc

SEQ ID NO: 78144 - DNA, 25 bp, Homo sapien
tttcctcgccttcgcgcgggacgaa

SEQ ID NO: 78145 - DNA, 25 bp, Homo sapien
gggtccccacaaaggcatcaagcca

SEQ ID NO: 78146 - DNA, 25 bp, Homo sapien
agccaggcttcgaaagctgcccgtc

SEQ ID NO: 78147 - DNA, 25 bp, Homo sapien
ggcttcgaaagctgcccgtccctgt

SEQ ID NO: 78148 - DNA, 25 bp, Homo sapien
tggacccgcggacacctgggcggaa

SEQ ID NO: 78149 - DNA, 25 bp, Homo sapien
ccgggcatcacctaatatcaccacc

SEQ ID NO: 78150 - DNA, 25 bp, Homo sapien
ctgtaaggttgtgtgtggagcccta

SEQ ID NO: 78151 - DNA, 25 bp, Homo sapien
gaaggccatcccagggcagacactg

SEQ ID NO: 78152 - DNA, 25 bp, Homo sapien
ggatcgacaagctgcccatcgagga

SEQ ID NO: 78153 - DNA, 25 bp, Homo sapien
aggcgccgtttttatcgcggtgatg

SEQ ID NO: 78154 - DNA, 25 bp, Homo sapien
gcggtgatgtgaggtgccaaatctc

SEQ ID NO: 78155 - DNA, 25 bp, Homo sapien
gccaaatctcgatcctggaattttc

SEQ ID NO: 78156 - DNA, 25 bp, Homo sapien
tttccgaggctcagcaagctaagga

SEQ ID NO: 78157 - DNA, 25 bp, Homo sapien
cgatttagatacaaacgcgcgcgtg

SEQ ID NO: 78158 - DNA, 25 bp, Homo sapien
caccaggttcatgtggaggctccca

SEQ ID NO: 78159 - DNA, 25 bp, Homo sapien
cgcgaacggttctgtacccatactg

SEQ ID NO: 78160 - DNA, 25 bp, Homo sapien
gaccaccggcatctctacacgaaga

SEQ ID NO: 78161 - DNA, 25 bp, Homo sapien
tggcacctgcacttttgaccaccgg

SEQ ID NO: 78162 - DNA, 25 bp, Homo sapien
tcagcctcgaatttggggatcccgc

SEQ ID NO: 78163 - DNA, 25 bp, Homo sapien
tgaggacgctctcatccgcactgtc

SEQ ID NO: 78164 - DNA, 25 bp, Homo sapien
tgcgtaccttcggaacccaagctga

SEQ ID NO: 78165 - DNA, 25 bp, Homo sapien
cgagcccgtggtgaagctgtactac

SEQ ID NO: 78166 - DNA, 25 bp, Homo sapien
tttcacacacgggaccagacgcttg

SEQ ID NO: 78167 - DNA, 25 bp, Homo sapien
tccggaaaggcgagctgagcattat

SEQ ID NO: 78168 - DNA, 25 bp, Homo sapien
gggtgatagtccttgcttccggaaa

SEQ ID NO: 78169 - DNA, 25 bp, Homo sapien
ttccgcccggatgaaggtattgtcg

SEQ ID NO: 78170 - DNA, 25 bp, Homo sapien
tctattacggtacgcgcgatgggta

SEQ ID NO: 78171 - DNA, 25 bp, Homo sapien
ggccagtttcgctgacgagcatctc

SEQ ID NO: 78172 - DNA, 25 bp, Homo sapien
tgggtattccctgatgccatgaact

SEQ ID NO: 78173 - DNA, 25 bp, Homo sapien
gacgcttgctttagttgacgcatga

SEQ ID NO: 78174 - DNA, 25 bp, Homo sapien
gccacggccatcgtcctcttcatcg

SEQ ID NO: 78175 - DNA, 25 bp, Homo sapien
aagtgccgtaggaccgcagcccgaa

SEQ ID NO: 78176 - DNA, 25 bp, Homo sapien
cgtaggaccgcagcccgaaagagcg

SEQ ID NO: 78177 - DNA, 25 bp, Homo sapien
gcggagaagctgtcccagcgcagca

SEQ ID NO: 78178 - DNA, 25 bp, Homo sapien
cgcttcgtccaacggccttcgagag

SEQ ID NO: 78179 - DNA, 25 bp, Homo sapien
acgtggggacgtcacgctgccgctt

SEQ ID NO: 78180 - DNA, 25 bp, Homo sapien
ctgccgcttgtctcggattgtgaag

SEQ ID NO: 78181 - DNA, 25 bp, Homo sapien
tgcagccaggcggagaagctgtccc

SEQ ID NO: 78182 - DNA, 25 bp, Homo sapien
cgcctgacggccgtttgttttgatg

SEQ ID NO: 78183 - DNA, 25 bp, Homo sapien
gtgcaccgggtaggtttcagtcaga

SEQ ID NO: 78184 - DNA, 25 bp, Homo sapien
gctccaaatcctcgtagcctgcttg

SEQ ID NO: 78185 - DNA, 25 bp, Homo sapien
aaagtttcctgcctcgtcgggcgca

SEQ ID NO: 78186 - DNA, 25 bp, Homo sapien
ggaccaacttcctgccgcctgggaa

SEQ ID NO: 78187 - DNA, 25 bp, Homo sapien
gtgcccaggagtcccgacttggcca

SEQ ID NO: 78188 - DNA, 25 bp, Homo sapien
ccgacccttcattcatgctgcagtg

SEQ ID NO: 78189 - DNA, 25 bp, Homo sapien
ttcagtcagagtcactatggcggcc

SEQ ID NO: 78190 - DNA, 25 bp, Homo sapien
atctagctgaggacgcgccttggaa

SEQ ID NO: 78191 - DNA, 25 bp, Homo sapien
agcaccggccgtggctccggtagca

SEQ ID NO: 78192 - DNA, 25 bp, Homo sapien
cgccaccaggatgccggtaaccgag

SEQ ID NO: 78193 - DNA, 25 bp, Homo sapien
ccgagaaggatctagctgaggacgc

SEQ ID NO: 78194 - DNA, 25 bp, Homo sapien
cgtgaacaaacgcatcggcaacctg

SEQ ID NO: 78195 - DNA, 25 bp, Homo sapien
aacgcatcggcaacctgcagaccga

SEQ ID NO: 78196 - DNA, 25 bp, Homo sapien
actgaggcccgacccattctgtccg

SEQ ID NO: 78197 - DNA, 25 bp, Homo sapien
tgccggtaaccgagaaggatctagc

SEQ ID NO: 78198 - DNA, 25 bp, Homo sapien
agacctgaggaggaaccgttctctg

SEQ ID NO: 78199 - DNA, 25 bp, Homo sapien
ccgtgagacctgaggaggaaccgtt

SEQ ID NO: 78200 - DNA, 25 bp, Homo sapien
gacagagacctggtaccttcccctg

SEQ ID NO: 78201 - DNA, 25 bp, Homo sapien
agatgctccgcggagtgctctccct

SEQ ID NO: 78202 - DNA, 25 bp, Homo sapien
aggaggaaccgttctctgcgcctgg

SEQ ID NO: 78203 - DNA, 25 bp, Homo sapien
ttcccctgccgtcgctggaatgggt

SEQ ID NO: 78204 - DNA, 25 bp, Homo sapien
gcccaggttggtgctctcagaggca

SEQ ID NO: 78205 - DNA, 25 bp, Homo sapien
tcagaggcagctgaatgggcgttgg

SEQ ID NO: 78206 - DNA, 25 bp, Homo sapien
tgtacacgttgaccatgaagtatgg

SEQ ID NO: 78207 - DNA, 25 bp, Homo sapien
aagctggcctccttagcgtcgactg

SEQ ID NO: 78208 - DNA, 25 bp, Homo sapien
tccttagcgtcgactgctcggaagc

SEQ ID NO: 78209 - DNA, 25 bp, Homo sapien
agctgtctcggactcgggaacaaaa

SEQ ID NO: 78210 - DNA, 25 bp, Homo sapien
gccgaagtcagtattcagaacaaca

SEQ ID NO: 78211 - DNA, 25 bp, Homo sapien
acggccggcatgtacacgttgacca

SEQ ID NO: 78212 - DNA, 25 bp, Homo sapien
tggtggcgaactcgtgccacacttc

SEQ ID NO: 78213 - DNA, 25 bp, Homo sapien
aagatggcacctacgcggtgaccta

SEQ ID NO: 78214 - DNA, 25 bp, Homo sapien
ctctctgcaccgtcccagctccgct

SEQ ID NO: 78215 - DNA, 25 bp, Homo sapien
ttggacacgcgaaatacgtccgcga

SEQ ID NO: 78216 - DNA, 25 bp, Homo sapien
gggtcgccttggacacgcgaaatac

SEQ ID NO: 78217 - DNA, 25 bp, Homo sapien
cgcagtgaccgctaggggtcgcctt

SEQ ID NO: 78218 - DNA, 25 bp, Homo sapien
aaggcggccctttgggagcgcctct

SEQ ID NO: 78219 - DNA, 25 bp, Homo sapien
atacgtccgcgagcggagtccctgc

SEQ ID NO: 78220 - DNA, 25 bp, Homo sapien
ttgtcgtggccgcagtgaccgctag

SEQ ID NO: 78221 - DNA, 25 bp, Homo sapien
ggccctttgggagcgcctctctgca

SEQ ID NO: 78222 - DNA, 25 bp, Homo sapien
ttcctggagaaggactgcagctcgc

SEQ ID NO: 78223 - DNA, 25 bp, Homo sapien
aaccggcacgctgcgcctttaagga

SEQ ID NO: 78224 - DNA, 25 bp, Homo sapien
gcttttctgtcggaggacgcgaacc

SEQ ID NO: 78225 - DNA, 25 bp, Homo sapien
tgtgcgagacgctaactgtaccctc

SEQ ID NO: 78226 - DNA, 25 bp, Homo sapien
tttgagatgcccgaaacccggcgcc

SEQ ID NO: 78227 - DNA, 25 bp, Homo sapien
atagcatcttgctccgtgtcacgcg

SEQ ID NO: 78228 - DNA, 25 bp, Homo sapien
agtcggcgatctgcacttgcctttc
